United States Patent 7,374,927 (METHODS OF ANALYSIS OF DEGRADED NUCLEIC ACID SAMPLES) - sequence listing, part 10

SEQ ID NO: 360753 - DNA, 25 bp, Homo sapien
actcttcatgaaagcattacctttg

SEQ ID NO: 360754 - DNA, 25 bp, Homo sapien
ttttcctttcatcaccgtctttgaa

SEQ ID NO: 360755 - DNA, 25 bp, Homo sapien
tcatcaccgtctttgaaacaaatta

SEQ ID NO: 360756 - DNA, 25 bp, Homo sapien
ttctttggacattcattggaaggct

SEQ ID NO: 360757 - DNA, 25 bp, Homo sapien
ttggaaggcttgttgaagacatgat

SEQ ID NO: 360758 - DNA, 25 bp, Homo sapien
agaagccttagtgacccagatctca

SEQ ID NO: 360759 - DNA, 25 bp, Homo sapien
cttagtgacccagatctcaaccaga

SEQ ID NO: 360760 - DNA, 25 bp, Homo sapien
aaccagagactcaagatagcctcaa

SEQ ID NO: 360761 - DNA, 25 bp, Homo sapien
gatagcctcaaatacagtgaaagat

SEQ ID NO: 360762 - DNA, 25 bp, Homo sapien
aaggtgatggcttaacccagctctc

SEQ ID NO: 360763 - DNA, 25 bp, Homo sapien
agctctcaggaccacggtggctgct

SEQ ID NO: 360764 - DNA, 25 bp, Homo sapien
gctacactgtaggttatggtatcca

SEQ ID NO: 360765 - DNA, 25 bp, Homo sapien
ggtatccaaactgtagtacctgata

SEQ ID NO: 360766 - DNA, 25 bp, Homo sapien
gtacctgatagtactggccagggat

SEQ ID NO: 360767 - DNA, 25 bp, Homo sapien
cagggatggcgctgtgtcctattca

SEQ ID NO: 360768 - DNA, 25 bp, Homo sapien
tgtcctattcattctcctagggctg

SEQ ID NO: 360769 - DNA, 25 bp, Homo sapien
cctagggctgtttcagtaccgagaa

SEQ ID NO: 360770 - DNA, 25 bp, Homo sapien
tctcttggctgtctactgaactcat

SEQ ID NO: 360771 - DNA, 25 bp, Homo sapien
tctactgaactcatctgtgcttcgt

SEQ ID NO: 360772 - DNA, 25 bp, Homo sapien
gagggtctcccattcatgcattgca

SEQ ID NO: 360773 - DNA, 25 bp, Homo sapien
gtgctactgttgtcaaaattacctt

SEQ ID NO: 360774 - DNA, 25 bp, Homo sapien
ttatcttttccacacatgcgtggga

SEQ ID NO: 360775 - DNA, 25 bp, Homo sapien
ggaaaggtatgatttctgcatgtaa

SEQ ID NO: 360776 - DNA, 25 bp, Homo sapien
gcatgtaattgcagtttaaccctta

SEQ ID NO: 360777 - DNA, 25 bp, Homo sapien
tgcagtttaacccttatttctaggt

SEQ ID NO: 360778 - DNA, 25 bp, Homo sapien
atttctaggttgatcataggtccca

SEQ ID NO: 360779 - DNA, 25 bp, Homo sapien
tcataggtcccagtttacccaggaa

SEQ ID NO: 360780 - DNA, 25 bp, Homo sapien
ggaaaattccagtttatacctgttg

SEQ ID NO: 360781 - DNA, 25 bp, Homo sapien
gtttatacctgttgtacctgtgtaa

SEQ ID NO: 360782 - DNA, 25 bp, Homo sapien
aattattggtagcactccctttcac

SEQ ID NO: 360783 - DNA, 25 bp, Homo sapien
cctttcactcttacaatgtcttggt

SEQ ID NO: 360784 - DNA, 25 bp, Homo sapien
gggtagagaggatgactgtcttaaa

SEQ ID NO: 360785 - DNA, 25 bp, Homo sapien
tcatcgcagattgttttctaacctt

SEQ ID NO: 360786 - DNA, 25 bp, Homo sapien
atagatcgtgtattctgcctagagc

SEQ ID NO: 360787 - DNA, 25 bp, Homo sapien
gtgtattctgcctagagcaaagact

SEQ ID NO: 360788 - DNA, 25 bp, Homo sapien
agattgttttctaaccttcggtgca

SEQ ID NO: 360789 - DNA, 25 bp, Homo sapien
tattctacttgtaaacttaccgtat

SEQ ID NO: 360790 - DNA, 25 bp, Homo sapien
acttaccgtataatcagtgtcttga

SEQ ID NO: 360791 - DNA, 25 bp, Homo sapien
atagtagtttttgttggttgaatct

SEQ ID NO: 360792 - DNA, 25 bp, Homo sapien
gaatgtgttggacttgggtaaattt

SEQ ID NO: 360793 - DNA, 25 bp, Homo sapien
ctaaccttcggtgcatgtattgaaa

SEQ ID NO: 360794 - DNA, 25 bp, Homo sapien
tacatttttctggatctggtgtgca

SEQ ID NO: 360795 - DNA, 25 bp, Homo sapien
aatttcacaaagtagacctaggcaa

SEQ ID NO: 360796 - DNA, 25 bp, Homo sapien
gttttctgcctggtaaataaatatt

SEQ ID NO: 360797 - DNA, 25 bp, Homo sapien
taaataaatattccagcaacccaca

SEQ ID NO: 360798 - DNA, 25 bp, Homo sapien
acagactcagacacttagtccaata

SEQ ID NO: 360799 - DNA, 25 bp, Homo sapien
gacacttagtccaatagaactccaa

SEQ ID NO: 360800 - DNA, 25 bp, Homo sapien
aaagtagacctaggcaatttcaaat

SEQ ID NO: 360801 - DNA, 25 bp, Homo sapien
tagtccaatagaactccaaagaggt

SEQ ID NO: 360802 - DNA, 25 bp, Homo sapien
aaagtacttccagtctatatattgt

SEQ ID NO: 360803 - DNA, 25 bp, Homo sapien
gcaatttcaaattggctgctatact

SEQ ID NO: 360804 - DNA, 25 bp, Homo sapien
aattggctgctatacttttcaaggt

SEQ ID NO: 360805 - DNA, 25 bp, Homo sapien
tggctgctatacttttcaaggtaaa

SEQ ID NO: 360806 - DNA, 25 bp, Homo sapien
gtcgaatacttcatgttctcactca

SEQ ID NO: 360807 - DNA, 25 bp, Homo sapien
ctcactcataaatgggagctacata

SEQ ID NO: 360808 - DNA, 25 bp, Homo sapien
aatgggagctacataaagtgtaccc

SEQ ID NO: 360809 - DNA, 25 bp, Homo sapien
aagtgtacccatgaacatagagtgt

SEQ ID NO: 360810 - DNA, 25 bp, Homo sapien
catagagtgtggaacaaacattgga

SEQ ID NO: 360811 - DNA, 25 bp, Homo sapien
ggtacagtgtacacttttctggtgt

SEQ ID NO: 360812 - DNA, 25 bp, Homo sapien
cacttttctggtgttggttgcagga

SEQ ID NO: 360813 - DNA, 25 bp, Homo sapien
aggaaaagcctggacttcaccactt

SEQ ID NO: 360814 - DNA, 25 bp, Homo sapien
gcctggacttcaccacttcgcaata

SEQ ID NO: 360815 - DNA, 25 bp, Homo sapien
aatgaaaccatgtctttgcagcaac

SEQ ID NO: 360816 - DNA, 25 bp, Homo sapien
gaaaccatgtctttgcagcaacctg

SEQ ID NO: 360817 - DNA, 25 bp, Homo sapien
cagcaggacgcttattttcaagcct

SEQ ID NO: 360818 - DNA, 25 bp, Homo sapien
gaacgtagttcctcccgctttcaca

SEQ ID NO: 360819 - DNA, 25 bp, Homo sapien
gctcctccgggagggagaacgacac

SEQ ID NO: 360820 - DNA, 25 bp, Homo sapien
ggagaacgacacactcttcgaggaa

SEQ ID NO: 360821 - DNA, 25 bp, Homo sapien
gacacactcttcgaggaaatcctgg

SEQ ID NO: 360822 - DNA, 25 bp, Homo sapien
tcgctgccgggacctttgtttctaa

SEQ ID NO: 360823 - DNA, 25 bp, Homo sapien
gggacctttgtttctaagctggcca

SEQ ID NO: 360824 - DNA, 25 bp, Homo sapien
tgtttctaagctggccacagctaga

SEQ ID NO: 360825 - DNA, 25 bp, Homo sapien
gctagagcagccttaagtgtcccaa

SEQ ID NO: 360826 - DNA, 25 bp, Homo sapien
ttaagtgtcccaatgacacgcctgc

SEQ ID NO: 360827 - DNA, 25 bp, Homo sapien
caatgacacgcctgctatcgagcgc

SEQ ID NO: 360828 - DNA, 25 bp, Homo sapien
ttcacttgctctttctaaaactgga

SEQ ID NO: 360829 - DNA, 25 bp, Homo sapien
ttgtctaaactctacagcagggtct

SEQ ID NO: 360830 - DNA, 25 bp, Homo sapien
cagcagggtctgatatatgtagatt

SEQ ID NO: 360831 - DNA, 25 bp, Homo sapien
gattatgtcatttggtggacttcta

SEQ ID NO: 360832 - DNA, 25 bp, Homo sapien
ggtggacttctataagagcatacac

SEQ ID NO: 360833 - DNA, 25 bp, Homo sapien
gagcatacacaatgaggcatggaca

SEQ ID NO: 360834 - DNA, 25 bp, Homo sapien
gaggcatggacacaaacatttattt

SEQ ID NO: 360835 - DNA, 25 bp, Homo sapien
actaattaccttagccttggcgagc

SEQ ID NO: 360836 - DNA, 25 bp, Homo sapien
tactggtagttcagaaccaaccctc

SEQ ID NO: 360837 - DNA, 25 bp, Homo sapien
caaccctcctcctataatgaaaaca

SEQ ID NO: 360838 - DNA, 25 bp, Homo sapien
aattctgcttctttgtaaactttct

SEQ ID NO: 360839 - DNA, 25 bp, Homo sapien
acatgtgtacctatataatattctt

SEQ ID NO: 360840 - DNA, 25 bp, Homo sapien
aatggacttcctacatagctcatat

SEQ ID NO: 360841 - DNA, 25 bp, Homo sapien
agctcatattgacgttagatttaaa

SEQ ID NO: 360842 - DNA, 25 bp, Homo sapien
gaaattccagaagggttttctatag

SEQ ID NO: 360843 - DNA, 25 bp, Homo sapien
gggttttctataggtaagtcataca

SEQ ID NO: 360844 - DNA, 25 bp, Homo sapien
gtaagtcatacattggatttccata

SEQ ID NO: 360845 - DNA, 25 bp, Homo sapien
ggatttccatattacctatgattat

SEQ ID NO: 360846 - DNA, 25 bp, Homo sapien
gagcaattttgctggtcatttgttt

SEQ ID NO: 360847 - DNA, 25 bp, Homo sapien
attttgctggtcatttgttttctgt

SEQ ID NO: 360848 - DNA, 25 bp, Homo sapien
gttctttgaggcattgtcctattac

SEQ ID NO: 360849 - DNA, 25 bp, Homo sapien
ttgaggcattgtcctattacatttt

SEQ ID NO: 360850 - DNA, 25 bp, Homo sapien
ggcagagctagacccctgctttcac

SEQ ID NO: 360851 - DNA, 25 bp, Homo sapien
cccctgctttcactcttagatgaga

SEQ ID NO: 360852 - DNA, 25 bp, Homo sapien
taggtgaaatccctgagctccagtg

SEQ ID NO: 360853 - DNA, 25 bp, Homo sapien
atccctgagctccagtgcttggaaa

SEQ ID NO: 360854 - DNA, 25 bp, Homo sapien
gcttggaaagcagttcaacagccta

SEQ ID NO: 360855 - DNA, 25 bp, Homo sapien
agcagttcaacagcctaacagacat

SEQ ID NO: 360856 - DNA, 25 bp, Homo sapien
ggattttaaacaggtgactccacac

SEQ ID NO: 360857 - DNA, 25 bp, Homo sapien
gactccacacttcatgaatcacaag

SEQ ID NO: 360858 - DNA, 25 bp, Homo sapien
gtgaatgagatgtacttttctttct

SEQ ID NO: 360859 - DNA, 25 bp, Homo sapien
aaagtcatttgctcttgctacctgt

SEQ ID NO: 360860 - DNA, 25 bp, Homo sapien
tttgctcttgctacctgtcctagaa

SEQ ID NO: 360861 - DNA, 25 bp, Homo sapien
tgcacatagacacttaatgaaagga

SEQ ID NO: 360862 - DNA, 25 bp, Homo sapien
gcagcagcttttccaccccaggaat

SEQ ID NO: 360863 - DNA, 25 bp, Homo sapien
taatgaaaggagacactcagtgtca

SEQ ID NO: 360864 - DNA, 25 bp, Homo sapien
tgctctcaggaccagagaagggaaa

SEQ ID NO: 360865 - DNA, 25 bp, Homo sapien
tcagtgtcacaagtgagcccttatg

SEQ ID NO: 360866 - DNA, 25 bp, Homo sapien
gtgtcacaagtgagcccttatgccc

SEQ ID NO: 360867 - DNA, 25 bp, Homo sapien
ttatgccccgcacacacatatggct

SEQ ID NO: 360868 - DNA, 25 bp, Homo sapien
cgcacacacatatggctgactgggc

SEQ ID NO: 360869 - DNA, 25 bp, Homo sapien
acacacatatggctgactgggcaag

SEQ ID NO: 360870 - DNA, 25 bp, Homo sapien
atatggctgactgggcaaggcgctc

SEQ ID NO: 360871 - DNA, 25 bp, Homo sapien
ctgactgggcaaggcgctcaggcat

SEQ ID NO: 360872 - DNA, 25 bp, Homo sapien
agaaatgatctgtgccattgtttac

SEQ ID NO: 360873 - DNA, 25 bp, Homo sapien
ttgtttaccctcctgagagacacca

SEQ ID NO: 360874 - DNA, 25 bp, Homo sapien
tgagagacaccaagaccctgccatg

SEQ ID NO: 360875 - DNA, 25 bp, Homo sapien
tgccatggctgaaccctggaaacag

SEQ ID NO: 360876 - DNA, 25 bp, Homo sapien
ctccaactctctactgtggctgtgg

SEQ ID NO: 360877 - DNA, 25 bp, Homo sapien
gtgggcccggatatcccaggagaca

SEQ ID NO: 360878 - DNA, 25 bp, Homo sapien
cctacatcaatcctggcaggcagca

SEQ ID NO: 360879 - DNA, 25 bp, Homo sapien
aggcagcagcacagctgcggcacca

SEQ ID NO: 360880 - DNA, 25 bp, Homo sapien
agaagctgttaacgacctttgccct

SEQ ID NO: 360881 - DNA, 25 bp, Homo sapien
aaggacttctgattgtggcccagac

SEQ ID NO: 360882 - DNA, 25 bp, Homo sapien
tggcccagacccttgacagaaatga

SEQ ID NO: 360883 - DNA, 25 bp, Homo sapien
aaactatttcttccctagtgtgcaa

SEQ ID NO: 360884 - DNA, 25 bp, Homo sapien
ttcttccctagtgtgcaagtccctt

SEQ ID NO: 360885 - DNA, 25 bp, Homo sapien
ttccccaattcctcattagctgagt

SEQ ID NO: 360886 - DNA, 25 bp, Homo sapien
gtatgttctttagggtctttttgct

SEQ ID NO: 360887 - DNA, 25 bp, Homo sapien
tttgttgcagccacccataatacat

SEQ ID NO: 360888 - DNA, 25 bp, Homo sapien
atacatggcgactgtctcaagactc

SEQ ID NO: 360889 - DNA, 25 bp, Homo sapien
gtctcaagactctgagcatttgact

SEQ ID NO: 360890 - DNA, 25 bp, Homo sapien
gagcatttgacttatggccctagtg

SEQ ID NO: 360891 - DNA, 25 bp, Homo sapien
atggccctagtgactgcacttaggt

SEQ ID NO: 360892 - DNA, 25 bp, Homo sapien
gcacttaggtgatggcaagctagcc

SEQ ID NO: 360893 - DNA, 25 bp, Homo sapien
ggcaagctagcccaaactaaattct

SEQ ID NO: 360894 - DNA, 25 bp, Homo sapien
ggacattccaggcaggcacttggtc

SEQ ID NO: 360895 - DNA, 25 bp, Homo sapien
gggccagccccaggaaataggaagt

SEQ ID NO: 360896 - DNA, 25 bp, Homo sapien
ccaggcaggcacttggtctagaggt

SEQ ID NO: 360897 - DNA, 25 bp, Homo sapien
taggaagtttccaggccgtggacct

SEQ ID NO: 360898 - DNA, 25 bp, Homo sapien
agtttccaggccgtggacctcctgt

SEQ ID NO: 360899 - DNA, 25 bp, Homo sapien
gggccatggaagagctcctctttgt

SEQ ID NO: 360900 - DNA, 25 bp, Homo sapien
gaagagctcctctttgttgcaggga

SEQ ID NO: 360901 - DNA, 25 bp, Homo sapien
ggtgggctgatcatttctaaatggc

SEQ ID NO: 360902 - DNA, 25 bp, Homo sapien
aatggcagaaccctgacaaacgtga

SEQ ID NO: 360903 - DNA, 25 bp, Homo sapien
gaaccctgacaaacgtgagactgag

SEQ ID NO: 360904 - DNA, 25 bp, Homo sapien
acaaacgtgagactgagagtccaca

SEQ ID NO: 360905 - DNA, 25 bp, Homo sapien
aaaaggagcaagaaccagtacaatc

SEQ ID NO: 360906 - DNA, 25 bp, Homo sapien
gaaccagtacaatctttctattctt

SEQ ID NO: 360907 - DNA, 25 bp, Homo sapien
gtacaatctttctattctttggcag

SEQ ID NO: 360908 - DNA, 25 bp, Homo sapien
aatctttctattctttggcagtata

SEQ ID NO: 360909 - DNA, 25 bp, Homo sapien
tttctattctttggcagtatatacc

SEQ ID NO: 360910 - DNA, 25 bp, Homo sapien
aatggtgagattcttaaggccaggc

SEQ ID NO: 360911 - DNA, 25 bp, Homo sapien
tgagattcttaaggccaggcggagt

SEQ ID NO: 360912 - DNA, 25 bp, Homo sapien
aggcggagtggctcacaacactttg

SEQ ID NO: 360913 - DNA, 25 bp, Homo sapien
aattattatgcatctcttaaaaggg

SEQ ID NO: 360914 - DNA, 25 bp, Homo sapien
gcatctcttaaaagggttacatagt

SEQ ID NO: 360915 - DNA, 25 bp, Homo sapien
gttacatagtatgacaaacatgcga

SEQ ID NO: 360916 - DNA, 25 bp, Homo sapien
aagattagtacacttgagaaagccc

SEQ ID NO: 360917 - DNA, 25 bp, Homo sapien
gagaaagccctggtacactagtcag

SEQ ID NO: 360918 - DNA, 25 bp, Homo sapien
agccctggtacactagtcagagaaa

SEQ ID NO: 360919 - DNA, 25 bp, Homo sapien
aaagagagcagggacaaattacaat

SEQ ID NO: 360920 - DNA, 25 bp, Homo sapien
atgtcagaatctacgaacccttcag

SEQ ID NO: 360921 - DNA, 25 bp, Homo sapien
cgaacccttcagacataaaaacttg

SEQ ID NO: 360922 - DNA, 25 bp, Homo sapien
gaggctgtctcaaaagtcagtggga

SEQ ID NO: 360923 - DNA, 25 bp, Homo sapien
gtcagtgggaaacgttaaatgcaat

SEQ ID NO: 360924 - DNA, 25 bp, Homo sapien
tagaacatgttactagctcctgtct

SEQ ID NO: 360925 - DNA, 25 bp, Homo sapien
atgaggcacaaaacgtagagtagat

SEQ ID NO: 360926 - DNA, 25 bp, Homo sapien
gagtagatacaaccaacaaaaccaa

SEQ ID NO: 360927 - DNA, 25 bp, Homo sapien
gaggcacattatggcttactttgaa

SEQ ID NO: 360928 - DNA, 25 bp, Homo sapien
ggcttactttgaatgacaggctgga

SEQ ID NO: 360929 - DNA, 25 bp, Homo sapien
gacaggctggaagttaaggcatgaa

SEQ ID NO: 360930 - DNA, 25 bp, Homo sapien
atgaaagcaggccttggtctggccc

SEQ ID NO: 360931 - DNA, 25 bp, Homo sapien
tctggcccctttcattatctcattt

SEQ ID NO: 360932 - DNA, 25 bp, Homo sapien
acactccatgaagtacctgctctaa

SEQ ID NO: 360933 - DNA, 25 bp, Homo sapien
gtacctgctctaatgcccattttat

SEQ ID NO: 360934 - DNA, 25 bp, Homo sapien
aatgtctaaggttacacatctgaac

SEQ ID NO: 360935 - DNA, 25 bp, Homo sapien
gctttgtgatgtgacttgactctgt

SEQ ID NO: 360936 - DNA, 25 bp, Homo sapien
tgactctgtagagcacatcaagatg

SEQ ID NO: 360937 - DNA, 25 bp, Homo sapien
gatgagcaccataggagcaagctta

SEQ ID NO: 360938 - DNA, 25 bp, Homo sapien
gtcagtgctaatattctgttcctag

SEQ ID NO: 360939 - DNA, 25 bp, Homo sapien
gggacatgccaagtctctttactgc

SEQ ID NO: 360940 - DNA, 25 bp, Homo sapien
aagtctctttactgcaaccagtggt

SEQ ID NO: 360941 - DNA, 25 bp, Homo sapien
gcaaccagtggttcacatatggaaa

SEQ ID NO: 360942 - DNA, 25 bp, Homo sapien
ttgtgctaatttccaactcctactt

SEQ ID NO: 360943 - DNA, 25 bp, Homo sapien
tttccaactcctacttatatatatg

SEQ ID NO: 360944 - DNA, 25 bp, Homo sapien
tatgatttgttaactctggaggatg

SEQ ID NO: 360945 - DNA, 25 bp, Homo sapien
gaggatgcagccatcagcataagca

SEQ ID NO: 360946 - DNA, 25 bp, Homo sapien
gccatcagcataagcaaccaacaga

SEQ ID NO: 360947 - DNA, 25 bp, Homo sapien
agaagaacacgctggatcctctcct

SEQ ID NO: 360948 - DNA, 25 bp, Homo sapien
tttcctgacagtgtgtagtcttcat

SEQ ID NO: 360949 - DNA, 25 bp, Homo sapien
atacaacagtaaccacgacccaaat

SEQ ID NO: 360950 - DNA, 25 bp, Homo sapien
taaccacgacccaaatctagggtag

SEQ ID NO: 360951 - DNA, 25 bp, Homo sapien
aggagagctgctaatttctacccca

SEQ ID NO: 360952 - DNA, 25 bp, Homo sapien
tgctaatttctaccccaatgctcga

SEQ ID NO: 360953 - DNA, 25 bp, Homo sapien
accccaatgctcgaaatcttgtcag

SEQ ID NO: 360954 - DNA, 25 bp, Homo sapien
tcgaaatcttgtcaggttttgtgtc

SEQ ID NO: 360955 - DNA, 25 bp, Homo sapien
caggttttgtgtcagggtagaacac

SEQ ID NO: 360956 - DNA, 25 bp, Homo sapien
gaacacatttatgctacaactaggt

SEQ ID NO: 360957 - DNA, 25 bp, Homo sapien
ttatgctacaactaggttatcagag

SEQ ID NO: 360958 - DNA, 25 bp, Homo sapien
ggttatcagagcaatacacacacaa

SEQ ID NO: 360959 - DNA, 25 bp, Homo sapien
cataatggtgggttgatttggacta

SEQ ID NO: 360960 - DNA, 25 bp, Homo sapien
gactgaatctattcgttccaacctc

SEQ ID NO: 360961 - DNA, 25 bp, Homo sapien
tattcgttccaacctccctaagcaa

SEQ ID NO: 360962 - DNA, 25 bp, Homo sapien
aacctccctaagcaatccacttatt

SEQ ID NO: 360963 - DNA, 25 bp, Homo sapien
aatccacttattgatcagtgctcca

SEQ ID NO: 360964 - DNA, 25 bp, Homo sapien
attgatcagtgctccaactcaagga

SEQ ID NO: 360965 - DNA, 25 bp, Homo sapien
cagtgctccaactcaaggaatattt

SEQ ID NO: 360966 - DNA, 25 bp, Homo sapien
ctatcaatcagagaatcttgaaggt

SEQ ID NO: 360967 - DNA, 25 bp, Homo sapien
gggatcatttacaatcattttacag

SEQ ID NO: 360968 - DNA, 25 bp, Homo sapien
tattgagaccagcagggagatgacc

SEQ ID NO: 360969 - DNA, 25 bp, Homo sapien
agggagatgacctgcccaagcctgc

SEQ ID NO: 360970 - DNA, 25 bp, Homo sapien
ggaagttgggactgaatctattcgt

SEQ ID NO: 360971 - DNA, 25 bp, Homo sapien
ctaaagctcaagttcactacctctt

SEQ ID NO: 360972 - DNA, 25 bp, Homo sapien
aaagctcaagttcactacctctttc

SEQ ID NO: 360973 - DNA, 25 bp, Homo sapien
aagttcactacctctttcctcagaa

SEQ ID NO: 360974 - DNA, 25 bp, Homo sapien
gaaggaatccctaattcttttatat

SEQ ID NO: 360975 - DNA, 25 bp, Homo sapien
gaatccctaattcttttatatgcta

SEQ ID NO: 360976 - DNA, 25 bp, Homo sapien
tttatatgctatagatgtgtacatc

SEQ ID NO: 360977 - DNA, 25 bp, Homo sapien
gatgtgtacatcttctatatatatt

SEQ ID NO: 360978 - DNA, 25 bp, Homo sapien
gagttttagtttatattcccatagt

SEQ ID NO: 360979 - DNA, 25 bp, Homo sapien
tattcccatagtaatcaaacatgtt

SEQ ID NO: 360980 - DNA, 25 bp, Homo sapien
aaatgtttttccaggcatatttgaa

SEQ ID NO: 360981 - DNA, 25 bp, Homo sapien
gtttttccaggcatatttgaagatt

SEQ ID NO: 360982 - DNA, 25 bp, Homo sapien
tttctaaatcctttctctttggcct

SEQ ID NO: 360983 - DNA, 25 bp, Homo sapien
ttggcctcttttctgtcgggaatta

SEQ ID NO: 360984 - DNA, 25 bp, Homo sapien
aattatgttccccagttgtgacact

SEQ ID NO: 360985 - DNA, 25 bp, Homo sapien
gttgtgacacttacttggtttagga

SEQ ID NO: 360986 - DNA, 25 bp, Homo sapien
ttaggattacggtgctctccgattt

SEQ ID NO: 360987 - DNA, 25 bp, Homo sapien
ctccgatttggcctgaaactttaat

SEQ ID NO: 360988 - DNA, 25 bp, Homo sapien
gtctctcggagagatttcacacatt

SEQ ID NO: 360989 - DNA, 25 bp, Homo sapien
tagtgtttgacagtagtgccggagt

SEQ ID NO: 360990 - DNA, 25 bp, Homo sapien
tagtgccggagtctgagcagtttac

SEQ ID NO: 360991 - DNA, 25 bp, Homo sapien
agcagtttacgttggcttcgtggtt

SEQ ID NO: 360992 - DNA, 25 bp, Homo sapien
tggtttccgaatcacgatgtttcta

SEQ ID NO: 360993 - DNA, 25 bp, Homo sapien
aaactgtacgtgaaaattagctgct

SEQ ID NO: 360994 - DNA, 25 bp, Homo sapien
gaatatgtaacatggactcccacat

SEQ ID NO: 360995 - DNA, 25 bp, Homo sapien
tggactcccacattttaaggatttt

SEQ ID NO: 360996 - DNA, 25 bp, Homo sapien
tttttctaggactgcatctttctct

SEQ ID NO: 360997 - DNA, 25 bp, Homo sapien
ctttctcttaataagtcagatcctt

SEQ ID NO: 360998 - DNA, 25 bp, Homo sapien
ggttgaaaatgtttactgcatgact

SEQ ID NO: 360999 - DNA, 25 bp, Homo sapien
tactgcatgactatcactgactatg

SEQ ID NO: 361000 - DNA, 25 bp, Homo sapien
cactgactatgtaagatgctgatgt

SEQ ID NO: 361001 - DNA, 25 bp, Homo sapien
gctgatgtacaactctatgacttga

SEQ ID NO: 361002 - DNA, 25 bp, Homo sapien
aagattgagttgcttctatgggaat

SEQ ID NO: 361003 - DNA, 25 bp, Homo sapien
tgggaatatgacaccatttgaatta

SEQ ID NO: 361004 - DNA, 25 bp, Homo sapien
ctaagtttagtttcctgatattcaa

SEQ ID NO: 361005 - DNA, 25 bp, Homo sapien
tgtttcccagagttttcccattcac

SEQ ID NO: 361006 - DNA, 25 bp, Homo sapien
tacctctcaagactgctgcacgaat

SEQ ID NO: 361007 - DNA, 25 bp, Homo sapien
actgctgcacgaattggttgactca

SEQ ID NO: 361008 - DNA, 25 bp, Homo sapien
ggttgactcagttcttaagccatgg

SEQ ID NO: 361009 - DNA, 25 bp, Homo sapien
gccatggaacttgctctactgtgag

SEQ ID NO: 361010 - DNA, 25 bp, Homo sapien
ctctactgtgagagcactgtggaaa

SEQ ID NO: 361011 - DNA, 25 bp, Homo sapien
actgaccctgagtagtaggattgga

SEQ ID NO: 361012 - DNA, 25 bp, Homo sapien
tcccattcactaggtcatttaattc

SEQ ID NO: 361013 - DNA, 25 bp, Homo sapien
gtcagcaacagggaactcatagtgg

SEQ ID NO: 361014 - DNA, 25 bp, Homo sapien
gtgagtacttgtatcacgacatact

SEQ ID NO: 361015 - DNA, 25 bp, Homo sapien
ttgatactactacttaggctttttt

SEQ ID NO: 361016 - DNA, 25 bp, Homo sapien
ttttttgtccttacttgctatattg

SEQ ID NO: 361017 - DNA, 25 bp, Homo sapien
acttgctatattgacgcacgtcttg

SEQ ID NO: 361018 - DNA, 25 bp, Homo sapien
ttgacgcacgtcttgatgatataaa

SEQ ID NO: 361019 - DNA, 25 bp, Homo sapien
gaaaaccagtagcacctaatcatta

SEQ ID NO: 361020 - DNA, 25 bp, Homo sapien
gtctattatattgttccaccctttt

SEQ ID NO: 361021 - DNA, 25 bp, Homo sapien
ggcaaactgtactagtaatcattgt

SEQ ID NO: 361022 - DNA, 25 bp, Homo sapien
atcattgtacagttttccattgaac

SEQ ID NO: 361023 - DNA, 25 bp, Homo sapien
tcatacttaaccctttttagagcag

SEQ ID NO: 361024 - DNA, 25 bp, Homo sapien
aatatggtcaacagacccctgtgga

SEQ ID NO: 361025 - DNA, 25 bp, Homo sapien
aacagacccctgtggatcaccaaga

SEQ ID NO: 361026 - DNA, 25 bp, Homo sapien
gaagtttcagtggtcaacatatcta

SEQ ID NO: 361027 - DNA, 25 bp, Homo sapien
atatctatgactctttaggctgctg

SEQ ID NO: 361028 - DNA, 25 bp, Homo sapien
taggctgctgtagttttacagtcaa

SEQ ID NO: 361029 - DNA, 25 bp, Homo sapien
gagtagttacatttataagagcctg

SEQ ID NO: 361030 - DNA, 25 bp, Homo sapien
taagagcctgagaatacttagactc

SEQ ID NO: 361031 - DNA, 25 bp, Homo sapien
cttagactcagtcatttgttagtat

SEQ ID NO: 361032 - DNA, 25 bp, Homo sapien
aatctcttagtttcagacatgtcag

SEQ ID NO: 361033 - DNA, 25 bp, Homo sapien
tcagacatgtcagaagcagctatat

SEQ ID NO: 361034 - DNA, 25 bp, Homo sapien
gcagctatatagcatatcttattct

SEQ ID NO: 361035 - DNA, 25 bp, Homo sapien
tgatatacatcaggctatctcaagt

SEQ ID NO: 361036 - DNA, 25 bp, Homo sapien
aatgtcatgtttattcaggctggga

SEQ ID NO: 361037 - DNA, 25 bp, Homo sapien
actgagcaaaggcagcttggcgtat

SEQ ID NO: 361038 - DNA, 25 bp, Homo sapien
agcttggcgtatactgagggtgtac

SEQ ID NO: 361039 - DNA, 25 bp, Homo sapien
gagggtgtacagtccaggacccaca

SEQ ID NO: 361040 - DNA, 25 bp, Homo sapien
agtccaggacccacagcattgatct

SEQ ID NO: 361041 - DNA, 25 bp, Homo sapien
gcattgatctcacctgggaacttat

SEQ ID NO: 361042 - DNA, 25 bp, Homo sapien
ccctaggcccactgaattagaaagt

SEQ ID NO: 361043 - DNA, 25 bp, Homo sapien
attagaaagtctgggagaaaggcct

SEQ ID NO: 361044 - DNA, 25 bp, Homo sapien
ttgggttttaacaaacgctgcaggt

SEQ ID NO: 361045 - DNA, 25 bp, Homo sapien
tttaacaaacgctgcaggtgattct

SEQ ID NO: 361046 - DNA, 25 bp, Homo sapien
ttctgatgcacgctggagaaccact

SEQ ID NO: 361047 - DNA, 25 bp, Homo sapien
catcacagggaattttactgagcaa

SEQ ID NO: 361048 - DNA, 25 bp, Homo sapien
aggaatggcttcactattgtctcaa

SEQ ID NO: 361049 - DNA, 25 bp, Homo sapien
atggcttcactattgtctcaaaaag

SEQ ID NO: 361050 - DNA, 25 bp, Homo sapien
ttctccttttcattaaggctgttac

SEQ ID NO: 361051 - DNA, 25 bp, Homo sapien
gcagaatgataaagcaagtttcctt

SEQ ID NO: 361052 - DNA, 25 bp, Homo sapien
gcaagtttccttgacagaaccatca

SEQ ID NO: 361053 - DNA, 25 bp, Homo sapien
gacagaaccatcacaaaattatata

SEQ ID NO: 361054 - DNA, 25 bp, Homo sapien
atatacagtatttcactggttccct

SEQ ID NO: 361055 - DNA, 25 bp, Homo sapien
agctgtggaggaatcagccagagta

SEQ ID NO: 361056 - DNA, 25 bp, Homo sapien
ggctgttacatatatacaatccaca

SEQ ID NO: 361057 - DNA, 25 bp, Homo sapien
atccacaggtagaaaccactcttag

SEQ ID NO: 361058 - DNA, 25 bp, Homo sapien
gggcctccataagcaggcagtagta

SEQ ID NO: 361059 - DNA, 25 bp, Homo sapien
tatcaaatgcagttccttgggacca

SEQ ID NO: 361060 - DNA, 25 bp, Homo sapien
aatgcagttccttgggaccagcccg

SEQ ID NO: 361061 - DNA, 25 bp, Homo sapien
aagtgacttccatcggtgtggtttc

SEQ ID NO: 361062 - DNA, 25 bp, Homo sapien
tttgcttctctcagaacccctgtga

SEQ ID NO: 361063 - DNA, 25 bp, Homo sapien
tcagaacccctgtgagtagatggat

SEQ ID NO: 361064 - DNA, 25 bp, Homo sapien
gtagatggataatcaacctcctttt

SEQ ID NO: 361065 - DNA, 25 bp, Homo sapien
caacctccttttaccatagatgaaa

SEQ ID NO: 361066 - DNA, 25 bp, Homo sapien
ttccatcggtgtggtttctccaggg

SEQ ID NO: 361067 - DNA, 25 bp, Homo sapien
gggacatgcccgagatgatttaatt

SEQ ID NO: 361068 - DNA, 25 bp, Homo sapien
gacaggcatatcttcaactgctgca

SEQ ID NO: 361069 - DNA, 25 bp, Homo sapien
cccagggacaccagcttgagaatca

SEQ ID NO: 361070 - DNA, 25 bp, Homo sapien
ctgagaacttcctgctcttaggcaa

SEQ ID NO: 361071 - DNA, 25 bp, Homo sapien
gctcttaggcaacgtgatattgatt

SEQ ID NO: 361072 - DNA, 25 bp, Homo sapien
atattgattgttttggcaacccact

SEQ ID NO: 361073 - DNA, 25 bp, Homo sapien
gcaacccacttcagcgaggatttta

SEQ ID NO: 361074 - DNA, 25 bp, Homo sapien
ggattttaccctacagatacaggct

SEQ ID NO: 361075 - DNA, 25 bp, Homo sapien
gatacaggcttcttggcagtaacta

SEQ ID NO: 361076 - DNA, 25 bp, Homo sapien
atgctgtggttaatgctgtagccca

SEQ ID NO: 361077 - DNA, 25 bp, Homo sapien
atgtttgtacctatggtccactatg

SEQ ID NO: 361078 - DNA, 25 bp, Homo sapien
gtccactatgtttgtacctatgtcc

SEQ ID NO: 361079 - DNA, 25 bp, Homo sapien
ttgtacctatgtcccaaaatctcat

SEQ ID NO: 361080 - DNA, 25 bp, Homo sapien
tgcctgctgattcagttcctgcatg

SEQ ID NO: 361081 - DNA, 25 bp, Homo sapien
accaggacaatggtttcctttcaag

SEQ ID NO: 361082 - DNA, 25 bp, Homo sapien
ggacaatggtttcctttcaaggttg

SEQ ID NO: 361083 - DNA, 25 bp, Homo sapien
ttcctttcaaggttgggatagggca

SEQ ID NO: 361084 - DNA, 25 bp, Homo sapien
ggatagggcaaaggcaacattgatt

SEQ ID NO: 361085 - DNA, 25 bp, Homo sapien
gaataaatctccaaggcatgatgct

SEQ ID NO: 361086 - DNA, 25 bp, Homo sapien
gagtgatacaatattctacatttta

SEQ ID NO: 361087 - DNA, 25 bp, Homo sapien
aaatctccaaggcatgatgctgggt

SEQ ID NO: 361088 - DNA, 25 bp, Homo sapien
gtgtgacacaggtgcgtacatttgt

SEQ ID NO: 361089 - DNA, 25 bp, Homo sapien
aagatttatgcatttgactgtataa

SEQ ID NO: 361090 - DNA, 25 bp, Homo sapien
gcatgatgctgggtgaaagaaacca

SEQ ID NO: 361091 - DNA, 25 bp, Homo sapien
tatgaagttctaaaccaggacaatg

SEQ ID NO: 361092 - DNA, 25 bp, Homo sapien
ccacatttccctcacagaaagacaa

SEQ ID NO: 361093 - DNA, 25 bp, Homo sapien
cctgagaaacctagtgagacatcct

SEQ ID NO: 361094 - DNA, 25 bp, Homo sapien
ctgagaaacctagtgagacatcctt

SEQ ID NO: 361095 - DNA, 25 bp, Homo sapien
tgagaaacctagtgagacatccttc

SEQ ID NO: 361096 - DNA, 25 bp, Homo sapien
gagaaacctagtgagacatccttct

SEQ ID NO: 361097 - DNA, 25 bp, Homo sapien
gaaacctagtgagacatccttctct

SEQ ID NO: 361098 - DNA, 25 bp, Homo sapien
aaacctagtgagacatccttctctt

SEQ ID NO: 361099 - DNA, 25 bp, Homo sapien
aacctagtgagacatccttctctta

SEQ ID NO: 361100 - DNA, 25 bp, Homo sapien
acctagtgagacatccttctcttaa

SEQ ID NO: 361101 - DNA, 25 bp, Homo sapien
gtgagacatccttctcttaaacaaa

SEQ ID NO: 361102 - DNA, 25 bp, Homo sapien
aaaacaaatgtagccatgcgtggtg

SEQ ID NO: 361103 - DNA, 25 bp, Homo sapien
agaagatccttctgctactgactga

SEQ ID NO: 361104 - DNA, 25 bp, Homo sapien
tctgctactgactgaactcgttgtg

SEQ ID NO: 361105 - DNA, 25 bp, Homo sapien
gaactcgttgtgaggtactcagtgt

SEQ ID NO: 361106 - DNA, 25 bp, Homo sapien
agaagctgccaccagagactaaagg

SEQ ID NO: 361107 - DNA, 25 bp, Homo sapien
aaggctgctatggaggaactacaga

SEQ ID NO: 361108 - DNA, 25 bp, Homo sapien
gaactcctttgccaggaaagaacat

SEQ ID NO: 361109 - DNA, 25 bp, Homo sapien
gaacatcaacttggctgtcctgttt

SEQ ID NO: 361110 - DNA, 25 bp, Homo sapien
gttttgaggacgataccccacatga

SEQ ID NO: 361111 - DNA, 25 bp, Homo sapien
ggtataaagattcctgccctacgtg

SEQ ID NO: 361112 - DNA, 25 bp, Homo sapien
ttccctcatgacctggcctgatgtg

SEQ ID NO: 361113 - DNA, 25 bp, Homo sapien
ctggcctgatgtggagtagctcctg

SEQ ID NO: 361114 - DNA, 25 bp, Homo sapien
gagattttctgattcccacattctg

SEQ ID NO: 361115 - DNA, 25 bp, Homo sapien
attcccacattctgcaacaataaaa

SEQ ID NO: 361116 - DNA, 25 bp, Homo sapien
gactaaccaggatacatttacaata

SEQ ID NO: 361117 - DNA, 25 bp, Homo sapien
acatgactaagtgacaacacgtggg

SEQ ID NO: 361118 - DNA, 25 bp, Homo sapien
aacacgtgggagataactggctttt

SEQ ID NO: 361119 - DNA, 25 bp, Homo sapien
aactggcttttgaaatgcatgtctg

SEQ ID NO: 361120 - DNA, 25 bp, Homo sapien
ggttctacaaacctgcagagcctat

SEQ ID NO: 361121 - DNA, 25 bp, Homo sapien
acaaacctgcagagcctatatccca

SEQ ID NO: 361122 - DNA, 25 bp, Homo sapien
agtcacttggatattttgtaatcac

SEQ ID NO: 361123 - DNA, 25 bp, Homo sapien
gtaatcactcaaatttctgacacaa

SEQ ID NO: 361124 - DNA, 25 bp, Homo sapien
ggaagtatggctgagattttctgat

SEQ ID NO: 361125 - DNA, 25 bp, Homo sapien
aatgcaacccctacaactaccaaag

SEQ ID NO: 361126 - DNA, 25 bp, Homo sapien
agcaaaaaggcctgtcccaactcca

SEQ ID NO: 361127 - DNA, 25 bp, Homo sapien
tcgtgtctcctctttattttacaac

SEQ ID NO: 361128 - DNA, 25 bp, Homo sapien
tctcctctttattttacaacgcggc

SEQ ID NO: 361129 - DNA, 25 bp, Homo sapien
ttattttacaacgcggccctccttg

SEQ ID NO: 361130 - DNA, 25 bp, Homo sapien
cagccctcacgaaaagttctgcagt

SEQ ID NO: 361131 - DNA, 25 bp, Homo sapien
ccctcacgaaaagttctgcagtggg

SEQ ID NO: 361132 - DNA, 25 bp, Homo sapien
ccaaagcttcagatttagacagtaa

SEQ ID NO: 361133 - DNA, 25 bp, Homo sapien
tagacagtaaccaccaaatccgacc

SEQ ID NO: 361134 - DNA, 25 bp, Homo sapien
taaccaccaaatccgacctgggctg

SEQ ID NO: 361135 - DNA, 25 bp, Homo sapien
accaaatccgacctgggctgcaggt

SEQ ID NO: 361136 - DNA, 25 bp, Homo sapien
gtgttaattgttgagggcactgaat

SEQ ID NO: 361137 - DNA, 25 bp, Homo sapien
gggcactgaattcccttgtcataag

SEQ ID NO: 361138 - DNA, 25 bp, Homo sapien
ttcccttgtcataagatggttcttg

SEQ ID NO: 361139 - DNA, 25 bp, Homo sapien
ggttcttgcaacatgtagctcttat

SEQ ID NO: 361140 - DNA, 25 bp, Homo sapien
ttcagggccatgtttatgagtggac

SEQ ID NO: 361141 - DNA, 25 bp, Homo sapien
acaaacccatgtacacctgaggaat

SEQ ID NO: 361142 - DNA, 25 bp, Homo sapien
acctgaggaatgtcgatgctgccac

SEQ ID NO: 361143 - DNA, 25 bp, Homo sapien
gatgctgccaccttacagataataa

SEQ ID NO: 361144 - DNA, 25 bp, Homo sapien
gcatacacgggtaacttggcaatga

SEQ ID NO: 361145 - DNA, 25 bp, Homo sapien
gacagcactgtagaacagctttatg

SEQ ID NO: 361146 - DNA, 25 bp, Homo sapien
acagcttgcttcctacaggtagaag

SEQ ID NO: 361147 - DNA, 25 bp, Homo sapien
gaaggtgatcatcagtgacaagcac

SEQ ID NO: 361148 - DNA, 25 bp, Homo sapien
acaagcactgcttcgagctgtacgg

SEQ ID NO: 361149 - DNA, 25 bp, Homo sapien
gagctgtacggctatgacatcctca

SEQ ID NO: 361150 - DNA, 25 bp, Homo sapien
ggctatgacatcctcatcgaccagg

SEQ ID NO: 361151 - DNA, 25 bp, Homo sapien
atcgaccaggacctcaagccgtggc

SEQ ID NO: 361152 - DNA, 25 bp, Homo sapien
ctcaagccgtggctcctggaggtca

SEQ ID NO: 361153 - DNA, 25 bp, Homo sapien
gaggtcaatgcgtccccatcactga

SEQ ID NO: 361154 - DNA, 25 bp, Homo sapien
gcagccaggaagactatgagctcaa

SEQ ID NO: 361155 - DNA, 25 bp, Homo sapien
gaagactatgagctcaagacctgcc

SEQ ID NO: 361156 - DNA, 25 bp, Homo sapien
tcctggaagacaccctgcatgttgt

SEQ ID NO: 361157 - DNA, 25 bp, Homo sapien
aagacaccctgcatgttgtggacat

SEQ ID NO: 361158 - DNA, 25 bp, Homo sapien
gagatgcttcaaattcgtaagtaag

SEQ ID NO: 361159 - DNA, 25 bp, Homo sapien
gtggttgaaacagacaataaatgct

SEQ ID NO: 361160 - DNA, 25 bp, Homo sapien
ataaatgctgtagaaatcccaagga

SEQ ID NO: 361161 - DNA, 25 bp, Homo sapien
aatgctgtagaaatcccaaggagag

SEQ ID NO: 361162 - DNA, 25 bp, Homo sapien
aggagagagagattgtcagggccca

SEQ ID NO: 361163 - DNA, 25 bp, Homo sapien
tgtcagggcccaagagtgtcaggaa

SEQ ID NO: 361164 - DNA, 25 bp, Homo sapien
tcagggcccaagagtgtcaggaaga

SEQ ID NO: 361165 - DNA, 25 bp, Homo sapien
aatgtatcttcttaaaagttgctta

SEQ ID NO: 361166 - DNA, 25 bp, Homo sapien
gggctctgtctaggccttcagaggt

SEQ ID NO: 361167 - DNA, 25 bp, Homo sapien
tctgtctaggccttcagaggtgtgg

SEQ ID NO: 361168 - DNA, 25 bp, Homo sapien
aagttgcttataatatggtttgaaa

SEQ ID NO: 361169 - DNA, 25 bp, Homo sapien
tcattttgaataagttgtgtataca

SEQ ID NO: 361170 - DNA, 25 bp, Homo sapien
gttgtcaggaattctctattttgtt

SEQ ID NO: 361171 - DNA, 25 bp, Homo sapien
ttgtcaggaattctctattttgttt

SEQ ID NO: 361172 - DNA, 25 bp, Homo sapien
acatttcccatgaattttcacaccc

SEQ ID NO: 361173 - DNA, 25 bp, Homo sapien
catttcccatgaattttcacaccca

SEQ ID NO: 361174 - DNA, 25 bp, Homo sapien
tttcccatgaattttcacacccaaa

SEQ ID NO: 361175 - DNA, 25 bp, Homo sapien
tcccatgaattttcacacccaaaaa

SEQ ID NO: 361176 - DNA, 25 bp, Homo sapien
tttcacacccaaaaattgttattgt

SEQ ID NO: 361177 - DNA, 25 bp, Homo sapien
gcaaaggtttcaagatgtttagcca

SEQ ID NO: 361178 - DNA, 25 bp, Homo sapien
aaggtttcaagatgtttagccaaat

SEQ ID NO: 361179 - DNA, 25 bp, Homo sapien
gtttcaagatgtttagccaaatata

SEQ ID NO: 361180 - DNA, 25 bp, Homo sapien
agaggcagtgaatgttccatgagct

SEQ ID NO: 361181 - DNA, 25 bp, Homo sapien
catgagctgcaagcagtggctgcct

SEQ ID NO: 361182 - DNA, 25 bp, Homo sapien
agcagtggctgcctggtctctgctc

SEQ ID NO: 361183 - DNA, 25 bp, Homo sapien
ttcttgtcttttaagctaagggagc

SEQ ID NO: 361184 - DNA, 25 bp, Homo sapien
taagggagctgtgagactgagttta

SEQ ID NO: 361185 - DNA, 25 bp, Homo sapien
gggtcaatatgctgggtatttatat

SEQ ID NO: 361186 - DNA, 25 bp, Homo sapien
ataagcacatactcttaagtttaga

SEQ ID NO: 361187 - DNA, 25 bp, Homo sapien
cttaagtttagatctgtgctacaaa

SEQ ID NO: 361188 - DNA, 25 bp, Homo sapien
gtgctacaaaccacgacctagaagt

SEQ ID NO: 361189 - DNA, 25 bp, Homo sapien
acgacctagaagtacacaacactgt

SEQ ID NO: 361190 - DNA, 25 bp, Homo sapien
acaacactgtcctgtggaggcagcc

SEQ ID NO: 361191 - DNA, 25 bp, Homo sapien
gcaaatggacattgttgtgttccaa

SEQ ID NO: 361192 - DNA, 25 bp, Homo sapien
aaataatcagaaggccacatttggc

SEQ ID NO: 361193 - DNA, 25 bp, Homo sapien
tggcctgtgagctatagtttgctta

SEQ ID NO: 361194 - DNA, 25 bp, Homo sapien
gtgagctatagtttgcttatctcta

SEQ ID NO: 361195 - DNA, 25 bp, Homo sapien
gttttctgtatttgttcctgaattg

SEQ ID NO: 361196 - DNA, 25 bp, Homo sapien
tcctgaattgtctcattcaccccaa

SEQ ID NO: 361197 - DNA, 25 bp, Homo sapien
aattgtctcattcaccccaaatatt

SEQ ID NO: 361198 - DNA, 25 bp, Homo sapien
agggatcctgctaagcgtcctacaa

SEQ ID NO: 361199 - DNA, 25 bp, Homo sapien
tgctaagcgtcctacaatgcatagt

SEQ ID NO: 361200 - DNA, 25 bp, Homo sapien
gcgtcctacaatgcatagtacaact

SEQ ID NO: 361201 - DNA, 25 bp, Homo sapien
ctcatccagaatgtcagtagttctg

SEQ ID NO: 361202 - DNA, 25 bp, Homo sapien
tcgccaggtgcccagagcagtctct

SEQ ID NO: 361203 - DNA, 25 bp, Homo sapien
tctgtcttccagagcaacacggtga

SEQ ID NO: 361204 - DNA, 25 bp, Homo sapien
tcttccagagcaacacggtgacgta

SEQ ID NO: 361205 - DNA, 25 bp, Homo sapien
gtgacgtaaagcgttcccagtggac

SEQ ID NO: 361206 - DNA, 25 bp, Homo sapien
ccccattttttcatcttagtttgct

SEQ ID NO: 361207 - DNA, 25 bp, Homo sapien
agtttgctttgagttgctgttggaa

SEQ ID NO: 361208 - DNA, 25 bp, Homo sapien
ctttgagttgctgttggaagttttc

SEQ ID NO: 361209 - DNA, 25 bp, Homo sapien
ttcttgagggaatggtcttccccag

SEQ ID NO: 361210 - DNA, 25 bp, Homo sapien
gatgagtcaaaaatgccgcaaagat

SEQ ID NO: 361211 - DNA, 25 bp, Homo sapien
aagagcaaaaccaagcgatgagcaa

SEQ ID NO: 361212 - DNA, 25 bp, Homo sapien
aagcttaaagtgtacaggtttcaat

SEQ ID NO: 361213 - DNA, 25 bp, Homo sapien
gagagagactccagaagcacttcca

SEQ ID NO: 361214 - DNA, 25 bp, Homo sapien
aagcacttccaagtgacctgcctgg

SEQ ID NO: 361215 - DNA, 25 bp, Homo sapien
ggtccaagacgagtacaccgagttt

SEQ ID NO: 361216 - DNA, 25 bp, Homo sapien
gagtacaccgagtttctccacgagg

SEQ ID NO: 361217 - DNA, 25 bp, Homo sapien
gagtttctccacgaggcacagagct

SEQ ID NO: 361218 - DNA, 25 bp, Homo sapien
ttctccacgaggcacagagctgagt

SEQ ID NO: 361219 - DNA, 25 bp, Homo sapien
cagagctgagtaggcaacctggcac

SEQ ID NO: 361220 - DNA, 25 bp, Homo sapien
tgggaaacagccttgggccttctgg

SEQ ID NO: 361221 - DNA, 25 bp, Homo sapien
gaggctcccacctcttcgggcagtt

SEQ ID NO: 361222 - DNA, 25 bp, Homo sapien
caagctaagcttcctgctttcctga

SEQ ID NO: 361223 - DNA, 25 bp, Homo sapien
ttcctgctttcctgacacctctggg

SEQ ID NO: 361224 - DNA, 25 bp, Homo sapien
ccctttctttgacctggacatgttg

SEQ ID NO: 361225 - DNA, 25 bp, Homo sapien
acctggacatgttgtctcctggtaa

SEQ ID NO: 361226 - DNA, 25 bp, Homo sapien
gtctcctggtaaatatttgatggtc

SEQ ID NO: 361227 - DNA, 25 bp, Homo sapien
gatggtcagcacacttaactaattg

SEQ ID NO: 361228 - DNA, 25 bp, Homo sapien
attgcagagtgaacaggaccctaat

SEQ ID NO: 361229 - DNA, 25 bp, Homo sapien
gggcagttacgtcgttcagcgttcc

SEQ ID NO: 361230 - DNA, 25 bp, Homo sapien
agcgttcccatctggatcacattag

SEQ ID NO: 361231 - DNA, 25 bp, Homo sapien
gattgtggcatgagtggctctttca

SEQ ID NO: 361232 - DNA, 25 bp, Homo sapien
agtgtggaccgcagcccagagttag

SEQ ID NO: 361233 - DNA, 25 bp, Homo sapien
gcccagagttagtcttggctgcagt

SEQ ID NO: 361234 - DNA, 25 bp, Homo sapien
agtcttggctgcagtgcaactcttt

SEQ ID NO: 361235 - DNA, 25 bp, Homo sapien
acacttcacccttggctgggctgtg

SEQ ID NO: 361236 - DNA, 25 bp, Homo sapien
tgggctgtgtgccaggaaaccctcc

SEQ ID NO: 361237 - DNA, 25 bp, Homo sapien
acaaccacgccagtcttggtaggga

SEQ ID NO: 361238 - DNA, 25 bp, Homo sapien
ttggtagggaggcagactccacatc

SEQ ID NO: 361239 - DNA, 25 bp, Homo sapien
gagcaggctcactttgtggaatcac

SEQ ID NO: 361240 - DNA, 25 bp, Homo sapien
atattcgtggagcttggtctgtaac

SEQ ID NO: 361241 - DNA, 25 bp, Homo sapien
gtggaatcaccatcaggaaaactat

SEQ ID NO: 361242 - DNA, 25 bp, Homo sapien
ggaaaactatcttaacctatcaatc

SEQ ID NO: 361243 - DNA, 25 bp, Homo sapien
taacctatcaatcagcagactttct

SEQ ID NO: 361244 - DNA, 25 bp, Homo sapien
tgatgagcaaggtctcttgtgccct

SEQ ID NO: 361245 - DNA, 25 bp, Homo sapien
tcttgtgccctgaagcccagcgagg

SEQ ID NO: 361246 - DNA, 25 bp, Homo sapien
ttcccagcacccagcgtttaacagg

SEQ ID NO: 361247 - DNA, 25 bp, Homo sapien
agcacccagcgtttaacagggccct

SEQ ID NO: 361248 - DNA, 25 bp, Homo sapien
gcacccagcgtttaacagggccctt

SEQ ID NO: 361249 - DNA, 25 bp, Homo sapien
aagctcagagttggggtctgcagca

SEQ ID NO: 361250 - DNA, 25 bp, Homo sapien
ggcagctcaagttccccagaccgca

SEQ ID NO: 361251 - DNA, 25 bp, Homo sapien
cagaccgcacctatcagacggaggg

SEQ ID NO: 361252 - DNA, 25 bp, Homo sapien
agaccgcacctatcagacggagggc

SEQ ID NO: 361253 - DNA, 25 bp, Homo sapien
accgcacctatcagacggagggcgg

SEQ ID NO: 361254 - DNA, 25 bp, Homo sapien
cgcacctatcagacggagggcggcc

SEQ ID NO: 361255 - DNA, 25 bp, Homo sapien
cctatcagacggagggcggcccgct

SEQ ID NO: 361256 - DNA, 25 bp, Homo sapien
gtcagagcccgacctcggcggacag

SEQ ID NO: 361257 - DNA, 25 bp, Homo sapien
gtgactcagtgagccacatggtaca

SEQ ID NO: 361258 - DNA, 25 bp, Homo sapien
gtccgggtgttcttggacaagtgac

SEQ ID NO: 361259 - DNA, 25 bp, Homo sapien
acatggtacagcactcagcctggga

SEQ ID NO: 361260 - DNA, 25 bp, Homo sapien
ctgggacacccgcagaactgagatg

SEQ ID NO: 361261 - DNA, 25 bp, Homo sapien
gtcaatttaattgtcacttctctgg

SEQ ID NO: 361262 - DNA, 25 bp, Homo sapien
gcactctcttttgctattagccaca

SEQ ID NO: 361263 - DNA, 25 bp, Homo sapien
tagccacaagcacgacatgcggttt

SEQ ID NO: 361264 - DNA, 25 bp, Homo sapien
atgcggtttcccaacactgctgggt

SEQ ID NO: 361265 - DNA, 25 bp, Homo sapien
actgtttctggaatttcagcttccc

SEQ ID NO: 361266 - DNA, 25 bp, Homo sapien
tttcagcttcccgatgggtaaaatg

SEQ ID NO: 361267 - DNA, 25 bp, Homo sapien
gaataacggacttctctccgaaggt

SEQ ID NO: 361268 - DNA, 25 bp, Homo sapien
atttccttatatacccttttgccag

SEQ ID NO: 361269 - DNA, 25 bp, Homo sapien
tttccttatatacccttttgccagc

SEQ ID NO: 361270 - DNA, 25 bp, Homo sapien
tccttatatacccttttgccagcca

SEQ ID NO: 361271 - DNA, 25 bp, Homo sapien
ccttttgccagccaagatactgata

SEQ ID NO: 361272 - DNA, 25 bp, Homo sapien
tttgccagccaagatactgatattt

SEQ ID NO: 361273 - DNA, 25 bp, Homo sapien
gtccaatacaatattctctttctgg

SEQ ID NO: 361274 - DNA, 25 bp, Homo sapien
aatacaatattctctttctggaggc

SEQ ID NO: 361275 - DNA, 25 bp, Homo sapien
tacaatattctctttctggaggctt

SEQ ID NO: 361276 - DNA, 25 bp, Homo sapien
aatattctctttctggaggcttcct

SEQ ID NO: 361277 - DNA, 25 bp, Homo sapien
gaggcttcctacaagtgaaagcaga

SEQ ID NO: 361278 - DNA, 25 bp, Homo sapien
ttcctacaagtgaaagcagattttg

SEQ ID NO: 361279 - DNA, 25 bp, Homo sapien
tttttttgtgcacccactcctctct

SEQ ID NO: 361280 - DNA, 25 bp, Homo sapien
aaacttactgctccttctaaaatct

SEQ ID NO: 361281 - DNA, 25 bp, Homo sapien
cttactgctccttctaaaatctaga

SEQ ID NO: 361282 - DNA, 25 bp, Homo sapien
atctagaaagaatactgcctatttt

SEQ ID NO: 361283 - DNA, 25 bp, Homo sapien
atgcttaaggaaggaagagtctgga

SEQ ID NO: 361284 - DNA, 25 bp, Homo sapien
gagtctggaagtttcttcattggct

SEQ ID NO: 361285 - DNA, 25 bp, Homo sapien
agtttcttcattggcttcttacatt

SEQ ID NO: 361286 - DNA, 25 bp, Homo sapien
tacattccaactttgctagtcacaa

SEQ ID NO: 361287 - DNA, 25 bp, Homo sapien
ccaactttgctagtcacaaggcctt

SEQ ID NO: 361288 - DNA, 25 bp, Homo sapien
gtcacaaggcctttgtaaaagagac

SEQ ID NO: 361289 - DNA, 25 bp, Homo sapien
atagtcattgctttattggaaacca

SEQ ID NO: 361290 - DNA, 25 bp, Homo sapien
taataaaccattccaaatctgcttc

SEQ ID NO: 361291 - DNA, 25 bp, Homo sapien
aatctgcttccaagctgctactgag

SEQ ID NO: 361292 - DNA, 25 bp, Homo sapien
gaaaacatgggctcagaaggacaaa

SEQ ID NO: 361293 - DNA, 25 bp, Homo sapien
gacaaagcattctcaggacagctct

SEQ ID NO: 361294 - DNA, 25 bp, Homo sapien
aggacagctctgtctcttggcagag

SEQ ID NO: 361295 - DNA, 25 bp, Homo sapien
ggaagagggttatctctgctgtgca

SEQ ID NO: 361296 - DNA, 25 bp, Homo sapien
cttggcagagggtgttgccacatca

SEQ ID NO: 361297 - DNA, 25 bp, Homo sapien
ctgaccactcacaggtgacgcagtg

SEQ ID NO: 361298 - DNA, 25 bp, Homo sapien
acaggtgacgcagtggcctgtctcc

SEQ ID NO: 361299 - DNA, 25 bp, Homo sapien
tctgtcctgtccactgttacaaaga

SEQ ID NO: 361300 - DNA, 25 bp, Homo sapien
gtgcaggcagttgccactggtctct

SEQ ID NO: 361301 - DNA, 25 bp, Homo sapien
gatagactgatatgcaagttgggaa

SEQ ID NO: 361302 - DNA, 25 bp, Homo sapien
agagtttgatagacctcgattgaga

SEQ ID NO: 361303 - DNA, 25 bp, Homo sapien
gacctcgattgagagacttttgtaa

SEQ ID NO: 361304 - DNA, 25 bp, Homo sapien
tgagagacttttgtaagagtggctt

SEQ ID NO: 361305 - DNA, 25 bp, Homo sapien
aaatgcaaatacaggaaagcttttt

SEQ ID NO: 361306 - DNA, 25 bp, Homo sapien
gttaagtgacttggagtgaaagctc

SEQ ID NO: 361307 - DNA, 25 bp, Homo sapien
gaaagctcaaactctagtgtaatct

SEQ ID NO: 361308 - DNA, 25 bp, Homo sapien
actctagtgtaatctctgacttttg

SEQ ID NO: 361309 - DNA, 25 bp, Homo sapien
aatctctgacttttgaatactttct

SEQ ID NO: 361310 - DNA, 25 bp, Homo sapien
tctgacttttgaatactttcttgaa

SEQ ID NO: 361311 - DNA, 25 bp, Homo sapien
ttttccaaatcaagttgatagactg

SEQ ID NO: 361312 - DNA, 25 bp, Homo sapien
tcatctctctgggatttttccagga

SEQ ID NO: 361313 - DNA, 25 bp, Homo sapien
aaacctcaggcaccaaaacctcagg

SEQ ID NO: 361314 - DNA, 25 bp, Homo sapien
tgcaatctgcaattctaagctcatt

SEQ ID NO: 361315 - DNA, 25 bp, Homo sapien
ggctgtccacaccattggtgctgca

SEQ ID NO: 361316 - DNA, 25 bp, Homo sapien
gcaattctaagctcattctattaaa

SEQ ID NO: 361317 - DNA, 25 bp, Homo sapien
tggtgctgcaccagagctgaccctt

SEQ ID NO: 361318 - DNA, 25 bp, Homo sapien
ttcacagctacttagtggttacttg

SEQ ID NO: 361319 - DNA, 25 bp, Homo sapien
ttaattttaaagaccacctgaagat

SEQ ID NO: 361320 - DNA, 25 bp, Homo sapien
accacctgaagatttacattttcta

SEQ ID NO: 361321 - DNA, 25 bp, Homo sapien
gatttacattttctagctgcacata

SEQ ID NO: 361322 - DNA, 25 bp, Homo sapien
agctgcacatatcctatagagggaa

SEQ ID NO: 361323 - DNA, 25 bp, Homo sapien
tcaccctggagggaaaacgcgccga

SEQ ID NO: 361324 - DNA, 25 bp, Homo sapien
caccctggagggaaaacgcgccgag

SEQ ID NO: 361325 - DNA, 25 bp, Homo sapien
gagacgcgcggagggctcgcccggg

SEQ ID NO: 361326 - DNA, 25 bp, Homo sapien
cgccgcacatccacgcaggttcaac

SEQ ID NO: 361327 - DNA, 25 bp, Homo sapien
cacgcaggttcaaccccagcgcggg

SEQ ID NO: 361328 - DNA, 25 bp, Homo sapien
acccgctgaagccaatgggtcgcac

SEQ ID NO: 361329 - DNA, 25 bp, Homo sapien
gctgaagccaatgggtcgcacggct

SEQ ID NO: 361330 - DNA, 25 bp, Homo sapien
gaagccaatgggtcgcacggctccg

SEQ ID NO: 361331 - DNA, 25 bp, Homo sapien
ggcttcccagtcaccctggagggaa

SEQ ID NO: 361332 - DNA, 25 bp, Homo sapien
gcttcccagtcaccctggagggaaa

SEQ ID NO: 361333 - DNA, 25 bp, Homo sapien
tcccagtcaccctggagggaaaacg

SEQ ID NO: 361334 - DNA, 25 bp, Homo sapien
gttaactcatttacaaaggtcatac

SEQ ID NO: 361335 - DNA, 25 bp, Homo sapien
agatgccagggctgatgccaagact

SEQ ID NO: 361336 - DNA, 25 bp, Homo sapien
gctgatgccaagactaacgttcatt

SEQ ID NO: 361337 - DNA, 25 bp, Homo sapien
taaactctacctcattatgcttatt

SEQ ID NO: 361338 - DNA, 25 bp, Homo sapien
tatgcttattcatcgatagtccaga

SEQ ID NO: 361339 - DNA, 25 bp, Homo sapien
atcgatagtccagatgcatcaattc

SEQ ID NO: 361340 - DNA, 25 bp, Homo sapien
gaatagaaaaactgtcatgtatacc

SEQ ID NO: 361341 - DNA, 25 bp, Homo sapien
tcacaacaacagcacgggtagctat

SEQ ID NO: 361342 - DNA, 25 bp, Homo sapien
gcacgggtagctattacctgcacat

SEQ ID NO: 361343 - DNA, 25 bp, Homo sapien
tattacctgcacataacagctatgg

SEQ ID NO: 361344 - DNA, 25 bp, Homo sapien
aacagctatggaaatcaggcttaaa

SEQ ID NO: 361345 - DNA, 25 bp, Homo sapien
gactttgaatgaccctggcagtcaa

SEQ ID NO: 361346 - DNA, 25 bp, Homo sapien
ggcagtcaagggtgagtgtcatcca

SEQ ID NO: 361347 - DNA, 25 bp, Homo sapien
tgagtgtcatccacaggagagccgg

SEQ ID NO: 361348 - DNA, 25 bp, Homo sapien
ccagccacgggctccatgggcagtt

SEQ ID NO: 361349 - DNA, 25 bp, Homo sapien
aagtcaccagagttttcgagaacca

SEQ ID NO: 361350 - DNA, 25 bp, Homo sapien
cagagttttcgagaaccacttccaa

SEQ ID NO: 361351 - DNA, 25 bp, Homo sapien
cacttccaaaagacaccgtcgtgac

SEQ ID NO: 361352 - DNA, 25 bp, Homo sapien
gtcgtgaccggagccattagcaaat

SEQ ID NO: 361353 - DNA, 25 bp, Homo sapien
ggagccattagcaaatatcaggatt

SEQ ID NO: 361354 - DNA, 25 bp, Homo sapien
ttaaagtctttcatggatgtgcaag

SEQ ID NO: 361355 - DNA, 25 bp, Homo sapien
gatgtgcaagactttgaatgaccct

SEQ ID NO: 361356 - DNA, 25 bp, Homo sapien
gttggatgctccgaagaaatgccac

SEQ ID NO: 361357 - DNA, 25 bp, Homo sapien
tggatgctccgaagaaatgccacat

SEQ ID NO: 361358 - DNA, 25 bp, Homo sapien
gaaatgccacatgtgtctgggcctc

SEQ ID NO: 361359 - DNA, 25 bp, Homo sapien
aaatgccacatgtgtctgggcctct

SEQ ID NO: 361360 - DNA, 25 bp, Homo sapien
aatgccacatgtgtctgggcctctg

SEQ ID NO: 361361 - DNA, 25 bp, Homo sapien
tctgggcctctgatacttagcacac

SEQ ID NO: 361362 - DNA, 25 bp, Homo sapien
ctgggcctctgatacttagcacacg

SEQ ID NO: 361363 - DNA, 25 bp, Homo sapien
tgggcctctgatacttagcacacgc

SEQ ID NO: 361364 - DNA, 25 bp, Homo sapien
gggcctctgatacttagcacacgct

SEQ ID NO: 361365 - DNA, 25 bp, Homo sapien
gcctctgatacttagcacacgctct

SEQ ID NO: 361366 - DNA, 25 bp, Homo sapien
tctgatacttagcacacgctctgta

SEQ ID NO: 361367 - DNA, 25 bp, Homo sapien
aattatgtattcatctcatggcata

SEQ ID NO: 361368 - DNA, 25 bp, Homo sapien
tattaacctattcaactaaagatgt

SEQ ID NO: 361369 - DNA, 25 bp, Homo sapien
agatgttgacttggatttatttaaa

SEQ ID NO: 361370 - DNA, 25 bp, Homo sapien
tatttaaattcatatgtgcactgta

SEQ ID NO: 361371 - DNA, 25 bp, Homo sapien
tgtgcactgtataagagagtactct

SEQ ID NO: 361372 - DNA, 25 bp, Homo sapien
gagagtactcttacattaacacatt

SEQ ID NO: 361373 - DNA, 25 bp, Homo sapien
gtactcttacattaacacattttag

SEQ ID NO: 361374 - DNA, 25 bp, Homo sapien
aacgatatattgctagtttcatgct

SEQ ID NO: 361375 - DNA, 25 bp, Homo sapien
atattgctagtttcatgcttcctcc

SEQ ID NO: 361376 - DNA, 25 bp, Homo sapien
ttgcctgtgtagatttcatttattg

SEQ ID NO: 361377 - DNA, 25 bp, Homo sapien
ttggtaattcattagtttaacacta

SEQ ID NO: 361378 - DNA, 25 bp, Homo sapien
gtggggaagatgttacacacttttt

SEQ ID NO: 361379 - DNA, 25 bp, Homo sapien
acacactttttaaatcaaccagatc

SEQ ID NO: 361380 - DNA, 25 bp, Homo sapien
gtgagaactcacactatacagtacc

SEQ ID NO: 361381 - DNA, 25 bp, Homo sapien
actcacactatacagtaccaaaggg

SEQ ID NO: 361382 - DNA, 25 bp, Homo sapien
gatggtgcaactctgccctcatgat

SEQ ID NO: 361383 - DNA, 25 bp, Homo sapien
tgcaactctgccctcatgatccagt

SEQ ID NO: 361384 - DNA, 25 bp, Homo sapien
tggttccataggctgtatggaaagc

SEQ ID NO: 361385 - DNA, 25 bp, Homo sapien
ccataggctgtatggaaagcatggc

SEQ ID NO: 361386 - DNA, 25 bp, Homo sapien
ggagcaggtgtcttacatggcagaa

SEQ ID NO: 361387 - DNA, 25 bp, Homo sapien
agcaggtgtcttacatggcagaagc

SEQ ID NO: 361388 - DNA, 25 bp, Homo sapien
caggtgtcttacatggcagaagcag

SEQ ID NO: 361389 - DNA, 25 bp, Homo sapien
gatgaatctgtgttgtataccagaa

SEQ ID NO: 361390 - DNA, 25 bp, Homo sapien
agccaacatgcagcttacttcttga

SEQ ID NO: 361391 - DNA, 25 bp, Homo sapien
attcgacactaatggttcaaacatt

SEQ ID NO: 361392 - DNA, 25 bp, Homo sapien
catgcagcttacttcttgagtagtt

SEQ ID NO: 361393 - DNA, 25 bp, Homo sapien
cttgaaaggctttttgataccacat

SEQ ID NO: 361394 - DNA, 25 bp, Homo sapien
aaggctttttgataccacattggta

SEQ ID NO: 361395 - DNA, 25 bp, Homo sapien
accacattggtaatcagctgaagac

SEQ ID NO: 361396 - DNA, 25 bp, Homo sapien
agctgaagactgacaataagttaca

SEQ ID NO: 361397 - DNA, 25 bp, Homo sapien
tttagattggctagcattccattta

SEQ ID NO: 361398 - DNA, 25 bp, Homo sapien
cttcttgagtagttttccaaatcag

SEQ ID NO: 361399 - DNA, 25 bp, Homo sapien
ataaaatggttgcatgtttttcttc

SEQ ID NO: 361400 - DNA, 25 bp, Homo sapien
acacattggccatccacttactatt

SEQ ID NO: 361401 - DNA, 25 bp, Homo sapien
tacctcatgccagacacacagtaag

SEQ ID NO: 361402 - DNA, 25 bp, Homo sapien
ttactattccccaaaaatgcctctg

SEQ ID NO: 361403 - DNA, 25 bp, Homo sapien
aaaatgcctctgtgtactttccaaa

SEQ ID NO: 361404 - DNA, 25 bp, Homo sapien
gtgtactttccaaactcagcatttt

SEQ ID NO: 361405 - DNA, 25 bp, Homo sapien
tgatgaaggttttcccaacccttgc

SEQ ID NO: 361406 - DNA, 25 bp, Homo sapien
gacacacagtaagccacctacagaa

SEQ ID NO: 361407 - DNA, 25 bp, Homo sapien
gaacccatccttcacaaaatgtgcc

SEQ ID NO: 361408 - DNA, 25 bp, Homo sapien
aaaccccttatcttgacatgggagg

SEQ ID NO: 361409 - DNA, 25 bp, Homo sapien
aggtggcccagccaatctctgtggt

SEQ ID NO: 361410 - DNA, 25 bp, Homo sapien
aatctctgtggtcctaactctcatt

SEQ ID NO: 361411 - DNA, 25 bp, Homo sapien
ccaggatcccagacacctggtgtgg

SEQ ID NO: 361412 - DNA, 25 bp, Homo sapien
cttcaggtgggctcgtgcccttggc

SEQ ID NO: 361413 - DNA, 25 bp, Homo sapien
ccacctcaggtccaggatgaacatt

SEQ ID NO: 361414 - DNA, 25 bp, Homo sapien
ttggccctcccagctaagtggttct

SEQ ID NO: 361415 - DNA, 25 bp, Homo sapien
aggcagaccagagtgggaccctcaa

SEQ ID NO: 361416 - DNA, 25 bp, Homo sapien
gtgggaccctcaaagtcacagagcc

SEQ ID NO: 361417 - DNA, 25 bp, Homo sapien
ccaaatgctcaactttaagggtgat

SEQ ID NO: 361418 - DNA, 25 bp, Homo sapien
aagggtgatactatcctcaggaatc

SEQ ID NO: 361419 - DNA, 25 bp, Homo sapien
tatcctcaggaatccttgcaaagta

SEQ ID NO: 361420 - DNA, 25 bp, Homo sapien
gaacattccagcagtgtggtctgcc

SEQ ID NO: 361421 - DNA, 25 bp, Homo sapien
agggaagaggcctgcacagtcctta

SEQ ID NO: 361422 - DNA, 25 bp, Homo sapien
aactggcaaagcttccttcataaag

SEQ ID NO: 361423 - DNA, 25 bp, Homo sapien
actggcaaagcttccttcataaagg

SEQ ID NO: 361424 - DNA, 25 bp, Homo sapien
ctggcaaagcttccttcataaagga

SEQ ID NO: 361425 - DNA, 25 bp, Homo sapien
aagacaaggccttaaagtcctctca

SEQ ID NO: 361426 - DNA, 25 bp, Homo sapien
gacaaggccttaaagtcctctcaag

SEQ ID NO: 361427 - DNA, 25 bp, Homo sapien
aaggccttaaagtcctctcaagcat

SEQ ID NO: 361428 - DNA, 25 bp, Homo sapien
aggccttaaagtcctctcaagcatt

SEQ ID NO: 361429 - DNA, 25 bp, Homo sapien
gccttaaagtcctctcaagcattct

SEQ ID NO: 361430 - DNA, 25 bp, Homo sapien
aagtcctctcaagcattcttttcta

SEQ ID NO: 361431 - DNA, 25 bp, Homo sapien
agtcctctcaagcattcttttctaa

SEQ ID NO: 361432 - DNA, 25 bp, Homo sapien
gtcctctcaagcattcttttctaaa

SEQ ID NO: 361433 - DNA, 25 bp, Homo sapien
atggttgatacattggcaaacagta

SEQ ID NO: 361434 - DNA, 25 bp, Homo sapien
acagtatttatttaacgtatgtata

SEQ ID NO: 361435 - DNA, 25 bp, Homo sapien
acgtatgtataaatggggtccctga

SEQ ID NO: 361436 - DNA, 25 bp, Homo sapien
ggtggtctagtgattaggaatttaa

SEQ ID NO: 361437 - DNA, 25 bp, Homo sapien
catcctcagagagcctctaagcaaa

SEQ ID NO: 361438 - DNA, 25 bp, Homo sapien
gagagcctctaagcaaaaagactaa

SEQ ID NO: 361439 - DNA, 25 bp, Homo sapien
gcctctaagcaaaaagactaagtta

SEQ ID NO: 361440 - DNA, 25 bp, Homo sapien
atcagttatcattagactttctcat

SEQ ID NO: 361441 - DNA, 25 bp, Homo sapien
gttatcattagactttctcatagaa

SEQ ID NO: 361442 - DNA, 25 bp, Homo sapien
agactttctcatagaaatttatggg

SEQ ID NO: 361443 - DNA, 25 bp, Homo sapien
aaaagtatgagccaagaattttata

SEQ ID NO: 361444 - DNA, 25 bp, Homo sapien
cgcctatagtcacagcttcttaggg

SEQ ID NO: 361445 - DNA, 25 bp, Homo sapien
tagtatgcaatgatcgttcctccac

SEQ ID NO: 361446 - DNA, 25 bp, Homo sapien
tgatcgttcctccacatagccactg

SEQ ID NO: 361447 - DNA, 25 bp, Homo sapien
gagacctcatcccttacaaaaaggg

SEQ ID NO: 361448 - DNA, 25 bp, Homo sapien
ggaggttccaacattaataccatgt

SEQ ID NO: 361449 - DNA, 25 bp, Homo sapien
gtacctgttattgtaattccccatg

SEQ ID NO: 361450 - DNA, 25 bp, Homo sapien
gtaattccccatgtatatcatacaa

SEQ ID NO: 361451 - DNA, 25 bp, Homo sapien
gggcacatactaataggatcatggt

SEQ ID NO: 361452 - DNA, 25 bp, Homo sapien
atgatttgggctgtgtcagtaaatt

SEQ ID NO: 361453 - DNA, 25 bp, Homo sapien
ttcccaaagctaggcacaatggtgg

SEQ ID NO: 361454 - DNA, 25 bp, Homo sapien
ctaggcacaatggtgggcgcctata

SEQ ID NO: 361455 - DNA, 25 bp, Homo sapien
tgattttccacaatcattgcattca

SEQ ID NO: 361456 - DNA, 25 bp, Homo sapien
ctctctgatgtgcaatgagttggta

SEQ ID NO: 361457 - DNA, 25 bp, Homo sapien
gtgcaatgagttggtacttgtttct

SEQ ID NO: 361458 - DNA, 25 bp, Homo sapien
tgtgaaactggagctttcagcgaaa

SEQ ID NO: 361459 - DNA, 25 bp, Homo sapien
aaaatttctgacaagcttcacaagc

SEQ ID NO: 361460 - DNA, 25 bp, Homo sapien
aagcttcacaagcatatggcttttc

SEQ ID NO: 361461 - DNA, 25 bp, Homo sapien
gtacaaggaggtgagacttcttctt

SEQ ID NO: 361462 - DNA, 25 bp, Homo sapien
caaggaggtgagacttcttcttaaa

SEQ ID NO: 361463 - DNA, 25 bp, Homo sapien
gctttcagcgaaagattttccacat

SEQ ID NO: 361464 - DNA, 25 bp, Homo sapien
gtgtgaattcgcttatgaacacaga

SEQ ID NO: 361465 - DNA, 25 bp, Homo sapien
ttcgcttatgaacacagaatgtaga

SEQ ID NO: 361466 - DNA, 25 bp, Homo sapien
aataatcagagaagcagggcagtat

SEQ ID NO: 361467 - DNA, 25 bp, Homo sapien
aagcagggcagtatatccctggaga

SEQ ID NO: 361468 - DNA, 25 bp, Homo sapien
tttatctccataccttaaattgttg

SEQ ID NO: 361469 - DNA, 25 bp, Homo sapien
aaattgttggtagatcctttggatg

SEQ ID NO: 361470 - DNA, 25 bp, Homo sapien
attcattatgatgctagaggcattg

SEQ ID NO: 361471 - DNA, 25 bp, Homo sapien
gggtccatgcgaaaggttcaaacag

SEQ ID NO: 361472 - DNA, 25 bp, Homo sapien
gaaaggttcaaacagcctattacat

SEQ ID NO: 361473 - DNA, 25 bp, Homo sapien
acagcctattacattaatgcacatg

SEQ ID NO: 361474 - DNA, 25 bp, Homo sapien
aagctaagtcttaagttcaaatcta

SEQ ID NO: 361475 - DNA, 25 bp, Homo sapien
tttttctcttcagttctgttctttg

SEQ ID NO: 361476 - DNA, 25 bp, Homo sapien
cttcagttctgttctttgtatgata

SEQ ID NO: 361477 - DNA, 25 bp, Homo sapien
acttcagtaagtcatggattagagg

SEQ ID NO: 361478 - DNA, 25 bp, Homo sapien
aagtttgaagtccatccgcaagagt

SEQ ID NO: 361479 - DNA, 25 bp, Homo sapien
gaagtccatccgcaagagtaattgg

SEQ ID NO: 361480 - DNA, 25 bp, Homo sapien
gagtaattggaccacaggttctaaa

SEQ ID NO: 361481 - DNA, 25 bp, Homo sapien
acaggttctaaattactgaccattt

SEQ ID NO: 361482 - DNA, 25 bp, Homo sapien
catttgtggacttcttagatttata

SEQ ID NO: 361483 - DNA, 25 bp, Homo sapien
tgtatggtatattagcatttctctc

SEQ ID NO: 361484 - DNA, 25 bp, Homo sapien
tctgtgccaggtgctaaaggtggta

SEQ ID NO: 361485 - DNA, 25 bp, Homo sapien
agcaatgttccttgacaccagacat

SEQ ID NO: 361486 - DNA, 25 bp, Homo sapien
ttgacaccagacatcagtgcttact

SEQ ID NO: 361487 - DNA, 25 bp, Homo sapien
tcagtgcttactaaacttcagtaag

SEQ ID NO: 361488 - DNA, 25 bp, Homo sapien
attatcctgcactttcatattgaga

SEQ ID NO: 361489 - DNA, 25 bp, Homo sapien
tattgagaagcttgcccagactctt

SEQ ID NO: 361490 - DNA, 25 bp, Homo sapien
gcccagactctttcttgcaattaca

SEQ ID NO: 361491 - DNA, 25 bp, Homo sapien
ttgcaattacaatcagccttccctg

SEQ ID NO: 361492 - DNA, 25 bp, Homo sapien
ttacaatcagccttccctggatgat

SEQ ID NO: 361493 - DNA, 25 bp, Homo sapien
cctccagctaagaaatgctctaaag

SEQ ID NO: 361494 - DNA, 25 bp, Homo sapien
gcaaatgtctgcaagaaaggccctt

SEQ ID NO: 361495 - DNA, 25 bp, Homo sapien
aaaggcccttcttttgtgggctcag

SEQ ID NO: 361496 - DNA, 25 bp, Homo sapien
ttgtgggctcaggaacaatgcgcca

SEQ ID NO: 361497 - DNA, 25 bp, Homo sapien
aatgcgccacctatgagtctgtcaa

SEQ ID NO: 361498 - DNA, 25 bp, Homo sapien
tatgagtctgtcaatgtgaccgatt

SEQ ID NO: 361499 - DNA, 25 bp, Homo sapien
ttcaagctcctgctggaagcggtca

SEQ ID NO: 361500 - DNA, 25 bp, Homo sapien
agctcctgctggaagcggtcagtca

SEQ ID NO: 361501 - DNA, 25 bp, Homo sapien
ggaagcggtcagtcagcaaatctac

SEQ ID NO: 361502 - DNA, 25 bp, Homo sapien
gcggtcagtcagcaaatctactagc

SEQ ID NO: 361503 - DNA, 25 bp, Homo sapien
gcaaatctactagctggctgcgggc

SEQ ID NO: 361504 - DNA, 25 bp, Homo sapien
aatctactagctggctgcgggcaaa

SEQ ID NO: 361505 - DNA, 25 bp, Homo sapien
tactagctggctgcgggcaaagtcc

SEQ ID NO: 361506 - DNA, 25 bp, Homo sapien
gtccgcccggctgaagaaagtgaat

SEQ ID NO: 361507 - DNA, 25 bp, Homo sapien
aagcaccgctggctctgcatgcttc

SEQ ID NO: 361508 - DNA, 25 bp, Homo sapien
ggagttgctgcaggaacagctccag

SEQ ID NO: 361509 - DNA, 25 bp, Homo sapien
acagctccaggtgctgagaagaaaa

SEQ ID NO: 361510 - DNA, 25 bp, Homo sapien
tctggaaacctgaaagatgcgacat

SEQ ID NO: 361511 - DNA, 25 bp, Homo sapien
agatgcgacattgcttttaccaaca

SEQ ID NO: 361512 - DNA, 25 bp, Homo sapien
tgcttttaccaacacctccacattt

SEQ ID NO: 361513 - DNA, 25 bp, Homo sapien
cacctccacatttcctatacataaa

SEQ ID NO: 361514 - DNA, 25 bp, Homo sapien
tactagtgtaataccctagaaatgt

SEQ ID NO: 361515 - DNA, 25 bp, Homo sapien
gcctttatatgattgtcatacatga

SEQ ID NO: 361516 - DNA, 25 bp, Homo sapien
gattgtcatacatgattgtaggtga

SEQ ID NO: 361517 - DNA, 25 bp, Homo sapien
gtaggtgatagaagtcatactgcca

SEQ ID NO: 361518 - DNA, 25 bp, Homo sapien
gtcatactgccaaaactcctgtaag

SEQ ID NO: 361519 - DNA, 25 bp, Homo sapien
gccaaaactcctgtaagtgtgaaga

SEQ ID NO: 361520 - DNA, 25 bp, Homo sapien
agtgcttataccttatttcacagga

SEQ ID NO: 361521 - DNA, 25 bp, Homo sapien
gatattattttcgtggatacaagag

SEQ ID NO: 361522 - DNA, 25 bp, Homo sapien
aagacagagggagcggcccttacga

SEQ ID NO: 361523 - DNA, 25 bp, Homo sapien
ggcccttacgactgatttgtgttta

SEQ ID NO: 361524 - DNA, 25 bp, Homo sapien
gtgtttacacaataaggaaatctct

SEQ ID NO: 361525 - DNA, 25 bp, Homo sapien
gggtctctccgtagttcacagggac

SEQ ID NO: 361526 - DNA, 25 bp, Homo sapien
tccgtagttcacagggaccctgctt

SEQ ID NO: 361527 - DNA, 25 bp, Homo sapien
acgcgtggcgaagagagtccgtcca

SEQ ID NO: 361528 - DNA, 25 bp, Homo sapien
gaagagagtccgtccagagctccag

SEQ ID NO: 361529 - DNA, 25 bp, Homo sapien
tgcacttcccaggtgccaagacaaa

SEQ ID NO: 361530 - DNA, 25 bp, Homo sapien
gtgccaagacaaaacatcactgggt

SEQ ID NO: 361531 - DNA, 25 bp, Homo sapien
agaactgtcatgaggattattcccc

SEQ ID NO: 361532 - DNA, 25 bp, Homo sapien
gacacacacgacgacgtgttcgaga

SEQ ID NO: 361533 - DNA, 25 bp, Homo sapien
ggctctctagtctcgctggaggact

SEQ ID NO: 361534 - DNA, 25 bp, Homo sapien
cgtgttcgagaagggccttggtact

SEQ ID NO: 361535 - DNA, 25 bp, Homo sapien
gaaaggcaggaagtacccgcacagc

SEQ ID NO: 361536 - DNA, 25 bp, Homo sapien
tccccagatctgcaggtcaaggtca

SEQ ID NO: 361537 - DNA, 25 bp, Homo sapien
aggtcaaggtcatgtgtgcccgcat

SEQ ID NO: 361538 - DNA, 25 bp, Homo sapien
gctggaggactcgaacatcggtact

SEQ ID NO: 361539 - DNA, 25 bp, Homo sapien
aaggtcatgtgtgcccgcatttgca

SEQ ID NO: 361540 - DNA, 25 bp, Homo sapien
gaacatcggtacttccgagaccagc

SEQ ID NO: 361541 - DNA, 25 bp, Homo sapien
agtccaggtcctgggtctggctagc

SEQ ID NO: 361542 - DNA, 25 bp, Homo sapien
gtctggctagctcccaggccttgaa

SEQ ID NO: 361543 - DNA, 25 bp, Homo sapien
tgcatggcttcttgccccaaacttt

SEQ ID NO: 361544 - DNA, 25 bp, Homo sapien
caaacttttattgtgatggccctaa

SEQ ID NO: 361545 - DNA, 25 bp, Homo sapien
aacttttattgtgatggccctaata

SEQ ID NO: 361546 - DNA, 25 bp, Homo sapien
gtagcggaaactgaattttcaagac

SEQ ID NO: 361547 - DNA, 25 bp, Homo sapien
ctgaattttcaagacatttacaatg

SEQ ID NO: 361548 - DNA, 25 bp, Homo sapien
gaaatcatgttgcatttaacaatgt

SEQ ID NO: 361549 - DNA, 25 bp, Homo sapien
aatgtactttattagcaacttcacc

SEQ ID NO: 361550 - DNA, 25 bp, Homo sapien
ttagcaacttcaccaaatattcccc

SEQ ID NO: 361551 - DNA, 25 bp, Homo sapien
acttcaccaaatattccccaagtca

SEQ ID NO: 361552 - DNA, 25 bp, Homo sapien
tattccccaagtcataagcaacaat

SEQ ID NO: 361553 - DNA, 25 bp, Homo sapien
agtgcacagaatggtgacacccaca

SEQ ID NO: 361554 - DNA, 25 bp, Homo sapien
atgctaaaaacacaccaactgcctc

SEQ ID NO: 361555 - DNA, 25 bp, Homo sapien
caactgcctctttctgatattctga

SEQ ID NO: 361556 - DNA, 25 bp, Homo sapien
gaaacctaggaggacaggccttcgt

SEQ ID NO: 361557 - DNA, 25 bp, Homo sapien
gagctactcaaaatcctagagcttt

SEQ ID NO: 361558 - DNA, 25 bp, Homo sapien
ttttgaagagactccacttcccttc

SEQ ID NO: 361559 - DNA, 25 bp, Homo sapien
agcttcactgtttgacccatagcca

SEQ ID NO: 361560 - DNA, 25 bp, Homo sapien
ctgtttgacccatagccaggttttc

SEQ ID NO: 361561 - DNA, 25 bp, Homo sapien
tgttcccattaccatgtttaacggg

SEQ ID NO: 361562 - DNA, 25 bp, Homo sapien
ccagagtctaagatcactagttggt

SEQ ID NO: 361563 - DNA, 25 bp, Homo sapien
cactagttggtgattttacctttga

SEQ ID NO: 361564 - DNA, 25 bp, Homo sapien
tacctttgaagcctatgttcactga

SEQ ID NO: 361565 - DNA, 25 bp, Homo sapien
aaccattcactgcaatgcctattcc

SEQ ID NO: 361566 - DNA, 25 bp, Homo sapien
gcaatgcctattccaaactttaaat

SEQ ID NO: 361567 - DNA, 25 bp, Homo sapien
aaacctgaaggactgtagttagcgg

SEQ ID NO: 361568 - DNA, 25 bp, Homo sapien
atgatgttaagtgtggccaagcgca

SEQ ID NO: 361569 - DNA, 25 bp, Homo sapien
gcacggcggcaagttttcaagcact

SEQ ID NO: 361570 - DNA, 25 bp, Homo sapien
ttcaagcactgagtttctattccaa

SEQ ID NO: 361571 - DNA, 25 bp, Homo sapien
gagagtgacaaatgcttccttaatg

SEQ ID NO: 361572 - DNA, 25 bp, Homo sapien
acaaatgcttccttaatgtcttcta

SEQ ID NO: 361573 - DNA, 25 bp, Homo sapien
taatgtcttctataccagaatgtaa

SEQ ID NO: 361574 - DNA, 25 bp, Homo sapien
taacacactatatacttccaagaag

SEQ ID NO: 361575 - DNA, 25 bp, Homo sapien
cttccaagaagtatgtcaatgtcaa

SEQ ID NO: 361576 - DNA, 25 bp, Homo sapien
gatctcctcataatttgggctgtta

SEQ ID NO: 361577 - DNA, 25 bp, Homo sapien
ggctgttactgagccaagagcacag

SEQ ID NO: 361578 - DNA, 25 bp, Homo sapien
gtttaggctgcctacaggaaccaga

SEQ ID NO: 361579 - DNA, 25 bp, Homo sapien
tctgattctgtgtcatttacatgtg

SEQ ID NO: 361580 - DNA, 25 bp, Homo sapien
atgggaatcctcacttaccaacgtt

SEQ ID NO: 361581 - DNA, 25 bp, Homo sapien
taccaacgttggaggacaccgcccg

SEQ ID NO: 361582 - DNA, 25 bp, Homo sapien
accgcccggttcatgatatcaagtg

SEQ ID NO: 361583 - DNA, 25 bp, Homo sapien
caagtgcctcattaaatttgtcctt

SEQ ID NO: 361584 - DNA, 25 bp, Homo sapien
atggatgtgccagcacttggtctga

SEQ ID NO: 361585 - DNA, 25 bp, Homo sapien
tggtctgagaacatcgacttccaac

SEQ ID NO: 361586 - DNA, 25 bp, Homo sapien
aacccaggtaccacttggtgatctc

SEQ ID NO: 361587 - DNA, 25 bp, Homo sapien
atgtcatatgaccaaaacatgaaag

SEQ ID NO: 361588 - DNA, 25 bp, Homo sapien
tatgaccaaaacatgaaagactgtg

SEQ ID NO: 361589 - DNA, 25 bp, Homo sapien
atgaccaaaacatgaaagactgtga

SEQ ID NO: 361590 - DNA, 25 bp, Homo sapien
tgaccaaaacatgaaagactgtgaa

SEQ ID NO: 361591 - DNA, 25 bp, Homo sapien
gaccaaaacatgaaagactgtgaaa

SEQ ID NO: 361592 - DNA, 25 bp, Homo sapien
catgaaagactgtgaaaatgaatct

SEQ ID NO: 361593 - DNA, 25 bp, Homo sapien
gtgaaaatgaatctggaggtaatcc

SEQ ID NO: 361594 - DNA, 25 bp, Homo sapien
tgaaaatgaatctggaggtaatccc

SEQ ID NO: 361595 - DNA, 25 bp, Homo sapien
gaaaatgaatctggaggtaatccca

SEQ ID NO: 361596 - DNA, 25 bp, Homo sapien
aaaatgaatctggaggtaatcccag

SEQ ID NO: 361597 - DNA, 25 bp, Homo sapien
aaatgaatctggaggtaatcccagc

SEQ ID NO: 361598 - DNA, 25 bp, Homo sapien
atgtctccgaaacagagttgactca

SEQ ID NO: 361599 - DNA, 25 bp, Homo sapien
aggagcaagaaaacctcagccccgc

SEQ ID NO: 361600 - DNA, 25 bp, Homo sapien
cgcacctagtaaaattccgccaatt

SEQ ID NO: 361601 - DNA, 25 bp, Homo sapien
aattccgccaattgaatctcacgca

SEQ ID NO: 361602 - DNA, 25 bp, Homo sapien
gaatctcacgcacgctaacacgtgg

SEQ ID NO: 361603 - DNA, 25 bp, Homo sapien
gggagcgttgcttgcaccacgagtc

SEQ ID NO: 361604 - DNA, 25 bp, Homo sapien
gctcaaccgccgatgccaagtgtgt

SEQ ID NO: 361605 - DNA, 25 bp, Homo sapien
ccaagtgtgtggttccggttgcgac

SEQ ID NO: 361606 - DNA, 25 bp, Homo sapien
aagtggcttccggatgtgcgaatga

SEQ ID NO: 361607 - DNA, 25 bp, Homo sapien
gtgcgaatgaaccaggcagagtttc

SEQ ID NO: 361608 - DNA, 25 bp, Homo sapien
gcaatccaaatcgttatgtctccga

SEQ ID NO: 361609 - DNA, 25 bp, Homo sapien
aaatagttcagtattcccaaggctg

SEQ ID NO: 361610 - DNA, 25 bp, Homo sapien
gaaatatccactgtacctctggttc

SEQ ID NO: 361611 - DNA, 25 bp, Homo sapien
gtacctctggttctgaagagtctat

SEQ ID NO: 361612 - DNA, 25 bp, Homo sapien
tgaagagtctatagtcggccaacac

SEQ ID NO: 361613 - DNA, 25 bp, Homo sapien
tatagtcggccaacactgtgaatgt

SEQ ID NO: 361614 - DNA, 25 bp, Homo sapien
actttcatgttatttgccaccctga

SEQ ID NO: 361615 - DNA, 25 bp, Homo sapien
catgttatttgccaccctgacagct

SEQ ID NO: 361616 - DNA, 25 bp, Homo sapien
ctgacagctgagacactgcttttca

SEQ ID NO: 361617 - DNA, 25 bp, Homo sapien
aagctgagttaatttctatacctga

SEQ ID NO: 361618 - DNA, 25 bp, Homo sapien
tgaaatgttcatttgtctgctgaat

SEQ ID NO: 361619 - DNA, 25 bp, Homo sapien
ttgtctgctgaattcagggagcatt

SEQ ID NO: 361620 - DNA, 25 bp, Homo sapien
aatgacgtccttatggcatgattcc

SEQ ID NO: 361621 - DNA, 25 bp, Homo sapien
gaaatgtccatcagttgttctcttt

SEQ ID NO: 361622 - DNA, 25 bp, Homo sapien
gtccatcagttgttctcttttaagt

SEQ ID NO: 361623 - DNA, 25 bp, Homo sapien
gggaatgatccctaacttggagata

SEQ ID NO: 361624 - DNA, 25 bp, Homo sapien
gatggacgactcatgatttctgccc

SEQ ID NO: 361625 - DNA, 25 bp, Homo sapien
gaagagcagctcatgtccattcacc

SEQ ID NO: 361626 - DNA, 25 bp, Homo sapien
gatttctgccctagcagctaaaagt

SEQ ID NO: 361627 - DNA, 25 bp, Homo sapien
agctaaaagtcatccctgcaacaaa

SEQ ID NO: 361628 - DNA, 25 bp, Homo sapien
caacaaaattcttaactcccatccg

SEQ ID NO: 361629 - DNA, 25 bp, Homo sapien
ttcaccccgggttaacaatgcagtt

SEQ ID NO: 361630 - DNA, 25 bp, Homo sapien
ttaacaatgcagtttttaccctaat

SEQ ID NO: 361631 - DNA, 25 bp, Homo sapien
gctgccctttctgataggagctgta

SEQ ID NO: 361632 - DNA, 25 bp, Homo sapien
ttcagttcttaaacagcttcccatc

SEQ ID NO: 361633 - DNA, 25 bp, Homo sapien
taaacagcttcccatcaaccaagga

SEQ ID NO: 361634 - DNA, 25 bp, Homo sapien
gagacagcctctccagctgttttat

SEQ ID NO: 361635 - DNA, 25 bp, Homo sapien
tattgggagttataggattttcacc

SEQ ID NO: 361636 - DNA, 25 bp, Homo sapien
tttcatctggtttttggtttaacat

SEQ ID NO: 361637 - DNA, 25 bp, Homo sapien
ggattttcacctggaaggagcctca

SEQ ID NO: 361638 - DNA, 25 bp, Homo sapien
acataagtaggcctgcttgttctct

SEQ ID NO: 361639 - DNA, 25 bp, Homo sapien
ctgcttgttctctgagccagtaaca

SEQ ID NO: 361640 - DNA, 25 bp, Homo sapien
gagccagtaacaggctacctacaat

SEQ ID NO: 361641 - DNA, 25 bp, Homo sapien
gctacctacaattccacgggcgctg

SEQ ID NO: 361642 - DNA, 25 bp, Homo sapien
agctcttccctacgtgaccaaaagg

SEQ ID NO: 361643 - DNA, 25 bp, Homo sapien
gacggtggaaggcacgcccccttca

SEQ ID NO: 361644 - DNA, 25 bp, Homo sapien
aaccaggccgcctcgaaagccaatt

SEQ ID NO: 361645 - DNA, 25 bp, Homo sapien
aggccgcctcgaaagccaatttcct

SEQ ID NO: 361646 - DNA, 25 bp, Homo sapien
gcctcgaaagccaatttccttcgct

SEQ ID NO: 361647 - DNA, 25 bp, Homo sapien
ccccgaatttcggatcaatctgcaa

SEQ ID NO: 361648 - DNA, 25 bp, Homo sapien
gaatttcggatcaatctgcaacgtg

SEQ ID NO: 361649 - DNA, 25 bp, Homo sapien
atttcggatcaatctgcaacgtgac

SEQ ID NO: 361650 - DNA, 25 bp, Homo sapien
tcggatcaatctgcaacgtgacggc

SEQ ID NO: 361651 - DNA, 25 bp, Homo sapien
gatcaatctgcaacgtgacggcagc

SEQ ID NO: 361652 - DNA, 25 bp, Homo sapien
caatctgcaacgtgacggcagcagg

SEQ ID NO: 361653 - DNA, 25 bp, Homo sapien
tccgcggtgcctgtggtttttaaag

SEQ ID NO: 361654 - DNA, 25 bp, Homo sapien
aagtgatgctgaagcgagcaccttt

SEQ ID NO: 361655 - DNA, 25 bp, Homo sapien
aagcgagcacctttgtgcatatgtc

SEQ ID NO: 361656 - DNA, 25 bp, Homo sapien
tgcatatgtcttgatccacgcctga

SEQ ID NO: 361657 - DNA, 25 bp, Homo sapien
cttgatccacgcctgattttaaaat

SEQ ID NO: 361658 - DNA, 25 bp, Homo sapien
cgtcctgcgcggtttctaagtgaaa

SEQ ID NO: 361659 - DNA, 25 bp, Homo sapien
atcctgcgcggtttctgcatttggt

SEQ ID NO: 361660 - DNA, 25 bp, Homo sapien
ctgcatttggtgttgagttgtcctt

SEQ ID NO: 361661 - DNA, 25 bp, Homo sapien
tgagttgtcctttctgcatcggaat

SEQ ID NO: 361662 - DNA, 25 bp, Homo sapien
tctgcatcggaattctgactcctga

SEQ ID NO: 361663 - DNA, 25 bp, Homo sapien
aaatcacatttctcaccgtgtctag

SEQ ID NO: 361664 - DNA, 25 bp, Homo sapien
agtctcttagtgtgtggaactgttt

SEQ ID NO: 361665 - DNA, 25 bp, Homo sapien
aggtaacgtgctcagggtgctttca

SEQ ID NO: 361666 - DNA, 25 bp, Homo sapien
ggtgctttcaacagctagacttgta

SEQ ID NO: 361667 - DNA, 25 bp, Homo sapien
ttgtatactagttccagctgcgcag

SEQ ID NO: 361668 - DNA, 25 bp, Homo sapien
tgcgcagctctctagctaggtgact

SEQ ID NO: 361669 - DNA, 25 bp, Homo sapien
ctttgaacaagcagtccaaccttct

SEQ ID NO: 361670 - DNA, 25 bp, Homo sapien
aaccttctgagctcccattttcttt

SEQ ID NO: 361671 - DNA, 25 bp, Homo sapien
cagttaccaggtccagttctaaacg

SEQ ID NO: 361672 - DNA, 25 bp, Homo sapien
gaatgaaaactaccagctctcctga

SEQ ID NO: 361673 - DNA, 25 bp, Homo sapien
agctctcctgaaactaactgtaccc

SEQ ID NO: 361674 - DNA, 25 bp, Homo sapien
actgtaccctcgttaagtctcttag

SEQ ID NO: 361675 - DNA, 25 bp, Homo sapien
ccgacattggtaaagaggttatctt

SEQ ID NO: 361676 - DNA, 25 bp, Homo sapien
tttagttgggccttaaagacaatgg

SEQ ID NO: 361677 - DNA, 25 bp, Homo sapien
gagtggacactgtctgttggctccg

SEQ ID NO: 361678 - DNA, 25 bp, Homo sapien
gttggctccgtagctaacattcatt

SEQ ID NO: 361679 - DNA, 25 bp, Homo sapien
agctaacattcattacttgccttcc

SEQ ID NO: 361680 - DNA, 25 bp, Homo sapien
attacttgccttcccattactaaca

SEQ ID NO: 361681 - DNA, 25 bp, Homo sapien
ccattactaacagcgtccagacttt

SEQ ID NO: 361682 - DNA, 25 bp, Homo sapien
aacagcgtccagactttaacttgga

SEQ ID NO: 361683 - DNA, 25 bp, Homo sapien
taccataagctcaagtactttaggg

SEQ ID NO: 361684 - DNA, 25 bp, Homo sapien
gggaaagctgatcccacttcaagct

SEQ ID NO: 361685 - DNA, 25 bp, Homo sapien
tgatcccacttcaagcttcagtcgg

SEQ ID NO: 361686 - DNA, 25 bp, Homo sapien
gatactaagtttccctttcaataat

SEQ ID NO: 361687 - DNA, 25 bp, Homo sapien
gatgtgaccaaccaaggagaatttg

SEQ ID NO: 361688 - DNA, 25 bp, Homo sapien
agcaagggagcatctttaaatgttt

SEQ ID NO: 361689 - DNA, 25 bp, Homo sapien
ttttgtttaagcgatgtcttccatc

SEQ ID NO: 361690 - DNA, 25 bp, Homo sapien
aagcgatgtcttccatccaaagtaa

SEQ ID NO: 361691 - DNA, 25 bp, Homo sapien
agaataatactctcggaaggtcctt

SEQ ID NO: 361692 - DNA, 25 bp, Homo sapien
gaaggtccttttggtgtcatgtcac

SEQ ID NO: 361693 - DNA, 25 bp, Homo sapien
tggtgtcatgtcacttgctgtatgt

SEQ ID NO: 361694 - DNA, 25 bp, Homo sapien
acttgctgtatgtggcagccttaca

SEQ ID NO: 361695 - DNA, 25 bp, Homo sapien
cttacagtgccacacttgggtactg

SEQ ID NO: 361696 - DNA, 25 bp, Homo sapien
cagtgccacacttgggtactgaaaa

SEQ ID NO: 361697 - DNA, 25 bp, Homo sapien
agaaaacaccactacaagtacacac

SEQ ID NO: 361698 - DNA, 25 bp, Homo sapien
aagtacacactacatgaacacatgt

SEQ ID NO: 361699 - DNA, 25 bp, Homo sapien
tttcatatatgcatgttcaggatac

SEQ ID NO: 361700 - DNA, 25 bp, Homo sapien
ttacactttgccaatttctgcagac

SEQ ID NO: 361701 - DNA, 25 bp, Homo sapien
ttctgcagacatatgatcagctctc

SEQ ID NO: 361702 - DNA, 25 bp, Homo sapien
gatcagctctcattagagtgccgtc

SEQ ID NO: 361703 - DNA, 25 bp, Homo sapien
gctctcattagagtgccgtcaaaat

SEQ ID NO: 361704 - DNA, 25 bp, Homo sapien
gtgccgtcaaaatgagtactgtgaa

SEQ ID NO: 361705 - DNA, 25 bp, Homo sapien
gtactgtgaatagggaactcttaaa

SEQ ID NO: 361706 - DNA, 25 bp, Homo sapien
tccccagactacactatactaaact

SEQ ID NO: 361707 - DNA, 25 bp, Homo sapien
atactaaactcaccatctctacaga

SEQ ID NO: 361708 - DNA, 25 bp, Homo sapien
tctgccttctctttgtcagtgatga

SEQ ID NO: 361709 - DNA, 25 bp, Homo sapien
tgccttctctttgtcagtgatgacc

SEQ ID NO: 361710 - DNA, 25 bp, Homo sapien
ccttctctttgtcagtgatgaccag

SEQ ID NO: 361711 - DNA, 25 bp, Homo sapien
gtgtaaaggtatctgctgcatcgaa

SEQ ID NO: 361712 - DNA, 25 bp, Homo sapien
gtaaaggtatctgctgcatcgaact

SEQ ID NO: 361713 - DNA, 25 bp, Homo sapien
aaaggtatctgctgcatcgaacttt

SEQ ID NO: 361714 - DNA, 25 bp, Homo sapien
aggtatctgctgcatcgaactttaa

SEQ ID NO: 361715 - DNA, 25 bp, Homo sapien
gtatctgctgcatcgaactttaaac

SEQ ID NO: 361716 - DNA, 25 bp, Homo sapien
atctgctgcatcgaactttaaactt

SEQ ID NO: 361717 - DNA, 25 bp, Homo sapien
gctgcatcgaactttaaacttcacg

SEQ ID NO: 361718 - DNA, 25 bp, Homo sapien
catcgaactttaaacttcacgttgt

SEQ ID NO: 361719 - DNA, 25 bp, Homo sapien
gatggtgtttatatccacggactgt

SEQ ID NO: 361720 - DNA, 25 bp, Homo sapien
acggactgtatctcgatggcgcacg

SEQ ID NO: 361721 - DNA, 25 bp, Homo sapien
ggagctatgcagaattatgccagaa

SEQ ID NO: 361722 - DNA, 25 bp, Homo sapien
gattgcttgctgaacaatatcccaa

SEQ ID NO: 361723 - DNA, 25 bp, Homo sapien
aaacttctgtttgacctgatgccca

SEQ ID NO: 361724 - DNA, 25 bp, Homo sapien
gacctgatgcccatcatatggataa

SEQ ID NO: 361725 - DNA, 25 bp, Homo sapien
aaccaactcaaaaatctcggattat

SEQ ID NO: 361726 - DNA, 25 bp, Homo sapien
ttataaagtcggatgcctatgtctg

SEQ ID NO: 361727 - DNA, 25 bp, Homo sapien
gtctgtcccctctacaagacaagtg

SEQ ID NO: 361728 - DNA, 25 bp, Homo sapien
gaggttatcccatctgatacatctg

SEQ ID NO: 361729 - DNA, 25 bp, Homo sapien
gatacatctgacacatcaccagaag

SEQ ID NO: 361730 - DNA, 25 bp, Homo sapien
atcacaacacagtctcgggcaccga

SEQ ID NO: 361731 - DNA, 25 bp, Homo sapien
ctgacaatcatctctcatttgaaat

SEQ ID NO: 361732 - DNA, 25 bp, Homo sapien
aggagccaactctgctgtcagtgaa

SEQ ID NO: 361733 - DNA, 25 bp, Homo sapien
gacaaaggtagtaaaactgcagcta

SEQ ID NO: 361734 - DNA, 25 bp, Homo sapien
actgcagctaattggcatgaagcac

SEQ ID NO: 361735 - DNA, 25 bp, Homo sapien
tggaactcccatacagattctgcac

SEQ ID NO: 361736 - DNA, 25 bp, Homo sapien
gattctgcacccacctttaaagagt

SEQ ID NO: 361737 - DNA, 25 bp, Homo sapien
aaatctttcaatactagagctaggg

SEQ ID NO: 361738 - DNA, 25 bp, Homo sapien
gggtgtctcagggtgaaaatctcaa

SEQ ID NO: 361739 - DNA, 25 bp, Homo sapien
gaaaatctcaaacctattctccaag

SEQ ID NO: 361740 - DNA, 25 bp, Homo sapien
ggaacattcaggcagccacatcaca

SEQ ID NO: 361741 - DNA, 25 bp, Homo sapien
tgtgacccacactcatgttttaaaa

SEQ ID NO: 361742 - DNA, 25 bp, Homo sapien
gaaaacacgtaagaactggccatga

SEQ ID NO: 361743 - DNA, 25 bp, Homo sapien
agaactggccatgacagcctgtgtt

SEQ ID NO: 361744 - DNA, 25 bp, Homo sapien
gacagcctgtgtttctatgtaacta

SEQ ID NO: 361745 - DNA, 25 bp, Homo sapien
gaccaggagaggtgtgcccctgcca

SEQ ID NO: 361746 - DNA, 25 bp, Homo sapien
tgccatgctgccatttgttatcacc

SEQ ID NO: 361747 - DNA, 25 bp, Homo sapien
ttatcacccgcctgtcaaatcacag

SEQ ID NO: 361748 - DNA, 25 bp, Homo sapien
atttcaaggcaagaaccatgttcat

SEQ ID NO: 361749 - DNA, 25 bp, Homo sapien
ccatgttcataggttgtattctaaa

SEQ ID NO: 361750 - DNA, 25 bp, Homo sapien
tattctaaatggagcggcgtgccct

SEQ ID NO: 361751 - DNA, 25 bp, Homo sapien
gcggcgtgcccttactgaaggacta

SEQ ID NO: 361752 - DNA, 25 bp, Homo sapien
taactaacccacttctacaataaat

SEQ ID NO: 361753 - DNA, 25 bp, Homo sapien
attaagtgaacctctggcagtggcc

SEQ ID NO: 361754 - DNA, 25 bp, Homo sapien
ggcagtggccagattactggattct

SEQ ID NO: 361755 - DNA, 25 bp, Homo sapien
gattctgcgggtgacatgctccaaa

SEQ ID NO: 361756 - DNA, 25 bp, Homo sapien
atgctccaaagcacagtgtctctgc

SEQ ID NO: 361757 - DNA, 25 bp, Homo sapien
gagccgacattgctcaggtgcccag

SEQ ID NO: 361758 - DNA, 25 bp, Homo sapien
gtgcccaggcttgaagggtgtccac

SEQ ID NO: 361759 - DNA, 25 bp, Homo sapien
tgaagggtgtccaccaacacacagc

SEQ ID NO: 361760 - DNA, 25 bp, Homo sapien
tgtgttctccagagtgcagggcact

SEQ ID NO: 361761 - DNA, 25 bp, Homo sapien
gtgcagggcactaatggtgatctct

SEQ ID NO: 361762 - DNA, 25 bp, Homo sapien
gaacacaggagctgaacttcaactt

SEQ ID NO: 361763 - DNA, 25 bp, Homo sapien
ggaaacaaagtcattccttgttgga

SEQ ID NO: 361764 - DNA, 25 bp, Homo sapien
cattccttgttggaaaccacttgta

SEQ ID NO: 361765 - DNA, 25 bp, Homo sapien
aatggtggaattatacagtgacaga

SEQ ID NO: 361766 - DNA, 25 bp, Homo sapien
gaaaagctcaggtttttctgattag

SEQ ID NO: 361767 - DNA, 25 bp, Homo sapien
aagctgctcagaaattaaatcctac

SEQ ID NO: 361768 - DNA, 25 bp, Homo sapien
aattaaatcctactgtgttcataaa

SEQ ID NO: 361769 - DNA, 25 bp, Homo sapien
aagaactcatcagggaagttgtttt

SEQ ID NO: 361770 - DNA, 25 bp, Homo sapien
ctttaggctataccacacataccag

SEQ ID NO: 361771 - DNA, 25 bp, Homo sapien
ataccacacataccagtagcatcac

SEQ ID NO: 361772 - DNA, 25 bp, Homo sapien
gtagcatcaccacctaatcattata

SEQ ID NO: 361773 - DNA, 25 bp, Homo sapien
cactgacaagtgttctatggaaaca

SEQ ID NO: 361774 - DNA, 25 bp, Homo sapien
atgggctctgatgctgggtagacct

SEQ ID NO: 361775 - DNA, 25 bp, Homo sapien
tgatgctgggtagacctgggttcaa

SEQ ID NO: 361776 - DNA, 25 bp, Homo sapien
aaatccttagctactttatgcctca

SEQ ID NO: 361777 - DNA, 25 bp, Homo sapien
ctcagtttcctcattacttaatata

SEQ ID NO: 361778 - DNA, 25 bp, Homo sapien
tataagacaataccaacttcatagg

SEQ ID NO: 361779 - DNA, 25 bp, Homo sapien
aatttttccacgtgtatatgtgtaa

SEQ ID NO: 361780 - DNA, 25 bp, Homo sapien
gtgtaaaacataactttattcctgg

SEQ ID NO: 361781 - DNA, 25 bp, Homo sapien
ggtaaagtactatgctgtcaccctt

SEQ ID NO: 361782 - DNA, 25 bp, Homo sapien
ttgtcttgttttgtgggaatccttc

SEQ ID NO: 361783 - DNA, 25 bp, Homo sapien
aatccttccattaatttcctcctgc

SEQ ID NO: 361784 - DNA, 25 bp, Homo sapien
gattaggaatatgggctctgatgct

SEQ ID NO: 361785 - DNA, 25 bp, Homo sapien
gtcaggattccagaaaagcagactt

SEQ ID NO: 361786 - DNA, 25 bp, Homo sapien
aaacgttaacttgcagctcactgag

SEQ ID NO: 361787 - DNA, 25 bp, Homo sapien
gaggcccttacacttgttctgggca

SEQ ID NO: 361788 - DNA, 25 bp, Homo sapien
ttgttctgggcacctctgtatgtta

SEQ ID NO: 361789 - DNA, 25 bp, Homo sapien
agaagtccaatatctttagctgctg

SEQ ID NO: 361790 - DNA, 25 bp, Homo sapien
ttagctgctggttataggtggccat

SEQ ID NO: 361791 - DNA, 25 bp, Homo sapien
aggtggccatatgtttctgcacaga

SEQ ID NO: 361792 - DNA, 25 bp, Homo sapien
cacctcagacactaaccagacttta

SEQ ID NO: 361793 - DNA, 25 bp, Homo sapien
gggctccccttgctagactaatttt

SEQ ID NO: 361794 - DNA, 25 bp, Homo sapien
cagactttaggtccattcctttcat

SEQ ID NO: 361795 - DNA, 25 bp, Homo sapien
gagacagtccacaatgttgatttta

SEQ ID NO: 361796 - DNA, 25 bp, Homo sapien
tttaatcacttcacagtcctgggat

SEQ ID NO: 361797 - DNA, 25 bp, Homo sapien
tcctgggatacctagactttgagtc

SEQ ID NO: 361798 - DNA, 25 bp, Homo sapien
gactttgagtcattgctgaggctat

SEQ ID NO: 361799 - DNA, 25 bp, Homo sapien
gctgaggctatatcgtcactttaga

SEQ ID NO: 361800 - DNA, 25 bp, Homo sapien
acttatctctgaggtcatctgttcc

SEQ ID NO: 361801 - DNA, 25 bp, Homo sapien
ctcttcacctcagctttcatgagag

SEQ ID NO: 361802 - DNA, 25 bp, Homo sapien
gctttcatgagaggcttgtcttaaa

SEQ ID NO: 361803 - DNA, 25 bp, Homo sapien
tgacttctagtgtgtttgttcatac

SEQ ID NO: 361804 - DNA, 25 bp, Homo sapien
gttcatacttggttgttgggcaatc

SEQ ID NO: 361805 - DNA, 25 bp, Homo sapien
agagatttagtctagcagtccagat

SEQ ID NO: 361806 - DNA, 25 bp, Homo sapien
gcagtccagataagagaatctcttt

SEQ ID NO: 361807 - DNA, 25 bp, Homo sapien
gatatagtattcacaagtctccaca

SEQ ID NO: 361808 - DNA, 25 bp, Homo sapien
cctcaccaacacatccagagtggaa

SEQ ID NO: 361809 - DNA, 25 bp, Homo sapien
ggaaggcaggagacttgttccaaga

SEQ ID NO: 361810 - DNA, 25 bp, Homo sapien
ggagacttgttccaagaggctttaa

SEQ ID NO: 361811 - DNA, 25 bp, Homo sapien
tgttccaagaggctttaaaaagacg

SEQ ID NO: 361812 - DNA, 25 bp, Homo sapien
gacgaaaagagataactaatgccag

SEQ ID NO: 361813 - DNA, 25 bp, Homo sapien
gtctgtgattcagggcacaaactac

SEQ ID NO: 361814 - DNA, 25 bp, Homo sapien
cagggcacaaactactgaaaagttg

SEQ ID NO: 361815 - DNA, 25 bp, Homo sapien
gaaaagttggaactaaggatcctca

SEQ ID NO: 361816 - DNA, 25 bp, Homo sapien
ttggaactaaggatcctcaaaagga

SEQ ID NO: 361817 - DNA, 25 bp, Homo sapien
caaaaggatatctcaaggttgaaag

SEQ ID NO: 361818 - DNA, 25 bp, Homo sapien
atcactgcctctagggtctttacaa

SEQ ID NO: 361819 - DNA, 25 bp, Homo sapien
tgcctctagggtctttacaagggac

SEQ ID NO: 361820 - DNA, 25 bp, Homo sapien
ttacaagggacagcgaacgtaaggt

SEQ ID NO: 361821 - DNA, 25 bp, Homo sapien
gaacgtaaggtttcggagctggctt

SEQ ID NO: 361822 - DNA, 25 bp, Homo sapien
taaggtttcggagctggcttcgccc

SEQ ID NO: 361823 - DNA, 25 bp, Homo sapien
agcagagggcaaactacgttcccat

SEQ ID NO: 361824 - DNA, 25 bp, Homo sapien
ggctggtcatccttcgggccaggct

SEQ ID NO: 361825 - DNA, 25 bp, Homo sapien
tccttcgggccaggctgactgtcta

SEQ ID NO: 361826 - DNA, 25 bp, Homo sapien
tcggatacctggtccccgcaggtga

SEQ ID NO: 361827 - DNA, 25 bp, Homo sapien
actacgttcccattaaagccacaag

SEQ ID NO: 361828 - DNA, 25 bp, Homo sapien
ccttggaaaagcacacttcaaccct

SEQ ID NO: 361829 - DNA, 25 bp, Homo sapien
ttgtttttctcagcactgcttaaaa

SEQ ID NO: 361830 - DNA, 25 bp, Homo sapien
gcaatgtatttggaaaaccccttat

SEQ ID NO: 361831 - DNA, 25 bp, Homo sapien
taaatttcagtgcatccataggatg

SEQ ID NO: 361832 - DNA, 25 bp, Homo sapien
ggatgggacaatatgggacctttgc

SEQ ID NO: 361833 - DNA, 25 bp, Homo sapien
atatgggacctttgcagatgtcagt

SEQ ID NO: 361834 - DNA, 25 bp, Homo sapien
acctttgcagatgtcagtagataca

SEQ ID NO: 361835 - DNA, 25 bp, Homo sapien
cagatgtatgttgaggtgtgaagat

SEQ ID NO: 361836 - DNA, 25 bp, Homo sapien
aggtgtgaagatgtactctgaaaaa

SEQ ID NO: 361837 - DNA, 25 bp, Homo sapien
aaaaatgtatgtgcccttcacccat

SEQ ID NO: 361838 - DNA, 25 bp, Homo sapien
tgtatgtgcccttcacccatcaatt

SEQ ID NO: 361839 - DNA, 25 bp, Homo sapien
agagatacatgcaatttgtttttct

SEQ ID NO: 361840 - DNA, 25 bp, Homo sapien
gacactgaagctggaatctggaaca

SEQ ID NO: 361841 - DNA, 25 bp, Homo sapien
tggacacatactggcacatcacaag

SEQ ID NO: 361842 - DNA, 25 bp, Homo sapien
caagcatgattgttatggtctcaaa

SEQ ID NO: 361843 - DNA, 25 bp, Homo sapien
tctcaaaagtgtgggaggatctccc

SEQ ID NO: 361844 - DNA, 25 bp, Homo sapien
ggatctcccaatcccaagagttttg

SEQ ID NO: 361845 - DNA, 25 bp, Homo sapien
ggaactgcttgttcactctgggaca

SEQ ID NO: 361846 - DNA, 25 bp, Homo sapien
ttcactctgggacacttagccttct

SEQ ID NO: 361847 - DNA, 25 bp, Homo sapien
tagccttctgcttattagtcctttt

SEQ ID NO: 361848 - DNA, 25 bp, Homo sapien
tagtccttttgctgtgttcttacca

SEQ ID NO: 361849 - DNA, 25 bp, Homo sapien
ttcttaccaggttgagggacacttc

SEQ ID NO: 361850 - DNA, 25 bp, Homo sapien
gggacacttctttccataaatgcag

SEQ ID NO: 361851 - DNA, 25 bp, Homo sapien
gtttatgagccacccagtttaaggt

SEQ ID NO: 361852 - DNA, 25 bp, Homo sapien
gagccacccagtttaaggtattttg

SEQ ID NO: 361853 - DNA, 25 bp, Homo sapien
aagagctggctgatttgtgcgtgtc

SEQ ID NO: 361854 - DNA, 25 bp, Homo sapien
ctggctgatttgtgcgtgtctgcgc

SEQ ID NO: 361855 - DNA, 25 bp, Homo sapien
tgtctgcgctgtgtcccaatgaaag

SEQ ID NO: 361856 - DNA, 25 bp, Homo sapien
atgaacattgattctgcaatcgatg

SEQ ID NO: 361857 - DNA, 25 bp, Homo sapien
ctgcaatcgatgtttgaaggtcaaa

SEQ ID NO: 361858 - DNA, 25 bp, Homo sapien
gaaaagcattgtactccccaaaact

SEQ ID NO: 361859 - DNA, 25 bp, Homo sapien
attgtactccccaaaactgtgccag

SEQ ID NO: 361860 - DNA, 25 bp, Homo sapien
tgccagccaggttaactttttgcga

SEQ ID NO: 361861 - DNA, 25 bp, Homo sapien
aactttttgcgagatgctacagatt

SEQ ID NO: 361862 - DNA, 25 bp, Homo sapien
gcaaagttccctcaaggtgtaccgt

SEQ ID NO: 361863 - DNA, 25 bp, Homo sapien
caaagttccctcaaggtgtaccgtg

SEQ ID NO: 361864 - DNA, 25 bp, Homo sapien
gtgggcactcttccccagcacttta

SEQ ID NO: 361865 - DNA, 25 bp, Homo sapien
agcactttagcagtaattcccccag

SEQ ID NO: 361866 - DNA, 25 bp, Homo sapien
tttagcagtaattcccccagctaca

SEQ ID NO: 361867 - DNA, 25 bp, Homo sapien
agctacacgctgcagttgtactctg

SEQ ID NO: 361868 - DNA, 25 bp, Homo sapien
agctctgctgtccttttacttgtag

SEQ ID NO: 361869 - DNA, 25 bp, Homo sapien
tctgctgtccttttacttgtagctg

SEQ ID NO: 361870 - DNA, 25 bp, Homo sapien
gctgtccttttacttgtagctggat

SEQ ID NO: 361871 - DNA, 25 bp, Homo sapien
attaatattgttgccagcatagcag

SEQ ID NO: 361872 - DNA, 25 bp, Homo sapien
aactgaagagtctccatatgtcaaa

SEQ ID NO: 361873 - DNA, 25 bp, Homo sapien
atttccagtttgatgctgcaatacc

SEQ ID NO: 361874 - DNA, 25 bp, Homo sapien
ttgatgctgcaataccactgtgctg

SEQ ID NO: 361875 - DNA, 25 bp, Homo sapien
ataccactgtgctgaacgtctctgg

SEQ ID NO: 361876 - DNA, 25 bp, Homo sapien
gaacgtctctggcacattcatcttg

SEQ ID NO: 361877 - DNA, 25 bp, Homo sapien
ctctggcacattcatcttggttgca

SEQ ID NO: 361878 - DNA, 25 bp, Homo sapien
tggttgcaattgtactttaggctat

SEQ ID NO: 361879 - DNA, 25 bp, Homo sapien
tttaggctatatttctaagagcgaa

SEQ ID NO: 361880 - DNA, 25 bp, Homo sapien
taagagcgaaatgaccacagccaaa

SEQ ID NO: 361881 - DNA, 25 bp, Homo sapien
gaccacagccaaaggtatgaacatt

SEQ ID NO: 361882 - DNA, 25 bp, Homo sapien
atgaacattgttcaggctttcaata

SEQ ID NO: 361883 - DNA, 25 bp, Homo sapien
ggctttcaataaagactgccagata

SEQ ID NO: 361884 - DNA, 25 bp, Homo sapien
ggaaacatctaagtgtgactcctcc

SEQ ID NO: 361885 - DNA, 25 bp, Homo sapien
gtgtgactcctccaaaatcactctt

SEQ ID NO: 361886 - DNA, 25 bp, Homo sapien
aatcactcttgcttccaattttgtc

SEQ ID NO: 361887 - DNA, 25 bp, Homo sapien
aattttgtctgctgttatggaggtc

SEQ ID NO: 361888 - DNA, 25 bp, Homo sapien
gaatgtgatcattctctgagtctca

SEQ ID NO: 361889 - DNA, 25 bp, Homo sapien
tatggaggtcagcaactagtataaa

SEQ ID NO: 361890 - DNA, 25 bp, Homo sapien
ataaaatcctgaggtcagcccttcc

SEQ ID NO: 361891 - DNA, 25 bp, Homo sapien
cacagttcgctgatgatgctgcttc

SEQ ID NO: 361892 - DNA, 25 bp, Homo sapien
taaaccttcatcatctcagggcgcc

SEQ ID NO: 361893 - DNA, 25 bp, Homo sapien
gttttccatccatgaatccttgtga

SEQ ID NO: 361894 - DNA, 25 bp, Homo sapien
atttttcatgtaggactgtcacgag

SEQ ID NO: 361895 - DNA, 25 bp, Homo sapien
agattggaggtattcttagtagttc

SEQ ID NO: 361896 - DNA, 25 bp, Homo sapien
attcttagtagttctgagttgatag

SEQ ID NO: 361897 - DNA, 25 bp, Homo sapien
gttctgagttgatagtttacattac

SEQ ID NO: 361898 - DNA, 25 bp, Homo sapien
gtttacattacaattaggtcttgaa

SEQ ID NO: 361899 - DNA, 25 bp, Homo sapien
gagaaaaaactaccaaatatccaat

SEQ ID NO: 361900 - DNA, 25 bp, Homo sapien
gggtaagcccatgatgtagccacta

SEQ ID NO: 361901 - DNA, 25 bp, Homo sapien
aagcccatgatgtagccactagtac

SEQ ID NO: 361902 - DNA, 25 bp, Homo sapien
tagccactagtacaataaaaatctg

SEQ ID NO: 361903 - DNA, 25 bp, Homo sapien
gcataaacttgatgcagctgcctcc

SEQ ID NO: 361904 - DNA, 25 bp, Homo sapien
tgatgcagctgcctccctcattcaa

SEQ ID NO: 361905 - DNA, 25 bp, Homo sapien
aactggggagttcttgagttcctca

SEQ ID NO: 361906 - DNA, 25 bp, Homo sapien
aaagtactcattcatgtcacatcta

SEQ ID NO: 361907 - DNA, 25 bp, Homo sapien
cacatctatttattttctgccttat

SEQ ID NO: 361908 - DNA, 25 bp, Homo sapien
ttttctgccttataccaagcttgtg

SEQ ID NO: 361909 - DNA, 25 bp, Homo sapien
taccaagcttgtgggattctcttaa

SEQ ID NO: 361910 - DNA, 25 bp, Homo sapien
tatacttacacctatgcaataccca

SEQ ID NO: 361911 - DNA, 25 bp, Homo sapien
atgcaatacccattagcatcgcctt

SEQ ID NO: 361912 - DNA, 25 bp, Homo sapien
ttagcatcgccttcctaaatcaggg

SEQ ID NO: 361913 - DNA, 25 bp, Homo sapien
ttgagtctctgtaaggtgcagtaac

SEQ ID NO: 361914 - DNA, 25 bp, Homo sapien
aatatcctgccctcttctcatttgt

SEQ ID NO: 361915 - DNA, 25 bp, Homo sapien
tctcatttgtctttactgcctttta

SEQ ID NO: 361916 - DNA, 25 bp, Homo sapien
ctgccttttatgtatgtgttagatg

SEQ ID NO: 361917 - DNA, 25 bp, Homo sapien
ccaggatcctgacattctgtggaaa

SEQ ID NO: 361918 - DNA, 25 bp, Homo sapien
gagtgcttgctcaaaggtcgatgat

SEQ ID NO: 361919 - DNA, 25 bp, Homo sapien
gtcgatgatgtgctacagatggcat

SEQ ID NO: 361920 - DNA, 25 bp, Homo sapien
atggcatcacctgttagagacagag

SEQ ID NO: 361921 - DNA, 25 bp, Homo sapien
gagctttctcaagaggagctttgat

SEQ ID NO: 361922 - DNA, 25 bp, Homo sapien
ttgatttcctttacttcccgaactg

SEQ ID NO: 361923 - DNA, 25 bp, Homo sapien
ttacttcccgaactgctatttcaca

SEQ ID NO: 361924 - DNA, 25 bp, Homo sapien
ctgctatttcacagtctctcagtag

SEQ ID NO: 361925 - DNA, 25 bp, Homo sapien
acagtctctcagtagatgtcagcag

SEQ ID NO: 361926 - DNA, 25 bp, Homo sapien
tcagtagatgtcagcagcacagcaa

SEQ ID NO: 361927 - DNA, 25 bp, Homo sapien
aaacatctcactgcccatcatggaa

SEQ ID NO: 361928 - DNA, 25 bp, Homo sapien
gctcttcaaggccactcttaagtac

SEQ ID NO: 361929 - DNA, 25 bp, Homo sapien
aggccactcttaagtacactgctga

SEQ ID NO: 361930 - DNA, 25 bp, Homo sapien
aagtacactgctgacctttctaggg

SEQ ID NO: 361931 - DNA, 25 bp, Homo sapien
gagttagcaactcaacaggtacatt

SEQ ID NO: 361932 - DNA, 25 bp, Homo sapien
ttcctaatgctttttgactggctta

SEQ ID NO: 361933 - DNA, 25 bp, Homo sapien
aatgctttttgactggcttaatcaa

SEQ ID NO: 361934 - DNA, 25 bp, Homo sapien
catctttagatgaggctgtaacttg

SEQ ID NO: 361935 - DNA, 25 bp, Homo sapien
gaggctgtaacttgtggagtagata

SEQ ID NO: 361936 - DNA, 25 bp, Homo sapien
attagctgaaaagcggcagttgcgg

SEQ ID NO: 361937 - DNA, 25 bp, Homo sapien
cagttgcggagctttgaagagatta

SEQ ID NO: 361938 - DNA, 25 bp, Homo sapien
ggctgtcaatcccataattaaactg

SEQ ID NO: 361939 - DNA, 25 bp, Homo sapien
ggactagtacgtggatgcattcata

SEQ ID NO: 361940 - DNA, 25 bp, Homo sapien
aatatgaccattgcagtgtaatctg

SEQ ID NO: 361941 - DNA, 25 bp, Homo sapien
gtgtaatctgactgctcactctaga

SEQ ID NO: 361942 - DNA, 25 bp, Homo sapien
gctcactctagagaacacttctgtt

SEQ ID NO: 361943 - DNA, 25 bp, Homo sapien
gaacacttctgttatacacaatgca

SEQ ID NO: 361944 - DNA, 25 bp, Homo sapien
aaacatacacccctaaagcgtagct

SEQ ID NO: 361945 - DNA, 25 bp, Homo sapien
taaagcgtagctaactgctcccact

SEQ ID NO: 361946 - DNA, 25 bp, Homo sapien
actgctcccactagataattgctgc

SEQ ID NO: 361947 - DNA, 25 bp, Homo sapien
gatgcattcataggctttgggaagc

SEQ ID NO: 361948 - DNA, 25 bp, Homo sapien
cgtatgtgtgtctatatcaatattt

SEQ ID NO: 361949 - DNA, 25 bp, Homo sapien
atgtttataactctgcgtattaagt

SEQ ID NO: 361950 - DNA, 25 bp, Homo sapien
gggtatgtctgccttaccagttatt

SEQ ID NO: 361951 - DNA, 25 bp, Homo sapien
atgtctgccttaccagttattcaca

SEQ ID NO: 361952 - DNA, 25 bp, Homo sapien
ggcacggaggccaaaatccaatgga

SEQ ID NO: 361953 - DNA, 25 bp, Homo sapien
gagaagtgaaacagccttttttcca

SEQ ID NO: 361954 - DNA, 25 bp, Homo sapien
ctgccttaccagttattcacaaaaa

SEQ ID NO: 361955 - DNA, 25 bp, Homo sapien
aaaccgtagtgcataaagaattgac

SEQ ID NO: 361956 - DNA, 25 bp, Homo sapien
aagaattgacgctgcagtttcattt

SEQ ID NO: 361957 - DNA, 25 bp, Homo sapien
ttgacgctgcagtttcattttttat

SEQ ID NO: 361958 - DNA, 25 bp, Homo sapien
acttatatgaaacgcagtcctcctc

SEQ ID NO: 361959 - DNA, 25 bp, Homo sapien
tatgaaacgcagtcctcctcagagt

SEQ ID NO: 361960 - DNA, 25 bp, Homo sapien
cagtcctcctcagagtcattcagga

SEQ ID NO: 361961 - DNA, 25 bp, Homo sapien
agaggacctgtcagataggcagccc

SEQ ID NO: 361962 - DNA, 25 bp, Homo sapien
taggcagccccatgctacgtgattc

SEQ ID NO: 361963 - DNA, 25 bp, Homo sapien
ggcagccccatgctacgtgattctt

SEQ ID NO: 361964 - DNA, 25 bp, Homo sapien
agccccatgctacgtgattctttat

SEQ ID NO: 361965 - DNA, 25 bp, Homo sapien
gccccatgctacgtgattctttatg

SEQ ID NO: 361966 - DNA, 25 bp, Homo sapien
ccccatgctacgtgattctttatgt

SEQ ID NO: 361967 - DNA, 25 bp, Homo sapien
ccatgctacgtgattctttatgttg

SEQ ID NO: 361968 - DNA, 25 bp, Homo sapien
gctacgtgattctttatgttgtgtt

SEQ ID NO: 361969 - DNA, 25 bp, Homo sapien
aaatcttgttatggccttaagaagg

SEQ ID NO: 361970 - DNA, 25 bp, Homo sapien
gggataaaatagctgtttcacaaac

SEQ ID NO: 361971 - DNA, 25 bp, Homo sapien
aaaatagctgtttcacaaacagttt

SEQ ID NO: 361972 - DNA, 25 bp, Homo sapien
cacgttacgtcgctccttctggcct

SEQ ID NO: 361973 - DNA, 25 bp, Homo sapien
ctcttcttccgggacgacgaattgc

SEQ ID NO: 361974 - DNA, 25 bp, Homo sapien
tcttcttccgggacgacgaattgcg

SEQ ID NO: 361975 - DNA, 25 bp, Homo sapien
ttcttccgggacgacgaattgcggg

SEQ ID NO: 361976 - DNA, 25 bp, Homo sapien
cattgcttcccattggctggtcagg

SEQ ID NO: 361977 - DNA, 25 bp, Homo sapien
ttgcttcccattggctggtcaggtc

SEQ ID NO: 361978 - DNA, 25 bp, Homo sapien
cttcccattggctggtcaggtcccg

SEQ ID NO: 361979 - DNA, 25 bp, Homo sapien
cattggctggtcaggtcccgcgcga

SEQ ID NO: 361980 - DNA, 25 bp, Homo sapien
ggctggtcaggtcccgcgcgagcgg

SEQ ID NO: 361981 - DNA, 25 bp, Homo sapien
caaaaccgggccatgcctctctcct

SEQ ID NO: 361982 - DNA, 25 bp, Homo sapien
tcatatcctccaatcaactccctct

SEQ ID NO: 361983 - DNA, 25 bp, Homo sapien
ttgtcattttcgtgcactaagtgga

SEQ ID NO: 361984 - DNA, 25 bp, Homo sapien
ttcgtgcactaagtggaaggaggca

SEQ ID NO: 361985 - DNA, 25 bp, Homo sapien
ggctggaaggtgatatgtgcctcct

SEQ ID NO: 361986 - DNA, 25 bp, Homo sapien
tgcttccagcagaccttataactgt

SEQ ID NO: 361987 - DNA, 25 bp, Homo sapien
tataactgtgtctctttgcatgccc

SEQ ID NO: 361988 - DNA, 25 bp, Homo sapien
tgtctctttgcatgcccactagaaa

SEQ ID NO: 361989 - DNA, 25 bp, Homo sapien
ctttgcatgcccactagaaagggat

SEQ ID NO: 361990 - DNA, 25 bp, Homo sapien
gaagccattagaagttgatgcccag

SEQ ID NO: 361991 - DNA, 25 bp, Homo sapien
attagaagttgatgcccagtgatcc

SEQ ID NO: 361992 - DNA, 25 bp, Homo sapien
gaagtctaactcatcaggtagccac

SEQ ID NO: 361993 - DNA, 25 bp, Homo sapien
gtctaactcatcaggtagccacagc

SEQ ID NO: 361994 - DNA, 25 bp, Homo sapien
atgacgcattcatggaggttgagat

SEQ ID NO: 361995 - DNA, 25 bp, Homo sapien
tatttcaggctaactattttgtcag

SEQ ID NO: 361996 - DNA, 25 bp, Homo sapien
taagtggcccaattaaccattaccg

SEQ ID NO: 361997 - DNA, 25 bp, Homo sapien
tattttgtcagaagccagtcattgg

SEQ ID NO: 361998 - DNA, 25 bp, Homo sapien
gccagtcattggcttcagcaagacc

SEQ ID NO: 361999 - DNA, 25 bp, Homo sapien
tggcccaattaaccattaccgaaat

SEQ ID NO: 362000 - DNA, 25 bp, Homo sapien
gaccaacctgacatagtgaacaaat

SEQ ID NO: 362001 - DNA, 25 bp, Homo sapien
gtgaacaaattgatatggacatttc

SEQ ID NO: 362002 - DNA, 25 bp, Homo sapien
gattgacttttctttatcttctatg

SEQ ID NO: 362003 - DNA, 25 bp, Homo sapien
ctttatcttctatgaagggtctgta

SEQ ID NO: 362004 - DNA, 25 bp, Homo sapien
taccgaaatatcttcagctgcctgc

SEQ ID NO: 362005 - DNA, 25 bp, Homo sapien
gtgctactgttctttacatcttgtg

SEQ ID NO: 362006 - DNA, 25 bp, Homo sapien
cttgtgactgtctcttactgggaat

SEQ ID NO: 362007 - DNA, 25 bp, Homo sapien
gaacacgcctcctcatgattaaggg

SEQ ID NO: 362008 - DNA, 25 bp, Homo sapien
gaagaatgatcctcctggcctggaa

SEQ ID NO: 362009 - DNA, 25 bp, Homo sapien
gtctcagcataacactaccaggttt

SEQ ID NO: 362010 - DNA, 25 bp, Homo sapien
tttggatgactgtgtagcctcagct

SEQ ID NO: 362011 - DNA, 25 bp, Homo sapien
agctagtccatgtccatcagtctca

SEQ ID NO: 362012 - DNA, 25 bp, Homo sapien
ggcccataccttttttgactggaca

SEQ ID NO: 362013 - DNA, 25 bp, Homo sapien
tttttgactggacattcctggagga

SEQ ID NO: 362014 - DNA, 25 bp, Homo sapien
gaagtttgccgagaaagatcccaac

SEQ ID NO: 362015 - DNA, 25 bp, Homo sapien
atcccaacaggattcttgtaacttc

SEQ ID NO: 362016 - DNA, 25 bp, Homo sapien
gactggcacagttaaagaatcgtga

SEQ ID NO: 362017 - DNA, 25 bp, Homo sapien
gaagttccgcacagaactagactca

SEQ ID NO: 362018 - DNA, 25 bp, Homo sapien
agactcaatattagatgttctccga

SEQ ID NO: 362019 - DNA, 25 bp, Homo sapien
tagatgttctccgagagctgcaccg

SEQ ID NO: 362020 - DNA, 25 bp, Homo sapien
tccgagagctgcaccggcaaggagt

SEQ ID NO: 362021 - DNA, 25 bp, Homo sapien
gatgaaatgaatgcaccagagtatt

SEQ ID NO: 362022 - DNA, 25 bp, Homo sapien
ctgaagatggatgggattgtgccac

SEQ ID NO: 362023 - DNA, 25 bp, Homo sapien
ggattgtgccactgtcaggacagct

SEQ ID NO: 362024 - DNA, 25 bp, Homo sapien
actgtcaggacagcttatgaaaaac

SEQ ID NO: 362025 - DNA, 25 bp, Homo sapien
gtgttccaatatgtttccagaaagc

SEQ ID NO: 362026 - DNA, 25 bp, Homo sapien
gaaagcaaacaaccaaagcaacatt

SEQ ID NO: 362027 - DNA, 25 bp, Homo sapien
aactagtcattagagccggttcttt

SEQ ID NO: 362028 - DNA, 25 bp, Homo sapien
agccggttctttcatgccaggaaaa

SEQ ID NO: 362029 - DNA, 25 bp, Homo sapien
ggaaaaagttactcagccaaatctg

SEQ ID NO: 362030 - DNA, 25 bp, Homo sapien
aaatctgaactactctcctgcagtt

SEQ ID NO: 362031 - DNA, 25 bp, Homo sapien
tctcctgcagtttacacaggtggta

SEQ ID NO: 362032 - DNA, 25 bp, Homo sapien
ggtggtatttaattgctgtctgtat

SEQ ID NO: 362033 - DNA, 25 bp, Homo sapien
gctgtggacttgttgtgattgtcac

SEQ ID NO: 362034 - DNA, 25 bp, Homo sapien
aatcaagattccctttgtggtgctt

SEQ ID NO: 362035 - DNA, 25 bp, Homo sapien
gccttagaccccaaagtccatttat

SEQ ID NO: 362036 - DNA, 25 bp, Homo sapien
aaagtccatttatgtgtgggcaaat

SEQ ID NO: 362037 - DNA, 25 bp, Homo sapien
caaagcactagatctaatgtccagt

SEQ ID NO: 362038 - DNA, 25 bp, Homo sapien
gccctcggaggcacaggaccgcggg

SEQ ID NO: 362039 - DNA, 25 bp, Homo sapien
agcgtggggaccaaactgccgcgcc

SEQ ID NO: 362040 - DNA, 25 bp, Homo sapien
tgtccccgcgtctgaggtccgcaag

SEQ ID NO: 362041 - DNA, 25 bp, Homo sapien
ccgcgtctgaggtccgcaaggaaga

SEQ ID NO: 362042 - DNA, 25 bp, Homo sapien
tctgaggtccgcaaggaagagctgc

SEQ ID NO: 362043 - DNA, 25 bp, Homo sapien
aagagctgcgggaatgcacgcccgg

SEQ ID NO: 362044 - DNA, 25 bp, Homo sapien
tttgtgaaccgaggctcggcgcgcc

SEQ ID NO: 362045 - DNA, 25 bp, Homo sapien
tcagtttctccaccgcacaccctgg

SEQ ID NO: 362046 - DNA, 25 bp, Homo sapien
accctggcctgagggtagcagccga

SEQ ID NO: 362047 - DNA, 25 bp, Homo sapien
tggcctgagggtagcagccgaccca

SEQ ID NO: 362048 - DNA, 25 bp, Homo sapien
ctgagggtagcagccgacccagtcg

SEQ ID NO: 362049 - DNA, 25 bp, Homo sapien
cgcgagccgaatgcacatgtagagg

SEQ ID NO: 362050 - DNA, 25 bp, Homo sapien
ccactgaactgggacctgcctgttg

SEQ ID NO: 362051 - DNA, 25 bp, Homo sapien
gacctgcctgttgaactcatggcgc

SEQ ID NO: 362052 - DNA, 25 bp, Homo sapien
tgttgaactcatggcgcttcctctc

SEQ ID NO: 362053 - DNA, 25 bp, Homo sapien
tcactctgggccaacgcctgggcag

SEQ ID NO: 362054 - DNA, 25 bp, Homo sapien
gcctgggcagcttcttcatgtaaat

SEQ ID NO: 362055 - DNA, 25 bp, Homo sapien
gggcagcttcttcatgtaaatcttc

SEQ ID NO: 362056 - DNA, 25 bp, Homo sapien
agttgcttttagagcttcctctcat

SEQ ID NO: 362057 - DNA, 25 bp, Homo sapien
agggcactgtgtccaacagcatctg

SEQ ID NO: 362058 - DNA, 25 bp, Homo sapien
gggcttcaagtctgtcaccaggttg

SEQ ID NO: 362059 - DNA, 25 bp, Homo sapien
tcaagtctgtcaccaggttgaggat

SEQ ID NO: 362060 - DNA, 25 bp, Homo sapien
ctggtttccaggttaagtgcactaa

SEQ ID NO: 362061 - DNA, 25 bp, Homo sapien
ggtgttatgatagtacctctacagg

SEQ ID NO: 362062 - DNA, 25 bp, Homo sapien
tacctctacaggttctgatggaagc

SEQ ID NO: 362063 - DNA, 25 bp, Homo sapien
ggatttggcttttccatttgggaga

SEQ ID NO: 362064 - DNA, 25 bp, Homo sapien
gaggctataaaaaaccttcctggag

SEQ ID NO: 362065 - DNA, 25 bp, Homo sapien
aggacgtgggctcattctgattcac

SEQ ID NO: 362066 - DNA, 25 bp, Homo sapien
tgattcacagacaggtccagcccct

SEQ ID NO: 362067 - DNA, 25 bp, Homo sapien
gccccttcacttcttactttgaact

SEQ ID NO: 362068 - DNA, 25 bp, Homo sapien
tactttgaactactccatctggaat

SEQ ID NO: 362069 - DNA, 25 bp, Homo sapien
taagtgagtcgtagaccctgttcct

SEQ ID NO: 362070 - DNA, 25 bp, Homo sapien
gaccctgttcctacagtttcaacaa

SEQ ID NO: 362071 - DNA, 25 bp, Homo sapien
attctccctgcaccaacaggacaga

SEQ ID NO: 362072 - DNA, 25 bp, Homo sapien
caagacttgatgtccaggccgagtg

SEQ ID NO: 362073 - DNA, 25 bp, Homo sapien
cctaaggaatccgagcatttgaaat

SEQ ID NO: 362074 - DNA, 25 bp, Homo sapien
caaatctggtcttacaggttgttat

SEQ ID NO: 362075 - DNA, 25 bp, Homo sapien
aggttgttatgtatttgtctaggta

SEQ ID NO: 362076 - DNA, 25 bp, Homo sapien
gatgtccaggccgagtgtccgtatg

SEQ ID NO: 362077 - DNA, 25 bp, Homo sapien
atatttaggcttccatttgttcctt

SEQ ID NO: 362078 - DNA, 25 bp, Homo sapien
cttgggtcccaaaaatatattagag

SEQ ID NO: 362079 - DNA, 25 bp, Homo sapien
gagtgtccgtatgcacaggagcctc

SEQ ID NO: 362080 - DNA, 25 bp, Homo sapien
gtatgcacaggagcctcttggtggt

SEQ ID NO: 362081 - DNA, 25 bp, Homo sapien
ggttgtgtccatgggctgattctcc

SEQ ID NO: 362082 - DNA, 25 bp, Homo sapien
agtgtccccacacaacgttgcgctt

SEQ ID NO: 362083 - DNA, 25 bp, Homo sapien
gcttctccgtggctgcatttagact

SEQ ID NO: 362084 - DNA, 25 bp, Homo sapien
gactttaccgtaaatgtgagtttca

SEQ ID NO: 362085 - DNA, 25 bp, Homo sapien
gtgagtttcactgctcacacattgc

SEQ ID NO: 362086 - DNA, 25 bp, Homo sapien
gtattcccacctccttacaacagtg

SEQ ID NO: 362087 - DNA, 25 bp, Homo sapien
agtgccttgcacagaacaggccctg

SEQ ID NO: 362088 - DNA, 25 bp, Homo sapien
aggccctgcgcggatgaaacttagc

SEQ ID NO: 362089 - DNA, 25 bp, Homo sapien
ccggctttgggtaagggagctctct

SEQ ID NO: 362090 - DNA, 25 bp, Homo sapien
aagggagctctctcagggcttgatg

SEQ ID NO: 362091 - DNA, 25 bp, Homo sapien
agggcttgatggctttacctttgtc

SEQ ID NO: 362092 - DNA, 25 bp, Homo sapien
tttacctttgtcgtgtgcttcttgc

SEQ ID NO: 362093 - DNA, 25 bp, Homo sapien
acatggtcttgctggtttatttcca

SEQ ID NO: 362094 - DNA, 25 bp, Homo sapien
tgccaatctctattctcaccaccgc

SEQ ID NO: 362095 - DNA, 25 bp, Homo sapien
gccaatctctattctcaccaccgct

SEQ ID NO: 362096 - DNA, 25 bp, Homo sapien
ccaatctctattctcaccaccgctt

SEQ ID NO: 362097 - DNA, 25 bp, Homo sapien
caatctctattctcaccaccgcttt

SEQ ID NO: 362098 - DNA, 25 bp, Homo sapien
aatctctattctcaccaccgctttt

SEQ ID NO: 362099 - DNA, 25 bp, Homo sapien
atctctattctcaccaccgcttttg

SEQ ID NO: 362100 - DNA, 25 bp, Homo sapien
tctctattctcaccaccgcttttga

SEQ ID NO: 362101 - DNA, 25 bp, Homo sapien
ctctattctcaccaccgcttttgat

SEQ ID NO: 362102 - DNA, 25 bp, Homo sapien
ggaaacttcaaagaaacacttgact

SEQ ID NO: 362103 - DNA, 25 bp, Homo sapien
caaagaaacacttgactttgtactt

SEQ ID NO: 362104 - DNA, 25 bp, Homo sapien
cacagagaagaccagcatgttccct

SEQ ID NO: 362105 - DNA, 25 bp, Homo sapien
agagaagaccagcatgttccctgca

SEQ ID NO: 362106 - DNA, 25 bp, Homo sapien
agaccagcatgttccctgcacgaga

SEQ ID NO: 362107 - DNA, 25 bp, Homo sapien
agcatgttccctgcacgagatgcac

SEQ ID NO: 362108 - DNA, 25 bp, Homo sapien
gttccctgcacgagatgcacacaaa

SEQ ID NO: 362109 - DNA, 25 bp, Homo sapien
agatgcacacaaactcctggagcgt

SEQ ID NO: 362110 - DNA, 25 bp, Homo sapien
caaactcctggagcgttccgtattt

SEQ ID NO: 362111 - DNA, 25 bp, Homo sapien
ggaaaacatcaatttctgactaatg

SEQ ID NO: 362112 - DNA, 25 bp, Homo sapien
gaaacacttgaaaggcattagtaca

SEQ ID NO: 362113 - DNA, 25 bp, Homo sapien
cgatcagcatatctgttgcattgag

SEQ ID NO: 362114 - DNA, 25 bp, Homo sapien
gttgcattgagattacttgtgaatt

SEQ ID NO: 362115 - DNA, 25 bp, Homo sapien
aattgcctcttcctttagaagctat

SEQ ID NO: 362116 - DNA, 25 bp, Homo sapien
atgctctttcaggacagagcccgtg

SEQ ID NO: 362117 - DNA, 25 bp, Homo sapien
tgtgctccataatatccccagctct

SEQ ID NO: 362118 - DNA, 25 bp, Homo sapien
agctctggctcagtgtcagactcac

SEQ ID NO: 362119 - DNA, 25 bp, Homo sapien
cacactgactgctcaataatctttg

SEQ ID NO: 362120 - DNA, 25 bp, Homo sapien
gcaaatgcagtgtgctacatgctat

SEQ ID NO: 362121 - DNA, 25 bp, Homo sapien
gctacatgctattatcaactcttgg

SEQ ID NO: 362122 - DNA, 25 bp, Homo sapien
aactcttgggcacagcatcatgaaa

SEQ ID NO: 362123 - DNA, 25 bp, Homo sapien
aagtgaagagctatcagccgggcgt

SEQ ID NO: 362124 - DNA, 25 bp, Homo sapien
agctcttccctacgtgaccaaaagg

SEQ ID NO: 362125 - DNA, 25 bp, Homo sapien
gacggtggaaggcacgcccccttca

SEQ ID NO: 362126 - DNA, 25 bp, Homo sapien
aaccaggccgcctcgaaagccaatt

SEQ ID NO: 362127 - DNA, 25 bp, Homo sapien
aggccgcctcgaaagccaatttcct

SEQ ID NO: 362128 - DNA, 25 bp, Homo sapien
gcctcgaaagccaatttccttcgct

SEQ ID NO: 362129 - DNA, 25 bp, Homo sapien
ccccgaatttcggatcaatctgcaa

SEQ ID NO: 362130 - DNA, 25 bp, Homo sapien
gaatttcggatcaatctgcaacgtg

SEQ ID NO: 362131 - DNA, 25 bp, Homo sapien
tcggatcaatctgcaacgtgacggc

SEQ ID NO: 362132 - DNA, 25 bp, Homo sapien
caatctgcaacgtgacggcagcagg

SEQ ID NO: 362133 - DNA, 25 bp, Homo sapien
atttctggctctggcaaagatctct

SEQ ID NO: 362134 - DNA, 25 bp, Homo sapien
ctctttaacatcttcacttgctggt

SEQ ID NO: 362135 - DNA, 25 bp, Homo sapien
tttgcactagcaatatccatcccag

SEQ ID NO: 362136 - DNA, 25 bp, Homo sapien
cagccccagtaccaagtggtgtgat

SEQ ID NO: 362137 - DNA, 25 bp, Homo sapien
tgcagtgcaattgtgtaggtcaaat

SEQ ID NO: 362138 - DNA, 25 bp, Homo sapien
agtggtgtgatatttggtgcttttt

SEQ ID NO: 362139 - DNA, 25 bp, Homo sapien
atgtttctttgggactgtttcctct

SEQ ID NO: 362140 - DNA, 25 bp, Homo sapien
ttctgtaaacaggagttaccagccc

SEQ ID NO: 362141 - DNA, 25 bp, Homo sapien
gttaccagccctttcatgggttaag

SEQ ID NO: 362142 - DNA, 25 bp, Homo sapien
gagctaacatatgtaatatccctca

SEQ ID NO: 362143 - DNA, 25 bp, Homo sapien
aatatccctcatccagtgggtggca

SEQ ID NO: 362144 - DNA, 25 bp, Homo sapien
tgggtggcacagaggagcttcatta

SEQ ID NO: 362145 - DNA, 25 bp, Homo sapien
aagaaccttcatttgtttgcactag

SEQ ID NO: 362146 - DNA, 25 bp, Homo sapien
gggactataatcaaactattttcta

SEQ ID NO: 362147 - DNA, 25 bp, Homo sapien
aatagtgtcactcaggatagcccca

SEQ ID NO: 362148 - DNA, 25 bp, Homo sapien
gtcactcaggatagccccagccatg

SEQ ID NO: 362149 - DNA, 25 bp, Homo sapien
ccagccatggaagagtcagggtttg

SEQ ID NO: 362150 - DNA, 25 bp, Homo sapien
gagtatagtgtatgtgtcctgtagg

SEQ ID NO: 362151 - DNA, 25 bp, Homo sapien
tatagtgtatgtgtcctgtaggaag

SEQ ID NO: 362152 - DNA, 25 bp, Homo sapien
aagatgaggattttgcaagctccat

SEQ ID NO: 362153 - DNA, 25 bp, Homo sapien
gaggattttgcaagctccataaaca

SEQ ID NO: 362154 - DNA, 25 bp, Homo sapien
gattttgcaagctccataaacagtt

SEQ ID NO: 362155 - DNA, 25 bp, Homo sapien
gcaagctccataaacagttctttct

SEQ ID NO: 362156 - DNA, 25 bp, Homo sapien
agctcagcgcagtctcgaactcttg

SEQ ID NO: 362157 - DNA, 25 bp, Homo sapien
gaaggagttagaatcttctgtgctt

SEQ ID NO: 362158 - DNA, 25 bp, Homo sapien
atcttctgtgcttagggtttgctgc

SEQ ID NO: 362159 - DNA, 25 bp, Homo sapien
tctgtgcttagggtttgctgctgct

SEQ ID NO: 362160 - DNA, 25 bp, Homo sapien
ctgctgctggtgagcttagaatttt

SEQ ID NO: 362161 - DNA, 25 bp, Homo sapien
gtggaaggcataagcatagaaatat

SEQ ID NO: 362162 - DNA, 25 bp, Homo sapien
gaataaagctagactcaaaccatca

SEQ ID NO: 362163 - DNA, 25 bp, Homo sapien
gctagactcaaaccatcataataaa

SEQ ID NO: 362164 - DNA, 25 bp, Homo sapien
gcatctcgtattttaacctaaggct

SEQ ID NO: 362165 - DNA, 25 bp, Homo sapien
ttaacctaaggcttcagctcccaca

SEQ ID NO: 362166 - DNA, 25 bp, Homo sapien
agctcccacacacgactggacagag

SEQ ID NO: 362167 - DNA, 25 bp, Homo sapien
aggggtgtgttagcctgatcttcag

SEQ ID NO: 362168 - DNA, 25 bp, Homo sapien
gagatcatctagttcaacctctccg

SEQ ID NO: 362169 - DNA, 25 bp, Homo sapien
agttcaacctctccgttcaaatgga

SEQ ID NO: 362170 - DNA, 25 bp, Homo sapien
ttgctttcaagacaacactcagttg

SEQ ID NO: 362171 - DNA, 25 bp, Homo sapien
tggagaacctgagccactaagattc

SEQ ID NO: 362172 - DNA, 25 bp, Homo sapien
gagccactaagattcacaggagagt

SEQ ID NO: 362173 - DNA, 25 bp, Homo sapien
gataattgagcaaacaactccaagt

SEQ ID NO: 362174 - DNA, 25 bp, Homo sapien
ttactatgttgttagcatcctaagt

SEQ ID NO: 362175 - DNA, 25 bp, Homo sapien
tcagttgctaaacccatttcctttt

SEQ ID NO: 362176 - DNA, 25 bp, Homo sapien
taggatattttcattgtctccgaat

SEQ ID NO: 362177 - DNA, 25 bp, Homo sapien
cattgtctccgaattttagagctga

SEQ ID NO: 362178 - DNA, 25 bp, Homo sapien
ttttagagctgaaaagtgccttaga

SEQ ID NO: 362179 - DNA, 25 bp, Homo sapien
atttccttatatacccttttgccag

SEQ ID NO: 362180 - DNA, 25 bp, Homo sapien
tccttatatacccttttgccagcca

SEQ ID NO: 362181 - DNA, 25 bp, Homo sapien
ccttttgccagccaagatactgata

SEQ ID NO: 362182 - DNA, 25 bp, Homo sapien
tttgccagccaagatactgatattt

SEQ ID NO: 362183 - DNA, 25 bp, Homo sapien
gtccaatacaatattctctttctgg

SEQ ID NO: 362184 - DNA, 25 bp, Homo sapien
tacaatattctctttctggaggctt

SEQ ID NO: 362185 - DNA, 25 bp, Homo sapien
aatattctctttctggaggcttcct

SEQ ID NO: 362186 - DNA, 25 bp, Homo sapien
gaggcttcctacaagtgaaagcaga

SEQ ID NO: 362187 - DNA, 25 bp, Homo sapien
ttcctacaagtgaaagcagattttg

SEQ ID NO: 362188 - DNA, 25 bp, Homo sapien
tgtcattttatttggcctttgcttg

SEQ ID NO: 362189 - DNA, 25 bp, Homo sapien
ttatttggcctttgcttgtctttga

SEQ ID NO: 362190 - DNA, 25 bp, Homo sapien
gaaaagacagttctcctgtggcagt

SEQ ID NO: 362191 - DNA, 25 bp, Homo sapien
gccattgtttctacttttgtgggac

SEQ ID NO: 362192 - DNA, 25 bp, Homo sapien
ttctacttttgtgggacttcagtca

SEQ ID NO: 362193 - DNA, 25 bp, Homo sapien
gggacttcagtcatgctgataatag

SEQ ID NO: 362194 - DNA, 25 bp, Homo sapien
gtcatgctgataatagaatcttctg

SEQ ID NO: 362195 - DNA, 25 bp, Homo sapien
gaatcttctgttcatacaattctgt

SEQ ID NO: 362196 - DNA, 25 bp, Homo sapien
gtaggtttaagccatcaccaggcct

SEQ ID NO: 362197 - DNA, 25 bp, Homo sapien
atcaccaggcctttgcaaatggcct

SEQ ID NO: 362198 - DNA, 25 bp, Homo sapien
caaatggcctaaatggtgttccctt

SEQ ID NO: 362199 - DNA, 25 bp, Homo sapien
ttccctttgaaataacgcttgccac

SEQ ID NO: 362200 - DNA, 25 bp, Homo sapien
gaaataacgcttgccacaagtatat

SEQ ID NO: 362201 - DNA, 25 bp, Homo sapien
tgaggccggacgtccagcaacacat

SEQ ID NO: 362202 - DNA, 25 bp, Homo sapien
ccggaatccagaagccgcttgtagt

SEQ ID NO: 362203 - DNA, 25 bp, Homo sapien
gaagccgcttgtagtcggtcacaga

SEQ ID NO: 362204 - DNA, 25 bp, Homo sapien
tagtcggtcacagaaatccgctcct

SEQ ID NO: 362205 - DNA, 25 bp, Homo sapien
acagcagcttcagggcgcggcactt

SEQ ID NO: 362206 - DNA, 25 bp, Homo sapien
aagagtttcaggctgtccgcatccc

SEQ ID NO: 362207 - DNA, 25 bp, Homo sapien
aggagccgcagaaggcctcgtagtc

SEQ ID NO: 362208 - DNA, 25 bp, Homo sapien
agaaggcctcgtagtcctgcaggcg

SEQ ID NO: 362209 - DNA, 25 bp, Homo sapien
ctgcgttccaactgactcaaaggga

SEQ ID NO: 362210 - DNA, 25 bp, Homo sapien
agtgcggcaggcgacagatgtccac

SEQ ID NO: 362211 - DNA, 25 bp, Homo sapien
atgtccacctctacttgaggccgga

SEQ ID NO: 362212 - DNA, 25 bp, Homo sapien
tgcacatttgcacacgatccggaga

SEQ ID NO: 362213 - DNA, 25 bp, Homo sapien
tttgcacacgatccggagagccgaa

SEQ ID NO: 362214 - DNA, 25 bp, Homo sapien
gaaggccgcgtgcttcctgtcacat

SEQ ID NO: 362215 - DNA, 25 bp, Homo sapien
tgtagtttccaaagacacgtctgca

SEQ ID NO: 362216 - DNA, 25 bp, Homo sapien
gacacgtctgcatttgaatttctag

SEQ ID NO: 362217 - DNA, 25 bp, Homo sapien
gaatttctagattttcgaggtaagg

SEQ ID NO: 362218 - DNA, 25 bp, Homo sapien
gtttggaaaatcacatcatgcctag

SEQ ID NO: 362219 - DNA, 25 bp, Homo sapien
aaatcacatcatgcctagaatctga

SEQ ID NO: 362220 - DNA, 25 bp, Homo sapien
ttgaattagcaagaaccgactgttt

SEQ ID NO: 362221 - DNA, 25 bp, Homo sapien
aaccgactgtttgcattttccatat

SEQ ID NO: 362222 - DNA, 25 bp, Homo sapien
atatccttttatctgctctttttaa

SEQ ID NO: 362223 - DNA, 25 bp, Homo sapien
aatccttaaaatgtgggagtccatg

SEQ ID NO: 362224 - DNA, 25 bp, Homo sapien
gggagtccatgttacatattccaat

SEQ ID NO: 362225 - DNA, 25 bp, Homo sapien
tccccagcagctaattttcacgtac

SEQ ID NO: 362226 - DNA, 25 bp, Homo sapien
agcagctaattttcacgtacagttt

SEQ ID NO: 362227 - DNA, 25 bp, Homo sapien
gctaattttcacgtacagtttaagt

SEQ ID NO: 362228 - DNA, 25 bp, Homo sapien
tacagtttaagtaccccaaatctga

SEQ ID NO: 362229 - DNA, 25 bp, Homo sapien
tatctgcaagattgactgactgatt

SEQ ID NO: 362230 - DNA, 25 bp, Homo sapien
tgactgactgattgagatggagttt

SEQ ID NO: 362231 - DNA, 25 bp, Homo sapien
gcgagatcttgggtcactggatgct

SEQ ID NO: 362232 - DNA, 25 bp, Homo sapien
gatcttgggtcactggatgctcagc

SEQ ID NO: 362233 - DNA, 25 bp, Homo sapien
tgggtcactggatgctcagcctcct

SEQ ID NO: 362234 - DNA, 25 bp, Homo sapien
gataggtatccaggtgccagagcaa

SEQ ID NO: 362235 - DNA, 25 bp, Homo sapien
cacgttcctgtaatcagttaactct

SEQ ID NO: 362236 - DNA, 25 bp, Homo sapien
gcaagagtcttttgctcaaggatta

SEQ ID NO: 362237 - DNA, 25 bp, Homo sapien
tcaaggattattgccttaggcctag

SEQ ID NO: 362238 - DNA, 25 bp, Homo sapien
ttaggcctagttatcacacatctga

SEQ ID NO: 362239 - DNA, 25 bp, Homo sapien
gataaagcagattggccaaagccct

SEQ ID NO: 362240 - DNA, 25 bp, Homo sapien
accttagtgggcagggaaatcttca

SEQ ID NO: 362241 - DNA, 25 bp, Homo sapien
aatcttcatttgcaatcagccctac

SEQ ID NO: 362242 - DNA, 25 bp, Homo sapien
ctacactcagtcagcaagtctctac

SEQ ID NO: 362243 - DNA, 25 bp, Homo sapien
gttaactctctgtaatagctcgata

SEQ ID NO: 362244 - DNA, 25 bp, Homo sapien
gtactctaactgtattaggtgcttt

SEQ ID NO: 362245 - DNA, 25 bp, Homo sapien
ttccctctaaccaggccatgatggg

SEQ ID NO: 362246 - DNA, 25 bp, Homo sapien
gccatgatgggaacctttgctgcct

SEQ ID NO: 362247 - DNA, 25 bp, Homo sapien
atgatgggaacctttgctgcctgcc

SEQ ID NO: 362248 - DNA, 25 bp, Homo sapien
atgggaacctttgctgcctgccctt

SEQ ID NO: 362249 - DNA, 25 bp, Homo sapien
tgcccttggagaaccccggattggc

SEQ ID NO: 362250 - DNA, 25 bp, Homo sapien
gagaaccccggattggcttccctgg

SEQ ID NO: 362251 - DNA, 25 bp, Homo sapien
gcaggactttgatttgacttccagc

SEQ ID NO: 362252 - DNA, 25 bp, Homo sapien
gactttgatttgacttccagcccca

SEQ ID NO: 362253 - DNA, 25 bp, Homo sapien
tgatttgacttccagccccacatga

SEQ ID NO: 362254 - DNA, 25 bp, Homo sapien
gacttccagccccacatgaggaggg

SEQ ID NO: 362255 - DNA, 25 bp, Homo sapien
tgtttgtggccctttatttaagttg

SEQ ID NO: 362256 - DNA, 25 bp, Homo sapien
ggcagaaagccccttgcatcctgag

SEQ ID NO: 362257 - DNA, 25 bp, Homo sapien
ttgcatcctgagctccttggagtag

SEQ ID NO: 362258 - DNA, 25 bp, Homo sapien
ttggagtagggaccgcatatcgcct

SEQ ID NO: 362259 - DNA, 25 bp, Homo sapien
atatcgcctgtgtgagccagatcgc

SEQ ID NO: 362260 - DNA, 25 bp, Homo sapien
ttgtccccgtctccgggagggcatt

SEQ ID NO: 362261 - DNA, 25 bp, Homo sapien
gggcatttaaatttcggctcaccgc

SEQ ID NO: 362262 - DNA, 25 bp, Homo sapien
aaatttcggctcaccgcatttctga

SEQ ID NO: 362263 - DNA, 25 bp, Homo sapien
gcatttctgacagccggagacggac

SEQ ID NO: 362264 - DNA, 25 bp, Homo sapien
tgaatatattcacgctgactcccgg

SEQ ID NO: 362265 - DNA, 25 bp, Homo sapien
gtcggacattcctgctttattgtgt

SEQ ID NO: 362266 - DNA, 25 bp, Homo sapien
attgtgttaattgctctctgggttt

SEQ ID NO: 362267 - DNA, 25 bp, Homo sapien
gttgacctgtcatagccttgttaaa

SEQ ID NO: 362268 - DNA, 25 bp, Homo sapien
gccttgttaaaatggctgctagcca

SEQ ID NO: 362269 - DNA, 25 bp, Homo sapien
tcaaagacaacaaacccagctcatc

SEQ ID NO: 362270 - DNA, 25 bp, Homo sapien
agctcatcctccagcttgatgggaa

SEQ ID NO: 362271 - DNA, 25 bp, Homo sapien
gggtttatgtcctaactgctttgta

SEQ ID NO: 362272 - DNA, 25 bp, Homo sapien
tgctgtttgcaaagactgttgccgt

SEQ ID NO: 362273 - DNA, 25 bp, Homo sapien
actgttgccgtcaattttctcttga

SEQ ID NO: 362274 - DNA, 25 bp, Homo sapien
atttttcttgtaaggctgactggca

SEQ ID NO: 362275 - DNA, 25 bp, Homo sapien
gaagctacactcctgaagaaaccaa

SEQ ID NO: 362276 - DNA, 25 bp, Homo sapien
aaaaatgcatctccttggcttctga

SEQ ID NO: 362277 - DNA, 25 bp, Homo sapien
ggcttctgacttctttgtgattcaa

SEQ ID NO: 362278 - DNA, 25 bp, Homo sapien
gcctccatacagacagcaattaaat

SEQ ID NO: 362279 - DNA, 25 bp, Homo sapien
taaataccacctgtgtaaactgcag

SEQ ID NO: 362280 - DNA, 25 bp, Homo sapien
gcaggagagtagttcagatttggct

SEQ ID NO: 362281 - DNA, 25 bp, Homo sapien
ggctgagtaactttttcctggcatg

SEQ ID NO: 362282 - DNA, 25 bp, Homo sapien
ctggcatgaaagaaccggctctaat

SEQ ID NO: 362283 - DNA, 25 bp, Homo sapien
ggctctaatgactagttcattccag

SEQ ID NO: 362284 - DNA, 25 bp, Homo sapien
actggacattagatctagtgctttg

SEQ ID NO: 362285 - DNA, 25 bp, Homo sapien
gttttgtttgcaacatttcctattt

SEQ ID NO: 362286 - DNA, 25 bp, Homo sapien
catttcctatttgcccacacataaa

SEQ ID NO: 362287 - DNA, 25 bp, Homo sapien
aaatcatccgtacctcaaacacagt

SEQ ID NO: 362288 - DNA, 25 bp, Homo sapien
gtatttaccctataggctggtcgac

SEQ ID NO: 362289 - DNA, 25 bp, Homo sapien
ggaataacgatagccgtgaggacac

SEQ ID NO: 362290 - DNA, 25 bp, Homo sapien
cgtgaggacacagcgggtttatcta

SEQ ID NO: 362291 - DNA, 25 bp, Homo sapien
ggacacagcgggtttatctatcaat

SEQ ID NO: 362292 - DNA, 25 bp, Homo sapien
cacagcgggtttatctatcaataga

SEQ ID NO: 362293 - DNA, 25 bp, Homo sapien
gggtttatctatcaatagacaccaa

SEQ ID NO: 362294 - DNA, 25 bp, Homo sapien
aatggaaaagacttattctaacttg

SEQ ID NO: 362295 - DNA, 25 bp, Homo sapien
ctaacttgttattagtcttagtgaa

SEQ ID NO: 362296 - DNA, 25 bp, Homo sapien
aatatgtcatttgaaggagccacgt

SEQ ID NO: 362297 - DNA, 25 bp, Homo sapien
tgtcatttgaaggagccacgtgtat

SEQ ID NO: 362298 - DNA, 25 bp, Homo sapien
aaggagccacgtgtatgggaagccc

SEQ ID NO: 362299 - DNA, 25 bp, Homo sapien
cacgtgtatgggaagccccggcgtc

SEQ ID NO: 362300 - DNA, 25 bp, Homo sapien
ttatgttccagtgggagtcactctc

SEQ ID NO: 362301 - DNA, 25 bp, Homo sapien
ggagtcactctcttctgtcgggaat

SEQ ID NO: 362302 - DNA, 25 bp, Homo sapien
ttctgtcgggaatcttatctgctgc

SEQ ID NO: 362303 - DNA, 25 bp, Homo sapien
tatctgctgctttgtgtctttggtc

SEQ ID NO: 362304 - DNA, 25 bp, Homo sapien
tttgtgtctttggtcagattcctga

SEQ ID NO: 362305 - DNA, 25 bp, Homo sapien
agattcctgacaatttagtttcctg

SEQ ID NO: 362306 - DNA, 25 bp, Homo sapien
gacaatttagtttcctgttgtaaag

SEQ ID NO: 362307 - DNA, 25 bp, Homo sapien
cctgttgtaaaggtgcttttcctgg

SEQ ID NO: 362308 - DNA, 25 bp, Homo sapien
aacaagatccattttaggagtgttt

SEQ ID NO: 362309 - DNA, 25 bp, Homo sapien
tagccattcattctggaactcaagg

SEQ ID NO: 362310 - DNA, 25 bp, Homo sapien
tggaactcaaggacaggactgtaat

SEQ ID NO: 362311 - DNA, 25 bp, Homo sapien
ggaacacagtccatgcgtgcggcgc

SEQ ID NO: 362312 - DNA, 25 bp, Homo sapien
gaacacagtccatgcgtgcggcgcc

SEQ ID NO: 362313 - DNA, 25 bp, Homo sapien
acagtccatgcgtgcggcgcccgac

SEQ ID NO: 362314 - DNA, 25 bp, Homo sapien
ccctttgtgcctggagtgtcacgcg

SEQ ID NO: 362315 - DNA, 25 bp, Homo sapien
ctttgtgcctggagtgtcacgcgcg

SEQ ID NO: 362316 - DNA, 25 bp, Homo sapien
ttgtgcctggagtgtcacgcgcggg

SEQ ID NO: 362317 - DNA, 25 bp, Homo sapien
gcctggagtgtcacgcgcgggcgct

SEQ ID NO: 362318 - DNA, 25 bp, Homo sapien
tgggagaggcctccggcaccccggg

SEQ ID NO: 362319 - DNA, 25 bp, Homo sapien
gtggtgggcgcctgctagctccggc

SEQ ID NO: 362320 - DNA, 25 bp, Homo sapien
ctccggctcgcggtgttaggccttg

SEQ ID NO: 362321 - DNA, 25 bp, Homo sapien
ccggctcgcggtgttaggccttggg

SEQ ID NO: 362322 - DNA, 25 bp, Homo sapien
gttaattgctgaaccatcacctgac

SEQ ID NO: 362323 - DNA, 25 bp, Homo sapien
gaaccatcacctgacatttctagtg

SEQ ID NO: 362324 - DNA, 25 bp, Homo sapien
acctgacatttctagtgggtcggga

SEQ ID NO: 362325 - DNA, 25 bp, Homo sapien
tctgctgccctgttgatgcctaact

SEQ ID NO: 362326 - DNA, 25 bp, Homo sapien
ctgttgatgcctaactacctgtaac

SEQ ID NO: 362327 - DNA, 25 bp, Homo sapien
attgtaagttttcctgtatccagta

SEQ ID NO: 362328 - DNA, 25 bp, Homo sapien
gtatccagtatcacctccaatattt

SEQ ID NO: 362329 - DNA, 25 bp, Homo sapien
tgaaataccacctcacaaccagatg

SEQ ID NO: 362330 - DNA, 25 bp, Homo sapien
atcaagagattgtctctccctggct

SEQ ID NO: 362331 - DNA, 25 bp, Homo sapien
ggctgccgaattctcattcttagag

SEQ ID NO: 362332 - DNA, 25 bp, Homo sapien
cattcttagagaggcaatttgttaa

SEQ ID NO: 362333 - DNA, 25 bp, Homo sapien
atttccctttcccaaagatctgcag

SEQ ID NO: 362334 - DNA, 25 bp, Homo sapien
agatctgcaggatagtggttggcta

SEQ ID NO: 362335 - DNA, 25 bp, Homo sapien
ttggctagtatttgtgagtggctca

SEQ ID NO: 362336 - DNA, 25 bp, Homo sapien
gagtggctcagaagggagttcatca

SEQ ID NO: 362337 - DNA, 25 bp, Homo sapien
gagttcatcatagtctttgtgttca

SEQ ID NO: 362338 - DNA, 25 bp, Homo sapien
gggcctcagttgaacctcagcttcc

SEQ ID NO: 362339 - DNA, 25 bp, Homo sapien
ttgcagccccacatgggagttcact

SEQ ID NO: 362340 - DNA, 25 bp, Homo sapien
gtctacaattatttggtgttacacc

SEQ ID NO: 362341 - DNA, 25 bp, Homo sapien
acatgggagttcactctgtgggtga

SEQ ID NO: 362342 - DNA, 25 bp, Homo sapien
gtgggtgatgagttttccccaacct

SEQ ID NO: 362343 - DNA, 25 bp, Homo sapien
aacctctgcctctccaaaagaactt

SEQ ID NO: 362344 - DNA, 25 bp, Homo sapien
atgtgcttccagcattttgtccgtt

SEQ ID NO: 362345 - DNA, 25 bp, Homo sapien
tttgtccgttggcagtaaatcagtt

SEQ ID NO: 362346 - DNA, 25 bp, Homo sapien
cagtaaatcagttgttgaaggcccc

SEQ ID NO: 362347 - DNA, 25 bp, Homo sapien
tcgctcatcaacatccatcacatag

SEQ ID NO: 362348 - DNA, 25 bp, Homo sapien
acatagaacgctggccaaatactgg

SEQ ID NO: 362349 - DNA, 25 bp, Homo sapien
gctgatgtatttcacccttagtcat

SEQ ID NO: 362350 - DNA, 25 bp, Homo sapien
acacagatgtttttataggcctgat

SEQ ID NO: 362351 - DNA, 25 bp, Homo sapien
ataggcctgattgacgcttcagcca

SEQ ID NO: 362352 - DNA, 25 bp, Homo sapien
gacgcttcagccattgtgattttgc

SEQ ID NO: 362353 - DNA, 25 bp, Homo sapien
gtgattttgctctaggttccaacga

SEQ ID NO: 362354 - DNA, 25 bp, Homo sapien
gctctaggttccaacgaaattctat

SEQ ID NO: 362355 - DNA, 25 bp, Homo sapien
atgggaagcaaggagcctgcagtca

SEQ ID NO: 362356 - DNA, 25 bp, Homo sapien
agtcagcattgtcactgggtagccc

SEQ ID NO: 362357 - DNA, 25 bp, Homo sapien
tctggcattactacctcagggtcgg

SEQ ID NO: 362358 - DNA, 25 bp, Homo sapien
tactacctcagggtcggctagacat

SEQ ID NO: 362359 - DNA, 25 bp, Homo sapien
gtcggctagacatgcacagcagttt

SEQ ID NO: 362360 - DNA, 25 bp, Homo sapien
agcagtttgggcaccagcattcaaa

SEQ ID NO: 362361 - DNA, 25 bp, Homo sapien
aaaccacaactagtaggcttagctt

SEQ ID NO: 362362 - DNA, 25 bp, Homo sapien
gcttaagtgtgtttgtgaggtatgc

SEQ ID NO: 362363 - DNA, 25 bp, Homo sapien
aagctctgaagcatgaaaccagtta

SEQ ID NO: 362364 - DNA, 25 bp, Homo sapien
gaaaccagttaggtcaacccatcac

SEQ ID NO: 362365 - DNA, 25 bp, Homo sapien
aacccatcacactgggttgcttatg

SEQ ID NO: 362366 - DNA, 25 bp, Homo sapien
tgccacatgccttatctcacgtaat

SEQ ID NO: 362367 - DNA, 25 bp, Homo sapien
ttatctcacgtaatacccatctgac

SEQ ID NO: 362368 - DNA, 25 bp, Homo sapien
acgtaatacccatctgacccttgtc

SEQ ID NO: 362369 - DNA, 25 bp, Homo sapien
ctgacccttgtctggctatttagtt

SEQ ID NO: 362370 - DNA, 25 bp, Homo sapien
caacttccaatgcattgtcacatat

SEQ ID NO: 362371 - DNA, 25 bp, Homo sapien
aggacaagctggcagagactctttc

SEQ ID NO: 362372 - DNA, 25 bp, Homo sapien
atgaaaagccttgcctgagtcactc

SEQ ID NO: 362373 - DNA, 25 bp, Homo sapien
cttgcatgttactccatccaaacga

SEQ ID NO: 362374 - DNA, 25 bp, Homo sapien
gttactccatccaaacgaaaccagc

SEQ ID NO: 362375 - DNA, 25 bp, Homo sapien
tgtcacatattggagttgggaccag

SEQ ID NO: 362376 - DNA, 25 bp, Homo sapien
agtcatgcaagtacactggcctctg

SEQ ID NO: 362377 - DNA, 25 bp, Homo sapien
tattgaattgtgtccaatgctgcaa

SEQ ID NO: 362378 - DNA, 25 bp, Homo sapien
cttttcaagtcttgcctgttggcaa

SEQ ID NO: 362379 - DNA, 25 bp, Homo sapien
gcctgttggcaaatgaatggtatac

SEQ ID NO: 362380 - DNA, 25 bp, Homo sapien
ataccattagtgttttgatctgcat

SEQ ID NO: 362381 - DNA, 25 bp, Homo sapien
tgatattgaccatctcttccaactt

SEQ ID NO: 362382 - DNA, 25 bp, Homo sapien
gtctgtttgaatactctcctttcca

SEQ ID NO: 362383 - DNA, 25 bp, Homo sapien
aatactctcctttccaaatgtgtga

SEQ ID NO: 362384 - DNA, 25 bp, Homo sapien
ttggttagcagtgagctctaggctt

SEQ ID NO: 362385 - DNA, 25 bp, Homo sapien
agctctaggctttgttgaacttgga

SEQ ID NO: 362386 - DNA, 25 bp, Homo sapien
tgaacttggagccagaacaatctga

SEQ ID NO: 362387 - DNA, 25 bp, Homo sapien
gagtttcaggccagggtctacagaa

SEQ ID NO: 362388 - DNA, 25 bp, Homo sapien
tgtgctcctggcactcagagtcagg

SEQ ID NO: 362389 - DNA, 25 bp, Homo sapien
ctggcactcagagtcaggtagctga

SEQ ID NO: 362390 - DNA, 25 bp, Homo sapien
gagtcaggtagctgagcactcgctc

SEQ ID NO: 362391 - DNA, 25 bp, Homo sapien
tttttacttatctgtcatttaatga

SEQ ID NO: 362392 - DNA, 25 bp, Homo sapien
agtttcctcctctctttccagttag

SEQ ID NO: 362393 - DNA, 25 bp, Homo sapien
taggtctgtcctagggagcagctgc

SEQ ID NO: 362394 - DNA, 25 bp, Homo sapien
cctccctcaggagcgtgcaggatgt

SEQ ID NO: 362395 - DNA, 25 bp, Homo sapien
tgcaggatgtctgtgcacaccagcg

SEQ ID NO: 362396 - DNA, 25 bp, Homo sapien
ggatgtctgtgcacaccagcgccag

SEQ ID NO: 362397 - DNA, 25 bp, Homo sapien
tcatcacaggactaacaggacccaa

SEQ ID NO: 362398 - DNA, 25 bp, Homo sapien
acaggactaacaggacccaaatgac

SEQ ID NO: 362399 - DNA, 25 bp, Homo sapien
tgcatattgtactcatttgtaatat

SEQ ID NO: 362400 - DNA, 25 bp, Homo sapien
actaagaatctttatgtcagctatt

SEQ ID NO: 362401 - DNA, 25 bp, Homo sapien
tgtcagctattcaacatttccctac

SEQ ID NO: 362402 - DNA, 25 bp, Homo sapien
gctattcaacatttccctactttat

SEQ ID NO: 362403 - DNA, 25 bp, Homo sapien
ttccctactttataatttctagctg

SEQ ID NO: 362404 - DNA, 25 bp, Homo sapien
atttctagctgctttaccatttagc

SEQ ID NO: 362405 - DNA, 25 bp, Homo sapien
gctgctttaccatttagcaacttta

SEQ ID NO: 362406 - DNA, 25 bp, Homo sapien
gcacattaatgtatacttagtagat

SEQ ID NO: 362407 - DNA, 25 bp, Homo sapien
gatacacatttacacattgagaagt

SEQ ID NO: 362408 - DNA, 25 bp, Homo sapien
aagataggtttgtgttctgtgtaca

SEQ ID NO: 362409 - DNA, 25 bp, Homo sapien
gttctgtgtacaattaggacatcca

SEQ ID NO: 362410 - DNA, 25 bp, Homo sapien
gagaaaaccaggacagacccaacga

SEQ ID NO: 362411 - DNA, 25 bp, Homo sapien
agacccaacgatgttgtctgctaaa

SEQ ID NO: 362412 - DNA, 25 bp, Homo sapien
gtctgctaaaaactttcctgtgaac

SEQ ID NO: 362413 - DNA, 25 bp, Homo sapien
attccaaacagttaatgtcttgacc

SEQ ID NO: 362414 - DNA, 25 bp, Homo sapien
aatgtcttgaccaagtacttcacaa

SEQ ID NO: 362415 - DNA, 25 bp, Homo sapien
gtgaaatgctcttaggatattacca

SEQ ID NO: 362416 - DNA, 25 bp, Homo sapien
gattacatggttggagttgatcaaa

SEQ ID NO: 362417 - DNA, 25 bp, Homo sapien
attgtgtcaaatgccagagctgctg

SEQ ID NO: 362418 - DNA, 25 bp, Homo sapien
gagctgctggctagacatactaccg

SEQ ID NO: 362419 - DNA, 25 bp, Homo sapien
ctagacatactaccgagagcagaat

SEQ ID NO: 362420 - DNA, 25 bp, Homo sapien
agttgatgacttaccacacaatgga

SEQ ID NO: 362421 - DNA, 25 bp, Homo sapien
agccttgcctgtcaaggaaagtacc

SEQ ID NO: 362422 - DNA, 25 bp, Homo sapien
aaagtaccctccgagcggtcaggct

SEQ ID NO: 362423 - DNA, 25 bp, Homo sapien
aagtaccctccgagcggtcaggctg

SEQ ID NO: 362424 - DNA, 25 bp, Homo sapien
agtaccctccgagcggtcaggctgg

SEQ ID NO: 362425 - DNA, 25 bp, Homo sapien
gggtgctgccaacgagtcccttttt

SEQ ID NO: 362426 - DNA, 25 bp, Homo sapien
ggtgctgccaacgagtccctttttg

SEQ ID NO: 362427 - DNA, 25 bp, Homo sapien
gtgctgccaacgagtccctttttgt

SEQ ID NO: 362428 - DNA, 25 bp, Homo sapien
tgctgccaacgagtccctttttgtc

SEQ ID NO: 362429 - DNA, 25 bp, Homo sapien
gctgccaacgagtccctttttgtct

SEQ ID NO: 362430 - DNA, 25 bp, Homo sapien
ctgccaacgagtccctttttgtctc

SEQ ID NO: 362431 - DNA, 25 bp, Homo sapien
gccaacgagtccctttttgtctcta

SEQ ID NO: 362432 - DNA, 25 bp, Homo sapien
atccagcaatcctaattcttggtgt

SEQ ID NO: 362433 - DNA, 25 bp, Homo sapien
aatcctaattcttggtgtatatcca

SEQ ID NO: 362434 - DNA, 25 bp, Homo sapien
aagatgatgtgtatccacatcagaa

SEQ ID NO: 362435 - DNA, 25 bp, Homo sapien
gaagatgatgtatatccaccacaga

SEQ ID NO: 362436 - DNA, 25 bp, Homo sapien
gatggtgtatatccacagaagtagt

SEQ ID NO: 362437 - DNA, 25 bp, Homo sapien
tatccacagaagtagtgtatatcaa

SEQ ID NO: 362438 - DNA, 25 bp, Homo sapien
atcacactgtacaccttccagtata

SEQ ID NO: 362439 - DNA, 25 bp, Homo sapien
actgtacaccttccagtatatacta

SEQ ID NO: 362440 - DNA, 25 bp, Homo sapien
aattcaagaggtaatcagtcttagt

SEQ ID NO: 362441 - DNA, 25 bp, Homo sapien
atcagtcttagtgaggatgcagaat

SEQ ID NO: 362442 - DNA, 25 bp, Homo sapien
gaataaagggaacctttgtacactg

SEQ ID NO: 362443 - DNA, 25 bp, Homo sapien
ggcacttaggtcagcagtcataaag

SEQ ID NO: 362444 - DNA, 25 bp, Homo sapien
cagaaatttggattatggtagtcat

SEQ ID NO: 362445 - DNA, 25 bp, Homo sapien
catgtttttgaacaaatgtccaaac

SEQ ID NO: 362446 - DNA, 25 bp, Homo sapien
atgtccaaacattcctagaaggcac

SEQ ID NO: 362447 - DNA, 25 bp, Homo sapien
attcctagaaggcactcttgaggta

SEQ ID NO: 362448 - DNA, 25 bp, Homo sapien
ggcactcttgaggtaaatcagttaa

SEQ ID NO: 362449 - DNA, 25 bp, Homo sapien
ataaagtgacttgcactagggccac

SEQ ID NO: 362450 - DNA, 25 bp, Homo sapien
aagtgacttgcactagggccacaaa

SEQ ID NO: 362451 - DNA, 25 bp, Homo sapien
ctagggccacaaaaaggatttacat

SEQ ID NO: 362452 - DNA, 25 bp, Homo sapien
aggatttacatgtcttaacagtcaa

SEQ ID NO: 362453 - DNA, 25 bp, Homo sapien
cagtcaaattttttagtagcttcaa

SEQ ID NO: 362454 - DNA, 25 bp, Homo sapien
aacagtagagtcacttcatcattga

SEQ ID NO: 362455 - DNA, 25 bp, Homo sapien
gagtcacttcatcattgaatgggag

SEQ ID NO: 362456 - DNA, 25 bp, Homo sapien
gacactctcaacaatgagacacatt

SEQ ID NO: 362457 - DNA, 25 bp, Homo sapien
attttatgtgctagtaataagccca

SEQ ID NO: 362458 - DNA, 25 bp, Homo sapien
caggctattgtgaaatctataaaag

SEQ ID NO: 362459 - DNA, 25 bp, Homo sapien
tttctttcataaatggagtctagat

SEQ ID NO: 362460 - DNA, 25 bp, Homo sapien
ggagtctagatagtgatcccagatt

SEQ ID NO: 362461 - DNA, 25 bp, Homo sapien
gtgatcccagattatcatgacaatt

SEQ ID NO: 362462 - DNA, 25 bp, Homo sapien
cagattatcatgacaatttggttac

SEQ ID NO: 362463 - DNA, 25 bp, Homo sapien
gacaatttggttacttgttagatat

SEQ ID NO: 362464 - DNA, 25 bp, Homo sapien
ttgttagatatggaacatcagcgtc

SEQ ID NO: 362465 - DNA, 25 bp, Homo sapien
aagtgtgccagaattggtgaacgga

SEQ ID NO: 362466 - DNA, 25 bp, Homo sapien
aacggaagagtccttatgttgcagt

SEQ ID NO: 362467 - DNA, 25 bp, Homo sapien
gagtccttatgttgcagtatgctgt

SEQ ID NO: 362468 - DNA, 25 bp, Homo sapien
agtatgctgtatagtaatggccttc

SEQ ID NO: 362469 - DNA, 25 bp, Homo sapien
gcatcctcttcatacagtagctggg

SEQ ID NO: 362470 - DNA, 25 bp, Homo sapien
aatgccagaatgtagttgccatcag

SEQ ID NO: 362471 - DNA, 25 bp, Homo sapien
gttgccatcagatttgattgtgaac

SEQ ID NO: 362472 - DNA, 25 bp, Homo sapien
gattgtgaacaaggactgactgcag

SEQ ID NO: 362473 - DNA, 25 bp, Homo sapien
gtttaactcttttatctccgaacat

SEQ ID NO: 362474 - DNA, 25 bp, Homo sapien
tcttttatctccgaacattgaatga

SEQ ID NO: 362475 - DNA, 25 bp, Homo sapien
tgagataaatttccagatgctgttc

SEQ ID NO: 362476 - DNA, 25 bp, Homo sapien
tggatcccacctaaacgcactgaat

SEQ ID NO: 362477 - DNA, 25 bp, Homo sapien
taaacgcactgaatctgaatctgaa

SEQ ID NO: 362478 - DNA, 25 bp, Homo sapien
atctgaatctgaatctgcagtggag

SEQ ID NO: 362479 - DNA, 25 bp, Homo sapien
gcgtgaaaccgaaagtctgtcttta

SEQ ID NO: 362480 - DNA, 25 bp, Homo sapien
gggagaatctgtcatgcagccatat

SEQ ID NO: 362481 - DNA, 25 bp, Homo sapien
gattcataagtaccgatcagtttat

SEQ ID NO: 362482 - DNA, 25 bp, Homo sapien
atatcctactagaaagtcaactccg

SEQ ID NO: 362483 - DNA, 25 bp, Homo sapien
agtcaactccgaggtcgaggaccat

SEQ ID NO: 362484 - DNA, 25 bp, Homo sapien
ggtcgaggaccatgtctgcctcgtt

SEQ ID NO: 362485 - DNA, 25 bp, Homo sapien
actgcatctgcagccttctggatag

SEQ ID NO: 362486 - DNA, 25 bp, Homo sapien
agccttctggatagtgcctggcaca

SEQ ID NO: 362487 - DNA, 25 bp, Homo sapien
tccctgtgtgtaccttatgtcatag

SEQ ID NO: 362488 - DNA, 25 bp, Homo sapien
atagcttctggtgttgttcctttac

SEQ ID NO: 362489 - DNA, 25 bp, Homo sapien
gttcctttactaggtgttactgcgg

SEQ ID NO: 362490 - DNA, 25 bp, Homo sapien
atgcaaaacttagtccatcggcgga

SEQ ID NO: 362491 - DNA, 25 bp, Homo sapien
gtccatcggcggatttatccatttt

SEQ ID NO: 362492 - DNA, 25 bp, Homo sapien
atggcaattttgtccttccaagtcc

SEQ ID NO: 362493 - DNA, 25 bp, Homo sapien
agtccgccagtttaagcgcctttat

SEQ ID NO: 362494 - DNA, 25 bp, Homo sapien
agtaccttgtgggtcaacgactcgt

SEQ ID NO: 362495 - DNA, 25 bp, Homo sapien
gtgaactacgaacggaaatctggca

SEQ ID NO: 362496 - DNA, 25 bp, Homo sapien
aatctggcaaacaaggctcatctcc

SEQ ID NO: 362497 - DNA, 25 bp, Homo sapien
cctccacagtcatcccaagaataaa

SEQ ID NO: 362498 - DNA, 25 bp, Homo sapien
attgtgtatagatctgttagctgtc

SEQ ID NO: 362499 - DNA, 25 bp, Homo sapien
atctgttagctgtcagggtgtgttt

SEQ ID NO: 362500 - DNA, 25 bp, Homo sapien
tttttaacctgttgtgtgcgtgtgg

SEQ ID NO: 362501 - DNA, 25 bp, Homo sapien
aactgttcaggaattctctgcacta

SEQ ID NO: 362502 - DNA, 25 bp, Homo sapien
ttcaggaattctctgcactagctgt

SEQ ID NO: 362503 - DNA, 25 bp, Homo sapien
tgcagaagagcagataactagcgct

SEQ ID NO: 362504 - DNA, 25 bp, Homo sapien
taactagcgctgctctggcattaat

SEQ ID NO: 362505 - DNA, 25 bp, Homo sapien
gccgccaatctaacatgagcacagg

SEQ ID NO: 362506 - DNA, 25 bp, Homo sapien
agcacaggtgcttcatgacaaacat

SEQ ID NO: 362507 - DNA, 25 bp, Homo sapien
tgttcaactgcaccatgttctggca

SEQ ID NO: 362508 - DNA, 25 bp, Homo sapien
accatgttctggcactgtattttga

SEQ ID NO: 362509 - DNA, 25 bp, Homo sapien
gaaggaactcgacacctttatgtaa

SEQ ID NO: 362510 - DNA, 25 bp, Homo sapien
acatcactttctttagattgttggg

SEQ ID NO: 362511 - DNA, 25 bp, Homo sapien
gttctaaggaagtgagtttcctgat

SEQ ID NO: 362512 - DNA, 25 bp, Homo sapien
gaaaattcacccttcttgctgattg

SEQ ID NO: 362513 - DNA, 25 bp, Homo sapien
ttcacccttcttgctgattgtgagg

SEQ ID NO: 362514 - DNA, 25 bp, Homo sapien
cttcttgctgattgtgaggaggtca

SEQ ID NO: 362515 - DNA, 25 bp, Homo sapien
gaggaggtcagatatctgtccctca

SEQ ID NO: 362516 - DNA, 25 bp, Homo sapien
tcagatatctgtccctcagctgtca

SEQ ID NO: 362517 - DNA, 25 bp, Homo sapien
cagctgtcacaatggtagacttgat

SEQ ID NO: 362518 - DNA, 25 bp, Homo sapien
gtagacttgatggagttacatgaca

SEQ ID NO: 362519 - DNA, 25 bp, Homo sapien
gaagagagcccaaggaagcacctga

SEQ ID NO: 362520 - DNA, 25 bp, Homo sapien
atatctctctgataggatgtcccta

SEQ ID NO: 362521 - DNA, 25 bp, Homo sapien
aggatgtccctatcagagagattca

SEQ ID NO: 362522 - DNA, 25 bp, Homo sapien
tccctatcagagagattcagagtct

SEQ ID NO: 362523 - DNA, 25 bp, Homo sapien
gagtctctgtaaacaattatctctt

SEQ ID NO: 362524 - DNA, 25 bp, Homo sapien
atctcttttgtaagaattacgtaag

SEQ ID NO: 362525 - DNA, 25 bp, Homo sapien
taaagtagcatctagaatcgagaga

SEQ ID NO: 362526 - DNA, 25 bp, Homo sapien
gagagaggagacttactactaatca

SEQ ID NO: 362527 - DNA, 25 bp, Homo sapien
gagacttactactaatcatcactga

SEQ ID NO: 362528 - DNA, 25 bp, Homo sapien
ttcatttatcagatttttgggcacc

SEQ ID NO: 362529 - DNA, 25 bp, Homo sapien
cctgctgggtgccagatcttgttag

SEQ ID NO: 362530 - DNA, 25 bp, Homo sapien
gatacatacatcagatatctctctg

SEQ ID NO: 362531 - DNA, 25 bp, Homo sapien
agagacaagatacccacgcccggaa

SEQ ID NO: 362532 - DNA, 25 bp, Homo sapien
acccttccaacctttgagccagttg

SEQ ID NO: 362533 - DNA, 25 bp, Homo sapien
acctttgagccagttgttccaatta

SEQ ID NO: 362534 - DNA, 25 bp, Homo sapien
tccaattataggaactgcaccttag

SEQ ID NO: 362535 - DNA, 25 bp, Homo sapien
ggaactgcaccttaggaaacatgtg

SEQ ID NO: 362536 - DNA, 25 bp, Homo sapien
ccttaggaaacatgtgagcacacca

SEQ ID NO: 362537 - DNA, 25 bp, Homo sapien
gagcacaccaagatttatgtaccag

SEQ ID NO: 362538 - DNA, 25 bp, Homo sapien
ggattttcactgtggcacataaaat

SEQ ID NO: 362539 - DNA, 25 bp, Homo sapien
acaacctcatgttcaagaatatagg

SEQ ID NO: 362540 - DNA, 25 bp, Homo sapien
aaaattatgtaatgctaaatggcca

SEQ ID NO: 362541 - DNA, 25 bp, Homo sapien
aactgcatcttttaataatcctcaa

SEQ ID NO: 362542 - DNA, 25 bp, Homo sapien
tgagctgccaacagcccatctctga

SEQ ID NO: 362543 - DNA, 25 bp, Homo sapien
agcccatctctgaggcacagctgag

SEQ ID NO: 362544 - DNA, 25 bp, Homo sapien
ggcacagctgagagatgtcttgact

SEQ ID NO: 362545 - DNA, 25 bp, Homo sapien
agatgtcttgactcctgaattacca

SEQ ID NO: 362546 - DNA, 25 bp, Homo sapien
gcaggacagtgcctcttccttccaa

SEQ ID NO: 362547 - DNA, 25 bp, Homo sapien
tttgtcctgacactggcccagacag

SEQ ID NO: 362548 - DNA, 25 bp, Homo sapien
cccagacaggaaggcagatgatgtt

SEQ ID NO: 362549 - DNA, 25 bp, Homo sapien
gatgatgttctgcttaggacacacc

SEQ ID NO: 362550 - DNA, 25 bp, Homo sapien
taggacacaccccatgatcatttct

SEQ ID NO: 362551 - DNA, 25 bp, Homo sapien
gatcatttctcagttcaagggttgt

SEQ ID NO: 362552 - DNA, 25 bp, Homo sapien
gttcaagggttgtggttaagagatc

SEQ ID NO: 362553 - DNA, 25 bp, Homo sapien
cctgagaaacctagtgagacatcct

SEQ ID NO: 362554 - DNA, 25 bp, Homo sapien
ctgagaaacctagtgagacatcctt

SEQ ID NO: 362555 - DNA, 25 bp, Homo sapien
tgagaaacctagtgagacatccttc

SEQ ID NO: 362556 - DNA, 25 bp, Homo sapien
gagaaacctagtgagacatccttct

SEQ ID NO: 362557 - DNA, 25 bp, Homo sapien
agaaacctagtgagacatccttctc

SEQ ID NO: 362558 - DNA, 25 bp, Homo sapien
gaaacctagtgagacatccttctct

SEQ ID NO: 362559 - DNA, 25 bp, Homo sapien
aaacctagtgagacatccttctctt

SEQ ID NO: 362560 - DNA, 25 bp, Homo sapien
aacctagtgagacatccttctctta

SEQ ID NO: 362561 - DNA, 25 bp, Homo sapien
acctagtgagacatccttctcttaa

SEQ ID NO: 362562 - DNA, 25 bp, Homo sapien
aagttgacgaggagggtccacagcc

SEQ ID NO: 362563 - DNA, 25 bp, Homo sapien
tgaacttgcctttacttcggggctc

SEQ ID NO: 362564 - DNA, 25 bp, Homo sapien
ttgaaggctgacacccttcacatac

SEQ ID NO: 362565 - DNA, 25 bp, Homo sapien
aaggagcaaacaaagcaagtggctt

SEQ ID NO: 362566 - DNA, 25 bp, Homo sapien
agcaagtggcttcatcaacatccca

SEQ ID NO: 362567 - DNA, 25 bp, Homo sapien
gcaagtggcttcatcaacatcccag

SEQ ID NO: 362568 - DNA, 25 bp, Homo sapien
aagtggcttcatcaacatcccagag

SEQ ID NO: 362569 - DNA, 25 bp, Homo sapien
gtggcttcatcaacatcccagaggg

SEQ ID NO: 362570 - DNA, 25 bp, Homo sapien
ggcttcatcaacatcccagagggaa

SEQ ID NO: 362571 - DNA, 25 bp, Homo sapien
gcttcatcaacatcccagagggaaa

SEQ ID NO: 362572 - DNA, 25 bp, Homo sapien
atcaacatcccagagggaaaggcag

SEQ ID NO: 362573 - DNA, 25 bp, Homo sapien
tctaccaaatgctttactcccatga

SEQ ID NO: 362574 - DNA, 25 bp, Homo sapien
tacagtgtctgttttacaagtgaga

SEQ ID NO: 362575 - DNA, 25 bp, Homo sapien
gtcaatttgccaagtgttgcacagc

SEQ ID NO: 362576 - DNA, 25 bp, Homo sapien
gttgcacagctaaatcgagattcca

SEQ ID NO: 362577 - DNA, 25 bp, Homo sapien
gagattccagagaatgtcacctcaa

SEQ ID NO: 362578 - DNA, 25 bp, Homo sapien
atgtcacctcaaagcttctagtggg

SEQ ID NO: 362579 - DNA, 25 bp, Homo sapien
catgtaggttgtggtcgctttggat

SEQ ID NO: 362580 - DNA, 25 bp, Homo sapien
caatttcacaggcaagtttcccttg

SEQ ID NO: 362581 - DNA, 25 bp, Homo sapien
tcccttgaaaaacaactccttgcca

SEQ ID NO: 362582 - DNA, 25 bp, Homo sapien
caactccttgccataatcatcacat

SEQ ID NO: 362583 - DNA, 25 bp, Homo sapien
attcattgagtgaccatctaccaaa

SEQ ID NO: 362584 - DNA, 25 bp, Homo sapien
tagatgttgtcttggcttcccacca

SEQ ID NO: 362585 - DNA, 25 bp, Homo sapien
ttgtcttggcttcccaccagcttaa

SEQ ID NO: 362586 - DNA, 25 bp, Homo sapien
cccaccagcttaagcgttcatatgc

SEQ ID NO: 362587 - DNA, 25 bp, Homo sapien
agcttaagcgttcatatgctctgct

SEQ ID NO: 362588 - DNA, 25 bp, Homo sapien
aagcgttcatatgctctgcttttag

SEQ ID NO: 362589 - DNA, 25 bp, Homo sapien
gcgttcatatgctctgcttttagtt

SEQ ID NO: 362590 - DNA, 25 bp, Homo sapien
tcatatgctctgcttttagttcata

SEQ ID NO: 362591 - DNA, 25 bp, Homo sapien
gctctgcttttagttcatatataca

SEQ ID NO: 362592 - DNA, 25 bp, Homo sapien
tatacatacataatgtttttccttt

SEQ ID NO: 362593 - DNA, 25 bp, Homo sapien
tgtttgggatcagcttcttgcactc

SEQ ID NO: 362594 - DNA, 25 bp, Homo sapien
tgggatcagcttcttgcactccttc

SEQ ID NO: 362595 - DNA, 25 bp, Homo sapien
gaacatgggcaaaacttcttgtagt

SEQ ID NO: 362596 - DNA, 25 bp, Homo sapien
aaacttcttgtagtgagtgaggact

SEQ ID NO: 362597 - DNA, 25 bp, Homo sapien
ggatttggtcaggaggattttgctt

SEQ ID NO: 362598 - DNA, 25 bp, Homo sapien
gttagttaaacaccttagatctgtc

SEQ ID NO: 362599 - DNA, 25 bp, Homo sapien
tagatctgtcagaagaccctggagg

SEQ ID NO: 362600 - DNA, 25 bp, Homo sapien
gcttgtttcctgacaccgttatcat

SEQ ID NO: 362601 - DNA, 25 bp, Homo sapien
ccgttatcatcagcctctattttta

SEQ ID NO: 362602 - DNA, 25 bp, Homo sapien
atttcctggttatcttaatctattt

SEQ ID NO: 362603 - DNA, 25 bp, Homo sapien
aaggctgtactggaaacctacctca

SEQ ID NO: 362604 - DNA, 25 bp, Homo sapien
gaaacctacctcagcttctaaatgc

SEQ ID NO: 362605 - DNA, 25 bp, Homo sapien
aatatacaggttatgtggcagtaga

SEQ ID NO: 362606 - DNA, 25 bp, Homo sapien
gaggtctgtgtagtttgaaaaagcc

SEQ ID NO: 362607 - DNA, 25 bp, Homo sapien
gaaaaagcctattcagtatgtctgt

SEQ ID NO: 362608 - DNA, 25 bp, Homo sapien
gttattttcatagtacaaactaggc

SEQ ID NO: 362609 - DNA, 25 bp, Homo sapien
ggcaaatacaactaagtcaaactct

SEQ ID NO: 362610 - DNA, 25 bp, Homo sapien
agtcaaactctaattggcttctagc

SEQ ID NO: 362611 - DNA, 25 bp, Homo sapien
ggcttctagcaatacaaaggtgata

SEQ ID NO: 362612 - DNA, 25 bp, Homo sapien
gaaagtgactgagcaacactaccct

SEQ ID NO: 362613 - DNA, 25 bp, Homo sapien
tgagcaacactaccctacagtgtta

SEQ ID NO: 362614 - DNA, 25 bp, Homo sapien
aaatactgacttaggcagagcaggc

SEQ ID NO: 362615 - DNA, 25 bp, Homo sapien
gacttaggcagagcaggcattatgt

SEQ ID NO: 362616 - DNA, 25 bp, Homo sapien
tagaggagcatatcggaatctctgg

SEQ ID NO: 362617 - DNA, 25 bp, Homo sapien
taggcagccccatgctacgtgattc

SEQ ID NO: 362618 - DNA, 25 bp, Homo sapien
aggcagccccatgctacgtgattct

SEQ ID NO: 362619 - DNA, 25 bp, Homo sapien
ggcagccccatgctacgtgattctt

SEQ ID NO: 362620 - DNA, 25 bp, Homo sapien
cagccccatgctacgtgattcttta

SEQ ID NO: 362621 - DNA, 25 bp, Homo sapien
agccccatgctacgtgattctttat

SEQ ID NO: 362622 - DNA, 25 bp, Homo sapien
gccccatgctacgtgattctttatg

SEQ ID NO: 362623 - DNA, 25 bp, Homo sapien
ccccatgctacgtgattctttatgt

SEQ ID NO: 362624 - DNA, 25 bp, Homo sapien
cccatgctacgtgattctttatgtt

SEQ ID NO: 362625 - DNA, 25 bp, Homo sapien
ccatgctacgtgattctttatgttg

SEQ ID NO: 362626 - DNA, 25 bp, Homo sapien
gggataaaatagctgtttcacaaac

SEQ ID NO: 362627 - DNA, 25 bp, Homo sapien
aaaatagctgtttcacaaacagttt

SEQ ID NO: 362628 - DNA, 25 bp, Homo sapien
cggcaccacctctgcagaaattctg

SEQ ID NO: 362629 - DNA, 25 bp, Homo sapien
gcagaaattctgcagttcattcacc

SEQ ID NO: 362630 - DNA, 25 bp, Homo sapien
aagaaacacatgtggctcttaagca

SEQ ID NO: 362631 - DNA, 25 bp, Homo sapien
cacatgtggctcttaagcaaatgaa

SEQ ID NO: 362632 - DNA, 25 bp, Homo sapien
tgaaaaggtgaccagcctcacgcat

SEQ ID NO: 362633 - DNA, 25 bp, Homo sapien
accagcctcacgcatcgtaagagaa

SEQ ID NO: 362634 - DNA, 25 bp, Homo sapien
gaaacgcaaactctaactacaccca

SEQ ID NO: 362635 - DNA, 25 bp, Homo sapien
gcaaactctaactacacccaaattc

SEQ ID NO: 362636 - DNA, 25 bp, Homo sapien
tttgtttagtttttgcctttcagat

SEQ ID NO: 362637 - DNA, 25 bp, Homo sapien
ggtgagcctgaggagaaacagccct

SEQ ID NO: 362638 - DNA, 25 bp, Homo sapien
gaaacagccctgttgactgtgtggg

SEQ ID NO: 362639 - DNA, 25 bp, Homo sapien
ggtgccccctgctgaatttagaaaa

SEQ ID NO: 362640 - DNA, 25 bp, Homo sapien
gaatattttggaatgacgggttgta

SEQ ID NO: 362641 - DNA, 25 bp, Homo sapien
gaatgacgggttgtagtgttttcta

SEQ ID NO: 362642 - DNA, 25 bp, Homo sapien
gttttctagagtgctttagttttga

SEQ ID NO: 362643 - DNA, 25 bp, Homo sapien
tagagtgctttagttttgacatttt

SEQ ID NO: 362644 - DNA, 25 bp, Homo sapien
gaaggattattacttctctgttggg

SEQ ID NO: 362645 - DNA, 25 bp, Homo sapien
gccctagaacaatttagtcttttat

SEQ ID NO: 362646 - DNA, 25 bp, Homo sapien
atggaaaagctgactatctgggatc

SEQ ID NO: 362647 - DNA, 25 bp, Homo sapien
actatctgggatcatatgctcagtt

SEQ ID NO: 362648 - DNA, 25 bp, Homo sapien
gatctgagagatcacgttctgaagt

SEQ ID NO: 362649 - DNA, 25 bp, Homo sapien
agatcacgttctgaagtcttctcat

SEQ ID NO: 362650 - DNA, 25 bp, Homo sapien
tgccctggaaaacagccactctcac

SEQ ID NO: 362651 - DNA, 25 bp, Homo sapien
actctcacacctcttacagggagga

SEQ ID NO: 362652 - DNA, 25 bp, Homo sapien
aaacagccagcgggagagagtcagc

SEQ ID NO: 362653 - DNA, 25 bp, Homo sapien
ggaaggaaggctggccctctgcttt

SEQ ID NO: 362654 - DNA, 25 bp, Homo sapien
gaaggctggccctctgcttttggtg

SEQ ID NO: 362655 - DNA, 25 bp, Homo sapien
gcttttggtgtcaggattactattt

SEQ ID NO: 362656 - DNA, 25 bp, Homo sapien
ctatttaatgcagtagtcctctatt

SEQ ID NO: 362657 - DNA, 25 bp, Homo sapien
tttgaaggcagactgctggtactct

SEQ ID NO: 362658 - DNA, 25 bp, Homo sapien
aaggcagactgctggtactctggga

SEQ ID NO: 362659 - DNA, 25 bp, Homo sapien
agactgctggtactctgggactgcc

SEQ ID NO: 362660 - DNA, 25 bp, Homo sapien
ctgctggtactctgggactgccctg

SEQ ID NO: 362661 - DNA, 25 bp, Homo sapien
gcagagtttacccagatgtaggttt

SEQ ID NO: 362662 - DNA, 25 bp, Homo sapien
tacccagatgtaggttttccttaag

SEQ ID NO: 362663 - DNA, 25 bp, Homo sapien
gagctcagtctaaagacatgttccc

SEQ ID NO: 362664 - DNA, 25 bp, Homo sapien
agtcatattaccgaagcctcatctt

SEQ ID NO: 362665 - DNA, 25 bp, Homo sapien
gcctcatcttctcacgagttcaaaa

SEQ ID NO: 362666 - DNA, 25 bp, Homo sapien
tctcacgagttcaaaacctctccaa

SEQ ID NO: 362667 - DNA, 25 bp, Homo sapien
ctctcaggagaaaccaagggccgga

SEQ ID NO: 362668 - DNA, 25 bp, Homo sapien
aaggtcccaccaaagaatcgaagct

SEQ ID NO: 362669 - DNA, 25 bp, Homo sapien
caaagaatcgaagctggtgccagct

SEQ ID NO: 362670 - DNA, 25 bp, Homo sapien
acatgttcccaagctgaaggtttca

SEQ ID NO: 362671 - DNA, 25 bp, Homo sapien
ggcaactcacccgtttgaatcaaac

SEQ ID NO: 362672 - DNA, 25 bp, Homo sapien
gacatgttggcagtaatgctgcctt

SEQ ID NO: 362673 - DNA, 25 bp, Homo sapien
tgttggcagtaatgctgccttgtta

SEQ ID NO: 362674 - DNA, 25 bp, Homo sapien
tcacatgttttttgttgacctcctt

SEQ ID NO: 362675 - DNA, 25 bp, Homo sapien
cacatgttttttgttgacctcctta

SEQ ID NO: 362676 - DNA, 25 bp, Homo sapien
catgttttttgttgacctccttatt

SEQ ID NO: 362677 - DNA, 25 bp, Homo sapien
tgttttttgttgacctccttattat

SEQ ID NO: 362678 - DNA, 25 bp, Homo sapien
ctgctctcctagtatattccttttt

SEQ ID NO: 362679 - DNA, 25 bp, Homo sapien
gctctcctagtatattcctttttgc

SEQ ID NO: 362680 - DNA, 25 bp, Homo sapien
ctctcctagtatattcctttttgct

SEQ ID NO: 362681 - DNA, 25 bp, Homo sapien
actcagaggccggtgcaggtccttg

SEQ ID NO: 362682 - DNA, 25 bp, Homo sapien
tcagaggccggtgcaggtccttggt

SEQ ID NO: 362683 - DNA, 25 bp, Homo sapien
agcctgtcaggaccactgaggcttg

SEQ ID NO: 362684 - DNA, 25 bp, Homo sapien
tgtcaggaccactgaggcttgtttc

SEQ ID NO: 362685 - DNA, 25 bp, Homo sapien
ttccacctcagttttacacacttct

SEQ ID NO: 362686 - DNA, 25 bp, Homo sapien
agttttacacacttctcacctccag

SEQ ID NO: 362687 - DNA, 25 bp, Homo sapien
tatccgtcctttcttcacacaacag

SEQ ID NO: 362688 - DNA, 25 bp, Homo sapien
gtgcagaagaatacagctggagcat

SEQ ID NO: 362689 - DNA, 25 bp, Homo sapien
ttcacacaacagtcagagtgatctt

SEQ ID NO: 362690 - DNA, 25 bp, Homo sapien
taaacatgtaaatcaggttgcccct

SEQ ID NO: 362691 - DNA, 25 bp, Homo sapien
tgtaaatcaggttgcccctgtgggc

SEQ ID NO: 362692 - DNA, 25 bp, Homo sapien
caggttgcccctgtgggcttggttt

SEQ ID NO: 362693 - DNA, 25 bp, Homo sapien
ccctgtgggcttggtttgtgaggaa

SEQ ID NO: 362694 - DNA, 25 bp, Homo sapien
ctgtttgcaatgatagaggccgatt

SEQ ID NO: 362695 - DNA, 25 bp, Homo sapien
agttgaggcagagtgggacatccaa

SEQ ID NO: 362696 - DNA, 25 bp, Homo sapien
gcagagtgggacatccaaagcgttg

SEQ ID NO: 362697 - DNA, 25 bp, Homo sapien
gcaggattggtattgcccaggaatc

SEQ ID NO: 362698 - DNA, 25 bp, Homo sapien
acagtagccagacccgctggtagac

SEQ ID NO: 362699 - DNA, 25 bp, Homo sapien
gccagacccgctggtagacgggttt

SEQ ID NO: 362700 - DNA, 25 bp, Homo sapien
tagacgggttttaggagcaggtatc

SEQ ID NO: 362701 - DNA, 25 bp, Homo sapien
agcaggtatccttctttgagcaaga

SEQ ID NO: 362702 - DNA, 25 bp, Homo sapien
ttctttgagcaagagtgtcatgcaa

SEQ ID NO: 362703 - DNA, 25 bp, Homo sapien
caagagtgtcatgcaagttaggaat

SEQ ID NO: 362704 - DNA, 25 bp, Homo sapien
gcaagttaggaatatgaagaaccac

SEQ ID NO: 362705 - DNA, 25 bp, Homo sapien
aaacaggccgtcttttgcagaggat

SEQ ID NO: 362706 - DNA, 25 bp, Homo sapien
gaagctctccttagggcctgtcaac

SEQ ID NO: 362707 - DNA, 25 bp, Homo sapien
gatttctgaaggttcttcctaggta

SEQ ID NO: 362708 - DNA, 25 bp, Homo sapien
ctaggtaatgatgtgcccttactgc

SEQ ID NO: 362709 - DNA, 25 bp, Homo sapien
tactgccacttgtgtcaacctccag

SEQ ID NO: 362710 - DNA, 25 bp, Homo sapien
tcttcactgctgacaccagactcag

SEQ ID NO: 362711 - DNA, 25 bp, Homo sapien
ttagggcctgtcaactacttctggc

SEQ ID NO: 362712 - DNA, 25 bp, Homo sapien
ccagactcagcatcacagtggcagt

SEQ ID NO: 362713 - DNA, 25 bp, Homo sapien
agtggcagtggtagcccaatgccaa

SEQ ID NO: 362714 - DNA, 25 bp, Homo sapien
ccaatgccaagggttctgttattat

SEQ ID NO: 362715 - DNA, 25 bp, Homo sapien
ggttctgttattatctgtccagctt

SEQ ID NO: 362716 - DNA, 25 bp, Homo sapien
tacatcatgcaaaccatccttacag

SEQ ID NO: 362717 - DNA, 25 bp, Homo sapien
gcaaaccatccttacagagtgagct

SEQ ID NO: 362718 - DNA, 25 bp, Homo sapien
cagagtgagcttaccttgtgatgag

SEQ ID NO: 362719 - DNA, 25 bp, Homo sapien
gagcttaccttgtgatgagcttttt

SEQ ID NO: 362720 - DNA, 25 bp, Homo sapien
taatactttcagtcataatggtacc

SEQ ID NO: 362721 - DNA, 25 bp, Homo sapien
attttgctttttccacacactgaaa

SEQ ID NO: 362722 - DNA, 25 bp, Homo sapien
gaacttctaagaaaggtgcttgtta

SEQ ID NO: 362723 - DNA, 25 bp, Homo sapien
aaggtgcttgttaatcattcttggt

SEQ ID NO: 362724 - DNA, 25 bp, Homo sapien
ttcatcatgttttgcggtgaaaatg

SEQ ID NO: 362725 - DNA, 25 bp, Homo sapien
agtaactaactctggttgccaccta

SEQ ID NO: 362726 - DNA, 25 bp, Homo sapien
ctaactctggttgccacctaaaaat

SEQ ID NO: 362727 - DNA, 25 bp, Homo sapien
gccctcggaggcacaggaccgcggg

SEQ ID NO: 362728 - DNA, 25 bp, Homo sapien
tttcctttctcccagagcagctgga

SEQ ID NO: 362729 - DNA, 25 bp, Homo sapien
tgtccccgcgtctgaggtccgcaag

SEQ ID NO: 362730 - DNA, 25 bp, Homo sapien
ccgcgtctgaggtccgcaaggaaga

SEQ ID NO: 362731 - DNA, 25 bp, Homo sapien
tctgaggtccgcaaggaagagctgc

SEQ ID NO: 362732 - DNA, 25 bp, Homo sapien
aagagctgcgggaatgcacgcccgg

SEQ ID NO: 362733 - DNA, 25 bp, Homo sapien
tttgtgaaccgaggctcggcgcgcc

SEQ ID NO: 362734 - DNA, 25 bp, Homo sapien
cagctggaggagagcctcagtttct

SEQ ID NO: 362735 - DNA, 25 bp, Homo sapien
accctggcctgagggtagcagccga

SEQ ID NO: 362736 - DNA, 25 bp, Homo sapien
tggcctgagggtagcagccgaccca

SEQ ID NO: 362737 - DNA, 25 bp, Homo sapien
ctgagggtagcagccgacccagtcg

SEQ ID NO: 362738 - DNA, 25 bp, Homo sapien
gataatgttgatcctaaatgttagt

SEQ ID NO: 362739 - DNA, 25 bp, Homo sapien
cctaaatgttagtgtgttgatttca

SEQ ID NO: 362740 - DNA, 25 bp, Homo sapien
gttgatttcataacactcaatggag

SEQ ID NO: 362741 - DNA, 25 bp, Homo sapien
acactcaatggagaagccagtctca

SEQ ID NO: 362742 - DNA, 25 bp, Homo sapien
ccagtctcagagaggcatggtgcta

SEQ ID NO: 362743 - DNA, 25 bp, Homo sapien
ggcatggtgctagactggaagacaa

SEQ ID NO: 362744 - DNA, 25 bp, Homo sapien
gaatcaatcatgtgtatgtcaatga

SEQ ID NO: 362745 - DNA, 25 bp, Homo sapien
taattacagtaagctgatggaattc

SEQ ID NO: 362746 - DNA, 25 bp, Homo sapien
gatggaattcacttttatctatttt

SEQ ID NO: 362747 - DNA, 25 bp, Homo sapien
catgtgtatgtcaatgaagttttta

SEQ ID NO: 362748 - DNA, 25 bp, Homo sapien
atctaggttggataaatgacaatgc

SEQ ID NO: 362749 - DNA, 25 bp, Homo sapien
aagggattggcaaatggccctgtct

SEQ ID NO: 362750 - DNA, 25 bp, Homo sapien
tggcaaatggccctgtctggatcaa

SEQ ID NO: 362751 - DNA, 25 bp, Homo sapien
aatggccctgtctggatcaatgaag

SEQ ID NO: 362752 - DNA, 25 bp, Homo sapien
ggatcaatgaagtcctttgcgggta

SEQ ID NO: 362753 - DNA, 25 bp, Homo sapien
atgaagtcctttgcgggtattccta

SEQ ID NO: 362754 - DNA, 25 bp, Homo sapien
tcctttgcgggtattcctatgggca

SEQ ID NO: 362755 - DNA, 25 bp, Homo sapien
gcgggtattcctatgggcagtaaga

SEQ ID NO: 362756 - DNA, 25 bp, Homo sapien
ttagcccaccctcaatgcatatgat

SEQ ID NO: 362757 - DNA, 25 bp, Homo sapien
accctcaatgcatatgattcagatg

SEQ ID NO: 362758 - DNA, 25 bp, Homo sapien
ttttgccactcatgaggaaagcttt

SEQ ID NO: 362759 - DNA, 25 bp, Homo sapien
ttatttcccccaacctagtgataag

SEQ ID NO: 362760 - DNA, 25 bp, Homo sapien
agagcccatggcctgactgcacagc

SEQ ID NO: 362761 - DNA, 25 bp, Homo sapien
agcctgcctggaggatgggtgcgca

SEQ ID NO: 362762 - DNA, 25 bp, Homo sapien
aggcccaggactatgccagaagcga

SEQ ID NO: 362763 - DNA, 25 bp, Homo sapien
gcccaggactatgccagaagcgatg

SEQ ID NO: 362764 - DNA, 25 bp, Homo sapien
gtaggagtcccctagagtctcagaa

SEQ ID NO: 362765 - DNA, 25 bp, Homo sapien
gagtcccctagagtctcagaagact

SEQ ID NO: 362766 - DNA, 25 bp, Homo sapien
ctgggctctttggagtacagggtcc

SEQ ID NO: 362767 - DNA, 25 bp, Homo sapien
gctctttggagtacagggtccccgg

SEQ ID NO: 362768 - DNA, 25 bp, Homo sapien
ttggagtacagggtccccggcctct

SEQ ID NO: 362769 - DNA, 25 bp, Homo sapien
tctcctttaagattctctccccagc

SEQ ID NO: 362770 - DNA, 25 bp, Homo sapien
ctggaaggccgatgactgggtggtc

SEQ ID NO: 362771 - DNA, 25 bp, Homo sapien
acttggcttatggtgtggtggcatt

SEQ ID NO: 362772 - DNA, 25 bp, Homo sapien
ggtgtggtggcatttgaccaactgt

SEQ ID NO: 362773 - DNA, 25 bp, Homo sapien
gaccaactgttcttgttgaggtagt

SEQ ID NO: 362774 - DNA, 25 bp, Homo sapien
tttttgaggcatctggtttacaaac

SEQ ID NO: 362775 - DNA, 25 bp, Homo sapien
gtttacaaacacctcaagggtatag

SEQ ID NO: 362776 - DNA, 25 bp, Homo sapien
gggtatagcccaaacttggcatctt

SEQ ID NO: 362777 - DNA, 25 bp, Homo sapien
aacttggcatcttctggtagtggca

SEQ ID NO: 362778 - DNA, 25 bp, Homo sapien
ggcagaacacccagtattcagggca

SEQ ID NO: 362779 - DNA, 25 bp, Homo sapien
tcaacatactttttcatcaagacag

SEQ ID NO: 362780 - DNA, 25 bp, Homo sapien
ggcagtgttaaactcttagggtgac

SEQ ID NO: 362781 - DNA, 25 bp, Homo sapien
agggtgacacagacgattgctttaa

SEQ ID NO: 362782 - DNA, 25 bp, Homo sapien
gtccttagatacttggcctgctcag

SEQ ID NO: 362783 - DNA, 25 bp, Homo sapien
tgaggtctgaaagccagaggccagt

SEQ ID NO: 362784 - DNA, 25 bp, Homo sapien
agggcaggactggatacagcctcct

SEQ ID NO: 362785 - DNA, 25 bp, Homo sapien
agcctcctctctgcatggatgggat

SEQ ID NO: 362786 - DNA, 25 bp, Homo sapien
gaagaccagagacaccgtagctctc

SEQ ID NO: 362787 - DNA, 25 bp, Homo sapien
tcgactcacacagcaaatgtcttga

SEQ ID NO: 362788 - DNA, 25 bp, Homo sapien
tgagacccggaaacagcagcgccat

SEQ ID NO: 362789 - DNA, 25 bp, Homo sapien
tgctgcccacctgaaatgcagaggt

SEQ ID NO: 362790 - DNA, 25 bp, Homo sapien
aaatgcagaggtagctcacccagcc

SEQ ID NO: 362791 - DNA, 25 bp, Homo sapien
acccagccctgctgagggtactgtg

SEQ ID NO: 362792 - DNA, 25 bp, Homo sapien
aagctgctgtccttagatacttggc

SEQ ID NO: 362793 - DNA, 25 bp, Homo sapien
agggccagaactaagcctgtataat

SEQ ID NO: 362794 - DNA, 25 bp, Homo sapien
gataggaaccttctgggtgcatgat

SEQ ID NO: 362795 - DNA, 25 bp, Homo sapien
gtgcatgatgagtggatcttctgat

SEQ ID NO: 362796 - DNA, 25 bp, Homo sapien
gatacatttaaagtgtcccctgttg

SEQ ID NO: 362797 - DNA, 25 bp, Homo sapien
taaagtgtcccctgttggtggcttc

SEQ ID NO: 362798 - DNA, 25 bp, Homo sapien
gtgaccaagaatggcctgtaatcct

SEQ ID NO: 362799 - DNA, 25 bp, Homo sapien
ggcctgtaatcctgaagcctgccaa

SEQ ID NO: 362800 - DNA, 25 bp, Homo sapien
gaaacaatgcttcctaccaggtgga

SEQ ID NO: 362801 - DNA, 25 bp, Homo sapien
aatgcagtattcttatccgagacgt

SEQ ID NO: 362802 - DNA, 25 bp, Homo sapien
tcttatccgagacgtaatagaggcc

SEQ ID NO: 362803 - DNA, 25 bp, Homo sapien
tgctgaacaacactatccaccagtt

SEQ ID NO: 362804 - DNA, 25 bp, Homo sapien
gggaacatgtctccaacttggaacc

SEQ ID NO: 362805 - DNA, 25 bp, Homo sapien
gatggctaatagcagcatctgcctt

SEQ ID NO: 362806 - DNA, 25 bp, Homo sapien
tggagcgctccctatgtggtaagca

SEQ ID NO: 362807 - DNA, 25 bp, Homo sapien
ccctatgtggtaagcactgtgctaa

SEQ ID NO: 362808 - DNA, 25 bp, Homo sapien
gctaaacacgtatgtgttgcctttt

SEQ ID NO: 362809 - DNA, 25 bp, Homo sapien
gttgccttttctggtccttatgata

SEQ ID NO: 362810 - DNA, 25 bp, Homo sapien
ggtccttatgatagttctagcagct

SEQ ID NO: 362811 - DNA, 25 bp, Homo sapien
tctagcagcttttgaacccaggtct

SEQ ID NO: 362812 - DNA, 25 bp, Homo sapien
gaacccaggtcttttctggtgtcaa

SEQ ID NO: 362813 - DNA, 25 bp, Homo sapien
ggtgtcaaaacctttgctcttgttc

SEQ ID NO: 362814 - DNA, 25 bp, Homo sapien
acaggtgaaagacccagttcaaagg

SEQ ID NO: 362815 - DNA, 25 bp, Homo sapien
tgaattttctcatcatagtcttaaa

SEQ ID NO: 362816 - DNA, 25 bp, Homo sapien
gaatcaaacaactgatggaggctga

SEQ ID NO: 362817 - DNA, 25 bp, Homo sapien
gaatacatgacgatcaatgacactt

SEQ ID NO: 362818 - DNA, 25 bp, Homo sapien
gatcaatgacacttggtacacacgt

SEQ ID NO: 362819 - DNA, 25 bp, Homo sapien
tgacacttggtacacacgttcacac

SEQ ID NO: 362820 - DNA, 25 bp, Homo sapien
ttggtacacacgttcacactcacag

SEQ ID NO: 362821 - DNA, 25 bp, Homo sapien
acgttcacactcacagacacataca

SEQ ID NO: 362822 - DNA, 25 bp, Homo sapien
acagacacatacacaaacgttggat

SEQ ID NO: 362823 - DNA, 25 bp, Homo sapien
cacaaacgttggataggaaaaggct

SEQ ID NO: 362824 - DNA, 25 bp, Homo sapien
aaaaggctggctggcaacatgtggc

SEQ ID NO: 362825 - DNA, 25 bp, Homo sapien
acatgtggcaacagtgctctgtaag

SEQ ID NO: 362826 - DNA, 25 bp, Homo sapien
tcataatagatgtctctccagcgtg

SEQ ID NO: 362827 - DNA, 25 bp, Homo sapien
ggaccctgaggcagtgacgcttagt

SEQ ID NO: 362828 - DNA, 25 bp, Homo sapien
gcagtgacgcttagtaatgtatcct

SEQ ID NO: 362829 - DNA, 25 bp, Homo sapien
gtatcctaatagtcagtgtttgtct

SEQ ID NO: 362830 - DNA, 25 bp, Homo sapien
aaaacactgaagcagaccgtaccaa

SEQ ID NO: 362831 - DNA, 25 bp, Homo sapien
gtttgtctgacaaatacctagtgac

SEQ ID NO: 362832 - DNA, 25 bp, Homo sapien
acctagtgaccacaagcctaatcag

SEQ ID NO: 362833 - DNA, 25 bp, Homo sapien
gtgaccacaagcctaatcagggccg

SEQ ID NO: 362834 - DNA, 25 bp, Homo sapien
tgaagcagaccgtaccaaattgact

SEQ ID NO: 362835 - DNA, 25 bp, Homo sapien
gaccgtaccaaattgactttattgt

SEQ ID NO: 362836 - DNA, 25 bp, Homo sapien
ttttaaaaccagccccttctgtctg

SEQ ID NO: 362837 - DNA, 25 bp, Homo sapien
ggacttgtcagaattgccagtactt

SEQ ID NO: 362838 - DNA, 25 bp, Homo sapien
attgccagtactttctattctagct

SEQ ID NO: 362839 - DNA, 25 bp, Homo sapien
tattctagctgcaaatcccgataaa

SEQ ID NO: 362840 - DNA, 25 bp, Homo sapien
aaaggttctctcactactgttaggc

SEQ ID NO: 362841 - DNA, 25 bp, Homo sapien
ctcactactgttaggctacttttcc

SEQ ID NO: 362842 - DNA, 25 bp, Homo sapien
ggctacttttccagtataatcttcc

SEQ ID NO: 362843 - DNA, 25 bp, Homo sapien
aatcttccatattcttcacttacca

SEQ ID NO: 362844 - DNA, 25 bp, Homo sapien
cacttaccagttgaactttgtgctt

SEQ ID NO: 362845 - DNA, 25 bp, Homo sapien
ctttgtgcttattgaagttctgttg

SEQ ID NO: 362846 - DNA, 25 bp, Homo sapien
ctgttgtatttttcaaacctgtgta

SEQ ID NO: 362847 - DNA, 25 bp, Homo sapien
gacaccaaagattacatattacagg

SEQ ID NO: 362848 - DNA, 25 bp, Homo sapien
aatcataatagatgtctctccagcg

SEQ ID NO: 362849 - DNA, 25 bp, Homo sapien
tcataatagatgtctctccagcgtg

SEQ ID NO: 362850 - DNA, 25 bp, Homo sapien
tctctccagcgtgcacctctgttct

SEQ ID NO: 362851 - DNA, 25 bp, Homo sapien
aaaacactgaagcagaccgtaccaa

SEQ ID NO: 362852 - DNA, 25 bp, Homo sapien
acactgaagcagaccgtaccaaatt

SEQ ID NO: 362853 - DNA, 25 bp, Homo sapien
cactgaagcagaccgtaccaaattg

SEQ ID NO: 362854 - DNA, 25 bp, Homo sapien
tgaagcagaccgtaccaaattgact

SEQ ID NO: 362855 - DNA, 25 bp, Homo sapien
aagcagaccgtaccaaattgacttt

SEQ ID NO: 362856 - DNA, 25 bp, Homo sapien
gcagaccgtaccaaattgactttat

SEQ ID NO: 362857 - DNA, 25 bp, Homo sapien
gaccgtaccaaattgactttattgt

SEQ ID NO: 362858 - DNA, 25 bp, Homo sapien
ttttaaaaccagccccttctgtctg

SEQ ID NO: 362859 - DNA, 25 bp, Homo sapien
ccaccagcaacatggaatcttcagt

SEQ ID NO: 362860 - DNA, 25 bp, Homo sapien
agtggatgcagctgaccaaccctcc

SEQ ID NO: 362861 - DNA, 25 bp, Homo sapien
ctgttggcaaacaagagctccacca

SEQ ID NO: 362862 - DNA, 25 bp, Homo sapien
ggatgcagctgaccaaccctcctga

SEQ ID NO: 362863 - DNA, 25 bp, Homo sapien
aaccctcctgacttctcagtctttt

SEQ ID NO: 362864 - DNA, 25 bp, Homo sapien
actgctcaccctttatgttcagatg

SEQ ID NO: 362865 - DNA, 25 bp, Homo sapien
gctcaccctttatgttcagatgtat

SEQ ID NO: 362866 - DNA, 25 bp, Homo sapien
tatgttcagatgtattcagcactag

SEQ ID NO: 362867 - DNA, 25 bp, Homo sapien
gcaaacaagagctccaccaaacttt

SEQ ID NO: 362868 - DNA, 25 bp, Homo sapien
gatgtattcagcactagataaccat

SEQ ID NO: 362869 - DNA, 25 bp, Homo sapien
ccatttttctcaccagtggcaggag

SEQ ID NO: 362870 - DNA, 25 bp, Homo sapien
tgaattccagacaattaatcattca

SEQ ID NO: 362871 - DNA, 25 bp, Homo sapien
ttcatctcatcagttcagcaaagca

SEQ ID NO: 362872 - DNA, 25 bp, Homo sapien
gttcagcaaagcaaatgccctcaat

SEQ ID NO: 362873 - DNA, 25 bp, Homo sapien
aaagcaaatgccctcaatggtttct

SEQ ID NO: 362874 - DNA, 25 bp, Homo sapien
gcaaatgccctcaatggtttctttt

SEQ ID NO: 362875 - DNA, 25 bp, Homo sapien
aatgccctcaatggtttcttttgtg

SEQ ID NO: 362876 - DNA, 25 bp, Homo sapien
gccctcaatggtttcttttgtgatt

SEQ ID NO: 362877 - DNA, 25 bp, Homo sapien
cttttgtgattcgattattatggga

SEQ ID NO: 362878 - DNA, 25 bp, Homo sapien
cgattattatgggatcagaatgtat

SEQ ID NO: 362879 - DNA, 25 bp, Homo sapien
gaatgtatcttattcctctgggaaa

SEQ ID NO: 362880 - DNA, 25 bp, Homo sapien
tattcctctgggaaaaatgaaacat

SEQ ID NO: 362881 - DNA, 25 bp, Homo sapien
actgctctagtggaaaaagctcaga

SEQ ID NO: 362882 - DNA, 25 bp, Homo sapien
gaactggtgacaggttctagtctgt

SEQ ID NO: 362883 - DNA, 25 bp, Homo sapien
gttctagtctgtcaccaattatcat

SEQ ID NO: 362884 - DNA, 25 bp, Homo sapien
caattatcatgtggccttctgtctg

SEQ ID NO: 362885 - DNA, 25 bp, Homo sapien
gtggccttctgtctgaccattattt

SEQ ID NO: 362886 - DNA, 25 bp, Homo sapien
ctgaccattatttcatctatatgat

SEQ ID NO: 362887 - DNA, 25 bp, Homo sapien
gttgattagctctcaatctggcacc

SEQ ID NO: 362888 - DNA, 25 bp, Homo sapien
aatctggcaccttgaaaccttccag

SEQ ID NO: 362889 - DNA, 25 bp, Homo sapien
tccagagtcctcaaagttggtaaga

SEQ ID NO: 362890 - DNA, 25 bp, Homo sapien
ggatgagctacgtttaacataccag

SEQ ID NO: 362891 - DNA, 25 bp, Homo sapien
ggatgccaaaatattggacaccact

SEQ ID NO: 362892 - DNA, 25 bp, Homo sapien
gaccaatttaagcactgaagtttga

SEQ ID NO: 362893 - DNA, 25 bp, Homo sapien
aatttaagcactgaagtttgaaaca

SEQ ID NO: 362894 - DNA, 25 bp, Homo sapien
gtcacctttggagggtgatagtgaa

SEQ ID NO: 362895 - DNA, 25 bp, Homo sapien
gaagcaactcatttattctgaaaac

SEQ ID NO: 362896 - DNA, 25 bp, Homo sapien
gcaactcatttattctgaaaacaag

SEQ ID NO: 362897 - DNA, 25 bp, Homo sapien
tattttattctaactttcctataca

SEQ ID NO: 362898 - DNA, 25 bp, Homo sapien
tattctaactttcctatacaaattg

SEQ ID NO: 362899 - DNA, 25 bp, Homo sapien
tatacaaattgtacctccacatata

SEQ ID NO: 362900 - DNA, 25 bp, Homo sapien
aaattgtacctccacatataaaata

SEQ ID NO: 362901 - DNA, 25 bp, Homo sapien
aaatttttcagaattccagcaataa

SEQ ID NO: 362902 - DNA, 25 bp, Homo sapien
tttttcagaattccagcaataaatg

SEQ ID NO: 362903 - DNA, 25 bp, Homo sapien
aacatcccaaatagtctgcatcctg

SEQ ID NO: 362904 - DNA, 25 bp, Homo sapien
gtctgcatcctgcatttgccagtgg

SEQ ID NO: 362905 - DNA, 25 bp, Homo sapien
gccagtggcccatgtattttttttt

SEQ ID NO: 362906 - DNA, 25 bp, Homo sapien
aaagatgaatagtgcactgctcagg

SEQ ID NO: 362907 - DNA, 25 bp, Homo sapien
tagtgcactgctcaggacacttttc

SEQ ID NO: 362908 - DNA, 25 bp, Homo sapien
caggacacttttctaaagcgagtaa

SEQ ID NO: 362909 - DNA, 25 bp, Homo sapien
atccacacttctcgatcgttgtatg

SEQ ID NO: 362910 - DNA, 25 bp, Homo sapien
tctcgatcgttgtatgaatcaaacc

SEQ ID NO: 362911 - DNA, 25 bp, Homo sapien
gaatcaaaccaagtgcaaaccaagt

SEQ ID NO: 362912 - DNA, 25 bp, Homo sapien
aaaccaagtgtttgcagtcatgcct

SEQ ID NO: 362913 - DNA, 25 bp, Homo sapien
gcagtcatgcctgtttccataaaac

SEQ ID NO: 362914 - DNA, 25 bp, Homo sapien
ctctcaatgagtcccacaagtgcgt

SEQ ID NO: 362915 - DNA, 25 bp, Homo sapien
aagagcccaggtaagctgagaacct

SEQ ID NO: 362916 - DNA, 25 bp, Homo sapien
tgagaacctgatactccatctactt

SEQ ID NO: 362917 - DNA, 25 bp, Homo sapien
ccatctactttaatcaccatccttt

SEQ ID NO: 362918 - DNA, 25 bp, Homo sapien
accatcctttccagacttaaagaag

SEQ ID NO: 362919 - DNA, 25 bp, Homo sapien
gaaggattgcccatgcacaggtagt

SEQ ID NO: 362920 - DNA, 25 bp, Homo sapien
acaggtagtgactccttaaaggcac

SEQ ID NO: 362921 - DNA, 25 bp, Homo sapien
ttaaaggcacaaatcatgactgaat

SEQ ID NO: 362922 - DNA, 25 bp, Homo sapien
gaatgtgttttcaagtccagaacag

SEQ ID NO: 362923 - DNA, 25 bp, Homo sapien
taaaacccagattcctaattccttg

SEQ ID NO: 362924 - DNA, 25 bp, Homo sapien
cagattcctaattccttgtttcctt

SEQ ID NO: 362925 - DNA, 25 bp, Homo sapien
gatggataaacaggtctcgtctctt

SEQ ID NO: 362926 - DNA, 25 bp, Homo sapien
tgagctggtggcacaacggattaat

SEQ ID NO: 362927 - DNA, 25 bp, Homo sapien
caacggattaatgaggcaacagggc

SEQ ID NO: 362928 - DNA, 25 bp, Homo sapien
gctctagatggtgagtgggatcaat

SEQ ID NO: 362929 - DNA, 25 bp, Homo sapien
agtgggatcaatgagacccaattga

SEQ ID NO: 362930 - DNA, 25 bp, Homo sapien
acccaattgagctgttagcggtctt

SEQ ID NO: 362931 - DNA, 25 bp, Homo sapien
ttagcggtcttaggcggagagcatc

SEQ ID NO: 362932 - DNA, 25 bp, Homo sapien
cttaggcggagagcatctctcagga

SEQ ID NO: 362933 - DNA, 25 bp, Homo sapien
aaggaaggcacagcgagaagaccta

SEQ ID NO: 362934 - DNA, 25 bp, Homo sapien
tttgcagattgctgcgtatcccagt

SEQ ID NO: 362935 - DNA, 25 bp, Homo sapien
tgcgtatcccagtgtcggcgatgga

SEQ ID NO: 362936 - DNA, 25 bp, Homo sapien
gctttggattaaggccttgatgcac

SEQ ID NO: 362937 - DNA, 25 bp, Homo sapien
actctggccagagaattagtagttg

SEQ ID NO: 362938 - DNA, 25 bp, Homo sapien
attagtagttgctgtttccgtgtgc

SEQ ID NO: 362939 - DNA, 25 bp, Homo sapien
tagttgctgtttccgtgtgcatatc

SEQ ID NO: 362940 - DNA, 25 bp, Homo sapien
gagaggcaagtttcctgggacagaa

SEQ ID NO: 362941 - DNA, 25 bp, Homo sapien
gaaatgtcctttgcttcttctagaa

SEQ ID NO: 362942 - DNA, 25 bp, Homo sapien
gtcctttgcttcttctagaatcaaa

SEQ ID NO: 362943 - DNA, 25 bp, Homo sapien
ggtatttcctttctcataagattcc

SEQ ID NO: 362944 - DNA, 25 bp, Homo sapien
gccacagcctcatttctctgttggt

SEQ ID NO: 362945 - DNA, 25 bp, Homo sapien
atttctctgttggtgccctataata

SEQ ID NO: 362946 - DNA, 25 bp, Homo sapien
ataatagcaaatgccagacagctgg

SEQ ID NO: 362947 - DNA, 25 bp, Homo sapien
gagggagtgatctgtcaaccgtaat

SEQ ID NO: 362948 - DNA, 25 bp, Homo sapien
aaccgtaatttggaatcatcactca

SEQ ID NO: 362949 - DNA, 25 bp, Homo sapien
gaatcatcactcactgacactgggc

SEQ ID NO: 362950 - DNA, 25 bp, Homo sapien
tgacactgggcaagcatgatttcag

SEQ ID NO: 362951 - DNA, 25 bp, Homo sapien
agttggcaagactcagctatcctgg

SEQ ID NO: 362952 - DNA, 25 bp, Homo sapien
tatcctggtagaatagtcatgcttt

SEQ ID NO: 362953 - DNA, 25 bp, Homo sapien
ggaaaagcagctaaccatatgatgg

SEQ ID NO: 362954 - DNA, 25 bp, Homo sapien
gaaaaccgtcacagtagtgctcttg

SEQ ID NO: 362955 - DNA, 25 bp, Homo sapien
agtgctcttgagacccaagcaggga

SEQ ID NO: 362956 - DNA, 25 bp, Homo sapien
cttggattaagatggctgactgggt

SEQ ID NO: 362957 - DNA, 25 bp, Homo sapien
ctgactgggttcctctggcaggaaa

SEQ ID NO: 362958 - DNA, 25 bp, Homo sapien
aatattgtcatacattcctgctaag

SEQ ID NO: 362959 - DNA, 25 bp, Homo sapien
tacattcctgctaagtataatatga

SEQ ID NO: 362960 - DNA, 25 bp, Homo sapien
tgaaatgttaaacggctcagagcta

SEQ ID NO: 362961 - DNA, 25 bp, Homo sapien
acggctcagagctaacgaatccatg

SEQ ID NO: 362962 - DNA, 25 bp, Homo sapien
gagctaacgaatccatggtcttcat

SEQ ID NO: 362963 - DNA, 25 bp, Homo sapien
aacgaatccatggtcttcattcagt

SEQ ID NO: 362964 - DNA, 25 bp, Homo sapien
gtcttcattcagttggcttgtgaag

SEQ ID NO: 362965 - DNA, 25 bp, Homo sapien
ggcttgtgaagtatctatccttgac

SEQ ID NO: 362966 - DNA, 25 bp, Homo sapien
tcactgctgtccttattcactttaa

SEQ ID NO: 362967 - DNA, 25 bp, Homo sapien
gctgtccttattcactttaaagctt

SEQ ID NO: 362968 - DNA, 25 bp, Homo sapien
ttcactttaaagctttgttcatcta

SEQ ID NO: 362969 - DNA, 25 bp, Homo sapien
tattacatgccatataagttccaga

SEQ ID NO: 362970 - DNA, 25 bp, Homo sapien
gaatcattccttttgacagtcccat

SEQ ID NO: 362971 - DNA, 25 bp, Homo sapien
acagtcccatgggatttaatcccct

SEQ ID NO: 362972 - DNA, 25 bp, Homo sapien
tcccctcctaaatcccaaaatatag

SEQ ID NO: 362973 - DNA, 25 bp, Homo sapien
gagaaaatgtttgggtacagcactg

SEQ ID NO: 362974 - DNA, 25 bp, Homo sapien
gggcatcatgcatactgaatattca

SEQ ID NO: 362975 - DNA, 25 bp, Homo sapien
gccttgtggttatttttactcgctt

SEQ ID NO: 362976 - DNA, 25 bp, Homo sapien
tttactcgcttgcaaaagtgaggaa

SEQ ID NO: 362977 - DNA, 25 bp, Homo sapien
aggatgttataggtctctttgagcc

SEQ ID NO: 362978 - DNA, 25 bp, Homo sapien
ataggtctctttgagcctctttgct

SEQ ID NO: 362979 - DNA, 25 bp, Homo sapien
taccctttatttctatatgatctac

SEQ ID NO: 362980 - DNA, 25 bp, Homo sapien
ctgcattctgaaatagttgtctagg

SEQ ID NO: 362981 - DNA, 25 bp, Homo sapien
cagtgagtgctatttgtaagatata

SEQ ID NO: 362982 - DNA, 25 bp, Homo sapien
atttaaagtcttcatacagttatta

SEQ ID NO: 362983 - DNA, 25 bp, Homo sapien
acagttattaactagctccaatatt

SEQ ID NO: 362984 - DNA, 25 bp, Homo sapien
aactagctccaatattactgaaatg

SEQ ID NO: 362985 - DNA, 25 bp, Homo sapien
aaatgatttctccaaatatcctata

SEQ ID NO: 362986 - DNA, 25 bp, Homo sapien
taattatcatgctggcaaatttatt

SEQ ID NO: 362987 - DNA, 25 bp, Homo sapien
atatccactgattaatgccacctat

SEQ ID NO: 362988 - DNA, 25 bp, Homo sapien
tgattaatgccacctatctgctttc

SEQ ID NO: 362989 - DNA, 25 bp, Homo sapien
aatgccacctatctgctttcctgaa

SEQ ID NO: 362990 - DNA, 25 bp, Homo sapien
tctgctttcctgaattcaaagttta

SEQ ID NO: 362991 - DNA, 25 bp, Homo sapien
atgcatgaattagctccctctgagt

SEQ ID NO: 362992 - DNA, 25 bp, Homo sapien
cctctgagttccaggcactatgctg

SEQ ID NO: 362993 - DNA, 25 bp, Homo sapien
gtctgctttcaagcaactcactgtg

SEQ ID NO: 362994 - DNA, 25 bp, Homo sapien
ggaacagaaatgagacccctatctt

SEQ ID NO: 362995 - DNA, 25 bp, Homo sapien
ttactgtcttttgcctgccaatctg

SEQ ID NO: 362996 - DNA, 25 bp, Homo sapien
gcctgccaatctgtatttgaaacca

SEQ ID NO: 362997 - DNA, 25 bp, Homo sapien
gaaaccattggacactgattctctg

SEQ ID NO: 362998 - DNA, 25 bp, Homo sapien
tggacactgattctctggcctggga

SEQ ID NO: 362999 - DNA, 25 bp, Homo sapien
tctggcctgggactttggcattgat

SEQ ID NO: 363000 - DNA, 25 bp, Homo sapien
gactttggcattgatggttttctgc

SEQ ID NO: 363001 - DNA, 25 bp, Homo sapien
gcctctgcctctattgcatttatta

SEQ ID NO: 363002 - DNA, 25 bp, Homo sapien
tccttactaagagttagttccctag

SEQ ID NO: 363003 - DNA, 25 bp, Homo sapien
agttccctagcccatcagaaagatt

SEQ ID NO: 363004 - DNA, 25 bp, Homo sapien
gaaagattcccaggctggctacttc

SEQ ID NO: 363005 - DNA, 25 bp, Homo sapien
aggctggctacttcgggatgaccct

SEQ ID NO: 363006 - DNA, 25 bp, Homo sapien
gctacttcgggatgacccttgcatt

SEQ ID NO: 363007 - DNA, 25 bp, Homo sapien
gacccttgcattttttattgaaatc

SEQ ID NO: 363008 - DNA, 25 bp, Homo sapien
ttttccccactagcttttaagacat

SEQ ID NO: 363009 - DNA, 25 bp, Homo sapien
gacataggaactatatcttgttcag

SEQ ID NO: 363010 - DNA, 25 bp, Homo sapien
atcttgttcagctttgcacttccaa

SEQ ID NO: 363011 - DNA, 25 bp, Homo sapien
gttcagctttgcacttccaattata

SEQ ID NO: 363012 - DNA, 25 bp, Homo sapien
ggctcaagcagtttgcccgcctgag

SEQ ID NO: 363013 - DNA, 25 bp, Homo sapien
gaaactgttccagggtgtacaaatc

SEQ ID NO: 363014 - DNA, 25 bp, Homo sapien
cagggtgtacaaatcccacgccaac

SEQ ID NO: 363015 - DNA, 25 bp, Homo sapien
ggcaaatactgttctgatcttagca

SEQ ID NO: 363016 - DNA, 25 bp, Homo sapien
tgatcttagcaacccagaataacct

SEQ ID NO: 363017 - DNA, 25 bp, Homo sapien
cccagaataacctttgtgccattta

SEQ ID NO: 363018 - DNA, 25 bp, Homo sapien
caacacatatttcttgggcagctat

SEQ ID NO: 363019 - DNA, 25 bp, Homo sapien
tagagagatgtattgctggctcttc

SEQ ID NO: 363020 - DNA, 25 bp, Homo sapien
gggcagctattatgggtcaggcact

SEQ ID NO: 363021 - DNA, 25 bp, Homo sapien
ttgctggctcttccaagaaatggag

SEQ ID NO: 363022 - DNA, 25 bp, Homo sapien
actttgcccaggaccattgtgccag

SEQ ID NO: 363023 - DNA, 25 bp, Homo sapien
gaccattgtgccagtgtgcaagaat

SEQ ID NO: 363024 - DNA, 25 bp, Homo sapien
gcattttactgtgattacttgtgaa

SEQ ID NO: 363025 - DNA, 25 bp, Homo sapien
tactgtgattacttgtgaaagtcat

SEQ ID NO: 363026 - DNA, 25 bp, Homo sapien
agttaatttccaatgcatttattca

SEQ ID NO: 363027 - DNA, 25 bp, Homo sapien
cataaaatattcattctggaatgca

SEQ ID NO: 363028 - DNA, 25 bp, Homo sapien
tctggaatgcagtgtttgtttaaat

SEQ ID NO: 363029 - DNA, 25 bp, Homo sapien
gaatgcagtgtttgtttaaatgtaa

SEQ ID NO: 363030 - DNA, 25 bp, Homo sapien
tagaattagtggtggctgtagtgct

SEQ ID NO: 363031 - DNA, 25 bp, Homo sapien
attagtggtggctgtagtgctgtat

SEQ ID NO: 363032 - DNA, 25 bp, Homo sapien
gtggtggctgtagtgctgtatttat

SEQ ID NO: 363033 - DNA, 25 bp, Homo sapien
gctgtagtgctgtatttattgctta

SEQ ID NO: 363034 - DNA, 25 bp, Homo sapien
attttctcttggttttaatctgcta

SEQ ID NO: 363035 - DNA, 25 bp, Homo sapien
ggagtaagacccacatgttgaaaca

SEQ ID NO: 363036 - DNA, 25 bp, Homo sapien
gttgaaacatattatagggctctag

SEQ ID NO: 363037 - DNA, 25 bp, Homo sapien
gaaggcaaacaactccatgtaacga

SEQ ID NO: 363038 - DNA, 25 bp, Homo sapien
taacgagggtggacactgagtgtct

SEQ ID NO: 363039 - DNA, 25 bp, Homo sapien
gtctgatgaggacagtatttcacag

SEQ ID NO: 363040 - DNA, 25 bp, Homo sapien
aatgctgtaaggtagccaaactcca

SEQ ID NO: 363041 - DNA, 25 bp, Homo sapien
ggagacagatcactccatccagcag

SEQ ID NO: 363042 - DNA, 25 bp, Homo sapien
ggtagccaaactccaagattaatat

SEQ ID NO: 363043 - DNA, 25 bp, Homo sapien
gagcttagtacgtgaagacatgcct

SEQ ID NO: 363044 - DNA, 25 bp, Homo sapien
gtgaagacatgccttggttcctaga

SEQ ID NO: 363045 - DNA, 25 bp, Homo sapien
gacatgccttggttcctagataaat

SEQ ID NO: 363046 - DNA, 25 bp, Homo sapien
gcagcacagttgtatgtggtaggta

SEQ ID NO: 363047 - DNA, 25 bp, Homo sapien
tggtaggtatttctagccccactgc

SEQ ID NO: 363048 - DNA, 25 bp, Homo sapien
gatggttcttgttatgagggtgtca

SEQ ID NO: 363049 - DNA, 25 bp, Homo sapien
gcctttcaaacccagtcgtgtcaaa

SEQ ID NO: 363050 - DNA, 25 bp, Homo sapien
aaccctgccttattaattagcattt

SEQ ID NO: 363051 - DNA, 25 bp, Homo sapien
gcattttccaaaggttcagtttgct

SEQ ID NO: 363052 - DNA, 25 bp, Homo sapien
tagtaagcagagaaattgacccaat

SEQ ID NO: 363053 - DNA, 25 bp, Homo sapien
gggtgtcaggaccacataatttgat

SEQ ID NO: 363054 - DNA, 25 bp, Homo sapien
tgattgttggtactctggaaagaaa

SEQ ID NO: 363055 - DNA, 25 bp, Homo sapien
aaaattgtgggacttggatcactga

SEQ ID NO: 363056 - DNA, 25 bp, Homo sapien
ggatcactgaataatctctgaattt

SEQ ID NO: 363057 - DNA, 25 bp, Homo sapien
gaagccgcacagacttggcctggca

SEQ ID NO: 363058 - DNA, 25 bp, Homo sapien
cggcgcttcacaaggcagagcgttc

SEQ ID NO: 363059 - DNA, 25 bp, Homo sapien
ttcacaaggcagagcgttcggcccc

SEQ ID NO: 363060 - DNA, 25 bp, Homo sapien
ccgggaagcggcatcgctaaaagga

SEQ ID NO: 363061 - DNA, 25 bp, Homo sapien
ggcatcgctaaaaggaaggctcagt

SEQ ID NO: 363062 - DNA, 25 bp, Homo sapien
gaaggctcagtgaaacgcttggcaa

SEQ ID NO: 363063 - DNA, 25 bp, Homo sapien
tcagtgaaacgcttggcaaagtcca

SEQ ID NO: 363064 - DNA, 25 bp, Homo sapien
gcttggcaaagtccaagccgcgccg

SEQ ID NO: 363065 - DNA, 25 bp, Homo sapien
cgccgcccagccagttgtctataag

SEQ ID NO: 363066 - DNA, 25 bp, Homo sapien
agccagttgtctataagcccagcca

SEQ ID NO: 363067 - DNA, 25 bp, Homo sapien
ctgagtgggcgctcgttctcaggcc

SEQ ID NO: 363068 - DNA, 25 bp, Homo sapien
cgggacagagtttggtggcctcatt

SEQ ID NO: 363069 - DNA, 25 bp, Homo sapien
gggacagagtttggtggcctcattt

SEQ ID NO: 363070 - DNA, 25 bp, Homo sapien
ggacagagtttggtggcctcattta

SEQ ID NO: 363071 - DNA, 25 bp, Homo sapien
gacagagtttggtggcctcatttac

SEQ ID NO: 363072 - DNA, 25 bp, Homo sapien
acagagtttggtggcctcatttacc

SEQ ID NO: 363073 - DNA, 25 bp, Homo sapien
cagagtttggtggcctcatttacca

SEQ ID NO: 363074 - DNA, 25 bp, Homo sapien
gagtttggtggcctcatttaccaga

SEQ ID NO: 363075 - DNA, 25 bp, Homo sapien
ctgctgtcaatctcacctggacagc

SEQ ID NO: 363076 - DNA, 25 bp, Homo sapien
tgctgtcaatctcacctggacagca

SEQ ID NO: 363077 - DNA, 25 bp, Homo sapien
aagtatttgattgaccctgaagcct

SEQ ID NO: 363078 - DNA, 25 bp, Homo sapien
agtatttgattgaccctgaagcctg

SEQ ID NO: 363079 - DNA, 25 bp, Homo sapien
tacctttgatattctctgtagatat

SEQ ID NO: 363080 - DNA, 25 bp, Homo sapien
tattctctgtagatattagttgaac

SEQ ID NO: 363081 - DNA, 25 bp, Homo sapien
tagttgaacatagttctcaccaaag

SEQ ID NO: 363082 - DNA, 25 bp, Homo sapien
agttctcaccaaagttagctatcca

SEQ ID NO: 363083 - DNA, 25 bp, Homo sapien
ccaaagttagctatccaaattcagg

SEQ ID NO: 363084 - DNA, 25 bp, Homo sapien
aactttgattcatttactagattgt

SEQ ID NO: 363085 - DNA, 25 bp, Homo sapien
gcagggaaaaatcttcctctcacct

SEQ ID NO: 363086 - DNA, 25 bp, Homo sapien
aaaatcttcctctcacctgtcagag

SEQ ID NO: 363087 - DNA, 25 bp, Homo sapien
tcacctgtcagagctactttttaaa

SEQ ID NO: 363088 - DNA, 25 bp, Homo sapien
ctgtcagagctactttttaaatatg

SEQ ID NO: 363089 - DNA, 25 bp, Homo sapien
gtagctgcttataaggtgatgtgat

SEQ ID NO: 363090 - DNA, 25 bp, Homo sapien
aatgggggaatacccacagtgagaa

SEQ ID NO: 363091 - DNA, 25 bp, Homo sapien
aattagatgagatagatgcatttga

SEQ ID NO: 363092 - DNA, 25 bp, Homo sapien
gtgcccacctgtggtgggtagttag

SEQ ID NO: 363093 - DNA, 25 bp, Homo sapien
cacctgtggtgggtagttaggtagc

SEQ ID NO: 363094 - DNA, 25 bp, Homo sapien
gttaggtagctgttacaaagtgccc

SEQ ID NO: 363095 - DNA, 25 bp, Homo sapien
ttaggtagctgttacaaagtgcccc

SEQ ID NO: 363096 - DNA, 25 bp, Homo sapien
taggtagctgttacaaagtgcccca

SEQ ID NO: 363097 - DNA, 25 bp, Homo sapien
aggtagctgttacaaagtgccccag

SEQ ID NO: 363098 - DNA, 25 bp, Homo sapien
ggtagctgttacaaagtgccccagc

SEQ ID NO: 363099 - DNA, 25 bp, Homo sapien
aaagtgccccagcagagaccccctt

SEQ ID NO: 363100 - DNA, 25 bp, Homo sapien
ccttgactaacttttattcttccat

SEQ ID NO: 363101 - DNA, 25 bp, Homo sapien
ccaccaaagtggttccacaagaggc

SEQ ID NO: 363102 - DNA, 25 bp, Homo sapien
gtggttccacaagaggccctaaaca

SEQ ID NO: 363103 - DNA, 25 bp, Homo sapien
acaagaggccctaaacaaatgagta

SEQ ID NO: 363104 - DNA, 25 bp, Homo sapien
gagtaggaggcatacctttgtttca

SEQ ID NO: 363105 - DNA, 25 bp, Homo sapien
gaggcatacctttgtttcattttgt

SEQ ID NO: 363106 - DNA, 25 bp, Homo sapien
tttgtttgttggtttctgtgcttgc

SEQ ID NO: 363107 - DNA, 25 bp, Homo sapien
gtttctgtgcttgctttttgttctt

SEQ ID NO: 363108 - DNA, 25 bp, Homo sapien
tcttttctgttaggcacaggtttta

SEQ ID NO: 363109 - DNA, 25 bp, Homo sapien
tgttaggcacaggttttatttagaa

SEQ ID NO: 363110 - DNA, 25 bp, Homo sapien
gttggaaacattgaatggaacagct

SEQ ID NO: 363111 - DNA, 25 bp, Homo sapien
tggaacagctaatgtaccatagtaa

SEQ ID NO: 363112 - DNA, 25 bp, Homo sapien
tccagacctcgcagggaacatttgc

SEQ ID NO: 363113 - DNA, 25 bp, Homo sapien
agaggaggctcggacatcccagttc

SEQ ID NO: 363114 - DNA, 25 bp, Homo sapien
ctcgaccaacgcgtggtagcggaac

SEQ ID NO: 363115 - DNA, 25 bp, Homo sapien
tagcggaacccctgtcgtagcgagg

SEQ ID NO: 363116 - DNA, 25 bp, Homo sapien
agactgggttcaagtcccgactctg

SEQ ID NO: 363117 - DNA, 25 bp, Homo sapien
gactctgccgatttcagcctgagtg

SEQ ID NO: 363118 - DNA, 25 bp, Homo sapien
tcagcctgagtgactttgagcgagt

SEQ ID NO: 363119 - DNA, 25 bp, Homo sapien
tttgagcgagtcactttttcccgtc

SEQ ID NO: 363120 - DNA, 25 bp, Homo sapien
ttttcccgtcgaaacctcagttgct

SEQ ID NO: 363121 - DNA, 25 bp, Homo sapien
tcagttgctccatccacaaaatggg

SEQ ID NO: 363122 - DNA, 25 bp, Homo sapien
atatgaacagccaccctaaaacggt

SEQ ID NO: 363123 - DNA, 25 bp, Homo sapien
gggtaggaggaagaatcaatctcgt

SEQ ID NO: 363124 - DNA, 25 bp, Homo sapien
gtaggaggaagaatcaatctcgtga

SEQ ID NO: 363125 - DNA, 25 bp, Homo sapien
taggaggaagaatcaatctcgtgaa

SEQ ID NO: 363126 - DNA, 25 bp, Homo sapien
atggaaccaaaagagagccctcatt

SEQ ID NO: 363127 - DNA, 25 bp, Homo sapien
aagagagccctcattgccaagtcat

SEQ ID NO: 363128 - DNA, 25 bp, Homo sapien
agagagccctcattgccaagtcatc

SEQ ID NO: 363129 - DNA, 25 bp, Homo sapien
gagagccctcattgccaagtcatcc

SEQ ID NO: 363130 - DNA, 25 bp, Homo sapien
agccctcattgccaagtcatcccta

SEQ ID NO: 363131 - DNA, 25 bp, Homo sapien
cctcattgccaagtcatccctaagc

SEQ ID NO: 363132 - DNA, 25 bp, Homo sapien
tcattgccaagtcatccctaagcca

SEQ ID NO: 363133 - DNA, 25 bp, Homo sapien
attgccaagtcatccctaagccaaa

SEQ ID NO: 363134 - DNA, 25 bp, Homo sapien
agggcaaccaagctgggcggccccg

SEQ ID NO: 363135 - DNA, 25 bp, Homo sapien
aacgctctaaatgtgtagcatttta

SEQ ID NO: 363136 - DNA, 25 bp, Homo sapien
atgtgtagcattttaatcaagccta

SEQ ID NO: 363137 - DNA, 25 bp, Homo sapien
gtgaaagtcacacatccctacatat

SEQ ID NO: 363138 - DNA, 25 bp, Homo sapien
gaaagtcacacatccctacatatat

SEQ ID NO: 363139 - DNA, 25 bp, Homo sapien
gtcacacatccctacatatatgcat

SEQ ID NO: 363140 - DNA, 25 bp, Homo sapien
atccctacatatatgcatgccggct

SEQ ID NO: 363141 - DNA, 25 bp, Homo sapien
tacatatatgcatgccggcttgcct

SEQ ID NO: 363142 - DNA, 25 bp, Homo sapien
tatgcatgccggcttgcctgttaaa

SEQ ID NO: 363143 - DNA, 25 bp, Homo sapien
gcatgccggcttgcctgttaaaatt

SEQ ID NO: 363144 - DNA, 25 bp, Homo sapien
gcctgttaaaattccagttaaagtg

SEQ ID NO: 363145 - DNA, 25 bp, Homo sapien
gtttgtaactgaaaggtcgattgta

SEQ ID NO: 363146 - DNA, 25 bp, Homo sapien
ggtcgattgtaatggattgccgttt

SEQ ID NO: 363147 - DNA, 25 bp, Homo sapien
aatggattgccgtttgtacctgtat

SEQ ID NO: 363148 - DNA, 25 bp, Homo sapien
attgccgtttgtacctgtatcagta

SEQ ID NO: 363149 - DNA, 25 bp, Homo sapien
gtttgtacctgtatcagtattgctg

SEQ ID NO: 363150 - DNA, 25 bp, Homo sapien
attgctgtgtaaaaattctgtatca

SEQ ID NO: 363151 - DNA, 25 bp, Homo sapien
aacagtactgtatatcatttgattt

SEQ ID NO: 363152 - DNA, 25 bp, Homo sapien
gcaaatttctaaataggctacgtcc

SEQ ID NO: 363153 - DNA, 25 bp, Homo sapien
aataggctacgtcccaacatggata

SEQ ID NO: 363154 - DNA, 25 bp, Homo sapien
catggataaagaccccaaggttggt

SEQ ID NO: 363155 - DNA, 25 bp, Homo sapien
aatcattttacatacagcagagttg

SEQ ID NO: 363156 - DNA, 25 bp, Homo sapien
ccccatcagctgaacgcagctgtga

SEQ ID NO: 363157 - DNA, 25 bp, Homo sapien
gctgtgacctctagagctcatggga

SEQ ID NO: 363158 - DNA, 25 bp, Homo sapien
acctctagagctcatgggagctgca

SEQ ID NO: 363159 - DNA, 25 bp, Homo sapien
aggccacccctgcacacatggtggg

SEQ ID NO: 363160 - DNA, 25 bp, Homo sapien
cacacatggtgggtctgcattgata

SEQ ID NO: 363161 - DNA, 25 bp, Homo sapien
taagacatgtcacacgtgcacacct

SEQ ID NO: 363162 - DNA, 25 bp, Homo sapien
tgtcacacgtgcacacctacaaaga

SEQ ID NO: 363163 - DNA, 25 bp, Homo sapien
aaagacctagaaatgtctctgactc

SEQ ID NO: 363164 - DNA, 25 bp, Homo sapien
aatgtctctgactcttacctgtgtg

SEQ ID NO: 363165 - DNA, 25 bp, Homo sapien
actcttacctgtgtgctgttaactc

SEQ ID NO: 363166 - DNA, 25 bp, Homo sapien
acctgtgtgctgttaactcaaatga

SEQ ID NO: 363167 - DNA, 25 bp, Homo sapien
caccttctgggcaagtggcagcatt

SEQ ID NO: 363168 - DNA, 25 bp, Homo sapien
aagtggcagcattgcgctcatgagg

SEQ ID NO: 363169 - DNA, 25 bp, Homo sapien
gctttgcattcttagccaagggcaa

SEQ ID NO: 363170 - DNA, 25 bp, Homo sapien
aactgggtgggtgatctggcccaaa

SEQ ID NO: 363171 - DNA, 25 bp, Homo sapien
gatctggcccaaacttgcccctagg

SEQ ID NO: 363172 - DNA, 25 bp, Homo sapien
taggctctgctagccctgaatcagc

SEQ ID NO: 363173 - DNA, 25 bp, Homo sapien
tgaatcagcaggcttcagagacgag

SEQ ID NO: 363174 - DNA, 25 bp, Homo sapien
gggtgttataaaagccagtctgtaa

SEQ ID NO: 363175 - DNA, 25 bp, Homo sapien
gccagtctgtaaagggtaaattcca

SEQ ID NO: 363176 - DNA, 25 bp, Homo sapien
ggtaaattccaaatcttgtgccttg

SEQ ID NO: 363177 - DNA, 25 bp, Homo sapien
aaatcttgtgccttgttataccaat

SEQ ID NO: 363178 - DNA, 25 bp, Homo sapien
ttaaactgtgagttccactgaatac

SEQ ID NO: 363179 - DNA, 25 bp, Homo sapien
taaactgtgagttccactgaataca

SEQ ID NO: 363180 - DNA, 25 bp, Homo sapien
aaactgtgagttccactgaatacat

SEQ ID NO: 363181 - DNA, 25 bp, Homo sapien
aactgtgagttccactgaatacatt

SEQ ID NO: 363182 - DNA, 25 bp, Homo sapien
actgtgagttccactgaatacattt

SEQ ID NO: 363183 - DNA, 25 bp, Homo sapien
ctgtgagttccactgaatacatttt

SEQ ID NO: 363184 - DNA, 25 bp, Homo sapien
tgtgagttccactgaatacatttta

SEQ ID NO: 363185 - DNA, 25 bp, Homo sapien
gtgagttccactgaatacattttaa

SEQ ID NO: 363186 - DNA, 25 bp, Homo sapien
tgagttccactgaatacattttaat

SEQ ID NO: 363187 - DNA, 25 bp, Homo sapien
acacctatttaaagatggcaatata

SEQ ID NO: 363188 - DNA, 25 bp, Homo sapien
agtgtgaactctccagataggtcct

SEQ ID NO: 363189 - DNA, 25 bp, Homo sapien
gataggtcctgctgtgataggccag

SEQ ID NO: 363190 - DNA, 25 bp, Homo sapien
gtaatggttggaggacaccagcata

SEQ ID NO: 363191 - DNA, 25 bp, Homo sapien
aggacaagaaagctgctcagtggct

SEQ ID NO: 363192 - DNA, 25 bp, Homo sapien
tgctcagtggctggcgtatagctgt

SEQ ID NO: 363193 - DNA, 25 bp, Homo sapien
ggcgtatagctgtgaaggtaaccaa

SEQ ID NO: 363194 - DNA, 25 bp, Homo sapien
acaccaaagagggagtctgtcattt

SEQ ID NO: 363195 - DNA, 25 bp, Homo sapien
ctgtcatttttataaggctggaagc

SEQ ID NO: 363196 - DNA, 25 bp, Homo sapien
ggctggaagcgaatgttccttttct

SEQ ID NO: 363197 - DNA, 25 bp, Homo sapien
gttccttttctaccttaacatacag

SEQ ID NO: 363198 - DNA, 25 bp, Homo sapien
ttccaggctggagggtaatacatat

SEQ ID NO: 363199 - DNA, 25 bp, Homo sapien
tgtaagcaataatttttccgtgtct

SEQ ID NO: 363200 - DNA, 25 bp, Homo sapien
ttccgtgtcttattgagtatggcta

SEQ ID NO: 363201 - DNA, 25 bp, Homo sapien
gtatggctagcgattatttattaca

SEQ ID NO: 363202 - DNA, 25 bp, Homo sapien
attacatgctagatgggttctttgc

SEQ ID NO: 363203 - DNA, 25 bp, Homo sapien
gggttctttgcatgtgggttccata

SEQ ID NO: 363204 - DNA, 25 bp, Homo sapien
atgtgggttccatataggtgcagaa

SEQ ID NO: 363205 - DNA, 25 bp, Homo sapien
agccactggagggatttcgaccata

SEQ ID NO: 363206 - DNA, 25 bp, Homo sapien
ttcgaccatatttgtcatttggatg

SEQ ID NO: 363207 - DNA, 25 bp, Homo sapien
gtgccttagaaaacgcaaagctgtt

SEQ ID NO: 363208 - DNA, 25 bp, Homo sapien
agctgttgcacatggcgataaatta

SEQ ID NO: 363209 - DNA, 25 bp, Homo sapien
agatgaagtcacttccaagtttcca

SEQ ID NO: 363210 - DNA, 25 bp, Homo sapien
ccatcctttactctctgagatctgg

SEQ ID NO: 363211 - DNA, 25 bp, Homo sapien
actctctgagatctggatttgcctt

SEQ ID NO: 363212 - DNA, 25 bp, Homo sapien
cccatgccactttcttaaggtagtc

SEQ ID NO: 363213 - DNA, 25 bp, Homo sapien
cactttcttaaggtagtcttctcaa

SEQ ID NO: 363214 - DNA, 25 bp, Homo sapien
ttccaaaagatcatacattctgttt

SEQ ID NO: 363215 - DNA, 25 bp, Homo sapien
taatcatagtgggttgttaagctcc

SEQ ID NO: 363216 - DNA, 25 bp, Homo sapien
agtgggttgttaagctcctgcacta

SEQ ID NO: 363217 - DNA, 25 bp, Homo sapien
ggatagggactatgatttgtttata

SEQ ID NO: 363218 - DNA, 25 bp, Homo sapien
ttatatctgtaacttccgtctcttg

SEQ ID NO: 363219 - DNA, 25 bp, Homo sapien
gtaacttccgtctcttgcctctttt

SEQ ID NO: 363220 - DNA, 25 bp, Homo sapien
ctcttttccccagcatagagcagaa

SEQ ID NO: 363221 - DNA, 25 bp, Homo sapien
aagcaaatctccatttgatttcaac

SEQ ID NO: 363222 - DNA, 25 bp, Homo sapien
ttgatttcaactctcagtcttgctc

SEQ ID NO: 363223 - DNA, 25 bp, Homo sapien
caactctcagtcttgctcctcaggg

SEQ ID NO: 363224 - DNA, 25 bp, Homo sapien
tcagggcaactgctgttactcattt

SEQ ID NO: 363225 - DNA, 25 bp, Homo sapien
aatgatgactgcactcatttttaaa

SEQ ID NO: 363226 - DNA, 25 bp, Homo sapien
ccttccagaaatcttctctgcatac

SEQ ID NO: 363227 - DNA, 25 bp, Homo sapien
tcttctctgcatacaaacactaatg

SEQ ID NO: 363228 - DNA, 25 bp, Homo sapien
aatgagagagctgtccacattgctt

SEQ ID NO: 363229 - DNA, 25 bp, Homo sapien
gtccacattgctttttgatttgctt

SEQ ID NO: 363230 - DNA, 25 bp, Homo sapien
tgatttgctttttgactatcttggg

SEQ ID NO: 363231 - DNA, 25 bp, Homo sapien
atttcatgtttacaggatgttcagt

SEQ ID NO: 363232 - DNA, 25 bp, Homo sapien
ctagcgaacttccatgacatttcct

SEQ ID NO: 363233 - DNA, 25 bp, Homo sapien
gaacttccatgacatttcctttcta

SEQ ID NO: 363234 - DNA, 25 bp, Homo sapien
tatagttatctatacacagtgtaag

SEQ ID NO: 363235 - DNA, 25 bp, Homo sapien
aacaaactgaaatgatccacctcat

SEQ ID NO: 363236 - DNA, 25 bp, Homo sapien
tgatccacctcatatgtgagtccgt

SEQ ID NO: 363237 - DNA, 25 bp, Homo sapien
tgtgagtccgtccaaaagatgttac

SEQ ID NO: 363238 - DNA, 25 bp, Homo sapien
agatgttactgctctgggtgggcca

SEQ ID NO: 363239 - DNA, 25 bp, Homo sapien
gggccagtgttctatatcggttata

SEQ ID NO: 363240 - DNA, 25 bp, Homo sapien
tatcggttatactaactttcattta

SEQ ID NO: 363241 - DNA, 25 bp, Homo sapien
ctaaaatgcctctgagaaacagtaa

SEQ ID NO: 363242 - DNA, 25 bp, Homo sapien
caagttgtctaaaatgcaacagctt

SEQ ID NO: 363243 - DNA, 25 bp, Homo sapien
agtagaagtagttaatttgggccag

SEQ ID NO: 363244 - DNA, 25 bp, Homo sapien
gtagaagtagttaatttgggccagg

SEQ ID NO: 363245 - DNA, 25 bp, Homo sapien
tagaagtagttaatttgggccaggt

SEQ ID NO: 363246 - DNA, 25 bp, Homo sapien
agaagtagttaatttgggccaggtg

SEQ ID NO: 363247 - DNA, 25 bp, Homo sapien
gaagtagttaatttgggccaggtgc

SEQ ID NO: 363248 - DNA, 25 bp, Homo sapien
aagtagttaatttgggccaggtgca

SEQ ID NO: 363249 - DNA, 25 bp, Homo sapien
cggaggctgcaatcagtcaagatcg

SEQ ID NO: 363250 - DNA, 25 bp, Homo sapien
ggaggctgcaatcagtcaagatcgc

SEQ ID NO: 363251 - DNA, 25 bp, Homo sapien
tcactgggaatagaatgcagcattt

SEQ ID NO: 363252 - DNA, 25 bp, Homo sapien
gcagcatttgagagtgaatcttcca

SEQ ID NO: 363253 - DNA, 25 bp, Homo sapien
gagtgaatcttccattttcatggct

SEQ ID NO: 363254 - DNA, 25 bp, Homo sapien
tgaaaacctttttccactgctgagg

SEQ ID NO: 363255 - DNA, 25 bp, Homo sapien
tgctgaggtggatctatttagttca

SEQ ID NO: 363256 - DNA, 25 bp, Homo sapien
ggatctatttagttcatgttgcctg

SEQ ID NO: 363257 - DNA, 25 bp, Homo sapien
ttagttcatgttgcctgagatacaa

SEQ ID NO: 363258 - DNA, 25 bp, Homo sapien
ctccggacttgctattatgtgagaa

SEQ ID NO: 363259 - DNA, 25 bp, Homo sapien
gtgagaaagataaacttcctacttg

SEQ ID NO: 363260 - DNA, 25 bp, Homo sapien
ttagtccctgtttttcagattgtcg

SEQ ID NO: 363261 - DNA, 25 bp, Homo sapien
cctgtttttcagattgtcgttacaa

SEQ ID NO: 363262 - DNA, 25 bp, Homo sapien
cttcacaggaggtggctgccacggc

SEQ ID NO: 363263 - DNA, 25 bp, Homo sapien
tgaggccgtgcatacgcgggtgccc

SEQ ID NO: 363264 - DNA, 25 bp, Homo sapien
gccagagctgcctgtggccagacac

SEQ ID NO: 363265 - DNA, 25 bp, Homo sapien
gtggccagacacacggtggagggaa

SEQ ID NO: 363266 - DNA, 25 bp, Homo sapien
acacacggtggagggaagtgcacgc

SEQ ID NO: 363267 - DNA, 25 bp, Homo sapien
gaagtgcacgcgaaacagacacagc

SEQ ID NO: 363268 - DNA, 25 bp, Homo sapien
gaaacagacacagcggcttcaaata

SEQ ID NO: 363269 - DNA, 25 bp, Homo sapien
cagacacagcggcttcaaatagatg

SEQ ID NO: 363270 - DNA, 25 bp, Homo sapien
gcttcaaatagatgccgcccctgcc

SEQ ID NO: 363271 - DNA, 25 bp, Homo sapien
tgcccgcgctttgcagctagtccct

SEQ ID NO: 363272 - DNA, 25 bp, Homo sapien
ggctttctggaggatttaaccacag

SEQ ID NO: 363273 - DNA, 25 bp, Homo sapien
ggtgttcttcaagaaagtttctcaa

SEQ ID NO: 363274 - DNA, 25 bp, Homo sapien
gtttctcaaaacagggagtacttca

SEQ ID NO: 363275 - DNA, 25 bp, Homo sapien
gggagtacttcaagatcaccctcta

SEQ ID NO: 363276 - DNA, 25 bp, Homo sapien
agatcaccctctacgggagaaccaa

SEQ ID NO: 363277 - DNA, 25 bp, Homo sapien
gaaccaaggagctgacttcggaact

SEQ ID NO: 363278 - DNA, 25 bp, Homo sapien
ctaaaggagaacttcatccgcttct

SEQ ID NO: 363279 - DNA, 25 bp, Homo sapien
aatctctgggcctccctgaaaacca

SEQ ID NO: 363280 - DNA, 25 bp, Homo sapien
tgaaaaccacatcgtcttccctgtc

SEQ ID NO: 363281 - DNA, 25 bp, Homo sapien
tgtcccaatcgaccagtgtatcgac

SEQ ID NO: 363282 - DNA, 25 bp, Homo sapien
tatcgacggctgagtgcacaggtgc

SEQ ID NO: 363283 - DNA, 25 bp, Homo sapien
accagcccgaacaccattgagggag

SEQ ID NO: 363284 - DNA, 25 bp, Homo sapien
gaggttttctagttggagttgtgtc

SEQ ID NO: 363285 - DNA, 25 bp, Homo sapien
ctagttggagttgtgtccaacagaa

SEQ ID NO: 363286 - DNA, 25 bp, Homo sapien
gtccaacagaattcattaacaccag

SEQ ID NO: 363287 - DNA, 25 bp, Homo sapien
tccctctggacttttttcatctttt

SEQ ID NO: 363288 - DNA, 25 bp, Homo sapien
tcatcttttcctccacctcaaaaaa

SEQ ID NO: 363289 - DNA, 25 bp, Homo sapien
cacacagattcttcttgtacaggca

SEQ ID NO: 363290 - DNA, 25 bp, Homo sapien
cagattcttcttgtacaggcatcaa

SEQ ID NO: 363291 - DNA, 25 bp, Homo sapien
gattcttcttgtacaggcatcaaaa

SEQ ID NO: 363292 - DNA, 25 bp, Homo sapien
ttcttcttgtacaggcatcaaaacc

SEQ ID NO: 363293 - DNA, 25 bp, Homo sapien
aactcctctgcccctaaggctgtgt

SEQ ID NO: 363294 - DNA, 25 bp, Homo sapien
cttcctcatctctggaatttggcca

SEQ ID NO: 363295 - DNA, 25 bp, Homo sapien
agagttggcctcatttctgagataa

SEQ ID NO: 363296 - DNA, 25 bp, Homo sapien
tggcctcatttctgagataacttag

SEQ ID NO: 363297 - DNA, 25 bp, Homo sapien
gggacagaagttcactaccctgagc

SEQ ID NO: 363298 - DNA, 25 bp, Homo sapien
tcactaccctgagcccattgtgagg

SEQ ID NO: 363299 - DNA, 25 bp, Homo sapien
tgtgaggccatcctcacagccgtga

SEQ ID NO: 363300 - DNA, 25 bp, Homo sapien
acagccgtgactccttatatttcta

SEQ ID NO: 363301 - DNA, 25 bp, Homo sapien
gccgtgactccttatatttctactg

SEQ ID NO: 363302 - DNA, 25 bp, Homo sapien
gactccttatatttctactgctggg

SEQ ID NO: 363303 - DNA, 25 bp, Homo sapien
tctactgctgggttgggaccttggc

SEQ ID NO: 363304 - DNA, 25 bp, Homo sapien
ggttgggaccttggcttgtcaagac

SEQ ID NO: 363305 - DNA, 25 bp, Homo sapien
ttgtcaagactaagtagtcagcccc

SEQ ID NO: 363306 - DNA, 25 bp, Homo sapien
aggacaagggagactccaggctctt

SEQ ID NO: 363307 - DNA, 25 bp, Homo sapien
aagggagactccaggctcttcctgc

SEQ ID NO: 363308 - DNA, 25 bp, Homo sapien
agtggagggtcttttttgcgcttga

SEQ ID NO: 363309 - DNA, 25 bp, Homo sapien
ttttttgcgcttgagcttacgcttg

SEQ ID NO: 363310 - DNA, 25 bp, Homo sapien
tacgcttgcgctgcttgttgacaaa

SEQ ID NO: 363311 - DNA, 25 bp, Homo sapien
tgctgaacaggatggcagctgccaa

SEQ ID NO: 363312 - DNA, 25 bp, Homo sapien
gcagctgccaagaagcagatggtag

SEQ ID NO: 363313 - DNA, 25 bp, Homo sapien
agatggtagctacgattcccgccag

SEQ ID NO: 363314 - DNA, 25 bp, Homo sapien
tctgtgctggagacgccggcgatgt

SEQ ID NO: 363315 - DNA, 25 bp, Homo sapien
atgttgctgggctcgctgatcagat

SEQ ID NO: 363316 - DNA, 25 bp, Homo sapien
ctgatcagatcctgcatgacggcca

SEQ ID NO: 363317 - DNA, 25 bp, Homo sapien
accccagagcacaggcagggaagtg

SEQ ID NO: 363318 - DNA, 25 bp, Homo sapien
ggaagtggaagaaaatcgcccattt

SEQ ID NO: 363319 - DNA, 25 bp, Homo sapien
aactaaatccgcgtctgtgaatacg

SEQ ID NO: 363320 - DNA, 25 bp, Homo sapien
atccgcgtctgtgaatacgtttctg

SEQ ID NO: 363321 - DNA, 25 bp, Homo sapien
gaatacgtttctgattaggaactta

SEQ ID NO: 363322 - DNA, 25 bp, Homo sapien
gaacttattgcgaggttcccttaag

SEQ ID NO: 363323 - DNA, 25 bp, Homo sapien
ttcccttaagggagtgtctttacat

SEQ ID NO: 363324 - DNA, 25 bp, Homo sapien
aagggagtgtctttacatcatttca

SEQ ID NO: 363325 - DNA, 25 bp, Homo sapien
aataggatcctgatttagtatcaag

SEQ ID NO: 363326 - DNA, 25 bp, Homo sapien
tagtatcaagaacccttcacaaagc

SEQ ID NO: 363327 - DNA, 25 bp, Homo sapien
gaacccttcacaaagcatgaaatgt

SEQ ID NO: 363328 - DNA, 25 bp, Homo sapien
aggcacattcggaagatggagtttc

SEQ ID NO: 363329 - DNA, 25 bp, Homo sapien
ggagtttcacatcagcaaggtggat

SEQ ID NO: 363330 - DNA, 25 bp, Homo sapien
tgagctgtacgaggactactgcatc

SEQ ID NO: 363331 - DNA, 25 bp, Homo sapien
gtacgaggactactgcatccagtgc

SEQ ID NO: 363332 - DNA, 25 bp, Homo sapien
ggactactgcatccagtgccgcctg

SEQ ID NO: 363333 - DNA, 25 bp, Homo sapien
agcctgcacgagtgcgccgaggaca

SEQ ID NO: 363334 - DNA, 25 bp, Homo sapien
gcgccgaggacatgtggctcatcga

SEQ ID NO: 363335 - DNA, 25 bp, Homo sapien
ggaggttcacctgggcgagttccac

SEQ ID NO: 363336 - DNA, 25 bp, Homo sapien
gggcgagttccacatcaggatgaaa

SEQ ID NO: 363337 - DNA, 25 bp, Homo sapien
atgaaaggcttggtgggctacgcac

SEQ ID NO: 363338 - DNA, 25 bp, Homo sapien
cttggtgggctacgcacgcctctgt

SEQ ID NO: 363339 - DNA, 25 bp, Homo sapien
tatgtttacagaattgagctgcaga

SEQ ID NO: 363340 - DNA, 25 bp, Homo sapien
gctgcagaaagtgcaagacatgcca

SEQ ID NO: 363341 - DNA, 25 bp, Homo sapien
agtgcaagacatgccaatttgagac

SEQ ID NO: 363342 - DNA, 25 bp, Homo sapien
aatttgagacacacggtcttctaag

SEQ ID NO: 363343 - DNA, 25 bp, Homo sapien
gacacacggtcttctaagactgaag

SEQ ID NO: 363344 - DNA, 25 bp, Homo sapien
gaaactaaacatcacagcaagctct

SEQ ID NO: 363345 - DNA, 25 bp, Homo sapien
aacatcacagcaagctctatctctg

SEQ ID NO: 363346 - DNA, 25 bp, Homo sapien
gcaagctctatctctgagctataat

SEQ ID NO: 363347 - DNA, 25 bp, Homo sapien
tttaatgcaaagacactagtttgat

SEQ ID NO: 363348 - DNA, 25 bp, Homo sapien
tatatactgtaatcctgaaacattt

SEQ ID NO: 363349 - DNA, 25 bp, Homo sapien
acatttgtgttacttacctttggag

SEQ ID NO: 363350 - DNA, 25 bp, Homo sapien
gcccctggcccagggtcaaaggaga

SEQ ID NO: 363351 - DNA, 25 bp, Homo sapien
gtcaaaggagagatggcagcccctc

SEQ ID NO: 363352 - DNA, 25 bp, Homo sapien
tcaaaggagagatggcagcccctcc

SEQ ID NO: 363353 - DNA, 25 bp, Homo sapien
gcatgcatgcacctcagctggcagg

SEQ ID NO: 363354 - DNA, 25 bp, Homo sapien
tgcacctcagctggcaggaggccaa

SEQ ID NO: 363355 - DNA, 25 bp, Homo sapien
aggaggccaagcctctggccgcagg

SEQ ID NO: 363356 - DNA, 25 bp, Homo sapien
gggcttacccaagctcagctgaggc

SEQ ID NO: 363357 - DNA, 25 bp, Homo sapien
ggcttacccaagctcagctgaggcc

SEQ ID NO: 363358 - DNA, 25 bp, Homo sapien
ctgaggccacccgagccccagggag

SEQ ID NO: 363359 - DNA, 25 bp, Homo sapien
agtctctgccccttagcagggcctg

SEQ ID NO: 363360 - DNA, 25 bp, Homo sapien
gtctctgccccttagcagggcctgg

SEQ ID NO: 363361 - DNA, 25 bp, Homo sapien
taccttccatttactctgtcagttg

SEQ ID NO: 363362 - DNA, 25 bp, Homo sapien
ctctgtcagttggtatttattgatt

SEQ ID NO: 363363 - DNA, 25 bp, Homo sapien
attgaacttacaattgacccagttg

SEQ ID NO: 363364 - DNA, 25 bp, Homo sapien
aattgacccagttgacctgagaatt

SEQ ID NO: 363365 - DNA, 25 bp, Homo sapien
cagttgacctgagaattgacctaaa

SEQ ID NO: 363366 - DNA, 25 bp, Homo sapien
tgacctaaaaatcacatagcctttg

SEQ ID NO: 363367 - DNA, 25 bp, Homo sapien
atcagtgctattgctctatcagtgg

SEQ ID NO: 363368 - DNA, 25 bp, Homo sapien
gctattgctctatcagtggctctat

SEQ ID NO: 363369 - DNA, 25 bp, Homo sapien
tatcagtggctctatgattcttagc

SEQ ID NO: 363370 - DNA, 25 bp, Homo sapien
aaatttgagattttctatccattaa

SEQ ID NO: 363371 - DNA, 25 bp, Homo sapien
tttttcattctaccttccatttact

SEQ ID NO: 363372 - DNA, 25 bp, Homo sapien
aattaattaagtgctgtattctgtt

SEQ ID NO: 363373 - DNA, 25 bp, Homo sapien
attaattaagtgctgtattctgtta

SEQ ID NO: 363374 - DNA, 25 bp, Homo sapien
ttaattaagtgctgtattctgttat

SEQ ID NO: 363375 - DNA, 25 bp, Homo sapien
taattaagtgctgtattctgttatt

SEQ ID NO: 363376 - DNA, 25 bp, Homo sapien
attaagtgctgtattctgttatttt

SEQ ID NO: 363377 - DNA, 25 bp, Homo sapien
ggcagatccactggggtcgccagtt

SEQ ID NO: 363378 - DNA, 25 bp, Homo sapien
agatccactggggtcgccagttcga

SEQ ID NO: 363379 - DNA, 25 bp, Homo sapien
gatccactggggtcgccagttcgag

SEQ ID NO: 363380 - DNA, 25 bp, Homo sapien
atccactggggtcgccagttcgaga

SEQ ID NO: 363381 - DNA, 25 bp, Homo sapien
tccactggggtcgccagttcgagac

SEQ ID NO: 363382 - DNA, 25 bp, Homo sapien
ccactggggtcgccagttcgagacc

SEQ ID NO: 363383 - DNA, 25 bp, Homo sapien
tttgccttaccagcggctacgagaa

SEQ ID NO: 363384 - DNA, 25 bp, Homo sapien
gctacgagaatcatgctgcttccca

SEQ ID NO: 363385 - DNA, 25 bp, Homo sapien
gcttcccacacccatctgtttagaa

SEQ ID NO: 363386 - DNA, 25 bp, Homo sapien
catagatgtctatttttctcagcct

SEQ ID NO: 363387 - DNA, 25 bp, Homo sapien
tttgcaaggagagtcccacgctcat

SEQ ID NO: 363388 - DNA, 25 bp, Homo sapien
acgctcattcacatgtcctggtgga

SEQ ID NO: 363389 - DNA, 25 bp, Homo sapien
ctggtggactctcttggccttattc

SEQ ID NO: 363390 - DNA, 25 bp, Homo sapien
gagtatcagcttcacaactgtgttg

SEQ ID NO: 363391 - DNA, 25 bp, Homo sapien
aactgtgttgaaattgcctcagcaa

SEQ ID NO: 363392 - DNA, 25 bp, Homo sapien
ttgcctcagcaatgggacctcaagt

SEQ ID NO: 363393 - DNA, 25 bp, Homo sapien
aagtgctcccgggtgcctgtgaaag

SEQ ID NO: 363394 - DNA, 25 bp, Homo sapien
gcaggcgctggtggctttgggaaca

SEQ ID NO: 363395 - DNA, 25 bp, Homo sapien
cccttttcactcttaagaatccgag

SEQ ID NO: 363396 - DNA, 25 bp, Homo sapien
cactcttaagaatccgagggtcaga

SEQ ID NO: 363397 - DNA, 25 bp, Homo sapien
aatccgagggtcagatgcgtttggc

SEQ ID NO: 363398 - DNA, 25 bp, Homo sapien
gggactgccgcaagtagttgactcc

SEQ ID NO: 363399 - DNA, 25 bp, Homo sapien
actgccgcaagtagttgactcctag

SEQ ID NO: 363400 - DNA, 25 bp, Homo sapien
cgcaagtagttgactcctagagcgt

SEQ ID NO: 363401 - DNA, 25 bp, Homo sapien
gtagttgactcctagagcgttgtga

SEQ ID NO: 363402 - DNA, 25 bp, Homo sapien
gactcctagagcgttgtgatcccca

SEQ ID NO: 363403 - DNA, 25 bp, Homo sapien
tagagcgttgtgatccccacgggca

SEQ ID NO: 363404 - DNA, 25 bp, Homo sapien
gttgtgatccccacgggcagagcag

SEQ ID NO: 363405 - DNA, 25 bp, Homo sapien
gggaagacagggctccagctaccac

SEQ ID NO: 363406 - DNA, 25 bp, Homo sapien
agctaccacaggacgggctctgggt

SEQ ID NO: 363407 - DNA, 25 bp, Homo sapien
acgggctctgggtatagccgttcca

SEQ ID NO: 363408 - DNA, 25 bp, Homo sapien
gggtatagccgttccagtcagggac

SEQ ID NO: 363409 - DNA, 25 bp, Homo sapien
tatagccgttccagtcagggacagc

SEQ ID NO: 363410 - DNA, 25 bp, Homo sapien
tcagggacagccgtggagagaccag

SEQ ID NO: 363411 - DNA, 25 bp, Homo sapien
agaccagggaccaggaagcagacag

SEQ ID NO: 363412 - DNA, 25 bp, Homo sapien
gaagcagacagtatgagcatgacca

SEQ ID NO: 363413 - DNA, 25 bp, Homo sapien
accagtggagaaggtactagtcaac

SEQ ID NO: 363414 - DNA, 25 bp, Homo sapien
gagaaggtactagtcaacctccaga

SEQ ID NO: 363415 - DNA, 25 bp, Homo sapien
ggtactagtcaacctccagaaagag

SEQ ID NO: 363416 - DNA, 25 bp, Homo sapien
ggagtctttgagtatgtacagtttt

SEQ ID NO: 363417 - DNA, 25 bp, Homo sapien
gtacagttttgaaaattctctttga

SEQ ID NO: 363418 - DNA, 25 bp, Homo sapien
aattgatttcatattctgtggcttt

SEQ ID NO: 363419 - DNA, 25 bp, Homo sapien
tttcaacctccatttacctcttgtc

SEQ ID NO: 363420 - DNA, 25 bp, Homo sapien
catttacctcttgtcattccaacat

SEQ ID NO: 363421 - DNA, 25 bp, Homo sapien
acccaatttctctttcaccatttag

SEQ ID NO: 363422 - DNA, 25 bp, Homo sapien
gattatcatctggattttcactcaa

SEQ ID NO: 363423 - DNA, 25 bp, Homo sapien
gattttcactcaagatgcagctcct

SEQ ID NO: 363424 - DNA, 25 bp, Homo sapien
gatgcagctcctaagattattgtta

SEQ ID NO: 363425 - DNA, 25 bp, Homo sapien
gcagctcctaagattattgttatgt

SEQ ID NO: 363426 - DNA, 25 bp, Homo sapien
gttaaattcataaactccttcacct

SEQ ID NO: 363427 - DNA, 25 bp, Homo sapien
agcctctagatgtaactgctatcgt

SEQ ID NO: 363428 - DNA, 25 bp, Homo sapien
gtaactgctatcgttgtcttttctc

SEQ ID NO: 363429 - DNA, 25 bp, Homo sapien
tgtcttttctctcaagtgccgagag

SEQ ID NO: 363430 - DNA, 25 bp, Homo sapien
agagaagcgctaacttctgctccag

SEQ ID NO: 363431 - DNA, 25 bp, Homo sapien
cagcttctggccctgtttggagatc

SEQ ID NO: 363432 - DNA, 25 bp, Homo sapien
tgtttggagatccagtggtccactc

SEQ ID NO: 363433 - DNA, 25 bp, Homo sapien
ggtccactccgtgcaggcggtagca

SEQ ID NO: 363434 - DNA, 25 bp, Homo sapien
gtctccagcatcaacctgaagtccg

SEQ ID NO: 363435 - DNA, 25 bp, Homo sapien
tgaagtccgccacgaactcggtgat

SEQ ID NO: 363436 - DNA, 25 bp, Homo sapien
gtactggccgctggcgaacttctct

SEQ ID NO: 363437 - DNA, 25 bp, Homo sapien
ttctcttccatctgcagcagacaca

SEQ ID NO: 363438 - DNA, 25 bp, Homo sapien
tgctgctgtgactcctttccccagt

SEQ ID NO: 363439 - DNA, 25 bp, Homo sapien
ctttccccagtgctaaaaaatagat

SEQ ID NO: 363440 - DNA, 25 bp, Homo sapien
gatgtagtcaggaggaactaacata

SEQ ID NO: 363441 - DNA, 25 bp, Homo sapien
aacatagattggcagtcacccacac

SEQ ID NO: 363442 - DNA, 25 bp, Homo sapien
agtcacccacacatctctggtgtta

SEQ ID NO: 363443 - DNA, 25 bp, Homo sapien
acatctctggtgttaccttagtctt

SEQ ID NO: 363444 - DNA, 25 bp, Homo sapien
gtgttaccttagtcttgtttcaagc

SEQ ID NO: 363445 - DNA, 25 bp, Homo sapien
tgtttcaagcatacaagccacaagt

SEQ ID NO: 363446 - DNA, 25 bp, Homo sapien
caagccacaagtttttgggtgtctt

SEQ ID NO: 363447 - DNA, 25 bp, Homo sapien
tttgggtgtcttaaatatacctaag

SEQ ID NO: 363448 - DNA, 25 bp, Homo sapien
tatacctaagttgtagtctctattt

SEQ ID NO: 363449 - DNA, 25 bp, Homo sapien
tgggacgagcgtttgcacaatggct

SEQ ID NO: 363450 - DNA, 25 bp, Homo sapien
acaatggctacccttgttcatgagg

SEQ ID NO: 363451 - DNA, 25 bp, Homo sapien
ttgttcatgaggcttcacgcacagc

SEQ ID NO: 363452 - DNA, 25 bp, Homo sapien
cacgcacagccgttccaagagcgga

SEQ ID NO: 363453 - DNA, 25 bp, Homo sapien
gttccaagagcggaccagacacagc

SEQ ID NO: 363454 - DNA, 25 bp, Homo sapien
acacaccgtttcctaactctgtgac

SEQ ID NO: 363455 - DNA, 25 bp, Homo sapien
cgtgcttgctcctctggttccacag

SEQ ID NO: 363456 - DNA, 25 bp, Homo sapien
tggttccacagctcttggtcccaag

SEQ ID NO: 363457 - DNA, 25 bp, Homo sapien
acagctcttggtcccaagggcagct

SEQ ID NO: 363458 - DNA, 25 bp, Homo sapien
gggtgtccacgtcctgtcttcacct

SEQ ID NO: 363459 - DNA, 25 bp, Homo sapien
tgtcttcacctgctatgggacgagc

SEQ ID NO: 363460 - DNA, 25 bp, Homo sapien
ctgctaaggtgcttctatctctttc

SEQ ID NO: 363461 - DNA, 25 bp, Homo sapien
tatactttatgttttatctttctca

SEQ ID NO: 363462 - DNA, 25 bp, Homo sapien
gttatttgcaagtgagtgtcctttt

SEQ ID NO: 363463 - DNA, 25 bp, Homo sapien
agcgtcatctctagggtcactggcc

SEQ ID NO: 363464 - DNA, 25 bp, Homo sapien
acacacttcttcatgcttttctttg

SEQ ID NO: 363465 - DNA, 25 bp, Homo sapien
atgacagatcgaagtataggttaca

SEQ ID NO: 363466 - DNA, 25 bp, Homo sapien
atcaaaaccctaccatcctgagaag

SEQ ID NO: 363467 - DNA, 25 bp, Homo sapien
atggttctattatagcagacgtcag

SEQ ID NO: 363468 - DNA, 25 bp, Homo sapien
gggactgcattctggtttgggactt

SEQ ID NO: 363469 - DNA, 25 bp, Homo sapien
tggtttgggactttgcctatggaaa

SEQ ID NO: 363470 - DNA, 25 bp, Homo sapien
aaattcctgctaaggtgcttctatc

SEQ ID NO: 363471 - DNA, 25 bp, Homo sapien
cactgtacctggtgtgcactgggtt

SEQ ID NO: 363472 - DNA, 25 bp, Homo sapien
cactgggttggtgtgcacatggtta

SEQ ID NO: 363473 - DNA, 25 bp, Homo sapien
ccagcattgggagggaggtctaaac

SEQ ID NO: 363474 - DNA, 25 bp, Homo sapien
taaacttttgactttgtctccgctt

SEQ ID NO: 363475 - DNA, 25 bp, Homo sapien
gtctccgcttcaaaagcttgacttg

SEQ ID NO: 363476 - DNA, 25 bp, Homo sapien
ttggcagctttctagttccctcttt

SEQ ID NO: 363477 - DNA, 25 bp, Homo sapien
agaagcagccttgttcatctccatg

SEQ ID NO: 363478 - DNA, 25 bp, Homo sapien
atctccatggttccaatctggcaag

SEQ ID NO: 363479 - DNA, 25 bp, Homo sapien
aatctggcaaggaatctcctgggta

SEQ ID NO: 363480 - DNA, 25 bp, Homo sapien
ctcctgggtagatacggctcatgtg

SEQ ID NO: 363481 - DNA, 25 bp, Homo sapien
tacggctcatgtggctacaggttgt

SEQ ID NO: 363482 - DNA, 25 bp, Homo sapien
gggaatacccacagtgagaattaga

SEQ ID NO: 363483 - DNA, 25 bp, Homo sapien
atacccacagtgagaattagatgag

SEQ ID NO: 363484 - DNA, 25 bp, Homo sapien
atgagatagatgcatttgaaaccac

SEQ ID NO: 363485 - DNA, 25 bp, Homo sapien
gtgcccacctgtggtgggtagttag

SEQ ID NO: 363486 - DNA, 25 bp, Homo sapien
acctgtggtgggtagttaggtagct

SEQ ID NO: 363487 - DNA, 25 bp, Homo sapien
ttaggtagctgttacaaagtgcccc

SEQ ID NO: 363488 - DNA, 25 bp, Homo sapien
taggtagctgttacaaagtgcccca

SEQ ID NO: 363489 - DNA, 25 bp, Homo sapien
aggtagctgttacaaagtgccccag

SEQ ID NO: 363490 - DNA, 25 bp, Homo sapien
ggtagctgttacaaagtgccccagc

SEQ ID NO: 363491 - DNA, 25 bp, Homo sapien
ccttgactaacttttattcttccat

SEQ ID NO: 363492 - DNA, 25 bp, Homo sapien
gactaacttttattcttccatcttt

SEQ ID NO: 363493 - DNA, 25 bp, Homo sapien
gaggaaactgaactccaagaagtta

SEQ ID NO: 363494 - DNA, 25 bp, Homo sapien
aaactccagggatgggctaatggca

SEQ ID NO: 363495 - DNA, 25 bp, Homo sapien
gttcctgtgggaagtgactctccca

SEQ ID NO: 363496 - DNA, 25 bp, Homo sapien
tgacctcttgtccactaatctttcc

SEQ ID NO: 363497 - DNA, 25 bp, Homo sapien
actaatctttcctagacaccaggct

SEQ ID NO: 363498 - DNA, 25 bp, Homo sapien
tagacaccaggctaggccctgctaa

SEQ ID NO: 363499 - DNA, 25 bp, Homo sapien
ggaagtgactctcccatgaacccaa

SEQ ID NO: 363500 - DNA, 25 bp, Homo sapien
ctgctaatctccttttgttactcaa

SEQ ID NO: 363501 - DNA, 25 bp, Homo sapien
aacccaagcatattgttcctcagag

SEQ ID NO: 363502 - DNA, 25 bp, Homo sapien
gactgttggagcagcaaataaccct

SEQ ID NO: 363503 - DNA, 25 bp, Homo sapien
taaccctaagatgagcttattcagc

SEQ ID NO: 363504 - DNA, 25 bp, Homo sapien
agatgcgtttggcaacattctcaca

SEQ ID NO: 363505 - DNA, 25 bp, Homo sapien
gcgtttggcaacattctcacaggag

SEQ ID NO: 363506 - DNA, 25 bp, Homo sapien
tggcaacattctcacaggaggagtc

SEQ ID NO: 363507 - DNA, 25 bp, Homo sapien
aggagtcagaggaggctctcctgca

SEQ ID NO: 363508 - DNA, 25 bp, Homo sapien
aggctctcctgcatgatgggtgagc

SEQ ID NO: 363509 - DNA, 25 bp, Homo sapien
cctgcatgatgggtgagccggcata

SEQ ID NO: 363510 - DNA, 25 bp, Homo sapien
tgagccggcataggaattgtgccaa

SEQ ID NO: 363511 - DNA, 25 bp, Homo sapien
gccaagggccattagattttgtaga

SEQ ID NO: 363512 - DNA, 25 bp, Homo sapien
gggccattagattttgtagagactc

SEQ ID NO: 363513 - DNA, 25 bp, Homo sapien
gaggacaacagcaggcgaaaaacac

SEQ ID NO: 363514 - DNA, 25 bp, Homo sapien
acaaacctcaaagtgcgtgcactgg

SEQ ID NO: 363515 - DNA, 25 bp, Homo sapien
gtgacaaccagttgaaatgttttct

SEQ ID NO: 363516 - DNA, 25 bp, Homo sapien
gttttctttttatcagctatgtggc

SEQ ID NO: 363517 - DNA, 25 bp, Homo sapien
ctttttatcagctatgtggccatat

SEQ ID NO: 363518 - DNA, 25 bp, Homo sapien
agccagagtcttctgtctcttttct

SEQ ID NO: 363519 - DNA, 25 bp, Homo sapien
gagtcttctgtctcttttctacctg

SEQ ID NO: 363520 - DNA, 25 bp, Homo sapien
tcttttctacctgtaatctattcca

SEQ ID NO: 363521 - DNA, 25 bp, Homo sapien
atctattccaggtgctaagaactgt

SEQ ID NO: 363522 - DNA, 25 bp, Homo sapien
gaactgtgaaagtccagcttgggta

SEQ ID NO: 363523 - DNA, 25 bp, Homo sapien
gaaagtccagcttgggtaatgtagt

SEQ ID NO: 363524 - DNA, 25 bp, Homo sapien
tgaggtcgctcaaattaaactaatt

SEQ ID NO: 363525 - DNA, 25 bp, Homo sapien
tttggcattgtgtgggtgacaacca

SEQ ID NO: 363526 - DNA, 25 bp, Homo sapien
aaggatctccctagcagaactcgtg

SEQ ID NO: 363527 - DNA, 25 bp, Homo sapien
gaactcgtggttcaggacaatgctg

SEQ ID NO: 363528 - DNA, 25 bp, Homo sapien
tgagagctaaaagagccagcctaat

SEQ ID NO: 363529 - DNA, 25 bp, Homo sapien
aaagagccagcctaatatcagactg

SEQ ID NO: 363530 - DNA, 25 bp, Homo sapien
gcctaatatcagactggagccagaa

SEQ ID NO: 363531 - DNA, 25 bp, Homo sapien
ggagccagaagtagacatctcccca

SEQ ID NO: 363532 - DNA, 25 bp, Homo sapien
acctctaccctatcaggactttcaa

SEQ ID NO: 363533 - DNA, 25 bp, Homo sapien
atcaggatggctgcagtgccagcct

SEQ ID NO: 363534 - DNA, 25 bp, Homo sapien
ttcccctaccaggtggaagagtctg

SEQ ID NO: 363535 - DNA, 25 bp, Homo sapien
gcagcaggtactgcctgaggaattt

SEQ ID NO: 363536 - DNA, 25 bp, Homo sapien
gcctgaggaatttgcaagttcgtgt

SEQ ID NO: 363537 - DNA, 25 bp, Homo sapien
tgcaacacagctggacgcacacaga

SEQ ID NO: 363538 - DNA, 25 bp, Homo sapien
agctggacgcacacagacactggga

SEQ ID NO: 363539 - DNA, 25 bp, Homo sapien
tggacgcacacagacactgggatgg

SEQ ID NO: 363540 - DNA, 25 bp, Homo sapien
agacagatgccaggcaggccggtgg

SEQ ID NO: 363541 - DNA, 25 bp, Homo sapien
tccttgtgggacacgggtctcccct

SEQ ID NO: 363542 - DNA, 25 bp, Homo sapien
ctcatagcaccttgcagcagttgat

SEQ ID NO: 363543 - DNA, 25 bp, Homo sapien
agcaccttgcagcagttgatgcagc

SEQ ID NO: 363544 - DNA, 25 bp, Homo sapien
tgatgcagccgttctgggagccgta

SEQ ID NO: 363545 - DNA, 25 bp, Homo sapien
agccgttctgggagccgtagcgctt

SEQ ID NO: 363546 - DNA, 25 bp, Homo sapien
tctgggagccgtagcgcttctgcag

SEQ ID NO: 363547 - DNA, 25 bp, Homo sapien
agccgtagcgcttctgcagcgcggc

SEQ ID NO: 363548 - DNA, 25 bp, Homo sapien
aaccacaacattgcctgcatgtcta

SEQ ID NO: 363549 - DNA, 25 bp, Homo sapien
accacaacattgcctgcatgtctaa

SEQ ID NO: 363550 - DNA, 25 bp, Homo sapien
ccacaacattgcctgcatgtctaaa

SEQ ID NO: 363551 - DNA, 25 bp, Homo sapien
cacaacattgcctgcatgtctaaaa

SEQ ID NO: 363552 - DNA, 25 bp, Homo sapien
acaacattgcctgcatgtctaaaag

SEQ ID NO: 363553 - DNA, 25 bp, Homo sapien
caacattgcctgcatgtctaaaaga

SEQ ID NO: 363554 - DNA, 25 bp, Homo sapien
aacattgcctgcatgtctaaaagaa

SEQ ID NO: 363555 - DNA, 25 bp, Homo sapien
acattgcctgcatgtctaaaagaaa

SEQ ID NO: 363556 - DNA, 25 bp, Homo sapien
cattgcctgcatgtctaaaagaaaa

SEQ ID NO: 363557 - DNA, 25 bp, Homo sapien
attgcctgcatgtctaaaagaaaat

SEQ ID NO: 363558 - DNA, 25 bp, Homo sapien
ggctgcagtttccacggagcagata

SEQ ID NO: 363559 - DNA, 25 bp, Homo sapien
tttccacggagcagatataggagct

SEQ ID NO: 363560 - DNA, 25 bp, Homo sapien
gagcagatataggagctggaatctt

SEQ ID NO: 363561 - DNA, 25 bp, Homo sapien
tggaatctttgctgccctgggcatt

SEQ ID NO: 363562 - DNA, 25 bp, Homo sapien
ttgtacttctacttccactacctct

SEQ ID NO: 363563 - DNA, 25 bp, Homo sapien
gctgccctgggcattgtggtctttg

SEQ ID NO: 363564 - DNA, 25 bp, Homo sapien
ccctgggcattgtggtctttgccct

SEQ ID NO: 363565 - DNA, 25 bp, Homo sapien
ggctgtcctggccataaagggctac

SEQ ID NO: 363566 - DNA, 25 bp, Homo sapien
ggaagctaaaagagaagccagcaga

SEQ ID NO: 363567 - DNA, 25 bp, Homo sapien
aagggtttctaaaacgctctgacag

SEQ ID NO: 363568 - DNA, 25 bp, Homo sapien
taaagagaggcaggcgctgtaccaa

SEQ ID NO: 363569 - DNA, 25 bp, Homo sapien
gagagcagtgctttggacctgccat

SEQ ID NO: 363570 - DNA, 25 bp, Homo sapien
agcagtgctttggacctgccatcag

SEQ ID NO: 363571 - DNA, 25 bp, Homo sapien
ggacctgccatcagcgtgtgacata

SEQ ID NO: 363572 - DNA, 25 bp, Homo sapien
cctgccatcagcgtgtgacataaga

SEQ ID NO: 363573 - DNA, 25 bp, Homo sapien
gccatcagcgtgtgacataagagat

SEQ ID NO: 363574 - DNA, 25 bp, Homo sapien
acataagagattacgtcctgcaggg

SEQ ID NO: 363575 - DNA, 25 bp, Homo sapien
aagagattacgtcctgcagggaccc

SEQ ID NO: 363576 - DNA, 25 bp, Homo sapien
gaagccaacagcgaggctttcagtt

SEQ ID NO: 363577 - DNA, 25 bp, Homo sapien
aacagcgaggctttcagttctttgg

SEQ ID NO: 363578 - DNA, 25 bp, Homo sapien
gggcttggcggcttttctcctcagt

SEQ ID NO: 363579 - DNA, 25 bp, Homo sapien
ttttctcctcagttttctggagtgc

SEQ ID NO: 363580 - DNA, 25 bp, Homo sapien
aatacctttgattaggttccagcca

SEQ ID NO: 363581 - DNA, 25 bp, Homo sapien
tgattaggttccagccaaacctcac

SEQ ID NO: 363582 - DNA, 25 bp, Homo sapien
tctctttccccatgcctttgtgtct

SEQ ID NO: 363583 - DNA, 25 bp, Homo sapien
atgcctttgtgtctctcttcgtctg

SEQ ID NO: 363584 - DNA, 25 bp, Homo sapien
tgtctctcttcgtctgatgtcgagt

SEQ ID NO: 363585 - DNA, 25 bp, Homo sapien
gtctgatgtcgagtctacaacctaa

SEQ ID NO: 363586 - DNA, 25 bp, Homo sapien
gtcgagtctacaacctaatgctttg

SEQ ID NO: 363587 - DNA, 25 bp, Homo sapien
ctacaacctaatgctttgaagacag

SEQ ID NO: 363588 - DNA, 25 bp, Homo sapien
ttgaagacagactgacttccccgtc

SEQ ID NO: 363589 - DNA, 25 bp, Homo sapien
acagactgacttccccgtccttggt

SEQ ID NO: 363590 - DNA, 25 bp, Homo sapien
atggcctgtccgtccacatgggcgg

SEQ ID NO: 363591 - DNA, 25 bp, Homo sapien
gaattagaacctagtcccctgattc

SEQ ID NO: 363592 - DNA, 25 bp, Homo sapien
tgattcccaaccatgtcttatacca

SEQ ID NO: 363593 - DNA, 25 bp, Homo sapien
agactgtttcccctaatcgatagga

SEQ ID NO: 363594 - DNA, 25 bp, Homo sapien
aactactcctaaagggcagaaactg

SEQ ID NO: 363595 - DNA, 25 bp, Homo sapien
agctttaatctgacacatggccgta

SEQ ID NO: 363596 - DNA, 25 bp, Homo sapien
gacacatggccgtaggcttgagtta

SEQ ID NO: 363597 - DNA, 25 bp, Homo sapien
gcttgagttagcagttggtcccttc

SEQ ID NO: 363598 - DNA, 25 bp, Homo sapien
ttagcagttggtcccttctttcttc

SEQ ID NO: 363599 - DNA, 25 bp, Homo sapien
ttccagactctcataagagtaccct

SEQ ID NO: 363600 - DNA, 25 bp, Homo sapien
aagagtaccctatcaggtctggaca

SEQ ID NO: 363601 - DNA, 25 bp, Homo sapien
atcaggtctggacagacttccgttt

SEQ ID NO: 363602 - DNA, 25 bp, Homo sapien
gaacttatggtaaagctgcccacag

SEQ ID NO: 363603 - DNA, 25 bp, Homo sapien
gatcctagaaggacaggaattccct

SEQ ID NO: 363604 - DNA, 25 bp, Homo sapien
aggaattccctgtctgcagcatttc

SEQ ID NO: 363605 - DNA, 25 bp, Homo sapien
aattccctgtctgcagcatttcata

SEQ ID NO: 363606 - DNA, 25 bp, Homo sapien
cataagcatgtaatattgttgcagg

SEQ ID NO: 363607 - DNA, 25 bp, Homo sapien
cagggatactgcagaaggagttgaa

SEQ ID NO: 363608 - DNA, 25 bp, Homo sapien
gagttgaagcagtggacagacagat

SEQ ID NO: 363609 - DNA, 25 bp, Homo sapien
gacagacagatgatataggtgattt

SEQ ID NO: 363610 - DNA, 25 bp, Homo sapien
ataggtgattttacagcctaagaaa

SEQ ID NO: 363611 - DNA, 25 bp, Homo sapien
gcgatgagactcagttggacaccga

SEQ ID NO: 363612 - DNA, 25 bp, Homo sapien
actcagttggacaccgagagagcaa

SEQ ID NO: 363613 - DNA, 25 bp, Homo sapien
gatcaggatgacatgtgccattttt

SEQ ID NO: 363614 - DNA, 25 bp, Homo sapien
atgtgccatttttcagaggacgtgc

SEQ ID NO: 363615 - DNA, 25 bp, Homo sapien
ttttcagaggacgtgcagacaggct

SEQ ID NO: 363616 - DNA, 25 bp, Homo sapien
ggacgtgcagacaggctggcattct

SEQ ID NO: 363617 - DNA, 25 bp, Homo sapien
caggctggcattctagattactttt

SEQ ID NO: 363618 - DNA, 25 bp, Homo sapien
ttcttactctgaaacatggcctgtt

SEQ ID NO: 363619 - DNA, 25 bp, Homo sapien
cctgtttgggagtgcgggattcaaa

SEQ ID NO: 363620 - DNA, 25 bp, Homo sapien
gtgcgggattcaaaggtggtcccac

SEQ ID NO: 363621 - DNA, 25 bp, Homo sapien
gctgcccctactgcaaatggcagtt

SEQ ID NO: 363622 - DNA, 25 bp, Homo sapien
tcttttggcttctgcagatggttgc

SEQ ID NO: 363623 - DNA, 25 bp, Homo sapien
aataatggtcagtcctcatctctgt

SEQ ID NO: 363624 - DNA, 25 bp, Homo sapien
actttggagacagacctacactacc

SEQ ID NO: 363625 - DNA, 25 bp, Homo sapien
gagacagacctacactaccagtttt

SEQ ID NO: 363626 - DNA, 25 bp, Homo sapien
gcagtgtttcccaaacctcatttat

SEQ ID NO: 363627 - DNA, 25 bp, Homo sapien
aaacctcatttatttgcctatagcc

SEQ ID NO: 363628 - DNA, 25 bp, Homo sapien
ttatttgcctatagccttcctggag

SEQ ID NO: 363629 - DNA, 25 bp, Homo sapien
agccttcctggagtttgtcttatat

SEQ ID NO: 363630 - DNA, 25 bp, Homo sapien
agtttgtcttatatgtccgctctgt

SEQ ID NO: 363631 - DNA, 25 bp, Homo sapien
ttatatgtccgctctgtgcactatt

SEQ ID NO: 363632 - DNA, 25 bp, Homo sapien
gctctgtgcactattcctatatgtt

SEQ ID NO: 363633 - DNA, 25 bp, Homo sapien
aaaaagcctcatcccagttatatcc

SEQ ID NO: 363634 - DNA, 25 bp, Homo sapien
gcctcatcccagttatatccttaaa

SEQ ID NO: 363635 - DNA, 25 bp, Homo sapien
gcacagctcacacgacatcagagag

SEQ ID NO: 363636 - DNA, 25 bp, Homo sapien
agctcacacgacatcagagagtcca

SEQ ID NO: 363637 - DNA, 25 bp, Homo sapien
gagagtccatactggcgacagaccc

SEQ ID NO: 363638 - DNA, 25 bp, Homo sapien
gtccatactggcgacagaccctatg

SEQ ID NO: 363639 - DNA, 25 bp, Homo sapien
cctttattcgtgtttcacaactgac

SEQ ID NO: 363640 - DNA, 25 bp, Homo sapien
tattcgtgtttcacaactgactcat

SEQ ID NO: 363641 - DNA, 25 bp, Homo sapien
tcgtgtttcacaactgactcatcat

SEQ ID NO: 363642 - DNA, 25 bp, Homo sapien
gtgtttcacaactgactcatcatca

SEQ ID NO: 363643 - DNA, 25 bp, Homo sapien
gtggaatggcctttattcgtagttc

SEQ ID NO: 363644 - DNA, 25 bp, Homo sapien
aatggcctttattcgtagttcacaa

SEQ ID NO: 363645 - DNA, 25 bp, Homo sapien
tggcctttattcgtagttcacaact

SEQ ID NO: 363646 - DNA, 25 bp, Homo sapien
gctgtaaaatttcaggcagagccat

SEQ ID NO: 363647 - DNA, 25 bp, Homo sapien
aggcagagccataacattgtacaga

SEQ ID NO: 363648 - DNA, 25 bp, Homo sapien
gcacttgtgattaaacctagcctgt

SEQ ID NO: 363649 - DNA, 25 bp, Homo sapien
ttaaacctagcctgttaaatcctga

SEQ ID NO: 363650 - DNA, 25 bp, Homo sapien
tcctgaaaccttcaaccattacttc

SEQ ID NO: 363651 - DNA, 25 bp, Homo sapien
tacttctgtgaatactttagccctg

SEQ ID NO: 363652 - DNA, 25 bp, Homo sapien
ttttctgttccggtgttgtgtctgt

SEQ ID NO: 363653 - DNA, 25 bp, Homo sapien
cggtgttgtgtctgttgccggcaat

SEQ ID NO: 363654 - DNA, 25 bp, Homo sapien
gttgccggcaatggacacaccatat

SEQ ID NO: 363655 - DNA, 25 bp, Homo sapien
atggacacaccatatctgctgctgg

SEQ ID NO: 363656 - DNA, 25 bp, Homo sapien
ctgctggcccaaggaacgtcattaa

SEQ ID NO: 363657 - DNA, 25 bp, Homo sapien
ggcctggcatgggtaaccatcagag

SEQ ID NO: 363658 - DNA, 25 bp, Homo sapien
ctggcatgggtaaccatcagaggaa

SEQ ID NO: 363659 - DNA, 25 bp, Homo sapien
gaggaaaaagccatgctcagccttc

SEQ ID NO: 363660 - DNA, 25 bp, Homo sapien
ggaaaaagccatgctcagccttcca

SEQ ID NO: 363661 - DNA, 25 bp, Homo sapien
aaagccatgctcagccttccagttg

SEQ ID NO: 363662 - DNA, 25 bp, Homo sapien
atgctcagccttccagttgagtggg

SEQ ID NO: 363663 - DNA, 25 bp, Homo sapien
tcagccttccagttgagtgggtaac

SEQ ID NO: 363664 - DNA, 25 bp, Homo sapien
ccttccagttgagtgggtaacgact

SEQ ID NO: 363665 - DNA, 25 bp, Homo sapien
gagtgggtaacgactgagtctccag

SEQ ID NO: 363666 - DNA, 25 bp, Homo sapien
atcctgccaacatttagctttggtt

SEQ ID NO: 363667 - DNA, 25 bp, Homo sapien
gccaacatttagctttggttctctt

SEQ ID NO: 363668 - DNA, 25 bp, Homo sapien
aaggcctggtgctactgtgtgatgc

SEQ ID NO: 363669 - DNA, 25 bp, Homo sapien
gtgagtgatgcaaatcatctcatcg

SEQ ID NO: 363670 - DNA, 25 bp, Homo sapien
gcaaatcatctcatcgaaggctcaa

SEQ ID NO: 363671 - DNA, 25 bp, Homo sapien
tcatctcatcgaaggctcaactgca

SEQ ID NO: 363672 - DNA, 25 bp, Homo sapien
catcgaaggctcaactgcagccagg

SEQ ID NO: 363673 - DNA, 25 bp, Homo sapien
tggtgctactgtgtgatgcctgccc

SEQ ID NO: 363674 - DNA, 25 bp, Homo sapien
gagtgtacaaatgaagtgcaggagc

SEQ ID NO: 363675 - DNA, 25 bp, Homo sapien
tcctgcttcttgaaatactcatatc

SEQ ID NO: 363676 - DNA, 25 bp, Homo sapien
tgaaatactcatatcctctggcaga

SEQ ID NO: 363677 - DNA, 25 bp, Homo sapien
atcctctggcagagactagctacag

SEQ ID NO: 363678 - DNA, 25 bp, Homo sapien
gcgagaggaaatctggcaccaagct

SEQ ID NO: 363679 - DNA, 25 bp, Homo sapien
gtctttatccgtgatgtagatggag

SEQ ID NO: 363680 - DNA, 25 bp, Homo sapien
atggagatacagaaggcatcctcat

SEQ ID NO: 363681 - DNA, 25 bp, Homo sapien
atcctcatcaaattaatggagtcat

SEQ ID NO: 363682 - DNA, 25 bp, Homo sapien
atcaagcaagaaggaatggtcaaac

SEQ ID NO: 363683 - DNA, 25 bp, Homo sapien
aatggtcaaactgtgggaagtcaga

SEQ ID NO: 363684 - DNA, 25 bp, Homo sapien
gtcagagttaggttgcgaactatct

SEQ ID NO: 363685 - DNA, 25 bp, Homo sapien
gcgaactatctacgcaggtttaata

SEQ ID NO: 363686 - DNA, 25 bp, Homo sapien
tacgcaggtttaataatggtccgaa

SEQ ID NO: 363687 - DNA, 25 bp, Homo sapien
tgcatttggagtctacatctaagta

SEQ ID NO: 363688 - DNA, 25 bp, Homo sapien
gaagacaggaatttttagccattca

SEQ ID NO: 363689 - DNA, 25 bp, Homo sapien
gaatttttagccattcatgtgaaaa

SEQ ID NO: 363690 - DNA, 25 bp, Homo sapien
gcaaagctctttcactatcagaatg

SEQ ID NO: 363691 - DNA, 25 bp, Homo sapien
atcagaatgtgtttttaagcaggga

SEQ ID NO: 363692 - DNA, 25 bp, Homo sapien
taaactttgcaagccagaaggtttc

SEQ ID NO: 363693 - DNA, 25 bp, Homo sapien
agaaggtttctgtagcagctcctca

SEQ ID NO: 363694 - DNA, 25 bp, Homo sapien
ctcctcatacctcttcattgtaaag

SEQ ID NO: 363695 - DNA, 25 bp, Homo sapien
gttcctaaaaactttgacactcaag

SEQ ID NO: 363696 - DNA, 25 bp, Homo sapien
gacactcaagtgtgaatgtcatata

SEQ ID NO: 363697 - DNA, 25 bp, Homo sapien
gaatgtcatatatcttgtgtcagaa

SEQ ID NO: 363698 - DNA, 25 bp, Homo sapien
tgtgtcagaaaatattctcccctcc

SEQ ID NO: 363699 - DNA, 25 bp, Homo sapien
aaaattcattctcagcttgtgggca

SEQ ID NO: 363700 - DNA, 25 bp, Homo sapien
attctcagcttgtgggcagtacaga

SEQ ID NO: 363701 - DNA, 25 bp, Homo sapien
gcttcgatgtgcctggaggatttcc

SEQ ID NO: 363702 - DNA, 25 bp, Homo sapien
gatgtgcctggaggatttccccaca

SEQ ID NO: 363703 - DNA, 25 bp, Homo sapien
tgtatctgcgcagcttgctcgtgtg

SEQ ID NO: 363704 - DNA, 25 bp, Homo sapien
aagcgctgtcgataagcttcacgca

SEQ ID NO: 363705 - DNA, 25 bp, Homo sapien
ataagcttcacgcactggcttgcca

SEQ ID NO: 363706 - DNA, 25 bp, Homo sapien
tggcttgccagttcttcagctctag

SEQ ID NO: 363707 - DNA, 25 bp, Homo sapien
agttcttcagctctaggacttgtag

SEQ ID NO: 363708 - DNA, 25 bp, Homo sapien
gtagctttaagcaaacggtgtggca

SEQ ID NO: 363709 - DNA, 25 bp, Homo sapien
agtgtggccacctgcaggatgtgca

SEQ ID NO: 363710 - DNA, 25 bp, Homo sapien
gactctagcctctgtgttcataaag

SEQ ID NO: 363711 - DNA, 25 bp, Homo sapien
aagtggatggatgttgttccttttt

SEQ ID NO: 363712 - DNA, 25 bp, Homo sapien
acctggtgaaatgcagtgtcaacta

SEQ ID NO: 363713 - DNA, 25 bp, Homo sapien
cctggtgaaatgcagtgtcaactaa

SEQ ID NO: 363714 - DNA, 25 bp, Homo sapien
ctggtgaaatgcagtgtcaactaaa

SEQ ID NO: 363715 - DNA, 25 bp, Homo sapien
tggtgaaatgcagtgtcaactaaaa

SEQ ID NO: 363716 - DNA, 25 bp, Homo sapien
ggtgaaatgcagtgtcaactaaaaa

SEQ ID NO: 363717 - DNA, 25 bp, Homo sapien
tgaaatgcagtgtcaactaaaaata

SEQ ID NO: 363718 - DNA, 25 bp, Homo sapien
gaaatgcagtgtcaactaaaaatag

SEQ ID NO: 363719 - DNA, 25 bp, Homo sapien
aaatgcagtgtcaactaaaaatagg

SEQ ID NO: 363720 - DNA, 25 bp, Homo sapien
aatgcagtgtcaactaaaaatagga

SEQ ID NO: 363721 - DNA, 25 bp, Homo sapien
atgcagtgtcaactaaaaataggaa

SEQ ID NO: 363722 - DNA, 25 bp, Homo sapien
gcagtgtcaactaaaaataggaaaa

SEQ ID NO: 363723 - DNA, 25 bp, Homo sapien
aaccacaacattgcctgcatgtcta

SEQ ID NO: 363724 - DNA, 25 bp, Homo sapien
cattgcctgcatgtctaaaagaaaa

SEQ ID NO: 363725 - DNA, 25 bp, Homo sapien
gccaacctggtgaaatgcagtgtca

SEQ ID NO: 363726 - DNA, 25 bp, Homo sapien
acctggtgaaatgcagtgtcaacta

SEQ ID NO: 363727 - DNA, 25 bp, Homo sapien
cctggtgaaatgcagtgtcaactaa

SEQ ID NO: 363728 - DNA, 25 bp, Homo sapien
ctggtgaaatgcagtgtcaactaaa

SEQ ID NO: 363729 - DNA, 25 bp, Homo sapien
tggtgaaatgcagtgtcaactaaaa

SEQ ID NO: 363730 - DNA, 25 bp, Homo sapien
ggtgaaatgcagtgtcaactaaaaa

SEQ ID NO: 363731 - DNA, 25 bp, Homo sapien
gaaatgcagtgtcaactaaaaatag

SEQ ID NO: 363732 - DNA, 25 bp, Homo sapien
aatgcagtgtcaactaaaaatagga

SEQ ID NO: 363733 - DNA, 25 bp, Homo sapien
tgcagtgtcaactaaaaataggaaa

SEQ ID NO: 363734 - DNA, 25 bp, Homo sapien
gcgatacaacttgacctcacaagac

SEQ ID NO: 363735 - DNA, 25 bp, Homo sapien
ttgacctcacaagacgtgggctctg

SEQ ID NO: 363736 - DNA, 25 bp, Homo sapien
acctcacaagacgtgggctctggca

SEQ ID NO: 363737 - DNA, 25 bp, Homo sapien
gggctctggcaccagcaataacagc

SEQ ID NO: 363738 - DNA, 25 bp, Homo sapien
aataacagccaagcctgtgcccagt

SEQ ID NO: 363739 - DNA, 25 bp, Homo sapien
taacagccaagcctgtgcccagttc

SEQ ID NO: 363740 - DNA, 25 bp, Homo sapien
agttcctggagcagtatttccatga

SEQ ID NO: 363741 - DNA, 25 bp, Homo sapien
ggagcagtatttccatgactcagac

SEQ ID NO: 363742 - DNA, 25 bp, Homo sapien
gacctggctcagttcatgcgcctct

SEQ ID NO: 363743 - DNA, 25 bp, Homo sapien
agttcatgcgcctcttcggtggcaa

SEQ ID NO: 363744 - DNA, 25 bp, Homo sapien
tgcgcctcttcggtggcaactttgc

SEQ ID NO: 363745 - DNA, 25 bp, Homo sapien
aactcctgagtacagtttttgtgct

SEQ ID NO: 363746 - DNA, 25 bp, Homo sapien
gtacagtttttgtgctgagctctca

SEQ ID NO: 363747 - DNA, 25 bp, Homo sapien
atcaagattcttccataagactgaa

SEQ ID NO: 363748 - DNA, 25 bp, Homo sapien
taagactgaagtgctggttaccaac

SEQ ID NO: 363749 - DNA, 25 bp, Homo sapien
tgctggttaccaactttcctggtta

SEQ ID NO: 363750 - DNA, 25 bp, Homo sapien
ttcctggttaacattcagcaaaagc

SEQ ID NO: 363751 - DNA, 25 bp, Homo sapien
gcattttctctctaagtctggaact

SEQ ID NO: 363752 - DNA, 25 bp, Homo sapien
aaattcacttgttactttcagacca

SEQ ID NO: 363753 - DNA, 25 bp, Homo sapien
gtgttttacacaaatcatgcgatct

SEQ ID NO: 363754 - DNA, 25 bp, Homo sapien
aaatcatgcgatcttggcactcctg

SEQ ID NO: 363755 - DNA, 25 bp, Homo sapien
tggcactcctgattgcttggttgaa

SEQ ID NO: 363756 - DNA, 25 bp, Homo sapien
ataccattaaaaagcctcaagccca

SEQ ID NO: 363757 - DNA, 25 bp, Homo sapien
ccattaaaaagcctcaagcccaagg

SEQ ID NO: 363758 - DNA, 25 bp, Homo sapien
caagcccaaggcagaagacctatct

SEQ ID NO: 363759 - DNA, 25 bp, Homo sapien
aagcccaaggcagaagacctatctg

SEQ ID NO: 363760 - DNA, 25 bp, Homo sapien
agaagacctatctgcatttgagccc

SEQ ID NO: 363761 - DNA, 25 bp, Homo sapien
gaagacctatctgcatttgagccct

SEQ ID NO: 363762 - DNA, 25 bp, Homo sapien
aagacctatctgcatttgagccctc

SEQ ID NO: 363763 - DNA, 25 bp, Homo sapien
agacctatctgcatttgagccctca

SEQ ID NO: 363764 - DNA, 25 bp, Homo sapien
gacctatctgcatttgagccctcaa

SEQ ID NO: 363765 - DNA, 25 bp, Homo sapien
acctatctgcatttgagccctcaaa

SEQ ID NO: 363766 - DNA, 25 bp, Homo sapien
ctatctgcatttgagccctcaaact

SEQ ID NO: 363767 - DNA, 25 bp, Homo sapien
tggcggcgggtgagtcctcgcgcag

SEQ ID NO: 363768 - DNA, 25 bp, Homo sapien
agctcccgaacgaagattccctctt

SEQ ID NO: 363769 - DNA, 25 bp, Homo sapien
cgaacgaagattccctctttgccgc

SEQ ID NO: 363770 - DNA, 25 bp, Homo sapien
acgttgatgccgctgaccccggtct

SEQ ID NO: 363771 - DNA, 25 bp, Homo sapien
tgcgcctccgtctccacgataattt

SEQ ID NO: 363772 - DNA, 25 bp, Homo sapien
gtctccacgataatttccaccaact

SEQ ID NO: 363773 - DNA, 25 bp, Homo sapien
agagcccgccattgcgctcaacagt

SEQ ID NO: 363774 - DNA, 25 bp, Homo sapien
cattgcgctcaacagtggctcatat

SEQ ID NO: 363775 - DNA, 25 bp, Homo sapien
ttgcgctcaacagtggctcatatac

SEQ ID NO: 363776 - DNA, 25 bp, Homo sapien
gcgctcaacagtggctcatatacat

SEQ ID NO: 363777 - DNA, 25 bp, Homo sapien
gctcaacagtggctcatatacatat

SEQ ID NO: 363778 - DNA, 25 bp, Homo sapien
agtagaagtagttaatttgggccag

SEQ ID NO: 363779 - DNA, 25 bp, Homo sapien
gtagaagtagttaatttgggccagg

SEQ ID NO: 363780 - DNA, 25 bp, Homo sapien
tagaagtagttaatttgggccaggt

SEQ ID NO: 363781 - DNA, 25 bp, Homo sapien
agaagtagttaatttgggccaggtg

SEQ ID NO: 363782 - DNA, 25 bp, Homo sapien
gaagtagttaatttgggccaggtgc

SEQ ID NO: 363783 - DNA, 25 bp, Homo sapien
aagtagttaatttgggccaggtgca

SEQ ID NO: 363784 - DNA, 25 bp, Homo sapien
cggaggctgcaatcagtcaagatcg

SEQ ID NO: 363785 - DNA, 25 bp, Homo sapien
ggaggctgcaatcagtcaagatcgc

SEQ ID NO: 363786 - DNA, 25 bp, Homo sapien
gaggctgcaatcagtcaagatcgcg

SEQ ID NO: 363787 - DNA, 25 bp, Homo sapien
aggctgcaatcagtcaagatcgcgc

SEQ ID NO: 363788 - DNA, 25 bp, Homo sapien
ggctgcaatcagtcaagatcgcgcc

SEQ ID NO: 363789 - DNA, 25 bp, Homo sapien
cctgctgccccgtgggctgtagcaa

SEQ ID NO: 363790 - DNA, 25 bp, Homo sapien
ctgctgccccgtgggctgtagcaag

SEQ ID NO: 363791 - DNA, 25 bp, Homo sapien
gccccgtgggctgtagcaagtgtgc

SEQ ID NO: 363792 - DNA, 25 bp, Homo sapien
ccccgtgggctgtagcaagtgtgcc

SEQ ID NO: 363793 - DNA, 25 bp, Homo sapien
cccgtgggctgtagcaagtgtgccc

SEQ ID NO: 363794 - DNA, 25 bp, Homo sapien
tgtgcccagggctgtgtttgcaaag

SEQ ID NO: 363795 - DNA, 25 bp, Homo sapien
tcctgcgccgctggtgtctcctgca

SEQ ID NO: 363796 - DNA, 25 bp, Homo sapien
tgcacctgcgctggttcctgcaagt

SEQ ID NO: 363797 - DNA, 25 bp, Homo sapien
gcacctgcgctggttcctgcaagtg

SEQ ID NO: 363798 - DNA, 25 bp, Homo sapien
cctgcgctggttcctgcaagtgcaa

SEQ ID NO: 363799 - DNA, 25 bp, Homo sapien
ctgcgctggttcctgcaagtgcaaa

SEQ ID NO: 363800 - DNA, 25 bp, Homo sapien
gccctcagtgagataaattagattt

SEQ ID NO: 363801 - DNA, 25 bp, Homo sapien
agataaattagatttggcatctcct

SEQ ID NO: 363802 - DNA, 25 bp, Homo sapien
ctgggccagggatctctctacaaga

SEQ ID NO: 363803 - DNA, 25 bp, Homo sapien
tgggccagggatctctctacaagag

SEQ ID NO: 363804 - DNA, 25 bp, Homo sapien
gggccagggatctctctacaagagc

SEQ ID NO: 363805 - DNA, 25 bp, Homo sapien
ggccagggatctctctacaagagcc

SEQ ID NO: 363806 - DNA, 25 bp, Homo sapien
agggatctctctacaagagcccctg

SEQ ID NO: 363807 - DNA, 25 bp, Homo sapien
gggatctctctacaagagcccctgc

SEQ ID NO: 363808 - DNA, 25 bp, Homo sapien
tgcccctctgttggaggcacagttt

SEQ ID NO: 363809 - DNA, 25 bp, Homo sapien
ccctctgttggaggcacagttttag

SEQ ID NO: 363810 - DNA, 25 bp, Homo sapien
ctgttggaggcacagttttagaata

SEQ ID NO: 363811 - DNA, 25 bp, Homo sapien
ttctgttttatatacctcttcgtac

SEQ ID NO: 363812 - DNA, 25 bp, Homo sapien
atacctcttcgtacattaagtgcaa

SEQ ID NO: 363813 - DNA, 25 bp, Homo sapien
ctcttcgtacattaagtgcaaacta

SEQ ID NO: 363814 - DNA, 25 bp, Homo sapien
gtgcaaactacatttcttcatctta

SEQ ID NO: 363815 - DNA, 25 bp, Homo sapien
tcttcatcttaaaggttgggtttct

SEQ ID NO: 363816 - DNA, 25 bp, Homo sapien
tgggtttctttcactctagagttag

SEQ ID NO: 363817 - DNA, 25 bp, Homo sapien
tctttctaacttttttatgtgggcg

SEQ ID NO: 363818 - DNA, 25 bp, Homo sapien
gtgggcgtttaaatttagtgctata

SEQ ID NO: 363819 - DNA, 25 bp, Homo sapien
ataaatttccctcttactactgcct

SEQ ID NO: 363820 - DNA, 25 bp, Homo sapien
cccagagattctgatatgttggatc

SEQ ID NO: 363821 - DNA, 25 bp, Homo sapien
tgatatgttggatctttgttcttat

SEQ ID NO: 363822 - DNA, 25 bp, Homo sapien
cccagatgcagtatttacatctcct

SEQ ID NO: 363823 - DNA, 25 bp, Homo sapien
ttctgctattcctgccgcataactc

SEQ ID NO: 363824 - DNA, 25 bp, Homo sapien
ttccaaccctgcctgaaataagcgt

SEQ ID NO: 363825 - DNA, 25 bp, Homo sapien
gaaataagcgtggttctcctgtctg

SEQ ID NO: 363826 - DNA, 25 bp, Homo sapien
tctcctgtctgtcagactatgaaga

SEQ ID NO: 363827 - DNA, 25 bp, Homo sapien
gagttctcaaatatgtctttcccag

SEQ ID NO: 363828 - DNA, 25 bp, Homo sapien
tcaaatatgtctttcccagcgaggg

SEQ ID NO: 363829 - DNA, 25 bp, Homo sapien
atatgtctttcccagcgagggagag

SEQ ID NO: 363830 - DNA, 25 bp, Homo sapien
aaaacttcagcctccacgatcgatg

SEQ ID NO: 363831 - DNA, 25 bp, Homo sapien
cctccacgatcgatgtttctcaagt

SEQ ID NO: 363832 - DNA, 25 bp, Homo sapien
atcctattctctcgcaggtgctggg

SEQ ID NO: 363833 - DNA, 25 bp, Homo sapien
atctgttatcgctgaagtttctctt

SEQ ID NO: 363834 - DNA, 25 bp, Homo sapien
ggccttggacctagttgatcgacag

SEQ ID NO: 363835 - DNA, 25 bp, Homo sapien
ttgatcgacagtccatcaccttaat

SEQ ID NO: 363836 - DNA, 25 bp, Homo sapien
accttaatctcatcacccagtggaa

SEQ ID NO: 363837 - DNA, 25 bp, Homo sapien
atcacccagtggaaggcgtgtttac

SEQ ID NO: 363838 - DNA, 25 bp, Homo sapien
gcgtgtttaccaggtccttggaagt

SEQ ID NO: 363839 - DNA, 25 bp, Homo sapien
acatacacatgtttggcttcttgtc

SEQ ID NO: 363840 - DNA, 25 bp, Homo sapien
ttggcttcttgtcattactgttcat

SEQ ID NO: 363841 - DNA, 25 bp, Homo sapien
tactgttcatgtcctgcatttgcat

SEQ ID NO: 363842 - DNA, 25 bp, Homo sapien
gcatttgcattctcagtgctacgga

SEQ ID NO: 363843 - DNA, 25 bp, Homo sapien
tacggaagagtgacagcatcctgtg

SEQ ID NO: 363844 - DNA, 25 bp, Homo sapien
gaggttttctagttggagttgtgtc

SEQ ID NO: 363845 - DNA, 25 bp, Homo sapien
gtccaacagaattcattaacaccag

SEQ ID NO: 363846 - DNA, 25 bp, Homo sapien
tccctctggacttttttcatctttt

SEQ ID NO: 363847 - DNA, 25 bp, Homo sapien
tcatcttttcctccacctcaaaaaa

SEQ ID NO: 363848 - DNA, 25 bp, Homo sapien
cacacagattcttcttgtacaggca

SEQ ID NO: 363849 - DNA, 25 bp, Homo sapien
gattcttcttgtacaggcatcaaaa

SEQ ID NO: 363850 - DNA, 25 bp, Homo sapien
acaggcatcaaaaccaactcctctg

SEQ ID NO: 363851 - DNA, 25 bp, Homo sapien
aactcctctgcccctaaggctgtgt

SEQ ID NO: 363852 - DNA, 25 bp, Homo sapien
aaggctgtgtccctgtggtctccag

SEQ ID NO: 363853 - DNA, 25 bp, Homo sapien
cttcctcatctctggaatttggcca

SEQ ID NO: 363854 - DNA, 25 bp, Homo sapien
tctctggaatttggccaggcagtcc

SEQ ID NO: 363855 - DNA, 25 bp, Homo sapien
agcttgataacctgtggctgctgct

SEQ ID NO: 363856 - DNA, 25 bp, Homo sapien
ctgctgttactgttattggctattg

SEQ ID NO: 363857 - DNA, 25 bp, Homo sapien
tctcagccactgaactcagtccagt

SEQ ID NO: 363858 - DNA, 25 bp, Homo sapien
aactcagtccagtagagtcctcgtg

SEQ ID NO: 363859 - DNA, 25 bp, Homo sapien
agagtcctcgtgattcccggtagaa

SEQ ID NO: 363860 - DNA, 25 bp, Homo sapien
ttcccggtagaaaagatgcatgctt

SEQ ID NO: 363861 - DNA, 25 bp, Homo sapien
gcatgcttatggtaggcaaaatcct

SEQ ID NO: 363862 - DNA, 25 bp, Homo sapien
atcctcaaatgaccgatagccttcc

SEQ ID NO: 363863 - DNA, 25 bp, Homo sapien
gccttccccaaaaacttctcaatag

SEQ ID NO: 363864 - DNA, 25 bp, Homo sapien
gttatatggtttcatgcaaactctg

SEQ ID NO: 363865 - DNA, 25 bp, Homo sapien
gaattaatcagcacatggcaagaat

SEQ ID NO: 363866 - DNA, 25 bp, Homo sapien
aaagaggctggtaaaactgcatttt

SEQ ID NO: 363867 - DNA, 25 bp, Homo sapien
cattttgcacaaaagtgttgattca

SEQ ID NO: 363868 - DNA, 25 bp, Homo sapien
tccagaatgtagaggacagacccat

SEQ ID NO: 363869 - DNA, 25 bp, Homo sapien
atgttctaatgaaaccacacctctc

SEQ ID NO: 363870 - DNA, 25 bp, Homo sapien
tttctctcaaacctcggtgttactc

SEQ ID NO: 363871 - DNA, 25 bp, Homo sapien
acctcggtgttactctggccaaaag

SEQ ID NO: 363872 - DNA, 25 bp, Homo sapien
tactctggccaaaagtcttaggttt

SEQ ID NO: 363873 - DNA, 25 bp, Homo sapien
gtcttaggtttcttgaagtgtttgt

SEQ ID NO: 363874 - DNA, 25 bp, Homo sapien
aggacagacccatgggaacttcaaa

SEQ ID NO: 363875 - DNA, 25 bp, Homo sapien
ggaacttcaaaattcccctctcaat

SEQ ID NO: 363876 - DNA, 25 bp, Homo sapien
tagaaaatcaagtaccgagaatgtt

SEQ ID NO: 363877 - DNA, 25 bp, Homo sapien
gacacagtactgttgatgttcattt

SEQ ID NO: 363878 - DNA, 25 bp, Homo sapien
tgttcattttgatggcccacatata

SEQ ID NO: 363879 - DNA, 25 bp, Homo sapien
ggcccacatatatgccactatcatt

SEQ ID NO: 363880 - DNA, 25 bp, Homo sapien
gtgttttatccttctgtgactttct

SEQ ID NO: 363881 - DNA, 25 bp, Homo sapien
tgactttctagggtcatttcccttc

SEQ ID NO: 363882 - DNA, 25 bp, Homo sapien
tccacctgaagtacccctactatta

SEQ ID NO: 363883 - DNA, 25 bp, Homo sapien
cctactattatttcctttagaggag

SEQ ID NO: 363884 - DNA, 25 bp, Homo sapien
tttagaggaggtctgctgatcatct

SEQ ID NO: 363885 - DNA, 25 bp, Homo sapien
tccacttgagattataacatgcgtt

SEQ ID NO: 363886 - DNA, 25 bp, Homo sapien
taacatgcgttcttgacttatcaat

SEQ ID NO: 363887 - DNA, 25 bp, Homo sapien
ttcctcttcccagacaatgctaaaa

SEQ ID NO: 363888 - DNA, 25 bp, Homo sapien
atcctgctattgagttctttttata

SEQ ID NO: 363889 - DNA, 25 bp, Homo sapien
gggccaaatatctcttggagtggaa

SEQ ID NO: 363890 - DNA, 25 bp, Homo sapien
aaatatctcttggagtggaattcct

SEQ ID NO: 363891 - DNA, 25 bp, Homo sapien
acccggaaatatgagctatactaga

SEQ ID NO: 363892 - DNA, 25 bp, Homo sapien
taagaactttatctcgtgtgttcat

SEQ ID NO: 363893 - DNA, 25 bp, Homo sapien
catgtaattttttgagtaggaactg

SEQ ID NO: 363894 - DNA, 25 bp, Homo sapien
tgagtaggaactgttttatcttgaa

SEQ ID NO: 363895 - DNA, 25 bp, Homo sapien
ttatcttgaatattgtagctaacta

SEQ ID NO: 363896 - DNA, 25 bp, Homo sapien
atatagcagaactgcctcagtcttt

SEQ ID NO: 363897 - DNA, 25 bp, Homo sapien
gaactgcctcagtctttttaagaag

SEQ ID NO: 363898 - DNA, 25 bp, Homo sapien
ctgcctcagtctttttaagaaggaa

SEQ ID NO: 363899 - DNA, 25 bp, Homo sapien
gaaagtatcttgcacaagctcacgt

SEQ ID NO: 363900 - DNA, 25 bp, Homo sapien
cttgcacaagctcacgtagctggta

SEQ ID NO: 363901 - DNA, 25 bp, Homo sapien
cacgtagctggtaagttacatagtt

SEQ ID NO: 363902 - DNA, 25 bp, Homo sapien
agttacatagttgggatctgaattc

SEQ ID NO: 363903 - DNA, 25 bp, Homo sapien
ggatctgaattcagttgtggcttca

SEQ ID NO: 363904 - DNA, 25 bp, Homo sapien
gtggcttcatgcctgagcttttaac

SEQ ID NO: 363905 - DNA, 25 bp, Homo sapien
gcctgagcttttaactactactact

SEQ ID NO: 363906 - DNA, 25 bp, Homo sapien
ctactaaactgagaaggcacttgct

SEQ ID NO: 363907 - DNA, 25 bp, Homo sapien
gaaggcacttgcttgagtaaattat

SEQ ID NO: 363908 - DNA, 25 bp, Homo sapien
gagtaaattatgtcatcctcttaat

SEQ ID NO: 363909 - DNA, 25 bp, Homo sapien
tgaagcattatgcagctgttaaaga

SEQ ID NO: 363910 - DNA, 25 bp, Homo sapien
tctaacttgtccttaacttgccatg

SEQ ID NO: 363911 - DNA, 25 bp, Homo sapien
acttgtccttaacttgccatgttga

SEQ ID NO: 363912 - DNA, 25 bp, Homo sapien
aacttgccatgttgacttcaaacct

SEQ ID NO: 363913 - DNA, 25 bp, Homo sapien
agactttgaagtatccagccccagg

SEQ ID NO: 363914 - DNA, 25 bp, Homo sapien
tccagccccagggtgcagagaggtt

SEQ ID NO: 363915 - DNA, 25 bp, Homo sapien
gccagggagcactgcaggaatcatt

SEQ ID NO: 363916 - DNA, 25 bp, Homo sapien
ggaatcattgcatgcttaaagcgag

SEQ ID NO: 363917 - DNA, 25 bp, Homo sapien
aaagcgagttatgtcagcaccctgt

SEQ ID NO: 363918 - DNA, 25 bp, Homo sapien
gttatgtcagcaccctgtaggattt

SEQ ID NO: 363919 - DNA, 25 bp, Homo sapien
gcaccctgtaggattttgttcctta

SEQ ID NO: 363920 - DNA, 25 bp, Homo sapien
gttccttattaagtgtgtgccatgt

SEQ ID NO: 363921 - DNA, 25 bp, Homo sapien
agttactgactctccagtgggccag

SEQ ID NO: 363922 - DNA, 25 bp, Homo sapien
aggccctacctagctgggacctgag

SEQ ID NO: 363923 - DNA, 25 bp, Homo sapien
aagagggctactgccgccctgactt

SEQ ID NO: 363924 - DNA, 25 bp, Homo sapien
gccgccctgacttgtaggtaagcta

SEQ ID NO: 363925 - DNA, 25 bp, Homo sapien
ggtgccttaaacaggttcccacgca

SEQ ID NO: 363926 - DNA, 25 bp, Homo sapien
ggtaagctaaaacatctaggcaaat

SEQ ID NO: 363927 - DNA, 25 bp, Homo sapien
aggcaaattactctgtcaactgtcc

SEQ ID NO: 363928 - DNA, 25 bp, Homo sapien
ggaagaaataagttcctgctgggcc

SEQ ID NO: 363929 - DNA, 25 bp, Homo sapien
aggctcagccacaaaaccagactga

SEQ ID NO: 363930 - DNA, 25 bp, Homo sapien
atttcctggcgctattgagcttgga

SEQ ID NO: 363931 - DNA, 25 bp, Homo sapien
tcacttgtggcatcgcagttactga

SEQ ID NO: 363932 - DNA, 25 bp, Homo sapien
tcgtccttcctccatgacttataag

SEQ ID NO: 363933 - DNA, 25 bp, Homo sapien
gtccttcctccatgacttataagtc

SEQ ID NO: 363934 - DNA, 25 bp, Homo sapien
gacttataagtcatcatctctgctg

SEQ ID NO: 363935 - DNA, 25 bp, Homo sapien
ttataagtcatcatctctgctggtt

SEQ ID NO: 363936 - DNA, 25 bp, Homo sapien
ataagtcatcatctctgctggtttc

SEQ ID NO: 363937 - DNA, 25 bp, Homo sapien
aagtcatcatctctgctggtttctg

SEQ ID NO: 363938 - DNA, 25 bp, Homo sapien
tcatcatctctgctggtttctgaaa

SEQ ID NO: 363939 - DNA, 25 bp, Homo sapien
atcatctctgctggtttctgaaatg

SEQ ID NO: 363940 - DNA, 25 bp, Homo sapien
catctctgctggtttctgaaatgag

SEQ ID NO: 363941 - DNA, 25 bp, Homo sapien
gtttctgaaatgagatatgcttctt

SEQ ID NO: 363942 - DNA, 25 bp, Homo sapien
tgagatatgcttcttggggtcttca

SEQ ID NO: 363943 - DNA, 25 bp, Homo sapien
tgtggccacgcagcacacttttgtt

SEQ ID NO: 363944 - DNA, 25 bp, Homo sapien
gtcttctgtccttgagcactggctt

SEQ ID NO: 363945 - DNA, 25 bp, Homo sapien
agcactggcttgttcctggataaac

SEQ ID NO: 363946 - DNA, 25 bp, Homo sapien
ttgttcctggataaactaggcataa

SEQ ID NO: 363947 - DNA, 25 bp, Homo sapien
tgtttagtaactgtctctgtacctc

SEQ ID NO: 363948 - DNA, 25 bp, Homo sapien
aataatacctatcctgctgtgtggg

SEQ ID NO: 363949 - DNA, 25 bp, Homo sapien
ctgcacagtgcctggaggtattgaa

SEQ ID NO: 363950 - DNA, 25 bp, Homo sapien
gaggtattgaagaattatttgctgc

SEQ ID NO: 363951 - DNA, 25 bp, Homo sapien
gtctctgtacctctggatgaggaca

SEQ ID NO: 363952 - DNA, 25 bp, Homo sapien
ctctggatgaggacagctcagccgg

SEQ ID NO: 363953 - DNA, 25 bp, Homo sapien
accagaatgtcagtgtggccacgca

SEQ ID NO: 363954 - DNA, 25 bp, Homo sapien
gaagccatcctagcagatgatgatg

SEQ ID NO: 363955 - DNA, 25 bp, Homo sapien
aaaatgtggccttccaaaccatcct

SEQ ID NO: 363956 - DNA, 25 bp, Homo sapien
aaccatcctgagctaattcttctgt

SEQ ID NO: 363957 - DNA, 25 bp, Homo sapien
attcttctgtgtgactcttgcgata

SEQ ID NO: 363958 - DNA, 25 bp, Homo sapien
gtgactcttgcgatagtggatacca

SEQ ID NO: 363959 - DNA, 25 bp, Homo sapien
tagtggataccatactgcctgcctt

SEQ ID NO: 363960 - DNA, 25 bp, Homo sapien
ctcctctgatgatcatcccagatgg

SEQ ID NO: 363961 - DNA, 25 bp, Homo sapien
tcccagatggagaatggttctgccc

SEQ ID NO: 363962 - DNA, 25 bp, Homo sapien
caccttgccaacataaactgctctg

SEQ ID NO: 363963 - DNA, 25 bp, Homo sapien
aggatttggatgttgccttaaagaa

SEQ ID NO: 363964 - DNA, 25 bp, Homo sapien
aagaaagagcgtgccgaacgaagaa

SEQ ID NO: 363965 - DNA, 25 bp, Homo sapien
aggcaaaggtggaagtatccctcga

SEQ ID NO: 363966 - DNA, 25 bp, Homo sapien
aaggtggaagtatccctcgaggcca

SEQ ID NO: 363967 - DNA, 25 bp, Homo sapien
aggtggaagtatccctcgaggccaa

SEQ ID NO: 363968 - DNA, 25 bp, Homo sapien
gtggaagtatccctcgaggccaaga

SEQ ID NO: 363969 - DNA, 25 bp, Homo sapien
ggaagtatccctcgaggccaagagt

SEQ ID NO: 363970 - DNA, 25 bp, Homo sapien
accagcctggtcttttgtagagacc

SEQ ID NO: 363971 - DNA, 25 bp, Homo sapien
cagcctggtcttttgtagagaccct

SEQ ID NO: 363972 - DNA, 25 bp, Homo sapien
caggcgtcgtgcacacctgtagtat

SEQ ID NO: 363973 - DNA, 25 bp, Homo sapien
ctacttgtaaggctgtggcagaagt

SEQ ID NO: 363974 - DNA, 25 bp, Homo sapien
aaggctgtggcagaagtgctttagc

SEQ ID NO: 363975 - DNA, 25 bp, Homo sapien
tgtggcagaagtgctttagcccagg

SEQ ID NO: 363976 - DNA, 25 bp, Homo sapien
gctaaggcagtagtaagagggaaat

SEQ ID NO: 363977 - DNA, 25 bp, Homo sapien
atagcactaaatttaaacgcccaca

SEQ ID NO: 363978 - DNA, 25 bp, Homo sapien
gcactaaatttaaacgcccacataa

SEQ ID NO: 363979 - DNA, 25 bp, Homo sapien
ataaatcatatataagcaatccatt

SEQ ID NO: 363980 - DNA, 25 bp, Homo sapien
aagcaatccattattgttaaaacaa

SEQ ID NO: 363981 - DNA, 25 bp, Homo sapien
acaaatcactaactctagagtgaaa

SEQ ID NO: 363982 - DNA, 25 bp, Homo sapien
ctaactctagagtgaaagaaaccca

SEQ ID NO: 363983 - DNA, 25 bp, Homo sapien
tgaaagaaacccaacctttaagatg

SEQ ID NO: 363984 - DNA, 25 bp, Homo sapien
acccaacctttaagatgaagaaatg

SEQ ID NO: 363985 - DNA, 25 bp, Homo sapien
gatccaacatatcagaatctctggg

SEQ ID NO: 363986 - DNA, 25 bp, Homo sapien
tccaacatatcagaatctctgggac

SEQ ID NO: 363987 - DNA, 25 bp, Homo sapien
ttctgtcttggaaaactgttcaaat

SEQ ID NO: 363988 - DNA, 25 bp, Homo sapien
agaagagtggaatgagcccatcacc

SEQ ID NO: 363989 - DNA, 25 bp, Homo sapien
cacccagctccaaaaatctgcaaat

SEQ ID NO: 363990 - DNA, 25 bp, Homo sapien
agctccaaaaatctgcaaatgcact

SEQ ID NO: 363991 - DNA, 25 bp, Homo sapien
aaaatctgcaaatgcactggccagt

SEQ ID NO: 363992 - DNA, 25 bp, Homo sapien
atgcactggccagtctggctcaccc

SEQ ID NO: 363993 - DNA, 25 bp, Homo sapien
cccacggggttattctgacatgaat

SEQ ID NO: 363994 - DNA, 25 bp, Homo sapien
ttttatgaatggattgcagggaggt

SEQ ID NO: 363995 - DNA, 25 bp, Homo sapien
gggaggtggaggtcttgtgttagga

SEQ ID NO: 363996 - DNA, 25 bp, Homo sapien
acaaaagtccccctatctcttctag

SEQ ID NO: 363997 - DNA, 25 bp, Homo sapien
tccccctatctcttctaggcgaggg

SEQ ID NO: 363998 - DNA, 25 bp, Homo sapien
aggtcactgagcaagtcctttgctc

SEQ ID NO: 363999 - DNA, 25 bp, Homo sapien
aagtcctttgctctgtgtaaaaatg

SEQ ID NO: 364000 - DNA, 25 bp, Homo sapien
cctttgctctgtgtaaaaatgacgt

SEQ ID NO: 364001 - DNA, 25 bp, Homo sapien
aaaatgacgtgaaaggctgatcctg

SEQ ID NO: 364002 - DNA, 25 bp, Homo sapien
atcctgaaagtcattaggtgtcctt

SEQ ID NO: 364003 - DNA, 25 bp, Homo sapien
agtcattaggtgtcctttccatgaa

SEQ ID NO: 364004 - DNA, 25 bp, Homo sapien
tcctttccatgaagttgtgccttcc

SEQ ID NO: 364005 - DNA, 25 bp, Homo sapien
ctgccacagctctgtcgtctggact

SEQ ID NO: 364006 - DNA, 25 bp, Homo sapien
gcccgagcagtgtggagcgaataca

SEQ ID NO: 364007 - DNA, 25 bp, Homo sapien
acagctctgtcgtctggactcgcca

SEQ ID NO: 364008 - DNA, 25 bp, Homo sapien
gagcagtgtggagcgaatacagccc

SEQ ID NO: 364009 - DNA, 25 bp, Homo sapien
gatgttttctttgtaacttatctta

SEQ ID NO: 364010 - DNA, 25 bp, Homo sapien
ttgtaacttatcttatttctttctt

SEQ ID NO: 364011 - DNA, 25 bp, Homo sapien
gtttttcactctcacagtagtttta

SEQ ID NO: 364012 - DNA, 25 bp, Homo sapien
ttcttgactgtctaatatccgaggc

SEQ ID NO: 364013 - DNA, 25 bp, Homo sapien
tgactgtctaatatccgaggctttg

SEQ ID NO: 364014 - DNA, 25 bp, Homo sapien
atatccgaggctttgttgtgctcca

SEQ ID NO: 364015 - DNA, 25 bp, Homo sapien
aggctttgttgtgctccattctttt

SEQ ID NO: 364016 - DNA, 25 bp, Homo sapien
tccattcttttctcatgcttgccat

SEQ ID NO: 364017 - DNA, 25 bp, Homo sapien
gaaagacatagacacatccatttta

SEQ ID NO: 364018 - DNA, 25 bp, Homo sapien
tcaagtattttgatcagagccaatt

SEQ ID NO: 364019 - DNA, 25 bp, Homo sapien
tttgatcagagccaattacttttaa

SEQ ID NO: 364020 - DNA, 25 bp, Homo sapien
ccaccaaggtggctgcgaccctgga

SEQ ID NO: 364021 - DNA, 25 bp, Homo sapien
tcctatggcctttagcctgctgcaa

SEQ ID NO: 364022 - DNA, 25 bp, Homo sapien
tggcctttagcctgctgcaaccaca

SEQ ID NO: 364023 - DNA, 25 bp, Homo sapien
catccctccttgatgtgtcactcga

SEQ ID NO: 364024 - DNA, 25 bp, Homo sapien
ttgatgtgtcactcgaccgccagtg

SEQ ID NO: 364025 - DNA, 25 bp, Homo sapien
tcactcgaccgccagtgtggcaaaa

SEQ ID NO: 364026 - DNA, 25 bp, Homo sapien
gtgtggcaaaactctctaacctctg

SEQ ID NO: 364027 - DNA, 25 bp, Homo sapien
taacctctgcccatgtcgtggtgaa

SEQ ID NO: 364028 - DNA, 25 bp, Homo sapien
tctgcccatgtcgtggtgaagaaaa

SEQ ID NO: 364029 - DNA, 25 bp, Homo sapien
aaaaggctctgccagtcaagctgcc

SEQ ID NO: 364030 - DNA, 25 bp, Homo sapien
tccactgctcaatcactgtattact

SEQ ID NO: 364031 - DNA, 25 bp, Homo sapien
aaaaaatagaatgaggctgggcaca

SEQ ID NO: 364032 - DNA, 25 bp, Homo sapien
aaaaatagaatgaggctgggcacag

SEQ ID NO: 364033 - DNA, 25 bp, Homo sapien
aaaatagaatgaggctgggcacagt

SEQ ID NO: 364034 - DNA, 25 bp, Homo sapien
ctgaggcagaattactttgagcccg

SEQ ID NO: 364035 - DNA, 25 bp, Homo sapien
tgaggcagaattactttgagcccgg

SEQ ID NO: 364036 - DNA, 25 bp, Homo sapien
gaggcagaattactttgagcccggg

SEQ ID NO: 364037 - DNA, 25 bp, Homo sapien
aggcagaattactttgagcccggga

SEQ ID NO: 364038 - DNA, 25 bp, Homo sapien
ggcagaattactttgagcccgggag

SEQ ID NO: 364039 - DNA, 25 bp, Homo sapien
gcagaattactttgagcccgggagg

SEQ ID NO: 364040 - DNA, 25 bp, Homo sapien
cagaattactttgagcccgggaggt

SEQ ID NO: 364041 - DNA, 25 bp, Homo sapien
agaattactttgagcccgggaggtg

SEQ ID NO: 364042 - DNA, 25 bp, Homo sapien
actcagcaagagaagaaccgtttat

SEQ ID NO: 364043 - DNA, 25 bp, Homo sapien
gaagaaccgtttatagtgtacattg

SEQ ID NO: 364044 - DNA, 25 bp, Homo sapien
tgaatatttcataaggcaaccgcct

SEQ ID NO: 364045 - DNA, 25 bp, Homo sapien
aaccgcctgttagcactcagagtga

SEQ ID NO: 364046 - DNA, 25 bp, Homo sapien
gaatagaaagagtaggcgggccttt

SEQ ID NO: 364047 - DNA, 25 bp, Homo sapien
taggcgggcctttgtctgcagatgt

SEQ ID NO: 364048 - DNA, 25 bp, Homo sapien
tggaggaaaccgttgaaaatctggc

SEQ ID NO: 364049 - DNA, 25 bp, Homo sapien
tgtgtccccttttccaatgttggtt

SEQ ID NO: 364050 - DNA, 25 bp, Homo sapien
ggtttacagaatcttgcttttgcct

SEQ ID NO: 364051 - DNA, 25 bp, Homo sapien
cttgcttttgcctttaacgttattg

SEQ ID NO: 364052 - DNA, 25 bp, Homo sapien
ggacgtattcgatttctaagtggtt

SEQ ID NO: 364053 - DNA, 25 bp, Homo sapien
aagaccatctcattgtcaggcagcc

SEQ ID NO: 364054 - DNA, 25 bp, Homo sapien
atctcattgtcaggcagcctggaca

SEQ ID NO: 364055 - DNA, 25 bp, Homo sapien
aaggacttcgtcatctatggcatgg

SEQ ID NO: 364056 - DNA, 25 bp, Homo sapien
gtcatctatggcatggagggctccc

SEQ ID NO: 364057 - DNA, 25 bp, Homo sapien
ttcctgggggcatttcagtttcagc

SEQ ID NO: 364058 - DNA, 25 bp, Homo sapien
cccgggctttcagtgcggtcaaggt

SEQ ID NO: 364059 - DNA, 25 bp, Homo sapien
agtgcggtcaaggtgaagatctcaa

SEQ ID NO: 364060 - DNA, 25 bp, Homo sapien
aaggtgaagatctcaagcaactggg

SEQ ID NO: 364061 - DNA, 25 bp, Homo sapien
ggaacccaggcttcacttgcctgta

SEQ ID NO: 364062 - DNA, 25 bp, Homo sapien
tcacttgcctgtaccgcgtgcgagt

SEQ ID NO: 364063 - DNA, 25 bp, Homo sapien
accgcgtgcgagtgcatggctctgt

SEQ ID NO: 364064 - DNA, 25 bp, Homo sapien
attttcttgttctgtgagttgataa

SEQ ID NO: 364065 - DNA, 25 bp, Homo sapien
aggagtttttaatctcagctctgag

SEQ ID NO: 364066 - DNA, 25 bp, Homo sapien
gaattggaagtcacttcactaccca

SEQ ID NO: 364067 - DNA, 25 bp, Homo sapien
tcactacccacctcttgggaactga

SEQ ID NO: 364068 - DNA, 25 bp, Homo sapien
gggaactgattccacaagtttatat

SEQ ID NO: 364069 - DNA, 25 bp, Homo sapien
tttatatccataatcccgagtaggc

SEQ ID NO: 364070 - DNA, 25 bp, Homo sapien
gagtaggcttcatgaccagttttcc

SEQ ID NO: 364071 - DNA, 25 bp, Homo sapien
accagttttccctctgaacattgaa

SEQ ID NO: 364072 - DNA, 25 bp, Homo sapien
agaatagcaactcccttagatcatt

SEQ ID NO: 364073 - DNA, 25 bp, Homo sapien
gttactcttctcacattgttagcat

SEQ ID NO: 364074 - DNA, 25 bp, Homo sapien
gtatgttaacctgtacttctaccca

SEQ ID NO: 364075 - DNA, 25 bp, Homo sapien
tacacctttatatatgagatccaag

SEQ ID NO: 364076 - DNA, 25 bp, Homo sapien
gagatccaagtttcactttttgtga

SEQ ID NO: 364077 - DNA, 25 bp, Homo sapien
gatccaagtttcactttttgtgata

SEQ ID NO: 364078 - DNA, 25 bp, Homo sapien
cactttttgtgatataatgagccag

SEQ ID NO: 364079 - DNA, 25 bp, Homo sapien
tttttgtgatataatgagccagttt

SEQ ID NO: 364080 - DNA, 25 bp, Homo sapien
gagccagttttctcagtaatgtcta

SEQ ID NO: 364081 - DNA, 25 bp, Homo sapien
gccagttttctcagtaatgtctact

SEQ ID NO: 364082 - DNA, 25 bp, Homo sapien
gttttctcagtaatgtctactaaaa

SEQ ID NO: 364083 - DNA, 25 bp, Homo sapien
taacctttctctaatatttgcatga

SEQ ID NO: 364084 - DNA, 25 bp, Homo sapien
acctttctctaatatttgcatgatt

SEQ ID NO: 364085 - DNA, 25 bp, Homo sapien
ttctctaatatttgcatgattctaa

SEQ ID NO: 364086 - DNA, 25 bp, Homo sapien
attcttacatttctcagcccaagaa

SEQ ID NO: 364087 - DNA, 25 bp, Homo sapien
tcagcccaagaacactttccaatct

SEQ ID NO: 364088 - DNA, 25 bp, Homo sapien
aagaacactttccaatctcaaaaca

SEQ ID NO: 364089 - DNA, 25 bp, Homo sapien
acatattacaaagatgcagtcatca

SEQ ID NO: 364090 - DNA, 25 bp, Homo sapien
gtcatcaagactgtatggtactagc

SEQ ID NO: 364091 - DNA, 25 bp, Homo sapien
aacagttctgaagtaaatccataca

SEQ ID NO: 364092 - DNA, 25 bp, Homo sapien
gtaaatccatacatttacagtcaac

SEQ ID NO: 364093 - DNA, 25 bp, Homo sapien
caacagaggcaagacgacagttcat

SEQ ID NO: 364094 - DNA, 25 bp, Homo sapien
ggcaagacgacagttcatgaggaaa

SEQ ID NO: 364095 - DNA, 25 bp, Homo sapien
acaactggacatccatgtgcaaaag

SEQ ID NO: 364096 - DNA, 25 bp, Homo sapien
tgcaaaagattaaagtgggacaccc

SEQ ID NO: 364097 - DNA, 25 bp, Homo sapien
actgtccataaatcatgtcctgcca

SEQ ID NO: 364098 - DNA, 25 bp, Homo sapien
aaatcatgtcctgccaaagactgga

SEQ ID NO: 364099 - DNA, 25 bp, Homo sapien
aatgttactggattgctgaaactaa

SEQ ID NO: 364100 - DNA, 25 bp, Homo sapien
agtcaaaatgactgtgccataaaca

SEQ ID NO: 364101 - DNA, 25 bp, Homo sapien
aacaattcatatctcatggtgattc

SEQ ID NO: 364102 - DNA, 25 bp, Homo sapien
catggtgattcaagacattactgct

SEQ ID NO: 364103 - DNA, 25 bp, Homo sapien
cattactgctatggtgagatttaac

SEQ ID NO: 364104 - DNA, 25 bp, Homo sapien
gatttaacatttagaggtgacagca

SEQ ID NO: 364105 - DNA, 25 bp, Homo sapien
acactggcagtgaattttttgtgct

SEQ ID NO: 364106 - DNA, 25 bp, Homo sapien
aattttttgtgctacaaacttggca

SEQ ID NO: 364107 - DNA, 25 bp, Homo sapien
agtttcaacttcatgtgttattaac

SEQ ID NO: 364108 - DNA, 25 bp, Homo sapien
gattctgctgctttaggattggcac

SEQ ID NO: 364109 - DNA, 25 bp, Homo sapien
ctgctttaggattggcacagctaga

SEQ ID NO: 364110 - DNA, 25 bp, Homo sapien
taggattggcacagctagagaagtc

SEQ ID NO: 364111 - DNA, 25 bp, Homo sapien
ttcagagtgccagagccttggcaat

SEQ ID NO: 364112 - DNA, 25 bp, Homo sapien
gagccttggcaatgagtctgatagt

SEQ ID NO: 364113 - DNA, 25 bp, Homo sapien
ggcaatgagtctgatagtcctagga

SEQ ID NO: 364114 - DNA, 25 bp, Homo sapien
gtctgatagtcctaggaggttctgg

SEQ ID NO: 364115 - DNA, 25 bp, Homo sapien
ggttctggaagaaagtctggaccat

SEQ ID NO: 364116 - DNA, 25 bp, Homo sapien
aagtctggaccatcattcgggaaac

SEQ ID NO: 364117 - DNA, 25 bp, Homo sapien
atcattcgggaaaccgtctactgag

SEQ ID NO: 364118 - DNA, 25 bp, Homo sapien
ggaaaccgtctactgagaaagtcga

SEQ ID NO: 364119 - DNA, 25 bp, Homo sapien
agtgttataggctggactgtgtccc

SEQ ID NO: 364120 - DNA, 25 bp, Homo sapien
ataggctggactgtgtccccttcct

SEQ ID NO: 364121 - DNA, 25 bp, Homo sapien
gttcagtcctggtgcaggtggtcct

SEQ ID NO: 364122 - DNA, 25 bp, Homo sapien
tgccccgccgccatgcatatatgga

SEQ ID NO: 364123 - DNA, 25 bp, Homo sapien
atatatggacgcctagtacctcaga

SEQ ID NO: 364124 - DNA, 25 bp, Homo sapien
atatggacgcctagtacctcagaat

SEQ ID NO: 364125 - DNA, 25 bp, Homo sapien
ggtggtcctggacaacactttgaaa

SEQ ID NO: 364126 - DNA, 25 bp, Homo sapien
acaagccagcaagcatatgggattc

SEQ ID NO: 364127 - DNA, 25 bp, Homo sapien
catatgggattcatctgctgtgagt

SEQ ID NO: 364128 - DNA, 25 bp, Homo sapien
gggattcatctgctgtgagtgataa

SEQ ID NO: 364129 - DNA, 25 bp, Homo sapien
tctgctgtgagtgataatttatcta

SEQ ID NO: 364130 - DNA, 25 bp, Homo sapien
tctcattctgtaaacggtgtctttt

SEQ ID NO: 364131 - DNA, 25 bp, Homo sapien
tcattctgtaaacggtgtctttttt

SEQ ID NO: 364132 - DNA, 25 bp, Homo sapien
aaagctttattgacacatttgtttt

SEQ ID NO: 364133 - DNA, 25 bp, Homo sapien
gtaaaatacacagaacataaacgtt

SEQ ID NO: 364134 - DNA, 25 bp, Homo sapien
gaacataaacgttaccatctgatat

SEQ ID NO: 364135 - DNA, 25 bp, Homo sapien
tggctgtgtccacacctaaatctcg

SEQ ID NO: 364136 - DNA, 25 bp, Homo sapien
gtgtccacacctaaatctcgaattg

SEQ ID NO: 364137 - DNA, 25 bp, Homo sapien
ataatccccacacatatgtaccaca

SEQ ID NO: 364138 - DNA, 25 bp, Homo sapien
ctttatccagtctttcgttgataga

SEQ ID NO: 364139 - DNA, 25 bp, Homo sapien
tccagtctttcgttgatagacattt

SEQ ID NO: 364140 - DNA, 25 bp, Homo sapien
atagacatttaggtcgattccatgt

SEQ ID NO: 364141 - DNA, 25 bp, Homo sapien
gaaaaatctgggaattactttagct

SEQ ID NO: 364142 - DNA, 25 bp, Homo sapien
gagattgatcggtgcatatcccttt

SEQ ID NO: 364143 - DNA, 25 bp, Homo sapien
atcggtgcatatccctttgttaggt

SEQ ID NO: 364144 - DNA, 25 bp, Homo sapien
gaaatgtttactctgatattagtat

SEQ ID NO: 364145 - DNA, 25 bp, Homo sapien
gcatatccctttgttaggttttgga

SEQ ID NO: 364146 - DNA, 25 bp, Homo sapien
ggtggtactaggaaaattggaatat

SEQ ID NO: 364147 - DNA, 25 bp, Homo sapien
gaaactctatttgttagtaatacca

SEQ ID NO: 364148 - DNA, 25 bp, Homo sapien
gttagtaataccacatcaggtagtt

SEQ ID NO: 364149 - DNA, 25 bp, Homo sapien
gattaaaagtctctactactcagat

SEQ ID NO: 364150 - DNA, 25 bp, Homo sapien
tataacacaaatggtcttgactcag

SEQ ID NO: 364151 - DNA, 25 bp, Homo sapien
gtcttgactcagatgttaatgctgt

SEQ ID NO: 364152 - DNA, 25 bp, Homo sapien
atcctaggcccgagacaagatggtg

SEQ ID NO: 364153 - DNA, 25 bp, Homo sapien
agatggtggaactcaggatgccagc

SEQ ID NO: 364154 - DNA, 25 bp, Homo sapien
gggagcccactactgtcctccaaga

SEQ ID NO: 364155 - DNA, 25 bp, Homo sapien
ggaaaacgggcattccagcacccat

SEQ ID NO: 364156 - DNA, 25 bp, Homo sapien
tcctcaaaaggccaatgcttcttga

SEQ ID NO: 364157 - DNA, 25 bp, Homo sapien
aaaaggccaatgcttcttgagaagg

SEQ ID NO: 364158 - DNA, 25 bp, Homo sapien
gatccagggttttgaagttcggcca

SEQ ID NO: 364159 - DNA, 25 bp, Homo sapien
tttgaagttcggccaactcggtgta

SEQ ID NO: 364160 - DNA, 25 bp, Homo sapien
gctcctgccctgaagtgagtgccca

SEQ ID NO: 364161 - DNA, 25 bp, Homo sapien
cctgcctgcgcactggatattagtg

SEQ ID NO: 364162 - DNA, 25 bp, Homo sapien
atattagtggccatcctaggcccga

SEQ ID NO: 364163 - DNA, 25 bp, Homo sapien
ccaccaaagtggttccacaagaggc

SEQ ID NO: 364164 - DNA, 25 bp, Homo sapien
caccaaagtggttccacaagaggcc

SEQ ID NO: 364165 - DNA, 25 bp, Homo sapien
acaagaggccctaaacaaatgagta

SEQ ID NO: 364166 - DNA, 25 bp, Homo sapien
agagtaggaggcatacctttgtttc

SEQ ID NO: 364167 - DNA, 25 bp, Homo sapien
gagtaggaggcatacctttgtttca

SEQ ID NO: 364168 - DNA, 25 bp, Homo sapien
agtaggaggcatacctttgtttcat

SEQ ID NO: 364169 - DNA, 25 bp, Homo sapien
tttgtttgttggtttctgtgcttgc

SEQ ID NO: 364170 - DNA, 25 bp, Homo sapien
tgtttgttggtttctgtgcttgctt

SEQ ID NO: 364171 - DNA, 25 bp, Homo sapien
gttggaaacattgaatggaacagct

SEQ ID NO: 364172 - DNA, 25 bp, Homo sapien
cattgaatggaacagctaatgtacc

SEQ ID NO: 364173 - DNA, 25 bp, Homo sapien
tggaacagctaatgtaccatagtaa

SEQ ID NO: 364174 - DNA, 25 bp, Homo sapien
gctgctccgtcttacagaggcattc

SEQ ID NO: 364175 - DNA, 25 bp, Homo sapien
agaggcattccagggacacccactt

SEQ ID NO: 364176 - DNA, 25 bp, Homo sapien
cccacttctacccactggaggaagg

SEQ ID NO: 364177 - DNA, 25 bp, Homo sapien
ggaggaaggaagtacatctttggat

SEQ ID NO: 364178 - DNA, 25 bp, Homo sapien
cccaggactgtcaaaggatattact

SEQ ID NO: 364179 - DNA, 25 bp, Homo sapien
ggatattactcatttcctcttgcag

SEQ ID NO: 364180 - DNA, 25 bp, Homo sapien
attactcatttcctcttgcagcaga

SEQ ID NO: 364181 - DNA, 25 bp, Homo sapien
tttcctcttgcagcagaatgtaatg

SEQ ID NO: 364182 - DNA, 25 bp, Homo sapien
agtaatggaggtgctgtgccatgac

SEQ ID NO: 364183 - DNA, 25 bp, Homo sapien
ctgtgccatgaccagcagtgttggt

SEQ ID NO: 364184 - DNA, 25 bp, Homo sapien
agcagtgttggtggccacccagatc

SEQ ID NO: 364185 - DNA, 25 bp, Homo sapien
atgttcttcagcaatttgcctctct

SEQ ID NO: 364186 - DNA, 25 bp, Homo sapien
atttgcctctctcactcagtatcat

SEQ ID NO: 364187 - DNA, 25 bp, Homo sapien
ctcagtatcatgtatctggtctcat

SEQ ID NO: 364188 - DNA, 25 bp, Homo sapien
gtatcatgtatctggtctcatctat

SEQ ID NO: 364189 - DNA, 25 bp, Homo sapien
gtatctggtctcatctatattgctc

SEQ ID NO: 364190 - DNA, 25 bp, Homo sapien
ggtctcatctatattgctctatgta

SEQ ID NO: 364191 - DNA, 25 bp, Homo sapien
tctatattgctctatgtatctttag

SEQ ID NO: 364192 - DNA, 25 bp, Homo sapien
tttatatatctgttctgatgatgaa

SEQ ID NO: 364193 - DNA, 25 bp, Homo sapien
accatatataaatcgagtcactcac

SEQ ID NO: 364194 - DNA, 25 bp, Homo sapien
atcgagtcactcacaatgtatgtac

SEQ ID NO: 364195 - DNA, 25 bp, Homo sapien
gtacaatatgttcttcagcaatttg

SEQ ID NO: 364196 - DNA, 25 bp, Homo sapien
taaaatggaatttgccaaacaaggg

SEQ ID NO: 364197 - DNA, 25 bp, Homo sapien
gggaatttttatctcaagatattta

SEQ ID NO: 364198 - DNA, 25 bp, Homo sapien
aaaacactggtattatctcagcatc

SEQ ID NO: 364199 - DNA, 25 bp, Homo sapien
aacactggtattatctcagcatcat

SEQ ID NO: 364200 - DNA, 25 bp, Homo sapien
actggtattatctcagcatcatggg

SEQ ID NO: 364201 - DNA, 25 bp, Homo sapien
ggtattatctcagcatcatgggcaa

SEQ ID NO: 364202 - DNA, 25 bp, Homo sapien
agcatcatgggcaatttttccttat

SEQ ID NO: 364203 - DNA, 25 bp, Homo sapien
tttttccttattacatgccaatatt

SEQ ID NO: 364204 - DNA, 25 bp, Homo sapien
ttccttattacatgccaatatttgt

SEQ ID NO: 364205 - DNA, 25 bp, Homo sapien
attacatgccaatatttgtacaaaa

SEQ ID NO: 364206 - DNA, 25 bp, Homo sapien
aagaaaataattggaacacatggat

SEQ ID NO: 364207 - DNA, 25 bp, Homo sapien
gctgtcttgtgcatcaaaggagggt

SEQ ID NO: 364208 - DNA, 25 bp, Homo sapien
caaaggagggttagcagcatccctg

SEQ ID NO: 364209 - DNA, 25 bp, Homo sapien
ataccttcttccactgttgtgacaa

SEQ ID NO: 364210 - DNA, 25 bp, Homo sapien
gtctccagacattgctagatcgggc

SEQ ID NO: 364211 - DNA, 25 bp, Homo sapien
gctagatcgggcaaaattgtgccca

SEQ ID NO: 364212 - DNA, 25 bp, Homo sapien
aaattgtgcccagttgagaatcact

SEQ ID NO: 364213 - DNA, 25 bp, Homo sapien
gttgagaatcactggcttaaaagga

SEQ ID NO: 364214 - DNA, 25 bp, Homo sapien
aggaaaaaggccattgcatggatgt

SEQ ID NO: 364215 - DNA, 25 bp, Homo sapien
gcatggatgtgcaataacaccttta

SEQ ID NO: 364216 - DNA, 25 bp, Homo sapien
gcaataacacctttagccatttcct

SEQ ID NO: 364217 - DNA, 25 bp, Homo sapien
agccatttcctaatgatgtcattta

SEQ ID NO: 364218 - DNA, 25 bp, Homo sapien
aaatctcccatatactacatcagtg

SEQ ID NO: 364219 - DNA, 25 bp, Homo sapien
tatactacatcagtggtcttcaaac

SEQ ID NO: 364220 - DNA, 25 bp, Homo sapien
tggtcttcaaactcttctgttccta

SEQ ID NO: 364221 - DNA, 25 bp, Homo sapien
ttttaaattatgtaactccctgcac

SEQ ID NO: 364222 - DNA, 25 bp, Homo sapien
gtaactccctgcacatctttaaata

SEQ ID NO: 364223 - DNA, 25 bp, Homo sapien
agaaggaagattggctaaccgctaa

SEQ ID NO: 364224 - DNA, 25 bp, Homo sapien
tccttatttcttgttaacagcagat

SEQ ID NO: 364225 - DNA, 25 bp, Homo sapien
ttggctaaccgctaaaacagtgagt

SEQ ID NO: 364226 - DNA, 25 bp, Homo sapien
aaccgctaaaacagtgagttcgata

SEQ ID NO: 364227 - DNA, 25 bp, Homo sapien
gttttcattcatgcaatcaagcctg

SEQ ID NO: 364228 - DNA, 25 bp, Homo sapien
ttcatgcaatcaagcctgggcagaa

SEQ ID NO: 364229 - DNA, 25 bp, Homo sapien
aaagtgtttctttcctatttgctct

SEQ ID NO: 364230 - DNA, 25 bp, Homo sapien
aagtgtttctttcctatttgctctt

SEQ ID NO: 364231 - DNA, 25 bp, Homo sapien
agtgtttctttcctatttgctcttt

SEQ ID NO: 364232 - DNA, 25 bp, Homo sapien
gtgtttctttcctatttgctctttt

SEQ ID NO: 364233 - DNA, 25 bp, Homo sapien
tgtttctttcctatttgctctttta

SEQ ID NO: 364234 - DNA, 25 bp, Homo sapien
gtttctttcctatttgctcttttat

SEQ ID NO: 364235 - DNA, 25 bp, Homo sapien
tttctttcctatttgctcttttata

SEQ ID NO: 364236 - DNA, 25 bp, Homo sapien
tctttcctatttgctcttttatatt

SEQ ID NO: 364237 - DNA, 25 bp, Homo sapien
ttatatttagtacggaacaaggaat

SEQ ID NO: 364238 - DNA, 25 bp, Homo sapien
gaaaatagctagaatgcttctaaag

SEQ ID NO: 364239 - DNA, 25 bp, Homo sapien
tagaatgcttctaaagtttgttttt

SEQ ID NO: 364240 - DNA, 25 bp, Homo sapien
gaaagggactgtcatgtcccatcct

SEQ ID NO: 364241 - DNA, 25 bp, Homo sapien
atgtcccatcctttggccagattga

SEQ ID NO: 364242 - DNA, 25 bp, Homo sapien
ggatgtccggacagatgcctgcatg

SEQ ID NO: 364243 - DNA, 25 bp, Homo sapien
tggtgagggccacatctgcacacga

SEQ ID NO: 364244 - DNA, 25 bp, Homo sapien
ctgctgtgatgccagagtgtgttca

SEQ ID NO: 364245 - DNA, 25 bp, Homo sapien
tgtgttcaaaggtgactctcctgct

SEQ ID NO: 364246 - DNA, 25 bp, Homo sapien
tctggactcttctctcaggcaagaa

SEQ ID NO: 364247 - DNA, 25 bp, Homo sapien
gcctgctatgtgatgcctgagcaca

SEQ ID NO: 364248 - DNA, 25 bp, Homo sapien
gaactaagtctttctgttaagtcct

SEQ ID NO: 364249 - DNA, 25 bp, Homo sapien
ttaagtcctgagtttgtcattggca

SEQ ID NO: 364250 - DNA, 25 bp, Homo sapien
gcaggtttacttgtggccagctctc

SEQ ID NO: 364251 - DNA, 25 bp, Homo sapien
agatctggttcaggatgagcctgaa

SEQ ID NO: 364252 - DNA, 25 bp, Homo sapien
actgcccctttttcacagacgggtg

SEQ ID NO: 364253 - DNA, 25 bp, Homo sapien
tgcccctttttcacagacgggtggg

SEQ ID NO: 364254 - DNA, 25 bp, Homo sapien
cttgagggtaggctggtacctggca

SEQ ID NO: 364255 - DNA, 25 bp, Homo sapien
ctggcaggtgaggagtggagtctac

SEQ ID NO: 364256 - DNA, 25 bp, Homo sapien
gagtctacagctccaaatgtgaaaa

SEQ ID NO: 364257 - DNA, 25 bp, Homo sapien
gtgagcaagtttgttgatgattaac

SEQ ID NO: 364258 - DNA, 25 bp, Homo sapien
gatgattaacttgcagatccttccc

SEQ ID NO: 364259 - DNA, 25 bp, Homo sapien
tgtgtaaactcctgcctagattctg

SEQ ID NO: 364260 - DNA, 25 bp, Homo sapien
taaactcctgcctagattctgccaa

SEQ ID NO: 364261 - DNA, 25 bp, Homo sapien
tgcctagattctgccaagctctttt

SEQ ID NO: 364262 - DNA, 25 bp, Homo sapien
tttataatagtttccctacccagag

SEQ ID NO: 364263 - DNA, 25 bp, Homo sapien
atagtttccctacccagagatatta

SEQ ID NO: 364264 - DNA, 25 bp, Homo sapien
ttccctacccagagatattagaagt

SEQ ID NO: 364265 - DNA, 25 bp, Homo sapien
taaagtaccttgagatccttaaatc

SEQ ID NO: 364266 - DNA, 25 bp, Homo sapien
aatcaaaggtgctatatacataagt

SEQ ID NO: 364267 - DNA, 25 bp, Homo sapien
gtaagactctactttcagaaaaagg

SEQ ID NO: 364268 - DNA, 25 bp, Homo sapien
aatattatttcctgcactgatccct

SEQ ID NO: 364269 - DNA, 25 bp, Homo sapien
gcactgatccctactaattctatat

SEQ ID NO: 364270 - DNA, 25 bp, Homo sapien
ccctactaattctatattgatccaa

SEQ ID NO: 364271 - DNA, 25 bp, Homo sapien
ttgatccaaaggcaactcaatgcta

SEQ ID NO: 364272 - DNA, 25 bp, Homo sapien
agtctgtgtctgtgtactgtagaga

SEQ ID NO: 364273 - DNA, 25 bp, Homo sapien
gatgttttctttgtaacttatctta

SEQ ID NO: 364274 - DNA, 25 bp, Homo sapien
ttgtaacttatcttatttctttctt

SEQ ID NO: 364275 - DNA, 25 bp, Homo sapien
ttcttgactgtctaatatccgaggc

SEQ ID NO: 364276 - DNA, 25 bp, Homo sapien
tgactgtctaatatccgaggctttg

SEQ ID NO: 364277 - DNA, 25 bp, Homo sapien
atatccgaggctttgttgtgctcca

SEQ ID NO: 364278 - DNA, 25 bp, Homo sapien
ctttgttgtgctccattcttttctc

SEQ ID NO: 364279 - DNA, 25 bp, Homo sapien
gaaagacatagacacatccatttta

SEQ ID NO: 364280 - DNA, 25 bp, Homo sapien
gacatagacacatccattttatatt

SEQ ID NO: 364281 - DNA, 25 bp, Homo sapien
cttttcacagtatttcaagtatttt

SEQ ID NO: 364282 - DNA, 25 bp, Homo sapien
tcaagtattttgatcagagccaatt

SEQ ID NO: 364283 - DNA, 25 bp, Homo sapien
tttgatcagagccaattacttttaa

SEQ ID NO: 364284 - DNA, 25 bp, Homo sapien
gtgattttatttgtgcaggtcatgc

SEQ ID NO: 364285 - DNA, 25 bp, Homo sapien
tgcaggtcatgcacacagttttgat

SEQ ID NO: 364286 - DNA, 25 bp, Homo sapien
gcacacagttttgataaagggcagt

SEQ ID NO: 364287 - DNA, 25 bp, Homo sapien
tgataaagggcagtaacaagtattg

SEQ ID NO: 364288 - DNA, 25 bp, Homo sapien
ccacaaggcattctctaaagctatg

SEQ ID NO: 364289 - DNA, 25 bp, Homo sapien
aaggcattctctaaagctatgtgaa

SEQ ID NO: 364290 - DNA, 25 bp, Homo sapien
agctatgtgaaattttctctgcacc

SEQ ID NO: 364291 - DNA, 25 bp, Homo sapien
gtgaaattttctctgcacctctgta

SEQ ID NO: 364292 - DNA, 25 bp, Homo sapien
aattttctctgcacctctgtacaga

SEQ ID NO: 364293 - DNA, 25 bp, Homo sapien
ctctgtacagagaatacacctgccc

SEQ ID NO: 364294 - DNA, 25 bp, Homo sapien
tacacctgcccctgtatatcctttt

SEQ ID NO: 364295 - DNA, 25 bp, Homo sapien
gagctccatgattttgacttcctgt

SEQ ID NO: 364296 - DNA, 25 bp, Homo sapien
tgacttcctgtctaacctgttgatg

SEQ ID NO: 364297 - DNA, 25 bp, Homo sapien
ctgtctaacctgttgatgctacaaa

SEQ ID NO: 364298 - DNA, 25 bp, Homo sapien
ttcaagaaacgttacaggtgctggt

SEQ ID NO: 364299 - DNA, 25 bp, Homo sapien
tgctggtgaattcaatgcccttggt

SEQ ID NO: 364300 - DNA, 25 bp, Homo sapien
atgcccttggtgtcaataagctttt

SEQ ID NO: 364301 - DNA, 25 bp, Homo sapien
agcttttgctgagtcttagaatgtg

SEQ ID NO: 364302 - DNA, 25 bp, Homo sapien
tgtggcttgaactgagaggactttc

SEQ ID NO: 364303 - DNA, 25 bp, Homo sapien
gaggactttcaaacagataatgcga

SEQ ID NO: 364304 - DNA, 25 bp, Homo sapien
agtttccaatgcaaatgtcttcggg

SEQ ID NO: 364305 - DNA, 25 bp, Homo sapien
atgatctcagtgtatatggaggccc

SEQ ID NO: 364306 - DNA, 25 bp, Homo sapien
ttgttgttgggcgttcagatgcaat

SEQ ID NO: 364307 - DNA, 25 bp, Homo sapien
gggcgttcagatgcaattggaccaa

SEQ ID NO: 364308 - DNA, 25 bp, Homo sapien
cgttcagatgcaattggaccaagag

SEQ ID NO: 364309 - DNA, 25 bp, Homo sapien
ttggaccaagagaacaatgggaacc

SEQ ID NO: 364310 - DNA, 25 bp, Homo sapien
gagaacaatgggaaccagtctttaa

SEQ ID NO: 364311 - DNA, 25 bp, Homo sapien
ggaaaatggctttgtcgacctcaaa

SEQ ID NO: 364312 - DNA, 25 bp, Homo sapien
gctttgtcgacctcaaatagctgct

SEQ ID NO: 364313 - DNA, 25 bp, Homo sapien
gtcgacctcaaatagctgctttatt

SEQ ID NO: 364314 - DNA, 25 bp, Homo sapien
atccctcttactaaagattagatcc

SEQ ID NO: 364315 - DNA, 25 bp, Homo sapien
ctaaagattagatcctgtgctgaaa

SEQ ID NO: 364316 - DNA, 25 bp, Homo sapien
aaaaaagatgacattccagaagaag

SEQ ID NO: 364317 - DNA, 25 bp, Homo sapien
gaggcatgaggcaaaccattgctgt

SEQ ID NO: 364318 - DNA, 25 bp, Homo sapien
gaggcaaaccattgctgtgggaata

SEQ ID NO: 364319 - DNA, 25 bp, Homo sapien
cattgctgtgggaatagcagtgacc

SEQ ID NO: 364320 - DNA, 25 bp, Homo sapien
cagcatgggcgatgaggaatgccat

SEQ ID NO: 364321 - DNA, 25 bp, Homo sapien
tgaggaatgccattgcagcctagaa

SEQ ID NO: 364322 - DNA, 25 bp, Homo sapien
gccattgcagcctagaaattcggtt

SEQ ID NO: 364323 - DNA, 25 bp, Homo sapien
gcagcctagaaattcggtttctgga

SEQ ID NO: 364324 - DNA, 25 bp, Homo sapien
attcggtttctggaggtttagcctg

SEQ ID NO: 364325 - DNA, 25 bp, Homo sapien
ttctggaggtttagcctgattttga

SEQ ID NO: 364326 - DNA, 25 bp, Homo sapien
gtatttaagaacagagggctccaga

SEQ ID NO: 364327 - DNA, 25 bp, Homo sapien
agaacagagggctccagaccaggtg

SEQ ID NO: 364328 - DNA, 25 bp, Homo sapien
gagaatgttatagcctccaagcctt

SEQ ID NO: 364329 - DNA, 25 bp, Homo sapien
aatattcctgatcctagtgacaaaa

SEQ ID NO: 364330 - DNA, 25 bp, Homo sapien
gttatagcctccaagcctttcagaa

SEQ ID NO: 364331 - DNA, 25 bp, Homo sapien
agcctccaagcctttcagaacctgt

SEQ ID NO: 364332 - DNA, 25 bp, Homo sapien
tcctgatcctagtgacaaaagttat

SEQ ID NO: 364333 - DNA, 25 bp, Homo sapien
atcagaatttttaacaagggtgcca

SEQ ID NO: 364334 - DNA, 25 bp, Homo sapien
taacaagggtgccagttcaaagctg

SEQ ID NO: 364335 - DNA, 25 bp, Homo sapien
gtgccagttcaaagctggaaactaa

SEQ ID NO: 364336 - DNA, 25 bp, Homo sapien
atgaatataaatgtgcaccctccca

SEQ ID NO: 364337 - DNA, 25 bp, Homo sapien
aatgtgcaccctcccacagaaaaaa

SEQ ID NO: 364338 - DNA, 25 bp, Homo sapien
aatacgactgtcactgaaaaatatt

SEQ ID NO: 364339 - DNA, 25 bp, Homo sapien
accacgcctggcctagttagcattt

SEQ ID NO: 364340 - DNA, 25 bp, Homo sapien
ccacgcctggcctagttagcatttt

SEQ ID NO: 364341 - DNA, 25 bp, Homo sapien
gccataacaaaaaccatcattgttt

SEQ ID NO: 364342 - DNA, 25 bp, Homo sapien
accatcattgtttgtattccacact

SEQ ID NO: 364343 - DNA, 25 bp, Homo sapien
catcattgtttgtattccacactgt

SEQ ID NO: 364344 - DNA, 25 bp, Homo sapien
cattgtttgtattccacactgttaa

SEQ ID NO: 364345 - DNA, 25 bp, Homo sapien
ttgtttgtattccacactgttaatg

SEQ ID NO: 364346 - DNA, 25 bp, Homo sapien
gtttgtattccacactgttaatgaa

SEQ ID NO: 364347 - DNA, 25 bp, Homo sapien
gtattccacactgttaatgaatgta

SEQ ID NO: 364348 - DNA, 25 bp, Homo sapien
ttccacactgttaatgaatgtaaag

SEQ ID NO: 364349 - DNA, 25 bp, Homo sapien
aagaggttagaaatgtagtgtttga

SEQ ID NO: 364350 - DNA, 25 bp, Homo sapien
ttgttgttgggcgttcagatgcaat

SEQ ID NO: 364351 - DNA, 25 bp, Homo sapien
gttgttgggcgttcagatgcaattg

SEQ ID NO: 364352 - DNA, 25 bp, Homo sapien
tgttgggcgttcagatgcaattgga

SEQ ID NO: 364353 - DNA, 25 bp, Homo sapien
ttgggcgttcagatgcaattggacc

SEQ ID NO: 364354 - DNA, 25 bp, Homo sapien
gggcgttcagatgcaattggaccaa

SEQ ID NO: 364355 - DNA, 25 bp, Homo sapien
ggcgttcagatgcaattggaccaag

SEQ ID NO: 364356 - DNA, 25 bp, Homo sapien
gcgttcagatgcaattggaccaaga

SEQ ID NO: 364357 - DNA, 25 bp, Homo sapien
gttcagatgcaattggaccaagaga

SEQ ID NO: 364358 - DNA, 25 bp, Homo sapien
gatgcaattggaccaagagaacaat

SEQ ID NO: 364359 - DNA, 25 bp, Homo sapien
ttggaccaagagaacaatgggaacc

SEQ ID NO: 364360 - DNA, 25 bp, Homo sapien
accaagagaacaatgggaaccagtc

SEQ ID NO: 364361 - DNA, 25 bp, Homo sapien
agtttctgtttcagtcacaaattag

SEQ ID NO: 364362 - DNA, 25 bp, Homo sapien
gtttcagtcacaaattagggttatt

SEQ ID NO: 364363 - DNA, 25 bp, Homo sapien
atactgtgaattctatgactttatc

SEQ ID NO: 364364 - DNA, 25 bp, Homo sapien
tttatcaaaatcagccacatccagg

SEQ ID NO: 364365 - DNA, 25 bp, Homo sapien
ccacatccaggagcttgcagttgtt

SEQ ID NO: 364366 - DNA, 25 bp, Homo sapien
caggagcttgcagttgttgaccaaa

SEQ ID NO: 364367 - DNA, 25 bp, Homo sapien
gagcttgcagttgttgaccaaatga

SEQ ID NO: 364368 - DNA, 25 bp, Homo sapien
tgatgacatagagtagttcagatct

SEQ ID NO: 364369 - DNA, 25 bp, Homo sapien
gtagttcagatctatcatgtgctct

SEQ ID NO: 364370 - DNA, 25 bp, Homo sapien
cagatctatcatgtgctcttctatc

SEQ ID NO: 364371 - DNA, 25 bp, Homo sapien
ctatcatgtgctcttctatctaatc

SEQ ID NO: 364372 - DNA, 25 bp, Homo sapien
tgctagatagactggctattacata

SEQ ID NO: 364373 - DNA, 25 bp, Homo sapien
ggctattacataaccatatgtagtt

SEQ ID NO: 364374 - DNA, 25 bp, Homo sapien
atttttcttcacatgtcactgttag

SEQ ID NO: 364375 - DNA, 25 bp, Homo sapien
tttcttcacatgtcactgttagaag

SEQ ID NO: 364376 - DNA, 25 bp, Homo sapien
cactgttagaagtaaatcccaatag

SEQ ID NO: 364377 - DNA, 25 bp, Homo sapien
gtatttcttgtaacatataactcat

SEQ ID NO: 364378 - DNA, 25 bp, Homo sapien
cctttagaataatcatggtttgttt

SEQ ID NO: 364379 - DNA, 25 bp, Homo sapien
tattaatcgtcaactgtggccaaaa

SEQ ID NO: 364380 - DNA, 25 bp, Homo sapien
taatcgtcaactgtggccaaaattg

SEQ ID NO: 364381 - DNA, 25 bp, Homo sapien
actgtggccaaaattgagtttcatg

SEQ ID NO: 364382 - DNA, 25 bp, Homo sapien
gccaaaattgagtttcatgagacaa

SEQ ID NO: 364383 - DNA, 25 bp, Homo sapien
caaaccatctttgaggttgcaaagc

SEQ ID NO: 364384 - DNA, 25 bp, Homo sapien
tttgaggttgcaaagctgctgtact

SEQ ID NO: 364385 - DNA, 25 bp, Homo sapien
tgcaaagctgctgtactgtgccaat

SEQ ID NO: 364386 - DNA, 25 bp, Homo sapien
tgacaatttagcacattacaagatt

SEQ ID NO: 364387 - DNA, 25 bp, Homo sapien
atgtatctccaagagaatgtcttaa

SEQ ID NO: 364388 - DNA, 25 bp, Homo sapien
gagaatgtcttaatcaaacttcaga

SEQ ID NO: 364389 - DNA, 25 bp, Homo sapien
aaacttcagaactgacccatctaag

SEQ ID NO: 364390 - DNA, 25 bp, Homo sapien
gaactgacccatctaagtcaatagt

SEQ ID NO: 364391 - DNA, 25 bp, Homo sapien
gacccatctaagtcaatagtgcaaa

SEQ ID NO: 364392 - DNA, 25 bp, Homo sapien
tagtgcaaagcacccaatacctgtg

SEQ ID NO: 364393 - DNA, 25 bp, Homo sapien
gcaaagcacccaatacctgtggagg

SEQ ID NO: 364394 - DNA, 25 bp, Homo sapien
gggttcaagcctagttaagcatgag

SEQ ID NO: 364395 - DNA, 25 bp, Homo sapien
gcctagttaagcatgagagagtcca

SEQ ID NO: 364396 - DNA, 25 bp, Homo sapien
gttaagcatgagagagtccatacta

SEQ ID NO: 364397 - DNA, 25 bp, Homo sapien
agcatgagagagtccatactaatga

SEQ ID NO: 364398 - DNA, 25 bp, Homo sapien
gagagtccatactaatgagaagtct

SEQ ID NO: 364399 - DNA, 25 bp, Homo sapien
aggcctttggtagtggctatcaact

SEQ ID NO: 364400 - DNA, 25 bp, Homo sapien
ggctatcaacttagtgttcatcaga

SEQ ID NO: 364401 - DNA, 25 bp, Homo sapien
caacttagtgttcatcagagatttc

SEQ ID NO: 364402 - DNA, 25 bp, Homo sapien
atactggtgagaagctttatcaacg

SEQ ID NO: 364403 - DNA, 25 bp, Homo sapien
gaagctttatcaacgtaaggaattc

SEQ ID NO: 364404 - DNA, 25 bp, Homo sapien
tatcaacgtaaggaattcgggaaga

SEQ ID NO: 364405 - DNA, 25 bp, Homo sapien
ggaaaattgtcccaacgccagcaaa

SEQ ID NO: 364406 - DNA, 25 bp, Homo sapien
tgtcccaacgccagcaaaactagat

SEQ ID NO: 364407 - DNA, 25 bp, Homo sapien
tatgaataaaccagccttagaagaa

SEQ ID NO: 364408 - DNA, 25 bp, Homo sapien
ctgtcatttttattcacgtccgctt

SEQ ID NO: 364409 - DNA, 25 bp, Homo sapien
tattcacgtccgcttttgttgctct

SEQ ID NO: 364410 - DNA, 25 bp, Homo sapien
tctcactggacctcttcctagttta

SEQ ID NO: 364411 - DNA, 25 bp, Homo sapien
tggacctcttcctagtttaacttga

SEQ ID NO: 364412 - DNA, 25 bp, Homo sapien
gaaaccaaacttgtagctagaaagg

SEQ ID NO: 364413 - DNA, 25 bp, Homo sapien
ttgtagctagaaaggcatggaggca

SEQ ID NO: 364414 - DNA, 25 bp, Homo sapien
gaggcaaacttggtcttaaattcag

SEQ ID NO: 364415 - DNA, 25 bp, Homo sapien
cttggtcttaaattcagcacattca

SEQ ID NO: 364416 - DNA, 25 bp, Homo sapien
ttgttccccaaagagtcacatcgac

SEQ ID NO: 364417 - DNA, 25 bp, Homo sapien
aaagagtcacatcgacgccgagctg

SEQ ID NO: 364418 - DNA, 25 bp, Homo sapien
ggtcacttacacttccccgagagca

SEQ ID NO: 364419 - DNA, 25 bp, Homo sapien
gagagcacctctccactagaaaggc

SEQ ID NO: 364420 - DNA, 25 bp, Homo sapien
aaggatacaacattggcccagaagc

SEQ ID NO: 364421 - DNA, 25 bp, Homo sapien
cagaagccagggacgctctggatga

SEQ ID NO: 364422 - DNA, 25 bp, Homo sapien
atgacggcgccctctgcggtctagg

SEQ ID NO: 364423 - DNA, 25 bp, Homo sapien
atcttttcccgctgccgagaaaagg

SEQ ID NO: 364424 - DNA, 25 bp, Homo sapien
agaaaaggccttcctggcttgggca

SEQ ID NO: 364425 - DNA, 25 bp, Homo sapien
tggcttgggcattaaccggctccag

SEQ ID NO: 364426 - DNA, 25 bp, Homo sapien
attggtccgtggcaactcccctttg

SEQ ID NO: 364427 - DNA, 25 bp, Homo sapien
acctctttccctgaattgctattga

SEQ ID NO: 364428 - DNA, 25 bp, Homo sapien
attgagaattggtccatctcccagc

SEQ ID NO: 364429 - DNA, 25 bp, Homo sapien
agctccaggtgctgctgtctgcagc

SEQ ID NO: 364430 - DNA, 25 bp, Homo sapien
gctgtctgcagcaagggcattactg

SEQ ID NO: 364431 - DNA, 25 bp, Homo sapien
attactgcccaggtaaggagtgcta

SEQ ID NO: 364432 - DNA, 25 bp, Homo sapien
ggagtgctagaatcaccaagcaaat

SEQ ID NO: 364433 - DNA, 25 bp, Homo sapien
attggcagaaatggaggcttcagtc

SEQ ID NO: 364434 - DNA, 25 bp, Homo sapien
aatggaggcttcagtcacacaaatt

SEQ ID NO: 364435 - DNA, 25 bp, Homo sapien
ggaactaaaacactggttatctcca

SEQ ID NO: 364436 - DNA, 25 bp, Homo sapien
actggttatctccaggaaaacctca

SEQ ID NO: 364437 - DNA, 25 bp, Homo sapien
ggaaaacctcatttagatggaaatt

SEQ ID NO: 364438 - DNA, 25 bp, Homo sapien
aaatgactttatcccaaggtacagt

SEQ ID NO: 364439 - DNA, 25 bp, Homo sapien
tatcccaaggtacagtgaggtaaac

SEQ ID NO: 364440 - DNA, 25 bp, Homo sapien
tattcttagatatccttagatttgg

SEQ ID NO: 364441 - DNA, 25 bp, Homo sapien
gatttggttaactgaggctgtagaa

SEQ ID NO: 364442 - DNA, 25 bp, Homo sapien
gaagcagcgaattgtctagccattt

SEQ ID NO: 364443 - DNA, 25 bp, Homo sapien
gcgaattgtctagccatttaagtta

SEQ ID NO: 364444 - DNA, 25 bp, Homo sapien
attgtctagccatttaagttatttt

SEQ ID NO: 364445 - DNA, 25 bp, Homo sapien
ttcagcataaacatcaatctctaat

SEQ ID NO: 364446 - DNA, 25 bp, Homo sapien
acatcaatctctaatttctatctag

SEQ ID NO: 364447 - DNA, 25 bp, Homo sapien
gaagtgactttaagacattacaaga

SEQ ID NO: 364448 - DNA, 25 bp, Homo sapien
attgtagacttattatcagcctttt

SEQ ID NO: 364449 - DNA, 25 bp, Homo sapien
gctgaacatcaccatcgagagggtc

SEQ ID NO: 364450 - DNA, 25 bp, Homo sapien
accatcgagagggtctgtcctgctg

SEQ ID NO: 364451 - DNA, 25 bp, Homo sapien
gatgaggcgatcagtttctcgagaa

SEQ ID NO: 364452 - DNA, 25 bp, Homo sapien
gtttctcgagaacttatggctttag

SEQ ID NO: 364453 - DNA, 25 bp, Homo sapien
gaccaataaggaatgcaatgctcac

SEQ ID NO: 364454 - DNA, 25 bp, Homo sapien
gcaatgctcacaggaaggttactat

SEQ ID NO: 364455 - DNA, 25 bp, Homo sapien
ggttactatcaactggatcctcgtt

SEQ ID NO: 364456 - DNA, 25 bp, Homo sapien
tggatcctcgttcacagccaggtca

SEQ ID NO: 364457 - DNA, 25 bp, Homo sapien
agccaggtcacaggcaatttcacta

SEQ ID NO: 364458 - DNA, 25 bp, Homo sapien
ggcaatttcactaactccattatgg

SEQ ID NO: 364459 - DNA, 25 bp, Homo sapien
attatggatgttctttaccaagaga

SEQ ID NO: 364460 - DNA, 25 bp, Homo sapien
aatgatgaacacagcgctccctatt

SEQ ID NO: 364461 - DNA, 25 bp, Homo sapien
gctccctattttgctaagcgctgtg

SEQ ID NO: 364462 - DNA, 25 bp, Homo sapien
gcgctgtgctaaactatatgcctta

SEQ ID NO: 364463 - DNA, 25 bp, Homo sapien
atgccttaactcatcttaatgtcta

SEQ ID NO: 364464 - DNA, 25 bp, Homo sapien
atgtctacaacagcttatatgaggg

SEQ ID NO: 364465 - DNA, 25 bp, Homo sapien
atatgagggctttaaaccaaggctt

SEQ ID NO: 364466 - DNA, 25 bp, Homo sapien
aaggcttggtaaactactgcccatg

SEQ ID NO: 364467 - DNA, 25 bp, Homo sapien
aactactgcccatgggccaaacctg

SEQ ID NO: 364468 - DNA, 25 bp, Homo sapien
atcatctagttctgtatagcccaca

SEQ ID NO: 364469 - DNA, 25 bp, Homo sapien
tctgtatagcccacaagccaagaat

SEQ ID NO: 364470 - DNA, 25 bp, Homo sapien
tttgagactgtgaaaaccgtatgaa

SEQ ID NO: 364471 - DNA, 25 bp, Homo sapien
gaaacagttcagagggagatacaaa

SEQ ID NO: 364472 - DNA, 25 bp, Homo sapien
gaggaagtactggatgctaaacaat

SEQ ID NO: 364473 - DNA, 25 bp, Homo sapien
ttatatgagagacagctcaggctgg

SEQ ID NO: 364474 - DNA, 25 bp, Homo sapien
agcctcttggaggaagtagcctgat

SEQ ID NO: 364475 - DNA, 25 bp, Homo sapien
gtagcctgatatgttaactttctgc

SEQ ID NO: 364476 - DNA, 25 bp, Homo sapien
gatatgttaactttctgcatgccag

SEQ ID NO: 364477 - DNA, 25 bp, Homo sapien
gttaactttctgcatgccagtggta

SEQ ID NO: 364478 - DNA, 25 bp, Homo sapien
ttctgcatgccagtggtaagtcatt

SEQ ID NO: 364479 - DNA, 25 bp, Homo sapien
tgccagtggtaagtcatttgagatt

SEQ ID NO: 364480 - DNA, 25 bp, Homo sapien
gattatagtatctttgtccacccaa

SEQ ID NO: 364481 - DNA, 25 bp, Homo sapien
gtccacccaaggtttactgctgtaa

SEQ ID NO: 364482 - DNA, 25 bp, Homo sapien
gccgaggcgtgcgaatcacaaggtc

SEQ ID NO: 364483 - DNA, 25 bp, Homo sapien
cgaggcgtgcgaatcacaaggtcag

SEQ ID NO: 364484 - DNA, 25 bp, Homo sapien
gagagtcacttgaatccggtaggcg

SEQ ID NO: 364485 - DNA, 25 bp, Homo sapien
agagtcacttgaatccggtaggcgg

SEQ ID NO: 364486 - DNA, 25 bp, Homo sapien
gagtcacttgaatccggtaggcgga

SEQ ID NO: 364487 - DNA, 25 bp, Homo sapien
agtcacttgaatccggtaggcggag

SEQ ID NO: 364488 - DNA, 25 bp, Homo sapien
gtcacttgaatccggtaggcggagg

SEQ ID NO: 364489 - DNA, 25 bp, Homo sapien
taaataagaaggcacaccacaagtt

SEQ ID NO: 364490 - DNA, 25 bp, Homo sapien
aaataagaaggcacaccacaagttc

SEQ ID NO: 364491 - DNA, 25 bp, Homo sapien
aataagaaggcacaccacaagttcg

SEQ ID NO: 364492 - DNA, 25 bp, Homo sapien
ataagaaggcacaccacaagttcga

SEQ ID NO: 364493 - DNA, 25 bp, Homo sapien
ggcctggcatgggtaaccatcagag

SEQ ID NO: 364494 - DNA, 25 bp, Homo sapien
gaggaaaaagccatgctcagccttc

SEQ ID NO: 364495 - DNA, 25 bp, Homo sapien
aaagccatgctcagccttccagttg

SEQ ID NO: 364496 - DNA, 25 bp, Homo sapien
atgctcagccttccagttgagtggg

SEQ ID NO: 364497 - DNA, 25 bp, Homo sapien
tcagccttccagttgagtgggtaac

SEQ ID NO: 364498 - DNA, 25 bp, Homo sapien
ccttccagttgagtgggtaacgact

SEQ ID NO: 364499 - DNA, 25 bp, Homo sapien
tgagtgggtaacgactgagtctcca

SEQ ID NO: 364500 - DNA, 25 bp, Homo sapien
aacgactgagtctccagggaattcc

SEQ ID NO: 364501 - DNA, 25 bp, Homo sapien
atcctgccaacatttagctttggtt

SEQ ID NO: 364502 - DNA, 25 bp, Homo sapien
gccaacatttagctttggttctctt

SEQ ID NO: 364503 - DNA, 25 bp, Homo sapien
catttccttagatgttacccagatg

SEQ ID NO: 364504 - DNA, 25 bp, Homo sapien
aattgtcttgtctacagctctatcc

SEQ ID NO: 364505 - DNA, 25 bp, Homo sapien
tacagctctatcctcagtacagcac

SEQ ID NO: 364506 - DNA, 25 bp, Homo sapien
gtacagcaccaagcttacagtggat

SEQ ID NO: 364507 - DNA, 25 bp, Homo sapien
gaagatttgccgatttgccgaatga

SEQ ID NO: 364508 - DNA, 25 bp, Homo sapien
ttgccgaatgaatgctttcacccct

SEQ ID NO: 364509 - DNA, 25 bp, Homo sapien
gcaactgtttactgcctgctaggag

SEQ ID NO: 364510 - DNA, 25 bp, Homo sapien
taggagctcagagcctctgggatac

SEQ ID NO: 364511 - DNA, 25 bp, Homo sapien
gacagtgcctgctcgcttggaaggc

SEQ ID NO: 364512 - DNA, 25 bp, Homo sapien
aaaacagcacttctttgcttcttcc

SEQ ID NO: 364513 - DNA, 25 bp, Homo sapien
ggagagttcatttctagggcaccac

SEQ ID NO: 364514 - DNA, 25 bp, Homo sapien
tctagggcaccacagctatgagaaa

SEQ ID NO: 364515 - DNA, 25 bp, Homo sapien
taacctacttatgggagaacagctg

SEQ ID NO: 364516 - DNA, 25 bp, Homo sapien
ggaataaacattgccattgtcaact

SEQ ID NO: 364517 - DNA, 25 bp, Homo sapien
cattgtcaactatgtaactgggaat

SEQ ID NO: 364518 - DNA, 25 bp, Homo sapien
gaatgtgacagcaacacgatgtttt

SEQ ID NO: 364519 - DNA, 25 bp, Homo sapien
tatgaaggcgataactctggaccga

SEQ ID NO: 364520 - DNA, 25 bp, Homo sapien
ctctggaccgatgacaaagtttatt

SEQ ID NO: 364521 - DNA, 25 bp, Homo sapien
aagtttattcagagtgctgctccaa

SEQ ID NO: 364522 - DNA, 25 bp, Homo sapien
tcagagtgctgctccaaaatccctg

SEQ ID NO: 364523 - DNA, 25 bp, Homo sapien
atccctgctcttcatggtgacctat

SEQ ID NO: 364524 - DNA, 25 bp, Homo sapien
atggtgacctatgacgacggaagca

SEQ ID NO: 364525 - DNA, 25 bp, Homo sapien
gaataacgatgccaagaatgccata

SEQ ID NO: 364526 - DNA, 25 bp, Homo sapien
acatgggctttgtttgcttattcca

SEQ ID NO: 364527 - DNA, 25 bp, Homo sapien
gcagcagctatagaccttaccatgg

SEQ ID NO: 364528 - DNA, 25 bp, Homo sapien
aacatgaagagaccctgcacccctt

SEQ ID NO: 364529 - DNA, 25 bp, Homo sapien
ggattgctgcaagagttacctgttg

SEQ ID NO: 364530 - DNA, 25 bp, Homo sapien
caggattgactggtgatgtttcatt

SEQ ID NO: 364531 - DNA, 25 bp, Homo sapien
atgtttcattctgaccttgtcccaa

SEQ ID NO: 364532 - DNA, 25 bp, Homo sapien
caagctctccatctctagatctggg

SEQ ID NO: 364533 - DNA, 25 bp, Homo sapien
gaaaagctctcacacaaaccggaag

SEQ ID NO: 364534 - DNA, 25 bp, Homo sapien
accggaagccaaatgtcccctatct

SEQ ID NO: 364535 - DNA, 25 bp, Homo sapien
aatgtcccctatctcttgaatgatc

SEQ ID NO: 364536 - DNA, 25 bp, Homo sapien
tcaagtcacttttgacaacatccag

SEQ ID NO: 364537 - DNA, 25 bp, Homo sapien
gggttcaagcctagttaagcatgag

SEQ ID NO: 364538 - DNA, 25 bp, Homo sapien
gcctagttaagcatgagagagtcca

SEQ ID NO: 364539 - DNA, 25 bp, Homo sapien
gttaagcatgagagagtccatacta

SEQ ID NO: 364540 - DNA, 25 bp, Homo sapien
agcatgagagagtccatactaatga

SEQ ID NO: 364541 - DNA, 25 bp, Homo sapien
gagagtccatactaatgagaagtct

SEQ ID NO: 364542 - DNA, 25 bp, Homo sapien
ggctatcaacttagtgttcatcaga

SEQ ID NO: 364543 - DNA, 25 bp, Homo sapien
atcaacttagtgttcatcagagatt

SEQ ID NO: 364544 - DNA, 25 bp, Homo sapien
aacttagtgttcatcagagatttca

SEQ ID NO: 364545 - DNA, 25 bp, Homo sapien
gaagctttatcaacgtaaggaattc

SEQ ID NO: 364546 - DNA, 25 bp, Homo sapien
gctttatcaacgtaaggaattcggg

SEQ ID NO: 364547 - DNA, 25 bp, Homo sapien
tatcaacgtaaggaattcgggaaga

SEQ ID NO: 364548 - DNA, 25 bp, Homo sapien
tggctctctcaggagtagatgagtg

SEQ ID NO: 364549 - DNA, 25 bp, Homo sapien
tagatgagtgctagaccctggacct

SEQ ID NO: 364550 - DNA, 25 bp, Homo sapien
gacctcctgactccgagttcatgta

SEQ ID NO: 364551 - DNA, 25 bp, Homo sapien
agttcatgtagtctccgctgcacca

SEQ ID NO: 364552 - DNA, 25 bp, Homo sapien
tgcaccaactccaaaaccgtgggat

SEQ ID NO: 364553 - DNA, 25 bp, Homo sapien
ctccaaaaccgtgggattctgcttt

SEQ ID NO: 364554 - DNA, 25 bp, Homo sapien
ttttcatcctctgtggtgttggcca

SEQ ID NO: 364555 - DNA, 25 bp, Homo sapien
ggtgttggccagatcatacttgaag

SEQ ID NO: 364556 - DNA, 25 bp, Homo sapien
ggccagatcatacttgaaggccttg

SEQ ID NO: 364557 - DNA, 25 bp, Homo sapien
gaaatggagtctgctgattagccaa

SEQ ID NO: 364558 - DNA, 25 bp, Homo sapien
gagtctgctgattagccaaaaagcc

SEQ ID NO: 364559 - DNA, 25 bp, Homo sapien
gttctgtccttctgattgggagtat

SEQ ID NO: 364560 - DNA, 25 bp, Homo sapien
gattgggagtattattttcctaggt

SEQ ID NO: 364561 - DNA, 25 bp, Homo sapien
gttccataaattgagacactgaatg

SEQ ID NO: 364562 - DNA, 25 bp, Homo sapien
gtgcattctcacatttctagagacc

SEQ ID NO: 364563 - DNA, 25 bp, Homo sapien
tgaaatcaaggtgcggtccgagcca

SEQ ID NO: 364564 - DNA, 25 bp, Homo sapien
atcaaggtgcggtccgagccacact

SEQ ID NO: 364565 - DNA, 25 bp, Homo sapien
gcaagttaatatacaattactgcta

SEQ ID NO: 364566 - DNA, 25 bp, Homo sapien
aaaggtacatacctccaattttgtg

SEQ ID NO: 364567 - DNA, 25 bp, Homo sapien
tgtgttgtgttgacaattccacttg

SEQ ID NO: 364568 - DNA, 25 bp, Homo sapien
gttgacaattccacttgtttgttct

SEQ ID NO: 364569 - DNA, 25 bp, Homo sapien
acttgtttgttctgtccttctgatt

SEQ ID NO: 364570 - DNA, 25 bp, Homo sapien
caaaactcaaatgccctttgtagtt

SEQ ID NO: 364571 - DNA, 25 bp, Homo sapien
gttcttgctcagtggcttttatttg

SEQ ID NO: 364572 - DNA, 25 bp, Homo sapien
tatttggttccctttgagttcccag

SEQ ID NO: 364573 - DNA, 25 bp, Homo sapien
ttctcttcagaggttactgatgagc

SEQ ID NO: 364574 - DNA, 25 bp, Homo sapien
ggttactgatgagccaagcctcaga

SEQ ID NO: 364575 - DNA, 25 bp, Homo sapien
gtccttgaaaggaggctccctgtgc

SEQ ID NO: 364576 - DNA, 25 bp, Homo sapien
ccagaggctgtctcctggtgaggct

SEQ ID NO: 364577 - DNA, 25 bp, Homo sapien
ctcctggtgaggctgcaatgcattt

SEQ ID NO: 364578 - DNA, 25 bp, Homo sapien
accaagcagacatcaccttgggcag

SEQ ID NO: 364579 - DNA, 25 bp, Homo sapien
ctgtgcctcctgtcaggtgatggga

SEQ ID NO: 364580 - DNA, 25 bp, Homo sapien
gggatggagacctacaaaactcaaa

SEQ ID NO: 364581 - DNA, 25 bp, Homo sapien
ggaagcttcaataataatgcctgca

SEQ ID NO: 364582 - DNA, 25 bp, Homo sapien
aatgcctgcaagatacctttcttag

SEQ ID NO: 364583 - DNA, 25 bp, Homo sapien
gcccagcttcttactgttatatttc

SEQ ID NO: 364584 - DNA, 25 bp, Homo sapien
ctttcttagcttttcctaaatggca

SEQ ID NO: 364585 - DNA, 25 bp, Homo sapien
atggcaagccactgtgtacacacac

SEQ ID NO: 364586 - DNA, 25 bp, Homo sapien
gtgtacacacacttttctaggaagg

SEQ ID NO: 364587 - DNA, 25 bp, Homo sapien
cacttttctaggaagggctccccag

SEQ ID NO: 364588 - DNA, 25 bp, Homo sapien
tactgttatatttccattctttttg

SEQ ID NO: 364589 - DNA, 25 bp, Homo sapien
cttttataatgcttagagttgccca

SEQ ID NO: 364590 - DNA, 25 bp, Homo sapien
ttctttttggcctaagttttccatg

SEQ ID NO: 364591 - DNA, 25 bp, Homo sapien
gttttccatgagtagcaagctttga

SEQ ID NO: 364592 - DNA, 25 bp, Homo sapien
attctatcctgccagtgctttagaa

SEQ ID NO: 364593 - DNA, 25 bp, Homo sapien
gcctgaaatatgctgttctatgtta

SEQ ID NO: 364594 - DNA, 25 bp, Homo sapien
gaaaagatcttgttgccaattcaga

SEQ ID NO: 364595 - DNA, 25 bp, Homo sapien
gccaattcagaaaccataaccttaa

SEQ ID NO: 364596 - DNA, 25 bp, Homo sapien
taaatagcatgcctgggtctcctct

SEQ ID NO: 364597 - DNA, 25 bp, Homo sapien
gccagtgctttagaataacttgcat

SEQ ID NO: 364598 - DNA, 25 bp, Homo sapien
tctcctctgtatctggtttaacatc

SEQ ID NO: 364599 - DNA, 25 bp, Homo sapien
atctggtttaacatctgcattgaat

SEQ ID NO: 364600 - DNA, 25 bp, Homo sapien
ctgcattgaatattggtattttcca

SEQ ID NO: 364601 - DNA, 25 bp, Homo sapien
ctatatggttgtgtttgggctttgt

SEQ ID NO: 364602 - DNA, 25 bp, Homo sapien
ggctttgtgtacagatgacttttgt

SEQ ID NO: 364603 - DNA, 25 bp, Homo sapien
tttctggagagcagcccctctctgg

SEQ ID NO: 364604 - DNA, 25 bp, Homo sapien
ttgtttcccttcaacttggaactct

SEQ ID NO: 364605 - DNA, 25 bp, Homo sapien
ttcaacttggaactcttcaaacatc

SEQ ID NO: 364606 - DNA, 25 bp, Homo sapien
gtggcaatcacagtctttaatcatt

SEQ ID NO: 364607 - DNA, 25 bp, Homo sapien
ttatcttgggtccatgtgagtgaca

SEQ ID NO: 364608 - DNA, 25 bp, Homo sapien
ggcctgggaaagatctccctccttt

SEQ ID NO: 364609 - DNA, 25 bp, Homo sapien
atctccctcctttacattttctctt

SEQ ID NO: 364610 - DNA, 25 bp, Homo sapien
atttctgatttgttagcaagtgcca

SEQ ID NO: 364611 - DNA, 25 bp, Homo sapien
gttagcaagtgccagcttgtaggct

SEQ ID NO: 364612 - DNA, 25 bp, Homo sapien
cagcttgtaggctggttgaagtaca

SEQ ID NO: 364613 - DNA, 25 bp, Homo sapien
ggctggttgaagtacagaactcaga

SEQ ID NO: 364614 - DNA, 25 bp, Homo sapien
ctttagccatcgtaaatcccttact

SEQ ID NO: 364615 - DNA, 25 bp, Homo sapien
ttagccatcgtaaatcccttactct

SEQ ID NO: 364616 - DNA, 25 bp, Homo sapien
aaagccttcagccaggttgcccatc

SEQ ID NO: 364617 - DNA, 25 bp, Homo sapien
aggttgcccatcttactctacataa

SEQ ID NO: 364618 - DNA, 25 bp, Homo sapien
ggttgcccatcttactctacataag

SEQ ID NO: 364619 - DNA, 25 bp, Homo sapien
aagccttcaggcagagtgtacatct

SEQ ID NO: 364620 - DNA, 25 bp, Homo sapien
gccttcaggcagagtgtacatcttg

SEQ ID NO: 364621 - DNA, 25 bp, Homo sapien
cttcaggcagagtgtacatcttgct

SEQ ID NO: 364622 - DNA, 25 bp, Homo sapien
attcataccggagagtcatcagtta

SEQ ID NO: 364623 - DNA, 25 bp, Homo sapien
cataccggagagtcatcagttattc

SEQ ID NO: 364624 - DNA, 25 bp, Homo sapien
accggagagtcatcagttattctct

SEQ ID NO: 364625 - DNA, 25 bp, Homo sapien
gctgggtggcgcccgtttccaggaa

SEQ ID NO: 364626 - DNA, 25 bp, Homo sapien
gccggcagcgagcttcccgggagca

SEQ ID NO: 364627 - DNA, 25 bp, Homo sapien
gcccaggcaagtccagcggagtttc

SEQ ID NO: 364628 - DNA, 25 bp, Homo sapien
caggcaagtccagcggagtttccag

SEQ ID NO: 364629 - DNA, 25 bp, Homo sapien
gcaagtccagcggagtttccaggcg

SEQ ID NO: 364630 - DNA, 25 bp, Homo sapien
aagtccagcggagtttccaggcgca

SEQ ID NO: 364631 - DNA, 25 bp, Homo sapien
agtccagcggagtttccaggcgcac

SEQ ID NO: 364632 - DNA, 25 bp, Homo sapien
agcggagtttccaggcgcaccattc

SEQ ID NO: 364633 - DNA, 25 bp, Homo sapien
agtttccaggcgcaccattcctgag

SEQ ID NO: 364634 - DNA, 25 bp, Homo sapien
aggcgcaccattcctgagctaggtg

SEQ ID NO: 364635 - DNA, 25 bp, Homo sapien
gcgcaccattcctgagctaggtggg

SEQ ID NO: 364636 - DNA, 25 bp, Homo sapien
ttgtggtagaaggatgtgtttatat

SEQ ID NO: 364637 - DNA, 25 bp, Homo sapien
gtagaaggatgtgtttatattctga

SEQ ID NO: 364638 - DNA, 25 bp, Homo sapien
ttatattctgaatttctgaattctt

SEQ ID NO: 364639 - DNA, 25 bp, Homo sapien
tcttggctattgcattcttgacaat

SEQ ID NO: 364640 - DNA, 25 bp, Homo sapien
ttggctattgcattcttgacaattt

SEQ ID NO: 364641 - DNA, 25 bp, Homo sapien
ggctattgcattcttgacaattttt

SEQ ID NO: 364642 - DNA, 25 bp, Homo sapien
ttcttaaaaccagagagtgaaaggc

SEQ ID NO: 364643 - DNA, 25 bp, Homo sapien
aaccagagagtgaaaggcatattat

SEQ ID NO: 364644 - DNA, 25 bp, Homo sapien
aaacaatcaaatatcttttagagta

SEQ ID NO: 364645 - DNA, 25 bp, Homo sapien
atatcttttagagtatggacaacta

SEQ ID NO: 364646 - DNA, 25 bp, Homo sapien
tagagtatggacaactattatatat

SEQ ID NO: 364647 - DNA, 25 bp, Homo sapien
ggtaccctgggtccttcttgctgaa

SEQ ID NO: 364648 - DNA, 25 bp, Homo sapien
gggtccttcttgctgaagggtccaa

SEQ ID NO: 364649 - DNA, 25 bp, Homo sapien
tgaagggtccaagctgtcctgaagg

SEQ ID NO: 364650 - DNA, 25 bp, Homo sapien
aggcagatgttgttactgggattct

SEQ ID NO: 364651 - DNA, 25 bp, Homo sapien
ctgggattcttggactggacttgac

SEQ ID NO: 364652 - DNA, 25 bp, Homo sapien
gactggacttgacacttccctaaac

SEQ ID NO: 364653 - DNA, 25 bp, Homo sapien
gacacttccctaaactctcatgaaa

SEQ ID NO: 364654 - DNA, 25 bp, Homo sapien
gaaatgctttaatttggcttaggga

SEQ ID NO: 364655 - DNA, 25 bp, Homo sapien
gttctgaatagccatggagtcacat

SEQ ID NO: 364656 - DNA, 25 bp, Homo sapien
aaatggtgtatctcatatttccaga

SEQ ID NO: 364657 - DNA, 25 bp, Homo sapien
aacatacacttccaacaataatcat

SEQ ID NO: 364658 - DNA, 25 bp, Homo sapien
tacctctgtaaaccctcaatcaaaa

SEQ ID NO: 364659 - DNA, 25 bp, Homo sapien
tttaaagtgatacctactggcccct

SEQ ID NO: 364660 - DNA, 25 bp, Homo sapien
agtgatacctactggcccctcaaaa

SEQ ID NO: 364661 - DNA, 25 bp, Homo sapien
gcccctcaaaacatccagcattaaa

SEQ ID NO: 364662 - DNA, 25 bp, Homo sapien
ggcactctgttaggtggcatacagc

SEQ ID NO: 364663 - DNA, 25 bp, Homo sapien
taaaaaactaagactggcagtgaaa

SEQ ID NO: 364664 - DNA, 25 bp, Homo sapien
ggaagaattttcatttagccagaac

SEQ ID NO: 364665 - DNA, 25 bp, Homo sapien
gttaggtggcatacagccctgatta

SEQ ID NO: 364666 - DNA, 25 bp, Homo sapien
acagccctgattaaaaacagcactg

SEQ ID NO: 364667 - DNA, 25 bp, Homo sapien
aacagcactgaacttagacatgttt

SEQ ID NO: 364668 - DNA, 25 bp, Homo sapien
cctagtaccttttttacagattgca

SEQ ID NO: 364669 - DNA, 25 bp, Homo sapien
gaaagtgtcacatagccaccaaaat

SEQ ID NO: 364670 - DNA, 25 bp, Homo sapien
ttctctactttcttgctttgctctg

SEQ ID NO: 364671 - DNA, 25 bp, Homo sapien
gctttgctctgattagctaagtctt

SEQ ID NO: 364672 - DNA, 25 bp, Homo sapien
gctaagtcttggtcacatggcttta

SEQ ID NO: 364673 - DNA, 25 bp, Homo sapien
catggctttatagcactgggaaaac

SEQ ID NO: 364674 - DNA, 25 bp, Homo sapien
ccaggatctggtcttttatagggta

SEQ ID NO: 364675 - DNA, 25 bp, Homo sapien
aagtgagccctatcttttgtgtaga

SEQ ID NO: 364676 - DNA, 25 bp, Homo sapien
gtgaatgtccattaaaaggcagtca

SEQ ID NO: 364677 - DNA, 25 bp, Homo sapien
aggcagtcagtgttggctactctaa

SEQ ID NO: 364678 - DNA, 25 bp, Homo sapien
gctactctaagccttcaaattgttg

SEQ ID NO: 364679 - DNA, 25 bp, Homo sapien
tcaaattgttgcttttccccttcaa

SEQ ID NO: 364680 - DNA, 25 bp, Homo sapien
acagcaggtgtgtccttgttagttc

SEQ ID NO: 364681 - DNA, 25 bp, Homo sapien
aggtgtgtccttgttagttccatcc

SEQ ID NO: 364682 - DNA, 25 bp, Homo sapien
gtgtccttgttagttccatccagct

SEQ ID NO: 364683 - DNA, 25 bp, Homo sapien
gttagttccatccagctcagctttg

SEQ ID NO: 364684 - DNA, 25 bp, Homo sapien
tggctggggagctaatttcactgga

SEQ ID NO: 364685 - DNA, 25 bp, Homo sapien
ttcactggagccaggctaagcatta

SEQ ID NO: 364686 - DNA, 25 bp, Homo sapien
ggagccaggctaagcattagggtaa

SEQ ID NO: 364687 - DNA, 25 bp, Homo sapien
ttagggtaagtatttgtcctgtctt

SEQ ID NO: 364688 - DNA, 25 bp, Homo sapien
gtcttgggcagtttcctcactgaaa

SEQ ID NO: 364689 - DNA, 25 bp, Homo sapien
cttgggcagtttcctcactgaaaaa

SEQ ID NO: 364690 - DNA, 25 bp, Homo sapien
agccctcctctaattctaaaattct

SEQ ID NO: 364691 - DNA, 25 bp, Homo sapien
aaagaaagaaaaactgcttgcaggg

SEQ ID NO: 364692 - DNA, 25 bp, Homo sapien
ttgtggtagaaggatgtgtttatat

SEQ ID NO: 364693 - DNA, 25 bp, Homo sapien
ttatattctgaatttctgaattctt

SEQ ID NO: 364694 - DNA, 25 bp, Homo sapien
tcttggctattgcattcttgacaat

SEQ ID NO: 364695 - DNA, 25 bp, Homo sapien
ttggctattgcattcttgacaattt

SEQ ID NO: 364696 - DNA, 25 bp, Homo sapien
ggctattgcattcttgacaattttt

SEQ ID NO: 364697 - DNA, 25 bp, Homo sapien
ttcttaaaaccagagagtgaaaggc

SEQ ID NO: 364698 - DNA, 25 bp, Homo sapien
aaccagagagtgaaaggcatattat

SEQ ID NO: 364699 - DNA, 25 bp, Homo sapien
aaacaatcaaatatcttttagagta

SEQ ID NO: 364700 - DNA, 25 bp, Homo sapien
atatcttttagagtatggacaacta

SEQ ID NO: 364701 - DNA, 25 bp, Homo sapien
tagagtatggacaactattatatat

SEQ ID NO: 364702 - DNA, 25 bp, Homo sapien
tcttgccttttatgcaaggctactt

SEQ ID NO: 364703 - DNA, 25 bp, Homo sapien
tatgcaaggctacttccatttctca

SEQ ID NO: 364704 - DNA, 25 bp, Homo sapien
acttccatttctcatctttgttctg

SEQ ID NO: 364705 - DNA, 25 bp, Homo sapien
tctcatctttgttctgctacaggtt

SEQ ID NO: 364706 - DNA, 25 bp, Homo sapien
atctggactctagaataaagtgtgc

SEQ ID NO: 364707 - DNA, 25 bp, Homo sapien
agacttatatttcggcttggcacac

SEQ ID NO: 364708 - DNA, 25 bp, Homo sapien
atatttcggcttggcacacttttct

SEQ ID NO: 364709 - DNA, 25 bp, Homo sapien
ttggcacacttttcttgccagccag

SEQ ID NO: 364710 - DNA, 25 bp, Homo sapien
gcataggctcttaatttgcctgact

SEQ ID NO: 364711 - DNA, 25 bp, Homo sapien
aatttgcctgactggttttgtagcc

SEQ ID NO: 364712 - DNA, 25 bp, Homo sapien
gcctgactggttttgtagccaataa

SEQ ID NO: 364713 - DNA, 25 bp, Homo sapien
tgtcagcaaaacagcccttaggctt

SEQ ID NO: 364714 - DNA, 25 bp, Homo sapien
ttaggcttggactccctgctagccg

SEQ ID NO: 364715 - DNA, 25 bp, Homo sapien
tgctagccgggttttacggtgctga

SEQ ID NO: 364716 - DNA, 25 bp, Homo sapien
cgggttttacggtgctgaagtcagc

SEQ ID NO: 364717 - DNA, 25 bp, Homo sapien
gaagtcagcatcttgattcagctgc

SEQ ID NO: 364718 - DNA, 25 bp, Homo sapien
ttcagctgcataaataatctcctgc

SEQ ID NO: 364719 - DNA, 25 bp, Homo sapien
gggaccagggcactctgtaagggct

SEQ ID NO: 364720 - DNA, 25 bp, Homo sapien
gaaccccagggaataagacagacca

SEQ ID NO: 364721 - DNA, 25 bp, Homo sapien
aaattctgtattgactctctcatgc

SEQ ID NO: 364722 - DNA, 25 bp, Homo sapien
tctctcatgcatgtaactgatcctt

SEQ ID NO: 364723 - DNA, 25 bp, Homo sapien
gcatgtaactgatccttagatattg

SEQ ID NO: 364724 - DNA, 25 bp, Homo sapien
tgccgtggcccagagggcagatctc

SEQ ID NO: 364725 - DNA, 25 bp, Homo sapien
gccgtggcccagagggcagatctct

SEQ ID NO: 364726 - DNA, 25 bp, Homo sapien
ccgtggcccagagggcagatctctt

SEQ ID NO: 364727 - DNA, 25 bp, Homo sapien
cgtggcccagagggcagatctcttg

SEQ ID NO: 364728 - DNA, 25 bp, Homo sapien
gtggcccagagggcagatctcttga

SEQ ID NO: 364729 - DNA, 25 bp, Homo sapien
ggcccagagggcagatctcttgagt

SEQ ID NO: 364730 - DNA, 25 bp, Homo sapien
gcccagagggcagatctcttgagtc

SEQ ID NO: 364731 - DNA, 25 bp, Homo sapien
cccagagggcagatctcttgagtcc

SEQ ID NO: 364732 - DNA, 25 bp, Homo sapien
ccagagggcagatctcttgagtcca

SEQ ID NO: 364733 - DNA, 25 bp, Homo sapien
gggaagatcatctgagctggggagg

SEQ ID NO: 364734 - DNA, 25 bp, Homo sapien
atcatctgagctggggaggtcgagg

SEQ ID NO: 364735 - DNA, 25 bp, Homo sapien
gtactgttgttaattagtgcattga

SEQ ID NO: 364736 - DNA, 25 bp, Homo sapien
agtgcattgaaacaggattggcctt

SEQ ID NO: 364737 - DNA, 25 bp, Homo sapien
ttgaaacaggattggccttacaggg

SEQ ID NO: 364738 - DNA, 25 bp, Homo sapien
gatggagtcagcctctatcaaggaa

SEQ ID NO: 364739 - DNA, 25 bp, Homo sapien
atctcaaagttcagcttcgcctact

SEQ ID NO: 364740 - DNA, 25 bp, Homo sapien
aaagttcagcttcgcctacttcagt

SEQ ID NO: 364741 - DNA, 25 bp, Homo sapien
ctacttcagttttctctctgtgact

SEQ ID NO: 364742 - DNA, 25 bp, Homo sapien
ggaagtcagaattcatacacagtga

SEQ ID NO: 364743 - DNA, 25 bp, Homo sapien
tgaaacacagacatcagcctcacct

SEQ ID NO: 364744 - DNA, 25 bp, Homo sapien
cctcacctttcactatttcatacat

SEQ ID NO: 364745 - DNA, 25 bp, Homo sapien
tacatgtaaccatagggaagaccta

SEQ ID NO: 364746 - DNA, 25 bp, Homo sapien
gtggtggctggctctcttcagcatg

SEQ ID NO: 364747 - DNA, 25 bp, Homo sapien
tggctggctctcttcagcatgtaat

SEQ ID NO: 364748 - DNA, 25 bp, Homo sapien
tggctctcttcagcatgtaattggg

SEQ ID NO: 364749 - DNA, 25 bp, Homo sapien
ttggggaaaccctcgcgtctactag

SEQ ID NO: 364750 - DNA, 25 bp, Homo sapien
actagacttctatgtgagaagtgct

SEQ ID NO: 364751 - DNA, 25 bp, Homo sapien
agtgctggaaaatgatttaggacat

SEQ ID NO: 364752 - DNA, 25 bp, Homo sapien
agtgttcttttgaagtaaggccagc

SEQ ID NO: 364753 - DNA, 25 bp, Homo sapien
agtaaggccagctgttgaacggtta

SEQ ID NO: 364754 - DNA, 25 bp, Homo sapien
aggccagctgttgaacggttaaact

SEQ ID NO: 364755 - DNA, 25 bp, Homo sapien
gctgttgaacggttaaactgtgcat

SEQ ID NO: 364756 - DNA, 25 bp, Homo sapien
ttgaacggttaaactgtgcatttct

SEQ ID NO: 364757 - DNA, 25 bp, Homo sapien
ctgaattcatatcacttttgcacca

SEQ ID NO: 364758 - DNA, 25 bp, Homo sapien
tgaaccatcataaattagggaccat

SEQ ID NO: 364759 - DNA, 25 bp, Homo sapien
accatctgtacattacccatgtcaa

SEQ ID NO: 364760 - DNA, 25 bp, Homo sapien
ctgtacattacccatgtcaatgaca

SEQ ID NO: 364761 - DNA, 25 bp, Homo sapien
tattcacaaatctctccatcttgac

SEQ ID NO: 364762 - DNA, 25 bp, Homo sapien
cacaaatctctccatcttgacatta

SEQ ID NO: 364763 - DNA, 25 bp, Homo sapien
atctctccatcttgacattagtcac

SEQ ID NO: 364764 - DNA, 25 bp, Homo sapien
ctctccatcttgacattagtcacca

SEQ ID NO: 364765 - DNA, 25 bp, Homo sapien
gacattagtcaccattgaatctcaa

SEQ ID NO: 364766 - DNA, 25 bp, Homo sapien
agtcaccattgaatctcaagtgcag

SEQ ID NO: 364767 - DNA, 25 bp, Homo sapien
accattgaatctcaagtgcagcgta

SEQ ID NO: 364768 - DNA, 25 bp, Homo sapien
gttccgccctcagtggtctgccggg

SEQ ID NO: 364769 - DNA, 25 bp, Homo sapien
ccctcagtggtctgccgggcgcccc

SEQ ID NO: 364770 - DNA, 25 bp, Homo sapien
gcctctgatcgcctcaagagagcgg

SEQ ID NO: 364771 - DNA, 25 bp, Homo sapien
cctctgatcgcctcaagagagcggg

SEQ ID NO: 364772 - DNA, 25 bp, Homo sapien
agtttcctccgccgctgtcgggcgt

SEQ ID NO: 364773 - DNA, 25 bp, Homo sapien
gcgggcggctgagggcgagggaggc

SEQ ID NO: 364774 - DNA, 25 bp, Homo sapien
gggaggccctcccttctggcgaggg

SEQ ID NO: 364775 - DNA, 25 bp, Homo sapien
cccaacccgccctgcggagctcggg

SEQ ID NO: 364776 - DNA, 25 bp, Homo sapien
cgctgtcgggcgtgcggcgctgagg

SEQ ID NO: 364777 - DNA, 25 bp, Homo sapien
gtgcggcgctgagggacccgggcga

SEQ ID NO: 364778 - DNA, 25 bp, Homo sapien
gggacccgggcgagcgcgccgcgca

SEQ ID NO: 364779 - DNA, 25 bp, Homo sapien
tttatttctatggaactctaaccta

SEQ ID NO: 364780 - DNA, 25 bp, Homo sapien
gtgaataaccaagccacagttcctc

SEQ ID NO: 364781 - DNA, 25 bp, Homo sapien
cacagttcctcctcaaatggagagt

SEQ ID NO: 364782 - DNA, 25 bp, Homo sapien
tcaaatggagagtgatgatcgacat

SEQ ID NO: 364783 - DNA, 25 bp, Homo sapien
atcgacatttgaatctctttgccct

SEQ ID NO: 364784 - DNA, 25 bp, Homo sapien
cgacatttgaatctctttgcccttt

SEQ ID NO: 364785 - DNA, 25 bp, Homo sapien
atcaggttctaaaataagctcgtaa

SEQ ID NO: 364786 - DNA, 25 bp, Homo sapien
ggaactctaacctattcgtgtcata

SEQ ID NO: 364787 - DNA, 25 bp, Homo sapien
ctaacctattcgtgtcatattgacc

SEQ ID NO: 364788 - DNA, 25 bp, Homo sapien
catattgaccttttgctgcatgagt

SEQ ID NO: 364789 - DNA, 25 bp, Homo sapien
tgaccttttgctgcatgagtcataa

SEQ ID NO: 364790 - DNA, 25 bp, Homo sapien
gactcaatattttcttgttagacaa

SEQ ID NO: 364791 - DNA, 25 bp, Homo sapien
gttagacaagtactattagcaccta

SEQ ID NO: 364792 - DNA, 25 bp, Homo sapien
attagcacctacagcacatttgaag

SEQ ID NO: 364793 - DNA, 25 bp, Homo sapien
cagcacatttgaaggtctaatggca

SEQ ID NO: 364794 - DNA, 25 bp, Homo sapien
ttcagcattattttgacctgtacat

SEQ ID NO: 364795 - DNA, 25 bp, Homo sapien
gacctgtacattacacttttccctt

SEQ ID NO: 364796 - DNA, 25 bp, Homo sapien
tcccttccctcatcttagtgaagta

SEQ ID NO: 364797 - DNA, 25 bp, Homo sapien
gtagagagattactgatctatttct

SEQ ID NO: 364798 - DNA, 25 bp, Homo sapien
tttatcttaatcattcctccctaac

SEQ ID NO: 364799 - DNA, 25 bp, Homo sapien
catagttttgttactgtactcatag

SEQ ID NO: 364800 - DNA, 25 bp, Homo sapien
gtactcatagatatttactaccctt

SEQ ID NO: 364801 - DNA, 25 bp, Homo sapien
ctagtgggttgacctttaaatgcaa

SEQ ID NO: 364802 - DNA, 25 bp, Homo sapien
gtaaaggtacgattatacttgagat

SEQ ID NO: 364803 - DNA, 25 bp, Homo sapien
tacttgagattttcctccattttta

SEQ ID NO: 364804 - DNA, 25 bp, Homo sapien
catttttatttcttcgtgaacatag

SEQ ID NO: 364805 - DNA, 25 bp, Homo sapien
tttcttcgtgaacatagagtttggg

SEQ ID NO: 364806 - DNA, 25 bp, Homo sapien
taaagttggttcacttcaaagctaa

SEQ ID NO: 364807 - DNA, 25 bp, Homo sapien
aaattgttaaacttgcagcttggta

SEQ ID NO: 364808 - DNA, 25 bp, Homo sapien
gcagcttggtattgcagagaagatt

SEQ ID NO: 364809 - DNA, 25 bp, Homo sapien
gaattttgctttagagaatgccact

SEQ ID NO: 364810 - DNA, 25 bp, Homo sapien
atgccactttggctgaactacaagt

SEQ ID NO: 364811 - DNA, 25 bp, Homo sapien
tggctgaactacaagtgtaggccac

SEQ ID NO: 364812 - DNA, 25 bp, Homo sapien
ggagtctttgagtatgtacagtttt

SEQ ID NO: 364813 - DNA, 25 bp, Homo sapien
gtctttgagtatgtacagttttgaa

SEQ ID NO: 364814 - DNA, 25 bp, Homo sapien
aattgatttcatattctgtggcttt

SEQ ID NO: 364815 - DNA, 25 bp, Homo sapien
tttcaacctccatttacctcttgtc

SEQ ID NO: 364816 - DNA, 25 bp, Homo sapien
aacctccatttacctcttgtcattc

SEQ ID NO: 364817 - DNA, 25 bp, Homo sapien
catttacctcttgtcattccaacat

SEQ ID NO: 364818 - DNA, 25 bp, Homo sapien
gattatcatctggattttcactcaa

SEQ ID NO: 364819 - DNA, 25 bp, Homo sapien
tcaagatgcagctcctaagattatt

SEQ ID NO: 364820 - DNA, 25 bp, Homo sapien
gatgcagctcctaagattattgtta

SEQ ID NO: 364821 - DNA, 25 bp, Homo sapien
gcagctcctaagattattgttatgt

SEQ ID NO: 364822 - DNA, 25 bp, Homo sapien
gctcctaagattattgttatgttaa

SEQ ID NO: 364823 - DNA, 25 bp, Homo sapien
ccaaccaaagtatctctttcaaaag

SEQ ID NO: 364824 - DNA, 25 bp, Homo sapien
tttcaaaaggaaacgacagtctcct

SEQ ID NO: 364825 - DNA, 25 bp, Homo sapien
ccgagacaaatttcagcaaagccgt

SEQ ID NO: 364826 - DNA, 25 bp, Homo sapien
aatttcagcaaagccgtgggacaca

SEQ ID NO: 364827 - DNA, 25 bp, Homo sapien
aatcgagactcagggagcgttaagt

SEQ ID NO: 364828 - DNA, 25 bp, Homo sapien
ccgtgggacacatggccttcgagct

SEQ ID NO: 364829 - DNA, 25 bp, Homo sapien
ttcgagctgctgtccattattgagt

SEQ ID NO: 364830 - DNA, 25 bp, Homo sapien
gtccattattgagtagcagaagcca

SEQ ID NO: 364831 - DNA, 25 bp, Homo sapien
tcaaaggacggaccgaaggtaagat

SEQ ID NO: 364832 - DNA, 25 bp, Homo sapien
ggagcgttaagtattttgcccaact

SEQ ID NO: 364833 - DNA, 25 bp, Homo sapien
ttttgcccaactgcatacgataaat

SEQ ID NO: 364834 - DNA, 25 bp, Homo sapien
aagcctgagctgtcacttcctcagt

SEQ ID NO: 364835 - DNA, 25 bp, Homo sapien
aaagggtctcattacatttcattac

SEQ ID NO: 364836 - DNA, 25 bp, Homo sapien
ttgctgaaacattaggaaccctgga

SEQ ID NO: 364837 - DNA, 25 bp, Homo sapien
gaaccctggagcactgagccaagat

SEQ ID NO: 364838 - DNA, 25 bp, Homo sapien
atcaccctctcctgcatgtttttgt

SEQ ID NO: 364839 - DNA, 25 bp, Homo sapien
tgtttttgtttctgtctcctgcttt

SEQ ID NO: 364840 - DNA, 25 bp, Homo sapien
ttttccactttctctatgtgtgagt

SEQ ID NO: 364841 - DNA, 25 bp, Homo sapien
atgtgtgagttgacttggctgcctg

SEQ ID NO: 364842 - DNA, 25 bp, Homo sapien
gctgcctgtagcttcatcgtcaaag

SEQ ID NO: 364843 - DNA, 25 bp, Homo sapien
acgtgggttcaacttggtgctctca

SEQ ID NO: 364844 - DNA, 25 bp, Homo sapien
actctcctccagcattgtttttgtc

SEQ ID NO: 364845 - DNA, 25 bp, Homo sapien
tgacatcacctcctaacaaggcaac

SEQ ID NO: 364846 - DNA, 25 bp, Homo sapien
acaaggcaacccaattctcttttca

SEQ ID NO: 364847 - DNA, 25 bp, Homo sapien
aacccaattctcttttcacttcact

SEQ ID NO: 364848 - DNA, 25 bp, Homo sapien
gcaaccagacgtgctcttttaaaaa

SEQ ID NO: 364849 - DNA, 25 bp, Homo sapien
aaatccaatcatttgaccttgcttt

SEQ ID NO: 364850 - DNA, 25 bp, Homo sapien
tcatttgaccttgctttaaagcttc

SEQ ID NO: 364851 - DNA, 25 bp, Homo sapien
taaagcttcaaagatttcctcttgt

SEQ ID NO: 364852 - DNA, 25 bp, Homo sapien
gatttcctcttgtacttggaccaag

SEQ ID NO: 364853 - DNA, 25 bp, Homo sapien
ggaccaagttcaaaatccttaccag

SEQ ID NO: 364854 - DNA, 25 bp, Homo sapien
atccttaccaggagctaatgtccag

SEQ ID NO: 364855 - DNA, 25 bp, Homo sapien
gagctaatgtccagcaagatcagat

SEQ ID NO: 364856 - DNA, 25 bp, Homo sapien
ttcttgctgtgtcataatatggcag

SEQ ID NO: 364857 - DNA, 25 bp, Homo sapien
atcacatggtgagagggcaagcaag

SEQ ID NO: 364858 - DNA, 25 bp, Homo sapien
aaacccactcccatgatagtgacat

SEQ ID NO: 364859 - DNA, 25 bp, Homo sapien
gatagtgacattaatccatgtatga

SEQ ID NO: 364860 - DNA, 25 bp, Homo sapien
atccatgtatgagggcaaagctttt

SEQ ID NO: 364861 - DNA, 25 bp, Homo sapien
gagggcaaagcttttattaattaat

SEQ ID NO: 364862 - DNA, 25 bp, Homo sapien
atctgttcatgaaggcagagggact

SEQ ID NO: 364863 - DNA, 25 bp, Homo sapien
ggcagagggactaagtttccaacat

SEQ ID NO: 364864 - DNA, 25 bp, Homo sapien
ctatagcaacccctatgttttcttc

SEQ ID NO: 364865 - DNA, 25 bp, Homo sapien
atagtcttatagttgtagcattaca

SEQ ID NO: 364866 - DNA, 25 bp, Homo sapien
gcattacataggtctgtgatctgtt

SEQ ID NO: 364867 - DNA, 25 bp, Homo sapien
tcataaaccattggaaggtgaacaa

SEQ ID NO: 364868 - DNA, 25 bp, Homo sapien
cataaaccattggaaggtgaacaat

SEQ ID NO: 364869 - DNA, 25 bp, Homo sapien
taaaccattggaaggtgaacaatta

SEQ ID NO: 364870 - DNA, 25 bp, Homo sapien
cattggaaggtgaacaattaaaaca

SEQ ID NO: 364871 - DNA, 25 bp, Homo sapien
tgggggcagtgggttattagaaata

SEQ ID NO: 364872 - DNA, 25 bp, Homo sapien
tagaaataacataaatggctggtat

SEQ ID NO: 364873 - DNA, 25 bp, Homo sapien
acataaatggctggtatggtttgtc

SEQ ID NO: 364874 - DNA, 25 bp, Homo sapien
cataaatggctggtatggtttgtct

SEQ ID NO: 364875 - DNA, 25 bp, Homo sapien
ataaatggctggtatggtttgtctg

SEQ ID NO: 364876 - DNA, 25 bp, Homo sapien
taaatggctggtatggtttgtctgt

SEQ ID NO: 364877 - DNA, 25 bp, Homo sapien
aaatggctggtatggtttgtctgtg

SEQ ID NO: 364878 - DNA, 25 bp, Homo sapien
ccaccctgagattcgggactgcttg

SEQ ID NO: 364879 - DNA, 25 bp, Homo sapien
cctgagattcgggactgcttgattt

SEQ ID NO: 364880 - DNA, 25 bp, Homo sapien
gattcgggactgcttgatttgccca

SEQ ID NO: 364881 - DNA, 25 bp, Homo sapien
gggactgcttgatttgcccaaatcc

SEQ ID NO: 364882 - DNA, 25 bp, Homo sapien
gatttgcccaaatccaggtgagaag

SEQ ID NO: 364883 - DNA, 25 bp, Homo sapien
tgcccaaatccaggtgagaagcttt

SEQ ID NO: 364884 - DNA, 25 bp, Homo sapien
gaagctttgatttcaggcacagtcc

SEQ ID NO: 364885 - DNA, 25 bp, Homo sapien
agctttgatttcaggcacagtccag

SEQ ID NO: 364886 - DNA, 25 bp, Homo sapien
tgatttcaggcacagtccagccttc

SEQ ID NO: 364887 - DNA, 25 bp, Homo sapien
cttctgtcaccagccaggaaggaca

SEQ ID NO: 364888 - DNA, 25 bp, Homo sapien
ctgtcaccagccaggaaggacatga

SEQ ID NO: 364889 - DNA, 25 bp, Homo sapien
cagccatttattacaagaagcaaca

SEQ ID NO: 364890 - DNA, 25 bp, Homo sapien
gcaacaggttattgacattacatgt

SEQ ID NO: 364891 - DNA, 25 bp, Homo sapien
gccaagatttggagcctttgtaata

SEQ ID NO: 364892 - DNA, 25 bp, Homo sapien
gcctttgtaataaggacttcctgca

SEQ ID NO: 364893 - DNA, 25 bp, Homo sapien
atttagagtcacatgtccagtagca

SEQ ID NO: 364894 - DNA, 25 bp, Homo sapien
gcatttctaattttgagcattcacc

SEQ ID NO: 364895 - DNA, 25 bp, Homo sapien
gagcattcaccttgctacctttaaa

SEQ ID NO: 364896 - DNA, 25 bp, Homo sapien
acatctgagttttaagtggcctttt

SEQ ID NO: 364897 - DNA, 25 bp, Homo sapien
taagtggcctttttatcatcataca

SEQ ID NO: 364898 - DNA, 25 bp, Homo sapien
tcatcatacacatgtgcatacaaag

SEQ ID NO: 364899 - DNA, 25 bp, Homo sapien
gggacttggcagtttaaaagccaca

SEQ ID NO: 364900 - DNA, 25 bp, Homo sapien
ttctgttttatatacctcttcgtac

SEQ ID NO: 364901 - DNA, 25 bp, Homo sapien
atacctcttcgtacattaagtgcaa

SEQ ID NO: 364902 - DNA, 25 bp, Homo sapien
gtacattaagtgcaaactacatttc

SEQ ID NO: 364903 - DNA, 25 bp, Homo sapien
tcttcatcttaaaggttgggtttct

SEQ ID NO: 364904 - DNA, 25 bp, Homo sapien
tgggtttctttcactctagagttag

SEQ ID NO: 364905 - DNA, 25 bp, Homo sapien
ctagagttagtgatttgttttaaca

SEQ ID NO: 364906 - DNA, 25 bp, Homo sapien
aatggattgcttatatatgatttat

SEQ ID NO: 364907 - DNA, 25 bp, Homo sapien
tctttctaacttttttatgtgggcg

SEQ ID NO: 364908 - DNA, 25 bp, Homo sapien
gtgggcgtttaaatttagtgctata

SEQ ID NO: 364909 - DNA, 25 bp, Homo sapien
cccagagattctgatatgttggatc

SEQ ID NO: 364910 - DNA, 25 bp, Homo sapien
tgatatgttggatctttgttcttat

SEQ ID NO: 364911 - DNA, 25 bp, Homo sapien
agacaagcactacaggactaacaaa

SEQ ID NO: 364912 - DNA, 25 bp, Homo sapien
ctacaggactaacaaaggagacatt

SEQ ID NO: 364913 - DNA, 25 bp, Homo sapien
taaacagctaaaagatgcggcagaa

SEQ ID NO: 364914 - DNA, 25 bp, Homo sapien
gatacagaggccaagataagaagaa

SEQ ID NO: 364915 - DNA, 25 bp, Homo sapien
gatttgaatctaagtagacaagcaa

SEQ ID NO: 364916 - DNA, 25 bp, Homo sapien
aagcaaaagctgatcaactgagaat

SEQ ID NO: 364917 - DNA, 25 bp, Homo sapien
ggaagatcaagttgttgccattaaa

SEQ ID NO: 364918 - DNA, 25 bp, Homo sapien
aatatgctaggtgctatagctaggc

SEQ ID NO: 364919 - DNA, 25 bp, Homo sapien
taggtgctatagctaggcagagtta

SEQ ID NO: 364920 - DNA, 25 bp, Homo sapien
gctatagctaggcagagttaaagag

SEQ ID NO: 364921 - DNA, 25 bp, Homo sapien
agttaaagagcaaaagcttgtgcct

SEQ ID NO: 364922 - DNA, 25 bp, Homo sapien
agcccctggcccagggtcaaaggag

SEQ ID NO: 364923 - DNA, 25 bp, Homo sapien
gcccctggcccagggtcaaaggaga

SEQ ID NO: 364924 - DNA, 25 bp, Homo sapien
ggtcaaaggagagatggcagcccct

SEQ ID NO: 364925 - DNA, 25 bp, Homo sapien
gtcaaaggagagatggcagcccctc

SEQ ID NO: 364926 - DNA, 25 bp, Homo sapien
tcaaaggagagatggcagcccctcc

SEQ ID NO: 364927 - DNA, 25 bp, Homo sapien
gcatgcatgcacctcagctggcagg

SEQ ID NO: 364928 - DNA, 25 bp, Homo sapien
agagccggggcttacccaagctcag

SEQ ID NO: 364929 - DNA, 25 bp, Homo sapien
agccggggcttacccaagctcagct

SEQ ID NO: 364930 - DNA, 25 bp, Homo sapien
tcagctgaggccacccgagccccag

SEQ ID NO: 364931 - DNA, 25 bp, Homo sapien
agtctctgccccttagcagggcctg

SEQ ID NO: 364932 - DNA, 25 bp, Homo sapien
gtctctgccccttagcagggcctgg

SEQ ID NO: 364933 - DNA, 25 bp, Homo sapien
ggaccagagaacagctccagggaaa

SEQ ID NO: 364934 - DNA, 25 bp, Homo sapien
aggaggagaatatcggcacccggat

SEQ ID NO: 364935 - DNA, 25 bp, Homo sapien
acccggatccggctagacaagctgg

SEQ ID NO: 364936 - DNA, 25 bp, Homo sapien
ctagacaagctggatggcaggaaac

SEQ ID NO: 364937 - DNA, 25 bp, Homo sapien
taggtacttcccaggccaggtagga

SEQ ID NO: 364938 - DNA, 25 bp, Homo sapien
gtcgaggtaggctgtgtttacaccc

SEQ ID NO: 364939 - DNA, 25 bp, Homo sapien
agttcattctctgactatgcttcac

SEQ ID NO: 364940 - DNA, 25 bp, Homo sapien
cattctctgactatgcttcacgcat

SEQ ID NO: 364941 - DNA, 25 bp, Homo sapien
gcttcacgcatattagcaaggaatg

SEQ ID NO: 364942 - DNA, 25 bp, Homo sapien
gacatctaacaagtcacaacttagt

SEQ ID NO: 364943 - DNA, 25 bp, Homo sapien
ttagtgatgaaaacttgctggacca

SEQ ID NO: 364944 - DNA, 25 bp, Homo sapien
tttgttggcataatataggcaggag

SEQ ID NO: 364945 - DNA, 25 bp, Homo sapien
ggaaactgtcatgattctatcgaat

SEQ ID NO: 364946 - DNA, 25 bp, Homo sapien
atgcttttggctattagtcattcac

SEQ ID NO: 364947 - DNA, 25 bp, Homo sapien
tttggctattagtcattcactcagt

SEQ ID NO: 364948 - DNA, 25 bp, Homo sapien
cagtagtgccatacattggctatta

SEQ ID NO: 364949 - DNA, 25 bp, Homo sapien
attggctattagtcattcactcagt

SEQ ID NO: 364950 - DNA, 25 bp, Homo sapien
agtagtgccatacacttagctcctg

SEQ ID NO: 364951 - DNA, 25 bp, Homo sapien
tacacttagctcctgattagctgag

SEQ ID NO: 364952 - DNA, 25 bp, Homo sapien
tgattagctgaggatactgctccct

SEQ ID NO: 364953 - DNA, 25 bp, Homo sapien
gatactgctccctcctattgtggga

SEQ ID NO: 364954 - DNA, 25 bp, Homo sapien
tgctccctcctattgtgggacagtg

SEQ ID NO: 364955 - DNA, 25 bp, Homo sapien
gggtacatgtttaacatttcatttc

SEQ ID NO: 364956 - DNA, 25 bp, Homo sapien
aatcaccccaaatttgcactaaata

SEQ ID NO: 364957 - DNA, 25 bp, Homo sapien
aaatttgcactaaataccaatgaag

SEQ ID NO: 364958 - DNA, 25 bp, Homo sapien
accaatgaagtgttattttgcttta

SEQ ID NO: 364959 - DNA, 25 bp, Homo sapien
tattttgctttagtagtcttctgag

SEQ ID NO: 364960 - DNA, 25 bp, Homo sapien
gctttagtagtcttctgagcaacaa

SEQ ID NO: 364961 - DNA, 25 bp, Homo sapien
agtcttctgagcaacaaactatggg

SEQ ID NO: 364962 - DNA, 25 bp, Homo sapien
gttatagatgattaacctctgttca

SEQ ID NO: 364963 - DNA, 25 bp, Homo sapien
gatgattaacctctgttcatagact

SEQ ID NO: 364964 - DNA, 25 bp, Homo sapien
gattaacctctgttcatagacttat

SEQ ID NO: 364965 - DNA, 25 bp, Homo sapien
aacctctgttcatagacttatatat

SEQ ID NO: 364966 - DNA, 25 bp, Homo sapien
aaacccctactgtgatggcattgag

SEQ ID NO: 364967 - DNA, 25 bp, Homo sapien
tcatggaggcttattacaggagtct

SEQ ID NO: 364968 - DNA, 25 bp, Homo sapien
atctgtacaactatatgggcccacc

SEQ ID NO: 364969 - DNA, 25 bp, Homo sapien
ccaccaactttgctcctgtaattaa

SEQ ID NO: 364970 - DNA, 25 bp, Homo sapien
gtagcaagatatgcttcttctgtaa

SEQ ID NO: 364971 - DNA, 25 bp, Homo sapien
tcttctgtaaaggatggctcccagt

SEQ ID NO: 364972 - DNA, 25 bp, Homo sapien
tcccagtattttgtgcttctgattg

SEQ ID NO: 364973 - DNA, 25 bp, Homo sapien
gttatctcagatatggcccagacta

SEQ ID NO: 364974 - DNA, 25 bp, Homo sapien
tggcccagactaaggagtccatagt

SEQ ID NO: 364975 - DNA, 25 bp, Homo sapien
gagtccatagttaatgcctcaaaac

SEQ ID NO: 364976 - DNA, 25 bp, Homo sapien
cagaatgggaatcctcaaaacccct

SEQ ID NO: 364977 - DNA, 25 bp, Homo sapien
acgcttgtcagctgaaaaaactaag

SEQ ID NO: 364978 - DNA, 25 bp, Homo sapien
aactaaggcagagcacaaatcaaga

SEQ ID NO: 364979 - DNA, 25 bp, Homo sapien
atcaagaaggtcaagtgattctaaa

SEQ ID NO: 364980 - DNA, 25 bp, Homo sapien
agaaagattctctgggttccaagca

SEQ ID NO: 364981 - DNA, 25 bp, Homo sapien
aagattctctgggttccaagcaaca

SEQ ID NO: 364982 - DNA, 25 bp, Homo sapien
gataagtgtgatatggactccacta

SEQ ID NO: 364983 - DNA, 25 bp, Homo sapien
tatggactccactaacatggatagt

SEQ ID NO: 364984 - DNA, 25 bp, Homo sapien
ggttgttcacaaggagaaacgacga

SEQ ID NO: 364985 - DNA, 25 bp, Homo sapien
gagaaacgacgaacaaagagcttgt

SEQ ID NO: 364986 - DNA, 25 bp, Homo sapien
gagaaacttgtgttgaagtctaaat

SEQ ID NO: 364987 - DNA, 25 bp, Homo sapien
gaagtctaaatcaaaaactcaaggc

SEQ ID NO: 364988 - DNA, 25 bp, Homo sapien
gctgtgttacagcagactttctttg

SEQ ID NO: 364989 - DNA, 25 bp, Homo sapien
gcagactttctttgcagttattgga

SEQ ID NO: 364990 - DNA, 25 bp, Homo sapien
gcagttattggagccctgttacaga

SEQ ID NO: 364991 - DNA, 25 bp, Homo sapien
ccctgttacagagcagtggacctga

SEQ ID NO: 364992 - DNA, 25 bp, Homo sapien
ggacctgagaggactgcacttttca

SEQ ID NO: 364993 - DNA, 25 bp, Homo sapien
gcacttttcatcagggacttcttaa

SEQ ID NO: 364994 - DNA, 25 bp, Homo sapien
gacttcttaattactcaaatgactg

SEQ ID NO: 364995 - DNA, 25 bp, Homo sapien
tcaaatgactggaaaagagctcttt

SEQ ID NO: 364996 - DNA, 25 bp, Homo sapien
gaatgtttcagctcctgaatcaaga

SEQ ID NO: 364997 - DNA, 25 bp, Homo sapien
atcaagacttactaggcagtctggt

SEQ ID NO: 364998 - DNA, 25 bp, Homo sapien
aaaaagttgattgcagaaggacctg

SEQ ID NO: 364999 - DNA, 25 bp, Homo sapien
agccaaattagttctccatgctttc

SEQ ID NO: 365000 - DNA, 25 bp, Homo sapien
catgctttcttcgtagaaaatcctt

SEQ ID NO: 365001 - DNA, 25 bp, Homo sapien
tcccataatgttttcatgccctgag

SEQ ID NO: 365002 - DNA, 25 bp, Homo sapien
tgttttcatgccctgagaatcagaa

SEQ ID NO: 365003 - DNA, 25 bp, Homo sapien
agtcattggaagatttgtgttttgc

SEQ ID NO: 365004 - DNA, 25 bp, Homo sapien
cagggcatgaatgagctgatgtgac

SEQ ID NO: 365005 - DNA, 25 bp, Homo sapien
aacagtgttaagtgatattgctaga

SEQ ID NO: 365006 - DNA, 25 bp, Homo sapien
ttttttcagcctaaaactctgttga

SEQ ID NO: 365007 - DNA, 25 bp, Homo sapien
gagctgatgtgacattatgccactt

SEQ ID NO: 365008 - DNA, 25 bp, Homo sapien
gtgacattatgccacttctttcttt

SEQ ID NO: 365009 - DNA, 25 bp, Homo sapien
ggttctcccttattaacttggcatt

SEQ ID NO: 365010 - DNA, 25 bp, Homo sapien
agtttttcaccaagtcctgtgccat

SEQ ID NO: 365011 - DNA, 25 bp, Homo sapien
tgtgccatttcacctcctaacgtct

SEQ ID NO: 365012 - DNA, 25 bp, Homo sapien
ctattaccctagagaagactttcat

SEQ ID NO: 365013 - DNA, 25 bp, Homo sapien
cattatttctcatctggattaccag

SEQ ID NO: 365014 - DNA, 25 bp, Homo sapien
tctggattaccagctcgatctctaa

SEQ ID NO: 365015 - DNA, 25 bp, Homo sapien
gctcgatctctaatctgcttcagtt

SEQ ID NO: 365016 - DNA, 25 bp, Homo sapien
atccttcttgctacttctaggctaa

SEQ ID NO: 365017 - DNA, 25 bp, Homo sapien
aaaacgtgatggtgcctcatgctgc

SEQ ID NO: 365018 - DNA, 25 bp, Homo sapien
tggtgcctcatgctgcttaaaatct

SEQ ID NO: 365019 - DNA, 25 bp, Homo sapien
attgatgttttgatggcggactaca

SEQ ID NO: 365020 - DNA, 25 bp, Homo sapien
gatggcggactacataagcgttaaa

SEQ ID NO: 365021 - DNA, 25 bp, Homo sapien
ccccagaaggtcagaagctttgctt

SEQ ID NO: 365022 - DNA, 25 bp, Homo sapien
aaatggtgtgcaaacgagacgcgaa

SEQ ID NO: 365023 - DNA, 25 bp, Homo sapien
gacgcgaaggaaacgcaaaccctcg

SEQ ID NO: 365024 - DNA, 25 bp, Homo sapien
ttccccgagcctgggtctgtctaat

SEQ ID NO: 365025 - DNA, 25 bp, Homo sapien
agcctgggtctgtctaatggcccag

SEQ ID NO: 365026 - DNA, 25 bp, Homo sapien
atggcccagagggagaggtcgcacc

SEQ ID NO: 365027 - DNA, 25 bp, Homo sapien
gcccggtcggctggcagaaacgaaa

SEQ ID NO: 365028 - DNA, 25 bp, Homo sapien
ctggcagaaacgaaacctcaacacc

SEQ ID NO: 365029 - DNA, 25 bp, Homo sapien
agctgaagcctttcgctgactagat

SEQ ID NO: 365030 - DNA, 25 bp, Homo sapien
aagcctttcgctgactagattacct

SEQ ID NO: 365031 - DNA, 25 bp, Homo sapien
cctttcgctgactagattacctggg

SEQ ID NO: 365032 - DNA, 25 bp, Homo sapien
gagattatcagaaggtgcgatgcac

SEQ ID NO: 365033 - DNA, 25 bp, Homo sapien
ggtgcgatgcacaatgctcattatt

SEQ ID NO: 365034 - DNA, 25 bp, Homo sapien
cacaatgctcattattttatcctag

SEQ ID NO: 365035 - DNA, 25 bp, Homo sapien
gctcattattttatcctagtacaag

SEQ ID NO: 365036 - DNA, 25 bp, Homo sapien
tattttatcctagtacaagacacgt

SEQ ID NO: 365037 - DNA, 25 bp, Homo sapien
gtacaagacacgtataacatctaac

SEQ ID NO: 365038 - DNA, 25 bp, Homo sapien
gacacgtataacatctaacagtaaa

SEQ ID NO: 365039 - DNA, 25 bp, Homo sapien
gaagatggaatctttctataaaaac

SEQ ID NO: 365040 - DNA, 25 bp, Homo sapien
aacaattctgttattaatagttgac

SEQ ID NO: 365041 - DNA, 25 bp, Homo sapien
gcactccagcataggcgtcagaata

SEQ ID NO: 365042 - DNA, 25 bp, Homo sapien
agcataggcgtcagaataagactct

SEQ ID NO: 365043 - DNA, 25 bp, Homo sapien
tcataaaccattggaaggtgaacaa

SEQ ID NO: 365044 - DNA, 25 bp, Homo sapien
cataaaccattggaaggtgaacaat

SEQ ID NO: 365045 - DNA, 25 bp, Homo sapien
taaaccattggaaggtgaacaatta

SEQ ID NO: 365046 - DNA, 25 bp, Homo sapien
gtcaaaaccagactaacagttttag

SEQ ID NO: 365047 - DNA, 25 bp, Homo sapien
ccagactaacagttttagaaagtga

SEQ ID NO: 365048 - DNA, 25 bp, Homo sapien
tgggggcagtgggttattagaaata

SEQ ID NO: 365049 - DNA, 25 bp, Homo sapien
ttagaaataacataaatggctggta

SEQ ID NO: 365050 - DNA, 25 bp, Homo sapien
ataaatggctggtatggtttgtctg

SEQ ID NO: 365051 - DNA, 25 bp, Homo sapien
taaatggctggtatggtttgtctgt

SEQ ID NO: 365052 - DNA, 25 bp, Homo sapien
aaatggctggtatggtttgtctgtg

SEQ ID NO: 365053 - DNA, 25 bp, Homo sapien
gctggtatggtttgtctgtgtcctc

SEQ ID NO: 365054 - DNA, 25 bp, Homo sapien
agctatatgtatttgcctttatgtt

SEQ ID NO: 365055 - DNA, 25 bp, Homo sapien
agagactttcttgagtgacattttt

SEQ ID NO: 365056 - DNA, 25 bp, Homo sapien
ttctgtatcacagcagcattcctag

SEQ ID NO: 365057 - DNA, 25 bp, Homo sapien
acagcagcattcctagtccttaggc

SEQ ID NO: 365058 - DNA, 25 bp, Homo sapien
tccttaggccctcggacagagtgaa

SEQ ID NO: 365059 - DNA, 25 bp, Homo sapien
aggccctcggacagagtgaaatcat

SEQ ID NO: 365060 - DNA, 25 bp, Homo sapien
aaataaggctacagtatttgctttt

SEQ ID NO: 365061 - DNA, 25 bp, Homo sapien
gtagatgattttacatttatggaca

SEQ ID NO: 365062 - DNA, 25 bp, Homo sapien
aatgtctgattaccccattttatca

SEQ ID NO: 365063 - DNA, 25 bp, Homo sapien
attaccccattttatcagtcctgac

SEQ ID NO: 365064 - DNA, 25 bp, Homo sapien
cagtcctgactgtacaagattgttg

SEQ ID NO: 365065 - DNA, 25 bp, Homo sapien
gaatccattaagttcgttggttgca

SEQ ID NO: 365066 - DNA, 25 bp, Homo sapien
aactctgcctcacttatgtttattg

SEQ ID NO: 365067 - DNA, 25 bp, Homo sapien
ttattggaggccataagagagccac

SEQ ID NO: 365068 - DNA, 25 bp, Homo sapien
aaagacaggaactagctacaggagc

SEQ ID NO: 365069 - DNA, 25 bp, Homo sapien
ggagctaatggccaatcttgtctga

SEQ ID NO: 365070 - DNA, 25 bp, Homo sapien
tggccaatcttgtctgagttctttg

SEQ ID NO: 365071 - DNA, 25 bp, Homo sapien
tttgatggcgacacatgaactacag

SEQ ID NO: 365072 - DNA, 25 bp, Homo sapien
tgaactacagccgttttgttgttgt

SEQ ID NO: 365073 - DNA, 25 bp, Homo sapien
tttcccctcagttttggatgactct

SEQ ID NO: 365074 - DNA, 25 bp, Homo sapien
cagttttggatgactctgctcaagg

SEQ ID NO: 365075 - DNA, 25 bp, Homo sapien
ctgctcaaggttcagattctgagga

SEQ ID NO: 365076 - DNA, 25 bp, Homo sapien
aatatagcttaattctggacacaaa

SEQ ID NO: 365077 - DNA, 25 bp, Homo sapien
tggacacaaacagttcccaccatga

SEQ ID NO: 365078 - DNA, 25 bp, Homo sapien
acagttcccaccatgaagagagagt

SEQ ID NO: 365079 - DNA, 25 bp, Homo sapien
gtgaccggaaaggagtgcgtcttaa

SEQ ID NO: 365080 - DNA, 25 bp, Homo sapien
aggagtgcgtcttaagcgcgttcgc

SEQ ID NO: 365081 - DNA, 25 bp, Homo sapien
aagcgcgttcgctgaatttgcacca

SEQ ID NO: 365082 - DNA, 25 bp, Homo sapien
acgcctacggaatatgttgtgacat

SEQ ID NO: 365083 - DNA, 25 bp, Homo sapien
gggccgcacttagcagtggaaagtc

SEQ ID NO: 365084 - DNA, 25 bp, Homo sapien
agcagtggaaagtctgtcctcctga

SEQ ID NO: 365085 - DNA, 25 bp, Homo sapien
agaacaaaatgctgcacgaccacct

SEQ ID NO: 365086 - DNA, 25 bp, Homo sapien
tcatcctggccctttattaaatata

SEQ ID NO: 365087 - DNA, 25 bp, Homo sapien
gcgggcagatccactggggtcgcca

SEQ ID NO: 365088 - DNA, 25 bp, Homo sapien
cgggcagatccactggggtcgccag

SEQ ID NO: 365089 - DNA, 25 bp, Homo sapien
gggcagatccactggggtcgccagt

SEQ ID NO: 365090 - DNA, 25 bp, Homo sapien
ggcagatccactggggtcgccagtt

SEQ ID NO: 365091 - DNA, 25 bp, Homo sapien
gcagatccactggggtcgccagttc

SEQ ID NO: 365092 - DNA, 25 bp, Homo sapien
cagatccactggggtcgccagttcg

SEQ ID NO: 365093 - DNA, 25 bp, Homo sapien
agatccactggggtcgccagttcga

SEQ ID NO: 365094 - DNA, 25 bp, Homo sapien
gatccactggggtcgccagttcgag

SEQ ID NO: 365095 - DNA, 25 bp, Homo sapien
atccactggggtcgccagttcgaga

SEQ ID NO: 365096 - DNA, 25 bp, Homo sapien
tccactggggtcgccagttcgagac

SEQ ID NO: 365097 - DNA, 25 bp, Homo sapien
ccactggggtcgccagttcgagacc

SEQ ID NO: 365098 - DNA, 25 bp, Homo sapien
tagcattttttgaatgcctctccct

SEQ ID NO: 365099 - DNA, 25 bp, Homo sapien
ttctcttttcaatcaggcttttcca

SEQ ID NO: 365100 - DNA, 25 bp, Homo sapien
aaagggttgtatacagactctgtgc

SEQ ID NO: 365101 - DNA, 25 bp, Homo sapien
ttgatattcattccccaattcactg

SEQ ID NO: 365102 - DNA, 25 bp, Homo sapien
ttcactgcaaggagacctctactgt

SEQ ID NO: 365103 - DNA, 25 bp, Homo sapien
tactgtcaccgtttactctttccta

SEQ ID NO: 365104 - DNA, 25 bp, Homo sapien
tttcctaccctgacatccagaaaca

SEQ ID NO: 365105 - DNA, 25 bp, Homo sapien
aaacaatggcctccagtgcatactt

SEQ ID NO: 365106 - DNA, 25 bp, Homo sapien
tccagtgcatacttctcaatctttg

SEQ ID NO: 365107 - DNA, 25 bp, Homo sapien
aatctttgctttatggcctttccat

SEQ ID NO: 365108 - DNA, 25 bp, Homo sapien
ttacttagcttccaggtcttaactt

SEQ ID NO: 365109 - DNA, 25 bp, Homo sapien
ttaaactgtgagttccactgaatac

SEQ ID NO: 365110 - DNA, 25 bp, Homo sapien
taaactgtgagttccactgaataca

SEQ ID NO: 365111 - DNA, 25 bp, Homo sapien
aaactgtgagttccactgaatacat

SEQ ID NO: 365112 - DNA, 25 bp, Homo sapien
aactgtgagttccactgaatacatt

SEQ ID NO: 365113 - DNA, 25 bp, Homo sapien
actgtgagttccactgaatacattt

SEQ ID NO: 365114 - DNA, 25 bp, Homo sapien
ctgtgagttccactgaatacatttt

SEQ ID NO: 365115 - DNA, 25 bp, Homo sapien
tgtgagttccactgaatacatttta

SEQ ID NO: 365116 - DNA, 25 bp, Homo sapien
gtgagttccactgaatacattttaa

SEQ ID NO: 365117 - DNA, 25 bp, Homo sapien
tgagttccactgaatacattttaat

SEQ ID NO: 365118 - DNA, 25 bp, Homo sapien
cattttaatgtctgtaggaagaatc

SEQ ID NO: 365119 - DNA, 25 bp, Homo sapien
acacctatttaaagatggcaatata

SEQ ID NO: 365120 - DNA, 25 bp, Homo sapien
atgtgcacaactgataccaggctca

SEQ ID NO: 365121 - DNA, 25 bp, Homo sapien
gtgacccgaagaatacacccatcaa

SEQ ID NO: 365122 - DNA, 25 bp, Homo sapien
ctgataccaggctcaacaaggctgt

SEQ ID NO: 365123 - DNA, 25 bp, Homo sapien
cccgaagaatacacccatcaacatt

SEQ ID NO: 365124 - DNA, 25 bp, Homo sapien
aatccatgtgcagttgtccagagaa

SEQ ID NO: 365125 - DNA, 25 bp, Homo sapien
ttcaccaaataagctctgtacttcg

SEQ ID NO: 365126 - DNA, 25 bp, Homo sapien
taagctctgtacttcggttacctat

SEQ ID NO: 365127 - DNA, 25 bp, Homo sapien
tctgtacttcggttacctatgtacc

SEQ ID NO: 365128 - DNA, 25 bp, Homo sapien
gggcttcaagaagcatgccccttga

SEQ ID NO: 365129 - DNA, 25 bp, Homo sapien
agcatgccccttgagcactcaaaga

SEQ ID NO: 365130 - DNA, 25 bp, Homo sapien
tgccccttgagcactcaaagagatt

SEQ ID NO: 365131 - DNA, 25 bp, Homo sapien
ggcgcctgtgcttcagttcaggatt

SEQ ID NO: 365132 - DNA, 25 bp, Homo sapien
gtgcttcagttcaggatttcgtggt

SEQ ID NO: 365133 - DNA, 25 bp, Homo sapien
cttcagttcaggatttcgtggtggg

SEQ ID NO: 365134 - DNA, 25 bp, Homo sapien
accgtggatggttgaggtgggccct

SEQ ID NO: 365135 - DNA, 25 bp, Homo sapien
cctgagtaatcatgggggcccttat

SEQ ID NO: 365136 - DNA, 25 bp, Homo sapien
gtcacgagggtctgcgcatgaagca

SEQ ID NO: 365137 - DNA, 25 bp, Homo sapien
ggtctgcgcatgaagcaaggaagct

SEQ ID NO: 365138 - DNA, 25 bp, Homo sapien
aggcgatgaggtggcccctggagga

SEQ ID NO: 365139 - DNA, 25 bp, Homo sapien
ctccgtggagaaacaaagccgcact

SEQ ID NO: 365140 - DNA, 25 bp, Homo sapien
tggagaaacaaagccgcactgacaa

SEQ ID NO: 365141 - DNA, 25 bp, Homo sapien
aacaaagccgcactgacaagacttc

SEQ ID NO: 365142 - DNA, 25 bp, Homo sapien
gtacaagggcttcatatacaatcag

SEQ ID NO: 365143 - DNA, 25 bp, Homo sapien
tacaagggcttcatatacaatcagg

SEQ ID NO: 365144 - DNA, 25 bp, Homo sapien
acaagggcttcatatacaatcagga

SEQ ID NO: 365145 - DNA, 25 bp, Homo sapien
caagggcttcatatacaatcaggag

SEQ ID NO: 365146 - DNA, 25 bp, Homo sapien
aagggcttcatatacaatcaggaga

SEQ ID NO: 365147 - DNA, 25 bp, Homo sapien
agggcttcatatacaatcaggagat

SEQ ID NO: 365148 - DNA, 25 bp, Homo sapien
gggcttcatatacaatcaggagatt

SEQ ID NO: 365149 - DNA, 25 bp, Homo sapien
ggcttcatatacaatcaggagattt

SEQ ID NO: 365150 - DNA, 25 bp, Homo sapien
tcaggagatttaataatcatgctag

SEQ ID NO: 365151 - DNA, 25 bp, Homo sapien
gatttaataatcatgctaggggccg

SEQ ID NO: 365152 - DNA, 25 bp, Homo sapien
aataatcatgctaggggccgggtgc

SEQ ID NO: 365153 - DNA, 25 bp, Homo sapien
aacagttgttttctaattggcggca

SEQ ID NO: 365154 - DNA, 25 bp, Homo sapien
tctaattggcggcaggtcagagaat

SEQ ID NO: 365155 - DNA, 25 bp, Homo sapien
cagagaatgagttagacttttgacc

SEQ ID NO: 365156 - DNA, 25 bp, Homo sapien
tcaggaggacagactttccactgct

SEQ ID NO: 365157 - DNA, 25 bp, Homo sapien
tttccactgctaagtgcggccccgg

SEQ ID NO: 365158 - DNA, 25 bp, Homo sapien
tggtgcaaattcagcgaacgcgctt

SEQ ID NO: 365159 - DNA, 25 bp, Homo sapien
gaacgcgcttaagacgcactccttt

SEQ ID NO: 365160 - DNA, 25 bp, Homo sapien
ttaagacgcactcctttccggtcac

SEQ ID NO: 365161 - DNA, 25 bp, Homo sapien
tactctctcttcatggtgggaactg

SEQ ID NO: 365162 - DNA, 25 bp, Homo sapien
tggtgggaactgtttgtgtccagaa

SEQ ID NO: 365163 - DNA, 25 bp, Homo sapien
tgtgtccagaattaagctatattta

SEQ ID NO: 365164 - DNA, 25 bp, Homo sapien
gggtaggaggaagaatcaatctcgt

SEQ ID NO: 365165 - DNA, 25 bp, Homo sapien
ggtaggaggaagaatcaatctcgtg

SEQ ID NO: 365166 - DNA, 25 bp, Homo sapien
gtaggaggaagaatcaatctcgtga

SEQ ID NO: 365167 - DNA, 25 bp, Homo sapien
taggaggaagaatcaatctcgtgaa

SEQ ID NO: 365168 - DNA, 25 bp, Homo sapien
aagagagccctcattgccaagtcat

SEQ ID NO: 365169 - DNA, 25 bp, Homo sapien
agagagccctcattgccaagtcatc

SEQ ID NO: 365170 - DNA, 25 bp, Homo sapien
gagagccctcattgccaagtcatcc

SEQ ID NO: 365171 - DNA, 25 bp, Homo sapien
agagccctcattgccaagtcatccc

SEQ ID NO: 365172 - DNA, 25 bp, Homo sapien
agccctcattgccaagtcatcccta

SEQ ID NO: 365173 - DNA, 25 bp, Homo sapien
ccctcattgccaagtcatccctaag

SEQ ID NO: 365174 - DNA, 25 bp, Homo sapien
cctcattgccaagtcatccctaagc

SEQ ID NO: 365175 - DNA, 25 bp, Homo sapien
gttccgccctcagtggtctgccggg

SEQ ID NO: 365176 - DNA, 25 bp, Homo sapien
ccctcagtggtctgccgggcgcccc

SEQ ID NO: 365177 - DNA, 25 bp, Homo sapien
ttcgccgcagtttcctccgccgctg

SEQ ID NO: 365178 - DNA, 25 bp, Homo sapien
gcctctgatcgcctcaagagagcgg

SEQ ID NO: 365179 - DNA, 25 bp, Homo sapien
agtttcctccgccgctgtcgggcgt

SEQ ID NO: 365180 - DNA, 25 bp, Homo sapien
gcgggcggctgagggcgagggaggc

SEQ ID NO: 365181 - DNA, 25 bp, Homo sapien
gggaggccctcccttctggcgaggg

SEQ ID NO: 365182 - DNA, 25 bp, Homo sapien
cgctgtcgggcgtgcggcgctgagg

SEQ ID NO: 365183 - DNA, 25 bp, Homo sapien
gctgtcgggcgtgcggcgctgaggg

SEQ ID NO: 365184 - DNA, 25 bp, Homo sapien
gtcgggcgtgcggcgctgagggacc

SEQ ID NO: 365185 - DNA, 25 bp, Homo sapien
gggacccgggcgagcgcgccgcgca

SEQ ID NO: 365186 - DNA, 25 bp, Homo sapien
gatacacctcacttgaagttggcct

SEQ ID NO: 365187 - DNA, 25 bp, Homo sapien
tcacttgaagttggcctggagaaaa

SEQ ID NO: 365188 - DNA, 25 bp, Homo sapien
agaaaagaggcgtcggactcctgga

SEQ ID NO: 365189 - DNA, 25 bp, Homo sapien
gaaacggtcaccagtttcggctcaa

SEQ ID NO: 365190 - DNA, 25 bp, Homo sapien
accagtttcggctcaaagcagcctg

SEQ ID NO: 365191 - DNA, 25 bp, Homo sapien
catggtcgaggcagcgtcctggtcc

SEQ ID NO: 365192 - DNA, 25 bp, Homo sapien
ggccggacgatcatttatgggatat

SEQ ID NO: 365193 - DNA, 25 bp, Homo sapien
aagactaccaactagaagccatagg

SEQ ID NO: 365194 - DNA, 25 bp, Homo sapien
aactagaagccatagggagtcattt

SEQ ID NO: 365195 - DNA, 25 bp, Homo sapien
aatcttctgctctcgtggcaagaaa

SEQ ID NO: 365196 - DNA, 25 bp, Homo sapien
ggatagagttgatacacctcacttg

SEQ ID NO: 365197 - DNA, 25 bp, Homo sapien
ctccaccttgtcctgacaggtggaa

SEQ ID NO: 365198 - DNA, 25 bp, Homo sapien
accttgtcctgacaggtggaagaag

SEQ ID NO: 365199 - DNA, 25 bp, Homo sapien
acatcacaggtgacaggtggctccc

SEQ ID NO: 365200 - DNA, 25 bp, Homo sapien
acaggtgacaggtggctcccaggat

SEQ ID NO: 365201 - DNA, 25 bp, Homo sapien
agatggtgggtggatcattgccaac

SEQ ID NO: 365202 - DNA, 25 bp, Homo sapien
tgggtggatcattgccaacgggatc

SEQ ID NO: 365203 - DNA, 25 bp, Homo sapien
ggatcattgccaacgggatccagcc

SEQ ID NO: 365204 - DNA, 25 bp, Homo sapien
ttcccacaaaaactcctgtctctgt

SEQ ID NO: 365205 - DNA, 25 bp, Homo sapien
acaaaaactcctgtctctgtagaat

SEQ ID NO: 365206 - DNA, 25 bp, Homo sapien
aaaactcctgtctctgtagaataca

SEQ ID NO: 365207 - DNA, 25 bp, Homo sapien
ctgtctctgtagaatacagggcttc

SEQ ID NO: 365208 - DNA, 25 bp, Homo sapien
gttatggcatgaggtacccatgttg

SEQ ID NO: 365209 - DNA, 25 bp, Homo sapien
caccactttcacaggtaatcctttc

SEQ ID NO: 365210 - DNA, 25 bp, Homo sapien
aatcctttctccctccagtaagtat

SEQ ID NO: 365211 - DNA, 25 bp, Homo sapien
ttctccctccagtaagtatctcttg

SEQ ID NO: 365212 - DNA, 25 bp, Homo sapien
gtatctcttggacagaactctcaga

SEQ ID NO: 365213 - DNA, 25 bp, Homo sapien
gacagaactctcagatatggttcga

SEQ ID NO: 365214 - DNA, 25 bp, Homo sapien
gatatggttcgagttctgttttatt

SEQ ID NO: 365215 - DNA, 25 bp, Homo sapien
cccctcttgtttggtagatctgttg

SEQ ID NO: 365216 - DNA, 25 bp, Homo sapien
ctcagctgcgaggtttggaccttga

SEQ ID NO: 365217 - DNA, 25 bp, Homo sapien
ggagaaggcttatcattcttactgg

SEQ ID NO: 365218 - DNA, 25 bp, Homo sapien
aaggcttatcattcttactggtaag

SEQ ID NO: 365219 - DNA, 25 bp, Homo sapien
atgtgcacaactgataccaggctca

SEQ ID NO: 365220 - DNA, 25 bp, Homo sapien
gtgacccgaagaatacacccatcaa

SEQ ID NO: 365221 - DNA, 25 bp, Homo sapien
cccgaagaatacacccatcaacatt

SEQ ID NO: 365222 - DNA, 25 bp, Homo sapien
ttcaccaaataagctctgtacttcg

SEQ ID NO: 365223 - DNA, 25 bp, Homo sapien
aataagctctgtacttcggttacct

SEQ ID NO: 365224 - DNA, 25 bp, Homo sapien
taagctctgtacttcggttacctat

SEQ ID NO: 365225 - DNA, 25 bp, Homo sapien
agctctgtacttcggttacctatgt

SEQ ID NO: 365226 - DNA, 25 bp, Homo sapien
tctgtacttcggttacctatgtacc

SEQ ID NO: 365227 - DNA, 25 bp, Homo sapien
gggcttcaagaagcatgccccttga

SEQ ID NO: 365228 - DNA, 25 bp, Homo sapien
agcatgccccttgagcactcaaaga

SEQ ID NO: 365229 - DNA, 25 bp, Homo sapien
tgccccttgagcactcaaagagatt

SEQ ID NO: 365230 - DNA, 25 bp, Homo sapien
tgacctctatatatttggcatgctg

SEQ ID NO: 365231 - DNA, 25 bp, Homo sapien
tttggcatgctgagcttcttgccat

SEQ ID NO: 365232 - DNA, 25 bp, Homo sapien
attgatctaaagtaccaggcccatt

SEQ ID NO: 365233 - DNA, 25 bp, Homo sapien
ccaggcccattcatacacattgtat

SEQ ID NO: 365234 - DNA, 25 bp, Homo sapien
attgtatactttccacaccttgctg

SEQ ID NO: 365235 - DNA, 25 bp, Homo sapien
ttgctgagaattctcttccctttcc

SEQ ID NO: 365236 - DNA, 25 bp, Homo sapien
atctgaaaaattcccactcagtttt

SEQ ID NO: 365237 - DNA, 25 bp, Homo sapien
aagtaccaattcacatgtctccagc

SEQ ID NO: 365238 - DNA, 25 bp, Homo sapien
tcttctctcgatttcctggaatggt

SEQ ID NO: 365239 - DNA, 25 bp, Homo sapien
gaacatggagtgtcttaacttgtgt

SEQ ID NO: 365240 - DNA, 25 bp, Homo sapien
gcatggtttaggagtctgttgtcaa

SEQ ID NO: 365241 - DNA, 25 bp, Homo sapien
tcgtccttcctccatgacttataag

SEQ ID NO: 365242 - DNA, 25 bp, Homo sapien
gtccttcctccatgacttataagtc

SEQ ID NO: 365243 - DNA, 25 bp, Homo sapien
gacttataagtcatcatctctgctg

SEQ ID NO: 365244 - DNA, 25 bp, Homo sapien
ataagtcatcatctctgctggtttc

SEQ ID NO: 365245 - DNA, 25 bp, Homo sapien
aagtcatcatctctgctggtttctg

SEQ ID NO: 365246 - DNA, 25 bp, Homo sapien
tcatcatctctgctggtttctgaaa

SEQ ID NO: 365247 - DNA, 25 bp, Homo sapien
atcatctctgctggtttctgaaatg

SEQ ID NO: 365248 - DNA, 25 bp, Homo sapien
catctctgctggtttctgaaatgag

SEQ ID NO: 365249 - DNA, 25 bp, Homo sapien
gtttctgaaatgagatatgcttctt

SEQ ID NO: 365250 - DNA, 25 bp, Homo sapien
tgagatatgcttcttggggtcttca

SEQ ID NO: 365251 - DNA, 25 bp, Homo sapien
ataggcctgacttgtgtaaccacta

SEQ ID NO: 365252 - DNA, 25 bp, Homo sapien
gtgctgctggtttttagtgcttagg

SEQ ID NO: 365253 - DNA, 25 bp, Homo sapien
tttagtgcttaggagttggccatgt

SEQ ID NO: 365254 - DNA, 25 bp, Homo sapien
tggccatgttaaatttcccacacca

SEQ ID NO: 365255 - DNA, 25 bp, Homo sapien
tgttaaatttcccacaccacaagta

SEQ ID NO: 365256 - DNA, 25 bp, Homo sapien
agaagccagtggcattcctgtctct

SEQ ID NO: 365257 - DNA, 25 bp, Homo sapien
gtctctgttggaagtcctggtctga

SEQ ID NO: 365258 - DNA, 25 bp, Homo sapien
agtcctggtctgaatgtggaccctc

SEQ ID NO: 365259 - DNA, 25 bp, Homo sapien
accttgttgcctgggtctgtgagag

SEQ ID NO: 365260 - DNA, 25 bp, Homo sapien
tgcctgggtctgtgagagcaaagct

SEQ ID NO: 365261 - DNA, 25 bp, Homo sapien
agcaaagctgagttctggtccggct

SEQ ID NO: 365262 - DNA, 25 bp, Homo sapien
tctggtccggcttgtagcagaagaa

SEQ ID NO: 365263 - DNA, 25 bp, Homo sapien
gattgcaatttgaactcatcagtaa

SEQ ID NO: 365264 - DNA, 25 bp, Homo sapien
gaactcatcagtaactccctggctg

SEQ ID NO: 365265 - DNA, 25 bp, Homo sapien
tctgaaccttagtttccccttctat

SEQ ID NO: 365266 - DNA, 25 bp, Homo sapien
ttgttccagatctgatagactaaga

SEQ ID NO: 365267 - DNA, 25 bp, Homo sapien
atagactaagaagccacttcctttg

SEQ ID NO: 365268 - DNA, 25 bp, Homo sapien
cagtgttgcaacatctgtacttgga

SEQ ID NO: 365269 - DNA, 25 bp, Homo sapien
gcaacatctgtacttggatcccctt

SEQ ID NO: 365270 - DNA, 25 bp, Homo sapien
atccccttcctttgacaagaatctt

SEQ ID NO: 365271 - DNA, 25 bp, Homo sapien
aagaatcttgcaacatgccaccctg

SEQ ID NO: 365272 - DNA, 25 bp, Homo sapien
cttgcaacatgccaccctgtattag

SEQ ID NO: 365273 - DNA, 25 bp, Homo sapien
acaattttgcaaaaggcctccctga

SEQ ID NO: 365274 - DNA, 25 bp, Homo sapien
gcactagggcctgcggccttcaagg

SEQ ID NO: 365275 - DNA, 25 bp, Homo sapien
ctgcggccttcaagggcgaggaccc

SEQ ID NO: 365276 - DNA, 25 bp, Homo sapien
gccttcaagggcgaggacccgaagt

SEQ ID NO: 365277 - DNA, 25 bp, Homo sapien
gggtacacctggtctcgtcattcgt

SEQ ID NO: 365278 - DNA, 25 bp, Homo sapien
gtacacctggtctcgtcattcgtcg

SEQ ID NO: 365279 - DNA, 25 bp, Homo sapien
ggtctcgtcattcgtcgctctgtga

SEQ ID NO: 365280 - DNA, 25 bp, Homo sapien
tcattcgtcgctctgtgaccgagga

SEQ ID NO: 365281 - DNA, 25 bp, Homo sapien
ttcgtcgctctgtgaccgaggaggc

SEQ ID NO: 365282 - DNA, 25 bp, Homo sapien
gctctgtgaccgaggaggcgggcaa

SEQ ID NO: 365283 - DNA, 25 bp, Homo sapien
aaggtcacccacgaatcccagccgt

SEQ ID NO: 365284 - DNA, 25 bp, Homo sapien
gacttcctggagcagccacgtgttc

SEQ ID NO: 365285 - DNA, 25 bp, Homo sapien
gaacttgcatggtatttgtactccc

SEQ ID NO: 365286 - DNA, 25 bp, Homo sapien
ggtatttgtactcccatgtgctggg

SEQ ID NO: 365287 - DNA, 25 bp, Homo sapien
gaggtatctcatgggagacttcaca

SEQ ID NO: 365288 - DNA, 25 bp, Homo sapien
agacttcacacaacagaaccgtttg

SEQ ID NO: 365289 - DNA, 25 bp, Homo sapien
aacagaaccgtttgagagagtctct

SEQ ID NO: 365290 - DNA, 25 bp, Homo sapien
tctggagcaggctgctggccaccga

SEQ ID NO: 365291 - DNA, 25 bp, Homo sapien
gctggccaccgagtactttaggatg

SEQ ID NO: 365292 - DNA, 25 bp, Homo sapien
agggaacaacggtgctcactgagtg

SEQ ID NO: 365293 - DNA, 25 bp, Homo sapien
ggtgctcactgagtggccgagaatt

SEQ ID NO: 365294 - DNA, 25 bp, Homo sapien
ggccgagaatttgctgtggtatgtc

SEQ ID NO: 365295 - DNA, 25 bp, Homo sapien
ggtatgtcaccagacgaacttgcat

SEQ ID NO: 365296 - DNA, 25 bp, Homo sapien
gtggaatcatcatcgcccaggaaga

SEQ ID NO: 365297 - DNA, 25 bp, Homo sapien
atgtccgagtccagcccagaaagcc

SEQ ID NO: 365298 - DNA, 25 bp, Homo sapien
gagtccagcccagaaagccgggaag

SEQ ID NO: 365299 - DNA, 25 bp, Homo sapien
aagagaaaatctcccccaggatcaa

SEQ ID NO: 365300 - DNA, 25 bp, Homo sapien
aaaccccaacctcagttgaggccag

SEQ ID NO: 365301 - DNA, 25 bp, Homo sapien
aacctcagttgaggccagggtggtc

SEQ ID NO: 365302 - DNA, 25 bp, Homo sapien
agaataaatgccatcgagcctgtgg

SEQ ID NO: 365303 - DNA, 25 bp, Homo sapien
aaatgccatcgagcctgtggctggc

SEQ ID NO: 365304 - DNA, 25 bp, Homo sapien
agagcgaggacagttacaatggccg

SEQ ID NO: 365305 - DNA, 25 bp, Homo sapien
cagggagaactgtccagcgaggata

SEQ ID NO: 365306 - DNA, 25 bp, Homo sapien
cagcgaggatattgtggaatcatca

SEQ ID NO: 365307 - DNA, 25 bp, Homo sapien
ggaatcaagcaagaatctactcagc

SEQ ID NO: 365308 - DNA, 25 bp, Homo sapien
aagcaagaatctactcagcatatcc

SEQ ID NO: 365309 - DNA, 25 bp, Homo sapien
cacatcctcagggtaattatagcaa

SEQ ID NO: 365310 - DNA, 25 bp, Homo sapien
ttcaaaaattatctctgtgcacatg

SEQ ID NO: 365311 - DNA, 25 bp, Homo sapien
atctctgtgcacatgaacttcccag

SEQ ID NO: 365312 - DNA, 25 bp, Homo sapien
acttcccagatcctgttgactcagg

SEQ ID NO: 365313 - DNA, 25 bp, Homo sapien
ttgactcaggaactcaaaatgggcc

SEQ ID NO: 365314 - DNA, 25 bp, Homo sapien
aaatgggccatttcacatgatcatg

SEQ ID NO: 365315 - DNA, 25 bp, Homo sapien
aaactaatgggcttttcatcttagc

SEQ ID NO: 365316 - DNA, 25 bp, Homo sapien
tcatcttagcacgagaatttacttc

SEQ ID NO: 365317 - DNA, 25 bp, Homo sapien
gagaatttacttcatcaagtggaat

SEQ ID NO: 365318 - DNA, 25 bp, Homo sapien
acagtgctatagtggtttcataatc

SEQ ID NO: 365319 - DNA, 25 bp, Homo sapien
gtttcataatcataaagcattccag

SEQ ID NO: 365320 - DNA, 25 bp, Homo sapien
tcggcacgatggacaggaagaaagt

SEQ ID NO: 365321 - DNA, 25 bp, Homo sapien
ggaacacaatattgcttatcaactg

SEQ ID NO: 365322 - DNA, 25 bp, Homo sapien
gcactcccagcaatttggcaagcca

SEQ ID NO: 365323 - DNA, 25 bp, Homo sapien
ccaagctttgatggctctggcagaa

SEQ ID NO: 365324 - DNA, 25 bp, Homo sapien
tggcagaaagccttcctgttccaaa

SEQ ID NO: 365325 - DNA, 25 bp, Homo sapien
agaaagccttcctgttccaaactca

SEQ ID NO: 365326 - DNA, 25 bp, Homo sapien
gtcagaggtcacaatccaaagcaag

SEQ ID NO: 365327 - DNA, 25 bp, Homo sapien
gacagtctcttgacgaagacaccct

SEQ ID NO: 365328 - DNA, 25 bp, Homo sapien
gaagacaccctgagtgctgaattaa

SEQ ID NO: 365329 - DNA, 25 bp, Homo sapien
ttgtttttgttggatagcttttaat

SEQ ID NO: 365330 - DNA, 25 bp, Homo sapien
catttcagagaggtgtaattttggg

SEQ ID NO: 365331 - DNA, 25 bp, Homo sapien
gtgtaattttgggtagatgctcatt

SEQ ID NO: 365332 - DNA, 25 bp, Homo sapien
gggtagatgctcattacatttttga

SEQ ID NO: 365333 - DNA, 25 bp, Homo sapien
gatgctcattacatttttgaaaggt

SEQ ID NO: 365334 - DNA, 25 bp, Homo sapien
atatgactggtgatactggctttac

SEQ ID NO: 365335 - DNA, 25 bp, Homo sapien
actggtgatactggctttacagaaa

SEQ ID NO: 365336 - DNA, 25 bp, Homo sapien
ttctgacatattctgacaaagagca

SEQ ID NO: 365337 - DNA, 25 bp, Homo sapien
ttctgacaaagagcagcaaaccact

SEQ ID NO: 365338 - DNA, 25 bp, Homo sapien
gcaaaccactgctgtgtggcattct

SEQ ID NO: 365339 - DNA, 25 bp, Homo sapien
gtgtggcattcttggagtgtgctgt

SEQ ID NO: 365340 - DNA, 25 bp, Homo sapien
gggtgttcacactcctcaaagccca

SEQ ID NO: 365341 - DNA, 25 bp, Homo sapien
agacctggagagatatcctctggaa

SEQ ID NO: 365342 - DNA, 25 bp, Homo sapien
caggccagactcctgttaatgctaa

SEQ ID NO: 365343 - DNA, 25 bp, Homo sapien
caacacatgtgcactttcaagggag

SEQ ID NO: 365344 - DNA, 25 bp, Homo sapien
gaccacacagtgcttagtatgctag

SEQ ID NO: 365345 - DNA, 25 bp, Homo sapien
gtaagcattaatttgattccttggg

SEQ ID NO: 365346 - DNA, 25 bp, Homo sapien
aatgggaccattttgaggcatatgc

SEQ ID NO: 365347 - DNA, 25 bp, Homo sapien
gaggcatatgctactgctcacaagc

SEQ ID NO: 365348 - DNA, 25 bp, Homo sapien
atcctctggaaccattacagggctt

SEQ ID NO: 365349 - DNA, 25 bp, Homo sapien
tttcaaagaacacacagtcccactg

SEQ ID NO: 365350 - DNA, 25 bp, Homo sapien
acagtcccactgaaatcagcagaat

SEQ ID NO: 365351 - DNA, 25 bp, Homo sapien
tgtggtctgctcagatcaccctgag

SEQ ID NO: 365352 - DNA, 25 bp, Homo sapien
ggtctgctcagatcaccctgagtgc

SEQ ID NO: 365353 - DNA, 25 bp, Homo sapien
gcagggccgggctgtgttggaagct

SEQ ID NO: 365354 - DNA, 25 bp, Homo sapien
tgtgttggaagctggcttagctggt

SEQ ID NO: 365355 - DNA, 25 bp, Homo sapien
gggcagccttatttcaattaaaagg

SEQ ID NO: 365356 - DNA, 25 bp, Homo sapien
aattaaaagggcattgactgggagc

SEQ ID NO: 365357 - DNA, 25 bp, Homo sapien
caaaacctaagaccttactgcaact

SEQ ID NO: 365358 - DNA, 25 bp, Homo sapien
acctaagaccttactgcaactaagt

SEQ ID NO: 365359 - DNA, 25 bp, Homo sapien
taacccaatgggatgaacagcctgt

SEQ ID NO: 365360 - DNA, 25 bp, Homo sapien
atgaacagcctgtggtctgctcaga

SEQ ID NO: 365361 - DNA, 25 bp, Homo sapien
aacagcctgtggtctgctcagatca

SEQ ID NO: 365362 - DNA, 25 bp, Homo sapien
gcggtgaggaggaaataaagacagt

SEQ ID NO: 365363 - DNA, 25 bp, Homo sapien
cggtgaggaggaaataaagacagtg

SEQ ID NO: 365364 - DNA, 25 bp, Homo sapien
aggaggaaataaagacagtggagaa

SEQ ID NO: 365365 - DNA, 25 bp, Homo sapien
ggaggaaataaagacagtggagaaa

SEQ ID NO: 365366 - DNA, 25 bp, Homo sapien
taaagacagtggagaaaaagacgaa

SEQ ID NO: 365367 - DNA, 25 bp, Homo sapien
agacagtggagaaaaagacgaaaat

SEQ ID NO: 365368 - DNA, 25 bp, Homo sapien
gacagtggagaaaaagacgaaaatg

SEQ ID NO: 365369 - DNA, 25 bp, Homo sapien
tggagaaaaagacgaaaatgggccg

SEQ ID NO: 365370 - DNA, 25 bp, Homo sapien
ggaggctaggcaggaaaatggtgtg

SEQ ID NO: 365371 - DNA, 25 bp, Homo sapien
gaggctaggcaggaaaatggtgtga

SEQ ID NO: 365372 - DNA, 25 bp, Homo sapien
aggctaggcaggaaaatggtgtgaa

SEQ ID NO: 365373 - DNA, 25 bp, Homo sapien
tattgcatgaaatcgggaaccagtc

SEQ ID NO: 365374 - DNA, 25 bp, Homo sapien
ggaaccagtctgaaacttgtaaaca

SEQ ID NO: 365375 - DNA, 25 bp, Homo sapien
acattgcctgatgggtagagaaacc

SEQ ID NO: 365376 - DNA, 25 bp, Homo sapien
catgagttaagaagagggccacgta

SEQ ID NO: 365377 - DNA, 25 bp, Homo sapien
agggtcagctggtgactggcataaa

SEQ ID NO: 365378 - DNA, 25 bp, Homo sapien
agggctccctccagtggtctctttg

SEQ ID NO: 365379 - DNA, 25 bp, Homo sapien
ggtctctttggaccatggcttgtaa

SEQ ID NO: 365380 - DNA, 25 bp, Homo sapien
atgactttacctgaggcctgttgct

SEQ ID NO: 365381 - DNA, 25 bp, Homo sapien
ggcctgttgcttttacatgcatcat

SEQ ID NO: 365382 - DNA, 25 bp, Homo sapien
atgcatcatccaaatgcttgtgcca

SEQ ID NO: 365383 - DNA, 25 bp, Homo sapien
tgcttgtgccacagtattgcatgaa

SEQ ID NO: 365384 - DNA, 25 bp, Homo sapien
aaacagctaagtgtttcctggctga

SEQ ID NO: 365385 - DNA, 25 bp, Homo sapien
ttcctggctgaattttattttgctt

SEQ ID NO: 365386 - DNA, 25 bp, Homo sapien
tctgccatttcagttcctgttatcg

SEQ ID NO: 365387 - DNA, 25 bp, Homo sapien
tcctgttatcgtgctttgaggtgca

SEQ ID NO: 365388 - DNA, 25 bp, Homo sapien
tgaggtgcactgaactgcagcaaac

SEQ ID NO: 365389 - DNA, 25 bp, Homo sapien
gggatccaaggctacgttgaaaagc

SEQ ID NO: 365390 - DNA, 25 bp, Homo sapien
ttgaaaagcctttgaccacagtgca

SEQ ID NO: 365391 - DNA, 25 bp, Homo sapien
tttgaccacagtgcagggagcagaa

SEQ ID NO: 365392 - DNA, 25 bp, Homo sapien
gatgatgagatttcccctgttgtca

SEQ ID NO: 365393 - DNA, 25 bp, Homo sapien
agatttcccctgttgtcacataaac

SEQ ID NO: 365394 - DNA, 25 bp, Homo sapien
ttgtgctctcagaactccaagcatg

SEQ ID NO: 365395 - DNA, 25 bp, Homo sapien
aatttattgttcttgcacacctgca

SEQ ID NO: 365396 - DNA, 25 bp, Homo sapien
tattgttcttgcacacctgcacagc

SEQ ID NO: 365397 - DNA, 25 bp, Homo sapien
agttggctgcaaaaactctcatgca

SEQ ID NO: 365398 - DNA, 25 bp, Homo sapien
aactctcatgcactagatgtggcac

SEQ ID NO: 365399 - DNA, 25 bp, Homo sapien
actagatgtggcaccttggagggca

SEQ ID NO: 365400 - DNA, 25 bp, Homo sapien
gcagggaccaagtgaggcctcatgt

SEQ ID NO: 365401 - DNA, 25 bp, Homo sapien
aagtgaggcctcatgtgtgtcttca

SEQ ID NO: 365402 - DNA, 25 bp, Homo sapien
aggcctcatgtgtgtcttcaccgtg

SEQ ID NO: 365403 - DNA, 25 bp, Homo sapien
atgtgtgtcttcaccgtgctgtcct

SEQ ID NO: 365404 - DNA, 25 bp, Homo sapien
cgtgctgtcctcacaaggccaggtg

SEQ ID NO: 365405 - DNA, 25 bp, Homo sapien
gtgcccaaagggagcctgacaggct

SEQ ID NO: 365406 - DNA, 25 bp, Homo sapien
accgtgcccggcctagaatctatat

SEQ ID NO: 365407 - DNA, 25 bp, Homo sapien
gtgcccggcctagaatctatattct

SEQ ID NO: 365408 - DNA, 25 bp, Homo sapien
cccggcctagaatctatattcttaa

SEQ ID NO: 365409 - DNA, 25 bp, Homo sapien
ggcctagaatctatattcttaacca

SEQ ID NO: 365410 - DNA, 25 bp, Homo sapien
agaatctatattcttaaccatttgt

SEQ ID NO: 365411 - DNA, 25 bp, Homo sapien
taaccatttgtagccatgatggcac

SEQ ID NO: 365412 - DNA, 25 bp, Homo sapien
accatttgtagccatgatggcacac

SEQ ID NO: 365413 - DNA, 25 bp, Homo sapien
ctattttatattctagctctagaca

SEQ ID NO: 365414 - DNA, 25 bp, Homo sapien
tctagctctagacacatagaaggtt

SEQ ID NO: 365415 - DNA, 25 bp, Homo sapien
agctctagacacatagaaggtttgt

SEQ ID NO: 365416 - DNA, 25 bp, Homo sapien
acatagaaggtttgtcatagttgac

SEQ ID NO: 365417 - DNA, 25 bp, Homo sapien
tgcaactgaagttagcctctctcct

SEQ ID NO: 365418 - DNA, 25 bp, Homo sapien
tcctctacccgcaagtgtagagact

SEQ ID NO: 365419 - DNA, 25 bp, Homo sapien
ctgggtatggtctgtattctctcaa

SEQ ID NO: 365420 - DNA, 25 bp, Homo sapien
tattctctcaagttggtggcgttgt

SEQ ID NO: 365421 - DNA, 25 bp, Homo sapien
ttggtggcgttgtttaggccccagc

SEQ ID NO: 365422 - DNA, 25 bp, Homo sapien
tttaggccccagctggaatgctgat

SEQ ID NO: 365423 - DNA, 25 bp, Homo sapien
aatgctgatgccctatgattctctc

SEQ ID NO: 365424 - DNA, 25 bp, Homo sapien
cctccaccctttacatctgttttat

SEQ ID NO: 365425 - DNA, 25 bp, Homo sapien
ttacatctgttttatcatgcaagtt

SEQ ID NO: 365426 - DNA, 25 bp, Homo sapien
tggcatgtatgttgccctattaaca

SEQ ID NO: 365427 - DNA, 25 bp, Homo sapien
gttgccctattaacagtagctttcc

SEQ ID NO: 365428 - DNA, 25 bp, Homo sapien
gctagtgggcctcggatttacggcg

SEQ ID NO: 365429 - DNA, 25 bp, Homo sapien
ggcctcggatttacggcggctgcat

SEQ ID NO: 365430 - DNA, 25 bp, Homo sapien
gcctcggatttacggcggctgcatc

SEQ ID NO: 365431 - DNA, 25 bp, Homo sapien
gatttacggcggctgcatctaactg

SEQ ID NO: 365432 - DNA, 25 bp, Homo sapien
atttacggcggctgcatctaactgg

SEQ ID NO: 365433 - DNA, 25 bp, Homo sapien
tttacggcggctgcatctaactggg

SEQ ID NO: 365434 - DNA, 25 bp, Homo sapien
ttacggcggctgcatctaactggga

SEQ ID NO: 365435 - DNA, 25 bp, Homo sapien
tacggcggctgcatctaactgggag

SEQ ID NO: 365436 - DNA, 25 bp, Homo sapien
cggcggctgcatctaactgggaggg

SEQ ID NO: 365437 - DNA, 25 bp, Homo sapien
atctaactgggagggggccgcacct

SEQ ID NO: 365438 - DNA, 25 bp, Homo sapien
gggagggggccgcacctcgcgtgaa

SEQ ID NO: 365439 - DNA, 25 bp, Homo sapien
aacggttgtagttgctggtcttcca

SEQ ID NO: 365440 - DNA, 25 bp, Homo sapien
agttgctggtcttccagttgacctt

SEQ ID NO: 365441 - DNA, 25 bp, Homo sapien
gacctttttagtgatcaattattgg

SEQ ID NO: 365442 - DNA, 25 bp, Homo sapien
caattattggccgtattagtgaaga

SEQ ID NO: 365443 - DNA, 25 bp, Homo sapien
gaagagccacttccaagacattaag

SEQ ID NO: 365444 - DNA, 25 bp, Homo sapien
gatgtgatatatccgacaagaacca

SEQ ID NO: 365445 - DNA, 25 bp, Homo sapien
gaaccaagggagttgcatatgtaat

SEQ ID NO: 365446 - DNA, 25 bp, Homo sapien
agttgcagagaatgtcatcagacaa

SEQ ID NO: 365447 - DNA, 25 bp, Homo sapien
ctccgccatggcatcagttttgaat

SEQ ID NO: 365448 - DNA, 25 bp, Homo sapien
atgtcaaggaatccaaagctcctga

SEQ ID NO: 365449 - DNA, 25 bp, Homo sapien
aaagctcctgaaagaacggttgtag

SEQ ID NO: 365450 - DNA, 25 bp, Homo sapien
actactgctgtgtatgttttgtata

SEQ ID NO: 365451 - DNA, 25 bp, Homo sapien
gtatactatttctgatctgcctcca

SEQ ID NO: 365452 - DNA, 25 bp, Homo sapien
tgatctgcctccatccatttaggtt

SEQ ID NO: 365453 - DNA, 25 bp, Homo sapien
gcctccatccatttaggttgtcata

SEQ ID NO: 365454 - DNA, 25 bp, Homo sapien
ttaggttgtcatattggttcatcca

SEQ ID NO: 365455 - DNA, 25 bp, Homo sapien
aataatacatgctggttcaatctaa

SEQ ID NO: 365456 - DNA, 25 bp, Homo sapien
tacatgctggttcaatctaaattct

SEQ ID NO: 365457 - DNA, 25 bp, Homo sapien
gattctatcctccaagtataataag

SEQ ID NO: 365458 - DNA, 25 bp, Homo sapien
taagccatgcagtataaagttgtct

SEQ ID NO: 365459 - DNA, 25 bp, Homo sapien
gcagtataaagttgtctatttgttt

SEQ ID NO: 365460 - DNA, 25 bp, Homo sapien
ataaaatcatctgcctttagtccca

SEQ ID NO: 365461 - DNA, 25 bp, Homo sapien
tcataagtgaaccttcacactgtta

SEQ ID NO: 365462 - DNA, 25 bp, Homo sapien
cctgcaagactactcttttatgtaa

SEQ ID NO: 365463 - DNA, 25 bp, Homo sapien
aagactactcttttatgtaacaact

SEQ ID NO: 365464 - DNA, 25 bp, Homo sapien
ctgtctaatgacaaaagtggtaatt

SEQ ID NO: 365465 - DNA, 25 bp, Homo sapien
ttatatactttgctacctacaaatg

SEQ ID NO: 365466 - DNA, 25 bp, Homo sapien
actttgctacctacaaatgatagga

SEQ ID NO: 365467 - DNA, 25 bp, Homo sapien
ttctcttgctgtttagacgtaagga

SEQ ID NO: 365468 - DNA, 25 bp, Homo sapien
gccctctctgccactcattctgtga

SEQ ID NO: 365469 - DNA, 25 bp, Homo sapien
tgctgtttagacgtaaggacccctt

SEQ ID NO: 365470 - DNA, 25 bp, Homo sapien
tcccacctcaacatggctacatgtt

SEQ ID NO: 365471 - DNA, 25 bp, Homo sapien
acatggctacatgtttgttatttca

SEQ ID NO: 365472 - DNA, 25 bp, Homo sapien
gagaccattatgattggcttgaacc

SEQ ID NO: 365473 - DNA, 25 bp, Homo sapien
ggcttgaaccaattaggagtcactc

SEQ ID NO: 365474 - DNA, 25 bp, Homo sapien
taggagtcactctcctgggattggg

SEQ ID NO: 365475 - DNA, 25 bp, Homo sapien
gacaacaatttcatggaaaccctcc

SEQ ID NO: 365476 - DNA, 25 bp, Homo sapien
ggccctgcctctaagtagttagctg

SEQ ID NO: 365477 - DNA, 25 bp, Homo sapien
gcctctaagtagttagctgcctgat

SEQ ID NO: 365478 - DNA, 25 bp, Homo sapien
gctgcctgataattctgcaaaagct

SEQ ID NO: 365479 - DNA, 25 bp, Homo sapien
aaagctggcttctattagcaaggga

SEQ ID NO: 365480 - DNA, 25 bp, Homo sapien
atgactattgtcaggccacagcatg

SEQ ID NO: 365481 - DNA, 25 bp, Homo sapien
ttccctcaggtcctattgattagga

SEQ ID NO: 365482 - DNA, 25 bp, Homo sapien
gcctttcttaaaccatctggcaagg

SEQ ID NO: 365483 - DNA, 25 bp, Homo sapien
acttcctctctctctatctttagta

SEQ ID NO: 365484 - DNA, 25 bp, Homo sapien
cctctctctctatctttagtatttt

SEQ ID NO: 365485 - DNA, 25 bp, Homo sapien
aaagtaaatcccagatagcatcaca

SEQ ID NO: 365486 - DNA, 25 bp, Homo sapien
gtaaatcccagatagcatcacatca

SEQ ID NO: 365487 - DNA, 25 bp, Homo sapien
aatcccagatagcatcacatcattt

SEQ ID NO: 365488 - DNA, 25 bp, Homo sapien
atttcacccccaccataggatttca

SEQ ID NO: 365489 - DNA, 25 bp, Homo sapien
ccccaccataggatttcaaagatct

SEQ ID NO: 365490 - DNA, 25 bp, Homo sapien
ccaccataggatttcaaagatctgt

SEQ ID NO: 365491 - DNA, 25 bp, Homo sapien
agatctgttatatttcaagattgag

SEQ ID NO: 365492 - DNA, 25 bp, Homo sapien
tgaaactctagaaaaagcttgaggg

SEQ ID NO: 365493 - DNA, 25 bp, Homo sapien
gaaagaggaagatttatgttacttt

SEQ ID NO: 365494 - DNA, 25 bp, Homo sapien
gggctcctggcacccacgcactacg

SEQ ID NO: 365495 - DNA, 25 bp, Homo sapien
gccgcctacgcgcttaagacctggg

SEQ ID NO: 365496 - DNA, 25 bp, Homo sapien
cgcctacgcgcttaagacctgggct

SEQ ID NO: 365497 - DNA, 25 bp, Homo sapien
cctacgcgcttaagacctgggctca

SEQ ID NO: 365498 - DNA, 25 bp, Homo sapien
tacgcgcttaagacctgggctcact

SEQ ID NO: 365499 - DNA, 25 bp, Homo sapien
tgggctcactgcatgtcctacagca

SEQ ID NO: 365500 - DNA, 25 bp, Homo sapien
gggctcactgcatgtcctacagcaa

SEQ ID NO: 365501 - DNA, 25 bp, Homo sapien
gctcactgcatgtcctacagcaact

SEQ ID NO: 365502 - DNA, 25 bp, Homo sapien
atgtcctacagcaactccgcgctga

SEQ ID NO: 365503 - DNA, 25 bp, Homo sapien
tgtcctacagcaactccgcgctgaa

SEQ ID NO: 365504 - DNA, 25 bp, Homo sapien
tctacgccttcctgagctcgcactt

SEQ ID NO: 365505 - DNA, 25 bp, Homo sapien
gggcggtctgtgaaacaccagccat

SEQ ID NO: 365506 - DNA, 25 bp, Homo sapien
agccatcccgtgaaagctcagcttg

SEQ ID NO: 365507 - DNA, 25 bp, Homo sapien
agcatacaaaacagacgccgaggtg

SEQ ID NO: 365508 - DNA, 25 bp, Homo sapien
agctcagcttgccactgtcatgtaa

SEQ ID NO: 365509 - DNA, 25 bp, Homo sapien
gcttgccactgtcatgtaacagggt

SEQ ID NO: 365510 - DNA, 25 bp, Homo sapien
gaggctcacacttgtcaccttcagc

SEQ ID NO: 365511 - DNA, 25 bp, Homo sapien
tgtcctgaggttttgttacaaggct

SEQ ID NO: 365512 - DNA, 25 bp, Homo sapien
gacgccgaggtgatcagtgattcca

SEQ ID NO: 365513 - DNA, 25 bp, Homo sapien
gattccaaaggctgacgctcagcag

SEQ ID NO: 365514 - DNA, 25 bp, Homo sapien
aaaggctgacgctcagcagcgccac

SEQ ID NO: 365515 - DNA, 25 bp, Homo sapien
atgccagccaactaggctacgggat

SEQ ID NO: 365516 - DNA, 25 bp, Homo sapien
ttgggaccagagacgacctgcctat

SEQ ID NO: 365517 - DNA, 25 bp, Homo sapien
agacgacctgcctatcacatcagct

SEQ ID NO: 365518 - DNA, 25 bp, Homo sapien
ggagtaactcctctgtcaaagccca

SEQ ID NO: 365519 - DNA, 25 bp, Homo sapien
aaagcccactagagagatcccagag

SEQ ID NO: 365520 - DNA, 25 bp, Homo sapien
cagagcctccctgggaatcatttta

SEQ ID NO: 365521 - DNA, 25 bp, Homo sapien
atatctgccagaaagtacctcttgt

SEQ ID NO: 365522 - DNA, 25 bp, Homo sapien
aaagtacctcttgtgctgccaaaga

SEQ ID NO: 365523 - DNA, 25 bp, Homo sapien
aagagaccattttcactattgtgct

SEQ ID NO: 365524 - DNA, 25 bp, Homo sapien
tattgtgcttcattctttagtcgtg

SEQ ID NO: 365525 - DNA, 25 bp, Homo sapien
agatgtaggcatgataccttagctg

SEQ ID NO: 365526 - DNA, 25 bp, Homo sapien
taagaccacacacttgggaccagag

SEQ ID NO: 365527 - DNA, 25 bp, Homo sapien
gaagtttacgcaaaaagagtacaca

SEQ ID NO: 365528 - DNA, 25 bp, Homo sapien
gcaaaaagagtacacagtttccaat

SEQ ID NO: 365529 - DNA, 25 bp, Homo sapien
agagtacacagtttccaatttaagt

SEQ ID NO: 365530 - DNA, 25 bp, Homo sapien
cacagtttccaatttaagtaggcag

SEQ ID NO: 365531 - DNA, 25 bp, Homo sapien
gtttccaatttaagtaggcagactg

SEQ ID NO: 365532 - DNA, 25 bp, Homo sapien
gtaggcagactgagcatgcccatca

SEQ ID NO: 365533 - DNA, 25 bp, Homo sapien
gcagactgagcatgcccatcagttt

SEQ ID NO: 365534 - DNA, 25 bp, Homo sapien
tattgctgcttccatccctcgaaat

SEQ ID NO: 365535 - DNA, 25 bp, Homo sapien
tgcttccatccctcgaaatgataga

SEQ ID NO: 365536 - DNA, 25 bp, Homo sapien
tccatccctcgaaatgatagaaaag

SEQ ID NO: 365537 - DNA, 25 bp, Homo sapien
ttgcagtgggccaggcatcatggct

SEQ ID NO: 365538 - DNA, 25 bp, Homo sapien
agcagctcatgtctcctcttagacc

SEQ ID NO: 365539 - DNA, 25 bp, Homo sapien
atgtctcctcttagaccctcagatt

SEQ ID NO: 365540 - DNA, 25 bp, Homo sapien
cagattcctcatctacagaaggaga

SEQ ID NO: 365541 - DNA, 25 bp, Homo sapien
ttaaggtctttatcagcttctaaaa

SEQ ID NO: 365542 - DNA, 25 bp, Homo sapien
agtttgatttgatggttgtaggagc

SEQ ID NO: 365543 - DNA, 25 bp, Homo sapien
gtaggagcaattgttctttcaaagc

SEQ ID NO: 365544 - DNA, 25 bp, Homo sapien
aaagcaccatcttctaacctcagga

SEQ ID NO: 365545 - DNA, 25 bp, Homo sapien
tggtggaaagactgcgggcctgccc

SEQ ID NO: 365546 - DNA, 25 bp, Homo sapien
gggcctgcccgtggagtctatgtct

SEQ ID NO: 365547 - DNA, 25 bp, Homo sapien
tggagtctatgtctggccctgccta

SEQ ID NO: 365548 - DNA, 25 bp, Homo sapien
tctggccctgcctagctcagtcaat

SEQ ID NO: 365549 - DNA, 25 bp, Homo sapien
aatgttgtcatccaggtggctttag

SEQ ID NO: 365550 - DNA, 25 bp, Homo sapien
catccaggtggctttagggtcctaa

SEQ ID NO: 365551 - DNA, 25 bp, Homo sapien
ggatggatctgtgtaggagttccct

SEQ ID NO: 365552 - DNA, 25 bp, Homo sapien
atctgtgtaggagttccctgtagat

SEQ ID NO: 365553 - DNA, 25 bp, Homo sapien
gagttccctgtagataaattactga

SEQ ID NO: 365554 - DNA, 25 bp, Homo sapien
cccatctactatccccagtatgtaa

SEQ ID NO: 365555 - DNA, 25 bp, Homo sapien
actatccccagtatgtaatggctga

SEQ ID NO: 365556 - DNA, 25 bp, Homo sapien
atatgtaatcaactgcattgtatct

SEQ ID NO: 365557 - DNA, 25 bp, Homo sapien
aactgcattgtatctaaagccttag

SEQ ID NO: 365558 - DNA, 25 bp, Homo sapien
aagccttagaactagtcaggtgctc

SEQ ID NO: 365559 - DNA, 25 bp, Homo sapien
tagaactagtcaggtgctccctcca

SEQ ID NO: 365560 - DNA, 25 bp, Homo sapien
gaactcaggcttggatttgaactct

SEQ ID NO: 365561 - DNA, 25 bp, Homo sapien
ggatttgaactctggttctatcaac

SEQ ID NO: 365562 - DNA, 25 bp, Homo sapien
tggttctatcaactattagctgtga

SEQ ID NO: 365563 - DNA, 25 bp, Homo sapien
attagctgtgatttcagatcagtga

SEQ ID NO: 365564 - DNA, 25 bp, Homo sapien
ttcagatcagtgacttgagcaattt

SEQ ID NO: 365565 - DNA, 25 bp, Homo sapien
tgagcaatttgtgccttgtttcatt

SEQ ID NO: 365566 - DNA, 25 bp, Homo sapien
gtgccttgtttcattaagtggagat

SEQ ID NO: 365567 - DNA, 25 bp, Homo sapien
tggagatgacaatagcacctgcctt

SEQ ID NO: 365568 - DNA, 25 bp, Homo sapien
aagaattatttgatgtggccgatga

SEQ ID NO: 365569 - DNA, 25 bp, Homo sapien
gatgtggccgatgagaaaaatcaga

SEQ ID NO: 365570 - DNA, 25 bp, Homo sapien
tgtgaagagccctctctaaatggcc

SEQ ID NO: 365571 - DNA, 25 bp, Homo sapien
ttctccagtgtaatttccggaagga

SEQ ID NO: 365572 - DNA, 25 bp, Homo sapien
tttctgttgcagtgggcacttagta

SEQ ID NO: 365573 - DNA, 25 bp, Homo sapien
gaaggaacaggcacagaacaggatt

SEQ ID NO: 365574 - DNA, 25 bp, Homo sapien
taaaggcattggttctgggtcaggc

SEQ ID NO: 365575 - DNA, 25 bp, Homo sapien
tctgggtcaggccatctgaacttga

SEQ ID NO: 365576 - DNA, 25 bp, Homo sapien
tctgaacttgagtcctttacctttt

SEQ ID NO: 365577 - DNA, 25 bp, Homo sapien
ttttagcctctatacccttatctgt

SEQ ID NO: 365578 - DNA, 25 bp, Homo sapien
tggagatagtaacatctaccccaca

SEQ ID NO: 365579 - DNA, 25 bp, Homo sapien
ctaccccacagagatgttttgagaa

SEQ ID NO: 365580 - DNA, 25 bp, Homo sapien
atatattgtaagcacctggcccgtg

SEQ ID NO: 365581 - DNA, 25 bp, Homo sapien
aaaataacccattgtatgcagcact

SEQ ID NO: 365582 - DNA, 25 bp, Homo sapien
gagcgaagctaaacgttgaaggtcc

SEQ ID NO: 365583 - DNA, 25 bp, Homo sapien
agctaaacgttgaaggtcctggttg

SEQ ID NO: 365584 - DNA, 25 bp, Homo sapien
tcctggttggagttggtggtcaact

SEQ ID NO: 365585 - DNA, 25 bp, Homo sapien
gtggtcaactccactgttgcttgga

SEQ ID NO: 365586 - DNA, 25 bp, Homo sapien
actccactgttgcttggatcactag

SEQ ID NO: 365587 - DNA, 25 bp, Homo sapien
actgttgcttggatcactaggcatt

SEQ ID NO: 365588 - DNA, 25 bp, Homo sapien
gatcactaggcattaaagggttctg

SEQ ID NO: 365589 - DNA, 25 bp, Homo sapien
gacagaaattcttgtattgcccatg

SEQ ID NO: 365590 - DNA, 25 bp, Homo sapien
gaaattcttgtattgcccatgcgag

SEQ ID NO: 365591 - DNA, 25 bp, Homo sapien
tcttgtattgcccatgcgagattcc

SEQ ID NO: 365592 - DNA, 25 bp, Homo sapien
attgcccatgcgagattccccaagt

SEQ ID NO: 365593 - DNA, 25 bp, Homo sapien
gtgtttgctctgattgtctacatta

SEQ ID NO: 365594 - DNA, 25 bp, Homo sapien
gtctacattagctcatatcagtctt

SEQ ID NO: 365595 - DNA, 25 bp, Homo sapien
tatcagtcttttgaacactggttca

SEQ ID NO: 365596 - DNA, 25 bp, Homo sapien
caaatctgggtgttgggttaggatc

SEQ ID NO: 365597 - DNA, 25 bp, Homo sapien
tactggtttctggtgtgattcttta

SEQ ID NO: 365598 - DNA, 25 bp, Homo sapien
gattctttagctacatttattcctt

SEQ ID NO: 365599 - DNA, 25 bp, Homo sapien
tattccttgtcttatgtcatttcac

SEQ ID NO: 365600 - DNA, 25 bp, Homo sapien
atatctccgcagagttctctggtag

SEQ ID NO: 365601 - DNA, 25 bp, Homo sapien
gtcatttcactggatcatgtaactg

SEQ ID NO: 365602 - DNA, 25 bp, Homo sapien
taaatgttctctgtgcactaggcca

SEQ ID NO: 365603 - DNA, 25 bp, Homo sapien
tgtgcactaggccaaggaagttcct

SEQ ID NO: 365604 - DNA, 25 bp, Homo sapien
gcaacataaaggaacctgcttagaa

SEQ ID NO: 365605 - DNA, 25 bp, Homo sapien
tttcctgaagtagaatccatagctc

SEQ ID NO: 365606 - DNA, 25 bp, Homo sapien
gaatccatagctcaaaacaagtttt

SEQ ID NO: 365607 - DNA, 25 bp, Homo sapien
ggtgttttttatgctcctaatgaaa

SEQ ID NO: 365608 - DNA, 25 bp, Homo sapien
gaatgcatcattaaaccttaacagt

SEQ ID NO: 365609 - DNA, 25 bp, Homo sapien
gtagagcagaatttcactgttacaa

SEQ ID NO: 365610 - DNA, 25 bp, Homo sapien
ttcactgttacaaaccacatgggtt

SEQ ID NO: 365611 - DNA, 25 bp, Homo sapien
acatgggttctcctggttgtgctgc

SEQ ID NO: 365612 - DNA, 25 bp, Homo sapien
aatgtaattcgtttgtgtgtctatt

SEQ ID NO: 365613 - DNA, 25 bp, Homo sapien
attaggcaggcaccacagacagtag

SEQ ID NO: 365614 - DNA, 25 bp, Homo sapien
gcaggcaccacagacagtagcaaca

SEQ ID NO: 365615 - DNA, 25 bp, Homo sapien
gtagcaggactgaattgtccccagt

SEQ ID NO: 365616 - DNA, 25 bp, Homo sapien
gaattgtccccagtttgcagaaaag

SEQ ID NO: 365617 - DNA, 25 bp, Homo sapien
tttgcagaaaagcacctgccgacct

SEQ ID NO: 365618 - DNA, 25 bp, Homo sapien
agtgccttacctcctgcccaggaga

SEQ ID NO: 365619 - DNA, 25 bp, Homo sapien
tgtcctcctcggatcaccgagagta

SEQ ID NO: 365620 - DNA, 25 bp, Homo sapien
gagaagcagtgagccgcatcttctc

SEQ ID NO: 365621 - DNA, 25 bp, Homo sapien
gcatcttctccatctggcagggtgg

SEQ ID NO: 365622 - DNA, 25 bp, Homo sapien
ttttcagaccccagcggctgagtca

SEQ ID NO: 365623 - DNA, 25 bp, Homo sapien
agcggctgagtcatgatctccctgc

SEQ ID NO: 365624 - DNA, 25 bp, Homo sapien
ctgccgcctcaatgtggttgcaagg

SEQ ID NO: 365625 - DNA, 25 bp, Homo sapien
aatgtggttgcaaggccgctgttca

SEQ ID NO: 365626 - DNA, 25 bp, Homo sapien
gagggacacaggctttattgaacag

SEQ ID NO: 365627 - DNA, 25 bp, Homo sapien
agggacacaggctttattgaacagg

SEQ ID NO: 365628 - DNA, 25 bp, Homo sapien
gggacacaggctttattgaacaggt

SEQ ID NO: 365629 - DNA, 25 bp, Homo sapien
ggacacaggctttattgaacaggtt

SEQ ID NO: 365630 - DNA, 25 bp, Homo sapien
gacacaggctttattgaacaggtta

SEQ ID NO: 365631 - DNA, 25 bp, Homo sapien
acacaggctttattgaacaggttaa

SEQ ID NO: 365632 - DNA, 25 bp, Homo sapien
cacaggctttattgaacaggttaag

SEQ ID NO: 365633 - DNA, 25 bp, Homo sapien
gaacaggttaaggtcaaacatttca

SEQ ID NO: 365634 - DNA, 25 bp, Homo sapien
caggttaaggtcaaacatttcagga

SEQ ID NO: 365635 - DNA, 25 bp, Homo sapien
ttaaggtcaaacatttcaggaaata

SEQ ID NO: 365636 - DNA, 25 bp, Homo sapien
atacattttgtatgaagttggattt

SEQ ID NO: 365637 - DNA, 25 bp, Homo sapien
ggaggaaggcgtcgcgggcgctctg

SEQ ID NO: 365638 - DNA, 25 bp, Homo sapien
gggcgggcgcgcagatggccactca

SEQ ID NO: 365639 - DNA, 25 bp, Homo sapien
cgcccggctagtgggcctcggattt

SEQ ID NO: 365640 - DNA, 25 bp, Homo sapien
agatggccactcaggtggagccgct

SEQ ID NO: 365641 - DNA, 25 bp, Homo sapien
atggccactcaggtggagccgctgc

SEQ ID NO: 365642 - DNA, 25 bp, Homo sapien
tggccactcaggtggagccgctgct

SEQ ID NO: 365643 - DNA, 25 bp, Homo sapien
ggcgccacgctcttgcaggccgaag

SEQ ID NO: 365644 - DNA, 25 bp, Homo sapien
gccacgctcttgcaggccgaagagc

SEQ ID NO: 365645 - DNA, 25 bp, Homo sapien
ggcctcggatttacggcggctgcat

SEQ ID NO: 365646 - DNA, 25 bp, Homo sapien
gatttacggcggctgcatctaactg

SEQ ID NO: 365647 - DNA, 25 bp, Homo sapien
tacggcggctgcatctaactgggag

SEQ ID NO: 365648 - DNA, 25 bp, Homo sapien
tagggtccagattgaactttaatat

SEQ ID NO: 365649 - DNA, 25 bp, Homo sapien
agggtccagattgaactttaatata

SEQ ID NO: 365650 - DNA, 25 bp, Homo sapien
gggtccagattgaactttaatatag

SEQ ID NO: 365651 - DNA, 25 bp, Homo sapien
aaccagtaagaataagattcggccg

SEQ ID NO: 365652 - DNA, 25 bp, Homo sapien
accagtaagaataagattcggccgg

SEQ ID NO: 365653 - DNA, 25 bp, Homo sapien
cagtaagaataagattcggccgggc

SEQ ID NO: 365654 - DNA, 25 bp, Homo sapien
agtaagaataagattcggccgggca

SEQ ID NO: 365655 - DNA, 25 bp, Homo sapien
aaattgttaacccatgtgcccattc

SEQ ID NO: 365656 - DNA, 25 bp, Homo sapien
aattgttaacccatgtgcccattcc

SEQ ID NO: 365657 - DNA, 25 bp, Homo sapien
attgttaacccatgtgcccattcct

SEQ ID NO: 365658 - DNA, 25 bp, Homo sapien
cctgagtagggcagactcttcacaa

SEQ ID NO: 365659 - DNA, 25 bp, Homo sapien
acaaaggaagaatttatctgtgcct

SEQ ID NO: 365660 - DNA, 25 bp, Homo sapien
aatttatctgtgcctctgagactag

SEQ ID NO: 365661 - DNA, 25 bp, Homo sapien
ggaatcttacccctaccactggact

SEQ ID NO: 365662 - DNA, 25 bp, Homo sapien
gaatcttacccctaccactggactg

SEQ ID NO: 365663 - DNA, 25 bp, Homo sapien
aatcttacccctaccactggactgt

SEQ ID NO: 365664 - DNA, 25 bp, Homo sapien
atcttacccctaccactggactgtt

SEQ ID NO: 365665 - DNA, 25 bp, Homo sapien
tcttacccctaccactggactgttt

SEQ ID NO: 365666 - DNA, 25 bp, Homo sapien
aactctgcatctcccacacagcata

SEQ ID NO: 365667 - DNA, 25 bp, Homo sapien
tctgcatctcccacacagcatatct

SEQ ID NO: 365668 - DNA, 25 bp, Homo sapien
gttgcttgataagtgtttaacaaat

SEQ ID NO: 365669 - DNA, 25 bp, Homo sapien
gaaggaggaggttgtagaagagaat

SEQ ID NO: 365670 - DNA, 25 bp, Homo sapien
gtgaaattgtgccaggtagttgtct

SEQ ID NO: 365671 - DNA, 25 bp, Homo sapien
gaaattgtgccaggtagttgtctaa

SEQ ID NO: 365672 - DNA, 25 bp, Homo sapien
aaattgtgccaggtagttgtctaaa

SEQ ID NO: 365673 - DNA, 25 bp, Homo sapien
aattgtgccaggtagttgtctaaat

SEQ ID NO: 365674 - DNA, 25 bp, Homo sapien
attgtgccaggtagttgtctaaata

SEQ ID NO: 365675 - DNA, 25 bp, Homo sapien
ttgtgccaggtagttgtctaaatat

SEQ ID NO: 365676 - DNA, 25 bp, Homo sapien
tgtgccaggtagttgtctaaatatg

SEQ ID NO: 365677 - DNA, 25 bp, Homo sapien
gccaggtagttgtctaaatatggac

SEQ ID NO: 365678 - DNA, 25 bp, Homo sapien
caggtagttgtctaaatatggacca

SEQ ID NO: 365679 - DNA, 25 bp, Homo sapien
ggtagttgtctaaatatggaccaat

SEQ ID NO: 365680 - DNA, 25 bp, Homo sapien
gttgtctaaatatggaccaattttg

SEQ ID NO: 365681 - DNA, 25 bp, Homo sapien
gtttcccacacgcagccatggtaca

SEQ ID NO: 365682 - DNA, 25 bp, Homo sapien
cacacgcagccatggtacagggcag

SEQ ID NO: 365683 - DNA, 25 bp, Homo sapien
gcagccatggtacagggcagctcat

SEQ ID NO: 365684 - DNA, 25 bp, Homo sapien
agccatggtacagggcagctcatcc

SEQ ID NO: 365685 - DNA, 25 bp, Homo sapien
tggttcccgtgctcctcggcctgtg

SEQ ID NO: 365686 - DNA, 25 bp, Homo sapien
gtggagggcacagccgtcagggaag

SEQ ID NO: 365687 - DNA, 25 bp, Homo sapien
cagggaaggccctcagctgcaggat

SEQ ID NO: 365688 - DNA, 25 bp, Homo sapien
ctgcaggatgccgtgcctcagagac

SEQ ID NO: 365689 - DNA, 25 bp, Homo sapien
gcaggatgccgtgcctcagagacca

SEQ ID NO: 365690 - DNA, 25 bp, Homo sapien
ctcagagaccaaccaggccctcgaa

SEQ ID NO: 365691 - DNA, 25 bp, Homo sapien
tgaagcgggcccagctccgttcact

SEQ ID NO: 365692 - DNA, 25 bp, Homo sapien
tcaaataagcttgcagttaagagaa

SEQ ID NO: 365693 - DNA, 25 bp, Homo sapien
gagaaaggcttttcttgggtaagag

SEQ ID NO: 365694 - DNA, 25 bp, Homo sapien
gtggcatttaaggtgtttagtgacc

SEQ ID NO: 365695 - DNA, 25 bp, Homo sapien
aaaccagttaagagggagagaatga

SEQ ID NO: 365696 - DNA, 25 bp, Homo sapien
atctcggaaagttgggaattcaagc

SEQ ID NO: 365697 - DNA, 25 bp, Homo sapien
aaggtgtttagtgaccattggcatg

SEQ ID NO: 365698 - DNA, 25 bp, Homo sapien
aagcatatatatgaatacagttaca

SEQ ID NO: 365699 - DNA, 25 bp, Homo sapien
acagttacattgagaacagtatata

SEQ ID NO: 365700 - DNA, 25 bp, Homo sapien
ccattggcatggtagggaaagttaa

SEQ ID NO: 365701 - DNA, 25 bp, Homo sapien
aaaggtctgccaaatagttgaaaga

SEQ ID NO: 365702 - DNA, 25 bp, Homo sapien
gtaaaattcaaataagcttgcagtt

SEQ ID NO: 365703 - DNA, 25 bp, Homo sapien
gatcagaaagacagacggcctctcc

SEQ ID NO: 365704 - DNA, 25 bp, Homo sapien
ggcctctccctcaggtttgccgagg

SEQ ID NO: 365705 - DNA, 25 bp, Homo sapien
aagaaacagggagcgccttcagcag

SEQ ID NO: 365706 - DNA, 25 bp, Homo sapien
gccttcagcagtctatgcggttata

SEQ ID NO: 365707 - DNA, 25 bp, Homo sapien
ggaacctgctaaaacccgagagata

SEQ ID NO: 365708 - DNA, 25 bp, Homo sapien
gcggttataggccattttcttgttt

SEQ ID NO: 365709 - DNA, 25 bp, Homo sapien
gaagaaagtctcatcttccctccct

SEQ ID NO: 365710 - DNA, 25 bp, Homo sapien
ctcgccactttgtctatttgttttg

SEQ ID NO: 365711 - DNA, 25 bp, Homo sapien
gggtccgcttatgagtttagctccg

SEQ ID NO: 365712 - DNA, 25 bp, Homo sapien
gtttagctccggttatagacaacag

SEQ ID NO: 365713 - DNA, 25 bp, Homo sapien
gacaacagtgtcaggtaagctgatc

SEQ ID NO: 365714 - DNA, 25 bp, Homo sapien
gggatcttcgttagcttccaaacac

SEQ ID NO: 365715 - DNA, 25 bp, Homo sapien
tagcttccaaacacatctcctggaa

SEQ ID NO: 365716 - DNA, 25 bp, Homo sapien
tctcctggaattcttagagtgccga

SEQ ID NO: 365717 - DNA, 25 bp, Homo sapien
gaattcttagagtgccgatgtgggt

SEQ ID NO: 365718 - DNA, 25 bp, Homo sapien
gagccccaaacttccatctggacag

SEQ ID NO: 365719 - DNA, 25 bp, Homo sapien
aacttccatctggacagcagctgga

SEQ ID NO: 365720 - DNA, 25 bp, Homo sapien
aaggagagtcttttcctgggcagca

SEQ ID NO: 365721 - DNA, 25 bp, Homo sapien
tttcctgggcagcagtgctcaggac

SEQ ID NO: 365722 - DNA, 25 bp, Homo sapien
tcaggacaggctctgaagaacctgt

SEQ ID NO: 365723 - DNA, 25 bp, Homo sapien
gaagaacctgtcaaatgtcattcag

SEQ ID NO: 365724 - DNA, 25 bp, Homo sapien
agacatgcaaacagggttctcagtg

SEQ ID NO: 365725 - DNA, 25 bp, Homo sapien
ttcccaattccccagcaattaagat

SEQ ID NO: 365726 - DNA, 25 bp, Homo sapien
ttccccagcaattaagatttcgagc

SEQ ID NO: 365727 - DNA, 25 bp, Homo sapien
gatttcgagcagaatttatctaaat

SEQ ID NO: 365728 - DNA, 25 bp, Homo sapien
aaggaaacacaatcgctgaaccaaa

SEQ ID NO: 365729 - DNA, 25 bp, Homo sapien
gaaccaaaacgtactgcagccgagc

SEQ ID NO: 365730 - DNA, 25 bp, Homo sapien
acgggcaaaataattgtgctggatt

SEQ ID NO: 365731 - DNA, 25 bp, Homo sapien
ttgtgctggattctcacacacacag

SEQ ID NO: 365732 - DNA, 25 bp, Homo sapien
gaagaccccagtggtgggaccctgg

SEQ ID NO: 365733 - DNA, 25 bp, Homo sapien
accctggaccaggccatggatgaag

SEQ ID NO: 365734 - DNA, 25 bp, Homo sapien
atgaaggacaaagaccagggcaggt

SEQ ID NO: 365735 - DNA, 25 bp, Homo sapien
cagggcaggtcacgggtttcccaat

SEQ ID NO: 365736 - DNA, 25 bp, Homo sapien
taagatatgaatggtgcacaatggg

SEQ ID NO: 365737 - DNA, 25 bp, Homo sapien
agagtttccacatatatccattcaa

SEQ ID NO: 365738 - DNA, 25 bp, Homo sapien
atccattcaaagtacctagtgaggt

SEQ ID NO: 365739 - DNA, 25 bp, Homo sapien
gtctgggtaggaataggtcaagctt

SEQ ID NO: 365740 - DNA, 25 bp, Homo sapien
taggtcaagcttcagtctagtcgcc

SEQ ID NO: 365741 - DNA, 25 bp, Homo sapien
aagcttcagtctagtcgccagagat

SEQ ID NO: 365742 - DNA, 25 bp, Homo sapien
tctagtcgccagagatttgtgttca

SEQ ID NO: 365743 - DNA, 25 bp, Homo sapien
gaattctaaatttaaacaggactct

SEQ ID NO: 365744 - DNA, 25 bp, Homo sapien
aacaggactcttcaggtcatttttt

SEQ ID NO: 365745 - DNA, 25 bp, Homo sapien
agcagggctcttcccaacatccatt

SEQ ID NO: 365746 - DNA, 25 bp, Homo sapien
tcttcccaacatccattcaactggg

SEQ ID NO: 365747 - DNA, 25 bp, Homo sapien
cttgggcatctagctttactttgaa

SEQ ID NO: 365748 - DNA, 25 bp, Homo sapien
ggtatggccgtcaaacttcggcata

SEQ ID NO: 365749 - DNA, 25 bp, Homo sapien
gctttactttgaacacactctctag

SEQ ID NO: 365750 - DNA, 25 bp, Homo sapien
gaacacactctctagtaattctgat

SEQ ID NO: 365751 - DNA, 25 bp, Homo sapien
tgtattggaaagaactcaggccctt

SEQ ID NO: 365752 - DNA, 25 bp, Homo sapien
tcaggccctttggagccatgaaaga

SEQ ID NO: 365753 - DNA, 25 bp, Homo sapien
ctggatttgaattctgattctgcca

SEQ ID NO: 365754 - DNA, 25 bp, Homo sapien
caaattacttacctctctgcaccat

SEQ ID NO: 365755 - DNA, 25 bp, Homo sapien
cagggttgcctaggaagttgctcaa

SEQ ID NO: 365756 - DNA, 25 bp, Homo sapien
aaacatatgtcctgaccctggaaat

SEQ ID NO: 365757 - DNA, 25 bp, Homo sapien
ctggaaattctcattcagcagtgtc

SEQ ID NO: 365758 - DNA, 25 bp, Homo sapien
gagggacacaggctttattgaacag

SEQ ID NO: 365759 - DNA, 25 bp, Homo sapien
agggacacaggctttattgaacagg

SEQ ID NO: 365760 - DNA, 25 bp, Homo sapien
gggacacaggctttattgaacaggt

SEQ ID NO: 365761 - DNA, 25 bp, Homo sapien
ggacacaggctttattgaacaggtt

SEQ ID NO: 365762 - DNA, 25 bp, Homo sapien
gacacaggctttattgaacaggtta

SEQ ID NO: 365763 - DNA, 25 bp, Homo sapien
acacaggctttattgaacaggttaa

SEQ ID NO: 365764 - DNA, 25 bp, Homo sapien
cacaggctttattgaacaggttaag

SEQ ID NO: 365765 - DNA, 25 bp, Homo sapien
gaacaggttaaggtcaaacatttca

SEQ ID NO: 365766 - DNA, 25 bp, Homo sapien
caggttaaggtcaaacatttcagga

SEQ ID NO: 365767 - DNA, 25 bp, Homo sapien
ttaaggtcaaacatttcaggaaata

SEQ ID NO: 365768 - DNA, 25 bp, Homo sapien
acattttgtatgaagttggattttt

SEQ ID NO: 365769 - DNA, 25 bp, Homo sapien
tattacaaggtgagtcccagcctcg

SEQ ID NO: 365770 - DNA, 25 bp, Homo sapien
atcactctgaccctgcgtgtgtttg

SEQ ID NO: 365771 - DNA, 25 bp, Homo sapien
ggtgggtgatttctgaacgtcccca

SEQ ID NO: 365772 - DNA, 25 bp, Homo sapien
aacgtccccatgtgttcagggcgaa

SEQ ID NO: 365773 - DNA, 25 bp, Homo sapien
ccccatgtgttcagggcgaagttcg

SEQ ID NO: 365774 - DNA, 25 bp, Homo sapien
gcgaagttcggtggccagaatgtca

SEQ ID NO: 365775 - DNA, 25 bp, Homo sapien
agaatgtcagagtggcttttctcag

SEQ ID NO: 365776 - DNA, 25 bp, Homo sapien
tttctcagttcctattctcattcgt

SEQ ID NO: 365777 - DNA, 25 bp, Homo sapien
tcctattctcattcgtctcggatga

SEQ ID NO: 365778 - DNA, 25 bp, Homo sapien
cattcgtctcggatgatggtttttt

SEQ ID NO: 365779 - DNA, 25 bp, Homo sapien
tttctccttttcttattcacggcac

SEQ ID NO: 365780 - DNA, 25 bp, Homo sapien
cttgaatcataccattttaagagta

SEQ ID NO: 365781 - DNA, 25 bp, Homo sapien
tttaagagtaattgcttaccacttt

SEQ ID NO: 365782 - DNA, 25 bp, Homo sapien
gcttaccactttctcttccaaaatt

SEQ ID NO: 365783 - DNA, 25 bp, Homo sapien
tcttccaaaatttagacttaccaag

SEQ ID NO: 365784 - DNA, 25 bp, Homo sapien
tagacttaccaagtatacttaacta

SEQ ID NO: 365785 - DNA, 25 bp, Homo sapien
actaaatttaacgagacgtgtctat

SEQ ID NO: 365786 - DNA, 25 bp, Homo sapien
gagacgtgtctatattgagtatact

SEQ ID NO: 365787 - DNA, 25 bp, Homo sapien
gaatttattggcatgtttgagacag

SEQ ID NO: 365788 - DNA, 25 bp, Homo sapien
ggcatgtttgagacagcgtagtaat

SEQ ID NO: 365789 - DNA, 25 bp, Homo sapien
tgagacagcgtagtaatggtaaaat

SEQ ID NO: 365790 - DNA, 25 bp, Homo sapien
gacacaaacattgtcaaagttttcc

SEQ ID NO: 365791 - DNA, 25 bp, Homo sapien
acagaactcctttttcattccatgc

SEQ ID NO: 365792 - DNA, 25 bp, Homo sapien
tttttcattccatgcccacagtcca

SEQ ID NO: 365793 - DNA, 25 bp, Homo sapien
cacagtccaattccaagaaatgtta

SEQ ID NO: 365794 - DNA, 25 bp, Homo sapien
gaagtatttgatgcaacaactgact

SEQ ID NO: 365795 - DNA, 25 bp, Homo sapien
aactgacttcaggacccttgtagtg

SEQ ID NO: 365796 - DNA, 25 bp, Homo sapien
gacccttgtagtgcttcccggacat

SEQ ID NO: 365797 - DNA, 25 bp, Homo sapien
cggacatcctctgggttcatgaaga

SEQ ID NO: 365798 - DNA, 25 bp, Homo sapien
tcatgaagacacttgccccggcagc

SEQ ID NO: 365799 - DNA, 25 bp, Homo sapien
ggcagcccgagtttggagctccgaa

SEQ ID NO: 365800 - DNA, 25 bp, Homo sapien
tttggagctccgaagcaccgttgct

SEQ ID NO: 365801 - DNA, 25 bp, Homo sapien
gtcaaagccgccgagatcggtgatg

SEQ ID NO: 365802 - DNA, 25 bp, Homo sapien
gggaatgtggtgtttcaaactcctg

SEQ ID NO: 365803 - DNA, 25 bp, Homo sapien
cattttagtttttgtctcctgagat

SEQ ID NO: 365804 - DNA, 25 bp, Homo sapien
aagtaccacatttctatgtattcat

SEQ ID NO: 365805 - DNA, 25 bp, Homo sapien
atgtattcattagaatgcctggaaa

SEQ ID NO: 365806 - DNA, 25 bp, Homo sapien
tttcctgatagatttctctctgatt

SEQ ID NO: 365807 - DNA, 25 bp, Homo sapien
atttctctctgattatgttgtagct

SEQ ID NO: 365808 - DNA, 25 bp, Homo sapien
tatgttgtagctaaagcagcaggga

SEQ ID NO: 365809 - DNA, 25 bp, Homo sapien
gggaacgaccttttctgcagggcag

SEQ ID NO: 365810 - DNA, 25 bp, Homo sapien
aactcctgggagtatgagcttcttc

SEQ ID NO: 365811 - DNA, 25 bp, Homo sapien
ggagtatgagcttcttcctccacaa

SEQ ID NO: 365812 - DNA, 25 bp, Homo sapien
atagcatttctacacaagaggttga

SEQ ID NO: 365813 - DNA, 25 bp, Homo sapien
tacttatgagatgggtgtcactgtc

SEQ ID NO: 365814 - DNA, 25 bp, Homo sapien
gtgtcactgtctgaaggttctccaa

SEQ ID NO: 365815 - DNA, 25 bp, Homo sapien
gaaggttctccaaattgtctgtgaa

SEQ ID NO: 365816 - DNA, 25 bp, Homo sapien
aattgtctgtgaactgcttaggtag

SEQ ID NO: 365817 - DNA, 25 bp, Homo sapien
aggagtgcactgcagtttcctgcta

SEQ ID NO: 365818 - DNA, 25 bp, Homo sapien
ccaactttgcttctagatctctggg

SEQ ID NO: 365819 - DNA, 25 bp, Homo sapien
gcctccttggtctggagaagagatc

SEQ ID NO: 365820 - DNA, 25 bp, Homo sapien
gagaagagatctgaggtcccacctt

SEQ ID NO: 365821 - DNA, 25 bp, Homo sapien
tgaggtcccaccttagaaatgaaag

SEQ ID NO: 365822 - DNA, 25 bp, Homo sapien
aaaccctcagggagccatgacccag

SEQ ID NO: 365823 - DNA, 25 bp, Homo sapien
catgtttgttacttgttatccctcc

SEQ ID NO: 365824 - DNA, 25 bp, Homo sapien
atacaaaccgcttcatgtctgtcat

SEQ ID NO: 365825 - DNA, 25 bp, Homo sapien
tgtctgtcattttcgtcaaccctgg

SEQ ID NO: 365826 - DNA, 25 bp, Homo sapien
ggtccttcaaatgccttttgttcct

SEQ ID NO: 365827 - DNA, 25 bp, Homo sapien
ttttgttccttctcatttacttcac

SEQ ID NO: 365828 - DNA, 25 bp, Homo sapien
ttacttcaccttgacttttcaagac

SEQ ID NO: 365829 - DNA, 25 bp, Homo sapien
gacatattggttatactacacagtt

SEQ ID NO: 365830 - DNA, 25 bp, Homo sapien
actacacagttggttacatttgaag

SEQ ID NO: 365831 - DNA, 25 bp, Homo sapien
cagattctgttatctttcacccaac

SEQ ID NO: 365832 - DNA, 25 bp, Homo sapien
ttatctttcacccaacagagacaag

SEQ ID NO: 365833 - DNA, 25 bp, Homo sapien
gatctctataaaccagcagtccttc

SEQ ID NO: 365834 - DNA, 25 bp, Homo sapien
cagtccttccccaaatacgtagtat

SEQ ID NO: 365835 - DNA, 25 bp, Homo sapien
ttcttccttctcttgaggatcatga

SEQ ID NO: 365836 - DNA, 25 bp, Homo sapien
atcttaagttgttaatcctgctctc

SEQ ID NO: 365837 - DNA, 25 bp, Homo sapien
taagttgttaatcctgctctcaaga

SEQ ID NO: 365838 - DNA, 25 bp, Homo sapien
gttgttaatcctgctctcaagatgt

SEQ ID NO: 365839 - DNA, 25 bp, Homo sapien
taatcctgctctcaagatgtaagta

SEQ ID NO: 365840 - DNA, 25 bp, Homo sapien
cttccttctcttgaggatcatgaaa

SEQ ID NO: 365841 - DNA, 25 bp, Homo sapien
caagatgtaagtaaggtgtgtttca

SEQ ID NO: 365842 - DNA, 25 bp, Homo sapien
gtaaggtgtgtttcagacattatta

SEQ ID NO: 365843 - DNA, 25 bp, Homo sapien
atagtggtatttgtaccaaaacact

SEQ ID NO: 365844 - DNA, 25 bp, Homo sapien
actagtatctcattacttaccatga

SEQ ID NO: 365845 - DNA, 25 bp, Homo sapien
tacttaccatgatatataacactgt

SEQ ID NO: 365846 - DNA, 25 bp, Homo sapien
ctggcccacttctagctagttatat

SEQ ID NO: 365847 - DNA, 25 bp, Homo sapien
tatatgcttgggtgagtcacgccct

SEQ ID NO: 365848 - DNA, 25 bp, Homo sapien
gcaacttacaagtgttttctcccac

SEQ ID NO: 365849 - DNA, 25 bp, Homo sapien
gtgttttctcccactgaagagcaag

SEQ ID NO: 365850 - DNA, 25 bp, Homo sapien
agagcaagctggaccaatacgttct

SEQ ID NO: 365851 - DNA, 25 bp, Homo sapien
tggaccaatacgttctgcagctaaa

SEQ ID NO: 365852 - DNA, 25 bp, Homo sapien
atcaaacaagggtctctccctagac

SEQ ID NO: 365853 - DNA, 25 bp, Homo sapien
tctctccctagacccttgtaaaata

SEQ ID NO: 365854 - DNA, 25 bp, Homo sapien
gaagtttcacaatgtaagttctccc

SEQ ID NO: 365855 - DNA, 25 bp, Homo sapien
aatatctccaaatcagtggtacctg

SEQ ID NO: 365856 - DNA, 25 bp, Homo sapien
cagtggtacctgctaccctgtatat

SEQ ID NO: 365857 - DNA, 25 bp, Homo sapien
gatagagtcataatggcaacctcca

SEQ ID NO: 365858 - DNA, 25 bp, Homo sapien
gtcataatggcaacctccaagccct

SEQ ID NO: 365859 - DNA, 25 bp, Homo sapien
cttgattaagaacacaggtagacat

SEQ ID NO: 365860 - DNA, 25 bp, Homo sapien
caggtagacatgaatcccaattgtc

SEQ ID NO: 365861 - DNA, 25 bp, Homo sapien
catgaatcccaattgtctattgcta

SEQ ID NO: 365862 - DNA, 25 bp, Homo sapien
gctatcttatttatatgattcggga

SEQ ID NO: 365863 - DNA, 25 bp, Homo sapien
tgattcgggaaaatacagcatgtaa

SEQ ID NO: 365864 - DNA, 25 bp, Homo sapien
gaggagcctcagtgattgggtacaa

SEQ ID NO: 365865 - DNA, 25 bp, Homo sapien
aagagtacagaaattatttttgcca

SEQ ID NO: 365866 - DNA, 25 bp, Homo sapien
attcctgagtgcattttcttacaac

SEQ ID NO: 365867 - DNA, 25 bp, Homo sapien
caactttttgactgcttccttttct

SEQ ID NO: 365868 - DNA, 25 bp, Homo sapien
cagggtattgataaagagtgggctc

SEQ ID NO: 365869 - DNA, 25 bp, Homo sapien
agagtgggctcattgttatggcaaa

SEQ ID NO: 365870 - DNA, 25 bp, Homo sapien
ggcaaaggattcacttgcatctctg

SEQ ID NO: 365871 - DNA, 25 bp, Homo sapien
gattcacttgcatctctgtgttttt

SEQ ID NO: 365872 - DNA, 25 bp, Homo sapien
ttttttgcactcagtcacatgatta

SEQ ID NO: 365873 - DNA, 25 bp, Homo sapien
gcactcagtcacatgattaaagcag

SEQ ID NO: 365874 - DNA, 25 bp, Homo sapien
gagatcagttattcatttataccat

SEQ ID NO: 365875 - DNA, 25 bp, Homo sapien
taaaaaaatattgagccaggccctg

SEQ ID NO: 365876 - DNA, 25 bp, Homo sapien
ccagagcggcgtggctgatagtcta

SEQ ID NO: 365877 - DNA, 25 bp, Homo sapien
ggctgatagtctagggcagtgctat

SEQ ID NO: 365878 - DNA, 25 bp, Homo sapien
agggcagtgctatccaatcttttgg

SEQ ID NO: 365879 - DNA, 25 bp, Homo sapien
tgtggggagccaggcttccctcacg

SEQ ID NO: 365880 - DNA, 25 bp, Homo sapien
gatgtgggaaggagatcaacttctc

SEQ ID NO: 365881 - DNA, 25 bp, Homo sapien
gggaaggagatcaacttctcctcac

SEQ ID NO: 365882 - DNA, 25 bp, Homo sapien
gaaggagatcaacttctcctcactc

SEQ ID NO: 365883 - DNA, 25 bp, Homo sapien
aggagatcaacttctcctcactctg

SEQ ID NO: 365884 - DNA, 25 bp, Homo sapien
ttctcctcactctgggacagacgat

SEQ ID NO: 365885 - DNA, 25 bp, Homo sapien
tcctcactctgggacagacgatgta

SEQ ID NO: 365886 - DNA, 25 bp, Homo sapien
cctcactctgggacagacgatgtat

SEQ ID NO: 365887 - DNA, 25 bp, Homo sapien
actctgggacagacgatgtatggaa

SEQ ID NO: 365888 - DNA, 25 bp, Homo sapien
ctgggacagacgatgtatggaaact

SEQ ID NO: 365889 - DNA, 25 bp, Homo sapien
gacagacgatgtatggaaactaaaa

SEQ ID NO: 365890 - DNA, 25 bp, Homo sapien
aaatgtgatcagactttcctattag

SEQ ID NO: 365891 - DNA, 25 bp, Homo sapien
tttcctattagatatggctcttctg

SEQ ID NO: 365892 - DNA, 25 bp, Homo sapien
atatggctcttctgtctcttgttat

SEQ ID NO: 365893 - DNA, 25 bp, Homo sapien
ctgacagctctgccataaagtccct

SEQ ID NO: 365894 - DNA, 25 bp, Homo sapien
atccttcccaaacaggctgtataag

SEQ ID NO: 365895 - DNA, 25 bp, Homo sapien
aagtgctttgaggtaattaaactct

SEQ ID NO: 365896 - DNA, 25 bp, Homo sapien
aaatataggcattcagccagattaa

SEQ ID NO: 365897 - DNA, 25 bp, Homo sapien
aaccccaaaagcattgtccagggat

SEQ ID NO: 365898 - DNA, 25 bp, Homo sapien
attgtccagggatatagattttacc

SEQ ID NO: 365899 - DNA, 25 bp, Homo sapien
tatagattttaccaaaggcttcctg

SEQ ID NO: 365900 - DNA, 25 bp, Homo sapien
gacgagggagcaacactttagatta

SEQ ID NO: 365901 - DNA, 25 bp, Homo sapien
ggaggaaggcgtcgcgggcgctctg

SEQ ID NO: 365902 - DNA, 25 bp, Homo sapien
ggaaggcgtcgcgggcgctctgcta

SEQ ID NO: 365903 - DNA, 25 bp, Homo sapien
gggcgggcgcgcagatggccactca

SEQ ID NO: 365904 - DNA, 25 bp, Homo sapien
gggcgcgcagatggccactcaggtg

SEQ ID NO: 365905 - DNA, 25 bp, Homo sapien
agatggccactcaggtggagccgct

SEQ ID NO: 365906 - DNA, 25 bp, Homo sapien
atggccactcaggtggagccgctgc

SEQ ID NO: 365907 - DNA, 25 bp, Homo sapien
tggccactcaggtggagccgctgct

SEQ ID NO: 365908 - DNA, 25 bp, Homo sapien
gccactcaggtggagccgctgctgc

SEQ ID NO: 365909 - DNA, 25 bp, Homo sapien
ggcgccacgctcttgcaggccgaag

SEQ ID NO: 365910 - DNA, 25 bp, Homo sapien
gcgccacgctcttgcaggccgaaga

SEQ ID NO: 365911 - DNA, 25 bp, Homo sapien
gccacgctcttgcaggccgaagagc

SEQ ID NO: 365912 - DNA, 25 bp, Homo sapien
ttggccacgggcaaaagaattttgt

SEQ ID NO: 365913 - DNA, 25 bp, Homo sapien
tggccacgggcaaaagaattttgtt

SEQ ID NO: 365914 - DNA, 25 bp, Homo sapien
gccacgggcaaaagaattttgttga

SEQ ID NO: 365915 - DNA, 25 bp, Homo sapien
gcaaaagaattttgttgagggcaaa

SEQ ID NO: 365916 - DNA, 25 bp, Homo sapien
ttgagggcaaataatatgagaccac

SEQ ID NO: 365917 - DNA, 25 bp, Homo sapien
gagggcaaataatatgagaccacaa

SEQ ID NO: 365918 - DNA, 25 bp, Homo sapien
gggcaaataatatgagaccacaaaa

SEQ ID NO: 365919 - DNA, 25 bp, Homo sapien
taatatgagaccacaaaactgcctt

SEQ ID NO: 365920 - DNA, 25 bp, Homo sapien
aatatgagaccacaaaactgccttc

SEQ ID NO: 365921 - DNA, 25 bp, Homo sapien
atatgagaccacaaaactgccttcc

SEQ ID NO: 365922 - DNA, 25 bp, Homo sapien
tatgagaccacaaaactgccttccc

SEQ ID NO: 365923 - DNA, 25 bp, Homo sapien
ttaaaatgctagtaccaggtggaac

SEQ ID NO: 365924 - DNA, 25 bp, Homo sapien
aggtggaacgctatttctgcaacag

SEQ ID NO: 365925 - DNA, 25 bp, Homo sapien
gctatttctgcaacaggactctgtc

SEQ ID NO: 365926 - DNA, 25 bp, Homo sapien
aggactctgtccatttcctttggaa

SEQ ID NO: 365927 - DNA, 25 bp, Homo sapien
ggctcttccaaggaatgacaccttt

SEQ ID NO: 365928 - DNA, 25 bp, Homo sapien
aatgacacctttacttgacaccctt

SEQ ID NO: 365929 - DNA, 25 bp, Homo sapien
gacacccttcggcatacaaatgatt

SEQ ID NO: 365930 - DNA, 25 bp, Homo sapien
tgattttaccaatagccatgattat

SEQ ID NO: 365931 - DNA, 25 bp, Homo sapien
taacaggcgtgggtgtttctccaaa

SEQ ID NO: 365932 - DNA, 25 bp, Homo sapien
aattattcatgcacaaggcagccca

SEQ ID NO: 365933 - DNA, 25 bp, Homo sapien
atgcacaaggcagcccaaagcttca

SEQ ID NO: 365934 - DNA, 25 bp, Homo sapien
ccaaagcggcgggattcagagctgc

SEQ ID NO: 365935 - DNA, 25 bp, Homo sapien
gcgggattcagagctgcgagaacac

SEQ ID NO: 365936 - DNA, 25 bp, Homo sapien
attcagagctgcgagaacactggaa

SEQ ID NO: 365937 - DNA, 25 bp, Homo sapien
gctgcgagaacactggaagctcccc

SEQ ID NO: 365938 - DNA, 25 bp, Homo sapien
ggctcatggcgccttctttattgtc

SEQ ID NO: 365939 - DNA, 25 bp, Homo sapien
agcagcggcgacaccttgggtgcaa

SEQ ID NO: 365940 - DNA, 25 bp, Homo sapien
cggcgacaccttgggtgcaagcggg

SEQ ID NO: 365941 - DNA, 25 bp, Homo sapien
tcatggcgccttctttattgtccac

SEQ ID NO: 365942 - DNA, 25 bp, Homo sapien
atggcgccttctttattgtccaccc

SEQ ID NO: 365943 - DNA, 25 bp, Homo sapien
aaatgacaaaactacccacatccca

SEQ ID NO: 365944 - DNA, 25 bp, Homo sapien
atgacaaaactacccacatcccatg

SEQ ID NO: 365945 - DNA, 25 bp, Homo sapien
ctctttaccactccgagggaactat

SEQ ID NO: 365946 - DNA, 25 bp, Homo sapien
cactccgagggaactatgctagctg

SEQ ID NO: 365947 - DNA, 25 bp, Homo sapien
gaactatgctagctgtcttattcct

SEQ ID NO: 365948 - DNA, 25 bp, Homo sapien
aggatctctcaagaaaatccatcct

SEQ ID NO: 365949 - DNA, 25 bp, Homo sapien
attcctctccaaataagaaagtctg

SEQ ID NO: 365950 - DNA, 25 bp, Homo sapien
gaaagtctgattgctatctgaggaa

SEQ ID NO: 365951 - DNA, 25 bp, Homo sapien
ggaagaagcccccatcaaatacagt

SEQ ID NO: 365952 - DNA, 25 bp, Homo sapien
ggctgcttatttgagcaatcacgat

SEQ ID NO: 365953 - DNA, 25 bp, Homo sapien
gttttgtctacattcaggaggtcag

SEQ ID NO: 365954 - DNA, 25 bp, Homo sapien
aggaagaactccactagccatcata

SEQ ID NO: 365955 - DNA, 25 bp, Homo sapien
actagccatcataagttgtcctctt

SEQ ID NO: 365956 - DNA, 25 bp, Homo sapien
taaaggatccacaaaagttctctag

SEQ ID NO: 365957 - DNA, 25 bp, Homo sapien
aaaagttctctagggacatagtcaa

SEQ ID NO: 365958 - DNA, 25 bp, Homo sapien
tctctagggacatagtcaaaaactg

SEQ ID NO: 365959 - DNA, 25 bp, Homo sapien
ggtccgaaataaatatccttccagt

SEQ ID NO: 365960 - DNA, 25 bp, Homo sapien
aataaatatccttccagtgttcagt

SEQ ID NO: 365961 - DNA, 25 bp, Homo sapien
gttttactgaacacatctcatggct

SEQ ID NO: 365962 - DNA, 25 bp, Homo sapien
catctcatggctttgggtttaactg

SEQ ID NO: 365963 - DNA, 25 bp, Homo sapien
gggtttaactgaataattcctcact

SEQ ID NO: 365964 - DNA, 25 bp, Homo sapien
tgaataattcctcactgggcacggt

SEQ ID NO: 365965 - DNA, 25 bp, Homo sapien
ttttctgggacaaagtctcactgca

SEQ ID NO: 365966 - DNA, 25 bp, Homo sapien
gggacaaagtctcactgcattccag

SEQ ID NO: 365967 - DNA, 25 bp, Homo sapien
tcggaattgccagccaaattattgg

SEQ ID NO: 365968 - DNA, 25 bp, Homo sapien
tggaggaatgttataccagatccct

SEQ ID NO: 365969 - DNA, 25 bp, Homo sapien
tgcggaccctacaaaccacctggta

SEQ ID NO: 365970 - DNA, 25 bp, Homo sapien
caaaccacctggtatcttaaagcag

SEQ ID NO: 365971 - DNA, 25 bp, Homo sapien
aaagcaggatattcctatccataaa

SEQ ID NO: 365972 - DNA, 25 bp, Homo sapien
gatgatcgtggtcatgacactattg

SEQ ID NO: 365973 - DNA, 25 bp, Homo sapien
ggagctggagcctatgctgacgata

SEQ ID NO: 365974 - DNA, 25 bp, Homo sapien
gagcctatgctgacgatactgcagg

SEQ ID NO: 365975 - DNA, 25 bp, Homo sapien
cgcagccactgggaatggtgatata

SEQ ID NO: 365976 - DNA, 25 bp, Homo sapien
ggtgatatattgatgcgcttcctgc

SEQ ID NO: 365977 - DNA, 25 bp, Homo sapien
ggagaagatccaaccatagcttgcc

SEQ ID NO: 365978 - DNA, 25 bp, Homo sapien
atatttccagttaacgtgtgtgaag

SEQ ID NO: 365979 - DNA, 25 bp, Homo sapien
tatttccagttaacgtgtgtgaagt

SEQ ID NO: 365980 - DNA, 25 bp, Homo sapien
atttccagttaacgtgtgtgaagtg

SEQ ID NO: 365981 - DNA, 25 bp, Homo sapien
tttccagttaacgtgtgtgaagtgg

SEQ ID NO: 365982 - DNA, 25 bp, Homo sapien
ttccagttaacgtgtgtgaagtggg

SEQ ID NO: 365983 - DNA, 25 bp, Homo sapien
tccagttaacgtgtgtgaagtgggt

SEQ ID NO: 365984 - DNA, 25 bp, Homo sapien
ccagttaacgtgtgtgaagtgggtt

SEQ ID NO: 365985 - DNA, 25 bp, Homo sapien
cagttaacgtgtgtgaagtgggttt

SEQ ID NO: 365986 - DNA, 25 bp, Homo sapien
gtctctttaagttctagcaatgtga

SEQ ID NO: 365987 - DNA, 25 bp, Homo sapien
gaggctcagatacattaagtaattc

SEQ ID NO: 365988 - DNA, 25 bp, Homo sapien
acacagctagaactggcaaagcctg

SEQ ID NO: 365989 - DNA, 25 bp, Homo sapien
gcaaagcctgggattgatccatgat

SEQ ID NO: 365990 - DNA, 25 bp, Homo sapien
tgatccatgatcttccagcattgaa

SEQ ID NO: 365991 - DNA, 25 bp, Homo sapien
aaataactgcaaggccttttcctca

SEQ ID NO: 365992 - DNA, 25 bp, Homo sapien
taacaacgtctagtgtcaattctat

SEQ ID NO: 365993 - DNA, 25 bp, Homo sapien
gtcaattctatacttgttatggtca

SEQ ID NO: 365994 - DNA, 25 bp, Homo sapien
atggtcaagtactgggctcagcatt

SEQ ID NO: 365995 - DNA, 25 bp, Homo sapien
tactgggctcagcattttacattca

SEQ ID NO: 365996 - DNA, 25 bp, Homo sapien
acattcattgtctctttaagttcta

SEQ ID NO: 365997 - DNA, 25 bp, Homo sapien
attaatagctgacctcccaaatctg

SEQ ID NO: 365998 - DNA, 25 bp, Homo sapien
tgacctcccaaatctgacaggatag

SEQ ID NO: 365999 - DNA, 25 bp, Homo sapien
gacaggatagacactgccacgtgca

SEQ ID NO: 366000 - DNA, 25 bp, Homo sapien
tagacactgccacgtgcaaggcctg

SEQ ID NO: 366001 - DNA, 25 bp, Homo sapien
gcccctcagacgcacaaaatgcgta

SEQ ID NO: 366002 - DNA, 25 bp, Homo sapien
aaaacaaatgcatcctttcctggct

SEQ ID NO: 366003 - DNA, 25 bp, Homo sapien
atcctttcctggctaagcgagtatt

SEQ ID NO: 366004 - DNA, 25 bp, Homo sapien
agcgagtattactctcttagccctg

SEQ ID NO: 366005 - DNA, 25 bp, Homo sapien
ttaactcttcatttcttagacccgc

SEQ ID NO: 366006 - DNA, 25 bp, Homo sapien
ttagacccgcagagtgtcttcctgc

SEQ ID NO: 366007 - DNA, 25 bp, Homo sapien
gagctgtgagtgttgttccctttgc

SEQ ID NO: 366008 - DNA, 25 bp, Homo sapien
tttgcctctcaaaatacgagcccct

SEQ ID NO: 366009 - DNA, 25 bp, Homo sapien
gccaaacccggcaattaagcttctt

SEQ ID NO: 366010 - DNA, 25 bp, Homo sapien
attaagcttcttacacatccagccc

SEQ ID NO: 366011 - DNA, 25 bp, Homo sapien
ggtctacactacagataatgcccgg

SEQ ID NO: 366012 - DNA, 25 bp, Homo sapien
actacagataatgcccgggttcaaa

SEQ ID NO: 366013 - DNA, 25 bp, Homo sapien
cactcactggatgcgtgaccttgga

SEQ ID NO: 366014 - DNA, 25 bp, Homo sapien
atgcgtgaccttggaaaaatgatca

SEQ ID NO: 366015 - DNA, 25 bp, Homo sapien
aatgatcaacctcttcaagctacac

SEQ ID NO: 366016 - DNA, 25 bp, Homo sapien
atcaacctcttcaagctacacaaag

SEQ ID NO: 366017 - DNA, 25 bp, Homo sapien
tggaaagaggtgctttttactccgg

SEQ ID NO: 366018 - DNA, 25 bp, Homo sapien
gggcttttgcctctcaaaatacgag

SEQ ID NO: 366019 - DNA, 25 bp, Homo sapien
ttgcaaagcaaggtgagcactgtta

SEQ ID NO: 366020 - DNA, 25 bp, Homo sapien
gcactgttaaaatccggctaggcca

SEQ ID NO: 366021 - DNA, 25 bp, Homo sapien
ggctaggccaagatttcccaatgtc

SEQ ID NO: 366022 - DNA, 25 bp, Homo sapien
aagatttcccaatgtcttgaagcca

SEQ ID NO: 366023 - DNA, 25 bp, Homo sapien
gaagccaatggctaggaaaacagct

SEQ ID NO: 366024 - DNA, 25 bp, Homo sapien
ctaggaaaacagctgagcctgggac

SEQ ID NO: 366025 - DNA, 25 bp, Homo sapien
tgagcctgggactggactttgtcag

SEQ ID NO: 366026 - DNA, 25 bp, Homo sapien
tggactttgtcagtaacctctcttc

SEQ ID NO: 366027 - DNA, 25 bp, Homo sapien
ctcttccctagggcacgggaggagt

SEQ ID NO: 366028 - DNA, 25 bp, Homo sapien
ggacctcttggcttgaggaccatga

SEQ ID NO: 366029 - DNA, 25 bp, Homo sapien
gcttgaggaccatgattgtgaatac

SEQ ID NO: 366030 - DNA, 25 bp, Homo sapien
taactactcaagaaaccttcccaat

SEQ ID NO: 366031 - DNA, 25 bp, Homo sapien
aatcactttcagtattccctgctag

SEQ ID NO: 366032 - DNA, 25 bp, Homo sapien
gtattccctgctagatattgattgt

SEQ ID NO: 366033 - DNA, 25 bp, Homo sapien
taattctgtggattgtgtttaagca

SEQ ID NO: 366034 - DNA, 25 bp, Homo sapien
agcaattcaatagtatgttcctgat

SEQ ID NO: 366035 - DNA, 25 bp, Homo sapien
atgttcctgattttgagatgctaag

SEQ ID NO: 366036 - DNA, 25 bp, Homo sapien
ggtattgcacagttgtcactttatc

SEQ ID NO: 366037 - DNA, 25 bp, Homo sapien
atcaagtgtgtacaacagtcccatg

SEQ ID NO: 366038 - DNA, 25 bp, Homo sapien
gtgtacaacagtcccatgaagttta

SEQ ID NO: 366039 - DNA, 25 bp, Homo sapien
gaagtttatagagcatacccttgta

SEQ ID NO: 366040 - DNA, 25 bp, Homo sapien
agagcatacccttgtatagcttcag

SEQ ID NO: 366041 - DNA, 25 bp, Homo sapien
tagtttccctgtcctcaaaagcatg

SEQ ID NO: 366042 - DNA, 25 bp, Homo sapien
tgtcctcaaaagcatgggcagacat

SEQ ID NO: 366043 - DNA, 25 bp, Homo sapien
acatgggcaaagtgctggcttgcaa

SEQ ID NO: 366044 - DNA, 25 bp, Homo sapien
agtgctggcttgcaattctcaataa

SEQ ID NO: 366045 - DNA, 25 bp, Homo sapien
attatcagatcgctatttaactcag

SEQ ID NO: 366046 - DNA, 25 bp, Homo sapien
aaaatacttgattgtgtggagagca

SEQ ID NO: 366047 - DNA, 25 bp, Homo sapien
ggtggccgccccataataagaaaag

SEQ ID NO: 366048 - DNA, 25 bp, Homo sapien
aaaccacagacgcagtgatttggca

SEQ ID NO: 366049 - DNA, 25 bp, Homo sapien
acgcagtgatttggcagggtgatat

SEQ ID NO: 366050 - DNA, 25 bp, Homo sapien
cagggtgatatacggaggaaattct

SEQ ID NO: 366051 - DNA, 25 bp, Homo sapien
cggaggaaattctgccatcaggaaa

SEQ ID NO: 366052 - DNA, 25 bp, Homo sapien
aagcaacatttggaaatccctgtgg

SEQ ID NO: 366053 - DNA, 25 bp, Homo sapien
tttggaaatccctgtggtgagttgg

SEQ ID NO: 366054 - DNA, 25 bp, Homo sapien
gggaaagcgccggtgtacatccctc

SEQ ID NO: 366055 - DNA, 25 bp, Homo sapien
ctcttctttccagggctctgagtgt

SEQ ID NO: 366056 - DNA, 25 bp, Homo sapien
ctggcacagagtcccgttgtccttt

SEQ ID NO: 366057 - DNA, 25 bp, Homo sapien
ttccagggctctgagtgtcagggct

SEQ ID NO: 366058 - DNA, 25 bp, Homo sapien
agagtcccgttgtcctttcataggc

SEQ ID NO: 366059 - DNA, 25 bp, Homo sapien
tgtcctttcataggcggtgtcagaa

SEQ ID NO: 366060 - DNA, 25 bp, Homo sapien
taggcggtgtcagaaaccctgtggt

SEQ ID NO: 366061 - DNA, 25 bp, Homo sapien
gaaaccctgtggtgaaattcagcct

SEQ ID NO: 366062 - DNA, 25 bp, Homo sapien
attccagaaatttggagtgttcttg

SEQ ID NO: 366063 - DNA, 25 bp, Homo sapien
aggagggacagttacgggccaggct

SEQ ID NO: 366064 - DNA, 25 bp, Homo sapien
agttacgggccaggctgacgtggga

SEQ ID NO: 366065 - DNA, 25 bp, Homo sapien
taggagggacagaggcctggctgct

SEQ ID NO: 366066 - DNA, 25 bp, Homo sapien
tggccccacgctgaggccagtgtga

SEQ ID NO: 366067 - DNA, 25 bp, Homo sapien
ggcctggaagcctcatccttcttga

SEQ ID NO: 366068 - DNA, 25 bp, Homo sapien
ctggaagcctcatccttcttgattg

SEQ ID NO: 366069 - DNA, 25 bp, Homo sapien
tggaagcctcatccttcttgattgc

SEQ ID NO: 366070 - DNA, 25 bp, Homo sapien
aggcatgcgccaccgcactggactc

SEQ ID NO: 366071 - DNA, 25 bp, Homo sapien
tggactccccctttcatcatcaaag

SEQ ID NO: 366072 - DNA, 25 bp, Homo sapien
cccctttcatcatcaaagccaaatt

SEQ ID NO: 366073 - DNA, 25 bp, Homo sapien
tcaaagccaaattttcttcttgttt

SEQ ID NO: 366074 - DNA, 25 bp, Homo sapien
aacaaatgtcaaatgtattagagcc

SEQ ID NO: 366075 - DNA, 25 bp, Homo sapien
atgtattagagccactttgggtgga

SEQ ID NO: 366076 - DNA, 25 bp, Homo sapien
gggttgcattccatttagtctttcc

SEQ ID NO: 366077 - DNA, 25 bp, Homo sapien
gttgcattccatttagtctttccta

SEQ ID NO: 366078 - DNA, 25 bp, Homo sapien
gcattccatttagtctttcctagag

SEQ ID NO: 366079 - DNA, 25 bp, Homo sapien
ccatttagtctttcctagaggcagg

SEQ ID NO: 366080 - DNA, 25 bp, Homo sapien
tagtctttcctagaggcagggaaat

SEQ ID NO: 366081 - DNA, 25 bp, Homo sapien
aaatgggctaggtggcctttggagc

SEQ ID NO: 366082 - DNA, 25 bp, Homo sapien
gcacactgctggcttggtaaatttc

SEQ ID NO: 366083 - DNA, 25 bp, Homo sapien
acactgctggcttggtaaatttctg

SEQ ID NO: 366084 - DNA, 25 bp, Homo sapien
tgtacttagagtctcatctggttct

SEQ ID NO: 366085 - DNA, 25 bp, Homo sapien
cagtgttctagtaacggaccctcgg

SEQ ID NO: 366086 - DNA, 25 bp, Homo sapien
agccttgcttactgcttcaaagaca

SEQ ID NO: 366087 - DNA, 25 bp, Homo sapien
tggtcatcacagcacgatgctgctt

SEQ ID NO: 366088 - DNA, 25 bp, Homo sapien
tcttgacagcgcttgctttgtattt

SEQ ID NO: 366089 - DNA, 25 bp, Homo sapien
ctttgtatttcctgggttgctcttc

SEQ ID NO: 366090 - DNA, 25 bp, Homo sapien
tctgtcccacattggctcattgcca

SEQ ID NO: 366091 - DNA, 25 bp, Homo sapien
cttgtccatgcttccttacaaagtg

SEQ ID NO: 366092 - DNA, 25 bp, Homo sapien
gtttgtaaggacagtagcagcccaa

SEQ ID NO: 366093 - DNA, 25 bp, Homo sapien
agcagcccaaagactggcatctgta

SEQ ID NO: 366094 - DNA, 25 bp, Homo sapien
tgtagacacatctggatcttccgtt

SEQ ID NO: 366095 - DNA, 25 bp, Homo sapien
tggatcttccgtttgatctcagtgt

SEQ ID NO: 366096 - DNA, 25 bp, Homo sapien
agccccgcgtgagaacgtgcataat

SEQ ID NO: 366097 - DNA, 25 bp, Homo sapien
tgagtgcacaccatcatgtcaaggt

SEQ ID NO: 366098 - DNA, 25 bp, Homo sapien
ggtgcatacttagtgagcgccatcc

SEQ ID NO: 366099 - DNA, 25 bp, Homo sapien
gaacgtgtatttcagtgtttcactt

SEQ ID NO: 366100 - DNA, 25 bp, Homo sapien
gtgtttcacttactggacggataac

SEQ ID NO: 366101 - DNA, 25 bp, Homo sapien
ggcagtcaccagaaataaatgtctc

SEQ ID NO: 366102 - DNA, 25 bp, Homo sapien
taaatgtctcagcactttacagatg

SEQ ID NO: 366103 - DNA, 25 bp, Homo sapien
tatgttctaggttgcatatatcccc

SEQ ID NO: 366104 - DNA, 25 bp, Homo sapien
gaaagtgatttcttcccaagcttct

SEQ ID NO: 366105 - DNA, 25 bp, Homo sapien
gcttctcaaactgttagctgctgtc

SEQ ID NO: 366106 - DNA, 25 bp, Homo sapien
agctgctgtctgacttcatcaataa

SEQ ID NO: 366107 - DNA, 25 bp, Homo sapien
cactagggccttttgggcaacacct

SEQ ID NO: 366108 - DNA, 25 bp, Homo sapien
tttgggcaacacctccggcagacag

SEQ ID NO: 366109 - DNA, 25 bp, Homo sapien
cagcgccagcgtctgcagaggaagg

SEQ ID NO: 366110 - DNA, 25 bp, Homo sapien
aacactgcacttccagggctgccag

SEQ ID NO: 366111 - DNA, 25 bp, Homo sapien
agggctgccagctttgcgtttggac

SEQ ID NO: 366112 - DNA, 25 bp, Homo sapien
ttgcgtttggacgtggactctgagc

SEQ ID NO: 366113 - DNA, 25 bp, Homo sapien
aggcccacctgctcgttccataaag

SEQ ID NO: 366114 - DNA, 25 bp, Homo sapien
ctcgttccataaagcgccccatgtg

SEQ ID NO: 366115 - DNA, 25 bp, Homo sapien
cccatgtgcctcctgaagtagaatc

SEQ ID NO: 366116 - DNA, 25 bp, Homo sapien
cctgaagtagaatcaagcgcacccc

SEQ ID NO: 366117 - DNA, 25 bp, Homo sapien
ggtcaccggtccaccgtcctgagag

SEQ ID NO: 366118 - DNA, 25 bp, Homo sapien
ggaatcttacccctaccactggact

SEQ ID NO: 366119 - DNA, 25 bp, Homo sapien
gaatcttacccctaccactggactg

SEQ ID NO: 366120 - DNA, 25 bp, Homo sapien
aatcttacccctaccactggactgt

SEQ ID NO: 366121 - DNA, 25 bp, Homo sapien
atcttacccctaccactggactgtt

SEQ ID NO: 366122 - DNA, 25 bp, Homo sapien
tcaactctgcatctcccacacagca

SEQ ID NO: 366123 - DNA, 25 bp, Homo sapien
caactctgcatctcccacacagcat

SEQ ID NO: 366124 - DNA, 25 bp, Homo sapien
aactctgcatctcccacacagcata

SEQ ID NO: 366125 - DNA, 25 bp, Homo sapien
actctgcatctcccacacagcatat

SEQ ID NO: 366126 - DNA, 25 bp, Homo sapien
ctctgcatctcccacacagcatatc

SEQ ID NO: 366127 - DNA, 25 bp, Homo sapien
tctgcatctcccacacagcatatct

SEQ ID NO: 366128 - DNA, 25 bp, Homo sapien
gaaggaggaggttgtagaagagaat

SEQ ID NO: 366129 - DNA, 25 bp, Homo sapien
ttggccacgggcaaaagaattttgt

SEQ ID NO: 366130 - DNA, 25 bp, Homo sapien
gccacgggcaaaagaattttgttga

SEQ ID NO: 366131 - DNA, 25 bp, Homo sapien
gcaaaagaattttgttgagggcaaa

SEQ ID NO: 366132 - DNA, 25 bp, Homo sapien
ttgagggcaaataatatgagaccac

SEQ ID NO: 366133 - DNA, 25 bp, Homo sapien
atatgagaccacaaaactgccttcc

SEQ ID NO: 366134 - DNA, 25 bp, Homo sapien
tatgagaccacaaaactgccttccc

SEQ ID NO: 366135 - DNA, 25 bp, Homo sapien
aaactgccttccctgctcagtttta

SEQ ID NO: 366136 - DNA, 25 bp, Homo sapien
tttagccttctctggttaccaaaat

SEQ ID NO: 366137 - DNA, 25 bp, Homo sapien
ttaccaaaataaccacgctcacggc

SEQ ID NO: 366138 - DNA, 25 bp, Homo sapien
gctcacggccgttcatttgaagata

SEQ ID NO: 366139 - DNA, 25 bp, Homo sapien
agatatttccagttaacgtgtgtga

SEQ ID NO: 366140 - DNA, 25 bp, Homo sapien
gagtgtccagaggtaggaccttgaa

SEQ ID NO: 366141 - DNA, 25 bp, Homo sapien
tttgtgatgcttagaactggtgtgc

SEQ ID NO: 366142 - DNA, 25 bp, Homo sapien
actggtgtgcagtactcatatgagc

SEQ ID NO: 366143 - DNA, 25 bp, Homo sapien
agtactcatatgagcccctggagct

SEQ ID NO: 366144 - DNA, 25 bp, Homo sapien
gcacaccttttgtcaggccaagact

SEQ ID NO: 366145 - DNA, 25 bp, Homo sapien
cttttgtcaggccaagactctctct

SEQ ID NO: 366146 - DNA, 25 bp, Homo sapien
ggtagaacctcttgactttattctg

SEQ ID NO: 366147 - DNA, 25 bp, Homo sapien
cttgactttattctggatctggtaa

SEQ ID NO: 366148 - DNA, 25 bp, Homo sapien
aataaaggaccttacatctctcctg

SEQ ID NO: 366149 - DNA, 25 bp, Homo sapien
ctcctgggatgacagaagacctttt

SEQ ID NO: 366150 - DNA, 25 bp, Homo sapien
tttctggcaagtctttcctggttta

SEQ ID NO: 366151 - DNA, 25 bp, Homo sapien
tatctagttcccatcagaaagtatt

SEQ ID NO: 366152 - DNA, 25 bp, Homo sapien
tatttactgagttctctttggtggc

SEQ ID NO: 366153 - DNA, 25 bp, Homo sapien
ctctttggtggcatattactctact

SEQ ID NO: 366154 - DNA, 25 bp, Homo sapien
ggtggcatattactctactagatta

SEQ ID NO: 366155 - DNA, 25 bp, Homo sapien
tacctatctcctagaataacttctg

SEQ ID NO: 366156 - DNA, 25 bp, Homo sapien
catattttctcctctctaggcatta

SEQ ID NO: 366157 - DNA, 25 bp, Homo sapien
tcctctctaggcattaacggtttaa

SEQ ID NO: 366158 - DNA, 25 bp, Homo sapien
caggatcatatgtgtactgagcttt

SEQ ID NO: 366159 - DNA, 25 bp, Homo sapien
gtactgagcttttacaagatctctt

SEQ ID NO: 366160 - DNA, 25 bp, Homo sapien
atctgtgttgaaatgactgtccctt

SEQ ID NO: 366161 - DNA, 25 bp, Homo sapien
aaatgactgtccctttatctagttc

SEQ ID NO: 366162 - DNA, 25 bp, Homo sapien
gcctttgttaaccttaaatacactg

SEQ ID NO: 366163 - DNA, 25 bp, Homo sapien
aagtgaaccatctcagacctttact

SEQ ID NO: 366164 - DNA, 25 bp, Homo sapien
gacctttactgatactacaactttt

SEQ ID NO: 366165 - DNA, 25 bp, Homo sapien
tttgttttctgatggccaaaatacc

SEQ ID NO: 366166 - DNA, 25 bp, Homo sapien
ggccaaaataccaaatgcctgttgt

SEQ ID NO: 366167 - DNA, 25 bp, Homo sapien
atgcctgttgtatttatggattaaa

SEQ ID NO: 366168 - DNA, 25 bp, Homo sapien
agttttggaatctaagctgtttgcc

SEQ ID NO: 366169 - DNA, 25 bp, Homo sapien
gtttgccaagctgaagctacaggtt

SEQ ID NO: 366170 - DNA, 25 bp, Homo sapien
aacttttggaatcatactgcctact

SEQ ID NO: 366171 - DNA, 25 bp, Homo sapien
atcatactgcctactgttactctaa

SEQ ID NO: 366172 - DNA, 25 bp, Homo sapien
aatgtgaatttttgcctatctttaa

SEQ ID NO: 366173 - DNA, 25 bp, Homo sapien
ctgacttaaaatcccagcatgtaat

SEQ ID NO: 366174 - DNA, 25 bp, Homo sapien
aatcccagcatgtaatgctttatgg

SEQ ID NO: 366175 - DNA, 25 bp, Homo sapien
ttatggtattataagtcctcccaag

SEQ ID NO: 366176 - DNA, 25 bp, Homo sapien
gtcctcccaagtttatatgttgtcc

SEQ ID NO: 366177 - DNA, 25 bp, Homo sapien
atgttgtccataaagttgttctgcc

SEQ ID NO: 366178 - DNA, 25 bp, Homo sapien
gagaaactgttctgaggaaactttt

SEQ ID NO: 366179 - DNA, 25 bp, Homo sapien
ttttcaccaatacctcactttttgc

SEQ ID NO: 366180 - DNA, 25 bp, Homo sapien
cctcactttttgctctgttcatggg

SEQ ID NO: 366181 - DNA, 25 bp, Homo sapien
aacattgtgccccttcctgttccat

SEQ ID NO: 366182 - DNA, 25 bp, Homo sapien
atggcatctaccttcagccaattcc

SEQ ID NO: 366183 - DNA, 25 bp, Homo sapien
cccacttatagcagccagttcatat

SEQ ID NO: 366184 - DNA, 25 bp, Homo sapien
tggatgggtccaacgtggtctttaa

SEQ ID NO: 366185 - DNA, 25 bp, Homo sapien
gtccaacgtggtctttaaacttctg

SEQ ID NO: 366186 - DNA, 25 bp, Homo sapien
taaacttctgggtccggtgctagtc

SEQ ID NO: 366187 - DNA, 25 bp, Homo sapien
ttctgggtccggtgctagtcaaaca

SEQ ID NO: 366188 - DNA, 25 bp, Homo sapien
gtccggtgctagtcaaacaggagct

SEQ ID NO: 366189 - DNA, 25 bp, Homo sapien
aagaggctggactatatcacagctg

SEQ ID NO: 366190 - DNA, 25 bp, Homo sapien
agcgatacgaatcccagcttcggga

SEQ ID NO: 366191 - DNA, 25 bp, Homo sapien
agcttcgggatcttgagcggcagtc

SEQ ID NO: 366192 - DNA, 25 bp, Homo sapien
cttgagcggcagtcagagcaacaga

SEQ ID NO: 366193 - DNA, 25 bp, Homo sapien
agagggagacccttgctcagctgca

SEQ ID NO: 366194 - DNA, 25 bp, Homo sapien
gacccttgctcagctgcagcaggag

SEQ ID NO: 366195 - DNA, 25 bp, Homo sapien
ccagaagaagctacagggagaagtg

SEQ ID NO: 366196 - DNA, 25 bp, Homo sapien
agtggagaaatatcaacagctacag

SEQ ID NO: 366197 - DNA, 25 bp, Homo sapien
aggacttaagtaaatccatgtcggg

SEQ ID NO: 366198 - DNA, 25 bp, Homo sapien
ggcagaaacttgaagcacaactaac

SEQ ID NO: 366199 - DNA, 25 bp, Homo sapien
ttaaacttctgggtccggtgctagt

SEQ ID NO: 366200 - DNA, 25 bp, Homo sapien
ttctgggtccggtgctagtcaaaca

SEQ ID NO: 366201 - DNA, 25 bp, Homo sapien
gggagctcaggtaccttccagagag

SEQ ID NO: 366202 - DNA, 25 bp, Homo sapien
gtccggtgctagtcaaacaggagct

SEQ ID NO: 366203 - DNA, 25 bp, Homo sapien
taccttccagagagtgagacccagc

SEQ ID NO: 366204 - DNA, 25 bp, Homo sapien
tgtctcgcacccagtaggctttcat

SEQ ID NO: 366205 - DNA, 25 bp, Homo sapien
agtaggctttcatccccgccatggc

SEQ ID NO: 366206 - DNA, 25 bp, Homo sapien
gtgtgaatgtttgtggccaattcaa

SEQ ID NO: 366207 - DNA, 25 bp, Homo sapien
gtgaatgtttgtggccaattcaatt

SEQ ID NO: 366208 - DNA, 25 bp, Homo sapien
aatgtttgtggccaattcaattgtg

SEQ ID NO: 366209 - DNA, 25 bp, Homo sapien
gtttgtggccaattcaattgtggaa

SEQ ID NO: 366210 - DNA, 25 bp, Homo sapien
ttgtggccaattcaattgtggaatc

SEQ ID NO: 366211 - DNA, 25 bp, Homo sapien
gtggccaattcaattgtggaatctt

SEQ ID NO: 366212 - DNA, 25 bp, Homo sapien
ggccaattcaattgtggaatcttat

SEQ ID NO: 366213 - DNA, 25 bp, Homo sapien
ttactttttgacatgctcttagcat

SEQ ID NO: 366214 - DNA, 25 bp, Homo sapien
ctttttgacatgctcttagcatgtt

SEQ ID NO: 366215 - DNA, 25 bp, Homo sapien
tgctagtcattctggatcttatgtt

SEQ ID NO: 366216 - DNA, 25 bp, Homo sapien
gctagtcattctggatcttatgttt

SEQ ID NO: 366217 - DNA, 25 bp, Homo sapien
tttaaagtaaatcccagatagcatc

SEQ ID NO: 366218 - DNA, 25 bp, Homo sapien
aagtaaatcccagatagcatcacat

SEQ ID NO: 366219 - DNA, 25 bp, Homo sapien
gtaaatcccagatagcatcacatca

SEQ ID NO: 366220 - DNA, 25 bp, Homo sapien
aaatcccagatagcatcacatcatt

SEQ ID NO: 366221 - DNA, 25 bp, Homo sapien
aatcccagatagcatcacatcattt

SEQ ID NO: 366222 - DNA, 25 bp, Homo sapien
atttcacccccaccataggatttca

SEQ ID NO: 366223 - DNA, 25 bp, Homo sapien
ccccaccataggatttcaaagatct

SEQ ID NO: 366224 - DNA, 25 bp, Homo sapien
ccaccataggatttcaaagatctgt

SEQ ID NO: 366225 - DNA, 25 bp, Homo sapien
agatctgttatatttcaagattgag

SEQ ID NO: 366226 - DNA, 25 bp, Homo sapien
tgaaactctagaaaaagcttgaggg

SEQ ID NO: 366227 - DNA, 25 bp, Homo sapien
gaaagaggaagatttatgttacttt

SEQ ID NO: 366228 - DNA, 25 bp, Homo sapien
ctaggactgcgtagtaaagtgctga

SEQ ID NO: 366229 - DNA, 25 bp, Homo sapien
gaaaattgaagagctcaggaccaag

SEQ ID NO: 366230 - DNA, 25 bp, Homo sapien
gctcaggaccaaggttaaatccctt

SEQ ID NO: 366231 - DNA, 25 bp, Homo sapien
tccctttcttcaggaattcctgatg

SEQ ID NO: 366232 - DNA, 25 bp, Homo sapien
tatatgtccaataactagagaactt

SEQ ID NO: 366233 - DNA, 25 bp, Homo sapien
agagaacttatgaaagatccggtca

SEQ ID NO: 366234 - DNA, 25 bp, Homo sapien
gaaagatccggtcatcgcatcagat

SEQ ID NO: 366235 - DNA, 25 bp, Homo sapien
tccggtcatcgcatcagatggctat

SEQ ID NO: 366236 - DNA, 25 bp, Homo sapien
atcgcatcagatggctattcatatg

SEQ ID NO: 366237 - DNA, 25 bp, Homo sapien
aagaaacgtacaagtcccatgacaa

SEQ ID NO: 366238 - DNA, 25 bp, Homo sapien
cccatgacaaatcttgttcttcctt

SEQ ID NO: 366239 - DNA, 25 bp, Homo sapien
aatagctagaattatggaacatcaa

SEQ ID NO: 366240 - DNA, 25 bp, Homo sapien
tcaaagggatggaaattgcctgtcc

SEQ ID NO: 366241 - DNA, 25 bp, Homo sapien
gggatggaaattgcctgtccatcct

SEQ ID NO: 366242 - DNA, 25 bp, Homo sapien
tgtccatcctttattcctcagatat

SEQ ID NO: 366243 - DNA, 25 bp, Homo sapien
gtccatcctttattcctcagatatg

SEQ ID NO: 366244 - DNA, 25 bp, Homo sapien
ccatcctttattcctcagatatgaa

SEQ ID NO: 366245 - DNA, 25 bp, Homo sapien
acaaccttaaatcagcagattactt

SEQ ID NO: 366246 - DNA, 25 bp, Homo sapien
agattactttgcacttaaactctat

SEQ ID NO: 366247 - DNA, 25 bp, Homo sapien
tactttgcacttaaactctatctaa

SEQ ID NO: 366248 - DNA, 25 bp, Homo sapien
gcacttaaactctatctaaatacaa

SEQ ID NO: 366249 - DNA, 25 bp, Homo sapien
tctatctaaatacaaaaacagccag

SEQ ID NO: 366250 - DNA, 25 bp, Homo sapien
cagctgcattctactttacatatta

SEQ ID NO: 366251 - DNA, 25 bp, Homo sapien
aataggacagtccttttgccactgc

SEQ ID NO: 366252 - DNA, 25 bp, Homo sapien
gacagtccttttgccactgcaagag

SEQ ID NO: 366253 - DNA, 25 bp, Homo sapien
gaaaggcaggattttacttgtggaa

SEQ ID NO: 366254 - DNA, 25 bp, Homo sapien
acttgtggaaatcagtgcctgcctt

SEQ ID NO: 366255 - DNA, 25 bp, Homo sapien
ttccatccacaaaaaccagatgtca

SEQ ID NO: 366256 - DNA, 25 bp, Homo sapien
caatatggaggaggcacatgtcagc

SEQ ID NO: 366257 - DNA, 25 bp, Homo sapien
gcctgggaagcctgagttccagctt

SEQ ID NO: 366258 - DNA, 25 bp, Homo sapien
ggaagcctgagttccagctttccct

SEQ ID NO: 366259 - DNA, 25 bp, Homo sapien
aagagcctcagtttacacccctgaa

SEQ ID NO: 366260 - DNA, 25 bp, Homo sapien
cagtttacacccctgaaaaatggag

SEQ ID NO: 366261 - DNA, 25 bp, Homo sapien
aggaataatgctttacggagtctaa

SEQ ID NO: 366262 - DNA, 25 bp, Homo sapien
gctttacggagtctaatgttgattt

SEQ ID NO: 366263 - DNA, 25 bp, Homo sapien
cacaagttccataccaaaaaatgaa

SEQ ID NO: 366264 - DNA, 25 bp, Homo sapien
aatgaatgtaaacttcttatgcagt

SEQ ID NO: 366265 - DNA, 25 bp, Homo sapien
acttcttatgcagtttcacacattg

SEQ ID NO: 366266 - DNA, 25 bp, Homo sapien
ttccattgcatttttcagaattctc

SEQ ID NO: 366267 - DNA, 25 bp, Homo sapien
tcgcaatcctctgacaactgttgaa

SEQ ID NO: 366268 - DNA, 25 bp, Homo sapien
tgacaactgttgaagatccgtatct

SEQ ID NO: 366269 - DNA, 25 bp, Homo sapien
actgttgaagatccgtatctcttta

SEQ ID NO: 366270 - DNA, 25 bp, Homo sapien
gtactatagtactcttgggagtcat

SEQ ID NO: 366271 - DNA, 25 bp, Homo sapien
gtcatgagatgatttatactctttt

SEQ ID NO: 366272 - DNA, 25 bp, Homo sapien
taccttgatggtactcttctaagac

SEQ ID NO: 366273 - DNA, 25 bp, Homo sapien
ggtactcttctaagaccattaactt

SEQ ID NO: 366274 - DNA, 25 bp, Homo sapien
ggtaactttatattggtaactctga

SEQ ID NO: 366275 - DNA, 25 bp, Homo sapien
gaaagtattcatgttgactcatttt

SEQ ID NO: 366276 - DNA, 25 bp, Homo sapien
ttttttccccatacatttctcacaa

SEQ ID NO: 366277 - DNA, 25 bp, Homo sapien
gtcagagacatctactaatataaat

SEQ ID NO: 366278 - DNA, 25 bp, Homo sapien
gattttacagtcaggtctaattatc

SEQ ID NO: 366279 - DNA, 25 bp, Homo sapien
agtcaggtctaattatcataacatg

SEQ ID NO: 366280 - DNA, 25 bp, Homo sapien
aagtcatttacttgtcttgcttaat

SEQ ID NO: 366281 - DNA, 25 bp, Homo sapien
aatattttcagaccacttgacagtg

SEQ ID NO: 366282 - DNA, 25 bp, Homo sapien
ttttcagaccacttgacagtgaaag

SEQ ID NO: 366283 - DNA, 25 bp, Homo sapien
tcatcaagctggaagaggagttacg

SEQ ID NO: 366284 - DNA, 25 bp, Homo sapien
gaggagttacgagagaagcaagcat

SEQ ID NO: 366285 - DNA, 25 bp, Homo sapien
gctgcagtctgcatgtgagaagcga

SEQ ID NO: 366286 - DNA, 25 bp, Homo sapien
atggagcggagactgcggacttggc

SEQ ID NO: 366287 - DNA, 25 bp, Homo sapien
agagagctggatgcactgagaaccc

SEQ ID NO: 366288 - DNA, 25 bp, Homo sapien
ctgagaacccagcagaaacatggaa

SEQ ID NO: 366289 - DNA, 25 bp, Homo sapien
gaaacatggaaatggccagccagcc

SEQ ID NO: 366290 - DNA, 25 bp, Homo sapien
agccagccaacatgccggaatacaa

SEQ ID NO: 366291 - DNA, 25 bp, Homo sapien
aacatgccggaatacaatgccccag

SEQ ID NO: 366292 - DNA, 25 bp, Homo sapien
agccctcctggaacttgtgcgggag

SEQ ID NO: 366293 - DNA, 25 bp, Homo sapien
ccctcctggaacttgtgcgggagaa

SEQ ID NO: 366294 - DNA, 25 bp, Homo sapien
ggagccggcgcactagggcctgcgg

SEQ ID NO: 366295 - DNA, 25 bp, Homo sapien
gcactagggcctgcggccttcaagg

SEQ ID NO: 366296 - DNA, 25 bp, Homo sapien
ctgcggccttcaagggcgaggaccc

SEQ ID NO: 366297 - DNA, 25 bp, Homo sapien
gggtacacctggtctcgtcattcgt

SEQ ID NO: 366298 - DNA, 25 bp, Homo sapien
gtacacctggtctcgtcattcgtcg

SEQ ID NO: 366299 - DNA, 25 bp, Homo sapien
ggtctcgtcattcgtcgctctgtga

SEQ ID NO: 366300 - DNA, 25 bp, Homo sapien
tcattcgtcgctctgtgaccgagga

SEQ ID NO: 366301 - DNA, 25 bp, Homo sapien
attcgtcgctctgtgaccgaggagg

SEQ ID NO: 366302 - DNA, 25 bp, Homo sapien
ttcgtcgctctgtgaccgaggaggc

SEQ ID NO: 366303 - DNA, 25 bp, Homo sapien
gctctgtgaccgaggaggcgggcaa

SEQ ID NO: 366304 - DNA, 25 bp, Homo sapien
aaggtcacccacgaatcccagccgt

SEQ ID NO: 366305 - DNA, 25 bp, Homo sapien
cacagttctttttaaagcacaacat

SEQ ID NO: 366306 - DNA, 25 bp, Homo sapien
aaacatacttgtctgtataaagaga

SEQ ID NO: 366307 - DNA, 25 bp, Homo sapien
gaaaatgaaattgtagtcactgtta

SEQ ID NO: 366308 - DNA, 25 bp, Homo sapien
agtcactgttatgtactgacattag

SEQ ID NO: 366309 - DNA, 25 bp, Homo sapien
gtactgacattagttacaacctagt

SEQ ID NO: 366310 - DNA, 25 bp, Homo sapien
tgacattagttacaacctagtttta

SEQ ID NO: 366311 - DNA, 25 bp, Homo sapien
aaaaaatggatgtttcagttaaatg

SEQ ID NO: 366312 - DNA, 25 bp, Homo sapien
agaggtacagatttttacaaggaca

SEQ ID NO: 366313 - DNA, 25 bp, Homo sapien
gtacagatttttacaaggacataat

SEQ ID NO: 366314 - DNA, 25 bp, Homo sapien
gttattgttctgtagaaatatccta

SEQ ID NO: 366315 - DNA, 25 bp, Homo sapien
tcctattaaatattgtatgtccctc

SEQ ID NO: 366316 - DNA, 25 bp, Homo sapien
ctttccttgactaagcatctcttca

SEQ ID NO: 366317 - DNA, 25 bp, Homo sapien
tccttgactaagcatctcttcatgc

SEQ ID NO: 366318 - DNA, 25 bp, Homo sapien
gactaagcatctcttcatgctcaaa

SEQ ID NO: 366319 - DNA, 25 bp, Homo sapien
taagcatctcttcatgctcaaaagt

SEQ ID NO: 366320 - DNA, 25 bp, Homo sapien
catctcttcatgctcaaaagtcttt

SEQ ID NO: 366321 - DNA, 25 bp, Homo sapien
ctcttcatgctcaaaagtcttttac

SEQ ID NO: 366322 - DNA, 25 bp, Homo sapien
aaagtcttttacatgtcttcttctg

SEQ ID NO: 366323 - DNA, 25 bp, Homo sapien
agtcttttacatgtcttcttctgtg

SEQ ID NO: 366324 - DNA, 25 bp, Homo sapien
gtcttttacatgtcttcttctgtga

SEQ ID NO: 366325 - DNA, 25 bp, Homo sapien
cttttacatgtcttcttctgtgaat

SEQ ID NO: 366326 - DNA, 25 bp, Homo sapien
aattcttttgtgtcatttgctcatt

SEQ ID NO: 366327 - DNA, 25 bp, Homo sapien
ctgcacgtgggctgtcttcacaggt

SEQ ID NO: 366328 - DNA, 25 bp, Homo sapien
ggctgtcttcacaggtctgatgtga

SEQ ID NO: 366329 - DNA, 25 bp, Homo sapien
ttcaatcacgacgttaaccggctcg

SEQ ID NO: 366330 - DNA, 25 bp, Homo sapien
acgttaaccggctcgagagagcgcc

SEQ ID NO: 366331 - DNA, 25 bp, Homo sapien
agagcgccggcctagaggctcatta

SEQ ID NO: 366332 - DNA, 25 bp, Homo sapien
ggcctagaggctcattatctattta

SEQ ID NO: 366333 - DNA, 25 bp, Homo sapien
tatctatttattttaccaaacgcga

SEQ ID NO: 366334 - DNA, 25 bp, Homo sapien
aacgcgaattgagacggactttgac

SEQ ID NO: 366335 - DNA, 25 bp, Homo sapien
ggactttgacaaaacacgaaatggt

SEQ ID NO: 366336 - DNA, 25 bp, Homo sapien
ctaagagcagagagtgaccaacagt

SEQ ID NO: 366337 - DNA, 25 bp, Homo sapien
gaccaacagtaaacaacacgcgcag

SEQ ID NO: 366338 - DNA, 25 bp, Homo sapien
gctttggagccctaaagttagtgga

SEQ ID NO: 366339 - DNA, 25 bp, Homo sapien
gagccctaaagttagtggacaagac

SEQ ID NO: 366340 - DNA, 25 bp, Homo sapien
tggacaagacactgggataaagctc

SEQ ID NO: 366341 - DNA, 25 bp, Homo sapien
gacactgggataaagctctatggct

SEQ ID NO: 366342 - DNA, 25 bp, Homo sapien
ctgggataaagctctatggctgctg

SEQ ID NO: 366343 - DNA, 25 bp, Homo sapien
gctggaaggaggtctgagtctgtgt

SEQ ID NO: 366344 - DNA, 25 bp, Homo sapien
ttgaagccctctgctccctgcagaa

SEQ ID NO: 366345 - DNA, 25 bp, Homo sapien
ttccttcagttagatctttcccttc

SEQ ID NO: 366346 - DNA, 25 bp, Homo sapien
agttagatctttcccttccctgctg

SEQ ID NO: 366347 - DNA, 25 bp, Homo sapien
ctgcctcgctcccttagctttggag

SEQ ID NO: 366348 - DNA, 25 bp, Homo sapien
tcccttagctttggagccctaaagt

SEQ ID NO: 366349 - DNA, 25 bp, Homo sapien
ggccttgatgagtcttgtgcacatg

SEQ ID NO: 366350 - DNA, 25 bp, Homo sapien
agcctagccctttaacaatgaccta

SEQ ID NO: 366351 - DNA, 25 bp, Homo sapien
aacaatgacctatttcgaactccca

SEQ ID NO: 366352 - DNA, 25 bp, Homo sapien
ttcgaactcccacattgacttctgt

SEQ ID NO: 366353 - DNA, 25 bp, Homo sapien
acttctgtcctcgttctgtgcatag

SEQ ID NO: 366354 - DNA, 25 bp, Homo sapien
atcttcagtgccctaccaggtaaat

SEQ ID NO: 366355 - DNA, 25 bp, Homo sapien
agaaccccacagtctttgaacactg

SEQ ID NO: 366356 - DNA, 25 bp, Homo sapien
atcagtgcagttacaccgtcatgat

SEQ ID NO: 366357 - DNA, 25 bp, Homo sapien
ccgtcatgatctgcttggtttcaaa

SEQ ID NO: 366358 - DNA, 25 bp, Homo sapien
agacctctggtatttttgttcttca

SEQ ID NO: 366359 - DNA, 25 bp, Homo sapien
atttaacctcacattcatgctctgc

SEQ ID NO: 366360 - DNA, 25 bp, Homo sapien
gatctgtaattggacagctctctcg

SEQ ID NO: 366361 - DNA, 25 bp, Homo sapien
tgtaattggacagctctctcgaaga

SEQ ID NO: 366362 - DNA, 25 bp, Homo sapien
aattggacagctctctcgaagagat

SEQ ID NO: 366363 - DNA, 25 bp, Homo sapien
tggacagctctctcgaagagatctt

SEQ ID NO: 366364 - DNA, 25 bp, Homo sapien
cagctctctcgaagagatcttacag

SEQ ID NO: 366365 - DNA, 25 bp, Homo sapien
tacagactgtatcagtctaattttt

SEQ ID NO: 366366 - DNA, 25 bp, Homo sapien
agttattttgtacagctttgtaaat

SEQ ID NO: 366367 - DNA, 25 bp, Homo sapien
catttttatattgccatgtttattt

SEQ ID NO: 366368 - DNA, 25 bp, Homo sapien
gggtaatttggttcattaagtacat

SEQ ID NO: 366369 - DNA, 25 bp, Homo sapien
tcattaagtacatagctaaggtaat

SEQ ID NO: 366370 - DNA, 25 bp, Homo sapien
ggtaatgaacatctttttcagtaat

SEQ ID NO: 366371 - DNA, 25 bp, Homo sapien
ggtgaaagagaactatacaggcaga

SEQ ID NO: 366372 - DNA, 25 bp, Homo sapien
caatatttttctttgcacatgccct

SEQ ID NO: 366373 - DNA, 25 bp, Homo sapien
actatacaggcagaaatgcatgtgt

SEQ ID NO: 366374 - DNA, 25 bp, Homo sapien
caggaaactggagaactgttgattt

SEQ ID NO: 366375 - DNA, 25 bp, Homo sapien
gatttattacagttctcaaattaga

SEQ ID NO: 366376 - DNA, 25 bp, Homo sapien
tttgcacatgccctttttcagtcca

SEQ ID NO: 366377 - DNA, 25 bp, Homo sapien
cattgcacactgaatttttctctga

SEQ ID NO: 366378 - DNA, 25 bp, Homo sapien
catgccctttttcagtccaattgaa

SEQ ID NO: 366379 - DNA, 25 bp, Homo sapien
cagtccaattgaacacttagagatt

SEQ ID NO: 366380 - DNA, 25 bp, Homo sapien
gaacacttagagatttttctttgct

SEQ ID NO: 366381 - DNA, 25 bp, Homo sapien
ctttgctttcacttgcattaaatgg

SEQ ID NO: 366382 - DNA, 25 bp, Homo sapien
ggagccctaaagttagtggacaaga

SEQ ID NO: 366383 - DNA, 25 bp, Homo sapien
tggacaagacactgggataaagctc

SEQ ID NO: 366384 - DNA, 25 bp, Homo sapien
gacactgggataaagctctatggct

SEQ ID NO: 366385 - DNA, 25 bp, Homo sapien
ctgggataaagctctatggctgctg

SEQ ID NO: 366386 - DNA, 25 bp, Homo sapien
ctctatggctgctggaaggaggtct

SEQ ID NO: 366387 - DNA, 25 bp, Homo sapien
tgaagccctctgctccctgcagaaa

SEQ ID NO: 366388 - DNA, 25 bp, Homo sapien
gcgaggaggagctttttccttcagt

SEQ ID NO: 366389 - DNA, 25 bp, Homo sapien
ttccttcagttagatctttcccttc

SEQ ID NO: 366390 - DNA, 25 bp, Homo sapien
agttagatctttcccttccctgctg

SEQ ID NO: 366391 - DNA, 25 bp, Homo sapien
ctgcctcgctcccttagctttggag

SEQ ID NO: 366392 - DNA, 25 bp, Homo sapien
tcccttagctttggagccctaaagt

SEQ ID NO: 366393 - DNA, 25 bp, Homo sapien
aacatgaagacttttggtcccaagc

SEQ ID NO: 366394 - DNA, 25 bp, Homo sapien
gggaggcagcccaaaaccaccgtcg

SEQ ID NO: 366395 - DNA, 25 bp, Homo sapien
accaccgtcggttcaagaatacaag

SEQ ID NO: 366396 - DNA, 25 bp, Homo sapien
gtgacctgcaattcttggaaagact

SEQ ID NO: 366397 - DNA, 25 bp, Homo sapien
aattcttctcccaatatgtggtcag

SEQ ID NO: 366398 - DNA, 25 bp, Homo sapien
tggtcagctcttccagcaggattag

SEQ ID NO: 366399 - DNA, 25 bp, Homo sapien
tcagctgtgcttctaagatcttcca

SEQ ID NO: 366400 - DNA, 25 bp, Homo sapien
ttggccttaacttggaaatgctgga

SEQ ID NO: 366401 - DNA, 25 bp, Homo sapien
gattgcatacaatctgtcctgctag

SEQ ID NO: 366402 - DNA, 25 bp, Homo sapien
tacaatctgtcctgctagtgagaga

SEQ ID NO: 366403 - DNA, 25 bp, Homo sapien
gcaaggactgcatctaagtgcaaca

SEQ ID NO: 366404 - DNA, 25 bp, Homo sapien
tcaggaccctcacactgggattcgt

SEQ ID NO: 366405 - DNA, 25 bp, Homo sapien
tgttcaagggtcacggtggaagaca

SEQ ID NO: 366406 - DNA, 25 bp, Homo sapien
gagagcgagtggataaccacgtgaa

SEQ ID NO: 366407 - DNA, 25 bp, Homo sapien
gtggataaccacgtgaaggcagaaa

SEQ ID NO: 366408 - DNA, 25 bp, Homo sapien
tgaaggcagaaaaggactccaaccc

SEQ ID NO: 366409 - DNA, 25 bp, Homo sapien
ccaccttatgtcctctccaggtgtt

SEQ ID NO: 366410 - DNA, 25 bp, Homo sapien
caggtgttcccaattctgccagcac

SEQ ID NO: 366411 - DNA, 25 bp, Homo sapien
ttttggctgggcttgcgggctctca

SEQ ID NO: 366412 - DNA, 25 bp, Homo sapien
gggctctcaccgtctggttgattcg

SEQ ID NO: 366413 - DNA, 25 bp, Homo sapien
tggttgattcggacgtggttgcact

SEQ ID NO: 366414 - DNA, 25 bp, Homo sapien
acgtggttgcactgtcctggatcct

SEQ ID NO: 366415 - DNA, 25 bp, Homo sapien
ccaaaggcttctgggagtcgcgcag

SEQ ID NO: 366416 - DNA, 25 bp, Homo sapien
gatgacttctatctctgaatccaag

SEQ ID NO: 366417 - DNA, 25 bp, Homo sapien
tgaaagccgcaagctgcagaaagga

SEQ ID NO: 366418 - DNA, 25 bp, Homo sapien
gaaaggacaagaggcatcacctatg

SEQ ID NO: 366419 - DNA, 25 bp, Homo sapien
ggcatcacctatgtggataaagaca

SEQ ID NO: 366420 - DNA, 25 bp, Homo sapien
ataaagacagcatcctgagttgatg

SEQ ID NO: 366421 - DNA, 25 bp, Homo sapien
gacagcatcctgagttgatggagaa

SEQ ID NO: 366422 - DNA, 25 bp, Homo sapien
gcagccgccgcataagtggtggcca

SEQ ID NO: 366423 - DNA, 25 bp, Homo sapien
agccgccgcataagtggtggccaac

SEQ ID NO: 366424 - DNA, 25 bp, Homo sapien
ccgcataagtggtggccaacgctgg

SEQ ID NO: 366425 - DNA, 25 bp, Homo sapien
aagcagaggccgctctgactacaca

SEQ ID NO: 366426 - DNA, 25 bp, Homo sapien
tcagcccatgtaagctcaccttggc

SEQ ID NO: 366427 - DNA, 25 bp, Homo sapien
gctgtaccccgaggagggagatcaa

SEQ ID NO: 366428 - DNA, 25 bp, Homo sapien
gtatatgttcctactgtcagcttta

SEQ ID NO: 366429 - DNA, 25 bp, Homo sapien
tcagctttactcacatccacatctt

SEQ ID NO: 366430 - DNA, 25 bp, Homo sapien
aacagcttattttttgtcctacatc

SEQ ID NO: 366431 - DNA, 25 bp, Homo sapien
tttttgtcctacatcagtggttctt

SEQ ID NO: 366432 - DNA, 25 bp, Homo sapien
ggttgctgtgggacacctgtctcct

SEQ ID NO: 366433 - DNA, 25 bp, Homo sapien
taaactttactgtaccaagaaagct

SEQ ID NO: 366434 - DNA, 25 bp, Homo sapien
aagcactaaactctgtcttcggtca

SEQ ID NO: 366435 - DNA, 25 bp, Homo sapien
aaactctgtcttcggtcagcatgac

SEQ ID NO: 366436 - DNA, 25 bp, Homo sapien
tcagcatgactctcagcccatgtaa

SEQ ID NO: 366437 - DNA, 25 bp, Homo sapien
gtagtgttaagttgcaacaacaaca

SEQ ID NO: 366438 - DNA, 25 bp, Homo sapien
ttgttcttaaagatgtctcactatg

SEQ ID NO: 366439 - DNA, 25 bp, Homo sapien
agatgtctcactatgattaaaaccc

SEQ ID NO: 366440 - DNA, 25 bp, Homo sapien
attaatgtagtgaaagccacacagg

SEQ ID NO: 366441 - DNA, 25 bp, Homo sapien
acacaggagttccttcttccaggag

SEQ ID NO: 366442 - DNA, 25 bp, Homo sapien
cacaggagttccttcttccaggagg

SEQ ID NO: 366443 - DNA, 25 bp, Homo sapien
ggagaataccaagcacatcactttc

SEQ ID NO: 366444 - DNA, 25 bp, Homo sapien
catcactttctctctgcatcagtga

SEQ ID NO: 366445 - DNA, 25 bp, Homo sapien
atcagtgatgtcaaatacgcatcag

SEQ ID NO: 366446 - DNA, 25 bp, Homo sapien
gaaagagaagcactgctgcttgtct

SEQ ID NO: 366447 - DNA, 25 bp, Homo sapien
gaagcactgctgcttgtctggatat

SEQ ID NO: 366448 - DNA, 25 bp, Homo sapien
agacttcacactgcaagagccttgg

SEQ ID NO: 366449 - DNA, 25 bp, Homo sapien
tgcaagagccttggtgtccacctgg

SEQ ID NO: 366450 - DNA, 25 bp, Homo sapien
acatctgaaagccacgttccttact

SEQ ID NO: 366451 - DNA, 25 bp, Homo sapien
agccacgttccttactgcagaatag

SEQ ID NO: 366452 - DNA, 25 bp, Homo sapien
gcatatatatcgcttaatcttaaat

SEQ ID NO: 366453 - DNA, 25 bp, Homo sapien
gttgttttcagactcagactccatt

SEQ ID NO: 366454 - DNA, 25 bp, Homo sapien
agactcagactccatttgtattata

SEQ ID NO: 366455 - DNA, 25 bp, Homo sapien
tacagggtagcaggtaccactgatt

SEQ ID NO: 366456 - DNA, 25 bp, Homo sapien
gcaggtaccactgatttggagatat

SEQ ID NO: 366457 - DNA, 25 bp, Homo sapien
gggagaacttacattgtgaaacttc

SEQ ID NO: 366458 - DNA, 25 bp, Homo sapien
tgttattttacaagggtctagggag

SEQ ID NO: 366459 - DNA, 25 bp, Homo sapien
tggaaaacaccacctactatcacct

SEQ ID NO: 366460 - DNA, 25 bp, Homo sapien
acctactatcacctctggagcctgg

SEQ ID NO: 366461 - DNA, 25 bp, Homo sapien
tctggagcctgggattatgggataa

SEQ ID NO: 366462 - DNA, 25 bp, Homo sapien
gattatgggataagttttcgatttt

SEQ ID NO: 366463 - DNA, 25 bp, Homo sapien
gtcaaatagctaaagtacacggaaa

SEQ ID NO: 366464 - DNA, 25 bp, Homo sapien
ctaaagtacacggaaagtgcgaaat

SEQ ID NO: 366465 - DNA, 25 bp, Homo sapien
aatagtaaattgaacacctgtgtat

SEQ ID NO: 366466 - DNA, 25 bp, Homo sapien
aaattgaacacctgtgtattcacca

SEQ ID NO: 366467 - DNA, 25 bp, Homo sapien
gtattcaccacacagcttaagcaat

SEQ ID NO: 366468 - DNA, 25 bp, Homo sapien
cacagcttaagcaataacattagca

SEQ ID NO: 366469 - DNA, 25 bp, Homo sapien
ataacattagcaatatttgggtaaa

SEQ ID NO: 366470 - DNA, 25 bp, Homo sapien
gcagagtcaacatggatcatttcac

SEQ ID NO: 366471 - DNA, 25 bp, Homo sapien
atactatgtcttggttttgaggata

SEQ ID NO: 366472 - DNA, 25 bp, Homo sapien
ggatattggatacaaaactctcttc

SEQ ID NO: 366473 - DNA, 25 bp, Homo sapien
ctctcttcctttagggctactgagt

SEQ ID NO: 366474 - DNA, 25 bp, Homo sapien
agggctactgagtcttgattcctga

SEQ ID NO: 366475 - DNA, 25 bp, Homo sapien
gagtcttgattcctgatcatcagaa

SEQ ID NO: 366476 - DNA, 25 bp, Homo sapien
atttcaccagaaacaacttgcttcc

SEQ ID NO: 366477 - DNA, 25 bp, Homo sapien
acttgcttccaatatacccaattct

SEQ ID NO: 366478 - DNA, 25 bp, Homo sapien
gaattcatggagagtgtactggcac

SEQ ID NO: 366479 - DNA, 25 bp, Homo sapien
tgtactggcactggaagagtttagt

SEQ ID NO: 366480 - DNA, 25 bp, Homo sapien
agagtttagtgtttcttgtatgctt

SEQ ID NO: 366481 - DNA, 25 bp, Homo sapien
aaaattccctctggctgcggttccg

SEQ ID NO: 366482 - DNA, 25 bp, Homo sapien
gctgcggttccgagaatagcctgga

SEQ ID NO: 366483 - DNA, 25 bp, Homo sapien
gggacgctgcccaacaagcaggttt

SEQ ID NO: 366484 - DNA, 25 bp, Homo sapien
agcaggtttgcggagactcacacct

SEQ ID NO: 366485 - DNA, 25 bp, Homo sapien
cggagactcacaccttagattctga

SEQ ID NO: 366486 - DNA, 25 bp, Homo sapien
agtttttaagcttgtttcctcagag

SEQ ID NO: 366487 - DNA, 25 bp, Homo sapien
taagcttgtttcctcagagcaggga

SEQ ID NO: 366488 - DNA, 25 bp, Homo sapien
tttcctcagagcagggaactcacga

SEQ ID NO: 366489 - DNA, 25 bp, Homo sapien
agggcgttgtgcagaagagtaacca

SEQ ID NO: 366490 - DNA, 25 bp, Homo sapien
gagtaaccagatctgctctacgttt

SEQ ID NO: 366491 - DNA, 25 bp, Homo sapien
cagatctgctctacgtttcaggaaa

SEQ ID NO: 366492 - DNA, 25 bp, Homo sapien
agccccacctgtaattggcaatgca

SEQ ID NO: 366493 - DNA, 25 bp, Homo sapien
gatatggctcctaactcgagaggcc

SEQ ID NO: 366494 - DNA, 25 bp, Homo sapien
ggcaatgcaatagctaaatcattcc

SEQ ID NO: 366495 - DNA, 25 bp, Homo sapien
attccccctcttagaaacacagatt

SEQ ID NO: 366496 - DNA, 25 bp, Homo sapien
tcctaactcgagaggccaccctttg

SEQ ID NO: 366497 - DNA, 25 bp, Homo sapien
tgtagtttgcaaagccctctccgca

SEQ ID NO: 366498 - DNA, 25 bp, Homo sapien
gcaaagccctctccgcacatgtatt

SEQ ID NO: 366499 - DNA, 25 bp, Homo sapien
tggttatccagatcccttgggaaat

SEQ ID NO: 366500 - DNA, 25 bp, Homo sapien
agaggccaccctttgcggcagggac

SEQ ID NO: 366501 - DNA, 25 bp, Homo sapien
gcaagtgctgtgcattaatgaaaag

SEQ ID NO: 366502 - DNA, 25 bp, Homo sapien
aaagctgtgggctagacaggccccg

SEQ ID NO: 366503 - DNA, 25 bp, Homo sapien
ggaagcactcaataatttcaaacta

SEQ ID NO: 366504 - DNA, 25 bp, Homo sapien
agtatattattagataggctccata

SEQ ID NO: 366505 - DNA, 25 bp, Homo sapien
ttagataggctccataattatttat

SEQ ID NO: 366506 - DNA, 25 bp, Homo sapien
atttattcctttttcaacagacagt

SEQ ID NO: 366507 - DNA, 25 bp, Homo sapien
ttcctttttcaacagacagtatgat

SEQ ID NO: 366508 - DNA, 25 bp, Homo sapien
tttctgtttgtattgttggcaagtt

SEQ ID NO: 366509 - DNA, 25 bp, Homo sapien
attgttggcaagttgttctaaatca

SEQ ID NO: 366510 - DNA, 25 bp, Homo sapien
gttgttctaaatcaacttgccaaca

SEQ ID NO: 366511 - DNA, 25 bp, Homo sapien
tcaacttgccaacatactattaaca

SEQ ID NO: 366512 - DNA, 25 bp, Homo sapien
gtaagaaatgcttctgattcagtaa

SEQ ID NO: 366513 - DNA, 25 bp, Homo sapien
gcttctgattcagtaactgggcaat

SEQ ID NO: 366514 - DNA, 25 bp, Homo sapien
tattcttttatctaacgcttactct

SEQ ID NO: 366515 - DNA, 25 bp, Homo sapien
tctaacgcttactcttacatttctt

SEQ ID NO: 366516 - DNA, 25 bp, Homo sapien
acatttctttaaagctctggccaag

SEQ ID NO: 366517 - DNA, 25 bp, Homo sapien
tatccaccaaactggtaagttggct

SEQ ID NO: 366518 - DNA, 25 bp, Homo sapien
tttttcctccccctgtcattcattt

SEQ ID NO: 366519 - DNA, 25 bp, Homo sapien
attcatttagctgttatatttcatt

SEQ ID NO: 366520 - DNA, 25 bp, Homo sapien
taatgttttgggtggtgcctcttat

SEQ ID NO: 366521 - DNA, 25 bp, Homo sapien
tttgggtggtgcctcttatactatg

SEQ ID NO: 366522 - DNA, 25 bp, Homo sapien
gggtggtgcctcttatactatgttg

SEQ ID NO: 366523 - DNA, 25 bp, Homo sapien
ttaaattgctttactcagattcccc

SEQ ID NO: 366524 - DNA, 25 bp, Homo sapien
gtgcatattatttctcatgcatgaa

SEQ ID NO: 366525 - DNA, 25 bp, Homo sapien
gggttgatccctcacttgactgata

SEQ ID NO: 366526 - DNA, 25 bp, Homo sapien
tgatccctcacttgactgatacttg

SEQ ID NO: 366527 - DNA, 25 bp, Homo sapien
ggagggactgactgtactcatggct

SEQ ID NO: 366528 - DNA, 25 bp, Homo sapien
gggactgactgtactcatggctaac

SEQ ID NO: 366529 - DNA, 25 bp, Homo sapien
gactgactgtactcatggctaactt

SEQ ID NO: 366530 - DNA, 25 bp, Homo sapien
tgactgtactcatggctaacttaaa

SEQ ID NO: 366531 - DNA, 25 bp, Homo sapien
gtactcatggctaacttaaagtatt

SEQ ID NO: 366532 - DNA, 25 bp, Homo sapien
taaggctgtcccctacaaccttctt

SEQ ID NO: 366533 - DNA, 25 bp, Homo sapien
gtagccaaaacagtatatgatccag

SEQ ID NO: 366534 - DNA, 25 bp, Homo sapien
aatgttgtcatccaggtggctttag

SEQ ID NO: 366535 - DNA, 25 bp, Homo sapien
tgtcatccaggtggctttagggtcc

SEQ ID NO: 366536 - DNA, 25 bp, Homo sapien
ctgccgcggacgatggtgaccgtac

SEQ ID NO: 366537 - DNA, 25 bp, Homo sapien
gcggacgatggtgaccgtacgggcc

SEQ ID NO: 366538 - DNA, 25 bp, Homo sapien
gatggtgaccgtacgggccgggccg

SEQ ID NO: 366539 - DNA, 25 bp, Homo sapien
cagaagcaacatccgaggctcggcg

SEQ ID NO: 366540 - DNA, 25 bp, Homo sapien
aagcaacatccgaggctcggcgcag

SEQ ID NO: 366541 - DNA, 25 bp, Homo sapien
aacatccgaggctcggcgcagaaga

SEQ ID NO: 366542 - DNA, 25 bp, Homo sapien
gaggctcggcgcagaagagccgccg

SEQ ID NO: 366543 - DNA, 25 bp, Homo sapien
aagagccgccgctgtgagccgtgcc

SEQ ID NO: 366544 - DNA, 25 bp, Homo sapien
gctgtgagccgtgccgtaccggccc

SEQ ID NO: 366545 - DNA, 25 bp, Homo sapien
gccgccgcccgaggagaacgggagg

SEQ ID NO: 366546 - DNA, 25 bp, Homo sapien
gcgagcgcctgctgccgcggacgat

SEQ ID NO: 366547 - DNA, 25 bp, Homo sapien
aaaagccctatcattttgccagctg

SEQ ID NO: 366548 - DNA, 25 bp, Homo sapien
agccctatcattttgccagctggtg

SEQ ID NO: 366549 - DNA, 25 bp, Homo sapien
ctatcattttgccagctggtgttta

SEQ ID NO: 366550 - DNA, 25 bp, Homo sapien
tcattttgccagctggtgtttaaga

SEQ ID NO: 366551 - DNA, 25 bp, Homo sapien
tgttttctgtgaaaccaggtgtact

SEQ ID NO: 366552 - DNA, 25 bp, Homo sapien
gtgaaaccaggtgtactgcattaga

SEQ ID NO: 366553 - DNA, 25 bp, Homo sapien
caacttttaatcattaagcattgtg

SEQ ID NO: 366554 - DNA, 25 bp, Homo sapien
tagaaattgtttggtttactgtatt

SEQ ID NO: 366555 - DNA, 25 bp, Homo sapien
aaaggtctatgtttaatcagatgga

SEQ ID NO: 366556 - DNA, 25 bp, Homo sapien
gtcttacacacctgtggtgactaat

SEQ ID NO: 366557 - DNA, 25 bp, Homo sapien
ggaaaagccctatcattttgccagc

SEQ ID NO: 366558 - DNA, 25 bp, Homo sapien
gctagctggtttgactctcacgcat

SEQ ID NO: 366559 - DNA, 25 bp, Homo sapien
ggtttgactctcacgcatcaagcgt

SEQ ID NO: 366560 - DNA, 25 bp, Homo sapien
acgcatcaagcgtctcaaatttgag

SEQ ID NO: 366561 - DNA, 25 bp, Homo sapien
tgcggccttcagttgaggtctatta

SEQ ID NO: 366562 - DNA, 25 bp, Homo sapien
aaagattccaaataagacaagggcg

SEQ ID NO: 366563 - DNA, 25 bp, Homo sapien
cccagcccatggagttgctatggtt

SEQ ID NO: 366564 - DNA, 25 bp, Homo sapien
gctatggttaagcagcctgagccgt

SEQ ID NO: 366565 - DNA, 25 bp, Homo sapien
gcagcctgagccgtacagttgaaaa

SEQ ID NO: 366566 - DNA, 25 bp, Homo sapien
ccatctccaaatagcacagccagtt

SEQ ID NO: 366567 - DNA, 25 bp, Homo sapien
aatagcacagccagttcagccgtct

SEQ ID NO: 366568 - DNA, 25 bp, Homo sapien
agccgtctgtcctcaacccaggaga

SEQ ID NO: 366569 - DNA, 25 bp, Homo sapien
caagtgtggctgtgtccatctctgc

SEQ ID NO: 366570 - DNA, 25 bp, Homo sapien
agtgtggctgtgtccatctctgctc

SEQ ID NO: 366571 - DNA, 25 bp, Homo sapien
aaaggcccgctctaggccttatcct

SEQ ID NO: 366572 - DNA, 25 bp, Homo sapien
tctaggccttatcctccctctaggt

SEQ ID NO: 366573 - DNA, 25 bp, Homo sapien
gggcgcccatagcactgccggtaaa

SEQ ID NO: 366574 - DNA, 25 bp, Homo sapien
atagcactgccggtaaaggagcctg

SEQ ID NO: 366575 - DNA, 25 bp, Homo sapien
gcactgccggtaaaggagcctgcat

SEQ ID NO: 366576 - DNA, 25 bp, Homo sapien
aaggagcctgcatgttcaggcccct

SEQ ID NO: 366577 - DNA, 25 bp, Homo sapien
tagacccaattgcttgcccccatga

SEQ ID NO: 366578 - DNA, 25 bp, Homo sapien
ccccatgaggctagcactaatagga

SEQ ID NO: 366579 - DNA, 25 bp, Homo sapien
ggctagcactaataggaaacccttt

SEQ ID NO: 366580 - DNA, 25 bp, Homo sapien
gaaagatttgagttgcccaattata

SEQ ID NO: 366581 - DNA, 25 bp, Homo sapien
tagggaagagctccttcttggacat

SEQ ID NO: 366582 - DNA, 25 bp, Homo sapien
aagagctccttcttggacattccta

SEQ ID NO: 366583 - DNA, 25 bp, Homo sapien
tccttcttggacattcctagggaca

SEQ ID NO: 366584 - DNA, 25 bp, Homo sapien
ttggacattcctagggacaaagaat

SEQ ID NO: 366585 - DNA, 25 bp, Homo sapien
gcctggtggccctcagagtaagtga

SEQ ID NO: 366586 - DNA, 25 bp, Homo sapien
ggccctcagagtaagtgacagcatt

SEQ ID NO: 366587 - DNA, 25 bp, Homo sapien
gtaagtgacagcatttaacgacaga

SEQ ID NO: 366588 - DNA, 25 bp, Homo sapien
ttaacgacagaagtcccagagcaat

SEQ ID NO: 366589 - DNA, 25 bp, Homo sapien
gtcccagagcaatatctgaaggttt

SEQ ID NO: 366590 - DNA, 25 bp, Homo sapien
tcccacataataggatttccaggag

SEQ ID NO: 366591 - DNA, 25 bp, Homo sapien
ccagatccctaagtgtgctgtgcta

SEQ ID NO: 366592 - DNA, 25 bp, Homo sapien
gtttttctgactgaactgttcaggc

SEQ ID NO: 366593 - DNA, 25 bp, Homo sapien
ggctctcagacttggccagtgctgt

SEQ ID NO: 366594 - DNA, 25 bp, Homo sapien
ttttggtctttattccccacatctc

SEQ ID NO: 366595 - DNA, 25 bp, Homo sapien
gattctaccctgaaaaatgttcttg

SEQ ID NO: 366596 - DNA, 25 bp, Homo sapien
ctctgcctggatgcccttgattgtt

SEQ ID NO: 366597 - DNA, 25 bp, Homo sapien
ttgattgttccatgtcctcagcata

SEQ ID NO: 366598 - DNA, 25 bp, Homo sapien
gttcaggcactgactctacatataa

SEQ ID NO: 366599 - DNA, 25 bp, Homo sapien
acatataattatgcttttctacccc

SEQ ID NO: 366600 - DNA, 25 bp, Homo sapien
acactcaacactttgactccagcaa

SEQ ID NO: 366601 - DNA, 25 bp, Homo sapien
acactttgactccagcaatcccaaa

SEQ ID NO: 366602 - DNA, 25 bp, Homo sapien
ccgtctgggaagtctgcctgaacat

SEQ ID NO: 366603 - DNA, 25 bp, Homo sapien
gtctgggaagtctgcctgaacattt

SEQ ID NO: 366604 - DNA, 25 bp, Homo sapien
gaagtctgcctgaacatttccaata

SEQ ID NO: 366605 - DNA, 25 bp, Homo sapien
gtctgcctgaacatttccaatatta

SEQ ID NO: 366606 - DNA, 25 bp, Homo sapien
gcctgaacatttccaatattaaaga

SEQ ID NO: 366607 - DNA, 25 bp, Homo sapien
aaaggtcaaccaaaggtccagatct

SEQ ID NO: 366608 - DNA, 25 bp, Homo sapien
ggtccagatctacaaaatcacctgc

SEQ ID NO: 366609 - DNA, 25 bp, Homo sapien
tcatctgaaatgaaattcttgacaa

SEQ ID NO: 366610 - DNA, 25 bp, Homo sapien
gaaattcttgacaatggattcaaat

SEQ ID NO: 366611 - DNA, 25 bp, Homo sapien
tggattcaaatatatacatgctatg

SEQ ID NO: 366612 - DNA, 25 bp, Homo sapien
atacatgctatgatggcaatttttg

SEQ ID NO: 366613 - DNA, 25 bp, Homo sapien
cttggagatatttccgtcctccacc

SEQ ID NO: 366614 - DNA, 25 bp, Homo sapien
acgtgtctgtggctggaactgccca

SEQ ID NO: 366615 - DNA, 25 bp, Homo sapien
gtctgtggctggaactgcccagcct

SEQ ID NO: 366616 - DNA, 25 bp, Homo sapien
ttaaggattgctgggccaccgcctc

SEQ ID NO: 366617 - DNA, 25 bp, Homo sapien
tgcctaccaccattccatatttaag

SEQ ID NO: 366618 - DNA, 25 bp, Homo sapien
catatttaagtggagcccctacgta

SEQ ID NO: 366619 - DNA, 25 bp, Homo sapien
taagtggagcccctacgtagaaagg

SEQ ID NO: 366620 - DNA, 25 bp, Homo sapien
aaaaaggatcccgtagcaggcagaa

SEQ ID NO: 366621 - DNA, 25 bp, Homo sapien
aaggatcccgtagcaggcagaaaag

SEQ ID NO: 366622 - DNA, 25 bp, Homo sapien
tagcaggcagaaaagccccttccat

SEQ ID NO: 366623 - DNA, 25 bp, Homo sapien
atcctgctcctctgatactgtgccc

SEQ ID NO: 366624 - DNA, 25 bp, Homo sapien
tcatctcccatctcacagccgagcg

SEQ ID NO: 366625 - DNA, 25 bp, Homo sapien
atctcacagccgagcgcccgggcac

SEQ ID NO: 366626 - DNA, 25 bp, Homo sapien
tgggctcaggccagaggtcatcagg

SEQ ID NO: 366627 - DNA, 25 bp, Homo sapien
gggcacccaaccgaggggctagaat

SEQ ID NO: 366628 - DNA, 25 bp, Homo sapien
ggctagaatcgggacaaagcagcag

SEQ ID NO: 366629 - DNA, 25 bp, Homo sapien
agaatcgggacaaagcagcaggcaa

SEQ ID NO: 366630 - DNA, 25 bp, Homo sapien
caaagcagcaggcaaggcctggaaa

SEQ ID NO: 366631 - DNA, 25 bp, Homo sapien
agatgggagaagacaagggcctggg

SEQ ID NO: 366632 - DNA, 25 bp, Homo sapien
ggctccgtagacttagccgctctca

SEQ ID NO: 366633 - DNA, 25 bp, Homo sapien
gctccgtagacttagccgctctcat

SEQ ID NO: 366634 - DNA, 25 bp, Homo sapien
tagacttagccgctctcatcgttcc

SEQ ID NO: 366635 - DNA, 25 bp, Homo sapien
gtgtatttcaagatatgtcttatgt

SEQ ID NO: 366636 - DNA, 25 bp, Homo sapien
tttgaaactgttttgcattgtcagt

SEQ ID NO: 366637 - DNA, 25 bp, Homo sapien
tgttttgcattgtcagttacttaag

SEQ ID NO: 366638 - DNA, 25 bp, Homo sapien
tttgcattgtcagttacttaagcag

SEQ ID NO: 366639 - DNA, 25 bp, Homo sapien
gtttttgagaacataatagggacct

SEQ ID NO: 366640 - DNA, 25 bp, Homo sapien
aatagggacctgtatactccttgtg

SEQ ID NO: 366641 - DNA, 25 bp, Homo sapien
tagggacctgtatactccttgtggg

SEQ ID NO: 366642 - DNA, 25 bp, Homo sapien
gtatactccttgtggggccgcattt

SEQ ID NO: 366643 - DNA, 25 bp, Homo sapien
caccagtacccagtaaattactgtg

SEQ ID NO: 366644 - DNA, 25 bp, Homo sapien
tctcttggtccagtttacctttaga

SEQ ID NO: 366645 - DNA, 25 bp, Homo sapien
ggtccagtttacctttagataaatg

SEQ ID NO: 366646 - DNA, 25 bp, Homo sapien
ttaggttataaaagacactgcagct

SEQ ID NO: 366647 - DNA, 25 bp, Homo sapien
gacactgcagcttctacttgagccc

SEQ ID NO: 366648 - DNA, 25 bp, Homo sapien
catgctatgagcaggcctataaaga

SEQ ID NO: 366649 - DNA, 25 bp, Homo sapien
atgagcaggcctataaagagactta

SEQ ID NO: 366650 - DNA, 25 bp, Homo sapien
aaaaaatgaagtctcctgcccacag

SEQ ID NO: 366651 - DNA, 25 bp, Homo sapien
tgcccacagccacattagtgaacct

SEQ ID NO: 366652 - DNA, 25 bp, Homo sapien
gccacattagtgaacctagaagcag

SEQ ID NO: 366653 - DNA, 25 bp, Homo sapien
gtgaacctagaagcagagactctgt

SEQ ID NO: 366654 - DNA, 25 bp, Homo sapien
gaagcagagactctgtgagataatc

SEQ ID NO: 366655 - DNA, 25 bp, Homo sapien
gttgctcagttttggtctaacttgt

SEQ ID NO: 366656 - DNA, 25 bp, Homo sapien
tcagttttggtctaacttgttatgc

SEQ ID NO: 366657 - DNA, 25 bp, Homo sapien
atgactttgttagctccattaagat

SEQ ID NO: 366658 - DNA, 25 bp, Homo sapien
tgttagctccattaagattttctgt

SEQ ID NO: 366659 - DNA, 25 bp, Homo sapien
aagattttctgttataatccaagat

SEQ ID NO: 366660 - DNA, 25 bp, Homo sapien
aaccttatctattatgcatctttgt

SEQ ID NO: 366661 - DNA, 25 bp, Homo sapien
gcatctttgtatgaaatttagacat

SEQ ID NO: 366662 - DNA, 25 bp, Homo sapien
tgtaaaaatgtaccaagctttattt

SEQ ID NO: 366663 - DNA, 25 bp, Homo sapien
ctcactttctgatagcttggaccta

SEQ ID NO: 366664 - DNA, 25 bp, Homo sapien
gcttggacctatcaactaggtttga

SEQ ID NO: 366665 - DNA, 25 bp, Homo sapien
gagacttttatttaatgagactgaa

SEQ ID NO: 366666 - DNA, 25 bp, Homo sapien
tgagactgaaatgttattaaccatg

SEQ ID NO: 366667 - DNA, 25 bp, Homo sapien
attaaccatgaaatttatacccatt

SEQ ID NO: 366668 - DNA, 25 bp, Homo sapien
aaggtcacccagcaaggtatcagta

SEQ ID NO: 366669 - DNA, 25 bp, Homo sapien
aaggtatcagtagccctgagggtaa

SEQ ID NO: 366670 - DNA, 25 bp, Homo sapien
gtaaggactctgataaggctcggga

SEQ ID NO: 366671 - DNA, 25 bp, Homo sapien
agcgtgtctggaaggctgatccact

SEQ ID NO: 366672 - DNA, 25 bp, Homo sapien
gaaggctgatccactgctgggccca

SEQ ID NO: 366673 - DNA, 25 bp, Homo sapien
ggagcagacccgactgcacatggct

SEQ ID NO: 366674 - DNA, 25 bp, Homo sapien
tgcacatggctcttttgctggaaga

SEQ ID NO: 366675 - DNA, 25 bp, Homo sapien
tgaaaatcacgtagcccaaccctat

SEQ ID NO: 366676 - DNA, 25 bp, Homo sapien
gcccaaccctatcattttcatatta

SEQ ID NO: 366677 - DNA, 25 bp, Homo sapien
gagtccaggtaagtgaatctgtcca

SEQ ID NO: 366678 - DNA, 25 bp, Homo sapien
taagtgaatctgtccaaggtcaccc

SEQ ID NO: 366679 - DNA, 25 bp, Homo sapien
atctgtatgtgttctgtgtcccttg

SEQ ID NO: 366680 - DNA, 25 bp, Homo sapien
ctgtgtcccttgcatgtgtgcgtgt

SEQ ID NO: 366681 - DNA, 25 bp, Homo sapien
tagagtgagcgcgtatgcatcaact

SEQ ID NO: 366682 - DNA, 25 bp, Homo sapien
gcatcaactcattgggctcttggct

SEQ ID NO: 366683 - DNA, 25 bp, Homo sapien
ggctcttggctgctcacaaggcaaa

SEQ ID NO: 366684 - DNA, 25 bp, Homo sapien
ggcaaatttgacttggaaagacttt

SEQ ID NO: 366685 - DNA, 25 bp, Homo sapien
gaaagactttcatctccttggaacc

SEQ ID NO: 366686 - DNA, 25 bp, Homo sapien
atctccttggaaccaagacttcctg

SEQ ID NO: 366687 - DNA, 25 bp, Homo sapien
gagacacttataatttctactactg

SEQ ID NO: 366688 - DNA, 25 bp, Homo sapien
atttctactactgcactactgtcca

SEQ ID NO: 366689 - DNA, 25 bp, Homo sapien
gcactactgtccattgtgggatgat

SEQ ID NO: 366690 - DNA, 25 bp, Homo sapien
ttctttgccctttgaatgttggtca

SEQ ID NO: 366691 - DNA, 25 bp, Homo sapien
gttggtcatatagtggtcattggcc

SEQ ID NO: 366692 - DNA, 25 bp, Homo sapien
cattggccaggacataaagaagcgg

SEQ ID NO: 366693 - DNA, 25 bp, Homo sapien
aagaagcgggctgatgcctatcctt

SEQ ID NO: 366694 - DNA, 25 bp, Homo sapien
ttgtttttctatagcctcatctcta

SEQ ID NO: 366695 - DNA, 25 bp, Homo sapien
gcctcatctctatagacaacattct

SEQ ID NO: 366696 - DNA, 25 bp, Homo sapien
acaacattctgtccacaagtgaaga

SEQ ID NO: 366697 - DNA, 25 bp, Homo sapien
gaagcaaacaggtggaatcctcagg

SEQ ID NO: 366698 - DNA, 25 bp, Homo sapien
gaatcctcaggagagtctttttgta

SEQ ID NO: 366699 - DNA, 25 bp, Homo sapien
gaaacctccaatccattaacattgt

SEQ ID NO: 366700 - DNA, 25 bp, Homo sapien
acattgtatatcctgtcttcttcaa

SEQ ID NO: 366701 - DNA, 25 bp, Homo sapien
aagttctagtgttctctagcactac

SEQ ID NO: 366702 - DNA, 25 bp, Homo sapien
gtgttctctagcactacagggtgac

SEQ ID NO: 366703 - DNA, 25 bp, Homo sapien
tctagcactacagggtgactataat

SEQ ID NO: 366704 - DNA, 25 bp, Homo sapien
ttttcacatacctagaagagcacat

SEQ ID NO: 366705 - DNA, 25 bp, Homo sapien
cacatacctagaagagcacattttg

SEQ ID NO: 366706 - DNA, 25 bp, Homo sapien
aaaagttttgagatgttggatacgt

SEQ ID NO: 366707 - DNA, 25 bp, Homo sapien
tgttggatacgttaattaccctgat

SEQ ID NO: 366708 - DNA, 25 bp, Homo sapien
gatctttacgcattgtatacttgtt

SEQ ID NO: 366709 - DNA, 25 bp, Homo sapien
tacgcattgtatacttgttgcacaa

SEQ ID NO: 366710 - DNA, 25 bp, Homo sapien
gtatacttgttgcacaatgtcatgt

SEQ ID NO: 366711 - DNA, 25 bp, Homo sapien
gcacaatgtcatgttgtaccccata

SEQ ID NO: 366712 - DNA, 25 bp, Homo sapien
agtgaagttacttctgggtgttctg

SEQ ID NO: 366713 - DNA, 25 bp, Homo sapien
tctgggtgttctggagtttcaggtt

SEQ ID NO: 366714 - DNA, 25 bp, Homo sapien
ggtgttctggagtttcaggttgatt

SEQ ID NO: 366715 - DNA, 25 bp, Homo sapien
ctggagtttcaggttgattttgaat

SEQ ID NO: 366716 - DNA, 25 bp, Homo sapien
gtagaattttttcttctaggaggct

SEQ ID NO: 366717 - DNA, 25 bp, Homo sapien
ttttcttctaggaggctttcaagtt

SEQ ID NO: 366718 - DNA, 25 bp, Homo sapien
atattctttacctcttcatttttga

SEQ ID NO: 366719 - DNA, 25 bp, Homo sapien
cttcatttttgacttgtagtttata

SEQ ID NO: 366720 - DNA, 25 bp, Homo sapien
ttatatgtagttcttctcagttcct

SEQ ID NO: 366721 - DNA, 25 bp, Homo sapien
atgtagttcttctcagttccttttc

SEQ ID NO: 366722 - DNA, 25 bp, Homo sapien
tagttcttctcagttccttttcttc

SEQ ID NO: 366723 - DNA, 25 bp, Homo sapien
ttttcccacagtaagccttttctca

SEQ ID NO: 366724 - DNA, 25 bp, Homo sapien
gtaagccttttctcaaatgctaaaa

SEQ ID NO: 366725 - DNA, 25 bp, Homo sapien
gggaagactcaaactatttgccatt

SEQ ID NO: 366726 - DNA, 25 bp, Homo sapien
ttcctctctttgcttaactcagaga

SEQ ID NO: 366727 - DNA, 25 bp, Homo sapien
gagagaaggccaaatatctattaaa

SEQ ID NO: 366728 - DNA, 25 bp, Homo sapien
aattcttcagggtctgattgctcct

SEQ ID NO: 366729 - DNA, 25 bp, Homo sapien
ggtctgattgctcctggaagtttca

SEQ ID NO: 366730 - DNA, 25 bp, Homo sapien
gctcctggaagtttcatatttttga

SEQ ID NO: 366731 - DNA, 25 bp, Homo sapien
aaaccttttgatgactaccagaaca

SEQ ID NO: 366732 - DNA, 25 bp, Homo sapien
gctgttctcactgatcagtttagta

SEQ ID NO: 366733 - DNA, 25 bp, Homo sapien
gtgtgactatgtttgaattttcttc

SEQ ID NO: 366734 - DNA, 25 bp, Homo sapien
ggaccattcgggttatatggttcat

SEQ ID NO: 366735 - DNA, 25 bp, Homo sapien
tgctcatttttatgtcatggtgttt

SEQ ID NO: 366736 - DNA, 25 bp, Homo sapien
ttatcttttctgtgctgatttgtaa

SEQ ID NO: 366737 - DNA, 25 bp, Homo sapien
gctattttaaaacccttcatctgcc

SEQ ID NO: 366738 - DNA, 25 bp, Homo sapien
taaaacccttcatctgccatatatg

SEQ ID NO: 366739 - DNA, 25 bp, Homo sapien
tttcttctccaaccttgggccactg

SEQ ID NO: 366740 - DNA, 25 bp, Homo sapien
gggccactggcatatacactcattt

SEQ ID NO: 366741 - DNA, 25 bp, Homo sapien
atcagaacttgtagtgctctttgaa

SEQ ID NO: 366742 - DNA, 25 bp, Homo sapien
gctctttgaaatgcagacagactat

SEQ ID NO: 366743 - DNA, 25 bp, Homo sapien
gactatggttcattctgcaactgca

SEQ ID NO: 366744 - DNA, 25 bp, Homo sapien
gcaactgcatattagttaacaggca

SEQ ID NO: 366745 - DNA, 25 bp, Homo sapien
aagttctaaagtaacattctattgc

SEQ ID NO: 366746 - DNA, 25 bp, Homo sapien
ctaaagtaacattctattgctaaag

SEQ ID NO: 366747 - DNA, 25 bp, Homo sapien
attgctaaagaaatcctaacctact

SEQ ID NO: 366748 - DNA, 25 bp, Homo sapien
gctaaagaaatcctaacctactatg

SEQ ID NO: 366749 - DNA, 25 bp, Homo sapien
gaaatcctaacctactatgtaacat

SEQ ID NO: 366750 - DNA, 25 bp, Homo sapien
atcctaacctactatgtaacatttt

SEQ ID NO: 366751 - DNA, 25 bp, Homo sapien
taacctactatgtaacatttttctc

SEQ ID NO: 366752 - DNA, 25 bp, Homo sapien
gtgaacttattattaacctcaattt

SEQ ID NO: 366753 - DNA, 25 bp, Homo sapien
ctcaattttttagaggcctccaatc

SEQ ID NO: 366754 - DNA, 25 bp, Homo sapien
tcaattttttagaggcctccaatct

SEQ ID NO: 366755 - DNA, 25 bp, Homo sapien
tgacaaatcataattatacacttat

SEQ ID NO: 366756 - DNA, 25 bp, Homo sapien
aaacttatttgcagtgaagactaga

SEQ ID NO: 366757 - DNA, 25 bp, Homo sapien
atgactaacacattaaattctgaag

SEQ ID NO: 366758 - DNA, 25 bp, Homo sapien
ttacttgtgggactttaggaaacat

SEQ ID NO: 366759 - DNA, 25 bp, Homo sapien
cattaaattctgaagtaccacataa

SEQ ID NO: 366760 - DNA, 25 bp, Homo sapien
gggactttaggaaacatgcttcatc

SEQ ID NO: 366761 - DNA, 25 bp, Homo sapien
ttttttgtaagtgttgtttgagagc

SEQ ID NO: 366762 - DNA, 25 bp, Homo sapien
tttaggaaacatgcttcatctggtc

SEQ ID NO: 366763 - DNA, 25 bp, Homo sapien
aggaaacatgcttcatctggtcctg

SEQ ID NO: 366764 - DNA, 25 bp, Homo sapien
tgcttctgtttctgctatcttacaa

SEQ ID NO: 366765 - DNA, 25 bp, Homo sapien
ctgtttctgctatcttacaatgaag

SEQ ID NO: 366766 - DNA, 25 bp, Homo sapien
tcttacaatgaagataattttcccc

SEQ ID NO: 366767 - DNA, 25 bp, Homo sapien
tattttataacgcactagaggagac

SEQ ID NO: 366768 - DNA, 25 bp, Homo sapien
ataacgcactagaggagacagagac

SEQ ID NO: 366769 - DNA, 25 bp, Homo sapien
gagacagagacgtcattgcttcacc

SEQ ID NO: 366770 - DNA, 25 bp, Homo sapien
gacagagacgtcattgcttcaccca

SEQ ID NO: 366771 - DNA, 25 bp, Homo sapien
acagagacgtcattgcttcacccag

SEQ ID NO: 366772 - DNA, 25 bp, Homo sapien
agagacgtcattgcttcacccaggg

SEQ ID NO: 366773 - DNA, 25 bp, Homo sapien
gagacgtcattgcttcacccagggc

SEQ ID NO: 366774 - DNA, 25 bp, Homo sapien
gcatggaaatacaaacagcccttct

SEQ ID NO: 366775 - DNA, 25 bp, Homo sapien
tggaaatacaaacagcccttctcct

SEQ ID NO: 366776 - DNA, 25 bp, Homo sapien
ggaaatacaaacagcccttctcctc

SEQ ID NO: 366777 - DNA, 25 bp, Homo sapien
ttctatcaggcaagatggaagactc

SEQ ID NO: 366778 - DNA, 25 bp, Homo sapien
gcggcggcatcctccgcaatgtgtc

SEQ ID NO: 366779 - DNA, 25 bp, Homo sapien
ccacccgtgaggactacaggcaggt

SEQ ID NO: 366780 - DNA, 25 bp, Homo sapien
acaggcaggtgctccgggatcacaa

SEQ ID NO: 366781 - DNA, 25 bp, Homo sapien
gggatcacaactgtctgcagacgct

SEQ ID NO: 366782 - DNA, 25 bp, Homo sapien
gtctgcagacgctgctgcagcatct

SEQ ID NO: 366783 - DNA, 25 bp, Homo sapien
atctgacttcgcacagcctgaccat

SEQ ID NO: 366784 - DNA, 25 bp, Homo sapien
tgaccatcgtgagcaacgcgtgcgg

SEQ ID NO: 366785 - DNA, 25 bp, Homo sapien
tgcggcacgctctggaacctgtcgg

SEQ ID NO: 366786 - DNA, 25 bp, Homo sapien
gggcatgctgcgtaatctggtgcac

SEQ ID NO: 366787 - DNA, 25 bp, Homo sapien
taatctggtgcactccaagcacaag

SEQ ID NO: 366788 - DNA, 25 bp, Homo sapien
gcacaagatgatcgccatgggcagc

SEQ ID NO: 366789 - DNA, 25 bp, Homo sapien
ttgcgctccgagcccagaggaagat

SEQ ID NO: 366790 - DNA, 25 bp, Homo sapien
aggaagatgcctgccggcaccgagc

SEQ ID NO: 366791 - DNA, 25 bp, Homo sapien
gggctgaacgcctgtcttccaggcg

SEQ ID NO: 366792 - DNA, 25 bp, Homo sapien
tgccctcggccggtgtcggtagcgg

SEQ ID NO: 366793 - DNA, 25 bp, Homo sapien
ccggtgtcggtagcggcactcggcg

SEQ ID NO: 366794 - DNA, 25 bp, Homo sapien
gtgccccgggcggacgaagagcgca

SEQ ID NO: 366795 - DNA, 25 bp, Homo sapien
aagagcgcaggctgggtacaccttg

SEQ ID NO: 366796 - DNA, 25 bp, Homo sapien
gcaggctgggtacaccttgcccgaa

SEQ ID NO: 366797 - DNA, 25 bp, Homo sapien
tgggtacaccttgcccgaatcggcg

SEQ ID NO: 366798 - DNA, 25 bp, Homo sapien
acaccttgcccgaatcggcggagtt

SEQ ID NO: 366799 - DNA, 25 bp, Homo sapien
aatcggcggagttcgcagctagcga

SEQ ID NO: 366800 - DNA, 25 bp, Homo sapien
agaccagtttgtcttgtaaactgtc

SEQ ID NO: 366801 - DNA, 25 bp, Homo sapien
gaccagtttgtcttgtaaactgtct

SEQ ID NO: 366802 - DNA, 25 bp, Homo sapien
gtttgtcttgtaaactgtcttactt

SEQ ID NO: 366803 - DNA, 25 bp, Homo sapien
ttgtcttgtaaactgtcttacttat

SEQ ID NO: 366804 - DNA, 25 bp, Homo sapien
gtcttgtaaactgtcttacttatgt

SEQ ID NO: 366805 - DNA, 25 bp, Homo sapien
ttgtaaactgtcttacttatgtgtg

SEQ ID NO: 366806 - DNA, 25 bp, Homo sapien
gtaaactgtcttacttatgtgtgta

SEQ ID NO: 366807 - DNA, 25 bp, Homo sapien
aaactgtcttacttatgtgtgtaaa

SEQ ID NO: 366808 - DNA, 25 bp, Homo sapien
cctttatataattggattcagaatc

SEQ ID NO: 366809 - DNA, 25 bp, Homo sapien
gaatcataagggacaggactgaaat

SEQ ID NO: 366810 - DNA, 25 bp, Homo sapien
ataagggacaggactgaaattattc

SEQ ID NO: 366811 - DNA, 25 bp, Homo sapien
gatttcactggctgattcgtttgtt

SEQ ID NO: 366812 - DNA, 25 bp, Homo sapien
gattcgtttgtttcagatgcttgaa

SEQ ID NO: 366813 - DNA, 25 bp, Homo sapien
gatgcttgaacggatgctttagaat

SEQ ID NO: 366814 - DNA, 25 bp, Homo sapien
ttagaattttctgcctgagctacgg

SEQ ID NO: 366815 - DNA, 25 bp, Homo sapien
tgagctacggcaccaagctggttag

SEQ ID NO: 366816 - DNA, 25 bp, Homo sapien
ccaagctggttagtcggaaggcgtt

SEQ ID NO: 366817 - DNA, 25 bp, Homo sapien
ggcgtttgtggctaaggccttgaaa

SEQ ID NO: 366818 - DNA, 25 bp, Homo sapien
aaagtctcaagtgggcttatttcta

SEQ ID NO: 366819 - DNA, 25 bp, Homo sapien
gggcttatttctactgaaacagcat

SEQ ID NO: 366820 - DNA, 25 bp, Homo sapien
tccaagcaaagcactcctccggaag

SEQ ID NO: 366821 - DNA, 25 bp, Homo sapien
agatgctaacagatgagatttcact

SEQ ID NO: 366822 - DNA, 25 bp, Homo sapien
tccccacagctggtaatctggactt

SEQ ID NO: 366823 - DNA, 25 bp, Homo sapien
ccccacagctggtaatctggactta

SEQ ID NO: 366824 - DNA, 25 bp, Homo sapien
cccacagctggtaatctggacttaa

SEQ ID NO: 366825 - DNA, 25 bp, Homo sapien
ccacagctggtaatctggacttaag

SEQ ID NO: 366826 - DNA, 25 bp, Homo sapien
cacagctggtaatctggacttaagg

SEQ ID NO: 366827 - DNA, 25 bp, Homo sapien
acagctggtaatctggacttaagga

SEQ ID NO: 366828 - DNA, 25 bp, Homo sapien
cagctggtaatctggacttaaggat

SEQ ID NO: 366829 - DNA, 25 bp, Homo sapien
ctggtaatctggacttaaggattgc

SEQ ID NO: 366830 - DNA, 25 bp, Homo sapien
ggtaatctggacttaaggattgctg

SEQ ID NO: 366831 - DNA, 25 bp, Homo sapien
taatctggacttaaggattgctggg

SEQ ID NO: 366832 - DNA, 25 bp, Homo sapien
gcccggcttcacacccatttcttta

SEQ ID NO: 366833 - DNA, 25 bp, Homo sapien
aaatcatttaagaccttgtttcata

SEQ ID NO: 366834 - DNA, 25 bp, Homo sapien
aacactgggaacatatgaaactttg

SEQ ID NO: 366835 - DNA, 25 bp, Homo sapien
ttagatttctaagctgtatttcagt

SEQ ID NO: 366836 - DNA, 25 bp, Homo sapien
gaaactttgtcagcatcagataata

SEQ ID NO: 366837 - DNA, 25 bp, Homo sapien
gttgtagcgacttgaaacatttttt

SEQ ID NO: 366838 - DNA, 25 bp, Homo sapien
tgattgtgccagtcactatttgtga

SEQ ID NO: 366839 - DNA, 25 bp, Homo sapien
cactatttgtgacttggattgaacc

SEQ ID NO: 366840 - DNA, 25 bp, Homo sapien
cttggattgaaccttgatatgactt

SEQ ID NO: 366841 - DNA, 25 bp, Homo sapien
gagtggtataactggatcataatat

SEQ ID NO: 366842 - DNA, 25 bp, Homo sapien
gatcataatatccttgtttgccact

SEQ ID NO: 366843 - DNA, 25 bp, Homo sapien
gtttgccactcaagaaagtgttcca

SEQ ID NO: 366844 - DNA, 25 bp, Homo sapien
attttcttaggatctatatcctata

SEQ ID NO: 366845 - DNA, 25 bp, Homo sapien
tattgtgttgttctaacaagacaga

SEQ ID NO: 366846 - DNA, 25 bp, Homo sapien
atcctttgatttttactctaagtat

SEQ ID NO: 366847 - DNA, 25 bp, Homo sapien
tgatttttactctaagtatggtaga

SEQ ID NO: 366848 - DNA, 25 bp, Homo sapien
gtaagaggctaaacaagaagctgtt

SEQ ID NO: 366849 - DNA, 25 bp, Homo sapien
tccttgaagacattgctttcagtca

SEQ ID NO: 366850 - DNA, 25 bp, Homo sapien
gaagacattgctttcagtcaccata

SEQ ID NO: 366851 - DNA, 25 bp, Homo sapien
attgctttcagtcaccatacatgtc

SEQ ID NO: 366852 - DNA, 25 bp, Homo sapien
gctttcagtcaccatacatgtctaa

SEQ ID NO: 366853 - DNA, 25 bp, Homo sapien
gtcaccatacatgtctaaataattt

SEQ ID NO: 366854 - DNA, 25 bp, Homo sapien
cttatcattcattctatgtaggaat

SEQ ID NO: 366855 - DNA, 25 bp, Homo sapien
agaaaaagagctgagccttctgccc

SEQ ID NO: 366856 - DNA, 25 bp, Homo sapien
tcaagcctcggaagcacagatttag

SEQ ID NO: 366857 - DNA, 25 bp, Homo sapien
gggtttctgagagcctgggtattca

SEQ ID NO: 366858 - DNA, 25 bp, Homo sapien
gagagcctgggtattcaaatgataa

SEQ ID NO: 366859 - DNA, 25 bp, Homo sapien
tgtggtgcagggacaagacttcagt

SEQ ID NO: 366860 - DNA, 25 bp, Homo sapien
aagacttcagtcagaggacccaggg

SEQ ID NO: 366861 - DNA, 25 bp, Homo sapien
tgacgttgggcagctgaccttacta

SEQ ID NO: 366862 - DNA, 25 bp, Homo sapien
gcacagatttaggagtcactgactt

SEQ ID NO: 366863 - DNA, 25 bp, Homo sapien
gaccttactatcagtgcctcagttt

SEQ ID NO: 366864 - DNA, 25 bp, Homo sapien
gtcactgacttagaggtggtagttt

SEQ ID NO: 366865 - DNA, 25 bp, Homo sapien
gtgacgtgatggttaagttcaccaa

SEQ ID NO: 366866 - DNA, 25 bp, Homo sapien
gggtcctcaagatcttcggcgccgg

SEQ ID NO: 366867 - DNA, 25 bp, Homo sapien
cctcaagatcttcggcgccggactg

SEQ ID NO: 366868 - DNA, 25 bp, Homo sapien
gccggactggcatcgggcgccaact

SEQ ID NO: 366869 - DNA, 25 bp, Homo sapien
ggcatcgggcgccaactacaagagc

SEQ ID NO: 366870 - DNA, 25 bp, Homo sapien
atcgggcgccaactacaagagcgtg

SEQ ID NO: 366871 - DNA, 25 bp, Homo sapien
ggcgccaactacaagagcgtgctgg

SEQ ID NO: 366872 - DNA, 25 bp, Homo sapien
aactacaagagcgtgctggccacgg

SEQ ID NO: 366873 - DNA, 25 bp, Homo sapien
gcgcgagctcgtggccgaggcgcta

SEQ ID NO: 366874 - DNA, 25 bp, Homo sapien
cgaggcgctagagcgctacggccta

SEQ ID NO: 366875 - DNA, 25 bp, Homo sapien
gcgctagagcgctacggcctagcag

SEQ ID NO: 366876 - DNA, 25 bp, Homo sapien
tagagcgctacggcctagcaggcag

SEQ ID NO: 366877 - DNA, 25 bp, Homo sapien
tggtctacaacttgagctgacaaaa

SEQ ID NO: 366878 - DNA, 25 bp, Homo sapien
ttgagctgacaaaaaaccggttgca

SEQ ID NO: 366879 - DNA, 25 bp, Homo sapien
aaaaccggttgcagaggccttctgg

SEQ ID NO: 366880 - DNA, 25 bp, Homo sapien
acatgatgtcatgtccttgacaagg

SEQ ID NO: 366881 - DNA, 25 bp, Homo sapien
gacaagggagcttctttatgtgtag

SEQ ID NO: 366882 - DNA, 25 bp, Homo sapien
gtgtagctacactccatgattccaa

SEQ ID NO: 366883 - DNA, 25 bp, Homo sapien
tccatgattccaagagcccagcagc

SEQ ID NO: 366884 - DNA, 25 bp, Homo sapien
ggctggcctgtttctagagtcataa

SEQ ID NO: 366885 - DNA, 25 bp, Homo sapien
tgggctgaagattttggacctgagt

SEQ ID NO: 366886 - DNA, 25 bp, Homo sapien
ggacctgagtttatcactttatgaa

SEQ ID NO: 366887 - DNA, 25 bp, Homo sapien
atcactttatgaactcttatatcag

SEQ ID NO: 366888 - DNA, 25 bp, Homo sapien
agtcagcccggtcaagcatgacagc

SEQ ID NO: 366889 - DNA, 25 bp, Homo sapien
agcaactcaaactcggcaaacttcc

SEQ ID NO: 366890 - DNA, 25 bp, Homo sapien
aactcggcaaacttccaagacgtgg

SEQ ID NO: 366891 - DNA, 25 bp, Homo sapien
caagacgtggaggacatgcctgaca

SEQ ID NO: 366892 - DNA, 25 bp, Homo sapien
catgcctgacagatgtgccttggaa

SEQ ID NO: 366893 - DNA, 25 bp, Homo sapien
agagtctgagagtccaggtgagcca

SEQ ID NO: 366894 - DNA, 25 bp, Homo sapien
ccaggtgagccaaggcatcattcat

SEQ ID NO: 366895 - DNA, 25 bp, Homo sapien
ggcatcattcatggatagcaaaggt

SEQ ID NO: 366896 - DNA, 25 bp, Homo sapien
ggatagcaaaggtctgcccctgcaa

SEQ ID NO: 366897 - DNA, 25 bp, Homo sapien
gcccctgcaaggtgtcttaaatgga

SEQ ID NO: 366898 - DNA, 25 bp, Homo sapien
taaatggaatctcatcagtaggagc

SEQ ID NO: 366899 - DNA, 25 bp, Homo sapien
gtcctgcccagtgtagaccgtggac

SEQ ID NO: 366900 - DNA, 25 bp, Homo sapien
gtagaccgtggaccccgcagccgaa

SEQ ID NO: 366901 - DNA, 25 bp, Homo sapien
gaatcccttgggaagctgcttaaag

SEQ ID NO: 366902 - DNA, 25 bp, Homo sapien
agctgcttaaagtgcatcctaccaa

SEQ ID NO: 366903 - DNA, 25 bp, Homo sapien
aaagtgcatcctaccaatgcagctc

SEQ ID NO: 366904 - DNA, 25 bp, Homo sapien
atgcagctcctttagggccatggag

SEQ ID NO: 366905 - DNA, 25 bp, Homo sapien
catggagccccaatactctgcattc

SEQ ID NO: 366906 - DNA, 25 bp, Homo sapien
tctgcattcctaacacgcgctgtgg

SEQ ID NO: 366907 - DNA, 25 bp, Homo sapien
ggcaggcgcagtccaggtacaccta

SEQ ID NO: 366908 - DNA, 25 bp, Homo sapien
tccttcccagtctactcaacatgaa

SEQ ID NO: 366909 - DNA, 25 bp, Homo sapien
gaagacgacagagaggaagaccttt

SEQ ID NO: 366910 - DNA, 25 bp, Homo sapien
tcttttcagctacacttagtcctga

SEQ ID NO: 366911 - DNA, 25 bp, Homo sapien
cagctacacttagtcctgagatgta

SEQ ID NO: 366912 - DNA, 25 bp, Homo sapien
acttagtcctgagatgtattttttc

SEQ ID NO: 366913 - DNA, 25 bp, Homo sapien
gaatacaaaaggagcccattttata

SEQ ID NO: 366914 - DNA, 25 bp, Homo sapien
taaaccttgatgtacatgttgagat

SEQ ID NO: 366915 - DNA, 25 bp, Homo sapien
gccttaaaaggaatgcatatggata

SEQ ID NO: 366916 - DNA, 25 bp, Homo sapien
aaagttgcacttataacacccttca

SEQ ID NO: 366917 - DNA, 25 bp, Homo sapien
gcacttataacacccttcaacaaaa

SEQ ID NO: 366918 - DNA, 25 bp, Homo sapien
ttttctttttcagtgtctaccattg

SEQ ID NO: 366919 - DNA, 25 bp, Homo sapien
tttcagtgtctaccattgtacttat

SEQ ID NO: 366920 - DNA, 25 bp, Homo sapien
gtctaccattgtacttataactgtt

SEQ ID NO: 366921 - DNA, 25 bp, Homo sapien
gaggcacggctggaggcgggttgga

SEQ ID NO: 366922 - DNA, 25 bp, Homo sapien
gcagcgcgcagctttgttgtgtctc

SEQ ID NO: 366923 - DNA, 25 bp, Homo sapien
agcgcgcagctttgttgtgtctcgt

SEQ ID NO: 366924 - DNA, 25 bp, Homo sapien
cgcgcagctttgttgtgtctcgtct

SEQ ID NO: 366925 - DNA, 25 bp, Homo sapien
attcgggaagcttctgtgcgtaggc

SEQ ID NO: 366926 - DNA, 25 bp, Homo sapien
aagcttctgtgcgtaggcgatgcag

SEQ ID NO: 366927 - DNA, 25 bp, Homo sapien
agcttctgtgcgtaggcgatgcagt

SEQ ID NO: 366928 - DNA, 25 bp, Homo sapien
cttctgtgcgtaggcgatgcagttt

SEQ ID NO: 366929 - DNA, 25 bp, Homo sapien
gcgtaggcgatgcagtttgagaggc

SEQ ID NO: 366930 - DNA, 25 bp, Homo sapien
ggctcagtgagtggccgccgtgggc

SEQ ID NO: 366931 - DNA, 25 bp, Homo sapien
gcccctggagcacagcgcggcttgg

SEQ ID NO: 366932 - DNA, 25 bp, Homo sapien
gaattagtatgcctctcagaatagc

SEQ ID NO: 366933 - DNA, 25 bp, Homo sapien
aggcagaactgctcttgtctaactt

SEQ ID NO: 366934 - DNA, 25 bp, Homo sapien
gctcttgtctaacttatttcatgtg

SEQ ID NO: 366935 - DNA, 25 bp, Homo sapien
ttcatgtgacatgcagtggagggat

SEQ ID NO: 366936 - DNA, 25 bp, Homo sapien
taagcagttgaaacccatcccatta

SEQ ID NO: 366937 - DNA, 25 bp, Homo sapien
aatgttagtgtgagtattccttagg

SEQ ID NO: 366938 - DNA, 25 bp, Homo sapien
attccttaggtgttattgtgtcttg

SEQ ID NO: 366939 - DNA, 25 bp, Homo sapien
tggagtcaagacaagcctgtccctc

SEQ ID NO: 366940 - DNA, 25 bp, Homo sapien
taccctcaaaggcacatgttttttc

SEQ ID NO: 366941 - DNA, 25 bp, Homo sapien
tcctcccagcaaaaccatctgaaag

SEQ ID NO: 366942 - DNA, 25 bp, Homo sapien
catctgaaagttctgtttagggttt

SEQ ID NO: 366943 - DNA, 25 bp, Homo sapien
ctctctggtctcaggccagctggcg

SEQ ID NO: 366944 - DNA, 25 bp, Homo sapien
atgggtggctagagtgatgaactca

SEQ ID NO: 366945 - DNA, 25 bp, Homo sapien
agagtgatgaactcaagccctgtgg

SEQ ID NO: 366946 - DNA, 25 bp, Homo sapien
tagtctccacggtgcccttcacaga

SEQ ID NO: 366947 - DNA, 25 bp, Homo sapien
ggtgcccttcacagagggcttggta

SEQ ID NO: 366948 - DNA, 25 bp, Homo sapien
atggccatgcccaggtgtgtgttga

SEQ ID NO: 366949 - DNA, 25 bp, Homo sapien
aggtgtgtgttgagaccattgacaa

SEQ ID NO: 366950 - DNA, 25 bp, Homo sapien
tgagaccattgacaactgctcgtgt

SEQ ID NO: 366951 - DNA, 25 bp, Homo sapien
gaccattgacaactgctcgtgtaca

SEQ ID NO: 366952 - DNA, 25 bp, Homo sapien
tgacaactgctcgtgtacaggcacc

SEQ ID NO: 366953 - DNA, 25 bp, Homo sapien
gggcacagcaggcatgcgagtgaga

SEQ ID NO: 366954 - DNA, 25 bp, Homo sapien
gatactggatctcttattctctatg

SEQ ID NO: 366955 - DNA, 25 bp, Homo sapien
tattctctatgcacttccttacaca

SEQ ID NO: 366956 - DNA, 25 bp, Homo sapien
aagggcctctcagttgaggcactac

SEQ ID NO: 366957 - DNA, 25 bp, Homo sapien
gttgaggcactactccaccttaaat

SEQ ID NO: 366958 - DNA, 25 bp, Homo sapien
aggtggccacattcagaagcactgt

SEQ ID NO: 366959 - DNA, 25 bp, Homo sapien
tggcctctcagcaacatgctaacac

SEQ ID NO: 366960 - DNA, 25 bp, Homo sapien
tatgagtcagctctgccaacaggat

SEQ ID NO: 366961 - DNA, 25 bp, Homo sapien
gccaacaggattgcttcctaggaaa

SEQ ID NO: 366962 - DNA, 25 bp, Homo sapien
gggtatccactctgctttcttggga

SEQ ID NO: 366963 - DNA, 25 bp, Homo sapien
tcttgggaaagcttcacggtatctt

SEQ ID NO: 366964 - DNA, 25 bp, Homo sapien
ggattccacaccctggagatactgg

SEQ ID NO: 366965 - DNA, 25 bp, Homo sapien
ctcctggttggaaaacggactgtca

SEQ ID NO: 366966 - DNA, 25 bp, Homo sapien
aacggactgtcatatcactctacat

SEQ ID NO: 366967 - DNA, 25 bp, Homo sapien
gtcatatcactctacattcatcatc

SEQ ID NO: 366968 - DNA, 25 bp, Homo sapien
tattttcccctttagagatgtcctg

SEQ ID NO: 366969 - DNA, 25 bp, Homo sapien
gatgtcctgggaacgtgtttgcaca

SEQ ID NO: 366970 - DNA, 25 bp, Homo sapien
gaacgtgtttgcacaagtgtccatg

SEQ ID NO: 366971 - DNA, 25 bp, Homo sapien
caagtgtccatgtgggtactgaggt

SEQ ID NO: 366972 - DNA, 25 bp, Homo sapien
gtttggttgagctagtggaaaccta

SEQ ID NO: 366973 - DNA, 25 bp, Homo sapien
gaaaaatcatctgtccaagtatctt

SEQ ID NO: 366974 - DNA, 25 bp, Homo sapien
gtccaagtatctttcattttagaga

SEQ ID NO: 366975 - DNA, 25 bp, Homo sapien
gaatcgagtcacttgatacttctga

SEQ ID NO: 366976 - DNA, 25 bp, Homo sapien
ggaggagagggttttctatgactgt

SEQ ID NO: 366977 - DNA, 25 bp, Homo sapien
tttattattagcaagagggctcctt

SEQ ID NO: 366978 - DNA, 25 bp, Homo sapien
agggctccttttgtaatttgtgcat

SEQ ID NO: 366979 - DNA, 25 bp, Homo sapien
gctccttttgtaatttgtgcatgaa

SEQ ID NO: 366980 - DNA, 25 bp, Homo sapien
gggtgctatccagttcgcctgatga

SEQ ID NO: 366981 - DNA, 25 bp, Homo sapien
tatccagttcgcctgatgagggctc

SEQ ID NO: 366982 - DNA, 25 bp, Homo sapien
agttcgcctgatgagggctctcgaa

SEQ ID NO: 366983 - DNA, 25 bp, Homo sapien
tgatgagggctctcgaaccagccgt

SEQ ID NO: 366984 - DNA, 25 bp, Homo sapien
tgagggctctcgaaccagccgtttt

SEQ ID NO: 366985 - DNA, 25 bp, Homo sapien
gttaaaggtgagaccttcctccatt

SEQ ID NO: 366986 - DNA, 25 bp, Homo sapien
gagaccttcctccattaatgtacaa

SEQ ID NO: 366987 - DNA, 25 bp, Homo sapien
actgtacatcaaggaaagactgcaa

SEQ ID NO: 366988 - DNA, 25 bp, Homo sapien
ataaatattcaagtgcttactctga

SEQ ID NO: 366989 - DNA, 25 bp, Homo sapien
tggagtggacagtcataagacattc

SEQ ID NO: 366990 - DNA, 25 bp, Homo sapien
gtgcttactctgaatgttagactta

SEQ ID NO: 366991 - DNA, 25 bp, Homo sapien
taatgctttttcatgttatctcagc

SEQ ID NO: 366992 - DNA, 25 bp, Homo sapien
tttcatgttatctcagcttcctagt

SEQ ID NO: 366993 - DNA, 25 bp, Homo sapien
atctcagcttcctagttttgatctt

SEQ ID NO: 366994 - DNA, 25 bp, Homo sapien
gcttcctagttttgatcttataatc

SEQ ID NO: 366995 - DNA, 25 bp, Homo sapien
aaaaaacatatctttgctccttctg

SEQ ID NO: 366996 - DNA, 25 bp, Homo sapien
atatctttgctccttctgttatggc

SEQ ID NO: 366997 - DNA, 25 bp, Homo sapien
gctccttctgttatggccactaaaa

SEQ ID NO: 366998 - DNA, 25 bp, Homo sapien
aggtcccaggccagtaggcgccgca

SEQ ID NO: 366999 - DNA, 25 bp, Homo sapien
gcagcagcactagcgactcgtcgaa

SEQ ID NO: 367000 - DNA, 25 bp, Homo sapien
gactcgtcgaagtactcggcgatca

SEQ ID NO: 367001 - DNA, 25 bp, Homo sapien
agtactcggcgatcatgacgagcga

SEQ ID NO: 367002 - DNA, 25 bp, Homo sapien
atcatgacgagcgagaaaacctcct

SEQ ID NO: 367003 - DNA, 25 bp, Homo sapien
cgtcgcgcgggctgcgctcattgtc

SEQ ID NO: 367004 - DNA, 25 bp, Homo sapien
cgcccaggtcgtaggccagcgtgtt

SEQ ID NO: 367005 - DNA, 25 bp, Homo sapien
tgtgtgcgaacatggcgaagtgctc

SEQ ID NO: 367006 - DNA, 25 bp, Homo sapien
gaagtgctcgccagcgcggtagtat

SEQ ID NO: 367007 - DNA, 25 bp, Homo sapien
ttgagcttggcgtagagcacgtcgt

SEQ ID NO: 367008 - DNA, 25 bp, Homo sapien
tagagcacgtcgtccaggtcccagg

SEQ ID NO: 367009 - DNA, 25 bp, Homo sapien
ctgagatgttctttacttattagta

SEQ ID NO: 367010 - DNA, 25 bp, Homo sapien
gatttttgtcaaagccttctcagtg

SEQ ID NO: 367011 - DNA, 25 bp, Homo sapien
tagtatcatgactttggttatcaat

SEQ ID NO: 367012 - DNA, 25 bp, Homo sapien
tttgtcaaagccttctcagtgtcca

SEQ ID NO: 367013 - DNA, 25 bp, Homo sapien
gattcatcattctacatcttgcttt

SEQ ID NO: 367014 - DNA, 25 bp, Homo sapien
attctacatcttgcttttatgtgtt

SEQ ID NO: 367015 - DNA, 25 bp, Homo sapien
tatgtgttttttgtccagatttaac

SEQ ID NO: 367016 - DNA, 25 bp, Homo sapien
cagatttaactttatgctgacttaa

SEQ ID NO: 367017 - DNA, 25 bp, Homo sapien
aaacctctatattctacaatcatct

SEQ ID NO: 367018 - DNA, 25 bp, Homo sapien
gggattatcagaaggtcttttcctt

SEQ ID NO: 367019 - DNA, 25 bp, Homo sapien
cttttcctttgctctagtagtatgt

SEQ ID NO: 367020 - DNA, 25 bp, Homo sapien
aaggtcaattctcaacgtcttcctg

SEQ ID NO: 367021 - DNA, 25 bp, Homo sapien
ttctcaacgtcttcctgaaggcagt

SEQ ID NO: 367022 - DNA, 25 bp, Homo sapien
cagtgcccagggagaaagccgaatc

SEQ ID NO: 367023 - DNA, 25 bp, Homo sapien
gaaagccgaatccagaggtccagat

SEQ ID NO: 367024 - DNA, 25 bp, Homo sapien
tccagaggtccagatccatagagtg

SEQ ID NO: 367025 - DNA, 25 bp, Homo sapien
agaaattcagagcatcagccagttc

SEQ ID NO: 367026 - DNA, 25 bp, Homo sapien
tcttcctgcggatccgtagtccttc

SEQ ID NO: 367027 - DNA, 25 bp, Homo sapien
gcgatcagtcggtcggtcggcacct

SEQ ID NO: 367028 - DNA, 25 bp, Homo sapien
cagccccttgccactgtaaagtgaa

SEQ ID NO: 367029 - DNA, 25 bp, Homo sapien
actgtaaagtgaaaggctcctgtga

SEQ ID NO: 367030 - DNA, 25 bp, Homo sapien
gcgctgggattgtgtaaggtcaatt

SEQ ID NO: 367031 - DNA, 25 bp, Homo sapien
ttctcttaaaagtctacaaaattat

SEQ ID NO: 367032 - DNA, 25 bp, Homo sapien
tataatctgataacaacagaacgtt

SEQ ID NO: 367033 - DNA, 25 bp, Homo sapien
caacagaacgttttggtattttgag

SEQ ID NO: 367034 - DNA, 25 bp, Homo sapien
ttttgagtaataggtgtcacatcgg

SEQ ID NO: 367035 - DNA, 25 bp, Homo sapien
gagtaataggtgtcacatcggaatt

SEQ ID NO: 367036 - DNA, 25 bp, Homo sapien
ataggtgtcacatcggaattgatat

SEQ ID NO: 367037 - DNA, 25 bp, Homo sapien
gtcacatcggaattgatatttgcca

SEQ ID NO: 367038 - DNA, 25 bp, Homo sapien
gccaaatttggcatgataattgaat

SEQ ID NO: 367039 - DNA, 25 bp, Homo sapien
gataattgaatgctttttgcttatt

SEQ ID NO: 367040 - DNA, 25 bp, Homo sapien
actgaaagatgatgcttgtaatttc

SEQ ID NO: 367041 - DNA, 25 bp, Homo sapien
atgcttgtaatttcaagtcgattaa

SEQ ID NO: 367042 - DNA, 25 bp, Homo sapien
tacttggcacttcacagagggcatg

SEQ ID NO: 367043 - DNA, 25 bp, Homo sapien
gagggcatgactctttccataaaaa

SEQ ID NO: 367044 - DNA, 25 bp, Homo sapien
gtatgttcatgatgtcttttatcta

SEQ ID NO: 367045 - DNA, 25 bp, Homo sapien
ggaaggtgagtgacacaccccttta

SEQ ID NO: 367046 - DNA, 25 bp, Homo sapien
gtgacacacccctttatagacgaag

SEQ ID NO: 367047 - DNA, 25 bp, Homo sapien
tagacgaagaatttgcagttgaggc

SEQ ID NO: 367048 - DNA, 25 bp, Homo sapien
cagttgaggctggttaaatgtgact

SEQ ID NO: 367049 - DNA, 25 bp, Homo sapien
tgactaactcaagattaacactggt

SEQ ID NO: 367050 - DNA, 25 bp, Homo sapien
gagtgaggcgatttcaatgtgtaca

SEQ ID NO: 367051 - DNA, 25 bp, Homo sapien
atgtgtacatgagggcaacaatcgt

SEQ ID NO: 367052 - DNA, 25 bp, Homo sapien
ataatatctacttggcacttcacag

SEQ ID NO: 367053 - DNA, 25 bp, Homo sapien
cctatctctttcttgcgtttagcac

SEQ ID NO: 367054 - DNA, 25 bp, Homo sapien
tcttgcgtttagcactctccatagt

SEQ ID NO: 367055 - DNA, 25 bp, Homo sapien
tcccttgtctctccttagtaagcga

SEQ ID NO: 367056 - DNA, 25 bp, Homo sapien
gtctctccttagtaagcgatacgaa

SEQ ID NO: 367057 - DNA, 25 bp, Homo sapien
agcgatacgaatcccagcttcggga

SEQ ID NO: 367058 - DNA, 25 bp, Homo sapien
agcttcgggatcttgagcggcagtc

SEQ ID NO: 367059 - DNA, 25 bp, Homo sapien
cttgagcggcagtcagagcaacaga

SEQ ID NO: 367060 - DNA, 25 bp, Homo sapien
agagggagacccttgctcagctgca

SEQ ID NO: 367061 - DNA, 25 bp, Homo sapien
gacccttgctcagctgcagcaggag

SEQ ID NO: 367062 - DNA, 25 bp, Homo sapien
agggaatgaggcagctctaggatct

SEQ ID NO: 367063 - DNA, 25 bp, Homo sapien
ggcagctctaggatctatactgtag

SEQ ID NO: 367064 - DNA, 25 bp, Homo sapien
ttcctgcacttctcttgaattcctt

SEQ ID NO: 367065 - DNA, 25 bp, Homo sapien
gtacagttttgctttaaccactgaa

SEQ ID NO: 367066 - DNA, 25 bp, Homo sapien
ctttaaccactgaagattgctgtaa

SEQ ID NO: 367067 - DNA, 25 bp, Homo sapien
gtgatagaatccacatggctgtcaa

SEQ ID NO: 367068 - DNA, 25 bp, Homo sapien
cacatggctgtcaagaaggagatct

SEQ ID NO: 367069 - DNA, 25 bp, Homo sapien
gaaggagatcttaccaaggacagtt

SEQ ID NO: 367070 - DNA, 25 bp, Homo sapien
aggacagttgactgactagtctcag

SEQ ID NO: 367071 - DNA, 25 bp, Homo sapien
gactagtctcagattgtttcatatc

SEQ ID NO: 367072 - DNA, 25 bp, Homo sapien
gttttacctattcgtaagttggcag

SEQ ID NO: 367073 - DNA, 25 bp, Homo sapien
aacattctggtggtagctagggatt

SEQ ID NO: 367074 - DNA, 25 bp, Homo sapien
gctagggatttaccttttgtcatcc

SEQ ID NO: 367075 - DNA, 25 bp, Homo sapien
tctttcctgtggcacctcgggacgt

SEQ ID NO: 367076 - DNA, 25 bp, Homo sapien
tgctgccctcagatgtgaaactcaa

SEQ ID NO: 367077 - DNA, 25 bp, Homo sapien
gtgaaactcaagctgtacgaccgga

SEQ ID NO: 367078 - DNA, 25 bp, Homo sapien
tcaagctgtacgaccggagtctgga

SEQ ID NO: 367079 - DNA, 25 bp, Homo sapien
ctgtacgaccggagtctggagtcaa

SEQ ID NO: 367080 - DNA, 25 bp, Homo sapien
cgaccggagtctggagtcaaaccca

SEQ ID NO: 367081 - DNA, 25 bp, Homo sapien
tctggagtcaaacccagagcagctg

SEQ ID NO: 367082 - DNA, 25 bp, Homo sapien
tgaggcacattgttacgggcaccac

SEQ ID NO: 367083 - DNA, 25 bp, Homo sapien
attgttacgggcaccacccgtccag

SEQ ID NO: 367084 - DNA, 25 bp, Homo sapien
ggagaatgacacatcaagctgctaa

SEQ ID NO: 367085 - DNA, 25 bp, Homo sapien
gacacatcaagctgctaacaattgg

SEQ ID NO: 367086 - DNA, 25 bp, Homo sapien
ctgccaaagaattaggctgaatgaa

SEQ ID NO: 367087 - DNA, 25 bp, Homo sapien
ttcatttacatactattccagaaaa

SEQ ID NO: 367088 - DNA, 25 bp, Homo sapien
aatacaagtgaatctatagtgacag

SEQ ID NO: 367089 - DNA, 25 bp, Homo sapien
gacagaaggattgcaagggaacact

SEQ ID NO: 367090 - DNA, 25 bp, Homo sapien
acagaaggattgcaagggaacactt

SEQ ID NO: 367091 - DNA, 25 bp, Homo sapien
gattgcaagggaacacttggtaact

SEQ ID NO: 367092 - DNA, 25 bp, Homo sapien
ttgcaagggaacacttggtaacttt

SEQ ID NO: 367093 - DNA, 25 bp, Homo sapien
tgcaagggaacacttggtaactttg

SEQ ID NO: 367094 - DNA, 25 bp, Homo sapien
gggaagagggacgtgttcattttct

SEQ ID NO: 367095 - DNA, 25 bp, Homo sapien
ggaagagggacgtgttcattttctt

SEQ ID NO: 367096 - DNA, 25 bp, Homo sapien
tgtacacttttgttatgtgcagttt

SEQ ID NO: 367097 - DNA, 25 bp, Homo sapien
tcatctcccatctcacagccgagcg

SEQ ID NO: 367098 - DNA, 25 bp, Homo sapien
atctcacagccgagcgcccgggcac

SEQ ID NO: 367099 - DNA, 25 bp, Homo sapien
gggcacccaaccgaggggctagaat

SEQ ID NO: 367100 - DNA, 25 bp, Homo sapien
ggctagaatcgggacaaagcagcag

SEQ ID NO: 367101 - DNA, 25 bp, Homo sapien
caggccagaggtcatcaggggagat

SEQ ID NO: 367102 - DNA, 25 bp, Homo sapien
gctctgctgccggcgcgcggccttt

SEQ ID NO: 367103 - DNA, 25 bp, Homo sapien
ggctccgtagacttagccgctctca

SEQ ID NO: 367104 - DNA, 25 bp, Homo sapien
gctccgtagacttagccgctctcat

SEQ ID NO: 367105 - DNA, 25 bp, Homo sapien
tccgtagacttagccgctctcatcg

SEQ ID NO: 367106 - DNA, 25 bp, Homo sapien
tagacttagccgctctcatcgttcc

SEQ ID NO: 367107 - DNA, 25 bp, Homo sapien
agacttagccgctctcatcgttccc

SEQ ID NO: 367108 - DNA, 25 bp, Homo sapien
attttgtcccaagactatcgcacta

SEQ ID NO: 367109 - DNA, 25 bp, Homo sapien
ttgtcccaagactatcgcactatat

SEQ ID NO: 367110 - DNA, 25 bp, Homo sapien
gtcccaagactatcgcactatatca

SEQ ID NO: 367111 - DNA, 25 bp, Homo sapien
gactatcgcactatatcatgttaaa

SEQ ID NO: 367112 - DNA, 25 bp, Homo sapien
caggtgatagttattgagtcattct

SEQ ID NO: 367113 - DNA, 25 bp, Homo sapien
tggttttatgcacagtagataattt

SEQ ID NO: 367114 - DNA, 25 bp, Homo sapien
tctacatatgatttggatttgaata

SEQ ID NO: 367115 - DNA, 25 bp, Homo sapien
tgtattccctatttaagtcaaccta

SEQ ID NO: 367116 - DNA, 25 bp, Homo sapien
tccctatttaagtcaacctaagaat

SEQ ID NO: 367117 - DNA, 25 bp, Homo sapien
gggctttttggtagatgacctcctc

SEQ ID NO: 367118 - DNA, 25 bp, Homo sapien
tgatctccgccacaatcctggaaca

SEQ ID NO: 367119 - DNA, 25 bp, Homo sapien
agcgatacgaatcccagcttcggga

SEQ ID NO: 367120 - DNA, 25 bp, Homo sapien
gatacgaatcccagcttcgggatct

SEQ ID NO: 367121 - DNA, 25 bp, Homo sapien
tacgaatcccagcttcgggatcttg

SEQ ID NO: 367122 - DNA, 25 bp, Homo sapien
cgaatcccagcttcgggatcttgag

SEQ ID NO: 367123 - DNA, 25 bp, Homo sapien
ttcgggatcttgagcggcagtcaga

SEQ ID NO: 367124 - DNA, 25 bp, Homo sapien
gatcttgagcggcagtcagagcaac

SEQ ID NO: 367125 - DNA, 25 bp, Homo sapien
cttgagcggcagtcagagcaacaga

SEQ ID NO: 367126 - DNA, 25 bp, Homo sapien
agagggagacccttgctcagctgca

SEQ ID NO: 367127 - DNA, 25 bp, Homo sapien
agggagacccttgctcagctgcagc

SEQ ID NO: 367128 - DNA, 25 bp, Homo sapien
gagacccttgctcagctgcagcagg

SEQ ID NO: 367129 - DNA, 25 bp, Homo sapien
agggaatgaggcagctctaggatct

SEQ ID NO: 367130 - DNA, 25 bp, Homo sapien
aggccacttcactgaggttcttcta

SEQ ID NO: 367131 - DNA, 25 bp, Homo sapien
ggttcttctactgcaaatacttcct

SEQ ID NO: 367132 - DNA, 25 bp, Homo sapien
actgcaaatacttcctgttacttat

SEQ ID NO: 367133 - DNA, 25 bp, Homo sapien
atttataccatgctctttcattccc

SEQ ID NO: 367134 - DNA, 25 bp, Homo sapien
tcattcccctgtactttttctctaa

SEQ ID NO: 367135 - DNA, 25 bp, Homo sapien
aggagtacccttcttgtttgatcat

SEQ ID NO: 367136 - DNA, 25 bp, Homo sapien
gaaattcacctcagacttacagata

SEQ ID NO: 367137 - DNA, 25 bp, Homo sapien
gagaagaaacatatcctgggtcata

SEQ ID NO: 367138 - DNA, 25 bp, Homo sapien
gacgactaaatagcagagcctggat

SEQ ID NO: 367139 - DNA, 25 bp, Homo sapien
actctggcttgttttgccctagtgc

SEQ ID NO: 367140 - DNA, 25 bp, Homo sapien
ttgttttgccctagtgctcaggcca

SEQ ID NO: 367141 - DNA, 25 bp, Homo sapien
catttaatgtctttattcctgcctt

SEQ ID NO: 367142 - DNA, 25 bp, Homo sapien
tgtctttattcctgcctttaatatg

SEQ ID NO: 367143 - DNA, 25 bp, Homo sapien
gaggaaggttccataagctacatgt

SEQ ID NO: 367144 - DNA, 25 bp, Homo sapien
ggttccataagctacatgtttccta

SEQ ID NO: 367145 - DNA, 25 bp, Homo sapien
atgtttcctagttaagctctttcct

SEQ ID NO: 367146 - DNA, 25 bp, Homo sapien
ttcctattgtgtttatacagttttg

SEQ ID NO: 367147 - DNA, 25 bp, Homo sapien
gttttgtttgttatactctttgcac

SEQ ID NO: 367148 - DNA, 25 bp, Homo sapien
ggactgaacccctctgaccttatga

SEQ ID NO: 367149 - DNA, 25 bp, Homo sapien
tctgaccttatgaggcccatggcac

SEQ ID NO: 367150 - DNA, 25 bp, Homo sapien
ggagctggggacattttaatcatca

SEQ ID NO: 367151 - DNA, 25 bp, Homo sapien
taatcatcaataaacgaagcacttt

SEQ ID NO: 367152 - DNA, 25 bp, Homo sapien
actcggtgagaccagcagagcagct

SEQ ID NO: 367153 - DNA, 25 bp, Homo sapien
gaaacttccgtttctgatctcagaa

SEQ ID NO: 367154 - DNA, 25 bp, Homo sapien
ttctgatctcagaacctggaagtaa

SEQ ID NO: 367155 - DNA, 25 bp, Homo sapien
gaacatttccacaaattttgtcatg

SEQ ID NO: 367156 - DNA, 25 bp, Homo sapien
tttgtcatggttattctggaggcag

SEQ ID NO: 367157 - DNA, 25 bp, Homo sapien
ggaggcagagttgaaccctgtaatt

SEQ ID NO: 367158 - DNA, 25 bp, Homo sapien
gaaccctgtaattacggagctttgg

SEQ ID NO: 367159 - DNA, 25 bp, Homo sapien
gagctttgggactcactacacccac

SEQ ID NO: 367160 - DNA, 25 bp, Homo sapien
gaggttagactcagtggaaaatcca

SEQ ID NO: 367161 - DNA, 25 bp, Homo sapien
cagaagtgcagatgtggatccaaat

SEQ ID NO: 367162 - DNA, 25 bp, Homo sapien
aatctcatgagatcaggctttcttg

SEQ ID NO: 367163 - DNA, 25 bp, Homo sapien
taaagcagcagtccataaatcccct

SEQ ID NO: 367164 - DNA, 25 bp, Homo sapien
ctccactcaaatctttctacagcta

SEQ ID NO: 367165 - DNA, 25 bp, Homo sapien
tctttctacagctacttagtgccct

SEQ ID NO: 367166 - DNA, 25 bp, Homo sapien
acagctacttagtgcccttcagtta

SEQ ID NO: 367167 - DNA, 25 bp, Homo sapien
agtgcccttcagttacttttataca

SEQ ID NO: 367168 - DNA, 25 bp, Homo sapien
atacaatttcaagtctgcctttagt

SEQ ID NO: 367169 - DNA, 25 bp, Homo sapien
caagtctgcctttagtgttaatttt

SEQ ID NO: 367170 - DNA, 25 bp, Homo sapien
ctgatttaacctatattccaggaag

SEQ ID NO: 367171 - DNA, 25 bp, Homo sapien
ttccaggaagtggtaagcaatattc

SEQ ID NO: 367172 - DNA, 25 bp, Homo sapien
atattcagttgatctgtgccagacc

SEQ ID NO: 367173 - DNA, 25 bp, Homo sapien
atctgtgccagacccagccttttaa

SEQ ID NO: 367174 - DNA, 25 bp, Homo sapien
ggccaggcgaatcttttgttaaaag

SEQ ID NO: 367175 - DNA, 25 bp, Homo sapien
gccaggcgaatcttttgttaaaaga

SEQ ID NO: 367176 - DNA, 25 bp, Homo sapien
tgttaaaagaacaatgcgcgctggg

SEQ ID NO: 367177 - DNA, 25 bp, Homo sapien
gttaaaagaacaatgcgcgctgggc

SEQ ID NO: 367178 - DNA, 25 bp, Homo sapien
ttaaaagaacaatgcgcgctgggca

SEQ ID NO: 367179 - DNA, 25 bp, Homo sapien
taaaagaacaatgcgcgctgggcac

SEQ ID NO: 367180 - DNA, 25 bp, Homo sapien
aaaagaacaatgcgcgctgggcaca

SEQ ID NO: 367181 - DNA, 25 bp, Homo sapien
aaagaacaatgcgcgctgggcacag

SEQ ID NO: 367182 - DNA, 25 bp, Homo sapien
aagaacaatgcgcgctgggcacagt

SEQ ID NO: 367183 - DNA, 25 bp, Homo sapien
agaacaatgcgcgctgggcacagtg

SEQ ID NO: 367184 - DNA, 25 bp, Homo sapien
gaacaatgcgcgctgggcacagtgg

SEQ ID NO: 367185 - DNA, 25 bp, Homo sapien
tttgctgatgacttttaaccacaag

SEQ ID NO: 367186 - DNA, 25 bp, Homo sapien
ggtaagtccacatagtgtactcatg

SEQ ID NO: 367187 - DNA, 25 bp, Homo sapien
tcatgggtgacttctgactttctaa

SEQ ID NO: 367188 - DNA, 25 bp, Homo sapien
gaaatgatgcttcccaagcacccga

SEQ ID NO: 367189 - DNA, 25 bp, Homo sapien
gaggttggttggtcccaaatctatc

SEQ ID NO: 367190 - DNA, 25 bp, Homo sapien
aaatctatcaaactcagtgccctct

SEQ ID NO: 367191 - DNA, 25 bp, Homo sapien
gccctctttagcgacatattttgtg

SEQ ID NO: 367192 - DNA, 25 bp, Homo sapien
ttgtgacattccttccattacacca

SEQ ID NO: 367193 - DNA, 25 bp, Homo sapien
taatataacctacccacctgtgtaa

SEQ ID NO: 367194 - DNA, 25 bp, Homo sapien
aaaaaatcaatatgcggccccattt

SEQ ID NO: 367195 - DNA, 25 bp, Homo sapien
atgcggccccattttgtaaaggatc

SEQ ID NO: 367196 - DNA, 25 bp, Homo sapien
gctgcctaaagcaaatatacctgta

SEQ ID NO: 367197 - DNA, 25 bp, Homo sapien
tgtaagacctaaaccttctttccag

SEQ ID NO: 367198 - DNA, 25 bp, Homo sapien
gttccaaaaccatagccacgggtct

SEQ ID NO: 367199 - DNA, 25 bp, Homo sapien
agccacgggtctaggaacacagtct

SEQ ID NO: 367200 - DNA, 25 bp, Homo sapien
aacacagtctcaaccatccgatgga

SEQ ID NO: 367201 - DNA, 25 bp, Homo sapien
gatggagccccacaagcaaagccag

SEQ ID NO: 367202 - DNA, 25 bp, Homo sapien
agccagtcccagcacagaaacttaa

SEQ ID NO: 367203 - DNA, 25 bp, Homo sapien
aaatcggccttgaatttaaatcagc

SEQ ID NO: 367204 - DNA, 25 bp, Homo sapien
atcagccagtttctgtgtcctcagt

SEQ ID NO: 367205 - DNA, 25 bp, Homo sapien
cagtttctcctgtaaaagccacaca

SEQ ID NO: 367206 - DNA, 25 bp, Homo sapien
gtttcagctaccaaaaagcagcctc

SEQ ID NO: 367207 - DNA, 25 bp, Homo sapien
ttctttcttcccctgagatagacct

SEQ ID NO: 367208 - DNA, 25 bp, Homo sapien
tctttcttcccctgagatagacctt

SEQ ID NO: 367209 - DNA, 25 bp, Homo sapien
tttcttcccctgagatagaccttcc

SEQ ID NO: 367210 - DNA, 25 bp, Homo sapien
ttcccctgagatagaccttccctat

SEQ ID NO: 367211 - DNA, 25 bp, Homo sapien
cctgagatagaccttccctattaca

SEQ ID NO: 367212 - DNA, 25 bp, Homo sapien
gagatagaccttccctattacatga

SEQ ID NO: 367213 - DNA, 25 bp, Homo sapien
gatagaccttccctattacatgata

SEQ ID NO: 367214 - DNA, 25 bp, Homo sapien
tagaccttccctattacatgataat

SEQ ID NO: 367215 - DNA, 25 bp, Homo sapien
gaccttccctattacatgataattt

SEQ ID NO: 367216 - DNA, 25 bp, Homo sapien
ccttccctattacatgataatttta

SEQ ID NO: 367217 - DNA, 25 bp, Homo sapien
agtacatttatagtttctttccatt

SEQ ID NO: 367218 - DNA, 25 bp, Homo sapien
attgatgtccattagactgtaagct

SEQ ID NO: 367219 - DNA, 25 bp, Homo sapien
aggaactttgctaccgaatctatac

SEQ ID NO: 367220 - DNA, 25 bp, Homo sapien
gctaccgaatctatacaaccttaac

SEQ ID NO: 367221 - DNA, 25 bp, Homo sapien
caaccttaacattgactagtgcttg

SEQ ID NO: 367222 - DNA, 25 bp, Homo sapien
taacattgactagtgcttgtaggtg

SEQ ID NO: 367223 - DNA, 25 bp, Homo sapien
gcttgtaggtgtgctcaatacttgt

SEQ ID NO: 367224 - DNA, 25 bp, Homo sapien
gtgtgctcaatacttgtttgttaac

SEQ ID NO: 367225 - DNA, 25 bp, Homo sapien
ggagtaaatgcacaatatttgaaca

SEQ ID NO: 367226 - DNA, 25 bp, Homo sapien
ctggatactgcagcctacaatatta

SEQ ID NO: 367227 - DNA, 25 bp, Homo sapien
gatattactcttttacagttgacac

SEQ ID NO: 367228 - DNA, 25 bp, Homo sapien
tacagttgacacctgtcctctctgt

SEQ ID NO: 367229 - DNA, 25 bp, Homo sapien
gacattaaggatctaagtgctcata

SEQ ID NO: 367230 - DNA, 25 bp, Homo sapien
agtgctcatatttgagagtctgatc

SEQ ID NO: 367231 - DNA, 25 bp, Homo sapien
agagtctgatctagtgaccctcatg

SEQ ID NO: 367232 - DNA, 25 bp, Homo sapien
tagtgaccctcatgaataacaatca

SEQ ID NO: 367233 - DNA, 25 bp, Homo sapien
aatcacaccttacttagtactggga

SEQ ID NO: 367234 - DNA, 25 bp, Homo sapien
tgggattttccctttacagttgatg

SEQ ID NO: 367235 - DNA, 25 bp, Homo sapien
ttccctttacagttgatgtttactt

SEQ ID NO: 367236 - DNA, 25 bp, Homo sapien
gtttacttacatgattgacctgcgt

SEQ ID NO: 367237 - DNA, 25 bp, Homo sapien
gattgacctgcgtaacagtttaaaa

SEQ ID NO: 367238 - DNA, 25 bp, Homo sapien
taaaacaggtaggaccacgaggtca

SEQ ID NO: 367239 - DNA, 25 bp, Homo sapien
ggctgtggatattgaacaattgtct

SEQ ID NO: 367240 - DNA, 25 bp, Homo sapien
ctaactaagcagatgttctcatgct

SEQ ID NO: 367241 - DNA, 25 bp, Homo sapien
tactgacacctcttctcagtggcat

SEQ ID NO: 367242 - DNA, 25 bp, Homo sapien
tgacacctcttctcagtggcatatg

SEQ ID NO: 367243 - DNA, 25 bp, Homo sapien
gatctcatttacaaatatctatggt

SEQ ID NO: 367244 - DNA, 25 bp, Homo sapien
aaatatctatggtgtttccttgttc

SEQ ID NO: 367245 - DNA, 25 bp, Homo sapien
atctatggtgtttccttgttctgtg

SEQ ID NO: 367246 - DNA, 25 bp, Homo sapien
ttccttgttctgtgttgatctgttt

SEQ ID NO: 367247 - DNA, 25 bp, Homo sapien
gatctgttttattgatacaaactga

SEQ ID NO: 367248 - DNA, 25 bp, Homo sapien
cttctatctctattatagtggcaat

SEQ ID NO: 367249 - DNA, 25 bp, Homo sapien
tatagtggcaatgatggtatatgca

SEQ ID NO: 367250 - DNA, 25 bp, Homo sapien
ggtatatgcattaaagttcttctga

SEQ ID NO: 367251 - DNA, 25 bp, Homo sapien
atctattttatattgctatggttga

SEQ ID NO: 367252 - DNA, 25 bp, Homo sapien
aatctggtgatttgttgtattttgg

SEQ ID NO: 367253 - DNA, 25 bp, Homo sapien
ttgactttgagattctagctcaagc

SEQ ID NO: 367254 - DNA, 25 bp, Homo sapien
gagattctagctcaagcatcagatt

SEQ ID NO: 367255 - DNA, 25 bp, Homo sapien
gctcaagcatcagattagatgtcaa

SEQ ID NO: 367256 - DNA, 25 bp, Homo sapien
aatgtcatttacaaggatagctaat

SEQ ID NO: 367257 - DNA, 25 bp, Homo sapien
cagtggtttttgattgtcgaagaaa

SEQ ID NO: 367258 - DNA, 25 bp, Homo sapien
tgagggaacaggtagaaaacgacca

SEQ ID NO: 367259 - DNA, 25 bp, Homo sapien
tagaaaacgaccacaatggtagtat

SEQ ID NO: 367260 - DNA, 25 bp, Homo sapien
caatggtagtattttcacagttatt

SEQ ID NO: 367261 - DNA, 25 bp, Homo sapien
ttcacagttatttgtagatttacgt

SEQ ID NO: 367262 - DNA, 25 bp, Homo sapien
atgtgccaatgtgactggaagttac

SEQ ID NO: 367263 - DNA, 25 bp, Homo sapien
ctggaagttacggtgctgcttgcaa

SEQ ID NO: 367264 - DNA, 25 bp, Homo sapien
acggtgctgcttgcaataaactttc

SEQ ID NO: 367265 - DNA, 25 bp, Homo sapien
acatttactcagtttagtttcatgg

SEQ ID NO: 367266 - DNA, 25 bp, Homo sapien
ttagtttcatggtttataattccga

SEQ ID NO: 367267 - DNA, 25 bp, Homo sapien
cagccaactgaggaaaaagtggact

SEQ ID NO: 367268 - DNA, 25 bp, Homo sapien
gtggactgcatctaatccatcttta

SEQ ID NO: 367269 - DNA, 25 bp, Homo sapien
aatccatctttactgtcaacatctg

SEQ ID NO: 367270 - DNA, 25 bp, Homo sapien
tgaaaaggctgctcactctcatcat

SEQ ID NO: 367271 - DNA, 25 bp, Homo sapien
actctcatcatctagtgttcctcat

SEQ ID NO: 367272 - DNA, 25 bp, Homo sapien
ctagtgttcctcatgtgttctaaag

SEQ ID NO: 367273 - DNA, 25 bp, Homo sapien
gaaatagggagatgaagccaagtat

SEQ ID NO: 367274 - DNA, 25 bp, Homo sapien
gaagccaagtatatcaaactcctca

SEQ ID NO: 367275 - DNA, 25 bp, Homo sapien
gccaagtatatcaaactcctcaagt

SEQ ID NO: 367276 - DNA, 25 bp, Homo sapien
aaactcctcaagtactgagtgggaa

SEQ ID NO: 367277 - DNA, 25 bp, Homo sapien
gaatgagatgtttggtgaagtagaa

SEQ ID NO: 367278 - DNA, 25 bp, Homo sapien
aatagatagctttagtggctctgac

SEQ ID NO: 367279 - DNA, 25 bp, Homo sapien
gatagctttagtggctctgactcag

SEQ ID NO: 367280 - DNA, 25 bp, Homo sapien
agctttagtggctctgactcagata

SEQ ID NO: 367281 - DNA, 25 bp, Homo sapien
gtggctctgactcagatatactgat

SEQ ID NO: 367282 - DNA, 25 bp, Homo sapien
gatgtagaaggaaggattctttcac

SEQ ID NO: 367283 - DNA, 25 bp, Homo sapien
tttagtaccttttgctttttcacat

SEQ ID NO: 367284 - DNA, 25 bp, Homo sapien
agatgtacttgtaatcctcagggca

SEQ ID NO: 367285 - DNA, 25 bp, Homo sapien
tgtacttggcagctctcggtgtcct

SEQ ID NO: 367286 - DNA, 25 bp, Homo sapien
catccacaccgttgacacagggaat

SEQ ID NO: 367287 - DNA, 25 bp, Homo sapien
cacaccgttgacacagggaatgggc

SEQ ID NO: 367288 - DNA, 25 bp, Homo sapien
caccgttgacacagggaatgggcac

SEQ ID NO: 367289 - DNA, 25 bp, Homo sapien
cgttgacacagggaatgggcacgtt

SEQ ID NO: 367290 - DNA, 25 bp, Homo sapien
acttggcagctctcggtgtcctttt

SEQ ID NO: 367291 - DNA, 25 bp, Homo sapien
tggcagctctcggtgtccttttggg

SEQ ID NO: 367292 - DNA, 25 bp, Homo sapien
gggtgaggagctactccaggtataa

SEQ ID NO: 367293 - DNA, 25 bp, Homo sapien
gggtgatgttgcgatcgatgttcat

SEQ ID NO: 367294 - DNA, 25 bp, Homo sapien
ggtgatgttgcgatcgatgttcatg

SEQ ID NO: 367295 - DNA, 25 bp, Homo sapien
agatggctcctagctgagtgggacc

SEQ ID NO: 367296 - DNA, 25 bp, Homo sapien
atggctcctagctgagtgggacccg

SEQ ID NO: 367297 - DNA, 25 bp, Homo sapien
ctcctagctgagtgggacccggcag

SEQ ID NO: 367298 - DNA, 25 bp, Homo sapien
agctgagtgggacccggcaggagtt

SEQ ID NO: 367299 - DNA, 25 bp, Homo sapien
aggccctcaggctctgcggtcactc

SEQ ID NO: 367300 - DNA, 25 bp, Homo sapien
tgctggtcactggtcttggtctgga

SEQ ID NO: 367301 - DNA, 25 bp, Homo sapien
ggtcactggtcttggtctggagtta

SEQ ID NO: 367302 - DNA, 25 bp, Homo sapien
cactggtcttggtctggagttatat

SEQ ID NO: 367303 - DNA, 25 bp, Homo sapien
ggagttatattttgatgccatgaag

SEQ ID NO: 367304 - DNA, 25 bp, Homo sapien
agtccctgctgaccccagtgtgtct

SEQ ID NO: 367305 - DNA, 25 bp, Homo sapien
gtgtctccccggagatggctcctag

SEQ ID NO: 367306 - DNA, 25 bp, Homo sapien
tggcacacaacctctcggtggtggc

SEQ ID NO: 367307 - DNA, 25 bp, Homo sapien
acctctcggtggtggccaccaatga

SEQ ID NO: 367308 - DNA, 25 bp, Homo sapien
gtggccaccaatgacgtgggtgtca

SEQ ID NO: 367309 - DNA, 25 bp, Homo sapien
atgacgtgggtgtcaccagtgcgtc

SEQ ID NO: 367310 - DNA, 25 bp, Homo sapien
ggtgtcaccagtgcgtcgcttccag

SEQ ID NO: 367311 - DNA, 25 bp, Homo sapien
acccatctctgatatcaagtgactc

SEQ ID NO: 367312 - DNA, 25 bp, Homo sapien
gatatcaagtgactccaacaaccta

SEQ ID NO: 367313 - DNA, 25 bp, Homo sapien
acctaaaactcaacaacgtgcgcct

SEQ ID NO: 367314 - DNA, 25 bp, Homo sapien
acaacgtgcgcctgccacgggagaa

SEQ ID NO: 367315 - DNA, 25 bp, Homo sapien
aatgacctcactccagattccagag

SEQ ID NO: 367316 - DNA, 25 bp, Homo sapien
cagtgaaaccagcagaccggcagat

SEQ ID NO: 367317 - DNA, 25 bp, Homo sapien
ccaaaggcttctgggagtcgcgcag

SEQ ID NO: 367318 - DNA, 25 bp, Homo sapien
ggcttctgggagtcgcgcaggcgca

SEQ ID NO: 367319 - DNA, 25 bp, Homo sapien
tgaaagccgcaagctgcagaaagga

SEQ ID NO: 367320 - DNA, 25 bp, Homo sapien
aaaggacaagaggcatcacctatgt

SEQ ID NO: 367321 - DNA, 25 bp, Homo sapien
ataaagacagcatcctgagttgatg

SEQ ID NO: 367322 - DNA, 25 bp, Homo sapien
aagacagcatcctgagttgatggag

SEQ ID NO: 367323 - DNA, 25 bp, Homo sapien
acagcatcctgagttgatggagaaa

SEQ ID NO: 367324 - DNA, 25 bp, Homo sapien
gcagccgccgcataagtggtggcca

SEQ ID NO: 367325 - DNA, 25 bp, Homo sapien
agccgccgcataagtggtggccaac

SEQ ID NO: 367326 - DNA, 25 bp, Homo sapien
ccgcataagtggtggccaacgctgg

SEQ ID NO: 367327 - DNA, 25 bp, Homo sapien
aagcagaggccgctctgactacaca

SEQ ID NO: 367328 - DNA, 25 bp, Homo sapien
gttgatagcttagttccccacaacc

SEQ ID NO: 367329 - DNA, 25 bp, Homo sapien
gttccccacaaccatgtacatttgg

SEQ ID NO: 367330 - DNA, 25 bp, Homo sapien
accatgtacatttgggaatgtgcta

SEQ ID NO: 367331 - DNA, 25 bp, Homo sapien
gaatgtgctatagtcagacccggcc

SEQ ID NO: 367332 - DNA, 25 bp, Homo sapien
gctatagtcagacccggccctgatt

SEQ ID NO: 367333 - DNA, 25 bp, Homo sapien
tgattccattcaagactgacctgga

SEQ ID NO: 367334 - DNA, 25 bp, Homo sapien
tcaagactgacctggacaccctttg

SEQ ID NO: 367335 - DNA, 25 bp, Homo sapien
gacaccctttgctgttagtgtagat

SEQ ID NO: 367336 - DNA, 25 bp, Homo sapien
gatagacacagactctgagggtctt

SEQ ID NO: 367337 - DNA, 25 bp, Homo sapien
actctgagggtcttgcccaagctat

SEQ ID NO: 367338 - DNA, 25 bp, Homo sapien
gtggcatggaacatctgagccctaa

SEQ ID NO: 367339 - DNA, 25 bp, Homo sapien
ctactcggacaagggcgtccagact

SEQ ID NO: 367340 - DNA, 25 bp, Homo sapien
caagggcgtccagactcccagcaag

SEQ ID NO: 367341 - DNA, 25 bp, Homo sapien
gcaaccaccggtactgccgtctttg

SEQ ID NO: 367342 - DNA, 25 bp, Homo sapien
tgccgtctttgcaacatcaagttca

SEQ ID NO: 367343 - DNA, 25 bp, Homo sapien
tgcaacatcaagttcagcagcctgt

SEQ ID NO: 367344 - DNA, 25 bp, Homo sapien
gcccacaagaagtattactgctcct

SEQ ID NO: 367345 - DNA, 25 bp, Homo sapien
aagaagtattactgctcctcgcacg

SEQ ID NO: 367346 - DNA, 25 bp, Homo sapien
aagtattactgctcctcgcacgccg

SEQ ID NO: 367347 - DNA, 25 bp, Homo sapien
acgccgccgagcacgtgaagtgagc

SEQ ID NO: 367348 - DNA, 25 bp, Homo sapien
gagcacgtgaagtgagcgcccacac

SEQ ID NO: 367349 - DNA, 25 bp, Homo sapien
gaagtgagcgcccacactacagccg

SEQ ID NO: 367350 - DNA, 25 bp, Homo sapien
gggcgtgttgaacatcctgcagtca

SEQ ID NO: 367351 - DNA, 25 bp, Homo sapien
cgtgttgaacatcctgcagtcacag

SEQ ID NO: 367352 - DNA, 25 bp, Homo sapien
gtagtctgtgcctgaagtctgtgtt

SEQ ID NO: 367353 - DNA, 25 bp, Homo sapien
tctgtgtttgtgttgtcgtggagac

SEQ ID NO: 367354 - DNA, 25 bp, Homo sapien
gtcgtggagacaaggcctttgagcc

SEQ ID NO: 367355 - DNA, 25 bp, Homo sapien
tggagacaaggcctttgagccccac

SEQ ID NO: 367356 - DNA, 25 bp, Homo sapien
cctctcaaggatgcgctctttattt

SEQ ID NO: 367357 - DNA, 25 bp, Homo sapien
aaggatgcgctctttatttctaccc

SEQ ID NO: 367358 - DNA, 25 bp, Homo sapien
gtggaaattcccaactcggttctca

SEQ ID NO: 367359 - DNA, 25 bp, Homo sapien
aaattcccaactcggttctcatgga

SEQ ID NO: 367360 - DNA, 25 bp, Homo sapien
tcccaactcggttctcatggaggag

SEQ ID NO: 367361 - DNA, 25 bp, Homo sapien
gaagatcacgttcagaagaatggaa

SEQ ID NO: 367362 - DNA, 25 bp, Homo sapien
tggagacccaccactactatatgat

SEQ ID NO: 367363 - DNA, 25 bp, Homo sapien
gacccaccactactatatgatgaat

SEQ ID NO: 367364 - DNA, 25 bp, Homo sapien
tgatgaatagcactaatacccactg

SEQ ID NO: 367365 - DNA, 25 bp, Homo sapien
gcactaatacccactgcttcagtgt

SEQ ID NO: 367366 - DNA, 25 bp, Homo sapien
gcttcagtgttaacacagcagtgat

SEQ ID NO: 367367 - DNA, 25 bp, Homo sapien
cagtgattgtcagctgccaatagca

SEQ ID NO: 367368 - DNA, 25 bp, Homo sapien
ttgtcagctgccaatagcaaatgaa

SEQ ID NO: 367369 - DNA, 25 bp, Homo sapien
aagttatgggtgacttgaaatacca

SEQ ID NO: 367370 - DNA, 25 bp, Homo sapien
gtgggcaatggtgcttctgtgcttt

SEQ ID NO: 367371 - DNA, 25 bp, Homo sapien
gtggaatttttagctcagcattgag

SEQ ID NO: 367372 - DNA, 25 bp, Homo sapien
taatgtgttttactggcaatctaag

SEQ ID NO: 367373 - DNA, 25 bp, Homo sapien
ctggcaatctaagttgaaatctagt

SEQ ID NO: 367374 - DNA, 25 bp, Homo sapien
gaaatctagtttacttttagctaca

SEQ ID NO: 367375 - DNA, 25 bp, Homo sapien
cttttagctacaaataccctccagg

SEQ ID NO: 367376 - DNA, 25 bp, Homo sapien
tagctacaaataccctccaggaagg

SEQ ID NO: 367377 - DNA, 25 bp, Homo sapien
aagttgtatgtggtactataaggca

SEQ ID NO: 367378 - DNA, 25 bp, Homo sapien
aaggcacaacatgcctctactttga

SEQ ID NO: 367379 - DNA, 25 bp, Homo sapien
gaaaagaatagccaccaagtcctga

SEQ ID NO: 367380 - DNA, 25 bp, Homo sapien
tagccaccaagtcctgaatggaaat

SEQ ID NO: 367381 - DNA, 25 bp, Homo sapien
gaaagaattcagtcacctaatttgt

SEQ ID NO: 367382 - DNA, 25 bp, Homo sapien
ttagggaagatttagatacacatgt

SEQ ID NO: 367383 - DNA, 25 bp, Homo sapien
actccagtgcaacacacttcagttt

SEQ ID NO: 367384 - DNA, 25 bp, Homo sapien
gtgcaacacacttcagttttctggg

SEQ ID NO: 367385 - DNA, 25 bp, Homo sapien
cacttcagttttctgggaactcctg

SEQ ID NO: 367386 - DNA, 25 bp, Homo sapien
ctcctgatggaaagtggctgtattt

SEQ ID NO: 367387 - DNA, 25 bp, Homo sapien
ctgtatttgttcatccctatagcct

SEQ ID NO: 367388 - DNA, 25 bp, Homo sapien
atttgttcatccctatagccttggg

SEQ ID NO: 367389 - DNA, 25 bp, Homo sapien
gtaaagagacacagggctcccagcc

SEQ ID NO: 367390 - DNA, 25 bp, Homo sapien
cggtggcccatccatgatgatgttg

SEQ ID NO: 367391 - DNA, 25 bp, Homo sapien
gatccataggatctgcatggcgttg

SEQ ID NO: 367392 - DNA, 25 bp, Homo sapien
ttgaacacggtggacagagtgatga

SEQ ID NO: 367393 - DNA, 25 bp, Homo sapien
atgagactcagggcggagatgctcc

SEQ ID NO: 367394 - DNA, 25 bp, Homo sapien
agaaaagtagactccccaatgcctc

SEQ ID NO: 367395 - DNA, 25 bp, Homo sapien
agtcaggatcccaagaggcgcgtgc

SEQ ID NO: 367396 - DNA, 25 bp, Homo sapien
tgtgtcttccaccagcgcaaaggga

SEQ ID NO: 367397 - DNA, 25 bp, Homo sapien
aagctatcggttgcttctgcagtga

SEQ ID NO: 367398 - DNA, 25 bp, Homo sapien
tccccaatgcctcgcagtaaatgag

SEQ ID NO: 367399 - DNA, 25 bp, Homo sapien
gcttctgcagtgaggcaagctcagc

SEQ ID NO: 367400 - DNA, 25 bp, Homo sapien
aagctcagccggacgcccagaagag

SEQ ID NO: 367401 - DNA, 25 bp, Homo sapien
cagtaaatgaggacgcctggcgcct

SEQ ID NO: 367402 - DNA, 25 bp, Homo sapien
cctgcggcgaggtcaactgaggtca

SEQ ID NO: 367403 - DNA, 25 bp, Homo sapien
gaggtcagacgagcttatctctcct

SEQ ID NO: 367404 - DNA, 25 bp, Homo sapien
tatctctcctgtcccgggaattaag

SEQ ID NO: 367405 - DNA, 25 bp, Homo sapien
gacatttattcttttgatgcacttg

SEQ ID NO: 367406 - DNA, 25 bp, Homo sapien
tgatgcacttgaatgccagagaact

SEQ ID NO: 367407 - DNA, 25 bp, Homo sapien
atgccagagaactgtccttcttttt

SEQ ID NO: 367408 - DNA, 25 bp, Homo sapien
cagcccctgagtcatgaacagcaag

SEQ ID NO: 367409 - DNA, 25 bp, Homo sapien
gagtgtttgaagtttctgctttgaa

SEQ ID NO: 367410 - DNA, 25 bp, Homo sapien
ctgctttgaactccgtccagcctga

SEQ ID NO: 367411 - DNA, 25 bp, Homo sapien
ggcctgagcaacttcacaacagtaa

SEQ ID NO: 367412 - DNA, 25 bp, Homo sapien
gtaattgcactttaagacagcctag

SEQ ID NO: 367413 - DNA, 25 bp, Homo sapien
gcctagagttctggacgagcgtgtt

SEQ ID NO: 367414 - DNA, 25 bp, Homo sapien
ttctggacgagcgtgtttggtagca

SEQ ID NO: 367415 - DNA, 25 bp, Homo sapien
ggatgaaagctagggcctcttattt

SEQ ID NO: 367416 - DNA, 25 bp, Homo sapien
aatgctttagcataatacctgactc

SEQ ID NO: 367417 - DNA, 25 bp, Homo sapien
atacctgactcagagtaaaggctta

SEQ ID NO: 367418 - DNA, 25 bp, Homo sapien
aaggcttaataaaccctagctgatc

SEQ ID NO: 367419 - DNA, 25 bp, Homo sapien
aaccctagctgatcttactgtcaga

SEQ ID NO: 367420 - DNA, 25 bp, Homo sapien
agaagtattaaccatctgcaggaat

SEQ ID NO: 367421 - DNA, 25 bp, Homo sapien
aaccatctgcaggaataagtaccag

SEQ ID NO: 367422 - DNA, 25 bp, Homo sapien
agtaccagagcctgcatcaaaatag

SEQ ID NO: 367423 - DNA, 25 bp, Homo sapien
aattggcaaaagcactcagtttaat

SEQ ID NO: 367424 - DNA, 25 bp, Homo sapien
gcactcagtttaatatatacctgtt

SEQ ID NO: 367425 - DNA, 25 bp, Homo sapien
taagagacagtcatggtttttagct

SEQ ID NO: 367426 - DNA, 25 bp, Homo sapien
ggtttttagctggatactctgggaa

SEQ ID NO: 367427 - DNA, 25 bp, Homo sapien
atcggcctccactgtacacctggat

SEQ ID NO: 367428 - DNA, 25 bp, Homo sapien
actgtacacctggatccaccaagtg

SEQ ID NO: 367429 - DNA, 25 bp, Homo sapien
tggatccaccaagtgtcacactagg

SEQ ID NO: 367430 - DNA, 25 bp, Homo sapien
gtaggtgttgttgcaattgctgaca

SEQ ID NO: 367431 - DNA, 25 bp, Homo sapien
gctgacaatgtttggttcattcaag

SEQ ID NO: 367432 - DNA, 25 bp, Homo sapien
actcagaacagtgctttgcccataa

SEQ ID NO: 367433 - DNA, 25 bp, Homo sapien
gtgctttgcccataaaggcagtgtt

SEQ ID NO: 367434 - DNA, 25 bp, Homo sapien
gcagtgttagtttttgctgtctact

SEQ ID NO: 367435 - DNA, 25 bp, Homo sapien
ttgctgtctacttgggtatcacctg

SEQ ID NO: 367436 - DNA, 25 bp, Homo sapien
gtatcacctgtgaactttaggtctt

SEQ ID NO: 367437 - DNA, 25 bp, Homo sapien
taggtcttttatgcctgaccatcgg

SEQ ID NO: 367438 - DNA, 25 bp, Homo sapien
tttattttcctcaggaagtggtata

SEQ ID NO: 367439 - DNA, 25 bp, Homo sapien
ttcctcaggaagtggtatataagat

SEQ ID NO: 367440 - DNA, 25 bp, Homo sapien
tcctcaaatggaaggatgtagttcc

SEQ ID NO: 367441 - DNA, 25 bp, Homo sapien
tgtagttcctaaacgtaaagtcctg

SEQ ID NO: 367442 - DNA, 25 bp, Homo sapien
taaacgtaaagtcctgttaatgcag

SEQ ID NO: 367443 - DNA, 25 bp, Homo sapien
ctgttaatgcagttatctgctgatt

SEQ ID NO: 367444 - DNA, 25 bp, Homo sapien
tgcagttatctgctgattttataat

SEQ ID NO: 367445 - DNA, 25 bp, Homo sapien
gttatctgctgattttataatacta

SEQ ID NO: 367446 - DNA, 25 bp, Homo sapien
tattttgatatagtaagcagggttt

SEQ ID NO: 367447 - DNA, 25 bp, Homo sapien
aagtcttctgtggaataaccgtaag

SEQ ID NO: 367448 - DNA, 25 bp, Homo sapien
cttctgtggaataaccgtaagtatt

SEQ ID NO: 367449 - DNA, 25 bp, Homo sapien
ggccaggcgaatcttttgttaaaag

SEQ ID NO: 367450 - DNA, 25 bp, Homo sapien
gccaggcgaatcttttgttaaaaga

SEQ ID NO: 367451 - DNA, 25 bp, Homo sapien
gttaaaagaacaatgcgcgctgggc

SEQ ID NO: 367452 - DNA, 25 bp, Homo sapien
ttaaaagaacaatgcgcgctgggca

SEQ ID NO: 367453 - DNA, 25 bp, Homo sapien
taaaagaacaatgcgcgctgggcac

SEQ ID NO: 367454 - DNA, 25 bp, Homo sapien
aaaagaacaatgcgcgctgggcaca

SEQ ID NO: 367455 - DNA, 25 bp, Homo sapien
aaagaacaatgcgcgctgggcacag

SEQ ID NO: 367456 - DNA, 25 bp, Homo sapien
aagaacaatgcgcgctgggcacagt

SEQ ID NO: 367457 - DNA, 25 bp, Homo sapien
agaacaatgcgcgctgggcacagtg

SEQ ID NO: 367458 - DNA, 25 bp, Homo sapien
gaacaatgcgcgctgggcacagtgg

SEQ ID NO: 367459 - DNA, 25 bp, Homo sapien
ggttgttgcagtgagagccatgatc

SEQ ID NO: 367460 - DNA, 25 bp, Homo sapien
tggcacacaacctctcggtggtggc

SEQ ID NO: 367461 - DNA, 25 bp, Homo sapien
acctctcggtggtggccaccaatga

SEQ ID NO: 367462 - DNA, 25 bp, Homo sapien
gtggccaccaatgacgtgggtgtca

SEQ ID NO: 367463 - DNA, 25 bp, Homo sapien
atgacgtgggtgtcaccagtgcgtc

SEQ ID NO: 367464 - DNA, 25 bp, Homo sapien
ggtgtcaccagtgcgtcgcttccag

SEQ ID NO: 367465 - DNA, 25 bp, Homo sapien
acccatctctgatatcaagtgactc

SEQ ID NO: 367466 - DNA, 25 bp, Homo sapien
gatatcaagtgactccaacaaccta

SEQ ID NO: 367467 - DNA, 25 bp, Homo sapien
acctaaaactcaacaacgtgcgcct

SEQ ID NO: 367468 - DNA, 25 bp, Homo sapien
aaaactcaacaacgtgcgcctgcca

SEQ ID NO: 367469 - DNA, 25 bp, Homo sapien
acaacgtgcgcctgccacgggagaa

SEQ ID NO: 367470 - DNA, 25 bp, Homo sapien
tccaaccttcagctcaatgacctca

SEQ ID NO: 367471 - DNA, 25 bp, Homo sapien
gtgccaaggtggtcatacgttttag

SEQ ID NO: 367472 - DNA, 25 bp, Homo sapien
ttcagtctggaaaaggccgggcaac

SEQ ID NO: 367473 - DNA, 25 bp, Homo sapien
aaggccgggcaacgccaagcaaacg

SEQ ID NO: 367474 - DNA, 25 bp, Homo sapien
aagcaaacgtgggacaactcgcagc

SEQ ID NO: 367475 - DNA, 25 bp, Homo sapien
tgggacaactcgcagccaggagaaa

SEQ ID NO: 367476 - DNA, 25 bp, Homo sapien
caggagaaagcttccaggtcacagt

SEQ ID NO: 367477 - DNA, 25 bp, Homo sapien
acaatacctgccttgccaacgtggt

SEQ ID NO: 367478 - DNA, 25 bp, Homo sapien
gacttaccacgtgtttattgggacg

SEQ ID NO: 367479 - DNA, 25 bp, Homo sapien
acctgccttgccaacgtggtgagga

SEQ ID NO: 367480 - DNA, 25 bp, Homo sapien
ggttatattccaaagcccacaaggt

SEQ ID NO: 367481 - DNA, 25 bp, Homo sapien
cacaaggttgaagatgcacacccgt

SEQ ID NO: 367482 - DNA, 25 bp, Homo sapien
acataagtagtatcccttccttcct

SEQ ID NO: 367483 - DNA, 25 bp, Homo sapien
aaggactagctttttgatcacacag

SEQ ID NO: 367484 - DNA, 25 bp, Homo sapien
gctttttgatcacacagcttgataa

SEQ ID NO: 367485 - DNA, 25 bp, Homo sapien
ttttcaagggtccaaattactgtct

SEQ ID NO: 367486 - DNA, 25 bp, Homo sapien
ggtccaaattactgtctaaaccatt

SEQ ID NO: 367487 - DNA, 25 bp, Homo sapien
ttactgtctaaaccatttgccactc

SEQ ID NO: 367488 - DNA, 25 bp, Homo sapien
tctaaaccatttgccactctttgtg

SEQ ID NO: 367489 - DNA, 25 bp, Homo sapien
tgtcaaaatctgcttttctatatca

SEQ ID NO: 367490 - DNA, 25 bp, Homo sapien
tttctatatcaaaacttttctctca

SEQ ID NO: 367491 - DNA, 25 bp, Homo sapien
acttttctctcaagacctgagggaa

SEQ ID NO: 367492 - DNA, 25 bp, Homo sapien
ttctctcaagacctgagggaattaa

SEQ ID NO: 367493 - DNA, 25 bp, Homo sapien
tgctttacccttgtactctactttg

SEQ ID NO: 367494 - DNA, 25 bp, Homo sapien
acccttgtactctactttgtttcag

SEQ ID NO: 367495 - DNA, 25 bp, Homo sapien
ccttgtactctactttgtttcagta

SEQ ID NO: 367496 - DNA, 25 bp, Homo sapien
tactttgtttcagtagaaacttcca

SEQ ID NO: 367497 - DNA, 25 bp, Homo sapien
gagtagcaccctgctaaagaaacct

SEQ ID NO: 367498 - DNA, 25 bp, Homo sapien
agaattgtctgcatctgttttacga

SEQ ID NO: 367499 - DNA, 25 bp, Homo sapien
gcaccctgctaaagaaacctgaata

SEQ ID NO: 367500 - DNA, 25 bp, Homo sapien
gtctgcatctgttttacgacaattc

SEQ ID NO: 367501 - DNA, 25 bp, Homo sapien
taaatttttcaattgtctttctaat

SEQ ID NO: 367502 - DNA, 25 bp, Homo sapien
aacctgaatattctgaatcatagag

SEQ ID NO: 367503 - DNA, 25 bp, Homo sapien
gagttactatgaataccatataagg

SEQ ID NO: 367504 - DNA, 25 bp, Homo sapien
caaacccgctggaagcccgcggttg

SEQ ID NO: 367505 - DNA, 25 bp, Homo sapien
gacctggcggcgaggacgcctattc

SEQ ID NO: 367506 - DNA, 25 bp, Homo sapien
cggcgaggacgcctattccctgctt

SEQ ID NO: 367507 - DNA, 25 bp, Homo sapien
aggacgcctattccctgcttctgcg

SEQ ID NO: 367508 - DNA, 25 bp, Homo sapien
ttctgcgaccacagctgggcactcg

SEQ ID NO: 367509 - DNA, 25 bp, Homo sapien
ctgcgaccacagctgggcactcgga

SEQ ID NO: 367510 - DNA, 25 bp, Homo sapien
gcactcggaaagttgctagggccga

SEQ ID NO: 367511 - DNA, 25 bp, Homo sapien
ggaggcgtggaccaggcgggcagca

SEQ ID NO: 367512 - DNA, 25 bp, Homo sapien
agcccgccgaggagtgatcctccga

SEQ ID NO: 367513 - DNA, 25 bp, Homo sapien
cgccgaggagtgatcctccgactgt

SEQ ID NO: 367514 - DNA, 25 bp, Homo sapien
agcccgcagcagatgtcggcccggc

SEQ ID NO: 367515 - DNA, 25 bp, Homo sapien
gctttgccagcatcttggagcgtct

SEQ ID NO: 367516 - DNA, 25 bp, Homo sapien
atcttggagcgtctgcagtactgca

SEQ ID NO: 367517 - DNA, 25 bp, Homo sapien
tggagcgtctgcagtactgcactca

SEQ ID NO: 367518 - DNA, 25 bp, Homo sapien
gatgtgctgaattcactcctgccaa

SEQ ID NO: 367519 - DNA, 25 bp, Homo sapien
tgctgaattcactcctgccaatgga

SEQ ID NO: 367520 - DNA, 25 bp, Homo sapien
attcactcctgccaatggagctggg

SEQ ID NO: 367521 - DNA, 25 bp, Homo sapien
accccagaggaggaagggacttctg

SEQ ID NO: 367522 - DNA, 25 bp, Homo sapien
agatctttggagtgcctaagacccc

SEQ ID NO: 367523 - DNA, 25 bp, Homo sapien
cagccccaggaactgagtccagaga

SEQ ID NO: 367524 - DNA, 25 bp, Homo sapien
gaggtagccctcttggcccctggct

SEQ ID NO: 367525 - DNA, 25 bp, Homo sapien
gggcctccaacctcagaacctttgg

SEQ ID NO: 367526 - DNA, 25 bp, Homo sapien
cacacagtgagtcagtaacaggaag

SEQ ID NO: 367527 - DNA, 25 bp, Homo sapien
agtgagtcagtaacaggaaggagcc

SEQ ID NO: 367528 - DNA, 25 bp, Homo sapien
aaggagcccttggactgcggcaatg

SEQ ID NO: 367529 - DNA, 25 bp, Homo sapien
tggactgcggcaatgccattagcga

SEQ ID NO: 367530 - DNA, 25 bp, Homo sapien
agtcacagagatgggtaagaaggca

SEQ ID NO: 367531 - DNA, 25 bp, Homo sapien
gcaatgccattagcgaccccatggg

SEQ ID NO: 367532 - DNA, 25 bp, Homo sapien
gaagaggcgaggcatcctagctccc

SEQ ID NO: 367533 - DNA, 25 bp, Homo sapien
atcctagctccctcaggccggaagg

SEQ ID NO: 367534 - DNA, 25 bp, Homo sapien
cacttctcatgtggtgagcggtaca

SEQ ID NO: 367535 - DNA, 25 bp, Homo sapien
tacaggtgagcagagcacagggctc

SEQ ID NO: 367536 - DNA, 25 bp, Homo sapien
agggctccagcagccggatagggaa

SEQ ID NO: 367537 - DNA, 25 bp, Homo sapien
atttgcctattaattccttcttcct

SEQ ID NO: 367538 - DNA, 25 bp, Homo sapien
tcttatcttcttaatgactcttata

SEQ ID NO: 367539 - DNA, 25 bp, Homo sapien
tatcttttcttactctccatgtagt

SEQ ID NO: 367540 - DNA, 25 bp, Homo sapien
agtagttcttactctgcatgttcag

SEQ ID NO: 367541 - DNA, 25 bp, Homo sapien
ctgcatgttcagactctagtggagg

SEQ ID NO: 367542 - DNA, 25 bp, Homo sapien
aggtgctaggaagttccactttctg

SEQ ID NO: 367543 - DNA, 25 bp, Homo sapien
gaagttccactttctggtagattat

SEQ ID NO: 367544 - DNA, 25 bp, Homo sapien
atggcactgagtagcccaagtctta

SEQ ID NO: 367545 - DNA, 25 bp, Homo sapien
tcattgtgatgtttccagtgtacca

SEQ ID NO: 367546 - DNA, 25 bp, Homo sapien
gtttccagtgtaccatcaactgtat

SEQ ID NO: 367547 - DNA, 25 bp, Homo sapien
actgtataggtgattagcatttgcc

SEQ ID NO: 367548 - DNA, 25 bp, Homo sapien
atatgccatctgtttatatcgggac

SEQ ID NO: 367549 - DNA, 25 bp, Homo sapien
tgccatctgtttatatcgggacaca

SEQ ID NO: 367550 - DNA, 25 bp, Homo sapien
gtttatatcgggacacagtatcttt

SEQ ID NO: 367551 - DNA, 25 bp, Homo sapien
atcgggacacagtatctttttaaca

SEQ ID NO: 367552 - DNA, 25 bp, Homo sapien
ggacacagtatctttttaacacaac

SEQ ID NO: 367553 - DNA, 25 bp, Homo sapien
aacaaatgctatcttatttcagaga

SEQ ID NO: 367554 - DNA, 25 bp, Homo sapien
tatttcagagatacaaagcattatg

SEQ ID NO: 367555 - DNA, 25 bp, Homo sapien
agcattatgttttatctacatcaca

SEQ ID NO: 367556 - DNA, 25 bp, Homo sapien
gaacttgggagagcatatgtgtaca

SEQ ID NO: 367557 - DNA, 25 bp, Homo sapien
ttgggagagcatatgtgtacagtaa

SEQ ID NO: 367558 - DNA, 25 bp, Homo sapien
aaatctcatgtagtggtcagattcc

SEQ ID NO: 367559 - DNA, 25 bp, Homo sapien
aaaaagaaaccagtaagtgctcaat

SEQ ID NO: 367560 - DNA, 25 bp, Homo sapien
gttactaacatctatttcttcattc

SEQ ID NO: 367561 - DNA, 25 bp, Homo sapien
taacatctatttcttcattcattct

SEQ ID NO: 367562 - DNA, 25 bp, Homo sapien
attcttcaaccattacccactgagt

SEQ ID NO: 367563 - DNA, 25 bp, Homo sapien
ttcttcaaccattacccactgagtg

SEQ ID NO: 367564 - DNA, 25 bp, Homo sapien
tcttcaaccattacccactgagtgc

SEQ ID NO: 367565 - DNA, 25 bp, Homo sapien
ccactgagtgcctatttggatactt

SEQ ID NO: 367566 - DNA, 25 bp, Homo sapien
atttggatacttggcttagtacctg

SEQ ID NO: 367567 - DNA, 25 bp, Homo sapien
gtgatgaaataatctacagcaaacc

SEQ ID NO: 367568 - DNA, 25 bp, Homo sapien
ccccatggcatgagtttataacaaa

SEQ ID NO: 367569 - DNA, 25 bp, Homo sapien
atggcatgagtttataacaaacctg

SEQ ID NO: 367570 - DNA, 25 bp, Homo sapien
gaatctattggccttttacagggta

SEQ ID NO: 367571 - DNA, 25 bp, Homo sapien
gtattaatccctttgtcacctacca

SEQ ID NO: 367572 - DNA, 25 bp, Homo sapien
gtcacctaccattgatgccttaagt

SEQ ID NO: 367573 - DNA, 25 bp, Homo sapien
gatgccttaagttttctgagtctca

SEQ ID NO: 367574 - DNA, 25 bp, Homo sapien
tgagtctcaattaaaaatcttcctt

SEQ ID NO: 367575 - DNA, 25 bp, Homo sapien
aatcttccttttcttgatgcatgac

SEQ ID NO: 367576 - DNA, 25 bp, Homo sapien
agtgtaatcagtacttgctcattta

SEQ ID NO: 367577 - DNA, 25 bp, Homo sapien
tcagtacttgctcatttatttgtct

SEQ ID NO: 367578 - DNA, 25 bp, Homo sapien
gtactatttaattatccttccagcg

SEQ ID NO: 367579 - DNA, 25 bp, Homo sapien
tagtgttaagctaaggcattgattc

SEQ ID NO: 367580 - DNA, 25 bp, Homo sapien
gcattgattcatgtatctgtcctta

SEQ ID NO: 367581 - DNA, 25 bp, Homo sapien
aaaaagtcaggctgcgagtgtgtct

SEQ ID NO: 367582 - DNA, 25 bp, Homo sapien
tgtgtctgtgattacgtgtgtgtca

SEQ ID NO: 367583 - DNA, 25 bp, Homo sapien
tttctttacttcagtctttgacttg

SEQ ID NO: 367584 - DNA, 25 bp, Homo sapien
acacagacacgctgcgcgctgattg

SEQ ID NO: 367585 - DNA, 25 bp, Homo sapien
tgattggttcccagctcagtctttc

SEQ ID NO: 367586 - DNA, 25 bp, Homo sapien
tttcagcttggcagcaacctagtct

SEQ ID NO: 367587 - DNA, 25 bp, Homo sapien
agcaacctagtctcaaccctgtttc

SEQ ID NO: 367588 - DNA, 25 bp, Homo sapien
ttctgagttgtgtttgcggaaattc

SEQ ID NO: 367589 - DNA, 25 bp, Homo sapien
gaggaggaatcacaccaattctatt

SEQ ID NO: 367590 - DNA, 25 bp, Homo sapien
agaccaggagtcacggcatgtacag

SEQ ID NO: 367591 - DNA, 25 bp, Homo sapien
tcacggcatgtacagtttcggacat

SEQ ID NO: 367592 - DNA, 25 bp, Homo sapien
ctttccttgctatagctgagaaaaa

SEQ ID NO: 367593 - DNA, 25 bp, Homo sapien
gagaaaaaagctgtggcccaaaagt

SEQ ID NO: 367594 - DNA, 25 bp, Homo sapien
acaggatcagattgtcttttcaaga

SEQ ID NO: 367595 - DNA, 25 bp, Homo sapien
gtcttttcaagagttcccatgtgca

SEQ ID NO: 367596 - DNA, 25 bp, Homo sapien
gttcccatgtgcaatacagagctga

SEQ ID NO: 367597 - DNA, 25 bp, Homo sapien
ggattcatagagaaaggccagtata

SEQ ID NO: 367598 - DNA, 25 bp, Homo sapien
gccagtataaatcttcagcatacca

SEQ ID NO: 367599 - DNA, 25 bp, Homo sapien
gaaaggagaaagcttgcaatgcatg

SEQ ID NO: 367600 - DNA, 25 bp, Homo sapien
tagcagaacttctctgattggccat

SEQ ID NO: 367601 - DNA, 25 bp, Homo sapien
gattggccatattctgcacatagtg

SEQ ID NO: 367602 - DNA, 25 bp, Homo sapien
acatagtgaccaactcacctctttt

SEQ ID NO: 367603 - DNA, 25 bp, Homo sapien
ggatcctcttcctggtactgttctt

SEQ ID NO: 367604 - DNA, 25 bp, Homo sapien
gaagcagtaatgaggatggttttat

SEQ ID NO: 367605 - DNA, 25 bp, Homo sapien
gatggttttatagctattccatagc

SEQ ID NO: 367606 - DNA, 25 bp, Homo sapien
tattccatagccttcctctttctta

SEQ ID NO: 367607 - DNA, 25 bp, Homo sapien
tcctctttcttatcctcgtatgtgt

SEQ ID NO: 367608 - DNA, 25 bp, Homo sapien
tttcttatcctcgtatgtgttctca

SEQ ID NO: 367609 - DNA, 25 bp, Homo sapien
tatcctcgtatgtgttctcactgtt

SEQ ID NO: 367610 - DNA, 25 bp, Homo sapien
gttctcactgtttttggtcaaattt

SEQ ID NO: 367611 - DNA, 25 bp, Homo sapien
ttgttgttcctctgcaggtcattgt

SEQ ID NO: 367612 - DNA, 25 bp, Homo sapien
gttcctctgcaggtcattgttgaaa

SEQ ID NO: 367613 - DNA, 25 bp, Homo sapien
cctctgcaggtcattgttgaaaata

SEQ ID NO: 367614 - DNA, 25 bp, Homo sapien
tccagcgacttgtcctgacgggaag

SEQ ID NO: 367615 - DNA, 25 bp, Homo sapien
gcgacttgtcctgacgggaaggacc

SEQ ID NO: 367616 - DNA, 25 bp, Homo sapien
cagaggcgggcccatgagacaacac

SEQ ID NO: 367617 - DNA, 25 bp, Homo sapien
agaggcgggcccatgagacaacaca

SEQ ID NO: 367618 - DNA, 25 bp, Homo sapien
gaggcgggcccatgagacaacacat

SEQ ID NO: 367619 - DNA, 25 bp, Homo sapien
aggcgggcccatgagacaacacatg

SEQ ID NO: 367620 - DNA, 25 bp, Homo sapien
gggcccatgagacaacacatggctc

SEQ ID NO: 367621 - DNA, 25 bp, Homo sapien
gagacaacacatggctcacgggcta

SEQ ID NO: 367622 - DNA, 25 bp, Homo sapien
gacaacacatggctcacgggctata

SEQ ID NO: 367623 - DNA, 25 bp, Homo sapien
acaacacatggctcacgggctatag

SEQ ID NO: 367624 - DNA, 25 bp, Homo sapien
aacacatggctcacgggctataggg

SEQ ID NO: 367625 - DNA, 25 bp, Homo sapien
aaatttaagatgtcctatggtttct

SEQ ID NO: 367626 - DNA, 25 bp, Homo sapien
tatggtttcttttagatttctaagg

SEQ ID NO: 367627 - DNA, 25 bp, Homo sapien
ggcttaggaccatgatttttcttaa

SEQ ID NO: 367628 - DNA, 25 bp, Homo sapien
atgttcaatgtgcagagcatctcca

SEQ ID NO: 367629 - DNA, 25 bp, Homo sapien
tgtgcagagcatctccaaaactccc

SEQ ID NO: 367630 - DNA, 25 bp, Homo sapien
ttcagacatctgacaggtaacccct

SEQ ID NO: 367631 - DNA, 25 bp, Homo sapien
atctgacaggtaacccctggctaac

SEQ ID NO: 367632 - DNA, 25 bp, Homo sapien
tggctaacccagctatctactggac

SEQ ID NO: 367633 - DNA, 25 bp, Homo sapien
cagctatctactggacacaggcagc

SEQ ID NO: 367634 - DNA, 25 bp, Homo sapien
taaataccctaaatcattctccatg

SEQ ID NO: 367635 - DNA, 25 bp, Homo sapien
ttctccatgatcagatagtctctca

SEQ ID NO: 367636 - DNA, 25 bp, Homo sapien
ggccccttccaagagggacaggcct

SEQ ID NO: 367637 - DNA, 25 bp, Homo sapien
gccccttccaagagggacaggcctc

SEQ ID NO: 367638 - DNA, 25 bp, Homo sapien
ccccttccaagagggacaggcctct

SEQ ID NO: 367639 - DNA, 25 bp, Homo sapien
ccttccaagagggacaggcctctcc

SEQ ID NO: 367640 - DNA, 25 bp, Homo sapien
ttccaagagggacaggcctctcccc

SEQ ID NO: 367641 - DNA, 25 bp, Homo sapien
tccaagagggacaggcctctcccca

SEQ ID NO: 367642 - DNA, 25 bp, Homo sapien
ccaagagggacaggcctctccccag

SEQ ID NO: 367643 - DNA, 25 bp, Homo sapien
aggcctctccccagcgcgccttcct

SEQ ID NO: 367644 - DNA, 25 bp, Homo sapien
ggcctctccccagcgcgccttcctc

SEQ ID NO: 367645 - DNA, 25 bp, Homo sapien
ttcctcccacgtttttatggatctg

SEQ ID NO: 367646 - DNA, 25 bp, Homo sapien
tcctcccacgtttttatggatctgc

SEQ ID NO: 367647 - DNA, 25 bp, Homo sapien
acattctctgctgtaccttcttgga

SEQ ID NO: 367648 - DNA, 25 bp, Homo sapien
ggacagttgtactcagactcagagt

SEQ ID NO: 367649 - DNA, 25 bp, Homo sapien
actcagagtctgtagtcctaatgaa

SEQ ID NO: 367650 - DNA, 25 bp, Homo sapien
tgtagtcctaatgaacagtcagtca

SEQ ID NO: 367651 - DNA, 25 bp, Homo sapien
gaacagtcagtcattccccttaaat

SEQ ID NO: 367652 - DNA, 25 bp, Homo sapien
tccccttaaatgatggtatcctcag

SEQ ID NO: 367653 - DNA, 25 bp, Homo sapien
aacatacttctttgtgggctcccaa

SEQ ID NO: 367654 - DNA, 25 bp, Homo sapien
taccttcttggatctctcctgtctg

SEQ ID NO: 367655 - DNA, 25 bp, Homo sapien
actgtatcttttgggtaatttcatg

SEQ ID NO: 367656 - DNA, 25 bp, Homo sapien
gtctgcttctttaaactgaggctga

SEQ ID NO: 367657 - DNA, 25 bp, Homo sapien
ctgataaaaggcacatttcctctct

SEQ ID NO: 367658 - DNA, 25 bp, Homo sapien
atccctaccccgtgtggccaagaat

SEQ ID NO: 367659 - DNA, 25 bp, Homo sapien
cccgtgtggccaagaatggttgcgt

SEQ ID NO: 367660 - DNA, 25 bp, Homo sapien
aatggttgcgtggtgcagcgggccc

SEQ ID NO: 367661 - DNA, 25 bp, Homo sapien
gcactgtccgcttggttcacgttcg

SEQ ID NO: 367662 - DNA, 25 bp, Homo sapien
ttggttcacgttcgccccgttctgg

SEQ ID NO: 367663 - DNA, 25 bp, Homo sapien
gaggagaaactcacaggccagaaga

SEQ ID NO: 367664 - DNA, 25 bp, Homo sapien
aactcacaggccagaagagaattct

SEQ ID NO: 367665 - DNA, 25 bp, Homo sapien
attctgcatggagaagtcgagaagg

SEQ ID NO: 367666 - DNA, 25 bp, Homo sapien
ggttgagggtggcatccctagtggt

SEQ ID NO: 367667 - DNA, 25 bp, Homo sapien
atcagctccccgtttcaggaacagg

SEQ ID NO: 367668 - DNA, 25 bp, Homo sapien
cgtttcaggaacaggcaggcgagcc

SEQ ID NO: 367669 - DNA, 25 bp, Homo sapien
agactcatggacttcaggagccctt

SEQ ID NO: 367670 - DNA, 25 bp, Homo sapien
gggatgaagagttcaaaccttttgg

SEQ ID NO: 367671 - DNA, 25 bp, Homo sapien
ttcttttctaggcttctccctcgca

SEQ ID NO: 367672 - DNA, 25 bp, Homo sapien
tccctcgcagggtgttccgtagttt

SEQ ID NO: 367673 - DNA, 25 bp, Homo sapien
ttccgtagtttcttctcgagccaat

SEQ ID NO: 367674 - DNA, 25 bp, Homo sapien
tcttctcgagccaatgcatgtatta

SEQ ID NO: 367675 - DNA, 25 bp, Homo sapien
gcatgtattatagcagcaggtgtct

SEQ ID NO: 367676 - DNA, 25 bp, Homo sapien
tagcagcaggtgtctttgtgctttc

SEQ ID NO: 367677 - DNA, 25 bp, Homo sapien
ttgtgctttctcatcatagtaacgt

SEQ ID NO: 367678 - DNA, 25 bp, Homo sapien
gtaacgtactacttgtaaatacatt

SEQ ID NO: 367679 - DNA, 25 bp, Homo sapien
gtgtgctgtatattttccatgccct

SEQ ID NO: 367680 - DNA, 25 bp, Homo sapien
gcctctgggccctttgcagtaatca

SEQ ID NO: 367681 - DNA, 25 bp, Homo sapien
tttgcagtaatcacccagggtctgg

SEQ ID NO: 367682 - DNA, 25 bp, Homo sapien
acccagggtctggtaaagccactga

SEQ ID NO: 367683 - DNA, 25 bp, Homo sapien
gggtctggtaaagccactgagagcc

SEQ ID NO: 367684 - DNA, 25 bp, Homo sapien
ctgagagccctactggcacctcaga

SEQ ID NO: 367685 - DNA, 25 bp, Homo sapien
aaatgggcaggcagttttgagaaga

SEQ ID NO: 367686 - DNA, 25 bp, Homo sapien
gaaccttctaataagaaatgtgagg

SEQ ID NO: 367687 - DNA, 25 bp, Homo sapien
gaccaggaagaaggagacaagtttg

SEQ ID NO: 367688 - DNA, 25 bp, Homo sapien
gctgcttcccctaatgggatgatgc

SEQ ID NO: 367689 - DNA, 25 bp, Homo sapien
aatgggatgatgcaatctgggctca

SEQ ID NO: 367690 - DNA, 25 bp, Homo sapien
tgggatgatgcaatctgggctcatg

SEQ ID NO: 367691 - DNA, 25 bp, Homo sapien
tgtagcccaggccaatttataacta

SEQ ID NO: 367692 - DNA, 25 bp, Homo sapien
gcttctaaaacagcattgataggtt

SEQ ID NO: 367693 - DNA, 25 bp, Homo sapien
tacttcaatgattagctcagttgct

SEQ ID NO: 367694 - DNA, 25 bp, Homo sapien
agctcagttgcttaactggagtttt

SEQ ID NO: 367695 - DNA, 25 bp, Homo sapien
aactggagttttaatcctgtgatat

SEQ ID NO: 367696 - DNA, 25 bp, Homo sapien
tcctgtgatatgtacattggattca

SEQ ID NO: 367697 - DNA, 25 bp, Homo sapien
attggattcatgactgtgcagcatt

SEQ ID NO: 367698 - DNA, 25 bp, Homo sapien
gactgtgcagcatttttagttatgt

SEQ ID NO: 367699 - DNA, 25 bp, Homo sapien
gtggtgtttggcagaatgacaataa

SEQ ID NO: 367700 - DNA, 25 bp, Homo sapien
ccccattttggtttcaggaggacat

SEQ ID NO: 367701 - DNA, 25 bp, Homo sapien
gtgtgtttattgtaactcctcatac

SEQ ID NO: 367702 - DNA, 25 bp, Homo sapien
accatgggaatgcaatctgtttgca

SEQ ID NO: 367703 - DNA, 25 bp, Homo sapien
ccatgggaatgcaatctgtttgcag

SEQ ID NO: 367704 - DNA, 25 bp, Homo sapien
catgggaatgcaatctgtttgcagt

SEQ ID NO: 367705 - DNA, 25 bp, Homo sapien
atgggaatgcaatctgtttgcagtc

SEQ ID NO: 367706 - DNA, 25 bp, Homo sapien
tgggaatgcaatctgtttgcagtct

SEQ ID NO: 367707 - DNA, 25 bp, Homo sapien
gggaatgcaatctgtttgcagtctc

SEQ ID NO: 367708 - DNA, 25 bp, Homo sapien
ggaatgcaatctgtttgcagtctcc

SEQ ID NO: 367709 - DNA, 25 bp, Homo sapien
gaatgcaatctgtttgcagtctcct

SEQ ID NO: 367710 - DNA, 25 bp, Homo sapien
agcaacctcctgtcagacgcggtct

SEQ ID NO: 367711 - DNA, 25 bp, Homo sapien
caaacgggcgcaccaacttatttca

SEQ ID NO: 367712 - DNA, 25 bp, Homo sapien
atcttctcatcgtaaaaggtttgga

SEQ ID NO: 367713 - DNA, 25 bp, Homo sapien
aacgagaaacgtttgccattcccag

SEQ ID NO: 367714 - DNA, 25 bp, Homo sapien
gtttgccattcccagtgagtttcaa

SEQ ID NO: 367715 - DNA, 25 bp, Homo sapien
ttcccagtgagtttcaaggctgcaa

SEQ ID NO: 367716 - DNA, 25 bp, Homo sapien
aaggctgcaaatcctccggagaggt

SEQ ID NO: 367717 - DNA, 25 bp, Homo sapien
tcctccggagaggtcctagatggtc

SEQ ID NO: 367718 - DNA, 25 bp, Homo sapien
aggtcctagatggtctctccgggtc

SEQ ID NO: 367719 - DNA, 25 bp, Homo sapien
tggaatgttttaccgtttgattcgg

SEQ ID NO: 367720 - DNA, 25 bp, Homo sapien
ttaccgtttgattcgggaattcagg

SEQ ID NO: 367721 - DNA, 25 bp, Homo sapien
aaagagaagcctgcggttggcatga

SEQ ID NO: 367722 - DNA, 25 bp, Homo sapien
aggatgcctgacaacaaaggctgga

SEQ ID NO: 367723 - DNA, 25 bp, Homo sapien
gcctctgtcttgacctgtgtaatga

SEQ ID NO: 367724 - DNA, 25 bp, Homo sapien
gtcttgacctgtgtaatgaattagt

SEQ ID NO: 367725 - DNA, 25 bp, Homo sapien
atgaattagtgtgctgtgtcactgt

SEQ ID NO: 367726 - DNA, 25 bp, Homo sapien
gtgtcactgtggcttgaagtcactg

SEQ ID NO: 367727 - DNA, 25 bp, Homo sapien
gaagtcactgtggatcgagctcaca

SEQ ID NO: 367728 - DNA, 25 bp, Homo sapien
gttgtcaacagagtctgaagcagtc

SEQ ID NO: 367729 - DNA, 25 bp, Homo sapien
aagcagtcagggtgttggattcctc

SEQ ID NO: 367730 - DNA, 25 bp, Homo sapien
gtgttggattcctctgttgttgtca

SEQ ID NO: 367731 - DNA, 25 bp, Homo sapien
gttgttgtcatcaattcctgctgag

SEQ ID NO: 367732 - DNA, 25 bp, Homo sapien
aagctcaccttgagttcacttcaca

SEQ ID NO: 367733 - DNA, 25 bp, Homo sapien
ttgagttcacttcacacgggccagt

SEQ ID NO: 367734 - DNA, 25 bp, Homo sapien
acgggccagtcacaaccacttaatt

SEQ ID NO: 367735 - DNA, 25 bp, Homo sapien
caaccacttaattctgtcctcacag

SEQ ID NO: 367736 - DNA, 25 bp, Homo sapien
ggcactgtggtgtttctatcttacg

SEQ ID NO: 367737 - DNA, 25 bp, Homo sapien
ggacgccagggcttgcatacgctat

SEQ ID NO: 367738 - DNA, 25 bp, Homo sapien
atacgctatcaccttgccagagtcg

SEQ ID NO: 367739 - DNA, 25 bp, Homo sapien
tgccagagtcgtgctgctgaattat

SEQ ID NO: 367740 - DNA, 25 bp, Homo sapien
tgctgtcgtgggtgtctctgtctcc

SEQ ID NO: 367741 - DNA, 25 bp, Homo sapien
atcacagatctgctggtttctttct

SEQ ID NO: 367742 - DNA, 25 bp, Homo sapien
gcacctggcaacctctggagggcaa

SEQ ID NO: 367743 - DNA, 25 bp, Homo sapien
ttgaagatgagttactccttgtcat

SEQ ID NO: 367744 - DNA, 25 bp, Homo sapien
tgagttactccttgtcatcttacaa

SEQ ID NO: 367745 - DNA, 25 bp, Homo sapien
aacagatgtcagttttgaaccaaga

SEQ ID NO: 367746 - DNA, 25 bp, Homo sapien
accaagaattggtgatttgtttata

SEQ ID NO: 367747 - DNA, 25 bp, Homo sapien
tttacacgtgtaagccaactgagat

SEQ ID NO: 367748 - DNA, 25 bp, Homo sapien
gatttctttcaatgatgcttaccat

SEQ ID NO: 367749 - DNA, 25 bp, Homo sapien
tgcttaccatctattttagccactg

SEQ ID NO: 367750 - DNA, 25 bp, Homo sapien
accatctattttagccactgagcct

SEQ ID NO: 367751 - DNA, 25 bp, Homo sapien
atctattttagccactgagcctttt

SEQ ID NO: 367752 - DNA, 25 bp, Homo sapien
attttagccactgagccttttatta

SEQ ID NO: 367753 - DNA, 25 bp, Homo sapien
gtaaagtttatttgtcttaactcat

SEQ ID NO: 367754 - DNA, 25 bp, Homo sapien
ctttgcagtaatcacccagggtctg

SEQ ID NO: 367755 - DNA, 25 bp, Homo sapien
ttgcagtaatcacccagggtctggt

SEQ ID NO: 367756 - DNA, 25 bp, Homo sapien
acccagggtctggtaaagccactga

SEQ ID NO: 367757 - DNA, 25 bp, Homo sapien
gggtctggtaaagccactgagagcc

SEQ ID NO: 367758 - DNA, 25 bp, Homo sapien
ctgagagccctactggcacctcaga

SEQ ID NO: 367759 - DNA, 25 bp, Homo sapien
gcaaatgggcaggcagttttgagaa

SEQ ID NO: 367760 - DNA, 25 bp, Homo sapien
gaaccttctaataagaaatgtgagg

SEQ ID NO: 367761 - DNA, 25 bp, Homo sapien
tgagggaggttacagcagtgtgtga

SEQ ID NO: 367762 - DNA, 25 bp, Homo sapien
gctgcttcccctaatgggatgatgc

SEQ ID NO: 367763 - DNA, 25 bp, Homo sapien
aatgggatgatgcaatctgggctca

SEQ ID NO: 367764 - DNA, 25 bp, Homo sapien
tgggatgatgcaatctgggctcatg

SEQ ID NO: 367765 - DNA, 25 bp, Homo sapien
tctacttcagtaacattcattcatt

SEQ ID NO: 367766 - DNA, 25 bp, Homo sapien
tttctaacatgcatttattgagtac

SEQ ID NO: 367767 - DNA, 25 bp, Homo sapien
gtacccactactatgtgcatagcat

SEQ ID NO: 367768 - DNA, 25 bp, Homo sapien
gcatagcattgcaatatagtcctgg

SEQ ID NO: 367769 - DNA, 25 bp, Homo sapien
atagtcctggaagtagacagtgcag

SEQ ID NO: 367770 - DNA, 25 bp, Homo sapien
agtagacagtgcagaacctttcaat

SEQ ID NO: 367771 - DNA, 25 bp, Homo sapien
gaacctttcaatctgtagatggtgt

SEQ ID NO: 367772 - DNA, 25 bp, Homo sapien
atacaaagtccatctgcagttccta

SEQ ID NO: 367773 - DNA, 25 bp, Homo sapien
gtccatctgcagttcctagtttaaa

SEQ ID NO: 367774 - DNA, 25 bp, Homo sapien
gtagagctttacctgtcatgtgcat

SEQ ID NO: 367775 - DNA, 25 bp, Homo sapien
ttacctgtcatgtgcatcagcaaga

SEQ ID NO: 367776 - DNA, 25 bp, Homo sapien
ttttgattctgttatctcgtgcatt

SEQ ID NO: 367777 - DNA, 25 bp, Homo sapien
gattctgttatctcgtgcattactt

SEQ ID NO: 367778 - DNA, 25 bp, Homo sapien
tgttatctcgtgcattacttattac

SEQ ID NO: 367779 - DNA, 25 bp, Homo sapien
attacttctaattcgtgccatctga

SEQ ID NO: 367780 - DNA, 25 bp, Homo sapien
taattcgtgccatctgaaatttgat

SEQ ID NO: 367781 - DNA, 25 bp, Homo sapien
tctattttctctaagcagtggtcaa

SEQ ID NO: 367782 - DNA, 25 bp, Homo sapien
atagtttacatgctttcacacttca

SEQ ID NO: 367783 - DNA, 25 bp, Homo sapien
agcaatgaaggactgtttttaggaa

SEQ ID NO: 367784 - DNA, 25 bp, Homo sapien
taggaaaacggactttattgagctt

SEQ ID NO: 367785 - DNA, 25 bp, Homo sapien
gagcttaatacattgatatgttcat

SEQ ID NO: 367786 - DNA, 25 bp, Homo sapien
attgaaaattcccaaggcacatcac

SEQ ID NO: 367787 - DNA, 25 bp, Homo sapien
aattatttgtggcaatagtgatcac

SEQ ID NO: 367788 - DNA, 25 bp, Homo sapien
ttgtggcaatagtgatcacattcat

SEQ ID NO: 367789 - DNA, 25 bp, Homo sapien
ttcattttaattttgccggaatatt

SEQ ID NO: 367790 - DNA, 25 bp, Homo sapien
aattttgccggaatatttcaagaca

SEQ ID NO: 367791 - DNA, 25 bp, Homo sapien
aaagcaggaagcaacataccatgaa

SEQ ID NO: 367792 - DNA, 25 bp, Homo sapien
cataccatgaatgtactgcaaggga

SEQ ID NO: 367793 - DNA, 25 bp, Homo sapien
gtactgcaagggaacacatttgtgt

SEQ ID NO: 367794 - DNA, 25 bp, Homo sapien
acacatttgtgtcatgtgaagagac

SEQ ID NO: 367795 - DNA, 25 bp, Homo sapien
gacatgacaaaaacagccctcctta

SEQ ID NO: 367796 - DNA, 25 bp, Homo sapien
atgacaaaaacagccctccttaaat

SEQ ID NO: 367797 - DNA, 25 bp, Homo sapien
aacagccctccttaaattatttgtg

SEQ ID NO: 367798 - DNA, 25 bp, Homo sapien
tgcaaaagcaagactgggttcgaga

SEQ ID NO: 367799 - DNA, 25 bp, Homo sapien
atctctctgacttcacttgctctgg

SEQ ID NO: 367800 - DNA, 25 bp, Homo sapien
aagcaagactgggttcgagagcagc

SEQ ID NO: 367801 - DNA, 25 bp, Homo sapien
cgagagcagccctgctgggtctgtg

SEQ ID NO: 367802 - DNA, 25 bp, Homo sapien
cctggccagggatccaagagccaac

SEQ ID NO: 367803 - DNA, 25 bp, Homo sapien
agggatccaagagccaacagcatat

SEQ ID NO: 367804 - DNA, 25 bp, Homo sapien
gagccaacagcatatcaggcagaaa

SEQ ID NO: 367805 - DNA, 25 bp, Homo sapien
tcacttgctctgggcagttggctct

SEQ ID NO: 367806 - DNA, 25 bp, Homo sapien
ctctgtgcccttggtaaggcttgac

SEQ ID NO: 367807 - DNA, 25 bp, Homo sapien
ttggtaaggcttgacctcttctctc

SEQ ID NO: 367808 - DNA, 25 bp, Homo sapien
gtaaggcttgacctcttctctcttc

SEQ ID NO: 367809 - DNA, 25 bp, Homo sapien
tggttgtctaccagaatgtcaggag

SEQ ID NO: 367810 - DNA, 25 bp, Homo sapien
gagactcatcttacacagtcatggt

SEQ ID NO: 367811 - DNA, 25 bp, Homo sapien
agtcatggtggccaatgtttctggt

SEQ ID NO: 367812 - DNA, 25 bp, Homo sapien
tgggttgtgctgaaacagctcttct

SEQ ID NO: 367813 - DNA, 25 bp, Homo sapien
aacagctcttctgagaacttccaac

SEQ ID NO: 367814 - DNA, 25 bp, Homo sapien
atgctctaacctggagacagccatc

SEQ ID NO: 367815 - DNA, 25 bp, Homo sapien
acatgtatggtactcttgtccccaa

SEQ ID NO: 367816 - DNA, 25 bp, Homo sapien
tcttgtccccaagaaatgttaggaa

SEQ ID NO: 367817 - DNA, 25 bp, Homo sapien
tcagctgaatgagaggaggtgcctt

SEQ ID NO: 367818 - DNA, 25 bp, Homo sapien
tgggtatctctgtgttggtgtatct

SEQ ID NO: 367819 - DNA, 25 bp, Homo sapien
gtgtatctgtgccattggctacaga

SEQ ID NO: 367820 - DNA, 25 bp, Homo sapien
gtcactctgttgctcatattctcca

SEQ ID NO: 367821 - DNA, 25 bp, Homo sapien
gttgctcatattctccatcttttgg

SEQ ID NO: 367822 - DNA, 25 bp, Homo sapien
attctccatcttttggaccaagcag

SEQ ID NO: 367823 - DNA, 25 bp, Homo sapien
gggtgagtgctgttcccagacaaga

SEQ ID NO: 367824 - DNA, 25 bp, Homo sapien
gtgctgttcccagacaagaaaccaa

SEQ ID NO: 367825 - DNA, 25 bp, Homo sapien
accaaacctttttcggttgctgctg

SEQ ID NO: 367826 - DNA, 25 bp, Homo sapien
ggtatggtgactacggagcctcatt

SEQ ID NO: 367827 - DNA, 25 bp, Homo sapien
gagcctcatttggtattgtcttcct

SEQ ID NO: 367828 - DNA, 25 bp, Homo sapien
ggtattgtcttcctttgtagtgttg

SEQ ID NO: 367829 - DNA, 25 bp, Homo sapien
tgtttattttacaatccagggattg

SEQ ID NO: 367830 - DNA, 25 bp, Homo sapien
caggccatgtgtttgcttctgggaa

SEQ ID NO: 367831 - DNA, 25 bp, Homo sapien
cagttttagaatctactgctgctaa

SEQ ID NO: 367832 - DNA, 25 bp, Homo sapien
gaatctactgctgctaaagcacatt

SEQ ID NO: 367833 - DNA, 25 bp, Homo sapien
caaatcctggtttttaatgtatgca

SEQ ID NO: 367834 - DNA, 25 bp, Homo sapien
atacttttgttcatgtctagcccac

SEQ ID NO: 367835 - DNA, 25 bp, Homo sapien
tgttcatgtctagcccactgggaat

SEQ ID NO: 367836 - DNA, 25 bp, Homo sapien
tagcccactgggaattttgttttca

SEQ ID NO: 367837 - DNA, 25 bp, Homo sapien
ttgttttcaccttatactgagtcct

SEQ ID NO: 367838 - DNA, 25 bp, Homo sapien
ttcaccttatactgagtcctttttc

SEQ ID NO: 367839 - DNA, 25 bp, Homo sapien
ccaagtttgatttctgtatcagggt

SEQ ID NO: 367840 - DNA, 25 bp, Homo sapien
tctgtatcagggtaacattgagaac

SEQ ID NO: 367841 - DNA, 25 bp, Homo sapien
gggtaacattgagaacacacatatt

SEQ ID NO: 367842 - DNA, 25 bp, Homo sapien
gaaagaaattccatcaagttccaaa

SEQ ID NO: 367843 - DNA, 25 bp, Homo sapien
aaacttgagtttgccaggtgccaag

SEQ ID NO: 367844 - DNA, 25 bp, Homo sapien
gccaggtgccaagtacttcgttgaa

SEQ ID NO: 367845 - DNA, 25 bp, Homo sapien
gtacttcgttgaatccacaggaatg

SEQ ID NO: 367846 - DNA, 25 bp, Homo sapien
actacaccattttatgttaagagac

SEQ ID NO: 367847 - DNA, 25 bp, Homo sapien
gttaagagacttgggcatccccagg

SEQ ID NO: 367848 - DNA, 25 bp, Homo sapien
gcatccccaggttttgttatctgat

SEQ ID NO: 367849 - DNA, 25 bp, Homo sapien
gttatctgatggaggtcctggaacc

SEQ ID NO: 367850 - DNA, 25 bp, Homo sapien
cagataccgagggactactgtaata

SEQ ID NO: 367851 - DNA, 25 bp, Homo sapien
actactgtaatataagaggccactt

SEQ ID NO: 367852 - DNA, 25 bp, Homo sapien
gaggccacttagttctttttctgag

SEQ ID NO: 367853 - DNA, 25 bp, Homo sapien
ggacaaaatgactccttatgaagca

SEQ ID NO: 367854 - DNA, 25 bp, Homo sapien
gtgccttctgtgagaaaacatgtat

SEQ ID NO: 367855 - DNA, 25 bp, Homo sapien
aaataggaacaatctcttgaagagg

SEQ ID NO: 367856 - DNA, 25 bp, Homo sapien
aagaggcaaatgactcaaaactgct

SEQ ID NO: 367857 - DNA, 25 bp, Homo sapien
aaaactgctcagtggctctttcaga

SEQ ID NO: 367858 - DNA, 25 bp, Homo sapien
gtggctctttcagaaaatctaagta

SEQ ID NO: 367859 - DNA, 25 bp, Homo sapien
tctaagtaaagttccctgacaacag

SEQ ID NO: 367860 - DNA, 25 bp, Homo sapien
aactgaagagattgcctggttcatc

SEQ ID NO: 367861 - DNA, 25 bp, Homo sapien
gattgcctggttcatcttgtagtct

SEQ ID NO: 367862 - DNA, 25 bp, Homo sapien
gagtggacgttgcacatcactgtga

SEQ ID NO: 367863 - DNA, 25 bp, Homo sapien
acatcactgtgaaaccttgcagagg

SEQ ID NO: 367864 - DNA, 25 bp, Homo sapien
tgggctccccagatggaggcagtca

SEQ ID NO: 367865 - DNA, 25 bp, Homo sapien
agccaggccctaagagccaaaccat

SEQ ID NO: 367866 - DNA, 25 bp, Homo sapien
caggccctaagagccaaaccatggg

SEQ ID NO: 367867 - DNA, 25 bp, Homo sapien
aagagccaaaccatgggctggtccc

SEQ ID NO: 367868 - DNA, 25 bp, Homo sapien
aaaccatgggctggtcccacttgga

SEQ ID NO: 367869 - DNA, 25 bp, Homo sapien
accatgggctggtcccacttggagc

SEQ ID NO: 367870 - DNA, 25 bp, Homo sapien
tgggctggtcccacttggagcctgt

SEQ ID NO: 367871 - DNA, 25 bp, Homo sapien
tggtcccacttggagcctgtggcca

SEQ ID NO: 367872 - DNA, 25 bp, Homo sapien
acttggagcctgtggccaggaccac

SEQ ID NO: 367873 - DNA, 25 bp, Homo sapien
gagcctgtggccaggaccacctcag

SEQ ID NO: 367874 - DNA, 25 bp, Homo sapien
ctgaattgtgggaagggtggtttct

SEQ ID NO: 367875 - DNA, 25 bp, Homo sapien
gaccagggcaggaaggttgtgctct

SEQ ID NO: 367876 - DNA, 25 bp, Homo sapien
ttgtgctctggcagtagggccacga

SEQ ID NO: 367877 - DNA, 25 bp, Homo sapien
gctctggcagtagggccacgacctg

SEQ ID NO: 367878 - DNA, 25 bp, Homo sapien
agtagggccacgacctgcctgcctg

SEQ ID NO: 367879 - DNA, 25 bp, Homo sapien
gagctcttgcccgaagcctgaagct

SEQ ID NO: 367880 - DNA, 25 bp, Homo sapien
agctcttgcccgaagcctgaagctt

SEQ ID NO: 367881 - DNA, 25 bp, Homo sapien
ttgcccgaagcctgaagcttccttc

SEQ ID NO: 367882 - DNA, 25 bp, Homo sapien
aagcctgaagcttccttcggcgcca

SEQ ID NO: 367883 - DNA, 25 bp, Homo sapien
tgaagcttccttcggcgccatgcag

SEQ ID NO: 367884 - DNA, 25 bp, Homo sapien
ggattacgctagtttttctttgtat

SEQ ID NO: 367885 - DNA, 25 bp, Homo sapien
gattacgctagtttttctttgtatt

SEQ ID NO: 367886 - DNA, 25 bp, Homo sapien
aacaaaaagttctgttcctgcctca

SEQ ID NO: 367887 - DNA, 25 bp, Homo sapien
tctttcccttcaatcttctagactt

SEQ ID NO: 367888 - DNA, 25 bp, Homo sapien
ttctagactttgagagttttgacct

SEQ ID NO: 367889 - DNA, 25 bp, Homo sapien
accatgggaatgcaatctgtttgca

SEQ ID NO: 367890 - DNA, 25 bp, Homo sapien
ccatgggaatgcaatctgtttgcag

SEQ ID NO: 367891 - DNA, 25 bp, Homo sapien
catgggaatgcaatctgtttgcagt

SEQ ID NO: 367892 - DNA, 25 bp, Homo sapien
atgggaatgcaatctgtttgcagtc

SEQ ID NO: 367893 - DNA, 25 bp, Homo sapien
tgggaatgcaatctgtttgcagtct

SEQ ID NO: 367894 - DNA, 25 bp, Homo sapien
gggaatgcaatctgtttgcagtctc

SEQ ID NO: 367895 - DNA, 25 bp, Homo sapien
ggaatgcaatctgtttgcagtctcc

SEQ ID NO: 367896 - DNA, 25 bp, Homo sapien
gaatgcaatctgtttgcagtctcct

SEQ ID NO: 367897 - DNA, 25 bp, Homo sapien
ggagtttaaatgtttgcaggattac

SEQ ID NO: 367898 - DNA, 25 bp, Homo sapien
gtttgcaggattactgtacttccaa

SEQ ID NO: 367899 - DNA, 25 bp, Homo sapien
tactgtacttccaaagacccactag

SEQ ID NO: 367900 - DNA, 25 bp, Homo sapien
aagacccactagaatgtcagctgta

SEQ ID NO: 367901 - DNA, 25 bp, Homo sapien
tgtcagctgtactctgtactctcca

SEQ ID NO: 367902 - DNA, 25 bp, Homo sapien
tgtactctgtactctccactgagaa

SEQ ID NO: 367903 - DNA, 25 bp, Homo sapien
gaacaaaatcctatgtcttaacagt

SEQ ID NO: 367904 - DNA, 25 bp, Homo sapien
aatcctatgtcttaacagttatgct

SEQ ID NO: 367905 - DNA, 25 bp, Homo sapien
aacagttatgctctaactttttgaa

SEQ ID NO: 367906 - DNA, 25 bp, Homo sapien
agatactggctttctgtaaaaacat

SEQ ID NO: 367907 - DNA, 25 bp, Homo sapien
acatcattgtgttagattgtttgta

SEQ ID NO: 367908 - DNA, 25 bp, Homo sapien
atgaagtttcacaacctcagcactg

SEQ ID NO: 367909 - DNA, 25 bp, Homo sapien
gaagtttcacaacctcagcactgtt

SEQ ID NO: 367910 - DNA, 25 bp, Homo sapien
agtttcacaacctcagcactgttgg

SEQ ID NO: 367911 - DNA, 25 bp, Homo sapien
ttcacaacctcagcactgttggtgt

SEQ ID NO: 367912 - DNA, 25 bp, Homo sapien
taattgtttgttgtgggagactgtc

SEQ ID NO: 367913 - DNA, 25 bp, Homo sapien
cattgtcaagtgtctcctggttagg

SEQ ID NO: 367914 - DNA, 25 bp, Homo sapien
gtcaagtgtctcctggttagggaaa

SEQ ID NO: 367915 - DNA, 25 bp, Homo sapien
ccccaggtaagaccactgctataga

SEQ ID NO: 367916 - DNA, 25 bp, Homo sapien
ggtaagaccactgctatagagaaat

SEQ ID NO: 367917 - DNA, 25 bp, Homo sapien
aagaccactgctatagagaaatact

SEQ ID NO: 367918 - DNA, 25 bp, Homo sapien
cactgctatagagaaatactacctt

SEQ ID NO: 367919 - DNA, 25 bp, Homo sapien
ttttagggcataagaatctatccat

SEQ ID NO: 367920 - DNA, 25 bp, Homo sapien
atctatccatagacgacagtatctg

SEQ ID NO: 367921 - DNA, 25 bp, Homo sapien
gacgacagtatctgactaatcttaa

SEQ ID NO: 367922 - DNA, 25 bp, Homo sapien
taagttcttgtttagtccctggcag

SEQ ID NO: 367923 - DNA, 25 bp, Homo sapien
ttcttgtttagtccctggcagagga

SEQ ID NO: 367924 - DNA, 25 bp, Homo sapien
gatatgatgcctttaatccgttcaa

SEQ ID NO: 367925 - DNA, 25 bp, Homo sapien
gcctttaatccgttcaagctcaatt

SEQ ID NO: 367926 - DNA, 25 bp, Homo sapien
taatccgttcaagctcaattagcca

SEQ ID NO: 367927 - DNA, 25 bp, Homo sapien
agctcaattagccatttacctttgc

SEQ ID NO: 367928 - DNA, 25 bp, Homo sapien
ttacctttgctaattaaatgacttg

SEQ ID NO: 367929 - DNA, 25 bp, Homo sapien
ccacctgttggatttctggtaatca

SEQ ID NO: 367930 - DNA, 25 bp, Homo sapien
ggttttttgtatgttactgacccat

SEQ ID NO: 367931 - DNA, 25 bp, Homo sapien
gtatgttactgacccatatggattt

SEQ ID NO: 367932 - DNA, 25 bp, Homo sapien
gacccatatggattttagtaacatc

SEQ ID NO: 367933 - DNA, 25 bp, Homo sapien
tttagtaacatcttgcttagtcatg

SEQ ID NO: 367934 - DNA, 25 bp, Homo sapien
cttgcttagtcatgttgttataaaa

SEQ ID NO: 367935 - DNA, 25 bp, Homo sapien
ttcaaattctgatatacattgcttg

SEQ ID NO: 367936 - DNA, 25 bp, Homo sapien
atgagtgagtacctcagagaaattt

SEQ ID NO: 367937 - DNA, 25 bp, Homo sapien
ttgatagactcaaacagatagtatg

SEQ ID NO: 367938 - DNA, 25 bp, Homo sapien
atgcgataggtaacatgtttgtaac

SEQ ID NO: 367939 - DNA, 25 bp, Homo sapien
gtttgtaaccatatagtatcctttt

SEQ ID NO: 367940 - DNA, 25 bp, Homo sapien
gtaaccatatagtatccttttagat

SEQ ID NO: 367941 - DNA, 25 bp, Homo sapien
tgtaaccaagcaactgagactcaac

SEQ ID NO: 367942 - DNA, 25 bp, Homo sapien
gagactcaaccaatcataggagcca

SEQ ID NO: 367943 - DNA, 25 bp, Homo sapien
ggagccaaacccttagtcaatccta

SEQ ID NO: 367944 - DNA, 25 bp, Homo sapien
gtcaatcctaggctgaatgctgcca

SEQ ID NO: 367945 - DNA, 25 bp, Homo sapien
aagtttggcccaaagcggcatccat

SEQ ID NO: 367946 - DNA, 25 bp, Homo sapien
aaggcaaatattgaactgcaccaat

SEQ ID NO: 367947 - DNA, 25 bp, Homo sapien
gaactgcaccaatcagggaaactct

SEQ ID NO: 367948 - DNA, 25 bp, Homo sapien
tataaatacatctcaccactctgga

SEQ ID NO: 367949 - DNA, 25 bp, Homo sapien
accactctggatgtggagtcactct

SEQ ID NO: 367950 - DNA, 25 bp, Homo sapien
tggagtcactctgaacgatctttgt

SEQ ID NO: 367951 - DNA, 25 bp, Homo sapien
aagcggcatccatacatagtgactg

SEQ ID NO: 367952 - DNA, 25 bp, Homo sapien
cagagtagttcaccgccctaaaaat

SEQ ID NO: 367953 - DNA, 25 bp, Homo sapien
tacagtatgtgacctcttaagattg

SEQ ID NO: 367954 - DNA, 25 bp, Homo sapien
gtatgtgacctcttaagattgtcct

SEQ ID NO: 367955 - DNA, 25 bp, Homo sapien
gtgacctcttaagattgtcctcttt

SEQ ID NO: 367956 - DNA, 25 bp, Homo sapien
gacctcttaagattgtcctctttaa

SEQ ID NO: 367957 - DNA, 25 bp, Homo sapien
agattgtcctctttaacttacttag

SEQ ID NO: 367958 - DNA, 25 bp, Homo sapien
gattgtcctctttaacttacttagt

SEQ ID NO: 367959 - DNA, 25 bp, Homo sapien
tagtaatatccatttaacgcgcccc

SEQ ID NO: 367960 - DNA, 25 bp, Homo sapien
ttcttttagtgctaagtaatattcg

SEQ ID NO: 367961 - DNA, 25 bp, Homo sapien
ttcgattgtctgaatatactactac

SEQ ID NO: 367962 - DNA, 25 bp, Homo sapien
gattgtctgaatatactactactga

SEQ ID NO: 367963 - DNA, 25 bp, Homo sapien
aaacaatgtgcagctttcaactggg

SEQ ID NO: 367964 - DNA, 25 bp, Homo sapien
tggaggctgctattctgtggacagt

SEQ ID NO: 367965 - DNA, 25 bp, Homo sapien
tctgtggacagtgagatgtttcctt

SEQ ID NO: 367966 - DNA, 25 bp, Homo sapien
ggcactgtcaatagacaatctgcgt

SEQ ID NO: 367967 - DNA, 25 bp, Homo sapien
caatctgcgtagagaaattccaagc

SEQ ID NO: 367968 - DNA, 25 bp, Homo sapien
gtagagaaattccaagctgaaagcc

SEQ ID NO: 367969 - DNA, 25 bp, Homo sapien
gatgaaaggaattaccagcatggaa

SEQ ID NO: 367970 - DNA, 25 bp, Homo sapien
aattaccagcatggaaattgtgtca

SEQ ID NO: 367971 - DNA, 25 bp, Homo sapien
aattgtgtcataggcttaagggcta

SEQ ID NO: 367972 - DNA, 25 bp, Homo sapien
tttctgttcaccctcaccaagagca

SEQ ID NO: 367973 - DNA, 25 bp, Homo sapien
gggcattttataacctgaacacaat

SEQ ID NO: 367974 - DNA, 25 bp, Homo sapien
gaccttccgttttctcatcataaat

SEQ ID NO: 367975 - DNA, 25 bp, Homo sapien
ttttctcatcataaatccccagacc

SEQ ID NO: 367976 - DNA, 25 bp, Homo sapien
ctttgagtctctgctggacacacac

SEQ ID NO: 367977 - DNA, 25 bp, Homo sapien
gacccctgccgttgagcctgtgctg

SEQ ID NO: 367978 - DNA, 25 bp, Homo sapien
agaaagctgaatacactccctggcc

SEQ ID NO: 367979 - DNA, 25 bp, Homo sapien
gcctgtgctgaacactcgcagtggt

SEQ ID NO: 367980 - DNA, 25 bp, Homo sapien
tgaacactcgcagtggtgaccgacg

SEQ ID NO: 367981 - DNA, 25 bp, Homo sapien
tccctggccagttccataggatgtt

SEQ ID NO: 367982 - DNA, 25 bp, Homo sapien
ataggatgttccgattccagctact

SEQ ID NO: 367983 - DNA, 25 bp, Homo sapien
gattccagctactcgcctccagtgt

SEQ ID NO: 367984 - DNA, 25 bp, Homo sapien
agacagcagcctccggcagggctca

SEQ ID NO: 367985 - DNA, 25 bp, Homo sapien
ggaagcttaacgaagttggcgccat

SEQ ID NO: 367986 - DNA, 25 bp, Homo sapien
agttggcgccatgaagctaaagact

SEQ ID NO: 367987 - DNA, 25 bp, Homo sapien
tgaagctaaagactgctaccccggg

SEQ ID NO: 367988 - DNA, 25 bp, Homo sapien
ggcgaagcccacgtttgtaggtccg

SEQ ID NO: 367989 - DNA, 25 bp, Homo sapien
tgatctcttgcccaatcagcgagtt

SEQ ID NO: 367990 - DNA, 25 bp, Homo sapien
caatcagcgagttcggcttcgcgag

SEQ ID NO: 367991 - DNA, 25 bp, Homo sapien
cttcgcgaggttggtgcccattggc

SEQ ID NO: 367992 - DNA, 25 bp, Homo sapien
gtgcccattggctttcgcataaaag

SEQ ID NO: 367993 - DNA, 25 bp, Homo sapien
tttcgcataaaagctccgaggttac

SEQ ID NO: 367994 - DNA, 25 bp, Homo sapien
tgaacggcaaaatggagcgcggaat

SEQ ID NO: 367995 - DNA, 25 bp, Homo sapien
atggagcgcggaatactgtctggct

SEQ ID NO: 367996 - DNA, 25 bp, Homo sapien
cagttttaactggattatatgcaaa

SEQ ID NO: 367997 - DNA, 25 bp, Homo sapien
atgcaaatacctacagattcacctg

SEQ ID NO: 367998 - DNA, 25 bp, Homo sapien
gattcacctgcacaagtagcagaca

SEQ ID NO: 367999 - DNA, 25 bp, Homo sapien
caagtagcagacactggaaagtcat

SEQ ID NO: 368000 - DNA, 25 bp, Homo sapien
ggtaggattagacaaagtggctatt

SEQ ID NO: 368001 - DNA, 25 bp, Homo sapien
ttttccctgggtggatattgcgtca

SEQ ID NO: 368002 - DNA, 25 bp, Homo sapien
gatattgcgtcagggtacagtgttc

SEQ ID NO: 368003 - DNA, 25 bp, Homo sapien
ttgcgtcagggtacagtgttctgtg

SEQ ID NO: 368004 - DNA, 25 bp, Homo sapien
gacttatttttaactaccagatctg

SEQ ID NO: 368005 - DNA, 25 bp, Homo sapien
ttaactaccagatctgattccttca

SEQ ID NO: 368006 - DNA, 25 bp, Homo sapien
atctgattccttcagtgcatatttt

SEQ ID NO: 368007 - DNA, 25 bp, Homo sapien
gggccatttcttatcagggtccccg

SEQ ID NO: 368008 - DNA, 25 bp, Homo sapien
gccatttcttatcagggtccccggc

SEQ ID NO: 368009 - DNA, 25 bp, Homo sapien
ggtggcagaaactccttccgaagcc

SEQ ID NO: 368010 - DNA, 25 bp, Homo sapien
gtggcagaaactccttccgaagccc

SEQ ID NO: 368011 - DNA, 25 bp, Homo sapien
ttggtttggtgcgtgaggttcttct

SEQ ID NO: 368012 - DNA, 25 bp, Homo sapien
tttggtgcgtgaggttcttcttgag

SEQ ID NO: 368013 - DNA, 25 bp, Homo sapien
gctcttgccctcaggtgggaccgag

SEQ ID NO: 368014 - DNA, 25 bp, Homo sapien
ttgccctcaggtgggaccgagccag

SEQ ID NO: 368015 - DNA, 25 bp, Homo sapien
cctcaggtgggaccgagccaggtga

SEQ ID NO: 368016 - DNA, 25 bp, Homo sapien
gggctgaagggccatttcttatcag

SEQ ID NO: 368017 - DNA, 25 bp, Homo sapien
gaagggccatttcttatcagggtcc

SEQ ID NO: 368018 - DNA, 25 bp, Homo sapien
actgggaatcccaacgcattttcgg

SEQ ID NO: 368019 - DNA, 25 bp, Homo sapien
gaatcccaacgcattttcggacaac

SEQ ID NO: 368020 - DNA, 25 bp, Homo sapien
gaaaaacaaactcgagcagtcccct

SEQ ID NO: 368021 - DNA, 25 bp, Homo sapien
gcagtcccctccaaagcagctgttg

SEQ ID NO: 368022 - DNA, 25 bp, Homo sapien
tgttttcaaacttcaccatccctga

SEQ ID NO: 368023 - DNA, 25 bp, Homo sapien
acttcaccatccctgacggatgaaa

SEQ ID NO: 368024 - DNA, 25 bp, Homo sapien
gacggatgaaagaccccgacctccg

SEQ ID NO: 368025 - DNA, 25 bp, Homo sapien
gggtttcgaggtgcccgagcctgcg

SEQ ID NO: 368026 - DNA, 25 bp, Homo sapien
aagctactcaaaagccttatataaa

SEQ ID NO: 368027 - DNA, 25 bp, Homo sapien
ataaatctaataagtgtttcacaac

SEQ ID NO: 368028 - DNA, 25 bp, Homo sapien
gtttcacaacacaggaactgggaat

SEQ ID NO: 368029 - DNA, 25 bp, Homo sapien
tctgccagaacttcagctcgtggag

SEQ ID NO: 368030 - DNA, 25 bp, Homo sapien
accggcatatacaccaaacatttgg

SEQ ID NO: 368031 - DNA, 25 bp, Homo sapien
agaagttcctaaatctgcctccaag

SEQ ID NO: 368032 - DNA, 25 bp, Homo sapien
atacttcaatgctaccagagggttt

SEQ ID NO: 368033 - DNA, 25 bp, Homo sapien
cagagggttttactgcttgcggttt

SEQ ID NO: 368034 - DNA, 25 bp, Homo sapien
tatctttaataagtgcctggcgggc

SEQ ID NO: 368035 - DNA, 25 bp, Homo sapien
ggcgcattcatccagaggtggaccc

SEQ ID NO: 368036 - DNA, 25 bp, Homo sapien
ggacccctctgtcattactaaattg

SEQ ID NO: 368037 - DNA, 25 bp, Homo sapien
taaattgcgcaaattctttcatcct

SEQ ID NO: 368038 - DNA, 25 bp, Homo sapien
gagcaatttcatgtcgtcgatggag

SEQ ID NO: 368039 - DNA, 25 bp, Homo sapien
gatggagatcgcctcatcacggaac

SEQ ID NO: 368040 - DNA, 25 bp, Homo sapien
gcttgcttgactttctgagtgtctc

SEQ ID NO: 368041 - DNA, 25 bp, Homo sapien
tgagtgtctctctggcacaagggcc

SEQ ID NO: 368042 - DNA, 25 bp, Homo sapien
aagggcctgtcatttgaattcccat

SEQ ID NO: 368043 - DNA, 25 bp, Homo sapien
aaatgatcccatttggccagagcct

SEQ ID NO: 368044 - DNA, 25 bp, Homo sapien
tggccagagccttttttatgagtat

SEQ ID NO: 368045 - DNA, 25 bp, Homo sapien
gcacacaaacttttccaggataccc

SEQ ID NO: 368046 - DNA, 25 bp, Homo sapien
atacccggctatctattaatccttc

SEQ ID NO: 368047 - DNA, 25 bp, Homo sapien
attaatccttcagcacggacgttct

SEQ ID NO: 368048 - DNA, 25 bp, Homo sapien
agcacggacgttctccatggtaaca

SEQ ID NO: 368049 - DNA, 25 bp, Homo sapien
ggtaacagtctgacctataagatct

SEQ ID NO: 368050 - DNA, 25 bp, Homo sapien
ataagatctaatgcctttcccaggg

SEQ ID NO: 368051 - DNA, 25 bp, Homo sapien
gagacagaaagtagtatgaccccaa

SEQ ID NO: 368052 - DNA, 25 bp, Homo sapien
gaaagtagtatgaccccaactgaga

SEQ ID NO: 368053 - DNA, 25 bp, Homo sapien
gtagtatgaccccaactgagaagtc

SEQ ID NO: 368054 - DNA, 25 bp, Homo sapien
atgaccccaactgagaagtctccta

SEQ ID NO: 368055 - DNA, 25 bp, Homo sapien
accccaactgagaagtctcctaggg

SEQ ID NO: 368056 - DNA, 25 bp, Homo sapien
aatcatcagttcttagtattacctc

SEQ ID NO: 368057 - DNA, 25 bp, Homo sapien
cagttcttagtattacctctttgga

SEQ ID NO: 368058 - DNA, 25 bp, Homo sapien
gttcttagtattacctctttggaat

SEQ ID NO: 368059 - DNA, 25 bp, Homo sapien
cttagtattacctctttggaatgta

SEQ ID NO: 368060 - DNA, 25 bp, Homo sapien
aagctgagagtatgtgatgcaatag

SEQ ID NO: 368061 - DNA, 25 bp, Homo sapien
gtatgtgatgcaatagagcttcatt

SEQ ID NO: 368062 - DNA, 25 bp, Homo sapien
atatttgtctattttatgcttaagt

SEQ ID NO: 368063 - DNA, 25 bp, Homo sapien
tttatgcttaagtgtatctacatta

SEQ ID NO: 368064 - DNA, 25 bp, Homo sapien
atgcaatgtggtgttagtattagac

SEQ ID NO: 368065 - DNA, 25 bp, Homo sapien
gtgttagtattagaccctggagtaa

SEQ ID NO: 368066 - DNA, 25 bp, Homo sapien
tagaccctggagtaaagtcataggt

SEQ ID NO: 368067 - DNA, 25 bp, Homo sapien
gaaagcaaatagtctgtagtttagt

SEQ ID NO: 368068 - DNA, 25 bp, Homo sapien
aagatgttaacattcgggcaaactg

SEQ ID NO: 368069 - DNA, 25 bp, Homo sapien
taacattcgggcaaactggataaag

SEQ ID NO: 368070 - DNA, 25 bp, Homo sapien
ttcgggcaaactggataaagattac

SEQ ID NO: 368071 - DNA, 25 bp, Homo sapien
gattacatggaatctcttttggcta

SEQ ID NO: 368072 - DNA, 25 bp, Homo sapien
acatggaatctcttttggctatttt

SEQ ID NO: 368073 - DNA, 25 bp, Homo sapien
agggccagcacaagctcctttgcag

SEQ ID NO: 368074 - DNA, 25 bp, Homo sapien
agcacaagctcctttgcagggagac

SEQ ID NO: 368075 - DNA, 25 bp, Homo sapien
tggcagctccacttggtgacttcct

SEQ ID NO: 368076 - DNA, 25 bp, Homo sapien
gtgacttcctttctgtgtatcagga

SEQ ID NO: 368077 - DNA, 25 bp, Homo sapien
gacaacttgtagaagacatgaccat

SEQ ID NO: 368078 - DNA, 25 bp, Homo sapien
gagacatcaacttcgcaacaaatat

SEQ ID NO: 368079 - DNA, 25 bp, Homo sapien
caaatgtatctgtgacaggctgaag

SEQ ID NO: 368080 - DNA, 25 bp, Homo sapien
gtgacaggctgaagaacgatgacta

SEQ ID NO: 368081 - DNA, 25 bp, Homo sapien
gaacgatgactaaacgaagggaatt

SEQ ID NO: 368082 - DNA, 25 bp, Homo sapien
gaagggaatttacacaagctagtct

SEQ ID NO: 368083 - DNA, 25 bp, Homo sapien
aatttacacaagctagtctggtggt

SEQ ID NO: 368084 - DNA, 25 bp, Homo sapien
ggtggccctggtcgctggaaggaaa

SEQ ID NO: 368085 - DNA, 25 bp, Homo sapien
gaaggaaaggtgaccacagacccag

SEQ ID NO: 368086 - DNA, 25 bp, Homo sapien
aaaggtgaccacagacccagcgcct

SEQ ID NO: 368087 - DNA, 25 bp, Homo sapien
gcccagtgccttcactgtggtcatg

SEQ ID NO: 368088 - DNA, 25 bp, Homo sapien
tgtccccagggaaatcctgagaaat

SEQ ID NO: 368089 - DNA, 25 bp, Homo sapien
gggctgcatttagtgtccatgtcct

SEQ ID NO: 368090 - DNA, 25 bp, Homo sapien
gcatttagtgtccatgtccttagat

SEQ ID NO: 368091 - DNA, 25 bp, Homo sapien
ttagtgtccatgtccttagattcag

SEQ ID NO: 368092 - DNA, 25 bp, Homo sapien
gtgtccatgtccttagattcagatg

SEQ ID NO: 368093 - DNA, 25 bp, Homo sapien
gtccttagattcagatggcaacatg

SEQ ID NO: 368094 - DNA, 25 bp, Homo sapien
tcagatggcaacatggtccagtaac

SEQ ID NO: 368095 - DNA, 25 bp, Homo sapien
cagcttctcgtctctgggatccgac

SEQ ID NO: 368096 - DNA, 25 bp, Homo sapien
tcgtctctgggatccgacctggaga

SEQ ID NO: 368097 - DNA, 25 bp, Homo sapien
ctctgggatccgacctggagacgat

SEQ ID NO: 368098 - DNA, 25 bp, Homo sapien
tgggatccgacctggagacgatcac

SEQ ID NO: 368099 - DNA, 25 bp, Homo sapien
gatccgacctggagacgatcaccgg

SEQ ID NO: 368100 - DNA, 25 bp, Homo sapien
gacctggagacgatcaccggctccg

SEQ ID NO: 368101 - DNA, 25 bp, Homo sapien
gggcggcctcgatgctcccggcggg

SEQ ID NO: 368102 - DNA, 25 bp, Homo sapien
gggtgcctcggcctctgggtcgggc

SEQ ID NO: 368103 - DNA, 25 bp, Homo sapien
caggtatagggccagcttctcgtct

SEQ ID NO: 368104 - DNA, 25 bp, Homo sapien
gtatagggccagcttctcgtctctg

SEQ ID NO: 368105 - DNA, 25 bp, Homo sapien
agggccagcttctcgtctctgggat

SEQ ID NO: 368106 - DNA, 25 bp, Homo sapien
gaacgccgggacagaccgacagacg

SEQ ID NO: 368107 - DNA, 25 bp, Homo sapien
acgccgggacagaccgacagacgga

SEQ ID NO: 368108 - DNA, 25 bp, Homo sapien
ccgggacagaccgacagacggactg

SEQ ID NO: 368109 - DNA, 25 bp, Homo sapien
ggacagaccgacagacggactggcc

SEQ ID NO: 368110 - DNA, 25 bp, Homo sapien
acagaccgacagacggactggccgg

SEQ ID NO: 368111 - DNA, 25 bp, Homo sapien
actccgtgggcctgatctccctggg

SEQ ID NO: 368112 - DNA, 25 bp, Homo sapien
gggcacctgggatgtccatctgcgt

SEQ ID NO: 368113 - DNA, 25 bp, Homo sapien
gcacctgggatgtccatctgcgtta

SEQ ID NO: 368114 - DNA, 25 bp, Homo sapien
cacctgggatgtccatctgcgttag

SEQ ID NO: 368115 - DNA, 25 bp, Homo sapien
acctgggatgtccatctgcgttagc

SEQ ID NO: 368116 - DNA, 25 bp, Homo sapien
ctgggatgtccatctgcgttagctg

SEQ ID NO: 368117 - DNA, 25 bp, Homo sapien
taaaaatggccaggttaggtattgt

SEQ ID NO: 368118 - DNA, 25 bp, Homo sapien
gaaactgaggccgagagaatgtcat

SEQ ID NO: 368119 - DNA, 25 bp, Homo sapien
tgaggccgagagaatgtcatacagt

SEQ ID NO: 368120 - DNA, 25 bp, Homo sapien
cagttaataagctgtttgctggtat

SEQ ID NO: 368121 - DNA, 25 bp, Homo sapien
aagctgtttgctggtataattcaaa

SEQ ID NO: 368122 - DNA, 25 bp, Homo sapien
aaagaaccatgatatgtggctgaac

SEQ ID NO: 368123 - DNA, 25 bp, Homo sapien
atgtggctgaactgacattcattca

SEQ ID NO: 368124 - DNA, 25 bp, Homo sapien
gaccagctacctattgtaacagttg

SEQ ID NO: 368125 - DNA, 25 bp, Homo sapien
taacagttgtatatatgtgtggtac

SEQ ID NO: 368126 - DNA, 25 bp, Homo sapien
tgtgtggtacagtgcattatctcag

SEQ ID NO: 368127 - DNA, 25 bp, Homo sapien
ggtacagtgcattatctcagatatt

SEQ ID NO: 368128 - DNA, 25 bp, Homo sapien
gcctaggcaggcagactgagctcag

SEQ ID NO: 368129 - DNA, 25 bp, Homo sapien
cctaggcaggcagactgagctcagg

SEQ ID NO: 368130 - DNA, 25 bp, Homo sapien
cagactgagctcaggagcttgagac

SEQ ID NO: 368131 - DNA, 25 bp, Homo sapien
attagtcgggcgtgatggcaggcat

SEQ ID NO: 368132 - DNA, 25 bp, Homo sapien
ttagtcgggcgtgatggcaggcatc

SEQ ID NO: 368133 - DNA, 25 bp, Homo sapien
tagtcgggcgtgatggcaggcatct

SEQ ID NO: 368134 - DNA, 25 bp, Homo sapien
tcacctgagctctggaggtggaggc

SEQ ID NO: 368135 - DNA, 25 bp, Homo sapien
acctgagctctggaggtggaggctg

SEQ ID NO: 368136 - DNA, 25 bp, Homo sapien
cctgagctctggaggtggaggctgc

SEQ ID NO: 368137 - DNA, 25 bp, Homo sapien
gagctctggaggtggaggctgccat

SEQ ID NO: 368138 - DNA, 25 bp, Homo sapien
agctctggaggtggaggctgccatg

SEQ ID NO: 368139 - DNA, 25 bp, Homo sapien
tgtgacaggctgaagaacgatgact

SEQ ID NO: 368140 - DNA, 25 bp, Homo sapien
tgacaggctgaagaacgatgactaa

SEQ ID NO: 368141 - DNA, 25 bp, Homo sapien
acaggctgaagaacgatgactaaac

SEQ ID NO: 368142 - DNA, 25 bp, Homo sapien
ggctgaagaacgatgactaaacgaa

SEQ ID NO: 368143 - DNA, 25 bp, Homo sapien
gaacgatgactaaacgaagggaatt

SEQ ID NO: 368144 - DNA, 25 bp, Homo sapien
aacgaagggaatttacacaagctag

SEQ ID NO: 368145 - DNA, 25 bp, Homo sapien
gaagggaatttacacaagctagtct

SEQ ID NO: 368146 - DNA, 25 bp, Homo sapien
aagggaatttacacaagctagtctg

SEQ ID NO: 368147 - DNA, 25 bp, Homo sapien
gggaatttacacaagctagtctggt

SEQ ID NO: 368148 - DNA, 25 bp, Homo sapien
gaatttacacaagctagtctggtgg

SEQ ID NO: 368149 - DNA, 25 bp, Homo sapien
aatttacacaagctagtctggtggt

SEQ ID NO: 368150 - DNA, 25 bp, Homo sapien
ggtggtctttgttttctagatgaga

SEQ ID NO: 368151 - DNA, 25 bp, Homo sapien
taaagcacatactctactgtacaaa

SEQ ID NO: 368152 - DNA, 25 bp, Homo sapien
ttttgccttcatggtgatgaaaact

SEQ ID NO: 368153 - DNA, 25 bp, Homo sapien
ggtgataccatctttaaagggatgc

SEQ ID NO: 368154 - DNA, 25 bp, Homo sapien
tgcagctaaaaagtagggactacct

SEQ ID NO: 368155 - DNA, 25 bp, Homo sapien
gggactacctgcatttcttatctaa

SEQ ID NO: 368156 - DNA, 25 bp, Homo sapien
gtatagacaactgccaaatccacca

SEQ ID NO: 368157 - DNA, 25 bp, Homo sapien
gataaccacagttggcatttagtga

SEQ ID NO: 368158 - DNA, 25 bp, Homo sapien
aatccaccaacaaacagtatgagct

SEQ ID NO: 368159 - DNA, 25 bp, Homo sapien
tattacactacaaagccaggactgg

SEQ ID NO: 368160 - DNA, 25 bp, Homo sapien
caggactggctatttttggtggtct

SEQ ID NO: 368161 - DNA, 25 bp, Homo sapien
gaaggcatttttcctaacactgata

SEQ ID NO: 368162 - DNA, 25 bp, Homo sapien
gtcaccaatactcttgatgccttaa

SEQ ID NO: 368163 - DNA, 25 bp, Homo sapien
gatgccttaagatgctagaaagcct

SEQ ID NO: 368164 - DNA, 25 bp, Homo sapien
ttggccctagcccttagctacaggg

SEQ ID NO: 368165 - DNA, 25 bp, Homo sapien
ttagctacagggaggcctagagaga

SEQ ID NO: 368166 - DNA, 25 bp, Homo sapien
cctagagagaggacacttggcaagt

SEQ ID NO: 368167 - DNA, 25 bp, Homo sapien
tgggaaacaaggttaagcctggctt

SEQ ID NO: 368168 - DNA, 25 bp, Homo sapien
taagcctggctttgctattcagacc

SEQ ID NO: 368169 - DNA, 25 bp, Homo sapien
tattcagacctgtgcagccctgatt

SEQ ID NO: 368170 - DNA, 25 bp, Homo sapien
tgggcccaaggagccatgagtctta

SEQ ID NO: 368171 - DNA, 25 bp, Homo sapien
gccatgagtcttaggcttgacacta

SEQ ID NO: 368172 - DNA, 25 bp, Homo sapien
atgaaatggcttaatggtgctgtta

SEQ ID NO: 368173 - DNA, 25 bp, Homo sapien
ggtgctgttaagtatttgtacctaa

SEQ ID NO: 368174 - DNA, 25 bp, Homo sapien
acctaacagtcttgtgtgacagatg

SEQ ID NO: 368175 - DNA, 25 bp, Homo sapien
cataatgaaacacacctgtctaggg

SEQ ID NO: 368176 - DNA, 25 bp, Homo sapien
gggcggcaatcaacagtcttacaca

SEQ ID NO: 368177 - DNA, 25 bp, Homo sapien
gtcttacacagagagggtattccct

SEQ ID NO: 368178 - DNA, 25 bp, Homo sapien
agggtattccctgcaagtttctggc

SEQ ID NO: 368179 - DNA, 25 bp, Homo sapien
aagtttctggcttgcctgtgatggg

SEQ ID NO: 368180 - DNA, 25 bp, Homo sapien
gaggcttttagagaggtgttataca

SEQ ID NO: 368181 - DNA, 25 bp, Homo sapien
acagggcgatttttggtgccttact

SEQ ID NO: 368182 - DNA, 25 bp, Homo sapien
tggtgccttacttttatcttaattt

SEQ ID NO: 368183 - DNA, 25 bp, Homo sapien
gaagccgtctcgttcaaccgatggg

SEQ ID NO: 368184 - DNA, 25 bp, Homo sapien
ttgtgaattttgtgttcagagcgtc

SEQ ID NO: 368185 - DNA, 25 bp, Homo sapien
gaattttgtgttcagagcgtcagag

SEQ ID NO: 368186 - DNA, 25 bp, Homo sapien
tcagagcgtcagaggacttgcaggt

SEQ ID NO: 368187 - DNA, 25 bp, Homo sapien
gggagacgttgttcactgaggattt

SEQ ID NO: 368188 - DNA, 25 bp, Homo sapien
gacgttgttcactgaggatttagca

SEQ ID NO: 368189 - DNA, 25 bp, Homo sapien
tgttcactgaggatttagcaaggga

SEQ ID NO: 368190 - DNA, 25 bp, Homo sapien
gatttagcaagggagagcgtaactt

SEQ ID NO: 368191 - DNA, 25 bp, Homo sapien
gagcgtaacttgagtgtttgaagcc

SEQ ID NO: 368192 - DNA, 25 bp, Homo sapien
gtgtttgaagccgtctcgttcaacc

SEQ ID NO: 368193 - DNA, 25 bp, Homo sapien
tttgaagccgtctcgttcaaccgat

SEQ ID NO: 368194 - DNA, 25 bp, Homo sapien
ttcccactcagtctattcacattag

SEQ ID NO: 368195 - DNA, 25 bp, Homo sapien
tattcacattagatcaagccctttg

SEQ ID NO: 368196 - DNA, 25 bp, Homo sapien
gactgtaggtcatgagactgtcatt

SEQ ID NO: 368197 - DNA, 25 bp, Homo sapien
agaggactgttcatacgttattaaa

SEQ ID NO: 368198 - DNA, 25 bp, Homo sapien
ccatcgttgggtcttcgttctaaag

SEQ ID NO: 368199 - DNA, 25 bp, Homo sapien
aaaggttcttatatgtacacatcac

SEQ ID NO: 368200 - DNA, 25 bp, Homo sapien
ttgcataccgtttctcctattaatc

SEQ ID NO: 368201 - DNA, 25 bp, Homo sapien
tctcctattaatccatctgtctcat

SEQ ID NO: 368202 - DNA, 25 bp, Homo sapien
agactgtcattccagagagggccct

SEQ ID NO: 368203 - DNA, 25 bp, Homo sapien
tgccccacgtccagagaagaaaatg

SEQ ID NO: 368204 - DNA, 25 bp, Homo sapien
aagacaaatctagacagaccttgct

SEQ ID NO: 368205 - DNA, 25 bp, Homo sapien
gggaaatcatctttcgggaatttat

SEQ ID NO: 368206 - DNA, 25 bp, Homo sapien
atcatctttcgggaatttatctaag

SEQ ID NO: 368207 - DNA, 25 bp, Homo sapien
atctttcgggaatttatctaagaag

SEQ ID NO: 368208 - DNA, 25 bp, Homo sapien
gtaatttcccttaagatactacaga

SEQ ID NO: 368209 - DNA, 25 bp, Homo sapien
atttcccttaagatactacagaatt

SEQ ID NO: 368210 - DNA, 25 bp, Homo sapien
gatactacagaatttccaaggactt

SEQ ID NO: 368211 - DNA, 25 bp, Homo sapien
ctacagaatttccaaggacttgagg

SEQ ID NO: 368212 - DNA, 25 bp, Homo sapien
ggacttgaggaataattgcactctt

SEQ ID NO: 368213 - DNA, 25 bp, Homo sapien
aggaataattgcactcttgaaagag

SEQ ID NO: 368214 - DNA, 25 bp, Homo sapien
aattgcactcttgaaagagcctatg

SEQ ID NO: 368215 - DNA, 25 bp, Homo sapien
tgcactcttgaaagagcctatgaaa

SEQ ID NO: 368216 - DNA, 25 bp, Homo sapien
tccatccagggtctgggacacccaa

SEQ ID NO: 368217 - DNA, 25 bp, Homo sapien
ctgggacacccaaaccttaggcttg

SEQ ID NO: 368218 - DNA, 25 bp, Homo sapien
gagctatgtgggatgcagttgcctt

SEQ ID NO: 368219 - DNA, 25 bp, Homo sapien
gatgcagttgcctttttacctgtga

SEQ ID NO: 368220 - DNA, 25 bp, Homo sapien
agttgcctttttacctgtgatgaga

SEQ ID NO: 368221 - DNA, 25 bp, Homo sapien
gcctttttacctgtgatgagaaact

SEQ ID NO: 368222 - DNA, 25 bp, Homo sapien
gaaactggtgaattgccaggattct

SEQ ID NO: 368223 - DNA, 25 bp, Homo sapien
gtgaattgccaggattctggctctg

SEQ ID NO: 368224 - DNA, 25 bp, Homo sapien
ggattctggctctggcttcagtctg

SEQ ID NO: 368225 - DNA, 25 bp, Homo sapien
caggctaggtagtttgtggaattct

SEQ ID NO: 368226 - DNA, 25 bp, Homo sapien
gtggaattctcctttgcaggtgagg

SEQ ID NO: 368227 - DNA, 25 bp, Homo sapien
tatcattcatacgacatttctggtt

SEQ ID NO: 368228 - DNA, 25 bp, Homo sapien
acgacatttctggtttaggtgtatg

SEQ ID NO: 368229 - DNA, 25 bp, Homo sapien
gtttaggtgtatgtagttgggccat

SEQ ID NO: 368230 - DNA, 25 bp, Homo sapien
agttgggccatgttacttgtccaga

SEQ ID NO: 368231 - DNA, 25 bp, Homo sapien
atgttacttgtccagaggaagagac

SEQ ID NO: 368232 - DNA, 25 bp, Homo sapien
ttttagtcctaaatgctgttttgtt

SEQ ID NO: 368233 - DNA, 25 bp, Homo sapien
tctgtcaagatatttacccgtgtca

SEQ ID NO: 368234 - DNA, 25 bp, Homo sapien
tacccgtgtcaaattcaaactacag

SEQ ID NO: 368235 - DNA, 25 bp, Homo sapien
gaagttagactagatatacgttttt

SEQ ID NO: 368236 - DNA, 25 bp, Homo sapien
ggctggacagtgttctattaactca

SEQ ID NO: 368237 - DNA, 25 bp, Homo sapien
attaactcattgaatgtgtttcctt

SEQ ID NO: 368238 - DNA, 25 bp, Homo sapien
ttgtgtacaaactgttaacctgaac

SEQ ID NO: 368239 - DNA, 25 bp, Homo sapien
tttctcctggaagcccgaggacttt

SEQ ID NO: 368240 - DNA, 25 bp, Homo sapien
taacctgaacagttttccggtgcaa

SEQ ID NO: 368241 - DNA, 25 bp, Homo sapien
cagttttccggtgcaaaaggtctca

SEQ ID NO: 368242 - DNA, 25 bp, Homo sapien
tccggtgcaaaaggtctcaccagaa

SEQ ID NO: 368243 - DNA, 25 bp, Homo sapien
ctttaggaaagatgagtgtgactgc

SEQ ID NO: 368244 - DNA, 25 bp, Homo sapien
gaagaaactaagctgagaaaacccg

SEQ ID NO: 368245 - DNA, 25 bp, Homo sapien
cggaaaaatactcggcgcagctgct

SEQ ID NO: 368246 - DNA, 25 bp, Homo sapien
agctgctgcggccttgggtcatctc

SEQ ID NO: 368247 - DNA, 25 bp, Homo sapien
tataaaatgctctattatctctagt

SEQ ID NO: 368248 - DNA, 25 bp, Homo sapien
tattatctctagtttgcttttttgt

SEQ ID NO: 368249 - DNA, 25 bp, Homo sapien
ggaccttacaagtagcaggccactc

SEQ ID NO: 368250 - DNA, 25 bp, Homo sapien
gtagcaggccactcttaaaaatgca

SEQ ID NO: 368251 - DNA, 25 bp, Homo sapien
accacagatgtcaccatgactgaaa

SEQ ID NO: 368252 - DNA, 25 bp, Homo sapien
ataattcatcagtgggttctcagac

SEQ ID NO: 368253 - DNA, 25 bp, Homo sapien
gactgaaaaatagaggctggccctg

SEQ ID NO: 368254 - DNA, 25 bp, Homo sapien
ctggccctgcctctgaagatgctgc

SEQ ID NO: 368255 - DNA, 25 bp, Homo sapien
aagatgctgcaatggacttgtgttc

SEQ ID NO: 368256 - DNA, 25 bp, Homo sapien
ttggctgtaacttcccttattgaga

SEQ ID NO: 368257 - DNA, 25 bp, Homo sapien
taatcgggctcatcgttaagctgtg

SEQ ID NO: 368258 - DNA, 25 bp, Homo sapien
gactgtttcagaagtaatgcctcaa

SEQ ID NO: 368259 - DNA, 25 bp, Homo sapien
gcctcaaggaccagcttgcagaaag

SEQ ID NO: 368260 - DNA, 25 bp, Homo sapien
aatgctttagcatactagaatcaga

SEQ ID NO: 368261 - DNA, 25 bp, Homo sapien
aagtatgtcaacagccatttaggca

SEQ ID NO: 368262 - DNA, 25 bp, Homo sapien
gccatttaggcaaataagcactcct

SEQ ID NO: 368263 - DNA, 25 bp, Homo sapien
ataagcactcctttaaagccgctgc

SEQ ID NO: 368264 - DNA, 25 bp, Homo sapien
cgctgccttctggttacaatttaca

SEQ ID NO: 368265 - DNA, 25 bp, Homo sapien
ggttacaatttacagtgtactttgt

SEQ ID NO: 368266 - DNA, 25 bp, Homo sapien
aaaacactgctgaggcttcataatc

SEQ ID NO: 368267 - DNA, 25 bp, Homo sapien
gaggcttcataatcatggctcttag

SEQ ID NO: 368268 - DNA, 25 bp, Homo sapien
atcatggctcttagaaactcaggaa

SEQ ID NO: 368269 - DNA, 25 bp, Homo sapien
aaccatgcctactaaatgtacagat

SEQ ID NO: 368270 - DNA, 25 bp, Homo sapien
gatatgcaaattccatagctcaata

SEQ ID NO: 368271 - DNA, 25 bp, Homo sapien
aaaggaacattgctcgatgctccca

SEQ ID NO: 368272 - DNA, 25 bp, Homo sapien
attgctcgatgctcccatctggtgg

SEQ ID NO: 368273 - DNA, 25 bp, Homo sapien
gatgctcccatctggtggcggcctc

SEQ ID NO: 368274 - DNA, 25 bp, Homo sapien
tggcggcctcaggaacccacgggaa

SEQ ID NO: 368275 - DNA, 25 bp, Homo sapien
cacgggaacctggaaggaggctctt

SEQ ID NO: 368276 - DNA, 25 bp, Homo sapien
gaggctctttgtgagacctgggcaa

SEQ ID NO: 368277 - DNA, 25 bp, Homo sapien
gggcagctcgtcgatgatttttttg

SEQ ID NO: 368278 - DNA, 25 bp, Homo sapien
ttttttgtgtttccaggcttcctgt

SEQ ID NO: 368279 - DNA, 25 bp, Homo sapien
gtttccaggcttcctgtgtgatcct

SEQ ID NO: 368280 - DNA, 25 bp, Homo sapien
tagagagaggattgggaaaccccac

SEQ ID NO: 368281 - DNA, 25 bp, Homo sapien
agaaggtccttgtggggcgtcctca

SEQ ID NO: 368282 - DNA, 25 bp, Homo sapien
gagtaactctagatttgagctgttc

SEQ ID NO: 368283 - DNA, 25 bp, Homo sapien
gtaactctagatttgagctgttcag

SEQ ID NO: 368284 - DNA, 25 bp, Homo sapien
actctagatttgagctgttcagtag

SEQ ID NO: 368285 - DNA, 25 bp, Homo sapien
tctagatttgagctgttcagtagcc

SEQ ID NO: 368286 - DNA, 25 bp, Homo sapien
tagatttgagctgttcagtagccat

SEQ ID NO: 368287 - DNA, 25 bp, Homo sapien
gatttgagctgttcagtagccatta

SEQ ID NO: 368288 - DNA, 25 bp, Homo sapien
ccttgcctggcctgcaaaatttgtt

SEQ ID NO: 368289 - DNA, 25 bp, Homo sapien
cttgcctggcctgcaaaatttgttt

SEQ ID NO: 368290 - DNA, 25 bp, Homo sapien
gattctatatgggaaatgttagcag

SEQ ID NO: 368291 - DNA, 25 bp, Homo sapien
aaatatcttatcaacagaaaaccag

SEQ ID NO: 368292 - DNA, 25 bp, Homo sapien
agaaaaccagttctatcaactatgg

SEQ ID NO: 368293 - DNA, 25 bp, Homo sapien
acctacctcactgggctgttgaaag

SEQ ID NO: 368294 - DNA, 25 bp, Homo sapien
gagcttcatgagatgaggcgtgcct

SEQ ID NO: 368295 - DNA, 25 bp, Homo sapien
ggcgtgcctggcaatttcatcagtg

SEQ ID NO: 368296 - DNA, 25 bp, Homo sapien
atcagtgcaattcagccctcagcag

SEQ ID NO: 368297 - DNA, 25 bp, Homo sapien
agccctcagcagtatatgtttgttg

SEQ ID NO: 368298 - DNA, 25 bp, Homo sapien
acataaaatgctgggctcaacgcct

SEQ ID NO: 368299 - DNA, 25 bp, Homo sapien
aacgcctgacccacagtcatagtta

SEQ ID NO: 368300 - DNA, 25 bp, Homo sapien
acagtcatagttagtgctcataaat

SEQ ID NO: 368301 - DNA, 25 bp, Homo sapien
tcataaatgtgaattccctcctgcc

SEQ ID NO: 368302 - DNA, 25 bp, Homo sapien
ggtctccctgcacctaaggaatgat

SEQ ID NO: 368303 - DNA, 25 bp, Homo sapien
aaggaatgataatctcaccagcctg

SEQ ID NO: 368304 - DNA, 25 bp, Homo sapien
tttttatggatctgcaccagactgt

SEQ ID NO: 368305 - DNA, 25 bp, Homo sapien
atctgcaccagactgttaccttctg

SEQ ID NO: 368306 - DNA, 25 bp, Homo sapien
ggagatggagatttgactgtttaaa

SEQ ID NO: 368307 - DNA, 25 bp, Homo sapien
aaacagcgaggagtctttctagaac

SEQ ID NO: 368308 - DNA, 25 bp, Homo sapien
gagtctttctagaacttttgaacac

SEQ ID NO: 368309 - DNA, 25 bp, Homo sapien
ttagcaaaccgaagtttcttcaatg

SEQ ID NO: 368310 - DNA, 25 bp, Homo sapien
gaagtttcttcaatgacccctcgag

SEQ ID NO: 368311 - DNA, 25 bp, Homo sapien
ttcaatgacccctcgagaactttgg

SEQ ID NO: 368312 - DNA, 25 bp, Homo sapien
gagaactttgggaccagtttcctat

SEQ ID NO: 368313 - DNA, 25 bp, Homo sapien
gaagctcttctgtcgttatattctt

SEQ ID NO: 368314 - DNA, 25 bp, Homo sapien
tctgtcgttatattcttctttcctt

SEQ ID NO: 368315 - DNA, 25 bp, Homo sapien
cctgaccaacgtggagaaacactat

SEQ ID NO: 368316 - DNA, 25 bp, Homo sapien
accaacgtggagaaacactatctct

SEQ ID NO: 368317 - DNA, 25 bp, Homo sapien
ccaacgtggagaaacactatctcta

SEQ ID NO: 368318 - DNA, 25 bp, Homo sapien
caacgtggagaaacactatctctac

SEQ ID NO: 368319 - DNA, 25 bp, Homo sapien
cgtggagaaacactatctctactaa

SEQ ID NO: 368320 - DNA, 25 bp, Homo sapien
gtgagcagagattgcgccattgtac

SEQ ID NO: 368321 - DNA, 25 bp, Homo sapien
tgagcagagattgcgccattgtact

SEQ ID NO: 368322 - DNA, 25 bp, Homo sapien
gagcagagattgcgccattgtactc

SEQ ID NO: 368323 - DNA, 25 bp, Homo sapien
agcagagattgcgccattgtactcc

SEQ ID NO: 368324 - DNA, 25 bp, Homo sapien
gcagagattgcgccattgtactcca

SEQ ID NO: 368325 - DNA, 25 bp, Homo sapien
ttaatctctgccaccaactagggtg

SEQ ID NO: 368326 - DNA, 25 bp, Homo sapien
gtgacacctgtacctgccacattca

SEQ ID NO: 368327 - DNA, 25 bp, Homo sapien
acattcacctttgcactgagcttag

SEQ ID NO: 368328 - DNA, 25 bp, Homo sapien
actgagcttagtcttgtgaccacat

SEQ ID NO: 368329 - DNA, 25 bp, Homo sapien
gtgaccacatctcaccagacgggaa

SEQ ID NO: 368330 - DNA, 25 bp, Homo sapien
gtgtaagctacagagacttgtttct

SEQ ID NO: 368331 - DNA, 25 bp, Homo sapien
aggtgtagtctcttcgggcctgtgt

SEQ ID NO: 368332 - DNA, 25 bp, Homo sapien
gtgtgccagctcgatgcagtgtcat

SEQ ID NO: 368333 - DNA, 25 bp, Homo sapien
gacttgtttctttcttgcacaggta

SEQ ID NO: 368334 - DNA, 25 bp, Homo sapien
ttcttgcacaggtaacccagaggca

SEQ ID NO: 368335 - DNA, 25 bp, Homo sapien
ggcatgttttttgtttcacgaggaa

SEQ ID NO: 368336 - DNA, 25 bp, Homo sapien
aacagaccttccagatagacggctc

SEQ ID NO: 368337 - DNA, 25 bp, Homo sapien
agatagacggctcaatcctgacttg

SEQ ID NO: 368338 - DNA, 25 bp, Homo sapien
tcaatcctgacttgagcactgccgg

SEQ ID NO: 368339 - DNA, 25 bp, Homo sapien
accacctgcttgtgcgggcctggtg

SEQ ID NO: 368340 - DNA, 25 bp, Homo sapien
agaactagcttctaacctcggcttg

SEQ ID NO: 368341 - DNA, 25 bp, Homo sapien
taacctcggcttggccaccaggaag

SEQ ID NO: 368342 - DNA, 25 bp, Homo sapien
ttggccaccaggaagctgcgtgacc

SEQ ID NO: 368343 - DNA, 25 bp, Homo sapien
tctcgagcctggtctgcacgctggg

SEQ ID NO: 368344 - DNA, 25 bp, Homo sapien
tgcacgctgggcattgccgagaaga

SEQ ID NO: 368345 - DNA, 25 bp, Homo sapien
aagactaacgaagtcaggtgcgtaa

SEQ ID NO: 368346 - DNA, 25 bp, Homo sapien
aggtgcgtaaaatcaccgggctcag

SEQ ID NO: 368347 - DNA, 25 bp, Homo sapien
tgcttctctgagtcactgccaaaga

SEQ ID NO: 368348 - DNA, 25 bp, Homo sapien
tcactgccaaagattgtaggacatc

SEQ ID NO: 368349 - DNA, 25 bp, Homo sapien
gggtgattactgaaattagctctaa

SEQ ID NO: 368350 - DNA, 25 bp, Homo sapien
ttagctctaacttcacatggctctg

SEQ ID NO: 368351 - DNA, 25 bp, Homo sapien
acatggctctgcaagaattgggtga

SEQ ID NO: 368352 - DNA, 25 bp, Homo sapien
gaagcgtgaaccctggagatagtca

SEQ ID NO: 368353 - DNA, 25 bp, Homo sapien
gagatagtcatctctttctcaagag

SEQ ID NO: 368354 - DNA, 25 bp, Homo sapien
ctttctcaagagtcagctacatgca

SEQ ID NO: 368355 - DNA, 25 bp, Homo sapien
caagagtcagctacatgcacactgg

SEQ ID NO: 368356 - DNA, 25 bp, Homo sapien
tgggcagtcagtggtgctagtatat

SEQ ID NO: 368357 - DNA, 25 bp, Homo sapien
gtgctagtatataagctttctgctt

SEQ ID NO: 368358 - DNA, 25 bp, Homo sapien
acactgggcgacagttccaatcctg

SEQ ID NO: 368359 - DNA, 25 bp, Homo sapien
cactgggcgacagttccaatcctgg

SEQ ID NO: 368360 - DNA, 25 bp, Homo sapien
aggagtttagccagaagatggacca

SEQ ID NO: 368361 - DNA, 25 bp, Homo sapien
gaagatggaccagatcatcgaaggt

SEQ ID NO: 368362 - DNA, 25 bp, Homo sapien
gatggaccagatcatcgaaggtaac

SEQ ID NO: 368363 - DNA, 25 bp, Homo sapien
tggaccagatcatcgaaggtaacat

SEQ ID NO: 368364 - DNA, 25 bp, Homo sapien
gaccagatcatcgaaggtaacatga

SEQ ID NO: 368365 - DNA, 25 bp, Homo sapien
ccagatcatcgaaggtaacatgaag

SEQ ID NO: 368366 - DNA, 25 bp, Homo sapien
cagcaggaaacagttacttgcagaa

SEQ ID NO: 368367 - DNA, 25 bp, Homo sapien
caggaaacagttacttgcagaatgt

SEQ ID NO: 368368 - DNA, 25 bp, Homo sapien
aggaaacagttacttgcagaatgtg

SEQ ID NO: 368369 - DNA, 25 bp, Homo sapien
agaagctgaaacacacaagagaaga

SEQ ID NO: 368370 - DNA, 25 bp, Homo sapien
caagagaagaggttgtgtctcctgc

SEQ ID NO: 368371 - DNA, 25 bp, Homo sapien
ttgtgtctcctgctcatagctagtc

SEQ ID NO: 368372 - DNA, 25 bp, Homo sapien
ctcctgctcatagctagtccatggg

SEQ ID NO: 368373 - DNA, 25 bp, Homo sapien
gagggaagagtgacctgagtcaaat

SEQ ID NO: 368374 - DNA, 25 bp, Homo sapien
gagtcaaataggagaacgcatgcag

SEQ ID NO: 368375 - DNA, 25 bp, Homo sapien
gaacgcatgcagattcgcagatggc

SEQ ID NO: 368376 - DNA, 25 bp, Homo sapien
agagggtacaagtccccgctcacac

SEQ ID NO: 368377 - DNA, 25 bp, Homo sapien
agagtctggatgtggcaccctggat

SEQ ID NO: 368378 - DNA, 25 bp, Homo sapien
ctggatgtggcaccctggattatga

SEQ ID NO: 368379 - DNA, 25 bp, Homo sapien
ggcaccctggattatgaggaggctt

SEQ ID NO: 368380 - DNA, 25 bp, Homo sapien
tgactttttgtatcatgagacagag

SEQ ID NO: 368381 - DNA, 25 bp, Homo sapien
ctcaacatggtactctactggcagg

SEQ ID NO: 368382 - DNA, 25 bp, Homo sapien
acatggtactctactggcaggatgc

SEQ ID NO: 368383 - DNA, 25 bp, Homo sapien
actctactggcaggatgcagtttta

SEQ ID NO: 368384 - DNA, 25 bp, Homo sapien
ttatgccatcagttatttattcttg

SEQ ID NO: 368385 - DNA, 25 bp, Homo sapien
gtatcatgagacagagtgcctaaga

SEQ ID NO: 368386 - DNA, 25 bp, Homo sapien
gattcattcattaatgttaaggcta

SEQ ID NO: 368387 - DNA, 25 bp, Homo sapien
gatcttgtttaaacaatgtttcttc

SEQ ID NO: 368388 - DNA, 25 bp, Homo sapien
tgcctaagagaaacccttgcacctg

SEQ ID NO: 368389 - DNA, 25 bp, Homo sapien
agaaacccttgcacctgggagcgct

SEQ ID NO: 368390 - DNA, 25 bp, Homo sapien
ttgcacctgggagcgctgcttggct

SEQ ID NO: 368391 - DNA, 25 bp, Homo sapien
gcctactgcagctcgatttgagtgg

SEQ ID NO: 368392 - DNA, 25 bp, Homo sapien
ctgcagctcgatttgagtgggagtt

SEQ ID NO: 368393 - DNA, 25 bp, Homo sapien
gagtgggagttgatataatgtcttt

SEQ ID NO: 368394 - DNA, 25 bp, Homo sapien
ttttttctcacttcagcagtaagta

SEQ ID NO: 368395 - DNA, 25 bp, Homo sapien
cacttcagcagtaagtatctggttt

SEQ ID NO: 368396 - DNA, 25 bp, Homo sapien
atctggtttgctcatagtcttttga

SEQ ID NO: 368397 - DNA, 25 bp, Homo sapien
tggtttgctcatagtcttttgatta

SEQ ID NO: 368398 - DNA, 25 bp, Homo sapien
tttcaaagaatcagccaacatgtga

SEQ ID NO: 368399 - DNA, 25 bp, Homo sapien
gaatcagccaacatgtgattatttt

SEQ ID NO: 368400 - DNA, 25 bp, Homo sapien
ggttattgctactagatattacatc

SEQ ID NO: 368401 - DNA, 25 bp, Homo sapien
ttacatctagctaaatcaaccattg

SEQ ID NO: 368402 - DNA, 25 bp, Homo sapien
gtgtttccctgtttccagccaaggg

SEQ ID NO: 368403 - DNA, 25 bp, Homo sapien
ctgtttccagccaagggtattgtga

SEQ ID NO: 368404 - DNA, 25 bp, Homo sapien
aagggtattgtgagtttctcctggg

SEQ ID NO: 368405 - DNA, 25 bp, Homo sapien
tgggcctccttcagaatctgggtgc

SEQ ID NO: 368406 - DNA, 25 bp, Homo sapien
ccttcagaatctgggtgctctggaa

SEQ ID NO: 368407 - DNA, 25 bp, Homo sapien
gaaagcagtgttttggcaacatggg

SEQ ID NO: 368408 - DNA, 25 bp, Homo sapien
gtcagctgggtctgggtttgaatat

SEQ ID NO: 368409 - DNA, 25 bp, Homo sapien
aatattttaccagcattgatgtcgg

SEQ ID NO: 368410 - DNA, 25 bp, Homo sapien
atttagtccctgtaagcctcagttt

SEQ ID NO: 368411 - DNA, 25 bp, Homo sapien
aatatatttgactctttgttgtgat

SEQ ID NO: 368412 - DNA, 25 bp, Homo sapien
ttggttacacatatgaagagcctgg

SEQ ID NO: 368413 - DNA, 25 bp, Homo sapien
aaactttcaaagatccgccaaatca

SEQ ID NO: 368414 - DNA, 25 bp, Homo sapien
aaagatccgccaaatcattcatagc

SEQ ID NO: 368415 - DNA, 25 bp, Homo sapien
gatccgccaaatcattcatagcaaa

SEQ ID NO: 368416 - DNA, 25 bp, Homo sapien
aaatcattcatagcaaattgtacat

SEQ ID NO: 368417 - DNA, 25 bp, Homo sapien
aattgtacatattgttcagctgatt

SEQ ID NO: 368418 - DNA, 25 bp, Homo sapien
acatattgttcagctgatttttata

SEQ ID NO: 368419 - DNA, 25 bp, Homo sapien
atttaaatacaccttagtggccaga

SEQ ID NO: 368420 - DNA, 25 bp, Homo sapien
aatacaccttagtggccagagactg

SEQ ID NO: 368421 - DNA, 25 bp, Homo sapien
accttagtggccagagactgacttc

SEQ ID NO: 368422 - DNA, 25 bp, Homo sapien
tatattgttctggtacatgtctgaa

SEQ ID NO: 368423 - DNA, 25 bp, Homo sapien
gttctggtacatgtctgaaattcta

SEQ ID NO: 368424 - DNA, 25 bp, Homo sapien
taagaacttttgtccatatagtaga

SEQ ID NO: 368425 - DNA, 25 bp, Homo sapien
atagtagacaacatactcaccagtg

SEQ ID NO: 368426 - DNA, 25 bp, Homo sapien
agtgaggacctcaaatagcaatatt

SEQ ID NO: 368427 - DNA, 25 bp, Homo sapien
ggacctcaaatagcaatatttctgt

SEQ ID NO: 368428 - DNA, 25 bp, Homo sapien
acagcatgtcagtcaaggttgggtt

SEQ ID NO: 368429 - DNA, 25 bp, Homo sapien
tcagtcaaggttgggttttcctgac

SEQ ID NO: 368430 - DNA, 25 bp, Homo sapien
ttttggttttcaggactggtgtgac

SEQ ID NO: 368431 - DNA, 25 bp, Homo sapien
tcaggactggtgtgacttaacatac

SEQ ID NO: 368432 - DNA, 25 bp, Homo sapien
gtgtgacttaacatacatggcatag

SEQ ID NO: 368433 - DNA, 25 bp, Homo sapien
caggtgttagggattttggagcttt

SEQ ID NO: 368434 - DNA, 25 bp, Homo sapien
tgttagggattttggagctttacct

SEQ ID NO: 368435 - DNA, 25 bp, Homo sapien
catcatataaccattcagtgtgctg

SEQ ID NO: 368436 - DNA, 25 bp, Homo sapien
ccattcagtgtgctgagacgtggca

SEQ ID NO: 368437 - DNA, 25 bp, Homo sapien
agacgtggcacagacatctccatgt

SEQ ID NO: 368438 - DNA, 25 bp, Homo sapien
gacatctccatgtgcaaatgtactt

SEQ ID NO: 368439 - DNA, 25 bp, Homo sapien
aaatgtactttgcagctcatatgac

SEQ ID NO: 368440 - DNA, 25 bp, Homo sapien
acgaatcactgtcaagggaatgcct

SEQ ID NO: 368441 - DNA, 25 bp, Homo sapien
caagggaatgcctgactgtacaaaa

SEQ ID NO: 368442 - DNA, 25 bp, Homo sapien
gcccacaattgagcatctatcactg

SEQ ID NO: 368443 - DNA, 25 bp, Homo sapien
tgaagatctctcagtagggctcctc

SEQ ID NO: 368444 - DNA, 25 bp, Homo sapien
tagggctcctctctaggttatgcca

SEQ ID NO: 368445 - DNA, 25 bp, Homo sapien
ggttatgccagatcactggtggtaa

SEQ ID NO: 368446 - DNA, 25 bp, Homo sapien
ttagatttggtggatggatgacaga

SEQ ID NO: 368447 - DNA, 25 bp, Homo sapien
ttagatgatgaaagcagtgtttgac

SEQ ID NO: 368448 - DNA, 25 bp, Homo sapien
aagagtaagtcctattatcagttgg

SEQ ID NO: 368449 - DNA, 25 bp, Homo sapien
gtaagtcctattatcagttggagaa

SEQ ID NO: 368450 - DNA, 25 bp, Homo sapien
ggagaaagcagaatggagtccagcc

SEQ ID NO: 368451 - DNA, 25 bp, Homo sapien
atggagtccagccagctaacaatgg

SEQ ID NO: 368452 - DNA, 25 bp, Homo sapien
agtccagccagctaacaatggaaat

SEQ ID NO: 368453 - DNA, 25 bp, Homo sapien
gaaataacatgggatctggtgcagt

SEQ ID NO: 368454 - DNA, 25 bp, Homo sapien
atctggtgcagtaatgggaaacgga

SEQ ID NO: 368455 - DNA, 25 bp, Homo sapien
atcccaggcacttaaataagaagtg

SEQ ID NO: 368456 - DNA, 25 bp, Homo sapien
gaagtgaaccctgggttatttggca

SEQ ID NO: 368457 - DNA, 25 bp, Homo sapien
cagccattgagaaaacagactcatt

SEQ ID NO: 368458 - DNA, 25 bp, Homo sapien
aaacagactcatttatcattccaat

SEQ ID NO: 368459 - DNA, 25 bp, Homo sapien
gactcatttatcattccaatctgtc

SEQ ID NO: 368460 - DNA, 25 bp, Homo sapien
tcatttatcattccaatctgtcaga

SEQ ID NO: 368461 - DNA, 25 bp, Homo sapien
ttatcattccaatctgtcagaagta

SEQ ID NO: 368462 - DNA, 25 bp, Homo sapien
atagatgacttattagaacactggt

SEQ ID NO: 368463 - DNA, 25 bp, Homo sapien
gatgacttattagaacactggttat

SEQ ID NO: 368464 - DNA, 25 bp, Homo sapien
tattagaacactggttataaagcat

SEQ ID NO: 368465 - DNA, 25 bp, Homo sapien
atatatccattaagttattagcagg

SEQ ID NO: 368466 - DNA, 25 bp, Homo sapien
ccattaagttattagcaggaaggaa

SEQ ID NO: 368467 - DNA, 25 bp, Homo sapien
taacaagtagtaagatggtagattt

SEQ ID NO: 368468 - DNA, 25 bp, Homo sapien
tcttagaccgtttaaatatggccac

SEQ ID NO: 368469 - DNA, 25 bp, Homo sapien
tagaccgtttaaatatggccacgaa

SEQ ID NO: 368470 - DNA, 25 bp, Homo sapien
atatggccacgaaacaagtagtctc

SEQ ID NO: 368471 - DNA, 25 bp, Homo sapien
atggccacgaaacaagtagtctctg

SEQ ID NO: 368472 - DNA, 25 bp, Homo sapien
cgaaacaagtagtctctggttggct

SEQ ID NO: 368473 - DNA, 25 bp, Homo sapien
aaacaagtagtctctggttggctgg

SEQ ID NO: 368474 - DNA, 25 bp, Homo sapien
actgtggctcatgtccttaacacca

SEQ ID NO: 368475 - DNA, 25 bp, Homo sapien
gtggctcatgtccttaacaccaaca

SEQ ID NO: 368476 - DNA, 25 bp, Homo sapien
tcatgtccttaacaccaacactttg

SEQ ID NO: 368477 - DNA, 25 bp, Homo sapien
tgtccttaacaccaacactttggga

SEQ ID NO: 368478 - DNA, 25 bp, Homo sapien
gagtgcggtggtgcacaccggtaat

SEQ ID NO: 368479 - DNA, 25 bp, Homo sapien
agacccaggttctgaaagtgattga

SEQ ID NO: 368480 - DNA, 25 bp, Homo sapien
ggtattactgattcctaaaagggca

SEQ ID NO: 368481 - DNA, 25 bp, Homo sapien
gcaaatgtgggtagcttttgtaaac

SEQ ID NO: 368482 - DNA, 25 bp, Homo sapien
gaaacaagttgactaggtgcatctt

SEQ ID NO: 368483 - DNA, 25 bp, Homo sapien
ggtagacttagtgtcaacctttgaa

SEQ ID NO: 368484 - DNA, 25 bp, Homo sapien
gactaggtgcatctttcatctcaag

SEQ ID NO: 368485 - DNA, 25 bp, Homo sapien
aggtgcatctttcatctcaagttga

SEQ ID NO: 368486 - DNA, 25 bp, Homo sapien
gcatctttcatctcaagttgacaaa

SEQ ID NO: 368487 - DNA, 25 bp, Homo sapien
agttgacaaagatggccctgagagc

SEQ ID NO: 368488 - DNA, 25 bp, Homo sapien
gaaaatatcgagtgggtctctttaa

SEQ ID NO: 368489 - DNA, 25 bp, Homo sapien
gtctctttaaagtagttcaaatgcc

SEQ ID NO: 368490 - DNA, 25 bp, Homo sapien
ctcctaagttaatgaaatgcgttgc

SEQ ID NO: 368491 - DNA, 25 bp, Homo sapien
aatgcgttgcagctggctaatggct

SEQ ID NO: 368492 - DNA, 25 bp, Homo sapien
ggctgggaaagtgcaaaccctgcat

SEQ ID NO: 368493 - DNA, 25 bp, Homo sapien
agtgcaaaccctgcattgaaccctt

SEQ ID NO: 368494 - DNA, 25 bp, Homo sapien
aacccttcccatcagactattcaat

SEQ ID NO: 368495 - DNA, 25 bp, Homo sapien
cagactattcaatggctaggtaatg

SEQ ID NO: 368496 - DNA, 25 bp, Homo sapien
taggtaatgtcaggcccgagctgga

SEQ ID NO: 368497 - DNA, 25 bp, Homo sapien
gcaaacaggctcgttgccaggcagg

SEQ ID NO: 368498 - DNA, 25 bp, Homo sapien
agttataatgttgaccaggcactgt

SEQ ID NO: 368499 - DNA, 25 bp, Homo sapien
actgttacttccacttgatcacact

SEQ ID NO: 368500 - DNA, 25 bp, Homo sapien
tacttccacttgatcacactgtttg

SEQ ID NO: 368501 - DNA, 25 bp, Homo sapien
ggaatcagcttgggacagtcaccag

SEQ ID NO: 368502 - DNA, 25 bp, Homo sapien
agctgacccttgaatgcctggacag

SEQ ID NO: 368503 - DNA, 25 bp, Homo sapien
ggacagccgagccaagaatctgaaa

SEQ ID NO: 368504 - DNA, 25 bp, Homo sapien
cgagccaagaatctgaaacccaagc

SEQ ID NO: 368505 - DNA, 25 bp, Homo sapien
tgacccttgaatgcctggacagtgg

SEQ ID NO: 368506 - DNA, 25 bp, Homo sapien
aagctgtagagactcaacttgcaga

SEQ ID NO: 368507 - DNA, 25 bp, Homo sapien
agagactcaacttgcagataacctg

SEQ ID NO: 368508 - DNA, 25 bp, Homo sapien
gataacctggctgcgagtactctgc

SEQ ID NO: 368509 - DNA, 25 bp, Homo sapien
tctgcccccaactggtggaagggag

SEQ ID NO: 368510 - DNA, 25 bp, Homo sapien
ggtggcgagaaggtgcatctacttc

SEQ ID NO: 368511 - DNA, 25 bp, Homo sapien
aaggtgcatctacttctgaagtgcc

SEQ ID NO: 368512 - DNA, 25 bp, Homo sapien
taattggtataaatcaacctctggg

SEQ ID NO: 368513 - DNA, 25 bp, Homo sapien
aggtgaatcacctccatcatcatca

SEQ ID NO: 368514 - DNA, 25 bp, Homo sapien
tctttcttctgtttcgaacactctg

SEQ ID NO: 368515 - DNA, 25 bp, Homo sapien
gtttcgaacactctgaattaagttt

SEQ ID NO: 368516 - DNA, 25 bp, Homo sapien
atatgtaaagatgccttgcgctctt

SEQ ID NO: 368517 - DNA, 25 bp, Homo sapien
ttgcgctcttatccagctcgatctt

SEQ ID NO: 368518 - DNA, 25 bp, Homo sapien
cgatcttcaccttcttctgggagat

SEQ ID NO: 368519 - DNA, 25 bp, Homo sapien
gttgtgctttattaagtcctggtct

SEQ ID NO: 368520 - DNA, 25 bp, Homo sapien
gtcctggtctggttggtagcttgaa

SEQ ID NO: 368521 - DNA, 25 bp, Homo sapien
gcttgaagtgtcttttgtatctcct

SEQ ID NO: 368522 - DNA, 25 bp, Homo sapien
gtgtcttttgtatctcctaagtgta

SEQ ID NO: 368523 - DNA, 25 bp, Homo sapien
gaaagtgcttacaggtacagctagt

SEQ ID NO: 368524 - DNA, 25 bp, Homo sapien
tgcttacaggtacagctagtatggg

SEQ ID NO: 368525 - DNA, 25 bp, Homo sapien
ataggagaatctgttttatgtttgt

SEQ ID NO: 368526 - DNA, 25 bp, Homo sapien
attttatgtcccttatcactgtgcc

SEQ ID NO: 368527 - DNA, 25 bp, Homo sapien
atgtcccttatcactgtgcctttaa

SEQ ID NO: 368528 - DNA, 25 bp, Homo sapien
atcactgtgcctttaacctactgaa

SEQ ID NO: 368529 - DNA, 25 bp, Homo sapien
actgtgcctttaacctactgaaatg

SEQ ID NO: 368530 - DNA, 25 bp, Homo sapien
gtgcctttaacctactgaaatgcag

SEQ ID NO: 368531 - DNA, 25 bp, Homo sapien
tactgaaatgcagttgaggccgggt

SEQ ID NO: 368532 - DNA, 25 bp, Homo sapien
aaagcttcagcggtcactgaaagtg

SEQ ID NO: 368533 - DNA, 25 bp, Homo sapien
tcagcggtcactgaaagtgcttaca

SEQ ID NO: 368534 - DNA, 25 bp, Homo sapien
tgttatcgattacagacattggata

SEQ ID NO: 368535 - DNA, 25 bp, Homo sapien
ttatcgattacagacattggataga

SEQ ID NO: 368536 - DNA, 25 bp, Homo sapien
tccctatcctgttttgttcagatcg

SEQ ID NO: 368537 - DNA, 25 bp, Homo sapien
ccctatcctgttttgttcagatcga

SEQ ID NO: 368538 - DNA, 25 bp, Homo sapien
cctatcctgttttgttcagatcgaa

SEQ ID NO: 368539 - DNA, 25 bp, Homo sapien
ctatcctgttttgttcagatcgaat

SEQ ID NO: 368540 - DNA, 25 bp, Homo sapien
atcctgttttgttcagatcgaatta

SEQ ID NO: 368541 - DNA, 25 bp, Homo sapien
cctgttttgttcagatcgaattacc

SEQ ID NO: 368542 - DNA, 25 bp, Homo sapien
cagacacgtaccctctgcttgctca

SEQ ID NO: 368543 - DNA, 25 bp, Homo sapien
ggagcttggcttttgagacaggagt

SEQ ID NO: 368544 - DNA, 25 bp, Homo sapien
acaggagtcttgccaatgcccccag

SEQ ID NO: 368545 - DNA, 25 bp, Homo sapien
gaatcagcccgagagctgtggatct

SEQ ID NO: 368546 - DNA, 25 bp, Homo sapien
agcttcgtgcgcattgctcatttgc

SEQ ID NO: 368547 - DNA, 25 bp, Homo sapien
gccggagaacgcacatgttgactta

SEQ ID NO: 368548 - DNA, 25 bp, Homo sapien
gcacatgttgacttatttcttcagt

SEQ ID NO: 368549 - DNA, 25 bp, Homo sapien
atttcttcagtctaggcctttcttg

SEQ ID NO: 368550 - DNA, 25 bp, Homo sapien
atttcagttcaaatgtctcacggaa

SEQ ID NO: 368551 - DNA, 25 bp, Homo sapien
atgtctcacggaagaggcattgaag

SEQ ID NO: 368552 - DNA, 25 bp, Homo sapien
gctcatttgcgccaacgtgaaaaga

SEQ ID NO: 368553 - DNA, 25 bp, Homo sapien
gtgaaaagaactgccaggatgccca

SEQ ID NO: 368554 - DNA, 25 bp, Homo sapien
ctggcttctgcggtgcttgcacagt

SEQ ID NO: 368555 - DNA, 25 bp, Homo sapien
ggtgcttgcacagtcctgaatcagc

SEQ ID NO: 368556 - DNA, 25 bp, Homo sapien
ttcaccacactagaagggctgctga

SEQ ID NO: 368557 - DNA, 25 bp, Homo sapien
aagatatctgggaactggtgaccaa

SEQ ID NO: 368558 - DNA, 25 bp, Homo sapien
ggtgaccaaaaaccctttcacactg

SEQ ID NO: 368559 - DNA, 25 bp, Homo sapien
actgggcgacagttccaatcctggc

SEQ ID NO: 368560 - DNA, 25 bp, Homo sapien
aatcctggccagacggagagactgc

SEQ ID NO: 368561 - DNA, 25 bp, Homo sapien
agaccgactttattatggatgattc

SEQ ID NO: 368562 - DNA, 25 bp, Homo sapien
tcctgagatgaaggcggagcattat

SEQ ID NO: 368563 - DNA, 25 bp, Homo sapien
ggcggagcattataagcacaccttt

SEQ ID NO: 368564 - DNA, 25 bp, Homo sapien
ggagcattataagcacacctttgac

SEQ ID NO: 368565 - DNA, 25 bp, Homo sapien
gagcattataagcacacctttgact

SEQ ID NO: 368566 - DNA, 25 bp, Homo sapien
taagcacacctttgactaaaatgag

SEQ ID NO: 368567 - DNA, 25 bp, Homo sapien
ctgctgcttttaagtaagaccctat

SEQ ID NO: 368568 - DNA, 25 bp, Homo sapien
ttaagtaagaccctatgcatcccct

SEQ ID NO: 368569 - DNA, 25 bp, Homo sapien
tgctgtaaaggcttgcttgttgctt

SEQ ID NO: 368570 - DNA, 25 bp, Homo sapien
gcttgttgcttttagttgagaactt

SEQ ID NO: 368571 - DNA, 25 bp, Homo sapien
acttttgcaagattgtcagtgtaca

SEQ ID NO: 368572 - DNA, 25 bp, Homo sapien
gtacattttttatgccacttggaaa

SEQ ID NO: 368573 - DNA, 25 bp, Homo sapien
gccacttggaaacttatgtgactat

SEQ ID NO: 368574 - DNA, 25 bp, Homo sapien
gtgactattcacaattgttatcagg

SEQ ID NO: 368575 - DNA, 25 bp, Homo sapien
aacagaacactgcaactttagaggt

SEQ ID NO: 368576 - DNA, 25 bp, Homo sapien
gcaactttagaggttttctctcttg

SEQ ID NO: 368577 - DNA, 25 bp, Homo sapien
ctcttggtcctaccttgtgtatgta

SEQ ID NO: 368578 - DNA, 25 bp, Homo sapien
gtgtcaccctcatcctcagttgttg

SEQ ID NO: 368579 - DNA, 25 bp, Homo sapien
ctcagttgttggtgatagctgccca

SEQ ID NO: 368580 - DNA, 25 bp, Homo sapien
tgatagctgcccaagtcacctgaca

SEQ ID NO: 368581 - DNA, 25 bp, Homo sapien
agctgcaggtgtcccctacagatga

SEQ ID NO: 368582 - DNA, 25 bp, Homo sapien
gggaacagtttacccaagcatctcc

SEQ ID NO: 368583 - DNA, 25 bp, Homo sapien
agtttacccaagcatctcctttaat

SEQ ID NO: 368584 - DNA, 25 bp, Homo sapien
gcatctcctttaatcagggaggaaa

SEQ ID NO: 368585 - DNA, 25 bp, Homo sapien
tcagggaggaaaaccctccgcagaa

SEQ ID NO: 368586 - DNA, 25 bp, Homo sapien
tttattcccctaggttgaggtcagg

SEQ ID NO: 368587 - DNA, 25 bp, Homo sapien
tggccagtgagcagggtcccttgtt

SEQ ID NO: 368588 - DNA, 25 bp, Homo sapien
gtcccttgttcaacaattcaccagg

SEQ ID NO: 368589 - DNA, 25 bp, Homo sapien
ttagaaaaccttctgcctgggcatt

SEQ ID NO: 368590 - DNA, 25 bp, Homo sapien
gcattccaatctttttagcaaatct

SEQ ID NO: 368591 - DNA, 25 bp, Homo sapien
ggtattcattatccacacttgttgg

SEQ ID NO: 368592 - DNA, 25 bp, Homo sapien
acacttgttggtattctctcataca

SEQ ID NO: 368593 - DNA, 25 bp, Homo sapien
caattctaaagttgccctgaggcca

SEQ ID NO: 368594 - DNA, 25 bp, Homo sapien
ccctgtgatgtacaatcccaagcaa

SEQ ID NO: 368595 - DNA, 25 bp, Homo sapien
atcccaagcaactggccatatcttt

SEQ ID NO: 368596 - DNA, 25 bp, Homo sapien
gagcagagctcctgcaagtgaagca

SEQ ID NO: 368597 - DNA, 25 bp, Homo sapien
gtgaagcagggaactgtacaacata

SEQ ID NO: 368598 - DNA, 25 bp, Homo sapien
caacataaacatttcaggatcactg

SEQ ID NO: 368599 - DNA, 25 bp, Homo sapien
tgacatccacatcatggctaacgtg

SEQ ID NO: 368600 - DNA, 25 bp, Homo sapien
aaggaaaaccactagcatttcgagt

SEQ ID NO: 368601 - DNA, 25 bp, Homo sapien
aaccactagcatttcgagtaggtca

SEQ ID NO: 368602 - DNA, 25 bp, Homo sapien
tagcatttcgagtaggtcagtcttt

SEQ ID NO: 368603 - DNA, 25 bp, Homo sapien
ttcgagtaggtcagtcttttttgtg

SEQ ID NO: 368604 - DNA, 25 bp, Homo sapien
atcggatggcgacttttttcacaat

SEQ ID NO: 368605 - DNA, 25 bp, Homo sapien
aaatgagttttcctggcaaatatta

SEQ ID NO: 368606 - DNA, 25 bp, Homo sapien
gagttttcctggcaaatattagttt

SEQ ID NO: 368607 - DNA, 25 bp, Homo sapien
aattgccatgacatttgaaccaagg

SEQ ID NO: 368608 - DNA, 25 bp, Homo sapien
ccatgacatttgaaccaaggctatg

SEQ ID NO: 368609 - DNA, 25 bp, Homo sapien
gaaccaaggctatgtattttaagaa

SEQ ID NO: 368610 - DNA, 25 bp, Homo sapien
ttggcaagaatcttgctctggatcc

SEQ ID NO: 368611 - DNA, 25 bp, Homo sapien
taagatcaccctgggattgactggc

SEQ ID NO: 368612 - DNA, 25 bp, Homo sapien
accctgggattgactggccaagcat

SEQ ID NO: 368613 - DNA, 25 bp, Homo sapien
ttgactggccaagcatttggtggaa

SEQ ID NO: 368614 - DNA, 25 bp, Homo sapien
aataaagccatgaaagtaccaagaa

SEQ ID NO: 368615 - DNA, 25 bp, Homo sapien
ttctcattttaattacatcagcttg

SEQ ID NO: 368616 - DNA, 25 bp, Homo sapien
aattacatcagcttgtctgtgatca

SEQ ID NO: 368617 - DNA, 25 bp, Homo sapien
tacatcagcttgtctgtgatcatgt

SEQ ID NO: 368618 - DNA, 25 bp, Homo sapien
atcagcttgtctgtgatcatgtagc

SEQ ID NO: 368619 - DNA, 25 bp, Homo sapien
cagcttgtctgtgatcatgtagcct

SEQ ID NO: 368620 - DNA, 25 bp, Homo sapien
gcttgtctgtgatcatgtagcctaa

SEQ ID NO: 368621 - DNA, 25 bp, Homo sapien
tgtctgtgatcatgtagcctaaggt

SEQ ID NO: 368622 - DNA, 25 bp, Homo sapien
ggcctgttgtatatgaaattgtcta

SEQ ID NO: 368623 - DNA, 25 bp, Homo sapien
attgtctagaattcaggtgcaggtc

SEQ ID NO: 368624 - DNA, 25 bp, Homo sapien
gtgcaggtctttgccggttaagtaa

SEQ ID NO: 368625 - DNA, 25 bp, Homo sapien
atactgcagatagtcagcttcacca

SEQ ID NO: 368626 - DNA, 25 bp, Homo sapien
tcagcttcaccaaagccgcagagga

SEQ ID NO: 368627 - DNA, 25 bp, Homo sapien
aacatgtcgagatcaggcttcctgc

SEQ ID NO: 368628 - DNA, 25 bp, Homo sapien
ggcttcctgcttgatagtctcttga

SEQ ID NO: 368629 - DNA, 25 bp, Homo sapien
tcatgaaagtcattggtaggccatt

SEQ ID NO: 368630 - DNA, 25 bp, Homo sapien
ggtaggccattagcattgatatctt

SEQ ID NO: 368631 - DNA, 25 bp, Homo sapien
atctaccctaaaccatctgctatgg

SEQ ID NO: 368632 - DNA, 25 bp, Homo sapien
ggacccataataagaggcctgttgt

SEQ ID NO: 368633 - DNA, 25 bp, Homo sapien
agaggacttgcaggtattagaaaac

SEQ ID NO: 368634 - DNA, 25 bp, Homo sapien
attagaaaactactcggatgctcca

SEQ ID NO: 368635 - DNA, 25 bp, Homo sapien
gaaaactactcggatgctccaatga

SEQ ID NO: 368636 - DNA, 25 bp, Homo sapien
aactactcggatgctccaatgacac

SEQ ID NO: 368637 - DNA, 25 bp, Homo sapien
ctcggatgctccaatgacaccaaaa

SEQ ID NO: 368638 - DNA, 25 bp, Homo sapien
gatgctccaatgacaccaaaacaga

SEQ ID NO: 368639 - DNA, 25 bp, Homo sapien
tccaatgacaccaaaacagattctg

SEQ ID NO: 368640 - DNA, 25 bp, Homo sapien
tctcgcatgcctcaatgctatgcta

SEQ ID NO: 368641 - DNA, 25 bp, Homo sapien
gcatgcctcaatgctatgctacatt

SEQ ID NO: 368642 - DNA, 25 bp, Homo sapien
gcctcaatgctatgctacattccaa

SEQ ID NO: 368643 - DNA, 25 bp, Homo sapien
caatgctatgctacattccaattca

SEQ ID NO: 368644 - DNA, 25 bp, Homo sapien
atctaaatgcatggtggcaccctgc

SEQ ID NO: 368645 - DNA, 25 bp, Homo sapien
atgcatggtggcaccctgcattgga

SEQ ID NO: 368646 - DNA, 25 bp, Homo sapien
ccctgcattggaccctggaacagaa

SEQ ID NO: 368647 - DNA, 25 bp, Homo sapien
tacaatatccctccagactttcaag

SEQ ID NO: 368648 - DNA, 25 bp, Homo sapien
aagtctggaatttagttggtggcaa

SEQ ID NO: 368649 - DNA, 25 bp, Homo sapien
ggcaatgtatgaatattggttccat

SEQ ID NO: 368650 - DNA, 25 bp, Homo sapien
attggttccatagtgttgacaaata

SEQ ID NO: 368651 - DNA, 25 bp, Homo sapien
ccctccagactttcaaggccatgaa

SEQ ID NO: 368652 - DNA, 25 bp, Homo sapien
ttagctgaggagtgtaaagtcttat

SEQ ID NO: 368653 - DNA, 25 bp, Homo sapien
tcaaggccatgaaaaacacagaaag

SEQ ID NO: 368654 - DNA, 25 bp, Homo sapien
ggaaactgggaagacatcatatcta

SEQ ID NO: 368655 - DNA, 25 bp, Homo sapien
gaccagggcaggaaggttgtgctct

SEQ ID NO: 368656 - DNA, 25 bp, Homo sapien
ttgtgctctggcagtagggccacga

SEQ ID NO: 368657 - DNA, 25 bp, Homo sapien
gctctggcagtagggccacgacctg

SEQ ID NO: 368658 - DNA, 25 bp, Homo sapien
agtagggccacgacctgcctgcctg

SEQ ID NO: 368659 - DNA, 25 bp, Homo sapien
gcctgcctgggctggagctcttgcc

SEQ ID NO: 368660 - DNA, 25 bp, Homo sapien
gagctcttgcccgaagcctgaagct

SEQ ID NO: 368661 - DNA, 25 bp, Homo sapien
ttgcccgaagcctgaagcttccttc

SEQ ID NO: 368662 - DNA, 25 bp, Homo sapien
tgaagcttccttcggcgccatgcag

SEQ ID NO: 368663 - DNA, 25 bp, Homo sapien
actggagctggccttgggatttaat

SEQ ID NO: 368664 - DNA, 25 bp, Homo sapien
gcaggacctggcctgtttgtttaaa

SEQ ID NO: 368665 - DNA, 25 bp, Homo sapien
ggattacgctagtttttctttgtat

SEQ ID NO: 368666 - DNA, 25 bp, Homo sapien
aatcgtgaaatgtatgcgcagctga

SEQ ID NO: 368667 - DNA, 25 bp, Homo sapien
atgtatgcgcagctgaagcgaattc

SEQ ID NO: 368668 - DNA, 25 bp, Homo sapien
gaagcgaattcagctatttcctcta

SEQ ID NO: 368669 - DNA, 25 bp, Homo sapien
gaattcagctatttcctctaccttt

SEQ ID NO: 368670 - DNA, 25 bp, Homo sapien
tcctctaccttttgtgtggaattta

SEQ ID NO: 368671 - DNA, 25 bp, Homo sapien
tactgaacttgtgagatgaacctgg

SEQ ID NO: 368672 - DNA, 25 bp, Homo sapien
ctcaaacttcttggtcacaggacgc

SEQ ID NO: 368673 - DNA, 25 bp, Homo sapien
aacttcttggtcacaggacgcttgc

SEQ ID NO: 368674 - DNA, 25 bp, Homo sapien
ggacgcttgcactctcttaaaatgt

SEQ ID NO: 368675 - DNA, 25 bp, Homo sapien
gcttgcactctcttaaaatgtactg

SEQ ID NO: 368676 - DNA, 25 bp, Homo sapien
acctggctcagcttaccgaagtgct

SEQ ID NO: 368677 - DNA, 25 bp, Homo sapien
gacagagaccaagaaatgcatatag

SEQ ID NO: 368678 - DNA, 25 bp, Homo sapien
ggaaaataagcatggtgatcccaaa

SEQ ID NO: 368679 - DNA, 25 bp, Homo sapien
ataagcatggtgatcccaaaaagaa

SEQ ID NO: 368680 - DNA, 25 bp, Homo sapien
atgagaagcatacacaccgaattaa

SEQ ID NO: 368681 - DNA, 25 bp, Homo sapien
gcatacacaccgaattaaagacagt

SEQ ID NO: 368682 - DNA, 25 bp, Homo sapien
caggctcaagaagtgatgaagatag

SEQ ID NO: 368683 - DNA, 25 bp, Homo sapien
gatagatatcaaaatggtgccgaga

SEQ ID NO: 368684 - DNA, 25 bp, Homo sapien
tatcaaaatggtgccgagagacgat

SEQ ID NO: 368685 - DNA, 25 bp, Homo sapien
tgccgagagacgatgggaaaaatct

SEQ ID NO: 368686 - DNA, 25 bp, Homo sapien
gggaaaaatctagcagatactctga

SEQ ID NO: 368687 - DNA, 25 bp, Homo sapien
atctagcagatactctgaacaatcc

SEQ ID NO: 368688 - DNA, 25 bp, Homo sapien
gaaatattacagatacgcgctaaag

SEQ ID NO: 368689 - DNA, 25 bp, Homo sapien
acagatacgcgctaaagtgtaacta

SEQ ID NO: 368690 - DNA, 25 bp, Homo sapien
atacgcgctaaagtgtaactacaag

SEQ ID NO: 368691 - DNA, 25 bp, Homo sapien
gtaactacaaggatatttgtcacta

SEQ ID NO: 368692 - DNA, 25 bp, Homo sapien
caaggatatttgtcactatagtatt

SEQ ID NO: 368693 - DNA, 25 bp, Homo sapien
gtaagggattgtgatacatatatat

SEQ ID NO: 368694 - DNA, 25 bp, Homo sapien
aatgggatactaatgcaagcattca

SEQ ID NO: 368695 - DNA, 25 bp, Homo sapien
ggatactaatgcaagcattcagtga

SEQ ID NO: 368696 - DNA, 25 bp, Homo sapien
gtagattaccaaactatacgatcct

SEQ ID NO: 368697 - DNA, 25 bp, Homo sapien
attaccaaactatacgatcctcatt

SEQ ID NO: 368698 - DNA, 25 bp, Homo sapien
taccaaactatacgatcctcattta

SEQ ID NO: 368699 - DNA, 25 bp, Homo sapien
gatctaggatttatgtatagacacc

SEQ ID NO: 368700 - DNA, 25 bp, Homo sapien
taggatttatgtatagacaccagtt

SEQ ID NO: 368701 - DNA, 25 bp, Homo sapien
tgaagaggaaaaactaactgaggga

SEQ ID NO: 368702 - DNA, 25 bp, Homo sapien
agtaatttcagcttttggagagaac

SEQ ID NO: 368703 - DNA, 25 bp, Homo sapien
ttttggagagaactggtagaaaaca

SEQ ID NO: 368704 - DNA, 25 bp, Homo sapien
gatgatatgctgagtatgaagggta

SEQ ID NO: 368705 - DNA, 25 bp, Homo sapien
gctgagtatgaagggtaaagtgcaa

SEQ ID NO: 368706 - DNA, 25 bp, Homo sapien
tgaagggtaaagtgcaaagagtatt

SEQ ID NO: 368707 - DNA, 25 bp, Homo sapien
tcaatatttgtctctagagataaca

SEQ ID NO: 368708 - DNA, 25 bp, Homo sapien
ttgtctctagagataacattctttc

SEQ ID NO: 368709 - DNA, 25 bp, Homo sapien
ctctagagataacattctttcttag

SEQ ID NO: 368710 - DNA, 25 bp, Homo sapien
ctggtggacactataaaataaggca

SEQ ID NO: 368711 - DNA, 25 bp, Homo sapien
taaggcagacataggcaaatacttc

SEQ ID NO: 368712 - DNA, 25 bp, Homo sapien
gcaaatacttcatgatcccacttaa

SEQ ID NO: 368713 - DNA, 25 bp, Homo sapien
tcatgatcccacttaattgtggaat

SEQ ID NO: 368714 - DNA, 25 bp, Homo sapien
taaaaacttaaactccgaggcagag

SEQ ID NO: 368715 - DNA, 25 bp, Homo sapien
gaacggtggttactagagtccagaa

SEQ ID NO: 368716 - DNA, 25 bp, Homo sapien
ccaagttgtaaggtgaacacgttct

SEQ ID NO: 368717 - DNA, 25 bp, Homo sapien
aacacgttctggagatttaatgtac

SEQ ID NO: 368718 - DNA, 25 bp, Homo sapien
aaaaggaaatcctgacatttgtcac

SEQ ID NO: 368719 - DNA, 25 bp, Homo sapien
gaaatcctgacatttgtcacatgaa

SEQ ID NO: 368720 - DNA, 25 bp, Homo sapien
acatgaataaacctggtggacacta

SEQ ID NO: 368721 - DNA, 25 bp, Homo sapien
aatatacttgctatctataaaaaag

SEQ ID NO: 368722 - DNA, 25 bp, Homo sapien
aaatcctgtcctaggcttttactct

SEQ ID NO: 368723 - DNA, 25 bp, Homo sapien
aatcctgtcctaggcttttactctt

SEQ ID NO: 368724 - DNA, 25 bp, Homo sapien
tcctgtcctaggcttttactcttga

SEQ ID NO: 368725 - DNA, 25 bp, Homo sapien
ctgtcctaggcttttactcttgatc

SEQ ID NO: 368726 - DNA, 25 bp, Homo sapien
cctaggcttttactcttgatcttca

SEQ ID NO: 368727 - DNA, 25 bp, Homo sapien
taggcttttactcttgatcttcaaa

SEQ ID NO: 368728 - DNA, 25 bp, Homo sapien
ggcttttactcttgatcttcaaagg

SEQ ID NO: 368729 - DNA, 25 bp, Homo sapien
tttactcttgatcttcaaaggcacg

SEQ ID NO: 368730 - DNA, 25 bp, Homo sapien
tactcttgatcttcaaaggcacgca

SEQ ID NO: 368731 - DNA, 25 bp, Homo sapien
tcttgatcttcaaaggcacgcaggg

SEQ ID NO: 368732 - DNA, 25 bp, Homo sapien
ttgggcatgtggacccaagcacctg

SEQ ID NO: 368733 - DNA, 25 bp, Homo sapien
ggtggcatctgagacagcctgatac

SEQ ID NO: 368734 - DNA, 25 bp, Homo sapien
agacagcctgatacgttcccgtctg

SEQ ID NO: 368735 - DNA, 25 bp, Homo sapien
ttcccgtctgtgcacccatggagat

SEQ ID NO: 368736 - DNA, 25 bp, Homo sapien
tggctgtccctggttgtaaattcga

SEQ ID NO: 368737 - DNA, 25 bp, Homo sapien
attcgagggtctgcatatctgatgt

SEQ ID NO: 368738 - DNA, 25 bp, Homo sapien
gatgttcaggtagacctgggcgcct

SEQ ID NO: 368739 - DNA, 25 bp, Homo sapien
tgggaacgaggccatcagctgccat

SEQ ID NO: 368740 - DNA, 25 bp, Homo sapien
agctgccatgcacataacaaagaga

SEQ ID NO: 368741 - DNA, 25 bp, Homo sapien
agagacaatgcattccttcttattt

SEQ ID NO: 368742 - DNA, 25 bp, Homo sapien
aatcgatgaatcatttgtgatgctt

SEQ ID NO: 368743 - DNA, 25 bp, Homo sapien
ggatttgcatccgtttagtgaccgt

SEQ ID NO: 368744 - DNA, 25 bp, Homo sapien
atccgtttagtgaccgtgctgacca

SEQ ID NO: 368745 - DNA, 25 bp, Homo sapien
tttagtgaccgtgctgaccatcgcc

SEQ ID NO: 368746 - DNA, 25 bp, Homo sapien
tatgattactggacttctgtgctgc

SEQ ID NO: 368747 - DNA, 25 bp, Homo sapien
tttccttttcttcaggttcctgagc

SEQ ID NO: 368748 - DNA, 25 bp, Homo sapien
aggttcctgagctccctgtatatat

SEQ ID NO: 368749 - DNA, 25 bp, Homo sapien
ctgagctccctgtatatatcctaga

SEQ ID NO: 368750 - DNA, 25 bp, Homo sapien
gctccctgtatatatcctagaatgg

SEQ ID NO: 368751 - DNA, 25 bp, Homo sapien
taaactgtcaataccaggtgttatt

SEQ ID NO: 368752 - DNA, 25 bp, Homo sapien
ccctgtcctcagacactgaggtgga

SEQ ID NO: 368753 - DNA, 25 bp, Homo sapien
gaggtggagagagctgaactcctcc

SEQ ID NO: 368754 - DNA, 25 bp, Homo sapien
aaactataggagtaagtgggcttat

SEQ ID NO: 368755 - DNA, 25 bp, Homo sapien
aagtgggcttattcaggaagggtat

SEQ ID NO: 368756 - DNA, 25 bp, Homo sapien
aggaaagaaagccagtgatgaaact

SEQ ID NO: 368757 - DNA, 25 bp, Homo sapien
gaaacttgaggctgtcctcagtgtt

SEQ ID NO: 368758 - DNA, 25 bp, Homo sapien
tgaggatggaggatgtcacactgta

SEQ ID NO: 368759 - DNA, 25 bp, Homo sapien
gaggatgtcacactgtaggatgaaa

SEQ ID NO: 368760 - DNA, 25 bp, Homo sapien
cactgtaggatgaaaatgtctggga

SEQ ID NO: 368761 - DNA, 25 bp, Homo sapien
aagtataggcatgttgcttcgggaa

SEQ ID NO: 368762 - DNA, 25 bp, Homo sapien
agatcatagctcttggattcattat

SEQ ID NO: 368763 - DNA, 25 bp, Homo sapien
ggattcattattgcacagaggactg

SEQ ID NO: 368764 - DNA, 25 bp, Homo sapien
cacagaggactgatcaaactatagg

SEQ ID NO: 368765 - DNA, 25 bp, Homo sapien
tctgcacttatcagccggtcctttg

SEQ ID NO: 368766 - DNA, 25 bp, Homo sapien
ttatcagccggtcctttgtggcaac

SEQ ID NO: 368767 - DNA, 25 bp, Homo sapien
agccggtcctttgtggcaacgcagc

SEQ ID NO: 368768 - DNA, 25 bp, Homo sapien
tgtggcaacgcagccctgttctgtt

SEQ ID NO: 368769 - DNA, 25 bp, Homo sapien
ttgcttttcctcttcttgaccaaag

SEQ ID NO: 368770 - DNA, 25 bp, Homo sapien
cttcttgaccaaagcatgtgccact

SEQ ID NO: 368771 - DNA, 25 bp, Homo sapien
aaagcatgtgccactagctgtcctt

SEQ ID NO: 368772 - DNA, 25 bp, Homo sapien
tagctgtccttgaggacctcgtctt

SEQ ID NO: 368773 - DNA, 25 bp, Homo sapien
gtccttgaggacctcgtctttatga

SEQ ID NO: 368774 - DNA, 25 bp, Homo sapien
gaggacctcgtctttatgaaacaca

SEQ ID NO: 368775 - DNA, 25 bp, Homo sapien
gtctttatgaaacacacacctggaa

SEQ ID NO: 368776 - DNA, 25 bp, Homo sapien
accaagctgtttactgattttcatg

SEQ ID NO: 368777 - DNA, 25 bp, Homo sapien
ctgattttcatgagaacatttaagt

SEQ ID NO: 368778 - DNA, 25 bp, Homo sapien
gtctaccactcatgctacttactag

SEQ ID NO: 368779 - DNA, 25 bp, Homo sapien
ttaagttagtttaggtctacctgat

SEQ ID NO: 368780 - DNA, 25 bp, Homo sapien
gttagtttaggtctacctgatttat

SEQ ID NO: 368781 - DNA, 25 bp, Homo sapien
taccactcatgctacttactagtaa

SEQ ID NO: 368782 - DNA, 25 bp, Homo sapien
tattttaaaagaaggcagagggctg

SEQ ID NO: 368783 - DNA, 25 bp, Homo sapien
gttaaacttaggaatttgtcacatg

SEQ ID NO: 368784 - DNA, 25 bp, Homo sapien
atttgtcacatgtaggttcctgagg

SEQ ID NO: 368785 - DNA, 25 bp, Homo sapien
tcacatgtaggttcctgaggagatc

SEQ ID NO: 368786 - DNA, 25 bp, Homo sapien
ggttcctgaggagatctaaaagtta

SEQ ID NO: 368787 - DNA, 25 bp, Homo sapien
gcaggtatgcaaaatgtgcctacca

SEQ ID NO: 368788 - DNA, 25 bp, Homo sapien
aaaatgtgcctaccaggactctgct

SEQ ID NO: 368789 - DNA, 25 bp, Homo sapien
taccaggactctgcttcatatccat

SEQ ID NO: 368790 - DNA, 25 bp, Homo sapien
ggtgctagtgctgaagtattacact

SEQ ID NO: 368791 - DNA, 25 bp, Homo sapien
gtaaaactttgtctggctagaggct

SEQ ID NO: 368792 - DNA, 25 bp, Homo sapien
tgtctggctagaggctttgaaggaa

SEQ ID NO: 368793 - DNA, 25 bp, Homo sapien
aatggagtgttctggttgaattcta

SEQ ID NO: 368794 - DNA, 25 bp, Homo sapien
gttctggttgaattctattaacttg

SEQ ID NO: 368795 - DNA, 25 bp, Homo sapien
aagtattacactcaccatccaaggt

SEQ ID NO: 368796 - DNA, 25 bp, Homo sapien
catccaaggttcacaggacttttgt

SEQ ID NO: 368797 - DNA, 25 bp, Homo sapien
gatggaactgtttagttctgcatct

SEQ ID NO: 368798 - DNA, 25 bp, Homo sapien
ggaagtggatctatgacacgtgctt

SEQ ID NO: 368799 - DNA, 25 bp, Homo sapien
tgacacgtgcttgtgcatttacccg

SEQ ID NO: 368800 - DNA, 25 bp, Homo sapien
cttgtgcatttacccgccctgttgg

SEQ ID NO: 368801 - DNA, 25 bp, Homo sapien
ctgttggtttctgtagctgtctagt

SEQ ID NO: 368802 - DNA, 25 bp, Homo sapien
gtttctgtagctgtctagttcctgc

SEQ ID NO: 368803 - DNA, 25 bp, Homo sapien
gtagctgtctagttcctgctgttcc

SEQ ID NO: 368804 - DNA, 25 bp, Homo sapien
acctgcccctttccttatgtgtagt

SEQ ID NO: 368805 - DNA, 25 bp, Homo sapien
gctctcagattgacaggacattcgc

SEQ ID NO: 368806 - DNA, 25 bp, Homo sapien
ttgacaggacattcgcttaggccat

SEQ ID NO: 368807 - DNA, 25 bp, Homo sapien
gacattcgcttaggccatgtcagtg

SEQ ID NO: 368808 - DNA, 25 bp, Homo sapien
aggtgaactgttcaacctgtgcccc

SEQ ID NO: 368809 - DNA, 25 bp, Homo sapien
acctgtggtgaacgaatctgtccgt

SEQ ID NO: 368810 - DNA, 25 bp, Homo sapien
gaacgaatctgtccgttcaccctgt

SEQ ID NO: 368811 - DNA, 25 bp, Homo sapien
tgccagggccgtccttacagcaagg

SEQ ID NO: 368812 - DNA, 25 bp, Homo sapien
tgtccgtccccatcagtgtcatgtt

SEQ ID NO: 368813 - DNA, 25 bp, Homo sapien
gcagtgacaacatccctttgcagga

SEQ ID NO: 368814 - DNA, 25 bp, Homo sapien
atccctttgcaggaggcatcctgaa

SEQ ID NO: 368815 - DNA, 25 bp, Homo sapien
tcctcagacagtggcagagcccaag

SEQ ID NO: 368816 - DNA, 25 bp, Homo sapien
agagcccaagagaacaatgtgcccc

SEQ ID NO: 368817 - DNA, 25 bp, Homo sapien
accagcctcaggaatcattgtcttg

SEQ ID NO: 368818 - DNA, 25 bp, Homo sapien
aggaatcattgtcttgtccccatca

SEQ ID NO: 368819 - DNA, 25 bp, Homo sapien
aagactcagggcacatgcgccaagc

SEQ ID NO: 368820 - DNA, 25 bp, Homo sapien
ctccttggcagctcacatggaacag

SEQ ID NO: 368821 - DNA, 25 bp, Homo sapien
agctcacatggaacagggccgggta

SEQ ID NO: 368822 - DNA, 25 bp, Homo sapien
aacagggccgggtatgactttgcaa

SEQ ID NO: 368823 - DNA, 25 bp, Homo sapien
gggccgggtatgactttgcaactga

SEQ ID NO: 368824 - DNA, 25 bp, Homo sapien
gtatgactttgcaactgaagctgaa

SEQ ID NO: 368825 - DNA, 25 bp, Homo sapien
tgaagctgaaggagtcttttctgac

SEQ ID NO: 368826 - DNA, 25 bp, Homo sapien
tcctcctatgagtccagcttcctgg

SEQ ID NO: 368827 - DNA, 25 bp, Homo sapien
atgcaagatctcaacaccatgttgt

SEQ ID NO: 368828 - DNA, 25 bp, Homo sapien
gatctcaacaccatgttgtctgcaa

SEQ ID NO: 368829 - DNA, 25 bp, Homo sapien
catgttgtctgcaacacatgacagc

SEQ ID NO: 368830 - DNA, 25 bp, Homo sapien
atcccaggagcgcagtggccactat

SEQ ID NO: 368831 - DNA, 25 bp, Homo sapien
ataaatgttactaacatctatttct

SEQ ID NO: 368832 - DNA, 25 bp, Homo sapien
cattcttcaaccattacccactgag

SEQ ID NO: 368833 - DNA, 25 bp, Homo sapien
attcttcaaccattacccactgagt

SEQ ID NO: 368834 - DNA, 25 bp, Homo sapien
ttcttcaaccattacccactgagtg

SEQ ID NO: 368835 - DNA, 25 bp, Homo sapien
tcttcaaccattacccactgagtgc

SEQ ID NO: 368836 - DNA, 25 bp, Homo sapien
ttcaaccattacccactgagtgcct

SEQ ID NO: 368837 - DNA, 25 bp, Homo sapien
ccccatggcatgagtttataacaaa

SEQ ID NO: 368838 - DNA, 25 bp, Homo sapien
cccatggcatgagtttataacaaac

SEQ ID NO: 368839 - DNA, 25 bp, Homo sapien
ccatggcatgagtttataacaaacc

SEQ ID NO: 368840 - DNA, 25 bp, Homo sapien
catggcatgagtttataacaaacct

SEQ ID NO: 368841 - DNA, 25 bp, Homo sapien
atggcatgagtttataacaaacctg

SEQ ID NO: 368842 - DNA, 25 bp, Homo sapien
gtcatactaccttaagaccacaatg

SEQ ID NO: 368843 - DNA, 25 bp, Homo sapien
agtgagtctagccaactctcatctg

SEQ ID NO: 368844 - DNA, 25 bp, Homo sapien
cccagcccagggaataaatatgtga

SEQ ID NO: 368845 - DNA, 25 bp, Homo sapien
gagctagctccacaggagacaccat

SEQ ID NO: 368846 - DNA, 25 bp, Homo sapien
gaggctccatacatagggctttatt

SEQ ID NO: 368847 - DNA, 25 bp, Homo sapien
aagaagcgttgctgctttcacttag

SEQ ID NO: 368848 - DNA, 25 bp, Homo sapien
ttaagttgtcccaattgtcttcagc

SEQ ID NO: 368849 - DNA, 25 bp, Homo sapien
ctgctttcacttaggccttttggaa

SEQ ID NO: 368850 - DNA, 25 bp, Homo sapien
ggaaagttctctactgacatgccca

SEQ ID NO: 368851 - DNA, 25 bp, Homo sapien
tactgacatgcccactctgtgggaa

SEQ ID NO: 368852 - DNA, 25 bp, Homo sapien
gtgggaagccacttgtcatgaagaa

SEQ ID NO: 368853 - DNA, 25 bp, Homo sapien
atacattgcagcttcatgaatgcat

SEQ ID NO: 368854 - DNA, 25 bp, Homo sapien
cattgcagcttcatgaatgcattaa

SEQ ID NO: 368855 - DNA, 25 bp, Homo sapien
gcagcttcatgaatgcattaagaaa

SEQ ID NO: 368856 - DNA, 25 bp, Homo sapien
tgaatgcattaagaaagctatgctg

SEQ ID NO: 368857 - DNA, 25 bp, Homo sapien
tgtaatcccaggtacccggcagggt

SEQ ID NO: 368858 - DNA, 25 bp, Homo sapien
gtaatcccaggtacccggcagggtg

SEQ ID NO: 368859 - DNA, 25 bp, Homo sapien
taatcccaggtacccggcagggtga

SEQ ID NO: 368860 - DNA, 25 bp, Homo sapien
gtgagcccatatcgtactgctgcag

SEQ ID NO: 368861 - DNA, 25 bp, Homo sapien
tgagcccatatcgtactgctgcagt

SEQ ID NO: 368862 - DNA, 25 bp, Homo sapien
gagcccatatcgtactgctgcagtc

SEQ ID NO: 368863 - DNA, 25 bp, Homo sapien
agcccatatcgtactgctgcagtcc

SEQ ID NO: 368864 - DNA, 25 bp, Homo sapien
tgtaacttgcttctgatgtgggtcc

SEQ ID NO: 368865 - DNA, 25 bp, Homo sapien
aacttgcttctgatgtgggtcccta

SEQ ID NO: 368866 - DNA, 25 bp, Homo sapien
ttgcttctgatgtgggtccctaacc

SEQ ID NO: 368867 - DNA, 25 bp, Homo sapien
ttctgatgtgggtccctaacctata

SEQ ID NO: 368868 - DNA, 25 bp, Homo sapien
gatgtgggtccctaacctataatct

SEQ ID NO: 368869 - DNA, 25 bp, Homo sapien
tgggtccctaacctataatctcagc

SEQ ID NO: 368870 - DNA, 25 bp, Homo sapien
tataatctcagcttccctaccctgg

SEQ ID NO: 368871 - DNA, 25 bp, Homo sapien
agcttccctaccctggactgaaggg

SEQ ID NO: 368872 - DNA, 25 bp, Homo sapien
tggactgaagggtctgcccatcccc

SEQ ID NO: 368873 - DNA, 25 bp, Homo sapien
cagcatgtcctgacctgtgcacggg

SEQ ID NO: 368874 - DNA, 25 bp, Homo sapien
cccactaaaccatctgacaacatta

SEQ ID NO: 368875 - DNA, 25 bp, Homo sapien
atgaagtttcacaacctcagcactg

SEQ ID NO: 368876 - DNA, 25 bp, Homo sapien
aagtttcacaacctcagcactgttg

SEQ ID NO: 368877 - DNA, 25 bp, Homo sapien
ttcacaacctcagcactgttggtgt

SEQ ID NO: 368878 - DNA, 25 bp, Homo sapien
taattgtttgttgtgggagactgtc

SEQ ID NO: 368879 - DNA, 25 bp, Homo sapien
ctctacccctacatgcaagtagtac

SEQ ID NO: 368880 - DNA, 25 bp, Homo sapien
aaccacaatcccacaaccaaaaatg

SEQ ID NO: 368881 - DNA, 25 bp, Homo sapien
cattgtcaagtgtctcctggttagg

SEQ ID NO: 368882 - DNA, 25 bp, Homo sapien
gtcaagtgtctcctggttagggaaa

SEQ ID NO: 368883 - DNA, 25 bp, Homo sapien
ccccaggtaagaccactgctataga

SEQ ID NO: 368884 - DNA, 25 bp, Homo sapien
ggtaagaccactgctatagagaaat

SEQ ID NO: 368885 - DNA, 25 bp, Homo sapien
cactgctatagagaaatactacctt

SEQ ID NO: 368886 - DNA, 25 bp, Homo sapien
gggcggtggcgttgagatgggaatt

SEQ ID NO: 368887 - DNA, 25 bp, Homo sapien
gaattgggaattgcaccggtggtct

SEQ ID NO: 368888 - DNA, 25 bp, Homo sapien
attgggaattgcaccggtggtctca

SEQ ID NO: 368889 - DNA, 25 bp, Homo sapien
attgcaccggtggtctcaggaggat

SEQ ID NO: 368890 - DNA, 25 bp, Homo sapien
gtggtctcaggaggatggaaaaccc

SEQ ID NO: 368891 - DNA, 25 bp, Homo sapien
gcaaagggaccgcagtttaacagaa

SEQ ID NO: 368892 - DNA, 25 bp, Homo sapien
ggctgcaccgagtggtcaggacatt

SEQ ID NO: 368893 - DNA, 25 bp, Homo sapien
accgagtggtcaggacattgaggcc

SEQ ID NO: 368894 - DNA, 25 bp, Homo sapien
ggtcaggacattgaggccgggtcag

SEQ ID NO: 368895 - DNA, 25 bp, Homo sapien
gccgggtcagggagcgtgagatacc

SEQ ID NO: 368896 - DNA, 25 bp, Homo sapien
tgagataccgggacgagcgggccca

SEQ ID NO: 368897 - DNA, 25 bp, Homo sapien
gagttgagaatctctttaatgcatt

SEQ ID NO: 368898 - DNA, 25 bp, Homo sapien
tacaatggtgataagttacttcaat

SEQ ID NO: 368899 - DNA, 25 bp, Homo sapien
aattattttataaggctgttgctat

SEQ ID NO: 368900 - DNA, 25 bp, Homo sapien
aaggctgttgctattgaaagatcaa

SEQ ID NO: 368901 - DNA, 25 bp, Homo sapien
gatcaattttgtctttacctgcatt

SEQ ID NO: 368902 - DNA, 25 bp, Homo sapien
caattttgtctttacctgcatttaa

SEQ ID NO: 368903 - DNA, 25 bp, Homo sapien
ttaaaatggaacagctcttagcagc

SEQ ID NO: 368904 - DNA, 25 bp, Homo sapien
cagctcttagcagctgtggtttttt

SEQ ID NO: 368905 - DNA, 25 bp, Homo sapien
tttaaatttgttggctcttaagatg

SEQ ID NO: 368906 - DNA, 25 bp, Homo sapien
aagtttataggtgcatctgcctcct

SEQ ID NO: 368907 - DNA, 25 bp, Homo sapien
tgcctcctcttctctaagaatatgc

SEQ ID NO: 368908 - DNA, 25 bp, Homo sapien
atcataagcacctcaacacttgaat

SEQ ID NO: 368909 - DNA, 25 bp, Homo sapien
aaagctggtagccttgaaaatgtca

SEQ ID NO: 368910 - DNA, 25 bp, Homo sapien
atgtcagtgtgatatctattatgta

SEQ ID NO: 368911 - DNA, 25 bp, Homo sapien
atagtggcctttcaggactgtcaca

SEQ ID NO: 368912 - DNA, 25 bp, Homo sapien
ggactgtcacagtaacactttattt

SEQ ID NO: 368913 - DNA, 25 bp, Homo sapien
cagagctaatgtttgtcctaaattt

SEQ ID NO: 368914 - DNA, 25 bp, Homo sapien
tcctaaattttcaggaccctagagg

SEQ ID NO: 368915 - DNA, 25 bp, Homo sapien
ggaccctagaggagagctttataca

SEQ ID NO: 368916 - DNA, 25 bp, Homo sapien
ggagagctttatacaattaccgatg

SEQ ID NO: 368917 - DNA, 25 bp, Homo sapien
attaccgatgtgaatttctctaaag

SEQ ID NO: 368918 - DNA, 25 bp, Homo sapien
gtgtatatttttgtgtccagttata

SEQ ID NO: 368919 - DNA, 25 bp, Homo sapien
agactcgacggcgggagaagtaacg

SEQ ID NO: 368920 - DNA, 25 bp, Homo sapien
gaggcccaggccgaggtagagatgc

SEQ ID NO: 368921 - DNA, 25 bp, Homo sapien
ggcccaggccgaggtagagatgcag

SEQ ID NO: 368922 - DNA, 25 bp, Homo sapien
gcgaaagccgagaagacgaagccca

SEQ ID NO: 368923 - DNA, 25 bp, Homo sapien
cgaaagccgagaagacgaagcccag

SEQ ID NO: 368924 - DNA, 25 bp, Homo sapien
ccgccagccgaaagtatcgagaaga

SEQ ID NO: 368925 - DNA, 25 bp, Homo sapien
ccgaaagtatcgagaagaagctgca

SEQ ID NO: 368926 - DNA, 25 bp, Homo sapien
aagtatcgagaagaagctgcaaggc

SEQ ID NO: 368927 - DNA, 25 bp, Homo sapien
agaagaagctgcaaggcgggcgcca

SEQ ID NO: 368928 - DNA, 25 bp, Homo sapien
aagaagctgcaaggcgggcgccagg

SEQ ID NO: 368929 - DNA, 25 bp, Homo sapien
gaggaggccccgttgccggtgagcg

SEQ ID NO: 368930 - DNA, 25 bp, Homo sapien
gaccttgcttgagaaggctgacctg

SEQ ID NO: 368931 - DNA, 25 bp, Homo sapien
tggacccctccctggatttcatgga

SEQ ID NO: 368932 - DNA, 25 bp, Homo sapien
atttcatggactccttggagcatga

SEQ ID NO: 368933 - DNA, 25 bp, Homo sapien
gactccttggagcatgacattccca

SEQ ID NO: 368934 - DNA, 25 bp, Homo sapien
tggagcatgacattcccaaagggtc

SEQ ID NO: 368935 - DNA, 25 bp, Homo sapien
aagaactatggctacgtctacgtgg

SEQ ID NO: 368936 - DNA, 25 bp, Homo sapien
gctacgtctacgtgggcactggcga

SEQ ID NO: 368937 - DNA, 25 bp, Homo sapien
tacgtgggcactggcgagaagaaca

SEQ ID NO: 368938 - DNA, 25 bp, Homo sapien
ggacttgcccttcatgctatagaat

SEQ ID NO: 368939 - DNA, 25 bp, Homo sapien
gctatagaatgggagccagcctgga

SEQ ID NO: 368940 - DNA, 25 bp, Homo sapien
gagtctaaacatgattttcttaagc

SEQ ID NO: 368941 - DNA, 25 bp, Homo sapien
tataagaagtcctcttgagcaccct

SEQ ID NO: 368942 - DNA, 25 bp, Homo sapien
ttgagcaccctcttatggataaccc

SEQ ID NO: 368943 - DNA, 25 bp, Homo sapien
tatggataaccctccgtcattgatg

SEQ ID NO: 368944 - DNA, 25 bp, Homo sapien
ctccgtcattgatgctttgtgttca

SEQ ID NO: 368945 - DNA, 25 bp, Homo sapien
gtgttcatccttattacaactcttt

SEQ ID NO: 368946 - DNA, 25 bp, Homo sapien
tctttacatgccactctttgactat

SEQ ID NO: 368947 - DNA, 25 bp, Homo sapien
gtgtgattctagtggtctctggcaa

SEQ ID NO: 368948 - DNA, 25 bp, Homo sapien
gtctctggcaagatggcacagacaa

SEQ ID NO: 368949 - DNA, 25 bp, Homo sapien
tgctttgttcctgtggtattctaaa

SEQ ID NO: 368950 - DNA, 25 bp, Homo sapien
tggaattgagttcacctaacagcat

SEQ ID NO: 368951 - DNA, 25 bp, Homo sapien
agcatccaatacaaacacctcactt

SEQ ID NO: 368952 - DNA, 25 bp, Homo sapien
gaaaaggtggctgggctcggtgtgc

SEQ ID NO: 368953 - DNA, 25 bp, Homo sapien
agagatttcaggatgggccactggc

SEQ ID NO: 368954 - DNA, 25 bp, Homo sapien
tcggtgtgcgctccaaccccggtag

SEQ ID NO: 368955 - DNA, 25 bp, Homo sapien
ccaaccccggtagcattagctgagt

SEQ ID NO: 368956 - DNA, 25 bp, Homo sapien
agcattagctgagtcacgcggcgag

SEQ ID NO: 368957 - DNA, 25 bp, Homo sapien
acgcggcgagcacacaacagatttg

SEQ ID NO: 368958 - DNA, 25 bp, Homo sapien
tttgtagcagctcatctgccatata

SEQ ID NO: 368959 - DNA, 25 bp, Homo sapien
cattgagttttttcattatcgtgta

SEQ ID NO: 368960 - DNA, 25 bp, Homo sapien
ttatcgtgtaaagtggaatcatgtc

SEQ ID NO: 368961 - DNA, 25 bp, Homo sapien
gtggaatcatgtcattcacctttac

SEQ ID NO: 368962 - DNA, 25 bp, Homo sapien
tttcaataaactgttcctttcctga

SEQ ID NO: 368963 - DNA, 25 bp, Homo sapien
tgacctcaggccctaggaagctgct

SEQ ID NO: 368964 - DNA, 25 bp, Homo sapien
agtgttgtcgcgatgtgagtgccca

SEQ ID NO: 368965 - DNA, 25 bp, Homo sapien
gtgagtgcccagcttaggatttgcc

SEQ ID NO: 368966 - DNA, 25 bp, Homo sapien
agcttaggatttgccctccaaagcc

SEQ ID NO: 368967 - DNA, 25 bp, Homo sapien
tgttcacctgctttactggcagatg

SEQ ID NO: 368968 - DNA, 25 bp, Homo sapien
ttactggcagatgaagcctagtcat

SEQ ID NO: 368969 - DNA, 25 bp, Homo sapien
gaagcctagtcatggttcaccaggg

SEQ ID NO: 368970 - DNA, 25 bp, Homo sapien
ggaataccaaactcgccctgcagat

SEQ ID NO: 368971 - DNA, 25 bp, Homo sapien
tcgccctgcagatcggtagtaattg

SEQ ID NO: 368972 - DNA, 25 bp, Homo sapien
ggaaacaggagaggcctctaccgct

SEQ ID NO: 368973 - DNA, 25 bp, Homo sapien
ggagaggcctctaccgctgaaaagc

SEQ ID NO: 368974 - DNA, 25 bp, Homo sapien
gaataaactgacaccccagatgttc

SEQ ID NO: 368975 - DNA, 25 bp, Homo sapien
accccagatgttccagcagctgatg

SEQ ID NO: 368976 - DNA, 25 bp, Homo sapien
gatgaagcaagtgacgcagctggcc

SEQ ID NO: 368977 - DNA, 25 bp, Homo sapien
cgcagctggccatcgacaccgagga

SEQ ID NO: 368978 - DNA, 25 bp, Homo sapien
attgacctcatttttgagaaggcca

SEQ ID NO: 368979 - DNA, 25 bp, Homo sapien
gagaaggccatttcagagcccaact

SEQ ID NO: 368980 - DNA, 25 bp, Homo sapien
gtgccgctgcctcatggcgctgaaa

SEQ ID NO: 368981 - DNA, 25 bp, Homo sapien
ggcgctgaaagtgcccactacggaa

SEQ ID NO: 368982 - DNA, 25 bp, Homo sapien
gactgtgaacttccgaaagctgttg

SEQ ID NO: 368983 - DNA, 25 bp, Homo sapien
tgaacttccgaaagctgttgttgaa

SEQ ID NO: 368984 - DNA, 25 bp, Homo sapien
gttgaatcgatgtcagaaggagttt

SEQ ID NO: 368985 - DNA, 25 bp, Homo sapien
caaggagttttcagtcgggaggaca

SEQ ID NO: 368986 - DNA, 25 bp, Homo sapien
ttttcagtcgggaggacaactgact

SEQ ID NO: 368987 - DNA, 25 bp, Homo sapien
tcgggaggacaactgactggcaaac

SEQ ID NO: 368988 - DNA, 25 bp, Homo sapien
cgggaggacaactgactggcaaaca

SEQ ID NO: 368989 - DNA, 25 bp, Homo sapien
gggaggacaactgactggcaaacaa

SEQ ID NO: 368990 - DNA, 25 bp, Homo sapien
ggaggacaactgactggcaaacaac

SEQ ID NO: 368991 - DNA, 25 bp, Homo sapien
gaggacaactgactggcaaacaact

SEQ ID NO: 368992 - DNA, 25 bp, Homo sapien
ggacaactgactggcaaacaactaa

SEQ ID NO: 368993 - DNA, 25 bp, Homo sapien
acaactgactggcaaacaactaaat

SEQ ID NO: 368994 - DNA, 25 bp, Homo sapien
actgactggcaaacaactaaataaa

SEQ ID NO: 368995 - DNA, 25 bp, Homo sapien
tacaggaattaactgaaacagggat

SEQ ID NO: 368996 - DNA, 25 bp, Homo sapien
ttggattttttcactggcagaagag

SEQ ID NO: 368997 - DNA, 25 bp, Homo sapien
aaaactctgacatttcataggttca

SEQ ID NO: 368998 - DNA, 25 bp, Homo sapien
cataggttcagttatccttggctaa

SEQ ID NO: 368999 - DNA, 25 bp, Homo sapien
ggttcagttatccttggctaaatta

SEQ ID NO: 369000 - DNA, 25 bp, Homo sapien
cttggctaaattatgaggtatgact

SEQ ID NO: 369001 - DNA, 25 bp, Homo sapien
gaggtatgactatttgagctttaca

SEQ ID NO: 369002 - DNA, 25 bp, Homo sapien
gactatttgagctttacatttatta

SEQ ID NO: 369003 - DNA, 25 bp, Homo sapien
gggtttttatgaagttctgcatggc

SEQ ID NO: 369004 - DNA, 25 bp, Homo sapien
tgaagttctgcatggctttgtattc

SEQ ID NO: 369005 - DNA, 25 bp, Homo sapien
tgccctaatagatttccataaacag

SEQ ID NO: 369006 - DNA, 25 bp, Homo sapien
ggttttggaactgaatattgcattg

SEQ ID NO: 369007 - DNA, 25 bp, Homo sapien
atgcgcgcggacttggcccaaaacg

SEQ ID NO: 369008 - DNA, 25 bp, Homo sapien
tgcgcgcggacttggcccaaaacgt

SEQ ID NO: 369009 - DNA, 25 bp, Homo sapien
gcgcgcggacttggcccaaaacgtg

SEQ ID NO: 369010 - DNA, 25 bp, Homo sapien
gcggacttggcccaaaacgtgcttc

SEQ ID NO: 369011 - DNA, 25 bp, Homo sapien
cggacttggcccaaaacgtgcttct

SEQ ID NO: 369012 - DNA, 25 bp, Homo sapien
ggtgggtcctcgctcttcaccggct

SEQ ID NO: 369013 - DNA, 25 bp, Homo sapien
gtgggtcctcgctcttcaccggctt

SEQ ID NO: 369014 - DNA, 25 bp, Homo sapien
tgcgcgccttccagtcctgctgggt

SEQ ID NO: 369015 - DNA, 25 bp, Homo sapien
ccttccagtcctgctgggtcctgcg

SEQ ID NO: 369016 - DNA, 25 bp, Homo sapien
gggctgtcacccgtcggcctctcca

SEQ ID NO: 369017 - DNA, 25 bp, Homo sapien
tcggcctctccaccatggccaagca

SEQ ID NO: 369018 - DNA, 25 bp, Homo sapien
ggtggccctggtcgctggaaggaaa

SEQ ID NO: 369019 - DNA, 25 bp, Homo sapien
ggaaaggtgaccacagacccagcgc

SEQ ID NO: 369020 - DNA, 25 bp, Homo sapien
gcccagtgccttcactgtggtcatg

SEQ ID NO: 369021 - DNA, 25 bp, Homo sapien
tgtccccagggaaatcctgagaaat

SEQ ID NO: 369022 - DNA, 25 bp, Homo sapien
aaatggaatttctcctggatcatgg

SEQ ID NO: 369023 - DNA, 25 bp, Homo sapien
atttctcctggatcatggtggcaga

SEQ ID NO: 369024 - DNA, 25 bp, Homo sapien
gggctgcatttagtgtccatgtcct

SEQ ID NO: 369025 - DNA, 25 bp, Homo sapien
ttagtgtccatgtccttagattcag

SEQ ID NO: 369026 - DNA, 25 bp, Homo sapien
gtgtccatgtccttagattcagatg

SEQ ID NO: 369027 - DNA, 25 bp, Homo sapien
gtccttagattcagatggcaacatg

SEQ ID NO: 369028 - DNA, 25 bp, Homo sapien
tcagatggcaacatggtccagtaac

SEQ ID NO: 369029 - DNA, 25 bp, Homo sapien
ggaatacacatctactaatcacaat

SEQ ID NO: 369030 - DNA, 25 bp, Homo sapien
aaacatcattgctttctggaggtag

SEQ ID NO: 369031 - DNA, 25 bp, Homo sapien
acttgaaggttgtagttccaggcaa

SEQ ID NO: 369032 - DNA, 25 bp, Homo sapien
agttccaggcaattttgtgcccttg

SEQ ID NO: 369033 - DNA, 25 bp, Homo sapien
gtgcccttgaggtgtccaattgata

SEQ ID NO: 369034 - DNA, 25 bp, Homo sapien
aattgatagtatagcttgcctctgc

SEQ ID NO: 369035 - DNA, 25 bp, Homo sapien
gtatagcttgcctctgctaataaat

SEQ ID NO: 369036 - DNA, 25 bp, Homo sapien
acacaaaagttttctttcctgtgat

SEQ ID NO: 369037 - DNA, 25 bp, Homo sapien
ggaatatgtgatgtttatctcctgc

SEQ ID NO: 369038 - DNA, 25 bp, Homo sapien
gtttatctcctgcatttcaaaatct

SEQ ID NO: 369039 - DNA, 25 bp, Homo sapien
cctgcatttcaaaatcttctggatt

SEQ ID NO: 369040 - DNA, 25 bp, Homo sapien
tgggcagatcgacccctgacctaat

SEQ ID NO: 369041 - DNA, 25 bp, Homo sapien
ctgacctaatcggttatgttatcga

SEQ ID NO: 369042 - DNA, 25 bp, Homo sapien
gttatcgattacagacattggatag

SEQ ID NO: 369043 - DNA, 25 bp, Homo sapien
cactgtgaaaatccctatcctgttt

SEQ ID NO: 369044 - DNA, 25 bp, Homo sapien
tccctatcctgttttgttcagatcg

SEQ ID NO: 369045 - DNA, 25 bp, Homo sapien
ctatcctgttttgttcagatcgaat

SEQ ID NO: 369046 - DNA, 25 bp, Homo sapien
cctgttttgttcagatcgaattacc

SEQ ID NO: 369047 - DNA, 25 bp, Homo sapien
cagatcgaattaccggtgcatgcag

SEQ ID NO: 369048 - DNA, 25 bp, Homo sapien
cagacacgtaccctctgcttgctca

SEQ ID NO: 369049 - DNA, 25 bp, Homo sapien
gagcttggcttttgagacaggagtc

SEQ ID NO: 369050 - DNA, 25 bp, Homo sapien
acaggagtcttgccaatgcccccag

SEQ ID NO: 369051 - DNA, 25 bp, Homo sapien
ggcccaccagagatctacttcctat

SEQ ID NO: 369052 - DNA, 25 bp, Homo sapien
caccagagatctacttcctatttct

SEQ ID NO: 369053 - DNA, 25 bp, Homo sapien
acttcctatttcttcagtgatcaag

SEQ ID NO: 369054 - DNA, 25 bp, Homo sapien
cttcagtgatcaagaagctgctggg

SEQ ID NO: 369055 - DNA, 25 bp, Homo sapien
gtcgggtactggctccaggattact

SEQ ID NO: 369056 - DNA, 25 bp, Homo sapien
ctccaggattactccagtattgtat

SEQ ID NO: 369057 - DNA, 25 bp, Homo sapien
gattactccagtattgtattacagc

SEQ ID NO: 369058 - DNA, 25 bp, Homo sapien
tccagtattgtattacagcaggagt

SEQ ID NO: 369059 - DNA, 25 bp, Homo sapien
gatagcgagctagtgtttgtattct

SEQ ID NO: 369060 - DNA, 25 bp, Homo sapien
gcgagctagtgtttgtattcttgat

SEQ ID NO: 369061 - DNA, 25 bp, Homo sapien
gctagtgtttgtattcttgatgaaa

SEQ ID NO: 369062 - DNA, 25 bp, Homo sapien
aaagacatttcatttccaggctgcc

SEQ ID NO: 369063 - DNA, 25 bp, Homo sapien
gccttcccagattctcagtctgtga

SEQ ID NO: 369064 - DNA, 25 bp, Homo sapien
gacagaacaccaagctaccaggaag

SEQ ID NO: 369065 - DNA, 25 bp, Homo sapien
agggcacctgcctcctagatcggaa

SEQ ID NO: 369066 - DNA, 25 bp, Homo sapien
tagatcggaatcttcgtccattcgc

SEQ ID NO: 369067 - DNA, 25 bp, Homo sapien
tcgtccattcgcacttaggtgatca

SEQ ID NO: 369068 - DNA, 25 bp, Homo sapien
taggtgatcacttgccttcgagagc

SEQ ID NO: 369069 - DNA, 25 bp, Homo sapien
ttcgagagccccatccagaagacgg

SEQ ID NO: 369070 - DNA, 25 bp, Homo sapien
ggacctccccagtggttgctcacag

SEQ ID NO: 369071 - DNA, 25 bp, Homo sapien
gacgggagtaatgagccctgctctg

SEQ ID NO: 369072 - DNA, 25 bp, Homo sapien
ctcacagtcctgagccttaggataa

SEQ ID NO: 369073 - DNA, 25 bp, Homo sapien
ggaaaagtctatactgaagtgaacc

SEQ ID NO: 369074 - DNA, 25 bp, Homo sapien
gaagtgaaccctacactgttattca

SEQ ID NO: 369075 - DNA, 25 bp, Homo sapien
gttattcaagttgccttaacacatt

SEQ ID NO: 369076 - DNA, 25 bp, Homo sapien
gctttaacagattattgtggtcaca

SEQ ID NO: 369077 - DNA, 25 bp, Homo sapien
gtggtcacactgtattactaatagt

SEQ ID NO: 369078 - DNA, 25 bp, Homo sapien
taagttacatcttcagaaagtcctg

SEQ ID NO: 369079 - DNA, 25 bp, Homo sapien
gaaagtcctgaagtccttcagtatt

SEQ ID NO: 369080 - DNA, 25 bp, Homo sapien
atagaacaccttcactctgcataat

SEQ ID NO: 369081 - DNA, 25 bp, Homo sapien
ccttcactctgcataatcctacata

SEQ ID NO: 369082 - DNA, 25 bp, Homo sapien
gcataatcctacataacaacattct

SEQ ID NO: 369083 - DNA, 25 bp, Homo sapien
acaacattcttgtcttctagtacat

SEQ ID NO: 369084 - DNA, 25 bp, Homo sapien
gcagctgtgtgcagttttcacttta

SEQ ID NO: 369085 - DNA, 25 bp, Homo sapien
gtgtgcagttttcactttaccttaa

SEQ ID NO: 369086 - DNA, 25 bp, Homo sapien
tcactttaccttaaaagcctctcct

SEQ ID NO: 369087 - DNA, 25 bp, Homo sapien
tgagttctcgactgaaattcgcccc

SEQ ID NO: 369088 - DNA, 25 bp, Homo sapien
tcgactgaaattcgcccctgggcgt

SEQ ID NO: 369089 - DNA, 25 bp, Homo sapien
tgaaattcgcccctgggcgtcaggc

SEQ ID NO: 369090 - DNA, 25 bp, Homo sapien
ggcgtcaggcaagcgggtcttccca

SEQ ID NO: 369091 - DNA, 25 bp, Homo sapien
caggcaagcgggtcttcccaacaga

SEQ ID NO: 369092 - DNA, 25 bp, Homo sapien
ttcccaacagaagtgggcagggccc

SEQ ID NO: 369093 - DNA, 25 bp, Homo sapien
tcaccacgccattctttatgcctgt

SEQ ID NO: 369094 - DNA, 25 bp, Homo sapien
tttatgcctgtcttggcggcgcctc

SEQ ID NO: 369095 - DNA, 25 bp, Homo sapien
aaaaattcatctgcgttcgttctcc

SEQ ID NO: 369096 - DNA, 25 bp, Homo sapien
atctgcgttcgttctcccaggagtg

SEQ ID NO: 369097 - DNA, 25 bp, Homo sapien
gagtgctccagggaaccacaggctt

SEQ ID NO: 369098 - DNA, 25 bp, Homo sapien
ttcccggcacttgaaggctgaactg

SEQ ID NO: 369099 - DNA, 25 bp, Homo sapien
tgaactgagcgtgagtgccctggtc

SEQ ID NO: 369100 - DNA, 25 bp, Homo sapien
cctggtccccaggaagcaggcggat

SEQ ID NO: 369101 - DNA, 25 bp, Homo sapien
atgctgcaggaaggcggcacaaagc

SEQ ID NO: 369102 - DNA, 25 bp, Homo sapien
acaaagcctgcatccgggagggccc

SEQ ID NO: 369103 - DNA, 25 bp, Homo sapien
gacagactgcatccaggagggcaca

SEQ ID NO: 369104 - DNA, 25 bp, Homo sapien
aggagggcacagtgacctgtcactc

SEQ ID NO: 369105 - DNA, 25 bp, Homo sapien
ctgtcactccgttctgcagaaattg

SEQ ID NO: 369106 - DNA, 25 bp, Homo sapien
atgttgtctgttggcctaatttttt

SEQ ID NO: 369107 - DNA, 25 bp, Homo sapien
gtgggaaaaaatattgcagaacctt

SEQ ID NO: 369108 - DNA, 25 bp, Homo sapien
ttgcagaaccttttagtagagctag

SEQ ID NO: 369109 - DNA, 25 bp, Homo sapien
atagagcaccagagtttgttccaac

SEQ ID NO: 369110 - DNA, 25 bp, Homo sapien
gcaccagagtttgttccaacgggaa

SEQ ID NO: 369111 - DNA, 25 bp, Homo sapien
ctgtctcttgtatgtcgtttttctt

SEQ ID NO: 369112 - DNA, 25 bp, Homo sapien
aaatttaagtcatacctcccacagt

SEQ ID NO: 369113 - DNA, 25 bp, Homo sapien
taagtcatacctcccacagtcagtt

SEQ ID NO: 369114 - DNA, 25 bp, Homo sapien
cccacagtcagtttctggtcactac

SEQ ID NO: 369115 - DNA, 25 bp, Homo sapien
tggtcactactatctccctgtcact

SEQ ID NO: 369116 - DNA, 25 bp, Homo sapien
cattacctacttccttccaaaatat

SEQ ID NO: 369117 - DNA, 25 bp, Homo sapien
ggaaagctcagcacaacccagaagt

SEQ ID NO: 369118 - DNA, 25 bp, Homo sapien
acaacccagaagtgcatgtcagagc

SEQ ID NO: 369119 - DNA, 25 bp, Homo sapien
gcagagcctgtccagggctgtccct

SEQ ID NO: 369120 - DNA, 25 bp, Homo sapien
agggctgtccctgcaactacagggc

SEQ ID NO: 369121 - DNA, 25 bp, Homo sapien
tagggagttcctagaagagaagctg

SEQ ID NO: 369122 - DNA, 25 bp, Homo sapien
gctccctcctgcaaagtgacacgta

SEQ ID NO: 369123 - DNA, 25 bp, Homo sapien
gtgacacgtaccaaatcttgcagcc

SEQ ID NO: 369124 - DNA, 25 bp, Homo sapien
acgtaccaaatcttgcagccaacaa

SEQ ID NO: 369125 - DNA, 25 bp, Homo sapien
tcttgcagccaacaagctatctttg

SEQ ID NO: 369126 - DNA, 25 bp, Homo sapien
caagctatctttgttggccagaatt

SEQ ID NO: 369127 - DNA, 25 bp, Homo sapien
gatagatatcacctgtccccaagag

SEQ ID NO: 369128 - DNA, 25 bp, Homo sapien
aagtgtggtccaagggccagcgcaa

SEQ ID NO: 369129 - DNA, 25 bp, Homo sapien
ggccagcgcaagtccacaaactgtt

SEQ ID NO: 369130 - DNA, 25 bp, Homo sapien
ggtttccaaagagcttccacatcta

SEQ ID NO: 369131 - DNA, 25 bp, Homo sapien
cacatctaagctcccatttgatctt

SEQ ID NO: 369132 - DNA, 25 bp, Homo sapien
ttgatcttctccagagtcctacaag

SEQ ID NO: 369133 - DNA, 25 bp, Homo sapien
gtcctacaaggattcacatgtgggt

SEQ ID NO: 369134 - DNA, 25 bp, Homo sapien
gggttctgcagctaacttcttacaa

SEQ ID NO: 369135 - DNA, 25 bp, Homo sapien
aatagatgtgcccatctgaggacca

SEQ ID NO: 369136 - DNA, 25 bp, Homo sapien
aaagactgtgcattttcctataaga

SEQ ID NO: 369137 - DNA, 25 bp, Homo sapien
ttttcctataagagaccgtgtcatc

SEQ ID NO: 369138 - DNA, 25 bp, Homo sapien
caatgtcactcgaagtgtggtccaa

SEQ ID NO: 369139 - DNA, 25 bp, Homo sapien
tggcaaatcctcctacccaaaaagg

SEQ ID NO: 369140 - DNA, 25 bp, Homo sapien
agagacctagactggatacgaacta

SEQ ID NO: 369141 - DNA, 25 bp, Homo sapien
atacgaactagcagtacttccttcc

SEQ ID NO: 369142 - DNA, 25 bp, Homo sapien
agtacttccttcctgactgtgactc

SEQ ID NO: 369143 - DNA, 25 bp, Homo sapien
tgactgtgactcctactacctgcca

SEQ ID NO: 369144 - DNA, 25 bp, Homo sapien
gactcagactcggacatggtcagtg

SEQ ID NO: 369145 - DNA, 25 bp, Homo sapien
cttgctctgcgctgggatcatactc

SEQ ID NO: 369146 - DNA, 25 bp, Homo sapien
tcatactcccaaatcacattactaa

SEQ ID NO: 369147 - DNA, 25 bp, Homo sapien
gagaggagacgccatcctatggatt

SEQ ID NO: 369148 - DNA, 25 bp, Homo sapien
gacgccatcctatggattcatactc

SEQ ID NO: 369149 - DNA, 25 bp, Homo sapien
ggattcatactcaccagagggcaac

SEQ ID NO: 369150 - DNA, 25 bp, Homo sapien
acacacacaatctgtatgatgattt

SEQ ID NO: 369151 - DNA, 25 bp, Homo sapien
ggagttgtagacatcacagatcaaa

SEQ ID NO: 369152 - DNA, 25 bp, Homo sapien
tcaaaagtggcctggtgctagctgt

SEQ ID NO: 369153 - DNA, 25 bp, Homo sapien
ctggtgctagctgtttgggtatatc

SEQ ID NO: 369154 - DNA, 25 bp, Homo sapien
tagctgtttgggtatatccttgaaa

SEQ ID NO: 369155 - DNA, 25 bp, Homo sapien
aaagggcaactttgtcatttcctag

SEQ ID NO: 369156 - DNA, 25 bp, Homo sapien
ctttgtcatttcctagagtaaccta

SEQ ID NO: 369157 - DNA, 25 bp, Homo sapien
gagtaacctagagagagatttccaa

SEQ ID NO: 369158 - DNA, 25 bp, Homo sapien
aaggctgtgacttttaggccaaaat

SEQ ID NO: 369159 - DNA, 25 bp, Homo sapien
agagagatttccaagcatttcccca

SEQ ID NO: 369160 - DNA, 25 bp, Homo sapien
tttccaagcatttccccatgaacag

SEQ ID NO: 369161 - DNA, 25 bp, Homo sapien
gaacgccgggacagaccgacagacg

SEQ ID NO: 369162 - DNA, 25 bp, Homo sapien
agtcccaaagtttccaggcatcagg

SEQ ID NO: 369163 - DNA, 25 bp, Homo sapien
acgccgggacagaccgacagacgga

SEQ ID NO: 369164 - DNA, 25 bp, Homo sapien
ccgggacagaccgacagacggactg

SEQ ID NO: 369165 - DNA, 25 bp, Homo sapien
acagaccgacagacggactggccgg

SEQ ID NO: 369166 - DNA, 25 bp, Homo sapien
tcagggcttcatcccactccgtggg

SEQ ID NO: 369167 - DNA, 25 bp, Homo sapien
actccgtgggcctgatctccctggg

SEQ ID NO: 369168 - DNA, 25 bp, Homo sapien
gggcacctgggatgtccatctgcgt

SEQ ID NO: 369169 - DNA, 25 bp, Homo sapien
gcacctgggatgtccatctgcgtta

SEQ ID NO: 369170 - DNA, 25 bp, Homo sapien
acctgggatgtccatctgcgttagc

SEQ ID NO: 369171 - DNA, 25 bp, Homo sapien
ctgggatgtccatctgcgttagctg

SEQ ID NO: 369172 - DNA, 25 bp, Homo sapien
aggattgtggctaaatttgcttcta

SEQ ID NO: 369173 - DNA, 25 bp, Homo sapien
ggctaaatttgcttctagctgttta

SEQ ID NO: 369174 - DNA, 25 bp, Homo sapien
gcttctagctgtttaattactctta

SEQ ID NO: 369175 - DNA, 25 bp, Homo sapien
tgcttcttcaagtagttccaaggaa

SEQ ID NO: 369176 - DNA, 25 bp, Homo sapien
gagctatttcagtcttttgcaggta

SEQ ID NO: 369177 - DNA, 25 bp, Homo sapien
ttcagtcttttgcaggtatctaacc

SEQ ID NO: 369178 - DNA, 25 bp, Homo sapien
ggtatctaaccttgccatgaaaaag

SEQ ID NO: 369179 - DNA, 25 bp, Homo sapien
gaaatcttgctttttcagcgaagct

SEQ ID NO: 369180 - DNA, 25 bp, Homo sapien
tcagcgaagctagattgtataattt

SEQ ID NO: 369181 - DNA, 25 bp, Homo sapien
tattagttttctccacctggtaaca

SEQ ID NO: 369182 - DNA, 25 bp, Homo sapien
tccacctggtaacacatccttaaga

SEQ ID NO: 369183 - DNA, 25 bp, Homo sapien
gaggagtgcatgtataccccagaga

SEQ ID NO: 369184 - DNA, 25 bp, Homo sapien
tgtataccccagagactagtgcact

SEQ ID NO: 369185 - DNA, 25 bp, Homo sapien
gagactagtgcactctaggataaaa

SEQ ID NO: 369186 - DNA, 25 bp, Homo sapien
aaaggagtcattcagcccttacttt

SEQ ID NO: 369187 - DNA, 25 bp, Homo sapien
cattcagcccttacttttggttgga

SEQ ID NO: 369188 - DNA, 25 bp, Homo sapien
agcccttacttttggttggatgcag

SEQ ID NO: 369189 - DNA, 25 bp, Homo sapien
ggatgcagggtgtagtttcaataaa

SEQ ID NO: 369190 - DNA, 25 bp, Homo sapien
tatttagctgttctgcataggcctt

SEQ ID NO: 369191 - DNA, 25 bp, Homo sapien
gctgttctgcataggcctttgagat

SEQ ID NO: 369192 - DNA, 25 bp, Homo sapien
ataagtaagataaattctccccaga

SEQ ID NO: 369193 - DNA, 25 bp, Homo sapien
tctccccagaaaccgcaaaacaatt

SEQ ID NO: 369194 - DNA, 25 bp, Homo sapien
ggtgtctttgtttacggcggcagat

SEQ ID NO: 369195 - DNA, 25 bp, Homo sapien
acggcggcagatgggaaatgactac

SEQ ID NO: 369196 - DNA, 25 bp, Homo sapien
caaataatcagatgtcttgtcgtct

SEQ ID NO: 369197 - DNA, 25 bp, Homo sapien
gactctcactgtagtcatccctgat

SEQ ID NO: 369198 - DNA, 25 bp, Homo sapien
agatgtcttgtcgtctgatcgttta

SEQ ID NO: 369199 - DNA, 25 bp, Homo sapien
ttgtcgtctgatcgtttaccggcat

SEQ ID NO: 369200 - DNA, 25 bp, Homo sapien
atcgtttaccggcatgctgttcatg

SEQ ID NO: 369201 - DNA, 25 bp, Homo sapien
gctgttcatgccatgctgactgtgt

SEQ ID NO: 369202 - DNA, 25 bp, Homo sapien
tcatccctgatttgaggctgggtcc

SEQ ID NO: 369203 - DNA, 25 bp, Homo sapien
tgcacccatccctgatcgaggctgg

SEQ ID NO: 369204 - DNA, 25 bp, Homo sapien
ctgatcgaggctggactctttggtg

SEQ ID NO: 369205 - DNA, 25 bp, Homo sapien
cagggaagacacagggaaatcatct

SEQ ID NO: 369206 - DNA, 25 bp, Homo sapien
gggaaatcatctttcgggaatttat

SEQ ID NO: 369207 - DNA, 25 bp, Homo sapien
atcatctttcgggaatttatctaag

SEQ ID NO: 369208 - DNA, 25 bp, Homo sapien
atctttcgggaatttatctaagaag

SEQ ID NO: 369209 - DNA, 25 bp, Homo sapien
gtaatttcccttaagatactacaga

SEQ ID NO: 369210 - DNA, 25 bp, Homo sapien
gatactacagaatttccaaggactt

SEQ ID NO: 369211 - DNA, 25 bp, Homo sapien
ctacagaatttccaaggacttgagg

SEQ ID NO: 369212 - DNA, 25 bp, Homo sapien
ggacttgaggaataattgcactctt

SEQ ID NO: 369213 - DNA, 25 bp, Homo sapien
aggaataattgcactcttgaaagag

SEQ ID NO: 369214 - DNA, 25 bp, Homo sapien
attgcactcttgaaagagcctatga

SEQ ID NO: 369215 - DNA, 25 bp, Homo sapien
gtaaatcgcaatctaccttgcacag

SEQ ID NO: 369216 - DNA, 25 bp, Homo sapien
gactgagcagttcttgtgagtgtaa

SEQ ID NO: 369217 - DNA, 25 bp, Homo sapien
tggctatagacttctctcagaagga

SEQ ID NO: 369218 - DNA, 25 bp, Homo sapien
gaatgggagtgcctggacactaccc

SEQ ID NO: 369219 - DNA, 25 bp, Homo sapien
agtgcctggacactacccagaggaa

SEQ ID NO: 369220 - DNA, 25 bp, Homo sapien
agaattataataacttggtctcact

SEQ ID NO: 369221 - DNA, 25 bp, Homo sapien
tggtctcactgggatattctggctc

SEQ ID NO: 369222 - DNA, 25 bp, Homo sapien
cactgggatattctggctcaaagcc

SEQ ID NO: 369223 - DNA, 25 bp, Homo sapien
ggaaagagccctgcgtggtggcgag

SEQ ID NO: 369224 - DNA, 25 bp, Homo sapien
agtgccccggtttgttatccaggca

SEQ ID NO: 369225 - DNA, 25 bp, Homo sapien
ccccggtttgttatccaggcataag

SEQ ID NO: 369226 - DNA, 25 bp, Homo sapien
tgttatccaggcataagaccaagaa

SEQ ID NO: 369227 - DNA, 25 bp, Homo sapien
tctgaactcctctgacttagcattc

SEQ ID NO: 369228 - DNA, 25 bp, Homo sapien
ctgaactcctctgacttagcattca

SEQ ID NO: 369229 - DNA, 25 bp, Homo sapien
tgaactcctctgacttagcattcaa

SEQ ID NO: 369230 - DNA, 25 bp, Homo sapien
gaactcctctgacttagcattcaac

SEQ ID NO: 369231 - DNA, 25 bp, Homo sapien
aactcctctgacttagcattcaact

SEQ ID NO: 369232 - DNA, 25 bp, Homo sapien
actcctctgacttagcattcaactt

SEQ ID NO: 369233 - DNA, 25 bp, Homo sapien
ctcctctgacttagcattcaactta

SEQ ID NO: 369234 - DNA, 25 bp, Homo sapien
tcctctgacttagcattcaacttaa

SEQ ID NO: 369235 - DNA, 25 bp, Homo sapien
ctctgacttagcattcaacttaagt

SEQ ID NO: 369236 - DNA, 25 bp, Homo sapien
ttagcattcaacttaagtcaagaaa

SEQ ID NO: 369237 - DNA, 25 bp, Homo sapien
gcattcaacttaagtcaagaaatac

SEQ ID NO: 369238 - DNA, 25 bp, Homo sapien
atgtgcttttgactgagggtggaaa

SEQ ID NO: 369239 - DNA, 25 bp, Homo sapien
gtggaaagtcagcagctgcagccca

SEQ ID NO: 369240 - DNA, 25 bp, Homo sapien
tgcagcccaagaagttagagccagg

SEQ ID NO: 369241 - DNA, 25 bp, Homo sapien
gggcagtgcctttgatgggaagctt

SEQ ID NO: 369242 - DNA, 25 bp, Homo sapien
gaaaataatcctgcgtgtgctcagc

SEQ ID NO: 369243 - DNA, 25 bp, Homo sapien
aataatcctgcgtgtgctcagccct

SEQ ID NO: 369244 - DNA, 25 bp, Homo sapien
tgtgctcagccctcactcagatcaa

SEQ ID NO: 369245 - DNA, 25 bp, Homo sapien
actcagatcaacagcccctcgggtc

SEQ ID NO: 369246 - DNA, 25 bp, Homo sapien
ctcgggtcccagctagatgtacttt

SEQ ID NO: 369247 - DNA, 25 bp, Homo sapien
gggtcccagctagatgtactttgta

SEQ ID NO: 369248 - DNA, 25 bp, Homo sapien
ggtcccagctagatgtactttgtag

SEQ ID NO: 369249 - DNA, 25 bp, Homo sapien
gtccctggcatcctggttcatatct

SEQ ID NO: 369250 - DNA, 25 bp, Homo sapien
tatatgcatcaccacgtagccagga

SEQ ID NO: 369251 - DNA, 25 bp, Homo sapien
atgcatcaccacgtagccaggaggg

SEQ ID NO: 369252 - DNA, 25 bp, Homo sapien
gggtttgagtcactgggatcttcct

SEQ ID NO: 369253 - DNA, 25 bp, Homo sapien
gtcactgggatcttcctggtgagag

SEQ ID NO: 369254 - DNA, 25 bp, Homo sapien
ggcatcctggttcatatctgtgttg

SEQ ID NO: 369255 - DNA, 25 bp, Homo sapien
agaagtcactgggcttagctgggcc

SEQ ID NO: 369256 - DNA, 25 bp, Homo sapien
ggttcatatctgtgttgctgactac

SEQ ID NO: 369257 - DNA, 25 bp, Homo sapien
gtgttgctgactacagtgtctgtga

SEQ ID NO: 369258 - DNA, 25 bp, Homo sapien
agtgtctgtgatgtccgcatgtcca

SEQ ID NO: 369259 - DNA, 25 bp, Homo sapien
atgtccgcatgtccaggcctgtttg

SEQ ID NO: 369260 - DNA, 25 bp, Homo sapien
ggagcagcctgggtctctgtcccag

SEQ ID NO: 369261 - DNA, 25 bp, Homo sapien
tttgcccaaggactaagctgttcgt

SEQ ID NO: 369262 - DNA, 25 bp, Homo sapien
aggactaagctgttcgtccacacgc

SEQ ID NO: 369263 - DNA, 25 bp, Homo sapien
atgggcattgcctggttctttctct

SEQ ID NO: 369264 - DNA, 25 bp, Homo sapien
agggcctcgggcgtacgcttaccag

SEQ ID NO: 369265 - DNA, 25 bp, Homo sapien
gtacgcttaccagcgactctatagt

SEQ ID NO: 369266 - DNA, 25 bp, Homo sapien
cgactctatagtctctctaggtcat

SEQ ID NO: 369267 - DNA, 25 bp, Homo sapien
agtctctctaggtcatagctttcat

SEQ ID NO: 369268 - DNA, 25 bp, Homo sapien
tttctcttgcagctgtcggaggaag

SEQ ID NO: 369269 - DNA, 25 bp, Homo sapien
gggagatcgtagatttgctgctgat

SEQ ID NO: 369270 - DNA, 25 bp, Homo sapien
gatttgctgctgatgaaaatactca

SEQ ID NO: 369271 - DNA, 25 bp, Homo sapien
aggagacgctcgagtctgcgtcccg

SEQ ID NO: 369272 - DNA, 25 bp, Homo sapien
ctcagcactgtccactgtttcggtg

SEQ ID NO: 369273 - DNA, 25 bp, Homo sapien
cactgtttcggtgccagcagagacc

SEQ ID NO: 369274 - DNA, 25 bp, Homo sapien
cagcaggcccgggacagttggtgtt

SEQ ID NO: 369275 - DNA, 25 bp, Homo sapien
acagttggtgtttggccgtgccgct

SEQ ID NO: 369276 - DNA, 25 bp, Homo sapien
gtgccgctgtctaacttggtgtgca

SEQ ID NO: 369277 - DNA, 25 bp, Homo sapien
ctgtctaacttggtgtgcagagtga

SEQ ID NO: 369278 - DNA, 25 bp, Homo sapien
tgcagagtgaattgccgctgccgga

SEQ ID NO: 369279 - DNA, 25 bp, Homo sapien
gggatttctgtcagcgccggcctcg

SEQ ID NO: 369280 - DNA, 25 bp, Homo sapien
gagctcggagacatgaacggcttca

SEQ ID NO: 369281 - DNA, 25 bp, Homo sapien
atgaacggcttcacgcctgacgaga

SEQ ID NO: 369282 - DNA, 25 bp, Homo sapien
aggcaatcgagcttaggccctgacc

SEQ ID NO: 369283 - DNA, 25 bp, Homo sapien
cgacctgagcctaggcgtctgacat

SEQ ID NO: 369284 - DNA, 25 bp, Homo sapien
taggcgtctgacatctggctccgtc

SEQ ID NO: 369285 - DNA, 25 bp, Homo sapien
tccctactgccttctttcaagggta

SEQ ID NO: 369286 - DNA, 25 bp, Homo sapien
tgccttctttcaagggtaagccctt

SEQ ID NO: 369287 - DNA, 25 bp, Homo sapien
caagggtaagcccttggtcacaagg

SEQ ID NO: 369288 - DNA, 25 bp, Homo sapien
actgactgggtcactatcactggca

SEQ ID NO: 369289 - DNA, 25 bp, Homo sapien
tgggtcactatcactggcagtaact

SEQ ID NO: 369290 - DNA, 25 bp, Homo sapien
taactgagttaaagagagcggcgcg

SEQ ID NO: 369291 - DNA, 25 bp, Homo sapien
tggcccgtgggcaacaccgtgactg

SEQ ID NO: 369292 - DNA, 25 bp, Homo sapien
ggcaacaccgtgactggagcccctt

SEQ ID NO: 369293 - DNA, 25 bp, Homo sapien
acacctgtatcccagagagcaaagt

SEQ ID NO: 369294 - DNA, 25 bp, Homo sapien
ccacctggcggcatggacacagaaa

SEQ ID NO: 369295 - DNA, 25 bp, Homo sapien
ggcggcatggacacagaaaagctac

SEQ ID NO: 369296 - DNA, 25 bp, Homo sapien
agaaaagctacgccggctggcctct

SEQ ID NO: 369297 - DNA, 25 bp, Homo sapien
gtatcagaagaggattctcggccta

SEQ ID NO: 369298 - DNA, 25 bp, Homo sapien
gaagaggattctcggcctaacacat

SEQ ID NO: 369299 - DNA, 25 bp, Homo sapien
ggattctcggcctaacacataggca

SEQ ID NO: 369300 - DNA, 25 bp, Homo sapien
acacataggcagtcctaactccgta

SEQ ID NO: 369301 - DNA, 25 bp, Homo sapien
ctttcttctctctgggaaaatgaac

SEQ ID NO: 369302 - DNA, 25 bp, Homo sapien
ttctctctgggaaaatgaacgtcca

SEQ ID NO: 369303 - DNA, 25 bp, Homo sapien
atgaacgtccaggacacacctgtat

SEQ ID NO: 369304 - DNA, 25 bp, Homo sapien
gggcccaccacaagaaatatggctc

SEQ ID NO: 369305 - DNA, 25 bp, Homo sapien
aagaaatatggctccaacgtccacc

SEQ ID NO: 369306 - DNA, 25 bp, Homo sapien
aaatatggctccaacgtccaccgca

SEQ ID NO: 369307 - DNA, 25 bp, Homo sapien
aacgtccaccgcatcaaaagtatgt

SEQ ID NO: 369308 - DNA, 25 bp, Homo sapien
gtccaccgcatcaaaagtatgttcc

SEQ ID NO: 369309 - DNA, 25 bp, Homo sapien
gcatcaaaagtatgttcctgcagat

SEQ ID NO: 369310 - DNA, 25 bp, Homo sapien
aaaagtatgttcctgcagatgggca

SEQ ID NO: 369311 - DNA, 25 bp, Homo sapien
gtatgttcctgcagatgggcacgac

SEQ ID NO: 369312 - DNA, 25 bp, Homo sapien
tgttcctgcagatgggcacgacggc

SEQ ID NO: 369313 - DNA, 25 bp, Homo sapien
accgcagcgcctacgaggcgggcat

SEQ ID NO: 369314 - DNA, 25 bp, Homo sapien
gcagcgcctacgaggcgggcatcca

SEQ ID NO: 369315 - DNA, 25 bp, Homo sapien
atgtgcttttgactgagggtggaaa

SEQ ID NO: 369316 - DNA, 25 bp, Homo sapien
gagggtggaaagtcagcagctgcag

SEQ ID NO: 369317 - DNA, 25 bp, Homo sapien
tgcagcccaagaagttagagccagg

SEQ ID NO: 369318 - DNA, 25 bp, Homo sapien
gagaaaataatcctgcgtgtgctca

SEQ ID NO: 369319 - DNA, 25 bp, Homo sapien
gaaaataatcctgcgtgtgctcagc

SEQ ID NO: 369320 - DNA, 25 bp, Homo sapien
aaataatcctgcgtgtgctcagccc

SEQ ID NO: 369321 - DNA, 25 bp, Homo sapien
taatcctgcgtgtgctcagccctca

SEQ ID NO: 369322 - DNA, 25 bp, Homo sapien
tcactcagatcaacagcccctcggg

SEQ ID NO: 369323 - DNA, 25 bp, Homo sapien
ctcgggtcccagctagatgtacttt

SEQ ID NO: 369324 - DNA, 25 bp, Homo sapien
gggtcccagctagatgtactttgta

SEQ ID NO: 369325 - DNA, 25 bp, Homo sapien
ggtcccagctagatgtactttgtag

SEQ ID NO: 369326 - DNA, 25 bp, Homo sapien
tggagtagctccagctaacgcagat

SEQ ID NO: 369327 - DNA, 25 bp, Homo sapien
taacgcagatggacatcccaggtgc

SEQ ID NO: 369328 - DNA, 25 bp, Homo sapien
cccagggagatcaggcccacggagt

SEQ ID NO: 369329 - DNA, 25 bp, Homo sapien
cccacggagtgggatgaagccctga

SEQ ID NO: 369330 - DNA, 25 bp, Homo sapien
ggaggccagcatggagacacctgct

SEQ ID NO: 369331 - DNA, 25 bp, Homo sapien
agacacctgctgagggaaagcccac

SEQ ID NO: 369332 - DNA, 25 bp, Homo sapien
ggaaagcccacgagcgctgcggcca

SEQ ID NO: 369333 - DNA, 25 bp, Homo sapien
catctgggtggagacctacaggcac

SEQ ID NO: 369334 - DNA, 25 bp, Homo sapien
aggagagcgccacattcagacactt

SEQ ID NO: 369335 - DNA, 25 bp, Homo sapien
tcagacacttgttgcatgtgaggca

SEQ ID NO: 369336 - DNA, 25 bp, Homo sapien
caacaggccagggtggaaccggaca

SEQ ID NO: 369337 - DNA, 25 bp, Homo sapien
agcggcacggccaaacaccaactgt

SEQ ID NO: 369338 - DNA, 25 bp, Homo sapien
gcggctcatctcgtcaggcgtgaag

SEQ ID NO: 369339 - DNA, 25 bp, Homo sapien
atctcgtcaggcgtgaagccgttca

SEQ ID NO: 369340 - DNA, 25 bp, Homo sapien
gtcaggcgtgaagccgttcatgtct

SEQ ID NO: 369341 - DNA, 25 bp, Homo sapien
gcgtgaagccgttcatgtctccgag

SEQ ID NO: 369342 - DNA, 25 bp, Homo sapien
tgaagccgttcatgtctccgagctc

SEQ ID NO: 369343 - DNA, 25 bp, Homo sapien
aggccggcgctgacagaaatcccct

SEQ ID NO: 369344 - DNA, 25 bp, Homo sapien
tccggcagcggcaattcactctgca

SEQ ID NO: 369345 - DNA, 25 bp, Homo sapien
attcactctgcacaccaagttagac

SEQ ID NO: 369346 - DNA, 25 bp, Homo sapien
acaccaagttagacagcggcacggc

SEQ ID NO: 369347 - DNA, 25 bp, Homo sapien
gttagacagcggcacggccaaacac

SEQ ID NO: 369348 - DNA, 25 bp, Homo sapien
aatatacttgctatctataaaaaag

SEQ ID NO: 369349 - DNA, 25 bp, Homo sapien
aaatcctgtcctaggcttttactct

SEQ ID NO: 369350 - DNA, 25 bp, Homo sapien
tcctgtcctaggcttttactcttga

SEQ ID NO: 369351 - DNA, 25 bp, Homo sapien
ctgtcctaggcttttactcttgatc

SEQ ID NO: 369352 - DNA, 25 bp, Homo sapien
cctaggcttttactcttgatcttca

SEQ ID NO: 369353 - DNA, 25 bp, Homo sapien
taggcttttactcttgatcttcaaa

SEQ ID NO: 369354 - DNA, 25 bp, Homo sapien
ggcttttactcttgatcttcaaagg

SEQ ID NO: 369355 - DNA, 25 bp, Homo sapien
ttactcttgatcttcaaaggcacgc

SEQ ID NO: 369356 - DNA, 25 bp, Homo sapien
tcttgatcttcaaaggcacgcaggg

SEQ ID NO: 369357 - DNA, 25 bp, Homo sapien
ggcacgcagggtttaatggttcctt

SEQ ID NO: 369358 - DNA, 25 bp, Homo sapien
gttccttgggttattattttgcagt

SEQ ID NO: 369359 - DNA, 25 bp, Homo sapien
tgtgtagtttcttcctgtgacaggg

SEQ ID NO: 369360 - DNA, 25 bp, Homo sapien
gtgtagtttcttcctgtgacaggga

SEQ ID NO: 369361 - DNA, 25 bp, Homo sapien
aggcgcagtcactatggaggcacct

SEQ ID NO: 369362 - DNA, 25 bp, Homo sapien
ggcgcagtcactatggaggcacctt

SEQ ID NO: 369363 - DNA, 25 bp, Homo sapien
gcgcagtcactatggaggcacctta

SEQ ID NO: 369364 - DNA, 25 bp, Homo sapien
atggaggcaccttacttccttaatc

SEQ ID NO: 369365 - DNA, 25 bp, Homo sapien
tggaggcaccttacttccttaatcg

SEQ ID NO: 369366 - DNA, 25 bp, Homo sapien
gaggcaccttacttccttaatcgtg

SEQ ID NO: 369367 - DNA, 25 bp, Homo sapien
ggcaccttacttccttaatcgtgta

SEQ ID NO: 369368 - DNA, 25 bp, Homo sapien
gcaccttacttccttaatcgtgtac

SEQ ID NO: 369369 - DNA, 25 bp, Homo sapien
accttacttccttaatcgtgtactg

SEQ ID NO: 369370 - DNA, 25 bp, Homo sapien
ggcggcacgggaaagggctgcggct

SEQ ID NO: 369371 - DNA, 25 bp, Homo sapien
aaagggctgcggctcagaccactgc

SEQ ID NO: 369372 - DNA, 25 bp, Homo sapien
aagggctgcggctcagaccactgcg

SEQ ID NO: 369373 - DNA, 25 bp, Homo sapien
ccactgcggcgggacgggcggatca

SEQ ID NO: 369374 - DNA, 25 bp, Homo sapien
gggatctaagtctcctgaggcaagg

SEQ ID NO: 369375 - DNA, 25 bp, Homo sapien
gagcccgggccccacgtagaggatc

SEQ ID NO: 369376 - DNA, 25 bp, Homo sapien
ggccccacgtagaggatccggcgcc

SEQ ID NO: 369377 - DNA, 25 bp, Homo sapien
ggcgagggcaaggtagccgcggcca

SEQ ID NO: 369378 - DNA, 25 bp, Homo sapien
gtagccgcggccacgctggctgcgg

SEQ ID NO: 369379 - DNA, 25 bp, Homo sapien
ctggctgcggcatggagacacggga

SEQ ID NO: 369380 - DNA, 25 bp, Homo sapien
tgcggcatggagacacgggaggaac

SEQ ID NO: 369381 - DNA, 25 bp, Homo sapien
cttgcctggttgatctccttagcaa

SEQ ID NO: 369382 - DNA, 25 bp, Homo sapien
ttgatctccttagcaactcatggtc

SEQ ID NO: 369383 - DNA, 25 bp, Homo sapien
gcaactcatggtcttttactctagc

SEQ ID NO: 369384 - DNA, 25 bp, Homo sapien
ttactctagcagatggatgcctcat

SEQ ID NO: 369385 - DNA, 25 bp, Homo sapien
tagcagatggatgcctcatctagag

SEQ ID NO: 369386 - DNA, 25 bp, Homo sapien
cactaagggccttcaagctaataaa

SEQ ID NO: 369387 - DNA, 25 bp, Homo sapien
gggactcaggcttcacctgctgtcc

SEQ ID NO: 369388 - DNA, 25 bp, Homo sapien
gtcccttagcagagggcggcccaca

SEQ ID NO: 369389 - DNA, 25 bp, Homo sapien
agagggcggcccacaggataccttt

SEQ ID NO: 369390 - DNA, 25 bp, Homo sapien
cccacaggatacctttccatacaat

SEQ ID NO: 369391 - DNA, 25 bp, Homo sapien
catacaatacatcaccaactggaga

SEQ ID NO: 369392 - DNA, 25 bp, Homo sapien
tttaagataccatttggtgcccaat

SEQ ID NO: 369393 - DNA, 25 bp, Homo sapien
gataccatttggtgcccaataaaat

SEQ ID NO: 369394 - DNA, 25 bp, Homo sapien
ttggtgcccaataaaatgagagaat

SEQ ID NO: 369395 - DNA, 25 bp, Homo sapien
gacagttttattcatagttgccaaa

SEQ ID NO: 369396 - DNA, 25 bp, Homo sapien
aaatgtccattagcacgagaacaga

SEQ ID NO: 369397 - DNA, 25 bp, Homo sapien
tccattagcacgagaacagacaaat

SEQ ID NO: 369398 - DNA, 25 bp, Homo sapien
attagcacgagaacagacaaatggt

SEQ ID NO: 369399 - DNA, 25 bp, Homo sapien
ggaatgtttgaatcgccaataagca

SEQ ID NO: 369400 - DNA, 25 bp, Homo sapien
gtttgaatcgccaataagcatgtgt

SEQ ID NO: 369401 - DNA, 25 bp, Homo sapien
gaatcgccaataagcatgtgtaaaa

SEQ ID NO: 369402 - DNA, 25 bp, Homo sapien
gccaataagcatgtgtaaaagtgtt

SEQ ID NO: 369403 - DNA, 25 bp, Homo sapien
gtatcatcaccagtactttgtactt

SEQ ID NO: 369404 - DNA, 25 bp, Homo sapien
cagtactttgtactttgagtctttt

SEQ ID NO: 369405 - DNA, 25 bp, Homo sapien
agtctttttaaatatgctctgttag

SEQ ID NO: 369406 - DNA, 25 bp, Homo sapien
atatgctctgttagtttgtatggaa

SEQ ID NO: 369407 - DNA, 25 bp, Homo sapien
atgatatttcattgcacttttaatt

SEQ ID NO: 369408 - DNA, 25 bp, Homo sapien
acttaaaaatgccttcccttgactg

SEQ ID NO: 369409 - DNA, 25 bp, Homo sapien
aaaatgccttcccttgactgttgat

SEQ ID NO: 369410 - DNA, 25 bp, Homo sapien
gccttcccttgactgttgatatgta

SEQ ID NO: 369411 - DNA, 25 bp, Homo sapien
aagtgtgtgttgaagccttgcagat

SEQ ID NO: 369412 - DNA, 25 bp, Homo sapien
tgaagccttgcagattattttttaa

SEQ ID NO: 369413 - DNA, 25 bp, Homo sapien
gaggtttatcactaggtatatctcc

SEQ ID NO: 369414 - DNA, 25 bp, Homo sapien
cagcttatcaagactgagtgggaag

SEQ ID NO: 369415 - DNA, 25 bp, Homo sapien
ttatcaagactgagtgggaaggcac

SEQ ID NO: 369416 - DNA, 25 bp, Homo sapien
atcaagactgagtgggaaggcacgt

SEQ ID NO: 369417 - DNA, 25 bp, Homo sapien
aaggcacgtggtggaagtcccgagt

SEQ ID NO: 369418 - DNA, 25 bp, Homo sapien
gcacgtggtggaagtcccgagttga

SEQ ID NO: 369419 - DNA, 25 bp, Homo sapien
gaagtcccgagttgaggaggtggat

SEQ ID NO: 369420 - DNA, 25 bp, Homo sapien
tggatggcagcctagtcaggatcct

SEQ ID NO: 369421 - DNA, 25 bp, Homo sapien
ggatggcagcctagtcaggatcctc

SEQ ID NO: 369422 - DNA, 25 bp, Homo sapien
gatggcagcctagtcaggatcctct

SEQ ID NO: 369423 - DNA, 25 bp, Homo sapien
atggcagcctagtcaggatcctctt

SEQ ID NO: 369424 - DNA, 25 bp, Homo sapien
tggcagcctagtcaggatcctcttc

SEQ ID NO: 369425 - DNA, 25 bp, Homo sapien
gatctaggatttatgtatagacacc

SEQ ID NO: 369426 - DNA, 25 bp, Homo sapien
ctaggatttatgtatagacaccagt

SEQ ID NO: 369427 - DNA, 25 bp, Homo sapien
taggatttatgtatagacaccagtt

SEQ ID NO: 369428 - DNA, 25 bp, Homo sapien
tgaagaggaaaaactaactgaggga

SEQ ID NO: 369429 - DNA, 25 bp, Homo sapien
ttttggagagaactggtagaaaaca

SEQ ID NO: 369430 - DNA, 25 bp, Homo sapien
gatgatatgctgagtatgaagggta

SEQ ID NO: 369431 - DNA, 25 bp, Homo sapien
tgatatgctgagtatgaagggtaaa

SEQ ID NO: 369432 - DNA, 25 bp, Homo sapien
gctgagtatgaagggtaaagtgcaa

SEQ ID NO: 369433 - DNA, 25 bp, Homo sapien
tgaagggtaaagtgcaaagagtatt

SEQ ID NO: 369434 - DNA, 25 bp, Homo sapien
tcaatatttgtctctagagataaca

SEQ ID NO: 369435 - DNA, 25 bp, Homo sapien
ttgtctctagagataacattctttc

SEQ ID NO: 369436 - DNA, 25 bp, Homo sapien
atgcccaacacccactgatctttaa

SEQ ID NO: 369437 - DNA, 25 bp, Homo sapien
aacacccactgatctttaactctca

SEQ ID NO: 369438 - DNA, 25 bp, Homo sapien
acccactgatctttaactctcacat

SEQ ID NO: 369439 - DNA, 25 bp, Homo sapien
gatctttaactctcacatgttgggc

SEQ ID NO: 369440 - DNA, 25 bp, Homo sapien
ctttaactctcacatgttgggcata

SEQ ID NO: 369441 - DNA, 25 bp, Homo sapien
aactctcacatgttgggcataagaa

SEQ ID NO: 369442 - DNA, 25 bp, Homo sapien
catgttgggcataagaagtcactat

SEQ ID NO: 369443 - DNA, 25 bp, Homo sapien
actatataattgttactggaaagca

SEQ ID NO: 369444 - DNA, 25 bp, Homo sapien
tactggaaagcaagacttaacgaac

SEQ ID NO: 369445 - DNA, 25 bp, Homo sapien
gacttaacgaacaattctgactatg

SEQ ID NO: 369446 - DNA, 25 bp, Homo sapien
gactatgaaaaatgtctctttcagt

SEQ ID NO: 369447 - DNA, 25 bp, Homo sapien
tttgtagcataaaccaagggctgac

SEQ ID NO: 369448 - DNA, 25 bp, Homo sapien
aagggctgacaaactatggtctctt

SEQ ID NO: 369449 - DNA, 25 bp, Homo sapien
atggtctcttggtcaaatctggtca

SEQ ID NO: 369450 - DNA, 25 bp, Homo sapien
ggtcaaatctggtcagccacttgtt

SEQ ID NO: 369451 - DNA, 25 bp, Homo sapien
ctggtcagccacttgtttatttaaa

SEQ ID NO: 369452 - DNA, 25 bp, Homo sapien
tgtgcattattcattggcgtttagc

SEQ ID NO: 369453 - DNA, 25 bp, Homo sapien
gcgtttagcacatttgccagtacca

SEQ ID NO: 369454 - DNA, 25 bp, Homo sapien
atttgccagtaccactactatctag

SEQ ID NO: 369455 - DNA, 25 bp, Homo sapien
gccagtaccactactatctagatcc

SEQ ID NO: 369456 - DNA, 25 bp, Homo sapien
gttatagtttcaaaacatgccatgt

SEQ ID NO: 369457 - DNA, 25 bp, Homo sapien
ttactatttcaagcatatgggaatt

SEQ ID NO: 369458 - DNA, 25 bp, Homo sapien
aagtggatgggaactcaaggtgcaa

SEQ ID NO: 369459 - DNA, 25 bp, Homo sapien
actcaaggtgcaaagaacctgtttt

SEQ ID NO: 369460 - DNA, 25 bp, Homo sapien
cccctgtattctcatgattttctct

SEQ ID NO: 369461 - DNA, 25 bp, Homo sapien
gattttctctcaggaagcacacact

SEQ ID NO: 369462 - DNA, 25 bp, Homo sapien
aggaagcacacactgtgaatggcag

SEQ ID NO: 369463 - DNA, 25 bp, Homo sapien
gaatggcagacttttcatttagccc

SEQ ID NO: 369464 - DNA, 25 bp, Homo sapien
agacttttcatttagccccaggtga

SEQ ID NO: 369465 - DNA, 25 bp, Homo sapien
tagccccaggtgacttactaaaaat

SEQ ID NO: 369466 - DNA, 25 bp, Homo sapien
ttctaagcacttgtaagaacccagt

SEQ ID NO: 369467 - DNA, 25 bp, Homo sapien
gaacccagtgggttggagcctccca

SEQ ID NO: 369468 - DNA, 25 bp, Homo sapien
tgggttggagcctcccactttgtcc

SEQ ID NO: 369469 - DNA, 25 bp, Homo sapien
agactgagcagttcttgtgagtgta

SEQ ID NO: 369470 - DNA, 25 bp, Homo sapien
gagcagttcttgtgagtgtaaaacc

SEQ ID NO: 369471 - DNA, 25 bp, Homo sapien
agaattataataacttggtctcact

SEQ ID NO: 369472 - DNA, 25 bp, Homo sapien
tggtctcactgggatattctggctc

SEQ ID NO: 369473 - DNA, 25 bp, Homo sapien
gtctcactgggatattctggctcaa

SEQ ID NO: 369474 - DNA, 25 bp, Homo sapien
cactgggatattctggctcaaagcc

SEQ ID NO: 369475 - DNA, 25 bp, Homo sapien
ggaaagagccctgcgtggtggcgag

SEQ ID NO: 369476 - DNA, 25 bp, Homo sapien
agtgccccggtttgttatccaggca

SEQ ID NO: 369477 - DNA, 25 bp, Homo sapien
ccccggtttgttatccaggcataag

SEQ ID NO: 369478 - DNA, 25 bp, Homo sapien
gtttgttatccaggcataagaccaa

SEQ ID NO: 369479 - DNA, 25 bp, Homo sapien
atccaggcataagaccaagaaatta

SEQ ID NO: 369480 - DNA, 25 bp, Homo sapien
ggctaattggtgcatattcaggtac

SEQ ID NO: 369481 - DNA, 25 bp, Homo sapien
attcaggtaccacctttgacgtgtg

SEQ ID NO: 369482 - DNA, 25 bp, Homo sapien
ttgacgtgtggctctttctcctgac

SEQ ID NO: 369483 - DNA, 25 bp, Homo sapien
attttctaagagtttctgagggtga

SEQ ID NO: 369484 - DNA, 25 bp, Homo sapien
ttctgagggtgaggctcttattttt

SEQ ID NO: 369485 - DNA, 25 bp, Homo sapien
taagggatcctgtctatttcctgca

SEQ ID NO: 369486 - DNA, 25 bp, Homo sapien
gtctatttcctgcacttcgagaaga

SEQ ID NO: 369487 - DNA, 25 bp, Homo sapien
gaagaatcaaaatgttcctgaattt

SEQ ID NO: 369488 - DNA, 25 bp, Homo sapien
tacctcatgcaaaatgtgtctcctg

SEQ ID NO: 369489 - DNA, 25 bp, Homo sapien
tgcaaaatgtgtctcctgaaataag

SEQ ID NO: 369490 - DNA, 25 bp, Homo sapien
gttagcaatgccgaaaggtttctgt

SEQ ID NO: 369491 - DNA, 25 bp, Homo sapien
gagtttagcaatggtgactgtttct

SEQ ID NO: 369492 - DNA, 25 bp, Homo sapien
taatttcaagttccctttgccttct

SEQ ID NO: 369493 - DNA, 25 bp, Homo sapien
ctttgccttctaggaaaagcttata

SEQ ID NO: 369494 - DNA, 25 bp, Homo sapien
acatcagtatttcccacacgaattt

SEQ ID NO: 369495 - DNA, 25 bp, Homo sapien
acacgaatttacttggccacgtaga

SEQ ID NO: 369496 - DNA, 25 bp, Homo sapien
ccagagtgttaagtgcccagtggaa

SEQ ID NO: 369497 - DNA, 25 bp, Homo sapien
gaaatgaaaatacttagcactgccc

SEQ ID NO: 369498 - DNA, 25 bp, Homo sapien
tgccctccgggaccttatagatcaa

SEQ ID NO: 369499 - DNA, 25 bp, Homo sapien
ggaccttatagatcaagcatagaac

SEQ ID NO: 369500 - DNA, 25 bp, Homo sapien
aactcataaaaatggtggctgggtt

SEQ ID NO: 369501 - DNA, 25 bp, Homo sapien
gtggctgggttgaaaattctcatta

SEQ ID NO: 369502 - DNA, 25 bp, Homo sapien
tcttctcctccgtggcggccatggt

SEQ ID NO: 369503 - DNA, 25 bp, Homo sapien
ggccatggtccagcacttcatgtgg

SEQ ID NO: 369504 - DNA, 25 bp, Homo sapien
ggtccagcacttcatgtggcaccct

SEQ ID NO: 369505 - DNA, 25 bp, Homo sapien
gccccttgtggacagacacagcggc

SEQ ID NO: 369506 - DNA, 25 bp, Homo sapien
aagccttgaggccacagcgaagaat

SEQ ID NO: 369507 - DNA, 25 bp, Homo sapien
gaagaatgcaggtgtctgcccagtt

SEQ ID NO: 369508 - DNA, 25 bp, Homo sapien
gtgtctgcccagttcactaggtcct

SEQ ID NO: 369509 - DNA, 25 bp, Homo sapien
cccagttcactaggtcctggatgaa

SEQ ID NO: 369510 - DNA, 25 bp, Homo sapien
actaggtcctggatgaaggaaccgt

SEQ ID NO: 369511 - DNA, 25 bp, Homo sapien
gaaggaaccgtggtggcctagacca

SEQ ID NO: 369512 - DNA, 25 bp, Homo sapien
aaccgtggtggcctagaccagtcag

SEQ ID NO: 369513 - DNA, 25 bp, Homo sapien
agaacaagtgtttcattttacaaag

SEQ ID NO: 369514 - DNA, 25 bp, Homo sapien
ttacaaagacactccaaatgatagt

SEQ ID NO: 369515 - DNA, 25 bp, Homo sapien
gatagttacttgattttctcgagac

SEQ ID NO: 369516 - DNA, 25 bp, Homo sapien
gattttctcgagacctttaactatg

SEQ ID NO: 369517 - DNA, 25 bp, Homo sapien
ggtgatgaataacaggacttgcttt

SEQ ID NO: 369518 - DNA, 25 bp, Homo sapien
acaggacttgctttcaagccttaat

SEQ ID NO: 369519 - DNA, 25 bp, Homo sapien
atgaagatacagctgagtgttttcc

SEQ ID NO: 369520 - DNA, 25 bp, Homo sapien
gttttcctcatgaatctgaaccaat

SEQ ID NO: 369521 - DNA, 25 bp, Homo sapien
gaatctgaaccaattaccaatttgt

SEQ ID NO: 369522 - DNA, 25 bp, Homo sapien
accaatttgtgttccagtcttgatt

SEQ ID NO: 369523 - DNA, 25 bp, Homo sapien
gtcttgattggtattgactgattca

SEQ ID NO: 369524 - DNA, 25 bp, Homo sapien
gtgagggctgccacagttgactgcc

SEQ ID NO: 369525 - DNA, 25 bp, Homo sapien
tgtgggacggctgctcttgtactct

SEQ ID NO: 369526 - DNA, 25 bp, Homo sapien
tctccatgctctgactcaagggaac

SEQ ID NO: 369527 - DNA, 25 bp, Homo sapien
caagggaacctgtgttcctggtctc

SEQ ID NO: 369528 - DNA, 25 bp, Homo sapien
tgtgttcctggtctcgtgccatcta

SEQ ID NO: 369529 - DNA, 25 bp, Homo sapien
cacatctcgaatttttcatcccatg

SEQ ID NO: 369530 - DNA, 25 bp, Homo sapien
agcagctacgtgtgtgtttattcca

SEQ ID NO: 369531 - DNA, 25 bp, Homo sapien
gtgtgtttattccagatgccaagtg

SEQ ID NO: 369532 - DNA, 25 bp, Homo sapien
gatgccaagtgaagcctagaacagg

SEQ ID NO: 369533 - DNA, 25 bp, Homo sapien
acaggagttgcatcttgcaggtccc

SEQ ID NO: 369534 - DNA, 25 bp, Homo sapien
catcttgcaggtcccctcagtggat

SEQ ID NO: 369535 - DNA, 25 bp, Homo sapien
tagttcttagtgatcagtggtcagt

SEQ ID NO: 369536 - DNA, 25 bp, Homo sapien
agtggtcagtaatcttcaaagtcag

SEQ ID NO: 369537 - DNA, 25 bp, Homo sapien
agtcagaatctatcaccttggtaaa

SEQ ID NO: 369538 - DNA, 25 bp, Homo sapien
aattatataaacctaacttgagcag

SEQ ID NO: 369539 - DNA, 25 bp, Homo sapien
gagcagatctgattattcttggata

SEQ ID NO: 369540 - DNA, 25 bp, Homo sapien
gtggtatcttgactattaaactacg

SEQ ID NO: 369541 - DNA, 25 bp, Homo sapien
aactacgtatagtgttgctgaaata

SEQ ID NO: 369542 - DNA, 25 bp, Homo sapien
gaattggattcatgtatcgtgggat

SEQ ID NO: 369543 - DNA, 25 bp, Homo sapien
atcgtgggatacaggtgttatttca

SEQ ID NO: 369544 - DNA, 25 bp, Homo sapien
gttatttcaggtgatgtacttgcat

SEQ ID NO: 369545 - DNA, 25 bp, Homo sapien
gatgtacttgcattattttctttag

SEQ ID NO: 369546 - DNA, 25 bp, Homo sapien
agccaagtgcagaatggtccccttt

SEQ ID NO: 369547 - DNA, 25 bp, Homo sapien
aagtgcagaatggtcccctttgttt

SEQ ID NO: 369548 - DNA, 25 bp, Homo sapien
tcccctttgttttcgtgggtatcag

SEQ ID NO: 369549 - DNA, 25 bp, Homo sapien
gttttcgtgggtatcagtggagaat

SEQ ID NO: 369550 - DNA, 25 bp, Homo sapien
ggagaatgagatccttcatatggaa

SEQ ID NO: 369551 - DNA, 25 bp, Homo sapien
tcatatggaatctccctgtgttgct

SEQ ID NO: 369552 - DNA, 25 bp, Homo sapien
acaggactttggtgctattctccaa

SEQ ID NO: 369553 - DNA, 25 bp, Homo sapien
tatctccagtggacatcccctgggc

SEQ ID NO: 369554 - DNA, 25 bp, Homo sapien
agtggacatcccctgggctactcct

SEQ ID NO: 369555 - DNA, 25 bp, Homo sapien
ggctactcctctcctgatgagaaaa

SEQ ID NO: 369556 - DNA, 25 bp, Homo sapien
gaaaatgctcacttcagccaagtgc

SEQ ID NO: 369557 - DNA, 25 bp, Homo sapien
gaatacatttatggatggtacttgg

SEQ ID NO: 369558 - DNA, 25 bp, Homo sapien
gttgagttattggaatcctcttttg

SEQ ID NO: 369559 - DNA, 25 bp, Homo sapien
atcctcttttgattctatgtgttgg

SEQ ID NO: 369560 - DNA, 25 bp, Homo sapien
gattctatgtgttggttagcagata

SEQ ID NO: 369561 - DNA, 25 bp, Homo sapien
gtgttggttagcagatagcaaatat

SEQ ID NO: 369562 - DNA, 25 bp, Homo sapien
tagcaagggatactagccctctcaa

SEQ ID NO: 369563 - DNA, 25 bp, Homo sapien
gatactagccctctcaaacacacaa

SEQ ID NO: 369564 - DNA, 25 bp, Homo sapien
aaatgtgtttagatccaagcgctat

SEQ ID NO: 369565 - DNA, 25 bp, Homo sapien
gtttagatccaagcgctatcaatgt

SEQ ID NO: 369566 - DNA, 25 bp, Homo sapien
ccaagcgctatcaatgttgggagga

SEQ ID NO: 369567 - DNA, 25 bp, Homo sapien
aaaagattatgttcctgtctttctt

SEQ ID NO: 369568 - DNA, 25 bp, Homo sapien
tgtcctcaccccagactattagagt

SEQ ID NO: 369569 - DNA, 25 bp, Homo sapien
ccagactattagagtcctgtgtgct

SEQ ID NO: 369570 - DNA, 25 bp, Homo sapien
gagcaatgtgtagaagacttaactt

SEQ ID NO: 369571 - DNA, 25 bp, Homo sapien
taactttctcataactgcagcaggg

SEQ ID NO: 369572 - DNA, 25 bp, Homo sapien
gggactgaaaattgacctccatcca

SEQ ID NO: 369573 - DNA, 25 bp, Homo sapien
gaaaattgacctccatccaaatgaa

SEQ ID NO: 369574 - DNA, 25 bp, Homo sapien
taaagctaaacctaggcttggtggg

SEQ ID NO: 369575 - DNA, 25 bp, Homo sapien
ttgtgattaattggtgatctctgcc

SEQ ID NO: 369576 - DNA, 25 bp, Homo sapien
gggctcagagtgtcagcacatgtac

SEQ ID NO: 369577 - DNA, 25 bp, Homo sapien
agagtgtcagcacatgtacctcatg

SEQ ID NO: 369578 - DNA, 25 bp, Homo sapien
acctcatgtttaccaagtctagaag

SEQ ID NO: 369579 - DNA, 25 bp, Homo sapien
tgaggaccgaccagagagggatttc

SEQ ID NO: 369580 - DNA, 25 bp, Homo sapien
cagagagggatttccttttcgtcct

SEQ ID NO: 369581 - DNA, 25 bp, Homo sapien
ccaaggagcttgttgggacgttcag

SEQ ID NO: 369582 - DNA, 25 bp, Homo sapien
caactaccagggattgagcactggg

SEQ ID NO: 369583 - DNA, 25 bp, Homo sapien
ggccaggcaagggagaacatactat

SEQ ID NO: 369584 - DNA, 25 bp, Homo sapien
aaatcagattctccacgttacctac

SEQ ID NO: 369585 - DNA, 25 bp, Homo sapien
tacctactcaagtcataagcgtctg

SEQ ID NO: 369586 - DNA, 25 bp, Homo sapien
ttgttgggacgttcaggagaccccg

SEQ ID NO: 369587 - DNA, 25 bp, Homo sapien
aagcgtctgaagaaagtgctctgta

SEQ ID NO: 369588 - DNA, 25 bp, Homo sapien
gaggttttggacacaacctgcatct

SEQ ID NO: 369589 - DNA, 25 bp, Homo sapien
agagcgccttcgactctggaggccg

SEQ ID NO: 369590 - DNA, 25 bp, Homo sapien
ccaccaatctctcctcaatgaataa

SEQ ID NO: 369591 - DNA, 25 bp, Homo sapien
gtaagagcgaaccacaattctcctg

SEQ ID NO: 369592 - DNA, 25 bp, Homo sapien
aattctcctgaaccctgctagagat

SEQ ID NO: 369593 - DNA, 25 bp, Homo sapien
ttaagtggtggttctcacttcctca

SEQ ID NO: 369594 - DNA, 25 bp, Homo sapien
ggtggttctcacttcctcaatgaaa

SEQ ID NO: 369595 - DNA, 25 bp, Homo sapien
ttcctcaatgaaaacttgcactggg

SEQ ID NO: 369596 - DNA, 25 bp, Homo sapien
acagcgcttgccttggtcagacctt

SEQ ID NO: 369597 - DNA, 25 bp, Homo sapien
ttcccacatctacatactctcaaat

SEQ ID NO: 369598 - DNA, 25 bp, Homo sapien
actctcaaatacatgaccaggtgat

SEQ ID NO: 369599 - DNA, 25 bp, Homo sapien
tggaaaaatttgcaccaccgtgtcc

SEQ ID NO: 369600 - DNA, 25 bp, Homo sapien
accaccgtgtcccatgaaattgttt

SEQ ID NO: 369601 - DNA, 25 bp, Homo sapien
tgcaccggagggtgaagacagccct

SEQ ID NO: 369602 - DNA, 25 bp, Homo sapien
tgaagacagccctcgcgaggaagga

SEQ ID NO: 369603 - DNA, 25 bp, Homo sapien
gaggccgtgagcagcctccggacac

SEQ ID NO: 369604 - DNA, 25 bp, Homo sapien
ggacacaacatgaggctgcggtgaa

SEQ ID NO: 369605 - DNA, 25 bp, Homo sapien
ggctgcggtgaagcgggccgaccac

SEQ ID NO: 369606 - DNA, 25 bp, Homo sapien
acgccaagtaccaagtgaccaggga

SEQ ID NO: 369607 - DNA, 25 bp, Homo sapien
agtgaccagggatgccgggaacact

SEQ ID NO: 369608 - DNA, 25 bp, Homo sapien
gatgccgggaacactgtcgaagaac

SEQ ID NO: 369609 - DNA, 25 bp, Homo sapien
gaacactgtcgaagaacggaaggca

SEQ ID NO: 369610 - DNA, 25 bp, Homo sapien
ctggtggttgagatgcccacggcta

SEQ ID NO: 369611 - DNA, 25 bp, Homo sapien
ttgagatgcccacggctaagcacct

SEQ ID NO: 369612 - DNA, 25 bp, Homo sapien
atcggttgccttggcagtggctgta

SEQ ID NO: 369613 - DNA, 25 bp, Homo sapien
cagtggctgtaatccatgcagttca

SEQ ID NO: 369614 - DNA, 25 bp, Homo sapien
tgtaatccatgcagttcagaatgat

SEQ ID NO: 369615 - DNA, 25 bp, Homo sapien
atcggctacacccattgtcctttga

SEQ ID NO: 369616 - DNA, 25 bp, Homo sapien
aaaggcgaaactgcatctgggcggt

SEQ ID NO: 369617 - DNA, 25 bp, Homo sapien
ctacacccattgtcctttgaacaag

SEQ ID NO: 369618 - DNA, 25 bp, Homo sapien
gaacaagacaaacaacccttgcaaa

SEQ ID NO: 369619 - DNA, 25 bp, Homo sapien
ggatttgatacataactagctcgct

SEQ ID NO: 369620 - DNA, 25 bp, Homo sapien
tacataactagctcgcttactgcgt

SEQ ID NO: 369621 - DNA, 25 bp, Homo sapien
tcgcttactgcgtctccatcggttg

SEQ ID NO: 369622 - DNA, 25 bp, Homo sapien
gtctccatcggttgccttggcagtg

SEQ ID NO: 369623 - DNA, 25 bp, Homo sapien
gtaaacattaggatgatctgtgtaa

SEQ ID NO: 369624 - DNA, 25 bp, Homo sapien
gtgtaaatgatgctttggcacaaca

SEQ ID NO: 369625 - DNA, 25 bp, Homo sapien
gctttggcacaacacctattttaag

SEQ ID NO: 369626 - DNA, 25 bp, Homo sapien
agtacatttcatatgtctactgtgt

SEQ ID NO: 369627 - DNA, 25 bp, Homo sapien
atatgtctactgtgttcatcaagaa

SEQ ID NO: 369628 - DNA, 25 bp, Homo sapien
gaaaattaatgtagttgggtgcctt

SEQ ID NO: 369629 - DNA, 25 bp, Homo sapien
gtagttgggtgccttttgaaaatgc

SEQ ID NO: 369630 - DNA, 25 bp, Homo sapien
ttcattgttttatatccttagcata

SEQ ID NO: 369631 - DNA, 25 bp, Homo sapien
tatccttagcatatagttacatgtg

SEQ ID NO: 369632 - DNA, 25 bp, Homo sapien
gaagacactgaaatgaaaaccctaa

SEQ ID NO: 369633 - DNA, 25 bp, Homo sapien
tctggataactgttatacaggtggt

SEQ ID NO: 369634 - DNA, 25 bp, Homo sapien
atttcttcccatctccaaaaatcca

SEQ ID NO: 369635 - DNA, 25 bp, Homo sapien
ttcttcccatctccaaaaatccaga

SEQ ID NO: 369636 - DNA, 25 bp, Homo sapien
ttgctccctgctccatacttaaggt

SEQ ID NO: 369637 - DNA, 25 bp, Homo sapien
gctccctgctccatacttaaggttt

SEQ ID NO: 369638 - DNA, 25 bp, Homo sapien
tgatgccaacatttggattctctct

SEQ ID NO: 369639 - DNA, 25 bp, Homo sapien
gatgccaacatttggattctctctt

SEQ ID NO: 369640 - DNA, 25 bp, Homo sapien
aggtgtaccccaaacagaaggcaca

SEQ ID NO: 369641 - DNA, 25 bp, Homo sapien
gtgtaccccaaacagaaggcacatg

SEQ ID NO: 369642 - DNA, 25 bp, Homo sapien
taccccaaacagaaggcacatggat

SEQ ID NO: 369643 - DNA, 25 bp, Homo sapien
caaacagaaggcacatggatctggg

SEQ ID NO: 369644 - DNA, 25 bp, Homo sapien
agtgctcagtagcccaacaacaagg

SEQ ID NO: 369645 - DNA, 25 bp, Homo sapien
gcatgttttgaattatcgtaggtta

SEQ ID NO: 369646 - DNA, 25 bp, Homo sapien
attatcgtaggttatacaatctgtt

SEQ ID NO: 369647 - DNA, 25 bp, Homo sapien
ggagggcatctttaagtaatattag

SEQ ID NO: 369648 - DNA, 25 bp, Homo sapien
gtgatatacgtgcactggtcagtct

SEQ ID NO: 369649 - DNA, 25 bp, Homo sapien
atacgtgcactggtcagtctgaatg

SEQ ID NO: 369650 - DNA, 25 bp, Homo sapien
ggtcagtctgaatgatttcctttaa

SEQ ID NO: 369651 - DNA, 25 bp, Homo sapien
gatttcctttaatgacgtatttaga

SEQ ID NO: 369652 - DNA, 25 bp, Homo sapien
gaaagccaatactataatgtcaagg

SEQ ID NO: 369653 - DNA, 25 bp, Homo sapien
gtaatattagtgatctcaggcttat

SEQ ID NO: 369654 - DNA, 25 bp, Homo sapien
gatctcaggcttataagtagctcaa

SEQ ID NO: 369655 - DNA, 25 bp, Homo sapien
gagtggtttcttatagcatgttttg

SEQ ID NO: 369656 - DNA, 25 bp, Homo sapien
gaagagcatgctcctgtgcctggca

SEQ ID NO: 369657 - DNA, 25 bp, Homo sapien
gtgcctggcatggtttcaccgagaa

SEQ ID NO: 369658 - DNA, 25 bp, Homo sapien
gtttcaccgagaacatcgtgcccga

SEQ ID NO: 369659 - DNA, 25 bp, Homo sapien
aacatcgtgcccgagctgagaagat

SEQ ID NO: 369660 - DNA, 25 bp, Homo sapien
agtggacgagccaggccctgctgac

SEQ ID NO: 369661 - DNA, 25 bp, Homo sapien
aacttgaaggcccatgcatcagacc

SEQ ID NO: 369662 - DNA, 25 bp, Homo sapien
tctccccaggatcctgttgcttaag

SEQ ID NO: 369663 - DNA, 25 bp, Homo sapien
acatagttactgttgggaacatctt

SEQ ID NO: 369664 - DNA, 25 bp, Homo sapien
taactttctaacttttgctgctaaa

SEQ ID NO: 369665 - DNA, 25 bp, Homo sapien
gctgacagtggacatagtggactca

SEQ ID NO: 369666 - DNA, 25 bp, Homo sapien
ggccccgtgtacagaatcgggtgaa

SEQ ID NO: 369667 - DNA, 25 bp, Homo sapien
gaggatgcatttgtgccagaagcag

SEQ ID NO: 369668 - DNA, 25 bp, Homo sapien
aagcaggtgcttttatatatcaggt

SEQ ID NO: 369669 - DNA, 25 bp, Homo sapien
gtagattttttatccttgttcagta

SEQ ID NO: 369670 - DNA, 25 bp, Homo sapien
ttatccttgttcagtaagagtgcat

SEQ ID NO: 369671 - DNA, 25 bp, Homo sapien
gtaagagtgcatgatgaacgccatc

SEQ ID NO: 369672 - DNA, 25 bp, Homo sapien
gaacgccatcagcacttggccaagg

SEQ ID NO: 369673 - DNA, 25 bp, Homo sapien
gagcttatattaggtttatgtccaa

SEQ ID NO: 369674 - DNA, 25 bp, Homo sapien
gcggccatgcctgtgagcagttctg

SEQ ID NO: 369675 - DNA, 25 bp, Homo sapien
tgaaaaacttccttgctcgactgat

SEQ ID NO: 369676 - DNA, 25 bp, Homo sapien
aaacttccttgctcgactgatattt

SEQ ID NO: 369677 - DNA, 25 bp, Homo sapien
gctcgactgatattttctccccttt

SEQ ID NO: 369678 - DNA, 25 bp, Homo sapien
gaattgtttatatctactgtcaagt

SEQ ID NO: 369679 - DNA, 25 bp, Homo sapien
atatctactgtcaagttgttttgac

SEQ ID NO: 369680 - DNA, 25 bp, Homo sapien
taacattggcagagaggtacagtat

SEQ ID NO: 369681 - DNA, 25 bp, Homo sapien
ggtacagtatgttatccctatggtg

SEQ ID NO: 369682 - DNA, 25 bp, Homo sapien
gtatgttatccctatggtgaaaata

SEQ ID NO: 369683 - DNA, 25 bp, Homo sapien
gttgtatatagttcctcaatctctg

SEQ ID NO: 369684 - DNA, 25 bp, Homo sapien
tagttcctcaatctctgaagtaaag

SEQ ID NO: 369685 - DNA, 25 bp, Homo sapien
gtatgaatggtttaatcaaggcttt

SEQ ID NO: 369686 - DNA, 25 bp, Homo sapien
cagtgatgattaaattgctgcagtc

SEQ ID NO: 369687 - DNA, 25 bp, Homo sapien
ttgctgcagtccataatttgggctt

SEQ ID NO: 369688 - DNA, 25 bp, Homo sapien
aatttgggcttgttatttgtacatt

SEQ ID NO: 369689 - DNA, 25 bp, Homo sapien
ttgctctgacatggacacagccagg

SEQ ID NO: 369690 - DNA, 25 bp, Homo sapien
tgctctgacatggacacagccagga

SEQ ID NO: 369691 - DNA, 25 bp, Homo sapien
gctctgacatggacacagccaggac

SEQ ID NO: 369692 - DNA, 25 bp, Homo sapien
ctctgacatggacacagccaggaca

SEQ ID NO: 369693 - DNA, 25 bp, Homo sapien
tctgacatggacacagccaggacaa

SEQ ID NO: 369694 - DNA, 25 bp, Homo sapien
tgacatggacacagccaggacaagc

SEQ ID NO: 369695 - DNA, 25 bp, Homo sapien
gacatggacacagccaggacaagct

SEQ ID NO: 369696 - DNA, 25 bp, Homo sapien
aggacaagctgctcagacctgcttc

SEQ ID NO: 369697 - DNA, 25 bp, Homo sapien
agctgctcagacctgcttccctggg

SEQ ID NO: 369698 - DNA, 25 bp, Homo sapien
accagcttcaaggagcggaaggctg

SEQ ID NO: 369699 - DNA, 25 bp, Homo sapien
gggacttctgtctgcctgtgctcca

SEQ ID NO: 369700 - DNA, 25 bp, Homo sapien
gagtcaggtgaacactctgtcctta

SEQ ID NO: 369701 - DNA, 25 bp, Homo sapien
actctgtccttagtgagctggagga

SEQ ID NO: 369702 - DNA, 25 bp, Homo sapien
tactcacccacaaaagggagcagga

SEQ ID NO: 369703 - DNA, 25 bp, Homo sapien
ggaaggaagctcatcccagtttatt

SEQ ID NO: 369704 - DNA, 25 bp, Homo sapien
gcaagaccagagtgcagcatggatt

SEQ ID NO: 369705 - DNA, 25 bp, Homo sapien
catggattttcctagctgtcaagag

SEQ ID NO: 369706 - DNA, 25 bp, Homo sapien
ttcctagctgtcaagagtttcagtt

SEQ ID NO: 369707 - DNA, 25 bp, Homo sapien
agtttcagttgggaggactccacca

SEQ ID NO: 369708 - DNA, 25 bp, Homo sapien
gggccactatgattgagctgaagag

SEQ ID NO: 369709 - DNA, 25 bp, Homo sapien
aagaggtcacctaaccaggcgacag

SEQ ID NO: 369710 - DNA, 25 bp, Homo sapien
agcgtaccccagtgcctcataggag

SEQ ID NO: 369711 - DNA, 25 bp, Homo sapien
gaactcttagagactctgactcaga

SEQ ID NO: 369712 - DNA, 25 bp, Homo sapien
tagagactctgactcagaatagaat

SEQ ID NO: 369713 - DNA, 25 bp, Homo sapien
gaatagaatttacagtcatccataa

SEQ ID NO: 369714 - DNA, 25 bp, Homo sapien
gtcatccataattttacttgcctaa

SEQ ID NO: 369715 - DNA, 25 bp, Homo sapien
acttgcctaataataactactgcca

SEQ ID NO: 369716 - DNA, 25 bp, Homo sapien
ataataactactgccacagctggcc

SEQ ID NO: 369717 - DNA, 25 bp, Homo sapien
cacagctggccaggtgcaacaggaa

SEQ ID NO: 369718 - DNA, 25 bp, Homo sapien
aacaggaagaccatcgccatcaact

SEQ ID NO: 369719 - DNA, 25 bp, Homo sapien
agaccatcgccatcaactctttctt

SEQ ID NO: 369720 - DNA, 25 bp, Homo sapien
tttcttccaaaccttggttgcttct

SEQ ID NO: 369721 - DNA, 25 bp, Homo sapien
tctccccacttaaaacctgtttctg

SEQ ID NO: 369722 - DNA, 25 bp, Homo sapien
gcggaactgagaaaggctgcatctt

SEQ ID NO: 369723 - DNA, 25 bp, Homo sapien
agaaaggctgcatcttgaaagatga

SEQ ID NO: 369724 - DNA, 25 bp, Homo sapien
aaagatgatttgtagttagccggaa

SEQ ID NO: 369725 - DNA, 25 bp, Homo sapien
gatttgtagttagccggaagtgtga

SEQ ID NO: 369726 - DNA, 25 bp, Homo sapien
gaaggtgggaactgttattaatgtt

SEQ ID NO: 369727 - DNA, 25 bp, Homo sapien
ggacaagtagacttatcaattataa

SEQ ID NO: 369728 - DNA, 25 bp, Homo sapien
atttctgaaggtggtaatgagttct

SEQ ID NO: 369729 - DNA, 25 bp, Homo sapien
gagttcttggaagttcattgtatta

SEQ ID NO: 369730 - DNA, 25 bp, Homo sapien
aataagcattgaatcattaagcctt

SEQ ID NO: 369731 - DNA, 25 bp, Homo sapien
tagggttcctcaggaacatgaagga

SEQ ID NO: 369732 - DNA, 25 bp, Homo sapien
gagaaacatctaattcagaatgcgg

SEQ ID NO: 369733 - DNA, 25 bp, Homo sapien
tttttaactattgaggtctgacatg

SEQ ID NO: 369734 - DNA, 25 bp, Homo sapien
gaggtctgacatgttttggatatta

SEQ ID NO: 369735 - DNA, 25 bp, Homo sapien
caaatatattctcccattgcatagg

SEQ ID NO: 369736 - DNA, 25 bp, Homo sapien
tttataggtttccactgcatctttt

SEQ ID NO: 369737 - DNA, 25 bp, Homo sapien
ttcatccctgggaatttatgtgttg

SEQ ID NO: 369738 - DNA, 25 bp, Homo sapien
tgtgttgaaaccagaagtagacttt

SEQ ID NO: 369739 - DNA, 25 bp, Homo sapien
ttacttgtacaaataggctctagca

SEQ ID NO: 369740 - DNA, 25 bp, Homo sapien
ggctctagcaataaataggctacta

SEQ ID NO: 369741 - DNA, 25 bp, Homo sapien
ataggctactaaaggcagtcacatt

SEQ ID NO: 369742 - DNA, 25 bp, Homo sapien
gctactaaaggcagtcacattttgt

SEQ ID NO: 369743 - DNA, 25 bp, Homo sapien
cacattttgtatgaggtcttctgtt

SEQ ID NO: 369744 - DNA, 25 bp, Homo sapien
aatatattttaccagtttccagaat

SEQ ID NO: 369745 - DNA, 25 bp, Homo sapien
tttaccagtttccagaatttccagt

SEQ ID NO: 369746 - DNA, 25 bp, Homo sapien
gaatttccagtacaggaccgcctga

SEQ ID NO: 369747 - DNA, 25 bp, Homo sapien
gaccgcctgaagagagagccattgt

SEQ ID NO: 369748 - DNA, 25 bp, Homo sapien
gagagccattgttcaattccaattc

SEQ ID NO: 369749 - DNA, 25 bp, Homo sapien
tgttcaattccaattcagtgtgagt

SEQ ID NO: 369750 - DNA, 25 bp, Homo sapien
attccaattcagtgtgagtgacaaa

SEQ ID NO: 369751 - DNA, 25 bp, Homo sapien
ttaaatttctgcctgtcagtctata

SEQ ID NO: 369752 - DNA, 25 bp, Homo sapien
gcctgtcagtctatattgctgtttt

SEQ ID NO: 369753 - DNA, 25 bp, Homo sapien
gtttttattatacatcagtttcttt

SEQ ID NO: 369754 - DNA, 25 bp, Homo sapien
aacttgtgagttcccatgtgttttg

SEQ ID NO: 369755 - DNA, 25 bp, Homo sapien
ggaagtaggtgatgccagccctcaa

SEQ ID NO: 369756 - DNA, 25 bp, Homo sapien
tgatgccagccctcaagtctgtctt

SEQ ID NO: 369757 - DNA, 25 bp, Homo sapien
ctgtcttcagccagggacttgagaa

SEQ ID NO: 369758 - DNA, 25 bp, Homo sapien
atattgggcagtggctccaatctgt

SEQ ID NO: 369759 - DNA, 25 bp, Homo sapien
cagtggctccaatctgtggaccagt

SEQ ID NO: 369760 - DNA, 25 bp, Homo sapien
gatcaggcagggtgccattcattgt

SEQ ID NO: 369761 - DNA, 25 bp, Homo sapien
agggtgccattcattgtctttctct

SEQ ID NO: 369762 - DNA, 25 bp, Homo sapien
gaaggactatatttgtactgtaccc

SEQ ID NO: 369763 - DNA, 25 bp, Homo sapien
ggattctatagactgataggcccta

SEQ ID NO: 369764 - DNA, 25 bp, Homo sapien
gactgataggccctatccacaaggg

SEQ ID NO: 369765 - DNA, 25 bp, Homo sapien
atccacaagggccatgactgggaaa

SEQ ID NO: 369766 - DNA, 25 bp, Homo sapien
tgttgattacatgtccattcattgg

SEQ ID NO: 369767 - DNA, 25 bp, Homo sapien
ttacatgtccattcattggtttggg

SEQ ID NO: 369768 - DNA, 25 bp, Homo sapien
aaacattcttgttaagagctgtgga

SEQ ID NO: 369769 - DNA, 25 bp, Homo sapien
gagctgtggagatcagtgtttgttt

SEQ ID NO: 369770 - DNA, 25 bp, Homo sapien
gtttgtttaccataaagattttgct

SEQ ID NO: 369771 - DNA, 25 bp, Homo sapien
tcccttttatgagtggaggctgtaa

SEQ ID NO: 369772 - DNA, 25 bp, Homo sapien
ggctgtaactggtatagccagcatt

SEQ ID NO: 369773 - DNA, 25 bp, Homo sapien
tttggttgggcacacactcatctct

SEQ ID NO: 369774 - DNA, 25 bp, Homo sapien
acactcatctctcaaggccagtggg

SEQ ID NO: 369775 - DNA, 25 bp, Homo sapien
ctcaaggccagtgggctagaggctt

SEQ ID NO: 369776 - DNA, 25 bp, Homo sapien
gggctagaggcttggcagactctaa

SEQ ID NO: 369777 - DNA, 25 bp, Homo sapien
aacacatgatgagccctgtaggtgg

SEQ ID NO: 369778 - DNA, 25 bp, Homo sapien
gccctgtaggtggtggacaaagact

SEQ ID NO: 369779 - DNA, 25 bp, Homo sapien
gagcaagccatttaggcaaacatct

SEQ ID NO: 369780 - DNA, 25 bp, Homo sapien
gccatttaggcaaacatctgaagaa

SEQ ID NO: 369781 - DNA, 25 bp, Homo sapien
ggcaaacaaataggactgtttcatt

SEQ ID NO: 369782 - DNA, 25 bp, Homo sapien
ggactgtttcattaagatcacttgc

SEQ ID NO: 369783 - DNA, 25 bp, Homo sapien
gatcacttgcattctaacaggttat

SEQ ID NO: 369784 - DNA, 25 bp, Homo sapien
acttgcattctaacaggttatgatg

SEQ ID NO: 369785 - DNA, 25 bp, Homo sapien
tttggacatgtcacatttgagatgc

SEQ ID NO: 369786 - DNA, 25 bp, Homo sapien
cacatttgagatgcagttgacacac

SEQ ID NO: 369787 - DNA, 25 bp, Homo sapien
gaaacctaataaaccatgatcttaa

SEQ ID NO: 369788 - DNA, 25 bp, Homo sapien
taaatttgatcatacctaagaggtt

SEQ ID NO: 369789 - DNA, 25 bp, Homo sapien
aaatggtgccattcccaccttagag

SEQ ID NO: 369790 - DNA, 25 bp, Homo sapien
gtgccattcccaccttagagtgcta

SEQ ID NO: 369791 - DNA, 25 bp, Homo sapien
cattcccaccttagagtgctacata

SEQ ID NO: 369792 - DNA, 25 bp, Homo sapien
tagagtgctacataggtgcttgggc

SEQ ID NO: 369793 - DNA, 25 bp, Homo sapien
gtgctacataggtgcttgggcgtat

SEQ ID NO: 369794 - DNA, 25 bp, Homo sapien
aggtgcttgggcgtatgtaacatta

SEQ ID NO: 369795 - DNA, 25 bp, Homo sapien
gtatgtaacattagtgtccttcctt

SEQ ID NO: 369796 - DNA, 25 bp, Homo sapien
gtaacattagtgtccttccttgaag

SEQ ID NO: 369797 - DNA, 25 bp, Homo sapien
aacattagtgtccttccttgaagcc

SEQ ID NO: 369798 - DNA, 25 bp, Homo sapien
attagtgtccttccttgaagccaca

SEQ ID NO: 369799 - DNA, 25 bp, Homo sapien
ttccatcctttttgactttagtatc

SEQ ID NO: 369800 - DNA, 25 bp, Homo sapien
catcctttttgactttagtatctaa

SEQ ID NO: 369801 - DNA, 25 bp, Homo sapien
gactttagtatctaacaggaatggg

SEQ ID NO: 369802 - DNA, 25 bp, Homo sapien
gaaagttacagtaattgtctatcat

SEQ ID NO: 369803 - DNA, 25 bp, Homo sapien
gtaattgtctatcatattgtctatc

SEQ ID NO: 369804 - DNA, 25 bp, Homo sapien
atattgtctatcataacctgttgta

SEQ ID NO: 369805 - DNA, 25 bp, Homo sapien
gtctatcataacctgttgtaaaagc

SEQ ID NO: 369806 - DNA, 25 bp, Homo sapien
aacctgttgtaaaagcacagttagc

SEQ ID NO: 369807 - DNA, 25 bp, Homo sapien
gcacagttagctttacatttaataa

SEQ ID NO: 369808 - DNA, 25 bp, Homo sapien
cccatcttatgtaactcaattaaga

SEQ ID NO: 369809 - DNA, 25 bp, Homo sapien
ttattatatacatctttgtttcctt

SEQ ID NO: 369810 - DNA, 25 bp, Homo sapien
tctgccatcttgagagccagcagct

SEQ ID NO: 369811 - DNA, 25 bp, Homo sapien
gggaccactactctggccacctttt

SEQ ID NO: 369812 - DNA, 25 bp, Homo sapien
tactctggccaccttttgtccttag

SEQ ID NO: 369813 - DNA, 25 bp, Homo sapien
agcagcttgttcctcaggagccagc

SEQ ID NO: 369814 - DNA, 25 bp, Homo sapien
tccgctgggctcacagggtacactg

SEQ ID NO: 369815 - DNA, 25 bp, Homo sapien
gggctcacagggtacactgcggcct

SEQ ID NO: 369816 - DNA, 25 bp, Homo sapien
tcccttcctttgagcagagcagccc

SEQ ID NO: 369817 - DNA, 25 bp, Homo sapien
gggctatttccttatgggattctct

SEQ ID NO: 369818 - DNA, 25 bp, Homo sapien
tttccttatgggattctctggccag

SEQ ID NO: 369819 - DNA, 25 bp, Homo sapien
ccttatgggattctctggccagaga

SEQ ID NO: 369820 - DNA, 25 bp, Homo sapien
agaaaggagtagctgactaagcctg

SEQ ID NO: 369821 - DNA, 25 bp, Homo sapien
atttttggttacatttcaaactcat

SEQ ID NO: 369822 - DNA, 25 bp, Homo sapien
aaaaaccattcataggagcacaaat

SEQ ID NO: 369823 - DNA, 25 bp, Homo sapien
ggagcacaaataacgtggctatata

SEQ ID NO: 369824 - DNA, 25 bp, Homo sapien
tgataatcaggctcagtgtacacag

SEQ ID NO: 369825 - DNA, 25 bp, Homo sapien
ggctcagtgtacacagctgcgagaa

SEQ ID NO: 369826 - DNA, 25 bp, Homo sapien
gctgcgagaagagcaagcggtttca

SEQ ID NO: 369827 - DNA, 25 bp, Homo sapien
agcggtttcagaagcttagagctgt

SEQ ID NO: 369828 - DNA, 25 bp, Homo sapien
ggaagtgaaatcagcatggtcaaat

SEQ ID NO: 369829 - DNA, 25 bp, Homo sapien
cagcatggtcaaatgcagttctcat

SEQ ID NO: 369830 - DNA, 25 bp, Homo sapien
gcagttctcattactttggagcctt

SEQ ID NO: 369831 - DNA, 25 bp, Homo sapien
ttctcattactttggagccttttaa

SEQ ID NO: 369832 - DNA, 25 bp, Homo sapien
ttttttacagtcttcagagacgatg

SEQ ID NO: 369833 - DNA, 25 bp, Homo sapien
agagacgatgaacctcctgtcacag

SEQ ID NO: 369834 - DNA, 25 bp, Homo sapien
tcctgtcacaggaggtatgcaaaca

SEQ ID NO: 369835 - DNA, 25 bp, Homo sapien
tatgcaaacagagaggtgtaggctt

SEQ ID NO: 369836 - DNA, 25 bp, Homo sapien
cccgggtatgggaaattatgctttg

SEQ ID NO: 369837 - DNA, 25 bp, Homo sapien
agtcataattttccccatgaacgtt

SEQ ID NO: 369838 - DNA, 25 bp, Homo sapien
aaattatgctttgccctcggtggga

SEQ ID NO: 369839 - DNA, 25 bp, Homo sapien
tgccctcggtgggaggacatcacaa

SEQ ID NO: 369840 - DNA, 25 bp, Homo sapien
gaggacatcacaaagttagactgca

SEQ ID NO: 369841 - DNA, 25 bp, Homo sapien
caaagggcacacaggtcaggagaac

SEQ ID NO: 369842 - DNA, 25 bp, Homo sapien
tcaggagaacggagaagggcattta

SEQ ID NO: 369843 - DNA, 25 bp, Homo sapien
aggtgcgctgggagtgtagcctcgc

SEQ ID NO: 369844 - DNA, 25 bp, Homo sapien
cgctgggagtgtagcctcgcctggg

SEQ ID NO: 369845 - DNA, 25 bp, Homo sapien
gggcctcacaaaggtgtgacaacat

SEQ ID NO: 369846 - DNA, 25 bp, Homo sapien
acaaatattttgactgcctactaag

SEQ ID NO: 369847 - DNA, 25 bp, Homo sapien
aaatattttgactgcctactaaggg

SEQ ID NO: 369848 - DNA, 25 bp, Homo sapien
attttgactgcctactaagggccac

SEQ ID NO: 369849 - DNA, 25 bp, Homo sapien
ttgactgcctactaagggccaccta

SEQ ID NO: 369850 - DNA, 25 bp, Homo sapien
actgcctactaagggccacctaata

SEQ ID NO: 369851 - DNA, 25 bp, Homo sapien
taagggccacctaatatgctcaatg

SEQ ID NO: 369852 - DNA, 25 bp, Homo sapien
aagggccacctaatatgctcaatga

SEQ ID NO: 369853 - DNA, 25 bp, Homo sapien
tgctcaatgaaaccattatgggcaa

SEQ ID NO: 369854 - DNA, 25 bp, Homo sapien
tttcctgcataaaactgaagactca

SEQ ID NO: 369855 - DNA, 25 bp, Homo sapien
tgaagactcaagatgcatcaagcac

SEQ ID NO: 369856 - DNA, 25 bp, Homo sapien
gactcaagatgcatcaagcactgta

SEQ ID NO: 369857 - DNA, 25 bp, Homo sapien
gatgcatcaagcactgtatacagaa

SEQ ID NO: 369858 - DNA, 25 bp, Homo sapien
tatacagaaaagtgctgcgtatcct

SEQ ID NO: 369859 - DNA, 25 bp, Homo sapien
gaaaagtgctgcgtatcctacagaa

SEQ ID NO: 369860 - DNA, 25 bp, Homo sapien
agtgctgcgtatcctacagaaagct

SEQ ID NO: 369861 - DNA, 25 bp, Homo sapien
ctgcgtatcctacagaaagctacag

SEQ ID NO: 369862 - DNA, 25 bp, Homo sapien
gggtcagaatcattcggattgtttc

SEQ ID NO: 369863 - DNA, 25 bp, Homo sapien
tcattcggattgtttcaagtttggg

SEQ ID NO: 369864 - DNA, 25 bp, Homo sapien
tattaatccattgctttctgatgct

SEQ ID NO: 369865 - DNA, 25 bp, Homo sapien
gatgcctagagattgatctgctttt

SEQ ID NO: 369866 - DNA, 25 bp, Homo sapien
attggcttccagactaaaccctgga

SEQ ID NO: 369867 - DNA, 25 bp, Homo sapien
gttcgatttcagaaccagtctgcag

SEQ ID NO: 369868 - DNA, 25 bp, Homo sapien
agtctgcaggcaactctgcattgtc

SEQ ID NO: 369869 - DNA, 25 bp, Homo sapien
aactctgcattgtctccttagagaa

SEQ ID NO: 369870 - DNA, 25 bp, Homo sapien
gaactggacaattccactgatctgg

SEQ ID NO: 369871 - DNA, 25 bp, Homo sapien
attccactgatctggatcctttggc

SEQ ID NO: 369872 - DNA, 25 bp, Homo sapien
ttattgaggctggtcagcactcctg

SEQ ID NO: 369873 - DNA, 25 bp, Homo sapien
agcactcctggccagagtcttgaaa

SEQ ID NO: 369874 - DNA, 25 bp, Homo sapien
aaaccctggattgaggtacagctag

SEQ ID NO: 369875 - DNA, 25 bp, Homo sapien
gtacagctagaataactcacttagg

SEQ ID NO: 369876 - DNA, 25 bp, Homo sapien
tccttaaccctattgagacactttt

SEQ ID NO: 369877 - DNA, 25 bp, Homo sapien
aaaagcatccattcctatgacatta

SEQ ID NO: 369878 - DNA, 25 bp, Homo sapien
atgacattaagcctcacttccatta

SEQ ID NO: 369879 - DNA, 25 bp, Homo sapien
gcctcacttccattaataaacccaa

SEQ ID NO: 369880 - DNA, 25 bp, Homo sapien
caagtgaaccttgggtccagcacca

SEQ ID NO: 369881 - DNA, 25 bp, Homo sapien
gacagttccaagactgtacctactt

SEQ ID NO: 369882 - DNA, 25 bp, Homo sapien
actgtacctacttggcagtctgtgt

SEQ ID NO: 369883 - DNA, 25 bp, Homo sapien
ctgtgtggcctatttttatctgata

SEQ ID NO: 369884 - DNA, 25 bp, Homo sapien
gtccccaatacttgagaatcatctg

SEQ ID NO: 369885 - DNA, 25 bp, Homo sapien
gaatcatctgtagtgttctccttaa

SEQ ID NO: 369886 - DNA, 25 bp, Homo sapien
tagtgttctccttaaccctattgag

SEQ ID NO: 369887 - DNA, 25 bp, Homo sapien
gttcctagttgtccatcacagaaag

SEQ ID NO: 369888 - DNA, 25 bp, Homo sapien
gtccatcacagaaagcattagcaga

SEQ ID NO: 369889 - DNA, 25 bp, Homo sapien
aggatgctgtggtgcagcgggaaca

SEQ ID NO: 369890 - DNA, 25 bp, Homo sapien
ctggattcaagtccttgggaaagtg

SEQ ID NO: 369891 - DNA, 25 bp, Homo sapien
aagtgagaacatgggaccttgggct

SEQ ID NO: 369892 - DNA, 25 bp, Homo sapien
gggctggtgagactcaacttcctcc

SEQ ID NO: 369893 - DNA, 25 bp, Homo sapien
actaattccaccctgccaggttgtt

SEQ ID NO: 369894 - DNA, 25 bp, Homo sapien
gctttgtagcttgagcttgttccta

SEQ ID NO: 369895 - DNA, 25 bp, Homo sapien
gtagcttgagcttgttcctagttgt

SEQ ID NO: 369896 - DNA, 25 bp, Homo sapien
ttgagcttgttcctagttgtccatc

SEQ ID NO: 369897 - DNA, 25 bp, Homo sapien
agcttgttcctagttgtccatcaca

SEQ ID NO: 369898 - DNA, 25 bp, Homo sapien
ctttttcttgtttggagataggtga

SEQ ID NO: 369899 - DNA, 25 bp, Homo sapien
ataggtgatgtgttgtcatatcctg

SEQ ID NO: 369900 - DNA, 25 bp, Homo sapien
gatgtgttgtcatatcctgtgatac

SEQ ID NO: 369901 - DNA, 25 bp, Homo sapien
tcctgtgatacaggtcactcatctg

SEQ ID NO: 369902 - DNA, 25 bp, Homo sapien
ggtcactcatctggccttctgtttc

SEQ ID NO: 369903 - DNA, 25 bp, Homo sapien
ctgtttctgaagtttaagtctggtt

SEQ ID NO: 369904 - DNA, 25 bp, Homo sapien
taatactactcagcatttcttgttg

SEQ ID NO: 369905 - DNA, 25 bp, Homo sapien
agcatttcttgttgcctaagtgaga

SEQ ID NO: 369906 - DNA, 25 bp, Homo sapien
cttgttgcctaagtgagacgaaact

SEQ ID NO: 369907 - DNA, 25 bp, Homo sapien
acttcatgtattcttgtactgttca

SEQ ID NO: 369908 - DNA, 25 bp, Homo sapien
gtactgttcatttcaattaattggt

SEQ ID NO: 369909 - DNA, 25 bp, Homo sapien
gcaaatatcttaatgtctggcttga

SEQ ID NO: 369910 - DNA, 25 bp, Homo sapien
gtctggcttgataaaagataggctc

SEQ ID NO: 369911 - DNA, 25 bp, Homo sapien
aaagataggctctcgaatctcgcgt

SEQ ID NO: 369912 - DNA, 25 bp, Homo sapien
aatctcgcgttcattcctgtgatat

SEQ ID NO: 369913 - DNA, 25 bp, Homo sapien
tcgcgttcattcctgtgatatcaca

SEQ ID NO: 369914 - DNA, 25 bp, Homo sapien
tgcagcccacggaggcctctgctgt

SEQ ID NO: 369915 - DNA, 25 bp, Homo sapien
gcctctgctgtgcactctgtgagaa

SEQ ID NO: 369916 - DNA, 25 bp, Homo sapien
tgctgtgcactctgtgagaatgaga

SEQ ID NO: 369917 - DNA, 25 bp, Homo sapien
ttggaaccccagtcattcttaaatg

SEQ ID NO: 369918 - DNA, 25 bp, Homo sapien
ttgtttgtgtgggtaatagtcatca

SEQ ID NO: 369919 - DNA, 25 bp, Homo sapien
tagtcatcaatattgaccatattag

SEQ ID NO: 369920 - DNA, 25 bp, Homo sapien
tctcctgagagaacatccttgcttt

SEQ ID NO: 369921 - DNA, 25 bp, Homo sapien
gaacatccttgctttgagtcaggct

SEQ ID NO: 369922 - DNA, 25 bp, Homo sapien
tgagtcaggctgtgggcaagttcct

SEQ ID NO: 369923 - DNA, 25 bp, Homo sapien
gggcaagttcctgaccacagggagt

SEQ ID NO: 369924 - DNA, 25 bp, Homo sapien
gaccacagggagtaaattggcctct

SEQ ID NO: 369925 - DNA, 25 bp, Homo sapien
aattggcctctttgatacacttttg

SEQ ID NO: 369926 - DNA, 25 bp, Homo sapien
tctttgatacacttttgcttgcctc

SEQ ID NO: 369927 - DNA, 25 bp, Homo sapien
ggaattgcatccaaggtatacatac

SEQ ID NO: 369928 - DNA, 25 bp, Homo sapien
tattcatcgatgtttcgtgcttctc

SEQ ID NO: 369929 - DNA, 25 bp, Homo sapien
atgtttcgtgcttctccttatgaaa

SEQ ID NO: 369930 - DNA, 25 bp, Homo sapien
tctccttatgaaactccagctatgt

SEQ ID NO: 369931 - DNA, 25 bp, Homo sapien
cagcatttgaaactgtttactacta

SEQ ID NO: 369932 - DNA, 25 bp, Homo sapien
tgaaactgtttactactatttactt

SEQ ID NO: 369933 - DNA, 25 bp, Homo sapien
tgaacacaactacttatttttcggt

SEQ ID NO: 369934 - DNA, 25 bp, Homo sapien
caactacttatttttcggtgccttg

SEQ ID NO: 369935 - DNA, 25 bp, Homo sapien
cttatttttcggtgccttgtagaag

SEQ ID NO: 369936 - DNA, 25 bp, Homo sapien
atttttcggtgccttgtagaagaca

SEQ ID NO: 369937 - DNA, 25 bp, Homo sapien
ttcggtgccttgtagaagacattta

SEQ ID NO: 369938 - DNA, 25 bp, Homo sapien
agctaagtgcagcagtaggtgcctt

SEQ ID NO: 369939 - DNA, 25 bp, Homo sapien
taagtgcagcagtaggtgccttgta

SEQ ID NO: 369940 - DNA, 25 bp, Homo sapien
gtgcagcagtaggtgccttgtagtc

SEQ ID NO: 369941 - DNA, 25 bp, Homo sapien
gcagcagtaggtgccttgtagtccc

SEQ ID NO: 369942 - DNA, 25 bp, Homo sapien
cagtgtatcttttaacattgcacca

SEQ ID NO: 369943 - DNA, 25 bp, Homo sapien
ggcttattaacctattttccaactg

SEQ ID NO: 369944 - DNA, 25 bp, Homo sapien
tgaggaattctcaggcagcctaatg

SEQ ID NO: 369945 - DNA, 25 bp, Homo sapien
gaattctcaggcagcctaatgagag

SEQ ID NO: 369946 - DNA, 25 bp, Homo sapien
gtatcttttaacattgcaccaacca

SEQ ID NO: 369947 - DNA, 25 bp, Homo sapien
cagcctaatgagagtaagacttttt

SEQ ID NO: 369948 - DNA, 25 bp, Homo sapien
aaatatgttgataccagactttttc

SEQ ID NO: 369949 - DNA, 25 bp, Homo sapien
gttgataccagactttttcacagtt

SEQ ID NO: 369950 - DNA, 25 bp, Homo sapien
tttcacagtttttcctgttatgtat

SEQ ID NO: 369951 - DNA, 25 bp, Homo sapien
gtattactaattgtcttcagtcaag

SEQ ID NO: 369952 - DNA, 25 bp, Homo sapien
gattatttttaactcctgtgacacc

SEQ ID NO: 369953 - DNA, 25 bp, Homo sapien
accttcattttttgttggtatgcta

SEQ ID NO: 369954 - DNA, 25 bp, Homo sapien
tacccagcagtatattcttaaatat

SEQ ID NO: 369955 - DNA, 25 bp, Homo sapien
gtgtattttatgtgcttacacattt

SEQ ID NO: 369956 - DNA, 25 bp, Homo sapien
catttttccatagtactgtagatca

SEQ ID NO: 369957 - DNA, 25 bp, Homo sapien
gatgaaatttgatacttttgacaga

SEQ ID NO: 369958 - DNA, 25 bp, Homo sapien
aaaaacaggtcagtgagttccttgg

SEQ ID NO: 369959 - DNA, 25 bp, Homo sapien
ttcttaaatattactgttgagccat

SEQ ID NO: 369960 - DNA, 25 bp, Homo sapien
tactgttgagccatatatacgacaa

SEQ ID NO: 369961 - DNA, 25 bp, Homo sapien
tatacgacaatggtggactttgaat

SEQ ID NO: 369962 - DNA, 25 bp, Homo sapien
gactttgaatgtccgcacatctgta

SEQ ID NO: 369963 - DNA, 25 bp, Homo sapien
ttgaatgtccgcacatctgtagtaa

SEQ ID NO: 369964 - DNA, 25 bp, Homo sapien
cgtcctgtcaagagcctatggtttc

SEQ ID NO: 369965 - DNA, 25 bp, Homo sapien
agagcctatggtttcaagacttaaa

SEQ ID NO: 369966 - DNA, 25 bp, Homo sapien
tggtttcaagacttaaacatctttg

SEQ ID NO: 369967 - DNA, 25 bp, Homo sapien
gcctgtgttgccaccttggaaagaa

SEQ ID NO: 369968 - DNA, 25 bp, Homo sapien
gggcttgctggcagttgagttccac

SEQ ID NO: 369969 - DNA, 25 bp, Homo sapien
ggcagttgagttccaccaatgtttt

SEQ ID NO: 369970 - DNA, 25 bp, Homo sapien
agttccaccaatgttttctcaagcc

SEQ ID NO: 369971 - DNA, 25 bp, Homo sapien
ccaccaatgttttctcaagccgaca

SEQ ID NO: 369972 - DNA, 25 bp, Homo sapien
gggccctaaatcaaggtgagcttcc

SEQ ID NO: 369973 - DNA, 25 bp, Homo sapien
acctccgtgcacttgcattctgtgt

SEQ ID NO: 369974 - DNA, 25 bp, Homo sapien
gcacttgcattctgtgtgggcagga

SEQ ID NO: 369975 - DNA, 25 bp, Homo sapien
accgtgacaggcagggtgccaccaa

SEQ ID NO: 369976 - DNA, 25 bp, Homo sapien
aggcagggtgccaccaagcatgtgt

SEQ ID NO: 369977 - DNA, 25 bp, Homo sapien
accaagcatgtgtggcctcccagga

SEQ ID NO: 369978 - DNA, 25 bp, Homo sapien
tgtgtggcctcccaggagctaagac

SEQ ID NO: 369979 - DNA, 25 bp, Homo sapien
ccaggagctaagaccccagagttct

SEQ ID NO: 369980 - DNA, 25 bp, Homo sapien
gttcttcaggctctgctgagtgcct

SEQ ID NO: 369981 - DNA, 25 bp, Homo sapien
tgctgagtgcctcccatttgcacag

SEQ ID NO: 369982 - DNA, 25 bp, Homo sapien
tttgcacagcctctttatgctgtta

SEQ ID NO: 369983 - DNA, 25 bp, Homo sapien
agcctctttatgctgttaggaatga

SEQ ID NO: 369984 - DNA, 25 bp, Homo sapien
tgaagaaaagtctaaactgaagctg

SEQ ID NO: 369985 - DNA, 25 bp, Homo sapien
tttactgaggctctgctttacctac

SEQ ID NO: 369986 - DNA, 25 bp, Homo sapien
gagctgcagctttatcaggcccaat

SEQ ID NO: 369987 - DNA, 25 bp, Homo sapien
tatcaggcccaatccatgccataat

SEQ ID NO: 369988 - DNA, 25 bp, Homo sapien
ggagaaggccaaccctaaaggattg

SEQ ID NO: 369989 - DNA, 25 bp, Homo sapien
aaaggattgtcctcttggccagctg

SEQ ID NO: 369990 - DNA, 25 bp, Homo sapien
agctggtgctgcgaatcctgcctgc

SEQ ID NO: 369991 - DNA, 25 bp, Homo sapien
gacccttctgggaatgtttgcacac

SEQ ID NO: 369992 - DNA, 25 bp, Homo sapien
gacactcttgtgagactggcttatg

SEQ ID NO: 369993 - DNA, 25 bp, Homo sapien
cttatggcatgagttgtggacacct

SEQ ID NO: 369994 - DNA, 25 bp, Homo sapien
gtggacacctatagagtgttcttct

SEQ ID NO: 369995 - DNA, 25 bp, Homo sapien
gtgttcttctctaagacctggaaag

SEQ ID NO: 369996 - DNA, 25 bp, Homo sapien
acctggaaagtcagcaaccctctgg

SEQ ID NO: 369997 - DNA, 25 bp, Homo sapien
gttacccttccagtatggatatgaa

SEQ ID NO: 369998 - DNA, 25 bp, Homo sapien
gaaatatcaacatgtgtcccactgt

SEQ ID NO: 369999 - DNA, 25 bp, Homo sapien
aacatgtgtcccactgttcagagtt

SEQ ID NO: 370000 - DNA, 25 bp, Homo sapien
atgtgtcccactgttcagagtttta

SEQ ID NO: 370001 - DNA, 25 bp, Homo sapien
gaactcagtctccaggttgaccgat

SEQ ID NO: 370002 - DNA, 25 bp, Homo sapien
gtctccaggttgaccgatactgtat

SEQ ID NO: 370003 - DNA, 25 bp, Homo sapien
gatactgtatgacgcagatgcccta

SEQ ID NO: 370004 - DNA, 25 bp, Homo sapien
gaagagtctagaagagtcccaaatg

SEQ ID NO: 370005 - DNA, 25 bp, Homo sapien
aagagtcccaaatgtgaagtgtcca

SEQ ID NO: 370006 - DNA, 25 bp, Homo sapien
atgtgaagtgtccattttcctataa

SEQ ID NO: 370007 - DNA, 25 bp, Homo sapien
acatgttacccttccagtatggata

SEQ ID NO: 370008 - DNA, 25 bp, Homo sapien
gacgggatattagaaaaccagaggc

SEQ ID NO: 370009 - DNA, 25 bp, Homo sapien
ccagaggcaaactgcttggtttatt

SEQ ID NO: 370010 - DNA, 25 bp, Homo sapien
cttggtttattgaagcactaactga

SEQ ID NO: 370011 - DNA, 25 bp, Homo sapien
gcactaactgaatgaatgcaggtat

SEQ ID NO: 370012 - DNA, 25 bp, Homo sapien
ggtatacgagtaatccaggaatccc

SEQ ID NO: 370013 - DNA, 25 bp, Homo sapien
taatccaggaatcccatgcattaag

SEQ ID NO: 370014 - DNA, 25 bp, Homo sapien
aaatttatttctatcacctctgtat

SEQ ID NO: 370015 - DNA, 25 bp, Homo sapien
tcacctctgtattgttgttaccttg

SEQ ID NO: 370016 - DNA, 25 bp, Homo sapien
gcttggttttttcagcagttggtaa

SEQ ID NO: 370017 - DNA, 25 bp, Homo sapien
aactgataagcctgtttctcactct

SEQ ID NO: 370018 - DNA, 25 bp, Homo sapien
taagcctgtttctcactctgtcatt

SEQ ID NO: 370019 - DNA, 25 bp, Homo sapien
tggatgattttctcagattcttctg

SEQ ID NO: 370020 - DNA, 25 bp, Homo sapien
gacaggcactgctagattcagctat

SEQ ID NO: 370021 - DNA, 25 bp, Homo sapien
ggctgaagagattgagtatttgacc

SEQ ID NO: 370022 - DNA, 25 bp, Homo sapien
atttgaccttctctcaaaatcataa

SEQ ID NO: 370023 - DNA, 25 bp, Homo sapien
gtgagaattcataaggcacccaatg

SEQ ID NO: 370024 - DNA, 25 bp, Homo sapien
taaggcacccaatgttaagatttat

SEQ ID NO: 370025 - DNA, 25 bp, Homo sapien
gtggcaagttgagggagcattcttc

SEQ ID NO: 370026 - DNA, 25 bp, Homo sapien
cattttagcttttacctgacaacca

SEQ ID NO: 370027 - DNA, 25 bp, Homo sapien
tacctgacaaccaaacttgccttta

SEQ ID NO: 370028 - DNA, 25 bp, Homo sapien
tttaccccatccctagaattggtgc

SEQ ID NO: 370029 - DNA, 25 bp, Homo sapien
tccctagaattggtgctcttggaat

SEQ ID NO: 370030 - DNA, 25 bp, Homo sapien
agatgtatccagttaaagcaggcaa

SEQ ID NO: 370031 - DNA, 25 bp, Homo sapien
gtatccagttaaagcaggcaataga

SEQ ID NO: 370032 - DNA, 25 bp, Homo sapien
gctcttcaaaaattaagcaaagctg

SEQ ID NO: 370033 - DNA, 25 bp, Homo sapien
gcaaagctgatgaatctgcacctgt

SEQ ID NO: 370034 - DNA, 25 bp, Homo sapien
ctgatgaatctgcacctgttgcaaa

SEQ ID NO: 370035 - DNA, 25 bp, Homo sapien
gaggagcatactcttttggacaagc

SEQ ID NO: 370036 - DNA, 25 bp, Homo sapien
gcatactcttttggacaagcttacc

SEQ ID NO: 370037 - DNA, 25 bp, Homo sapien
gacaagcttacccaacaactgcagg

SEQ ID NO: 370038 - DNA, 25 bp, Homo sapien
caactgcagggccttgctgtgacaa

SEQ ID NO: 370039 - DNA, 25 bp, Homo sapien
ctgcagggccttgctgtgacaataa

SEQ ID NO: 370040 - DNA, 25 bp, Homo sapien
agggccttgctgtgacaataagcag

SEQ ID NO: 370041 - DNA, 25 bp, Homo sapien
ggaaccatgccaaaaagtgctttga

SEQ ID NO: 370042 - DNA, 25 bp, Homo sapien
gtgctttgaaggttttatggttgtt

SEQ ID NO: 370043 - DNA, 25 bp, Homo sapien
gaatatagatgaaagagggctctct

SEQ ID NO: 370044 - DNA, 25 bp, Homo sapien
gagggctctctttgattagccagag

SEQ ID NO: 370045 - DNA, 25 bp, Homo sapien
gctctctttgattagccagagggca

SEQ ID NO: 370046 - DNA, 25 bp, Homo sapien
tagccagagggcaacataagatttg

SEQ ID NO: 370047 - DNA, 25 bp, Homo sapien
taccttcaactgaattacctgaaac

SEQ ID NO: 370048 - DNA, 25 bp, Homo sapien
attacctgaaacagattgcagcccc

SEQ ID NO: 370049 - DNA, 25 bp, Homo sapien
attgcagcccccattataccaggct

SEQ ID NO: 370050 - DNA, 25 bp, Homo sapien
taccaggctgaaatcagcacacaag

SEQ ID NO: 370051 - DNA, 25 bp, Homo sapien
gatactgacacaaagggaaccatgc

SEQ ID NO: 370052 - DNA, 25 bp, Homo sapien
gcagccctggtttcttcttagtttt

SEQ ID NO: 370053 - DNA, 25 bp, Homo sapien
gtttcttcttagttttattggtctg

SEQ ID NO: 370054 - DNA, 25 bp, Homo sapien
tattggtctgtgttttgatcagcac

SEQ ID NO: 370055 - DNA, 25 bp, Homo sapien
gtgttttgatcagcacagtcacttt

SEQ ID NO: 370056 - DNA, 25 bp, Homo sapien
gatcagcacagtcacttttttgttc

SEQ ID NO: 370057 - DNA, 25 bp, Homo sapien
gttctctttcctggtaagcagggag

SEQ ID NO: 370058 - DNA, 25 bp, Homo sapien
gcagggagtcaaaacaatagcaaga

SEQ ID NO: 370059 - DNA, 25 bp, Homo sapien
gaatttctactactttgtaaactct

SEQ ID NO: 370060 - DNA, 25 bp, Homo sapien
tactttgtaaactctaggctcgtgg

SEQ ID NO: 370061 - DNA, 25 bp, Homo sapien
ttgtaaactctaggctcgtgggtct

SEQ ID NO: 370062 - DNA, 25 bp, Homo sapien
aaactctaggctcgtgggtctccta

SEQ ID NO: 370063 - DNA, 25 bp, Homo sapien
caggtgaatggctggggccccaaat

SEQ ID NO: 370064 - DNA, 25 bp, Homo sapien
ctggggccccaaatccaggagattt

SEQ ID NO: 370065 - DNA, 25 bp, Homo sapien
caggagattttcatcagaggtgggt

SEQ ID NO: 370066 - DNA, 25 bp, Homo sapien
agattttcatcagaggtgggtgggt

SEQ ID NO: 370067 - DNA, 25 bp, Homo sapien
gtgggtgggtgttcacaatatttat

SEQ ID NO: 370068 - DNA, 25 bp, Homo sapien
gggtgggtgttcacaatatttattt

SEQ ID NO: 370069 - DNA, 25 bp, Homo sapien
gtgggtgttcacaatatttattttt

SEQ ID NO: 370070 - DNA, 25 bp, Homo sapien
tattttttcatttggtaatgggagg

SEQ ID NO: 370071 - DNA, 25 bp, Homo sapien
ggtgatcagccccaacagagaaaat

SEQ ID NO: 370072 - DNA, 25 bp, Homo sapien
tgatcagccccaacagagaaaatga

SEQ ID NO: 370073 - DNA, 25 bp, Homo sapien
atgaggagtttagagttgcagctgg

SEQ ID NO: 370074 - DNA, 25 bp, Homo sapien
tatatctctgtgtgccgagatgctc

SEQ ID NO: 370075 - DNA, 25 bp, Homo sapien
gtgccgagatgctcccctccatgag

SEQ ID NO: 370076 - DNA, 25 bp, Homo sapien
atgagctccaccttcattgtgcata

SEQ ID NO: 370077 - DNA, 25 bp, Homo sapien
cattgtgcataggacgctgattctt

SEQ ID NO: 370078 - DNA, 25 bp, Homo sapien
ataggacgctgattcttagtacaca

SEQ ID NO: 370079 - DNA, 25 bp, Homo sapien
gcaacagagcttcagcagatgcctt

SEQ ID NO: 370080 - DNA, 25 bp, Homo sapien
agcttcagcagatgccttcttggga

SEQ ID NO: 370081 - DNA, 25 bp, Homo sapien
agatgccttcttgggaccgcgcttg

SEQ ID NO: 370082 - DNA, 25 bp, Homo sapien
ttgggaccgcgcttgactctagttc

SEQ ID NO: 370083 - DNA, 25 bp, Homo sapien
ttgaaatttcccctttcgctatgtt

SEQ ID NO: 370084 - DNA, 25 bp, Homo sapien
ctttcgctatgtttcactggttttt

SEQ ID NO: 370085 - DNA, 25 bp, Homo sapien
ggtacctggctgaagactttggact

SEQ ID NO: 370086 - DNA, 25 bp, Homo sapien
gactttggactttaacctggagatg

SEQ ID NO: 370087 - DNA, 25 bp, Homo sapien
taaagtccataccaaatccaacgcc

SEQ ID NO: 370088 - DNA, 25 bp, Homo sapien
ataccaaatccaacgcctagcaaat

SEQ ID NO: 370089 - DNA, 25 bp, Homo sapien
caacgcctagcaaatggagaacaag

SEQ ID NO: 370090 - DNA, 25 bp, Homo sapien
aagtgggagaggtctgccatgccct

SEQ ID NO: 370091 - DNA, 25 bp, Homo sapien
gtctgccatgccctatctgaccttg

SEQ ID NO: 370092 - DNA, 25 bp, Homo sapien
aggactcatcccttctcttctggag

SEQ ID NO: 370093 - DNA, 25 bp, Homo sapien
ttctcttctggagccatttccaatt

SEQ ID NO: 370094 - DNA, 25 bp, Homo sapien
tggagccatttccaattctgcccaa

SEQ ID NO: 370095 - DNA, 25 bp, Homo sapien
aattctgcccaaaaggacagcctga

SEQ ID NO: 370096 - DNA, 25 bp, Homo sapien
gttccagtagaagacttactcgcaa

SEQ ID NO: 370097 - DNA, 25 bp, Homo sapien
gacttactcgcaaaagcagtggaat

SEQ ID NO: 370098 - DNA, 25 bp, Homo sapien
ttttcttagtattttctgttacagg

SEQ ID NO: 370099 - DNA, 25 bp, Homo sapien
gttacaggtacagaagagtgcatac

SEQ ID NO: 370100 - DNA, 25 bp, Homo sapien
gagtgcatacaacacacagttttgt

SEQ ID NO: 370101 - DNA, 25 bp, Homo sapien
cacagttttgtcgaatagttatgaa

SEQ ID NO: 370102 - DNA, 25 bp, Homo sapien
agtgaacacttgtctaaccactgcc

SEQ ID NO: 370103 - DNA, 25 bp, Homo sapien
taaccactgcccgagtcaagaaaga

SEQ ID NO: 370104 - DNA, 25 bp, Homo sapien
ctgcccgagtcaagaaagaacattt

SEQ ID NO: 370105 - DNA, 25 bp, Homo sapien
ggaagtatctcaaggttgctttaac

SEQ ID NO: 370106 - DNA, 25 bp, Homo sapien
gctttaactgacatttctttaacac

SEQ ID NO: 370107 - DNA, 25 bp, Homo sapien
cagtgtatcttttaacattgcacca

SEQ ID NO: 370108 - DNA, 25 bp, Homo sapien
aactgaggaattctcaggcagccta

SEQ ID NO: 370109 - DNA, 25 bp, Homo sapien
tgaggaattctcaggcagcctaatg

SEQ ID NO: 370110 - DNA, 25 bp, Homo sapien
gaattctcaggcagcctaatgagag

SEQ ID NO: 370111 - DNA, 25 bp, Homo sapien
gtatcttttaacattgcaccaacca

SEQ ID NO: 370112 - DNA, 25 bp, Homo sapien
tatcttttaacattgcaccaaccac

SEQ ID NO: 370113 - DNA, 25 bp, Homo sapien
aaatatgttgataccagactttttc

SEQ ID NO: 370114 - DNA, 25 bp, Homo sapien
tttcacagtttttcctgttatgtat

SEQ ID NO: 370115 - DNA, 25 bp, Homo sapien
gttatgtattactaattgtcttcag

SEQ ID NO: 370116 - DNA, 25 bp, Homo sapien
gtattactaattgtcttcagtcaag

SEQ ID NO: 370117 - DNA, 25 bp, Homo sapien
ttactaattgtcttcagtcaagaaa

SEQ ID NO: 370118 - DNA, 25 bp, Homo sapien
ggaactccagactgacacagcagtt

SEQ ID NO: 370119 - DNA, 25 bp, Homo sapien
cagactgacacagcagttgtttttg

SEQ ID NO: 370120 - DNA, 25 bp, Homo sapien
aatccagatacatcattgtaaactc

SEQ ID NO: 370121 - DNA, 25 bp, Homo sapien
gtaaactcttactctaggtgctctt

SEQ ID NO: 370122 - DNA, 25 bp, Homo sapien
tcttactctaggtgctctttggtga

SEQ ID NO: 370123 - DNA, 25 bp, Homo sapien
agacaggctttgttctcttgttcat

SEQ ID NO: 370124 - DNA, 25 bp, Homo sapien
ggctttgttctcttgttcataacat

SEQ ID NO: 370125 - DNA, 25 bp, Homo sapien
ctcttgttcataacatttctctgca

SEQ ID NO: 370126 - DNA, 25 bp, Homo sapien
ttctctgcaaagaattctctatgga

SEQ ID NO: 370127 - DNA, 25 bp, Homo sapien
tctctatggagtgaagcgaatgaag

SEQ ID NO: 370128 - DNA, 25 bp, Homo sapien
gaaatagggaactccagactgacac

SEQ ID NO: 370129 - DNA, 25 bp, Homo sapien
actagctcggtcctgtgtccaggat

SEQ ID NO: 370130 - DNA, 25 bp, Homo sapien
tgtgtccaggatgctagagcccaga

SEQ ID NO: 370131 - DNA, 25 bp, Homo sapien
agagacggcactcccagaacttgct

SEQ ID NO: 370132 - DNA, 25 bp, Homo sapien
agaacttgctgggttcctctgtctg

SEQ ID NO: 370133 - DNA, 25 bp, Homo sapien
tgtctctttgttaactgtctccctg

SEQ ID NO: 370134 - DNA, 25 bp, Homo sapien
catgaatagccctgcactctgtgca

SEQ ID NO: 370135 - DNA, 25 bp, Homo sapien
actctgtgcagtagtgtccattctc

SEQ ID NO: 370136 - DNA, 25 bp, Homo sapien
agtagtgtccattctctcggcctgg

SEQ ID NO: 370137 - DNA, 25 bp, Homo sapien
gactccgaaacaggttaggtgactt

SEQ ID NO: 370138 - DNA, 25 bp, Homo sapien
taggtgacttgtgttctacgtgtct

SEQ ID NO: 370139 - DNA, 25 bp, Homo sapien
gttctacgtgtcttaccaaactctt

SEQ ID NO: 370140 - DNA, 25 bp, Homo sapien
gactgggaatatcttctaaatcctt

SEQ ID NO: 370141 - DNA, 25 bp, Homo sapien
aactgtgctgaaaacaaactgctga

SEQ ID NO: 370142 - DNA, 25 bp, Homo sapien
tgactttaaaacgatgcctctggaa

SEQ ID NO: 370143 - DNA, 25 bp, Homo sapien
gaaaaaagggacatgcagcagctgc

SEQ ID NO: 370144 - DNA, 25 bp, Homo sapien
agcagctgccagatgttcatgatcc

SEQ ID NO: 370145 - DNA, 25 bp, Homo sapien
tcccctacttaacaaaggcacctat

SEQ ID NO: 370146 - DNA, 25 bp, Homo sapien
aaaggcacctatatttcaccagaaa

SEQ ID NO: 370147 - DNA, 25 bp, Homo sapien
gtgcagaaacccatcttttcgaaag

SEQ ID NO: 370148 - DNA, 25 bp, Homo sapien
gaaagagctttccatcattcaggca

SEQ ID NO: 370149 - DNA, 25 bp, Homo sapien
tcattcaggcaacaggtcactcagt

SEQ ID NO: 370150 - DNA, 25 bp, Homo sapien
gaaactgtgccaggagactgggaat

SEQ ID NO: 370151 - DNA, 25 bp, Homo sapien
ggaagctctaagtttgccattgaaa

SEQ ID NO: 370152 - DNA, 25 bp, Homo sapien
ttgccattgaaactttttgtaccag

SEQ ID NO: 370153 - DNA, 25 bp, Homo sapien
gaaactttttgtaccagtaatccat

SEQ ID NO: 370154 - DNA, 25 bp, Homo sapien
gtaatccataaactggttgttctat

SEQ ID NO: 370155 - DNA, 25 bp, Homo sapien
gcagcatgttacaaatgactgcttt

SEQ ID NO: 370156 - DNA, 25 bp, Homo sapien
atcctttaatttatcctgaatgctg

SEQ ID NO: 370157 - DNA, 25 bp, Homo sapien
aatgctgtagtgttaaattagtgga

SEQ ID NO: 370158 - DNA, 25 bp, Homo sapien
attggcagtctgtgggtgattaatt

SEQ ID NO: 370159 - DNA, 25 bp, Homo sapien
taatttggtatggatttgtcagttt

SEQ ID NO: 370160 - DNA, 25 bp, Homo sapien
gtcagttttgtgtggagtttaagaa

SEQ ID NO: 370161 - DNA, 25 bp, Homo sapien
gaacagccttaaactctacatttca

SEQ ID NO: 370162 - DNA, 25 bp, Homo sapien
agggcagcgtagaaaaccagggctc

SEQ ID NO: 370163 - DNA, 25 bp, Homo sapien
aaccagggctcttgtcccaaaagag

SEQ ID NO: 370164 - DNA, 25 bp, Homo sapien
cagggctcttgtcccaaaagaggag

SEQ ID NO: 370165 - DNA, 25 bp, Homo sapien
gaaagagggttttgcagtcaaggaa

SEQ ID NO: 370166 - DNA, 25 bp, Homo sapien
aaacccaacatgatcgaagagaagc

SEQ ID NO: 370167 - DNA, 25 bp, Homo sapien
gaagagaagccctgaatctgcatca

SEQ ID NO: 370168 - DNA, 25 bp, Homo sapien
aagccctgaatctgcatcagaggga

SEQ ID NO: 370169 - DNA, 25 bp, Homo sapien
tgggcagtgtcgcaacttggccact

SEQ ID NO: 370170 - DNA, 25 bp, Homo sapien
agtgtcgcaacttggccactgcggc

SEQ ID NO: 370171 - DNA, 25 bp, Homo sapien
tatcatatcaataacaacgtaccgt

SEQ ID NO: 370172 - DNA, 25 bp, Homo sapien
gtggccaagggcagcgtagaaaacc

SEQ ID NO: 370173 - DNA, 25 bp, Homo sapien
gagctgcattaatactacattgtca

SEQ ID NO: 370174 - DNA, 25 bp, Homo sapien
tacagctatccaaggagcaagtgct

SEQ ID NO: 370175 - DNA, 25 bp, Homo sapien
taaataatagtgttcctgcagggat

SEQ ID NO: 370176 - DNA, 25 bp, Homo sapien
ttcctgcagggatgtctgaagtact

SEQ ID NO: 370177 - DNA, 25 bp, Homo sapien
gtctgaagtactctgcaaggctaat

SEQ ID NO: 370178 - DNA, 25 bp, Homo sapien
gcaaggctaattaggacagatcaat

SEQ ID NO: 370179 - DNA, 25 bp, Homo sapien
agatcaatgtacacttacctctcca

SEQ ID NO: 370180 - DNA, 25 bp, Homo sapien
tacacttacctctccagaaggctga

SEQ ID NO: 370181 - DNA, 25 bp, Homo sapien
aaaggtgtgtagtgactatgtgtca

SEQ ID NO: 370182 - DNA, 25 bp, Homo sapien
aaatttacttgaccatgggcaacag

SEQ ID NO: 370183 - DNA, 25 bp, Homo sapien
ttgaccatgggcaacagatgtccat

SEQ ID NO: 370184 - DNA, 25 bp, Homo sapien
tacactacgcccaaatgcagtgctt

SEQ ID NO: 370185 - DNA, 25 bp, Homo sapien
gtattcagatggtgagtgtcctccg

SEQ ID NO: 370186 - DNA, 25 bp, Homo sapien
gagtgtcctccgaaggaaaatgttc

SEQ ID NO: 370187 - DNA, 25 bp, Homo sapien
gcccaaatgcagtgctttcttcttt

SEQ ID NO: 370188 - DNA, 25 bp, Homo sapien
atgttctatgtttgtgtagcgtgac

SEQ ID NO: 370189 - DNA, 25 bp, Homo sapien
gtagcgtgacatgcaggcctagact

SEQ ID NO: 370190 - DNA, 25 bp, Homo sapien
atgcaggcctagacttgtggaaact

SEQ ID NO: 370191 - DNA, 25 bp, Homo sapien
ccttttatgctataccagggtaaca

SEQ ID NO: 370192 - DNA, 25 bp, Homo sapien
aaccatgtaggtgatttgtattatt

SEQ ID NO: 370193 - DNA, 25 bp, Homo sapien
tgatttgtattattccaccaggatc

SEQ ID NO: 370194 - DNA, 25 bp, Homo sapien
ttattccaccaggatcagtgcgaag

SEQ ID NO: 370195 - DNA, 25 bp, Homo sapien
atttgctctgaagagagtcacccag

SEQ ID NO: 370196 - DNA, 25 bp, Homo sapien
tgaagagagtcacccagagtaactt

SEQ ID NO: 370197 - DNA, 25 bp, Homo sapien
gagtcacccagagtaacttaaattg

SEQ ID NO: 370198 - DNA, 25 bp, Homo sapien
cacctctctgtctggccggctaggg

SEQ ID NO: 370199 - DNA, 25 bp, Homo sapien
ccggctagggcccaacgaagtcaga

SEQ ID NO: 370200 - DNA, 25 bp, Homo sapien
ggcccaacgaagtcagagccacgtg

SEQ ID NO: 370201 - DNA, 25 bp, Homo sapien
gaagtcagagccacgtgcaaatcac

SEQ ID NO: 370202 - DNA, 25 bp, Homo sapien
gagccacgtgcaaatcactctatgt

SEQ ID NO: 370203 - DNA, 25 bp, Homo sapien
gtgcaaatcactctatgttaaacgg

SEQ ID NO: 370204 - DNA, 25 bp, Homo sapien
ggagaatgccacagtatgtgtgaca

SEQ ID NO: 370205 - DNA, 25 bp, Homo sapien
atgccacagtatgtgtgacatttgc

SEQ ID NO: 370206 - DNA, 25 bp, Homo sapien
atctgttaccattaatactcaatag

SEQ ID NO: 370207 - DNA, 25 bp, Homo sapien
tactcaatagtcctatttttcctat

SEQ ID NO: 370208 - DNA, 25 bp, Homo sapien
gtaaaatccaccatgctaattgcag

SEQ ID NO: 370209 - DNA, 25 bp, Homo sapien
ccaccatgctaattgcagaaggtat

SEQ ID NO: 370210 - DNA, 25 bp, Homo sapien
gtatattagaagtcaactggagcca

SEQ ID NO: 370211 - DNA, 25 bp, Homo sapien
caactggagccattcattattaaca

SEQ ID NO: 370212 - DNA, 25 bp, Homo sapien
ggagccattcattattaacaatcac

SEQ ID NO: 370213 - DNA, 25 bp, Homo sapien
aggcagtttcattcaagcaagcttt

SEQ ID NO: 370214 - DNA, 25 bp, Homo sapien
ggcagcagtcaacatccttaaacat

SEQ ID NO: 370215 - DNA, 25 bp, Homo sapien
gtcaacatccttaaacatactaact

SEQ ID NO: 370216 - DNA, 25 bp, Homo sapien
gatctaagtcttcacacaagtcaat

SEQ ID NO: 370217 - DNA, 25 bp, Homo sapien
aacctgttgagccatttggtcccat

SEQ ID NO: 370218 - DNA, 25 bp, Homo sapien
ggacccaagtcctgtgtttcatcgt

SEQ ID NO: 370219 - DNA, 25 bp, Homo sapien
gtgtttcatcgttactaccatgtgt

SEQ ID NO: 370220 - DNA, 25 bp, Homo sapien
tactaccatgtgttccgtgagggag

SEQ ID NO: 370221 - DNA, 25 bp, Homo sapien
agaactggaaggtgcctgcaggact

SEQ ID NO: 370222 - DNA, 25 bp, Homo sapien
caggactgtgagtgatgtcagaatt

SEQ ID NO: 370223 - DNA, 25 bp, Homo sapien
gtcagaattctgcaaagctactacg

SEQ ID NO: 370224 - DNA, 25 bp, Homo sapien
aagctactacgatcaaggaaactgg

SEQ ID NO: 370225 - DNA, 25 bp, Homo sapien
aggaaactggtgtgtgattcttcaa

SEQ ID NO: 370226 - DNA, 25 bp, Homo sapien
gtgtgattcttcaaaaggcctgatt

SEQ ID NO: 370227 - DNA, 25 bp, Homo sapien
ttatttacctgaacacatcatatat

SEQ ID NO: 370228 - DNA, 25 bp, Homo sapien
aaaaagccattgagcagtcctcaga

SEQ ID NO: 370229 - DNA, 25 bp, Homo sapien
gtcctcagaggttatggactctcaa

SEQ ID NO: 370230 - DNA, 25 bp, Homo sapien
ggttatggactctcaagcgactaat

SEQ ID NO: 370231 - DNA, 25 bp, Homo sapien
ggactctcaagcgactaatggaata

SEQ ID NO: 370232 - DNA, 25 bp, Homo sapien
tagtgttctgttgtgaagtctagaa

SEQ ID NO: 370233 - DNA, 25 bp, Homo sapien
agcaccttgtattgtctgcttctaa

SEQ ID NO: 370234 - DNA, 25 bp, Homo sapien
gtctgcttctaaagtgtcctatagt

SEQ ID NO: 370235 - DNA, 25 bp, Homo sapien
gttggtgtacatgtgctacctgttt

SEQ ID NO: 370236 - DNA, 25 bp, Homo sapien
gtacatgtgctacctgttttatggg

SEQ ID NO: 370237 - DNA, 25 bp, Homo sapien
gaatgtttaacacgatcctccaagt

SEQ ID NO: 370238 - DNA, 25 bp, Homo sapien
taacacgatcctccaagttggttct

SEQ ID NO: 370239 - DNA, 25 bp, Homo sapien
ttttaaggaatgtcacgatagtgca

SEQ ID NO: 370240 - DNA, 25 bp, Homo sapien
gtcacgatagtgcagaatacctgga

SEQ ID NO: 370241 - DNA, 25 bp, Homo sapien
cctggaaatgtgtaataccttcttt

SEQ ID NO: 370242 - DNA, 25 bp, Homo sapien
atgtttgtggactaatgtgatgatt

SEQ ID NO: 370243 - DNA, 25 bp, Homo sapien
gagatgttctcactgtgatttcaac

SEQ ID NO: 370244 - DNA, 25 bp, Homo sapien
tgtgatttcaacaacctatagcaaa

SEQ ID NO: 370245 - DNA, 25 bp, Homo sapien
gaccacagcagagaatcaaacatgc

SEQ ID NO: 370246 - DNA, 25 bp, Homo sapien
aaacatgcaactctgaaatactgta

SEQ ID NO: 370247 - DNA, 25 bp, Homo sapien
ttcaaatcagaatatagctacgtat

SEQ ID NO: 370248 - DNA, 25 bp, Homo sapien
agctacgtatgattggatacttttt

SEQ ID NO: 370249 - DNA, 25 bp, Homo sapien
tttcttgccaattatgtttgagttg

SEQ ID NO: 370250 - DNA, 25 bp, Homo sapien
taagtgttaactgaggaagtcccaa

SEQ ID NO: 370251 - DNA, 25 bp, Homo sapien
gaagtcccaaaaaggtgctgtcact

SEQ ID NO: 370252 - DNA, 25 bp, Homo sapien
ggtgctgtcactttaagttctggac

SEQ ID NO: 370253 - DNA, 25 bp, Homo sapien
tgtcactttaagttctggacttggg

SEQ ID NO: 370254 - DNA, 25 bp, Homo sapien
gttcaaatacaatgttctaggacaa

SEQ ID NO: 370255 - DNA, 25 bp, Homo sapien
aacagcaaagcatttgtgtttgttt

SEQ ID NO: 370256 - DNA, 25 bp, Homo sapien
tttgtgtttgtttgtctatttgtaa

SEQ ID NO: 370257 - DNA, 25 bp, Homo sapien
tttgtaaagcaaccaccttccttat

SEQ ID NO: 370258 - DNA, 25 bp, Homo sapien
aagcaaccaccttccttattggaag

SEQ ID NO: 370259 - DNA, 25 bp, Homo sapien
acatgtaaatacttgctgcagcatt

SEQ ID NO: 370260 - DNA, 25 bp, Homo sapien
cttgctgcagcatttaatatgttta

SEQ ID NO: 370261 - DNA, 25 bp, Homo sapien
atgaacatggagctgcatcttttta

SEQ ID NO: 370262 - DNA, 25 bp, Homo sapien
gaacatggagctgcatctttttaaa

SEQ ID NO: 370263 - DNA, 25 bp, Homo sapien
catggagctgcatctttttaaacgt

SEQ ID NO: 370264 - DNA, 25 bp, Homo sapien
ggagctgcatctttttaaacgttgt

SEQ ID NO: 370265 - DNA, 25 bp, Homo sapien
agctgcatctttttaaacgttgttt

SEQ ID NO: 370266 - DNA, 25 bp, Homo sapien
aacgttgttttttgatgcttcagac

SEQ ID NO: 370267 - DNA, 25 bp, Homo sapien
gttgttttttgatgcttcagactct

SEQ ID NO: 370268 - DNA, 25 bp, Homo sapien
gttttttgatgcttcagactcttaa

SEQ ID NO: 370269 - DNA, 25 bp, Homo sapien
gatgcttcagactcttaatgctttt

SEQ ID NO: 370270 - DNA, 25 bp, Homo sapien
gcttcagactcttaatgcttttata

SEQ ID NO: 370271 - DNA, 25 bp, Homo sapien
cagactcttaatgcttttatataaa

SEQ ID NO: 370272 - DNA, 25 bp, Homo sapien
attgatcttcaatgtgctgtgttaa

SEQ ID NO: 370273 - DNA, 25 bp, Homo sapien
gtgctgtgttaaatcttgcttctct

SEQ ID NO: 370274 - DNA, 25 bp, Homo sapien
gtgttaaatcttgcttctctgaaaa

SEQ ID NO: 370275 - DNA, 25 bp, Homo sapien
aatcttgcttctctgaaaagttgga

SEQ ID NO: 370276 - DNA, 25 bp, Homo sapien
tggagacaagatttgtcttcctttt

SEQ ID NO: 370277 - DNA, 25 bp, Homo sapien
acccatgcagaccattgtttgatct

SEQ ID NO: 370278 - DNA, 25 bp, Homo sapien
gcagaccattgtttgatctatgcta

SEQ ID NO: 370279 - DNA, 25 bp, Homo sapien
gaccattgtttgatctatgctaact

SEQ ID NO: 370280 - DNA, 25 bp, Homo sapien
atctatgctaacttatcaacttggc

SEQ ID NO: 370281 - DNA, 25 bp, Homo sapien
gctaacttatcaacttggctattca

SEQ ID NO: 370282 - DNA, 25 bp, Homo sapien
ttatcaacttggctattcaataaag

SEQ ID NO: 370283 - DNA, 25 bp, Homo sapien
aacgtggcagtcaacgccaagggca

SEQ ID NO: 370284 - DNA, 25 bp, Homo sapien
ctacatcggcggagcccctgacgtg

SEQ ID NO: 370285 - DNA, 25 bp, Homo sapien
ggagcccctgacgtggccacgctga

SEQ ID NO: 370286 - DNA, 25 bp, Homo sapien
accgggggcagattctcctcgggca

SEQ ID NO: 370287 - DNA, 25 bp, Homo sapien
tctcctcgggcatcacaggctgtgt

SEQ ID NO: 370288 - DNA, 25 bp, Homo sapien
tcctcgggcatcacaggctgtgtca

SEQ ID NO: 370289 - DNA, 25 bp, Homo sapien
tcgggcatcacaggctgtgtcaaga

SEQ ID NO: 370290 - DNA, 25 bp, Homo sapien
catcacaggctgtgtcaagaacctg

SEQ ID NO: 370291 - DNA, 25 bp, Homo sapien
acaggctgtgtcaagaacctggtgc

SEQ ID NO: 370292 - DNA, 25 bp, Homo sapien
gccccagcccgacaatgtcgagtat

SEQ ID NO: 370293 - DNA, 25 bp, Homo sapien
gcccgacaatgtcgagtatattatt

SEQ ID NO: 370294 - DNA, 25 bp, Homo sapien
aagttattttgctcgactgaaaaag

SEQ ID NO: 370295 - DNA, 25 bp, Homo sapien
gttattttgctcgactgaaaaagaa

SEQ ID NO: 370296 - DNA, 25 bp, Homo sapien
aaaatgcagagacagcctcagctgt

SEQ ID NO: 370297 - DNA, 25 bp, Homo sapien
gcagagacagcctcagctgtagcta

SEQ ID NO: 370298 - DNA, 25 bp, Homo sapien
agacagcctcagctgtagctacaag

SEQ ID NO: 370299 - DNA, 25 bp, Homo sapien
aggactcatactgggaaggaagata

SEQ ID NO: 370300 - DNA, 25 bp, Homo sapien
ttttagagccagacaagtgcaacat

SEQ ID NO: 370301 - DNA, 25 bp, Homo sapien
gagccagacaagtgcaacattgctg

SEQ ID NO: 370302 - DNA, 25 bp, Homo sapien
ccagacaagtgcaacattgctgtgg

SEQ ID NO: 370303 - DNA, 25 bp, Homo sapien
aagaggaatatatgactgatgagaa

SEQ ID NO: 370304 - DNA, 25 bp, Homo sapien
tcagttaaaggagatcaggcgtaca

SEQ ID NO: 370305 - DNA, 25 bp, Homo sapien
agtggtagccagtagcaacctcagt

SEQ ID NO: 370306 - DNA, 25 bp, Homo sapien
gccagtagcaacctcagtgacaatt

SEQ ID NO: 370307 - DNA, 25 bp, Homo sapien
taatgtacatgatgctctccagccg

SEQ ID NO: 370308 - DNA, 25 bp, Homo sapien
gctctccagccgagtacaaaaatat

SEQ ID NO: 370309 - DNA, 25 bp, Homo sapien
gtgggtggatttacaattatgaaca

SEQ ID NO: 370310 - DNA, 25 bp, Homo sapien
aacaatcaccgcactgtttgttgct

SEQ ID NO: 370311 - DNA, 25 bp, Homo sapien
gataatcaagaccaatgcctgtgca

SEQ ID NO: 370312 - DNA, 25 bp, Homo sapien
aagaccaatgcctgtgcacgctttc

SEQ ID NO: 370313 - DNA, 25 bp, Homo sapien
cacgctttctctaactttctctaaa

SEQ ID NO: 370314 - DNA, 25 bp, Homo sapien
ctaactttctctaaaaggactgcat

SEQ ID NO: 370315 - DNA, 25 bp, Homo sapien
aggactgcatataaagacttcaaat

SEQ ID NO: 370316 - DNA, 25 bp, Homo sapien
taggcttatcgttcaaatacagcac

SEQ ID NO: 370317 - DNA, 25 bp, Homo sapien
caaatacagcacttgaatatcccaa

SEQ ID NO: 370318 - DNA, 25 bp, Homo sapien
tgaatatcccaagtagttcttctac

SEQ ID NO: 370319 - DNA, 25 bp, Homo sapien
gtagttcttctacgcatagctcacc

SEQ ID NO: 370320 - DNA, 25 bp, Homo sapien
atagctcacctttctaaacccagtt

SEQ ID NO: 370321 - DNA, 25 bp, Homo sapien
ttctaaacccagttaagcatggaag

SEQ ID NO: 370322 - DNA, 25 bp, Homo sapien
attgatatcttttcccaagtactgg

SEQ ID NO: 370323 - DNA, 25 bp, Homo sapien
tcccaagtactggattttaaatctg

SEQ ID NO: 370324 - DNA, 25 bp, Homo sapien
atatttcagttgagctgctgttttc

SEQ ID NO: 370325 - DNA, 25 bp, Homo sapien
ctgttttcttccatgcaatattgta

SEQ ID NO: 370326 - DNA, 25 bp, Homo sapien
aagctggtgagagtgccctcctaca

SEQ ID NO: 370327 - DNA, 25 bp, Homo sapien
atgaaatggacatccttttaactaa

SEQ ID NO: 370328 - DNA, 25 bp, Homo sapien
ggaattgaacattgcagttttcaaa

SEQ ID NO: 370329 - DNA, 25 bp, Homo sapien
caaatatttttccttgttgggtctg

SEQ ID NO: 370330 - DNA, 25 bp, Homo sapien
gggagatttaaattgcgctaacagt

SEQ ID NO: 370331 - DNA, 25 bp, Homo sapien
aaaaggaattctactttgatctgca

SEQ ID NO: 370332 - DNA, 25 bp, Homo sapien
atttaaattgcgctaacagtgttgc

SEQ ID NO: 370333 - DNA, 25 bp, Homo sapien
gttcttaggtgaaacatttacccat

SEQ ID NO: 370334 - DNA, 25 bp, Homo sapien
gaaatactgagacatgaaaggcatt

SEQ ID NO: 370335 - DNA, 25 bp, Homo sapien
catgaaaggcattatcaactaactc

SEQ ID NO: 370336 - DNA, 25 bp, Homo sapien
cagtgttgcgcaaaaatgagttcat

SEQ ID NO: 370337 - DNA, 25 bp, Homo sapien
gagttcatgccatttaacatattgt

SEQ ID NO: 370338 - DNA, 25 bp, Homo sapien
cttactacaagaatggcaggcagaa

SEQ ID NO: 370339 - DNA, 25 bp, Homo sapien
ggcaggcagaattccctacttattt

SEQ ID NO: 370340 - DNA, 25 bp, Homo sapien
tatcactgatgtctcactctttttc

SEQ ID NO: 370341 - DNA, 25 bp, Homo sapien
gccacaaagtttaattcacctaagt

SEQ ID NO: 370342 - DNA, 25 bp, Homo sapien
ttcacctaagtgagacgtgcatatg

SEQ ID NO: 370343 - DNA, 25 bp, Homo sapien
agacgtgcatatgatgtaactccac

SEQ ID NO: 370344 - DNA, 25 bp, Homo sapien
gtaactccactgtacagatacacag

SEQ ID NO: 370345 - DNA, 25 bp, Homo sapien
gatacacagatctttacagaagaac

SEQ ID NO: 370346 - DNA, 25 bp, Homo sapien
ttttggcaacccctatgcccctggg

SEQ ID NO: 370347 - DNA, 25 bp, Homo sapien
tatgcccctgggtagggtccagaag

SEQ ID NO: 370348 - DNA, 25 bp, Homo sapien
cttacttatggagagcatgtgtcac

SEQ ID NO: 370349 - DNA, 25 bp, Homo sapien
gaagagggaacacttcctcactcat

SEQ ID NO: 370350 - DNA, 25 bp, Homo sapien
gaacacttcctcactcattatatga

SEQ ID NO: 370351 - DNA, 25 bp, Homo sapien
ttatatgaggtaagcattgccctaa

SEQ ID NO: 370352 - DNA, 25 bp, Homo sapien
gtaagcattgccctaataccaaaac

SEQ ID NO: 370353 - DNA, 25 bp, Homo sapien
tgccctaataccaaaaccaatgtta

SEQ ID NO: 370354 - DNA, 25 bp, Homo sapien
tgaaacctacagaccaataaccctc

SEQ ID NO: 370355 - DNA, 25 bp, Homo sapien
agaccaataaccctcatgaacataa

SEQ ID NO: 370356 - DNA, 25 bp, Homo sapien
aaagaaactatccttggaatgcaag

SEQ ID NO: 370357 - DNA, 25 bp, Homo sapien
tatccttggaatgcaaggctggttc

SEQ ID NO: 370358 - DNA, 25 bp, Homo sapien
aaaatcaatcagtgtaatctaccat

SEQ ID NO: 370359 - DNA, 25 bp, Homo sapien
atctaccatattaacagtctgaaga

SEQ ID NO: 370360 - DNA, 25 bp, Homo sapien
tacacgttgacagcatcctcattga

SEQ ID NO: 370361 - DNA, 25 bp, Homo sapien
gcatcctcattgaatcctttatgtt

SEQ ID NO: 370362 - DNA, 25 bp, Homo sapien
aagcatagcagaaagtgctcccatt

SEQ ID NO: 370363 - DNA, 25 bp, Homo sapien
gtgctcccattacttatttggccaa

SEQ ID NO: 370364 - DNA, 25 bp, Homo sapien
caaactactgtttggtccatgcaag

SEQ ID NO: 370365 - DNA, 25 bp, Homo sapien
catgtatgttatttccttgagggta

SEQ ID NO: 370366 - DNA, 25 bp, Homo sapien
gtgaacctccttaaactgcatgtat

SEQ ID NO: 370367 - DNA, 25 bp, Homo sapien
tgcatgtatatgtcactgttccaat

SEQ ID NO: 370368 - DNA, 25 bp, Homo sapien
tgttccaatgtatgtgtgtctctct

SEQ ID NO: 370369 - DNA, 25 bp, Homo sapien
tatcacgtaacccagcacttatttc

SEQ ID NO: 370370 - DNA, 25 bp, Homo sapien
acttatttcctcagccaagtggcta

SEQ ID NO: 370371 - DNA, 25 bp, Homo sapien
tgagcttccatatatggccctcaga

SEQ ID NO: 370372 - DNA, 25 bp, Homo sapien
agtatccatgtctaatttatctttg

SEQ ID NO: 370373 - DNA, 25 bp, Homo sapien
ctcagaatacaaagcccagtccttc

SEQ ID NO: 370374 - DNA, 25 bp, Homo sapien
tccttcttctcactcggttcagtaa

SEQ ID NO: 370375 - DNA, 25 bp, Homo sapien
tcggttcagtaactgccagaggcag

SEQ ID NO: 370376 - DNA, 25 bp, Homo sapien
cagaggcagcatacagggttggtta

SEQ ID NO: 370377 - DNA, 25 bp, Homo sapien
acagggttggttaagagcacagtct

SEQ ID NO: 370378 - DNA, 25 bp, Homo sapien
gggcccactggcttgagttcaaatc

SEQ ID NO: 370379 - DNA, 25 bp, Homo sapien
gagttcaaatccttccatgagatgt

SEQ ID NO: 370380 - DNA, 25 bp, Homo sapien
gtgtctctggataagttactcaacc

SEQ ID NO: 370381 - DNA, 25 bp, Homo sapien
gcttctcagcacaggagtgaggaga

SEQ ID NO: 370382 - DNA, 25 bp, Homo sapien
gacacaggatttatctctccacgtt

SEQ ID NO: 370383 - DNA, 25 bp, Homo sapien
atctctccacgtttgtatttcatta

SEQ ID NO: 370384 - DNA, 25 bp, Homo sapien
attcttggaaagcaacggctctgga

SEQ ID NO: 370385 - DNA, 25 bp, Homo sapien
gttacttgcgtaaccttggatgcca

SEQ ID NO: 370386 - DNA, 25 bp, Homo sapien
ggatgccatcttggacaggccgtaa

SEQ ID NO: 370387 - DNA, 25 bp, Homo sapien
aggccgtaactttctgaggaccatc

SEQ ID NO: 370388 - DNA, 25 bp, Homo sapien
gaggaccatcctgtgggtgtagtta

SEQ ID NO: 370389 - DNA, 25 bp, Homo sapien
tatggtcccataacattacctgttg

SEQ ID NO: 370390 - DNA, 25 bp, Homo sapien
tgttgtcacagtttccttaaggtca

SEQ ID NO: 370391 - DNA, 25 bp, Homo sapien
taaggtcaagctgaactcgctgcat

SEQ ID NO: 370392 - DNA, 25 bp, Homo sapien
gaactcgctgcatttgtgcaaactg

SEQ ID NO: 370393 - DNA, 25 bp, Homo sapien
cccaaagtagcgctgcgagcagctg

SEQ ID NO: 370394 - DNA, 25 bp, Homo sapien
aagtagcgctgcgagcagctgcgtc

SEQ ID NO: 370395 - DNA, 25 bp, Homo sapien
tagcgctgcgagcagctgcgtctcc

SEQ ID NO: 370396 - DNA, 25 bp, Homo sapien
agaaccctccggtctcaaggaagca

SEQ ID NO: 370397 - DNA, 25 bp, Homo sapien
aaccctccggtctcaaggaagcagg

SEQ ID NO: 370398 - DNA, 25 bp, Homo sapien
ccctccggtctcaaggaagcaggtg

SEQ ID NO: 370399 - DNA, 25 bp, Homo sapien
tccggtctcaaggaagcaggtgaca

SEQ ID NO: 370400 - DNA, 25 bp, Homo sapien
ccttctctcaaacctctaaacagga

SEQ ID NO: 370401 - DNA, 25 bp, Homo sapien
tctaaacaggaaatagcccgaatca

SEQ ID NO: 370402 - DNA, 25 bp, Homo sapien
gctgagtggcgtgcgtgcaggccca

SEQ ID NO: 370403 - DNA, 25 bp, Homo sapien
gacaccccaaagtagcgctgcgagc

SEQ ID NO: 370404 - DNA, 25 bp, Homo sapien
aataattctcccgaaatcaggtcaa

SEQ ID NO: 370405 - DNA, 25 bp, Homo sapien
gaaatcaggtcaaccccatcaccaa

SEQ ID NO: 370406 - DNA, 25 bp, Homo sapien
caaccagttgagttccagattctat

SEQ ID NO: 370407 - DNA, 25 bp, Homo sapien
aattctgagatgacttaggttggac

SEQ ID NO: 370408 - DNA, 25 bp, Homo sapien
gacttaggttggacattcaatgttg

SEQ ID NO: 370409 - DNA, 25 bp, Homo sapien
caatgttgtgctatgaatttcctct

SEQ ID NO: 370410 - DNA, 25 bp, Homo sapien
gaatttcctctttatgcagagtatc

SEQ ID NO: 370411 - DNA, 25 bp, Homo sapien
atctgtttgcttgcagagtggcttt

SEQ ID NO: 370412 - DNA, 25 bp, Homo sapien
gtggctttctggcttgctgccagcc

SEQ ID NO: 370413 - DNA, 25 bp, Homo sapien
gcatggtccacgcttatgagttcag

SEQ ID NO: 370414 - DNA, 25 bp, Homo sapien
atgagttcaggatctacggcaatgt

SEQ ID NO: 370415 - DNA, 25 bp, Homo sapien
taccaggcactggttgttgatggtc

SEQ ID NO: 370416 - DNA, 25 bp, Homo sapien
ttgggtgtgggcagtcatcagtcat

SEQ ID NO: 370417 - DNA, 25 bp, Homo sapien
tgggcagtcatcagtcatcaggtgt

SEQ ID NO: 370418 - DNA, 25 bp, Homo sapien
gcacatgtgccactgttcagcggag

SEQ ID NO: 370419 - DNA, 25 bp, Homo sapien
ctgttcagcggagctgactggtttc

SEQ ID NO: 370420 - DNA, 25 bp, Homo sapien
aggtgtctttaactgtcattgtgtg

SEQ ID NO: 370421 - DNA, 25 bp, Homo sapien
ctttaactgtcattgtgtgtggaat

SEQ ID NO: 370422 - DNA, 25 bp, Homo sapien
tgtgtggaatgtcgcagactcctcc

SEQ ID NO: 370423 - DNA, 25 bp, Homo sapien
gactcctccacgtggcgggaatgag

SEQ ID NO: 370424 - DNA, 25 bp, Homo sapien
gcgggaatgagctgtgtaaatactt

SEQ ID NO: 370425 - DNA, 25 bp, Homo sapien
aatacttcaataaagcctgacttca

SEQ ID NO: 370426 - DNA, 25 bp, Homo sapien
tgattcgcccagtaggcatgagcca

SEQ ID NO: 370427 - DNA, 25 bp, Homo sapien
ccggtcgagggttttctcatagtat

SEQ ID NO: 370428 - DNA, 25 bp, Homo sapien
agtatgtttagttgttctgaggagc

SEQ ID NO: 370429 - DNA, 25 bp, Homo sapien
aatgcatgtttacaacatccacagt

SEQ ID NO: 370430 - DNA, 25 bp, Homo sapien
aaagctttcaggtgaactgcacaca

SEQ ID NO: 370431 - DNA, 25 bp, Homo sapien
acacagttccactatgtcttctggg

SEQ ID NO: 370432 - DNA, 25 bp, Homo sapien
gaaactcttgaatatcctggtacat

SEQ ID NO: 370433 - DNA, 25 bp, Homo sapien
atatcctggtacatcttcctttata

SEQ ID NO: 370434 - DNA, 25 bp, Homo sapien
aggactcatactgggcccactatgt

SEQ ID NO: 370435 - DNA, 25 bp, Homo sapien
tactgggcccactatgtaaaacgtg

SEQ ID NO: 370436 - DNA, 25 bp, Homo sapien
attggaggttttgcaccacagagaa

SEQ ID NO: 370437 - DNA, 25 bp, Homo sapien
gaatatgattgaatgaactgcccat

SEQ ID NO: 370438 - DNA, 25 bp, Homo sapien
gattgaatgaactgcccattatatt

SEQ ID NO: 370439 - DNA, 25 bp, Homo sapien
attaatgaccagttcaaagcagttt

SEQ ID NO: 370440 - DNA, 25 bp, Homo sapien
gaccagttcaaagcagttttgtgct

SEQ ID NO: 370441 - DNA, 25 bp, Homo sapien
tggcaaaaatactgtaggcctttct

SEQ ID NO: 370442 - DNA, 25 bp, Homo sapien
caaaaatactgtaggcctttctggt

SEQ ID NO: 370443 - DNA, 25 bp, Homo sapien
attgcagcaatatcttgggaactta

SEQ ID NO: 370444 - DNA, 25 bp, Homo sapien
gaaaaagctctttcctatgacattg

SEQ ID NO: 370445 - DNA, 25 bp, Homo sapien
gaacttaagtttagtggcgttggag

SEQ ID NO: 370446 - DNA, 25 bp, Homo sapien
cgttggaggtgtttctgaccatctt

SEQ ID NO: 370447 - DNA, 25 bp, Homo sapien
gaggtgtttctgaccatcttgcttg

SEQ ID NO: 370448 - DNA, 25 bp, Homo sapien
tgcttcttagctaaagtaattttat

SEQ ID NO: 370449 - DNA, 25 bp, Homo sapien
tgtcatcattttctgctcttctaga

SEQ ID NO: 370450 - DNA, 25 bp, Homo sapien
catcattttctgctcttctagaatg

SEQ ID NO: 370451 - DNA, 25 bp, Homo sapien
tctgctcttctagaatgatgtgtag

SEQ ID NO: 370452 - DNA, 25 bp, Homo sapien
ttgaagatactatcccttctttggc

SEQ ID NO: 370453 - DNA, 25 bp, Homo sapien
aagatactatcccttctttggcatt

SEQ ID NO: 370454 - DNA, 25 bp, Homo sapien
atactatcccttctttggcattctt

SEQ ID NO: 370455 - DNA, 25 bp, Homo sapien
ccttctttggcattcttctcttaat

SEQ ID NO: 370456 - DNA, 25 bp, Homo sapien
ggcattcttctcttaatgctatgct

SEQ ID NO: 370457 - DNA, 25 bp, Homo sapien
attcttctcttaatgctatgctatt

SEQ ID NO: 370458 - DNA, 25 bp, Homo sapien
aatgctatgctattatttatcataa

SEQ ID NO: 370459 - DNA, 25 bp, Homo sapien
caactaccacacaaatcctgacagg

SEQ ID NO: 370460 - DNA, 25 bp, Homo sapien
aaatcctgacaggagcctttctgcc

SEQ ID NO: 370461 - DNA, 25 bp, Homo sapien
gggcccgtgtgaggaactcttactg

SEQ ID NO: 370462 - DNA, 25 bp, Homo sapien
tgtgaggaactcttactggacgccc

SEQ ID NO: 370463 - DNA, 25 bp, Homo sapien
ctgttgctgtgctgatcttacacat

SEQ ID NO: 370464 - DNA, 25 bp, Homo sapien
gttgctgtgctgatcttacacatca

SEQ ID NO: 370465 - DNA, 25 bp, Homo sapien
gatcttacacatcagtttccacgga

SEQ ID NO: 370466 - DNA, 25 bp, Homo sapien
tcttacacatcagtttccacggatc

SEQ ID NO: 370467 - DNA, 25 bp, Homo sapien
tcagtttccacggatcccatgtgaa

SEQ ID NO: 370468 - DNA, 25 bp, Homo sapien
gtttccacggatcccatgtgaatca

SEQ ID NO: 370469 - DNA, 25 bp, Homo sapien
tgagttgagaatttgtttcccccac

SEQ ID NO: 370470 - DNA, 25 bp, Homo sapien
ctcaggagtgtcagccccgtccagg

SEQ ID NO: 370471 - DNA, 25 bp, Homo sapien
tgacatgccctacgatgccaggcag

SEQ ID NO: 370472 - DNA, 25 bp, Homo sapien
ttcagctgcctcatatttatggcca

SEQ ID NO: 370473 - DNA, 25 bp, Homo sapien
atttatggccatcgaggactctcca

SEQ ID NO: 370474 - DNA, 25 bp, Homo sapien
ccaaccaagcgcctgccagtgaagg

SEQ ID NO: 370475 - DNA, 25 bp, Homo sapien
gtgaaggatatctacaactggatct

SEQ ID NO: 370476 - DNA, 25 bp, Homo sapien
caactggatcttggaacattttccg

SEQ ID NO: 370477 - DNA, 25 bp, Homo sapien
ggaacattttccgtattttgcaaat

SEQ ID NO: 370478 - DNA, 25 bp, Homo sapien
attttgcaaatgcacctactgggtg

SEQ ID NO: 370479 - DNA, 25 bp, Homo sapien
cacctactgggtggaaaaactcagt

SEQ ID NO: 370480 - DNA, 25 bp, Homo sapien
agtgagacacaatttatcattgaat

SEQ ID NO: 370481 - DNA, 25 bp, Homo sapien
aggtcaggttcatccatcagcccca

SEQ ID NO: 370482 - DNA, 25 bp, Homo sapien
aaactcacatgtcggcactatctgg

SEQ ID NO: 370483 - DNA, 25 bp, Homo sapien
gtcggcactatctgggcaactaaaa

SEQ ID NO: 370484 - DNA, 25 bp, Homo sapien
agagatcatttctccccagatatca

SEQ ID NO: 370485 - DNA, 25 bp, Homo sapien
tggcagacttgaatatagatacgct

SEQ ID NO: 370486 - DNA, 25 bp, Homo sapien
gatacgctgagttatccagctctct

SEQ ID NO: 370487 - DNA, 25 bp, Homo sapien
tgagttatccagctctctcactctg

SEQ ID NO: 370488 - DNA, 25 bp, Homo sapien
aagtgttgaatcactgttatcctaa

SEQ ID NO: 370489 - DNA, 25 bp, Homo sapien
gttttctaccgtggccactgtgatg

SEQ ID NO: 370490 - DNA, 25 bp, Homo sapien
ggctggcaaagagcagcctcgtgcc

SEQ ID NO: 370491 - DNA, 25 bp, Homo sapien
gtgccttccgagaaggctgccagga

SEQ ID NO: 370492 - DNA, 25 bp, Homo sapien
tacactgggactggaaggagctgcc

SEQ ID NO: 370493 - DNA, 25 bp, Homo sapien
ggagctgccttcctgaagtcctcct

SEQ ID NO: 370494 - DNA, 25 bp, Homo sapien
gcttctctgaagttgtcccagcaca

SEQ ID NO: 370495 - DNA, 25 bp, Homo sapien
atgtatgttgcttaagcccttaatt

SEQ ID NO: 370496 - DNA, 25 bp, Homo sapien
gtcagggccctgataaggaaatgaa

SEQ ID NO: 370497 - DNA, 25 bp, Homo sapien
gaaatgaagtggagcccgcacctgc

SEQ ID NO: 370498 - DNA, 25 bp, Homo sapien
ccgcacctgcccagaatgtgaaatt

SEQ ID NO: 370499 - DNA, 25 bp, Homo sapien
ctctgaccgggctccagatgggcaa

SEQ ID NO: 370500 - DNA, 25 bp, Homo sapien
tccagatgggcaagtgcagcccctc

SEQ ID NO: 370501 - DNA, 25 bp, Homo sapien
atttgcaaggtgttgaacccctatg

SEQ ID NO: 370502 - DNA, 25 bp, Homo sapien
gggcctggccaaatcagcaagaagg

SEQ ID NO: 370503 - DNA, 25 bp, Homo sapien
gggaaatgggatcattaacaccact

SEQ ID NO: 370504 - DNA, 25 bp, Homo sapien
gggatcattaacaccactgagaaag

SEQ ID NO: 370505 - DNA, 25 bp, Homo sapien
aaaggagtttacagggatcgcaata

SEQ ID NO: 370506 - DNA, 25 bp, Homo sapien
gatcgcaatagtaactgtctgcttg

SEQ ID NO: 370507 - DNA, 25 bp, Homo sapien
aatagtaactgtctgcttgtggtag

SEQ ID NO: 370508 - DNA, 25 bp, Homo sapien
aactgtctgcttgtggtagtagaaa

SEQ ID NO: 370509 - DNA, 25 bp, Homo sapien
gtagaaagcttgtgccaggctgcat

SEQ ID NO: 370510 - DNA, 25 bp, Homo sapien
aaagcttgtgccaggctgcatgaat

SEQ ID NO: 370511 - DNA, 25 bp, Homo sapien
gtagatttttattgaaacagaccac

SEQ ID NO: 370512 - DNA, 25 bp, Homo sapien
aaaatataactgtgatctttttgtc

SEQ ID NO: 370513 - DNA, 25 bp, Homo sapien
actggaaacacccaaacgtgaactg

SEQ ID NO: 370514 - DNA, 25 bp, Homo sapien
actttctgctgattccaactttctt

SEQ ID NO: 370515 - DNA, 25 bp, Homo sapien
ttcctgtgattttcgtcttttcccg

SEQ ID NO: 370516 - DNA, 25 bp, Homo sapien
gtcttttcccgtgcatttcatttct

SEQ ID NO: 370517 - DNA, 25 bp, Homo sapien
agctctgtactaaatcctcacaagt

SEQ ID NO: 370518 - DNA, 25 bp, Homo sapien
aatcctcacaagtttctcgttttca

SEQ ID NO: 370519 - DNA, 25 bp, Homo sapien
tctcgttttcatacgggaactggat

SEQ ID NO: 370520 - DNA, 25 bp, Homo sapien
gaatgactccccaaaaaatacagct

SEQ ID NO: 370521 - DNA, 25 bp, Homo sapien
gatctttcaaagtcagtaaaccaca

SEQ ID NO: 370522 - DNA, 25 bp, Homo sapien
caaaggtttgtgtaatggcttgtac

SEQ ID NO: 370523 - DNA, 25 bp, Homo sapien
tggcttgtacttaacgcctgatacc

SEQ ID NO: 370524 - DNA, 25 bp, Homo sapien
acttaacgcctgatacctgagtaaa

SEQ ID NO: 370525 - DNA, 25 bp, Homo sapien
cttgcctacagccattagtgatggg

SEQ ID NO: 370526 - DNA, 25 bp, Homo sapien
gggatttgaatccagtaaatctgat

SEQ ID NO: 370527 - DNA, 25 bp, Homo sapien
aaatctgatttgaggtgtctttgac

SEQ ID NO: 370528 - DNA, 25 bp, Homo sapien
ggtgtctttgacaagctcaggcttg

SEQ ID NO: 370529 - DNA, 25 bp, Homo sapien
aagctcaggcttgcagaggtggttt

SEQ ID NO: 370530 - DNA, 25 bp, Homo sapien
catcagccccagttgatttggtgtt

SEQ ID NO: 370531 - DNA, 25 bp, Homo sapien
gccccagttgatttggtgttacata

SEQ ID NO: 370532 - DNA, 25 bp, Homo sapien
ttggtgttacatacaatcttacgta

SEQ ID NO: 370533 - DNA, 25 bp, Homo sapien
ccgtgaccggcctattacagtatta

SEQ ID NO: 370534 - DNA, 25 bp, Homo sapien
attaaacccttaatattatctacag

SEQ ID NO: 370535 - DNA, 25 bp, Homo sapien
tatctacagggtagattcttttacc

SEQ ID NO: 370536 - DNA, 25 bp, Homo sapien
attaggagctaattgggcagagtgt

SEQ ID NO: 370537 - DNA, 25 bp, Homo sapien
gttgcaaggtaatccgtccgtctac

SEQ ID NO: 370538 - DNA, 25 bp, Homo sapien
tagtaccttgtactgctgtagggat

SEQ ID NO: 370539 - DNA, 25 bp, Homo sapien
ggataaattcctaactagacttgaa

SEQ ID NO: 370540 - DNA, 25 bp, Homo sapien
gggaccattgaaatcagtttcatat

SEQ ID NO: 370541 - DNA, 25 bp, Homo sapien
gtctacttacccatcagacgttttg

SEQ ID NO: 370542 - DNA, 25 bp, Homo sapien
ttacccatcagacgttttgacagcc

SEQ ID NO: 370543 - DNA, 25 bp, Homo sapien
tttgacagcccttcatggagccggg

SEQ ID NO: 370544 - DNA, 25 bp, Homo sapien
agcccttcatggagccgggtcttag

SEQ ID NO: 370545 - DNA, 25 bp, Homo sapien
ggtcttagggctgtaaaggtgataa

SEQ ID NO: 370546 - DNA, 25 bp, Homo sapien
aaaggtgataaacccaggattcctg

SEQ ID NO: 370547 - DNA, 25 bp, Homo sapien
aaaagccaactctgtagacaccttc

SEQ ID NO: 370548 - DNA, 25 bp, Homo sapien
aaagccaactctgtagacaccttca

SEQ ID NO: 370549 - DNA, 25 bp, Homo sapien
aataattagacctttacattcctga

SEQ ID NO: 370550 - DNA, 25 bp, Homo sapien
taattagacctttacattcctgaag

SEQ ID NO: 370551 - DNA, 25 bp, Homo sapien
aattagacctttacattcctgaaga

SEQ ID NO: 370552 - DNA, 25 bp, Homo sapien
ttagacctttacattcctgaagata

SEQ ID NO: 370553 - DNA, 25 bp, Homo sapien
tagacctttacattcctgaagataa

SEQ ID NO: 370554 - DNA, 25 bp, Homo sapien
gacctttacattcctgaagataaac

SEQ ID NO: 370555 - DNA, 25 bp, Homo sapien
ttgttgctaatgtaatcggtttttg

SEQ ID NO: 370556 - DNA, 25 bp, Homo sapien
gttgctaatgtaatcggtttttgta

SEQ ID NO: 370557 - DNA, 25 bp, Homo sapien
ctaatgtaatcggtttttgtaatgg

SEQ ID NO: 370558 - DNA, 25 bp, Homo sapien
atcccaggctgactgacgtccctgg

SEQ ID NO: 370559 - DNA, 25 bp, Homo sapien
tgactgacgtccctggcacccaaat

SEQ ID NO: 370560 - DNA, 25 bp, Homo sapien
tgacgtccctggcacccaaatgtcg

SEQ ID NO: 370561 - DNA, 25 bp, Homo sapien
gtccctggcacccaaatgtcgcggg

SEQ ID NO: 370562 - DNA, 25 bp, Homo sapien
ctccagccagtgaaacccgggacag

SEQ ID NO: 370563 - DNA, 25 bp, Homo sapien
ccagccagtgaaacccgggacagcg

SEQ ID NO: 370564 - DNA, 25 bp, Homo sapien
gtgaaacccgggacagcggcaccca

SEQ ID NO: 370565 - DNA, 25 bp, Homo sapien
tgaaacccgggacagcggcacccag

SEQ ID NO: 370566 - DNA, 25 bp, Homo sapien
agggcggaggccgtctctgctgcgc

SEQ ID NO: 370567 - DNA, 25 bp, Homo sapien
cagcgacgcacccaggcccaagggc

SEQ ID NO: 370568 - DNA, 25 bp, Homo sapien
ctctcgggctcgcaggcgctgggtc

SEQ ID NO: 370569 - DNA, 25 bp, Homo sapien
atataactgagtatgcttcctttct

SEQ ID NO: 370570 - DNA, 25 bp, Homo sapien
tataactgagtatgcttcctttcta

SEQ ID NO: 370571 - DNA, 25 bp, Homo sapien
ataactgagtatgcttcctttctac

SEQ ID NO: 370572 - DNA, 25 bp, Homo sapien
taactgagtatgcttcctttctacc

SEQ ID NO: 370573 - DNA, 25 bp, Homo sapien
aactgagtatgcttcctttctacct

SEQ ID NO: 370574 - DNA, 25 bp, Homo sapien
actgagtatgcttcctttctacctt

SEQ ID NO: 370575 - DNA, 25 bp, Homo sapien
gatatatcaccaatagctttaatgt

SEQ ID NO: 370576 - DNA, 25 bp, Homo sapien
atatcaccaatagctttaatgttta

SEQ ID NO: 370577 - DNA, 25 bp, Homo sapien
tagctttaatgtttaactcaaagac

SEQ ID NO: 370578 - DNA, 25 bp, Homo sapien
gtttaactcaaagacatatagcagt

SEQ ID NO: 370579 - DNA, 25 bp, Homo sapien
taactcaaagacatatagcagtata

SEQ ID NO: 370580 - DNA, 25 bp, Homo sapien
agacttgggccgttgctctgacatg

SEQ ID NO: 370581 - DNA, 25 bp, Homo sapien
ttgctctgacatggacacagccagg

SEQ ID NO: 370582 - DNA, 25 bp, Homo sapien
gctctgacatggacacagccaggac

SEQ ID NO: 370583 - DNA, 25 bp, Homo sapien
tctgacatggacacagccaggacaa

SEQ ID NO: 370584 - DNA, 25 bp, Homo sapien
gacatggacacagccaggacaagct

SEQ ID NO: 370585 - DNA, 25 bp, Homo sapien
acacagccaggacaagctgctcaga

SEQ ID NO: 370586 - DNA, 25 bp, Homo sapien
accagcactgtgtggagaccagctt

SEQ ID NO: 370587 - DNA, 25 bp, Homo sapien
agcactgtgtggagaccagcttcaa

SEQ ID NO: 370588 - DNA, 25 bp, Homo sapien
cactgtgtggagaccagcttcaagg

SEQ ID NO: 370589 - DNA, 25 bp, Homo sapien
tgtgtggagaccagcttcaaggagc

SEQ ID NO: 370590 - DNA, 25 bp, Homo sapien
cttcaaggagcggaaggctggcttg

SEQ ID NO: 370591 - DNA, 25 bp, Homo sapien
tggtggaaaccctgagctgcaccgg

SEQ ID NO: 370592 - DNA, 25 bp, Homo sapien
ccagggcagtcgtgctgggctcctc

SEQ ID NO: 370593 - DNA, 25 bp, Homo sapien
gctcctcagagcaggctgttgcagt

SEQ ID NO: 370594 - DNA, 25 bp, Homo sapien
gcaggctgttgcagttgctctgttc

SEQ ID NO: 370595 - DNA, 25 bp, Homo sapien
ttgcagttgctctgttcgcaggaaa

SEQ ID NO: 370596 - DNA, 25 bp, Homo sapien
gctctgttcgcaggaaattatttgg

SEQ ID NO: 370597 - DNA, 25 bp, Homo sapien
atgcagctcgcggtggctgctgtac

SEQ ID NO: 370598 - DNA, 25 bp, Homo sapien
gtggctgctgtaccctttagcgtaa

SEQ ID NO: 370599 - DNA, 25 bp, Homo sapien
taccctttagcgtaaccttgctact

SEQ ID NO: 370600 - DNA, 25 bp, Homo sapien
aacctgagaacttcctgatctctct

SEQ ID NO: 370601 - DNA, 25 bp, Homo sapien
tagcattaaggtaaaaatcttctcc

SEQ ID NO: 370602 - DNA, 25 bp, Homo sapien
gaggcgcagaagattgatcgcatga

SEQ ID NO: 370603 - DNA, 25 bp, Homo sapien
gattgatcgcatgatggaggctttc

SEQ ID NO: 370604 - DNA, 25 bp, Homo sapien
ttgatcgcatgatggaggctttcgc

SEQ ID NO: 370605 - DNA, 25 bp, Homo sapien
gatcgcatgatggaggctttcgctt

SEQ ID NO: 370606 - DNA, 25 bp, Homo sapien
atcgcatgatggaggctttcgcttc

SEQ ID NO: 370607 - DNA, 25 bp, Homo sapien
tcgcatgatggaggctttcgcttct

SEQ ID NO: 370608 - DNA, 25 bp, Homo sapien
gcatgatggaggctttcgcttctcg

SEQ ID NO: 370609 - DNA, 25 bp, Homo sapien
atgatggaggctttcgcttctcgct

SEQ ID NO: 370610 - DNA, 25 bp, Homo sapien
gatggaggctttcgcttctcgctac

SEQ ID NO: 370611 - DNA, 25 bp, Homo sapien
tggaggctttcgcttctcgctactg

SEQ ID NO: 370612 - DNA, 25 bp, Homo sapien
ggaggctttcgcttctcgctactgc

SEQ ID NO: 370613 - DNA, 25 bp, Homo sapien
attagctaaatgtatgttctgagta

SEQ ID NO: 370614 - DNA, 25 bp, Homo sapien
ggaaaatttattttgctgctagcat

SEQ ID NO: 370615 - DNA, 25 bp, Homo sapien
ttgctgctagcatacaacatttgct

SEQ ID NO: 370616 - DNA, 25 bp, Homo sapien
gtatataaacttaagtcaatgccag

SEQ ID NO: 370617 - DNA, 25 bp, Homo sapien
aaaccagctcaaatttataatctgt

SEQ ID NO: 370618 - DNA, 25 bp, Homo sapien
aacatactgtaaactcagagttgga

SEQ ID NO: 370619 - DNA, 25 bp, Homo sapien
aactcagagttggaaacgcctggta

SEQ ID NO: 370620 - DNA, 25 bp, Homo sapien
gttggaaacgcctggtaatatggtt

SEQ ID NO: 370621 - DNA, 25 bp, Homo sapien
acgcctggtaatatggttaagtcat

SEQ ID NO: 370622 - DNA, 25 bp, Homo sapien
aatgcctgagatttctttcattgtg

SEQ ID NO: 370623 - DNA, 25 bp, Homo sapien
gcctgagatttctttcattgtgaat

SEQ ID NO: 370624 - DNA, 25 bp, Homo sapien
gaaagggattcatggcgtcggaaat

SEQ ID NO: 370625 - DNA, 25 bp, Homo sapien
atggcgtcggaaatgatctggctga

SEQ ID NO: 370626 - DNA, 25 bp, Homo sapien
gatctggctgaatccgtggtggcac

SEQ ID NO: 370627 - DNA, 25 bp, Homo sapien
tggtggcaccgagaccaaactcatt

SEQ ID NO: 370628 - DNA, 25 bp, Homo sapien
attcaccaaatgatgccacttccca

SEQ ID NO: 370629 - DNA, 25 bp, Homo sapien
gaggcagagcctgagtcaccggtca

SEQ ID NO: 370630 - DNA, 25 bp, Homo sapien
tcaccggtcacccttaatatttatt

SEQ ID NO: 370631 - DNA, 25 bp, Homo sapien
tattaagtgcctgagacacccggtt

SEQ ID NO: 370632 - DNA, 25 bp, Homo sapien
gacacccggttaccttggccgtgag

SEQ ID NO: 370633 - DNA, 25 bp, Homo sapien
gtgaggacacgtggcctgcacccag

SEQ ID NO: 370634 - DNA, 25 bp, Homo sapien
gcacccaggtgtggctgtcaggaca

SEQ ID NO: 370635 - DNA, 25 bp, Homo sapien
cgcttcacccagctggatgaccggg

SEQ ID NO: 370636 - DNA, 25 bp, Homo sapien
ctggcttccggctgggtgtgacatc

SEQ ID NO: 370637 - DNA, 25 bp, Homo sapien
tccggctgggtgtgacatctcatgg

SEQ ID NO: 370638 - DNA, 25 bp, Homo sapien
agatcctgagactcgctcggctgtg

SEQ ID NO: 370639 - DNA, 25 bp, Homo sapien
tcggctgtggagctcaccctgatag

SEQ ID NO: 370640 - DNA, 25 bp, Homo sapien
accctgataggctacctgctcatca

SEQ ID NO: 370641 - DNA, 25 bp, Homo sapien
tcatcacagcagtctttgtcaccat

SEQ ID NO: 370642 - DNA, 25 bp, Homo sapien
tgtcaccattcacttctgtcgttgc

SEQ ID NO: 370643 - DNA, 25 bp, Homo sapien
ttctgtcgttgctgctgctacttat

SEQ ID NO: 370644 - DNA, 25 bp, Homo sapien
tgctacttatttcactgttgtccca

SEQ ID NO: 370645 - DNA, 25 bp, Homo sapien
ttatttcactgttgtcccagcttct

SEQ ID NO: 370646 - DNA, 25 bp, Homo sapien
gagagctctgaatcccaaacatcac

SEQ ID NO: 370647 - DNA, 25 bp, Homo sapien
ctcttccttctgttgacaatgagtt

SEQ ID NO: 370648 - DNA, 25 bp, Homo sapien
gaaaagctggctggcttggcatctc

SEQ ID NO: 370649 - DNA, 25 bp, Homo sapien
tggcttggcatctccatcaagtggc

SEQ ID NO: 370650 - DNA, 25 bp, Homo sapien
agtctgaaacgccaacatcctcttt

SEQ ID NO: 370651 - DNA, 25 bp, Homo sapien
ctctttccctacagctttcttttca

SEQ ID NO: 370652 - DNA, 25 bp, Homo sapien
tttcttttcaggtccattgtctccc

SEQ ID NO: 370653 - DNA, 25 bp, Homo sapien
tgtctcccggaggtagcaaaagaaa

SEQ ID NO: 370654 - DNA, 25 bp, Homo sapien
tctatctaattcaagcaccgctacg

SEQ ID NO: 370655 - DNA, 25 bp, Homo sapien
gctacgggtaccacagtcattgaat

SEQ ID NO: 370656 - DNA, 25 bp, Homo sapien
gaatgcatcaaatctccagagagct

SEQ ID NO: 370657 - DNA, 25 bp, Homo sapien
aacactttttgatacagcgtctctt

SEQ ID NO: 370658 - DNA, 25 bp, Homo sapien
ttgatacagcgtctcttgtcttcac

SEQ ID NO: 370659 - DNA, 25 bp, Homo sapien
gtcttcactgatactggagtctccg

SEQ ID NO: 370660 - DNA, 25 bp, Homo sapien
actggagtctccgttgtctgcttgg

SEQ ID NO: 370661 - DNA, 25 bp, Homo sapien
ttgtctgcttggtcccttcgagttt

SEQ ID NO: 370662 - DNA, 25 bp, Homo sapien
gtctgttttctgtaatgtctgatac

SEQ ID NO: 370663 - DNA, 25 bp, Homo sapien
gtctgatactagaaactaatttgct

SEQ ID NO: 370664 - DNA, 25 bp, Homo sapien
atttcccagttatgatgagtattta

SEQ ID NO: 370665 - DNA, 25 bp, Homo sapien
gaatgtataacccagacatgatttg

SEQ ID NO: 370666 - DNA, 25 bp, Homo sapien
acatgatttgtaaagccgacagtat

SEQ ID NO: 370667 - DNA, 25 bp, Homo sapien
gccgacagtatgtttctattacaca

SEQ ID NO: 370668 - DNA, 25 bp, Homo sapien
caactaccacacaaatcctgacagg

SEQ ID NO: 370669 - DNA, 25 bp, Homo sapien
aaatcctgacaggagcctttctgcc

SEQ ID NO: 370670 - DNA, 25 bp, Homo sapien
tgaggaactcttactggacgccccc

SEQ ID NO: 370671 - DNA, 25 bp, Homo sapien
ctgttgctgtgctgatcttacacat

SEQ ID NO: 370672 - DNA, 25 bp, Homo sapien
gttgctgtgctgatcttacacatca

SEQ ID NO: 370673 - DNA, 25 bp, Homo sapien
gatcttacacatcagtttccacgga

SEQ ID NO: 370674 - DNA, 25 bp, Homo sapien
tcttacacatcagtttccacggatc

SEQ ID NO: 370675 - DNA, 25 bp, Homo sapien
acatcagtttccacggatcccatgt

SEQ ID NO: 370676 - DNA, 25 bp, Homo sapien
tcagtttccacggatcccatgtgaa

SEQ ID NO: 370677 - DNA, 25 bp, Homo sapien
gtttccacggatcccatgtgaatca

SEQ ID NO: 370678 - DNA, 25 bp, Homo sapien
tgagttgagaatttgtttcccccac

SEQ ID NO: 370679 - DNA, 25 bp, Homo sapien
agccctgtaggtggtggacaaagac

SEQ ID NO: 370680 - DNA, 25 bp, Homo sapien
ccctgtaggtggtggacaaagacta

SEQ ID NO: 370681 - DNA, 25 bp, Homo sapien
gagcaagccatttaggcaaacatct

SEQ ID NO: 370682 - DNA, 25 bp, Homo sapien
gccatttaggcaaacatctgaagaa

SEQ ID NO: 370683 - DNA, 25 bp, Homo sapien
ggcaaacaaataggactgtttcatt

SEQ ID NO: 370684 - DNA, 25 bp, Homo sapien
ggactgtttcattaagatcacttgc

SEQ ID NO: 370685 - DNA, 25 bp, Homo sapien
gtttcattaagatcacttgcattct

SEQ ID NO: 370686 - DNA, 25 bp, Homo sapien
gatcacttgcattctaacaggttat

SEQ ID NO: 370687 - DNA, 25 bp, Homo sapien
acttgcattctaacaggttatgatg

SEQ ID NO: 370688 - DNA, 25 bp, Homo sapien
tttggacatgtcacatttgagatgc

SEQ ID NO: 370689 - DNA, 25 bp, Homo sapien
gaaacctaataaaccatgatcttaa

SEQ ID NO: 370690 - DNA, 25 bp, Homo sapien
atagcactcatattgttcttttcga

SEQ ID NO: 370691 - DNA, 25 bp, Homo sapien
gttcttttcgacacagatttgagag

SEQ ID NO: 370692 - DNA, 25 bp, Homo sapien
gatctgaagcacctctttgtgggtt

SEQ ID NO: 370693 - DNA, 25 bp, Homo sapien
tctttgtgggtttcactctcaacac

SEQ ID NO: 370694 - DNA, 25 bp, Homo sapien
tcactctcaacactcttggaaaatc

SEQ ID NO: 370695 - DNA, 25 bp, Homo sapien
aaaatcaccgagtgtcatgagaggt

SEQ ID NO: 370696 - DNA, 25 bp, Homo sapien
aggtgttattgatgcaggcctgtca

SEQ ID NO: 370697 - DNA, 25 bp, Homo sapien
ccaggtgtctttgttttggcaagga

SEQ ID NO: 370698 - DNA, 25 bp, Homo sapien
agagaggcctcctcagaaagactga

SEQ ID NO: 370699 - DNA, 25 bp, Homo sapien
ggacagcaactgtattctgatacta

SEQ ID NO: 370700 - DNA, 25 bp, Homo sapien
ggagttccgggcaaagacattaata

SEQ ID NO: 370701 - DNA, 25 bp, Homo sapien
agaagctatagtcaattgccagtta

SEQ ID NO: 370702 - DNA, 25 bp, Homo sapien
gtcaattgccagttagaaagagtac

SEQ ID NO: 370703 - DNA, 25 bp, Homo sapien
tgcagggttctgagctgggtcccaa

SEQ ID NO: 370704 - DNA, 25 bp, Homo sapien
gaaactgtgcaagtactaggtgaag

SEQ ID NO: 370705 - DNA, 25 bp, Homo sapien
ggtgaagaggcctgtgaaactaact

SEQ ID NO: 370706 - DNA, 25 bp, Homo sapien
ttctgagctgggtcccaaggacatg

SEQ ID NO: 370707 - DNA, 25 bp, Homo sapien
gaaactaacttactgcaaggcttga

SEQ ID NO: 370708 - DNA, 25 bp, Homo sapien
aaatagagacattcgcggccaggtg

SEQ ID NO: 370709 - DNA, 25 bp, Homo sapien
ggacaacttggcaggtactttctac

SEQ ID NO: 370710 - DNA, 25 bp, Homo sapien
ggtactttctaccatcaagggcaca

SEQ ID NO: 370711 - DNA, 25 bp, Homo sapien
agggcacacgacattgctgaggaca

SEQ ID NO: 370712 - DNA, 25 bp, Homo sapien
ggataagtgagcagaccgtacagga

SEQ ID NO: 370713 - DNA, 25 bp, Homo sapien
gaccgtacaggagcagcacaccagg

SEQ ID NO: 370714 - DNA, 25 bp, Homo sapien
caccaggagccatgagaagtgcctt

SEQ ID NO: 370715 - DNA, 25 bp, Homo sapien
gaagtgccttggaaaccaacaggga

SEQ ID NO: 370716 - DNA, 25 bp, Homo sapien
accaacagggaaacagaactatctt

SEQ ID NO: 370717 - DNA, 25 bp, Homo sapien
gaactatctttatacacatcccctc

SEQ ID NO: 370718 - DNA, 25 bp, Homo sapien
gacagactcttccataagtcctttg

SEQ ID NO: 370719 - DNA, 25 bp, Homo sapien
tttgtatgttgttgacagtttgcag

SEQ ID NO: 370720 - DNA, 25 bp, Homo sapien
ttcgataaatcagtgtacttgacag

SEQ ID NO: 370721 - DNA, 25 bp, Homo sapien
aggaatgctccacatttgacgtgta

SEQ ID NO: 370722 - DNA, 25 bp, Homo sapien
cacatttgacgtgtagtgctataaa

SEQ ID NO: 370723 - DNA, 25 bp, Homo sapien
tgatgagcggccagatgagcggtct

SEQ ID NO: 370724 - DNA, 25 bp, Homo sapien
agcggtctgatgacatgtgctccca

SEQ ID NO: 370725 - DNA, 25 bp, Homo sapien
tctgatgacatgtgctcccagggct

SEQ ID NO: 370726 - DNA, 25 bp, Homo sapien
agggctcagaaatcccactggaccc

SEQ ID NO: 370727 - DNA, 25 bp, Homo sapien
gggccctcccaattctgaggactca

SEQ ID NO: 370728 - DNA, 25 bp, Homo sapien
aggactcagactgtgacagcactga

SEQ ID NO: 370729 - DNA, 25 bp, Homo sapien
gacagcactgaattggacaactcca

SEQ ID NO: 370730 - DNA, 25 bp, Homo sapien
gacaactccaacagcgttgatgcct

SEQ ID NO: 370731 - DNA, 25 bp, Homo sapien
actccaacagcgttgatgccttgcg

SEQ ID NO: 370732 - DNA, 25 bp, Homo sapien
atgaaagccactcgtattccttgta

SEQ ID NO: 370733 - DNA, 25 bp, Homo sapien
gccactcgtattccttgtacataga

SEQ ID NO: 370734 - DNA, 25 bp, Homo sapien
gcgtcaccgtcaagtatgaccggcg

SEQ ID NO: 370735 - DNA, 25 bp, Homo sapien
tcaccgtcaagtatgaccggcggga

SEQ ID NO: 370736 - DNA, 25 bp, Homo sapien
agaagtggatcgacgggcgcctgga

SEQ ID NO: 370737 - DNA, 25 bp, Homo sapien
gctgtaccgcggcatggaggcagac

SEQ ID NO: 370738 - DNA, 25 bp, Homo sapien
tggaggcagacatgcccgatgagat

SEQ ID NO: 370739 - DNA, 25 bp, Homo sapien
gcagacatgcccgatgagatcaaca

SEQ ID NO: 370740 - DNA, 25 bp, Homo sapien
gacatgcccgatgagatcaacattg

SEQ ID NO: 370741 - DNA, 25 bp, Homo sapien
agctcagcggctgggcaagcgcgtg

SEQ ID NO: 370742 - DNA, 25 bp, Homo sapien
gcaagcgcgtgctgagcaagctgca

SEQ ID NO: 370743 - DNA, 25 bp, Homo sapien
gtgctgagcaagctgcagtctccat

SEQ ID NO: 370744 - DNA, 25 bp, Homo sapien
agcaagctgcagtctccatcgcggg

SEQ ID NO: 370745 - DNA, 25 bp, Homo sapien
gaaagagacatcagatgcacaattt

SEQ ID NO: 370746 - DNA, 25 bp, Homo sapien
gcattgttgtagttatttatatttc

SEQ ID NO: 370747 - DNA, 25 bp, Homo sapien
atgaaacggatgttgtgtttctctt

SEQ ID NO: 370748 - DNA, 25 bp, Homo sapien
ctctttccatcatctggtttttacc

SEQ ID NO: 370749 - DNA, 25 bp, Homo sapien
ctttccatcatctggtttttaccat

SEQ ID NO: 370750 - DNA, 25 bp, Homo sapien
tccatcatctggtttttaccatttc

SEQ ID NO: 370751 - DNA, 25 bp, Homo sapien
gtttttaccatttcactcagtaggt

SEQ ID NO: 370752 - DNA, 25 bp, Homo sapien
ttaccatttcactcagtaggtattt

SEQ ID NO: 370753 - DNA, 25 bp, Homo sapien
atttcactcagtaggtatttttaga

SEQ ID NO: 370754 - DNA, 25 bp, Homo sapien
ttagaacacacttatttgaggaaag

SEQ ID NO: 370755 - DNA, 25 bp, Homo sapien
acacacttatttgaggaaagagaca

SEQ ID NO: 370756 - DNA, 25 bp, Homo sapien
tacatattttactgccagaaaacct

SEQ ID NO: 370757 - DNA, 25 bp, Homo sapien
gacaaggaaattataaacccagaga

SEQ ID NO: 370758 - DNA, 25 bp, Homo sapien
aaacccagagattcttatcgcaagg

SEQ ID NO: 370759 - DNA, 25 bp, Homo sapien
ccagagattcttatcgcaagggaag

SEQ ID NO: 370760 - DNA, 25 bp, Homo sapien
ggtacacggtcggatgagcccattc

SEQ ID NO: 370761 - DNA, 25 bp, Homo sapien
gtcggatgagcccattcagcattct

SEQ ID NO: 370762 - DNA, 25 bp, Homo sapien
atgagcccattcagcattctggctg

SEQ ID NO: 370763 - DNA, 25 bp, Homo sapien
ggtggctgctagtcccagatgtcac

SEQ ID NO: 370764 - DNA, 25 bp, Homo sapien
gctgctagtcccagatgtcactaag

SEQ ID NO: 370765 - DNA, 25 bp, Homo sapien
agtcccagatgtcactaagtcatta

SEQ ID NO: 370766 - DNA, 25 bp, Homo sapien
gatgtcactaagtcattaccattta

SEQ ID NO: 370767 - DNA, 25 bp, Homo sapien
agtgttctctgacggagctgtctct

SEQ ID NO: 370768 - DNA, 25 bp, Homo sapien
ctctttgcacacgaggagcctgaaa

SEQ ID NO: 370769 - DNA, 25 bp, Homo sapien
ggtgaaacggcagaagacccacttt

SEQ ID NO: 370770 - DNA, 25 bp, Homo sapien
gaagacccactttcatgatttgcca

SEQ ID NO: 370771 - DNA, 25 bp, Homo sapien
atgatttgccatgtggtgcctcagt

SEQ ID NO: 370772 - DNA, 25 bp, Homo sapien
gtgattctcggtaacaacggcttca

SEQ ID NO: 370773 - DNA, 25 bp, Homo sapien
aacggcttcatctggatttacccaa

SEQ ID NO: 370774 - DNA, 25 bp, Homo sapien
atttacccaacacctgagcacaaag

SEQ ID NO: 370775 - DNA, 25 bp, Homo sapien
gcttcattgcaaacctggagcctgt

SEQ ID NO: 370776 - DNA, 25 bp, Homo sapien
gatcgagaggtgatatcccggcttc

SEQ ID NO: 370777 - DNA, 25 bp, Homo sapien
ggaactgcatcatctcgctggtaac

SEQ ID NO: 370778 - DNA, 25 bp, Homo sapien
gaatctctttggctctgtgaggcaa

SEQ ID NO: 370779 - DNA, 25 bp, Homo sapien
caggaaccaggagtcaattgagatt

SEQ ID NO: 370780 - DNA, 25 bp, Homo sapien
gagatttgtaacttcagaccccaca

SEQ ID NO: 370781 - DNA, 25 bp, Homo sapien
ttccaccttgactcttgtgtcttat

SEQ ID NO: 370782 - DNA, 25 bp, Homo sapien
tgtgtcttatgtgtagcaggtgcta

SEQ ID NO: 370783 - DNA, 25 bp, Homo sapien
gcaggtgctaccattaaaattgagg

SEQ ID NO: 370784 - DNA, 25 bp, Homo sapien
gctctgtgaggcaagttttattctt

SEQ ID NO: 370785 - DNA, 25 bp, Homo sapien
ttttattctttgttcatgcctgcta

SEQ ID NO: 370786 - DNA, 25 bp, Homo sapien
gttcatgcctgctaagtgccagtaa

SEQ ID NO: 370787 - DNA, 25 bp, Homo sapien
gtgccagtaattgtgcccatgttgc

SEQ ID NO: 370788 - DNA, 25 bp, Homo sapien
ggataacccagaactcagataattt

SEQ ID NO: 370789 - DNA, 25 bp, Homo sapien
ctcacgtctgacactgaggagtgca

SEQ ID NO: 370790 - DNA, 25 bp, Homo sapien
gaggagtgcatagtcttcaactgaa

SEQ ID NO: 370791 - DNA, 25 bp, Homo sapien
gtcttcaactgaaatggcactacag

SEQ ID NO: 370792 - DNA, 25 bp, Homo sapien
actacagttagttctcattggaaac

SEQ ID NO: 370793 - DNA, 25 bp, Homo sapien
aagtgtatttctggaacctgctcgt

SEQ ID NO: 370794 - DNA, 25 bp, Homo sapien
ggaacctgctcgtctaaaatagtca

SEQ ID NO: 370795 - DNA, 25 bp, Homo sapien
atagtcaatgcctttgtaaagactc

SEQ ID NO: 370796 - DNA, 25 bp, Homo sapien
gtaaagactcagcatattcaatatc

SEQ ID NO: 370797 - DNA, 25 bp, Homo sapien
atctattgtatggtagctagctata

SEQ ID NO: 370798 - DNA, 25 bp, Homo sapien
tttagtcctggtttgtgtattgttg

SEQ ID NO: 370799 - DNA, 25 bp, Homo sapien
gagctatagtagtttgctttatcca

SEQ ID NO: 370800 - DNA, 25 bp, Homo sapien
tcctgtctcctgttcaggagactca

SEQ ID NO: 370801 - DNA, 25 bp, Homo sapien
ctcctgttcaggagactcaacatct

SEQ ID NO: 370802 - DNA, 25 bp, Homo sapien
tgttcaggagactcaacatctgatt

SEQ ID NO: 370803 - DNA, 25 bp, Homo sapien
caggagactcaacatctgattgttt

SEQ ID NO: 370804 - DNA, 25 bp, Homo sapien
gagactcaacatctgattgttttcc

SEQ ID NO: 370805 - DNA, 25 bp, Homo sapien
tcaacatctgattgttttccacctc

SEQ ID NO: 370806 - DNA, 25 bp, Homo sapien
tggagctgtcttcccacactctcca

SEQ ID NO: 370807 - DNA, 25 bp, Homo sapien
tcggcccgctgcttgtagagggctt

SEQ ID NO: 370808 - DNA, 25 bp, Homo sapien
cgctgcttgtagagggcttcccacc

SEQ ID NO: 370809 - DNA, 25 bp, Homo sapien
atcctctccagctcccgtagagtct

SEQ ID NO: 370810 - DNA, 25 bp, Homo sapien
cccgtagagtctcctgctgccacag

SEQ ID NO: 370811 - DNA, 25 bp, Homo sapien
cagagagggtagagaagggactttg

SEQ ID NO: 370812 - DNA, 25 bp, Homo sapien
caggtgaatggctggggccccaaat

SEQ ID NO: 370813 - DNA, 25 bp, Homo sapien
caggagattttcatcagaggtgggt

SEQ ID NO: 370814 - DNA, 25 bp, Homo sapien
agattttcatcagaggtgggtgggt

SEQ ID NO: 370815 - DNA, 25 bp, Homo sapien
gtgggtgggtgttcacaatatttat

SEQ ID NO: 370816 - DNA, 25 bp, Homo sapien
tgggtgggtgttcacaatatttatt

SEQ ID NO: 370817 - DNA, 25 bp, Homo sapien
gggtgggtgttcacaatatttattt

SEQ ID NO: 370818 - DNA, 25 bp, Homo sapien
gtgggtgttcacaatatttattttt

SEQ ID NO: 370819 - DNA, 25 bp, Homo sapien
tgggtgttcacaatatttatttttt

SEQ ID NO: 370820 - DNA, 25 bp, Homo sapien
atgaggagtttagagttgcagctgg

SEQ ID NO: 370821 - DNA, 25 bp, Homo sapien
tgaggagtttagagttgcagctggg

SEQ ID NO: 370822 - DNA, 25 bp, Homo sapien
acaggccttggcacctctacctggg

SEQ ID NO: 370823 - DNA, 25 bp, Homo sapien
gggatgacgtcaactccgatgattc

SEQ ID NO: 370824 - DNA, 25 bp, Homo sapien
aactccgatgattccgacgatattg

SEQ ID NO: 370825 - DNA, 25 bp, Homo sapien
gattccgacgatattgtcattgcac

SEQ ID NO: 370826 - DNA, 25 bp, Homo sapien
gatattgtcattgcaccgtctctgc

SEQ ID NO: 370827 - DNA, 25 bp, Homo sapien
accgtctctgcccacgaagaacttt

SEQ ID NO: 370828 - DNA, 25 bp, Homo sapien
tttccagtttaggtccccgtcactg

SEQ ID NO: 370829 - DNA, 25 bp, Homo sapien
gtctccacgccgtgatggcagcgct

SEQ ID NO: 370830 - DNA, 25 bp, Homo sapien
gcagcgctgccgaggacataggaac

SEQ ID NO: 370831 - DNA, 25 bp, Homo sapien
gaggacataggaaccacgactggaa

SEQ ID NO: 370832 - DNA, 25 bp, Homo sapien
ggagaagaacgatgatacctactta

SEQ ID NO: 370833 - DNA, 25 bp, Homo sapien
ttagcctgatggaatggctttcctt

SEQ ID NO: 370834 - DNA, 25 bp, Homo sapien
ggaatggctttccttttcaaacatt

SEQ ID NO: 370835 - DNA, 25 bp, Homo sapien
aatgaaatctttacctctgcatatt

SEQ ID NO: 370836 - DNA, 25 bp, Homo sapien
ctgcatattaatgagccttgccata

SEQ ID NO: 370837 - DNA, 25 bp, Homo sapien
ttactgtagagtggcttttcaaaga

SEQ ID NO: 370838 - DNA, 25 bp, Homo sapien
tttgttgcactaaaactgtggtagt

SEQ ID NO: 370839 - DNA, 25 bp, Homo sapien
ctgtggtagtaaactcagtgaacat

SEQ ID NO: 370840 - DNA, 25 bp, Homo sapien
aactcagtgaacatgatgtgtggaa

SEQ ID NO: 370841 - DNA, 25 bp, Homo sapien
aagagcataattagctggtcaatat

SEQ ID NO: 370842 - DNA, 25 bp, Homo sapien
agctggtcaatatttttgtccaaaa

SEQ ID NO: 370843 - DNA, 25 bp, Homo sapien
ttttgtccaaaatacctgcaagagt

SEQ ID NO: 370844 - DNA, 25 bp, Homo sapien
atcatggtgaattagtacgtaggct

SEQ ID NO: 370845 - DNA, 25 bp, Homo sapien
gtacgtaggctatgctgagaataat

SEQ ID NO: 370846 - DNA, 25 bp, Homo sapien
aaaatgtaaatctcttctccaataa

SEQ ID NO: 370847 - DNA, 25 bp, Homo sapien
tctccaataagtgtattcggtcctt

SEQ ID NO: 370848 - DNA, 25 bp, Homo sapien
taagtgtattcggtcctttgaaaga

SEQ ID NO: 370849 - DNA, 25 bp, Homo sapien
agaaactcctttgcaatcactctct

SEQ ID NO: 370850 - DNA, 25 bp, Homo sapien
actcctttgcaatcactctctgaaa

SEQ ID NO: 370851 - DNA, 25 bp, Homo sapien
attgtaaagaatcctggctgtgaga

SEQ ID NO: 370852 - DNA, 25 bp, Homo sapien
ttgtttttccctctgacactttcca

SEQ ID NO: 370853 - DNA, 25 bp, Homo sapien
agcagagacatctcagaattgccta

SEQ ID NO: 370854 - DNA, 25 bp, Homo sapien
agtacttgcttagaaatcatggtga

SEQ ID NO: 370855 - DNA, 25 bp, Homo sapien
ttatctcattttttgtaggtctgtg

SEQ ID NO: 370856 - DNA, 25 bp, Homo sapien
taaagaacttagtcatcccttccac

SEQ ID NO: 370857 - DNA, 25 bp, Homo sapien
ctgtgaagaacagaccctgggtccc

SEQ ID NO: 370858 - DNA, 25 bp, Homo sapien
cagaccctgggtcccacactgaaat

SEQ ID NO: 370859 - DNA, 25 bp, Homo sapien
ggaaccctggagagcctcgactccg

SEQ ID NO: 370860 - DNA, 25 bp, Homo sapien
agagcctcgactccggaagtctcaa

SEQ ID NO: 370861 - DNA, 25 bp, Homo sapien
gactccggaagtctcaaggtgcctc

SEQ ID NO: 370862 - DNA, 25 bp, Homo sapien
gaagtctcaaggtgcctcctcctct

SEQ ID NO: 370863 - DNA, 25 bp, Homo sapien
cttagctggcccgttggttttctga

SEQ ID NO: 370864 - DNA, 25 bp, Homo sapien
ctggcccgttggttttctgagcagg

SEQ ID NO: 370865 - DNA, 25 bp, Homo sapien
tgaactgtgaacaagtcagacaaat

SEQ ID NO: 370866 - DNA, 25 bp, Homo sapien
tttccagtttaggtccccgtcactg

SEQ ID NO: 370867 - DNA, 25 bp, Homo sapien
cgtcactgtctccacgccgtgatgg

SEQ ID NO: 370868 - DNA, 25 bp, Homo sapien
gtctccacgccgtgatggcagcgct

SEQ ID NO: 370869 - DNA, 25 bp, Homo sapien
tgatggcagcgctgccgaggacata

SEQ ID NO: 370870 - DNA, 25 bp, Homo sapien
gcagcgctgccgaggacataggaac

SEQ ID NO: 370871 - DNA, 25 bp, Homo sapien
gcgctgccgaggacataggaaccac

SEQ ID NO: 370872 - DNA, 25 bp, Homo sapien
tgccgaggacataggaaccacgact

SEQ ID NO: 370873 - DNA, 25 bp, Homo sapien
gaggacataggaaccacgactggaa

SEQ ID NO: 370874 - DNA, 25 bp, Homo sapien
aaccacgactggaaagataatttat

SEQ ID NO: 370875 - DNA, 25 bp, Homo sapien
gataatttatcgtgttaggagaaga

SEQ ID NO: 370876 - DNA, 25 bp, Homo sapien
ggagaagaacgatgatacctactta

SEQ ID NO: 370877 - DNA, 25 bp, Homo sapien
aacattattgcaacacatcgaagag

SEQ ID NO: 370878 - DNA, 25 bp, Homo sapien
attattgcaacacatcgaagagaac

SEQ ID NO: 370879 - DNA, 25 bp, Homo sapien
attgcaacacatcgaagagaacatt

SEQ ID NO: 370880 - DNA, 25 bp, Homo sapien
gcaacacatcgaagagaacattatt

SEQ ID NO: 370881 - DNA, 25 bp, Homo sapien
acacatcgaagagaacattattaat

SEQ ID NO: 370882 - DNA, 25 bp, Homo sapien
attaatgaagactgcttaaaagaaa

SEQ ID NO: 370883 - DNA, 25 bp, Homo sapien
ttgcatctcacttctttgtctcaaa

SEQ ID NO: 370884 - DNA, 25 bp, Homo sapien
caaaacccagaatcaataattgagt

SEQ ID NO: 370885 - DNA, 25 bp, Homo sapien
attgagttaaacttggagcctgaag

SEQ ID NO: 370886 - DNA, 25 bp, Homo sapien
tcagttcatcattcacactaaagaa

SEQ ID NO: 370887 - DNA, 25 bp, Homo sapien
agttcatcattcacactaaagaatt

SEQ ID NO: 370888 - DNA, 25 bp, Homo sapien
gcaacagcagcgtactgctggctct

SEQ ID NO: 370889 - DNA, 25 bp, Homo sapien
cttccaggtgctgccgcaaatgtgc

SEQ ID NO: 370890 - DNA, 25 bp, Homo sapien
gtgctgccgcaaatgtgctgggaca

SEQ ID NO: 370891 - DNA, 25 bp, Homo sapien
cgcaaatgtgctgggacatcaccta

SEQ ID NO: 370892 - DNA, 25 bp, Homo sapien
tgtgccgcgtggtgaagcacctgca

SEQ ID NO: 370893 - DNA, 25 bp, Homo sapien
gcacctgcaggtgttcggcatgttt

SEQ ID NO: 370894 - DNA, 25 bp, Homo sapien
ttcggcatgtttgcgtcggcctaca

SEQ ID NO: 370895 - DNA, 25 bp, Homo sapien
gtcggcctacatgctggtagtcatg

SEQ ID NO: 370896 - DNA, 25 bp, Homo sapien
tggtagtcatgacagccgaccgcta

SEQ ID NO: 370897 - DNA, 25 bp, Homo sapien
acagccgaccgctacatcgcggtgt

SEQ ID NO: 370898 - DNA, 25 bp, Homo sapien
atcgcggtgtgccacccgctcaaga

SEQ ID NO: 370899 - DNA, 25 bp, Homo sapien
cgcttcttgtgctgggatgcgtacc

SEQ ID NO: 370900 - DNA, 25 bp, Homo sapien
ttgtgctgggatgcgtacccgctgt

SEQ ID NO: 370901 - DNA, 25 bp, Homo sapien
tgtcccccagagaatccttgggctc

SEQ ID NO: 370902 - DNA, 25 bp, Homo sapien
tgtgcttcctgtcgtcctcttccgt

SEQ ID NO: 370903 - DNA, 25 bp, Homo sapien
tgtcgtcctcttccgtgtcgctggg

SEQ ID NO: 370904 - DNA, 25 bp, Homo sapien
gggctctcgtggctccggaagctcc

SEQ ID NO: 370905 - DNA, 25 bp, Homo sapien
gctccccttggtggcaaactcatag

SEQ ID NO: 370906 - DNA, 25 bp, Homo sapien
ggcaaactcatagtggtcgtcggct

SEQ ID NO: 370907 - DNA, 25 bp, Homo sapien
aactcatagtggtcgtcggctgagg

SEQ ID NO: 370908 - DNA, 25 bp, Homo sapien
gggcttttcggtgcgtctctttttg

SEQ ID NO: 370909 - DNA, 25 bp, Homo sapien
ttttcggtgcgtctctttttgaggg

SEQ ID NO: 370910 - DNA, 25 bp, Homo sapien
actatagatttgctgttaccttatt

SEQ ID NO: 370911 - DNA, 25 bp, Homo sapien
gagatacagaagtcaggctagccca

SEQ ID NO: 370912 - DNA, 25 bp, Homo sapien
agaagtcaggctagcccagtgcttg

SEQ ID NO: 370913 - DNA, 25 bp, Homo sapien
agttacagcactcaagacaccctgg

SEQ ID NO: 370914 - DNA, 25 bp, Homo sapien
aagactgtctctaccagccttttgt

SEQ ID NO: 370915 - DNA, 25 bp, Homo sapien
tctctaccagccttttgtcttccaa

SEQ ID NO: 370916 - DNA, 25 bp, Homo sapien
tgggcataggcctgagatataagct

SEQ ID NO: 370917 - DNA, 25 bp, Homo sapien
aatattcaacttaatggagacagca

SEQ ID NO: 370918 - DNA, 25 bp, Homo sapien
tggagacagcatcttttacatttaa

SEQ ID NO: 370919 - DNA, 25 bp, Homo sapien
aacagaggatttgaacacgttctat

SEQ ID NO: 370920 - DNA, 25 bp, Homo sapien
gttctatgcagacatggttttacta

SEQ ID NO: 370921 - DNA, 25 bp, Homo sapien
gagaagctgtccagcgctttccagg

SEQ ID NO: 370922 - DNA, 25 bp, Homo sapien
aggtgcgctgggagtgtagcctcgc

SEQ ID NO: 370923 - DNA, 25 bp, Homo sapien
gggcctcacaaaggtgtgacaacat

SEQ ID NO: 370924 - DNA, 25 bp, Homo sapien
aaatattttgactgcctactaaggg

SEQ ID NO: 370925 - DNA, 25 bp, Homo sapien
attttgactgcctactaagggccac

SEQ ID NO: 370926 - DNA, 25 bp, Homo sapien
gactgcctactaagggccacctaat

SEQ ID NO: 370927 - DNA, 25 bp, Homo sapien
aagggccacctaatatgctcaatga

SEQ ID NO: 370928 - DNA, 25 bp, Homo sapien
cactcatcggtcttggtgtgatcag

SEQ ID NO: 370929 - DNA, 25 bp, Homo sapien
tgctcaatgaaaccattatgggcaa

SEQ ID NO: 370930 - DNA, 25 bp, Homo sapien
gatcagcattgagagggcctacccg

SEQ ID NO: 370931 - DNA, 25 bp, Homo sapien
gctcacactgggttccaacatcggc

SEQ ID NO: 370932 - DNA, 25 bp, Homo sapien
gggaggaccaccaccctttcagagg

SEQ ID NO: 370933 - DNA, 25 bp, Homo sapien
ggaggaccaccaccctttcagaggc

SEQ ID NO: 370934 - DNA, 25 bp, Homo sapien
gaggaccaccaccctttcagaggcg

SEQ ID NO: 370935 - DNA, 25 bp, Homo sapien
aggaccaccaccctttcagaggcgt

SEQ ID NO: 370936 - DNA, 25 bp, Homo sapien
cctttcagaggcgtgaggccctggg

SEQ ID NO: 370937 - DNA, 25 bp, Homo sapien
ctttcagaggcgtgaggccctgggg

SEQ ID NO: 370938 - DNA, 25 bp, Homo sapien
tttcagaggcgtgaggccctggggc

SEQ ID NO: 370939 - DNA, 25 bp, Homo sapien
ttcagaggcgtgaggccctggggcc

SEQ ID NO: 370940 - DNA, 25 bp, Homo sapien
tcagaggcgtgaggccctggggccc

SEQ ID NO: 370941 - DNA, 25 bp, Homo sapien
tctagtgcaactggaattcccacct

SEQ ID NO: 370942 - DNA, 25 bp, Homo sapien
cacctcctggtatttctggacacca

SEQ ID NO: 370943 - DNA, 25 bp, Homo sapien
actccctttctctggatcatttatg

SEQ ID NO: 370944 - DNA, 25 bp, Homo sapien
gagagtcttctatttaattgcaagt

SEQ ID NO: 370945 - DNA, 25 bp, Homo sapien
gtaacagctgcatctgcacagcgct

SEQ ID NO: 370946 - DNA, 25 bp, Homo sapien
tggttccccacatcaaaggcagagg

SEQ ID NO: 370947 - DNA, 25 bp, Homo sapien
agtcattcaaagtagctaggagcct

SEQ ID NO: 370948 - DNA, 25 bp, Homo sapien
taggagcctcccagcgaatagaacc

SEQ ID NO: 370949 - DNA, 25 bp, Homo sapien
cagcgaatagaacccgggtgtccca

SEQ ID NO: 370950 - DNA, 25 bp, Homo sapien
cgggtgtcccaagcctagagcatga

SEQ ID NO: 370951 - DNA, 25 bp, Homo sapien
tgacctagaacttcgctctgtggga

SEQ ID NO: 370952 - DNA, 25 bp, Homo sapien
aacccgtctgcgtacctaagtgtgg

SEQ ID NO: 370953 - DNA, 25 bp, Homo sapien
gtctgcgtacctaagtgtggctccc

SEQ ID NO: 370954 - DNA, 25 bp, Homo sapien
agcgtcctggtagcatggatccagt

SEQ ID NO: 370955 - DNA, 25 bp, Homo sapien
gatccagtctgaaaggtgaggacaa

SEQ ID NO: 370956 - DNA, 25 bp, Homo sapien
aggacaacgtggaaactcatgagct

SEQ ID NO: 370957 - DNA, 25 bp, Homo sapien
tggaaactcatgagctgagcctgcc

SEQ ID NO: 370958 - DNA, 25 bp, Homo sapien
tgagcctgcccgctgggacacgtct

SEQ ID NO: 370959 - DNA, 25 bp, Homo sapien
ccgcgtcaccttctggtttagggag

SEQ ID NO: 370960 - DNA, 25 bp, Homo sapien
accttctggtttagggagccgtcag

SEQ ID NO: 370961 - DNA, 25 bp, Homo sapien
tagggagccgtcaggtccctaaacg

SEQ ID NO: 370962 - DNA, 25 bp, Homo sapien
acagagaggtgctatgggtacaatt

SEQ ID NO: 370963 - DNA, 25 bp, Homo sapien
gcgtaacaggcaccacaatagttct

SEQ ID NO: 370964 - DNA, 25 bp, Homo sapien
tgacaggctcggctgccagcattcc

SEQ ID NO: 370965 - DNA, 25 bp, Homo sapien
ccaggaaggcggtcaggcaaccctg

SEQ ID NO: 370966 - DNA, 25 bp, Homo sapien
atgtgtccagcttgaaagtctatcg

SEQ ID NO: 370967 - DNA, 25 bp, Homo sapien
gaaagtctatcgaggcttggtcttg

SEQ ID NO: 370968 - DNA, 25 bp, Homo sapien
tctatcgaggcttggtcttgggaaa

SEQ ID NO: 370969 - DNA, 25 bp, Homo sapien
ctccgtcctccatcattgctggagg

SEQ ID NO: 370970 - DNA, 25 bp, Homo sapien
gccttgtgacactgggacgatgcag

SEQ ID NO: 370971 - DNA, 25 bp, Homo sapien
tgacactgggacgatgcaggacttg

SEQ ID NO: 370972 - DNA, 25 bp, Homo sapien
ctctgtctcttacaacctgtggaat

SEQ ID NO: 370973 - DNA, 25 bp, Homo sapien
acaacctgtggaatgttcagcaaaa

SEQ ID NO: 370974 - DNA, 25 bp, Homo sapien
ggaatatggcacctctgatttgaaa

SEQ ID NO: 370975 - DNA, 25 bp, Homo sapien
attcctattccatctgcctcgttgt

SEQ ID NO: 370976 - DNA, 25 bp, Homo sapien
ggatgattttcatcagccgtgtatc

SEQ ID NO: 370977 - DNA, 25 bp, Homo sapien
agccgtgtatctgcttccttggcag

SEQ ID NO: 370978 - DNA, 25 bp, Homo sapien
agaccccaggctgtttcagtgtgtc

SEQ ID NO: 370979 - DNA, 25 bp, Homo sapien
tcagtgtgtcatctggcaggcccaa

SEQ ID NO: 370980 - DNA, 25 bp, Homo sapien
gcaggcccaaacagaggatgtctca

SEQ ID NO: 370981 - DNA, 25 bp, Homo sapien
ggatgtctcaattgtgcatgtgtaa

SEQ ID NO: 370982 - DNA, 25 bp, Homo sapien
caggcctgagtgttgaagacagctt

SEQ ID NO: 370983 - DNA, 25 bp, Homo sapien
gaagacagcttgttccaatgtaaga

SEQ ID NO: 370984 - DNA, 25 bp, Homo sapien
gattgttcataacaggagtctgcag

SEQ ID NO: 370985 - DNA, 25 bp, Homo sapien
atggagtgttatatttcaaggtttt

SEQ ID NO: 370986 - DNA, 25 bp, Homo sapien
accccaatcaggcaccaggataaaa

SEQ ID NO: 370987 - DNA, 25 bp, Homo sapien
ggcaccaggataaaagcagggactt

SEQ ID NO: 370988 - DNA, 25 bp, Homo sapien
taaaagcagggacttaaacagcacc

SEQ ID NO: 370989 - DNA, 25 bp, Homo sapien
ggttcttcagcctgagccatcacat

SEQ ID NO: 370990 - DNA, 25 bp, Homo sapien
tgagccatcacatgctatcagtctc

SEQ ID NO: 370991 - DNA, 25 bp, Homo sapien
tcacatgctatcagtctcctaacct

SEQ ID NO: 370992 - DNA, 25 bp, Homo sapien
cccctgggccttaagacagggcttg

SEQ ID NO: 370993 - DNA, 25 bp, Homo sapien
aatgagttacattgccacctgagaa

SEQ ID NO: 370994 - DNA, 25 bp, Homo sapien
cctcccaagtgcaaaatgtgtaaac

SEQ ID NO: 370995 - DNA, 25 bp, Homo sapien
gtgtaaacagagtaaacggaacaga

SEQ ID NO: 370996 - DNA, 25 bp, Homo sapien
aactcaggacagtggctagtacaga

SEQ ID NO: 370997 - DNA, 25 bp, Homo sapien
ctagtacagaggtctcagtaaattt

SEQ ID NO: 370998 - DNA, 25 bp, Homo sapien
aagtggctgttttacttgcctattg

SEQ ID NO: 370999 - DNA, 25 bp, Homo sapien
gctgttttacttgcctattgttaac

SEQ ID NO: 371000 - DNA, 25 bp, Homo sapien
cttgcctattgttaacagactcaga

SEQ ID NO: 371001 - DNA, 25 bp, Homo sapien
ttttttcagtctaccttgcaagata

SEQ ID NO: 371002 - DNA, 25 bp, Homo sapien
agggaaaccaagtgacagtgctgaa

SEQ ID NO: 371003 - DNA, 25 bp, Homo sapien
tgaacactgggctgagtggtaccaa

SEQ ID NO: 371004 - DNA, 25 bp, Homo sapien
gagtggtaccaaacatcagtttagt

SEQ ID NO: 371005 - DNA, 25 bp, Homo sapien
agtttagtcactaattagccatgtg

SEQ ID NO: 371006 - DNA, 25 bp, Homo sapien
actaattagccatgtgatcctgtta

SEQ ID NO: 371007 - DNA, 25 bp, Homo sapien
aaattcttacttgcaggccctctgg

SEQ ID NO: 371008 - DNA, 25 bp, Homo sapien
tgcaggccctctggacccaggagag

SEQ ID NO: 371009 - DNA, 25 bp, Homo sapien
ggctgggccggattccgcagattct

SEQ ID NO: 371010 - DNA, 25 bp, Homo sapien
gcagattctggcctaggtcctgaat

SEQ ID NO: 371011 - DNA, 25 bp, Homo sapien
tggcctaggtcctgaatgcctggtg

SEQ ID NO: 371012 - DNA, 25 bp, Homo sapien
tgaatgcctggtgagttactgagaa

SEQ ID NO: 371013 - DNA, 25 bp, Homo sapien
gttactgagaaaggccctacaggct

SEQ ID NO: 371014 - DNA, 25 bp, Homo sapien
gaaccagtagcagaagctccaggga

SEQ ID NO: 371015 - DNA, 25 bp, Homo sapien
cctacaggctgagggtgccagtcag

SEQ ID NO: 371016 - DNA, 25 bp, Homo sapien
gaagctccagggaaactgatgaagg

SEQ ID NO: 371017 - DNA, 25 bp, Homo sapien
tctagcagcccaaagggattggaat

SEQ ID NO: 371018 - DNA, 25 bp, Homo sapien
tggagtgagttctctgggcctttgc

SEQ ID NO: 371019 - DNA, 25 bp, Homo sapien
tttgcttgctcctctctaaaaacag

SEQ ID NO: 371020 - DNA, 25 bp, Homo sapien
aacagggactcaataggtgatctct

SEQ ID NO: 371021 - DNA, 25 bp, Homo sapien
ggtgatctctaaagtccttccgtga

SEQ ID NO: 371022 - DNA, 25 bp, Homo sapien
tctaaagtccttccgtgatcattct

SEQ ID NO: 371023 - DNA, 25 bp, Homo sapien
aggtctaccacagccgtggtgtgga

SEQ ID NO: 371024 - DNA, 25 bp, Homo sapien
gccgtggtgtggagtgctattcata

SEQ ID NO: 371025 - DNA, 25 bp, Homo sapien
gagtgctattcataactacataact

SEQ ID NO: 371026 - DNA, 25 bp, Homo sapien
tactaagactaccatgcaaccaaat

SEQ ID NO: 371027 - DNA, 25 bp, Homo sapien
aattagactgctactttctccttct

SEQ ID NO: 371028 - DNA, 25 bp, Homo sapien
ctccttctggagtaatctgatattc

SEQ ID NO: 371029 - DNA, 25 bp, Homo sapien
ttaaataagttaattctatgctcct

SEQ ID NO: 371030 - DNA, 25 bp, Homo sapien
gctaggactacactttaccatatga

SEQ ID NO: 371031 - DNA, 25 bp, Homo sapien
tacactttaccatatgagcagcgtt

SEQ ID NO: 371032 - DNA, 25 bp, Homo sapien
ttaccatatgagcagcgttacaggg

SEQ ID NO: 371033 - DNA, 25 bp, Homo sapien
aatagacctagtaccattattttgg

SEQ ID NO: 371034 - DNA, 25 bp, Homo sapien
gacctagtaccattattttggagat

SEQ ID NO: 371035 - DNA, 25 bp, Homo sapien
ggagattcaaactgttacacgttgg

SEQ ID NO: 371036 - DNA, 25 bp, Homo sapien
actgttacacgttggtggactaaat

SEQ ID NO: 371037 - DNA, 25 bp, Homo sapien
gcagaaatcaagaagcaacttacaa

SEQ ID NO: 371038 - DNA, 25 bp, Homo sapien
gagttaataatctcgtccattctga

SEQ ID NO: 371039 - DNA, 25 bp, Homo sapien
taataatctcgtccattctgaatga

SEQ ID NO: 371040 - DNA, 25 bp, Homo sapien
ctccaaagctgtgccaccaatgaga

SEQ ID NO: 371041 - DNA, 25 bp, Homo sapien
agctgtgccaccaatgagagcattg

SEQ ID NO: 371042 - DNA, 25 bp, Homo sapien
aatgagagcattgggttcaagtttg

SEQ ID NO: 371043 - DNA, 25 bp, Homo sapien
gtttgcatcaaacatggtattacca

SEQ ID NO: 371044 - DNA, 25 bp, Homo sapien
atggtattaccaacgctgagcctcc

SEQ ID NO: 371045 - DNA, 25 bp, Homo sapien
cagagcacttaaaagtcctagtgag

SEQ ID NO: 371046 - DNA, 25 bp, Homo sapien
aagtcctagtgagagaatagatact

SEQ ID NO: 371047 - DNA, 25 bp, Homo sapien
gaatagatactatgcaagggaaaaa

SEQ ID NO: 371048 - DNA, 25 bp, Homo sapien
actctcaactctttgtacaaatatt

SEQ ID NO: 371049 - DNA, 25 bp, Homo sapien
caaatattattgtcctaagggcctt

SEQ ID NO: 371050 - DNA, 25 bp, Homo sapien
ctcctgcctagaaaataggttgtgt

SEQ ID NO: 371051 - DNA, 25 bp, Homo sapien
actgccattctcacactataacaag

SEQ ID NO: 371052 - DNA, 25 bp, Homo sapien
gaagtgcataagtctcctgggaaaa

SEQ ID NO: 371053 - DNA, 25 bp, Homo sapien
ttctcgtgccatgactggtgatttc

SEQ ID NO: 371054 - DNA, 25 bp, Homo sapien
tgatttcatgactcataagcccctc

SEQ ID NO: 371055 - DNA, 25 bp, Homo sapien
ccctccgtaggcatcattcaagatc

SEQ ID NO: 371056 - DNA, 25 bp, Homo sapien
cattcaagatcaatggcccatgcat

SEQ ID NO: 371057 - DNA, 25 bp, Homo sapien
aatggcccatgcatgctgtttgcag

SEQ ID NO: 371058 - DNA, 25 bp, Homo sapien
ctgtttgcagcagtcaattgagttg

SEQ ID NO: 371059 - DNA, 25 bp, Homo sapien
gaattagaattccaaccatacattt

SEQ ID NO: 371060 - DNA, 25 bp, Homo sapien
aaaatgttgtgacttcatggcaaac

SEQ ID NO: 371061 - DNA, 25 bp, Homo sapien
gtgacttcatggcaaacaggtggat

SEQ ID NO: 371062 - DNA, 25 bp, Homo sapien
tcttctgtaactgctcccataagta

SEQ ID NO: 371063 - DNA, 25 bp, Homo sapien
gctcccataagtacttggtgatgat

SEQ ID NO: 371064 - DNA, 25 bp, Homo sapien
ggtgatgatctgagtccattccatg

SEQ ID NO: 371065 - DNA, 25 bp, Homo sapien
gagtccattccatgaaagggtcaac

SEQ ID NO: 371066 - DNA, 25 bp, Homo sapien
gaaagggtcaacatgtctcttctta

SEQ ID NO: 371067 - DNA, 25 bp, Homo sapien
aacatgtctcttcttaaccttggtc

SEQ ID NO: 371068 - DNA, 25 bp, Homo sapien
aaccttggtctcagagattgctgca

SEQ ID NO: 371069 - DNA, 25 bp, Homo sapien
gcatagtaggcacaggtcatcttaa

SEQ ID NO: 371070 - DNA, 25 bp, Homo sapien
gtcatcttaatgagccaggcagccc

SEQ ID NO: 371071 - DNA, 25 bp, Homo sapien
acaggcactgtgtatttggctaagt

SEQ ID NO: 371072 - DNA, 25 bp, Homo sapien
gacctttttggctagttgcgtgagt

SEQ ID NO: 371073 - DNA, 25 bp, Homo sapien
cagctcgaagcttgaatttggtaat

SEQ ID NO: 371074 - DNA, 25 bp, Homo sapien
gaatttggtaatgcatactacagaa

SEQ ID NO: 371075 - DNA, 25 bp, Homo sapien
atgattttagcaacactcacccact

SEQ ID NO: 371076 - DNA, 25 bp, Homo sapien
gtgaatgtatggactgcagaagcta

SEQ ID NO: 371077 - DNA, 25 bp, Homo sapien
gaagctacatagctcctcattcttc

SEQ ID NO: 371078 - DNA, 25 bp, Homo sapien
ctcattcttcactctattttcataa

SEQ ID NO: 371079 - DNA, 25 bp, Homo sapien
aagcatgtttcagggcatatcttcc

SEQ ID NO: 371080 - DNA, 25 bp, Homo sapien
cactgttgctgacaagtcaaaagct

SEQ ID NO: 371081 - DNA, 25 bp, Homo sapien
gtcaaaagctcataagccacagaag

SEQ ID NO: 371082 - DNA, 25 bp, Homo sapien
gaagatggtgttgctttgttttcat

SEQ ID NO: 371083 - DNA, 25 bp, Homo sapien
ggtgttgctttgttttcatggtgga

SEQ ID NO: 371084 - DNA, 25 bp, Homo sapien
gagtgtgagtacattgtccttccaa

SEQ ID NO: 371085 - DNA, 25 bp, Homo sapien
gtacattgtccttccaaacctgatt

SEQ ID NO: 371086 - DNA, 25 bp, Homo sapien
cctgggtactgcacatatgtgttgt

SEQ ID NO: 371087 - DNA, 25 bp, Homo sapien
caaacctgattcatcccaaactctg

SEQ ID NO: 371088 - DNA, 25 bp, Homo sapien
aactctgtgaggtttttctccagtg

SEQ ID NO: 371089 - DNA, 25 bp, Homo sapien
ttctccagtgccataattgcatttc

SEQ ID NO: 371090 - DNA, 25 bp, Homo sapien
tacttgtttgaagagctctgcttgc

SEQ ID NO: 371091 - DNA, 25 bp, Homo sapien
agctctgcttgctcaacacttgctt

SEQ ID NO: 371092 - DNA, 25 bp, Homo sapien
ctttatgtcatatagctctttttca

SEQ ID NO: 371093 - DNA, 25 bp, Homo sapien
ggtcagggaatgtttttgctcacaa

SEQ ID NO: 371094 - DNA, 25 bp, Homo sapien
tgctcacaaattcacgtggttatgt

SEQ ID NO: 371095 - DNA, 25 bp, Homo sapien
tcctgttctggaagccactgagata

SEQ ID NO: 371096 - DNA, 25 bp, Homo sapien
tggaaccccaaatacgagctgttcc

SEQ ID NO: 371097 - DNA, 25 bp, Homo sapien
agctgttcccctcgcgtcaggagaa

SEQ ID NO: 371098 - DNA, 25 bp, Homo sapien
tcccctcgcgtcaggagaagctcta

SEQ ID NO: 371099 - DNA, 25 bp, Homo sapien
aggagaagctctacccgggctgggc

SEQ ID NO: 371100 - DNA, 25 bp, Homo sapien
tgctgtccttgctgcccgtgctgtg

SEQ ID NO: 371101 - DNA, 25 bp, Homo sapien
ttgctcagctgctcacccggcggag

SEQ ID NO: 371102 - DNA, 25 bp, Homo sapien
acgtggagggacagggacgcgcgcc

SEQ ID NO: 371103 - DNA, 25 bp, Homo sapien
gaccatctttgtggcttacatcatc

SEQ ID NO: 371104 - DNA, 25 bp, Homo sapien
atctttgtggcttacatcatcctcc

SEQ ID NO: 371105 - DNA, 25 bp, Homo sapien
ttgtggcttacatcatcctcctgtt

SEQ ID NO: 371106 - DNA, 25 bp, Homo sapien
agttgtagatatccttcactggcag

SEQ ID NO: 371107 - DNA, 25 bp, Homo sapien
atccttcactggcaggcgcttggtt

SEQ ID NO: 371108 - DNA, 25 bp, Homo sapien
ggagagtcctcgatggccataaata

SEQ ID NO: 371109 - DNA, 25 bp, Homo sapien
gcctggcatcgtagggcatgtcaga

SEQ ID NO: 371110 - DNA, 25 bp, Homo sapien
tgaggaccgactccccaaagctctt

SEQ ID NO: 371111 - DNA, 25 bp, Homo sapien
tccccaaagctcttcagcaagttct

SEQ ID NO: 371112 - DNA, 25 bp, Homo sapien
aagttcttgctctcgtgcagccagt

SEQ ID NO: 371113 - DNA, 25 bp, Homo sapien
tgcagccagttcaggttggtcagct

SEQ ID NO: 371114 - DNA, 25 bp, Homo sapien
ttcaggttggtcagctcttcatctt

SEQ ID NO: 371115 - DNA, 25 bp, Homo sapien
ccctcttctaatcggatgtcaggca

SEQ ID NO: 371116 - DNA, 25 bp, Homo sapien
tctaatcggatgtcaggcagagaaa

SEQ ID NO: 371117 - DNA, 25 bp, Homo sapien
aggcgcctgctcatgttgaagtgcg

SEQ ID NO: 371118 - DNA, 25 bp, Homo sapien
gcctgctcatgttgaagtgcgctgt

SEQ ID NO: 371119 - DNA, 25 bp, Homo sapien
ctgctcatgttgaagtgcgctgttc

SEQ ID NO: 371120 - DNA, 25 bp, Homo sapien
gctcatgttgaagtgcgctgttcac

SEQ ID NO: 371121 - DNA, 25 bp, Homo sapien
tcatgttgaagtgcgctgttcacac

SEQ ID NO: 371122 - DNA, 25 bp, Homo sapien
tgttgaagtgcgctgttcacacccg

SEQ ID NO: 371123 - DNA, 25 bp, Homo sapien
tgaagtgcgctgttcacacccgctc

SEQ ID NO: 371124 - DNA, 25 bp, Homo sapien
tgttcacacccgctccggagagcac

SEQ ID NO: 371125 - DNA, 25 bp, Homo sapien
cctcttcaaagtctcctgtgacatt

SEQ ID NO: 371126 - DNA, 25 bp, Homo sapien
tcttcaaagtctcctgtgacatttt

SEQ ID NO: 371127 - DNA, 25 bp, Homo sapien
caaagtctcctgtgacattttttct

SEQ ID NO: 371128 - DNA, 25 bp, Homo sapien
aggttaaattgaccttgtcatttat

SEQ ID NO: 371129 - DNA, 25 bp, Homo sapien
gaccttgtcatttataaaagcaact

SEQ ID NO: 371130 - DNA, 25 bp, Homo sapien
gttcatcatgaaatttagagtctag

SEQ ID NO: 371131 - DNA, 25 bp, Homo sapien
gaggtggaaagaataccatcatcca

SEQ ID NO: 371132 - DNA, 25 bp, Homo sapien
taccatcatccatgggcttatcact

SEQ ID NO: 371133 - DNA, 25 bp, Homo sapien
tcatccatgggcttatcactgagat

SEQ ID NO: 371134 - DNA, 25 bp, Homo sapien
catccatgggcttatcactgagata

SEQ ID NO: 371135 - DNA, 25 bp, Homo sapien
tccatgggcttatcactgagataac

SEQ ID NO: 371136 - DNA, 25 bp, Homo sapien
gctgggatacaagtgcatgacactt

SEQ ID NO: 371137 - DNA, 25 bp, Homo sapien
caagtgcatgacacttttatagtgt

SEQ ID NO: 371138 - DNA, 25 bp, Homo sapien
gtgtctttaaagtgacttagaaggg

SEQ ID NO: 371139 - DNA, 25 bp, Homo sapien
aagccctggaggtttctgcagacga

SEQ ID NO: 371140 - DNA, 25 bp, Homo sapien
ggtctccgaggcttccaaagagagc

SEQ ID NO: 371141 - DNA, 25 bp, Homo sapien
gcggagcccgtcttacctgagcagc

SEQ ID NO: 371142 - DNA, 25 bp, Homo sapien
cccagcgagtccagcggtggcgact

SEQ ID NO: 371143 - DNA, 25 bp, Homo sapien
gagctgagggcaagctcagagccca

SEQ ID NO: 371144 - DNA, 25 bp, Homo sapien
cagagcccagggtgagtcatttcct

SEQ ID NO: 371145 - DNA, 25 bp, Homo sapien
agggtgagtcatttcctgtctccat

SEQ ID NO: 371146 - DNA, 25 bp, Homo sapien
gtctccatggattgatggaccctga

SEQ ID NO: 371147 - DNA, 25 bp, Homo sapien
gacaaaggaccagggatcaagggca

SEQ ID NO: 371148 - DNA, 25 bp, Homo sapien
gatcaagggcaaggcgagctccatg

SEQ ID NO: 371149 - DNA, 25 bp, Homo sapien
aggcgagctccatgtgggccaaaga

SEQ ID NO: 371150 - DNA, 25 bp, Homo sapien
ggaatgtatccaattcagaatatgg

SEQ ID NO: 371151 - DNA, 25 bp, Homo sapien
gaaatgctacttgctaaactgaatg

SEQ ID NO: 371152 - DNA, 25 bp, Homo sapien
gacagagaactccaagattctcgaa

SEQ ID NO: 371153 - DNA, 25 bp, Homo sapien
ttctcgaaatctaaaataccctgtt

SEQ ID NO: 371154 - DNA, 25 bp, Homo sapien
ataccctgttttgccattgttacct

SEQ ID NO: 371155 - DNA, 25 bp, Homo sapien
tgccattgttacctgattttgaatc

SEQ ID NO: 371156 - DNA, 25 bp, Homo sapien
ttgaatcaaaactacactccccaga

SEQ ID NO: 371157 - DNA, 25 bp, Homo sapien
caaaactacactccccagagagaag

SEQ ID NO: 371158 - DNA, 25 bp, Homo sapien
gagaagccccaaaacatacaggttc

SEQ ID NO: 371159 - DNA, 25 bp, Homo sapien
tgggaaactggaaggtaccaactag

SEQ ID NO: 371160 - DNA, 25 bp, Homo sapien
gaaggtaccaactaggaatgtatcc

SEQ ID NO: 371161 - DNA, 25 bp, Homo sapien
aaatgcctctagttcctcagaggta

SEQ ID NO: 371162 - DNA, 25 bp, Homo sapien
ggaaaaataaactcaacctgctttg

SEQ ID NO: 371163 - DNA, 25 bp, Homo sapien
actcaacctgctttggacttgtgta

SEQ ID NO: 371164 - DNA, 25 bp, Homo sapien
gctttggacttgtgtatttacttgg

SEQ ID NO: 371165 - DNA, 25 bp, Homo sapien
gggttggtttccagaatctccttat

SEQ ID NO: 371166 - DNA, 25 bp, Homo sapien
aatctccttattcctgaaacagtat

SEQ ID NO: 371167 - DNA, 25 bp, Homo sapien
tctttccaacctctgaggcatgcta

SEQ ID NO: 371168 - DNA, 25 bp, Homo sapien
ctctgaggcatgctattttatagtg

SEQ ID NO: 371169 - DNA, 25 bp, Homo sapien
tttatagtggtttgctctttgaaaa

SEQ ID NO: 371170 - DNA, 25 bp, Homo sapien
aattgtttttgtgccctctcttaat

SEQ ID NO: 371171 - DNA, 25 bp, Homo sapien
gtgccctctcttaatagtcacagat

SEQ ID NO: 371172 - DNA, 25 bp, Homo sapien
atatccctaatttggattagttttg

SEQ ID NO: 371173 - DNA, 25 bp, Homo sapien
atttggattagttttgtactttgtg

SEQ ID NO: 371174 - DNA, 25 bp, Homo sapien
tggattagttttgtactttgtgttg

SEQ ID NO: 371175 - DNA, 25 bp, Homo sapien
gtactttgtgttgagtttgtgatgc

SEQ ID NO: 371176 - DNA, 25 bp, Homo sapien
actttgtgttgagtttgtgatgcta

SEQ ID NO: 371177 - DNA, 25 bp, Homo sapien
ctttgtgttgagtttgtgatgctaa

SEQ ID NO: 371178 - DNA, 25 bp, Homo sapien
ttgtgttgagtttgtgatgctaaaa

SEQ ID NO: 371179 - DNA, 25 bp, Homo sapien
tgttgagtttgtgatgctaaaagta

SEQ ID NO: 371180 - DNA, 25 bp, Homo sapien
atactaaatcacattgtaccaaagc

SEQ ID NO: 371181 - DNA, 25 bp, Homo sapien
actaaatcacattgtaccaaagctg

SEQ ID NO: 371182 - DNA, 25 bp, Homo sapien
atatatactgtattgtagtgtttaa

SEQ ID NO: 371183 - DNA, 25 bp, Homo sapien
gaaaaaaccatgtgtgcaaacttta

SEQ ID NO: 371184 - DNA, 25 bp, Homo sapien
gtgtgcaaactttacatgcatttgg

SEQ ID NO: 371185 - DNA, 25 bp, Homo sapien
gtgttgcttaattgcataggacgga

SEQ ID NO: 371186 - DNA, 25 bp, Homo sapien
ggttgcactgaagttaacaagattc

SEQ ID NO: 371187 - DNA, 25 bp, Homo sapien
taacaagattcaaaccgtcgcccaa

SEQ ID NO: 371188 - DNA, 25 bp, Homo sapien
gtcgcccaagttggtatttccatgt

SEQ ID NO: 371189 - DNA, 25 bp, Homo sapien
ccatgtttggtacacatcactctgt

SEQ ID NO: 371190 - DNA, 25 bp, Homo sapien
atcactctgtgccatatcaggtcgt

SEQ ID NO: 371191 - DNA, 25 bp, Homo sapien
gtgccatatcaggtcgttgttaagt

SEQ ID NO: 371192 - DNA, 25 bp, Homo sapien
aggacggaatgaaccaattgagagt

SEQ ID NO: 371193 - DNA, 25 bp, Homo sapien
aattgagagtgggagttttctgtct

SEQ ID NO: 371194 - DNA, 25 bp, Homo sapien
ggcgcagcgctacctgcggaaataa

SEQ ID NO: 371195 - DNA, 25 bp, Homo sapien
gctacctgcggaaataacagcctca

SEQ ID NO: 371196 - DNA, 25 bp, Homo sapien
tgcggaaataacagcctcagccggg

SEQ ID NO: 371197 - DNA, 25 bp, Homo sapien
agccccagccaaaggcgtggctgtc

SEQ ID NO: 371198 - DNA, 25 bp, Homo sapien
gctgggccctgtagtgctggactct

SEQ ID NO: 371199 - DNA, 25 bp, Homo sapien
tgtagtgctggactctcccgggcca

SEQ ID NO: 371200 - DNA, 25 bp, Homo sapien
tctcccgggccacaatagggacagg

SEQ ID NO: 371201 - DNA, 25 bp, Homo sapien
gggtcagcagaggtaccacgaagct

SEQ ID NO: 371202 - DNA, 25 bp, Homo sapien
gtaccacgaagctaccttttgggat

SEQ ID NO: 371203 - DNA, 25 bp, Homo sapien
taccttttgggatgattgctcgatt

SEQ ID NO: 371204 - DNA, 25 bp, Homo sapien
tgattgctcgattgtttggttttta

SEQ ID NO: 371205 - DNA, 25 bp, Homo sapien
gatgcactgtgcttggtcctgacca

SEQ ID NO: 371206 - DNA, 25 bp, Homo sapien
gtgcttggtcctgaccatcatgaat

SEQ ID NO: 371207 - DNA, 25 bp, Homo sapien
acatctacaacatgggcaaccctgg

SEQ ID NO: 371208 - DNA, 25 bp, Homo sapien
acatgggcaaccctggcttcgagga

SEQ ID NO: 371209 - DNA, 25 bp, Homo sapien
ttcgggccacgggtaaaatgtatgc

SEQ ID NO: 371210 - DNA, 25 bp, Homo sapien
aatgtatgcctgcaagcgcttggag

SEQ ID NO: 371211 - DNA, 25 bp, Homo sapien
gagtccatggccctcaatgagaagc

SEQ ID NO: 371212 - DNA, 25 bp, Homo sapien
gagaagcagatcctcgagaaggtca

SEQ ID NO: 371213 - DNA, 25 bp, Homo sapien
cctcgagaaggtcaacagtcagttt

SEQ ID NO: 371214 - DNA, 25 bp, Homo sapien
ggcctatgcctacgagaccaaggat

SEQ ID NO: 371215 - DNA, 25 bp, Homo sapien
acgagaccaaggatgcactgtgctt

SEQ ID NO: 371216 - DNA, 25 bp, Homo sapien
ttcagaagtcagtggtagacaagaa

SEQ ID NO: 371217 - DNA, 25 bp, Homo sapien
tttattttaattcactgacagacaa

SEQ ID NO: 371218 - DNA, 25 bp, Homo sapien
caaatcagcaagcaattgatatggg

SEQ ID NO: 371219 - DNA, 25 bp, Homo sapien
aagggagttgataatgggctgaaca

SEQ ID NO: 371220 - DNA, 25 bp, Homo sapien
taatgggctgaacattagcatcccc

SEQ ID NO: 371221 - DNA, 25 bp, Homo sapien
gccagtaacctcacttatgagttaa

SEQ ID NO: 371222 - DNA, 25 bp, Homo sapien
aaatcctaacatatgctcccattac

SEQ ID NO: 371223 - DNA, 25 bp, Homo sapien
atcctaacatatgctcccattacat

SEQ ID NO: 371224 - DNA, 25 bp, Homo sapien
acatatgctcccattacattaaaca

SEQ ID NO: 371225 - DNA, 25 bp, Homo sapien
tacattaaacattcacactttcaga

SEQ ID NO: 371226 - DNA, 25 bp, Homo sapien
aacattcacactttcagaagtcagt

SEQ ID NO: 371227 - DNA, 25 bp, Homo sapien
gatgaaaaagttaacaagctccaga

SEQ ID NO: 371228 - DNA, 25 bp, Homo sapien
actcacagaagctgccctggaactt

SEQ ID NO: 371229 - DNA, 25 bp, Homo sapien
tggtcttgcttgtagctatccagcc

SEQ ID NO: 371230 - DNA, 25 bp, Homo sapien
ttgtagctatccagccactcatcta

SEQ ID NO: 371231 - DNA, 25 bp, Homo sapien
agccactcatctaccaaagactgta

SEQ ID NO: 371232 - DNA, 25 bp, Homo sapien
agaagctgccctggaacttcttcca

SEQ ID NO: 371233 - DNA, 25 bp, Homo sapien
cgctcctgccttgcacgttagagag

SEQ ID NO: 371234 - DNA, 25 bp, Homo sapien
ttgcacgttagagagccggtacatg

SEQ ID NO: 371235 - DNA, 25 bp, Homo sapien
cgcgcccgtgataaggttttacctg

SEQ ID NO: 371236 - DNA, 25 bp, Homo sapien
tggaacttcttccaggatagacctg

SEQ ID NO: 371237 - DNA, 25 bp, Homo sapien
tccaggatagacctggagctgtcag

SEQ ID NO: 371238 - DNA, 25 bp, Homo sapien
attcatctgatgtgttgcttgctac

SEQ ID NO: 371239 - DNA, 25 bp, Homo sapien
gtgttgcttgctaccttatattctc

SEQ ID NO: 371240 - DNA, 25 bp, Homo sapien
gctaccttatattctcctttcaaat

SEQ ID NO: 371241 - DNA, 25 bp, Homo sapien
atattcttttatcccaaactcctga

SEQ ID NO: 371242 - DNA, 25 bp, Homo sapien
tatcccaaactcctgaaggactctt

SEQ ID NO: 371243 - DNA, 25 bp, Homo sapien
cttcagatgttctacttacttaaat

SEQ ID NO: 371244 - DNA, 25 bp, Homo sapien
ttaaatctcatattgtcatacagtc

SEQ ID NO: 371245 - DNA, 25 bp, Homo sapien
gtcatacagtccatttatctgatga

SEQ ID NO: 371246 - DNA, 25 bp, Homo sapien
ggaactaaatatcccacaggtgttt

SEQ ID NO: 371247 - DNA, 25 bp, Homo sapien
aaacatctgtgggatacaggccaag

SEQ ID NO: 371248 - DNA, 25 bp, Homo sapien
atacaggccaaggaaggagtttgtt

SEQ ID NO: 371249 - DNA, 25 bp, Homo sapien
ctccaaagctgtgccaccaatgaga

SEQ ID NO: 371250 - DNA, 25 bp, Homo sapien
agctgtgccaccaatgagagcattg

SEQ ID NO: 371251 - DNA, 25 bp, Homo sapien
agcattgggttcaagtttgcatcaa

SEQ ID NO: 371252 - DNA, 25 bp, Homo sapien
gtttgcatcaaacatggtattacca

SEQ ID NO: 371253 - DNA, 25 bp, Homo sapien
atggtattaccaacgctgagcctcc

SEQ ID NO: 371254 - DNA, 25 bp, Homo sapien
gctgagcctccagcagagcacttaa

SEQ ID NO: 371255 - DNA, 25 bp, Homo sapien
gagcacttaaaagtcctagtgagag

SEQ ID NO: 371256 - DNA, 25 bp, Homo sapien
actgtttgtttactctcaactcttt

SEQ ID NO: 371257 - DNA, 25 bp, Homo sapien
actctcaactctttgtacaaatatt

SEQ ID NO: 371258 - DNA, 25 bp, Homo sapien
caaatattattgtcctaagggcctt

SEQ ID NO: 371259 - DNA, 25 bp, Homo sapien
ctcctgcctagaaaataggttgtgt

SEQ ID NO: 371260 - DNA, 25 bp, Homo sapien
gcttgacttgggttagtggccttaa

SEQ ID NO: 371261 - DNA, 25 bp, Homo sapien
gtggccttaatgaagtgctaaattt

SEQ ID NO: 371262 - DNA, 25 bp, Homo sapien
gctaaatttgctctttaccgcgaga

SEQ ID NO: 371263 - DNA, 25 bp, Homo sapien
gctctttaccgcgagactgatcaga

SEQ ID NO: 371264 - DNA, 25 bp, Homo sapien
actcgcaccttttacatcagacaag

SEQ ID NO: 371265 - DNA, 25 bp, Homo sapien
agacaagaggaggactgtgccagaa

SEQ ID NO: 371266 - DNA, 25 bp, Homo sapien
aatctgtgcatgaaacaccatctgc

SEQ ID NO: 371267 - DNA, 25 bp, Homo sapien
accatctgctcttcatgcagggagg

SEQ ID NO: 371268 - DNA, 25 bp, Homo sapien
aattctgttttatgttctgtgattc

SEQ ID NO: 371269 - DNA, 25 bp, Homo sapien
gattctgtggtagactcagtgcttt

SEQ ID NO: 371270 - DNA, 25 bp, Homo sapien
ctcagtgctttcagagtccagagct

SEQ ID NO: 371271 - DNA, 25 bp, Homo sapien
ttagctagtaaattgtagaaccagt

SEQ ID NO: 371272 - DNA, 25 bp, Homo sapien
gtagaaccagtactgaaaccaaggt

SEQ ID NO: 371273 - DNA, 25 bp, Homo sapien
gaaaccaaggtctgttcaaattaat

SEQ ID NO: 371274 - DNA, 25 bp, Homo sapien
atcattcatataggaattcatggtg

SEQ ID NO: 371275 - DNA, 25 bp, Homo sapien
attcatggtgagtaggacaggcaaa

SEQ ID NO: 371276 - DNA, 25 bp, Homo sapien
gacaggcaaaggtggctgtgttcat

SEQ ID NO: 371277 - DNA, 25 bp, Homo sapien
ggctgtgttcatggagcctccatta

SEQ ID NO: 371278 - DNA, 25 bp, Homo sapien
tccattagatggagggagtcattct

SEQ ID NO: 371279 - DNA, 25 bp, Homo sapien
gatggagggagtcattctttaataa

SEQ ID NO: 371280 - DNA, 25 bp, Homo sapien
gaagatggtttaggttagatggtca

SEQ ID NO: 371281 - DNA, 25 bp, Homo sapien
gtctcataaatgtctctttttcttt

SEQ ID NO: 371282 - DNA, 25 bp, Homo sapien
gcatttgttttgcattgaaagtttg

SEQ ID NO: 371283 - DNA, 25 bp, Homo sapien
ggaattgctggaagacgtatcccca

SEQ ID NO: 371284 - DNA, 25 bp, Homo sapien
tggaagacgtatccccagttaggaa

SEQ ID NO: 371285 - DNA, 25 bp, Homo sapien
gtatccccagttaggaatacaactt

SEQ ID NO: 371286 - DNA, 25 bp, Homo sapien
aacttgcaaagttcggtctagggcg

SEQ ID NO: 371287 - DNA, 25 bp, Homo sapien
aagttcggtctagggcgtgtagtca

SEQ ID NO: 371288 - DNA, 25 bp, Homo sapien
ctagggcgtgtagtcagagctctgt

SEQ ID NO: 371289 - DNA, 25 bp, Homo sapien
agagctctgtgatctcccttgaaag

SEQ ID NO: 371290 - DNA, 25 bp, Homo sapien
gtgatctcccttgaaagggtgtgat

SEQ ID NO: 371291 - DNA, 25 bp, Homo sapien
gagtgtagtaggtgccactggaatt

SEQ ID NO: 371292 - DNA, 25 bp, Homo sapien
accactgattggatttctgtaaaca

SEQ ID NO: 371293 - DNA, 25 bp, Homo sapien
ataaaacaaagctctggcaggcaat

SEQ ID NO: 371294 - DNA, 25 bp, Homo sapien
tctggcaggcaatgctttggtcttc

SEQ ID NO: 371295 - DNA, 25 bp, Homo sapien
aacaaggccggcgaggtctcaggaa

SEQ ID NO: 371296 - DNA, 25 bp, Homo sapien
ggcgggactccaggcagatgttcac

SEQ ID NO: 371297 - DNA, 25 bp, Homo sapien
aggcagatgttcacgccacgtcatc

SEQ ID NO: 371298 - DNA, 25 bp, Homo sapien
tccagactgaccatctgtctcgagg

SEQ ID NO: 371299 - DNA, 25 bp, Homo sapien
gtagccgtcctggttgtggcaaatg

SEQ ID NO: 371300 - DNA, 25 bp, Homo sapien
ggcaaatgtggacctcatcctctgt

SEQ ID NO: 371301 - DNA, 25 bp, Homo sapien
aacccaagccattgcatgggcactg

SEQ ID NO: 371302 - DNA, 25 bp, Homo sapien
gcatgggcactgtccgaagcctgtt

SEQ ID NO: 371303 - DNA, 25 bp, Homo sapien
gaagcctgttctgcctcccagatga

SEQ ID NO: 371304 - DNA, 25 bp, Homo sapien
gccataggacacttttagcacaaaa

SEQ ID NO: 371305 - DNA, 25 bp, Homo sapien
gtagttgtttacctcccattctcct

SEQ ID NO: 371306 - DNA, 25 bp, Homo sapien
tcctcctttaatctcagtgctttta

SEQ ID NO: 371307 - DNA, 25 bp, Homo sapien
tgactaaatgtcagcccagggtata

SEQ ID NO: 371308 - DNA, 25 bp, Homo sapien
gaaatggaaaacataccccttcttg

SEQ ID NO: 371309 - DNA, 25 bp, Homo sapien
aaaacataccccttcttggtcattg

SEQ ID NO: 371310 - DNA, 25 bp, Homo sapien
cttcttggtcattgggtaacagcac

SEQ ID NO: 371311 - DNA, 25 bp, Homo sapien
gggtaacagcaccatttcggtaaca

SEQ ID NO: 371312 - DNA, 25 bp, Homo sapien
tttcggtaacagtcatacttgatga

SEQ ID NO: 371313 - DNA, 25 bp, Homo sapien
gggtatagtaaccatgacacagtac

SEQ ID NO: 371314 - DNA, 25 bp, Homo sapien
cacagtactatccttggtgaagagt

SEQ ID NO: 371315 - DNA, 25 bp, Homo sapien
aggacgaggacgactgggaatccta

SEQ ID NO: 371316 - DNA, 25 bp, Homo sapien
agacccagacttgggctgttgctct

SEQ ID NO: 371317 - DNA, 25 bp, Homo sapien
ttgctctgacatggacacagccagg

SEQ ID NO: 371318 - DNA, 25 bp, Homo sapien
gacatggacacagccaggacaagct

SEQ ID NO: 371319 - DNA, 25 bp, Homo sapien
aggacaagctgctcagacctgcttc

SEQ ID NO: 371320 - DNA, 25 bp, Homo sapien
gctcagacctgcttccctgggaggg

SEQ ID NO: 371321 - DNA, 25 bp, Homo sapien
accagcactgtgtggagaccagctt

SEQ ID NO: 371322 - DNA, 25 bp, Homo sapien
agcactgtgtggagaccagcttcaa

SEQ ID NO: 371323 - DNA, 25 bp, Homo sapien
tgtgtggagaccagcttcaaggagc

SEQ ID NO: 371324 - DNA, 25 bp, Homo sapien
cttcaaggagcggaaggctggcttg

SEQ ID NO: 371325 - DNA, 25 bp, Homo sapien
gggacttctgtctgcctgtgctcca

SEQ ID NO: 371326 - DNA, 25 bp, Homo sapien
aacattattgcaacacatcgaagag

SEQ ID NO: 371327 - DNA, 25 bp, Homo sapien
acattattgcaacacatcgaagaga

SEQ ID NO: 371328 - DNA, 25 bp, Homo sapien
attattgcaacacatcgaagagaac

SEQ ID NO: 371329 - DNA, 25 bp, Homo sapien
tattgcaacacatcgaagagaacat

SEQ ID NO: 371330 - DNA, 25 bp, Homo sapien
ttgcaacacatcgaagagaacatta

SEQ ID NO: 371331 - DNA, 25 bp, Homo sapien
gcaacacatcgaagagaacattatt

SEQ ID NO: 371332 - DNA, 25 bp, Homo sapien
acacatcgaagagaacattattaat

SEQ ID NO: 371333 - DNA, 25 bp, Homo sapien
attaatgaagactgcttaaaagaaa

SEQ ID NO: 371334 - DNA, 25 bp, Homo sapien
caaaacccagaatcaataattgagt

SEQ ID NO: 371335 - DNA, 25 bp, Homo sapien
tcagttcatcattcacactaaagaa

SEQ ID NO: 371336 - DNA, 25 bp, Homo sapien
agttcatcattcacactaaagaatt

SEQ ID NO: 371337 - DNA, 25 bp, Homo sapien
ggaagtgaattacttgcatcagata

SEQ ID NO: 371338 - DNA, 25 bp, Homo sapien
atatgcttacattacatgcacgcgg

SEQ ID NO: 371339 - DNA, 25 bp, Homo sapien
atgcacgcggatttcatgctccata

SEQ ID NO: 371340 - DNA, 25 bp, Homo sapien
gcggatttcatgctccataatcttt

SEQ ID NO: 371341 - DNA, 25 bp, Homo sapien
catgctccataatcttttctatttt

SEQ ID NO: 371342 - DNA, 25 bp, Homo sapien
tacctttctgtaaatgatgtgcatg

SEQ ID NO: 371343 - DNA, 25 bp, Homo sapien
gatgtgcatggaatatgccttatag

SEQ ID NO: 371344 - DNA, 25 bp, Homo sapien
aaaaatgctgttcataatttgacta

SEQ ID NO: 371345 - DNA, 25 bp, Homo sapien
tttgactacgtggaaaagtgcctat

SEQ ID NO: 371346 - DNA, 25 bp, Homo sapien
aagtgcctatatggtggtaatgcta

SEQ ID NO: 371347 - DNA, 25 bp, Homo sapien
tatatggtggtaatgctagtaaggc

SEQ ID NO: 371348 - DNA, 25 bp, Homo sapien
tagtctcatagtaactccagcacgt

SEQ ID NO: 371349 - DNA, 25 bp, Homo sapien
gcacgtaatatgagtgtcttcctta

SEQ ID NO: 371350 - DNA, 25 bp, Homo sapien
gtcttccttaagtccgcatcaagtt

SEQ ID NO: 371351 - DNA, 25 bp, Homo sapien
gcatcaagttctccctcaggtggaa

SEQ ID NO: 371352 - DNA, 25 bp, Homo sapien
tctccctcaggtggaactgtttaat

SEQ ID NO: 371353 - DNA, 25 bp, Homo sapien
tccagtccaatcctgtctcttagat

SEQ ID NO: 371354 - DNA, 25 bp, Homo sapien
gtatttccagggactggccttgtca

SEQ ID NO: 371355 - DNA, 25 bp, Homo sapien
gagctgatttcttgttctttaaaac

SEQ ID NO: 371356 - DNA, 25 bp, Homo sapien
ttagattgacatttggtttagacca

SEQ ID NO: 371357 - DNA, 25 bp, Homo sapien
taatctttggaggtgggcgtccttt

SEQ ID NO: 371358 - DNA, 25 bp, Homo sapien
gggcgtccttttactggtacatata

SEQ ID NO: 371359 - DNA, 25 bp, Homo sapien
gagtcctcaaatagtttctccctgt

SEQ ID NO: 371360 - DNA, 25 bp, Homo sapien
ttctccctgtctactctccaggatt

SEQ ID NO: 371361 - DNA, 25 bp, Homo sapien
ggatttatagctgcattcagtggga

SEQ ID NO: 371362 - DNA, 25 bp, Homo sapien
tagctgcattcagtgggagacatga

SEQ ID NO: 371363 - DNA, 25 bp, Homo sapien
aaggagtatgccttctccatcttat

SEQ ID NO: 371364 - DNA, 25 bp, Homo sapien
gccttctccatcttatctggaactg

SEQ ID NO: 371365 - DNA, 25 bp, Homo sapien
ggaactgaagctaggttaccactat

SEQ ID NO: 371366 - DNA, 25 bp, Homo sapien
gctaggttaccactatgtctaattt

SEQ ID NO: 371367 - DNA, 25 bp, Homo sapien
catactgtacatactctgtactttt

SEQ ID NO: 371368 - DNA, 25 bp, Homo sapien
tagcaacatgtcaccaactttttcc

SEQ ID NO: 371369 - DNA, 25 bp, Homo sapien
atcatatgtattgctacaattctgt

SEQ ID NO: 371370 - DNA, 25 bp, Homo sapien
acacattctgaagggacttcatgtg

SEQ ID NO: 371371 - DNA, 25 bp, Homo sapien
cagtgagaccctcagcaggagttgg

SEQ ID NO: 371372 - DNA, 25 bp, Homo sapien
aatcaggacatgtatacccctggct

SEQ ID NO: 371373 - DNA, 25 bp, Homo sapien
aggacatgtatacccctggctcttc

SEQ ID NO: 371374 - DNA, 25 bp, Homo sapien
gaggttgccttgtgctgctgatgtt

SEQ ID NO: 371375 - DNA, 25 bp, Homo sapien
ttgccttgtgctgctgatgtttcac

SEQ ID NO: 371376 - DNA, 25 bp, Homo sapien
gtttcacaaccaaaggtcactgctg

SEQ ID NO: 371377 - DNA, 25 bp, Homo sapien
aaccaaaggtcactgctgatctcat

SEQ ID NO: 371378 - DNA, 25 bp, Homo sapien
aaaggtcactgctgatctcatagca

SEQ ID NO: 371379 - DNA, 25 bp, Homo sapien
ggtcactgctgatctcatagcaata

SEQ ID NO: 371380 - DNA, 25 bp, Homo sapien
gctgatctcatagcaataactacag

SEQ ID NO: 371381 - DNA, 25 bp, Homo sapien
taccagcccaagtctacattctgag

SEQ ID NO: 371382 - DNA, 25 bp, Homo sapien
acattctgaggctctaggaacacga

SEQ ID NO: 371383 - DNA, 25 bp, Homo sapien
gagagagaactccagtgctcacatc

SEQ ID NO: 371384 - DNA, 25 bp, Homo sapien
acatcccatattgaccctctttatg

SEQ ID NO: 371385 - DNA, 25 bp, Homo sapien
ttctttcccttataatcctatcttt

SEQ ID NO: 371386 - DNA, 25 bp, Homo sapien
tatgttcttcaattaccacctacct

SEQ ID NO: 371387 - DNA, 25 bp, Homo sapien
ttaccacctacctgaaaaagcctca

SEQ ID NO: 371388 - DNA, 25 bp, Homo sapien
aatcctatctttaacctcaagccat

SEQ ID NO: 371389 - DNA, 25 bp, Homo sapien
aacctcaagccattcattgtttagg

SEQ ID NO: 371390 - DNA, 25 bp, Homo sapien
gtttaggaattcaaggtctccttgg

SEQ ID NO: 371391 - DNA, 25 bp, Homo sapien
gggagtctcatgtccttgccaagcc

SEQ ID NO: 371392 - DNA, 25 bp, Homo sapien
tctttttcttccttaggcttgcaga

SEQ ID NO: 371393 - DNA, 25 bp, Homo sapien
ttaggcttgcagactgcttgctgac

SEQ ID NO: 371394 - DNA, 25 bp, Homo sapien
actgcttgctgacttgattctgttt

SEQ ID NO: 371395 - DNA, 25 bp, Homo sapien
ggaaggcagtggaaaagctctcccc

SEQ ID NO: 371396 - DNA, 25 bp, Homo sapien
ccccagcttttgtgtacaaatacca

SEQ ID NO: 371397 - DNA, 25 bp, Homo sapien
ccactcccacataaagagctgtaat

SEQ ID NO: 371398 - DNA, 25 bp, Homo sapien
gagctgtaattactagctacagaat

SEQ ID NO: 371399 - DNA, 25 bp, Homo sapien
gttttgtaaaaaccatgcagaatta

SEQ ID NO: 371400 - DNA, 25 bp, Homo sapien
aaagtgctctactaaatggtttcag

SEQ ID NO: 371401 - DNA, 25 bp, Homo sapien
atggtttcaggcagacacacaacta

SEQ ID NO: 371402 - DNA, 25 bp, Homo sapien
ggcagacacacaactaatcaaattt

SEQ ID NO: 371403 - DNA, 25 bp, Homo sapien
ttatttttactcttaatgacttagt

SEQ ID NO: 371404 - DNA, 25 bp, Homo sapien
actcttaatgacttagtagccacag

SEQ ID NO: 371405 - DNA, 25 bp, Homo sapien
cttaatgacttagtagccacagaaa

SEQ ID NO: 371406 - DNA, 25 bp, Homo sapien
aatgacttagtagccacagaaaaag

SEQ ID NO: 371407 - DNA, 25 bp, Homo sapien
agatgtaattgatgcttaaagctga

SEQ ID NO: 371408 - DNA, 25 bp, Homo sapien
gatgcttaaagctgatgccatacta

SEQ ID NO: 371409 - DNA, 25 bp, Homo sapien
gcttaaagctgatgccatactatca

SEQ ID NO: 371410 - DNA, 25 bp, Homo sapien
aaagctgatgccatactatcaaaaa

SEQ ID NO: 371411 - DNA, 25 bp, Homo sapien
aatatagtgatgaagcaatgtgaat

SEQ ID NO: 371412 - DNA, 25 bp, Homo sapien
taacagtattatgggaaatggacaa

SEQ ID NO: 371413 - DNA, 25 bp, Homo sapien
attaaatgttgatcaaggttctggg

SEQ ID NO: 371414 - DNA, 25 bp, Homo sapien
gtgggacccagcaataactaacttg

SEQ ID NO: 371415 - DNA, 25 bp, Homo sapien
actaacttggaatgaactaacccag

SEQ ID NO: 371416 - DNA, 25 bp, Homo sapien
gaactaacccagaatagccagacct

SEQ ID NO: 371417 - DNA, 25 bp, Homo sapien
agccagacctagttggttattcaca

SEQ ID NO: 371418 - DNA, 25 bp, Homo sapien
gaaggaacaaaccacaccttccctg

SEQ ID NO: 371419 - DNA, 25 bp, Homo sapien
gttattcacactgcaatttgggcct

SEQ ID NO: 371420 - DNA, 25 bp, Homo sapien
tgcaatttgggcctttttcagtttt

SEQ ID NO: 371421 - DNA, 25 bp, Homo sapien
gtttttgttcaagtctgattatatc

SEQ ID NO: 371422 - DNA, 25 bp, Homo sapien
ggtttgaggctaacatgtctttaat

SEQ ID NO: 371423 - DNA, 25 bp, Homo sapien
cttccctggccttactaagatgcaa

SEQ ID NO: 371424 - DNA, 25 bp, Homo sapien
ggtgttcttccagagggaattttgg

SEQ ID NO: 371425 - DNA, 25 bp, Homo sapien
aaatcttcaccaatatttctagtgt

SEQ ID NO: 371426 - DNA, 25 bp, Homo sapien
caatatttctagtgttgatggtaat

SEQ ID NO: 371427 - DNA, 25 bp, Homo sapien
aggcattttattattcagtacataa

SEQ ID NO: 371428 - DNA, 25 bp, Homo sapien
atgacaagtgggaaccatgtagctg

SEQ ID NO: 371429 - DNA, 25 bp, Homo sapien
gctgagatgtatttgtttagatgaa

SEQ ID NO: 371430 - DNA, 25 bp, Homo sapien
gatgaaaagtctacactggttctta

SEQ ID NO: 371431 - DNA, 25 bp, Homo sapien
agtctacactggttcttaatgtgaa

SEQ ID NO: 371432 - DNA, 25 bp, Homo sapien
aatcaaaccatgtatctaccttaag

SEQ ID NO: 371433 - DNA, 25 bp, Homo sapien
atagatctgagtgctgttttccttg

SEQ ID NO: 371434 - DNA, 25 bp, Homo sapien
taccttgtctttcccctaagagaat

SEQ ID NO: 371435 - DNA, 25 bp, Homo sapien
gtctttcccctaagagaatttgaag

SEQ ID NO: 371436 - DNA, 25 bp, Homo sapien
tccccaaaaccaaggagccctgcca

SEQ ID NO: 371437 - DNA, 25 bp, Homo sapien
aagcagaagtaatgtggtccacagc

SEQ ID NO: 371438 - DNA, 25 bp, Homo sapien
agcagaagtaatgtggtccacagcc

SEQ ID NO: 371439 - DNA, 25 bp, Homo sapien
gcagaagtaatgtggtccacagcca

SEQ ID NO: 371440 - DNA, 25 bp, Homo sapien
agaagtaatgtggtccacagccatg

SEQ ID NO: 371441 - DNA, 25 bp, Homo sapien
gaagtaatgtggtccacagccatgc

SEQ ID NO: 371442 - DNA, 25 bp, Homo sapien
aagtaatgtggtccacagccatgcc

SEQ ID NO: 371443 - DNA, 25 bp, Homo sapien
agtaatgtggtccacagccatgccc

SEQ ID NO: 371444 - DNA, 25 bp, Homo sapien
gtaatgtggtccacagccatgccct

SEQ ID NO: 371445 - DNA, 25 bp, Homo sapien
taatgtggtccacagccatgccctt

SEQ ID NO: 371446 - DNA, 25 bp, Homo sapien
aatgtggtccacagccatgcccttg

SEQ ID NO: 371447 - DNA, 25 bp, Homo sapien
ttgacaaccccgtctatcagaagac

SEQ ID NO: 371448 - DNA, 25 bp, Homo sapien
gaggatgaggtccacatttgccaca

SEQ ID NO: 371449 - DNA, 25 bp, Homo sapien
atttgccacaaccaggacggctaca

SEQ ID NO: 371450 - DNA, 25 bp, Homo sapien
tacagctacccctcgagacagatgg

SEQ ID NO: 371451 - DNA, 25 bp, Homo sapien
gacgtggcgtgaacatctgcctgga

SEQ ID NO: 371452 - DNA, 25 bp, Homo sapien
gacctcgccggccttgttttattca

SEQ ID NO: 371453 - DNA, 25 bp, Homo sapien
aaagcattgcctgccagagctttgt

SEQ ID NO: 371454 - DNA, 25 bp, Homo sapien
gcctgccagagctttgttttatata

SEQ ID NO: 371455 - DNA, 25 bp, Homo sapien
tcatctgggaggcagaacaggcttc

SEQ ID NO: 371456 - DNA, 25 bp, Homo sapien
gaacaggcttcggacagtgcccatg

SEQ ID NO: 371457 - DNA, 25 bp, Homo sapien
cagtgcccatgcaatggcttgggtt

SEQ ID NO: 371458 - DNA, 25 bp, Homo sapien
ccctgagcgaggacgacctgtgggc

SEQ ID NO: 371459 - DNA, 25 bp, Homo sapien
ggcccccagcacgcggggtcccact

SEQ ID NO: 371460 - DNA, 25 bp, Homo sapien
gcccccagcacgcggggtcccactg

SEQ ID NO: 371461 - DNA, 25 bp, Homo sapien
cccccagcacgcggggtcccactgt

SEQ ID NO: 371462 - DNA, 25 bp, Homo sapien
ccccagcacgcggggtcccactgtc

SEQ ID NO: 371463 - DNA, 25 bp, Homo sapien
cccagcacgcggggtcccactgtcc

SEQ ID NO: 371464 - DNA, 25 bp, Homo sapien
ccagcacgcggggtcccactgtcca

SEQ ID NO: 371465 - DNA, 25 bp, Homo sapien
gggtcccactgtccactggaggttc

SEQ ID NO: 371466 - DNA, 25 bp, Homo sapien
ggtcccactgtccactggaggttct

SEQ ID NO: 371467 - DNA, 25 bp, Homo sapien
gtcccactgtccactggaggttctg

SEQ ID NO: 371468 - DNA, 25 bp, Homo sapien
tcccactgtccactggaggttctgg

SEQ ID NO: 371469 - DNA, 25 bp, Homo sapien
ctgacccatacaggacctaaagata

SEQ ID NO: 371470 - DNA, 25 bp, Homo sapien
gcagatgaagtgatggcaaatgcat

SEQ ID NO: 371471 - DNA, 25 bp, Homo sapien
aaaatgcctgcagggctcacaggga

SEQ ID NO: 371472 - DNA, 25 bp, Homo sapien
agaggaccggaagcgattgatttgc

SEQ ID NO: 371473 - DNA, 25 bp, Homo sapien
gaagcgattgatttgctcacagaat

SEQ ID NO: 371474 - DNA, 25 bp, Homo sapien
gaatgccaggaaggctcagaaatga

SEQ ID NO: 371475 - DNA, 25 bp, Homo sapien
atgagagttccccagttccccagag

SEQ ID NO: 371476 - DNA, 25 bp, Homo sapien
ccagttccccagaggcataggtgaa

SEQ ID NO: 371477 - DNA, 25 bp, Homo sapien
agccccagaaggacttgagaaggga

SEQ ID NO: 371478 - DNA, 25 bp, Homo sapien
agaagggaagttccctattgcagct

SEQ ID NO: 371479 - DNA, 25 bp, Homo sapien
gttccctattgcagctctggcccaa

SEQ ID NO: 371480 - DNA, 25 bp, Homo sapien
ctgtggcttcagtcaattgtcttga

SEQ ID NO: 371481 - DNA, 25 bp, Homo sapien
tggcttcagtcaattgtcttgagac

SEQ ID NO: 371482 - DNA, 25 bp, Homo sapien
agaggctgaaagacaccttcccggg

SEQ ID NO: 371483 - DNA, 25 bp, Homo sapien
tgaaagacaccttcccgggtggaag

SEQ ID NO: 371484 - DNA, 25 bp, Homo sapien
tcccgggtggaagaaggagttcact

SEQ ID NO: 371485 - DNA, 25 bp, Homo sapien
ggagttcactgaaaacttatcttaa

SEQ ID NO: 371486 - DNA, 25 bp, Homo sapien
tgaaaacttatcttaaactgaccct

SEQ ID NO: 371487 - DNA, 25 bp, Homo sapien
tatcttaaactgacccttccctttg

SEQ ID NO: 371488 - DNA, 25 bp, Homo sapien
taaactgacccttccctttgagtga

SEQ ID NO: 371489 - DNA, 25 bp, Homo sapien
tgacccttccctttgagtgagtctt

SEQ ID NO: 371490 - DNA, 25 bp, Homo sapien
tccctttgagtgagtcttcattcct

SEQ ID NO: 371491 - DNA, 25 bp, Homo sapien
aataaggcactggacatcctcacgt

SEQ ID NO: 371492 - DNA, 25 bp, Homo sapien
gacatcctcacgtggagttcacagg

SEQ ID NO: 371493 - DNA, 25 bp, Homo sapien
gtggagttcacaggctcatcagtga

SEQ ID NO: 371494 - DNA, 25 bp, Homo sapien
aggctcatcagtgaattctgtacca

SEQ ID NO: 371495 - DNA, 25 bp, Homo sapien
ttctgtaccacatttcaaccttgtt

SEQ ID NO: 371496 - DNA, 25 bp, Homo sapien
acattcttagtattgcctgattatt

SEQ ID NO: 371497 - DNA, 25 bp, Homo sapien
tgcatgttgctttattggcctgtaa

SEQ ID NO: 371498 - DNA, 25 bp, Homo sapien
tggtaagatttggtctcgcaccttc

SEQ ID NO: 371499 - DNA, 25 bp, Homo sapien
cttccatctttgctaccacattaaa

SEQ ID NO: 371500 - DNA, 25 bp, Homo sapien
agcatatttctctgattgcccttat

SEQ ID NO: 371501 - DNA, 25 bp, Homo sapien
ctctgattgcccttatggagaaata

SEQ ID NO: 371502 - DNA, 25 bp, Homo sapien
cattttatggttctcttaaggaatt

SEQ ID NO: 371503 - DNA, 25 bp, Homo sapien
taatattcacttctgaaggacttac

SEQ ID NO: 371504 - DNA, 25 bp, Homo sapien
tttatcattttagccagcagggaaa

SEQ ID NO: 371505 - DNA, 25 bp, Homo sapien
taaatcatttttaatccccagaaga

SEQ ID NO: 371506 - DNA, 25 bp, Homo sapien
aaagtgctggaaatagcttctatat

SEQ ID NO: 371507 - DNA, 25 bp, Homo sapien
gaaatagcttctatatagtcagcag

SEQ ID NO: 371508 - DNA, 25 bp, Homo sapien
cttctatatagtcagcagttcacct

SEQ ID NO: 371509 - DNA, 25 bp, Homo sapien
atatagtcagcagttcacctggaga

SEQ ID NO: 371510 - DNA, 25 bp, Homo sapien
tagtcagcagttcacctggagaaag

SEQ ID NO: 371511 - DNA, 25 bp, Homo sapien
cctggagaaagatcttaattccttg

SEQ ID NO: 371512 - DNA, 25 bp, Homo sapien
ttattaccttttccctcatgaaatt

SEQ ID NO: 371513 - DNA, 25 bp, Homo sapien
gctcatgaggcatttgcaacttctc

SEQ ID NO: 371514 - DNA, 25 bp, Homo sapien
caacttctcctctctagacttcttt

SEQ ID NO: 371515 - DNA, 25 bp, Homo sapien
agacttctttctagttttcctctgt

SEQ ID NO: 371516 - DNA, 25 bp, Homo sapien
ttttcctctgttgtgtcactgcgat

SEQ ID NO: 371517 - DNA, 25 bp, Homo sapien
gtcactgcgatgtgtccagggacaa

SEQ ID NO: 371518 - DNA, 25 bp, Homo sapien
gtgtccagggacaaagccataagta

SEQ ID NO: 371519 - DNA, 25 bp, Homo sapien
acaagacctgtctgggttaaagcac

SEQ ID NO: 371520 - DNA, 25 bp, Homo sapien
gttaaagcacgaccttatgcccaag

SEQ ID NO: 371521 - DNA, 25 bp, Homo sapien
tatgcccaagcatttactctggtgc

SEQ ID NO: 371522 - DNA, 25 bp, Homo sapien
gctgaataacgcgaactactggaat

SEQ ID NO: 371523 - DNA, 25 bp, Homo sapien
attcttgctctcaaatggaccacac

SEQ ID NO: 371524 - DNA, 25 bp, Homo sapien
aaactcactgtaatcaaatcttata

SEQ ID NO: 371525 - DNA, 25 bp, Homo sapien
catgaaaagttgtcaatgcttgaat

SEQ ID NO: 371526 - DNA, 25 bp, Homo sapien
gttgtcaatgcttgaatgaatacta

SEQ ID NO: 371527 - DNA, 25 bp, Homo sapien
gaatactaaaatcataccacaagat

SEQ ID NO: 371528 - DNA, 25 bp, Homo sapien
tcataccacaagatactagataaca

SEQ ID NO: 371529 - DNA, 25 bp, Homo sapien
gatactagataacataaatgaccat

SEQ ID NO: 371530 - DNA, 25 bp, Homo sapien
tgctcaaagggcaacaactttaaga

SEQ ID NO: 371531 - DNA, 25 bp, Homo sapien
caaagagtggtggtgtggaacccaa

SEQ ID NO: 371532 - DNA, 25 bp, Homo sapien
tggtggtgtggaacccaagattctt

SEQ ID NO: 371533 - DNA, 25 bp, Homo sapien
gtggaacccaagattcttggcgact

SEQ ID NO: 371534 - DNA, 25 bp, Homo sapien
cccaagattcttggcgactagggaa

SEQ ID NO: 371535 - DNA, 25 bp, Homo sapien
ttcaaccacaaacacagtgacttag

SEQ ID NO: 371536 - DNA, 25 bp, Homo sapien
acaaacacagtgacttagcatcatc

SEQ ID NO: 371537 - DNA, 25 bp, Homo sapien
aacatgtgaacatgcctcagtcttt

SEQ ID NO: 371538 - DNA, 25 bp, Homo sapien
tgcctcagtctttggagaacttagt

SEQ ID NO: 371539 - DNA, 25 bp, Homo sapien
ggagaacttagttactgttaacctg

SEQ ID NO: 371540 - DNA, 25 bp, Homo sapien
gttactgttaacctgaatgtcacca

SEQ ID NO: 371541 - DNA, 25 bp, Homo sapien
actgttaacctgaatgtcaccaccc

SEQ ID NO: 371542 - DNA, 25 bp, Homo sapien
ttaacctgaatgtcaccacccctga

SEQ ID NO: 371543 - DNA, 25 bp, Homo sapien
tgaatgtcaccacccctgactcgga

SEQ ID NO: 371544 - DNA, 25 bp, Homo sapien
cggagactggcaccaaatggattat

SEQ ID NO: 371545 - DNA, 25 bp, Homo sapien
ggcaccaaatggattatgggttcaa

SEQ ID NO: 371546 - DNA, 25 bp, Homo sapien
caagggtaggaggcagggccgctgc

SEQ ID NO: 371547 - DNA, 25 bp, Homo sapien
gcaccttgtaattctgtcctgcctt

SEQ ID NO: 371548 - DNA, 25 bp, Homo sapien
ttgtaattctgtcctgcctttttct

SEQ ID NO: 371549 - DNA, 25 bp, Homo sapien
tgcctttttcttcctgtatttaagt

SEQ ID NO: 371550 - DNA, 25 bp, Homo sapien
accaaccaccctcactcagcctttt

SEQ ID NO: 371551 - DNA, 25 bp, Homo sapien
tccctccaggcatctctgggaaagg

SEQ ID NO: 371552 - DNA, 25 bp, Homo sapien
tccaggcatctctgggaaaggacct

SEQ ID NO: 371553 - DNA, 25 bp, Homo sapien
cccggaggagcctttgcccgcgtgt

SEQ ID NO: 371554 - DNA, 25 bp, Homo sapien
cggaggagcctttgcccgcgtgtca

SEQ ID NO: 371555 - DNA, 25 bp, Homo sapien
aggagcctttgcccgcgtgtcagac

SEQ ID NO: 371556 - DNA, 25 bp, Homo sapien
tttgcccgcgtgtcagactccatcc

SEQ ID NO: 371557 - DNA, 25 bp, Homo sapien
catctctgggaaaggacctggggct

SEQ ID NO: 371558 - DNA, 25 bp, Homo sapien
cccggaggagcctttgcccgcgtgt

SEQ ID NO: 371559 - DNA, 25 bp, Homo sapien
ccggaggagcctttgcccgcgtgtc

SEQ ID NO: 371560 - DNA, 25 bp, Homo sapien
cggaggagcctttgcccgcgtgtca

SEQ ID NO: 371561 - DNA, 25 bp, Homo sapien
ggaggagcctttgcccgcgtgtcag

SEQ ID NO: 371562 - DNA, 25 bp, Homo sapien
aggagcctttgcccgcgtgtcagac

SEQ ID NO: 371563 - DNA, 25 bp, Homo sapien
ggagcctttgcccgcgtgtcagact

SEQ ID NO: 371564 - DNA, 25 bp, Homo sapien
gcctttgcccgcgtgtcagactcca

SEQ ID NO: 371565 - DNA, 25 bp, Homo sapien
ctttgcccgcgtgtcagactccatc

SEQ ID NO: 371566 - DNA, 25 bp, Homo sapien
tttgcccgcgtgtcagactccatcc

SEQ ID NO: 371567 - DNA, 25 bp, Homo sapien
tgcccgcgtgtcagactccatccct

SEQ ID NO: 371568 - DNA, 25 bp, Homo sapien
ttctcttgtgaaattgtgctggtta

SEQ ID NO: 371569 - DNA, 25 bp, Homo sapien
gtgctggttatctttaagcttatca

SEQ ID NO: 371570 - DNA, 25 bp, Homo sapien
ctttaagcttatcagttatttgtcc

SEQ ID NO: 371571 - DNA, 25 bp, Homo sapien
gtccaattaaacacttttcaccagt

SEQ ID NO: 371572 - DNA, 25 bp, Homo sapien
tttcaccagtatttagtccgagttg

SEQ ID NO: 371573 - DNA, 25 bp, Homo sapien
gtccgagttgtacagacgatgtatt

SEQ ID NO: 371574 - DNA, 25 bp, Homo sapien
gtcatggttcatctacagactcaaa

SEQ ID NO: 371575 - DNA, 25 bp, Homo sapien
gtaccttgggagtgtgtagagtaac

SEQ ID NO: 371576 - DNA, 25 bp, Homo sapien
taatagctttatgatcctgatgatg

SEQ ID NO: 371577 - DNA, 25 bp, Homo sapien
aacacaataaagttggatcttccat

SEQ ID NO: 371578 - DNA, 25 bp, Homo sapien
ggatcttccatgttacaatcacaga

SEQ ID NO: 371579 - DNA, 25 bp, Homo sapien
taaaactatttgaccttatggagga

SEQ ID NO: 371580 - DNA, 25 bp, Homo sapien
aaactatttgaccttatggaggaag

SEQ ID NO: 371581 - DNA, 25 bp, Homo sapien
aactatttgaccttatggaggaagg

SEQ ID NO: 371582 - DNA, 25 bp, Homo sapien
actatttgaccttatggaggaaggt

SEQ ID NO: 371583 - DNA, 25 bp, Homo sapien
tttgaccttatggaggaaggtcatg

SEQ ID NO: 371584 - DNA, 25 bp, Homo sapien
ttgaccttatggaggaaggtcatgt

SEQ ID NO: 371585 - DNA, 25 bp, Homo sapien
tgaccttatggaggaaggtcatgtt

SEQ ID NO: 371586 - DNA, 25 bp, Homo sapien
gaccttatggaggaaggtcatgttt

SEQ ID NO: 371587 - DNA, 25 bp, Homo sapien
atcagttcaaccacaggaagcctct

SEQ ID NO: 371588 - DNA, 25 bp, Homo sapien
ggaagcctctaaatttagcactcta

SEQ ID NO: 371589 - DNA, 25 bp, Homo sapien
tagcactctactcacagagggccaa

SEQ ID NO: 371590 - DNA, 25 bp, Homo sapien
atgtcacaaacttaggaacttaggt

SEQ ID NO: 371591 - DNA, 25 bp, Homo sapien
gaacttaggtatctagtcttctctg

SEQ ID NO: 371592 - DNA, 25 bp, Homo sapien
tatctagtcttctctgtcattttgt

SEQ ID NO: 371593 - DNA, 25 bp, Homo sapien
aactgaggcccataggtaaaacatc

SEQ ID NO: 371594 - DNA, 25 bp, Homo sapien
aggtaaaacatctcacctccagtca

SEQ ID NO: 371595 - DNA, 25 bp, Homo sapien
ctccagtcacacaggtaagtacatg

SEQ ID NO: 371596 - DNA, 25 bp, Homo sapien
aaatctggaactgggttctgaactg

SEQ ID NO: 371597 - DNA, 25 bp, Homo sapien
tgggttccctgagaattggacatca

SEQ ID NO: 371598 - DNA, 25 bp, Homo sapien
gtagaacgccgtgtggtgaaccagc

SEQ ID NO: 371599 - DNA, 25 bp, Homo sapien
tgtggtgaaccagctggcagcagcc

SEQ ID NO: 371600 - DNA, 25 bp, Homo sapien
tggcagcagcctatgagcaggacct

SEQ ID NO: 371601 - DNA, 25 bp, Homo sapien
gggctgtactttgcgcatcacggtg

SEQ ID NO: 371602 - DNA, 25 bp, Homo sapien
tgtactttgcgcatcacggtggagg

SEQ ID NO: 371603 - DNA, 25 bp, Homo sapien
gacaagcagctactcaaaagcccag

SEQ ID NO: 371604 - DNA, 25 bp, Homo sapien
aagctgcgtctggagatcatcgaca

SEQ ID NO: 371605 - DNA, 25 bp, Homo sapien
gatcatcgacaaggacagcaagact

SEQ ID NO: 371606 - DNA, 25 bp, Homo sapien
aagactcgcagactggacatccggg

SEQ ID NO: 371607 - DNA, 25 bp, Homo sapien
cagactggacatccgggcaccactg

SEQ ID NO: 371608 - DNA, 25 bp, Homo sapien
actgcaccctgagaaggtgtgcaac

SEQ ID NO: 371609 - DNA, 25 bp, Homo sapien
taaacctttaaaagctacagacaca

SEQ ID NO: 371610 - DNA, 25 bp, Homo sapien
aacctttaaaagctacagacacaag

SEQ ID NO: 371611 - DNA, 25 bp, Homo sapien
acctttaaaagctacagacacaagt

SEQ ID NO: 371612 - DNA, 25 bp, Homo sapien
cctttaaaagctacagacacaagta

SEQ ID NO: 371613 - DNA, 25 bp, Homo sapien
ctttaaaagctacagacacaagtaa

SEQ ID NO: 371614 - DNA, 25 bp, Homo sapien
ttaaaagctacagacacaagtaatg

SEQ ID NO: 371615 - DNA, 25 bp, Homo sapien
aattatgagtcacttaaggggggag

SEQ ID NO: 371616 - DNA, 25 bp, Homo sapien
ttatgagtcacttaaggggggaggt

SEQ ID NO: 371617 - DNA, 25 bp, Homo sapien
tgagtcacttaaggggggaggtaat

SEQ ID NO: 371618 - DNA, 25 bp, Homo sapien
cacttaaggggggaggtaatatgct

SEQ ID NO: 371619 - DNA, 25 bp, Homo sapien
gagagatgggcataagtcaggaact

SEQ ID NO: 371620 - DNA, 25 bp, Homo sapien
agatgggcataagtcaggaacttgg

SEQ ID NO: 371621 - DNA, 25 bp, Homo sapien
ataagtcaggaacttgggaggacca

SEQ ID NO: 371622 - DNA, 25 bp, Homo sapien
tcccaacaaactccagaacagcaga

SEQ ID NO: 371623 - DNA, 25 bp, Homo sapien
ggtgctgtagaggagcactcagctc

SEQ ID NO: 371624 - DNA, 25 bp, Homo sapien
tgctgtagaggagcactcagctcac

SEQ ID NO: 371625 - DNA, 25 bp, Homo sapien
ctgtagaggagcactcagctcacgg

SEQ ID NO: 371626 - DNA, 25 bp, Homo sapien
agctcttggctgagcttctacaggg

SEQ ID NO: 371627 - DNA, 25 bp, Homo sapien
ctcttggctgagcttctacagggct

SEQ ID NO: 371628 - DNA, 25 bp, Homo sapien
tttggggacttcagccttccttcca

SEQ ID NO: 371629 - DNA, 25 bp, Homo sapien
gggtccagactacctgatgcccctt

SEQ ID NO: 371630 - DNA, 25 bp, Homo sapien
ctttgttgtaactgctggtcagatg

SEQ ID NO: 371631 - DNA, 25 bp, Homo sapien
actgctggtcagatggatgtagctg

SEQ ID NO: 371632 - DNA, 25 bp, Homo sapien
gtagctgactgctttggcaccagat

SEQ ID NO: 371633 - DNA, 25 bp, Homo sapien
ttggcaccagatttgcacaaggcat

SEQ ID NO: 371634 - DNA, 25 bp, Homo sapien
caaggcataaggctgctgcagaaat

SEQ ID NO: 371635 - DNA, 25 bp, Homo sapien
atctgggtccagaacggcactattt

SEQ ID NO: 371636 - DNA, 25 bp, Homo sapien
gaacggcactatttggtgtccacat

SEQ ID NO: 371637 - DNA, 25 bp, Homo sapien
tggtgtccacatggcttttgagcac

SEQ ID NO: 371638 - DNA, 25 bp, Homo sapien
gttgtcaggtgtaaaattcccactg

SEQ ID NO: 371639 - DNA, 25 bp, Homo sapien
gtagcttttgagagattctactctg

SEQ ID NO: 371640 - DNA, 25 bp, Homo sapien
attctactctgctttgttgtaactg

SEQ ID NO: 371641 - DNA, 25 bp, Homo sapien
ggatctaccaatccataccagtatg

SEQ ID NO: 371642 - DNA, 25 bp, Homo sapien
ccataccagtatgctttccttttat

SEQ ID NO: 371643 - DNA, 25 bp, Homo sapien
tattggtgtgggtgtgccccttgaa

SEQ ID NO: 371644 - DNA, 25 bp, Homo sapien
gtgtgccccttgaagagacgaccat

SEQ ID NO: 371645 - DNA, 25 bp, Homo sapien
gagacgaccatcactgtgtcaagac

SEQ ID NO: 371646 - DNA, 25 bp, Homo sapien
agacaggccaataccacttccatga

SEQ ID NO: 371647 - DNA, 25 bp, Homo sapien
ctgagaccttccactatactttctg

SEQ ID NO: 371648 - DNA, 25 bp, Homo sapien
gtcatcctgacacctgtagataatc

SEQ ID NO: 371649 - DNA, 25 bp, Homo sapien
aagctaagtttctcccaaggctgac

SEQ ID NO: 371650 - DNA, 25 bp, Homo sapien
aaggctgacattcattccctgttct

SEQ ID NO: 371651 - DNA, 25 bp, Homo sapien
acctcagctcatagcgagacacttt

SEQ ID NO: 371652 - DNA, 25 bp, Homo sapien
gaatttctaagaccatttcattctg

SEQ ID NO: 371653 - DNA, 25 bp, Homo sapien
gaccatttcattctgaaacttctta

SEQ ID NO: 371654 - DNA, 25 bp, Homo sapien
ctgaaacttcttatcaattacctaa

SEQ ID NO: 371655 - DNA, 25 bp, Homo sapien
atcaattacctaaatctcaacgaaa

SEQ ID NO: 371656 - DNA, 25 bp, Homo sapien
gaaaaacaatttactgaagccgact

SEQ ID NO: 371657 - DNA, 25 bp, Homo sapien
acaatttactgaagccgactcccct

SEQ ID NO: 371658 - DNA, 25 bp, Homo sapien
ggaggctcaggacgcgccctctgaa

SEQ ID NO: 371659 - DNA, 25 bp, Homo sapien
tttcttcttcacaagtcaccaagag

SEQ ID NO: 371660 - DNA, 25 bp, Homo sapien
aagtcaccaagagaggacatgaggg

SEQ ID NO: 371661 - DNA, 25 bp, Homo sapien
aaataaccttccacagagacaaact

SEQ ID NO: 371662 - DNA, 25 bp, Homo sapien
acagagacaaactgtccttctatcc

SEQ ID NO: 371663 - DNA, 25 bp, Homo sapien
gtgtaaacaataaacctccattcat

SEQ ID NO: 371664 - DNA, 25 bp, Homo sapien
aaacctccattcataaggtggatgt

SEQ ID NO: 371665 - DNA, 25 bp, Homo sapien
atgttgtaagcttgatggtggttgt

SEQ ID NO: 371666 - DNA, 25 bp, Homo sapien
gtgatttagctttgaccacttttca

SEQ ID NO: 371667 - DNA, 25 bp, Homo sapien
cacttttcatcctacagcttcaata

SEQ ID NO: 371668 - DNA, 25 bp, Homo sapien
agcttcaatatcaaactggttagga

SEQ ID NO: 371669 - DNA, 25 bp, Homo sapien
taatatagaagttcccctcgttcct

SEQ ID NO: 371670 - DNA, 25 bp, Homo sapien
gttcccctcgttccttgggagatga

SEQ ID NO: 371671 - DNA, 25 bp, Homo sapien
ttgggagatgatggcctttgaatat

SEQ ID NO: 371672 - DNA, 25 bp, Homo sapien
ggcctttgaatatgcagacaacctt

SEQ ID NO: 371673 - DNA, 25 bp, Homo sapien
caacctttgaattgtgcctactaaa

SEQ ID NO: 371674 - DNA, 25 bp, Homo sapien
gggcatgtacgagaccgcgctgtgg

SEQ ID NO: 371675 - DNA, 25 bp, Homo sapien
agaccgcgctgtggggttcagattt

SEQ ID NO: 371676 - DNA, 25 bp, Homo sapien
gttcagatttaggaaggacgaccgc

SEQ ID NO: 371677 - DNA, 25 bp, Homo sapien
agatttaggaaggacgaccgcgtcg

SEQ ID NO: 371678 - DNA, 25 bp, Homo sapien
tagggtctgggaggtgagctcgccc

SEQ ID NO: 371679 - DNA, 25 bp, Homo sapien
gaggacttgggaaggatccggtcct

SEQ ID NO: 371680 - DNA, 25 bp, Homo sapien
tgggaggtgagctcgcccgccgagg

SEQ ID NO: 371681 - DNA, 25 bp, Homo sapien
cgccgaggcagaactaagcgagtcg

SEQ ID NO: 371682 - DNA, 25 bp, Homo sapien
gaggcagaactaagcgagtcgcctg

SEQ ID NO: 371683 - DNA, 25 bp, Homo sapien
agaactaagcgagtcgcctggagag

SEQ ID NO: 371684 - DNA, 25 bp, Homo sapien
gaggcgtgaagggagcctgcacgtg

SEQ ID NO: 371685 - DNA, 25 bp, Homo sapien
tatcttaatagtttatttgggacca

SEQ ID NO: 371686 - DNA, 25 bp, Homo sapien
gccttttcaggaagcttgtctcata

SEQ ID NO: 371687 - DNA, 25 bp, Homo sapien
aggaagcttgtctcatattcactcc

SEQ ID NO: 371688 - DNA, 25 bp, Homo sapien
tattcactcccgagacattcacctg

SEQ ID NO: 371689 - DNA, 25 bp, Homo sapien
attcacctgccaagtggcctgagga

SEQ ID NO: 371690 - DNA, 25 bp, Homo sapien
gtggcctgaggatcaatccagtcct

SEQ ID NO: 371691 - DNA, 25 bp, Homo sapien
ggatcaatccagtcctaggtttatt

SEQ ID NO: 371692 - DNA, 25 bp, Homo sapien
aatccagtcctaggtttattttgca

SEQ ID NO: 371693 - DNA, 25 bp, Homo sapien
gttattcagcctcatatgactccac

SEQ ID NO: 371694 - DNA, 25 bp, Homo sapien
cctcatatgactccacggtcggctt

SEQ ID NO: 371695 - DNA, 25 bp, Homo sapien
ggatacaaattctcctttaaagtgt

SEQ ID NO: 371696 - DNA, 25 bp, Homo sapien
caagaagaggcatgtcagtgtcagt

SEQ ID NO: 371697 - DNA, 25 bp, Homo sapien
atgtcagtgtcagtgtgcatgccgg

SEQ ID NO: 371698 - DNA, 25 bp, Homo sapien
gtgtcagtgtgcatgccgggactct

SEQ ID NO: 371699 - DNA, 25 bp, Homo sapien
gtgcatgccgggactctgcaaagga

SEQ ID NO: 371700 - DNA, 25 bp, Homo sapien
gactctgcaaaggagcgggcatcca

SEQ ID NO: 371701 - DNA, 25 bp, Homo sapien
aggagaaagggctgctcctccccac

SEQ ID NO: 371702 - DNA, 25 bp, Homo sapien
tcctcctgtgagcaaagccgacaag

SEQ ID NO: 371703 - DNA, 25 bp, Homo sapien
gtgagcaaagccgacaagcagagac

SEQ ID NO: 371704 - DNA, 25 bp, Homo sapien
ttcagaccctcagacagaaacatta

SEQ ID NO: 371705 - DNA, 25 bp, Homo sapien
agacagaaacattaagtgccatgga

SEQ ID NO: 371706 - DNA, 25 bp, Homo sapien
gtgccatggatgtgtcagagtttct

SEQ ID NO: 371707 - DNA, 25 bp, Homo sapien
accctacctttgctgtgatggcaca

SEQ ID NO: 371708 - DNA, 25 bp, Homo sapien
tacctttgctgtgatggcacaccag

SEQ ID NO: 371709 - DNA, 25 bp, Homo sapien
ctttgctgtgatggcacaccagaat

SEQ ID NO: 371710 - DNA, 25 bp, Homo sapien
gatggcacaccagaatgaaaaccct

SEQ ID NO: 371711 - DNA, 25 bp, Homo sapien
atgaaaaccctgctgtgaggccaca

SEQ ID NO: 371712 - DNA, 25 bp, Homo sapien
ttttctcctgcacgcttcccttgat

SEQ ID NO: 371713 - DNA, 25 bp, Homo sapien
acgcttcccttgattctgctcctga

SEQ ID NO: 371714 - DNA, 25 bp, Homo sapien
tgattctgctcctgagcctatggta

SEQ ID NO: 371715 - DNA, 25 bp, Homo sapien
gctcctgagcctatggtagctgaac

SEQ ID NO: 371716 - DNA, 25 bp, Homo sapien
ctatggtagctgaacttccccaggg

SEQ ID NO: 371717 - DNA, 25 bp, Homo sapien
atggtagctgaacttccccagggcc

SEQ ID NO: 371718 - DNA, 25 bp, Homo sapien
ggtaataaacatgtgctctagctct

SEQ ID NO: 371719 - DNA, 25 bp, Homo sapien
ctctagctctgtgctagtcagctta

SEQ ID NO: 371720 - DNA, 25 bp, Homo sapien
gctagtcagcttatttcagaactct

SEQ ID NO: 371721 - DNA, 25 bp, Homo sapien
ttcagaactctagtttgattcagtt

SEQ ID NO: 371722 - DNA, 25 bp, Homo sapien
gattcagtttcttgcctctgactca

SEQ ID NO: 371723 - DNA, 25 bp, Homo sapien
ttcttgcctctgactcaaaatggag

SEQ ID NO: 371724 - DNA, 25 bp, Homo sapien
acacccacatatccttttggcagca

SEQ ID NO: 371725 - DNA, 25 bp, Homo sapien
acatatccttttggcagcagctacc

SEQ ID NO: 371726 - DNA, 25 bp, Homo sapien
gcagcagctacctgccagagatgtt

SEQ ID NO: 371727 - DNA, 25 bp, Homo sapien
gctacctgccagagatgttgaagaa

SEQ ID NO: 371728 - DNA, 25 bp, Homo sapien
agaagagtagccaacctttacacag

SEQ ID NO: 371729 - DNA, 25 bp, Homo sapien
atacataatgtgtacctataggtgt

SEQ ID NO: 371730 - DNA, 25 bp, Homo sapien
ggtgtatttataatgcctgtgtgca

SEQ ID NO: 371731 - DNA, 25 bp, Homo sapien
aatgcctgtgtgcagtatacagaca

SEQ ID NO: 371732 - DNA, 25 bp, Homo sapien
gtgtgcagtatacagacataattac

SEQ ID NO: 371733 - DNA, 25 bp, Homo sapien
ggcattcttgtaaattgaactgaca

SEQ ID NO: 371734 - DNA, 25 bp, Homo sapien
tgcttctattcagtacactttattt

SEQ ID NO: 371735 - DNA, 25 bp, Homo sapien
cagtacactttattttgagcagata

SEQ ID NO: 371736 - DNA, 25 bp, Homo sapien
tttgagcagatatttccgaaaagag

SEQ ID NO: 371737 - DNA, 25 bp, Homo sapien
gaaaaaatcactgttgacatgcttt

SEQ ID NO: 371738 - DNA, 25 bp, Homo sapien
gttgacatgctttttaaaactgttt

SEQ ID NO: 371739 - DNA, 25 bp, Homo sapien
aactcatactgtggctatcaaacag

SEQ ID NO: 371740 - DNA, 25 bp, Homo sapien
aatactacacaggagcatcactatg

SEQ ID NO: 371741 - DNA, 25 bp, Homo sapien
ggagcatcactatgcctgtgtgaaa

SEQ ID NO: 371742 - DNA, 25 bp, Homo sapien
tttacctagggttgattcctagaag

SEQ ID NO: 371743 - DNA, 25 bp, Homo sapien
aaattgccctcctgtactatttact

SEQ ID NO: 371744 - DNA, 25 bp, Homo sapien
gccctcctgtactatttactcagta

SEQ ID NO: 371745 - DNA, 25 bp, Homo sapien
ttttcttgaggttgatctgaggtct

SEQ ID NO: 371746 - DNA, 25 bp, Homo sapien
gatctgaggtctaacattgttatcc

SEQ ID NO: 371747 - DNA, 25 bp, Homo sapien
acattgttatcctatatcattttca

SEQ ID NO: 371748 - DNA, 25 bp, Homo sapien
tttcatcccaagtagtgatatctgt

SEQ ID NO: 371749 - DNA, 25 bp, Homo sapien
aatcacaggtttgatgtgtgctaat

SEQ ID NO: 371750 - DNA, 25 bp, Homo sapien
gatgtgtgctaattatgtattcttc

SEQ ID NO: 371751 - DNA, 25 bp, Homo sapien
tgggtggcgacaaagcacaggatgt

SEQ ID NO: 371752 - DNA, 25 bp, Homo sapien
cacaggatgtggtctctaccgtgat

SEQ ID NO: 371753 - DNA, 25 bp, Homo sapien
atgtggtctctaccgtgattcctga

SEQ ID NO: 371754 - DNA, 25 bp, Homo sapien
tctaccgtgattcctgagcatgcat

SEQ ID NO: 371755 - DNA, 25 bp, Homo sapien
accgtgattcctgagcatgcatgca

SEQ ID NO: 371756 - DNA, 25 bp, Homo sapien
gattcctgagcatgcatgcacccct

SEQ ID NO: 371757 - DNA, 25 bp, Homo sapien
gggtgtctttatgcctataaacttg

SEQ ID NO: 371758 - DNA, 25 bp, Homo sapien
tatgcctataaacttgccttggaat

SEQ ID NO: 371759 - DNA, 25 bp, Homo sapien
ataaacttgccttggaatccagcct

SEQ ID NO: 371760 - DNA, 25 bp, Homo sapien
tccctttcctcctggagttgagaag

SEQ ID NO: 371761 - DNA, 25 bp, Homo sapien
gaggcctccgctgcgcggattttct

SEQ ID NO: 371762 - DNA, 25 bp, Homo sapien
tggtttactacatcaccagttaaca

SEQ ID NO: 371763 - DNA, 25 bp, Homo sapien
ggtttactacatcaccagttaacat

SEQ ID NO: 371764 - DNA, 25 bp, Homo sapien
gtttactacatcaccagttaacatt

SEQ ID NO: 371765 - DNA, 25 bp, Homo sapien
tttactacatcaccagttaacattt

SEQ ID NO: 371766 - DNA, 25 bp, Homo sapien
ttactacatcaccagttaacatttt

SEQ ID NO: 371767 - DNA, 25 bp, Homo sapien
tactacatcaccagttaacatttta

SEQ ID NO: 371768 - DNA, 25 bp, Homo sapien
actacatcaccagttaacattttat

SEQ ID NO: 371769 - DNA, 25 bp, Homo sapien
ctacatcaccagttaacattttata

SEQ ID NO: 371770 - DNA, 25 bp, Homo sapien
tacatcaccagttaacattttatat

SEQ ID NO: 371771 - DNA, 25 bp, Homo sapien
acatcaccagttaacattttatatt

SEQ ID NO: 371772 - DNA, 25 bp, Homo sapien
gaaacccagaaagtccactccagaa

SEQ ID NO: 371773 - DNA, 25 bp, Homo sapien
gaaacctttagactcagaaacagct

SEQ ID NO: 371774 - DNA, 25 bp, Homo sapien
aagaacaggcacaacttcttctccg

SEQ ID NO: 371775 - DNA, 25 bp, Homo sapien
ttcttctccgtctgggtggcaaaca

SEQ ID NO: 371776 - DNA, 25 bp, Homo sapien
gcaaacagctttgccagagactgta

SEQ ID NO: 371777 - DNA, 25 bp, Homo sapien
gctgagccccgtgggtgaaagcaca

SEQ ID NO: 371778 - DNA, 25 bp, Homo sapien
aaagcacacgccttgtagacagcga

SEQ ID NO: 371779 - DNA, 25 bp, Homo sapien
tagacagcgaagtggcccggaagac

SEQ ID NO: 371780 - DNA, 25 bp, Homo sapien
ggaagacggtctcccttaacagcag

SEQ ID NO: 371781 - DNA, 25 bp, Homo sapien
ccgggtgcacacaaaggctggcgcc

SEQ ID NO: 371782 - DNA, 25 bp, Homo sapien
gtgtggactggacccgaaacccaga

SEQ ID NO: 371783 - DNA, 25 bp, Homo sapien
accactgtgtagattataatatccc

SEQ ID NO: 371784 - DNA, 25 bp, Homo sapien
atatccctaatttggattagttttg

SEQ ID NO: 371785 - DNA, 25 bp, Homo sapien
tggattagttttgtactttgtgttg

SEQ ID NO: 371786 - DNA, 25 bp, Homo sapien
gtactttgtgttgagtttgtgatgc

SEQ ID NO: 371787 - DNA, 25 bp, Homo sapien
ctttgtgttgagtttgtgatgctaa

SEQ ID NO: 371788 - DNA, 25 bp, Homo sapien
gtgttgagtttgtgatgctaaaagt

SEQ ID NO: 371789 - DNA, 25 bp, Homo sapien
actaaatcacattgtaccaaagctg

SEQ ID NO: 371790 - DNA, 25 bp, Homo sapien
aatcacattgtaccaaagctgtaat

SEQ ID NO: 371791 - DNA, 25 bp, Homo sapien
cattgtaccaaagctgtaatggaaa

SEQ ID NO: 371792 - DNA, 25 bp, Homo sapien
atatatactgtattgtagtgtttaa

SEQ ID NO: 371793 - DNA, 25 bp, Homo sapien
taaaactatttgaccttatggagga

SEQ ID NO: 371794 - DNA, 25 bp, Homo sapien
aatctgtggaccagtatttcagctt

SEQ ID NO: 371795 - DNA, 25 bp, Homo sapien
atctgtggaccagtatttcagcttt

SEQ ID NO: 371796 - DNA, 25 bp, Homo sapien
tctgtggaccagtatttcagctttc

SEQ ID NO: 371797 - DNA, 25 bp, Homo sapien
ctgtggaccagtatttcagctttcc

SEQ ID NO: 371798 - DNA, 25 bp, Homo sapien
tgtggaccagtatttcagctttccc

SEQ ID NO: 371799 - DNA, 25 bp, Homo sapien
gtggaccagtatttcagctttccct

SEQ ID NO: 371800 - DNA, 25 bp, Homo sapien
tggaccagtatttcagctttccctg

SEQ ID NO: 371801 - DNA, 25 bp, Homo sapien
ggaccagtatttcagctttccctga

SEQ ID NO: 371802 - DNA, 25 bp, Homo sapien
gaccagtatttcagctttccctgaa

SEQ ID NO: 371803 - DNA, 25 bp, Homo sapien
accagtatttcagctttccctgaag

SEQ ID NO: 371804 - DNA, 25 bp, Homo sapien
cagtatttcagctttccctgaagat

SEQ ID NO: 371805 - DNA, 25 bp, Homo sapien
gtcacgaaggcagatgggttgaact

SEQ ID NO: 371806 - DNA, 25 bp, Homo sapien
actaagacaggaacacccgccgtgg

SEQ ID NO: 371807 - DNA, 25 bp, Homo sapien
gcaccggttcctggcatggaggcac

SEQ ID NO: 371808 - DNA, 25 bp, Homo sapien
atggaggcacccaaggtcttaggag

SEQ ID NO: 371809 - DNA, 25 bp, Homo sapien
ggatggactgtcacatgggcaaaga

SEQ ID NO: 371810 - DNA, 25 bp, Homo sapien
gcaggactgcaaaggccacagaaga

SEQ ID NO: 371811 - DNA, 25 bp, Homo sapien
gagagacaacccatgagaagtcact

SEQ ID NO: 371812 - DNA, 25 bp, Homo sapien
agaagtcactcagaccagggtcaga

SEQ ID NO: 371813 - DNA, 25 bp, Homo sapien
gatagaggactgtggtcgaaccaag

SEQ ID NO: 371814 - DNA, 25 bp, Homo sapien
ggaggttcaactgtgacttatgcca

SEQ ID NO: 371815 - DNA, 25 bp, Homo sapien
gacttatgccagtgtggtcacgaag

SEQ ID NO: 371816 - DNA, 25 bp, Homo sapien
tagtggctcagtttgctggagatgc

SEQ ID NO: 371817 - DNA, 25 bp, Homo sapien
ttggaactaacccaccagatcttag

SEQ ID NO: 371818 - DNA, 25 bp, Homo sapien
gaagatgtacacgtgcttctttcct

SEQ ID NO: 371819 - DNA, 25 bp, Homo sapien
tttttcctactctacctggctagtc

SEQ ID NO: 371820 - DNA, 25 bp, Homo sapien
ctacctggctagtctttagatatgt

SEQ ID NO: 371821 - DNA, 25 bp, Homo sapien
atgtttttcttcgtatgtggtgttt

SEQ ID NO: 371822 - DNA, 25 bp, Homo sapien
gtggtgtttatacatttcacatgaa

SEQ ID NO: 371823 - DNA, 25 bp, Homo sapien
agatgcgcagtgtctgcctcagcag

SEQ ID NO: 371824 - DNA, 25 bp, Homo sapien
gcagtctcagcagtttctaactaaa

SEQ ID NO: 371825 - DNA, 25 bp, Homo sapien
taaagctgactttagttagaccgaa

SEQ ID NO: 371826 - DNA, 25 bp, Homo sapien
gttagaccgaaaccgaacacatggc

SEQ ID NO: 371827 - DNA, 25 bp, Homo sapien
cggccgcacagggttttataggatc

SEQ ID NO: 371828 - DNA, 25 bp, Homo sapien
cgcacagggttttataggatcacat

SEQ ID NO: 371829 - DNA, 25 bp, Homo sapien
agggttttataggatcacattgaca

SEQ ID NO: 371830 - DNA, 25 bp, Homo sapien
gatcacattgacaaaagtaccatgg

SEQ ID NO: 371831 - DNA, 25 bp, Homo sapien
accatggagttttatgagtcagcat

SEQ ID NO: 371832 - DNA, 25 bp, Homo sapien
gagttttatgagtcagcatatttta

SEQ ID NO: 371833 - DNA, 25 bp, Homo sapien
tattacagtaattttcctcttcttc

SEQ ID NO: 371834 - DNA, 25 bp, Homo sapien
tcctcttcttctggcttttcatgaa

SEQ ID NO: 371835 - DNA, 25 bp, Homo sapien
tcttctggcttttcatgaaagaaac

SEQ ID NO: 371836 - DNA, 25 bp, Homo sapien
atatgatgaagttcttgcaaaacag

SEQ ID NO: 371837 - DNA, 25 bp, Homo sapien
agcttattcctaccaaaacagataa

SEQ ID NO: 371838 - DNA, 25 bp, Homo sapien
aggacttaccagactgctgcttttg

SEQ ID NO: 371839 - DNA, 25 bp, Homo sapien
ttttgggcatcatctgctgggttga

SEQ ID NO: 371840 - DNA, 25 bp, Homo sapien
atttggtttggccaagagtcttgcc

SEQ ID NO: 371841 - DNA, 25 bp, Homo sapien
gactttaatctatgcctcttgttct

SEQ ID NO: 371842 - DNA, 25 bp, Homo sapien
gcctcttgttctacatgaattcttg

SEQ ID NO: 371843 - DNA, 25 bp, Homo sapien
gaattactcacgttccataggaaga

SEQ ID NO: 371844 - DNA, 25 bp, Homo sapien
agtgcatccccaggtgatggttttt

SEQ ID NO: 371845 - DNA, 25 bp, Homo sapien
gttatggtatgatcctttcacaccg

SEQ ID NO: 371846 - DNA, 25 bp, Homo sapien
cagacctggattaatgcttccaaag

SEQ ID NO: 371847 - DNA, 25 bp, Homo sapien
gaaggaccttggcacctaaactgac

SEQ ID NO: 371848 - DNA, 25 bp, Homo sapien
gcaccccacaggagtaactcatcag

SEQ ID NO: 371849 - DNA, 25 bp, Homo sapien
agagtatttctctattgctgaatac

SEQ ID NO: 371850 - DNA, 25 bp, Homo sapien
atttctctattgctgaatacttaag

SEQ ID NO: 371851 - DNA, 25 bp, Homo sapien
ctctattgctgaatacttaagtagt

SEQ ID NO: 371852 - DNA, 25 bp, Homo sapien
ttattatgataaattcctgggaggg

SEQ ID NO: 371853 - DNA, 25 bp, Homo sapien
aactttatgacttatgtttgcctta

SEQ ID NO: 371854 - DNA, 25 bp, Homo sapien
tatgacttatgtttgccttattgca

SEQ ID NO: 371855 - DNA, 25 bp, Homo sapien
tatgtttgccttattgcattcccaa

SEQ ID NO: 371856 - DNA, 25 bp, Homo sapien
tgtttgccttattgcattcccaaag

SEQ ID NO: 371857 - DNA, 25 bp, Homo sapien
gcattcccaaagagttgtaacattt

SEQ ID NO: 371858 - DNA, 25 bp, Homo sapien
acattttacagtgttaccatttgag

SEQ ID NO: 371859 - DNA, 25 bp, Homo sapien
ttacagtgttaccatttgagtaggg

SEQ ID NO: 371860 - DNA, 25 bp, Homo sapien
ggcatgtgacttttgtgttaaggca

SEQ ID NO: 371861 - DNA, 25 bp, Homo sapien
gttaaggcagtttacccatcttggc

SEQ ID NO: 371862 - DNA, 25 bp, Homo sapien
agtttacccatcttggctgatgtgg

SEQ ID NO: 371863 - DNA, 25 bp, Homo sapien
gcaaacttccagtagaatcccggtc

SEQ ID NO: 371864 - DNA, 25 bp, Homo sapien
tagaatcccggtcttttcatccaag

SEQ ID NO: 371865 - DNA, 25 bp, Homo sapien
tcttttcatccaagtgcttgcaggg

SEQ ID NO: 371866 - DNA, 25 bp, Homo sapien
gcagaaaccaaagagcttgcttttt

SEQ ID NO: 371867 - DNA, 25 bp, Homo sapien
ttgtctttgtaattccttagggtct

SEQ ID NO: 371868 - DNA, 25 bp, Homo sapien
gtctgtgatatatgccaggaaatct

SEQ ID NO: 371869 - DNA, 25 bp, Homo sapien
actaatatgctttttattctcccat

SEQ ID NO: 371870 - DNA, 25 bp, Homo sapien
attctcccattattccctaaattgt

SEQ ID NO: 371871 - DNA, 25 bp, Homo sapien
tttaatttctagactttccaaagct

SEQ ID NO: 371872 - DNA, 25 bp, Homo sapien
aaaagcccattgtcaactctcttag

SEQ ID NO: 371873 - DNA, 25 bp, Homo sapien
gtcaactctcttagaacttcatcaa

SEQ ID NO: 371874 - DNA, 25 bp, Homo sapien
gtgtctgaccttctttctttttgtg

SEQ ID NO: 371875 - DNA, 25 bp, Homo sapien
tttctttttgtgtgttggtgcctca

SEQ ID NO: 371876 - DNA, 25 bp, Homo sapien
tggtgcctcagatgtatcatgtgct

SEQ ID NO: 371877 - DNA, 25 bp, Homo sapien
atgtgctgcttgaactgattctcta

SEQ ID NO: 371878 - DNA, 25 bp, Homo sapien
tgattctctacagtgttccttccta

SEQ ID NO: 371879 - DNA, 25 bp, Homo sapien
ttccttcctagtctcaagctgatga

SEQ ID NO: 371880 - DNA, 25 bp, Homo sapien
gtctcaagctgatgatgtgctcaaa

SEQ ID NO: 371881 - DNA, 25 bp, Homo sapien
aatccatgtaatgacaccttttaga

SEQ ID NO: 371882 - DNA, 25 bp, Homo sapien
gctgctgtgagatggaattccagga

SEQ ID NO: 371883 - DNA, 25 bp, Homo sapien
aacttcaggtgtctggaccctttct

SEQ ID NO: 371884 - DNA, 25 bp, Homo sapien
gtctggaccctttctatctagataa

SEQ ID NO: 371885 - DNA, 25 bp, Homo sapien
atttttagattcttctgctccctag

SEQ ID NO: 371886 - DNA, 25 bp, Homo sapien
tttagattcttctgctccctagtga

SEQ ID NO: 371887 - DNA, 25 bp, Homo sapien
gattcttctgctccctagtgaccta

SEQ ID NO: 371888 - DNA, 25 bp, Homo sapien
tctgctccctagtgacctacctggg

SEQ ID NO: 371889 - DNA, 25 bp, Homo sapien
aaacaaaagcatcttccctagaaat

SEQ ID NO: 371890 - DNA, 25 bp, Homo sapien
agcatcttccctagaaatttttgtg

SEQ ID NO: 371891 - DNA, 25 bp, Homo sapien
tgtgaattgtttgcacttgtgcctg

SEQ ID NO: 371892 - DNA, 25 bp, Homo sapien
ttgtttgcacttgtgcctgttttaa

SEQ ID NO: 371893 - DNA, 25 bp, Homo sapien
acaccaaagcaggacacgccatttt

SEQ ID NO: 371894 - DNA, 25 bp, Homo sapien
agcaggacacgccattttccactga

SEQ ID NO: 371895 - DNA, 25 bp, Homo sapien
caccctataccctgaggaaagggag

SEQ ID NO: 371896 - DNA, 25 bp, Homo sapien
gaaagggagactttcctccgatgtt

SEQ ID NO: 371897 - DNA, 25 bp, Homo sapien
gactttcctccgatgtttatttagc

SEQ ID NO: 371898 - DNA, 25 bp, Homo sapien
tccgatgtttatttagctgttgcaa

SEQ ID NO: 371899 - DNA, 25 bp, Homo sapien
tagctgttgcaaacatcttcaccct

SEQ ID NO: 371900 - DNA, 25 bp, Homo sapien
tgcaaacatcttcaccctaatagtc

SEQ ID NO: 371901 - DNA, 25 bp, Homo sapien
aattccagccacttgtcaggctctc

SEQ ID NO: 371902 - DNA, 25 bp, Homo sapien
tctcctcttgaccactgtgttatgg

SEQ ID NO: 371903 - DNA, 25 bp, Homo sapien
tgggcactcatgctccacaccaaag

SEQ ID NO: 371904 - DNA, 25 bp, Homo sapien
ctttcccctagatccagaaataaag

SEQ ID NO: 371905 - DNA, 25 bp, Homo sapien
aagcgcaggttctgtttgtagtgtc

SEQ ID NO: 371906 - DNA, 25 bp, Homo sapien
gcaggttctgtttgtagtgtcctcc

SEQ ID NO: 371907 - DNA, 25 bp, Homo sapien
tctgtttgtagtgtcctccttgctt

SEQ ID NO: 371908 - DNA, 25 bp, Homo sapien
tgcttccccttccattcaagagatt

SEQ ID NO: 371909 - DNA, 25 bp, Homo sapien
aagagattccagcaaatggctttcc

SEQ ID NO: 371910 - DNA, 25 bp, Homo sapien
aatggctttccctccatgggtcgca

SEQ ID NO: 371911 - DNA, 25 bp, Homo sapien
atgggtcgcatttccctatctggga

SEQ ID NO: 371912 - DNA, 25 bp, Homo sapien
ccctatctgggaaatgcgagctttg

SEQ ID NO: 371913 - DNA, 25 bp, Homo sapien
atgcgagctttgaccaggagggcca

SEQ ID NO: 371914 - DNA, 25 bp, Homo sapien
accaggagggccacagagtttcaga

SEQ ID NO: 371915 - DNA, 25 bp, Homo sapien
ggtctcctgggcttggtcactgtct

SEQ ID NO: 371916 - DNA, 25 bp, Homo sapien
tgggcttggtcactgtctctcacca

SEQ ID NO: 371917 - DNA, 25 bp, Homo sapien
gtctctcaccagcatgtttctttgt

SEQ ID NO: 371918 - DNA, 25 bp, Homo sapien
accagcatgtttctttgtgcggtca

SEQ ID NO: 371919 - DNA, 25 bp, Homo sapien
gcatgtttctttgtgcggtcaggaa

SEQ ID NO: 371920 - DNA, 25 bp, Homo sapien
ctttgtgcggtcaggaattatttcc

SEQ ID NO: 371921 - DNA, 25 bp, Homo sapien
attatttccaaatgctcctgaagcc

SEQ ID NO: 371922 - DNA, 25 bp, Homo sapien
aaatgctcctgaagcctagtgtttt

SEQ ID NO: 371923 - DNA, 25 bp, Homo sapien
gctcctgaagcctagtgttttagtg

SEQ ID NO: 371924 - DNA, 25 bp, Homo sapien
agcctagtgttttagtgaacattag

SEQ ID NO: 371925 - DNA, 25 bp, Homo sapien
cattagtgattgttagcagtggttc

SEQ ID NO: 371926 - DNA, 25 bp, Homo sapien
tacacctgctacaccttactgacaa

SEQ ID NO: 371927 - DNA, 25 bp, Homo sapien
cctgctacaccttactgacaaaact

SEQ ID NO: 371928 - DNA, 25 bp, Homo sapien
aaaactgggcagctgaaaataaaag

SEQ ID NO: 371929 - DNA, 25 bp, Homo sapien
ataaattctattccactgtaagaag

SEQ ID NO: 371930 - DNA, 25 bp, Homo sapien
tattccactgtaagaagttgatttc

SEQ ID NO: 371931 - DNA, 25 bp, Homo sapien
gatttcttttcagctttctttgtat

SEQ ID NO: 371932 - DNA, 25 bp, Homo sapien
cttttcagctttctttgtatatcag

SEQ ID NO: 371933 - DNA, 25 bp, Homo sapien
tcagctttctttgtatatcagtaaa

SEQ ID NO: 371934 - DNA, 25 bp, Homo sapien
aagtctgataagtatggatagcatg

SEQ ID NO: 371935 - DNA, 25 bp, Homo sapien
ggatagcatgttacctaagctttta

SEQ ID NO: 371936 - DNA, 25 bp, Homo sapien
gcatgttacctaagcttttaatttg

SEQ ID NO: 371937 - DNA, 25 bp, Homo sapien
gaagccatgcagtgacacccgctaa

SEQ ID NO: 371938 - DNA, 25 bp, Homo sapien
agtgacacccgctaagacttgttgg

SEQ ID NO: 371939 - DNA, 25 bp, Homo sapien
gacttgttggtagccatgtcggagc

SEQ ID NO: 371940 - DNA, 25 bp, Homo sapien
atgtcggagccccacagggtccagt

SEQ ID NO: 371941 - DNA, 25 bp, Homo sapien
tgaatcctgcgtttttgaagaagtc

SEQ ID NO: 371942 - DNA, 25 bp, Homo sapien
gcagcagctgttcggattacactca

SEQ ID NO: 371943 - DNA, 25 bp, Homo sapien
attacactcaccctctttgaaccag

SEQ ID NO: 371944 - DNA, 25 bp, Homo sapien
ttgaaccagatcacaaacgctgccc

SEQ ID NO: 371945 - DNA, 25 bp, Homo sapien
acaaacgctgcccagagttcttcta

SEQ ID NO: 371946 - DNA, 25 bp, Homo sapien
agagttcttctacccagagctggtg

SEQ ID NO: 371947 - DNA, 25 bp, Homo sapien
gggaaggtaaaaggccttcagcctg

SEQ ID NO: 371948 - DNA, 25 bp, Homo sapien
tcttccccaggatgccgagacacaa

SEQ ID NO: 371949 - DNA, 25 bp, Homo sapien
gagacacaactacagccgggtggcc

SEQ ID NO: 371950 - DNA, 25 bp, Homo sapien
tggtcaagtcgctgtgtgccaagca

SEQ ID NO: 371951 - DNA, 25 bp, Homo sapien
aagcacggcctcagctacgaagtga

SEQ ID NO: 371952 - DNA, 25 bp, Homo sapien
aagccactggttcgtgtggatcaca

SEQ ID NO: 371953 - DNA, 25 bp, Homo sapien
gatgaaccacatccccaaggagatc

SEQ ID NO: 371954 - DNA, 25 bp, Homo sapien
aaggagatcggccacgagaagcacc

SEQ ID NO: 371955 - DNA, 25 bp, Homo sapien
agaagcaccgggactgggtcagctc

SEQ ID NO: 371956 - DNA, 25 bp, Homo sapien
gactgggtcagctctcagctggcag

SEQ ID NO: 371957 - DNA, 25 bp, Homo sapien
aacgtggagccctcacttttcacca

SEQ ID NO: 371958 - DNA, 25 bp, Homo sapien
ttttcaccaactggttcagcgggca

SEQ ID NO: 371959 - DNA, 25 bp, Homo sapien
cctttggagttggtgcttgaaggca

SEQ ID NO: 371960 - DNA, 25 bp, Homo sapien
gtgtgaatgcctgaggcccgttctt

SEQ ID NO: 371961 - DNA, 25 bp, Homo sapien
cgagtcagcttctatctcagcaagg

SEQ ID NO: 371962 - DNA, 25 bp, Homo sapien
ccgttcttcctgaacattcttggat

SEQ ID NO: 371963 - DNA, 25 bp, Homo sapien
tcagcttctatctcagcaagggcct

SEQ ID NO: 371964 - DNA, 25 bp, Homo sapien
ggcacattctccatcaactatgttt

SEQ ID NO: 371965 - DNA, 25 bp, Homo sapien
aactatgtttaagcatttcatcctg

SEQ ID NO: 371966 - DNA, 25 bp, Homo sapien
tggcagtcgctgcttttttctggac

SEQ ID NO: 371967 - DNA, 25 bp, Homo sapien
tcgctgcttttttctggacatcagt

SEQ ID NO: 371968 - DNA, 25 bp, Homo sapien
ggacatcagttcttgattccttcca

SEQ ID NO: 371969 - DNA, 25 bp, Homo sapien
agttcttgattccttccatctccag

SEQ ID NO: 371970 - DNA, 25 bp, Homo sapien
aacatagcgggaccccctgtctctt

SEQ ID NO: 371971 - DNA, 25 bp, Homo sapien
tagcgggaccccctgtctcttcaaa

SEQ ID NO: 371972 - DNA, 25 bp, Homo sapien
tggcgcaggctctgtagtcccagat

SEQ ID NO: 371973 - DNA, 25 bp, Homo sapien
ggcgcaggctctgtagtcccagata

SEQ ID NO: 371974 - DNA, 25 bp, Homo sapien
aaatctgtgaggttaaaaggctgtg

SEQ ID NO: 371975 - DNA, 25 bp, Homo sapien
aatctgtgaggttaaaaggctgtgt

SEQ ID NO: 371976 - DNA, 25 bp, Homo sapien
tctgtgaggttaaaaggctgtgtgt

SEQ ID NO: 371977 - DNA, 25 bp, Homo sapien
ggctgtgtgtgtgaaaatatcttgg

SEQ ID NO: 371978 - DNA, 25 bp, Homo sapien
gctgtgtgtgtgaaaatatcttgga

SEQ ID NO: 371979 - DNA, 25 bp, Homo sapien
ctgtgtgtgtgaaaatatcttggaa

SEQ ID NO: 371980 - DNA, 25 bp, Homo sapien
gtgtgtgaaaatatcttggaaattg

SEQ ID NO: 371981 - DNA, 25 bp, Homo sapien
atttccagtggtgtggcctgaaaac

SEQ ID NO: 371982 - DNA, 25 bp, Homo sapien
aaagaataacctaggctgctggaaa

SEQ ID NO: 371983 - DNA, 25 bp, Homo sapien
tgctggaaagcacccttttggttgt

SEQ ID NO: 371984 - DNA, 25 bp, Homo sapien
gtagattgaactttgttctctgctt

SEQ ID NO: 371985 - DNA, 25 bp, Homo sapien
tgaactttgttctctgctttctttt

SEQ ID NO: 371986 - DNA, 25 bp, Homo sapien
cttggaaagagaggacttagcttta

SEQ ID NO: 371987 - DNA, 25 bp, Homo sapien
cttagctttaagtcagcactgattt

SEQ ID NO: 371988 - DNA, 25 bp, Homo sapien
gcactgatttgggactgttcctaag

SEQ ID NO: 371989 - DNA, 25 bp, Homo sapien
gatttgggactgttcctaaggcata

SEQ ID NO: 371990 - DNA, 25 bp, Homo sapien
gggactgttcctaaggcatatcagt

SEQ ID NO: 371991 - DNA, 25 bp, Homo sapien
cagtgcttcattgtcattgtgtttt

SEQ ID NO: 371992 - DNA, 25 bp, Homo sapien
ttaaaagtgatcttgaggaatgctt

SEQ ID NO: 371993 - DNA, 25 bp, Homo sapien
agggaagcatggtccagccctgtta

SEQ ID NO: 371994 - DNA, 25 bp, Homo sapien
gctttgttgatcttgaattaataat

SEQ ID NO: 371995 - DNA, 25 bp, Homo sapien
gaagcatggtccagccctgttatcc

SEQ ID NO: 371996 - DNA, 25 bp, Homo sapien
aaatgcagaatatttcagttttgaa

SEQ ID NO: 371997 - DNA, 25 bp, Homo sapien
tcttacaactacaaaccccttcata

SEQ ID NO: 371998 - DNA, 25 bp, Homo sapien
cttcatagtctccatccattcagaa

SEQ ID NO: 371999 - DNA, 25 bp, Homo sapien
cctgttatcccccaaaaggacacat

SEQ ID NO: 372000 - DNA, 25 bp, Homo sapien
ggacacatacaaagctcagttcttg

SEQ ID NO: 372001 - DNA, 25 bp, Homo sapien
tcagttcttgagctgtgcttatgca

SEQ ID NO: 372002 - DNA, 25 bp, Homo sapien
gtgcttatgcaatactatagtgatc

SEQ ID NO: 372003 - DNA, 25 bp, Homo sapien
agcaggagctcccaagtgccggcca

SEQ ID NO: 372004 - DNA, 25 bp, Homo sapien
gcaggagctcccaagtgccggccac

SEQ ID NO: 372005 - DNA, 25 bp, Homo sapien
aggagctcccaagtgccggccaccg

SEQ ID NO: 372006 - DNA, 25 bp, Homo sapien
ggagctcccaagtgccggccaccgc

SEQ ID NO: 372007 - DNA, 25 bp, Homo sapien
gagctcccaagtgccggccaccgct

SEQ ID NO: 372008 - DNA, 25 bp, Homo sapien
ggccaccgctgtcagggattgccca

SEQ ID NO: 372009 - DNA, 25 bp, Homo sapien
gccaccgctgtcagggattgcccac

SEQ ID NO: 372010 - DNA, 25 bp, Homo sapien
gctgtcagggattgcccacccctgg

SEQ ID NO: 372011 - DNA, 25 bp, Homo sapien
ctgtcagggattgcccacccctggg

SEQ ID NO: 372012 - DNA, 25 bp, Homo sapien
tgtcagggattgcccacccctgggc

SEQ ID NO: 372013 - DNA, 25 bp, Homo sapien
tcagggattgcccacccctgggcat

SEQ ID NO: 372014 - DNA, 25 bp, Homo sapien
aaatagccagcctatggaccacatt

SEQ ID NO: 372015 - DNA, 25 bp, Homo sapien
aatagccagcctatggaccacattt

SEQ ID NO: 372016 - DNA, 25 bp, Homo sapien
atagccagcctatggaccacatttg

SEQ ID NO: 372017 - DNA, 25 bp, Homo sapien
tagccagcctatggaccacatttga

SEQ ID NO: 372018 - DNA, 25 bp, Homo sapien
gccagcctatggaccacatttgact

SEQ ID NO: 372019 - DNA, 25 bp, Homo sapien
cagcctatggaccacatttgactaa

SEQ ID NO: 372020 - DNA, 25 bp, Homo sapien
gcctatggaccacatttgactaagt

SEQ ID NO: 372021 - DNA, 25 bp, Homo sapien
tatggaccacatttgactaagttca

SEQ ID NO: 372022 - DNA, 25 bp, Homo sapien
ggaccacatttgactaagttcaaac

SEQ ID NO: 372023 - DNA, 25 bp, Homo sapien
gaagataacataagccagatgcctt

SEQ ID NO: 372024 - DNA, 25 bp, Homo sapien
tactagccatacaaagaggcaggaa

SEQ ID NO: 372025 - DNA, 25 bp, Homo sapien
gcattgtctactgaaaagctgtggc

SEQ ID NO: 372026 - DNA, 25 bp, Homo sapien
agctgtggcagcgagtggtattatt

SEQ ID NO: 372027 - DNA, 25 bp, Homo sapien
ggtattattgaccatgtgttctcat

SEQ ID NO: 372028 - DNA, 25 bp, Homo sapien
tgtagtgtccatttaatatctgcat

SEQ ID NO: 372029 - DNA, 25 bp, Homo sapien
tatctgcatgtgtgtttaatctctg

SEQ ID NO: 372030 - DNA, 25 bp, Homo sapien
gtgtttaatctctgaataccatgta

SEQ ID NO: 372031 - DNA, 25 bp, Homo sapien
aatgaagcaattgtctccctcttct

SEQ ID NO: 372032 - DNA, 25 bp, Homo sapien
tgtctccctcttcttaactggaaat

SEQ ID NO: 372033 - DNA, 25 bp, Homo sapien
tcacacttgtgaggtatggtatcca

SEQ ID NO: 372034 - DNA, 25 bp, Homo sapien
gtatggtatccattatcaacagtgg

SEQ ID NO: 372035 - DNA, 25 bp, Homo sapien
aacagtggattcatgattgacttca

SEQ ID NO: 372036 - DNA, 25 bp, Homo sapien
ttcccttacctctgtcgacctgtga

SEQ ID NO: 372037 - DNA, 25 bp, Homo sapien
ttacctctgtcgacctgtgaaactg

SEQ ID NO: 372038 - DNA, 25 bp, Homo sapien
tacctctgtcgacctgtgaaactga

SEQ ID NO: 372039 - DNA, 25 bp, Homo sapien
acctctgtcgacctgtgaaactgaa

SEQ ID NO: 372040 - DNA, 25 bp, Homo sapien
cctctgtcgacctgtgaaactgaac

SEQ ID NO: 372041 - DNA, 25 bp, Homo sapien
tgtgaaactgaacaaacagcttatc

SEQ ID NO: 372042 - DNA, 25 bp, Homo sapien
gcccctaatgtgaaatgatgggaca

SEQ ID NO: 372043 - DNA, 25 bp, Homo sapien
cctaatgtgaaatgatgggacagac

SEQ ID NO: 372044 - DNA, 25 bp, Homo sapien
aatccagcaggagtttcttagttag

SEQ ID NO: 372045 - DNA, 25 bp, Homo sapien
gcaggagtttcttagttaggatcca

SEQ ID NO: 372046 - DNA, 25 bp, Homo sapien
aggagtttcttagttaggatccaca

SEQ ID NO: 372047 - DNA, 25 bp, Homo sapien
aattgttgggtgtgcccatatacat

SEQ ID NO: 372048 - DNA, 25 bp, Homo sapien
attctaccgagaggacataaatgca

SEQ ID NO: 372049 - DNA, 25 bp, Homo sapien
ggacataaatgcagtcacagctcag

SEQ ID NO: 372050 - DNA, 25 bp, Homo sapien
cataaatgcagtcacagctcagtaa

SEQ ID NO: 372051 - DNA, 25 bp, Homo sapien
ggaccagggatgattcctagtcgga

SEQ ID NO: 372052 - DNA, 25 bp, Homo sapien
cagggatgattcctagtcggagatt

SEQ ID NO: 372053 - DNA, 25 bp, Homo sapien
gatgattcctagtcggagattggga

SEQ ID NO: 372054 - DNA, 25 bp, Homo sapien
attcctagtcggagattgggagaaa

SEQ ID NO: 372055 - DNA, 25 bp, Homo sapien
gaagatgagcctgaatcatttcatg

SEQ ID NO: 372056 - DNA, 25 bp, Homo sapien
gagcctgaatcatttcatgtaccta

SEQ ID NO: 372057 - DNA, 25 bp, Homo sapien
gcctgaatcatttcatgtacctaac

SEQ ID NO: 372058 - DNA, 25 bp, Homo sapien
aagcttgggactctcgtctgcactg

SEQ ID NO: 372059 - DNA, 25 bp, Homo sapien
ctgcactgcgtgtcctctgaagcag

SEQ ID NO: 372060 - DNA, 25 bp, Homo sapien
agtgaagtctgtgcctatgccgagc

SEQ ID NO: 372061 - DNA, 25 bp, Homo sapien
atgccgagcgcgctaagaagtctcc

SEQ ID NO: 372062 - DNA, 25 bp, Homo sapien
ggtctctgagcaaaggagcatgctt

SEQ ID NO: 372063 - DNA, 25 bp, Homo sapien
caccaccagcgtaactggcaagtta

SEQ ID NO: 372064 - DNA, 25 bp, Homo sapien
ttaccaaggttgttcctgaaacagc

SEQ ID NO: 372065 - DNA, 25 bp, Homo sapien
acagcagtgatcatgacttctcctt

SEQ ID NO: 372066 - DNA, 25 bp, Homo sapien
gacttctcctttccagagttttggg

SEQ ID NO: 372067 - DNA, 25 bp, Homo sapien
ggtccttctgaattaatggtccttt

SEQ ID NO: 372068 - DNA, 25 bp, Homo sapien
cagcctgtttcaagtgccatgtgga

SEQ ID NO: 372069 - DNA, 25 bp, Homo sapien
ttccagggctcatcccagaaaatat

SEQ ID NO: 372070 - DNA, 25 bp, Homo sapien
gtgtctagagttctaacagtacagt

SEQ ID NO: 372071 - DNA, 25 bp, Homo sapien
gtgcttgaataataaacctcctttg

SEQ ID NO: 372072 - DNA, 25 bp, Homo sapien
ctcctttgattggtgactagtcttt

SEQ ID NO: 372073 - DNA, 25 bp, Homo sapien
gactagtcttttttggtatatctcc

SEQ ID NO: 372074 - DNA, 25 bp, Homo sapien
gtatatctccacctttaaaaattgt

SEQ ID NO: 372075 - DNA, 25 bp, Homo sapien
tttaacctggttatactgtgttcta

SEQ ID NO: 372076 - DNA, 25 bp, Homo sapien
tactgtgttctaacatgtctctcat

SEQ ID NO: 372077 - DNA, 25 bp, Homo sapien
gttctaacatgtctctcattttctc

SEQ ID NO: 372078 - DNA, 25 bp, Homo sapien
acagtacagtagtctatgccatttc

SEQ ID NO: 372079 - DNA, 25 bp, Homo sapien
gtctatgccatttctaacagctaaa

SEQ ID NO: 372080 - DNA, 25 bp, Homo sapien
tcataaggaacgtgcgacgcgcctc

SEQ ID NO: 372081 - DNA, 25 bp, Homo sapien
gacgcgcctcagaagtacgtgttca

SEQ ID NO: 372082 - DNA, 25 bp, Homo sapien
gtacgtgttcataaatggtagccat

SEQ ID NO: 372083 - DNA, 25 bp, Homo sapien
gtagccattgttgttaccttcccgt

SEQ ID NO: 372084 - DNA, 25 bp, Homo sapien
tgaacatggatcacatcatctctgt

SEQ ID NO: 372085 - DNA, 25 bp, Homo sapien
acatcatctctgtgggtaacccagt

SEQ ID NO: 372086 - DNA, 25 bp, Homo sapien
aacccagtcctcgttgtatgacttg

SEQ ID NO: 372087 - DNA, 25 bp, Homo sapien
caaaatgcagttccacttgtattaa

SEQ ID NO: 372088 - DNA, 25 bp, Homo sapien
aatattgaccctgttcatcgtcacc

SEQ ID NO: 372089 - DNA, 25 bp, Homo sapien
atcgtcaccaggactgcatcttgca

SEQ ID NO: 372090 - DNA, 25 bp, Homo sapien
ttctaggcacacacgacccgttatc

SEQ ID NO: 372091 - DNA, 25 bp, Homo sapien
atgatatcaggactggttacttggt

SEQ ID NO: 372092 - DNA, 25 bp, Homo sapien
tgatatcaggactggttacttggtt

SEQ ID NO: 372093 - DNA, 25 bp, Homo sapien
gatatcaggactggttacttggtta

SEQ ID NO: 372094 - DNA, 25 bp, Homo sapien
atatcaggactggttacttggttaa

SEQ ID NO: 372095 - DNA, 25 bp, Homo sapien
tatcaggactggttacttggttaag

SEQ ID NO: 372096 - DNA, 25 bp, Homo sapien
atcaggactggttacttggttaagg

SEQ ID NO: 372097 - DNA, 25 bp, Homo sapien
tcaggactggttacttggttaagga

SEQ ID NO: 372098 - DNA, 25 bp, Homo sapien
caggactggttacttggttaaggag

SEQ ID NO: 372099 - DNA, 25 bp, Homo sapien
taggagatctgtcccttttagagac

SEQ ID NO: 372100 - DNA, 25 bp, Homo sapien
aggagatctgtcccttttagagaca

SEQ ID NO: 372101 - DNA, 25 bp, Homo sapien
ttaatgtagtacaagcttcgggctt

SEQ ID NO: 372102 - DNA, 25 bp, Homo sapien
gctttcaggtgcttcattagctttc

SEQ ID NO: 372103 - DNA, 25 bp, Homo sapien
attagctttcagttcctttggtagt

SEQ ID NO: 372104 - DNA, 25 bp, Homo sapien
cctttggtagtgtgggcatttcctt

SEQ ID NO: 372105 - DNA, 25 bp, Homo sapien
gcatttccttggctgacagtggata

SEQ ID NO: 372106 - DNA, 25 bp, Homo sapien
ggatattcttgtacccttcttgggt

SEQ ID NO: 372107 - DNA, 25 bp, Homo sapien
cttgggtcctgggatctcttgaaat

SEQ ID NO: 372108 - DNA, 25 bp, Homo sapien
gagttgtgctatttaagctgaccag

SEQ ID NO: 372109 - DNA, 25 bp, Homo sapien
gctgaccagtatctataaacgtgtt

SEQ ID NO: 372110 - DNA, 25 bp, Homo sapien
gtgtttgcatgagtttacatcccag

SEQ ID NO: 372111 - DNA, 25 bp, Homo sapien
gtttacatcccaggattccatgatt

SEQ ID NO: 372112 - DNA, 25 bp, Homo sapien
tcagccgccggtccgagccttcctg

SEQ ID NO: 372113 - DNA, 25 bp, Homo sapien
atctccaccctgaaggacaagcgcg

SEQ ID NO: 372114 - DNA, 25 bp, Homo sapien
tctccaccctgaaggacaagcgcgg

SEQ ID NO: 372115 - DNA, 25 bp, Homo sapien
tccaccctgaaggacaagcgcggga

SEQ ID NO: 372116 - DNA, 25 bp, Homo sapien
ccaccctgaaggacaagcgcgggac

SEQ ID NO: 372117 - DNA, 25 bp, Homo sapien
caccctgaaggacaagcgcgggacc

SEQ ID NO: 372118 - DNA, 25 bp, Homo sapien
ccctgaaggacaagcgcgggacccg

SEQ ID NO: 372119 - DNA, 25 bp, Homo sapien
tgaaggacaagcgcgggacccgcta

SEQ ID NO: 372120 - DNA, 25 bp, Homo sapien
aaggacaagcgcgggacccgctatg

SEQ ID NO: 372121 - DNA, 25 bp, Homo sapien
aggacaagcgcgggacccgctatga

SEQ ID NO: 372122 - DNA, 25 bp, Homo sapien
ggacaagcgcgggacccgctatgag

SEQ ID NO: 372123 - DNA, 25 bp, Homo sapien
attgtctttaattgtattcaggatt

SEQ ID NO: 372124 - DNA, 25 bp, Homo sapien
ataataaccgatttggaccattttg

SEQ ID NO: 372125 - DNA, 25 bp, Homo sapien
aaccgatttggaccattttgaacat

SEQ ID NO: 372126 - DNA, 25 bp, Homo sapien
ataacagcttcgtataaccacaacc

SEQ ID NO: 372127 - DNA, 25 bp, Homo sapien
cagcttcgtataaccacaaccaaaa

SEQ ID NO: 372128 - DNA, 25 bp, Homo sapien
tctgtattaggagaatcgaattgaa

SEQ ID NO: 372129 - DNA, 25 bp, Homo sapien
gtttagatttcaaaatcattccagc

SEQ ID NO: 372130 - DNA, 25 bp, Homo sapien
ttccagctctgcttttatctatcct

SEQ ID NO: 372131 - DNA, 25 bp, Homo sapien
agctctgcttttatctatcctggat

SEQ ID NO: 372132 - DNA, 25 bp, Homo sapien
ctgcttttatctatcctggatttgg

SEQ ID NO: 372133 - DNA, 25 bp, Homo sapien
tatcctggatttggtagaaaactaa

SEQ ID NO: 372134 - DNA, 25 bp, Homo sapien
aagttaattcaaagtgctggtcctg

SEQ ID NO: 372135 - DNA, 25 bp, Homo sapien
gttaattcaaagtgctggtcctggc

SEQ ID NO: 372136 - DNA, 25 bp, Homo sapien
taattcaaagtgctggtcctggccg

SEQ ID NO: 372137 - DNA, 25 bp, Homo sapien
aattcaaagtgctggtcctggccgg

SEQ ID NO: 372138 - DNA, 25 bp, Homo sapien
attcaaagtgctggtcctggccggg

SEQ ID NO: 372139 - DNA, 25 bp, Homo sapien
tcaaagtgctggtcctggccgggca

SEQ ID NO: 372140 - DNA, 25 bp, Homo sapien
tcctggccgggcatggtaattcatg

SEQ ID NO: 372141 - DNA, 25 bp, Homo sapien
cctggccgggcatggtaattcatgc

SEQ ID NO: 372142 - DNA, 25 bp, Homo sapien
agaactttgcgtggccaaggcaaga

SEQ ID NO: 372143 - DNA, 25 bp, Homo sapien
gttgtcctggcttttaggaggctga

SEQ ID NO: 372144 - DNA, 25 bp, Homo sapien
ttgtcctggcttttaggaggctgaa

SEQ ID NO: 372145 - DNA, 25 bp, Homo sapien
aggagctgtcctccatccggcaatt

SEQ ID NO: 372146 - DNA, 25 bp, Homo sapien
ctccatccggcaattcctggaaaag

SEQ ID NO: 372147 - DNA, 25 bp, Homo sapien
attcctggaaaagcgggatgagatc

SEQ ID NO: 372148 - DNA, 25 bp, Homo sapien
gctggacaagctgctattccacatt

SEQ ID NO: 372149 - DNA, 25 bp, Homo sapien
tattccacatttacctgctagcggt

SEQ ID NO: 372150 - DNA, 25 bp, Homo sapien
acctgctagcggtgctggcctacag

SEQ ID NO: 372151 - DNA, 25 bp, Homo sapien
ggcctacagcatcaccctggttatg

SEQ ID NO: 372152 - DNA, 25 bp, Homo sapien
atcaccctggttatgctctggtcca

SEQ ID NO: 372153 - DNA, 25 bp, Homo sapien
ttatgctctggtccatctggcagta

SEQ ID NO: 372154 - DNA, 25 bp, Homo sapien
ggtccatctggcagtacgcttgagt

SEQ ID NO: 372155 - DNA, 25 bp, Homo sapien
agtacgcttgagtgggtacagccca

SEQ ID NO: 372156 - DNA, 25 bp, Homo sapien
agacactccaaacctttcagataac

SEQ ID NO: 372157 - DNA, 25 bp, Homo sapien
actatcattgcagaccttcactttt

SEQ ID NO: 372158 - DNA, 25 bp, Homo sapien
gaccttcacttttggaatgcaatct

SEQ ID NO: 372159 - DNA, 25 bp, Homo sapien
tttctgtgcatcacacacatgcttt

SEQ ID NO: 372160 - DNA, 25 bp, Homo sapien
tttctgcacgtggttgccttagtca

SEQ ID NO: 372161 - DNA, 25 bp, Homo sapien
tggttgccttagtcatcttcctaca

SEQ ID NO: 372162 - DNA, 25 bp, Homo sapien
tcatcttcctacagcaccatctaga

SEQ ID NO: 372163 - DNA, 25 bp, Homo sapien
atttgaagagatgacagtgcctaaa

SEQ ID NO: 372164 - DNA, 25 bp, Homo sapien
gtgcctaaaagtacagtttacatcc

SEQ ID NO: 372165 - DNA, 25 bp, Homo sapien
catgttttttgtgcaccttcttcta

SEQ ID NO: 372166 - DNA, 25 bp, Homo sapien
tgtgcaccttcttctatagcacttt

SEQ ID NO: 372167 - DNA, 25 bp, Homo sapien
aagatcttatgtctacttggtcatc

SEQ ID NO: 372168 - DNA, 25 bp, Homo sapien
atgtctacttggtcatcagccaaga

SEQ ID NO: 372169 - DNA, 25 bp, Homo sapien
atggttccttagactgcactttgag

SEQ ID NO: 372170 - DNA, 25 bp, Homo sapien
gaggaggcatcaacaccgtgaacat

SEQ ID NO: 372171 - DNA, 25 bp, Homo sapien
gtaaaaaccttggatttgcctctgt

SEQ ID NO: 372172 - DNA, 25 bp, Homo sapien
tttgcctctgtccttgaacatgcta

SEQ ID NO: 372173 - DNA, 25 bp, Homo sapien
gtccttgaacatgctatctggaaag

SEQ ID NO: 372174 - DNA, 25 bp, Homo sapien
gcactttgagaactattgacgtaca

SEQ ID NO: 372175 - DNA, 25 bp, Homo sapien
acgtacagggaaaaatgctcttggt

SEQ ID NO: 372176 - DNA, 25 bp, Homo sapien
aatgctcttggtgttccagttaagc

SEQ ID NO: 372177 - DNA, 25 bp, Homo sapien
ggtgttccagttaagcacagaataa

SEQ ID NO: 372178 - DNA, 25 bp, Homo sapien
aaaaccccagtctctgagacaaaca

SEQ ID NO: 372179 - DNA, 25 bp, Homo sapien
acaaacaaaaaggaactgtctcatt

SEQ ID NO: 372180 - DNA, 25 bp, Homo sapien
ttgggaaagcagacgtaggacgcct

SEQ ID NO: 372181 - DNA, 25 bp, Homo sapien
gaattttgacaaggcctcatctacg

SEQ ID NO: 372182 - DNA, 25 bp, Homo sapien
gacaaggcctcatctacgaatttct

SEQ ID NO: 372183 - DNA, 25 bp, Homo sapien
ctcatctacgaatttctctcgacgt

SEQ ID NO: 372184 - DNA, 25 bp, Homo sapien
gaatttctctcgacgtttgtagtgg

SEQ ID NO: 372185 - DNA, 25 bp, Homo sapien
ttctctcgacgtttgtagtgggtgg

SEQ ID NO: 372186 - DNA, 25 bp, Homo sapien
tggttggcctttattcctcttctgg

SEQ ID NO: 372187 - DNA, 25 bp, Homo sapien
tttattcctcttctggtgtgttggg

SEQ ID NO: 372188 - DNA, 25 bp, Homo sapien
cctccgggttgctcagggatgcagt

SEQ ID NO: 372189 - DNA, 25 bp, Homo sapien
tcatgaagcacactgcgtgtccatc

SEQ ID NO: 372190 - DNA, 25 bp, Homo sapien
aagcacactgcgtgtccatctccta

SEQ ID NO: 372191 - DNA, 25 bp, Homo sapien
atctcctatcgtacccgtgggtcga

SEQ ID NO: 372192 - DNA, 25 bp, Homo sapien
acgccctgagcgtgtacacatgatg

SEQ ID NO: 372193 - DNA, 25 bp, Homo sapien
aggacaagatgggtggccccggctc

SEQ ID NO: 372194 - DNA, 25 bp, Homo sapien
tgcccgctgtgcagccgtgtgcgtt

SEQ ID NO: 372195 - DNA, 25 bp, Homo sapien
gtgcgttggcgtgtgtttctgtgtc

SEQ ID NO: 372196 - DNA, 25 bp, Homo sapien
tttctgtgtcactggcgtgtcacgt

SEQ ID NO: 372197 - DNA, 25 bp, Homo sapien
tgtcactggcgtgtcacgtgatgta

SEQ ID NO: 372198 - DNA, 25 bp, Homo sapien
ctggcgtgtcacgtgatgtagccgt

SEQ ID NO: 372199 - DNA, 25 bp, Homo sapien
tcacgtgatgtagccgtgtttgctg

SEQ ID NO: 372200 - DNA, 25 bp, Homo sapien
agggcccaggcactttctgtttgaa

SEQ ID NO: 372201 - DNA, 25 bp, Homo sapien
aggcactttctgtttgaacccctgt

SEQ ID NO: 372202 - DNA, 25 bp, Homo sapien
ttgaacccctgtcatgatcacagtg

SEQ ID NO: 372203 - DNA, 25 bp, Homo sapien
gatcacagtgtcagagacgcgtcct

SEQ ID NO: 372204 - DNA, 25 bp, Homo sapien
tcagagacgcgtcctctttcttggg

SEQ ID NO: 372205 - DNA, 25 bp, Homo sapien
aagttgaggagtgcccttcagagcc

SEQ ID NO: 372206 - DNA, 25 bp, Homo sapien
tgggtaggcaccctccttcctgttt

SEQ ID NO: 372207 - DNA, 25 bp, Homo sapien
aaaatgctaacctgccctgagtttc

SEQ ID NO: 372208 - DNA, 25 bp, Homo sapien
ctgccctgagtttccattactgtgg

SEQ ID NO: 372209 - DNA, 25 bp, Homo sapien
ctgagtttccattactgtgggtggg

SEQ ID NO: 372210 - DNA, 25 bp, Homo sapien
gggttcccctgggccaaacagtgat

SEQ ID NO: 372211 - DNA, 25 bp, Homo sapien
gaagcctcagttctactgacagttg

SEQ ID NO: 372212 - DNA, 25 bp, Homo sapien
gacagttggtaataataacctctct

SEQ ID NO: 372213 - DNA, 25 bp, Homo sapien
aacctctctgtcataatgtacccaa

SEQ ID NO: 372214 - DNA, 25 bp, Homo sapien
atcatgcttttcagtaatactccag

SEQ ID NO: 372215 - DNA, 25 bp, Homo sapien
atactccagtgaatgaggctaagag

SEQ ID NO: 372216 - DNA, 25 bp, Homo sapien
gaggctaagagtaccatttttgttc

SEQ ID NO: 372217 - DNA, 25 bp, Homo sapien
atacaaagatgtcaggttaccaaat

SEQ ID NO: 372218 - DNA, 25 bp, Homo sapien
tgtcaggttaccaaatcatttgcta

SEQ ID NO: 372219 - DNA, 25 bp, Homo sapien
aatcatttgctagtagatcctaaca

SEQ ID NO: 372220 - DNA, 25 bp, Homo sapien
agatcctaacaatatcacctatagg

SEQ ID NO: 372221 - DNA, 25 bp, Homo sapien
tcacctataggaaactgaacgtagc

SEQ ID NO: 372222 - DNA, 25 bp, Homo sapien
gtcagggcttttatggtatccatca

SEQ ID NO: 372223 - DNA, 25 bp, Homo sapien
atggtatccatcactcgaataatgt

SEQ ID NO: 372224 - DNA, 25 bp, Homo sapien
taagtaatttctcaccatctacccc

SEQ ID NO: 372225 - DNA, 25 bp, Homo sapien
ctaccttcttactctttcatgtcag

SEQ ID NO: 372226 - DNA, 25 bp, Homo sapien
tactctttcatgtcaggtgtgctgg

SEQ ID NO: 372227 - DNA, 25 bp, Homo sapien
gcaagttttaactagtggttgtgtt

SEQ ID NO: 372228 - DNA, 25 bp, Homo sapien
ggtgtgctggccctcaatgaccaac

SEQ ID NO: 372229 - DNA, 25 bp, Homo sapien
gccctcaatgaccaacacaacaaag

SEQ ID NO: 372230 - DNA, 25 bp, Homo sapien
ttctgagacttagacttagacttag

SEQ ID NO: 372231 - DNA, 25 bp, Homo sapien
tacaaatgtgttgggtgcaagtata

SEQ ID NO: 372232 - DNA, 25 bp, Homo sapien
taatttagttacatgcatagattgc

SEQ ID NO: 372233 - DNA, 25 bp, Homo sapien
cacagagagggaaatggtaactaag

SEQ ID NO: 372234 - DNA, 25 bp, Homo sapien
gagcaggcaggtccctacattccca

SEQ ID NO: 372235 - DNA, 25 bp, Homo sapien
gcaggtccctacattcccaggaaag

SEQ ID NO: 372236 - DNA, 25 bp, Homo sapien
gaggagctaagatgtcctgtggcat

SEQ ID NO: 372237 - DNA, 25 bp, Homo sapien
gctaagatgtcctgtggcatgaaca

SEQ ID NO: 372238 - DNA, 25 bp, Homo sapien
ggcatgaacacaggaatctccattc

SEQ ID NO: 372239 - DNA, 25 bp, Homo sapien
gaacacaggaatctccattcatgaa

SEQ ID NO: 372240 - DNA, 25 bp, Homo sapien
ggaatctccattcatgaaaacccta

SEQ ID NO: 372241 - DNA, 25 bp, Homo sapien
ggctccagaaccagccagttctcag

SEQ ID NO: 372242 - DNA, 25 bp, Homo sapien
gaaccagccagttctcagtgaccat

SEQ ID NO: 372243 - DNA, 25 bp, Homo sapien
agccagttctcagtgaccatctgca

SEQ ID NO: 372244 - DNA, 25 bp, Homo sapien
gagggcccaggcactttctgtttga

SEQ ID NO: 372245 - DNA, 25 bp, Homo sapien
ggcccaggcactttctgtttgaacc

SEQ ID NO: 372246 - DNA, 25 bp, Homo sapien
tgtttgaacccctgtcatgatcaca

SEQ ID NO: 372247 - DNA, 25 bp, Homo sapien
ttgaacccctgtcatgatcacagtg

SEQ ID NO: 372248 - DNA, 25 bp, Homo sapien
acccctgtcatgatcacagtgtcag

SEQ ID NO: 372249 - DNA, 25 bp, Homo sapien
tgtcagagacgcgtcctctttcttg

SEQ ID NO: 372250 - DNA, 25 bp, Homo sapien
tcagagacgcgtcctctttcttggg

SEQ ID NO: 372251 - DNA, 25 bp, Homo sapien
aagttgaggagtgcccttcagagcc

SEQ ID NO: 372252 - DNA, 25 bp, Homo sapien
gggtgggtaggcaccctccttcctg

SEQ ID NO: 372253 - DNA, 25 bp, Homo sapien
tgggtaggcaccctccttcctgttt

SEQ ID NO: 372254 - DNA, 25 bp, Homo sapien
tttatctaataaaatgctaacctgc

SEQ ID NO: 372255 - DNA, 25 bp, Homo sapien
agcgtctgatccgtacctcgctgga

SEQ ID NO: 372256 - DNA, 25 bp, Homo sapien
gtacctcgctggacctggagttaga

SEQ ID NO: 372257 - DNA, 25 bp, Homo sapien
ctggagttagacctgcaggcgacaa

SEQ ID NO: 372258 - DNA, 25 bp, Homo sapien
tgacccaggagatctcggtgctgaa

SEQ ID NO: 372259 - DNA, 25 bp, Homo sapien
gatctcggtgctgaaggagctcaag

SEQ ID NO: 372260 - DNA, 25 bp, Homo sapien
tgcgtgaggacgagcgtttccgcct

SEQ ID NO: 372261 - DNA, 25 bp, Homo sapien
cgtttccgcctgctgctgaggatgc

SEQ ID NO: 372262 - DNA, 25 bp, Homo sapien
gagcacaagggtgagcttcagacag

SEQ ID NO: 372263 - DNA, 25 bp, Homo sapien
gtgagcttcagacagacaagatgat

SEQ ID NO: 372264 - DNA, 25 bp, Homo sapien
tgccaaggatgtgcacaggctccga

SEQ ID NO: 372265 - DNA, 25 bp, Homo sapien
atgtgcacaggctccgaggccagag

SEQ ID NO: 372266 - DNA, 25 bp, Homo sapien
ggctgactgccatctccatgcctga

SEQ ID NO: 372267 - DNA, 25 bp, Homo sapien
ccatgcctgagagccactgattttt

SEQ ID NO: 372268 - DNA, 25 bp, Homo sapien
actgatttttcattggcatttcccc

SEQ ID NO: 372269 - DNA, 25 bp, Homo sapien
ttcattggcatttcccctggtttgt

SEQ ID NO: 372270 - DNA, 25 bp, Homo sapien
ttgtctcattcttcttggttgagta

SEQ ID NO: 372271 - DNA, 25 bp, Homo sapien
tcctgctaggagtcccaattatttt

SEQ ID NO: 372272 - DNA, 25 bp, Homo sapien
gagtcccaattatttttgactaggg

SEQ ID NO: 372273 - DNA, 25 bp, Homo sapien
gacagttgacatttctggtcctaca

SEQ ID NO: 372274 - DNA, 25 bp, Homo sapien
acatttctggtcctacaggcccttt

SEQ ID NO: 372275 - DNA, 25 bp, Homo sapien
acaggccctttctggccagggaggc

SEQ ID NO: 372276 - DNA, 25 bp, Homo sapien
ttgccacccgtggttggatcttgtt

SEQ ID NO: 372277 - DNA, 25 bp, Homo sapien
gactctgtcctttgagtcctttgga

SEQ ID NO: 372278 - DNA, 25 bp, Homo sapien
ttaaacagacccattctttttgatc

SEQ ID NO: 372279 - DNA, 25 bp, Homo sapien
ggtttaagtggattactgcctagct

SEQ ID NO: 372280 - DNA, 25 bp, Homo sapien
ggattactgcctagctgagccaaaa

SEQ ID NO: 372281 - DNA, 25 bp, Homo sapien
gagccaaaatgtttgcttgtacctg

SEQ ID NO: 372282 - DNA, 25 bp, Homo sapien
tttgcttgtacctgttggaccacta

SEQ ID NO: 372283 - DNA, 25 bp, Homo sapien
tgttggaccactacagcaaaccgct

SEQ ID NO: 372284 - DNA, 25 bp, Homo sapien
gcaaaccgctgcttacagtgcattg

SEQ ID NO: 372285 - DNA, 25 bp, Homo sapien
gtgcattgtgtatttctgtagtact

SEQ ID NO: 372286 - DNA, 25 bp, Homo sapien
ctgtagtactgttttgcattttcca

SEQ ID NO: 372287 - DNA, 25 bp, Homo sapien
aactttgcaagtcaatcactgttgt

SEQ ID NO: 372288 - DNA, 25 bp, Homo sapien
aggaccagtctggtgagcacaccat

SEQ ID NO: 372289 - DNA, 25 bp, Homo sapien
gtgagcacaccatcaataagatctg

SEQ ID NO: 372290 - DNA, 25 bp, Homo sapien
gattgtcaatcatatccctggtttc

SEQ ID NO: 372291 - DNA, 25 bp, Homo sapien
ggctggatcctcaaagttcacattc

SEQ ID NO: 372292 - DNA, 25 bp, Homo sapien
tcacattccggacctcacactggaa

SEQ ID NO: 372293 - DNA, 25 bp, Homo sapien
aaaggcacttcaatttcagaggcat

SEQ ID NO: 372294 - DNA, 25 bp, Homo sapien
gaggcattcttaacaaacacggcgt

SEQ ID NO: 372295 - DNA, 25 bp, Homo sapien
gttagccactgtcacaatgtcttta

SEQ ID NO: 372296 - DNA, 25 bp, Homo sapien
tattcttcttggagacgatggcctt

SEQ ID NO: 372297 - DNA, 25 bp, Homo sapien
cgatggccttgttgatcttctttaa

SEQ ID NO: 372298 - DNA, 25 bp, Homo sapien
tattttaccaactccatttacgccg

SEQ ID NO: 372299 - DNA, 25 bp, Homo sapien
ggttttgtggaaactgtgctgttct

SEQ ID NO: 372300 - DNA, 25 bp, Homo sapien
tgtggaaactgtgctgttctgcttt

SEQ ID NO: 372301 - DNA, 25 bp, Homo sapien
taatcaatctggcagccttcattta

SEQ ID NO: 372302 - DNA, 25 bp, Homo sapien
aaactgtgctgttctgcttttgcag

SEQ ID NO: 372303 - DNA, 25 bp, Homo sapien
tagtataacttttatacaccgtgag

SEQ ID NO: 372304 - DNA, 25 bp, Homo sapien
gcagtctgtgagattctgatttttt

SEQ ID NO: 372305 - DNA, 25 bp, Homo sapien
tttttctcatcagcaattatccttg

SEQ ID NO: 372306 - DNA, 25 bp, Homo sapien
tcatcagcaattatccttgtcttgg

SEQ ID NO: 372307 - DNA, 25 bp, Homo sapien
gcaattatccttgtcttggaacatc

SEQ ID NO: 372308 - DNA, 25 bp, Homo sapien
atccttgtcttggaacatcagagct

SEQ ID NO: 372309 - DNA, 25 bp, Homo sapien
tgtcttggaacatcagagcttgaag

SEQ ID NO: 372310 - DNA, 25 bp, Homo sapien
agagacaatgctgtgagtttccaac

SEQ ID NO: 372311 - DNA, 25 bp, Homo sapien
aatgctgtgagtttccaacctcagc

SEQ ID NO: 372312 - DNA, 25 bp, Homo sapien
atctgcgggcagagaaggtctagtt

SEQ ID NO: 372313 - DNA, 25 bp, Homo sapien
caccattatgatatcaggactggtt

SEQ ID NO: 372314 - DNA, 25 bp, Homo sapien
atcaggactggttacttggttaagg

SEQ ID NO: 372315 - DNA, 25 bp, Homo sapien
taggagatctgtcccttttagagac

SEQ ID NO: 372316 - DNA, 25 bp, Homo sapien
acttataatgaagtacttgggaaag

SEQ ID NO: 372317 - DNA, 25 bp, Homo sapien
tacttgggaaagtggttttcaagag

SEQ ID NO: 372318 - DNA, 25 bp, Homo sapien
ggttttcaagagtataaatatcctg

SEQ ID NO: 372319 - DNA, 25 bp, Homo sapien
tatcctgtattctaatgatcatcct

SEQ ID NO: 372320 - DNA, 25 bp, Homo sapien
atcctgtattctaatgatcatcctc

SEQ ID NO: 372321 - DNA, 25 bp, Homo sapien
agcgtctgatccgtacctcgctgga

SEQ ID NO: 372322 - DNA, 25 bp, Homo sapien
tgatccgtacctcgctggacctgga

SEQ ID NO: 372323 - DNA, 25 bp, Homo sapien
atccgtacctcgctggacctggagt

SEQ ID NO: 372324 - DNA, 25 bp, Homo sapien
gtacctcgctggacctggagttaga

SEQ ID NO: 372325 - DNA, 25 bp, Homo sapien
tggaccgagcggagcacaagggtga

SEQ ID NO: 372326 - DNA, 25 bp, Homo sapien
gatgagggcagctgccaaggatgtg

SEQ ID NO: 372327 - DNA, 25 bp, Homo sapien
tgccaaggatgtgcacaggctccga

SEQ ID NO: 372328 - DNA, 25 bp, Homo sapien
ccaaggatgtgcacaggctccgagg

SEQ ID NO: 372329 - DNA, 25 bp, Homo sapien
aaggatgtgcacaggctccgaggcc

SEQ ID NO: 372330 - DNA, 25 bp, Homo sapien
aggatgtgcacaggctccgaggcca

SEQ ID NO: 372331 - DNA, 25 bp, Homo sapien
gatgtgcacaggctccgaggccaga

SEQ ID NO: 372332 - DNA, 25 bp, Homo sapien
tataggaatgaaggcactgaactct

SEQ ID NO: 372333 - DNA, 25 bp, Homo sapien
aaggcactgaactcttctttataat

SEQ ID NO: 372334 - DNA, 25 bp, Homo sapien
ttctttataatcctcacactgagat

SEQ ID NO: 372335 - DNA, 25 bp, Homo sapien
cctcacactgagatttcttttctat

SEQ ID NO: 372336 - DNA, 25 bp, Homo sapien
gtcaaaatactgcaatctctcacat

SEQ ID NO: 372337 - DNA, 25 bp, Homo sapien
gcaatctctcacattttaatcacac

SEQ ID NO: 372338 - DNA, 25 bp, Homo sapien
aagagggcagatttcccagcccaaa

SEQ ID NO: 372339 - DNA, 25 bp, Homo sapien
ttaattattctctagctctggatgg

SEQ ID NO: 372340 - DNA, 25 bp, Homo sapien
tctctagctctggatggaacacatc

SEQ ID NO: 372341 - DNA, 25 bp, Homo sapien
taagggacccacatcccagactgaa

SEQ ID NO: 372342 - DNA, 25 bp, Homo sapien
gactgaactagagatggttccctaa

SEQ ID NO: 372343 - DNA, 25 bp, Homo sapien
gttttctttgaactgctgtaacctt

SEQ ID NO: 372344 - DNA, 25 bp, Homo sapien
gaactgctgtaaccttaaattggaa

SEQ ID NO: 372345 - DNA, 25 bp, Homo sapien
ggaaactgattcttgtgagcctact

SEQ ID NO: 372346 - DNA, 25 bp, Homo sapien
attcttgtgagcctactttccttaa

SEQ ID NO: 372347 - DNA, 25 bp, Homo sapien
tgtgagcctactttccttaatcccg

SEQ ID NO: 372348 - DNA, 25 bp, Homo sapien
ccccacttaatgtaaatgtcttgat

SEQ ID NO: 372349 - DNA, 25 bp, Homo sapien
gatttaggaatttgtctccctccgt

SEQ ID NO: 372350 - DNA, 25 bp, Homo sapien
taggaatttgtctccctccgttaca

SEQ ID NO: 372351 - DNA, 25 bp, Homo sapien
ctccgttacacagttgatgcctgaa

SEQ ID NO: 372352 - DNA, 25 bp, Homo sapien
gggaggactcaacaccctaattgta

SEQ ID NO: 372353 - DNA, 25 bp, Homo sapien
ggactcaacaccctaattgtatttt

SEQ ID NO: 372354 - DNA, 25 bp, Homo sapien
aacatagcgggaccccctgtctctt

SEQ ID NO: 372355 - DNA, 25 bp, Homo sapien
tagcgggaccccctgtctcttcaaa

SEQ ID NO: 372356 - DNA, 25 bp, Homo sapien
tggcgcaggctctgtagtcccagat

SEQ ID NO: 372357 - DNA, 25 bp, Homo sapien
aaatctgtgaggttaaaaggctgtg

SEQ ID NO: 372358 - DNA, 25 bp, Homo sapien
aatctgtgaggttaaaaggctgtgt

SEQ ID NO: 372359 - DNA, 25 bp, Homo sapien
atctgtgaggttaaaaggctgtgtg

SEQ ID NO: 372360 - DNA, 25 bp, Homo sapien
tctgtgaggttaaaaggctgtgtgt

SEQ ID NO: 372361 - DNA, 25 bp, Homo sapien
ggctgtgtgtgtgaaaatatcttgg

SEQ ID NO: 372362 - DNA, 25 bp, Homo sapien
gctgtgtgtgtgaaaatatcttgga

SEQ ID NO: 372363 - DNA, 25 bp, Homo sapien
ctgtgtgtgtgaaaatatcttggaa

SEQ ID NO: 372364 - DNA, 25 bp, Homo sapien
gtgtgtgaaaatatcttggaaattg

SEQ ID NO: 372365 - DNA, 25 bp, Homo sapien
agtatcttctgtgtgtccatatgtc

SEQ ID NO: 372366 - DNA, 25 bp, Homo sapien
gtatcttctgtgtgtccatatgtct

SEQ ID NO: 372367 - DNA, 25 bp, Homo sapien
atcttctgtgtgtccatatgtctat

SEQ ID NO: 372368 - DNA, 25 bp, Homo sapien
cttctgtgtgtccatatgtctatat

SEQ ID NO: 372369 - DNA, 25 bp, Homo sapien
gtgtgtccatatgtctatatgcgtt

SEQ ID NO: 372370 - DNA, 25 bp, Homo sapien
gtgtccatatgtctatatgcgttat

SEQ ID NO: 372371 - DNA, 25 bp, Homo sapien
ctatatgcgttatatgtatgtgaca

SEQ ID NO: 372372 - DNA, 25 bp, Homo sapien
atatgtatgtgacaatagttggtaa

SEQ ID NO: 372373 - DNA, 25 bp, Homo sapien
aatattgctagtatataactccagg

SEQ ID NO: 372374 - DNA, 25 bp, Homo sapien
ataactccaggtaagaagtatcttc

SEQ ID NO: 372375 - DNA, 25 bp, Homo sapien
aactccaggtaagaagtatcttctg

SEQ ID NO: 372376 - DNA, 25 bp, Homo sapien
tcttggaagccgagacgcgggccac

SEQ ID NO: 372377 - DNA, 25 bp, Homo sapien
ttggaagccgagacgcgggccaccc

SEQ ID NO: 372378 - DNA, 25 bp, Homo sapien
gccttgggggttcctgaactcccag

SEQ ID NO: 372379 - DNA, 25 bp, Homo sapien
tgaactcccagccttgagacctacc

SEQ ID NO: 372380 - DNA, 25 bp, Homo sapien
tcccagccttgagacctaccatcag

SEQ ID NO: 372381 - DNA, 25 bp, Homo sapien
agggtcctgtgcgtcttcctacgga

SEQ ID NO: 372382 - DNA, 25 bp, Homo sapien
aaagctttgagagtgtaccttttcg

SEQ ID NO: 372383 - DNA, 25 bp, Homo sapien
atctccaccctgaaggacaagcgcg

SEQ ID NO: 372384 - DNA, 25 bp, Homo sapien
gggacccgctatgaggtgcgtgaag

SEQ ID NO: 372385 - DNA, 25 bp, Homo sapien
aggtgcgtgaagtgggcaggccctg

SEQ ID NO: 372386 - DNA, 25 bp, Homo sapien
tgaagtgggcaggccctgtcagtct

SEQ ID NO: 372387 - DNA, 25 bp, Homo sapien
caatccccttgcttgagaagcacta

SEQ ID NO: 372388 - DNA, 25 bp, Homo sapien
aatccccttgcttgagaagcactac

SEQ ID NO: 372389 - DNA, 25 bp, Homo sapien
atccccttgcttgagaagcactact

SEQ ID NO: 372390 - DNA, 25 bp, Homo sapien
gaccttacaactgtgataaaacttg

SEQ ID NO: 372391 - DNA, 25 bp, Homo sapien
cttacaactgtgataaaacttgaat

SEQ ID NO: 372392 - DNA, 25 bp, Homo sapien
gaataaggcattccagttaactttt

SEQ ID NO: 372393 - DNA, 25 bp, Homo sapien
taaggcattccagttaacttttact

SEQ ID NO: 372394 - DNA, 25 bp, Homo sapien
gcattccagttaacttttactccct

SEQ ID NO: 372395 - DNA, 25 bp, Homo sapien
gaaggggttccttttccattgctca

SEQ ID NO: 372396 - DNA, 25 bp, Homo sapien
ggggttccttttccattgctcagtt

SEQ ID NO: 372397 - DNA, 25 bp, Homo sapien
ttgttctactcttcccctcttctca

SEQ ID NO: 372398 - DNA, 25 bp, Homo sapien
atgctggccgaaacgacaatggttt

SEQ ID NO: 372399 - DNA, 25 bp, Homo sapien
acgacaatggtttatggacttgcat

SEQ ID NO: 372400 - DNA, 25 bp, Homo sapien
tggacttgcatccattttgtatttt

SEQ ID NO: 372401 - DNA, 25 bp, Homo sapien
aagatgttttcaacgtttacattca

SEQ ID NO: 372402 - DNA, 25 bp, Homo sapien
gtttacattcaatccaagcctttgt

SEQ ID NO: 372403 - DNA, 25 bp, Homo sapien
ttcaatccaagcctttgtatatttt

SEQ ID NO: 372404 - DNA, 25 bp, Homo sapien
atattttagagctgtgcaacacttt

SEQ ID NO: 372405 - DNA, 25 bp, Homo sapien
gctgtgcaacactttaagtcttgta

SEQ ID NO: 372406 - DNA, 25 bp, Homo sapien
gtgacagtttcattgtgaacccctc

SEQ ID NO: 372407 - DNA, 25 bp, Homo sapien
gtttcattgtgaacccctctcaaaa

SEQ ID NO: 372408 - DNA, 25 bp, Homo sapien
aagtttgattacctagaaagtgtgt

SEQ ID NO: 372409 - DNA, 25 bp, Homo sapien
ttgaatctcttggaaaaggccatga

SEQ ID NO: 372410 - DNA, 25 bp, Homo sapien
tgaatctcttggaaaaggccatgaa

SEQ ID NO: 372411 - DNA, 25 bp, Homo sapien
gaatctcttggaaaaggccatgaag

SEQ ID NO: 372412 - DNA, 25 bp, Homo sapien
tggtgccaaggacttgcgaggggaa

SEQ ID NO: 372413 - DNA, 25 bp, Homo sapien
ggtgccaaggacttgcgaggggaaa

SEQ ID NO: 372414 - DNA, 25 bp, Homo sapien
gtgccaaggacttgcgaggggaaat

SEQ ID NO: 372415 - DNA, 25 bp, Homo sapien
tgccaaggacttgcgaggggaaata

SEQ ID NO: 372416 - DNA, 25 bp, Homo sapien
gccaaggacttgcgaggggaaataa

SEQ ID NO: 372417 - DNA, 25 bp, Homo sapien
aataaaaatgttatccagcctgacc

SEQ ID NO: 372418 - DNA, 25 bp, Homo sapien
ataaaaatgttatccagcctgacca

SEQ ID NO: 372419 - DNA, 25 bp, Homo sapien
taaaaatgttatccagcctgaccaa

SEQ ID NO: 372420 - DNA, 25 bp, Homo sapien
aacttttaagaatttgcttgacctg

SEQ ID NO: 372421 - DNA, 25 bp, Homo sapien
tttaagaatttgcttgacctgtggc

SEQ ID NO: 372422 - DNA, 25 bp, Homo sapien
ttaagaatttgcttgacctgtggca

SEQ ID NO: 372423 - DNA, 25 bp, Homo sapien
aatttgcttgacctgtggcaatcca

SEQ ID NO: 372424 - DNA, 25 bp, Homo sapien
tttgcttgacctgtggcaatccaaa

SEQ ID NO: 372425 - DNA, 25 bp, Homo sapien
tgcttgacctgtggcaatccaaaaa

SEQ ID NO: 372426 - DNA, 25 bp, Homo sapien
cttgacctgtggcaatccaaaaata

SEQ ID NO: 372427 - DNA, 25 bp, Homo sapien
gacctgtggcaatccaaaaatacat

SEQ ID NO: 372428 - DNA, 25 bp, Homo sapien
gtatttataaattctagacttctgt

SEQ ID NO: 372429 - DNA, 25 bp, Homo sapien
tacttctggcatatccacacttttt

SEQ ID NO: 372430 - DNA, 25 bp, Homo sapien
acttctggcatatccacactttttt

SEQ ID NO: 372431 - DNA, 25 bp, Homo sapien
gagtcggagctcagctgtcggttta

SEQ ID NO: 372432 - DNA, 25 bp, Homo sapien
cggagctcagctgtcggtttaaaga

SEQ ID NO: 372433 - DNA, 25 bp, Homo sapien
agcctgcattcctgtgcgcaatcga

SEQ ID NO: 372434 - DNA, 25 bp, Homo sapien
attcctgtgcgcaatcgattccgca

SEQ ID NO: 372435 - DNA, 25 bp, Homo sapien
aatcgattccgcaatgacagcacct

SEQ ID NO: 372436 - DNA, 25 bp, Homo sapien
aatgacagcaccttactccttcctg

SEQ ID NO: 372437 - DNA, 25 bp, Homo sapien
ttgtgagaggaacatgagccagaca

SEQ ID NO: 372438 - DNA, 25 bp, Homo sapien
ccagacaaagacttggctcagggct

SEQ ID NO: 372439 - DNA, 25 bp, Homo sapien
ttggctcagggctccgtggaacaag

SEQ ID NO: 372440 - DNA, 25 bp, Homo sapien
gctccgtggaacaagccaggatgca

SEQ ID NO: 372441 - DNA, 25 bp, Homo sapien
aggccgctgaacaaacaccccagaa

SEQ ID NO: 372442 - DNA, 25 bp, Homo sapien
ggtcggctgcagtgccagcatcctg

SEQ ID NO: 372443 - DNA, 25 bp, Homo sapien
agtatggccagcgtcttggagcagc

SEQ ID NO: 372444 - DNA, 25 bp, Homo sapien
agctccaggtcatcggtgatgtcct

SEQ ID NO: 372445 - DNA, 25 bp, Homo sapien
aggtcatcggtgatgtcctcttcat

SEQ ID NO: 372446 - DNA, 25 bp, Homo sapien
tcatcggtgatgtcctcttcattct

SEQ ID NO: 372447 - DNA, 25 bp, Homo sapien
tccatggctccctacttagaagttg

SEQ ID NO: 372448 - DNA, 25 bp, Homo sapien
ggctccctacttagaagttggcctt

SEQ ID NO: 372449 - DNA, 25 bp, Homo sapien
tccctacttagaagttggcctttag

SEQ ID NO: 372450 - DNA, 25 bp, Homo sapien
tgtaataggctgacatggctcaaaa

SEQ ID NO: 372451 - DNA, 25 bp, Homo sapien
ggctgacatggctcaaaattgaaaa

SEQ ID NO: 372452 - DNA, 25 bp, Homo sapien
gaaaagtgtagccagtgatgagaac

SEQ ID NO: 372453 - DNA, 25 bp, Homo sapien
gtgtggccatatttaaacacctgag

SEQ ID NO: 372454 - DNA, 25 bp, Homo sapien
ctttgatttgaagcacctcatcctt

SEQ ID NO: 372455 - DNA, 25 bp, Homo sapien
ctcatccttctttcaatgcgaacac

SEQ ID NO: 372456 - DNA, 25 bp, Homo sapien
gcgaacactatcatatggcattctt

SEQ ID NO: 372457 - DNA, 25 bp, Homo sapien
ggcattcttactgaggattttgtct

SEQ ID NO: 372458 - DNA, 25 bp, Homo sapien
gattttgtctaaccatatgttgcca

SEQ ID NO: 372459 - DNA, 25 bp, Homo sapien
atatgttgccatgaattaactctgc

SEQ ID NO: 372460 - DNA, 25 bp, Homo sapien
taactctgccgcctttcttaaggat

SEQ ID NO: 372461 - DNA, 25 bp, Homo sapien
tgatttgggaatcttcccctttcca

SEQ ID NO: 372462 - DNA, 25 bp, Homo sapien
gatgcagtacttaactttccttggt

SEQ ID NO: 372463 - DNA, 25 bp, Homo sapien
tgtagatattgccttgtgtattcca

SEQ ID NO: 372464 - DNA, 25 bp, Homo sapien
cagttactggaggaacgtaattcca

SEQ ID NO: 372465 - DNA, 25 bp, Homo sapien
agcttgaaagccgtggtgatggtaa

SEQ ID NO: 372466 - DNA, 25 bp, Homo sapien
atgcctggttctatttctgttatta

SEQ ID NO: 372467 - DNA, 25 bp, Homo sapien
tgttttcccagcgatctgactgaac

SEQ ID NO: 372468 - DNA, 25 bp, Homo sapien
atctgactgaactcgcagagggaca

SEQ ID NO: 372469 - DNA, 25 bp, Homo sapien
gcagagggacaaatccagtttttct

SEQ ID NO: 372470 - DNA, 25 bp, Homo sapien
tttgtcaaactaaatcaggcctgat

SEQ ID NO: 372471 - DNA, 25 bp, Homo sapien
gatagaaaactcattgctctccggg

SEQ ID NO: 372472 - DNA, 25 bp, Homo sapien
aaagccctaatatagctgcggaaga

SEQ ID NO: 372473 - DNA, 25 bp, Homo sapien
ttgcctcctgcaagcatcatcaaca

SEQ ID NO: 372474 - DNA, 25 bp, Homo sapien
tgcaagcatcatcaacagttactgg

SEQ ID NO: 372475 - DNA, 25 bp, Homo sapien
gaagtgatgctgcagaggacaatca

SEQ ID NO: 372476 - DNA, 25 bp, Homo sapien
tgctgcagaggacaatcaagagagt

SEQ ID NO: 372477 - DNA, 25 bp, Homo sapien
ggtgacttttaaggtcctgtcaact

SEQ ID NO: 372478 - DNA, 25 bp, Homo sapien
ttttaaggtcctgtcaactctgagt

SEQ ID NO: 372479 - DNA, 25 bp, Homo sapien
aaggtcctgtcaactctgagtttct

SEQ ID NO: 372480 - DNA, 25 bp, Homo sapien
gtcaactctgagtttctacatcaaa

SEQ ID NO: 372481 - DNA, 25 bp, Homo sapien
ctgagtttctacatcaaaaggaatt

SEQ ID NO: 372482 - DNA, 25 bp, Homo sapien
tgcagggtagtgagtatcctgtgat

SEQ ID NO: 372483 - DNA, 25 bp, Homo sapien
gatgagaggtgctcacacagcagac

SEQ ID NO: 372484 - DNA, 25 bp, Homo sapien
aggtgctcacacagcagacaggtca

SEQ ID NO: 372485 - DNA, 25 bp, Homo sapien
agcagacaggtcattacttggaagt

SEQ ID NO: 372486 - DNA, 25 bp, Homo sapien
ttttatatactatggaggaatctcc

SEQ ID NO: 372487 - DNA, 25 bp, Homo sapien
ctatggaggaatctccactcacctt

SEQ ID NO: 372488 - DNA, 25 bp, Homo sapien
tatattctcacatacaaccggatgg

SEQ ID NO: 372489 - DNA, 25 bp, Homo sapien
aaccggatggatagccattcctttt

SEQ ID NO: 372490 - DNA, 25 bp, Homo sapien
ccttttcttaatttgattcctgcca

SEQ ID NO: 372491 - DNA, 25 bp, Homo sapien
ttaatttgattcctgccaacaccct

SEQ ID NO: 372492 - DNA, 25 bp, Homo sapien
aatttgattcctgccaacaccctaa

SEQ ID NO: 372493 - DNA, 25 bp, Homo sapien
ctaaccgtcatgacttcacctttta

SEQ ID NO: 372494 - DNA, 25 bp, Homo sapien
cttcaccttttaccatgggtggctt

SEQ ID NO: 372495 - DNA, 25 bp, Homo sapien
taccatgggtggcttattaaaaaca

SEQ ID NO: 372496 - DNA, 25 bp, Homo sapien
tgcagactcggcaccccatttatag

SEQ ID NO: 372497 - DNA, 25 bp, Homo sapien
actgcacagtgtaagtaactttaac

SEQ ID NO: 372498 - DNA, 25 bp, Homo sapien
actttaactccttgaagaccctctg

SEQ ID NO: 372499 - DNA, 25 bp, Homo sapien
aactccttgaagaccctctggtgga

SEQ ID NO: 372500 - DNA, 25 bp, Homo sapien
ttgaagaccctctggtggagtccat

SEQ ID NO: 372501 - DNA, 25 bp, Homo sapien
agaccctctggtggagtccattgta

SEQ ID NO: 372502 - DNA, 25 bp, Homo sapien
ggagtccattgtaggacattcttca

SEQ ID NO: 372503 - DNA, 25 bp, Homo sapien
aggacattcttcatgttgatggata

SEQ ID NO: 372504 - DNA, 25 bp, Homo sapien
taagaaggtgatgtttgcaggttta

SEQ ID NO: 372505 - DNA, 25 bp, Homo sapien
tttgcaggtttaggcaaaccaccag

SEQ ID NO: 372506 - DNA, 25 bp, Homo sapien
tttaggcaaaccaccagagacacag

SEQ ID NO: 372507 - DNA, 25 bp, Homo sapien
agagacacagggaactgcccgtccc

SEQ ID NO: 372508 - DNA, 25 bp, Homo sapien
ttgaatctcttggaaaaggccatga

SEQ ID NO: 372509 - DNA, 25 bp, Homo sapien
tgaatctcttggaaaaggccatgaa

SEQ ID NO: 372510 - DNA, 25 bp, Homo sapien
gaatctcttggaaaaggccatgaag

SEQ ID NO: 372511 - DNA, 25 bp, Homo sapien
aaggccatgaagaataaagcagtca

SEQ ID NO: 372512 - DNA, 25 bp, Homo sapien
ggccatgaagaataaagcagtcaaa

SEQ ID NO: 372513 - DNA, 25 bp, Homo sapien
gcagtcaaaaagaagtcctccatgt

SEQ ID NO: 372514 - DNA, 25 bp, Homo sapien
aagaagtcctccatgttggtgccaa

SEQ ID NO: 372515 - DNA, 25 bp, Homo sapien
tcctccatgttggtgccaaggactt

SEQ ID NO: 372516 - DNA, 25 bp, Homo sapien
tgccaaggacttgcgaggggaaata

SEQ ID NO: 372517 - DNA, 25 bp, Homo sapien
ataaaaatgttatccagcctgacca

SEQ ID NO: 372518 - DNA, 25 bp, Homo sapien
taaaaatgttatccagcctgaccaa

SEQ ID NO: 372519 - DNA, 25 bp, Homo sapien
gttcttaggaacagactcgatgcaa

SEQ ID NO: 372520 - DNA, 25 bp, Homo sapien
cgatgcaagtgtttctgttctggga

SEQ ID NO: 372521 - DNA, 25 bp, Homo sapien
aggatggctggaacactgtactgag

SEQ ID NO: 372522 - DNA, 25 bp, Homo sapien
aaaggcttccagatgtctaaaagat

SEQ ID NO: 372523 - DNA, 25 bp, Homo sapien
taaactactgaactgttacctaggt

SEQ ID NO: 372524 - DNA, 25 bp, Homo sapien
tacctaggttaacaaccctgttgag

SEQ ID NO: 372525 - DNA, 25 bp, Homo sapien
ccctgttgagtatttgctgtttgtc

SEQ ID NO: 372526 - DNA, 25 bp, Homo sapien
gctgtttgtccagttcaggaatttt

SEQ ID NO: 372527 - DNA, 25 bp, Homo sapien
gttttgtctatatgtgcggcttttc

SEQ ID NO: 372528 - DNA, 25 bp, Homo sapien
atatgtgcggcttttcagaagaaat

SEQ ID NO: 372529 - DNA, 25 bp, Homo sapien
tatggtagcttttactttttatgaa

SEQ ID NO: 372530 - DNA, 25 bp, Homo sapien
cttttcttcgtacaatctccttaga

SEQ ID NO: 372531 - DNA, 25 bp, Homo sapien
agaacagctggaatcatttcgcggg

SEQ ID NO: 372532 - DNA, 25 bp, Homo sapien
gctaacaacagtcagtgccatacac

SEQ ID NO: 372533 - DNA, 25 bp, Homo sapien
gtgccatacacacttctactaggtt

SEQ ID NO: 372534 - DNA, 25 bp, Homo sapien
acttctactaggttagtgctctgca

SEQ ID NO: 372535 - DNA, 25 bp, Homo sapien
gttagtgctctgcagatcctttaca

SEQ ID NO: 372536 - DNA, 25 bp, Homo sapien
gatcctttacaactgtattcacaag

SEQ ID NO: 372537 - DNA, 25 bp, Homo sapien
aggaaacagccaaataacctactct

SEQ ID NO: 372538 - DNA, 25 bp, Homo sapien
ttctaagaggtttccttgttgggct

SEQ ID NO: 372539 - DNA, 25 bp, Homo sapien
ccttgttgggctaacttgattgcat

SEQ ID NO: 372540 - DNA, 25 bp, Homo sapien
aaggaagcatcatatccaagcattt

SEQ ID NO: 372541 - DNA, 25 bp, Homo sapien
agcctcaacccctgcttggagggca

SEQ ID NO: 372542 - DNA, 25 bp, Homo sapien
tcaacccctgcttggagggcagtgc

SEQ ID NO: 372543 - DNA, 25 bp, Homo sapien
agcagtggcagtgagagctccaaag

SEQ ID NO: 372544 - DNA, 25 bp, Homo sapien
agtgagagctccaaagatagttcga

SEQ ID NO: 372545 - DNA, 25 bp, Homo sapien
aagatagttcgagatgttccacccc

SEQ ID NO: 372546 - DNA, 25 bp, Homo sapien
atagttcgagatgttccaccccggg

SEQ ID NO: 372547 - DNA, 25 bp, Homo sapien
tcgagatgttccaccccgggcctgg

SEQ ID NO: 372548 - DNA, 25 bp, Homo sapien
accctgagcggcatgagagactccg

SEQ ID NO: 372549 - DNA, 25 bp, Homo sapien
cggcgattggaatctggtgacaagt

SEQ ID NO: 372550 - DNA, 25 bp, Homo sapien
tggtgacaagtggttctccctggaa

SEQ ID NO: 372551 - DNA, 25 bp, Homo sapien
acaagtggttctccctggaattctt

SEQ ID NO: 372552 - DNA, 25 bp, Homo sapien
taagcagttgaagtaaaacctgtag

SEQ ID NO: 372553 - DNA, 25 bp, Homo sapien
aaacctgtagtgagttcttcagtca

SEQ ID NO: 372554 - DNA, 25 bp, Homo sapien
gtgagttcttcagtcagtcaacact

SEQ ID NO: 372555 - DNA, 25 bp, Homo sapien
gtcagtcaacactaaacctgttttg

SEQ ID NO: 372556 - DNA, 25 bp, Homo sapien
atttgatgctagtattacactggac

SEQ ID NO: 372557 - DNA, 25 bp, Homo sapien
agtattacactggactttctcaaaa

SEQ ID NO: 372558 - DNA, 25 bp, Homo sapien
atgaagtacacctatatatgcatat

SEQ ID NO: 372559 - DNA, 25 bp, Homo sapien
gtatatgagcatgcgtatttgtaca

SEQ ID NO: 372560 - DNA, 25 bp, Homo sapien
gcgtatttgtacaaaagcccttcaa

SEQ ID NO: 372561 - DNA, 25 bp, Homo sapien
tataaacaccaaaacactctctgcc

SEQ ID NO: 372562 - DNA, 25 bp, Homo sapien
atagatgtacttaccttacacagta

SEQ ID NO: 372563 - DNA, 25 bp, Homo sapien
ggtcaggctggataacatttttatt

SEQ ID NO: 372564 - DNA, 25 bp, Homo sapien
ttttatttcccctcgcaagtccttg

SEQ ID NO: 372565 - DNA, 25 bp, Homo sapien
aagtccttggcaccaacatggagga

SEQ ID NO: 372566 - DNA, 25 bp, Homo sapien
catggccttttccaagagattcaaa

SEQ ID NO: 372567 - DNA, 25 bp, Homo sapien
gagattcaaatgctccttattcttt

SEQ ID NO: 372568 - DNA, 25 bp, Homo sapien
aaatgctccttattctttaagtggg

SEQ ID NO: 372569 - DNA, 25 bp, Homo sapien
aggtagaggcaaagtctgtccccac

SEQ ID NO: 372570 - DNA, 25 bp, Homo sapien
cccaccatctttaaactgcgtacaa

SEQ ID NO: 372571 - DNA, 25 bp, Homo sapien
taaactgcgtacaagtttggaagcc

SEQ ID NO: 372572 - DNA, 25 bp, Homo sapien
gggcatacttgtcctgagtagtaag

SEQ ID NO: 372573 - DNA, 25 bp, Homo sapien
agtagtaagccatggtgtcctctcc

SEQ ID NO: 372574 - DNA, 25 bp, Homo sapien
ctggcccacgggagcttactaatga

SEQ ID NO: 372575 - DNA, 25 bp, Homo sapien
tggcccacgggagcttactaatgat

SEQ ID NO: 372576 - DNA, 25 bp, Homo sapien
gcccacgggagcttactaatgatga

SEQ ID NO: 372577 - DNA, 25 bp, Homo sapien
aatgatgaaccacccgaccaacacg

SEQ ID NO: 372578 - DNA, 25 bp, Homo sapien
gtaccacagtcttcccgtgagaaag

SEQ ID NO: 372579 - DNA, 25 bp, Homo sapien
gaaagaaggttctggctccacgggt

SEQ ID NO: 372580 - DNA, 25 bp, Homo sapien
gctccacgggtgaatctgacttttc

SEQ ID NO: 372581 - DNA, 25 bp, Homo sapien
ctgtctccttcggtgcctgcagaga

SEQ ID NO: 372582 - DNA, 25 bp, Homo sapien
gtctccttcggtgcctgcagagact

SEQ ID NO: 372583 - DNA, 25 bp, Homo sapien
tgcagagactttgtcttccggcata

SEQ ID NO: 372584 - DNA, 25 bp, Homo sapien
ttccggcataaggattcccgtggga

SEQ ID NO: 372585 - DNA, 25 bp, Homo sapien
ataagtgatagacgtgacaaagcct

SEQ ID NO: 372586 - DNA, 25 bp, Homo sapien
aagtgatagacgtgacaaagcctga

SEQ ID NO: 372587 - DNA, 25 bp, Homo sapien
agtgatagacgtgacaaagcctgaa

SEQ ID NO: 372588 - DNA, 25 bp, Homo sapien
gtgatagacgtgacaaagcctgaag

SEQ ID NO: 372589 - DNA, 25 bp, Homo sapien
gatagacgtgacaaagcctgaagaa

SEQ ID NO: 372590 - DNA, 25 bp, Homo sapien
atagacgtgacaaagcctgaagaat

SEQ ID NO: 372591 - DNA, 25 bp, Homo sapien
tagacgtgacaaagcctgaagaatg

SEQ ID NO: 372592 - DNA, 25 bp, Homo sapien
agacgtgacaaagcctgaagaatga

SEQ ID NO: 372593 - DNA, 25 bp, Homo sapien
gaagaatgaatgaaagtcagccaaa

SEQ ID NO: 372594 - DNA, 25 bp, Homo sapien
aaagtaaagggcttcaagcaattgt

SEQ ID NO: 372595 - DNA, 25 bp, Homo sapien
gaaggggcaactaatccaggattgg

SEQ ID NO: 372596 - DNA, 25 bp, Homo sapien
atgaggacgcgctcgggacactcac

SEQ ID NO: 372597 - DNA, 25 bp, Homo sapien
ggacgcgctcgggacactcacgttt

SEQ ID NO: 372598 - DNA, 25 bp, Homo sapien
gacgcgctcgggacactcacgtttt

SEQ ID NO: 372599 - DNA, 25 bp, Homo sapien
acctgcgtcctctcgggacagtggc

SEQ ID NO: 372600 - DNA, 25 bp, Homo sapien
ctgcgtcctctcgggacagtggcgt

SEQ ID NO: 372601 - DNA, 25 bp, Homo sapien
gcgctcgggacactcacgttttctg

SEQ ID NO: 372602 - DNA, 25 bp, Homo sapien
actcacgttttctgcaccggcttcc

SEQ ID NO: 372603 - DNA, 25 bp, Homo sapien
gcttccgccgcttgcgactggcgta

SEQ ID NO: 372604 - DNA, 25 bp, Homo sapien
tccgccgcttgcgactggcgtaggt

SEQ ID NO: 372605 - DNA, 25 bp, Homo sapien
cttgcgactggcgtaggtgatgttg

SEQ ID NO: 372606 - DNA, 25 bp, Homo sapien
tggcgtaggtgatgttggcgctgct

SEQ ID NO: 372607 - DNA, 25 bp, Homo sapien
aaatgcgtgatcagagaatccttca

SEQ ID NO: 372608 - DNA, 25 bp, Homo sapien
catcctgtctatcttctcagttgag

SEQ ID NO: 372609 - DNA, 25 bp, Homo sapien
cctgtctatcttctcagttgagttt

SEQ ID NO: 372610 - DNA, 25 bp, Homo sapien
tgagtttttaatctcactttgggtt

SEQ ID NO: 372611 - DNA, 25 bp, Homo sapien
tccttgtgaagttggagggaagttt

SEQ ID NO: 372612 - DNA, 25 bp, Homo sapien
ttataatagcctaacactaccccac

SEQ ID NO: 372613 - DNA, 25 bp, Homo sapien
aggaggaacctctgttttcaagaga

SEQ ID NO: 372614 - DNA, 25 bp, Homo sapien
gttttcaagagagatgcctgtcctg

SEQ ID NO: 372615 - DNA, 25 bp, Homo sapien
ttcaagagagatgcctgtcctgtgc

SEQ ID NO: 372616 - DNA, 25 bp, Homo sapien
gtcctgtgcttggatagtcagtcaa

SEQ ID NO: 372617 - DNA, 25 bp, Homo sapien
ttggatagtcagtcaattatttgtg

SEQ ID NO: 372618 - DNA, 25 bp, Homo sapien
tttcgtttcgttcttggtgcttgca

SEQ ID NO: 372619 - DNA, 25 bp, Homo sapien
ggtgcttgcagtggttttactttct

SEQ ID NO: 372620 - DNA, 25 bp, Homo sapien
ttttatgcttctctagatgtcacat

SEQ ID NO: 372621 - DNA, 25 bp, Homo sapien
gaattcctgaattatcaaacatggg

SEQ ID NO: 372622 - DNA, 25 bp, Homo sapien
gtatcagttgatgattggccagtca

SEQ ID NO: 372623 - DNA, 25 bp, Homo sapien
gggatcatttacctgtgcaaaccat

SEQ ID NO: 372624 - DNA, 25 bp, Homo sapien
attggccagtcatgatcacacgtgc

SEQ ID NO: 372625 - DNA, 25 bp, Homo sapien
gatcacacgtgcattttcttgactt

SEQ ID NO: 372626 - DNA, 25 bp, Homo sapien
ttgacttttgtgctgccacaatctt

SEQ ID NO: 372627 - DNA, 25 bp, Homo sapien
gtgctgccacaatcttttttgctgt

SEQ ID NO: 372628 - DNA, 25 bp, Homo sapien
tttttgctgtgctcattttcgtttc

SEQ ID NO: 372629 - DNA, 25 bp, Homo sapien
ataagtgatagacgtgacaaagcct

SEQ ID NO: 372630 - DNA, 25 bp, Homo sapien
aagtgatagacgtgacaaagcctga

SEQ ID NO: 372631 - DNA, 25 bp, Homo sapien
gtgatagacgtgacaaagcctgaag

SEQ ID NO: 372632 - DNA, 25 bp, Homo sapien
gatagacgtgacaaagcctgaagaa

SEQ ID NO: 372633 - DNA, 25 bp, Homo sapien
atagacgtgacaaagcctgaagaat

SEQ ID NO: 372634 - DNA, 25 bp, Homo sapien
agacgtgacaaagcctgaagaatga

SEQ ID NO: 372635 - DNA, 25 bp, Homo sapien
gaagaatgaatgaaagtcagccaaa

SEQ ID NO: 372636 - DNA, 25 bp, Homo sapien
gaatgaaagtcagccaaagacgtgg

SEQ ID NO: 372637 - DNA, 25 bp, Homo sapien
aagtcagccaaagacgtggagaagg

SEQ ID NO: 372638 - DNA, 25 bp, Homo sapien
aaagtaaagggcttcaagcaattgt

SEQ ID NO: 372639 - DNA, 25 bp, Homo sapien
gaaggggcaactaatccaggattgg

SEQ ID NO: 372640 - DNA, 25 bp, Homo sapien
aaaacttgtttgtgtcaggaagtga

SEQ ID NO: 372641 - DNA, 25 bp, Homo sapien
gtacggagatatgacctggaaggta

SEQ ID NO: 372642 - DNA, 25 bp, Homo sapien
tggcagtttttgcattacttttctg

SEQ ID NO: 372643 - DNA, 25 bp, Homo sapien
gtttttgcattacttttctgaccac

SEQ ID NO: 372644 - DNA, 25 bp, Homo sapien
ttgcattacttttctgaccacattc

SEQ ID NO: 372645 - DNA, 25 bp, Homo sapien
aaatggtgacaagaaggcggtctgc

SEQ ID NO: 372646 - DNA, 25 bp, Homo sapien
gaaggcggtctgctgtaaaattcgt

SEQ ID NO: 372647 - DNA, 25 bp, Homo sapien
acataattatccctagccataccat

SEQ ID NO: 372648 - DNA, 25 bp, Homo sapien
attatccctagccataccatacttg

SEQ ID NO: 372649 - DNA, 25 bp, Homo sapien
atccctagccataccatacttgcta

SEQ ID NO: 372650 - DNA, 25 bp, Homo sapien
gctagacgctagaaagtatacatat

SEQ ID NO: 372651 - DNA, 25 bp, Homo sapien
gaaatacctgttaaaagcttggctt

SEQ ID NO: 372652 - DNA, 25 bp, Homo sapien
cttggctttccttatatgagtgagg

SEQ ID NO: 372653 - DNA, 25 bp, Homo sapien
tatgagtgaggctcccagcttgggt

SEQ ID NO: 372654 - DNA, 25 bp, Homo sapien
ctgggctcacggatcagcttgctgg

SEQ ID NO: 372655 - DNA, 25 bp, Homo sapien
tagagagacacatgctcccttctca

SEQ ID NO: 372656 - DNA, 25 bp, Homo sapien
atgctcccttctcatcgtagagagc

SEQ ID NO: 372657 - DNA, 25 bp, Homo sapien
tcatcgtagagagcctgcatgctga

SEQ ID NO: 372658 - DNA, 25 bp, Homo sapien
cctgcatgctgagaggctcccttta

SEQ ID NO: 372659 - DNA, 25 bp, Homo sapien
tcgctggcttttcctttagacctag

SEQ ID NO: 372660 - DNA, 25 bp, Homo sapien
ttagacctagccaccagtgttttga

SEQ ID NO: 372661 - DNA, 25 bp, Homo sapien
tagccaccagtgttttgaatcatgg

SEQ ID NO: 372662 - DNA, 25 bp, Homo sapien
aggagtgaggcaacaggcacccgaa

SEQ ID NO: 372663 - DNA, 25 bp, Homo sapien
gaggcaacaggcacccgaagtccct

SEQ ID NO: 372664 - DNA, 25 bp, Homo sapien
tccttccctctgtgtgctctgaata

SEQ ID NO: 372665 - DNA, 25 bp, Homo sapien
cctctgtgtgctctgaatatgtcct

SEQ ID NO: 372666 - DNA, 25 bp, Homo sapien
gggtgtgggctcacagatccctatc

SEQ ID NO: 372667 - DNA, 25 bp, Homo sapien
agatccctatcagcctggttcgtgg

SEQ ID NO: 372668 - DNA, 25 bp, Homo sapien
tggttcgtgggagggctcttcctaa

SEQ ID NO: 372669 - DNA, 25 bp, Homo sapien
cccatctctaagtcactctgaaagg

SEQ ID NO: 372670 - DNA, 25 bp, Homo sapien
tggagaggagacgcctccagactct

SEQ ID NO: 372671 - DNA, 25 bp, Homo sapien
ttttgaggactgaactgggtcactc

SEQ ID NO: 372672 - DNA, 25 bp, Homo sapien
ctgaactgggtcactcgggatctgt

SEQ ID NO: 372673 - DNA, 25 bp, Homo sapien
gataaggttttatagccagattcag

SEQ ID NO: 372674 - DNA, 25 bp, Homo sapien
ttatagccagattcagtggcagacc

SEQ ID NO: 372675 - DNA, 25 bp, Homo sapien
gtggcagaccatgatttaagaaatt

SEQ ID NO: 372676 - DNA, 25 bp, Homo sapien
agactactcactgtcaaaatctctc

SEQ ID NO: 372677 - DNA, 25 bp, Homo sapien
aaaatctctccttcctataggaaat

SEQ ID NO: 372678 - DNA, 25 bp, Homo sapien
cttcctataggaaatttagctgagt

SEQ ID NO: 372679 - DNA, 25 bp, Homo sapien
tcttcatccccaatttctctctttt

SEQ ID NO: 372680 - DNA, 25 bp, Homo sapien
gtattctgaactccattctcagctg

SEQ ID NO: 372681 - DNA, 25 bp, Homo sapien
tccattctcagctgggaaagctaca

SEQ ID NO: 372682 - DNA, 25 bp, Homo sapien
ggaaagctacagatccttttagtgc

SEQ ID NO: 372683 - DNA, 25 bp, Homo sapien
gatccttttagtgcaagataaggtt

SEQ ID NO: 372684 - DNA, 25 bp, Homo sapien
aaggcttcaagctagcaatgtattc

SEQ ID NO: 372685 - DNA, 25 bp, Homo sapien
caagctagcaatgtattcgaattac

SEQ ID NO: 372686 - DNA, 25 bp, Homo sapien
tcgaattacagttttcagattgtgg

SEQ ID NO: 372687 - DNA, 25 bp, Homo sapien
tcatttaagtagcaccttttaataa

SEQ ID NO: 372688 - DNA, 25 bp, Homo sapien
gtgtaggcaaaagcacaagtgtttc

SEQ ID NO: 372689 - DNA, 25 bp, Homo sapien
aaagcacaagtgtttcaaatgtaaa

SEQ ID NO: 372690 - DNA, 25 bp, Homo sapien
actttataactgaattctatgtcgt

SEQ ID NO: 372691 - DNA, 25 bp, Homo sapien
gaattctatgtcgttcatacgtaga

SEQ ID NO: 372692 - DNA, 25 bp, Homo sapien
gtcgttcatacgtagagttacagta

SEQ ID NO: 372693 - DNA, 25 bp, Homo sapien
gttacagtaagggtctagtatgtcc

SEQ ID NO: 372694 - DNA, 25 bp, Homo sapien
gggtctagtatgtccaaatcttaat

SEQ ID NO: 372695 - DNA, 25 bp, Homo sapien
gacaagactttctggaagggaaaca

SEQ ID NO: 372696 - DNA, 25 bp, Homo sapien
gagacagaagtcaaggtatagcatg

SEQ ID NO: 372697 - DNA, 25 bp, Homo sapien
gacttggaaaagtcctagcagtaga

SEQ ID NO: 372698 - DNA, 25 bp, Homo sapien
gtccttggttagtaagccttagcaa

SEQ ID NO: 372699 - DNA, 25 bp, Homo sapien
tagcaattcagccttccactgggtt

SEQ ID NO: 372700 - DNA, 25 bp, Homo sapien
actgggttcctctgttgcctccttg

SEQ ID NO: 372701 - DNA, 25 bp, Homo sapien
ccttgccatcatcgtttacatacat

SEQ ID NO: 372702 - DNA, 25 bp, Homo sapien
atatttagtgagtctgcagcaagca

SEQ ID NO: 372703 - DNA, 25 bp, Homo sapien
agcaagcaggctactcagttcacac

SEQ ID NO: 372704 - DNA, 25 bp, Homo sapien
ttcacagatgtttgagtgcttgctg

SEQ ID NO: 372705 - DNA, 25 bp, Homo sapien
cttgctgtgtgctggtacagacaag

SEQ ID NO: 372706 - DNA, 25 bp, Homo sapien
atgggcaagggcagcctttcaactg

SEQ ID NO: 372707 - DNA, 25 bp, Homo sapien
caagggcagcctttcaactgttttt

SEQ ID NO: 372708 - DNA, 25 bp, Homo sapien
agggcagcctttcaactgtttttga

SEQ ID NO: 372709 - DNA, 25 bp, Homo sapien
gcagcctttcaactgtttttgaaca

SEQ ID NO: 372710 - DNA, 25 bp, Homo sapien
atgcagtgttaacatgtatatccag

SEQ ID NO: 372711 - DNA, 25 bp, Homo sapien
gttaacatgtatatccagattctga

SEQ ID NO: 372712 - DNA, 25 bp, Homo sapien
agatcttcccaaactatcattccac

SEQ ID NO: 372713 - DNA, 25 bp, Homo sapien
tcccaaactatcattccacacattt

SEQ ID NO: 372714 - DNA, 25 bp, Homo sapien
tatcattccacacatttaacctcct

SEQ ID NO: 372715 - DNA, 25 bp, Homo sapien
ttaacctccttccataccaaatctt

SEQ ID NO: 372716 - DNA, 25 bp, Homo sapien
cataccaaatctttctcataaggaa

SEQ ID NO: 372717 - DNA, 25 bp, Homo sapien
gaggccgcggagacagctcggagct

SEQ ID NO: 372718 - DNA, 25 bp, Homo sapien
gggagtggcacagcgctggcggatc

SEQ ID NO: 372719 - DNA, 25 bp, Homo sapien
agtggcacagcgctggcggatccag

SEQ ID NO: 372720 - DNA, 25 bp, Homo sapien
agtctccgccgcaggcatagcgcta

SEQ ID NO: 372721 - DNA, 25 bp, Homo sapien
ggcggatccaggtgggcttcacggg

SEQ ID NO: 372722 - DNA, 25 bp, Homo sapien
cgggaccggaaatgacgcgcagaac

SEQ ID NO: 372723 - DNA, 25 bp, Homo sapien
gaccggaaatgacgcgcagaaccct

SEQ ID NO: 372724 - DNA, 25 bp, Homo sapien
gcagaaccctgcatcgggctcctcg

SEQ ID NO: 372725 - DNA, 25 bp, Homo sapien
gcaggcatagcgctaggccccggcg

SEQ ID NO: 372726 - DNA, 25 bp, Homo sapien
ggcgccttcacaacaaagggacgct

SEQ ID NO: 372727 - DNA, 25 bp, Homo sapien
tcacaacaaagggacgctggcgggc

SEQ ID NO: 372728 - DNA, 25 bp, Homo sapien
cttctttgtcttatttctgccttca

SEQ ID NO: 372729 - DNA, 25 bp, Homo sapien
ctgccactgttcaggagcagttgac

SEQ ID NO: 372730 - DNA, 25 bp, Homo sapien
gagcagttgactaaacttttatcct

SEQ ID NO: 372731 - DNA, 25 bp, Homo sapien
tgtttttagttcttacagtggtaat

SEQ ID NO: 372732 - DNA, 25 bp, Homo sapien
cttacagtggtaatcacatcagttt

SEQ ID NO: 372733 - DNA, 25 bp, Homo sapien
atcagtttggcaatctaagatgtct

SEQ ID NO: 372734 - DNA, 25 bp, Homo sapien
gatgtctttatcaagggtcagccct

SEQ ID NO: 372735 - DNA, 25 bp, Homo sapien
agggtcagcccttttctatttggag

SEQ ID NO: 372736 - DNA, 25 bp, Homo sapien
gcccttttctatttggagctgaatc

SEQ ID NO: 372737 - DNA, 25 bp, Homo sapien
ttggagctgaatcttttctttcatg

SEQ ID NO: 372738 - DNA, 25 bp, Homo sapien
atctgcaggataatattgtttcaaa

SEQ ID NO: 372739 - DNA, 25 bp, Homo sapien
gttgtagtctccacttcagtcagaa

SEQ ID NO: 372740 - DNA, 25 bp, Homo sapien
aagccctggtgttccaaactcagtc

SEQ ID NO: 372741 - DNA, 25 bp, Homo sapien
tggtgttccaaactcagtctttcct

SEQ ID NO: 372742 - DNA, 25 bp, Homo sapien
tgttccaaactcagtctttcctgaa

SEQ ID NO: 372743 - DNA, 25 bp, Homo sapien
cctgaagaagaggatctgagttatc

SEQ ID NO: 372744 - DNA, 25 bp, Homo sapien
gaggatctgagttatcttctgaaac

SEQ ID NO: 372745 - DNA, 25 bp, Homo sapien
ttatcttctgaaacagcgttctccc

SEQ ID NO: 372746 - DNA, 25 bp, Homo sapien
tgaaacagcgttctcccttcccagt

SEQ ID NO: 372747 - DNA, 25 bp, Homo sapien
ccttcccagttgtatcactcttata

SEQ ID NO: 372748 - DNA, 25 bp, Homo sapien
ttcccagttgtatcactcttataaa

SEQ ID NO: 372749 - DNA, 25 bp, Homo sapien
actcttataaaaagactgtccagtc

SEQ ID NO: 372750 - DNA, 25 bp, Homo sapien
agacactcaaactcccaaagcgcat

SEQ ID NO: 372751 - DNA, 25 bp, Homo sapien
tcaaactcccaaagcgcatgattgc

SEQ ID NO: 372752 - DNA, 25 bp, Homo sapien
aagcgcatgattgctgggaaacagt

SEQ ID NO: 372753 - DNA, 25 bp, Homo sapien
aaccagacttgccttgaaagtgttt

SEQ ID NO: 372754 - DNA, 25 bp, Homo sapien
gtttaagttattcgacggaggacag

SEQ ID NO: 372755 - DNA, 25 bp, Homo sapien
ttattcgacggaggacagagtatgt

SEQ ID NO: 372756 - DNA, 25 bp, Homo sapien
gacagagtatgtgagcctttgccga

SEQ ID NO: 372757 - DNA, 25 bp, Homo sapien
gagtatgtgagcctttgccgaacaa

SEQ ID NO: 372758 - DNA, 25 bp, Homo sapien
gagcctttgccgaacaaacaaacgt

SEQ ID NO: 372759 - DNA, 25 bp, Homo sapien
tatttattgtgagaacagccagttc

SEQ ID NO: 372760 - DNA, 25 bp, Homo sapien
cagccagttcatagtgggacttgta

SEQ ID NO: 372761 - DNA, 25 bp, Homo sapien
aatttatgttgtgatcttgcctgaa

SEQ ID NO: 372762 - DNA, 25 bp, Homo sapien
gtgatcttgcctgaacaaattatat

SEQ ID NO: 372763 - DNA, 25 bp, Homo sapien
aactttctattaatagttcacgcaa

SEQ ID NO: 372764 - DNA, 25 bp, Homo sapien
gttcacgcaagagaaaacactttca

SEQ ID NO: 372765 - DNA, 25 bp, Homo sapien
aacactttcaacatagtcgaaggct

SEQ ID NO: 372766 - DNA, 25 bp, Homo sapien
ttcaacatagtcgaaggcttcaaga

SEQ ID NO: 372767 - DNA, 25 bp, Homo sapien
cttcaagatctaagtgtatcagact

SEQ ID NO: 372768 - DNA, 25 bp, Homo sapien
gggaaaaagtggcacaaccttcgat

SEQ ID NO: 372769 - DNA, 25 bp, Homo sapien
gtggcacaaccttcgatttaaaatt

SEQ ID NO: 372770 - DNA, 25 bp, Homo sapien
tagctattacgttctattaagttgt

SEQ ID NO: 372771 - DNA, 25 bp, Homo sapien
ttctggaagacaattttattttaca

SEQ ID NO: 372772 - DNA, 25 bp, Homo sapien
gggtctcaaggccccatacccattg

SEQ ID NO: 372773 - DNA, 25 bp, Homo sapien
aaaatgaggataccaagtccagaac

SEQ ID NO: 372774 - DNA, 25 bp, Homo sapien
gaggataccaagtccagaacagttt

SEQ ID NO: 372775 - DNA, 25 bp, Homo sapien
gataccaagtccagaacagtttttg

SEQ ID NO: 372776 - DNA, 25 bp, Homo sapien
caagtccagaacagtttttggttat

SEQ ID NO: 372777 - DNA, 25 bp, Homo sapien
gttattaacctataaaacctcaatg

SEQ ID NO: 372778 - DNA, 25 bp, Homo sapien
ttaacctataaaacctcaatgcata

SEQ ID NO: 372779 - DNA, 25 bp, Homo sapien
aaaacctcaatgcataaatctttgt

SEQ ID NO: 372780 - DNA, 25 bp, Homo sapien
cctcaatgcataaatctttgttata

SEQ ID NO: 372781 - DNA, 25 bp, Homo sapien
taatatgatcataaatgtcacctca

SEQ ID NO: 372782 - DNA, 25 bp, Homo sapien
atacccattggcaagagacccaccc

SEQ ID NO: 372783 - DNA, 25 bp, Homo sapien
tactgtacttgaatcttcaagctaa

SEQ ID NO: 372784 - DNA, 25 bp, Homo sapien
gaatcttcaagctaactcactttca

SEQ ID NO: 372785 - DNA, 25 bp, Homo sapien
atcttcaagctaactcactttcaga

SEQ ID NO: 372786 - DNA, 25 bp, Homo sapien
cttcaagctaactcactttcagaaa

SEQ ID NO: 372787 - DNA, 25 bp, Homo sapien
caagctaactcactttcagaaaaaa

SEQ ID NO: 372788 - DNA, 25 bp, Homo sapien
gaatagcatatgaaagtgggagaga

SEQ ID NO: 372789 - DNA, 25 bp, Homo sapien
tgtgcccggccgcaaccttcaatta

SEQ ID NO: 372790 - DNA, 25 bp, Homo sapien
ccggccgcaaccttcaattatttag

SEQ ID NO: 372791 - DNA, 25 bp, Homo sapien
ctaacctgctcaacaaagggagacc

SEQ ID NO: 372792 - DNA, 25 bp, Homo sapien
gtctcaacagacaaaaacatggaat

SEQ ID NO: 372793 - DNA, 25 bp, Homo sapien
tataaagcctaaactaaatgcactt

SEQ ID NO: 372794 - DNA, 25 bp, Homo sapien
cgtgagccccagcactaggtgggaa

SEQ ID NO: 372795 - DNA, 25 bp, Homo sapien
gtgagccccagcactaggtgggaag

SEQ ID NO: 372796 - DNA, 25 bp, Homo sapien
tgagccccagcactaggtgggaagg

SEQ ID NO: 372797 - DNA, 25 bp, Homo sapien
gagccccagcactaggtgggaaggc

SEQ ID NO: 372798 - DNA, 25 bp, Homo sapien
agccccagcactaggtgggaaggct

SEQ ID NO: 372799 - DNA, 25 bp, Homo sapien
gccccagcactaggtgggaaggctg

SEQ ID NO: 372800 - DNA, 25 bp, Homo sapien
ccccagcactaggtgggaaggctgc

SEQ ID NO: 372801 - DNA, 25 bp, Homo sapien
cccagcactaggtgggaaggctgct

SEQ ID NO: 372802 - DNA, 25 bp, Homo sapien
ccagcactaggtgggaaggctgctg

SEQ ID NO: 372803 - DNA, 25 bp, Homo sapien
cagcactaggtgggaaggctgctga

SEQ ID NO: 372804 - DNA, 25 bp, Homo sapien
gagacgcgggccaccctcggtcctc

SEQ ID NO: 372805 - DNA, 25 bp, Homo sapien
gccttgggggttcctgaactcccag

SEQ ID NO: 372806 - DNA, 25 bp, Homo sapien
tcctgaactcccagccttgagacct

SEQ ID NO: 372807 - DNA, 25 bp, Homo sapien
tgaactcccagccttgagacctacc

SEQ ID NO: 372808 - DNA, 25 bp, Homo sapien
aactcccagccttgagacctaccat

SEQ ID NO: 372809 - DNA, 25 bp, Homo sapien
tcccagccttgagacctaccatcag

SEQ ID NO: 372810 - DNA, 25 bp, Homo sapien
agggtcctgtgcgtcttcctacgga

SEQ ID NO: 372811 - DNA, 25 bp, Homo sapien
gggacccgctatgaggtgcgtgaag

SEQ ID NO: 372812 - DNA, 25 bp, Homo sapien
gacccgctatgaggtgcgtgaagtg

SEQ ID NO: 372813 - DNA, 25 bp, Homo sapien
gaggtgcgtgaagtgggcaggccct

SEQ ID NO: 372814 - DNA, 25 bp, Homo sapien
ggtgcgtgaagtgggcaggccctgt

SEQ ID NO: 372815 - DNA, 25 bp, Homo sapien
ttcccctgtgttcaacactacaaag

SEQ ID NO: 372816 - DNA, 25 bp, Homo sapien
gttcaacactacaaagctactcctg

SEQ ID NO: 372817 - DNA, 25 bp, Homo sapien
aaagctactcctgccagaagagggc

SEQ ID NO: 372818 - DNA, 25 bp, Homo sapien
agagggcagagttctttcttgggtt

SEQ ID NO: 372819 - DNA, 25 bp, Homo sapien
tctttcttgggtttgaactggcttt

SEQ ID NO: 372820 - DNA, 25 bp, Homo sapien
atcccacatccttagcactacttaa

SEQ ID NO: 372821 - DNA, 25 bp, Homo sapien
tagcactacttaaccttcttttcct

SEQ ID NO: 372822 - DNA, 25 bp, Homo sapien
tacttaaccttcttttcctgaagat

SEQ ID NO: 372823 - DNA, 25 bp, Homo sapien
atatcagtgtcctgcgtttttatct

SEQ ID NO: 372824 - DNA, 25 bp, Homo sapien
aatattagagctgaggttcctagga

SEQ ID NO: 372825 - DNA, 25 bp, Homo sapien
gtttgtcagtataaggccctgtggg

SEQ ID NO: 372826 - DNA, 25 bp, Homo sapien
gcaaattgagcttgggtgattttta

SEQ ID NO: 372827 - DNA, 25 bp, Homo sapien
tagattatcatcttgtgagaagaga

SEQ ID NO: 372828 - DNA, 25 bp, Homo sapien
gtttaaacgtggtaaatcacttcat

SEQ ID NO: 372829 - DNA, 25 bp, Homo sapien
ggtgcaataatttagtagcattagc

SEQ ID NO: 372830 - DNA, 25 bp, Homo sapien
agcattagctttagttacaaatata

SEQ ID NO: 372831 - DNA, 25 bp, Homo sapien
ggatctttctgctgacaacttaggt

SEQ ID NO: 372832 - DNA, 25 bp, Homo sapien
tctttctgctgacaacttaggttgt

SEQ ID NO: 372833 - DNA, 25 bp, Homo sapien
cttaggttgtatgagttatgcttaa

SEQ ID NO: 372834 - DNA, 25 bp, Homo sapien
taaatctgatgtttcctgtacctgc

SEQ ID NO: 372835 - DNA, 25 bp, Homo sapien
ctgtacctgccacactatgttagaa

SEQ ID NO: 372836 - DNA, 25 bp, Homo sapien
gtacctgccacactatgttagaatg

SEQ ID NO: 372837 - DNA, 25 bp, Homo sapien
ggaggttctcctgcgtcactttctg

SEQ ID NO: 372838 - DNA, 25 bp, Homo sapien
cttcctggtttctgtggctccaatt

SEQ ID NO: 372839 - DNA, 25 bp, Homo sapien
gtttctgtggctccaattttctatg

SEQ ID NO: 372840 - DNA, 25 bp, Homo sapien
gtggctccaattttctatgcagccc

SEQ ID NO: 372841 - DNA, 25 bp, Homo sapien
ttaaatgaggtttccccttcatgga

SEQ ID NO: 372842 - DNA, 25 bp, Homo sapien
aggtttccccttcatggaagtgctg

SEQ ID NO: 372843 - DNA, 25 bp, Homo sapien
atggaagtgctgctgacccttcgtg

SEQ ID NO: 372844 - DNA, 25 bp, Homo sapien
tgctgacccttcgtgcagaaatggg

SEQ ID NO: 372845 - DNA, 25 bp, Homo sapien
ccctttgtgcgtggctggtcgtatt

SEQ ID NO: 372846 - DNA, 25 bp, Homo sapien
ggctggtcgtattcgggcagccctc

SEQ ID NO: 372847 - DNA, 25 bp, Homo sapien
gcagccctccgtcgctttttataaa

SEQ ID NO: 372848 - DNA, 25 bp, Homo sapien
taagaatggagcttaaccatgcctc

SEQ ID NO: 372849 - DNA, 25 bp, Homo sapien
aaccatgcctccattgggaagtcta

SEQ ID NO: 372850 - DNA, 25 bp, Homo sapien
aagtctagactttgagccaggtaca

SEQ ID NO: 372851 - DNA, 25 bp, Homo sapien
actttgagccaggtacagtaagaaa

SEQ ID NO: 372852 - DNA, 25 bp, Homo sapien
gaaaaattagcctctgattcattaa

SEQ ID NO: 372853 - DNA, 25 bp, Homo sapien
gcctctgattcattaagtttgccac

SEQ ID NO: 372854 - DNA, 25 bp, Homo sapien
gtttgccacatgacttattttgata

SEQ ID NO: 372855 - DNA, 25 bp, Homo sapien
ttggatacattaactcacttaggag

SEQ ID NO: 372856 - DNA, 25 bp, Homo sapien
atgggtgattaaagttcattacagc

SEQ ID NO: 372857 - DNA, 25 bp, Homo sapien
atgtgtctaaaacagactcttgtat

SEQ ID NO: 372858 - DNA, 25 bp, Homo sapien
ttatcaccttagcagaaaaaccaca

SEQ ID NO: 372859 - DNA, 25 bp, Homo sapien
gtccatgctgaatggggcccttgaa

SEQ ID NO: 372860 - DNA, 25 bp, Homo sapien
tggggcccttgaaagatccactgga

SEQ ID NO: 372861 - DNA, 25 bp, Homo sapien
ttctttgcccggctgcggccactta

SEQ ID NO: 372862 - DNA, 25 bp, Homo sapien
gatgccccttgatctcctgcagttt

SEQ ID NO: 372863 - DNA, 25 bp, Homo sapien
agctctgcatcatccggtcgtgctc

SEQ ID NO: 372864 - DNA, 25 bp, Homo sapien
gccacagccctccaggcagagagct

SEQ ID NO: 372865 - DNA, 25 bp, Homo sapien
aggcagagagctctctggtccacct

SEQ ID NO: 372866 - DNA, 25 bp, Homo sapien
tttcagcaacaagacgtgggatttc

SEQ ID NO: 372867 - DNA, 25 bp, Homo sapien
cagcaacaagacgtgggatttcccc

SEQ ID NO: 372868 - DNA, 25 bp, Homo sapien
gtgttgcagatttcataaaggaaac

SEQ ID NO: 372869 - DNA, 25 bp, Homo sapien
taaaggaaactgctccggggctaag

SEQ ID NO: 372870 - DNA, 25 bp, Homo sapien
agctccaggtcatcggtgatgtcct

SEQ ID NO: 372871 - DNA, 25 bp, Homo sapien
aggtcatcggtgatgtcctcttcat

SEQ ID NO: 372872 - DNA, 25 bp, Homo sapien
tcatcggtgatgtcctcttcattct

SEQ ID NO: 372873 - DNA, 25 bp, Homo sapien
tccatggctccctacttagaagttg

SEQ ID NO: 372874 - DNA, 25 bp, Homo sapien
atggctccctacttagaagttggcc

SEQ ID NO: 372875 - DNA, 25 bp, Homo sapien
gctccctacttagaagttggccttt

SEQ ID NO: 372876 - DNA, 25 bp, Homo sapien
tccctacttagaagttggcctttag

SEQ ID NO: 372877 - DNA, 25 bp, Homo sapien
tatgtaataggctgacatggctcaa

SEQ ID NO: 372878 - DNA, 25 bp, Homo sapien
ataggctgacatggctcaaaattga

SEQ ID NO: 372879 - DNA, 25 bp, Homo sapien
ggctgacatggctcaaaattgaaaa

SEQ ID NO: 372880 - DNA, 25 bp, Homo sapien
gaaaagtgtagccagtgatgagaac

SEQ ID NO: 372881 - DNA, 25 bp, Homo sapien
taaaacagctgaaaattgggacaac

SEQ ID NO: 372882 - DNA, 25 bp, Homo sapien
aaattgggacaacatactttacgca

SEQ ID NO: 372883 - DNA, 25 bp, Homo sapien
ttgggacaacatactttacgcaatg

SEQ ID NO: 372884 - DNA, 25 bp, Homo sapien
gggacaacatactttacgcaatgaa

SEQ ID NO: 372885 - DNA, 25 bp, Homo sapien
gacaacatactttacgcaatgaaca

SEQ ID NO: 372886 - DNA, 25 bp, Homo sapien
actttacgcaatgaacagtagttaa

SEQ ID NO: 372887 - DNA, 25 bp, Homo sapien
taagtatacacctagagttttaatt

SEQ ID NO: 372888 - DNA, 25 bp, Homo sapien
tatacacctagagttttaattacct

SEQ ID NO: 372889 - DNA, 25 bp, Homo sapien
gtgaaacttagatacaattgtgatt

SEQ ID NO: 372890 - DNA, 25 bp, Homo sapien
attgtgattggatacttagatacta

SEQ ID NO: 372891 - DNA, 25 bp, Homo sapien
gtgaaacttagtgtaacaattttga

SEQ ID NO: 372892 - DNA, 25 bp, Homo sapien
tgtatctgggcaaaaatggaaactt

SEQ ID NO: 372893 - DNA, 25 bp, Homo sapien
gttcatacaagtacttcacgtggtt

SEQ ID NO: 372894 - DNA, 25 bp, Homo sapien
gtggttaaagaagcccatcccggct

SEQ ID NO: 372895 - DNA, 25 bp, Homo sapien
atcccggctgtgagaatagcgtgca

SEQ ID NO: 372896 - DNA, 25 bp, Homo sapien
atagcgtgcagtagctcgcgcgtta

SEQ ID NO: 372897 - DNA, 25 bp, Homo sapien
gtagctcgcgcgttaagaacgggca

SEQ ID NO: 372898 - DNA, 25 bp, Homo sapien
aagaacgggcagaacgccactcaaa

SEQ ID NO: 372899 - DNA, 25 bp, Homo sapien
cgccactcaaaagcacgtcgggatg

SEQ ID NO: 372900 - DNA, 25 bp, Homo sapien
agactgcccttaccgcgtgagagtg

SEQ ID NO: 372901 - DNA, 25 bp, Homo sapien
gtgagagtgcgtggctttttctcca

SEQ ID NO: 372902 - DNA, 25 bp, Homo sapien
aattaggtgcttgaacttcctcaga

SEQ ID NO: 372903 - DNA, 25 bp, Homo sapien
gtaacgcaccttcaacctgagataa

SEQ ID NO: 372904 - DNA, 25 bp, Homo sapien
agagtcattacgtttcccagtccca

SEQ ID NO: 372905 - DNA, 25 bp, Homo sapien
ccatgtcacattgaccagtcctgtg

SEQ ID NO: 372906 - DNA, 25 bp, Homo sapien
agtcctgtggtcctatggctaagcg

SEQ ID NO: 372907 - DNA, 25 bp, Homo sapien
gctaagcggaggacacggccacaag

SEQ ID NO: 372908 - DNA, 25 bp, Homo sapien
gacacggccacaagctgtgagtcat

SEQ ID NO: 372909 - DNA, 25 bp, Homo sapien
ggcaaagggacccattagccagttt

SEQ ID NO: 372910 - DNA, 25 bp, Homo sapien
gtttacaatgactggcaactgacca

SEQ ID NO: 372911 - DNA, 25 bp, Homo sapien
actgaccagatagagcttaccgtat

SEQ ID NO: 372912 - DNA, 25 bp, Homo sapien
ccgtatgtccatgtagagttgctca

SEQ ID NO: 372913 - DNA, 25 bp, Homo sapien
gagttgctcatattagtctgtaaat

SEQ ID NO: 372914 - DNA, 25 bp, Homo sapien
ggccaccgctgtcagggattgccca

SEQ ID NO: 372915 - DNA, 25 bp, Homo sapien
gccaccgctgtcagggattgcccac

SEQ ID NO: 372916 - DNA, 25 bp, Homo sapien
ccaccgctgtcagggattgcccacc

SEQ ID NO: 372917 - DNA, 25 bp, Homo sapien
caccgctgtcagggattgcccaccc

SEQ ID NO: 372918 - DNA, 25 bp, Homo sapien
accgctgtcagggattgcccacccc

SEQ ID NO: 372919 - DNA, 25 bp, Homo sapien
gctgtcagggattgcccacccctgg

SEQ ID NO: 372920 - DNA, 25 bp, Homo sapien
ctgtcagggattgcccacccctggg

SEQ ID NO: 372921 - DNA, 25 bp, Homo sapien
tgtcagggattgcccacccctgggc

SEQ ID NO: 372922 - DNA, 25 bp, Homo sapien
gtcagggattgcccacccctgggca

SEQ ID NO: 372923 - DNA, 25 bp, Homo sapien
tcagggattgcccacccctgggcat

SEQ ID NO: 372924 - DNA, 25 bp, Homo sapien
aaacctatggttcacattgactttt

SEQ ID NO: 372925 - DNA, 25 bp, Homo sapien
gtattgatcattgtcttttgaagac

SEQ ID NO: 372926 - DNA, 25 bp, Homo sapien
gaagtatgatcagtctctgccactt

SEQ ID NO: 372927 - DNA, 25 bp, Homo sapien
agtctctgccacttgtgctagtttt

SEQ ID NO: 372928 - DNA, 25 bp, Homo sapien
cttgtgctagtttttgtgtggtgtt

SEQ ID NO: 372929 - DNA, 25 bp, Homo sapien
aaacatgggcatttgtctggatcct

SEQ ID NO: 372930 - DNA, 25 bp, Homo sapien
gggcatttgtctggatcctaattac

SEQ ID NO: 372931 - DNA, 25 bp, Homo sapien
gtctggatcctaattacaaataagt

SEQ ID NO: 372932 - DNA, 25 bp, Homo sapien
aagtaacctagaattctcttcagat

SEQ ID NO: 372933 - DNA, 25 bp, Homo sapien
ttctcttcagatagtgcactaacag

SEQ ID NO: 372934 - DNA, 25 bp, Homo sapien
gcactaacagcaatgaatctattct

SEQ ID NO: 372935 - DNA, 25 bp, Homo sapien
agttctggttggaagctggcatcag

SEQ ID NO: 372936 - DNA, 25 bp, Homo sapien
tctagaactgttcttagtttctcta

SEQ ID NO: 372937 - DNA, 25 bp, Homo sapien
gtacatgcaaatttttagcaaggtt

SEQ ID NO: 372938 - DNA, 25 bp, Homo sapien
aagttcagtgaacattgttacaggg

SEQ ID NO: 372939 - DNA, 25 bp, Homo sapien
ttgttacagggatttccattcttca

SEQ ID NO: 372940 - DNA, 25 bp, Homo sapien
tagcaaggttgtgcctaatcaccac

SEQ ID NO: 372941 - DNA, 25 bp, Homo sapien
gttgtgcctaatcaccaccatgaaa

SEQ ID NO: 372942 - DNA, 25 bp, Homo sapien
aaacttctttggaatatgagccttg

SEQ ID NO: 372943 - DNA, 25 bp, Homo sapien
ggaatatgagccttggtgtttacca

SEQ ID NO: 372944 - DNA, 25 bp, Homo sapien
gagccttggtgtttaccagtaggga

SEQ ID NO: 372945 - DNA, 25 bp, Homo sapien
ccagtagggaaatgacaggttgttc

SEQ ID NO: 372946 - DNA, 25 bp, Homo sapien
gaagatacttcttacctggagttat

SEQ ID NO: 372947 - DNA, 25 bp, Homo sapien
gatacttcttacctggagttatata

SEQ ID NO: 372948 - DNA, 25 bp, Homo sapien
acttcttacctggagttatatacta

SEQ ID NO: 372949 - DNA, 25 bp, Homo sapien
ttacctggagttatatactagcaat

SEQ ID NO: 372950 - DNA, 25 bp, Homo sapien
ggagttatatactagcaatattttc

SEQ ID NO: 372951 - DNA, 25 bp, Homo sapien
tattttctgctttcactcttgccct

SEQ ID NO: 372952 - DNA, 25 bp, Homo sapien
ttttttaccaactattgtcacatac

SEQ ID NO: 372953 - DNA, 25 bp, Homo sapien
ttaccaactattgtcacatacatat

SEQ ID NO: 372954 - DNA, 25 bp, Homo sapien
tgtcacatacatataacgcatatag

SEQ ID NO: 372955 - DNA, 25 bp, Homo sapien
aacgcatatagacatatggacacac

SEQ ID NO: 372956 - DNA, 25 bp, Homo sapien
atatggacacacagaagatacttct

SEQ ID NO: 372957 - DNA, 25 bp, Homo sapien
cagtattgagttgctgctcttctta

SEQ ID NO: 372958 - DNA, 25 bp, Homo sapien
gagttgctgctcttcttaaaatcgt

SEQ ID NO: 372959 - DNA, 25 bp, Homo sapien
gttgctgctcttcttaaaatcgttt

SEQ ID NO: 372960 - DNA, 25 bp, Homo sapien
gctgctcttcttaaaatcgtttaga

SEQ ID NO: 372961 - DNA, 25 bp, Homo sapien
tgtacagctccaccttttagaggtc

SEQ ID NO: 372962 - DNA, 25 bp, Homo sapien
cagctccaccttttagaggtcttac

SEQ ID NO: 372963 - DNA, 25 bp, Homo sapien
ccaccttttagaggtcttactgcaa

SEQ ID NO: 372964 - DNA, 25 bp, Homo sapien
actgcaataagaagtaatgcctggg

SEQ ID NO: 372965 - DNA, 25 bp, Homo sapien
taatcctaataggacgtcccgcact

SEQ ID NO: 372966 - DNA, 25 bp, Homo sapien
ctaataggacgtcccgcacttgtca

SEQ ID NO: 372967 - DNA, 25 bp, Homo sapien
taggacgtcccgcacttgtcacagt

SEQ ID NO: 372968 - DNA, 25 bp, Homo sapien
caatccccttgcttgagaagcacta

SEQ ID NO: 372969 - DNA, 25 bp, Homo sapien
atccccttgcttgagaagcactact

SEQ ID NO: 372970 - DNA, 25 bp, Homo sapien
gaagcactactcaaaaatttaccag

SEQ ID NO: 372971 - DNA, 25 bp, Homo sapien
gaccttacaactgtgataaaacttg

SEQ ID NO: 372972 - DNA, 25 bp, Homo sapien
gaataaggcattccagttaactttt

SEQ ID NO: 372973 - DNA, 25 bp, Homo sapien
taaggcattccagttaacttttact

SEQ ID NO: 372974 - DNA, 25 bp, Homo sapien
gcattccagttaacttttactccct

SEQ ID NO: 372975 - DNA, 25 bp, Homo sapien
gaaggggttccttttccattgctca

SEQ ID NO: 372976 - DNA, 25 bp, Homo sapien
ccttttccattgctcagtttttaga

SEQ ID NO: 372977 - DNA, 25 bp, Homo sapien
ataattctcatcttttttctaaaga

SEQ ID NO: 372978 - DNA, 25 bp, Homo sapien
atagatcaagctccttgttctactc

SEQ ID NO: 372979 - DNA, 25 bp, Homo sapien
ggattggggaccctccgatatgttc

SEQ ID NO: 372980 - DNA, 25 bp, Homo sapien
gattggggaccctccgatatgttcc

SEQ ID NO: 372981 - DNA, 25 bp, Homo sapien
attggggaccctccgatatgttcca

SEQ ID NO: 372982 - DNA, 25 bp, Homo sapien
ttggggaccctccgatatgttccag

SEQ ID NO: 372983 - DNA, 25 bp, Homo sapien
tggggaccctccgatatgttccaga

SEQ ID NO: 372984 - DNA, 25 bp, Homo sapien
ggggaccctccgatatgttccagag

SEQ ID NO: 372985 - DNA, 25 bp, Homo sapien
gggaccctccgatatgttccagagg

SEQ ID NO: 372986 - DNA, 25 bp, Homo sapien
ggaccctccgatatgttccagagga

SEQ ID NO: 372987 - DNA, 25 bp, Homo sapien
gaccctccgatatgttccagaggaa

SEQ ID NO: 372988 - DNA, 25 bp, Homo sapien
accctccgatatgttccagaggaat

SEQ ID NO: 372989 - DNA, 25 bp, Homo sapien
ccctccgatatgttccagaggaatc

SEQ ID NO: 372990 - DNA, 25 bp, Homo sapien
atttcatattccctatctcataggg

SEQ ID NO: 372991 - DNA, 25 bp, Homo sapien
ggatgcctgctgtaaacaagcagta

SEQ ID NO: 372992 - DNA, 25 bp, Homo sapien
gtatgtatggttgtaccaatgccta

SEQ ID NO: 372993 - DNA, 25 bp, Homo sapien
ggttgtaccaatgcctattggctga

SEQ ID NO: 372994 - DNA, 25 bp, Homo sapien
gtaccaatgcctattggctgaacat

SEQ ID NO: 372995 - DNA, 25 bp, Homo sapien
attggctgaacattatgctactttc

SEQ ID NO: 372996 - DNA, 25 bp, Homo sapien
attatgctactttcagatattaaaa

SEQ ID NO: 372997 - DNA, 25 bp, Homo sapien
ttcagatattaaaatggtgttcctt

SEQ ID NO: 372998 - DNA, 25 bp, Homo sapien
gctatatcactttattgaattttgc

SEQ ID NO: 372999 - DNA, 25 bp, Homo sapien
aatgtattctagtcttactctaaag

SEQ ID NO: 373000 - DNA, 25 bp, Homo sapien
agtcttactctaaagacctttgatg

SEQ ID NO: 373001 - DNA, 25 bp, Homo sapien
agttagatgcagacgtttgtgcccc

SEQ ID NO: 373002 - DNA, 25 bp, Homo sapien
tattcatgccaaaggagcgtatttc

SEQ ID NO: 373003 - DNA, 25 bp, Homo sapien
aaggagcgtatttcctaaacacaag

SEQ ID NO: 373004 - DNA, 25 bp, Homo sapien
aggacaatctcttaaccacaataca

SEQ ID NO: 373005 - DNA, 25 bp, Homo sapien
aatgatccagcatcgttgcttctta

SEQ ID NO: 373006 - DNA, 25 bp, Homo sapien
gttgcttcttatttagttgtcccat

SEQ ID NO: 373007 - DNA, 25 bp, Homo sapien
cttatttagttgtcccatctcttaa

SEQ ID NO: 373008 - DNA, 25 bp, Homo sapien
taacacttcctccttgggttctcaa

SEQ ID NO: 373009 - DNA, 25 bp, Homo sapien
gggttctcaatgtttgtcatgctgt

SEQ ID NO: 373010 - DNA, 25 bp, Homo sapien
gtcatgctgtggctagttttgaaga

SEQ ID NO: 373011 - DNA, 25 bp, Homo sapien
atatcgtgataggtgatacagcttc

SEQ ID NO: 373012 - DNA, 25 bp, Homo sapien
atgcccgttccataactcacggctg

SEQ ID NO: 373013 - DNA, 25 bp, Homo sapien
caaaaattattcatgagattgctca

SEQ ID NO: 373014 - DNA, 25 bp, Homo sapien
gagattgctcaaatgttacaacact

SEQ ID NO: 373015 - DNA, 25 bp, Homo sapien
aaatgttacaacactgagttcctga

SEQ ID NO: 373016 - DNA, 25 bp, Homo sapien
caacactgagttcctgaaaacagca

SEQ ID NO: 373017 - DNA, 25 bp, Homo sapien
gttccataactcacggctgtgtgac

SEQ ID NO: 373018 - DNA, 25 bp, Homo sapien
aaaacagcagtttgtatcagaaaac

SEQ ID NO: 373019 - DNA, 25 bp, Homo sapien
aggtttgtattatctctacttgtaa

SEQ ID NO: 373020 - DNA, 25 bp, Homo sapien
gtgaccttggcgctctgactcagaa

SEQ ID NO: 373021 - DNA, 25 bp, Homo sapien
tggcgctctgactcagaatgtccaa

SEQ ID NO: 373022 - DNA, 25 bp, Homo sapien
tctgactcagaatgtccaagctttg

SEQ ID NO: 373023 - DNA, 25 bp, Homo sapien
cagatgagccataattgaaactttt

SEQ ID NO: 373024 - DNA, 25 bp, Homo sapien
gattagcataattgtatcgttgaat

SEQ ID NO: 373025 - DNA, 25 bp, Homo sapien
tagtaactaatggtttctttgaaat

SEQ ID NO: 373026 - DNA, 25 bp, Homo sapien
tttgaaatcctttggtttagctgca

SEQ ID NO: 373027 - DNA, 25 bp, Homo sapien
ttggtttagctgcaatggctcctgc

SEQ ID NO: 373028 - DNA, 25 bp, Homo sapien
tagctgcaatggctcctgctctcat

SEQ ID NO: 373029 - DNA, 25 bp, Homo sapien
tcctgctctcatgtagctaaaaaga

SEQ ID NO: 373030 - DNA, 25 bp, Homo sapien
gcaaatgactttataactcttggga

SEQ ID NO: 373031 - DNA, 25 bp, Homo sapien
ataactcttgggattgatgtttata

SEQ ID NO: 373032 - DNA, 25 bp, Homo sapien
atacccttcagctatttccagttaa

SEQ ID NO: 373033 - DNA, 25 bp, Homo sapien
ttccagttaatttttaatgccataa

SEQ ID NO: 373034 - DNA, 25 bp, Homo sapien
agtgatttactattgggactgaccc

SEQ ID NO: 373035 - DNA, 25 bp, Homo sapien
ggactgacccagttgctaatgccag

SEQ ID NO: 373036 - DNA, 25 bp, Homo sapien
gttgctaatgccagaagcttgtatt

SEQ ID NO: 373037 - DNA, 25 bp, Homo sapien
gaagcttgtatttatagcacacatt

SEQ ID NO: 373038 - DNA, 25 bp, Homo sapien
agcacacattgccacaaagacctag

SEQ ID NO: 373039 - DNA, 25 bp, Homo sapien
cattgccacaaagacctaggttagg

SEQ ID NO: 373040 - DNA, 25 bp, Homo sapien
taccatcaatacctgccactctgta

SEQ ID NO: 373041 - DNA, 25 bp, Homo sapien
ccactctgtacatcacaaagttgaa

SEQ ID NO: 373042 - DNA, 25 bp, Homo sapien
gttgaaatgcatgttggtttctcat

SEQ ID NO: 373043 - DNA, 25 bp, Homo sapien
atgcatgttggtttctcatatttca

SEQ ID NO: 373044 - DNA, 25 bp, Homo sapien
tcatatttcatggttcaatcacgaa

SEQ ID NO: 373045 - DNA, 25 bp, Homo sapien
tacttcatggtagcctttgacagag

SEQ ID NO: 373046 - DNA, 25 bp, Homo sapien
ggtagcctttgacagagaactcttt

SEQ ID NO: 373047 - DNA, 25 bp, Homo sapien
gctcaggctttggtcatgacacagg

SEQ ID NO: 373048 - DNA, 25 bp, Homo sapien
tttggtcatgacacaggcagattgg

SEQ ID NO: 373049 - DNA, 25 bp, Homo sapien
gggcaggtcttggtacaatgacaac

SEQ ID NO: 373050 - DNA, 25 bp, Homo sapien
aatgacaactagcacgagaccttga

SEQ ID NO: 373051 - DNA, 25 bp, Homo sapien
cgagaccttgaactcaacatggatt

SEQ ID NO: 373052 - DNA, 25 bp, Homo sapien
tagtggtaccacctactgccagagt

SEQ ID NO: 373053 - DNA, 25 bp, Homo sapien
cagagtctcttttgaattggcttta

SEQ ID NO: 373054 - DNA, 25 bp, Homo sapien
gaattggctttatccaggagtccca

SEQ ID NO: 373055 - DNA, 25 bp, Homo sapien
caaaagccctttaaactacttcatg

SEQ ID NO: 373056 - DNA, 25 bp, Homo sapien
tggaaccctgcgtccaggcgtgacg

SEQ ID NO: 373057 - DNA, 25 bp, Homo sapien
caggcgtgacggtcatcccgaaagg

SEQ ID NO: 373058 - DNA, 25 bp, Homo sapien
tcatccttttatcctgtaatctgtc

SEQ ID NO: 373059 - DNA, 25 bp, Homo sapien
tatcctgtaatctgtcaccatgacc

SEQ ID NO: 373060 - DNA, 25 bp, Homo sapien
taatctgtcaccatgaccctgacaa

SEQ ID NO: 373061 - DNA, 25 bp, Homo sapien
tgaccctgacaaaaggttccttcac

SEQ ID NO: 373062 - DNA, 25 bp, Homo sapien
aggttccttcacctactccagtggg

SEQ ID NO: 373063 - DNA, 25 bp, Homo sapien
gggagtatccatgatgaacacttca

SEQ ID NO: 373064 - DNA, 25 bp, Homo sapien
gaacacttcatttgctggaggacaa

SEQ ID NO: 373065 - DNA, 25 bp, Homo sapien
agccgggagcccaccagaggaaaag

SEQ ID NO: 373066 - DNA, 25 bp, Homo sapien
gagcccaccagaggaaaagtccgag

SEQ ID NO: 373067 - DNA, 25 bp, Homo sapien
ctagaattgccagctacacattaga

SEQ ID NO: 373068 - DNA, 25 bp, Homo sapien
gccagctacacattagaaggtttag

SEQ ID NO: 373069 - DNA, 25 bp, Homo sapien
aagacttaactcttggagcttggga

SEQ ID NO: 373070 - DNA, 25 bp, Homo sapien
taactcttggagcttgggatagtgc

SEQ ID NO: 373071 - DNA, 25 bp, Homo sapien
ttgggatagtgctacaactagtcct

SEQ ID NO: 373072 - DNA, 25 bp, Homo sapien
gcctgagccttttcttcattcatgt

SEQ ID NO: 373073 - DNA, 25 bp, Homo sapien
agtaactgtgtgtggctgtggaact

SEQ ID NO: 373074 - DNA, 25 bp, Homo sapien
tttggacactgataagaacctgtat

SEQ ID NO: 373075 - DNA, 25 bp, Homo sapien
gaactggacagctcagccgtagagt

SEQ ID NO: 373076 - DNA, 25 bp, Homo sapien
agccgtagagtgtttccctttcttg

SEQ ID NO: 373077 - DNA, 25 bp, Homo sapien
aaatgctaacggtggagactaaggc

SEQ ID NO: 373078 - DNA, 25 bp, Homo sapien
ccaagggcaggcagcggcctccttg

SEQ ID NO: 373079 - DNA, 25 bp, Homo sapien
caccaagtttcagggccctggattg

SEQ ID NO: 373080 - DNA, 25 bp, Homo sapien
tggattgttcccagttcccattgtg

SEQ ID NO: 373081 - DNA, 25 bp, Homo sapien
agttcccattgtggtcccttcagag

SEQ ID NO: 373082 - DNA, 25 bp, Homo sapien
attgtggtcccttcagagctccttt

SEQ ID NO: 373083 - DNA, 25 bp, Homo sapien
tttccaacagcatctctctgtcgaa

SEQ ID NO: 373084 - DNA, 25 bp, Homo sapien
cagcatctctctgtcgaagaaagaa

SEQ ID NO: 373085 - DNA, 25 bp, Homo sapien
aaagaagctctgtcaagttagagag

SEQ ID NO: 373086 - DNA, 25 bp, Homo sapien
ttgttttccttgttaatctgctcca

SEQ ID NO: 373087 - DNA, 25 bp, Homo sapien
ttgttaatctgctccaaccacctga

SEQ ID NO: 373088 - DNA, 25 bp, Homo sapien
tccaaccacctgaacatctaagtaa

SEQ ID NO: 373089 - DNA, 25 bp, Homo sapien
gaagtgatcgggaaaggaacccatt

SEQ ID NO: 373090 - DNA, 25 bp, Homo sapien
ggaaaggaacccattgcaaccaagt

SEQ ID NO: 373091 - DNA, 25 bp, Homo sapien
ggaacccattgcaaccaagtcgaag

SEQ ID NO: 373092 - DNA, 25 bp, Homo sapien
ccattgcaaccaagtcgaagtgata

SEQ ID NO: 373093 - DNA, 25 bp, Homo sapien
gatgaatctgctgattaatttgttc

SEQ ID NO: 373094 - DNA, 25 bp, Homo sapien
gacagtgacttgtatgctgaactcc

SEQ ID NO: 373095 - DNA, 25 bp, Homo sapien
tctgtttctgccaaacttctttaac

SEQ ID NO: 373096 - DNA, 25 bp, Homo sapien
tgccaaacttctttaactcccagga

SEQ ID NO: 373097 - DNA, 25 bp, Homo sapien
tgacttgtatgctgaactccgctgc

SEQ ID NO: 373098 - DNA, 25 bp, Homo sapien
gctgaactccgctgcatgtgtataa

SEQ ID NO: 373099 - DNA, 25 bp, Homo sapien
cctctggaattcatcccaaaaacat

SEQ ID NO: 373100 - DNA, 25 bp, Homo sapien
aatgaaaactctgggactcttcggc

SEQ ID NO: 373101 - DNA, 25 bp, Homo sapien
ggcaaaatcctcattaagccgagca

SEQ ID NO: 373102 - DNA, 25 bp, Homo sapien
taagccgagcagctttggccaagta

SEQ ID NO: 373103 - DNA, 25 bp, Homo sapien
tggccaagtaatttttgcctccttc

SEQ ID NO: 373104 - DNA, 25 bp, Homo sapien
ctcgcgtggcctgagtttaggagca

SEQ ID NO: 373105 - DNA, 25 bp, Homo sapien
gaggcagcaccctggcaaagcagct

SEQ ID NO: 373106 - DNA, 25 bp, Homo sapien
acagataagcctcccctcatgaaat

SEQ ID NO: 373107 - DNA, 25 bp, Homo sapien
gctaccattgacatcagggctgcat

SEQ ID NO: 373108 - DNA, 25 bp, Homo sapien
tggcaaagcagctcacacactgcag

SEQ ID NO: 373109 - DNA, 25 bp, Homo sapien
actcatcagctgtggtgaggcggct

SEQ ID NO: 373110 - DNA, 25 bp, Homo sapien
gcggctggagcaaagtcaaagtcat

SEQ ID NO: 373111 - DNA, 25 bp, Homo sapien
attacatcaacagtctacgtcacag

SEQ ID NO: 373112 - DNA, 25 bp, Homo sapien
gtctacgtcacagccaaattatatt

SEQ ID NO: 373113 - DNA, 25 bp, Homo sapien
agtgttttgcatgtgacctatttca

SEQ ID NO: 373114 - DNA, 25 bp, Homo sapien
gtgctttctagcaaacggttctgtt

SEQ ID NO: 373115 - DNA, 25 bp, Homo sapien
acggttctgttaattagcgagtcac

SEQ ID NO: 373116 - DNA, 25 bp, Homo sapien
tagcgagtcactgttgattctgctg

SEQ ID NO: 373117 - DNA, 25 bp, Homo sapien
gattctgctgtggtggtaagttgat

SEQ ID NO: 373118 - DNA, 25 bp, Homo sapien
gttgataccgtgtaactaatcccgt

SEQ ID NO: 373119 - DNA, 25 bp, Homo sapien
gtaactaatcccgtggatgcctcct

SEQ ID NO: 373120 - DNA, 25 bp, Homo sapien
tttgtccaaacgaagcagccgtggt

SEQ ID NO: 373121 - DNA, 25 bp, Homo sapien
gccgtggtagtagctgtctatgatt

SEQ ID NO: 373122 - DNA, 25 bp, Homo sapien
ttgggttcctgattaaacttcactg

SEQ ID NO: 373123 - DNA, 25 bp, Homo sapien
gggttcctgattaaacttcactgtg

SEQ ID NO: 373124 - DNA, 25 bp, Homo sapien
cctgattaaacttcactgtgtgttt

SEQ ID NO: 373125 - DNA, 25 bp, Homo sapien
actgtgtgttttctatctcggaaaa

SEQ ID NO: 373126 - DNA, 25 bp, Homo sapien
ctgtgtgttttctatctcggaaaaa

SEQ ID NO: 373127 - DNA, 25 bp, Homo sapien
caagtgccggccaccgctgtcaggg

SEQ ID NO: 373128 - DNA, 25 bp, Homo sapien
gccggccaccgctgtcagggattgc

SEQ ID NO: 373129 - DNA, 25 bp, Homo sapien
ggccaccgctgtcagggattgccca

SEQ ID NO: 373130 - DNA, 25 bp, Homo sapien
gctgtcagggattgcccacccctgg

SEQ ID NO: 373131 - DNA, 25 bp, Homo sapien
tcagggattgcccacccctgggcat

SEQ ID NO: 373132 - DNA, 25 bp, Homo sapien
gattgcccacccctgggcatcatgt

SEQ ID NO: 373133 - DNA, 25 bp, Homo sapien
gagtctttccaatttaatgaggtaa

SEQ ID NO: 373134 - DNA, 25 bp, Homo sapien
aagtttttgagcatgttttctctaa

SEQ ID NO: 373135 - DNA, 25 bp, Homo sapien
tataaggaaaccctagcttcagttt

SEQ ID NO: 373136 - DNA, 25 bp, Homo sapien
gcttcagttttcctttcctagctga

SEQ ID NO: 373137 - DNA, 25 bp, Homo sapien
gttttcctttcctagctgatgattt

SEQ ID NO: 373138 - DNA, 25 bp, Homo sapien
tcctagctgatgatttgttcactta

SEQ ID NO: 373139 - DNA, 25 bp, Homo sapien
ttgttcacttaatcattattcaaga

SEQ ID NO: 373140 - DNA, 25 bp, Homo sapien
tgcagaagtagatcagtccctttac

SEQ ID NO: 373141 - DNA, 25 bp, Homo sapien
gtccctttactttttgctctgcata

SEQ ID NO: 373142 - DNA, 25 bp, Homo sapien
tttgctctgcatagggtaacatagt

SEQ ID NO: 373143 - DNA, 25 bp, Homo sapien
caataaaaacttaccgtgcttgtgt

SEQ ID NO: 373144 - DNA, 25 bp, Homo sapien
atgatatcaggactggttacttggt

SEQ ID NO: 373145 - DNA, 25 bp, Homo sapien
tgatatcaggactggttacttggtt

SEQ ID NO: 373146 - DNA, 25 bp, Homo sapien
gatatcaggactggttacttggtta

SEQ ID NO: 373147 - DNA, 25 bp, Homo sapien
atatcaggactggttacttggttaa

SEQ ID NO: 373148 - DNA, 25 bp, Homo sapien
tatcaggactggttacttggttaag

SEQ ID NO: 373149 - DNA, 25 bp, Homo sapien
atcaggactggttacttggttaagg

SEQ ID NO: 373150 - DNA, 25 bp, Homo sapien
tcaggactggttacttggttaagga

SEQ ID NO: 373151 - DNA, 25 bp, Homo sapien
caggactggttacttggttaaggag

SEQ ID NO: 373152 - DNA, 25 bp, Homo sapien
ctcaagcctcccacagcttcgcggg

SEQ ID NO: 373153 - DNA, 25 bp, Homo sapien
agcttcgcgggcactggccttcctg

SEQ ID NO: 373154 - DNA, 25 bp, Homo sapien
cttcgcgggcactggccttcctgaa

SEQ ID NO: 373155 - DNA, 25 bp, Homo sapien
gaacacctctcctggcgtcttagga

SEQ ID NO: 373156 - DNA, 25 bp, Homo sapien
aacacctctcctggcgtcttaggaa

SEQ ID NO: 373157 - DNA, 25 bp, Homo sapien
acctctcctggcgtcttaggaatac

SEQ ID NO: 373158 - DNA, 25 bp, Homo sapien
ctctcctggcgtcttaggaatactc

SEQ ID NO: 373159 - DNA, 25 bp, Homo sapien
tctcctggcgtcttaggaatactcc

SEQ ID NO: 373160 - DNA, 25 bp, Homo sapien
ctcctggcgtcttaggaatactcca

SEQ ID NO: 373161 - DNA, 25 bp, Homo sapien
cctggcgtcttaggaatactccacg

SEQ ID NO: 373162 - DNA, 25 bp, Homo sapien
ctggcgtcttaggaatactccacgg

SEQ ID NO: 373163 - DNA, 25 bp, Homo sapien
tgccgctggcccacgggagcttact

SEQ ID NO: 373164 - DNA, 25 bp, Homo sapien
gctggcccacgggagcttactaatg

SEQ ID NO: 373165 - DNA, 25 bp, Homo sapien
ctggcccacgggagcttactaatga

SEQ ID NO: 373166 - DNA, 25 bp, Homo sapien
tggcccacgggagcttactaatgat

SEQ ID NO: 373167 - DNA, 25 bp, Homo sapien
ggcccacgggagcttactaatgatg

SEQ ID NO: 373168 - DNA, 25 bp, Homo sapien
gcccacgggagcttactaatgatga

SEQ ID NO: 373169 - DNA, 25 bp, Homo sapien
aatgatgaaccacccgaccaacacg

SEQ ID NO: 373170 - DNA, 25 bp, Homo sapien
acccgaccaacacgcactggtacca

SEQ ID NO: 373171 - DNA, 25 bp, Homo sapien
ctgtctccttcggtgcctgcagaga

SEQ ID NO: 373172 - DNA, 25 bp, Homo sapien
tgtctccttcggtgcctgcagagac

SEQ ID NO: 373173 - DNA, 25 bp, Homo sapien
gtctccttcggtgcctgcagagact

SEQ ID NO: 373174 - DNA, 25 bp, Homo sapien
atagcagctccatttctggagtctg

SEQ ID NO: 373175 - DNA, 25 bp, Homo sapien
ctggagtctgggtcttccgaggcca

SEQ ID NO: 373176 - DNA, 25 bp, Homo sapien
agattggcaggtggactacgagtca

SEQ ID NO: 373177 - DNA, 25 bp, Homo sapien
tggcaggtggactacgagtcataca

SEQ ID NO: 373178 - DNA, 25 bp, Homo sapien
gacgctggttcgagagtacttttcc

SEQ ID NO: 373179 - DNA, 25 bp, Homo sapien
ttcgagagtacttttcctgggaggg

SEQ ID NO: 373180 - DNA, 25 bp, Homo sapien
gtgggcaaagccttcaatcagggca

SEQ ID NO: 373181 - DNA, 25 bp, Homo sapien
ttcaatcagggcaagatcttcaagt

SEQ ID NO: 373182 - DNA, 25 bp, Homo sapien
tcttcaagtgaacatctcttgccat

SEQ ID NO: 373183 - DNA, 25 bp, Homo sapien
gtgaacatctcttgccatcacctag

SEQ ID NO: 373184 - DNA, 25 bp, Homo sapien
aacatctcttgccatcacctagctg

SEQ ID NO: 373185 - DNA, 25 bp, Homo sapien
ttccccaaaggtgcccggcagggag

SEQ ID NO: 373186 - DNA, 25 bp, Homo sapien
cactcagcgcaggtcaggctaaggc

SEQ ID NO: 373187 - DNA, 25 bp, Homo sapien
aggctaaggccagtcggctggtcac

SEQ ID NO: 373188 - DNA, 25 bp, Homo sapien
gccagtcggctggtcactatgcaat

SEQ ID NO: 373189 - DNA, 25 bp, Homo sapien
agtcggctggtcactatgcaatgct

SEQ ID NO: 373190 - DNA, 25 bp, Homo sapien
tcggctggtcactatgcaatgctgc

SEQ ID NO: 373191 - DNA, 25 bp, Homo sapien
tggtcactatgcaatgctgccctgg

SEQ ID NO: 373192 - DNA, 25 bp, Homo sapien
gaacagaattgattcttgcccctct

SEQ ID NO: 373193 - DNA, 25 bp, Homo sapien
agaattgattcttgcccctctccct

SEQ ID NO: 373194 - DNA, 25 bp, Homo sapien
cacccctcgctttgaataaagcact

SEQ ID NO: 373195 - DNA, 25 bp, Homo sapien
cgctttgaataaagcacttgcgccc

SEQ ID NO: 373196 - DNA, 25 bp, Homo sapien
atagcagctccatttctggagtctg

SEQ ID NO: 373197 - DNA, 25 bp, Homo sapien
tcttcaagtgaacatctcttgccat

SEQ ID NO: 373198 - DNA, 25 bp, Homo sapien
cttcaagtgaacatctcttgccatc

SEQ ID NO: 373199 - DNA, 25 bp, Homo sapien
ttcaagtgaacatctcttgccatca

SEQ ID NO: 373200 - DNA, 25 bp, Homo sapien
tcaagtgaacatctcttgccatcac

SEQ ID NO: 373201 - DNA, 25 bp, Homo sapien
gtgaacatctcttgccatcacctag

SEQ ID NO: 373202 - DNA, 25 bp, Homo sapien
tgaacatctcttgccatcacctagc

SEQ ID NO: 373203 - DNA, 25 bp, Homo sapien
gaacatctcttgccatcacctagct

SEQ ID NO: 373204 - DNA, 25 bp, Homo sapien
aacatctcttgccatcacctagctg

SEQ ID NO: 373205 - DNA, 25 bp, Homo sapien
acatctcttgccatcacctagctgc

SEQ ID NO: 373206 - DNA, 25 bp, Homo sapien
atgcacttttctcatgtgtacactg

SEQ ID NO: 373207 - DNA, 25 bp, Homo sapien
tactgtacttgaatcttcaagctaa

SEQ ID NO: 373208 - DNA, 25 bp, Homo sapien
gaatcttcaagctaactcactttca

SEQ ID NO: 373209 - DNA, 25 bp, Homo sapien
tcttcaagctaactcactttcagaa

SEQ ID NO: 373210 - DNA, 25 bp, Homo sapien
caagctaactcactttcagaaaaaa

SEQ ID NO: 373211 - DNA, 25 bp, Homo sapien
ccttggttcaaccatcattgttata

SEQ ID NO: 373212 - DNA, 25 bp, Homo sapien
ccggccgcaaccttcaattatttag

SEQ ID NO: 373213 - DNA, 25 bp, Homo sapien
ctaacctgctcaacaaagggagacc

SEQ ID NO: 373214 - DNA, 25 bp, Homo sapien
gtctcaacagacaaaaacatggaat

SEQ ID NO: 373215 - DNA, 25 bp, Homo sapien
tataaagcctaaactaaatgcactt

SEQ ID NO: 373216 - DNA, 25 bp, Homo sapien
aaatgcacttttctcatgtgtacac

SEQ ID NO: 373217 - DNA, 25 bp, Homo sapien
agttgcggggcatccagtggttttt

SEQ ID NO: 373218 - DNA, 25 bp, Homo sapien
agaataaagcatttttccagccttt

SEQ ID NO: 373219 - DNA, 25 bp, Homo sapien
ccagcctttcttctacaaactatat

SEQ ID NO: 373220 - DNA, 25 bp, Homo sapien
ttcttctacaaactatatttcaggg

SEQ ID NO: 373221 - DNA, 25 bp, Homo sapien
tctacaaactatatttcagggaaac

SEQ ID NO: 373222 - DNA, 25 bp, Homo sapien
tttagctaataaatgcagaggccct

SEQ ID NO: 373223 - DNA, 25 bp, Homo sapien
ttgaggccatgttcacacatcactg

SEQ ID NO: 373224 - DNA, 25 bp, Homo sapien
aggccatgttcacacatcactgcag

SEQ ID NO: 373225 - DNA, 25 bp, Homo sapien
gccatgttcacacatcactgcagtc

SEQ ID NO: 373226 - DNA, 25 bp, Homo sapien
cagagcaagacgctgagtctttaac

SEQ ID NO: 373227 - DNA, 25 bp, Homo sapien
gcaagacgctgagtctttaacaaaa

SEQ ID NO: 373228 - DNA, 25 bp, Homo sapien
aatattccattcttatttatgtctt

SEQ ID NO: 373229 - DNA, 25 bp, Homo sapien
gataattcagactattttattttga

SEQ ID NO: 373230 - DNA, 25 bp, Homo sapien
tttgaacctgttttctactctggca

SEQ ID NO: 373231 - DNA, 25 bp, Homo sapien
gaacctgttttctactctggcaaag

SEQ ID NO: 373232 - DNA, 25 bp, Homo sapien
acctgttttctactctggcaaagaa

SEQ ID NO: 373233 - DNA, 25 bp, Homo sapien
tggcaaagaaagataggcagaacta

SEQ ID NO: 373234 - DNA, 25 bp, Homo sapien
ggcagaactattagtgttccatata

SEQ ID NO: 373235 - DNA, 25 bp, Homo sapien
gagataaatgacctaagttttcctt

SEQ ID NO: 373236 - DNA, 25 bp, Homo sapien
atgcaaaagatgatggcaggtcccc

SEQ ID NO: 373237 - DNA, 25 bp, Homo sapien
gatggcaggtccccgactaaagaag

SEQ ID NO: 373238 - DNA, 25 bp, Homo sapien
aatgtgttcagttttcactggttaa

SEQ ID NO: 373239 - DNA, 25 bp, Homo sapien
ggcagatgggccaaggtgaccacca

SEQ ID NO: 373240 - DNA, 25 bp, Homo sapien
aaggtgaccaccattctgcctcaat

SEQ ID NO: 373241 - DNA, 25 bp, Homo sapien
attctgcctcaatcttttgcaagcc

SEQ ID NO: 373242 - DNA, 25 bp, Homo sapien
aaaactcagtcctggcacctcaact

SEQ ID NO: 373243 - DNA, 25 bp, Homo sapien
agtcctggcacctcaactgtgacaa

SEQ ID NO: 373244 - DNA, 25 bp, Homo sapien
ggcacctcaactgtgacaatcagca

SEQ ID NO: 373245 - DNA, 25 bp, Homo sapien
ccatctgggatgatgggagagctct

SEQ ID NO: 373246 - DNA, 25 bp, Homo sapien
agctctggcagatgtcccaatcctg

SEQ ID NO: 373247 - DNA, 25 bp, Homo sapien
cagatgtcccaatcctggaggtcat

SEQ ID NO: 373248 - DNA, 25 bp, Homo sapien
aatcctggaggtcatccattaggaa

SEQ ID NO: 373249 - DNA, 25 bp, Homo sapien
ccattaggaattaaattctccagcc

SEQ ID NO: 373250 - DNA, 25 bp, Homo sapien
aattagtcaagcaacggcctttcct

SEQ ID NO: 373251 - DNA, 25 bp, Homo sapien
ggcctttcctgtctgtttggtgcag

SEQ ID NO: 373252 - DNA, 25 bp, Homo sapien
ggtgcagctgaacacatgggtctat

SEQ ID NO: 373253 - DNA, 25 bp, Homo sapien
atgggtctatataaagttcttttgc

SEQ ID NO: 373254 - DNA, 25 bp, Homo sapien
gcaggaagttcttagcaaggtcaaa

SEQ ID NO: 373255 - DNA, 25 bp, Homo sapien
gcaaggtcaaaaacaattctcatgt

SEQ ID NO: 373256 - DNA, 25 bp, Homo sapien
atgtgaagccatggtgatttcttac

SEQ ID NO: 373257 - DNA, 25 bp, Homo sapien
gatttcttaccgtttgctgtcatga

SEQ ID NO: 373258 - DNA, 25 bp, Homo sapien
ggcatataatcggatgtgctcttca

SEQ ID NO: 373259 - DNA, 25 bp, Homo sapien
gatgtgctcttcaatcatttcgtga

SEQ ID NO: 373260 - DNA, 25 bp, Homo sapien
atttcgtgagattttcagccaacaa

SEQ ID NO: 373261 - DNA, 25 bp, Homo sapien
gattatggaaaacctgagctgaaaa

SEQ ID NO: 373262 - DNA, 25 bp, Homo sapien
tgagctgaaaatggcacctggatct

SEQ ID NO: 373263 - DNA, 25 bp, Homo sapien
ttttttgagctttattctgtgagag

SEQ ID NO: 373264 - DNA, 25 bp, Homo sapien
ttattctgtgagagatcttccccta

SEQ ID NO: 373265 - DNA, 25 bp, Homo sapien
gtgagagatcttcccctacagtgat

SEQ ID NO: 373266 - DNA, 25 bp, Homo sapien
gattggtgtaaatgagacagtcaca

SEQ ID NO: 373267 - DNA, 25 bp, Homo sapien
aattgtctaatttgagcatgccaag

SEQ ID NO: 373268 - DNA, 25 bp, Homo sapien
taatttgagcatgccaagtgatttt

SEQ ID NO: 373269 - DNA, 25 bp, Homo sapien
ttgtcagcctcttttggtcataaaa

SEQ ID NO: 373270 - DNA, 25 bp, Homo sapien
aaacatcctacattaaattcagaag

SEQ ID NO: 373271 - DNA, 25 bp, Homo sapien
aattcagaagggtagctgcataagc

SEQ ID NO: 373272 - DNA, 25 bp, Homo sapien
atatattctgtatctggagttccgt

SEQ ID NO: 373273 - DNA, 25 bp, Homo sapien
atctggagttccgttttgaatatta

SEQ ID NO: 373274 - DNA, 25 bp, Homo sapien
ttttaagccttaactcgccattgat

SEQ ID NO: 373275 - DNA, 25 bp, Homo sapien
gccttaactcgccattgatttacca

SEQ ID NO: 373276 - DNA, 25 bp, Homo sapien
cggccctttgtttgacttgcgtcgt

SEQ ID NO: 373277 - DNA, 25 bp, Homo sapien
tgacttgcgtcgtctgatactcagt

SEQ ID NO: 373278 - DNA, 25 bp, Homo sapien
gcgtcgtctgatactcagtattgta

SEQ ID NO: 373279 - DNA, 25 bp, Homo sapien
cagtattgtagctttttgtccgcat

SEQ ID NO: 373280 - DNA, 25 bp, Homo sapien
ttgtccgcatgttactccctgtaaa

SEQ ID NO: 373281 - DNA, 25 bp, Homo sapien
gttactccctgtaaatacgctgtta

SEQ ID NO: 373282 - DNA, 25 bp, Homo sapien
aaatacgctgttatacatactgtta

SEQ ID NO: 373283 - DNA, 25 bp, Homo sapien
gactgacttccatgtgtgaaggcct

SEQ ID NO: 373284 - DNA, 25 bp, Homo sapien
gaaggcctgcagttaattctcctgt

SEQ ID NO: 373285 - DNA, 25 bp, Homo sapien
ttctcctgtgtcttgaatggttggg

SEQ ID NO: 373286 - DNA, 25 bp, Homo sapien
gggagatgagttggtcagaccctta

SEQ ID NO: 373287 - DNA, 25 bp, Homo sapien
ggtcagacccttagtgaaatgatgt

SEQ ID NO: 373288 - DNA, 25 bp, Homo sapien
aagaaggtagtagaacatcccacac

SEQ ID NO: 373289 - DNA, 25 bp, Homo sapien
agaacatcccacacctgctaataag

SEQ ID NO: 373290 - DNA, 25 bp, Homo sapien
ttgcaaactcagttgactcacctca

SEQ ID NO: 373291 - DNA, 25 bp, Homo sapien
gactcacctcagatttgcctagtga

SEQ ID NO: 373292 - DNA, 25 bp, Homo sapien
ggacagagcccatgctggaagtact

SEQ ID NO: 373293 - DNA, 25 bp, Homo sapien
gaagtactgagcatcaggactgtat

SEQ ID NO: 373294 - DNA, 25 bp, Homo sapien
gagccacttcctcatcttgatacat

SEQ ID NO: 373295 - DNA, 25 bp, Homo sapien
tcttgatacatcagccactatcctt

SEQ ID NO: 373296 - DNA, 25 bp, Homo sapien
tcaggcaactccagcttaatttctc

SEQ ID NO: 373297 - DNA, 25 bp, Homo sapien
gcaactccagcttaatttctcgatg

SEQ ID NO: 373298 - DNA, 25 bp, Homo sapien
cagcttaatttctcgatggccttgc

SEQ ID NO: 373299 - DNA, 25 bp, Homo sapien
ttaatttctcgatggccttgccctt

SEQ ID NO: 373300 - DNA, 25 bp, Homo sapien
ttgcccttctaaaaggccgttctct

SEQ ID NO: 373301 - DNA, 25 bp, Homo sapien
aaggccgttctcttttcccagatga

SEQ ID NO: 373302 - DNA, 25 bp, Homo sapien
agatgactttttcctatcccctcca

SEQ ID NO: 373303 - DNA, 25 bp, Homo sapien
acttggaaacgccacctctgcctga

SEQ ID NO: 373304 - DNA, 25 bp, Homo sapien
tctgcctgaccaatgtcgagccact

SEQ ID NO: 373305 - DNA, 25 bp, Homo sapien
tctttggtggagagattacgttctt

SEQ ID NO: 373306 - DNA, 25 bp, Homo sapien
gattacgttcttgtgtatcttcagt

SEQ ID NO: 373307 - DNA, 25 bp, Homo sapien
gtgcctgacacagaagtgtttctaa

SEQ ID NO: 373308 - DNA, 25 bp, Homo sapien
ctaaaagtaacatctgcacacccct

SEQ ID NO: 373309 - DNA, 25 bp, Homo sapien
gggcgaggccaagaaatctgctctc

SEQ ID NO: 373310 - DNA, 25 bp, Homo sapien
gaaatctgctctccaagtgataact

SEQ ID NO: 373311 - DNA, 25 bp, Homo sapien
aaactttttaacatgctcttcaggt

SEQ ID NO: 373312 - DNA, 25 bp, Homo sapien
aacatgctcttcaggtgacacttaa

SEQ ID NO: 373313 - DNA, 25 bp, Homo sapien
caggtgacacttaaacttgtttgaa

SEQ ID NO: 373314 - DNA, 25 bp, Homo sapien
gcaaccttattaggctgtaattatt

SEQ ID NO: 373315 - DNA, 25 bp, Homo sapien
ctccaactagattgtcatctctttg

SEQ ID NO: 373316 - DNA, 25 bp, Homo sapien
gagccacaaagttttgattcttgcg

SEQ ID NO: 373317 - DNA, 25 bp, Homo sapien
gattcttgcgatgtatgtgccttat

SEQ ID NO: 373318 - DNA, 25 bp, Homo sapien
gagggaccagttggtgttgcccaat

SEQ ID NO: 373319 - DNA, 25 bp, Homo sapien
ggtgttgcccaatcagcactccaag

SEQ ID NO: 373320 - DNA, 25 bp, Homo sapien
gcactccaaggctgtgtgtgcacca

SEQ ID NO: 373321 - DNA, 25 bp, Homo sapien
gtgtgtgcaccagccagagagcgca

SEQ ID NO: 373322 - DNA, 25 bp, Homo sapien
gcagagtcgaggctgtcttgtatcc

SEQ ID NO: 373323 - DNA, 25 bp, Homo sapien
gtatcctggtttcatgtgttgtttt

SEQ ID NO: 373324 - DNA, 25 bp, Homo sapien
ggaggatgttctcttctgacaagtt

SEQ ID NO: 373325 - DNA, 25 bp, Homo sapien
gacaagttacccttgtgtatcctgc

SEQ ID NO: 373326 - DNA, 25 bp, Homo sapien
gtgtatcctgcagacatgtaaaata

SEQ ID NO: 373327 - DNA, 25 bp, Homo sapien
gtctgcaattacgattcttctgggt

SEQ ID NO: 373328 - DNA, 25 bp, Homo sapien
cttctgggtttattttgccagctca

SEQ ID NO: 373329 - DNA, 25 bp, Homo sapien
tattttgccagctcattatccagcc

SEQ ID NO: 373330 - DNA, 25 bp, Homo sapien
cctggaatcaggcctcccaaattta

SEQ ID NO: 373331 - DNA, 25 bp, Homo sapien
tagctggtgaaactgccctttcctt

SEQ ID NO: 373332 - DNA, 25 bp, Homo sapien
ctttcctttctgttctatgagtgtg

SEQ ID NO: 373333 - DNA, 25 bp, Homo sapien
ctgttctatgagtgtgatggtgttt

SEQ ID NO: 373334 - DNA, 25 bp, Homo sapien
ttcaggcgcacttcacatgtgcaaa

SEQ ID NO: 373335 - DNA, 25 bp, Homo sapien
agaaagcactcacctacacgtttag

SEQ ID NO: 373336 - DNA, 25 bp, Homo sapien
actcacctacacgtttaggctcaga

SEQ ID NO: 373337 - DNA, 25 bp, Homo sapien
tacacgtttaggctcagaatattga

SEQ ID NO: 373338 - DNA, 25 bp, Homo sapien
tcatggatggtggtgacatggactt

SEQ ID NO: 373339 - DNA, 25 bp, Homo sapien
ttttgccgggaacactgcagagaca

SEQ ID NO: 373340 - DNA, 25 bp, Homo sapien
agagacaatgctgtgagtttccaac

SEQ ID NO: 373341 - DNA, 25 bp, Homo sapien
atctgcgggcagagaaggtctagtt

SEQ ID NO: 373342 - DNA, 25 bp, Homo sapien
agtttgtccatcaccattatgatat

SEQ ID NO: 373343 - DNA, 25 bp, Homo sapien
tttgtccatcaccattatgatatca

SEQ ID NO: 373344 - DNA, 25 bp, Homo sapien
ttgtccatcaccattatgatatcag

SEQ ID NO: 373345 - DNA, 25 bp, Homo sapien
tgtccatcaccattatgatatcagg

SEQ ID NO: 373346 - DNA, 25 bp, Homo sapien
tccatcaccattatgatatcaggac

SEQ ID NO: 373347 - DNA, 25 bp, Homo sapien
ccatcaccattatgatatcaggact

SEQ ID NO: 373348 - DNA, 25 bp, Homo sapien
catcaccattatgatatcaggactg

SEQ ID NO: 373349 - DNA, 25 bp, Homo sapien
gatttaacaacacactgaggtaagc

SEQ ID NO: 373350 - DNA, 25 bp, Homo sapien
taacaacacactgaggtaagcaaaa

SEQ ID NO: 373351 - DNA, 25 bp, Homo sapien
tgcaggatgtattgtctgtgaattt

SEQ ID NO: 373352 - DNA, 25 bp, Homo sapien
ctgtgaatttcagcatcaatctgaa

SEQ ID NO: 373353 - DNA, 25 bp, Homo sapien
atgttttgataatgcctgataattc

SEQ ID NO: 373354 - DNA, 25 bp, Homo sapien
atcatctcactgattacatgtcttt

SEQ ID NO: 373355 - DNA, 25 bp, Homo sapien
atttgtttataatcttgtgtcttca

SEQ ID NO: 373356 - DNA, 25 bp, Homo sapien
atcttgtgtcttcaaatgtgtggaa

SEQ ID NO: 373357 - DNA, 25 bp, Homo sapien
agatgtgcagacttatttttaggta

SEQ ID NO: 373358 - DNA, 25 bp, Homo sapien
ggtatctgagataggaagggccaat

SEQ ID NO: 373359 - DNA, 25 bp, Homo sapien
ttgaacccacatttcggggctaatg

SEQ ID NO: 373360 - DNA, 25 bp, Homo sapien
ggtggcccatccagggaaccaacga

SEQ ID NO: 373361 - DNA, 25 bp, Homo sapien
ggcccatccagggaaccaacgagta

SEQ ID NO: 373362 - DNA, 25 bp, Homo sapien
gggaaccaacgagtacctcacttag

SEQ ID NO: 373363 - DNA, 25 bp, Homo sapien
ccaacgagtacctcacttagtgacc

SEQ ID NO: 373364 - DNA, 25 bp, Homo sapien
agtacctcacttagtgaccccagca

SEQ ID NO: 373365 - DNA, 25 bp, Homo sapien
atccaggctggcgtcgcgggtgctg

SEQ ID NO: 373366 - DNA, 25 bp, Homo sapien
acgcgggcgtcccaaggccacgtgg

SEQ ID NO: 373367 - DNA, 25 bp, Homo sapien
tggccacgaaggtccccgtgccaga

SEQ ID NO: 373368 - DNA, 25 bp, Homo sapien
tcggcccagagcctgcgcataaagc

SEQ ID NO: 373369 - DNA, 25 bp, Homo sapien
agagcctgcgcataaagccactttg

SEQ ID NO: 373370 - DNA, 25 bp, Homo sapien
gcgcataaagccactttgccacttt

SEQ ID NO: 373371 - DNA, 25 bp, Homo sapien
ttgcatcgccctagttttctttctt

SEQ ID NO: 373372 - DNA, 25 bp, Homo sapien
attccaacagaagccacaggccgga

SEQ ID NO: 373373 - DNA, 25 bp, Homo sapien
tgttgggtttttcgtctttccagat

SEQ ID NO: 373374 - DNA, 25 bp, Homo sapien
ttgggtttttcgtctttccagattg

SEQ ID NO: 373375 - DNA, 25 bp, Homo sapien
gggtttttcgtctttccagattgca

SEQ ID NO: 373376 - DNA, 25 bp, Homo sapien
tccagattgcagtggacacagcccc

SEQ ID NO: 373377 - DNA, 25 bp, Homo sapien
cccggcttctgtctggacattgcat

SEQ ID NO: 373378 - DNA, 25 bp, Homo sapien
ggcttctgtctggacattgcatcgc

SEQ ID NO: 373379 - DNA, 25 bp, Homo sapien
ttctgtctggacattgcatcgccct

SEQ ID NO: 373380 - DNA, 25 bp, Homo sapien
tgtctggacattgcatcgccctagt

SEQ ID NO: 373381 - DNA, 25 bp, Homo sapien
tggacattgcatcgccctagttttc

SEQ ID NO: 373382 - DNA, 25 bp, Homo sapien
ttttattttgctatggtggtgattc

SEQ ID NO: 373383 - DNA, 25 bp, Homo sapien
ggtggtgattctttatttgctggtt

SEQ ID NO: 373384 - DNA, 25 bp, Homo sapien
ctttatttgctggttgtcttttctc

SEQ ID NO: 373385 - DNA, 25 bp, Homo sapien
ggttgtcttttctcacacatctttc

SEQ ID NO: 373386 - DNA, 25 bp, Homo sapien
ttttctcacacatctttctctctgt

SEQ ID NO: 373387 - DNA, 25 bp, Homo sapien
ttctgcccagaaaaacctgacttcg

SEQ ID NO: 373388 - DNA, 25 bp, Homo sapien
acctgacttcgataccaaaaaagat

SEQ ID NO: 373389 - DNA, 25 bp, Homo sapien
atactcaacgattctttcagcttta

SEQ ID NO: 373390 - DNA, 25 bp, Homo sapien
ttccattgtttcttgcgacttgtgt

SEQ ID NO: 373391 - DNA, 25 bp, Homo sapien
gacttgtgtctcgttctttgtagta

SEQ ID NO: 373392 - DNA, 25 bp, Homo sapien
gtgtctcgttctttgtagtattgat

SEQ ID NO: 373393 - DNA, 25 bp, Homo sapien
agatgattttacctgccttccctaa

SEQ ID NO: 373394 - DNA, 25 bp, Homo sapien
tgccttccctaagtgcactcgggaa

SEQ ID NO: 373395 - DNA, 25 bp, Homo sapien
gaaggatcatctcaaaaagggttaa

SEQ ID NO: 373396 - DNA, 25 bp, Homo sapien
tggaaatcacttacacacgcggtcg

SEQ ID NO: 373397 - DNA, 25 bp, Homo sapien
tacacacgcggtcgcggcttggact

SEQ ID NO: 373398 - DNA, 25 bp, Homo sapien
acttggctagtgaggccggcctgcc

SEQ ID NO: 373399 - DNA, 25 bp, Homo sapien
tctgcttccattcactcagacacag

SEQ ID NO: 373400 - DNA, 25 bp, Homo sapien
attcactcagacacagcttgggctt

SEQ ID NO: 373401 - DNA, 25 bp, Homo sapien
tcagacacagcttgggcttttcctc

SEQ ID NO: 373402 - DNA, 25 bp, Homo sapien
ttttcctccaagtgctggtagcagt

SEQ ID NO: 373403 - DNA, 25 bp, Homo sapien
tgctggtagcagtcatttatgaggg

SEQ ID NO: 373404 - DNA, 25 bp, Homo sapien
aaatatcagggaaaggagccaagtc

SEQ ID NO: 373405 - DNA, 25 bp, Homo sapien
gaaaggagccaagtccttggtattt

SEQ ID NO: 373406 - DNA, 25 bp, Homo sapien
gtccttggtatttagtttggtgaat

SEQ ID NO: 373407 - DNA, 25 bp, Homo sapien
tagtttggtgaatacttgcattgaa

SEQ ID NO: 373408 - DNA, 25 bp, Homo sapien
atgtcaagatgtcaagtcatttttg

SEQ ID NO: 373409 - DNA, 25 bp, Homo sapien
tttttgaatgtgtctcagggatttc

SEQ ID NO: 373410 - DNA, 25 bp, Homo sapien
gtctcagggatttctatgctacaca

SEQ ID NO: 373411 - DNA, 25 bp, Homo sapien
gggatttctatgctacacattcttt

SEQ ID NO: 373412 - DNA, 25 bp, Homo sapien
atgctacacattcttttaacaaatc

SEQ ID NO: 373413 - DNA, 25 bp, Homo sapien
caaatcaagtatttatgtacacatg

SEQ ID NO: 373414 - DNA, 25 bp, Homo sapien
tgtacacatgttcagattttttgac

SEQ ID NO: 373415 - DNA, 25 bp, Homo sapien
agcatttggccaacaaaggacacca

SEQ ID NO: 373416 - DNA, 25 bp, Homo sapien
gatattcaacgtggctgcaaatact

SEQ ID NO: 373417 - DNA, 25 bp, Homo sapien
aaatactagctgacttctttacctg

SEQ ID NO: 373418 - DNA, 25 bp, Homo sapien
ttctttacctgttggccaaccaaag

SEQ ID NO: 373419 - DNA, 25 bp, Homo sapien
tgaatgaagggaggccctgctgatc

SEQ ID NO: 373420 - DNA, 25 bp, Homo sapien
tccccgagagaggtttgctatgtgt

SEQ ID NO: 373421 - DNA, 25 bp, Homo sapien
gtgtgcaaccctcagtaacatacat

SEQ ID NO: 373422 - DNA, 25 bp, Homo sapien
gacttttaggttccaggattccgag

SEQ ID NO: 373423 - DNA, 25 bp, Homo sapien
ccaggattccgaggcagggtttcta

SEQ ID NO: 373424 - DNA, 25 bp, Homo sapien
gggtttctaagattccttgcagtgg

SEQ ID NO: 373425 - DNA, 25 bp, Homo sapien
gtagcataggttcatttgatttaca

SEQ ID NO: 373426 - DNA, 25 bp, Homo sapien
ttttctctcttattacttctttcct

SEQ ID NO: 373427 - DNA, 25 bp, Homo sapien
tacttctttcctttggcattttcaa

SEQ ID NO: 373428 - DNA, 25 bp, Homo sapien
gaaatgctttcctttggttgttggt

SEQ ID NO: 373429 - DNA, 25 bp, Homo sapien
ataaacctgcaaagctctgctctgt

SEQ ID NO: 373430 - DNA, 25 bp, Homo sapien
acctgcaaagctctgctctgttttg

SEQ ID NO: 373431 - DNA, 25 bp, Homo sapien
aggcttctgtcccttttgattccaa

SEQ ID NO: 373432 - DNA, 25 bp, Homo sapien
gtcccttttgattccaactgaactt

SEQ ID NO: 373433 - DNA, 25 bp, Homo sapien
tccaactgaacttttgtgttctcta

SEQ ID NO: 373434 - DNA, 25 bp, Homo sapien
ttctctaatgatactaacacggtgt

SEQ ID NO: 373435 - DNA, 25 bp, Homo sapien
cacggtgtaggttttacagtctcct

SEQ ID NO: 373436 - DNA, 25 bp, Homo sapien
acagtctcctaatttgtactggtaa

SEQ ID NO: 373437 - DNA, 25 bp, Homo sapien
tgcattccctgcttctccaggtaag

SEQ ID NO: 373438 - DNA, 25 bp, Homo sapien
agctggaggtgggaacgcactctct

SEQ ID NO: 373439 - DNA, 25 bp, Homo sapien
aggtgggaacgcactctcttttcat

SEQ ID NO: 373440 - DNA, 25 bp, Homo sapien
gggaacgcactctcttttcatcaag

SEQ ID NO: 373441 - DNA, 25 bp, Homo sapien
cgcactctcttttcatcaagctgag

SEQ ID NO: 373442 - DNA, 25 bp, Homo sapien
tgcttctccaggtaagcgatgccag

SEQ ID NO: 373443 - DNA, 25 bp, Homo sapien
ttttcatcaagctgagatttcactc

SEQ ID NO: 373444 - DNA, 25 bp, Homo sapien
caagctgagatttcactcgtttttt

SEQ ID NO: 373445 - DNA, 25 bp, Homo sapien
ctccaggtaagcgatgccagggcag

SEQ ID NO: 373446 - DNA, 25 bp, Homo sapien
caggctcaggcattctgggctcatg

SEQ ID NO: 373447 - DNA, 25 bp, Homo sapien
gctcaggcattctgggctcatgctt

SEQ ID NO: 373448 - DNA, 25 bp, Homo sapien
tacttaataaggctaggctggccat

SEQ ID NO: 373449 - DNA, 25 bp, Homo sapien
taggctggccatcagttgcttattt

SEQ ID NO: 373450 - DNA, 25 bp, Homo sapien
tggccatcagttgcttatttcagat

SEQ ID NO: 373451 - DNA, 25 bp, Homo sapien
cagttgcttatttcagatgtgtcac

SEQ ID NO: 373452 - DNA, 25 bp, Homo sapien
tgcttatttcagatgtgtcactaaa

SEQ ID NO: 373453 - DNA, 25 bp, Homo sapien
gtgtcactaaattttccttctagat

SEQ ID NO: 373454 - DNA, 25 bp, Homo sapien
aaattttccttctagatggtccttg

SEQ ID NO: 373455 - DNA, 25 bp, Homo sapien
ctagatggtccttgagcaaaactta

SEQ ID NO: 373456 - DNA, 25 bp, Homo sapien
ggtccttgagcaaaacttaataatt

SEQ ID NO: 373457 - DNA, 25 bp, Homo sapien
tgttttttatttccactgcctttat

SEQ ID NO: 373458 - DNA, 25 bp, Homo sapien
tttccactgcctttataaaatcaaa

SEQ ID NO: 373459 - DNA, 25 bp, Homo sapien
taagattgcaatgaagttagaactc

SEQ ID NO: 373460 - DNA, 25 bp, Homo sapien
gaagttagaactcttacgttactgt

SEQ ID NO: 373461 - DNA, 25 bp, Homo sapien
agaactcttacgttactgtttatgt

SEQ ID NO: 373462 - DNA, 25 bp, Homo sapien
actcttacgttactgtttatgtcca

SEQ ID NO: 373463 - DNA, 25 bp, Homo sapien
cttacgttactgtttatgtccacaa

SEQ ID NO: 373464 - DNA, 25 bp, Homo sapien
tacgttactgtttatgtccacaaaa

SEQ ID NO: 373465 - DNA, 25 bp, Homo sapien
gttactgtttatgtccacaaaatgt

SEQ ID NO: 373466 - DNA, 25 bp, Homo sapien
gtttatgtccacaaaatgtttagaa

SEQ ID NO: 373467 - DNA, 25 bp, Homo sapien
ttaacagtgttaatatttcttatat

SEQ ID NO: 373468 - DNA, 25 bp, Homo sapien
tcttatattgttgggtttatgcata

SEQ ID NO: 373469 - DNA, 25 bp, Homo sapien
attgttgggtttatgcataatataa

SEQ ID NO: 373470 - DNA, 25 bp, Homo sapien
gtagatgctcgtagccagaacagaa

SEQ ID NO: 373471 - DNA, 25 bp, Homo sapien
aggttacacatgatcatggcacaga

SEQ ID NO: 373472 - DNA, 25 bp, Homo sapien
gaggtttgacttggtgggccataat

SEQ ID NO: 373473 - DNA, 25 bp, Homo sapien
gtgggccataatgtttattatcctt

SEQ ID NO: 373474 - DNA, 25 bp, Homo sapien
tttttgaaataacagggaccagcag

SEQ ID NO: 373475 - DNA, 25 bp, Homo sapien
ggaccagcagcagttttctcaggat

SEQ ID NO: 373476 - DNA, 25 bp, Homo sapien
tcaggataaatgctctaccccactt

SEQ ID NO: 373477 - DNA, 25 bp, Homo sapien
ctaccccacttctctatgaacaggt

SEQ ID NO: 373478 - DNA, 25 bp, Homo sapien
gaggcttactttccattttcatatt

SEQ ID NO: 373479 - DNA, 25 bp, Homo sapien
ttcatatttatacacctctctacaa

SEQ ID NO: 373480 - DNA, 25 bp, Homo sapien
tatacacctctctacaaaagcaatt

SEQ ID NO: 373481 - DNA, 25 bp, Homo sapien
caagagtggcccctggcgaatacaa

SEQ ID NO: 373482 - DNA, 25 bp, Homo sapien
tggcccctggcgaatacaatgactt

SEQ ID NO: 373483 - DNA, 25 bp, Homo sapien
acaatgacttctctgagccactgta

SEQ ID NO: 373484 - DNA, 25 bp, Homo sapien
tctgagccactgtaagggaccaccc

SEQ ID NO: 373485 - DNA, 25 bp, Homo sapien
caggtttcagtgaacccttacctat

SEQ ID NO: 373486 - DNA, 25 bp, Homo sapien
aacccttacctatattcagcatcca

SEQ ID NO: 373487 - DNA, 25 bp, Homo sapien
ttcagcatccagtagtgggaaaact

SEQ ID NO: 373488 - DNA, 25 bp, Homo sapien
attaatccacaaagcggctatcttt

SEQ ID NO: 373489 - DNA, 25 bp, Homo sapien
gaaagggtcttggataccagcacat

SEQ ID NO: 373490 - DNA, 25 bp, Homo sapien
cttggataccagcacattggaggga

SEQ ID NO: 373491 - DNA, 25 bp, Homo sapien
gggagatagcctgacctctgtcctt

SEQ ID NO: 373492 - DNA, 25 bp, Homo sapien
ccagcagctcaccatggctttaaaa

SEQ ID NO: 373493 - DNA, 25 bp, Homo sapien
gcagctcaccatggctttaaaacat

SEQ ID NO: 373494 - DNA, 25 bp, Homo sapien
tggctttaaaacatgctctcttaga

SEQ ID NO: 373495 - DNA, 25 bp, Homo sapien
tttaaaacatgctctcttagatcag

SEQ ID NO: 373496 - DNA, 25 bp, Homo sapien
tagatcaggagaaactcgggcactc

SEQ ID NO: 373497 - DNA, 25 bp, Homo sapien
gaaactcgggcactccctaagtcca

SEQ ID NO: 373498 - DNA, 25 bp, Homo sapien
actccctaagtccactctagttgtg

SEQ ID NO: 373499 - DNA, 25 bp, Homo sapien
actctagttgtggacttttccccat

SEQ ID NO: 373500 - DNA, 25 bp, Homo sapien
tagttgtggacttttccccattgac

SEQ ID NO: 373501 - DNA, 25 bp, Homo sapien
ccattgaccctcacctgaataaggg

SEQ ID NO: 373502 - DNA, 25 bp, Homo sapien
tgaccctcacctgaataagggactt

SEQ ID NO: 373503 - DNA, 25 bp, Homo sapien
agcacccatagccaggtcttcctgg

SEQ ID NO: 373504 - DNA, 25 bp, Homo sapien
cttcctggcccttgaggctgggctg

SEQ ID NO: 373505 - DNA, 25 bp, Homo sapien
gcacctacctcttccttaagctgaa

SEQ ID NO: 373506 - DNA, 25 bp, Homo sapien
ttaagctgaagctcccacactgtct

SEQ ID NO: 373507 - DNA, 25 bp, Homo sapien
acactgtcttccagggctgaggaga

SEQ ID NO: 373508 - DNA, 25 bp, Homo sapien
ggagatgctctccttttctactgac

SEQ ID NO: 373509 - DNA, 25 bp, Homo sapien
ccttttctactgaccatcttgatac

SEQ ID NO: 373510 - DNA, 25 bp, Homo sapien
gaccatcttgatacttatttatacg

SEQ ID NO: 373511 - DNA, 25 bp, Homo sapien
tatttatacgagaggcagttgctgg

SEQ ID NO: 373512 - DNA, 25 bp, Homo sapien
agaatggctctgctgagcctcctac

SEQ ID NO: 373513 - DNA, 25 bp, Homo sapien
gacaacaccccaataaacagaacat

SEQ ID NO: 373514 - DNA, 25 bp, Homo sapien
ctgcggataccagtggacctggagt

SEQ ID NO: 373515 - DNA, 25 bp, Homo sapien
ctggttggtctacactgctggtgaa

SEQ ID NO: 373516 - DNA, 25 bp, Homo sapien
ggtgaatgcaccaccaccatttaac

SEQ ID NO: 373517 - DNA, 25 bp, Homo sapien
catttaaccaccctgccgctggtgg

SEQ ID NO: 373518 - DNA, 25 bp, Homo sapien
cactgtgtggccatcacgactagct

SEQ ID NO: 373519 - DNA, 25 bp, Homo sapien
acgactagctctgctatgaatgcac

SEQ ID NO: 373520 - DNA, 25 bp, Homo sapien
atgcacctgccctcatttgagttga

SEQ ID NO: 373521 - DNA, 25 bp, Homo sapien
ctgccctcatttgagttgagcctga

SEQ ID NO: 373522 - DNA, 25 bp, Homo sapien
gagttgagcctgagcatttcgcagc

SEQ ID NO: 373523 - DNA, 25 bp, Homo sapien
gcctgagcatttcgcagctgggatt

SEQ ID NO: 373524 - DNA, 25 bp, Homo sapien
tttcgcagctgggattggagtcgct

SEQ ID NO: 373525 - DNA, 25 bp, Homo sapien
tcctcctttgactgtttgactcatt

SEQ ID NO: 373526 - DNA, 25 bp, Homo sapien
attgactgttaaaatgccaccccat

SEQ ID NO: 373527 - DNA, 25 bp, Homo sapien
atgccaccccatacatatttgggat

SEQ ID NO: 373528 - DNA, 25 bp, Homo sapien
tgacagcaaccttcaagatctgggt

SEQ ID NO: 373529 - DNA, 25 bp, Homo sapien
tgggttttcagctttctgcaacctt

SEQ ID NO: 373530 - DNA, 25 bp, Homo sapien
tctgcaacctttgttttcactgaaa

SEQ ID NO: 373531 - DNA, 25 bp, Homo sapien
aatgttgaaactactcgtctgaggg

SEQ ID NO: 373532 - DNA, 25 bp, Homo sapien
aggaacctcctcacaaatgctatag

SEQ ID NO: 373533 - DNA, 25 bp, Homo sapien
aatgctatagctgccaattggacac

SEQ ID NO: 373534 - DNA, 25 bp, Homo sapien
gcatttcgaggtctggccctaagaa

SEQ ID NO: 373535 - DNA, 25 bp, Homo sapien
tggccctaagaatttactttctcct

SEQ ID NO: 373536 - DNA, 25 bp, Homo sapien
gcttacacgagagttttaaaagact

SEQ ID NO: 373537 - DNA, 25 bp, Homo sapien
ttaaaagactgagcagtatcccctt

SEQ ID NO: 373538 - DNA, 25 bp, Homo sapien
gggataaacctgcagacactgagaa

SEQ ID NO: 373539 - DNA, 25 bp, Homo sapien
ctgcctgttgtggaaaatagggcat

SEQ ID NO: 373540 - DNA, 25 bp, Homo sapien
tctcctgtgaatgcgaattgcgagg

SEQ ID NO: 373541 - DNA, 25 bp, Homo sapien
cgaattgcgagggttgccaaagcct

SEQ ID NO: 373542 - DNA, 25 bp, Homo sapien
aagcctcccttccaagaaacttgct

SEQ ID NO: 373543 - DNA, 25 bp, Homo sapien
gaaacttgcttaggtgtctggtgtc

SEQ ID NO: 373544 - DNA, 25 bp, Homo sapien
tgcttaggtgtctggtgtccacaga

SEQ ID NO: 373545 - DNA, 25 bp, Homo sapien
gactcttctcccgacagggacaaaa

SEQ ID NO: 373546 - DNA, 25 bp, Homo sapien
gggacaaaaattcttgcctgccttt

SEQ ID NO: 373547 - DNA, 25 bp, Homo sapien
gagcatgtccacaggtggcctccag

SEQ ID NO: 373548 - DNA, 25 bp, Homo sapien
tccgcagactgactttcctctgtgt

SEQ ID NO: 373549 - DNA, 25 bp, Homo sapien
actttcctctgtgtctgggtgttac

SEQ ID NO: 373550 - DNA, 25 bp, Homo sapien
gtgtctgggtgttacagtctgtgcc

SEQ ID NO: 373551 - DNA, 25 bp, Homo sapien
gtgttacagtctgtgcccactgcat

SEQ ID NO: 373552 - DNA, 25 bp, Homo sapien
actgcatcctaaaggccttttcttt

SEQ ID NO: 373553 - DNA, 25 bp, Homo sapien
ttttctctttgggtgatagtcagag

SEQ ID NO: 373554 - DNA, 25 bp, Homo sapien
cagagagtggtgtttttgttcaggt

SEQ ID NO: 373555 - DNA, 25 bp, Homo sapien
ggattggaaactctagtcttttcta

SEQ ID NO: 373556 - DNA, 25 bp, Homo sapien
tgttctgaaagaagtctgtttggat

SEQ ID NO: 373557 - DNA, 25 bp, Homo sapien
gtctgtttggataaagagctgtatt

SEQ ID NO: 373558 - DNA, 25 bp, Homo sapien
gtcctcagtgttgtctgcacctgct

SEQ ID NO: 373559 - DNA, 25 bp, Homo sapien
tcagtgttgtctgcacctgctccga

SEQ ID NO: 373560 - DNA, 25 bp, Homo sapien
agtgttgtctgcacctgctccgact

SEQ ID NO: 373561 - DNA, 25 bp, Homo sapien
aggcggccgtgccttactactctgt

SEQ ID NO: 373562 - DNA, 25 bp, Homo sapien
gccgtgccttactactctgtgtctt

SEQ ID NO: 373563 - DNA, 25 bp, Homo sapien
gcctcctctgaggaatctggccctg

SEQ ID NO: 373564 - DNA, 25 bp, Homo sapien
ggaatctggccctgtctgacagtcc

SEQ ID NO: 373565 - DNA, 25 bp, Homo sapien
tctggccctgtctgacagtcccaga

SEQ ID NO: 373566 - DNA, 25 bp, Homo sapien
cgttctctcctctttagttgcatga

SEQ ID NO: 373567 - DNA, 25 bp, Homo sapien
gttctctcctctttagttgcatgag

SEQ ID NO: 373568 - DNA, 25 bp, Homo sapien
tctctcctctttagttgcatgagtt

SEQ ID NO: 373569 - DNA, 25 bp, Homo sapien
gacctcagtatctgagacgctgagt

SEQ ID NO: 373570 - DNA, 25 bp, Homo sapien
tgagacgctgagtcacattccaacc

SEQ ID NO: 373571 - DNA, 25 bp, Homo sapien
tgagtcacattccaacctttaccgt

SEQ ID NO: 373572 - DNA, 25 bp, Homo sapien
cattccaacctttaccgtgtcaaag

SEQ ID NO: 373573 - DNA, 25 bp, Homo sapien
ttaccgtgtcaaaggttctaagagg

SEQ ID NO: 373574 - DNA, 25 bp, Homo sapien
ggaaagtcacaaacctgaaattatt

SEQ ID NO: 373575 - DNA, 25 bp, Homo sapien
gtttcttacctaatgaagcatctga

SEQ ID NO: 373576 - DNA, 25 bp, Homo sapien
gaagcatctgacacctgatgatcct

SEQ ID NO: 373577 - DNA, 25 bp, Homo sapien
ctgacacctgatgatcctatgaata

SEQ ID NO: 373578 - DNA, 25 bp, Homo sapien
tgaaaagtattgtgcctgatgtatc

SEQ ID NO: 373579 - DNA, 25 bp, Homo sapien
gtattgtgcctgatgtatcatatta

SEQ ID NO: 373580 - DNA, 25 bp, Homo sapien
cttccctaatttcttgctatgaagg

SEQ ID NO: 373581 - DNA, 25 bp, Homo sapien
ttccctaatttcttgctatgaagga

SEQ ID NO: 373582 - DNA, 25 bp, Homo sapien
ccctaatttcttgctatgaaggatt

SEQ ID NO: 373583 - DNA, 25 bp, Homo sapien
cctaatttcttgctatgaaggattg

SEQ ID NO: 373584 - DNA, 25 bp, Homo sapien
aatttcttgctatgaaggattggat

SEQ ID NO: 373585 - DNA, 25 bp, Homo sapien
tttcttgctatgaaggattggatac

SEQ ID NO: 373586 - DNA, 25 bp, Homo sapien
tcttgctatgaaggattggatactt

SEQ ID NO: 373587 - DNA, 25 bp, Homo sapien
tgctatgaaggattggatacttatc

SEQ ID NO: 373588 - DNA, 25 bp, Homo sapien
atgaaggattggatacttatcacac

SEQ ID NO: 373589 - DNA, 25 bp, Homo sapien
gaaggattggatacttatcacacta

SEQ ID NO: 373590 - DNA, 25 bp, Homo sapien
aggattggatacttatcacactaaa

SEQ ID NO: 373591 - DNA, 25 bp, Homo sapien
acattgcatcgccctagttttcttt

SEQ ID NO: 373592 - DNA, 25 bp, Homo sapien
aacagaagccacaggccggagcccc

SEQ ID NO: 373593 - DNA, 25 bp, Homo sapien
ttgtcacctacctatcccctttcgg

SEQ ID NO: 373594 - DNA, 25 bp, Homo sapien
tgttgggtttttcgtctttccagat

SEQ ID NO: 373595 - DNA, 25 bp, Homo sapien
ttgggtttttcgtctttccagattg

SEQ ID NO: 373596 - DNA, 25 bp, Homo sapien
gggtttttcgtctttccagattgca

SEQ ID NO: 373597 - DNA, 25 bp, Homo sapien
cccggcttctgtctggacattgcat

SEQ ID NO: 373598 - DNA, 25 bp, Homo sapien
ggcttctgtctggacattgcatcgc

SEQ ID NO: 373599 - DNA, 25 bp, Homo sapien
ttctgtctggacattgcatcgccct

SEQ ID NO: 373600 - DNA, 25 bp, Homo sapien
tgtctggacattgcatcgccctagt

SEQ ID NO: 373601 - DNA, 25 bp, Homo sapien
tggacattgcatcgccctagttttc

SEQ ID NO: 373602 - DNA, 25 bp, Homo sapien
gttgcttgactatcccaattcttga

SEQ ID NO: 373603 - DNA, 25 bp, Homo sapien
gactatcccaattcttgagtcctgg

SEQ ID NO: 373604 - DNA, 25 bp, Homo sapien
atcccaattcttgagtcctgggagg

SEQ ID NO: 373605 - DNA, 25 bp, Homo sapien
ctgggaattgggaccttagcacatt

SEQ ID NO: 373606 - DNA, 25 bp, Homo sapien
gaattgggaccttagcacatttggg

SEQ ID NO: 373607 - DNA, 25 bp, Homo sapien
gggctctcgcaaagttctggctaag

SEQ ID NO: 373608 - DNA, 25 bp, Homo sapien
actcacccattgcatgtggcattcc

SEQ ID NO: 373609 - DNA, 25 bp, Homo sapien
cattgcatgtggcattccccactac

SEQ ID NO: 373610 - DNA, 25 bp, Homo sapien
ctgtacaagggaagcctgtcttggt

SEQ ID NO: 373611 - DNA, 25 bp, Homo sapien
caagggaagcctgtcttggtgtgtt

SEQ ID NO: 373612 - DNA, 25 bp, Homo sapien
gtgtgtttgttgcttgactatccca

SEQ ID NO: 373613 - DNA, 25 bp, Homo sapien
taccagagatttaataacatagcag

SEQ ID NO: 373614 - DNA, 25 bp, Homo sapien
gatttaataacatagcagaagtaac

SEQ ID NO: 373615 - DNA, 25 bp, Homo sapien
cagaagtaactgaatcgcctcctct

SEQ ID NO: 373616 - DNA, 25 bp, Homo sapien
tcctctgccctatgcacttgtattt

SEQ ID NO: 373617 - DNA, 25 bp, Homo sapien
ctctgccctatgcacttgtattttt

SEQ ID NO: 373618 - DNA, 25 bp, Homo sapien
tttatttcaaaaatgccaggaagat

SEQ ID NO: 373619 - DNA, 25 bp, Homo sapien
atgccaggaagataagtgtatgcaa

SEQ ID NO: 373620 - DNA, 25 bp, Homo sapien
acaacttaatctatttgatcattag

SEQ ID NO: 373621 - DNA, 25 bp, Homo sapien
tttgatcattagttaagtaagctta

SEQ ID NO: 373622 - DNA, 25 bp, Homo sapien
tttttaactctctaaagaatacatt

SEQ ID NO: 373623 - DNA, 25 bp, Homo sapien
gctttaatttagtaacagttaatct

SEQ ID NO: 373624 - DNA, 25 bp, Homo sapien
agcctcctttctgccgggaagttcg

SEQ ID NO: 373625 - DNA, 25 bp, Homo sapien
aagttcgtccgggagtcaaacatcg

SEQ ID NO: 373626 - DNA, 25 bp, Homo sapien
tcgtccgggagtcaaacatcgctgc

SEQ ID NO: 373627 - DNA, 25 bp, Homo sapien
gtcaaacatcgctgccctccggttg

SEQ ID NO: 373628 - DNA, 25 bp, Homo sapien
ggatccgaacagaaaaggcttccac

SEQ ID NO: 373629 - DNA, 25 bp, Homo sapien
gaacagaaaaggcttccacccgctc

SEQ ID NO: 373630 - DNA, 25 bp, Homo sapien
tcccctgagggatcccacgctgagg

SEQ ID NO: 373631 - DNA, 25 bp, Homo sapien
gggatcccacgctgagggactgaac

SEQ ID NO: 373632 - DNA, 25 bp, Homo sapien
cccactgctcatatccgagcagata

SEQ ID NO: 373633 - DNA, 25 bp, Homo sapien
atatccgagcagatagaccccggcc

SEQ ID NO: 373634 - DNA, 25 bp, Homo sapien
tgagcctcctttctgccgggaagtt

SEQ ID NO: 373635 - DNA, 25 bp, Homo sapien
ttcccttacctctgtcgacctgtga

SEQ ID NO: 373636 - DNA, 25 bp, Homo sapien
ttacctctgtcgacctgtgaaactg

SEQ ID NO: 373637 - DNA, 25 bp, Homo sapien
acctctgtcgacctgtgaaactgaa

SEQ ID NO: 373638 - DNA, 25 bp, Homo sapien
cctctgtcgacctgtgaaactgaac

SEQ ID NO: 373639 - DNA, 25 bp, Homo sapien
tgtcgacctgtgaaactgaacaaac

SEQ ID NO: 373640 - DNA, 25 bp, Homo sapien
tgtgaaactgaacaaacagcttatc

SEQ ID NO: 373641 - DNA, 25 bp, Homo sapien
aaacagcttatctgcccctaatgtg

SEQ ID NO: 373642 - DNA, 25 bp, Homo sapien
gcccctaatgtgaaatgatgggaca

SEQ ID NO: 373643 - DNA, 25 bp, Homo sapien
aatccagcaggagtttcttagttag

SEQ ID NO: 373644 - DNA, 25 bp, Homo sapien
gcaggagtttcttagttaggatcca

SEQ ID NO: 373645 - DNA, 25 bp, Homo sapien
aggagtttcttagttaggatccaca

SEQ ID NO: 373646 - DNA, 25 bp, Homo sapien
ccttctggaacttcaaatacaaaag

SEQ ID NO: 373647 - DNA, 25 bp, Homo sapien
gttttgatattgtttcacagctctc

SEQ ID NO: 373648 - DNA, 25 bp, Homo sapien
gatattgtttcacagctctctgaag

SEQ ID NO: 373649 - DNA, 25 bp, Homo sapien
ttgtttcacagctctctgaagcttt

SEQ ID NO: 373650 - DNA, 25 bp, Homo sapien
cacagctctctgaagctttgttcat

SEQ ID NO: 373651 - DNA, 25 bp, Homo sapien
agctctctgaagctttgttcatttt

SEQ ID NO: 373652 - DNA, 25 bp, Homo sapien
cctgtttttcagattagataatttc

SEQ ID NO: 373653 - DNA, 25 bp, Homo sapien
gataatttctattgatctctttgta

SEQ ID NO: 373654 - DNA, 25 bp, Homo sapien
ttgtaagtttactgactccttcctc

SEQ ID NO: 373655 - DNA, 25 bp, Homo sapien
aagtttactgactccttcctctgta

SEQ ID NO: 373656 - DNA, 25 bp, Homo sapien
tttactgactccttcctctgtaatc

SEQ ID NO: 373657 - DNA, 25 bp, Homo sapien
gtgctatccggttgggaggtctcac

SEQ ID NO: 373658 - DNA, 25 bp, Homo sapien
tccctaacgtgcacctccgagaaga

SEQ ID NO: 373659 - DNA, 25 bp, Homo sapien
agcacctgctcggtggaagggctct

SEQ ID NO: 373660 - DNA, 25 bp, Homo sapien
tccggagactggcactcagtatctg

SEQ ID NO: 373661 - DNA, 25 bp, Homo sapien
tgagtatgaggagcctcacttcccg

SEQ ID NO: 373662 - DNA, 25 bp, Homo sapien
gtaaacttgaccgtgactcagtaac

SEQ ID NO: 373663 - DNA, 25 bp, Homo sapien
gtgactcagtaacccacagcgtgct

SEQ ID NO: 373664 - DNA, 25 bp, Homo sapien
cacacactgggtttgcattggagat

SEQ ID NO: 373665 - DNA, 25 bp, Homo sapien
attggagattgtttcaccctgcaaa

SEQ ID NO: 373666 - DNA, 25 bp, Homo sapien
aaacgtcaacgtcagcagactcgtc

SEQ ID NO: 373667 - DNA, 25 bp, Homo sapien
agactcgtcggtgcgctgtgctatc

SEQ ID NO: 373668 - DNA, 25 bp, Homo sapien
agtcatcaggaacccaactttcttc

SEQ ID NO: 373669 - DNA, 25 bp, Homo sapien
gctgctgtgccgttcttaatacatg

SEQ ID NO: 373670 - DNA, 25 bp, Homo sapien
atacatgattcccagctagtggtgc

SEQ ID NO: 373671 - DNA, 25 bp, Homo sapien
ctagtggtgcagtgctggctttcat

SEQ ID NO: 373672 - DNA, 25 bp, Homo sapien
gtttatatttctagccggcagaaag

SEQ ID NO: 373673 - DNA, 25 bp, Homo sapien
aggaaagagttatccacctcctgca

SEQ ID NO: 373674 - DNA, 25 bp, Homo sapien
tatccacctcctgcaagtagatttg

SEQ ID NO: 373675 - DNA, 25 bp, Homo sapien
gtagatttgcaggaattctcactcc

SEQ ID NO: 373676 - DNA, 25 bp, Homo sapien
aattctcactcctgttagccagata

SEQ ID NO: 373677 - DNA, 25 bp, Homo sapien
gttagccagatattacccacctagc

SEQ ID NO: 373678 - DNA, 25 bp, Homo sapien
gtgtggaggctctatagtcatcagg

SEQ ID NO: 373679 - DNA, 25 bp, Homo sapien
gaagtcttgtctaaaatcctctgtg

SEQ ID NO: 373680 - DNA, 25 bp, Homo sapien
atcctctgtgtctttatgctctgta

SEQ ID NO: 373681 - DNA, 25 bp, Homo sapien
atgctctgtaaccaatttcttcttt

SEQ ID NO: 373682 - DNA, 25 bp, Homo sapien
ttcttctttgtcacgtaatggtctt

SEQ ID NO: 373683 - DNA, 25 bp, Homo sapien
agtttttactacatatgccttccgc

SEQ ID NO: 373684 - DNA, 25 bp, Homo sapien
atgccttccgcatttgtagtttttt

SEQ ID NO: 373685 - DNA, 25 bp, Homo sapien
tcaactgtttcaaattctggagcat

SEQ ID NO: 373686 - DNA, 25 bp, Homo sapien
gcacacatgaagcaatccaccgaag

SEQ ID NO: 373687 - DNA, 25 bp, Homo sapien
tccaccgaagaaactctgttcatcc

SEQ ID NO: 373688 - DNA, 25 bp, Homo sapien
tgttcatccatttttctcttggctg

SEQ ID NO: 373689 - DNA, 25 bp, Homo sapien
ggctgtccttgcactttgtaagttc

SEQ ID NO: 373690 - DNA, 25 bp, Homo sapien
atgatatcaggactggttacttggt

SEQ ID NO: 373691 - DNA, 25 bp, Homo sapien
tgatatcaggactggttacttggtt

SEQ ID NO: 373692 - DNA, 25 bp, Homo sapien
gatatcaggactggttacttggtta

SEQ ID NO: 373693 - DNA, 25 bp, Homo sapien
atatcaggactggttacttggttaa

SEQ ID NO: 373694 - DNA, 25 bp, Homo sapien
tatcaggactggttacttggttaag

SEQ ID NO: 373695 - DNA, 25 bp, Homo sapien
atcaggactggttacttggttaagg

SEQ ID NO: 373696 - DNA, 25 bp, Homo sapien
tcaggactggttacttggttaagga

SEQ ID NO: 373697 - DNA, 25 bp, Homo sapien
caggactggttacttggttaaggag

SEQ ID NO: 373698 - DNA, 25 bp, Homo sapien
tcggcacgaggtttggtgttatttt

SEQ ID NO: 373699 - DNA, 25 bp, Homo sapien
catttctctcagcaagcattttcct

SEQ ID NO: 373700 - DNA, 25 bp, Homo sapien
ctctcagcaagcattttcctgggta

SEQ ID NO: 373701 - DNA, 25 bp, Homo sapien
gcaagcattttcctgggtagtagta

SEQ ID NO: 373702 - DNA, 25 bp, Homo sapien
ttcctgggtagtagtaatagcttag

SEQ ID NO: 373703 - DNA, 25 bp, Homo sapien
agcttaggaatcaaatgccactttt

SEQ ID NO: 373704 - DNA, 25 bp, Homo sapien
gtttgaaataccacaaatcacaggt

SEQ ID NO: 373705 - DNA, 25 bp, Homo sapien
aaatcacaggtgagtcagtcctccc

SEQ ID NO: 373706 - DNA, 25 bp, Homo sapien
caggtgagtcagtcctcccagagga

SEQ ID NO: 373707 - DNA, 25 bp, Homo sapien
tcccagaggaaaagacagtcctagg

SEQ ID NO: 373708 - DNA, 25 bp, Homo sapien
agtcctagggagaatcacaggcctg

SEQ ID NO: 373709 - DNA, 25 bp, Homo sapien
ttctccatttttcctagtatgcccc

SEQ ID NO: 373710 - DNA, 25 bp, Homo sapien
cctagtatgcccctttaatttgtca

SEQ ID NO: 373711 - DNA, 25 bp, Homo sapien
tagtatgcccctttaatttgtcagt

SEQ ID NO: 373712 - DNA, 25 bp, Homo sapien
gtatgcccctttaatttgtcagttt

SEQ ID NO: 373713 - DNA, 25 bp, Homo sapien
tgcccctttaatttgtcagtttgct

SEQ ID NO: 373714 - DNA, 25 bp, Homo sapien
ttgtcagtttgctgttagcactgtt

SEQ ID NO: 373715 - DNA, 25 bp, Homo sapien
cagtttgctgttagcactgttatat

SEQ ID NO: 373716 - DNA, 25 bp, Homo sapien
cactgttatatgctgccttagaaag

SEQ ID NO: 373717 - DNA, 25 bp, Homo sapien
gttatatgctgccttagaaagactt

SEQ ID NO: 373718 - DNA, 25 bp, Homo sapien
atgctgccttagaaagacttttggt

SEQ ID NO: 373719 - DNA, 25 bp, Homo sapien
atgactgtgttaatcttttttgatc

SEQ ID NO: 373720 - DNA, 25 bp, Homo sapien
aatccaggcaaagtgctgtgaaggg

SEQ ID NO: 373721 - DNA, 25 bp, Homo sapien
gagcacttagcccacaagttccctg

SEQ ID NO: 373722 - DNA, 25 bp, Homo sapien
acaagttccctgactacggagccgg

SEQ ID NO: 373723 - DNA, 25 bp, Homo sapien
cctgactacggagccggttctggaa

SEQ ID NO: 373724 - DNA, 25 bp, Homo sapien
ggaacttttcttcatgccacggccc

SEQ ID NO: 373725 - DNA, 25 bp, Homo sapien
atgccacggcccctgcaaggaaata

SEQ ID NO: 373726 - DNA, 25 bp, Homo sapien
acggcccctgcaaggaaatagatgc

SEQ ID NO: 373727 - DNA, 25 bp, Homo sapien
tgccagcgagcccactgtatctggg

SEQ ID NO: 373728 - DNA, 25 bp, Homo sapien
gagcccactgtatctgggcccaagg

SEQ ID NO: 373729 - DNA, 25 bp, Homo sapien
agaagcctgagcaccgtgttacctc

SEQ ID NO: 373730 - DNA, 25 bp, Homo sapien
ccaaggcctcatgaatccaggcaaa

SEQ ID NO: 373731 - DNA, 25 bp, Homo sapien
gagaaagggcaagtccctcgtggtc

SEQ ID NO: 373732 - DNA, 25 bp, Homo sapien
aagcacctcgataaccagtggcagg

SEQ ID NO: 373733 - DNA, 25 bp, Homo sapien
taaccagtggcaggtaggctgaagt

SEQ ID NO: 373734 - DNA, 25 bp, Homo sapien
gaaggaagcctctgtcaggaggtct

SEQ ID NO: 373735 - DNA, 25 bp, Homo sapien
tctgtcaggaggtctggcgcccagt

SEQ ID NO: 373736 - DNA, 25 bp, Homo sapien
tggcgcccagtgacagacaagacag

SEQ ID NO: 373737 - DNA, 25 bp, Homo sapien
cagccctggctaaaggaatgtctga

SEQ ID NO: 373738 - DNA, 25 bp, Homo sapien
ggaagcctctgcctctgaatgcatt

SEQ ID NO: 373739 - DNA, 25 bp, Homo sapien
tctgcctctgaatgcattccaagac

SEQ ID NO: 373740 - DNA, 25 bp, Homo sapien
gacctggtgcaaatggatgtccatt

SEQ ID NO: 373741 - DNA, 25 bp, Homo sapien
aatggatgtccattcattgttttgt

SEQ ID NO: 373742 - DNA, 25 bp, Homo sapien
gaaattgcttaatcacaaatgttct

SEQ ID NO: 373743 - DNA, 25 bp, Homo sapien
taatcacaaatgttctacagtcttt

SEQ ID NO: 373744 - DNA, 25 bp, Homo sapien
caaatgttctacagtctttaaatgt

SEQ ID NO: 373745 - DNA, 25 bp, Homo sapien
agtagaattagacagtgagatcatc

SEQ ID NO: 373746 - DNA, 25 bp, Homo sapien
gacagtgagatcatctgagtaaatt

SEQ ID NO: 373747 - DNA, 25 bp, Homo sapien
ctgagtaaattgattggtgattcca

SEQ ID NO: 373748 - DNA, 25 bp, Homo sapien
tggtgattccagagataagactaat

SEQ ID NO: 373749 - DNA, 25 bp, Homo sapien
aaaaacgtactcatcacagaatttg

SEQ ID NO: 373750 - DNA, 25 bp, Homo sapien
aaaatacatgtacacttcaaagagt

SEQ ID NO: 373751 - DNA, 25 bp, Homo sapien
aatgtataaatgctgtagctcagga

SEQ ID NO: 373752 - DNA, 25 bp, Homo sapien
gtagctcaggattatatgtaccttt

SEQ ID NO: 373753 - DNA, 25 bp, Homo sapien
agtgccactgagctgctagaaaagc

SEQ ID NO: 373754 - DNA, 25 bp, Homo sapien
gagctgctagaaaagcaggccacac

SEQ ID NO: 373755 - DNA, 25 bp, Homo sapien
aaatattgctgagcgagtcaaggaa

SEQ ID NO: 373756 - DNA, 25 bp, Homo sapien
gtttgccccttcctatgaatctcga

SEQ ID NO: 373757 - DNA, 25 bp, Homo sapien
cttcctatgaatctcgacgccaaaa

SEQ ID NO: 373758 - DNA, 25 bp, Homo sapien
aatctcgacgccaaaaccaagacag

SEQ ID NO: 373759 - DNA, 25 bp, Homo sapien
gacagaatcaataaaaccgttttat

SEQ ID NO: 373760 - DNA, 25 bp, Homo sapien
gttttatatggaactcccaggaaat

SEQ ID NO: 373761 - DNA, 25 bp, Homo sapien
aaccaccctttactgcaagctaagc

SEQ ID NO: 373762 - DNA, 25 bp, Homo sapien
aagctaagccgcaatcagaaccgga

SEQ ID NO: 373763 - DNA, 25 bp, Homo sapien
agccgcaatcagaaccggactacct

SEQ ID NO: 373764 - DNA, 25 bp, Homo sapien
aaagactatctaccaatgactcccc

SEQ ID NO: 373765 - DNA, 25 bp, Homo sapien
taacctgaaggctgttttgtgcccc

SEQ ID NO: 373766 - DNA, 25 bp, Homo sapien
tgaaggctgttttgtgcccctcctt

SEQ ID NO: 373767 - DNA, 25 bp, Homo sapien
tgttttgtgcccctccttgattgtg

SEQ ID NO: 373768 - DNA, 25 bp, Homo sapien
tttgtgcccctccttgattgtgcat

SEQ ID NO: 373769 - DNA, 25 bp, Homo sapien
gtgcccctccttgattgtgcattca

SEQ ID NO: 373770 - DNA, 25 bp, Homo sapien
ttgattgtgcattcacctcccaacc

SEQ ID NO: 373771 - DNA, 25 bp, Homo sapien
cgctccttgggcaactgttatcttt

SEQ ID NO: 373772 - DNA, 25 bp, Homo sapien
gttatttgtcattgccttaacatta

SEQ ID NO: 373773 - DNA, 25 bp, Homo sapien
tttgtcattgccttaacattagatt

SEQ ID NO: 373774 - DNA, 25 bp, Homo sapien
attttgaatgcaactcctcttttaa

SEQ ID NO: 373775 - DNA, 25 bp, Homo sapien
agtctgatgaattgcttagcctgtt

SEQ ID NO: 373776 - DNA, 25 bp, Homo sapien
gatgaattgcttagcctgttgcctt

SEQ ID NO: 373777 - DNA, 25 bp, Homo sapien
aattgcttagcctgttgcctttgac

SEQ ID NO: 373778 - DNA, 25 bp, Homo sapien
ttgcttagcctgttgcctttgacta

SEQ ID NO: 373779 - DNA, 25 bp, Homo sapien
ggcctgggtggcctcattaactcta

SEQ ID NO: 373780 - DNA, 25 bp, Homo sapien
tgggctcttgattctccctgaagga

SEQ ID NO: 373781 - DNA, 25 bp, Homo sapien
tcttgattctccctgaaggagggat

SEQ ID NO: 373782 - DNA, 25 bp, Homo sapien
gagggaggaacagtcagccacagct

SEQ ID NO: 373783 - DNA, 25 bp, Homo sapien
ggaggaacagtcagccacagctctc

SEQ ID NO: 373784 - DNA, 25 bp, Homo sapien
ggaacagtcagccacagctctcttc

SEQ ID NO: 373785 - DNA, 25 bp, Homo sapien
tctccaccccaagctttgaggaaga

SEQ ID NO: 373786 - DNA, 25 bp, Homo sapien
gaaaactgatgccaacacttccttt

SEQ ID NO: 373787 - DNA, 25 bp, Homo sapien
ttgccttttgtttcctgtgcaaaca

SEQ ID NO: 373788 - DNA, 25 bp, Homo sapien
gtgcaaacaagtgagtcaccccttt

SEQ ID NO: 373789 - DNA, 25 bp, Homo sapien
tttgatcccagccataaagtacctg

SEQ ID NO: 373790 - DNA, 25 bp, Homo sapien
gttttttccagtttgtcagtgtctg

SEQ ID NO: 373791 - DNA, 25 bp, Homo sapien
gtcagtgtctgtgagaattacttat

SEQ ID NO: 373792 - DNA, 25 bp, Homo sapien
ttctctattctcatagcacgtgtgt

SEQ ID NO: 373793 - DNA, 25 bp, Homo sapien
gcacgtgtgtgattggttcatgcat

SEQ ID NO: 373794 - DNA, 25 bp, Homo sapien
ggttcatgcatgtaggtctcttaac

SEQ ID NO: 373795 - DNA, 25 bp, Homo sapien
ctcttaacaatgatggtgggcctct

SEQ ID NO: 373796 - DNA, 25 bp, Homo sapien
gctggccggttgttctatgcagaga

SEQ ID NO: 373797 - DNA, 25 bp, Homo sapien
ttgccaggaacactgcagagacaat

SEQ ID NO: 373798 - DNA, 25 bp, Homo sapien
agagacaatgctgtgagtttccaac

SEQ ID NO: 373799 - DNA, 25 bp, Homo sapien
agtttgtccatcaccattatgatat

SEQ ID NO: 373800 - DNA, 25 bp, Homo sapien
tttgtccatcaccattatgatatca

SEQ ID NO: 373801 - DNA, 25 bp, Homo sapien
ttgtccatcaccattatgatatcag

SEQ ID NO: 373802 - DNA, 25 bp, Homo sapien
tgtccatcaccattatgatatcagg

SEQ ID NO: 373803 - DNA, 25 bp, Homo sapien
tccatcaccattatgatatcaggac

SEQ ID NO: 373804 - DNA, 25 bp, Homo sapien
catcaccattatgatatcaggactg

SEQ ID NO: 373805 - DNA, 25 bp, Homo sapien
cacgcgtccgcaaatatttcctcat

SEQ ID NO: 373806 - DNA, 25 bp, Homo sapien
ttcctcatcttttgttgttgtcatg

SEQ ID NO: 373807 - DNA, 25 bp, Homo sapien
tcatggatggtggtgacatggactt

SEQ ID NO: 373808 - DNA, 25 bp, Homo sapien
aaagactatctaccaatgactcccc

SEQ ID NO: 373809 - DNA, 25 bp, Homo sapien
taacctgaaggctgttttgtgcccc

SEQ ID NO: 373810 - DNA, 25 bp, Homo sapien
acctgaaggctgttttgtgcccctc

SEQ ID NO: 373811 - DNA, 25 bp, Homo sapien
tgaaggctgttttgtgcccctcctt

SEQ ID NO: 373812 - DNA, 25 bp, Homo sapien
tgttttgtgcccctccttgattgtg

SEQ ID NO: 373813 - DNA, 25 bp, Homo sapien
tttgtgcccctccttgattgtgcat

SEQ ID NO: 373814 - DNA, 25 bp, Homo sapien
gtgcccctccttgattgtgcattca

SEQ ID NO: 373815 - DNA, 25 bp, Homo sapien
ccttgattgtgcattcacctcccaa

SEQ ID NO: 373816 - DNA, 25 bp, Homo sapien
ttgattgtgcattcacctcccaacc

SEQ ID NO: 373817 - DNA, 25 bp, Homo sapien
gttatttgtcattgccttaacatta

SEQ ID NO: 373818 - DNA, 25 bp, Homo sapien
tttgtcattgccttaacattagatt

SEQ ID NO: 373819 - DNA, 25 bp, Homo sapien
ttttttcttgagacacttgttgccc

SEQ ID NO: 373820 - DNA, 25 bp, Homo sapien
tcttgagacacttgttgcccagact

SEQ ID NO: 373821 - DNA, 25 bp, Homo sapien
ttttctctgccctattgaaccatat

SEQ ID NO: 373822 - DNA, 25 bp, Homo sapien
tctctgccctattgaaccatatatg

SEQ ID NO: 373823 - DNA, 25 bp, Homo sapien
tgccctattgaaccatatatgccag

SEQ ID NO: 373824 - DNA, 25 bp, Homo sapien
ccatatatgccagagaaagagcccc

SEQ ID NO: 373825 - DNA, 25 bp, Homo sapien
atgctgcaggtaatcattttcatct

SEQ ID NO: 373826 - DNA, 25 bp, Homo sapien
aatcattttcatctggaagttctgg

SEQ ID NO: 373827 - DNA, 25 bp, Homo sapien
gaagttctgggaaaattgttctaag

SEQ ID NO: 373828 - DNA, 25 bp, Homo sapien
ttgttctaagccaacctgtgatctc

SEQ ID NO: 373829 - DNA, 25 bp, Homo sapien
ttctaagccaacctgtgatctcagc

SEQ ID NO: 373830 - DNA, 25 bp, Homo sapien
ttgtctttttgtggccaaatatcct

SEQ ID NO: 373831 - DNA, 25 bp, Homo sapien
caactgcataccgtagctgaaaatt

SEQ ID NO: 373832 - DNA, 25 bp, Homo sapien
aatatcctactgtgatcacttcagt

SEQ ID NO: 373833 - DNA, 25 bp, Homo sapien
gatcacttcagtcatatcctggacc

SEQ ID NO: 373834 - DNA, 25 bp, Homo sapien
agtcatatcctggaccgtctttggt

SEQ ID NO: 373835 - DNA, 25 bp, Homo sapien
gaccgtctttggtttactgtgacta

SEQ ID NO: 373836 - DNA, 25 bp, Homo sapien
actgtgactaaaatcatagcaccaa

SEQ ID NO: 373837 - DNA, 25 bp, Homo sapien
ataatttggtcctatctgcttctac

SEQ ID NO: 373838 - DNA, 25 bp, Homo sapien
tctaccatcccaacttttttcatca

SEQ ID NO: 373839 - DNA, 25 bp, Homo sapien
atttccaatcatccatttttaatag

SEQ ID NO: 373840 - DNA, 25 bp, Homo sapien
gatatctgaactgtagagcactgta

SEQ ID NO: 373841 - DNA, 25 bp, Homo sapien
tacaatagcattttaagaccatagt

SEQ ID NO: 373842 - DNA, 25 bp, Homo sapien
gaccatagtaggattctagcatacc

SEQ ID NO: 373843 - DNA, 25 bp, Homo sapien
gattctagcataccgtgtagtacct

SEQ ID NO: 373844 - DNA, 25 bp, Homo sapien
taccgtgtagtacctatggagtatt

SEQ ID NO: 373845 - DNA, 25 bp, Homo sapien
acctatggagtattgtaagagctaa

SEQ ID NO: 373846 - DNA, 25 bp, Homo sapien
tgaattgcttctcatcttgttctcc

SEQ ID NO: 373847 - DNA, 25 bp, Homo sapien
atcttgttctccagtttccattgtt

SEQ ID NO: 373848 - DNA, 25 bp, Homo sapien
gttggtttattgcagatttgtatcc

SEQ ID NO: 373849 - DNA, 25 bp, Homo sapien
attgcagatttgtatcctgtgtcaa

SEQ ID NO: 373850 - DNA, 25 bp, Homo sapien
gtatcctgtgtcaaattcaaggtat

SEQ ID NO: 373851 - DNA, 25 bp, Homo sapien
gataaaccttttcaaccagcagcaa

SEQ ID NO: 373852 - DNA, 25 bp, Homo sapien
aaatcaaggttgtcagtggttacag

SEQ ID NO: 373853 - DNA, 25 bp, Homo sapien
tggttacagagtgccaagaggactt

SEQ ID NO: 373854 - DNA, 25 bp, Homo sapien
atttccatagattttcttcttccaa

SEQ ID NO: 373855 - DNA, 25 bp, Homo sapien
atttgtctatagttctccggaggcc

SEQ ID NO: 373856 - DNA, 25 bp, Homo sapien
aggcctctccagattgtgatgcact

SEQ ID NO: 373857 - DNA, 25 bp, Homo sapien
aagccaccatgaacatatcctcagg

SEQ ID NO: 373858 - DNA, 25 bp, Homo sapien
aattccacattcatggcttttggga

SEQ ID NO: 373859 - DNA, 25 bp, Homo sapien
atgaacatatcctcaggtctccagt

SEQ ID NO: 373860 - DNA, 25 bp, Homo sapien
agtcttctgccatcgcatgaaaaat

SEQ ID NO: 373861 - DNA, 25 bp, Homo sapien
aaaatggagcttgtcaaacacagag

SEQ ID NO: 373862 - DNA, 25 bp, Homo sapien
gaatccagaatgttggacctgatgc

SEQ ID NO: 373863 - DNA, 25 bp, Homo sapien
cacgtctttggctgactttcattca

SEQ ID NO: 373864 - DNA, 25 bp, Homo sapien
ttggctgactttcattcattcttca

SEQ ID NO: 373865 - DNA, 25 bp, Homo sapien
tttcattcattcttcaggctttgtc

SEQ ID NO: 373866 - DNA, 25 bp, Homo sapien
attcttcaggctttgtcacgtctat

SEQ ID NO: 373867 - DNA, 25 bp, Homo sapien
ttcaggctttgtcacgtctatcact

SEQ ID NO: 373868 - DNA, 25 bp, Homo sapien
ggctttgtcacgtctatcacttatt

SEQ ID NO: 373869 - DNA, 25 bp, Homo sapien
tgtcacgtctatcacttattttctg

SEQ ID NO: 373870 - DNA, 25 bp, Homo sapien
gtctatcacttattttctgactact

SEQ ID NO: 373871 - DNA, 25 bp, Homo sapien
tgaccccaatcctggattagttgcc

SEQ ID NO: 373872 - DNA, 25 bp, Homo sapien
aatcctggattagttgccccttctg

SEQ ID NO: 373873 - DNA, 25 bp, Homo sapien
tcctggattagttgccccttctgtc

SEQ ID NO: 373874 - DNA, 25 bp, Homo sapien
aagccctggtgttccaaactcagtc

SEQ ID NO: 373875 - DNA, 25 bp, Homo sapien
tggtgttccaaactcagtctttcct

SEQ ID NO: 373876 - DNA, 25 bp, Homo sapien
tgttccaaactcagtctttcctgaa

SEQ ID NO: 373877 - DNA, 25 bp, Homo sapien
cctgaagaagaggatctgagttatc

SEQ ID NO: 373878 - DNA, 25 bp, Homo sapien
ctgagttatcttctgaaacagcgtt

SEQ ID NO: 373879 - DNA, 25 bp, Homo sapien
ttatcttctgaaacagcgttctccc

SEQ ID NO: 373880 - DNA, 25 bp, Homo sapien
atcttctgaaacagcgttctccctt

SEQ ID NO: 373881 - DNA, 25 bp, Homo sapien
tgaaacagcgttctcccttcccagt

SEQ ID NO: 373882 - DNA, 25 bp, Homo sapien
ccttcccagttgtatcactcttata

SEQ ID NO: 373883 - DNA, 25 bp, Homo sapien
ttcccagttgtatcactcttataaa

SEQ ID NO: 373884 - DNA, 25 bp, Homo sapien
actcttataaaaagactgtccagtc

SEQ ID NO: 373885 - DNA, 25 bp, Homo sapien
ggcctcccaacagagtgtggttttt

SEQ ID NO: 373886 - DNA, 25 bp, Homo sapien
cccagcccagggactgaacagtggt

SEQ ID NO: 373887 - DNA, 25 bp, Homo sapien
tggtttcagagtttagattctgtga

SEQ ID NO: 373888 - DNA, 25 bp, Homo sapien
gattctgtgatagcaggtgcctccc

SEQ ID NO: 373889 - DNA, 25 bp, Homo sapien
gtgatagcaggtgcctcccttctca

SEQ ID NO: 373890 - DNA, 25 bp, Homo sapien
agggtgccacagcactctaccgggt

SEQ ID NO: 373891 - DNA, 25 bp, Homo sapien
taccgggtctcctctagggtagcca

SEQ ID NO: 373892 - DNA, 25 bp, Homo sapien
gtctcctctagggtagccaggacag

SEQ ID NO: 373893 - DNA, 25 bp, Homo sapien
ggtagccaggacagaaggcctgcat

SEQ ID NO: 373894 - DNA, 25 bp, Homo sapien
ggcctgcatggtggaagactcccac

SEQ ID NO: 373895 - DNA, 25 bp, Homo sapien
tggtggaagactcccactctatact

SEQ ID NO: 373896 - DNA, 25 bp, Homo sapien
aagttaattcaaagtgctggtcctg

SEQ ID NO: 373897 - DNA, 25 bp, Homo sapien
ttaattcaaagtgctggtcctggcc

SEQ ID NO: 373898 - DNA, 25 bp, Homo sapien
aattcaaagtgctggtcctggccgg

SEQ ID NO: 373899 - DNA, 25 bp, Homo sapien
attcaaagtgctggtcctggccggg

SEQ ID NO: 373900 - DNA, 25 bp, Homo sapien
tcaaagtgctggtcctggccgggca

SEQ ID NO: 373901 - DNA, 25 bp, Homo sapien
tcctggccgggcatggtaattcatg

SEQ ID NO: 373902 - DNA, 25 bp, Homo sapien
agaactttgcgtggccaaggcaaga

SEQ ID NO: 373903 - DNA, 25 bp, Homo sapien
tggcatatgcctgttgtcctggctt

SEQ ID NO: 373904 - DNA, 25 bp, Homo sapien
gttgtcctggcttttaggaggctga

SEQ ID NO: 373905 - DNA, 25 bp, Homo sapien
ttgtcctggcttttaggaggctgaa

SEQ ID NO: 373906 - DNA, 25 bp, Homo sapien
ttacagtgagttatggtcataccac

SEQ ID NO: 373907 - DNA, 25 bp, Homo sapien
aagtattccctaaacgatgtgagtg

SEQ ID NO: 373908 - DNA, 25 bp, Homo sapien
aagtcattgcaaagtcagtattttt

SEQ ID NO: 373909 - DNA, 25 bp, Homo sapien
ttttttgttcatcattgctactgaa

SEQ ID NO: 373910 - DNA, 25 bp, Homo sapien
gaaattcagagttccattgtatatg

SEQ ID NO: 373911 - DNA, 25 bp, Homo sapien
atatgtgtgtcttgagtgtacctta

SEQ ID NO: 373912 - DNA, 25 bp, Homo sapien
gagtgtaccttattagaatatccaa

SEQ ID NO: 373913 - DNA, 25 bp, Homo sapien
gcttttggatattctatgcttttgt

SEQ ID NO: 373914 - DNA, 25 bp, Homo sapien
gcttttgtgtccttcagaaatcatg

SEQ ID NO: 373915 - DNA, 25 bp, Homo sapien
gtttttgttttggttgctgcctgaa

SEQ ID NO: 373916 - DNA, 25 bp, Homo sapien
ggttgctgcctgaaaaaagttacca

SEQ ID NO: 373917 - DNA, 25 bp, Homo sapien
aagttaccaactcatttagtgaaat

SEQ ID NO: 373918 - DNA, 25 bp, Homo sapien
gatggatcgaattccattggatact

SEQ ID NO: 373919 - DNA, 25 bp, Homo sapien
gatactaattgagcttcccttggtg

SEQ ID NO: 373920 - DNA, 25 bp, Homo sapien
ttcccttggtggttccataacacaa

SEQ ID NO: 373921 - DNA, 25 bp, Homo sapien
aacacaagataagttctcggtaatt

SEQ ID NO: 373922 - DNA, 25 bp, Homo sapien
gtaattataaacacgaacttctgag

SEQ ID NO: 373923 - DNA, 25 bp, Homo sapien
gtatgtctggtagagaacgtgcaaa

SEQ ID NO: 373924 - DNA, 25 bp, Homo sapien
gcaaatttcaacacacactcatata

SEQ ID NO: 373925 - DNA, 25 bp, Homo sapien
aatcgtgcaatgctattccagtcat

SEQ ID NO: 373926 - DNA, 25 bp, Homo sapien
tttctaccaccaacaggctcagaca

SEQ ID NO: 373927 - DNA, 25 bp, Homo sapien
tttcatatgtcaggtaaacgtgccg

SEQ ID NO: 373928 - DNA, 25 bp, Homo sapien
aaacgtgccgggatggtccttgctc

SEQ ID NO: 373929 - DNA, 25 bp, Homo sapien
agtaaaagaacttgtcaatcgcctt

SEQ ID NO: 373930 - DNA, 25 bp, Homo sapien
aagaacttgtcaatcgcctttggaa

SEQ ID NO: 373931 - DNA, 25 bp, Homo sapien
gaacttgtcaatcgcctttggaagg

SEQ ID NO: 373932 - DNA, 25 bp, Homo sapien
gcctttggaaggcaatgaaacactt

SEQ ID NO: 373933 - DNA, 25 bp, Homo sapien
gaaacacttaataaactctcaataa

SEQ ID NO: 373934 - DNA, 25 bp, Homo sapien
taaactctcaataacagaagcgtaa

SEQ ID NO: 373935 - DNA, 25 bp, Homo sapien
taaaaatgaaatgtaaacctccaat

SEQ ID NO: 373936 - DNA, 25 bp, Homo sapien
gtctgattttattatacaccaaagg

SEQ ID NO: 373937 - DNA, 25 bp, Homo sapien
tacaccaaaggttaacagtgaatct

SEQ ID NO: 373938 - DNA, 25 bp, Homo sapien
gttaacagtgaatctctgtgtgatc

SEQ ID NO: 373939 - DNA, 25 bp, Homo sapien
tttgcctatctgcatcttctcactt

SEQ ID NO: 373940 - DNA, 25 bp, Homo sapien
acatccgatcctgcttagagtcgaa

SEQ ID NO: 373941 - DNA, 25 bp, Homo sapien
gagtcgaagatgaatctggcataat

SEQ ID NO: 373942 - DNA, 25 bp, Homo sapien
ggcataatacaaacagcactggact

SEQ ID NO: 373943 - DNA, 25 bp, Homo sapien
aaacagcactggactggaagcatga

SEQ ID NO: 373944 - DNA, 25 bp, Homo sapien
ggactggaagcatgaagtttctctt

SEQ ID NO: 373945 - DNA, 25 bp, Homo sapien
aagtttctcttatctgtgccttggt

SEQ ID NO: 373946 - DNA, 25 bp, Homo sapien
ataaataatcacacaggtctctgtt

SEQ ID NO: 373947 - DNA, 25 bp, Homo sapien
gtctctgttagtaccattttgtgat

SEQ ID NO: 373948 - DNA, 25 bp, Homo sapien
gtgattttatatcgtgcttaccaca

SEQ ID NO: 373949 - DNA, 25 bp, Homo sapien
gtgcttaccacacctagaaacaggg

SEQ ID NO: 373950 - DNA, 25 bp, Homo sapien
atcattccagccagctaacagagaa

SEQ ID NO: 373951 - DNA, 25 bp, Homo sapien
gcattgtcaaatttgtaagcttcat

SEQ ID NO: 373952 - DNA, 25 bp, Homo sapien
gtaagcttcatagggatggacatca

SEQ ID NO: 373953 - DNA, 25 bp, Homo sapien
tggacatcatatctataatgccctt

SEQ ID NO: 373954 - DNA, 25 bp, Homo sapien
ataatgcccttctatatgtgctacc

SEQ ID NO: 373955 - DNA, 25 bp, Homo sapien
tgcccttctatatgtgctaccatag

SEQ ID NO: 373956 - DNA, 25 bp, Homo sapien
gtgctaccatagatgtgacattttt

SEQ ID NO: 373957 - DNA, 25 bp, Homo sapien
accatagatgtgacatttttgacct

SEQ ID NO: 373958 - DNA, 25 bp, Homo sapien
ttttgaccttaatatcgtctttgaa

SEQ ID NO: 373959 - DNA, 25 bp, Homo sapien
ttgagaaacctgttaacttacattt

SEQ ID NO: 373960 - DNA, 25 bp, Homo sapien
tatttcattttcagcacagtgcaaa

SEQ ID NO: 373961 - DNA, 25 bp, Homo sapien
tcagcacagtgcaaaagttctttaa

SEQ ID NO: 373962 - DNA, 25 bp, Homo sapien
accttcgtgctgaccaggagctcat

SEQ ID NO: 373963 - DNA, 25 bp, Homo sapien
aggagctcatgacttactcccatga

SEQ ID NO: 373964 - DNA, 25 bp, Homo sapien
atcatctgcgggatcacctctgtct

SEQ ID NO: 373965 - DNA, 25 bp, Homo sapien
tccttgctgggtacgacgacttcaa

SEQ ID NO: 373966 - DNA, 25 bp, Homo sapien
tcaactgcaacgtctgggatgcact

SEQ ID NO: 373967 - DNA, 25 bp, Homo sapien
tgggatgcactcaaagccgaccggg

SEQ ID NO: 373968 - DNA, 25 bp, Homo sapien
tcttggctgggcatgacaaccgcgt

SEQ ID NO: 373969 - DNA, 25 bp, Homo sapien
atgacaaccgcgtcagctgcctggg

SEQ ID NO: 373970 - DNA, 25 bp, Homo sapien
agggtcctgggatagcttcctcaag

SEQ ID NO: 373971 - DNA, 25 bp, Homo sapien
gatctggaactaacgccagtagcat

SEQ ID NO: 373972 - DNA, 25 bp, Homo sapien
aacgccagtagcatgtggatgccat

SEQ ID NO: 373973 - DNA, 25 bp, Homo sapien
aagagattccagcaaatggctttcc

SEQ ID NO: 373974 - DNA, 25 bp, Homo sapien
agcaaatggctttccctccatgggt

SEQ ID NO: 373975 - DNA, 25 bp, Homo sapien
aatggctttccctccatgggtcgca

SEQ ID NO: 373976 - DNA, 25 bp, Homo sapien
atgggtcgcatttccctatctggga

SEQ ID NO: 373977 - DNA, 25 bp, Homo sapien
ccctatctgggaaatgcgagctttg

SEQ ID NO: 373978 - DNA, 25 bp, Homo sapien
tatctgggaaatgcgagctttgacc

SEQ ID NO: 373979 - DNA, 25 bp, Homo sapien
atgcgagctttgaccaggagggcca

SEQ ID NO: 373980 - DNA, 25 bp, Homo sapien
ctttgaccaggagggccacagagtt

SEQ ID NO: 373981 - DNA, 25 bp, Homo sapien
accaggagggccacagagtttcaga

SEQ ID NO: 373982 - DNA, 25 bp, Homo sapien
gggccattccctggatagttaagag

SEQ ID NO: 373983 - DNA, 25 bp, Homo sapien
cattccctggatagttaagagaaac

SEQ ID NO: 373984 - DNA, 25 bp, Homo sapien
tgccatttgttaatactaaccctta

SEQ ID NO: 373985 - DNA, 25 bp, Homo sapien
gaatcacatccaatagtgtcacagt

SEQ ID NO: 373986 - DNA, 25 bp, Homo sapien
gcaataaacttgatcaggtacagaa

SEQ ID NO: 373987 - DNA, 25 bp, Homo sapien
attattgctactatacttcactaca

SEQ ID NO: 373988 - DNA, 25 bp, Homo sapien
acaaagcttgtctatacagtatcat

SEQ ID NO: 373989 - DNA, 25 bp, Homo sapien
gtgacataagccttacaatcgtata

SEQ ID NO: 373990 - DNA, 25 bp, Homo sapien
caatcgtatacaacattcacatggc

SEQ ID NO: 373991 - DNA, 25 bp, Homo sapien
tcacaaatctgtgtcctgtaagttc

SEQ ID NO: 373992 - DNA, 25 bp, Homo sapien
cctgtaagttctctccttctaaaat

SEQ ID NO: 373993 - DNA, 25 bp, Homo sapien
aaatcttcatgttaacttttctact

SEQ ID NO: 373994 - DNA, 25 bp, Homo sapien
aacttttctactcattgccatttgt

SEQ ID NO: 373995 - DNA, 25 bp, Homo sapien
aagctgttaacaactttaatacctg

SEQ ID NO: 373996 - DNA, 25 bp, Homo sapien
ttaatacctgtcttgtttgttctct

SEQ ID NO: 373997 - DNA, 25 bp, Homo sapien
tgttgcctggaatacatgagtcttc

SEQ ID NO: 373998 - DNA, 25 bp, Homo sapien
aattctccatgattagcacctttat

SEQ ID NO: 373999 - DNA, 25 bp, Homo sapien
agcacctttatgtggttatctcatt

SEQ ID NO: 374000 - DNA, 25 bp, Homo sapien
cttgtcaaattcgtcactaaaattg

SEQ ID NO: 374001 - DNA, 25 bp, Homo sapien
atacatgagtcttcctgatctcttc

SEQ ID NO: 374002 - DNA, 25 bp, Homo sapien
tactttcttgaaaacctgtttctgc

SEQ ID NO: 374003 - DNA, 25 bp, Homo sapien
tctgctgctcccaacatgatttaat

SEQ ID NO: 374004 - DNA, 25 bp, Homo sapien
agtcttcctgatctcttcaaacggg

SEQ ID NO: 374005 - DNA, 25 bp, Homo sapien
gagaattcttttgacgtttttgaat

SEQ ID NO: 374006 - DNA, 25 bp, Homo sapien
atgaggacgcgctcgggacactcac

SEQ ID NO: 374007 - DNA, 25 bp, Homo sapien
gaacccggtgtaggctgggaccact

SEQ ID NO: 374008 - DNA, 25 bp, Homo sapien
ggacgcgctcgggacactcacgttt

SEQ ID NO: 374009 - DNA, 25 bp, Homo sapien
acctgcgtcctctcgggacagtggc

SEQ ID NO: 374010 - DNA, 25 bp, Homo sapien
gcgctcgggacactcacgttttctg

SEQ ID NO: 374011 - DNA, 25 bp, Homo sapien
actcacgttttctgcaccggcttcc

SEQ ID NO: 374012 - DNA, 25 bp, Homo sapien
gcttccgccgcttgcgactggcgta

SEQ ID NO: 374013 - DNA, 25 bp, Homo sapien
tccgccgcttgcgactggcgtaggt

SEQ ID NO: 374014 - DNA, 25 bp, Homo sapien
cttgcgactggcgtaggtgatgttg

SEQ ID NO: 374015 - DNA, 25 bp, Homo sapien
tgatgttggcgctgctgctgttcat

SEQ ID NO: 374016 - DNA, 25 bp, Homo sapien
tgttggcgctgctgctgttcatggt

SEQ ID NO: 374017 - DNA, 25 bp, Homo sapien
ggtagcatagcagcatttcttcata

SEQ ID NO: 374018 - DNA, 25 bp, Homo sapien
atttcttcatatctgccttcctagt

SEQ ID NO: 374019 - DNA, 25 bp, Homo sapien
atatctgccttcctagtatggatac

SEQ ID NO: 374020 - DNA, 25 bp, Homo sapien
gaaatggtcctactagactagacag

SEQ ID NO: 374021 - DNA, 25 bp, Homo sapien
gccatgccaacctgaatagaagtgc

SEQ ID NO: 374022 - DNA, 25 bp, Homo sapien
agaagtgccagcacatggcttctgt

SEQ ID NO: 374023 - DNA, 25 bp, Homo sapien
catggcttctgtgttatctgttatc

SEQ ID NO: 374024 - DNA, 25 bp, Homo sapien
gttatctgttatctcactgctttga

SEQ ID NO: 374025 - DNA, 25 bp, Homo sapien
atgaccataagcctcatctgggtaa

SEQ ID NO: 374026 - DNA, 25 bp, Homo sapien
gggtaagaacagctcaatttagcca

SEQ ID NO: 374027 - DNA, 25 bp, Homo sapien
aatttagccatcataccccaggctt

SEQ ID NO: 374028 - DNA, 25 bp, Homo sapien
gctgacttcgaggataactaagatt

SEQ ID NO: 374029 - DNA, 25 bp, Homo sapien
aactaagattacatactttctcagg

SEQ ID NO: 374030 - DNA, 25 bp, Homo sapien
aaggctgcatgcaagacttctctgt

SEQ ID NO: 374031 - DNA, 25 bp, Homo sapien
catgcaagacttctctgtcagggtt

SEQ ID NO: 374032 - DNA, 25 bp, Homo sapien
gtatatgtagctgatgacccactgg

SEQ ID NO: 374033 - DNA, 25 bp, Homo sapien
acaccagtgttccagttcacttacc

SEQ ID NO: 374034 - DNA, 25 bp, Homo sapien
gttcacttaccacatctgtgacagt

SEQ ID NO: 374035 - DNA, 25 bp, Homo sapien
accacatctgtgacagtgtgtttag

SEQ ID NO: 374036 - DNA, 25 bp, Homo sapien
aatgtgatgcattacttcttatgtt

SEQ ID NO: 374037 - DNA, 25 bp, Homo sapien
tacttcttatgtttttatcagtgac

SEQ ID NO: 374038 - DNA, 25 bp, Homo sapien
agtgacatggttgactgtgccctaa

SEQ ID NO: 374039 - DNA, 25 bp, Homo sapien
cccagtcggctttggagtcacggga

SEQ ID NO: 374040 - DNA, 25 bp, Homo sapien
agtcacgggagctagtgcctgctca

SEQ ID NO: 374041 - DNA, 25 bp, Homo sapien
gtgcctgctcacacatttttcaaaa

SEQ ID NO: 374042 - DNA, 25 bp, Homo sapien
aaagggcagtgcactcagaacttca

SEQ ID NO: 374043 - DNA, 25 bp, Homo sapien
taattcctcttgcagtgttgaccag

SEQ ID NO: 374044 - DNA, 25 bp, Homo sapien
gtgttgaccagcagagagacttgag

SEQ ID NO: 374045 - DNA, 25 bp, Homo sapien
ctactttaagcctccactatgtgtt

SEQ ID NO: 374046 - DNA, 25 bp, Homo sapien
atctgcttatggaagttgtgccctt

SEQ ID NO: 374047 - DNA, 25 bp, Homo sapien
gttgtgcccttcacttggttagtaa

SEQ ID NO: 374048 - DNA, 25 bp, Homo sapien
tggttagtaaccacctcagccataa

SEQ ID NO: 374049 - DNA, 25 bp, Homo sapien
acctcagccataatacttaccatca

SEQ ID NO: 374050 - DNA, 25 bp, Homo sapien
ttttctgctgtgttattctgaaggc

SEQ ID NO: 374051 - DNA, 25 bp, Homo sapien
gaaggcagctcaggatcccaggata

SEQ ID NO: 374052 - DNA, 25 bp, Homo sapien
ggatactgtgatagtccttcacctc

SEQ ID NO: 374053 - DNA, 25 bp, Homo sapien
tccaggcagggacaagcaacgcacc

SEQ ID NO: 374054 - DNA, 25 bp, Homo sapien
caacgcacctgcatcgggaaagcaa

SEQ ID NO: 374055 - DNA, 25 bp, Homo sapien
gcttgcagcctattggccagaggca

SEQ ID NO: 374056 - DNA, 25 bp, Homo sapien
gaggcaggtcacgtgaccactaggt

SEQ ID NO: 374057 - DNA, 25 bp, Homo sapien
cactaggtgggtggtaatctggaaa

SEQ ID NO: 374058 - DNA, 25 bp, Homo sapien
tctggaaagcgttgggcgcactgct

SEQ ID NO: 374059 - DNA, 25 bp, Homo sapien
gcgcactgctgtccctggacaaaat

SEQ ID NO: 374060 - DNA, 25 bp, Homo sapien
aatccagattcttgttagtgaggca

SEQ ID NO: 374061 - DNA, 25 bp, Homo sapien
aaggtcatgacggatggctgtggat

SEQ ID NO: 374062 - DNA, 25 bp, Homo sapien
gctggtaagggagacaaactgcctc

SEQ ID NO: 374063 - DNA, 25 bp, Homo sapien
gggagacaaactgcctcccttgttt

SEQ ID NO: 374064 - DNA, 25 bp, Homo sapien
actgcctcccttgtttccaagagaa

SEQ ID NO: 374065 - DNA, 25 bp, Homo sapien
gttttctgcctttgacagttggtgt

SEQ ID NO: 374066 - DNA, 25 bp, Homo sapien
gcctttgacagttggtgtgatagtt

SEQ ID NO: 374067 - DNA, 25 bp, Homo sapien
ctgccgggctccagttttgagaggg

SEQ ID NO: 374068 - DNA, 25 bp, Homo sapien
tgtgatagtttgcttccagtgaagt

SEQ ID NO: 374069 - DNA, 25 bp, Homo sapien
gaagtttgactcactgtatctggaa

SEQ ID NO: 374070 - DNA, 25 bp, Homo sapien
gactcactgtatctggaagctgtca

SEQ ID NO: 374071 - DNA, 25 bp, Homo sapien
aagctgtcagaagtgggagcatgaa

SEQ ID NO: 374072 - DNA, 25 bp, Homo sapien
atgttaattttgttcctagctgcta

SEQ ID NO: 374073 - DNA, 25 bp, Homo sapien
gttaattttgttcctagctgctaat

SEQ ID NO: 374074 - DNA, 25 bp, Homo sapien
ttcctagctgctaatttttctgcca

SEQ ID NO: 374075 - DNA, 25 bp, Homo sapien
tcctagctgctaatttttctgccaa

SEQ ID NO: 374076 - DNA, 25 bp, Homo sapien
ctgatatgtataaccatttactata

SEQ ID NO: 374077 - DNA, 25 bp, Homo sapien
gccaaaagtattctaattttcaggt

SEQ ID NO: 374078 - DNA, 25 bp, Homo sapien
tttttattcacgtcatttaaattag

SEQ ID NO: 374079 - DNA, 25 bp, Homo sapien
aatctctttaacaagatgcaacaag

SEQ ID NO: 374080 - DNA, 25 bp, Homo sapien
caagatgcaacaagacagaattatt

SEQ ID NO: 374081 - DNA, 25 bp, Homo sapien
gttgcaaatcattctaatatatgta

SEQ ID NO: 374082 - DNA, 25 bp, Homo sapien
attatttgtaatgcagttattggta

SEQ ID NO: 374083 - DNA, 25 bp, Homo sapien
tattgcatatctgggttggatgtta

SEQ ID NO: 374084 - DNA, 25 bp, Homo sapien
aggaatatttacctggtgttacatt

SEQ ID NO: 374085 - DNA, 25 bp, Homo sapien
gtaactggtctagcaacattaaggg

SEQ ID NO: 374086 - DNA, 25 bp, Homo sapien
gggatttctgaagccaactccggag

SEQ ID NO: 374087 - DNA, 25 bp, Homo sapien
cacattttgcactgtttttatatac

SEQ ID NO: 374088 - DNA, 25 bp, Homo sapien
tgtattcatatcctcttatcacctc

SEQ ID NO: 374089 - DNA, 25 bp, Homo sapien
atcctcttatcacctcagactcaga

SEQ ID NO: 374090 - DNA, 25 bp, Homo sapien
agactcagacacaaggccttttaca

SEQ ID NO: 374091 - DNA, 25 bp, Homo sapien
acacaaggccttttacatggaaatt

SEQ ID NO: 374092 - DNA, 25 bp, Homo sapien
ttatgtaaaataacgtcctgtgacc

SEQ ID NO: 374093 - DNA, 25 bp, Homo sapien
cgtcctgtgaccaagttgtttaaat

SEQ ID NO: 374094 - DNA, 25 bp, Homo sapien
gcagattggtctgtccccagagggc

SEQ ID NO: 374095 - DNA, 25 bp, Homo sapien
tcgaagtgggcttgcttcttccgga

SEQ ID NO: 374096 - DNA, 25 bp, Homo sapien
gacaaaaggcagacccaggctctaa

SEQ ID NO: 374097 - DNA, 25 bp, Homo sapien
tgcttcttccggacgttccaatgca

SEQ ID NO: 374098 - DNA, 25 bp, Homo sapien
ggacgttccaatgcaggcactgggc

SEQ ID NO: 374099 - DNA, 25 bp, Homo sapien
caggcactgggcgaggctctcaaac

SEQ ID NO: 374100 - DNA, 25 bp, Homo sapien
aggctctcaaaccagtcgctcacgg

SEQ ID NO: 374101 - DNA, 25 bp, Homo sapien
aggctctaacccagctacagaaagg

SEQ ID NO: 374102 - DNA, 25 bp, Homo sapien
tacagaaaggaagtggccgtgccac

SEQ ID NO: 374103 - DNA, 25 bp, Homo sapien
tgccactgagacaggcggtcacaga

SEQ ID NO: 374104 - DNA, 25 bp, Homo sapien
cggtcacagacacacgcagattggt

SEQ ID NO: 374105 - DNA, 25 bp, Homo sapien
tcaggccctctttgccacaagggac

SEQ ID NO: 374106 - DNA, 25 bp, Homo sapien
ctctttgccacaagggacttcagca

SEQ ID NO: 374107 - DNA, 25 bp, Homo sapien
gccacaagggacttcagcaagtgtt

SEQ ID NO: 374108 - DNA, 25 bp, Homo sapien
agggacttcagcaagtgttagggac

SEQ ID NO: 374109 - DNA, 25 bp, Homo sapien
gttagggacggggttctgcacattc

SEQ ID NO: 374110 - DNA, 25 bp, Homo sapien
ttctgcacattcagccagatgcggt

SEQ ID NO: 374111 - DNA, 25 bp, Homo sapien
attcagccagatgcggtgccttcct

SEQ ID NO: 374112 - DNA, 25 bp, Homo sapien
accagaaggcccgaagcatccagaa

SEQ ID NO: 374113 - DNA, 25 bp, Homo sapien
ctcctgacctggctgacagaatcaa

SEQ ID NO: 374114 - DNA, 25 bp, Homo sapien
gctgacagaatcaatggcccacaac

SEQ ID NO: 374115 - DNA, 25 bp, Homo sapien
gacagaatcaatggcccacaacatc

SEQ ID NO: 374116 - DNA, 25 bp, Homo sapien
accgtctgcacttggcatctgaagt

SEQ ID NO: 374117 - DNA, 25 bp, Homo sapien
tctgcacttggcatctgaagtcggg

SEQ ID NO: 374118 - DNA, 25 bp, Homo sapien
gtggtcttgtgggactgacccctta

SEQ ID NO: 374119 - DNA, 25 bp, Homo sapien
ttaccctgtgggttctgcactagct

SEQ ID NO: 374120 - DNA, 25 bp, Homo sapien
ttctgcactagctccgggcaattgg

SEQ ID NO: 374121 - DNA, 25 bp, Homo sapien
gctccgggcaattggtgacagaatc

SEQ ID NO: 374122 - DNA, 25 bp, Homo sapien
gagttaaattgtaggacatcgcgtt

SEQ ID NO: 374123 - DNA, 25 bp, Homo sapien
taggacatcgcgttggtgtctgaga

SEQ ID NO: 374124 - DNA, 25 bp, Homo sapien
agggaaaggcttacacacatgtgat

SEQ ID NO: 374125 - DNA, 25 bp, Homo sapien
acacatgtgatttcagaagcgttct

SEQ ID NO: 374126 - DNA, 25 bp, Homo sapien
gtgggtagaggaatcgttttctctt

SEQ ID NO: 374127 - DNA, 25 bp, Homo sapien
ccatgctgtcaaacgcaggttgctg

SEQ ID NO: 374128 - DNA, 25 bp, Homo sapien
tcaaacgcaggttgctgtgccagac

SEQ ID NO: 374129 - DNA, 25 bp, Homo sapien
tgtgccagaccccaaaaggacccgg

SEQ ID NO: 374130 - DNA, 25 bp, Homo sapien
aggtgcatcaaggtggagatcagaa

SEQ ID NO: 374131 - DNA, 25 bp, Homo sapien
cacgccctcgaaacggcagagcagg

SEQ ID NO: 374132 - DNA, 25 bp, Homo sapien
agctgcttcctgcttaagcactacg

SEQ ID NO: 374133 - DNA, 25 bp, Homo sapien
taagcactacgactcgcacccagag

SEQ ID NO: 374134 - DNA, 25 bp, Homo sapien
aaatacgattcctgcttggttccca

SEQ ID NO: 374135 - DNA, 25 bp, Homo sapien
tgcttggttcccagttggccctgga

SEQ ID NO: 374136 - DNA, 25 bp, Homo sapien
cagttggccctggacgctgccaagg

SEQ ID NO: 374137 - DNA, 25 bp, Homo sapien
tagaacaaaagcctatcctgccggc

SEQ ID NO: 374138 - DNA, 25 bp, Homo sapien
tttcttcctaactgtgatccagatg

SEQ ID NO: 374139 - DNA, 25 bp, Homo sapien
gatgatcctcacaggtacacactgg

SEQ ID NO: 374140 - DNA, 25 bp, Homo sapien
tacacactggcagctcaggacctgg

SEQ ID NO: 374141 - DNA, 25 bp, Homo sapien
gatatctaatgaccgactgggctca

SEQ ID NO: 374142 - DNA, 25 bp, Homo sapien
actgggctcaggagacgacatttct

SEQ ID NO: 374143 - DNA, 25 bp, Homo sapien
acaagctgtcatgaaaatggcccag

SEQ ID NO: 374144 - DNA, 25 bp, Homo sapien
tgggatgcctcttggacacagaact

SEQ ID NO: 374145 - DNA, 25 bp, Homo sapien
ggacacagaacttccttagcagggt

SEQ ID NO: 374146 - DNA, 25 bp, Homo sapien
gaacttccttagcagggtgttggaa

SEQ ID NO: 374147 - DNA, 25 bp, Homo sapien
gtgttggaaagtcccaggcctgttc

SEQ ID NO: 374148 - DNA, 25 bp, Homo sapien
tggaaagtcccaggcctgttctgtg

SEQ ID NO: 374149 - DNA, 25 bp, Homo sapien
tttcacagtgtgcttcatgcagaaa

SEQ ID NO: 374150 - DNA, 25 bp, Homo sapien
gaaaccaggacaggaataatgcatt

SEQ ID NO: 374151 - DNA, 25 bp, Homo sapien
gaataatgcattgccttccaacaat

SEQ ID NO: 374152 - DNA, 25 bp, Homo sapien
tgccttccaacaatgccagatactg

SEQ ID NO: 374153 - DNA, 25 bp, Homo sapien
tactggaattcctacacagagtttc

SEQ ID NO: 374154 - DNA, 25 bp, Homo sapien
aatgagagctcctatcacagaaggg

SEQ ID NO: 374155 - DNA, 25 bp, Homo sapien
ggcggttgtcaccatggatattaga

SEQ ID NO: 374156 - DNA, 25 bp, Homo sapien
gatattagaggcctatcttacagcc

SEQ ID NO: 374157 - DNA, 25 bp, Homo sapien
gaggcctatcttacagccaggcaga

SEQ ID NO: 374158 - DNA, 25 bp, Homo sapien
tgagatcatgatagacaagaccaca

SEQ ID NO: 374159 - DNA, 25 bp, Homo sapien
agacaagaccacagaggacgtatgc

SEQ ID NO: 374160 - DNA, 25 bp, Homo sapien
gagaacatgatcgtgtatgtggaaa

SEQ ID NO: 374161 - DNA, 25 bp, Homo sapien
gaaagtgctagaagaccctgccatc

SEQ ID NO: 374162 - DNA, 25 bp, Homo sapien
aagtgctagaagaccctgccatcgc

SEQ ID NO: 374163 - DNA, 25 bp, Homo sapien
agaagaccctgccatcgccagcgat

SEQ ID NO: 374164 - DNA, 25 bp, Homo sapien
catcgccagcgatgaaagctttggg

SEQ ID NO: 374165 - DNA, 25 bp, Homo sapien
gaagaaattctgtacctttcgagaa

SEQ ID NO: 374166 - DNA, 25 bp, Homo sapien
gtacctttcgagaagattatgatga

SEQ ID NO: 374167 - DNA, 25 bp, Homo sapien
gatgacatttccaatcagatagact

SEQ ID NO: 374168 - DNA, 25 bp, Homo sapien
ttccaatcagatagacttcatcatc

SEQ ID NO: 374169 - DNA, 25 bp, Homo sapien
gacgggacgctgctgtacgcttcct

SEQ ID NO: 374170 - DNA, 25 bp, Homo sapien
tgtacgcttcctcgcttttccaggg

SEQ ID NO: 374171 - DNA, 25 bp, Homo sapien
aatgtgtggtgagaataaaagcaac

SEQ ID NO: 374172 - DNA, 25 bp, Homo sapien
atgtgtggtgagaataaaagcaaca

SEQ ID NO: 374173 - DNA, 25 bp, Homo sapien
tgtgtggtgagaataaaagcaacaa

SEQ ID NO: 374174 - DNA, 25 bp, Homo sapien
gtgtggtgagaataaaagcaacaaa

SEQ ID NO: 374175 - DNA, 25 bp, Homo sapien
gtggtgagaataaaagcaacaaaga

SEQ ID NO: 374176 - DNA, 25 bp, Homo sapien
aggaggatcctttgtgctcaagagt

SEQ ID NO: 374177 - DNA, 25 bp, Homo sapien
ggaggatcctttgtgctcaagagtt

SEQ ID NO: 374178 - DNA, 25 bp, Homo sapien
gaggatcctttgtgctcaagagttt

SEQ ID NO: 374179 - DNA, 25 bp, Homo sapien
aggatcctttgtgctcaagagtttg

SEQ ID NO: 374180 - DNA, 25 bp, Homo sapien
ggatcctttgtgctcaagagtttga

SEQ ID NO: 374181 - DNA, 25 bp, Homo sapien
gatcctttgtgctcaagagtttgag

SEQ ID NO: 374182 - DNA, 25 bp, Homo sapien
ctggtttccagccaagttcgtggaa

SEQ ID NO: 374183 - DNA, 25 bp, Homo sapien
cagccaagttcgtggaagtcctgga

SEQ ID NO: 374184 - DNA, 25 bp, Homo sapien
aagttcgtggaagtcctggatgagc

SEQ ID NO: 374185 - DNA, 25 bp, Homo sapien
tggaagtcctggatgagcgcagcaa

SEQ ID NO: 374186 - DNA, 25 bp, Homo sapien
gggatatcaatatcaggctgcccca

SEQ ID NO: 374187 - DNA, 25 bp, Homo sapien
gatatcaatatcaggctgccccact

SEQ ID NO: 374188 - DNA, 25 bp, Homo sapien
tgccccaccagggtccttagggatg

SEQ ID NO: 374189 - DNA, 25 bp, Homo sapien
cagtttgtaccaaaaaccttgtgag

SEQ ID NO: 374190 - DNA, 25 bp, Homo sapien
gtaccaaaaaccttgtgaggaggtg

SEQ ID NO: 374191 - DNA, 25 bp, Homo sapien
ggagccatgtctgtgctcaggaaga

SEQ ID NO: 374192 - DNA, 25 bp, Homo sapien
tggctagtaggctcctggcctcttt

SEQ ID NO: 374193 - DNA, 25 bp, Homo sapien
catataatctttggatggatgggct

SEQ ID NO: 374194 - DNA, 25 bp, Homo sapien
gatggatgggctgttaatttgtaaa

SEQ ID NO: 374195 - DNA, 25 bp, Homo sapien
actatttggagggtcattttgatgc

SEQ ID NO: 374196 - DNA, 25 bp, Homo sapien
tatttggagggtcattttgatgctt

SEQ ID NO: 374197 - DNA, 25 bp, Homo sapien
caatgggttagaataatagatcttc

SEQ ID NO: 374198 - DNA, 25 bp, Homo sapien
atagatcttcaagtcttttcttaaa

SEQ ID NO: 374199 - DNA, 25 bp, Homo sapien
atcttcaagtcttttcttaaatggg

SEQ ID NO: 374200 - DNA, 25 bp, Homo sapien
gggtatgtagttccagcttttcagt

SEQ ID NO: 374201 - DNA, 25 bp, Homo sapien
gttccagcttttcagtgagaaattt

SEQ ID NO: 374202 - DNA, 25 bp, Homo sapien
gtgagaaatttccaaaccgtgctta

SEQ ID NO: 374203 - DNA, 25 bp, Homo sapien
gaaatttccaaaccgtgcttattag

SEQ ID NO: 374204 - DNA, 25 bp, Homo sapien
gatgatcctcacaggtacacactgg

SEQ ID NO: 374205 - DNA, 25 bp, Homo sapien
gatcctcacaggtacacactggcag

SEQ ID NO: 374206 - DNA, 25 bp, Homo sapien
acaggtacacactggcagctcagga

SEQ ID NO: 374207 - DNA, 25 bp, Homo sapien
gatggcggatatctaatgaccgact

SEQ ID NO: 374208 - DNA, 25 bp, Homo sapien
gatatctaatgaccgactgggctca

SEQ ID NO: 374209 - DNA, 25 bp, Homo sapien
atctaatgaccgactgggctcagga

SEQ ID NO: 374210 - DNA, 25 bp, Homo sapien
taatgaccgactgggctcaggagac

SEQ ID NO: 374211 - DNA, 25 bp, Homo sapien
gaccgactgggctcaggagacgaca

SEQ ID NO: 374212 - DNA, 25 bp, Homo sapien
tgggctcaggagacgacatttctgt

SEQ ID NO: 374213 - DNA, 25 bp, Homo sapien
tcaggagacgacatttctgtatatg

SEQ ID NO: 374214 - DNA, 25 bp, Homo sapien
atacatggaaacaagctgtcatgaa

SEQ ID NO: 374215 - DNA, 25 bp, Homo sapien
atatgttggtcatatgagtttttaa

SEQ ID NO: 374216 - DNA, 25 bp, Homo sapien
aactgaattgtttgttatagaagta

SEQ ID NO: 374217 - DNA, 25 bp, Homo sapien
gagactgtgctttatatgcacctac

SEQ ID NO: 374218 - DNA, 25 bp, Homo sapien
tgtgctttatatgcacctacggctc

SEQ ID NO: 374219 - DNA, 25 bp, Homo sapien
ttcaccaatattgatgactaattat

SEQ ID NO: 374220 - DNA, 25 bp, Homo sapien
taaaaaacatcagccacagcttcaa

SEQ ID NO: 374221 - DNA, 25 bp, Homo sapien
attgatgactaattatttggccaaa

SEQ ID NO: 374222 - DNA, 25 bp, Homo sapien
attgacagtgattgttgcaattata

SEQ ID NO: 374223 - DNA, 25 bp, Homo sapien
tgattgttgcaattatatttctaaa

SEQ ID NO: 374224 - DNA, 25 bp, Homo sapien
ttctaaagacccatgcaatacaatg

SEQ ID NO: 374225 - DNA, 25 bp, Homo sapien
taaagacccatgcaatacaatggtg

SEQ ID NO: 374226 - DNA, 25 bp, Homo sapien
atgtgccagacacggctctaagccc

SEQ ID NO: 374227 - DNA, 25 bp, Homo sapien
tcagagcctaaattcaatgattcag

SEQ ID NO: 374228 - DNA, 25 bp, Homo sapien
gacgttctcattattgccagttggc

SEQ ID NO: 374229 - DNA, 25 bp, Homo sapien
ttgccagttggctgacgaagagact

SEQ ID NO: 374230 - DNA, 25 bp, Homo sapien
ttggctgacgaagagactgagaccc

SEQ ID NO: 374231 - DNA, 25 bp, Homo sapien
gactgagacccaaaggccttaggga

SEQ ID NO: 374232 - DNA, 25 bp, Homo sapien
gggaaattgtctaaattcacaccac

SEQ ID NO: 374233 - DNA, 25 bp, Homo sapien
aaattcacaccactgatgcgtggca

SEQ ID NO: 374234 - DNA, 25 bp, Homo sapien
aatgattcagtgattgccccctata

SEQ ID NO: 374235 - DNA, 25 bp, Homo sapien
tatcatactcccctggatgggccac

SEQ ID NO: 374236 - DNA, 25 bp, Homo sapien
ggatgggccactcatatttatcagg

SEQ ID NO: 374237 - DNA, 25 bp, Homo sapien
aatcccattcctgagatttcgcgca

SEQ ID NO: 374238 - DNA, 25 bp, Homo sapien
gagatttcgcgcacggaagtcttcg

SEQ ID NO: 374239 - DNA, 25 bp, Homo sapien
ggaagtcttcgtgtttgcggccgac

SEQ ID NO: 374240 - DNA, 25 bp, Homo sapien
tgtttgcggccgaccatggcgtcgc

SEQ ID NO: 374241 - DNA, 25 bp, Homo sapien
ggcacagggcgtatccgctttccca

SEQ ID NO: 374242 - DNA, 25 bp, Homo sapien
gggcgcgccaactgcaactgacgaa

SEQ ID NO: 374243 - DNA, 25 bp, Homo sapien
caccttcagtgaccggccagatggt

SEQ ID NO: 374244 - DNA, 25 bp, Homo sapien
agatggtcgccaacttcgccgccgg

SEQ ID NO: 374245 - DNA, 25 bp, Homo sapien
tgccccatgcaggtggtcgatgtcg

SEQ ID NO: 374246 - DNA, 25 bp, Homo sapien
aactgacgaagccacccgggtcgct

SEQ ID NO: 374247 - DNA, 25 bp, Homo sapien
cctcgaagagctggcgtgttggttc

SEQ ID NO: 374248 - DNA, 25 bp, Homo sapien
ggagctcaggcaaaagaggtttcca

SEQ ID NO: 374249 - DNA, 25 bp, Homo sapien
ggtttccaggatgcagattaggtca

SEQ ID NO: 374250 - DNA, 25 bp, Homo sapien
gcagattaggtcatgcaggccttta

SEQ ID NO: 374251 - DNA, 25 bp, Homo sapien
atgcaggcctttaccggcattgatg

SEQ ID NO: 374252 - DNA, 25 bp, Homo sapien
ttaccggcattgatgtggctcatgt

SEQ ID NO: 374253 - DNA, 25 bp, Homo sapien
atgtggctcatgtttcaggcagact

SEQ ID NO: 374254 - DNA, 25 bp, Homo sapien
acttgacattcagatgattgttttt

SEQ ID NO: 374255 - DNA, 25 bp, Homo sapien
cttttggtacagttgatagacatca

SEQ ID NO: 374256 - DNA, 25 bp, Homo sapien
gacatcataaacgatatcaagctta

SEQ ID NO: 374257 - DNA, 25 bp, Homo sapien
tcaagcttacacttcatatggagtt

SEQ ID NO: 374258 - DNA, 25 bp, Homo sapien
atggagttaaacttggtcagtgtta

SEQ ID NO: 374259 - DNA, 25 bp, Homo sapien
gggctgggacaggaaccgccggagg

SEQ ID NO: 374260 - DNA, 25 bp, Homo sapien
ggctgggacaggaaccgccggaggg

SEQ ID NO: 374261 - DNA, 25 bp, Homo sapien
gggactggccagctcaaccgcttcg

SEQ ID NO: 374262 - DNA, 25 bp, Homo sapien
ggactggccagctcaaccgcttcgt

SEQ ID NO: 374263 - DNA, 25 bp, Homo sapien
gactggccagctcaaccgcttcgtg

SEQ ID NO: 374264 - DNA, 25 bp, Homo sapien
tggccagctcaaccgcttcgtgcaa

SEQ ID NO: 374265 - DNA, 25 bp, Homo sapien
cagctcaaccgcttcgtgcaactct

SEQ ID NO: 374266 - DNA, 25 bp, Homo sapien
agctcaaccgcttcgtgcaactctc

SEQ ID NO: 374267 - DNA, 25 bp, Homo sapien
tcaaccgcttcgtgcaactctccgg

SEQ ID NO: 374268 - DNA, 25 bp, Homo sapien
aaccgcttcgtgcaactctccgggg

SEQ ID NO: 374269 - DNA, 25 bp, Homo sapien
ttcgtgcaactctccggggcggccg

SEQ ID NO: 374270 - DNA, 25 bp, Homo sapien
tgtgacctaagaaaagacccactag

SEQ ID NO: 374271 - DNA, 25 bp, Homo sapien
gaaaagacccactagaaagtaattg

SEQ ID NO: 374272 - DNA, 25 bp, Homo sapien
gacccactagaaagtaattgtacta

SEQ ID NO: 374273 - DNA, 25 bp, Homo sapien
tcataaaactggatttgatttcttt

SEQ ID NO: 374274 - DNA, 25 bp, Homo sapien
gtttcatatgaatgtaacttgattt

SEQ ID NO: 374275 - DNA, 25 bp, Homo sapien
tgatataatttgatccttcttgtat

SEQ ID NO: 374276 - DNA, 25 bp, Homo sapien
aatttgatccttcttgtatcttgaa

SEQ ID NO: 374277 - DNA, 25 bp, Homo sapien
tttgatccttcttgtatcttgaagt

SEQ ID NO: 374278 - DNA, 25 bp, Homo sapien
atcttgaagttttgtacttgggatt

SEQ ID NO: 374279 - DNA, 25 bp, Homo sapien
acttgggatttctggactgataaat

SEQ ID NO: 374280 - DNA, 25 bp, Homo sapien
tgggatttctggactgataaatgaa

SEQ ID NO: 374281 - DNA, 25 bp, Homo sapien
cttttccctatctgcctaacagtgc

SEQ ID NO: 374282 - DNA, 25 bp, Homo sapien
ctatctgcctaacagtgcctcacaa

SEQ ID NO: 374283 - DNA, 25 bp, Homo sapien
gtcaaggcagcaggactgatcaagt

SEQ ID NO: 374284 - DNA, 25 bp, Homo sapien
gatcaagtgactactggttagccag

SEQ ID NO: 374285 - DNA, 25 bp, Homo sapien
accctcaggtctgagataggagttc

SEQ ID NO: 374286 - DNA, 25 bp, Homo sapien
ataggagttctctaggaacctggaa

SEQ ID NO: 374287 - DNA, 25 bp, Homo sapien
aacctggaatgagttcctgtctcct

SEQ ID NO: 374288 - DNA, 25 bp, Homo sapien
ttcctgtctcctgaatgatggtctg

SEQ ID NO: 374289 - DNA, 25 bp, Homo sapien
tgaatgatggtctgggtgccacctg

SEQ ID NO: 374290 - DNA, 25 bp, Homo sapien
tgggtgccacctgtttttaaactct

SEQ ID NO: 374291 - DNA, 25 bp, Homo sapien
tcttaaacctggaactccttaaatg

SEQ ID NO: 374292 - DNA, 25 bp, Homo sapien
ttctgagataatttgcccagccctt

SEQ ID NO: 374293 - DNA, 25 bp, Homo sapien
tctaatccccaaaactgtttttgtg

SEQ ID NO: 374294 - DNA, 25 bp, Homo sapien
ttttgtggtctttgtagcctatagt

SEQ ID NO: 374295 - DNA, 25 bp, Homo sapien
ggtctttgtagcctatagtagtttt

SEQ ID NO: 374296 - DNA, 25 bp, Homo sapien
atagtagttttctcacatctttccc

SEQ ID NO: 374297 - DNA, 25 bp, Homo sapien
ttcagctttttccagtgtgtctcct

SEQ ID NO: 374298 - DNA, 25 bp, Homo sapien
tttccagtgtgtctccttaacagta

SEQ ID NO: 374299 - DNA, 25 bp, Homo sapien
gtgtgtctccttaacagtaacttta

SEQ ID NO: 374300 - DNA, 25 bp, Homo sapien
tccttaacagtaactttaccacttg

SEQ ID NO: 374301 - DNA, 25 bp, Homo sapien
aactaaattggtgtggaaaggctgc

SEQ ID NO: 374302 - DNA, 25 bp, Homo sapien
gaaaggctgcacacaataaagttat

SEQ ID NO: 374303 - DNA, 25 bp, Homo sapien
gagctggaaggtgtttaatgaacgc

SEQ ID NO: 374304 - DNA, 25 bp, Homo sapien
gaaggtgtttaatgaacgctgccga

SEQ ID NO: 374305 - DNA, 25 bp, Homo sapien
ggtgtttaatgaacgctgccgaatt

SEQ ID NO: 374306 - DNA, 25 bp, Homo sapien
gtttaatgaacgctgccgaattcac

SEQ ID NO: 374307 - DNA, 25 bp, Homo sapien
ttaatgaacgctgccgaattcactt

SEQ ID NO: 374308 - DNA, 25 bp, Homo sapien
atgaacgctgccgaattcacttcaa

SEQ ID NO: 374309 - DNA, 25 bp, Homo sapien
tgaacgctgccgaattcacttcaag

SEQ ID NO: 374310 - DNA, 25 bp, Homo sapien
gaacgctgccgaattcacttcaagc

SEQ ID NO: 374311 - DNA, 25 bp, Homo sapien
acgctgccgaattcacttcaagcct

SEQ ID NO: 374312 - DNA, 25 bp, Homo sapien
tgccgaattcacttcaagcctccaa

SEQ ID NO: 374313 - DNA, 25 bp, Homo sapien
gccgaattcacttcaagcctccaaa

SEQ ID NO: 374314 - DNA, 25 bp, Homo sapien
atcatggtctgggtttccaaaacta

SEQ ID NO: 374315 - DNA, 25 bp, Homo sapien
tcatggtctgggtttccaaaactac

SEQ ID NO: 374316 - DNA, 25 bp, Homo sapien
tttccaaaactaccctagtacagtg

SEQ ID NO: 374317 - DNA, 25 bp, Homo sapien
aaaactaccctagtacagtgaatga

SEQ ID NO: 374318 - DNA, 25 bp, Homo sapien
ttgtttcagaaccatgtacctttat

SEQ ID NO: 374319 - DNA, 25 bp, Homo sapien
gtttcagaaccatgtacctttatgc

SEQ ID NO: 374320 - DNA, 25 bp, Homo sapien
tttcagaaccatgtacctttatgct

SEQ ID NO: 374321 - DNA, 25 bp, Homo sapien
tgctttgtgattgtgaaacattgac

SEQ ID NO: 374322 - DNA, 25 bp, Homo sapien
tgtgattgtgaaacattgacttttt

SEQ ID NO: 374323 - DNA, 25 bp, Homo sapien
ttgtgtgttttgaaacttaggtgca

SEQ ID NO: 374324 - DNA, 25 bp, Homo sapien
tgtgttttgaaacttaggtgcaatg

SEQ ID NO: 374325 - DNA, 25 bp, Homo sapien
ggctcacatcttagtaaatcacctg

SEQ ID NO: 374326 - DNA, 25 bp, Homo sapien
cacatcttagtaaatcacctgtaaa

SEQ ID NO: 374327 - DNA, 25 bp, Homo sapien
agtaaatcacctgtaaataaagctt

SEQ ID NO: 374328 - DNA, 25 bp, Homo sapien
aataaagcttgcaagggcagtgact

SEQ ID NO: 374329 - DNA, 25 bp, Homo sapien
gagtcgttcttccaaaaagggccat

SEQ ID NO: 374330 - DNA, 25 bp, Homo sapien
cgttcttccaaaaagggccatctgt

SEQ ID NO: 374331 - DNA, 25 bp, Homo sapien
ccatctgtgaccctgagagataaac

SEQ ID NO: 374332 - DNA, 25 bp, Homo sapien
gataaacctggcagaccagggctca

SEQ ID NO: 374333 - DNA, 25 bp, Homo sapien
gcagaccagggctcacatcttagta

SEQ ID NO: 374334 - DNA, 25 bp, Homo sapien
gaccagggctcacatcttagtaaat

SEQ ID NO: 374335 - DNA, 25 bp, Homo sapien
ccagggctcacatcttagtaaatca

SEQ ID NO: 374336 - DNA, 25 bp, Homo sapien
gaggcttattcacattagttaaaac

SEQ ID NO: 374337 - DNA, 25 bp, Homo sapien
atttcatgcttgcttcggctgctaa

SEQ ID NO: 374338 - DNA, 25 bp, Homo sapien
tgcttgcttcggctgctaaactgaa

SEQ ID NO: 374339 - DNA, 25 bp, Homo sapien
gtgtggatgctttctataatgctat

SEQ ID NO: 374340 - DNA, 25 bp, Homo sapien
aatgctattggtctaagtgtgatta

SEQ ID NO: 374341 - DNA, 25 bp, Homo sapien
ggtgtataagcctctaattattaca

SEQ ID NO: 374342 - DNA, 25 bp, Homo sapien
ttattacataactggcacgtctgac

SEQ ID NO: 374343 - DNA, 25 bp, Homo sapien
ggcacgtctgacttttgctatcatt

SEQ ID NO: 374344 - DNA, 25 bp, Homo sapien
gacttttgctatcatttgaggattc

SEQ ID NO: 374345 - DNA, 25 bp, Homo sapien
gaggattctactgtatataagtttc

SEQ ID NO: 374346 - DNA, 25 bp, Homo sapien
tataagtttcatctaacattggcat

SEQ ID NO: 374347 - DNA, 25 bp, Homo sapien
ggcgccgaacggtgctcagcaacca

SEQ ID NO: 374348 - DNA, 25 bp, Homo sapien
gtgctcagcaaccacccggacaggg

SEQ ID NO: 374349 - DNA, 25 bp, Homo sapien
gacagggccaggccgttttctcccg

SEQ ID NO: 374350 - DNA, 25 bp, Homo sapien
gttttctcccgctcaggcattagtc

SEQ ID NO: 374351 - DNA, 25 bp, Homo sapien
tcccgctcaggcattagtcgttggc

SEQ ID NO: 374352 - DNA, 25 bp, Homo sapien
cgctcaggcattagtcgttggctgt

SEQ ID NO: 374353 - DNA, 25 bp, Homo sapien
ctcaggcattagtcgttggctgtgg

SEQ ID NO: 374354 - DNA, 25 bp, Homo sapien
gcattagtcgttggctgtgggccgc

SEQ ID NO: 374355 - DNA, 25 bp, Homo sapien
gaagttgaggcctaccacggaggag

SEQ ID NO: 374356 - DNA, 25 bp, Homo sapien
atctcaggggatccgcaagggctcc

SEQ ID NO: 374357 - DNA, 25 bp, Homo sapien
tcttcagagaagaactcggccgaat

SEQ ID NO: 374358 - DNA, 25 bp, Homo sapien
gggagtaggtgctaacctggataac

SEQ ID NO: 374359 - DNA, 25 bp, Homo sapien
ggagtaggtgctaacctggataact

SEQ ID NO: 374360 - DNA, 25 bp, Homo sapien
gagtaggtgctaacctggataactg

SEQ ID NO: 374361 - DNA, 25 bp, Homo sapien
agtaggtgctaacctggataactgt

SEQ ID NO: 374362 - DNA, 25 bp, Homo sapien
gtaggtgctaacctggataactgta

SEQ ID NO: 374363 - DNA, 25 bp, Homo sapien
taggtgctaacctggataactgtaa

SEQ ID NO: 374364 - DNA, 25 bp, Homo sapien
aggtgctaacctggataactgtaaa

SEQ ID NO: 374365 - DNA, 25 bp, Homo sapien
ggtgctaacctggataactgtaaaa

SEQ ID NO: 374366 - DNA, 25 bp, Homo sapien
gtgctaacctggataactgtaaaag

SEQ ID NO: 374367 - DNA, 25 bp, Homo sapien
cctggataactgtaaaagggctctc

SEQ ID NO: 374368 - DNA, 25 bp, Homo sapien
ttctttctgtcaggggctcccacag

SEQ ID NO: 374369 - DNA, 25 bp, Homo sapien
ttttcctatgtgaattgtccctctt

SEQ ID NO: 374370 - DNA, 25 bp, Homo sapien
tcctatgtgaattgtccctcttttt

SEQ ID NO: 374371 - DNA, 25 bp, Homo sapien
caaaccaatgtgttgtagacctata

SEQ ID NO: 374372 - DNA, 25 bp, Homo sapien
gacctatatgtaacctattccttag

SEQ ID NO: 374373 - DNA, 25 bp, Homo sapien
gtaacctattccttagtctcatatt

SEQ ID NO: 374374 - DNA, 25 bp, Homo sapien
ttaactgatcaagtccttgctacta

SEQ ID NO: 374375 - DNA, 25 bp, Homo sapien
gatcaagtccttgctactaaaatgc

SEQ ID NO: 374376 - DNA, 25 bp, Homo sapien
ttgtgtttttcatcatgacgtcgtg

SEQ ID NO: 374377 - DNA, 25 bp, Homo sapien
tcatgacgtcgtgtgcttctaaatt

SEQ ID NO: 374378 - DNA, 25 bp, Homo sapien
gtcgtgtgcttctaaattaatcatt

SEQ ID NO: 374379 - DNA, 25 bp, Homo sapien
gagtgaatttatattagtcttggaa

SEQ ID NO: 374380 - DNA, 25 bp, Homo sapien
ggaattgtaccctgcaagcctgtgg

SEQ ID NO: 374381 - DNA, 25 bp, Homo sapien
ttttttacaaatgtgcttggcagtt

SEQ ID NO: 374382 - DNA, 25 bp, Homo sapien
ggcagttttattcacagtacccgat

SEQ ID NO: 374383 - DNA, 25 bp, Homo sapien
gtacccgatacttagaaacaactca

SEQ ID NO: 374384 - DNA, 25 bp, Homo sapien
acaactcagatatccatcattagct

SEQ ID NO: 374385 - DNA, 25 bp, Homo sapien
tatactggatggagcattacccacc

SEQ ID NO: 374386 - DNA, 25 bp, Homo sapien
ggagcattacccaccaataaaaagg

SEQ ID NO: 374387 - DNA, 25 bp, Homo sapien
gtgaaacaaccctgccacttagcag

SEQ ID NO: 374388 - DNA, 25 bp, Homo sapien
caaccctgccacttagcagtttatt

SEQ ID NO: 374389 - DNA, 25 bp, Homo sapien
gcagtttattagttggctccaagtt

SEQ ID NO: 374390 - DNA, 25 bp, Homo sapien
attagttggctccaagttcaccctc

SEQ ID NO: 374391 - DNA, 25 bp, Homo sapien
atagcaagcggagaaagaagggatc

SEQ ID NO: 374392 - DNA, 25 bp, Homo sapien
gaagattctagatccttcttttgac

SEQ ID NO: 374393 - DNA, 25 bp, Homo sapien
attctagatccttcttttgactgcc

SEQ ID NO: 374394 - DNA, 25 bp, Homo sapien
tagatccttcttttgactgccagct

SEQ ID NO: 374395 - DNA, 25 bp, Homo sapien
atccttcttttgactgccagctgat

SEQ ID NO: 374396 - DNA, 25 bp, Homo sapien
cttttgactgccagctgattttgat

SEQ ID NO: 374397 - DNA, 25 bp, Homo sapien
gattttgattgccagctttacctgc

SEQ ID NO: 374398 - DNA, 25 bp, Homo sapien
agctttacctgcttcatgagctcag

SEQ ID NO: 374399 - DNA, 25 bp, Homo sapien
ctgcttcatgagctcagccaagtca

SEQ ID NO: 374400 - DNA, 25 bp, Homo sapien
taacctctcagagcttcactgttct

SEQ ID NO: 374401 - DNA, 25 bp, Homo sapien
aatggtatctcattacagagtagaa

SEQ ID NO: 374402 - DNA, 25 bp, Homo sapien
gggagacccctaatgaggaagttga

SEQ ID NO: 374403 - DNA, 25 bp, Homo sapien
gaggtaatgcttaacattgttgctg

SEQ ID NO: 374404 - DNA, 25 bp, Homo sapien
tttcccagagccattttggctcaat

SEQ ID NO: 374405 - DNA, 25 bp, Homo sapien
gtctattcaattcaagttaactcta

SEQ ID NO: 374406 - DNA, 25 bp, Homo sapien
attcaagttaactctagcccagccc

SEQ ID NO: 374407 - DNA, 25 bp, Homo sapien
cagatcaactcctcctacaaatatt

SEQ ID NO: 374408 - DNA, 25 bp, Homo sapien
gatcaactcctcctacaaatattat

SEQ ID NO: 374409 - DNA, 25 bp, Homo sapien
aatattattggatgataggccctag

SEQ ID NO: 374410 - DNA, 25 bp, Homo sapien
ggatgataggccctagaacccaata

SEQ ID NO: 374411 - DNA, 25 bp, Homo sapien
gataggccctagaacccaataaagg

SEQ ID NO: 374412 - DNA, 25 bp, Homo sapien
aaaggagctccaaatgtcgttgggt

SEQ ID NO: 374413 - DNA, 25 bp, Homo sapien
gggccggtggtcctctgtgctgaag

SEQ ID NO: 374414 - DNA, 25 bp, Homo sapien
tctgtgctgaaggccacggcgccag

SEQ ID NO: 374415 - DNA, 25 bp, Homo sapien
tcgcgacacggccagagagccctcg

SEQ ID NO: 374416 - DNA, 25 bp, Homo sapien
ggagtcaccgcagtgcgccaggtac

SEQ ID NO: 374417 - DNA, 25 bp, Homo sapien
accgcagtgcgccaggtacagaaac

SEQ ID NO: 374418 - DNA, 25 bp, Homo sapien
agtgcgccaggtacagaaaccgcgg

SEQ ID NO: 374419 - DNA, 25 bp, Homo sapien
cgcaggcgctcgtcggcgctcaaga

SEQ ID NO: 374420 - DNA, 25 bp, Homo sapien
tcgtcggcgctcaagaaggctcggc

SEQ ID NO: 374421 - DNA, 25 bp, Homo sapien
tcggcgctcaagaaggctcggcgca

SEQ ID NO: 374422 - DNA, 25 bp, Homo sapien
agagagccctcgacgcgtcggcggc

SEQ ID NO: 374423 - DNA, 25 bp, Homo sapien
agcggcgtggatgcgctcgcgttcc

SEQ ID NO: 374424 - DNA, 25 bp, Homo sapien
aaggactgggtcatctcataagagc

SEQ ID NO: 374425 - DNA, 25 bp, Homo sapien
aggactgggtcatctcataagagct

SEQ ID NO: 374426 - DNA, 25 bp, Homo sapien
ggactgggtcatctcataagagcta

SEQ ID NO: 374427 - DNA, 25 bp, Homo sapien
gactgggtcatctcataagagctaa

SEQ ID NO: 374428 - DNA, 25 bp, Homo sapien
tatcaacagggcgggctttctagga

SEQ ID NO: 374429 - DNA, 25 bp, Homo sapien
atcaacagggcgggctttctaggat

SEQ ID NO: 374430 - DNA, 25 bp, Homo sapien
tcaacagggcgggctttctaggatg

SEQ ID NO: 374431 - DNA, 25 bp, Homo sapien
caacagggcgggctttctaggatga

SEQ ID NO: 374432 - DNA, 25 bp, Homo sapien
aacagggcgggctttctaggatgat

SEQ ID NO: 374433 - DNA, 25 bp, Homo sapien
acagggcgggctttctaggatgatt

SEQ ID NO: 374434 - DNA, 25 bp, Homo sapien
gtgtaccaacgtcttatctcagttt

SEQ ID NO: 374435 - DNA, 25 bp, Homo sapien
acgtcttatctcagtttggacatga

SEQ ID NO: 374436 - DNA, 25 bp, Homo sapien
gctttttacatctatatttgacagt

SEQ ID NO: 374437 - DNA, 25 bp, Homo sapien
acatgcattgtgtagattctctatg

SEQ ID NO: 374438 - DNA, 25 bp, Homo sapien
gattctctatgaaaattaagaccct

SEQ ID NO: 374439 - DNA, 25 bp, Homo sapien
aacgaaggctggaaatgggtgtatt

SEQ ID NO: 374440 - DNA, 25 bp, Homo sapien
atccttaagggagttttgctataga

SEQ ID NO: 374441 - DNA, 25 bp, Homo sapien
agttttgctatagaatctcaggata

SEQ ID NO: 374442 - DNA, 25 bp, Homo sapien
ggataaagacagactccgacaatat

SEQ ID NO: 374443 - DNA, 25 bp, Homo sapien
agacagactccgacaatattcatcc

SEQ ID NO: 374444 - DNA, 25 bp, Homo sapien
acatttttattgaagtgtaccaacg

SEQ ID NO: 374445 - DNA, 25 bp, Homo sapien
cagtgcctgcattggaacgtccgga

SEQ ID NO: 374446 - DNA, 25 bp, Homo sapien
gtgcctgcattggaacgtccggaag

SEQ ID NO: 374447 - DNA, 25 bp, Homo sapien
gcctgcattggaacgtccggaagaa

SEQ ID NO: 374448 - DNA, 25 bp, Homo sapien
gcattggaacgtccggaagaagcaa

SEQ ID NO: 374449 - DNA, 25 bp, Homo sapien
gtcaagcccctatccaggcccgaat

SEQ ID NO: 374450 - DNA, 25 bp, Homo sapien
gggacagaccaatctgcgtgtgtct

SEQ ID NO: 374451 - DNA, 25 bp, Homo sapien
agaccaatctgcgtgtgtctgtgac

SEQ ID NO: 374452 - DNA, 25 bp, Homo sapien
accaatctgcgtgtgtctgtgaccg

SEQ ID NO: 374453 - DNA, 25 bp, Homo sapien
aatctgcgtgtgtctgtgaccgcct

SEQ ID NO: 374454 - DNA, 25 bp, Homo sapien
ctgcgtgtgtctgtgaccgcctgtc

SEQ ID NO: 374455 - DNA, 25 bp, Homo sapien
gtggcacggccacttcctttctgta

SEQ ID NO: 374456 - DNA, 25 bp, Homo sapien
aaaccattagtaatacatgctgtaa

SEQ ID NO: 374457 - DNA, 25 bp, Homo sapien
gaacattttgattaatctttcccta

SEQ ID NO: 374458 - DNA, 25 bp, Homo sapien
taatctttccctagaagtgactgaa

SEQ ID NO: 374459 - DNA, 25 bp, Homo sapien
gtgcatatttgagaaagggaacttt

SEQ ID NO: 374460 - DNA, 25 bp, Homo sapien
gagaaactatgcttaagctggtctt

SEQ ID NO: 374461 - DNA, 25 bp, Homo sapien
taagctggtcttttgcattgctaat

SEQ ID NO: 374462 - DNA, 25 bp, Homo sapien
ggtcttttgcattgctaatgtgaca

SEQ ID NO: 374463 - DNA, 25 bp, Homo sapien
taatgtgacatgtacccaacttttc

SEQ ID NO: 374464 - DNA, 25 bp, Homo sapien
gacatgtacccaacttttcattaat

SEQ ID NO: 374465 - DNA, 25 bp, Homo sapien
aatgcaagatgacgcttacgttctg

SEQ ID NO: 374466 - DNA, 25 bp, Homo sapien
gcttacgttctgtaaaccattagta

SEQ ID NO: 374467 - DNA, 25 bp, Homo sapien
gaaaaatcaatcagctggaggaccc

SEQ ID NO: 374468 - DNA, 25 bp, Homo sapien
taatacattttcaataccaccagga

SEQ ID NO: 374469 - DNA, 25 bp, Homo sapien
ctgcaggtctgggttgccagacgtt

SEQ ID NO: 374470 - DNA, 25 bp, Homo sapien
ctgggttgccagacgttttatttct

SEQ ID NO: 374471 - DNA, 25 bp, Homo sapien
agggaatgggactgttgctgatcct

SEQ ID NO: 374472 - DNA, 25 bp, Homo sapien
gggactgttgctgatcctcaaaggc

SEQ ID NO: 374473 - DNA, 25 bp, Homo sapien
ttgctgatcctcaaaggcctctgta

SEQ ID NO: 374474 - DNA, 25 bp, Homo sapien
tcctcaaaggcctctgtaggatgga

SEQ ID NO: 374475 - DNA, 25 bp, Homo sapien
tatcctgccatgtgagctcagggaa

SEQ ID NO: 374476 - DNA, 25 bp, Homo sapien
gtgagctcagggaatgcaaatgcat

SEQ ID NO: 374477 - DNA, 25 bp, Homo sapien
atgcatttaaatatccatctaaagc

SEQ ID NO: 374478 - DNA, 25 bp, Homo sapien
cccttttatagaggagtctcctaga

SEQ ID NO: 374479 - DNA, 25 bp, Homo sapien
tagaggagtctcctagagccaaccg

SEQ ID NO: 374480 - DNA, 25 bp, Homo sapien
aggagtctcctagagccaaccgcag

SEQ ID NO: 374481 - DNA, 25 bp, Homo sapien
ggagccacctggaatgtgccagctg

SEQ ID NO: 374482 - DNA, 25 bp, Homo sapien
gaatgtgccagctgcagtagccgtt

SEQ ID NO: 374483 - DNA, 25 bp, Homo sapien
gtgccagctgcagtagccgttcctt

SEQ ID NO: 374484 - DNA, 25 bp, Homo sapien
attggtcctgcctgttgcgttactt

SEQ ID NO: 374485 - DNA, 25 bp, Homo sapien
tgcctgttgcgttacttctctgtgc

SEQ ID NO: 374486 - DNA, 25 bp, Homo sapien
ctcaagcacagaggcctcgaaaggt

SEQ ID NO: 374487 - DNA, 25 bp, Homo sapien
ggcctcgaaaggttgatcagacatc

SEQ ID NO: 374488 - DNA, 25 bp, Homo sapien
aaaggttgatcagacatcctcagca

SEQ ID NO: 374489 - DNA, 25 bp, Homo sapien
gaacgccaccgcctagtgtgaatgc

SEQ ID NO: 374490 - DNA, 25 bp, Homo sapien
cgccaccgcctagtgtgaatgctag

SEQ ID NO: 374491 - DNA, 25 bp, Homo sapien
gaatgctaggtcagaagctgctttt

SEQ ID NO: 374492 - DNA, 25 bp, Homo sapien
taggtcagaagctgctttttcacac

SEQ ID NO: 374493 - DNA, 25 bp, Homo sapien
tcacactgaaaccatttaagtatgt

SEQ ID NO: 374494 - DNA, 25 bp, Homo sapien
taagttacttatagtccataaaggg

SEQ ID NO: 374495 - DNA, 25 bp, Homo sapien
gtccataaagggactacattatttt

SEQ ID NO: 374496 - DNA, 25 bp, Homo sapien
gggactacattattttgttactctg

SEQ ID NO: 374497 - DNA, 25 bp, Homo sapien
attttgttactctgataatcccata

SEQ ID NO: 374498 - DNA, 25 bp, Homo sapien
gttactctgataatcccataaaaca

SEQ ID NO: 374499 - DNA, 25 bp, Homo sapien
atgtttacagtaaccatgaatggaa

SEQ ID NO: 374500 - DNA, 25 bp, Homo sapien
gaaggtgtttaatgaacgctgccga

SEQ ID NO: 374501 - DNA, 25 bp, Homo sapien
tgaacgctgccgaattcacttcaag

SEQ ID NO: 374502 - DNA, 25 bp, Homo sapien
gccgaattcacttcaagcctccaaa

SEQ ID NO: 374503 - DNA, 25 bp, Homo sapien
aaggactgggtcatctcataagagc

SEQ ID NO: 374504 - DNA, 25 bp, Homo sapien
aggactgggtcatctcataagagct

SEQ ID NO: 374505 - DNA, 25 bp, Homo sapien
gactgggtcatctcataagagctaa

SEQ ID NO: 374506 - DNA, 25 bp, Homo sapien
aacagggcgggctttctaggatgat

SEQ ID NO: 374507 - DNA, 25 bp, Homo sapien
acagggcgggctttctaggatgatt

SEQ ID NO: 374508 - DNA, 25 bp, Homo sapien
tctaggatgatttctgagccaacag

SEQ ID NO: 374509 - DNA, 25 bp, Homo sapien
gagccaacagtccaagaccttttgt

SEQ ID NO: 374510 - DNA, 25 bp, Homo sapien
ttttgttgatttcagccccacttag

SEQ ID NO: 374511 - DNA, 25 bp, Homo sapien
gccaaatgtaacaataaaaccctgt

SEQ ID NO: 374512 - DNA, 25 bp, Homo sapien
taaagcttgcaattttaaaagtagc

SEQ ID NO: 374513 - DNA, 25 bp, Homo sapien
aaagtagctcacatttaatttcttg

SEQ ID NO: 374514 - DNA, 25 bp, Homo sapien
ttcttgtgtgaaatagaacatgctt

SEQ ID NO: 374515 - DNA, 25 bp, Homo sapien
gaacatgctttaaaggaagtatttt

SEQ ID NO: 374516 - DNA, 25 bp, Homo sapien
ttttatgtgaatttgcattccagta

SEQ ID NO: 374517 - DNA, 25 bp, Homo sapien
tgtgaatttgcattccagtataaat

SEQ ID NO: 374518 - DNA, 25 bp, Homo sapien
gaatttgcattccagtataaatagt

SEQ ID NO: 374519 - DNA, 25 bp, Homo sapien
gcattccagtataaatagtattcac

SEQ ID NO: 374520 - DNA, 25 bp, Homo sapien
gtattcacaaaaaagattttcctag

SEQ ID NO: 374521 - DNA, 25 bp, Homo sapien
tcctagattttatctattgaatagg

SEQ ID NO: 374522 - DNA, 25 bp, Homo sapien
agcagacgcatcaggagcaaaccat

SEQ ID NO: 374523 - DNA, 25 bp, Homo sapien
ccagggccactatcttgctagaagc

SEQ ID NO: 374524 - DNA, 25 bp, Homo sapien
ttgctagaagccactgtgtgctttt

SEQ ID NO: 374525 - DNA, 25 bp, Homo sapien
agcacatggtttctcgtttagcagc

SEQ ID NO: 374526 - DNA, 25 bp, Homo sapien
cgtttagcagctctttttatggtaa

SEQ ID NO: 374527 - DNA, 25 bp, Homo sapien
aatggtcaatttatggttcactgcc

SEQ ID NO: 374528 - DNA, 25 bp, Homo sapien
gttcactgccaggatttcggtgtac

SEQ ID NO: 374529 - DNA, 25 bp, Homo sapien
gccaggatttcggtgtactgtcaaa

SEQ ID NO: 374530 - DNA, 25 bp, Homo sapien
gaaggctcgagaacctcttttactg

SEQ ID NO: 374531 - DNA, 25 bp, Homo sapien
ccagtacacgtaaagcttggctaag

SEQ ID NO: 374532 - DNA, 25 bp, Homo sapien
gcttggctaagcagacgcatcagga

SEQ ID NO: 374533 - DNA, 25 bp, Homo sapien
ttgagtctcaaactggaatgccttt

SEQ ID NO: 374534 - DNA, 25 bp, Homo sapien
gacagatgcttctatagaggttctt

SEQ ID NO: 374535 - DNA, 25 bp, Homo sapien
ggttctttgacctaaatagttcagc

SEQ ID NO: 374536 - DNA, 25 bp, Homo sapien
attctggtatctaatcagattccta

SEQ ID NO: 374537 - DNA, 25 bp, Homo sapien
agattcctaatcatagcccgtaaga

SEQ ID NO: 374538 - DNA, 25 bp, Homo sapien
tagcccgtaagaaggaatgttactt

SEQ ID NO: 374539 - DNA, 25 bp, Homo sapien
attggactttgctcatgtgctcgtg

SEQ ID NO: 374540 - DNA, 25 bp, Homo sapien
tcatgtgctcgtgtccgcatttttt

SEQ ID NO: 374541 - DNA, 25 bp, Homo sapien
ggttctcttttattgatgggcatgc

SEQ ID NO: 374542 - DNA, 25 bp, Homo sapien
gcatgcagtgggtgttacttggaaa

SEQ ID NO: 374543 - DNA, 25 bp, Homo sapien
gggtgttacttggaaatggccaatt

SEQ ID NO: 374544 - DNA, 25 bp, Homo sapien
tgaaggttttgtttacacgtgtgaa

SEQ ID NO: 374545 - DNA, 25 bp, Homo sapien
ttacacgtgtgaaacaaacttttgt

SEQ ID NO: 374546 - DNA, 25 bp, Homo sapien
tttgtgtgattgtcattactaattg

SEQ ID NO: 374547 - DNA, 25 bp, Homo sapien
ttactaattgaagggcaaccaggtt

SEQ ID NO: 374548 - DNA, 25 bp, Homo sapien
gcaaccaggttgtaaaattcagcgt

SEQ ID NO: 374549 - DNA, 25 bp, Homo sapien
ttcttaacagtattcatctttagga

SEQ ID NO: 374550 - DNA, 25 bp, Homo sapien
tcatctttaggactgtcgtttgagg

SEQ ID NO: 374551 - DNA, 25 bp, Homo sapien
aggactgtcgtttgaggatagcata

SEQ ID NO: 374552 - DNA, 25 bp, Homo sapien
ctgagaaactctaggtttgctgtga

SEQ ID NO: 374553 - DNA, 25 bp, Homo sapien
gactaatactcgtttcacatatgtg

SEQ ID NO: 374554 - DNA, 25 bp, Homo sapien
cacatatgtgttatttgttgagtgc

SEQ ID NO: 374555 - DNA, 25 bp, Homo sapien
gaacgaagaacacctgagaatactg

SEQ ID NO: 374556 - DNA, 25 bp, Homo sapien
atgtttcctgttgcaaagctaatga

SEQ ID NO: 374557 - DNA, 25 bp, Homo sapien
tgaaagtgcctaaaaacccctgctc

SEQ ID NO: 374558 - DNA, 25 bp, Homo sapien
ctgctcctacgttgttttcccattt

SEQ ID NO: 374559 - DNA, 25 bp, Homo sapien
tttaaagcagactcttcagccaggg

SEQ ID NO: 374560 - DNA, 25 bp, Homo sapien
ttgcaaagctaatgagaccccaccc

SEQ ID NO: 374561 - DNA, 25 bp, Homo sapien
aactccctgagtctaatgtgtgtct

SEQ ID NO: 374562 - DNA, 25 bp, Homo sapien
atgtgtgtctaggactagggcacag

SEQ ID NO: 374563 - DNA, 25 bp, Homo sapien
ccttcttgtctcagagcaggcagga

SEQ ID NO: 374564 - DNA, 25 bp, Homo sapien
aggcaggagctcatctgtcttgttc

SEQ ID NO: 374565 - DNA, 25 bp, Homo sapien
ttctgccttcctaattaccctggaa

SEQ ID NO: 374566 - DNA, 25 bp, Homo sapien
aggcctgtgtctagccccagtggct

SEQ ID NO: 374567 - DNA, 25 bp, Homo sapien
agtggctcactgaactttcagggca

SEQ ID NO: 374568 - DNA, 25 bp, Homo sapien
gggggtcctgcttagaagccagtca

SEQ ID NO: 374569 - DNA, 25 bp, Homo sapien
ctgtgtgtgtggctgagtgtattct

SEQ ID NO: 374570 - DNA, 25 bp, Homo sapien
ctgagtgtattctgcgcgtgtgtgt

SEQ ID NO: 374571 - DNA, 25 bp, Homo sapien
gggagcatggtgtctcccgctccac

SEQ ID NO: 374572 - DNA, 25 bp, Homo sapien
ccttttactttgcattgaacggcct

SEQ ID NO: 374573 - DNA, 25 bp, Homo sapien
tactttgcattgaacggcctgtcca

SEQ ID NO: 374574 - DNA, 25 bp, Homo sapien
attgaacggcctgtccaaagatcct

SEQ ID NO: 374575 - DNA, 25 bp, Homo sapien
tgtccaaagatcctctctctagggc

SEQ ID NO: 374576 - DNA, 25 bp, Homo sapien
aagatcctctctctagggcagcaga

SEQ ID NO: 374577 - DNA, 25 bp, Homo sapien
tgtcccatccctctaggacagggaa

SEQ ID NO: 374578 - DNA, 25 bp, Homo sapien
gtcccatccctctaggacagggaag

SEQ ID NO: 374579 - DNA, 25 bp, Homo sapien
ccatccctctaggacagggaagctg

SEQ ID NO: 374580 - DNA, 25 bp, Homo sapien
ccctctaggacagggaagctggcct

SEQ ID NO: 374581 - DNA, 25 bp, Homo sapien
ctaggacagggaagctggcctggtc

SEQ ID NO: 374582 - DNA, 25 bp, Homo sapien
gattccagcctaaggaaggctggcc

SEQ ID NO: 374583 - DNA, 25 bp, Homo sapien
cctaaggaaggctggccgtggtcca

SEQ ID NO: 374584 - DNA, 25 bp, Homo sapien
aggctggccgtggtccaggagttaa

SEQ ID NO: 374585 - DNA, 25 bp, Homo sapien
ccgtggtccaggagttaagggcttg

SEQ ID NO: 374586 - DNA, 25 bp, Homo sapien
ggtttaagtggccacccatccaggc

SEQ ID NO: 374587 - DNA, 25 bp, Homo sapien
gtttaagtggccacccatccaggcc

SEQ ID NO: 374588 - DNA, 25 bp, Homo sapien
cgggtgagatatgccagccccataa

SEQ ID NO: 374589 - DNA, 25 bp, Homo sapien
atgccagccccataattaggacctg

SEQ ID NO: 374590 - DNA, 25 bp, Homo sapien
aattaggacctgaaaatctctgcca

SEQ ID NO: 374591 - DNA, 25 bp, Homo sapien
aaaatctctgccaggcctgcctttg

SEQ ID NO: 374592 - DNA, 25 bp, Homo sapien
tgcctttgtgacgtggcccagtcta

SEQ ID NO: 374593 - DNA, 25 bp, Homo sapien
aaaaccctggagactctataggtag

SEQ ID NO: 374594 - DNA, 25 bp, Homo sapien
ggcccagtctacctcagctatggaa

SEQ ID NO: 374595 - DNA, 25 bp, Homo sapien
agctatggaacaggccttgactggt

SEQ ID NO: 374596 - DNA, 25 bp, Homo sapien
cttgactggtgaggcccaaagccgg

SEQ ID NO: 374597 - DNA, 25 bp, Homo sapien
tggacaggcgctgaagacttggatt

SEQ ID NO: 374598 - DNA, 25 bp, Homo sapien
gaagacttggattggtttagaccta

SEQ ID NO: 374599 - DNA, 25 bp, Homo sapien
atgagcagttgatgttttatgtggc

SEQ ID NO: 374600 - DNA, 25 bp, Homo sapien
gcagttgatgttttatgtggcatta

SEQ ID NO: 374601 - DNA, 25 bp, Homo sapien
tgtggcattaagacaatcaagtcct

SEQ ID NO: 374602 - DNA, 25 bp, Homo sapien
gacaatcaagtcctcacaactctgg

SEQ ID NO: 374603 - DNA, 25 bp, Homo sapien
tcaagtcctcacaactctggaatgt

SEQ ID NO: 374604 - DNA, 25 bp, Homo sapien
tcctcacaactctggaatgtcttct

SEQ ID NO: 374605 - DNA, 25 bp, Homo sapien
gaatgtcttcttatactgatgctga

SEQ ID NO: 374606 - DNA, 25 bp, Homo sapien
tgtcttcttatactgatgctgaatt

SEQ ID NO: 374607 - DNA, 25 bp, Homo sapien
cagcttctttctaatgttctgtgaa

SEQ ID NO: 374608 - DNA, 25 bp, Homo sapien
gtgtcttatataatggtgcttttat

SEQ ID NO: 374609 - DNA, 25 bp, Homo sapien
ataatggtgcttttatggttattaa

SEQ ID NO: 374610 - DNA, 25 bp, Homo sapien
ctggcacataggcactgaaacactg

SEQ ID NO: 374611 - DNA, 25 bp, Homo sapien
ataggcactgaaacactgcatgtta

SEQ ID NO: 374612 - DNA, 25 bp, Homo sapien
aaacactgcatgttaatccacaccc

SEQ ID NO: 374613 - DNA, 25 bp, Homo sapien
tgagtgtagtcaaagctggtaagtg

SEQ ID NO: 374614 - DNA, 25 bp, Homo sapien
ctggtaagtgacaagggctttcgtg

SEQ ID NO: 374615 - DNA, 25 bp, Homo sapien
ctgacctaatgttgggcatcaggtt

SEQ ID NO: 374616 - DNA, 25 bp, Homo sapien
aatgttgggcatcaggttacccaaa

SEQ ID NO: 374617 - DNA, 25 bp, Homo sapien
atcaggttacccaaagagcttcagg

SEQ ID NO: 374618 - DNA, 25 bp, Homo sapien
gtaactgccaatgagggctttggct

SEQ ID NO: 374619 - DNA, 25 bp, Homo sapien
taaacgtaccgactataaagctctg

SEQ ID NO: 374620 - DNA, 25 bp, Homo sapien
cgtaccgactataaagctctgagaa

SEQ ID NO: 374621 - DNA, 25 bp, Homo sapien
gacatacttgaaactcagaaacagc

SEQ ID NO: 374622 - DNA, 25 bp, Homo sapien
agaaacagcactgagtctccccatg

SEQ ID NO: 374623 - DNA, 25 bp, Homo sapien
tgagtctccccatgccaattcttgc

SEQ ID NO: 374624 - DNA, 25 bp, Homo sapien
catgccaattcttgcctgctgtctt

SEQ ID NO: 374625 - DNA, 25 bp, Homo sapien
aattcttgcctgctgtcttcgactt

SEQ ID NO: 374626 - DNA, 25 bp, Homo sapien
tgcctgctgtcttcgacttgggtca

SEQ ID NO: 374627 - DNA, 25 bp, Homo sapien
tgctgtcttcgacttgggtcagaga

SEQ ID NO: 374628 - DNA, 25 bp, Homo sapien
tcttcgacttgggtcagagaaggtg

SEQ ID NO: 374629 - DNA, 25 bp, Homo sapien
cagagaaggtgagcagacccggcag

SEQ ID NO: 374630 - DNA, 25 bp, Homo sapien
ccaagcacccagcacaacagagggt

SEQ ID NO: 374631 - DNA, 25 bp, Homo sapien
cacaacagagggtggcgggcagtga

SEQ ID NO: 374632 - DNA, 25 bp, Homo sapien
aaaagaagggtcagaggtcaggaag

SEQ ID NO: 374633 - DNA, 25 bp, Homo sapien
ggtcagaggtcaggaaggagaactt

SEQ ID NO: 374634 - DNA, 25 bp, Homo sapien
gtcagaggtcaggaaggagaacttg

SEQ ID NO: 374635 - DNA, 25 bp, Homo sapien
tcagaggtcaggaaggagaacttgg

SEQ ID NO: 374636 - DNA, 25 bp, Homo sapien
cagaggtcaggaaggagaacttggg

SEQ ID NO: 374637 - DNA, 25 bp, Homo sapien
gagggtgtgtgggaagaatggagaa

SEQ ID NO: 374638 - DNA, 25 bp, Homo sapien
agggtgtgtgggaagaatggagaaa

SEQ ID NO: 374639 - DNA, 25 bp, Homo sapien
gggtgtgtgggaagaatggagaaat

SEQ ID NO: 374640 - DNA, 25 bp, Homo sapien
aagaatggagaaattcaggctgggt

SEQ ID NO: 374641 - DNA, 25 bp, Homo sapien
ttagccaggcggtagtggtgtgtgc

SEQ ID NO: 374642 - DNA, 25 bp, Homo sapien
ccaggcggtagtggtgtgtgcctat

SEQ ID NO: 374643 - DNA, 25 bp, Homo sapien
gcgagactgaataccagaacacaga

SEQ ID NO: 374644 - DNA, 25 bp, Homo sapien
ctaaaggatgattctctgtggactc

SEQ ID NO: 374645 - DNA, 25 bp, Homo sapien
gatgattctctgtggactccaaagg

SEQ ID NO: 374646 - DNA, 25 bp, Homo sapien
ggaataaccaacacagctcaatcga

SEQ ID NO: 374647 - DNA, 25 bp, Homo sapien
aaccaggctggtgacggataatgac

SEQ ID NO: 374648 - DNA, 25 bp, Homo sapien
gtgacggataatgaccaactaattt

SEQ ID NO: 374649 - DNA, 25 bp, Homo sapien
gaccaactaatttcatctcaacact

SEQ ID NO: 374650 - DNA, 25 bp, Homo sapien
ctcaacactgtttctgatgtaaaat

SEQ ID NO: 374651 - DNA, 25 bp, Homo sapien
gaacacagagtatgcacaactgcag

SEQ ID NO: 374652 - DNA, 25 bp, Homo sapien
gagtatgcacaactgcaggacatca

SEQ ID NO: 374653 - DNA, 25 bp, Homo sapien
taccaccacctgctcggtggagagg

SEQ ID NO: 374654 - DNA, 25 bp, Homo sapien
caggcaaggttctccggtgaagcca

SEQ ID NO: 374655 - DNA, 25 bp, Homo sapien
aaggttctccggtgaagccacagcc

SEQ ID NO: 374656 - DNA, 25 bp, Homo sapien
gttctccggtgaagccacagcctgg

SEQ ID NO: 374657 - DNA, 25 bp, Homo sapien
ctgtcttgatctccccaccgagaag

SEQ ID NO: 374658 - DNA, 25 bp, Homo sapien
cagtgggcaggctcgaggcgtctgc

SEQ ID NO: 374659 - DNA, 25 bp, Homo sapien
agcatgcagccccaggagagccacg

SEQ ID NO: 374660 - DNA, 25 bp, Homo sapien
gagagccacgtccactatagtaggt

SEQ ID NO: 374661 - DNA, 25 bp, Homo sapien
agagccacgtccactatagtaggtg

SEQ ID NO: 374662 - DNA, 25 bp, Homo sapien
gccacgtccactatagtaggtggga

SEQ ID NO: 374663 - DNA, 25 bp, Homo sapien
tatagtaggtgggaggacggcagca

SEQ ID NO: 374664 - DNA, 25 bp, Homo sapien
acggcagcagggacggagtcagcct

SEQ ID NO: 374665 - DNA, 25 bp, Homo sapien
gaaattgacttttgtttggagtttg

SEQ ID NO: 374666 - DNA, 25 bp, Homo sapien
aattgacttttgtttggagtttgtg

SEQ ID NO: 374667 - DNA, 25 bp, Homo sapien
attgacttttgtttggagtttgtga

SEQ ID NO: 374668 - DNA, 25 bp, Homo sapien
ccatgcggcaagagcgagtcgcagg

SEQ ID NO: 374669 - DNA, 25 bp, Homo sapien
catgcggcaagagcgagtcgcagga

SEQ ID NO: 374670 - DNA, 25 bp, Homo sapien
cggcaagagcgagtcgcaggaacaa

SEQ ID NO: 374671 - DNA, 25 bp, Homo sapien
ggcaagagcgagtcgcaggaacaag

SEQ ID NO: 374672 - DNA, 25 bp, Homo sapien
gcaagagcgagtcgcaggaacaagt

SEQ ID NO: 374673 - DNA, 25 bp, Homo sapien
agagcgagtcgcaggaacaagtggg

SEQ ID NO: 374674 - DNA, 25 bp, Homo sapien
acaagtggggaatcttggccgcggc

SEQ ID NO: 374675 - DNA, 25 bp, Homo sapien
caagtggggaatcttggccgcggcc

SEQ ID NO: 374676 - DNA, 25 bp, Homo sapien
gagcacagggtctgtccttagacat

SEQ ID NO: 374677 - DNA, 25 bp, Homo sapien
agacataatggtgaccctccacaag

SEQ ID NO: 374678 - DNA, 25 bp, Homo sapien
gtaacagaaacctcagcactgggaa

SEQ ID NO: 374679 - DNA, 25 bp, Homo sapien
cacaagctctgtggcttttaaagtt

SEQ ID NO: 374680 - DNA, 25 bp, Homo sapien
ggcttttaaagttctgacagggata

SEQ ID NO: 374681 - DNA, 25 bp, Homo sapien
gcaaatgacatcgtagctgcatata

SEQ ID NO: 374682 - DNA, 25 bp, Homo sapien
gaacacactattaagcagggccctg

SEQ ID NO: 374683 - DNA, 25 bp, Homo sapien
ttaagcagggccctgtagctctact

SEQ ID NO: 374684 - DNA, 25 bp, Homo sapien
cctgtagctctactcgtgtgtgtgt

SEQ ID NO: 374685 - DNA, 25 bp, Homo sapien
gcactgggaaaagctgcccacactg

SEQ ID NO: 374686 - DNA, 25 bp, Homo sapien
tgggtgatgggcacctctcactgac

SEQ ID NO: 374687 - DNA, 25 bp, Homo sapien
gaattgtggaaaccttacttcattt

SEQ ID NO: 374688 - DNA, 25 bp, Homo sapien
gaagaacccagtctgattaaaggaa

SEQ ID NO: 374689 - DNA, 25 bp, Homo sapien
ggaagttccgtgtttaaggcaacat

SEQ ID NO: 374690 - DNA, 25 bp, Homo sapien
ggcaacatgttgcttgtggcagatc

SEQ ID NO: 374691 - DNA, 25 bp, Homo sapien
ttgcttgtggcagatctagactcaa

SEQ ID NO: 374692 - DNA, 25 bp, Homo sapien
ctcaaaactgagattcctgcctctg

SEQ ID NO: 374693 - DNA, 25 bp, Homo sapien
gtccagtgcttttttcacttcatta

SEQ ID NO: 374694 - DNA, 25 bp, Homo sapien
acttcattacattacgagccatctt

SEQ ID NO: 374695 - DNA, 25 bp, Homo sapien
agccatcttaactccattcatgcaa

SEQ ID NO: 374696 - DNA, 25 bp, Homo sapien
tggacaggatgagagaccccaatct

SEQ ID NO: 374697 - DNA, 25 bp, Homo sapien
agaccccaatctctcagatttgagg

SEQ ID NO: 374698 - DNA, 25 bp, Homo sapien
tctaaggaagattaagctgtttgca

SEQ ID NO: 374699 - DNA, 25 bp, Homo sapien
tacagttttctttagctaccctgct

SEQ ID NO: 374700 - DNA, 25 bp, Homo sapien
tttctttagctaccctgctcacaat

SEQ ID NO: 374701 - DNA, 25 bp, Homo sapien
tgctcacaataccatctacactgtg

SEQ ID NO: 374702 - DNA, 25 bp, Homo sapien
acaataccatctacactgtgtctgt

SEQ ID NO: 374703 - DNA, 25 bp, Homo sapien
atctacactgtgtctgtacctgtgt

SEQ ID NO: 374704 - DNA, 25 bp, Homo sapien
cactgtgtctgtacctgtgtgacaa

SEQ ID NO: 374705 - DNA, 25 bp, Homo sapien
gaattagattcttcaagctagactt

SEQ ID NO: 374706 - DNA, 25 bp, Homo sapien
caagctagacttgattgggctagta

SEQ ID NO: 374707 - DNA, 25 bp, Homo sapien
acttgattgggctagtattacttta

SEQ ID NO: 374708 - DNA, 25 bp, Homo sapien
ggctagtattactttaggaaatgtt

SEQ ID NO: 374709 - DNA, 25 bp, Homo sapien
attttccattctcataaccctcagt

SEQ ID NO: 374710 - DNA, 25 bp, Homo sapien
ataaccctcagtgggcttcaagtga

SEQ ID NO: 374711 - DNA, 25 bp, Homo sapien
agtgggcttcaagtgatcatctgcc

SEQ ID NO: 374712 - DNA, 25 bp, Homo sapien
tcatctgcctcatcagagtagtcat

SEQ ID NO: 374713 - DNA, 25 bp, Homo sapien
gagtagtcatgcaactatccaagat

SEQ ID NO: 374714 - DNA, 25 bp, Homo sapien
caagatactgtgtggaagctattca

SEQ ID NO: 374715 - DNA, 25 bp, Homo sapien
tattcagtgatcttccagcctggaa

SEQ ID NO: 374716 - DNA, 25 bp, Homo sapien
tgttttccattatcaagacatggcc

SEQ ID NO: 374717 - DNA, 25 bp, Homo sapien
gacatggccatctatctaaatatta

SEQ ID NO: 374718 - DNA, 25 bp, Homo sapien
aatgatggtgctttctgcatttggt

SEQ ID NO: 374719 - DNA, 25 bp, Homo sapien
aaatttgcagtcctcactgcacatg

SEQ ID NO: 374720 - DNA, 25 bp, Homo sapien
aatgtgtggtgagaataaaagcaac

SEQ ID NO: 374721 - DNA, 25 bp, Homo sapien
tgtgtggtgagaataaaagcaacaa

SEQ ID NO: 374722 - DNA, 25 bp, Homo sapien
gtggtgagaataaaagcaacaaaga

SEQ ID NO: 374723 - DNA, 25 bp, Homo sapien
caaagaaatgaatgtggtggctcac

SEQ ID NO: 374724 - DNA, 25 bp, Homo sapien
aggaggatcctttgtgctcaagagt

SEQ ID NO: 374725 - DNA, 25 bp, Homo sapien
ggaggatcctttgtgctcaagagtt

SEQ ID NO: 374726 - DNA, 25 bp, Homo sapien
gaggatcctttgtgctcaagagttt

SEQ ID NO: 374727 - DNA, 25 bp, Homo sapien
aggatcctttgtgctcaagagtttg

SEQ ID NO: 374728 - DNA, 25 bp, Homo sapien
ggatcctttgtgctcaagagtttga

SEQ ID NO: 374729 - DNA, 25 bp, Homo sapien
gatcctttgtgctcaagagtttgag

SEQ ID NO: 374730 - DNA, 25 bp, Homo sapien
gctgccatgagccataatcacgcca

SEQ ID NO: 374731 - DNA, 25 bp, Homo sapien
attagtccttctatagccagattag

SEQ ID NO: 374732 - DNA, 25 bp, Homo sapien
agtccttctatagccagattagcaa

SEQ ID NO: 374733 - DNA, 25 bp, Homo sapien
cttctatagccagattagcaatctt

SEQ ID NO: 374734 - DNA, 25 bp, Homo sapien
tagcaatcttagagcctggtcaggc

SEQ ID NO: 374735 - DNA, 25 bp, Homo sapien
tcttagagcctggtcaggcacagtg

SEQ ID NO: 374736 - DNA, 25 bp, Homo sapien
aaaaatgaaattgttaattggccag

SEQ ID NO: 374737 - DNA, 25 bp, Homo sapien
agagggtggctctagcacagtcatc

SEQ ID NO: 374738 - DNA, 25 bp, Homo sapien
agggtggctctagcacagtcatcaa

SEQ ID NO: 374739 - DNA, 25 bp, Homo sapien
ggtggctctagcacagtcatcaagg

SEQ ID NO: 374740 - DNA, 25 bp, Homo sapien
ggctctagcacagtcatcaaggctg

SEQ ID NO: 374741 - DNA, 25 bp, Homo sapien
ctctagcacagtcatcaaggctgca

SEQ ID NO: 374742 - DNA, 25 bp, Homo sapien
gatattttggcagactttttgacag

SEQ ID NO: 374743 - DNA, 25 bp, Homo sapien
tttggcagactttttgacagcaccc

SEQ ID NO: 374744 - DNA, 25 bp, Homo sapien
tggcagactttttgacagcacccac

SEQ ID NO: 374745 - DNA, 25 bp, Homo sapien
ttgacagcacccacatttgatttga

SEQ ID NO: 374746 - DNA, 25 bp, Homo sapien
tgtagtaaattgaggtctatgtttc

SEQ ID NO: 374747 - DNA, 25 bp, Homo sapien
gacagcacccacatttgatttgatg

SEQ ID NO: 374748 - DNA, 25 bp, Homo sapien
gcacccacatttgatttgatgagat

SEQ ID NO: 374749 - DNA, 25 bp, Homo sapien
gagatgtgtgctcctatttgagtta

SEQ ID NO: 374750 - DNA, 25 bp, Homo sapien
gtgctcctatttgagttatgtccaa

SEQ ID NO: 374751 - DNA, 25 bp, Homo sapien
tttgagttatgtccaaagggcagac

SEQ ID NO: 374752 - DNA, 25 bp, Homo sapien
gttatgtccaaagggcagacagatg

SEQ ID NO: 374753 - DNA, 25 bp, Homo sapien
ctctgcccgtacttataccaggtgg

SEQ ID NO: 374754 - DNA, 25 bp, Homo sapien
tgcccgtacttataccaggtgggat

SEQ ID NO: 374755 - DNA, 25 bp, Homo sapien
cgtacttataccaggtgggatccct

SEQ ID NO: 374756 - DNA, 25 bp, Homo sapien
tataccaggtgggatccctgccctg

SEQ ID NO: 374757 - DNA, 25 bp, Homo sapien
ttgggcccgccctgctgtggaactg

SEQ ID NO: 374758 - DNA, 25 bp, Homo sapien
agggagcccagcctttcctcatgtc

SEQ ID NO: 374759 - DNA, 25 bp, Homo sapien
agcctttcctcatgtcaacacagtt

SEQ ID NO: 374760 - DNA, 25 bp, Homo sapien
ctttcctcatgtcaacacagttcac

SEQ ID NO: 374761 - DNA, 25 bp, Homo sapien
tcctcatgtcaacacagttcacaat

SEQ ID NO: 374762 - DNA, 25 bp, Homo sapien
acacagttcacaatatagttttcaa

SEQ ID NO: 374763 - DNA, 25 bp, Homo sapien
gggtgtcctcagctggccctacaga

SEQ ID NO: 374764 - DNA, 25 bp, Homo sapien
gtctccagacagtagaggtgagcca

SEQ ID NO: 374765 - DNA, 25 bp, Homo sapien
aagttagcgtgattgtcaccaggcc

SEQ ID NO: 374766 - DNA, 25 bp, Homo sapien
tctggctgcgtcctcactttcacat

SEQ ID NO: 374767 - DNA, 25 bp, Homo sapien
ttcacatccctagctgaggaaacag

SEQ ID NO: 374768 - DNA, 25 bp, Homo sapien
gaaacagcgagtcgcatcacgtcat

SEQ ID NO: 374769 - DNA, 25 bp, Homo sapien
gagtcgcatcacgtcatggaaacat

SEQ ID NO: 374770 - DNA, 25 bp, Homo sapien
aatgggccgtaaattgctcttagcg

SEQ ID NO: 374771 - DNA, 25 bp, Homo sapien
ctcttagcgggtctgtttggttaat

SEQ ID NO: 374772 - DNA, 25 bp, Homo sapien
gaggagtgcctgttatcttgggctt

SEQ ID NO: 374773 - DNA, 25 bp, Homo sapien
tatcttgggcttagatccgctctga

SEQ ID NO: 374774 - DNA, 25 bp, Homo sapien
gatccgctctgagttcagttcaatc

SEQ ID NO: 374775 - DNA, 25 bp, Homo sapien
aaggaggtagggacgatagcagggc

SEQ ID NO: 374776 - DNA, 25 bp, Homo sapien
taccagctcgggctagcgcttccgg

SEQ ID NO: 374777 - DNA, 25 bp, Homo sapien
ctcgggctagcgcttccggctcgat

SEQ ID NO: 374778 - DNA, 25 bp, Homo sapien
tcgggctagcgcttccggctcgatc

SEQ ID NO: 374779 - DNA, 25 bp, Homo sapien
cgggctagcgcttccggctcgatcg

SEQ ID NO: 374780 - DNA, 25 bp, Homo sapien
gggctagcgcttccggctcgatcgg

SEQ ID NO: 374781 - DNA, 25 bp, Homo sapien
tctctctttttctctgcttctcacg

SEQ ID NO: 374782 - DNA, 25 bp, Homo sapien
ctctctttttctctgcttctcacgg

SEQ ID NO: 374783 - DNA, 25 bp, Homo sapien
ctctctaaggatggcccagaaggag

SEQ ID NO: 374784 - DNA, 25 bp, Homo sapien
ggatggcccagaaggagaactccta

SEQ ID NO: 374785 - DNA, 25 bp, Homo sapien
tacggccgacagacggtaaggccct

SEQ ID NO: 374786 - DNA, 25 bp, Homo sapien
tgtcccatccctctaggacagggaa

SEQ ID NO: 374787 - DNA, 25 bp, Homo sapien
ccatccctctaggacagggaagctg

SEQ ID NO: 374788 - DNA, 25 bp, Homo sapien
ccctctaggacagggaagctggcct

SEQ ID NO: 374789 - DNA, 25 bp, Homo sapien
aggacagggaagctggcctggtcca

SEQ ID NO: 374790 - DNA, 25 bp, Homo sapien
actgatggtgcttggattccagcct

SEQ ID NO: 374791 - DNA, 25 bp, Homo sapien
cctaaggaaggctggccgtggtcca

SEQ ID NO: 374792 - DNA, 25 bp, Homo sapien
aggctggccgtggtccaggagttaa

SEQ ID NO: 374793 - DNA, 25 bp, Homo sapien
ccgtggtccaggagttaagggcttg

SEQ ID NO: 374794 - DNA, 25 bp, Homo sapien
ggtttaagtggccacccatccaggc

SEQ ID NO: 374795 - DNA, 25 bp, Homo sapien
catccaggccctggccagtgtggga

SEQ ID NO: 374796 - DNA, 25 bp, Homo sapien
aaaaggtgcacttggccagtggcgc

SEQ ID NO: 374797 - DNA, 25 bp, Homo sapien
gggcttaagcctataactgctggtg

SEQ ID NO: 374798 - DNA, 25 bp, Homo sapien
gcctataactgctggtgatctgaca

SEQ ID NO: 374799 - DNA, 25 bp, Homo sapien
aaccctgatgagagattcctgcctg

SEQ ID NO: 374800 - DNA, 25 bp, Homo sapien
ttcctgcctggcaaagagttgccca

SEQ ID NO: 374801 - DNA, 25 bp, Homo sapien
ccagctccaagacgccaggattgga

SEQ ID NO: 374802 - DNA, 25 bp, Homo sapien
attggacagaacaggctggcgagct

SEQ ID NO: 374803 - DNA, 25 bp, Homo sapien
tgcccagtacacaaccttggtgcta

SEQ ID NO: 374804 - DNA, 25 bp, Homo sapien
tacacaaccttggtgctactccaaa

SEQ ID NO: 374805 - DNA, 25 bp, Homo sapien
ggtgctactccaaagaacattgtct

SEQ ID NO: 374806 - DNA, 25 bp, Homo sapien
gaacattgtctatcgagacctgaat

SEQ ID NO: 374807 - DNA, 25 bp, Homo sapien
gtctatcgagacctgaatcataccc

SEQ ID NO: 374808 - DNA, 25 bp, Homo sapien
ttccccttggaaacagcaatcccaa

SEQ ID NO: 374809 - DNA, 25 bp, Homo sapien
gcaatcccaaataatgtcggcttac

SEQ ID NO: 374810 - DNA, 25 bp, Homo sapien
tcccaaataatgtcggcttacaaaa

SEQ ID NO: 374811 - DNA, 25 bp, Homo sapien
tttttcccttatgagatccacctaa

SEQ ID NO: 374812 - DNA, 25 bp, Homo sapien
gagatccacctaaggccattgacgt

SEQ ID NO: 374813 - DNA, 25 bp, Homo sapien
aaggccattgacgtggcctgcgatc

SEQ ID NO: 374814 - DNA, 25 bp, Homo sapien
attgacgtggcctgcgatctcagtg

SEQ ID NO: 374815 - DNA, 25 bp, Homo sapien
gtggcctgcgatctcagtgacaatg

SEQ ID NO: 374816 - DNA, 25 bp, Homo sapien
gcgatctcagtgacaatgatctgct

SEQ ID NO: 374817 - DNA, 25 bp, Homo sapien
ggaacacagcagagtctgtgccatg

SEQ ID NO: 374818 - DNA, 25 bp, Homo sapien
acagcagagtctgtgccatgaagca

SEQ ID NO: 374819 - DNA, 25 bp, Homo sapien
gaaactatgtatcttagaactggag

SEQ ID NO: 374820 - DNA, 25 bp, Homo sapien
gaacctaggtttctgacttctacat

SEQ ID NO: 374821 - DNA, 25 bp, Homo sapien
ttcctgtactccacctatcaagaag

SEQ ID NO: 374822 - DNA, 25 bp, Homo sapien
gaagggccttttcagcctagaaaca

SEQ ID NO: 374823 - DNA, 25 bp, Homo sapien
ttcagcctagaaacacatgtgataa

SEQ ID NO: 374824 - DNA, 25 bp, Homo sapien
ctcctatgagattgtgctccttgtt

SEQ ID NO: 374825 - DNA, 25 bp, Homo sapien
tgagattgtgctccttgttcatctg

SEQ ID NO: 374826 - DNA, 25 bp, Homo sapien
ctgtcatctgctgtgctggtaaggt

SEQ ID NO: 374827 - DNA, 25 bp, Homo sapien
ctgtgctggtaaggtggctagtaat

SEQ ID NO: 374828 - DNA, 25 bp, Homo sapien
gtggctagtaatagtgggtacccaa

SEQ ID NO: 374829 - DNA, 25 bp, Homo sapien
gtgggtacccaattaacatgctgaa

SEQ ID NO: 374830 - DNA, 25 bp, Homo sapien
atacagaactgtaattttcccaata

SEQ ID NO: 374831 - DNA, 25 bp, Homo sapien
gaactgtaattttcccaataatgta

SEQ ID NO: 374832 - DNA, 25 bp, Homo sapien
aaatgtaccatctctagctgatttt

SEQ ID NO: 374833 - DNA, 25 bp, Homo sapien
atgtaccatctctagctgattttca

SEQ ID NO: 374834 - DNA, 25 bp, Homo sapien
gtaccatctctagctgattttcagt

SEQ ID NO: 374835 - DNA, 25 bp, Homo sapien
accatctctagctgattttcagttc

SEQ ID NO: 374836 - DNA, 25 bp, Homo sapien
atctctagctgattttcagttccaa

SEQ ID NO: 374837 - DNA, 25 bp, Homo sapien
gtattaatattaaagtggcctgtta

SEQ ID NO: 374838 - DNA, 25 bp, Homo sapien
gtggcctgttaaaatgaacagtatc

SEQ ID NO: 374839 - DNA, 25 bp, Homo sapien
accacacgctgctgtcacgacgtag

SEQ ID NO: 374840 - DNA, 25 bp, Homo sapien
cacacgctgctgtcacgacgtaggt

SEQ ID NO: 374841 - DNA, 25 bp, Homo sapien
tttgtccatagaggcttcaagatag

SEQ ID NO: 374842 - DNA, 25 bp, Homo sapien
ccagtagtgttcataagaagccaat

SEQ ID NO: 374843 - DNA, 25 bp, Homo sapien
agagcaggagccactttatcaggtg

SEQ ID NO: 374844 - DNA, 25 bp, Homo sapien
cctgctggctagtcccaagcggtgg

SEQ ID NO: 374845 - DNA, 25 bp, Homo sapien
tcccaagcggtggtgttgccaggat

SEQ ID NO: 374846 - DNA, 25 bp, Homo sapien
gtgataatgggacacacagaggcac

SEQ ID NO: 374847 - DNA, 25 bp, Homo sapien
gaggcactgagtctccataggttaa

SEQ ID NO: 374848 - DNA, 25 bp, Homo sapien
aaatgccaccaaaactggcctttgc

SEQ ID NO: 374849 - DNA, 25 bp, Homo sapien
gcctttgcctaatatccctcattga

SEQ ID NO: 374850 - DNA, 25 bp, Homo sapien
tatccctcattgactatttagcatt

SEQ ID NO: 374851 - DNA, 25 bp, Homo sapien
tttcctgacatttctgcaagctttg

SEQ ID NO: 374852 - DNA, 25 bp, Homo sapien
gggagtaggtgctaacctggataac

SEQ ID NO: 374853 - DNA, 25 bp, Homo sapien
ggagtaggtgctaacctggataact

SEQ ID NO: 374854 - DNA, 25 bp, Homo sapien
gagtaggtgctaacctggataactg

SEQ ID NO: 374855 - DNA, 25 bp, Homo sapien
gtaggtgctaacctggataactgta

SEQ ID NO: 374856 - DNA, 25 bp, Homo sapien
aggtgctaacctggataactgtaaa

SEQ ID NO: 374857 - DNA, 25 bp, Homo sapien
ggtgctaacctggataactgtaaaa

SEQ ID NO: 374858 - DNA, 25 bp, Homo sapien
gtgctaacctggataactgtaaaag

SEQ ID NO: 374859 - DNA, 25 bp, Homo sapien
cctggataactgtaaaagggctctc

SEQ ID NO: 374860 - DNA, 25 bp, Homo sapien
ataactgtaaaagggctctctctcc

SEQ ID NO: 374861 - DNA, 25 bp, Homo sapien
actgtctctcttctttctgtcaggg

SEQ ID NO: 374862 - DNA, 25 bp, Homo sapien
ttctttctgtcaggggctcccacag

SEQ ID NO: 374863 - DNA, 25 bp, Homo sapien
taagtctcatggttgctgtgggctg

SEQ ID NO: 374864 - DNA, 25 bp, Homo sapien
tggctggtttgttttggctcaggat

SEQ ID NO: 374865 - DNA, 25 bp, Homo sapien
taggatatggctgctcttctcatta

SEQ ID NO: 374866 - DNA, 25 bp, Homo sapien
atcagtgatgcttgccacagggcgg

SEQ ID NO: 374867 - DNA, 25 bp, Homo sapien
tgctggacaagtgggcatctctctg

SEQ ID NO: 374868 - DNA, 25 bp, Homo sapien
atatagtctctgcactggccagctt

SEQ ID NO: 374869 - DNA, 25 bp, Homo sapien
tgctcttctcattagctgttgctgt

SEQ ID NO: 374870 - DNA, 25 bp, Homo sapien
gctgttgctgttaataaatcacttc

SEQ ID NO: 374871 - DNA, 25 bp, Homo sapien
aaatcacttcacaacttagccgcaa

SEQ ID NO: 374872 - DNA, 25 bp, Homo sapien
acttagccgcaaatgacagcaatca

SEQ ID NO: 374873 - DNA, 25 bp, Homo sapien
cagcaatcattgcattaagtctcat

SEQ ID NO: 374874 - DNA, 25 bp, Homo sapien
tcctttgatggacggaagagacaag

SEQ ID NO: 374875 - DNA, 25 bp, Homo sapien
gaagagacaagagatccgccatgga

SEQ ID NO: 374876 - DNA, 25 bp, Homo sapien
aagagatccgccatggagacagcat

SEQ ID NO: 374877 - DNA, 25 bp, Homo sapien
gcatcagcatcactacctcatgcta

SEQ ID NO: 374878 - DNA, 25 bp, Homo sapien
gaccccgtgagcgactggtttgaga

SEQ ID NO: 374879 - DNA, 25 bp, Homo sapien
gactggtttgagagcctcgcccagt

SEQ ID NO: 374880 - DNA, 25 bp, Homo sapien
agtgcctgcattggaacgtccggaa

SEQ ID NO: 374881 - DNA, 25 bp, Homo sapien
gcattggaacgtccggaagaagcaa

SEQ ID NO: 374882 - DNA, 25 bp, Homo sapien
aggagggctaggtcaagcccctatc

SEQ ID NO: 374883 - DNA, 25 bp, Homo sapien
gggacagaccaatctgcgtgtgtct

SEQ ID NO: 374884 - DNA, 25 bp, Homo sapien
aatctgcgtgtgtctgtgaccgcct

SEQ ID NO: 374885 - DNA, 25 bp, Homo sapien
gagcaaaggtgagagataaaatgat

SEQ ID NO: 374886 - DNA, 25 bp, Homo sapien
gagataaaatgatgtgatcaggctg

SEQ ID NO: 374887 - DNA, 25 bp, Homo sapien
agataaaatgatgtgatcaggctgg

SEQ ID NO: 374888 - DNA, 25 bp, Homo sapien
gataaaatgatgtgatcaggctggg

SEQ ID NO: 374889 - DNA, 25 bp, Homo sapien
ataaaatgatgtgatcaggctgggt

SEQ ID NO: 374890 - DNA, 25 bp, Homo sapien
taaaatgatgtgatcaggctgggtg

SEQ ID NO: 374891 - DNA, 25 bp, Homo sapien
aaaatgatgtgatcaggctgggtgc

SEQ ID NO: 374892 - DNA, 25 bp, Homo sapien
aaatgatgtgatcaggctgggtgcg

SEQ ID NO: 374893 - DNA, 25 bp, Homo sapien
aatgatgtgatcaggctgggtgcgt

SEQ ID NO: 374894 - DNA, 25 bp, Homo sapien
atgatgtgatcaggctgggtgcgtt

SEQ ID NO: 374895 - DNA, 25 bp, Homo sapien
tgatgtgatcaggctgggtgcgttg

SEQ ID NO: 374896 - DNA, 25 bp, Homo sapien
gcagcagaatccgtgccttttcttc

SEQ ID NO: 374897 - DNA, 25 bp, Homo sapien
agcagaatccgtgccttttcttctg

SEQ ID NO: 374898 - DNA, 25 bp, Homo sapien
gccttttcttctggagtgtgtgaga

SEQ ID NO: 374899 - DNA, 25 bp, Homo sapien
tcttctggagtgtgtgagagtccgt

SEQ ID NO: 374900 - DNA, 25 bp, Homo sapien
agtatctcacacagatgtggcaatt

SEQ ID NO: 374901 - DNA, 25 bp, Homo sapien
aacactttgaagaacacctttgcca

SEQ ID NO: 374902 - DNA, 25 bp, Homo sapien
tttgaagaacacctttgccacatgt

SEQ ID NO: 374903 - DNA, 25 bp, Homo sapien
gaagaacacctttgccacatgtcct

SEQ ID NO: 374904 - DNA, 25 bp, Homo sapien
gaacacctttgccacatgtcctcag

SEQ ID NO: 374905 - DNA, 25 bp, Homo sapien
gccacatgtcctcaggaccttctga

SEQ ID NO: 374906 - DNA, 25 bp, Homo sapien
ggtcactcatatttgactcaataaa

SEQ ID NO: 374907 - DNA, 25 bp, Homo sapien
ggaacatgctgcagagttgtcccct

SEQ ID NO: 374908 - DNA, 25 bp, Homo sapien
acatgctgcagagttgtcccctggg

SEQ ID NO: 374909 - DNA, 25 bp, Homo sapien
tgagagagagccactccactcccat

SEQ ID NO: 374910 - DNA, 25 bp, Homo sapien
tccactcccatcctttgtaggtaga

SEQ ID NO: 374911 - DNA, 25 bp, Homo sapien
tttgtaggtagagggccaccgccag

SEQ ID NO: 374912 - DNA, 25 bp, Homo sapien
accgccaggctcttagctacttgga

SEQ ID NO: 374913 - DNA, 25 bp, Homo sapien
gctacttggaactagggccagcttg

SEQ ID NO: 374914 - DNA, 25 bp, Homo sapien
atatgggtgaggcacccatggcctc

SEQ ID NO: 374915 - DNA, 25 bp, Homo sapien
atggcctctgctacattgtttttaa

SEQ ID NO: 374916 - DNA, 25 bp, Homo sapien
aatggtcctatcacagaaactctgc

SEQ ID NO: 374917 - DNA, 25 bp, Homo sapien
aacattttacaattactctatccaa

SEQ ID NO: 374918 - DNA, 25 bp, Homo sapien
aggactgtttctggccgaggacttc

SEQ ID NO: 374919 - DNA, 25 bp, Homo sapien
tggccgaggacttcttccaattaaa

SEQ ID NO: 374920 - DNA, 25 bp, Homo sapien
cgtgggctgtctcccctcatttcat

SEQ ID NO: 374921 - DNA, 25 bp, Homo sapien
gcaatgtgtgtgatttacttttctg

SEQ ID NO: 374922 - DNA, 25 bp, Homo sapien
tataaaagtgtgttcttaactccag

SEQ ID NO: 374923 - DNA, 25 bp, Homo sapien
ttaactccagaaccactctttttgc

SEQ ID NO: 374924 - DNA, 25 bp, Homo sapien
tcatcccaccccacagatgataaaa

SEQ ID NO: 374925 - DNA, 25 bp, Homo sapien
gatgataaaattcagacctctctcc

SEQ ID NO: 374926 - DNA, 25 bp, Homo sapien
cagacctctctcctgaaaggcagag

SEQ ID NO: 374927 - DNA, 25 bp, Homo sapien
aggcagaggttcaacattcaggact

SEQ ID NO: 374928 - DNA, 25 bp, Homo sapien
attcaggactgtttctggccgagga

SEQ ID NO: 374929 - DNA, 25 bp, Homo sapien
gtcgctgtgtgctgagtaatgcagt

SEQ ID NO: 374930 - DNA, 25 bp, Homo sapien
aatgcagtcctttgctgggcgggaa

SEQ ID NO: 374931 - DNA, 25 bp, Homo sapien
agtgggcagcactctgaagggacat

SEQ ID NO: 374932 - DNA, 25 bp, Homo sapien
agaaggaatgaaccccatgagctgg

SEQ ID NO: 374933 - DNA, 25 bp, Homo sapien
gcacacgcctgatgcctgtgtcaga

SEQ ID NO: 374934 - DNA, 25 bp, Homo sapien
gtgtcagagccacgcagtctctgag

SEQ ID NO: 374935 - DNA, 25 bp, Homo sapien
agtctctgagtcgtgttcccaagca

SEQ ID NO: 374936 - DNA, 25 bp, Homo sapien
ttggcaagtcccgatggtcttctta

SEQ ID NO: 374937 - DNA, 25 bp, Homo sapien
gatggtcttcttaggccagtcagga

SEQ ID NO: 374938 - DNA, 25 bp, Homo sapien
taggccagtcaggatgtttcttaga

SEQ ID NO: 374939 - DNA, 25 bp, Homo sapien
gtttcttagactcacatcagccttg

SEQ ID NO: 374940 - DNA, 25 bp, Homo sapien
tcaccttctcagtgggtcgcttttt

SEQ ID NO: 374941 - DNA, 25 bp, Homo sapien
tcagtgggtcgctttttccgctgga

SEQ ID NO: 374942 - DNA, 25 bp, Homo sapien
tttccgctggatggtggacacccga

SEQ ID NO: 374943 - DNA, 25 bp, Homo sapien
ggatggtggacacccgaatctccgt

SEQ ID NO: 374944 - DNA, 25 bp, Homo sapien
tggacacccgaatctccgtgcgcat

SEQ ID NO: 374945 - DNA, 25 bp, Homo sapien
tgcgcatccacgagtacgcagccat

SEQ ID NO: 374946 - DNA, 25 bp, Homo sapien
ccgcctgcatggagaacctggtgga

SEQ ID NO: 374947 - DNA, 25 bp, Homo sapien
agatccgggccagggtgatggccag

SEQ ID NO: 374948 - DNA, 25 bp, Homo sapien
ggaggtgtctgctgaggccctggag

SEQ ID NO: 374949 - DNA, 25 bp, Homo sapien
gatggtcatcaacaacgacgccgag

SEQ ID NO: 374950 - DNA, 25 bp, Homo sapien
catcaacaacgacgccgagctctgg

SEQ ID NO: 374951 - DNA, 25 bp, Homo sapien
acactgatatggtttcaatcttgga

SEQ ID NO: 374952 - DNA, 25 bp, Homo sapien
gtttcaatcttggaggaatcctgat

SEQ ID NO: 374953 - DNA, 25 bp, Homo sapien
agagtcccaaatctgatgatttcag

SEQ ID NO: 374954 - DNA, 25 bp, Homo sapien
gatttcagggctgaacagttccctt

SEQ ID NO: 374955 - DNA, 25 bp, Homo sapien
aacagttcccttctttgagtgatga

SEQ ID NO: 374956 - DNA, 25 bp, Homo sapien
tcccttctttgagtgatgaggacct

SEQ ID NO: 374957 - DNA, 25 bp, Homo sapien
ataaatggagcccatacgtgtgtga

SEQ ID NO: 374958 - DNA, 25 bp, Homo sapien
gagagacctgaggtgtcatgcccag

SEQ ID NO: 374959 - DNA, 25 bp, Homo sapien
ctgaggtgtcatgcccagggatcac

SEQ ID NO: 374960 - DNA, 25 bp, Homo sapien
atgcccagggatcacccatgcacag

SEQ ID NO: 374961 - DNA, 25 bp, Homo sapien
gggatcatgtatatacactgatatg

SEQ ID NO: 374962 - DNA, 25 bp, Homo sapien
aactagagtcagagttcggcagctg

SEQ ID NO: 374963 - DNA, 25 bp, Homo sapien
actagagtcagagttcggcagctgc

SEQ ID NO: 374964 - DNA, 25 bp, Homo sapien
ctagagtcagagttcggcagctgcg

SEQ ID NO: 374965 - DNA, 25 bp, Homo sapien
acttataagcagtttttctcactta

SEQ ID NO: 374966 - DNA, 25 bp, Homo sapien
ttataagcagtttttctcacttagt

SEQ ID NO: 374967 - DNA, 25 bp, Homo sapien
ataagcagtttttctcacttagtcc

SEQ ID NO: 374968 - DNA, 25 bp, Homo sapien
ctttattgcttttggtgaaagtttg

SEQ ID NO: 374969 - DNA, 25 bp, Homo sapien
gggtacacctcagaggttcagtaat

SEQ ID NO: 374970 - DNA, 25 bp, Homo sapien
acacctcagaggttcagtaattcac

SEQ ID NO: 374971 - DNA, 25 bp, Homo sapien
acctcagaggttcagtaattcacct

SEQ ID NO: 374972 - DNA, 25 bp, Homo sapien
ctcagaggttcagtaattcacctgg

SEQ ID NO: 374973 - DNA, 25 bp, Homo sapien
gggagacccctaatgaggaagttga

SEQ ID NO: 374974 - DNA, 25 bp, Homo sapien
gacccctaatgaggaagttgaggta

SEQ ID NO: 374975 - DNA, 25 bp, Homo sapien
ggaagttgaggtaatgcttaacatt

SEQ ID NO: 374976 - DNA, 25 bp, Homo sapien
aggtaatgcttaacattgttgctgt

SEQ ID NO: 374977 - DNA, 25 bp, Homo sapien
tttcccagagccattttggctcaat

SEQ ID NO: 374978 - DNA, 25 bp, Homo sapien
cagatcaactcctcctacaaatatt

SEQ ID NO: 374979 - DNA, 25 bp, Homo sapien
gatcaactcctcctacaaatattat

SEQ ID NO: 374980 - DNA, 25 bp, Homo sapien
aatattattggatgataggccctag

SEQ ID NO: 374981 - DNA, 25 bp, Homo sapien
attattggatgataggccctagaac

SEQ ID NO: 374982 - DNA, 25 bp, Homo sapien
ggatgataggccctagaacccaata

SEQ ID NO: 374983 - DNA, 25 bp, Homo sapien
gataggccctagaacccaataaagg

SEQ ID NO: 374984 - DNA, 25 bp, Homo sapien
tgcacccctccgtttgacaacatat

SEQ ID NO: 374985 - DNA, 25 bp, Homo sapien
tgacaacatatccaccgccgttttt

SEQ ID NO: 374986 - DNA, 25 bp, Homo sapien
tcaaaatacccggaccaatcgatta

SEQ ID NO: 374987 - DNA, 25 bp, Homo sapien
atacccggaccaatcgattagccct

SEQ ID NO: 374988 - DNA, 25 bp, Homo sapien
aatcgattagccctcgccggactcg

SEQ ID NO: 374989 - DNA, 25 bp, Homo sapien
ccggactcggactgcaggaagtgat

SEQ ID NO: 374990 - DNA, 25 bp, Homo sapien
gactgcaggaagtgattgatcggct

SEQ ID NO: 374991 - DNA, 25 bp, Homo sapien
gtgattgatcggctgtttggtttat

SEQ ID NO: 374992 - DNA, 25 bp, Homo sapien
tcggctgtttggtttattgattcat

SEQ ID NO: 374993 - DNA, 25 bp, Homo sapien
attgattcattaactacggtgcctc

SEQ ID NO: 374994 - DNA, 25 bp, Homo sapien
attcattaactacggtgcctccctg

SEQ ID NO: 374995 - DNA, 25 bp, Homo sapien
actggtaaacaaaccgccgcgcagg

SEQ ID NO: 374996 - DNA, 25 bp, Homo sapien
ccgcgcaggcgcaatggcaacagga

SEQ ID NO: 374997 - DNA, 25 bp, Homo sapien
acggtaacctgggtagccgccaatg

SEQ ID NO: 374998 - DNA, 25 bp, Homo sapien
ccgccaatgggctttttcgtagagt

SEQ ID NO: 374999 - DNA, 25 bp, Homo sapien
agccaaacaaaacgctggttccaag

SEQ ID NO: 375000 - DNA, 25 bp, Homo sapien
tgataaactggctgacttcctctat

SEQ ID NO: 375001 - DNA, 25 bp, Homo sapien
aagaagtagttgtgcggccttctgg

SEQ ID NO: 375002 - DNA, 25 bp, Homo sapien
ttctgggcctcgcagagatcttctt

SEQ ID NO: 375003 - DNA, 25 bp, Homo sapien
cgtggaattcctcggccccagagaa

SEQ ID NO: 375004 - DNA, 25 bp, Homo sapien
agagaaatgccgctagcctgtcggc

SEQ ID NO: 375005 - DNA, 25 bp, Homo sapien
tagcctgtcggctagttatattagc

SEQ ID NO: 375006 - DNA, 25 bp, Homo sapien
agcagtccttccctattagtgatca

SEQ ID NO: 375007 - DNA, 25 bp, Homo sapien
gtgtttcaatcaagttcctgccata

SEQ ID NO: 375008 - DNA, 25 bp, Homo sapien
ttcctgccatatcccacttagtaaa

SEQ ID NO: 375009 - DNA, 25 bp, Homo sapien
ttagtaaaacagtccaccactcctt

SEQ ID NO: 375010 - DNA, 25 bp, Homo sapien
accactcctttgaagcatagcaacc

SEQ ID NO: 375011 - DNA, 25 bp, Homo sapien
agcaaccaagttccttgggctctat

SEQ ID NO: 375012 - DNA, 25 bp, Homo sapien
accagcaccttacacatggcaggta

SEQ ID NO: 375013 - DNA, 25 bp, Homo sapien
acgtgtcttcaactgactcacaagc

SEQ ID NO: 375014 - DNA, 25 bp, Homo sapien
acaagctctcaggtgcttactgggt

SEQ ID NO: 375015 - DNA, 25 bp, Homo sapien
gtgggacttgactgttgttgctaat

SEQ ID NO: 375016 - DNA, 25 bp, Homo sapien
gttgctaattaaatccccattccac

SEQ ID NO: 375017 - DNA, 25 bp, Homo sapien
gcccagagggaacatcctgccacac

SEQ ID NO: 375018 - DNA, 25 bp, Homo sapien
tggcagtagcctctttccagctaca

SEQ ID NO: 375019 - DNA, 25 bp, Homo sapien
gtagcctctttccagctacacgtcg

SEQ ID NO: 375020 - DNA, 25 bp, Homo sapien
acaggcccctggaaatgctacctac

SEQ ID NO: 375021 - DNA, 25 bp, Homo sapien
ggcccctggaaatgctacctacgtg

SEQ ID NO: 375022 - DNA, 25 bp, Homo sapien
ccctggaaatgctacctacgtgttg

SEQ ID NO: 375023 - DNA, 25 bp, Homo sapien
ctctctggccaagccctgggtggga

SEQ ID NO: 375024 - DNA, 25 bp, Homo sapien
gagcagagcctctgcctcttgcctg

SEQ ID NO: 375025 - DNA, 25 bp, Homo sapien
tcctctcagacctaaggccgggctc

SEQ ID NO: 375026 - DNA, 25 bp, Homo sapien
ctgtgtgcactgagcttcagcagct

SEQ ID NO: 375027 - DNA, 25 bp, Homo sapien
agcagctgagcctaggtctgtgctg

SEQ ID NO: 375028 - DNA, 25 bp, Homo sapien
tttgtaccaaaaaccttgtgaggag

SEQ ID NO: 375029 - DNA, 25 bp, Homo sapien
ggagccatgtctgtgctcaggaaga

SEQ ID NO: 375030 - DNA, 25 bp, Homo sapien
gtggctagtaggctcctggcctctt

SEQ ID NO: 375031 - DNA, 25 bp, Homo sapien
gctcctggcctctttggtttataaa

SEQ ID NO: 375032 - DNA, 25 bp, Homo sapien
tttgagaaagcacctacctgtcttc

SEQ ID NO: 375033 - DNA, 25 bp, Homo sapien
agaaagcacctacctgtcttctgtg

SEQ ID NO: 375034 - DNA, 25 bp, Homo sapien
ggctgcagagctgtattcaggtcca

SEQ ID NO: 375035 - DNA, 25 bp, Homo sapien
tgtattcaggtccaaggttctgccc

SEQ ID NO: 375036 - DNA, 25 bp, Homo sapien
aaggttctgcccttccttgagtggt

SEQ ID NO: 375037 - DNA, 25 bp, Homo sapien
atgctgggacacaacagacccggga

SEQ ID NO: 375038 - DNA, 25 bp, Homo sapien
gggacacaacagacccgggacccag

SEQ ID NO: 375039 - DNA, 25 bp, Homo sapien
ggatggtgtccagtaatctgtttta

SEQ ID NO: 375040 - DNA, 25 bp, Homo sapien
gtggagatagtgactcttctatgct

SEQ ID NO: 375041 - DNA, 25 bp, Homo sapien
aagcccagcaggtgatactagtgta

SEQ ID NO: 375042 - DNA, 25 bp, Homo sapien
taaagtggaagcacctctggtctat

SEQ ID NO: 375043 - DNA, 25 bp, Homo sapien
gaagcacctctggtctatgacttct

SEQ ID NO: 375044 - DNA, 25 bp, Homo sapien
tggcatataaatcagccccaagatt

SEQ ID NO: 375045 - DNA, 25 bp, Homo sapien
gccccaagatttgaggtgtccctga

SEQ ID NO: 375046 - DNA, 25 bp, Homo sapien
gactcttctatgctagtggttctct

SEQ ID NO: 375047 - DNA, 25 bp, Homo sapien
gttctctaagtgtggtcccagacca

SEQ ID NO: 375048 - DNA, 25 bp, Homo sapien
cgtcacccggtacttactggaaatg

SEQ ID NO: 375049 - DNA, 25 bp, Homo sapien
ggaaatgcaagttctcagacctcac

SEQ ID NO: 375050 - DNA, 25 bp, Homo sapien
ggcccatgacccactgtactggaaa

SEQ ID NO: 375051 - DNA, 25 bp, Homo sapien
gaaaaccactgcgtctccttatctg

SEQ ID NO: 375052 - DNA, 25 bp, Homo sapien
tccttatctggacacgtgcaggctg

SEQ ID NO: 375053 - DNA, 25 bp, Homo sapien
gtgcaggctggtattttcaaaccca

SEQ ID NO: 375054 - DNA, 25 bp, Homo sapien
gctgtgctacagagagtatgtgctt

SEQ ID NO: 375055 - DNA, 25 bp, Homo sapien
gagtatgtgctttaccaagcctggt

SEQ ID NO: 375056 - DNA, 25 bp, Homo sapien
accaagcctggtgctgaagtaccca

SEQ ID NO: 375057 - DNA, 25 bp, Homo sapien
tgaagtacccacaggcaccaatgtc

SEQ ID NO: 375058 - DNA, 25 bp, Homo sapien
cttcctccatcatatagagtgcact

SEQ ID NO: 375059 - DNA, 25 bp, Homo sapien
tgtagtgtgaagtccccatttgtcc

SEQ ID NO: 375060 - DNA, 25 bp, Homo sapien
taactccccgtgtgcctataaagaa

SEQ ID NO: 375061 - DNA, 25 bp, Homo sapien
tttgagaaagcacctacctgtcttc

SEQ ID NO: 375062 - DNA, 25 bp, Homo sapien
agaaagcacctacctgtcttctgtg

SEQ ID NO: 375063 - DNA, 25 bp, Homo sapien
gggctgcagagctgtattcaggtcc

SEQ ID NO: 375064 - DNA, 25 bp, Homo sapien
gctgcagagctgtattcaggtccaa

SEQ ID NO: 375065 - DNA, 25 bp, Homo sapien
gcagagctgtattcaggtccaaggt

SEQ ID NO: 375066 - DNA, 25 bp, Homo sapien
gagctgtattcaggtccaaggttct

SEQ ID NO: 375067 - DNA, 25 bp, Homo sapien
tgtattcaggtccaaggttctgccc

SEQ ID NO: 375068 - DNA, 25 bp, Homo sapien
attcaggtccaaggttctgcccttc

SEQ ID NO: 375069 - DNA, 25 bp, Homo sapien
aaggttctgcccttccttgagtggt

SEQ ID NO: 375070 - DNA, 25 bp, Homo sapien
atgctgggacacaacagacccggga

SEQ ID NO: 375071 - DNA, 25 bp, Homo sapien
gggacacaacagacccgggacccag

SEQ ID NO: 375072 - DNA, 25 bp, Homo sapien
caagttggtcactgtgttagctcaa

SEQ ID NO: 375073 - DNA, 25 bp, Homo sapien
gttagctcaaattggtgcttctctc

SEQ ID NO: 375074 - DNA, 25 bp, Homo sapien
tattggagttgctgttcttggcctt

SEQ ID NO: 375075 - DNA, 25 bp, Homo sapien
gttcttggccttggatagatatgat

SEQ ID NO: 375076 - DNA, 25 bp, Homo sapien
tagatatgattgtccgtgccatcct

SEQ ID NO: 375077 - DNA, 25 bp, Homo sapien
cacagcttcaagcagccatcaaaag

SEQ ID NO: 375078 - DNA, 25 bp, Homo sapien
gtggagttcaaatcagcctcagaaa

SEQ ID NO: 375079 - DNA, 25 bp, Homo sapien
taatcatgccattactgaggtcatc

SEQ ID NO: 375080 - DNA, 25 bp, Homo sapien
gaacagccgttttatttgccactga

SEQ ID NO: 375081 - DNA, 25 bp, Homo sapien
tttgccactgaagtgtttttctgct

SEQ ID NO: 375082 - DNA, 25 bp, Homo sapien
gtgtttttctgcttccttttcagta

SEQ ID NO: 375083 - DNA, 25 bp, Homo sapien
aattatatgtatgcacggatgtcac

SEQ ID NO: 375084 - DNA, 25 bp, Homo sapien
gtatgcacggatgtcactttttaag

SEQ ID NO: 375085 - DNA, 25 bp, Homo sapien
gtcactttttaaggccatattgcat

SEQ ID NO: 375086 - DNA, 25 bp, Homo sapien
ggccatattgcattgataacaagct

SEQ ID NO: 375087 - DNA, 25 bp, Homo sapien
aatttcacatgctaacgacaacttg

SEQ ID NO: 375088 - DNA, 25 bp, Homo sapien
acgacaacttgaatgaactgctggg

SEQ ID NO: 375089 - DNA, 25 bp, Homo sapien
gcagtggtatgtgcctttcaacttg

SEQ ID NO: 375090 - DNA, 25 bp, Homo sapien
tggtatgtgcctttcaacttgataa

SEQ ID NO: 375091 - DNA, 25 bp, Homo sapien
gggacattttcatattgggagatta

SEQ ID NO: 375092 - DNA, 25 bp, Homo sapien
gtatcttcatgttctatgactatag

SEQ ID NO: 375093 - DNA, 25 bp, Homo sapien
atgactatagaaccatttgccaaaa

SEQ ID NO: 375094 - DNA, 25 bp, Homo sapien
gcgtgccagatgctccaattcctga

SEQ ID NO: 375095 - DNA, 25 bp, Homo sapien
gatgctccaattcctgagcacctgt

SEQ ID NO: 375096 - DNA, 25 bp, Homo sapien
aatcctttcctagaacaaggcaggg

SEQ ID NO: 375097 - DNA, 25 bp, Homo sapien
acaaggcagggtatgaataagatca

SEQ ID NO: 375098 - DNA, 25 bp, Homo sapien
cagtttatttttaggtcattgaaca

SEQ ID NO: 375099 - DNA, 25 bp, Homo sapien
ttgaacaaatcaagccccatgctat

SEQ ID NO: 375100 - DNA, 25 bp, Homo sapien
ggcaggaagcctatggttgaatgtt

SEQ ID NO: 375101 - DNA, 25 bp, Homo sapien
gaagcctatggttgaatgtttgcca

SEQ ID NO: 375102 - DNA, 25 bp, Homo sapien
atgtttgccatgtgcaatttcccat

SEQ ID NO: 375103 - DNA, 25 bp, Homo sapien
gccatgtgcaatttcccataaaaca

SEQ ID NO: 375104 - DNA, 25 bp, Homo sapien
aaaacacaaagcagcagcgcaccgc

SEQ ID NO: 375105 - DNA, 25 bp, Homo sapien
gttctttcaagtgattcacatctca

SEQ ID NO: 375106 - DNA, 25 bp, Homo sapien
aacccataccactctcaacttttat

SEQ ID NO: 375107 - DNA, 25 bp, Homo sapien
ctcaacttttatttgatgtgttcaa

SEQ ID NO: 375108 - DNA, 25 bp, Homo sapien
tatgaagtacttgcgtacctcccat

SEQ ID NO: 375109 - DNA, 25 bp, Homo sapien
gcagggctgaacacttaatttgaca

SEQ ID NO: 375110 - DNA, 25 bp, Homo sapien
taatttgacatgaagctgaaggact

SEQ ID NO: 375111 - DNA, 25 bp, Homo sapien
atgaagctgaaggactgagcaagcc

SEQ ID NO: 375112 - DNA, 25 bp, Homo sapien
agtacttgcgtacctcccatttctg

SEQ ID NO: 375113 - DNA, 25 bp, Homo sapien
ggttgaatgaagcatagccttggct

SEQ ID NO: 375114 - DNA, 25 bp, Homo sapien
tagccttggcttcataccacacttt

SEQ ID NO: 375115 - DNA, 25 bp, Homo sapien
accacactttttgtgccttgtatta

SEQ ID NO: 375116 - DNA, 25 bp, Homo sapien
gggattcccactgatatttatcgaa

SEQ ID NO: 375117 - DNA, 25 bp, Homo sapien
atgtacccactcagtccgaataaaa

SEQ ID NO: 375118 - DNA, 25 bp, Homo sapien
gggaccttagagacaatctggccta

SEQ ID NO: 375119 - DNA, 25 bp, Homo sapien
gacaatctggcctaatactcttatt

SEQ ID NO: 375120 - DNA, 25 bp, Homo sapien
ggcctaatactcttattttgcccat

SEQ ID NO: 375121 - DNA, 25 bp, Homo sapien
atactcttattttgcccatgaggaa

SEQ ID NO: 375122 - DNA, 25 bp, Homo sapien
caagtaacttgcgaaaagtcacaca

SEQ ID NO: 375123 - DNA, 25 bp, Homo sapien
cacacagctaggtagtggcagatct

SEQ ID NO: 375124 - DNA, 25 bp, Homo sapien
gatctgcaactaaaattcaggcctt

SEQ ID NO: 375125 - DNA, 25 bp, Homo sapien
gaagcaagatcccaatatagtttac

SEQ ID NO: 375126 - DNA, 25 bp, Homo sapien
attttcatatgggattcccactgat

SEQ ID NO: 375127 - DNA, 25 bp, Homo sapien
gaaaaacctggcaaacaggagctat

SEQ ID NO: 375128 - DNA, 25 bp, Homo sapien
aaaagtacttcagagctcttctccc

SEQ ID NO: 375129 - DNA, 25 bp, Homo sapien
ttcctcctgactggatttcagggca

SEQ ID NO: 375130 - DNA, 25 bp, Homo sapien
aaaagttcagactgaggtacagtat

SEQ ID NO: 375131 - DNA, 25 bp, Homo sapien
ggtacagtatgattttggcccttaa

SEQ ID NO: 375132 - DNA, 25 bp, Homo sapien
cagtatgattttggcccttaagtag

SEQ ID NO: 375133 - DNA, 25 bp, Homo sapien
taaatatgcttatgcctcttctcct

SEQ ID NO: 375134 - DNA, 25 bp, Homo sapien
ttatgcctcttctcctaatctaaat

SEQ ID NO: 375135 - DNA, 25 bp, Homo sapien
ctcttctcctaatctaaatccttac

SEQ ID NO: 375136 - DNA, 25 bp, Homo sapien
aatctaaatccttacaatcctgccc

SEQ ID NO: 375137 - DNA, 25 bp, Homo sapien
tctctaacccattatttcttgcctt

SEQ ID NO: 375138 - DNA, 25 bp, Homo sapien
gaaaatacatatgtgctgagggata

SEQ ID NO: 375139 - DNA, 25 bp, Homo sapien
tatgtgctgagggatatgatttata

SEQ ID NO: 375140 - DNA, 25 bp, Homo sapien
gatttatatccctcagaaattgaca

SEQ ID NO: 375141 - DNA, 25 bp, Homo sapien
gaaattgacattgtaagttcttgga

SEQ ID NO: 375142 - DNA, 25 bp, Homo sapien
aagttcttggataagttcttgcacc

SEQ ID NO: 375143 - DNA, 25 bp, Homo sapien
ttcttggataagttcttgcaccaca

SEQ ID NO: 375144 - DNA, 25 bp, Homo sapien
tttttcatctgttactcaggtttag

SEQ ID NO: 375145 - DNA, 25 bp, Homo sapien
ctgttactcaggtttagaaatgtat

SEQ ID NO: 375146 - DNA, 25 bp, Homo sapien
atgtatgttttaagatctacttgcc

SEQ ID NO: 375147 - DNA, 25 bp, Homo sapien
acataccttaagtttactcagaatt

SEQ ID NO: 375148 - DNA, 25 bp, Homo sapien
attatcaattagcatatgggaatat

SEQ ID NO: 375149 - DNA, 25 bp, Homo sapien
gcgaccacagccaaagcgggcgatg

SEQ ID NO: 375150 - DNA, 25 bp, Homo sapien
aaagcgggcgatgggtcatcagtta

SEQ ID NO: 375151 - DNA, 25 bp, Homo sapien
cgatgggtcatcagttaaggaagtt

SEQ ID NO: 375152 - DNA, 25 bp, Homo sapien
gttgaaacctaccaccggacacgtg

SEQ ID NO: 375153 - DNA, 25 bp, Homo sapien
taccaccggacacgtgctttaagat

SEQ ID NO: 375154 - DNA, 25 bp, Homo sapien
gacacgtgctttaagatctttgaga

SEQ ID NO: 375155 - DNA, 25 bp, Homo sapien
gagaaaagatgcacagaattcttca

SEQ ID NO: 375156 - DNA, 25 bp, Homo sapien
gtggaaataacggagcaacttgcta

SEQ ID NO: 375157 - DNA, 25 bp, Homo sapien
gagcaacttgctaatggcaggcatt

SEQ ID NO: 375158 - DNA, 25 bp, Homo sapien
aatggcaggcattttacaaggcagt

SEQ ID NO: 375159 - DNA, 25 bp, Homo sapien
ggcattttacaaggcagttggccag

SEQ ID NO: 375160 - DNA, 25 bp, Homo sapien
gtcccaccctgaacagagctggacc

SEQ ID NO: 375161 - DNA, 25 bp, Homo sapien
tcccaccctgaacagagctggaccc

SEQ ID NO: 375162 - DNA, 25 bp, Homo sapien
ccagagccacacacgcccgggaaca

SEQ ID NO: 375163 - DNA, 25 bp, Homo sapien
cagagccacacacgcccgggaacac

SEQ ID NO: 375164 - DNA, 25 bp, Homo sapien
gagccacacacgcccgggaacacac

SEQ ID NO: 375165 - DNA, 25 bp, Homo sapien
agccacacacgcccgggaacacaca

SEQ ID NO: 375166 - DNA, 25 bp, Homo sapien
acacacgcccgggaacacacactgt

SEQ ID NO: 375167 - DNA, 25 bp, Homo sapien
cacacgcccgggaacacacactgtg

SEQ ID NO: 375168 - DNA, 25 bp, Homo sapien
acacgcccgggaacacacactgtgc

SEQ ID NO: 375169 - DNA, 25 bp, Homo sapien
acgcccgggaacacacactgtgctg

SEQ ID NO: 375170 - DNA, 25 bp, Homo sapien
cgcccgggaacacacactgtgctgg

SEQ ID NO: 375171 - DNA, 25 bp, Homo sapien
gactctggcacaggggccttggttt

SEQ ID NO: 375172 - DNA, 25 bp, Homo sapien
tttacctgccataggtcccttttca

SEQ ID NO: 375173 - DNA, 25 bp, Homo sapien
tgctgatgagacacaactctggccc

SEQ ID NO: 375174 - DNA, 25 bp, Homo sapien
aggtctgcccaaggggactctcaat

SEQ ID NO: 375175 - DNA, 25 bp, Homo sapien
gggactctcaataaactctagctga

SEQ ID NO: 375176 - DNA, 25 bp, Homo sapien
ggactctcaataaactctagctgaa

SEQ ID NO: 375177 - DNA, 25 bp, Homo sapien
gactctcaataaactctagctgaag

SEQ ID NO: 375178 - DNA, 25 bp, Homo sapien
ctctcaataaactctagctgaaggc

SEQ ID NO: 375179 - DNA, 25 bp, Homo sapien
ctcaataaactctagctgaaggcaa

SEQ ID NO: 375180 - DNA, 25 bp, Homo sapien
caataaactctagctgaaggcaaaa

SEQ ID NO: 375181 - DNA, 25 bp, Homo sapien
ataaactctagctgaaggcaaaaaa

SEQ ID NO: 375182 - DNA, 25 bp, Homo sapien
tataagcgtatctttaagtacctgg

SEQ ID NO: 375183 - DNA, 25 bp, Homo sapien
aggaattgatccacacttttgagta

SEQ ID NO: 375184 - DNA, 25 bp, Homo sapien
acacttttgagtaacctggctgcca

SEQ ID NO: 375185 - DNA, 25 bp, Homo sapien
gagtaacctggctgccacttaaaaa

SEQ ID NO: 375186 - DNA, 25 bp, Homo sapien
gttttcctcctgatctttaaatgtg

SEQ ID NO: 375187 - DNA, 25 bp, Homo sapien
gattgctaggatatcagacacctgt

SEQ ID NO: 375188 - DNA, 25 bp, Homo sapien
cagacacctgtttggaaatatcttt

SEQ ID NO: 375189 - DNA, 25 bp, Homo sapien
gcgtgacagaaaactccaggtgata

SEQ ID NO: 375190 - DNA, 25 bp, Homo sapien
agtcattaagtttacagcttcggaa

SEQ ID NO: 375191 - DNA, 25 bp, Homo sapien
taaactagacgaccttgaagacctt

SEQ ID NO: 375192 - DNA, 25 bp, Homo sapien
gaagacctttcccaatcatataagc

SEQ ID NO: 375193 - DNA, 25 bp, Homo sapien
gataaaatgatgtgatcaggctggg

SEQ ID NO: 375194 - DNA, 25 bp, Homo sapien
ataaaatgatgtgatcaggctgggt

SEQ ID NO: 375195 - DNA, 25 bp, Homo sapien
taaaatgatgtgatcaggctgggtg

SEQ ID NO: 375196 - DNA, 25 bp, Homo sapien
aaaatgatgtgatcaggctgggtgc

SEQ ID NO: 375197 - DNA, 25 bp, Homo sapien
aaatgatgtgatcaggctgggtgcg

SEQ ID NO: 375198 - DNA, 25 bp, Homo sapien
aatgatgtgatcaggctgggtgcgt

SEQ ID NO: 375199 - DNA, 25 bp, Homo sapien
atgatgtgatcaggctgggtgcgtt

SEQ ID NO: 375200 - DNA, 25 bp, Homo sapien
tgatgtgatcaggctgggtgcgttg

SEQ ID NO: 375201 - DNA, 25 bp, Homo sapien
gaagccctgtttctactaggaatac

SEQ ID NO: 375202 - DNA, 25 bp, Homo sapien
aagccctgtttctactaggaataca

SEQ ID NO: 375203 - DNA, 25 bp, Homo sapien
agccctgtttctactaggaatacaa

SEQ ID NO: 375204 - DNA, 25 bp, Homo sapien
tcaccttctcagtgggtcgcttttt

SEQ ID NO: 375205 - DNA, 25 bp, Homo sapien
tcagtgggtcgctttttccgctgga

SEQ ID NO: 375206 - DNA, 25 bp, Homo sapien
tttccgctggatggtggacacccga

SEQ ID NO: 375207 - DNA, 25 bp, Homo sapien
ggatggtggacacccgaatctccgt

SEQ ID NO: 375208 - DNA, 25 bp, Homo sapien
tggacacccgaatctccgtgcgcat

SEQ ID NO: 375209 - DNA, 25 bp, Homo sapien
gaatctccgtgcgcatccacgagta

SEQ ID NO: 375210 - DNA, 25 bp, Homo sapien
agatccgggccagggtgatggccag

SEQ ID NO: 375211 - DNA, 25 bp, Homo sapien
ggaggtgtctgctgaggccctggag

SEQ ID NO: 375212 - DNA, 25 bp, Homo sapien
gagatggtcatcaacaacgacgccg

SEQ ID NO: 375213 - DNA, 25 bp, Homo sapien
tggtcatcaacaacgacgccgagct

SEQ ID NO: 375214 - DNA, 25 bp, Homo sapien
catcaacaacgacgccgagctctgg

SEQ ID NO: 375215 - DNA, 25 bp, Homo sapien
tttggccttagaaatccgtaaaatg

SEQ ID NO: 375216 - DNA, 25 bp, Homo sapien
gataattaagactagactacactga

SEQ ID NO: 375217 - DNA, 25 bp, Homo sapien
acactgaatatgttgatagaccaat

SEQ ID NO: 375218 - DNA, 25 bp, Homo sapien
ctaggctgtctgtcttatgtctgag

SEQ ID NO: 375219 - DNA, 25 bp, Homo sapien
gtcttatgtctgagaatgactggca

SEQ ID NO: 375220 - DNA, 25 bp, Homo sapien
atgactggcaggtgatgcttgtgtt

SEQ ID NO: 375221 - DNA, 25 bp, Homo sapien
tgatgcttgtgttccagccagaatg

SEQ ID NO: 375222 - DNA, 25 bp, Homo sapien
ttgtgttccagccagaatgagcctt

SEQ ID NO: 375223 - DNA, 25 bp, Homo sapien
gcatttctaagcttatattacctga

SEQ ID NO: 375224 - DNA, 25 bp, Homo sapien
ctaagcttatattacctgatggtgg

SEQ ID NO: 375225 - DNA, 25 bp, Homo sapien
gaacagtcattcttgcattaaagat

SEQ ID NO: 375226 - DNA, 25 bp, Homo sapien
ttgaaagctcattaaatctacctgt

SEQ ID NO: 375227 - DNA, 25 bp, Homo sapien
agctcattaaatctacctgtaccct

SEQ ID NO: 375228 - DNA, 25 bp, Homo sapien
tcattaaatctacctgtaccctaaa

SEQ ID NO: 375229 - DNA, 25 bp, Homo sapien
aagcaaaccatacctactacaaaag

SEQ ID NO: 375230 - DNA, 25 bp, Homo sapien
atacctactacaaaagctagccagg

SEQ ID NO: 375231 - DNA, 25 bp, Homo sapien
caggtagatattttctggtctcatt

SEQ ID NO: 375232 - DNA, 25 bp, Homo sapien
gatattttctggtctcattaatgtc

SEQ ID NO: 375233 - DNA, 25 bp, Homo sapien
ggtctcattaatgtcttttgcaata

SEQ ID NO: 375234 - DNA, 25 bp, Homo sapien
gtcttttgcaataagagcttttgtt

SEQ ID NO: 375235 - DNA, 25 bp, Homo sapien
tgttatgtctaaaagcttacacaca

SEQ ID NO: 375236 - DNA, 25 bp, Homo sapien
aaaaaccaacctcaggccagacatg

SEQ ID NO: 375237 - DNA, 25 bp, Homo sapien
gaagcaaaggctaagaagcatctgt

SEQ ID NO: 375238 - DNA, 25 bp, Homo sapien
ggctaagaagcatctgtacaggcat

SEQ ID NO: 375239 - DNA, 25 bp, Homo sapien
agaagcatctgtacaggcataaaga

SEQ ID NO: 375240 - DNA, 25 bp, Homo sapien
atctgtacaggcataaagaggaaac

SEQ ID NO: 375241 - DNA, 25 bp, Homo sapien
gggaagcccctaggctggacagatc

SEQ ID NO: 375242 - DNA, 25 bp, Homo sapien
taggctggacagatcacctagccca

SEQ ID NO: 375243 - DNA, 25 bp, Homo sapien
tggacagatcacctagcccagggtg

SEQ ID NO: 375244 - DNA, 25 bp, Homo sapien
gacagatcacctagcccagggtgtg

SEQ ID NO: 375245 - DNA, 25 bp, Homo sapien
ccgagccctagcaaggagtcactga

SEQ ID NO: 375246 - DNA, 25 bp, Homo sapien
cgagccctagcaaggagtcactgac

SEQ ID NO: 375247 - DNA, 25 bp, Homo sapien
caaggagtcactgacacatttcctg

SEQ ID NO: 375248 - DNA, 25 bp, Homo sapien
atttgtccttggtgcactcacaaca

SEQ ID NO: 375249 - DNA, 25 bp, Homo sapien
ggtgcactcacaacactttttaggg

SEQ ID NO: 375250 - DNA, 25 bp, Homo sapien
cacataggtggctgacagggattct

SEQ ID NO: 375251 - DNA, 25 bp, Homo sapien
ctgacagggattctagtcctctttt

SEQ ID NO: 375252 - DNA, 25 bp, Homo sapien
gggccctcggaacacacaagataca

SEQ ID NO: 375253 - DNA, 25 bp, Homo sapien
ttcctttgtcctctctagtttacaa

SEQ ID NO: 375254 - DNA, 25 bp, Homo sapien
gtttacaatctaaataggtgcttcc

SEQ ID NO: 375255 - DNA, 25 bp, Homo sapien
taggtgcttccaaccttgatttttt

SEQ ID NO: 375256 - DNA, 25 bp, Homo sapien
acacaagatacaggccggttcacca

SEQ ID NO: 375257 - DNA, 25 bp, Homo sapien
gccggttcaccaaggtaggagaaag

SEQ ID NO: 375258 - DNA, 25 bp, Homo sapien
aacgaagagcatgccatttgtcctt

SEQ ID NO: 375259 - DNA, 25 bp, Homo sapien
tgtggtgttgacgtttgcggtccca

SEQ ID NO: 375260 - DNA, 25 bp, Homo sapien
gtgttgacgtttgcggtcccagcta

SEQ ID NO: 375261 - DNA, 25 bp, Homo sapien
gcctctgccccaaactcgttaaaag

SEQ ID NO: 375262 - DNA, 25 bp, Homo sapien
tctgccccaaactcgttaaaagatt

SEQ ID NO: 375263 - DNA, 25 bp, Homo sapien
aaccacaactgctgtttctgtgtag

SEQ ID NO: 375264 - DNA, 25 bp, Homo sapien
acaactgctgtttctgtgtagatgc

SEQ ID NO: 375265 - DNA, 25 bp, Homo sapien
gctgtttctgtgtagatgcatctgc

SEQ ID NO: 375266 - DNA, 25 bp, Homo sapien
gtttctgtgtagatgcatctgcatg

SEQ ID NO: 375267 - DNA, 25 bp, Homo sapien
gtagatgcatctgcatgcccaggag

SEQ ID NO: 375268 - DNA, 25 bp, Homo sapien
gcatgcccaggagcagtaaatgcaa

SEQ ID NO: 375269 - DNA, 25 bp, Homo sapien
gcccaggagcagtaaatgcaataaa

SEQ ID NO: 375270 - DNA, 25 bp, Homo sapien
agcaggagctgtcaggctggcggtt

SEQ ID NO: 375271 - DNA, 25 bp, Homo sapien
gagctgtcaggctggcggttccgcg

SEQ ID NO: 375272 - DNA, 25 bp, Homo sapien
aggctggcggttccgcgccgcggct

SEQ ID NO: 375273 - DNA, 25 bp, Homo sapien
tgcgcccgcaactctgggctgagaa

SEQ ID NO: 375274 - DNA, 25 bp, Homo sapien
gcaactctgggctgagaacttctcc

SEQ ID NO: 375275 - DNA, 25 bp, Homo sapien
aactctgggctgagaacttctcccg

SEQ ID NO: 375276 - DNA, 25 bp, Homo sapien
tctgggctgagaacttctcccgccg

SEQ ID NO: 375277 - DNA, 25 bp, Homo sapien
tgggctgagaacttctcccgccggc

SEQ ID NO: 375278 - DNA, 25 bp, Homo sapien
gccgcgcttctctccgttacaaagg

SEQ ID NO: 375279 - DNA, 25 bp, Homo sapien
ccgaggtcgtgctaggatcccgcgc

SEQ ID NO: 375280 - DNA, 25 bp, Homo sapien
gtcgtgctaggatcccgcgcccagg

SEQ ID NO: 375281 - DNA, 25 bp, Homo sapien
tctcaggagaggtcggccaaccctc

SEQ ID NO: 375282 - DNA, 25 bp, Homo sapien
aggagatctttgtctcccttttggc

SEQ ID NO: 375283 - DNA, 25 bp, Homo sapien
tttgtctcccttttggccactgata

SEQ ID NO: 375284 - DNA, 25 bp, Homo sapien
tcccttttggccactgatacctttg

SEQ ID NO: 375285 - DNA, 25 bp, Homo sapien
cactgatacctttggccttatctga

SEQ ID NO: 375286 - DNA, 25 bp, Homo sapien
atacctttggccttatctgacaaca

SEQ ID NO: 375287 - DNA, 25 bp, Homo sapien
ttggccttatctgacaacagctacc

SEQ ID NO: 375288 - DNA, 25 bp, Homo sapien
ttatctgacaacagctacccctcga

SEQ ID NO: 375289 - DNA, 25 bp, Homo sapien
ttgctctggaggttgagacccccat

SEQ ID NO: 375290 - DNA, 25 bp, Homo sapien
catctgagcaacatcctctctcttt

SEQ ID NO: 375291 - DNA, 25 bp, Homo sapien
tctgatcccttggcatcgtcacaaa

SEQ ID NO: 375292 - DNA, 25 bp, Homo sapien
gaaattgacttttgtttggagtttg

SEQ ID NO: 375293 - DNA, 25 bp, Homo sapien
aattgacttttgtttggagtttgtg

SEQ ID NO: 375294 - DNA, 25 bp, Homo sapien
attgacttttgtttggagtttgtga

SEQ ID NO: 375295 - DNA, 25 bp, Homo sapien
gagggcctttctgcctccagttcct

SEQ ID NO: 375296 - DNA, 25 bp, Homo sapien
gcctttctgcctccagttccttgag

SEQ ID NO: 375297 - DNA, 25 bp, Homo sapien
ccatgcggcaagagcgagtcgcagg

SEQ ID NO: 375298 - DNA, 25 bp, Homo sapien
catgcggcaagagcgagtcgcagga

SEQ ID NO: 375299 - DNA, 25 bp, Homo sapien
cggcaagagcgagtcgcaggaacaa

SEQ ID NO: 375300 - DNA, 25 bp, Homo sapien
gcaagagcgagtcgcaggaacaagt

SEQ ID NO: 375301 - DNA, 25 bp, Homo sapien
agagcgagtcgcaggaacaagtggg

SEQ ID NO: 375302 - DNA, 25 bp, Homo sapien
acaagtggggaatcttggccgcggc

SEQ ID NO: 375303 - DNA, 25 bp, Homo sapien
aggcctctcctgctagaattgggca

SEQ ID NO: 375304 - DNA, 25 bp, Homo sapien
tcctgctagaattgggcatggccga

SEQ ID NO: 375305 - DNA, 25 bp, Homo sapien
gtaagagccacctcctaggccgcag

SEQ ID NO: 375306 - DNA, 25 bp, Homo sapien
ctcctaggccgcagtggcccaaggt

SEQ ID NO: 375307 - DNA, 25 bp, Homo sapien
gggatctgtagggttcccgcactgc

SEQ ID NO: 375308 - DNA, 25 bp, Homo sapien
tagggttcccgcactgcgatagggc

SEQ ID NO: 375309 - DNA, 25 bp, Homo sapien
accaacatttccagctctcaggtgt

SEQ ID NO: 375310 - DNA, 25 bp, Homo sapien
catttccagctctcaggtgtacaga

SEQ ID NO: 375311 - DNA, 25 bp, Homo sapien
tccagctctcaggtgtacagaaatg

SEQ ID NO: 375312 - DNA, 25 bp, Homo sapien
ctcaggtgtacagaaatgcggttta

SEQ ID NO: 375313 - DNA, 25 bp, Homo sapien
acagaaatgcggtttactttgtagg

SEQ ID NO: 375314 - DNA, 25 bp, Homo sapien
aggagggagtgcgtctgttcacttt

SEQ ID NO: 375315 - DNA, 25 bp, Homo sapien
gagggagtgcgtctgttcactttaa

SEQ ID NO: 375316 - DNA, 25 bp, Homo sapien
gagtgcgtctgttcactttaagtta

SEQ ID NO: 375317 - DNA, 25 bp, Homo sapien
gcgtctgttcactttaagttacttt

SEQ ID NO: 375318 - DNA, 25 bp, Homo sapien
actctgaacatgattatattatgcc

SEQ ID NO: 375319 - DNA, 25 bp, Homo sapien
gattacaaagaataagcagcaatat

SEQ ID NO: 375320 - DNA, 25 bp, Homo sapien
gcagcaatattgaagcatctacagt

SEQ ID NO: 375321 - DNA, 25 bp, Homo sapien
gaagcatctacagtatgttaactac

SEQ ID NO: 375322 - DNA, 25 bp, Homo sapien
gaaaactgctcataaagactaaaag

SEQ ID NO: 375323 - DNA, 25 bp, Homo sapien
cataaagactaaaagttgacctgtt

SEQ ID NO: 375324 - DNA, 25 bp, Homo sapien
tgacctgttaaaacgttaatgtact

SEQ ID NO: 375325 - DNA, 25 bp, Homo sapien
catataatctttggatggatgggct

SEQ ID NO: 375326 - DNA, 25 bp, Homo sapien
gatggatgggctgttaatttgtaaa

SEQ ID NO: 375327 - DNA, 25 bp, Homo sapien
actatttggagggtcattttgatgc

SEQ ID NO: 375328 - DNA, 25 bp, Homo sapien
tatttggagggtcattttgatgctt

SEQ ID NO: 375329 - DNA, 25 bp, Homo sapien
caatgggttagaataatagatcttc

SEQ ID NO: 375330 - DNA, 25 bp, Homo sapien
atagatcttcaagtcttttcttaaa

SEQ ID NO: 375331 - DNA, 25 bp, Homo sapien
atcttcaagtcttttcttaaatggg

SEQ ID NO: 375332 - DNA, 25 bp, Homo sapien
tttcagtgagaaatttccaaaccgt

SEQ ID NO: 375333 - DNA, 25 bp, Homo sapien
gtgagaaatttccaaaccgtgctta

SEQ ID NO: 375334 - DNA, 25 bp, Homo sapien
gagaaatttccaaaccgtgcttatt

SEQ ID NO: 375335 - DNA, 25 bp, Homo sapien
gaaatttccaaaccgtgcttattag

SEQ ID NO: 375336 - DNA, 25 bp, Homo sapien
ctgcactagggcaaaggccagtagg

SEQ ID NO: 375337 - DNA, 25 bp, Homo sapien
gggcaaaggccagtaggaatagatt

SEQ ID NO: 375338 - DNA, 25 bp, Homo sapien
gaggtgttaaggtgtgaactgttaa

SEQ ID NO: 375339 - DNA, 25 bp, Homo sapien
agaatgagtacccatgaatagccat

SEQ ID NO: 375340 - DNA, 25 bp, Homo sapien
tgaatagccatgattcctaccctgt

SEQ ID NO: 375341 - DNA, 25 bp, Homo sapien
atgattcctaccctgtcccagtcat

SEQ ID NO: 375342 - DNA, 25 bp, Homo sapien
ctgtcccagtcatctctttccttat

SEQ ID NO: 375343 - DNA, 25 bp, Homo sapien
tctctttccttatccatctctgaaa

SEQ ID NO: 375344 - DNA, 25 bp, Homo sapien
atgcatgagtgaatccatttgtgag

SEQ ID NO: 375345 - DNA, 25 bp, Homo sapien
gagagcgaatggagatgacaagatt

SEQ ID NO: 375346 - DNA, 25 bp, Homo sapien
gacaagattagctaggagactggaa

SEQ ID NO: 375347 - DNA, 25 bp, Homo sapien
agatcacacacaaggctgtcacttc

SEQ ID NO: 375348 - DNA, 25 bp, Homo sapien
gtcacttcatacttgcaggattgca

SEQ ID NO: 375349 - DNA, 25 bp, Homo sapien
caggattgcacagcagccgggcaga

SEQ ID NO: 375350 - DNA, 25 bp, Homo sapien
ggcgggcagcagagacgcacctcac

SEQ ID NO: 375351 - DNA, 25 bp, Homo sapien
gggcagcagagacgcacctcacttc

SEQ ID NO: 375352 - DNA, 25 bp, Homo sapien
agacgcacctcacttcctagacagt

SEQ ID NO: 375353 - DNA, 25 bp, Homo sapien
acctcacttcctagacagtgcggca

SEQ ID NO: 375354 - DNA, 25 bp, Homo sapien
acttcctagacagtgcggcagccag

SEQ ID NO: 375355 - DNA, 25 bp, Homo sapien
cttcctagacagtgcggcagccagg

SEQ ID NO: 375356 - DNA, 25 bp, Homo sapien
acttcccagacagttgggcggccag

SEQ ID NO: 375357 - DNA, 25 bp, Homo sapien
agttgggcggccaggcaagcgctcc

SEQ ID NO: 375358 - DNA, 25 bp, Homo sapien
tccctgcacgggaaaaacattggca

SEQ ID NO: 375359 - DNA, 25 bp, Homo sapien
aacattggcaatagcctccttacca

SEQ ID NO: 375360 - DNA, 25 bp, Homo sapien
tggcaatagcctccttaccaaccaa

SEQ ID NO: 375361 - DNA, 25 bp, Homo sapien
tgctccttctgacttactaggatgg

SEQ ID NO: 375362 - DNA, 25 bp, Homo sapien
gacttactaggatggcctcagagaa

SEQ ID NO: 375363 - DNA, 25 bp, Homo sapien
agagaaggcacagtgttaacccagc

SEQ ID NO: 375364 - DNA, 25 bp, Homo sapien
ttaacccagccttatcacagttgtg

SEQ ID NO: 375365 - DNA, 25 bp, Homo sapien
tatcacagttgtggaagcgccaggg

SEQ ID NO: 375366 - DNA, 25 bp, Homo sapien
gtctccattggtgggttaagcacga

SEQ ID NO: 375367 - DNA, 25 bp, Homo sapien
ggagcaatgccttacatctagtaga

SEQ ID NO: 375368 - DNA, 25 bp, Homo sapien
ttaagcacgacacccaattgatcca

SEQ ID NO: 375369 - DNA, 25 bp, Homo sapien
gaaagatcttgttattgattaacca

SEQ ID NO: 375370 - DNA, 25 bp, Homo sapien
gattaaccattttcttatgccttgc

SEQ ID NO: 375371 - DNA, 25 bp, Homo sapien
tatgccttgctattgacatattcat

SEQ ID NO: 375372 - DNA, 25 bp, Homo sapien
acatattcatgctctttctacgtct

SEQ ID NO: 375373 - DNA, 25 bp, Homo sapien
gctctttctacgtctagtggctgaa

SEQ ID NO: 375374 - DNA, 25 bp, Homo sapien
acgtctagtggctgaaaatgtttgc

SEQ ID NO: 375375 - DNA, 25 bp, Homo sapien
tgtttgcatttgttcatttgactaa

SEQ ID NO: 375376 - DNA, 25 bp, Homo sapien
atttgactaatggtgtgatttttgt

SEQ ID NO: 375377 - DNA, 25 bp, Homo sapien
ggactggatgtatgtctctagcaat

SEQ ID NO: 375378 - DNA, 25 bp, Homo sapien
gtatgtctctagcaatacgaggtac

SEQ ID NO: 375379 - DNA, 25 bp, Homo sapien
gcaatacgaggtactttctaaacta

SEQ ID NO: 375380 - DNA, 25 bp, Homo sapien
ctggaaggaggtagggacgatagca

SEQ ID NO: 375381 - DNA, 25 bp, Homo sapien
aaggaggtagggacgatagcagggc

SEQ ID NO: 375382 - DNA, 25 bp, Homo sapien
ggaggtagggacgatagcagggcgc

SEQ ID NO: 375383 - DNA, 25 bp, Homo sapien
taccagctcgggctagcgcttccgg

SEQ ID NO: 375384 - DNA, 25 bp, Homo sapien
ctcgggctagcgcttccggctcgat

SEQ ID NO: 375385 - DNA, 25 bp, Homo sapien
tcgggctagcgcttccggctcgatc

SEQ ID NO: 375386 - DNA, 25 bp, Homo sapien
cgggctagcgcttccggctcgatcg

SEQ ID NO: 375387 - DNA, 25 bp, Homo sapien
gggctagcgcttccggctcgatcgg

SEQ ID NO: 375388 - DNA, 25 bp, Homo sapien
gctagcgcttccggctcgatcggtc

SEQ ID NO: 375389 - DNA, 25 bp, Homo sapien
tctctctttttctctgcttctcacg

SEQ ID NO: 375390 - DNA, 25 bp, Homo sapien
ctctctttttctctgcttctcacgg

SEQ ID NO: 375391 - DNA, 25 bp, Homo sapien
taggtggcagagctacgttcaaact

SEQ ID NO: 375392 - DNA, 25 bp, Homo sapien
ggcagagctacgttcaaactcagct

SEQ ID NO: 375393 - DNA, 25 bp, Homo sapien
ccaacccatagcacactgtggctgt

SEQ ID NO: 375394 - DNA, 25 bp, Homo sapien
tgtggctgtgctgcacgcaccgttc

SEQ ID NO: 375395 - DNA, 25 bp, Homo sapien
gtgctgcacgcaccgttcaagaggc

SEQ ID NO: 375396 - DNA, 25 bp, Homo sapien
agaggcgccctcgtcagtgggatct

SEQ ID NO: 375397 - DNA, 25 bp, Homo sapien
gccctcgtcagtgggatctctggct

SEQ ID NO: 375398 - DNA, 25 bp, Homo sapien
tgcatgttcgtccacgccagcggtt

SEQ ID NO: 375399 - DNA, 25 bp, Homo sapien
tggtggtcaccacactcaacagggt

SEQ ID NO: 375400 - DNA, 25 bp, Homo sapien
acactcaacagggtgccttaagcat

SEQ ID NO: 375401 - DNA, 25 bp, Homo sapien
aacagggtgccttaagcatggcccg

SEQ ID NO: 375402 - DNA, 25 bp, Homo sapien
tgttacttgaacaatctcagtctct

SEQ ID NO: 375403 - DNA, 25 bp, Homo sapien
atctcagtctctaactggtgggtgg

SEQ ID NO: 375404 - DNA, 25 bp, Homo sapien
aagaggtgtgggtccaggttaggca

SEQ ID NO: 375405 - DNA, 25 bp, Homo sapien
caagaattcaagtagccccatctct

SEQ ID NO: 375406 - DNA, 25 bp, Homo sapien
tcgggcaagcccaaagctcaggtcc

SEQ ID NO: 375407 - DNA, 25 bp, Homo sapien
aagcccaaagctcaggtcccatacg

SEQ ID NO: 375408 - DNA, 25 bp, Homo sapien
aggtcccatacgctacccttagatc

SEQ ID NO: 375409 - DNA, 25 bp, Homo sapien
tatccccagggctagggtgaaccat

SEQ ID NO: 375410 - DNA, 25 bp, Homo sapien
gctagggtgaaccatgccaaaggaa

SEQ ID NO: 375411 - DNA, 25 bp, Homo sapien
ctgtctcctagtctgcctatgtctt

SEQ ID NO: 375412 - DNA, 25 bp, Homo sapien
tgcctatgtctttctctgctatatg

SEQ ID NO: 375413 - DNA, 25 bp, Homo sapien
aatcgttagcgggtcatgtcggccg

SEQ ID NO: 375414 - DNA, 25 bp, Homo sapien
atcgttagcgggtcatgtcggccgc

SEQ ID NO: 375415 - DNA, 25 bp, Homo sapien
gcgctgacgggaccgggctgcggca

SEQ ID NO: 375416 - DNA, 25 bp, Homo sapien
acgggaccgggctgcggcaatcgtt

SEQ ID NO: 375417 - DNA, 25 bp, Homo sapien
cgggaccgggctgcggcaatcgtta

SEQ ID NO: 375418 - DNA, 25 bp, Homo sapien
gctgcggcaatcgttagcgggtcat

SEQ ID NO: 375419 - DNA, 25 bp, Homo sapien
ctgcggcaatcgttagcgggtcatg

SEQ ID NO: 375420 - DNA, 25 bp, Homo sapien
tgcggcaatcgttagcgggtcatgt

SEQ ID NO: 375421 - DNA, 25 bp, Homo sapien
gcggcaatcgttagcgggtcatgtc

SEQ ID NO: 375422 - DNA, 25 bp, Homo sapien
cggcaatcgttagcgggtcatgtcg

SEQ ID NO: 375423 - DNA, 25 bp, Homo sapien
gcaatcgttagcgggtcatgtcggc

SEQ ID NO: 375424 - DNA, 25 bp, Homo sapien
atggatgtcgggaagcaggccatgc

SEQ ID NO: 375425 - DNA, 25 bp, Homo sapien
gaagcaggccatgcagtaccaggtc

SEQ ID NO: 375426 - DNA, 25 bp, Homo sapien
aggccatgcagtaccaggtcctgaa

SEQ ID NO: 375427 - DNA, 25 bp, Homo sapien
gccatgcagtaccaggtcctgaatg

SEQ ID NO: 375428 - DNA, 25 bp, Homo sapien
tcctcctacctgtccaatgtggatg

SEQ ID NO: 375429 - DNA, 25 bp, Homo sapien
aatgtggatgtctacctggacggac

SEQ ID NO: 375430 - DNA, 25 bp, Homo sapien
gtggatgtctacctggacggacacc

SEQ ID NO: 375431 - DNA, 25 bp, Homo sapien
atgtctacctggacggacacctcat

SEQ ID NO: 375432 - DNA, 25 bp, Homo sapien
tggacggacacctcatcaccacggt

SEQ ID NO: 375433 - DNA, 25 bp, Homo sapien
ggacacctcatcaccacggtgcagg

SEQ ID NO: 375434 - DNA, 25 bp, Homo sapien
acctcatcaccacggtgcagggcga

SEQ ID NO: 375435 - DNA, 25 bp, Homo sapien
gtacccaatagttgctttttctcct

SEQ ID NO: 375436 - DNA, 25 bp, Homo sapien
tacccaatagttgctttttctcctc

SEQ ID NO: 375437 - DNA, 25 bp, Homo sapien
gccccagtgtatgttgttctcttca

SEQ ID NO: 375438 - DNA, 25 bp, Homo sapien
ccagtgtatgttgttctcttcatta

SEQ ID NO: 375439 - DNA, 25 bp, Homo sapien
tatgttgttctcttcattatgttca

SEQ ID NO: 375440 - DNA, 25 bp, Homo sapien
ggaaagcatttccactgttagatga

SEQ ID NO: 375441 - DNA, 25 bp, Homo sapien
agcatttccactgttagatgatttt

SEQ ID NO: 375442 - DNA, 25 bp, Homo sapien
aaagttatacaacagtgtgacctat

SEQ ID NO: 375443 - DNA, 25 bp, Homo sapien
atacaacagtgtgacctatttgcac

SEQ ID NO: 375444 - DNA, 25 bp, Homo sapien
tgacctatttgcacacaagcatgga

SEQ ID NO: 375445 - DNA, 25 bp, Homo sapien
tatttgcacacaagcatggacacag

SEQ ID NO: 375446 - DNA, 25 bp, Homo sapien
gctatttgcctctagaagcaattgt

SEQ ID NO: 375447 - DNA, 25 bp, Homo sapien
gaagcaattgttcataatggaggca

SEQ ID NO: 375448 - DNA, 25 bp, Homo sapien
aatggaggcatattttcctttgtag

SEQ ID NO: 375449 - DNA, 25 bp, Homo sapien
ggaggcatattttcctttgtagaaa

SEQ ID NO: 375450 - DNA, 25 bp, Homo sapien
tttcccagtgagttaataagttggc

SEQ ID NO: 375451 - DNA, 25 bp, Homo sapien
ttctctcgggtcaaagactgagttt

SEQ ID NO: 375452 - DNA, 25 bp, Homo sapien
ctgagttttttgttcttagtgctaa

SEQ ID NO: 375453 - DNA, 25 bp, Homo sapien
gctaatagaaccaaatcacctgcat

SEQ ID NO: 375454 - DNA, 25 bp, Homo sapien
aatcacctgcatttgagtatttaac

SEQ ID NO: 375455 - DNA, 25 bp, Homo sapien
aagcttcttgaagcatgcagtcaaa

SEQ ID NO: 375456 - DNA, 25 bp, Homo sapien
cagtcaaaataaaacgcatgggcgt

SEQ ID NO: 375457 - DNA, 25 bp, Homo sapien
tccttcagtctgctaggtcaaagta

SEQ ID NO: 375458 - DNA, 25 bp, Homo sapien
tcttatctttatgttgaccagtttg

SEQ ID NO: 375459 - DNA, 25 bp, Homo sapien
gcattgatttggagctaagggctat

SEQ ID NO: 375460 - DNA, 25 bp, Homo sapien
tatgttgaccagtttgttccacttt

SEQ ID NO: 375461 - DNA, 25 bp, Homo sapien
agctaagggctatattctggtaaca

SEQ ID NO: 375462 - DNA, 25 bp, Homo sapien
acataacaaggtgctatctagtgaa

SEQ ID NO: 375463 - DNA, 25 bp, Homo sapien
gaatgtgtgattgtgtagtcatgga

SEQ ID NO: 375464 - DNA, 25 bp, Homo sapien
gaagtaacttcattgaactttctgc

SEQ ID NO: 375465 - DNA, 25 bp, Homo sapien
gaactttctgctaacgtatcctttc

SEQ ID NO: 375466 - DNA, 25 bp, Homo sapien
tctgctaacgtatcctttccatatt

SEQ ID NO: 375467 - DNA, 25 bp, Homo sapien
taacgtatcctttccatattcccct

SEQ ID NO: 375468 - DNA, 25 bp, Homo sapien
tgccggtactgcgtcaagagcttca

SEQ ID NO: 375469 - DNA, 25 bp, Homo sapien
ggtactgcgtcaagagcttcacgca

SEQ ID NO: 375470 - DNA, 25 bp, Homo sapien
gccacgagcgcctgcacatgaagcg

SEQ ID NO: 375471 - DNA, 25 bp, Homo sapien
acatgaagcgccgttccaagcaggc

SEQ ID NO: 375472 - DNA, 25 bp, Homo sapien
agcgccgttccaagcaggctctgaa

SEQ ID NO: 375473 - DNA, 25 bp, Homo sapien
gttccaagcaggctctgaactccta

SEQ ID NO: 375474 - DNA, 25 bp, Homo sapien
aggacataccttccccaggatagag

SEQ ID NO: 375475 - DNA, 25 bp, Homo sapien
aggatagagagcacacctccctcct

SEQ ID NO: 375476 - DNA, 25 bp, Homo sapien
ggtagtgagcgttcgggtggtgcca

SEQ ID NO: 375477 - DNA, 25 bp, Homo sapien
gtggtgccatgggagcactctccct

SEQ ID NO: 375478 - DNA, 25 bp, Homo sapien
ccccaggtaatgaaagagtggccaa

SEQ ID NO: 375479 - DNA, 25 bp, Homo sapien
ttcataccgttctttcattcggtgg

SEQ ID NO: 375480 - DNA, 25 bp, Homo sapien
taccgttctttcattcggtggattt

SEQ ID NO: 375481 - DNA, 25 bp, Homo sapien
ttttctcttgagacaccatgaatgt

SEQ ID NO: 375482 - DNA, 25 bp, Homo sapien
tgagacaccatgaatgtttcttctt

SEQ ID NO: 375483 - DNA, 25 bp, Homo sapien
ttcttcttgctaactcttgaacgtt

SEQ ID NO: 375484 - DNA, 25 bp, Homo sapien
cttgaacgttgaatttccagcgagt

SEQ ID NO: 375485 - DNA, 25 bp, Homo sapien
atttccagcgagtgtcaggttctcg

SEQ ID NO: 375486 - DNA, 25 bp, Homo sapien
gtcaggttctcggaatataacttca

SEQ ID NO: 375487 - DNA, 25 bp, Homo sapien
ggttctcggaatataacttcatagt

SEQ ID NO: 375488 - DNA, 25 bp, Homo sapien
agttattttcaagtgccatgactgc

SEQ ID NO: 375489 - DNA, 25 bp, Homo sapien
attttcaagtgccatgactgcatag

SEQ ID NO: 375490 - DNA, 25 bp, Homo sapien
gagggtgtgtgggaagaatggagaa

SEQ ID NO: 375491 - DNA, 25 bp, Homo sapien
agggtgtgtgggaagaatggagaaa

SEQ ID NO: 375492 - DNA, 25 bp, Homo sapien
gggtgtgtgggaagaatggagaaat

SEQ ID NO: 375493 - DNA, 25 bp, Homo sapien
ggtgtgtgggaagaatggagaaatt

SEQ ID NO: 375494 - DNA, 25 bp, Homo sapien
gtgtgtgggaagaatggagaaattc

SEQ ID NO: 375495 - DNA, 25 bp, Homo sapien
tgtgtgggaagaatggagaaattca

SEQ ID NO: 375496 - DNA, 25 bp, Homo sapien
tgggaagaatggagaaattcaggct

SEQ ID NO: 375497 - DNA, 25 bp, Homo sapien
gggaagaatggagaaattcaggctg

SEQ ID NO: 375498 - DNA, 25 bp, Homo sapien
ggaagaatggagaaattcaggctgg

SEQ ID NO: 375499 - DNA, 25 bp, Homo sapien
gaagaatggagaaattcaggctggg

SEQ ID NO: 375500 - DNA, 25 bp, Homo sapien
gtgtaaaatcaaattctactacata

SEQ ID NO: 375501 - DNA, 25 bp, Homo sapien
taatgaattatttgctacttttgat

SEQ ID NO: 375502 - DNA, 25 bp, Homo sapien
gtatgattgcttttatagaaattaa

SEQ ID NO: 375503 - DNA, 25 bp, Homo sapien
ctgttttataacaagtggatagact

SEQ ID NO: 375504 - DNA, 25 bp, Homo sapien
gtggatagactttacagttttgtgc

SEQ ID NO: 375505 - DNA, 25 bp, Homo sapien
agactttacagttttgtgctgtgcg

SEQ ID NO: 375506 - DNA, 25 bp, Homo sapien
agttttgtgctgtgcggcctgtcaa

SEQ ID NO: 375507 - DNA, 25 bp, Homo sapien
gtgctgtgcggcctgtcaatcagtt

SEQ ID NO: 375508 - DNA, 25 bp, Homo sapien
tgtgcggcctgtcaatcagttcagt

SEQ ID NO: 375509 - DNA, 25 bp, Homo sapien
gcggcctgtcaatcagttcagtgac

SEQ ID NO: 375510 - DNA, 25 bp, Homo sapien
ctgtcaatcagttcagtgacagctg

SEQ ID NO: 375511 - DNA, 25 bp, Homo sapien
gacctggcagatttcacttctgtaa

SEQ ID NO: 375512 - DNA, 25 bp, Homo sapien
tagtcactactccttgaatcaaggc

SEQ ID NO: 375513 - DNA, 25 bp, Homo sapien
aagaaagtctatttatgctgctgga

SEQ ID NO: 375514 - DNA, 25 bp, Homo sapien
tatgctgctggagagactgtatgct

SEQ ID NO: 375515 - DNA, 25 bp, Homo sapien
agactgtatgctgagactgtgtaga

SEQ ID NO: 375516 - DNA, 25 bp, Homo sapien
ttgaatcaaggctggccctgggatt

SEQ ID NO: 375517 - DNA, 25 bp, Homo sapien
aggttcaattgagcccagatcccag

SEQ ID NO: 375518 - DNA, 25 bp, Homo sapien
gggattcactttaaccactagactg

SEQ ID NO: 375519 - DNA, 25 bp, Homo sapien
gtgtcagaaatgatctcgttccagt

SEQ ID NO: 375520 - DNA, 25 bp, Homo sapien
gttccagttccagacctaagcatta

SEQ ID NO: 375521 - DNA, 25 bp, Homo sapien
gacctaagcattaagtagacctggc

SEQ ID NO: 375522 - DNA, 25 bp, Homo sapien
aatagctttgttttgtaccaacagg

SEQ ID NO: 375523 - DNA, 25 bp, Homo sapien
gaaaagatttcgttcccagcagcat

SEQ ID NO: 375524 - DNA, 25 bp, Homo sapien
gatttcgttcccagcagcatcaaga

SEQ ID NO: 375525 - DNA, 25 bp, Homo sapien
aacagttatggaggacttgtatgga

SEQ ID NO: 375526 - DNA, 25 bp, Homo sapien
aatttaagtcttcactgagggccac

SEQ ID NO: 375527 - DNA, 25 bp, Homo sapien
aagtcttcactgagggccactttac

SEQ ID NO: 375528 - DNA, 25 bp, Homo sapien
ttcactgagggccactttacaaagg

SEQ ID NO: 375529 - DNA, 25 bp, Homo sapien
tgagggccactttacaaaggaaatt

SEQ ID NO: 375530 - DNA, 25 bp, Homo sapien
gagaagccttgttgttggataggaa

SEQ ID NO: 375531 - DNA, 25 bp, Homo sapien
gtactaaagatactctacctacatt

SEQ ID NO: 375532 - DNA, 25 bp, Homo sapien
aagatactctacctacattaattta

SEQ ID NO: 375533 - DNA, 25 bp, Homo sapien
aaagcaaaactgtatcacatagggt

SEQ ID NO: 375534 - DNA, 25 bp, Homo sapien
tcacatagggtttttggtcactcac

SEQ ID NO: 375535 - DNA, 25 bp, Homo sapien
catagggtttttggtcactcacaac

SEQ ID NO: 375536 - DNA, 25 bp, Homo sapien
gggtttttggtcactcacaacctga

SEQ ID NO: 375537 - DNA, 25 bp, Homo sapien
ttggtcactcacaacctgaattcac

SEQ ID NO: 375538 - DNA, 25 bp, Homo sapien
ggaattctagaattatatgctaaat

SEQ ID NO: 375539 - DNA, 25 bp, Homo sapien
tgtacagatactagcattgcacata

SEQ ID NO: 375540 - DNA, 25 bp, Homo sapien
gcattgcacatatagtctgctttct

SEQ ID NO: 375541 - DNA, 25 bp, Homo sapien
acatatagtctgctttctgttcctc

SEQ ID NO: 375542 - DNA, 25 bp, Homo sapien
atagtctgctttctgttcctccaga

SEQ ID NO: 375543 - DNA, 25 bp, Homo sapien
gttcctccagaatttgagtcctgtt

SEQ ID NO: 375544 - DNA, 25 bp, Homo sapien
atcatggtctgggtttccaaaacta

SEQ ID NO: 375545 - DNA, 25 bp, Homo sapien
tcatggtctgggtttccaaaactac

SEQ ID NO: 375546 - DNA, 25 bp, Homo sapien
tttccaaaactaccctagtacagtg

SEQ ID NO: 375547 - DNA, 25 bp, Homo sapien
aaaactaccctagtacagtgaatga

SEQ ID NO: 375548 - DNA, 25 bp, Homo sapien
ttgtttcagaaccatgtacctttat

SEQ ID NO: 375549 - DNA, 25 bp, Homo sapien
tttcagaaccatgtacctttatgct

SEQ ID NO: 375550 - DNA, 25 bp, Homo sapien
aaccatgtacctttatgctttgtga

SEQ ID NO: 375551 - DNA, 25 bp, Homo sapien
tgctttgtgattgtgaaacattgac

SEQ ID NO: 375552 - DNA, 25 bp, Homo sapien
tgtgattgtgaaacattgacttttt

SEQ ID NO: 375553 - DNA, 25 bp, Homo sapien
gtgtgttttgaaacttaggtgcaat

SEQ ID NO: 375554 - DNA, 25 bp, Homo sapien
ttaggtgcaatgtcccctggaaaaa

SEQ ID NO: 375555 - DNA, 25 bp, Homo sapien
aagtgtggcacctgagtgtctgtct

SEQ ID NO: 375556 - DNA, 25 bp, Homo sapien
tggcacctgagtgtctgtcttggga

SEQ ID NO: 375557 - DNA, 25 bp, Homo sapien
cacctgagtgtctgtcttgggagct

SEQ ID NO: 375558 - DNA, 25 bp, Homo sapien
cctgagtgtctgtcttgggagctgc

SEQ ID NO: 375559 - DNA, 25 bp, Homo sapien
caggctctcagcaggtagtagtggg

SEQ ID NO: 375560 - DNA, 25 bp, Homo sapien
tggtggtgccaggatggagagccaa

SEQ ID NO: 375561 - DNA, 25 bp, Homo sapien
gagagccaagcctagctctccagtg

SEQ ID NO: 375562 - DNA, 25 bp, Homo sapien
aagcctagctctccagtgcctgtgc

SEQ ID NO: 375563 - DNA, 25 bp, Homo sapien
accacctcctacaggccaaagtgga

SEQ ID NO: 375564 - DNA, 25 bp, Homo sapien
ttacatgaatgaggtgtggcggcaa

SEQ ID NO: 375565 - DNA, 25 bp, Homo sapien
aggtgtggcggcaaggctagagaga

SEQ ID NO: 375566 - DNA, 25 bp, Homo sapien
aatcagttaagaatttggagagttt

SEQ ID NO: 375567 - DNA, 25 bp, Homo sapien
cagttaagaatttggagagtttatc

SEQ ID NO: 375568 - DNA, 25 bp, Homo sapien
gaatttggagagtttatcttaaatg

SEQ ID NO: 375569 - DNA, 25 bp, Homo sapien
tttggagagtttatcttaaatggaa

SEQ ID NO: 375570 - DNA, 25 bp, Homo sapien
ttggagagtttatcttaaatggaaa

SEQ ID NO: 375571 - DNA, 25 bp, Homo sapien
ggaaatggtgtattcttttcaaaga

SEQ ID NO: 375572 - DNA, 25 bp, Homo sapien
gaaatggtgtattcttttcaaagaa

SEQ ID NO: 375573 - DNA, 25 bp, Homo sapien
aagaattttgtaaccatctttacag

SEQ ID NO: 375574 - DNA, 25 bp, Homo sapien
agaattttgtaaccatctttacagt

SEQ ID NO: 375575 - DNA, 25 bp, Homo sapien
gaattttgtaaccatctttacagtt

SEQ ID NO: 375576 - DNA, 25 bp, Homo sapien
ttttgtaaccatctttacagtttct

SEQ ID NO: 375577 - DNA, 25 bp, Homo sapien
atctttcttatttgctttctgtcga

SEQ ID NO: 375578 - DNA, 25 bp, Homo sapien
ttggaggcttttcctggatatattt

SEQ ID NO: 375579 - DNA, 25 bp, Homo sapien
gctttctgtcgattccaaatatgag

SEQ ID NO: 375580 - DNA, 25 bp, Homo sapien
agaaaagaagtcactccctctcagg

SEQ ID NO: 375581 - DNA, 25 bp, Homo sapien
tctcagggccttcagataagacttc

SEQ ID NO: 375582 - DNA, 25 bp, Homo sapien
ataagacttcatcaggtgtactacc

SEQ ID NO: 375583 - DNA, 25 bp, Homo sapien
aggtgtactaccagactgccattac

SEQ ID NO: 375584 - DNA, 25 bp, Homo sapien
ctgccattacagttcccaaaggtga

SEQ ID NO: 375585 - DNA, 25 bp, Homo sapien
aaggtgattcatttccagtgggatt

SEQ ID NO: 375586 - DNA, 25 bp, Homo sapien
gaattattaccagccagtccttgag

SEQ ID NO: 375587 - DNA, 25 bp, Homo sapien
ttgagtaatctcaggcttaacaggc

SEQ ID NO: 375588 - DNA, 25 bp, Homo sapien
gggacactgacctcctgctctgtgt

SEQ ID NO: 375589 - DNA, 25 bp, Homo sapien
tgcctgccaactgatctgccaagtg

SEQ ID NO: 375590 - DNA, 25 bp, Homo sapien
aactgatctgccaagtgccaggtcc

SEQ ID NO: 375591 - DNA, 25 bp, Homo sapien
ctgccaagtgccaggtcccacatga

SEQ ID NO: 375592 - DNA, 25 bp, Homo sapien
ggaagccacaggtgtaggcccctag

SEQ ID NO: 375593 - DNA, 25 bp, Homo sapien
aggtgtaggcccctagcccttgaat

SEQ ID NO: 375594 - DNA, 25 bp, Homo sapien
ctcagttcctcacagccaggaaggt

SEQ ID NO: 375595 - DNA, 25 bp, Homo sapien
tcacagccaggaaggtcccaacagg

SEQ ID NO: 375596 - DNA, 25 bp, Homo sapien
aggaaggtcccaacaggctgcatgc

SEQ ID NO: 375597 - DNA, 25 bp, Homo sapien
aaggtcccaacaggctgcatgcagt

SEQ ID NO: 375598 - DNA, 25 bp, Homo sapien
gcatgcagtggcaggtgcttcggat

SEQ ID NO: 375599 - DNA, 25 bp, Homo sapien
ttgcctctcccaagactatgggtaa

SEQ ID NO: 375600 - DNA, 25 bp, Homo sapien
ggtaacagggcatctatacccctca

SEQ ID NO: 375601 - DNA, 25 bp, Homo sapien
ctatacccctcaaagacattcatgt

SEQ ID NO: 375602 - DNA, 25 bp, Homo sapien
catgtgaatggccaactccctgctg

SEQ ID NO: 375603 - DNA, 25 bp, Homo sapien
ggaaaggcaacagcaaactctcttg

SEQ ID NO: 375604 - DNA, 25 bp, Homo sapien
acagcaaactctcttgtttcttctg

SEQ ID NO: 375605 - DNA, 25 bp, Homo sapien
aatgaaagcaccaaagagccttctt

SEQ ID NO: 375606 - DNA, 25 bp, Homo sapien
aagagccttctttgctacaatatct

SEQ ID NO: 375607 - DNA, 25 bp, Homo sapien
aatatctttgtgtgcagtctcctgc

SEQ ID NO: 375608 - DNA, 25 bp, Homo sapien
aagagcatccaacgcacacatcgtg

SEQ ID NO: 375609 - DNA, 25 bp, Homo sapien
aacgcacacatcgtgagacgttttt

SEQ ID NO: 375610 - DNA, 25 bp, Homo sapien
gaggttggcctcagtgacaatcaaa

SEQ ID NO: 375611 - DNA, 25 bp, Homo sapien
ttttctcttgcccttgctggaatag

SEQ ID NO: 375612 - DNA, 25 bp, Homo sapien
tgcccttgctggaatagggatcaag

SEQ ID NO: 375613 - DNA, 25 bp, Homo sapien
agcagtgggatatctggatttctta

SEQ ID NO: 375614 - DNA, 25 bp, Homo sapien
ggatttcttatactcagtcaaccac

SEQ ID NO: 375615 - DNA, 25 bp, Homo sapien
cttatactcagtcaaccacaacatg

SEQ ID NO: 375616 - DNA, 25 bp, Homo sapien
ttagtactgaactagcccagggttt

SEQ ID NO: 375617 - DNA, 25 bp, Homo sapien
gcccagggtttcaatggaactcgta

SEQ ID NO: 375618 - DNA, 25 bp, Homo sapien
gaactcgtagatctcattcccaagg

SEQ ID NO: 375619 - DNA, 25 bp, Homo sapien
aaaggacgtgtcttctgaaaggcat

SEQ ID NO: 375620 - DNA, 25 bp, Homo sapien
ctgaaaggcattacccatggaaagc

SEQ ID NO: 375621 - DNA, 25 bp, Homo sapien
agaagactgtccactccagcaagat

SEQ ID NO: 375622 - DNA, 25 bp, Homo sapien
gtccactccagcaagatccagggat

SEQ ID NO: 375623 - DNA, 25 bp, Homo sapien
aagatccagggatgatagccttgca

SEQ ID NO: 375624 - DNA, 25 bp, Homo sapien
ggatgatagccttgcagggccactg

SEQ ID NO: 375625 - DNA, 25 bp, Homo sapien
actgggagtttgtgcccaagcttct

SEQ ID NO: 375626 - DNA, 25 bp, Homo sapien
tgggccttccccagaggtattaaag

SEQ ID NO: 375627 - DNA, 25 bp, Homo sapien
aagtatgattcctctgtcttcagtt

SEQ ID NO: 375628 - DNA, 25 bp, Homo sapien
gcccatagtacccagttcccaaggg

SEQ ID NO: 375629 - DNA, 25 bp, Homo sapien
cccagtcacgtggtgaagcctagca

SEQ ID NO: 375630 - DNA, 25 bp, Homo sapien
gtggtgaagcctagcactcatgcag

SEQ ID NO: 375631 - DNA, 25 bp, Homo sapien
actcatgcagctcttagggaaccaa

SEQ ID NO: 375632 - DNA, 25 bp, Homo sapien
aaaacagagctcaccttctgcaact

SEQ ID NO: 375633 - DNA, 25 bp, Homo sapien
agctcaccttctgcaactacaaagg

SEQ ID NO: 375634 - DNA, 25 bp, Homo sapien
acaacaaacttacatcaggctgatt

SEQ ID NO: 375635 - DNA, 25 bp, Homo sapien
acttacatcaggctgatttgcaaat

SEQ ID NO: 375636 - DNA, 25 bp, Homo sapien
gcaaatcacaagttttactttgttt

SEQ ID NO: 375637 - DNA, 25 bp, Homo sapien
gctgctttcttacattgaacttggt

SEQ ID NO: 375638 - DNA, 25 bp, Homo sapien
ggttattttatttacatccacaatg

SEQ ID NO: 375639 - DNA, 25 bp, Homo sapien
acatccacaatggatagtttcagtg

SEQ ID NO: 375640 - DNA, 25 bp, Homo sapien
tacattccttaaagttgtaccctat

SEQ ID NO: 375641 - DNA, 25 bp, Homo sapien
gttgtaccctatttgttgttacaat

SEQ ID NO: 375642 - DNA, 25 bp, Homo sapien
gtaccctatttgttgttacaataca

SEQ ID NO: 375643 - DNA, 25 bp, Homo sapien
aagaactggcattttcatatggata

SEQ ID NO: 375644 - DNA, 25 bp, Homo sapien
gaactggcattttcatatggataca

SEQ ID NO: 375645 - DNA, 25 bp, Homo sapien
actggcattttcatatggatacata

SEQ ID NO: 375646 - DNA, 25 bp, Homo sapien
tgcctttcaggtatactacagcgtt

SEQ ID NO: 375647 - DNA, 25 bp, Homo sapien
gcctttcaggtatactacagcgtta

SEQ ID NO: 375648 - DNA, 25 bp, Homo sapien
tttcaggtatactacagcgttatat

SEQ ID NO: 375649 - DNA, 25 bp, Homo sapien
gtatactacagcgttatatgaacat

SEQ ID NO: 375650 - DNA, 25 bp, Homo sapien
actacagcgttatatgaacataatg

SEQ ID NO: 375651 - DNA, 25 bp, Homo sapien
atcttggtgtagtttctaattttca

SEQ ID NO: 375652 - DNA, 25 bp, Homo sapien
ggtgtagtttctaattttcactgca

SEQ ID NO: 375653 - DNA, 25 bp, Homo sapien
tgtagtttctaattttcactgcata

SEQ ID NO: 375654 - DNA, 25 bp, Homo sapien
tactttgggcagtatcttcctgatg

SEQ ID NO: 375655 - DNA, 25 bp, Homo sapien
ggcagtatcttcctgatgtcttctt

SEQ ID NO: 375656 - DNA, 25 bp, Homo sapien
tcctgatgtcttcttagctaagagg

SEQ ID NO: 375657 - DNA, 25 bp, Homo sapien
aatagggaggaaattccttcatcag

SEQ ID NO: 375658 - DNA, 25 bp, Homo sapien
attccttcatcagaacgacttcaag

SEQ ID NO: 375659 - DNA, 25 bp, Homo sapien
acgacttcaagtggataacaatatt

SEQ ID NO: 375660 - DNA, 25 bp, Homo sapien
ggaaggaaatatgatcctcctgaga

SEQ ID NO: 375661 - DNA, 25 bp, Homo sapien
cctcctgagactaactttgtatgtt

SEQ ID NO: 375662 - DNA, 25 bp, Homo sapien
gaactaagtgaatgtatctgcagag

SEQ ID NO: 375663 - DNA, 25 bp, Homo sapien
gatatgtcattagatccaagtgctg

SEQ ID NO: 375664 - DNA, 25 bp, Homo sapien
gatccaagtgctgattaaattttta

SEQ ID NO: 375665 - DNA, 25 bp, Homo sapien
aagggatgactgaattcagggagaa

SEQ ID NO: 375666 - DNA, 25 bp, Homo sapien
atacctagctgtaaaaaaggctgag

SEQ ID NO: 375667 - DNA, 25 bp, Homo sapien
aagaaccaaataggcggtagtccat

SEQ ID NO: 375668 - DNA, 25 bp, Homo sapien
aataggcggtagtccattgggtcag

SEQ ID NO: 375669 - DNA, 25 bp, Homo sapien
gcggtagtccattgggtcaggaaaa

SEQ ID NO: 375670 - DNA, 25 bp, Homo sapien
gtcaggaaaagcttgaccaagtatc

SEQ ID NO: 375671 - DNA, 25 bp, Homo sapien
cttgaccaagtatctgagctatgtt

SEQ ID NO: 375672 - DNA, 25 bp, Homo sapien
agtatctgagctatgttttgagaga

SEQ ID NO: 375673 - DNA, 25 bp, Homo sapien
taaagtctccagttgagtgtccaag

SEQ ID NO: 375674 - DNA, 25 bp, Homo sapien
gagtgtccaagtggctggctaacta

SEQ ID NO: 375675 - DNA, 25 bp, Homo sapien
gtggctggctaactaaatatcaagg

SEQ ID NO: 375676 - DNA, 25 bp, Homo sapien
aatctgctgagttgtctagtgttta

SEQ ID NO: 375677 - DNA, 25 bp, Homo sapien
gagttgtctagtgtttaaggcatca

SEQ ID NO: 375678 - DNA, 25 bp, Homo sapien
gtctagtgtttaaggcatcaggata

SEQ ID NO: 375679 - DNA, 25 bp, Homo sapien
gggttatcataggatctgccttgtt

SEQ ID NO: 375680 - DNA, 25 bp, Homo sapien
ataggatctgccttgttcgtttctc

SEQ ID NO: 375681 - DNA, 25 bp, Homo sapien
ttgttcgtttctcttctttcataga

SEQ ID NO: 375682 - DNA, 25 bp, Homo sapien
aaaaatactgtgcttcctactgtcc

SEQ ID NO: 375683 - DNA, 25 bp, Homo sapien
gtgcttcctactgtccagtgtttga

SEQ ID NO: 375684 - DNA, 25 bp, Homo sapien
tcctactgtccagtgtttgagcaca

SEQ ID NO: 375685 - DNA, 25 bp, Homo sapien
gtccagtgtttgagcacagtagttt

SEQ ID NO: 375686 - DNA, 25 bp, Homo sapien
gtgtttgagcacagtagtttcatgt

SEQ ID NO: 375687 - DNA, 25 bp, Homo sapien
catatggtgttcttggtgcagtctg

SEQ ID NO: 375688 - DNA, 25 bp, Homo sapien
ggtgttcttggtgcagtctgtataa

SEQ ID NO: 375689 - DNA, 25 bp, Homo sapien
tggtgcagtctgtataattttaagg

SEQ ID NO: 375690 - DNA, 25 bp, Homo sapien
aagtgactcaagcagtagaaaatct

SEQ ID NO: 375691 - DNA, 25 bp, Homo sapien
aactgttgtcagtagtttggttagt

SEQ ID NO: 375692 - DNA, 25 bp, Homo sapien
gtggtaagtactccaatccatttta

SEQ ID NO: 375693 - DNA, 25 bp, Homo sapien
taagtactccaatccattttacaaa

SEQ ID NO: 375694 - DNA, 25 bp, Homo sapien
aaatcctctgtaataccactaccaa

SEQ ID NO: 375695 - DNA, 25 bp, Homo sapien
ggttgtaaggtctaaaaatctgaag

SEQ ID NO: 375696 - DNA, 25 bp, Homo sapien
aaatctgaagtgttactaggtccat

SEQ ID NO: 375697 - DNA, 25 bp, Homo sapien
gttactaggtccatatggtgttctt

SEQ ID NO: 375698 - DNA, 25 bp, Homo sapien
gaagcaaaggctaagaagcatctgt

SEQ ID NO: 375699 - DNA, 25 bp, Homo sapien
ggctaagaagcatctgtacaggcat

SEQ ID NO: 375700 - DNA, 25 bp, Homo sapien
taagaagcatctgtacaggcataaa

SEQ ID NO: 375701 - DNA, 25 bp, Homo sapien
gaagcatctgtacaggcataaagag

SEQ ID NO: 375702 - DNA, 25 bp, Homo sapien
atctgtacaggcataaagaggaaac

SEQ ID NO: 375703 - DNA, 25 bp, Homo sapien
taggctggacagatcacctagccca

SEQ ID NO: 375704 - DNA, 25 bp, Homo sapien
ggctggacagatcacctagcccagg

SEQ ID NO: 375705 - DNA, 25 bp, Homo sapien
tggacagatcacctagcccagggtg

SEQ ID NO: 375706 - DNA, 25 bp, Homo sapien
gacagatcacctagcccagggtgtg

SEQ ID NO: 375707 - DNA, 25 bp, Homo sapien
ccgagccctagcaaggagtcactga

SEQ ID NO: 375708 - DNA, 25 bp, Homo sapien
cgagccctagcaaggagtcactgac

SEQ ID NO: 375709 - DNA, 25 bp, Homo sapien
gcggggaagacacattcattcagta

SEQ ID NO: 375710 - DNA, 25 bp, Homo sapien
ttcagtaaacgtttcatgagctcct

SEQ ID NO: 375711 - DNA, 25 bp, Homo sapien
aaacgtttcatgagctcctactgtg

SEQ ID NO: 375712 - DNA, 25 bp, Homo sapien
ttcatgagctcctactgtgtgctgg

SEQ ID NO: 375713 - DNA, 25 bp, Homo sapien
tgtgtgctgggcatagctctcggct

SEQ ID NO: 375714 - DNA, 25 bp, Homo sapien
tgggcatagctctcggctggttcac

SEQ ID NO: 375715 - DNA, 25 bp, Homo sapien
tcggctggttcacggacctgatgtt

SEQ ID NO: 375716 - DNA, 25 bp, Homo sapien
aagccacgcgcagtatcatgacaag

SEQ ID NO: 375717 - DNA, 25 bp, Homo sapien
cacgcgcagtatcatgacaaggaat

SEQ ID NO: 375718 - DNA, 25 bp, Homo sapien
catgacaaggaatgacgaatggttt

SEQ ID NO: 375719 - DNA, 25 bp, Homo sapien
tgactaggggtcaggctacttagcg

SEQ ID NO: 375720 - DNA, 25 bp, Homo sapien
ataagtcttatgctatctcagttga

SEQ ID NO: 375721 - DNA, 25 bp, Homo sapien
tatgctatctcagttgacacattga

SEQ ID NO: 375722 - DNA, 25 bp, Homo sapien
cagttgacacattgaggttattttg

SEQ ID NO: 375723 - DNA, 25 bp, Homo sapien
gaagctagttggactttgttttgtt

SEQ ID NO: 375724 - DNA, 25 bp, Homo sapien
gttttccaaaagttctccactattg

SEQ ID NO: 375725 - DNA, 25 bp, Homo sapien
aagttctccactattggttttagag

SEQ ID NO: 375726 - DNA, 25 bp, Homo sapien
ctccactattggttttagagagagc

SEQ ID NO: 375727 - DNA, 25 bp, Homo sapien
gagagcaaggacatctttcctctga

SEQ ID NO: 375728 - DNA, 25 bp, Homo sapien
aggacatctttcctctgacacgtgg

SEQ ID NO: 375729 - DNA, 25 bp, Homo sapien
tctgacacgtgggaatgggtgatat

SEQ ID NO: 375730 - DNA, 25 bp, Homo sapien
gaaatagcctccaatgggaaatatt

SEQ ID NO: 375731 - DNA, 25 bp, Homo sapien
ttcacaaatgatatcacctccttgg

SEQ ID NO: 375732 - DNA, 25 bp, Homo sapien
tcacctccttgggaaactgttagtt

SEQ ID NO: 375733 - DNA, 25 bp, Homo sapien
gaaggacacctgtaagtggcatgtt

SEQ ID NO: 375734 - DNA, 25 bp, Homo sapien
gacacctgtaagtggcatgtttaat

SEQ ID NO: 375735 - DNA, 25 bp, Homo sapien
aagataccagattaaaaggcaatgt

SEQ ID NO: 375736 - DNA, 25 bp, Homo sapien
aaggcaatgtactatcttggaaaga

SEQ ID NO: 375737 - DNA, 25 bp, Homo sapien
tatcttggaaagagccagacatctg

SEQ ID NO: 375738 - DNA, 25 bp, Homo sapien
gaaagagccagacatctgagtttta

SEQ ID NO: 375739 - DNA, 25 bp, Homo sapien
tttaatctcagttttagccctctga

SEQ ID NO: 375740 - DNA, 25 bp, Homo sapien
cagttttagccctctgatgtagaac

SEQ ID NO: 375741 - DNA, 25 bp, Homo sapien
tagccctctgatgtagaactattga

SEQ ID NO: 375742 - DNA, 25 bp, Homo sapien
agttacatcatctgtggtcacaaca

SEQ ID NO: 375743 - DNA, 25 bp, Homo sapien
ggtcacaacaccctgaaaatgccta

SEQ ID NO: 375744 - DNA, 25 bp, Homo sapien
gcctaatattggaaacttaagcagg

SEQ ID NO: 375745 - DNA, 25 bp, Homo sapien
gcaggattgatccaggttattactt

SEQ ID NO: 375746 - DNA, 25 bp, Homo sapien
cttggatgggagaccagatgctata

SEQ ID NO: 375747 - DNA, 25 bp, Homo sapien
ggagaccagatgctataggctgaaa

SEQ ID NO: 375748 - DNA, 25 bp, Homo sapien
gaaagcataagtacgcacaagttaa

SEQ ID NO: 375749 - DNA, 25 bp, Homo sapien
aggactataagttctatctcttttc

SEQ ID NO: 375750 - DNA, 25 bp, Homo sapien
agttctatctcttttctttacattg

SEQ ID NO: 375751 - DNA, 25 bp, Homo sapien
atctcttttctttacattgttcagt

SEQ ID NO: 375752 - DNA, 25 bp, Homo sapien
tccctttgaaaatgtgttatgtact

SEQ ID NO: 375753 - DNA, 25 bp, Homo sapien
caatcagccaattagaatttgcctg

SEQ ID NO: 375754 - DNA, 25 bp, Homo sapien
gcctgaaatcatagactcaccctag

SEQ ID NO: 375755 - DNA, 25 bp, Homo sapien
gactcaccctagttttattgctgta

SEQ ID NO: 375756 - DNA, 25 bp, Homo sapien
tgtttttaagaattggaagcctgct

SEQ ID NO: 375757 - DNA, 25 bp, Homo sapien
aaaaaatgtagttgagccccataat

SEQ ID NO: 375758 - DNA, 25 bp, Homo sapien
gttgagccccataattttacaaatg

SEQ ID NO: 375759 - DNA, 25 bp, Homo sapien
aaacttctaactctacttggatcaa

SEQ ID NO: 375760 - DNA, 25 bp, Homo sapien
tacttggatcaaaacctcatacatt

SEQ ID NO: 375761 - DNA, 25 bp, Homo sapien
gggtcctgacaagtcagctgactca

SEQ ID NO: 375762 - DNA, 25 bp, Homo sapien
acaagtcagctgactcaacctcaca

SEQ ID NO: 375763 - DNA, 25 bp, Homo sapien
gctcaggattcctgaaacgtgtggg

SEQ ID NO: 375764 - DNA, 25 bp, Homo sapien
tatttgcactaatggctttctgaag

SEQ ID NO: 375765 - DNA, 25 bp, Homo sapien
tattaagcttgggaacctggtcgcc

SEQ ID NO: 375766 - DNA, 25 bp, Homo sapien
ttgggaacctggtcgcccagtgttt

SEQ ID NO: 375767 - DNA, 25 bp, Homo sapien
tcgcccagtgttttctctggacaaa

SEQ ID NO: 375768 - DNA, 25 bp, Homo sapien
gataaagtcttgagttcctcagggt

SEQ ID NO: 375769 - DNA, 25 bp, Homo sapien
gagttcctcagggtaactgtgttga

SEQ ID NO: 375770 - DNA, 25 bp, Homo sapien
gtaactgtgttgatgtctcccgtcc

SEQ ID NO: 375771 - DNA, 25 bp, Homo sapien
cccgtcctcttcagtaaggcttgaa

SEQ ID NO: 375772 - DNA, 25 bp, Homo sapien
ggcttgaatatgattttactcatca

SEQ ID NO: 375773 - DNA, 25 bp, Homo sapien
gattttactcatcattgattctgca

SEQ ID NO: 375774 - DNA, 25 bp, Homo sapien
tcattgattctgcatagtgtaccca

SEQ ID NO: 375775 - DNA, 25 bp, Homo sapien
gcagcagaatccgtgccttttcttc

SEQ ID NO: 375776 - DNA, 25 bp, Homo sapien
agcagaatccgtgccttttcttctg

SEQ ID NO: 375777 - DNA, 25 bp, Homo sapien
gccttttcttctggagtgtgtgaga

SEQ ID NO: 375778 - DNA, 25 bp, Homo sapien
ttttcttctggagtgtgtgagagtc

SEQ ID NO: 375779 - DNA, 25 bp, Homo sapien
tcttctggagtgtgtgagagtccgt

SEQ ID NO: 375780 - DNA, 25 bp, Homo sapien
aacactttgaagaacacctttgcca

SEQ ID NO: 375781 - DNA, 25 bp, Homo sapien
ctttgaagaacacctttgccacatg

SEQ ID NO: 375782 - DNA, 25 bp, Homo sapien
ttgaagaacacctttgccacatgtc

SEQ ID NO: 375783 - DNA, 25 bp, Homo sapien
tgaagaacacctttgccacatgtcc

SEQ ID NO: 375784 - DNA, 25 bp, Homo sapien
gaagaacacctttgccacatgtcct

SEQ ID NO: 375785 - DNA, 25 bp, Homo sapien
gaacacctttgccacatgtcctcag

SEQ ID NO: 375786 - DNA, 25 bp, Homo sapien
aagagaagggcgaagattacaagga

SEQ ID NO: 375787 - DNA, 25 bp, Homo sapien
ggtagcaggaaggactccggccagt

SEQ ID NO: 375788 - DNA, 25 bp, Homo sapien
gactccggccagtacgaaaaggact

SEQ ID NO: 375789 - DNA, 25 bp, Homo sapien
cggccagtacgaaaaggacttcctg

SEQ ID NO: 375790 - DNA, 25 bp, Homo sapien
gaggcggatgcttacggagtttctt

SEQ ID NO: 375791 - DNA, 25 bp, Homo sapien
ggcggatgcttacggagtttcttac

SEQ ID NO: 375792 - DNA, 25 bp, Homo sapien
ggatgcttacggagtttcttacaac

SEQ ID NO: 375793 - DNA, 25 bp, Homo sapien
gcttacggagtttcttacaacatga

SEQ ID NO: 375794 - DNA, 25 bp, Homo sapien
gtttcttacaacatgaaagctgaca

SEQ ID NO: 375795 - DNA, 25 bp, Homo sapien
gaaagctgacatagaagatgagcta

SEQ ID NO: 375796 - DNA, 25 bp, Homo sapien
gatgagctagataaaaccattgaat

SEQ ID NO: 375797 - DNA, 25 bp, Homo sapien
tctatgagttctccaatatcaagga

SEQ ID NO: 375798 - DNA, 25 bp, Homo sapien
gaacgtataatgtttccaccccaga

SEQ ID NO: 375799 - DNA, 25 bp, Homo sapien
tataatgtttccaccccagaagcaa

SEQ ID NO: 375800 - DNA, 25 bp, Homo sapien
atgtttccaccccagaagcaaccag

SEQ ID NO: 375801 - DNA, 25 bp, Homo sapien
gctcatccctggaaaactcatccag

SEQ ID NO: 375802 - DNA, 25 bp, Homo sapien
gaaaactcatccagtgcttcttcgt

SEQ ID NO: 375803 - DNA, 25 bp, Homo sapien
agtgcttcttcgttgctcaactaag

SEQ ID NO: 375804 - DNA, 25 bp, Homo sapien
ttcgttgctcaactaagaacaggat

SEQ ID NO: 375805 - DNA, 25 bp, Homo sapien
aggataatccaacctacgtgacctc

SEQ ID NO: 375806 - DNA, 25 bp, Homo sapien
gcaggtttccgggagcagatgccaa

SEQ ID NO: 375807 - DNA, 25 bp, Homo sapien
agactttttcatagagaagaggctt

SEQ ID NO: 375808 - DNA, 25 bp, Homo sapien
ttactggttggtccttttttcactg

SEQ ID NO: 375809 - DNA, 25 bp, Homo sapien
tactggttggtccttttttcactgg

SEQ ID NO: 375810 - DNA, 25 bp, Homo sapien
ttttcactggtacccgtggaccctg

SEQ ID NO: 375811 - DNA, 25 bp, Homo sapien
tgccacttactaaccccaagggaat

SEQ ID NO: 375812 - DNA, 25 bp, Homo sapien
ttactaaccccaagggaatcagcca

SEQ ID NO: 375813 - DNA, 25 bp, Homo sapien
taaccccaagggaatcagccaatat

SEQ ID NO: 375814 - DNA, 25 bp, Homo sapien
aaccccaagggaatcagccaatata

SEQ ID NO: 375815 - DNA, 25 bp, Homo sapien
ccccaagggaatcagccaatatatt

SEQ ID NO: 375816 - DNA, 25 bp, Homo sapien
ccaagggaatcagccaatatattac

SEQ ID NO: 375817 - DNA, 25 bp, Homo sapien
gggaatcagccaatatattactgag

SEQ ID NO: 375818 - DNA, 25 bp, Homo sapien
cagccaatatattactgagacttcc

SEQ ID NO: 375819 - DNA, 25 bp, Homo sapien
cctttgagtcaagcagccctgtttg

SEQ ID NO: 375820 - DNA, 25 bp, Homo sapien
tggtttgaaaaacaacgtctgaaga

SEQ ID NO: 375821 - DNA, 25 bp, Homo sapien
ttgagtcaagcagccctgtttgtaa

SEQ ID NO: 375822 - DNA, 25 bp, Homo sapien
gaaattttatcaaataactggtcca

SEQ ID NO: 375823 - DNA, 25 bp, Homo sapien
caaataactggtccaaaatacgtat

SEQ ID NO: 375824 - DNA, 25 bp, Homo sapien
agtcaagcagccctgtttgtaaata

SEQ ID NO: 375825 - DNA, 25 bp, Homo sapien
aatctgcaaaatgtatacactgagt

SEQ ID NO: 375826 - DNA, 25 bp, Homo sapien
tgtgtttttagtcttcacatcaaaa

SEQ ID NO: 375827 - DNA, 25 bp, Homo sapien
gtcttcacatcaaaattgctctatt

SEQ ID NO: 375828 - DNA, 25 bp, Homo sapien
catcaaaattgctctattaatgaac

SEQ ID NO: 375829 - DNA, 25 bp, Homo sapien
tttgtaaatattgtcctaattgccc

SEQ ID NO: 375830 - DNA, 25 bp, Homo sapien
gggccatatcaacagcatggctatt

SEQ ID NO: 375831 - DNA, 25 bp, Homo sapien
atatcaacagcatggctattcaggg

SEQ ID NO: 375832 - DNA, 25 bp, Homo sapien
gcagtagaagagtcctttcctgtca

SEQ ID NO: 375833 - DNA, 25 bp, Homo sapien
ctctgtcaccttgaggtcatgccaa

SEQ ID NO: 375834 - DNA, 25 bp, Homo sapien
gtcaccttgaggtcatgccaaagaa

SEQ ID NO: 375835 - DNA, 25 bp, Homo sapien
ggtcatgccaaagaaacttggactt

SEQ ID NO: 375836 - DNA, 25 bp, Homo sapien
aacttggacttatacacagatctta

SEQ ID NO: 375837 - DNA, 25 bp, Homo sapien
acagatcttaattggctcttgtccc

SEQ ID NO: 375838 - DNA, 25 bp, Homo sapien
taattggctcttgtccccaggacat

SEQ ID NO: 375839 - DNA, 25 bp, Homo sapien
aagagtcctttcctgtcaacaatga

SEQ ID NO: 375840 - DNA, 25 bp, Homo sapien
tttcctgtcaacaatgaagcatttg

SEQ ID NO: 375841 - DNA, 25 bp, Homo sapien
aataaggatttattctcagaacacc

SEQ ID NO: 375842 - DNA, 25 bp, Homo sapien
ggatttattctcagaacaccaagta

SEQ ID NO: 375843 - DNA, 25 bp, Homo sapien
gaacaccaagtaaatctatctctat

SEQ ID NO: 375844 - DNA, 25 bp, Homo sapien
caccaagtaaatctatctctatata

SEQ ID NO: 375845 - DNA, 25 bp, Homo sapien
catattcaaagtatatacagagcct

SEQ ID NO: 375846 - DNA, 25 bp, Homo sapien
ttctatggaccaaatgtaaaatatt

SEQ ID NO: 375847 - DNA, 25 bp, Homo sapien
aaatgtctataaatggtgtcataac

SEQ ID NO: 375848 - DNA, 25 bp, Homo sapien
gtgtcataactagagcacgggcgtt

SEQ ID NO: 375849 - DNA, 25 bp, Homo sapien
gagcacgggcgttatgtaagtttct

SEQ ID NO: 375850 - DNA, 25 bp, Homo sapien
gcacgggcgttatgtaagtttctaa

SEQ ID NO: 375851 - DNA, 25 bp, Homo sapien
gggcgttatgtaagtttctaagaat

SEQ ID NO: 375852 - DNA, 25 bp, Homo sapien
gagccacctggagacgacaagccga

SEQ ID NO: 375853 - DNA, 25 bp, Homo sapien
aggagaggcacagacactcctcatc

SEQ ID NO: 375854 - DNA, 25 bp, Homo sapien
ttcatccaagaagagccacgaccga

SEQ ID NO: 375855 - DNA, 25 bp, Homo sapien
gccacgaccgagagcgagccaagaa

SEQ ID NO: 375856 - DNA, 25 bp, Homo sapien
gtagcaggaaggactccggccagta

SEQ ID NO: 375857 - DNA, 25 bp, Homo sapien
gactccggccagtacgaaaaggact

SEQ ID NO: 375858 - DNA, 25 bp, Homo sapien
cggccagtacgaaaaggacttcctg

SEQ ID NO: 375859 - DNA, 25 bp, Homo sapien
gaggcggatgcttacggagtttctt

SEQ ID NO: 375860 - DNA, 25 bp, Homo sapien
ggatgcttacggagtttcttacaac

SEQ ID NO: 375861 - DNA, 25 bp, Homo sapien
gtttcttacaacatgaaagctgaca

SEQ ID NO: 375862 - DNA, 25 bp, Homo sapien
gatgagctagataaaaccattgaat

SEQ ID NO: 375863 - DNA, 25 bp, Homo sapien
attttgcatggcctcagaccaaata

SEQ ID NO: 375864 - DNA, 25 bp, Homo sapien
ggcctcagaccaaatatttccaagt

SEQ ID NO: 375865 - DNA, 25 bp, Homo sapien
atatttccaagtcccgtccttatat

SEQ ID NO: 375866 - DNA, 25 bp, Homo sapien
agtcccgtccttatatatagcaaag

SEQ ID NO: 375867 - DNA, 25 bp, Homo sapien
tgtattttgctcatgccttcaagcc

SEQ ID NO: 375868 - DNA, 25 bp, Homo sapien
atgccttcaagcctgggagtaacac

SEQ ID NO: 375869 - DNA, 25 bp, Homo sapien
ggagtaacacagttttgctgtcaga

SEQ ID NO: 375870 - DNA, 25 bp, Homo sapien
cagaagaagatggttgctgaggcaa

SEQ ID NO: 375871 - DNA, 25 bp, Homo sapien
agtgggaacaggcatcccgcaccat

SEQ ID NO: 375872 - DNA, 25 bp, Homo sapien
taaaagcagcaatttttcctttaat

SEQ ID NO: 375873 - DNA, 25 bp, Homo sapien
agccaagtgaaactattttcatctt

SEQ ID NO: 375874 - DNA, 25 bp, Homo sapien
cagtattgatcaatcattgtcttga

SEQ ID NO: 375875 - DNA, 25 bp, Homo sapien
tgatcaatcattgtcttgatttttt

SEQ ID NO: 375876 - DNA, 25 bp, Homo sapien
tttacagcgtatatttctaatcata

SEQ ID NO: 375877 - DNA, 25 bp, Homo sapien
aagccaagagaactggttgaatgaa

SEQ ID NO: 375878 - DNA, 25 bp, Homo sapien
agataaagcttcctaatggcgtgta

SEQ ID NO: 375879 - DNA, 25 bp, Homo sapien
aaagcttcctaatggcgtgtaaact

SEQ ID NO: 375880 - DNA, 25 bp, Homo sapien
tcctaatggcgtgtaaactttgcat

SEQ ID NO: 375881 - DNA, 25 bp, Homo sapien
gcgtgtaaactttgcatatgtatgt

SEQ ID NO: 375882 - DNA, 25 bp, Homo sapien
tgtagtttgatacatattgtcacat

SEQ ID NO: 375883 - DNA, 25 bp, Homo sapien
catttgaaaatcttgtgggttgtaa

SEQ ID NO: 375884 - DNA, 25 bp, Homo sapien
tgaaaatcttgtgggttgtaactgg

SEQ ID NO: 375885 - DNA, 25 bp, Homo sapien
ctttcacggagccacctggagacga

SEQ ID NO: 375886 - DNA, 25 bp, Homo sapien
tttcacggagccacctggagacgac

SEQ ID NO: 375887 - DNA, 25 bp, Homo sapien
ttcacggagccacctggagacgaca

SEQ ID NO: 375888 - DNA, 25 bp, Homo sapien
cacggagccacctggagacgacaag

SEQ ID NO: 375889 - DNA, 25 bp, Homo sapien
acggagccacctggagacgacaagc

SEQ ID NO: 375890 - DNA, 25 bp, Homo sapien
ggagccacctggagacgacaagccg

SEQ ID NO: 375891 - DNA, 25 bp, Homo sapien
gagccacctggagacgacaagccga

SEQ ID NO: 375892 - DNA, 25 bp, Homo sapien
cacctggagacgacaagccgaggga

SEQ ID NO: 375893 - DNA, 25 bp, Homo sapien
acgacaagccgagggagagcgcctg

SEQ ID NO: 375894 - DNA, 25 bp, Homo sapien
aaggagaggcacagacactcctcat

SEQ ID NO: 375895 - DNA, 25 bp, Homo sapien
aggagaggcacagacactcctcatc

SEQ ID NO: 375896 - DNA, 25 bp, Homo sapien
ggcgggcagcagagacgcacctcac

SEQ ID NO: 375897 - DNA, 25 bp, Homo sapien
gggcagcagagacgcacctcacttc

SEQ ID NO: 375898 - DNA, 25 bp, Homo sapien
agacgcacctcacttcctagacagt

SEQ ID NO: 375899 - DNA, 25 bp, Homo sapien
gacgcacctcacttcctagacagtg

SEQ ID NO: 375900 - DNA, 25 bp, Homo sapien
gcacctcacttcctagacagtgcgg

SEQ ID NO: 375901 - DNA, 25 bp, Homo sapien
acctcacttcctagacagtgcggca

SEQ ID NO: 375902 - DNA, 25 bp, Homo sapien
ctcacttcctagacagtgcggcagc

SEQ ID NO: 375903 - DNA, 25 bp, Homo sapien
acttcctagacagtgcggcagccag

SEQ ID NO: 375904 - DNA, 25 bp, Homo sapien
cttcctagacagtgcggcagccagg

SEQ ID NO: 375905 - DNA, 25 bp, Homo sapien
acttcccagacagttgggcggccag

SEQ ID NO: 375906 - DNA, 25 bp, Homo sapien
agttgggcggccaggcaagcgctcc

SEQ ID NO: 375907 - DNA, 25 bp, Homo sapien
tgcagtcacagctacacagatcaca

SEQ ID NO: 375908 - DNA, 25 bp, Homo sapien
caaagccttcattgccttaactgga

SEQ ID NO: 375909 - DNA, 25 bp, Homo sapien
ttcattgccttaactggagccccat

SEQ ID NO: 375910 - DNA, 25 bp, Homo sapien
aatgctttgcccctgagacaaatgg

SEQ ID NO: 375911 - DNA, 25 bp, Homo sapien
ttgcccctgagacaaatggaggcct

SEQ ID NO: 375912 - DNA, 25 bp, Homo sapien
acaaatggaggcctgtcctgacctg

SEQ ID NO: 375913 - DNA, 25 bp, Homo sapien
aatggaggcctgtcctgacctgtct

SEQ ID NO: 375914 - DNA, 25 bp, Homo sapien
tgacctgtctcaccatgtacatagc

SEQ ID NO: 375915 - DNA, 25 bp, Homo sapien
tgtctcaccatgtacatagcttgat

SEQ ID NO: 375916 - DNA, 25 bp, Homo sapien
gtacatagcttgataaagggccaat

SEQ ID NO: 375917 - DNA, 25 bp, Homo sapien
taaagggccaataaatatgatgtta

SEQ ID NO: 375918 - DNA, 25 bp, Homo sapien
gtaagaggatgtcaactctccatct

SEQ ID NO: 375919 - DNA, 25 bp, Homo sapien
tgtcaactctccatctcctggcaaa

SEQ ID NO: 375920 - DNA, 25 bp, Homo sapien
tcctggcaaagagccacttgcttgt

SEQ ID NO: 375921 - DNA, 25 bp, Homo sapien
gagccacttgcttgtgcagtttaat

SEQ ID NO: 375922 - DNA, 25 bp, Homo sapien
cttgcttgtgcagtttaattttttg

SEQ ID NO: 375923 - DNA, 25 bp, Homo sapien
ttgtttgcctttatagggactgcac

SEQ ID NO: 375924 - DNA, 25 bp, Homo sapien
gggactgcacattatctaccttgaa

SEQ ID NO: 375925 - DNA, 25 bp, Homo sapien
tctaccttgaagtgctttttctggc

SEQ ID NO: 375926 - DNA, 25 bp, Homo sapien
aagtgctttttctggcagcatagtt

SEQ ID NO: 375927 - DNA, 25 bp, Homo sapien
tttctggcagcatagttactgttaa

SEQ ID NO: 375928 - DNA, 25 bp, Homo sapien
tctatctatgtccaggagtacccct

SEQ ID NO: 375929 - DNA, 25 bp, Homo sapien
actgaggcttggtcactgagtggag

SEQ ID NO: 375930 - DNA, 25 bp, Homo sapien
aagtgtggcacctgagtgtctgtct

SEQ ID NO: 375931 - DNA, 25 bp, Homo sapien
cacctgagtgtctgtcttgggagct

SEQ ID NO: 375932 - DNA, 25 bp, Homo sapien
cctgagtgtctgtcttgggagctgc

SEQ ID NO: 375933 - DNA, 25 bp, Homo sapien
agctgcaggctctcagcaggtagta

SEQ ID NO: 375934 - DNA, 25 bp, Homo sapien
tggtggtgccaggatggagagccaa

SEQ ID NO: 375935 - DNA, 25 bp, Homo sapien
gagagccaagcctagctctccagtg

SEQ ID NO: 375936 - DNA, 25 bp, Homo sapien
aagcctagctctccagtgcctgtgc

SEQ ID NO: 375937 - DNA, 25 bp, Homo sapien
agtgcctgtgctctctgctggtacc

SEQ ID NO: 375938 - DNA, 25 bp, Homo sapien
accacctcctacaggccaaagtgga

SEQ ID NO: 375939 - DNA, 25 bp, Homo sapien
ttacatgaatgaggtgtggcggcaa

SEQ ID NO: 375940 - DNA, 25 bp, Homo sapien
caaggttttcatccctatgctgttg

SEQ ID NO: 375941 - DNA, 25 bp, Homo sapien
tgctgttgttttctactacctgttt

SEQ ID NO: 375942 - DNA, 25 bp, Homo sapien
gttttactcttgttcatactgctac

SEQ ID NO: 375943 - DNA, 25 bp, Homo sapien
actttcccatgtttcctatatgcct

SEQ ID NO: 375944 - DNA, 25 bp, Homo sapien
atatgcctcccctatattggagagg

SEQ ID NO: 375945 - DNA, 25 bp, Homo sapien
ggataactcgcgtttacatatgtga

SEQ ID NO: 375946 - DNA, 25 bp, Homo sapien
taattcacagagttggctcgatcat

SEQ ID NO: 375947 - DNA, 25 bp, Homo sapien
ggctcgatcattttgagattctagt

SEQ ID NO: 375948 - DNA, 25 bp, Homo sapien
agattctagttgctttatctcaaag

SEQ ID NO: 375949 - DNA, 25 bp, Homo sapien
agctttcactgaagggctgtaactg

SEQ ID NO: 375950 - DNA, 25 bp, Homo sapien
agtcaaatctctgcattgtttcatg

SEQ ID NO: 375951 - DNA, 25 bp, Homo sapien
aaggccagatgcactggtgggcaca

SEQ ID NO: 375952 - DNA, 25 bp, Homo sapien
actggtgggcacagtgcttcgagcc

SEQ ID NO: 375953 - DNA, 25 bp, Homo sapien
tgcttcgagcctgcacaaaatgaat

SEQ ID NO: 375954 - DNA, 25 bp, Homo sapien
aagaagagttcagccatccctgggc

SEQ ID NO: 375955 - DNA, 25 bp, Homo sapien
aatgggttagttgccaatgttgtaa

SEQ ID NO: 375956 - DNA, 25 bp, Homo sapien
tgaaatctctagcttctctggaaga

SEQ ID NO: 375957 - DNA, 25 bp, Homo sapien
tctggatctgctcaaaggctgcccc

SEQ ID NO: 375958 - DNA, 25 bp, Homo sapien
aggctgccccctttagatgagacaa

SEQ ID NO: 375959 - DNA, 25 bp, Homo sapien
tggagtccttgtcctaggagcacct

SEQ ID NO: 375960 - DNA, 25 bp, Homo sapien
taggagcacctgcatgactgtggta

SEQ ID NO: 375961 - DNA, 25 bp, Homo sapien
catgactgtggtaggcagccctggt

SEQ ID NO: 375962 - DNA, 25 bp, Homo sapien
ggtgttaatggcatcctagggcaat

SEQ ID NO: 375963 - DNA, 25 bp, Homo sapien
cctagggcaatggtaggcgcctgat

SEQ ID NO: 375964 - DNA, 25 bp, Homo sapien
tttcatttatcatctggacagcccc

SEQ ID NO: 375965 - DNA, 25 bp, Homo sapien
gacagccccttcttataacgtacat

SEQ ID NO: 375966 - DNA, 25 bp, Homo sapien
ttcttataacgtacatccttgcctc

SEQ ID NO: 375967 - DNA, 25 bp, Homo sapien
atccttgcctcttctgaggctctaa

SEQ ID NO: 375968 - DNA, 25 bp, Homo sapien
gaggctctaagatccccaaggtggc

SEQ ID NO: 375969 - DNA, 25 bp, Homo sapien
caaggtggctcctgtatccagaaac

SEQ ID NO: 375970 - DNA, 25 bp, Homo sapien
ttccctcccagttaagcaagatctc

SEQ ID NO: 375971 - DNA, 25 bp, Homo sapien
ctctcttcaactcagggatgctgag

SEQ ID NO: 375972 - DNA, 25 bp, Homo sapien
gaactacacacaggaacagccaaga

SEQ ID NO: 375973 - DNA, 25 bp, Homo sapien
aagtacttctgaatgggtgaagaaa

SEQ ID NO: 375974 - DNA, 25 bp, Homo sapien
ggcactaaaatgtaccaaaagattt

SEQ ID NO: 375975 - DNA, 25 bp, Homo sapien
attttgggcccaagtgacatccaga

SEQ ID NO: 375976 - DNA, 25 bp, Homo sapien
agtgacatccagaccatttttcttt

SEQ ID NO: 375977 - DNA, 25 bp, Homo sapien
gataagggctagattaaattcaagg

SEQ ID NO: 375978 - DNA, 25 bp, Homo sapien
ggaaactcctgataaccatgttaag

SEQ ID NO: 375979 - DNA, 25 bp, Homo sapien
ttaagatcaaccacagtaggctgag

SEQ ID NO: 375980 - DNA, 25 bp, Homo sapien
gtaggctgagttttactgaaacctt

SEQ ID NO: 375981 - DNA, 25 bp, Homo sapien
tgaaaccttggtcctcttaagctac

SEQ ID NO: 375982 - DNA, 25 bp, Homo sapien
ggtcctcttaagctactacatactg

SEQ ID NO: 375983 - DNA, 25 bp, Homo sapien
tactacatactgattctattataag

SEQ ID NO: 375984 - DNA, 25 bp, Homo sapien
attgagactggccatgaccgacagc

SEQ ID NO: 375985 - DNA, 25 bp, Homo sapien
agtgcctctccctgtaggaaagtct

SEQ ID NO: 375986 - DNA, 25 bp, Homo sapien
aggaaagtctgcgtccctatcccgg

SEQ ID NO: 375987 - DNA, 25 bp, Homo sapien
agcaggccagctgtgcacaggacgt

SEQ ID NO: 375988 - DNA, 25 bp, Homo sapien
agctgtgcacaggacgtcctcattc

SEQ ID NO: 375989 - DNA, 25 bp, Homo sapien
ggacgtcctcattcccaattcagca

SEQ ID NO: 375990 - DNA, 25 bp, Homo sapien
tctaattttctcttgtggtcttggt

SEQ ID NO: 375991 - DNA, 25 bp, Homo sapien
ttttctcttgtggtcttggtaactc

SEQ ID NO: 375992 - DNA, 25 bp, Homo sapien
ttgtggtcttggtaactccattctc

SEQ ID NO: 375993 - DNA, 25 bp, Homo sapien
taactccattctccgcctataagaa

SEQ ID NO: 375994 - DNA, 25 bp, Homo sapien
cattctccgcctataagaaaccggg

SEQ ID NO: 375995 - DNA, 25 bp, Homo sapien
taaagcttgcaattttaaaagtagc

SEQ ID NO: 375996 - DNA, 25 bp, Homo sapien
aagcttgcaattttaaaagtagctc

SEQ ID NO: 375997 - DNA, 25 bp, Homo sapien
aaagtagctcacatttaatttcttg

SEQ ID NO: 375998 - DNA, 25 bp, Homo sapien
gaacatgctttaaaggaagtatttt

SEQ ID NO: 375999 - DNA, 25 bp, Homo sapien
ttttatgtgaatttgcattccagta

SEQ ID NO: 376000 - DNA, 25 bp, Homo sapien
ttatgtgaatttgcattccagtata

SEQ ID NO: 376001 - DNA, 25 bp, Homo sapien
tgtgaatttgcattccagtataaat

SEQ ID NO: 376002 - DNA, 25 bp, Homo sapien
gaatttgcattccagtataaatagt

SEQ ID NO: 376003 - DNA, 25 bp, Homo sapien
gcattccagtataaatagtattcac

SEQ ID NO: 376004 - DNA, 25 bp, Homo sapien
tattcacaaaaaagattttcctaga

SEQ ID NO: 376005 - DNA, 25 bp, Homo sapien
tcctagattttatctattgaatagg

SEQ ID NO: 376006 - DNA, 25 bp, Homo sapien
gttttaccatagttagagccaaaag

SEQ ID NO: 376007 - DNA, 25 bp, Homo sapien
agacacttgcaattgttcttgagca

SEQ ID NO: 376008 - DNA, 25 bp, Homo sapien
gagcaatgaactttcactgcagaat

SEQ ID NO: 376009 - DNA, 25 bp, Homo sapien
gcagaatttcaggttagttacaaaa

SEQ ID NO: 376010 - DNA, 25 bp, Homo sapien
gaataatcattgtgtactgcaccga

SEQ ID NO: 376011 - DNA, 25 bp, Homo sapien
gtactgcaccgatatgtgtgtatat

SEQ ID NO: 376012 - DNA, 25 bp, Homo sapien
atacgtatatacacatgctgcggtt

SEQ ID NO: 376013 - DNA, 25 bp, Homo sapien
catgctgcggttctgaatttcattt

SEQ ID NO: 376014 - DNA, 25 bp, Homo sapien
gaagtgctgacatattttagtgaag

SEQ ID NO: 376015 - DNA, 25 bp, Homo sapien
gtgaaggtcagcagttttctaactt

SEQ ID NO: 376016 - DNA, 25 bp, Homo sapien
gcagttttctaacttgtgcctaaga

SEQ ID NO: 376017 - DNA, 25 bp, Homo sapien
acagttcatgaaatgtcttccctaa

SEQ ID NO: 376018 - DNA, 25 bp, Homo sapien
atgtcttccctaatgttactgattt

SEQ ID NO: 376019 - DNA, 25 bp, Homo sapien
gttactgatttataacagcacattt

SEQ ID NO: 376020 - DNA, 25 bp, Homo sapien
acagcacatttgtaacatggttttt

SEQ ID NO: 376021 - DNA, 25 bp, Homo sapien
catggtttttatcgtgtcagtgtac

SEQ ID NO: 376022 - DNA, 25 bp, Homo sapien
tatcgtgtcagtgtaccatactgta

SEQ ID NO: 376023 - DNA, 25 bp, Homo sapien
gatgattacttgtcatgcttagtat

SEQ ID NO: 376024 - DNA, 25 bp, Homo sapien
cagggatttttgtaagtctatattt

SEQ ID NO: 376025 - DNA, 25 bp, Homo sapien
gtctatatttgaaagtccctcccta

SEQ ID NO: 376026 - DNA, 25 bp, Homo sapien
aagtccctccctatggtgatactgt

SEQ ID NO: 376027 - DNA, 25 bp, Homo sapien
ggtgatactgtgttcatgttgttta

SEQ ID NO: 376028 - DNA, 25 bp, Homo sapien
attttgcactttttccctgcttgat

SEQ ID NO: 376029 - DNA, 25 bp, Homo sapien
ttgattccaagagtaggtgctgcct

SEQ ID NO: 376030 - DNA, 25 bp, Homo sapien
actctttactcaggagggccttgca

SEQ ID NO: 376031 - DNA, 25 bp, Homo sapien
agtcctgcaccaggcctgggtgagt

SEQ ID NO: 376032 - DNA, 25 bp, Homo sapien
gggtgagtggatgcgcctcttacca

SEQ ID NO: 376033 - DNA, 25 bp, Homo sapien
gcctcttaccatatgacacgtgtca

SEQ ID NO: 376034 - DNA, 25 bp, Homo sapien
atgacacgtgtcaagatgcccttcc

SEQ ID NO: 376035 - DNA, 25 bp, Homo sapien
ggccagcactgctcgttactgtctg

SEQ ID NO: 376036 - DNA, 25 bp, Homo sapien
tactgtctgccttcagtggtctgag

SEQ ID NO: 376037 - DNA, 25 bp, Homo sapien
gaggtcccagtatgaactgccgtga

SEQ ID NO: 376038 - DNA, 25 bp, Homo sapien
tgccgtgaagtcaaaactcttatgt

SEQ ID NO: 376039 - DNA, 25 bp, Homo sapien
cctggagatcctgggtgaatggtat

SEQ ID NO: 376040 - DNA, 25 bp, Homo sapien
gatcctgggtgaatggtatctcctg

SEQ ID NO: 376041 - DNA, 25 bp, Homo sapien
atcctgggtgaatggtatctcctgc

SEQ ID NO: 376042 - DNA, 25 bp, Homo sapien
tcctgggtgaatggtatctcctgcc

SEQ ID NO: 376043 - DNA, 25 bp, Homo sapien
ctgggtgaatggtatctcctgccac

SEQ ID NO: 376044 - DNA, 25 bp, Homo sapien
tgggtgaatggtatctcctgccact

SEQ ID NO: 376045 - DNA, 25 bp, Homo sapien
gggtgaatggtatctcctgccactg

SEQ ID NO: 376046 - DNA, 25 bp, Homo sapien
gtgaatggtatctcctgccactgtc

SEQ ID NO: 376047 - DNA, 25 bp, Homo sapien
tgaatggtatctcctgccactgtcc

SEQ ID NO: 376048 - DNA, 25 bp, Homo sapien
aatggtatctcctgccactgtccca

SEQ ID NO: 376049 - DNA, 25 bp, Homo sapien
tatcatgtacaagagtgagattatc

SEQ ID NO: 376050 - DNA, 25 bp, Homo sapien
caaagcctccacatgatttcatctg

SEQ ID NO: 376051 - DNA, 25 bp, Homo sapien
gcctccacatgatttcatctgtgca

SEQ ID NO: 376052 - DNA, 25 bp, Homo sapien
atctgtgcagactctaatccactta

SEQ ID NO: 376053 - DNA, 25 bp, Homo sapien
gactctaatccacttacttaatgaa

SEQ ID NO: 376054 - DNA, 25 bp, Homo sapien
aattgcagtaaagatggttttgaca

SEQ ID NO: 376055 - DNA, 25 bp, Homo sapien
ggttttgacagaaatcatttcccgt

SEQ ID NO: 376056 - DNA, 25 bp, Homo sapien
atttcccgtatctaatactgtggta

SEQ ID NO: 376057 - DNA, 25 bp, Homo sapien
gattgattgactcatctgacgggct

SEQ ID NO: 376058 - DNA, 25 bp, Homo sapien
ttgactcatctgacgggctgggcct

SEQ ID NO: 376059 - DNA, 25 bp, Homo sapien
gctgggccttgctgaagcagtgtct

SEQ ID NO: 376060 - DNA, 25 bp, Homo sapien
gaagtcgcggcagatggctgtggca

SEQ ID NO: 376061 - DNA, 25 bp, Homo sapien
acccttggggagctgatctatcttg

SEQ ID NO: 376062 - DNA, 25 bp, Homo sapien
aaagaaccctagagagtgctgggct

SEQ ID NO: 376063 - DNA, 25 bp, Homo sapien
cctagagagtgctgggctgttccct

SEQ ID NO: 376064 - DNA, 25 bp, Homo sapien
agagtgctgggctgttcccttggct

SEQ ID NO: 376065 - DNA, 25 bp, Homo sapien
tgggctgttcccttggctgcataca

SEQ ID NO: 376066 - DNA, 25 bp, Homo sapien
ttcccttggctgcatacacagtgct

SEQ ID NO: 376067 - DNA, 25 bp, Homo sapien
tacacagtgctaatgaggtgccttc

SEQ ID NO: 376068 - DNA, 25 bp, Homo sapien
agtgctaatgaggtgccttcgggaa

SEQ ID NO: 376069 - DNA, 25 bp, Homo sapien
acctgttgttgaggcaattgttctc

SEQ ID NO: 376070 - DNA, 25 bp, Homo sapien
gaggcaattgttctcttaactgaat

SEQ ID NO: 376071 - DNA, 25 bp, Homo sapien
gttctcttaactgaattaattaggg

SEQ ID NO: 376072 - DNA, 25 bp, Homo sapien
cttctaaaacagagctcaccttctg

SEQ ID NO: 376073 - DNA, 25 bp, Homo sapien
aaacagagctcaccttctgcaacta

SEQ ID NO: 376074 - DNA, 25 bp, Homo sapien
acaacaaacttacatcaggctgatt

SEQ ID NO: 376075 - DNA, 25 bp, Homo sapien
acttacatcaggctgatttgcaaat

SEQ ID NO: 376076 - DNA, 25 bp, Homo sapien
gcaaatcacaagttttactttgttt

SEQ ID NO: 376077 - DNA, 25 bp, Homo sapien
ggttattttatttacatccacaatg

SEQ ID NO: 376078 - DNA, 25 bp, Homo sapien
acatccacaatggatagtttcagtg

SEQ ID NO: 376079 - DNA, 25 bp, Homo sapien
agtttcagtggtttgatgaaaatca

SEQ ID NO: 376080 - DNA, 25 bp, Homo sapien
tacattccttaaagttgtaccctat

SEQ ID NO: 376081 - DNA, 25 bp, Homo sapien
gttgtaccctatttgttgttacaat

SEQ ID NO: 376082 - DNA, 25 bp, Homo sapien
gtaccctatttgttgttacaataca

SEQ ID NO: 376083 - DNA, 25 bp, Homo sapien
gttcagatagaagctagatgcccat

SEQ ID NO: 376084 - DNA, 25 bp, Homo sapien
tagaagctagatgcccattactcag

SEQ ID NO: 376085 - DNA, 25 bp, Homo sapien
cttcgactaaaactatgtggtaact

SEQ ID NO: 376086 - DNA, 25 bp, Homo sapien
tcttctaggtctatggttccatggc

SEQ ID NO: 376087 - DNA, 25 bp, Homo sapien
gttccatggcaggaatcaattcaca

SEQ ID NO: 376088 - DNA, 25 bp, Homo sapien
attcacatagtgcatcttcagtcac

SEQ ID NO: 376089 - DNA, 25 bp, Homo sapien
tcttcagtcacttataatgagatca

SEQ ID NO: 376090 - DNA, 25 bp, Homo sapien
taatgagatcaacctcatgtcaatt

SEQ ID NO: 376091 - DNA, 25 bp, Homo sapien
aatgaaatgggctacttaactggaa

SEQ ID NO: 376092 - DNA, 25 bp, Homo sapien
ggctacttaactggaagtgacttcc

SEQ ID NO: 376093 - DNA, 25 bp, Homo sapien
gacttccaagtctacagagatgttc

SEQ ID NO: 376094 - DNA, 25 bp, Homo sapien
gaaagccaccaatgcaatcgacttg

SEQ ID NO: 376095 - DNA, 25 bp, Homo sapien
aattcacaagttgcctgctcaacac

SEQ ID NO: 376096 - DNA, 25 bp, Homo sapien
gtcggaagaggccagccctagttta

SEQ ID NO: 376097 - DNA, 25 bp, Homo sapien
tgcatgcccggatctggactaggac

SEQ ID NO: 376098 - DNA, 25 bp, Homo sapien
taggacatggcttccagtcagcttt

SEQ ID NO: 376099 - DNA, 25 bp, Homo sapien
gtcagcttttgctgccggcagtgat

SEQ ID NO: 376100 - DNA, 25 bp, Homo sapien
tgaagaaaggcagcggttccctctg

SEQ ID NO: 376101 - DNA, 25 bp, Homo sapien
tgctggttccttctgcactgttcag

SEQ ID NO: 376102 - DNA, 25 bp, Homo sapien
gttcagttgtcataagtccccaggg

SEQ ID NO: 376103 - DNA, 25 bp, Homo sapien
gtgtgctgacgagtttgtctgaact

SEQ ID NO: 376104 - DNA, 25 bp, Homo sapien
actgagatccgaaagctctgccagg

SEQ ID NO: 376105 - DNA, 25 bp, Homo sapien
gaaatgttagtcatgtgagttcttg

SEQ ID NO: 376106 - DNA, 25 bp, Homo sapien
aatgttagtcatgtgagttcttggg

SEQ ID NO: 376107 - DNA, 25 bp, Homo sapien
aaacttctgaaatgtagtactgtaa

SEQ ID NO: 376108 - DNA, 25 bp, Homo sapien
attatttcctgcaggaggtacaaag

SEQ ID NO: 376109 - DNA, 25 bp, Homo sapien
ttcctgcaggaggtacaaaggctgt

SEQ ID NO: 376110 - DNA, 25 bp, Homo sapien
acaaaggctgtgtgttcatttgcca

SEQ ID NO: 376111 - DNA, 25 bp, Homo sapien
aaggctgtgtgttcatttgccagac

SEQ ID NO: 376112 - DNA, 25 bp, Homo sapien
ggctgtgtgttcatttgccagacgc

SEQ ID NO: 376113 - DNA, 25 bp, Homo sapien
gctgtgtgttcatttgccagacgct

SEQ ID NO: 376114 - DNA, 25 bp, Homo sapien
tgtgttcatttgccagacgcttttt

SEQ ID NO: 376115 - DNA, 25 bp, Homo sapien
ttcatttgccagacgcttttttttt

SEQ ID NO: 376116 - DNA, 25 bp, Homo sapien
ttgctcagcaacagtaggccttcag

SEQ ID NO: 376117 - DNA, 25 bp, Homo sapien
acagtaggccttcaggatttttctt

SEQ ID NO: 376118 - DNA, 25 bp, Homo sapien
ctttgatttattgcagtggcctctg

SEQ ID NO: 376119 - DNA, 25 bp, Homo sapien
gtggcctctgaagggtcttcctcct

SEQ ID NO: 376120 - DNA, 25 bp, Homo sapien
ttcctattgagcacgttcctatcca

SEQ ID NO: 376121 - DNA, 25 bp, Homo sapien
ttcctatccattcccaatatttcag

SEQ ID NO: 376122 - DNA, 25 bp, Homo sapien
tgcaaagctttgatcagaacactct

SEQ ID NO: 376123 - DNA, 25 bp, Homo sapien
acactcttctacctacaaaatcctt

SEQ ID NO: 376124 - DNA, 25 bp, Homo sapien
ccgagcattttttgtctccagaata

SEQ ID NO: 376125 - DNA, 25 bp, Homo sapien
atatcaaccccatgtcgatctattc

SEQ ID NO: 376126 - DNA, 25 bp, Homo sapien
gtcgatctattcatattcctccttg

SEQ ID NO: 376127 - DNA, 25 bp, Homo sapien
caggatttccctatttaaaagcatc

SEQ ID NO: 376128 - DNA, 25 bp, Homo sapien
aagcatccatgaaacagttccttta

SEQ ID NO: 376129 - DNA, 25 bp, Homo sapien
tgaaacagttcctttatgccttctg

SEQ ID NO: 376130 - DNA, 25 bp, Homo sapien
atgccttctgtttaggatttccaga

SEQ ID NO: 376131 - DNA, 25 bp, Homo sapien
ggaaaccaggcttgtgccttggatc

SEQ ID NO: 376132 - DNA, 25 bp, Homo sapien
aaaatactacacttgccaaaagcaa

SEQ ID NO: 376133 - DNA, 25 bp, Homo sapien
ctgaggaatgagcattggccagtcc

SEQ ID NO: 376134 - DNA, 25 bp, Homo sapien
attggccagtcctagtatgaagtca

SEQ ID NO: 376135 - DNA, 25 bp, Homo sapien
aagttagcccttaccatttagtgct

SEQ ID NO: 376136 - DNA, 25 bp, Homo sapien
gcccttaccatttagtgcttactga

SEQ ID NO: 376137 - DNA, 25 bp, Homo sapien
tactgaatgccaacaatgcacttag

SEQ ID NO: 376138 - DNA, 25 bp, Homo sapien
ggatttgaaactcgacagttctctt

SEQ ID NO: 376139 - DNA, 25 bp, Homo sapien
cagttctcttgtatttgcttcctag

SEQ ID NO: 376140 - DNA, 25 bp, Homo sapien
tgcttcctaggtttctgcatgcaag

SEQ ID NO: 376141 - DNA, 25 bp, Homo sapien
ggtaggactgaaaaaacactgcctt

SEQ ID NO: 376142 - DNA, 25 bp, Homo sapien
acactgccttttgacttctagcatt

SEQ ID NO: 376143 - DNA, 25 bp, Homo sapien
ctagcatttagcaaccgagagtcgt

SEQ ID NO: 376144 - DNA, 25 bp, Homo sapien
ttcacttaatctgtggttctcctaa

SEQ ID NO: 376145 - DNA, 25 bp, Homo sapien
gtggttctcctaaaactattatctg

SEQ ID NO: 376146 - DNA, 25 bp, Homo sapien
ttatctgaaacctacagcatcccac

SEQ ID NO: 376147 - DNA, 25 bp, Homo sapien
acagcatcccaccatgaaatatttg

SEQ ID NO: 376148 - DNA, 25 bp, Homo sapien
tgttgtgacgtgttgcagcatgtaa

SEQ ID NO: 376149 - DNA, 25 bp, Homo sapien
caggctgctctctcgtgaatatatt

SEQ ID NO: 376150 - DNA, 25 bp, Homo sapien
gttacttttttctggcactggaata

SEQ ID NO: 376151 - DNA, 25 bp, Homo sapien
atcttttcacttcccatctgataag

SEQ ID NO: 376152 - DNA, 25 bp, Homo sapien
gaatatacaactatccatgacagca

SEQ ID NO: 376153 - DNA, 25 bp, Homo sapien
cagcaaaatttgagggccatattga

SEQ ID NO: 376154 - DNA, 25 bp, Homo sapien
gccatattgagatcaccggctgata

SEQ ID NO: 376155 - DNA, 25 bp, Homo sapien
ttaaattgcttagttccacgttaga

SEQ ID NO: 376156 - DNA, 25 bp, Homo sapien
tagtttaatcaatttctgtcccaga

SEQ ID NO: 376157 - DNA, 25 bp, Homo sapien
atctgataagtgctagctgctgatt

SEQ ID NO: 376158 - DNA, 25 bp, Homo sapien
ttttttgctcagtatctccatttat

SEQ ID NO: 376159 - DNA, 25 bp, Homo sapien
tttcatctctagagcagcgcatcag

SEQ ID NO: 376160 - DNA, 25 bp, Homo sapien
gggaggaagcacctagccccattcc

SEQ ID NO: 376161 - DNA, 25 bp, Homo sapien
gcaggtaccccagactgggaggtaa

SEQ ID NO: 376162 - DNA, 25 bp, Homo sapien
accccagactgggaggtaaggacag

SEQ ID NO: 376163 - DNA, 25 bp, Homo sapien
tgaacgtctccagcgtgggtccaac

SEQ ID NO: 376164 - DNA, 25 bp, Homo sapien
agcgtgggtccaactgagcagccat

SEQ ID NO: 376165 - DNA, 25 bp, Homo sapien
cgtgggtccaactgagcagccatgg

SEQ ID NO: 376166 - DNA, 25 bp, Homo sapien
gctggaggctggctcaaccccaaga

SEQ ID NO: 376167 - DNA, 25 bp, Homo sapien
gaggctggctcaaccccaagaccag

SEQ ID NO: 376168 - DNA, 25 bp, Homo sapien
gggagcgaggacgtctgtgcagagc

SEQ ID NO: 376169 - DNA, 25 bp, Homo sapien
gaggcagcagccatgtgtgaacaga

SEQ ID NO: 376170 - DNA, 25 bp, Homo sapien
atgtgtgaacagactgggcctcatc

SEQ ID NO: 376171 - DNA, 25 bp, Homo sapien
aagtttgatgttgtacatacctaca

SEQ ID NO: 376172 - DNA, 25 bp, Homo sapien
tacatacctacaagtaccatttttg

SEQ ID NO: 376173 - DNA, 25 bp, Homo sapien
tttttgtgcatgattacactccact

SEQ ID NO: 376174 - DNA, 25 bp, Homo sapien
catcttccaagtactgcatgtgatt

SEQ ID NO: 376175 - DNA, 25 bp, Homo sapien
agaaagtgaccacaccaaagcctcc

SEQ ID NO: 376176 - DNA, 25 bp, Homo sapien
tgtacagggatcaggtccacagtgg

SEQ ID NO: 376177 - DNA, 25 bp, Homo sapien
ggtccacagtggtgcagattcaacc

SEQ ID NO: 376178 - DNA, 25 bp, Homo sapien
tgcagattcaaccaccacccaggga

SEQ ID NO: 376179 - DNA, 25 bp, Homo sapien
cagggagtgcttgcagactctgcat

SEQ ID NO: 376180 - DNA, 25 bp, Homo sapien
agactctgcatagatgttgctgcat

SEQ ID NO: 376181 - DNA, 25 bp, Homo sapien
atagatgttgctgcatgcgtcccat

SEQ ID NO: 376182 - DNA, 25 bp, Homo sapien
atgtacatagtactggtaaccagtg

SEQ ID NO: 376183 - DNA, 25 bp, Homo sapien
aaccagtggctgcattttattcctt

SEQ ID NO: 376184 - DNA, 25 bp, Homo sapien
gctgcattttattccttgctgtgga

SEQ ID NO: 376185 - DNA, 25 bp, Homo sapien
tgctgtggactgaggtattggcttc

SEQ ID NO: 376186 - DNA, 25 bp, Homo sapien
ctgaggtattggcttcttgaatctt

SEQ ID NO: 376187 - DNA, 25 bp, Homo sapien
cagaccttatttcatacaagtgtaa

SEQ ID NO: 376188 - DNA, 25 bp, Homo sapien
ggattgcatgagagtgatggcatca

SEQ ID NO: 376189 - DNA, 25 bp, Homo sapien
gatggcatcatcatttcaattgaat

SEQ ID NO: 376190 - DNA, 25 bp, Homo sapien
tgccccaaggcaattaactctgaat

SEQ ID NO: 376191 - DNA, 25 bp, Homo sapien
ttaactctgaattgctgttctaatg

SEQ ID NO: 376192 - DNA, 25 bp, Homo sapien
gctgttctaatgtgacatatctgtg

SEQ ID NO: 376193 - DNA, 25 bp, Homo sapien
gcaaatgcacatgtcaatcaatgat

SEQ ID NO: 376194 - DNA, 25 bp, Homo sapien
caatgattaatgcacccaggttatg

SEQ ID NO: 376195 - DNA, 25 bp, Homo sapien
ttatgtacaaggcactgggcttagc

SEQ ID NO: 376196 - DNA, 25 bp, Homo sapien
tgggcttagcaccacagggaacttc

SEQ ID NO: 376197 - DNA, 25 bp, Homo sapien
agaggctcgctttctagttgtgtag

SEQ ID NO: 376198 - DNA, 25 bp, Homo sapien
atacaagacaattcacccatgccaa

SEQ ID NO: 376199 - DNA, 25 bp, Homo sapien
atacaggctgtttaagtactgcaga

SEQ ID NO: 376200 - DNA, 25 bp, Homo sapien
aaggctaccagacttttcaataagg

SEQ ID NO: 376201 - DNA, 25 bp, Homo sapien
aataaggtctacagcttcccaagag

SEQ ID NO: 376202 - DNA, 25 bp, Homo sapien
acagcttcccaagagcatgtctttg

SEQ ID NO: 376203 - DNA, 25 bp, Homo sapien
gagcatgtctttgttaaatcaggaa

SEQ ID NO: 376204 - DNA, 25 bp, Homo sapien
aagtctatgacctgaacattggcgg

SEQ ID NO: 376205 - DNA, 25 bp, Homo sapien
tgacctgaacattggcggaattatt

SEQ ID NO: 376206 - DNA, 25 bp, Homo sapien
gttctggttgtccttgctgtactgg

SEQ ID NO: 376207 - DNA, 25 bp, Homo sapien
gtccttgctgtactggccctgatca

SEQ ID NO: 376208 - DNA, 25 bp, Homo sapien
ttgggcatctgctgtgcatacagac

SEQ ID NO: 376209 - DNA, 25 bp, Homo sapien
tctgctgtgcatacagacgtggcta

SEQ ID NO: 376210 - DNA, 25 bp, Homo sapien
acagacgtggctacttcatcaacaa

SEQ ID NO: 376211 - DNA, 25 bp, Homo sapien
gacgtggctacttcatcaacaataa

SEQ ID NO: 376212 - DNA, 25 bp, Homo sapien
tggctacttcatcaacaataaacag

SEQ ID NO: 376213 - DNA, 25 bp, Homo sapien
gagggcgacttcagacacaagtcat

SEQ ID NO: 376214 - DNA, 25 bp, Homo sapien
acttcagacacaagtcatcgtttgt

SEQ ID NO: 376215 - DNA, 25 bp, Homo sapien
tttttgcttatggattttagaggtc

SEQ ID NO: 376216 - DNA, 25 bp, Homo sapien
ttttagaggtccacaaatcgaaagg

SEQ ID NO: 376217 - DNA, 25 bp, Homo sapien
tcttcatttctaaccctaaaataat

SEQ ID NO: 376218 - DNA, 25 bp, Homo sapien
aattttgttaatgagatgctgggaa

SEQ ID NO: 376219 - DNA, 25 bp, Homo sapien
aagactaccaaaaggcctcaaagct

SEQ ID NO: 376220 - DNA, 25 bp, Homo sapien
caaaaggcctcaaagctcatgcttc

SEQ ID NO: 376221 - DNA, 25 bp, Homo sapien
gcctcaaagctcatgcttctagaat

SEQ ID NO: 376222 - DNA, 25 bp, Homo sapien
tagtctttgggaagtagcatttctt

SEQ ID NO: 376223 - DNA, 25 bp, Homo sapien
agcatttcttgggaagtagcatttc

SEQ ID NO: 376224 - DNA, 25 bp, Homo sapien
gaaaatccagtgttaatgggctcta

SEQ ID NO: 376225 - DNA, 25 bp, Homo sapien
atccagtgttaatgggctctagatc

SEQ ID NO: 376226 - DNA, 25 bp, Homo sapien
gcccagagggaacatcctgccacac

SEQ ID NO: 376227 - DNA, 25 bp, Homo sapien
tggcagtagcctctttccagctaca

SEQ ID NO: 376228 - DNA, 25 bp, Homo sapien
gtagcctctttccagctacacgtcg

SEQ ID NO: 376229 - DNA, 25 bp, Homo sapien
tccagctacacgtcgctgccacagg

SEQ ID NO: 376230 - DNA, 25 bp, Homo sapien
acaggcccctggaaatgctacctac

SEQ ID NO: 376231 - DNA, 25 bp, Homo sapien
aggcccctggaaatgctacctacgt

SEQ ID NO: 376232 - DNA, 25 bp, Homo sapien
gcccctggaaatgctacctacgtgt

SEQ ID NO: 376233 - DNA, 25 bp, Homo sapien
ccctggaaatgctacctacgtgttg

SEQ ID NO: 376234 - DNA, 25 bp, Homo sapien
gagcagagcctctgcctcttgcctg

SEQ ID NO: 376235 - DNA, 25 bp, Homo sapien
tcctctcagacctaaggccgggctc

SEQ ID NO: 376236 - DNA, 25 bp, Homo sapien
ctgtgtgcactgagcttcagcagct

SEQ ID NO: 376237 - DNA, 25 bp, Homo sapien
gtagttaaccagatagtgcctttat

SEQ ID NO: 376238 - DNA, 25 bp, Homo sapien
tagtgcctttatcaggtgaacgaag

SEQ ID NO: 376239 - DNA, 25 bp, Homo sapien
gaacgaagatactcaatgccaccat

SEQ ID NO: 376240 - DNA, 25 bp, Homo sapien
atgccaccattgtttcatacacatt

SEQ ID NO: 376241 - DNA, 25 bp, Homo sapien
acacattatgtaccagatatagtca

SEQ ID NO: 376242 - DNA, 25 bp, Homo sapien
gatatagtcagatgtgttccacctt

SEQ ID NO: 376243 - DNA, 25 bp, Homo sapien
gatgtgttccaccttttcgagaaat

SEQ ID NO: 376244 - DNA, 25 bp, Homo sapien
gttccaccttttcgagaaattgcat

SEQ ID NO: 376245 - DNA, 25 bp, Homo sapien
gaaattgcatttttagaacctagag

SEQ ID NO: 376246 - DNA, 25 bp, Homo sapien
tagaacctagagaaatcacactgcc

SEQ ID NO: 376247 - DNA, 25 bp, Homo sapien
tgcctgaggccaaagataaggtaat

SEQ ID NO: 376248 - DNA, 25 bp, Homo sapien
gtcaatgtcatcatcctcgtcatcc

SEQ ID NO: 376249 - DNA, 25 bp, Homo sapien
tcgtcatcctctgctggtgtggctg

SEQ ID NO: 376250 - DNA, 25 bp, Homo sapien
tgctggtgtggctggcttcttggct

SEQ ID NO: 376251 - DNA, 25 bp, Homo sapien
tccacttggcgcatgggagatacgt

SEQ ID NO: 376252 - DNA, 25 bp, Homo sapien
catgggagatacgtgctgggtctgt

SEQ ID NO: 376253 - DNA, 25 bp, Homo sapien
ggtggccaggcgagctcttctccag

SEQ ID NO: 376254 - DNA, 25 bp, Homo sapien
ccagcttggagatggcctgctgcag

SEQ ID NO: 376255 - DNA, 25 bp, Homo sapien
tgtaccacgccacgcagactctggt

SEQ ID NO: 376256 - DNA, 25 bp, Homo sapien
agactctggttctccacttccagac

SEQ ID NO: 376257 - DNA, 25 bp, Homo sapien
atccggacgacgagctcaccgtggt

SEQ ID NO: 376258 - DNA, 25 bp, Homo sapien
gacgacgagctcaccgtggtctccg

SEQ ID NO: 376259 - DNA, 25 bp, Homo sapien
tcacgtggccgaatccctcgggctg

SEQ ID NO: 376260 - DNA, 25 bp, Homo sapien
cctcgggctgctttctctctgggct

SEQ ID NO: 376261 - DNA, 25 bp, Homo sapien
tgttttcttactgtgaacctcgtgg

SEQ ID NO: 376262 - DNA, 25 bp, Homo sapien
ttcttactgtgaacctcgtgggctc

SEQ ID NO: 376263 - DNA, 25 bp, Homo sapien
aacctcgtgggctcctgctcggtgt

SEQ ID NO: 376264 - DNA, 25 bp, Homo sapien
tgctcggtgtcctttcttactctgt

SEQ ID NO: 376265 - DNA, 25 bp, Homo sapien
gcattctattggcaagtattttatt

SEQ ID NO: 376266 - DNA, 25 bp, Homo sapien
tttactgatataactgaggatgaac

SEQ ID NO: 376267 - DNA, 25 bp, Homo sapien
ttttattacgcgttttctcctagat

SEQ ID NO: 376268 - DNA, 25 bp, Homo sapien
gcgttttctcctagattttggtatc

SEQ ID NO: 376269 - DNA, 25 bp, Homo sapien
tgctgacttgattaaacattttgga

SEQ ID NO: 376270 - DNA, 25 bp, Homo sapien
aagtcattgatactggtaaataaaa

SEQ ID NO: 376271 - DNA, 25 bp, Homo sapien
agtcattgatactggtaaataaaag

SEQ ID NO: 376272 - DNA, 25 bp, Homo sapien
gtcattgatactggtaaataaaagg

SEQ ID NO: 376273 - DNA, 25 bp, Homo sapien
cattgatactggtaaataaaagggc

SEQ ID NO: 376274 - DNA, 25 bp, Homo sapien
ttgatactggtaaataaaagggcct

SEQ ID NO: 376275 - DNA, 25 bp, Homo sapien
tgatactggtaaataaaagggcctt

SEQ ID NO: 376276 - DNA, 25 bp, Homo sapien
gggccttatttcacctgtaatccca

SEQ ID NO: 376277 - DNA, 25 bp, Homo sapien
catacacctggggtctcagctgctt

SEQ ID NO: 376278 - DNA, 25 bp, Homo sapien
atacacctggggtctcagctgcttg

SEQ ID NO: 376279 - DNA, 25 bp, Homo sapien
tacacctggggtctcagctgcttgg

SEQ ID NO: 376280 - DNA, 25 bp, Homo sapien
acacctggggtctcagctgcttggg

SEQ ID NO: 376281 - DNA, 25 bp, Homo sapien
ctgccttcggccacatggacagatt

SEQ ID NO: 376282 - DNA, 25 bp, Homo sapien
ggacagattttcatcgccatcgaga

SEQ ID NO: 376283 - DNA, 25 bp, Homo sapien
accagggctgggaagattacaggaa

SEQ ID NO: 376284 - DNA, 25 bp, Homo sapien
catcgagacgcagggcagattgctc

SEQ ID NO: 376285 - DNA, 25 bp, Homo sapien
cgcagggcagattgctcggctaatg

SEQ ID NO: 376286 - DNA, 25 bp, Homo sapien
cagattgctcggctaatgagtacat

SEQ ID NO: 376287 - DNA, 25 bp, Homo sapien
gctaatgagtacatgtcactgcgct

SEQ ID NO: 376288 - DNA, 25 bp, Homo sapien
acttgagtagtgagtgatgtcatgc

SEQ ID NO: 376289 - DNA, 25 bp, Homo sapien
cccagccctgctataatgcaactgt

SEQ ID NO: 376290 - DNA, 25 bp, Homo sapien
ataatgcaactgtcagggccccgtg

SEQ ID NO: 376291 - DNA, 25 bp, Homo sapien
aagattacaggaaagcaggcaggag

SEQ ID NO: 376292 - DNA, 25 bp, Homo sapien
ctttcaggatgcagttgtcatgttg

SEQ ID NO: 376293 - DNA, 25 bp, Homo sapien
atgttgatgccatgcttttcagtat

SEQ ID NO: 376294 - DNA, 25 bp, Homo sapien
atgcttttcagtatcgtggccatca

SEQ ID NO: 376295 - DNA, 25 bp, Homo sapien
tcgtggccatcatctgttcagtagg

SEQ ID NO: 376296 - DNA, 25 bp, Homo sapien
gcaagtgtttatttggtgtcttaag

SEQ ID NO: 376297 - DNA, 25 bp, Homo sapien
ggtgtcttaagttagcctgtgggaa

SEQ ID NO: 376298 - DNA, 25 bp, Homo sapien
ttagcctgtgggaagttctaaatca

SEQ ID NO: 376299 - DNA, 25 bp, Homo sapien
tcaggatggtacgtggttgccagca

SEQ ID NO: 376300 - DNA, 25 bp, Homo sapien
agagagctgctcctcaagtgaagga

SEQ ID NO: 376301 - DNA, 25 bp, Homo sapien
ataggaaagagcctcagatgcttat

SEQ ID NO: 376302 - DNA, 25 bp, Homo sapien
cagatgcttatatatgtaccgtggg

SEQ ID NO: 376303 - DNA, 25 bp, Homo sapien
cgaccgcagcagaagtgcacgaggt

SEQ ID NO: 376304 - DNA, 25 bp, Homo sapien
acggtcatcagggtcacaaccaact

SEQ ID NO: 376305 - DNA, 25 bp, Homo sapien
cagggtcacaaccaactgtgggctc

SEQ ID NO: 376306 - DNA, 25 bp, Homo sapien
aagagccaggcttatgttcttcttg

SEQ ID NO: 376307 - DNA, 25 bp, Homo sapien
tgcgatgctgaaggcagctgtccac

SEQ ID NO: 376308 - DNA, 25 bp, Homo sapien
tgaaggcagctgtccacatcacttg

SEQ ID NO: 376309 - DNA, 25 bp, Homo sapien
aagctgtccccgcagagacctgcag

SEQ ID NO: 376310 - DNA, 25 bp, Homo sapien
agctgtccacatcacttgctctctg

SEQ ID NO: 376311 - DNA, 25 bp, Homo sapien
gggccggtcagctccagaggaattc

SEQ ID NO: 376312 - DNA, 25 bp, Homo sapien
cggtcagctccagaggaattcatct

SEQ ID NO: 376313 - DNA, 25 bp, Homo sapien
gagctcgcggcggaggacccagagg

SEQ ID NO: 376314 - DNA, 25 bp, Homo sapien
ccttgacggccttccagagggacaa

SEQ ID NO: 376315 - DNA, 25 bp, Homo sapien
gacagtgacgtgtgtgatcctgact

SEQ ID NO: 376316 - DNA, 25 bp, Homo sapien
gtgatcctgactctgtgtaggctga

SEQ ID NO: 376317 - DNA, 25 bp, Homo sapien
gtaggctgaggctaagctctgcagt

SEQ ID NO: 376318 - DNA, 25 bp, Homo sapien
gagagtggagtcagcgtttcttctt

SEQ ID NO: 376319 - DNA, 25 bp, Homo sapien
gcgtttcttcttgctattgagcttc

SEQ ID NO: 376320 - DNA, 25 bp, Homo sapien
gataggcatctatcacttgcgctca

SEQ ID NO: 376321 - DNA, 25 bp, Homo sapien
agttccttccgttgaacatctgcaa

SEQ ID NO: 376322 - DNA, 25 bp, Homo sapien
gatgatgccaaaggcgggttcttca

SEQ ID NO: 376323 - DNA, 25 bp, Homo sapien
aggtgtcctcctaggagctggcagc

SEQ ID NO: 376324 - DNA, 25 bp, Homo sapien
atgcctgtcgttgacccttgacggc

SEQ ID NO: 376325 - DNA, 25 bp, Homo sapien
aaattattcatgtgtcccttaaaag

SEQ ID NO: 376326 - DNA, 25 bp, Homo sapien
tgtcccttaaaagtttcactacgtg

SEQ ID NO: 376327 - DNA, 25 bp, Homo sapien
accaagtgttgtggcaacagctgag

SEQ ID NO: 376328 - DNA, 25 bp, Homo sapien
tgagagagtgcaggcaccactgtgt

SEQ ID NO: 376329 - DNA, 25 bp, Homo sapien
tgttgaccgggaatgtgtcacccct

SEQ ID NO: 376330 - DNA, 25 bp, Homo sapien
tgccagggaactcttctcctcgcgg

SEQ ID NO: 376331 - DNA, 25 bp, Homo sapien
gggacttgggatggccatcagacct

SEQ ID NO: 376332 - DNA, 25 bp, Homo sapien
ggatggccatcagaccttctagggt

SEQ ID NO: 376333 - DNA, 25 bp, Homo sapien
tcatcctaggtatgggtgaccgtcc

SEQ ID NO: 376334 - DNA, 25 bp, Homo sapien
gtgaccgtccctgagacataagcga

SEQ ID NO: 376335 - DNA, 25 bp, Homo sapien
taagcgaggtagattcagccatcct

SEQ ID NO: 376336 - DNA, 25 bp, Homo sapien
tttctactgtcagaggagacccact

SEQ ID NO: 376337 - DNA, 25 bp, Homo sapien
tactgtcagaggagacccactaaaa

SEQ ID NO: 376338 - DNA, 25 bp, Homo sapien
gaggagacccactaaaaaccagaat

SEQ ID NO: 376339 - DNA, 25 bp, Homo sapien
ttctttacttaacacactgaagcta

SEQ ID NO: 376340 - DNA, 25 bp, Homo sapien
tgaagctataggtgagccatcccat

SEQ ID NO: 376341 - DNA, 25 bp, Homo sapien
agctataggtgagccatcccatgtc

SEQ ID NO: 376342 - DNA, 25 bp, Homo sapien
agccatcccatgtcagactttatac

SEQ ID NO: 376343 - DNA, 25 bp, Homo sapien
ccatcccatgtcagactttatactc

SEQ ID NO: 376344 - DNA, 25 bp, Homo sapien
tcccatgtcagactttatactcaaa

SEQ ID NO: 376345 - DNA, 25 bp, Homo sapien
atggtacgtcatagagaaaagcagc

SEQ ID NO: 376346 - DNA, 25 bp, Homo sapien
catagagaaaagcagcgtgaattat

SEQ ID NO: 376347 - DNA, 25 bp, Homo sapien
tctggaatcaccttactgtttagta

SEQ ID NO: 376348 - DNA, 25 bp, Homo sapien
aaacattcagaggacttgctacaca

SEQ ID NO: 376349 - DNA, 25 bp, Homo sapien
ttgctacacatctgggcagtctgca

SEQ ID NO: 376350 - DNA, 25 bp, Homo sapien
gggcagtctgcattgtaattcatat

SEQ ID NO: 376351 - DNA, 25 bp, Homo sapien
gtgtcttcatctgctaaagcacctt

SEQ ID NO: 376352 - DNA, 25 bp, Homo sapien
aaagcacctttgaaccatattgtaa

SEQ ID NO: 376353 - DNA, 25 bp, Homo sapien
gaagcgattcataatatctgaagca

SEQ ID NO: 376354 - DNA, 25 bp, Homo sapien
tgaagcaatccccagatacgggtta

SEQ ID NO: 376355 - DNA, 25 bp, Homo sapien
atacgggttaggcatggccctgctc

SEQ ID NO: 376356 - DNA, 25 bp, Homo sapien
ttaggcatggccctgctctgagcag

SEQ ID NO: 376357 - DNA, 25 bp, Homo sapien
aaaagtggcagtccgtgacgcagcc

SEQ ID NO: 376358 - DNA, 25 bp, Homo sapien
acgacgactggctgttgaccctgtt

SEQ ID NO: 376359 - DNA, 25 bp, Homo sapien
cctgttcaggcctcggtgaaggtga

SEQ ID NO: 376360 - DNA, 25 bp, Homo sapien
gcggctaagcggtgcgctctgaaat

SEQ ID NO: 376361 - DNA, 25 bp, Homo sapien
taagcggtgcgctctgaaatggccg

SEQ ID NO: 376362 - DNA, 25 bp, Homo sapien
ggtgcgctctgaaatggccgcttcc

SEQ ID NO: 376363 - DNA, 25 bp, Homo sapien
ggcgatatccctgagctgagagcat

SEQ ID NO: 376364 - DNA, 25 bp, Homo sapien
tgaaatggccgcttcctggaactgc

SEQ ID NO: 376365 - DNA, 25 bp, Homo sapien
tggaactgcctaagatggcggtcgc

SEQ ID NO: 376366 - DNA, 25 bp, Homo sapien
taagatggcggtcgcgggctctgct

SEQ ID NO: 376367 - DNA, 25 bp, Homo sapien
tgctgtgcagcccagccgcggcaaa

SEQ ID NO: 376368 - DNA, 25 bp, Homo sapien
caaaatccgttctctccatcgctga

SEQ ID NO: 376369 - DNA, 25 bp, Homo sapien
gagtctggactcaagggctccctgc

SEQ ID NO: 376370 - DNA, 25 bp, Homo sapien
gtcttgtagcttggaggatccaggc

SEQ ID NO: 376371 - DNA, 25 bp, Homo sapien
gtagcttggaggatccaggcatata

SEQ ID NO: 376372 - DNA, 25 bp, Homo sapien
cttggaggatccaggcatataggga

SEQ ID NO: 376373 - DNA, 25 bp, Homo sapien
atgaaatggaagctgctgcaccctg

SEQ ID NO: 376374 - DNA, 25 bp, Homo sapien
aaatggaagctgctgcaccctgctg

SEQ ID NO: 376375 - DNA, 25 bp, Homo sapien
atggaagctgctgcaccctgctggg

SEQ ID NO: 376376 - DNA, 25 bp, Homo sapien
ggagcagaccctgccatttacctgt

SEQ ID NO: 376377 - DNA, 25 bp, Homo sapien
gccatttacctgttctggcgtagaa

SEQ ID NO: 376378 - DNA, 25 bp, Homo sapien
acctgttctggcgtagaatggactg

SEQ ID NO: 376379 - DNA, 25 bp, Homo sapien
ttctggcgtagaatggactgggaat

SEQ ID NO: 376380 - DNA, 25 bp, Homo sapien
gtccacctgcactgaagcgggatga

SEQ ID NO: 376381 - DNA, 25 bp, Homo sapien
aagcgggatgatgcccacttcagat

SEQ ID NO: 376382 - DNA, 25 bp, Homo sapien
tgatgcccacttcagatccttgttt

SEQ ID NO: 376383 - DNA, 25 bp, Homo sapien
tgtttccagctgttcaggtggcaga

SEQ ID NO: 376384 - DNA, 25 bp, Homo sapien
gcagtggctgtgttttcatttagga

SEQ ID NO: 376385 - DNA, 25 bp, Homo sapien
tgtgctttaatttaggagctacctg

SEQ ID NO: 376386 - DNA, 25 bp, Homo sapien
gagctacctggagttgggccaaact

SEQ ID NO: 376387 - DNA, 25 bp, Homo sapien
gccaaactccgggttaagggcacag

SEQ ID NO: 376388 - DNA, 25 bp, Homo sapien
agggcacaggcctcctcggtagact

SEQ ID NO: 376389 - DNA, 25 bp, Homo sapien
ggtagactgcccaccctgcagacat

SEQ ID NO: 376390 - DNA, 25 bp, Homo sapien
gacatcagctgcatgttcagggctc

SEQ ID NO: 376391 - DNA, 25 bp, Homo sapien
ttaacaagcacctcccactagaaga

SEQ ID NO: 376392 - DNA, 25 bp, Homo sapien
agcacctcccactagaagaagtctg

SEQ ID NO: 376393 - DNA, 25 bp, Homo sapien
gagaaacattaccttccagattgtt

SEQ ID NO: 376394 - DNA, 25 bp, Homo sapien
ggaataactaatctggcattttgct

SEQ ID NO: 376395 - DNA, 25 bp, Homo sapien
taatctggcattttgctattaacaa

SEQ ID NO: 376396 - DNA, 25 bp, Homo sapien
cttcatcttaatttctgcgtgatct

SEQ ID NO: 376397 - DNA, 25 bp, Homo sapien
ttctgcgtgatcttttgttggttct

SEQ ID NO: 376398 - DNA, 25 bp, Homo sapien
gatcttttgttggttctgtgttact

SEQ ID NO: 376399 - DNA, 25 bp, Homo sapien
gttggttctgtgttactattttaat

SEQ ID NO: 376400 - DNA, 25 bp, Homo sapien
ttcactgctgtaaatatgtgttcgc

SEQ ID NO: 376401 - DNA, 25 bp, Homo sapien
atatgtgttcgcagattattaaata

SEQ ID NO: 376402 - DNA, 25 bp, Homo sapien
tcagatcttgttgaaagctgcgata

SEQ ID NO: 376403 - DNA, 25 bp, Homo sapien
gatcttgttgaaagctgcgatatcg

SEQ ID NO: 376404 - DNA, 25 bp, Homo sapien
ttgttgaaagctgcgatatcgacac

SEQ ID NO: 376405 - DNA, 25 bp, Homo sapien
tgaaagctgcgatatcgacactctg

SEQ ID NO: 376406 - DNA, 25 bp, Homo sapien
aaagctgcgatatcgacactctgca

SEQ ID NO: 376407 - DNA, 25 bp, Homo sapien
agctgcgatatcgacactctgcacg

SEQ ID NO: 376408 - DNA, 25 bp, Homo sapien
tgcgatatcgacactctgcacgtgc

SEQ ID NO: 376409 - DNA, 25 bp, Homo sapien
atatcgacactctgcacgtgctcct

SEQ ID NO: 376410 - DNA, 25 bp, Homo sapien
tgcacgtgctcctcaaacttggtga

SEQ ID NO: 376411 - DNA, 25 bp, Homo sapien
acgtgctcctcaaacttggtgatct

SEQ ID NO: 376412 - DNA, 25 bp, Homo sapien
tgctcctcaaacttggtgatctcct

SEQ ID NO: 376413 - DNA, 25 bp, Homo sapien
tttggctacttcctcgctttggagg

SEQ ID NO: 376414 - DNA, 25 bp, Homo sapien
aggttgctttcttctcaaggtggac

SEQ ID NO: 376415 - DNA, 25 bp, Homo sapien
aaggtggaccacctgctagaacagg

SEQ ID NO: 376416 - DNA, 25 bp, Homo sapien
ctgttcactggccagcttggagaga

SEQ ID NO: 376417 - DNA, 25 bp, Homo sapien
ttgaaaacccagacaggcttgaact

SEQ ID NO: 376418 - DNA, 25 bp, Homo sapien
gaagactgcccatgtgattctaagt

SEQ ID NO: 376419 - DNA, 25 bp, Homo sapien
gtgattctaagtcaggcccttgtga

SEQ ID NO: 376420 - DNA, 25 bp, Homo sapien
gtgactgaaccaccatgaggctgga

SEQ ID NO: 376421 - DNA, 25 bp, Homo sapien
tcgggtatcccagaggcagagcaca

SEQ ID NO: 376422 - DNA, 25 bp, Homo sapien
ggcttgaactgtaagtcacaccgga

SEQ ID NO: 376423 - DNA, 25 bp, Homo sapien
gaggcagtcccggagcacagctttg

SEQ ID NO: 376424 - DNA, 25 bp, Homo sapien
taatatgtattagtcacatcaggat

SEQ ID NO: 376425 - DNA, 25 bp, Homo sapien
gtattagtcacatcaggataaagta

SEQ ID NO: 376426 - DNA, 25 bp, Homo sapien
ggataaagtatctattaccttcagc

SEQ ID NO: 376427 - DNA, 25 bp, Homo sapien
taaagtatctattaccttcagcatt

SEQ ID NO: 376428 - DNA, 25 bp, Homo sapien
aaagtatctattaccttcagcattt

SEQ ID NO: 376429 - DNA, 25 bp, Homo sapien
gtattacaagccaattctacacttc

SEQ ID NO: 376430 - DNA, 25 bp, Homo sapien
ttacaagccaattctacacttcatt

SEQ ID NO: 376431 - DNA, 25 bp, Homo sapien
caagccaattctacacttcattatt

SEQ ID NO: 376432 - DNA, 25 bp, Homo sapien
aagccaattctacacttcattattt

SEQ ID NO: 376433 - DNA, 25 bp, Homo sapien
gccaattctacacttcattatttta

SEQ ID NO: 376434 - DNA, 25 bp, Homo sapien
aattctacacttcattattttaatg

SEQ ID NO: 376435 - DNA, 25 bp, Homo sapien
gcactgctcatttggtgttcagtca

SEQ ID NO: 376436 - DNA, 25 bp, Homo sapien
tttggtgttcagtcacatgctgttt

SEQ ID NO: 376437 - DNA, 25 bp, Homo sapien
ttttttgttagtattcctgctgtta

SEQ ID NO: 376438 - DNA, 25 bp, Homo sapien
cctgctgttatttctgagctcactt

SEQ ID NO: 376439 - DNA, 25 bp, Homo sapien
gagctcactttctagctctgtgaat

SEQ ID NO: 376440 - DNA, 25 bp, Homo sapien
ctctgtgaatacagggtcagccctt

SEQ ID NO: 376441 - DNA, 25 bp, Homo sapien
gggtcagcccttacgccacactggg

SEQ ID NO: 376442 - DNA, 25 bp, Homo sapien
ggtcccgtagatgctctttgtgcga

SEQ ID NO: 376443 - DNA, 25 bp, Homo sapien
gatgctctttgtgcgattagggaat

SEQ ID NO: 376444 - DNA, 25 bp, Homo sapien
tctccatgaaacctttcttgaccac

SEQ ID NO: 376445 - DNA, 25 bp, Homo sapien
agcccatagagctctgtcttgcaca

SEQ ID NO: 376446 - DNA, 25 bp, Homo sapien
tgtgctgtagggtacatggccggct

SEQ ID NO: 376447 - DNA, 25 bp, Homo sapien
gaatgtccaggaagtcttaactcaa

SEQ ID NO: 376448 - DNA, 25 bp, Homo sapien
ggaagtcttaactcaagccacccca

SEQ ID NO: 376449 - DNA, 25 bp, Homo sapien
accccaaggctgtgattcagaacat

SEQ ID NO: 376450 - DNA, 25 bp, Homo sapien
tcagaacattttcgtggtccgtctc

SEQ ID NO: 376451 - DNA, 25 bp, Homo sapien
aacattttcgtggtccgtctcatct

SEQ ID NO: 376452 - DNA, 25 bp, Homo sapien
tttggtttggccagcgaccgaaagc

SEQ ID NO: 376453 - DNA, 25 bp, Homo sapien
gtttggccagcgaccgaaagcagag

SEQ ID NO: 376454 - DNA, 25 bp, Homo sapien
cagagggagccaagagtcacagagt

SEQ ID NO: 376455 - DNA, 25 bp, Homo sapien
aagggcaatgtgtgccttcaacagg

SEQ ID NO: 376456 - DNA, 25 bp, Homo sapien
caatgtgtgccttcaacagggccct

SEQ ID NO: 376457 - DNA, 25 bp, Homo sapien
agttcgctagaacaaacccttctct

SEQ ID NO: 376458 - DNA, 25 bp, Homo sapien
aacccttctctcagcatttctgtta

SEQ ID NO: 376459 - DNA, 25 bp, Homo sapien
gttattaaagttcactggaatgctt

SEQ ID NO: 376460 - DNA, 25 bp, Homo sapien
tctactccctaccacaggaaatgga

SEQ ID NO: 376461 - DNA, 25 bp, Homo sapien
gaggacccctaccttttatatattg

SEQ ID NO: 376462 - DNA, 25 bp, Homo sapien
gcaacaaagctgacatctttctaaa

SEQ ID NO: 376463 - DNA, 25 bp, Homo sapien
gaatcaacattgcactaggagactg

SEQ ID NO: 376464 - DNA, 25 bp, Homo sapien
accacaggaaatggacctatctcat

SEQ ID NO: 376465 - DNA, 25 bp, Homo sapien
ggacctatctcatttaaactttact

SEQ ID NO: 376466 - DNA, 25 bp, Homo sapien
aacaatgcaggacttttcttcttaa

SEQ ID NO: 376467 - DNA, 25 bp, Homo sapien
tcttaattctcagttcgctagaaca

SEQ ID NO: 376468 - DNA, 25 bp, Homo sapien
agctgcctctcttgtcctgagggtt

SEQ ID NO: 376469 - DNA, 25 bp, Homo sapien
ctcttgtcctgagggttaggctgga

SEQ ID NO: 376470 - DNA, 25 bp, Homo sapien
ggctggagtgacagtttccgcccac

SEQ ID NO: 376471 - DNA, 25 bp, Homo sapien
gctgccggaaagaaaatgctgacca

SEQ ID NO: 376472 - DNA, 25 bp, Homo sapien
atgctgaccattggaggtgcccaac

SEQ ID NO: 376473 - DNA, 25 bp, Homo sapien
gtgcccaacagtagaatgggctact

SEQ ID NO: 376474 - DNA, 25 bp, Homo sapien
gtaagagccccatttctggaggtat

SEQ ID NO: 376475 - DNA, 25 bp, Homo sapien
aatcttgactggacagccagctctg

SEQ ID NO: 376476 - DNA, 25 bp, Homo sapien
gagattttatcagggcacttctata

SEQ ID NO: 376477 - DNA, 25 bp, Homo sapien
agggcacttctatacctgtgggaca

SEQ ID NO: 376478 - DNA, 25 bp, Homo sapien
atacctgtgggacattggactggat

SEQ ID NO: 376479 - DNA, 25 bp, Homo sapien
gagctggaaccctatggtgaactgc

SEQ ID NO: 376480 - DNA, 25 bp, Homo sapien
gctggaaccctatggtgaactgcgc

SEQ ID NO: 376481 - DNA, 25 bp, Homo sapien
catgtgaggaggttgcgcgcttctt

SEQ ID NO: 376482 - DNA, 25 bp, Homo sapien
gaggttgcgcgcttcttttgaaaac

SEQ ID NO: 376483 - DNA, 25 bp, Homo sapien
gttgcgcgcttcttttgaaaaccta

SEQ ID NO: 376484 - DNA, 25 bp, Homo sapien
gcttcttttgaaaacctaatgcctg

SEQ ID NO: 376485 - DNA, 25 bp, Homo sapien
taatgcctgatctgtcgttgttgcc

SEQ ID NO: 376486 - DNA, 25 bp, Homo sapien
ctgatctgtcgttgttgcccatcac

SEQ ID NO: 376487 - DNA, 25 bp, Homo sapien
gtcgttgttgcccatcacctccaga

SEQ ID NO: 376488 - DNA, 25 bp, Homo sapien
tcccacggatcctacattactgtga

SEQ ID NO: 376489 - DNA, 25 bp, Homo sapien
ccacggatcctacattactgtgagt

SEQ ID NO: 376490 - DNA, 25 bp, Homo sapien
caatcaagagactgtacatatgtga

SEQ ID NO: 376491 - DNA, 25 bp, Homo sapien
agacaatctaaactgtgtttctgaa

SEQ ID NO: 376492 - DNA, 25 bp, Homo sapien
catttttcttcactgtaatgttatt

SEQ ID NO: 376493 - DNA, 25 bp, Homo sapien
aatgttattttacagctgtttgtta

SEQ ID NO: 376494 - DNA, 25 bp, Homo sapien
gatcctaaaagtaacaggtttcgtg

SEQ ID NO: 376495 - DNA, 25 bp, Homo sapien
caggtttcgtgtgagtgtgcttgta

SEQ ID NO: 376496 - DNA, 25 bp, Homo sapien
tgtgagtgtgcttgtatacgtgaga

SEQ ID NO: 376497 - DNA, 25 bp, Homo sapien
atttaacgatggttccttggacagc

SEQ ID NO: 376498 - DNA, 25 bp, Homo sapien
atggttccttggacagcattctggt

SEQ ID NO: 376499 - DNA, 25 bp, Homo sapien
ttggacagcattctggtgttcagca

SEQ ID NO: 376500 - DNA, 25 bp, Homo sapien
ggtgttcagcaaccaatatggaata

SEQ ID NO: 376501 - DNA, 25 bp, Homo sapien
gtctacatttagcaacatcaggcat

SEQ ID NO: 376502 - DNA, 25 bp, Homo sapien
atcaggcatatattcacagtactct

SEQ ID NO: 376503 - DNA, 25 bp, Homo sapien
ggtaatgaacagactccacaataaa

SEQ ID NO: 376504 - DNA, 25 bp, Homo sapien
gactcgaagtgggtaatcggcatct

SEQ ID NO: 376505 - DNA, 25 bp, Homo sapien
taatcggcatctaacttggcactgt

SEQ ID NO: 376506 - DNA, 25 bp, Homo sapien
taacttggcactgttccttgggtct

SEQ ID NO: 376507 - DNA, 25 bp, Homo sapien
ttccttgggtctcctttgcagtcag

SEQ ID NO: 376508 - DNA, 25 bp, Homo sapien
tcagccccgctggattcagaaatgt

SEQ ID NO: 376509 - DNA, 25 bp, Homo sapien
atttcacaaacccaggcggtcgcac

SEQ ID NO: 376510 - DNA, 25 bp, Homo sapien
gtatcgccagctgaaccaacacatg

SEQ ID NO: 376511 - DNA, 25 bp, Homo sapien
tgaaccaacacatgcaactcgtctc

SEQ ID NO: 376512 - DNA, 25 bp, Homo sapien
cagacaagtagttttcttttcagca

SEQ ID NO: 376513 - DNA, 25 bp, Homo sapien
gcaaatatttaacatatctctcaat

SEQ ID NO: 376514 - DNA, 25 bp, Homo sapien
tatctctcaatatatttttcaccag

SEQ ID NO: 376515 - DNA, 25 bp, Homo sapien
gtgaagtaccatagaccatattgtc

SEQ ID NO: 376516 - DNA, 25 bp, Homo sapien
gaccatattgtctagatgggacaaa

SEQ ID NO: 376517 - DNA, 25 bp, Homo sapien
gagaagacaataactgacaagtctg

SEQ ID NO: 376518 - DNA, 25 bp, Homo sapien
acaagtctgtgatttttgggttaga

SEQ ID NO: 376519 - DNA, 25 bp, Homo sapien
tttgggttagatgagaccacttttg

SEQ ID NO: 376520 - DNA, 25 bp, Homo sapien
gagaccacttttgatttttgaggaa

SEQ ID NO: 376521 - DNA, 25 bp, Homo sapien
tttggtcctgatgtgtaaaatgatt

SEQ ID NO: 376522 - DNA, 25 bp, Homo sapien
gggtttcacatacagacaagtagtt

SEQ ID NO: 376523 - DNA, 25 bp, Homo sapien
aaacgtagcaagcttgtgtgcccac

SEQ ID NO: 376524 - DNA, 25 bp, Homo sapien
aggcaagccgaacccgagataccat

SEQ ID NO: 376525 - DNA, 25 bp, Homo sapien
gagataccattttccgtttgcaggg

SEQ ID NO: 376526 - DNA, 25 bp, Homo sapien
ctggagatccacacgagggcgcgct

SEQ ID NO: 376527 - DNA, 25 bp, Homo sapien
gagggcgcgctcacgttccagaagc

SEQ ID NO: 376528 - DNA, 25 bp, Homo sapien
tccagaagccgcgtttgaccaagag

SEQ ID NO: 376529 - DNA, 25 bp, Homo sapien
aagaggccgcggtaccttgtctgtc

SEQ ID NO: 376530 - DNA, 25 bp, Homo sapien
cttgtctgtccaacactggattcta

SEQ ID NO: 376531 - DNA, 25 bp, Homo sapien
actggattctaataggcgacctcaa

SEQ ID NO: 376532 - DNA, 25 bp, Homo sapien
accccttagaaacaggcggcagcta

SEQ ID NO: 376533 - DNA, 25 bp, Homo sapien
aggtgtttgctagtttatttgttct

SEQ ID NO: 376534 - DNA, 25 bp, Homo sapien
tcaaggctctgtttgatgtcctggc

SEQ ID NO: 376535 - DNA, 25 bp, Homo sapien
tggcccatccccagaactatttcaa

SEQ ID NO: 376536 - DNA, 25 bp, Homo sapien
gagtcccgagagatgtttccaagat

SEQ ID NO: 376537 - DNA, 25 bp, Homo sapien
aagatcgttcatccgattgctacgt

SEQ ID NO: 376538 - DNA, 25 bp, Homo sapien
gattgctacgttccaaagtgtccag

SEQ ID NO: 376539 - DNA, 25 bp, Homo sapien
tgtccaggtttttgagaccttacaa

SEQ ID NO: 376540 - DNA, 25 bp, Homo sapien
agaccttacaaatgactcagcccac

SEQ ID NO: 376541 - DNA, 25 bp, Homo sapien
cgtgccactcaatacaaatgttctg

SEQ ID NO: 376542 - DNA, 25 bp, Homo sapien
gggacagagctgtcttccttctgca

SEQ ID NO: 376543 - DNA, 25 bp, Homo sapien
ttctgcatgtcagcacagtcgggta

SEQ ID NO: 376544 - DNA, 25 bp, Homo sapien
gtattgctgcctcccgtatcagtga

SEQ ID NO: 376545 - DNA, 25 bp, Homo sapien
agctgctaacagagaagcccctcat

SEQ ID NO: 376546 - DNA, 25 bp, Homo sapien
cagagaagcccctcatcctgtacga

SEQ ID NO: 376547 - DNA, 25 bp, Homo sapien
tcatcctgtacgaccagtgcagaga

SEQ ID NO: 376548 - DNA, 25 bp, Homo sapien
gaccagtgcagagaaacgatcccct

SEQ ID NO: 376549 - DNA, 25 bp, Homo sapien
tgcagagaaacgatcccctcgaatg

SEQ ID NO: 376550 - DNA, 25 bp, Homo sapien
ccctcgaatgcttcctagtggagtt

SEQ ID NO: 376551 - DNA, 25 bp, Homo sapien
agaaattttttgttgatcgtgcctt

SEQ ID NO: 376552 - DNA, 25 bp, Homo sapien
tttgttgatcgtgcctttgaactaa

SEQ ID NO: 376553 - DNA, 25 bp, Homo sapien
gatcgtgcctttgaactaaggtcat

SEQ ID NO: 376554 - DNA, 25 bp, Homo sapien
gttcctctgagggaaacagacttat

SEQ ID NO: 376555 - DNA, 25 bp, Homo sapien
cacagaagggacctaatggtttact

SEQ ID NO: 376556 - DNA, 25 bp, Homo sapien
agcatgattctgtttccgtattttc

SEQ ID NO: 376557 - DNA, 25 bp, Homo sapien
tcactttttggtatgctgcggcaca

SEQ ID NO: 376558 - DNA, 25 bp, Homo sapien
gctgcggcacatttagaacatgatc

SEQ ID NO: 376559 - DNA, 25 bp, Homo sapien
gaacatgatctgtctggaggtttta

SEQ ID NO: 376560 - DNA, 25 bp, Homo sapien
ggttttattcacatggtggcctgcc

SEQ ID NO: 376561 - DNA, 25 bp, Homo sapien
tgcccttcagggagaacttgcttgc

SEQ ID NO: 376562 - DNA, 25 bp, Homo sapien
aacttgcttgccttctttctttggc

SEQ ID NO: 376563 - DNA, 25 bp, Homo sapien
tttggcagtttggatttgacctagc

SEQ ID NO: 376564 - DNA, 25 bp, Homo sapien
cctagccctgtggtatgtgcaagta

SEQ ID NO: 376565 - DNA, 25 bp, Homo sapien
atttccttctttagtagttagagca

SEQ ID NO: 376566 - DNA, 25 bp, Homo sapien
atagttaacacgatgcagaagtcaa

SEQ ID NO: 376567 - DNA, 25 bp, Homo sapien
aagacaacagcagttgccatccctg

SEQ ID NO: 376568 - DNA, 25 bp, Homo sapien
gacaacagcagttgccatccctgga

SEQ ID NO: 376569 - DNA, 25 bp, Homo sapien
aacagcagttgccatccctggacag

SEQ ID NO: 376570 - DNA, 25 bp, Homo sapien
agcagttgccatccctggacagggt

SEQ ID NO: 376571 - DNA, 25 bp, Homo sapien
agttgccatccctggacagggtgaa

SEQ ID NO: 376572 - DNA, 25 bp, Homo sapien
tccctggacagggtgaacattggct

SEQ ID NO: 376573 - DNA, 25 bp, Homo sapien
cagggtgaacattggctgtggctat

SEQ ID NO: 376574 - DNA, 25 bp, Homo sapien
accagtgtctccgtggatgtctggt

SEQ ID NO: 376575 - DNA, 25 bp, Homo sapien
agtgtctccgtggatgtctggtaca

SEQ ID NO: 376576 - DNA, 25 bp, Homo sapien
tgtctccgtggatgtctggtacatc

SEQ ID NO: 376577 - DNA, 25 bp, Homo sapien
gagcacggcaggttagtgagcgctt

SEQ ID NO: 376578 - DNA, 25 bp, Homo sapien
atactgttttctgtttagtcctcaa

SEQ ID NO: 376579 - DNA, 25 bp, Homo sapien
tagtcctcaatcttcctaactcaaa

SEQ ID NO: 376580 - DNA, 25 bp, Homo sapien
tggttacccctgttaccgtgccata

SEQ ID NO: 376581 - DNA, 25 bp, Homo sapien
ttaccgtgccatattcttcttgctg

SEQ ID NO: 376582 - DNA, 25 bp, Homo sapien
gcttttcaaccccacgtgattgttg

SEQ ID NO: 376583 - DNA, 25 bp, Homo sapien
gattgttgattgacggttctgctat

SEQ ID NO: 376584 - DNA, 25 bp, Homo sapien
ggttctgctataatgtgcgtgccct

SEQ ID NO: 376585 - DNA, 25 bp, Homo sapien
tgtgcgtgcccttcaagtttcagaa

SEQ ID NO: 376586 - DNA, 25 bp, Homo sapien
aaactttcccaatcatttcacttca

SEQ ID NO: 376587 - DNA, 25 bp, Homo sapien
attattttctccgaacgtgtttgtg

SEQ ID NO: 376588 - DNA, 25 bp, Homo sapien
acgtgtttgtgatcttctgttatat

SEQ ID NO: 376589 - DNA, 25 bp, Homo sapien
taagatgtttatttggctctcagtt

SEQ ID NO: 376590 - DNA, 25 bp, Homo sapien
cagtctgtacaagaagtgcattgcc

SEQ ID NO: 376591 - DNA, 25 bp, Homo sapien
caagaagtgcattgccagcatcagc

SEQ ID NO: 376592 - DNA, 25 bp, Homo sapien
gaaacttacagccttggcagaaagt

SEQ ID NO: 376593 - DNA, 25 bp, Homo sapien
gggagccggcatgtcatgtggccag

SEQ ID NO: 376594 - DNA, 25 bp, Homo sapien
ggaggtggccacatgcttttaaaca

SEQ ID NO: 376595 - DNA, 25 bp, Homo sapien
ggttgaacagcaagattttccccta

SEQ ID NO: 376596 - DNA, 25 bp, Homo sapien
attttcccctatgcatggtgtgtta

SEQ ID NO: 376597 - DNA, 25 bp, Homo sapien
ccctatgcatggtgtgttagtcctt

SEQ ID NO: 376598 - DNA, 25 bp, Homo sapien
catggtgtgttagtcctttgtgcat

SEQ ID NO: 376599 - DNA, 25 bp, Homo sapien
gttagtcctttgtgcattgctataa

SEQ ID NO: 376600 - DNA, 25 bp, Homo sapien
aatttgcccaaggtcttccagcaag

SEQ ID NO: 376601 - DNA, 25 bp, Homo sapien
caaggtcttccagcaagtaagggct

SEQ ID NO: 376602 - DNA, 25 bp, Homo sapien
agtactatgttcagtccttggttta

SEQ ID NO: 376603 - DNA, 25 bp, Homo sapien
gagggccccggttctttactgctgg

SEQ ID NO: 376604 - DNA, 25 bp, Homo sapien
ctttactgctggatgtgttaacaca

SEQ ID NO: 376605 - DNA, 25 bp, Homo sapien
gtgttaacacacctgtttattagac

SEQ ID NO: 376606 - DNA, 25 bp, Homo sapien
gtttattagaccattgacagcaatc

SEQ ID NO: 376607 - DNA, 25 bp, Homo sapien
aatatgcaagaagcctggtgctaat

SEQ ID NO: 376608 - DNA, 25 bp, Homo sapien
tccttggtttaaattgacttctgta

SEQ ID NO: 376609 - DNA, 25 bp, Homo sapien
gacttctgtaagtttcacaactggc

SEQ ID NO: 376610 - DNA, 25 bp, Homo sapien
agtttcacaactggcccatgaggtg

SEQ ID NO: 376611 - DNA, 25 bp, Homo sapien
aactgctggcacctgatgtttgagc

SEQ ID NO: 376612 - DNA, 25 bp, Homo sapien
agctatttttgtacctgtctcttct

SEQ ID NO: 376613 - DNA, 25 bp, Homo sapien
gtacctgtctcttctcaaactagat

SEQ ID NO: 376614 - DNA, 25 bp, Homo sapien
ctagatgataagtggcctcagggca

SEQ ID NO: 376615 - DNA, 25 bp, Homo sapien
tggcctcagggcagggactacatac

SEQ ID NO: 376616 - DNA, 25 bp, Homo sapien
gactacatactcctgagagctgctt

SEQ ID NO: 376617 - DNA, 25 bp, Homo sapien
gctgcttgagctcgaggtgtttatt

SEQ ID NO: 376618 - DNA, 25 bp, Homo sapien
tcccctcaatttacctgtgtctaaa

SEQ ID NO: 376619 - DNA, 25 bp, Homo sapien
tttacctgtgtctaaactttggtga

SEQ ID NO: 376620 - DNA, 25 bp, Homo sapien
ttggtgaattattctcccatctgcc

SEQ ID NO: 376621 - DNA, 25 bp, Homo sapien
gtggaatgcatcaagttcaaggtct

SEQ ID NO: 376622 - DNA, 25 bp, Homo sapien
ctcctccccaaagagtacgttgtgt

SEQ ID NO: 376623 - DNA, 25 bp, Homo sapien
tccccaaagagtacgttgtgtagtg

SEQ ID NO: 376624 - DNA, 25 bp, Homo sapien
agtagcaaacggacccaaagatgaa

SEQ ID NO: 376625 - DNA, 25 bp, Homo sapien
aaaagccaccagatttgttgcaacg

SEQ ID NO: 376626 - DNA, 25 bp, Homo sapien
gccaccagatttgttgcaacgttga

SEQ ID NO: 376627 - DNA, 25 bp, Homo sapien
gcaacgttgatgtaaacctggccgt

SEQ ID NO: 376628 - DNA, 25 bp, Homo sapien
tgatgtaaacctggccgtcttcctg

SEQ ID NO: 376629 - DNA, 25 bp, Homo sapien
acctggccgtcttcctgaaccagtg

SEQ ID NO: 376630 - DNA, 25 bp, Homo sapien
gagcccctggaatagactcataaaa

SEQ ID NO: 376631 - DNA, 25 bp, Homo sapien
gttagcacataccattgaattcact

SEQ ID NO: 376632 - DNA, 25 bp, Homo sapien
ttgaattcactgagacacatgagaa

SEQ ID NO: 376633 - DNA, 25 bp, Homo sapien
ggcgggagaaggctgtgcacaggct

SEQ ID NO: 376634 - DNA, 25 bp, Homo sapien
gaaggctgtgcacaggctgcgggta

SEQ ID NO: 376635 - DNA, 25 bp, Homo sapien
aggctgtgcacaggctgcgggtaca

SEQ ID NO: 376636 - DNA, 25 bp, Homo sapien
acaggctgcgggtacagcaggccgc

SEQ ID NO: 376637 - DNA, 25 bp, Homo sapien
gcgggtacagcaggccgcgttgcgg

SEQ ID NO: 376638 - DNA, 25 bp, Homo sapien
agctgttccggctgcgcgggatcaa

SEQ ID NO: 376639 - DNA, 25 bp, Homo sapien
ggctgcgcgggatcaaggcccaggt

SEQ ID NO: 376640 - DNA, 25 bp, Homo sapien
tgcgcgggatcaaggcccaggtggc

SEQ ID NO: 376641 - DNA, 25 bp, Homo sapien
gggatgccgaggtctgtcccacgcc

SEQ ID NO: 376642 - DNA, 25 bp, Homo sapien
gcccgcctggccaccacagagaaga

SEQ ID NO: 376643 - DNA, 25 bp, Homo sapien
cagagaagaagacggagcagcagcg

SEQ ID NO: 376644 - DNA, 25 bp, Homo sapien
cgatgacctggtactttacgtagga

SEQ ID NO: 376645 - DNA, 25 bp, Homo sapien
tttacgtaggatttcccatcagcct

SEQ ID NO: 376646 - DNA, 25 bp, Homo sapien
atcagcctctgtcctgtgggcagac

SEQ ID NO: 376647 - DNA, 25 bp, Homo sapien
tgtcctgtgggcagacccaggcaca

SEQ ID NO: 376648 - DNA, 25 bp, Homo sapien
gggcctggatgaacccaaagccacc

SEQ ID NO: 376649 - DNA, 25 bp, Homo sapien
tgatctgtcctctaacttctgtcaa

SEQ ID NO: 376650 - DNA, 25 bp, Homo sapien
taacttctgtcaacctgcaggacca

SEQ ID NO: 376651 - DNA, 25 bp, Homo sapien
tcactgtgagacttctgtagcctgc

SEQ ID NO: 376652 - DNA, 25 bp, Homo sapien
aactctctccagggtggttaactct

SEQ ID NO: 376653 - DNA, 25 bp, Homo sapien
tctgttttccttatgcccaacactg

SEQ ID NO: 376654 - DNA, 25 bp, Homo sapien
gagtgggcgacaataaacgctgcta

SEQ ID NO: 376655 - DNA, 25 bp, Homo sapien
ggaccgtcttccttggatttagtga

SEQ ID NO: 376656 - DNA, 25 bp, Homo sapien
tccttggatttagtgaacccctttg

SEQ ID NO: 376657 - DNA, 25 bp, Homo sapien
gagtatctaggacatagtccccaga

SEQ ID NO: 376658 - DNA, 25 bp, Homo sapien
tggctgagcatataaccataggtat

SEQ ID NO: 376659 - DNA, 25 bp, Homo sapien
aaagtcactgtatcaattgccatga

SEQ ID NO: 376660 - DNA, 25 bp, Homo sapien
cttgagggacctgaatctaccgatt

SEQ ID NO: 376661 - DNA, 25 bp, Homo sapien
taccgattcatcttaaggcagcagg

SEQ ID NO: 376662 - DNA, 25 bp, Homo sapien
ttaaggcagcaggaccagtttgagt

SEQ ID NO: 376663 - DNA, 25 bp, Homo sapien
gaccagtttgagtggcaacaatgca

SEQ ID NO: 376664 - DNA, 25 bp, Homo sapien
aacaatgcagcagcagaatcaatgg

SEQ ID NO: 376665 - DNA, 25 bp, Homo sapien
tgataaaagggaccgtcttccttgg

SEQ ID NO: 376666 - DNA, 25 bp, Homo sapien
gtatatatcccctttgttaactgca

SEQ ID NO: 376667 - DNA, 25 bp, Homo sapien
tgttaactgcacctgagcctgacat

SEQ ID NO: 376668 - DNA, 25 bp, Homo sapien
agcctgacatcctaccattcacatt

SEQ ID NO: 376669 - DNA, 25 bp, Homo sapien
aacattgtccatatactgtttggta

SEQ ID NO: 376670 - DNA, 25 bp, Homo sapien
tatgtctgtcatgaacagcggcagc

SEQ ID NO: 376671 - DNA, 25 bp, Homo sapien
acagcggcagcaatgaaaaccagga

SEQ ID NO: 376672 - DNA, 25 bp, Homo sapien
gttctatggaggttttacgccactg

SEQ ID NO: 376673 - DNA, 25 bp, Homo sapien
gtaaatttctctatgtgaggctgaa

SEQ ID NO: 376674 - DNA, 25 bp, Homo sapien
gctgaaaggttaggtcctggaaaat

SEQ ID NO: 376675 - DNA, 25 bp, Homo sapien
ggtctgtaagcaccagaaatgtcca

SEQ ID NO: 376676 - DNA, 25 bp, Homo sapien
gaaatgtccaaaagtatatatcccc

SEQ ID NO: 376677 - DNA, 25 bp, Homo sapien
aacaagccagttagcaaacagtcct

SEQ ID NO: 376678 - DNA, 25 bp, Homo sapien
gccagttagcaaacagtcctggaaa

SEQ ID NO: 376679 - DNA, 25 bp, Homo sapien
gaatggtttaattccggtcttcaca

SEQ ID NO: 376680 - DNA, 25 bp, Homo sapien
ggtttaattccggtcttcacatatt

SEQ ID NO: 376681 - DNA, 25 bp, Homo sapien
aattccggtcttcacatattctaaa

SEQ ID NO: 376682 - DNA, 25 bp, Homo sapien
aagcctctaagtataaaatcagtga

SEQ ID NO: 376683 - DNA, 25 bp, Homo sapien
ctgttaatgtagtaaatgttggctt

SEQ ID NO: 376684 - DNA, 25 bp, Homo sapien
ggctttaaagaaatagctccgataa

SEQ ID NO: 376685 - DNA, 25 bp, Homo sapien
atagctccgataaggactttttaga

SEQ ID NO: 376686 - DNA, 25 bp, Homo sapien
aaaacaggtggttggctgcattttt

SEQ ID NO: 376687 - DNA, 25 bp, Homo sapien
aggtggttggctgcattttttaagc

SEQ ID NO: 376688 - DNA, 25 bp, Homo sapien
acccactactggcataacagaagaa

SEQ ID NO: 376689 - DNA, 25 bp, Homo sapien
agcacaattggcaggttatcacttt

SEQ ID NO: 376690 - DNA, 25 bp, Homo sapien
ttatcactttccagtcgttccaata

SEQ ID NO: 376691 - DNA, 25 bp, Homo sapien
gaattttacatgtgcaatgttcctg

SEQ ID NO: 376692 - DNA, 25 bp, Homo sapien
ctgactgcaatgaagaaaaggcctt

SEQ ID NO: 376693 - DNA, 25 bp, Homo sapien
aaaggccttctggagatttctgttt

SEQ ID NO: 376694 - DNA, 25 bp, Homo sapien
tttttaagcacattctccttccatc

SEQ ID NO: 376695 - DNA, 25 bp, Homo sapien
cttccatccacatatttacatcctt

SEQ ID NO: 376696 - DNA, 25 bp, Homo sapien
cattcaagattggttctgattcttt

SEQ ID NO: 376697 - DNA, 25 bp, Homo sapien
acagtttaagcacttggttcctcag

SEQ ID NO: 376698 - DNA, 25 bp, Homo sapien
gcacttggttcctcagttggataac

SEQ ID NO: 376699 - DNA, 25 bp, Homo sapien
gagactcgccagttttttctaatca

SEQ ID NO: 376700 - DNA, 25 bp, Homo sapien
agttttttctaatcagctgcctgaa

SEQ ID NO: 376701 - DNA, 25 bp, Homo sapien
agctgcctgaaagcggttcagagtt

SEQ ID NO: 376702 - DNA, 25 bp, Homo sapien
agttctgtcaacaagcccttgcacg

SEQ ID NO: 376703 - DNA, 25 bp, Homo sapien
cccttgcacgctgggcttattaatg

SEQ ID NO: 376704 - DNA, 25 bp, Homo sapien
gcttattaatgctgggccactcaga

SEQ ID NO: 376705 - DNA, 25 bp, Homo sapien
gccactcagagccatgactcaggaa

SEQ ID NO: 376706 - DNA, 25 bp, Homo sapien
gaaacaggcttttggaacttaatgc

SEQ ID NO: 376707 - DNA, 25 bp, Homo sapien
agacagccctactcaggttcctggt

SEQ ID NO: 376708 - DNA, 25 bp, Homo sapien
cctggtctctgttctcatgttctga

SEQ ID NO: 376709 - DNA, 25 bp, Homo sapien
cactcaacttggagactcgccagtt

SEQ ID NO: 376710 - DNA, 25 bp, Homo sapien
tagtgttaggatcagtgttactcaa

SEQ ID NO: 376711 - DNA, 25 bp, Homo sapien
gatcagtgttactcaaagtgttgta

SEQ ID NO: 376712 - DNA, 25 bp, Homo sapien
caagcatttaaatcacattgtttga

SEQ ID NO: 376713 - DNA, 25 bp, Homo sapien
cattgtttgaaaactgggatctaca

SEQ ID NO: 376714 - DNA, 25 bp, Homo sapien
gaaaactgggatctacaaaaaatat

SEQ ID NO: 376715 - DNA, 25 bp, Homo sapien
aaaggcaagggaatgttcagtgaat

SEQ ID NO: 376716 - DNA, 25 bp, Homo sapien
aaatattcagactggagggttccta

SEQ ID NO: 376717 - DNA, 25 bp, Homo sapien
tcagactggagggttcctaactttt

SEQ ID NO: 376718 - DNA, 25 bp, Homo sapien
taatacttaagcagggtctttacca

SEQ ID NO: 376719 - DNA, 25 bp, Homo sapien
ttaagcagggtctttaccacagagt

SEQ ID NO: 376720 - DNA, 25 bp, Homo sapien
gcagggtctttaccacagagttaaa

SEQ ID NO: 376721 - DNA, 25 bp, Homo sapien
gcatgtcccttttttactgtaatat

SEQ ID NO: 376722 - DNA, 25 bp, Homo sapien
ttttctatcccttattttatcccat

SEQ ID NO: 376723 - DNA, 25 bp, Homo sapien
atcccttattttatcccatggttat

SEQ ID NO: 376724 - DNA, 25 bp, Homo sapien
atcccatggttattaatgattgtca

SEQ ID NO: 376725 - DNA, 25 bp, Homo sapien
aatgattgtcatatagaagggtgtc

SEQ ID NO: 376726 - DNA, 25 bp, Homo sapien
gaagggtgtcattaatcagatttcc

SEQ ID NO: 376727 - DNA, 25 bp, Homo sapien
attaatcagatttccctgacacctg

SEQ ID NO: 376728 - DNA, 25 bp, Homo sapien
gtgaaaaggtcttgaaaattatctg

SEQ ID NO: 376729 - DNA, 25 bp, Homo sapien
aattatctgacttttcacagcttct

SEQ ID NO: 376730 - DNA, 25 bp, Homo sapien
tatctgacttttcacagcttctttc

SEQ ID NO: 376731 - DNA, 25 bp, Homo sapien
tcattctttctagtcctttcttcaa

SEQ ID NO: 376732 - DNA, 25 bp, Homo sapien
ggtagagcagccctcagactcagac

SEQ ID NO: 376733 - DNA, 25 bp, Homo sapien
tcagactcagaccatttcacttctg

SEQ ID NO: 376734 - DNA, 25 bp, Homo sapien
gaccatttcacttctgaattctggg

SEQ ID NO: 376735 - DNA, 25 bp, Homo sapien
ttctcaaaaccagaaggtgcgctgc

SEQ ID NO: 376736 - DNA, 25 bp, Homo sapien
aggtgcgctgcattgggtctgagag

SEQ ID NO: 376737 - DNA, 25 bp, Homo sapien
gggccacttgtgagatcagggactt

SEQ ID NO: 376738 - DNA, 25 bp, Homo sapien
gtgagatcagggacttgcaaacaag

SEQ ID NO: 376739 - DNA, 25 bp, Homo sapien
aacaagtgcctatgagggccagaca

SEQ ID NO: 376740 - DNA, 25 bp, Homo sapien
atattactgagcacttaactttgca

SEQ ID NO: 376741 - DNA, 25 bp, Homo sapien
ctcagcctgagtccagagaggtaaa

SEQ ID NO: 376742 - DNA, 25 bp, Homo sapien
ccacaggtagtaagggtagagcagc

SEQ ID NO: 376743 - DNA, 25 bp, Homo sapien
gaagtatggctcagtcttactcttg

SEQ ID NO: 376744 - DNA, 25 bp, Homo sapien
cagtgagaggtgacctgctgacatc

SEQ ID NO: 376745 - DNA, 25 bp, Homo sapien
tgctgacatccctcaagtgacagag

SEQ ID NO: 376746 - DNA, 25 bp, Homo sapien
gacatccctcaagtgacagagtcaa

SEQ ID NO: 376747 - DNA, 25 bp, Homo sapien
gacagagtcaattcatgtctccaaa

SEQ ID NO: 376748 - DNA, 25 bp, Homo sapien
gagtcaattcatgtctccaaagaga

SEQ ID NO: 376749 - DNA, 25 bp, Homo sapien
aaaagcatatccctcctccaagaga

SEQ ID NO: 376750 - DNA, 25 bp, Homo sapien
gcatatccctcctccaagagaaaat

SEQ ID NO: 376751 - DNA, 25 bp, Homo sapien
tgtgctggttttgggtcaccccccg

SEQ ID NO: 376752 - DNA, 25 bp, Homo sapien
tgcgggctgttagcctgcatgcctg

SEQ ID NO: 376753 - DNA, 25 bp, Homo sapien
gttagcctgcatgcctgggctcctg

SEQ ID NO: 376754 - DNA, 25 bp, Homo sapien
gaaaaatactcgtacggcctctgaa

SEQ ID NO: 376755 - DNA, 25 bp, Homo sapien
cctctgaaccatcagctcaactaag

SEQ ID NO: 376756 - DNA, 25 bp, Homo sapien
gctcaactaagctatgccagcactg

SEQ ID NO: 376757 - DNA, 25 bp, Homo sapien
atgccagcactggacgagagtttgc

SEQ ID NO: 376758 - DNA, 25 bp, Homo sapien
tggacgagagtttgcagcctttttt

SEQ ID NO: 376759 - DNA, 25 bp, Homo sapien
gtttgcagccttttttgccaagaag

SEQ ID NO: 376760 - DNA, 25 bp, Homo sapien
ctcttttcaagttcgaatcgtcctc

SEQ ID NO: 376761 - DNA, 25 bp, Homo sapien
aatcgtcctcccatgccatcagtat

SEQ ID NO: 376762 - DNA, 25 bp, Homo sapien
atgccatcagtatgagcgcctatct

SEQ ID NO: 376763 - DNA, 25 bp, Homo sapien
gagcgcctatctgcgagaacagaga

SEQ ID NO: 376764 - DNA, 25 bp, Homo sapien
acagagaagggagctctatagtcgg

SEQ ID NO: 376765 - DNA, 25 bp, Homo sapien
gggataattataaaatcagccttct

SEQ ID NO: 376766 - DNA, 25 bp, Homo sapien
atcagccttctaaagctattatgag

SEQ ID NO: 376767 - DNA, 25 bp, Homo sapien
aaatgagatgatacccagaaagaac

SEQ ID NO: 376768 - DNA, 25 bp, Homo sapien
gatacccagaaagaacatgagtgtg

SEQ ID NO: 376769 - DNA, 25 bp, Homo sapien
gatacagaggatgtgctatattcca

SEQ ID NO: 376770 - DNA, 25 bp, Homo sapien
aggcaaatgtgcagcctgcgtttcc

SEQ ID NO: 376771 - DNA, 25 bp, Homo sapien
aaatgtgcagcctgcgtttccttcc

SEQ ID NO: 376772 - DNA, 25 bp, Homo sapien
ggatgtgctatattccagagcgtta

SEQ ID NO: 376773 - DNA, 25 bp, Homo sapien
gtgctatattccagagcgttaaaaa

SEQ ID NO: 376774 - DNA, 25 bp, Homo sapien
aaacaaaaacgctctatgactcagt

SEQ ID NO: 376775 - DNA, 25 bp, Homo sapien
aaaaacgctctatgactcagtttcc

SEQ ID NO: 376776 - DNA, 25 bp, Homo sapien
ggcttgtgtagggaccagcaggcct

SEQ ID NO: 376777 - DNA, 25 bp, Homo sapien
tccaggcgtcaaggagctcctggct

SEQ ID NO: 376778 - DNA, 25 bp, Homo sapien
tcacatggaagttggtgccttccgt

SEQ ID NO: 376779 - DNA, 25 bp, Homo sapien
tgggcagctgcttccactcttgtct

SEQ ID NO: 376780 - DNA, 25 bp, Homo sapien
tctcatctagagagactcccaagcc

SEQ ID NO: 376781 - DNA, 25 bp, Homo sapien
aagttggtgccttccgtagtcctat

SEQ ID NO: 376782 - DNA, 25 bp, Homo sapien
gtgttaggaattaactccctgccta

SEQ ID NO: 376783 - DNA, 25 bp, Homo sapien
ctaccccaaggcctcagaaatagat

SEQ ID NO: 376784 - DNA, 25 bp, Homo sapien
tgccttccgtagtcctatttcatat

SEQ ID NO: 376785 - DNA, 25 bp, Homo sapien
tccgtagtcctatttcatatgaaga

SEQ ID NO: 376786 - DNA, 25 bp, Homo sapien
atttcatatgaagattggcttggca

SEQ ID NO: 376787 - DNA, 25 bp, Homo sapien
gaaaagagtgccatctaccgaaact

SEQ ID NO: 376788 - DNA, 25 bp, Homo sapien
tgccatctaccgaaactccacagtt

SEQ ID NO: 376789 - DNA, 25 bp, Homo sapien
aatggcttctttggtgcagagttcc

SEQ ID NO: 376790 - DNA, 25 bp, Homo sapien
tccaaaaattatgtagcccagctct

SEQ ID NO: 376791 - DNA, 25 bp, Homo sapien
tatgtagcccagctctttaattttg

SEQ ID NO: 376792 - DNA, 25 bp, Homo sapien
aacatctaatgatatcaccgccttg

SEQ ID NO: 376793 - DNA, 25 bp, Homo sapien
gatatcaccgccttgaagtgattaa

SEQ ID NO: 376794 - DNA, 25 bp, Homo sapien
aaagatgttattgcttttgctggac

SEQ ID NO: 376795 - DNA, 25 bp, Homo sapien
cagttgtaaagtttccaggtctaca

SEQ ID NO: 376796 - DNA, 25 bp, Homo sapien
gtttccaggtctacaataactttct

SEQ ID NO: 376797 - DNA, 25 bp, Homo sapien
ccctctcagtgaactgtttcttgta

SEQ ID NO: 376798 - DNA, 25 bp, Homo sapien
aataaatgtactgttcccctgtcaa

SEQ ID NO: 376799 - DNA, 25 bp, Homo sapien
ctgttcccctgtcaacattttaaca

SEQ ID NO: 376800 - DNA, 25 bp, Homo sapien
gagaggtgaatctccatctttggtt

SEQ ID NO: 376801 - DNA, 25 bp, Homo sapien
gtttgcctgaataacctctttcttg

SEQ ID NO: 376802 - DNA, 25 bp, Homo sapien
atacaggatgtacaacttgcaatta

SEQ ID NO: 376803 - DNA, 25 bp, Homo sapien
ttgtcaccattctttgaactctctt

SEQ ID NO: 376804 - DNA, 25 bp, Homo sapien
ttgaactctcttggcccttgactag

SEQ ID NO: 376805 - DNA, 25 bp, Homo sapien
ggcccttgactaggagctcacagat

SEQ ID NO: 376806 - DNA, 25 bp, Homo sapien
ctaggagctcacagatgtttttcat

SEQ ID NO: 376807 - DNA, 25 bp, Homo sapien
gtttttcatccatcagtttagacag

SEQ ID NO: 376808 - DNA, 25 bp, Homo sapien
caggtttgttccagtgtctttctct

SEQ ID NO: 376809 - DNA, 25 bp, Homo sapien
ccttctcccgttcagctgtaatggt

SEQ ID NO: 376810 - DNA, 25 bp, Homo sapien
agctgtaatggtgaggcctgccaca

SEQ ID NO: 376811 - DNA, 25 bp, Homo sapien
gtgaggcctgccacagccagatctg

SEQ ID NO: 376812 - DNA, 25 bp, Homo sapien
gaagaggcacagagacttgcgacca

SEQ ID NO: 376813 - DNA, 25 bp, Homo sapien
agagacttgcgaccagcaaccgtca

SEQ ID NO: 376814 - DNA, 25 bp, Homo sapien
gcaaccgtcactgctattggagatg

SEQ ID NO: 376815 - DNA, 25 bp, Homo sapien
ttgaggagtggctctaagtcaacac

SEQ ID NO: 376816 - DNA, 25 bp, Homo sapien
taagtctcttaccatatgaacgcgg

SEQ ID NO: 376817 - DNA, 25 bp, Homo sapien
agaatgctaattcccagagtcatga

SEQ ID NO: 376818 - DNA, 25 bp, Homo sapien
attcccagagtcatgaatggcttag

SEQ ID NO: 376819 - DNA, 25 bp, Homo sapien
atggcttagagaaatcaatcacctt

SEQ ID NO: 376820 - DNA, 25 bp, Homo sapien
tggctttttgcctccattccatgag

SEQ ID NO: 376821 - DNA, 25 bp, Homo sapien
attccatgaggcatacagtaaggct

SEQ ID NO: 376822 - DNA, 25 bp, Homo sapien
agtaaggctgcctgctagtaagcag

SEQ ID NO: 376823 - DNA, 25 bp, Homo sapien
ataagtgggtacctatccagccatt

SEQ ID NO: 376824 - DNA, 25 bp, Homo sapien
cctatccagccattctcttttcaga

SEQ ID NO: 376825 - DNA, 25 bp, Homo sapien
actatcttagccaaacttgcctttg

SEQ ID NO: 376826 - DNA, 25 bp, Homo sapien
ttgcctttgcttcactcatcatgca

SEQ ID NO: 376827 - DNA, 25 bp, Homo sapien
tcatcatgcagccttctgggttggt

SEQ ID NO: 376828 - DNA, 25 bp, Homo sapien
ctgggttggttgctatatatatctt

SEQ ID NO: 376829 - DNA, 25 bp, Homo sapien
ttgatgtcccattctcttccacagc

SEQ ID NO: 376830 - DNA, 25 bp, Homo sapien
cagccctgaggtcttacgaattttt

SEQ ID NO: 376831 - DNA, 25 bp, Homo sapien
ctgggcggattcagcgaagtctcat

SEQ ID NO: 376832 - DNA, 25 bp, Homo sapien
gattcagcgaagtctcatgggaagc

SEQ ID NO: 376833 - DNA, 25 bp, Homo sapien
agtctcatgggaagcaggacctaga

SEQ ID NO: 376834 - DNA, 25 bp, Homo sapien
agccctcagcgtcagacagcaagga

SEQ ID NO: 376835 - DNA, 25 bp, Homo sapien
agcaaggaactgtcaccagccgcac

SEQ ID NO: 376836 - DNA, 25 bp, Homo sapien
agccgcacgcgtggtaaatgaccca

SEQ ID NO: 376837 - DNA, 25 bp, Homo sapien
tggtaaatgacccagacccaactcg

SEQ ID NO: 376838 - DNA, 25 bp, Homo sapien
ttacatttctcaccctactctggat

SEQ ID NO: 376839 - DNA, 25 bp, Homo sapien
ccctactctggatggtgtgtggttt

SEQ ID NO: 376840 - DNA, 25 bp, Homo sapien
tttctttttagttctctagggtctg

SEQ ID NO: 376841 - DNA, 25 bp, Homo sapien
agttctctagggtctgataggaaca

SEQ ID NO: 376842 - DNA, 25 bp, Homo sapien
tgatcaactcactttaaactggtct

SEQ ID NO: 376843 - DNA, 25 bp, Homo sapien
gagtataagaccctctgtacttccc

SEQ ID NO: 376844 - DNA, 25 bp, Homo sapien
tgtacttcccatggtgattttgagg

SEQ ID NO: 376845 - DNA, 25 bp, Homo sapien
gaggagcacatgcataatgtatctg

SEQ ID NO: 376846 - DNA, 25 bp, Homo sapien
gcttgacaagcacttgaagccattc

SEQ ID NO: 376847 - DNA, 25 bp, Homo sapien
gaagccattcttactaaattattag

SEQ ID NO: 376848 - DNA, 25 bp, Homo sapien
tattttagctcctcctatctgctga

SEQ ID NO: 376849 - DNA, 25 bp, Homo sapien
gctcctcctatctgctgaattaatt

SEQ ID NO: 376850 - DNA, 25 bp, Homo sapien
acagtcacatgttccatgacaccat

SEQ ID NO: 376851 - DNA, 25 bp, Homo sapien
atgacaccatgttttgccaaggaaa

SEQ ID NO: 376852 - DNA, 25 bp, Homo sapien
taaatttgaaattgcccacaagatc

SEQ ID NO: 376853 - DNA, 25 bp, Homo sapien
agtatcctcaactagactcaatttg

SEQ ID NO: 376854 - DNA, 25 bp, Homo sapien
tcactttgaaattgtacctcccact

SEQ ID NO: 376855 - DNA, 25 bp, Homo sapien
caattgttttggtggctgtatgtag

SEQ ID NO: 376856 - DNA, 25 bp, Homo sapien
ggtggctgtatgtagttattttaaa

SEQ ID NO: 376857 - DNA, 25 bp, Homo sapien
gaaattgtacctcccactgtaatat

SEQ ID NO: 376858 - DNA, 25 bp, Homo sapien
atctcccagaggcaaatactgtgaa

SEQ ID NO: 376859 - DNA, 25 bp, Homo sapien
ccagaggcaaatactgtgaacattt

SEQ ID NO: 376860 - DNA, 25 bp, Homo sapien
gtacctcccactgtaatattttaat

SEQ ID NO: 376861 - DNA, 25 bp, Homo sapien
agttgttttagatgcttgtagttgt

SEQ ID NO: 376862 - DNA, 25 bp, Homo sapien
gatgcttgtagttgttcatacagtt

SEQ ID NO: 376863 - DNA, 25 bp, Homo sapien
catacagttttcattagtatcctca

SEQ ID NO: 376864 - DNA, 25 bp, Homo sapien
tgcacatttttaatccctagctggc

SEQ ID NO: 376865 - DNA, 25 bp, Homo sapien
ctccctcatttgcatttcctaagat

SEQ ID NO: 376866 - DNA, 25 bp, Homo sapien
tttcctaagatcataccaactggta

SEQ ID NO: 376867 - DNA, 25 bp, Homo sapien
ttaacatcagcctgacccagatact

SEQ ID NO: 376868 - DNA, 25 bp, Homo sapien
agcctgacccagatactgacctaag

SEQ ID NO: 376869 - DNA, 25 bp, Homo sapien
tactgacctaagaggcctacaacaa

SEQ ID NO: 376870 - DNA, 25 bp, Homo sapien
gcagaaaaagcctctggtgaccaaa

SEQ ID NO: 376871 - DNA, 25 bp, Homo sapien
ggtgaccaaaccctaacaggacttg

SEQ ID NO: 376872 - DNA, 25 bp, Homo sapien
gacttgagttctggaggagccccac

SEQ ID NO: 376873 - DNA, 25 bp, Homo sapien
gaggagccccactgtcatcctgtct

SEQ ID NO: 376874 - DNA, 25 bp, Homo sapien
gtctccatcaacacgaataactaag

SEQ ID NO: 376875 - DNA, 25 bp, Homo sapien
gagtcgggtaaagcgtcttctcttt

SEQ ID NO: 376876 - DNA, 25 bp, Homo sapien
taaagcgtcttctctttttcggcgg

SEQ ID NO: 376877 - DNA, 25 bp, Homo sapien
gcgtcttctctttttcggcggaatt

SEQ ID NO: 376878 - DNA, 25 bp, Homo sapien
aagagggatgtggttaccttgagca

SEQ ID NO: 376879 - DNA, 25 bp, Homo sapien
ggttaccttgagcagaaatacccaa

SEQ ID NO: 376880 - DNA, 25 bp, Homo sapien
gggccataggctgcgggaacgactt

SEQ ID NO: 376881 - DNA, 25 bp, Homo sapien
gtaaaagcgcggcaccgacaccagc

SEQ ID NO: 376882 - DNA, 25 bp, Homo sapien
accagctgtgtgcagcagtggcggc

SEQ ID NO: 376883 - DNA, 25 bp, Homo sapien
caaggtggctcagcgttgaagtcga

SEQ ID NO: 376884 - DNA, 25 bp, Homo sapien
gcgttgaagtcgaactgctctctat

SEQ ID NO: 376885 - DNA, 25 bp, Homo sapien
gaagtcgaactgctctctatacagc

SEQ ID NO: 376886 - DNA, 25 bp, Homo sapien
tgaacaaattttctagtcgagtttt

SEQ ID NO: 376887 - DNA, 25 bp, Homo sapien
ttttctagtcgagttttcaatgtga

SEQ ID NO: 376888 - DNA, 25 bp, Homo sapien
atttgttcttacattatggctcccg

SEQ ID NO: 376889 - DNA, 25 bp, Homo sapien
gttcttacattatggctcccgaggg

SEQ ID NO: 376890 - DNA, 25 bp, Homo sapien
tgtgcaaggatgactaagtgtacgt

SEQ ID NO: 376891 - DNA, 25 bp, Homo sapien
gactaagtgtacgtctttccgtgtg

SEQ ID NO: 376892 - DNA, 25 bp, Homo sapien
taagtgtacgtctttccgtgtgtgt

SEQ ID NO: 376893 - DNA, 25 bp, Homo sapien
gtacgtctttccgtgtgtgtatgct

SEQ ID NO: 376894 - DNA, 25 bp, Homo sapien
ttccgtgtgtgtatgctggtgaaca

SEQ ID NO: 376895 - DNA, 25 bp, Homo sapien
gtgtatgctggtgaacagtcagatt

SEQ ID NO: 376896 - DNA, 25 bp, Homo sapien
gaacagtcagatttatttatatttt

SEQ ID NO: 376897 - DNA, 25 bp, Homo sapien
gaatgagaggagtcccacgtccagg

SEQ ID NO: 376898 - DNA, 25 bp, Homo sapien
agaggagtcccacgtccaggtccaa

SEQ ID NO: 376899 - DNA, 25 bp, Homo sapien
atttcaagtctaagaatgagggtgc

SEQ ID NO: 376900 - DNA, 25 bp, Homo sapien
tgccctgataaatggcacacccaag

SEQ ID NO: 376901 - DNA, 25 bp, Homo sapien
ggcacacccaagaagggcactcagg

SEQ ID NO: 376902 - DNA, 25 bp, Homo sapien
agactctcagggtctctgacgacgt

SEQ ID NO: 376903 - DNA, 25 bp, Homo sapien
agggtctctgacgacgtccagatca

SEQ ID NO: 376904 - DNA, 25 bp, Homo sapien
tgacgacgtccagatcagtcacttc

SEQ ID NO: 376905 - DNA, 25 bp, Homo sapien
agatcagtcacttccttgctacaca

SEQ ID NO: 376906 - DNA, 25 bp, Homo sapien
ttccttgctacacatgccatggact

SEQ ID NO: 376907 - DNA, 25 bp, Homo sapien
acatgccatggactgtgaatgagag

SEQ ID NO: 376908 - DNA, 25 bp, Homo sapien
ccgcgcctcaggaaaacaggatggt

SEQ ID NO: 376909 - DNA, 25 bp, Homo sapien
acaggatggtagtgaatggcaccga

SEQ ID NO: 376910 - DNA, 25 bp, Homo sapien
atggtagtgaatggcaccgagccgc

SEQ ID NO: 376911 - DNA, 25 bp, Homo sapien
tgaatggcaccgagccgccccaggg

SEQ ID NO: 376912 - DNA, 25 bp, Homo sapien
ttcgccccggactgaagtgcggtcg

SEQ ID NO: 376913 - DNA, 25 bp, Homo sapien
ggcggctccgagtcgtgcgaggcag

SEQ ID NO: 376914 - DNA, 25 bp, Homo sapien
aggggaccctttgccttcagaacag

SEQ ID NO: 376915 - DNA, 25 bp, Homo sapien
acgttgggcgcgtggacagagtcct

SEQ ID NO: 376916 - DNA, 25 bp, Homo sapien
tggagcgcgcgcctcctagcggagc

SEQ ID NO: 376917 - DNA, 25 bp, Homo sapien
gaaggccgcgcctcaggaaaacagg

SEQ ID NO: 376918 - DNA, 25 bp, Homo sapien
aggccgcgcctcaggaaaacaggat

SEQ ID NO: 376919 - DNA, 25 bp, Homo sapien
agtgagattttagcattaactctgt

SEQ ID NO: 376920 - DNA, 25 bp, Homo sapien
gtgagattttagcattaactctgtt

SEQ ID NO: 376921 - DNA, 25 bp, Homo sapien
ttaaaacttctacctgtagatatta

SEQ ID NO: 376922 - DNA, 25 bp, Homo sapien
taaaacttctacctgtagatattaa

SEQ ID NO: 376923 - DNA, 25 bp, Homo sapien
aaaacttctacctgtagatattaag

SEQ ID NO: 376924 - DNA, 25 bp, Homo sapien
aaacttctacctgtagatattaagt

SEQ ID NO: 376925 - DNA, 25 bp, Homo sapien
aacttctacctgtagatattaagtt

SEQ ID NO: 376926 - DNA, 25 bp, Homo sapien
acttctacctgtagatattaagttt

SEQ ID NO: 376927 - DNA, 25 bp, Homo sapien
gattggattaaagacctggcacttc

SEQ ID NO: 376928 - DNA, 25 bp, Homo sapien
aagacctggcacttcagtaactcag

SEQ ID NO: 376929 - DNA, 25 bp, Homo sapien
tcagtaactcagcacgcttccactt

SEQ ID NO: 376930 - DNA, 25 bp, Homo sapien
gcttccacttcactcaacttaagag

SEQ ID NO: 376931 - DNA, 25 bp, Homo sapien
gagagttcattgacagtgttaggat

SEQ ID NO: 376932 - DNA, 25 bp, Homo sapien
gtgaaggctgggaaacacttatttt

SEQ ID NO: 376933 - DNA, 25 bp, Homo sapien
tggctctcccaaataggtacctcaa

SEQ ID NO: 376934 - DNA, 25 bp, Homo sapien
taggtacctcaaaaactgttagcaa

SEQ ID NO: 376935 - DNA, 25 bp, Homo sapien
aactgttagcaagcggcatttggat

SEQ ID NO: 376936 - DNA, 25 bp, Homo sapien
acattgtccacattaatggttggca

SEQ ID NO: 376937 - DNA, 25 bp, Homo sapien
gttggcatgattgtgcttgcaggcc

SEQ ID NO: 376938 - DNA, 25 bp, Homo sapien
agctctcacttcaccttatatgtaa

SEQ ID NO: 376939 - DNA, 25 bp, Homo sapien
gttgacatcctagaaatggtttctg

SEQ ID NO: 376940 - DNA, 25 bp, Homo sapien
atggtttctgggtggtattatatgg

SEQ ID NO: 376941 - DNA, 25 bp, Homo sapien
ggcctaggactctgaactgggacta

SEQ ID NO: 376942 - DNA, 25 bp, Homo sapien
actgggactagttgtttattttctg

SEQ ID NO: 376943 - DNA, 25 bp, Homo sapien
gggaagtctgtattcttattctcaa

SEQ ID NO: 376944 - DNA, 25 bp, Homo sapien
ttcttattctcaactgaacccctga

SEQ ID NO: 376945 - DNA, 25 bp, Homo sapien
gaacccctgactcttttgttgtatt

SEQ ID NO: 376946 - DNA, 25 bp, Homo sapien
ttatgattccgaaatgctttgaggg

SEQ ID NO: 376947 - DNA, 25 bp, Homo sapien
aataatgggagatgcttgctgttag

SEQ ID NO: 376948 - DNA, 25 bp, Homo sapien
gcattaaggttatacagctctcact

SEQ ID NO: 376949 - DNA, 25 bp, Homo sapien
atggtgacacataccttcgctgcat

SEQ ID NO: 376950 - DNA, 25 bp, Homo sapien
tgtagtcggaccacacagggcaagg

SEQ ID NO: 376951 - DNA, 25 bp, Homo sapien
gtcggaccacacagggcaaggcagt

SEQ ID NO: 376952 - DNA, 25 bp, Homo sapien
gcagtggctgctgcacatgttttgt

SEQ ID NO: 376953 - DNA, 25 bp, Homo sapien
gggagccaggactcctatcatcatg

SEQ ID NO: 376954 - DNA, 25 bp, Homo sapien
aggactcctatcatcatgctcgagg

SEQ ID NO: 376955 - DNA, 25 bp, Homo sapien
atcatcatgctcgaggcctggagat

SEQ ID NO: 376956 - DNA, 25 bp, Homo sapien
gacctggtcacctccattagtgtgc

SEQ ID NO: 376957 - DNA, 25 bp, Homo sapien
gtcacctccattagtgtgccaccat

SEQ ID NO: 376958 - DNA, 25 bp, Homo sapien
gtgccaccatacactggagacctgt

SEQ ID NO: 376959 - DNA, 25 bp, Homo sapien
agacctgtctttggctcccaggata

SEQ ID NO: 376960 - DNA, 25 bp, Homo sapien
cctgctgtgcgtgtcagggagcagc

SEQ ID NO: 376961 - DNA, 25 bp, Homo sapien
agcccctgaggacttgcggctgctc

SEQ ID NO: 376962 - DNA, 25 bp, Homo sapien
cggctgctcttctacgatgaggtgt

SEQ ID NO: 376963 - DNA, 25 bp, Homo sapien
cttctacgatgaggtgtcccggctg

SEQ ID NO: 376964 - DNA, 25 bp, Homo sapien
cccggctggagagcttttgggcact

SEQ ID NO: 376965 - DNA, 25 bp, Homo sapien
tggagagcttttgggcactccgtgt

SEQ ID NO: 376966 - DNA, 25 bp, Homo sapien
tttgggcactccgtgtggtgtgtca

SEQ ID NO: 376967 - DNA, 25 bp, Homo sapien
ggagcagctgacagccctgcttgcc

SEQ ID NO: 376968 - DNA, 25 bp, Homo sapien
tgcttgcctggatccgggaaccatg

SEQ ID NO: 376969 - DNA, 25 bp, Homo sapien
gagctgttttccatcggactccgga

SEQ ID NO: 376970 - DNA, 25 bp, Homo sapien
catcggactccggacagtgatccaa

SEQ ID NO: 376971 - DNA, 25 bp, Homo sapien
tgttctataaacacataggcactat

SEQ ID NO: 376972 - DNA, 25 bp, Homo sapien
acaggcacacttttcctattcagca

SEQ ID NO: 376973 - DNA, 25 bp, Homo sapien
tcctattcagcaaatatctgagtgc

SEQ ID NO: 376974 - DNA, 25 bp, Homo sapien
gtgcctactatatgctgaggatagg

SEQ ID NO: 376975 - DNA, 25 bp, Homo sapien
aagattggcacaacttaagtaacag

SEQ ID NO: 376976 - DNA, 25 bp, Homo sapien
ttaagtaacagaatccaccaagaca

SEQ ID NO: 376977 - DNA, 25 bp, Homo sapien
aagacaaacttcctcatccaatcta

SEQ ID NO: 376978 - DNA, 25 bp, Homo sapien
acttcctcatccaatctattcagat

SEQ ID NO: 376979 - DNA, 25 bp, Homo sapien
aaaactagagagaatgcatgcaatt

SEQ ID NO: 376980 - DNA, 25 bp, Homo sapien
aatgcatgcaattaaacagtctggc

SEQ ID NO: 376981 - DNA, 25 bp, Homo sapien
agttttgatcctagattgttctata

SEQ ID NO: 376982 - DNA, 25 bp, Homo sapien
tagtcctagggacacacaacctcag

SEQ ID NO: 376983 - DNA, 25 bp, Homo sapien
gggacacacaacctcagagacaaat

SEQ ID NO: 376984 - DNA, 25 bp, Homo sapien
gacaaatgcagaaggcagttaccaa

SEQ ID NO: 376985 - DNA, 25 bp, Homo sapien
gcagttaccaagcaattacggtcca

SEQ ID NO: 376986 - DNA, 25 bp, Homo sapien
ttacggtccaacatgtctggtccaa

SEQ ID NO: 376987 - DNA, 25 bp, Homo sapien
tctggtccaaccttttcctttactg

SEQ ID NO: 376988 - DNA, 25 bp, Homo sapien
agggaatgagcttgtttacatgcaa

SEQ ID NO: 376989 - DNA, 25 bp, Homo sapien
gttgggactcaaatcctatttcaca

SEQ ID NO: 376990 - DNA, 25 bp, Homo sapien
aattctgtcctaacattcaacccaa

SEQ ID NO: 376991 - DNA, 25 bp, Homo sapien
gtcctaacattcaacccaattcaat

SEQ ID NO: 376992 - DNA, 25 bp, Homo sapien
gcaagagagatcctacctagtccta

SEQ ID NO: 376993 - DNA, 25 bp, Homo sapien
cctcagcctcgccttgtggttttat

SEQ ID NO: 376994 - DNA, 25 bp, Homo sapien
aataatgttcgaaattgtattcatt

SEQ ID NO: 376995 - DNA, 25 bp, Homo sapien
gtattcattaatataagcgactctg

SEQ ID NO: 376996 - DNA, 25 bp, Homo sapien
tcattaatataagcgactctgtctc

SEQ ID NO: 376997 - DNA, 25 bp, Homo sapien
attaatataagcgactctgtctcaa

SEQ ID NO: 376998 - DNA, 25 bp, Homo sapien
aaatcattattggtaagatacatag

SEQ ID NO: 376999 - DNA, 25 bp, Homo sapien
gatacatagaatgtcagaggtgacg

SEQ ID NO: 377000 - DNA, 25 bp, Homo sapien
ggtgacgagggccatgaggaagagg

SEQ ID NO: 377001 - DNA, 25 bp, Homo sapien
gggttgcagttttaaataggatgtc

SEQ ID NO: 377002 - DNA, 25 bp, Homo sapien
tgcagttttaaataggatgtcaggg

SEQ ID NO: 377003 - DNA, 25 bp, Homo sapien
cagtgaaaagtgacattttggccgg

SEQ ID NO: 377004 - DNA, 25 bp, Homo sapien
gatggaccacacatgtggattgcaa

SEQ ID NO: 377005 - DNA, 25 bp, Homo sapien
gattgcaaggacagctactcagaga

SEQ ID NO: 377006 - DNA, 25 bp, Homo sapien
tgcaaggacagctactcagagagtt

SEQ ID NO: 377007 - DNA, 25 bp, Homo sapien
gacagctactcagagagttcacatt

SEQ ID NO: 377008 - DNA, 25 bp, Homo sapien
ggaaattgaggcttattgtgagcaa

SEQ ID NO: 377009 - DNA, 25 bp, Homo sapien
aaaggacctaaagctgtgaatggga

SEQ ID NO: 377010 - DNA, 25 bp, Homo sapien
gacctaaagctgtgaatgggagaga

SEQ ID NO: 377011 - DNA, 25 bp, Homo sapien
gtgaaaaggagaagaggccctgctt

SEQ ID NO: 377012 - DNA, 25 bp, Homo sapien
ttattgtgagcaaggtgccggcctc

SEQ ID NO: 377013 - DNA, 25 bp, Homo sapien
attgtgagcaaggtgccggcctccg

SEQ ID NO: 377014 - DNA, 25 bp, Homo sapien
gagcagcacatgaaagctgcctgcg

SEQ ID NO: 377015 - DNA, 25 bp, Homo sapien
attggtggaaaagagtaaaacatct

SEQ ID NO: 377016 - DNA, 25 bp, Homo sapien
aaagagtaaaacatctatatgctat

SEQ ID NO: 377017 - DNA, 25 bp, Homo sapien
aagagtaaaacatctatatgctata

SEQ ID NO: 377018 - DNA, 25 bp, Homo sapien
agagtaaaacatctatatgctataa

SEQ ID NO: 377019 - DNA, 25 bp, Homo sapien
gagtaaaacatctatatgctataaa

SEQ ID NO: 377020 - DNA, 25 bp, Homo sapien
acatctatatgctataaaaaggccg

SEQ ID NO: 377021 - DNA, 25 bp, Homo sapien
catctatatgctataaaaaggccgg

SEQ ID NO: 377022 - DNA, 25 bp, Homo sapien
tctatatgctataaaaaggccgggt

SEQ ID NO: 377023 - DNA, 25 bp, Homo sapien
ctatatgctataaaaaggccgggtg

SEQ ID NO: 377024 - DNA, 25 bp, Homo sapien
tatatgctataaaaaggccgggtgc

SEQ ID NO: 377025 - DNA, 25 bp, Homo sapien
atatgctataaaaaggccgggtgcg

SEQ ID NO: 377026 - DNA, 25 bp, Homo sapien
ccccagatggctagtatccaaccat

SEQ ID NO: 377027 - DNA, 25 bp, Homo sapien
tagtatccaaccatcagggctcaat

SEQ ID NO: 377028 - DNA, 25 bp, Homo sapien
aaccatcagggctcaatcctaagca

SEQ ID NO: 377029 - DNA, 25 bp, Homo sapien
atcagggctcaatcctaagcaaaat

SEQ ID NO: 377030 - DNA, 25 bp, Homo sapien
aaaatattgaactagctgttttctt

SEQ ID NO: 377031 - DNA, 25 bp, Homo sapien
gttttcttctcactggcctggtatc

SEQ ID NO: 377032 - DNA, 25 bp, Homo sapien
ttctcactggcctggtatctgcaaa

SEQ ID NO: 377033 - DNA, 25 bp, Homo sapien
actggcctggtatctgcaaagctaa

SEQ ID NO: 377034 - DNA, 25 bp, Homo sapien
gtatctgcaaagctaaccatccggc

SEQ ID NO: 377035 - DNA, 25 bp, Homo sapien
ctttccttccaaacatagtactcct

SEQ ID NO: 377036 - DNA, 25 bp, Homo sapien
aacatagtactcctcagtctctcct

SEQ ID NO: 377037 - DNA, 25 bp, Homo sapien
atagttacccataaagaggaatcct

SEQ ID NO: 377038 - DNA, 25 bp, Homo sapien
gaggaatcctttgagtgtatgccat

SEQ ID NO: 377039 - DNA, 25 bp, Homo sapien
gagtgtatgccattggtgagccgat

SEQ ID NO: 377040 - DNA, 25 bp, Homo sapien
attggtgagccgatgagcatggacc

SEQ ID NO: 377041 - DNA, 25 bp, Homo sapien
agcatggaccatagaagggctcaat

SEQ ID NO: 377042 - DNA, 25 bp, Homo sapien
gattggcttaaaatggctactgtga

SEQ ID NO: 377043 - DNA, 25 bp, Homo sapien
tcttagggagatgcagcttggactt

SEQ ID NO: 377044 - DNA, 25 bp, Homo sapien
ctgtggtttagagtttgctttaatg

SEQ ID NO: 377045 - DNA, 25 bp, Homo sapien
agagtttgctttaatgacattgtat

SEQ ID NO: 377046 - DNA, 25 bp, Homo sapien
aaaggtcacatgattgctgtaattt

SEQ ID NO: 377047 - DNA, 25 bp, Homo sapien
tgtattcattatggtttcctcaata

SEQ ID NO: 377048 - DNA, 25 bp, Homo sapien
tgcagtcctcataccaccataaggt

SEQ ID NO: 377049 - DNA, 25 bp, Homo sapien
tggagtgtttaagcgtcctgtccga

SEQ ID NO: 377050 - DNA, 25 bp, Homo sapien
taagcgtcctgtccgagatggcata

SEQ ID NO: 377051 - DNA, 25 bp, Homo sapien
tcctgtccgagatggcatagctagt

SEQ ID NO: 377052 - DNA, 25 bp, Homo sapien
gaaatttgaacccaagtaatccagg

SEQ ID NO: 377053 - DNA, 25 bp, Homo sapien
agtaatccaggtccagaatgccccg

SEQ ID NO: 377054 - DNA, 25 bp, Homo sapien
gaatgccccggatgcagaaatgacc

SEQ ID NO: 377055 - DNA, 25 bp, Homo sapien
gaaatgaccacacagattctaccaa

SEQ ID NO: 377056 - DNA, 25 bp, Homo sapien
gattctaccaatgaactaacctgat

SEQ ID NO: 377057 - DNA, 25 bp, Homo sapien
gagagacaagcgcttgtccatgcca

SEQ ID NO: 377058 - DNA, 25 bp, Homo sapien
aagcgcttgtccatgccaggctctg

SEQ ID NO: 377059 - DNA, 25 bp, Homo sapien
gaacgtggactagtgcttactgtgc

SEQ ID NO: 377060 - DNA, 25 bp, Homo sapien
agtgcttactgtgcatgctatgctt

SEQ ID NO: 377061 - DNA, 25 bp, Homo sapien
gcatgctatgcttacgttgttttgt

SEQ ID NO: 377062 - DNA, 25 bp, Homo sapien
aataggtagactcagaaaaccctgc

SEQ ID NO: 377063 - DNA, 25 bp, Homo sapien
ggatgctccagctggacaagagctt

SEQ ID NO: 377064 - DNA, 25 bp, Homo sapien
agagcttagacactgccttgagggc

SEQ ID NO: 377065 - DNA, 25 bp, Homo sapien
gccttgagggcagcagtagtcagaa

SEQ ID NO: 377066 - DNA, 25 bp, Homo sapien
tagagggcccagaactcccatgtgt

SEQ ID NO: 377067 - DNA, 25 bp, Homo sapien
cccagaactcccatgtgtctataaa

SEQ ID NO: 377068 - DNA, 25 bp, Homo sapien
ttcaactgttgaaggaagctcttgc

SEQ ID NO: 377069 - DNA, 25 bp, Homo sapien
gaagctcttgctgaacgtggactag

SEQ ID NO: 377070 - DNA, 25 bp, Homo sapien
gcaagggctatgaaatgcctggcat

SEQ ID NO: 377071 - DNA, 25 bp, Homo sapien
aagggctatgaaatgcctggcatca

SEQ ID NO: 377072 - DNA, 25 bp, Homo sapien
aatgcctggcatcattcaaaggctg

SEQ ID NO: 377073 - DNA, 25 bp, Homo sapien
atgcctggcatcattcaaaggctgt

SEQ ID NO: 377074 - DNA, 25 bp, Homo sapien
tgcctggcatcattcaaaggctgtt

SEQ ID NO: 377075 - DNA, 25 bp, Homo sapien
gcctggcatcattcaaaggctgttt

SEQ ID NO: 377076 - DNA, 25 bp, Homo sapien
cctggcatcattcaaaggctgtttg

SEQ ID NO: 377077 - DNA, 25 bp, Homo sapien
ctggcatcattcaaaggctgtttgc

SEQ ID NO: 377078 - DNA, 25 bp, Homo sapien
gcatcattcaaaggctgtttgccag

SEQ ID NO: 377079 - DNA, 25 bp, Homo sapien
atcattcaaaggctgtttgccagga

SEQ ID NO: 377080 - DNA, 25 bp, Homo sapien
attcaaaggctgtttgccaggaggg

SEQ ID NO: 377081 - DNA, 25 bp, Homo sapien
agttctgtcatgaagtatagtcaca

SEQ ID NO: 377082 - DNA, 25 bp, Homo sapien
tgttgtgcaactggcagtctttcat

SEQ ID NO: 377083 - DNA, 25 bp, Homo sapien
ggactttgtggtttgatgaggtaca

SEQ ID NO: 377084 - DNA, 25 bp, Homo sapien
gggcagacaggaatgcaagtcagtc

SEQ ID NO: 377085 - DNA, 25 bp, Homo sapien
aatgcaagtcagtctgttgtgagaa

SEQ ID NO: 377086 - DNA, 25 bp, Homo sapien
gggtccagaagctgagtgctagttc

SEQ ID NO: 377087 - DNA, 25 bp, Homo sapien
aagctgagtgctagttctgggtcca

SEQ ID NO: 377088 - DNA, 25 bp, Homo sapien
gagtgctagttctgggtccacccta

SEQ ID NO: 377089 - DNA, 25 bp, Homo sapien
ctgggtccaccctacagtgtggcag

SEQ ID NO: 377090 - DNA, 25 bp, Homo sapien
cacctgtctcatggatgctgtaaga

SEQ ID NO: 377091 - DNA, 25 bp, Homo sapien
cctcacggagcagcatctgtgggta

SEQ ID NO: 377092 - DNA, 25 bp, Homo sapien
attctgacatccagccagaaccttg

SEQ ID NO: 377093 - DNA, 25 bp, Homo sapien
tcccaaatgccacgaagagacaggt

SEQ ID NO: 377094 - DNA, 25 bp, Homo sapien
cacgaagagacaggtggtatctggt

SEQ ID NO: 377095 - DNA, 25 bp, Homo sapien
gtatctggtgggtctgtctgaggca

SEQ ID NO: 377096 - DNA, 25 bp, Homo sapien
tgcagaggctgcagcatccgaacgt

SEQ ID NO: 377097 - DNA, 25 bp, Homo sapien
aggctgcagcatccgaacgtggaaa

SEQ ID NO: 377098 - DNA, 25 bp, Homo sapien
aacgtggaaacgtcgctccagcctg

SEQ ID NO: 377099 - DNA, 25 bp, Homo sapien
caaatatgcaacacaaactgtaggg

SEQ ID NO: 377100 - DNA, 25 bp, Homo sapien
aaagggatgttgtgaccccattcat

SEQ ID NO: 377101 - DNA, 25 bp, Homo sapien
gtgaccccattcattcaactaatca

SEQ ID NO: 377102 - DNA, 25 bp, Homo sapien
attcaactaatcacggccagggctg

SEQ ID NO: 377103 - DNA, 25 bp, Homo sapien
taattcccagacgtgcaagacaaag

SEQ ID NO: 377104 - DNA, 25 bp, Homo sapien
gaagggttttaactccctgccagat

SEQ ID NO: 377105 - DNA, 25 bp, Homo sapien
agatccgctcggaattagctcttct

SEQ ID NO: 377106 - DNA, 25 bp, Homo sapien
ggaattagctcttctggcggtgcag

SEQ ID NO: 377107 - DNA, 25 bp, Homo sapien
tcttctggcggtgcagcaacaagtg

SEQ ID NO: 377108 - DNA, 25 bp, Homo sapien
tgtgcactcggagggactacatcct

SEQ ID NO: 377109 - DNA, 25 bp, Homo sapien
cagcccctagtccaaacgggagtag

SEQ ID NO: 377110 - DNA, 25 bp, Homo sapien
gcatttcaagcaaagatggtccaga

SEQ ID NO: 377111 - DNA, 25 bp, Homo sapien
aattggaaagcacatctcgaggcgc

SEQ ID NO: 377112 - DNA, 25 bp, Homo sapien
catctcgaggcgctgaatctgttct

SEQ ID NO: 377113 - DNA, 25 bp, Homo sapien
gcgctgaatctgttctcgccgtctg

SEQ ID NO: 377114 - DNA, 25 bp, Homo sapien
cagatcctggacataaaatcagtaa

SEQ ID NO: 377115 - DNA, 25 bp, Homo sapien
agatcctggacataaaatcagtaaa

SEQ ID NO: 377116 - DNA, 25 bp, Homo sapien
gatcctggacataaaatcagtaaac

SEQ ID NO: 377117 - DNA, 25 bp, Homo sapien
atcctggacataaaatcagtaaacc

SEQ ID NO: 377118 - DNA, 25 bp, Homo sapien
tcctggacataaaatcagtaaaccg

SEQ ID NO: 377119 - DNA, 25 bp, Homo sapien
gacataaaatcagtaaaccggccag

SEQ ID NO: 377120 - DNA, 25 bp, Homo sapien
acataaaatcagtaaaccggccagg

SEQ ID NO: 377121 - DNA, 25 bp, Homo sapien
cataaaatcagtaaaccggccaggc

SEQ ID NO: 377122 - DNA, 25 bp, Homo sapien
ataaaatcagtaaaccggccaggca

SEQ ID NO: 377123 - DNA, 25 bp, Homo sapien
taaaatcagtaaaccggccaggcac

SEQ ID NO: 377124 - DNA, 25 bp, Homo sapien
aaatcagtaaaccggccaggcacgg

SEQ ID NO: 377125 - DNA, 25 bp, Homo sapien
actgttgtacggtgtctagaattaa

SEQ ID NO: 377126 - DNA, 25 bp, Homo sapien
aactttcatggtatttagcctttct

SEQ ID NO: 377127 - DNA, 25 bp, Homo sapien
tcatggtatttagcctttcttaaat

SEQ ID NO: 377128 - DNA, 25 bp, Homo sapien
taaactttctaacctatgtattcaa

SEQ ID NO: 377129 - DNA, 25 bp, Homo sapien
acctatgtattcaacttctgtattt

SEQ ID NO: 377130 - DNA, 25 bp, Homo sapien
ttatatttaatcagtggttcatgtt

SEQ ID NO: 377131 - DNA, 25 bp, Homo sapien
ggttcatgttatataatacaccctt

SEQ ID NO: 377132 - DNA, 25 bp, Homo sapien
taatacacccttaactagttaaatg

SEQ ID NO: 377133 - DNA, 25 bp, Homo sapien
ggaatgttggtatggtacagagtac

SEQ ID NO: 377134 - DNA, 25 bp, Homo sapien
gtacagagtaccatattgctaagaa

SEQ ID NO: 377135 - DNA, 25 bp, Homo sapien
gaaatgcctatggtgaattaaagct

SEQ ID NO: 377136 - DNA, 25 bp, Homo sapien
cgccagggacaccaggaattcgggg

SEQ ID NO: 377137 - DNA, 25 bp, Homo sapien
gccagggacaccaggaattcggggg

SEQ ID NO: 377138 - DNA, 25 bp, Homo sapien
ccccacgcaccacctacctggcttc

SEQ ID NO: 377139 - DNA, 25 bp, Homo sapien
ccacgcaccacctacctggcttcct

SEQ ID NO: 377140 - DNA, 25 bp, Homo sapien
cacgcaccacctacctggcttcctg

SEQ ID NO: 377141 - DNA, 25 bp, Homo sapien
acgcaccacctacctggcttcctgc

SEQ ID NO: 377142 - DNA, 25 bp, Homo sapien
cgcaccacctacctggcttcctgca

SEQ ID NO: 377143 - DNA, 25 bp, Homo sapien
gcaccacctacctggcttcctgcaa

SEQ ID NO: 377144 - DNA, 25 bp, Homo sapien
caccacctacctggcttcctgcaag

SEQ ID NO: 377145 - DNA, 25 bp, Homo sapien
accacctacctggcttcctgcaagg

SEQ ID NO: 377146 - DNA, 25 bp, Homo sapien
ccacctacctggcttcctgcaaggc

SEQ ID NO: 377147 - DNA, 25 bp, Homo sapien
ttccagggccttaagcaccacgaat

SEQ ID NO: 377148 - DNA, 25 bp, Homo sapien
cagggccttaagcaccacgaataat

SEQ ID NO: 377149 - DNA, 25 bp, Homo sapien
agggccttaagcaccacgaataata

SEQ ID NO: 377150 - DNA, 25 bp, Homo sapien
gggccttaagcaccacgaataataa

SEQ ID NO: 377151 - DNA, 25 bp, Homo sapien
cacgaataataaagcatgtggattt

SEQ ID NO: 377152 - DNA, 25 bp, Homo sapien
aagcatgtggattttatcttatgaa

SEQ ID NO: 377153 - DNA, 25 bp, Homo sapien
gcatgtggattttatcttatgaaat

SEQ ID NO: 377154 - DNA, 25 bp, Homo sapien
agaagtcattaaagggtgaggcata

SEQ ID NO: 377155 - DNA, 25 bp, Homo sapien
agcagcaggagccagaccttccagg

SEQ ID NO: 377156 - DNA, 25 bp, Homo sapien
gcagcaggagccagaccttccaggg

SEQ ID NO: 377157 - DNA, 25 bp, Homo sapien
gcaggagccagaccttccagggcct

SEQ ID NO: 377158 - DNA, 25 bp, Homo sapien
ctcagggctgactcatgggtagcag

SEQ ID NO: 377159 - DNA, 25 bp, Homo sapien
gcaggcctgtgggtgcttctgtcac

SEQ ID NO: 377160 - DNA, 25 bp, Homo sapien
atgggtagcagaggcctgctcccca

SEQ ID NO: 377161 - DNA, 25 bp, Homo sapien
cgctgggaaacctttgggctgagtc

SEQ ID NO: 377162 - DNA, 25 bp, Homo sapien
tttgggctgagtcagacttttagat

SEQ ID NO: 377163 - DNA, 25 bp, Homo sapien
tccctgtgtggccttgcacaattta

SEQ ID NO: 377164 - DNA, 25 bp, Homo sapien
gcacaatttacagcctcagtttctc

SEQ ID NO: 377165 - DNA, 25 bp, Homo sapien
tcccagcctcctatagatggaaggc

SEQ ID NO: 377166 - DNA, 25 bp, Homo sapien
ttctgtcacccctgggagtcttttt

SEQ ID NO: 377167 - DNA, 25 bp, Homo sapien
agccactccctaacgggtgtagagc

SEQ ID NO: 377168 - DNA, 25 bp, Homo sapien
gagcaagattggaagataccctgga

SEQ ID NO: 377169 - DNA, 25 bp, Homo sapien
ggacaaggatatcaaataactactg

SEQ ID NO: 377170 - DNA, 25 bp, Homo sapien
aactactgttcaatctttactcaag

SEQ ID NO: 377171 - DNA, 25 bp, Homo sapien
actgttcaatctttactcaagtgtg

SEQ ID NO: 377172 - DNA, 25 bp, Homo sapien
gttcaatctttactcaagtgtggaa

SEQ ID NO: 377173 - DNA, 25 bp, Homo sapien
tactcaagtgtggaaattttgcctg

SEQ ID NO: 377174 - DNA, 25 bp, Homo sapien
ggaaattttgcctgaagtcctccac

SEQ ID NO: 377175 - DNA, 25 bp, Homo sapien
tgaagtcctccacctaaaaacctga

SEQ ID NO: 377176 - DNA, 25 bp, Homo sapien
agtcctccacctaaaaacctgatgc

SEQ ID NO: 377177 - DNA, 25 bp, Homo sapien
cctgatgccattggtaatgatgttt

SEQ ID NO: 377178 - DNA, 25 bp, Homo sapien
gaagataagatcaaagcacagaaaa

SEQ ID NO: 377179 - DNA, 25 bp, Homo sapien
tatatatatctggttgaaatactat

SEQ ID NO: 377180 - DNA, 25 bp, Homo sapien
tttatcgaccccagttgcacgtttc

SEQ ID NO: 377181 - DNA, 25 bp, Homo sapien
gttgcacgtttcaccttggaggata

SEQ ID NO: 377182 - DNA, 25 bp, Homo sapien
tatctcccctccttgaatgaaagtt

SEQ ID NO: 377183 - DNA, 25 bp, Homo sapien
gaatgaaagttttactcgggcaggt

SEQ ID NO: 377184 - DNA, 25 bp, Homo sapien
tcgggcaggtaccttatcttcttca

SEQ ID NO: 377185 - DNA, 25 bp, Homo sapien
atcttcttcactgtttatatctgac

SEQ ID NO: 377186 - DNA, 25 bp, Homo sapien
atatctgacatctcagcggtacctg

SEQ ID NO: 377187 - DNA, 25 bp, Homo sapien
atctcagcggtacctggtctatagt

SEQ ID NO: 377188 - DNA, 25 bp, Homo sapien
gtacctggtctatagtaggtgttta

SEQ ID NO: 377189 - DNA, 25 bp, Homo sapien
gtcaatgtcacacgttaactcagag

SEQ ID NO: 377190 - DNA, 25 bp, Homo sapien
cacacgttaactcagagaggccttc

SEQ ID NO: 377191 - DNA, 25 bp, Homo sapien
atcttccatacaaccggtgtatgtt

SEQ ID NO: 377192 - DNA, 25 bp, Homo sapien
caaccggtgtatgttttgaaatctc

SEQ ID NO: 377193 - DNA, 25 bp, Homo sapien
ttgaaatctcattcaacctataggg

SEQ ID NO: 377194 - DNA, 25 bp, Homo sapien
gcaattataactttgcagctttata

SEQ ID NO: 377195 - DNA, 25 bp, Homo sapien
tgcagctttataacactacgatctt

SEQ ID NO: 377196 - DNA, 25 bp, Homo sapien
acactacgatctttatcaggctggt

SEQ ID NO: 377197 - DNA, 25 bp, Homo sapien
atcagattgatggtctcagatgaac

SEQ ID NO: 377198 - DNA, 25 bp, Homo sapien
aattcatatttcctaatagcaaagt

SEQ ID NO: 377199 - DNA, 25 bp, Homo sapien
gcaaagttattctaatttcaggatt

SEQ ID NO: 377200 - DNA, 25 bp, Homo sapien
gtgttaatgccagaataatacccca

SEQ ID NO: 377201 - DNA, 25 bp, Homo sapien
tgccagaataataccccaaatctag

SEQ ID NO: 377202 - DNA, 25 bp, Homo sapien
ttcttccacatggttagaggcatgt

SEQ ID NO: 377203 - DNA, 25 bp, Homo sapien
aggcatgtgattttcagcactgtgt

SEQ ID NO: 377204 - DNA, 25 bp, Homo sapien
gaatggtgtattataacgtgtgcaa

SEQ ID NO: 377205 - DNA, 25 bp, Homo sapien
aacgtgtgcaagataatgtcagtgt

SEQ ID NO: 377206 - DNA, 25 bp, Homo sapien
agtgtgcacagagggtcttttttcc

SEQ ID NO: 377207 - DNA, 25 bp, Homo sapien
tttttccttatctgattagtactgt

SEQ ID NO: 377208 - DNA, 25 bp, Homo sapien
cctgatttttcaaccatgacctgca

SEQ ID NO: 377209 - DNA, 25 bp, Homo sapien
ttttcaaccatgacctgcatgagag

SEQ ID NO: 377210 - DNA, 25 bp, Homo sapien
gcatgagagaagcatcctaggaagt

SEQ ID NO: 377211 - DNA, 25 bp, Homo sapien
gcatcctaggaagtcttagatcata

SEQ ID NO: 377212 - DNA, 25 bp, Homo sapien
gtcttagatcatacttttgagtttt

SEQ ID NO: 377213 - DNA, 25 bp, Homo sapien
tgtgtgggttataattcatctatac

SEQ ID NO: 377214 - DNA, 25 bp, Homo sapien
tacagatcaagcatcccaatgtgtt

SEQ ID NO: 377215 - DNA, 25 bp, Homo sapien
gcatcccaatgtgtttgttggttaa

SEQ ID NO: 377216 - DNA, 25 bp, Homo sapien
gttggttaaccagcatcttagtctt

SEQ ID NO: 377217 - DNA, 25 bp, Homo sapien
accagcatcttagtcttctagcaag

SEQ ID NO: 377218 - DNA, 25 bp, Homo sapien
gtcttctagcaagaaagtttccaga

SEQ ID NO: 377219 - DNA, 25 bp, Homo sapien
gcggttacaggaatggaaagctctt

SEQ ID NO: 377220 - DNA, 25 bp, Homo sapien
actaaatttgttaaagccatcgtga

SEQ ID NO: 377221 - DNA, 25 bp, Homo sapien
aaagccatcgtgaatagctgtattc

SEQ ID NO: 377222 - DNA, 25 bp, Homo sapien
gtattcaacactaccatgacaattg

SEQ ID NO: 377223 - DNA, 25 bp, Homo sapien
ctaccatgacaattgtttaccaaca

SEQ ID NO: 377224 - DNA, 25 bp, Homo sapien
gtgcagagtgtcgatatcgcagctt

SEQ ID NO: 377225 - DNA, 25 bp, Homo sapien
gagtgtcgatatcgcagctttcaac

SEQ ID NO: 377226 - DNA, 25 bp, Homo sapien
cgatatcgcagctttcaacaagatc

SEQ ID NO: 377227 - DNA, 25 bp, Homo sapien
tttcaacaagatctgaagcctgagt

SEQ ID NO: 377228 - DNA, 25 bp, Homo sapien
tcaacaagatctgaagcctgagtgt

SEQ ID NO: 377229 - DNA, 25 bp, Homo sapien
agatctgaagcctgagtgtgtgtac

SEQ ID NO: 377230 - DNA, 25 bp, Homo sapien
atctgaagcctgagtgtgtgtacgt

SEQ ID NO: 377231 - DNA, 25 bp, Homo sapien
ctgaagcctgagtgtgtgtacgtgc

SEQ ID NO: 377232 - DNA, 25 bp, Homo sapien
gaagcctgagtgtgtgtacgtgcgc

SEQ ID NO: 377233 - DNA, 25 bp, Homo sapien
ggccctgccacgattaaagactgag

SEQ ID NO: 377234 - DNA, 25 bp, Homo sapien
agcacgtgcagagtgtcgatatcgc

SEQ ID NO: 377235 - DNA, 25 bp, Homo sapien
tggctggtccccatgactgaattga

SEQ ID NO: 377236 - DNA, 25 bp, Homo sapien
gctggtccccatgactgaattgagt

SEQ ID NO: 377237 - DNA, 25 bp, Homo sapien
ggtccccatgactgaattgagtggt

SEQ ID NO: 377238 - DNA, 25 bp, Homo sapien
catgactgaattgagtggtgaagcc

SEQ ID NO: 377239 - DNA, 25 bp, Homo sapien
agtggtgaagccaccttctcctggc

SEQ ID NO: 377240 - DNA, 25 bp, Homo sapien
tcatggacccgggatcttgggtgtt

SEQ ID NO: 377241 - DNA, 25 bp, Homo sapien
ggatcttgggtgttcacccctaaat

SEQ ID NO: 377242 - DNA, 25 bp, Homo sapien
ccaggagcccaccctaaaggtgagt

SEQ ID NO: 377243 - DNA, 25 bp, Homo sapien
caagtactcacgggactctccaggg

SEQ ID NO: 377244 - DNA, 25 bp, Homo sapien
tgtagaaccaggaccacccttacca

SEQ ID NO: 377245 - DNA, 25 bp, Homo sapien
ttaccaggcctaggaccctccagga

SEQ ID NO: 377246 - DNA, 25 bp, Homo sapien
gtaaactttgacatttccactttgt

SEQ ID NO: 377247 - DNA, 25 bp, Homo sapien
atttaaattctatctgtctgactga

SEQ ID NO: 377248 - DNA, 25 bp, Homo sapien
atctgtctgactgaagttctaaggc

SEQ ID NO: 377249 - DNA, 25 bp, Homo sapien
aagttctaaggcattctgtggttac

SEQ ID NO: 377250 - DNA, 25 bp, Homo sapien
ctgtggttacttagaaatgattcct

SEQ ID NO: 377251 - DNA, 25 bp, Homo sapien
ggaagacaatcatctcctgtgatca

SEQ ID NO: 377252 - DNA, 25 bp, Homo sapien
atgattccttatattaatgtttaca

SEQ ID NO: 377253 - DNA, 25 bp, Homo sapien
gttaaatacatgtcttattgcctaa

SEQ ID NO: 377254 - DNA, 25 bp, Homo sapien
aatcatctcctgtgatcagcttaag

SEQ ID NO: 377255 - DNA, 25 bp, Homo sapien
tctcctgtgatcagcttaaggtttt

SEQ ID NO: 377256 - DNA, 25 bp, Homo sapien
gttttgttttatctggaacaagcta

SEQ ID NO: 377257 - DNA, 25 bp, Homo sapien
gaccactcagtgtgctgttcatctt

SEQ ID NO: 377258 - DNA, 25 bp, Homo sapien
tctttgtattgctgacacctaaccc

SEQ ID NO: 377259 - DNA, 25 bp, Homo sapien
gccttgacccagtgtactcagtact

SEQ ID NO: 377260 - DNA, 25 bp, Homo sapien
agtactgaccagattcttgaatcct

SEQ ID NO: 377261 - DNA, 25 bp, Homo sapien
gaatcctgtgctatgatatccatgt

SEQ ID NO: 377262 - DNA, 25 bp, Homo sapien
ggaagttaggcattggtacccacac

SEQ ID NO: 377263 - DNA, 25 bp, Homo sapien
acattttgtacccacaactgctgca

SEQ ID NO: 377264 - DNA, 25 bp, Homo sapien
gatcatcttctctaatcacaggtaa

SEQ ID NO: 377265 - DNA, 25 bp, Homo sapien
tcacaggtaacatccccaagcaaat

SEQ ID NO: 377266 - DNA, 25 bp, Homo sapien
aactgctgcagcacttgagttctgc

SEQ ID NO: 377267 - DNA, 25 bp, Homo sapien
tgctgagcttgtttgcacattcacc

SEQ ID NO: 377268 - DNA, 25 bp, Homo sapien
cacaagaggcctcccagtgtgcgcg

SEQ ID NO: 377269 - DNA, 25 bp, Homo sapien
gggtcctgagccacccaccgaagga

SEQ ID NO: 377270 - DNA, 25 bp, Homo sapien
ccgcgggacagcaaggcccgaagca

SEQ ID NO: 377271 - DNA, 25 bp, Homo sapien
ggtcgctccgggatgtctgagctct

SEQ ID NO: 377272 - DNA, 25 bp, Homo sapien
ccgggatgtctgagctctgggaggg

SEQ ID NO: 377273 - DNA, 25 bp, Homo sapien
gtgtgcgcgggcctcttgaagaagt

SEQ ID NO: 377274 - DNA, 25 bp, Homo sapien
gaagtaactctactcagaggcccga

SEQ ID NO: 377275 - DNA, 25 bp, Homo sapien
gtaactctactcagaggcccgaatg

SEQ ID NO: 377276 - DNA, 25 bp, Homo sapien
tcagaggcccgaatgacccaaactg

SEQ ID NO: 377277 - DNA, 25 bp, Homo sapien
agaggcccgaatgacccaaactggg

SEQ ID NO: 377278 - DNA, 25 bp, Homo sapien
aatgacccaaactgggctctgggag

SEQ ID NO: 377279 - DNA, 25 bp, Homo sapien
ctgcacctggccaaatgtgtatata

SEQ ID NO: 377280 - DNA, 25 bp, Homo sapien
taatatgtattagtcacatcaggat

SEQ ID NO: 377281 - DNA, 25 bp, Homo sapien
gtattagtcacatcaggataaagta

SEQ ID NO: 377282 - DNA, 25 bp, Homo sapien
ggataaagtatctattaccttcagc

SEQ ID NO: 377283 - DNA, 25 bp, Homo sapien
aaagtatctattaccttcagcattt

SEQ ID NO: 377284 - DNA, 25 bp, Homo sapien
ctattaccttcagcatttatccttt

SEQ ID NO: 377285 - DNA, 25 bp, Homo sapien
gtattacaagccaattctacacttc

SEQ ID NO: 377286 - DNA, 25 bp, Homo sapien
ttacaagccaattctacacttcatt

SEQ ID NO: 377287 - DNA, 25 bp, Homo sapien
caagccaattctacacttcattatt

SEQ ID NO: 377288 - DNA, 25 bp, Homo sapien
gccaattctacacttcattatttta

SEQ ID NO: 377289 - DNA, 25 bp, Homo sapien
gactacagggtcattttaattataa

SEQ ID NO: 377290 - DNA, 25 bp, Homo sapien
ggaaaacatgtacacctaacagcat

SEQ ID NO: 377291 - DNA, 25 bp, Homo sapien
agcatggtaaggaagccccagaagg

SEQ ID NO: 377292 - DNA, 25 bp, Homo sapien
agccccagaaggatgtttctaaaga

SEQ ID NO: 377293 - DNA, 25 bp, Homo sapien
ggatgtttctaaagaccatgaggga

SEQ ID NO: 377294 - DNA, 25 bp, Homo sapien
gaccatgagggagtctgaaacctga

SEQ ID NO: 377295 - DNA, 25 bp, Homo sapien
gagtctgaaacctgaaatcatgcca

SEQ ID NO: 377296 - DNA, 25 bp, Homo sapien
gaaacctgaaatcatgccaaggact

SEQ ID NO: 377297 - DNA, 25 bp, Homo sapien
gggtgtctatctgatgctgccacaa

SEQ ID NO: 377298 - DNA, 25 bp, Homo sapien
gtctatctgatgctgccacaaccag

SEQ ID NO: 377299 - DNA, 25 bp, Homo sapien
gctgccacaaccagttgaaacgtat

SEQ ID NO: 377300 - DNA, 25 bp, Homo sapien
tgtaatgtccttaatagtaaaccgg

SEQ ID NO: 377301 - DNA, 25 bp, Homo sapien
ctgcacgtccggtgggacacacctg

SEQ ID NO: 377302 - DNA, 25 bp, Homo sapien
tccagagggagagtgcaggcccctt

SEQ ID NO: 377303 - DNA, 25 bp, Homo sapien
tccagctcagaatgatgcagaaatg

SEQ ID NO: 377304 - DNA, 25 bp, Homo sapien
agaaatgataagactcaaagcaggg

SEQ ID NO: 377305 - DNA, 25 bp, Homo sapien
cacggaggaaccagggcacatctgt

SEQ ID NO: 377306 - DNA, 25 bp, Homo sapien
gggcacatctgtggtacccagggac

SEQ ID NO: 377307 - DNA, 25 bp, Homo sapien
atctgtggtacccagggacgtccct

SEQ ID NO: 377308 - DNA, 25 bp, Homo sapien
gggacgtcccttgtcagcccgtttg

SEQ ID NO: 377309 - DNA, 25 bp, Homo sapien
gtcagcccgtttgccacacattgtt

SEQ ID NO: 377310 - DNA, 25 bp, Homo sapien
cacacattgttcctcttgtccaggg

SEQ ID NO: 377311 - DNA, 25 bp, Homo sapien
gcttcccaggactggaggagcagct

SEQ ID NO: 377312 - DNA, 25 bp, Homo sapien
tcagaattcggatttctctccacgt

SEQ ID NO: 377313 - DNA, 25 bp, Homo sapien
tcttttgttacggacacccatcatg

SEQ ID NO: 377314 - DNA, 25 bp, Homo sapien
ggatttctctccacgtggcgtctgc

SEQ ID NO: 377315 - DNA, 25 bp, Homo sapien
cttccaggctggagcgacgtttcca

SEQ ID NO: 377316 - DNA, 25 bp, Homo sapien
ttgttacggacacccatcatgtatg

SEQ ID NO: 377317 - DNA, 25 bp, Homo sapien
gacgtttccacgttcggatgctgca

SEQ ID NO: 377318 - DNA, 25 bp, Homo sapien
acgttcggatgctgcagcctctgca

SEQ ID NO: 377319 - DNA, 25 bp, Homo sapien
agataccacctgtctcttcgtggca

SEQ ID NO: 377320 - DNA, 25 bp, Homo sapien
acctgtctcttcgtggcatttggga

SEQ ID NO: 377321 - DNA, 25 bp, Homo sapien
tcttcgtggcatttgggagatgcgt

SEQ ID NO: 377322 - DNA, 25 bp, Homo sapien
acacccatcatgtatggctcctcat

SEQ ID NO: 377323 - DNA, 25 bp, Homo sapien
tgtctgctacgctcatcagagtata

SEQ ID NO: 377324 - DNA, 25 bp, Homo sapien
ttgtaactgccttattgaaaagtaa

SEQ ID NO: 377325 - DNA, 25 bp, Homo sapien
attccaggcctcctcatattgtact

SEQ ID NO: 377326 - DNA, 25 bp, Homo sapien
ttccaggcctcctcatattgtactt

SEQ ID NO: 377327 - DNA, 25 bp, Homo sapien
cttttcatgttgcaatatcacacga

SEQ ID NO: 377328 - DNA, 25 bp, Homo sapien
ttcatgttgcaatatcacacgatgg

SEQ ID NO: 377329 - DNA, 25 bp, Homo sapien
atgttgcaatatcacacgatgggat

SEQ ID NO: 377330 - DNA, 25 bp, Homo sapien
gcaatatcacacgatgggatggccc

SEQ ID NO: 377331 - DNA, 25 bp, Homo sapien
aatatcacacgatgggatggcccga

SEQ ID NO: 377332 - DNA, 25 bp, Homo sapien
atcacacgatgggatggcccgactt

SEQ ID NO: 377333 - DNA, 25 bp, Homo sapien
acacgatgggatggcccgacttttg

SEQ ID NO: 377334 - DNA, 25 bp, Homo sapien
gtatactgtattgcagacaaccgca

SEQ ID NO: 377335 - DNA, 25 bp, Homo sapien
actgtattgcagacaaccgcatggg

SEQ ID NO: 377336 - DNA, 25 bp, Homo sapien
caaaggtggtgggatacaactaggt

SEQ ID NO: 377337 - DNA, 25 bp, Homo sapien
gatacaactaggtttcaagcaactt

SEQ ID NO: 377338 - DNA, 25 bp, Homo sapien
aactaggtttcaagcaacttatgtc

SEQ ID NO: 377339 - DNA, 25 bp, Homo sapien
aatgctgaagcaacaactatataac

SEQ ID NO: 377340 - DNA, 25 bp, Homo sapien
gggaacatttacatggctctagttt

SEQ ID NO: 377341 - DNA, 25 bp, Homo sapien
atggctctagttttacatgactcta

SEQ ID NO: 377342 - DNA, 25 bp, Homo sapien
gactctagtgttgaccattggattt

SEQ ID NO: 377343 - DNA, 25 bp, Homo sapien
cattggattttctcgtggtcagcag

SEQ ID NO: 377344 - DNA, 25 bp, Homo sapien
ttggattttctcgtggtcagcagct

SEQ ID NO: 377345 - DNA, 25 bp, Homo sapien
aatccctcggagtaatctttggcct

SEQ ID NO: 377346 - DNA, 25 bp, Homo sapien
cttccgtgtgtgatgtttctttgtt

SEQ ID NO: 377347 - DNA, 25 bp, Homo sapien
attttttgaccttctgctttttgat

SEQ ID NO: 377348 - DNA, 25 bp, Homo sapien
ttttgattcgggattttggagccag

SEQ ID NO: 377349 - DNA, 25 bp, Homo sapien
ttttggagccagaatgccttggccc

SEQ ID NO: 377350 - DNA, 25 bp, Homo sapien
ttggccccgccatgaggtctgactt

SEQ ID NO: 377351 - DNA, 25 bp, Homo sapien
atgaggtctgacttgtgctggctac

SEQ ID NO: 377352 - DNA, 25 bp, Homo sapien
tgtgctggctactttacccttggtg

SEQ ID NO: 377353 - DNA, 25 bp, Homo sapien
gtgcagagtacagtgagtcaaacca

SEQ ID NO: 377354 - DNA, 25 bp, Homo sapien
aaccattgagagtggtgcctggcac

SEQ ID NO: 377355 - DNA, 25 bp, Homo sapien
gtatttttgcacttaatttcatgta

SEQ ID NO: 377356 - DNA, 25 bp, Homo sapien
gcaatcagatttctcagcctggtac

SEQ ID NO: 377357 - DNA, 25 bp, Homo sapien
gatttctcagcctggtacattatga

SEQ ID NO: 377358 - DNA, 25 bp, Homo sapien
ggtacattatgaacagcttagtgct

SEQ ID NO: 377359 - DNA, 25 bp, Homo sapien
cagcttagtgctgttgagtaattta

SEQ ID NO: 377360 - DNA, 25 bp, Homo sapien
gatgattaggaaagcttttctctgc

SEQ ID NO: 377361 - DNA, 25 bp, Homo sapien
aaattaaaccactggctcaaacaga

SEQ ID NO: 377362 - DNA, 25 bp, Homo sapien
ggctcaaacagaattttccttgaac

SEQ ID NO: 377363 - DNA, 25 bp, Homo sapien
ttccttgaacccaagttttcacatt

SEQ ID NO: 377364 - DNA, 25 bp, Homo sapien
ttcacattagagatttgcataactt

SEQ ID NO: 377365 - DNA, 25 bp, Homo sapien
aaagggttgcacagccaaatgttaa

SEQ ID NO: 377366 - DNA, 25 bp, Homo sapien
gctgaagaagtgacgttattttaga

SEQ ID NO: 377367 - DNA, 25 bp, Homo sapien
aaaagtactgtacacccatgctcaa

SEQ ID NO: 377368 - DNA, 25 bp, Homo sapien
gtactgtacacccatgctcaatata

SEQ ID NO: 377369 - DNA, 25 bp, Homo sapien
gtacacccatgctcaatatatagtc

SEQ ID NO: 377370 - DNA, 25 bp, Homo sapien
catgctcaatatatagtcctggaaa

SEQ ID NO: 377371 - DNA, 25 bp, Homo sapien
gcaattgaaacatgtcttctcacaa

SEQ ID NO: 377372 - DNA, 25 bp, Homo sapien
tgtggtgttttaagttgctgtggac

SEQ ID NO: 377373 - DNA, 25 bp, Homo sapien
taagttgctgtggacacttttaaga

SEQ ID NO: 377374 - DNA, 25 bp, Homo sapien
tagaacccatggaacccttgtttat

SEQ ID NO: 377375 - DNA, 25 bp, Homo sapien
atggaacccttgtttatcgccatgc

SEQ ID NO: 377376 - DNA, 25 bp, Homo sapien
aacccttgtttatcgccatgcaaat

SEQ ID NO: 377377 - DNA, 25 bp, Homo sapien
atcgccatgcaaattacaatcttga

SEQ ID NO: 377378 - DNA, 25 bp, Homo sapien
gacagcttccagacaatggccggga

SEQ ID NO: 377379 - DNA, 25 bp, Homo sapien
ggtgcactcaggctgtgccaccgat

SEQ ID NO: 377380 - DNA, 25 bp, Homo sapien
cccttgcctgctctgagactcagtt

SEQ ID NO: 377381 - DNA, 25 bp, Homo sapien
gagactcagtttctgtacccataaa

SEQ ID NO: 377382 - DNA, 25 bp, Homo sapien
aatgggcacaataacaccccatccg

SEQ ID NO: 377383 - DNA, 25 bp, Homo sapien
ttgtcccgtttcatttttcctcaca

SEQ ID NO: 377384 - DNA, 25 bp, Homo sapien
tcagtacctgatacgaatttcctgg

SEQ ID NO: 377385 - DNA, 25 bp, Homo sapien
gaatttcctggttgactcactcact

SEQ ID NO: 377386 - DNA, 25 bp, Homo sapien
caatggtggcaattccttgagggca

SEQ ID NO: 377387 - DNA, 25 bp, Homo sapien
agggactcggttccccagagcatgc

SEQ ID NO: 377388 - DNA, 25 bp, Homo sapien
atgcctggcacggtgcagtgaacag

SEQ ID NO: 377389 - DNA, 25 bp, Homo sapien
gggctcagatggatccctggaccct

SEQ ID NO: 377390 - DNA, 25 bp, Homo sapien
gagtctggactcaagggctccctgc

SEQ ID NO: 377391 - DNA, 25 bp, Homo sapien
caagggctccctgcagcattgcggg

SEQ ID NO: 377392 - DNA, 25 bp, Homo sapien
tcttgtagcttggaggatccaggca

SEQ ID NO: 377393 - DNA, 25 bp, Homo sapien
cttggaggatccaggcatataggga

SEQ ID NO: 377394 - DNA, 25 bp, Homo sapien
atgaaatggaagctgctgcaccctg

SEQ ID NO: 377395 - DNA, 25 bp, Homo sapien
atggaagctgctgcaccctgctggg

SEQ ID NO: 377396 - DNA, 25 bp, Homo sapien
ggagcagaccctgccatttacctgt

SEQ ID NO: 377397 - DNA, 25 bp, Homo sapien
gccatttacctgttctggcgtagaa

SEQ ID NO: 377398 - DNA, 25 bp, Homo sapien
acctgttctggcgtagaatggactg

SEQ ID NO: 377399 - DNA, 25 bp, Homo sapien
ttctggcgtagaatggactgggaat

SEQ ID NO: 377400 - DNA, 25 bp, Homo sapien
gaatgctaatattcaacataaactt

SEQ ID NO: 377401 - DNA, 25 bp, Homo sapien
agtgagattttagcattaactctgt

SEQ ID NO: 377402 - DNA, 25 bp, Homo sapien
gtgagattttagcattaactctgtt

SEQ ID NO: 377403 - DNA, 25 bp, Homo sapien
atcttgaatttaaaacttctacctg

SEQ ID NO: 377404 - DNA, 25 bp, Homo sapien
tgaatttaaaacttctacctgtaga

SEQ ID NO: 377405 - DNA, 25 bp, Homo sapien
gaatttaaaacttctacctgtagat

SEQ ID NO: 377406 - DNA, 25 bp, Homo sapien
ttaaaacttctacctgtagatatta

SEQ ID NO: 377407 - DNA, 25 bp, Homo sapien
aaaacttctacctgtagatattaag

SEQ ID NO: 377408 - DNA, 25 bp, Homo sapien
aaacttctacctgtagatattaagt

SEQ ID NO: 377409 - DNA, 25 bp, Homo sapien
aacttctacctgtagatattaagtt

SEQ ID NO: 377410 - DNA, 25 bp, Homo sapien
acttctacctgtagatattaagttt

SEQ ID NO: 377411 - DNA, 25 bp, Homo sapien
aggcccgggcgcaggaccgctggag

SEQ ID NO: 377412 - DNA, 25 bp, Homo sapien
gcccgggcgcaggaccgctggagga

SEQ ID NO: 377413 - DNA, 25 bp, Homo sapien
ggcgcaggaccgctggaggacgcag

SEQ ID NO: 377414 - DNA, 25 bp, Homo sapien
gcgcaggaccgctggaggacgcagc

SEQ ID NO: 377415 - DNA, 25 bp, Homo sapien
caggaccgctggaggacgcagcgtc

SEQ ID NO: 377416 - DNA, 25 bp, Homo sapien
ggaccgctggaggacgcagcgtcca

SEQ ID NO: 377417 - DNA, 25 bp, Homo sapien
tcagcgcaggggacgccgtcttcct

SEQ ID NO: 377418 - DNA, 25 bp, Homo sapien
gcaggggacgccgtcttcctctggg

SEQ ID NO: 377419 - DNA, 25 bp, Homo sapien
tccaccacggctgggcgtctgtgcc

SEQ ID NO: 377420 - DNA, 25 bp, Homo sapien
ggcgtctgtgccaggcctcccgaag

SEQ ID NO: 377421 - DNA, 25 bp, Homo sapien
agcctgcaagacaggcccgggcgca

SEQ ID NO: 377422 - DNA, 25 bp, Homo sapien
gaaaatctactgtagtctgttttaa

SEQ ID NO: 377423 - DNA, 25 bp, Homo sapien
gtatgctatactatgttcattggtt

SEQ ID NO: 377424 - DNA, 25 bp, Homo sapien
gctattttgtgaactgtataccctc

SEQ ID NO: 377425 - DNA, 25 bp, Homo sapien
gttcattggttacttaactggatat

SEQ ID NO: 377426 - DNA, 25 bp, Homo sapien
gtgaatccacaattcttgcagaact

SEQ ID NO: 377427 - DNA, 25 bp, Homo sapien
gaactgtataccctctgaaagcgct

SEQ ID NO: 377428 - DNA, 25 bp, Homo sapien
cactcctttaccttagaactgtcaa

SEQ ID NO: 377429 - DNA, 25 bp, Homo sapien
gtataccctctgaaagcgcttattt

SEQ ID NO: 377430 - DNA, 25 bp, Homo sapien
ttacatgctacacaacagttccaat

SEQ ID NO: 377431 - DNA, 25 bp, Homo sapien
gttccaattttaaggagtgtctcct

SEQ ID NO: 377432 - DNA, 25 bp, Homo sapien
gagtgtctcctaaaattgggatgaa

SEQ ID NO: 377433 - DNA, 25 bp, Homo sapien
ctttgaagaaccctcaatgagtctg

SEQ ID NO: 377434 - DNA, 25 bp, Homo sapien
aggttcagtatctcttgggaaggat

SEQ ID NO: 377435 - DNA, 25 bp, Homo sapien
ctcttgggaaggatgtgttccaggc

SEQ ID NO: 377436 - DNA, 25 bp, Homo sapien
aggctccaggcctagtcttacatgg

SEQ ID NO: 377437 - DNA, 25 bp, Homo sapien
gggttgaaagactgtgcccctgcaa

SEQ ID NO: 377438 - DNA, 25 bp, Homo sapien
cccctgcaatggtcttttcctaaga

SEQ ID NO: 377439 - DNA, 25 bp, Homo sapien
gtctgtctgtcctattttaaccatc

SEQ ID NO: 377440 - DNA, 25 bp, Homo sapien
acacctggcagtgtcaggtctggga

SEQ ID NO: 377441 - DNA, 25 bp, Homo sapien
gtcaggtctgggaaaacagttgctg

SEQ ID NO: 377442 - DNA, 25 bp, Homo sapien
acagttgctgatgttttcatggagt

SEQ ID NO: 377443 - DNA, 25 bp, Homo sapien
aatactgaaagctgcgggcatccct

SEQ ID NO: 377444 - DNA, 25 bp, Homo sapien
agattagggtttgactggtaggaca

SEQ ID NO: 377445 - DNA, 25 bp, Homo sapien
gggcacatgagaaccaagctgattt

SEQ ID NO: 377446 - DNA, 25 bp, Homo sapien
gatgtggatcacagtagagacagat

SEQ ID NO: 377447 - DNA, 25 bp, Homo sapien
gagacagattaaactggcaagccaa

SEQ ID NO: 377448 - DNA, 25 bp, Homo sapien
aactggcaagccaaggctgaaggtt

SEQ ID NO: 377449 - DNA, 25 bp, Homo sapien
tttgactggtaggacaggactgacc

SEQ ID NO: 377450 - DNA, 25 bp, Homo sapien
aggagaattccaagtatttgactag

SEQ ID NO: 377451 - DNA, 25 bp, Homo sapien
gactagaaggtaagcccagaaggca

SEQ ID NO: 377452 - DNA, 25 bp, Homo sapien
gacaggactgaccagagactatcat

SEQ ID NO: 377453 - DNA, 25 bp, Homo sapien
cagagactatcattctaaactttag

SEQ ID NO: 377454 - DNA, 25 bp, Homo sapien
ctttagtcaaagagtactgtgcccc

SEQ ID NO: 377455 - DNA, 25 bp, Homo sapien
gcggctaagcggtgcgctctgaaat

SEQ ID NO: 377456 - DNA, 25 bp, Homo sapien
taagcggtgcgctctgaaatggccg

SEQ ID NO: 377457 - DNA, 25 bp, Homo sapien
ggtgcgctctgaaatggccgcttcc

SEQ ID NO: 377458 - DNA, 25 bp, Homo sapien
tgcgctctgaaatggccgcttcctg

SEQ ID NO: 377459 - DNA, 25 bp, Homo sapien
ctgaaatggccgcttcctggaactg

SEQ ID NO: 377460 - DNA, 25 bp, Homo sapien
tgaaatggccgcttcctggaactgc

SEQ ID NO: 377461 - DNA, 25 bp, Homo sapien
gaaatggccgcttcctggaactgcc

SEQ ID NO: 377462 - DNA, 25 bp, Homo sapien
tggaactgcctaagatggcggtcgc

SEQ ID NO: 377463 - DNA, 25 bp, Homo sapien
taagatggcggtcgcgggctctgct

SEQ ID NO: 377464 - DNA, 25 bp, Homo sapien
tgctgtgcagcccagccgcggcaaa

SEQ ID NO: 377465 - DNA, 25 bp, Homo sapien
gctgtgcagcccagccgcggcaaaa

SEQ ID NO: 377466 - DNA, 25 bp, Homo sapien
atattacatgtattgccaactcaaa

SEQ ID NO: 377467 - DNA, 25 bp, Homo sapien
ttgccaactcaaaactttcagcttt

SEQ ID NO: 377468 - DNA, 25 bp, Homo sapien
ttcagcttttaacatgcttcctcac

SEQ ID NO: 377469 - DNA, 25 bp, Homo sapien
ttcctcacacattatcccctttgat

SEQ ID NO: 377470 - DNA, 25 bp, Homo sapien
tttgatcctccacaactctgaggtg

SEQ ID NO: 377471 - DNA, 25 bp, Homo sapien
ggtcttagccccacttggtagatga

SEQ ID NO: 377472 - DNA, 25 bp, Homo sapien
gagatgctcagtatcacacagcaaa

SEQ ID NO: 377473 - DNA, 25 bp, Homo sapien
acagcaaacctcttggccctataca

SEQ ID NO: 377474 - DNA, 25 bp, Homo sapien
tccaaacacaagacccaggttgcat

SEQ ID NO: 377475 - DNA, 25 bp, Homo sapien
gacccaggttgcatatagaaggttc

SEQ ID NO: 377476 - DNA, 25 bp, Homo sapien
gaaggttcagtgtccctggtttaga

SEQ ID NO: 377477 - DNA, 25 bp, Homo sapien
ggaggtttaatacggccaatggatc

SEQ ID NO: 377478 - DNA, 25 bp, Homo sapien
tacggccaatggatcttgtataaag

SEQ ID NO: 377479 - DNA, 25 bp, Homo sapien
tcttgtataaagtctacgtaagttt

SEQ ID NO: 377480 - DNA, 25 bp, Homo sapien
tttaatttaccagagctataagatg

SEQ ID NO: 377481 - DNA, 25 bp, Homo sapien
ggactgctacagataaaatgagata

SEQ ID NO: 377482 - DNA, 25 bp, Homo sapien
atgccataaaattacagtagcttgg

SEQ ID NO: 377483 - DNA, 25 bp, Homo sapien
aattttagtgaatcatggcccttgt

SEQ ID NO: 377484 - DNA, 25 bp, Homo sapien
aatcatggcccttgtgttatctaga

SEQ ID NO: 377485 - DNA, 25 bp, Homo sapien
ggcccttgtgttatctagaatgcta

SEQ ID NO: 377486 - DNA, 25 bp, Homo sapien
aattattcaagctgttcctaaactt

SEQ ID NO: 377487 - DNA, 25 bp, Homo sapien
agctgttcctaaacttaagtatgac

SEQ ID NO: 377488 - DNA, 25 bp, Homo sapien
ccttctcttgcccttatatagtgta

SEQ ID NO: 377489 - DNA, 25 bp, Homo sapien
tgcccttatatagtgtaggtgatat

SEQ ID NO: 377490 - DNA, 25 bp, Homo sapien
aggtgatatttttctatttggctct

SEQ ID NO: 377491 - DNA, 25 bp, Homo sapien
gatatttttctatttggctctttta

SEQ ID NO: 377492 - DNA, 25 bp, Homo sapien
ggctcttttagaagctggactatca

SEQ ID NO: 377493 - DNA, 25 bp, Homo sapien
gaagctggactatcacgaaagaagg

SEQ ID NO: 377494 - DNA, 25 bp, Homo sapien
gtgtagtgcattatgagtcagcctc

SEQ ID NO: 377495 - DNA, 25 bp, Homo sapien
gcattatgagtcagcctctgtggct

SEQ ID NO: 377496 - DNA, 25 bp, Homo sapien
atgagtcagcctctgtggctgtttg

SEQ ID NO: 377497 - DNA, 25 bp, Homo sapien
tttcacatatgtgttgaggagcaat

SEQ ID NO: 377498 - DNA, 25 bp, Homo sapien
gaggagcaatgcatcagtaatgaat

SEQ ID NO: 377499 - DNA, 25 bp, Homo sapien
aaaatcttcttgtgcccgggccaag

SEQ ID NO: 377500 - DNA, 25 bp, Homo sapien
gccaaggcctcttcgtcaatgtaga

SEQ ID NO: 377501 - DNA, 25 bp, Homo sapien
tcaatgtagacagccggcctcttgg

SEQ ID NO: 377502 - DNA, 25 bp, Homo sapien
tcttggccatgaggaaatactgcac

SEQ ID NO: 377503 - DNA, 25 bp, Homo sapien
gaaatactgcaccttcctcagattc

SEQ ID NO: 377504 - DNA, 25 bp, Homo sapien
atcacatactggagccagccgcaga

SEQ ID NO: 377505 - DNA, 25 bp, Homo sapien
accccagcgttgcagtgcacgtaca

SEQ ID NO: 377506 - DNA, 25 bp, Homo sapien
tgcacgtacacgatgtgtcccttct

SEQ ID NO: 377507 - DNA, 25 bp, Homo sapien
gcagcatctgtactcggccttcggt

SEQ ID NO: 377508 - DNA, 25 bp, Homo sapien
ggccttcggtgctcatatctggtgt

SEQ ID NO: 377509 - DNA, 25 bp, Homo sapien
ctcatatctggtgttggcatccaga

SEQ ID NO: 377510 - DNA, 25 bp, Homo sapien
agcaggtccccaagccatgtcaggc

SEQ ID NO: 377511 - DNA, 25 bp, Homo sapien
ggtccccaagccatgtcaggcatct

SEQ ID NO: 377512 - DNA, 25 bp, Homo sapien
atgtcaggcatctccaccacggctg

SEQ ID NO: 377513 - DNA, 25 bp, Homo sapien
ggcgtctgtgccaggcctcccgaag

SEQ ID NO: 377514 - DNA, 25 bp, Homo sapien
gatggcgccagggacaccaggaatt

SEQ ID NO: 377515 - DNA, 25 bp, Homo sapien
atggcgccagggacaccaggaattc

SEQ ID NO: 377516 - DNA, 25 bp, Homo sapien
gcgccagggacaccaggaattcggg

SEQ ID NO: 377517 - DNA, 25 bp, Homo sapien
tacctggcttcctgcaaggccttca

SEQ ID NO: 377518 - DNA, 25 bp, Homo sapien
ggcttcctgcaaggccttcacgcct

SEQ ID NO: 377519 - DNA, 25 bp, Homo sapien
tgagagcgaccaaagcttccccggg

SEQ ID NO: 377520 - DNA, 25 bp, Homo sapien
agcctgcaagacaggcccgggcgca

SEQ ID NO: 377521 - DNA, 25 bp, Homo sapien
taggaaatgttacttttgttaatct

SEQ ID NO: 377522 - DNA, 25 bp, Homo sapien
gaaagacattccactattatgcgta

SEQ ID NO: 377523 - DNA, 25 bp, Homo sapien
ctattatgcgtaatgctcagctttt

SEQ ID NO: 377524 - DNA, 25 bp, Homo sapien
tacaggtatttcacacaataatttg

SEQ ID NO: 377525 - DNA, 25 bp, Homo sapien
aatttgttcttaatgcagccactat

SEQ ID NO: 377526 - DNA, 25 bp, Homo sapien
aatgcagccactataacttgataag

SEQ ID NO: 377527 - DNA, 25 bp, Homo sapien
taacttgataagtcattgcactatt

SEQ ID NO: 377528 - DNA, 25 bp, Homo sapien
gatttagtacatttcagaacttttg

SEQ ID NO: 377529 - DNA, 25 bp, Homo sapien
tcagaacttttgaacttttgacaaa

SEQ ID NO: 377530 - DNA, 25 bp, Homo sapien
aacttttgacaaattgcattgggaa

SEQ ID NO: 377531 - DNA, 25 bp, Homo sapien
attgcattgggaaaagaagtctgtt

SEQ ID NO: 377532 - DNA, 25 bp, Homo sapien
ttagccatcttccttgacagtgtga

SEQ ID NO: 377533 - DNA, 25 bp, Homo sapien
cttccttgacagtgtgatctgttta

SEQ ID NO: 377534 - DNA, 25 bp, Homo sapien
ctgtttagtgagatttagcatgtgt

SEQ ID NO: 377535 - DNA, 25 bp, Homo sapien
ttaacctgcttcactccagtctgtt

SEQ ID NO: 377536 - DNA, 25 bp, Homo sapien
actccagtctgttctggctgtttat

SEQ ID NO: 377537 - DNA, 25 bp, Homo sapien
gtctgttctggctgtttattacctt

SEQ ID NO: 377538 - DNA, 25 bp, Homo sapien
ctggctgtttattaccttgttgcaa

SEQ ID NO: 377539 - DNA, 25 bp, Homo sapien
taccttgttgcaaaacagggccgaa

SEQ ID NO: 377540 - DNA, 25 bp, Homo sapien
acagggccgaagcaaggattacctt

SEQ ID NO: 377541 - DNA, 25 bp, Homo sapien
aggattaccttgacaaccctagctt

SEQ ID NO: 377542 - DNA, 25 bp, Homo sapien
cttgacaaccctagcttctccttag

SEQ ID NO: 377543 - DNA, 25 bp, Homo sapien
ggtgtccacagaaaattggagaatt

SEQ ID NO: 377544 - DNA, 25 bp, Homo sapien
gggaaacctcatacacatctggtgt

SEQ ID NO: 377545 - DNA, 25 bp, Homo sapien
aacctcatacacatctggtgtcaga

SEQ ID NO: 377546 - DNA, 25 bp, Homo sapien
atctggtgtcagaaatgttgtgagt

SEQ ID NO: 377547 - DNA, 25 bp, Homo sapien
ataagtttttcctatacagtagcta

SEQ ID NO: 377548 - DNA, 25 bp, Homo sapien
gtttttcctatacagtagctaaagt

SEQ ID NO: 377549 - DNA, 25 bp, Homo sapien
cagtagctaaagtacctacatcatt

SEQ ID NO: 377550 - DNA, 25 bp, Homo sapien
taaagtacctacatcattaatttgt

SEQ ID NO: 377551 - DNA, 25 bp, Homo sapien
ctgtgtaaaaataagactttctgat

SEQ ID NO: 377552 - DNA, 25 bp, Homo sapien
ctgatatttttttcaagtggcaaca

SEQ ID NO: 377553 - DNA, 25 bp, Homo sapien
gtggcaacatttatcagactttttt

SEQ ID NO: 377554 - DNA, 25 bp, Homo sapien
tccacccctctagtttctaaatgat

SEQ ID NO: 377555 - DNA, 25 bp, Homo sapien
taggtgaggtttaaactctcaggat

SEQ ID NO: 377556 - DNA, 25 bp, Homo sapien
ctctcaggattattcagggtttgtg

SEQ ID NO: 377557 - DNA, 25 bp, Homo sapien
ttgtggagagtaggaaggtttcttc

SEQ ID NO: 377558 - DNA, 25 bp, Homo sapien
tacagcacaatttaaggagcctggc

SEQ ID NO: 377559 - DNA, 25 bp, Homo sapien
taaggagcctggcaagaagcatcca

SEQ ID NO: 377560 - DNA, 25 bp, Homo sapien
agaagcatccaatattagcaagtag

SEQ ID NO: 377561 - DNA, 25 bp, Homo sapien
aagtatgaggttggaacttcccacg

SEQ ID NO: 377562 - DNA, 25 bp, Homo sapien
gaggttggaacttcccacgatactt

SEQ ID NO: 377563 - DNA, 25 bp, Homo sapien
ggaacttcccacgatacttagtaca

SEQ ID NO: 377564 - DNA, 25 bp, Homo sapien
tcccacgatacttagtacatggaaa

SEQ ID NO: 377565 - DNA, 25 bp, Homo sapien
atctatgaggctctgagagtttctt

SEQ ID NO: 377566 - DNA, 25 bp, Homo sapien
ggctctgagagtttctttgaggcaa

SEQ ID NO: 377567 - DNA, 25 bp, Homo sapien
gaaccagagctggaagctaggagaa

SEQ ID NO: 377568 - DNA, 25 bp, Homo sapien
ttgaggcaaagatcttggcatttct

SEQ ID NO: 377569 - DNA, 25 bp, Homo sapien
ggcatttctttgtatcttcttgagt

SEQ ID NO: 377570 - DNA, 25 bp, Homo sapien
tttctttgtatcttcttgagtcctt

SEQ ID NO: 377571 - DNA, 25 bp, Homo sapien
ttcttgagtccttcttaaaccagtg

SEQ ID NO: 377572 - DNA, 25 bp, Homo sapien
tgagtccttcttaaaccagtgcctt

SEQ ID NO: 377573 - DNA, 25 bp, Homo sapien
tcttaaaccagtgccttcttgatga

SEQ ID NO: 377574 - DNA, 25 bp, Homo sapien
agagaggacacctcagccctttgag

SEQ ID NO: 377575 - DNA, 25 bp, Homo sapien
gaggacacctcagccctttgagagg

SEQ ID NO: 377576 - DNA, 25 bp, Homo sapien
gctgaactgtgcctagttattttga

SEQ ID NO: 377577 - DNA, 25 bp, Homo sapien
ggttttgagcaccttttggattaat

SEQ ID NO: 377578 - DNA, 25 bp, Homo sapien
ttgagcatagtggtgaatcgttttg

SEQ ID NO: 377579 - DNA, 25 bp, Homo sapien
cgttttgaaatgagagacctagcca

SEQ ID NO: 377580 - DNA, 25 bp, Homo sapien
gacctagccaaggatatgttcactt

SEQ ID NO: 377581 - DNA, 25 bp, Homo sapien
tgttcacttagtaagaggtcacatc

SEQ ID NO: 377582 - DNA, 25 bp, Homo sapien
gagcaccttttggattaatgccaga

SEQ ID NO: 377583 - DNA, 25 bp, Homo sapien
aagaggtcacatcttctgcaaaata

SEQ ID NO: 377584 - DNA, 25 bp, Homo sapien
aaaagtcaaagctccattccactct

SEQ ID NO: 377585 - DNA, 25 bp, Homo sapien
ccactctctggcttccgtggaggaa

SEQ ID NO: 377586 - DNA, 25 bp, Homo sapien
gaagggctgaactgtgcctagttat

SEQ ID NO: 377587 - DNA, 25 bp, Homo sapien
gaaggaggggtgacttcatcccaga

SEQ ID NO: 377588 - DNA, 25 bp, Homo sapien
ttcatcccagagagacccgagttcc

SEQ ID NO: 377589 - DNA, 25 bp, Homo sapien
gctcctgcaggagtgagtcttacct

SEQ ID NO: 377590 - DNA, 25 bp, Homo sapien
aggagtgagtcttacctcccctggc

SEQ ID NO: 377591 - DNA, 25 bp, Homo sapien
cctcattcagcacctctgctgggaa

SEQ ID NO: 377592 - DNA, 25 bp, Homo sapien
agcctgcagcgactgtgaggccaca

SEQ ID NO: 377593 - DNA, 25 bp, Homo sapien
tgaggccacagctcctcagattcac

SEQ ID NO: 377594 - DNA, 25 bp, Homo sapien
tcctcagattcactgcccgctgtgt

SEQ ID NO: 377595 - DNA, 25 bp, Homo sapien
ccgctgtgtgccagtactcaggcag

SEQ ID NO: 377596 - DNA, 25 bp, Homo sapien
gtgtgccagtactcaggcagctgga

SEQ ID NO: 377597 - DNA, 25 bp, Homo sapien
tgccagtactcaggcagctggagag

SEQ ID NO: 377598 - DNA, 25 bp, Homo sapien
gaagaggttagcatgaacttacaaa

SEQ ID NO: 377599 - DNA, 25 bp, Homo sapien
caaattgttttaagtaatcctcttg

SEQ ID NO: 377600 - DNA, 25 bp, Homo sapien
gtaatcctcttgaatgccagtcatt

SEQ ID NO: 377601 - DNA, 25 bp, Homo sapien
gccagtcattaaaggactttgccct

SEQ ID NO: 377602 - DNA, 25 bp, Homo sapien
ttaaaggactttgcccttctacatc

SEQ ID NO: 377603 - DNA, 25 bp, Homo sapien
tacatccttttcacaaatccccatt

SEQ ID NO: 377604 - DNA, 25 bp, Homo sapien
cttttcacaaatccccatttctgta

SEQ ID NO: 377605 - DNA, 25 bp, Homo sapien
ccatttctgtaataactggtgcaaa

SEQ ID NO: 377606 - DNA, 25 bp, Homo sapien
actggtgcaaacctaaaggtgcttt

SEQ ID NO: 377607 - DNA, 25 bp, Homo sapien
agttttactactttgcagatttgca

SEQ ID NO: 377608 - DNA, 25 bp, Homo sapien
actttgcagatttgcaatgctgcat

SEQ ID NO: 377609 - DNA, 25 bp, Homo sapien
gaaactgcaagtttttgacttgaag

SEQ ID NO: 377610 - DNA, 25 bp, Homo sapien
gaagcagttagagcaatgtgtttga

SEQ ID NO: 377611 - DNA, 25 bp, Homo sapien
tgtgtttgaaattatgtccatgaaa

SEQ ID NO: 377612 - DNA, 25 bp, Homo sapien
atcacagggatctctgaaatatctt

SEQ ID NO: 377613 - DNA, 25 bp, Homo sapien
gaaacttgaaatttatgaggtctga

SEQ ID NO: 377614 - DNA, 25 bp, Homo sapien
atgaggtctgaatggacttgtttaa

SEQ ID NO: 377615 - DNA, 25 bp, Homo sapien
ttaaaattggctctgactcctcact

SEQ ID NO: 377616 - DNA, 25 bp, Homo sapien
ttggctctgactcctcacttctgag

SEQ ID NO: 377617 - DNA, 25 bp, Homo sapien
cacttctgagtttcatcctatccga

SEQ ID NO: 377618 - DNA, 25 bp, Homo sapien
aaaagactgcaagctttcctgccaa

SEQ ID NO: 377619 - DNA, 25 bp, Homo sapien
gcaagctttcctgccaatttgggat

SEQ ID NO: 377620 - DNA, 25 bp, Homo sapien
gaaggaggggtgacttcatcccaga

SEQ ID NO: 377621 - DNA, 25 bp, Homo sapien
ttcatcccagagagacccgagttcc

SEQ ID NO: 377622 - DNA, 25 bp, Homo sapien
aggagtgagtcttacctcccctggc

SEQ ID NO: 377623 - DNA, 25 bp, Homo sapien
cctcattcagcacctctgctgggaa

SEQ ID NO: 377624 - DNA, 25 bp, Homo sapien
tgaggccacagctcctcagattcac

SEQ ID NO: 377625 - DNA, 25 bp, Homo sapien
aggccacagctcctcagattcactg

SEQ ID NO: 377626 - DNA, 25 bp, Homo sapien
tcctcagattcactgcccgctgtgt

SEQ ID NO: 377627 - DNA, 25 bp, Homo sapien
ccgctgtgtgccagtactcaggcag

SEQ ID NO: 377628 - DNA, 25 bp, Homo sapien
gctgtgtgccagtactcaggcagct

SEQ ID NO: 377629 - DNA, 25 bp, Homo sapien
gtgtgccagtactcaggcagctgga

SEQ ID NO: 377630 - DNA, 25 bp, Homo sapien
tgccagtactcaggcagctggagag

SEQ ID NO: 377631 - DNA, 25 bp, Homo sapien
ttcggcacagcggaatgtgaacaaa

SEQ ID NO: 377632 - DNA, 25 bp, Homo sapien
aattggcttaagaaatctgcactag

SEQ ID NO: 377633 - DNA, 25 bp, Homo sapien
agaaatctgcactagcaaaccgttg

SEQ ID NO: 377634 - DNA, 25 bp, Homo sapien
aaatctgcactagcaaaccgttgca

SEQ ID NO: 377635 - DNA, 25 bp, Homo sapien
tgcactagcaaaccgttgcagtctt

SEQ ID NO: 377636 - DNA, 25 bp, Homo sapien
agcaaaccgttgcagtcttttattt

SEQ ID NO: 377637 - DNA, 25 bp, Homo sapien
caaaccgttgcagtcttttatttat

SEQ ID NO: 377638 - DNA, 25 bp, Homo sapien
ttataagttctttacggtcatgttc

SEQ ID NO: 377639 - DNA, 25 bp, Homo sapien
aagttctttacggtcatgttctaat

SEQ ID NO: 377640 - DNA, 25 bp, Homo sapien
gttctttacggtcatgttctaataa

SEQ ID NO: 377641 - DNA, 25 bp, Homo sapien
ttacggtcatgttctaataaatttg

SEQ ID NO: 377642 - DNA, 25 bp, Homo sapien
ccccgactgcaaggagctgtgtagc

SEQ ID NO: 377643 - DNA, 25 bp, Homo sapien
actgcaaggagctgtgtagctgcca

SEQ ID NO: 377644 - DNA, 25 bp, Homo sapien
gaaggcaactccacgtgctcagaga

SEQ ID NO: 377645 - DNA, 25 bp, Homo sapien
acccacacgggcagtgcgaggacgt

SEQ ID NO: 377646 - DNA, 25 bp, Homo sapien
gaggacgtgacaggccagtgtactt

SEQ ID NO: 377647 - DNA, 25 bp, Homo sapien
gacaggccagtgtacttgtcacgcg

SEQ ID NO: 377648 - DNA, 25 bp, Homo sapien
agtgtacttgtcacgcgcggcgctg

SEQ ID NO: 377649 - DNA, 25 bp, Homo sapien
gcgagcatgcgtgccagtgccagca

SEQ ID NO: 377650 - DNA, 25 bp, Homo sapien
tccacgtgctcagagaacgaggtgt

SEQ ID NO: 377651 - DNA, 25 bp, Homo sapien
acggctacttcggtgccaactgcga

SEQ ID NO: 377652 - DNA, 25 bp, Homo sapien
tacttcggtgccaactgcgacacca

SEQ ID NO: 377653 - DNA, 25 bp, Homo sapien
gcgcattacacaatgtagggcctat

SEQ ID NO: 377654 - DNA, 25 bp, Homo sapien
gatgaggtttcaattatgggctaat

SEQ ID NO: 377655 - DNA, 25 bp, Homo sapien
gctaatggtgcaaagcttgagatca

SEQ ID NO: 377656 - DNA, 25 bp, Homo sapien
gagatcacagtgctttgccattcac

SEQ ID NO: 377657 - DNA, 25 bp, Homo sapien
cattcacctcttctccctaaaaggg

SEQ ID NO: 377658 - DNA, 25 bp, Homo sapien
gggtcctaacagagggagattttca

SEQ ID NO: 377659 - DNA, 25 bp, Homo sapien
tcacataaggaatacccgccaagca

SEQ ID NO: 377660 - DNA, 25 bp, Homo sapien
gaatacccgccaagcaggaagcagg

SEQ ID NO: 377661 - DNA, 25 bp, Homo sapien
tctgcttcctcttctgtaatgtggg

SEQ ID NO: 377662 - DNA, 25 bp, Homo sapien
gcaggccactgctttattaataacg

SEQ ID NO: 377663 - DNA, 25 bp, Homo sapien
acagcagctctacatagcgcattac

SEQ ID NO: 377664 - DNA, 25 bp, Homo sapien
aagatttccaaacaaccttgaagat

SEQ ID NO: 377665 - DNA, 25 bp, Homo sapien
gatgtaaatgtaaaggataccaaac

SEQ ID NO: 377666 - DNA, 25 bp, Homo sapien
gataccaaacataacttcctctctt

SEQ ID NO: 377667 - DNA, 25 bp, Homo sapien
attgtatttaaaccagatccatgtc

SEQ ID NO: 377668 - DNA, 25 bp, Homo sapien
ccagatccatgtcaaacttataaga

SEQ ID NO: 377669 - DNA, 25 bp, Homo sapien
gatccatgtcaaacttataagaaca

SEQ ID NO: 377670 - DNA, 25 bp, Homo sapien
aagaacagaatatagtacaggtaga

SEQ ID NO: 377671 - DNA, 25 bp, Homo sapien
gtacaggtagaggaaattcactttt

SEQ ID NO: 377672 - DNA, 25 bp, Homo sapien
ggaaattcacttttcatgagcaaaa

SEQ ID NO: 377673 - DNA, 25 bp, Homo sapien
aagaaacagcggaagggaatatttg

SEQ ID NO: 377674 - DNA, 25 bp, Homo sapien
ggaagactgcctaaaagatttccaa

SEQ ID NO: 377675 - DNA, 25 bp, Homo sapien
gggcaaaatcataagtagtcttaca

SEQ ID NO: 377676 - DNA, 25 bp, Homo sapien
tataagaatggcatattctaggaac

SEQ ID NO: 377677 - DNA, 25 bp, Homo sapien
agtcttacatactacattagatatc

SEQ ID NO: 377678 - DNA, 25 bp, Homo sapien
gatatcaatatttaagcctgtagga

SEQ ID NO: 377679 - DNA, 25 bp, Homo sapien
aatgggaggcattgaagcacttaag

SEQ ID NO: 377680 - DNA, 25 bp, Homo sapien
tttgttttagattactctggtcatc

SEQ ID NO: 377681 - DNA, 25 bp, Homo sapien
attctaggaactaacactgtggcta

SEQ ID NO: 377682 - DNA, 25 bp, Homo sapien
tttaagaggtagaatctctcagact

SEQ ID NO: 377683 - DNA, 25 bp, Homo sapien
taggaactaacactgtggctagaga

SEQ ID NO: 377684 - DNA, 25 bp, Homo sapien
aactaacactgtggctagagaggaa

SEQ ID NO: 377685 - DNA, 25 bp, Homo sapien
ggaaatggtgttacgtgagtaagaa

SEQ ID NO: 377686 - DNA, 25 bp, Homo sapien
aagtggtcctcacaagagtcataaa

SEQ ID NO: 377687 - DNA, 25 bp, Homo sapien
gtaattagcacagtatattcagcag

SEQ ID NO: 377688 - DNA, 25 bp, Homo sapien
tatattcagcagtgtataactctac

SEQ ID NO: 377689 - DNA, 25 bp, Homo sapien
ataactctacaaatagtaccttata

SEQ ID NO: 377690 - DNA, 25 bp, Homo sapien
ataccttatgcataattggattcaa

SEQ ID NO: 377691 - DNA, 25 bp, Homo sapien
ttggattcaaacattgaaggtctat

SEQ ID NO: 377692 - DNA, 25 bp, Homo sapien
gaaggtctattttagtgttcttcaa

SEQ ID NO: 377693 - DNA, 25 bp, Homo sapien
ttccctgacctactgaaatagaaac

SEQ ID NO: 377694 - DNA, 25 bp, Homo sapien
gaatttgtattctaatcatctcaaa

SEQ ID NO: 377695 - DNA, 25 bp, Homo sapien
taatcatctcaaacaattcctaaag

SEQ ID NO: 377696 - DNA, 25 bp, Homo sapien
aacaattcctaaagacactgatttt

SEQ ID NO: 377697 - DNA, 25 bp, Homo sapien
agaaatctactcttgctggtctttg

SEQ ID NO: 377698 - DNA, 25 bp, Homo sapien
ctactcttgctggtctttgtaagtt

SEQ ID NO: 377699 - DNA, 25 bp, Homo sapien
gtctttgtaagttgcatgaatattt

SEQ ID NO: 377700 - DNA, 25 bp, Homo sapien
gtgcaatctaaatggtagcctttac

SEQ ID NO: 377701 - DNA, 25 bp, Homo sapien
taaatggtagcctttactaatgtgt

SEQ ID NO: 377702 - DNA, 25 bp, Homo sapien
gaaagaggtgttcctcattatctaa

SEQ ID NO: 377703 - DNA, 25 bp, Homo sapien
tcaaagcacgattttagataaccta

SEQ ID NO: 377704 - DNA, 25 bp, Homo sapien
ttagataacctaaacggcccagcct

SEQ ID NO: 377705 - DNA, 25 bp, Homo sapien
acggcccagcctatacgaagttgat

SEQ ID NO: 377706 - DNA, 25 bp, Homo sapien
gcccagcctatacgaagttgattat

SEQ ID NO: 377707 - DNA, 25 bp, Homo sapien
gttgattatatctcgatgtctgtaa

SEQ ID NO: 377708 - DNA, 25 bp, Homo sapien
ccgtggtcggctcttaatggtgtca

SEQ ID NO: 377709 - DNA, 25 bp, Homo sapien
gtcggctcttaatggtgtcacagaa

SEQ ID NO: 377710 - DNA, 25 bp, Homo sapien
agaggagaccaaagactgaaactga

SEQ ID NO: 377711 - DNA, 25 bp, Homo sapien
gaaactgaagactaaaccatggaaa

SEQ ID NO: 377712 - DNA, 25 bp, Homo sapien
ttgggaacaagcacttactcgctta

SEQ ID NO: 377713 - DNA, 25 bp, Homo sapien
gcacttactcgcttagagggtgaaa

SEQ ID NO: 377714 - DNA, 25 bp, Homo sapien
aagtgaatttgcctacagggccaat

SEQ ID NO: 377715 - DNA, 25 bp, Homo sapien
ctacagggccaatttggaagcacct

SEQ ID NO: 377716 - DNA, 25 bp, Homo sapien
ggaagcacctctccctggaagccag

SEQ ID NO: 377717 - DNA, 25 bp, Homo sapien
gaaaagatagccaccttgcataact

SEQ ID NO: 377718 - DNA, 25 bp, Homo sapien
gaagaattcgtaaactgacagcaga

SEQ ID NO: 377719 - DNA, 25 bp, Homo sapien
cttcctgctctcctaaggttgcggg

SEQ ID NO: 377720 - DNA, 25 bp, Homo sapien
ggacagtagagtgctgagccccaga

SEQ ID NO: 377721 - DNA, 25 bp, Homo sapien
tatccactctctagacctttgggaa

SEQ ID NO: 377722 - DNA, 25 bp, Homo sapien
tgggtccctctcctgatttgatcca

SEQ ID NO: 377723 - DNA, 25 bp, Homo sapien
tgatttgatccattcggccccaact

SEQ ID NO: 377724 - DNA, 25 bp, Homo sapien
cccaactccagagtcgggaatggga

SEQ ID NO: 377725 - DNA, 25 bp, Homo sapien
gaatgggagatgaaactagttttcc

SEQ ID NO: 377726 - DNA, 25 bp, Homo sapien
ttttggacaagtcccacccctagat

SEQ ID NO: 377727 - DNA, 25 bp, Homo sapien
gctctaccagcagcgtgtcctggaa

SEQ ID NO: 377728 - DNA, 25 bp, Homo sapien
tgcccgtctgcacaggtgtcttgat

SEQ ID NO: 377729 - DNA, 25 bp, Homo sapien
aggtgtcttgatccagccctgcgtc

SEQ ID NO: 377730 - DNA, 25 bp, Homo sapien
ttccagggccttaagcaccacgaat

SEQ ID NO: 377731 - DNA, 25 bp, Homo sapien
cagggccttaagcaccacgaataat

SEQ ID NO: 377732 - DNA, 25 bp, Homo sapien
gggccttaagcaccacgaataataa

SEQ ID NO: 377733 - DNA, 25 bp, Homo sapien
aagcatgtggattttatcttatgaa

SEQ ID NO: 377734 - DNA, 25 bp, Homo sapien
agaagtcattaaagggtgaggcata

SEQ ID NO: 377735 - DNA, 25 bp, Homo sapien
ataaaaattcttgccagacacagtg

SEQ ID NO: 377736 - DNA, 25 bp, Homo sapien
gctgtggtgtgctatgattgcacct

SEQ ID NO: 377737 - DNA, 25 bp, Homo sapien
ccagtgcacttgctgtgtagcagca

SEQ ID NO: 377738 - DNA, 25 bp, Homo sapien
aagtagcacaggaaaaagcagcagg

SEQ ID NO: 377739 - DNA, 25 bp, Homo sapien
agcagcaggagccagaccttccagg

SEQ ID NO: 377740 - DNA, 25 bp, Homo sapien
gcaggagccagaccttccagggcct

SEQ ID NO: 377741 - DNA, 25 bp, Homo sapien
ctggaggatcagcaacttacacaaa

SEQ ID NO: 377742 - DNA, 25 bp, Homo sapien
acaaaagcactaaaggctcctccct

SEQ ID NO: 377743 - DNA, 25 bp, Homo sapien
tattgcccgcctcacactttggaaa

SEQ ID NO: 377744 - DNA, 25 bp, Homo sapien
gcaaatcaactttctaattcaggga

SEQ ID NO: 377745 - DNA, 25 bp, Homo sapien
aattcagggatcaacagccttggtt

SEQ ID NO: 377746 - DNA, 25 bp, Homo sapien
gatcaacagccttggtttgttaact

SEQ ID NO: 377747 - DNA, 25 bp, Homo sapien
aatggtcatttatctatcagtcatg

SEQ ID NO: 377748 - DNA, 25 bp, Homo sapien
gccatgggctgatacttagattcac

SEQ ID NO: 377749 - DNA, 25 bp, Homo sapien
gattcacaaaatgccacatcactag

SEQ ID NO: 377750 - DNA, 25 bp, Homo sapien
cactaggccagaagatgctcccaag

SEQ ID NO: 377751 - DNA, 25 bp, Homo sapien
tcccaagatgttgccaaactggagg

SEQ ID NO: 377752 - DNA, 25 bp, Homo sapien
gtggacagcccacccaggcggcggg

SEQ ID NO: 377753 - DNA, 25 bp, Homo sapien
gtgcagcccacaggctggcgaggag

SEQ ID NO: 377754 - DNA, 25 bp, Homo sapien
actccctgaccctggaagctgagcc

SEQ ID NO: 377755 - DNA, 25 bp, Homo sapien
aagctgagcctgctttcctgaccct

SEQ ID NO: 377756 - DNA, 25 bp, Homo sapien
tccccagaacactcagagggacggt

SEQ ID NO: 377757 - DNA, 25 bp, Homo sapien
aacactcagagggacggtcaacatc

SEQ ID NO: 377758 - DNA, 25 bp, Homo sapien
agagggacggtcaacatcagagcac

SEQ ID NO: 377759 - DNA, 25 bp, Homo sapien
gggacggtcaacatcagagcacatt

SEQ ID NO: 377760 - DNA, 25 bp, Homo sapien
gacggtcaacatcagagcacattaa

SEQ ID NO: 377761 - DNA, 25 bp, Homo sapien
atcagagcacattaaacgctggtga

SEQ ID NO: 377762 - DNA, 25 bp, Homo sapien
gagcacattaaacgctggtgaaacc

SEQ ID NO: 377763 - DNA, 25 bp, Homo sapien
tgtctgctacgctcatcagagtata

SEQ ID NO: 377764 - DNA, 25 bp, Homo sapien
gctacgctcatcagagtatattttg

SEQ ID NO: 377765 - DNA, 25 bp, Homo sapien
ttgtaactgccttattgaaaagtaa

SEQ ID NO: 377766 - DNA, 25 bp, Homo sapien
attccaggcctcctcatattgtact

SEQ ID NO: 377767 - DNA, 25 bp, Homo sapien
aatctatggctctgtactgttgaaa

SEQ ID NO: 377768 - DNA, 25 bp, Homo sapien
cttttcatgttgcaatatcacacga

SEQ ID NO: 377769 - DNA, 25 bp, Homo sapien
catgttgcaatatcacacgatggga

SEQ ID NO: 377770 - DNA, 25 bp, Homo sapien
aatatcacacgatgggatggcccga

SEQ ID NO: 377771 - DNA, 25 bp, Homo sapien
atcacacgatgggatggcccgactt

SEQ ID NO: 377772 - DNA, 25 bp, Homo sapien
acacgatgggatggcccgacttttg

SEQ ID NO: 377773 - DNA, 25 bp, Homo sapien
ggcccgacttttgctcttaataaat

SEQ ID NO: 377774 - DNA, 25 bp, Homo sapien
cgcgcctcaggaaaacaggatggta

SEQ ID NO: 377775 - DNA, 25 bp, Homo sapien
atggtagtgaatggcaccgagccgc

SEQ ID NO: 377776 - DNA, 25 bp, Homo sapien
tgaatggcaccgagccgccccaggg

SEQ ID NO: 377777 - DNA, 25 bp, Homo sapien
ttcgccccggactgaagtgcggtcg

SEQ ID NO: 377778 - DNA, 25 bp, Homo sapien
ggcggctccgagtcgtgcgaggcag

SEQ ID NO: 377779 - DNA, 25 bp, Homo sapien
gggaccctttgccttcagaacaggg

SEQ ID NO: 377780 - DNA, 25 bp, Homo sapien
tttgccttcagaacagggcgcccga

SEQ ID NO: 377781 - DNA, 25 bp, Homo sapien
acgttgggcgcgtggacagagtcct

SEQ ID NO: 377782 - DNA, 25 bp, Homo sapien
tggagcgcgcgcctcctagcggagc

SEQ ID NO: 377783 - DNA, 25 bp, Homo sapien
gaaggccgcgcctcaggaaaacagg

SEQ ID NO: 377784 - DNA, 25 bp, Homo sapien
aggccgcgcctcaggaaaacaggat

SEQ ID NO: 377785 - DNA, 25 bp, Homo sapien
ttcttcctgtgttacaattaccctg

SEQ ID NO: 377786 - DNA, 25 bp, Homo sapien
acaattaccctgtttctgattacta

SEQ ID NO: 377787 - DNA, 25 bp, Homo sapien
tctgattactacagcccaacccggg

SEQ ID NO: 377788 - DNA, 25 bp, Homo sapien
gaccataggattctggatcaaccat

SEQ ID NO: 377789 - DNA, 25 bp, Homo sapien
atcaaccatttcttccagcttgtat

SEQ ID NO: 377790 - DNA, 25 bp, Homo sapien
gcttgtatccaagcccgctgaatct

SEQ ID NO: 377791 - DNA, 25 bp, Homo sapien
gaatctctccctgttattcagaaca

SEQ ID NO: 377792 - DNA, 25 bp, Homo sapien
tttgggtctgaccaaatttgcagtg

SEQ ID NO: 377793 - DNA, 25 bp, Homo sapien
cagtgggaattgtgttgatcctctt

SEQ ID NO: 377794 - DNA, 25 bp, Homo sapien
gatcctcttggttcgtcagcttgta

SEQ ID NO: 377795 - DNA, 25 bp, Homo sapien
agcttgtacaaaatctctcactgca

SEQ ID NO: 377796 - DNA, 25 bp, Homo sapien
cggattaacacaacctcgttgataa

SEQ ID NO: 377797 - DNA, 25 bp, Homo sapien
caacctcgttgataaactcttcgga

SEQ ID NO: 377798 - DNA, 25 bp, Homo sapien
aactcttcggacagctgttattctt

SEQ ID NO: 377799 - DNA, 25 bp, Homo sapien
gctgttattctttgattttctgcat

SEQ ID NO: 377800 - DNA, 25 bp, Homo sapien
gattttctgcataagatcctacagc

SEQ ID NO: 377801 - DNA, 25 bp, Homo sapien
ataagatcctacagcttccctgaga

SEQ ID NO: 377802 - DNA, 25 bp, Homo sapien
tacagcttccctgagattggataag

SEQ ID NO: 377803 - DNA, 25 bp, Homo sapien
ataaccaaatctcattcaacccagc

SEQ ID NO: 377804 - DNA, 25 bp, Homo sapien
ggatatctacccaaagaacaactct

SEQ ID NO: 377805 - DNA, 25 bp, Homo sapien
tacaaatacttacacgccttttagg

SEQ ID NO: 377806 - DNA, 25 bp, Homo sapien
acgccttttaggaaattgatgtaat

SEQ ID NO: 377807 - DNA, 25 bp, Homo sapien
tgtttgcgagcccactcagtcactg

SEQ ID NO: 377808 - DNA, 25 bp, Homo sapien
cactcagtcactgcacaggtgctta

SEQ ID NO: 377809 - DNA, 25 bp, Homo sapien
ctgcacaggtgcttagccgagaggc

SEQ ID NO: 377810 - DNA, 25 bp, Homo sapien
tcctgttcgctgtgtggcctgagtg

SEQ ID NO: 377811 - DNA, 25 bp, Homo sapien
gcctgagtggctggacctcactgta

SEQ ID NO: 377812 - DNA, 25 bp, Homo sapien
ctggacctcactgtatctcctggtg

SEQ ID NO: 377813 - DNA, 25 bp, Homo sapien
gtatctcctggtgggattgctcaga

SEQ ID NO: 377814 - DNA, 25 bp, Homo sapien
gattgctcagaggtctcagcaaggc

SEQ ID NO: 377815 - DNA, 25 bp, Homo sapien
tgagctgtggcaagcacccgacatc

SEQ ID NO: 377816 - DNA, 25 bp, Homo sapien
tgtgatatactgagcacctcctcta

SEQ ID NO: 377817 - DNA, 25 bp, Homo sapien
gagcacctcctctagagagaataaa

SEQ ID NO: 377818 - DNA, 25 bp, Homo sapien
gttggtagtgtcttgatgtattttc

SEQ ID NO: 377819 - DNA, 25 bp, Homo sapien
gtgtcttgatgtattttcagtggta

SEQ ID NO: 377820 - DNA, 25 bp, Homo sapien
gatgtattttcagtggtagggtaaa

SEQ ID NO: 377821 - DNA, 25 bp, Homo sapien
gatttctggagaaatatctcactaa

SEQ ID NO: 377822 - DNA, 25 bp, Homo sapien
tttgatagtgtgtgtgttacatgtg

SEQ ID NO: 377823 - DNA, 25 bp, Homo sapien
gaagggccacagtaacagtaactag

SEQ ID NO: 377824 - DNA, 25 bp, Homo sapien
gtaacagtaactagtctggactctt

SEQ ID NO: 377825 - DNA, 25 bp, Homo sapien
aacagtaactagtctggactcttaa

SEQ ID NO: 377826 - DNA, 25 bp, Homo sapien
ttgatattcaggttaaagtcttaaa

SEQ ID NO: 377827 - DNA, 25 bp, Homo sapien
aagtcttaaacagggatttgatgca

SEQ ID NO: 377828 - DNA, 25 bp, Homo sapien
aacagggatttgatgcattaattat

SEQ ID NO: 377829 - DNA, 25 bp, Homo sapien
tatattttcttatgcatgctcgatg

SEQ ID NO: 377830 - DNA, 25 bp, Homo sapien
atgctcgatgcattttcgtcctgag

SEQ ID NO: 377831 - DNA, 25 bp, Homo sapien
ctcgatgcattttcgtcctgagaaa

SEQ ID NO: 377832 - DNA, 25 bp, Homo sapien
tctacagaaactacccgtgtgtaaa

SEQ ID NO: 377833 - DNA, 25 bp, Homo sapien
gattggcttaaaatggctactgtga

SEQ ID NO: 377834 - DNA, 25 bp, Homo sapien
taaaatggctactgtgatgggaaca

SEQ ID NO: 377835 - DNA, 25 bp, Homo sapien
tcttagggagatgcagcttggactt

SEQ ID NO: 377836 - DNA, 25 bp, Homo sapien
gaatactttacaactgtggtttaga

SEQ ID NO: 377837 - DNA, 25 bp, Homo sapien
gtggtttagagtttgctttaatgac

SEQ ID NO: 377838 - DNA, 25 bp, Homo sapien
aaaggtcacatgattgctgtaattt

SEQ ID NO: 377839 - DNA, 25 bp, Homo sapien
tgtattcattatggtttcctcaata

SEQ ID NO: 377840 - DNA, 25 bp, Homo sapien
taggaccctgattgagtcctcggac

SEQ ID NO: 377841 - DNA, 25 bp, Homo sapien
tgagtcctcggaccaccaagagtgc

SEQ ID NO: 377842 - DNA, 25 bp, Homo sapien
caagagcctccctcttctggtgact

SEQ ID NO: 377843 - DNA, 25 bp, Homo sapien
ctcttctggtgactcgtgcctgctt

SEQ ID NO: 377844 - DNA, 25 bp, Homo sapien
tgcttcccgtggagagctccagaag

SEQ ID NO: 377845 - DNA, 25 bp, Homo sapien
gagaacgtggcagggatcctaactt

SEQ ID NO: 377846 - DNA, 25 bp, Homo sapien
gtggcagggatcctaactttcttac

SEQ ID NO: 377847 - DNA, 25 bp, Homo sapien
ggaagttcttcacaagtacccatct

SEQ ID NO: 377848 - DNA, 25 bp, Homo sapien
gaccacaaggccttcttgggtcaag

SEQ ID NO: 377849 - DNA, 25 bp, Homo sapien
gggtcaagttctgccatctctggtt

SEQ ID NO: 377850 - DNA, 25 bp, Homo sapien
aagttctgccatctctggttaagat

SEQ ID NO: 377851 - DNA, 25 bp, Homo sapien
gaggaagatgacaaccccgactggg

SEQ ID NO: 377852 - DNA, 25 bp, Homo sapien
tgacaaccccgactgggtgtcagag

SEQ ID NO: 377853 - DNA, 25 bp, Homo sapien
gatggcaaggcctgtgcgacagata

SEQ ID NO: 377854 - DNA, 25 bp, Homo sapien
gcctgtgcgacagataatgcctgag

SEQ ID NO: 377855 - DNA, 25 bp, Homo sapien
ggaaatgttcctgagtcacgctgag

SEQ ID NO: 377856 - DNA, 25 bp, Homo sapien
tcatgagttcatgcgacgtatattt

SEQ ID NO: 377857 - DNA, 25 bp, Homo sapien
tgcgacgtatattttcctttggaaa

SEQ ID NO: 377858 - DNA, 25 bp, Homo sapien
gaagcagaggaaactcttaatactt

SEQ ID NO: 377859 - DNA, 25 bp, Homo sapien
atcgttcttgattagtatcgtgagt

SEQ ID NO: 377860 - DNA, 25 bp, Homo sapien
tgaaaagtctagaactcctgtaagt

SEQ ID NO: 377861 - DNA, 25 bp, Homo sapien
gaactcctgtaagtttttgaactca

SEQ ID NO: 377862 - DNA, 25 bp, Homo sapien
gaaatactaccgtcaatagagcagc

SEQ ID NO: 377863 - DNA, 25 bp, Homo sapien
caatagagcagcaatttctaggtat

SEQ ID NO: 377864 - DNA, 25 bp, Homo sapien
acatagggattgacaggtgtttgtt

SEQ ID NO: 377865 - DNA, 25 bp, Homo sapien
tgtttgttggtgtcagtgtgagcaa

SEQ ID NO: 377866 - DNA, 25 bp, Homo sapien
gtgtcagtgtgagcaaaccacgtaa

SEQ ID NO: 377867 - DNA, 25 bp, Homo sapien
aaccacgtaagctgagtgaagcaga

SEQ ID NO: 377868 - DNA, 25 bp, Homo sapien
gcagaaatggagaggtctcaccaat

SEQ ID NO: 377869 - DNA, 25 bp, Homo sapien
ggagaggtctcaccaattctgagta

SEQ ID NO: 377870 - DNA, 25 bp, Homo sapien
accaattctgagtagtgagggctag

SEQ ID NO: 377871 - DNA, 25 bp, Homo sapien
tgagggctagtaacaaagattaacc

SEQ ID NO: 377872 - DNA, 25 bp, Homo sapien
acatgggtgtgtggtggctggttcc

SEQ ID NO: 377873 - DNA, 25 bp, Homo sapien
atgtctaactttgccagtgcttcag

SEQ ID NO: 377874 - DNA, 25 bp, Homo sapien
ttgccagtgcttcagcaagtttttt

SEQ ID NO: 377875 - DNA, 25 bp, Homo sapien
gaggtttcaaatctgtgaactttgg

SEQ ID NO: 377876 - DNA, 25 bp, Homo sapien
acagttgttggctctggtatttact

SEQ ID NO: 377877 - DNA, 25 bp, Homo sapien
ggctctggtatttactagttttgta

SEQ ID NO: 377878 - DNA, 25 bp, Homo sapien
gtagtaacgttttgctagcctgact

SEQ ID NO: 377879 - DNA, 25 bp, Homo sapien
ttgctagcctgactgacttttctta

SEQ ID NO: 377880 - DNA, 25 bp, Homo sapien
tcttactggtttttatgcccacggt

SEQ ID NO: 377881 - DNA, 25 bp, Homo sapien
ggtgtctgcggaatagcgtctcgtc

SEQ ID NO: 377882 - DNA, 25 bp, Homo sapien
aatagcgtctcgtcttgtttgtata

SEQ ID NO: 377883 - DNA, 25 bp, Homo sapien
ctcgtcttgtttgtataggcagtca

SEQ ID NO: 377884 - DNA, 25 bp, Homo sapien
aactgaggccaaaggagccgcgctt

SEQ ID NO: 377885 - DNA, 25 bp, Homo sapien
aaaggagccgcgcttcctcatgagc

SEQ ID NO: 377886 - DNA, 25 bp, Homo sapien
tcatgagcatgaagcggcaaagcct

SEQ ID NO: 377887 - DNA, 25 bp, Homo sapien
tagaagcttctaacgcctaaccgtc

SEQ ID NO: 377888 - DNA, 25 bp, Homo sapien
tgcaaggcccttcctgactttttcc

SEQ ID NO: 377889 - DNA, 25 bp, Homo sapien
tttttccttttctgatgctaagaca

SEQ ID NO: 377890 - DNA, 25 bp, Homo sapien
gatgctaagacacctcagaaacacc

SEQ ID NO: 377891 - DNA, 25 bp, Homo sapien
cacggacttagctgggatgcagaat

SEQ ID NO: 377892 - DNA, 25 bp, Homo sapien
cagaatagaagctgggcctttgtct

SEQ ID NO: 377893 - DNA, 25 bp, Homo sapien
tttgtctgactaccctgcaacagtc

SEQ ID NO: 377894 - DNA, 25 bp, Homo sapien
gcaacagtcagccacagacgggaag

SEQ ID NO: 377895 - DNA, 25 bp, Homo sapien
gggagggcttgccatctgcttcaaa

SEQ ID NO: 377896 - DNA, 25 bp, Homo sapien
agggcttgccatctgcttcaaagat

SEQ ID NO: 377897 - DNA, 25 bp, Homo sapien
atctgcttcaaagatgatgcctttt

SEQ ID NO: 377898 - DNA, 25 bp, Homo sapien
gcttccttgagccttttctttaagg

SEQ ID NO: 377899 - DNA, 25 bp, Homo sapien
ggtggagtcctcatgatctcacctc

SEQ ID NO: 377900 - DNA, 25 bp, Homo sapien
atgatctcacctcttaaggccctat

SEQ ID NO: 377901 - DNA, 25 bp, Homo sapien
aaggccctatctcttaattctgtag

SEQ ID NO: 377902 - DNA, 25 bp, Homo sapien
atctcttaattctgtagtgtcggga

SEQ ID NO: 377903 - DNA, 25 bp, Homo sapien
tagtgtcgggattaggattcaacct

SEQ ID NO: 377904 - DNA, 25 bp, Homo sapien
attaggattcaacctgtatattggg

SEQ ID NO: 377905 - DNA, 25 bp, Homo sapien
gggggagacagcaacattcacacca

SEQ ID NO: 377906 - DNA, 25 bp, Homo sapien
ctacccgtgtgtaaaaagaagattg

SEQ ID NO: 377907 - DNA, 25 bp, Homo sapien
gaagattggcttaaaatggctactg

SEQ ID NO: 377908 - DNA, 25 bp, Homo sapien
ttggcttaaaatggctactgtgatg

SEQ ID NO: 377909 - DNA, 25 bp, Homo sapien
tcttagggagatgcagcttggactt

SEQ ID NO: 377910 - DNA, 25 bp, Homo sapien
ttagggagatgcagcttggacttga

SEQ ID NO: 377911 - DNA, 25 bp, Homo sapien
tggacttgaggtaaattgaatactt

SEQ ID NO: 377912 - DNA, 25 bp, Homo sapien
ctgtggtttagagtttgctttaatg

SEQ ID NO: 377913 - DNA, 25 bp, Homo sapien
agagtttgctttaatgacattgtat

SEQ ID NO: 377914 - DNA, 25 bp, Homo sapien
gacattgtatgtaaaaggtcacatg

SEQ ID NO: 377915 - DNA, 25 bp, Homo sapien
aaaggtcacatgattgctgtaattt

SEQ ID NO: 377916 - DNA, 25 bp, Homo sapien
tgtattcattatggtttcctcaata

SEQ ID NO: 377917 - DNA, 25 bp, Homo sapien
ggataactgaacttttctatgaaga

SEQ ID NO: 377918 - DNA, 25 bp, Homo sapien
gagcttgattatggccatacattga

SEQ ID NO: 377919 - DNA, 25 bp, Homo sapien
gagcattcagtgagtccacagttct

SEQ ID NO: 377920 - DNA, 25 bp, Homo sapien
gtccacagttctttgttgagggtct

SEQ ID NO: 377921 - DNA, 25 bp, Homo sapien
ttgagggtctcctgcatgccataca

SEQ ID NO: 377922 - DNA, 25 bp, Homo sapien
atgccatacactgtgctacgtcctg

SEQ ID NO: 377923 - DNA, 25 bp, Homo sapien
gggctccataaattctttgttaaca

SEQ ID NO: 377924 - DNA, 25 bp, Homo sapien
gaagcactttcagatacattacctc

SEQ ID NO: 377925 - DNA, 25 bp, Homo sapien
gatacattacctcatctctaacaga

SEQ ID NO: 377926 - DNA, 25 bp, Homo sapien
acacagtcaacagaaccatgcggag

SEQ ID NO: 377927 - DNA, 25 bp, Homo sapien
ccatgcggaggctgatcaatattct

SEQ ID NO: 377928 - DNA, 25 bp, Homo sapien
tgctgattgcaatggttatgggaat

SEQ ID NO: 377929 - DNA, 25 bp, Homo sapien
gtaatttattacactcattggtttt

SEQ ID NO: 377930 - DNA, 25 bp, Homo sapien
ttattacactcattggtttttattg

SEQ ID NO: 377931 - DNA, 25 bp, Homo sapien
tgattatagtattgtctgacttttt

SEQ ID NO: 377932 - DNA, 25 bp, Homo sapien
tattttctactatggttcctttagc

SEQ ID NO: 377933 - DNA, 25 bp, Homo sapien
tctactatggttcctttagcagaaa

SEQ ID NO: 377934 - DNA, 25 bp, Homo sapien
ctatggttcctttagcagaaaagta

SEQ ID NO: 377935 - DNA, 25 bp, Homo sapien
cttttgtgcatatattgaagtggtt

SEQ ID NO: 377936 - DNA, 25 bp, Homo sapien
gtggtttttcagctatgaattcttt

SEQ ID NO: 377937 - DNA, 25 bp, Homo sapien
tcagctatgaattctttagggtaga

SEQ ID NO: 377938 - DNA, 25 bp, Homo sapien
gaagttttgcagaaattgactgtga

SEQ ID NO: 377939 - DNA, 25 bp, Homo sapien
gtgtaggaacacttgataccttctc

SEQ ID NO: 377940 - DNA, 25 bp, Homo sapien
gtaggaacacttgataccttctcag

SEQ ID NO: 377941 - DNA, 25 bp, Homo sapien
ggaacacttgataccttctcagtag

SEQ ID NO: 377942 - DNA, 25 bp, Homo sapien
acacttgataccttctcagtagtta

SEQ ID NO: 377943 - DNA, 25 bp, Homo sapien
gataccttctcagtagttatgtgca

SEQ ID NO: 377944 - DNA, 25 bp, Homo sapien
accttctcagtagttatgtgcatgt

SEQ ID NO: 377945 - DNA, 25 bp, Homo sapien
tctcagtagttatgtgcatgtttct

SEQ ID NO: 377946 - DNA, 25 bp, Homo sapien
gtttctgtagtttcccaagctaatg

SEQ ID NO: 377947 - DNA, 25 bp, Homo sapien
tgtagtttcccaagctaatgggaga

SEQ ID NO: 377948 - DNA, 25 bp, Homo sapien
tcccaagctaatgggagagatcttc

SEQ ID NO: 377949 - DNA, 25 bp, Homo sapien
aatgctgaatagagcctagtttgct

SEQ ID NO: 377950 - DNA, 25 bp, Homo sapien
tttccctggttttctgtcactggca

SEQ ID NO: 377951 - DNA, 25 bp, Homo sapien
tggttttctgtcactggcacaggag

SEQ ID NO: 377952 - DNA, 25 bp, Homo sapien
gtcactggcacaggagggtacagtt

SEQ ID NO: 377953 - DNA, 25 bp, Homo sapien
gtacagttgggagagtgcgttcctg

SEQ ID NO: 377954 - DNA, 25 bp, Homo sapien
agcagttgatttaggtcagttctcc

SEQ ID NO: 377955 - DNA, 25 bp, Homo sapien
cgtgcctcacagcaggcctttgtgc

SEQ ID NO: 377956 - DNA, 25 bp, Homo sapien
ggcctttgtgcccttgaatctcaaa

SEQ ID NO: 377957 - DNA, 25 bp, Homo sapien
gggatctgcttggtacccagagctc

SEQ ID NO: 377958 - DNA, 25 bp, Homo sapien
ccagagctctggtcattgtgtccaa

SEQ ID NO: 377959 - DNA, 25 bp, Homo sapien
gagctctggtcattgtgtccaacca

SEQ ID NO: 377960 - DNA, 25 bp, Homo sapien
tggtcattgtgtccaaccacacacc

SEQ ID NO: 377961 - DNA, 25 bp, Homo sapien
ctggacgcaccctcactgtcagggt

SEQ ID NO: 377962 - DNA, 25 bp, Homo sapien
atggtggcagagacatgctggtggc

SEQ ID NO: 377963 - DNA, 25 bp, Homo sapien
gaggacgggcttcggctgcgcggag

SEQ ID NO: 377964 - DNA, 25 bp, Homo sapien
gccccaggggactgtcaggcacaga

SEQ ID NO: 377965 - DNA, 25 bp, Homo sapien
gtgccccagactgtccgaattgctt

SEQ ID NO: 377966 - DNA, 25 bp, Homo sapien
cccagactgtccgaattgcttttat

SEQ ID NO: 377967 - DNA, 25 bp, Homo sapien
agactgtccgaattgcttttatttt

SEQ ID NO: 377968 - DNA, 25 bp, Homo sapien
atactttcagtatactccatagacc

SEQ ID NO: 377969 - DNA, 25 bp, Homo sapien
ttcagtatactccatagaccaaaga

SEQ ID NO: 377970 - DNA, 25 bp, Homo sapien
gagcaaaatctatctgaacctggac

SEQ ID NO: 377971 - DNA, 25 bp, Homo sapien
aaatctatctgaacctggacgcacc

SEQ ID NO: 377972 - DNA, 25 bp, Homo sapien
aacaccccggatcgagaagcccgat

SEQ ID NO: 377973 - DNA, 25 bp, Homo sapien
aagcccgatgggaaagaatgtctgg

SEQ ID NO: 377974 - DNA, 25 bp, Homo sapien
tgtctgggaaggacgtcatgcccga

SEQ ID NO: 377975 - DNA, 25 bp, Homo sapien
atgcccgaggcttgcgtgacagttt

SEQ ID NO: 377976 - DNA, 25 bp, Homo sapien
gtgacagtttccactcacagtgcgc

SEQ ID NO: 377977 - DNA, 25 bp, Homo sapien
tgcagatcctgctttgtgacttcga

SEQ ID NO: 377978 - DNA, 25 bp, Homo sapien
agtgcgctcactctgaacctctgtg

SEQ ID NO: 377979 - DNA, 25 bp, Homo sapien
tctgaacctctgtgcacacgatggg

SEQ ID NO: 377980 - DNA, 25 bp, Homo sapien
atctcttcccactatctgctaggaa

SEQ ID NO: 377981 - DNA, 25 bp, Homo sapien
gaagcgctggaagcacttagaccct

SEQ ID NO: 377982 - DNA, 25 bp, Homo sapien
tggaagcacttagaccctgcctgtg

SEQ ID NO: 377983 - DNA, 25 bp, Homo sapien
taatagatatccctgcagttgcatt

SEQ ID NO: 377984 - DNA, 25 bp, Homo sapien
atatccctgcagttgcatttagtgt

SEQ ID NO: 377985 - DNA, 25 bp, Homo sapien
cagttgcatttagtgtgtgtgtgat

SEQ ID NO: 377986 - DNA, 25 bp, Homo sapien
taaaatgggttcttgcaggctcacc

SEQ ID NO: 377987 - DNA, 25 bp, Homo sapien
aatgggttcttgcaggctcacctca

SEQ ID NO: 377988 - DNA, 25 bp, Homo sapien
ttgcaggctcacctcactgacaggt

SEQ ID NO: 377989 - DNA, 25 bp, Homo sapien
cccctgtggctcttcttgtatggac

SEQ ID NO: 377990 - DNA, 25 bp, Homo sapien
gtggctcttcttgtatggaccgcgg

SEQ ID NO: 377991 - DNA, 25 bp, Homo sapien
ttcttgtatggaccgcggctggcaa

SEQ ID NO: 377992 - DNA, 25 bp, Homo sapien
tatggaccgcggctggcaaattagc

SEQ ID NO: 377993 - DNA, 25 bp, Homo sapien
ggctggcaaattagcctctttccac

SEQ ID NO: 377994 - DNA, 25 bp, Homo sapien
gacctatactgtttgaaaatgcagg

SEQ ID NO: 377995 - DNA, 25 bp, Homo sapien
acctatactgtttgaaaatgcaggc

SEQ ID NO: 377996 - DNA, 25 bp, Homo sapien
cctatactgtttgaaaatgcaggcc

SEQ ID NO: 377997 - DNA, 25 bp, Homo sapien
ctatactgtttgaaaatgcaggccg

SEQ ID NO: 377998 - DNA, 25 bp, Homo sapien
tactgtttgaaaatgcaggccgggc

SEQ ID NO: 377999 - DNA, 25 bp, Homo sapien
ctgtttgaaaatgcaggccgggcgc

SEQ ID NO: 378000 - DNA, 25 bp, Homo sapien
tgtttgaaaatgcaggccgggcgcg

SEQ ID NO: 378001 - DNA, 25 bp, Homo sapien
gtttgaaaatgcaggccgggcgcgg

SEQ ID NO: 378002 - DNA, 25 bp, Homo sapien
tttgaaaatgcaggccgggcgcggt

SEQ ID NO: 378003 - DNA, 25 bp, Homo sapien
ttgaaaatgcaggccgggcgcggtg

SEQ ID NO: 378004 - DNA, 25 bp, Homo sapien
tgaaaatgcaggccgggcgcggtgg

SEQ ID NO: 378005 - DNA, 25 bp, Homo sapien
attggtggaaaagagtaaaacatct

SEQ ID NO: 378006 - DNA, 25 bp, Homo sapien
aagagtaaaacatctatatgctata

SEQ ID NO: 378007 - DNA, 25 bp, Homo sapien
agagtaaaacatctatatgctataa

SEQ ID NO: 378008 - DNA, 25 bp, Homo sapien
gagtaaaacatctatatgctataaa

SEQ ID NO: 378009 - DNA, 25 bp, Homo sapien
acatctatatgctataaaaaggccg

SEQ ID NO: 378010 - DNA, 25 bp, Homo sapien
catctatatgctataaaaaggccgg

SEQ ID NO: 378011 - DNA, 25 bp, Homo sapien
tctatatgctataaaaaggccgggt

SEQ ID NO: 378012 - DNA, 25 bp, Homo sapien
ctatatgctataaaaaggccgggtg

SEQ ID NO: 378013 - DNA, 25 bp, Homo sapien
tatatgctataaaaaggccgggtgc

SEQ ID NO: 378014 - DNA, 25 bp, Homo sapien
atatgctataaaaaggccgggtgcg

SEQ ID NO: 378015 - DNA, 25 bp, Homo sapien
ttagcggggccaggtggcaggcacc

SEQ ID NO: 378016 - DNA, 25 bp, Homo sapien
tggagattatttccggtcccataaa

SEQ ID NO: 378017 - DNA, 25 bp, Homo sapien
ttccggtcccataaaagtcaagagt

SEQ ID NO: 378018 - DNA, 25 bp, Homo sapien
gtatatgggatctacagcacagcta

SEQ ID NO: 378019 - DNA, 25 bp, Homo sapien
gcacagctagaaaggtttgacccaa

SEQ ID NO: 378020 - DNA, 25 bp, Homo sapien
gtttgacccaacagggagtagagac

SEQ ID NO: 378021 - DNA, 25 bp, Homo sapien
gagacatttctttctctgtgacaga

SEQ ID NO: 378022 - DNA, 25 bp, Homo sapien
ttttcctctaggttaggacaggctt

SEQ ID NO: 378023 - DNA, 25 bp, Homo sapien
aatactgcagagattaatcgtacat

SEQ ID NO: 378024 - DNA, 25 bp, Homo sapien
aatcgtacatttgcagtagacctgg

SEQ ID NO: 378025 - DNA, 25 bp, Homo sapien
ttgcagtagacctgggatcccatgt

SEQ ID NO: 378026 - DNA, 25 bp, Homo sapien
tagacctgggatcccatgtagttct

SEQ ID NO: 378027 - DNA, 25 bp, Homo sapien
tgattgggaccaagactaaggactt

SEQ ID NO: 378028 - DNA, 25 bp, Homo sapien
taaggacttgtctccaatctcagct

SEQ ID NO: 378029 - DNA, 25 bp, Homo sapien
aatctcagctgaggcagtgcctctg

SEQ ID NO: 378030 - DNA, 25 bp, Homo sapien
gtgcctctgaaccaagatcttggtc

SEQ ID NO: 378031 - DNA, 25 bp, Homo sapien
atcttggtcaggcattaagacactg

SEQ ID NO: 378032 - DNA, 25 bp, Homo sapien
taagacactggctttgtcctaccaa

SEQ ID NO: 378033 - DNA, 25 bp, Homo sapien
gtcctaccaactaggatttcttggt

SEQ ID NO: 378034 - DNA, 25 bp, Homo sapien
ggtggttcacactatttcttgtgct

SEQ ID NO: 378035 - DNA, 25 bp, Homo sapien
gagatgccaatgcacacagcaggga

SEQ ID NO: 378036 - DNA, 25 bp, Homo sapien
gtttcagtgttgaagggtgcagcac

SEQ ID NO: 378037 - DNA, 25 bp, Homo sapien
acccgagtagcctctgtagtgattg

SEQ ID NO: 378038 - DNA, 25 bp, Homo sapien
gtacaaggcccagcggactctgcct

SEQ ID NO: 378039 - DNA, 25 bp, Homo sapien
ccttcttgggccaaacatctttact

SEQ ID NO: 378040 - DNA, 25 bp, Homo sapien
gggctgttgcagactgaatgtcatt

SEQ ID NO: 378041 - DNA, 25 bp, Homo sapien
gttgcagactgaatgtcattttgac

SEQ ID NO: 378042 - DNA, 25 bp, Homo sapien
atgtcattttgacagcagtgtccaa

SEQ ID NO: 378043 - DNA, 25 bp, Homo sapien
gacagcagtgtccaagaatcaggaa

SEQ ID NO: 378044 - DNA, 25 bp, Homo sapien
gtgtccaagaatcaggaagctgttc

SEQ ID NO: 378045 - DNA, 25 bp, Homo sapien
caggaagctgttctagaattcaggt

SEQ ID NO: 378046 - DNA, 25 bp, Homo sapien
gttctagaattcaggttggtatcat

SEQ ID NO: 378047 - DNA, 25 bp, Homo sapien
gaattcaggttggtatcatcataaa

SEQ ID NO: 378048 - DNA, 25 bp, Homo sapien
ggttggtatcatcataaatgagttc

SEQ ID NO: 378049 - DNA, 25 bp, Homo sapien
tctacatagagaagtgccagagcat

SEQ ID NO: 378050 - DNA, 25 bp, Homo sapien
agtgccagagcatccgtcagtagaa

SEQ ID NO: 378051 - DNA, 25 bp, Homo sapien
gagcatccgtcagtagaagttactt

SEQ ID NO: 378052 - DNA, 25 bp, Homo sapien
acttaaggttggctgtgtcttccac

SEQ ID NO: 378053 - DNA, 25 bp, Homo sapien
gttggctgtgtcttccacatctttt

SEQ ID NO: 378054 - DNA, 25 bp, Homo sapien
ccacatcttttgtttacccatgaag

SEQ ID NO: 378055 - DNA, 25 bp, Homo sapien
tgttctgtgtcttgtcataaagatg

SEQ ID NO: 378056 - DNA, 25 bp, Homo sapien
agatgggacgtgacttctttctgct

SEQ ID NO: 378057 - DNA, 25 bp, Homo sapien
tttctgctcttgcttccatctggtg

SEQ ID NO: 378058 - DNA, 25 bp, Homo sapien
tgttttctgcacagcctccttgaga

SEQ ID NO: 378059 - DNA, 25 bp, Homo sapien
acagcctccttgagaccttccagaa

SEQ ID NO: 378060 - DNA, 25 bp, Homo sapien
tggccttcctggaccgcagtggcca

SEQ ID NO: 378061 - DNA, 25 bp, Homo sapien
accgcagtggccaggagctgaaaac

SEQ ID NO: 378062 - DNA, 25 bp, Homo sapien
ccaggagctgaaaaccgtgacccca

SEQ ID NO: 378063 - DNA, 25 bp, Homo sapien
cctgcagctgttcttgatgggattt

SEQ ID NO: 378064 - DNA, 25 bp, Homo sapien
gttcgccagtcagatgcatttgcac

SEQ ID NO: 378065 - DNA, 25 bp, Homo sapien
atgcatttgcacaggacttggatcc

SEQ ID NO: 378066 - DNA, 25 bp, Homo sapien
ggacttggatcctgaactgtgtaac

SEQ ID NO: 378067 - DNA, 25 bp, Homo sapien
ttggatcctgaactgtgtaacctgg

SEQ ID NO: 378068 - DNA, 25 bp, Homo sapien
ctgaactgtgtaacctggagaggca

SEQ ID NO: 378069 - DNA, 25 bp, Homo sapien
agcctgtgccggtgtctgtttctgt

SEQ ID NO: 378070 - DNA, 25 bp, Homo sapien
tgtttctgttgtctctcggcccttc

SEQ ID NO: 378071 - DNA, 25 bp, Homo sapien
gttaaatttcccagaaagtgacata

SEQ ID NO: 378072 - DNA, 25 bp, Homo sapien
catattctaagaacttttaccccag

SEQ ID NO: 378073 - DNA, 25 bp, Homo sapien
tcagaagttgtaatacgtttgtttc

SEQ ID NO: 378074 - DNA, 25 bp, Homo sapien
gtttcctttcctctgttatcttttg

SEQ ID NO: 378075 - DNA, 25 bp, Homo sapien
tcctttcctctgttatcttttgtgc

SEQ ID NO: 378076 - DNA, 25 bp, Homo sapien
gttatcttttgtgctttgacgtatc

SEQ ID NO: 378077 - DNA, 25 bp, Homo sapien
tttgtgctttgacgtatcttgaggg

SEQ ID NO: 378078 - DNA, 25 bp, Homo sapien
gaggggtctttgcacaaggattaca

SEQ ID NO: 378079 - DNA, 25 bp, Homo sapien
aaggattacatcattcagggaccaa

SEQ ID NO: 378080 - DNA, 25 bp, Homo sapien
attcagggaccaagcactatctcag

SEQ ID NO: 378081 - DNA, 25 bp, Homo sapien
aagcactatctcagtaatagttaag

SEQ ID NO: 378082 - DNA, 25 bp, Homo sapien
aggtagtctcgtctttgccatttgc

SEQ ID NO: 378083 - DNA, 25 bp, Homo sapien
ggtgaaataaatcttcctcccatcc

SEQ ID NO: 378084 - DNA, 25 bp, Homo sapien
cctcccatcctgagtgactgtaaga

SEQ ID NO: 378085 - DNA, 25 bp, Homo sapien
gactgtaagatcattcacaaaggac

SEQ ID NO: 378086 - DNA, 25 bp, Homo sapien
aaaggacatgttcttcccctcaatg

SEQ ID NO: 378087 - DNA, 25 bp, Homo sapien
tcccctcaatgggtgtctcggagga

SEQ ID NO: 378088 - DNA, 25 bp, Homo sapien
ttcacgtttccagggatttacttca

SEQ ID NO: 378089 - DNA, 25 bp, Homo sapien
ggatttacttcaaatagtcccttgt

SEQ ID NO: 378090 - DNA, 25 bp, Homo sapien
caaatagtcccttgtatgcatcggc

SEQ ID NO: 378091 - DNA, 25 bp, Homo sapien
cccttgtatgcatcggccacaaaga

SEQ ID NO: 378092 - DNA, 25 bp, Homo sapien
acaggctcatcatctcgggttttgc

SEQ ID NO: 378093 - DNA, 25 bp, Homo sapien
ttttctatcccttattttatcccat

SEQ ID NO: 378094 - DNA, 25 bp, Homo sapien
ttctatcccttattttatcccatgg

SEQ ID NO: 378095 - DNA, 25 bp, Homo sapien
atcccttattttatcccatggttat

SEQ ID NO: 378096 - DNA, 25 bp, Homo sapien
atcccatggttattaatgattgtca

SEQ ID NO: 378097 - DNA, 25 bp, Homo sapien
aatgattgtcatatagaagggtgtc

SEQ ID NO: 378098 - DNA, 25 bp, Homo sapien
gaagggtgtcattaatcagatttcc

SEQ ID NO: 378099 - DNA, 25 bp, Homo sapien
gggtgtcattaatcagatttccctg

SEQ ID NO: 378100 - DNA, 25 bp, Homo sapien
attaatcagatttccctgacacctg

SEQ ID NO: 378101 - DNA, 25 bp, Homo sapien
gtgaaaaggtcttgaaaattatctg

SEQ ID NO: 378102 - DNA, 25 bp, Homo sapien
aattatctgacttttcacagcttct

SEQ ID NO: 378103 - DNA, 25 bp, Homo sapien
tatctgacttttcacagcttctttc

SEQ ID NO: 378104 - DNA, 25 bp, Homo sapien
gactttttaaagcaattgtcctcac

SEQ ID NO: 378105 - DNA, 25 bp, Homo sapien
attgtcctcacagagaccacatgta

SEQ ID NO: 378106 - DNA, 25 bp, Homo sapien
gagaccacatgtaatatactgaaat

SEQ ID NO: 378107 - DNA, 25 bp, Homo sapien
catttttaatggctttgttaacatc

SEQ ID NO: 378108 - DNA, 25 bp, Homo sapien
gaaatgctgcctaaatttgatttca

SEQ ID NO: 378109 - DNA, 25 bp, Homo sapien
aagtgtgcatagtaaggctgtaggt

SEQ ID NO: 378110 - DNA, 25 bp, Homo sapien
gataaatagttcactcagttgtaca

SEQ ID NO: 378111 - DNA, 25 bp, Homo sapien
gtacaaagcacaactagaacttttt

SEQ ID NO: 378112 - DNA, 25 bp, Homo sapien
gaactttttgttgggaggcttacat

SEQ ID NO: 378113 - DNA, 25 bp, Homo sapien
gggaggcttacatacatcttgaata

SEQ ID NO: 378114 - DNA, 25 bp, Homo sapien
ttgactattaagttggctacacagt

SEQ ID NO: 378115 - DNA, 25 bp, Homo sapien
ttaactcttcacattcttattggcc

SEQ ID NO: 378116 - DNA, 25 bp, Homo sapien
tcttcacattcttattggccaacca

SEQ ID NO: 378117 - DNA, 25 bp, Homo sapien
attcttattggccaaccagtatcta

SEQ ID NO: 378118 - DNA, 25 bp, Homo sapien
ggccaaccagtatctaatacatgga

SEQ ID NO: 378119 - DNA, 25 bp, Homo sapien
tggaatgaggtttcaggccctgcct

SEQ ID NO: 378120 - DNA, 25 bp, Homo sapien
cactgaggcgcttcccactgggaag

SEQ ID NO: 378121 - DNA, 25 bp, Homo sapien
ttcccactgggaagtactagagaat

SEQ ID NO: 378122 - DNA, 25 bp, Homo sapien
ggtatatctagaaacacactttgtg

SEQ ID NO: 378123 - DNA, 25 bp, Homo sapien
tattatttatcccagttcattccat

SEQ ID NO: 378124 - DNA, 25 bp, Homo sapien
atcccagttcattccatacattaag

SEQ ID NO: 378125 - DNA, 25 bp, Homo sapien
tattctggaagggtatttaactctt

SEQ ID NO: 378126 - DNA, 25 bp, Homo sapien
tgtccacatgtcagttgtaactccc

SEQ ID NO: 378127 - DNA, 25 bp, Homo sapien
aaaggaattatttctaacccagatg

SEQ ID NO: 378128 - DNA, 25 bp, Homo sapien
atttctaacccagatgtatcacttg

SEQ ID NO: 378129 - DNA, 25 bp, Homo sapien
gatgtatcacttgaaactttttaga

SEQ ID NO: 378130 - DNA, 25 bp, Homo sapien
aagcaaaataatcagggaagttcct

SEQ ID NO: 378131 - DNA, 25 bp, Homo sapien
gaagttcctagaaaggtgtttggct

SEQ ID NO: 378132 - DNA, 25 bp, Homo sapien
taaagaagacttcccccacaactgt

SEQ ID NO: 378133 - DNA, 25 bp, Homo sapien
tgtcagcacaaaacagggtattgat

SEQ ID NO: 378134 - DNA, 25 bp, Homo sapien
ggtattgatttttaactctgatgtt

SEQ ID NO: 378135 - DNA, 25 bp, Homo sapien
atgtttctattggagttgaatacta

SEQ ID NO: 378136 - DNA, 25 bp, Homo sapien
aaaattccctacattctagaaacat

SEQ ID NO: 378137 - DNA, 25 bp, Homo sapien
aaaagagccaaattactgcctaagc

SEQ ID NO: 378138 - DNA, 25 bp, Homo sapien
aattactgcctaagctcatgtcaca

SEQ ID NO: 378139 - DNA, 25 bp, Homo sapien
atgtcacacctacccggacatcagt

SEQ ID NO: 378140 - DNA, 25 bp, Homo sapien
atcagtctcccagcctcagttgaga

SEQ ID NO: 378141 - DNA, 25 bp, Homo sapien
agcctcagttgagagcaagattcct

SEQ ID NO: 378142 - DNA, 25 bp, Homo sapien
gagggcatgcatgtataaatgacac

SEQ ID NO: 378143 - DNA, 25 bp, Homo sapien
gtataaatgacacagccccatgaaa

SEQ ID NO: 378144 - DNA, 25 bp, Homo sapien
gacacagccccatgaaagaaaagct

SEQ ID NO: 378145 - DNA, 25 bp, Homo sapien
gaaaagctttcccaggcagaaagac

SEQ ID NO: 378146 - DNA, 25 bp, Homo sapien
caggagactgtctgcactcttaaaa

SEQ ID NO: 378147 - DNA, 25 bp, Homo sapien
gactgtctgcactcttaaaagagcc

SEQ ID NO: 378148 - DNA, 25 bp, Homo sapien
tttgtattttcaatgacctgctata

SEQ ID NO: 378149 - DNA, 25 bp, Homo sapien
gtattttcaatgacctgctatattt

SEQ ID NO: 378150 - DNA, 25 bp, Homo sapien
aatgacctgctatatttaagtttcc

SEQ ID NO: 378151 - DNA, 25 bp, Homo sapien
ttacttttgtgacttgggagaaatg

SEQ ID NO: 378152 - DNA, 25 bp, Homo sapien
aacatcattatgacactgtattaag

SEQ ID NO: 378153 - DNA, 25 bp, Homo sapien
tatgacactgtattaagagattaaa

SEQ ID NO: 378154 - DNA, 25 bp, Homo sapien
gtacatgctgaaaaggcaactgaca

SEQ ID NO: 378155 - DNA, 25 bp, Homo sapien
aaggcaactgacaaaatcctgtatt

SEQ ID NO: 378156 - DNA, 25 bp, Homo sapien
tgacaaaatcctgtatttggccttt

SEQ ID NO: 378157 - DNA, 25 bp, Homo sapien
tagaattccctatatcagtaagaga

SEQ ID NO: 378158 - DNA, 25 bp, Homo sapien
gaattccctatatcagtaagagaaa

SEQ ID NO: 378159 - DNA, 25 bp, Homo sapien
acatatttttactagcttatgaaaa

SEQ ID NO: 378160 - DNA, 25 bp, Homo sapien
ggaaaatagcttgacatccttttgg

SEQ ID NO: 378161 - DNA, 25 bp, Homo sapien
tagcttgacatccttttggataatg

SEQ ID NO: 378162 - DNA, 25 bp, Homo sapien
agtacttccttacaatgttctaatg

SEQ ID NO: 378163 - DNA, 25 bp, Homo sapien
agttttggttgtatcagtccagaat

SEQ ID NO: 378164 - DNA, 25 bp, Homo sapien
ggttgtatcagtccagaatatgtaa

SEQ ID NO: 378165 - DNA, 25 bp, Homo sapien
agaatatgtaattttccatttccct

SEQ ID NO: 378166 - DNA, 25 bp, Homo sapien
gtaaaacagtgcataggagaccttt

SEQ ID NO: 378167 - DNA, 25 bp, Homo sapien
agtgcataggagacctttctgtcct

SEQ ID NO: 378168 - DNA, 25 bp, Homo sapien
ttctgtccttggttgcccaaaatct

SEQ ID NO: 378169 - DNA, 25 bp, Homo sapien
ctgtccttggttgcccaaaatcttt

SEQ ID NO: 378170 - DNA, 25 bp, Homo sapien
ttctgcctgtccttttcctcaagtt

SEQ ID NO: 378171 - DNA, 25 bp, Homo sapien
tcctcaagttatttccggacttcag

SEQ ID NO: 378172 - DNA, 25 bp, Homo sapien
ttatttccggacttcagcttcttta

SEQ ID NO: 378173 - DNA, 25 bp, Homo sapien
tccggacttcagcttctttatatct

SEQ ID NO: 378174 - DNA, 25 bp, Homo sapien
atcttagtttaaggctctcagagag

SEQ ID NO: 378175 - DNA, 25 bp, Homo sapien
gctctcagagagtctttcagcttct

SEQ ID NO: 378176 - DNA, 25 bp, Homo sapien
cagagagtctttcagcttcttcaat

SEQ ID NO: 378177 - DNA, 25 bp, Homo sapien
ccaagtattgaatggacgtaatcct

SEQ ID NO: 378178 - DNA, 25 bp, Homo sapien
tggacgtaatcctcttagtgcttat

SEQ ID NO: 378179 - DNA, 25 bp, Homo sapien
acgtaatcctcttagtgcttatttt

SEQ ID NO: 378180 - DNA, 25 bp, Homo sapien
gaaactttagccaatgtgccaccat

SEQ ID NO: 378181 - DNA, 25 bp, Homo sapien
gagcattatcagaggcttctagaaa

SEQ ID NO: 378182 - DNA, 25 bp, Homo sapien
gcttctagaaatgatcagccctcaa

SEQ ID NO: 378183 - DNA, 25 bp, Homo sapien
gccctcaaaaactatccagctcaat

SEQ ID NO: 378184 - DNA, 25 bp, Homo sapien
actatccagctcaatctcttcattt

SEQ ID NO: 378185 - DNA, 25 bp, Homo sapien
tcatttgacatatgactgcgacaaa

SEQ ID NO: 378186 - DNA, 25 bp, Homo sapien
caacaagtcattgatcgcactggta

SEQ ID NO: 378187 - DNA, 25 bp, Homo sapien
aaatgataggtgcttccccagcagc

SEQ ID NO: 378188 - DNA, 25 bp, Homo sapien
ttaagggccgaacccagggctcttg

SEQ ID NO: 378189 - DNA, 25 bp, Homo sapien
agggctcttgccatatcatcaatgg

SEQ ID NO: 378190 - DNA, 25 bp, Homo sapien
tcatcaatggctcagagtatagcat

SEQ ID NO: 378191 - DNA, 25 bp, Homo sapien
gtatagcataaactcactgggttct

SEQ ID NO: 378192 - DNA, 25 bp, Homo sapien
agctatgcttttgttatggtctata

SEQ ID NO: 378193 - DNA, 25 bp, Homo sapien
gggtcataggcatccattaagatac

SEQ ID NO: 378194 - DNA, 25 bp, Homo sapien
agatcttgtgattgtccgtgggctc

SEQ ID NO: 378195 - DNA, 25 bp, Homo sapien
gtgattgtccgtgggctcacatggt

SEQ ID NO: 378196 - DNA, 25 bp, Homo sapien
ggctcacatggtttcttttgttcaa

SEQ ID NO: 378197 - DNA, 25 bp, Homo sapien
ttcaatactgttgtcccaccatgat

SEQ ID NO: 378198 - DNA, 25 bp, Homo sapien
gttgtcccaccatgatagttgacat

SEQ ID NO: 378199 - DNA, 25 bp, Homo sapien
gacatggcatgtaattacagacaga

SEQ ID NO: 378200 - DNA, 25 bp, Homo sapien
gatatcttaaaactctgtcacattg

SEQ ID NO: 378201 - DNA, 25 bp, Homo sapien
tgtcacattgtttccttaatccctt

SEQ ID NO: 378202 - DNA, 25 bp, Homo sapien
tgtttccttaatcccttagacctat

SEQ ID NO: 378203 - DNA, 25 bp, Homo sapien
tgcaactgtggtgctcttgagactg

SEQ ID NO: 378204 - DNA, 25 bp, Homo sapien
cttgagactgaggtttctgcagcca

SEQ ID NO: 378205 - DNA, 25 bp, Homo sapien
gtttctgcagccagtaagtcacctg

SEQ ID NO: 378206 - DNA, 25 bp, Homo sapien
taagtcacctgctcctgtccgcaag

SEQ ID NO: 378207 - DNA, 25 bp, Homo sapien
caagcttacctaccttgtttggttg

SEQ ID NO: 378208 - DNA, 25 bp, Homo sapien
ccttgtttggttgggtgattaagct

SEQ ID NO: 378209 - DNA, 25 bp, Homo sapien
tgattaagctgtcaccccttttcaa

SEQ ID NO: 378210 - DNA, 25 bp, Homo sapien
gtcaccccttttcaatgagaatcct

SEQ ID NO: 378211 - DNA, 25 bp, Homo sapien
aatcctttgctttcagtaacgtcct

SEQ ID NO: 378212 - DNA, 25 bp, Homo sapien
tcagtaacgtcctcatatttctttc

SEQ ID NO: 378213 - DNA, 25 bp, Homo sapien
tgtgtgtctttactccttcttcctc

SEQ ID NO: 378214 - DNA, 25 bp, Homo sapien
agggcaaaaggcgttttctccacat

SEQ ID NO: 378215 - DNA, 25 bp, Homo sapien
aaaggcgttttctccacatgcagaa

SEQ ID NO: 378216 - DNA, 25 bp, Homo sapien
ttctccacatgcagaaagtcccttg

SEQ ID NO: 378217 - DNA, 25 bp, Homo sapien
tgcagaaagtcccttgctctgagca

SEQ ID NO: 378218 - DNA, 25 bp, Homo sapien
atacgtacacacatgctctttcttt

SEQ ID NO: 378219 - DNA, 25 bp, Homo sapien
gctctttctttgtatacatgctgac

SEQ ID NO: 378220 - DNA, 25 bp, Homo sapien
tacatgctgactacacgggcaggat

SEQ ID NO: 378221 - DNA, 25 bp, Homo sapien
gactacacgggcaggatgcaaatcc

SEQ ID NO: 378222 - DNA, 25 bp, Homo sapien
ggatgcaaatcctggctgcagaaag

SEQ ID NO: 378223 - DNA, 25 bp, Homo sapien
gtcaaatcagaaccccatccttaag

SEQ ID NO: 378224 - DNA, 25 bp, Homo sapien
tgtgcccacaccatatctacagaag

SEQ ID NO: 378225 - DNA, 25 bp, Homo sapien
gattccatatctccgtaaattacag

SEQ ID NO: 378226 - DNA, 25 bp, Homo sapien
acagctaattacagggcattgttcc

SEQ ID NO: 378227 - DNA, 25 bp, Homo sapien
aatcctgagtcttaagggctgtctt

SEQ ID NO: 378228 - DNA, 25 bp, Homo sapien
ttaagggctgtcttacctttcactt

SEQ ID NO: 378229 - DNA, 25 bp, Homo sapien
tttcacttccactgtcctgtagaaa

SEQ ID NO: 378230 - DNA, 25 bp, Homo sapien
agatcaagctgcaaaccacgtcctt

SEQ ID NO: 378231 - DNA, 25 bp, Homo sapien
acgtccttcatctgttgttcatttt

SEQ ID NO: 378232 - DNA, 25 bp, Homo sapien
tttcttgcaactctttgactctgat

SEQ ID NO: 378233 - DNA, 25 bp, Homo sapien
tttgactctgatcccctgagcagca

SEQ ID NO: 378234 - DNA, 25 bp, Homo sapien
tgagcagcacgttcatcacgcatgc

SEQ ID NO: 378235 - DNA, 25 bp, Homo sapien
gttccccatttcagatgtccagtaa

SEQ ID NO: 378236 - DNA, 25 bp, Homo sapien
gaatgaagacatatttactacttta

SEQ ID NO: 378237 - DNA, 25 bp, Homo sapien
tactactttattaacatagatcgtg

SEQ ID NO: 378238 - DNA, 25 bp, Homo sapien
atagatcgtgaatgtacttactggt

SEQ ID NO: 378239 - DNA, 25 bp, Homo sapien
tcgtgaatgtacttactggtttttt

SEQ ID NO: 378240 - DNA, 25 bp, Homo sapien
actggtttttttgcagtatgagacc

SEQ ID NO: 378241 - DNA, 25 bp, Homo sapien
gtatgagaccataacaaccttgaaa

SEQ ID NO: 378242 - DNA, 25 bp, Homo sapien
gaccataacaaccttgaaagctgct

SEQ ID NO: 378243 - DNA, 25 bp, Homo sapien
aattactgtcagttaatttgcaaat

SEQ ID NO: 378244 - DNA, 25 bp, Homo sapien
aattgtcatttttgtatgtgttaaa

SEQ ID NO: 378245 - DNA, 25 bp, Homo sapien
aaaagactactatatcacaattaaa

SEQ ID NO: 378246 - DNA, 25 bp, Homo sapien
agtactttttagttgaactacatat

SEQ ID NO: 378247 - DNA, 25 bp, Homo sapien
tgaggtctccataatttaaggtgct

SEQ ID NO: 378248 - DNA, 25 bp, Homo sapien
cataatttaaggtgctgttcagact

SEQ ID NO: 378249 - DNA, 25 bp, Homo sapien
tgttcagacttggttcagctcatag

SEQ ID NO: 378250 - DNA, 25 bp, Homo sapien
ggttcagctcataggacttgttctt

SEQ ID NO: 378251 - DNA, 25 bp, Homo sapien
taggacttgttctttcatctcagcc

SEQ ID NO: 378252 - DNA, 25 bp, Homo sapien
tggaatcctcctgctttcatctggg

SEQ ID NO: 378253 - DNA, 25 bp, Homo sapien
aaaccacttgttattgtggagggca

SEQ ID NO: 378254 - DNA, 25 bp, Homo sapien
taatgccctcctcttagagcctgag

SEQ ID NO: 378255 - DNA, 25 bp, Homo sapien
ccgccaggcaggttttggtggttat

SEQ ID NO: 378256 - DNA, 25 bp, Homo sapien
tttggacactgaagggtcagacctg

SEQ ID NO: 378257 - DNA, 25 bp, Homo sapien
gacctggaagactgggaccaaaaga

SEQ ID NO: 378258 - DNA, 25 bp, Homo sapien
gtctaacccctagaggagagtttgt

SEQ ID NO: 378259 - DNA, 25 bp, Homo sapien
acccctagaggagagtttgtcacat

SEQ ID NO: 378260 - DNA, 25 bp, Homo sapien
gagtttgtcacatggtaggagctta

SEQ ID NO: 378261 - DNA, 25 bp, Homo sapien
gtcacatggtaggagcttaataaat

SEQ ID NO: 378262 - DNA, 25 bp, Homo sapien
aacagatgctttcagcagtgtatct

SEQ ID NO: 378263 - DNA, 25 bp, Homo sapien
tgctttcagcagtgtatctgccaat

SEQ ID NO: 378264 - DNA, 25 bp, Homo sapien
agcagtgtatctgccaataaaccta

SEQ ID NO: 378265 - DNA, 25 bp, Homo sapien
aataaacctaaaggcatgatttgcc

SEQ ID NO: 378266 - DNA, 25 bp, Homo sapien
gatttgccctggtgatccccccaga

SEQ ID NO: 378267 - DNA, 25 bp, Homo sapien
gtgcttagtctcttggctgaattcc

SEQ ID NO: 378268 - DNA, 25 bp, Homo sapien
agtctcttggctgaattccttctgg

SEQ ID NO: 378269 - DNA, 25 bp, Homo sapien
cacaagaggcctcccagtgtgcgcg

SEQ ID NO: 378270 - DNA, 25 bp, Homo sapien
tgagggcactgggtcctgagccacc

SEQ ID NO: 378271 - DNA, 25 bp, Homo sapien
gggtcctgagccacccaccgaagga

SEQ ID NO: 378272 - DNA, 25 bp, Homo sapien
ccgcgggacagcaaggcccgaagca

SEQ ID NO: 378273 - DNA, 25 bp, Homo sapien
ggtcgctccgggatgtctgagctct

SEQ ID NO: 378274 - DNA, 25 bp, Homo sapien
ccgggatgtctgagctctgggaggg

SEQ ID NO: 378275 - DNA, 25 bp, Homo sapien
tgtgcgcgggcctcttgaagaagta

SEQ ID NO: 378276 - DNA, 25 bp, Homo sapien
gaagtaactctactcagaggcccga

SEQ ID NO: 378277 - DNA, 25 bp, Homo sapien
gtaactctactcagaggcccgaatg

SEQ ID NO: 378278 - DNA, 25 bp, Homo sapien
tcagaggcccgaatgacccaaactg

SEQ ID NO: 378279 - DNA, 25 bp, Homo sapien
aatgacccaaactgggctctgggag

SEQ ID NO: 378280 - DNA, 25 bp, Homo sapien
aaagatgacattaacacgtgcactg

SEQ ID NO: 378281 - DNA, 25 bp, Homo sapien
acacgtgcactgttcacatcttggg

SEQ ID NO: 378282 - DNA, 25 bp, Homo sapien
gatcacagacaagacgttactaaac

SEQ ID NO: 378283 - DNA, 25 bp, Homo sapien
gttactaaacggacccctgcagtag

SEQ ID NO: 378284 - DNA, 25 bp, Homo sapien
gtaggtcccgaattgcagaatcatc

SEQ ID NO: 378285 - DNA, 25 bp, Homo sapien
atccaattccagcatggtcagcacg

SEQ ID NO: 378286 - DNA, 25 bp, Homo sapien
ggtcagcacggagatattcacagaa

SEQ ID NO: 378287 - DNA, 25 bp, Homo sapien
aaagtcctctctgagccgctagagt

SEQ ID NO: 378288 - DNA, 25 bp, Homo sapien
gagtcaacaagcttttcatacacac

SEQ ID NO: 378289 - DNA, 25 bp, Homo sapien
tcatacacactatggagagcccacg

SEQ ID NO: 378290 - DNA, 25 bp, Homo sapien
gagaacacagttccatgtcttggct

SEQ ID NO: 378291 - DNA, 25 bp, Homo sapien
aagcagggcctgagttttagaaact

SEQ ID NO: 378292 - DNA, 25 bp, Homo sapien
aaactctggtagtggagctaacact

SEQ ID NO: 378293 - DNA, 25 bp, Homo sapien
ttttataccaaatccttgccgtttg

SEQ ID NO: 378294 - DNA, 25 bp, Homo sapien
tccttgccgtttgcttcagatgaaa

SEQ ID NO: 378295 - DNA, 25 bp, Homo sapien
gcagcacgagtggttaactcaccaa

SEQ ID NO: 378296 - DNA, 25 bp, Homo sapien
aagaaatcctgtgaaactggtagta

SEQ ID NO: 378297 - DNA, 25 bp, Homo sapien
actggtagtagtcctcatgcctaaa

SEQ ID NO: 378298 - DNA, 25 bp, Homo sapien
gttaactcaccaagaaactggcctt

SEQ ID NO: 378299 - DNA, 25 bp, Homo sapien
aagaaactggccttggtgaaattca

SEQ ID NO: 378300 - DNA, 25 bp, Homo sapien
tgaaattcagtaggccggtaacaga

SEQ ID NO: 378301 - DNA, 25 bp, Homo sapien
aggccggtaacagatgcccaccgtg

SEQ ID NO: 378302 - DNA, 25 bp, Homo sapien
actaatgaaccaaggcggctgccac

SEQ ID NO: 378303 - DNA, 25 bp, Homo sapien
cggctgccaccaggaaggaacagaa

SEQ ID NO: 378304 - DNA, 25 bp, Homo sapien
ccaggaaggaacagaacgcaggcat

SEQ ID NO: 378305 - DNA, 25 bp, Homo sapien
aggcattcaaccatgacgtctgcac

SEQ ID NO: 378306 - DNA, 25 bp, Homo sapien
attcaaccatgacgtctgcacagtg

SEQ ID NO: 378307 - DNA, 25 bp, Homo sapien
acgtctgcacagtgttagtaacatg

SEQ ID NO: 378308 - DNA, 25 bp, Homo sapien
acatgtcattgtggtttcgttctca

SEQ ID NO: 378309 - DNA, 25 bp, Homo sapien
gtggtttcgttctcactgtggtaaa

SEQ ID NO: 378310 - DNA, 25 bp, Homo sapien
tttctgagcacttaaactgtgttgc

SEQ ID NO: 378311 - DNA, 25 bp, Homo sapien
taactgagaaggctctgttttgggc

SEQ ID NO: 378312 - DNA, 25 bp, Homo sapien
tcactgtgctgtttcctttgagtgg

SEQ ID NO: 378313 - DNA, 25 bp, Homo sapien
aagatccaagatgttctacagatgc

SEQ ID NO: 378314 - DNA, 25 bp, Homo sapien
gatccaagatgttctacagatgcta

SEQ ID NO: 378315 - DNA, 25 bp, Homo sapien
atccaagatgttctacagatgctat

SEQ ID NO: 378316 - DNA, 25 bp, Homo sapien
ccaagatgttctacagatgctatta

SEQ ID NO: 378317 - DNA, 25 bp, Homo sapien
aagatgttctacagatgctattaac

SEQ ID NO: 378318 - DNA, 25 bp, Homo sapien
gatgttctacagatgctattaactg

SEQ ID NO: 378319 - DNA, 25 bp, Homo sapien
gttctacagatgctattaactgagt

SEQ ID NO: 378320 - DNA, 25 bp, Homo sapien
tacagatgctattaactgagtactt

SEQ ID NO: 378321 - DNA, 25 bp, Homo sapien
gatgctattaactgagtacttggat

SEQ ID NO: 378322 - DNA, 25 bp, Homo sapien
tgctattaactgagtacttggatat

SEQ ID NO: 378323 - DNA, 25 bp, Homo sapien
ctattaactgagtacttggatatga

SEQ ID NO: 378324 - DNA, 25 bp, Homo sapien
gtggacagcccacccaggcggcggg

SEQ ID NO: 378325 - DNA, 25 bp, Homo sapien
gtgcagcccacaggctggcgaggag

SEQ ID NO: 378326 - DNA, 25 bp, Homo sapien
tggcgaggaggtgcctctgccctac

SEQ ID NO: 378327 - DNA, 25 bp, Homo sapien
gggcagggtgcatccactgtgacag

SEQ ID NO: 378328 - DNA, 25 bp, Homo sapien
aactccctgaccctggaagctgagc

SEQ ID NO: 378329 - DNA, 25 bp, Homo sapien
aagctgagcctgctttcctgaccct

SEQ ID NO: 378330 - DNA, 25 bp, Homo sapien
tccccagaacactcagagggacggt

SEQ ID NO: 378331 - DNA, 25 bp, Homo sapien
aacactcagagggacggtcaacatc

SEQ ID NO: 378332 - DNA, 25 bp, Homo sapien
gggacggtcaacatcagagcacatt

SEQ ID NO: 378333 - DNA, 25 bp, Homo sapien
gacggtcaacatcagagcacattaa

SEQ ID NO: 378334 - DNA, 25 bp, Homo sapien
gagcacattaaacgctggtgaaacc

SEQ ID NO: 378335 - DNA, 25 bp, Homo sapien
gggcagtcacccattcaattaggaa

SEQ ID NO: 378336 - DNA, 25 bp, Homo sapien
gaaacaccagcaagtgccagaagct

SEQ ID NO: 378337 - DNA, 25 bp, Homo sapien
gccagaagcttctcattagcaggtc

SEQ ID NO: 378338 - DNA, 25 bp, Homo sapien
gcttctcattagcaggtcagctttc

SEQ ID NO: 378339 - DNA, 25 bp, Homo sapien
cattagcaggtcagctttcaataac

SEQ ID NO: 378340 - DNA, 25 bp, Homo sapien
gtttatccaggtgtgtgagacccga

SEQ ID NO: 378341 - DNA, 25 bp, Homo sapien
tgtgtgagacccgataagcagaagg

SEQ ID NO: 378342 - DNA, 25 bp, Homo sapien
gggaaagctcttagcgacctatcca

SEQ ID NO: 378343 - DNA, 25 bp, Homo sapien
tagcgacctatccagctgctctgca

SEQ ID NO: 378344 - DNA, 25 bp, Homo sapien
aatggacagggcacccttcagaagc

SEQ ID NO: 378345 - DNA, 25 bp, Homo sapien
acagggcacccttcagaagcctgtg

SEQ ID NO: 378346 - DNA, 25 bp, Homo sapien
cagccttccgggaactggagtctgt

SEQ ID NO: 378347 - DNA, 25 bp, Homo sapien
agccttccgggaactggagtctgtc

SEQ ID NO: 378348 - DNA, 25 bp, Homo sapien
gccttccgggaactggagtctgtct

SEQ ID NO: 378349 - DNA, 25 bp, Homo sapien
ccttccgggaactggagtctgtctc

SEQ ID NO: 378350 - DNA, 25 bp, Homo sapien
cttccgggaactggagtctgtctct

SEQ ID NO: 378351 - DNA, 25 bp, Homo sapien
ttccgggaactggagtctgtctctt

SEQ ID NO: 378352 - DNA, 25 bp, Homo sapien
tccgggaactggagtctgtctcttt

SEQ ID NO: 378353 - DNA, 25 bp, Homo sapien
ccgggaactggagtctgtctctttc

SEQ ID NO: 378354 - DNA, 25 bp, Homo sapien
cgggaactggagtctgtctctttca

SEQ ID NO: 378355 - DNA, 25 bp, Homo sapien
gctcaaaaattctcctgtggtgcct

SEQ ID NO: 378356 - DNA, 25 bp, Homo sapien
aaattctcctgtggtgcctcagtaa

SEQ ID NO: 378357 - DNA, 25 bp, Homo sapien
ttatcattcagggagattttacaga

SEQ ID NO: 378358 - DNA, 25 bp, Homo sapien
acataattgatgtcattcaggaaaa

SEQ ID NO: 378359 - DNA, 25 bp, Homo sapien
gaaaaatggccagaggtagatgatg

SEQ ID NO: 378360 - DNA, 25 bp, Homo sapien
tgatgacagcatcgaagatcttgga

SEQ ID NO: 378361 - DNA, 25 bp, Homo sapien
gcatcgaagatcttggagaagtaaa

SEQ ID NO: 378362 - DNA, 25 bp, Homo sapien
aatttgtctgtatttaatggcctga

SEQ ID NO: 378363 - DNA, 25 bp, Homo sapien
tctgtatttaatggcctgaactgag

SEQ ID NO: 378364 - DNA, 25 bp, Homo sapien
tgaactgagagttgatatggccaaa

SEQ ID NO: 378365 - DNA, 25 bp, Homo sapien
atggccaaagggagagaggcctttt

SEQ ID NO: 378366 - DNA, 25 bp, Homo sapien
gaggagacaatagttcagaaccttt

SEQ ID NO: 378367 - DNA, 25 bp, Homo sapien
cagaacctttttaagagccattcta

SEQ ID NO: 378368 - DNA, 25 bp, Homo sapien
gccattctaaaagtgaccagcagga

SEQ ID NO: 378369 - DNA, 25 bp, Homo sapien
gcaggagggatctagtagtgaataa

SEQ ID NO: 378370 - DNA, 25 bp, Homo sapien
gaaaatgactctttcgtccagaaga

SEQ ID NO: 378371 - DNA, 25 bp, Homo sapien
gactctttcgtccagaagagctctg

SEQ ID NO: 378372 - DNA, 25 bp, Homo sapien
cctatctgagattggtatataatat

SEQ ID NO: 378373 - DNA, 25 bp, Homo sapien
agggctcccgtttatcttgtgctat

SEQ ID NO: 378374 - DNA, 25 bp, Homo sapien
ccgtttatcttgtgctatctctgta

SEQ ID NO: 378375 - DNA, 25 bp, Homo sapien
tatcttgtgctatctctgtagtatt

SEQ ID NO: 378376 - DNA, 25 bp, Homo sapien
tgtgctatctctgtagtattttcat

SEQ ID NO: 378377 - DNA, 25 bp, Homo sapien
tcagagatgtgatcccaggtagcaa

SEQ ID NO: 378378 - DNA, 25 bp, Homo sapien
aaccaatacaggtgagattactaag

SEQ ID NO: 378379 - DNA, 25 bp, Homo sapien
tactaagttgctcaccattatgggt

SEQ ID NO: 378380 - DNA, 25 bp, Homo sapien
gatctaactagattcttctgagaag

SEQ ID NO: 378381 - DNA, 25 bp, Homo sapien
gagaagccattagaatgggcctcag

SEQ ID NO: 378382 - DNA, 25 bp, Homo sapien
atgggcctcaggattgtctgctgaa

SEQ ID NO: 378383 - DNA, 25 bp, Homo sapien
gcggtattatgcatcagctctcatt

SEQ ID NO: 378384 - DNA, 25 bp, Homo sapien
ttatgcatcagctctcattccctat

SEQ ID NO: 378385 - DNA, 25 bp, Homo sapien
ctatgggtcaagatttcctcctggg

SEQ ID NO: 378386 - DNA, 25 bp, Homo sapien
gatgttaactcatctgcacttccag

SEQ ID NO: 378387 - DNA, 25 bp, Homo sapien
tgcacttccaggttgaagcaaagct

SEQ ID NO: 378388 - DNA, 25 bp, Homo sapien
aagatttccaaacaaccttgaagat

SEQ ID NO: 378389 - DNA, 25 bp, Homo sapien
gatgtaaatgtaaaggataccaaac

SEQ ID NO: 378390 - DNA, 25 bp, Homo sapien
gataccaaacataacttcctctctt

SEQ ID NO: 378391 - DNA, 25 bp, Homo sapien
cataacttcctctctttgtttctat

SEQ ID NO: 378392 - DNA, 25 bp, Homo sapien
attgtatttaaaccagatccatgtc

SEQ ID NO: 378393 - DNA, 25 bp, Homo sapien
ccagatccatgtcaaacttataaga

SEQ ID NO: 378394 - DNA, 25 bp, Homo sapien
gtacaggtagaggaaattcactttt

SEQ ID NO: 378395 - DNA, 25 bp, Homo sapien
ggaaattcacttttcatgagcaaaa

SEQ ID NO: 378396 - DNA, 25 bp, Homo sapien
tttcttcatttctgagcttagaagg

SEQ ID NO: 378397 - DNA, 25 bp, Homo sapien
aagaaacagcggaagggaatatttg

SEQ ID NO: 378398 - DNA, 25 bp, Homo sapien
ggaagactgcctaaaagatttccaa

SEQ ID NO: 378399 - DNA, 25 bp, Homo sapien
ttactattgttcctatttgagccag

SEQ ID NO: 378400 - DNA, 25 bp, Homo sapien
gttcctatttgagccagttgtcttt

SEQ ID NO: 378401 - DNA, 25 bp, Homo sapien
ttgagccagttgtctttcagtaaag

SEQ ID NO: 378402 - DNA, 25 bp, Homo sapien
gccagttgtctttcagtaaagctat

SEQ ID NO: 378403 - DNA, 25 bp, Homo sapien
agtactttaagatctataagacctt

SEQ ID NO: 378404 - DNA, 25 bp, Homo sapien
gaattcatcaatttctgtatatggg

SEQ ID NO: 378405 - DNA, 25 bp, Homo sapien
caatttctgtatatgggctttaacc

SEQ ID NO: 378406 - DNA, 25 bp, Homo sapien
tatgggctttaacctaattttccag

SEQ ID NO: 378407 - DNA, 25 bp, Homo sapien
cctaattttccaggttatgcgactt

SEQ ID NO: 378408 - DNA, 25 bp, Homo sapien
aattttccaggttatgcgacttata

SEQ ID NO: 378409 - DNA, 25 bp, Homo sapien
gcgacttataaagcactgtgaccaa

SEQ ID NO: 378410 - DNA, 25 bp, Homo sapien
atctatcagcttgctaatcacagct

SEQ ID NO: 378411 - DNA, 25 bp, Homo sapien
taatcacagctgtgtttccagcctt

SEQ ID NO: 378412 - DNA, 25 bp, Homo sapien
tgtatcatgagcttcgggagcttca

SEQ ID NO: 378413 - DNA, 25 bp, Homo sapien
gggagcttcagcaggcagtagtcct

SEQ ID NO: 378414 - DNA, 25 bp, Homo sapien
tagtcctggctgttgatggttggct

SEQ ID NO: 378415 - DNA, 25 bp, Homo sapien
gaagcagtgtatgctggcaggccct

SEQ ID NO: 378416 - DNA, 25 bp, Homo sapien
tggcaggccctggtaccatctctaa

SEQ ID NO: 378417 - DNA, 25 bp, Homo sapien
gtaccatctctaacagcggttatca

SEQ ID NO: 378418 - DNA, 25 bp, Homo sapien
cagcggttatcacagcaacattaaa

SEQ ID NO: 378419 - DNA, 25 bp, Homo sapien
taaccacaggagatagcgcctgctt

SEQ ID NO: 378420 - DNA, 25 bp, Homo sapien
cagccttgcttcatctatcagcttg

SEQ ID NO: 378421 - DNA, 25 bp, Homo sapien
gactattctaatccaaatgtttgaa

SEQ ID NO: 378422 - DNA, 25 bp, Homo sapien
ggaaatttttatatggcaatacaca

SEQ ID NO: 378423 - DNA, 25 bp, Homo sapien
ttgagtgccaacataatgttccaag

SEQ ID NO: 378424 - DNA, 25 bp, Homo sapien
gccaacataatgttccaaggaaatg

SEQ ID NO: 378425 - DNA, 25 bp, Homo sapien
tccaaggaaatgctttttggagcat

SEQ ID NO: 378426 - DNA, 25 bp, Homo sapien
agattcagaatgctcaactgtttta

SEQ ID NO: 378427 - DNA, 25 bp, Homo sapien
tatggcaatacacagggcaaaaatg

SEQ ID NO: 378428 - DNA, 25 bp, Homo sapien
cacagggcaaaaatgatgagaccag

SEQ ID NO: 378429 - DNA, 25 bp, Homo sapien
atgtttccaacatgacaaaagttaa

SEQ ID NO: 378430 - DNA, 25 bp, Homo sapien
attacaggttgactattctaatcca

SEQ ID NO: 378431 - DNA, 25 bp, Homo sapien
ggttgactattctaatccaaatgtt

SEQ ID NO: 378432 - DNA, 25 bp, Homo sapien
tggcttcctggcatcaggactttta

SEQ ID NO: 378433 - DNA, 25 bp, Homo sapien
ggacttttaaaagctcacagatgat

SEQ ID NO: 378434 - DNA, 25 bp, Homo sapien
agttcaagaactttggtactagcag

SEQ ID NO: 378435 - DNA, 25 bp, Homo sapien
actttggtactagcagaacagactg

SEQ ID NO: 378436 - DNA, 25 bp, Homo sapien
gccaattcaagactttctatcacct

SEQ ID NO: 378437 - DNA, 25 bp, Homo sapien
tacactttagtttacctcctatatc

SEQ ID NO: 378438 - DNA, 25 bp, Homo sapien
atcccacctacatactcttttgaaa

SEQ ID NO: 378439 - DNA, 25 bp, Homo sapien
agcctgaagcccactggagcctcta

SEQ ID NO: 378440 - DNA, 25 bp, Homo sapien
ctggagcctctaatacaggtctgat

SEQ ID NO: 378441 - DNA, 25 bp, Homo sapien
tacaggtctgatgcctgggttttgc

SEQ ID NO: 378442 - DNA, 25 bp, Homo sapien
ttaattggtttgcactggcttcctg

SEQ ID NO: 378443 - DNA, 25 bp, Homo sapien
tggaccacctgccaggtttatctgt

SEQ ID NO: 378444 - DNA, 25 bp, Homo sapien
accacctgccaggtttatctgttat

SEQ ID NO: 378445 - DNA, 25 bp, Homo sapien
acctgccaggtttatctgttatacc

SEQ ID NO: 378446 - DNA, 25 bp, Homo sapien
gtttatctgttatacctgtggcatt

SEQ ID NO: 378447 - DNA, 25 bp, Homo sapien
tatctgttatacctgtggcattctt

SEQ ID NO: 378448 - DNA, 25 bp, Homo sapien
ctgttatacctgtggcattcttatt

SEQ ID NO: 378449 - DNA, 25 bp, Homo sapien
atacctgtggcattcttattatgtc

SEQ ID NO: 378450 - DNA, 25 bp, Homo sapien
ctgtggcattcttattatgtcagac

SEQ ID NO: 378451 - DNA, 25 bp, Homo sapien
ggcattcttattatgtcagacaagt

SEQ ID NO: 378452 - DNA, 25 bp, Homo sapien
gtcagacaagttattatagttcatt

SEQ ID NO: 378453 - DNA, 25 bp, Homo sapien
tatagttcattcaactctaacaaat

SEQ ID NO: 378454 - DNA, 25 bp, Homo sapien
tcctggagcttcgagtctatggtat

SEQ ID NO: 378455 - DNA, 25 bp, Homo sapien
ctggagcttcgagtctatggtatga

SEQ ID NO: 378456 - DNA, 25 bp, Homo sapien
gagcttcgagtctatggtatgagtt

SEQ ID NO: 378457 - DNA, 25 bp, Homo sapien
tcgagtctatggtatgagttaaaca

SEQ ID NO: 378458 - DNA, 25 bp, Homo sapien
taaacagaagggtatctcctccatc

SEQ ID NO: 378459 - DNA, 25 bp, Homo sapien
acagaagggtatctcctccatcaga

SEQ ID NO: 378460 - DNA, 25 bp, Homo sapien
gctccatcagacctggagcttccaa

SEQ ID NO: 378461 - DNA, 25 bp, Homo sapien
tgaagagctgaaccaggtccagaaa

SEQ ID NO: 378462 - DNA, 25 bp, Homo sapien
agaacccagcactactcccagaggc

SEQ ID NO: 378463 - DNA, 25 bp, Homo sapien
gaggcgctgcaaggctccgtgctcc

SEQ ID NO: 378464 - DNA, 25 bp, Homo sapien
gtgctcctggagcttcgagtctatg

SEQ ID NO: 378465 - DNA, 25 bp, Homo sapien
gaggtgtattgtaccaaattttgta

SEQ ID NO: 378466 - DNA, 25 bp, Homo sapien
gatcttaaagcttcctaaattgtga

SEQ ID NO: 378467 - DNA, 25 bp, Homo sapien
gaaaagggtatgtgctaacatctca

SEQ ID NO: 378468 - DNA, 25 bp, Homo sapien
tctcagaactttagacctgcttgtt

SEQ ID NO: 378469 - DNA, 25 bp, Homo sapien
atctttaccgatctctgatgataaa

SEQ ID NO: 378470 - DNA, 25 bp, Homo sapien
taccgatctctgatgataaatgcag

SEQ ID NO: 378471 - DNA, 25 bp, Homo sapien
aagcaagtagagtcaatcagagttt

SEQ ID NO: 378472 - DNA, 25 bp, Homo sapien
gtcaatcagagttttgaacatcata

SEQ ID NO: 378473 - DNA, 25 bp, Homo sapien
gaacatcatagtaatacttccgtga

SEQ ID NO: 378474 - DNA, 25 bp, Homo sapien
atagtaatacttccgtgattcagag

SEQ ID NO: 378475 - DNA, 25 bp, Homo sapien
tacttccgtgattcagagttagatc

SEQ ID NO: 378476 - DNA, 25 bp, Homo sapien
tatggaaacttctgtacctgtgtca

SEQ ID NO: 378477 - DNA, 25 bp, Homo sapien
ggaaacttctgtacctgtgtcaacg

SEQ ID NO: 378478 - DNA, 25 bp, Homo sapien
aacttctgtacctgtgtcaacggtg

SEQ ID NO: 378479 - DNA, 25 bp, Homo sapien
ttctgtacctgtgtcaacggtgcat

SEQ ID NO: 378480 - DNA, 25 bp, Homo sapien
gtacctgtgtcaacggtgcatctta

SEQ ID NO: 378481 - DNA, 25 bp, Homo sapien
gtgtcaacggtgcatcttatctaat

SEQ ID NO: 378482 - DNA, 25 bp, Homo sapien
gtcaacggtgcatcttatctaatac

SEQ ID NO: 378483 - DNA, 25 bp, Homo sapien
cggtgcatcttatctaatactatat

SEQ ID NO: 378484 - DNA, 25 bp, Homo sapien
actgtaatctaatattatctctgat

SEQ ID NO: 378485 - DNA, 25 bp, Homo sapien
aatgctaataaactctgctcaaatg

SEQ ID NO: 378486 - DNA, 25 bp, Homo sapien
gctaataaactctgctcaaatgtga

SEQ ID NO: 378487 - DNA, 25 bp, Homo sapien
actgtatttcaatctatttctccaa

SEQ ID NO: 378488 - DNA, 25 bp, Homo sapien
atttctccaagatgcttttcatata

SEQ ID NO: 378489 - DNA, 25 bp, Homo sapien
gaaatatcccaggataactgcttct

SEQ ID NO: 378490 - DNA, 25 bp, Homo sapien
gcattaagactgttttcaaagcttt

SEQ ID NO: 378491 - DNA, 25 bp, Homo sapien
agactgttttcaaagctttcctcac

SEQ ID NO: 378492 - DNA, 25 bp, Homo sapien
ctgttttcaaagctttcctcacatt

SEQ ID NO: 378493 - DNA, 25 bp, Homo sapien
tatatcccaacccatgactttggag

SEQ ID NO: 378494 - DNA, 25 bp, Homo sapien
aacccatgactttggagatatacct

SEQ ID NO: 378495 - DNA, 25 bp, Homo sapien
aaaccaatataacagcagggttatt

SEQ ID NO: 378496 - DNA, 25 bp, Homo sapien
tcaaatgttgcttcagatgtgcaag

SEQ ID NO: 378497 - DNA, 25 bp, Homo sapien
gttgcttcagatgtgcaagttgcaa

SEQ ID NO: 378498 - DNA, 25 bp, Homo sapien
ggtaatctgcttcctcaagattctg

SEQ ID NO: 378499 - DNA, 25 bp, Homo sapien
gttgatacacattcaggactctggt

SEQ ID NO: 378500 - DNA, 25 bp, Homo sapien
gcttgatgacaatgacccagtttct

SEQ ID NO: 378501 - DNA, 25 bp, Homo sapien
aatgacccagtttctttgactaaat

SEQ ID NO: 378502 - DNA, 25 bp, Homo sapien
actttagaatcacaaggtccattaa

SEQ ID NO: 378503 - DNA, 25 bp, Homo sapien
gtccattaaaggacatctcccctga

SEQ ID NO: 378504 - DNA, 25 bp, Homo sapien
tcccctgaccttcccattttgtaga

SEQ ID NO: 378505 - DNA, 25 bp, Homo sapien
ggaagactaaggtccaagcttgaat

SEQ ID NO: 378506 - DNA, 25 bp, Homo sapien
aagcttgaatgacctgccatcatgg

SEQ ID NO: 378507 - DNA, 25 bp, Homo sapien
gggataaccggaattgatacaatgt

SEQ ID NO: 378508 - DNA, 25 bp, Homo sapien
gattcaagattcagagctcattttt

SEQ ID NO: 378509 - DNA, 25 bp, Homo sapien
gtacatgcagccaaatttacaggaa

SEQ ID NO: 378510 - DNA, 25 bp, Homo sapien
cttgaaataccaacattctggcaaa

SEQ ID NO: 378511 - DNA, 25 bp, Homo sapien
aagagtaagtggaacctgggatgca

SEQ ID NO: 378512 - DNA, 25 bp, Homo sapien
gtggaacctgggatgcaggaacaaa

SEQ ID NO: 378513 - DNA, 25 bp, Homo sapien
caaacatttttgtgggagctccctt

SEQ ID NO: 378514 - DNA, 25 bp, Homo sapien
atttttgtgggagctcccttcgctg

SEQ ID NO: 378515 - DNA, 25 bp, Homo sapien
ctcccttcgctgttgtgcagcagaa

SEQ ID NO: 378516 - DNA, 25 bp, Homo sapien
gtgcagcagaaacagattctcagtt

SEQ ID NO: 378517 - DNA, 25 bp, Homo sapien
attctcagttcatttttactcccac

SEQ ID NO: 378518 - DNA, 25 bp, Homo sapien
gttcatttttactcccactgtatta

SEQ ID NO: 378519 - DNA, 25 bp, Homo sapien
tttttactcccactgtattatagtt

SEQ ID NO: 378520 - DNA, 25 bp, Homo sapien
cacaccctctacagctgagaacagg

SEQ ID NO: 378521 - DNA, 25 bp, Homo sapien
tgggcactgcaaggaaactgtacat

SEQ ID NO: 378522 - DNA, 25 bp, Homo sapien
gaaactgtacatcacactggaggaa

SEQ ID NO: 378523 - DNA, 25 bp, Homo sapien
gaagcagacgtttgggtttaatgaa

SEQ ID NO: 378524 - DNA, 25 bp, Homo sapien
aattcatgactagagtgtagccatt

SEQ ID NO: 378525 - DNA, 25 bp, Homo sapien
ttctctggagaaccacaaatggagt

SEQ ID NO: 378526 - DNA, 25 bp, Homo sapien
aaatggagtgtgttttcctagactg

SEQ ID NO: 378527 - DNA, 25 bp, Homo sapien
gtgtgttttcctagactgttcttag

SEQ ID NO: 378528 - DNA, 25 bp, Homo sapien
ttcctagactgttcttagatgttct

SEQ ID NO: 378529 - DNA, 25 bp, Homo sapien
gatgttctgagatacggcactcgga

SEQ ID NO: 378530 - DNA, 25 bp, Homo sapien
gagatacggcactcggagtgctccc

SEQ ID NO: 378531 - DNA, 25 bp, Homo sapien
cccgggtgtcactgctgtggtttga

SEQ ID NO: 378532 - DNA, 25 bp, Homo sapien
ctgtggtttgagtttgtgtgtcccc

SEQ ID NO: 378533 - DNA, 25 bp, Homo sapien
tgtccccagccttcatatgttggaa

SEQ ID NO: 378534 - DNA, 25 bp, Homo sapien
atatgttggaacctgagacccaaga

SEQ ID NO: 378535 - DNA, 25 bp, Homo sapien
acctgagacccaagaagatcgttat

SEQ ID NO: 378536 - DNA, 25 bp, Homo sapien
gaaggtgattaagtcaccagggtcc

SEQ ID NO: 378537 - DNA, 25 bp, Homo sapien
accagggtccccattgaagcgcttg

SEQ ID NO: 378538 - DNA, 25 bp, Homo sapien
aagcgcttgggaaaccatcgaggcc

SEQ ID NO: 378539 - DNA, 25 bp, Homo sapien
cttccgccgggagaggacacagcaa

SEQ ID NO: 378540 - DNA, 25 bp, Homo sapien
acacagcaagaggcacccactggga

SEQ ID NO: 378541 - DNA, 25 bp, Homo sapien
aggctgctggcaccgagaccctgga

SEQ ID NO: 378542 - DNA, 25 bp, Homo sapien
aaatttattatatcactggttttca

SEQ ID NO: 378543 - DNA, 25 bp, Homo sapien
tgtataggctgacttctgaataatt

SEQ ID NO: 378544 - DNA, 25 bp, Homo sapien
ggtatctattattttcattcccata

SEQ ID NO: 378545 - DNA, 25 bp, Homo sapien
attattttcattcccataagagggt

SEQ ID NO: 378546 - DNA, 25 bp, Homo sapien
gagggtgtaaacaattaactccagg

SEQ ID NO: 378547 - DNA, 25 bp, Homo sapien
taactccagggttttattgtatcct

SEQ ID NO: 378548 - DNA, 25 bp, Homo sapien
tccagggttttattgtatcctgcaa

SEQ ID NO: 378549 - DNA, 25 bp, Homo sapien
gtatcctgcaatatttagtattaac

SEQ ID NO: 378550 - DNA, 25 bp, Homo sapien
ctatatatgatttagcactgtgcca

SEQ ID NO: 378551 - DNA, 25 bp, Homo sapien
agcactgtgccaaacacattttcaa

SEQ ID NO: 378552 - DNA, 25 bp, Homo sapien
gccaaacacattttcaagagtacat

SEQ ID NO: 378553 - DNA, 25 bp, Homo sapien
cagtgacttttcagatttatttctt

SEQ ID NO: 378554 - DNA, 25 bp, Homo sapien
atttatttcttgttagccgctgtgt

SEQ ID NO: 378555 - DNA, 25 bp, Homo sapien
gccgctgtgtctatttggtgctaca

SEQ ID NO: 378556 - DNA, 25 bp, Homo sapien
acaaaatccctgatgtaagggctta

SEQ ID NO: 378557 - DNA, 25 bp, Homo sapien
tacatttacgggaaaggattggaca

SEQ ID NO: 378558 - DNA, 25 bp, Homo sapien
gacaatagtatcattttctcaccat

SEQ ID NO: 378559 - DNA, 25 bp, Homo sapien
tctcaccatttgcatgtacatcatg

SEQ ID NO: 378560 - DNA, 25 bp, Homo sapien
gtacatcatgtctttccaattgttt

SEQ ID NO: 378561 - DNA, 25 bp, Homo sapien
gcaaaattgtgcagtggttcaacct

SEQ ID NO: 378562 - DNA, 25 bp, Homo sapien
gtggttcaacctgaccaaagtggta

SEQ ID NO: 378563 - DNA, 25 bp, Homo sapien
caaagtggtattatgctgctgggaa

SEQ ID NO: 378564 - DNA, 25 bp, Homo sapien
agtgatgaaattcctgtttcatggg

SEQ ID NO: 378565 - DNA, 25 bp, Homo sapien
ctgctgctgtggattcttgtagcta

SEQ ID NO: 378566 - DNA, 25 bp, Homo sapien
gattcttgtagctatgcctcggctt

SEQ ID NO: 378567 - DNA, 25 bp, Homo sapien
tcggcttcttggcatatcaggtagg

SEQ ID NO: 378568 - DNA, 25 bp, Homo sapien
ataaattcattcttctgctctcctg

SEQ ID NO: 378569 - DNA, 25 bp, Homo sapien
attcttctgctctcctgacttagag

SEQ ID NO: 378570 - DNA, 25 bp, Homo sapien
cctgacttagagaaatggtttgctt

SEQ ID NO: 378571 - DNA, 25 bp, Homo sapien
atggtttgcttaaaatgctagtaac

SEQ ID NO: 378572 - DNA, 25 bp, Homo sapien
acatcacagtcaacaggagcttgct

SEQ ID NO: 378573 - DNA, 25 bp, Homo sapien
aacaggagcttgcttcatgcgaagg

SEQ ID NO: 378574 - DNA, 25 bp, Homo sapien
gcttcatgcgaaggatcaatgtgat

SEQ ID NO: 378575 - DNA, 25 bp, Homo sapien
gaaatatcccaggataactgcttct

SEQ ID NO: 378576 - DNA, 25 bp, Homo sapien
gcattaagactgttttcaaagcttt

SEQ ID NO: 378577 - DNA, 25 bp, Homo sapien
tatatcccaacccatgactttggag

SEQ ID NO: 378578 - DNA, 25 bp, Homo sapien
tatcccaacccatgactttggagat

SEQ ID NO: 378579 - DNA, 25 bp, Homo sapien
tcccaacccatgactttggagatat

SEQ ID NO: 378580 - DNA, 25 bp, Homo sapien
aacccatgactttggagatatacct

SEQ ID NO: 378581 - DNA, 25 bp, Homo sapien
aaaccaatataacagcagggttatt

SEQ ID NO: 378582 - DNA, 25 bp, Homo sapien
tcaaatgttgcttcagatgtgcaag

SEQ ID NO: 378583 - DNA, 25 bp, Homo sapien
atgttgcttcagatgtgcaagttgc

SEQ ID NO: 378584 - DNA, 25 bp, Homo sapien
gttgcttcagatgtgcaagttgcaa

SEQ ID NO: 378585 - DNA, 25 bp, Homo sapien
gcttcagatgtgcaagttgcaaatt

SEQ ID NO: 378586 - DNA, 25 bp, Homo sapien
ggaatctcaaggactccgactcctg

SEQ ID NO: 378587 - DNA, 25 bp, Homo sapien
tccgactcctggcttgttcagagaa

SEQ ID NO: 378588 - DNA, 25 bp, Homo sapien
tgttcagagaaggagagccccgact

SEQ ID NO: 378589 - DNA, 25 bp, Homo sapien
tcccggaatgcgacgtggaggtcca

SEQ ID NO: 378590 - DNA, 25 bp, Homo sapien
atgcgacgtggaggtccagccccag

SEQ ID NO: 378591 - DNA, 25 bp, Homo sapien
agccccagggccatcccgaggagtc

SEQ ID NO: 378592 - DNA, 25 bp, Homo sapien
gtcccgggaacaggaggcatccgaa

SEQ ID NO: 378593 - DNA, 25 bp, Homo sapien
gaacaggaggcatccgaagtcctgg

SEQ ID NO: 378594 - DNA, 25 bp, Homo sapien
gaagtcctggcggaaccttcgagcc

SEQ ID NO: 378595 - DNA, 25 bp, Homo sapien
gaaggcagcagcactgagagcagcc

SEQ ID NO: 378596 - DNA, 25 bp, Homo sapien
agcagcactgagagcagccgcgacg

SEQ ID NO: 378597 - DNA, 25 bp, Homo sapien
gtttttcagagcttaacacactgga

SEQ ID NO: 378598 - DNA, 25 bp, Homo sapien
gtgtagcagttcttgaagccactaa

SEQ ID NO: 378599 - DNA, 25 bp, Homo sapien
agagccaggcaagacgtgtgaacag

SEQ ID NO: 378600 - DNA, 25 bp, Homo sapien
tgggcatgagcgaggcctgttctaa

SEQ ID NO: 378601 - DNA, 25 bp, Homo sapien
gaggcctgttctaagcgtgctgcca

SEQ ID NO: 378602 - DNA, 25 bp, Homo sapien
actgctctgttctcgtccatggctg

SEQ ID NO: 378603 - DNA, 25 bp, Homo sapien
gcagaaatgtcagcctggagttgct

SEQ ID NO: 378604 - DNA, 25 bp, Homo sapien
gtcgactttaaggtgggcagtgtct

SEQ ID NO: 378605 - DNA, 25 bp, Homo sapien
aggtgggcagtgtctttgcagcatc

SEQ ID NO: 378606 - DNA, 25 bp, Homo sapien
ctttgcagcatctttatctgcactc

SEQ ID NO: 378607 - DNA, 25 bp, Homo sapien
atctgcactcagtttttcagagctt

SEQ ID NO: 378608 - DNA, 25 bp, Homo sapien
aagtccaccatgctgaactccaggt

SEQ ID NO: 378609 - DNA, 25 bp, Homo sapien
tgaactccaggtgagaactctcctc

SEQ ID NO: 378610 - DNA, 25 bp, Homo sapien
tgcccacatgggtcctggctcatga

SEQ ID NO: 378611 - DNA, 25 bp, Homo sapien
aaaatccagggaagatagcgcagtt

SEQ ID NO: 378612 - DNA, 25 bp, Homo sapien
agatagcgcagttgtaggctcagac

SEQ ID NO: 378613 - DNA, 25 bp, Homo sapien
acactggtcatgtcattgaggtaag

SEQ ID NO: 378614 - DNA, 25 bp, Homo sapien
gtcattgaggtaagtcagctacaaa

SEQ ID NO: 378615 - DNA, 25 bp, Homo sapien
tctttccttccggtttccaaatcat

SEQ ID NO: 378616 - DNA, 25 bp, Homo sapien
gagctagaagatgccgcccgctgca

SEQ ID NO: 378617 - DNA, 25 bp, Homo sapien
cacagtggcactgatgagacccatc

SEQ ID NO: 378618 - DNA, 25 bp, Homo sapien
atgagacccatctggcggatctgga

SEQ ID NO: 378619 - DNA, 25 bp, Homo sapien
ttgtgctattcttaggcattaaagt

SEQ ID NO: 378620 - DNA, 25 bp, Homo sapien
gctattcttaggcattaaagtttat

SEQ ID NO: 378621 - DNA, 25 bp, Homo sapien
aagtgactagcttgttactgtttag

SEQ ID NO: 378622 - DNA, 25 bp, Homo sapien
gtgactagcttgttactgtttagaa

SEQ ID NO: 378623 - DNA, 25 bp, Homo sapien
tgactagcttgttactgtttagaat

SEQ ID NO: 378624 - DNA, 25 bp, Homo sapien
aattgacccccaaaattgcatatat

SEQ ID NO: 378625 - DNA, 25 bp, Homo sapien
aagcatcaggtatggtatttctgca

SEQ ID NO: 378626 - DNA, 25 bp, Homo sapien
gcatcaggtatggtatttctgcaaa

SEQ ID NO: 378627 - DNA, 25 bp, Homo sapien
atcaggtatggtatttctgcaaaga

SEQ ID NO: 378628 - DNA, 25 bp, Homo sapien
aagcatttgtgctattcttaggcat

SEQ ID NO: 378629 - DNA, 25 bp, Homo sapien
gcatttgtgctattcttaggcatta

SEQ ID NO: 378630 - DNA, 25 bp, Homo sapien
tttgtaacatacaaaaagaatctgc

SEQ ID NO: 378631 - DNA, 25 bp, Homo sapien
ttgtaacatacaaaaagaatctgcc

SEQ ID NO: 378632 - DNA, 25 bp, Homo sapien
tgtaacatacaaaaagaatctgcca

SEQ ID NO: 378633 - DNA, 25 bp, Homo sapien
gtaacatacaaaaagaatctgccag

SEQ ID NO: 378634 - DNA, 25 bp, Homo sapien
taacatacaaaaagaatctgccaga

SEQ ID NO: 378635 - DNA, 25 bp, Homo sapien
aacatacaaaaagaatctgccagaa

SEQ ID NO: 378636 - DNA, 25 bp, Homo sapien
acatacaaaaagaatctgccagaaa

SEQ ID NO: 378637 - DNA, 25 bp, Homo sapien
catacaaaaagaatctgccagaaaa

SEQ ID NO: 378638 - DNA, 25 bp, Homo sapien
tttttgtagaaaatgagctgctaga

SEQ ID NO: 378639 - DNA, 25 bp, Homo sapien
aaggcccaagtgaaagcctcagagg

SEQ ID NO: 378640 - DNA, 25 bp, Homo sapien
gcccaagtgaaagcctcagaggcgg

SEQ ID NO: 378641 - DNA, 25 bp, Homo sapien
tcagaggcggagtcgtgagcgaacc

SEQ ID NO: 378642 - DNA, 25 bp, Homo sapien
agtcgtgagcgaacctggcaggaga

SEQ ID NO: 378643 - DNA, 25 bp, Homo sapien
cgaacctggcaggagacgaggttcc

SEQ ID NO: 378644 - DNA, 25 bp, Homo sapien
tgtggcagagaaactcgtgaccggg

SEQ ID NO: 378645 - DNA, 25 bp, Homo sapien
ggcaccgcctctacccgaaatgaat

SEQ ID NO: 378646 - DNA, 25 bp, Homo sapien
aagacactacccaagctcagaaggt

SEQ ID NO: 378647 - DNA, 25 bp, Homo sapien
gacactacccaagctcagaaggtaa

SEQ ID NO: 378648 - DNA, 25 bp, Homo sapien
aagctcagaaggtaagtgctgggtc

SEQ ID NO: 378649 - DNA, 25 bp, Homo sapien
gaatttttgtatcttgtcttgtctt

SEQ ID NO: 378650 - DNA, 25 bp, Homo sapien
gtcttgtctttgtccattataaact

SEQ ID NO: 378651 - DNA, 25 bp, Homo sapien
ggaggatcacagttaagccttccat

SEQ ID NO: 378652 - DNA, 25 bp, Homo sapien
gttaagccttccatgaattcatagt

SEQ ID NO: 378653 - DNA, 25 bp, Homo sapien
gtttggaatcatttaccttaccatt

SEQ ID NO: 378654 - DNA, 25 bp, Homo sapien
tttcttattacagtgtcactacact

SEQ ID NO: 378655 - DNA, 25 bp, Homo sapien
atgtaggtgcttgaacatgccccac

SEQ ID NO: 378656 - DNA, 25 bp, Homo sapien
cacagacacagttgtagccctagta

SEQ ID NO: 378657 - DNA, 25 bp, Homo sapien
agccctagtatttgtgacggtcatt

SEQ ID NO: 378658 - DNA, 25 bp, Homo sapien
gacacagtgcagactttacagatgg

SEQ ID NO: 378659 - DNA, 25 bp, Homo sapien
ggagcattatgctctcagaggactt

SEQ ID NO: 378660 - DNA, 25 bp, Homo sapien
cttggcagcagagcagtgaacatgt

SEQ ID NO: 378661 - DNA, 25 bp, Homo sapien
gtgaacatgtggaagtggtctctaa

SEQ ID NO: 378662 - DNA, 25 bp, Homo sapien
catgtggaagtggtctctaaaacaa

SEQ ID NO: 378663 - DNA, 25 bp, Homo sapien
tctctaaaacaaatattgtcctgga

SEQ ID NO: 378664 - DNA, 25 bp, Homo sapien
gaactctccaggacaacacaacctt

SEQ ID NO: 378665 - DNA, 25 bp, Homo sapien
ggacaacacaaccttatgagtgaca

SEQ ID NO: 378666 - DNA, 25 bp, Homo sapien
atgagtgacatctgttggcattctg

SEQ ID NO: 378667 - DNA, 25 bp, Homo sapien
gtgacatctgttggcattctgtgga

SEQ ID NO: 378668 - DNA, 25 bp, Homo sapien
gagtctctgtttgaatgcaagtaaa

SEQ ID NO: 378669 - DNA, 25 bp, Homo sapien
gaatgcaagtaaagacccttaaaat

SEQ ID NO: 378670 - DNA, 25 bp, Homo sapien
tttgtttgccaagtatcatattaga

SEQ ID NO: 378671 - DNA, 25 bp, Homo sapien
gtgctttcatagttgctacaaaggt

SEQ ID NO: 378672 - DNA, 25 bp, Homo sapien
gctttcatagttgctacaaaggtaa

SEQ ID NO: 378673 - DNA, 25 bp, Homo sapien
ataatggagagatttggtacaaaac

SEQ ID NO: 378674 - DNA, 25 bp, Homo sapien
ggagagatttggtacaaaacaacaa

SEQ ID NO: 378675 - DNA, 25 bp, Homo sapien
atatagctgataaaattacctgagg

SEQ ID NO: 378676 - DNA, 25 bp, Homo sapien
gctgataaaattacctgaggagtgt

SEQ ID NO: 378677 - DNA, 25 bp, Homo sapien
acctgaggagtgtaatgcttatttt

SEQ ID NO: 378678 - DNA, 25 bp, Homo sapien
ttttgtgtatatctttgcaatctat

SEQ ID NO: 378679 - DNA, 25 bp, Homo sapien
gagactgtgaaatacttagccatgc

SEQ ID NO: 378680 - DNA, 25 bp, Homo sapien
tgtgaaatacttagccatgcagaat

SEQ ID NO: 378681 - DNA, 25 bp, Homo sapien
gaaatacttagccatgcagaatatg

SEQ ID NO: 378682 - DNA, 25 bp, Homo sapien
gccagtggctctgtgggcgtccttt

SEQ ID NO: 378683 - DNA, 25 bp, Homo sapien
ggctttccctgggactgtgtggctc

SEQ ID NO: 378684 - DNA, 25 bp, Homo sapien
actgtgtggctcctgtcccaactgg

SEQ ID NO: 378685 - DNA, 25 bp, Homo sapien
attccacattcccattgctggacca

SEQ ID NO: 378686 - DNA, 25 bp, Homo sapien
tgggcacagggcttccttttgctga

SEQ ID NO: 378687 - DNA, 25 bp, Homo sapien
ggcttccttttgctgattcatttcc

SEQ ID NO: 378688 - DNA, 25 bp, Homo sapien
gagttgagccccatctgagtcccca

SEQ ID NO: 378689 - DNA, 25 bp, Homo sapien
atgctggccctgaaacggttacaaa

SEQ ID NO: 378690 - DNA, 25 bp, Homo sapien
acaaaggctgaaaccagggatggca

SEQ ID NO: 378691 - DNA, 25 bp, Homo sapien
atggcaggcccaggatcagtgctgt

SEQ ID NO: 378692 - DNA, 25 bp, Homo sapien
cccaggatcagtgctgtggctgttg

SEQ ID NO: 378693 - DNA, 25 bp, Homo sapien
ttgcagtgagcacgatcgtccattg

SEQ ID NO: 378694 - DNA, 25 bp, Homo sapien
gcagtgagcacgatcgtccattgca

SEQ ID NO: 378695 - DNA, 25 bp, Homo sapien
gtgagcacgatcgtccattgcactc

SEQ ID NO: 378696 - DNA, 25 bp, Homo sapien
aacaaaactgtgattctccatctaa

SEQ ID NO: 378697 - DNA, 25 bp, Homo sapien
aactgtgattctccatctaactttt

SEQ ID NO: 378698 - DNA, 25 bp, Homo sapien
gtgattctccatctaactttttaca

SEQ ID NO: 378699 - DNA, 25 bp, Homo sapien
ctttttacaattatcctttcacaat

SEQ ID NO: 378700 - DNA, 25 bp, Homo sapien
acaattatcctttcacaattcaaga

SEQ ID NO: 378701 - DNA, 25 bp, Homo sapien
gtgtgaatgcaagtcattactaaca

SEQ ID NO: 378702 - DNA, 25 bp, Homo sapien
aatgcaagtcattactaacagtatc

SEQ ID NO: 378703 - DNA, 25 bp, Homo sapien
gtatctcagtaaaagtagtccagga

SEQ ID NO: 378704 - DNA, 25 bp, Homo sapien
tgttagcccaagtggcgccatcaag

SEQ ID NO: 378705 - DNA, 25 bp, Homo sapien
agtggcgccatcaagtaaacccctg

SEQ ID NO: 378706 - DNA, 25 bp, Homo sapien
tgccattttgtacaccctgatcagg

SEQ ID NO: 378707 - DNA, 25 bp, Homo sapien
accctgatcagggaggaaacttcca

SEQ ID NO: 378708 - DNA, 25 bp, Homo sapien
gaaacttccataggggctcaggcca

SEQ ID NO: 378709 - DNA, 25 bp, Homo sapien
ctgactgcaggaaatggctccctta

SEQ ID NO: 378710 - DNA, 25 bp, Homo sapien
gaaatggctcccttattacatcctg

SEQ ID NO: 378711 - DNA, 25 bp, Homo sapien
cttattacatcctgccaggcagcta

SEQ ID NO: 378712 - DNA, 25 bp, Homo sapien
gggatttgaaacgtgcagcagcctt

SEQ ID NO: 378713 - DNA, 25 bp, Homo sapien
cagcagccttgcaaatgagccaaac

SEQ ID NO: 378714 - DNA, 25 bp, Homo sapien
gccttgcaaatgagccaaaccccgt

SEQ ID NO: 378715 - DNA, 25 bp, Homo sapien
gacagatagacatcgtcagtctctt

SEQ ID NO: 378716 - DNA, 25 bp, Homo sapien
tagacatcgtcagtctctttttaca

SEQ ID NO: 378717 - DNA, 25 bp, Homo sapien
gtctctttttacaagtcaagacagt

SEQ ID NO: 378718 - DNA, 25 bp, Homo sapien
tcaaagtaatagtttcctggcagga

SEQ ID NO: 378719 - DNA, 25 bp, Homo sapien
aattgctggagcgttggagagccat

SEQ ID NO: 378720 - DNA, 25 bp, Homo sapien
gctggagcgttggagagccatctct

SEQ ID NO: 378721 - DNA, 25 bp, Homo sapien
aaaggaagagttgcctggtctgaga

SEQ ID NO: 378722 - DNA, 25 bp, Homo sapien
agttgcctggtctgagaactttaga

SEQ ID NO: 378723 - DNA, 25 bp, Homo sapien
gaactgaaaatgcatgtgtatccat

SEQ ID NO: 378724 - DNA, 25 bp, Homo sapien
agggcctcaggctggcgccccagaa

SEQ ID NO: 378725 - DNA, 25 bp, Homo sapien
gtcactctgggaagacagatagaca

SEQ ID NO: 378726 - DNA, 25 bp, Homo sapien
gatgcagtatagtcttaagggttct

SEQ ID NO: 378727 - DNA, 25 bp, Homo sapien
cttaagggttctgcatacattttag

SEQ ID NO: 378728 - DNA, 25 bp, Homo sapien
cttagccgtaagttaggtcctgtgt

SEQ ID NO: 378729 - DNA, 25 bp, Homo sapien
ggtcctgtgttaaactgtttagtgc

SEQ ID NO: 378730 - DNA, 25 bp, Homo sapien
aactgtttagtgctctgtttttaag

SEQ ID NO: 378731 - DNA, 25 bp, Homo sapien
aaacaaatgttgaacctcacacttt

SEQ ID NO: 378732 - DNA, 25 bp, Homo sapien
ggtgtaaatgttttcatctcttagg

SEQ ID NO: 378733 - DNA, 25 bp, Homo sapien
atctcttaggcttgctgtctcctaa

SEQ ID NO: 378734 - DNA, 25 bp, Homo sapien
tgtctcctaaggtcacccaagcagt

SEQ ID NO: 378735 - DNA, 25 bp, Homo sapien
tcacccaagcagtggttggatttta

SEQ ID NO: 378736 - DNA, 25 bp, Homo sapien
ggttggattttatacacattactac

SEQ ID NO: 378737 - DNA, 25 bp, Homo sapien
tgtccagtgtggatattctccccag

SEQ ID NO: 378738 - DNA, 25 bp, Homo sapien
ggatattctccccagaataatgctt

SEQ ID NO: 378739 - DNA, 25 bp, Homo sapien
ttttgcagtatgtatagcctgaaaa

SEQ ID NO: 378740 - DNA, 25 bp, Homo sapien
tttttctgtatcttcaagctctggt

SEQ ID NO: 378741 - DNA, 25 bp, Homo sapien
tatcttcaagctctggttccttttt

SEQ ID NO: 378742 - DNA, 25 bp, Homo sapien
ttgaatttatctctctcctctcaca

SEQ ID NO: 378743 - DNA, 25 bp, Homo sapien
ctctcctctcacattttcatattag

SEQ ID NO: 378744 - DNA, 25 bp, Homo sapien
atcaggctatggtttcaattctttg

SEQ ID NO: 378745 - DNA, 25 bp, Homo sapien
tctttggttagaaacttcctcaggt

SEQ ID NO: 378746 - DNA, 25 bp, Homo sapien
tgttgtttgcaagtcctatcttcca

SEQ ID NO: 378747 - DNA, 25 bp, Homo sapien
tgcaagtcctatcttccacaaaaca

SEQ ID NO: 378748 - DNA, 25 bp, Homo sapien
tgaagtacttatgggctgcacacac

SEQ ID NO: 378749 - DNA, 25 bp, Homo sapien
cacacacttcaaccttggcagataa

SEQ ID NO: 378750 - DNA, 25 bp, Homo sapien
aagttgggtactggctgtggatcat

SEQ ID NO: 378751 - DNA, 25 bp, Homo sapien
ggatcatttagctgcagtcctcttt

SEQ ID NO: 378752 - DNA, 25 bp, Homo sapien
cctctttcctacaaccttgattaga

SEQ ID NO: 378753 - DNA, 25 bp, Homo sapien
taagttccagaagggcatgccacca

SEQ ID NO: 378754 - DNA, 25 bp, Homo sapien
catgccaccacgaattcttcttaat

SEQ ID NO: 378755 - DNA, 25 bp, Homo sapien
ttaatactgatgtagcccctttcat

SEQ ID NO: 378756 - DNA, 25 bp, Homo sapien
tgtagcccctttcatcagtgacttt

SEQ ID NO: 378757 - DNA, 25 bp, Homo sapien
agtgactttactgcttttcagaatg

SEQ ID NO: 378758 - DNA, 25 bp, Homo sapien
tttcagaatgtagtcctggttcttc

SEQ ID NO: 378759 - DNA, 25 bp, Homo sapien
ctgcctcgccttgtgttacgatatt

SEQ ID NO: 378760 - DNA, 25 bp, Homo sapien
tgcctcgccttgtgttacgatattt

SEQ ID NO: 378761 - DNA, 25 bp, Homo sapien
gcctcgccttgtgttacgatatttc

SEQ ID NO: 378762 - DNA, 25 bp, Homo sapien
cctcgccttgtgttacgatatttcg

SEQ ID NO: 378763 - DNA, 25 bp, Homo sapien
ctcgccttgtgttacgatatttcgt

SEQ ID NO: 378764 - DNA, 25 bp, Homo sapien
tcgccttgtgttacgatatttcgtt

SEQ ID NO: 378765 - DNA, 25 bp, Homo sapien
gccttgtgttacgatatttcgtttg

SEQ ID NO: 378766 - DNA, 25 bp, Homo sapien
tcctggactggttatcttgttatta

SEQ ID NO: 378767 - DNA, 25 bp, Homo sapien
cctggactggttatcttgttattat

SEQ ID NO: 378768 - DNA, 25 bp, Homo sapien
ctggactggttatcttgttattatt

SEQ ID NO: 378769 - DNA, 25 bp, Homo sapien
gactggttatcttgttattattgtt

SEQ ID NO: 378770 - DNA, 25 bp, Homo sapien
gaaagggcttcagtcgaagctcatc

SEQ ID NO: 378771 - DNA, 25 bp, Homo sapien
aagggcttcagtcgaagctcatccc

SEQ ID NO: 378772 - DNA, 25 bp, Homo sapien
ttcagtcgaagctcatcccttatta

SEQ ID NO: 378773 - DNA, 25 bp, Homo sapien
tcagtcgaagctcatcccttattat

SEQ ID NO: 378774 - DNA, 25 bp, Homo sapien
gaaaagccttctgtcagagttcaac

SEQ ID NO: 378775 - DNA, 25 bp, Homo sapien
aaagccttctgtcagagttcaactc

SEQ ID NO: 378776 - DNA, 25 bp, Homo sapien
atactaaagagtaatatctgagctt

SEQ ID NO: 378777 - DNA, 25 bp, Homo sapien
atatctgagcttttattaatgttag

SEQ ID NO: 378778 - DNA, 25 bp, Homo sapien
gagcttttattaatgttagcataag

SEQ ID NO: 378779 - DNA, 25 bp, Homo sapien
gttagcataagaacacatataccta

SEQ ID NO: 378780 - DNA, 25 bp, Homo sapien
taagaacacatatacctaacctccc

SEQ ID NO: 378781 - DNA, 25 bp, Homo sapien
ctgctctggataacttgagacatga

SEQ ID NO: 378782 - DNA, 25 bp, Homo sapien
tgctctggataacttgagacatgac

SEQ ID NO: 378783 - DNA, 25 bp, Homo sapien
ggagccccagctgtgagaacctgcc

SEQ ID NO: 378784 - DNA, 25 bp, Homo sapien
tccttgaagaagtgacgtccctgag

SEQ ID NO: 378785 - DNA, 25 bp, Homo sapien
ccttgaagaagtgacgtccctgagc

SEQ ID NO: 378786 - DNA, 25 bp, Homo sapien
cttgaagaagtgacgtccctgagcc

SEQ ID NO: 378787 - DNA, 25 bp, Homo sapien
ttgaagaagtgacgtccctgagccc

SEQ ID NO: 378788 - DNA, 25 bp, Homo sapien
tgaagaagtgacgtccctgagcccc

SEQ ID NO: 378789 - DNA, 25 bp, Homo sapien
gaagaagtgacgtccctgagcccca

SEQ ID NO: 378790 - DNA, 25 bp, Homo sapien
aagaagtgacgtccctgagccccaa

SEQ ID NO: 378791 - DNA, 25 bp, Homo sapien
gaagtgacgtccctgagccccaaac

SEQ ID NO: 378792 - DNA, 25 bp, Homo sapien
ttgcagtgagcacgatcgtccattg

SEQ ID NO: 378793 - DNA, 25 bp, Homo sapien
gcagtgagcacgatcgtccattgca

SEQ ID NO: 378794 - DNA, 25 bp, Homo sapien
gtgagcacgatcgtccattgcactc

SEQ ID NO: 378795 - DNA, 25 bp, Homo sapien
acaacaaaactgtgattctccatct

SEQ ID NO: 378796 - DNA, 25 bp, Homo sapien
aacaaaactgtgattctccatctaa

SEQ ID NO: 378797 - DNA, 25 bp, Homo sapien
aaaactgtgattctccatctaactt

SEQ ID NO: 378798 - DNA, 25 bp, Homo sapien
aactgtgattctccatctaactttt

SEQ ID NO: 378799 - DNA, 25 bp, Homo sapien
ctttttacaattatcctttcacaat

SEQ ID NO: 378800 - DNA, 25 bp, Homo sapien
tatcctttcacaattcaagaaagtg

SEQ ID NO: 378801 - DNA, 25 bp, Homo sapien
gtgtgaatgcaagtcattactaaca

SEQ ID NO: 378802 - DNA, 25 bp, Homo sapien
aatgcaagtcattactaacagtatc

SEQ ID NO: 378803 - DNA, 25 bp, Homo sapien
tgaccctgtgggagtcagaagccat

SEQ ID NO: 378804 - DNA, 25 bp, Homo sapien
gacggaatagactcacattaggttt

SEQ ID NO: 378805 - DNA, 25 bp, Homo sapien
gtttgtgaaaactccatccagctaa

SEQ ID NO: 378806 - DNA, 25 bp, Homo sapien
atccagctaagcgatcttgaacaag

SEQ ID NO: 378807 - DNA, 25 bp, Homo sapien
ttgaacaagtcacaacctcccaggc

SEQ ID NO: 378808 - DNA, 25 bp, Homo sapien
aggctcctcatttgctagtcacgga

SEQ ID NO: 378809 - DNA, 25 bp, Homo sapien
tagtcacggacagtgattcctgcct

SEQ ID NO: 378810 - DNA, 25 bp, Homo sapien
gacaacgaatgtgaatcatgcttgc

SEQ ID NO: 378811 - DNA, 25 bp, Homo sapien
tcatgcttgcaggtttgagggcaca

SEQ ID NO: 378812 - DNA, 25 bp, Homo sapien
agggcacagtgtttgctaatgatgt

SEQ ID NO: 378813 - DNA, 25 bp, Homo sapien
tttatattatacattttcccaccat

SEQ ID NO: 378814 - DNA, 25 bp, Homo sapien
aaacgtattgtataatatgcccaga

SEQ ID NO: 378815 - DNA, 25 bp, Homo sapien
atgcccagaaaaatcatctgttcac

SEQ ID NO: 378816 - DNA, 25 bp, Homo sapien
gggactccaatgaaggattctcttt

SEQ ID NO: 378817 - DNA, 25 bp, Homo sapien
gaaggattctctttgtttagtaatt

SEQ ID NO: 378818 - DNA, 25 bp, Homo sapien
agccaaagcactcctggttaagact

SEQ ID NO: 378819 - DNA, 25 bp, Homo sapien
gaaaggttctgacagtaggcagctt

SEQ ID NO: 378820 - DNA, 25 bp, Homo sapien
gacagtaggcagctttgagtcaaaa

SEQ ID NO: 378821 - DNA, 25 bp, Homo sapien
gcactcctggttaagactcattttt

SEQ ID NO: 378822 - DNA, 25 bp, Homo sapien
ttttacacaaatggctctcctaggg

SEQ ID NO: 378823 - DNA, 25 bp, Homo sapien
ctcctagggccgtatgtattcaaag

SEQ ID NO: 378824 - DNA, 25 bp, Homo sapien
aagtaaatgcatctaaacgtattgt

SEQ ID NO: 378825 - DNA, 25 bp, Homo sapien
cacctggggatagtcttcaagaata

SEQ ID NO: 378826 - DNA, 25 bp, Homo sapien
gggatagtcttcaagaatagcagcc

SEQ ID NO: 378827 - DNA, 25 bp, Homo sapien
ggatagtcttcaagaatagcagcca

SEQ ID NO: 378828 - DNA, 25 bp, Homo sapien
gatagtcttcaagaatagcagccag

SEQ ID NO: 378829 - DNA, 25 bp, Homo sapien
atagtcttcaagaatagcagccagg

SEQ ID NO: 378830 - DNA, 25 bp, Homo sapien
tagtcttcaagaatagcagccaggc

SEQ ID NO: 378831 - DNA, 25 bp, Homo sapien
agtcttcaagaatagcagccaggca

SEQ ID NO: 378832 - DNA, 25 bp, Homo sapien
gtcttcaagaatagcagccaggcac

SEQ ID NO: 378833 - DNA, 25 bp, Homo sapien
tcttcaagaatagcagccaggcacg

SEQ ID NO: 378834 - DNA, 25 bp, Homo sapien
cttcaagaatagcagccaggcacgg

SEQ ID NO: 378835 - DNA, 25 bp, Homo sapien
ttcaagaatagcagccaggcacggt

SEQ ID NO: 378836 - DNA, 25 bp, Homo sapien
gatgtctgttggaaaacccaggact

SEQ ID NO: 378837 - DNA, 25 bp, Homo sapien
ggaaaacccaggactccacacacaa

SEQ ID NO: 378838 - DNA, 25 bp, Homo sapien
actcctgggattttgtttcccatct

SEQ ID NO: 378839 - DNA, 25 bp, Homo sapien
cccatctctttctaggtgtttgcaa

SEQ ID NO: 378840 - DNA, 25 bp, Homo sapien
acagctgtgctaatctcacatttag

SEQ ID NO: 378841 - DNA, 25 bp, Homo sapien
taatctcacatttagccatgataga

SEQ ID NO: 378842 - DNA, 25 bp, Homo sapien
gatgatggttctagagtgtacttcc

SEQ ID NO: 378843 - DNA, 25 bp, Homo sapien
gtacttccatttgtaagtcctcctg

SEQ ID NO: 378844 - DNA, 25 bp, Homo sapien
agtcctcctgataagtgctttcttg

SEQ ID NO: 378845 - DNA, 25 bp, Homo sapien
tgctttcttgtttatcactatgtaa

SEQ ID NO: 378846 - DNA, 25 bp, Homo sapien
tgagataaacattttgttcaccatt

SEQ ID NO: 378847 - DNA, 25 bp, Homo sapien
tcctggagcttcgagtctatggtat

SEQ ID NO: 378848 - DNA, 25 bp, Homo sapien
gagcttcgagtctatggtatgagtt

SEQ ID NO: 378849 - DNA, 25 bp, Homo sapien
tcgagtctatggtatgagttaaaca

SEQ ID NO: 378850 - DNA, 25 bp, Homo sapien
taaacagaagggtatctcctccatc

SEQ ID NO: 378851 - DNA, 25 bp, Homo sapien
acagaagggtatctcctccatcaga

SEQ ID NO: 378852 - DNA, 25 bp, Homo sapien
atctacaggagggtgtctgctccat

SEQ ID NO: 378853 - DNA, 25 bp, Homo sapien
gctccatcagacctggagcttccaa

SEQ ID NO: 378854 - DNA, 25 bp, Homo sapien
tgaagagctgaaccaggtccagaaa

SEQ ID NO: 378855 - DNA, 25 bp, Homo sapien
agaacccagcactactcccagaggc

SEQ ID NO: 378856 - DNA, 25 bp, Homo sapien
gcgctgcaaggctccgtgctcctgg

SEQ ID NO: 378857 - DNA, 25 bp, Homo sapien
gtgctcctggagcttcgagtctatg

SEQ ID NO: 378858 - DNA, 25 bp, Homo sapien
gcatgtaactcaatgtagtattaat

SEQ ID NO: 378859 - DNA, 25 bp, Homo sapien
atgttaggaaaattagtgatggcac

SEQ ID NO: 378860 - DNA, 25 bp, Homo sapien
gtgatggcacatttaaccaattgaa

SEQ ID NO: 378861 - DNA, 25 bp, Homo sapien
ttcagttctgaataccgtgatgcat

SEQ ID NO: 378862 - DNA, 25 bp, Homo sapien
tctgaataccgtgatgcatgttcaa

SEQ ID NO: 378863 - DNA, 25 bp, Homo sapien
aaatccaacaactttagcagtttgt

SEQ ID NO: 378864 - DNA, 25 bp, Homo sapien
ttagcagtttgtttaccagttattg

SEQ ID NO: 378865 - DNA, 25 bp, Homo sapien
ttaccagttattgagtaccaactgt

SEQ ID NO: 378866 - DNA, 25 bp, Homo sapien
gagtaccaactgtgttcaacattgt

SEQ ID NO: 378867 - DNA, 25 bp, Homo sapien
gtgttcaacattgttatttcactca

SEQ ID NO: 378868 - DNA, 25 bp, Homo sapien
gttatgatacggtcaataaaaccac

SEQ ID NO: 378869 - DNA, 25 bp, Homo sapien
tcttttaccacttttcttactctgt

SEQ ID NO: 378870 - DNA, 25 bp, Homo sapien
ccacttttcttactctgttatcttc

SEQ ID NO: 378871 - DNA, 25 bp, Homo sapien
ggagtatctaacctgcaaagatctt

SEQ ID NO: 378872 - DNA, 25 bp, Homo sapien
taattaaggctttggctttcgactt

SEQ ID NO: 378873 - DNA, 25 bp, Homo sapien
ggctttcgacttaaaagtctccata

SEQ ID NO: 378874 - DNA, 25 bp, Homo sapien
gtctccataaaggaacgctacgcat

SEQ ID NO: 378875 - DNA, 25 bp, Homo sapien
gaacgctacgcatcatcctgaaaat

SEQ ID NO: 378876 - DNA, 25 bp, Homo sapien
taaagatcaaagtccacagccagtg

SEQ ID NO: 378877 - DNA, 25 bp, Homo sapien
agagaatcagtcagcctagtttttt

SEQ ID NO: 378878 - DNA, 25 bp, Homo sapien
ttttttgaggaaatctgtgcacaga

SEQ ID NO: 378879 - DNA, 25 bp, Homo sapien
gcacagatcccaagtctacacataa

SEQ ID NO: 378880 - DNA, 25 bp, Homo sapien
tgagattcctgaagcctggcattga

SEQ ID NO: 378881 - DNA, 25 bp, Homo sapien
tcacacaggagccaacccattgcag

SEQ ID NO: 378882 - DNA, 25 bp, Homo sapien
aggagccaacccattgcagctgaac

SEQ ID NO: 378883 - DNA, 25 bp, Homo sapien
cagctgaacaagcagagaaactcag

SEQ ID NO: 378884 - DNA, 25 bp, Homo sapien
gaaactcagtctggaaaggcccctc

SEQ ID NO: 378885 - DNA, 25 bp, Homo sapien
tgaagcctggcattgactggtcccc

SEQ ID NO: 378886 - DNA, 25 bp, Homo sapien
accactcagggcaccactgtacagt

SEQ ID NO: 378887 - DNA, 25 bp, Homo sapien
agggcaccactgtacagtgcaacaa

SEQ ID NO: 378888 - DNA, 25 bp, Homo sapien
tacagtgcaacaagtcaggagacct

SEQ ID NO: 378889 - DNA, 25 bp, Homo sapien
tggcattgactggtcccctaagaac

SEQ ID NO: 378890 - DNA, 25 bp, Homo sapien
gactggtcccctaagaacagatgtt

SEQ ID NO: 378891 - DNA, 25 bp, Homo sapien
ttcattccttttctatacattaagg

SEQ ID NO: 378892 - DNA, 25 bp, Homo sapien
ccataataccatttttctcagtgtt

SEQ ID NO: 378893 - DNA, 25 bp, Homo sapien
cataataccatttttctcagtgttt

SEQ ID NO: 378894 - DNA, 25 bp, Homo sapien
ttttaaaagcaattacccataagag

SEQ ID NO: 378895 - DNA, 25 bp, Homo sapien
gcaattacccataagagaagctgaa

SEQ ID NO: 378896 - DNA, 25 bp, Homo sapien
attacccataagagaagctgaaaaa

SEQ ID NO: 378897 - DNA, 25 bp, Homo sapien
aaaggcatttctagaatgtggaagc

SEQ ID NO: 378898 - DNA, 25 bp, Homo sapien
gcatttctagaatgtggaagcatct

SEQ ID NO: 378899 - DNA, 25 bp, Homo sapien
ctatacattaaggtagatcagtcat

SEQ ID NO: 378900 - DNA, 25 bp, Homo sapien
tgacgaaaagttagatagctatagc

SEQ ID NO: 378901 - DNA, 25 bp, Homo sapien
ttataccttttggtttaatatagat

SEQ ID NO: 378902 - DNA, 25 bp, Homo sapien
taaccatgtgccaccgagagaccat

SEQ ID NO: 378903 - DNA, 25 bp, Homo sapien
tgtgccaccgagagaccatgatcaa

SEQ ID NO: 378904 - DNA, 25 bp, Homo sapien
gccaccgagagaccatgatcaaaaa

SEQ ID NO: 378905 - DNA, 25 bp, Homo sapien
actcggtggagtgcgctattcaggc

SEQ ID NO: 378906 - DNA, 25 bp, Homo sapien
gagaaggatattgcagctcatctta

SEQ ID NO: 378907 - DNA, 25 bp, Homo sapien
agaacaatcccacctggcattgtat

SEQ ID NO: 378908 - DNA, 25 bp, Homo sapien
gaacttcggtagttacatgacacgt

SEQ ID NO: 378909 - DNA, 25 bp, Homo sapien
tcggtagttacatgacacgtgaaat

SEQ ID NO: 378910 - DNA, 25 bp, Homo sapien
atgacacgtgaaatcaaacacttca

SEQ ID NO: 378911 - DNA, 25 bp, Homo sapien
aacacttcatctacttctacctgga

SEQ ID NO: 378912 - DNA, 25 bp, Homo sapien
acggtaaccatgtgccaccgagaga

SEQ ID NO: 378913 - DNA, 25 bp, Homo sapien
ttcacagtaacaggtgccacagcta

SEQ ID NO: 378914 - DNA, 25 bp, Homo sapien
aggtgccacagctacaagtactaat

SEQ ID NO: 378915 - DNA, 25 bp, Homo sapien
gtactaataatgcatcttctccctt

SEQ ID NO: 378916 - DNA, 25 bp, Homo sapien
ctcccctaactgagggtgtctgtgt

SEQ ID NO: 378917 - DNA, 25 bp, Homo sapien
taactgagggtgtctgtgtgtttgc

SEQ ID NO: 378918 - DNA, 25 bp, Homo sapien
tttgtttcctctttagcacccctct

SEQ ID NO: 378919 - DNA, 25 bp, Homo sapien
ccagttcaatgagtggccctgcagt

SEQ ID NO: 378920 - DNA, 25 bp, Homo sapien
tgcagtggacctcgctacagtgttc

SEQ ID NO: 378921 - DNA, 25 bp, Homo sapien
ggacctcgctacagtgttcacatgt

SEQ ID NO: 378922 - DNA, 25 bp, Homo sapien
cgctacagtgttcacatgtgctcct

SEQ ID NO: 378923 - DNA, 25 bp, Homo sapien
atgtgctccttagcactggtgctca

SEQ ID NO: 378924 - DNA, 25 bp, Homo sapien
gaaaatttattcttatgagacgtat

SEQ ID NO: 378925 - DNA, 25 bp, Homo sapien
tattcttatgagacgtatagtattc

SEQ ID NO: 378926 - DNA, 25 bp, Homo sapien
aatgcatgattgtacattatgtata

SEQ ID NO: 378927 - DNA, 25 bp, Homo sapien
ttatgtatagacgacaatgttttta

SEQ ID NO: 378928 - DNA, 25 bp, Homo sapien
gcatgggtttttctgcagcttattg

SEQ ID NO: 378929 - DNA, 25 bp, Homo sapien
gggtttttctgcagcttattgtgaa

SEQ ID NO: 378930 - DNA, 25 bp, Homo sapien
tctgcagcttattgtgaataccttg

SEQ ID NO: 378931 - DNA, 25 bp, Homo sapien
gcttattgtgaataccttggttctg

SEQ ID NO: 378932 - DNA, 25 bp, Homo sapien
attgtgaataccttggttctgttca

SEQ ID NO: 378933 - DNA, 25 bp, Homo sapien
gaataccttggttctgttcaataga

SEQ ID NO: 378934 - DNA, 25 bp, Homo sapien
accttggttctgttcaatagaaaca

SEQ ID NO: 378935 - DNA, 25 bp, Homo sapien
aagtgttagggctgttgtctcacca

SEQ ID NO: 378936 - DNA, 25 bp, Homo sapien
ttagggctgttgtctcaccaatgtc

SEQ ID NO: 378937 - DNA, 25 bp, Homo sapien
ggctgttgtctcaccaatgtcacta

SEQ ID NO: 378938 - DNA, 25 bp, Homo sapien
gttgtctcaccaatgtcactaccat

SEQ ID NO: 378939 - DNA, 25 bp, Homo sapien
ctcagggaggatacctgggccgggc

SEQ ID NO: 378940 - DNA, 25 bp, Homo sapien
tgagcccttgctgagggtgtaacct

SEQ ID NO: 378941 - DNA, 25 bp, Homo sapien
ctgagggtgtaacctccgctgcctg

SEQ ID NO: 378942 - DNA, 25 bp, Homo sapien
ctgggcctgggaatcaatcacatga

SEQ ID NO: 378943 - DNA, 25 bp, Homo sapien
cctgggaatcaatcacatgaggcac

SEQ ID NO: 378944 - DNA, 25 bp, Homo sapien
acatgaggcacttcagttcctggga

SEQ ID NO: 378945 - DNA, 25 bp, Homo sapien
ggcacttcagttcctgggaagtgtt

SEQ ID NO: 378946 - DNA, 25 bp, Homo sapien
gggtgcattcgtgggtcctattcat

SEQ ID NO: 378947 - DNA, 25 bp, Homo sapien
attcgtgggtcctattcatctctcg

SEQ ID NO: 378948 - DNA, 25 bp, Homo sapien
gtcctattcatctctcgtcagttaa

SEQ ID NO: 378949 - DNA, 25 bp, Homo sapien
atctctcgtcagttaatgtctctag

SEQ ID NO: 378950 - DNA, 25 bp, Homo sapien
caggaacccgtcgtgtgaggttggg

SEQ ID NO: 378951 - DNA, 25 bp, Homo sapien
gtcagttaatgtctctagtccttcc

SEQ ID NO: 378952 - DNA, 25 bp, Homo sapien
taatgtctctagtccttcctgtaaa

SEQ ID NO: 378953 - DNA, 25 bp, Homo sapien
gtctctagtccttcctgtaaaggtg

SEQ ID NO: 378954 - DNA, 25 bp, Homo sapien
tctagtccttcctgtaaaggtgaaa

SEQ ID NO: 378955 - DNA, 25 bp, Homo sapien
cacaaatcccagtgtctttttatgc

SEQ ID NO: 378956 - DNA, 25 bp, Homo sapien
cagtaaagccattctgatcacctca

SEQ ID NO: 378957 - DNA, 25 bp, Homo sapien
caggccggatccttttatcccgtgg

SEQ ID NO: 378958 - DNA, 25 bp, Homo sapien
cctgcctcggccatcgggatgaggt

SEQ ID NO: 378959 - DNA, 25 bp, Homo sapien
ggccatcgggatgaggtccctcaag

SEQ ID NO: 378960 - DNA, 25 bp, Homo sapien
tcgggatgaggtccctcaagtccct

SEQ ID NO: 378961 - DNA, 25 bp, Homo sapien
ctcaagtccctgcacaagcaggtca

SEQ ID NO: 378962 - DNA, 25 bp, Homo sapien
agacaggcgccctgagagctccgaa

SEQ ID NO: 378963 - DNA, 25 bp, Homo sapien
tgagagctccgaaggcgcgatcccc

SEQ ID NO: 378964 - DNA, 25 bp, Homo sapien
tggagaagccagaaccgcgattgtt

SEQ ID NO: 378965 - DNA, 25 bp, Homo sapien
agccagaaccgcgattgttgcatct

SEQ ID NO: 378966 - DNA, 25 bp, Homo sapien
gaaccgcgattgttgcatctgggaa

SEQ ID NO: 378967 - DNA, 25 bp, Homo sapien
cgattgttgcatctgggaaaaccca

SEQ ID NO: 378968 - DNA, 25 bp, Homo sapien
tggctgaaaacctggaggtcacaac

SEQ ID NO: 378969 - DNA, 25 bp, Homo sapien
ggaggtcacaacagtacaaagaatc

SEQ ID NO: 378970 - DNA, 25 bp, Homo sapien
agtcaagatcttgtgccagagagca

SEQ ID NO: 378971 - DNA, 25 bp, Homo sapien
aaatgaactcttcctcttgctgaga

SEQ ID NO: 378972 - DNA, 25 bp, Homo sapien
tcttgctgagaaaacccaccctgct

SEQ ID NO: 378973 - DNA, 25 bp, Homo sapien
taaaccctggccttgcctggtaatt

SEQ ID NO: 378974 - DNA, 25 bp, Homo sapien
tggccttgcctggtaattccatcca

SEQ ID NO: 378975 - DNA, 25 bp, Homo sapien
ggtaattccatccatgcgcctggaa

SEQ ID NO: 378976 - DNA, 25 bp, Homo sapien
gccctgcagtctgagctaccagatt

SEQ ID NO: 378977 - DNA, 25 bp, Homo sapien
gtctgagctaccagattccttgtga

SEQ ID NO: 378978 - DNA, 25 bp, Homo sapien
atttgaggaccatgactcacccaac

SEQ ID NO: 378979 - DNA, 25 bp, Homo sapien
gcgcccggctgtgcgtctgcacatt

SEQ ID NO: 378980 - DNA, 25 bp, Homo sapien
gcgtctgcacattgcaaattcactt

SEQ ID NO: 378981 - DNA, 25 bp, Homo sapien
acttatttgttcttgattttcccag

SEQ ID NO: 378982 - DNA, 25 bp, Homo sapien
gattttcccagaattgttttattct

SEQ ID NO: 378983 - DNA, 25 bp, Homo sapien
tttattctgtaagggacagggtctc

SEQ ID NO: 378984 - DNA, 25 bp, Homo sapien
catgatcatagcctgctgtaatctc

SEQ ID NO: 378985 - DNA, 25 bp, Homo sapien
gatcatagcctgctgtaatctctaa

SEQ ID NO: 378986 - DNA, 25 bp, Homo sapien
catagcctgctgtaatctctaactc

SEQ ID NO: 378987 - DNA, 25 bp, Homo sapien
tagcctgctgtaatctctaactcct

SEQ ID NO: 378988 - DNA, 25 bp, Homo sapien
gcagaggttgtttgcagtccagcct

SEQ ID NO: 378989 - DNA, 25 bp, Homo sapien
cagaggttgtttgcagtccagcctg

SEQ ID NO: 378990 - DNA, 25 bp, Homo sapien
aaaaatggacctgagagtaccctct

SEQ ID NO: 378991 - DNA, 25 bp, Homo sapien
gacctgagagtaccctctcgaggga

SEQ ID NO: 378992 - DNA, 25 bp, Homo sapien
accctctcgagggatgatcaagaat

SEQ ID NO: 378993 - DNA, 25 bp, Homo sapien
gagacagttggaggtgtgctcatta

SEQ ID NO: 378994 - DNA, 25 bp, Homo sapien
ggaggtgtgctcattaagattcaaa

SEQ ID NO: 378995 - DNA, 25 bp, Homo sapien
gagcagattataacctgtggccaaa

SEQ ID NO: 378996 - DNA, 25 bp, Homo sapien
tatacaatcattggaggctggtaaa

SEQ ID NO: 378997 - DNA, 25 bp, Homo sapien
ggctggtaaagctccctaatatgtt

SEQ ID NO: 378998 - DNA, 25 bp, Homo sapien
aaagctccctaatatgttgccacca

SEQ ID NO: 378999 - DNA, 25 bp, Homo sapien
ctccctaatatgttgccaccattat

SEQ ID NO: 379000 - DNA, 25 bp, Homo sapien
gaagattgtgtggtgatctacgaaa

SEQ ID NO: 379001 - DNA, 25 bp, Homo sapien
agtaacatctcatctcagaacagag

SEQ ID NO: 379002 - DNA, 25 bp, Homo sapien
tcagaacagagctgtgaccacatgc

SEQ ID NO: 379003 - DNA, 25 bp, Homo sapien
gaccacatgccaatatatgtgtcac

SEQ ID NO: 379004 - DNA, 25 bp, Homo sapien
tgtgtcacaaagtctacatatgtta

SEQ ID NO: 379005 - DNA, 25 bp, Homo sapien
acatatgttacattccttggaagtc

SEQ ID NO: 379006 - DNA, 25 bp, Homo sapien
attccttggaagtctccttaaatgt

SEQ ID NO: 379007 - DNA, 25 bp, Homo sapien
gtcaacaagcttgttttgttattga

SEQ ID NO: 379008 - DNA, 25 bp, Homo sapien
gatatttccgagattgggcacattt

SEQ ID NO: 379009 - DNA, 25 bp, Homo sapien
gattgggcacatttaagacagtaaa

SEQ ID NO: 379010 - DNA, 25 bp, Homo sapien
gatgctataagaagatgctgtatct

SEQ ID NO: 379011 - DNA, 25 bp, Homo sapien
agatgctgtatcttgagaattgaaa

SEQ ID NO: 379012 - DNA, 25 bp, Homo sapien
cttccatgctcccaactcccttctg

SEQ ID NO: 379013 - DNA, 25 bp, Homo sapien
ttctgcttgtcccaaatccgccagt

SEQ ID NO: 379014 - DNA, 25 bp, Homo sapien
tctgcttgtcccaaatccgccagtg

SEQ ID NO: 379015 - DNA, 25 bp, Homo sapien
ctgcttgtcccaaatccgccagtgt

SEQ ID NO: 379016 - DNA, 25 bp, Homo sapien
tgcttgtcccaaatccgccagtgtt

SEQ ID NO: 379017 - DNA, 25 bp, Homo sapien
gcttgtcccaaatccgccagtgttt

SEQ ID NO: 379018 - DNA, 25 bp, Homo sapien
cttgtcccaaatccgccagtgtttc

SEQ ID NO: 379019 - DNA, 25 bp, Homo sapien
ttgtcccaaatccgccagtgtttct

SEQ ID NO: 379020 - DNA, 25 bp, Homo sapien
tcccaaatccgccagtgtttctgaa

SEQ ID NO: 379021 - DNA, 25 bp, Homo sapien
cccaaatccgccagtgtttctgaat

SEQ ID NO: 379022 - DNA, 25 bp, Homo sapien
ccaaatccgccagtgtttctgaatg

SEQ ID NO: 379023 - DNA, 25 bp, Homo sapien
cctggatcttgcactgtgggccctg

SEQ ID NO: 379024 - DNA, 25 bp, Homo sapien
actgtgggccctgtggctactctga

SEQ ID NO: 379025 - DNA, 25 bp, Homo sapien
gctactctgatctggctgctctgga

SEQ ID NO: 379026 - DNA, 25 bp, Homo sapien
gtttgtttgaatgtgggaccaagca

SEQ ID NO: 379027 - DNA, 25 bp, Homo sapien
gagtgtgagcagattgccttccgcc

SEQ ID NO: 379028 - DNA, 25 bp, Homo sapien
ttccgcctgtttacacaccgggaga

SEQ ID NO: 379029 - DNA, 25 bp, Homo sapien
accgggagatcctgagtcacctgca

SEQ ID NO: 379030 - DNA, 25 bp, Homo sapien
gggactgcaccagccctggtaggaa

SEQ ID NO: 379031 - DNA, 25 bp, Homo sapien
tggtaggaacccaagccaattcaaa

SEQ ID NO: 379032 - DNA, 25 bp, Homo sapien
ggcttaggacccaatttccatagat

SEQ ID NO: 379033 - DNA, 25 bp, Homo sapien
tgcaaatggcagttacagacaggtt

SEQ ID NO: 379034 - DNA, 25 bp, Homo sapien
ctagtctaagaccataacgggcaga

SEQ ID NO: 379035 - DNA, 25 bp, Homo sapien
aagcataagaggttccagggccata

SEQ ID NO: 379036 - DNA, 25 bp, Homo sapien
tagggcacatatagggaggaaagaa

SEQ ID NO: 379037 - DNA, 25 bp, Homo sapien
taggcagacctaaatcaagcagctt

SEQ ID NO: 379038 - DNA, 25 bp, Homo sapien
ctctgaatttttttactgctgggaa

SEQ ID NO: 379039 - DNA, 25 bp, Homo sapien
tactgctgggaaaagtgtactacat

SEQ ID NO: 379040 - DNA, 25 bp, Homo sapien
aatcaagcagcttaccacaatagtg

SEQ ID NO: 379041 - DNA, 25 bp, Homo sapien
agcttaccacaatagtgcatgctga

SEQ ID NO: 379042 - DNA, 25 bp, Homo sapien
gtgcatgctgagtagattagttcca

SEQ ID NO: 379043 - DNA, 25 bp, Homo sapien
actggaatgctggtgtcaaggaaaa

SEQ ID NO: 379044 - DNA, 25 bp, Homo sapien
ctggtgtcaaggaaaagcctccctc

SEQ ID NO: 379045 - DNA, 25 bp, Homo sapien
gaagtgacaattccactcagtctat

SEQ ID NO: 379046 - DNA, 25 bp, Homo sapien
cactcagtctattagaggtctggat

SEQ ID NO: 379047 - DNA, 25 bp, Homo sapien
ggtagccacacaataactctaactt

SEQ ID NO: 379048 - DNA, 25 bp, Homo sapien
aactctaacttgacttctaaccatt

SEQ ID NO: 379049 - DNA, 25 bp, Homo sapien
gacttctaaccattctatcttattg

SEQ ID NO: 379050 - DNA, 25 bp, Homo sapien
tcttattgatttggaggctgtcttc

SEQ ID NO: 379051 - DNA, 25 bp, Homo sapien
gaggctgtcttctgccagatttttt

SEQ ID NO: 379052 - DNA, 25 bp, Homo sapien
cagattttttgtggcttgagatgat

SEQ ID NO: 379053 - DNA, 25 bp, Homo sapien
tgagatgatattttcgaacccttct

SEQ ID NO: 379054 - DNA, 25 bp, Homo sapien
ttcactacctttcttacccttaatg

SEQ ID NO: 379055 - DNA, 25 bp, Homo sapien
ttacccttaatgtgccaagcttgaa

SEQ ID NO: 379056 - DNA, 25 bp, Homo sapien
ctgtctttatcaatcattcgtctgt

SEQ ID NO: 379057 - DNA, 25 bp, Homo sapien
aatcattcgtctgtaatctatctgt

SEQ ID NO: 379058 - DNA, 25 bp, Homo sapien
gtaatctatctgtgccgtttggcat

SEQ ID NO: 379059 - DNA, 25 bp, Homo sapien
agaagggcatagcagtggaaactca

SEQ ID NO: 379060 - DNA, 25 bp, Homo sapien
ggagttacctccatgtgaatggaca

SEQ ID NO: 379061 - DNA, 25 bp, Homo sapien
agaagagagcatgccctaactcagg

SEQ ID NO: 379062 - DNA, 25 bp, Homo sapien
cctaactcagggaccttgtccagca

SEQ ID NO: 379063 - DNA, 25 bp, Homo sapien
aggcactctggccttgttatactgt

SEQ ID NO: 379064 - DNA, 25 bp, Homo sapien
attctgctttcatctaaattcatct

SEQ ID NO: 379065 - DNA, 25 bp, Homo sapien
aaattcatcttatctatctattgtt

SEQ ID NO: 379066 - DNA, 25 bp, Homo sapien
tcagtccatttttatctatcatcta

SEQ ID NO: 379067 - DNA, 25 bp, Homo sapien
ggcaaccagcatcagcttttcctga

SEQ ID NO: 379068 - DNA, 25 bp, Homo sapien
ccagcatcagcttttcctgagatca

SEQ ID NO: 379069 - DNA, 25 bp, Homo sapien
gagatcacacacagcattgcagtgg

SEQ ID NO: 379070 - DNA, 25 bp, Homo sapien
agacatgggttctgtttgttcttat

SEQ ID NO: 379071 - DNA, 25 bp, Homo sapien
gtttgttcttatggacttcccttca

SEQ ID NO: 379072 - DNA, 25 bp, Homo sapien
tatggacttcccttcatccttgctg

SEQ ID NO: 379073 - DNA, 25 bp, Homo sapien
ttgctgcattcacagtcgacctaca

SEQ ID NO: 379074 - DNA, 25 bp, Homo sapien
attcacagtcgacctacagtgactt

SEQ ID NO: 379075 - DNA, 25 bp, Homo sapien
tacagtgacttcaggcccagaacca

SEQ ID NO: 379076 - DNA, 25 bp, Homo sapien
agaaccagatgcagagggaacagcc

SEQ ID NO: 379077 - DNA, 25 bp, Homo sapien
agagggaacagcctggcctagactt

SEQ ID NO: 379078 - DNA, 25 bp, Homo sapien
ctctgctcagtgttaaggtctagcc

SEQ ID NO: 379079 - DNA, 25 bp, Homo sapien
gctcagtgttaaggtctagccacag

SEQ ID NO: 379080 - DNA, 25 bp, Homo sapien
agtgttaaggtctagccacagacac

SEQ ID NO: 379081 - DNA, 25 bp, Homo sapien
gggcctgcatgggttgtgtcctggg

SEQ ID NO: 379082 - DNA, 25 bp, Homo sapien
atggctgggaagaatctccaggtct

SEQ ID NO: 379083 - DNA, 25 bp, Homo sapien
tctccaggtctgtggcccttgtgtt

SEQ ID NO: 379084 - DNA, 25 bp, Homo sapien
ctgtggcccttgtgttgagtgatta

SEQ ID NO: 379085 - DNA, 25 bp, Homo sapien
ggcccttgtgttgagtgattatttt

SEQ ID NO: 379086 - DNA, 25 bp, Homo sapien
gattattttgtgacactctcattcc

SEQ ID NO: 379087 - DNA, 25 bp, Homo sapien
ttttgtgacactctcattcctggac

SEQ ID NO: 379088 - DNA, 25 bp, Homo sapien
taggaggccattaaaggtcttttgt

SEQ ID NO: 379089 - DNA, 25 bp, Homo sapien
gagcatggctttaaaatcaaacaga

SEQ ID NO: 379090 - DNA, 25 bp, Homo sapien
gacacgagtttgtctatttggactt

SEQ ID NO: 379091 - DNA, 25 bp, Homo sapien
tctatttggacttatttttcttatg

SEQ ID NO: 379092 - DNA, 25 bp, Homo sapien
ttttcttatgacttagcaggtaatt

SEQ ID NO: 379093 - DNA, 25 bp, Homo sapien
gtaattactacctgcttggaagtgc

SEQ ID NO: 379094 - DNA, 25 bp, Homo sapien
tactacctgcttggaagtgcaccaa

SEQ ID NO: 379095 - DNA, 25 bp, Homo sapien
cttggaagtgcaccaagcactatat

SEQ ID NO: 379096 - DNA, 25 bp, Homo sapien
agcactatataggtactgcctcatt

SEQ ID NO: 379097 - DNA, 25 bp, Homo sapien
ggtactgcctcattacatattcaca

SEQ ID NO: 379098 - DNA, 25 bp, Homo sapien
tgcctcattacatattcacaaaact

SEQ ID NO: 379099 - DNA, 25 bp, Homo sapien
cacaaaactctataggtattttaca

SEQ ID NO: 379100 - DNA, 25 bp, Homo sapien
ccttgttccttgttaatgcctattg

SEQ ID NO: 379101 - DNA, 25 bp, Homo sapien
ttgaatctatatgaacctgtacgtg

SEQ ID NO: 379102 - DNA, 25 bp, Homo sapien
aacctgtacgtgtgtttctcactgt

SEQ ID NO: 379103 - DNA, 25 bp, Homo sapien
ttgcatgttttatctttcccactag

SEQ ID NO: 379104 - DNA, 25 bp, Homo sapien
ctatgcaatattttctggcctctgt

SEQ ID NO: 379105 - DNA, 25 bp, Homo sapien
gaaagctaggactatcttttttgtc

SEQ ID NO: 379106 - DNA, 25 bp, Homo sapien
gtgtaatttttgcatcacaagctat

SEQ ID NO: 379107 - DNA, 25 bp, Homo sapien
ttctggcctctgtgaacaacttgta

SEQ ID NO: 379108 - DNA, 25 bp, Homo sapien
gtgaacaacttgtagttccttgaga

SEQ ID NO: 379109 - DNA, 25 bp, Homo sapien
gttccttgagatttctattatcact

SEQ ID NO: 379110 - DNA, 25 bp, Homo sapien
tgcaattgaaatgcccttgttcctt

SEQ ID NO: 379111 - DNA, 25 bp, Homo sapien
ggattgctttctccaattaaggcct

SEQ ID NO: 379112 - DNA, 25 bp, Homo sapien
aattaaggcctttccatcagctctc

SEQ ID NO: 379113 - DNA, 25 bp, Homo sapien
atcagctctctgctttttcaaagcg

SEQ ID NO: 379114 - DNA, 25 bp, Homo sapien
ggattagtgggttatcttttccaag

SEQ ID NO: 379115 - DNA, 25 bp, Homo sapien
cttttccaaggaacaggtttgcact

SEQ ID NO: 379116 - DNA, 25 bp, Homo sapien
aagtgcctaaagtgtgcccattaat

SEQ ID NO: 379117 - DNA, 25 bp, Homo sapien
ggctcataagccttttggtaacact

SEQ ID NO: 379118 - DNA, 25 bp, Homo sapien
gtagtatcatataggcaagctctcc

SEQ ID NO: 379119 - DNA, 25 bp, Homo sapien
taggcaagctctccttataagtaag

SEQ ID NO: 379120 - DNA, 25 bp, Homo sapien
aaacagacatcctgctttaacaatt

SEQ ID NO: 379121 - DNA, 25 bp, Homo sapien
caatttgtaagatgactgtgcagta

SEQ ID NO: 379122 - DNA, 25 bp, Homo sapien
aagaacagcttagcttcttaatgtg

SEQ ID NO: 379123 - DNA, 25 bp, Homo sapien
gtagaatgccctaggtgaatccctc

SEQ ID NO: 379124 - DNA, 25 bp, Homo sapien
ttgaggctgctaaaagctttccttt

SEQ ID NO: 379125 - DNA, 25 bp, Homo sapien
ttttttctgtgccagttctcgctgc

SEQ ID NO: 379126 - DNA, 25 bp, Homo sapien
tctcgctgcctcattggttgagatg

SEQ ID NO: 379127 - DNA, 25 bp, Homo sapien
gatgtcttttttgatgtcctcttta

SEQ ID NO: 379128 - DNA, 25 bp, Homo sapien
ggtgaatccctccagtcttccagta

SEQ ID NO: 379129 - DNA, 25 bp, Homo sapien
tagagagtgttatcctcaccttttt

SEQ ID NO: 379130 - DNA, 25 bp, Homo sapien
gttatcctcacctttttgcatagtc

SEQ ID NO: 379131 - DNA, 25 bp, Homo sapien
actcctctctctgatgacacatgaa

SEQ ID NO: 379132 - DNA, 25 bp, Homo sapien
tatgcttttgcacacttcaggcaac

SEQ ID NO: 379133 - DNA, 25 bp, Homo sapien
gattgctcacagaaagcaccattta

SEQ ID NO: 379134 - DNA, 25 bp, Homo sapien
attctttagcagtgtccccaataag

SEQ ID NO: 379135 - DNA, 25 bp, Homo sapien
agcagtgtccccaataagaacttgt

SEQ ID NO: 379136 - DNA, 25 bp, Homo sapien
gtgtccccaataagaacttgtaagg

SEQ ID NO: 379137 - DNA, 25 bp, Homo sapien
tagtaattggattttccagtgactc

SEQ ID NO: 379138 - DNA, 25 bp, Homo sapien
attggcttgattctttggagagatc

SEQ ID NO: 379139 - DNA, 25 bp, Homo sapien
gattctttggagagatcacagtgat

SEQ ID NO: 379140 - DNA, 25 bp, Homo sapien
gtgtaaatatcgctttggtggccaa

SEQ ID NO: 379141 - DNA, 25 bp, Homo sapien
tatcgctttggtggccaatggaaat

SEQ ID NO: 379142 - DNA, 25 bp, Homo sapien
caatggaaatacttcgttaagaaat

SEQ ID NO: 379143 - DNA, 25 bp, Homo sapien
tgacacatcaaagattgctcacaga

SEQ ID NO: 379144 - DNA, 25 bp, Homo sapien
ggatactattaaatttgctttgaaa

SEQ ID NO: 379145 - DNA, 25 bp, Homo sapien
gtttttcatgagcaggtcaataaga

SEQ ID NO: 379146 - DNA, 25 bp, Homo sapien
gggtagtacctacgataatgcagta

SEQ ID NO: 379147 - DNA, 25 bp, Homo sapien
caaatgcccagagcttaagattgat

SEQ ID NO: 379148 - DNA, 25 bp, Homo sapien
agattgattattccctcttcagtgt

SEQ ID NO: 379149 - DNA, 25 bp, Homo sapien
tattccctcttcagtgttgcctaga

SEQ ID NO: 379150 - DNA, 25 bp, Homo sapien
cagtgttgcctagagcagtgggtaa

SEQ ID NO: 379151 - DNA, 25 bp, Homo sapien
tagagcagtgggtaatagcattaac

SEQ ID NO: 379152 - DNA, 25 bp, Homo sapien
gataatgcagtatgcccctgaatta

SEQ ID NO: 379153 - DNA, 25 bp, Homo sapien
tgaattaccccacaagattttccct

SEQ ID NO: 379154 - DNA, 25 bp, Homo sapien
gtgaagattacttaactcagtttag

SEQ ID NO: 379155 - DNA, 25 bp, Homo sapien
taatctgggcaaaaccctgcaggct

SEQ ID NO: 379156 - DNA, 25 bp, Homo sapien
aaccctgcaggctttatcctgggaa

SEQ ID NO: 379157 - DNA, 25 bp, Homo sapien
tttttcccaagcaaagccaaatagc

SEQ ID NO: 379158 - DNA, 25 bp, Homo sapien
gaatcagtagcctggaagtcactgc

SEQ ID NO: 379159 - DNA, 25 bp, Homo sapien
gtcactgcagaagttttacctgtgg

SEQ ID NO: 379160 - DNA, 25 bp, Homo sapien
ttacctgtgggaggctatgggaacc

SEQ ID NO: 379161 - DNA, 25 bp, Homo sapien
atgggaaccctcttgtgtcatgtgc

SEQ ID NO: 379162 - DNA, 25 bp, Homo sapien
ttgtgtcatgtgctctcaaatgtga

SEQ ID NO: 379163 - DNA, 25 bp, Homo sapien
gaatgagcgggccaagaactaagaa

SEQ ID NO: 379164 - DNA, 25 bp, Homo sapien
gcattcaatgagagttcactttggt

SEQ ID NO: 379165 - DNA, 25 bp, Homo sapien
aaatctaactcagatagaggcctca

SEQ ID NO: 379166 - DNA, 25 bp, Homo sapien
ggagactttcacaagtggtttccat

SEQ ID NO: 379167 - DNA, 25 bp, Homo sapien
ctttcacaagtggtttccatggaga

SEQ ID NO: 379168 - DNA, 25 bp, Homo sapien
agcattctgtggtcaagtaagttta

SEQ ID NO: 379169 - DNA, 25 bp, Homo sapien
tagggagctattcatgtttcacttg

SEQ ID NO: 379170 - DNA, 25 bp, Homo sapien
gtttcacttgctttgtggagattca

SEQ ID NO: 379171 - DNA, 25 bp, Homo sapien
tggagattcacactatgcactggga

SEQ ID NO: 379172 - DNA, 25 bp, Homo sapien
gaacactgtttatcaatgtcatttg

SEQ ID NO: 379173 - DNA, 25 bp, Homo sapien
atcaatgtcatttggctatagaaac

SEQ ID NO: 379174 - DNA, 25 bp, Homo sapien
ggctatagaaacattttctcctgct

SEQ ID NO: 379175 - DNA, 25 bp, Homo sapien
attttctcctgctgattgtgtgtgt

SEQ ID NO: 379176 - DNA, 25 bp, Homo sapien
ttaacattccaatgaactagcattt

SEQ ID NO: 379177 - DNA, 25 bp, Homo sapien
agaaatcttagggaccagatggaag

SEQ ID NO: 379178 - DNA, 25 bp, Homo sapien
accagatggaagagggcctgtgtat

SEQ ID NO: 379179 - DNA, 25 bp, Homo sapien
gggcctgtgtataaagacattagga

SEQ ID NO: 379180 - DNA, 25 bp, Homo sapien
gcagcctgacttgtctccagagaaa

SEQ ID NO: 379181 - DNA, 25 bp, Homo sapien
ttgacttagcaaccaagggacactg

SEQ ID NO: 379182 - DNA, 25 bp, Homo sapien
agcaaccaagggacactgggtcaaa

SEQ ID NO: 379183 - DNA, 25 bp, Homo sapien
gacactgggtcaaagacgaggaatc

SEQ ID NO: 379184 - DNA, 25 bp, Homo sapien
cgaggaatcaggacgtcggtgccta

SEQ ID NO: 379185 - DNA, 25 bp, Homo sapien
tcggtgcctagtgactgagcgccag

SEQ ID NO: 379186 - DNA, 25 bp, Homo sapien
atttctctacattgccatgggctaa

SEQ ID NO: 379187 - DNA, 25 bp, Homo sapien
atgggctaaacccagtgtgctgtaa

SEQ ID NO: 379188 - DNA, 25 bp, Homo sapien
gagagtgtcctcatgtgactgaagt

SEQ ID NO: 379189 - DNA, 25 bp, Homo sapien
agtatgtgctactcttcttaattga

SEQ ID NO: 379190 - DNA, 25 bp, Homo sapien
gaataaccccagaatctccagaatt

SEQ ID NO: 379191 - DNA, 25 bp, Homo sapien
tatacagccctgttttttgaccgtt

SEQ ID NO: 379192 - DNA, 25 bp, Homo sapien
ttgaccgttcattttgtccttggag

SEQ ID NO: 379193 - DNA, 25 bp, Homo sapien
attttgtccttggagtcactaccac

SEQ ID NO: 379194 - DNA, 25 bp, Homo sapien
gagtcactaccacttggcctcaaag

SEQ ID NO: 379195 - DNA, 25 bp, Homo sapien
cttggcctcaaagtgtgaacatgta

SEQ ID NO: 379196 - DNA, 25 bp, Homo sapien
gtgaacatgtaaccctttccttaat

SEQ ID NO: 379197 - DNA, 25 bp, Homo sapien
aatttggatcctttgtcagtacaac

SEQ ID NO: 379198 - DNA, 25 bp, Homo sapien
gaacaatttcaatggcttagggtaa

SEQ ID NO: 379199 - DNA, 25 bp, Homo sapien
atttccaaacttcataatttgctag

SEQ ID NO: 379200 - DNA, 25 bp, Homo sapien
tcataatttgctagtagtgctaact

SEQ ID NO: 379201 - DNA, 25 bp, Homo sapien
gtgctaactaaaattttacaccagg

SEQ ID NO: 379202 - DNA, 25 bp, Homo sapien
ttttacaccaggtaaaatcaggtca

SEQ ID NO: 379203 - DNA, 25 bp, Homo sapien
gtattgacttcattgttggacttca

SEQ ID NO: 379204 - DNA, 25 bp, Homo sapien
gacttcattgttggacttcatactc

SEQ ID NO: 379205 - DNA, 25 bp, Homo sapien
gttggacttcatactctgatgggaa

SEQ ID NO: 379206 - DNA, 25 bp, Homo sapien
gacttcatactctgatgggaaagaa

SEQ ID NO: 379207 - DNA, 25 bp, Homo sapien
atgtgtcaggtgcataatatcctaa

SEQ ID NO: 379208 - DNA, 25 bp, Homo sapien
aatatcctaatttatgcttgtcaga

SEQ ID NO: 379209 - DNA, 25 bp, Homo sapien
gtatatactacaacaaatttccaaa

SEQ ID NO: 379210 - DNA, 25 bp, Homo sapien
gttttccctaaatgatactaggaca

SEQ ID NO: 379211 - DNA, 25 bp, Homo sapien
gatggaaaagccaaaggttctccta

SEQ ID NO: 379212 - DNA, 25 bp, Homo sapien
aaggttctcctaccgaaacacagtg

SEQ ID NO: 379213 - DNA, 25 bp, Homo sapien
gttctcctaccgaaacacagtgttt

SEQ ID NO: 379214 - DNA, 25 bp, Homo sapien
acaagatgaatgtcacgctgagaga

SEQ ID NO: 379215 - DNA, 25 bp, Homo sapien
gtcacgctgagagatagaacatcta

SEQ ID NO: 379216 - DNA, 25 bp, Homo sapien
gatactaggacaattggctctccat

SEQ ID NO: 379217 - DNA, 25 bp, Homo sapien
gagttcttacaaattgattacagga

SEQ ID NO: 379218 - DNA, 25 bp, Homo sapien
ggacaattggctctccatttggagg

SEQ ID NO: 379219 - DNA, 25 bp, Homo sapien
gatatgtatcttatagacaactata

SEQ ID NO: 379220 - DNA, 25 bp, Homo sapien
agacaactataatttctaggtgaat

SEQ ID NO: 379221 - DNA, 25 bp, Homo sapien
agttggagtaggagactttcacaag

SEQ ID NO: 379222 - DNA, 25 bp, Homo sapien
agcattctgtggtcaagtaagttta

SEQ ID NO: 379223 - DNA, 25 bp, Homo sapien
ctgtggtcaagtaagtttagggagc

SEQ ID NO: 379224 - DNA, 25 bp, Homo sapien
tttagggagctattcatgtttcact

SEQ ID NO: 379225 - DNA, 25 bp, Homo sapien
agggagctattcatgtttcacttgc

SEQ ID NO: 379226 - DNA, 25 bp, Homo sapien
ggagctattcatgtttcacttgctt

SEQ ID NO: 379227 - DNA, 25 bp, Homo sapien
gctattcatgtttcacttgctttgt

SEQ ID NO: 379228 - DNA, 25 bp, Homo sapien
attcatgtttcacttgctttgtgga

SEQ ID NO: 379229 - DNA, 25 bp, Homo sapien
catgtttcacttgctttgtggagat

SEQ ID NO: 379230 - DNA, 25 bp, Homo sapien
gtttcacttgctttgtggagattca

SEQ ID NO: 379231 - DNA, 25 bp, Homo sapien
ttaactttgtgtaagaacactgttt

SEQ ID NO: 379232 - DNA, 25 bp, Homo sapien
ggctgcactgaaccattatgtctga

SEQ ID NO: 379233 - DNA, 25 bp, Homo sapien
gaaccattatgtctgattgctgcac

SEQ ID NO: 379234 - DNA, 25 bp, Homo sapien
accattatgtctgattgctgcactt

SEQ ID NO: 379235 - DNA, 25 bp, Homo sapien
tgcactttcatctctgtgcctcgat

SEQ ID NO: 379236 - DNA, 25 bp, Homo sapien
tcatctctgtgcctcgattcgggaa

SEQ ID NO: 379237 - DNA, 25 bp, Homo sapien
atctctgtgcctcgattcgggaatg

SEQ ID NO: 379238 - DNA, 25 bp, Homo sapien
tctgtgcctcgattcgggaatgggc

SEQ ID NO: 379239 - DNA, 25 bp, Homo sapien
gcctcgattcgggaatgggcagtaa

SEQ ID NO: 379240 - DNA, 25 bp, Homo sapien
cgattcgggaatgggcagtaatact

SEQ ID NO: 379241 - DNA, 25 bp, Homo sapien
ggcagtaatactgacacactcggga

SEQ ID NO: 379242 - DNA, 25 bp, Homo sapien
gtaatactgacacactcgggactcc

SEQ ID NO: 379243 - DNA, 25 bp, Homo sapien
catcattatggatacatgcagggtt

SEQ ID NO: 379244 - DNA, 25 bp, Homo sapien
ttgatgatcttgatataacccctga

SEQ ID NO: 379245 - DNA, 25 bp, Homo sapien
gatataacccctgattttaaagaca

SEQ ID NO: 379246 - DNA, 25 bp, Homo sapien
aaaagatgaagccactatccccagg

SEQ ID NO: 379247 - DNA, 25 bp, Homo sapien
agctagtcagctgcagacccaagtc

SEQ ID NO: 379248 - DNA, 25 bp, Homo sapien
gacccaagtctgtaaaactatatgc

SEQ ID NO: 379249 - DNA, 25 bp, Homo sapien
aactatatgctgtgctttttccgcc

SEQ ID NO: 379250 - DNA, 25 bp, Homo sapien
acacttacacaccttctctgttttt

SEQ ID NO: 379251 - DNA, 25 bp, Homo sapien
ctgtttttctctcttcggtggcttt

SEQ ID NO: 379252 - DNA, 25 bp, Homo sapien
tctctcttcggtggctttcgaagga

SEQ ID NO: 379253 - DNA, 25 bp, Homo sapien
aataaagtgagttcaatgggcttct

SEQ ID NO: 379254 - DNA, 25 bp, Homo sapien
ttcctgccatgccagtgttctaagt

SEQ ID NO: 379255 - DNA, 25 bp, Homo sapien
agtgttctaagtccctcactgattt

SEQ ID NO: 379256 - DNA, 25 bp, Homo sapien
tctaagtccctcactgatttctcaa

SEQ ID NO: 379257 - DNA, 25 bp, Homo sapien
actgatttctcaatgacctctggtg

SEQ ID NO: 379258 - DNA, 25 bp, Homo sapien
atttctcaatgacctctggtgtgta

SEQ ID NO: 379259 - DNA, 25 bp, Homo sapien
acctctggtgtgtaagaagccttca

SEQ ID NO: 379260 - DNA, 25 bp, Homo sapien
gaagccttcatgaggctctttgtct

SEQ ID NO: 379261 - DNA, 25 bp, Homo sapien
tcatgaggctctttgtctcctcagc

SEQ ID NO: 379262 - DNA, 25 bp, Homo sapien
tcagcagcccctgtagaataccatg

SEQ ID NO: 379263 - DNA, 25 bp, Homo sapien
agcccctgtagaataccatgaagaa

SEQ ID NO: 379264 - DNA, 25 bp, Homo sapien
ctgtctcctgctctggtttctctct

SEQ ID NO: 379265 - DNA, 25 bp, Homo sapien
aggtcccaagcttcagactgctgtg

SEQ ID NO: 379266 - DNA, 25 bp, Homo sapien
tttggagcccacctactctctggca

SEQ ID NO: 379267 - DNA, 25 bp, Homo sapien
agcatcctactcctggcaacatcag

SEQ ID NO: 379268 - DNA, 25 bp, Homo sapien
cagcctcacattgccagatgttggc

SEQ ID NO: 379269 - DNA, 25 bp, Homo sapien
ccagatgttggcagaagggctaata

SEQ ID NO: 379270 - DNA, 25 bp, Homo sapien
aagggctaatattgaccgtcttgac

SEQ ID NO: 379271 - DNA, 25 bp, Homo sapien
gaccgtcttgactggctggagcctt

SEQ ID NO: 379272 - DNA, 25 bp, Homo sapien
ccttcaaagccactgggatgtcctc

SEQ ID NO: 379273 - DNA, 25 bp, Homo sapien
actgggatgtcctccaggcacctgg

SEQ ID NO: 379274 - DNA, 25 bp, Homo sapien
gggtaggcatttcactggtttatga

SEQ ID NO: 379275 - DNA, 25 bp, Homo sapien
cactggtttatgaagctcgagtttc

SEQ ID NO: 379276 - DNA, 25 bp, Homo sapien
acgggaaataataacacctcagaag

SEQ ID NO: 379277 - DNA, 25 bp, Homo sapien
ggaaataataacacctcagaaggtt

SEQ ID NO: 379278 - DNA, 25 bp, Homo sapien
ataacacctcagaaggtttttgtga

SEQ ID NO: 379279 - DNA, 25 bp, Homo sapien
aacacctcagaaggtttttgtgaag

SEQ ID NO: 379280 - DNA, 25 bp, Homo sapien
cacctcagaaggtttttgtgaagat

SEQ ID NO: 379281 - DNA, 25 bp, Homo sapien
acctcagaaggtttttgtgaagatc

SEQ ID NO: 379282 - DNA, 25 bp, Homo sapien
ctcagaaggtttttgtgaagatcaa

SEQ ID NO: 379283 - DNA, 25 bp, Homo sapien
gtttttgtgaagatcaaagaagcta

SEQ ID NO: 379284 - DNA, 25 bp, Homo sapien
agaagctaaatatatgtggcatgat

SEQ ID NO: 379285 - DNA, 25 bp, Homo sapien
tatatgtggcatgatttgtaaagtg

SEQ ID NO: 379286 - DNA, 25 bp, Homo sapien
gtaaagtgttatgcatatgtatgtt

SEQ ID NO: 379287 - DNA, 25 bp, Homo sapien
gaaagacggaggaaacaatcaaaat

SEQ ID NO: 379288 - DNA, 25 bp, Homo sapien
ctattgctttgacacctttactagg

SEQ ID NO: 379289 - DNA, 25 bp, Homo sapien
tattgctttgacacctttactaggt

SEQ ID NO: 379290 - DNA, 25 bp, Homo sapien
gctttgacacctttactaggtgaat

SEQ ID NO: 379291 - DNA, 25 bp, Homo sapien
cctttactaggtgaattggtggcat

SEQ ID NO: 379292 - DNA, 25 bp, Homo sapien
tttactaggtgaattggtggcattc

SEQ ID NO: 379293 - DNA, 25 bp, Homo sapien
aaagctaatagggacgtttatatca

SEQ ID NO: 379294 - DNA, 25 bp, Homo sapien
taatagggacgtttatatcaagaaa

SEQ ID NO: 379295 - DNA, 25 bp, Homo sapien
gaattttagttgtacatatactttg

SEQ ID NO: 379296 - DNA, 25 bp, Homo sapien
gttgtacatatactttgtatgtttt

SEQ ID NO: 379297 - DNA, 25 bp, Homo sapien
tgtatgtttttgtcttctttcatat

SEQ ID NO: 379298 - DNA, 25 bp, Homo sapien
ctcgtcataaagggatgtatcgtat

SEQ ID NO: 379299 - DNA, 25 bp, Homo sapien
attctacattaactgcgctgtatta

SEQ ID NO: 379300 - DNA, 25 bp, Homo sapien
acattaactgcgctgtattatctac

SEQ ID NO: 379301 - DNA, 25 bp, Homo sapien
actgcgctgtattatctacaggtac

SEQ ID NO: 379302 - DNA, 25 bp, Homo sapien
ctacaggtacaatcaatggaccaat

SEQ ID NO: 379303 - DNA, 25 bp, Homo sapien
tggaccaatagttcctaaattagta

SEQ ID NO: 379304 - DNA, 25 bp, Homo sapien
taaggcttaccttacaaaagtaatg

SEQ ID NO: 379305 - DNA, 25 bp, Homo sapien
gatatttctctttcaaaggctaaca

SEQ ID NO: 379306 - DNA, 25 bp, Homo sapien
ggctaacagcaattcttggtcctga

SEQ ID NO: 379307 - DNA, 25 bp, Homo sapien
gcaattcttggtcctgagctattca

SEQ ID NO: 379308 - DNA, 25 bp, Homo sapien
ggtcctgagctattcagttcataca

SEQ ID NO: 379309 - DNA, 25 bp, Homo sapien
acagcactaagcagaatgcctggca

SEQ ID NO: 379310 - DNA, 25 bp, Homo sapien
tgagcatatcaggaagccagcttaa

SEQ ID NO: 379311 - DNA, 25 bp, Homo sapien
gccagcttaagagaggctctactct

SEQ ID NO: 379312 - DNA, 25 bp, Homo sapien
gagaggctctactctatggtatagc

SEQ ID NO: 379313 - DNA, 25 bp, Homo sapien
tctactctatggtatagcccctgag

SEQ ID NO: 379314 - DNA, 25 bp, Homo sapien
actctatggtatagcccctgagctg

SEQ ID NO: 379315 - DNA, 25 bp, Homo sapien
agctggagggcccaattttgtctta

SEQ ID NO: 379316 - DNA, 25 bp, Homo sapien
ggagggcccaattttgtcttaagct

SEQ ID NO: 379317 - DNA, 25 bp, Homo sapien
ggtcagagactgtgtctaccttttt

SEQ ID NO: 379318 - DNA, 25 bp, Homo sapien
tgtctacctttttcactcctctata

SEQ ID NO: 379319 - DNA, 25 bp, Homo sapien
actcctctatacacagcactaagca

SEQ ID NO: 379320 - DNA, 25 bp, Homo sapien
tagttttggtttacagcaggatttg

SEQ ID NO: 379321 - DNA, 25 bp, Homo sapien
gtttacagcaggatttgatgggcat

SEQ ID NO: 379322 - DNA, 25 bp, Homo sapien
gatgggcatgcatatttatcaatgt

SEQ ID NO: 379323 - DNA, 25 bp, Homo sapien
gcatgcatatttatcaatgtgaaag

SEQ ID NO: 379324 - DNA, 25 bp, Homo sapien
gaaagtgttgtctgtgggcggcgga

SEQ ID NO: 379325 - DNA, 25 bp, Homo sapien
gcttgggccgtgtccaggccacgca

SEQ ID NO: 379326 - DNA, 25 bp, Homo sapien
aggccacgcactgcaagggtgcagc

SEQ ID NO: 379327 - DNA, 25 bp, Homo sapien
acggtccctgctcctaaagctgttg

SEQ ID NO: 379328 - DNA, 25 bp, Homo sapien
ccccactgcaagagtggagtaggtt

SEQ ID NO: 379329 - DNA, 25 bp, Homo sapien
gtaggttgaggtgtagccatgacat

SEQ ID NO: 379330 - DNA, 25 bp, Homo sapien
ggttgaggtgtagccatgacattct

SEQ ID NO: 379331 - DNA, 25 bp, Homo sapien
acttcccagtgagcagagggtttgg

SEQ ID NO: 379332 - DNA, 25 bp, Homo sapien
gattttcagaaagggctttagtctc

SEQ ID NO: 379333 - DNA, 25 bp, Homo sapien
aaagggctttagtctctgagctgtg

SEQ ID NO: 379334 - DNA, 25 bp, Homo sapien
agctgtggctagtagctggctggct

SEQ ID NO: 379335 - DNA, 25 bp, Homo sapien
gtctaatagggtgtctgaccatagg

SEQ ID NO: 379336 - DNA, 25 bp, Homo sapien
tgaccataggacacctctcgtgttt

SEQ ID NO: 379337 - DNA, 25 bp, Homo sapien
ggacacctctcgtgtttggccttcc

SEQ ID NO: 379338 - DNA, 25 bp, Homo sapien
gtacacacacaaatctgtatcccca

SEQ ID NO: 379339 - DNA, 25 bp, Homo sapien
acaaatctgtatccccaggagtgcc

SEQ ID NO: 379340 - DNA, 25 bp, Homo sapien
atctgtatccccaggagtgcctcct

SEQ ID NO: 379341 - DNA, 25 bp, Homo sapien
gtggtgcaccatcccatgagagcag

SEQ ID NO: 379342 - DNA, 25 bp, Homo sapien
agtgagtagtgctgggcctgaaccc

SEQ ID NO: 379343 - DNA, 25 bp, Homo sapien
tagtgctgggcctgaaccccaaagt

SEQ ID NO: 379344 - DNA, 25 bp, Homo sapien
aaagtccacactcttgctatagccg

SEQ ID NO: 379345 - DNA, 25 bp, Homo sapien
cacactcttgctatagccgctgagg

SEQ ID NO: 379346 - DNA, 25 bp, Homo sapien
actcttgctatagccgctgaggcag

SEQ ID NO: 379347 - DNA, 25 bp, Homo sapien
gctgaggcaggcagaagagctcctt

SEQ ID NO: 379348 - DNA, 25 bp, Homo sapien
ttcaaagccttctctgaatcactcc

SEQ ID NO: 379349 - DNA, 25 bp, Homo sapien
ggcctccacctacgtaacagaaatg

SEQ ID NO: 379350 - DNA, 25 bp, Homo sapien
tacgtaacagaaatgcggctcagaa

SEQ ID NO: 379351 - DNA, 25 bp, Homo sapien
atgcggctcagaaagaccaagtgac

SEQ ID NO: 379352 - DNA, 25 bp, Homo sapien
gaccaagtgacagctagtgagtagt

SEQ ID NO: 379353 - DNA, 25 bp, Homo sapien
ttatctgggacctgcagtttggctt

SEQ ID NO: 379354 - DNA, 25 bp, Homo sapien
gtttggctttgggattgatcatctt

SEQ ID NO: 379355 - DNA, 25 bp, Homo sapien
gattttattcctgacgattcccttg

SEQ ID NO: 379356 - DNA, 25 bp, Homo sapien
ctctggttctcaacctcaacgagtt

SEQ ID NO: 379357 - DNA, 25 bp, Homo sapien
aacgagttcaaatcagttgtccttt

SEQ ID NO: 379358 - DNA, 25 bp, Homo sapien
tcagttgtcctttttagctcccgtg

SEQ ID NO: 379359 - DNA, 25 bp, Homo sapien
ttagctcccgtggaactgttttgta

SEQ ID NO: 379360 - DNA, 25 bp, Homo sapien
cgtggaactgttttgtatctgcctc

SEQ ID NO: 379361 - DNA, 25 bp, Homo sapien
tgtatctgcctctttactagtctac

SEQ ID NO: 379362 - DNA, 25 bp, Homo sapien
tactagtctaccttagtgccatcca

SEQ ID NO: 379363 - DNA, 25 bp, Homo sapien
gtacataatgtacatactgtcaatt

SEQ ID NO: 379364 - DNA, 25 bp, Homo sapien
cccttagacagtgtaagcctgtagg

SEQ ID NO: 379365 - DNA, 25 bp, Homo sapien
taagcctgtagggtgcagccccaag

SEQ ID NO: 379366 - DNA, 25 bp, Homo sapien
gcagccccaagtttatgtccaaagg

SEQ ID NO: 379367 - DNA, 25 bp, Homo sapien
taagataggcagtgcaaggagcttc

SEQ ID NO: 379368 - DNA, 25 bp, Homo sapien
gcaaggagcttcccactggccagag

SEQ ID NO: 379369 - DNA, 25 bp, Homo sapien
tggccagagcagctgccttgtagaa

SEQ ID NO: 379370 - DNA, 25 bp, Homo sapien
agagcagctgccttgtagaatgtgg

SEQ ID NO: 379371 - DNA, 25 bp, Homo sapien
tagaagtttcacacgcttgcagcta

SEQ ID NO: 379372 - DNA, 25 bp, Homo sapien
gtttcacacgcttgcagctaagagt

SEQ ID NO: 379373 - DNA, 25 bp, Homo sapien
agagctctctgttttacttcgtgaa

SEQ ID NO: 379374 - DNA, 25 bp, Homo sapien
acttcgtgaaacattagcagctctg

SEQ ID NO: 379375 - DNA, 25 bp, Homo sapien
gagattctgcagatgacaggattct

SEQ ID NO: 379376 - DNA, 25 bp, Homo sapien
gacaggattctttgtcagggacaag

SEQ ID NO: 379377 - DNA, 25 bp, Homo sapien
gaaagagtggtctcacctccaaatt

SEQ ID NO: 379378 - DNA, 25 bp, Homo sapien
ctccaaattaccatgtcccaagaca

SEQ ID NO: 379379 - DNA, 25 bp, Homo sapien
gaagcatagggtacctggtgtgcct

SEQ ID NO: 379380 - DNA, 25 bp, Homo sapien
tggtgtgcctaatcccttataaatg

SEQ ID NO: 379381 - DNA, 25 bp, Homo sapien
atttaattctttccttatggtgata

SEQ ID NO: 379382 - DNA, 25 bp, Homo sapien
aaagctggctaggaattcgtagaat

SEQ ID NO: 379383 - DNA, 25 bp, Homo sapien
cgtagaatacttactatccttggaa

SEQ ID NO: 379384 - DNA, 25 bp, Homo sapien
tcctttgcaaacagtccagtcactt

SEQ ID NO: 379385 - DNA, 25 bp, Homo sapien
acagtccagtcacttgcttgttaaa

SEQ ID NO: 379386 - DNA, 25 bp, Homo sapien
ttggagcgcacccagaactggaact

SEQ ID NO: 379387 - DNA, 25 bp, Homo sapien
cagaactggaacttgcctttctcgc

SEQ ID NO: 379388 - DNA, 25 bp, Homo sapien
tggaacttgcctttctcgccggctg

SEQ ID NO: 379389 - DNA, 25 bp, Homo sapien
aggacctcggcgatccgctggtatt

SEQ ID NO: 379390 - DNA, 25 bp, Homo sapien
tcggcgatccgctggtatttgctgc

SEQ ID NO: 379391 - DNA, 25 bp, Homo sapien
cgctggtatttgctgcgtgtcaccg

SEQ ID NO: 379392 - DNA, 25 bp, Homo sapien
cgagtcgccgtaggtgcgcaagcac

SEQ ID NO: 379393 - DNA, 25 bp, Homo sapien
attgaatactacacagcgagcccgt

SEQ ID NO: 379394 - DNA, 25 bp, Homo sapien
atactacacagcgagcccgtcttga

SEQ ID NO: 379395 - DNA, 25 bp, Homo sapien
gagcccgtcttgaccggcacataca

SEQ ID NO: 379396 - DNA, 25 bp, Homo sapien
ttgaccggcacatacaccacttggc

SEQ ID NO: 379397 - DNA, 25 bp, Homo sapien
atgctgacaaggcaagaatacctca

SEQ ID NO: 379398 - DNA, 25 bp, Homo sapien
agaatacctcagttggaatcccaga

SEQ ID NO: 379399 - DNA, 25 bp, Homo sapien
cctcagttggaatcccagaagggac

SEQ ID NO: 379400 - DNA, 25 bp, Homo sapien
gggtgagcactgatgtggaaattat

SEQ ID NO: 379401 - DNA, 25 bp, Homo sapien
aaaagccatgccaagctcacagtgg

SEQ ID NO: 379402 - DNA, 25 bp, Homo sapien
agctcacagtgggaagtgtctctca

SEQ ID NO: 379403 - DNA, 25 bp, Homo sapien
ggaagtgtctctcagaagcagtcaa

SEQ ID NO: 379404 - DNA, 25 bp, Homo sapien
gtctctcagaagcagtcaaaggcaa

SEQ ID NO: 379405 - DNA, 25 bp, Homo sapien
gcaaggcaggatcagttgatagcat

SEQ ID NO: 379406 - DNA, 25 bp, Homo sapien
tgccccaaggcaagtgatcacaaat

SEQ ID NO: 379407 - DNA, 25 bp, Homo sapien
aggcaagtgatcacaaatctgcctt

SEQ ID NO: 379408 - DNA, 25 bp, Homo sapien
cacctggggatagtcttcaagaata

SEQ ID NO: 379409 - DNA, 25 bp, Homo sapien
acctggggatagtcttcaagaatag

SEQ ID NO: 379410 - DNA, 25 bp, Homo sapien
gggatagtcttcaagaatagcagcc

SEQ ID NO: 379411 - DNA, 25 bp, Homo sapien
ggatagtcttcaagaatagcagcca

SEQ ID NO: 379412 - DNA, 25 bp, Homo sapien
gatagtcttcaagaatagcagccag

SEQ ID NO: 379413 - DNA, 25 bp, Homo sapien
atagtcttcaagaatagcagccagg

SEQ ID NO: 379414 - DNA, 25 bp, Homo sapien
tagtcttcaagaatagcagccaggc

SEQ ID NO: 379415 - DNA, 25 bp, Homo sapien
agtcttcaagaatagcagccaggca

SEQ ID NO: 379416 - DNA, 25 bp, Homo sapien
gtcttcaagaatagcagccaggcac

SEQ ID NO: 379417 - DNA, 25 bp, Homo sapien
tcttcaagaatagcagccaggcacg

SEQ ID NO: 379418 - DNA, 25 bp, Homo sapien
cttcaagaatagcagccaggcacgg

SEQ ID NO: 379419 - DNA, 25 bp, Homo sapien
ctttgcatagattgtcataaaatgt

SEQ ID NO: 379420 - DNA, 25 bp, Homo sapien
ccattagaatgatattttacttgta

SEQ ID NO: 379421 - DNA, 25 bp, Homo sapien
gtaagataataaagagttctctgag

SEQ ID NO: 379422 - DNA, 25 bp, Homo sapien
ataaagtaaattgcccactcaaatt

SEQ ID NO: 379423 - DNA, 25 bp, Homo sapien
gagttctctgagctattcagatgtt

SEQ ID NO: 379424 - DNA, 25 bp, Homo sapien
gctattcagatgtttactttggaat

SEQ ID NO: 379425 - DNA, 25 bp, Homo sapien
atactgttaaatctagattaccagc

SEQ ID NO: 379426 - DNA, 25 bp, Homo sapien
ttaaatctagattaccagcagttac

SEQ ID NO: 379427 - DNA, 25 bp, Homo sapien
taaatctagattaccagcagttacc

SEQ ID NO: 379428 - DNA, 25 bp, Homo sapien
ttggaatacaggtctaaactttaca

SEQ ID NO: 379429 - DNA, 25 bp, Homo sapien
tggaatacaggtctaaactttacaa

SEQ ID NO: 379430 - DNA, 25 bp, Homo sapien
tatttgggagcaaagacaagcatgc

SEQ ID NO: 379431 - DNA, 25 bp, Homo sapien
gacaagcatgctaaatcttcatttt

SEQ ID NO: 379432 - DNA, 25 bp, Homo sapien
agcatgctaaatcttcattttgcta

SEQ ID NO: 379433 - DNA, 25 bp, Homo sapien
ggctataagcatatatttttggcaa

SEQ ID NO: 379434 - DNA, 25 bp, Homo sapien
atatttttggcaacttatttgcaat

SEQ ID NO: 379435 - DNA, 25 bp, Homo sapien
atattcttgccttaaagtttcctgc

SEQ ID NO: 379436 - DNA, 25 bp, Homo sapien
tgccttaaagtttcctgcaaatttc

SEQ ID NO: 379437 - DNA, 25 bp, Homo sapien
gtaattcccgaatagcaaaacatta

SEQ ID NO: 379438 - DNA, 25 bp, Homo sapien
cattaatattccatgattagctcta

SEQ ID NO: 379439 - DNA, 25 bp, Homo sapien
gtgttgtctcactattaaaatggaa

SEQ ID NO: 379440 - DNA, 25 bp, Homo sapien
ttcaaatcttttctaatggttaata

SEQ ID NO: 379441 - DNA, 25 bp, Homo sapien
ggagctcatgctggtacgctgctgc

SEQ ID NO: 379442 - DNA, 25 bp, Homo sapien
gaaggtttggaacctgtagtgtcct

SEQ ID NO: 379443 - DNA, 25 bp, Homo sapien
acctgtagtgtcctgtctgataagg

SEQ ID NO: 379444 - DNA, 25 bp, Homo sapien
ctgataagggtgaagctctcgttct

SEQ ID NO: 379445 - DNA, 25 bp, Homo sapien
tctcgttcttgcttgccccagaaga

SEQ ID NO: 379446 - DNA, 25 bp, Homo sapien
gaccagtttttagtcttcactcagt

SEQ ID NO: 379447 - DNA, 25 bp, Homo sapien
agtttttagtcttcactcagtggat

SEQ ID NO: 379448 - DNA, 25 bp, Homo sapien
tagtcttcactcagtggattttcaa

SEQ ID NO: 379449 - DNA, 25 bp, Homo sapien
agtggattttcaaatgctcttggct

SEQ ID NO: 379450 - DNA, 25 bp, Homo sapien
tacgctgctgctgcagttaccagaa

SEQ ID NO: 379451 - DNA, 25 bp, Homo sapien
tgctgctgcagttaccagaaaaact

SEQ ID NO: 379452 - DNA, 25 bp, Homo sapien
tggaccagaatcttcatttaacaag

SEQ ID NO: 379453 - DNA, 25 bp, Homo sapien
caagatgcccagaaaacctgagata

SEQ ID NO: 379454 - DNA, 25 bp, Homo sapien
gataatcaaagacccacaactaagt

SEQ ID NO: 379455 - DNA, 25 bp, Homo sapien
aagtaagacctctcaggatctcaaa

SEQ ID NO: 379456 - DNA, 25 bp, Homo sapien
atctcaaagccaagtgttttacaga

SEQ ID NO: 379457 - DNA, 25 bp, Homo sapien
aaaggcatattatctaggagtggaa

SEQ ID NO: 379458 - DNA, 25 bp, Homo sapien
attcaacattccacctaggaggctt

SEQ ID NO: 379459 - DNA, 25 bp, Homo sapien
taggaggcttccatctctgcttagg

SEQ ID NO: 379460 - DNA, 25 bp, Homo sapien
ttccatctctgcttaggagctgagt

SEQ ID NO: 379461 - DNA, 25 bp, Homo sapien
gtgttcagtacctatgaagacctaa

SEQ ID NO: 379462 - DNA, 25 bp, Homo sapien
gacctaactcttgagggagagactc

SEQ ID NO: 379463 - DNA, 25 bp, Homo sapien
ttaactgtgtgccaagtacgcgata

SEQ ID NO: 379464 - DNA, 25 bp, Homo sapien
aagtacgcgataggcaacccggcat

SEQ ID NO: 379465 - DNA, 25 bp, Homo sapien
gcaacccggcattcatctgagaaag

SEQ ID NO: 379466 - DNA, 25 bp, Homo sapien
aagagacactgtcactgcccttatg

SEQ ID NO: 379467 - DNA, 25 bp, Homo sapien
tgcccttatggagcctgcagcttgg

SEQ ID NO: 379468 - DNA, 25 bp, Homo sapien
gaaactcgtccgcaaactagcaaaa

SEQ ID NO: 379469 - DNA, 25 bp, Homo sapien
gaagggttagtcgaaattctttcag

SEQ ID NO: 379470 - DNA, 25 bp, Homo sapien
aattctttcagcaacggtggagcat

SEQ ID NO: 379471 - DNA, 25 bp, Homo sapien
attctggtaaatattcgttgagtgt

SEQ ID NO: 379472 - DNA, 25 bp, Homo sapien
gagtgtttagcaatttctcgagcac

SEQ ID NO: 379473 - DNA, 25 bp, Homo sapien
gcaatttctcgagcacttaactgtg

SEQ ID NO: 379474 - DNA, 25 bp, Homo sapien
tagtacttagaaacaagcactctag

SEQ ID NO: 379475 - DNA, 25 bp, Homo sapien
agtacttagaaacaagcactctagg

SEQ ID NO: 379476 - DNA, 25 bp, Homo sapien
gtacttagaaacaagcactctaggc

SEQ ID NO: 379477 - DNA, 25 bp, Homo sapien
tacttagaaacaagcactctaggct

SEQ ID NO: 379478 - DNA, 25 bp, Homo sapien
acttagaaacaagcactctaggctg

SEQ ID NO: 379479 - DNA, 25 bp, Homo sapien
cttagaaacaagcactctaggctgg

SEQ ID NO: 379480 - DNA, 25 bp, Homo sapien
ttagaaacaagcactctaggctggg

SEQ ID NO: 379481 - DNA, 25 bp, Homo sapien
tagaaacaagcactctaggctgggc

SEQ ID NO: 379482 - DNA, 25 bp, Homo sapien
agaaacaagcactctaggctgggct

SEQ ID NO: 379483 - DNA, 25 bp, Homo sapien
gaaacaagcactctaggctgggctt

SEQ ID NO: 379484 - DNA, 25 bp, Homo sapien
aaacaagcactctaggctgggcttg

SEQ ID NO: 379485 - DNA, 25 bp, Homo sapien
gactactggaaatttttgcacttga

SEQ ID NO: 379486 - DNA, 25 bp, Homo sapien
acagattatccattccaaaatgtct

SEQ ID NO: 379487 - DNA, 25 bp, Homo sapien
ccaaaatgtcttttctctgatcaca

SEQ ID NO: 379488 - DNA, 25 bp, Homo sapien
gcaaacaaatgtcaatatctcttat

SEQ ID NO: 379489 - DNA, 25 bp, Homo sapien
ggaattaatcgatgcaaataaactt

SEQ ID NO: 379490 - DNA, 25 bp, Homo sapien
gttttcataagtacagacaccttag

SEQ ID NO: 379491 - DNA, 25 bp, Homo sapien
taagtacagacaccttagggaagaa

SEQ ID NO: 379492 - DNA, 25 bp, Homo sapien
gaagcttatggttgattaatttcct

SEQ ID NO: 379493 - DNA, 25 bp, Homo sapien
gattaatttcctaacagcacagcta

SEQ ID NO: 379494 - DNA, 25 bp, Homo sapien
aacagcacagctatgaatattttgc

SEQ ID NO: 379495 - DNA, 25 bp, Homo sapien
ggtacactggaggtaggaagactac

SEQ ID NO: 379496 - DNA, 25 bp, Homo sapien
ctttgcatagattgtcataaaatgt

SEQ ID NO: 379497 - DNA, 25 bp, Homo sapien
ccattagaatgatattttacttgta

SEQ ID NO: 379498 - DNA, 25 bp, Homo sapien
gtaagataataaagagttctctgag

SEQ ID NO: 379499 - DNA, 25 bp, Homo sapien
ataaagtaaattgcccactcaaatt

SEQ ID NO: 379500 - DNA, 25 bp, Homo sapien
gagttctctgagctattcagatgtt

SEQ ID NO: 379501 - DNA, 25 bp, Homo sapien
gctattcagatgtttactttggaat

SEQ ID NO: 379502 - DNA, 25 bp, Homo sapien
atactgttaaatctagattaccagc

SEQ ID NO: 379503 - DNA, 25 bp, Homo sapien
taaatctagattaccagcagttacc

SEQ ID NO: 379504 - DNA, 25 bp, Homo sapien
taccagcagttacctttttagtttg

SEQ ID NO: 379505 - DNA, 25 bp, Homo sapien
cagcagttacctttttagtttgtag

SEQ ID NO: 379506 - DNA, 25 bp, Homo sapien
tggaatacaggtctaaactttacaa

SEQ ID NO: 379507 - DNA, 25 bp, Homo sapien
cagggtttaggaagggcttctcagt

SEQ ID NO: 379508 - DNA, 25 bp, Homo sapien
ttctcagtcagtctatgccagtcta

SEQ ID NO: 379509 - DNA, 25 bp, Homo sapien
ctatgccagtctataaggttttgtg

SEQ ID NO: 379510 - DNA, 25 bp, Homo sapien
ggagcaagtttgtcaggtcactgca

SEQ ID NO: 379511 - DNA, 25 bp, Homo sapien
atgctttcagttcttcctatctggt

SEQ ID NO: 379512 - DNA, 25 bp, Homo sapien
tatctggtcagctgccttctggcac

SEQ ID NO: 379513 - DNA, 25 bp, Homo sapien
cactccagctggatttacgagccaa

SEQ ID NO: 379514 - DNA, 25 bp, Homo sapien
tcctcttgaccccaagtttaggagg

SEQ ID NO: 379515 - DNA, 25 bp, Homo sapien
agttctctccatccagacgctggag

SEQ ID NO: 379516 - DNA, 25 bp, Homo sapien
agacgctggagaggactttccctgt

SEQ ID NO: 379517 - DNA, 25 bp, Homo sapien
agaggactttccctgttggcccagg

SEQ ID NO: 379518 - DNA, 25 bp, Homo sapien
cagccaggagcactgagtcagcagc

SEQ ID NO: 379519 - DNA, 25 bp, Homo sapien
gcgcagttgatccacataaagcctc

SEQ ID NO: 379520 - DNA, 25 bp, Homo sapien
gttgatccacataaagcctcacatt

SEQ ID NO: 379521 - DNA, 25 bp, Homo sapien
ataaagcctcacattgttcctgcag

SEQ ID NO: 379522 - DNA, 25 bp, Homo sapien
aggacagtggtgacctttgggattc

SEQ ID NO: 379523 - DNA, 25 bp, Homo sapien
ggagcactgctctgggtgagtggtt

SEQ ID NO: 379524 - DNA, 25 bp, Homo sapien
gagtggttgtgctaatgccccaaga

SEQ ID NO: 379525 - DNA, 25 bp, Homo sapien
atgccccaagacaagcagcctctgt

SEQ ID NO: 379526 - DNA, 25 bp, Homo sapien
tggctggctctgcaggctaaacccc

SEQ ID NO: 379527 - DNA, 25 bp, Homo sapien
agccacttctctagccataaagcag

SEQ ID NO: 379528 - DNA, 25 bp, Homo sapien
tagccataaagcagccccagccagg

SEQ ID NO: 379529 - DNA, 25 bp, Homo sapien
gagtgagtttctacatgtcctggca

SEQ ID NO: 379530 - DNA, 25 bp, Homo sapien
tacatgtcctggcaacgtctaaagc

SEQ ID NO: 379531 - DNA, 25 bp, Homo sapien
taaagccacagcaattccttgtcct

SEQ ID NO: 379532 - DNA, 25 bp, Homo sapien
ttgtcctcttttgtttcaactcgtt

SEQ ID NO: 379533 - DNA, 25 bp, Homo sapien
aactcgtttaacagatctccactga

SEQ ID NO: 379534 - DNA, 25 bp, Homo sapien
ctgattgcctggagacagggctttt

SEQ ID NO: 379535 - DNA, 25 bp, Homo sapien
gggctttttctgtagagagctcaca

SEQ ID NO: 379536 - DNA, 25 bp, Homo sapien
acaggaggaccacatgggccatgtc

SEQ ID NO: 379537 - DNA, 25 bp, Homo sapien
cactctgggatggtttctgttcttg

SEQ ID NO: 379538 - DNA, 25 bp, Homo sapien
tctgttcttgcttcaatggtgcaca

SEQ ID NO: 379539 - DNA, 25 bp, Homo sapien
ctcagagcttgtcccacatctttaa

SEQ ID NO: 379540 - DNA, 25 bp, Homo sapien
taaatatgcaaactccacccatctt

SEQ ID NO: 379541 - DNA, 25 bp, Homo sapien
tttgcacacggaaggccagtggtct

SEQ ID NO: 379542 - DNA, 25 bp, Homo sapien
acggaaggccagtggtctccgcttc

SEQ ID NO: 379543 - DNA, 25 bp, Homo sapien
ccacctttgctgtggtgtctgtgtc

SEQ ID NO: 379544 - DNA, 25 bp, Homo sapien
cttttgtgccgtgcttggcatatgt

SEQ ID NO: 379545 - DNA, 25 bp, Homo sapien
ttggcatatgtggtcctcgttcatc

SEQ ID NO: 379546 - DNA, 25 bp, Homo sapien
tatgtggtcctcgttcatcgtgccg

SEQ ID NO: 379547 - DNA, 25 bp, Homo sapien
catcgtgccgcctgtggtgatgcgt

SEQ ID NO: 379548 - DNA, 25 bp, Homo sapien
gtgatgcgtgcagtgacgctgttta

SEQ ID NO: 379549 - DNA, 25 bp, Homo sapien
gtgacgctgtttatgtggtccgcac

SEQ ID NO: 379550 - DNA, 25 bp, Homo sapien
agcggctctgaaccccaagagaaga

SEQ ID NO: 379551 - DNA, 25 bp, Homo sapien
aacttaggtatcttgtggcctggca

SEQ ID NO: 379552 - DNA, 25 bp, Homo sapien
gtatcttgtggcctggcacctataa

SEQ ID NO: 379553 - DNA, 25 bp, Homo sapien
gtggcctggcacctataacttttaa

SEQ ID NO: 379554 - DNA, 25 bp, Homo sapien
ggcacctataacttttaagctatct

SEQ ID NO: 379555 - DNA, 25 bp, Homo sapien
gctatcttaaagtagattgttctta

SEQ ID NO: 379556 - DNA, 25 bp, Homo sapien
attggtgattgttcaatgtattttc

SEQ ID NO: 379557 - DNA, 25 bp, Homo sapien
atgtattttcttcaaatcctataag

SEQ ID NO: 379558 - DNA, 25 bp, Homo sapien
ttattttttaggttggtgaatgtca

SEQ ID NO: 379559 - DNA, 25 bp, Homo sapien
gtgaatgtcattgttggctccatgt

SEQ ID NO: 379560 - DNA, 25 bp, Homo sapien
gtcattgttggctccatgtttagat

SEQ ID NO: 379561 - DNA, 25 bp, Homo sapien
ttatcagtttggatttaggtggcga

SEQ ID NO: 379562 - DNA, 25 bp, Homo sapien
ttaatccacgacacaggaacactga

SEQ ID NO: 379563 - DNA, 25 bp, Homo sapien
ataagttgtgctttgccagtcgggc

SEQ ID NO: 379564 - DNA, 25 bp, Homo sapien
tcgggctgcctgtgttttatctgaa

SEQ ID NO: 379565 - DNA, 25 bp, Homo sapien
aaacatctgactttaaccccaggca

SEQ ID NO: 379566 - DNA, 25 bp, Homo sapien
cccaggcagatttctcttcaggttg

SEQ ID NO: 379567 - DNA, 25 bp, Homo sapien
cttcaggttgtaattattctggaac

SEQ ID NO: 379568 - DNA, 25 bp, Homo sapien
ggaacaatgatacctcctgtgtgga

SEQ ID NO: 379569 - DNA, 25 bp, Homo sapien
ctgtgtggaaggattcccactggaa

SEQ ID NO: 379570 - DNA, 25 bp, Homo sapien
acagtgtactgaagttgacccggat

SEQ ID NO: 379571 - DNA, 25 bp, Homo sapien
tgacccggataactgctggctgcaa

SEQ ID NO: 379572 - DNA, 25 bp, Homo sapien
tgcaatccagcttaccctcttttat

SEQ ID NO: 379573 - DNA, 25 bp, Homo sapien
gaattgttcatagacttgtgataat

SEQ ID NO: 379574 - DNA, 25 bp, Homo sapien
aacacattttgtgcgcatgatgaag

SEQ ID NO: 379575 - DNA, 25 bp, Homo sapien
gagcaccgtgaatctagtcttgact

SEQ ID NO: 379576 - DNA, 25 bp, Homo sapien
gactgcccctggtggaacatttgaa

SEQ ID NO: 379577 - DNA, 25 bp, Homo sapien
ctggtggaacatttgaaagcccttg

SEQ ID NO: 379578 - DNA, 25 bp, Homo sapien
aaagcccttgggactccaggagaga

SEQ ID NO: 379579 - DNA, 25 bp, Homo sapien
gcatgtatgctaaatttgtgagtta

SEQ ID NO: 379580 - DNA, 25 bp, Homo sapien
gtgagttagcaagaccctgctgtga

SEQ ID NO: 379581 - DNA, 25 bp, Homo sapien
ccctgctgtgattactatgttgtac

SEQ ID NO: 379582 - DNA, 25 bp, Homo sapien
actatgttgtacagatcttcaaagt

SEQ ID NO: 379583 - DNA, 25 bp, Homo sapien
atatgagtcatgttatttctagatt

SEQ ID NO: 379584 - DNA, 25 bp, Homo sapien
gatgatgcacggtgccatggcagcc

SEQ ID NO: 379585 - DNA, 25 bp, Homo sapien
ttctccgcgggttttggcacaggct

SEQ ID NO: 379586 - DNA, 25 bp, Homo sapien
tccatgagcgtaccctgtgagtgaa

SEQ ID NO: 379587 - DNA, 25 bp, Homo sapien
atcacgcagccggtcttgggcagca

SEQ ID NO: 379588 - DNA, 25 bp, Homo sapien
agcatccgcagagcataggcatggt

SEQ ID NO: 379589 - DNA, 25 bp, Homo sapien
agagcataggcatggtcctcgtccg

SEQ ID NO: 379590 - DNA, 25 bp, Homo sapien
ttaaggttcgggtctgacttgtcgc

SEQ ID NO: 379591 - DNA, 25 bp, Homo sapien
gtgagtgaacgttccttttacttat

SEQ ID NO: 379592 - DNA, 25 bp, Homo sapien
ctgatttctaattcggaggcacctc

SEQ ID NO: 379593 - DNA, 25 bp, Homo sapien
gaggcacctccttttgagcggcggc

SEQ ID NO: 379594 - DNA, 25 bp, Homo sapien
ttgagcggcggctccaggtcctcag

SEQ ID NO: 379595 - DNA, 25 bp, Homo sapien
gtgatatttctcttctgatttccct

SEQ ID NO: 379596 - DNA, 25 bp, Homo sapien
gatatttctcttctgatttccctcc

SEQ ID NO: 379597 - DNA, 25 bp, Homo sapien
tctcttatcttaccactgtgaaaac

SEQ ID NO: 379598 - DNA, 25 bp, Homo sapien
tgttaatctcgttgtcgtccagtat

SEQ ID NO: 379599 - DNA, 25 bp, Homo sapien
atctcgttgtcgtccagtattctgc

SEQ ID NO: 379600 - DNA, 25 bp, Homo sapien
atgtacagtggtctagtggagtcaa

SEQ ID NO: 379601 - DNA, 25 bp, Homo sapien
aagttccagataacacagctttcct

SEQ ID NO: 379602 - DNA, 25 bp, Homo sapien
cagctttcctgtatatagatcacta

SEQ ID NO: 379603 - DNA, 25 bp, Homo sapien
tgggcaggtcagcaaagatctctta

SEQ ID NO: 379604 - DNA, 25 bp, Homo sapien
gcaggtcagcaaagatctcttacag

SEQ ID NO: 379605 - DNA, 25 bp, Homo sapien
taatctatgatgcttcatttagcag

SEQ ID NO: 379606 - DNA, 25 bp, Homo sapien
acttttgatattatctgccaaggtt

SEQ ID NO: 379607 - DNA, 25 bp, Homo sapien
caaggttgaagtgtgtgcagcccat

SEQ ID NO: 379608 - DNA, 25 bp, Homo sapien
gtgtgcagcccataagtacttcaac

SEQ ID NO: 379609 - DNA, 25 bp, Homo sapien
aaaggtgactgcaaatactggtaaa

SEQ ID NO: 379610 - DNA, 25 bp, Homo sapien
aaggtgttccacttgttcattgtct

SEQ ID NO: 379611 - DNA, 25 bp, Homo sapien
attgtctcagggaaggatgaacgac

SEQ ID NO: 379612 - DNA, 25 bp, Homo sapien
gaacgacagctagaaacatcataac

SEQ ID NO: 379613 - DNA, 25 bp, Homo sapien
cataacaaaacttcctctcattctt

SEQ ID NO: 379614 - DNA, 25 bp, Homo sapien
aaacttcctctcattcttgggtggg

SEQ ID NO: 379615 - DNA, 25 bp, Homo sapien
gggcaaaagcctgacttggtctgat

SEQ ID NO: 379616 - DNA, 25 bp, Homo sapien
cctgacttggtctgatgatatcccc

SEQ ID NO: 379617 - DNA, 25 bp, Homo sapien
gatccacaatttgatatatgcacta

SEQ ID NO: 379618 - DNA, 25 bp, Homo sapien
tatgcactaaatccttttaacgttg

SEQ ID NO: 379619 - DNA, 25 bp, Homo sapien
tccttttaacgttgtaatgtagcca

SEQ ID NO: 379620 - DNA, 25 bp, Homo sapien
gccaaatgtagaatagcatgccagg

SEQ ID NO: 379621 - DNA, 25 bp, Homo sapien
ggaatcaacggctagcatccttttt

SEQ ID NO: 379622 - DNA, 25 bp, Homo sapien
ggctagcatcctttttaacatttat

SEQ ID NO: 379623 - DNA, 25 bp, Homo sapien
ggatatgtaccaaaccgaaccattg

SEQ ID NO: 379624 - DNA, 25 bp, Homo sapien
gtaccaaaccgaaccattgagtata

SEQ ID NO: 379625 - DNA, 25 bp, Homo sapien
ggatttccttgttaccatattcaga

SEQ ID NO: 379626 - DNA, 25 bp, Homo sapien
gctacaggcaattcattatactttc

SEQ ID NO: 379627 - DNA, 25 bp, Homo sapien
catattcagatcttgtgagtgtgta

SEQ ID NO: 379628 - DNA, 25 bp, Homo sapien
agtggcaagctgagatctacaagga

SEQ ID NO: 379629 - DNA, 25 bp, Homo sapien
caaggagctgctaagaaatggtgaa

SEQ ID NO: 379630 - DNA, 25 bp, Homo sapien
gtcacatgaagggtataaactcaag

SEQ ID NO: 379631 - DNA, 25 bp, Homo sapien
aaactcaagaatttactacttcagg

SEQ ID NO: 379632 - DNA, 25 bp, Homo sapien
caagaatttactacttcaggtttgg

SEQ ID NO: 379633 - DNA, 25 bp, Homo sapien
gctaggaatacatcagtgcttgctt

SEQ ID NO: 379634 - DNA, 25 bp, Homo sapien
atacatcagtgcttgcttgggatct

SEQ ID NO: 379635 - DNA, 25 bp, Homo sapien
atcagtgcttgcttgggatctttgg

SEQ ID NO: 379636 - DNA, 25 bp, Homo sapien
gcttgcttgggatctttgggttcac

SEQ ID NO: 379637 - DNA, 25 bp, Homo sapien
cttgggatctttgggttcacctctg

SEQ ID NO: 379638 - DNA, 25 bp, Homo sapien
gttcacctctggcacactcaggtaa

SEQ ID NO: 379639 - DNA, 25 bp, Homo sapien
aacatcaacatagtcattcctcaag

SEQ ID NO: 379640 - DNA, 25 bp, Homo sapien
gtcattcctcaagttagcatctctc

SEQ ID NO: 379641 - DNA, 25 bp, Homo sapien
tagcatctctcctgggttttagtac

SEQ ID NO: 379642 - DNA, 25 bp, Homo sapien
ttgatgcacatctagaggcttgatt

SEQ ID NO: 379643 - DNA, 25 bp, Homo sapien
gttttagtactatctggtcatcttt

SEQ ID NO: 379644 - DNA, 25 bp, Homo sapien
ccatcagggcttgtagggcactaat

SEQ ID NO: 379645 - DNA, 25 bp, Homo sapien
tagggacaagtagcgatgttcctcc

SEQ ID NO: 379646 - DNA, 25 bp, Homo sapien
gatgttcctccctgatgttcagaat

SEQ ID NO: 379647 - DNA, 25 bp, Homo sapien
tgatgttcagaatgacctatgccca

SEQ ID NO: 379648 - DNA, 25 bp, Homo sapien
gtttcagcaggaatacttcatagat

SEQ ID NO: 379649 - DNA, 25 bp, Homo sapien
gcttctagcacatcagaaggctcat

SEQ ID NO: 379650 - DNA, 25 bp, Homo sapien
tgtgatgactaggagctgagagctt

SEQ ID NO: 379651 - DNA, 25 bp, Homo sapien
agctgagagcttagtggttctgcca

SEQ ID NO: 379652 - DNA, 25 bp, Homo sapien
agcttagtggttctgccagagctgc

SEQ ID NO: 379653 - DNA, 25 bp, Homo sapien
gcagagtctttgttggcctcagggt

SEQ ID NO: 379654 - DNA, 25 bp, Homo sapien
ttgttggcctcagggtgggacctct

SEQ ID NO: 379655 - DNA, 25 bp, Homo sapien
acctctcacatctctgtcagctttt

SEQ ID NO: 379656 - DNA, 25 bp, Homo sapien
gacaccaacctgttatgattcattt

SEQ ID NO: 379657 - DNA, 25 bp, Homo sapien
atttcacctgtcctgagcactagca

SEQ ID NO: 379658 - DNA, 25 bp, Homo sapien
aaaattcgctgtagcttgtgatgta

SEQ ID NO: 379659 - DNA, 25 bp, Homo sapien
gatgtattattctggatttctcaac

SEQ ID NO: 379660 - DNA, 25 bp, Homo sapien
cattcactataccattactgtctat

SEQ ID NO: 379661 - DNA, 25 bp, Homo sapien
agacaattcatagcctgtggtctcc

SEQ ID NO: 379662 - DNA, 25 bp, Homo sapien
tgtggtctccacataaacagcaaca

SEQ ID NO: 379663 - DNA, 25 bp, Homo sapien
ttctattctagggataactgctcat

SEQ ID NO: 379664 - DNA, 25 bp, Homo sapien
ggataactgctcatgattactccca

SEQ ID NO: 379665 - DNA, 25 bp, Homo sapien
atgattactcccatatatttctagt

SEQ ID NO: 379666 - DNA, 25 bp, Homo sapien
atatttctagtatttccctctgtac

SEQ ID NO: 379667 - DNA, 25 bp, Homo sapien
atttccctctgtactgttggcgtga

SEQ ID NO: 379668 - DNA, 25 bp, Homo sapien
gtactgttggcgtgacattgacact

SEQ ID NO: 379669 - DNA, 25 bp, Homo sapien
ggcgtgacattgacactagtattat

SEQ ID NO: 379670 - DNA, 25 bp, Homo sapien
agcatagtctataaacctttcagta

SEQ ID NO: 379671 - DNA, 25 bp, Homo sapien
acctttcagtaggatgatattctct

SEQ ID NO: 379672 - DNA, 25 bp, Homo sapien
gtggctttgcaagaggagacacaaa

SEQ ID NO: 379673 - DNA, 25 bp, Homo sapien
gagacacaaacctcgcattgatggt

SEQ ID NO: 379674 - DNA, 25 bp, Homo sapien
aaacctcgcattgatggtctggtta

SEQ ID NO: 379675 - DNA, 25 bp, Homo sapien
atggtctggttaaggtgggcacact

SEQ ID NO: 379676 - DNA, 25 bp, Homo sapien
ggtgggcacactgaaaaaacgactt

SEQ ID NO: 379677 - DNA, 25 bp, Homo sapien
tttgatggccaaaattaagtccact

SEQ ID NO: 379678 - DNA, 25 bp, Homo sapien
ttaagtccactatgatgacgcagga

SEQ ID NO: 379679 - DNA, 25 bp, Homo sapien
atgatgacgcaggaacaaatccaga

SEQ ID NO: 379680 - DNA, 25 bp, Homo sapien
atatgatgcactggttaaaagctca

SEQ ID NO: 379681 - DNA, 25 bp, Homo sapien
gttaaaagctcagaggaactcctca

SEQ ID NO: 379682 - DNA, 25 bp, Homo sapien
ggaactcctcagtgcattacagaaa

SEQ ID NO: 379683 - DNA, 25 bp, Homo sapien
gactcttgaagtgtctctttccatc

SEQ ID NO: 379684 - DNA, 25 bp, Homo sapien
tggcgaggagtgaccagtctgctta

SEQ ID NO: 379685 - DNA, 25 bp, Homo sapien
agtgcctgctgctgtgtactgctgg

SEQ ID NO: 379686 - DNA, 25 bp, Homo sapien
gctgtgtactgctggcccagtagca

SEQ ID NO: 379687 - DNA, 25 bp, Homo sapien
ggcccagtagcacagacactgtcag

SEQ ID NO: 379688 - DNA, 25 bp, Homo sapien
tgtcagcctggaggacggacagaca

SEQ ID NO: 379689 - DNA, 25 bp, Homo sapien
cagacaggtgtccagttctaccaat

SEQ ID NO: 379690 - DNA, 25 bp, Homo sapien
cagttctaccaatcctttgctttcc

SEQ ID NO: 379691 - DNA, 25 bp, Homo sapien
cccaactcctctacttgacttaatt

SEQ ID NO: 379692 - DNA, 25 bp, Homo sapien
tttaatttttctctacccactgtct

SEQ ID NO: 379693 - DNA, 25 bp, Homo sapien
ttttctctacccactgtctaatatg

SEQ ID NO: 379694 - DNA, 25 bp, Homo sapien
atatatggcgtggttatgtggagtt

SEQ ID NO: 379695 - DNA, 25 bp, Homo sapien
gtggagttgtatctctatcagtatt

SEQ ID NO: 379696 - DNA, 25 bp, Homo sapien
ctatcagtattaatgggctcgggat

SEQ ID NO: 379697 - DNA, 25 bp, Homo sapien
aatgggctcgggatgatttatattc

SEQ ID NO: 379698 - DNA, 25 bp, Homo sapien
gctcgggatgatttatattcaactg

SEQ ID NO: 379699 - DNA, 25 bp, Homo sapien
tattctttatcctgtactcattttg

SEQ ID NO: 379700 - DNA, 25 bp, Homo sapien
gtactcattttggatacttactaaa

SEQ ID NO: 379701 - DNA, 25 bp, Homo sapien
tgttataataaaatggcttgccgtg

SEQ ID NO: 379702 - DNA, 25 bp, Homo sapien
ataaaatggcttgccgtgtttgaaa

SEQ ID NO: 379703 - DNA, 25 bp, Homo sapien
atctgacaatgttctaagacctaat

SEQ ID NO: 379704 - DNA, 25 bp, Homo sapien
agacctaatttgatcttcatgacaa

SEQ ID NO: 379705 - DNA, 25 bp, Homo sapien
aaagggcttcagtcgaagctcatcc

SEQ ID NO: 379706 - DNA, 25 bp, Homo sapien
ttcagtcgaagctcatcccttatta

SEQ ID NO: 379707 - DNA, 25 bp, Homo sapien
tcagtcgaagctcatcccttattat

SEQ ID NO: 379708 - DNA, 25 bp, Homo sapien
gaaaagccttctgtcagagttcaac

SEQ ID NO: 379709 - DNA, 25 bp, Homo sapien
aaagccttctgtcagagttcaactc

SEQ ID NO: 379710 - DNA, 25 bp, Homo sapien
gttcaactctgatcagacatcagca

SEQ ID NO: 379711 - DNA, 25 bp, Homo sapien
atactaaagagtaatatctgagctt

SEQ ID NO: 379712 - DNA, 25 bp, Homo sapien
atatctgagcttttattaatgttag

SEQ ID NO: 379713 - DNA, 25 bp, Homo sapien
gttagcataagaacacatataccta

SEQ ID NO: 379714 - DNA, 25 bp, Homo sapien
taagaacacatatacctaacctccc

SEQ ID NO: 379715 - DNA, 25 bp, Homo sapien
ctaacctcccaccactgaaatatat

SEQ ID NO: 379716 - DNA, 25 bp, Homo sapien
caatgtttgtacttgttatttgaga

SEQ ID NO: 379717 - DNA, 25 bp, Homo sapien
atttgagattttacctttcactgta

SEQ ID NO: 379718 - DNA, 25 bp, Homo sapien
gttacagtacattagatccatgata

SEQ ID NO: 379719 - DNA, 25 bp, Homo sapien
agatccatgataataggttacatta

SEQ ID NO: 379720 - DNA, 25 bp, Homo sapien
tattttatttgcagagccctactgc

SEQ ID NO: 379721 - DNA, 25 bp, Homo sapien
agccctactgcagtgatttgaacaa

SEQ ID NO: 379722 - DNA, 25 bp, Homo sapien
gcagtgatttgaacaactcctaaat

SEQ ID NO: 379723 - DNA, 25 bp, Homo sapien
gaacaactcctaaatagatgccata

SEQ ID NO: 379724 - DNA, 25 bp, Homo sapien
aaaagttacaaacaggtggactgca

SEQ ID NO: 379725 - DNA, 25 bp, Homo sapien
gtggactgcagggtcgtcttacaaa

SEQ ID NO: 379726 - DNA, 25 bp, Homo sapien
gcagggtcgtcttacaaaatgacaa

SEQ ID NO: 379727 - DNA, 25 bp, Homo sapien
tgccagacacgttcctgcatatctg

SEQ ID NO: 379728 - DNA, 25 bp, Homo sapien
ttcctgcatatctgaacatagttca

SEQ ID NO: 379729 - DNA, 25 bp, Homo sapien
atgtactgaatataactgctgaaga

SEQ ID NO: 379730 - DNA, 25 bp, Homo sapien
tggatcacaggaaggttgctatagt

SEQ ID NO: 379731 - DNA, 25 bp, Homo sapien
atagtggatgctccttgagctacac

SEQ ID NO: 379732 - DNA, 25 bp, Homo sapien
tgctccttgagctacacaaattctc

SEQ ID NO: 379733 - DNA, 25 bp, Homo sapien
aaaaagatgacttaccttagacatg

SEQ ID NO: 379734 - DNA, 25 bp, Homo sapien
taccttagacatgtggactggaatt

SEQ ID NO: 379735 - DNA, 25 bp, Homo sapien
aatgtgttcatcaagtttcacatct

SEQ ID NO: 379736 - DNA, 25 bp, Homo sapien
tcacatctaagttgaaacagggtgt

SEQ ID NO: 379737 - DNA, 25 bp, Homo sapien
acagggtgtgtcataaagtcagtta

SEQ ID NO: 379738 - DNA, 25 bp, Homo sapien
ggtcatgtctctggctaaggagcgt

SEQ ID NO: 379739 - DNA, 25 bp, Homo sapien
taaggagcgtacctagcctgcctaa

SEQ ID NO: 379740 - DNA, 25 bp, Homo sapien
ctgcctaagccatgagcctgttggg

SEQ ID NO: 379741 - DNA, 25 bp, Homo sapien
gtggcatgaacagtgactgctcttc

SEQ ID NO: 379742 - DNA, 25 bp, Homo sapien
tgactgctcttcaccccaaatgcag

SEQ ID NO: 379743 - DNA, 25 bp, Homo sapien
aaatgcagtgtttctccttaaggag

SEQ ID NO: 379744 - DNA, 25 bp, Homo sapien
ggaggcactcagacatttaggaaac

SEQ ID NO: 379745 - DNA, 25 bp, Homo sapien
atttactcactgaatgcgccctgat

SEQ ID NO: 379746 - DNA, 25 bp, Homo sapien
gaatgcgccctgatgcttaatgagt

SEQ ID NO: 379747 - DNA, 25 bp, Homo sapien
ttaatgagtggcacgggtcagcagc

SEQ ID NO: 379748 - DNA, 25 bp, Homo sapien
cacgggtcagcagcaccgttgtgga

SEQ ID NO: 379749 - DNA, 25 bp, Homo sapien
atgggacttttttactcttctgact

SEQ ID NO: 379750 - DNA, 25 bp, Homo sapien
tttctcttcagatatgtggtaggta

SEQ ID NO: 379751 - DNA, 25 bp, Homo sapien
gagaggccttattattggctttggt

SEQ ID NO: 379752 - DNA, 25 bp, Homo sapien
attggctttggttgacatgctggtt

SEQ ID NO: 379753 - DNA, 25 bp, Homo sapien
gttgacatgctggttttggaatctt

SEQ ID NO: 379754 - DNA, 25 bp, Homo sapien
gttttggaatcttacctcctagcct

SEQ ID NO: 379755 - DNA, 25 bp, Homo sapien
tagcctccaaatgtccacagaatct

SEQ ID NO: 379756 - DNA, 25 bp, Homo sapien
aaactatacataggcaacaggcata

SEQ ID NO: 379757 - DNA, 25 bp, Homo sapien
acaggcatatgccacgccagttcat

SEQ ID NO: 379758 - DNA, 25 bp, Homo sapien
acgccagttcatgcttctgagttag

SEQ ID NO: 379759 - DNA, 25 bp, Homo sapien
gcttctgagttagacactctatggt

SEQ ID NO: 379760 - DNA, 25 bp, Homo sapien
gtgggcactgagagcagaaccgcat

SEQ ID NO: 379761 - DNA, 25 bp, Homo sapien
cagaaccgcattgagtcggagtgga

SEQ ID NO: 379762 - DNA, 25 bp, Homo sapien
ggagcacagaagtgtaggtcctttt

SEQ ID NO: 379763 - DNA, 25 bp, Homo sapien
gtccttttgcgctgtttcaagctaa

SEQ ID NO: 379764 - DNA, 25 bp, Homo sapien
gtttcaagctaaacccgtgtcactg

SEQ ID NO: 379765 - DNA, 25 bp, Homo sapien
cgtgtcactgatgccgtacagaagt

SEQ ID NO: 379766 - DNA, 25 bp, Homo sapien
agaagttacagaatgggacgccacc

SEQ ID NO: 379767 - DNA, 25 bp, Homo sapien
aaacattacgtcatccgctgaccat

SEQ ID NO: 379768 - DNA, 25 bp, Homo sapien
tgaccatttccttgcggtcttccca

SEQ ID NO: 379769 - DNA, 25 bp, Homo sapien
tcccaccgtctaaatcgccatataa

SEQ ID NO: 379770 - DNA, 25 bp, Homo sapien
ggttcagctcctgggcgacagcgta

SEQ ID NO: 379771 - DNA, 25 bp, Homo sapien
ttgagccttatttataattgtccta

SEQ ID NO: 379772 - DNA, 25 bp, Homo sapien
aattgtcctatgaagttatattgta

SEQ ID NO: 379773 - DNA, 25 bp, Homo sapien
gttatattgtatcattctgtgtttg

SEQ ID NO: 379774 - DNA, 25 bp, Homo sapien
cattctgtgtttgttgcagtatcat

SEQ ID NO: 379775 - DNA, 25 bp, Homo sapien
gtaaaaagctacattgcaacacaat

SEQ ID NO: 379776 - DNA, 25 bp, Homo sapien
cacaataaaatacttcaatgcttac

SEQ ID NO: 379777 - DNA, 25 bp, Homo sapien
caatgcttacaataggaagtcttga

SEQ ID NO: 379778 - DNA, 25 bp, Homo sapien
ggaagtcttgaaatagtatcctgac

SEQ ID NO: 379779 - DNA, 25 bp, Homo sapien
atagtatcctgacatggtattagaa

SEQ ID NO: 379780 - DNA, 25 bp, Homo sapien
tggtattagaaagtcttatctgcag

SEQ ID NO: 379781 - DNA, 25 bp, Homo sapien
gaaagtcttatctgcagaataacac

SEQ ID NO: 379782 - DNA, 25 bp, Homo sapien
gatcgtttgagcctgcaaggtggag

SEQ ID NO: 379783 - DNA, 25 bp, Homo sapien
atcgtttgagcctgcaaggtggagg

SEQ ID NO: 379784 - DNA, 25 bp, Homo sapien
tcgtttgagcctgcaaggtggaggt

SEQ ID NO: 379785 - DNA, 25 bp, Homo sapien
cgtttgagcctgcaaggtggaggtt

SEQ ID NO: 379786 - DNA, 25 bp, Homo sapien
cgaggggggcagattacttgggctc

SEQ ID NO: 379787 - DNA, 25 bp, Homo sapien
gaggggggcagattacttgggctca

SEQ ID NO: 379788 - DNA, 25 bp, Homo sapien
aggggggcagattacttgggctcag

SEQ ID NO: 379789 - DNA, 25 bp, Homo sapien
ggggggcagattacttgggctcagg

SEQ ID NO: 379790 - DNA, 25 bp, Homo sapien
gggggcagattacttgggctcagga

SEQ ID NO: 379791 - DNA, 25 bp, Homo sapien
ttacttgggctcaggagtcggagac

SEQ ID NO: 379792 - DNA, 25 bp, Homo sapien
tacttgggctcaggagtcggagacc

SEQ ID NO: 379793 - DNA, 25 bp, Homo sapien
taaccatgtgccaccgagagaccat

SEQ ID NO: 379794 - DNA, 25 bp, Homo sapien
atgtgccaccgagagaccatgatca

SEQ ID NO: 379795 - DNA, 25 bp, Homo sapien
gtgccaccgagagaccatgatcaaa

SEQ ID NO: 379796 - DNA, 25 bp, Homo sapien
ccaccgagagaccatgatcaaaaat

SEQ ID NO: 379797 - DNA, 25 bp, Homo sapien
atagagaaggatattgcagctcatc

SEQ ID NO: 379798 - DNA, 25 bp, Homo sapien
gaacttcggtagttacatgacacgt

SEQ ID NO: 379799 - DNA, 25 bp, Homo sapien
acttcggtagttacatgacacgtga

SEQ ID NO: 379800 - DNA, 25 bp, Homo sapien
tcggtagttacatgacacgtgaaat

SEQ ID NO: 379801 - DNA, 25 bp, Homo sapien
gtagttacatgacacgtgaaatcaa

SEQ ID NO: 379802 - DNA, 25 bp, Homo sapien
atgacacgtgaaatcaaacacttca

SEQ ID NO: 379803 - DNA, 25 bp, Homo sapien
acggtaaccatgtgccaccgagaga

SEQ ID NO: 379804 - DNA, 25 bp, Homo sapien
gaaaatcatggcttcactgggaaat

SEQ ID NO: 379805 - DNA, 25 bp, Homo sapien
aatgttttaaatctacatgtagcta

SEQ ID NO: 379806 - DNA, 25 bp, Homo sapien
catgtagctaggatatgtgatttca

SEQ ID NO: 379807 - DNA, 25 bp, Homo sapien
gcaaagtggttttattacagcgtta

SEQ ID NO: 379808 - DNA, 25 bp, Homo sapien
tctgatagattgtgctgatgaacct

SEQ ID NO: 379809 - DNA, 25 bp, Homo sapien
gatgaacctggttgtgggcaattga

SEQ ID NO: 379810 - DNA, 25 bp, Homo sapien
gttgtgggcaattgaattcttgtct

SEQ ID NO: 379811 - DNA, 25 bp, Homo sapien
ttgaattcttgtcttcccactacca

SEQ ID NO: 379812 - DNA, 25 bp, Homo sapien
cttgtcttcccactaccatttcatg

SEQ ID NO: 379813 - DNA, 25 bp, Homo sapien
ctgtcgtctgaacactattcaacac

SEQ ID NO: 379814 - DNA, 25 bp, Homo sapien
gtctgaacactattcaacaccatta

SEQ ID NO: 379815 - DNA, 25 bp, Homo sapien
gccatgaaccttgccatgggtgagg

SEQ ID NO: 379816 - DNA, 25 bp, Homo sapien
gatactatattttctccccaatacc

SEQ ID NO: 379817 - DNA, 25 bp, Homo sapien
aataccaccaacgaagtaacagatg

SEQ ID NO: 379818 - DNA, 25 bp, Homo sapien
cagatgagtctttcatgctgtgatt

SEQ ID NO: 379819 - DNA, 25 bp, Homo sapien
ggattaagatacaaggtgagcccag

SEQ ID NO: 379820 - DNA, 25 bp, Homo sapien
agatacaaggtgagcccagagatga

SEQ ID NO: 379821 - DNA, 25 bp, Homo sapien
gatgaattgggcacacatttcctgg

SEQ ID NO: 379822 - DNA, 25 bp, Homo sapien
ccactgcaagcctgggatatccaga

SEQ ID NO: 379823 - DNA, 25 bp, Homo sapien
gggatatccagaggcatcttcctca

SEQ ID NO: 379824 - DNA, 25 bp, Homo sapien
gcacccctaggtgcctgtgggctgt

SEQ ID NO: 379825 - DNA, 25 bp, Homo sapien
gtgggctgtgccttacatttaataa

SEQ ID NO: 379826 - DNA, 25 bp, Homo sapien
gtttctaaagaattctggcttcaca

SEQ ID NO: 379827 - DNA, 25 bp, Homo sapien
ttctggcttcacattgactcatgtt

SEQ ID NO: 379828 - DNA, 25 bp, Homo sapien
attgactcatgtttctttcactcca

SEQ ID NO: 379829 - DNA, 25 bp, Homo sapien
catgtttctttcactccattttgaa

SEQ ID NO: 379830 - DNA, 25 bp, Homo sapien
ttgcttgggtaagcatcttctggga

SEQ ID NO: 379831 - DNA, 25 bp, Homo sapien
cttctgggaactttgtatctatggt

SEQ ID NO: 379832 - DNA, 25 bp, Homo sapien
gggaactttgtatctatggtatata

SEQ ID NO: 379833 - DNA, 25 bp, Homo sapien
ttttttctagtttcaactccgtcat

SEQ ID NO: 379834 - DNA, 25 bp, Homo sapien
ctagtttcaactccgtcatagtttt

SEQ ID NO: 379835 - DNA, 25 bp, Homo sapien
gatatgtgaattcaactttctgtgt

SEQ ID NO: 379836 - DNA, 25 bp, Homo sapien
gtattgaagtagcaaaaaccatctt

SEQ ID NO: 379837 - DNA, 25 bp, Homo sapien
aaggactgcgtggtgggagccctgc

SEQ ID NO: 379838 - DNA, 25 bp, Homo sapien
tccacccagctgttagcatgatgtc

SEQ ID NO: 379839 - DNA, 25 bp, Homo sapien
tagcatgatgtcttacctcaaacaa

SEQ ID NO: 379840 - DNA, 25 bp, Homo sapien
atgatgtcttacctcaaacaacccc

SEQ ID NO: 379841 - DNA, 25 bp, Homo sapien
catacggcatgaacgggctgggcct

SEQ ID NO: 379842 - DNA, 25 bp, Homo sapien
gggctatccggccactccgcggaag

SEQ ID NO: 379843 - DNA, 25 bp, Homo sapien
accttcacgcgttcacagctggacg

SEQ ID NO: 379844 - DNA, 25 bp, Homo sapien
gcgttcacagctggacgtgctcgag

SEQ ID NO: 379845 - DNA, 25 bp, Homo sapien
agctggacgtgctcgaggcgctctt

SEQ ID NO: 379846 - DNA, 25 bp, Homo sapien
gtgctcgaggcgctcttcgccaaga

SEQ ID NO: 379847 - DNA, 25 bp, Homo sapien
tcgaggcgctcttcgccaagactcg

SEQ ID NO: 379848 - DNA, 25 bp, Homo sapien
cgtgggtgctgtagccccactcact

SEQ ID NO: 379849 - DNA, 25 bp, Homo sapien
tgacatcaccagagcacatgctcag

SEQ ID NO: 379850 - DNA, 25 bp, Homo sapien
agcacatgctcagtatgttgccacc

SEQ ID NO: 379851 - DNA, 25 bp, Homo sapien
acctcccaaatccagaagggtgtgg

SEQ ID NO: 379852 - DNA, 25 bp, Homo sapien
agaagggtgtggtcttagatgccat

SEQ ID NO: 379853 - DNA, 25 bp, Homo sapien
gatgccatggaagcgattctgtaca

SEQ ID NO: 379854 - DNA, 25 bp, Homo sapien
agcgattctgtacaatgccgagtca

SEQ ID NO: 379855 - DNA, 25 bp, Homo sapien
aatgccgagtcagtcacaggctgat

SEQ ID NO: 379856 - DNA, 25 bp, Homo sapien
tcagtcacaggctgatgtggcagct

SEQ ID NO: 379857 - DNA, 25 bp, Homo sapien
caggccagctgctcaatagaagcgt

SEQ ID NO: 379858 - DNA, 25 bp, Homo sapien
aatagaagcgtctgcgtcccttgtc

SEQ ID NO: 379859 - DNA, 25 bp, Homo sapien
aggctggctgcagccctgtgtacag

SEQ ID NO: 379860 - DNA, 25 bp, Homo sapien
tgcatgaggtatgcctgcaccaggt

SEQ ID NO: 379861 - DNA, 25 bp, Homo sapien
ctgtgtacagacgaggagggttcct

SEQ ID NO: 379862 - DNA, 25 bp, Homo sapien
tgctggtgctcacttgcctagtgct

SEQ ID NO: 379863 - DNA, 25 bp, Homo sapien
tagtgctcgcactcctggctgtcta

SEQ ID NO: 379864 - DNA, 25 bp, Homo sapien
gctgtctacctgagcgtgctgcaga

SEQ ID NO: 379865 - DNA, 25 bp, Homo sapien
tgctgcagagtgaatccctgcgcat

SEQ ID NO: 379866 - DNA, 25 bp, Homo sapien
gtggagtccatcagcgacctacata

SEQ ID NO: 379867 - DNA, 25 bp, Homo sapien
gacctacatagtggagcaggcacac

SEQ ID NO: 379868 - DNA, 25 bp, Homo sapien
actgcgcccctatctaactgaagag

SEQ ID NO: 379869 - DNA, 25 bp, Homo sapien
tctaactgaagaggcacgaccgtgg

SEQ ID NO: 379870 - DNA, 25 bp, Homo sapien
aaatatatttgccatacccaactga

SEQ ID NO: 379871 - DNA, 25 bp, Homo sapien
tttgccatacccaactgaaacggaa

SEQ ID NO: 379872 - DNA, 25 bp, Homo sapien
acaagaacccagagttttctcctca

SEQ ID NO: 379873 - DNA, 25 bp, Homo sapien
agagttttctcctcatctgtaactt

SEQ ID NO: 379874 - DNA, 25 bp, Homo sapien
ttctcctcatctgtaactttcattg

SEQ ID NO: 379875 - DNA, 25 bp, Homo sapien
gtaactttcattgtactagaacctt

SEQ ID NO: 379876 - DNA, 25 bp, Homo sapien
gaaccttattgaattcttatggcaa

SEQ ID NO: 379877 - DNA, 25 bp, Homo sapien
gaattcttatggcaagagtctgatt

SEQ ID NO: 379878 - DNA, 25 bp, Homo sapien
gagtctgattaatgttctctctcca

SEQ ID NO: 379879 - DNA, 25 bp, Homo sapien
ctgattaatgttctctctccatgtt

SEQ ID NO: 379880 - DNA, 25 bp, Homo sapien
gttttacatcattcacagttgtgtc

SEQ ID NO: 379881 - DNA, 25 bp, Homo sapien
ccagccaggagcactgagtcagcag

SEQ ID NO: 379882 - DNA, 25 bp, Homo sapien
ccaggagcactgagtcagcagcaca

SEQ ID NO: 379883 - DNA, 25 bp, Homo sapien
gcgcagttgatccacataaagcctc

SEQ ID NO: 379884 - DNA, 25 bp, Homo sapien
gttgatccacataaagcctcacatt

SEQ ID NO: 379885 - DNA, 25 bp, Homo sapien
ggagcactgctctgggtgagtggtt

SEQ ID NO: 379886 - DNA, 25 bp, Homo sapien
gggtgagtggttgtgctaatgcccc

SEQ ID NO: 379887 - DNA, 25 bp, Homo sapien
atgccccaagacaagcagcctctgt

SEQ ID NO: 379888 - DNA, 25 bp, Homo sapien
tggctggctctgcaggctaaacccc

SEQ ID NO: 379889 - DNA, 25 bp, Homo sapien
agccacttctctagccataaagcag

SEQ ID NO: 379890 - DNA, 25 bp, Homo sapien
ttctctagccataaagcagccccag

SEQ ID NO: 379891 - DNA, 25 bp, Homo sapien
tagccataaagcagccccagccagg

SEQ ID NO: 379892 - DNA, 25 bp, Homo sapien
aagttgttatgcactttgggatagt

SEQ ID NO: 379893 - DNA, 25 bp, Homo sapien
tagtggtgatctgtacaggctgtgt

SEQ ID NO: 379894 - DNA, 25 bp, Homo sapien
acaggctgtgtgttagctacttgaa

SEQ ID NO: 379895 - DNA, 25 bp, Homo sapien
tagctacttgaaggcgtaactggta

SEQ ID NO: 379896 - DNA, 25 bp, Homo sapien
ggcgtaactggtatttcttgtgtgt

SEQ ID NO: 379897 - DNA, 25 bp, Homo sapien
taacagcatgacttcttacagagct

SEQ ID NO: 379898 - DNA, 25 bp, Homo sapien
gcatgacttcttacagagctgtaat

SEQ ID NO: 379899 - DNA, 25 bp, Homo sapien
gaggatgccatatttgagatgtcag

SEQ ID NO: 379900 - DNA, 25 bp, Homo sapien
gagatgtcagttttaacactcatta

SEQ ID NO: 379901 - DNA, 25 bp, Homo sapien
ttaacacactactgtgcaagcattg

SEQ ID NO: 379902 - DNA, 25 bp, Homo sapien
gcaagcattgacacaggctgcactg

SEQ ID NO: 379903 - DNA, 25 bp, Homo sapien
agagtcggcccgatcaggtgacgcc

SEQ ID NO: 379904 - DNA, 25 bp, Homo sapien
gtgacgcctgagctgtcaccgctgt

SEQ ID NO: 379905 - DNA, 25 bp, Homo sapien
gctgtcaccacttacacacagggtg

SEQ ID NO: 379906 - DNA, 25 bp, Homo sapien
gtcaccacttacacacagggtgtgt

SEQ ID NO: 379907 - DNA, 25 bp, Homo sapien
caaagtggtgcgtgccagggagggc

SEQ ID NO: 379908 - DNA, 25 bp, Homo sapien
gctaagtgaccgagggcaggcacgt

SEQ ID NO: 379909 - DNA, 25 bp, Homo sapien
ggcgctgacaatggccaccagtgag

SEQ ID NO: 379910 - DNA, 25 bp, Homo sapien
acaatggccaccagtgagcagggcc

SEQ ID NO: 379911 - DNA, 25 bp, Homo sapien
caggcacatgggaggtggcccctcc

SEQ ID NO: 379912 - DNA, 25 bp, Homo sapien
tgaccacggagccatcgtgtctgca

SEQ ID NO: 379913 - DNA, 25 bp, Homo sapien
gagccatcgtgtctgcagaggccca

SEQ ID NO: 379914 - DNA, 25 bp, Homo sapien
ctgctctggataacttgagacatga

SEQ ID NO: 379915 - DNA, 25 bp, Homo sapien
gaagcatcagtgtgcatctacgcag

SEQ ID NO: 379916 - DNA, 25 bp, Homo sapien
atcctggccagctgctggcagaact

SEQ ID NO: 379917 - DNA, 25 bp, Homo sapien
agaactcctggctgccgcacgggaa

SEQ ID NO: 379918 - DNA, 25 bp, Homo sapien
tcatgggtgtgttactcagccacca

SEQ ID NO: 379919 - DNA, 25 bp, Homo sapien
ggagccccagctgtgagaacctgcc

SEQ ID NO: 379920 - DNA, 25 bp, Homo sapien
tgggctcctggaagatgtccttgaa

SEQ ID NO: 379921 - DNA, 25 bp, Homo sapien
tccttgaagaagtgacgtccctgag

SEQ ID NO: 379922 - DNA, 25 bp, Homo sapien
ttgaagaagtgacgtccctgagccc

SEQ ID NO: 379923 - DNA, 25 bp, Homo sapien
gaagaagtgacgtccctgagcccca

SEQ ID NO: 379924 - DNA, 25 bp, Homo sapien
gaagtgacgtccctgagccccaaac

SEQ ID NO: 379925 - DNA, 25 bp, Homo sapien
cgcccggctgtgcgtctgcacattg

SEQ ID NO: 379926 - DNA, 25 bp, Homo sapien
gattttcccagaattgttttattct

SEQ ID NO: 379927 - DNA, 25 bp, Homo sapien
tttattctgtaagggacagggtctc

SEQ ID NO: 379928 - DNA, 25 bp, Homo sapien
catgatcatagcctgctgtaatctc

SEQ ID NO: 379929 - DNA, 25 bp, Homo sapien
gatcatagcctgctgtaatctctaa

SEQ ID NO: 379930 - DNA, 25 bp, Homo sapien
tcatagcctgctgtaatctctaact

SEQ ID NO: 379931 - DNA, 25 bp, Homo sapien
catagcctgctgtaatctctaactc

SEQ ID NO: 379932 - DNA, 25 bp, Homo sapien
atagcctgctgtaatctctaactcc

SEQ ID NO: 379933 - DNA, 25 bp, Homo sapien
tagcctgctgtaatctctaactcct

SEQ ID NO: 379934 - DNA, 25 bp, Homo sapien
gcagaggttgtttgcagtccagcct

SEQ ID NO: 379935 - DNA, 25 bp, Homo sapien
cagaggttgtttgcagtccagcctg

SEQ ID NO: 379936 - DNA, 25 bp, Homo sapien
gcatgtttgacttttgacaataaca

SEQ ID NO: 379937 - DNA, 25 bp, Homo sapien
gtatacaatatcagaacttcacatt

SEQ ID NO: 379938 - DNA, 25 bp, Homo sapien
gaacttcacattttatatactagta

SEQ ID NO: 379939 - DNA, 25 bp, Homo sapien
agtatctggctattagtattttaca

SEQ ID NO: 379940 - DNA, 25 bp, Homo sapien
tagtattttacaggaaccatagttc

SEQ ID NO: 379941 - DNA, 25 bp, Homo sapien
aaccatagttcttggtgactacata

SEQ ID NO: 379942 - DNA, 25 bp, Homo sapien
tgtaaactaagtgccgtttcaacgt

SEQ ID NO: 379943 - DNA, 25 bp, Homo sapien
gccgtttcaacgttacaatcatttt

SEQ ID NO: 379944 - DNA, 25 bp, Homo sapien
aaatctgttctgagcctatagtgtt

SEQ ID NO: 379945 - DNA, 25 bp, Homo sapien
ctgagcctatagtgtttgctttgtg

SEQ ID NO: 379946 - DNA, 25 bp, Homo sapien
gtttgctttgtgaacatgtgtattg

SEQ ID NO: 379947 - DNA, 25 bp, Homo sapien
aacagtgctacttagttatcagtat

SEQ ID NO: 379948 - DNA, 25 bp, Homo sapien
gaagataattggcttgatgtcctag

SEQ ID NO: 379949 - DNA, 25 bp, Homo sapien
gatgtcctagaagttctttgatcca

SEQ ID NO: 379950 - DNA, 25 bp, Homo sapien
gttctttgatccagaggtgggtgca

SEQ ID NO: 379951 - DNA, 25 bp, Homo sapien
gtgggtgcagctgaaagtaaacaga

SEQ ID NO: 379952 - DNA, 25 bp, Homo sapien
tggattgccagttacatgtatgcct

SEQ ID NO: 379953 - DNA, 25 bp, Homo sapien
agttacatgtatgcctgcccagttc

SEQ ID NO: 379954 - DNA, 25 bp, Homo sapien
gcccagttccctttttatttgcaga

SEQ ID NO: 379955 - DNA, 25 bp, Homo sapien
tccctttttatttgcagaagctgtg

SEQ ID NO: 379956 - DNA, 25 bp, Homo sapien
ttttgttcacaattaggttcctagg

SEQ ID NO: 379957 - DNA, 25 bp, Homo sapien
ggagcaaaacctcaaggattgattt

SEQ ID NO: 379958 - DNA, 25 bp, Homo sapien
tttgagatcccctgggccaagacag

SEQ ID NO: 379959 - DNA, 25 bp, Homo sapien
acacactccccgcataaatgtaaaa

SEQ ID NO: 379960 - DNA, 25 bp, Homo sapien
ttaaactaccaattcctaggcaaag

SEQ ID NO: 379961 - DNA, 25 bp, Homo sapien
gatgattctaacattctgttccttt

SEQ ID NO: 379962 - DNA, 25 bp, Homo sapien
ttctgttccttttgacaagtgtcca

SEQ ID NO: 379963 - DNA, 25 bp, Homo sapien
agagaatgctgagaatgtcccctgc

SEQ ID NO: 379964 - DNA, 25 bp, Homo sapien
cctgcatatcggctctgttggagag

SEQ ID NO: 379965 - DNA, 25 bp, Homo sapien
gttggagagcccctgatttttagca

SEQ ID NO: 379966 - DNA, 25 bp, Homo sapien
agcccctgatttttagcagacctgt

SEQ ID NO: 379967 - DNA, 25 bp, Homo sapien
agcagacctgtttcattcaacatgg

SEQ ID NO: 379968 - DNA, 25 bp, Homo sapien
gtttcattcaacatgggttacccag

SEQ ID NO: 379969 - DNA, 25 bp, Homo sapien
agtgagtagtgctgggcctgaaccc

SEQ ID NO: 379970 - DNA, 25 bp, Homo sapien
aaagtccacactcttgctatagccg

SEQ ID NO: 379971 - DNA, 25 bp, Homo sapien
cacactcttgctatagccgctgagg

SEQ ID NO: 379972 - DNA, 25 bp, Homo sapien
actcttgctatagccgctgaggcag

SEQ ID NO: 379973 - DNA, 25 bp, Homo sapien
ggacctggggctgtttgtatcccag

SEQ ID NO: 379974 - DNA, 25 bp, Homo sapien
ggcctccacctacgtaacagaaatg

SEQ ID NO: 379975 - DNA, 25 bp, Homo sapien
tacgtaacagaaatgcggctcagaa

SEQ ID NO: 379976 - DNA, 25 bp, Homo sapien
gaaatgcggctcagaaagaccaagt

SEQ ID NO: 379977 - DNA, 25 bp, Homo sapien
tgcggctcagaaagaccaagtgaca

SEQ ID NO: 379978 - DNA, 25 bp, Homo sapien
agaaagaccaagtgacagctagtga

SEQ ID NO: 379979 - DNA, 25 bp, Homo sapien
gaccaagtgacagctagtgagtagt

SEQ ID NO: 379980 - DNA, 25 bp, Homo sapien
catgtttacgagtgttagaaggcca

SEQ ID NO: 379981 - DNA, 25 bp, Homo sapien
aattggtgcgttgtattcgatttga

SEQ ID NO: 379982 - DNA, 25 bp, Homo sapien
taaagtgtgggatcttgtggctgct

SEQ ID NO: 379983 - DNA, 25 bp, Homo sapien
ctgcagggacactctgtctacggac

SEQ ID NO: 379984 - DNA, 25 bp, Homo sapien
tgtctacggacccttgtggagcatt

SEQ ID NO: 379985 - DNA, 25 bp, Homo sapien
gacccttgtggagcattccggaaga

SEQ ID NO: 379986 - DNA, 25 bp, Homo sapien
ttccggaagagtttttcgactacag

SEQ ID NO: 379987 - DNA, 25 bp, Homo sapien
tcgactacagtttgatgaattccag

SEQ ID NO: 379988 - DNA, 25 bp, Homo sapien
ttccagattgtcagtagttcacatg

SEQ ID NO: 379989 - DNA, 25 bp, Homo sapien
atgacacaatcctcatctgggactt

SEQ ID NO: 379990 - DNA, 25 bp, Homo sapien
catctgggacttcctaaatgatcca

SEQ ID NO: 379991 - DNA, 25 bp, Homo sapien
cggaacatttctcatcagctgtgta

SEQ ID NO: 379992 - DNA, 25 bp, Homo sapien
atttctcatcagctgtgtacactat

SEQ ID NO: 379993 - DNA, 25 bp, Homo sapien
atcagctgtgtacactatgtcaggc

SEQ ID NO: 379994 - DNA, 25 bp, Homo sapien
gtgtacactatgtcaggcatttcaa

SEQ ID NO: 379995 - DNA, 25 bp, Homo sapien
ctatgtcaggcatttcaaatatgtt

SEQ ID NO: 379996 - DNA, 25 bp, Homo sapien
ttctggaagttgtcagtgctgttct

SEQ ID NO: 379997 - DNA, 25 bp, Homo sapien
agtgctgttctctatgaggcctgaa

SEQ ID NO: 379998 - DNA, 25 bp, Homo sapien
gggagctttggagagctttccattt

SEQ ID NO: 379999 - DNA, 25 bp, Homo sapien
ggagagctttccattttggattagt

SEQ ID NO: 380000 - DNA, 25 bp, Homo sapien
cattttggattagtgatttccctgt

SEQ ID NO: 380001 - DNA, 25 bp, Homo sapien
tttccctcgtttttgtcacagcaca

SEQ ID NO: 380002 - DNA, 25 bp, Homo sapien
atgttggacagtggaaaagtatcta

SEQ ID NO: 380003 - DNA, 25 bp, Homo sapien
aagtatctagagtttttacctgcct

SEQ ID NO: 380004 - DNA, 25 bp, Homo sapien
agagtttttacctgccttatctgaa

SEQ ID NO: 380005 - DNA, 25 bp, Homo sapien
gtttttacctgccttatctgaattc

SEQ ID NO: 380006 - DNA, 25 bp, Homo sapien
tacctgccttatctgaattcttctt

SEQ ID NO: 380007 - DNA, 25 bp, Homo sapien
ttgaaacttgagcttaaactctaat

SEQ ID NO: 380008 - DNA, 25 bp, Homo sapien
taaactctaatagctgtttcccttt

SEQ ID NO: 380009 - DNA, 25 bp, Homo sapien
gtttccctttctattctgaacaact

SEQ ID NO: 380010 - DNA, 25 bp, Homo sapien
ttctattctgaacaactgtctccat

SEQ ID NO: 380011 - DNA, 25 bp, Homo sapien
aacaactgtctccatttttcaagtg

SEQ ID NO: 380012 - DNA, 25 bp, Homo sapien
gatgacatctcatttattttgagta

SEQ ID NO: 380013 - DNA, 25 bp, Homo sapien
ttccagtcctaaacatctgtcctgc

SEQ ID NO: 380014 - DNA, 25 bp, Homo sapien
cagtcctaaacatctgtcctgctga

SEQ ID NO: 380015 - DNA, 25 bp, Homo sapien
agtcctaaacatctgtcctgctgac

SEQ ID NO: 380016 - DNA, 25 bp, Homo sapien
gtcctaaacatctgtcctgctgaca

SEQ ID NO: 380017 - DNA, 25 bp, Homo sapien
tcctaaacatctgtcctgctgacat

SEQ ID NO: 380018 - DNA, 25 bp, Homo sapien
gccagaactacccatctaagctgtt

SEQ ID NO: 380019 - DNA, 25 bp, Homo sapien
atctaagctgttccctgattgccaa

SEQ ID NO: 380020 - DNA, 25 bp, Homo sapien
ctaagctgttccctgattgccaacc

SEQ ID NO: 380021 - DNA, 25 bp, Homo sapien
taagctgttccctgattgccaaccc

SEQ ID NO: 380022 - DNA, 25 bp, Homo sapien
ttccctgattgccaaccctcagaaa

SEQ ID NO: 380023 - DNA, 25 bp, Homo sapien
tagctttttttgagctgaagcagga

SEQ ID NO: 380024 - DNA, 25 bp, Homo sapien
tggacattcaatggttcctttttcc

SEQ ID NO: 380025 - DNA, 25 bp, Homo sapien
ttcaactgatgccaaaccttggatt

SEQ ID NO: 380026 - DNA, 25 bp, Homo sapien
gatgccaaaccttggatttggttta

SEQ ID NO: 380027 - DNA, 25 bp, Homo sapien
tggatttggtttaatccacctttgg

SEQ ID NO: 380028 - DNA, 25 bp, Homo sapien
gttaaaccgatttggatgaccctgt

SEQ ID NO: 380029 - DNA, 25 bp, Homo sapien
aaccgatttggatgaccctgtgagt

SEQ ID NO: 380030 - DNA, 25 bp, Homo sapien
atttggatgaccctgtgagtcgcca

SEQ ID NO: 380031 - DNA, 25 bp, Homo sapien
tgaccctgtgagtcgccactggata

SEQ ID NO: 380032 - DNA, 25 bp, Homo sapien
tgagtcgccactggataccgacagt

SEQ ID NO: 380033 - DNA, 25 bp, Homo sapien
actggataccgacagtctgctgtgg

SEQ ID NO: 380034 - DNA, 25 bp, Homo sapien
taccgacagtctgctgtggtgctta

SEQ ID NO: 380035 - DNA, 25 bp, Homo sapien
ttgtacctgttaatttttgtgggat

SEQ ID NO: 380036 - DNA, 25 bp, Homo sapien
ttgtgggatgttgttcccattcttc

SEQ ID NO: 380037 - DNA, 25 bp, Homo sapien
ttcccattcttctttgtgagacaga

SEQ ID NO: 380038 - DNA, 25 bp, Homo sapien
aaatctggctggctacagtgtagat

SEQ ID NO: 380039 - DNA, 25 bp, Homo sapien
atttctaaagatcctgcttttttgt

SEQ ID NO: 380040 - DNA, 25 bp, Homo sapien
gggcagacaattgcaatacttgtac

SEQ ID NO: 380041 - DNA, 25 bp, Homo sapien
gcaatacttgtactaaacactggaa

SEQ ID NO: 380042 - DNA, 25 bp, Homo sapien
ggaatacaaatgcatgactcatatc

SEQ ID NO: 380043 - DNA, 25 bp, Homo sapien
gtacatatactgttcttggttttat

SEQ ID NO: 380044 - DNA, 25 bp, Homo sapien
ttggttttattgttccacttgaata

SEQ ID NO: 380045 - DNA, 25 bp, Homo sapien
gttccacttgaatatttctactgta

SEQ ID NO: 380046 - DNA, 25 bp, Homo sapien
ctggatttgtgcactgtactgtgtg

SEQ ID NO: 380047 - DNA, 25 bp, Homo sapien
tactgtgtgcacagtctgcatgaaa

SEQ ID NO: 380048 - DNA, 25 bp, Homo sapien
gaaaattgcgtagacttcagtgtgg

SEQ ID NO: 380049 - DNA, 25 bp, Homo sapien
ttaggtgctgaactgactgattctt

SEQ ID NO: 380050 - DNA, 25 bp, Homo sapien
actgactgattctttgttgaggagg

SEQ ID NO: 380051 - DNA, 25 bp, Homo sapien
gaggaggatggtctcaacatcatta

SEQ ID NO: 380052 - DNA, 25 bp, Homo sapien
caacatcattatggagaggccaggt

SEQ ID NO: 380053 - DNA, 25 bp, Homo sapien
agtggcttggattctccaggtgtcc

SEQ ID NO: 380054 - DNA, 25 bp, Homo sapien
ttggattctccaggtgtccatatgt

SEQ ID NO: 380055 - DNA, 25 bp, Homo sapien
tatgaattacaatgtgttgccctct

SEQ ID NO: 380056 - DNA, 25 bp, Homo sapien
atgtgttgccctctggatttgtgca

SEQ ID NO: 380057 - DNA, 25 bp, Homo sapien
cctgtgccttccttgcgggcagaga

SEQ ID NO: 380058 - DNA, 25 bp, Homo sapien
gagagaagggctccccagatctaca

SEQ ID NO: 380059 - DNA, 25 bp, Homo sapien
tgcatctcccctggagtgttcactt

SEQ ID NO: 380060 - DNA, 25 bp, Homo sapien
ggagtgttcacttgcaagctgccaa

SEQ ID NO: 380061 - DNA, 25 bp, Homo sapien
gttcacttgcaagctgccaaaacat

SEQ ID NO: 380062 - DNA, 25 bp, Homo sapien
ccaaaacatgatggcctctggttgt

SEQ ID NO: 380063 - DNA, 25 bp, Homo sapien
atggcctctggttgttctgttgaac

SEQ ID NO: 380064 - DNA, 25 bp, Homo sapien
ggttgttctgttgaactccttgaac

SEQ ID NO: 380065 - DNA, 25 bp, Homo sapien
tgaactccttgaacgtttagaccct

SEQ ID NO: 380066 - DNA, 25 bp, Homo sapien
aaggagtctatacctggacacccac

SEQ ID NO: 380067 - DNA, 25 bp, Homo sapien
cttccccatgcacacatctggaagg

SEQ ID NO: 380068 - DNA, 25 bp, Homo sapien
catgctgaactccaggtgagaactc

SEQ ID NO: 380069 - DNA, 25 bp, Homo sapien
gaactccaggtgagaactctcctct

SEQ ID NO: 380070 - DNA, 25 bp, Homo sapien
tgcccacatgggtcctggctcatga

SEQ ID NO: 380071 - DNA, 25 bp, Homo sapien
ctggctcatgagtaaggaaaaggtg

SEQ ID NO: 380072 - DNA, 25 bp, Homo sapien
aaaatccagggaagatagcgcagtt

SEQ ID NO: 380073 - DNA, 25 bp, Homo sapien
tccagggaagatagcgcagttgtag

SEQ ID NO: 380074 - DNA, 25 bp, Homo sapien
agatagcgcagttgtaggctcagac

SEQ ID NO: 380075 - DNA, 25 bp, Homo sapien
acactggtcatgtcattgaggtaag

SEQ ID NO: 380076 - DNA, 25 bp, Homo sapien
catgtcattgaggtaagtcagctac

SEQ ID NO: 380077 - DNA, 25 bp, Homo sapien
gtcattgaggtaagtcagctacaaa

SEQ ID NO: 380078 - DNA, 25 bp, Homo sapien
tctttccttccggtttccaaatcat

SEQ ID NO: 380079 - DNA, 25 bp, Homo sapien
ttagaacaagctccctacttttctg

SEQ ID NO: 380080 - DNA, 25 bp, Homo sapien
gaagtgacttgtacacagtggcaag

SEQ ID NO: 380081 - DNA, 25 bp, Homo sapien
gtggcaaggcgggtactcaagtcaa

SEQ ID NO: 380082 - DNA, 25 bp, Homo sapien
ggcgggtactcaagtcaagactcct

SEQ ID NO: 380083 - DNA, 25 bp, Homo sapien
tgactcccagttccccacaaggagt

SEQ ID NO: 380084 - DNA, 25 bp, Homo sapien
tccccacaaggagttagtcagccta

SEQ ID NO: 380085 - DNA, 25 bp, Homo sapien
agaaaataacgtctccactgcctga

SEQ ID NO: 380086 - DNA, 25 bp, Homo sapien
gtctccactgcctgaaacacagtgt

SEQ ID NO: 380087 - DNA, 25 bp, Homo sapien
tcaagggaaaattatctgatcactg

SEQ ID NO: 380088 - DNA, 25 bp, Homo sapien
ctgcagaacattgagacactagaaa

SEQ ID NO: 380089 - DNA, 25 bp, Homo sapien
gaaaattgaatttcgagctcagaaa

SEQ ID NO: 380090 - DNA, 25 bp, Homo sapien
ccaaagctctgcaggtcgaacctta

SEQ ID NO: 380091 - DNA, 25 bp, Homo sapien
ggtcgaaccttatctgctatgggaa

SEQ ID NO: 380092 - DNA, 25 bp, Homo sapien
ttcagattcacgcagggccctctgc

SEQ ID NO: 380093 - DNA, 25 bp, Homo sapien
ggtagccaccaaacacatgcataag

SEQ ID NO: 380094 - DNA, 25 bp, Homo sapien
gacttttcccagaatgctgcagcag

SEQ ID NO: 380095 - DNA, 25 bp, Homo sapien
gaactaccctccagatagacactag

SEQ ID NO: 380096 - DNA, 25 bp, Homo sapien
gccacagtgctacgtgagtcttgca

SEQ ID NO: 380097 - DNA, 25 bp, Homo sapien
atctttatggcgaggctgagagcac

SEQ ID NO: 380098 - DNA, 25 bp, Homo sapien
agagcactgcctgcatgctttacca

SEQ ID NO: 380099 - DNA, 25 bp, Homo sapien
tgcatgctttaccagagcccagcct

SEQ ID NO: 380100 - DNA, 25 bp, Homo sapien
ctccagcctccacggaaaatgtgtt

SEQ ID NO: 380101 - DNA, 25 bp, Homo sapien
gggcaaacgcttagggatcctggtt

SEQ ID NO: 380102 - DNA, 25 bp, Homo sapien
aacgcttagggatcctggttgtctt

SEQ ID NO: 380103 - DNA, 25 bp, Homo sapien
ggatcctggttgtcttctccttcat

SEQ ID NO: 380104 - DNA, 25 bp, Homo sapien
atcaaagaggccattctacccagtc

SEQ ID NO: 380105 - DNA, 25 bp, Homo sapien
tctacccagtcgtcagaagatatac

SEQ ID NO: 380106 - DNA, 25 bp, Homo sapien
agaagatatactgacccccatgcag

SEQ ID NO: 380107 - DNA, 25 bp, Homo sapien
tgacccccatgcaggcaggatgtgg

SEQ ID NO: 380108 - DNA, 25 bp, Homo sapien
gcaagatcaggagagtcaggcccct

SEQ ID NO: 380109 - DNA, 25 bp, Homo sapien
ggcccctgggcctctatgccaggtg

SEQ ID NO: 380110 - DNA, 25 bp, Homo sapien
cttggctcagatctgatgcttcaag

SEQ ID NO: 380111 - DNA, 25 bp, Homo sapien
tgcttcaagaggctgtaacctcaga

SEQ ID NO: 380112 - DNA, 25 bp, Homo sapien
tgggcctccctcttggttgagctga

SEQ ID NO: 380113 - DNA, 25 bp, Homo sapien
tcttggttgagctgagtgtgcctga

SEQ ID NO: 380114 - DNA, 25 bp, Homo sapien
gaggattctccaggtctatcttgat

SEQ ID NO: 380115 - DNA, 25 bp, Homo sapien
tctccaggtctatcttgatttcata

SEQ ID NO: 380116 - DNA, 25 bp, Homo sapien
gatttcataggtccttctcaatcca

SEQ ID NO: 380117 - DNA, 25 bp, Homo sapien
aggtccttctcaatccaaggtcaaa

SEQ ID NO: 380118 - DNA, 25 bp, Homo sapien
gaatcttattttctgcaccaggaac

SEQ ID NO: 380119 - DNA, 25 bp, Homo sapien
gcaccaggaactcagggttatcccc

SEQ ID NO: 380120 - DNA, 25 bp, Homo sapien
aactcagggttatccccaacctatg

SEQ ID NO: 380121 - DNA, 25 bp, Homo sapien
atgatggtcatccaacctgtgtttt

SEQ ID NO: 380122 - DNA, 25 bp, Homo sapien
ttggcctctgagtggatgactggat

SEQ ID NO: 380123 - DNA, 25 bp, Homo sapien
atcctgctggatgagatgaacgcgc

SEQ ID NO: 380124 - DNA, 25 bp, Homo sapien
atgaacgcgcacacttcctggacat

SEQ ID NO: 380125 - DNA, 25 bp, Homo sapien
acatggccgacaagtgccgtgtcaa

SEQ ID NO: 380126 - DNA, 25 bp, Homo sapien
gtgtcaacctgcaccacgtggattt

SEQ ID NO: 380127 - DNA, 25 bp, Homo sapien
acgtggatttcctgcgcgtacggac

SEQ ID NO: 380128 - DNA, 25 bp, Homo sapien
atttcctgcgcgtacggactgtggc

SEQ ID NO: 380129 - DNA, 25 bp, Homo sapien
tactactgccgcactgggaagtcct

SEQ ID NO: 380130 - DNA, 25 bp, Homo sapien
gccacgtcaaggagaagttcctgct

SEQ ID NO: 380131 - DNA, 25 bp, Homo sapien
gggagctacagcttcatgtggtcct

SEQ ID NO: 380132 - DNA, 25 bp, Homo sapien
cacgtgttccaaggagagctggtct

SEQ ID NO: 380133 - DNA, 25 bp, Homo sapien
tggtctccagcttcgacgaggagtt

SEQ ID NO: 380134 - DNA, 25 bp, Homo sapien
gtgatgacagctgtctaaaggtttt

SEQ ID NO: 380135 - DNA, 25 bp, Homo sapien
aatgcacatctcagttacaagcagt

SEQ ID NO: 380136 - DNA, 25 bp, Homo sapien
aatgtttatgaactattcttatgta

SEQ ID NO: 380137 - DNA, 25 bp, Homo sapien
tctcagttacaagcagtactcatag

SEQ ID NO: 380138 - DNA, 25 bp, Homo sapien
tacaattgtcctttactgtactttt

SEQ ID NO: 380139 - DNA, 25 bp, Homo sapien
cagtatagtaccttattttctgctg

SEQ ID NO: 380140 - DNA, 25 bp, Homo sapien
gttaagtgggtgtcaaactccaaga

SEQ ID NO: 380141 - DNA, 25 bp, Homo sapien
gcagtactcatagtttaatatccat

SEQ ID NO: 380142 - DNA, 25 bp, Homo sapien
taatatccatgtaacggtgcatcaa

SEQ ID NO: 380143 - DNA, 25 bp, Homo sapien
gtaacggtgcatcaatatattgcta

SEQ ID NO: 380144 - DNA, 25 bp, Homo sapien
atgtctgtgtgcatataagtgaaaa

SEQ ID NO: 380145 - DNA, 25 bp, Homo sapien
cttcctgtaatgattgatgttcctc

SEQ ID NO: 380146 - DNA, 25 bp, Homo sapien
ttgatgttcctcattctaccagcgt

SEQ ID NO: 380147 - DNA, 25 bp, Homo sapien
acagtgttggtaagcttgaagaaaa

SEQ ID NO: 380148 - DNA, 25 bp, Homo sapien
agaaaaatcgtgcatactggaaaca

SEQ ID NO: 380149 - DNA, 25 bp, Homo sapien
actggaaacaatggtcttgcctcaa

SEQ ID NO: 380150 - DNA, 25 bp, Homo sapien
aacaatggtcttgcctcaaacctgt

SEQ ID NO: 380151 - DNA, 25 bp, Homo sapien
gcctcaaacctgttgagaacttctc

SEQ ID NO: 380152 - DNA, 25 bp, Homo sapien
aaaggagtatcttcgagctctctct

SEQ ID NO: 380153 - DNA, 25 bp, Homo sapien
atcttcgagctctctctatctcata

SEQ ID NO: 380154 - DNA, 25 bp, Homo sapien
tctctatctcatacctaccagcttg

SEQ ID NO: 380155 - DNA, 25 bp, Homo sapien
tacctaccagcttgcatagagtata

SEQ ID NO: 380156 - DNA, 25 bp, Homo sapien
ttgatttgagccactcccactgtca

SEQ ID NO: 380157 - DNA, 25 bp, Homo sapien
actgtcatcagctttcacctggatt

SEQ ID NO: 380158 - DNA, 25 bp, Homo sapien
tggattatcgtgacagcctcctact

SEQ ID NO: 380159 - DNA, 25 bp, Homo sapien
actgcttctctatcatgtggccaga

SEQ ID NO: 380160 - DNA, 25 bp, Homo sapien
tgtggccagagctatcttcctaaaa

SEQ ID NO: 380161 - DNA, 25 bp, Homo sapien
tagttgatcaagtcactctctggcc

SEQ ID NO: 380162 - DNA, 25 bp, Homo sapien
aggataaagtctggacccctcagca

SEQ ID NO: 380163 - DNA, 25 bp, Homo sapien
ggacccctcagcatggcttgtgaga

SEQ ID NO: 380164 - DNA, 25 bp, Homo sapien
ttgtgagactcatggtgtccttgtc

SEQ ID NO: 380165 - DNA, 25 bp, Homo sapien
tggtctcatcacttgccttcttgca

SEQ ID NO: 380166 - DNA, 25 bp, Homo sapien
agcctcctgtatccagagatgcagt

SEQ ID NO: 380167 - DNA, 25 bp, Homo sapien
acagaggcgatgatggaacaacact

SEQ ID NO: 380168 - DNA, 25 bp, Homo sapien
gtgaagagaaccacagcacggctcc

SEQ ID NO: 380169 - DNA, 25 bp, Homo sapien
acggctccccataaaagtcatcttt

SEQ ID NO: 380170 - DNA, 25 bp, Homo sapien
gacagatatttcatggcggcagctt

SEQ ID NO: 380171 - DNA, 25 bp, Homo sapien
ctaattaggcttcccaacctgcaat

SEQ ID NO: 380172 - DNA, 25 bp, Homo sapien
gcagcttgagaaggctcacgtttct

SEQ ID NO: 380173 - DNA, 25 bp, Homo sapien
aaggctcacgtttcttaggcagctg

SEQ ID NO: 380174 - DNA, 25 bp, Homo sapien
acgtttcttaggcagctggtgcaga

SEQ ID NO: 380175 - DNA, 25 bp, Homo sapien
taatcatgagatcttccagtcccag

SEQ ID NO: 380176 - DNA, 25 bp, Homo sapien
aacctgcaatctaacgagcttggtg

SEQ ID NO: 380177 - DNA, 25 bp, Homo sapien
gatgtggctgccaagtttacagcag

SEQ ID NO: 380178 - DNA, 25 bp, Homo sapien
aacacattcctggtttttgcctaca

SEQ ID NO: 380179 - DNA, 25 bp, Homo sapien
ttttgcctacacttacgtgttagac

SEQ ID NO: 380180 - DNA, 25 bp, Homo sapien
tacacttacgtgttagacaagaact

SEQ ID NO: 380181 - DNA, 25 bp, Homo sapien
taaagtactggtgtcaccctttgcc

SEQ ID NO: 380182 - DNA, 25 bp, Homo sapien
gtgtcaccctttgcctatatggtag

SEQ ID NO: 380183 - DNA, 25 bp, Homo sapien
caccctttgcctatatggtagagca

SEQ ID NO: 380184 - DNA, 25 bp, Homo sapien
taaacttctgaaaacccaaggccag

SEQ ID NO: 380185 - DNA, 25 bp, Homo sapien
aaaacccaaggccaggtactgcatt

SEQ ID NO: 380186 - DNA, 25 bp, Homo sapien
caggtactgcattctgaatcagaat

SEQ ID NO: 380187 - DNA, 25 bp, Homo sapien
ctgaatcagaatctcgcagtgtttc

SEQ ID NO: 380188 - DNA, 25 bp, Homo sapien
gaatctcgcagtgtttctgtgaata

SEQ ID NO: 380189 - DNA, 25 bp, Homo sapien
gaataaccatagagcagtgccttta

SEQ ID NO: 380190 - DNA, 25 bp, Homo sapien
gtgcctttaaattagctataggaag

SEQ ID NO: 380191 - DNA, 25 bp, Homo sapien
agtcttttcaagtttctgaacaata

SEQ ID NO: 380192 - DNA, 25 bp, Homo sapien
atatttctcttagttggcacctcac

SEQ ID NO: 380193 - DNA, 25 bp, Homo sapien
agttggcacctcacaaatactagat

SEQ ID NO: 380194 - DNA, 25 bp, Homo sapien
aatactagatcatgtcagacgctgc

SEQ ID NO: 380195 - DNA, 25 bp, Homo sapien
cagacgctgctggttaatagctgca

SEQ ID NO: 380196 - DNA, 25 bp, Homo sapien
atagctgcaggaaggcatgttgtgc

SEQ ID NO: 380197 - DNA, 25 bp, Homo sapien
catgttgtgcagtggatattgctca

SEQ ID NO: 380198 - DNA, 25 bp, Homo sapien
cagtggatattgctcatggaagtgt

SEQ ID NO: 380199 - DNA, 25 bp, Homo sapien
aattctggtgatttcaataacatca

SEQ ID NO: 380200 - DNA, 25 bp, Homo sapien
ctctgaatcacataagtaaggcatc

SEQ ID NO: 380201 - DNA, 25 bp, Homo sapien
aagtaaggcatctttgttgtcaaag

SEQ ID NO: 380202 - DNA, 25 bp, Homo sapien
ttgtcaaagacagcacagggtatta

SEQ ID NO: 380203 - DNA, 25 bp, Homo sapien
gacagcacagggtattaaggacaca

SEQ ID NO: 380204 - DNA, 25 bp, Homo sapien
agaattagtcttttgtgttgtttat

SEQ ID NO: 380205 - DNA, 25 bp, Homo sapien
ttcataatcttttctccttcagtgg

SEQ ID NO: 380206 - DNA, 25 bp, Homo sapien
aatcttttctccttcagtggagtac

SEQ ID NO: 380207 - DNA, 25 bp, Homo sapien
ttttctccttcagtggagtactgat

SEQ ID NO: 380208 - DNA, 25 bp, Homo sapien
tccttcagtggagtactgattgcat

SEQ ID NO: 380209 - DNA, 25 bp, Homo sapien
ctgattgcatgaaatttgatgtgta

SEQ ID NO: 380210 - DNA, 25 bp, Homo sapien
aattgtgtgcctacagttaaaagca

SEQ ID NO: 380211 - DNA, 25 bp, Homo sapien
cgccctggagacaagagccgcagag

SEQ ID NO: 380212 - DNA, 25 bp, Homo sapien
cgggacgccatgaccgcgacagtgc

SEQ ID NO: 380213 - DNA, 25 bp, Homo sapien
gcgacagtgcgcacgcgggatccat

SEQ ID NO: 380214 - DNA, 25 bp, Homo sapien
gatccatgcgcggtgcccggctggt

SEQ ID NO: 380215 - DNA, 25 bp, Homo sapien
tggtgccagcgctcgtccggctgca

SEQ ID NO: 380216 - DNA, 25 bp, Homo sapien
ggagcggacgcccatttcaatgccg

SEQ ID NO: 380217 - DNA, 25 bp, Homo sapien
tgccgtcaggccgtccctgggcatc

SEQ ID NO: 380218 - DNA, 25 bp, Homo sapien
tgggcatcccgcgtctggctgctgt

SEQ ID NO: 380219 - DNA, 25 bp, Homo sapien
catcccgcgtctggctgctgtggaa

SEQ ID NO: 380220 - DNA, 25 bp, Homo sapien
tcccgcgtctggctgctgtggaact

SEQ ID NO: 380221 - DNA, 25 bp, Homo sapien
tggaacattcagaacccaacgccgc

SEQ ID NO: 380222 - DNA, 25 bp, Homo sapien
agacagcaacagagagtaggcggct

SEQ ID NO: 380223 - DNA, 25 bp, Homo sapien
tcacagggcgtcatgtgcctttcta

SEQ ID NO: 380224 - DNA, 25 bp, Homo sapien
cgtcatgtgcctttctattttcatc

SEQ ID NO: 380225 - DNA, 25 bp, Homo sapien
gagattgtggttgcaagcttcagta

SEQ ID NO: 380226 - DNA, 25 bp, Homo sapien
gcaagcttcagtatttgcctcgctt

SEQ ID NO: 380227 - DNA, 25 bp, Homo sapien
tttgcctcgcttcccttttcatatt

SEQ ID NO: 380228 - DNA, 25 bp, Homo sapien
agtacctcagactctgcattccaaa

SEQ ID NO: 380229 - DNA, 25 bp, Homo sapien
agccaaagtgtcgagggcatttaaa

SEQ ID NO: 380230 - DNA, 25 bp, Homo sapien
gtcgagggcatttaaatggcattaa

SEQ ID NO: 380231 - DNA, 25 bp, Homo sapien
gaatctatggagtgggtgaagtacc

SEQ ID NO: 380232 - DNA, 25 bp, Homo sapien
ctatggagtgggtgaagtaccgatt

SEQ ID NO: 380233 - DNA, 25 bp, Homo sapien
ttggtcatcattttactgctctctt

SEQ ID NO: 380234 - DNA, 25 bp, Homo sapien
tttactgctctcttcatgtgatgga

SEQ ID NO: 380235 - DNA, 25 bp, Homo sapien
gctctcttcatgtgatggaaatcaa

SEQ ID NO: 380236 - DNA, 25 bp, Homo sapien
gatggaaatcaattttccttctcaa

SEQ ID NO: 380237 - DNA, 25 bp, Homo sapien
ttccttctcaaatgggatcagtatc

SEQ ID NO: 380238 - DNA, 25 bp, Homo sapien
gggatcagtatcatttcctagtcat

SEQ ID NO: 380239 - DNA, 25 bp, Homo sapien
atttcctagtcatacatccatccag

SEQ ID NO: 380240 - DNA, 25 bp, Homo sapien
acatccatccagtttttgttacttt

SEQ ID NO: 380241 - DNA, 25 bp, Homo sapien
acattaatcaaaatagctctgcttc

SEQ ID NO: 380242 - DNA, 25 bp, Homo sapien
atagctctgcttcattgaggcatgc

SEQ ID NO: 380243 - DNA, 25 bp, Homo sapien
ttcattgaggcatgcagtcctcaga

SEQ ID NO: 380244 - DNA, 25 bp, Homo sapien
taagctctcttcagtctctgtaatg

SEQ ID NO: 380245 - DNA, 25 bp, Homo sapien
atgtttctgattgcatgtttcttca

SEQ ID NO: 380246 - DNA, 25 bp, Homo sapien
taaatgtaggctcagctctttccca

SEQ ID NO: 380247 - DNA, 25 bp, Homo sapien
cagctctttcccaggattttcatca

SEQ ID NO: 380248 - DNA, 25 bp, Homo sapien
aaagctttaagtgcctaaccctgct

SEQ ID NO: 380249 - DNA, 25 bp, Homo sapien
taaccctgcttgtctctgtacatag

SEQ ID NO: 380250 - DNA, 25 bp, Homo sapien
gtctctgtacatagaagcctgcaca

SEQ ID NO: 380251 - DNA, 25 bp, Homo sapien
gatccaacccttgctaggtatcata

SEQ ID NO: 380252 - DNA, 25 bp, Homo sapien
aggtatcatagtttaggcccattta

SEQ ID NO: 380253 - DNA, 25 bp, Homo sapien
tgtactggcagttcagccgcttaca

SEQ ID NO: 380254 - DNA, 25 bp, Homo sapien
cttacatgcactcaccctgtttgtg

SEQ ID NO: 380255 - DNA, 25 bp, Homo sapien
aaaatgacaggccagcagtgactac

SEQ ID NO: 380256 - DNA, 25 bp, Homo sapien
ttatcacgtgtgtaacatctcttga

SEQ ID NO: 380257 - DNA, 25 bp, Homo sapien
tctcttgagggctgctttgtaattc

SEQ ID NO: 380258 - DNA, 25 bp, Homo sapien
ggtgttgttgtaccagtgtaactgc

SEQ ID NO: 380259 - DNA, 25 bp, Homo sapien
actgctaagtggtttctctggttcc

SEQ ID NO: 380260 - DNA, 25 bp, Homo sapien
gtacatgaagttgtgcaatctccac

SEQ ID NO: 380261 - DNA, 25 bp, Homo sapien
aatctccacataccagcagtttcaa

SEQ ID NO: 380262 - DNA, 25 bp, Homo sapien
atgacagtttgcatgaggccatctt

SEQ ID NO: 380263 - DNA, 25 bp, Homo sapien
aggccatcttaatagcaggtagcat

SEQ ID NO: 380264 - DNA, 25 bp, Homo sapien
ggtagcatgtaaccaacccatctga

SEQ ID NO: 380265 - DNA, 25 bp, Homo sapien
aacccatctgaattaagccaccatt

SEQ ID NO: 380266 - DNA, 25 bp, Homo sapien
caccccaccagttttcagaacagag

SEQ ID NO: 380267 - DNA, 25 bp, Homo sapien
ttttcagaacagagaccaacaacag

SEQ ID NO: 380268 - DNA, 25 bp, Homo sapien
gagaggaatccccaaaatcacccag

SEQ ID NO: 380269 - DNA, 25 bp, Homo sapien
ctaggtcacggccaaattgggtcta

SEQ ID NO: 380270 - DNA, 25 bp, Homo sapien
gggtctagaatccagatgtcccgat

SEQ ID NO: 380271 - DNA, 25 bp, Homo sapien
agatgtcccgatttctgcttgctga

SEQ ID NO: 380272 - DNA, 25 bp, Homo sapien
cccgatttctgcttgctgagagata

SEQ ID NO: 380273 - DNA, 25 bp, Homo sapien
tcagtcaagggcaatatcagtcatt

SEQ ID NO: 380274 - DNA, 25 bp, Homo sapien
atcagtcattccgtgacatgtttgg

SEQ ID NO: 380275 - DNA, 25 bp, Homo sapien
ccatgttttgatctgaagtcatagg

SEQ ID NO: 380276 - DNA, 25 bp, Homo sapien
gatgggtttcagacccattcctctc

SEQ ID NO: 380277 - DNA, 25 bp, Homo sapien
ggaatctcaaggactccgactcctg

SEQ ID NO: 380278 - DNA, 25 bp, Homo sapien
atctcaaggactccgactcctggct

SEQ ID NO: 380279 - DNA, 25 bp, Homo sapien
cctggcttgttcagagaaggagagc

SEQ ID NO: 380280 - DNA, 25 bp, Homo sapien
tcccggaatgcgacgtggaggtcca

SEQ ID NO: 380281 - DNA, 25 bp, Homo sapien
gaatgcgacgtggaggtccagcccc

SEQ ID NO: 380282 - DNA, 25 bp, Homo sapien
atgcgacgtggaggtccagccccag

SEQ ID NO: 380283 - DNA, 25 bp, Homo sapien
agccccagggccatcccgaggagtc

SEQ ID NO: 380284 - DNA, 25 bp, Homo sapien
gtcccgggaacaggaggcatccgaa

SEQ ID NO: 380285 - DNA, 25 bp, Homo sapien
gaacaggaggcatccgaagtcctgg

SEQ ID NO: 380286 - DNA, 25 bp, Homo sapien
gaagtcctggcggaaccttcgagcc

SEQ ID NO: 380287 - DNA, 25 bp, Homo sapien
agtcctggcggaaccttcgagccgc

SEQ ID NO: 380288 - DNA, 25 bp, Homo sapien
gtattacagcccctctctcctgaaa

SEQ ID NO: 380289 - DNA, 25 bp, Homo sapien
tcctgaaactgcttctgaggtctca

SEQ ID NO: 380290 - DNA, 25 bp, Homo sapien
ttctgaggtctcaaagcctgaatca

SEQ ID NO: 380291 - DNA, 25 bp, Homo sapien
aagcctgaatcaaatgaccattgta

SEQ ID NO: 380292 - DNA, 25 bp, Homo sapien
tgaccattgtactagccttgtattg

SEQ ID NO: 380293 - DNA, 25 bp, Homo sapien
aatgtcagttttcagcttgtcctca

SEQ ID NO: 380294 - DNA, 25 bp, Homo sapien
gttttcagcttgtcctcatatataa

SEQ ID NO: 380295 - DNA, 25 bp, Homo sapien
cccctttcataggacacgctaatga

SEQ ID NO: 380296 - DNA, 25 bp, Homo sapien
ggacacgctaatgagatgcatatca

SEQ ID NO: 380297 - DNA, 25 bp, Homo sapien
aaagcctgatgttttgtgggacgga

SEQ ID NO: 380298 - DNA, 25 bp, Homo sapien
tgggacggagccttttaaactggat

SEQ ID NO: 380299 - DNA, 25 bp, Homo sapien
taaagcacccccatatacattattc

SEQ ID NO: 380300 - DNA, 25 bp, Homo sapien
tctcatttaagacagcaagcaaaga

SEQ ID NO: 380301 - DNA, 25 bp, Homo sapien
aaatttgctctagtgatgaagtgat

SEQ ID NO: 380302 - DNA, 25 bp, Homo sapien
aatcctgtgtcaatgaacttctgca

SEQ ID NO: 380303 - DNA, 25 bp, Homo sapien
atgaacttctgcaatgcacaggaaa

SEQ ID NO: 380304 - DNA, 25 bp, Homo sapien
gcacaggaaaataaacccactttag

SEQ ID NO: 380305 - DNA, 25 bp, Homo sapien
gttaatgcctttgattaagcatcac

SEQ ID NO: 380306 - DNA, 25 bp, Homo sapien
tttgattaagcatcactgcccactg

SEQ ID NO: 380307 - DNA, 25 bp, Homo sapien
tgcccactgcagatggaccaaaagt

SEQ ID NO: 380308 - DNA, 25 bp, Homo sapien
ggaccaaaagtttctctagtacgca

SEQ ID NO: 380309 - DNA, 25 bp, Homo sapien
ccaaaagtttctctagtacgcatta

SEQ ID NO: 380310 - DNA, 25 bp, Homo sapien
gttcacttcctattgtcaccttcta

SEQ ID NO: 380311 - DNA, 25 bp, Homo sapien
tcacttcctattgtcaccttctata

SEQ ID NO: 380312 - DNA, 25 bp, Homo sapien
cacttcctattgtcaccttctatag

SEQ ID NO: 380313 - DNA, 25 bp, Homo sapien
cttcctattgtcaccttctatagtt

SEQ ID NO: 380314 - DNA, 25 bp, Homo sapien
tattgtcaccttctatagtttctgg

SEQ ID NO: 380315 - DNA, 25 bp, Homo sapien
ttgtcaccttctatagtttctggta

SEQ ID NO: 380316 - DNA, 25 bp, Homo sapien
gtcaccttctatagtttctggtaat

SEQ ID NO: 380317 - DNA, 25 bp, Homo sapien
caccttctatagtttctggtaatca

SEQ ID NO: 380318 - DNA, 25 bp, Homo sapien
ccttctatagtttctggtaatcata

SEQ ID NO: 380319 - DNA, 25 bp, Homo sapien
gtttctggtaatcataacatattca

SEQ ID NO: 380320 - DNA, 25 bp, Homo sapien
acatattcataaagagtaggctggg

SEQ ID NO: 380321 - DNA, 25 bp, Homo sapien
actgcctgtcagtgtgaagtggcac

SEQ ID NO: 380322 - DNA, 25 bp, Homo sapien
tgaagtggcacagctctgatgtagt

SEQ ID NO: 380323 - DNA, 25 bp, Homo sapien
gatgtagtgctaagtctagcctcca

SEQ ID NO: 380324 - DNA, 25 bp, Homo sapien
gctaagtctagcctccagatttgag

SEQ ID NO: 380325 - DNA, 25 bp, Homo sapien
agatttgaggcagccctgaccatgc

SEQ ID NO: 380326 - DNA, 25 bp, Homo sapien
gcagccctgaccatgctaccatggg

SEQ ID NO: 380327 - DNA, 25 bp, Homo sapien
gaagtggtcctgtgaaaaggagaca

SEQ ID NO: 380328 - DNA, 25 bp, Homo sapien
ttgagatataaaggcaacaaccggg

SEQ ID NO: 380329 - DNA, 25 bp, Homo sapien
gggctgacctctatagatctgccag

SEQ ID NO: 380330 - DNA, 25 bp, Homo sapien
atctgccagttaaagagggctttct

SEQ ID NO: 380331 - DNA, 25 bp, Homo sapien
gagggctttctttcacttatcaggg

SEQ ID NO: 380332 - DNA, 25 bp, Homo sapien
gatggctcctcttcagatttggtgg

SEQ ID NO: 380333 - DNA, 25 bp, Homo sapien
ctcctcttcagatttggtgggcaat

SEQ ID NO: 380334 - DNA, 25 bp, Homo sapien
gcaatggaggttatttgccctctgt

SEQ ID NO: 380335 - DNA, 25 bp, Homo sapien
atttgccctctgttaggactttagt

SEQ ID NO: 380336 - DNA, 25 bp, Homo sapien
aggactttagtctcttcacaaggat

SEQ ID NO: 380337 - DNA, 25 bp, Homo sapien
ttcacaaggatccaagggcttctca

SEQ ID NO: 380338 - DNA, 25 bp, Homo sapien
caagcatattgaactattagactac

SEQ ID NO: 380339 - DNA, 25 bp, Homo sapien
gactacattcatgtttagtatctca

SEQ ID NO: 380340 - DNA, 25 bp, Homo sapien
gaccctttcaattctaatcaatcaa

SEQ ID NO: 380341 - DNA, 25 bp, Homo sapien
caatcaatctgcctttactcacaaa

SEQ ID NO: 380342 - DNA, 25 bp, Homo sapien
atgtcccatcctacattatagaagc

SEQ ID NO: 380343 - DNA, 25 bp, Homo sapien
gattatcactgccagaaaggcttaa

SEQ ID NO: 380344 - DNA, 25 bp, Homo sapien
aggaaggcctttaacaggcagacat

SEQ ID NO: 380345 - DNA, 25 bp, Homo sapien
catggtgaggctgggcattctaaac

SEQ ID NO: 380346 - DNA, 25 bp, Homo sapien
acaggaccaggtaagcagactcaga

SEQ ID NO: 380347 - DNA, 25 bp, Homo sapien
catagtgagcatgcaggtgtgttga

SEQ ID NO: 380348 - DNA, 25 bp, Homo sapien
caggttggctggaatataatctatc

SEQ ID NO: 380349 - DNA, 25 bp, Homo sapien
ggaatataatctatctgaacgcaag

SEQ ID NO: 380350 - DNA, 25 bp, Homo sapien
gaacgcaagagagaagcccgaacta

SEQ ID NO: 380351 - DNA, 25 bp, Homo sapien
gagaagcccgaactaagaagactga

SEQ ID NO: 380352 - DNA, 25 bp, Homo sapien
actgaagaggccagatcacagatct

SEQ ID NO: 380353 - DNA, 25 bp, Homo sapien
gaagtttggtctttactcaggacac

SEQ ID NO: 380354 - DNA, 25 bp, Homo sapien
atggctagaaggtgtgttctggaac

SEQ ID NO: 380355 - DNA, 25 bp, Homo sapien
gaaggtgtgttctggaacaatcaga

SEQ ID NO: 380356 - DNA, 25 bp, Homo sapien
tctggaacaatcagaaacctgaggc

SEQ ID NO: 380357 - DNA, 25 bp, Homo sapien
gaaacctgaggcaacttgaaatggg

SEQ ID NO: 380358 - DNA, 25 bp, Homo sapien
tgcaggctgaggctctccacacatt

SEQ ID NO: 380359 - DNA, 25 bp, Homo sapien
ctgaggctctccacacattttcatg

SEQ ID NO: 380360 - DNA, 25 bp, Homo sapien
tgctcaccctctaagtgagacgtaa

SEQ ID NO: 380361 - DNA, 25 bp, Homo sapien
caccctctaagtgagacgtaaagac

SEQ ID NO: 380362 - DNA, 25 bp, Homo sapien
gtgagacgtaaagactgcagtgttc

SEQ ID NO: 380363 - DNA, 25 bp, Homo sapien
taaagactgcagtgttcggagccct

SEQ ID NO: 380364 - DNA, 25 bp, Homo sapien
aagactgcagtgttcggagcccttt

SEQ ID NO: 380365 - DNA, 25 bp, Homo sapien
aggcctttgctgcaagtgaccctgt

SEQ ID NO: 380366 - DNA, 25 bp, Homo sapien
gtggattctcagacatgatactctc

SEQ ID NO: 380367 - DNA, 25 bp, Homo sapien
gatactctcatcatatttgcaactc

SEQ ID NO: 380368 - DNA, 25 bp, Homo sapien
atatttgcaactcttctctctcttt

SEQ ID NO: 380369 - DNA, 25 bp, Homo sapien
gggagaagtttcctgggctccatca

SEQ ID NO: 380370 - DNA, 25 bp, Homo sapien
tccatcaatggctgcatcttttctg

SEQ ID NO: 380371 - DNA, 25 bp, Homo sapien
aatggctgcatcttttctggactca

SEQ ID NO: 380372 - DNA, 25 bp, Homo sapien
atcttttctggactcagcagtctcc

SEQ ID NO: 380373 - DNA, 25 bp, Homo sapien
agcagtctccttgattccatgtaga

SEQ ID NO: 380374 - DNA, 25 bp, Homo sapien
agttgctgattgcatttcctctcat

SEQ ID NO: 380375 - DNA, 25 bp, Homo sapien
tttcctctcattaacaattgggtgt

SEQ ID NO: 380376 - DNA, 25 bp, Homo sapien
gattaagcctaaaatgatgaccagc

SEQ ID NO: 380377 - DNA, 25 bp, Homo sapien
gatattttgaatctggttctgagct

SEQ ID NO: 380378 - DNA, 25 bp, Homo sapien
tctggttctgagctaaagttgagta

SEQ ID NO: 380379 - DNA, 25 bp, Homo sapien
ggaaatccatcatctatattagcaa

SEQ ID NO: 380380 - DNA, 25 bp, Homo sapien
tctatattagcaacagattctcaga

SEQ ID NO: 380381 - DNA, 25 bp, Homo sapien
gattctcagagtaaattgttaactt

SEQ ID NO: 380382 - DNA, 25 bp, Homo sapien
tcaagctggacttgatcatacaagt

SEQ ID NO: 380383 - DNA, 25 bp, Homo sapien
gttagtctcataatgtattggacca

SEQ ID NO: 380384 - DNA, 25 bp, Homo sapien
atgtaaacttcattggtcagattta

SEQ ID NO: 380385 - DNA, 25 bp, Homo sapien
ggtcagatttagaagcattcatgct

SEQ ID NO: 380386 - DNA, 25 bp, Homo sapien
gcattcatgctcacaagttttggga

SEQ ID NO: 380387 - DNA, 25 bp, Homo sapien
gttcaaagatctcccttctgggtct

SEQ ID NO: 380388 - DNA, 25 bp, Homo sapien
aaagatctcccttctgggtctgaca

SEQ ID NO: 380389 - DNA, 25 bp, Homo sapien
gatctcccttctgggtctgacaaga

SEQ ID NO: 380390 - DNA, 25 bp, Homo sapien
tcccttctgggtctgacaagaagaa

SEQ ID NO: 380391 - DNA, 25 bp, Homo sapien
tctgggtctgacaagaagaaacata

SEQ ID NO: 380392 - DNA, 25 bp, Homo sapien
gaagaaacataacccttatttattg

SEQ ID NO: 380393 - DNA, 25 bp, Homo sapien
tattgcattcttctggcttacatac

SEQ ID NO: 380394 - DNA, 25 bp, Homo sapien
gcattcttctggcttacatacattg

SEQ ID NO: 380395 - DNA, 25 bp, Homo sapien
ttctggcttacatacattgccctca

SEQ ID NO: 380396 - DNA, 25 bp, Homo sapien
ctggcttacatacattgccctcact

SEQ ID NO: 380397 - DNA, 25 bp, Homo sapien
agagaattgccatcattctccattt

SEQ ID NO: 380398 - DNA, 25 bp, Homo sapien
tagtacttagaaacaagcactctag

SEQ ID NO: 380399 - DNA, 25 bp, Homo sapien
gtacttagaaacaagcactctaggc

SEQ ID NO: 380400 - DNA, 25 bp, Homo sapien
tacttagaaacaagcactctaggct

SEQ ID NO: 380401 - DNA, 25 bp, Homo sapien
acttagaaacaagcactctaggctg

SEQ ID NO: 380402 - DNA, 25 bp, Homo sapien
cttagaaacaagcactctaggctgg

SEQ ID NO: 380403 - DNA, 25 bp, Homo sapien
ttagaaacaagcactctaggctggg

SEQ ID NO: 380404 - DNA, 25 bp, Homo sapien
tagaaacaagcactctaggctgggc

SEQ ID NO: 380405 - DNA, 25 bp, Homo sapien
agaaacaagcactctaggctgggct

SEQ ID NO: 380406 - DNA, 25 bp, Homo sapien
gaaacaagcactctaggctgggctt

SEQ ID NO: 380407 - DNA, 25 bp, Homo sapien
aaacaagcactctaggctgggcttg

SEQ ID NO: 380408 - DNA, 25 bp, Homo sapien
aacaagcactctaggctgggcttgg

SEQ ID NO: 380409 - DNA, 25 bp, Homo sapien
aatctgttgacgctctgtgacatgg

SEQ ID NO: 380410 - DNA, 25 bp, Homo sapien
tgacgctctgtgacatggccccgca

SEQ ID NO: 380411 - DNA, 25 bp, Homo sapien
acaggaacacacaaccactcttctg

SEQ ID NO: 380412 - DNA, 25 bp, Homo sapien
tcttctgctcccatacaggacaggg

SEQ ID NO: 380413 - DNA, 25 bp, Homo sapien
ggttcatggtccgatgccccggtag

SEQ ID NO: 380414 - DNA, 25 bp, Homo sapien
gatgccccggtagtgtggcttccat

SEQ ID NO: 380415 - DNA, 25 bp, Homo sapien
ccccggtagtgtggcttccatcagt

SEQ ID NO: 380416 - DNA, 25 bp, Homo sapien
ctcgtggaacgcttctctgcaaagg

SEQ ID NO: 380417 - DNA, 25 bp, Homo sapien
gaacgcttctctgcaaaggccagga

SEQ ID NO: 380418 - DNA, 25 bp, Homo sapien
ggctgggatccggtaggtaatccct

SEQ ID NO: 380419 - DNA, 25 bp, Homo sapien
atccggtaggtaatccctctgtcat

SEQ ID NO: 380420 - DNA, 25 bp, Homo sapien
gctgctctgtgcctgctgtcagagc

SEQ ID NO: 380421 - DNA, 25 bp, Homo sapien
atgtggccaccctgagacccggagg

SEQ ID NO: 380422 - DNA, 25 bp, Homo sapien
gagacgggcgtctgcctgggtttgc

SEQ ID NO: 380423 - DNA, 25 bp, Homo sapien
cctgggtttgcggagagccgcttat

SEQ ID NO: 380424 - DNA, 25 bp, Homo sapien
agccgcttatgggtgtggtccgtcc

SEQ ID NO: 380425 - DNA, 25 bp, Homo sapien
cgcttatgggtgtggtccgtccaga

SEQ ID NO: 380426 - DNA, 25 bp, Homo sapien
ttatgggtgtggtccgtccagacac

SEQ ID NO: 380427 - DNA, 25 bp, Homo sapien
tgtggtccgtccagacaccttgttt

SEQ ID NO: 380428 - DNA, 25 bp, Homo sapien
tgagcgggcaagcagagcatcccca

SEQ ID NO: 380429 - DNA, 25 bp, Homo sapien
agagcatccccaccgctgagcaaga

SEQ ID NO: 380430 - DNA, 25 bp, Homo sapien
cccaccgctgagcaagaactttttc

SEQ ID NO: 380431 - DNA, 25 bp, Homo sapien
cgtgggtgtgcctagggcctacttc

SEQ ID NO: 380432 - DNA, 25 bp, Homo sapien
tagggcctacttcccaaggtgccac

SEQ ID NO: 380433 - DNA, 25 bp, Homo sapien
caaggtgccacaggcccatgatggg

SEQ ID NO: 380434 - DNA, 25 bp, Homo sapien
gcctggactttgatgctattgctgc

SEQ ID NO: 380435 - DNA, 25 bp, Homo sapien
actttgatgctattgctgccaggtc

SEQ ID NO: 380436 - DNA, 25 bp, Homo sapien
attgctgccaggtcttgctgtgtga

SEQ ID NO: 380437 - DNA, 25 bp, Homo sapien
gtgaccttgggtaggttgcttctac

SEQ ID NO: 380438 - DNA, 25 bp, Homo sapien
tgggtaggttgcttctactctctgg

SEQ ID NO: 380439 - DNA, 25 bp, Homo sapien
tcctctgtgactcagggataggagt

SEQ ID NO: 380440 - DNA, 25 bp, Homo sapien
actcagggataggagtcatcagcct

SEQ ID NO: 380441 - DNA, 25 bp, Homo sapien
atcagcctggatgagctatgtcaga

SEQ ID NO: 380442 - DNA, 25 bp, Homo sapien
ttggcttccagtgtcgcttccacta

SEQ ID NO: 380443 - DNA, 25 bp, Homo sapien
gcttccactacctaccttaagagtg

SEQ ID NO: 380444 - DNA, 25 bp, Homo sapien
agcctctggtgttgctaaataaagc

SEQ ID NO: 380445 - DNA, 25 bp, Homo sapien
agaaacttcaggaatcccactctgc

SEQ ID NO: 380446 - DNA, 25 bp, Homo sapien
ggaatcccactctgcttctttaagt

SEQ ID NO: 380447 - DNA, 25 bp, Homo sapien
gcttctttaagtctgaaacttcagt

SEQ ID NO: 380448 - DNA, 25 bp, Homo sapien
aaacttcagttctcatatttatcag

SEQ ID NO: 380449 - DNA, 25 bp, Homo sapien
aagggtgttggtctagctaatattt

SEQ ID NO: 380450 - DNA, 25 bp, Homo sapien
taatatttaaggacagacccttcca

SEQ ID NO: 380451 - DNA, 25 bp, Homo sapien
gagtgatatccacaaactacataat

SEQ ID NO: 380452 - DNA, 25 bp, Homo sapien
agcttttcaaagacaggcttcctaa

SEQ ID NO: 380453 - DNA, 25 bp, Homo sapien
tgcttagggaattagtcattaggga

SEQ ID NO: 380454 - DNA, 25 bp, Homo sapien
gagacataatttcacatctaccagg

SEQ ID NO: 380455 - DNA, 25 bp, Homo sapien
atttcacatctaccaggatagcact

SEQ ID NO: 380456 - DNA, 25 bp, Homo sapien
ctaccaggatagcactagagtcaaa

SEQ ID NO: 380457 - DNA, 25 bp, Homo sapien
gatagcactagagtcaaaaaggcat

SEQ ID NO: 380458 - DNA, 25 bp, Homo sapien
aaggcataataacaagtgctggcaa

SEQ ID NO: 380459 - DNA, 25 bp, Homo sapien
caagtgctggcaaagagagaaatta

SEQ ID NO: 380460 - DNA, 25 bp, Homo sapien
ttagaattctcaaaacgccactggt

SEQ ID NO: 380461 - DNA, 25 bp, Homo sapien
gaattctcaaaacgccactggtggg

SEQ ID NO: 380462 - DNA, 25 bp, Homo sapien
aaaacgccactggtgggactgtgaa

SEQ ID NO: 380463 - DNA, 25 bp, Homo sapien
cgccactggtgggactgtgaaatgt

SEQ ID NO: 380464 - DNA, 25 bp, Homo sapien
acatggccactaaataccagggcat

SEQ ID NO: 380465 - DNA, 25 bp, Homo sapien
aataccagggcattgtggcaaccat

SEQ ID NO: 380466 - DNA, 25 bp, Homo sapien
accagggcattgtggcaaccataaa

SEQ ID NO: 380467 - DNA, 25 bp, Homo sapien
gggcattgtggcaaccataaagaaa

SEQ ID NO: 380468 - DNA, 25 bp, Homo sapien
gaatacaatttcctagaccagcgga

SEQ ID NO: 380469 - DNA, 25 bp, Homo sapien
tttcctagaccagcggaaaatggat

SEQ ID NO: 380470 - DNA, 25 bp, Homo sapien
ttttgaccaagattacgaagagttt

SEQ ID NO: 380471 - DNA, 25 bp, Homo sapien
tacgaagagttttgcaagcagacta

SEQ ID NO: 380472 - DNA, 25 bp, Homo sapien
gcaagcagactaatgaccttcatgt

SEQ ID NO: 380473 - DNA, 25 bp, Homo sapien
gactaatgaccttcatgtaggttgt

SEQ ID NO: 380474 - DNA, 25 bp, Homo sapien
ccttcatgtaggttgtataataaaa

SEQ ID NO: 380475 - DNA, 25 bp, Homo sapien
ggtagaacttcaacaataagtcagt

SEQ ID NO: 380476 - DNA, 25 bp, Homo sapien
aagtcagttctagtggctgtcgcct

SEQ ID NO: 380477 - DNA, 25 bp, Homo sapien
tgagaaagctactcttctccctctt

SEQ ID NO: 380478 - DNA, 25 bp, Homo sapien
ggccccactgcagaattaaagaagg

SEQ ID NO: 380479 - DNA, 25 bp, Homo sapien
gcggaggagtctataagaaggaatc

SEQ ID NO: 380480 - DNA, 25 bp, Homo sapien
aggaatcatgatttctatttagcag

SEQ ID NO: 380481 - DNA, 25 bp, Homo sapien
tatttagcagattggatgggcaggt

SEQ ID NO: 380482 - DNA, 25 bp, Homo sapien
gggtagaaatgttagatcttgcaac

SEQ ID NO: 380483 - DNA, 25 bp, Homo sapien
tagatcttgcaacatcagatccttg

SEQ ID NO: 380484 - DNA, 25 bp, Homo sapien
gatccttggaataaagaagcctctc

SEQ ID NO: 380485 - DNA, 25 bp, Homo sapien
ttggaataaagaagcctctctgtgc

SEQ ID NO: 380486 - DNA, 25 bp, Homo sapien
aatggcctttacctatttcttcagt

SEQ ID NO: 380487 - DNA, 25 bp, Homo sapien
aatatacctgatctgttcatgcact

SEQ ID NO: 380488 - DNA, 25 bp, Homo sapien
gttcatgcactaaaggctctggagc

SEQ ID NO: 380489 - DNA, 25 bp, Homo sapien
tctgaatttggccttcacctggtat

SEQ ID NO: 380490 - DNA, 25 bp, Homo sapien
tggccttcacctggtatcacagaaa

SEQ ID NO: 380491 - DNA, 25 bp, Homo sapien
atcggctgtatgttaggttttcttt

SEQ ID NO: 380492 - DNA, 25 bp, Homo sapien
ttttctttaatcctcacatcgtgcc

SEQ ID NO: 380493 - DNA, 25 bp, Homo sapien
acatcgtgccaaacttagtctggtt

SEQ ID NO: 380494 - DNA, 25 bp, Homo sapien
gtattgcaacaacttctgaaactct

SEQ ID NO: 380495 - DNA, 25 bp, Homo sapien
aagtggactatatgtttctcacagt

SEQ ID NO: 380496 - DNA, 25 bp, Homo sapien
acagtttttgtttatgctcagcaaa

SEQ ID NO: 380497 - DNA, 25 bp, Homo sapien
tagtgagcttggcatctaacccata

SEQ ID NO: 380498 - DNA, 25 bp, Homo sapien
taacccatagctccctggaaactta

SEQ ID NO: 380499 - DNA, 25 bp, Homo sapien
gattaaatcacagccacacagtcac

SEQ ID NO: 380500 - DNA, 25 bp, Homo sapien
cagccacacagtcaccaattaaaca

SEQ ID NO: 380501 - DNA, 25 bp, Homo sapien
aacatctgataagggctgttacctc

SEQ ID NO: 380502 - DNA, 25 bp, Homo sapien
agggctgttacctctacacatagac

SEQ ID NO: 380503 - DNA, 25 bp, Homo sapien
gaagatatgtccattatagccactc

SEQ ID NO: 380504 - DNA, 25 bp, Homo sapien
atagccactcatccaatgaatcaag

SEQ ID NO: 380505 - DNA, 25 bp, Homo sapien
agttcccaggctctcgttgggtctc

SEQ ID NO: 380506 - DNA, 25 bp, Homo sapien
tcgttgggtctcagggagctcaccc

SEQ ID NO: 380507 - DNA, 25 bp, Homo sapien
cctgtctgctcaaggtagtgagctt

SEQ ID NO: 380508 - DNA, 25 bp, Homo sapien
tcaaaagaaggccaccaggtggctc

SEQ ID NO: 380509 - DNA, 25 bp, Homo sapien
tgattgagcgcttccgagagggcaa

SEQ ID NO: 380510 - DNA, 25 bp, Homo sapien
tggtgaccaccaacgtgtgtgcccg

SEQ ID NO: 380511 - DNA, 25 bp, Homo sapien
gtgcccgcggcattgatgttgaaca

SEQ ID NO: 380512 - DNA, 25 bp, Homo sapien
gttgaacaagtgtctgtcgtcatca

SEQ ID NO: 380513 - DNA, 25 bp, Homo sapien
agtgtctgtcgtcatcaactttgat

SEQ ID NO: 380514 - DNA, 25 bp, Homo sapien
aactttgatcttcccgtggacaagg

SEQ ID NO: 380515 - DNA, 25 bp, Homo sapien
ggacaaggacgggaatcctgacaat

SEQ ID NO: 380516 - DNA, 25 bp, Homo sapien
aatcctgacaatgagacctacctgc

SEQ ID NO: 380517 - DNA, 25 bp, Homo sapien
tgagacctacctgcaccggatcggg

SEQ ID NO: 380518 - DNA, 25 bp, Homo sapien
tggcagtgaacatggtggacagcaa

SEQ ID NO: 380519 - DNA, 25 bp, Homo sapien
tagagtcaacagtccagaaccccta

SEQ ID NO: 380520 - DNA, 25 bp, Homo sapien
cagaacccctatccgtatgaacagg

SEQ ID NO: 380521 - DNA, 25 bp, Homo sapien
gggcccgtttctggttgaaatcaag

SEQ ID NO: 380522 - DNA, 25 bp, Homo sapien
atcaaggttaggatgcaactgagaa

SEQ ID NO: 380523 - DNA, 25 bp, Homo sapien
aaaagactgcactttggagaggcaa

SEQ ID NO: 380524 - DNA, 25 bp, Homo sapien
caagcacgctatccgggttgttgtt

SEQ ID NO: 380525 - DNA, 25 bp, Homo sapien
ttgttttatgtcttggtgcttaggt

SEQ ID NO: 380526 - DNA, 25 bp, Homo sapien
tcttggtgcttaggtgaggacttag

SEQ ID NO: 380527 - DNA, 25 bp, Homo sapien
gaggacttagctgggtttattcaaa

SEQ ID NO: 380528 - DNA, 25 bp, Homo sapien
gcgggtctgggctattcttgagaat

SEQ ID NO: 380529 - DNA, 25 bp, Homo sapien
tcttgagaatgtcccttccatttct

SEQ ID NO: 380530 - DNA, 25 bp, Homo sapien
gaggagcccctggactactatgcca

SEQ ID NO: 380531 - DNA, 25 bp, Homo sapien
gagcccctggactactatgccactg

SEQ ID NO: 380532 - DNA, 25 bp, Homo sapien
tactatgccactgctctcaagagca

SEQ ID NO: 380533 - DNA, 25 bp, Homo sapien
gggcagggtgcatgtgccccccact

SEQ ID NO: 380534 - DNA, 25 bp, Homo sapien
aggaagccctgcaaccagaacccgg

SEQ ID NO: 380535 - DNA, 25 bp, Homo sapien
accaggaccaccaccttctgaggag

SEQ ID NO: 380536 - DNA, 25 bp, Homo sapien
tgggcaccattcctacagccccgaa

SEQ ID NO: 380537 - DNA, 25 bp, Homo sapien
agccccgaagactgcatctcctgaa

SEQ ID NO: 380538 - DNA, 25 bp, Homo sapien
gaagactgcatctcctgaatgctca

SEQ ID NO: 380539 - DNA, 25 bp, Homo sapien
tgcatctcctgaatgctcacctaag

SEQ ID NO: 380540 - DNA, 25 bp, Homo sapien
atctcctgaatgctcacctaagctc

SEQ ID NO: 380541 - DNA, 25 bp, Homo sapien
aagaactcagcgtctgtggcttatg

SEQ ID NO: 380542 - DNA, 25 bp, Homo sapien
gtggcttatgtgtctggctctctcg

SEQ ID NO: 380543 - DNA, 25 bp, Homo sapien
ggctctctcggtccaagagtttgtc

SEQ ID NO: 380544 - DNA, 25 bp, Homo sapien
aagcagtgacctccagagaagcagt

SEQ ID NO: 380545 - DNA, 25 bp, Homo sapien
tgacaggatgccctttagctcctga

SEQ ID NO: 380546 - DNA, 25 bp, Homo sapien
tttagctcctgacttctattacctt

SEQ ID NO: 380547 - DNA, 25 bp, Homo sapien
agccaattgctacatcctcagggag

SEQ ID NO: 380548 - DNA, 25 bp, Homo sapien
aggatgacctcctggtttacatgtc

SEQ ID NO: 380549 - DNA, 25 bp, Homo sapien
acctcctggtttacatgtctttttg

SEQ ID NO: 380550 - DNA, 25 bp, Homo sapien
aaccccaacatatcttggtatcctc

SEQ ID NO: 380551 - DNA, 25 bp, Homo sapien
ggtatcctccattaacaccacaggg

SEQ ID NO: 380552 - DNA, 25 bp, Homo sapien
agtgggaaggagtccctgttctcag

SEQ ID NO: 380553 - DNA, 25 bp, Homo sapien
gagtgccgtatctcagaacatctaa

SEQ ID NO: 380554 - DNA, 25 bp, Homo sapien
gtctaggaaaacacactccatttgt

SEQ ID NO: 380555 - DNA, 25 bp, Homo sapien
actccatttgtggttctccagagaa

SEQ ID NO: 380556 - DNA, 25 bp, Homo sapien
atcagcacttggaatcctttgccac

SEQ ID NO: 380557 - DNA, 25 bp, Homo sapien
ggctctgaatcctgactgcgagatt

SEQ ID NO: 380558 - DNA, 25 bp, Homo sapien
tgcgagattacacctgccagttcac

SEQ ID NO: 380559 - DNA, 25 bp, Homo sapien
agttcaccatcgactgtgtcacacg

SEQ ID NO: 380560 - DNA, 25 bp, Homo sapien
tgtgtcacacggctcagcacagctc

SEQ ID NO: 380561 - DNA, 25 bp, Homo sapien
catcctgatttccatctacttctaa

SEQ ID NO: 380562 - DNA, 25 bp, Homo sapien
atctacttctaaactgcatcactct

SEQ ID NO: 380563 - DNA, 25 bp, Homo sapien
gatatacacaggcactaaactagag

SEQ ID NO: 380564 - DNA, 25 bp, Homo sapien
tatacacaggcactaaactagaggg

SEQ ID NO: 380565 - DNA, 25 bp, Homo sapien
cttaccagaggtatcaggcttagta

SEQ ID NO: 380566 - DNA, 25 bp, Homo sapien
accagaggtatcaggcttagtaaca

SEQ ID NO: 380567 - DNA, 25 bp, Homo sapien
ccagaggtatcaggcttagtaacat

SEQ ID NO: 380568 - DNA, 25 bp, Homo sapien
gaggtatcaggcttagtaacattct

SEQ ID NO: 380569 - DNA, 25 bp, Homo sapien
gtatcaggcttagtaacattctagg

SEQ ID NO: 380570 - DNA, 25 bp, Homo sapien
tcaggcttagtaacattctaggaat

SEQ ID NO: 380571 - DNA, 25 bp, Homo sapien
ggcttagtaacattctaggaatatt

SEQ ID NO: 380572 - DNA, 25 bp, Homo sapien
tgtataaaaaactgtcccaaatact

SEQ ID NO: 380573 - DNA, 25 bp, Homo sapien
aaaactgtcccaaatactaacagag

SEQ ID NO: 380574 - DNA, 25 bp, Homo sapien
ttgaaacagttcaacctcgtcatcc

SEQ ID NO: 380575 - DNA, 25 bp, Homo sapien
caacctcgtcatccaatgcagggat

SEQ ID NO: 380576 - DNA, 25 bp, Homo sapien
atgcagggattgcatctctactgcc

SEQ ID NO: 380577 - DNA, 25 bp, Homo sapien
tactgccccggaactggtcattcat

SEQ ID NO: 380578 - DNA, 25 bp, Homo sapien
tggtcattcattattgcttgcctaa

SEQ ID NO: 380579 - DNA, 25 bp, Homo sapien
attgcttgcctaatgagtccctaat

SEQ ID NO: 380580 - DNA, 25 bp, Homo sapien
atgagtccctaatgctttactttta

SEQ ID NO: 380581 - DNA, 25 bp, Homo sapien
ctataaagcatattggagcacggaa

SEQ ID NO: 380582 - DNA, 25 bp, Homo sapien
gacaagtataagacagcctattcta

SEQ ID NO: 380583 - DNA, 25 bp, Homo sapien
gagatgggttgcctaattgtctgcc

SEQ ID NO: 380584 - DNA, 25 bp, Homo sapien
gtctgccctgagatggaggcattat

SEQ ID NO: 380585 - DNA, 25 bp, Homo sapien
atgccgccaaggtgtactacatcaa

SEQ ID NO: 380586 - DNA, 25 bp, Homo sapien
ctacatcaactagagctagccaggt

SEQ ID NO: 380587 - DNA, 25 bp, Homo sapien
tagagctagccaggtgttgccggac

SEQ ID NO: 380588 - DNA, 25 bp, Homo sapien
gctagccaggtgttgccggacccag

SEQ ID NO: 380589 - DNA, 25 bp, Homo sapien
aggtgttgccggacccagccttcct

SEQ ID NO: 380590 - DNA, 25 bp, Homo sapien
gaggagtgtcaaagagtcaaactaa

SEQ ID NO: 380591 - DNA, 25 bp, Homo sapien
gagtcaaactaaagaaatcctttca

SEQ ID NO: 380592 - DNA, 25 bp, Homo sapien
tggactcaaagtgtccagtgtctca

SEQ ID NO: 380593 - DNA, 25 bp, Homo sapien
tgtgtccaaggaatgacgtgcagtt

SEQ ID NO: 380594 - DNA, 25 bp, Homo sapien
gaatgacgtgcagtttttgactatt

SEQ ID NO: 380595 - DNA, 25 bp, Homo sapien
cataaagcaggttggagtttttctc

SEQ ID NO: 380596 - DNA, 25 bp, Homo sapien
gtagttaccttttttcaagctctga

SEQ ID NO: 380597 - DNA, 25 bp, Homo sapien
accacttcttcctggaatatagctg

SEQ ID NO: 380598 - DNA, 25 bp, Homo sapien
gttcagattacgtgttagacttaag

SEQ ID NO: 380599 - DNA, 25 bp, Homo sapien
ctacttttgtggctagcaaaggttg

SEQ ID NO: 380600 - DNA, 25 bp, Homo sapien
gcaaaggttgtgcatctatttaaaa

SEQ ID NO: 380601 - DNA, 25 bp, Homo sapien
taaaattatttacaggatgctctaa

SEQ ID NO: 380602 - DNA, 25 bp, Homo sapien
ggaatatagctgtagtatttctcac

SEQ ID NO: 380603 - DNA, 25 bp, Homo sapien
agtatttctcactagtattattaga

SEQ ID NO: 380604 - DNA, 25 bp, Homo sapien
gtattattagatacctgtgtacaga

SEQ ID NO: 380605 - DNA, 25 bp, Homo sapien
acctgtgtacagaaagtatgcagtt

SEQ ID NO: 380606 - DNA, 25 bp, Homo sapien
gcagttattcaggttaatgtttcat

SEQ ID NO: 380607 - DNA, 25 bp, Homo sapien
gtagtacccatgacaacatttattt

SEQ ID NO: 380608 - DNA, 25 bp, Homo sapien
attgaccaaacacgaacattataga

SEQ ID NO: 380609 - DNA, 25 bp, Homo sapien
acttgaaattcatctgagtaaggaa

SEQ ID NO: 380610 - DNA, 25 bp, Homo sapien
gagaacagtcaaagaagctaattta

SEQ ID NO: 380611 - DNA, 25 bp, Homo sapien
aaaagaaccacctaatccgctgatt

SEQ ID NO: 380612 - DNA, 25 bp, Homo sapien
ccacctaatccgctgatttctaatc

SEQ ID NO: 380613 - DNA, 25 bp, Homo sapien
gatttctaatcatgccgagtgctta

SEQ ID NO: 380614 - DNA, 25 bp, Homo sapien
taatcatgccgagtgcttatctctc

SEQ ID NO: 380615 - DNA, 25 bp, Homo sapien
tcatgccgagtgcttatctctcctg

SEQ ID NO: 380616 - DNA, 25 bp, Homo sapien
atctctcctgccaggcatacagcga

SEQ ID NO: 380617 - DNA, 25 bp, Homo sapien
tgccaggcatacagcgagcgccttg

SEQ ID NO: 380618 - DNA, 25 bp, Homo sapien
gcttattggattactcttggcaggg

SEQ ID NO: 380619 - DNA, 25 bp, Homo sapien
tggattactcttggcagggcagcat

SEQ ID NO: 380620 - DNA, 25 bp, Homo sapien
catcctcaactactagtgcttggat

SEQ ID NO: 380621 - DNA, 25 bp, Homo sapien
tttggccagagacaaaacacttcaa

SEQ ID NO: 380622 - DNA, 25 bp, Homo sapien
ctaaatttacttgatcgctgtataa

SEQ ID NO: 380623 - DNA, 25 bp, Homo sapien
gaaacattaagacttagacctccta

SEQ ID NO: 380624 - DNA, 25 bp, Homo sapien
gacttagacctcctataatgatcat

SEQ ID NO: 380625 - DNA, 25 bp, Homo sapien
agacctcctataatgatcatgatga

SEQ ID NO: 380626 - DNA, 25 bp, Homo sapien
catgatgagaatggccagaactcct

SEQ ID NO: 380627 - DNA, 25 bp, Homo sapien
ttcctccaggacatcaggtgtgtgt

SEQ ID NO: 380628 - DNA, 25 bp, Homo sapien
cctccaggacatcaggtgtgtgttt

SEQ ID NO: 380629 - DNA, 25 bp, Homo sapien
gcttcattgaagctccatctgggac

SEQ ID NO: 380630 - DNA, 25 bp, Homo sapien
gaagctccatctgggacttaaaaca

SEQ ID NO: 380631 - DNA, 25 bp, Homo sapien
aggaagtcgtcttgagcacccattg

SEQ ID NO: 380632 - DNA, 25 bp, Homo sapien
gaagtcgtcttgagcacccattgct

SEQ ID NO: 380633 - DNA, 25 bp, Homo sapien
ttatattggacttgctttctagcac

SEQ ID NO: 380634 - DNA, 25 bp, Homo sapien
ggacttgctttctagcacataccac

SEQ ID NO: 380635 - DNA, 25 bp, Homo sapien
tagcacataccacaattgtagacct

SEQ ID NO: 380636 - DNA, 25 bp, Homo sapien
aacaggaggtgttcagcgtaagaca

SEQ ID NO: 380637 - DNA, 25 bp, Homo sapien
cacacggagctacttctcattactg

SEQ ID NO: 380638 - DNA, 25 bp, Homo sapien
gatcaaagaatagcagtctctggcc

SEQ ID NO: 380639 - DNA, 25 bp, Homo sapien
aagaatagcagtctctggcctgctc

SEQ ID NO: 380640 - DNA, 25 bp, Homo sapien
gactgatcacaaaatccaaggtgct

SEQ ID NO: 380641 - DNA, 25 bp, Homo sapien
atccaaggtgctacaggaaacaagc

SEQ ID NO: 380642 - DNA, 25 bp, Homo sapien
ggaaacaagcacactcaagaaagtt

SEQ ID NO: 380643 - DNA, 25 bp, Homo sapien
tccaatttctccgttttataagaca

SEQ ID NO: 380644 - DNA, 25 bp, Homo sapien
tctccgttttataagacatttccta

SEQ ID NO: 380645 - DNA, 25 bp, Homo sapien
cttgagtcccaatagagctgttttt

SEQ ID NO: 380646 - DNA, 25 bp, Homo sapien
ttttttctcacttcctacaaaatgc

SEQ ID NO: 380647 - DNA, 25 bp, Homo sapien
agcagcttttgtttggttctgaacc

SEQ ID NO: 380648 - DNA, 25 bp, Homo sapien
ggttctgaaccgtatgtggcgtatt

SEQ ID NO: 380649 - DNA, 25 bp, Homo sapien
accgtatgtggcgtattgttattag

SEQ ID NO: 380650 - DNA, 25 bp, Homo sapien
tgttattaggttctagcttccttta

SEQ ID NO: 380651 - DNA, 25 bp, Homo sapien
ggcttaagaattgctttgttgtgct

SEQ ID NO: 380652 - DNA, 25 bp, Homo sapien
gcttaagaattgctttgttgtgctg

SEQ ID NO: 380653 - DNA, 25 bp, Homo sapien
cttaagaattgctttgttgtgctgt

SEQ ID NO: 380654 - DNA, 25 bp, Homo sapien
taagaattgctttgttgtgctgtgc

SEQ ID NO: 380655 - DNA, 25 bp, Homo sapien
aagaattgctttgttgtgctgtgct

SEQ ID NO: 380656 - DNA, 25 bp, Homo sapien
agaattgctttgttgtgctgtgctt

SEQ ID NO: 380657 - DNA, 25 bp, Homo sapien
gaattgctttgttgtgctgtgcttg

SEQ ID NO: 380658 - DNA, 25 bp, Homo sapien
aattgctttgttgtgctgtgcttgc

SEQ ID NO: 380659 - DNA, 25 bp, Homo sapien
tgctgtgcttgcttcagcatcacat

SEQ ID NO: 380660 - DNA, 25 bp, Homo sapien
gctgtgcttgcttcagcatcacata

SEQ ID NO: 380661 - DNA, 25 bp, Homo sapien
ctgtgcttgcttcagcatcacatat

SEQ ID NO: 380662 - DNA, 25 bp, Homo sapien
cagtagttactgcatcatatagttc

SEQ ID NO: 380663 - DNA, 25 bp, Homo sapien
tagttccaagtaaatttgacatgga

SEQ ID NO: 380664 - DNA, 25 bp, Homo sapien
gacatggaaataagtgttaactaca

SEQ ID NO: 380665 - DNA, 25 bp, Homo sapien
gaatatatacattccaatgtttgga

SEQ ID NO: 380666 - DNA, 25 bp, Homo sapien
agattgacagtacagatgacctata

SEQ ID NO: 380667 - DNA, 25 bp, Homo sapien
gtacagatgacctataaactggtta

SEQ ID NO: 380668 - DNA, 25 bp, Homo sapien
tataaactggttaaatagccctatt

SEQ ID NO: 380669 - DNA, 25 bp, Homo sapien
aatagccctattacaattgaaattg

SEQ ID NO: 380670 - DNA, 25 bp, Homo sapien
gaaattgggtcaaaaatcaatctct

SEQ ID NO: 380671 - DNA, 25 bp, Homo sapien
gtcaaaaatcaatctctaacctgag

SEQ ID NO: 380672 - DNA, 25 bp, Homo sapien
ctctaacctgagatacatttgtata

SEQ ID NO: 380673 - DNA, 25 bp, Homo sapien
ataccatgtggacgagagtcgaaac

SEQ ID NO: 380674 - DNA, 25 bp, Homo sapien
tgtggacgagagtcgaaactacatc

SEQ ID NO: 380675 - DNA, 25 bp, Homo sapien
tacatcagtaactcagcacagtcca

SEQ ID NO: 380676 - DNA, 25 bp, Homo sapien
cagtaactcagcacagtccaatggg

SEQ ID NO: 380677 - DNA, 25 bp, Homo sapien
ggagaaacaacccagcagtgcgaaa

SEQ ID NO: 380678 - DNA, 25 bp, Homo sapien
gcagtgcgaaaagctccaacaaaaa

SEQ ID NO: 380679 - DNA, 25 bp, Homo sapien
aagagtattatgtctgatcccaaga

SEQ ID NO: 380680 - DNA, 25 bp, Homo sapien
gatcccaagatcttaaatggacact

SEQ ID NO: 380681 - DNA, 25 bp, Homo sapien
ggacacttgtatagaaatagtcttc

SEQ ID NO: 380682 - DNA, 25 bp, Homo sapien
tactttcctttttatgaagcacata

SEQ ID NO: 380683 - DNA, 25 bp, Homo sapien
gaatgcaatcaggaaggaaagactt

SEQ ID NO: 380684 - DNA, 25 bp, Homo sapien
gtaaatagtggttatcactccctgg

SEQ ID NO: 380685 - DNA, 25 bp, Homo sapien
taagaaaagggcctctgccatgcat

SEQ ID NO: 380686 - DNA, 25 bp, Homo sapien
aaaagggcctctgccatgcatgtca

SEQ ID NO: 380687 - DNA, 25 bp, Homo sapien
gggcctctgccatgcatgtcatggg

SEQ ID NO: 380688 - DNA, 25 bp, Homo sapien
acatatgtctaactaagacgcctct

SEQ ID NO: 380689 - DNA, 25 bp, Homo sapien
tgtctaactaagacgcctctaccct

SEQ ID NO: 380690 - DNA, 25 bp, Homo sapien
gagcagcacatgctcaactctggag

SEQ ID NO: 380691 - DNA, 25 bp, Homo sapien
aactctggagcaagcagctttgcag

SEQ ID NO: 380692 - DNA, 25 bp, Homo sapien
gcagctttgcagacacattttagaa

SEQ ID NO: 380693 - DNA, 25 bp, Homo sapien
tagaaaagggattcctgcatcttct

SEQ ID NO: 380694 - DNA, 25 bp, Homo sapien
cacacacccagtcaaaagagggaga

SEQ ID NO: 380695 - DNA, 25 bp, Homo sapien
agtgtcccccttgtggaaccaaatg

SEQ ID NO: 380696 - DNA, 25 bp, Homo sapien
ggaaccaaatgtatccatcttgaat

SEQ ID NO: 380697 - DNA, 25 bp, Homo sapien
agaagctgcttaacccatggatcct

SEQ ID NO: 380698 - DNA, 25 bp, Homo sapien
agctgcttaacccatggatcctgaa

SEQ ID NO: 380699 - DNA, 25 bp, Homo sapien
ccatggatcctgaaaacataggcaa

SEQ ID NO: 380700 - DNA, 25 bp, Homo sapien
cataggcaagaagcacaggtcctga

SEQ ID NO: 380701 - DNA, 25 bp, Homo sapien
gcacaggtcctgatgagtggatctt

SEQ ID NO: 380702 - DNA, 25 bp, Homo sapien
gtggatctttactacttttaccaga

SEQ ID NO: 380703 - DNA, 25 bp, Homo sapien
tactacttttaccagattcctccct

SEQ ID NO: 380704 - DNA, 25 bp, Homo sapien
tcaagttctgccctggtgagctgtg

SEQ ID NO: 380705 - DNA, 25 bp, Homo sapien
agttctgccctggtgagctgtggcc

SEQ ID NO: 380706 - DNA, 25 bp, Homo sapien
tccaggaaaggaaatttacagtata

SEQ ID NO: 380707 - DNA, 25 bp, Homo sapien
aaatttacagtatatctcattttgg

SEQ ID NO: 380708 - DNA, 25 bp, Homo sapien
aatcttatatacttatattgggtaa

SEQ ID NO: 380709 - DNA, 25 bp, Homo sapien
tgaaggaaataagaaagctcagtct

SEQ ID NO: 380710 - DNA, 25 bp, Homo sapien
gaaagctcagtcttataagaagtct

SEQ ID NO: 380711 - DNA, 25 bp, Homo sapien
agctcagtcttataagaagtctcag

SEQ ID NO: 380712 - DNA, 25 bp, Homo sapien
cagtcttataagaagtctcagataa

SEQ ID NO: 380713 - DNA, 25 bp, Homo sapien
ataagaagtctcagataatgtgtag

SEQ ID NO: 380714 - DNA, 25 bp, Homo sapien
cagataatgtgtagactttacagaa

SEQ ID NO: 380715 - DNA, 25 bp, Homo sapien
tacagaaaagcagtttaagaatggt

SEQ ID NO: 380716 - DNA, 25 bp, Homo sapien
acatgagagttgaaaggtagtttag

SEQ ID NO: 380717 - DNA, 25 bp, Homo sapien
aattttcgtctttacctatgtgaag

SEQ ID NO: 380718 - DNA, 25 bp, Homo sapien
ttcgtctttacctatgtgaagcgag

SEQ ID NO: 380719 - DNA, 25 bp, Homo sapien
tatgtgaagcgaggtgacgtgatac

SEQ ID NO: 380720 - DNA, 25 bp, Homo sapien
ggcgccgtcttataatttagatgta

SEQ ID NO: 380721 - DNA, 25 bp, Homo sapien
gacagagctgatggccagtgtatac

SEQ ID NO: 380722 - DNA, 25 bp, Homo sapien
cagtgtatacagagcgtggcccgcg

SEQ ID NO: 380723 - DNA, 25 bp, Homo sapien
tatacagagcgtggcccgcggtgta

SEQ ID NO: 380724 - DNA, 25 bp, Homo sapien
gcccgcggtgtacaatacccatata

SEQ ID NO: 380725 - DNA, 25 bp, Homo sapien
cccatataaggtacattgtgcagga

SEQ ID NO: 380726 - DNA, 25 bp, Homo sapien
tactgaaatctgtaaacctttttat

SEQ ID NO: 380727 - DNA, 25 bp, Homo sapien
ttttatgaaacttttaagcaccagg

SEQ ID NO: 380728 - DNA, 25 bp, Homo sapien
gttggcatcctttgaggaggtagct

SEQ ID NO: 380729 - DNA, 25 bp, Homo sapien
gaggaggtagctatgcacttcacct

SEQ ID NO: 380730 - DNA, 25 bp, Homo sapien
gtagctatgcacttcacctgggagg

SEQ ID NO: 380731 - DNA, 25 bp, Homo sapien
tggatgatgctcagaagaaacctgt

SEQ ID NO: 380732 - DNA, 25 bp, Homo sapien
gaaacctgtacagggacatgatgct

SEQ ID NO: 380733 - DNA, 25 bp, Homo sapien
agacctacagcagcctggtatcatt

SEQ ID NO: 380734 - DNA, 25 bp, Homo sapien
aggcatgggcgcatcgcagctatgt

SEQ ID NO: 380735 - DNA, 25 bp, Homo sapien
gggctttgcattaccaaacctgaga

SEQ ID NO: 380736 - DNA, 25 bp, Homo sapien
aagctagagcaaggagcagagccat

SEQ ID NO: 380737 - DNA, 25 bp, Homo sapien
gatagtagaagaagccccaaacctg

SEQ ID NO: 380738 - DNA, 25 bp, Homo sapien
ataaatctctggagttggcatcctt

SEQ ID NO: 380739 - DNA, 25 bp, Homo sapien
ccctctcagtaattatgtttggcaa

SEQ ID NO: 380740 - DNA, 25 bp, Homo sapien
gaaatacaaggatctggcaaggtta

SEQ ID NO: 380741 - DNA, 25 bp, Homo sapien
tatcagtgacagtactctgaggcat

SEQ ID NO: 380742 - DNA, 25 bp, Homo sapien
tactctgaggcatctgggcatgtca

SEQ ID NO: 380743 - DNA, 25 bp, Homo sapien
ctgggcatgtcagatgaagatttat

SEQ ID NO: 380744 - DNA, 25 bp, Homo sapien
gtcagctgttgcagggatcagttgt

SEQ ID NO: 380745 - DNA, 25 bp, Homo sapien
gatcagttgttttattcctggaaaa

SEQ ID NO: 380746 - DNA, 25 bp, Homo sapien
ttgctgcaaatctatatctgacctg

SEQ ID NO: 380747 - DNA, 25 bp, Homo sapien
aaatctatatctgacctgctgagga

SEQ ID NO: 380748 - DNA, 25 bp, Homo sapien
cctgctgaggaaatcgtttggtgaa

SEQ ID NO: 380749 - DNA, 25 bp, Homo sapien
aatcgtttggtgaaatgaatccaga

SEQ ID NO: 380750 - DNA, 25 bp, Homo sapien
aggcttttagaatattatcagtatc

SEQ ID NO: 380751 - DNA, 25 bp, Homo sapien
atcagtatcttcatttctggtattc

SEQ ID NO: 380752 - DNA, 25 bp, Homo sapien
tctggtattcagatgttatgtgata

SEQ ID NO: 380753 - DNA, 25 bp, Homo sapien
tttcccagatacactatatatttgt

SEQ ID NO: 380754 - DNA, 25 bp, Homo sapien
taactgttgctcatttatggtttgt

SEQ ID NO: 380755 - DNA, 25 bp, Homo sapien
ttttgggtggtggtgttcatctgta

SEQ ID NO: 380756 - DNA, 25 bp, Homo sapien
ggtggtggtgttcatctgtatatca

SEQ ID NO: 380757 - DNA, 25 bp, Homo sapien
ctgtatatcaccatgttaatttgta

SEQ ID NO: 380758 - DNA, 25 bp, Homo sapien
ttaatttgtaatggaagtgcacttc

SEQ ID NO: 380759 - DNA, 25 bp, Homo sapien
ggaagtgcacttcgtagtgtatatt

SEQ ID NO: 380760 - DNA, 25 bp, Homo sapien
cgtagtgtatattgttactgacatt

SEQ ID NO: 380761 - DNA, 25 bp, Homo sapien
ggtgatgtcgcagctgtacagccct

SEQ ID NO: 380762 - DNA, 25 bp, Homo sapien
ctgttggctctctgcagtggaagcg

SEQ ID NO: 380763 - DNA, 25 bp, Homo sapien
ggctctctgcagtggaagcgcttct

SEQ ID NO: 380764 - DNA, 25 bp, Homo sapien
gagcaacagccgcttgtcctcgggc

SEQ ID NO: 380765 - DNA, 25 bp, Homo sapien
ttgtcctcgggctgcagttgccagt

SEQ ID NO: 380766 - DNA, 25 bp, Homo sapien
agttgccagtgcatggccagcgaga

SEQ ID NO: 380767 - DNA, 25 bp, Homo sapien
agtgcatggccagcgagaagccgaa

SEQ ID NO: 380768 - DNA, 25 bp, Homo sapien
cagcgagaagccgaagaggctcccg

SEQ ID NO: 380769 - DNA, 25 bp, Homo sapien
gggtctccatatttccggatcacgt

SEQ ID NO: 380770 - DNA, 25 bp, Homo sapien
catatttccggatcacgttgtcctc

SEQ ID NO: 380771 - DNA, 25 bp, Homo sapien
ggagccccgccgacaggtagagcaa

SEQ ID NO: 380772 - DNA, 25 bp, Homo sapien
cttcaccagctatggcattagccca

SEQ ID NO: 380773 - DNA, 25 bp, Homo sapien
ttcaccagctatggcattagcccac

SEQ ID NO: 380774 - DNA, 25 bp, Homo sapien
caccagctatggcattagcccacag

SEQ ID NO: 380775 - DNA, 25 bp, Homo sapien
accagctatggcattagcccacagg

SEQ ID NO: 380776 - DNA, 25 bp, Homo sapien
ccagctatggcattagcccacaggc

SEQ ID NO: 380777 - DNA, 25 bp, Homo sapien
cagctatggcattagcccacaggcc

SEQ ID NO: 380778 - DNA, 25 bp, Homo sapien
agctatggcattagcccacaggcca

SEQ ID NO: 380779 - DNA, 25 bp, Homo sapien
gctatggcattagcccacaggccaa

SEQ ID NO: 380780 - DNA, 25 bp, Homo sapien
ctatggcattagcccacaggccaag

SEQ ID NO: 380781 - DNA, 25 bp, Homo sapien
gagggataccatgtctaaaaactac

SEQ ID NO: 380782 - DNA, 25 bp, Homo sapien
ggataccatgtctaaaaactacaat

SEQ ID NO: 380783 - DNA, 25 bp, Homo sapien
gtaggacctggtgagatgcacctgt

SEQ ID NO: 380784 - DNA, 25 bp, Homo sapien
ggacctggtgagatgcacctgtagt

SEQ ID NO: 380785 - DNA, 25 bp, Homo sapien
agaagccttgaaacactcagccctg

SEQ ID NO: 380786 - DNA, 25 bp, Homo sapien
ttgaaacactcagccctggactgaa

SEQ ID NO: 380787 - DNA, 25 bp, Homo sapien
aacactcagccctggactgaatcct

SEQ ID NO: 380788 - DNA, 25 bp, Homo sapien
ggactgaatcctccaggcaccagag

SEQ ID NO: 380789 - DNA, 25 bp, Homo sapien
ttccaccccacttgaaacctgttgg

SEQ ID NO: 380790 - DNA, 25 bp, Homo sapien
aacctgttggccctgttgcaaccct

SEQ ID NO: 380791 - DNA, 25 bp, Homo sapien
ttacagtgaggaccactgcactccc

SEQ ID NO: 380792 - DNA, 25 bp, Homo sapien
tccactgtcatagtttcctcggtta

SEQ ID NO: 380793 - DNA, 25 bp, Homo sapien
gtcatagtttcctcggttacaattt

SEQ ID NO: 380794 - DNA, 25 bp, Homo sapien
accctcccctgggtagcagtagagg

SEQ ID NO: 380795 - DNA, 25 bp, Homo sapien
ctcctccagctctaaggttctatga

SEQ ID NO: 380796 - DNA, 25 bp, Homo sapien
aaggttctatgatcctatacaacag

SEQ ID NO: 380797 - DNA, 25 bp, Homo sapien
atgatcctatacaacaggtgacagt

SEQ ID NO: 380798 - DNA, 25 bp, Homo sapien
aggtgacagtcatagcccatatttg

SEQ ID NO: 380799 - DNA, 25 bp, Homo sapien
atatttgtcttccaactggccacct

SEQ ID NO: 380800 - DNA, 25 bp, Homo sapien
aactggccaccttttcagattctca

SEQ ID NO: 380801 - DNA, 25 bp, Homo sapien
ggagtcggttaggtctgatttcttc

SEQ ID NO: 380802 - DNA, 25 bp, Homo sapien
gatttcttccactgtcatagtttcc

SEQ ID NO: 380803 - DNA, 25 bp, Homo sapien
gaacttttggcatatgatctgcttc

SEQ ID NO: 380804 - DNA, 25 bp, Homo sapien
tgatctgcttctaattagcaatgat

SEQ ID NO: 380805 - DNA, 25 bp, Homo sapien
tagttattattcctgtccgttacca

SEQ ID NO: 380806 - DNA, 25 bp, Homo sapien
ttattattcctgtccgttaccacaa

SEQ ID NO: 380807 - DNA, 25 bp, Homo sapien
tattcctgtccgttaccacaataaa

SEQ ID NO: 380808 - DNA, 25 bp, Homo sapien
ataaaaaattggttctacgatatca

SEQ ID NO: 380809 - DNA, 25 bp, Homo sapien
ttggttctacgatatcaaaatgtct

SEQ ID NO: 380810 - DNA, 25 bp, Homo sapien
ttaaatctcccacatggttttcagg

SEQ ID NO: 380811 - DNA, 25 bp, Homo sapien
aatctcccacatggttttcaggcaa

SEQ ID NO: 380812 - DNA, 25 bp, Homo sapien
ctcccacatggttttcaggcaacaa

SEQ ID NO: 380813 - DNA, 25 bp, Homo sapien
ggttttcaggcaacaattctcaatt

SEQ ID NO: 380814 - DNA, 25 bp, Homo sapien
cttagaaatcactttgacaagtttt

SEQ ID NO: 380815 - DNA, 25 bp, Homo sapien
gacaagttttaaactcaaacactga

SEQ ID NO: 380816 - DNA, 25 bp, Homo sapien
ccaaaatttggtgcaggtatttagt

SEQ ID NO: 380817 - DNA, 25 bp, Homo sapien
gtatttagtaatgggtagaacctgt

SEQ ID NO: 380818 - DNA, 25 bp, Homo sapien
gaacctgttaatatctgagtcatat

SEQ ID NO: 380819 - DNA, 25 bp, Homo sapien
ggccaaacatggaactacctcatca

SEQ ID NO: 380820 - DNA, 25 bp, Homo sapien
caaaaatgtggccaactattaatat

SEQ ID NO: 380821 - DNA, 25 bp, Homo sapien
ttttgtttgagtcaggaacatcctg

SEQ ID NO: 380822 - DNA, 25 bp, Homo sapien
ggaacatcctgttatcaagttgcta

SEQ ID NO: 380823 - DNA, 25 bp, Homo sapien
tatcaagttgctacatcccctttca

SEQ ID NO: 380824 - DNA, 25 bp, Homo sapien
ctccttaccaaatcacttagaaatc

SEQ ID NO: 380825 - DNA, 25 bp, Homo sapien
tataaaccatagaccatacctgtgt

SEQ ID NO: 380826 - DNA, 25 bp, Homo sapien
ggaaagtcataattattacacttgt

SEQ ID NO: 380827 - DNA, 25 bp, Homo sapien
accatagaccatacctgtgtttgcc

SEQ ID NO: 380828 - DNA, 25 bp, Homo sapien
tattacacttgtacatacccttaaa

SEQ ID NO: 380829 - DNA, 25 bp, Homo sapien
ttacacttgtacatacccttaaaat

SEQ ID NO: 380830 - DNA, 25 bp, Homo sapien
aaagagcctgcttgaaatgttgcaa

SEQ ID NO: 380831 - DNA, 25 bp, Homo sapien
agagcctgcttgaaatgttgcaaaa

SEQ ID NO: 380832 - DNA, 25 bp, Homo sapien
cagaaatacctgctaatatgccctt

SEQ ID NO: 380833 - DNA, 25 bp, Homo sapien
aaatacctgctaatatgcccttcta

SEQ ID NO: 380834 - DNA, 25 bp, Homo sapien
tacctgctaatatgcccttctaatt

SEQ ID NO: 380835 - DNA, 25 bp, Homo sapien
ggctgtttaaatgggtccctaagat

SEQ ID NO: 380836 - DNA, 25 bp, Homo sapien
gtgtcaaatgtcaaactcttgagaa

SEQ ID NO: 380837 - DNA, 25 bp, Homo sapien
ctactgcttttgctgcagggatgca

SEQ ID NO: 380838 - DNA, 25 bp, Homo sapien
actgcttttgctgcagggatgcatt

SEQ ID NO: 380839 - DNA, 25 bp, Homo sapien
gcagggatgcatttcacagagcaca

SEQ ID NO: 380840 - DNA, 25 bp, Homo sapien
agggatgcatttcacagagcacatg

SEQ ID NO: 380841 - DNA, 25 bp, Homo sapien
acagagcacatgagcaactcggagg

SEQ ID NO: 380842 - DNA, 25 bp, Homo sapien
cacatgagcaactcggagggacctg

SEQ ID NO: 380843 - DNA, 25 bp, Homo sapien
aaagagactgataagctcagctcga

SEQ ID NO: 380844 - DNA, 25 bp, Homo sapien
gagactgataagctcagctcgaggc

SEQ ID NO: 380845 - DNA, 25 bp, Homo sapien
ggagagagaacctgctatctctggg

SEQ ID NO: 380846 - DNA, 25 bp, Homo sapien
gaacctgctatctctggggtccaga

SEQ ID NO: 380847 - DNA, 25 bp, Homo sapien
cagtaaaaactagtgggctatgctt

SEQ ID NO: 380848 - DNA, 25 bp, Homo sapien
aactagtgggctatgcttaggtttt

SEQ ID NO: 380849 - DNA, 25 bp, Homo sapien
agtgggctatgcttaggtttttctt

SEQ ID NO: 380850 - DNA, 25 bp, Homo sapien
gggctatgcttaggtttttcttgaa

SEQ ID NO: 380851 - DNA, 25 bp, Homo sapien
gcctggtttgaacattattaagctg

SEQ ID NO: 380852 - DNA, 25 bp, Homo sapien
ttttctatgatacagctttcaggta

SEQ ID NO: 380853 - DNA, 25 bp, Homo sapien
ctatgatacagctttcaggtagaaa

SEQ ID NO: 380854 - DNA, 25 bp, Homo sapien
gaattttcgttgtgtttaacaatgt

SEQ ID NO: 380855 - DNA, 25 bp, Homo sapien
aacaatgttgtgtttaacagcttat

SEQ ID NO: 380856 - DNA, 25 bp, Homo sapien
gtgtttaacagcttatacaaataac

SEQ ID NO: 380857 - DNA, 25 bp, Homo sapien
gtataaatggtaattgccactgtca

SEQ ID NO: 380858 - DNA, 25 bp, Homo sapien
ggtctgcttggccactcagtgcagc

SEQ ID NO: 380859 - DNA, 25 bp, Homo sapien
ggccactcagtgcagctgcgattaa

SEQ ID NO: 380860 - DNA, 25 bp, Homo sapien
gtgcagctgcgattaaccctaaagg

SEQ ID NO: 380861 - DNA, 25 bp, Homo sapien
tgcgattaaccctaaaggctttaag

SEQ ID NO: 380862 - DNA, 25 bp, Homo sapien
taaggaacgggccacctgtaacaga

SEQ ID NO: 380863 - DNA, 25 bp, Homo sapien
tgtaacagagacaccagccttcctg

SEQ ID NO: 380864 - DNA, 25 bp, Homo sapien
caccagccttcctgtatagacacta

SEQ ID NO: 380865 - DNA, 25 bp, Homo sapien
caagagtgttgagctagttcctggt

SEQ ID NO: 380866 - DNA, 25 bp, Homo sapien
gagctagttcctggtgaagtgtttc

SEQ ID NO: 380867 - DNA, 25 bp, Homo sapien
tgaagtgtttccacagaagacatgt

SEQ ID NO: 380868 - DNA, 25 bp, Homo sapien
tattaagggaaactttcctctgcct

SEQ ID NO: 380869 - DNA, 25 bp, Homo sapien
catgtgctttggatcagcaacccca

SEQ ID NO: 380870 - DNA, 25 bp, Homo sapien
agcaaccccagtggtattctaccag

SEQ ID NO: 380871 - DNA, 25 bp, Homo sapien
agcagatgtatagtcaggtcccaac

SEQ ID NO: 380872 - DNA, 25 bp, Homo sapien
tagtcaggtcccaacagcaaattgt

SEQ ID NO: 380873 - DNA, 25 bp, Homo sapien
caaattgttgggtgtgagagttcta

SEQ ID NO: 380874 - DNA, 25 bp, Homo sapien
gaaggatatgaactcctctgacctt

SEQ ID NO: 380875 - DNA, 25 bp, Homo sapien
ctctgaccttaagccagcattcatt

SEQ ID NO: 380876 - DNA, 25 bp, Homo sapien
cctggagaaaactaccgtattcaag

SEQ ID NO: 380877 - DNA, 25 bp, Homo sapien
agtgttttagccaggcgatgacaga

SEQ ID NO: 380878 - DNA, 25 bp, Homo sapien
gatgacagagaagcaccattcctca

SEQ ID NO: 380879 - DNA, 25 bp, Homo sapien
tcaccctccattcttgtaatgtctg

SEQ ID NO: 380880 - DNA, 25 bp, Homo sapien
ttgggtgtgcggacaagcagtgtgg

SEQ ID NO: 380881 - DNA, 25 bp, Homo sapien
tgggtgtgcggacaagcagtgtgga

SEQ ID NO: 380882 - DNA, 25 bp, Homo sapien
gggtgtgcggacaagcagtgtggac

SEQ ID NO: 380883 - DNA, 25 bp, Homo sapien
ggtgtgcggacaagcagtgtggact

SEQ ID NO: 380884 - DNA, 25 bp, Homo sapien
gtgtgcggacaagcagtgtggactc

SEQ ID NO: 380885 - DNA, 25 bp, Homo sapien
tgtgcggacaagcagtgtggactcc

SEQ ID NO: 380886 - DNA, 25 bp, Homo sapien
gtgcggacaagcagtgtggactccc

SEQ ID NO: 380887 - DNA, 25 bp, Homo sapien
tgcggacaagcagtgtggactcccc

SEQ ID NO: 380888 - DNA, 25 bp, Homo sapien
gcggacaagcagtgtggactcccca

SEQ ID NO: 380889 - DNA, 25 bp, Homo sapien
cggacaagcagtgtggactccccag

SEQ ID NO: 380890 - DNA, 25 bp, Homo sapien
ggacaagcagtgtggactccccagg

SEQ ID NO: 380891 - DNA, 25 bp, Homo sapien
ccaggcccaggaatgcctcaagatt

SEQ ID NO: 380892 - DNA, 25 bp, Homo sapien
caggcccaggaatgcctcaagattt

SEQ ID NO: 380893 - DNA, 25 bp, Homo sapien
gatgttatcataaacatgtacttac

SEQ ID NO: 380894 - DNA, 25 bp, Homo sapien
ccttctgaagcacttatgctctttc

SEQ ID NO: 380895 - DNA, 25 bp, Homo sapien
cttctgaagcacttatgctctttct

SEQ ID NO: 380896 - DNA, 25 bp, Homo sapien
tatggtatgtaagctctcggtctgg

SEQ ID NO: 380897 - DNA, 25 bp, Homo sapien
aagctctcggtctggggagtaacag

SEQ ID NO: 380898 - DNA, 25 bp, Homo sapien
ggagtaacagtgcagagatctacct

SEQ ID NO: 380899 - DNA, 25 bp, Homo sapien
gtaacagtgcagagatctacctgtc

SEQ ID NO: 380900 - DNA, 25 bp, Homo sapien
taacagtgcagagatctacctgtct

SEQ ID NO: 380901 - DNA, 25 bp, Homo sapien
gatctacctgtcttgttgccacatg

SEQ ID NO: 380902 - DNA, 25 bp, Homo sapien
aatgttttccgatggagggaagcac

SEQ ID NO: 380903 - DNA, 25 bp, Homo sapien
cacagttctcccatggagggaagga

SEQ ID NO: 380904 - DNA, 25 bp, Homo sapien
agccctgagcatgcatggaattccc

SEQ ID NO: 380905 - DNA, 25 bp, Homo sapien
gctctgccacactgaatctgttaga

SEQ ID NO: 380906 - DNA, 25 bp, Homo sapien
agctgttcagaactcttactgtttc

SEQ ID NO: 380907 - DNA, 25 bp, Homo sapien
gaactcttactgtttcaacattcaa

SEQ ID NO: 380908 - DNA, 25 bp, Homo sapien
aagattcactgcattgctggaccct

SEQ ID NO: 380909 - DNA, 25 bp, Homo sapien
actgcattgctggaccctctgtgaa

SEQ ID NO: 380910 - DNA, 25 bp, Homo sapien
tcctttctgttactgcagagaagct

SEQ ID NO: 380911 - DNA, 25 bp, Homo sapien
gctggtgatacctgcctgagattgc

SEQ ID NO: 380912 - DNA, 25 bp, Homo sapien
acctgcctgagattgctagttagtt

SEQ ID NO: 380913 - DNA, 25 bp, Homo sapien
gatgatggcaatgcaccttgcaggt

SEQ ID NO: 380914 - DNA, 25 bp, Homo sapien
accttgcaggtgcagtttccttggg

SEQ ID NO: 380915 - DNA, 25 bp, Homo sapien
acaaggaggttgttatctggccatc

SEQ ID NO: 380916 - DNA, 25 bp, Homo sapien
aggaggttgttatctggccatcttc

SEQ ID NO: 380917 - DNA, 25 bp, Homo sapien
aggttgttatctggccatcttcatt

SEQ ID NO: 380918 - DNA, 25 bp, Homo sapien
ttgttatctggccatcttcattccc

SEQ ID NO: 380919 - DNA, 25 bp, Homo sapien
atcttcattcccaccttgtgggaac

SEQ ID NO: 380920 - DNA, 25 bp, Homo sapien
ccaccttgtgggaactgggtccagg

SEQ ID NO: 380921 - DNA, 25 bp, Homo sapien
gaactgggtccagggaaccaacaca

SEQ ID NO: 380922 - DNA, 25 bp, Homo sapien
ctgggtccagggaaccaacacaaat

SEQ ID NO: 380923 - DNA, 25 bp, Homo sapien
ggtccagggaaccaacacaaataag

SEQ ID NO: 380924 - DNA, 25 bp, Homo sapien
gggaaacctcaagtgtaggtctaat

SEQ ID NO: 380925 - DNA, 25 bp, Homo sapien
gtctaattagtgtttctgggatcca

SEQ ID NO: 380926 - DNA, 25 bp, Homo sapien
agtgtttctgggatccaaagttaga

SEQ ID NO: 380927 - DNA, 25 bp, Homo sapien
gattttattgcctggatctgcttta

SEQ ID NO: 380928 - DNA, 25 bp, Homo sapien
gcctggatctgctttaaagacaatt

SEQ ID NO: 380929 - DNA, 25 bp, Homo sapien
gacaattggtgtttacaccctcttg

SEQ ID NO: 380930 - DNA, 25 bp, Homo sapien
tgtttacaccctcttgtcagcaaaa

SEQ ID NO: 380931 - DNA, 25 bp, Homo sapien
ttacaccctcttgtcagcaaaacag

SEQ ID NO: 380932 - DNA, 25 bp, Homo sapien
cctcttgtcagcaaaacagctagtt

SEQ ID NO: 380933 - DNA, 25 bp, Homo sapien
acagctagttaggtaaggacatata

SEQ ID NO: 380934 - DNA, 25 bp, Homo sapien
atagttccaagtaggtaaagtcact

SEQ ID NO: 380935 - DNA, 25 bp, Homo sapien
tgcttcagctgtaattctgcttctg

SEQ ID NO: 380936 - DNA, 25 bp, Homo sapien
agtggatggaaaaccttcgcaggac

SEQ ID NO: 380937 - DNA, 25 bp, Homo sapien
accttcgcaggacagttcaacctaa

SEQ ID NO: 380938 - DNA, 25 bp, Homo sapien
aataaggacaattgcaggcgagctg

SEQ ID NO: 380939 - DNA, 25 bp, Homo sapien
gaaaatgttcttcgtttatggatca

SEQ ID NO: 380940 - DNA, 25 bp, Homo sapien
gatcattgaagccaaggaccttgcc

SEQ ID NO: 380941 - DNA, 25 bp, Homo sapien
aatatttctgcgaactgtgccttga

SEQ ID NO: 380942 - DNA, 25 bp, Homo sapien
gaactgtgccttgatgataccctct

SEQ ID NO: 380943 - DNA, 25 bp, Homo sapien
gatgataccctctttgctcgtacaa

SEQ ID NO: 380944 - DNA, 25 bp, Homo sapien
cattttgaattcttcagccttccac

SEQ ID NO: 380945 - DNA, 25 bp, Homo sapien
cttcatagtatcacagttcacattt

SEQ ID NO: 380946 - DNA, 25 bp, Homo sapien
aggccaacatcattctgtgcgatga

SEQ ID NO: 380947 - DNA, 25 bp, Homo sapien
ctgtgcgatgatgcggaactgatac

SEQ ID NO: 380948 - DNA, 25 bp, Homo sapien
aactgatactcagcatcgggaacaa

SEQ ID NO: 380949 - DNA, 25 bp, Homo sapien
agccctgtgacagtgtacattgtgg

SEQ ID NO: 380950 - DNA, 25 bp, Homo sapien
tacattgtggtggtgatctgagtct

SEQ ID NO: 380951 - DNA, 25 bp, Homo sapien
tgagtcttgttgtgtctgacccact

SEQ ID NO: 380952 - DNA, 25 bp, Homo sapien
tggatgtctctttgcgttcgatgta

SEQ ID NO: 380953 - DNA, 25 bp, Homo sapien
agaaccaccatcatctttgggccgg

SEQ ID NO: 380954 - DNA, 25 bp, Homo sapien
gggccgggaccaggacaagctaaca

SEQ ID NO: 380955 - DNA, 25 bp, Homo sapien
cttggttacatcgagtacttctgga

SEQ ID NO: 380956 - DNA, 25 bp, Homo sapien
cttctggaggattgcttggaggttc

SEQ ID NO: 380957 - DNA, 25 bp, Homo sapien
ccttgaagtgctgtatagtgaagta

SEQ ID NO: 380958 - DNA, 25 bp, Homo sapien
gaagtgctgtatagtgaagtataaa

SEQ ID NO: 380959 - DNA, 25 bp, Homo sapien
tatataattatcttggtggatctat

SEQ ID NO: 380960 - DNA, 25 bp, Homo sapien
taattatcttggtggatctatttta

SEQ ID NO: 380961 - DNA, 25 bp, Homo sapien
atctattttatgcatgaccttttaa

SEQ ID NO: 380962 - DNA, 25 bp, Homo sapien
attttatgcatgaccttttaacctt

SEQ ID NO: 380963 - DNA, 25 bp, Homo sapien
ctttgcttatttcccactacgaagg

SEQ ID NO: 380964 - DNA, 25 bp, Homo sapien
gggaaggtagattttatgaatgatt

SEQ ID NO: 380965 - DNA, 25 bp, Homo sapien
ttataaagtgaaaatccagtgtgga

SEQ ID NO: 380966 - DNA, 25 bp, Homo sapien
ggaggtagcaaagcatctatctatt

SEQ ID NO: 380967 - DNA, 25 bp, Homo sapien
aggtagcaaagcatctatctattct

SEQ ID NO: 380968 - DNA, 25 bp, Homo sapien
ggcagcacttggttggtctggcctc

SEQ ID NO: 380969 - DNA, 25 bp, Homo sapien
ttggtctggcctcctgagcttagca

SEQ ID NO: 380970 - DNA, 25 bp, Homo sapien
ctgagcttagcacccatggacaaag

SEQ ID NO: 380971 - DNA, 25 bp, Homo sapien
catggacaaagctttacctgctgga

SEQ ID NO: 380972 - DNA, 25 bp, Homo sapien
tacctgctggaggtcagatgactat

SEQ ID NO: 380973 - DNA, 25 bp, Homo sapien
gatcacagcctttaagaattatcct

SEQ ID NO: 380974 - DNA, 25 bp, Homo sapien
gtatctctaggagctggaccaccag

SEQ ID NO: 380975 - DNA, 25 bp, Homo sapien
ggaccaccaggaggcagtcattctg

SEQ ID NO: 380976 - DNA, 25 bp, Homo sapien
tcaggcaatgtcttgtctacaacac

SEQ ID NO: 380977 - DNA, 25 bp, Homo sapien
atgtcttgtctacaacactgtctgt

SEQ ID NO: 380978 - DNA, 25 bp, Homo sapien
tagtagccagcatgaaccccaaaga

SEQ ID NO: 380979 - DNA, 25 bp, Homo sapien
tgttgctggtggtgataatcctaat

SEQ ID NO: 380980 - DNA, 25 bp, Homo sapien
taatcctaattctggctttttgggt

SEQ ID NO: 380981 - DNA, 25 bp, Homo sapien
tgggtactgcccaaatacaaaacaa

SEQ ID NO: 380982 - DNA, 25 bp, Homo sapien
gagaaataatgtgcccagggaccgt

SEQ ID NO: 380983 - DNA, 25 bp, Homo sapien
ccagggaccgtggagacacagccat

SEQ ID NO: 380984 - DNA, 25 bp, Homo sapien
gccatggaagttggaatctatgcaa

SEQ ID NO: 380985 - DNA, 25 bp, Homo sapien
aatctgtgccagaagtgggatccag

SEQ ID NO: 380986 - DNA, 25 bp, Homo sapien
gggatccaggccgtgtgtttccaca

SEQ ID NO: 380987 - DNA, 25 bp, Homo sapien
cgtgtgtttccacagcccaagatga

SEQ ID NO: 380988 - DNA, 25 bp, Homo sapien
tgttccaggaggtggcaccaagaga

SEQ ID NO: 380989 - DNA, 25 bp, Homo sapien
gtggcaccaagagagcaagaagcct

SEQ ID NO: 380990 - DNA, 25 bp, Homo sapien
tgaagactgttttcactctcctctg

SEQ ID NO: 380991 - DNA, 25 bp, Homo sapien
gcccatagcaagactgcttccatag

SEQ ID NO: 380992 - DNA, 25 bp, Homo sapien
agatttctcagaaccgtagccagtt

SEQ ID NO: 380993 - DNA, 25 bp, Homo sapien
gccagttctggctatttggtcaagt

SEQ ID NO: 380994 - DNA, 25 bp, Homo sapien
atttggtcaagtctgggatccctct

SEQ ID NO: 380995 - DNA, 25 bp, Homo sapien
cttacctgctattctgcagctgctt

SEQ ID NO: 380996 - DNA, 25 bp, Homo sapien
gctgctttctctgtcttacattttt

SEQ ID NO: 380997 - DNA, 25 bp, Homo sapien
tgtcttacattttttgggccacgtc

SEQ ID NO: 380998 - DNA, 25 bp, Homo sapien
ttttgggccacgtctaatcttaaag

SEQ ID NO: 380999 - DNA, 25 bp, Homo sapien
gagtaaactctacccttggtttgca

SEQ ID NO: 381000 - DNA, 25 bp, Homo sapien
tctacccttggtttgcatagtgtgc

SEQ ID NO: 381001 - DNA, 25 bp, Homo sapien
aggagctcaggagggcgcgggagtc

SEQ ID NO: 381002 - DNA, 25 bp, Homo sapien
ggagaggaggcaaggcccacggtgg

SEQ ID NO: 381003 - DNA, 25 bp, Homo sapien
acggtgggcttggcaccctcacaga

SEQ ID NO: 381004 - DNA, 25 bp, Homo sapien
tgggctttgtctccgagccttttgc

SEQ ID NO: 381005 - DNA, 25 bp, Homo sapien
gagccttttgctcccaggcaacact

SEQ ID NO: 381006 - DNA, 25 bp, Homo sapien
tcccaggcaacactgagctgagctg

SEQ ID NO: 381007 - DNA, 25 bp, Homo sapien
cccaggcaacactgagctgagctga

SEQ ID NO: 381008 - DNA, 25 bp, Homo sapien
gggtgccatggagcggctctgattg

SEQ ID NO: 381009 - DNA, 25 bp, Homo sapien
gctctgattggaggcttgaggccct

SEQ ID NO: 381010 - DNA, 25 bp, Homo sapien
ggcaagaagagctgcagtaaaagta

SEQ ID NO: 381011 - DNA, 25 bp, Homo sapien
gctgcagtaaaagtaaatctccttt

SEQ ID NO: 381012 - DNA, 25 bp, Homo sapien
agccttggggcctgtctttgaatgg

SEQ ID NO: 381013 - DNA, 25 bp, Homo sapien
gggcctgtctttgaatgggaatgag

SEQ ID NO: 381014 - DNA, 25 bp, Homo sapien
atgggaatgagactgtgcaaaccgt

SEQ ID NO: 381015 - DNA, 25 bp, Homo sapien
aatgagactgtgcaaaccgtggact

SEQ ID NO: 381016 - DNA, 25 bp, Homo sapien
tgagactgtgcaaaccgtggactac

SEQ ID NO: 381017 - DNA, 25 bp, Homo sapien
agactgtgcaaaccgtggactaccc

SEQ ID NO: 381018 - DNA, 25 bp, Homo sapien
actgtgcaaaccgtggactaccctg

SEQ ID NO: 381019 - DNA, 25 bp, Homo sapien
tgtgcaaaccgtggactaccctgtg

SEQ ID NO: 381020 - DNA, 25 bp, Homo sapien
tgcaaaccgtggactaccctgtgtc

SEQ ID NO: 381021 - DNA, 25 bp, Homo sapien
caaaccgtggactaccctgtgtcac

SEQ ID NO: 381022 - DNA, 25 bp, Homo sapien
gtggactaccctgtgtcacccacag

SEQ ID NO: 381023 - DNA, 25 bp, Homo sapien
gaatttttccagtattcctacatga

SEQ ID NO: 381024 - DNA, 25 bp, Homo sapien
ttccagtattcctacatgaaattgt

SEQ ID NO: 381025 - DNA, 25 bp, Homo sapien
ttttggtgctatattcttgtagcta

SEQ ID NO: 381026 - DNA, 25 bp, Homo sapien
ctatattcttgtagctaaagcctag

SEQ ID NO: 381027 - DNA, 25 bp, Homo sapien
gtagctaaagcctagtagaattctc

SEQ ID NO: 381028 - DNA, 25 bp, Homo sapien
aagcctagtagaattctcaagaata

SEQ ID NO: 381029 - DNA, 25 bp, Homo sapien
tcaagaataggtgaaatacactttc

SEQ ID NO: 381030 - DNA, 25 bp, Homo sapien
acactttcaaagttgcctgtcattt

SEQ ID NO: 381031 - DNA, 25 bp, Homo sapien
actttcaaagttgcctgtcatttaa

SEQ ID NO: 381032 - DNA, 25 bp, Homo sapien
aagttgcctgtcatttaaaagacca

SEQ ID NO: 381033 - DNA, 25 bp, Homo sapien
ttgcctgtcatttaaaagaccaaat

SEQ ID NO: 381034 - DNA, 25 bp, Homo sapien
agcttcctggacatggtagttcatt

SEQ ID NO: 381035 - DNA, 25 bp, Homo sapien
atggtagttcattgcatcttgggaa

SEQ ID NO: 381036 - DNA, 25 bp, Homo sapien
gtaaatcattttttcagctgtcaat

SEQ ID NO: 381037 - DNA, 25 bp, Homo sapien
gtccctcacatccttgaaccttgtt

SEQ ID NO: 381038 - DNA, 25 bp, Homo sapien
gaaccttgttcttgcaaaatcttgg

SEQ ID NO: 381039 - DNA, 25 bp, Homo sapien
caaaatcttggccttctttctgggt

SEQ ID NO: 381040 - DNA, 25 bp, Homo sapien
agtttcttggacaccacatagagga

SEQ ID NO: 381041 - DNA, 25 bp, Homo sapien
atagaggaacttggcctgatcttca

SEQ ID NO: 381042 - DNA, 25 bp, Homo sapien
cctgatcttcattcccatagttgta

SEQ ID NO: 381043 - DNA, 25 bp, Homo sapien
ggattcacacccagatctctagaaa

SEQ ID NO: 381044 - DNA, 25 bp, Homo sapien
gatcaaaagcagttccttctcgcag

SEQ ID NO: 381045 - DNA, 25 bp, Homo sapien
tcagaacttaatttgcttgagaatt

SEQ ID NO: 381046 - DNA, 25 bp, Homo sapien
gtttctctctgactcatatattaca

SEQ ID NO: 381047 - DNA, 25 bp, Homo sapien
atattacatttctcggtagcataat

SEQ ID NO: 381048 - DNA, 25 bp, Homo sapien
aactcatttggttgtgcattgccta

SEQ ID NO: 381049 - DNA, 25 bp, Homo sapien
gaagtgccacatatcccaagtgatt

SEQ ID NO: 381050 - DNA, 25 bp, Homo sapien
gttgtgcattgcctaaagttgtaaa

SEQ ID NO: 381051 - DNA, 25 bp, Homo sapien
ttaagttccagtcccatcttttctc

SEQ ID NO: 381052 - DNA, 25 bp, Homo sapien
cagtcccatcttttctcattactaa

SEQ ID NO: 381053 - DNA, 25 bp, Homo sapien
atcccaagtgattaccagtctaaat

SEQ ID NO: 381054 - DNA, 25 bp, Homo sapien
tctaaatcatagacacagttctctg

SEQ ID NO: 381055 - DNA, 25 bp, Homo sapien
aacaggtcttcagcagtcagaactt

SEQ ID NO: 381056 - DNA, 25 bp, Homo sapien
ttcctagctgtgtgaatacctgctc

SEQ ID NO: 381057 - DNA, 25 bp, Homo sapien
agctgtgtgaatacctgctcacgtc

SEQ ID NO: 381058 - DNA, 25 bp, Homo sapien
gaatacctgctcacgtcaaatgcat

SEQ ID NO: 381059 - DNA, 25 bp, Homo sapien
acctgctcacgtcaaatgcatacaa

SEQ ID NO: 381060 - DNA, 25 bp, Homo sapien
atgcatacaagtttcattctccctt

SEQ ID NO: 381061 - DNA, 25 bp, Homo sapien
atacaagtttcattctccctttcac

SEQ ID NO: 381062 - DNA, 25 bp, Homo sapien
aacacacaggtgcaacagacttgaa

SEQ ID NO: 381063 - DNA, 25 bp, Homo sapien
tgaggaggcacctacactcacctgc

SEQ ID NO: 381064 - DNA, 25 bp, Homo sapien
tgcactaacagagtggccgtcctaa

SEQ ID NO: 381065 - DNA, 25 bp, Homo sapien
gtccatcacgttagctgtcccacat

SEQ ID NO: 381066 - DNA, 25 bp, Homo sapien
gtcccacatcacaagactatgccat

SEQ ID NO: 381067 - DNA, 25 bp, Homo sapien
ctcaataatgagctcaataacattt

SEQ ID NO: 381068 - DNA, 25 bp, Homo sapien
accacaactggccttcaaaattaat

SEQ ID NO: 381069 - DNA, 25 bp, Homo sapien
ggcttaagaattgctttgttgtgct

SEQ ID NO: 381070 - DNA, 25 bp, Homo sapien
taagaattgctttgttgtgctgtgc

SEQ ID NO: 381071 - DNA, 25 bp, Homo sapien
aagaattgctttgttgtgctgtgct

SEQ ID NO: 381072 - DNA, 25 bp, Homo sapien
agaattgctttgttgtgctgtgctt

SEQ ID NO: 381073 - DNA, 25 bp, Homo sapien
gaattgctttgttgtgctgtgcttg

SEQ ID NO: 381074 - DNA, 25 bp, Homo sapien
aattgctttgttgtgctgtgcttgc

SEQ ID NO: 381075 - DNA, 25 bp, Homo sapien
gctgtgcttgcttcagcatcacata

SEQ ID NO: 381076 - DNA, 25 bp, Homo sapien
ctgtgcttgcttcagcatcacatat

SEQ ID NO: 381077 - DNA, 25 bp, Homo sapien
cttgcttcagcatcacatataaata

SEQ ID NO: 381078 - DNA, 25 bp, Homo sapien
cctgggctttagacagtgggattgc

SEQ ID NO: 381079 - DNA, 25 bp, Homo sapien
gacagtgggattgcaattaggtttg

SEQ ID NO: 381080 - DNA, 25 bp, Homo sapien
caattaggtttggagtgtttcattc

SEQ ID NO: 381081 - DNA, 25 bp, Homo sapien
tggagtgtttcattctgtttgtcag

SEQ ID NO: 381082 - DNA, 25 bp, Homo sapien
ggttgtgccaaaatgcagtttttct

SEQ ID NO: 381083 - DNA, 25 bp, Homo sapien
tttatctaatatagccaactggcag

SEQ ID NO: 381084 - DNA, 25 bp, Homo sapien
gccaactggcagaatatattgtctt

SEQ ID NO: 381085 - DNA, 25 bp, Homo sapien
ttttctgtctttacaggataggaaa

SEQ ID NO: 381086 - DNA, 25 bp, Homo sapien
ttggatcgaacatttcacctctcat

SEQ ID NO: 381087 - DNA, 25 bp, Homo sapien
tcacctctcatattaagtctggcaa

SEQ ID NO: 381088 - DNA, 25 bp, Homo sapien
ggcaatgatgactatatgtattcct

SEQ ID NO: 381089 - DNA, 25 bp, Homo sapien
gatcctgggaaagtactgttgcaca

SEQ ID NO: 381090 - DNA, 25 bp, Homo sapien
tggactcaggaatgtcctccaacca

SEQ ID NO: 381091 - DNA, 25 bp, Homo sapien
tgtgccgtctatccagaccagactt

SEQ ID NO: 381092 - DNA, 25 bp, Homo sapien
gaccagacttcggtagatgcctttg

SEQ ID NO: 381093 - DNA, 25 bp, Homo sapien
gatgcctttgttagatctatcacat

SEQ ID NO: 381094 - DNA, 25 bp, Homo sapien
gtaaacgagcttgtatctccttccc

SEQ ID NO: 381095 - DNA, 25 bp, Homo sapien
cttccctgtgccacgagagagattg

SEQ ID NO: 381096 - DNA, 25 bp, Homo sapien
ctttttattccagtctaggcagaga

SEQ ID NO: 381097 - DNA, 25 bp, Homo sapien
ataagagcacgattagagtcctgtc

SEQ ID NO: 381098 - DNA, 25 bp, Homo sapien
agtcctgtctggttatctgttgccc

SEQ ID NO: 381099 - DNA, 25 bp, Homo sapien
gactctgagtatttcctgtggatcc

SEQ ID NO: 381100 - DNA, 25 bp, Homo sapien
acgcctggatgagagagtggaacac

SEQ ID NO: 381101 - DNA, 25 bp, Homo sapien
agtggaacactgtcatcatccaggg

SEQ ID NO: 381102 - DNA, 25 bp, Homo sapien
agctcccagcctgagttgcgttact

SEQ ID NO: 381103 - DNA, 25 bp, Homo sapien
agcctgagttgcgttacttctggaa

SEQ ID NO: 381104 - DNA, 25 bp, Homo sapien
gagttgcgttacttctggaacttta

SEQ ID NO: 381105 - DNA, 25 bp, Homo sapien
gcgttacttctggaactttatatca

SEQ ID NO: 381106 - DNA, 25 bp, Homo sapien
tacttctggaactttatatcaatga

SEQ ID NO: 381107 - DNA, 25 bp, Homo sapien
atcaatgaaatcattctgttctgtg

SEQ ID NO: 381108 - DNA, 25 bp, Homo sapien
aatcattctgttctgtgtctgctgc

SEQ ID NO: 381109 - DNA, 25 bp, Homo sapien
ctgctgcttttgcttaagattatgt

SEQ ID NO: 381110 - DNA, 25 bp, Homo sapien
gtttaaatgatagagcatgaggctg

SEQ ID NO: 381111 - DNA, 25 bp, Homo sapien
tagtgtaatacaaccaagagaatca

SEQ ID NO: 381112 - DNA, 25 bp, Homo sapien
agtgtaatacaaccaagagaatcaa

SEQ ID NO: 381113 - DNA, 25 bp, Homo sapien
gtgtaatacaaccaagagaatcaaa

SEQ ID NO: 381114 - DNA, 25 bp, Homo sapien
tgtaatacaaccaagagaatcaaaa

SEQ ID NO: 381115 - DNA, 25 bp, Homo sapien
gtaatacaaccaagagaatcaaaac

SEQ ID NO: 381116 - DNA, 25 bp, Homo sapien
atacaaccaagagaatcaaaacaac

SEQ ID NO: 381117 - DNA, 25 bp, Homo sapien
tacaaccaagagaatcaaaacaaca

SEQ ID NO: 381118 - DNA, 25 bp, Homo sapien
caaccaagagaatcaaaacaacaat

SEQ ID NO: 381119 - DNA, 25 bp, Homo sapien
aaaatgttaagattggcctggcgca

SEQ ID NO: 381120 - DNA, 25 bp, Homo sapien
aaatgttaagattggcctggcgcag

SEQ ID NO: 381121 - DNA, 25 bp, Homo sapien
aatgttaagattggcctggcgcagt

SEQ ID NO: 381122 - DNA, 25 bp, Homo sapien
tataggcctgccatacttctacttt

SEQ ID NO: 381123 - DNA, 25 bp, Homo sapien
tgccatacttctactttgccaaata

SEQ ID NO: 381124 - DNA, 25 bp, Homo sapien
ctttgccaaatagcactttattatc

SEQ ID NO: 381125 - DNA, 25 bp, Homo sapien
tattatcaagatacacccatggctc

SEQ ID NO: 381126 - DNA, 25 bp, Homo sapien
aagatacacccatggctcatttcag

SEQ ID NO: 381127 - DNA, 25 bp, Homo sapien
ccatggctcatttcagactcactga

SEQ ID NO: 381128 - DNA, 25 bp, Homo sapien
aatgcacagtcgtcatattttgggc

SEQ ID NO: 381129 - DNA, 25 bp, Homo sapien
gtcgtcatattttgggcagtctgtg

SEQ ID NO: 381130 - DNA, 25 bp, Homo sapien
gagttcttggtaactcatcccctta

SEQ ID NO: 381131 - DNA, 25 bp, Homo sapien
gtaactcatccccttactacaaaag

SEQ ID NO: 381132 - DNA, 25 bp, Homo sapien
aaatatttagatttctcacattgaa

SEQ ID NO: 381133 - DNA, 25 bp, Homo sapien
cagctgctgaatttttccttgaggc

SEQ ID NO: 381134 - DNA, 25 bp, Homo sapien
ctgctgaatttttccttgaggctgt

SEQ ID NO: 381135 - DNA, 25 bp, Homo sapien
ttgaggctgtttggtgtgtgaccca

SEQ ID NO: 381136 - DNA, 25 bp, Homo sapien
agggcatttcatgaaccatctcagg

SEQ ID NO: 381137 - DNA, 25 bp, Homo sapien
tcatgaaccatctcaggcacttctg

SEQ ID NO: 381138 - DNA, 25 bp, Homo sapien
tagtccaaagggtcggaccgtgtcg

SEQ ID NO: 381139 - DNA, 25 bp, Homo sapien
tcaggcacttctgcatcacggaaga

SEQ ID NO: 381140 - DNA, 25 bp, Homo sapien
tctgcatcacggaagacctggccct

SEQ ID NO: 381141 - DNA, 25 bp, Homo sapien
agggtcggaccgtgtcgtcagccta

SEQ ID NO: 381142 - DNA, 25 bp, Homo sapien
tcggaccgtgtcgtcagcctagcgt

SEQ ID NO: 381143 - DNA, 25 bp, Homo sapien
ggacgggccaaggagactccgggct

SEQ ID NO: 381144 - DNA, 25 bp, Homo sapien
gtcagctgattagctaccttaactc

SEQ ID NO: 381145 - DNA, 25 bp, Homo sapien
atctgcatccttaattgccctttgc

SEQ ID NO: 381146 - DNA, 25 bp, Homo sapien
aggtgtaacatactcagattctggg

SEQ ID NO: 381147 - DNA, 25 bp, Homo sapien
cagagacatctttaggagctgttat

SEQ ID NO: 381148 - DNA, 25 bp, Homo sapien
aatagttaggtctttctctccagga

SEQ ID NO: 381149 - DNA, 25 bp, Homo sapien
acttgtcattcagcggttaccatgc

SEQ ID NO: 381150 - DNA, 25 bp, Homo sapien
accatgcatgggtatcttcttccaa

SEQ ID NO: 381151 - DNA, 25 bp, Homo sapien
atcttcttccaattgcctgagccag

SEQ ID NO: 381152 - DNA, 25 bp, Homo sapien
gagccagccagactttcatgtttga

SEQ ID NO: 381153 - DNA, 25 bp, Homo sapien
gagcattcagattgggctttatttc

SEQ ID NO: 381154 - DNA, 25 bp, Homo sapien
gctttatttctcaaggcatgtggca

SEQ ID NO: 381155 - DNA, 25 bp, Homo sapien
ttgaaggatagtaagcagacagcac

SEQ ID NO: 381156 - DNA, 25 bp, Homo sapien
gcactaaaagtcatccattcgttat

SEQ ID NO: 381157 - DNA, 25 bp, Homo sapien
ggatttagtcttaagaccctcattt

SEQ ID NO: 381158 - DNA, 25 bp, Homo sapien
ccctcatttgagagatgccttccct

SEQ ID NO: 381159 - DNA, 25 bp, Homo sapien
atgccttccctgtacctggaggaaa

SEQ ID NO: 381160 - DNA, 25 bp, Homo sapien
ttatctctgaagacacagggccaca

SEQ ID NO: 381161 - DNA, 25 bp, Homo sapien
gagtctgaacaaacaggctttacca

SEQ ID NO: 381162 - DNA, 25 bp, Homo sapien
tgacttgtcagccacctttgagcaa

SEQ ID NO: 381163 - DNA, 25 bp, Homo sapien
tgtcagccacctttgagcaagaact

SEQ ID NO: 381164 - DNA, 25 bp, Homo sapien
gcaagaacttgcctggagtccaaat

SEQ ID NO: 381165 - DNA, 25 bp, Homo sapien
cctggagtccaaatgtatggctatt

SEQ ID NO: 381166 - DNA, 25 bp, Homo sapien
gaaaattggatcgaacatttcacct

SEQ ID NO: 381167 - DNA, 25 bp, Homo sapien
ttggatcgaacatttcacctctcat

SEQ ID NO: 381168 - DNA, 25 bp, Homo sapien
ggatcgaacatttcacctctcatat

SEQ ID NO: 381169 - DNA, 25 bp, Homo sapien
atcgaacatttcacctctcatatta

SEQ ID NO: 381170 - DNA, 25 bp, Homo sapien
tcgaacatttcacctctcatattaa

SEQ ID NO: 381171 - DNA, 25 bp, Homo sapien
gaacatttcacctctcatattaagt

SEQ ID NO: 381172 - DNA, 25 bp, Homo sapien
atttcacctctcatattaagtctgg

SEQ ID NO: 381173 - DNA, 25 bp, Homo sapien
ttcacctctcatattaagtctggca

SEQ ID NO: 381174 - DNA, 25 bp, Homo sapien
cacctctcatattaagtctggcaat

SEQ ID NO: 381175 - DNA, 25 bp, Homo sapien
ctctcatattaagtctggcaatgat

SEQ ID NO: 381176 - DNA, 25 bp, Homo sapien
ggcaatgatgactatatgtattcct

SEQ ID NO: 381177 - DNA, 25 bp, Homo sapien
ccatatctttactatcctgtgttga

SEQ ID NO: 381178 - DNA, 25 bp, Homo sapien
atatctttactatcctgtgttgatt

SEQ ID NO: 381179 - DNA, 25 bp, Homo sapien
ctttactatcctgtgttgatttttt

SEQ ID NO: 381180 - DNA, 25 bp, Homo sapien
gacaatacatgttctttgtgggaaa

SEQ ID NO: 381181 - DNA, 25 bp, Homo sapien
aaaaatcacctgaattcaccacgac

SEQ ID NO: 381182 - DNA, 25 bp, Homo sapien
aaatcacctgaattcaccacgacca

SEQ ID NO: 381183 - DNA, 25 bp, Homo sapien
ctgaattcaccacgaccacattgtt

SEQ ID NO: 381184 - DNA, 25 bp, Homo sapien
agtggctgggcccaaaggcactttt

SEQ ID NO: 381185 - DNA, 25 bp, Homo sapien
gtggctgggcccaaaggcacttttg

SEQ ID NO: 381186 - DNA, 25 bp, Homo sapien
aatgatgtaaacttttgtggcatac

SEQ ID NO: 381187 - DNA, 25 bp, Homo sapien
tgtaaacttttgtggcatacattca

SEQ ID NO: 381188 - DNA, 25 bp, Homo sapien
ggaacagttctgtttttgacataca

SEQ ID NO: 381189 - DNA, 25 bp, Homo sapien
gacatacaggttttctttgggattg

SEQ ID NO: 381190 - DNA, 25 bp, Homo sapien
atagattcatgtcagaatggccaac

SEQ ID NO: 381191 - DNA, 25 bp, Homo sapien
atggccaacttaacgtgggtttctg

SEQ ID NO: 381192 - DNA, 25 bp, Homo sapien
taacgtgggtttctgtattccctgg

SEQ ID NO: 381193 - DNA, 25 bp, Homo sapien
tgtattccctggtgttgctcttaac

SEQ ID NO: 381194 - DNA, 25 bp, Homo sapien
gtgttgctcttaacctgaactcata

SEQ ID NO: 381195 - DNA, 25 bp, Homo sapien
gaactcataatcagttgccatactg

SEQ ID NO: 381196 - DNA, 25 bp, Homo sapien
gagcactcagggtgaacatagtcaa

SEQ ID NO: 381197 - DNA, 25 bp, Homo sapien
gtttttccatggtgaaaccttcagt

SEQ ID NO: 381198 - DNA, 25 bp, Homo sapien
tgaaaccttcagtatttggctgaat

SEQ ID NO: 381199 - DNA, 25 bp, Homo sapien
gggtaacatagcctgccaaaggctt

SEQ ID NO: 381200 - DNA, 25 bp, Homo sapien
ggtaacatagcctgccaaaggctta

SEQ ID NO: 381201 - DNA, 25 bp, Homo sapien
gtaacatagcctgccaaaggcttaa

SEQ ID NO: 381202 - DNA, 25 bp, Homo sapien
aacatagcctgccaaaggcttaagg

SEQ ID NO: 381203 - DNA, 25 bp, Homo sapien
catagcctgccaaaggcttaaggaa

SEQ ID NO: 381204 - DNA, 25 bp, Homo sapien
tagcctgccaaaggcttaaggaaat

SEQ ID NO: 381205 - DNA, 25 bp, Homo sapien
gccaaaggcttaaggaaatgcagat

SEQ ID NO: 381206 - DNA, 25 bp, Homo sapien
caaaggcttaaggaaatgcagatat

SEQ ID NO: 381207 - DNA, 25 bp, Homo sapien
aaaggcttaaggaaatgcagatatt

SEQ ID NO: 381208 - DNA, 25 bp, Homo sapien
gagcgcaacggcacaatctcagttc

SEQ ID NO: 381209 - DNA, 25 bp, Homo sapien
cgcaacggcacaatctcagttcact

SEQ ID NO: 381210 - DNA, 25 bp, Homo sapien
tcctacctctcttttcatttacgaa

SEQ ID NO: 381211 - DNA, 25 bp, Homo sapien
cgaattcaattatttgtcaggctga

SEQ ID NO: 381212 - DNA, 25 bp, Homo sapien
tgtcaggctgaacatttaaatgcac

SEQ ID NO: 381213 - DNA, 25 bp, Homo sapien
aatgcactctatgctctctagattc

SEQ ID NO: 381214 - DNA, 25 bp, Homo sapien
tatgctctctagattctccctactc

SEQ ID NO: 381215 - DNA, 25 bp, Homo sapien
ctactccccttctcattaaaattct

SEQ ID NO: 381216 - DNA, 25 bp, Homo sapien
atcaaaggaaagcaaagccctagaa

SEQ ID NO: 381217 - DNA, 25 bp, Homo sapien
accttttgttttgaggtgactcata

SEQ ID NO: 381218 - DNA, 25 bp, Homo sapien
aggtgactcatattgcagagaatgc

SEQ ID NO: 381219 - DNA, 25 bp, Homo sapien
ggagaggcaatctaaatagcaacca

SEQ ID NO: 381220 - DNA, 25 bp, Homo sapien
aatctaaatagcaaccacaccaagg

SEQ ID NO: 381221 - DNA, 25 bp, Homo sapien
gatagttcggatgtcgctgtggcaa

SEQ ID NO: 381222 - DNA, 25 bp, Homo sapien
atagttcggatgtcgctgtggcaaa

SEQ ID NO: 381223 - DNA, 25 bp, Homo sapien
ttcggatgtcgctgtggcaaagtcc

SEQ ID NO: 381224 - DNA, 25 bp, Homo sapien
tcggatgtcgctgtggcaaagtccg

SEQ ID NO: 381225 - DNA, 25 bp, Homo sapien
cggatgtcgctgtggcaaagtccga

SEQ ID NO: 381226 - DNA, 25 bp, Homo sapien
ggatgtcgctgtggcaaagtccgag

SEQ ID NO: 381227 - DNA, 25 bp, Homo sapien
atgtcgctgtggcaaagtccgaggg

SEQ ID NO: 381228 - DNA, 25 bp, Homo sapien
tgtcgctgtggcaaagtccgagggc

SEQ ID NO: 381229 - DNA, 25 bp, Homo sapien
gtcgctgtggcaaagtccgagggcc

SEQ ID NO: 381230 - DNA, 25 bp, Homo sapien
aagtccgagggccagcgctgccctg

SEQ ID NO: 381231 - DNA, 25 bp, Homo sapien
gagggccagcgctgccctggagatt

SEQ ID NO: 381232 - DNA, 25 bp, Homo sapien
gtatatttgattttgggtaacacag

SEQ ID NO: 381233 - DNA, 25 bp, Homo sapien
gagttctgccaggttggctactatg

SEQ ID NO: 381234 - DNA, 25 bp, Homo sapien
ggttggctactatgtccctttgatg

SEQ ID NO: 381235 - DNA, 25 bp, Homo sapien
gctactatgtccctttgatgtgccc

SEQ ID NO: 381236 - DNA, 25 bp, Homo sapien
tgatgtgcccatccttttgattttt

SEQ ID NO: 381237 - DNA, 25 bp, Homo sapien
gtgcccatccttttgatttttgagc

SEQ ID NO: 381238 - DNA, 25 bp, Homo sapien
gcccatccttttgatttttgagcac

SEQ ID NO: 381239 - DNA, 25 bp, Homo sapien
tttgatttttgagcacttcttactt

SEQ ID NO: 381240 - DNA, 25 bp, Homo sapien
aggttcatcttggatattccctgcc

SEQ ID NO: 381241 - DNA, 25 bp, Homo sapien
gccccaaccctagaatccctagaat

SEQ ID NO: 381242 - DNA, 25 bp, Homo sapien
cttttgttggagaatcatacttaga

SEQ ID NO: 381243 - DNA, 25 bp, Homo sapien
agtatgctcagccaagtctagttta

SEQ ID NO: 381244 - DNA, 25 bp, Homo sapien
gtctagtttaatactcagtctcttt

SEQ ID NO: 381245 - DNA, 25 bp, Homo sapien
aatactcagtctctttgggacaaat

SEQ ID NO: 381246 - DNA, 25 bp, Homo sapien
gggacaaatacacaattaactcaag

SEQ ID NO: 381247 - DNA, 25 bp, Homo sapien
aagggacaggaatcagatgggcata

SEQ ID NO: 381248 - DNA, 25 bp, Homo sapien
tgggcatagggcatctggtccatga

SEQ ID NO: 381249 - DNA, 25 bp, Homo sapien
atctggtccatgatcatcctttgtt

SEQ ID NO: 381250 - DNA, 25 bp, Homo sapien
atcctttgttcgtgctgatctctga

SEQ ID NO: 381251 - DNA, 25 bp, Homo sapien
gctgatctctgatgaaatatctgaa

SEQ ID NO: 381252 - DNA, 25 bp, Homo sapien
aaagagtgtcttagctctcatgcct

SEQ ID NO: 381253 - DNA, 25 bp, Homo sapien
tctcatgcctccaattccataaggg

SEQ ID NO: 381254 - DNA, 25 bp, Homo sapien
tcaaaattcttgctaggttactgtt

SEQ ID NO: 381255 - DNA, 25 bp, Homo sapien
aattcttgctaggttactgtttcta

SEQ ID NO: 381256 - DNA, 25 bp, Homo sapien
tgctaggttactgtttctaggtcag

SEQ ID NO: 381257 - DNA, 25 bp, Homo sapien
tctaggtcagaaaggttatttttgt

SEQ ID NO: 381258 - DNA, 25 bp, Homo sapien
tttgtttcagacttgcaccataatg

SEQ ID NO: 381259 - DNA, 25 bp, Homo sapien
gacttgcaccataatgtgatttgag

SEQ ID NO: 381260 - DNA, 25 bp, Homo sapien
aatgtgatttgagtaggtctttttt

SEQ ID NO: 381261 - DNA, 25 bp, Homo sapien
ggaaagccaatacatccacatggtt

SEQ ID NO: 381262 - DNA, 25 bp, Homo sapien
gccaatacatccacatggtttaaaa

SEQ ID NO: 381263 - DNA, 25 bp, Homo sapien
aaaatcccacagtgtgcaggcacct

SEQ ID NO: 381264 - DNA, 25 bp, Homo sapien
tcccacagtgtgcaggcacctgtag

SEQ ID NO: 381265 - DNA, 25 bp, Homo sapien
attttgatctcatttgtattttgta

SEQ ID NO: 381266 - DNA, 25 bp, Homo sapien
gacttatctgttgaggcttttgcca

SEQ ID NO: 381267 - DNA, 25 bp, Homo sapien
tctgttgaggcttttgccattgaga

SEQ ID NO: 381268 - DNA, 25 bp, Homo sapien
aattcttgatgggtttctgttagtc

SEQ ID NO: 381269 - DNA, 25 bp, Homo sapien
ggtttctgttagtcatgtattttgc

SEQ ID NO: 381270 - DNA, 25 bp, Homo sapien
gtattttgctaataatttccctagt

SEQ ID NO: 381271 - DNA, 25 bp, Homo sapien
gtagtttgccacttagtgctatttt

SEQ ID NO: 381272 - DNA, 25 bp, Homo sapien
gccacttagtgctatttttgacata

SEQ ID NO: 381273 - DNA, 25 bp, Homo sapien
tgtagttgcatgttgacctagtcca

SEQ ID NO: 381274 - DNA, 25 bp, Homo sapien
gacctagtccattatggtttttgta

SEQ ID NO: 381275 - DNA, 25 bp, Homo sapien
tttttgtatttggtccacgtggatt

SEQ ID NO: 381276 - DNA, 25 bp, Homo sapien
tctgccttcacggtactgtcccctt

SEQ ID NO: 381277 - DNA, 25 bp, Homo sapien
ttcccatgagccactactctgatgt

SEQ ID NO: 381278 - DNA, 25 bp, Homo sapien
ccatgagccactactctgatgtcag

SEQ ID NO: 381279 - DNA, 25 bp, Homo sapien
tgtcagcctataaccaaaggagctg

SEQ ID NO: 381280 - DNA, 25 bp, Homo sapien
tcagcctataaccaaaggagctggg

SEQ ID NO: 381281 - DNA, 25 bp, Homo sapien
aggcctggtgaccaacctttctcag

SEQ ID NO: 381282 - DNA, 25 bp, Homo sapien
tttctcagcccactcaatcagggtg

SEQ ID NO: 381283 - DNA, 25 bp, Homo sapien
tctcagcccactcaatcagggtgct

SEQ ID NO: 381284 - DNA, 25 bp, Homo sapien
gcaggcaggaggcaacaccctatct

SEQ ID NO: 381285 - DNA, 25 bp, Homo sapien
gcaggaggcaacaccctatctgcta

SEQ ID NO: 381286 - DNA, 25 bp, Homo sapien
gaggcaacaccctatctgctaccat

SEQ ID NO: 381287 - DNA, 25 bp, Homo sapien
tgtgcccgctttgtgcttctaaggt

SEQ ID NO: 381288 - DNA, 25 bp, Homo sapien
gcccgctttgtgcttctaaggtgca

SEQ ID NO: 381289 - DNA, 25 bp, Homo sapien
tttgtgcttctaaggtgcacaccta

SEQ ID NO: 381290 - DNA, 25 bp, Homo sapien
gcttctaaggtgcacacctagccta

SEQ ID NO: 381291 - DNA, 25 bp, Homo sapien
taaggtgcacacctagcctaggtga

SEQ ID NO: 381292 - DNA, 25 bp, Homo sapien
gcacacctagcctaggtgagacact

SEQ ID NO: 381293 - DNA, 25 bp, Homo sapien
acgccccttctcaaagccagaggtg

SEQ ID NO: 381294 - DNA, 25 bp, Homo sapien
ccccttctcaaagccagaggtgagt

SEQ ID NO: 381295 - DNA, 25 bp, Homo sapien
ggtgagtggaattaggacacacaca

SEQ ID NO: 381296 - DNA, 25 bp, Homo sapien
ggcctgcagagtaagcttattaccc

SEQ ID NO: 381297 - DNA, 25 bp, Homo sapien
gtaagcttattacccacaactgtgc

SEQ ID NO: 381298 - DNA, 25 bp, Homo sapien
ccttgaagtgctgtatagtgaagta

SEQ ID NO: 381299 - DNA, 25 bp, Homo sapien
taattatcttggtggatctatttta

SEQ ID NO: 381300 - DNA, 25 bp, Homo sapien
atctattttatgcatgaccttttaa

SEQ ID NO: 381301 - DNA, 25 bp, Homo sapien
attttatgcatgaccttttaacctt

SEQ ID NO: 381302 - DNA, 25 bp, Homo sapien
tttgactttgcttatttcccactac

SEQ ID NO: 381303 - DNA, 25 bp, Homo sapien
ctttgcttatttcccactacgaagg

SEQ ID NO: 381304 - DNA, 25 bp, Homo sapien
ttataaagtgaaaatccagtgtgga

SEQ ID NO: 381305 - DNA, 25 bp, Homo sapien
ggaggtagcaaagcatctatctatt

SEQ ID NO: 381306 - DNA, 25 bp, Homo sapien
aggtagcaaagcatctatctattct

SEQ ID NO: 381307 - DNA, 25 bp, Homo sapien
aagcatctatctattctgaatcatg

SEQ ID NO: 381308 - DNA, 25 bp, Homo sapien
tggaaataaaattgctccatctggg

SEQ ID NO: 381309 - DNA, 25 bp, Homo sapien
aagaccccatttccttatcagagag

SEQ ID NO: 381310 - DNA, 25 bp, Homo sapien
tatcagagagaactggcaccttttt

SEQ ID NO: 381311 - DNA, 25 bp, Homo sapien
gaactggcaccttttttagtgggat

SEQ ID NO: 381312 - DNA, 25 bp, Homo sapien
tgggtataagaatcaggttttggca

SEQ ID NO: 381313 - DNA, 25 bp, Homo sapien
tttttagtgggatggcaatgggcaa

SEQ ID NO: 381314 - DNA, 25 bp, Homo sapien
tcatcagagaaaactagcacctttt

SEQ ID NO: 381315 - DNA, 25 bp, Homo sapien
atgtggttaacctgaatctggcctg

SEQ ID NO: 381316 - DNA, 25 bp, Homo sapien
ggttaacctgaatctggcctgcaga

SEQ ID NO: 381317 - DNA, 25 bp, Homo sapien
ctggcctgcagatattgatatgctg

SEQ ID NO: 381318 - DNA, 25 bp, Homo sapien
atctgggttcaaatatggagtctgc

SEQ ID NO: 381319 - DNA, 25 bp, Homo sapien
aaatatggagtctgcagttagtggg

SEQ ID NO: 381320 - DNA, 25 bp, Homo sapien
gggtaacatagcctgccaaaggctt

SEQ ID NO: 381321 - DNA, 25 bp, Homo sapien
ggtaacatagcctgccaaaggctta

SEQ ID NO: 381322 - DNA, 25 bp, Homo sapien
gtaacatagcctgccaaaggcttaa

SEQ ID NO: 381323 - DNA, 25 bp, Homo sapien
aacatagcctgccaaaggcttaagg

SEQ ID NO: 381324 - DNA, 25 bp, Homo sapien
acatagcctgccaaaggcttaagga

SEQ ID NO: 381325 - DNA, 25 bp, Homo sapien
catagcctgccaaaggcttaaggaa

SEQ ID NO: 381326 - DNA, 25 bp, Homo sapien
atagcctgccaaaggcttaaggaaa

SEQ ID NO: 381327 - DNA, 25 bp, Homo sapien
tagcctgccaaaggcttaaggaaat

SEQ ID NO: 381328 - DNA, 25 bp, Homo sapien
gccaaaggcttaaggaaatgcagat

SEQ ID NO: 381329 - DNA, 25 bp, Homo sapien
caaaggcttaaggaaatgcagatat

SEQ ID NO: 381330 - DNA, 25 bp, Homo sapien
aaaggcttaaggaaatgcagatatt

SEQ ID NO: 381331 - DNA, 25 bp, Homo sapien
ccagcatcggaaagacttcccagca

SEQ ID NO: 381332 - DNA, 25 bp, Homo sapien
agcaccaagcttgagctgtgtcgtt

SEQ ID NO: 381333 - DNA, 25 bp, Homo sapien
agcttgagctgtgtcgtttcgtgga

SEQ ID NO: 381334 - DNA, 25 bp, Homo sapien
gagctgttgagagatttctgcccta

SEQ ID NO: 381335 - DNA, 25 bp, Homo sapien
gttgagagatttctgccctagagat

SEQ ID NO: 381336 - DNA, 25 bp, Homo sapien
ctgccctagagatggcctttgtata

SEQ ID NO: 381337 - DNA, 25 bp, Homo sapien
gacacaaacacatcagacactccgt

SEQ ID NO: 381338 - DNA, 25 bp, Homo sapien
actggcaggacggtgttcatcgcat

SEQ ID NO: 381339 - DNA, 25 bp, Homo sapien
tgttcatcgcattctcttctgtgac

SEQ ID NO: 381340 - DNA, 25 bp, Homo sapien
tcttctgtgaccagcctctaggcta

SEQ ID NO: 381341 - DNA, 25 bp, Homo sapien
agcctctaggctagcggctgcattc

SEQ ID NO: 381342 - DNA, 25 bp, Homo sapien
cctattccagaaagatcgccttaga

SEQ ID NO: 381343 - DNA, 25 bp, Homo sapien
tgacagatgcaaataagcctgagat

SEQ ID NO: 381344 - DNA, 25 bp, Homo sapien
gcctgagatcagcttagtgtttgaa

SEQ ID NO: 381345 - DNA, 25 bp, Homo sapien
attgctctgaactgaaatatacctg

SEQ ID NO: 381346 - DNA, 25 bp, Homo sapien
actgaaatatacctgttagttctga

SEQ ID NO: 381347 - DNA, 25 bp, Homo sapien
aatatacctgttagttctgaggtta

SEQ ID NO: 381348 - DNA, 25 bp, Homo sapien
aattacaactttcaagtcatgtata

SEQ ID NO: 381349 - DNA, 25 bp, Homo sapien
aagtcatgtataatcagaggtatca

SEQ ID NO: 381350 - DNA, 25 bp, Homo sapien
tcattgcccaatacctaagatcttt

SEQ ID NO: 381351 - DNA, 25 bp, Homo sapien
aaggaaagccagacacaatgctgca

SEQ ID NO: 381352 - DNA, 25 bp, Homo sapien
gaaagacatccaagcactgcagatt

SEQ ID NO: 381353 - DNA, 25 bp, Homo sapien
gaacctgcaggccaaaagcagcatc

SEQ ID NO: 381354 - DNA, 25 bp, Homo sapien
agcagcatcagaaggctcttcccaa

SEQ ID NO: 381355 - DNA, 25 bp, Homo sapien
atcagaaggctcttcccaaaaaggg

SEQ ID NO: 381356 - DNA, 25 bp, Homo sapien
gggcaaatcaccactgtccgcgctg

SEQ ID NO: 381357 - DNA, 25 bp, Homo sapien
actgtccgcgctggcacggaaaaag

SEQ ID NO: 381358 - DNA, 25 bp, Homo sapien
tggcacggaaaaaggcaaggctgtc

SEQ ID NO: 381359 - DNA, 25 bp, Homo sapien
aaaggcaaggctgtctttggtcatc

SEQ ID NO: 381360 - DNA, 25 bp, Homo sapien
tgtctttggtcatcaggagtcccag

SEQ ID NO: 381361 - DNA, 25 bp, Homo sapien
ctttggtcatcaggagtcccagcct

SEQ ID NO: 381362 - DNA, 25 bp, Homo sapien
gactctgagattcacaatcagcagc

SEQ ID NO: 381363 - DNA, 25 bp, Homo sapien
gagattcacaatcagcagctctaaa

SEQ ID NO: 381364 - DNA, 25 bp, Homo sapien
acaaaatcttgcttgaccctatatt

SEQ ID NO: 381365 - DNA, 25 bp, Homo sapien
gcttgaccctatattatgccatgaa

SEQ ID NO: 381366 - DNA, 25 bp, Homo sapien
gaccctatattatgccatgaatgaa

SEQ ID NO: 381367 - DNA, 25 bp, Homo sapien
tacagtgacagcttgtttcatgcat

SEQ ID NO: 381368 - DNA, 25 bp, Homo sapien
gcttgtttcatgcatagtcatggaa

SEQ ID NO: 381369 - DNA, 25 bp, Homo sapien
tagagatgttctttaaactgaccta

SEQ ID NO: 381370 - DNA, 25 bp, Homo sapien
taatgagtttcacggctttcaacac

SEQ ID NO: 381371 - DNA, 25 bp, Homo sapien
gagtttcacggctttcaacactatt

SEQ ID NO: 381372 - DNA, 25 bp, Homo sapien
acggctttcaacactattgtcatat

SEQ ID NO: 381373 - DNA, 25 bp, Homo sapien
aaaatattttgctctccaaatagaa

SEQ ID NO: 381374 - DNA, 25 bp, Homo sapien
tgctctccaaatagaattgttttta

SEQ ID NO: 381375 - DNA, 25 bp, Homo sapien
attagaactgcattgttcattcagg

SEQ ID NO: 381376 - DNA, 25 bp, Homo sapien
agaactgcattgttcattcaggagc

SEQ ID NO: 381377 - DNA, 25 bp, Homo sapien
aactgcattgttcattcaggagcca

SEQ ID NO: 381378 - DNA, 25 bp, Homo sapien
actgcattgttcattcaggagccac

SEQ ID NO: 381379 - DNA, 25 bp, Homo sapien
tgcattgttcattcaggagccacta

SEQ ID NO: 381380 - DNA, 25 bp, Homo sapien
gcattgttcattcaggagccactag

SEQ ID NO: 381381 - DNA, 25 bp, Homo sapien
cattgttcattcaggagccactagt

SEQ ID NO: 381382 - DNA, 25 bp, Homo sapien
attgttcattcaggagccactagtc

SEQ ID NO: 381383 - DNA, 25 bp, Homo sapien
ttgttcattcaggagccactagtca

SEQ ID NO: 381384 - DNA, 25 bp, Homo sapien
tgttcattcaggagccactagtcac

SEQ ID NO: 381385 - DNA, 25 bp, Homo sapien
gttcattcaggagccactagtcaca

SEQ ID NO: 381386 - DNA, 25 bp, Homo sapien
cctgtggctctgaacagcggtgtgt

SEQ ID NO: 381387 - DNA, 25 bp, Homo sapien
tgaacagcggtgtgtccctcctggt

SEQ ID NO: 381388 - DNA, 25 bp, Homo sapien
tggtgcttgcgctgtgcctctctct

SEQ ID NO: 381389 - DNA, 25 bp, Homo sapien
ctctctctggcttggttctcatagg

SEQ ID NO: 381390 - DNA, 25 bp, Homo sapien
ttctcataggctctgcttgtgggat

SEQ ID NO: 381391 - DNA, 25 bp, Homo sapien
ataggctctgcttgtgggatcagca

SEQ ID NO: 381392 - DNA, 25 bp, Homo sapien
cagcagaggcttaagatgggataca

SEQ ID NO: 381393 - DNA, 25 bp, Homo sapien
acctgggtcctttgcttctgagaat

SEQ ID NO: 381394 - DNA, 25 bp, Homo sapien
gcttctgagaatgctcaactgaaag

SEQ ID NO: 381395 - DNA, 25 bp, Homo sapien
tgctcaactgaaagagaggccttct

SEQ ID NO: 381396 - DNA, 25 bp, Homo sapien
aaagagaggccttctcatccccaag

SEQ ID NO: 381397 - DNA, 25 bp, Homo sapien
aagtgtttgttacgctttaaagcag

SEQ ID NO: 381398 - DNA, 25 bp, Homo sapien
ttttcctttatataaccggctaatg

SEQ ID NO: 381399 - DNA, 25 bp, Homo sapien
ccggctaatgaaagaggttggattg

SEQ ID NO: 381400 - DNA, 25 bp, Homo sapien
ggttggattgaattttgatgtactt

SEQ ID NO: 381401 - DNA, 25 bp, Homo sapien
aaatatctgtttgggcaggccatat

SEQ ID NO: 381402 - DNA, 25 bp, Homo sapien
gggcaggccatattggtctatgtat

SEQ ID NO: 381403 - DNA, 25 bp, Homo sapien
aggccatattggtctatgtattttt

SEQ ID NO: 381404 - DNA, 25 bp, Homo sapien
gagaacatgctttgttttgcctgtc

SEQ ID NO: 381405 - DNA, 25 bp, Homo sapien
aacatgctttgttttgcctgtcaag

SEQ ID NO: 381406 - DNA, 25 bp, Homo sapien
atgctttgttttgcctgtcaaggta

SEQ ID NO: 381407 - DNA, 25 bp, Homo sapien
ttgcctgtcaaggtaatgactttag

SEQ ID NO: 381408 - DNA, 25 bp, Homo sapien
taacatcccctggaaggaagtaact

SEQ ID NO: 381409 - DNA, 25 bp, Homo sapien
aatctttctgacaggacaccgcaac

SEQ ID NO: 381410 - DNA, 25 bp, Homo sapien
caacaactcattgtcatagtgcgac

SEQ ID NO: 381411 - DNA, 25 bp, Homo sapien
atagtgcgacaatcttagccctgtt

SEQ ID NO: 381412 - DNA, 25 bp, Homo sapien
tcttagccctgttgcaactgggcaa

SEQ ID NO: 381413 - DNA, 25 bp, Homo sapien
aaaactttcatcattgcacttccct

SEQ ID NO: 381414 - DNA, 25 bp, Homo sapien
ttgcaactgggcaaatagtccattt

SEQ ID NO: 381415 - DNA, 25 bp, Homo sapien
atttgcagagagaagcatcatcggg

SEQ ID NO: 381416 - DNA, 25 bp, Homo sapien
tcatcattgcacttccctgtttgat

SEQ ID NO: 381417 - DNA, 25 bp, Homo sapien
gtaaacagcaaactcgttatggtct

SEQ ID NO: 381418 - DNA, 25 bp, Homo sapien
gttatggtctgcaaggtaccctatt

SEQ ID NO: 381419 - DNA, 25 bp, Homo sapien
aggacagacgagcaccccatgccta

SEQ ID NO: 381420 - DNA, 25 bp, Homo sapien
cccgagctaagtcccagggcatctg

SEQ ID NO: 381421 - DNA, 25 bp, Homo sapien
aagtcccagggcatctgggccttgc

SEQ ID NO: 381422 - DNA, 25 bp, Homo sapien
gccttgcctggagactgggctagct

SEQ ID NO: 381423 - DNA, 25 bp, Homo sapien
gagactgggctagctctgtaggctc

SEQ ID NO: 381424 - DNA, 25 bp, Homo sapien
gctagctctgtaggctcggagagcc

SEQ ID NO: 381425 - DNA, 25 bp, Homo sapien
ccacctctagtattttgggagatag

SEQ ID NO: 381426 - DNA, 25 bp, Homo sapien
gagatagggaaagtgaaccgacttc

SEQ ID NO: 381427 - DNA, 25 bp, Homo sapien
taccagccaggcttactacttctag

SEQ ID NO: 381428 - DNA, 25 bp, Homo sapien
agccaggcttactacttctagaaga

SEQ ID NO: 381429 - DNA, 25 bp, Homo sapien
aaagcagagtgccagggagtgagat

SEQ ID NO: 381430 - DNA, 25 bp, Homo sapien
ggcccattcatttgtgttgtagctc

SEQ ID NO: 381431 - DNA, 25 bp, Homo sapien
gcccattcatttgtgttgtagctca

SEQ ID NO: 381432 - DNA, 25 bp, Homo sapien
cccattcatttgtgttgtagctcaa

SEQ ID NO: 381433 - DNA, 25 bp, Homo sapien
ccattcatttgtgttgtagctcaaa

SEQ ID NO: 381434 - DNA, 25 bp, Homo sapien
cattcatttgtgttgtagctcaaaa

SEQ ID NO: 381435 - DNA, 25 bp, Homo sapien
attcatttgtgttgtagctcaaaaa

SEQ ID NO: 381436 - DNA, 25 bp, Homo sapien
ttcatttgtgttgtagctcaaaaaa

SEQ ID NO: 381437 - DNA, 25 bp, Homo sapien
tcatttgtgttgtagctcaaaaaaa

SEQ ID NO: 381438 - DNA, 25 bp, Homo sapien
tctcctccggaggaagggccagctg

SEQ ID NO: 381439 - DNA, 25 bp, Homo sapien
gccagctgagtcagcagctagtcca

SEQ ID NO: 381440 - DNA, 25 bp, Homo sapien
ctagtccatagcacagccttataac

SEQ ID NO: 381441 - DNA, 25 bp, Homo sapien
aactgtaaagccaggcattgcccat

SEQ ID NO: 381442 - DNA, 25 bp, Homo sapien
gcattgcccatgagcagagctggaa

SEQ ID NO: 381443 - DNA, 25 bp, Homo sapien
ggaaccagagcttcagtcagtaaga

SEQ ID NO: 381444 - DNA, 25 bp, Homo sapien
gaagaaaactggctgctatctttat

SEQ ID NO: 381445 - DNA, 25 bp, Homo sapien
tatctttatagttccactgccctaa

SEQ ID NO: 381446 - DNA, 25 bp, Homo sapien
actgccctaaccaagtgtccacatt

SEQ ID NO: 381447 - DNA, 25 bp, Homo sapien
aaatgtgtagtgtccatcccttatg

SEQ ID NO: 381448 - DNA, 25 bp, Homo sapien
tcccttatgtaatagtggtttcccg

SEQ ID NO: 381449 - DNA, 25 bp, Homo sapien
aggtcaaagttgtctcctctccaaa

SEQ ID NO: 381450 - DNA, 25 bp, Homo sapien
aaaccttgcagaagcacctttcttc

SEQ ID NO: 381451 - DNA, 25 bp, Homo sapien
cttgcagaagcacctttcttctctt

SEQ ID NO: 381452 - DNA, 25 bp, Homo sapien
tttcttctcttcagcgcactgtttt

SEQ ID NO: 381453 - DNA, 25 bp, Homo sapien
agcgcactgttttgggactgtttat

SEQ ID NO: 381454 - DNA, 25 bp, Homo sapien
gggactgtttatgcagcagatgtaa

SEQ ID NO: 381455 - DNA, 25 bp, Homo sapien
gatgtaagtagacaacatggactcc

SEQ ID NO: 381456 - DNA, 25 bp, Homo sapien
atggactccatgtgacatgcctcta

SEQ ID NO: 381457 - DNA, 25 bp, Homo sapien
tccatgtgacatgcctctaatagta

SEQ ID NO: 381458 - DNA, 25 bp, Homo sapien
gtgacatgcctctaatagtaaagat

SEQ ID NO: 381459 - DNA, 25 bp, Homo sapien
attaatttaaagtgcaccatcagga

SEQ ID NO: 381460 - DNA, 25 bp, Homo sapien
gtaagcaggtggaatactcacccac

SEQ ID NO: 381461 - DNA, 25 bp, Homo sapien
gaatactcacccaccaagctctggg

SEQ ID NO: 381462 - DNA, 25 bp, Homo sapien
taccccgagggcctgacaagaggat

SEQ ID NO: 381463 - DNA, 25 bp, Homo sapien
ggtggcatcctccaaagaccagcct

SEQ ID NO: 381464 - DNA, 25 bp, Homo sapien
gccccagcgatgttttcttgttgta

SEQ ID NO: 381465 - DNA, 25 bp, Homo sapien
cagcgatgttttcttgttgtacaag

SEQ ID NO: 381466 - DNA, 25 bp, Homo sapien
ttgttgtacaagaaccaggtccgag

SEQ ID NO: 381467 - DNA, 25 bp, Homo sapien
agaaccaggtccgagtgttgcctcc

SEQ ID NO: 381468 - DNA, 25 bp, Homo sapien
gctgctgattgtgaatctcagagtc

SEQ ID NO: 381469 - DNA, 25 bp, Homo sapien
gattgtgaatctcagagtcttaaga

SEQ ID NO: 381470 - DNA, 25 bp, Homo sapien
gagaagccaaatatattcctcttgt

SEQ ID NO: 381471 - DNA, 25 bp, Homo sapien
tcagctctagaggtaatgtttttct

SEQ ID NO: 381472 - DNA, 25 bp, Homo sapien
gtttttctccctctgcaaaatcaac

SEQ ID NO: 381473 - DNA, 25 bp, Homo sapien
tctccctctgcaaaatcaacacaat

SEQ ID NO: 381474 - DNA, 25 bp, Homo sapien
taatttatgaactcctgatgcctaa

SEQ ID NO: 381475 - DNA, 25 bp, Homo sapien
tatgaactcctgatgcctaagaaat

SEQ ID NO: 381476 - DNA, 25 bp, Homo sapien
taaacaccacattaatacaagcatt

SEQ ID NO: 381477 - DNA, 25 bp, Homo sapien
tgatgcctaagaaatccctgtccct

SEQ ID NO: 381478 - DNA, 25 bp, Homo sapien
ttcctagtttctaccaccttcagat

SEQ ID NO: 381479 - DNA, 25 bp, Homo sapien
gtttctaccaccttcagattggagt

SEQ ID NO: 381480 - DNA, 25 bp, Homo sapien
gattggagtttgcatgagcacaata

SEQ ID NO: 381481 - DNA, 25 bp, Homo sapien
gcatgagcacaatagcctcagctct

SEQ ID NO: 381482 - DNA, 25 bp, Homo sapien
ataagcgacgtgtggttcgtaccaa

SEQ ID NO: 381483 - DNA, 25 bp, Homo sapien
aagcgacgtgtggttcgtaccaaga

SEQ ID NO: 381484 - DNA, 25 bp, Homo sapien
tgcacattatcgtgcactggcgtgc

SEQ ID NO: 381485 - DNA, 25 bp, Homo sapien
ttatcgtgcactggcgtgctcagca

SEQ ID NO: 381486 - DNA, 25 bp, Homo sapien
gtgctcagcaggtgttgtactcgat

SEQ ID NO: 381487 - DNA, 25 bp, Homo sapien
ctcagcaggtgttgtactcgataca

SEQ ID NO: 381488 - DNA, 25 bp, Homo sapien
gtactcgatacaaacaagggatcat

SEQ ID NO: 381489 - DNA, 25 bp, Homo sapien
acaagggatcatcgcagagtctgct

SEQ ID NO: 381490 - DNA, 25 bp, Homo sapien
gcagagtctgctccatactatgcta

SEQ ID NO: 381491 - DNA, 25 bp, Homo sapien
agtctgctccatactatgctatcta

SEQ ID NO: 381492 - DNA, 25 bp, Homo sapien
tactatgctatctaataagcgacgt

SEQ ID NO: 381493 - DNA, 25 bp, Homo sapien
catctagatttcaagcattcagctg

SEQ ID NO: 381494 - DNA, 25 bp, Homo sapien
attcagctgacttgcctcataaatg

SEQ ID NO: 381495 - DNA, 25 bp, Homo sapien
ctgacttgcctcataaatgtagtga

SEQ ID NO: 381496 - DNA, 25 bp, Homo sapien
aatgtagtgactgcttgatgaggtt

SEQ ID NO: 381497 - DNA, 25 bp, Homo sapien
tgactgcttgatgaggtttggaaat

SEQ ID NO: 381498 - DNA, 25 bp, Homo sapien
ttaataagtcaccttccagtccatg

SEQ ID NO: 381499 - DNA, 25 bp, Homo sapien
accttccagtccatgagacaacttg

SEQ ID NO: 381500 - DNA, 25 bp, Homo sapien
gacaacttgattattctctttaact

SEQ ID NO: 381501 - DNA, 25 bp, Homo sapien
acacaacttatgaaatctgccttta

SEQ ID NO: 381502 - DNA, 25 bp, Homo sapien
atgaaatctgcctttaacaagtaac

SEQ ID NO: 381503 - DNA, 25 bp, Homo sapien
tttattggcattgctccattttctg

SEQ ID NO: 381504 - DNA, 25 bp, Homo sapien
catactccaagtttatcggcagaat

SEQ ID NO: 381505 - DNA, 25 bp, Homo sapien
tagaacctagatctgggtgtagccc

SEQ ID NO: 381506 - DNA, 25 bp, Homo sapien
gagaacattccccaaaaggccgatg

SEQ ID NO: 381507 - DNA, 25 bp, Homo sapien
caaaaggccgatgggaatatctgtt

SEQ ID NO: 381508 - DNA, 25 bp, Homo sapien
aatatctgtttggtgggtgtctcct

SEQ ID NO: 381509 - DNA, 25 bp, Homo sapien
ggtgggtgtctccttattgtagaat

SEQ ID NO: 381510 - DNA, 25 bp, Homo sapien
aacaggttatcaaacttgacaccat

SEQ ID NO: 381511 - DNA, 25 bp, Homo sapien
gggtgtagcccagaaacacgctctg

SEQ ID NO: 381512 - DNA, 25 bp, Homo sapien
ctgccctactctgttgtagcatgta

SEQ ID NO: 381513 - DNA, 25 bp, Homo sapien
gtagcatgtagcctagttggttaac

SEQ ID NO: 381514 - DNA, 25 bp, Homo sapien
taacttgatattttccatactccaa

SEQ ID NO: 381515 - DNA, 25 bp, Homo sapien
ttcagccaagtatctatgtccagtt

SEQ ID NO: 381516 - DNA, 25 bp, Homo sapien
aactgttgattctgagtaagtctgt

SEQ ID NO: 381517 - DNA, 25 bp, Homo sapien
gtaagtctgtatgctatcaagaaca

SEQ ID NO: 381518 - DNA, 25 bp, Homo sapien
caggatcatgggaaatgcacgcaaa

SEQ ID NO: 381519 - DNA, 25 bp, Homo sapien
aaatgcacgcaaatcctgttgaagc

SEQ ID NO: 381520 - DNA, 25 bp, Homo sapien
aaatcctgttgaagcaatgcatgct

SEQ ID NO: 381521 - DNA, 25 bp, Homo sapien
aatgcatgcttcaacaaccactgac

SEQ ID NO: 381522 - DNA, 25 bp, Homo sapien
aaccactgaccactttgcataattg

SEQ ID NO: 381523 - DNA, 25 bp, Homo sapien
gaaaaacctaagcatagcccactag

SEQ ID NO: 381524 - DNA, 25 bp, Homo sapien
gcatagcccactagtttttactgtt

SEQ ID NO: 381525 - DNA, 25 bp, Homo sapien
gcaaaactatttgtattcagccaag

SEQ ID NO: 381526 - DNA, 25 bp, Homo sapien
tttaatcctgcttgacactttaccc

SEQ ID NO: 381527 - DNA, 25 bp, Homo sapien
gcttgacactttacccaagggagat

SEQ ID NO: 381528 - DNA, 25 bp, Homo sapien
gagatggtcccttttatcagttgaa

SEQ ID NO: 381529 - DNA, 25 bp, Homo sapien
atcagttgaatgttagcagcgttat

SEQ ID NO: 381530 - DNA, 25 bp, Homo sapien
cagcgttatttcagagtgtggtgac

SEQ ID NO: 381531 - DNA, 25 bp, Homo sapien
agaaactcatgtactcaaccagcca

SEQ ID NO: 381532 - DNA, 25 bp, Homo sapien
ctcaaccagccacagtttcaaacaa

SEQ ID NO: 381533 - DNA, 25 bp, Homo sapien
atgtgcaaaggacagcaaccttctt

SEQ ID NO: 381534 - DNA, 25 bp, Homo sapien
gcaaccttcttgtatgttaaaccac

SEQ ID NO: 381535 - DNA, 25 bp, Homo sapien
tgttaaaccaccagtacgctttgta

SEQ ID NO: 381536 - DNA, 25 bp, Homo sapien
gtacatctgtgataacgcctgtttt

SEQ ID NO: 381537 - DNA, 25 bp, Homo sapien
gtgaccagcgcgattcaccgctcta

SEQ ID NO: 381538 - DNA, 25 bp, Homo sapien
ccctggctgctcgaacccgggtcgc

SEQ ID NO: 381539 - DNA, 25 bp, Homo sapien
gaccagcgcgattcaccgctctaat

SEQ ID NO: 381540 - DNA, 25 bp, Homo sapien
gattcaccgctctaatcgctccggt

SEQ ID NO: 381541 - DNA, 25 bp, Homo sapien
gctctaatcgctccggttttccaag

SEQ ID NO: 381542 - DNA, 25 bp, Homo sapien
aatttgttgaaggcgcccttcccat

SEQ ID NO: 381543 - DNA, 25 bp, Homo sapien
ttgaaggcgcccttcccatagcgca

SEQ ID NO: 381544 - DNA, 25 bp, Homo sapien
ttcccatagcgcacagtaaaagcag

SEQ ID NO: 381545 - DNA, 25 bp, Homo sapien
tagcgcacagtaaaagcagtagttc

SEQ ID NO: 381546 - DNA, 25 bp, Homo sapien
gcgcacagtaaaagcagtagttctt

SEQ ID NO: 381547 - DNA, 25 bp, Homo sapien
gtaaaagcagtagttcttgtctctg

SEQ ID NO: 381548 - DNA, 25 bp, Homo sapien
atggaggccttattttcaaaaatgt

SEQ ID NO: 381549 - DNA, 25 bp, Homo sapien
aatataaggcacgttttcacacaaa

SEQ ID NO: 381550 - DNA, 25 bp, Homo sapien
ataaggcacgttttcacacaaaatt

SEQ ID NO: 381551 - DNA, 25 bp, Homo sapien
agggcatagatgcaatcattgggaa

SEQ ID NO: 381552 - DNA, 25 bp, Homo sapien
tctgtgtgctttctggactgtgata

SEQ ID NO: 381553 - DNA, 25 bp, Homo sapien
ttctggactgtgataagtgacgttt

SEQ ID NO: 381554 - DNA, 25 bp, Homo sapien
agtgacgttttatagcctgttgtat

SEQ ID NO: 381555 - DNA, 25 bp, Homo sapien
aaatatatctctgctcttcagccat

SEQ ID NO: 381556 - DNA, 25 bp, Homo sapien
atatctctgctcttcagccattttt

SEQ ID NO: 381557 - DNA, 25 bp, Homo sapien
tctctgctcttcagccatttttggt

SEQ ID NO: 381558 - DNA, 25 bp, Homo sapien
aagtatagggagttttatgacatca

SEQ ID NO: 381559 - DNA, 25 bp, Homo sapien
gggccgggagcgctgggtgttggag

SEQ ID NO: 381560 - DNA, 25 bp, Homo sapien
ggaggagcgcaccacgctgagcggt

SEQ ID NO: 381561 - DNA, 25 bp, Homo sapien
acgctgagcggtcctcgctccaagc

SEQ ID NO: 381562 - DNA, 25 bp, Homo sapien
ctagccccagcgaagtgcagtgcac

SEQ ID NO: 381563 - DNA, 25 bp, Homo sapien
agcgaagtgcagtgcacccagcagt

SEQ ID NO: 381564 - DNA, 25 bp, Homo sapien
gaagtgcagtgcacccagcagtgca

SEQ ID NO: 381565 - DNA, 25 bp, Homo sapien
tgcagtgcacccagcagtgcagtga

SEQ ID NO: 381566 - DNA, 25 bp, Homo sapien
agtgcacccagcagtgcagtgaccc

SEQ ID NO: 381567 - DNA, 25 bp, Homo sapien
tcaagtggggctgacctcccggtgc

SEQ ID NO: 381568 - DNA, 25 bp, Homo sapien
cctcccggtgccctgctgaagctgt

SEQ ID NO: 381569 - DNA, 25 bp, Homo sapien
ccccagcaggcctgaccaaaaaagg

SEQ ID NO: 381570 - DNA, 25 bp, Homo sapien
aacagtgtcgcaatcattcctcagt

SEQ ID NO: 381571 - DNA, 25 bp, Homo sapien
gtcgcaatcattcctcagttatggc

SEQ ID NO: 381572 - DNA, 25 bp, Homo sapien
ttcctcagttatggcaagaatgtgc

SEQ ID NO: 381573 - DNA, 25 bp, Homo sapien
agcccacaggccaagataacttata

SEQ ID NO: 381574 - DNA, 25 bp, Homo sapien
atgtgttcactggaaactggctgtt

SEQ ID NO: 381575 - DNA, 25 bp, Homo sapien
ggagctgaggagctgtgtctctgca

SEQ ID NO: 381576 - DNA, 25 bp, Homo sapien
gggactggccacaagcaaagagtca

SEQ ID NO: 381577 - DNA, 25 bp, Homo sapien
aagcaaagagtcagcagcatgaagc

SEQ ID NO: 381578 - DNA, 25 bp, Homo sapien
tgtagcgtgtgcagcaggcgccaat

SEQ ID NO: 381579 - DNA, 25 bp, Homo sapien
aggcgccaatccaacagcatgggaa

SEQ ID NO: 381580 - DNA, 25 bp, Homo sapien
cagcatgggaacaacagtgtcgcaa

SEQ ID NO: 381581 - DNA, 25 bp, Homo sapien
atgtgattctttgttctgcaattca

SEQ ID NO: 381582 - DNA, 25 bp, Homo sapien
tgcaattcaaatttctgggagccaa

SEQ ID NO: 381583 - DNA, 25 bp, Homo sapien
tgggagccaaacagtctccttggtt

SEQ ID NO: 381584 - DNA, 25 bp, Homo sapien
agtctccttggttcagattactgtt

SEQ ID NO: 381585 - DNA, 25 bp, Homo sapien
tactgttttttgactagagcttctc

SEQ ID NO: 381586 - DNA, 25 bp, Homo sapien
agagcttctcacttcagattctgtc

SEQ ID NO: 381587 - DNA, 25 bp, Homo sapien
aagattatggcttaacctatggttg

SEQ ID NO: 381588 - DNA, 25 bp, Homo sapien
taacctatggttgtcctttgatttg

SEQ ID NO: 381589 - DNA, 25 bp, Homo sapien
gtcctttgatttggtgccatatgaa

SEQ ID NO: 381590 - DNA, 25 bp, Homo sapien
ctgtttttcttagaaggctgagggt

SEQ ID NO: 381591 - DNA, 25 bp, Homo sapien
gtgtgttgtcagacaccatgactga

SEQ ID NO: 381592 - DNA, 25 bp, Homo sapien
tggagtagtggcacagagaccatat

SEQ ID NO: 381593 - DNA, 25 bp, Homo sapien
accatatggcctgcagaatggaaaa

SEQ ID NO: 381594 - DNA, 25 bp, Homo sapien
ggaaaatgtcacctgtttggcctct

SEQ ID NO: 381595 - DNA, 25 bp, Homo sapien
ttggcctcttaccagaaaaatttgc

SEQ ID NO: 381596 - DNA, 25 bp, Homo sapien
aaaaatttgccaaccgctcaactag

SEQ ID NO: 381597 - DNA, 25 bp, Homo sapien
aaccgctcaactagggtgtgatgga

SEQ ID NO: 381598 - DNA, 25 bp, Homo sapien
aagccactcagggaatcatctgtac

SEQ ID NO: 381599 - DNA, 25 bp, Homo sapien
gaatcatctgtacccttgtggcctg

SEQ ID NO: 381600 - DNA, 25 bp, Homo sapien
acccttgtggcctgcattttaacaa

SEQ ID NO: 381601 - DNA, 25 bp, Homo sapien
taaatttgctagaaatcttccctcc

SEQ ID NO: 381602 - DNA, 25 bp, Homo sapien
gttaatcaattgaccaaaacccagt

SEQ ID NO: 381603 - DNA, 25 bp, Homo sapien
aggatctcccaacccgaagacagca

SEQ ID NO: 381604 - DNA, 25 bp, Homo sapien
gcaggcagcccaataatgtgatcag

SEQ ID NO: 381605 - DNA, 25 bp, Homo sapien
tgtgatcagacagcctttgggtcct

SEQ ID NO: 381606 - DNA, 25 bp, Homo sapien
gcctttgggtcctgatgggtctcaa

SEQ ID NO: 381607 - DNA, 25 bp, Homo sapien
tcaaggcttcaaacagcgcagataa

SEQ ID NO: 381608 - DNA, 25 bp, Homo sapien
ggcaagaaaagatgccgccgttgct

SEQ ID NO: 381609 - DNA, 25 bp, Homo sapien
acgggttgcactgccgtggcagaca

SEQ ID NO: 381610 - DNA, 25 bp, Homo sapien
tggcagacagctggacttgagcaga

SEQ ID NO: 381611 - DNA, 25 bp, Homo sapien
ttgagcagagggaacgacctgactt

SEQ ID NO: 381612 - DNA, 25 bp, Homo sapien
ggaacgacctgacttacttgcactg

SEQ ID NO: 381613 - DNA, 25 bp, Homo sapien
actgtgaccttgaaccccatgcact

SEQ ID NO: 381614 - DNA, 25 bp, Homo sapien
agtttgtttctgtctgacaaagcaa

SEQ ID NO: 381615 - DNA, 25 bp, Homo sapien
gtttgtttctgtctgacaaagcaac

SEQ ID NO: 381616 - DNA, 25 bp, Homo sapien
atgctttctgtcatactgtgttttc

SEQ ID NO: 381617 - DNA, 25 bp, Homo sapien
tgctttctgtcatactgtgttttca

SEQ ID NO: 381618 - DNA, 25 bp, Homo sapien
gctttctgtcatactgtgttttcag

SEQ ID NO: 381619 - DNA, 25 bp, Homo sapien
ctttctgtcatactgtgttttcaga

SEQ ID NO: 381620 - DNA, 25 bp, Homo sapien
tctgtcatactgtgttttcagatgc

SEQ ID NO: 381621 - DNA, 25 bp, Homo sapien
tgtcatactgtgttttcagatgcag

SEQ ID NO: 381622 - DNA, 25 bp, Homo sapien
gtcatactgtgttttcagatgcaga

SEQ ID NO: 381623 - DNA, 25 bp, Homo sapien
catactgtgttttcagatgcagaat

SEQ ID NO: 381624 - DNA, 25 bp, Homo sapien
actgtgttttcagatgcagaatttt

SEQ ID NO: 381625 - DNA, 25 bp, Homo sapien
ccccagctcatacattcacatttag

SEQ ID NO: 381626 - DNA, 25 bp, Homo sapien
tcacatttagagtatctgggacaag

SEQ ID NO: 381627 - DNA, 25 bp, Homo sapien
aagggtcttaggaacatcaccagag

SEQ ID NO: 381628 - DNA, 25 bp, Homo sapien
gaacatcaccagagacatttggact

SEQ ID NO: 381629 - DNA, 25 bp, Homo sapien
gacctttgtctgcaaagcaatcggt

SEQ ID NO: 381630 - DNA, 25 bp, Homo sapien
gcaatcggtgagttagagtccaaac

SEQ ID NO: 381631 - DNA, 25 bp, Homo sapien
tagagtccaaacattctcacctctc

SEQ ID NO: 381632 - DNA, 25 bp, Homo sapien
tcacctctctaactggcaacaggga

SEQ ID NO: 381633 - DNA, 25 bp, Homo sapien
ggcaacagggaaccccacttggact

SEQ ID NO: 381634 - DNA, 25 bp, Homo sapien
agaccagcactctctgcctctggta

SEQ ID NO: 381635 - DNA, 25 bp, Homo sapien
ctctgcctctggtatcatcagccaa

SEQ ID NO: 381636 - DNA, 25 bp, Homo sapien
ccctgccatggctgaggtcagagtg

SEQ ID NO: 381637 - DNA, 25 bp, Homo sapien
tgaggtcagagtggcacccggcacc

SEQ ID NO: 381638 - DNA, 25 bp, Homo sapien
cccaggctgcggtgagaatgccaag

SEQ ID NO: 381639 - DNA, 25 bp, Homo sapien
ggttaagagcacaggcagcgcccca

SEQ ID NO: 381640 - DNA, 25 bp, Homo sapien
gttctgctgcctcctagctgtgtga

SEQ ID NO: 381641 - DNA, 25 bp, Homo sapien
tagctgtgtgacctaacaccagcca

SEQ ID NO: 381642 - DNA, 25 bp, Homo sapien
gcttctgggcctccatcatctgtaa

SEQ ID NO: 381643 - DNA, 25 bp, Homo sapien
gtaaaaccgggtaatagtgcacaca

SEQ ID NO: 381644 - DNA, 25 bp, Homo sapien
agtgcacacagttggtgccacataa

SEQ ID NO: 381645 - DNA, 25 bp, Homo sapien
agttggtgccacataaaggctcaac

SEQ ID NO: 381646 - DNA, 25 bp, Homo sapien
ggtgccacataaaggctcaacagat

SEQ ID NO: 381647 - DNA, 25 bp, Homo sapien
aaagttatgataccctgtgagtgtt

SEQ ID NO: 381648 - DNA, 25 bp, Homo sapien
tgataccctgtgagtgttcacagcc

SEQ ID NO: 381649 - DNA, 25 bp, Homo sapien
gtgttcattctctcctagctcagtt

SEQ ID NO: 381650 - DNA, 25 bp, Homo sapien
tagctcagttcctaggcttatgtat

SEQ ID NO: 381651 - DNA, 25 bp, Homo sapien
gttcctaggcttatgtatagggcag

SEQ ID NO: 381652 - DNA, 25 bp, Homo sapien
tcattagcacgaatttccaagatgt

SEQ ID NO: 381653 - DNA, 25 bp, Homo sapien
gggtcttgaggtgccattgtcttgc

SEQ ID NO: 381654 - DNA, 25 bp, Homo sapien
aggtgccattgtcttgctctggaaa

SEQ ID NO: 381655 - DNA, 25 bp, Homo sapien
cattgtcttgctctggaaaaggcca

SEQ ID NO: 381656 - DNA, 25 bp, Homo sapien
cttgctctggaaaaggccaagatct

SEQ ID NO: 381657 - DNA, 25 bp, Homo sapien
gaaagcatatctaccaacacttatc

SEQ ID NO: 381658 - DNA, 25 bp, Homo sapien
aagaatttgacctggctctgatccc

SEQ ID NO: 381659 - DNA, 25 bp, Homo sapien
gacctggctctgatccctggtgtgt

SEQ ID NO: 381660 - DNA, 25 bp, Homo sapien
ggtgtgttgtgtgggcctctttaac

SEQ ID NO: 381661 - DNA, 25 bp, Homo sapien
gtgtgggcctctttaacgtttgcca

SEQ ID NO: 381662 - DNA, 25 bp, Homo sapien
ctctttaacgtttgccactgagcct

SEQ ID NO: 381663 - DNA, 25 bp, Homo sapien
taacctcactgtacttcactgtact

SEQ ID NO: 381664 - DNA, 25 bp, Homo sapien
ttcactgtacttcacacgcattggt

SEQ ID NO: 381665 - DNA, 25 bp, Homo sapien
tcacacgcattggtgttaacatttt

SEQ ID NO: 381666 - DNA, 25 bp, Homo sapien
acccactgagggtttgttgtgagaa

SEQ ID NO: 381667 - DNA, 25 bp, Homo sapien
gttgtgagaattgctgaagccacgt

SEQ ID NO: 381668 - DNA, 25 bp, Homo sapien
ttgaagtggataaatcttgtaactc

SEQ ID NO: 381669 - DNA, 25 bp, Homo sapien
aaaagatgtggtttggagagcttca

SEQ ID NO: 381670 - DNA, 25 bp, Homo sapien
atgtggtttggagagcttcaggatt

SEQ ID NO: 381671 - DNA, 25 bp, Homo sapien
ggagagcttcaggattggtgaacat

SEQ ID NO: 381672 - DNA, 25 bp, Homo sapien
gagcttcaggattggtgaacatgga

SEQ ID NO: 381673 - DNA, 25 bp, Homo sapien
cttcaggattggtgaacatggaggt

SEQ ID NO: 381674 - DNA, 25 bp, Homo sapien
ctgggtggatggcacgcccggagaa

SEQ ID NO: 381675 - DNA, 25 bp, Homo sapien
atggcacgcccggagaagacgtaga

SEQ ID NO: 381676 - DNA, 25 bp, Homo sapien
cacgcccggagaagacgtagaagct

SEQ ID NO: 381677 - DNA, 25 bp, Homo sapien
gggtgctaggaacatctgctgttct

SEQ ID NO: 381678 - DNA, 25 bp, Homo sapien
gtgctaggaacatctgctgttctaa

SEQ ID NO: 381679 - DNA, 25 bp, Homo sapien
ctaggaacatctgctgttctaacat

SEQ ID NO: 381680 - DNA, 25 bp, Homo sapien
gaaatgactgctaaccagacctcgt

SEQ ID NO: 381681 - DNA, 25 bp, Homo sapien
gactgctaaccagacctcgttatga

SEQ ID NO: 381682 - DNA, 25 bp, Homo sapien
gacctcgttatgaaaccaatgatga

SEQ ID NO: 381683 - DNA, 25 bp, Homo sapien
aaaaagtcacttggtgcacctctca

SEQ ID NO: 381684 - DNA, 25 bp, Homo sapien
tcacttggtgcacctctcaacaaaa

SEQ ID NO: 381685 - DNA, 25 bp, Homo sapien
cgagttcttgtatatgcaaatcatt

SEQ ID NO: 381686 - DNA, 25 bp, Homo sapien
tgcaaatcatttacgaggcaagttt

SEQ ID NO: 381687 - DNA, 25 bp, Homo sapien
aggcaagttttcaacagacctagaa

SEQ ID NO: 381688 - DNA, 25 bp, Homo sapien
tgaaagtgtgttgttagccctcctc

SEQ ID NO: 381689 - DNA, 25 bp, Homo sapien
ctgggaccttggcaatgactcagag

SEQ ID NO: 381690 - DNA, 25 bp, Homo sapien
gggctttctgagtaaagggacattt

SEQ ID NO: 381691 - DNA, 25 bp, Homo sapien
acttttatccagatgacattacagg

SEQ ID NO: 381692 - DNA, 25 bp, Homo sapien
gacattacaggttcaagtgggttaa

SEQ ID NO: 381693 - DNA, 25 bp, Homo sapien
ggttaaggagacctcctgtacatct

SEQ ID NO: 381694 - DNA, 25 bp, Homo sapien
tcctgtacatctacagtgtttcctt

SEQ ID NO: 381695 - DNA, 25 bp, Homo sapien
aaaggtgtgttcttcataagcttca

SEQ ID NO: 381696 - DNA, 25 bp, Homo sapien
gtgttcttcataagcttcagtgcag

SEQ ID NO: 381697 - DNA, 25 bp, Homo sapien
tttttcaaagacgagctgttgtgca

SEQ ID NO: 381698 - DNA, 25 bp, Homo sapien
acgagctgttgtgcaatttgctgta

SEQ ID NO: 381699 - DNA, 25 bp, Homo sapien
ctgtatttaatgcatgttctgaaag

SEQ ID NO: 381700 - DNA, 25 bp, Homo sapien
gcatgttctgaaaggattcactttt

SEQ ID NO: 381701 - DNA, 25 bp, Homo sapien
ggattcacttttgactttatatgac

SEQ ID NO: 381702 - DNA, 25 bp, Homo sapien
aagaggttgagtcttattttcattt

SEQ ID NO: 381703 - DNA, 25 bp, Homo sapien
agaggttgagtcttattttcatttg

SEQ ID NO: 381704 - DNA, 25 bp, Homo sapien
gaggttgagtcttattttcatttgt

SEQ ID NO: 381705 - DNA, 25 bp, Homo sapien
aggttgagtcttattttcatttgta

SEQ ID NO: 381706 - DNA, 25 bp, Homo sapien
gcctagcatagtgcctttcactcag

SEQ ID NO: 381707 - DNA, 25 bp, Homo sapien
ctagcatagtgcctttcactcagtt

SEQ ID NO: 381708 - DNA, 25 bp, Homo sapien
tagcatagtgcctttcactcagttg

SEQ ID NO: 381709 - DNA, 25 bp, Homo sapien
ctttcactcagttggaatatataat

SEQ ID NO: 381710 - DNA, 25 bp, Homo sapien
tttcactcagttggaatatataata

SEQ ID NO: 381711 - DNA, 25 bp, Homo sapien
tcactcagttggaatatataataaa

SEQ ID NO: 381712 - DNA, 25 bp, Homo sapien
cactcagttggaatatataataaat

SEQ ID NO: 381713 - DNA, 25 bp, Homo sapien
aaatacccagcacaatacttgtata

SEQ ID NO: 381714 - DNA, 25 bp, Homo sapien
ggaactatgaacactagaccttatg

SEQ ID NO: 381715 - DNA, 25 bp, Homo sapien
ctagaccttatgtggtttattcctt

SEQ ID NO: 381716 - DNA, 25 bp, Homo sapien
ttattccttcaatcatttcaaacat

SEQ ID NO: 381717 - DNA, 25 bp, Homo sapien
aagtagggcctacatggttatttgc

SEQ ID NO: 381718 - DNA, 25 bp, Homo sapien
tacatggttatttgcctgctcactt

SEQ ID NO: 381719 - DNA, 25 bp, Homo sapien
atttgcctgctcactttatgtttac

SEQ ID NO: 381720 - DNA, 25 bp, Homo sapien
gcctgctcactttatgtttacatct

SEQ ID NO: 381721 - DNA, 25 bp, Homo sapien
atctcccacattcataccaatatac

SEQ ID NO: 381722 - DNA, 25 bp, Homo sapien
cacattcataccaatatacgtcagg

SEQ ID NO: 381723 - DNA, 25 bp, Homo sapien
atacgtcaggtttgcttaaccattg

SEQ ID NO: 381724 - DNA, 25 bp, Homo sapien
gcaactttaattatggtgagcgttt

SEQ ID NO: 381725 - DNA, 25 bp, Homo sapien
attatggtgagcgtttccgtttggg

SEQ ID NO: 381726 - DNA, 25 bp, Homo sapien
gtgagcgtttccgtttgggtacaag

SEQ ID NO: 381727 - DNA, 25 bp, Homo sapien
gcagaaattgtgttatactttattt

SEQ ID NO: 381728 - DNA, 25 bp, Homo sapien
atatacagtgtcatggttctatcca

SEQ ID NO: 381729 - DNA, 25 bp, Homo sapien
acagtgtcatggttctatccaatga

SEQ ID NO: 381730 - DNA, 25 bp, Homo sapien
tgacttttctgaattagcttggaga

SEQ ID NO: 381731 - DNA, 25 bp, Homo sapien
attagcttggagaactagggctgtt

SEQ ID NO: 381732 - DNA, 25 bp, Homo sapien
gaaatgatttatcccattcctctct

SEQ ID NO: 381733 - DNA, 25 bp, Homo sapien
atgatttatcccattcctctctcat

SEQ ID NO: 381734 - DNA, 25 bp, Homo sapien
tcattcacccttctgggctgactgt

SEQ ID NO: 381735 - DNA, 25 bp, Homo sapien
acacagagaatgaagccatgtccaa

SEQ ID NO: 381736 - DNA, 25 bp, Homo sapien
gccatgtccaagattgtggaactgg

SEQ ID NO: 381737 - DNA, 25 bp, Homo sapien
gagctggatgtcgttcgggaaatct

SEQ ID NO: 381738 - DNA, 25 bp, Homo sapien
gatgtcgttcgggaaatctacaaag

SEQ ID NO: 381739 - DNA, 25 bp, Homo sapien
gatgcaaatactcaagttcacacat

SEQ ID NO: 381740 - DNA, 25 bp, Homo sapien
attcaaagacagtctaccctggaaa

SEQ ID NO: 381741 - DNA, 25 bp, Homo sapien
gagctagagaaacaagggaccatta

SEQ ID NO: 381742 - DNA, 25 bp, Homo sapien
caagggaccattaaaattcacaaga

SEQ ID NO: 381743 - DNA, 25 bp, Homo sapien
gggatatcgccatactgccagttgt

SEQ ID NO: 381744 - DNA, 25 bp, Homo sapien
atactgccagttgtggcttctgcac

SEQ ID NO: 381745 - DNA, 25 bp, Homo sapien
gtggcttctgcacattgtccatggg

SEQ ID NO: 381746 - DNA, 25 bp, Homo sapien
aaatacccagcacaatacttgtata

SEQ ID NO: 381747 - DNA, 25 bp, Homo sapien
tacccagcacaatacttgtatattt

SEQ ID NO: 381748 - DNA, 25 bp, Homo sapien
ttttagtaccatacagaagtaaaat

SEQ ID NO: 381749 - DNA, 25 bp, Homo sapien
caggaactatgaacactagacctta

SEQ ID NO: 381750 - DNA, 25 bp, Homo sapien
ggaactatgaacactagaccttatg

SEQ ID NO: 381751 - DNA, 25 bp, Homo sapien
ctatgaacactagaccttatgtggt

SEQ ID NO: 381752 - DNA, 25 bp, Homo sapien
gaacactagaccttatgtggtttat

SEQ ID NO: 381753 - DNA, 25 bp, Homo sapien
acactagaccttatgtggtttattc

SEQ ID NO: 381754 - DNA, 25 bp, Homo sapien
catttcaaacattgaaagtagggcc

SEQ ID NO: 381755 - DNA, 25 bp, Homo sapien
cacattcataccaatatacgtcagg

SEQ ID NO: 381756 - DNA, 25 bp, Homo sapien
ttcataccaatatacgtcaggtttg

SEQ ID NO: 381757 - DNA, 25 bp, Homo sapien
atatagctttttgttgttggatact

SEQ ID NO: 381758 - DNA, 25 bp, Homo sapien
agctttttgttgttggatactttca

SEQ ID NO: 381759 - DNA, 25 bp, Homo sapien
ggatactttcatctggatacattct

SEQ ID NO: 381760 - DNA, 25 bp, Homo sapien
ctggatacattcttggaaataggat

SEQ ID NO: 381761 - DNA, 25 bp, Homo sapien
cattcttggaaataggatcattggg

SEQ ID NO: 381762 - DNA, 25 bp, Homo sapien
gttttttgtgccagggtggtatata

SEQ ID NO: 381763 - DNA, 25 bp, Homo sapien
tgtgccagggtggtatatacacttt

SEQ ID NO: 381764 - DNA, 25 bp, Homo sapien
gccagggtggtatatacactttttt

SEQ ID NO: 381765 - DNA, 25 bp, Homo sapien
ggtggtatatacactttttttgcct

SEQ ID NO: 381766 - DNA, 25 bp, Homo sapien
ttgcctttgatatggccagattgct

SEQ ID NO: 381767 - DNA, 25 bp, Homo sapien
gaacaatatcatatgtatctttgtg

SEQ ID NO: 381768 - DNA, 25 bp, Homo sapien
aacatcagaggatttacagtagaaa

SEQ ID NO: 381769 - DNA, 25 bp, Homo sapien
acatcagaggatttacagtagaaag

SEQ ID NO: 381770 - DNA, 25 bp, Homo sapien
cagaggatttacagtagaaagaact

SEQ ID NO: 381771 - DNA, 25 bp, Homo sapien
tagaaagaactaaggaactaacact

SEQ ID NO: 381772 - DNA, 25 bp, Homo sapien
gtataacaaaagttgaacctgttag

SEQ ID NO: 381773 - DNA, 25 bp, Homo sapien
aggtttttgaagagatatattcgaa

SEQ ID NO: 381774 - DNA, 25 bp, Homo sapien
aaaattatactatttcaacattctc

SEQ ID NO: 381775 - DNA, 25 bp, Homo sapien
atttcaacattctcatttatgtgaa

SEQ ID NO: 381776 - DNA, 25 bp, Homo sapien
tcaacattctcatttatgtgaaagc

SEQ ID NO: 381777 - DNA, 25 bp, Homo sapien
aacattctcatttatgtgaaagcat

SEQ ID NO: 381778 - DNA, 25 bp, Homo sapien
cattctcatttatgtgaaagcatgt

SEQ ID NO: 381779 - DNA, 25 bp, Homo sapien
gatgtggcttcttaggttcctctgg

SEQ ID NO: 381780 - DNA, 25 bp, Homo sapien
tgtggcttcttaggttcctctggga

SEQ ID NO: 381781 - DNA, 25 bp, Homo sapien
tggcttcttaggttcctctgggagc

SEQ ID NO: 381782 - DNA, 25 bp, Homo sapien
gcttcttaggttcctctgggagctg

SEQ ID NO: 381783 - DNA, 25 bp, Homo sapien
gttgatggagcgtccctgaagcccc

SEQ ID NO: 381784 - DNA, 25 bp, Homo sapien
gatggagcgtccctgaagcccccag

SEQ ID NO: 381785 - DNA, 25 bp, Homo sapien
tatagagacctcaacagactgcccc

SEQ ID NO: 381786 - DNA, 25 bp, Homo sapien
agagacctcaacagactgccccggg

SEQ ID NO: 381787 - DNA, 25 bp, Homo sapien
gggccaaggcgaaggcttcccatca

SEQ ID NO: 381788 - DNA, 25 bp, Homo sapien
gaaggcttcccatcaccacaggaag

SEQ ID NO: 381789 - DNA, 25 bp, Homo sapien
aggcttcccatcaccacaggaagtg

SEQ ID NO: 381790 - DNA, 25 bp, Homo sapien
gactcagttgcactgagaacatctt

SEQ ID NO: 381791 - DNA, 25 bp, Homo sapien
ctttgaatgagcaggccctctttaa

SEQ ID NO: 381792 - DNA, 25 bp, Homo sapien
caggccctctttaatccagaagttt

SEQ ID NO: 381793 - DNA, 25 bp, Homo sapien
tggactctattgaaacgggctaact

SEQ ID NO: 381794 - DNA, 25 bp, Homo sapien
aacgggctaactcatttaccagata

SEQ ID NO: 381795 - DNA, 25 bp, Homo sapien
accagatacattgcagttttctctt

SEQ ID NO: 381796 - DNA, 25 bp, Homo sapien
gggtttgccaattttatcttggaga

SEQ ID NO: 381797 - DNA, 25 bp, Homo sapien
atattgaccaaactgctgtgtccct

SEQ ID NO: 381798 - DNA, 25 bp, Homo sapien
gctgtgtccctcacggctccaaaaa

SEQ ID NO: 381799 - DNA, 25 bp, Homo sapien
caaaaacttctgagccttggtcaaa

SEQ ID NO: 381800 - DNA, 25 bp, Homo sapien
ctgagccttggtcaaattactttgt

SEQ ID NO: 381801 - DNA, 25 bp, Homo sapien
agtggacccactgactcctggacat

SEQ ID NO: 381802 - DNA, 25 bp, Homo sapien
actgactcctggacatcaggatgct

SEQ ID NO: 381803 - DNA, 25 bp, Homo sapien
gcaaaggtgttatcatccatgttct

SEQ ID NO: 381804 - DNA, 25 bp, Homo sapien
ggtgttatcatccatgttcttcgtc

SEQ ID NO: 381805 - DNA, 25 bp, Homo sapien
atcatccatgttcttcgtcttcagt

SEQ ID NO: 381806 - DNA, 25 bp, Homo sapien
atgttcttcgtcttcagttcctcct

SEQ ID NO: 381807 - DNA, 25 bp, Homo sapien
ttcgtcttcagttcctcctcggcag

SEQ ID NO: 381808 - DNA, 25 bp, Homo sapien
acgggaccctggcactcgggctgtg

SEQ ID NO: 381809 - DNA, 25 bp, Homo sapien
gggttgccagtcatcggaacgtcag

SEQ ID NO: 381810 - DNA, 25 bp, Homo sapien
gtcatcggaacgtcagaaacctgaa

SEQ ID NO: 381811 - DNA, 25 bp, Homo sapien
aaacctgaagtgtcatctggggcca

SEQ ID NO: 381812 - DNA, 25 bp, Homo sapien
agatgtaacatgacagcacccaccc

SEQ ID NO: 381813 - DNA, 25 bp, Homo sapien
gataccacgtatctcttcatttctg

SEQ ID NO: 381814 - DNA, 25 bp, Homo sapien
ttctgcctcagaactaagcattcat

SEQ ID NO: 381815 - DNA, 25 bp, Homo sapien
acaggatcgcttcccaaagtaatct

SEQ ID NO: 381816 - DNA, 25 bp, Homo sapien
aaagtaatctccctacacacaagac

SEQ ID NO: 381817 - DNA, 25 bp, Homo sapien
tacacacaagacctcatggctctgc

SEQ ID NO: 381818 - DNA, 25 bp, Homo sapien
ctgtcactcagctcgattcaaggaa

SEQ ID NO: 381819 - DNA, 25 bp, Homo sapien
tagcgagcaagcaccctgacaagta

SEQ ID NO: 381820 - DNA, 25 bp, Homo sapien
aattttagctatacctcagccttgc

SEQ ID NO: 381821 - DNA, 25 bp, Homo sapien
accttttagtgcagccatcgctatg

SEQ ID NO: 381822 - DNA, 25 bp, Homo sapien
ccatcgctatggcaactatctttac

SEQ ID NO: 381823 - DNA, 25 bp, Homo sapien
aaatcttggattatttgtgatagta

SEQ ID NO: 381824 - DNA, 25 bp, Homo sapien
gtgatagtaatcacaaatttttggc

SEQ ID NO: 381825 - DNA, 25 bp, Homo sapien
ggaaatgcagcctagtcttgagaac

SEQ ID NO: 381826 - DNA, 25 bp, Homo sapien
gcagcctagtcttgagaacataatt

SEQ ID NO: 381827 - DNA, 25 bp, Homo sapien
gttaaactattaccacacagcccat

SEQ ID NO: 381828 - DNA, 25 bp, Homo sapien
aactattaccacacagcccataaaa

SEQ ID NO: 381829 - DNA, 25 bp, Homo sapien
acagcccataaaacagcatttgcgt

SEQ ID NO: 381830 - DNA, 25 bp, Homo sapien
acagcatttgcgtttattgagagag

SEQ ID NO: 381831 - DNA, 25 bp, Homo sapien
attgagagagaggatgtgccatcat

SEQ ID NO: 381832 - DNA, 25 bp, Homo sapien
ggatgtgccatcatgattaatgaaa

SEQ ID NO: 381833 - DNA, 25 bp, Homo sapien
taatttgcagtgtttggattgtata

SEQ ID NO: 381834 - DNA, 25 bp, Homo sapien
ttctgcagcccagaggagaggcttc

SEQ ID NO: 381835 - DNA, 25 bp, Homo sapien
ggcttccactgacatttggactgga

SEQ ID NO: 381836 - DNA, 25 bp, Homo sapien
atgttcagtgaagcgtctcagttgc

SEQ ID NO: 381837 - DNA, 25 bp, Homo sapien
tctcagttgctgttgtattggcgta

SEQ ID NO: 381838 - DNA, 25 bp, Homo sapien
ttggcgtaggattagtcaatgactt

SEQ ID NO: 381839 - DNA, 25 bp, Homo sapien
agggagaggccccaattttgccacg

SEQ ID NO: 381840 - DNA, 25 bp, Homo sapien
attttgccacggtcgcctgtaggaa

SEQ ID NO: 381841 - DNA, 25 bp, Homo sapien
ttcacccttatcaagttgggaaact

SEQ ID NO: 381842 - DNA, 25 bp, Homo sapien
gaaactacttcccacagtaaggaat

SEQ ID NO: 381843 - DNA, 25 bp, Homo sapien
aagctctcggcccagatcaatgtaa

SEQ ID NO: 381844 - DNA, 25 bp, Homo sapien
atcaatgtaaccatcaaagcctggg

SEQ ID NO: 381845 - DNA, 25 bp, Homo sapien
gtttaaccattcagtatcattacaa

SEQ ID NO: 381846 - DNA, 25 bp, Homo sapien
acaaatcttcagtgatgtctaccat

SEQ ID NO: 381847 - DNA, 25 bp, Homo sapien
gtgatgtctaccatattctaagcaa

SEQ ID NO: 381848 - DNA, 25 bp, Homo sapien
ggaaacaagttcctggcattcaagg

SEQ ID NO: 381849 - DNA, 25 bp, Homo sapien
agttcctggcattcaagggcgtata

SEQ ID NO: 381850 - DNA, 25 bp, Homo sapien
agggcgtatactctgccgggaaata

SEQ ID NO: 381851 - DNA, 25 bp, Homo sapien
gccgggaaatacagacacataagag

SEQ ID NO: 381852 - DNA, 25 bp, Homo sapien
gccacaggtgccaagttagaattat

SEQ ID NO: 381853 - DNA, 25 bp, Homo sapien
cagcggtagtgcaacaacctggaga

SEQ ID NO: 381854 - DNA, 25 bp, Homo sapien
caacctggagaatagtcattgtaat

SEQ ID NO: 381855 - DNA, 25 bp, Homo sapien
aagtgtccaaaagcataggatgagc

SEQ ID NO: 381856 - DNA, 25 bp, Homo sapien
gacatggcgactcccggccctgtga

SEQ ID NO: 381857 - DNA, 25 bp, Homo sapien
gactcccggccctgtgattccggag

SEQ ID NO: 381858 - DNA, 25 bp, Homo sapien
tgtgattccggaggtcccctttgaa

SEQ ID NO: 381859 - DNA, 25 bp, Homo sapien
ggaggtcccctttgaaccatcgaag

SEQ ID NO: 381860 - DNA, 25 bp, Homo sapien
tttgaaccatcgaagcctccagtca

SEQ ID NO: 381861 - DNA, 25 bp, Homo sapien
aaccatcgaagcctccagtcattga

SEQ ID NO: 381862 - DNA, 25 bp, Homo sapien
catcgaagcctccagtcattgaggg

SEQ ID NO: 381863 - DNA, 25 bp, Homo sapien
ggctgagccccactgtttacaggaa

SEQ ID NO: 381864 - DNA, 25 bp, Homo sapien
tgagccccactgtttacaggaatcc

SEQ ID NO: 381865 - DNA, 25 bp, Homo sapien
gccccactgtttacaggaatccaga

SEQ ID NO: 381866 - DNA, 25 bp, Homo sapien
ttacaggaatccagagagtttcaag

SEQ ID NO: 381867 - DNA, 25 bp, Homo sapien
gtgcggacaagcagtgtggactccc

SEQ ID NO: 381868 - DNA, 25 bp, Homo sapien
tgcggacaagcagtgtggactcccc

SEQ ID NO: 381869 - DNA, 25 bp, Homo sapien
gcggacaagcagtgtggactcccca

SEQ ID NO: 381870 - DNA, 25 bp, Homo sapien
cggacaagcagtgtggactccccag

SEQ ID NO: 381871 - DNA, 25 bp, Homo sapien
ggacaagcagtgtggactccccagg

SEQ ID NO: 381872 - DNA, 25 bp, Homo sapien
gacaagcagtgtggactccccagga

SEQ ID NO: 381873 - DNA, 25 bp, Homo sapien
acaagcagtgtggactccccaggag

SEQ ID NO: 381874 - DNA, 25 bp, Homo sapien
caagcagtgtggactccccaggagc

SEQ ID NO: 381875 - DNA, 25 bp, Homo sapien
aagcagtgtggactccccaggagca

SEQ ID NO: 381876 - DNA, 25 bp, Homo sapien
agcagtgtggactccccaggagcac

SEQ ID NO: 381877 - DNA, 25 bp, Homo sapien
tgtggactccccaggagcacccagg

SEQ ID NO: 381878 - DNA, 25 bp, Homo sapien
aaatcttgaatttctaagaggctta

SEQ ID NO: 381879 - DNA, 25 bp, Homo sapien
atcttgaatttctaagaggcttatt

SEQ ID NO: 381880 - DNA, 25 bp, Homo sapien
tttctaagaggcttattttgttctt

SEQ ID NO: 381881 - DNA, 25 bp, Homo sapien
tcttttggctgaatgagtatatttg

SEQ ID NO: 381882 - DNA, 25 bp, Homo sapien
atagatgattctgtttacattgttc

SEQ ID NO: 381883 - DNA, 25 bp, Homo sapien
gattctgtttacattgttcatatga

SEQ ID NO: 381884 - DNA, 25 bp, Homo sapien
gttcatatgaataataatctgtgtt

SEQ ID NO: 381885 - DNA, 25 bp, Homo sapien
aatctgtgttaatttcattttgata

SEQ ID NO: 381886 - DNA, 25 bp, Homo sapien
gataattggcctttaatatttgtat

SEQ ID NO: 381887 - DNA, 25 bp, Homo sapien
aattggcctttaatatttgtatctc

SEQ ID NO: 381888 - DNA, 25 bp, Homo sapien
ctctgttactgtaaaataatagcta

SEQ ID NO: 381889 - DNA, 25 bp, Homo sapien
ttagtttttggcctccctatcctct

SEQ ID NO: 381890 - DNA, 25 bp, Homo sapien
cacatgagaacactgcctggatgca

SEQ ID NO: 381891 - DNA, 25 bp, Homo sapien
aacactgcctggatgcatctcatga

SEQ ID NO: 381892 - DNA, 25 bp, Homo sapien
ctggatgcatctcatgatctctgga

SEQ ID NO: 381893 - DNA, 25 bp, Homo sapien
gatctctggagaatttccccatctt

SEQ ID NO: 381894 - DNA, 25 bp, Homo sapien
tcttctttccatcgtgtggattcaa

SEQ ID NO: 381895 - DNA, 25 bp, Homo sapien
taccttttgatgtttagaagttcgt

SEQ ID NO: 381896 - DNA, 25 bp, Homo sapien
agaagttcgtggaagtagacgctga

SEQ ID NO: 381897 - DNA, 25 bp, Homo sapien
gataacagagaatgccagggaagat

SEQ ID NO: 381898 - DNA, 25 bp, Homo sapien
ctgggtcagggtacttggatgaaac

SEQ ID NO: 381899 - DNA, 25 bp, Homo sapien
tacttggatgaaacggtgcaggcca

SEQ ID NO: 381900 - DNA, 25 bp, Homo sapien
gtaagcactaacatttctgcattca

SEQ ID NO: 381901 - DNA, 25 bp, Homo sapien
gggcacctaacattaaggacaaccg

SEQ ID NO: 381902 - DNA, 25 bp, Homo sapien
ggacaaccgagaaaggaaccacaga

SEQ ID NO: 381903 - DNA, 25 bp, Homo sapien
aaggaaccacagaaatccatgaggg

SEQ ID NO: 381904 - DNA, 25 bp, Homo sapien
agatactaattaatgccctgcattt

SEQ ID NO: 381905 - DNA, 25 bp, Homo sapien
attttcactcctggccagaatctga

SEQ ID NO: 381906 - DNA, 25 bp, Homo sapien
tcactcctggccagaatctgacaca

SEQ ID NO: 381907 - DNA, 25 bp, Homo sapien
agaaattacactgctgctacaaact

SEQ ID NO: 381908 - DNA, 25 bp, Homo sapien
ttccaaccctatctctctgtttatc

SEQ ID NO: 381909 - DNA, 25 bp, Homo sapien
tctgtttatcccacctccgatattt

SEQ ID NO: 381910 - DNA, 25 bp, Homo sapien
atcccacctccgatattttcaataa

SEQ ID NO: 381911 - DNA, 25 bp, Homo sapien
gggaagctgggttctagctttgttc

SEQ ID NO: 381912 - DNA, 25 bp, Homo sapien
agctgggttctagctttgttctttc

SEQ ID NO: 381913 - DNA, 25 bp, Homo sapien
tgggttctagctttgttctttctgc

SEQ ID NO: 381914 - DNA, 25 bp, Homo sapien
gttctagctttgttctttctgctcc

SEQ ID NO: 381915 - DNA, 25 bp, Homo sapien
agacttcctcctgggacctccgtga

SEQ ID NO: 381916 - DNA, 25 bp, Homo sapien
tccgtgagccctggccaaaggctgt

SEQ ID NO: 381917 - DNA, 25 bp, Homo sapien
gggattggaccagcactaacgagaa

SEQ ID NO: 381918 - DNA, 25 bp, Homo sapien
ggaccagcactaacgagaagttact

SEQ ID NO: 381919 - DNA, 25 bp, Homo sapien
gagaagttactttggggccctgaga

SEQ ID NO: 381920 - DNA, 25 bp, Homo sapien
tgagacccccacgtttgcaagggag

SEQ ID NO: 381921 - DNA, 25 bp, Homo sapien
cgccagcacggccagacgaaaggaa

SEQ ID NO: 381922 - DNA, 25 bp, Homo sapien
gcattagccacattttgagtattca

SEQ ID NO: 381923 - DNA, 25 bp, Homo sapien
gtagattctgtattagcacaaagat

SEQ ID NO: 381924 - DNA, 25 bp, Homo sapien
gtattagcacaaagatatggaacat

SEQ ID NO: 381925 - DNA, 25 bp, Homo sapien
ctgttggacagcactgcattagaat

SEQ ID NO: 381926 - DNA, 25 bp, Homo sapien
gacagcactgcattagaatattttc

SEQ ID NO: 381927 - DNA, 25 bp, Homo sapien
aatattttcatactgctcttcctca

SEQ ID NO: 381928 - DNA, 25 bp, Homo sapien
attttcatactgctcttcctcaatt

SEQ ID NO: 381929 - DNA, 25 bp, Homo sapien
ttcatactgctcttcctcaattaat

SEQ ID NO: 381930 - DNA, 25 bp, Homo sapien
catactgctcttcctcaattaattt

SEQ ID NO: 381931 - DNA, 25 bp, Homo sapien
ttgttgttaatgttgatgtcttcat

SEQ ID NO: 381932 - DNA, 25 bp, Homo sapien
ttgatgtcttcattggatgggtcat

SEQ ID NO: 381933 - DNA, 25 bp, Homo sapien
ctgctgacgggctttgtctgtggaa

SEQ ID NO: 381934 - DNA, 25 bp, Homo sapien
gaaggaaattgacccactctcctat

SEQ ID NO: 381935 - DNA, 25 bp, Homo sapien
agcccctccaggtttacagaatgtt

SEQ ID NO: 381936 - DNA, 25 bp, Homo sapien
gaatgttgctacttcacaatggcga

SEQ ID NO: 381937 - DNA, 25 bp, Homo sapien
aatggcgatgtggtgagaaactcct

SEQ ID NO: 381938 - DNA, 25 bp, Homo sapien
aaaggaaccttgtctttcagggcat

SEQ ID NO: 381939 - DNA, 25 bp, Homo sapien
tttcagggcataaggcggcgacttc

SEQ ID NO: 381940 - DNA, 25 bp, Homo sapien
taaggcggcgacttccaaggtcaat

SEQ ID NO: 381941 - DNA, 25 bp, Homo sapien
gacttccaaggtcaatgcttttccc

SEQ ID NO: 381942 - DNA, 25 bp, Homo sapien
ccccacatctctatgtacataggga

SEQ ID NO: 381943 - DNA, 25 bp, Homo sapien
gaacttagttctgggccatgtacag

SEQ ID NO: 381944 - DNA, 25 bp, Homo sapien
tgcagggacagtgatcagggcacct

SEQ ID NO: 381945 - DNA, 25 bp, Homo sapien
agtgatcagggcacctggtaccctg

SEQ ID NO: 381946 - DNA, 25 bp, Homo sapien
ctggtaccctgaccaacttgatgat

SEQ ID NO: 381947 - DNA, 25 bp, Homo sapien
gaccaacttgatgatggcatctctt

SEQ ID NO: 381948 - DNA, 25 bp, Homo sapien
atctcttttaagatgcccaagtctg

SEQ ID NO: 381949 - DNA, 25 bp, Homo sapien
ttaagatgcccaagtctgcgcactt

SEQ ID NO: 381950 - DNA, 25 bp, Homo sapien
agtctgcgcacttttattcctttat

SEQ ID NO: 381951 - DNA, 25 bp, Homo sapien
ttattcctttattcggcccctagca

SEQ ID NO: 381952 - DNA, 25 bp, Homo sapien
aaagaaggtcagttgcatgcgtgtg

SEQ ID NO: 381953 - DNA, 25 bp, Homo sapien
gggcttccctgatgagtcctcatgg

SEQ ID NO: 381954 - DNA, 25 bp, Homo sapien
cctgatgagtcctcatggagggtgc

SEQ ID NO: 381955 - DNA, 25 bp, Homo sapien
tcctcctcgatgttggcaaacttca

SEQ ID NO: 381956 - DNA, 25 bp, Homo sapien
aaacgagttggtgccgaggatctgc

SEQ ID NO: 381957 - DNA, 25 bp, Homo sapien
cagcttggccaccatcttgaggaag

SEQ ID NO: 381958 - DNA, 25 bp, Homo sapien
ggaagctctccacgaagaggttgat

SEQ ID NO: 381959 - DNA, 25 bp, Homo sapien
aggccatgagcagctggtccaaagc

SEQ ID NO: 381960 - DNA, 25 bp, Homo sapien
ggtccaaagcctccatagcaatgca

SEQ ID NO: 381961 - DNA, 25 bp, Homo sapien
aatgcacacgtacccatatcgatgg

SEQ ID NO: 381962 - DNA, 25 bp, Homo sapien
atatcgatggcgacccacgtcacgg

SEQ ID NO: 381963 - DNA, 25 bp, Homo sapien
acgtcacggatgagcctctcagaga

SEQ ID NO: 381964 - DNA, 25 bp, Homo sapien
ggtaggcgccaatacgatcaagttt

SEQ ID NO: 381965 - DNA, 25 bp, Homo sapien
cgatcaagtttttctggagctgaga

SEQ ID NO: 381966 - DNA, 25 bp, Homo sapien
tggtgctgctgagggttttctccag

SEQ ID NO: 381967 - DNA, 25 bp, Homo sapien
tttctccaggcgctgaaggcacatg

SEQ ID NO: 381968 - DNA, 25 bp, Homo sapien
aaggcacatggcaagctgcttctcc

SEQ ID NO: 381969 - DNA, 25 bp, Homo sapien
tctgcagaggctgccgtgcagcgca

SEQ ID NO: 381970 - DNA, 25 bp, Homo sapien
aagggctcggcacagtccgatgcat

SEQ ID NO: 381971 - DNA, 25 bp, Homo sapien
gatgcattcctctgctttgccgtga

SEQ ID NO: 381972 - DNA, 25 bp, Homo sapien
tttgccgtgacagctcagacggtca

SEQ ID NO: 381973 - DNA, 25 bp, Homo sapien
gacggtcacaaaacatgtccatgat

SEQ ID NO: 381974 - DNA, 25 bp, Homo sapien
ccatgatgtccagcaatgcctggac

SEQ ID NO: 381975 - DNA, 25 bp, Homo sapien
gcctggacacacaggtcccgagaaa

SEQ ID NO: 381976 - DNA, 25 bp, Homo sapien
acacaggtcccgagaaaagtcatca

SEQ ID NO: 381977 - DNA, 25 bp, Homo sapien
gttcagctaccaccaaggcctgaag

SEQ ID NO: 381978 - DNA, 25 bp, Homo sapien
gggtcttccgtccagagatgctgct

SEQ ID NO: 381979 - DNA, 25 bp, Homo sapien
gggcttcccgagaacgtgtcggtca

SEQ ID NO: 381980 - DNA, 25 bp, Homo sapien
ccgagaacgtgtcggtcattgcctg

SEQ ID NO: 381981 - DNA, 25 bp, Homo sapien
ctggagcgcccaacgatgatcaaat

SEQ ID NO: 381982 - DNA, 25 bp, Homo sapien
gagcgcccaacgatgatcaaatatg

SEQ ID NO: 381983 - DNA, 25 bp, Homo sapien
gcatcaacaatatccgggagctggt

SEQ ID NO: 381984 - DNA, 25 bp, Homo sapien
acaatatccgggagctggtgggcca

SEQ ID NO: 381985 - DNA, 25 bp, Homo sapien
tggtgggccacaaggtgaacctgca

SEQ ID NO: 381986 - DNA, 25 bp, Homo sapien
gggccacaaggtgaacctgcagatg

SEQ ID NO: 381987 - DNA, 25 bp, Homo sapien
gatggtgtatgacagtcccctgtgc

SEQ ID NO: 381988 - DNA, 25 bp, Homo sapien
gacattgtactcagtgggccttggg

SEQ ID NO: 381989 - DNA, 25 bp, Homo sapien
gaggactgtggcattcactgtcctt

SEQ ID NO: 381990 - DNA, 25 bp, Homo sapien
gcattcactgtccttgagtgtttca

SEQ ID NO: 381991 - DNA, 25 bp, Homo sapien
tgagtgtttcaccttcttggataac

SEQ ID NO: 381992 - DNA, 25 bp, Homo sapien
ttcttggataacacacgggccttct

SEQ ID NO: 381993 - DNA, 25 bp, Homo sapien
gatttcatcagagattacagccaga

SEQ ID NO: 381994 - DNA, 25 bp, Homo sapien
gggctgaagaccatcctcttgacca

SEQ ID NO: 381995 - DNA, 25 bp, Homo sapien
atcctcttgaccacagaggtgtgac

SEQ ID NO: 381996 - DNA, 25 bp, Homo sapien
gtgtgactgtgggaattcctcccaa

SEQ ID NO: 381997 - DNA, 25 bp, Homo sapien
tcctcccaatttatggtttcccaga

SEQ ID NO: 381998 - DNA, 25 bp, Homo sapien
catgtcttttgtgttaagaaaccaa

SEQ ID NO: 381999 - DNA, 25 bp, Homo sapien
ggccgtggcagcgtcctgcagttca

SEQ ID NO: 382000 - DNA, 25 bp, Homo sapien
agcgtcctgcagttcatgcccttca

SEQ ID NO: 382001 - DNA, 25 bp, Homo sapien
ttcaccaccgtgtcggaactggtga

SEQ ID NO: 382002 - DNA, 25 bp, Homo sapien
ccaccgtgtcggaactggtgaaggt

SEQ ID NO: 382003 - DNA, 25 bp, Homo sapien
tgggccgccaggtggctgctaaagc

SEQ ID NO: 382004 - DNA, 25 bp, Homo sapien
ggctgctaaagccattgctgcactc

SEQ ID NO: 382005 - DNA, 25 bp, Homo sapien
taaagccattgctgcactctgaggg

SEQ ID NO: 382006 - DNA, 25 bp, Homo sapien
ggaaagatgaggcatcgtgcctcac

SEQ ID NO: 382007 - DNA, 25 bp, Homo sapien
acatccgctccacatggtgcaagag

SEQ ID NO: 382008 - DNA, 25 bp, Homo sapien
catggtgcaagagcctctagcggct

SEQ ID NO: 382009 - DNA, 25 bp, Homo sapien
caagagcctctagcggcttccagtt

SEQ ID NO: 382010 - DNA, 25 bp, Homo sapien
gttttctcattcacaaaagtatccc

SEQ ID NO: 382011 - DNA, 25 bp, Homo sapien
aaagtatcccttctacccctatctg

SEQ ID NO: 382012 - DNA, 25 bp, Homo sapien
cctatctggcgcagggctgaaatgt

SEQ ID NO: 382013 - DNA, 25 bp, Homo sapien
ggcgcagggctgaaatgtcatcatt

SEQ ID NO: 382014 - DNA, 25 bp, Homo sapien
aaatgtcatcattagaggttctgtc

SEQ ID NO: 382015 - DNA, 25 bp, Homo sapien
atcattagaggttctgtcttctggg

SEQ ID NO: 382016 - DNA, 25 bp, Homo sapien
aggttctgtcttctggggcttacaa

SEQ ID NO: 382017 - DNA, 25 bp, Homo sapien
gggcttacaagttctatgtttctta

SEQ ID NO: 382018 - DNA, 25 bp, Homo sapien
gttctatgtttcttaaaattcgctg

SEQ ID NO: 382019 - DNA, 25 bp, Homo sapien
atgtttcttaaaattcgctgattaa

SEQ ID NO: 382020 - DNA, 25 bp, Homo sapien
taaaaagataggatcacacctgaaa

SEQ ID NO: 382021 - DNA, 25 bp, Homo sapien
agcccaaaaagggcctggtgcggtg

SEQ ID NO: 382022 - DNA, 25 bp, Homo sapien
gcccaaaaagggcctggtgcggtgg

SEQ ID NO: 382023 - DNA, 25 bp, Homo sapien
gggtggctgagtggttggatcactt

SEQ ID NO: 382024 - DNA, 25 bp, Homo sapien
ggtggctgagtggttggatcacttg

SEQ ID NO: 382025 - DNA, 25 bp, Homo sapien
gtggctgagtggttggatcacttga

SEQ ID NO: 382026 - DNA, 25 bp, Homo sapien
gctgagtggttggatcacttgaggt

SEQ ID NO: 382027 - DNA, 25 bp, Homo sapien
ggtgttgcacctgtaatccaagcca

SEQ ID NO: 382028 - DNA, 25 bp, Homo sapien
gtgttgcacctgtaatccaagccac

SEQ ID NO: 382029 - DNA, 25 bp, Homo sapien
tgttgcacctgtaatccaagccact

SEQ ID NO: 382030 - DNA, 25 bp, Homo sapien
gttgcacctgtaatccaagccactt

SEQ ID NO: 382031 - DNA, 25 bp, Homo sapien
ttgcacctgtaatccaagccacttg

SEQ ID NO: 382032 - DNA, 25 bp, Homo sapien
tttttgctcatgtttcttaaggaag

SEQ ID NO: 382033 - DNA, 25 bp, Homo sapien
agtagagtagtccttgtgtcagaac

SEQ ID NO: 382034 - DNA, 25 bp, Homo sapien
gtgtcagaacacatgttaatccaca

SEQ ID NO: 382035 - DNA, 25 bp, Homo sapien
acatcgtttttaggattcttggagc

SEQ ID NO: 382036 - DNA, 25 bp, Homo sapien
gattcttggagctagcctggatcat

SEQ ID NO: 382037 - DNA, 25 bp, Homo sapien
ggagctagcctggatcatgggtaaa

SEQ ID NO: 382038 - DNA, 25 bp, Homo sapien
acattttgccttttgtatcttatac

SEQ ID NO: 382039 - DNA, 25 bp, Homo sapien
tcttatactggaatgggatgtctgt

SEQ ID NO: 382040 - DNA, 25 bp, Homo sapien
ggatgtctgtaagtcctagaacctc

SEQ ID NO: 382041 - DNA, 25 bp, Homo sapien
gtcctagaacctctttgagcatatt

SEQ ID NO: 382042 - DNA, 25 bp, Homo sapien
gcatatttcttacaagcctctgttt

SEQ ID NO: 382043 - DNA, 25 bp, Homo sapien
gtcactgctcttaaactccaaaatg

SEQ ID NO: 382044 - DNA, 25 bp, Homo sapien
ctccaaaatgtacccgtatcttcaa

SEQ ID NO: 382045 - DNA, 25 bp, Homo sapien
gaaatatgcaactaccctaaagaat

SEQ ID NO: 382046 - DNA, 25 bp, Homo sapien
caagagagacaaacaagcactgact

SEQ ID NO: 382047 - DNA, 25 bp, Homo sapien
cagtcactttaattccctcattttt

SEQ ID NO: 382048 - DNA, 25 bp, Homo sapien
tgactttagacaactcaggccaaaa

SEQ ID NO: 382049 - DNA, 25 bp, Homo sapien
aactcaggccaaaacaagtcaaggg

SEQ ID NO: 382050 - DNA, 25 bp, Homo sapien
aagtcaagggtatgatgtgcacaac

SEQ ID NO: 382051 - DNA, 25 bp, Homo sapien
tgtgcacaacgatctaactgaaatg

SEQ ID NO: 382052 - DNA, 25 bp, Homo sapien
ggaaagatacctacttgggttatat

SEQ ID NO: 382053 - DNA, 25 bp, Homo sapien
ttcaaatctaatagtcactgctctt

SEQ ID NO: 382054 - DNA, 25 bp, Homo sapien
tgttttgttgcaccaattttataaa

SEQ ID NO: 382055 - DNA, 25 bp, Homo sapien
taagcagtgcaatacgtgttacttt

SEQ ID NO: 382056 - DNA, 25 bp, Homo sapien
atacgtgttacttttctgaggcaaa

SEQ ID NO: 382057 - DNA, 25 bp, Homo sapien
tgttacttttctgaggcaaaccaaa

SEQ ID NO: 382058 - DNA, 25 bp, Homo sapien
aatttctcaaggttcttgctgcctt

SEQ ID NO: 382059 - DNA, 25 bp, Homo sapien
gcagcatttgatggaagatctttta

SEQ ID NO: 382060 - DNA, 25 bp, Homo sapien
taaaccagattgcaaatcctttttt

SEQ ID NO: 382061 - DNA, 25 bp, Homo sapien
taaaatcctaaaccatgtaccaagt

SEQ ID NO: 382062 - DNA, 25 bp, Homo sapien
gtttttggtccaaattatgtaggat

SEQ ID NO: 382063 - DNA, 25 bp, Homo sapien
ttgcattctattaaccaatatgagt

SEQ ID NO: 382064 - DNA, 25 bp, Homo sapien
gagtgtatttctgtaagcatagtta

SEQ ID NO: 382065 - DNA, 25 bp, Homo sapien
tcagtaataggtgttggtatcccat

SEQ ID NO: 382066 - DNA, 25 bp, Homo sapien
ggtatcccatggtgagcaagttcct

SEQ ID NO: 382067 - DNA, 25 bp, Homo sapien
atggtgagcaagttcctcccagcag

SEQ ID NO: 382068 - DNA, 25 bp, Homo sapien
tcccagcagctgatgccaacaactg

SEQ ID NO: 382069 - DNA, 25 bp, Homo sapien
acccttcttgggctacagcagacca

SEQ ID NO: 382070 - DNA, 25 bp, Homo sapien
gagccaggtgacatatgacacacat

SEQ ID NO: 382071 - DNA, 25 bp, Homo sapien
gagcaaaggaggacacactgagtgt

SEQ ID NO: 382072 - DNA, 25 bp, Homo sapien
tttcacacagagtgacaggtccagc

SEQ ID NO: 382073 - DNA, 25 bp, Homo sapien
cagagtgacaggtccagcacaggct

SEQ ID NO: 382074 - DNA, 25 bp, Homo sapien
ctgtgaggactctatcgcttggtaa

SEQ ID NO: 382075 - DNA, 25 bp, Homo sapien
tgaggactctatcgcttggtaagaa

SEQ ID NO: 382076 - DNA, 25 bp, Homo sapien
ttaaccatgggtgctagtaactttt

SEQ ID NO: 382077 - DNA, 25 bp, Homo sapien
agattagttttttatgtgtgaagtc

SEQ ID NO: 382078 - DNA, 25 bp, Homo sapien
ttaaattattacacgaccagaacta

SEQ ID NO: 382079 - DNA, 25 bp, Homo sapien
gcaatatacagttaagtccacggat

SEQ ID NO: 382080 - DNA, 25 bp, Homo sapien
agtccacggatactcccattaatga

SEQ ID NO: 382081 - DNA, 25 bp, Homo sapien
gagaaataacactaggaagccacta

SEQ ID NO: 382082 - DNA, 25 bp, Homo sapien
ctaggaagccactattacaggaaga

SEQ ID NO: 382083 - DNA, 25 bp, Homo sapien
aagatttggttttcatggcagtctg

SEQ ID NO: 382084 - DNA, 25 bp, Homo sapien
aaaaatttttgagccactatctatt

SEQ ID NO: 382085 - DNA, 25 bp, Homo sapien
tgagccactatctattgttgaatat

SEQ ID NO: 382086 - DNA, 25 bp, Homo sapien
ggaggaactaataagggcttacaca

SEQ ID NO: 382087 - DNA, 25 bp, Homo sapien
cttcatgatattgctccaaagtgga

SEQ ID NO: 382088 - DNA, 25 bp, Homo sapien
ggatgtgccccaatacagtacacat

SEQ ID NO: 382089 - DNA, 25 bp, Homo sapien
atttgttttcagatcatttcatgga

SEQ ID NO: 382090 - DNA, 25 bp, Homo sapien
gaatctttgaagtatctttgactct

SEQ ID NO: 382091 - DNA, 25 bp, Homo sapien
atctttgactctaactttgacttgg

SEQ ID NO: 382092 - DNA, 25 bp, Homo sapien
tctaactttgacttggtggtggacc

SEQ ID NO: 382093 - DNA, 25 bp, Homo sapien
gacttggtggtggaccttccttggt

SEQ ID NO: 382094 - DNA, 25 bp, Homo sapien
tggtttttataacacctaagagata

SEQ ID NO: 382095 - DNA, 25 bp, Homo sapien
gagatatcctttagaattacatgta

SEQ ID NO: 382096 - DNA, 25 bp, Homo sapien
gtggattgactaacactttcccctc

SEQ ID NO: 382097 - DNA, 25 bp, Homo sapien
cccctcttgacccaatatcatgaag

SEQ ID NO: 382098 - DNA, 25 bp, Homo sapien
cgggcccggcgccttgcatttcgat

SEQ ID NO: 382099 - DNA, 25 bp, Homo sapien
ttgcatttcgatctccgtgatgacg

SEQ ID NO: 382100 - DNA, 25 bp, Homo sapien
gatctccgtgatgacgatgacgcgg

SEQ ID NO: 382101 - DNA, 25 bp, Homo sapien
aggagggcgtccgagtcaacaaccg

SEQ ID NO: 382102 - DNA, 25 bp, Homo sapien
gtcaacaaccgcttcgagctgataa

SEQ ID NO: 382103 - DNA, 25 bp, Homo sapien
accgcttcgagctgataaacattga

SEQ ID NO: 382104 - DNA, 25 bp, Homo sapien
gagctgataaacattgacgatcttg

SEQ ID NO: 382105 - DNA, 25 bp, Homo sapien
attgacgatcttgaggatgaccctg

SEQ ID NO: 382106 - DNA, 25 bp, Homo sapien
agacgtcgtggtcgttcggtcctat

SEQ ID NO: 382107 - DNA, 25 bp, Homo sapien
gtggtcgttcggtcctatgtcgcgc

SEQ ID NO: 382108 - DNA, 25 bp, Homo sapien
tcgttcggtcctatgtcgcgccggg

SEQ ID NO: 382109 - DNA, 25 bp, Homo sapien
gtctcattgttaattcgctgctggg

SEQ ID NO: 382110 - DNA, 25 bp, Homo sapien
agatgagtcataccctataaggagt

SEQ ID NO: 382111 - DNA, 25 bp, Homo sapien
aggcatgccttgtaacgtatgtccc

SEQ ID NO: 382112 - DNA, 25 bp, Homo sapien
aacgtatgtccccagagctgtcatt

SEQ ID NO: 382113 - DNA, 25 bp, Homo sapien
gtcatttgcataagctgcaggccat

SEQ ID NO: 382114 - DNA, 25 bp, Homo sapien
aggccatagattcctgattccctca

SEQ ID NO: 382115 - DNA, 25 bp, Homo sapien
tgattccctcagtaactgaccgtac

SEQ ID NO: 382116 - DNA, 25 bp, Homo sapien
aactgaccgtacgacaatggagctg

SEQ ID NO: 382117 - DNA, 25 bp, Homo sapien
aatggagctgatccgcggcactcta

SEQ ID NO: 382118 - DNA, 25 bp, Homo sapien
cgcggcactctagattttcagggta

SEQ ID NO: 382119 - DNA, 25 bp, Homo sapien
tggaggaatgagtttcacttccaaa

SEQ ID NO: 382120 - DNA, 25 bp, Homo sapien
tgaagacaccagagtgtatgcatac

SEQ ID NO: 382121 - DNA, 25 bp, Homo sapien
tttctaattgtacccttcttgtctc

SEQ ID NO: 382122 - DNA, 25 bp, Homo sapien
aatcttgcccttaatatccctggag

SEQ ID NO: 382123 - DNA, 25 bp, Homo sapien
gtcattttctgttatacacagttcc

SEQ ID NO: 382124 - DNA, 25 bp, Homo sapien
cacagttccacaattttgtctctag

SEQ ID NO: 382125 - DNA, 25 bp, Homo sapien
ttgtctctagttgacttcaaatgtg

SEQ ID NO: 382126 - DNA, 25 bp, Homo sapien
gtgtaactttattggtcttgcccta

SEQ ID NO: 382127 - DNA, 25 bp, Homo sapien
ggtcttgccctattataattgtcat

SEQ ID NO: 382128 - DNA, 25 bp, Homo sapien
attgtcatgactttcagattgtatc

SEQ ID NO: 382129 - DNA, 25 bp, Homo sapien
tctgaactcacagactgctgtctta

SEQ ID NO: 382130 - DNA, 25 bp, Homo sapien
actgctgtcttactaataggtctgg

SEQ ID NO: 382131 - DNA, 25 bp, Homo sapien
acatcagaggatttacagtagaaag

SEQ ID NO: 382132 - DNA, 25 bp, Homo sapien
tagaaagaactaaggaactaacact

SEQ ID NO: 382133 - DNA, 25 bp, Homo sapien
taaggaactaacacttcagacttta

SEQ ID NO: 382134 - DNA, 25 bp, Homo sapien
gaactaacacttcagactttaaaat

SEQ ID NO: 382135 - DNA, 25 bp, Homo sapien
gtataacaaaagttgaacctgttag

SEQ ID NO: 382136 - DNA, 25 bp, Homo sapien
ttgaacctgttagaaaatttccttg

SEQ ID NO: 382137 - DNA, 25 bp, Homo sapien
aggtttttgaagagatatattcgaa

SEQ ID NO: 382138 - DNA, 25 bp, Homo sapien
aaaattatactatttcaacattctc

SEQ ID NO: 382139 - DNA, 25 bp, Homo sapien
atttcaacattctcatttatgtgaa

SEQ ID NO: 382140 - DNA, 25 bp, Homo sapien
tcaacattctcatttatgtgaaagc

SEQ ID NO: 382141 - DNA, 25 bp, Homo sapien
cattctcatttatgtgaaagcatgt

SEQ ID NO: 382142 - DNA, 25 bp, Homo sapien
taaagatttacttgctcatattaac

SEQ ID NO: 382143 - DNA, 25 bp, Homo sapien
tactctccaagaattaatgtgccct

SEQ ID NO: 382144 - DNA, 25 bp, Homo sapien
tctccaagaattaatgtgccctaaa

SEQ ID NO: 382145 - DNA, 25 bp, Homo sapien
ccaagaattaatgtgccctaaaaat

SEQ ID NO: 382146 - DNA, 25 bp, Homo sapien
ttcctccaaaaacttatccttatca

SEQ ID NO: 382147 - DNA, 25 bp, Homo sapien
caaaaacttatccttatcatgtgat

SEQ ID NO: 382148 - DNA, 25 bp, Homo sapien
ggaaactgctgtaggcagcatctgg

SEQ ID NO: 382149 - DNA, 25 bp, Homo sapien
actgctgtaggcagcatctgggaat

SEQ ID NO: 382150 - DNA, 25 bp, Homo sapien
catctgggaatgcaaatcttcaatc

SEQ ID NO: 382151 - DNA, 25 bp, Homo sapien
gggaatgcaaatcttcaatcacatt

SEQ ID NO: 382152 - DNA, 25 bp, Homo sapien
gcaaatcttcaatcacatttctatt

SEQ ID NO: 382153 - DNA, 25 bp, Homo sapien
aataagaccaatttctgccatgaag

SEQ ID NO: 382154 - DNA, 25 bp, Homo sapien
acgtactctcattttaagcaccttc

SEQ ID NO: 382155 - DNA, 25 bp, Homo sapien
attttaagcaccttctttcctgtct

SEQ ID NO: 382156 - DNA, 25 bp, Homo sapien
ctttcctgtctcttgattgtttttt

SEQ ID NO: 382157 - DNA, 25 bp, Homo sapien
gtaaagaatgtctcagtctgcctta

SEQ ID NO: 382158 - DNA, 25 bp, Homo sapien
atgtctcagtctgccttaaaggaac

SEQ ID NO: 382159 - DNA, 25 bp, Homo sapien
ttaaaggaactgtgaaggcttctct

SEQ ID NO: 382160 - DNA, 25 bp, Homo sapien
gaagtgaactgaaacattgtctaat

SEQ ID NO: 382161 - DNA, 25 bp, Homo sapien
attgtctaatgtctttgtggcttta

SEQ ID NO: 382162 - DNA, 25 bp, Homo sapien
gtctttgtggctttagagcttttgt

SEQ ID NO: 382163 - DNA, 25 bp, Homo sapien
agagcttttgttatattgtgcctat

SEQ ID NO: 382164 - DNA, 25 bp, Homo sapien
tatataaatatatgccagtcttggc

SEQ ID NO: 382165 - DNA, 25 bp, Homo sapien
gttttatatctgtgtggtgttttgt

SEQ ID NO: 382166 - DNA, 25 bp, Homo sapien
ttttgtaccggcacgggatatggaa

SEQ ID NO: 382167 - DNA, 25 bp, Homo sapien
gtaccggcacgggatatggaacgaa

SEQ ID NO: 382168 - DNA, 25 bp, Homo sapien
gatatggaacgaaaactgctttgta

SEQ ID NO: 382169 - DNA, 25 bp, Homo sapien
gctttgtaatgcagtttgtgacatt

SEQ ID NO: 382170 - DNA, 25 bp, Homo sapien
caaaaaactgttctggactgcaaat

SEQ ID NO: 382171 - DNA, 25 bp, Homo sapien
gttctggactgcaaatctgcacaca

SEQ ID NO: 382172 - DNA, 25 bp, Homo sapien
aatctgcacacacaacgaacagttg

SEQ ID NO: 382173 - DNA, 25 bp, Homo sapien
acagttgcatttcagagagttctct

SEQ ID NO: 382174 - DNA, 25 bp, Homo sapien
cagagagttctctcaatttgtaagt

SEQ ID NO: 382175 - DNA, 25 bp, Homo sapien
ttggttaatagtccctttcccatgt

SEQ ID NO: 382176 - DNA, 25 bp, Homo sapien
atgtccagctcctacaaatatgtcc

SEQ ID NO: 382177 - DNA, 25 bp, Homo sapien
tggctgcctttagctgtggtactgc

SEQ ID NO: 382178 - DNA, 25 bp, Homo sapien
atatgtcccttaatgcatttggtga

SEQ ID NO: 382179 - DNA, 25 bp, Homo sapien
gtgacatttacacctcactcatgtg

SEQ ID NO: 382180 - DNA, 25 bp, Homo sapien
tcatgtgctctttccctattcactc

SEQ ID NO: 382181 - DNA, 25 bp, Homo sapien
tattcactccttcactcattcaaag

SEQ ID NO: 382182 - DNA, 25 bp, Homo sapien
gtggtactgctgacaaccctgcttg

SEQ ID NO: 382183 - DNA, 25 bp, Homo sapien
gcttgctactgccttatccagcaca

SEQ ID NO: 382184 - DNA, 25 bp, Homo sapien
gtgaaaaacttctccagcctggcaa

SEQ ID NO: 382185 - DNA, 25 bp, Homo sapien
cctggcaaggccacgttggttaata

SEQ ID NO: 382186 - DNA, 25 bp, Homo sapien
agcaagagagcgagctgtgagctgt

SEQ ID NO: 382187 - DNA, 25 bp, Homo sapien
gctgccctttgatcccgacattagt

SEQ ID NO: 382188 - DNA, 25 bp, Homo sapien
ccctttgatcccgacattagtgtta

SEQ ID NO: 382189 - DNA, 25 bp, Homo sapien
ctttgatcccgacattagtgttagg

SEQ ID NO: 382190 - DNA, 25 bp, Homo sapien
cggagacacagagcgcggccataga

SEQ ID NO: 382191 - DNA, 25 bp, Homo sapien
cgccgcaccggcactcatttattta

SEQ ID NO: 382192 - DNA, 25 bp, Homo sapien
atttatttatacctcccatcacaca

SEQ ID NO: 382193 - DNA, 25 bp, Homo sapien
tgtgtgtagctctcgctctttccct

SEQ ID NO: 382194 - DNA, 25 bp, Homo sapien
tgtagctctcgctctttccctcagt

SEQ ID NO: 382195 - DNA, 25 bp, Homo sapien
tttccctcagtctgtgcctcttgtg

SEQ ID NO: 382196 - DNA, 25 bp, Homo sapien
cagtctgtgcctcttgtgtgtgtgt

SEQ ID NO: 382197 - DNA, 25 bp, Homo sapien
gactctcgcaccctgatgacataac

SEQ ID NO: 382198 - DNA, 25 bp, Homo sapien
accctgatgacataaccaagtctgg

SEQ ID NO: 382199 - DNA, 25 bp, Homo sapien
tcatccagggatgaagctttaccat

SEQ ID NO: 382200 - DNA, 25 bp, Homo sapien
tcgaggccgaggtcgactctggcac

SEQ ID NO: 382201 - DNA, 25 bp, Homo sapien
caggagctcgaagcccaggtcgatt

SEQ ID NO: 382202 - DNA, 25 bp, Homo sapien
aagcccaggtcgattctggtggcaa

SEQ ID NO: 382203 - DNA, 25 bp, Homo sapien
gattctggtggcaagatggcagcac

SEQ ID NO: 382204 - DNA, 25 bp, Homo sapien
gatggcagcaccaatctggagattc

SEQ ID NO: 382205 - DNA, 25 bp, Homo sapien
tcgactctggcaccctgatgacaag

SEQ ID NO: 382206 - DNA, 25 bp, Homo sapien
gaaagcagaatcatccagggatgca

SEQ ID NO: 382207 - DNA, 25 bp, Homo sapien
ggatgcagcgttaccatccaggagc

SEQ ID NO: 382208 - DNA, 25 bp, Homo sapien
tgaaaaagactagcccaccccaaag

SEQ ID NO: 382209 - DNA, 25 bp, Homo sapien
agcccaccccaaaggtttatcactg

SEQ ID NO: 382210 - DNA, 25 bp, Homo sapien
tcactgtcaccatgtctaatgtcta

SEQ ID NO: 382211 - DNA, 25 bp, Homo sapien
catgtctaatgtctattctggaaga

SEQ ID NO: 382212 - DNA, 25 bp, Homo sapien
gaagaagtctgcctttgtttaggga

SEQ ID NO: 382213 - DNA, 25 bp, Homo sapien
ggatataaaagacccttgcacaaga

SEQ ID NO: 382214 - DNA, 25 bp, Homo sapien
ttgcacaagagttggtatttaccct

SEQ ID NO: 382215 - DNA, 25 bp, Homo sapien
tggtatttaccctgtcagatgctgc

SEQ ID NO: 382216 - DNA, 25 bp, Homo sapien
gtcagatgctgctaccaagatttgg

SEQ ID NO: 382217 - DNA, 25 bp, Homo sapien
ccaagatttggattgtgtacagtcg

SEQ ID NO: 382218 - DNA, 25 bp, Homo sapien
ggattgtgtacagtcgaggattaaa

SEQ ID NO: 382219 - DNA, 25 bp, Homo sapien
gtaatcctgtaagttacttttacat

SEQ ID NO: 382220 - DNA, 25 bp, Homo sapien
acttttacattgacagttctgaaat

SEQ ID NO: 382221 - DNA, 25 bp, Homo sapien
attcatgttgagtgttaattaggca

SEQ ID NO: 382222 - DNA, 25 bp, Homo sapien
gaggttttgtagaaggtcgtatcca

SEQ ID NO: 382223 - DNA, 25 bp, Homo sapien
ggtcgtatccatgggttttttatat

SEQ ID NO: 382224 - DNA, 25 bp, Homo sapien
aaagtgttttcgatgtatcattggg

SEQ ID NO: 382225 - DNA, 25 bp, Homo sapien
ctagaaataaagtcagcatcccatt

SEQ ID NO: 382226 - DNA, 25 bp, Homo sapien
atcccatttgactccttacacagaa

SEQ ID NO: 382227 - DNA, 25 bp, Homo sapien
tttgactccttacacagaagttcat

SEQ ID NO: 382228 - DNA, 25 bp, Homo sapien
gaagttcattctatactcattacag

SEQ ID NO: 382229 - DNA, 25 bp, Homo sapien
agagtatttctgtgcctttaggttc

SEQ ID NO: 382230 - DNA, 25 bp, Homo sapien
gactctcgcaccctgatgacataac

SEQ ID NO: 382231 - DNA, 25 bp, Homo sapien
tcgcaccctgatgacataaccaagt

SEQ ID NO: 382232 - DNA, 25 bp, Homo sapien
accctgatgacataaccaagtctgg

SEQ ID NO: 382233 - DNA, 25 bp, Homo sapien
gatcatccagggatgaagctttacc

SEQ ID NO: 382234 - DNA, 25 bp, Homo sapien
tcgaggccgaggtcgactctggcac

SEQ ID NO: 382235 - DNA, 25 bp, Homo sapien
caggagctcgaagcccaggtcgatt

SEQ ID NO: 382236 - DNA, 25 bp, Homo sapien
aagcccaggtcgattctggtggcaa

SEQ ID NO: 382237 - DNA, 25 bp, Homo sapien
gattctggtggcaagatggcagcac

SEQ ID NO: 382238 - DNA, 25 bp, Homo sapien
gtggcaagatggcagcaccaatctg

SEQ ID NO: 382239 - DNA, 25 bp, Homo sapien
gatggcagcaccaatctggagattc

SEQ ID NO: 382240 - DNA, 25 bp, Homo sapien
cgactctggcaccctgatgacaagt

SEQ ID NO: 382241 - DNA, 25 bp, Homo sapien
gctccgggccggagttccaatcaag

SEQ ID NO: 382242 - DNA, 25 bp, Homo sapien
gggccggagttccaatcaagcgcca

SEQ ID NO: 382243 - DNA, 25 bp, Homo sapien
ggagttccaatcaagcgccacccaa

SEQ ID NO: 382244 - DNA, 25 bp, Homo sapien
ccccaaaaagatcctgcctcaggga

SEQ ID NO: 382245 - DNA, 25 bp, Homo sapien
aagatcctgcctcagggaaatgcat

SEQ ID NO: 382246 - DNA, 25 bp, Homo sapien
tcctgcctcagggaaatgcatggag

SEQ ID NO: 382247 - DNA, 25 bp, Homo sapien
atgcatggagccggcggaaaagccc

SEQ ID NO: 382248 - DNA, 25 bp, Homo sapien
cccggcggatcgcagaccctaaggg

SEQ ID NO: 382249 - DNA, 25 bp, Homo sapien
gcagcgccgcgaagggcatccccga

SEQ ID NO: 382250 - DNA, 25 bp, Homo sapien
gcatccccgaagaccgggaggaacg

SEQ ID NO: 382251 - DNA, 25 bp, Homo sapien
ggacctgtggcttagcgcgctccgc

SEQ ID NO: 382252 - DNA, 25 bp, Homo sapien
agctgctccactccgaacaatcact

SEQ ID NO: 382253 - DNA, 25 bp, Homo sapien
aacaatcactgctgacactttccgc

SEQ ID NO: 382254 - DNA, 25 bp, Homo sapien
aatcactgctgacactttccgcaaa

SEQ ID NO: 382255 - DNA, 25 bp, Homo sapien
tgacactttccgcaaactcttccga

SEQ ID NO: 382256 - DNA, 25 bp, Homo sapien
aaactcttccgagtctactccaatt

SEQ ID NO: 382257 - DNA, 25 bp, Homo sapien
tcttccgagtctactccaatttcct

SEQ ID NO: 382258 - DNA, 25 bp, Homo sapien
ttcctccggggaaagctgaagctgt

SEQ ID NO: 382259 - DNA, 25 bp, Homo sapien
gacagatgaccaggtgtgtccacct

SEQ ID NO: 382260 - DNA, 25 bp, Homo sapien
aggtgtgtccacctgggcatatcca

SEQ ID NO: 382261 - DNA, 25 bp, Homo sapien
tcaccaacattgcttgtgccacacc

SEQ ID NO: 382262 - DNA, 25 bp, Homo sapien
tctggctctcatggggtccaagttt

SEQ ID NO: 382263 - DNA, 25 bp, Homo sapien
agctcacctgtgcacttctaaattg

SEQ ID NO: 382264 - DNA, 25 bp, Homo sapien
ctaaattgaattggcccacggtgtc

SEQ ID NO: 382265 - DNA, 25 bp, Homo sapien
gcccacggtgtccaaccaagaagga

SEQ ID NO: 382266 - DNA, 25 bp, Homo sapien
ggagcatctgcactccgagaaagat

SEQ ID NO: 382267 - DNA, 25 bp, Homo sapien
aagatgtgttctgtaactgccccag

SEQ ID NO: 382268 - DNA, 25 bp, Homo sapien
cagtggctctcggtgctagatatgc

SEQ ID NO: 382269 - DNA, 25 bp, Homo sapien
gctgggcaaaatgtagatgatcttt

SEQ ID NO: 382270 - DNA, 25 bp, Homo sapien
tatgttgtgggcagcgtctttctct

SEQ ID NO: 382271 - DNA, 25 bp, Homo sapien
gtctttctctgcctttgctatatgc

SEQ ID NO: 382272 - DNA, 25 bp, Homo sapien
atgcagtcagcagtaagccttttgc

SEQ ID NO: 382273 - DNA, 25 bp, Homo sapien
ttgacttctgagatccaaggctgat

SEQ ID NO: 382274 - DNA, 25 bp, Homo sapien
tccagaatctcctaacgcgcaggtg

SEQ ID NO: 382275 - DNA, 25 bp, Homo sapien
taacgcgcaggtgtccaacgtgacc

SEQ ID NO: 382276 - DNA, 25 bp, Homo sapien
tgaccagcgcgattcaccgctctaa

SEQ ID NO: 382277 - DNA, 25 bp, Homo sapien
gattcaccgctctaatcgctccggt

SEQ ID NO: 382278 - DNA, 25 bp, Homo sapien
gctctaatcgctccggttttccaag

SEQ ID NO: 382279 - DNA, 25 bp, Homo sapien
gttgaaggcgcccttcccatagcgc

SEQ ID NO: 382280 - DNA, 25 bp, Homo sapien
ttcccatagcgcacagtaaaagcag

SEQ ID NO: 382281 - DNA, 25 bp, Homo sapien
tagcgcacagtaaaagcagtagttc

SEQ ID NO: 382282 - DNA, 25 bp, Homo sapien
gtaaaagcagtagttcttgtctctg

SEQ ID NO: 382283 - DNA, 25 bp, Homo sapien
cagtagttcttgtctctgtggcgca

SEQ ID NO: 382284 - DNA, 25 bp, Homo sapien
gggcgaaggccattcggctgtcctt

SEQ ID NO: 382285 - DNA, 25 bp, Homo sapien
gcctgatgatcggtcactgtgttcc

SEQ ID NO: 382286 - DNA, 25 bp, Homo sapien
cctgatgatcggtcactgtgttcca

SEQ ID NO: 382287 - DNA, 25 bp, Homo sapien
ctgatgatcggtcactgtgttccat

SEQ ID NO: 382288 - DNA, 25 bp, Homo sapien
tgatgatcggtcactgtgttccatc

SEQ ID NO: 382289 - DNA, 25 bp, Homo sapien
gatgatcggtcactgtgttccatca

SEQ ID NO: 382290 - DNA, 25 bp, Homo sapien
atgatcggtcactgtgttccatcac

SEQ ID NO: 382291 - DNA, 25 bp, Homo sapien
tgatcggtcactgtgttccatcacc

SEQ ID NO: 382292 - DNA, 25 bp, Homo sapien
gatcggtcactgtgttccatcaccc

SEQ ID NO: 382293 - DNA, 25 bp, Homo sapien
atcggtcactgtgttccatcacccc

SEQ ID NO: 382294 - DNA, 25 bp, Homo sapien
ctgattctaccttataatgaattgt

SEQ ID NO: 382295 - DNA, 25 bp, Homo sapien
tgattctaccttataatgaattgta

SEQ ID NO: 382296 - DNA, 25 bp, Homo sapien
tcccttatccggatagctgggtgga

SEQ ID NO: 382297 - DNA, 25 bp, Homo sapien
tagctgggtggattcttatccctgt

SEQ ID NO: 382298 - DNA, 25 bp, Homo sapien
ggattcttatccctgtgcagtagca

SEQ ID NO: 382299 - DNA, 25 bp, Homo sapien
atccctgtgcagtagcaagtgctga

SEQ ID NO: 382300 - DNA, 25 bp, Homo sapien
aagagattagttttgtggacccaat

SEQ ID NO: 382301 - DNA, 25 bp, Homo sapien
tttgtggacccaatgagggactcct

SEQ ID NO: 382302 - DNA, 25 bp, Homo sapien
tgagggactccttttaaatgtaagt

SEQ ID NO: 382303 - DNA, 25 bp, Homo sapien
caatgatttgtataaggtacctact

SEQ ID NO: 382304 - DNA, 25 bp, Homo sapien
aggtacctactgcattacgtctaac

SEQ ID NO: 382305 - DNA, 25 bp, Homo sapien
gcattacgtctaacacagttgtata

SEQ ID NO: 382306 - DNA, 25 bp, Homo sapien
gctactttgcatatcattggccaat

SEQ ID NO: 382307 - DNA, 25 bp, Homo sapien
cgacacatgggcctctcaaaggaga

SEQ ID NO: 382308 - DNA, 25 bp, Homo sapien
taagtcccacggtagggccagtggt

SEQ ID NO: 382309 - DNA, 25 bp, Homo sapien
acggtagggccagtggttgctccct

SEQ ID NO: 382310 - DNA, 25 bp, Homo sapien
ccctgggttttggaatcatttctgc

SEQ ID NO: 382311 - DNA, 25 bp, Homo sapien
tcatttctgcggagctttcaaggcc

SEQ ID NO: 382312 - DNA, 25 bp, Homo sapien
tttcaaggccagaccctgggcttag

SEQ ID NO: 382313 - DNA, 25 bp, Homo sapien
gaccctgggcttagggtcgagactt

SEQ ID NO: 382314 - DNA, 25 bp, Homo sapien
gacagccagacccagcaagatggct

SEQ ID NO: 382315 - DNA, 25 bp, Homo sapien
ccagcaagatggctgcgaccgtgaa

SEQ ID NO: 382316 - DNA, 25 bp, Homo sapien
atccgggtgcgcatcatgagctgag

SEQ ID NO: 382317 - DNA, 25 bp, Homo sapien
catcatgagctgagagcgctggctg

SEQ ID NO: 382318 - DNA, 25 bp, Homo sapien
tctatttttaactggccacttcctg

SEQ ID NO: 382319 - DNA, 25 bp, Homo sapien
aagccgctggtacagacagccgtag

SEQ ID NO: 382320 - DNA, 25 bp, Homo sapien
tcaagctgccaacacaggtacagaa

SEQ ID NO: 382321 - DNA, 25 bp, Homo sapien
cagaatgcagctttcttagcttggg

SEQ ID NO: 382322 - DNA, 25 bp, Homo sapien
gggacgtttaccttcctgtgatggt

SEQ ID NO: 382323 - DNA, 25 bp, Homo sapien
gaaccaaagttttatggccttgaag

SEQ ID NO: 382324 - DNA, 25 bp, Homo sapien
tacagacagccgtagaacccgaagg

SEQ ID NO: 382325 - DNA, 25 bp, Homo sapien
accagcaacaacttcttgatggaga

SEQ ID NO: 382326 - DNA, 25 bp, Homo sapien
cccgaagggcaagtaccatggacgt

SEQ ID NO: 382327 - DNA, 25 bp, Homo sapien
gtcacagattagaagagcaccaagc

SEQ ID NO: 382328 - DNA, 25 bp, Homo sapien
gagcaccaagcagtgagttctattt

SEQ ID NO: 382329 - DNA, 25 bp, Homo sapien
ggtgggatctctgctcgcctcaagc

SEQ ID NO: 382330 - DNA, 25 bp, Homo sapien
tgggatctctgctcgcctcaagctc

SEQ ID NO: 382331 - DNA, 25 bp, Homo sapien
ccaaggccggcagaactatggaaat

SEQ ID NO: 382332 - DNA, 25 bp, Homo sapien
caaggccggcagaactatggaaatt

SEQ ID NO: 382333 - DNA, 25 bp, Homo sapien
aaggccggcagaactatggaaattt

SEQ ID NO: 382334 - DNA, 25 bp, Homo sapien
aggccggcagaactatggaaatttc

SEQ ID NO: 382335 - DNA, 25 bp, Homo sapien
gccggcagaactatggaaatttcta

SEQ ID NO: 382336 - DNA, 25 bp, Homo sapien
aacccaaacagtccttcttattcag

SEQ ID NO: 382337 - DNA, 25 bp, Homo sapien
acccaaacagtccttcttattcaga

SEQ ID NO: 382338 - DNA, 25 bp, Homo sapien
cccaaacagtccttcttattcagac

SEQ ID NO: 382339 - DNA, 25 bp, Homo sapien
caaacagtccttcttattcagactt

SEQ ID NO: 382340 - DNA, 25 bp, Homo sapien
aggtagaatctgctcccatgcaggt

SEQ ID NO: 382341 - DNA, 25 bp, Homo sapien
gagcctgttcagatggagctgtctc

SEQ ID NO: 382342 - DNA, 25 bp, Homo sapien
ggtccagaaggagcctgttcagata

SEQ ID NO: 382343 - DNA, 25 bp, Homo sapien
tgttcagatagagctgtctcctccc

SEQ ID NO: 382344 - DNA, 25 bp, Homo sapien
gtctcctcccatggaggtggtccag

SEQ ID NO: 382345 - DNA, 25 bp, Homo sapien
gttaagatagagctgtctcctccca

SEQ ID NO: 382346 - DNA, 25 bp, Homo sapien
gagctgtctcctcccatagaggtgg

SEQ ID NO: 382347 - DNA, 25 bp, Homo sapien
aggtggtccagaaggagcctgttca

SEQ ID NO: 382348 - DNA, 25 bp, Homo sapien
agcctgttcagatggagttgtctcc

SEQ ID NO: 382349 - DNA, 25 bp, Homo sapien
tggttcagaaggagcctgctcagag

SEQ ID NO: 382350 - DNA, 25 bp, Homo sapien
cccttcacatggagccaatttccaa

SEQ ID NO: 382351 - DNA, 25 bp, Homo sapien
aacgcgatgcgctgaatgtcataag

SEQ ID NO: 382352 - DNA, 25 bp, Homo sapien
gtcataagaacacaacttttcgatg

SEQ ID NO: 382353 - DNA, 25 bp, Homo sapien
ttgccttacatgtgaagtgttccgt

SEQ ID NO: 382354 - DNA, 25 bp, Homo sapien
tgttccgttgaatatcacactgaat

SEQ ID NO: 382355 - DNA, 25 bp, Homo sapien
cactgaatagcaggtgtcaccacct

SEQ ID NO: 382356 - DNA, 25 bp, Homo sapien
gtgtcaccacctcctgagataagaa

SEQ ID NO: 382357 - DNA, 25 bp, Homo sapien
gtacagtgtagcagtggttttgcct

SEQ ID NO: 382358 - DNA, 25 bp, Homo sapien
gtggttttgcctagtgttccaattt

SEQ ID NO: 382359 - DNA, 25 bp, Homo sapien
ttttgcctagtgttccaattttgga

SEQ ID NO: 382360 - DNA, 25 bp, Homo sapien
ggaacgtcacataacaatggaacat

SEQ ID NO: 382361 - DNA, 25 bp, Homo sapien
gtcaaacagggaaagcaaacgcgat

SEQ ID NO: 382362 - DNA, 25 bp, Homo sapien
tctgcctatcttgtactagactctt

SEQ ID NO: 382363 - DNA, 25 bp, Homo sapien
gtactagactcttcatgctgatcgg

SEQ ID NO: 382364 - DNA, 25 bp, Homo sapien
gactcttcatgctgatcggatcttg

SEQ ID NO: 382365 - DNA, 25 bp, Homo sapien
tgctgatcggatcttgcattgaaat

SEQ ID NO: 382366 - DNA, 25 bp, Homo sapien
tcttgcattgaaataaccatgtgga

SEQ ID NO: 382367 - DNA, 25 bp, Homo sapien
gatgacatgtacaaccatatttaaa

SEQ ID NO: 382368 - DNA, 25 bp, Homo sapien
aaagagcaatagtgtccgtgtgtca

SEQ ID NO: 382369 - DNA, 25 bp, Homo sapien
gcaatagtgtccgtgtgtcatgaaa

SEQ ID NO: 382370 - DNA, 25 bp, Homo sapien
gtccgtgtgtcatgaaaaacttatt

SEQ ID NO: 382371 - DNA, 25 bp, Homo sapien
gtatgttcataaatcctgcactgta

SEQ ID NO: 382372 - DNA, 25 bp, Homo sapien
gtataaaacacatcacttaaacatt

SEQ ID NO: 382373 - DNA, 25 bp, Homo sapien
tggcgaaggctgctaccgagacgac

SEQ ID NO: 382374 - DNA, 25 bp, Homo sapien
gctccaagactggtgagtaagcagt

SEQ ID NO: 382375 - DNA, 25 bp, Homo sapien
tggaaagtttccggccctccaggag

SEQ ID NO: 382376 - DNA, 25 bp, Homo sapien
aggaggcttcctggctcttgattgg

SEQ ID NO: 382377 - DNA, 25 bp, Homo sapien
tgagtaagcagtcggcgtcgggaat

SEQ ID NO: 382378 - DNA, 25 bp, Homo sapien
tggctcttgattggccagtgtgaac

SEQ ID NO: 382379 - DNA, 25 bp, Homo sapien
cttgattggccagtgtgaacagact

SEQ ID NO: 382380 - DNA, 25 bp, Homo sapien
tgaacagactgtagagaccggcggt

SEQ ID NO: 382381 - DNA, 25 bp, Homo sapien
acagactgtagagaccggcggtcac

SEQ ID NO: 382382 - DNA, 25 bp, Homo sapien
tccttggaccagagcaaggcctgct

SEQ ID NO: 382383 - DNA, 25 bp, Homo sapien
gaagaccccggcgtggcgaaggctg

SEQ ID NO: 382384 - DNA, 25 bp, Homo sapien
atttggaaagtttatgcttctctca

SEQ ID NO: 382385 - DNA, 25 bp, Homo sapien
taagccatatcacagtttaagaaat

SEQ ID NO: 382386 - DNA, 25 bp, Homo sapien
tatcatatgccctttcagaaaccag

SEQ ID NO: 382387 - DNA, 25 bp, Homo sapien
atgccctttcagaaaccaggtattt

SEQ ID NO: 382388 - DNA, 25 bp, Homo sapien
aaccaggtattttgcatatgattga

SEQ ID NO: 382389 - DNA, 25 bp, Homo sapien
gggtttgtccatgttaattaagatc

SEQ ID NO: 382390 - DNA, 25 bp, Homo sapien
ctgtatttgcaactttcacattgta

SEQ ID NO: 382391 - DNA, 25 bp, Homo sapien
gcaactttcacattgtaatttccta

SEQ ID NO: 382392 - DNA, 25 bp, Homo sapien
gtaatttcctatacacttattaaag

SEQ ID NO: 382393 - DNA, 25 bp, Homo sapien
aaagtattgttttgccatgtggttt

SEQ ID NO: 382394 - DNA, 25 bp, Homo sapien
tttgccatgtggtttattaaataaa

SEQ ID NO: 382395 - DNA, 25 bp, Homo sapien
acgtgtgatgttaactatggtccat

SEQ ID NO: 382396 - DNA, 25 bp, Homo sapien
taactatggtccatctatttctaga

SEQ ID NO: 382397 - DNA, 25 bp, Homo sapien
taatgccatcttaaacttgttttag

SEQ ID NO: 382398 - DNA, 25 bp, Homo sapien
catttaaacttaccagttcactgtt

SEQ ID NO: 382399 - DNA, 25 bp, Homo sapien
gaacacagacaggaagggcaataag

SEQ ID NO: 382400 - DNA, 25 bp, Homo sapien
atttgataaatgttagcccagcaac

SEQ ID NO: 382401 - DNA, 25 bp, Homo sapien
tgttagcccagcaactacttttgtt

SEQ ID NO: 382402 - DNA, 25 bp, Homo sapien
ggtttaatcattacagtgacttaca

SEQ ID NO: 382403 - DNA, 25 bp, Homo sapien
gtgacttacagcatatcttactcca

SEQ ID NO: 382404 - DNA, 25 bp, Homo sapien
agcatatcttactccaaacgtgtga

SEQ ID NO: 382405 - DNA, 25 bp, Homo sapien
atcttactccaaacgtgtgatgtta

SEQ ID NO: 382406 - DNA, 25 bp, Homo sapien
aacgccgtcgctgtgacttttggag

SEQ ID NO: 382407 - DNA, 25 bp, Homo sapien
aagctcctaggagtcatggcctgga

SEQ ID NO: 382408 - DNA, 25 bp, Homo sapien
ctggatcatgcccatttctgttgcc

SEQ ID NO: 382409 - DNA, 25 bp, Homo sapien
atttctgttgccctgtccacatttg

SEQ ID NO: 382410 - DNA, 25 bp, Homo sapien
ggagttaatgggtctctcttcacct

SEQ ID NO: 382411 - DNA, 25 bp, Homo sapien
gctgttcttcgctggagcccgagag

SEQ ID NO: 382412 - DNA, 25 bp, Homo sapien
accttcccagtgtgttggccatgat

SEQ ID NO: 382413 - DNA, 25 bp, Homo sapien
gccatgatccacgtgaagcgctgca

SEQ ID NO: 382414 - DNA, 25 bp, Homo sapien
tgctgatgctggtcaccagcgacat

SEQ ID NO: 382415 - DNA, 25 bp, Homo sapien
agcgacatgtacacactcatcaact

SEQ ID NO: 382416 - DNA, 25 bp, Homo sapien
tcatcaactacgtgggcttcatcaa

SEQ ID NO: 382417 - DNA, 25 bp, Homo sapien
gtaccttcttcacttattaattgcc

SEQ ID NO: 382418 - DNA, 25 bp, Homo sapien
accttcttcacttattaattgccga

SEQ ID NO: 382419 - DNA, 25 bp, Homo sapien
ttcttcacttattaattgccgagct

SEQ ID NO: 382420 - DNA, 25 bp, Homo sapien
ttcacttattaattgccgagctact

SEQ ID NO: 382421 - DNA, 25 bp, Homo sapien
cacttattaattgccgagctacttc

SEQ ID NO: 382422 - DNA, 25 bp, Homo sapien
tattaattgccgagctacttcattc

SEQ ID NO: 382423 - DNA, 25 bp, Homo sapien
ttaattgccgagctacttcattctg

SEQ ID NO: 382424 - DNA, 25 bp, Homo sapien
taattgccgagctacttcattctgg

SEQ ID NO: 382425 - DNA, 25 bp, Homo sapien
attgccgagctacttcattctggaa

SEQ ID NO: 382426 - DNA, 25 bp, Homo sapien
ttgccgagctacttcattctggaat

SEQ ID NO: 382427 - DNA, 25 bp, Homo sapien
gccgagctacttcattctggaatat

SEQ ID NO: 382428 - DNA, 25 bp, Homo sapien
gcatgcgagcattgaaggaccaata

SEQ ID NO: 382429 - DNA, 25 bp, Homo sapien
ggaccaatagcaaacttatcagtac

SEQ ID NO: 382430 - DNA, 25 bp, Homo sapien
aacagttatcagaggctaaaacaga

SEQ ID NO: 382431 - DNA, 25 bp, Homo sapien
agaagagcccacagtgcattccagt

SEQ ID NO: 382432 - DNA, 25 bp, Homo sapien
cagtgcattccagtgaagctgcaat

SEQ ID NO: 382433 - DNA, 25 bp, Homo sapien
aagctgcaataatgaataattccca

SEQ ID NO: 382434 - DNA, 25 bp, Homo sapien
gatggtgaacattttgcacacccac

SEQ ID NO: 382435 - DNA, 25 bp, Homo sapien
atcagtcaatagaacctttgggaag

SEQ ID NO: 382436 - DNA, 25 bp, Homo sapien
tggaaaggtctgaaacttcctccct

SEQ ID NO: 382437 - DNA, 25 bp, Homo sapien
aggcctgaagattcctggcttagag

SEQ ID NO: 382438 - DNA, 25 bp, Homo sapien
ttcctggcttagagcatgcgagcat

SEQ ID NO: 382439 - DNA, 25 bp, Homo sapien
tgttttaatcaggtttctgccctca

SEQ ID NO: 382440 - DNA, 25 bp, Homo sapien
tctgccctcatcttctatttgggaa

SEQ ID NO: 382441 - DNA, 25 bp, Homo sapien
aaaactggtctgttggcatggctgg

SEQ ID NO: 382442 - DNA, 25 bp, Homo sapien
gagcggcaggcacattcttagtctc

SEQ ID NO: 382443 - DNA, 25 bp, Homo sapien
aggcacattcttagtctctgacttt

SEQ ID NO: 382444 - DNA, 25 bp, Homo sapien
ttagtctctgactttctgcagccat

SEQ ID NO: 382445 - DNA, 25 bp, Homo sapien
aagtgttgggtaacagtctactgaa

SEQ ID NO: 382446 - DNA, 25 bp, Homo sapien
gtgtgcggagttgtgttcatcttta

SEQ ID NO: 382447 - DNA, 25 bp, Homo sapien
ttggtaaattgggatctcctgttga

SEQ ID NO: 382448 - DNA, 25 bp, Homo sapien
agttgagtttatgcctggagcccct

SEQ ID NO: 382449 - DNA, 25 bp, Homo sapien
gtttatgcctggagcccctagagca

SEQ ID NO: 382450 - DNA, 25 bp, Homo sapien
taataccactggctcagcaaataca

SEQ ID NO: 382451 - DNA, 25 bp, Homo sapien
ctggctcagcaaatacaagttagtt

SEQ ID NO: 382452 - DNA, 25 bp, Homo sapien
atacaagttagtttgctttaagcag

SEQ ID NO: 382453 - DNA, 25 bp, Homo sapien
ttttgctaagtgcaggaggcccttt

SEQ ID NO: 382454 - DNA, 25 bp, Homo sapien
gaggccctttattattgctgcagaa

SEQ ID NO: 382455 - DNA, 25 bp, Homo sapien
gcctggctgagttgatgttttacat

SEQ ID NO: 382456 - DNA, 25 bp, Homo sapien
ttctcccttactgaaatctacatga

SEQ ID NO: 382457 - DNA, 25 bp, Homo sapien
aatctacatgacatgatgcttcttg

SEQ ID NO: 382458 - DNA, 25 bp, Homo sapien
atgcttcttgctgggtttttgtaca

SEQ ID NO: 382459 - DNA, 25 bp, Homo sapien
cttgctgggtttttgtacatgtaaa

SEQ ID NO: 382460 - DNA, 25 bp, Homo sapien
aagaaaatggctggaggtgtgcttt

SEQ ID NO: 382461 - DNA, 25 bp, Homo sapien
atgtggtgttttcatcataaaagag

SEQ ID NO: 382462 - DNA, 25 bp, Homo sapien
agtaatttctactgaactgtggtca

SEQ ID NO: 382463 - DNA, 25 bp, Homo sapien
actgtggtcagttcaccaaggcaca

SEQ ID NO: 382464 - DNA, 25 bp, Homo sapien
aaggcacatgcctgtaggactggag

SEQ ID NO: 382465 - DNA, 25 bp, Homo sapien
tgcctgtaggactggagactcacat

SEQ ID NO: 382466 - DNA, 25 bp, Homo sapien
gactcacatgaggtagtgtctgatt

SEQ ID NO: 382467 - DNA, 25 bp, Homo sapien
tgtctgattgagagtcctggaggca

SEQ ID NO: 382468 - DNA, 25 bp, Homo sapien
tcctggaggcagttagacttcttta

SEQ ID NO: 382469 - DNA, 25 bp, Homo sapien
gcagttagacttctttaaggatgga

SEQ ID NO: 382470 - DNA, 25 bp, Homo sapien
gggattcctgcttagttaatctgac

SEQ ID NO: 382471 - DNA, 25 bp, Homo sapien
tcctgcttagttaatctgactttta

SEQ ID NO: 382472 - DNA, 25 bp, Homo sapien
ggttctgccccaaatattcttttgt

SEQ ID NO: 382473 - DNA, 25 bp, Homo sapien
aaatattcttttgtgagagagcccc

SEQ ID NO: 382474 - DNA, 25 bp, Homo sapien
ggttcagagccttcatttggctgag

SEQ ID NO: 382475 - DNA, 25 bp, Homo sapien
acggttccgtcctgcaggtcagtga

SEQ ID NO: 382476 - DNA, 25 bp, Homo sapien
gttccgtcctgcaggtcagtgagaa

SEQ ID NO: 382477 - DNA, 25 bp, Homo sapien
tcctgcaggtcagtgagaagctgtc

SEQ ID NO: 382478 - DNA, 25 bp, Homo sapien
agagccttcatttggctgaggatgt

SEQ ID NO: 382479 - DNA, 25 bp, Homo sapien
gaagctgtcagcaaggtttctttca

SEQ ID NO: 382480 - DNA, 25 bp, Homo sapien
aaagctgctgtttagacagctgatc

SEQ ID NO: 382481 - DNA, 25 bp, Homo sapien
gacagctgatctcttggtctgaaaa

SEQ ID NO: 382482 - DNA, 25 bp, Homo sapien
gctgatctcttggtctgaaaacaaa

SEQ ID NO: 382483 - DNA, 25 bp, Homo sapien
tgcccagtatgcagcctccaggcag

SEQ ID NO: 382484 - DNA, 25 bp, Homo sapien
tatgcagcctccaggcagagggcct

SEQ ID NO: 382485 - DNA, 25 bp, Homo sapien
gcaggtagggttcccctagcagcct

SEQ ID NO: 382486 - DNA, 25 bp, Homo sapien
gggtggtcagatagaaacattaact

SEQ ID NO: 382487 - DNA, 25 bp, Homo sapien
gaacgtagaggccagttcttggctc

SEQ ID NO: 382488 - DNA, 25 bp, Homo sapien
aggccagttcttggctcagggagcc

SEQ ID NO: 382489 - DNA, 25 bp, Homo sapien
taactgttgcacatacaagccactc

SEQ ID NO: 382490 - DNA, 25 bp, Homo sapien
tgttgcacatacaagccactcacac

SEQ ID NO: 382491 - DNA, 25 bp, Homo sapien
atacaagccactcacactgctatcg

SEQ ID NO: 382492 - DNA, 25 bp, Homo sapien
tgcccgcatgctgggaaggtgagcc

SEQ ID NO: 382493 - DNA, 25 bp, Homo sapien
ggaaggtgagcccttgcctggagag

SEQ ID NO: 382494 - DNA, 25 bp, Homo sapien
cttcagtctctgaccaagggtttga

SEQ ID NO: 382495 - DNA, 25 bp, Homo sapien
tgtggctccagagggtgttctttca

SEQ ID NO: 382496 - DNA, 25 bp, Homo sapien
agagggtgttctttcagccactccg

SEQ ID NO: 382497 - DNA, 25 bp, Homo sapien
gcacaaccatgttctcctttggtga

SEQ ID NO: 382498 - DNA, 25 bp, Homo sapien
tgttctcctttggtgatgcctctaa

SEQ ID NO: 382499 - DNA, 25 bp, Homo sapien
gtgatgcctctaacttaccgtgaaa

SEQ ID NO: 382500 - DNA, 25 bp, Homo sapien
tgaaaatgtacctttcccttcgcta

SEQ ID NO: 382501 - DNA, 25 bp, Homo sapien
ttccctcctagtcagccgagattct

SEQ ID NO: 382502 - DNA, 25 bp, Homo sapien
taatttccacacaagtctgataagg

SEQ ID NO: 382503 - DNA, 25 bp, Homo sapien
acaagtctgataaggcaggcacccc

SEQ ID NO: 382504 - DNA, 25 bp, Homo sapien
agaagactgaggttcgggtagaaat

SEQ ID NO: 382505 - DNA, 25 bp, Homo sapien
gttcacattttggatgctctcccca

SEQ ID NO: 382506 - DNA, 25 bp, Homo sapien
agcgatgtttgggatcctaaagaaa

SEQ ID NO: 382507 - DNA, 25 bp, Homo sapien
gtttgggatcctaaagaaagcatca

SEQ ID NO: 382508 - DNA, 25 bp, Homo sapien
aagaaagcatcagaccagactcagg

SEQ ID NO: 382509 - DNA, 25 bp, Homo sapien
agactcaggtctggacgtccctcaa

SEQ ID NO: 382510 - DNA, 25 bp, Homo sapien
aggtctggacgtccctcaagtggcc

SEQ ID NO: 382511 - DNA, 25 bp, Homo sapien
tcaagtggcccggaggtaccgatat

SEQ ID NO: 382512 - DNA, 25 bp, Homo sapien
gtggcccggaggtaccgatattagt

SEQ ID NO: 382513 - DNA, 25 bp, Homo sapien
gtaccgatattagtgtcaccgccgt

SEQ ID NO: 382514 - DNA, 25 bp, Homo sapien
atattagtgtcaccgccgtcagtgc

SEQ ID NO: 382515 - DNA, 25 bp, Homo sapien
ataaaacctttgttctgagagaaat

SEQ ID NO: 382516 - DNA, 25 bp, Homo sapien
tgacatcatctgcacatggacagct

SEQ ID NO: 382517 - DNA, 25 bp, Homo sapien
ggttcgatgccttccagaggcacct

SEQ ID NO: 382518 - DNA, 25 bp, Homo sapien
gaggcacctctctaacaataagagc

SEQ ID NO: 382519 - DNA, 25 bp, Homo sapien
gattgagtggaaataccccagcttc

SEQ ID NO: 382520 - DNA, 25 bp, Homo sapien
agcctccatgcccttagtggcatga

SEQ ID NO: 382521 - DNA, 25 bp, Homo sapien
tggcatgattccgaggtgcatccta

SEQ ID NO: 382522 - DNA, 25 bp, Homo sapien
gtgcatcctacactgactcttggtg

SEQ ID NO: 382523 - DNA, 25 bp, Homo sapien
agctcattcgcgtggccctcagcag

SEQ ID NO: 382524 - DNA, 25 bp, Homo sapien
accacctctccgtgattccaggaat

SEQ ID NO: 382525 - DNA, 25 bp, Homo sapien
gattccaggaatcagctcccgaata

SEQ ID NO: 382526 - DNA, 25 bp, Homo sapien
agctcccgaataaacgacttgcacc

SEQ ID NO: 382527 - DNA, 25 bp, Homo sapien
gatggtgtcaccagattttggtcac

SEQ ID NO: 382528 - DNA, 25 bp, Homo sapien
ttttggtcaccaatgagtacccgac

SEQ ID NO: 382529 - DNA, 25 bp, Homo sapien
aatgagtacccgacccgttgccatg

SEQ ID NO: 382530 - DNA, 25 bp, Homo sapien
ccgacccgttgccatgattaagaga

SEQ ID NO: 382531 - DNA, 25 bp, Homo sapien
acccgttgccatgattaagagagaa

SEQ ID NO: 382532 - DNA, 25 bp, Homo sapien
atgctttctattggagtttcaggaa

SEQ ID NO: 382533 - DNA, 25 bp, Homo sapien
atacatgaagtagtgtctgccatac

SEQ ID NO: 382534 - DNA, 25 bp, Homo sapien
gaagtagtgtctgccatacatgtta

SEQ ID NO: 382535 - DNA, 25 bp, Homo sapien
gtgtctgccatacatgttaatattc

SEQ ID NO: 382536 - DNA, 25 bp, Homo sapien
attctacattcttgcttccttaaat

SEQ ID NO: 382537 - DNA, 25 bp, Homo sapien
acattcttgcttccttaaattaata

SEQ ID NO: 382538 - DNA, 25 bp, Homo sapien
tcagggtcttttgtgataccatatg

SEQ ID NO: 382539 - DNA, 25 bp, Homo sapien
atcacgtatttcgatagaggttgca

SEQ ID NO: 382540 - DNA, 25 bp, Homo sapien
cgatagaggttgcattatacctgta

SEQ ID NO: 382541 - DNA, 25 bp, Homo sapien
atacctgtaggtcattttgtgtaat

SEQ ID NO: 382542 - DNA, 25 bp, Homo sapien
tctctgtttttattcaagtaccata

SEQ ID NO: 382543 - DNA, 25 bp, Homo sapien
atgtcagttcatgaatagtccattt

SEQ ID NO: 382544 - DNA, 25 bp, Homo sapien
tttagaatgtaaggcgtttcaactt

SEQ ID NO: 382545 - DNA, 25 bp, Homo sapien
gtaccatacagttggttaccatagc

SEQ ID NO: 382546 - DNA, 25 bp, Homo sapien
accatagctatgtagtgtatttcaa

SEQ ID NO: 382547 - DNA, 25 bp, Homo sapien
gtgtatttcaaagttagtcacttat

SEQ ID NO: 382548 - DNA, 25 bp, Homo sapien
gtcacttattttgtcttgattgctt

SEQ ID NO: 382549 - DNA, 25 bp, Homo sapien
ccctgccatggctgaggtcagagtg

SEQ ID NO: 382550 - DNA, 25 bp, Homo sapien
ctgaggtcagagtggcacccggcac

SEQ ID NO: 382551 - DNA, 25 bp, Homo sapien
ggtcagagtggcacccggcacccag

SEQ ID NO: 382552 - DNA, 25 bp, Homo sapien
cccaggctgcggtgagaatgccaag

SEQ ID NO: 382553 - DNA, 25 bp, Homo sapien
gctgtgtgacctaacaccagccacc

SEQ ID NO: 382554 - DNA, 25 bp, Homo sapien
gcttctgggcctccatcatctgtaa

SEQ ID NO: 382555 - DNA, 25 bp, Homo sapien
gtaaaaccgggtaatagtgcacaca

SEQ ID NO: 382556 - DNA, 25 bp, Homo sapien
aaaccgggtaatagtgcacacagtt

SEQ ID NO: 382557 - DNA, 25 bp, Homo sapien
agtgcacacagttggtgccacataa

SEQ ID NO: 382558 - DNA, 25 bp, Homo sapien
agttggtgccacataaaggctcaac

SEQ ID NO: 382559 - DNA, 25 bp, Homo sapien
ggtgccacataaaggctcaacagat

SEQ ID NO: 382560 - DNA, 25 bp, Homo sapien
ttggagaaagcacgtctcttccgac

SEQ ID NO: 382561 - DNA, 25 bp, Homo sapien
aagcacgtctcttccgacagcaaaa

SEQ ID NO: 382562 - DNA, 25 bp, Homo sapien
tcttccgacagcaaaacactgggca

SEQ ID NO: 382563 - DNA, 25 bp, Homo sapien
aacactgggcaggttcattttaagt

SEQ ID NO: 382564 - DNA, 25 bp, Homo sapien
gtatcatttatctagacttgcagtt

SEQ ID NO: 382565 - DNA, 25 bp, Homo sapien
gacttgcagttgcactcaaagtatt

SEQ ID NO: 382566 - DNA, 25 bp, Homo sapien
agttgcactcaaagtatttctacaa

SEQ ID NO: 382567 - DNA, 25 bp, Homo sapien
gatcaaaagattacagttacctcat

SEQ ID NO: 382568 - DNA, 25 bp, Homo sapien
agcacaagtaccaataactgcctca

SEQ ID NO: 382569 - DNA, 25 bp, Homo sapien
aataactgcctcaaaaatacttgtt

SEQ ID NO: 382570 - DNA, 25 bp, Homo sapien
aatttcctagtaatatcgtctcaat

SEQ ID NO: 382571 - DNA, 25 bp, Homo sapien
ttgtggctaatgcagcaccataatt

SEQ ID NO: 382572 - DNA, 25 bp, Homo sapien
gctaatgcagcaccataatttgtaa

SEQ ID NO: 382573 - DNA, 25 bp, Homo sapien
acagagagatgttttgagcatattt

SEQ ID NO: 382574 - DNA, 25 bp, Homo sapien
gaaaattaatcctatagcatctgaa

SEQ ID NO: 382575 - DNA, 25 bp, Homo sapien
tagcatctgaaagacctcactggga

SEQ ID NO: 382576 - DNA, 25 bp, Homo sapien
atctgaaagacctcactgggaagtt

SEQ ID NO: 382577 - DNA, 25 bp, Homo sapien
gatttttgtttgatttgtgcataca

SEQ ID NO: 382578 - DNA, 25 bp, Homo sapien
ataggtatcacaacttgatctggaa

SEQ ID NO: 382579 - DNA, 25 bp, Homo sapien
taagctgtgaaaattctcaaggaat

SEQ ID NO: 382580 - DNA, 25 bp, Homo sapien
attattatcatttagctctgcaaag

SEQ ID NO: 382581 - DNA, 25 bp, Homo sapien
ttagctctgcaaagctttccatggc

SEQ ID NO: 382582 - DNA, 25 bp, Homo sapien
gatgtggcacaaatagaagtatgta

SEQ ID NO: 382583 - DNA, 25 bp, Homo sapien
gtatgtaacattcaaacaacagcat

SEQ ID NO: 382584 - DNA, 25 bp, Homo sapien
aacaacagcatctaggatttttgaa

SEQ ID NO: 382585 - DNA, 25 bp, Homo sapien
tcggttacagttacacaaagggtca

SEQ ID NO: 382586 - DNA, 25 bp, Homo sapien
cagttacacaaagggtcacttcctc

SEQ ID NO: 382587 - DNA, 25 bp, Homo sapien
gtaccttcttcacttattaattgcc

SEQ ID NO: 382588 - DNA, 25 bp, Homo sapien
cgacacatgggcctctcaaaggaga

SEQ ID NO: 382589 - DNA, 25 bp, Homo sapien
ttcacttattaattgccgagctact

SEQ ID NO: 382590 - DNA, 25 bp, Homo sapien
ttaattgccgagctacttcattctg

SEQ ID NO: 382591 - DNA, 25 bp, Homo sapien
attgccgagctacttcattctggaa

SEQ ID NO: 382592 - DNA, 25 bp, Homo sapien
gccgagctacttcattctggaatat

SEQ ID NO: 382593 - DNA, 25 bp, Homo sapien
atgaatcttcagcttaagtatcttc

SEQ ID NO: 382594 - DNA, 25 bp, Homo sapien
tcttcagcttaagtatcttctgaca

SEQ ID NO: 382595 - DNA, 25 bp, Homo sapien
tcttctgacataaaagcattttcat

SEQ ID NO: 382596 - DNA, 25 bp, Homo sapien
agtgctgatattactctccacagta

SEQ ID NO: 382597 - DNA, 25 bp, Homo sapien
gtattatatctgatcctgcaaagta

SEQ ID NO: 382598 - DNA, 25 bp, Homo sapien
atatctgatcctgcaaagtagttca

SEQ ID NO: 382599 - DNA, 25 bp, Homo sapien
gatcctgcaaagtagttcagatacc

SEQ ID NO: 382600 - DNA, 25 bp, Homo sapien
agttcagataccagagaatactctt

SEQ ID NO: 382601 - DNA, 25 bp, Homo sapien
gaatactcttaaacattttgactca

SEQ ID NO: 382602 - DNA, 25 bp, Homo sapien
actcttaaacattttgactcacgca

SEQ ID NO: 382603 - DNA, 25 bp, Homo sapien
tgggttaaaagaatgcaaaatcgca

SEQ ID NO: 382604 - DNA, 25 bp, Homo sapien
gcctgatgatcggtcactgtgttcc

SEQ ID NO: 382605 - DNA, 25 bp, Homo sapien
cctgatgatcggtcactgtgttcca

SEQ ID NO: 382606 - DNA, 25 bp, Homo sapien
ctgatgatcggtcactgtgttccat

SEQ ID NO: 382607 - DNA, 25 bp, Homo sapien
tgatgatcggtcactgtgttccatc

SEQ ID NO: 382608 - DNA, 25 bp, Homo sapien
gatgatcggtcactgtgttccatca

SEQ ID NO: 382609 - DNA, 25 bp, Homo sapien
atgatcggtcactgtgttccatcac

SEQ ID NO: 382610 - DNA, 25 bp, Homo sapien
tgatcggtcactgtgttccatcacc

SEQ ID NO: 382611 - DNA, 25 bp, Homo sapien
gatcggtcactgtgttccatcaccc

SEQ ID NO: 382612 - DNA, 25 bp, Homo sapien
catgggactgtctagttgcgggaaa

SEQ ID NO: 382613 - DNA, 25 bp, Homo sapien
ctgattctaccttataatgaattgt

SEQ ID NO: 382614 - DNA, 25 bp, Homo sapien
tgattctaccttataatgaattgta

SEQ ID NO: 382615 - DNA, 25 bp, Homo sapien
atcagcagaatccagactataagaa

SEQ ID NO: 382616 - DNA, 25 bp, Homo sapien
gaatccagactataagaaactacag

SEQ ID NO: 382617 - DNA, 25 bp, Homo sapien
agaaactacaggacacatgacctag

SEQ ID NO: 382618 - DNA, 25 bp, Homo sapien
acaggacacatgacctagtttcttc

SEQ ID NO: 382619 - DNA, 25 bp, Homo sapien
ttctgtaaataacttgcaaggatga

SEQ ID NO: 382620 - DNA, 25 bp, Homo sapien
acagtgttacgcgtctgcctcagga

SEQ ID NO: 382621 - DNA, 25 bp, Homo sapien
ttacgcgtctgcctcaggaggctga

SEQ ID NO: 382622 - DNA, 25 bp, Homo sapien
caggagctttagtctagcctgagca

SEQ ID NO: 382623 - DNA, 25 bp, Homo sapien
ctaaatttgaccatgcccctagaaa

SEQ ID NO: 382624 - DNA, 25 bp, Homo sapien
gaccatgcccctagaaataattcct

SEQ ID NO: 382625 - DNA, 25 bp, Homo sapien
gcccctagaaataattcctaatctt

SEQ ID NO: 382626 - DNA, 25 bp, Homo sapien
taatctttgattttggtccctgttt

SEQ ID NO: 382627 - DNA, 25 bp, Homo sapien
tgattttggtccctgtttctaagaa

SEQ ID NO: 382628 - DNA, 25 bp, Homo sapien
tgaaaaggtcgtaataccgcccctg

SEQ ID NO: 382629 - DNA, 25 bp, Homo sapien
taccgcccctgagaaaaaaggagca

SEQ ID NO: 382630 - DNA, 25 bp, Homo sapien
aggagcagcgctaaataatcgagaa

SEQ ID NO: 382631 - DNA, 25 bp, Homo sapien
gaaaatgcctcctcttgaaacggat

SEQ ID NO: 382632 - DNA, 25 bp, Homo sapien
atgcctcctcttgaaacggatatag

SEQ ID NO: 382633 - DNA, 25 bp, Homo sapien
gagaatcatataatacaggagctta

SEQ ID NO: 382634 - DNA, 25 bp, Homo sapien
ggagcttaaacacctatgcgcgatg

SEQ ID NO: 382635 - DNA, 25 bp, Homo sapien
atgcgcgatgataaagagggtacta

SEQ ID NO: 382636 - DNA, 25 bp, Homo sapien
aagagggtactattagagcgcttgg

SEQ ID NO: 382637 - DNA, 25 bp, Homo sapien
acaggtgagtgtggtgtgctcatga

SEQ ID NO: 382638 - DNA, 25 bp, Homo sapien
gagtatgagtatgcctgagtgtgaa

SEQ ID NO: 382639 - DNA, 25 bp, Homo sapien
agtatgcctgagtgtgaatgtgtat

SEQ ID NO: 382640 - DNA, 25 bp, Homo sapien
gcacatgagtgcacgggtgtcagca

SEQ ID NO: 382641 - DNA, 25 bp, Homo sapien
gcacgggtgtcagcatgtgtatata

SEQ ID NO: 382642 - DNA, 25 bp, Homo sapien
cagcatgtgtatataagtgtgggca

SEQ ID NO: 382643 - DNA, 25 bp, Homo sapien
ataagtgtgggcatgtgtatgtgat

SEQ ID NO: 382644 - DNA, 25 bp, Homo sapien
gagtggtgctttctctagtgtgtcc

SEQ ID NO: 382645 - DNA, 25 bp, Homo sapien
tttctctagtgtgtcctccggaaca

SEQ ID NO: 382646 - DNA, 25 bp, Homo sapien
ctagtgtgtcctccggaacatcttg

SEQ ID NO: 382647 - DNA, 25 bp, Homo sapien
tccggaacatcttgcctacctagca

SEQ ID NO: 382648 - DNA, 25 bp, Homo sapien
acagttacacaaagggtcacttcct

SEQ ID NO: 382649 - DNA, 25 bp, Homo sapien
cagttacacaaagggtcacttcctc

SEQ ID NO: 382650 - DNA, 25 bp, Homo sapien
tacacaaagggtcacttcctcccca

SEQ ID NO: 382651 - DNA, 25 bp, Homo sapien
acaaagggtcacttcctccccagcg

SEQ ID NO: 382652 - DNA, 25 bp, Homo sapien
aagggtcacttcctccccagcgaca

SEQ ID NO: 382653 - DNA, 25 bp, Homo sapien
tcacttcctccccagcgacacatgg

SEQ ID NO: 382654 - DNA, 25 bp, Homo sapien
cgacacatgggcctctcaaaggaga

SEQ ID NO: 382655 - DNA, 25 bp, Homo sapien
gacacatgggcctctcaaaggagag

SEQ ID NO: 382656 - DNA, 25 bp, Homo sapien
acacatgggcctctcaaaggagagg

SEQ ID NO: 382657 - DNA, 25 bp, Homo sapien
cacatgggcctctcaaaggagagga

SEQ ID NO: 382658 - DNA, 25 bp, Homo sapien
gagaggagggagtaagtcccacggt

SEQ ID NO: 382659 - DNA, 25 bp, Homo sapien
cagcagcagtttgaaagtgttccgt

SEQ ID NO: 382660 - DNA, 25 bp, Homo sapien
cagcagtttgaaagtgttccgtttt

SEQ ID NO: 382661 - DNA, 25 bp, Homo sapien
agagccatggataatgctgcaacat

SEQ ID NO: 382662 - DNA, 25 bp, Homo sapien
gttaagtggatgagctattatgaaa

SEQ ID NO: 382663 - DNA, 25 bp, Homo sapien
gataatgctgcaacatgagtggcac

SEQ ID NO: 382664 - DNA, 25 bp, Homo sapien
aatgctgcaacatgagtggcacaga

SEQ ID NO: 382665 - DNA, 25 bp, Homo sapien
gtactaaattactatggatcagatg

SEQ ID NO: 382666 - DNA, 25 bp, Homo sapien
gggagtacacagagagagcaattaa

SEQ ID NO: 382667 - DNA, 25 bp, Homo sapien
cagagagagcaattaatttggtgtg

SEQ ID NO: 382668 - DNA, 25 bp, Homo sapien
ggaaggtggtgatctgaatacagca

SEQ ID NO: 382669 - DNA, 25 bp, Homo sapien
ggtgatctgaatacagcagcagttt

SEQ ID NO: 382670 - DNA, 25 bp, Homo sapien
ggaaatcaaccacactcagctgagt

SEQ ID NO: 382671 - DNA, 25 bp, Homo sapien
agctgagttcccttcccgaaggtca

SEQ ID NO: 382672 - DNA, 25 bp, Homo sapien
ggctcccgacgatcatgcagaagta

SEQ ID NO: 382673 - DNA, 25 bp, Homo sapien
gaagtagatgccactgtcttccggc

SEQ ID NO: 382674 - DNA, 25 bp, Homo sapien
tccggcttcacgcttgtgagattga

SEQ ID NO: 382675 - DNA, 25 bp, Homo sapien
agaatgaaccggcttgcatcccgaa

SEQ ID NO: 382676 - DNA, 25 bp, Homo sapien
ttgcatcccgaaacacagctatctt

SEQ ID NO: 382677 - DNA, 25 bp, Homo sapien
gttccacctcttcaccgtggatagt

SEQ ID NO: 382678 - DNA, 25 bp, Homo sapien
cgtggatagtcccttttgcggaatc

SEQ ID NO: 382679 - DNA, 25 bp, Homo sapien
cttttgcggaatcccagagggccag

SEQ ID NO: 382680 - DNA, 25 bp, Homo sapien
cacactctcttcttgagggtggact

SEQ ID NO: 382681 - DNA, 25 bp, Homo sapien
tagtgtaatacaaccaagagaatca

SEQ ID NO: 382682 - DNA, 25 bp, Homo sapien
agtgtaatacaaccaagagaatcaa

SEQ ID NO: 382683 - DNA, 25 bp, Homo sapien
gtgtaatacaaccaagagaatcaaa

SEQ ID NO: 382684 - DNA, 25 bp, Homo sapien
gtaatacaaccaagagaatcaaaac

SEQ ID NO: 382685 - DNA, 25 bp, Homo sapien
tacaaccaagagaatcaaaacaaca

SEQ ID NO: 382686 - DNA, 25 bp, Homo sapien
aaaatgttaagattggcctggcgca

SEQ ID NO: 382687 - DNA, 25 bp, Homo sapien
aaatgttaagattggcctggcgcag

SEQ ID NO: 382688 - DNA, 25 bp, Homo sapien
aatgttaagattggcctggcgcagt

SEQ ID NO: 382689 - DNA, 25 bp, Homo sapien
ggcgcacacctgtaacttcagctat

SEQ ID NO: 382690 - DNA, 25 bp, Homo sapien
cacacctgtaacttcagctattcag

SEQ ID NO: 382691 - DNA, 25 bp, Homo sapien
tattcaggagactgaggcccaagaa

SEQ ID NO: 382692 - DNA, 25 bp, Homo sapien
agcaaggcccacagaaccagcattc

SEQ ID NO: 382693 - DNA, 25 bp, Homo sapien
agcactccctttggcgagacaaaga

SEQ ID NO: 382694 - DNA, 25 bp, Homo sapien
aaagattccagagccgatgatgttc

SEQ ID NO: 382695 - DNA, 25 bp, Homo sapien
attccagagccgatgatgttcccta

SEQ ID NO: 382696 - DNA, 25 bp, Homo sapien
agccgatgatgttccctacgatgat

SEQ ID NO: 382697 - DNA, 25 bp, Homo sapien
gatgttccctacgatgataccacag

SEQ ID NO: 382698 - DNA, 25 bp, Homo sapien
gatgataccacaggcactgaccaat

SEQ ID NO: 382699 - DNA, 25 bp, Homo sapien
aggcactgaccaatccgatctcttt

SEQ ID NO: 382700 - DNA, 25 bp, Homo sapien
gaccaatccgatctctttcttcagg

SEQ ID NO: 382701 - DNA, 25 bp, Homo sapien
aatccagacgatgagagcaaggccc

SEQ ID NO: 382702 - DNA, 25 bp, Homo sapien
gacgatgagagcaaggcccacagaa

SEQ ID NO: 382703 - DNA, 25 bp, Homo sapien
gaagagtctcatgtgatacagtgga

SEQ ID NO: 382704 - DNA, 25 bp, Homo sapien
atacagtggagatttcataccgaat

SEQ ID NO: 382705 - DNA, 25 bp, Homo sapien
gcataaatttaacggaactcattag

SEQ ID NO: 382706 - DNA, 25 bp, Homo sapien
agccttttttctcaggttgtttcat

SEQ ID NO: 382707 - DNA, 25 bp, Homo sapien
ttctcaggttgtttcattactgtat

SEQ ID NO: 382708 - DNA, 25 bp, Homo sapien
tcattactgtatggtgagacaactg

SEQ ID NO: 382709 - DNA, 25 bp, Homo sapien
gagacaactgattcaccacgattta

SEQ ID NO: 382710 - DNA, 25 bp, Homo sapien
gattcaccacgatttagtctagagc

SEQ ID NO: 382711 - DNA, 25 bp, Homo sapien
accacgatttagtctagagctactt

SEQ ID NO: 382712 - DNA, 25 bp, Homo sapien
gtctagagctacttttctattctga

SEQ ID NO: 382713 - DNA, 25 bp, Homo sapien
gttttgctaaactatggtgaattat

SEQ ID NO: 382714 - DNA, 25 bp, Homo sapien
cctggatgagagagtggaacactgt

SEQ ID NO: 382715 - DNA, 25 bp, Homo sapien
gagagtggaacactgtcatcatcca

SEQ ID NO: 382716 - DNA, 25 bp, Homo sapien
agtggaacactgtcatcatccaggg

SEQ ID NO: 382717 - DNA, 25 bp, Homo sapien
agctcccagcctgagttgcgttact

SEQ ID NO: 382718 - DNA, 25 bp, Homo sapien
agcctgagttgcgttacttctggaa

SEQ ID NO: 382719 - DNA, 25 bp, Homo sapien
ctgagttgcgttacttctggaactt

SEQ ID NO: 382720 - DNA, 25 bp, Homo sapien
gttgcgttacttctggaactttata

SEQ ID NO: 382721 - DNA, 25 bp, Homo sapien
gcgttacttctggaactttatatca

SEQ ID NO: 382722 - DNA, 25 bp, Homo sapien
tacttctggaactttatatcaatga

SEQ ID NO: 382723 - DNA, 25 bp, Homo sapien
atcaatgaaatcattctgttctgtg

SEQ ID NO: 382724 - DNA, 25 bp, Homo sapien
gtttaaatgatagagcatgaggctg

SEQ ID NO: 382725 - DNA, 25 bp, Homo sapien
gatagttcggatgtcgctgtggcaa

SEQ ID NO: 382726 - DNA, 25 bp, Homo sapien
atagttcggatgtcgctgtggcaaa

SEQ ID NO: 382727 - DNA, 25 bp, Homo sapien
ttcggatgtcgctgtggcaaagtcc

SEQ ID NO: 382728 - DNA, 25 bp, Homo sapien
cggatgtcgctgtggcaaagtccga

SEQ ID NO: 382729 - DNA, 25 bp, Homo sapien
tcgctgtggcaaagtccgagggcca

SEQ ID NO: 382730 - DNA, 25 bp, Homo sapien
gagggccagcgctgccctggagatt

SEQ ID NO: 382731 - DNA, 25 bp, Homo sapien
gcgacagcgacgtgggcaagggcga

SEQ ID NO: 382732 - DNA, 25 bp, Homo sapien
gattgagcgcctggaggacagggct

SEQ ID NO: 382733 - DNA, 25 bp, Homo sapien
ggacagggctggagattgagcgcct

SEQ ID NO: 382734 - DNA, 25 bp, Homo sapien
gctggagattgagcgcctggaggac

SEQ ID NO: 382735 - DNA, 25 bp, Homo sapien
agggcgagatcctggcgagcctgca

SEQ ID NO: 382736 - DNA, 25 bp, Homo sapien
aaaaagaatcttatctcctatagaa

SEQ ID NO: 382737 - DNA, 25 bp, Homo sapien
gaatcttatctcctatagaaaacag

SEQ ID NO: 382738 - DNA, 25 bp, Homo sapien
atctcctatagaaaacagcaacata

SEQ ID NO: 382739 - DNA, 25 bp, Homo sapien
aggatagttaactattatactccaa

SEQ ID NO: 382740 - DNA, 25 bp, Homo sapien
tattatactccaacaattcatgagc

SEQ ID NO: 382741 - DNA, 25 bp, Homo sapien
tccaacaattcatgagcaacagtat

SEQ ID NO: 382742 - DNA, 25 bp, Homo sapien
acaattcatgagcaacagtatatac

SEQ ID NO: 382743 - DNA, 25 bp, Homo sapien
gcaacagtatatacactgagtaaaa

SEQ ID NO: 382744 - DNA, 25 bp, Homo sapien
agaaatgcacatggtaataaaaagt

SEQ ID NO: 382745 - DNA, 25 bp, Homo sapien
atgcaattaactaagaacagctctg

SEQ ID NO: 382746 - DNA, 25 bp, Homo sapien
caattaactaagaacagctctgaat

SEQ ID NO: 382747 - DNA, 25 bp, Homo sapien
gagtcttgataattacaagtcaaca

SEQ ID NO: 382748 - DNA, 25 bp, Homo sapien
ttacaagtcaacagctatcgaaagt

SEQ ID NO: 382749 - DNA, 25 bp, Homo sapien
tcgaaagttagcacagcttgtctgt

SEQ ID NO: 382750 - DNA, 25 bp, Homo sapien
agcttgtctgtggtgctgttttttt

SEQ ID NO: 382751 - DNA, 25 bp, Homo sapien
agtggacttatgctgttttcatgtt

SEQ ID NO: 382752 - DNA, 25 bp, Homo sapien
acaaaaaggtttcatgtgattcatg

SEQ ID NO: 382753 - DNA, 25 bp, Homo sapien
gtgattcatgtgtaagatgcacagt

SEQ ID NO: 382754 - DNA, 25 bp, Homo sapien
gatgcacagtatttgacatcctgat

SEQ ID NO: 382755 - DNA, 25 bp, Homo sapien
cagtatttgacatcctgattatgta

SEQ ID NO: 382756 - DNA, 25 bp, Homo sapien
agtcttacacttatggttggcctca

SEQ ID NO: 382757 - DNA, 25 bp, Homo sapien
ggttggcctcaaatctattgcattt

SEQ ID NO: 382758 - DNA, 25 bp, Homo sapien
tgctgccagacacccaatattacaa

SEQ ID NO: 382759 - DNA, 25 bp, Homo sapien
cccaatattacaagagcatcattaa

SEQ ID NO: 382760 - DNA, 25 bp, Homo sapien
tcactttcgctgttctccaggtctc

SEQ ID NO: 382761 - DNA, 25 bp, Homo sapien
tgttctccaggtctctgagtccatt

SEQ ID NO: 382762 - DNA, 25 bp, Homo sapien
gggtgagtttgtttctcataatggg

SEQ ID NO: 382763 - DNA, 25 bp, Homo sapien
ggcaaatattggtatctaggtaggt

SEQ ID NO: 382764 - DNA, 25 bp, Homo sapien
ggtatctaggtaggttatagctgaa

SEQ ID NO: 382765 - DNA, 25 bp, Homo sapien
ggttatagctgaagatgttctgtca

SEQ ID NO: 382766 - DNA, 25 bp, Homo sapien
gatgttctgtcattctgatatgctc

SEQ ID NO: 382767 - DNA, 25 bp, Homo sapien
gtcattctgatatgctctagagtgt

SEQ ID NO: 382768 - DNA, 25 bp, Homo sapien
ctagagtgttatatgaccttgtccc

SEQ ID NO: 382769 - DNA, 25 bp, Homo sapien
ccatatgctgggtaaagtttctttc

SEQ ID NO: 382770 - DNA, 25 bp, Homo sapien
gaatttctcttcttcatgtcgatgg

SEQ ID NO: 382771 - DNA, 25 bp, Homo sapien
catgtcgatggagtgctggcatttt

SEQ ID NO: 382772 - DNA, 25 bp, Homo sapien
ctggcatttttgtagcagttgtaaa

SEQ ID NO: 382773 - DNA, 25 bp, Homo sapien
aaatcagtacgagggctgcggccgc

SEQ ID NO: 382774 - DNA, 25 bp, Homo sapien
gctgcaacagaagcggagccattct

SEQ ID NO: 382775 - DNA, 25 bp, Homo sapien
aagcggagccattctccatgccgtg

SEQ ID NO: 382776 - DNA, 25 bp, Homo sapien
atccatcatcacaggcaaccgtttt

SEQ ID NO: 382777 - DNA, 25 bp, Homo sapien
tcacaggcaaccgtttttcttcatt

SEQ ID NO: 382778 - DNA, 25 bp, Homo sapien
gtatgaaggcacaacgacagaaagt

SEQ ID NO: 382779 - DNA, 25 bp, Homo sapien
aggtgagtcccatatgctgggtaaa

SEQ ID NO: 382780 - DNA, 25 bp, Homo sapien
gatgacagatgcaaataagcctgag

SEQ ID NO: 382781 - DNA, 25 bp, Homo sapien
tgacagatgcaaataagcctgagat

SEQ ID NO: 382782 - DNA, 25 bp, Homo sapien
attgctctgaactgaaatatacctg

SEQ ID NO: 382783 - DNA, 25 bp, Homo sapien
ttgctctgaactgaaatatacctgt

SEQ ID NO: 382784 - DNA, 25 bp, Homo sapien
gctctgaactgaaatatacctgtta

SEQ ID NO: 382785 - DNA, 25 bp, Homo sapien
tctgaactgaaatatacctgttagt

SEQ ID NO: 382786 - DNA, 25 bp, Homo sapien
actgaaatatacctgttagttctga

SEQ ID NO: 382787 - DNA, 25 bp, Homo sapien
gaaatatacctgttagttctgaggt

SEQ ID NO: 382788 - DNA, 25 bp, Homo sapien
aatatacctgttagttctgaggtta

SEQ ID NO: 382789 - DNA, 25 bp, Homo sapien
aattacaactttcaagtcatgtata

SEQ ID NO: 382790 - DNA, 25 bp, Homo sapien
aagtcatgtataatcagaggtatca

SEQ ID NO: 382791 - DNA, 25 bp, Homo sapien
taccttggaagctttagctaccaat

SEQ ID NO: 382792 - DNA, 25 bp, Homo sapien
aagctttagctaccaatccagtacc

SEQ ID NO: 382793 - DNA, 25 bp, Homo sapien
tccagtaccctcctaactagaatgt

SEQ ID NO: 382794 - DNA, 25 bp, Homo sapien
agaatgtatacacatcagcaggact

SEQ ID NO: 382795 - DNA, 25 bp, Homo sapien
gcaggactgactgactacttcatta

SEQ ID NO: 382796 - DNA, 25 bp, Homo sapien
gactgactgactacttcattagaga

SEQ ID NO: 382797 - DNA, 25 bp, Homo sapien
ttagagatatactgtactcattggg

SEQ ID NO: 382798 - DNA, 25 bp, Homo sapien
gggtactgctgttcttatgtgggat

SEQ ID NO: 382799 - DNA, 25 bp, Homo sapien
actgctgttcttatgtgggatttta

SEQ ID NO: 382800 - DNA, 25 bp, Homo sapien
gttgtaatgtattgcatcttaatgt

SEQ ID NO: 382801 - DNA, 25 bp, Homo sapien
gttgtactatattggttggcatttt

SEQ ID NO: 382802 - DNA, 25 bp, Homo sapien
gcgacctgatcttgaagtggcctgg

SEQ ID NO: 382803 - DNA, 25 bp, Homo sapien
tgatcttgaagtggcctggccctga

SEQ ID NO: 382804 - DNA, 25 bp, Homo sapien
tgaacagcgccctggctgaggagat

SEQ ID NO: 382805 - DNA, 25 bp, Homo sapien
cctggctgaggagatcacgctgcac

SEQ ID NO: 382806 - DNA, 25 bp, Homo sapien
agatcacgctgcactatgcccggct

SEQ ID NO: 382807 - DNA, 25 bp, Homo sapien
tcacgctgcactatgcccggctggg

SEQ ID NO: 382808 - DNA, 25 bp, Homo sapien
gagctcatcaaggacaccgaagacc

SEQ ID NO: 382809 - DNA, 25 bp, Homo sapien
ctcatcaaggacaccgaagaccctg

SEQ ID NO: 382810 - DNA, 25 bp, Homo sapien
agccccaaggaatcgcctccagaaa

SEQ ID NO: 382811 - DNA, 25 bp, Homo sapien
gggcccgttctgtggtagccacgat

SEQ ID NO: 382812 - DNA, 25 bp, Homo sapien
ccgttctgtggtagccacgatggga

SEQ ID NO: 382813 - DNA, 25 bp, Homo sapien
gaggaaaatagtgtccgtctcatta

SEQ ID NO: 382814 - DNA, 25 bp, Homo sapien
aaaatagtgtccgtctcattaaggg

SEQ ID NO: 382815 - DNA, 25 bp, Homo sapien
agtgtccgtctcattaagggaatta

SEQ ID NO: 382816 - DNA, 25 bp, Homo sapien
ttagccaaatagtcccctggcatag

SEQ ID NO: 382817 - DNA, 25 bp, Homo sapien
gggagtggaataaggctacaacaac

SEQ ID NO: 382818 - DNA, 25 bp, Homo sapien
aaggctacaacaacgaatataggga

SEQ ID NO: 382819 - DNA, 25 bp, Homo sapien
gacagatttgagagacgaggtagaa

SEQ ID NO: 382820 - DNA, 25 bp, Homo sapien
aattaataggactcgatggctggtg

SEQ ID NO: 382821 - DNA, 25 bp, Homo sapien
gagtagaggttagctcccaggtttc

SEQ ID NO: 382822 - DNA, 25 bp, Homo sapien
tagaggttagctcccaggtttctcc

SEQ ID NO: 382823 - DNA, 25 bp, Homo sapien
cccaggtttctccttgaccatagga

SEQ ID NO: 382824 - DNA, 25 bp, Homo sapien
agccagatgcggtggtgcatatctg

SEQ ID NO: 382825 - DNA, 25 bp, Homo sapien
agaggttgagtcttattttcatttg

SEQ ID NO: 382826 - DNA, 25 bp, Homo sapien
gaggttgagtcttattttcatttgt

SEQ ID NO: 382827 - DNA, 25 bp, Homo sapien
ttctctcactgcctagcatagtgcc

SEQ ID NO: 382828 - DNA, 25 bp, Homo sapien
tctcactgcctagcatagtgccttt

SEQ ID NO: 382829 - DNA, 25 bp, Homo sapien
tcactgcctagcatagtgcctttca

SEQ ID NO: 382830 - DNA, 25 bp, Homo sapien
gcctagcatagtgcctttcactcag

SEQ ID NO: 382831 - DNA, 25 bp, Homo sapien
ctagcatagtgcctttcactcagtt

SEQ ID NO: 382832 - DNA, 25 bp, Homo sapien
tagcatagtgcctttcactcagttg

SEQ ID NO: 382833 - DNA, 25 bp, Homo sapien
ctttcactcagttggaatatataat

SEQ ID NO: 382834 - DNA, 25 bp, Homo sapien
cactcagttggaatatataataaat

SEQ ID NO: 382835 - DNA, 25 bp, Homo sapien
gatcctgcgggagttatgtacacat

SEQ ID NO: 382836 - DNA, 25 bp, Homo sapien
atgtacacattcgagccaaccaagg

SEQ ID NO: 382837 - DNA, 25 bp, Homo sapien
ttcgagccaaccaaggagccaaagt

SEQ ID NO: 382838 - DNA, 25 bp, Homo sapien
ggagccaaagtaacattccagcttc

SEQ ID NO: 382839 - DNA, 25 bp, Homo sapien
ggtgaaactgaatcgttgccctttt

SEQ ID NO: 382840 - DNA, 25 bp, Homo sapien
aatcgttgcccttttctgatcaaaa

SEQ ID NO: 382841 - DNA, 25 bp, Homo sapien
gaaagtgtgctttgccatctttatt

SEQ ID NO: 382842 - DNA, 25 bp, Homo sapien
taaaaccttcttcttcccattgaca

SEQ ID NO: 382843 - DNA, 25 bp, Homo sapien
ttgacacaccggcagacattcacat

SEQ ID NO: 382844 - DNA, 25 bp, Homo sapien
ggctgcacagactcttcagatctgt

SEQ ID NO: 382845 - DNA, 25 bp, Homo sapien
gactcttcagatctgttagcttgaa

SEQ ID NO: 382846 - DNA, 25 bp, Homo sapien
gttatcctggaaatcggtaacagca

SEQ ID NO: 382847 - DNA, 25 bp, Homo sapien
agtagtgagtggcatgtcttaacca

SEQ ID NO: 382848 - DNA, 25 bp, Homo sapien
ggcatgtcttaaccacagagtgcag

SEQ ID NO: 382849 - DNA, 25 bp, Homo sapien
gtcttaaccacagagtgcagtgatt

SEQ ID NO: 382850 - DNA, 25 bp, Homo sapien
gtgcagtgattataaaattccattt

SEQ ID NO: 382851 - DNA, 25 bp, Homo sapien
gtttttctcaaattgcataagcagt

SEQ ID NO: 382852 - DNA, 25 bp, Homo sapien
gaaccacaggaggagtagtcagaag

SEQ ID NO: 382853 - DNA, 25 bp, Homo sapien
caggcccccttcatctaaaaggtgt

SEQ ID NO: 382854 - DNA, 25 bp, Homo sapien
gtgttgaaagccttggactatgtga

SEQ ID NO: 382855 - DNA, 25 bp, Homo sapien
aaagccttggactatgtgaattaac

SEQ ID NO: 382856 - DNA, 25 bp, Homo sapien
gaattaacttagactgcttattggt

SEQ ID NO: 382857 - DNA, 25 bp, Homo sapien
gaaagatctctctgtgttggtagaa

SEQ ID NO: 382858 - DNA, 25 bp, Homo sapien
gatctctctgtgttggtagaattgt

SEQ ID NO: 382859 - DNA, 25 bp, Homo sapien
ttctatttgggatttctgggtttca

SEQ ID NO: 382860 - DNA, 25 bp, Homo sapien
ttttgtgtttatctacacttttcaa

SEQ ID NO: 382861 - DNA, 25 bp, Homo sapien
gggatttctgggtttcaacaacttg

SEQ ID NO: 382862 - DNA, 25 bp, Homo sapien
attccttatctgacacccttatggc

SEQ ID NO: 382863 - DNA, 25 bp, Homo sapien
tatctgacacccttatggctggaga

SEQ ID NO: 382864 - DNA, 25 bp, Homo sapien
acccttatggctggagatgtttcaa

SEQ ID NO: 382865 - DNA, 25 bp, Homo sapien
gatgtttcaaaattatggctagagt

SEQ ID NO: 382866 - DNA, 25 bp, Homo sapien
ttctgggtttcaacaacttgtataa

SEQ ID NO: 382867 - DNA, 25 bp, Homo sapien
caactgtcacaatatatggattttt

SEQ ID NO: 382868 - DNA, 25 bp, Homo sapien
gaatcgccgtgctcaggaggactcg

SEQ ID NO: 382869 - DNA, 25 bp, Homo sapien
aggaggactcgggagcaagcccggg

SEQ ID NO: 382870 - DNA, 25 bp, Homo sapien
acggacgacccaaacacaagactgt

SEQ ID NO: 382871 - DNA, 25 bp, Homo sapien
ggtcccaaatatgagccgcgagaaa

SEQ ID NO: 382872 - DNA, 25 bp, Homo sapien
acacaagactgtgtgccccttagag

SEQ ID NO: 382873 - DNA, 25 bp, Homo sapien
gactgtgtgccccttagagagccaa

SEQ ID NO: 382874 - DNA, 25 bp, Homo sapien
ctgtgtgccccttagagagccaaag

SEQ ID NO: 382875 - DNA, 25 bp, Homo sapien
cttagagagccaaagggatccctgt

SEQ ID NO: 382876 - DNA, 25 bp, Homo sapien
tagagagccaaagggatccctgtgc

SEQ ID NO: 382877 - DNA, 25 bp, Homo sapien
tatgagccgcgagaaatgcagcccc

SEQ ID NO: 382878 - DNA, 25 bp, Homo sapien
tgagccgcgagaaatgcagccccgg

SEQ ID NO: 382879 - DNA, 25 bp, Homo sapien
ggctggcttccttgtgaagtccctg

SEQ ID NO: 382880 - DNA, 25 bp, Homo sapien
aagtccctgtgcatagatggcaccc

SEQ ID NO: 382881 - DNA, 25 bp, Homo sapien
ctggctggaagtgagccactcttac

SEQ ID NO: 382882 - DNA, 25 bp, Homo sapien
agccactcttactccaggtgccagt

SEQ ID NO: 382883 - DNA, 25 bp, Homo sapien
tgaggctgaatttgcacttggaaat

SEQ ID NO: 382884 - DNA, 25 bp, Homo sapien
gcagcatgaagtcttggcccagctt

SEQ ID NO: 382885 - DNA, 25 bp, Homo sapien
acctgggacttgtggctcatgataa

SEQ ID NO: 382886 - DNA, 25 bp, Homo sapien
tgtggctggaggtctcgccacccat

SEQ ID NO: 382887 - DNA, 25 bp, Homo sapien
catttttagggtgtggctgctctcc

SEQ ID NO: 382888 - DNA, 25 bp, Homo sapien
gctgctctcctgtgtgaattttggt

SEQ ID NO: 382889 - DNA, 25 bp, Homo sapien
tggtggatcagcaagttggatgtca

SEQ ID NO: 382890 - DNA, 25 bp, Homo sapien
ggaagggccagccttcaccatcgcg

SEQ ID NO: 382891 - DNA, 25 bp, Homo sapien
cttcaccatcgcgtgggattgggag

SEQ ID NO: 382892 - DNA, 25 bp, Homo sapien
acaacccagacacttgcgttcacaa

SEQ ID NO: 382893 - DNA, 25 bp, Homo sapien
gacacttgcgttcacaagcaaccta

SEQ ID NO: 382894 - DNA, 25 bp, Homo sapien
tgccagacgcgctagattcctctaa

SEQ ID NO: 382895 - DNA, 25 bp, Homo sapien
agacgcgctagattcctctaaggtc

SEQ ID NO: 382896 - DNA, 25 bp, Homo sapien
gattcctctaaggtctctgagatgc

SEQ ID NO: 382897 - DNA, 25 bp, Homo sapien
gtctctgagatgcaccgttttttaa

SEQ ID NO: 382898 - DNA, 25 bp, Homo sapien
gggtgaactgattttgatcttcttg

SEQ ID NO: 382899 - DNA, 25 bp, Homo sapien
actgattttgatcttcttgtctaga

SEQ ID NO: 382900 - DNA, 25 bp, Homo sapien
gatcttcttgtctagatgcaataaa

SEQ ID NO: 382901 - DNA, 25 bp, Homo sapien
gagctggccttgaaccggtcgactc

SEQ ID NO: 382902 - DNA, 25 bp, Homo sapien
ttgaaccggtcgactctgaaggcac

SEQ ID NO: 382903 - DNA, 25 bp, Homo sapien
ggtcgactctgaaggcaccaggaac

SEQ ID NO: 382904 - DNA, 25 bp, Homo sapien
atttggaaacacagacccgtcaagg

SEQ ID NO: 382905 - DNA, 25 bp, Homo sapien
aacacagacccgtcaagggaaggcg

SEQ ID NO: 382906 - DNA, 25 bp, Homo sapien
caggctttgatttggatccaggcga

SEQ ID NO: 382907 - DNA, 25 bp, Homo sapien
gatttggatccaggcgaacattact

SEQ ID NO: 382908 - DNA, 25 bp, Homo sapien
ggatccaggcgaacattactgtcag

SEQ ID NO: 382909 - DNA, 25 bp, Homo sapien
aggcgaacattactgtcagctccca

SEQ ID NO: 382910 - DNA, 25 bp, Homo sapien
ccaccctgtcctcaaggctggtgga

SEQ ID NO: 382911 - DNA, 25 bp, Homo sapien
gtgaggtccccgtcagctgcactgt

SEQ ID NO: 382912 - DNA, 25 bp, Homo sapien
ttttatttgcctctactacgtcagg

SEQ ID NO: 382913 - DNA, 25 bp, Homo sapien
tactacgtcaggcagaattcttcaa

SEQ ID NO: 382914 - DNA, 25 bp, Homo sapien
acatttgttgatcccttttctcatc

SEQ ID NO: 382915 - DNA, 25 bp, Homo sapien
ttttctcatcttacccctttatgcc

SEQ ID NO: 382916 - DNA, 25 bp, Homo sapien
cccctttatgccacctactgaaaag

SEQ ID NO: 382917 - DNA, 25 bp, Homo sapien
tttcctgttttttgtctatgtccca

SEQ ID NO: 382918 - DNA, 25 bp, Homo sapien
gtcccagctgacattcagtcaaatg

SEQ ID NO: 382919 - DNA, 25 bp, Homo sapien
gggatacttctaatttggtggtgtt

SEQ ID NO: 382920 - DNA, 25 bp, Homo sapien
gtggtgtttctttgtacatttttca

SEQ ID NO: 382921 - DNA, 25 bp, Homo sapien
gcaactgtttagtcatgtgttttca

SEQ ID NO: 382922 - DNA, 25 bp, Homo sapien
taagccttgatccttttattctgaa

SEQ ID NO: 382923 - DNA, 25 bp, Homo sapien
tatttacaggaataagagcagccct

SEQ ID NO: 382924 - DNA, 25 bp, Homo sapien
aatgggaaggagaacctcatggcca

SEQ ID NO: 382925 - DNA, 25 bp, Homo sapien
ggagaacctcatggccaggtttgtg

SEQ ID NO: 382926 - DNA, 25 bp, Homo sapien
atggccaggtttgtgcccttagtga

SEQ ID NO: 382927 - DNA, 25 bp, Homo sapien
caggtttgtgcccttagtgaggtcc

SEQ ID NO: 382928 - DNA, 25 bp, Homo sapien
ttgtgcccttagtgaggtccccaag

SEQ ID NO: 382929 - DNA, 25 bp, Homo sapien
ctggaaggaccactgtcttcttata

SEQ ID NO: 382930 - DNA, 25 bp, Homo sapien
aaggaccactgtcttcttatagccc

SEQ ID NO: 382931 - DNA, 25 bp, Homo sapien
actgtcttcttatagcccttcagac

SEQ ID NO: 382932 - DNA, 25 bp, Homo sapien
aagagcagccctaagagctctggga

SEQ ID NO: 382933 - DNA, 25 bp, Homo sapien
agccctaagagctctgggaccggga

SEQ ID NO: 382934 - DNA, 25 bp, Homo sapien
ttaacatctttgaatccgggatttg

SEQ ID NO: 382935 - DNA, 25 bp, Homo sapien
tccgggatttgccttatagttgatg

SEQ ID NO: 382936 - DNA, 25 bp, Homo sapien
gaagataaaagtcaccagggaccat

SEQ ID NO: 382937 - DNA, 25 bp, Homo sapien
gggaccatatgtatatacgctcatc

SEQ ID NO: 382938 - DNA, 25 bp, Homo sapien
gctcatcattatcataccgacctgg

SEQ ID NO: 382939 - DNA, 25 bp, Homo sapien
ccgacctggtgaagcatgttgagaa

SEQ ID NO: 382940 - DNA, 25 bp, Homo sapien
tatgcattttactagaggcttctgt

SEQ ID NO: 382941 - DNA, 25 bp, Homo sapien
gtaagtatccagtgagcgaatctct

SEQ ID NO: 382942 - DNA, 25 bp, Homo sapien
gtgagcgaatctcttcacttagaag

SEQ ID NO: 382943 - DNA, 25 bp, Homo sapien
gaagatgaccttattccatgaattc

SEQ ID NO: 382944 - DNA, 25 bp, Homo sapien
taaagcacacgtttcttcacatttt

SEQ ID NO: 382945 - DNA, 25 bp, Homo sapien
gaatgagtccacgttaccctaagga

SEQ ID NO: 382946 - DNA, 25 bp, Homo sapien
tcagactaccctgctctatttgaat

SEQ ID NO: 382947 - DNA, 25 bp, Homo sapien
gactaccctgctctatttgaataat

SEQ ID NO: 382948 - DNA, 25 bp, Homo sapien
aaagggtgtatattcgtgtaatgac

SEQ ID NO: 382949 - DNA, 25 bp, Homo sapien
gtatattcgtgtaatgacatccaga

SEQ ID NO: 382950 - DNA, 25 bp, Homo sapien
tcgtgtaatgacatccagatctcac

SEQ ID NO: 382951 - DNA, 25 bp, Homo sapien
accctgctctatttgaataatgagg

SEQ ID NO: 382952 - DNA, 25 bp, Homo sapien
aataatgaggcttgtggtggtctgt

SEQ ID NO: 382953 - DNA, 25 bp, Homo sapien
tggacagagtagaatttgggcagct

SEQ ID NO: 382954 - DNA, 25 bp, Homo sapien
agagtagaatttgggcagctgctga

SEQ ID NO: 382955 - DNA, 25 bp, Homo sapien
gggcagctgctgaaggtttggtctc

SEQ ID NO: 382956 - DNA, 25 bp, Homo sapien
ggctaaaaatgtcaggcagcttcat

SEQ ID NO: 382957 - DNA, 25 bp, Homo sapien
gctaaaaatgtcaggcagcttcatt

SEQ ID NO: 382958 - DNA, 25 bp, Homo sapien
aaaaatgtcaggcagcttcattggg

SEQ ID NO: 382959 - DNA, 25 bp, Homo sapien
aaatgtcaggcagcttcattgggaa

SEQ ID NO: 382960 - DNA, 25 bp, Homo sapien
aatgtcaggcagcttcattgggaat

SEQ ID NO: 382961 - DNA, 25 bp, Homo sapien
atgtcaggcagcttcattgggaata

SEQ ID NO: 382962 - DNA, 25 bp, Homo sapien
tgtcaggcagcttcattgggaataa

SEQ ID NO: 382963 - DNA, 25 bp, Homo sapien
gtcaggcagcttcattgggaataat

SEQ ID NO: 382964 - DNA, 25 bp, Homo sapien
caggcagcttcattgggaataatgc

SEQ ID NO: 382965 - DNA, 25 bp, Homo sapien
ggcagcttcattgggaataatgcgg

SEQ ID NO: 382966 - DNA, 25 bp, Homo sapien
gaataatgcggccatccaggaactc

SEQ ID NO: 382967 - DNA, 25 bp, Homo sapien
tcaaggtacaaacctcactttttat

SEQ ID NO: 382968 - DNA, 25 bp, Homo sapien
tacaaacctcactttttatgtttat

SEQ ID NO: 382969 - DNA, 25 bp, Homo sapien
aactgaatgtgtttgttagttccag

SEQ ID NO: 382970 - DNA, 25 bp, Homo sapien
ttgttagttccagttgcattttggc

SEQ ID NO: 382971 - DNA, 25 bp, Homo sapien
gttagttccagttgcattttggctg

SEQ ID NO: 382972 - DNA, 25 bp, Homo sapien
gttccagttgcattttggctgactc

SEQ ID NO: 382973 - DNA, 25 bp, Homo sapien
ttccagttgcattttggctgactct

SEQ ID NO: 382974 - DNA, 25 bp, Homo sapien
tccagttgcattttggctgactctt

SEQ ID NO: 382975 - DNA, 25 bp, Homo sapien
cagttgcattttggctgactctttg

SEQ ID NO: 382976 - DNA, 25 bp, Homo sapien
ttgcattttggctgactctttgtga

SEQ ID NO: 382977 - DNA, 25 bp, Homo sapien
tgcattttggctgactctttgtgat

SEQ ID NO: 382978 - DNA, 25 bp, Homo sapien
gaactttctggcgaggagactccct

SEQ ID NO: 382979 - DNA, 25 bp, Homo sapien
aggagactccctcttgaatcatcca

SEQ ID NO: 382980 - DNA, 25 bp, Homo sapien
tgaatcatccatatgtagccccggg

SEQ ID NO: 382981 - DNA, 25 bp, Homo sapien
gggtcacttgcgaagagtctctaac

SEQ ID NO: 382982 - DNA, 25 bp, Homo sapien
aagagtctctaacagcttctgcctc

SEQ ID NO: 382983 - DNA, 25 bp, Homo sapien
tcctaagctctgaccgctaggcttt

SEQ ID NO: 382984 - DNA, 25 bp, Homo sapien
agccgccggtcctgattcctgagat

SEQ ID NO: 382985 - DNA, 25 bp, Homo sapien
tagagagcagtctccagtgcagggt

SEQ ID NO: 382986 - DNA, 25 bp, Homo sapien
gtccccatcctatctgaaaacagtg

SEQ ID NO: 382987 - DNA, 25 bp, Homo sapien
gaaaacagtggagtcagtgacccca

SEQ ID NO: 382988 - DNA, 25 bp, Homo sapien
gaccccaggtggagggacttccagt

SEQ ID NO: 382989 - DNA, 25 bp, Homo sapien
gaggagcaggtccacagctacctct

SEQ ID NO: 382990 - DNA, 25 bp, Homo sapien
aggagtctgttctccatcactgaat

SEQ ID NO: 382991 - DNA, 25 bp, Homo sapien
tgttctccatcactgaatgccaatc

SEQ ID NO: 382992 - DNA, 25 bp, Homo sapien
ccatcactgaatgccaatctgcggg

SEQ ID NO: 382993 - DNA, 25 bp, Homo sapien
caaatgactttgcagtgttttgcta

SEQ ID NO: 382994 - DNA, 25 bp, Homo sapien
aaacaagcaaatatgctcagtattt

SEQ ID NO: 382995 - DNA, 25 bp, Homo sapien
tggaagagttaaaacttcagcttgt

SEQ ID NO: 382996 - DNA, 25 bp, Homo sapien
ttcagcttgttttgaccagagtctg

SEQ ID NO: 382997 - DNA, 25 bp, Homo sapien
ccagagtctgtacttaagtgagcct

SEQ ID NO: 382998 - DNA, 25 bp, Homo sapien
gtacttaagtgagcctgacacgtgg

SEQ ID NO: 382999 - DNA, 25 bp, Homo sapien
gacttgcagtcatagtcatcgggat

SEQ ID NO: 383000 - DNA, 25 bp, Homo sapien
aagttttaaaactctgccaaagcat

SEQ ID NO: 383001 - DNA, 25 bp, Homo sapien
aaactctgccaaagcattgctcagt

SEQ ID NO: 383002 - DNA, 25 bp, Homo sapien
aagcattgctcagtgtatctgggca

SEQ ID NO: 383003 - DNA, 25 bp, Homo sapien
attgctcagtgtatctgggcagccc

SEQ ID NO: 383004 - DNA, 25 bp, Homo sapien
gctcagtgtatctgggcagcccctt

SEQ ID NO: 383005 - DNA, 25 bp, Homo sapien
agcagtagcagaggcagcttctgag

SEQ ID NO: 383006 - DNA, 25 bp, Homo sapien
tggctgaccaagtccactggaagag

SEQ ID NO: 383007 - DNA, 25 bp, Homo sapien
ccactggaagagaaggcttgtgcca

SEQ ID NO: 383008 - DNA, 25 bp, Homo sapien
attttaatgtccctcttcagccgtg

SEQ ID NO: 383009 - DNA, 25 bp, Homo sapien
taatgtccctcttcagccgtgcctg

SEQ ID NO: 383010 - DNA, 25 bp, Homo sapien
gagctctcctgggatgataagtgaa

SEQ ID NO: 383011 - DNA, 25 bp, Homo sapien
gtagaaaccagctttacttgtaaat

SEQ ID NO: 383012 - DNA, 25 bp, Homo sapien
ttacttgtaaatcctgagcttgttg

SEQ ID NO: 383013 - DNA, 25 bp, Homo sapien
tccccgccaggtttcaggtaatatg

SEQ ID NO: 383014 - DNA, 25 bp, Homo sapien
aatatggatgcttttcgggactgcg

SEQ ID NO: 383015 - DNA, 25 bp, Homo sapien
atgcttttcgggactgcgtgggatt

SEQ ID NO: 383016 - DNA, 25 bp, Homo sapien
gatggtgagaagcaactgaacattt

SEQ ID NO: 383017 - DNA, 25 bp, Homo sapien
agttctctttttgagttgtgtcttg

SEQ ID NO: 383018 - DNA, 25 bp, Homo sapien
agttgtgtcttggaggagttgttta

SEQ ID NO: 383019 - DNA, 25 bp, Homo sapien
gttgtttaagagctcgccgggtcca

SEQ ID NO: 383020 - DNA, 25 bp, Homo sapien
tccattgccctcctataaaaacctg

SEQ ID NO: 383021 - DNA, 25 bp, Homo sapien
ctataaaaacctgggcatttgtgag

SEQ ID NO: 383022 - DNA, 25 bp, Homo sapien
caaggcgattgtcttctggaagcag

SEQ ID NO: 383023 - DNA, 25 bp, Homo sapien
agccacgccgtgtgaggttcctcat

SEQ ID NO: 383024 - DNA, 25 bp, Homo sapien
tgtgaggttcctcatcactgccctg

SEQ ID NO: 383025 - DNA, 25 bp, Homo sapien
gggataattgcaaaatcacgtttga

SEQ ID NO: 383026 - DNA, 25 bp, Homo sapien
ggagccgtgaattctccaactctta

SEQ ID NO: 383027 - DNA, 25 bp, Homo sapien
aactcttaactggtcctcgactgga

SEQ ID NO: 383028 - DNA, 25 bp, Homo sapien
tggtcctcgactggagccacttttc

SEQ ID NO: 383029 - DNA, 25 bp, Homo sapien
agaaacgcagatgccgatgcttaat

SEQ ID NO: 383030 - DNA, 25 bp, Homo sapien
gatgccgatgcttaatcaactccgt

SEQ ID NO: 383031 - DNA, 25 bp, Homo sapien
ggatagctgccctgatgccaaggcg

SEQ ID NO: 383032 - DNA, 25 bp, Homo sapien
gatgccaaggcgattgtcttctgga

SEQ ID NO: 383033 - DNA, 25 bp, Homo sapien
aatctatagaattgccatggaaacc

SEQ ID NO: 383034 - DNA, 25 bp, Homo sapien
catggaaaccctattggagaaacac

SEQ ID NO: 383035 - DNA, 25 bp, Homo sapien
gaaacacaggtttccatgtcaaccc

SEQ ID NO: 383036 - DNA, 25 bp, Homo sapien
cctgtccaggataccgctacaaaat

SEQ ID NO: 383037 - DNA, 25 bp, Homo sapien
ggataccgctacaaaatgccctata

SEQ ID NO: 383038 - DNA, 25 bp, Homo sapien
ggaaccccatccaagtagagtgatt

SEQ ID NO: 383039 - DNA, 25 bp, Homo sapien
aaccacaatgttttctgactaatgg

SEQ ID NO: 383040 - DNA, 25 bp, Homo sapien
aatggaattaggagactgcgacttt

SEQ ID NO: 383041 - DNA, 25 bp, Homo sapien
ggagactgcgacttttgtccattgt

SEQ ID NO: 383042 - DNA, 25 bp, Homo sapien
attgttcttaggcaaggcatttggg

SEQ ID NO: 383043 - DNA, 25 bp, Homo sapien
gattcacctttttaatctcaggtct

SEQ ID NO: 383044 - DNA, 25 bp, Homo sapien
aaagaggtaaatagggctgggcgcg

SEQ ID NO: 383045 - DNA, 25 bp, Homo sapien
aagaggtaaatagggctgggcgcgg

SEQ ID NO: 383046 - DNA, 25 bp, Homo sapien
agaggtaaatagggctgggcgcggt

SEQ ID NO: 383047 - DNA, 25 bp, Homo sapien
gaggtaaatagggctgggcgcggtg

SEQ ID NO: 383048 - DNA, 25 bp, Homo sapien
tgggaagccgaggtgaacagatcac

SEQ ID NO: 383049 - DNA, 25 bp, Homo sapien
gggaagccgaggtgaacagatcacc

SEQ ID NO: 383050 - DNA, 25 bp, Homo sapien
ggaagccgaggtgaacagatcacct

SEQ ID NO: 383051 - DNA, 25 bp, Homo sapien
gaagccgaggtgaacagatcacctg

SEQ ID NO: 383052 - DNA, 25 bp, Homo sapien
caggcatggtggtggacccctgtaa

SEQ ID NO: 383053 - DNA, 25 bp, Homo sapien
tgagggggaggattgcttaaaccca

SEQ ID NO: 383054 - DNA, 25 bp, Homo sapien
gagggggaggattgcttaaacccag

SEQ ID NO: 383055 - DNA, 25 bp, Homo sapien
atattcttactcaagtatatgtgaa

SEQ ID NO: 383056 - DNA, 25 bp, Homo sapien
ggattcggtatgatctgcgatttca

SEQ ID NO: 383057 - DNA, 25 bp, Homo sapien
gtaaatattcatcaatttggagtat

SEQ ID NO: 383058 - DNA, 25 bp, Homo sapien
gagaaaatactgaggcttcccttca

SEQ ID NO: 383059 - DNA, 25 bp, Homo sapien
atactgaggcttcccttcagctcta

SEQ ID NO: 383060 - DNA, 25 bp, Homo sapien
tctactttccagagttaacaccatt

SEQ ID NO: 383061 - DNA, 25 bp, Homo sapien
tgatctgcgatttcaggcatccact

SEQ ID NO: 383062 - DNA, 25 bp, Homo sapien
gcgatttcaggcatccactagggtc

SEQ ID NO: 383063 - DNA, 25 bp, Homo sapien
ggtactactgtacttcataagggca

SEQ ID NO: 383064 - DNA, 25 bp, Homo sapien
tactgtacttcataagggcaagggt

SEQ ID NO: 383065 - DNA, 25 bp, Homo sapien
agggcaagggtggttatgtattaat

SEQ ID NO: 383066 - DNA, 25 bp, Homo sapien
acagggagagttacaggcttcagac

SEQ ID NO: 383067 - DNA, 25 bp, Homo sapien
caggcttcagactttatctcgttgt

SEQ ID NO: 383068 - DNA, 25 bp, Homo sapien
gactttatctcgttgtggaaagcaa

SEQ ID NO: 383069 - DNA, 25 bp, Homo sapien
gcaagagaccaagccaaaaactttg

SEQ ID NO: 383070 - DNA, 25 bp, Homo sapien
aaactttggtcgtgcttttcaacat

SEQ ID NO: 383071 - DNA, 25 bp, Homo sapien
gtgcttttcaacatctccggtcaaa

SEQ ID NO: 383072 - DNA, 25 bp, Homo sapien
ttttcaacatctccggtcaaaagag

SEQ ID NO: 383073 - DNA, 25 bp, Homo sapien
ttttctcccattgctgcgtcttaga

SEQ ID NO: 383074 - DNA, 25 bp, Homo sapien
gggtgtggtgccatgataccacttt

SEQ ID NO: 383075 - DNA, 25 bp, Homo sapien
gataccacttttgaaaatcctgttg

SEQ ID NO: 383076 - DNA, 25 bp, Homo sapien
tctgctcccttcctgggttttgcgc

SEQ ID NO: 383077 - DNA, 25 bp, Homo sapien
ctcaggccaggcttagaatataaac

SEQ ID NO: 383078 - DNA, 25 bp, Homo sapien
tcaggccaggcttagaatataaact

SEQ ID NO: 383079 - DNA, 25 bp, Homo sapien
ggccaggcttagaatataaactgac

SEQ ID NO: 383080 - DNA, 25 bp, Homo sapien
ggcttagaatataaactgacacctt

SEQ ID NO: 383081 - DNA, 25 bp, Homo sapien
ttagaatataaactgacaccttgaa

SEQ ID NO: 383082 - DNA, 25 bp, Homo sapien
gaagtgaccatcttgtaatcaacac

SEQ ID NO: 383083 - DNA, 25 bp, Homo sapien
gtgaccatcttgtaatcaacacttt

SEQ ID NO: 383084 - DNA, 25 bp, Homo sapien
gaccatcttgtaatcaacactttat

SEQ ID NO: 383085 - DNA, 25 bp, Homo sapien
atcttgtaatcaacactttattcta

SEQ ID NO: 383086 - DNA, 25 bp, Homo sapien
gtaatcaacactttattctaaggat

SEQ ID NO: 383087 - DNA, 25 bp, Homo sapien
aacactttattctaaggataacaga

SEQ ID NO: 383088 - DNA, 25 bp, Homo sapien
agaagttggttcttgtctcgaatac

SEQ ID NO: 383089 - DNA, 25 bp, Homo sapien
gttcttgtctcgaatacttttcctc

SEQ ID NO: 383090 - DNA, 25 bp, Homo sapien
tgtctcgaatacttttcctcccgtg

SEQ ID NO: 383091 - DNA, 25 bp, Homo sapien
tcccactgtcgctgctggaggaaga

SEQ ID NO: 383092 - DNA, 25 bp, Homo sapien
ccttgaatcagaggcggctgtctcg

SEQ ID NO: 383093 - DNA, 25 bp, Homo sapien
gtgcggctagagcagggccagtaga

SEQ ID NO: 383094 - DNA, 25 bp, Homo sapien
ttttccatctgttgcagtttccgaa

SEQ ID NO: 383095 - DNA, 25 bp, Homo sapien
catctgttgcagtttccgaaccaaa

SEQ ID NO: 383096 - DNA, 25 bp, Homo sapien
gttgcagtttccgaaccaaacgcac

SEQ ID NO: 383097 - DNA, 25 bp, Homo sapien
gcgtgtcaatggcagccgcgcattc

SEQ ID NO: 383098 - DNA, 25 bp, Homo sapien
tggcagccgcgcattctggaagaag

SEQ ID NO: 383099 - DNA, 25 bp, Homo sapien
tctgagctcagatcagcaaggcaga

SEQ ID NO: 383100 - DNA, 25 bp, Homo sapien
gcagagaaactccagatggcaaatt

SEQ ID NO: 383101 - DNA, 25 bp, Homo sapien
gatggcaaattatcccaactcttct

SEQ ID NO: 383102 - DNA, 25 bp, Homo sapien
caactcttctaactcgtaaaagcat

SEQ ID NO: 383103 - DNA, 25 bp, Homo sapien
taaaatgccccagggctgaacgcac

SEQ ID NO: 383104 - DNA, 25 bp, Homo sapien
agggctgaacgcacgctgctttagc

SEQ ID NO: 383105 - DNA, 25 bp, Homo sapien
gaacgcacgctgctttagctccttg

SEQ ID NO: 383106 - DNA, 25 bp, Homo sapien
aatgatgcgcacgtagatttgtaga

SEQ ID NO: 383107 - DNA, 25 bp, Homo sapien
gatttgtagagcgtattcttgagaa

SEQ ID NO: 383108 - DNA, 25 bp, Homo sapien
ctggtctgggctgccggctaaaagt

SEQ ID NO: 383109 - DNA, 25 bp, Homo sapien
taaaagttgtcctccgcgcggtggg

SEQ ID NO: 383110 - DNA, 25 bp, Homo sapien
ctagaccagccttgtcaggagattt

SEQ ID NO: 383111 - DNA, 25 bp, Homo sapien
agtctgtctccatgtctggctgctt

SEQ ID NO: 383112 - DNA, 25 bp, Homo sapien
tggctgcttcccattacagattact

SEQ ID NO: 383113 - DNA, 25 bp, Homo sapien
gaagctcttgtgaacaatctccagg

SEQ ID NO: 383114 - DNA, 25 bp, Homo sapien
gagatcctgatcttttgccatgcca

SEQ ID NO: 383115 - DNA, 25 bp, Homo sapien
gccatgccattgataaattcttcta

SEQ ID NO: 383116 - DNA, 25 bp, Homo sapien
tctaaagtcaattccctttgtagga

SEQ ID NO: 383117 - DNA, 25 bp, Homo sapien
gatccagtagagagtagctccatta

SEQ ID NO: 383118 - DNA, 25 bp, Homo sapien
ttatatcgatcttatggaacaccaa

SEQ ID NO: 383119 - DNA, 25 bp, Homo sapien
gttgatgaattcttcaggactcaga

SEQ ID NO: 383120 - DNA, 25 bp, Homo sapien
ggactcagagtttgctggccattga

SEQ ID NO: 383121 - DNA, 25 bp, Homo sapien
caggcccaggaatgcctcaagattt

SEQ ID NO: 383122 - DNA, 25 bp, Homo sapien
atgtacttacctaagtcctgtcctt

SEQ ID NO: 383123 - DNA, 25 bp, Homo sapien
cctgtcctttggcaaattatgggct

SEQ ID NO: 383124 - DNA, 25 bp, Homo sapien
tatgggctatgagacacagcattct

SEQ ID NO: 383125 - DNA, 25 bp, Homo sapien
atgagacacagcattcttgcctttc

SEQ ID NO: 383126 - DNA, 25 bp, Homo sapien
gggtcaatttcagcgatcctacaca

SEQ ID NO: 383127 - DNA, 25 bp, Homo sapien
atttcagcgatcctacacattcctt

SEQ ID NO: 383128 - DNA, 25 bp, Homo sapien
gcacttatgctctttctatatggta

SEQ ID NO: 383129 - DNA, 25 bp, Homo sapien
tatggtatgtaagctctcggtctgg

SEQ ID NO: 383130 - DNA, 25 bp, Homo sapien
ggagtaacagtgcagagatctacct

SEQ ID NO: 383131 - DNA, 25 bp, Homo sapien
gatctacctgtcttgttgccacatg

SEQ ID NO: 383132 - DNA, 25 bp, Homo sapien
gcacataattagatagatccagata

SEQ ID NO: 383133 - DNA, 25 bp, Homo sapien
gatagatccagatataatcgctaac

SEQ ID NO: 383134 - DNA, 25 bp, Homo sapien
tataatcgctaacaatatttttaca

SEQ ID NO: 383135 - DNA, 25 bp, Homo sapien
ttacatatcatcttccagtattttt

SEQ ID NO: 383136 - DNA, 25 bp, Homo sapien
atcatcttccagtatttttcctaca

SEQ ID NO: 383137 - DNA, 25 bp, Homo sapien
atcttccagtatttttcctacatat

SEQ ID NO: 383138 - DNA, 25 bp, Homo sapien
aaaaaatagcatccgacagtgtcta

SEQ ID NO: 383139 - DNA, 25 bp, Homo sapien
atccgacagtgtctatttgtggcct

SEQ ID NO: 383140 - DNA, 25 bp, Homo sapien
gacagtgtctatttgtggcctgctt

SEQ ID NO: 383141 - DNA, 25 bp, Homo sapien
cagtgtctatttgtggcctgctttt

SEQ ID NO: 383142 - DNA, 25 bp, Homo sapien
tttccctatcaatatacacacttgg

SEQ ID NO: 383143 - DNA, 25 bp, Homo sapien
aaggctagcctaagatgacaaagtt

SEQ ID NO: 383144 - DNA, 25 bp, Homo sapien
gttggatagaaaactggttagcacc

SEQ ID NO: 383145 - DNA, 25 bp, Homo sapien
ggttagcaccaattcaacagagcaa

SEQ ID NO: 383146 - DNA, 25 bp, Homo sapien
gctaagatccatttaagtcgataat

SEQ ID NO: 383147 - DNA, 25 bp, Homo sapien
agagcaaaacaaaatcatgaccttt

SEQ ID NO: 383148 - DNA, 25 bp, Homo sapien
gcttctctattgagcaaacataatt

SEQ ID NO: 383149 - DNA, 25 bp, Homo sapien
tattttctgcaagttaacatctgac

SEQ ID NO: 383150 - DNA, 25 bp, Homo sapien
gactttgttgagacaaggccctaat

SEQ ID NO: 383151 - DNA, 25 bp, Homo sapien
agtcgataatgctaaaccgcgggat

SEQ ID NO: 383152 - DNA, 25 bp, Homo sapien
ccgcgggatagtaatgctggttaaa

SEQ ID NO: 383153 - DNA, 25 bp, Homo sapien
gagagaatgcagagaccaatgtatg

SEQ ID NO: 383154 - DNA, 25 bp, Homo sapien
attccctgcataccctaggctgctg

SEQ ID NO: 383155 - DNA, 25 bp, Homo sapien
cctatcctgtcccttgtttataaca

SEQ ID NO: 383156 - DNA, 25 bp, Homo sapien
aacattgagaggttttctagggcac

SEQ ID NO: 383157 - DNA, 25 bp, Homo sapien
agaggttttctagggcacatactga

SEQ ID NO: 383158 - DNA, 25 bp, Homo sapien
gaaaatggtgactacttttagagca

SEQ ID NO: 383159 - DNA, 25 bp, Homo sapien
acttttagagcaaggctgggcatca

SEQ ID NO: 383160 - DNA, 25 bp, Homo sapien
tgtccagctctacttgtgtgatgtt

SEQ ID NO: 383161 - DNA, 25 bp, Homo sapien
agcccctttttctgcctaggataag

SEQ ID NO: 383162 - DNA, 25 bp, Homo sapien
attaacttggatcttctaatggtcc

SEQ ID NO: 383163 - DNA, 25 bp, Homo sapien
aatggtccaaatcttttggtcacaa

SEQ ID NO: 383164 - DNA, 25 bp, Homo sapien
tggtcacaataaagagtctccaaat

SEQ ID NO: 383165 - DNA, 25 bp, Homo sapien
aaaacattgcggcaacaccatggct

SEQ ID NO: 383166 - DNA, 25 bp, Homo sapien
aacattgcggcaacaccatggctgg

SEQ ID NO: 383167 - DNA, 25 bp, Homo sapien
acattgcggcaacaccatggctggg

SEQ ID NO: 383168 - DNA, 25 bp, Homo sapien
attgcggcaacaccatggctgggta

SEQ ID NO: 383169 - DNA, 25 bp, Homo sapien
tgcggcaacaccatggctgggtagt

SEQ ID NO: 383170 - DNA, 25 bp, Homo sapien
gcggcaacaccatggctgggtagtt

SEQ ID NO: 383171 - DNA, 25 bp, Homo sapien
cggcaacaccatggctgggtagttc

SEQ ID NO: 383172 - DNA, 25 bp, Homo sapien
gcaacaccatggctgggtagttcga

SEQ ID NO: 383173 - DNA, 25 bp, Homo sapien
aacaccatggctgggtagttcgagg

SEQ ID NO: 383174 - DNA, 25 bp, Homo sapien
gcatatggtaaaacattgcggcaac

SEQ ID NO: 383175 - DNA, 25 bp, Homo sapien
tatggtaaaacattgcggcaacacc

SEQ ID NO: 383176 - DNA, 25 bp, Homo sapien
agtctggacagagtgagccggaatc

SEQ ID NO: 383177 - DNA, 25 bp, Homo sapien
attactcctcagacacttgggacat

SEQ ID NO: 383178 - DNA, 25 bp, Homo sapien
gatactgttaataccagaggactag

SEQ ID NO: 383179 - DNA, 25 bp, Homo sapien
ggactagaagatcccatgtggagat

SEQ ID NO: 383180 - DNA, 25 bp, Homo sapien
ggagatgtcaggtggcttagccatt

SEQ ID NO: 383181 - DNA, 25 bp, Homo sapien
agatctgaaatggtccagagcccag

SEQ ID NO: 383182 - DNA, 25 bp, Homo sapien
ggtccagagcccagatattcaacaa

SEQ ID NO: 383183 - DNA, 25 bp, Homo sapien
acttgggacattcatggtgacctat

SEQ ID NO: 383184 - DNA, 25 bp, Homo sapien
atggtgacctattggcacccaagga

SEQ ID NO: 383185 - DNA, 25 bp, Homo sapien
ggcacccaaggaagagaacctgatt

SEQ ID NO: 383186 - DNA, 25 bp, Homo sapien
agcgagttttctgaacaggtttata

SEQ ID NO: 383187 - DNA, 25 bp, Homo sapien
cccacctgggaacagtgatcctgag

SEQ ID NO: 383188 - DNA, 25 bp, Homo sapien
gaacagtgatcctgagcagctgaag

SEQ ID NO: 383189 - DNA, 25 bp, Homo sapien
gaactggtcagtgctattgaagaac

SEQ ID NO: 383190 - DNA, 25 bp, Homo sapien
agaagtacaatctgcagccaaaagc

SEQ ID NO: 383191 - DNA, 25 bp, Homo sapien
taaaatagtccagccttgggtatac

SEQ ID NO: 383192 - DNA, 25 bp, Homo sapien
ccagccttgggtatacttgcattta

SEQ ID NO: 383193 - DNA, 25 bp, Homo sapien
tgcatttacctacaattaagctggg

SEQ ID NO: 383194 - DNA, 25 bp, Homo sapien
taagctgggtttaacttgttaagca

SEQ ID NO: 383195 - DNA, 25 bp, Homo sapien
gtgttttacaaagacctacattcct

SEQ ID NO: 383196 - DNA, 25 bp, Homo sapien
gacctacattcctcattgtttcatg

SEQ ID NO: 383197 - DNA, 25 bp, Homo sapien
tgtttcatgtttgacctttaaggtg

SEQ ID NO: 383198 - DNA, 25 bp, Homo sapien
acatagcatgaaatccgtcactggt

SEQ ID NO: 383199 - DNA, 25 bp, Homo sapien
gaaatccgtcactggtgctttgcat

SEQ ID NO: 383200 - DNA, 25 bp, Homo sapien
tggtgctttgcatttgtcttggaaa

SEQ ID NO: 383201 - DNA, 25 bp, Homo sapien
gtcttggaaaggacatacgccccgc

SEQ ID NO: 383202 - DNA, 25 bp, Homo sapien
ctaactagggagactgtgaatattc

SEQ ID NO: 383203 - DNA, 25 bp, Homo sapien
ttggtttccgtcagtctcctgagaa

SEQ ID NO: 383204 - DNA, 25 bp, Homo sapien
gctggctcgcgcgttttccacggag

SEQ ID NO: 383205 - DNA, 25 bp, Homo sapien
aatttaggtctagcgtggttcacag

SEQ ID NO: 383206 - DNA, 25 bp, Homo sapien
gcgtggttcacagttctggtttttt

SEQ ID NO: 383207 - DNA, 25 bp, Homo sapien
tcacagttctggttttttaggagtt

SEQ ID NO: 383208 - DNA, 25 bp, Homo sapien
cttgaaagctcaatgtcggacacat

SEQ ID NO: 383209 - DNA, 25 bp, Homo sapien
tgcctttccgcttctacgaccaggg

SEQ ID NO: 383210 - DNA, 25 bp, Homo sapien
tttccgcttctacgaccaggggcgc

SEQ ID NO: 383211 - DNA, 25 bp, Homo sapien
agcagcgaccccacagtgcagcgct

SEQ ID NO: 383212 - DNA, 25 bp, Homo sapien
cacagtgcagcgctccgtgtttgca

SEQ ID NO: 383213 - DNA, 25 bp, Homo sapien
acagtgcagcgctccgtgtttgcat

SEQ ID NO: 383214 - DNA, 25 bp, Homo sapien
cagtgcagcgctccgtgtttgcatc

SEQ ID NO: 383215 - DNA, 25 bp, Homo sapien
gtgcagcgctccgtgtttgcatcgg

SEQ ID NO: 383216 - DNA, 25 bp, Homo sapien
tgcagcgctccgtgtttgcatcggt

SEQ ID NO: 383217 - DNA, 25 bp, Homo sapien
gcagcgctccgtgtttgcatcggtg

SEQ ID NO: 383218 - DNA, 25 bp, Homo sapien
tttgcatcggtggacaaggtgccag

SEQ ID NO: 383219 - DNA, 25 bp, Homo sapien
ttgcatcggtggacaaggtgccagg

SEQ ID NO: 383220 - DNA, 25 bp, Homo sapien
gcgaggcggattcccgccctgggcg

SEQ ID NO: 383221 - DNA, 25 bp, Homo sapien
agggtaacgtatacacttcccatcg

SEQ ID NO: 383222 - DNA, 25 bp, Homo sapien
tcccagtcttgtcttaaggcgccgt

SEQ ID NO: 383223 - DNA, 25 bp, Homo sapien
ccagtcttgtcttaaggcgccgtcg

SEQ ID NO: 383224 - DNA, 25 bp, Homo sapien
agtcttgtcttaaggcgccgtcgcc

SEQ ID NO: 383225 - DNA, 25 bp, Homo sapien
gggtaacgtatacacttcccatcgc

SEQ ID NO: 383226 - DNA, 25 bp, Homo sapien
ggtaacgtatacacttcccatcgcg

SEQ ID NO: 383227 - DNA, 25 bp, Homo sapien
taacgtatacacttcccatcgcgta

SEQ ID NO: 383228 - DNA, 25 bp, Homo sapien
tgcaccagcccctggaaaatgcgct

SEQ ID NO: 383229 - DNA, 25 bp, Homo sapien
ttaaagtccttaccgcgaggcggat

SEQ ID NO: 383230 - DNA, 25 bp, Homo sapien
gtccttaccgcgaggcggattcccg

SEQ ID NO: 383231 - DNA, 25 bp, Homo sapien
agaaagaagcccagtctcacagcaa

SEQ ID NO: 383232 - DNA, 25 bp, Homo sapien
gaagcccagtctcacagcaatgact

SEQ ID NO: 383233 - DNA, 25 bp, Homo sapien
acactatttaggacagatggactga

SEQ ID NO: 383234 - DNA, 25 bp, Homo sapien
gggcatttccggaggccagaccaaa

SEQ ID NO: 383235 - DNA, 25 bp, Homo sapien
tttccggaggccagaccaaaggtga

SEQ ID NO: 383236 - DNA, 25 bp, Homo sapien
agaccaaaggtgatctccaggagat

SEQ ID NO: 383237 - DNA, 25 bp, Homo sapien
gatctccaggagatttggatgttag

SEQ ID NO: 383238 - DNA, 25 bp, Homo sapien
gttagtgcaggatagctcagagcca

SEQ ID NO: 383239 - DNA, 25 bp, Homo sapien
gagccaagtggcagataagtctttg

SEQ ID NO: 383240 - DNA, 25 bp, Homo sapien
gcggcccaactccttagtaggacga

SEQ ID NO: 383241 - DNA, 25 bp, Homo sapien
tccttagtaggacgacgtgactcga

SEQ ID NO: 383242 - DNA, 25 bp, Homo sapien
gaactaggcctcaaaaacatacgta

SEQ ID NO: 383243 - DNA, 25 bp, Homo sapien
taggcctcaaaaacatacgtaacga

SEQ ID NO: 383244 - DNA, 25 bp, Homo sapien
atacgtaacgaaaaggcctagcgag

SEQ ID NO: 383245 - DNA, 25 bp, Homo sapien
gcctagcgaggcaaattctgattga

SEQ ID NO: 383246 - DNA, 25 bp, Homo sapien
gggttctatattgtgagtaaattaa

SEQ ID NO: 383247 - DNA, 25 bp, Homo sapien
ttgagttgtttgttgctaagaggta

SEQ ID NO: 383248 - DNA, 25 bp, Homo sapien
aatgtaagagagtactggttccttc

SEQ ID NO: 383249 - DNA, 25 bp, Homo sapien
gagagtactggttccttcagtagtg

SEQ ID NO: 383250 - DNA, 25 bp, Homo sapien
ggttccttcagtagtgagtatttct

SEQ ID NO: 383251 - DNA, 25 bp, Homo sapien
gagtatttctcatagtgcagcttta

SEQ ID NO: 383252 - DNA, 25 bp, Homo sapien
gtgcagctttatttatctccaggat

SEQ ID NO: 383253 - DNA, 25 bp, Homo sapien
aggcttcctgtgctcatcataaaga

SEQ ID NO: 383254 - DNA, 25 bp, Homo sapien
cagcatgctgaacctcctagagttg

SEQ ID NO: 383255 - DNA, 25 bp, Homo sapien
gaacctcctagagttggcctcagga

SEQ ID NO: 383256 - DNA, 25 bp, Homo sapien
ggacatgagggaaggccagttacat

SEQ ID NO: 383257 - DNA, 25 bp, Homo sapien
agttacatgccaagcgtggttcctg

SEQ ID NO: 383258 - DNA, 25 bp, Homo sapien
tagaaactcactcccaatctgcctt

SEQ ID NO: 383259 - DNA, 25 bp, Homo sapien
tagcaggcactcaatgttcatttct

SEQ ID NO: 383260 - DNA, 25 bp, Homo sapien
tgaaggtgatttttcttctgtgact

SEQ ID NO: 383261 - DNA, 25 bp, Homo sapien
cctggtatcatcttgcgttggtgga

SEQ ID NO: 383262 - DNA, 25 bp, Homo sapien
gaagaccacaacttatttaacccat

SEQ ID NO: 383263 - DNA, 25 bp, Homo sapien
tttaacccatgtaccctggacaagt

SEQ ID NO: 383264 - DNA, 25 bp, Homo sapien
tccccacgcaattgaaaatctgcat

SEQ ID NO: 383265 - DNA, 25 bp, Homo sapien
ctgcatataatttaactgctgatta

SEQ ID NO: 383266 - DNA, 25 bp, Homo sapien
aactgctgattaactactgttgact

SEQ ID NO: 383267 - DNA, 25 bp, Homo sapien
tgctgattaactactgttgactgga

SEQ ID NO: 383268 - DNA, 25 bp, Homo sapien
ataacataacagtcagtacgtattt

SEQ ID NO: 383269 - DNA, 25 bp, Homo sapien
cagtcagtacgtattttgtgtgtta

SEQ ID NO: 383270 - DNA, 25 bp, Homo sapien
aattgcatccaagaactgtagtaca

SEQ ID NO: 383271 - DNA, 25 bp, Homo sapien
aatatcaaatggtctgccattgaac

SEQ ID NO: 383272 - DNA, 25 bp, Homo sapien
aaatggtctgccattgaacaatgca

SEQ ID NO: 383273 - DNA, 25 bp, Homo sapien
gccattgaacaatgcagaggttagg

SEQ ID NO: 383274 - DNA, 25 bp, Homo sapien
aactccccacgcaattgaaaatctg

SEQ ID NO: 383275 - DNA, 25 bp, Homo sapien
aaagaaagaaattgatccctcataa

SEQ ID NO: 383276 - DNA, 25 bp, Homo sapien
gaaattgatccctcataataggctg

SEQ ID NO: 383277 - DNA, 25 bp, Homo sapien
attgatccctcataataggctgtat

SEQ ID NO: 383278 - DNA, 25 bp, Homo sapien
gatccctcataataggctgtatagc

SEQ ID NO: 383279 - DNA, 25 bp, Homo sapien
atggttgcacaacagacttctttga

SEQ ID NO: 383280 - DNA, 25 bp, Homo sapien
gttgcacaacagacttctttgaatt

SEQ ID NO: 383281 - DNA, 25 bp, Homo sapien
gaatttgcttgctaaacttttactg

SEQ ID NO: 383282 - DNA, 25 bp, Homo sapien
tttgcttgctaaacttttactggat

SEQ ID NO: 383283 - DNA, 25 bp, Homo sapien
gcttgctaaacttttactggataat

SEQ ID NO: 383284 - DNA, 25 bp, Homo sapien
aacttttactggataatactgggat

SEQ ID NO: 383285 - DNA, 25 bp, Homo sapien
tttactggataatactgggattaca

SEQ ID NO: 383286 - DNA, 25 bp, Homo sapien
ccagcaacagagagtcatctaagca

SEQ ID NO: 383287 - DNA, 25 bp, Homo sapien
gagtcatctaagcagagtgctgcaa

SEQ ID NO: 383288 - DNA, 25 bp, Homo sapien
agagcatggctctcggaagaggact

SEQ ID NO: 383289 - DNA, 25 bp, Homo sapien
gctctcggaagaggactattagtca

SEQ ID NO: 383290 - DNA, 25 bp, Homo sapien
actattagtcagtcttcttccttaa

SEQ ID NO: 383291 - DNA, 25 bp, Homo sapien
agtcagtcttcttccttaaagtcaa

SEQ ID NO: 383292 - DNA, 25 bp, Homo sapien
gtcttcttccttaaagtcaagcagt

SEQ ID NO: 383293 - DNA, 25 bp, Homo sapien
caagcagtaacagcaacaaggagac

SEQ ID NO: 383294 - DNA, 25 bp, Homo sapien
acaaggagacgagtggcagcagcaa

SEQ ID NO: 383295 - DNA, 25 bp, Homo sapien
gtggcagcagcaaaaacagttcctc

SEQ ID NO: 383296 - DNA, 25 bp, Homo sapien
aaacagttcctccacatcaaagcag

SEQ ID NO: 383297 - DNA, 25 bp, Homo sapien
ctagccagggctcaggtacctcact

SEQ ID NO: 383298 - DNA, 25 bp, Homo sapien
agggctcaggtacctcactctcctg

SEQ ID NO: 383299 - DNA, 25 bp, Homo sapien
tctcctgccttgtgcgtagctcctg

SEQ ID NO: 383300 - DNA, 25 bp, Homo sapien
cggtcagtccccagcagccttggca

SEQ ID NO: 383301 - DNA, 25 bp, Homo sapien
agccttggcacacagtgtctggagc

SEQ ID NO: 383302 - DNA, 25 bp, Homo sapien
gccttggcacacagtgtctggagcc

SEQ ID NO: 383303 - DNA, 25 bp, Homo sapien
tgctcctgctgcaaaagcagaaacc

SEQ ID NO: 383304 - DNA, 25 bp, Homo sapien
cataagttattgaaatgctgacccc

SEQ ID NO: 383305 - DNA, 25 bp, Homo sapien
agttattgaaatgctgacccccgtt

SEQ ID NO: 383306 - DNA, 25 bp, Homo sapien
ttgaaatgctgacccccgttcagga

SEQ ID NO: 383307 - DNA, 25 bp, Homo sapien
tgctgacccccgttcaggaaaccat

SEQ ID NO: 383308 - DNA, 25 bp, Homo sapien
tcaggtgatccgtccacttcatcct

SEQ ID NO: 383309 - DNA, 25 bp, Homo sapien
attatagttgtgagcttctgcgcct

SEQ ID NO: 383310 - DNA, 25 bp, Homo sapien
tatagttgtgagcttctgcgcctgg

SEQ ID NO: 383311 - DNA, 25 bp, Homo sapien
atagttgtgagcttctgcgcctggc

SEQ ID NO: 383312 - DNA, 25 bp, Homo sapien
agttgtgagcttctgcgcctggcct

SEQ ID NO: 383313 - DNA, 25 bp, Homo sapien
ggcctcctggccgatttcgagtatt

SEQ ID NO: 383314 - DNA, 25 bp, Homo sapien
ctcctggccgatttcgagtatttgt

SEQ ID NO: 383315 - DNA, 25 bp, Homo sapien
tggccgatttcgagtatttgtatgt

SEQ ID NO: 383316 - DNA, 25 bp, Homo sapien
gccgatttcgagtatttgtatgtga

SEQ ID NO: 383317 - DNA, 25 bp, Homo sapien
atttcgagtatttgtatgtgaagac

SEQ ID NO: 383318 - DNA, 25 bp, Homo sapien
agggaaagcgcaagactggagtcca

SEQ ID NO: 383319 - DNA, 25 bp, Homo sapien
gtgaaacgtctgttagcttgtatat

SEQ ID NO: 383320 - DNA, 25 bp, Homo sapien
ttagcttgtatatatgtcagaataa

SEQ ID NO: 383321 - DNA, 25 bp, Homo sapien
tttccaaatggatgagcgagctaaa

SEQ ID NO: 383322 - DNA, 25 bp, Homo sapien
tggatgagcgagctaaatgctgaat

SEQ ID NO: 383323 - DNA, 25 bp, Homo sapien
gagcgagctaaatgctgaatgttga

SEQ ID NO: 383324 - DNA, 25 bp, Homo sapien
gagctaaatgctgaatgttgaaaaa

SEQ ID NO: 383325 - DNA, 25 bp, Homo sapien
accccggcctgcatgacattgtgag

SEQ ID NO: 383326 - DNA, 25 bp, Homo sapien
cccggcctgcatgacattgtgagac

SEQ ID NO: 383327 - DNA, 25 bp, Homo sapien
ggcctgcatgacattgtgagacctt

SEQ ID NO: 383328 - DNA, 25 bp, Homo sapien
cctgcatgacattgtgagaccttgt

SEQ ID NO: 383329 - DNA, 25 bp, Homo sapien
gcatgacattgtgagaccttgtttc

SEQ ID NO: 383330 - DNA, 25 bp, Homo sapien
agcacctacacctttccactggata

SEQ ID NO: 383331 - DNA, 25 bp, Homo sapien
tacacctttccactggatactgttt

SEQ ID NO: 383332 - DNA, 25 bp, Homo sapien
ttttcaatcaagtcaattccctcta

SEQ ID NO: 383333 - DNA, 25 bp, Homo sapien
tcaatcaagtcaattccctctaaga

SEQ ID NO: 383334 - DNA, 25 bp, Homo sapien
gtcaattccctctaagacattggtg

SEQ ID NO: 383335 - DNA, 25 bp, Homo sapien
aattccctctaagacattggtgata

SEQ ID NO: 383336 - DNA, 25 bp, Homo sapien
ccctctaagacattggtgatatcat

SEQ ID NO: 383337 - DNA, 25 bp, Homo sapien
tggtgatatcataaattctcctttt

SEQ ID NO: 383338 - DNA, 25 bp, Homo sapien
gcctcacagccaaagtatcagcagc

SEQ ID NO: 383339 - DNA, 25 bp, Homo sapien
acagccaaagtatcagcagccgctt

SEQ ID NO: 383340 - DNA, 25 bp, Homo sapien
agccaaagtatcagcagccgctttg

SEQ ID NO: 383341 - DNA, 25 bp, Homo sapien
tttcaaaagatctccaaaatccaag

SEQ ID NO: 383342 - DNA, 25 bp, Homo sapien
atctccaaaatccaagccatggaaa

SEQ ID NO: 383343 - DNA, 25 bp, Homo sapien
ggaaaatccaatacctcatcttata

SEQ ID NO: 383344 - DNA, 25 bp, Homo sapien
atacctcatcttatacattgaatag

SEQ ID NO: 383345 - DNA, 25 bp, Homo sapien
tagaatttctcataggacgttcctt

SEQ ID NO: 383346 - DNA, 25 bp, Homo sapien
gctcaggccttaatgcttgctcacc

SEQ ID NO: 383347 - DNA, 25 bp, Homo sapien
ttggataagggcttgcaaccctgtg

SEQ ID NO: 383348 - DNA, 25 bp, Homo sapien
ggcttgcaaccctgtgaaacattta

SEQ ID NO: 383349 - DNA, 25 bp, Homo sapien
taatttggagtcttgatacagtgcc

SEQ ID NO: 383350 - DNA, 25 bp, Homo sapien
gagtcttgatacagtgccaactgca

SEQ ID NO: 383351 - DNA, 25 bp, Homo sapien
taatgcttgctcacctccggctgtg

SEQ ID NO: 383352 - DNA, 25 bp, Homo sapien
gcctcagactgggaatcccctgaag

SEQ ID NO: 383353 - DNA, 25 bp, Homo sapien
cctcagactgggaatcccctgaaga

SEQ ID NO: 383354 - DNA, 25 bp, Homo sapien
ctcagactgggaatcccctgaagat

SEQ ID NO: 383355 - DNA, 25 bp, Homo sapien
tcagactgggaatcccctgaagatg

SEQ ID NO: 383356 - DNA, 25 bp, Homo sapien
gaagatggggccgtgtctccctcaa

SEQ ID NO: 383357 - DNA, 25 bp, Homo sapien
atggggccgtgtctccctcaaagtg

SEQ ID NO: 383358 - DNA, 25 bp, Homo sapien
gccgtgtctccctcaaagtggggct

SEQ ID NO: 383359 - DNA, 25 bp, Homo sapien
caaagtggggctccctcaggacagc

SEQ ID NO: 383360 - DNA, 25 bp, Homo sapien
tgaagaaagggctgcttctccctca

SEQ ID NO: 383361 - DNA, 25 bp, Homo sapien
gaagaaagggctgcttctccctcag

SEQ ID NO: 383362 - DNA, 25 bp, Homo sapien
aagaaagggctgcttctccctcaga

SEQ ID NO: 383363 - DNA, 25 bp, Homo sapien
caaagtaaccatcgctcagggtggt

SEQ ID NO: 383364 - DNA, 25 bp, Homo sapien
ggcaaataatgtctccatagaatca

SEQ ID NO: 383365 - DNA, 25 bp, Homo sapien
tcactttccaatacaacggctcttt

SEQ ID NO: 383366 - DNA, 25 bp, Homo sapien
ctttccaatacaacggctcttttca

SEQ ID NO: 383367 - DNA, 25 bp, Homo sapien
agagccacctactatttctgcggga

SEQ ID NO: 383368 - DNA, 25 bp, Homo sapien
gccacctactatttctgcgggagag

SEQ ID NO: 383369 - DNA, 25 bp, Homo sapien
cacctactatttctgcgggagagct

SEQ ID NO: 383370 - DNA, 25 bp, Homo sapien
cctactatttctgcgggagagctgg

SEQ ID NO: 383371 - DNA, 25 bp, Homo sapien
gagagctgggccactggttaaacat

SEQ ID NO: 383372 - DNA, 25 bp, Homo sapien
agctgggccactggttaaacatttg

SEQ ID NO: 383373 - DNA, 25 bp, Homo sapien
gccactggttaaacatttggaacgt

SEQ ID NO: 383374 - DNA, 25 bp, Homo sapien
tctaccccagcctctggtgtcatgt

SEQ ID NO: 383375 - DNA, 25 bp, Homo sapien
cagtgggcctccagaagggagagtt

SEQ ID NO: 383376 - DNA, 25 bp, Homo sapien
ggaacacaatacaaaatcagagctc

SEQ ID NO: 383377 - DNA, 25 bp, Homo sapien
tacaaaatcagagctctggcccttg

SEQ ID NO: 383378 - DNA, 25 bp, Homo sapien
aaaatcagagctctggcccttgcgg

SEQ ID NO: 383379 - DNA, 25 bp, Homo sapien
agagctctggcccttgcggaaaaaa

SEQ ID NO: 383380 - DNA, 25 bp, Homo sapien
gagctctggcccttgcggaaaaaac

SEQ ID NO: 383381 - DNA, 25 bp, Homo sapien
gctctggcccttgcggaaaaaactt

SEQ ID NO: 383382 - DNA, 25 bp, Homo sapien
gaagggtgagacagacatttatcaa

SEQ ID NO: 383383 - DNA, 25 bp, Homo sapien
gagacagacatttatcaaaggatac

SEQ ID NO: 383384 - DNA, 25 bp, Homo sapien
tcaaaggatacacaactaaatgtcg

SEQ ID NO: 383385 - DNA, 25 bp, Homo sapien
gctaactgcagcctccacttcccaa

SEQ ID NO: 383386 - DNA, 25 bp, Homo sapien
ctaactgcagcctccacttcccaag

SEQ ID NO: 383387 - DNA, 25 bp, Homo sapien
taactgcagcctccacttcccaagt

SEQ ID NO: 383388 - DNA, 25 bp, Homo sapien
aactgcagcctccacttcccaagtt

SEQ ID NO: 383389 - DNA, 25 bp, Homo sapien
ccacgcctggcctatgtttaataat

SEQ ID NO: 383390 - DNA, 25 bp, Homo sapien
cacgcctggcctatgtttaataatg

SEQ ID NO: 383391 - DNA, 25 bp, Homo sapien
acgcctggcctatgtttaataatgt

SEQ ID NO: 383392 - DNA, 25 bp, Homo sapien
cgcctggcctatgtttaataatgtt

SEQ ID NO: 383393 - DNA, 25 bp, Homo sapien
aataatgttgaaataggatggaata

SEQ ID NO: 383394 - DNA, 25 bp, Homo sapien
ataggatggaatattttgttaaatt

SEQ ID NO: 383395 - DNA, 25 bp, Homo sapien
gatggaatattttgttaaattaaca

SEQ ID NO: 383396 - DNA, 25 bp, Homo sapien
tgtgtcatgctaatgctctgtccac

SEQ ID NO: 383397 - DNA, 25 bp, Homo sapien
gtacatttgttgtgcaatattgtgc

SEQ ID NO: 383398 - DNA, 25 bp, Homo sapien
gtcatgctaatgctctgtccacttt

SEQ ID NO: 383399 - DNA, 25 bp, Homo sapien
tgtaatattttcaagccctatatga

SEQ ID NO: 383400 - DNA, 25 bp, Homo sapien
atgctaatgctctgtccactttcct

SEQ ID NO: 383401 - DNA, 25 bp, Homo sapien
gaaaaagctgttatttgcatgactg

SEQ ID NO: 383402 - DNA, 25 bp, Homo sapien
gctgttatttgcatgactgtatcct

SEQ ID NO: 383403 - DNA, 25 bp, Homo sapien
gtaatacttttgtctggatactgaa

SEQ ID NO: 383404 - DNA, 25 bp, Homo sapien
aatacttttgtctggatactgaatc

SEQ ID NO: 383405 - DNA, 25 bp, Homo sapien
ttttgtctggatactgaatccaact

SEQ ID NO: 383406 - DNA, 25 bp, Homo sapien
ggatactgaatccaactaagtagaa

SEQ ID NO: 383407 - DNA, 25 bp, Homo sapien
aaaagtttcttgctttatgtgcaaa

SEQ ID NO: 383408 - DNA, 25 bp, Homo sapien
gagatccatctcaagtgctgccctc

SEQ ID NO: 383409 - DNA, 25 bp, Homo sapien
ctattgccatagaacatacagcttt

SEQ ID NO: 383410 - DNA, 25 bp, Homo sapien
gaaacactagctatcttttgtcagt

SEQ ID NO: 383411 - DNA, 25 bp, Homo sapien
tgtcagttttttgtgacccaccagc

SEQ ID NO: 383412 - DNA, 25 bp, Homo sapien
ttttgtgacccaccagcattctgaa

SEQ ID NO: 383413 - DNA, 25 bp, Homo sapien
accagcattctgaagtacaggatat

SEQ ID NO: 383414 - DNA, 25 bp, Homo sapien
gtacaggatatctgtcagtgccatt

SEQ ID NO: 383415 - DNA, 25 bp, Homo sapien
tctcctggaagtctacctcttgtag

SEQ ID NO: 383416 - DNA, 25 bp, Homo sapien
ctacctcttgtagtgcagtcacatt

SEQ ID NO: 383417 - DNA, 25 bp, Homo sapien
gtgcagtcacattttactgaaatgt

SEQ ID NO: 383418 - DNA, 25 bp, Homo sapien
aggtaggttcgctgcaactctgcgc

SEQ ID NO: 383419 - DNA, 25 bp, Homo sapien
caactctgcgcgctaggaacacagg

SEQ ID NO: 383420 - DNA, 25 bp, Homo sapien
gcgtttcagttctatcatctctgga

SEQ ID NO: 383421 - DNA, 25 bp, Homo sapien
atctctggaaatggacaccccaggg

SEQ ID NO: 383422 - DNA, 25 bp, Homo sapien
ggacaagtggactgactgcgtagtt

SEQ ID NO: 383423 - DNA, 25 bp, Homo sapien
gactgcgtagttgaatctggcaacc

SEQ ID NO: 383424 - DNA, 25 bp, Homo sapien
atctggcaaccgagaggccttggag

SEQ ID NO: 383425 - DNA, 25 bp, Homo sapien
aaatttggctctatttcttaagcag

SEQ ID NO: 383426 - DNA, 25 bp, Homo sapien
gagcctattttagtaatcagcatct

SEQ ID NO: 383427 - DNA, 25 bp, Homo sapien
aattatcttaacgtgaatcagcttg

SEQ ID NO: 383428 - DNA, 25 bp, Homo sapien
agctgcaccaggtaggttcgctgca

SEQ ID NO: 383429 - DNA, 25 bp, Homo sapien
cagttccctgaggtttaagatcaaa

SEQ ID NO: 383430 - DNA, 25 bp, Homo sapien
taaattactctgcttttcgactcat

SEQ ID NO: 383431 - DNA, 25 bp, Homo sapien
tttcgactcattcaggtagcattgt

SEQ ID NO: 383432 - DNA, 25 bp, Homo sapien
gtagcattgtacctgaacctgattg

SEQ ID NO: 383433 - DNA, 25 bp, Homo sapien
ctgaacctgattgctactttttcat

SEQ ID NO: 383434 - DNA, 25 bp, Homo sapien
cctcatccacagacatttggagaag

SEQ ID NO: 383435 - DNA, 25 bp, Homo sapien
atgggagggtgtctgttatcccttt

SEQ ID NO: 383436 - DNA, 25 bp, Homo sapien
gtctgttatccctttctctttgctt

SEQ ID NO: 383437 - DNA, 25 bp, Homo sapien
tctttgctttgtccccgttgttaga

SEQ ID NO: 383438 - DNA, 25 bp, Homo sapien
tttgtccccgttgttagactggcag

SEQ ID NO: 383439 - DNA, 25 bp, Homo sapien
agactggcagcgtcagttgctcggt

SEQ ID NO: 383440 - DNA, 25 bp, Homo sapien
gggagatgcttcctgctagagacct

SEQ ID NO: 383441 - DNA, 25 bp, Homo sapien
acctgggcgggctgtatgatgccca

SEQ ID NO: 383442 - DNA, 25 bp, Homo sapien
gtatgatgcccagcttccaaaagat

SEQ ID NO: 383443 - DNA, 25 bp, Homo sapien
gcccagcttccaaaagatgtcacag

SEQ ID NO: 383444 - DNA, 25 bp, Homo sapien
gatgtcacagcacaagtgtccaaat

SEQ ID NO: 383445 - DNA, 25 bp, Homo sapien
tttacttcttacattcagggagaga

SEQ ID NO: 383446 - DNA, 25 bp, Homo sapien
agggttttctgtgctaggattgctt

SEQ ID NO: 383447 - DNA, 25 bp, Homo sapien
ctgtgctaggattgcttgagaatga

SEQ ID NO: 383448 - DNA, 25 bp, Homo sapien
gatacatagtgggtacatggccaag

SEQ ID NO: 383449 - DNA, 25 bp, Homo sapien
gtacatggccaagtacacatgtgaa

SEQ ID NO: 383450 - DNA, 25 bp, Homo sapien
acatgtgaaatcctttttcccagaa

SEQ ID NO: 383451 - DNA, 25 bp, Homo sapien
gcgccgggccccattggttacgcgt

SEQ ID NO: 383452 - DNA, 25 bp, Homo sapien
ttggttacgcgtccgctcggtgcca

SEQ ID NO: 383453 - DNA, 25 bp, Homo sapien
ggcgcaggccacatggtcctcggat

SEQ ID NO: 383454 - DNA, 25 bp, Homo sapien
gcaggccacatggtcctcggattgc

SEQ ID NO: 383455 - DNA, 25 bp, Homo sapien
gccacatggtcctcggattgcccgg

SEQ ID NO: 383456 - DNA, 25 bp, Homo sapien
atggtcctcggattgcccggtcccg

SEQ ID NO: 383457 - DNA, 25 bp, Homo sapien
gggtccccgcaaggcgcgtctacac

SEQ ID NO: 383458 - DNA, 25 bp, Homo sapien
caggtccctgcgcccggagacagaa

SEQ ID NO: 383459 - DNA, 25 bp, Homo sapien
gagacagaagccacgcgggcgcgct

SEQ ID NO: 383460 - DNA, 25 bp, Homo sapien
tcctgggctctttgtcgagagccca

SEQ ID NO: 383461 - DNA, 25 bp, Homo sapien
tctttgtcgagagcccagcgtggcg

SEQ ID NO: 383462 - DNA, 25 bp, Homo sapien
acttctttaaagagcttctttggct

SEQ ID NO: 383463 - DNA, 25 bp, Homo sapien
taaagagcttctttggctctagaaa

SEQ ID NO: 383464 - DNA, 25 bp, Homo sapien
gagcttctttggctctagaaaaatt

SEQ ID NO: 383465 - DNA, 25 bp, Homo sapien
gcgtatctactaacaaacatgagac

SEQ ID NO: 383466 - DNA, 25 bp, Homo sapien
tactaacaaacatgagacctccctg

SEQ ID NO: 383467 - DNA, 25 bp, Homo sapien
tggtcagttggccaaatgtactaac

SEQ ID NO: 383468 - DNA, 25 bp, Homo sapien
agttggccaaatgtactaacgggca

SEQ ID NO: 383469 - DNA, 25 bp, Homo sapien
gaacagcaaattaccaagtgtctca

SEQ ID NO: 383470 - DNA, 25 bp, Homo sapien
agcaaattaccaagtgtctcagaaa

SEQ ID NO: 383471 - DNA, 25 bp, Homo sapien
aaattaccaagtgtctcagaaaatg

SEQ ID NO: 383472 - DNA, 25 bp, Homo sapien
gacaaaaccatattttgacaagttt

SEQ ID NO: 383473 - DNA, 25 bp, Homo sapien
tttgcgggacacacaaatgtctgat

SEQ ID NO: 383474 - DNA, 25 bp, Homo sapien
acaaatgtctgatggtggcccagga

SEQ ID NO: 383475 - DNA, 25 bp, Homo sapien
ccaggagggctgtcactcagaatca

SEQ ID NO: 383476 - DNA, 25 bp, Homo sapien
tgtcactcagaatcaggcgggtgca

SEQ ID NO: 383477 - DNA, 25 bp, Homo sapien
cagagtggcctgcaggacatgatga

SEQ ID NO: 383478 - DNA, 25 bp, Homo sapien
atgatgacccagcatgagacaggat

SEQ ID NO: 383479 - DNA, 25 bp, Homo sapien
gagacaggatgcatcacatctgggt

SEQ ID NO: 383480 - DNA, 25 bp, Homo sapien
gatgcatcacatctgggtgacgcct

SEQ ID NO: 383481 - DNA, 25 bp, Homo sapien
atcacatctgggtgacgcctctctc

SEQ ID NO: 383482 - DNA, 25 bp, Homo sapien
ggatcagcctggactaaatgcctct

SEQ ID NO: 383483 - DNA, 25 bp, Homo sapien
gcctggactaaatgcctctcctggg

SEQ ID NO: 383484 - DNA, 25 bp, Homo sapien
ctgctacagagatcaaggtaggaga

SEQ ID NO: 383485 - DNA, 25 bp, Homo sapien
tgctacagagatcaaggtaggagat

SEQ ID NO: 383486 - DNA, 25 bp, Homo sapien
gctacagagatcaaggtaggagata

SEQ ID NO: 383487 - DNA, 25 bp, Homo sapien
ctacagagatcaaggtaggagataa

SEQ ID NO: 383488 - DNA, 25 bp, Homo sapien
tacagagatcaaggtaggagataaa

SEQ ID NO: 383489 - DNA, 25 bp, Homo sapien
acagagatcaaggtaggagataaag

SEQ ID NO: 383490 - DNA, 25 bp, Homo sapien
cagagatcaaggtaggagataaaga

SEQ ID NO: 383491 - DNA, 25 bp, Homo sapien
ttcggcgatttgggctgggcgcggt

SEQ ID NO: 383492 - DNA, 25 bp, Homo sapien
ggcgatttgggctgggcgcggtgat

SEQ ID NO: 383493 - DNA, 25 bp, Homo sapien
gcgatttgggctgggcgcggtgatt

SEQ ID NO: 383494 - DNA, 25 bp, Homo sapien
atttgggctgggcgcggtgattcac

SEQ ID NO: 383495 - DNA, 25 bp, Homo sapien
gaaggctacagtgagacacgaatgt

SEQ ID NO: 383496 - DNA, 25 bp, Homo sapien
agtgagacacgaatgtgccactgca

SEQ ID NO: 383497 - DNA, 25 bp, Homo sapien
ttaagcctagaaatttgagacccac

SEQ ID NO: 383498 - DNA, 25 bp, Homo sapien
agcctagaaatttgagacccaccta

SEQ ID NO: 383499 - DNA, 25 bp, Homo sapien
gtgaaagtgtctcaataaaccaata

SEQ ID NO: 383500 - DNA, 25 bp, Homo sapien
ctagaaatttgagacccacctaggc

SEQ ID NO: 383501 - DNA, 25 bp, Homo sapien
aaatgctccaggaaaaaacagccac

SEQ ID NO: 383502 - DNA, 25 bp, Homo sapien
aaaacagccacattcacacatccag

SEQ ID NO: 383503 - DNA, 25 bp, Homo sapien
acacatccagaattgagcctcctgt

SEQ ID NO: 383504 - DNA, 25 bp, Homo sapien
acatccagaattgagcctcctgtat

SEQ ID NO: 383505 - DNA, 25 bp, Homo sapien
catccagaattgagcctcctgtatg

SEQ ID NO: 383506 - DNA, 25 bp, Homo sapien
tcttcgagtttaaaatagtcattgt

SEQ ID NO: 383507 - DNA, 25 bp, Homo sapien
ttttacattctaaagtgcatgtagg

SEQ ID NO: 383508 - DNA, 25 bp, Homo sapien
agtgcatgtaggttgatatttttta

SEQ ID NO: 383509 - DNA, 25 bp, Homo sapien
cattggagaatttaatctttcttta

SEQ ID NO: 383510 - DNA, 25 bp, Homo sapien
catttttctgctttctggcaaaagt

SEQ ID NO: 383511 - DNA, 25 bp, Homo sapien
tttctgctttctggcaaaagttggg

SEQ ID NO: 383512 - DNA, 25 bp, Homo sapien
aaacatgcttgtgaattgtgcagta

SEQ ID NO: 383513 - DNA, 25 bp, Homo sapien
gaattgtgcagtaaaaggtggtaat

SEQ ID NO: 383514 - DNA, 25 bp, Homo sapien
aggtggtaatgactactggaagcta

SEQ ID NO: 383515 - DNA, 25 bp, Homo sapien
ctactggaagctaagtcaaaggtga

SEQ ID NO: 383516 - DNA, 25 bp, Homo sapien
agtcaaaggtgatttcctacctgat

SEQ ID NO: 383517 - DNA, 25 bp, Homo sapien
tgtgaatgggcgaccaagaacagga

SEQ ID NO: 383518 - DNA, 25 bp, Homo sapien
aggactcaagacatctcagtgttct

SEQ ID NO: 383519 - DNA, 25 bp, Homo sapien
gtctctttcagcatcaccaggcagt

SEQ ID NO: 383520 - DNA, 25 bp, Homo sapien
ccacacgaccacagatacggcaaaa

SEQ ID NO: 383521 - DNA, 25 bp, Homo sapien
aacctgtggattatgaattcaaacc

SEQ ID NO: 383522 - DNA, 25 bp, Homo sapien
acccatagtggttgcttcaggaatc

SEQ ID NO: 383523 - DNA, 25 bp, Homo sapien
gaatcaactgttcaacccctttaca

SEQ ID NO: 383524 - DNA, 25 bp, Homo sapien
ggttttcactggtggtggcccatta

SEQ ID NO: 383525 - DNA, 25 bp, Homo sapien
ggtggcccattacaggcaaccagtt

SEQ ID NO: 383526 - DNA, 25 bp, Homo sapien
gcaaccagttctcctcagggcatgg

SEQ ID NO: 383527 - DNA, 25 bp, Homo sapien
tctcctcagggcatggtgcaagctg

SEQ ID NO: 383528 - DNA, 25 bp, Homo sapien
gttttgatctatagttgaatgacga

SEQ ID NO: 383529 - DNA, 25 bp, Homo sapien
tatagttgaatgacgaagcacagag

SEQ ID NO: 383530 - DNA, 25 bp, Homo sapien
cacagagccttccataggtatggag

SEQ ID NO: 383531 - DNA, 25 bp, Homo sapien
ccataggtatggagggctcatcatt

SEQ ID NO: 383532 - DNA, 25 bp, Homo sapien
tatggagggctcatcattgtacttt

SEQ ID NO: 383533 - DNA, 25 bp, Homo sapien
gaatttacttagatttagtgtacca

SEQ ID NO: 383534 - DNA, 25 bp, Homo sapien
tttagtgtaccaaagaactgaagtt

SEQ ID NO: 383535 - DNA, 25 bp, Homo sapien
tttttggatccgcatttggttgaac

SEQ ID NO: 383536 - DNA, 25 bp, Homo sapien
ttggatccgcatttggttgaacatt

SEQ ID NO: 383537 - DNA, 25 bp, Homo sapien
taatttagatagcaagaggaactga

SEQ ID NO: 383538 - DNA, 25 bp, Homo sapien
gaggaactgaataacccttgataca

SEQ ID NO: 383539 - DNA, 25 bp, Homo sapien
ttgcccggcgtgtagtccctgacaa

SEQ ID NO: 383540 - DNA, 25 bp, Homo sapien
tagtccctgacaagcgtgccctgta

SEQ ID NO: 383541 - DNA, 25 bp, Homo sapien
cctgacaagcgtgccctgtaggaga

SEQ ID NO: 383542 - DNA, 25 bp, Homo sapien
gacaagcgtgccctgtaggagaaaa

SEQ ID NO: 383543 - DNA, 25 bp, Homo sapien
acaagcgtgccctgtaggagaaaag

SEQ ID NO: 383544 - DNA, 25 bp, Homo sapien
gagaaaagtctgtgtcctgtgaagt

SEQ ID NO: 383545 - DNA, 25 bp, Homo sapien
gaaaagtctgtgtcctgtgaagtgt

SEQ ID NO: 383546 - DNA, 25 bp, Homo sapien
aaagtctgtgtcctgtgaagtgtga

SEQ ID NO: 383547 - DNA, 25 bp, Homo sapien
agtctgtgtcctgtgaagtgtgacc

SEQ ID NO: 383548 - DNA, 25 bp, Homo sapien
ctgtgtcctgtgaagtgtgaccgtg

SEQ ID NO: 383549 - DNA, 25 bp, Homo sapien
ttccattttgaaagaaagcgtcggg

SEQ ID NO: 383550 - DNA, 25 bp, Homo sapien
tcagaacagagctgagtgcagaaat

SEQ ID NO: 383551 - DNA, 25 bp, Homo sapien
aaatgaaaatctatggctctgtgtt

SEQ ID NO: 383552 - DNA, 25 bp, Homo sapien
atctatggctctgtgttccaaaacg

SEQ ID NO: 383553 - DNA, 25 bp, Homo sapien
ggctctgtgttccaaaacgatgaag

SEQ ID NO: 383554 - DNA, 25 bp, Homo sapien
atggtggcagtggtaaaatccttct

SEQ ID NO: 383555 - DNA, 25 bp, Homo sapien
gcagtggtaaaatccttctccagga

SEQ ID NO: 383556 - DNA, 25 bp, Homo sapien
aaatctgtccttggcccaatgtgta

SEQ ID NO: 383557 - DNA, 25 bp, Homo sapien
gtccttggcccaatgtgtaaacact

SEQ ID NO: 383558 - DNA, 25 bp, Homo sapien
ggcccaatgtgtaaacacttgctga

SEQ ID NO: 383559 - DNA, 25 bp, Homo sapien
taaaggcactctacagtgtgcagat

SEQ ID NO: 383560 - DNA, 25 bp, Homo sapien
aggcactctacagtgtgcagatgcc

SEQ ID NO: 383561 - DNA, 25 bp, Homo sapien
gtcaaccctttcagagaccgtatct

SEQ ID NO: 383562 - DNA, 25 bp, Homo sapien
agaccgtatctgcagagtgttctcc

SEQ ID NO: 383563 - DNA, 25 bp, Homo sapien
gtatctgcagagtgttctcccacaa

SEQ ID NO: 383564 - DNA, 25 bp, Homo sapien
gagtgttctcccacaaaggcatgtt

SEQ ID NO: 383565 - DNA, 25 bp, Homo sapien
ctcccacaaaggcatgttctccttt

SEQ ID NO: 383566 - DNA, 25 bp, Homo sapien
ctgggcatggcatctgtgttcagcg

SEQ ID NO: 383567 - DNA, 25 bp, Homo sapien
gcctgcccaagcctgaagattgagt

SEQ ID NO: 383568 - DNA, 25 bp, Homo sapien
gaagattgagtatgcctttcgcatc

SEQ ID NO: 383569 - DNA, 25 bp, Homo sapien
atgcctttcgcatctatgattttaa

SEQ ID NO: 383570 - DNA, 25 bp, Homo sapien
ctgcgactgctgaacagtgatgaca

SEQ ID NO: 383571 - DNA, 25 bp, Homo sapien
tgatgacatgtctgaggacctcctg

SEQ ID NO: 383572 - DNA, 25 bp, Homo sapien
gcagtggtgttccaaattctccatt

SEQ ID NO: 383573 - DNA, 25 bp, Homo sapien
tctccattacctctatgcctaatat

SEQ ID NO: 383574 - DNA, 25 bp, Homo sapien
atattcatcagccttcattactctc

SEQ ID NO: 383575 - DNA, 25 bp, Homo sapien
ctctctagcatattcaccttgattc

SEQ ID NO: 383576 - DNA, 25 bp, Homo sapien
acagattcaaacttcctacagcctt

SEQ ID NO: 383577 - DNA, 25 bp, Homo sapien
cagccttctactgatgtcttacaag

SEQ ID NO: 383578 - DNA, 25 bp, Homo sapien
atgtcttacaagctcttgcctctgt

SEQ ID NO: 383579 - DNA, 25 bp, Homo sapien
tttgcttagattgctctttggtccc

SEQ ID NO: 383580 - DNA, 25 bp, Homo sapien
tctttggtcccagctcatgttcatc

SEQ ID NO: 383581 - DNA, 25 bp, Homo sapien
caaagcctttcttcctttatatctt

SEQ ID NO: 383582 - DNA, 25 bp, Homo sapien
ttatatcttctgactgagctctccc

SEQ ID NO: 383583 - DNA, 25 bp, Homo sapien
tgaatgatgttctccaaatcctggg

SEQ ID NO: 383584 - DNA, 25 bp, Homo sapien
taattctaggacttcatgttgatac

SEQ ID NO: 383585 - DNA, 25 bp, Homo sapien
tttagttaaggcaaaacgcttgtga

SEQ ID NO: 383586 - DNA, 25 bp, Homo sapien
tactggtgaacaactagcgtgcaca

SEQ ID NO: 383587 - DNA, 25 bp, Homo sapien
actagcgtgcacatttatgatttga

SEQ ID NO: 383588 - DNA, 25 bp, Homo sapien
tatgatttgagcagaacagcccttt

SEQ ID NO: 383589 - DNA, 25 bp, Homo sapien
ttgagcagaacagccctttaagtac

SEQ ID NO: 383590 - DNA, 25 bp, Homo sapien
attgtttaaaagcttggcagctacg

SEQ ID NO: 383591 - DNA, 25 bp, Homo sapien
ggcagctacgagtatttgaggtaca

SEQ ID NO: 383592 - DNA, 25 bp, Homo sapien
gggcacagaaccagcctcctgaatt

SEQ ID NO: 383593 - DNA, 25 bp, Homo sapien
cctcctgaattccatttactctggt

SEQ ID NO: 383594 - DNA, 25 bp, Homo sapien
tgaccacaaatctcagttcttcagg

SEQ ID NO: 383595 - DNA, 25 bp, Homo sapien
taggaaaaccgtgagccacctgcaa

SEQ ID NO: 383596 - DNA, 25 bp, Homo sapien
gccacctgcaaatataggctgctta

SEQ ID NO: 383597 - DNA, 25 bp, Homo sapien
gacaggttcagggaatccgtccttt

SEQ ID NO: 383598 - DNA, 25 bp, Homo sapien
gggaatccgtccttttagcactggg

SEQ ID NO: 383599 - DNA, 25 bp, Homo sapien
ggcggtttcactttggacttgatca

SEQ ID NO: 383600 - DNA, 25 bp, Homo sapien
ggcttagaggcctttagctttccga

SEQ ID NO: 383601 - DNA, 25 bp, Homo sapien
ttagctttccgatcctgaggagcct

SEQ ID NO: 383602 - DNA, 25 bp, Homo sapien
tactacttttgtgtcccctactgtt

SEQ ID NO: 383603 - DNA, 25 bp, Homo sapien
tcccctactgttgcctagcaaagta

SEQ ID NO: 383604 - DNA, 25 bp, Homo sapien
aagtagggcccctggtagacactca

SEQ ID NO: 383605 - DNA, 25 bp, Homo sapien
gagatttaagctctgtcagtatttt

SEQ ID NO: 383606 - DNA, 25 bp, Homo sapien
gatttaagctctgtcagtattttca

SEQ ID NO: 383607 - DNA, 25 bp, Homo sapien
ttttcatttactgatagcatttata

SEQ ID NO: 383608 - DNA, 25 bp, Homo sapien
catttactgatagcatttatatttt

SEQ ID NO: 383609 - DNA, 25 bp, Homo sapien
gtatatttcattattatccttcata

SEQ ID NO: 383610 - DNA, 25 bp, Homo sapien
atttcattattatccttcataacag

SEQ ID NO: 383611 - DNA, 25 bp, Homo sapien
cattattatccttcataacagaatt

SEQ ID NO: 383612 - DNA, 25 bp, Homo sapien
tatccttcataacagaattataatg

SEQ ID NO: 383613 - DNA, 25 bp, Homo sapien
gttatttttcttgttggtagatgtg

SEQ ID NO: 383614 - DNA, 25 bp, Homo sapien
tatttttcttgttggtagatgtgaa

SEQ ID NO: 383615 - DNA, 25 bp, Homo sapien
tgtgaaatggtgcttcaaaaaatat

SEQ ID NO: 383616 - DNA, 25 bp, Homo sapien
gcacataattagatagatccagata

SEQ ID NO: 383617 - DNA, 25 bp, Homo sapien
gatccagatataatcgctaacaata

SEQ ID NO: 383618 - DNA, 25 bp, Homo sapien
atatcatcttccagtatttttccta

SEQ ID NO: 383619 - DNA, 25 bp, Homo sapien
atcttccagtatttttcctacatat

SEQ ID NO: 383620 - DNA, 25 bp, Homo sapien
agctccagctttaaatgtcctccag

SEQ ID NO: 383621 - DNA, 25 bp, Homo sapien
aaaaaatagcatccgacagtgtcta

SEQ ID NO: 383622 - DNA, 25 bp, Homo sapien
atccgacagtgtctatttgtggcct

SEQ ID NO: 383623 - DNA, 25 bp, Homo sapien
acagtgtctatttgtggcctgcttt

SEQ ID NO: 383624 - DNA, 25 bp, Homo sapien
tttccctatcaatatacacacttgg

SEQ ID NO: 383625 - DNA, 25 bp, Homo sapien
aatgacacttatttctcctctttta

SEQ ID NO: 383626 - DNA, 25 bp, Homo sapien
gacacttatttctcctcttttataa

SEQ ID NO: 383627 - DNA, 25 bp, Homo sapien
gggactcacttatattccacagttt

SEQ ID NO: 383628 - DNA, 25 bp, Homo sapien
taataggtcaaggtccaggctggaa

SEQ ID NO: 383629 - DNA, 25 bp, Homo sapien
gggaccacttcgaatcttgaatgca

SEQ ID NO: 383630 - DNA, 25 bp, Homo sapien
tactggtcagcgttggttctttaga

SEQ ID NO: 383631 - DNA, 25 bp, Homo sapien
gggcaaacagctcaagacaccatgg

SEQ ID NO: 383632 - DNA, 25 bp, Homo sapien
agctcaagacaccatggctgatgaa

SEQ ID NO: 383633 - DNA, 25 bp, Homo sapien
tggctgatgaagacgctatgtacac

SEQ ID NO: 383634 - DNA, 25 bp, Homo sapien
gctatgtacacgctttccagtatga

SEQ ID NO: 383635 - DNA, 25 bp, Homo sapien
gaaagcctgtgtagaatcgattaaa

SEQ ID NO: 383636 - DNA, 25 bp, Homo sapien
atcgattaaaaattgctcagcactt

SEQ ID NO: 383637 - DNA, 25 bp, Homo sapien
cagcacttactacagccattttcaa

SEQ ID NO: 383638 - DNA, 25 bp, Homo sapien
gaaatatgtaatcccctggctgact

SEQ ID NO: 383639 - DNA, 25 bp, Homo sapien
tatgtaatcccctggctgactagga

SEQ ID NO: 383640 - DNA, 25 bp, Homo sapien
taatcccctggctgactaggactgt

SEQ ID NO: 383641 - DNA, 25 bp, Homo sapien
tcccctggctgactaggactgttaa

SEQ ID NO: 383642 - DNA, 25 bp, Homo sapien
ctggctgactaggactgttaaacat

SEQ ID NO: 383643 - DNA, 25 bp, Homo sapien
ctgttaaacatagtgtggactggat

SEQ ID NO: 383644 - DNA, 25 bp, Homo sapien
tggactggatgatgccttcgacaaa

SEQ ID NO: 383645 - DNA, 25 bp, Homo sapien
ggatgatgccttcgacaaaccagag

SEQ ID NO: 383646 - DNA, 25 bp, Homo sapien
atgatgccttcgacaaaccagagaa

SEQ ID NO: 383647 - DNA, 25 bp, Homo sapien
gccttcgacaaaccagagaagccaa

SEQ ID NO: 383648 - DNA, 25 bp, Homo sapien
agctggtgcctggagtgggccctgt

SEQ ID NO: 383649 - DNA, 25 bp, Homo sapien
tggaaattattctctgcttgggaat

SEQ ID NO: 383650 - DNA, 25 bp, Homo sapien
cagttctgtagtttcgattcgaaat

SEQ ID NO: 383651 - DNA, 25 bp, Homo sapien
aatagttttcaatatgttccagaca

SEQ ID NO: 383652 - DNA, 25 bp, Homo sapien
gacattataaatgacttcccttcta

SEQ ID NO: 383653 - DNA, 25 bp, Homo sapien
cccttctatttccatgtatttccca

SEQ ID NO: 383654 - DNA, 25 bp, Homo sapien
gtatttcccatgttgattacagcca

SEQ ID NO: 383655 - DNA, 25 bp, Homo sapien
tacagccaggctgatcagagtaaag

SEQ ID NO: 383656 - DNA, 25 bp, Homo sapien
aagcaccaggtgtcatagcatccta

SEQ ID NO: 383657 - DNA, 25 bp, Homo sapien
attcatctatgcatgtatccaggga

SEQ ID NO: 383658 - DNA, 25 bp, Homo sapien
gatgaacattcagacatttctcttt

SEQ ID NO: 383659 - DNA, 25 bp, Homo sapien
ttccccttctattctttagagttgg

SEQ ID NO: 383660 - DNA, 25 bp, Homo sapien
gctttcagaatctttcggaggctct

SEQ ID NO: 383661 - DNA, 25 bp, Homo sapien
ttcagaatctttcggaggctctagt

SEQ ID NO: 383662 - DNA, 25 bp, Homo sapien
gttagaacaatctctcaaaatttag

SEQ ID NO: 383663 - DNA, 25 bp, Homo sapien
tcacttttaactctaaagcgtaaga

SEQ ID NO: 383664 - DNA, 25 bp, Homo sapien
gcgtaagaatcatggtaaccctctc

SEQ ID NO: 383665 - DNA, 25 bp, Homo sapien
gtaaccctctcagaagtggtccttt

SEQ ID NO: 383666 - DNA, 25 bp, Homo sapien
ctctcagaagtggtcctttcttgct

SEQ ID NO: 383667 - DNA, 25 bp, Homo sapien
ttcttgctcatttcagtttcgtatt

SEQ ID NO: 383668 - DNA, 25 bp, Homo sapien
gctcatttcagtttcgtattaattt

SEQ ID NO: 383669 - DNA, 25 bp, Homo sapien
atcactgatgtattgtctttcaagc

SEQ ID NO: 383670 - DNA, 25 bp, Homo sapien
tgatgtattgtctttcaagctatca

SEQ ID NO: 383671 - DNA, 25 bp, Homo sapien
aaactacagtatcaaggcatacaac

SEQ ID NO: 383672 - DNA, 25 bp, Homo sapien
ggcatacaacttaaattccacttgg

SEQ ID NO: 383673 - DNA, 25 bp, Homo sapien
atacaacttaaattccacttggaag

SEQ ID NO: 383674 - DNA, 25 bp, Homo sapien
gttacaagggaagctatgccttctg

SEQ ID NO: 383675 - DNA, 25 bp, Homo sapien
gaagctatgccttctgaagtctatc

SEQ ID NO: 383676 - DNA, 25 bp, Homo sapien
atgccttctgaagtctatccttagt

SEQ ID NO: 383677 - DNA, 25 bp, Homo sapien
gccttctgaagtctatccttagttg

SEQ ID NO: 383678 - DNA, 25 bp, Homo sapien
gaagtctatccttagttgaaacaga

SEQ ID NO: 383679 - DNA, 25 bp, Homo sapien
ggtacaagatccttaaattattttg

SEQ ID NO: 383680 - DNA, 25 bp, Homo sapien
cttaaattattttgaaccacagagg

SEQ ID NO: 383681 - DNA, 25 bp, Homo sapien
accacagaggttgaaattgttttgt

SEQ ID NO: 383682 - DNA, 25 bp, Homo sapien
agtgtctttggtgctgggaatgaaa

SEQ ID NO: 383683 - DNA, 25 bp, Homo sapien
catttagtgtgtttactgggtgcca

SEQ ID NO: 383684 - DNA, 25 bp, Homo sapien
ccctcactaagcacctgcattatgt

SEQ ID NO: 383685 - DNA, 25 bp, Homo sapien
ctgcattatgtctcccacatgggat

SEQ ID NO: 383686 - DNA, 25 bp, Homo sapien
tcccacatgggattctgcaaagtag

SEQ ID NO: 383687 - DNA, 25 bp, Homo sapien
gaaattttacgtctcacaggtgaag

SEQ ID NO: 383688 - DNA, 25 bp, Homo sapien
agagaggttaacttgcccacagtct

SEQ ID NO: 383689 - DNA, 25 bp, Homo sapien
cagtctcatgactacaaagtggcag

SEQ ID NO: 383690 - DNA, 25 bp, Homo sapien
cccacactgctttgggagtggacat

SEQ ID NO: 383691 - DNA, 25 bp, Homo sapien
ggacatagtgtcttgaggcttgcag

SEQ ID NO: 383692 - DNA, 25 bp, Homo sapien
aggcttgcagggtatgtcacagaca

SEQ ID NO: 383693 - DNA, 25 bp, Homo sapien
tattgtaaagacgtcaattttccca

SEQ ID NO: 383694 - DNA, 25 bp, Homo sapien
tttcccaaaactgattgatagctat

SEQ ID NO: 383695 - DNA, 25 bp, Homo sapien
taaattcccaaactatcaagtgcat

SEQ ID NO: 383696 - DNA, 25 bp, Homo sapien
tcaagtgcatcattgttgttggaat

SEQ ID NO: 383697 - DNA, 25 bp, Homo sapien
gttggaattgacaagctgattttaa

SEQ ID NO: 383698 - DNA, 25 bp, Homo sapien
gagaaaaaccttacatgaaaataca

SEQ ID NO: 383699 - DNA, 25 bp, Homo sapien
aaagagccagaatagtcaagacact

SEQ ID NO: 383700 - DNA, 25 bp, Homo sapien
aatagtcaagacactctcaaagaag

SEQ ID NO: 383701 - DNA, 25 bp, Homo sapien
aaagacttactttatcagatctcaa

SEQ ID NO: 383702 - DNA, 25 bp, Homo sapien
agacagcttgatattggcacaagaa

SEQ ID NO: 383703 - DNA, 25 bp, Homo sapien
ttggcacaagaacagacagactaat

SEQ ID NO: 383704 - DNA, 25 bp, Homo sapien
gtgcagtacctctcctttttaaggg

SEQ ID NO: 383705 - DNA, 25 bp, Homo sapien
tttctttttgtttggctgaattgca

SEQ ID NO: 383706 - DNA, 25 bp, Homo sapien
gaattgcagtaactagccttgcctt

SEQ ID NO: 383707 - DNA, 25 bp, Homo sapien
tagccttgcctttctattctgtaga

SEQ ID NO: 383708 - DNA, 25 bp, Homo sapien
tgtagaaatgacagggtcttcacaa

SEQ ID NO: 383709 - DNA, 25 bp, Homo sapien
acaatccttcaccagtggctactaa

SEQ ID NO: 383710 - DNA, 25 bp, Homo sapien
tcaccagtggctactaagctataat

SEQ ID NO: 383711 - DNA, 25 bp, Homo sapien
atgtggaagtggtctgaggcatata

SEQ ID NO: 383712 - DNA, 25 bp, Homo sapien
gagtatatgccaagaacactaccat

SEQ ID NO: 383713 - DNA, 25 bp, Homo sapien
gaacactaccatatatggcatcagc

SEQ ID NO: 383714 - DNA, 25 bp, Homo sapien
tagtcattagaccatgtaacagtaa

SEQ ID NO: 383715 - DNA, 25 bp, Homo sapien
gattttcatgtatcaaggaagctgc

SEQ ID NO: 383716 - DNA, 25 bp, Homo sapien
gcatgttacaatctggaatattttt

SEQ ID NO: 383717 - DNA, 25 bp, Homo sapien
ctggaatattttttcacacagagaa

SEQ ID NO: 383718 - DNA, 25 bp, Homo sapien
aaagccaggctttcgaaatcccgag

SEQ ID NO: 383719 - DNA, 25 bp, Homo sapien
gccaggctttcgaaatcccgagatt

SEQ ID NO: 383720 - DNA, 25 bp, Homo sapien
ttccgaaaaggcacttaactttgct

SEQ ID NO: 383721 - DNA, 25 bp, Homo sapien
ttcagagtggctgttctagactgga

SEQ ID NO: 383722 - DNA, 25 bp, Homo sapien
gagtggctgttctagactggatttc

SEQ ID NO: 383723 - DNA, 25 bp, Homo sapien
ggctgttctagactggatttctttt

SEQ ID NO: 383724 - DNA, 25 bp, Homo sapien
atttcttttttcattggagctggta

SEQ ID NO: 383725 - DNA, 25 bp, Homo sapien
tcattggagctggtaactgaaattt

SEQ ID NO: 383726 - DNA, 25 bp, Homo sapien
ctgggtctcaatttcaccctcagtt

SEQ ID NO: 383727 - DNA, 25 bp, Homo sapien
atttcaccctcagttcaaggagctg

SEQ ID NO: 383728 - DNA, 25 bp, Homo sapien
ctgagtaggcagaggcaaaggctat

SEQ ID NO: 383729 - DNA, 25 bp, Homo sapien
ggcagaggcaaaggctatactcaac

SEQ ID NO: 383730 - DNA, 25 bp, Homo sapien
aggctatactcaacacacgtgcaat

SEQ ID NO: 383731 - DNA, 25 bp, Homo sapien
aacacacgtgcaattgaaagcaggc

SEQ ID NO: 383732 - DNA, 25 bp, Homo sapien
ttgaaagcaggcgaggcaaaaccag

SEQ ID NO: 383733 - DNA, 25 bp, Homo sapien
agaggaggttctaagcagtataacc

SEQ ID NO: 383734 - DNA, 25 bp, Homo sapien
tctaagcagtataacctaagcctct

SEQ ID NO: 383735 - DNA, 25 bp, Homo sapien
tcaaagcttcttcccatttgtactt

SEQ ID NO: 383736 - DNA, 25 bp, Homo sapien
gtacttcagttctaggacaaggcaa

SEQ ID NO: 383737 - DNA, 25 bp, Homo sapien
gggagaggctcctccatctttccca

SEQ ID NO: 383738 - DNA, 25 bp, Homo sapien
atctttcccaagtcacaccatcgtt

SEQ ID NO: 383739 - DNA, 25 bp, Homo sapien
atcgtttcctacgtggtctggacaa

SEQ ID NO: 383740 - DNA, 25 bp, Homo sapien
ggtctggacaagagcaagagcacac

SEQ ID NO: 383741 - DNA, 25 bp, Homo sapien
agagcagccagaacccacctcaggt

SEQ ID NO: 383742 - DNA, 25 bp, Homo sapien
ttccccatccggtgcagttaaggca

SEQ ID NO: 383743 - DNA, 25 bp, Homo sapien
ttaaggcacttctgccagcaccatg

SEQ ID NO: 383744 - DNA, 25 bp, Homo sapien
gggtgatctctgaacccaaacttgc

SEQ ID NO: 383745 - DNA, 25 bp, Homo sapien
tgaacccaaacttgccccaaagaag

SEQ ID NO: 383746 - DNA, 25 bp, Homo sapien
cttgccccaaagaaggttgctctgt

SEQ ID NO: 383747 - DNA, 25 bp, Homo sapien
aaagaaggttgctctgtcctctcca

SEQ ID NO: 383748 - DNA, 25 bp, Homo sapien
aagaataaggcagtaagtgctattt

SEQ ID NO: 383749 - DNA, 25 bp, Homo sapien
gaataaggcagtaagtgctatttgg

SEQ ID NO: 383750 - DNA, 25 bp, Homo sapien
aataaggcagtaagtgctatttgga

SEQ ID NO: 383751 - DNA, 25 bp, Homo sapien
ataaggcagtaagtgctatttggag

SEQ ID NO: 383752 - DNA, 25 bp, Homo sapien
taaggcagtaagtgctatttggaga

SEQ ID NO: 383753 - DNA, 25 bp, Homo sapien
aaggcagtaagtgctatttggagaa

SEQ ID NO: 383754 - DNA, 25 bp, Homo sapien
aggcagtaagtgctatttggagaat

SEQ ID NO: 383755 - DNA, 25 bp, Homo sapien
ggcagtaagtgctatttggagaata

SEQ ID NO: 383756 - DNA, 25 bp, Homo sapien
gcagtaagtgctatttggagaatat

SEQ ID NO: 383757 - DNA, 25 bp, Homo sapien
cagtaagtgctatttggagaatatt

SEQ ID NO: 383758 - DNA, 25 bp, Homo sapien
gtaagtgctatttggagaatattct

SEQ ID NO: 383759 - DNA, 25 bp, Homo sapien
cagtgagacacgaatgtgccactgc

SEQ ID NO: 383760 - DNA, 25 bp, Homo sapien
ttaagcctagaaatttgagacccac

SEQ ID NO: 383761 - DNA, 25 bp, Homo sapien
aagcctagaaatttgagacccacct

SEQ ID NO: 383762 - DNA, 25 bp, Homo sapien
agcctagaaatttgagacccaccta

SEQ ID NO: 383763 - DNA, 25 bp, Homo sapien
gcctagaaatttgagacccacctag

SEQ ID NO: 383764 - DNA, 25 bp, Homo sapien
ctagaaatttgagacccacctaggc

SEQ ID NO: 383765 - DNA, 25 bp, Homo sapien
aaatgctccaggaaaaaacagccac

SEQ ID NO: 383766 - DNA, 25 bp, Homo sapien
acacatccagaattgagcctcctgt

SEQ ID NO: 383767 - DNA, 25 bp, Homo sapien
cacatccagaattgagcctcctgta

SEQ ID NO: 383768 - DNA, 25 bp, Homo sapien
acatccagaattgagcctcctgtat

SEQ ID NO: 383769 - DNA, 25 bp, Homo sapien
catccagaattgagcctcctgtatg

SEQ ID NO: 383770 - DNA, 25 bp, Homo sapien
gagattaccgatttagtaaatgcta

SEQ ID NO: 383771 - DNA, 25 bp, Homo sapien
gtaaatgctatcatctcatacccca

SEQ ID NO: 383772 - DNA, 25 bp, Homo sapien
atgctatcatctcataccccattca

SEQ ID NO: 383773 - DNA, 25 bp, Homo sapien
aaatgagcaacatggaaacattcca

SEQ ID NO: 383774 - DNA, 25 bp, Homo sapien
acattccaattccagtcttaggtga

SEQ ID NO: 383775 - DNA, 25 bp, Homo sapien
attccagtcttaggtgagttccaat

SEQ ID NO: 383776 - DNA, 25 bp, Homo sapien
gtgagttccaatgaaattacctgaa

SEQ ID NO: 383777 - DNA, 25 bp, Homo sapien
ttacctgaagaactgaactagtgct

SEQ ID NO: 383778 - DNA, 25 bp, Homo sapien
gaactgaactagtgcttttagttaa

SEQ ID NO: 383779 - DNA, 25 bp, Homo sapien
tcatcttgcctcttaacctcaatat

SEQ ID NO: 383780 - DNA, 25 bp, Homo sapien
tgcctcttaacctcaatataacaag

SEQ ID NO: 383781 - DNA, 25 bp, Homo sapien
gatagtattgtcctcattctgcaga

SEQ ID NO: 383782 - DNA, 25 bp, Homo sapien
tggacacacgaatcccatcctgtgt

SEQ ID NO: 383783 - DNA, 25 bp, Homo sapien
gattcctgcatgcacagagggctgt

SEQ ID NO: 383784 - DNA, 25 bp, Homo sapien
ctgtgcagcctctggcaaaagggca

SEQ ID NO: 383785 - DNA, 25 bp, Homo sapien
ccaggattgggctacttgacataag

SEQ ID NO: 383786 - DNA, 25 bp, Homo sapien
gaccctgggaatgacagaggcccct

SEQ ID NO: 383787 - DNA, 25 bp, Homo sapien
agaggcccctgtatatacactttct

SEQ ID NO: 383788 - DNA, 25 bp, Homo sapien
actttcttcacttggatttacttgg

SEQ ID NO: 383789 - DNA, 25 bp, Homo sapien
tgccagacactcttctaagctcttt

SEQ ID NO: 383790 - DNA, 25 bp, Homo sapien
taagctctttacctgtttgaacaca

SEQ ID NO: 383791 - DNA, 25 bp, Homo sapien
tgtttgaacacacttgatcctcacc

SEQ ID NO: 383792 - DNA, 25 bp, Homo sapien
agactctagtgaaggaactccaagc

SEQ ID NO: 383793 - DNA, 25 bp, Homo sapien
actccaagctggttattctgtgata

SEQ ID NO: 383794 - DNA, 25 bp, Homo sapien
aattcttgccacaattcagttttct

SEQ ID NO: 383795 - DNA, 25 bp, Homo sapien
gatattcatgagactttgctgggat

SEQ ID NO: 383796 - DNA, 25 bp, Homo sapien
gctgggatagactttatgctgcatg

SEQ ID NO: 383797 - DNA, 25 bp, Homo sapien
gtagtgctccaacattagtgtgctt

SEQ ID NO: 383798 - DNA, 25 bp, Homo sapien
tagtgtgcttttctaagtgggtaag

SEQ ID NO: 383799 - DNA, 25 bp, Homo sapien
tactgttgcagtatgccaaggagac

SEQ ID NO: 383800 - DNA, 25 bp, Homo sapien
ttttcttcctcgctttgaataataa

SEQ ID NO: 383801 - DNA, 25 bp, Homo sapien
taacctctttaaacctgtgacaact

SEQ ID NO: 383802 - DNA, 25 bp, Homo sapien
tttagtattctatagcagctgcttt

SEQ ID NO: 383803 - DNA, 25 bp, Homo sapien
ggtgacttttcagcaagcccctcca

SEQ ID NO: 383804 - DNA, 25 bp, Homo sapien
tcagcaagcccctccggtgggcgag

SEQ ID NO: 383805 - DNA, 25 bp, Homo sapien
tgggcgaggacctctgcacgtgtct

SEQ ID NO: 383806 - DNA, 25 bp, Homo sapien
tgcacgtgtctccagaggccaaagc

SEQ ID NO: 383807 - DNA, 25 bp, Homo sapien
aaagcagaagaaaacgttagcacag

SEQ ID NO: 383808 - DNA, 25 bp, Homo sapien
gaaaacgttagcacaggagtcactt

SEQ ID NO: 383809 - DNA, 25 bp, Homo sapien
cgttagcacaggagtcacttgactt

SEQ ID NO: 383810 - DNA, 25 bp, Homo sapien
aggattgcggtttctccggctcggc

SEQ ID NO: 383811 - DNA, 25 bp, Homo sapien
cggctcggctgtctcagttgtttaa

SEQ ID NO: 383812 - DNA, 25 bp, Homo sapien
tccacgtgtgtcaccaggccaggta

SEQ ID NO: 383813 - DNA, 25 bp, Homo sapien
acgtgtgtcaccaggccaggtaact

SEQ ID NO: 383814 - DNA, 25 bp, Homo sapien
agggctgtgactccacagctcagat

SEQ ID NO: 383815 - DNA, 25 bp, Homo sapien
actccacagctcagatacagcagca

SEQ ID NO: 383816 - DNA, 25 bp, Homo sapien
aagccccgcactcagagcaggtagc

SEQ ID NO: 383817 - DNA, 25 bp, Homo sapien
aggtagccctggtcttggcagacag

SEQ ID NO: 383818 - DNA, 25 bp, Homo sapien
cacctctgcctgagttctgtttgtg

SEQ ID NO: 383819 - DNA, 25 bp, Homo sapien
agaactaggcttgtccactttacag

SEQ ID NO: 383820 - DNA, 25 bp, Homo sapien
agaccagggcaggtgtgcatgtcac

SEQ ID NO: 383821 - DNA, 25 bp, Homo sapien
caggtgtgcatgtcacccaagtgac

SEQ ID NO: 383822 - DNA, 25 bp, Homo sapien
agtgacaccagcgtctggccatagc

SEQ ID NO: 383823 - DNA, 25 bp, Homo sapien
ggcttgtccactttacagattggga

SEQ ID NO: 383824 - DNA, 25 bp, Homo sapien
attgggaggtgagcgacgcacccac

SEQ ID NO: 383825 - DNA, 25 bp, Homo sapien
tcctgccgcagctgatcgggtgcta

SEQ ID NO: 383826 - DNA, 25 bp, Homo sapien
tgctgaggatacacgtctgggagaa

SEQ ID NO: 383827 - DNA, 25 bp, Homo sapien
gcaaagctcttcaaaggagacctat

SEQ ID NO: 383828 - DNA, 25 bp, Homo sapien
ggagacctataaagtcatctttgtt

SEQ ID NO: 383829 - DNA, 25 bp, Homo sapien
gttcattcttctcatgtttctgcat

SEQ ID NO: 383830 - DNA, 25 bp, Homo sapien
tgcattctgggcattctcctaaatt

SEQ ID NO: 383831 - DNA, 25 bp, Homo sapien
ggagaaaccaaaatgcccagaagtc

SEQ ID NO: 383832 - DNA, 25 bp, Homo sapien
gtcaaattctgcaactgtcatcaag

SEQ ID NO: 383833 - DNA, 25 bp, Homo sapien
aaactggttttatcagaacagcctg

SEQ ID NO: 383834 - DNA, 25 bp, Homo sapien
acagcctgcctgagagagatcaagc

SEQ ID NO: 383835 - DNA, 25 bp, Homo sapien
tcaagcagggcacaggtcaccaggt

SEQ ID NO: 383836 - DNA, 25 bp, Homo sapien
agaaggtctgatgcctagaaagaag

SEQ ID NO: 383837 - DNA, 25 bp, Homo sapien
agaaggaaaggacaccactggtgaa

SEQ ID NO: 383838 - DNA, 25 bp, Homo sapien
acaccactggtgaagcgggagattt

SEQ ID NO: 383839 - DNA, 25 bp, Homo sapien
gaagcgggagatttaaccttctttg

SEQ ID NO: 383840 - DNA, 25 bp, Homo sapien
ttttccttacttgaactgtaaagca

SEQ ID NO: 383841 - DNA, 25 bp, Homo sapien
aagtggtttgctaggtgttctgccc

SEQ ID NO: 383842 - DNA, 25 bp, Homo sapien
aggtgttctgcccttaaacccatgc

SEQ ID NO: 383843 - DNA, 25 bp, Homo sapien
cacatcctcatcagcctgaaagcat

SEQ ID NO: 383844 - DNA, 25 bp, Homo sapien
gatgcccagaatctatagcaccttg

SEQ ID NO: 383845 - DNA, 25 bp, Homo sapien
agaatctatagcaccttgagagaag

SEQ ID NO: 383846 - DNA, 25 bp, Homo sapien
gagagaaggtcactagcaagctaaa

SEQ ID NO: 383847 - DNA, 25 bp, Homo sapien
ctcagatgcccattcaccagaatct

SEQ ID NO: 383848 - DNA, 25 bp, Homo sapien
tcagatgcccattcaccagaatctc

SEQ ID NO: 383849 - DNA, 25 bp, Homo sapien
cagatgcccattcaccagaatctca

SEQ ID NO: 383850 - DNA, 25 bp, Homo sapien
agatgcccattcaccagaatctcaa

SEQ ID NO: 383851 - DNA, 25 bp, Homo sapien
gatgcccattcaccagaatctcaag

SEQ ID NO: 383852 - DNA, 25 bp, Homo sapien
gagctgctggccgtcagggcggagc

SEQ ID NO: 383853 - DNA, 25 bp, Homo sapien
tgctggccgtcagggcggagctgca

SEQ ID NO: 383854 - DNA, 25 bp, Homo sapien
gcgggaggtggccacgcgcgccgtc

SEQ ID NO: 383855 - DNA, 25 bp, Homo sapien
gggaggtggccacgcgcgccgtctc

SEQ ID NO: 383856 - DNA, 25 bp, Homo sapien
gtctcatcctcatctgagcggggct

SEQ ID NO: 383857 - DNA, 25 bp, Homo sapien
tccgtccacacctcggtctgatggg

SEQ ID NO: 383858 - DNA, 25 bp, Homo sapien
agtaagcattgaagcaccctctctg

SEQ ID NO: 383859 - DNA, 25 bp, Homo sapien
accctctctgctggtacttggtgtc

SEQ ID NO: 383860 - DNA, 25 bp, Homo sapien
tacttggtgtcttagcctgaagctc

SEQ ID NO: 383861 - DNA, 25 bp, Homo sapien
ctggaggtggaaagcactcttttta

SEQ ID NO: 383862 - DNA, 25 bp, Homo sapien
gaagcccttagcagttgttcatgag

SEQ ID NO: 383863 - DNA, 25 bp, Homo sapien
tttgatgtcaccattttgtttttgc

SEQ ID NO: 383864 - DNA, 25 bp, Homo sapien
gctttgatggcatttgggcctggaa

SEQ ID NO: 383865 - DNA, 25 bp, Homo sapien
gggcctggaatatagaccctctatt

SEQ ID NO: 383866 - DNA, 25 bp, Homo sapien
atagaccctctattggcaccggtag

SEQ ID NO: 383867 - DNA, 25 bp, Homo sapien
gcaccggtagcctttatatgcctac

SEQ ID NO: 383868 - DNA, 25 bp, Homo sapien
ccttgcttttgatgccttgatgtgt

SEQ ID NO: 383869 - DNA, 25 bp, Homo sapien
gcctcagactgggaatcccctgaag

SEQ ID NO: 383870 - DNA, 25 bp, Homo sapien
tcagactgggaatcccctgaagatg

SEQ ID NO: 383871 - DNA, 25 bp, Homo sapien
gaagatggggccgtgtctccctcaa

SEQ ID NO: 383872 - DNA, 25 bp, Homo sapien
tggggccgtgtctccctcaaagtgg

SEQ ID NO: 383873 - DNA, 25 bp, Homo sapien
caaagtggggctccctcaggacagc

SEQ ID NO: 383874 - DNA, 25 bp, Homo sapien
tgaagaaagggctgcttctccctca

SEQ ID NO: 383875 - DNA, 25 bp, Homo sapien
gaagaaagggctgcttctccctcag

SEQ ID NO: 383876 - DNA, 25 bp, Homo sapien
aagaaagggctgcttctccctcaga

SEQ ID NO: 383877 - DNA, 25 bp, Homo sapien
ggctgcttctccctcagactggagc

SEQ ID NO: 383878 - DNA, 25 bp, Homo sapien
ctcagactggagctccctgaagatg

SEQ ID NO: 383879 - DNA, 25 bp, Homo sapien
tcagactggagctccctgaagatgg

SEQ ID NO: 383880 - DNA, 25 bp, Homo sapien
aaccatgaatatgtcagtgttctat

SEQ ID NO: 383881 - DNA, 25 bp, Homo sapien
gtcagtgttctatggattacgaaat

SEQ ID NO: 383882 - DNA, 25 bp, Homo sapien
gaaattagtaatgttgcttagccca

SEQ ID NO: 383883 - DNA, 25 bp, Homo sapien
tgttgcttagcccaaacgtgttttt

SEQ ID NO: 383884 - DNA, 25 bp, Homo sapien
aagtatagtttgtacatctctaagt

SEQ ID NO: 383885 - DNA, 25 bp, Homo sapien
agtttgtacatctctaagttatcaa

SEQ ID NO: 383886 - DNA, 25 bp, Homo sapien
aaaagtccatatatgcaactctagt

SEQ ID NO: 383887 - DNA, 25 bp, Homo sapien
tatgcaactctagtaagcacttaat

SEQ ID NO: 383888 - DNA, 25 bp, Homo sapien
gcacttaataggttacatagcactg

SEQ ID NO: 383889 - DNA, 25 bp, Homo sapien
ggttacatagcactggttaagaaca

SEQ ID NO: 383890 - DNA, 25 bp, Homo sapien
caagacagtagtcccttaaaccatg

SEQ ID NO: 383891 - DNA, 25 bp, Homo sapien
gattacactaaaggattgtctccat

SEQ ID NO: 383892 - DNA, 25 bp, Homo sapien
aaggattgtctccatacctatctgt

SEQ ID NO: 383893 - DNA, 25 bp, Homo sapien
gtctccatacctatctgttcaaatt

SEQ ID NO: 383894 - DNA, 25 bp, Homo sapien
tatctgttcaaattagagctctcat

SEQ ID NO: 383895 - DNA, 25 bp, Homo sapien
attagagctctcatatgtgtttcct

SEQ ID NO: 383896 - DNA, 25 bp, Homo sapien
atgtgtttccttgtgcacttaatct

SEQ ID NO: 383897 - DNA, 25 bp, Homo sapien
gtgcacttaatctacaccttgaaat

SEQ ID NO: 383898 - DNA, 25 bp, Homo sapien
acaccttgaaatagatctggattat

SEQ ID NO: 383899 - DNA, 25 bp, Homo sapien
attatccattggaaagtgtctccac

SEQ ID NO: 383900 - DNA, 25 bp, Homo sapien
gtgtctccacagtttagcattctta

SEQ ID NO: 383901 - DNA, 25 bp, Homo sapien
gcattcttagattaaacatccatgt

SEQ ID NO: 383902 - DNA, 25 bp, Homo sapien
ctagccagggctcaggtacctcact

SEQ ID NO: 383903 - DNA, 25 bp, Homo sapien
agggctcaggtacctcactctcctg

SEQ ID NO: 383904 - DNA, 25 bp, Homo sapien
tctcctgccttgtgcgtagctcctg

SEQ ID NO: 383905 - DNA, 25 bp, Homo sapien
cggtcagtccccagcagccttggca

SEQ ID NO: 383906 - DNA, 25 bp, Homo sapien
agccttggcacacagtgtctggagc

SEQ ID NO: 383907 - DNA, 25 bp, Homo sapien
tgctcctgctgcaaaagcagaaacc

SEQ ID NO: 383908 - DNA, 25 bp, Homo sapien
gaaaccatgtgaaccttctggccag

SEQ ID NO: 383909 - DNA, 25 bp, Homo sapien
gaaccttctggccagtactggaaag

SEQ ID NO: 383910 - DNA, 25 bp, Homo sapien
cataagttattgaaatgctgacccc

SEQ ID NO: 383911 - DNA, 25 bp, Homo sapien
ttgaaatgctgacccccgttcagga

SEQ ID NO: 383912 - DNA, 25 bp, Homo sapien
gttcaggaaaccatgcagccccttc

SEQ ID NO: 383913 - DNA, 25 bp, Homo sapien
tgacatctggaacagtacacagcac

SEQ ID NO: 383914 - DNA, 25 bp, Homo sapien
catctggaacagtacacagcacatt

SEQ ID NO: 383915 - DNA, 25 bp, Homo sapien
tctggaacagtacacagcacattta

SEQ ID NO: 383916 - DNA, 25 bp, Homo sapien
agtacacagcacatttagatgctca

SEQ ID NO: 383917 - DNA, 25 bp, Homo sapien
tacacagcacatttagatgctcaat

SEQ ID NO: 383918 - DNA, 25 bp, Homo sapien
gcacatttagatgctcaatacttgt

SEQ ID NO: 383919 - DNA, 25 bp, Homo sapien
catttagatgctcaatacttgtgga

SEQ ID NO: 383920 - DNA, 25 bp, Homo sapien
tttagatgctcaatacttgtggagt

SEQ ID NO: 383921 - DNA, 25 bp, Homo sapien
tagatgctcaatacttgtggagtaa

SEQ ID NO: 383922 - DNA, 25 bp, Homo sapien
gatgctcaatacttgtggagtaaat

SEQ ID NO: 383923 - DNA, 25 bp, Homo sapien
gctcaatacttgtggagtaaataaa

SEQ ID NO: 383924 - DNA, 25 bp, Homo sapien
gagatttaagctctgtcagtatttt

SEQ ID NO: 383925 - DNA, 25 bp, Homo sapien
gatttaagctctgtcagtattttca

SEQ ID NO: 383926 - DNA, 25 bp, Homo sapien
ttcatttactgatagcatttatatt

SEQ ID NO: 383927 - DNA, 25 bp, Homo sapien
gtatatttcattattatccttcata

SEQ ID NO: 383928 - DNA, 25 bp, Homo sapien
atttcattattatccttcataacag

SEQ ID NO: 383929 - DNA, 25 bp, Homo sapien
cattattatccttcataacagaatt

SEQ ID NO: 383930 - DNA, 25 bp, Homo sapien
tatccttcataacagaattataatg

SEQ ID NO: 383931 - DNA, 25 bp, Homo sapien
gttatttttcttgttggtagatgtg

SEQ ID NO: 383932 - DNA, 25 bp, Homo sapien
tatttttcttgttggtagatgtgaa

SEQ ID NO: 383933 - DNA, 25 bp, Homo sapien
tgtgaaatggtgcttcaaaaaatat

SEQ ID NO: 383934 - DNA, 25 bp, Homo sapien
gaaataaattcttttgcattcattt

SEQ ID NO: 383935 - DNA, 25 bp, Homo sapien
atatattttatggtgatgggtagat

SEQ ID NO: 383936 - DNA, 25 bp, Homo sapien
gatgggtagatttccatactcgcca

SEQ ID NO: 383937 - DNA, 25 bp, Homo sapien
tgggtagatttccatactcgccaca

SEQ ID NO: 383938 - DNA, 25 bp, Homo sapien
ggtagatttccatactcgccacaat

SEQ ID NO: 383939 - DNA, 25 bp, Homo sapien
tagatttccatactcgccacaatta

SEQ ID NO: 383940 - DNA, 25 bp, Homo sapien
gatttccatactcgccacaattact

SEQ ID NO: 383941 - DNA, 25 bp, Homo sapien
ttccatactcgccacaattactagc

SEQ ID NO: 383942 - DNA, 25 bp, Homo sapien
atactcgccacaattactagccttt

SEQ ID NO: 383943 - DNA, 25 bp, Homo sapien
gccacaattactagcctttcctaaa

SEQ ID NO: 383944 - DNA, 25 bp, Homo sapien
gatagttgagaaacaggctctctct

SEQ ID NO: 383945 - DNA, 25 bp, Homo sapien
tagttgagaaacaggctctctctct

SEQ ID NO: 383946 - DNA, 25 bp, Homo sapien
gtagagatgcaattggttctcctgc

SEQ ID NO: 383947 - DNA, 25 bp, Homo sapien
gatgcaattggttctcctgcattga

SEQ ID NO: 383948 - DNA, 25 bp, Homo sapien
gcaattggttctcctgcattgagat

SEQ ID NO: 383949 - DNA, 25 bp, Homo sapien
ttggttctcctgcattgagatttga

SEQ ID NO: 383950 - DNA, 25 bp, Homo sapien
gttatgttaacatttatacttgcct

SEQ ID NO: 383951 - DNA, 25 bp, Homo sapien
atttatacttgccttggactgtaga

SEQ ID NO: 383952 - DNA, 25 bp, Homo sapien
tatacttgccttggactgtagaaca

SEQ ID NO: 383953 - DNA, 25 bp, Homo sapien
tacttgccttggactgtagaacaga

SEQ ID NO: 383954 - DNA, 25 bp, Homo sapien
gccttggactgtagaacagaactta

SEQ ID NO: 383955 - DNA, 25 bp, Homo sapien
gttttacaactacaatcaagtcatt

SEQ ID NO: 383956 - DNA, 25 bp, Homo sapien
aactacaatcaagtcattttacctt

SEQ ID NO: 383957 - DNA, 25 bp, Homo sapien
tctaaggcatccactgcatttcctt

SEQ ID NO: 383958 - DNA, 25 bp, Homo sapien
catccactgcatttcctttcatttg

SEQ ID NO: 383959 - DNA, 25 bp, Homo sapien
gcttctgttacaattgcatccacgt

SEQ ID NO: 383960 - DNA, 25 bp, Homo sapien
aattgcatccacgttttcttttctt

SEQ ID NO: 383961 - DNA, 25 bp, Homo sapien
gtgtttggagaattcgagtgcctag

SEQ ID NO: 383962 - DNA, 25 bp, Homo sapien
attcgagtgcctaggatgccagacc

SEQ ID NO: 383963 - DNA, 25 bp, Homo sapien
gatgccagaccagagttgagacaaa

SEQ ID NO: 383964 - DNA, 25 bp, Homo sapien
attttctgctttgtagttctgtact

SEQ ID NO: 383965 - DNA, 25 bp, Homo sapien
gtagttctgtacttttcgagagaag

SEQ ID NO: 383966 - DNA, 25 bp, Homo sapien
agatttctaaccctgcaacttttgc

SEQ ID NO: 383967 - DNA, 25 bp, Homo sapien
acttttgccaagctttattgccctg

SEQ ID NO: 383968 - DNA, 25 bp, Homo sapien
gtttgaataaatccagacccatgaa

SEQ ID NO: 383969 - DNA, 25 bp, Homo sapien
agagtactggcttccagcaactgga

SEQ ID NO: 383970 - DNA, 25 bp, Homo sapien
aagcatggtgggatatacacacaca

SEQ ID NO: 383971 - DNA, 25 bp, Homo sapien
gcaactggagcaaatacttgtgtat

SEQ ID NO: 383972 - DNA, 25 bp, Homo sapien
gaggcctaagtctgaaatgtcattg

SEQ ID NO: 383973 - DNA, 25 bp, Homo sapien
gtcattgtgaccaaatgcacacacc

SEQ ID NO: 383974 - DNA, 25 bp, Homo sapien
gcacacaccatcagcttgcattgaa

SEQ ID NO: 383975 - DNA, 25 bp, Homo sapien
tacacacacattgctaagtcccttg

SEQ ID NO: 383976 - DNA, 25 bp, Homo sapien
tcacagtctagcctgaaggcagata

SEQ ID NO: 383977 - DNA, 25 bp, Homo sapien
gaaggcagataattaagcagctcta

SEQ ID NO: 383978 - DNA, 25 bp, Homo sapien
aagcagctctaatacaagtttgaat

SEQ ID NO: 383979 - DNA, 25 bp, Homo sapien
aagtttcgatcattgatgctccgga

SEQ ID NO: 383980 - DNA, 25 bp, Homo sapien
atgctccggacatctcatctttaaa

SEQ ID NO: 383981 - DNA, 25 bp, Homo sapien
gttagaaaacacatctgtacaggcc

SEQ ID NO: 383982 - DNA, 25 bp, Homo sapien
tggtgacaccactgggcttttacac

SEQ ID NO: 383983 - DNA, 25 bp, Homo sapien
cactgggcttttacactaagaatga

SEQ ID NO: 383984 - DNA, 25 bp, Homo sapien
gctgagcaccatccaaaacaatttt

SEQ ID NO: 383985 - DNA, 25 bp, Homo sapien
ggaggcaggcctttcagaccggatt

SEQ ID NO: 383986 - DNA, 25 bp, Homo sapien
caggcctttcagaccggatttagtg

SEQ ID NO: 383987 - DNA, 25 bp, Homo sapien
accggatttagtgagcagtcagtaa

SEQ ID NO: 383988 - DNA, 25 bp, Homo sapien
cagtcagtaacccagagcttcttgt

SEQ ID NO: 383989 - DNA, 25 bp, Homo sapien
ccagagcttcttgtctgagagcaga

SEQ ID NO: 383990 - DNA, 25 bp, Homo sapien
ctgacttctgggaactgctttgcat

SEQ ID NO: 383991 - DNA, 25 bp, Homo sapien
aactgctttgcatttctcctataga

SEQ ID NO: 383992 - DNA, 25 bp, Homo sapien
gcatttctcctatagatctgtagtt

SEQ ID NO: 383993 - DNA, 25 bp, Homo sapien
agatctgtagttaagggaaccaagg

SEQ ID NO: 383994 - DNA, 25 bp, Homo sapien
tgtttctcaaagctccttgattaag

SEQ ID NO: 383995 - DNA, 25 bp, Homo sapien
aagtttgtttgagggcagtagctca

SEQ ID NO: 383996 - DNA, 25 bp, Homo sapien
aaaatcctgaagtttctgttgaagc

SEQ ID NO: 383997 - DNA, 25 bp, Homo sapien
ctgttgaagccatacaatgttctat

SEQ ID NO: 383998 - DNA, 25 bp, Homo sapien
ctctaagacattctctgaggtgtgt

SEQ ID NO: 383999 - DNA, 25 bp, Homo sapien
gtgaggaagtcactactcctagcct

SEQ ID NO: 384000 - DNA, 25 bp, Homo sapien
aagtcactactcctagcctttgtta

SEQ ID NO: 384001 - DNA, 25 bp, Homo sapien
tctctcctttcctgaagatatgaaa

SEQ ID NO: 384002 - DNA, 25 bp, Homo sapien
gatatgaaaatcagtcttggcccat

SEQ ID NO: 384003 - DNA, 25 bp, Homo sapien
gaaaatcagtcttggcccatttgaa

SEQ ID NO: 384004 - DNA, 25 bp, Homo sapien
gtcttggcccatttgaattaaagta

SEQ ID NO: 384005 - DNA, 25 bp, Homo sapien
aaaatggaaaatactcagcctctct

SEQ ID NO: 384006 - DNA, 25 bp, Homo sapien
gggaatctgttctctaaaaggcttt

SEQ ID NO: 384007 - DNA, 25 bp, Homo sapien
tctaaaaggcttttcacatgctgaa

SEQ ID NO: 384008 - DNA, 25 bp, Homo sapien
ggcttttcacatgctgaattggcaa

SEQ ID NO: 384009 - DNA, 25 bp, Homo sapien
caggaagttgaataagcatgagcac

SEQ ID NO: 384010 - DNA, 25 bp, Homo sapien
aataagcatgagcacagattttcag

SEQ ID NO: 384011 - DNA, 25 bp, Homo sapien
aggcattttattttgtccattatag

SEQ ID NO: 384012 - DNA, 25 bp, Homo sapien
gagtttaccactctccagaagatag

SEQ ID NO: 384013 - DNA, 25 bp, Homo sapien
tctccagaagatagtgctgcacgaa

SEQ ID NO: 384014 - DNA, 25 bp, Homo sapien
gtagcccaggttaggaactcagcga

SEQ ID NO: 384015 - DNA, 25 bp, Homo sapien
aactcagcgactgaagccctcttgt

SEQ ID NO: 384016 - DNA, 25 bp, Homo sapien
gagaaggatatccagacagccctaa

SEQ ID NO: 384017 - DNA, 25 bp, Homo sapien
gacagccctaaataatgcatatggt

SEQ ID NO: 384018 - DNA, 25 bp, Homo sapien
atatggtaaaacattgcggcaacac

SEQ ID NO: 384019 - DNA, 25 bp, Homo sapien
attgcggcaacaccatggctgggta

SEQ ID NO: 384020 - DNA, 25 bp, Homo sapien
aacaccatggctgggtagttcgagg

SEQ ID NO: 384021 - DNA, 25 bp, Homo sapien
gtttttgcgttagctttaagggcag

SEQ ID NO: 384022 - DNA, 25 bp, Homo sapien
ttaagggcagctccatcctatgaag

SEQ ID NO: 384023 - DNA, 25 bp, Homo sapien
ccgaggccagtgtccagcaagatac

SEQ ID NO: 384024 - DNA, 25 bp, Homo sapien
gtgtccagcaagatacggtgcagca

SEQ ID NO: 384025 - DNA, 25 bp, Homo sapien
acggtgcagcaagagtatccaggga

SEQ ID NO: 384026 - DNA, 25 bp, Homo sapien
gaagaaggctgtcgtgttttgtcac

SEQ ID NO: 384027 - DNA, 25 bp, Homo sapien
tgtcgtgttttgtcacctgctttgc

SEQ ID NO: 384028 - DNA, 25 bp, Homo sapien
gcgagcttcggctctgctccggaga

SEQ ID NO: 384029 - DNA, 25 bp, Homo sapien
ttcagagtattcttcagcccatgca

SEQ ID NO: 384030 - DNA, 25 bp, Homo sapien
atgcactctctgtctgtgtagcttt

SEQ ID NO: 384031 - DNA, 25 bp, Homo sapien
tgtgtagctttgtccctcatgcaag

SEQ ID NO: 384032 - DNA, 25 bp, Homo sapien
tgtccctcatgcaaggtgcagcttg

SEQ ID NO: 384033 - DNA, 25 bp, Homo sapien
ttgcccatggctatcccgaggccag

SEQ ID NO: 384034 - DNA, 25 bp, Homo sapien
accaggaggcctgcacgttgaagag

SEQ ID NO: 384035 - DNA, 25 bp, Homo sapien
aggactgccccatcagcagagtgga

SEQ ID NO: 384036 - DNA, 25 bp, Homo sapien
agcagagtggacacgtttccccagc

SEQ ID NO: 384037 - DNA, 25 bp, Homo sapien
tggcccctgaggtctggaaatgtga

SEQ ID NO: 384038 - DNA, 25 bp, Homo sapien
tggaaatgtgactctcagcctgcct

SEQ ID NO: 384039 - DNA, 25 bp, Homo sapien
ccgtgtgcctttttctgacccaaat

SEQ ID NO: 384040 - DNA, 25 bp, Homo sapien
tgtgcctttttctgacccaaatctc

SEQ ID NO: 384041 - DNA, 25 bp, Homo sapien
atctcatggtttctggggccaaaat

SEQ ID NO: 384042 - DNA, 25 bp, Homo sapien
tttcctgcctcccaatagctataaa

SEQ ID NO: 384043 - DNA, 25 bp, Homo sapien
tcctgcctcccaatagctataaaaa

SEQ ID NO: 384044 - DNA, 25 bp, Homo sapien
ttggtaaagccaagcataatgaatg

SEQ ID NO: 384045 - DNA, 25 bp, Homo sapien
tcagaggctccagcatctctagtac

SEQ ID NO: 384046 - DNA, 25 bp, Homo sapien
gtatgagagtcgtaggacccttaca

SEQ ID NO: 384047 - DNA, 25 bp, Homo sapien
taggacccttacaagacccaacaag

SEQ ID NO: 384048 - DNA, 25 bp, Homo sapien
acaagccactcgatgcatttttcta

SEQ ID NO: 384049 - DNA, 25 bp, Homo sapien
gatgcatttttctatcacattctca

SEQ ID NO: 384050 - DNA, 25 bp, Homo sapien
tatcacattctcaatagttccagct

SEQ ID NO: 384051 - DNA, 25 bp, Homo sapien
tagttccagctcaggatgaaaggat

SEQ ID NO: 384052 - DNA, 25 bp, Homo sapien
ggcctggctccaacctaaagcctga

SEQ ID NO: 384053 - DNA, 25 bp, Homo sapien
taaagcctgactgtcacgtgccttg

SEQ ID NO: 384054 - DNA, 25 bp, Homo sapien
acgtgccttgcttgattttatatat

SEQ ID NO: 384055 - DNA, 25 bp, Homo sapien
gtttcaagaatagtccaatatagca

SEQ ID NO: 384056 - DNA, 25 bp, Homo sapien
atgttctggcatcctccctgtggat

SEQ ID NO: 384057 - DNA, 25 bp, Homo sapien
gttctggcatcctccctgtggattt

SEQ ID NO: 384058 - DNA, 25 bp, Homo sapien
ggctgtggtagagtcacctatgaga

SEQ ID NO: 384059 - DNA, 25 bp, Homo sapien
gtggtagagtcacctatgagatcct

SEQ ID NO: 384060 - DNA, 25 bp, Homo sapien
gtagagtcacctatgagatcctgga

SEQ ID NO: 384061 - DNA, 25 bp, Homo sapien
gagtcacctatgagatcctggagta

SEQ ID NO: 384062 - DNA, 25 bp, Homo sapien
gtcacctatgagatcctggagtagt

SEQ ID NO: 384063 - DNA, 25 bp, Homo sapien
acctatgagatcctggagtagtgga

SEQ ID NO: 384064 - DNA, 25 bp, Homo sapien
gtgaagacggaaactgagctcagta

SEQ ID NO: 384065 - DNA, 25 bp, Homo sapien
cggaaactgagctcagtatccgggt

SEQ ID NO: 384066 - DNA, 25 bp, Homo sapien
ccaggagacaaaggccctttgcttt

SEQ ID NO: 384067 - DNA, 25 bp, Homo sapien
tactgtccctttcacaccttgcctg

SEQ ID NO: 384068 - DNA, 25 bp, Homo sapien
ttgcctggccaaggggctagacctc

SEQ ID NO: 384069 - DNA, 25 bp, Homo sapien
caggctaagcctcagattcagtgca

SEQ ID NO: 384070 - DNA, 25 bp, Homo sapien
gattcagtgcaggacacaagctcat

SEQ ID NO: 384071 - DNA, 25 bp, Homo sapien
agtgcaggacacaagctcatgcccc

SEQ ID NO: 384072 - DNA, 25 bp, Homo sapien
cccgtcttgccagtgacacttgaag

SEQ ID NO: 384073 - DNA, 25 bp, Homo sapien
gtcttgccagtgacacttgaagcct

SEQ ID NO: 384074 - DNA, 25 bp, Homo sapien
tgccagtgacacttgaagcctcccg

SEQ ID NO: 384075 - DNA, 25 bp, Homo sapien
agtgacacttgaagcctcccgactt

SEQ ID NO: 384076 - DNA, 25 bp, Homo sapien
tgaagcctcccgacttccacagagt

SEQ ID NO: 384077 - DNA, 25 bp, Homo sapien
cttccacagagtgcttcaggacaca

SEQ ID NO: 384078 - DNA, 25 bp, Homo sapien
ccaggaggcctgcacgttgaagagg

SEQ ID NO: 384079 - DNA, 25 bp, Homo sapien
ggaggcctgcacgttgaagaggaag

SEQ ID NO: 384080 - DNA, 25 bp, Homo sapien
aggactgccccatcagcagagtgga

SEQ ID NO: 384081 - DNA, 25 bp, Homo sapien
ggactgccccatcagcagagtggac

SEQ ID NO: 384082 - DNA, 25 bp, Homo sapien
gccccatcagcagagtggacacgtt

SEQ ID NO: 384083 - DNA, 25 bp, Homo sapien
ccccatcagcagagtggacacgttt

SEQ ID NO: 384084 - DNA, 25 bp, Homo sapien
ccatcagcagagtggacacgtttcc

SEQ ID NO: 384085 - DNA, 25 bp, Homo sapien
atcagcagagtggacacgtttcccc

SEQ ID NO: 384086 - DNA, 25 bp, Homo sapien
tcagcagagtggacacgtttcccca

SEQ ID NO: 384087 - DNA, 25 bp, Homo sapien
agcagagtggacacgtttccccagc

SEQ ID NO: 384088 - DNA, 25 bp, Homo sapien
gcagagtggacacgtttccccagcc

SEQ ID NO: 384089 - DNA, 25 bp, Homo sapien
gacacagatgctggtggccacacct

SEQ ID NO: 384090 - DNA, 25 bp, Homo sapien
acacctactcgggtcattccaaggg

SEQ ID NO: 384091 - DNA, 25 bp, Homo sapien
attccaagggcatcctgtggagcag

SEQ ID NO: 384092 - DNA, 25 bp, Homo sapien
gggctgtatgacatttctgtaacct

SEQ ID NO: 384093 - DNA, 25 bp, Homo sapien
aacctgtcttggctctgtacttcct

SEQ ID NO: 384094 - DNA, 25 bp, Homo sapien
cttggctctgtacttcctgattaca

SEQ ID NO: 384095 - DNA, 25 bp, Homo sapien
ttacaatttggcttcccatgtggat

SEQ ID NO: 384096 - DNA, 25 bp, Homo sapien
gcttcccatgtggatgtgccaacag

SEQ ID NO: 384097 - DNA, 25 bp, Homo sapien
gtgccaacagggacaaagtgtatat

SEQ ID NO: 384098 - DNA, 25 bp, Homo sapien
aagtgtatatgtcaactgtgtccat

SEQ ID NO: 384099 - DNA, 25 bp, Homo sapien
atatgtcaactgtgtccatctgtac

SEQ ID NO: 384100 - DNA, 25 bp, Homo sapien
cgagcccctcattaccagtgaagga

SEQ ID NO: 384101 - DNA, 25 bp, Homo sapien
agcccctcattaccagtgaaggaca

SEQ ID NO: 384102 - DNA, 25 bp, Homo sapien
gcccctcattaccagtgaaggacat

SEQ ID NO: 384103 - DNA, 25 bp, Homo sapien
ggttcgggaagctcctcatctgagg

SEQ ID NO: 384104 - DNA, 25 bp, Homo sapien
gttcgggaagctcctcatctgaggc

SEQ ID NO: 384105 - DNA, 25 bp, Homo sapien
ggcctgcctttttgggactcagatg

SEQ ID NO: 384106 - DNA, 25 bp, Homo sapien
cctttttgggactcagatggcagga

SEQ ID NO: 384107 - DNA, 25 bp, Homo sapien
gactcagatggcaggaggtccaccc

SEQ ID NO: 384108 - DNA, 25 bp, Homo sapien
cccactttggtgctaatagctctcc

SEQ ID NO: 384109 - DNA, 25 bp, Homo sapien
gacccctcactttgtgcctttagta

SEQ ID NO: 384110 - DNA, 25 bp, Homo sapien
tgcctttagtaaacactgtgctttg

SEQ ID NO: 384111 - DNA, 25 bp, Homo sapien
tgtgccagagacgtgtctgcaccaa

SEQ ID NO: 384112 - DNA, 25 bp, Homo sapien
gagacgtgtctgcaccaagttcagc

SEQ ID NO: 384113 - DNA, 25 bp, Homo sapien
tgtctgcaccaagttcagccatcag

SEQ ID NO: 384114 - DNA, 25 bp, Homo sapien
cagccatcagtatgatgacctccca

SEQ ID NO: 384115 - DNA, 25 bp, Homo sapien
tcagtatgatgacctcccagaagta

SEQ ID NO: 384116 - DNA, 25 bp, Homo sapien
gtatgatgacctcccagaagtaggg

SEQ ID NO: 384117 - DNA, 25 bp, Homo sapien
gaacaggttaaaacttcccctgctg

SEQ ID NO: 384118 - DNA, 25 bp, Homo sapien
aggttaaaacttcccctgctgatca

SEQ ID NO: 384119 - DNA, 25 bp, Homo sapien
aaacttcccctgctgatcagtagtg

SEQ ID NO: 384120 - DNA, 25 bp, Homo sapien
aaacattccaagattcccatgcaga

SEQ ID NO: 384121 - DNA, 25 bp, Homo sapien
aagattcccatgcagaagggttaga

SEQ ID NO: 384122 - DNA, 25 bp, Homo sapien
aataacaccccaagctacaggaagt

SEQ ID NO: 384123 - DNA, 25 bp, Homo sapien
aacaccccaagctacaggaagtgag

SEQ ID NO: 384124 - DNA, 25 bp, Homo sapien
ctacaggaagtgaggcctctgatgg

SEQ ID NO: 384125 - DNA, 25 bp, Homo sapien
gaatctataaaacaagctgacaata

SEQ ID NO: 384126 - DNA, 25 bp, Homo sapien
ggaggtagtgacacaggctgtggga

SEQ ID NO: 384127 - DNA, 25 bp, Homo sapien
aagtctgtggtgagcaaagtttgcc

SEQ ID NO: 384128 - DNA, 25 bp, Homo sapien
gcaaagtttgccttattacactgat

SEQ ID NO: 384129 - DNA, 25 bp, Homo sapien
gtttgccttattacactgataaagt

SEQ ID NO: 384130 - DNA, 25 bp, Homo sapien
aattacactaataaagctggatcac

SEQ ID NO: 384131 - DNA, 25 bp, Homo sapien
attttttaatgtgggccagatggca

SEQ ID NO: 384132 - DNA, 25 bp, Homo sapien
gaagcttaaataacaccccaagcta

SEQ ID NO: 384133 - DNA, 25 bp, Homo sapien
gtcacctgggccctcgacgatgagc

SEQ ID NO: 384134 - DNA, 25 bp, Homo sapien
ggccctcgacgatgagcccatcgtg

SEQ ID NO: 384135 - DNA, 25 bp, Homo sapien
atcgtgcgggatggcagccaccgca

SEQ ID NO: 384136 - DNA, 25 bp, Homo sapien
gcaccaaccagtacaccatgtcgga

SEQ ID NO: 384137 - DNA, 25 bp, Homo sapien
aaccagtacaccatgtcggacggca

SEQ ID NO: 384138 - DNA, 25 bp, Homo sapien
agtacaccatgtcggacggcaccac

SEQ ID NO: 384139 - DNA, 25 bp, Homo sapien
accatcagccacatgaacgtcacag

SEQ ID NO: 384140 - DNA, 25 bp, Homo sapien
atcagccacatgaacgtcacaggcc

SEQ ID NO: 384141 - DNA, 25 bp, Homo sapien
tgtaccggtgcacagcgcggaactt

SEQ ID NO: 384142 - DNA, 25 bp, Homo sapien
aacttggtgggcagtgctgaatatc

SEQ ID NO: 384143 - DNA, 25 bp, Homo sapien
atatcaggcgcgaataaacgtaaga

SEQ ID NO: 384144 - DNA, 25 bp, Homo sapien
agctcctagggaccatgcagctgac

SEQ ID NO: 384145 - DNA, 25 bp, Homo sapien
atgcagctgacctgctccaaggcac

SEQ ID NO: 384146 - DNA, 25 bp, Homo sapien
caaaatcctggagccggcaccaggg

SEQ ID NO: 384147 - DNA, 25 bp, Homo sapien
agggcatgtcccacgagactgttag

SEQ ID NO: 384148 - DNA, 25 bp, Homo sapien
gtcccacgagactgttaggagggct

SEQ ID NO: 384149 - DNA, 25 bp, Homo sapien
ttgccccttggttgctcattgagaa

SEQ ID NO: 384150 - DNA, 25 bp, Homo sapien
agaagcagtatagggcttccatgcc

SEQ ID NO: 384151 - DNA, 25 bp, Homo sapien
tttggcctcccctggatccctgtag

SEQ ID NO: 384152 - DNA, 25 bp, Homo sapien
tcctttggtgcctttctcagagtac

SEQ ID NO: 384153 - DNA, 25 bp, Homo sapien
ggtgcctttctcagagtacatggac

SEQ ID NO: 384154 - DNA, 25 bp, Homo sapien
agagtacatggacttccttctgcca

SEQ ID NO: 384155 - DNA, 25 bp, Homo sapien
aagccgggctttctaatccacgtca

SEQ ID NO: 384156 - DNA, 25 bp, Homo sapien
gctttctaatccacgtcaactttat

SEQ ID NO: 384157 - DNA, 25 bp, Homo sapien
gaaatttaagaatccgtgttgcatg

SEQ ID NO: 384158 - DNA, 25 bp, Homo sapien
tgttgcatgtttggtagctctctga

SEQ ID NO: 384159 - DNA, 25 bp, Homo sapien
gtttcaggccataaactcagctcca

SEQ ID NO: 384160 - DNA, 25 bp, Homo sapien
cagctccagaggttaccttttaagt

SEQ ID NO: 384161 - DNA, 25 bp, Homo sapien
taccttttaagtgccaagaactcaa

SEQ ID NO: 384162 - DNA, 25 bp, Homo sapien
gaactcaagtgcaaggtggcctact

SEQ ID NO: 384163 - DNA, 25 bp, Homo sapien
aaggtggcctactcaaaaatcattt

SEQ ID NO: 384164 - DNA, 25 bp, Homo sapien
catttggtagcattcagttattcat

SEQ ID NO: 384165 - DNA, 25 bp, Homo sapien
gaattcctctctcgcatgcattata

SEQ ID NO: 384166 - DNA, 25 bp, Homo sapien
gctacaggaatgtccccagaagggt

SEQ ID NO: 384167 - DNA, 25 bp, Homo sapien
gcatgccttggaacctttacctaga

SEQ ID NO: 384168 - DNA, 25 bp, Homo sapien
ttatcctgggtccttaccttgggag

SEQ ID NO: 384169 - DNA, 25 bp, Homo sapien
ggacctctacctaagggatctacct

SEQ ID NO: 384170 - DNA, 25 bp, Homo sapien
ggatctacctgggttacttacatga

SEQ ID NO: 384171 - DNA, 25 bp, Homo sapien
gagagtagttactggagtcttaaat

SEQ ID NO: 384172 - DNA, 25 bp, Homo sapien
gagtcttaaatagagggttacctgc

SEQ ID NO: 384173 - DNA, 25 bp, Homo sapien
atcagcccgtagtccattgcccatt

SEQ ID NO: 384174 - DNA, 25 bp, Homo sapien
attgcccattgccaggcggactgta

SEQ ID NO: 384175 - DNA, 25 bp, Homo sapien
gactgtatgtgtccggtcctctggt

SEQ ID NO: 384176 - DNA, 25 bp, Homo sapien
ggtcctctggttgctacaggaatgt

SEQ ID NO: 384177 - DNA, 25 bp, Homo sapien
gatctagcccttggctacgcaggaa

SEQ ID NO: 384178 - DNA, 25 bp, Homo sapien
ttggctacgcaggaacggtgcgccc

SEQ ID NO: 384179 - DNA, 25 bp, Homo sapien
gttcagcaggcaggcgtcaggttct

SEQ ID NO: 384180 - DNA, 25 bp, Homo sapien
gtcaggttctaccaaggcgctgaaa

SEQ ID NO: 384181 - DNA, 25 bp, Homo sapien
taccaaggcgctgaaatgagcccat

SEQ ID NO: 384182 - DNA, 25 bp, Homo sapien
atgagcccatcagcgggtaggagcc

SEQ ID NO: 384183 - DNA, 25 bp, Homo sapien
ccagcgtggattttaattgcctcaa

SEQ ID NO: 384184 - DNA, 25 bp, Homo sapien
cccaggctcgtgaacggcgcctgat

SEQ ID NO: 384185 - DNA, 25 bp, Homo sapien
gcgagctctcgaggtcgcagtgacc

SEQ ID NO: 384186 - DNA, 25 bp, Homo sapien
attgcctcaatcagcagtcattctc

SEQ ID NO: 384187 - DNA, 25 bp, Homo sapien
cctggacggtgggtcccgcgatcta

SEQ ID NO: 384188 - DNA, 25 bp, Homo sapien
aacttttttcatgtatgtgactgta

SEQ ID NO: 384189 - DNA, 25 bp, Homo sapien
gactgtatgttctgagtcacagcat

SEQ ID NO: 384190 - DNA, 25 bp, Homo sapien
gttctgagtcacagcataaagtgta

SEQ ID NO: 384191 - DNA, 25 bp, Homo sapien
gtgtaatttttactgtgggcaatac

SEQ ID NO: 384192 - DNA, 25 bp, Homo sapien
gtgggcaatacatatcggagaagtt

SEQ ID NO: 384193 - DNA, 25 bp, Homo sapien
aggatgctgaacaagatcatttctt

SEQ ID NO: 384194 - DNA, 25 bp, Homo sapien
atcatttcttcagcctcatgattct

SEQ ID NO: 384195 - DNA, 25 bp, Homo sapien
agtagttcctgacccatcagatcca

SEQ ID NO: 384196 - DNA, 25 bp, Homo sapien
ttcctgacccatcagatccattcag

SEQ ID NO: 384197 - DNA, 25 bp, Homo sapien
agatccattcagtggctcatgtgca

SEQ ID NO: 384198 - DNA, 25 bp, Homo sapien
cagtggctcatgtgcagctttcata

SEQ ID NO: 384199 - DNA, 25 bp, Homo sapien
agagactggcatgactgcgtttcca

SEQ ID NO: 384200 - DNA, 25 bp, Homo sapien
gactgcgtttccactcattgatagt

SEQ ID NO: 384201 - DNA, 25 bp, Homo sapien
attccgggacgccacaagatacatg

SEQ ID NO: 384202 - DNA, 25 bp, Homo sapien
tttcatgtctgaatcgggacccagc

SEQ ID NO: 384203 - DNA, 25 bp, Homo sapien
gggacccagctcgagtagtagttgt

SEQ ID NO: 384204 - DNA, 25 bp, Homo sapien
tgcagccctataacggcgttgccct

SEQ ID NO: 384205 - DNA, 25 bp, Homo sapien
gccctgggacggcaactctgatgac

SEQ ID NO: 384206 - DNA, 25 bp, Homo sapien
ggcaactctgatgaccgggtcttgt

SEQ ID NO: 384207 - DNA, 25 bp, Homo sapien
accgggtcttgttggatctgtctgc

SEQ ID NO: 384208 - DNA, 25 bp, Homo sapien
ttggatctgtctgccttcctcaaga

SEQ ID NO: 384209 - DNA, 25 bp, Homo sapien
ttcctcaagaccattgcactgaatg

SEQ ID NO: 384210 - DNA, 25 bp, Homo sapien
atgtgcacacaactgcagagcttaa

SEQ ID NO: 384211 - DNA, 25 bp, Homo sapien
actgcagagcttaatgccacaacct

SEQ ID NO: 384212 - DNA, 25 bp, Homo sapien
taatgccacaacctccaggagattg

SEQ ID NO: 384213 - DNA, 25 bp, Homo sapien
tggagaaatggctgcagtttgctgc

SEQ ID NO: 384214 - DNA, 25 bp, Homo sapien
ctgcagtttgctgcccatcagcttt

SEQ ID NO: 384215 - DNA, 25 bp, Homo sapien
ggcagacattgcagacgtagtttta

SEQ ID NO: 384216 - DNA, 25 bp, Homo sapien
gttccataaagcatcgccaaggcag

SEQ ID NO: 384217 - DNA, 25 bp, Homo sapien
aaggcagcatgcctgtgcgacacac

SEQ ID NO: 384218 - DNA, 25 bp, Homo sapien
cctgtgcgacacacgcagggctttg

SEQ ID NO: 384219 - DNA, 25 bp, Homo sapien
gtgttttccccgtattaacagcaag

SEQ ID NO: 384220 - DNA, 25 bp, Homo sapien
aacagcaagtcgttgaagcgttgag

SEQ ID NO: 384221 - DNA, 25 bp, Homo sapien
tggagttagttcattcttctcgccc

SEQ ID NO: 384222 - DNA, 25 bp, Homo sapien
cccctggaacttctgatcaaaagtc

SEQ ID NO: 384223 - DNA, 25 bp, Homo sapien
agtcaatacctttgtgacctacaag

SEQ ID NO: 384224 - DNA, 25 bp, Homo sapien
gacctacaagtctctttatttgccc

SEQ ID NO: 384225 - DNA, 25 bp, Homo sapien
aagtctctttatttgccctccatta

SEQ ID NO: 384226 - DNA, 25 bp, Homo sapien
ttatttgccctccattatagactga

SEQ ID NO: 384227 - DNA, 25 bp, Homo sapien
cctccattatagactgagctgttaa

SEQ ID NO: 384228 - DNA, 25 bp, Homo sapien
ataacatttaatgagctcacatgga

SEQ ID NO: 384229 - DNA, 25 bp, Homo sapien
gctcacatggattcactggctaata

SEQ ID NO: 384230 - DNA, 25 bp, Homo sapien
gagttgaggacattgctgccctgtt

SEQ ID NO: 384231 - DNA, 25 bp, Homo sapien
ttgaggacattgctgccctgtttat

SEQ ID NO: 384232 - DNA, 25 bp, Homo sapien
atggtggcagtggtaaaatccttct

SEQ ID NO: 384233 - DNA, 25 bp, Homo sapien
gcagtggtaaaatccttctccagga

SEQ ID NO: 384234 - DNA, 25 bp, Homo sapien
aaatctgtccttggcccaatgtgta

SEQ ID NO: 384235 - DNA, 25 bp, Homo sapien
ggcccaatgtgtaaacacttgctga

SEQ ID NO: 384236 - DNA, 25 bp, Homo sapien
gaaaccagcaacttgttcacaattc

SEQ ID NO: 384237 - DNA, 25 bp, Homo sapien
gcaacttgttcacaattcttctgaa

SEQ ID NO: 384238 - DNA, 25 bp, Homo sapien
aattcttctgaatttcttgggaaat

SEQ ID NO: 384239 - DNA, 25 bp, Homo sapien
atttgaagtggagtacctgtaccaa

SEQ ID NO: 384240 - DNA, 25 bp, Homo sapien
ggagtacctgtaccaacatgaaatg

SEQ ID NO: 384241 - DNA, 25 bp, Homo sapien
gacacgaatttaagtgacgctcaac

SEQ ID NO: 384242 - DNA, 25 bp, Homo sapien
ttaagtgacgctcaacaacgaaaag

SEQ ID NO: 384243 - DNA, 25 bp, Homo sapien
gagacactaagtggcaaccaaaaca

SEQ ID NO: 384244 - DNA, 25 bp, Homo sapien
gccaaccagctgaaaacctctacat

SEQ ID NO: 384245 - DNA, 25 bp, Homo sapien
tgaaaacctctacattgcccttgac

SEQ ID NO: 384246 - DNA, 25 bp, Homo sapien
tgcccttgacctcacttgggaggaa

SEQ ID NO: 384247 - DNA, 25 bp, Homo sapien
gataagggcaggactctccagcgga

SEQ ID NO: 384248 - DNA, 25 bp, Homo sapien
agacagatgccaagggaaaccctgc

SEQ ID NO: 384249 - DNA, 25 bp, Homo sapien
ctgccagctccgctagcaaaggaaa

SEQ ID NO: 384250 - DNA, 25 bp, Homo sapien
gcggacctccacaagtaacgaatcg

SEQ ID NO: 384251 - DNA, 25 bp, Homo sapien
gggatcaactgaaaaggccttttgg

SEQ ID NO: 384252 - DNA, 25 bp, Homo sapien
cttttggagcctttcgatctatcat

SEQ ID NO: 384253 - DNA, 25 bp, Homo sapien
gagcctttcgatctatcatggagac

SEQ ID NO: 384254 - DNA, 25 bp, Homo sapien
atgttctggcatcctccctgtggat

SEQ ID NO: 384255 - DNA, 25 bp, Homo sapien
gcatcctccctgtggatttcccagt

SEQ ID NO: 384256 - DNA, 25 bp, Homo sapien
atttcccagtgcctgcagctcacag

SEQ ID NO: 384257 - DNA, 25 bp, Homo sapien
agtgcctgcagctcacaggcaacag

SEQ ID NO: 384258 - DNA, 25 bp, Homo sapien
tgcaccctatttggaatcttttatc

SEQ ID NO: 384259 - DNA, 25 bp, Homo sapien
ggctgtggtagagtcacctatgaga

SEQ ID NO: 384260 - DNA, 25 bp, Homo sapien
gtagagtcacctatgagatcctgga

SEQ ID NO: 384261 - DNA, 25 bp, Homo sapien
gtcacctatgagatcctggagtagt

SEQ ID NO: 384262 - DNA, 25 bp, Homo sapien
gtgaagacggaaactgagctcagta

SEQ ID NO: 384263 - DNA, 25 bp, Homo sapien
aactgagctcagtatccgggtgcca

SEQ ID NO: 384264 - DNA, 25 bp, Homo sapien
ccaggagacaaaggccctttgcttt

SEQ ID NO: 384265 - DNA, 25 bp, Homo sapien
gatgagctagtatcactgggtccta

SEQ ID NO: 384266 - DNA, 25 bp, Homo sapien
actgggtcctagtaagtttcagcaa

SEQ ID NO: 384267 - DNA, 25 bp, Homo sapien
gacagaactgtcatcattatcagaa

SEQ ID NO: 384268 - DNA, 25 bp, Homo sapien
gaccttaaagtctgtgttagtccct

SEQ ID NO: 384269 - DNA, 25 bp, Homo sapien
tagtcccttagcaccaccgctgaga

SEQ ID NO: 384270 - DNA, 25 bp, Homo sapien
ttagcaccaccgctgagattttgct

SEQ ID NO: 384271 - DNA, 25 bp, Homo sapien
agcaccaccgctgagattttgctga

SEQ ID NO: 384272 - DNA, 25 bp, Homo sapien
tgtgtgttgggcttcactgaaggaa

SEQ ID NO: 384273 - DNA, 25 bp, Homo sapien
tgaaggaagcccctgaaagtgttca

SEQ ID NO: 384274 - DNA, 25 bp, Homo sapien
gaaaatgagaaactgttccagctga

SEQ ID NO: 384275 - DNA, 25 bp, Homo sapien
gagaaactgttccagctgaaaatac

SEQ ID NO: 384276 - DNA, 25 bp, Homo sapien
ctggaagcccacttttatcgtgaaa

SEQ ID NO: 384277 - DNA, 25 bp, Homo sapien
tcagggtgatggaatctacctcatt

SEQ ID NO: 384278 - DNA, 25 bp, Homo sapien
atctacctcattaaagaccccagtg

SEQ ID NO: 384279 - DNA, 25 bp, Homo sapien
gctcaagtttgatattcgtctgtat

SEQ ID NO: 384280 - DNA, 25 bp, Homo sapien
gtctgtatgtcttactcaagtcctt

SEQ ID NO: 384281 - DNA, 25 bp, Homo sapien
tcaagtccttagaccccttagagat

SEQ ID NO: 384282 - DNA, 25 bp, Homo sapien
gaccccttagagatttatatagcca

SEQ ID NO: 384283 - DNA, 25 bp, Homo sapien
atatagccaaagacggactctctag

SEQ ID NO: 384284 - DNA, 25 bp, Homo sapien
gactctctaggttttgtaccgagcc

SEQ ID NO: 384285 - DNA, 25 bp, Homo sapien
tgtaccgagccatatcaggagccca

SEQ ID NO: 384286 - DNA, 25 bp, Homo sapien
ccaaaaacctggcaccgcatcttta

SEQ ID NO: 384287 - DNA, 25 bp, Homo sapien
tacaactctctgacttagtaggcac

SEQ ID NO: 384288 - DNA, 25 bp, Homo sapien
aactctctgacttagtaggcaccat

SEQ ID NO: 384289 - DNA, 25 bp, Homo sapien
tctctgacttagtaggcaccattag

SEQ ID NO: 384290 - DNA, 25 bp, Homo sapien
tgacttagtaggcaccattagactg

SEQ ID NO: 384291 - DNA, 25 bp, Homo sapien
gtaggcaccattagactgcttaata

SEQ ID NO: 384292 - DNA, 25 bp, Homo sapien
aattccatttattctttagcacagt

SEQ ID NO: 384293 - DNA, 25 bp, Homo sapien
gttgtagaagtcagttgtctcttaa

SEQ ID NO: 384294 - DNA, 25 bp, Homo sapien
tgtagaagtcagttgtctcttaaac

SEQ ID NO: 384295 - DNA, 25 bp, Homo sapien
ttctttagcacagtagatgctactg

SEQ ID NO: 384296 - DNA, 25 bp, Homo sapien
cagagcacaggagagaagaattaca

SEQ ID NO: 384297 - DNA, 25 bp, Homo sapien
aagaattacaactctctgacttagt

SEQ ID NO: 384298 - DNA, 25 bp, Homo sapien
aaagcaaatatagttcatgacctct

SEQ ID NO: 384299 - DNA, 25 bp, Homo sapien
gggactacagatgtacaccatcatg

SEQ ID NO: 384300 - DNA, 25 bp, Homo sapien
agatgtacaccatcatgcctagctc

SEQ ID NO: 384301 - DNA, 25 bp, Homo sapien
gtacaccatcatgcctagctcattt

SEQ ID NO: 384302 - DNA, 25 bp, Homo sapien
catcatgcctagctcatttttaaaa

SEQ ID NO: 384303 - DNA, 25 bp, Homo sapien
atttatcttctctttataaccaggg

SEQ ID NO: 384304 - DNA, 25 bp, Homo sapien
gttcatgacctctagcaactgttga

SEQ ID NO: 384305 - DNA, 25 bp, Homo sapien
gacctctagcaactgttgaaaactg

SEQ ID NO: 384306 - DNA, 25 bp, Homo sapien
ttgaaaactgctctttagggatgac

SEQ ID NO: 384307 - DNA, 25 bp, Homo sapien
aactgctctttagggatgacatgct

SEQ ID NO: 384308 - DNA, 25 bp, Homo sapien
tgctctttagggatgacatgctggc

SEQ ID NO: 384309 - DNA, 25 bp, Homo sapien
acacctggctaaagagactctggct

SEQ ID NO: 384310 - DNA, 25 bp, Homo sapien
agcggtcgtcgccaataccaaaatt

SEQ ID NO: 384311 - DNA, 25 bp, Homo sapien
gactctggctgaagaattccctgaa

SEQ ID NO: 384312 - DNA, 25 bp, Homo sapien
gtagctctaggttataacacagaac

SEQ ID NO: 384313 - DNA, 25 bp, Homo sapien
gaactccattcttgtaaatctctta

SEQ ID NO: 384314 - DNA, 25 bp, Homo sapien
gtaaatctcttagttgcttctttat

SEQ ID NO: 384315 - DNA, 25 bp, Homo sapien
gcttctttatttcatcttccctatt

SEQ ID NO: 384316 - DNA, 25 bp, Homo sapien
ccctattccatctaatgttccctga

SEQ ID NO: 384317 - DNA, 25 bp, Homo sapien
ggaaacacgataaccacagtcaata

SEQ ID NO: 384318 - DNA, 25 bp, Homo sapien
agtcaataaagaccaaggccacatt

SEQ ID NO: 384319 - DNA, 25 bp, Homo sapien
caaggccacattccattgaccagag

SEQ ID NO: 384320 - DNA, 25 bp, Homo sapien
catggcccaagggaggcttggcctt

SEQ ID NO: 384321 - DNA, 25 bp, Homo sapien
tggccttgggcttgccagcctcagc

SEQ ID NO: 384322 - DNA, 25 bp, Homo sapien
caaaaccttgggacctcagcagtcc

SEQ ID NO: 384323 - DNA, 25 bp, Homo sapien
gccctgacaagggtcttgtatccag

SEQ ID NO: 384324 - DNA, 25 bp, Homo sapien
acaagggtcttgtatccagggcaga

SEQ ID NO: 384325 - DNA, 25 bp, Homo sapien
ggtcttgtatccagggcagaggcct

SEQ ID NO: 384326 - DNA, 25 bp, Homo sapien
tgaggtgacccaggcttgctttgtg

SEQ ID NO: 384327 - DNA, 25 bp, Homo sapien
gacccaggcttgctttgtggctgat

SEQ ID NO: 384328 - DNA, 25 bp, Homo sapien
aggcttgctttgtggctgatgccag

SEQ ID NO: 384329 - DNA, 25 bp, Homo sapien
ctttgtggctgatgccagcaggctt

SEQ ID NO: 384330 - DNA, 25 bp, Homo sapien
gcagtcccaaggctgccctgacaat

SEQ ID NO: 384331 - DNA, 25 bp, Homo sapien
gcctctgtgtggattctgtggcacg

SEQ ID NO: 384332 - DNA, 25 bp, Homo sapien
gcacgggtgggatagtagcctgggc

SEQ ID NO: 384333 - DNA, 25 bp, Homo sapien
tcacccttacccaagtttcagtata

SEQ ID NO: 384334 - DNA, 25 bp, Homo sapien
aagtttcagtatacccattctggaa

SEQ ID NO: 384335 - DNA, 25 bp, Homo sapien
gtatacccattctggaataggacaa

SEQ ID NO: 384336 - DNA, 25 bp, Homo sapien
ggaataggacaaatctgcagacaaa

SEQ ID NO: 384337 - DNA, 25 bp, Homo sapien
gcagacaaaagcaaggatgggaata

SEQ ID NO: 384338 - DNA, 25 bp, Homo sapien
aggaactgaataatgcaaagcacac

SEQ ID NO: 384339 - DNA, 25 bp, Homo sapien
tgaataatgcaaagcacacactcca

SEQ ID NO: 384340 - DNA, 25 bp, Homo sapien
gcacacactccatttaattatgtgt

SEQ ID NO: 384341 - DNA, 25 bp, Homo sapien
gtgtagagagaggacttatctattt

SEQ ID NO: 384342 - DNA, 25 bp, Homo sapien
actctcacagtgtatacattcagga

SEQ ID NO: 384343 - DNA, 25 bp, Homo sapien
attcaggaggaacaagacacacagt

SEQ ID NO: 384344 - DNA, 25 bp, Homo sapien
aagacacacagtgccaagtaaataa

SEQ ID NO: 384345 - DNA, 25 bp, Homo sapien
ttaaagcatgtaatgttcccctttt

SEQ ID NO: 384346 - DNA, 25 bp, Homo sapien
tttagtgacaaaccccatgtgcttt

SEQ ID NO: 384347 - DNA, 25 bp, Homo sapien
cccatgtgctttcattgattttatg

SEQ ID NO: 384348 - DNA, 25 bp, Homo sapien
gagcatctgtcacgtggcagcactt

SEQ ID NO: 384349 - DNA, 25 bp, Homo sapien
gcagcacttgcctggatactggaga

SEQ ID NO: 384350 - DNA, 25 bp, Homo sapien
tgcctggatactggagagctgagaa

SEQ ID NO: 384351 - DNA, 25 bp, Homo sapien
gaatgcgacaggcaagtcctactct

SEQ ID NO: 384352 - DNA, 25 bp, Homo sapien
gcaagtcctactctcacagtgtata

SEQ ID NO: 384353 - DNA, 25 bp, Homo sapien
catggccggagcgaggtggtggacc

SEQ ID NO: 384354 - DNA, 25 bp, Homo sapien
aggtggtggacctgacgcggcgcgc

SEQ ID NO: 384355 - DNA, 25 bp, Homo sapien
agctcggcttcccaggcgtgctgca

SEQ ID NO: 384356 - DNA, 25 bp, Homo sapien
aggacggcgtcatcgacctgaccgt

SEQ ID NO: 384357 - DNA, 25 bp, Homo sapien
gggactccaagcagggctcgtccaa

SEQ ID NO: 384358 - DNA, 25 bp, Homo sapien
acggcgtcatcgacctgaccgtggg

SEQ ID NO: 384359 - DNA, 25 bp, Homo sapien
gcgtcatcgacctgaccgtgggcca

SEQ ID NO: 384360 - DNA, 25 bp, Homo sapien
ggctgcacaacgtgatccaccgcgc

SEQ ID NO: 384361 - DNA, 25 bp, Homo sapien
cgctgcacgcgcacgtcaaggcgga

SEQ ID NO: 384362 - DNA, 25 bp, Homo sapien
aagcagggctcgtccaagtccgcgg

SEQ ID NO: 384363 - DNA, 25 bp, Homo sapien
agggctcgtccaagtccgcggactc

SEQ ID NO: 384364 - DNA, 25 bp, Homo sapien
atggcaaaaatctacagagaaactg

SEQ ID NO: 384365 - DNA, 25 bp, Homo sapien
gagaaactgaactggcaaaattaac

SEQ ID NO: 384366 - DNA, 25 bp, Homo sapien
ggagcaaaacagatgtgcagatcta

SEQ ID NO: 384367 - DNA, 25 bp, Homo sapien
gtgcagatctaactaaaacagagct

SEQ ID NO: 384368 - DNA, 25 bp, Homo sapien
aaacagagctatagtgaaacaaaat

SEQ ID NO: 384369 - DNA, 25 bp, Homo sapien
aagcatgtacattatctatcgttca

SEQ ID NO: 384370 - DNA, 25 bp, Homo sapien
aagacattaaagctattgatttgat

SEQ ID NO: 384371 - DNA, 25 bp, Homo sapien
ttttccatagcaagcaccaaaagct

SEQ ID NO: 384372 - DNA, 25 bp, Homo sapien
gtacattatctatcgttcatttaag

SEQ ID NO: 384373 - DNA, 25 bp, Homo sapien
aaaagcttatattcacagttcctgt

SEQ ID NO: 384374 - DNA, 25 bp, Homo sapien
gcttatattcacagttcctgtgttt

SEQ ID NO: 384375 - DNA, 25 bp, Homo sapien
ggttttgctatctgaggagtgacag

SEQ ID NO: 384376 - DNA, 25 bp, Homo sapien
aatctgtgtattaacgaacctgcac

SEQ ID NO: 384377 - DNA, 25 bp, Homo sapien
gaacctgcacagttcaaacttacat

SEQ ID NO: 384378 - DNA, 25 bp, Homo sapien
acttacatttttcaagggtcactgt

SEQ ID NO: 384379 - DNA, 25 bp, Homo sapien
catttttcaagggtcactgtgtgat

SEQ ID NO: 384380 - DNA, 25 bp, Homo sapien
gtcactgtgtgattggaatggacaa

SEQ ID NO: 384381 - DNA, 25 bp, Homo sapien
ttactgttcattaagtggaggtggt

SEQ ID NO: 384382 - DNA, 25 bp, Homo sapien
cattaagtggaggtggttttcataa

SEQ ID NO: 384383 - DNA, 25 bp, Homo sapien
aggtttacatccttgttgtctacac

SEQ ID NO: 384384 - DNA, 25 bp, Homo sapien
tacatccttgttgtctacacattga

SEQ ID NO: 384385 - DNA, 25 bp, Homo sapien
tccttgttgtctacacattgaatag

SEQ ID NO: 384386 - DNA, 25 bp, Homo sapien
ttatccccaacttttgccagaaagc

SEQ ID NO: 384387 - DNA, 25 bp, Homo sapien
gaaagattaaattctccaatgatat

SEQ ID NO: 384388 - DNA, 25 bp, Homo sapien
aaaaatatcaacctacatgcacttt

SEQ ID NO: 384389 - DNA, 25 bp, Homo sapien
atcaacctacatgcactttagaatg

SEQ ID NO: 384390 - DNA, 25 bp, Homo sapien
tgactattttaaactcgaagaccca

SEQ ID NO: 384391 - DNA, 25 bp, Homo sapien
taaactcgaagacccactattttga

SEQ ID NO: 384392 - DNA, 25 bp, Homo sapien
gaagacccactattttgagtatttt

SEQ ID NO: 384393 - DNA, 25 bp, Homo sapien
ttttttcctccttcaatctcaggct

SEQ ID NO: 384394 - DNA, 25 bp, Homo sapien
tcctccttcaatctcaggcttttct

SEQ ID NO: 384395 - DNA, 25 bp, Homo sapien
ttaagcagcctctgtaactcccttt

SEQ ID NO: 384396 - DNA, 25 bp, Homo sapien
ctgtaactcccttttgtccataggt

SEQ ID NO: 384397 - DNA, 25 bp, Homo sapien
aaccatggacaagtatattctgctg

SEQ ID NO: 384398 - DNA, 25 bp, Homo sapien
tggacaagtatattctgctgccaca

SEQ ID NO: 384399 - DNA, 25 bp, Homo sapien
attctgctgccacaaagactgtaaa

SEQ ID NO: 384400 - DNA, 25 bp, Homo sapien
ctgccacaaagactgtaaagtgctt

SEQ ID NO: 384401 - DNA, 25 bp, Homo sapien
gtaaagtgcttcatttcaacagctg

SEQ ID NO: 384402 - DNA, 25 bp, Homo sapien
gtgcttcatttcaacagctgaggca

SEQ ID NO: 384403 - DNA, 25 bp, Homo sapien
tttcaacagctgaggcaagccaagt

SEQ ID NO: 384404 - DNA, 25 bp, Homo sapien
gaggcaagccaagtgatcattaata

SEQ ID NO: 384405 - DNA, 25 bp, Homo sapien
ataaagcttttcttggttccttcag

SEQ ID NO: 384406 - DNA, 25 bp, Homo sapien
agcttttcttggttccttcagtggt

SEQ ID NO: 384407 - DNA, 25 bp, Homo sapien
tccttcagtggtgttggtagtaaaa

SEQ ID NO: 384408 - DNA, 25 bp, Homo sapien
cacattcctgatgagctccaggtgt

SEQ ID NO: 384409 - DNA, 25 bp, Homo sapien
atgagctccaggtgttcccatgctg

SEQ ID NO: 384410 - DNA, 25 bp, Homo sapien
cccctctgaccacacttagaataag

SEQ ID NO: 384411 - DNA, 25 bp, Homo sapien
tgagaactcagcctcttgattccaa

SEQ ID NO: 384412 - DNA, 25 bp, Homo sapien
actcagcctcttgattccaatttta

SEQ ID NO: 384413 - DNA, 25 bp, Homo sapien
taaacatgcaattgattcttgtaat

SEQ ID NO: 384414 - DNA, 25 bp, Homo sapien
attcttgtcaaaatgcatatcagta

SEQ ID NO: 384415 - DNA, 25 bp, Homo sapien
gtttgtaatcagtattggcatgctt

SEQ ID NO: 384416 - DNA, 25 bp, Homo sapien
tcagtattggcatgcttaaaagaat

SEQ ID NO: 384417 - DNA, 25 bp, Homo sapien
aagacttgctatatttgtcatttta

SEQ ID NO: 384418 - DNA, 25 bp, Homo sapien
ggaaagattttgcttaagctcataa

SEQ ID NO: 384419 - DNA, 25 bp, Homo sapien
attatagttgtgagcttctgcgcct

SEQ ID NO: 384420 - DNA, 25 bp, Homo sapien
tatagttgtgagcttctgcgcctgg

SEQ ID NO: 384421 - DNA, 25 bp, Homo sapien
atagttgtgagcttctgcgcctggc

SEQ ID NO: 384422 - DNA, 25 bp, Homo sapien
agttgtgagcttctgcgcctggcct

SEQ ID NO: 384423 - DNA, 25 bp, Homo sapien
gttgtgagcttctgcgcctggcctc

SEQ ID NO: 384424 - DNA, 25 bp, Homo sapien
ggcctcctggccgatttcgagtatt

SEQ ID NO: 384425 - DNA, 25 bp, Homo sapien
ctcctggccgatttcgagtatttgt

SEQ ID NO: 384426 - DNA, 25 bp, Homo sapien
cctggccgatttcgagtatttgtat

SEQ ID NO: 384427 - DNA, 25 bp, Homo sapien
tggccgatttcgagtatttgtatgt

SEQ ID NO: 384428 - DNA, 25 bp, Homo sapien
gccgatttcgagtatttgtatgtga

SEQ ID NO: 384429 - DNA, 25 bp, Homo sapien
atttcgagtatttgtatgtgaagac

SEQ ID NO: 384430 - DNA, 25 bp, Homo sapien
gcaccgtgtggagtgagacaggcgt

SEQ ID NO: 384431 - DNA, 25 bp, Homo sapien
gagacaggcgtgaaagacagcggct

SEQ ID NO: 384432 - DNA, 25 bp, Homo sapien
aaagacagcggctgcggccacccag

SEQ ID NO: 384433 - DNA, 25 bp, Homo sapien
gggcaaggcagaggcgctccaggtg

SEQ ID NO: 384434 - DNA, 25 bp, Homo sapien
aaggcagaggcgctccaggtggagg

SEQ ID NO: 384435 - DNA, 25 bp, Homo sapien
aaagaaatcctctcagcccgccttt

SEQ ID NO: 384436 - DNA, 25 bp, Homo sapien
agaccacgtccaacagcctgggact

SEQ ID NO: 384437 - DNA, 25 bp, Homo sapien
acgtccaacagcctgggactttcgg

SEQ ID NO: 384438 - DNA, 25 bp, Homo sapien
gtccaacagcctgggactttcggga

SEQ ID NO: 384439 - DNA, 25 bp, Homo sapien
acagcctgggactttcgggaccctg

SEQ ID NO: 384440 - DNA, 25 bp, Homo sapien
cagcctgggactttcgggaccctgg

SEQ ID NO: 384441 - DNA, 25 bp, Homo sapien
caggccctgtttcggatgccaactg

SEQ ID NO: 384442 - DNA, 25 bp, Homo sapien
tgtttcggatgccaactggcccact

SEQ ID NO: 384443 - DNA, 25 bp, Homo sapien
agcttgcgaccattggcactgggag

SEQ ID NO: 384444 - DNA, 25 bp, Homo sapien
gtcagttgggccttcataaacactc

SEQ ID NO: 384445 - DNA, 25 bp, Homo sapien
ccttcataaacactcacctggctgg

SEQ ID NO: 384446 - DNA, 25 bp, Homo sapien
aaatgtgtgcacagtctggaaaact

SEQ ID NO: 384447 - DNA, 25 bp, Homo sapien
aactgtcagaatcagttttcccata

SEQ ID NO: 384448 - DNA, 25 bp, Homo sapien
ggtgggctagcattgcagctgcatt

SEQ ID NO: 384449 - DNA, 25 bp, Homo sapien
ttgcagctgcatttgggaccattca

SEQ ID NO: 384450 - DNA, 25 bp, Homo sapien
ggaccattcaaatctgtcactctct

SEQ ID NO: 384451 - DNA, 25 bp, Homo sapien
gtcactctcttgtgtatattcctgt

SEQ ID NO: 384452 - DNA, 25 bp, Homo sapien
agctcctcccctgggatgaaaaagc

SEQ ID NO: 384453 - DNA, 25 bp, Homo sapien
cctcccctgggatgaaaaagcactc

SEQ ID NO: 384454 - DNA, 25 bp, Homo sapien
gggatgaaaaagcactctgacgtct

SEQ ID NO: 384455 - DNA, 25 bp, Homo sapien
cactctgacgtcttgaaagctggca

SEQ ID NO: 384456 - DNA, 25 bp, Homo sapien
gacgtcttgaaagctggcagctctc

SEQ ID NO: 384457 - DNA, 25 bp, Homo sapien
cagtgaaaaaatgtaccgacaagat

SEQ ID NO: 384458 - DNA, 25 bp, Homo sapien
tgtaccgacaagattactaagtaac

SEQ ID NO: 384459 - DNA, 25 bp, Homo sapien
ctcatccctcacaatgcgcggaaaa

SEQ ID NO: 384460 - DNA, 25 bp, Homo sapien
aatgcgcggaaaaccacaggcggct

SEQ ID NO: 384461 - DNA, 25 bp, Homo sapien
cggaaaaccacaggcggctgtgcgc

SEQ ID NO: 384462 - DNA, 25 bp, Homo sapien
ggctgtgcgcgcagcgtcggctcag

SEQ ID NO: 384463 - DNA, 25 bp, Homo sapien
gaaatatgtaatcccctggctgact

SEQ ID NO: 384464 - DNA, 25 bp, Homo sapien
taatcccctggctgactaggactgt

SEQ ID NO: 384465 - DNA, 25 bp, Homo sapien
ctggctgactaggactgttaaacat

SEQ ID NO: 384466 - DNA, 25 bp, Homo sapien
ctgttaaacatagtgtggactggat

SEQ ID NO: 384467 - DNA, 25 bp, Homo sapien
tggactggatgatgccttcgacaaa

SEQ ID NO: 384468 - DNA, 25 bp, Homo sapien
gatgatgccttcgacaaaccagaga

SEQ ID NO: 384469 - DNA, 25 bp, Homo sapien
ggaccctagaggagactctcattcg

SEQ ID NO: 384470 - DNA, 25 bp, Homo sapien
gaggagactctcattcgattttaaa

SEQ ID NO: 384471 - DNA, 25 bp, Homo sapien
gaagcacaacgggtcattttccttt

SEQ ID NO: 384472 - DNA, 25 bp, Homo sapien
caacgggtcattttcctttgtatgt

SEQ ID NO: 384473 - DNA, 25 bp, Homo sapien
ttcctagcgcagaactgtttctaaa

SEQ ID NO: 384474 - DNA, 25 bp, Homo sapien
atcaatcacagcaatgaccttggcg

SEQ ID NO: 384475 - DNA, 25 bp, Homo sapien
ttcctgttagctgtttcctttgata

SEQ ID NO: 384476 - DNA, 25 bp, Homo sapien
aatgaccttggcgagcatttgccct

SEQ ID NO: 384477 - DNA, 25 bp, Homo sapien
gagcatttgccctaaacgtgactgg

SEQ ID NO: 384478 - DNA, 25 bp, Homo sapien
acgtgactgggctcctgccaacaga

SEQ ID NO: 384479 - DNA, 25 bp, Homo sapien
gatattggcagtcattcctcatggg

SEQ ID NO: 384480 - DNA, 25 bp, Homo sapien
attcctcatgggtcagtgcaatcaa

SEQ ID NO: 384481 - DNA, 25 bp, Homo sapien
ggagtggtccttgctgattcacaaa

SEQ ID NO: 384482 - DNA, 25 bp, Homo sapien
agggtccacgatgtcgtaggaacca

SEQ ID NO: 384483 - DNA, 25 bp, Homo sapien
agaacacaccggcatccgccagagg

SEQ ID NO: 384484 - DNA, 25 bp, Homo sapien
tccgccagaggctgttaatcttatg

SEQ ID NO: 384485 - DNA, 25 bp, Homo sapien
gcacctggcctgcaatacagtattg

SEQ ID NO: 384486 - DNA, 25 bp, Homo sapien
cagtattgttaaccgtcttcaccat

SEQ ID NO: 384487 - DNA, 25 bp, Homo sapien
tgttaaccgtcttcaccatgttgta

SEQ ID NO: 384488 - DNA, 25 bp, Homo sapien
accgtcttcaccatgttgtacgtta

SEQ ID NO: 384489 - DNA, 25 bp, Homo sapien
ttcaccatgttgtacgttagagctc

SEQ ID NO: 384490 - DNA, 25 bp, Homo sapien
gttgtacgttagagctccagaaatt

SEQ ID NO: 384491 - DNA, 25 bp, Homo sapien
acgttagagctccagaaattattta

SEQ ID NO: 384492 - DNA, 25 bp, Homo sapien
cggcagccatttgtgcctctcggtt

SEQ ID NO: 384493 - DNA, 25 bp, Homo sapien
tgcctctcggttctctttattagct

SEQ ID NO: 384494 - DNA, 25 bp, Homo sapien
ctctttattagcttccattttgtgg

SEQ ID NO: 384495 - DNA, 25 bp, Homo sapien
attagcttccattttgtgggtcagt

SEQ ID NO: 384496 - DNA, 25 bp, Homo sapien
ttgttagttttttcaggcatataat

SEQ ID NO: 384497 - DNA, 25 bp, Homo sapien
gttagttttttcaggcatataatat

SEQ ID NO: 384498 - DNA, 25 bp, Homo sapien
atatatggcatattctgataagagg

SEQ ID NO: 384499 - DNA, 25 bp, Homo sapien
atatggcatattctgataagaggca

SEQ ID NO: 384500 - DNA, 25 bp, Homo sapien
tatggcatattctgataagaggcat

SEQ ID NO: 384501 - DNA, 25 bp, Homo sapien
tggcatattctgataagaggcatac

SEQ ID NO: 384502 - DNA, 25 bp, Homo sapien
ggcatattctgataagaggcataca

SEQ ID NO: 384503 - DNA, 25 bp, Homo sapien
gcatattctgataagaggcatacaa

SEQ ID NO: 384504 - DNA, 25 bp, Homo sapien
attctgataagaggcatacaatatg

SEQ ID NO: 384505 - DNA, 25 bp, Homo sapien
tatgaacagttcaattgtacagttt

SEQ ID NO: 384506 - DNA, 25 bp, Homo sapien
gaacagttcaattgtacagttttag

SEQ ID NO: 384507 - DNA, 25 bp, Homo sapien
ctggcccctgaggtctggaaatgtg

SEQ ID NO: 384508 - DNA, 25 bp, Homo sapien
tggcccctgaggtctggaaatgtga

SEQ ID NO: 384509 - DNA, 25 bp, Homo sapien
ccgtgtgcctttttctgacccaaat

SEQ ID NO: 384510 - DNA, 25 bp, Homo sapien
gtgtgcctttttctgacccaaatct

SEQ ID NO: 384511 - DNA, 25 bp, Homo sapien
tgtgcctttttctgacccaaatctc

SEQ ID NO: 384512 - DNA, 25 bp, Homo sapien
atctcatggtttctggggccaaaat

SEQ ID NO: 384513 - DNA, 25 bp, Homo sapien
tctggggccaaaattccctttcctg

SEQ ID NO: 384514 - DNA, 25 bp, Homo sapien
tttcctgcctcccaatagctataaa

SEQ ID NO: 384515 - DNA, 25 bp, Homo sapien
tcctgcctcccaatagctataaaaa

SEQ ID NO: 384516 - DNA, 25 bp, Homo sapien
tgcctcccaatagctataaaaaatt

SEQ ID NO: 384517 - DNA, 25 bp, Homo sapien
ttggtaaagccaagcataatgaatg

SEQ ID NO: 384518 - DNA, 25 bp, Homo sapien
gattttataatagctgattctctga

SEQ ID NO: 384519 - DNA, 25 bp, Homo sapien
gaagaatccctgagactttgtatga

SEQ ID NO: 384520 - DNA, 25 bp, Homo sapien
gtatagcagtggctttcgatgtgcc

SEQ ID NO: 384521 - DNA, 25 bp, Homo sapien
ttcgatgtgccaagtctacctcctc

SEQ ID NO: 384522 - DNA, 25 bp, Homo sapien
tgggacactcaagcaacacagatgt

SEQ ID NO: 384523 - DNA, 25 bp, Homo sapien
aacacagatgtacacgggaattttg

SEQ ID NO: 384524 - DNA, 25 bp, Homo sapien
tctatactgagaatactgcacacat

SEQ ID NO: 384525 - DNA, 25 bp, Homo sapien
gatatgaatgctctcctgggtaaaa

SEQ ID NO: 384526 - DNA, 25 bp, Homo sapien
tgggtaaaattaacctcctttgcat

SEQ ID NO: 384527 - DNA, 25 bp, Homo sapien
tcctttgcatttcattctcacattc

SEQ ID NO: 384528 - DNA, 25 bp, Homo sapien
tcattctcacattctcgcacaaaat

SEQ ID NO: 384529 - DNA, 25 bp, Homo sapien
ggtaccatatagtgttctctcttct

SEQ ID NO: 384530 - DNA, 25 bp, Homo sapien
ccatatagtgttctctcttctccca

SEQ ID NO: 384531 - DNA, 25 bp, Homo sapien
taaagtgttgtaaataagatggctc

SEQ ID NO: 384532 - DNA, 25 bp, Homo sapien
aagatggctcatgaaggtacagtga

SEQ ID NO: 384533 - DNA, 25 bp, Homo sapien
aggtacagtgagactgaccctcctg

SEQ ID NO: 384534 - DNA, 25 bp, Homo sapien
tgagactgaccctcctgtgtgcagg

SEQ ID NO: 384535 - DNA, 25 bp, Homo sapien
gtgtgcagggctaggccatccctct

SEQ ID NO: 384536 - DNA, 25 bp, Homo sapien
gccatccctctgcatggtgaagaga

SEQ ID NO: 384537 - DNA, 25 bp, Homo sapien
aactgaggtggcttaaggtcactgt

SEQ ID NO: 384538 - DNA, 25 bp, Homo sapien
ggcttaaggtcactgtgtttcagca

SEQ ID NO: 384539 - DNA, 25 bp, Homo sapien
gtgtttcagcagttgaatgttttca

SEQ ID NO: 384540 - DNA, 25 bp, Homo sapien
tcaatcaacagaatcaatagcagct

SEQ ID NO: 384541 - DNA, 25 bp, Homo sapien
aatagcagctgtgctcagtacctcg

SEQ ID NO: 384542 - DNA, 25 bp, Homo sapien
agtacctcgcgcttgtgtacgggtt

SEQ ID NO: 384543 - DNA, 25 bp, Homo sapien
cttgtgtacgggtttgcgactgaaa

SEQ ID NO: 384544 - DNA, 25 bp, Homo sapien
acgggtttgcgactgaaaagctcac

SEQ ID NO: 384545 - DNA, 25 bp, Homo sapien
aaagctcacagcctgtgggtgcttg

SEQ ID NO: 384546 - DNA, 25 bp, Homo sapien
tgggtgcttgttgctgcttttccac

SEQ ID NO: 384547 - DNA, 25 bp, Homo sapien
tgcttttccaccagtttgatttgaa

SEQ ID NO: 384548 - DNA, 25 bp, Homo sapien
gtgtgctgggtcagcaccacacgca

SEQ ID NO: 384549 - DNA, 25 bp, Homo sapien
agcaccacacgcacctggttttatt

SEQ ID NO: 384550 - DNA, 25 bp, Homo sapien
tggttttattattcatgcctcttta

SEQ ID NO: 384551 - DNA, 25 bp, Homo sapien
cattgaaagggaacccactgagggt

SEQ ID NO: 384552 - DNA, 25 bp, Homo sapien
tgtccctggaggctccgcccattag

SEQ ID NO: 384553 - DNA, 25 bp, Homo sapien
ggccttccgtggattcgctcattcg

SEQ ID NO: 384554 - DNA, 25 bp, Homo sapien
gattcgctcattcgctctgctaaaa

SEQ ID NO: 384555 - DNA, 25 bp, Homo sapien
gctcattcgctctgctaaaatggaa

SEQ ID NO: 384556 - DNA, 25 bp, Homo sapien
acccactgagggtacggattgcacc

SEQ ID NO: 384557 - DNA, 25 bp, Homo sapien
gctctgctaaaatggaatgactact

SEQ ID NO: 384558 - DNA, 25 bp, Homo sapien
gaatgactacttactagtagttgta

SEQ ID NO: 384559 - DNA, 25 bp, Homo sapien
tgagggtacggattgcacccgagcc

SEQ ID NO: 384560 - DNA, 25 bp, Homo sapien
gtacggattgcacccgagcctgaga

SEQ ID NO: 384561 - DNA, 25 bp, Homo sapien
acgtggcgaggtgggcaagggactc

SEQ ID NO: 384562 - DNA, 25 bp, Homo sapien
gttttatagcatcttcttcattcat

SEQ ID NO: 384563 - DNA, 25 bp, Homo sapien
tatgagctttgtaaggttcttcaag

SEQ ID NO: 384564 - DNA, 25 bp, Homo sapien
gttcttcaagttacccaagctgtca

SEQ ID NO: 384565 - DNA, 25 bp, Homo sapien
aagctgtcagtcagaccacccggca

SEQ ID NO: 384566 - DNA, 25 bp, Homo sapien
cggcagccgttgattctgtaggtca

SEQ ID NO: 384567 - DNA, 25 bp, Homo sapien
ctcaaggttttcaggtttgttacag

SEQ ID NO: 384568 - DNA, 25 bp, Homo sapien
atgtgcctctcatcttctatggtga

SEQ ID NO: 384569 - DNA, 25 bp, Homo sapien
atgttcttacaggtgctgaggacca

SEQ ID NO: 384570 - DNA, 25 bp, Homo sapien
aggaccaaactgaggcttccagcca

SEQ ID NO: 384571 - DNA, 25 bp, Homo sapien
agccacaccagcacatctctttatt

SEQ ID NO: 384572 - DNA, 25 bp, Homo sapien
tctctttatttgcagcctgaggctt

SEQ ID NO: 384573 - DNA, 25 bp, Homo sapien
ctgtcccccaggatgtcttgtggtg

SEQ ID NO: 384574 - DNA, 25 bp, Homo sapien
agggcaccccctgttgtaggcactg

SEQ ID NO: 384575 - DNA, 25 bp, Homo sapien
tgcccctcgagacactcttgggaga

SEQ ID NO: 384576 - DNA, 25 bp, Homo sapien
ctcgagacactcttgggagatgcat

SEQ ID NO: 384577 - DNA, 25 bp, Homo sapien
agacactcttgggagatgcattttc

SEQ ID NO: 384578 - DNA, 25 bp, Homo sapien
ttgggagatgcattttccgtctggc

SEQ ID NO: 384579 - DNA, 25 bp, Homo sapien
ggagatgcattttccgtctggctca

SEQ ID NO: 384580 - DNA, 25 bp, Homo sapien
tgcattttccgtctggctcacaggg

SEQ ID NO: 384581 - DNA, 25 bp, Homo sapien
tgccggcccctgcacatttaggata

SEQ ID NO: 384582 - DNA, 25 bp, Homo sapien
ggcccctgcacatttaggatatgct

SEQ ID NO: 384583 - DNA, 25 bp, Homo sapien
ctgcacatttaggatatgctcctgg

SEQ ID NO: 384584 - DNA, 25 bp, Homo sapien
agaaagttgcttaacctggccagaa

SEQ ID NO: 384585 - DNA, 25 bp, Homo sapien
gttgcttaacctggccagaagaaac

SEQ ID NO: 384586 - DNA, 25 bp, Homo sapien
agaaacaggaaaggcgtcttggagt

SEQ ID NO: 384587 - DNA, 25 bp, Homo sapien
aaaggcgtcttggagtaagatgtcc

SEQ ID NO: 384588 - DNA, 25 bp, Homo sapien
ggcaagcatgttgagaatcacacct

SEQ ID NO: 384589 - DNA, 25 bp, Homo sapien
tgttgagaatcacacctagcaggga

SEQ ID NO: 384590 - DNA, 25 bp, Homo sapien
gaatcacacctagcagggaggatat

SEQ ID NO: 384591 - DNA, 25 bp, Homo sapien
ctagcagggaggatattatgagcaa

SEQ ID NO: 384592 - DNA, 25 bp, Homo sapien
taagtgaaacgaactccttgccctt

SEQ ID NO: 384593 - DNA, 25 bp, Homo sapien
caagcaagtgaaagtgggatgtgta

SEQ ID NO: 384594 - DNA, 25 bp, Homo sapien
gagcaagataaagtcctgggcaggc

SEQ ID NO: 384595 - DNA, 25 bp, Homo sapien
gaagtttgggaatcactggttgaaa

SEQ ID NO: 384596 - DNA, 25 bp, Homo sapien
agggccacaccatagttctagtatt

SEQ ID NO: 384597 - DNA, 25 bp, Homo sapien
atttgattccaaataggctaggtag

SEQ ID NO: 384598 - DNA, 25 bp, Homo sapien
ggctaggtaggatccattgtctaac

SEQ ID NO: 384599 - DNA, 25 bp, Homo sapien
ggatccattgtctaacattggccat

SEQ ID NO: 384600 - DNA, 25 bp, Homo sapien
attggccatccaacttgtgtcataa

SEQ ID NO: 384601 - DNA, 25 bp, Homo sapien
gccatccaacttgtgtcataaggtt

SEQ ID NO: 384602 - DNA, 25 bp, Homo sapien
atagttctagtattttttggaggtg

SEQ ID NO: 384603 - DNA, 25 bp, Homo sapien
gggccaggaatgtacattttcaata

SEQ ID NO: 384604 - DNA, 25 bp, Homo sapien
cttaccagcttataagattctgaca

SEQ ID NO: 384605 - DNA, 25 bp, Homo sapien
gattctgacacacattgaagtttgg

SEQ ID NO: 384606 - DNA, 25 bp, Homo sapien
ccccagtggaaacactcatttgtct

SEQ ID NO: 384607 - DNA, 25 bp, Homo sapien
tggcgtaaccccagctcagctgagg

SEQ ID NO: 384608 - DNA, 25 bp, Homo sapien
gtaaccccagctcagctgaggcagt

SEQ ID NO: 384609 - DNA, 25 bp, Homo sapien
agcttggagttaactgtctgggatc

SEQ ID NO: 384610 - DNA, 25 bp, Homo sapien
ggatcaggccctctttggaatgaac

SEQ ID NO: 384611 - DNA, 25 bp, Homo sapien
ggccctctttggaatgaacgaccgc

SEQ ID NO: 384612 - DNA, 25 bp, Homo sapien
atgaacgaccgcttgcttggaggaa

SEQ ID NO: 384613 - DNA, 25 bp, Homo sapien
acgaccgcttgcttggaggaaccag

SEQ ID NO: 384614 - DNA, 25 bp, Homo sapien
accagacttggttcaaagggagaca

SEQ ID NO: 384615 - DNA, 25 bp, Homo sapien
acttggttcaaagggagacacagct

SEQ ID NO: 384616 - DNA, 25 bp, Homo sapien
agaaagtcctttccagccccaatct

SEQ ID NO: 384617 - DNA, 25 bp, Homo sapien
gacaaggtgccaggtgagccagccc

SEQ ID NO: 384618 - DNA, 25 bp, Homo sapien
tgcgccacagctcgttcatcatggt

SEQ ID NO: 384619 - DNA, 25 bp, Homo sapien
acagctcgttcatcatggtgggcgt

SEQ ID NO: 384620 - DNA, 25 bp, Homo sapien
tcgttcatcatggtgggcgttcaag

SEQ ID NO: 384621 - DNA, 25 bp, Homo sapien
atggtgggcgttcaaggtctttctc

SEQ ID NO: 384622 - DNA, 25 bp, Homo sapien
gttcaaggtctttctctctgtggag

SEQ ID NO: 384623 - DNA, 25 bp, Homo sapien
tcaaggtctttctctctgtggagcc

SEQ ID NO: 384624 - DNA, 25 bp, Homo sapien
gtgagctgcccttcctctctcagaa

SEQ ID NO: 384625 - DNA, 25 bp, Homo sapien
ccagcttcttagaatttgtcaaagc

SEQ ID NO: 384626 - DNA, 25 bp, Homo sapien
gaatttgtcaaagcacagcgcaaga

SEQ ID NO: 384627 - DNA, 25 bp, Homo sapien
aagcacagcgcaagattaaacacag

SEQ ID NO: 384628 - DNA, 25 bp, Homo sapien
gcactcctaggctctatcagactga

SEQ ID NO: 384629 - DNA, 25 bp, Homo sapien
taccatgcctggaaggccaatgcca

SEQ ID NO: 384630 - DNA, 25 bp, Homo sapien
gtgccaagtcagtgcgcgagttcct

SEQ ID NO: 384631 - DNA, 25 bp, Homo sapien
agaactatactgacgaagccattga

SEQ ID NO: 384632 - DNA, 25 bp, Homo sapien
gaagccattgaaacagatgatctga

SEQ ID NO: 384633 - DNA, 25 bp, Homo sapien
gatgatctgaccattaagctggtga

SEQ ID NO: 384634 - DNA, 25 bp, Homo sapien
gctggtgatcaaggcactcctggaa

SEQ ID NO: 384635 - DNA, 25 bp, Homo sapien
gaagtggttcagtcaggtggcaaaa

SEQ ID NO: 384636 - DNA, 25 bp, Homo sapien
aaaacattgaacttgctgtcatgag

SEQ ID NO: 384637 - DNA, 25 bp, Homo sapien
gaacttgctgtcatgaggcgagatc

SEQ ID NO: 384638 - DNA, 25 bp, Homo sapien
tgaggcgagatcaatccctcaagat

SEQ ID NO: 384639 - DNA, 25 bp, Homo sapien
aagtgctcaaccgaatacattttgg

SEQ ID NO: 384640 - DNA, 25 bp, Homo sapien
aatacattttggctgcttgtttgtg

SEQ ID NO: 384641 - DNA, 25 bp, Homo sapien
ggtgccgtccatgtagtttgtatat

SEQ ID NO: 384642 - DNA, 25 bp, Homo sapien
gtgagttgggcagcttcatgtagta

SEQ ID NO: 384643 - DNA, 25 bp, Homo sapien
gcaagtacacgattgacgtttccaa

SEQ ID NO: 384644 - DNA, 25 bp, Homo sapien
tgatcatccacttcttaacgttgct

SEQ ID NO: 384645 - DNA, 25 bp, Homo sapien
acttcttaacgttgcttattctggt

SEQ ID NO: 384646 - DNA, 25 bp, Homo sapien
atggtaatctttcagctcctgctcc

SEQ ID NO: 384647 - DNA, 25 bp, Homo sapien
cctgctccactgctaagtgatactg

SEQ ID NO: 384648 - DNA, 25 bp, Homo sapien
aagtgatactgtgaattctccattc

SEQ ID NO: 384649 - DNA, 25 bp, Homo sapien
aattctccattcaaattcctaagtc

SEQ ID NO: 384650 - DNA, 25 bp, Homo sapien
gtctttcagaaagctatgcttcagg

SEQ ID NO: 384651 - DNA, 25 bp, Homo sapien
ggagtccctaacattaacagcccct

SEQ ID NO: 384652 - DNA, 25 bp, Homo sapien
ttctctttcttattcttctgcctct

SEQ ID NO: 384653 - DNA, 25 bp, Homo sapien
tcgggctcagaatttgccagactct

SEQ ID NO: 384654 - DNA, 25 bp, Homo sapien
ctagcccgacccagaattatatttc

SEQ ID NO: 384655 - DNA, 25 bp, Homo sapien
atatttctatgcattcttcccaaaa

SEQ ID NO: 384656 - DNA, 25 bp, Homo sapien
agactcaagagtcatcatctcccca

SEQ ID NO: 384657 - DNA, 25 bp, Homo sapien
gctgtccagtcatcatcttttgcat

SEQ ID NO: 384658 - DNA, 25 bp, Homo sapien
atcttttgcatcctctactcattgt

SEQ ID NO: 384659 - DNA, 25 bp, Homo sapien
ggttttatcaccagttagccagaca

SEQ ID NO: 384660 - DNA, 25 bp, Homo sapien
gacacaggttagctattcatttcaa

SEQ ID NO: 384661 - DNA, 25 bp, Homo sapien
tgactgcccagctggactgactaat

SEQ ID NO: 384662 - DNA, 25 bp, Homo sapien
ggactgactaatgctgctgttttat

SEQ ID NO: 384663 - DNA, 25 bp, Homo sapien
tcttaatatcttacatgccacctca

SEQ ID NO: 384664 - DNA, 25 bp, Homo sapien
gccacctcactcctcagagataagt

SEQ ID NO: 384665 - DNA, 25 bp, Homo sapien
gataagtgccttaggttagtgacct

SEQ ID NO: 384666 - DNA, 25 bp, Homo sapien
ataacaaaggccaggtatagaacga

SEQ ID NO: 384667 - DNA, 25 bp, Homo sapien
atagaacgagaaatcagtggacctg

SEQ ID NO: 384668 - DNA, 25 bp, Homo sapien
gatttaaattgtcattgtctctcat

SEQ ID NO: 384669 - DNA, 25 bp, Homo sapien
tctcctgagcttctctaggatatta

SEQ ID NO: 384670 - DNA, 25 bp, Homo sapien
ctaggatattaaagcctggatctga

SEQ ID NO: 384671 - DNA, 25 bp, Homo sapien
ctggatctgatattgaggagcctct

SEQ ID NO: 384672 - DNA, 25 bp, Homo sapien
gatgcattcaaaatcttgtccaaga

SEQ ID NO: 384673 - DNA, 25 bp, Homo sapien
ttgtccaagaactcaagtcacttta

SEQ ID NO: 384674 - DNA, 25 bp, Homo sapien
ttaactgctttggagacttcataat

SEQ ID NO: 384675 - DNA, 25 bp, Homo sapien
gtttcactgtttttggaggactcat

SEQ ID NO: 384676 - DNA, 25 bp, Homo sapien
gaggactcatggcttttaactacaa

SEQ ID NO: 384677 - DNA, 25 bp, Homo sapien
ttttaactacaatcgggcattccag

SEQ ID NO: 384678 - DNA, 25 bp, Homo sapien
ggcattccaggtgtgggcagtccct

SEQ ID NO: 384679 - DNA, 25 bp, Homo sapien
agtccctctgttattggtagctttt

SEQ ID NO: 384680 - DNA, 25 bp, Homo sapien
gcctacttagtagcccatagttttt

SEQ ID NO: 384681 - DNA, 25 bp, Homo sapien
cccatagttttttatctgtgtttga

SEQ ID NO: 384682 - DNA, 25 bp, Homo sapien
aactgtgctggatgcacttttcctg

SEQ ID NO: 384683 - DNA, 25 bp, Homo sapien
aaggtgcatcggcagacgctgaacc

SEQ ID NO: 384684 - DNA, 25 bp, Homo sapien
gcagacgctgaaccctcactttggg

SEQ ID NO: 384685 - DNA, 25 bp, Homo sapien
tggtcatggcggtgtacgacttcga

SEQ ID NO: 384686 - DNA, 25 bp, Homo sapien
ggtgtacgacttcgaccgcttctct

SEQ ID NO: 384687 - DNA, 25 bp, Homo sapien
cttctctcgcaatgacgccatcggg

SEQ ID NO: 384688 - DNA, 25 bp, Homo sapien
tgcgggtccctatgagctccgtgga

SEQ ID NO: 384689 - DNA, 25 bp, Homo sapien
tccctatgagctccgtggacctggg

SEQ ID NO: 384690 - DNA, 25 bp, Homo sapien
ttggatcttggtggctcctcggacc

SEQ ID NO: 384691 - DNA, 25 bp, Homo sapien
ggacccctatgtgcgggtctacctg

SEQ ID NO: 384692 - DNA, 25 bp, Homo sapien
caaacggaggcggtacgagaccaag

SEQ ID NO: 384693 - DNA, 25 bp, Homo sapien
tacgagaccaaggtgcatcggcaga

SEQ ID NO: 384694 - DNA, 25 bp, Homo sapien
tgaggcctacccaaatttgccgtat

SEQ ID NO: 384695 - DNA, 25 bp, Homo sapien
cccaaatttgccgtatctgatatta

SEQ ID NO: 384696 - DNA, 25 bp, Homo sapien
caatgtccatcctctttaacctgtt

SEQ ID NO: 384697 - DNA, 25 bp, Homo sapien
catcctctttaacctgttctacgta

SEQ ID NO: 384698 - DNA, 25 bp, Homo sapien
tctttaacctgttctacgtattctt

SEQ ID NO: 384699 - DNA, 25 bp, Homo sapien
taccaccctctgatacactatgtaa

SEQ ID NO: 384700 - DNA, 25 bp, Homo sapien
tgtaatatacttgttcactgttcta

SEQ ID NO: 384701 - DNA, 25 bp, Homo sapien
tcactgttctattgatttattgtct

SEQ ID NO: 384702 - DNA, 25 bp, Homo sapien
tatctcttctccctaccagaatgta

SEQ ID NO: 384703 - DNA, 25 bp, Homo sapien
agtaagcttattgtctgcttgttca

SEQ ID NO: 384704 - DNA, 25 bp, Homo sapien
agattttgtcttcatgaggcctacc

SEQ ID NO: 384705 - DNA, 25 bp, Homo sapien
gccgcggctggcactgctgctgctt

SEQ ID NO: 384706 - DNA, 25 bp, Homo sapien
ctccggcgcgtggtacaagcacgtg

SEQ ID NO: 384707 - DNA, 25 bp, Homo sapien
tggtacaagcacgtggcgagtcccc

SEQ ID NO: 384708 - DNA, 25 bp, Homo sapien
ggtacaagcacgtggcgagtccccg

SEQ ID NO: 384709 - DNA, 25 bp, Homo sapien
aagcacgtggcgagtccccgctacc

SEQ ID NO: 384710 - DNA, 25 bp, Homo sapien
cgctaccacacggtgggccgcgccg

SEQ ID NO: 384711 - DNA, 25 bp, Homo sapien
gggctgcgtcgctcaccctatctgt

SEQ ID NO: 384712 - DNA, 25 bp, Homo sapien
gctgcgtcgctcaccctatctgtgg

SEQ ID NO: 384713 - DNA, 25 bp, Homo sapien
gtcgctcaccctatctgtggcgccg

SEQ ID NO: 384714 - DNA, 25 bp, Homo sapien
tctcctgctgccctcgtgggttcag

SEQ ID NO: 384715 - DNA, 25 bp, Homo sapien
acgcgacgcaggagctcccaggcag

SEQ ID NO: 384716 - DNA, 25 bp, Homo sapien
gatggataagtgtttcaggcagaat

SEQ ID NO: 384717 - DNA, 25 bp, Homo sapien
ggattatacaggtcgacgtttattt

SEQ ID NO: 384718 - DNA, 25 bp, Homo sapien
ttctttctgaactttcctggaggat

SEQ ID NO: 384719 - DNA, 25 bp, Homo sapien
tttcctggaggatcatcggccatac

SEQ ID NO: 384720 - DNA, 25 bp, Homo sapien
atcggccatactccagcagaagggt

SEQ ID NO: 384721 - DNA, 25 bp, Homo sapien
aaataacgtttccacggcaacagtg

SEQ ID NO: 384722 - DNA, 25 bp, Homo sapien
ggcaacagtggcagcaattcaaagg

SEQ ID NO: 384723 - DNA, 25 bp, Homo sapien
aaggaagacgttggagaattcacat

SEQ ID NO: 384724 - DNA, 25 bp, Homo sapien
taatggccctcaaagatgttgacac

SEQ ID NO: 384725 - DNA, 25 bp, Homo sapien
agatgttgacaccagaatcttcaga

SEQ ID NO: 384726 - DNA, 25 bp, Homo sapien
gaatcttcagaacctttgcatatgt

SEQ ID NO: 384727 - DNA, 25 bp, Homo sapien
tggaccaaagtctagtatccttgag

SEQ ID NO: 384728 - DNA, 25 bp, Homo sapien
tatccttgagaagcctgggtacatt

SEQ ID NO: 384729 - DNA, 25 bp, Homo sapien
tttctctgttgcatagttaccctgc

SEQ ID NO: 384730 - DNA, 25 bp, Homo sapien
atagttaccctgctaagtgactgta

SEQ ID NO: 384731 - DNA, 25 bp, Homo sapien
tgctaagtgactgtagatccctttg

SEQ ID NO: 384732 - DNA, 25 bp, Homo sapien
acagtgtatctttttggcagtataa

SEQ ID NO: 384733 - DNA, 25 bp, Homo sapien
gtataataggatatttccccaagga

SEQ ID NO: 384734 - DNA, 25 bp, Homo sapien
agtggatggctctatttgatgaaca

SEQ ID NO: 384735 - DNA, 25 bp, Homo sapien
accactgtgagctgacctgagtcaa

SEQ ID NO: 384736 - DNA, 25 bp, Homo sapien
aaaactgattatcacctagcctggt

SEQ ID NO: 384737 - DNA, 25 bp, Homo sapien
ctagcctggtggatcacagtggcgt

SEQ ID NO: 384738 - DNA, 25 bp, Homo sapien
atctgtagaatgtatgcccaattgc

SEQ ID NO: 384739 - DNA, 25 bp, Homo sapien
atgcccaattgctaaacggatgttg

SEQ ID NO: 384740 - DNA, 25 bp, Homo sapien
gctaaacggatgttgtgcccagaat

SEQ ID NO: 384741 - DNA, 25 bp, Homo sapien
gtgactacctcaacatacaggccaa

SEQ ID NO: 384742 - DNA, 25 bp, Homo sapien
acatacaggccaagcgttacctaca

SEQ ID NO: 384743 - DNA, 25 bp, Homo sapien
tacaccaacacccaagccattaatt

SEQ ID NO: 384744 - DNA, 25 bp, Homo sapien
aagccattaatttgaggtgccatga

SEQ ID NO: 384745 - DNA, 25 bp, Homo sapien
tgaaccacagcctaacaccatttag

SEQ ID NO: 384746 - DNA, 25 bp, Homo sapien
tcaggcttgcctctacttaaatata

SEQ ID NO: 384747 - DNA, 25 bp, Homo sapien
gagagagttctcttagacttctttc

SEQ ID NO: 384748 - DNA, 25 bp, Homo sapien
gttctcttagacttctttctttgta

SEQ ID NO: 384749 - DNA, 25 bp, Homo sapien
tattttttgcacttgaactgaaacg

SEQ ID NO: 384750 - DNA, 25 bp, Homo sapien
cttgaactgaaacgtactgtactgt

SEQ ID NO: 384751 - DNA, 25 bp, Homo sapien
actgtactgtaaattatgactcatt

SEQ ID NO: 384752 - DNA, 25 bp, Homo sapien
atgactcattttaagtgacctttaa

SEQ ID NO: 384753 - DNA, 25 bp, Homo sapien
gaaatgggtgacaggcttaacctca

SEQ ID NO: 384754 - DNA, 25 bp, Homo sapien
tgacaggcttaacctcacctatgaa

SEQ ID NO: 384755 - DNA, 25 bp, Homo sapien
cctcacctatgaatgtacagtatgt

SEQ ID NO: 384756 - DNA, 25 bp, Homo sapien
atgtggatttgtgaaactgactgta

SEQ ID NO: 384757 - DNA, 25 bp, Homo sapien
gatttattcctttgaaaagcctgct

SEQ ID NO: 384758 - DNA, 25 bp, Homo sapien
aaaagcctgctgttttggaaatgca

SEQ ID NO: 384759 - DNA, 25 bp, Homo sapien
ggaaatgcacagttgacatgttgaa

SEQ ID NO: 384760 - DNA, 25 bp, Homo sapien
cactgtaactggcattcccatagta

SEQ ID NO: 384761 - DNA, 25 bp, Homo sapien
agacctctgagatctgcacacatgg

SEQ ID NO: 384762 - DNA, 25 bp, Homo sapien
cagaaaactgcccttttctttctct

SEQ ID NO: 384763 - DNA, 25 bp, Homo sapien
ttctttctctcatcctacatagctg

SEQ ID NO: 384764 - DNA, 25 bp, Homo sapien
acatagctgcctggcaaatccctag

SEQ ID NO: 384765 - DNA, 25 bp, Homo sapien
ggcaaatccctagtcttcatcagct

SEQ ID NO: 384766 - DNA, 25 bp, Homo sapien
agctcacatcacatttccatgacaa

SEQ ID NO: 384767 - DNA, 25 bp, Homo sapien
acaatcccctttgattcctcagaat

SEQ ID NO: 384768 - DNA, 25 bp, Homo sapien
agaatctggccttcctttatagcac

SEQ ID NO: 384769 - DNA, 25 bp, Homo sapien
tggccccttgtctatgatcttttta

SEQ ID NO: 384770 - DNA, 25 bp, Homo sapien
gatctttttagcttgatttcttgaa

SEQ ID NO: 384771 - DNA, 25 bp, Homo sapien
ctcccaggtacctagcagaggctgt

SEQ ID NO: 384772 - DNA, 25 bp, Homo sapien
ctagcagaggctgtcagtccttggc

SEQ ID NO: 384773 - DNA, 25 bp, Homo sapien
agtccttggctcacctggaacaggg

SEQ ID NO: 384774 - DNA, 25 bp, Homo sapien
ggttggaacaggtgtgtgcccccac

SEQ ID NO: 384775 - DNA, 25 bp, Homo sapien
ccctgccattgtggactcttgtatt

SEQ ID NO: 384776 - DNA, 25 bp, Homo sapien
gactcttgtatttgagggacctcaa

SEQ ID NO: 384777 - DNA, 25 bp, Homo sapien
aagagagtgaggaccctaccatcca

SEQ ID NO: 384778 - DNA, 25 bp, Homo sapien
taccatccactgtccatattcagtc

SEQ ID NO: 384779 - DNA, 25 bp, Homo sapien
atccactgtccatattcagtcccag

SEQ ID NO: 384780 - DNA, 25 bp, Homo sapien
cagccatccaattcttgagttttct

SEQ ID NO: 384781 - DNA, 25 bp, Homo sapien
aattcttgagttttctcactgattg

SEQ ID NO: 384782 - DNA, 25 bp, Homo sapien
tcaccataggccagatagcgcctct

SEQ ID NO: 384783 - DNA, 25 bp, Homo sapien
ataggccagatagcgcctcttcaaa

SEQ ID NO: 384784 - DNA, 25 bp, Homo sapien
agatagcgcctcttcaaactgaaag

SEQ ID NO: 384785 - DNA, 25 bp, Homo sapien
gatagcgcctcttcaaactgaaaga

SEQ ID NO: 384786 - DNA, 25 bp, Homo sapien
tgaaagaaatcttaactccacaaag

SEQ ID NO: 384787 - DNA, 25 bp, Homo sapien
ttaactccacaaagaaagcatccta

SEQ ID NO: 384788 - DNA, 25 bp, Homo sapien
gaaagcatcctaaatccccagttcc

SEQ ID NO: 384789 - DNA, 25 bp, Homo sapien
caaccccagggataccttgtagaca

SEQ ID NO: 384790 - DNA, 25 bp, Homo sapien
agggataccttgtagacagtgccaa

SEQ ID NO: 384791 - DNA, 25 bp, Homo sapien
gataccttgtagacagtgccaaaaa

SEQ ID NO: 384792 - DNA, 25 bp, Homo sapien
cagtgccaaaaaacagctccaaccc

SEQ ID NO: 384793 - DNA, 25 bp, Homo sapien
caaggcgagaccctcacctcatgga

SEQ ID NO: 384794 - DNA, 25 bp, Homo sapien
aaggcgagaccctcacctcatggag

SEQ ID NO: 384795 - DNA, 25 bp, Homo sapien
aggcgagaccctcacctcatggagc

SEQ ID NO: 384796 - DNA, 25 bp, Homo sapien
gagaccctcacctcatggagcctgg

SEQ ID NO: 384797 - DNA, 25 bp, Homo sapien
agaccctcacctcatggagcctggc

SEQ ID NO: 384798 - DNA, 25 bp, Homo sapien
gaccctcacctcatggagcctggcc

SEQ ID NO: 384799 - DNA, 25 bp, Homo sapien
accctcacctcatggagcctggcca

SEQ ID NO: 384800 - DNA, 25 bp, Homo sapien
ctcacctcatggagcctggccacgg

SEQ ID NO: 384801 - DNA, 25 bp, Homo sapien
tcacctcatggagcctggccacgga

SEQ ID NO: 384802 - DNA, 25 bp, Homo sapien
acctcatggagcctggccacggacc

SEQ ID NO: 384803 - DNA, 25 bp, Homo sapien
cctcatggagcctggccacggaccc

SEQ ID NO: 384804 - DNA, 25 bp, Homo sapien
gaggtatacacagttgttttgtttt

SEQ ID NO: 384805 - DNA, 25 bp, Homo sapien
aaggtaattaagcatttggtcaagt

SEQ ID NO: 384806 - DNA, 25 bp, Homo sapien
gcatttggtcaagtaaatatagaac

SEQ ID NO: 384807 - DNA, 25 bp, Homo sapien
gaaattgtgcttaatgttatatact

SEQ ID NO: 384808 - DNA, 25 bp, Homo sapien
tatactgttattatttgcaggctgg

SEQ ID NO: 384809 - DNA, 25 bp, Homo sapien
tgcaggctggttttaattcttaatt

SEQ ID NO: 384810 - DNA, 25 bp, Homo sapien
aaacgtgacactttacatatttcat

SEQ ID NO: 384811 - DNA, 25 bp, Homo sapien
gtgacactttacatatttcatattt

SEQ ID NO: 384812 - DNA, 25 bp, Homo sapien
tatttttcatatagtctggaggtat

SEQ ID NO: 384813 - DNA, 25 bp, Homo sapien
catatagtctggaggtatacacagt

SEQ ID NO: 384814 - DNA, 25 bp, Homo sapien
gtctggaggtatacacagttgtttt

SEQ ID NO: 384815 - DNA, 25 bp, Homo sapien
catatatagacagacaggaacgcgt

SEQ ID NO: 384816 - DNA, 25 bp, Homo sapien
atatctatatatttctctcacccta

SEQ ID NO: 384817 - DNA, 25 bp, Homo sapien
tatatatttctctcaccctattttg

SEQ ID NO: 384818 - DNA, 25 bp, Homo sapien
tatatttctctcaccctattttgag

SEQ ID NO: 384819 - DNA, 25 bp, Homo sapien
ttctctcaccctattttgagacaga

SEQ ID NO: 384820 - DNA, 25 bp, Homo sapien
gacagaggcacaaagactcagcaat

SEQ ID NO: 384821 - DNA, 25 bp, Homo sapien
aggcacaaagactcagcaatttttt

SEQ ID NO: 384822 - DNA, 25 bp, Homo sapien
cccagtctaggtggttttgacaaag

SEQ ID NO: 384823 - DNA, 25 bp, Homo sapien
gtctaggtggttttgacaaagacca

SEQ ID NO: 384824 - DNA, 25 bp, Homo sapien
gacaaagaccaaaatcccaactcag

SEQ ID NO: 384825 - DNA, 25 bp, Homo sapien
agaccaaaatcccaactcagagaca

SEQ ID NO: 384826 - DNA, 25 bp, Homo sapien
gatacagggctagtggacatttaga

SEQ ID NO: 384827 - DNA, 25 bp, Homo sapien
gctagagtcttgtatgtcttttctt

SEQ ID NO: 384828 - DNA, 25 bp, Homo sapien
ttctttgaaggagttctaaccttgt

SEQ ID NO: 384829 - DNA, 25 bp, Homo sapien
ggagttctaaccttgtaaattgaga

SEQ ID NO: 384830 - DNA, 25 bp, Homo sapien
taatttcttaagcttcaaccatgtt

SEQ ID NO: 384831 - DNA, 25 bp, Homo sapien
gcttcaaccatgttttataccttat

SEQ ID NO: 384832 - DNA, 25 bp, Homo sapien
ttataccttatttcgttacatcata

SEQ ID NO: 384833 - DNA, 25 bp, Homo sapien
gtgtaatatgaaatcttttgcttta

SEQ ID NO: 384834 - DNA, 25 bp, Homo sapien
gaatgttctaaacttgaaaggcaat

SEQ ID NO: 384835 - DNA, 25 bp, Homo sapien
aatgttttgctgctttcatgaccaa

SEQ ID NO: 384836 - DNA, 25 bp, Homo sapien
tgctgctttcatgaccaaagataca

SEQ ID NO: 384837 - DNA, 25 bp, Homo sapien
gggaagcaggcacctctaacatgag

SEQ ID NO: 384838 - DNA, 25 bp, Homo sapien
gcaggcacctctaacatgaggcagt

SEQ ID NO: 384839 - DNA, 25 bp, Homo sapien
ggcacctctaacatgaggcagtaag

SEQ ID NO: 384840 - DNA, 25 bp, Homo sapien
acagccatatcaccatcccaagttg

SEQ ID NO: 384841 - DNA, 25 bp, Homo sapien
atatcaccatcccaagttgcaagcg

SEQ ID NO: 384842 - DNA, 25 bp, Homo sapien
caccatcccaagttgcaagcggaag

SEQ ID NO: 384843 - DNA, 25 bp, Homo sapien
gttgcaagcggaagactttggttct

SEQ ID NO: 384844 - DNA, 25 bp, Homo sapien
caagcggaagactttggttcttagg

SEQ ID NO: 384845 - DNA, 25 bp, Homo sapien
ttggagaaagtacctgttaagtgag

SEQ ID NO: 384846 - DNA, 25 bp, Homo sapien
gggtaatgccaaacactgaaaccat

SEQ ID NO: 384847 - DNA, 25 bp, Homo sapien
tgaaaccatcagctcttgctcagaa

SEQ ID NO: 384848 - DNA, 25 bp, Homo sapien
gagaatcgtgtgatcagtgtgctaa

SEQ ID NO: 384849 - DNA, 25 bp, Homo sapien
taaatctctctgcctgtttggactt

SEQ ID NO: 384850 - DNA, 25 bp, Homo sapien
gtcctctgtgaggaatattctctat

SEQ ID NO: 384851 - DNA, 25 bp, Homo sapien
gtatgtactgtgtatgattcattac

SEQ ID NO: 384852 - DNA, 25 bp, Homo sapien
gtatgattcattaccattttgaggg

SEQ ID NO: 384853 - DNA, 25 bp, Homo sapien
atgctcttatttttccaacagctaa

SEQ ID NO: 384854 - DNA, 25 bp, Homo sapien
ttttccaacagctaaactactctta

SEQ ID NO: 384855 - DNA, 25 bp, Homo sapien
ttagttgaacagtgtgccctagctt

SEQ ID NO: 384856 - DNA, 25 bp, Homo sapien
agtgtgccctagcttttcttgcaac

SEQ ID NO: 384857 - DNA, 25 bp, Homo sapien
gcttttcttgcaaccagagtatttt

SEQ ID NO: 384858 - DNA, 25 bp, Homo sapien
tttttgtacagatttgctttctctt

SEQ ID NO: 384859 - DNA, 25 bp, Homo sapien
gcattacaaatattcataacctgga

SEQ ID NO: 384860 - DNA, 25 bp, Homo sapien
ggaaacaagttcttaccagttgatt

SEQ ID NO: 384861 - DNA, 25 bp, Homo sapien
agttcttaccagttgattgtcacat

SEQ ID NO: 384862 - DNA, 25 bp, Homo sapien
accagttgattgtcacatagttctg

SEQ ID NO: 384863 - DNA, 25 bp, Homo sapien
ttctggatgtgttggcctgaatggc

SEQ ID NO: 384864 - DNA, 25 bp, Homo sapien
ggcctgaatggctgttgtgctgctt

SEQ ID NO: 384865 - DNA, 25 bp, Homo sapien
atggctgttgtgctgcttgtgacat

SEQ ID NO: 384866 - DNA, 25 bp, Homo sapien
gcttgtaaaacacatgctctgcaga

SEQ ID NO: 384867 - DNA, 25 bp, Homo sapien
acacatgctctgcagaacacaccag

SEQ ID NO: 384868 - DNA, 25 bp, Homo sapien
cagaatctgtggtgacctggatgtg

SEQ ID NO: 384869 - DNA, 25 bp, Homo sapien
ggcctcagagggaagcattacaaat

SEQ ID NO: 384870 - DNA, 25 bp, Homo sapien
attgttaataccgtgattccctgcc

SEQ ID NO: 384871 - DNA, 25 bp, Homo sapien
cactcaacacttgatgcatttgttt

SEQ ID NO: 384872 - DNA, 25 bp, Homo sapien
gttttggaaagtgccattttatgct

SEQ ID NO: 384873 - DNA, 25 bp, Homo sapien
cattttatgctgagatactggtatt

SEQ ID NO: 384874 - DNA, 25 bp, Homo sapien
tactggtattgaaaacttccctctt

SEQ ID NO: 384875 - DNA, 25 bp, Homo sapien
ctctttcccaactctgtcagaagtt

SEQ ID NO: 384876 - DNA, 25 bp, Homo sapien
tcagaagttctcttgctctttggaa

SEQ ID NO: 384877 - DNA, 25 bp, Homo sapien
ctctttggaagaagccgagggcctt

SEQ ID NO: 384878 - DNA, 25 bp, Homo sapien
gccgagggccttaacaaatcagact

SEQ ID NO: 384879 - DNA, 25 bp, Homo sapien
aaatcagactgacctcccttgtgac

SEQ ID NO: 384880 - DNA, 25 bp, Homo sapien
tgacctcccttgtgacaggcagcct

SEQ ID NO: 384881 - DNA, 25 bp, Homo sapien
tttccccttgtattacagtacaatg

SEQ ID NO: 384882 - DNA, 25 bp, Homo sapien
cattactatactgtcaagctgaaag

SEQ ID NO: 384883 - DNA, 25 bp, Homo sapien
aaaaagttcgagtctgttgcactag

SEQ ID NO: 384884 - DNA, 25 bp, Homo sapien
gagtctgttgcactaggctgtacat

SEQ ID NO: 384885 - DNA, 25 bp, Homo sapien
gttgcactaggctgtacatgactaa

SEQ ID NO: 384886 - DNA, 25 bp, Homo sapien
aggctgtacatgactaaagttgaca

SEQ ID NO: 384887 - DNA, 25 bp, Homo sapien
agttgacagatgctatgctagattt

SEQ ID NO: 384888 - DNA, 25 bp, Homo sapien
gatttataatcactagttctggtac

SEQ ID NO: 384889 - DNA, 25 bp, Homo sapien
actagttctggtacttgtgtctttg

SEQ ID NO: 384890 - DNA, 25 bp, Homo sapien
agcaatacaaaataccaagccttat

SEQ ID NO: 384891 - DNA, 25 bp, Homo sapien
taccaagccttatacttaaaagaag

SEQ ID NO: 384892 - DNA, 25 bp, Homo sapien
tagtcccttagcaccaccgctgaga

SEQ ID NO: 384893 - DNA, 25 bp, Homo sapien
agtcccttagcaccaccgctgagat

SEQ ID NO: 384894 - DNA, 25 bp, Homo sapien
tcccttagcaccaccgctgagattt

SEQ ID NO: 384895 - DNA, 25 bp, Homo sapien
ttagcaccaccgctgagattttgct

SEQ ID NO: 384896 - DNA, 25 bp, Homo sapien
tagcaccaccgctgagattttgctg

SEQ ID NO: 384897 - DNA, 25 bp, Homo sapien
agcaccaccgctgagattttgctga

SEQ ID NO: 384898 - DNA, 25 bp, Homo sapien
tgtgtgttgggcttcactgaaggaa

SEQ ID NO: 384899 - DNA, 25 bp, Homo sapien
gtgttgggcttcactgaaggaagcc

SEQ ID NO: 384900 - DNA, 25 bp, Homo sapien
gaaagtgttcagaaatagggaaaat

SEQ ID NO: 384901 - DNA, 25 bp, Homo sapien
gaaaatgagaaactgttccagctga

SEQ ID NO: 384902 - DNA, 25 bp, Homo sapien
aaaatgagaaactgttccagctgaa

SEQ ID NO: 384903 - DNA, 25 bp, Homo sapien
agtggtcaaccacagagtcttcaag

SEQ ID NO: 384904 - DNA, 25 bp, Homo sapien
gtggtcaaccacagagtcttcaaga

SEQ ID NO: 384905 - DNA, 25 bp, Homo sapien
ataagaaattctgtaccatctgaaa

SEQ ID NO: 384906 - DNA, 25 bp, Homo sapien
ccatctgaaagtagttcttgttggt

SEQ ID NO: 384907 - DNA, 25 bp, Homo sapien
aaagtagttcttgttggtgccttca

SEQ ID NO: 384908 - DNA, 25 bp, Homo sapien
acaaacatttagttgaggttcttga

SEQ ID NO: 384909 - DNA, 25 bp, Homo sapien
catttagttgaggttcttgatataa

SEQ ID NO: 384910 - DNA, 25 bp, Homo sapien
gaggttcttgatataaaacaattac

SEQ ID NO: 384911 - DNA, 25 bp, Homo sapien
aaaacagtaacatcaaattggctag

SEQ ID NO: 384912 - DNA, 25 bp, Homo sapien
gtaacatcaaattggctagagagat

SEQ ID NO: 384913 - DNA, 25 bp, Homo sapien
gtgagtagacagattacaattctat

SEQ ID NO: 384914 - DNA, 25 bp, Homo sapien
aagcaactgacaatgtaccgggttt

SEQ ID NO: 384915 - DNA, 25 bp, Homo sapien
agcaactgacaatgtaccgggtttg

SEQ ID NO: 384916 - DNA, 25 bp, Homo sapien
aatgtaccgggtttggattcagtgc

SEQ ID NO: 384917 - DNA, 25 bp, Homo sapien
tgtaccgggtttggattcagtgcaa

SEQ ID NO: 384918 - DNA, 25 bp, Homo sapien
taccgggtttggattcagtgcaaat

SEQ ID NO: 384919 - DNA, 25 bp, Homo sapien
ccgggtttggattcagtgcaaatac

SEQ ID NO: 384920 - DNA, 25 bp, Homo sapien
tcagtgcaaatactgcaagcccctt

SEQ ID NO: 384921 - DNA, 25 bp, Homo sapien
gtgcaaatactgcaagccccttctg

SEQ ID NO: 384922 - DNA, 25 bp, Homo sapien
gcaaatactgcaagccccttctgtc

SEQ ID NO: 384923 - DNA, 25 bp, Homo sapien
ggcacctgctgccaacacgatgcaa

SEQ ID NO: 384924 - DNA, 25 bp, Homo sapien
gcacctgctgccaacacgatgcaag

SEQ ID NO: 384925 - DNA, 25 bp, Homo sapien
ctccggcgcgtggtacaagcacgtg

SEQ ID NO: 384926 - DNA, 25 bp, Homo sapien
cgtggtacaagcacgtggcgagtcc

SEQ ID NO: 384927 - DNA, 25 bp, Homo sapien
tggtacaagcacgtggcgagtcccc

SEQ ID NO: 384928 - DNA, 25 bp, Homo sapien
ggtacaagcacgtggcgagtccccg

SEQ ID NO: 384929 - DNA, 25 bp, Homo sapien
aagcacgtggcgagtccccgctacc

SEQ ID NO: 384930 - DNA, 25 bp, Homo sapien
cgctaccacacggtgggccgcgccg

SEQ ID NO: 384931 - DNA, 25 bp, Homo sapien
gggctgcgtcgctcaccctatctgt

SEQ ID NO: 384932 - DNA, 25 bp, Homo sapien
gctgcgtcgctcaccctatctgtgg

SEQ ID NO: 384933 - DNA, 25 bp, Homo sapien
gtcgctcaccctatctgtggcgccg

SEQ ID NO: 384934 - DNA, 25 bp, Homo sapien
tctcctgctgccctcgtgggttcag

SEQ ID NO: 384935 - DNA, 25 bp, Homo sapien
ctcctgctgccctcgtgggttcagg

SEQ ID NO: 384936 - DNA, 25 bp, Homo sapien
ggcagcaagacctatgagcaagaac

SEQ ID NO: 384937 - DNA, 25 bp, Homo sapien
gcaagaactatttacttgaccctcg

SEQ ID NO: 384938 - DNA, 25 bp, Homo sapien
ttctcttgttcttgtgtggtctgaa

SEQ ID NO: 384939 - DNA, 25 bp, Homo sapien
gatttcctataagccaatttctaat

SEQ ID NO: 384940 - DNA, 25 bp, Homo sapien
tttaatctgtaccttctatcttctc

SEQ ID NO: 384941 - DNA, 25 bp, Homo sapien
gtaccttctatcttctcataattcg

SEQ ID NO: 384942 - DNA, 25 bp, Homo sapien
cataattcgtggtcttacagccttc

SEQ ID NO: 384943 - DNA, 25 bp, Homo sapien
ggtcttacagccttccaaaataact

SEQ ID NO: 384944 - DNA, 25 bp, Homo sapien
aaataactccagttgggcacccatg

SEQ ID NO: 384945 - DNA, 25 bp, Homo sapien
tccagttgggcacccatgagctagg

SEQ ID NO: 384946 - DNA, 25 bp, Homo sapien
gagctaggatcaaactttctttata

SEQ ID NO: 384947 - DNA, 25 bp, Homo sapien
tgaaaacctttgaacctcacggtgt

SEQ ID NO: 384948 - DNA, 25 bp, Homo sapien
tgaacctcacggtgtcctgatgaag

SEQ ID NO: 384949 - DNA, 25 bp, Homo sapien
gaagggatttcttggttttgacatc

SEQ ID NO: 384950 - DNA, 25 bp, Homo sapien
ttggttttgacatctccgaccccac

SEQ ID NO: 384951 - DNA, 25 bp, Homo sapien
cgttgcctggtcactgggccatgac

SEQ ID NO: 384952 - DNA, 25 bp, Homo sapien
tggtcactgggccatgacccaactg

SEQ ID NO: 384953 - DNA, 25 bp, Homo sapien
caactgcccttcttgtcagttgctg

SEQ ID NO: 384954 - DNA, 25 bp, Homo sapien
tcagttgctgatggtgggccagggc

SEQ ID NO: 384955 - DNA, 25 bp, Homo sapien
agggcgcaggtctccctcccagatg

SEQ ID NO: 384956 - DNA, 25 bp, Homo sapien
gcaaggaccacagctgggtggccct

SEQ ID NO: 384957 - DNA, 25 bp, Homo sapien
gcactctgtgctgaaaacctttgaa

SEQ ID NO: 384958 - DNA, 25 bp, Homo sapien
gacactgggtgagctttgtgatctt

SEQ ID NO: 384959 - DNA, 25 bp, Homo sapien
gagaagctccctcttcaaggagcct

SEQ ID NO: 384960 - DNA, 25 bp, Homo sapien
actgctctgtgcctctagaacatgg

SEQ ID NO: 384961 - DNA, 25 bp, Homo sapien
ggatagctctcgtcgtcacttccta

SEQ ID NO: 384962 - DNA, 25 bp, Homo sapien
gtcacttcctaaggccttgtgcaga

SEQ ID NO: 384963 - DNA, 25 bp, Homo sapien
cttgtgcagatgcatgggttaccca

SEQ ID NO: 384964 - DNA, 25 bp, Homo sapien
atggcacatggcacgtggcttgtaa

SEQ ID NO: 384965 - DNA, 25 bp, Homo sapien
caaagggcaccttgtctcagagtgt

SEQ ID NO: 384966 - DNA, 25 bp, Homo sapien
ctcagagtgtggcttgggctcttaa

SEQ ID NO: 384967 - DNA, 25 bp, Homo sapien
tgggctcttaacctgggttgatact

SEQ ID NO: 384968 - DNA, 25 bp, Homo sapien
gatactggttgagctgtgtgacact

SEQ ID NO: 384969 - DNA, 25 bp, Homo sapien
ggtcacttaaatattgaatctcaat

SEQ ID NO: 384970 - DNA, 25 bp, Homo sapien
ctcacttttttaggacatgtaatca

SEQ ID NO: 384971 - DNA, 25 bp, Homo sapien
cttttttaggacatgtaatcaagac

SEQ ID NO: 384972 - DNA, 25 bp, Homo sapien
aatgacagagcaccatcaaccatgc

SEQ ID NO: 384973 - DNA, 25 bp, Homo sapien
agagcaccatcaaccatgctcagac

SEQ ID NO: 384974 - DNA, 25 bp, Homo sapien
actaaccccttgacaattatcacag

SEQ ID NO: 384975 - DNA, 25 bp, Homo sapien
gacaattatcacagtctttcttgga

SEQ ID NO: 384976 - DNA, 25 bp, Homo sapien
attatcacagtctttcttggatggg

SEQ ID NO: 384977 - DNA, 25 bp, Homo sapien
gggactacagagtcctggaggacca

SEQ ID NO: 384978 - DNA, 25 bp, Homo sapien
agtcctggaggaccaatgacatatt

SEQ ID NO: 384979 - DNA, 25 bp, Homo sapien
cctggaggaccaatgacatattttg

SEQ ID NO: 384980 - DNA, 25 bp, Homo sapien
tattgttcttgtgagtgatacagca

SEQ ID NO: 384981 - DNA, 25 bp, Homo sapien
gtgggaaaacttacatttccttgtg

SEQ ID NO: 384982 - DNA, 25 bp, Homo sapien
atttccttgtgtcaaaatgtaatga

SEQ ID NO: 384983 - DNA, 25 bp, Homo sapien
gatctaattcttatggaggtctact

SEQ ID NO: 384984 - DNA, 25 bp, Homo sapien
tcttatggaggtctacttgttggaa

SEQ ID NO: 384985 - DNA, 25 bp, Homo sapien
gtaattgcctactctttgtgtgcag

SEQ ID NO: 384986 - DNA, 25 bp, Homo sapien
gcctactctttgtgtgcagaggtgc

SEQ ID NO: 384987 - DNA, 25 bp, Homo sapien
tgcagaggtgcattttaggacaaag

SEQ ID NO: 384988 - DNA, 25 bp, Homo sapien
gacaaagggaactttcttgagtcct

SEQ ID NO: 384989 - DNA, 25 bp, Homo sapien
tgagtcctttaaatcactgggtgat

SEQ ID NO: 384990 - DNA, 25 bp, Homo sapien
gattgctgtcttcttatttggcaaa

SEQ ID NO: 384991 - DNA, 25 bp, Homo sapien
ccttgagggcctaggcaggattcct

SEQ ID NO: 384992 - DNA, 25 bp, Homo sapien
taggcaggattcctggccagcctgc

SEQ ID NO: 384993 - DNA, 25 bp, Homo sapien
ccagggagctgagccggatttgctg

SEQ ID NO: 384994 - DNA, 25 bp, Homo sapien
acagagtgggtcctgggccgatgac

SEQ ID NO: 384995 - DNA, 25 bp, Homo sapien
tgacccagcccaaagggtggcacag

SEQ ID NO: 384996 - DNA, 25 bp, Homo sapien
acctctgccggacgagctgaactcg

SEQ ID NO: 384997 - DNA, 25 bp, Homo sapien
gacgagctgaactcggcactccggg

SEQ ID NO: 384998 - DNA, 25 bp, Homo sapien
ggatttgctgtgtggtcttcggagg

SEQ ID NO: 384999 - DNA, 25 bp, Homo sapien
gggatgtctgctgtgagtctcttta

SEQ ID NO: 385000 - DNA, 25 bp, Homo sapien
gtctgctgtgagtctctttagacag

SEQ ID NO: 385001 - DNA, 25 bp, Homo sapien
gagtctctttagacagcagtgacct

SEQ ID NO: 385002 - DNA, 25 bp, Homo sapien
aacaacaactttagtatggaatgtg

SEQ ID NO: 385003 - DNA, 25 bp, Homo sapien
atggaatgtgaagaactggcaggat

SEQ ID NO: 385004 - DNA, 25 bp, Homo sapien
actggcaggatattcacgttgagct

SEQ ID NO: 385005 - DNA, 25 bp, Homo sapien
tggcaggatattcacgttgagctgt

SEQ ID NO: 385006 - DNA, 25 bp, Homo sapien
cgttgagctgtgcagtaagtagctt

SEQ ID NO: 385007 - DNA, 25 bp, Homo sapien
aagtagcttactggacatgtgaggc

SEQ ID NO: 385008 - DNA, 25 bp, Homo sapien
ggctgaagatacagttgttcatatg

SEQ ID NO: 385009 - DNA, 25 bp, Homo sapien
gatacagttgttcatatggaagcaa

SEQ ID NO: 385010 - DNA, 25 bp, Homo sapien
atagatattttttagtccacttggc

SEQ ID NO: 385011 - DNA, 25 bp, Homo sapien
gatattttttagtccacttggctgg

SEQ ID NO: 385012 - DNA, 25 bp, Homo sapien
tttagtccacttggctggataataa

SEQ ID NO: 385013 - DNA, 25 bp, Homo sapien
cctttgctaggaattatcagaataa

SEQ ID NO: 385014 - DNA, 25 bp, Homo sapien
ggaattatcagaataagtacctaaa

SEQ ID NO: 385015 - DNA, 25 bp, Homo sapien
aattaatctctccaggattttttgt

SEQ ID NO: 385016 - DNA, 25 bp, Homo sapien
tttctcttcagcatatgcccaaggt

SEQ ID NO: 385017 - DNA, 25 bp, Homo sapien
ctcttcagcatatgcccaaggtatg

SEQ ID NO: 385018 - DNA, 25 bp, Homo sapien
tgagcagcctgaagctattctgaat

SEQ ID NO: 385019 - DNA, 25 bp, Homo sapien
cagcctgaagctattctgaatgaca

SEQ ID NO: 385020 - DNA, 25 bp, Homo sapien
tgaatgacaaggactagttttaggt

SEQ ID NO: 385021 - DNA, 25 bp, Homo sapien
gcaaacagcactgtgatactgactt

SEQ ID NO: 385022 - DNA, 25 bp, Homo sapien
gtgatactgactttgtttattaaaa

SEQ ID NO: 385023 - DNA, 25 bp, Homo sapien
actcataatgagttaaagcgattag

SEQ ID NO: 385024 - DNA, 25 bp, Homo sapien
gggaagcaggcacctctaacatgag

SEQ ID NO: 385025 - DNA, 25 bp, Homo sapien
gcaggcacctctaacatgaggcagt

SEQ ID NO: 385026 - DNA, 25 bp, Homo sapien
ggcacctctaacatgaggcagtaag

SEQ ID NO: 385027 - DNA, 25 bp, Homo sapien
acagccatatcaccatcccaagttg

SEQ ID NO: 385028 - DNA, 25 bp, Homo sapien
atatcaccatcccaagttgcaagcg

SEQ ID NO: 385029 - DNA, 25 bp, Homo sapien
atcaccatcccaagttgcaagcgga

SEQ ID NO: 385030 - DNA, 25 bp, Homo sapien
caccatcccaagttgcaagcggaag

SEQ ID NO: 385031 - DNA, 25 bp, Homo sapien
atcccaagttgcaagcggaagactt

SEQ ID NO: 385032 - DNA, 25 bp, Homo sapien
gttgcaagcggaagactttggttct

SEQ ID NO: 385033 - DNA, 25 bp, Homo sapien
caagcggaagactttggttcttagg

SEQ ID NO: 385034 - DNA, 25 bp, Homo sapien
ttggagaaagtacctgttaagtgag

SEQ ID NO: 385035 - DNA, 25 bp, Homo sapien
tacctgtttatctgtaactagtata

SEQ ID NO: 385036 - DNA, 25 bp, Homo sapien
acctgtttatctgtaactagtatac

SEQ ID NO: 385037 - DNA, 25 bp, Homo sapien
cctgtttatctgtaactagtataca

SEQ ID NO: 385038 - DNA, 25 bp, Homo sapien
ctgtttatctgtaactagtatacaa

SEQ ID NO: 385039 - DNA, 25 bp, Homo sapien
tgtttatctgtaactagtatacaaa

SEQ ID NO: 385040 - DNA, 25 bp, Homo sapien
gtttatctgtaactagtatacaaac

SEQ ID NO: 385041 - DNA, 25 bp, Homo sapien
tttatctgtaactagtatacaaaca

SEQ ID NO: 385042 - DNA, 25 bp, Homo sapien
ttatctgtaactagtatacaaacaa

SEQ ID NO: 385043 - DNA, 25 bp, Homo sapien
tatctgtaactagtatacaaacaaa

SEQ ID NO: 385044 - DNA, 25 bp, Homo sapien
atctgtaactagtatacaaacaaat

SEQ ID NO: 385045 - DNA, 25 bp, Homo sapien
tctgtaactagtatacaaacaaatt

SEQ ID NO: 385046 - DNA, 25 bp, Homo sapien
tgggcctggctcttacaggcttggt

SEQ ID NO: 385047 - DNA, 25 bp, Homo sapien
tcttacaggcttggtcaggagggct

SEQ ID NO: 385048 - DNA, 25 bp, Homo sapien
gtcaggagggctggccttcttcact

SEQ ID NO: 385049 - DNA, 25 bp, Homo sapien
tgtgtctgggtccacacacccttca

SEQ ID NO: 385050 - DNA, 25 bp, Homo sapien
acccttcagtaaccaacggcactga

SEQ ID NO: 385051 - DNA, 25 bp, Homo sapien
gtaaccaacggcactgagaagcaca

SEQ ID NO: 385052 - DNA, 25 bp, Homo sapien
ctcagcctgggatccggtgatggtc

SEQ ID NO: 385053 - DNA, 25 bp, Homo sapien
gctgggtcaggagtcccaaaggtca

SEQ ID NO: 385054 - DNA, 25 bp, Homo sapien
ggagtcccaaaggtcagtgacagtt

SEQ ID NO: 385055 - DNA, 25 bp, Homo sapien
cccaaaggtcagtgacagtttctca

SEQ ID NO: 385056 - DNA, 25 bp, Homo sapien
agtttctcagaagaggcccagcgtc

SEQ ID NO: 385057 - DNA, 25 bp, Homo sapien
atacacacttggtacactacgggat

SEQ ID NO: 385058 - DNA, 25 bp, Homo sapien
cacacttggtacactacgggattgt

SEQ ID NO: 385059 - DNA, 25 bp, Homo sapien
acttggtacactacgggattgttgt

SEQ ID NO: 385060 - DNA, 25 bp, Homo sapien
gtacactacgggattgttgtgcttt

SEQ ID NO: 385061 - DNA, 25 bp, Homo sapien
actacgggattgttgtgcttttgtt

SEQ ID NO: 385062 - DNA, 25 bp, Homo sapien
aggtttgatgtagatggcttgttac

SEQ ID NO: 385063 - DNA, 25 bp, Homo sapien
aattgtccattactttatgttgtgt

SEQ ID NO: 385064 - DNA, 25 bp, Homo sapien
gtgttgtgacagatttggctatatt

SEQ ID NO: 385065 - DNA, 25 bp, Homo sapien
atactcttgaatatattagcctcag

SEQ ID NO: 385066 - DNA, 25 bp, Homo sapien
ttgaatatattagcctcagcctata

SEQ ID NO: 385067 - DNA, 25 bp, Homo sapien
gcctcagcctatataaaaatttctt

SEQ ID NO: 385068 - DNA, 25 bp, Homo sapien
ccttgggtgcagatcatgatgttta

SEQ ID NO: 385069 - DNA, 25 bp, Homo sapien
ggtgcagatcatgatgtttaagaac

SEQ ID NO: 385070 - DNA, 25 bp, Homo sapien
tgtttaagaacatgacgccgtcacc

SEQ ID NO: 385071 - DNA, 25 bp, Homo sapien
ttaagaacatgacgccgtcaccctt

SEQ ID NO: 385072 - DNA, 25 bp, Homo sapien
acccttcctgcgattctacttagat

SEQ ID NO: 385073 - DNA, 25 bp, Homo sapien
ccttcctgcgattctacttagattc

SEQ ID NO: 385074 - DNA, 25 bp, Homo sapien
cttcctgcgattctacttagattct

SEQ ID NO: 385075 - DNA, 25 bp, Homo sapien
agcaggtcctggtggatgtggagac

SEQ ID NO: 385076 - DNA, 25 bp, Homo sapien
tactgcctgcgggagtgcatctgtg

SEQ ID NO: 385077 - DNA, 25 bp, Homo sapien
ctgcctgcgggagtgcatctgtgaa

SEQ ID NO: 385078 - DNA, 25 bp, Homo sapien
gagtgcatctgtgaagtggaagggc

SEQ ID NO: 385079 - DNA, 25 bp, Homo sapien
tgtctaaaaaactactgccccactt

SEQ ID NO: 385080 - DNA, 25 bp, Homo sapien
caaattgcagtgttctgtcacctag

SEQ ID NO: 385081 - DNA, 25 bp, Homo sapien
ttctgtcacctaggcatcatctctt

SEQ ID NO: 385082 - DNA, 25 bp, Homo sapien
tcttcctgcccctagtatttgatta

SEQ ID NO: 385083 - DNA, 25 bp, Homo sapien
gtttcgattctgttttgttcatctg

SEQ ID NO: 385084 - DNA, 25 bp, Homo sapien
aaactttcttagacacactggcacc

SEQ ID NO: 385085 - DNA, 25 bp, Homo sapien
agacacactggcaccaaggtaagag

SEQ ID NO: 385086 - DNA, 25 bp, Homo sapien
ggctgcccaggcaaagtcagtgaac

SEQ ID NO: 385087 - DNA, 25 bp, Homo sapien
tttgttcatctgttcgagcagaggg

SEQ ID NO: 385088 - DNA, 25 bp, Homo sapien
gggcagttgaagtctcgtcctggtc

SEQ ID NO: 385089 - DNA, 25 bp, Homo sapien
gcatggactggcacagaggtgttct

SEQ ID NO: 385090 - DNA, 25 bp, Homo sapien
ggtgtctcaggccacaccggccttg

SEQ ID NO: 385091 - DNA, 25 bp, Homo sapien
acaccggccttgcattgcctgcctg

SEQ ID NO: 385092 - DNA, 25 bp, Homo sapien
gagggtgcggctgtgcagcctgtcc

SEQ ID NO: 385093 - DNA, 25 bp, Homo sapien
agggcattgcttacacggatgcctt

SEQ ID NO: 385094 - DNA, 25 bp, Homo sapien
gcattgcttacacggatgccttccc

SEQ ID NO: 385095 - DNA, 25 bp, Homo sapien
tgcttacacggatgccttcccctgg

SEQ ID NO: 385096 - DNA, 25 bp, Homo sapien
ttcccctgggccctgacattggagc

SEQ ID NO: 385097 - DNA, 25 bp, Homo sapien
gacattggagcctgggcatcctcag

SEQ ID NO: 385098 - DNA, 25 bp, Homo sapien
cctcaggtggtcaggcgtagatcac

SEQ ID NO: 385099 - DNA, 25 bp, Homo sapien
gtggtcaggcgtagatcaccagaat

SEQ ID NO: 385100 - DNA, 25 bp, Homo sapien
gatcaccagaataaacccagcttcc

SEQ ID NO: 385101 - DNA, 25 bp, Homo sapien
acttcttatctgcttatactgaaag

SEQ ID NO: 385102 - DNA, 25 bp, Homo sapien
cttatactgaaagcttggatagaga

SEQ ID NO: 385103 - DNA, 25 bp, Homo sapien
gatagagataaatctccacctccct

SEQ ID NO: 385104 - DNA, 25 bp, Homo sapien
taaatctccacctcccttaagttgg

SEQ ID NO: 385105 - DNA, 25 bp, Homo sapien
ttccaggccatattcacaagagaaa

SEQ ID NO: 385106 - DNA, 25 bp, Homo sapien
aagagattgttgtggactttgttta

SEQ ID NO: 385107 - DNA, 25 bp, Homo sapien
acaatttatatttcattctctaaac

SEQ ID NO: 385108 - DNA, 25 bp, Homo sapien
tcttgttctttctcaaatgtttttt

SEQ ID NO: 385109 - DNA, 25 bp, Homo sapien
ttaaatcatgatggcctgtaacagt

SEQ ID NO: 385110 - DNA, 25 bp, Homo sapien
catgatggcctgtaacagttgaagc

SEQ ID NO: 385111 - DNA, 25 bp, Homo sapien
gtaacagttgaagcatctaaaaatt

SEQ ID NO: 385112 - DNA, 25 bp, Homo sapien
agcagtggaagagggtgcccaacct

SEQ ID NO: 385113 - DNA, 25 bp, Homo sapien
gttggaccaacccttggctcgcagc

SEQ ID NO: 385114 - DNA, 25 bp, Homo sapien
cttggctcgcagctcaactctgctt

SEQ ID NO: 385115 - DNA, 25 bp, Homo sapien
cagcttctcccctgtgacgggaagg

SEQ ID NO: 385116 - DNA, 25 bp, Homo sapien
ttctcccctgtgacgggaaggcagg

SEQ ID NO: 385117 - DNA, 25 bp, Homo sapien
gtgactccaggctctgcactggttc

SEQ ID NO: 385118 - DNA, 25 bp, Homo sapien
ccaggctctgcactggttcttcttg

SEQ ID NO: 385119 - DNA, 25 bp, Homo sapien
gttcttcttggttcctcccaccagg

SEQ ID NO: 385120 - DNA, 25 bp, Homo sapien
ttgttcctcatgtccccatgtttct

SEQ ID NO: 385121 - DNA, 25 bp, Homo sapien
tgcgtcttagcacctttcttctgtt

SEQ ID NO: 385122 - DNA, 25 bp, Homo sapien
cctttcttctgttcaaagttttctg

SEQ ID NO: 385123 - DNA, 25 bp, Homo sapien
tttcctcagaaccaacatgacgcag

SEQ ID NO: 385124 - DNA, 25 bp, Homo sapien
acatgacgcagctcaataagggtga

SEQ ID NO: 385125 - DNA, 25 bp, Homo sapien
agaagccccgtctggacgagccttg

SEQ ID NO: 385126 - DNA, 25 bp, Homo sapien
ccttgcctgacctcttcggtgctga

SEQ ID NO: 385127 - DNA, 25 bp, Homo sapien
tcggtgctgaccttcccaaagtgat

SEQ ID NO: 385128 - DNA, 25 bp, Homo sapien
aagtgatgccttactggttttgtac

SEQ ID NO: 385129 - DNA, 25 bp, Homo sapien
ctggttttgtactaactgtgttcat

SEQ ID NO: 385130 - DNA, 25 bp, Homo sapien
cagggctaaaaagtcatctgttcat

SEQ ID NO: 385131 - DNA, 25 bp, Homo sapien
tcaagttgctgtgacttttctcatc

SEQ ID NO: 385132 - DNA, 25 bp, Homo sapien
ttttctcatccaaaagactcatttg

SEQ ID NO: 385133 - DNA, 25 bp, Homo sapien
agactcatttgtgtggatgcgtgac

SEQ ID NO: 385134 - DNA, 25 bp, Homo sapien
acagtctctctgttctacggattat

SEQ ID NO: 385135 - DNA, 25 bp, Homo sapien
ggattatcttgtaaaccagtgttca

SEQ ID NO: 385136 - DNA, 25 bp, Homo sapien
gcacatttttcacagtacaagccgt

SEQ ID NO: 385137 - DNA, 25 bp, Homo sapien
tacaagccgtagtttttacctgtag

SEQ ID NO: 385138 - DNA, 25 bp, Homo sapien
ttacctgtagtttggacttctctgt

SEQ ID NO: 385139 - DNA, 25 bp, Homo sapien
gaatgtaactgcattaccagccctt

SEQ ID NO: 385140 - DNA, 25 bp, Homo sapien
actgcattaccagcccttttaaagg

SEQ ID NO: 385141 - DNA, 25 bp, Homo sapien
tttaaaggcatctatctatcaaagg

SEQ ID NO: 385142 - DNA, 25 bp, Homo sapien
ttagattttcttgggaccgtttctg

SEQ ID NO: 385143 - DNA, 25 bp, Homo sapien
tttctgtaacctttgcccttcacaa

SEQ ID NO: 385144 - DNA, 25 bp, Homo sapien
gaaaatattggttttgccattacat

SEQ ID NO: 385145 - DNA, 25 bp, Homo sapien
ggaatagagactcgcccttgatgtc

SEQ ID NO: 385146 - DNA, 25 bp, Homo sapien
cttgatgtccctctcgaagtagtag

SEQ ID NO: 385147 - DNA, 25 bp, Homo sapien
ctctcgaagtagtaggcggcatcca

SEQ ID NO: 385148 - DNA, 25 bp, Homo sapien
tcaccggcggccttctgagacgtgt

SEQ ID NO: 385149 - DNA, 25 bp, Homo sapien
ttctgagacgtgttctgccgcagct

SEQ ID NO: 385150 - DNA, 25 bp, Homo sapien
tctgccgcagctcgatctggatggt

SEQ ID NO: 385151 - DNA, 25 bp, Homo sapien
gatctggatggtgggctgctcgtag

SEQ ID NO: 385152 - DNA, 25 bp, Homo sapien
gctcgtagtgcacggccgccacgaa

SEQ ID NO: 385153 - DNA, 25 bp, Homo sapien
agccgatagcgctcgcggaagagcc

SEQ ID NO: 385154 - DNA, 25 bp, Homo sapien
ggaagagccgcctcagctcggcgtc

SEQ ID NO: 385155 - DNA, 25 bp, Homo sapien
cggcgtccaggtctgagtggttgaa

SEQ ID NO: 385156 - DNA, 25 bp, Homo sapien
gtgcccggccaatatgaccttttta

SEQ ID NO: 385157 - DNA, 25 bp, Homo sapien
gaccgcagtccgtaaatataagggc

SEQ ID NO: 385158 - DNA, 25 bp, Homo sapien
taagggcataaagcaggaccataat

SEQ ID NO: 385159 - DNA, 25 bp, Homo sapien
aggaccataatcacatacatgctga

SEQ ID NO: 385160 - DNA, 25 bp, Homo sapien
catacatgctgactgtgtgttgaga

SEQ ID NO: 385161 - DNA, 25 bp, Homo sapien
ttactgccggcagggtcacagtgag

SEQ ID NO: 385162 - DNA, 25 bp, Homo sapien
gggcctctaatttgggtggtgcctt

SEQ ID NO: 385163 - DNA, 25 bp, Homo sapien
accaagttggtatggatcacgtcca

SEQ ID NO: 385164 - DNA, 25 bp, Homo sapien
ggatcacgtccatacaagacactgc

SEQ ID NO: 385165 - DNA, 25 bp, Homo sapien
acaagacactgcaaactgggaccat

SEQ ID NO: 385166 - DNA, 25 bp, Homo sapien
gcaaactgggaccattgcttccact

SEQ ID NO: 385167 - DNA, 25 bp, Homo sapien
ttctcatgtgttttctgattaaggc

SEQ ID NO: 385168 - DNA, 25 bp, Homo sapien
catgtgttttctgattaaggctctt

SEQ ID NO: 385169 - DNA, 25 bp, Homo sapien
gtgttttctgattaaggctcttgac

SEQ ID NO: 385170 - DNA, 25 bp, Homo sapien
ttctgattaaggctcttgacttcca

SEQ ID NO: 385171 - DNA, 25 bp, Homo sapien
ctgattaaggctcttgacttccaag

SEQ ID NO: 385172 - DNA, 25 bp, Homo sapien
ttaaggctcttgacttccaaggctg

SEQ ID NO: 385173 - DNA, 25 bp, Homo sapien
aaggctcttgacttccaaggctgtg

SEQ ID NO: 385174 - DNA, 25 bp, Homo sapien
ctcttgacttccaaggctgtgtggg

SEQ ID NO: 385175 - DNA, 25 bp, Homo sapien
gggctcttggactgatataaaactt

SEQ ID NO: 385176 - DNA, 25 bp, Homo sapien
gctcttggactgatataaaactttg

SEQ ID NO: 385177 - DNA, 25 bp, Homo sapien
tggactgatataaaactttgtcaaa

SEQ ID NO: 385178 - DNA, 25 bp, Homo sapien
tcttcagcgtgttggccaggcggca

SEQ ID NO: 385179 - DNA, 25 bp, Homo sapien
aggcggcacgtggtctccagtagtt

SEQ ID NO: 385180 - DNA, 25 bp, Homo sapien
agtagttccctgtaggtgatcctca

SEQ ID NO: 385181 - DNA, 25 bp, Homo sapien
gatgactgtgtggacagctccgatc

SEQ ID NO: 385182 - DNA, 25 bp, Homo sapien
taggtgatcctcacttccgttccag

SEQ ID NO: 385183 - DNA, 25 bp, Homo sapien
tcatcgcgctcccagatcaaagcaa

SEQ ID NO: 385184 - DNA, 25 bp, Homo sapien
gggacttccgaacatgctggtccaa

SEQ ID NO: 385185 - DNA, 25 bp, Homo sapien
gctggtccaagcagttgacagagac

SEQ ID NO: 385186 - DNA, 25 bp, Homo sapien
agagacatttaactggcctcccagg

SEQ ID NO: 385187 - DNA, 25 bp, Homo sapien
tggacagctccgatcctggcacagg

SEQ ID NO: 385188 - DNA, 25 bp, Homo sapien
gacacgggcatgtagatggcaacac

SEQ ID NO: 385189 - DNA, 25 bp, Homo sapien
agaaccactatctaggccattgcaa

SEQ ID NO: 385190 - DNA, 25 bp, Homo sapien
ggccattgcaacaattctctaactg

SEQ ID NO: 385191 - DNA, 25 bp, Homo sapien
attcttggatcccactcatgacctt

SEQ ID NO: 385192 - DNA, 25 bp, Homo sapien
aattctctaactggtctcctgactt

SEQ ID NO: 385193 - DNA, 25 bp, Homo sapien
aactggtctcctgactttattcata

SEQ ID NO: 385194 - DNA, 25 bp, Homo sapien
gactttattcatatctcttctgatc

SEQ ID NO: 385195 - DNA, 25 bp, Homo sapien
ctgatcaatttccaacttccacaag

SEQ ID NO: 385196 - DNA, 25 bp, Homo sapien
agagtgactggaccatgttacctcc

SEQ ID NO: 385197 - DNA, 25 bp, Homo sapien
catgttacctccctactgaaaactt

SEQ ID NO: 385198 - DNA, 25 bp, Homo sapien
tgaaaactttcctagggctccccat

SEQ ID NO: 385199 - DNA, 25 bp, Homo sapien
ataagtccttaaggtgactcagagg

SEQ ID NO: 385200 - DNA, 25 bp, Homo sapien
ggactctggcaatctgtagccccaa

SEQ ID NO: 385201 - DNA, 25 bp, Homo sapien
tgtagccccaatgccttgatgtctt

SEQ ID NO: 385202 - DNA, 25 bp, Homo sapien
gatgtcttcctcattaacactgtca

SEQ ID NO: 385203 - DNA, 25 bp, Homo sapien
tgtcacgtctcaccaggaatacagt

SEQ ID NO: 385204 - DNA, 25 bp, Homo sapien
gggccacagacctgaaaccaaatgg

SEQ ID NO: 385205 - DNA, 25 bp, Homo sapien
tccggtctctaaggaagtcccaaag

SEQ ID NO: 385206 - DNA, 25 bp, Homo sapien
aagagaatgctctgtgggtccctag

SEQ ID NO: 385207 - DNA, 25 bp, Homo sapien
tctgtgggtccctagcatctgagga

SEQ ID NO: 385208 - DNA, 25 bp, Homo sapien
aggacgggctccttcagaactcggg

SEQ ID NO: 385209 - DNA, 25 bp, Homo sapien
ggtccgagcgactcatgatttgcat

SEQ ID NO: 385210 - DNA, 25 bp, Homo sapien
gatttgcatgggactctggcaatct

SEQ ID NO: 385211 - DNA, 25 bp, Homo sapien
gtgggctgacccagacatttaatca

SEQ ID NO: 385212 - DNA, 25 bp, Homo sapien
acccagacatttaatcaccatctct

SEQ ID NO: 385213 - DNA, 25 bp, Homo sapien
caccatctcttatgttgttgccgta

SEQ ID NO: 385214 - DNA, 25 bp, Homo sapien
gttgccgtaagaaatgcattccagg

SEQ ID NO: 385215 - DNA, 25 bp, Homo sapien
attccaggttgggacttgggatcct

SEQ ID NO: 385216 - DNA, 25 bp, Homo sapien
ttgggatcctgagagcacattcgcc

SEQ ID NO: 385217 - DNA, 25 bp, Homo sapien
tgcaagatggaagcccagtctcctt

SEQ ID NO: 385218 - DNA, 25 bp, Homo sapien
cagtctccttactaccaaactgtag

SEQ ID NO: 385219 - DNA, 25 bp, Homo sapien
tttataggacattccctaagctggg

SEQ ID NO: 385220 - DNA, 25 bp, Homo sapien
atcactattcatgtcaactgtactt

SEQ ID NO: 385221 - DNA, 25 bp, Homo sapien
actgtactttggtatagactcccta

SEQ ID NO: 385222 - DNA, 25 bp, Homo sapien
gtatagcaggctgtgaagagcgact

SEQ ID NO: 385223 - DNA, 25 bp, Homo sapien
ctgcagggcccgtccataagagaaa

SEQ ID NO: 385224 - DNA, 25 bp, Homo sapien
gggcccgtccataagagaaacttag

SEQ ID NO: 385225 - DNA, 25 bp, Homo sapien
gagaaacttagtttccagggctttg

SEQ ID NO: 385226 - DNA, 25 bp, Homo sapien
gaggttgagagtggcatcctcttca

SEQ ID NO: 385227 - DNA, 25 bp, Homo sapien
gagagtggcatcctcttcactcatg

SEQ ID NO: 385228 - DNA, 25 bp, Homo sapien
ttcactcatgccaccagacaaaaag

SEQ ID NO: 385229 - DNA, 25 bp, Homo sapien
gatgccaggaacagctgcaggaaca

SEQ ID NO: 385230 - DNA, 25 bp, Homo sapien
agagctgttacggtggccatagcta

SEQ ID NO: 385231 - DNA, 25 bp, Homo sapien
ttacggtggccatagctacttgttc

SEQ ID NO: 385232 - DNA, 25 bp, Homo sapien
tggccatagctacttgttctggagt

SEQ ID NO: 385233 - DNA, 25 bp, Homo sapien
atccaggagatactgtacggtttga

SEQ ID NO: 385234 - DNA, 25 bp, Homo sapien
ggagatactgtacggtttgaaagaa

SEQ ID NO: 385235 - DNA, 25 bp, Homo sapien
gaaaatcagtatacccattaataat

SEQ ID NO: 385236 - DNA, 25 bp, Homo sapien
gggaagaatgcttttcaaccttata

SEQ ID NO: 385237 - DNA, 25 bp, Homo sapien
gaatgcttttcaaccttatacacta

SEQ ID NO: 385238 - DNA, 25 bp, Homo sapien
gcttttcaaccttatacactagaag

SEQ ID NO: 385239 - DNA, 25 bp, Homo sapien
cttatacactagaagcatgctcttt

SEQ ID NO: 385240 - DNA, 25 bp, Homo sapien
tagaagcatgctctttaaaattaat

SEQ ID NO: 385241 - DNA, 25 bp, Homo sapien
aattaatgcaacaggatgacgactt

SEQ ID NO: 385242 - DNA, 25 bp, Homo sapien
caggatgacgacttgatgtagaaac

SEQ ID NO: 385243 - DNA, 25 bp, Homo sapien
tgacgacttgatgtagaaactatat

SEQ ID NO: 385244 - DNA, 25 bp, Homo sapien
tctctctgaaccgtgcactatattg

SEQ ID NO: 385245 - DNA, 25 bp, Homo sapien
gaaccgtgcaaatttctgatctaga

SEQ ID NO: 385246 - DNA, 25 bp, Homo sapien
gatgaattgctccttacattcgata

SEQ ID NO: 385247 - DNA, 25 bp, Homo sapien
ttacattcgataatcagtgaccacg

SEQ ID NO: 385248 - DNA, 25 bp, Homo sapien
gtgaccacgaaacactcagaccaga

SEQ ID NO: 385249 - DNA, 25 bp, Homo sapien
gaaacactcagaccagagcctggct

SEQ ID NO: 385250 - DNA, 25 bp, Homo sapien
gagcctggcttatcaaaaaccttca

SEQ ID NO: 385251 - DNA, 25 bp, Homo sapien
tgaccttttcccctagatctttagc

SEQ ID NO: 385252 - DNA, 25 bp, Homo sapien
tttcccctagatctttagcagttaa

SEQ ID NO: 385253 - DNA, 25 bp, Homo sapien
ttcaaagcccaagtataaccacatt

SEQ ID NO: 385254 - DNA, 25 bp, Homo sapien
gaaaccagaagactgtctctctgaa

SEQ ID NO: 385255 - DNA, 25 bp, Homo sapien
atgctatgtttcttgctgttgctgg

SEQ ID NO: 385256 - DNA, 25 bp, Homo sapien
atgtgagccagagtggtcttgccgc

SEQ ID NO: 385257 - DNA, 25 bp, Homo sapien
ggatttcgttggtctccaggagcga

SEQ ID NO: 385258 - DNA, 25 bp, Homo sapien
ttgctctgcccgaagtaatcctgca

SEQ ID NO: 385259 - DNA, 25 bp, Homo sapien
aatcctgcagcgtgtcaggacgcat

SEQ ID NO: 385260 - DNA, 25 bp, Homo sapien
tgtcaggacgcatcgtgtcggccag

SEQ ID NO: 385261 - DNA, 25 bp, Homo sapien
tcggccagcggcttgccctgtagca

SEQ ID NO: 385262 - DNA, 25 bp, Homo sapien
agcttgttttatgacatctcgcaca

SEQ ID NO: 385263 - DNA, 25 bp, Homo sapien
atctcgcacatcatttgtcttggca

SEQ ID NO: 385264 - DNA, 25 bp, Homo sapien
atttgtcttggcatttgttgcagat

SEQ ID NO: 385265 - DNA, 25 bp, Homo sapien
aatgtcacaaaccttatgctatgtt

SEQ ID NO: 385266 - DNA, 25 bp, Homo sapien
gaggttgagagtggcatcctcttca

SEQ ID NO: 385267 - DNA, 25 bp, Homo sapien
ggttgagagtggcatcctcttcact

SEQ ID NO: 385268 - DNA, 25 bp, Homo sapien
tgagagtggcatcctcttcactcat

SEQ ID NO: 385269 - DNA, 25 bp, Homo sapien
ctcatgccaccagacaaaaagcaga

SEQ ID NO: 385270 - DNA, 25 bp, Homo sapien
agagctgttacggtggccatagcta

SEQ ID NO: 385271 - DNA, 25 bp, Homo sapien
agctgttacggtggccatagctact

SEQ ID NO: 385272 - DNA, 25 bp, Homo sapien
tgttacggtggccatagctacttgt

SEQ ID NO: 385273 - DNA, 25 bp, Homo sapien
ttacggtggccatagctacttgttc

SEQ ID NO: 385274 - DNA, 25 bp, Homo sapien
acggtggccatagctacttgttctg

SEQ ID NO: 385275 - DNA, 25 bp, Homo sapien
ggtggccatagctacttgttctgga

SEQ ID NO: 385276 - DNA, 25 bp, Homo sapien
tggccatagctacttgttctggagt

SEQ ID NO: 385277 - DNA, 25 bp, Homo sapien
agactgtctctctgaaccgtgcact

SEQ ID NO: 385278 - DNA, 25 bp, Homo sapien
tctctctgaaccgtgcactatattg

SEQ ID NO: 385279 - DNA, 25 bp, Homo sapien
tctgaaccgtgcactatattgcagt

SEQ ID NO: 385280 - DNA, 25 bp, Homo sapien
aaccgtgcactatattgcagttgga

SEQ ID NO: 385281 - DNA, 25 bp, Homo sapien
gcactatattgcagttggacatgag

SEQ ID NO: 385282 - DNA, 25 bp, Homo sapien
attgcagttggacatgagaaccgtg

SEQ ID NO: 385283 - DNA, 25 bp, Homo sapien
gaaccgtgcaaatttctgatctaga

SEQ ID NO: 385284 - DNA, 25 bp, Homo sapien
ttttcaaagcccaagtataaccaca

SEQ ID NO: 385285 - DNA, 25 bp, Homo sapien
aaagcccaagtataaccacattttg

SEQ ID NO: 385286 - DNA, 25 bp, Homo sapien
gcccaagtataaccacattttgaaa

SEQ ID NO: 385287 - DNA, 25 bp, Homo sapien
gaaaccagaagactgtctctctgaa

SEQ ID NO: 385288 - DNA, 25 bp, Homo sapien
agctacaccggaggctgatggcgct

SEQ ID NO: 385289 - DNA, 25 bp, Homo sapien
gctgatggcgctgcgggagcgcaac

SEQ ID NO: 385290 - DNA, 25 bp, Homo sapien
tgctgcagcagattgtgaatctgat

SEQ ID NO: 385291 - DNA, 25 bp, Homo sapien
gattgtgaatctgatcgaggagact

SEQ ID NO: 385292 - DNA, 25 bp, Homo sapien
ttgtgaatctgatcgaggagactgg

SEQ ID NO: 385293 - DNA, 25 bp, Homo sapien
tggccacttcaatgtcaccaacacc

SEQ ID NO: 385294 - DNA, 25 bp, Homo sapien
ttcgacctcttctccctggacgaga

SEQ ID NO: 385295 - DNA, 25 bp, Homo sapien
tggacgagaccaccgtgcgcaaact

SEQ ID NO: 385296 - DNA, 25 bp, Homo sapien
gaccaccgtgcgcaaactgcagagc

SEQ ID NO: 385297 - DNA, 25 bp, Homo sapien
ccgtgcgcaaactgcagagctgcct

SEQ ID NO: 385298 - DNA, 25 bp, Homo sapien
tcccgtctcgcctgcttcatttgga

SEQ ID NO: 385299 - DNA, 25 bp, Homo sapien
taattaccttatacaaaggcctcag

SEQ ID NO: 385300 - DNA, 25 bp, Homo sapien
ttatacaaaggcctcagtgactttc

SEQ ID NO: 385301 - DNA, 25 bp, Homo sapien
ctccttacctaacgaatcatcttta

SEQ ID NO: 385302 - DNA, 25 bp, Homo sapien
gaagttaccaaatctgttcaccaca

SEQ ID NO: 385303 - DNA, 25 bp, Homo sapien
aaatctgttcaccacaaacctgaga

SEQ ID NO: 385304 - DNA, 25 bp, Homo sapien
ggacaccagcaatgaacatgaaact

SEQ ID NO: 385305 - DNA, 25 bp, Homo sapien
gcaatgaacatgaaactcagcttat

SEQ ID NO: 385306 - DNA, 25 bp, Homo sapien
ctcagcttatgaggcatatttggct

SEQ ID NO: 385307 - DNA, 25 bp, Homo sapien
gatgaaaggtgatatttctagcata

SEQ ID NO: 385308 - DNA, 25 bp, Homo sapien
atttctagcatatcagtttgtggtg

SEQ ID NO: 385309 - DNA, 25 bp, Homo sapien
gcatatcagtttgtggtggtaaatt

SEQ ID NO: 385310 - DNA, 25 bp, Homo sapien
atgcccatgactggaaccagaacag

SEQ ID NO: 385311 - DNA, 25 bp, Homo sapien
gcaaaacaagctatcgatcagggaa

SEQ ID NO: 385312 - DNA, 25 bp, Homo sapien
tcgatcagggaagatctccagttat

SEQ ID NO: 385313 - DNA, 25 bp, Homo sapien
gataacactaatatacaagcttggg

SEQ ID NO: 385314 - DNA, 25 bp, Homo sapien
agccatatgtggaagtggccatagg

SEQ ID NO: 385315 - DNA, 25 bp, Homo sapien
gatacagagtagagtttcatgaacc

SEQ ID NO: 385316 - DNA, 25 bp, Homo sapien
aaacttggtggaaatttgatcctga

SEQ ID NO: 385317 - DNA, 25 bp, Homo sapien
gtgtgtctcgaaagaagattgctca

SEQ ID NO: 385318 - DNA, 25 bp, Homo sapien
gattgctcagatgttggatcgttat

SEQ ID NO: 385319 - DNA, 25 bp, Homo sapien
gaatatcaaatgtccatttctattg

SEQ ID NO: 385320 - DNA, 25 bp, Homo sapien
taatgaattcagtggaaccatcaca

SEQ ID NO: 385321 - DNA, 25 bp, Homo sapien
atgctgttttccctaccagacaagc

SEQ ID NO: 385322 - DNA, 25 bp, Homo sapien
ctgttttccctaccagacaagcaaa

SEQ ID NO: 385323 - DNA, 25 bp, Homo sapien
aaattaaaatagtagcccaggcttg

SEQ ID NO: 385324 - DNA, 25 bp, Homo sapien
tagaggttggcatcaggctgcccac

SEQ ID NO: 385325 - DNA, 25 bp, Homo sapien
ctgagtgttcctcccggcactggaa

SEQ ID NO: 385326 - DNA, 25 bp, Homo sapien
actggaagccagtggccgtccagag

SEQ ID NO: 385327 - DNA, 25 bp, Homo sapien
agccagtggccgtccagaggaacgt

SEQ ID NO: 385328 - DNA, 25 bp, Homo sapien
gaggaacgtgattgaattgctgtat

SEQ ID NO: 385329 - DNA, 25 bp, Homo sapien
gaattgctgtatatccatctggtgg

SEQ ID NO: 385330 - DNA, 25 bp, Homo sapien
tatccatctggtggagcactgctgt

SEQ ID NO: 385331 - DNA, 25 bp, Homo sapien
ggagcactgctgtgtgtctgttaaa

SEQ ID NO: 385332 - DNA, 25 bp, Homo sapien
tgctgagaatggcacctggtgagag

SEQ ID NO: 385333 - DNA, 25 bp, Homo sapien
ggctttgtgctgagtgctgtacatg

SEQ ID NO: 385334 - DNA, 25 bp, Homo sapien
gagtgctgtacatgtattagttcct

SEQ ID NO: 385335 - DNA, 25 bp, Homo sapien
gctgtacatgtattagttcctttac

SEQ ID NO: 385336 - DNA, 25 bp, Homo sapien
actgctgaccacattgtacccattt

SEQ ID NO: 385337 - DNA, 25 bp, Homo sapien
tgctgaccacattgtacccatttca

SEQ ID NO: 385338 - DNA, 25 bp, Homo sapien
gaccacattgtacccatttcacaga

SEQ ID NO: 385339 - DNA, 25 bp, Homo sapien
cacattgtacccatttcacagagaa

SEQ ID NO: 385340 - DNA, 25 bp, Homo sapien
acttgaaccaagccctctgctctga

SEQ ID NO: 385341 - DNA, 25 bp, Homo sapien
tctgctctgaagaccgcgtcctgaa

SEQ ID NO: 385342 - DNA, 25 bp, Homo sapien
tctgaagaccgcgtcctgaatttct

SEQ ID NO: 385343 - DNA, 25 bp, Homo sapien
acatggacagaaggcggatggctct

SEQ ID NO: 385344 - DNA, 25 bp, Homo sapien
cgccttcttcttccattcgagatgg

SEQ ID NO: 385345 - DNA, 25 bp, Homo sapien
ttccattcgagatggctcgtaccga

SEQ ID NO: 385346 - DNA, 25 bp, Homo sapien
agatggctcgtaccgaacctccttg

SEQ ID NO: 385347 - DNA, 25 bp, Homo sapien
tcgcctccgggctttattgcaagtt

SEQ ID NO: 385348 - DNA, 25 bp, Homo sapien
gggctggaccaatacatctgccgat

SEQ ID NO: 385349 - DNA, 25 bp, Homo sapien
tacatctgccgatgccctggccgaa

SEQ ID NO: 385350 - DNA, 25 bp, Homo sapien
atgccctggccgaatggcaggcgac

SEQ ID NO: 385351 - DNA, 25 bp, Homo sapien
tattgcaagtttacggttccataca

SEQ ID NO: 385352 - DNA, 25 bp, Homo sapien
ttacggttccatacaagtaaatccg

SEQ ID NO: 385353 - DNA, 25 bp, Homo sapien
gggtccacaccactaattattatgg

SEQ ID NO: 385354 - DNA, 25 bp, Homo sapien
tggacaagggtctcgtggacgacat

SEQ ID NO: 385355 - DNA, 25 bp, Homo sapien
caagggtctcgtggacgacatcaaa

SEQ ID NO: 385356 - DNA, 25 bp, Homo sapien
gagcccgagaaggagctttcccgga

SEQ ID NO: 385357 - DNA, 25 bp, Homo sapien
gaggtcctgagggagtacaagctgc

SEQ ID NO: 385358 - DNA, 25 bp, Homo sapien
acaagctgcccgacgggaacatcat

SEQ ID NO: 385359 - DNA, 25 bp, Homo sapien
agagccccgggctctcgaatatggt

SEQ ID NO: 385360 - DNA, 25 bp, Homo sapien
gggctctcgaatatggtctccagca

SEQ ID NO: 385361 - DNA, 25 bp, Homo sapien
gaatatggtctccagcagcatcacc

SEQ ID NO: 385362 - DNA, 25 bp, Homo sapien
tctccagcagcatcaccaagtgtga

SEQ ID NO: 385363 - DNA, 25 bp, Homo sapien
tcaccaagtgtgataccgacatcca

SEQ ID NO: 385364 - DNA, 25 bp, Homo sapien
gtgtgataccgacatccagaagatc

SEQ ID NO: 385365 - DNA, 25 bp, Homo sapien
tgtatcccctttcggtccaacaaca

SEQ ID NO: 385366 - DNA, 25 bp, Homo sapien
ttcggtccaacaacaggaaacctga

SEQ ID NO: 385367 - DNA, 25 bp, Homo sapien
agtatctgtatgacaacccgggatc

SEQ ID NO: 385368 - DNA, 25 bp, Homo sapien
gacaacccgggatcgtttgcaagta

SEQ ID NO: 385369 - DNA, 25 bp, Homo sapien
ccgggatcgtttgcaagtaactgaa

SEQ ID NO: 385370 - DNA, 25 bp, Homo sapien
gtaactgaatccattgcgacattgt

SEQ ID NO: 385371 - DNA, 25 bp, Homo sapien
cattgcgacattgtgaaggcttaaa

SEQ ID NO: 385372 - DNA, 25 bp, Homo sapien
aatagcgttgttatcgccttgggtt

SEQ ID NO: 385373 - DNA, 25 bp, Homo sapien
tatcgccttgggtttaaattatttg

SEQ ID NO: 385374 - DNA, 25 bp, Homo sapien
ttatttgatgagttccacttgtatc

SEQ ID NO: 385375 - DNA, 25 bp, Homo sapien
ttgtatcatggcctacccgaggaga

SEQ ID NO: 385376 - DNA, 25 bp, Homo sapien
atgctttcacactacaccagcgtag

SEQ ID NO: 385377 - DNA, 25 bp, Homo sapien
aagtgctttttctctaggtgagcct

SEQ ID NO: 385378 - DNA, 25 bp, Homo sapien
aggtgagcctaagaggactcagaca

SEQ ID NO: 385379 - DNA, 25 bp, Homo sapien
gactcagacagggtgtttgattaac

SEQ ID NO: 385380 - DNA, 25 bp, Homo sapien
ttcacactacaccagcgtagctgag

SEQ ID NO: 385381 - DNA, 25 bp, Homo sapien
tggatagcactaatctacagcatta

SEQ ID NO: 385382 - DNA, 25 bp, Homo sapien
atctacagcattaatgaaccagcaa

SEQ ID NO: 385383 - DNA, 25 bp, Homo sapien
gaacatcttcagtatcaacatacct

SEQ ID NO: 385384 - DNA, 25 bp, Homo sapien
agcgtagctgagaagctgtgacaca

SEQ ID NO: 385385 - DNA, 25 bp, Homo sapien
gtgacacagatcacactaactgcaa

SEQ ID NO: 385386 - DNA, 25 bp, Homo sapien
gcgaaaatattcactctcttagaga

SEQ ID NO: 385387 - DNA, 25 bp, Homo sapien
gtctttcctctagtactaccagtat

SEQ ID NO: 385388 - DNA, 25 bp, Homo sapien
agtactaccagtattcataaatgta

SEQ ID NO: 385389 - DNA, 25 bp, Homo sapien
cataaatgtataccccttactgtaa

SEQ ID NO: 385390 - DNA, 25 bp, Homo sapien
tgtataccccttactgtaatttgtt

SEQ ID NO: 385391 - DNA, 25 bp, Homo sapien
gttcctcttagaagtcagatcatct

SEQ ID NO: 385392 - DNA, 25 bp, Homo sapien
cagatcatctgatttatagaggatt

SEQ ID NO: 385393 - DNA, 25 bp, Homo sapien
aaaggcttattttatacatacgtat

SEQ ID NO: 385394 - DNA, 25 bp, Homo sapien
taaatgtttcattgacccaagtaat

SEQ ID NO: 385395 - DNA, 25 bp, Homo sapien
atgttacctatgtctttcaggaaaa

SEQ ID NO: 385396 - DNA, 25 bp, Homo sapien
gaaaaataattatagcagctgatct

SEQ ID NO: 385397 - DNA, 25 bp, Homo sapien
gcagctgatctgtaaatgactttaa

SEQ ID NO: 385398 - DNA, 25 bp, Homo sapien
ccccattaatgtcatcgtgagatac

SEQ ID NO: 385399 - DNA, 25 bp, Homo sapien
tcgtgagatacatcaagtgtgttct

SEQ ID NO: 385400 - DNA, 25 bp, Homo sapien
tttcgtataataaatgggctttgct

SEQ ID NO: 385401 - DNA, 25 bp, Homo sapien
gggctttgcttatcaacatcacaat

SEQ ID NO: 385402 - DNA, 25 bp, Homo sapien
tatactgtacaaaactgcaggaaga

SEQ ID NO: 385403 - DNA, 25 bp, Homo sapien
aacacccttgagtttcctgtcgtct

SEQ ID NO: 385404 - DNA, 25 bp, Homo sapien
gaaactgtagtgcatatgttaaaac

SEQ ID NO: 385405 - DNA, 25 bp, Homo sapien
ttacagtattgagtcgtgtgccact

SEQ ID NO: 385406 - DNA, 25 bp, Homo sapien
attgagtcgtgtgccactgctgtac

SEQ ID NO: 385407 - DNA, 25 bp, Homo sapien
tgtgccactgctgtacctgatgtat

SEQ ID NO: 385408 - DNA, 25 bp, Homo sapien
gctgtacctgatgtatccaatctgg

SEQ ID NO: 385409 - DNA, 25 bp, Homo sapien
ggccccagtcacatggtgtcagagt

SEQ ID NO: 385410 - DNA, 25 bp, Homo sapien
agtcacatggtgtcagagttacctt

SEQ ID NO: 385411 - DNA, 25 bp, Homo sapien
tggtgtcagagttaccttggcaact

SEQ ID NO: 385412 - DNA, 25 bp, Homo sapien
gtcagagttaccttggcaactggcc

SEQ ID NO: 385413 - DNA, 25 bp, Homo sapien
gagttaccttggcaactggcctttt

SEQ ID NO: 385414 - DNA, 25 bp, Homo sapien
taccttggcaactggcctttttggt

SEQ ID NO: 385415 - DNA, 25 bp, Homo sapien
ctggcctttttggttcagagtaaat

SEQ ID NO: 385416 - DNA, 25 bp, Homo sapien
cccctgggatttgtcgagaaacgca

SEQ ID NO: 385417 - DNA, 25 bp, Homo sapien
ggatttgtcgagaaacgcactgtac

SEQ ID NO: 385418 - DNA, 25 bp, Homo sapien
gtcgagaaacgcactgtacgtgaaa

SEQ ID NO: 385419 - DNA, 25 bp, Homo sapien
gcactgtacgtgaaatgctttgcca

SEQ ID NO: 385420 - DNA, 25 bp, Homo sapien
ccatgaaatgtcttattaaaaggaa

SEQ ID NO: 385421 - DNA, 25 bp, Homo sapien
atgaaatgtcttattaaaaggaagc

SEQ ID NO: 385422 - DNA, 25 bp, Homo sapien
gaaatgtcttattaaaaggaagcac

SEQ ID NO: 385423 - DNA, 25 bp, Homo sapien
aaggaagcaccaagtttcaggccag

SEQ ID NO: 385424 - DNA, 25 bp, Homo sapien
aggaagcaccaagtttcaggccagg

SEQ ID NO: 385425 - DNA, 25 bp, Homo sapien
ggaagcaccaagtttcaggccagga

SEQ ID NO: 385426 - DNA, 25 bp, Homo sapien
gaagcaccaagtttcaggccaggag

SEQ ID NO: 385427 - DNA, 25 bp, Homo sapien
aagcaccaagtttcaggccaggagt

SEQ ID NO: 385428 - DNA, 25 bp, Homo sapien
agcaccaagtttcaggccaggagtg

SEQ ID NO: 385429 - DNA, 25 bp, Homo sapien
gcaccaagtttcaggccaggagtgg

SEQ ID NO: 385430 - DNA, 25 bp, Homo sapien
caccaagtttcaggccaggagtggt

SEQ ID NO: 385431 - DNA, 25 bp, Homo sapien
tccttctggaccacctgaaaagggt

SEQ ID NO: 385432 - DNA, 25 bp, Homo sapien
ggaggcagtcaataagatgtccctg

SEQ ID NO: 385433 - DNA, 25 bp, Homo sapien
gtcaataagatgtccctgcacaacc

SEQ ID NO: 385434 - DNA, 25 bp, Homo sapien
aataagatgtccctgcacaacctcg

SEQ ID NO: 385435 - DNA, 25 bp, Homo sapien
tccggccctccgagaaggagagcaa

SEQ ID NO: 385436 - DNA, 25 bp, Homo sapien
gagaaggagagcaagctccctgcca

SEQ ID NO: 385437 - DNA, 25 bp, Homo sapien
gccagcctatcaccatgactgacag

SEQ ID NO: 385438 - DNA, 25 bp, Homo sapien
ctgacagctggtccttggaggtcat

SEQ ID NO: 385439 - DNA, 25 bp, Homo sapien
tggtccttggaggtcatgtcccagg

SEQ ID NO: 385440 - DNA, 25 bp, Homo sapien
aggtccaggtgctgctgtacttcct

SEQ ID NO: 385441 - DNA, 25 bp, Homo sapien
ctgctgtacttcctgcagctggagg

SEQ ID NO: 385442 - DNA, 25 bp, Homo sapien
ggtggttccaagtggtgcttacatc

SEQ ID NO: 385443 - DNA, 25 bp, Homo sapien
actccacgatggaggcctggattat

SEQ ID NO: 385444 - DNA, 25 bp, Homo sapien
tatagcttgagaactgggtgtgcct

SEQ ID NO: 385445 - DNA, 25 bp, Homo sapien
gtgcctggcctacttcgagagcaag

SEQ ID NO: 385446 - DNA, 25 bp, Homo sapien
tcgagagcaagttcaaccccatggc

SEQ ID NO: 385447 - DNA, 25 bp, Homo sapien
atggccatctacgagaacacacgtg

SEQ ID NO: 385448 - DNA, 25 bp, Homo sapien
acacgtgagggctacactggctttg

SEQ ID NO: 385449 - DNA, 25 bp, Homo sapien
ttggcctctttcagatgcgtggcag

SEQ ID NO: 385450 - DNA, 25 bp, Homo sapien
tgtggcgaccatggcaggaaccgct

SEQ ID NO: 385451 - DNA, 25 bp, Homo sapien
aggaaccgctgccatatgtcatgtt

SEQ ID NO: 385452 - DNA, 25 bp, Homo sapien
tgtcatgttccgctttactgaatcc

SEQ ID NO: 385453 - DNA, 25 bp, Homo sapien
agagtgagttgtctcaggaccccgt

SEQ ID NO: 385454 - DNA, 25 bp, Homo sapien
aggaccccgtcactgcgacgttgac

SEQ ID NO: 385455 - DNA, 25 bp, Homo sapien
gtcactgcgacgttgacactcctct

SEQ ID NO: 385456 - DNA, 25 bp, Homo sapien
ccaactccccaaacactgtggaagg

SEQ ID NO: 385457 - DNA, 25 bp, Homo sapien
gaagtgatccacagcattcaggcca

SEQ ID NO: 385458 - DNA, 25 bp, Homo sapien
atccacagcattcaggccacttggg

SEQ ID NO: 385459 - DNA, 25 bp, Homo sapien
gtctagaccatggtggtgccagcct

SEQ ID NO: 385460 - DNA, 25 bp, Homo sapien
cccgctggagcggttgagtgcagaa

SEQ ID NO: 385461 - DNA, 25 bp, Homo sapien
gagtgcagaagggtgcgcctcttcc

SEQ ID NO: 385462 - DNA, 25 bp, Homo sapien
tgccagcctgagacggttcctgcct

SEQ ID NO: 385463 - DNA, 25 bp, Homo sapien
tgagacggttcctgcctgtcttggg

SEQ ID NO: 385464 - DNA, 25 bp, Homo sapien
atagcattgcttcgtgcactttgaa

SEQ ID NO: 385465 - DNA, 25 bp, Homo sapien
aggtgttttctgtgctactagttgt

SEQ ID NO: 385466 - DNA, 25 bp, Homo sapien
agttgtcacgttgcattcatgttca

SEQ ID NO: 385467 - DNA, 25 bp, Homo sapien
attcatgttcacctcctgatttaag

SEQ ID NO: 385468 - DNA, 25 bp, Homo sapien
gatttaagtatctcgggtgtgccca

SEQ ID NO: 385469 - DNA, 25 bp, Homo sapien
tcgggtgtgcccagccactaaagca

SEQ ID NO: 385470 - DNA, 25 bp, Homo sapien
agcactctggactaatcgctaaaga

SEQ ID NO: 385471 - DNA, 25 bp, Homo sapien
ggatgtgttcacatgtacccatcat

SEQ ID NO: 385472 - DNA, 25 bp, Homo sapien
gtacccatcatttgatcatagcact

SEQ ID NO: 385473 - DNA, 25 bp, Homo sapien
gattgcttttgatgtgtgtctctag

SEQ ID NO: 385474 - DNA, 25 bp, Homo sapien
catgcttaaagcacatgtccattaa

SEQ ID NO: 385475 - DNA, 25 bp, Homo sapien
ggaaatagtttgttcatatggccaa

SEQ ID NO: 385476 - DNA, 25 bp, Homo sapien
agtttgttcatatggccaaattata

SEQ ID NO: 385477 - DNA, 25 bp, Homo sapien
tcatatggccaaattataaagggac

SEQ ID NO: 385478 - DNA, 25 bp, Homo sapien
gctatgttttctgattacgaaggaa

SEQ ID NO: 385479 - DNA, 25 bp, Homo sapien
ttacgaaggaaatctatgctcacag

SEQ ID NO: 385480 - DNA, 25 bp, Homo sapien
tctatgctcacagtgggaaaacaag

SEQ ID NO: 385481 - DNA, 25 bp, Homo sapien
gtggcaaagcacaggtaagaaaata

SEQ ID NO: 385482 - DNA, 25 bp, Homo sapien
gaaagcaaactgttaattatagctg

SEQ ID NO: 385483 - DNA, 25 bp, Homo sapien
ctgtatatttcagtgtagaggctac

SEQ ID NO: 385484 - DNA, 25 bp, Homo sapien
gtagaggctacaggtgccttgcatt

SEQ ID NO: 385485 - DNA, 25 bp, Homo sapien
ggtgccttgcatttgttttcttata

SEQ ID NO: 385486 - DNA, 25 bp, Homo sapien
aagacttctgaaaacgactccaaga

SEQ ID NO: 385487 - DNA, 25 bp, Homo sapien
tccaagaacagcaaggccgtgaaca

SEQ ID NO: 385488 - DNA, 25 bp, Homo sapien
gaagtcaatagaacgcatgcctgct

SEQ ID NO: 385489 - DNA, 25 bp, Homo sapien
aatagaacgcatgcctgctttgccc

SEQ ID NO: 385490 - DNA, 25 bp, Homo sapien
tgctttgccctccaggacgagatcc

SEQ ID NO: 385491 - DNA, 25 bp, Homo sapien
aggacgagatcctccaacggctgtt

SEQ ID NO: 385492 - DNA, 25 bp, Homo sapien
gagatcctccaacggctgttgttca

SEQ ID NO: 385493 - DNA, 25 bp, Homo sapien
aaatgaatcaccacgggcggtcaag

SEQ ID NO: 385494 - DNA, 25 bp, Homo sapien
tattccttctgctgttgcttagcaa

SEQ ID NO: 385495 - DNA, 25 bp, Homo sapien
gttgcttagcaactggttggtcaag

SEQ ID NO: 385496 - DNA, 25 bp, Homo sapien
caagtatgaacacaagctcaccctc

SEQ ID NO: 385497 - DNA, 25 bp, Homo sapien
gtgtgtactgatcagttttattact

SEQ ID NO: 385498 - DNA, 25 bp, Homo sapien
ttatactcctgaagaagtaatgtga

SEQ ID NO: 385499 - DNA, 25 bp, Homo sapien
aattttctatgccattaggctattt

SEQ ID NO: 385500 - DNA, 25 bp, Homo sapien
atgccattaggctatttcttgctct

SEQ ID NO: 385501 - DNA, 25 bp, Homo sapien
attaggctatttcttgctctctgca

SEQ ID NO: 385502 - DNA, 25 bp, Homo sapien
taggctatttcttgctctctgcata

SEQ ID NO: 385503 - DNA, 25 bp, Homo sapien
tatttcttgctctctgcataccaaa

SEQ ID NO: 385504 - DNA, 25 bp, Homo sapien
tcttgctctctgcataccaaatctt

SEQ ID NO: 385505 - DNA, 25 bp, Homo sapien
gctctctgcataccaaatcttattt

SEQ ID NO: 385506 - DNA, 25 bp, Homo sapien
ccaaatcttatttctgaccagtttt

SEQ ID NO: 385507 - DNA, 25 bp, Homo sapien
gatttgccaaaaggtaagtgtttct

SEQ ID NO: 385508 - DNA, 25 bp, Homo sapien
gtacgggtggtagaggccgctcatc

SEQ ID NO: 385509 - DNA, 25 bp, Homo sapien
gcaccgcggaccacgaggcagagaa

SEQ ID NO: 385510 - DNA, 25 bp, Homo sapien
acgaggcagagaacacggccgatct

SEQ ID NO: 385511 - DNA, 25 bp, Homo sapien
gggcaaaactacacgaggcgaactc

SEQ ID NO: 385512 - DNA, 25 bp, Homo sapien
actacacgaggcgaactcggcggcg

SEQ ID NO: 385513 - DNA, 25 bp, Homo sapien
tcgtcgccctcatggcctataagcg

SEQ ID NO: 385514 - DNA, 25 bp, Homo sapien
tcatggcctataagcgagtccacgt

SEQ ID NO: 385515 - DNA, 25 bp, Homo sapien
ggcctataagcgagtccacgtagta

SEQ ID NO: 385516 - DNA, 25 bp, Homo sapien
gcgagtccacgtagtagttgctgag

SEQ ID NO: 385517 - DNA, 25 bp, Homo sapien
cgtagtagttgctgagggtgccact

SEQ ID NO: 385518 - DNA, 25 bp, Homo sapien
tgctgagggtgccactggaagacat

SEQ ID NO: 385519 - DNA, 25 bp, Homo sapien
ttctaggcactgtccgggctcggca

SEQ ID NO: 385520 - DNA, 25 bp, Homo sapien
ggccccgggcagaaccttgcaggaa

SEQ ID NO: 385521 - DNA, 25 bp, Homo sapien
ctcctggagttcagtgtgggcagac

SEQ ID NO: 385522 - DNA, 25 bp, Homo sapien
acattggccaataacttcagtacaa

SEQ ID NO: 385523 - DNA, 25 bp, Homo sapien
cagtacaagtggagctgaggcgtca

SEQ ID NO: 385524 - DNA, 25 bp, Homo sapien
atatccactgatagactgcacacgc

SEQ ID NO: 385525 - DNA, 25 bp, Homo sapien
tgcacacgcagtggcacgcttaaac

SEQ ID NO: 385526 - DNA, 25 bp, Homo sapien
gcagtggcacgcttaaaccgtcaca

SEQ ID NO: 385527 - DNA, 25 bp, Homo sapien
ttaaaccgtcacacgtgctcttgtc

SEQ ID NO: 385528 - DNA, 25 bp, Homo sapien
tcttgtccatgcattcattcccatt

SEQ ID NO: 385529 - DNA, 25 bp, Homo sapien
attcattcccattctaggcactgtc

SEQ ID NO: 385530 - DNA, 25 bp, Homo sapien
gtttcaacatctcccggtccattta

SEQ ID NO: 385531 - DNA, 25 bp, Homo sapien
ttgaccctcatcagggctcatcttt

SEQ ID NO: 385532 - DNA, 25 bp, Homo sapien
agggctcatctttaagccttcccga

SEQ ID NO: 385533 - DNA, 25 bp, Homo sapien
aagccttcccgaagcattctaatgc

SEQ ID NO: 385534 - DNA, 25 bp, Homo sapien
aaacatagtatgtatagaccctggg

SEQ ID NO: 385535 - DNA, 25 bp, Homo sapien
tgactgtggtggcatagccaaacaa

SEQ ID NO: 385536 - DNA, 25 bp, Homo sapien
caagcatgtcattagtcccaaggca

SEQ ID NO: 385537 - DNA, 25 bp, Homo sapien
gtcattagtcccaaggcaagcattg

SEQ ID NO: 385538 - DNA, 25 bp, Homo sapien
aaggcaagcattgcaccagccagca

SEQ ID NO: 385539 - DNA, 25 bp, Homo sapien
cagccagcacggtcaggcggttata

SEQ ID NO: 385540 - DNA, 25 bp, Homo sapien
tcaggcggttatagcgcattgccat

SEQ ID NO: 385541 - DNA, 25 bp, Homo sapien
agtggagaggcctaactctaatgtc

SEQ ID NO: 385542 - DNA, 25 bp, Homo sapien
taactctaatgtcgcctgcttaagc

SEQ ID NO: 385543 - DNA, 25 bp, Homo sapien
aatgtcgcctgcttaagcaaatcat

SEQ ID NO: 385544 - DNA, 25 bp, Homo sapien
agcaaatcatgcttctctgtttcac

SEQ ID NO: 385545 - DNA, 25 bp, Homo sapien
aatcatgcttctctgtttcacgtag

SEQ ID NO: 385546 - DNA, 25 bp, Homo sapien
cttctctgtttcacgtagttgggtt

SEQ ID NO: 385547 - DNA, 25 bp, Homo sapien
tagttgggttgacaagtttctgcct

SEQ ID NO: 385548 - DNA, 25 bp, Homo sapien
gtttctgcctttaagataaatgagt

SEQ ID NO: 385549 - DNA, 25 bp, Homo sapien
atgagtaatagtctaatgaccagct

SEQ ID NO: 385550 - DNA, 25 bp, Homo sapien
tattttcttcctattctgttcaaga

SEQ ID NO: 385551 - DNA, 25 bp, Homo sapien
gaaacagtaaacttggtttcaatct

SEQ ID NO: 385552 - DNA, 25 bp, Homo sapien
catcagtgcatctgggttatcaaca

SEQ ID NO: 385553 - DNA, 25 bp, Homo sapien
gggttatcaacattttctcaaatgc

SEQ ID NO: 385554 - DNA, 25 bp, Homo sapien
caaatgctgtcaatattttactgta

SEQ ID NO: 385555 - DNA, 25 bp, Homo sapien
cagatttttttccaatacctgtgca

SEQ ID NO: 385556 - DNA, 25 bp, Homo sapien
acctgtgcaagatacatgtgtagct

SEQ ID NO: 385557 - DNA, 25 bp, Homo sapien
gatacatgtgtagctcaaaactatt

SEQ ID NO: 385558 - DNA, 25 bp, Homo sapien
gtgtagctcaaaactatttgtgatc

SEQ ID NO: 385559 - DNA, 25 bp, Homo sapien
actatttgtgatctactgtttgcat

SEQ ID NO: 385560 - DNA, 25 bp, Homo sapien
atttgtgatctactgtttgcatgta

SEQ ID NO: 385561 - DNA, 25 bp, Homo sapien
gtttgcatgtaagagaccaggatat

SEQ ID NO: 385562 - DNA, 25 bp, Homo sapien
gagaccaggatatgtaactcttata

SEQ ID NO: 385563 - DNA, 25 bp, Homo sapien
agcacgaatcacaaagggcctcaaa

SEQ ID NO: 385564 - DNA, 25 bp, Homo sapien
cacaaagggcctcaaaaccacatta

SEQ ID NO: 385565 - DNA, 25 bp, Homo sapien
ttctgcttctgaatgtgagagccta

SEQ ID NO: 385566 - DNA, 25 bp, Homo sapien
gtgagagcctatactggatctctga

SEQ ID NO: 385567 - DNA, 25 bp, Homo sapien
gaaagtatgattgtctagccgatac

SEQ ID NO: 385568 - DNA, 25 bp, Homo sapien
gattgtctagccgatacttgactgt

SEQ ID NO: 385569 - DNA, 25 bp, Homo sapien
tgtctagccgatacttgactgtgtg

SEQ ID NO: 385570 - DNA, 25 bp, Homo sapien
aaccttcatctactccggaatcctg

SEQ ID NO: 385571 - DNA, 25 bp, Homo sapien
tactccggaatcctgaggcacagac

SEQ ID NO: 385572 - DNA, 25 bp, Homo sapien
tgaggcacagactcagaggccctct

SEQ ID NO: 385573 - DNA, 25 bp, Homo sapien
ttgtcagggtgatgcaacagcaaga

SEQ ID NO: 385574 - DNA, 25 bp, Homo sapien
atttcacttattggtaatcttactc

SEQ ID NO: 385575 - DNA, 25 bp, Homo sapien
attggtaatcttactctactgattt

SEQ ID NO: 385576 - DNA, 25 bp, Homo sapien
cagactgtgatttttgaacttcctt

SEQ ID NO: 385577 - DNA, 25 bp, Homo sapien
gcctttctcctgtctttctgtgttt

SEQ ID NO: 385578 - DNA, 25 bp, Homo sapien
ctgtgtttattcatggaattccagt

SEQ ID NO: 385579 - DNA, 25 bp, Homo sapien
ggaattccagttatctgggcttgaa

SEQ ID NO: 385580 - DNA, 25 bp, Homo sapien
gggcttgaaattgcaggctctccta

SEQ ID NO: 385581 - DNA, 25 bp, Homo sapien
gaaattgcaggctctcctaacttaa

SEQ ID NO: 385582 - DNA, 25 bp, Homo sapien
gcaggctctcctaacttaagcaaaa

SEQ ID NO: 385583 - DNA, 25 bp, Homo sapien
ttttctttctgactgcattaaatca

SEQ ID NO: 385584 - DNA, 25 bp, Homo sapien
attaaatcagatacaactcagcatt

SEQ ID NO: 385585 - DNA, 25 bp, Homo sapien
acaaccaagcttaggagccgactgt

SEQ ID NO: 385586 - DNA, 25 bp, Homo sapien
aggagccgactgttaagatgcccca

SEQ ID NO: 385587 - DNA, 25 bp, Homo sapien
gttaagatgccccagtgacacggac

SEQ ID NO: 385588 - DNA, 25 bp, Homo sapien
gatgccccagtgacacggacaagtt

SEQ ID NO: 385589 - DNA, 25 bp, Homo sapien
agtgacacggacaagtttctcctct

SEQ ID NO: 385590 - DNA, 25 bp, Homo sapien
gacacggacaagtttctcctctgca

SEQ ID NO: 385591 - DNA, 25 bp, Homo sapien
tctgcaacccaatgagagctgctga

SEQ ID NO: 385592 - DNA, 25 bp, Homo sapien
acccaatgagagctgctgaccacga

SEQ ID NO: 385593 - DNA, 25 bp, Homo sapien
tgagagctgctgaccacgagagcat

SEQ ID NO: 385594 - DNA, 25 bp, Homo sapien
tgctgaccacgagagcatcgcggga

SEQ ID NO: 385595 - DNA, 25 bp, Homo sapien
gaccacgagagcatcgcgggaccgc

SEQ ID NO: 385596 - DNA, 25 bp, Homo sapien
tattttcagcttaggtttttaccag

SEQ ID NO: 385597 - DNA, 25 bp, Homo sapien
ggtttttaccagctgaatgactgta

SEQ ID NO: 385598 - DNA, 25 bp, Homo sapien
ctgaatgactgtaggcaagccgttt

SEQ ID NO: 385599 - DNA, 25 bp, Homo sapien
aggcaagccgtttaaatagctttga

SEQ ID NO: 385600 - DNA, 25 bp, Homo sapien
atagctttgagacctaatttctcca

SEQ ID NO: 385601 - DNA, 25 bp, Homo sapien
gagacctaatttctccatctgttag

SEQ ID NO: 385602 - DNA, 25 bp, Homo sapien
ttctccatctgttagaggtggtgat

SEQ ID NO: 385603 - DNA, 25 bp, Homo sapien
gtgataattatacttgccctacctg

SEQ ID NO: 385604 - DNA, 25 bp, Homo sapien
attatacttgccctacctgatcagg

SEQ ID NO: 385605 - DNA, 25 bp, Homo sapien
tgccctacctgatcagggtttttgt

SEQ ID NO: 385606 - DNA, 25 bp, Homo sapien
tagataaaacgctttgtaaactgta

SEQ ID NO: 385607 - DNA, 25 bp, Homo sapien
gcgatagctgaatactggtgcgagc

SEQ ID NO: 385608 - DNA, 25 bp, Homo sapien
aatactggtgcgagctcagaagctt

SEQ ID NO: 385609 - DNA, 25 bp, Homo sapien
gagctcagaagcttccgtgtgcgga

SEQ ID NO: 385610 - DNA, 25 bp, Homo sapien
gaagcttccgtgtgcggagaacaaa

SEQ ID NO: 385611 - DNA, 25 bp, Homo sapien
ttccgtgtgcggagaacaaagactg

SEQ ID NO: 385612 - DNA, 25 bp, Homo sapien
gagaacaaagactgaggcgctctgg

SEQ ID NO: 385613 - DNA, 25 bp, Homo sapien
agagcgctgtccgaagtgctgatca

SEQ ID NO: 385614 - DNA, 25 bp, Homo sapien
gctgtccgaagtgctgatcagactt

SEQ ID NO: 385615 - DNA, 25 bp, Homo sapien
agtgctgatcagacttcggatccac

SEQ ID NO: 385616 - DNA, 25 bp, Homo sapien
gctgatcagacttcggatccaccca

SEQ ID NO: 385617 - DNA, 25 bp, Homo sapien
agggcggcagccgaaccggagagac

SEQ ID NO: 385618 - DNA, 25 bp, Homo sapien
atcttggtctctccatacctagttt

SEQ ID NO: 385619 - DNA, 25 bp, Homo sapien
gtctctccatacctagtttctttgt

SEQ ID NO: 385620 - DNA, 25 bp, Homo sapien
agtttctttgtatctacactctgta

SEQ ID NO: 385621 - DNA, 25 bp, Homo sapien
tgagattctgttaagctcctctatc

SEQ ID NO: 385622 - DNA, 25 bp, Homo sapien
attctgttaagctcctctatctcat

SEQ ID NO: 385623 - DNA, 25 bp, Homo sapien
ctcctctatctcatcctagaactaa

SEQ ID NO: 385624 - DNA, 25 bp, Homo sapien
gaactaagagaccaaagcaatcaaa

SEQ ID NO: 385625 - DNA, 25 bp, Homo sapien
agcaatcaaacaagcatacagttgg

SEQ ID NO: 385626 - DNA, 25 bp, Homo sapien
cccagccaaaagcacactcttttta

SEQ ID NO: 385627 - DNA, 25 bp, Homo sapien
acttaatcaatcttgagatcctcat

SEQ ID NO: 385628 - DNA, 25 bp, Homo sapien
gaaatatctagttacccatcttggt

SEQ ID NO: 385629 - DNA, 25 bp, Homo sapien
aagtgattggcatattatgtgatac

SEQ ID NO: 385630 - DNA, 25 bp, Homo sapien
atgtatcatagcacaactctgttgg

SEQ ID NO: 385631 - DNA, 25 bp, Homo sapien
caactctgttgggtattaaggcttc

SEQ ID NO: 385632 - DNA, 25 bp, Homo sapien
aaggcttcatcttagtatttccctg

SEQ ID NO: 385633 - DNA, 25 bp, Homo sapien
ttcatcttagtatttccctgcgttg

SEQ ID NO: 385634 - DNA, 25 bp, Homo sapien
tatttccctgcgttgctctttgaaa

SEQ ID NO: 385635 - DNA, 25 bp, Homo sapien
ccctgcgttgctctttgaaataaaa

SEQ ID NO: 385636 - DNA, 25 bp, Homo sapien
ataacctcttatcatattgatgtgt

SEQ ID NO: 385637 - DNA, 25 bp, Homo sapien
ttactcagttggcttctaatttgcg

SEQ ID NO: 385638 - DNA, 25 bp, Homo sapien
gttggcttctaatttgcgtaacaag

SEQ ID NO: 385639 - DNA, 25 bp, Homo sapien
gtactattattggaagcatgccttc

SEQ ID NO: 385640 - DNA, 25 bp, Homo sapien
aatgtccattatattaaaccagttg

SEQ ID NO: 385641 - DNA, 25 bp, Homo sapien
tgtttatcagtcattgagaatggac

SEQ ID NO: 385642 - DNA, 25 bp, Homo sapien
gagaatggacttattgagtctccca

SEQ ID NO: 385643 - DNA, 25 bp, Homo sapien
gaatggacttattgagtctcccagt

SEQ ID NO: 385644 - DNA, 25 bp, Homo sapien
atggacttattgagtctcccagtta

SEQ ID NO: 385645 - DNA, 25 bp, Homo sapien
gacttattgagtctcccagttatga

SEQ ID NO: 385646 - DNA, 25 bp, Homo sapien
attgagtctcccagttatgactgtg

SEQ ID NO: 385647 - DNA, 25 bp, Homo sapien
tttccatatctcttttagttctatc

SEQ ID NO: 385648 - DNA, 25 bp, Homo sapien
tccatatctcttttagttctatcaa

SEQ ID NO: 385649 - DNA, 25 bp, Homo sapien
atctcttttagttctatcaattttt

SEQ ID NO: 385650 - DNA, 25 bp, Homo sapien
atgtaatttccctatatttatatct

SEQ ID NO: 385651 - DNA, 25 bp, Homo sapien
aagactcgctcttcgggagctcgaa

SEQ ID NO: 385652 - DNA, 25 bp, Homo sapien
gagctcgaatggcttcttaggaccc

SEQ ID NO: 385653 - DNA, 25 bp, Homo sapien
aatggcttcttaggaccccgcaggg

SEQ ID NO: 385654 - DNA, 25 bp, Homo sapien
gtgacgagcgctcctccctggagtt

SEQ ID NO: 385655 - DNA, 25 bp, Homo sapien
ggagttcagccctcggcttgggact

SEQ ID NO: 385656 - DNA, 25 bp, Homo sapien
gggagcccagcgactacgctctgaa

SEQ ID NO: 385657 - DNA, 25 bp, Homo sapien
agcgactacgctctgaaatcccggg

SEQ ID NO: 385658 - DNA, 25 bp, Homo sapien
tacgctctgaaatcccgggctccat

SEQ ID NO: 385659 - DNA, 25 bp, Homo sapien
tttggcgtttttagaagatggtcac

SEQ ID NO: 385660 - DNA, 25 bp, Homo sapien
ttagaagatggtcacggcccacttt

SEQ ID NO: 385661 - DNA, 25 bp, Homo sapien
acggcccactttcgcttttcagagg

SEQ ID NO: 385662 - DNA, 25 bp, Homo sapien
aaagacaaaatctgaccatcagcca

SEQ ID NO: 385663 - DNA, 25 bp, Homo sapien
gaccatcagccagtgacagtcctgg

SEQ ID NO: 385664 - DNA, 25 bp, Homo sapien
catcagccagtgacagtcctggcaa

SEQ ID NO: 385665 - DNA, 25 bp, Homo sapien
agccagtgacagtcctggcaaatga

SEQ ID NO: 385666 - DNA, 25 bp, Homo sapien
cagtgacagtcctggcaaatgaagg

SEQ ID NO: 385667 - DNA, 25 bp, Homo sapien
agtgacagtcctggcaaatgaaggt

SEQ ID NO: 385668 - DNA, 25 bp, Homo sapien
gacagtcctggcaaatgaaggtggg

SEQ ID NO: 385669 - DNA, 25 bp, Homo sapien
tggccacaacccactgctctgatgg

SEQ ID NO: 385670 - DNA, 25 bp, Homo sapien
gccacaacccactgctctgatgggt

SEQ ID NO: 385671 - DNA, 25 bp, Homo sapien
acaacccactgctctgatgggtggt

SEQ ID NO: 385672 - DNA, 25 bp, Homo sapien
caacccactgctctgatgggtggtt

SEQ ID NO: 385673 - DNA, 25 bp, Homo sapien
atcacaaatatggtgcagctattgc

SEQ ID NO: 385674 - DNA, 25 bp, Homo sapien
cagctattgctggagtttaccgagc

SEQ ID NO: 385675 - DNA, 25 bp, Homo sapien
ctggagtttaccgagcagcagggaa

SEQ ID NO: 385676 - DNA, 25 bp, Homo sapien
atgataccatttgaagccctcacac

SEQ ID NO: 385677 - DNA, 25 bp, Homo sapien
gcactggacagacattttgcgtctt

SEQ ID NO: 385678 - DNA, 25 bp, Homo sapien
tttttacggattttagctactctat

SEQ ID NO: 385679 - DNA, 25 bp, Homo sapien
gctactctatagcatacatccttat

SEQ ID NO: 385680 - DNA, 25 bp, Homo sapien
tccttatgctgagatgttgaactta

SEQ ID NO: 385681 - DNA, 25 bp, Homo sapien
ggaatcctccaaaagaatacattat

SEQ ID NO: 385682 - DNA, 25 bp, Homo sapien
gagtgtagtgttttcttagttcttc

SEQ ID NO: 385683 - DNA, 25 bp, Homo sapien
cttcaccctcagacatcacaaatat

SEQ ID NO: 385684 - DNA, 25 bp, Homo sapien
atttcttcatgctttcgattctgca

SEQ ID NO: 385685 - DNA, 25 bp, Homo sapien
agccagtcacctcaccagagaatga

SEQ ID NO: 385686 - DNA, 25 bp, Homo sapien
tcacctcaccagagaatgacggctg

SEQ ID NO: 385687 - DNA, 25 bp, Homo sapien
gcacaaggattaatatttcccttct

SEQ ID NO: 385688 - DNA, 25 bp, Homo sapien
ataccattaggaaggttttcatgat

SEQ ID NO: 385689 - DNA, 25 bp, Homo sapien
aaatgaagctatctcacccagctgg

SEQ ID NO: 385690 - DNA, 25 bp, Homo sapien
tatctcacccagctgggtttggagg

SEQ ID NO: 385691 - DNA, 25 bp, Homo sapien
ctgggtttggaggagcaatctgctt

SEQ ID NO: 385692 - DNA, 25 bp, Homo sapien
aggagcaatctgcttattattctgt

SEQ ID NO: 385693 - DNA, 25 bp, Homo sapien
attattctgtcgttaccacttactc

SEQ ID NO: 385694 - DNA, 25 bp, Homo sapien
gttaccacttactcaagcgagctgt

SEQ ID NO: 385695 - DNA, 25 bp, Homo sapien
gcattatacgtaagctgagagactg

SEQ ID NO: 385696 - DNA, 25 bp, Homo sapien
agctgagagactgcacatcctttga

SEQ ID NO: 385697 - DNA, 25 bp, Homo sapien
tgagagactgcacatcctttgaggg

SEQ ID NO: 385698 - DNA, 25 bp, Homo sapien
gacaaaacaccagaacccgagaaca

SEQ ID NO: 385699 - DNA, 25 bp, Homo sapien
cagaacccgagaacacgtttgtaga

SEQ ID NO: 385700 - DNA, 25 bp, Homo sapien
gtttgtagaaatcttacttcatcat

SEQ ID NO: 385701 - DNA, 25 bp, Homo sapien
tgagttcctcaagcatgcgtgcaac

SEQ ID NO: 385702 - DNA, 25 bp, Homo sapien
gcatgcgtgcaacacaaaaggtctt

SEQ ID NO: 385703 - DNA, 25 bp, Homo sapien
aaaggtcttggctgttcttcatgtc

SEQ ID NO: 385704 - DNA, 25 bp, Homo sapien
gttcttcatgtctggcattggcagc

SEQ ID NO: 385705 - DNA, 25 bp, Homo sapien
gcattggcagctttcaggtcacaga

SEQ ID NO: 385706 - DNA, 25 bp, Homo sapien
atgtcattcagtttttgacaatgag

SEQ ID NO: 385707 - DNA, 25 bp, Homo sapien
gaggcatcagtgatatttcttatct

SEQ ID NO: 385708 - DNA, 25 bp, Homo sapien
gatatttcttatctacttgttacat

SEQ ID NO: 385709 - DNA, 25 bp, Homo sapien
gtaatgactgtgattgtgaccgagt

SEQ ID NO: 385710 - DNA, 25 bp, Homo sapien
gaccgagtaatgtgcactttttctt

SEQ ID NO: 385711 - DNA, 25 bp, Homo sapien
gcactttttcttgtaactgtggaca

SEQ ID NO: 385712 - DNA, 25 bp, Homo sapien
tgctatgcttttttcttctagtgtt

SEQ ID NO: 385713 - DNA, 25 bp, Homo sapien
gtgtttctagaattactgttcctta

SEQ ID NO: 385714 - DNA, 25 bp, Homo sapien
gaattactgttccttacaattatgt

SEQ ID NO: 385715 - DNA, 25 bp, Homo sapien
aaaacttttgtgatactgttggtga

SEQ ID NO: 385716 - DNA, 25 bp, Homo sapien
ggaaatacatagctgcacaaacatc

SEQ ID NO: 385717 - DNA, 25 bp, Homo sapien
tggtgaagccctcgatgtcagcaaa

SEQ ID NO: 385718 - DNA, 25 bp, Homo sapien
aaacaggatgctcacgttgtcatgt

SEQ ID NO: 385719 - DNA, 25 bp, Homo sapien
atgctcacgttgtcatgtttctgga

SEQ ID NO: 385720 - DNA, 25 bp, Homo sapien
aatcttatggaacatcatatcctcc

SEQ ID NO: 385721 - DNA, 25 bp, Homo sapien
atcctcctgcttggcgttgatgtct

SEQ ID NO: 385722 - DNA, 25 bp, Homo sapien
gttgatgtctgctttcatctccatg

SEQ ID NO: 385723 - DNA, 25 bp, Homo sapien
agcaggagccgttcctgctgctggt

SEQ ID NO: 385724 - DNA, 25 bp, Homo sapien
ctggatgcactctcgggtctcctgg

SEQ ID NO: 385725 - DNA, 25 bp, Homo sapien
gtctcctggaaagcctgtctctggg

SEQ ID NO: 385726 - DNA, 25 bp, Homo sapien
gtctctgggagacctcagccggata

SEQ ID NO: 385727 - DNA, 25 bp, Homo sapien
ctcagccggatagtgggtgcagaca

SEQ ID NO: 385728 - DNA, 25 bp, Homo sapien
tgctaataatgactgaaccatcgaa

SEQ ID NO: 385729 - DNA, 25 bp, Homo sapien
aaagcaaagttatagacagcgcctg

SEQ ID NO: 385730 - DNA, 25 bp, Homo sapien
tatagacagcgcctgcagacgcttt

SEQ ID NO: 385731 - DNA, 25 bp, Homo sapien
ctgcagacgctttcgggtccggagc

SEQ ID NO: 385732 - DNA, 25 bp, Homo sapien
gtgtattttacaactgcgatgccta

SEQ ID NO: 385733 - DNA, 25 bp, Homo sapien
tacaactgcgatgcctatcgggaat

SEQ ID NO: 385734 - DNA, 25 bp, Homo sapien
gcctatcgggaatgtggcaatcgcc

SEQ ID NO: 385735 - DNA, 25 bp, Homo sapien
gggcctgacagtaatcttgacaaat

SEQ ID NO: 385736 - DNA, 25 bp, Homo sapien
ccatgtcttttgaaggcagcagagc

SEQ ID NO: 385737 - DNA, 25 bp, Homo sapien
aagactcttaagattccagtgcgtt

SEQ ID NO: 385738 - DNA, 25 bp, Homo sapien
taagattccagtgcgttttgtaaaa

SEQ ID NO: 385739 - DNA, 25 bp, Homo sapien
ttctctccaggaattgaatccagaa

SEQ ID NO: 385740 - DNA, 25 bp, Homo sapien
gtcatcaagctaaaaggatatacca

SEQ ID NO: 385741 - DNA, 25 bp, Homo sapien
tcatcaagctaaaaggatataccaa

SEQ ID NO: 385742 - DNA, 25 bp, Homo sapien
ccatgttgaaaaatctatccaggat

SEQ ID NO: 385743 - DNA, 25 bp, Homo sapien
atgttgaaaaatctatccaggattc

SEQ ID NO: 385744 - DNA, 25 bp, Homo sapien
gttgaaaaatctatccaggattcat

SEQ ID NO: 385745 - DNA, 25 bp, Homo sapien
ggattcatcccgtgtcaacaatggt

SEQ ID NO: 385746 - DNA, 25 bp, Homo sapien
gattcatcccgtgtcaacaatggta

SEQ ID NO: 385747 - DNA, 25 bp, Homo sapien
attcatcccgtgtcaacaatggtaa

SEQ ID NO: 385748 - DNA, 25 bp, Homo sapien
ttcatcccgtgtcaacaatggtaaa

SEQ ID NO: 385749 - DNA, 25 bp, Homo sapien
tcatcccgtgtcaacaatggtaaag

SEQ ID NO: 385750 - DNA, 25 bp, Homo sapien
actttccagcacataaataaaggct

SEQ ID NO: 385751 - DNA, 25 bp, Homo sapien
acctgatgtatatattagacagttc

SEQ ID NO: 385752 - DNA, 25 bp, Homo sapien
gacagttctaggatgttagttccct

SEQ ID NO: 385753 - DNA, 25 bp, Homo sapien
aggatgttagttcccttcattccag

SEQ ID NO: 385754 - DNA, 25 bp, Homo sapien
ttcccttcattccagagctatgctt

SEQ ID NO: 385755 - DNA, 25 bp, Homo sapien
gagctatgcttgtgatacagcccct

SEQ ID NO: 385756 - DNA, 25 bp, Homo sapien
tgcttgtgatacagccccttttctt

SEQ ID NO: 385757 - DNA, 25 bp, Homo sapien
gaaggacttccttaacaatgactat

SEQ ID NO: 385758 - DNA, 25 bp, Homo sapien
cagttttgtattctgtcaatgcaaa

SEQ ID NO: 385759 - DNA, 25 bp, Homo sapien
taagacaggttgagccttaatcatg

SEQ ID NO: 385760 - DNA, 25 bp, Homo sapien
ggttgagccttaatcatgtaacaaa

SEQ ID NO: 385761 - DNA, 25 bp, Homo sapien
cccagaggctgggtgcgaggctagc

SEQ ID NO: 385762 - DNA, 25 bp, Homo sapien
cgccctcatttgtgcagcgccagat

SEQ ID NO: 385763 - DNA, 25 bp, Homo sapien
ctcatttgtgcagcgccagatcctt

SEQ ID NO: 385764 - DNA, 25 bp, Homo sapien
tttgtgcagcgccagatccttcgga

SEQ ID NO: 385765 - DNA, 25 bp, Homo sapien
tgtgcagcgccagatccttcggaca

SEQ ID NO: 385766 - DNA, 25 bp, Homo sapien
gcagcgccagatccttcggacacat

SEQ ID NO: 385767 - DNA, 25 bp, Homo sapien
agatccttcggacacatccctaggt

SEQ ID NO: 385768 - DNA, 25 bp, Homo sapien
atccttcggacacatccctaggtgt

SEQ ID NO: 385769 - DNA, 25 bp, Homo sapien
ggacacatccctaggtgtctccatc

SEQ ID NO: 385770 - DNA, 25 bp, Homo sapien
ctaggtgtctccatcctcattcggt

SEQ ID NO: 385771 - DNA, 25 bp, Homo sapien
gtgtctccatcctcattcggtccat

SEQ ID NO: 385772 - DNA, 25 bp, Homo sapien
gtgattctcaggtggatctgcatgt

SEQ ID NO: 385773 - DNA, 25 bp, Homo sapien
caggtggatctgcatgttggtatta

SEQ ID NO: 385774 - DNA, 25 bp, Homo sapien
acacagggctgacctttccgaagag

SEQ ID NO: 385775 - DNA, 25 bp, Homo sapien
tgacctttccgaagagaggcatgaa

SEQ ID NO: 385776 - DNA, 25 bp, Homo sapien
gaaatggcaggctgcacattcacct

SEQ ID NO: 385777 - DNA, 25 bp, Homo sapien
ggcaggctgcacattcaccttagaa

SEQ ID NO: 385778 - DNA, 25 bp, Homo sapien
tagaaggtagttggctattccccac

SEQ ID NO: 385779 - DNA, 25 bp, Homo sapien
tattccccaccttgcagaatacaat

SEQ ID NO: 385780 - DNA, 25 bp, Homo sapien
gcagaatacaatcacctttgaaagc

SEQ ID NO: 385781 - DNA, 25 bp, Homo sapien
gcctgtgcattcacttgacaatgaa

SEQ ID NO: 385782 - DNA, 25 bp, Homo sapien
gttttgtgatcatttacaacggcag

SEQ ID NO: 385783 - DNA, 25 bp, Homo sapien
agtgttctaccttttgggtatgaga

SEQ ID NO: 385784 - DNA, 25 bp, Homo sapien
accttttgggtatgagactaatatc

SEQ ID NO: 385785 - DNA, 25 bp, Homo sapien
gagactaatatcactaattcctcaa

SEQ ID NO: 385786 - DNA, 25 bp, Homo sapien
aattcctcaatagttatcatggctc

SEQ ID NO: 385787 - DNA, 25 bp, Homo sapien
aatagttatcatggctctatcttaa

SEQ ID NO: 385788 - DNA, 25 bp, Homo sapien
tctcttttgagaacaactgcttatt

SEQ ID NO: 385789 - DNA, 25 bp, Homo sapien
gagatgattatctagaagccagatt

SEQ ID NO: 385790 - DNA, 25 bp, Homo sapien
aaaatcagcttgtgaccttgctaag

SEQ ID NO: 385791 - DNA, 25 bp, Homo sapien
cagcttgtgaccttgctaagcatat

SEQ ID NO: 385792 - DNA, 25 bp, Homo sapien
gctaagcatataaactggaaattca

SEQ ID NO: 385793 - DNA, 25 bp, Homo sapien
tatgggttcatttaaaagtgttcta

SEQ ID NO: 385794 - DNA, 25 bp, Homo sapien
tggactttgctcactaaagtttgaa

SEQ ID NO: 385795 - DNA, 25 bp, Homo sapien
ggactttgctcactaaagtttgaat

SEQ ID NO: 385796 - DNA, 25 bp, Homo sapien
gactttgctcactaaagtttgaatg

SEQ ID NO: 385797 - DNA, 25 bp, Homo sapien
ctttgctcactaaagtttgaatgtt

SEQ ID NO: 385798 - DNA, 25 bp, Homo sapien
tttgctcactaaagtttgaatgtta

SEQ ID NO: 385799 - DNA, 25 bp, Homo sapien
gctcactaaagtttgaatgttaaga

SEQ ID NO: 385800 - DNA, 25 bp, Homo sapien
gaatagatgtatacagtctggatgc

SEQ ID NO: 385801 - DNA, 25 bp, Homo sapien
atagatgtatacagtctggatgcag

SEQ ID NO: 385802 - DNA, 25 bp, Homo sapien
agatgtatacagtctggatgcagtg

SEQ ID NO: 385803 - DNA, 25 bp, Homo sapien
atgtatacagtctggatgcagtggt

SEQ ID NO: 385804 - DNA, 25 bp, Homo sapien
tgtatacagtctggatgcagtggtg

SEQ ID NO: 385805 - DNA, 25 bp, Homo sapien
cctctgtcccccaatataatgaact

SEQ ID NO: 385806 - DNA, 25 bp, Homo sapien
aaaatcaagagagcaccccaaagtt

SEQ ID NO: 385807 - DNA, 25 bp, Homo sapien
gagagcaccccaaagttatttgtaa

SEQ ID NO: 385808 - DNA, 25 bp, Homo sapien
ggattcatacttcttttgctatgca

SEQ ID NO: 385809 - DNA, 25 bp, Homo sapien
ttgctatgcacaaaacattcacgtt

SEQ ID NO: 385810 - DNA, 25 bp, Homo sapien
aacaggtgcttttaggacacaactt

SEQ ID NO: 385811 - DNA, 25 bp, Homo sapien
ggaggcaatattgacactttggttt

SEQ ID NO: 385812 - DNA, 25 bp, Homo sapien
ttggtttgtggaacgttggtcttat

SEQ ID NO: 385813 - DNA, 25 bp, Homo sapien
acgttggtcttatttatatttctgc

SEQ ID NO: 385814 - DNA, 25 bp, Homo sapien
atatttctgcattccatccagtttc

SEQ ID NO: 385815 - DNA, 25 bp, Homo sapien
tgcattccatccagtttcctacatt

SEQ ID NO: 385816 - DNA, 25 bp, Homo sapien
gattgatggctactgacttaaagtc

SEQ ID NO: 385817 - DNA, 25 bp, Homo sapien
gacttaaagtctgcataggagaaga

SEQ ID NO: 385818 - DNA, 25 bp, Homo sapien
gaagagatagagcatgacataccaa

SEQ ID NO: 385819 - DNA, 25 bp, Homo sapien
gagcatgacataccaagtgaagcaa

SEQ ID NO: 385820 - DNA, 25 bp, Homo sapien
gactaagattcctgcattttgactc

SEQ ID NO: 385821 - DNA, 25 bp, Homo sapien
agattcctgcattttgactctaaat

SEQ ID NO: 385822 - DNA, 25 bp, Homo sapien
ctgcattttgactctaaatggttct

SEQ ID NO: 385823 - DNA, 25 bp, Homo sapien
ttcttttgaagtaaccagtgatctt

SEQ ID NO: 385824 - DNA, 25 bp, Homo sapien
agtgatcttttttgcttaccctcat

SEQ ID NO: 385825 - DNA, 25 bp, Homo sapien
ttgcttaccctcatcaacagaatgg

SEQ ID NO: 385826 - DNA, 25 bp, Homo sapien
gcttaccctcatcaacagaatggat

SEQ ID NO: 385827 - DNA, 25 bp, Homo sapien
gtgtagtatcctatgaggctgagat

SEQ ID NO: 385828 - DNA, 25 bp, Homo sapien
aagccagtggacgtggccgatgctt

SEQ ID NO: 385829 - DNA, 25 bp, Homo sapien
acgtggccgatgcttcaggctcctt

SEQ ID NO: 385830 - DNA, 25 bp, Homo sapien
ttccagccaggtccagcagtgttac

SEQ ID NO: 385831 - DNA, 25 bp, Homo sapien
agcagtgttaccatctgcttctcct

SEQ ID NO: 385832 - DNA, 25 bp, Homo sapien
gcaggcaccatgaactatgttaaca

SEQ ID NO: 385833 - DNA, 25 bp, Homo sapien
gaactatgttaacaaccccagtctg

SEQ ID NO: 385834 - DNA, 25 bp, Homo sapien
taacaaccccagtctgtactacaga

SEQ ID NO: 385835 - DNA, 25 bp, Homo sapien
gtactacagaaagggctgcagccac

SEQ ID NO: 385836 - DNA, 25 bp, Homo sapien
agggctgcagccacatgagaattca

SEQ ID NO: 385837 - DNA, 25 bp, Homo sapien
cacatgagaattcagtccacacaag

SEQ ID NO: 385838 - DNA, 25 bp, Homo sapien
tgaatcacatgaatctagtttaaga

SEQ ID NO: 385839 - DNA, 25 bp, Homo sapien
tctagtttaagatggaaacccactg

SEQ ID NO: 385840 - DNA, 25 bp, Homo sapien
tggaaacccactgctgctttgccta

SEQ ID NO: 385841 - DNA, 25 bp, Homo sapien
ttgcctactattcccccaagaagaa

SEQ ID NO: 385842 - DNA, 25 bp, Homo sapien
ctgagaagctatcacagttagtatt

SEQ ID NO: 385843 - DNA, 25 bp, Homo sapien
gaatctagagtcatatttgcagaat

SEQ ID NO: 385844 - DNA, 25 bp, Homo sapien
gcagaatgtaatgctgtttacttta

SEQ ID NO: 385845 - DNA, 25 bp, Homo sapien
gctgtttactttaactctgttttgg

SEQ ID NO: 385846 - DNA, 25 bp, Homo sapien
actctgttttggagcccagagctca

SEQ ID NO: 385847 - DNA, 25 bp, Homo sapien
ctaattttttgctaacaatttgcta

SEQ ID NO: 385848 - DNA, 25 bp, Homo sapien
tttgctaatcaaattgtctgcttga

SEQ ID NO: 385849 - DNA, 25 bp, Homo sapien
gaggcaaatgcagtttattgtaata

SEQ ID NO: 385850 - DNA, 25 bp, Homo sapien
gtaatatatgggattagattcatct

SEQ ID NO: 385851 - DNA, 25 bp, Homo sapien
tagattcatctatggagggcagagt

SEQ ID NO: 385852 - DNA, 25 bp, Homo sapien
tctggcagagaaggatgtccgttcc

SEQ ID NO: 385853 - DNA, 25 bp, Homo sapien
gcagagaaggatgtccgttccagga

SEQ ID NO: 385854 - DNA, 25 bp, Homo sapien
aggatgtccgttccaggagcacacg

SEQ ID NO: 385855 - DNA, 25 bp, Homo sapien
ccctgccagggctcgggcgctgtgg

SEQ ID NO: 385856 - DNA, 25 bp, Homo sapien
gcgctgtggctcctgccttgatgaa

SEQ ID NO: 385857 - DNA, 25 bp, Homo sapien
tgatgaagcccgtgtcctgccttga

SEQ ID NO: 385858 - DNA, 25 bp, Homo sapien
atgaagcccgtgtcctgccttgatg

SEQ ID NO: 385859 - DNA, 25 bp, Homo sapien
tgccttgatgaagcctgtgccacct

SEQ ID NO: 385860 - DNA, 25 bp, Homo sapien
atgacagattttactaaagctagtg

SEQ ID NO: 385861 - DNA, 25 bp, Homo sapien
tactaaagctagtgtttttataaca

SEQ ID NO: 385862 - DNA, 25 bp, Homo sapien
atatattagttgatgtttacctata

SEQ ID NO: 385863 - DNA, 25 bp, Homo sapien
ttgatgtttacctataagtggagta

SEQ ID NO: 385864 - DNA, 25 bp, Homo sapien
acctataagtggagtagattttcat

SEQ ID NO: 385865 - DNA, 25 bp, Homo sapien
ttttcatctgcctgcaatggtataa

SEQ ID NO: 385866 - DNA, 25 bp, Homo sapien
ttcatctgcctgcaatggtataatt

SEQ ID NO: 385867 - DNA, 25 bp, Homo sapien
atctgcctgcaatggtataatttca

SEQ ID NO: 385868 - DNA, 25 bp, Homo sapien
gcctgcaatggtataatttcagtct

SEQ ID NO: 385869 - DNA, 25 bp, Homo sapien
ctgattctaagtcaaatgcaaatgg

SEQ ID NO: 385870 - DNA, 25 bp, Homo sapien
gattctaagtcaaatgcaaatgggt

SEQ ID NO: 385871 - DNA, 25 bp, Homo sapien
ctattaatatctagttctcagagca

SEQ ID NO: 385872 - DNA, 25 bp, Homo sapien
ttaatatctagttctcagagcattt

SEQ ID NO: 385873 - DNA, 25 bp, Homo sapien
atatctagttctcagagcatttgga

SEQ ID NO: 385874 - DNA, 25 bp, Homo sapien
atctagttctcagagcatttggaaa

SEQ ID NO: 385875 - DNA, 25 bp, Homo sapien
gagcatttggaaaggttatcttaaa

SEQ ID NO: 385876 - DNA, 25 bp, Homo sapien
atcttaaatggctacctaaattgaa

SEQ ID NO: 385877 - DNA, 25 bp, Homo sapien
aaatggctacctaaattgaaatcct

SEQ ID NO: 385878 - DNA, 25 bp, Homo sapien
atggctacctaaattgaaatccttt

SEQ ID NO: 385879 - DNA, 25 bp, Homo sapien
tggctacctaaattgaaatcctttt

SEQ ID NO: 385880 - DNA, 25 bp, Homo sapien
gctacctaaattgaaatccttttca

SEQ ID NO: 385881 - DNA, 25 bp, Homo sapien
taaataatttctttacagatgtttt

SEQ ID NO: 385882 - DNA, 25 bp, Homo sapien
tccaaactactcatggagtccaaat

SEQ ID NO: 385883 - DNA, 25 bp, Homo sapien
atttttccagatcccttttccagat

SEQ ID NO: 385884 - DNA, 25 bp, Homo sapien
ttccagatcccttttccagatttta

SEQ ID NO: 385885 - DNA, 25 bp, Homo sapien
ggacctagaaatcctttaagtcaca

SEQ ID NO: 385886 - DNA, 25 bp, Homo sapien
aaatcctttaagtcacaatgttatt

SEQ ID NO: 385887 - DNA, 25 bp, Homo sapien
tggccaactgcaattaaacttcttt

SEQ ID NO: 385888 - DNA, 25 bp, Homo sapien
tacatttcaaagcttattcaggcat

SEQ ID NO: 385889 - DNA, 25 bp, Homo sapien
agcttattcaggcatttttggcatg

SEQ ID NO: 385890 - DNA, 25 bp, Homo sapien
ttttggcatgtacctcaagatcaat

SEQ ID NO: 385891 - DNA, 25 bp, Homo sapien
atgtacctcaagatcaatgattgtt

SEQ ID NO: 385892 - DNA, 25 bp, Homo sapien
tcaatagtgggctatttgccttttt

SEQ ID NO: 385893 - DNA, 25 bp, Homo sapien
tttaggaggtttaagcagctctggc

SEQ ID NO: 385894 - DNA, 25 bp, Homo sapien
agctctggcccctaccagtagtata

SEQ ID NO: 385895 - DNA, 25 bp, Homo sapien
ccctaccagtagtatatgcccttta

SEQ ID NO: 385896 - DNA, 25 bp, Homo sapien
taccagtagtatatgccctttaccc

SEQ ID NO: 385897 - DNA, 25 bp, Homo sapien
gggttgtgacaacgaaaaatgtctc

SEQ ID NO: 385898 - DNA, 25 bp, Homo sapien
agacattgccaaatgctctcttggg

SEQ ID NO: 385899 - DNA, 25 bp, Homo sapien
tagccaccaatcaagaaccactgtt

SEQ ID NO: 385900 - DNA, 25 bp, Homo sapien
ccactgttctaaaccagcagtctca

SEQ ID NO: 385901 - DNA, 25 bp, Homo sapien
aagcatggtctccatggaccactga

SEQ ID NO: 385902 - DNA, 25 bp, Homo sapien
tctccatggaccactgaggtcctaa

SEQ ID NO: 385903 - DNA, 25 bp, Homo sapien
gtcctaagaccctttgagggaggag

SEQ ID NO: 385904 - DNA, 25 bp, Homo sapien
cctggctgtccttctggtagagggt

SEQ ID NO: 385905 - DNA, 25 bp, Homo sapien
ccttctggtagagggtctcgtggaa

SEQ ID NO: 385906 - DNA, 25 bp, Homo sapien
gtctcgtggaaaaggatcacacccc

SEQ ID NO: 385907 - DNA, 25 bp, Homo sapien
ccccgatgctctggttgatggaact

SEQ ID NO: 385908 - DNA, 25 bp, Homo sapien
ggttgatggaactgtccacagagaa

SEQ ID NO: 385909 - DNA, 25 bp, Homo sapien
gaagaggatttctcggaactgccgg

SEQ ID NO: 385910 - DNA, 25 bp, Homo sapien
ggatttctcggaactgccggcggtt

SEQ ID NO: 385911 - DNA, 25 bp, Homo sapien
tgccggcggttctcttcagtgtttt

SEQ ID NO: 385912 - DNA, 25 bp, Homo sapien
accttgatcctctgcaggcggttcc

SEQ ID NO: 385913 - DNA, 25 bp, Homo sapien
aggcggttccccatggtacctacag

SEQ ID NO: 385914 - DNA, 25 bp, Homo sapien
ggtacctacagattcatctgcagcc

SEQ ID NO: 385915 - DNA, 25 bp, Homo sapien
gccaccaagttccagaatgatacac

SEQ ID NO: 385916 - DNA, 25 bp, Homo sapien
acacggatcagtgcagaagttcatc

SEQ ID NO: 385917 - DNA, 25 bp, Homo sapien
gctctcggaccttagggctgttgga

SEQ ID NO: 385918 - DNA, 25 bp, Homo sapien
tggagaaggcttcagcagcagaact

SEQ ID NO: 385919 - DNA, 25 bp, Homo sapien
tgatggtgaaggctcgtgttctcca

SEQ ID NO: 385920 - DNA, 25 bp, Homo sapien
gtgttctccatcctcaactttcttt

SEQ ID NO: 385921 - DNA, 25 bp, Homo sapien
aactttctttgcttcgatcatacac

SEQ ID NO: 385922 - DNA, 25 bp, Homo sapien
agtctgctgtgaagaccttctctca

SEQ ID NO: 385923 - DNA, 25 bp, Homo sapien
tctctcaagtggcatttgggagtcc

SEQ ID NO: 385924 - DNA, 25 bp, Homo sapien
atttgggagtccatgccagatcatg

SEQ ID NO: 385925 - DNA, 25 bp, Homo sapien
catgccagatcatggtgcttcatga

SEQ ID NO: 385926 - DNA, 25 bp, Homo sapien
ggttgagaacaataggagtccacat

SEQ ID NO: 385927 - DNA, 25 bp, Homo sapien
taggagtccacataagtcttcaatt

SEQ ID NO: 385928 - DNA, 25 bp, Homo sapien
agtcttcaattctaggagcttcaaa

SEQ ID NO: 385929 - DNA, 25 bp, Homo sapien
tgagatgtgttgtccttcatgttcc

SEQ ID NO: 385930 - DNA, 25 bp, Homo sapien
gttgtccttcatgttcctgttcatc

SEQ ID NO: 385931 - DNA, 25 bp, Homo sapien
agttgcttccctttgaagaactaag

SEQ ID NO: 385932 - DNA, 25 bp, Homo sapien
gaactaagaaaacactacactccat

SEQ ID NO: 385933 - DNA, 25 bp, Homo sapien
gacttggcttgggtaaaggtacaca

SEQ ID NO: 385934 - DNA, 25 bp, Homo sapien
tacactccataatgtattcttttgg

SEQ ID NO: 385935 - DNA, 25 bp, Homo sapien
gtattcttttggaggattccataaa

SEQ ID NO: 385936 - DNA, 25 bp, Homo sapien
ttaagttcaacatctcagcataagg

SEQ ID NO: 385937 - DNA, 25 bp, Homo sapien
acatgattttaccttaatcctctat

SEQ ID NO: 385938 - DNA, 25 bp, Homo sapien
atgattttaccttaatcctctataa

SEQ ID NO: 385939 - DNA, 25 bp, Homo sapien
ggctaatttaacacagctgtgacag

SEQ ID NO: 385940 - DNA, 25 bp, Homo sapien
ttaacacagctgtgacagagctcga

SEQ ID NO: 385941 - DNA, 25 bp, Homo sapien
acacagctgtgacagagctcgaatt

SEQ ID NO: 385942 - DNA, 25 bp, Homo sapien
gattctgaagcccatactctttcag

SEQ ID NO: 385943 - DNA, 25 bp, Homo sapien
tcagctctataatggagtctatgga

SEQ ID NO: 385944 - DNA, 25 bp, Homo sapien
atggatctatatttttcctataaga

SEQ ID NO: 385945 - DNA, 25 bp, Homo sapien
agacagctgtgtcagacttaggagt

SEQ ID NO: 385946 - DNA, 25 bp, Homo sapien
gtcagacttaggagtgtctttccct

SEQ ID NO: 385947 - DNA, 25 bp, Homo sapien
cagacttaggagtgtctttccctcc

SEQ ID NO: 385948 - DNA, 25 bp, Homo sapien
gtatgtagatgtgtgtcagtaccaa

SEQ ID NO: 385949 - DNA, 25 bp, Homo sapien
ctttcctgctgaatagcaaagaact

SEQ ID NO: 385950 - DNA, 25 bp, Homo sapien
aaaagtgtgaacaatgcgtttcagt

SEQ ID NO: 385951 - DNA, 25 bp, Homo sapien
gaacaatgcgtttcagttgactgta

SEQ ID NO: 385952 - DNA, 25 bp, Homo sapien
gcgtttcagttgactgtattgcata

SEQ ID NO: 385953 - DNA, 25 bp, Homo sapien
attgcatacttttttgctgaagact

SEQ ID NO: 385954 - DNA, 25 bp, Homo sapien
gctgaagactttttctgtaaacaca

SEQ ID NO: 385955 - DNA, 25 bp, Homo sapien
tgtaaacacaattgccttgttcagt

SEQ ID NO: 385956 - DNA, 25 bp, Homo sapien
aactgacttaccataagatgcactg

SEQ ID NO: 385957 - DNA, 25 bp, Homo sapien
taccataagatgcactgttgataat

SEQ ID NO: 385958 - DNA, 25 bp, Homo sapien
tgttgataatgctttctgatgtgtg

SEQ ID NO: 385959 - DNA, 25 bp, Homo sapien
ttccctaaaggagcgggcaagacca

SEQ ID NO: 385960 - DNA, 25 bp, Homo sapien
aagaccaggcctcaccggaaaacag

SEQ ID NO: 385961 - DNA, 25 bp, Homo sapien
aggcctcaccggaaaacagcgcagc

SEQ ID NO: 385962 - DNA, 25 bp, Homo sapien
gacacatctgatcaataaaacgccc

SEQ ID NO: 385963 - DNA, 25 bp, Homo sapien
agtgcggcgctttcaaaggcctgga

SEQ ID NO: 385964 - DNA, 25 bp, Homo sapien
tgatcaataaaacgcccatcccgga

SEQ ID NO: 385965 - DNA, 25 bp, Homo sapien
ctggagcctggtactcggcgcagcc

SEQ ID NO: 385966 - DNA, 25 bp, Homo sapien
gcatcttggccctccggagatcaac

SEQ ID NO: 385967 - DNA, 25 bp, Homo sapien
ggccctccggagatcaacgtttata

SEQ ID NO: 385968 - DNA, 25 bp, Homo sapien
gatcaacgtttatagcgggctcctc

SEQ ID NO: 385969 - DNA, 25 bp, Homo sapien
ttatagcgggctcctcttggactct

SEQ ID NO: 385970 - DNA, 25 bp, Homo sapien
ataaagctctgaggcgacagcggct

SEQ ID NO: 385971 - DNA, 25 bp, Homo sapien
agcggctgcggagaccctgcccgaa

SEQ ID NO: 385972 - DNA, 25 bp, Homo sapien
cctcccttgagaagccgcgggcaga

SEQ ID NO: 385973 - DNA, 25 bp, Homo sapien
aagccgcgggcagacagacggacct

SEQ ID NO: 385974 - DNA, 25 bp, Homo sapien
agacagacggacctcggaccgagca

SEQ ID NO: 385975 - DNA, 25 bp, Homo sapien
agacggacctcggaccgagcaacgg

SEQ ID NO: 385976 - DNA, 25 bp, Homo sapien
gggaccgcgggctctcgcctttctg

SEQ ID NO: 385977 - DNA, 25 bp, Homo sapien
ctttctgccgacttcttccaattct

SEQ ID NO: 385978 - DNA, 25 bp, Homo sapien
cgacttcttccaattctcatcttct

SEQ ID NO: 385979 - DNA, 25 bp, Homo sapien
agagaaatcgggacttggcattttc

SEQ ID NO: 385980 - DNA, 25 bp, Homo sapien
tcctaatttgttggaggccgccagc

SEQ ID NO: 385981 - DNA, 25 bp, Homo sapien
gaaactcgagcttgtgtctttggtc

SEQ ID NO: 385982 - DNA, 25 bp, Homo sapien
ctcgagcttgtgtctttggtcccgg

SEQ ID NO: 385983 - DNA, 25 bp, Homo sapien
tcccggagggcttaagcccggcagc

SEQ ID NO: 385984 - DNA, 25 bp, Homo sapien
gcttaagcccggcagccaggacagc

SEQ ID NO: 385985 - DNA, 25 bp, Homo sapien
agccaggacagcacgggtcactgat

SEQ ID NO: 385986 - DNA, 25 bp, Homo sapien
ggacagcacgggtcactgattccaa

SEQ ID NO: 385987 - DNA, 25 bp, Homo sapien
gcacgggtcactgattccaagaagt

SEQ ID NO: 385988 - DNA, 25 bp, Homo sapien
gggtcactgattccaagaagttgtg

SEQ ID NO: 385989 - DNA, 25 bp, Homo sapien
cctccccaacttaagtgcactagtt

SEQ ID NO: 385990 - DNA, 25 bp, Homo sapien
cttaagtgcactagttgtaaaatgt

SEQ ID NO: 385991 - DNA, 25 bp, Homo sapien
ctccagagctctgagggtcagggaa

SEQ ID NO: 385992 - DNA, 25 bp, Homo sapien
cctgcagtctggctgagccctgctt

SEQ ID NO: 385993 - DNA, 25 bp, Homo sapien
ttggttgtctccacacacagctggg

SEQ ID NO: 385994 - DNA, 25 bp, Homo sapien
ggtgtctcaggccacaccggccttg

SEQ ID NO: 385995 - DNA, 25 bp, Homo sapien
ggccctgagctgagggcattgctta

SEQ ID NO: 385996 - DNA, 25 bp, Homo sapien
agggcattgcttacacggatgcctt

SEQ ID NO: 385997 - DNA, 25 bp, Homo sapien
tgcttacacggatgccttcccctgg

SEQ ID NO: 385998 - DNA, 25 bp, Homo sapien
ttcccctgggccctgacattggagc

SEQ ID NO: 385999 - DNA, 25 bp, Homo sapien
gacattggagcctgggcatcctcag

SEQ ID NO: 386000 - DNA, 25 bp, Homo sapien
cctcaggtggtcaggcgtagatcac

SEQ ID NO: 386001 - DNA, 25 bp, Homo sapien
gtggtcaggcgtagatcaccagaat

SEQ ID NO: 386002 - DNA, 25 bp, Homo sapien
gatcaccagaataaacccagcttcc

SEQ ID NO: 386003 - DNA, 25 bp, Homo sapien
aaaagcattaattatgaaaagcgtc

SEQ ID NO: 386004 - DNA, 25 bp, Homo sapien
atgaaaagcgtcatatgttctaaaa

SEQ ID NO: 386005 - DNA, 25 bp, Homo sapien
gataatgtaatgagcttcataaaca

SEQ ID NO: 386006 - DNA, 25 bp, Homo sapien
gtaatgagcttcataaacatttata

SEQ ID NO: 386007 - DNA, 25 bp, Homo sapien
ttgagaatctggcttttctatcatt

SEQ ID NO: 386008 - DNA, 25 bp, Homo sapien
gagaatctggcttttctatcatttg

SEQ ID NO: 386009 - DNA, 25 bp, Homo sapien
aattcatgatagtggatggtagcta

SEQ ID NO: 386010 - DNA, 25 bp, Homo sapien
gatagtggatggtagctatacttca

SEQ ID NO: 386011 - DNA, 25 bp, Homo sapien
tagtggatggtagctatacttcagc

SEQ ID NO: 386012 - DNA, 25 bp, Homo sapien
agtggatggtagctatacttcagca

SEQ ID NO: 386013 - DNA, 25 bp, Homo sapien
gtggatggtagctatacttcagcaa

SEQ ID NO: 386014 - DNA, 25 bp, Homo sapien
aaacatcaggtttgctcaaatagac

SEQ ID NO: 386015 - DNA, 25 bp, Homo sapien
gctcaaatagactaacaacctgttg

SEQ ID NO: 386016 - DNA, 25 bp, Homo sapien
aacaacctgttgtccttaagcacat

SEQ ID NO: 386017 - DNA, 25 bp, Homo sapien
gttgtccttaagcacatactaccat

SEQ ID NO: 386018 - DNA, 25 bp, Homo sapien
gtccttaagcacatactaccatgaa

SEQ ID NO: 386019 - DNA, 25 bp, Homo sapien
agaaaattcgaatgcagtgctggtg

SEQ ID NO: 386020 - DNA, 25 bp, Homo sapien
tcaagtcctttcacaaagatcaaac

SEQ ID NO: 386021 - DNA, 25 bp, Homo sapien
tttcacaaagatcaaacttcagcct

SEQ ID NO: 386022 - DNA, 25 bp, Homo sapien
aacttcagcctattttgttagactc

SEQ ID NO: 386023 - DNA, 25 bp, Homo sapien
cagcctattttgttagactcagcaa

SEQ ID NO: 386024 - DNA, 25 bp, Homo sapien
tagactcagcaatgtctaaaacatt

SEQ ID NO: 386025 - DNA, 25 bp, Homo sapien
gccctttttcctcctgacagccaga

SEQ ID NO: 386026 - DNA, 25 bp, Homo sapien
cagacccttctgtctatggcactgc

SEQ ID NO: 386027 - DNA, 25 bp, Homo sapien
agacccttctgtctatggcactgcc

SEQ ID NO: 386028 - DNA, 25 bp, Homo sapien
acccttctgtctatggcactgcctg

SEQ ID NO: 386029 - DNA, 25 bp, Homo sapien
tgtctatggcactgcctgcagctgc

SEQ ID NO: 386030 - DNA, 25 bp, Homo sapien
gtctatggcactgcctgcagctgca

SEQ ID NO: 386031 - DNA, 25 bp, Homo sapien
agaggatatttccatggctgggcta

SEQ ID NO: 386032 - DNA, 25 bp, Homo sapien
gccagtaccagaatatcaaccagac

SEQ ID NO: 386033 - DNA, 25 bp, Homo sapien
ccagtaccagaatatcaaccagaca

SEQ ID NO: 386034 - DNA, 25 bp, Homo sapien
atcaaccagacactctcagctgcag

SEQ ID NO: 386035 - DNA, 25 bp, Homo sapien
tcaaccagacactctcagctgcagg

SEQ ID NO: 386036 - DNA, 25 bp, Homo sapien
gaagtgattcatccaggtggcgcta

SEQ ID NO: 386037 - DNA, 25 bp, Homo sapien
cgctaggagggatcttcgccgcaga

SEQ ID NO: 386038 - DNA, 25 bp, Homo sapien
atcttcgccgcagagggcattcgag

SEQ ID NO: 386039 - DNA, 25 bp, Homo sapien
gacaactctagacatccatgcaact

SEQ ID NO: 386040 - DNA, 25 bp, Homo sapien
atgcaacttctgttcttgtgctcct

SEQ ID NO: 386041 - DNA, 25 bp, Homo sapien
ttgtgctcctgctgttttcaaattc

SEQ ID NO: 386042 - DNA, 25 bp, Homo sapien
gttttcaaattccacagtcacagac

SEQ ID NO: 386043 - DNA, 25 bp, Homo sapien
agactgcaccctggaaaactcagga

SEQ ID NO: 386044 - DNA, 25 bp, Homo sapien
gacaccctagagtgaactgctctga

SEQ ID NO: 386045 - DNA, 25 bp, Homo sapien
gggcgtgggaccaagttccttagat

SEQ ID NO: 386046 - DNA, 25 bp, Homo sapien
agataaggctgtggccccatggtaa

SEQ ID NO: 386047 - DNA, 25 bp, Homo sapien
gcacgctggccgagagcagcgacca

SEQ ID NO: 386048 - DNA, 25 bp, Homo sapien
tggccgagagcagcgaccacgtgga

SEQ ID NO: 386049 - DNA, 25 bp, Homo sapien
ggacatgctggccacgggaggcttc

SEQ ID NO: 386050 - DNA, 25 bp, Homo sapien
caggaccaagggaggcagcaccatg

SEQ ID NO: 386051 - DNA, 25 bp, Homo sapien
aggaccaagggaggcagcaccatgt

SEQ ID NO: 386052 - DNA, 25 bp, Homo sapien
caccatgtccttctgtgggacactg

SEQ ID NO: 386053 - DNA, 25 bp, Homo sapien
accatgtccttctgtgggacactgc

SEQ ID NO: 386054 - DNA, 25 bp, Homo sapien
atgtccttctgtgggacactgccag

SEQ ID NO: 386055 - DNA, 25 bp, Homo sapien
agcccagcccggtggatcctctggg

SEQ ID NO: 386056 - DNA, 25 bp, Homo sapien
gaaatcccacagtttgatgtattaa

SEQ ID NO: 386057 - DNA, 25 bp, Homo sapien
aatcccacagtttgatgtattaaag

SEQ ID NO: 386058 - DNA, 25 bp, Homo sapien
tgctgtcagctaagttcacttctga

SEQ ID NO: 386059 - DNA, 25 bp, Homo sapien
gggttcctccaaatgttggctgaaa

SEQ ID NO: 386060 - DNA, 25 bp, Homo sapien
ccaaatgttggctgaaattcatccc

SEQ ID NO: 386061 - DNA, 25 bp, Homo sapien
gaaattcatcccaaggctggtctgc

SEQ ID NO: 386062 - DNA, 25 bp, Homo sapien
gcaaagtctgcaattcataatggag

SEQ ID NO: 386063 - DNA, 25 bp, Homo sapien
attcataatggagctactgtactgg

SEQ ID NO: 386064 - DNA, 25 bp, Homo sapien
tggagctactgtactggctattgga

SEQ ID NO: 386065 - DNA, 25 bp, Homo sapien
tactggctattggaaggaggagatt

SEQ ID NO: 386066 - DNA, 25 bp, Homo sapien
gaaaattcagatgactcattgtgag

SEQ ID NO: 386067 - DNA, 25 bp, Homo sapien
actcattgtgagtgctagttctctt

SEQ ID NO: 386068 - DNA, 25 bp, Homo sapien
tgctagttctcttgtaggatgccac

SEQ ID NO: 386069 - DNA, 25 bp, Homo sapien
aatgtgtaactttgaaattgtgttc

SEQ ID NO: 386070 - DNA, 25 bp, Homo sapien
atttgcactcggtgcagcggttatg

SEQ ID NO: 386071 - DNA, 25 bp, Homo sapien
gcactcggtgcagcggttatgctta

SEQ ID NO: 386072 - DNA, 25 bp, Homo sapien
ggtgcagcggttatgcttatgaaaa

SEQ ID NO: 386073 - DNA, 25 bp, Homo sapien
gaaaatacctggcagctttgtgcaa

SEQ ID NO: 386074 - DNA, 25 bp, Homo sapien
aatacctggcagctttgtgcaatga

SEQ ID NO: 386075 - DNA, 25 bp, Homo sapien
aggaattatctattttgtcatagta

SEQ ID NO: 386076 - DNA, 25 bp, Homo sapien
gtatattctgggtagttttaattgg

SEQ ID NO: 386077 - DNA, 25 bp, Homo sapien
tactgcatagtgttttgggtatttt

SEQ ID NO: 386078 - DNA, 25 bp, Homo sapien
ttatatgcaaaggtcttacgagcca

SEQ ID NO: 386079 - DNA, 25 bp, Homo sapien
ggtcttacgagccaataaaactatt

SEQ ID NO: 386080 - DNA, 25 bp, Homo sapien
gtcttgtgaaaccttacttcctcca

SEQ ID NO: 386081 - DNA, 25 bp, Homo sapien
gaaggaacggtttccaaagctaatg

SEQ ID NO: 386082 - DNA, 25 bp, Homo sapien
gctctgcctcgtgacactcaagtgg

SEQ ID NO: 386083 - DNA, 25 bp, Homo sapien
gtggcctcagatatgagcactggca

SEQ ID NO: 386084 - DNA, 25 bp, Homo sapien
aggtcacttagagagaagctgccgg

SEQ ID NO: 386085 - DNA, 25 bp, Homo sapien
aagctgccgggccaagcacacgaca

SEQ ID NO: 386086 - DNA, 25 bp, Homo sapien
gcacacgacaatcttggccctaagt

SEQ ID NO: 386087 - DNA, 25 bp, Homo sapien
taagtgctcacccattcctcatgtg

SEQ ID NO: 386088 - DNA, 25 bp, Homo sapien
tttctgctttgggaactatccaagt

SEQ ID NO: 386089 - DNA, 25 bp, Homo sapien
tatccaagtggcacatcaccatgtc

SEQ ID NO: 386090 - DNA, 25 bp, Homo sapien
catgtccagcttaggtgtcttgtga

SEQ ID NO: 386091 - DNA, 25 bp, Homo sapien
aagggactttggaacagcgtggaca

SEQ ID NO: 386092 - DNA, 25 bp, Homo sapien
ggaacagcgtggacataatccagaa

SEQ ID NO: 386093 - DNA, 25 bp, Homo sapien
aaaccttttgagtcaacagtctctg

SEQ ID NO: 386094 - DNA, 25 bp, Homo sapien
gtcaacagtctctgaagtcctatca

SEQ ID NO: 386095 - DNA, 25 bp, Homo sapien
agtcctatcactgcctgtcacagag

SEQ ID NO: 386096 - DNA, 25 bp, Homo sapien
gtcacagagactgtatgtctgacac

SEQ ID NO: 386097 - DNA, 25 bp, Homo sapien
tgtctgacaccaaatgaggaccaat

SEQ ID NO: 386098 - DNA, 25 bp, Homo sapien
gaggaccaattgaatcaacccacag

SEQ ID NO: 386099 - DNA, 25 bp, Homo sapien
tgattgaagtttccctctcagattt

SEQ ID NO: 386100 - DNA, 25 bp, Homo sapien
tgaagtttccctctcagatttgaaa

SEQ ID NO: 386101 - DNA, 25 bp, Homo sapien
cccctgaaaaggctgatgtacctgt

SEQ ID NO: 386102 - DNA, 25 bp, Homo sapien
tcccggatggtgctgactgctccct

SEQ ID NO: 386103 - DNA, 25 bp, Homo sapien
cggatggtgctgactgctccctaag

SEQ ID NO: 386104 - DNA, 25 bp, Homo sapien
ggatggtgctgactgctccctaagc

SEQ ID NO: 386105 - DNA, 25 bp, Homo sapien
gatggtgctgactgctccctaagcg

SEQ ID NO: 386106 - DNA, 25 bp, Homo sapien
atggtgctgactgctccctaagcgg

SEQ ID NO: 386107 - DNA, 25 bp, Homo sapien
ggtgctgactgctccctaagcggcg

SEQ ID NO: 386108 - DNA, 25 bp, Homo sapien
tgactgctccctaagcggcggcggc

SEQ ID NO: 386109 - DNA, 25 bp, Homo sapien
gcggcggcgagtcgtgaggacgcgc

SEQ ID NO: 386110 - DNA, 25 bp, Homo sapien
cgagtcgtgaggacgcgccgcggag

SEQ ID NO: 386111 - DNA, 25 bp, Homo sapien
ggacgcgccgcggaggctgttcggg

SEQ ID NO: 386112 - DNA, 25 bp, Homo sapien
gggtcgaggcttcccgtcgccggca

SEQ ID NO: 386113 - DNA, 25 bp, Homo sapien
aacctgaaagaatggattcctgctc

SEQ ID NO: 386114 - DNA, 25 bp, Homo sapien
gaatggattcctgctcccaatgtgt

SEQ ID NO: 386115 - DNA, 25 bp, Homo sapien
gattcctgctcccaatgtgttttta

SEQ ID NO: 386116 - DNA, 25 bp, Homo sapien
ccaatgtgtttttaatatcaactta

SEQ ID NO: 386117 - DNA, 25 bp, Homo sapien
gatgtagttgtctaatgttaaccta

SEQ ID NO: 386118 - DNA, 25 bp, Homo sapien
gttaacctaattaagagagcttggt

SEQ ID NO: 386119 - DNA, 25 bp, Homo sapien
gagagcttggtgtgatttctcatat

SEQ ID NO: 386120 - DNA, 25 bp, Homo sapien
cttggtgtgatttctcatatacagc

SEQ ID NO: 386121 - DNA, 25 bp, Homo sapien
tctcatatacagcatctaaatattt

SEQ ID NO: 386122 - DNA, 25 bp, Homo sapien
gtagaagatatttgacattaacttt

SEQ ID NO: 386123 - DNA, 25 bp, Homo sapien
atcataacattattcttaaaacctg

SEQ ID NO: 386124 - DNA, 25 bp, Homo sapien
aatgtccattatattaaaccagttg

SEQ ID NO: 386125 - DNA, 25 bp, Homo sapien
gttatccaggtttgatatatccttt

SEQ ID NO: 386126 - DNA, 25 bp, Homo sapien
atcctttttgatttccatctatttg

SEQ ID NO: 386127 - DNA, 25 bp, Homo sapien
catctatttgtttatcagtcattga

SEQ ID NO: 386128 - DNA, 25 bp, Homo sapien
gaatggacttattgagtctcccagt

SEQ ID NO: 386129 - DNA, 25 bp, Homo sapien
attgagtctcccagttatgactgtg

SEQ ID NO: 386130 - DNA, 25 bp, Homo sapien
gtggatttttccatatctcttttag

SEQ ID NO: 386131 - DNA, 25 bp, Homo sapien
tccatatctcttttagttctatcaa

SEQ ID NO: 386132 - DNA, 25 bp, Homo sapien
tattttggatctttgttagttgcat

SEQ ID NO: 386133 - DNA, 25 bp, Homo sapien
atttcagtgtttatcttcttggtga

SEQ ID NO: 386134 - DNA, 25 bp, Homo sapien
atgtaatttccctatatttatatct

SEQ ID NO: 386135 - DNA, 25 bp, Homo sapien
aaattctgctatttgacacagcttt

SEQ ID NO: 386136 - DNA, 25 bp, Homo sapien
gctatttgacacagctttggaaaga

SEQ ID NO: 386137 - DNA, 25 bp, Homo sapien
tccgttttgtattagaatgactgtt

SEQ ID NO: 386138 - DNA, 25 bp, Homo sapien
tatggtttcatggacactgttgagc

SEQ ID NO: 386139 - DNA, 25 bp, Homo sapien
catggacactgttgagcaatgtaca

SEQ ID NO: 386140 - DNA, 25 bp, Homo sapien
agtgtatggtgtgcttacctgtcca

SEQ ID NO: 386141 - DNA, 25 bp, Homo sapien
ttacctgtccactctagagcattgc

SEQ ID NO: 386142 - DNA, 25 bp, Homo sapien
tagagcattgcttacaggttttttg

SEQ ID NO: 386143 - DNA, 25 bp, Homo sapien
gatgctgtgctgtaaaatactgtca

SEQ ID NO: 386144 - DNA, 25 bp, Homo sapien
ttgctatttcctggtacagtgtagt

SEQ ID NO: 386145 - DNA, 25 bp, Homo sapien
tacagtgtagtttttcccctttcat

SEQ ID NO: 386146 - DNA, 25 bp, Homo sapien
ctggaaatagtttgttcatatggcc

SEQ ID NO: 386147 - DNA, 25 bp, Homo sapien
gaaatagtttgttcatatggccaaa

SEQ ID NO: 386148 - DNA, 25 bp, Homo sapien
agtttgttcatatggccaaattata

SEQ ID NO: 386149 - DNA, 25 bp, Homo sapien
tcatatggccaaattataaagggac

SEQ ID NO: 386150 - DNA, 25 bp, Homo sapien
gctatgttttctgattacgaaggaa

SEQ ID NO: 386151 - DNA, 25 bp, Homo sapien
ttacgaaggaaatctatgctcacag

SEQ ID NO: 386152 - DNA, 25 bp, Homo sapien
tctatgctcacagtgggaaaacaag

SEQ ID NO: 386153 - DNA, 25 bp, Homo sapien
gtggcaaagcacaggtaagaaaata

SEQ ID NO: 386154 - DNA, 25 bp, Homo sapien
ctgtatatttcagtgtagaggctac

SEQ ID NO: 386155 - DNA, 25 bp, Homo sapien
tcagtgtagaggctacaggtgcctt

SEQ ID NO: 386156 - DNA, 25 bp, Homo sapien
gtagaggctacaggtgccttgcatt

SEQ ID NO: 386157 - DNA, 25 bp, Homo sapien
cctgtgtttgcagtgagagtgactt

SEQ ID NO: 386158 - DNA, 25 bp, Homo sapien
ttgcagtgagagtgacttgctgtca

SEQ ID NO: 386159 - DNA, 25 bp, Homo sapien
agtgagagtgacttgctgtcagtca

SEQ ID NO: 386160 - DNA, 25 bp, Homo sapien
agagtgacttgctgtcagtcacggg

SEQ ID NO: 386161 - DNA, 25 bp, Homo sapien
ttcccccttcccactgaagtgtgag

SEQ ID NO: 386162 - DNA, 25 bp, Homo sapien
aagtgtgagctctatgtttcagggc

SEQ ID NO: 386163 - DNA, 25 bp, Homo sapien
gtgagctctatgtttcagggcatct

SEQ ID NO: 386164 - DNA, 25 bp, Homo sapien
gagctctatgtttcagggcatctat

SEQ ID NO: 386165 - DNA, 25 bp, Homo sapien
gctctatgtttcagggcatctatta

SEQ ID NO: 386166 - DNA, 25 bp, Homo sapien
gggcatctattaaagagtgagccac

SEQ ID NO: 386167 - DNA, 25 bp, Homo sapien
ttaggtaaagtgatctggttgactg

SEQ ID NO: 386168 - DNA, 25 bp, Homo sapien
agctacaccggaggctgatggcgct

SEQ ID NO: 386169 - DNA, 25 bp, Homo sapien
gctgatggcgctgcgggagcgcaac

SEQ ID NO: 386170 - DNA, 25 bp, Homo sapien
ggagcgcaacgtgctgcagcagatt

SEQ ID NO: 386171 - DNA, 25 bp, Homo sapien
gctgcagcagattgtgaatctgatc

SEQ ID NO: 386172 - DNA, 25 bp, Homo sapien
tgaatctgatcgaggagactggcca

SEQ ID NO: 386173 - DNA, 25 bp, Homo sapien
gactggccacttcaatgtcaccaac

SEQ ID NO: 386174 - DNA, 25 bp, Homo sapien
ttcgacctcttctccctggacgaga

SEQ ID NO: 386175 - DNA, 25 bp, Homo sapien
tggacgagaccaccgtgcgcaaact

SEQ ID NO: 386176 - DNA, 25 bp, Homo sapien
ccgtgcgcaaactgcagagctgcct

SEQ ID NO: 386177 - DNA, 25 bp, Homo sapien
tgcctggaggccgtggccacatgac

SEQ ID NO: 386178 - DNA, 25 bp, Homo sapien
tcccgtctcgcctgcttcatttgga

SEQ ID NO: 386179 - DNA, 25 bp, Homo sapien
tataggagccatgtaagcacgcagt

SEQ ID NO: 386180 - DNA, 25 bp, Homo sapien
gaactgcttaatttcactacatgtt

SEQ ID NO: 386181 - DNA, 25 bp, Homo sapien
catgttgatgtacttgtcttccgtc

SEQ ID NO: 386182 - DNA, 25 bp, Homo sapien
tctatataactttatgccaccctta

SEQ ID NO: 386183 - DNA, 25 bp, Homo sapien
tatgccacccttaaatgaatcattg

SEQ ID NO: 386184 - DNA, 25 bp, Homo sapien
gaatcattgggtatacctgtcatgt

SEQ ID NO: 386185 - DNA, 25 bp, Homo sapien
atacctgtcatgttggatcctgtaa

SEQ ID NO: 386186 - DNA, 25 bp, Homo sapien
tgtaatcacagttttccctgctcac

SEQ ID NO: 386187 - DNA, 25 bp, Homo sapien
cctgctcacctttttgtctaagatc

SEQ ID NO: 386188 - DNA, 25 bp, Homo sapien
ggaaggagaaccatttgatcagaat

SEQ ID NO: 386189 - DNA, 25 bp, Homo sapien
gaatacaaccaatagtctttaagca

SEQ ID NO: 386190 - DNA, 25 bp, Homo sapien
aaccgcatctgctcatctgatattc

SEQ ID NO: 386191 - DNA, 25 bp, Homo sapien
tgatattcaaacacacagtattcgt

SEQ ID NO: 386192 - DNA, 25 bp, Homo sapien
tctgtgctcacccattgtctcattg

SEQ ID NO: 386193 - DNA, 25 bp, Homo sapien
tgtctcattgccagtggtgtccaag

SEQ ID NO: 386194 - DNA, 25 bp, Homo sapien
tgctccgtgtgtctcatgccagcag

SEQ ID NO: 386195 - DNA, 25 bp, Homo sapien
tgtgtctcatgccagcagcacgtcg

SEQ ID NO: 386196 - DNA, 25 bp, Homo sapien
gtcgccatccgtcaccagaattagt

SEQ ID NO: 386197 - DNA, 25 bp, Homo sapien
accagaattagtcctcacagcctag

SEQ ID NO: 386198 - DNA, 25 bp, Homo sapien
cacagcctaggaccagttttgtatc

SEQ ID NO: 386199 - DNA, 25 bp, Homo sapien
gttttgtatcaaactcgtctgatgt

SEQ ID NO: 386200 - DNA, 25 bp, Homo sapien
actcgtctgatgttttgatgccatt

SEQ ID NO: 386201 - DNA, 25 bp, Homo sapien
gggacgaggcacctggcctcttctt

SEQ ID NO: 386202 - DNA, 25 bp, Homo sapien
aggcacctggcctcttcttcgtgga

SEQ ID NO: 386203 - DNA, 25 bp, Homo sapien
tggcctcttcttcgtggacgccgag

SEQ ID NO: 386204 - DNA, 25 bp, Homo sapien
tcttcttcgtggacgccgagcgcgt

SEQ ID NO: 386205 - DNA, 25 bp, Homo sapien
gacgacgtcttctttccgcctagtg

SEQ ID NO: 386206 - DNA, 25 bp, Homo sapien
gtgtccgcagcatctcggctctggg

SEQ ID NO: 386207 - DNA, 25 bp, Homo sapien
acgttcacgcgcgacgaggacctgg

SEQ ID NO: 386208 - DNA, 25 bp, Homo sapien
acgaggacctggctgttttcctggc

SEQ ID NO: 386209 - DNA, 25 bp, Homo sapien
aggacctggctgttttcctggcgtc

SEQ ID NO: 386210 - DNA, 25 bp, Homo sapien
tggctgttttcctggcgtcccgcgc

SEQ ID NO: 386211 - DNA, 25 bp, Homo sapien
aggactgcgcggacccgtcgggctg

SEQ ID NO: 386212 - DNA, 25 bp, Homo sapien
actccagtttagccgccgccggagg

SEQ ID NO: 386213 - DNA, 25 bp, Homo sapien
ctccagtttagccgccgccggaggc

SEQ ID NO: 386214 - DNA, 25 bp, Homo sapien
ccagtttagccgccgccggaggcag

SEQ ID NO: 386215 - DNA, 25 bp, Homo sapien
cagtttagccgccgccggaggcagg

SEQ ID NO: 386216 - DNA, 25 bp, Homo sapien
gggctgcggacttcggcctgcccct

SEQ ID NO: 386217 - DNA, 25 bp, Homo sapien
ggctgcggacttcggcctgcccctc

SEQ ID NO: 386218 - DNA, 25 bp, Homo sapien
gctgcggacttcggcctgcccctca

SEQ ID NO: 386219 - DNA, 25 bp, Homo sapien
ctgcggacttcggcctgcccctcac

SEQ ID NO: 386220 - DNA, 25 bp, Homo sapien
tgcggacttcggcctgcccctcacc

SEQ ID NO: 386221 - DNA, 25 bp, Homo sapien
cctcacctcactcccgctgcttgca

SEQ ID NO: 386222 - DNA, 25 bp, Homo sapien
tcacctcactcccgctgcttgcacc

SEQ ID NO: 386223 - DNA, 25 bp, Homo sapien
gaggtggtgatttggccagtgtttt

SEQ ID NO: 386224 - DNA, 25 bp, Homo sapien
aaagaaccgcagaagaaactgcatt

SEQ ID NO: 386225 - DNA, 25 bp, Homo sapien
ccattaaatgggaaatacagtgcta

SEQ ID NO: 386226 - DNA, 25 bp, Homo sapien
ggataagagtgcgaacctctcatct

SEQ ID NO: 386227 - DNA, 25 bp, Homo sapien
ataagagtgcgaacctctcatctct

SEQ ID NO: 386228 - DNA, 25 bp, Homo sapien
acaacttcatgtgctgctgactaat

SEQ ID NO: 386229 - DNA, 25 bp, Homo sapien
catgtgctgctgactaattttaaac

SEQ ID NO: 386230 - DNA, 25 bp, Homo sapien
aattttaaacatggccacagctggg

SEQ ID NO: 386231 - DNA, 25 bp, Homo sapien
gccagtgttttaacttgtgacaagt

SEQ ID NO: 386232 - DNA, 25 bp, Homo sapien
acttgtgacaagtactcaggtgtga

SEQ ID NO: 386233 - DNA, 25 bp, Homo sapien
gacaagtactcaggtgtgaggacaa

SEQ ID NO: 386234 - DNA, 25 bp, Homo sapien
ttcctttgctctggatacaccgaat

SEQ ID NO: 386235 - DNA, 25 bp, Homo sapien
tttgctctggatacaccgaatgacc

SEQ ID NO: 386236 - DNA, 25 bp, Homo sapien
gatacaccgaatgaccaggtaacat

SEQ ID NO: 386237 - DNA, 25 bp, Homo sapien
tgaccaggtaacatcatcaggccgg

SEQ ID NO: 386238 - DNA, 25 bp, Homo sapien
ccaggtaacatcatcaggccgggtg

SEQ ID NO: 386239 - DNA, 25 bp, Homo sapien
ggtaacatcatcaggccgggtgcag

SEQ ID NO: 386240 - DNA, 25 bp, Homo sapien
agtggctcctataatcccgatattt

SEQ ID NO: 386241 - DNA, 25 bp, Homo sapien
ggctcctataatcccgatattttgg

SEQ ID NO: 386242 - DNA, 25 bp, Homo sapien
ccaggaagtccagaacgtagtgagc

SEQ ID NO: 386243 - DNA, 25 bp, Homo sapien
gtccagaacgtagtgagccttgatt

SEQ ID NO: 386244 - DNA, 25 bp, Homo sapien
aacgtagtgagccttgattatacca

SEQ ID NO: 386245 - DNA, 25 bp, Homo sapien
agctgggatgcttgagggtatccaa

SEQ ID NO: 386246 - DNA, 25 bp, Homo sapien
aaagacaaaatctgaccatcagcca

SEQ ID NO: 386247 - DNA, 25 bp, Homo sapien
gaccatcagccagtgacagtcctgg

SEQ ID NO: 386248 - DNA, 25 bp, Homo sapien
catcagccagtgacagtcctggcaa

SEQ ID NO: 386249 - DNA, 25 bp, Homo sapien
agccagtgacagtcctggcaaatga

SEQ ID NO: 386250 - DNA, 25 bp, Homo sapien
agtgacagtcctggcaaatgaaggt

SEQ ID NO: 386251 - DNA, 25 bp, Homo sapien
tgatcctctggtttcttccattggg

SEQ ID NO: 386252 - DNA, 25 bp, Homo sapien
tggccacaacccactgctctgatgg

SEQ ID NO: 386253 - DNA, 25 bp, Homo sapien
acaacccactgctctgatgggtggt

SEQ ID NO: 386254 - DNA, 25 bp, Homo sapien
caacccactgctctgatgggtggtt

SEQ ID NO: 386255 - DNA, 25 bp, Homo sapien
ctgctctgatgggtggtttgtccaa

SEQ ID NO: 386256 - DNA, 25 bp, Homo sapien
atgagagttcagttgttgttccgga

SEQ ID NO: 386257 - DNA, 25 bp, Homo sapien
tcagttgttgttccggaaacccgat

SEQ ID NO: 386258 - DNA, 25 bp, Homo sapien
gttgttgttccggaaacccgatgtg

SEQ ID NO: 386259 - DNA, 25 bp, Homo sapien
ttgttccggaaacccgatgtggaag

SEQ ID NO: 386260 - DNA, 25 bp, Homo sapien
gaaggagtagacctgtgtccctgtt

SEQ ID NO: 386261 - DNA, 25 bp, Homo sapien
gtagacctgtgtccctgttgagcca

SEQ ID NO: 386262 - DNA, 25 bp, Homo sapien
cctgttgagccacccctgggagcga

SEQ ID NO: 386263 - DNA, 25 bp, Homo sapien
acccctgggagcgagcatggcaatc

SEQ ID NO: 386264 - DNA, 25 bp, Homo sapien
gagcgagcatggcaatccacaggcc

SEQ ID NO: 386265 - DNA, 25 bp, Homo sapien
agcatggcaatccacaggccctctg

SEQ ID NO: 386266 - DNA, 25 bp, Homo sapien
gtttcttattcctttgatttgtatg

SEQ ID NO: 386267 - DNA, 25 bp, Homo sapien
cactccttttccaataagtttgagt

SEQ ID NO: 386268 - DNA, 25 bp, Homo sapien
gtttgagttaggagcttttaccttg

SEQ ID NO: 386269 - DNA, 25 bp, Homo sapien
ggagcttttaccttgtagcagagca

SEQ ID NO: 386270 - DNA, 25 bp, Homo sapien
ctagttggttcacctggaaaacaga

SEQ ID NO: 386271 - DNA, 25 bp, Homo sapien
gctcaccatgcggatgcgggtcaca

SEQ ID NO: 386272 - DNA, 25 bp, Homo sapien
tgcgggtcacactgaatgctggaga

SEQ ID NO: 386273 - DNA, 25 bp, Homo sapien
gggtcacactgaatgctggagagat

SEQ ID NO: 386274 - DNA, 25 bp, Homo sapien
atgtaatatgctgaggtggcgacct

SEQ ID NO: 386275 - DNA, 25 bp, Homo sapien
ggtggcgacctcagtggagaaatgt

SEQ ID NO: 386276 - DNA, 25 bp, Homo sapien
agagtatttaaaatatgcttccaca

SEQ ID NO: 386277 - DNA, 25 bp, Homo sapien
aatatgcttccacatttcaaaatat

SEQ ID NO: 386278 - DNA, 25 bp, Homo sapien
agctctctttcttctgagaccctga

SEQ ID NO: 386279 - DNA, 25 bp, Homo sapien
tgatggccttgctgctttgtggtcc

SEQ ID NO: 386280 - DNA, 25 bp, Homo sapien
tttgtggtcccatgaggcatctctg

SEQ ID NO: 386281 - DNA, 25 bp, Homo sapien
ggcaggacctgtttggtttaacact

SEQ ID NO: 386282 - DNA, 25 bp, Homo sapien
tggtctgcccatctatacctggtat

SEQ ID NO: 386283 - DNA, 25 bp, Homo sapien
tacctggtattgctcctatgttttt

SEQ ID NO: 386284 - DNA, 25 bp, Homo sapien
atgtttttgctctcagagggccatc

SEQ ID NO: 386285 - DNA, 25 bp, Homo sapien
agagggccatcttattgctcccact

SEQ ID NO: 386286 - DNA, 25 bp, Homo sapien
ttccagcttctcaatagggcctcag

SEQ ID NO: 386287 - DNA, 25 bp, Homo sapien
ttggtttaacactcttctcccagct

SEQ ID NO: 386288 - DNA, 25 bp, Homo sapien
gcttgtgtgggttctgccaatgtat

SEQ ID NO: 386289 - DNA, 25 bp, Homo sapien
catgtcctgctcttttccctggact

SEQ ID NO: 386290 - DNA, 25 bp, Homo sapien
ttttccctggactcctttgtcttga

SEQ ID NO: 386291 - DNA, 25 bp, Homo sapien
ccctggactcctttgtcttgacggg

SEQ ID NO: 386292 - DNA, 25 bp, Homo sapien
gggtcagctaaagacttcgaacctt

SEQ ID NO: 386293 - DNA, 25 bp, Homo sapien
agacttcgaacctttactcatcaaa

SEQ ID NO: 386294 - DNA, 25 bp, Homo sapien
tttactcatcaaagctcatcttcgg

SEQ ID NO: 386295 - DNA, 25 bp, Homo sapien
actcatcaaagctcatcttcggaaa

SEQ ID NO: 386296 - DNA, 25 bp, Homo sapien
atcaaagctcatcttcggaaactgc

SEQ ID NO: 386297 - DNA, 25 bp, Homo sapien
gctcatcttcggaaactgctcatag

SEQ ID NO: 386298 - DNA, 25 bp, Homo sapien
catcttcggaaactgctcatagcac

SEQ ID NO: 386299 - DNA, 25 bp, Homo sapien
ttcggaaactgctcatagcacttta

SEQ ID NO: 386300 - DNA, 25 bp, Homo sapien
gtaatatatgggattagattcatct

SEQ ID NO: 386301 - DNA, 25 bp, Homo sapien
tagattcatctatggagggcagagt

SEQ ID NO: 386302 - DNA, 25 bp, Homo sapien
agattcatctatggagggcagagtg

SEQ ID NO: 386303 - DNA, 25 bp, Homo sapien
tctggcagagaaggatgtccgttcc

SEQ ID NO: 386304 - DNA, 25 bp, Homo sapien
gcagagaaggatgtccgttccagga

SEQ ID NO: 386305 - DNA, 25 bp, Homo sapien
tccgttccaggagcacacggccctg

SEQ ID NO: 386306 - DNA, 25 bp, Homo sapien
ccctgccagggctcgggcgctgtgg

SEQ ID NO: 386307 - DNA, 25 bp, Homo sapien
gcgctgtggctcctgccttgatgaa

SEQ ID NO: 386308 - DNA, 25 bp, Homo sapien
tgatgaagcccgtgtcctgccttga

SEQ ID NO: 386309 - DNA, 25 bp, Homo sapien
atgaagcccgtgtcctgccttgatg

SEQ ID NO: 386310 - DNA, 25 bp, Homo sapien
ccccaccgaagagccctgagctcag

SEQ ID NO: 386311 - DNA, 25 bp, Homo sapien
tcccaattcctatggagcctctcta

SEQ ID NO: 386312 - DNA, 25 bp, Homo sapien
aattcctatggagcctctctatttt

SEQ ID NO: 386313 - DNA, 25 bp, Homo sapien
tatggagcctctctattttacctct

SEQ ID NO: 386314 - DNA, 25 bp, Homo sapien
attttacctctttccgtgcatccct

SEQ ID NO: 386315 - DNA, 25 bp, Homo sapien
gctatgcttttggagtcctggatgg

SEQ ID NO: 386316 - DNA, 25 bp, Homo sapien
ggcatttgtggaaaccagatgtgct

SEQ ID NO: 386317 - DNA, 25 bp, Homo sapien
cttttggagtcctggatgggaatct

SEQ ID NO: 386318 - DNA, 25 bp, Homo sapien
gaggaaggacaggtcaggtctcccc

SEQ ID NO: 386319 - DNA, 25 bp, Homo sapien
gtggaaaccagatgtgctggcagct

SEQ ID NO: 386320 - DNA, 25 bp, Homo sapien
gggttggttccatttcggccaccag

SEQ ID NO: 386321 - DNA, 25 bp, Homo sapien
gttggttccatttcggccaccagga

SEQ ID NO: 386322 - DNA, 25 bp, Homo sapien
gcattaacaggatacaacagttcat

SEQ ID NO: 386323 - DNA, 25 bp, Homo sapien
gagtaactatgcacacaaatttctt

SEQ ID NO: 386324 - DNA, 25 bp, Homo sapien
gaaaatgcacagatgtatggtggaa

SEQ ID NO: 386325 - DNA, 25 bp, Homo sapien
aactgtatctaacactgaaactact

SEQ ID NO: 386326 - DNA, 25 bp, Homo sapien
tgaaactactacaggactccatcaa

SEQ ID NO: 386327 - DNA, 25 bp, Homo sapien
tccatcaatgagtccaacttttagt

SEQ ID NO: 386328 - DNA, 25 bp, Homo sapien
caatgagtccaacttttagtgataa

SEQ ID NO: 386329 - DNA, 25 bp, Homo sapien
agtgataaaaaactactgtactggg

SEQ ID NO: 386330 - DNA, 25 bp, Homo sapien
tgtactgggcaaacttggcagtcat

SEQ ID NO: 386331 - DNA, 25 bp, Homo sapien
tggcagtcataaacccacatctact

SEQ ID NO: 386332 - DNA, 25 bp, Homo sapien
ggagtcacagagcaatatgcattaa

SEQ ID NO: 386333 - DNA, 25 bp, Homo sapien
ggacaaggctggttttcatcactta

SEQ ID NO: 386334 - DNA, 25 bp, Homo sapien
tcacttacatcgttcttgcctgaga

SEQ ID NO: 386335 - DNA, 25 bp, Homo sapien
gaacccagggatcagtataagtgct

SEQ ID NO: 386336 - DNA, 25 bp, Homo sapien
taagtgcttgcctttgtatgcgttt

SEQ ID NO: 386337 - DNA, 25 bp, Homo sapien
tatgcgtttcactactgtggctgtt

SEQ ID NO: 386338 - DNA, 25 bp, Homo sapien
tcagcccatgttctatgatccaatc

SEQ ID NO: 386339 - DNA, 25 bp, Homo sapien
aatcccaatcagcaatggccttgac

SEQ ID NO: 386340 - DNA, 25 bp, Homo sapien
caatggccttgacctagaatacttt

SEQ ID NO: 386341 - DNA, 25 bp, Homo sapien
tactcatcccaagaaagttgccttc

SEQ ID NO: 386342 - DNA, 25 bp, Homo sapien
agttgccttctctagaggatgacaa

SEQ ID NO: 386343 - DNA, 25 bp, Homo sapien
gcatttcaattttgtcttcacagtt

SEQ ID NO: 386344 - DNA, 25 bp, Homo sapien
gatcttgttgggagacttaatggca

SEQ ID NO: 386345 - DNA, 25 bp, Homo sapien
ttgggagacttaatggcagcaggca

SEQ ID NO: 386346 - DNA, 25 bp, Homo sapien
gggctcgggaccatgctgagctttt

SEQ ID NO: 386347 - DNA, 25 bp, Homo sapien
gaccatgctgagctttttggcacca

SEQ ID NO: 386348 - DNA, 25 bp, Homo sapien
tttttggcaccacccacagagaacg

SEQ ID NO: 386349 - DNA, 25 bp, Homo sapien
ttggcaccacccacagagaacgtgg

SEQ ID NO: 386350 - DNA, 25 bp, Homo sapien
gcaccttcccagcacatgcagaatg

SEQ ID NO: 386351 - DNA, 25 bp, Homo sapien
atgcagaatgactccagtggttcca

SEQ ID NO: 386352 - DNA, 25 bp, Homo sapien
gaatgactccagtggttccatcgtc

SEQ ID NO: 386353 - DNA, 25 bp, Homo sapien
tcacccacagtggaagtgcccggga

SEQ ID NO: 386354 - DNA, 25 bp, Homo sapien
cccacagtggaagtgcccgggatct

SEQ ID NO: 386355 - DNA, 25 bp, Homo sapien
aacctctttccgcaggtgccgcggt

SEQ ID NO: 386356 - DNA, 25 bp, Homo sapien
gcaggtgccgcggtctcaggacaca

SEQ ID NO: 386357 - DNA, 25 bp, Homo sapien
gcggtctcaggacacactgaataat

SEQ ID NO: 386358 - DNA, 25 bp, Homo sapien
ttctctgggcaaaaagcacagttgg

SEQ ID NO: 386359 - DNA, 25 bp, Homo sapien
cacagttggcaggatcgggtgtctc

SEQ ID NO: 386360 - DNA, 25 bp, Homo sapien
ggatcgggtgtctcgatcatcctca

SEQ ID NO: 386361 - DNA, 25 bp, Homo sapien
atcatcctcacccctgaagacaggg

SEQ ID NO: 386362 - DNA, 25 bp, Homo sapien
gggagcagacaccaccgcatgaaca

SEQ ID NO: 386363 - DNA, 25 bp, Homo sapien
agacaccaccgcatgaacacatctg

SEQ ID NO: 386364 - DNA, 25 bp, Homo sapien
gcatgaacacatctgcctgagcgat

SEQ ID NO: 386365 - DNA, 25 bp, Homo sapien
aacacatctgcctgagcgatgagct

SEQ ID NO: 386366 - DNA, 25 bp, Homo sapien
tgagatcttgttgggagacttaatg

SEQ ID NO: 386367 - DNA, 25 bp, Homo sapien
cttgttgggagacttaatggcagca

SEQ ID NO: 386368 - DNA, 25 bp, Homo sapien
ttgggagacttaatggcagcaggca

SEQ ID NO: 386369 - DNA, 25 bp, Homo sapien
tttttggcaccacccacagagaacg

SEQ ID NO: 386370 - DNA, 25 bp, Homo sapien
ttggcaccacccacagagaacgtgg

SEQ ID NO: 386371 - DNA, 25 bp, Homo sapien
gcacatgcagaatgactccagtggt

SEQ ID NO: 386372 - DNA, 25 bp, Homo sapien
atgcagaatgactccagtggttcca

SEQ ID NO: 386373 - DNA, 25 bp, Homo sapien
agaatgactccagtggttccatcgt

SEQ ID NO: 386374 - DNA, 25 bp, Homo sapien
aatgactccagtggttccatcgtcc

SEQ ID NO: 386375 - DNA, 25 bp, Homo sapien
tcacccacagtggaagtgcccggga

SEQ ID NO: 386376 - DNA, 25 bp, Homo sapien
cccacagtggaagtgcccgggatct

SEQ ID NO: 386377 - DNA, 25 bp, Homo sapien
tactaatgttgtttgatctgtgttt

SEQ ID NO: 386378 - DNA, 25 bp, Homo sapien
actaatgttgtttgatctgtgtttg

SEQ ID NO: 386379 - DNA, 25 bp, Homo sapien
ctaatgttgtttgatctgtgtttgt

SEQ ID NO: 386380 - DNA, 25 bp, Homo sapien
aatgttgtttgatctgtgtttgtta

SEQ ID NO: 386381 - DNA, 25 bp, Homo sapien
atgttgtttgatctgtgtttgttat

SEQ ID NO: 386382 - DNA, 25 bp, Homo sapien
gttgtttgatctgtgtttgttatac

SEQ ID NO: 386383 - DNA, 25 bp, Homo sapien
gtttgatctgtgtttgttatactgg

SEQ ID NO: 386384 - DNA, 25 bp, Homo sapien
tttgatctgtgtttgttatactggt

SEQ ID NO: 386385 - DNA, 25 bp, Homo sapien
ttgatctgtgtttgttatactggtt

SEQ ID NO: 386386 - DNA, 25 bp, Homo sapien
tgatctgtgtttgttatactggttg

SEQ ID NO: 386387 - DNA, 25 bp, Homo sapien
gatctgtgtttgttatactggttgt

SEQ ID NO: 386388 - DNA, 25 bp, Homo sapien
catacatgtatctggtttgtcaggc

SEQ ID NO: 386389 - DNA, 25 bp, Homo sapien
ttgtcaggctacaaggtaggctgca

SEQ ID NO: 386390 - DNA, 25 bp, Homo sapien
gtaggctgcaaaattaaatctagac

SEQ ID NO: 386391 - DNA, 25 bp, Homo sapien
gacattcttttaatgccaccacacg

SEQ ID NO: 386392 - DNA, 25 bp, Homo sapien
ttttaatgccaccacacgtgttccg

SEQ ID NO: 386393 - DNA, 25 bp, Homo sapien
attatgtttgatttctctacttgtc

SEQ ID NO: 386394 - DNA, 25 bp, Homo sapien
gatttctctacttgtcatatcacta

SEQ ID NO: 386395 - DNA, 25 bp, Homo sapien
gattttattgctgcgtgactctgta

SEQ ID NO: 386396 - DNA, 25 bp, Homo sapien
tgctgcgtgactctgtattactttg

SEQ ID NO: 386397 - DNA, 25 bp, Homo sapien
gactctgtattactttggtgcataa

SEQ ID NO: 386398 - DNA, 25 bp, Homo sapien
aaagttgaacattgttgtttactga

SEQ ID NO: 386399 - DNA, 25 bp, Homo sapien
aacttctgaggtaggggctgtacca

SEQ ID NO: 386400 - DNA, 25 bp, Homo sapien
ggctgtaccatatttttgccccaca

SEQ ID NO: 386401 - DNA, 25 bp, Homo sapien
ccccacacccattaagcgaatacca

SEQ ID NO: 386402 - DNA, 25 bp, Homo sapien
aagcgaataccaaaaacaacttgtg

SEQ ID NO: 386403 - DNA, 25 bp, Homo sapien
gcgaataccaaaaacaacttgtgga

SEQ ID NO: 386404 - DNA, 25 bp, Homo sapien
aaacaacttgtggaaatttgataat

SEQ ID NO: 386405 - DNA, 25 bp, Homo sapien
tattatttgggcaggattggcattt

SEQ ID NO: 386406 - DNA, 25 bp, Homo sapien
ttatttgggcaggattggcatttac

SEQ ID NO: 386407 - DNA, 25 bp, Homo sapien
tttgggcaggattggcatttaccat

SEQ ID NO: 386408 - DNA, 25 bp, Homo sapien
gggcaggattggcatttaccatgct

SEQ ID NO: 386409 - DNA, 25 bp, Homo sapien
gcaggattggcatttaccatgcttt

SEQ ID NO: 386410 - DNA, 25 bp, Homo sapien
tgacagcacttagacgaggcttggg

SEQ ID NO: 386411 - DNA, 25 bp, Homo sapien
cagtgttgggagagggctccccaac

SEQ ID NO: 386412 - DNA, 25 bp, Homo sapien
tctgctgggaccacccagggtcgga

SEQ ID NO: 386413 - DNA, 25 bp, Homo sapien
gggtcggacacccaagggtgcctgg

SEQ ID NO: 386414 - DNA, 25 bp, Homo sapien
ggtgcctggcaggtcgcagagttgg

SEQ ID NO: 386415 - DNA, 25 bp, Homo sapien
cagagttggcaagccgggcctcgta

SEQ ID NO: 386416 - DNA, 25 bp, Homo sapien
gtggcgagtactggttccgaacgca

SEQ ID NO: 386417 - DNA, 25 bp, Homo sapien
cgagtactggttccgaacgcacgca

SEQ ID NO: 386418 - DNA, 25 bp, Homo sapien
gtactggttccgaacgcacgcaggg

SEQ ID NO: 386419 - DNA, 25 bp, Homo sapien
tcatctcccttaagcatcctcttct

SEQ ID NO: 386420 - DNA, 25 bp, Homo sapien
tcccgtcaccgtttactctgcaaaa

SEQ ID NO: 386421 - DNA, 25 bp, Homo sapien
ttttttaaatggcactatgtagtaa

SEQ ID NO: 386422 - DNA, 25 bp, Homo sapien
ggcactatgtagtaattaagagcta

SEQ ID NO: 386423 - DNA, 25 bp, Homo sapien
tagtaattaagagctaaggagacag

SEQ ID NO: 386424 - DNA, 25 bp, Homo sapien
taagcaattctgtcctctgattccc

SEQ ID NO: 386425 - DNA, 25 bp, Homo sapien
tgagaatagaagagtacctgtacct

SEQ ID NO: 386426 - DNA, 25 bp, Homo sapien
agaagagtacctgtacctacaaggg

SEQ ID NO: 386427 - DNA, 25 bp, Homo sapien
gcaattctttatttgataagagtga

SEQ ID NO: 386428 - DNA, 25 bp, Homo sapien
aatggtagacatgaaaggcaggtga

SEQ ID NO: 386429 - DNA, 25 bp, Homo sapien
gacatgaaaggcaggtgaggaaaca

SEQ ID NO: 386430 - DNA, 25 bp, Homo sapien
ggaaacagaaaaggtctctttgcag

SEQ ID NO: 386431 - DNA, 25 bp, Homo sapien
aggtctctttgcagatatatatttt

SEQ ID NO: 386432 - DNA, 25 bp, Homo sapien
atcaccctgaagatgacttcctgag

SEQ ID NO: 386433 - DNA, 25 bp, Homo sapien
agccacagccttagagctgcgggaa

SEQ ID NO: 386434 - DNA, 25 bp, Homo sapien
tagagctgcgggaacaccgagaccc

SEQ ID NO: 386435 - DNA, 25 bp, Homo sapien
ccttcagcctcgacctgggtgcagg

SEQ ID NO: 386436 - DNA, 25 bp, Homo sapien
ttccacagcgagaactgcactacct

SEQ ID NO: 386437 - DNA, 25 bp, Homo sapien
aactgcactaccttctgttgtactt

SEQ ID NO: 386438 - DNA, 25 bp, Homo sapien
ttgttgctgtgacctccctaagaca

SEQ ID NO: 386439 - DNA, 25 bp, Homo sapien
gacctccctaagacactgaagatac

SEQ ID NO: 386440 - DNA, 25 bp, Homo sapien
gacactgaagatacttctcgggaaa

SEQ ID NO: 386441 - DNA, 25 bp, Homo sapien
ttctcgggaaaggatcatcgccgtt

SEQ ID NO: 386442 - DNA, 25 bp, Homo sapien
aggatcatcgccgttgaaatgaaaa

SEQ ID NO: 386443 - DNA, 25 bp, Homo sapien
aagaagtcacaatagtttgggagaa

SEQ ID NO: 386444 - DNA, 25 bp, Homo sapien
gtatggtgagtaaggttatgcgtat

SEQ ID NO: 386445 - DNA, 25 bp, Homo sapien
ggttatgcgtataatttcatactga

SEQ ID NO: 386446 - DNA, 25 bp, Homo sapien
ttattactatttgggatgtacgtca

SEQ ID NO: 386447 - DNA, 25 bp, Homo sapien
ttctaacaaacactgccaacacgtc

SEQ ID NO: 386448 - DNA, 25 bp, Homo sapien
cactgccaacacgtcaattttttaa

SEQ ID NO: 386449 - DNA, 25 bp, Homo sapien
tttttaaaaagcgtgggccacattg

SEQ ID NO: 386450 - DNA, 25 bp, Homo sapien
agcgtgggccacattgctaagaatt

SEQ ID NO: 386451 - DNA, 25 bp, Homo sapien
gccttattgatgttttgccgttcca

SEQ ID NO: 386452 - DNA, 25 bp, Homo sapien
gatgttttgccgttccaatgtatgc

SEQ ID NO: 386453 - DNA, 25 bp, Homo sapien
ttgccgttccaatgtatgcattttt

SEQ ID NO: 386454 - DNA, 25 bp, Homo sapien
gacattggctgaattataactagtt

SEQ ID NO: 386455 - DNA, 25 bp, Homo sapien
actagttagttatcacctcgtccct

SEQ ID NO: 386456 - DNA, 25 bp, Homo sapien
atcacctcgtcccttaaagtcagtg

SEQ ID NO: 386457 - DNA, 25 bp, Homo sapien
aaagtcagtgacctcctgtgtttga

SEQ ID NO: 386458 - DNA, 25 bp, Homo sapien
gacctcctgtgtttgatgtatatta

SEQ ID NO: 386459 - DNA, 25 bp, Homo sapien
gagtcttaagtcagtgtacagttcc

SEQ ID NO: 386460 - DNA, 25 bp, Homo sapien
cagttccactggaatttgacagttg

SEQ ID NO: 386461 - DNA, 25 bp, Homo sapien
gacagttgtctctacagtcatgcaa

SEQ ID NO: 386462 - DNA, 25 bp, Homo sapien
gtctctacagtcatgcaactcgaag

SEQ ID NO: 386463 - DNA, 25 bp, Homo sapien
acagtcatgcaactcgaagtagaaa

SEQ ID NO: 386464 - DNA, 25 bp, Homo sapien
tcttgttttagcacagttgatgcac

SEQ ID NO: 386465 - DNA, 25 bp, Homo sapien
cccttctatcatttgtacttaagta

SEQ ID NO: 386466 - DNA, 25 bp, Homo sapien
ccttctatcatttgtacttaagtat

SEQ ID NO: 386467 - DNA, 25 bp, Homo sapien
cttctatcatttgtacttaagtatt

SEQ ID NO: 386468 - DNA, 25 bp, Homo sapien
tgtacttaagtatttacctggtgaa

SEQ ID NO: 386469 - DNA, 25 bp, Homo sapien
ggtgaaaataaagcttatgccgggc

SEQ ID NO: 386470 - DNA, 25 bp, Homo sapien
gtgaaaataaagcttatgccgggca

SEQ ID NO: 386471 - DNA, 25 bp, Homo sapien
tgaaaataaagcttatgccgggcac

SEQ ID NO: 386472 - DNA, 25 bp, Homo sapien
aaataaagcttatgccgggcacggt

SEQ ID NO: 386473 - DNA, 25 bp, Homo sapien
aataaagcttatgccgggcacggtg

SEQ ID NO: 386474 - DNA, 25 bp, Homo sapien
ataaagcttatgccgggcacggtgc

SEQ ID NO: 386475 - DNA, 25 bp, Homo sapien
taaagcttatgccgggcacggtgcc

SEQ ID NO: 386476 - DNA, 25 bp, Homo sapien
acacgtggcaggatgaagagtactt

SEQ ID NO: 386477 - DNA, 25 bp, Homo sapien
tgaagagtacttcggcagctatgga

SEQ ID NO: 386478 - DNA, 25 bp, Homo sapien
agtacttcggcagctatggaactct

SEQ ID NO: 386479 - DNA, 25 bp, Homo sapien
acttcggcagctatggaactctgaa

SEQ ID NO: 386480 - DNA, 25 bp, Homo sapien
gctatggaactctgaaactccactt

SEQ ID NO: 386481 - DNA, 25 bp, Homo sapien
acttggagatgttggcagaccagcc

SEQ ID NO: 386482 - DNA, 25 bp, Homo sapien
ggagatgttggcagaccagccacga

SEQ ID NO: 386483 - DNA, 25 bp, Homo sapien
actaaataccacagtgtcatcctgc

SEQ ID NO: 386484 - DNA, 25 bp, Homo sapien
ggatcatcagtctcttctgtgcaca

SEQ ID NO: 386485 - DNA, 25 bp, Homo sapien
agtctcttctgtgcacactatgcgc

SEQ ID NO: 386486 - DNA, 25 bp, Homo sapien
ctgtgcacactatgcgcggcctaga

SEQ ID NO: 386487 - DNA, 25 bp, Homo sapien
ttattttgctctacccagtaactgc

SEQ ID NO: 386488 - DNA, 25 bp, Homo sapien
tacccagtaactgcgctggtacata

SEQ ID NO: 386489 - DNA, 25 bp, Homo sapien
aactgcgctggtacatagacgcact

SEQ ID NO: 386490 - DNA, 25 bp, Homo sapien
gctggtacatagacgcactgagcaa

SEQ ID NO: 386491 - DNA, 25 bp, Homo sapien
tagacgcactgagcaaacaaacttt

SEQ ID NO: 386492 - DNA, 25 bp, Homo sapien
gtaaccacctctgactacttttgta

SEQ ID NO: 386493 - DNA, 25 bp, Homo sapien
aaatatttggatctagtttctaagt

SEQ ID NO: 386494 - DNA, 25 bp, Homo sapien
ttatatgttccccaaaattactttg

SEQ ID NO: 386495 - DNA, 25 bp, Homo sapien
aattactttgaatctgtcaccagca

SEQ ID NO: 386496 - DNA, 25 bp, Homo sapien
aatgagttcttggtgatacaatggt

SEQ ID NO: 386497 - DNA, 25 bp, Homo sapien
ttcttggtgatacaatggtgagact

SEQ ID NO: 386498 - DNA, 25 bp, Homo sapien
atccacagtcataactgggagactt

SEQ ID NO: 386499 - DNA, 25 bp, Homo sapien
gacttcaataactctgttctcaata

SEQ ID NO: 386500 - DNA, 25 bp, Homo sapien
ataactctgttctcaataactgata

SEQ ID NO: 386501 - DNA, 25 bp, Homo sapien
ggataacattatcaactggtttaat

SEQ ID NO: 386502 - DNA, 25 bp, Homo sapien
catttataaaacactctactcaaga

SEQ ID NO: 386503 - DNA, 25 bp, Homo sapien
taaaacactctactcaagagcaaca

SEQ ID NO: 386504 - DNA, 25 bp, Homo sapien
atacatattctttccaagtgcccac

SEQ ID NO: 386505 - DNA, 25 bp, Homo sapien
catattctttccaagtgcccacaga

SEQ ID NO: 386506 - DNA, 25 bp, Homo sapien
gtgcccacagaacatatacccagat

SEQ ID NO: 386507 - DNA, 25 bp, Homo sapien
catatacccagatagatcatattct

SEQ ID NO: 386508 - DNA, 25 bp, Homo sapien
aagagacatggaaaaatccacagtc

SEQ ID NO: 386509 - DNA, 25 bp, Homo sapien
gtaggcaggtacatgtacttcctaa

SEQ ID NO: 386510 - DNA, 25 bp, Homo sapien
ttatctttctgtaagttcgttatgc

SEQ ID NO: 386511 - DNA, 25 bp, Homo sapien
gttcgttatgcttgactgtttccat

SEQ ID NO: 386512 - DNA, 25 bp, Homo sapien
actgtttccatgttctcccaataat

SEQ ID NO: 386513 - DNA, 25 bp, Homo sapien
gttacttatcactttactcatggag

SEQ ID NO: 386514 - DNA, 25 bp, Homo sapien
tcaactgtatctttctttaactgga

SEQ ID NO: 386515 - DNA, 25 bp, Homo sapien
gctatatgatatgcttactacagac

SEQ ID NO: 386516 - DNA, 25 bp, Homo sapien
actacagactgcattaattcacgaa

SEQ ID NO: 386517 - DNA, 25 bp, Homo sapien
gaaacgaattctgttatgctgtaat

SEQ ID NO: 386518 - DNA, 25 bp, Homo sapien
tgctgtaatttgaactctcctcacc

SEQ ID NO: 386519 - DNA, 25 bp, Homo sapien
tctcctcaccacaacttattaaaaa

SEQ ID NO: 386520 - DNA, 25 bp, Homo sapien
ttttcctaggtgctactttggcaga

SEQ ID NO: 386521 - DNA, 25 bp, Homo sapien
cctaggtgctactttggcagagcta

SEQ ID NO: 386522 - DNA, 25 bp, Homo sapien
gtgctactttggcagagctaagtta

SEQ ID NO: 386523 - DNA, 25 bp, Homo sapien
tggcagagctaagttatcttttgtt

SEQ ID NO: 386524 - DNA, 25 bp, Homo sapien
ttgttttcttaatgcgtttggacca

SEQ ID NO: 386525 - DNA, 25 bp, Homo sapien
aatgcgtttggaccattttgctggc

SEQ ID NO: 386526 - DNA, 25 bp, Homo sapien
cgtttggaccattttgctggctata

SEQ ID NO: 386527 - DNA, 25 bp, Homo sapien
ttggaccattttgctggctataaaa

SEQ ID NO: 386528 - DNA, 25 bp, Homo sapien
caatgttgacattgtagttacacaa

SEQ ID NO: 386529 - DNA, 25 bp, Homo sapien
caaaatgacatgttcgaatgtgaaa

SEQ ID NO: 386530 - DNA, 25 bp, Homo sapien
aaaggtcataatagctttcccatca

SEQ ID NO: 386531 - DNA, 25 bp, Homo sapien
actccatattttatgctggttgtct

SEQ ID NO: 386532 - DNA, 25 bp, Homo sapien
ttatgctggttgtctgcaagcttgt

SEQ ID NO: 386533 - DNA, 25 bp, Homo sapien
gcaagcttgtgcgatgttatgttca

SEQ ID NO: 386534 - DNA, 25 bp, Homo sapien
tgttatgttcatgttaatcctattt

SEQ ID NO: 386535 - DNA, 25 bp, Homo sapien
tgaagtgttcccaaccttatgttaa

SEQ ID NO: 386536 - DNA, 25 bp, Homo sapien
gactgtattcagttattttgccctt

SEQ ID NO: 386537 - DNA, 25 bp, Homo sapien
attttgccctttattgaggaaccag

SEQ ID NO: 386538 - DNA, 25 bp, Homo sapien
ttgaggaaccagatttgttttcttt

SEQ ID NO: 386539 - DNA, 25 bp, Homo sapien
gttgaggtactttcttcaaatgctt

SEQ ID NO: 386540 - DNA, 25 bp, Homo sapien
tatgcctttcagtgcattactatgg

SEQ ID NO: 386541 - DNA, 25 bp, Homo sapien
gcattactatgggaggagcaactaa

SEQ ID NO: 386542 - DNA, 25 bp, Homo sapien
aaacacatctgtagtcttggccaaa

SEQ ID NO: 386543 - DNA, 25 bp, Homo sapien
acatctgtagtcttggccaaatgat

SEQ ID NO: 386544 - DNA, 25 bp, Homo sapien
gtcttggccaaatgatacactttat

SEQ ID NO: 386545 - DNA, 25 bp, Homo sapien
aaatgatacactttattttgtggaa

SEQ ID NO: 386546 - DNA, 25 bp, Homo sapien
gttctaggaacctgggttcgttcat

SEQ ID NO: 386547 - DNA, 25 bp, Homo sapien
acctgggttcgttcatcattgttgt

SEQ ID NO: 386548 - DNA, 25 bp, Homo sapien
ggttcgttcatcattgttgtttatt

SEQ ID NO: 386549 - DNA, 25 bp, Homo sapien
atatagatgctctgcaacaaactct

SEQ ID NO: 386550 - DNA, 25 bp, Homo sapien
aaactctgtgacagtatccttcagt

SEQ ID NO: 386551 - DNA, 25 bp, Homo sapien
gtatccttcagtagagaaagtttct

SEQ ID NO: 386552 - DNA, 25 bp, Homo sapien
agtttcttacttgtgagtacactct

SEQ ID NO: 386553 - DNA, 25 bp, Homo sapien
acccaatcttatttctaaacctctg

SEQ ID NO: 386554 - DNA, 25 bp, Homo sapien
atttctaaacctctgtgcattctta

SEQ ID NO: 386555 - DNA, 25 bp, Homo sapien
taaacctctgtgcattcttagtgtc

SEQ ID NO: 386556 - DNA, 25 bp, Homo sapien
aacctctgtgcattcttagtgtctt

SEQ ID NO: 386557 - DNA, 25 bp, Homo sapien
tagtgtcttctcattctgaaacaga

SEQ ID NO: 386558 - DNA, 25 bp, Homo sapien
gttttctaaaatcagataatcctaa

SEQ ID NO: 386559 - DNA, 25 bp, Homo sapien
aacaaaaatgttagtcagggtcact

SEQ ID NO: 386560 - DNA, 25 bp, Homo sapien
tgttagtcagggtcactaaaaagta

SEQ ID NO: 386561 - DNA, 25 bp, Homo sapien
gactttgtacgatattgtgttttta

SEQ ID NO: 386562 - DNA, 25 bp, Homo sapien
tttatagtagcctttatgaactcag

SEQ ID NO: 386563 - DNA, 25 bp, Homo sapien
actcagtataagtgcaagttgtttg

SEQ ID NO: 386564 - DNA, 25 bp, Homo sapien
gtaggggctgtaccatatttttgcc

SEQ ID NO: 386565 - DNA, 25 bp, Homo sapien
ccccacacccattaagcgaatacca

SEQ ID NO: 386566 - DNA, 25 bp, Homo sapien
aagcgaataccaaaaacaacttgtg

SEQ ID NO: 386567 - DNA, 25 bp, Homo sapien
gcgaataccaaaaacaacttgtgga

SEQ ID NO: 386568 - DNA, 25 bp, Homo sapien
aaacaacttgtggaaatttgataat

SEQ ID NO: 386569 - DNA, 25 bp, Homo sapien
tattatttgggcaggattggcattt

SEQ ID NO: 386570 - DNA, 25 bp, Homo sapien
ttatttgggcaggattggcatttac

SEQ ID NO: 386571 - DNA, 25 bp, Homo sapien
tttgggcaggattggcatttaccat

SEQ ID NO: 386572 - DNA, 25 bp, Homo sapien
gggcaggattggcatttaccatgct

SEQ ID NO: 386573 - DNA, 25 bp, Homo sapien
ggcaggattggcatttaccatgctt

SEQ ID NO: 386574 - DNA, 25 bp, Homo sapien
gcaggattggcatttaccatgcttt

SEQ ID NO: 386575 - DNA, 25 bp, Homo sapien
ggatttctgaatcatcccattttat

SEQ ID NO: 386576 - DNA, 25 bp, Homo sapien
atcccattttattccgtatgttcga

SEQ ID NO: 386577 - DNA, 25 bp, Homo sapien
gatctattaccttgatcccgatgca

SEQ ID NO: 386578 - DNA, 25 bp, Homo sapien
gatgcaccattgtctgggccttcaa

SEQ ID NO: 386579 - DNA, 25 bp, Homo sapien
attgtctgggccttcaacccaggac

SEQ ID NO: 386580 - DNA, 25 bp, Homo sapien
aggaccctcagtaccaaaattcaca

SEQ ID NO: 386581 - DNA, 25 bp, Homo sapien
gactgtggccaaaaacgacagctat

SEQ ID NO: 386582 - DNA, 25 bp, Homo sapien
aaacgacagctatttgattctgact

SEQ ID NO: 386583 - DNA, 25 bp, Homo sapien
agggatccacttcttaatcctaaca

SEQ ID NO: 386584 - DNA, 25 bp, Homo sapien
aaaatagggatcgacagcaagcaat

SEQ ID NO: 386585 - DNA, 25 bp, Homo sapien
gacagcaagcaatccttaagggact

SEQ ID NO: 386586 - DNA, 25 bp, Homo sapien
attcacataatgatactgtattgac

SEQ ID NO: 386587 - DNA, 25 bp, Homo sapien
gatactgtattgactttcaattttc

SEQ ID NO: 386588 - DNA, 25 bp, Homo sapien
gactttcaattttcagaattaacct

SEQ ID NO: 386589 - DNA, 25 bp, Homo sapien
gaattaacctatagttacagcactt

SEQ ID NO: 386590 - DNA, 25 bp, Homo sapien
gttacagcacttaagacaaccagag

SEQ ID NO: 386591 - DNA, 25 bp, Homo sapien
tacagcacttaagacaaccagagtt

SEQ ID NO: 386592 - DNA, 25 bp, Homo sapien
gtgatgatttaactgacagaagcta

SEQ ID NO: 386593 - DNA, 25 bp, Homo sapien
ttaactgacagaagctaggaaatat

SEQ ID NO: 386594 - DNA, 25 bp, Homo sapien
gcaaagagagtcaggaatactactt

SEQ ID NO: 386595 - DNA, 25 bp, Homo sapien
gaatactacttaaaactgatgggtt

SEQ ID NO: 386596 - DNA, 25 bp, Homo sapien
tagtgctttaattctatttaagtaa

SEQ ID NO: 386597 - DNA, 25 bp, Homo sapien
ctctaatcccctaaatcaaactgca

SEQ ID NO: 386598 - DNA, 25 bp, Homo sapien
gcaattcaacaataaagggcgtaca

SEQ ID NO: 386599 - DNA, 25 bp, Homo sapien
gggcgtacagagatgactttgtcct

SEQ ID NO: 386600 - DNA, 25 bp, Homo sapien
gaatatccttgtaccctctatatag

SEQ ID NO: 386601 - DNA, 25 bp, Homo sapien
gtaccctctatatagctaacttcca

SEQ ID NO: 386602 - DNA, 25 bp, Homo sapien
tttgtttctattcctatcaagatga

SEQ ID NO: 386603 - DNA, 25 bp, Homo sapien
attcctatcaagatgagcctttaag

SEQ ID NO: 386604 - DNA, 25 bp, Homo sapien
ttttattaagctcttgaccaagaag

SEQ ID NO: 386605 - DNA, 25 bp, Homo sapien
aatacacttgattcagagtttctga

SEQ ID NO: 386606 - DNA, 25 bp, Homo sapien
tcagagtttctgatgctcttaatca

SEQ ID NO: 386607 - DNA, 25 bp, Homo sapien
cagaactatatgtattgtctcaata

SEQ ID NO: 386608 - DNA, 25 bp, Homo sapien
ccagatcccagcatgtggtcagagc

SEQ ID NO: 386609 - DNA, 25 bp, Homo sapien
cagagctggtgtgactgaagccaac

SEQ ID NO: 386610 - DNA, 25 bp, Homo sapien
gaagccaacaggtgacacggtcatc

SEQ ID NO: 386611 - DNA, 25 bp, Homo sapien
gacacggtcatcgaagagcagcaga

SEQ ID NO: 386612 - DNA, 25 bp, Homo sapien
gagcagcagacaaaactaacccaaa

SEQ ID NO: 386613 - DNA, 25 bp, Homo sapien
aactaacccaaaggcagctgaaagt

SEQ ID NO: 386614 - DNA, 25 bp, Homo sapien
agccctcgccggattcaacttttgc

SEQ ID NO: 386615 - DNA, 25 bp, Homo sapien
gccaacggtgaagaactgccctgag

SEQ ID NO: 386616 - DNA, 25 bp, Homo sapien
tgccctgagctgcaaaccttacaaa

SEQ ID NO: 386617 - DNA, 25 bp, Homo sapien
gagctgcaaaccttacaaagtctgt

SEQ ID NO: 386618 - DNA, 25 bp, Homo sapien
taaaccataccatgtgctaactgca

SEQ ID NO: 386619 - DNA, 25 bp, Homo sapien
gaacaaaggcttggatgcatattcc

SEQ ID NO: 386620 - DNA, 25 bp, Homo sapien
tattccctgaggaaagttgcacagt

SEQ ID NO: 386621 - DNA, 25 bp, Homo sapien
taatcactattacctgagttgaact

SEQ ID NO: 386622 - DNA, 25 bp, Homo sapien
gagttgaactttgctcaccatgttt

SEQ ID NO: 386623 - DNA, 25 bp, Homo sapien
actttgctcaccatgtttgtacttg

SEQ ID NO: 386624 - DNA, 25 bp, Homo sapien
atcctttgcactgccgaagcgtaat

SEQ ID NO: 386625 - DNA, 25 bp, Homo sapien
ctgccgaagcgtaatcttgtgtatt

SEQ ID NO: 386626 - DNA, 25 bp, Homo sapien
ttgtgtattacttagctctctgctg

SEQ ID NO: 386627 - DNA, 25 bp, Homo sapien
gtattacttagctctctgctgatct

SEQ ID NO: 386628 - DNA, 25 bp, Homo sapien
gatctcagtatggacagtgtaacaa

SEQ ID NO: 386629 - DNA, 25 bp, Homo sapien
aaccaaaatggctggacagacttct

SEQ ID NO: 386630 - DNA, 25 bp, Homo sapien
gcattagaatgcttcgggaaggctt

SEQ ID NO: 386631 - DNA, 25 bp, Homo sapien
atgcttcgggaaggcttaaagatga

SEQ ID NO: 386632 - DNA, 25 bp, Homo sapien
ggaaggcttaaagatgagccctgat

SEQ ID NO: 386633 - DNA, 25 bp, Homo sapien
taaagatgagccctgatgagggtca

SEQ ID NO: 386634 - DNA, 25 bp, Homo sapien
taaatggaccgggagatgttgaaac

SEQ ID NO: 386635 - DNA, 25 bp, Homo sapien
atgttgaaacgggtacaagcataac

SEQ ID NO: 386636 - DNA, 25 bp, Homo sapien
acaagcataacagtacctcagaaaa

SEQ ID NO: 386637 - DNA, 25 bp, Homo sapien
acctcagaaaaagtggttgcatttt

SEQ ID NO: 386638 - DNA, 25 bp, Homo sapien
cacccatttttgttcaagctcttac

SEQ ID NO: 386639 - DNA, 25 bp, Homo sapien
gttcaagctcttacattaacattct

SEQ ID NO: 386640 - DNA, 25 bp, Homo sapien
gctcttacattaacattcttagcag

SEQ ID NO: 386641 - DNA, 25 bp, Homo sapien
tgccaagaccactatgctcagctga

SEQ ID NO: 386642 - DNA, 25 bp, Homo sapien
gaccactatgctcagctgaagaggg

SEQ ID NO: 386643 - DNA, 25 bp, Homo sapien
agaacccgaactggtcggtggtgca

SEQ ID NO: 386644 - DNA, 25 bp, Homo sapien
cagggaagatgtggtcaacagcgac

SEQ ID NO: 386645 - DNA, 25 bp, Homo sapien
gtcaacagcgacagacctggagaag

SEQ ID NO: 386646 - DNA, 25 bp, Homo sapien
acctggagaagcacccttatgagca

SEQ ID NO: 386647 - DNA, 25 bp, Homo sapien
cttatgagcaaagagtggctctcct

SEQ ID NO: 386648 - DNA, 25 bp, Homo sapien
tctaccgtaaacaatgtaatgccag

SEQ ID NO: 386649 - DNA, 25 bp, Homo sapien
gtaatgccaggaagaagtaccgaat

SEQ ID NO: 386650 - DNA, 25 bp, Homo sapien
gaagaagtaccgaatgtcagctaga

SEQ ID NO: 386651 - DNA, 25 bp, Homo sapien
atgtcagctagaaaccggtgcagag

SEQ ID NO: 386652 - DNA, 25 bp, Homo sapien
attgccagtaggacgaacaagtaat

SEQ ID NO: 386653 - DNA, 25 bp, Homo sapien
gatgacatcgaaactgttattaaca

SEQ ID NO: 386654 - DNA, 25 bp, Homo sapien
acatgctgtgtaattctagatctaa

SEQ ID NO: 386655 - DNA, 25 bp, Homo sapien
gtaattctagatctaaactctatga

SEQ ID NO: 386656 - DNA, 25 bp, Homo sapien
aatgtgttccaccagagatgagaga

SEQ ID NO: 386657 - DNA, 25 bp, Homo sapien
agatgagagaaaaagctgctacagt

SEQ ID NO: 386658 - DNA, 25 bp, Homo sapien
gtgcaacaggcacttcttagtgaca

SEQ ID NO: 386659 - DNA, 25 bp, Homo sapien
aggcacttcttagtgacaccagcaa

SEQ ID NO: 386660 - DNA, 25 bp, Homo sapien
gtgacaccagcaacccagcatatag

SEQ ID NO: 386661 - DNA, 25 bp, Homo sapien
agcaacccagcatatagagaagata

SEQ ID NO: 386662 - DNA, 25 bp, Homo sapien
taagtcccagttattgccagtagga

SEQ ID NO: 386663 - DNA, 25 bp, Homo sapien
atctggaccaagaaataggatctac

SEQ ID NO: 386664 - DNA, 25 bp, Homo sapien
gaaataggatctactggcactgcag

SEQ ID NO: 386665 - DNA, 25 bp, Homo sapien
atctactggcactgcagaagttccc

SEQ ID NO: 386666 - DNA, 25 bp, Homo sapien
gaagttccccttactgtggatttca

SEQ ID NO: 386667 - DNA, 25 bp, Homo sapien
cttactgtggatttcaatcccatcc

SEQ ID NO: 386668 - DNA, 25 bp, Homo sapien
ctccctgtatcccaaaggtgatcac

SEQ ID NO: 386669 - DNA, 25 bp, Homo sapien
aggtgatcactagactggctcttta

SEQ ID NO: 386670 - DNA, 25 bp, Homo sapien
tcactagactggctctttacatttt

SEQ ID NO: 386671 - DNA, 25 bp, Homo sapien
ctacctttgtatgtatccctaaact

SEQ ID NO: 386672 - DNA, 25 bp, Homo sapien
gtatgtatccctaaactatagtttc

SEQ ID NO: 386673 - DNA, 25 bp, Homo sapien
ctatagtttcgtgtggtctttttgg

SEQ ID NO: 386674 - DNA, 25 bp, Homo sapien
gataacctgcgctatgccattttgc

SEQ ID NO: 386675 - DNA, 25 bp, Homo sapien
ctgcgctatgccattttgcttcctt

SEQ ID NO: 386676 - DNA, 25 bp, Homo sapien
tctcactgtgttctttcagagtgta

SEQ ID NO: 386677 - DNA, 25 bp, Homo sapien
ttctttcagagtgtagatatctacc

SEQ ID NO: 386678 - DNA, 25 bp, Homo sapien
aattcagccaaaagcactattatgt

SEQ ID NO: 386679 - DNA, 25 bp, Homo sapien
atgtgtacagaatcatcccccaagg

SEQ ID NO: 386680 - DNA, 25 bp, Homo sapien
ggtttagagtcaccaataccctatt

SEQ ID NO: 386681 - DNA, 25 bp, Homo sapien
aataccctattctgagcttctgctg

SEQ ID NO: 386682 - DNA, 25 bp, Homo sapien
tgtttcttcatctctggtgttcatg

SEQ ID NO: 386683 - DNA, 25 bp, Homo sapien
tcttcatctctggtgttcatgtctt

SEQ ID NO: 386684 - DNA, 25 bp, Homo sapien
agagggataacctgcgctatgccat

SEQ ID NO: 386685 - DNA, 25 bp, Homo sapien
gtatgtagatgtgtgtcagtaccaa

SEQ ID NO: 386686 - DNA, 25 bp, Homo sapien
atttctgatttccattcaagtcttt

SEQ ID NO: 386687 - DNA, 25 bp, Homo sapien
gtcttttaaactctttcctgctgaa

SEQ ID NO: 386688 - DNA, 25 bp, Homo sapien
tttcctgctgaatagcaaagaactt

SEQ ID NO: 386689 - DNA, 25 bp, Homo sapien
gaacaatgcgtttcagttgactgta

SEQ ID NO: 386690 - DNA, 25 bp, Homo sapien
gcgtttcagttgactgtattgcata

SEQ ID NO: 386691 - DNA, 25 bp, Homo sapien
attgcatacttttttgctgaagact

SEQ ID NO: 386692 - DNA, 25 bp, Homo sapien
gctgaagactttttctgtaaacaca

SEQ ID NO: 386693 - DNA, 25 bp, Homo sapien
tgtaaacacaattgccttgttcagt

SEQ ID NO: 386694 - DNA, 25 bp, Homo sapien
gacttaccataagatgcactgttga

SEQ ID NO: 386695 - DNA, 25 bp, Homo sapien
tgttgataatgctttctgatgtgtg

SEQ ID NO: 386696 - DNA, 25 bp, Homo sapien
aacaagaccgtccaagagcctcaag

SEQ ID NO: 386697 - DNA, 25 bp, Homo sapien
agcctcaaggctcaatgtcaattgc

SEQ ID NO: 386698 - DNA, 25 bp, Homo sapien
ggctcaatgtcaattgctgcaagct

SEQ ID NO: 386699 - DNA, 25 bp, Homo sapien
attgctgcaagcttagtgagtgaag

SEQ ID NO: 386700 - DNA, 25 bp, Homo sapien
caaaatgggccagttgacaacatca

SEQ ID NO: 386701 - DNA, 25 bp, Homo sapien
aacatcaggtgccatgttggccaat

SEQ ID NO: 386702 - DNA, 25 bp, Homo sapien
aagatggacctcaagccgactggtt

SEQ ID NO: 386703 - DNA, 25 bp, Homo sapien
agccgactggttccttgtacttgaa

SEQ ID NO: 386704 - DNA, 25 bp, Homo sapien
tgtacttgaagtacttgcctttttt

SEQ ID NO: 386705 - DNA, 25 bp, Homo sapien
gtttcctcagttttatgttcttgca

SEQ ID NO: 386706 - DNA, 25 bp, Homo sapien
tataattttatcctaacctccaaag

SEQ ID NO: 386707 - DNA, 25 bp, Homo sapien
ggtgaggtccagagatatatccaga

SEQ ID NO: 386708 - DNA, 25 bp, Homo sapien
aagggctcggagacctacagcccca

SEQ ID NO: 386709 - DNA, 25 bp, Homo sapien
ctacagccccaatactgcatatggt

SEQ ID NO: 386710 - DNA, 25 bp, Homo sapien
atactgcatatggtgtggacttcct

SEQ ID NO: 386711 - DNA, 25 bp, Homo sapien
atatggtgtggacttcctggtgccc

SEQ ID NO: 386712 - DNA, 25 bp, Homo sapien
tcctggtgcccgtgatgggctatat

SEQ ID NO: 386713 - DNA, 25 bp, Homo sapien
tgatgggctatatctgccgcatctg

SEQ ID NO: 386714 - DNA, 25 bp, Homo sapien
cgcatctgccacaagttctatcaca

SEQ ID NO: 386715 - DNA, 25 bp, Homo sapien
ctgggccactttgagaacctgcaga

SEQ ID NO: 386716 - DNA, 25 bp, Homo sapien
aacctgcagaaatacaaggcggcca

SEQ ID NO: 386717 - DNA, 25 bp, Homo sapien
atacaaggcggccaagaaccccagc

SEQ ID NO: 386718 - DNA, 25 bp, Homo sapien
aggctttcaggttcataatcctgtt

SEQ ID NO: 386719 - DNA, 25 bp, Homo sapien
aatcctgttgatagatgacatgtag

SEQ ID NO: 386720 - DNA, 25 bp, Homo sapien
gatgtttttaggactggattctaag

SEQ ID NO: 386721 - DNA, 25 bp, Homo sapien
ttaggactggattctaagggtggtt

SEQ ID NO: 386722 - DNA, 25 bp, Homo sapien
aatatccaaatactgctgcctcaag

SEQ ID NO: 386723 - DNA, 25 bp, Homo sapien
aatactgctgcctcaagagaacaat

SEQ ID NO: 386724 - DNA, 25 bp, Homo sapien
ctgcctcaagagaacaatttttgtt

SEQ ID NO: 386725 - DNA, 25 bp, Homo sapien
aagatgcagtaaccctgtatgtggc

SEQ ID NO: 386726 - DNA, 25 bp, Homo sapien
gcagtaaccctgtatgtggcatttt

SEQ ID NO: 386727 - DNA, 25 bp, Homo sapien
taaccctgtatgtggcattttgtca

SEQ ID NO: 386728 - DNA, 25 bp, Homo sapien
gtatgtggcattttgtcaggttaat

SEQ ID NO: 386729 - DNA, 25 bp, Homo sapien
tatttctaaacctctgtgcattctt

SEQ ID NO: 386730 - DNA, 25 bp, Homo sapien
taaacctctgtgcattcttagtgtc

SEQ ID NO: 386731 - DNA, 25 bp, Homo sapien
aacctctgtgcattcttagtgtctt

SEQ ID NO: 386732 - DNA, 25 bp, Homo sapien
gttttctaaaatcagataatcctaa

SEQ ID NO: 386733 - DNA, 25 bp, Homo sapien
aacaaaaatgttagtcagggtcact

SEQ ID NO: 386734 - DNA, 25 bp, Homo sapien
tgttagtcagggtcactaaaaagta

SEQ ID NO: 386735 - DNA, 25 bp, Homo sapien
gcacatttatataaatacagtcctt

SEQ ID NO: 386736 - DNA, 25 bp, Homo sapien
gactttgtacgatattgtgttttta

SEQ ID NO: 386737 - DNA, 25 bp, Homo sapien
tttatagtagcctttatgaactcag

SEQ ID NO: 386738 - DNA, 25 bp, Homo sapien
ttatgaactcagtataagtgcaagt

SEQ ID NO: 386739 - DNA, 25 bp, Homo sapien
actcagtataagtgcaagttgtttg

SEQ ID NO: 386740 - DNA, 25 bp, Homo sapien
aaatcttacctcagtatcattttat

SEQ ID NO: 386741 - DNA, 25 bp, Homo sapien
attttatttggcattgatttaatca

SEQ ID NO: 386742 - DNA, 25 bp, Homo sapien
gtgaggtttaacatcttctggtatg

SEQ ID NO: 386743 - DNA, 25 bp, Homo sapien
gcttactgatttgtagcggtagttg

SEQ ID NO: 386744 - DNA, 25 bp, Homo sapien
tgtagcggtagttgacatgattcta

SEQ ID NO: 386745 - DNA, 25 bp, Homo sapien
gttgacatgattctacacatctttg

SEQ ID NO: 386746 - DNA, 25 bp, Homo sapien
gattctacacatctttgtcatcata

SEQ ID NO: 386747 - DNA, 25 bp, Homo sapien
gtcatcatataagtgttgaatcgtt

SEQ ID NO: 386748 - DNA, 25 bp, Homo sapien
tgttgaatcgtttttctagtgggac

SEQ ID NO: 386749 - DNA, 25 bp, Homo sapien
tagtgggacgttttatccttttgct

SEQ ID NO: 386750 - DNA, 25 bp, Homo sapien
ggacgttttatccttttgctatgtt

SEQ ID NO: 386751 - DNA, 25 bp, Homo sapien
ggtgtttggtgcttgatttccagaa

SEQ ID NO: 386752 - DNA, 25 bp, Homo sapien
tttggtgcttgatttccagaaactc

SEQ ID NO: 386753 - DNA, 25 bp, Homo sapien
agaaactctccagcgacttggactt

SEQ ID NO: 386754 - DNA, 25 bp, Homo sapien
tctccagcgacttggacttcttctt

SEQ ID NO: 386755 - DNA, 25 bp, Homo sapien
agaagtgactgtgtggttggtctct

SEQ ID NO: 386756 - DNA, 25 bp, Homo sapien
gggactctgtatttgctcgtttacg

SEQ ID NO: 386757 - DNA, 25 bp, Homo sapien
gtatttgctcgtttacgtgttggaa

SEQ ID NO: 386758 - DNA, 25 bp, Homo sapien
tcctgctccattggttccttaagaa

SEQ ID NO: 386759 - DNA, 25 bp, Homo sapien
gctccattggttccttaagaaatgc

SEQ ID NO: 386760 - DNA, 25 bp, Homo sapien
tatattttgtgagtgcaagctggct

SEQ ID NO: 386761 - DNA, 25 bp, Homo sapien
aaatgtcccccatgtttctgaaaag

SEQ ID NO: 386762 - DNA, 25 bp, Homo sapien
gtccaaatcgcaggcatatgctatg

SEQ ID NO: 386763 - DNA, 25 bp, Homo sapien
attctacatcccacagttcttccaa

SEQ ID NO: 386764 - DNA, 25 bp, Homo sapien
agttcttccaacgtgtggcacagta

SEQ ID NO: 386765 - DNA, 25 bp, Homo sapien
ggctgcggcggaatccagtgctatc

SEQ ID NO: 386766 - DNA, 25 bp, Homo sapien
aatccagtgctatccagtccataag

SEQ ID NO: 386767 - DNA, 25 bp, Homo sapien
agtccataagccacgtatgacgtta

SEQ ID NO: 386768 - DNA, 25 bp, Homo sapien
gttgaccagagtgggaccaagtcca

SEQ ID NO: 386769 - DNA, 25 bp, Homo sapien
aagtccaacagtagcatggctcttt

SEQ ID NO: 386770 - DNA, 25 bp, Homo sapien
gcatggctctttcatataggactat

SEQ ID NO: 386771 - DNA, 25 bp, Homo sapien
ggactatttacaagactgctgagca

SEQ ID NO: 386772 - DNA, 25 bp, Homo sapien
gaatgccttataaacctgcagggtc

SEQ ID NO: 386773 - DNA, 25 bp, Homo sapien
ggatcacctgcccttgcattggacc

SEQ ID NO: 386774 - DNA, 25 bp, Homo sapien
gcattggaccagtccctgtggaaga

SEQ ID NO: 386775 - DNA, 25 bp, Homo sapien
tgggctatctatctgcactgtcatt

SEQ ID NO: 386776 - DNA, 25 bp, Homo sapien
tatctgcactgtcattgctaactcc

SEQ ID NO: 386777 - DNA, 25 bp, Homo sapien
gtcattgctaactcctgtcagaatc

SEQ ID NO: 386778 - DNA, 25 bp, Homo sapien
tgctaactcctgtcagaatcacatg

SEQ ID NO: 386779 - DNA, 25 bp, Homo sapien
tgagtagtgggctgaatcccaaaag

SEQ ID NO: 386780 - DNA, 25 bp, Homo sapien
gtggaaacaacagatgttcactata

SEQ ID NO: 386781 - DNA, 25 bp, Homo sapien
agtggttgaagattagccttacagt

SEQ ID NO: 386782 - DNA, 25 bp, Homo sapien
tattctgatcacttaatacagtaga

SEQ ID NO: 386783 - DNA, 25 bp, Homo sapien
gtagagtcaaacaggaatccaagtt

SEQ ID NO: 386784 - DNA, 25 bp, Homo sapien
aaatggagatgctgcagagcccaac

SEQ ID NO: 386785 - DNA, 25 bp, Homo sapien
gctgcagagcccaacgtaatttttt

SEQ ID NO: 386786 - DNA, 25 bp, Homo sapien
taaacagcaagttttccatctccct

SEQ ID NO: 386787 - DNA, 25 bp, Homo sapien
gaatcctctgaagcttttacccaag

SEQ ID NO: 386788 - DNA, 25 bp, Homo sapien
tttcttgcctctccagtgctatttt

SEQ ID NO: 386789 - DNA, 25 bp, Homo sapien
gtgctattttccttcagatggacct

SEQ ID NO: 386790 - DNA, 25 bp, Homo sapien
aacataatttcttggacactactag

SEQ ID NO: 386791 - DNA, 25 bp, Homo sapien
actactagagagacttcgaggcaat

SEQ ID NO: 386792 - DNA, 25 bp, Homo sapien
gatcagtattaaccagctataacag

SEQ ID NO: 386793 - DNA, 25 bp, Homo sapien
aacagaggtttgatcatgcttactt

SEQ ID NO: 386794 - DNA, 25 bp, Homo sapien
catgcttacttgtacagtttttccc

SEQ ID NO: 386795 - DNA, 25 bp, Homo sapien
tgttgttctgtttacaaatcaggag

SEQ ID NO: 386796 - DNA, 25 bp, Homo sapien
acaaatcaggagagcccctgttttt

SEQ ID NO: 386797 - DNA, 25 bp, Homo sapien
gtttttatatgctaggaaggtcctt

SEQ ID NO: 386798 - DNA, 25 bp, Homo sapien
atatgctaggaaggtccttgggata

SEQ ID NO: 386799 - DNA, 25 bp, Homo sapien
ataggccgaagaggtgtgcaaacga

SEQ ID NO: 386800 - DNA, 25 bp, Homo sapien
ccgaagaggtgtgcaaacgagcagt

SEQ ID NO: 386801 - DNA, 25 bp, Homo sapien
tgtctctcaggaccacggcggcctg

SEQ ID NO: 386802 - DNA, 25 bp, Homo sapien
acagttctgcttctccctatctaga

SEQ ID NO: 386803 - DNA, 25 bp, Homo sapien
tgcttctccctatctagaacgaggt

SEQ ID NO: 386804 - DNA, 25 bp, Homo sapien
ttctccctatctagaacgaggtttt

SEQ ID NO: 386805 - DNA, 25 bp, Homo sapien
gactctgagtggagcccccccatga

SEQ ID NO: 386806 - DNA, 25 bp, Homo sapien
tgcagctcagacaacaggtaaataa

SEQ ID NO: 386807 - DNA, 25 bp, Homo sapien
gtcacagatttgaccagggtggcaa

SEQ ID NO: 386808 - DNA, 25 bp, Homo sapien
gaaatgacaagctaccatgagattc

SEQ ID NO: 386809 - DNA, 25 bp, Homo sapien
catgagattcaacagtggcacggaa

SEQ ID NO: 386810 - DNA, 25 bp, Homo sapien
aagctgccaccaccgtacatagagg

SEQ ID NO: 386811 - DNA, 25 bp, Homo sapien
atagaggcacagatgaccaagcaga

SEQ ID NO: 386812 - DNA, 25 bp, Homo sapien
gatgaccaagcagaacagcaccagt

SEQ ID NO: 386813 - DNA, 25 bp, Homo sapien
gaagaagggcactggcttttcctcg

SEQ ID NO: 386814 - DNA, 25 bp, Homo sapien
gcactggcttttcctcgaagtgaag

SEQ ID NO: 386815 - DNA, 25 bp, Homo sapien
ggcctttggaatgtcttggaccatc

SEQ ID NO: 386816 - DNA, 25 bp, Homo sapien
ttggaccatcacagaaagcagcatg

SEQ ID NO: 386817 - DNA, 25 bp, Homo sapien
attcagccgttggtctttgaaattt

SEQ ID NO: 386818 - DNA, 25 bp, Homo sapien
ttcagccgttggtctttgaaatttc

SEQ ID NO: 386819 - DNA, 25 bp, Homo sapien
tcagccgttggtctttgaaatttcc

SEQ ID NO: 386820 - DNA, 25 bp, Homo sapien
cagccgttggtctttgaaatttcct

SEQ ID NO: 386821 - DNA, 25 bp, Homo sapien
agccgttggtctttgaaatttcctg

SEQ ID NO: 386822 - DNA, 25 bp, Homo sapien
tttgaaatttcctgtgatgtgtttc

SEQ ID NO: 386823 - DNA, 25 bp, Homo sapien
ttgaaatttcctgtgatgtgtttca

SEQ ID NO: 386824 - DNA, 25 bp, Homo sapien
tgaaatttcctgtgatgtgtttcaa

SEQ ID NO: 386825 - DNA, 25 bp, Homo sapien
aagacatttgtaattcactcagttt

SEQ ID NO: 386826 - DNA, 25 bp, Homo sapien
cactcagttttccatacacatttag

SEQ ID NO: 386827 - DNA, 25 bp, Homo sapien
aaagcccatctgtggaatccctaaa

SEQ ID NO: 386828 - DNA, 25 bp, Homo sapien
ggaatccctaaactgccttcaaaga

SEQ ID NO: 386829 - DNA, 25 bp, Homo sapien
gaaggcaagggtcactaaatatttt

SEQ ID NO: 386830 - DNA, 25 bp, Homo sapien
ggattaaggtaccagaggcatcagt

SEQ ID NO: 386831 - DNA, 25 bp, Homo sapien
gtataaggatggagtctggtcttta

SEQ ID NO: 386832 - DNA, 25 bp, Homo sapien
tctggtctttaattacgacaagggt

SEQ ID NO: 386833 - DNA, 25 bp, Homo sapien
gacaagggtattgcttacattctac

SEQ ID NO: 386834 - DNA, 25 bp, Homo sapien
cttacattctactctctggttttca

SEQ ID NO: 386835 - DNA, 25 bp, Homo sapien
tgacatgctgacaaatccagctcct

SEQ ID NO: 386836 - DNA, 25 bp, Homo sapien
aaagctgcaagttatggtaaagtac

SEQ ID NO: 386837 - DNA, 25 bp, Homo sapien
atgatatttaatgcatctgtggctt

SEQ ID NO: 386838 - DNA, 25 bp, Homo sapien
gcatctgtggcttaacacttgtgag

SEQ ID NO: 386839 - DNA, 25 bp, Homo sapien
acttgtgagagttaccagcttgaaa

SEQ ID NO: 386840 - DNA, 25 bp, Homo sapien
atgatggtgttgactacctcttgaa

SEQ ID NO: 386841 - DNA, 25 bp, Homo sapien
gttgactacctcttgaatcacatct

SEQ ID NO: 386842 - DNA, 25 bp, Homo sapien
gaatcacatctatcaaccactggca

SEQ ID NO: 386843 - DNA, 25 bp, Homo sapien
tggtattaacaactaaccgtactag

SEQ ID NO: 386844 - DNA, 25 bp, Homo sapien
caactaaccgtactagagaccaaag

SEQ ID NO: 386845 - DNA, 25 bp, Homo sapien
gagaccaaagtgaaccctgattttt

SEQ ID NO: 386846 - DNA, 25 bp, Homo sapien
aaagtgaaccctgatttttatatgt

SEQ ID NO: 386847 - DNA, 25 bp, Homo sapien
tgctgagaatggcacctggtgagag

SEQ ID NO: 386848 - DNA, 25 bp, Homo sapien
ggctttgtgctgagtgctgtacatg

SEQ ID NO: 386849 - DNA, 25 bp, Homo sapien
gagtgctgtacatgtattagttcct

SEQ ID NO: 386850 - DNA, 25 bp, Homo sapien
gctgtacatgtattagttcctttac

SEQ ID NO: 386851 - DNA, 25 bp, Homo sapien
actgctgaccacattgtacccattt

SEQ ID NO: 386852 - DNA, 25 bp, Homo sapien
tgaccacattgtacccatttcacag

SEQ ID NO: 386853 - DNA, 25 bp, Homo sapien
cacattgtacccatttcacagagaa

SEQ ID NO: 386854 - DNA, 25 bp, Homo sapien
ttgaaccaagccctctgctctgaag

SEQ ID NO: 386855 - DNA, 25 bp, Homo sapien
tctgctctgaagaccgcgtcctgaa

SEQ ID NO: 386856 - DNA, 25 bp, Homo sapien
tctgaagaccgcgtcctgaatttct

SEQ ID NO: 386857 - DNA, 25 bp, Homo sapien
tagagcttcctcatcaggttaccca

SEQ ID NO: 386858 - DNA, 25 bp, Homo sapien
cattggcattcattgtgtctaatac

SEQ ID NO: 386859 - DNA, 25 bp, Homo sapien
gtgtctaatacttgacctgtcctgc

SEQ ID NO: 386860 - DNA, 25 bp, Homo sapien
acttgacctgtcctgctgtttatta

SEQ ID NO: 386861 - DNA, 25 bp, Homo sapien
gtctcaggcccattgttgtaggtga

SEQ ID NO: 386862 - DNA, 25 bp, Homo sapien
tgtaggtgaggtggtttcttttgtt

SEQ ID NO: 386863 - DNA, 25 bp, Homo sapien
ttgatatataacgttttgctgactt

SEQ ID NO: 386864 - DNA, 25 bp, Homo sapien
gtgctgtgacttcaggctaatagag

SEQ ID NO: 386865 - DNA, 25 bp, Homo sapien
agaggtccagatgtcacatgtgcca

SEQ ID NO: 386866 - DNA, 25 bp, Homo sapien
aatgaggaccatggctatggcccac

SEQ ID NO: 386867 - DNA, 25 bp, Homo sapien
gctatggcccactgtgttcagaaga

SEQ ID NO: 386868 - DNA, 25 bp, Homo sapien
gtgttcagaagacacgcccaagcca

SEQ ID NO: 386869 - DNA, 25 bp, Homo sapien
gcaatggagaagcaaatttgtttca

SEQ ID NO: 386870 - DNA, 25 bp, Homo sapien
aaatcttgtgttatacttttctcct

SEQ ID NO: 386871 - DNA, 25 bp, Homo sapien
atacttttctcctggctcacttttt

SEQ ID NO: 386872 - DNA, 25 bp, Homo sapien
ttatgggctatttggctggtgagac

SEQ ID NO: 386873 - DNA, 25 bp, Homo sapien
ggctatttggctggtgagacacgat

SEQ ID NO: 386874 - DNA, 25 bp, Homo sapien
ttggctggtgagacacgatcccctc

SEQ ID NO: 386875 - DNA, 25 bp, Homo sapien
agacacgatcccctcctaagaaaat

SEQ ID NO: 386876 - DNA, 25 bp, Homo sapien
gaaaatgtaggtgctcagacaggta

SEQ ID NO: 386877 - DNA, 25 bp, Homo sapien
ggtgctcagacaggtaaccactgct

SEQ ID NO: 386878 - DNA, 25 bp, Homo sapien
agacaggtaaccactgctgctactg

SEQ ID NO: 386879 - DNA, 25 bp, Homo sapien
caggtaaccactgctgctactgttt

SEQ ID NO: 386880 - DNA, 25 bp, Homo sapien
aagtctcattactctgatcagttat

SEQ ID NO: 386881 - DNA, 25 bp, Homo sapien
atcagttattgatcggaggctaccc

SEQ ID NO: 386882 - DNA, 25 bp, Homo sapien
tgatcggaggctaccctggctcagt

SEQ ID NO: 386883 - DNA, 25 bp, Homo sapien
tcagtcaccagctgctcactgtgtc

SEQ ID NO: 386884 - DNA, 25 bp, Homo sapien
actgtgtccttctgtggtctcagga

SEQ ID NO: 386885 - DNA, 25 bp, Homo sapien
ggtctcaggagctgcagttgttgct

SEQ ID NO: 386886 - DNA, 25 bp, Homo sapien
ctggatgtgtctgtactggcagtga

SEQ ID NO: 386887 - DNA, 25 bp, Homo sapien
tggcagtgattttgcaacttcctct

SEQ ID NO: 386888 - DNA, 25 bp, Homo sapien
gcaacttcctctgtataagcgatac

SEQ ID NO: 386889 - DNA, 25 bp, Homo sapien
gtatttgatggtaattgcctgtggt

SEQ ID NO: 386890 - DNA, 25 bp, Homo sapien
ttgcctgtggtggttgtatcatgat

SEQ ID NO: 386891 - DNA, 25 bp, Homo sapien
cgtgacattcatgctttggtgtggg

SEQ ID NO: 386892 - DNA, 25 bp, Homo sapien
agattccaaactttttacacccatg

SEQ ID NO: 386893 - DNA, 25 bp, Homo sapien
tactctttattttacccttcattat

SEQ ID NO: 386894 - DNA, 25 bp, Homo sapien
aaaataacaacatcacccattgccc

SEQ ID NO: 386895 - DNA, 25 bp, Homo sapien
cccgtgtccaaaggattcgcttgta

SEQ ID NO: 386896 - DNA, 25 bp, Homo sapien
atacctagaaagatagacacccatg

SEQ ID NO: 386897 - DNA, 25 bp, Homo sapien
agatagacacccatggaaggactgc

SEQ ID NO: 386898 - DNA, 25 bp, Homo sapien
ttgttattttggactgacccacatg

SEQ ID NO: 386899 - DNA, 25 bp, Homo sapien
tgacccacatgtaatcctttttcac

SEQ ID NO: 386900 - DNA, 25 bp, Homo sapien
gtaatcctttttcacatatggtttg

SEQ ID NO: 386901 - DNA, 25 bp, Homo sapien
tcacatatggtttgaacctggtatc

SEQ ID NO: 386902 - DNA, 25 bp, Homo sapien
tgcaggcaggactccagcgtcagga

SEQ ID NO: 386903 - DNA, 25 bp, Homo sapien
ggactccagcgtcaggatgttgcca

SEQ ID NO: 386904 - DNA, 25 bp, Homo sapien
cagcgtcaggatgttgccacttgga

SEQ ID NO: 386905 - DNA, 25 bp, Homo sapien
gatgttgccacttggagtatgaaca

SEQ ID NO: 386906 - DNA, 25 bp, Homo sapien
gggttttcagccacagttccctcga

SEQ ID NO: 386907 - DNA, 25 bp, Homo sapien
acagttccctcgaggccagtgttca

SEQ ID NO: 386908 - DNA, 25 bp, Homo sapien
agtgttcagcaggatcatgccttct

SEQ ID NO: 386909 - DNA, 25 bp, Homo sapien
aggatcatgccttctgtgtctggaa

SEQ ID NO: 386910 - DNA, 25 bp, Homo sapien
gcagaggcaacagtgtttaggattt

SEQ ID NO: 386911 - DNA, 25 bp, Homo sapien
acagtgtttaggatttgggttatca

SEQ ID NO: 386912 - DNA, 25 bp, Homo sapien
cataaggtgttaagagtcccttgtt

SEQ ID NO: 386913 - DNA, 25 bp, Homo sapien
gaacgaaaagggagtcgcgtataga

SEQ ID NO: 386914 - DNA, 25 bp, Homo sapien
gtcgcgagccacactttgcaatgaa

SEQ ID NO: 386915 - DNA, 25 bp, Homo sapien
gccacactttgcaatgaaactcttt

SEQ ID NO: 386916 - DNA, 25 bp, Homo sapien
gaaactctttagactttctgccggg

SEQ ID NO: 386917 - DNA, 25 bp, Homo sapien
tttagactttctgccgggagagcgg

SEQ ID NO: 386918 - DNA, 25 bp, Homo sapien
agagcggcccagacgcgccaggtct

SEQ ID NO: 386919 - DNA, 25 bp, Homo sapien
cagacgcgccaggtctgtagcagga

SEQ ID NO: 386920 - DNA, 25 bp, Homo sapien
gggtccccagaagcctacaggtgag

SEQ ID NO: 386921 - DNA, 25 bp, Homo sapien
tacaggtgagtatcggttctcccct

SEQ ID NO: 386922 - DNA, 25 bp, Homo sapien
gaggcgggagcagcttccctgttct

SEQ ID NO: 386923 - DNA, 25 bp, Homo sapien
tgttctgatcctatcgcgggcggcg

SEQ ID NO: 386924 - DNA, 25 bp, Homo sapien
tataatccctatatatcttgaatct

SEQ ID NO: 386925 - DNA, 25 bp, Homo sapien
tacacatatacataaattttcagct

SEQ ID NO: 386926 - DNA, 25 bp, Homo sapien
attttcagctatttctgttcccctg

SEQ ID NO: 386927 - DNA, 25 bp, Homo sapien
agctatttctgttcccctgaactaa

SEQ ID NO: 386928 - DNA, 25 bp, Homo sapien
gttcccctgaactaatttgagatta

SEQ ID NO: 386929 - DNA, 25 bp, Homo sapien
tgagattagacccaaacatgctttt

SEQ ID NO: 386930 - DNA, 25 bp, Homo sapien
gattagacccaaacatgcttttaaa

SEQ ID NO: 386931 - DNA, 25 bp, Homo sapien
atgcttttaaatgtctcatgccaag

SEQ ID NO: 386932 - DNA, 25 bp, Homo sapien
ttaaatgtctcatgccaaggcactg

SEQ ID NO: 386933 - DNA, 25 bp, Homo sapien
catgccaaggcactgaattaagact

SEQ ID NO: 386934 - DNA, 25 bp, Homo sapien
aaggcactgaattaagacttcttaa

SEQ ID NO: 386935 - DNA, 25 bp, Homo sapien
atcattactcagtccacaacctgga

SEQ ID NO: 386936 - DNA, 25 bp, Homo sapien
tccacaacctggactcatgtagggt

SEQ ID NO: 386937 - DNA, 25 bp, Homo sapien
tgtagggtcccctgtcagtaaagga

SEQ ID NO: 386938 - DNA, 25 bp, Homo sapien
taaaggagtcagtcaagcccaccag

SEQ ID NO: 386939 - DNA, 25 bp, Homo sapien
aagcccaccaggtataccaaggact

SEQ ID NO: 386940 - DNA, 25 bp, Homo sapien
tactccttggaaagctgccccttgg

SEQ ID NO: 386941 - DNA, 25 bp, Homo sapien
gccccttggcctaatattggtgttt

SEQ ID NO: 386942 - DNA, 25 bp, Homo sapien
tggtgtttagcttgagcctgactcc

SEQ ID NO: 386943 - DNA, 25 bp, Homo sapien
cctgactccttctcaacactaagag

SEQ ID NO: 386944 - DNA, 25 bp, Homo sapien
tcaagctaaatacatgtcctcagaa

SEQ ID NO: 386945 - DNA, 25 bp, Homo sapien
aaatctgaaagctctctgcctgtgt

SEQ ID NO: 386946 - DNA, 25 bp, Homo sapien
ctggactacaaatttacaagattct

SEQ ID NO: 386947 - DNA, 25 bp, Homo sapien
acaagattctcttcaagcaattcaa

SEQ ID NO: 386948 - DNA, 25 bp, Homo sapien
aacagctggctactatccaaatcct

SEQ ID NO: 386949 - DNA, 25 bp, Homo sapien
aaatcctccactggtcttatcaagt

SEQ ID NO: 386950 - DNA, 25 bp, Homo sapien
gtgatgagacactgatatccaaata

SEQ ID NO: 386951 - DNA, 25 bp, Homo sapien
atccaaataagttgtctttactgaa

SEQ ID NO: 386952 - DNA, 25 bp, Homo sapien
gaagtgaagacccatatatgcagtt

SEQ ID NO: 386953 - DNA, 25 bp, Homo sapien
taaggaacaagttttattgaccaat

SEQ ID NO: 386954 - DNA, 25 bp, Homo sapien
gaccaataagttgatatttgtccat

SEQ ID NO: 386955 - DNA, 25 bp, Homo sapien
ttgtccataggtctcctttctataa

SEQ ID NO: 386956 - DNA, 25 bp, Homo sapien
aatcatcttgatgtttaacaactct

SEQ ID NO: 386957 - DNA, 25 bp, Homo sapien
gccctttttcctcctgacagccaga

SEQ ID NO: 386958 - DNA, 25 bp, Homo sapien
acagccagacccttctgtctatggc

SEQ ID NO: 386959 - DNA, 25 bp, Homo sapien
cagacccttctgtctatggcactgc

SEQ ID NO: 386960 - DNA, 25 bp, Homo sapien
acccttctgtctatggcactgcctg

SEQ ID NO: 386961 - DNA, 25 bp, Homo sapien
gtctatggcactgcctgcagctgca

SEQ ID NO: 386962 - DNA, 25 bp, Homo sapien
agaggatatttccatggctgggcta

SEQ ID NO: 386963 - DNA, 25 bp, Homo sapien
atttccatggctgggctatgcaaac

SEQ ID NO: 386964 - DNA, 25 bp, Homo sapien
gccagtaccagaatatcaaccagac

SEQ ID NO: 386965 - DNA, 25 bp, Homo sapien
atcaaccagacactctcagctgcag

SEQ ID NO: 386966 - DNA, 25 bp, Homo sapien
tcaaccagacactctcagctgcagg

SEQ ID NO: 386967 - DNA, 25 bp, Homo sapien
gagacctgagtttgtcctacaaaac

SEQ ID NO: 386968 - DNA, 25 bp, Homo sapien
gatagctatgtcttttattgcagat

SEQ ID NO: 386969 - DNA, 25 bp, Homo sapien
atgacagattttactaaagctagtg

SEQ ID NO: 386970 - DNA, 25 bp, Homo sapien
tactaaagctagtgtttttataaca

SEQ ID NO: 386971 - DNA, 25 bp, Homo sapien
atatattagttgatgtttacctata

SEQ ID NO: 386972 - DNA, 25 bp, Homo sapien
ttgatgtttacctataagtggagta

SEQ ID NO: 386973 - DNA, 25 bp, Homo sapien
acctataagtggagtagattttcat

SEQ ID NO: 386974 - DNA, 25 bp, Homo sapien
ttttcatctgcctgcaatggtataa

SEQ ID NO: 386975 - DNA, 25 bp, Homo sapien
atctgcctgcaatggtataatttca

SEQ ID NO: 386976 - DNA, 25 bp, Homo sapien
gcctgcaatggtataatttcagtct

SEQ ID NO: 386977 - DNA, 25 bp, Homo sapien
tttgggtacccttagacctctgatt

SEQ ID NO: 386978 - DNA, 25 bp, Homo sapien
gattctaagtcaaatgcaaatgggt

SEQ ID NO: 386979 - DNA, 25 bp, Homo sapien
gactgaagacattgattagatataa

SEQ ID NO: 386980 - DNA, 25 bp, Homo sapien
taaatgccatcacataaacaaagtg

SEQ ID NO: 386981 - DNA, 25 bp, Homo sapien
aagctgtataaagctgcagctttca

SEQ ID NO: 386982 - DNA, 25 bp, Homo sapien
aaacctggcattaaaatgtaatggc

SEQ ID NO: 386983 - DNA, 25 bp, Homo sapien
atggcaaaaccaatattttctatat

SEQ ID NO: 386984 - DNA, 25 bp, Homo sapien
gtgaagggcaaaggttacagaaacg

SEQ ID NO: 386985 - DNA, 25 bp, Homo sapien
tacagaaacggtcccaagaaaatct

SEQ ID NO: 386986 - DNA, 25 bp, Homo sapien
taacacccaaattttcctttgatag

SEQ ID NO: 386987 - DNA, 25 bp, Homo sapien
ttcctttgatagatagatgccttta

SEQ ID NO: 386988 - DNA, 25 bp, Homo sapien
gggctggtaatgcagttacattcta

SEQ ID NO: 386989 - DNA, 25 bp, Homo sapien
gttacattctaacagagaagtccaa

SEQ ID NO: 386990 - DNA, 25 bp, Homo sapien
ctaagtattatgaggacaagccgca

SEQ ID NO: 386991 - DNA, 25 bp, Homo sapien
acctgggcgcgtgtctgctgcagtc

SEQ ID NO: 386992 - DNA, 25 bp, Homo sapien
tgctgcagtcggactgtgtggtcca

SEQ ID NO: 386993 - DNA, 25 bp, Homo sapien
gtggtccaggaaggaaaatcacctc

SEQ ID NO: 386994 - DNA, 25 bp, Homo sapien
aatcacctcggcagtgtttgaagga

SEQ ID NO: 386995 - DNA, 25 bp, Homo sapien
gaaggaaggatactgcaactctttg

SEQ ID NO: 386996 - DNA, 25 bp, Homo sapien
gcaactctttgaagtacgcattttt

SEQ ID NO: 386997 - DNA, 25 bp, Homo sapien
gaagtacgcattttttgagtgtaaa

SEQ ID NO: 386998 - DNA, 25 bp, Homo sapien
agatcagtgttggataacagggcaa

SEQ ID NO: 386999 - DNA, 25 bp, Homo sapien
ataacagggcaagattcagaggaag

SEQ ID NO: 387000 - DNA, 25 bp, Homo sapien
gaagcgccgtcatgcctaagtatta

SEQ ID NO: 387001 - DNA, 25 bp, Homo sapien
tgaaaatgcccgtcctacacaaata

SEQ ID NO: 387002 - DNA, 25 bp, Homo sapien
atgcccgtcctacacaaataatgtg

SEQ ID NO: 387003 - DNA, 25 bp, Homo sapien
gacattgctctctggataaaggata

SEQ ID NO: 387004 - DNA, 25 bp, Homo sapien
gcaaaatgagccagttaacatgtca

SEQ ID NO: 387005 - DNA, 25 bp, Homo sapien
tctaaaaggatcttgttacttcata

SEQ ID NO: 387006 - DNA, 25 bp, Homo sapien
gacttaggcactgatcagaaacggt

SEQ ID NO: 387007 - DNA, 25 bp, Homo sapien
atcagaaacggtctctgtttaccaa

SEQ ID NO: 387008 - DNA, 25 bp, Homo sapien
gtctctgtttaccaaaattccttct

SEQ ID NO: 387009 - DNA, 25 bp, Homo sapien
ttaccaaaattccttctttgcacac

SEQ ID NO: 387010 - DNA, 25 bp, Homo sapien
ccttctttgcacacagagctgtgta

SEQ ID NO: 387011 - DNA, 25 bp, Homo sapien
gctgtgtagtgaaaatgcccgtcct

SEQ ID NO: 387012 - DNA, 25 bp, Homo sapien
cccgaagctgataacctgaagaaaa

SEQ ID NO: 387013 - DNA, 25 bp, Homo sapien
taccttggttgtagtcagtgtcaca

SEQ ID NO: 387014 - DNA, 25 bp, Homo sapien
cttggttgtagtcagtgtcacagaa

SEQ ID NO: 387015 - DNA, 25 bp, Homo sapien
ttttttctgccaacagtgagggtcg

SEQ ID NO: 387016 - DNA, 25 bp, Homo sapien
ttttctgccaacagtgagggtcgct

SEQ ID NO: 387017 - DNA, 25 bp, Homo sapien
ttctgccaacagtgagggtcgctgt

SEQ ID NO: 387018 - DNA, 25 bp, Homo sapien
ctgccaacagtgagggtcgctgtct

SEQ ID NO: 387019 - DNA, 25 bp, Homo sapien
gtagtcagtgtcacagaagtgcagt

SEQ ID NO: 387020 - DNA, 25 bp, Homo sapien
gtcagtgtcacagaagtgcagttta

SEQ ID NO: 387021 - DNA, 25 bp, Homo sapien
gtgtcacagaagtgcagtttaatgt

SEQ ID NO: 387022 - DNA, 25 bp, Homo sapien
gtgcagtttaatgtattatgtgtac

SEQ ID NO: 387023 - DNA, 25 bp, Homo sapien
gtgtggcacccacgccatgcaggaa

SEQ ID NO: 387024 - DNA, 25 bp, Homo sapien
ggcacccacgccatgcaggaactgg

SEQ ID NO: 387025 - DNA, 25 bp, Homo sapien
aactggcccagcatgaagaccagct

SEQ ID NO: 387026 - DNA, 25 bp, Homo sapien
atgaagaccagctggtagcgggaca

SEQ ID NO: 387027 - DNA, 25 bp, Homo sapien
cccaggatggccgctgtgtagaaga

SEQ ID NO: 387028 - DNA, 25 bp, Homo sapien
ggttggcagggcacgtcctgacacc

SEQ ID NO: 387029 - DNA, 25 bp, Homo sapien
ctcatagcggccagccgtgaagtgg

SEQ ID NO: 387030 - DNA, 25 bp, Homo sapien
cagctggacttgacgttctcatcca

SEQ ID NO: 387031 - DNA, 25 bp, Homo sapien
gacttgacgttctcatccaggtagg

SEQ ID NO: 387032 - DNA, 25 bp, Homo sapien
tgacgttctcatccaggtaggtgac

SEQ ID NO: 387033 - DNA, 25 bp, Homo sapien
atccaggtaggtgacgcccagcgtg

SEQ ID NO: 387034 - DNA, 25 bp, Homo sapien
actcctctgcaccataacttattaa

SEQ ID NO: 387035 - DNA, 25 bp, Homo sapien
ggctaaacctgaatgactctacgta

SEQ ID NO: 387036 - DNA, 25 bp, Homo sapien
acgtatctatagtttcactgctcat

SEQ ID NO: 387037 - DNA, 25 bp, Homo sapien
actgctcatataccagctgctacaa

SEQ ID NO: 387038 - DNA, 25 bp, Homo sapien
gtttgtctttactcctaattgctaa

SEQ ID NO: 387039 - DNA, 25 bp, Homo sapien
ttaactgaaacccttcctgtctagg

SEQ ID NO: 387040 - DNA, 25 bp, Homo sapien
tcctgtctagggagaattgctgcta

SEQ ID NO: 387041 - DNA, 25 bp, Homo sapien
attgctgctagtaaggtcagtttgc

SEQ ID NO: 387042 - DNA, 25 bp, Homo sapien
ggtcagtttgcaatgttcagcttta

SEQ ID NO: 387043 - DNA, 25 bp, Homo sapien
gttcagctttagatatgtgtcgtaa

SEQ ID NO: 387044 - DNA, 25 bp, Homo sapien
gtgtcgtaatgggagtctgaaaact

SEQ ID NO: 387045 - DNA, 25 bp, Homo sapien
gttctggagtatacttcttggtgca

SEQ ID NO: 387046 - DNA, 25 bp, Homo sapien
cttcttggtgcaggcatgtccagca

SEQ ID NO: 387047 - DNA, 25 bp, Homo sapien
gtccagcagtcaccatgttgggctt

SEQ ID NO: 387048 - DNA, 25 bp, Homo sapien
gcagtcaccatgttgggctttagca

SEQ ID NO: 387049 - DNA, 25 bp, Homo sapien
tgttgggctttagcagggtgccctc

SEQ ID NO: 387050 - DNA, 25 bp, Homo sapien
agggtgccctccaggtaaacatgat

SEQ ID NO: 387051 - DNA, 25 bp, Homo sapien
tgccctccaggtaaacatgatggtc

SEQ ID NO: 387052 - DNA, 25 bp, Homo sapien
catgatggtcattcagggccttgta

SEQ ID NO: 387053 - DNA, 25 bp, Homo sapien
ggccttgtagacagcagccaggacc

SEQ ID NO: 387054 - DNA, 25 bp, Homo sapien
atggacactggtcggcaatcctcag

SEQ ID NO: 387055 - DNA, 25 bp, Homo sapien
tggtcggcaatcctcagcacagcac

SEQ ID NO: 387056 - DNA, 25 bp, Homo sapien
gtaatcacaaccaaataagagcaga

SEQ ID NO: 387057 - DNA, 25 bp, Homo sapien
ttagatattcaaacggagtcctccc

SEQ ID NO: 387058 - DNA, 25 bp, Homo sapien
ctagtttatgttaaaaggccagtct

SEQ ID NO: 387059 - DNA, 25 bp, Homo sapien
aggccagtctaaattctttcactta

SEQ ID NO: 387060 - DNA, 25 bp, Homo sapien
aattctttcacttacatctttacag

SEQ ID NO: 387061 - DNA, 25 bp, Homo sapien
tattttctctcttccatacccagaa

SEQ ID NO: 387062 - DNA, 25 bp, Homo sapien
ctctcttccatacccagaaatctaa

SEQ ID NO: 387063 - DNA, 25 bp, Homo sapien
gacttttctcatgttcaactggacc

SEQ ID NO: 387064 - DNA, 25 bp, Homo sapien
tttctcatgttcaactggacctagg

SEQ ID NO: 387065 - DNA, 25 bp, Homo sapien
atgacagaaaagcatcccataggct

SEQ ID NO: 387066 - DNA, 25 bp, Homo sapien
gcatcccataggctttaatatactt

SEQ ID NO: 387067 - DNA, 25 bp, Homo sapien
atgcaccattcagacttgttagagt

SEQ ID NO: 387068 - DNA, 25 bp, Homo sapien
gggtttatgactgccaagtttgccc

SEQ ID NO: 387069 - DNA, 25 bp, Homo sapien
gcccagtacagtagttttttatcac

SEQ ID NO: 387070 - DNA, 25 bp, Homo sapien
gatggagtcctgtagtagtttcagt

SEQ ID NO: 387071 - DNA, 25 bp, Homo sapien
ttttccaccatacatctgtgcattt

SEQ ID NO: 387072 - DNA, 25 bp, Homo sapien
atctgtgcattttctctttaggtga

SEQ ID NO: 387073 - DNA, 25 bp, Homo sapien
gtgtgcatagttactcagtttttat

SEQ ID NO: 387074 - DNA, 25 bp, Homo sapien
gaactgttgtatcctgttaatgcat

SEQ ID NO: 387075 - DNA, 25 bp, Homo sapien
aatgcatattgctctgtgactccag

SEQ ID NO: 387076 - DNA, 25 bp, Homo sapien
gtgactccagtatatcttacctgta

SEQ ID NO: 387077 - DNA, 25 bp, Homo sapien
ctgtactgaccaaacctaaataaag

SEQ ID NO: 387078 - DNA, 25 bp, Homo sapien
acctgtgccttgtgggttggacttt

SEQ ID NO: 387079 - DNA, 25 bp, Homo sapien
ggttggactttgaagctggccccgc

SEQ ID NO: 387080 - DNA, 25 bp, Homo sapien
ctttccccacggctttaatcatgaa

SEQ ID NO: 387081 - DNA, 25 bp, Homo sapien
cacggctttaatcatgaaaaccagg

SEQ ID NO: 387082 - DNA, 25 bp, Homo sapien
gaaaggtttatcctgtgccagaaac

SEQ ID NO: 387083 - DNA, 25 bp, Homo sapien
gaaaccaaggtttatcatgctctag

SEQ ID NO: 387084 - DNA, 25 bp, Homo sapien
tatcatgctctaggaacttttttct

SEQ ID NO: 387085 - DNA, 25 bp, Homo sapien
taggaacttttttcttacactgcct

SEQ ID NO: 387086 - DNA, 25 bp, Homo sapien
ttttttcttacactgcctaccgcca

SEQ ID NO: 387087 - DNA, 25 bp, Homo sapien
tgcctaccgccattcatgattaaac

SEQ ID NO: 387088 - DNA, 25 bp, Homo sapien
cgccattcatgattaaaccatccag

SEQ ID NO: 387089 - DNA, 25 bp, Homo sapien
acaaagtccttcataatttaaccat

SEQ ID NO: 387090 - DNA, 25 bp, Homo sapien
atttaaccattagcatctttggcca

SEQ ID NO: 387091 - DNA, 25 bp, Homo sapien
accattagcatctttggccaaacca

SEQ ID NO: 387092 - DNA, 25 bp, Homo sapien
aaaagcatcttctcctagttgtgtg

SEQ ID NO: 387093 - DNA, 25 bp, Homo sapien
tcttctcctagttgtgtgtgggcaa

SEQ ID NO: 387094 - DNA, 25 bp, Homo sapien
gtgtgtgggcaacagaaacaagtta

SEQ ID NO: 387095 - DNA, 25 bp, Homo sapien
gttctttttatgcaaatcccctgtg

SEQ ID NO: 387096 - DNA, 25 bp, Homo sapien
tatgcaaatcccctgtgaaaataaa

SEQ ID NO: 387097 - DNA, 25 bp, Homo sapien
tttttcttgtatagccacctagaga

SEQ ID NO: 387098 - DNA, 25 bp, Homo sapien
agccacctagagaattcttcataga

SEQ ID NO: 387099 - DNA, 25 bp, Homo sapien
tacagttttcaccacttaacataag

SEQ ID NO: 387100 - DNA, 25 bp, Homo sapien
ttcttagcgctggtctccagtcctg

SEQ ID NO: 387101 - DNA, 25 bp, Homo sapien
ttgcctcagttgtatggttctttcc

SEQ ID NO: 387102 - DNA, 25 bp, Homo sapien
gtatggttctttcctgtgggctcaa

SEQ ID NO: 387103 - DNA, 25 bp, Homo sapien
ttcctgtgggctcaattttgcccta

SEQ ID NO: 387104 - DNA, 25 bp, Homo sapien
caattttgccctacatagttggata

SEQ ID NO: 387105 - DNA, 25 bp, Homo sapien
agttggataaaactctgtgctgtcc

SEQ ID NO: 387106 - DNA, 25 bp, Homo sapien
gagagtaaagctgttcacccacaca

SEQ ID NO: 387107 - DNA, 25 bp, Homo sapien
ttgtgccccgtggagcctggcacat

SEQ ID NO: 387108 - DNA, 25 bp, Homo sapien
cctggcacattccaggctcctagga

SEQ ID NO: 387109 - DNA, 25 bp, Homo sapien
agagcctcctagacaataggccctt

SEQ ID NO: 387110 - DNA, 25 bp, Homo sapien
gacaataggccctttggaccgagtt

SEQ ID NO: 387111 - DNA, 25 bp, Homo sapien
ttctaatttcatgtatgggaataca

SEQ ID NO: 387112 - DNA, 25 bp, Homo sapien
atttcttttcttgagcaatcacttc

SEQ ID NO: 387113 - DNA, 25 bp, Homo sapien
tttcttgagcaatcacttctctctc

SEQ ID NO: 387114 - DNA, 25 bp, Homo sapien
ttgagcaatcacttctctctccaat

SEQ ID NO: 387115 - DNA, 25 bp, Homo sapien
aatcacttctctctccaattcatga

SEQ ID NO: 387116 - DNA, 25 bp, Homo sapien
cttctctctccaattcatgattctg

SEQ ID NO: 387117 - DNA, 25 bp, Homo sapien
ccaattcatgattctggagcagatt

SEQ ID NO: 387118 - DNA, 25 bp, Homo sapien
ggagcagattgagtagagtaagttt

SEQ ID NO: 387119 - DNA, 25 bp, Homo sapien
gagtaagtttttagctcctcctgta

SEQ ID NO: 387120 - DNA, 25 bp, Homo sapien
ttgtggcagcttttcgtagcaaaga

SEQ ID NO: 387121 - DNA, 25 bp, Homo sapien
ggcagcttttcgtagcaaagaaata

SEQ ID NO: 387122 - DNA, 25 bp, Homo sapien
aagttcaccaattctaacacaccca

SEQ ID NO: 387123 - DNA, 25 bp, Homo sapien
acacccaactcctacaatcatatgg

SEQ ID NO: 387124 - DNA, 25 bp, Homo sapien
caatcatatggacccagacaaactg

SEQ ID NO: 387125 - DNA, 25 bp, Homo sapien
agacaaactgaatggcctctggagc

SEQ ID NO: 387126 - DNA, 25 bp, Homo sapien
aactgaatggcctctggagccgtat

SEQ ID NO: 387127 - DNA, 25 bp, Homo sapien
tggagccgtatttctcacttagttc

SEQ ID NO: 387128 - DNA, 25 bp, Homo sapien
ttctcacttagttctgcctgtgcaa

SEQ ID NO: 387129 - DNA, 25 bp, Homo sapien
gcctgtgcaacctgaaaatgccctg

SEQ ID NO: 387130 - DNA, 25 bp, Homo sapien
gaaaaatcatgtcccaagttctgag

SEQ ID NO: 387131 - DNA, 25 bp, Homo sapien
agttctgagaattgttcacactttc

SEQ ID NO: 387132 - DNA, 25 bp, Homo sapien
gagacagaattcagagctctttttg

SEQ ID NO: 387133 - DNA, 25 bp, Homo sapien
gttgtaccaatttacttcccagcag

SEQ ID NO: 387134 - DNA, 25 bp, Homo sapien
gtaccaatttacttcccagcagctg

SEQ ID NO: 387135 - DNA, 25 bp, Homo sapien
aagcattagtagagtttcagttgtt

SEQ ID NO: 387136 - DNA, 25 bp, Homo sapien
ccttgtcaacgctttgtgcccttga

SEQ ID NO: 387137 - DNA, 25 bp, Homo sapien
ttgtgcccttgacctttacaacact

SEQ ID NO: 387138 - DNA, 25 bp, Homo sapien
cttgacctttacaacactccatttt

SEQ ID NO: 387139 - DNA, 25 bp, Homo sapien
acataaatagccagaggacttgcct

SEQ ID NO: 387140 - DNA, 25 bp, Homo sapien
atgtttgctccatgagccaatcacg

SEQ ID NO: 387141 - DNA, 25 bp, Homo sapien
tgctccatgagccaatcacggaagg

SEQ ID NO: 387142 - DNA, 25 bp, Homo sapien
agccaatcacggaaggaagctgggc

SEQ ID NO: 387143 - DNA, 25 bp, Homo sapien
agaggacttgcctgggccgtacata

SEQ ID NO: 387144 - DNA, 25 bp, Homo sapien
ctctgaccttcagttatggagagga

SEQ ID NO: 387145 - DNA, 25 bp, Homo sapien
tggttgtctacctggaatgggatga

SEQ ID NO: 387146 - DNA, 25 bp, Homo sapien
agctctgctgcccaaagtgtttcct

SEQ ID NO: 387147 - DNA, 25 bp, Homo sapien
gcccaaagtgtttcctgtttcaggg

SEQ ID NO: 387148 - DNA, 25 bp, Homo sapien
ggaaagatttctatggctggctatg

SEQ ID NO: 387149 - DNA, 25 bp, Homo sapien
gggactgcaaacctcttaagagttg

SEQ ID NO: 387150 - DNA, 25 bp, Homo sapien
acagtggaccagtcttgtgtttacc

SEQ ID NO: 387151 - DNA, 25 bp, Homo sapien
ttgtgtttacccctcagggatgcta

SEQ ID NO: 387152 - DNA, 25 bp, Homo sapien
gggatgctactgatctcaaggtctt

SEQ ID NO: 387153 - DNA, 25 bp, Homo sapien
gatctcaaggtcttgccaggtctca

SEQ ID NO: 387154 - DNA, 25 bp, Homo sapien
aggtctcacaatctccattgggact

SEQ ID NO: 387155 - DNA, 25 bp, Homo sapien
ctgagatgagcttttcttgtagaat

SEQ ID NO: 387156 - DNA, 25 bp, Homo sapien
aggaaccatacctactcagtgcctg

SEQ ID NO: 387157 - DNA, 25 bp, Homo sapien
agtgcctggcactatgatccagttg

SEQ ID NO: 387158 - DNA, 25 bp, Homo sapien
atgatccagttgctgcctcaggtca

SEQ ID NO: 387159 - DNA, 25 bp, Homo sapien
gggaaggtatcatcggaagagcaaa

SEQ ID NO: 387160 - DNA, 25 bp, Homo sapien
tgagccacatccaagcctggtttgc

SEQ ID NO: 387161 - DNA, 25 bp, Homo sapien
tggtttgctgcactctattgccaaa

SEQ ID NO: 387162 - DNA, 25 bp, Homo sapien
ttgccaaagactgacactggcctca

SEQ ID NO: 387163 - DNA, 25 bp, Homo sapien
actggcctcagtcttactcagatat

SEQ ID NO: 387164 - DNA, 25 bp, Homo sapien
gtcttactcagatatggctcctcaa

SEQ ID NO: 387165 - DNA, 25 bp, Homo sapien
agatatggctcctcaattgggatgg

SEQ ID NO: 387166 - DNA, 25 bp, Homo sapien
gacttcaataactctgttctcaata

SEQ ID NO: 387167 - DNA, 25 bp, Homo sapien
acttcaataactctgttctcaataa

SEQ ID NO: 387168 - DNA, 25 bp, Homo sapien
tcaataactctgttctcaataactg

SEQ ID NO: 387169 - DNA, 25 bp, Homo sapien
caataactctgttctcaataactga

SEQ ID NO: 387170 - DNA, 25 bp, Homo sapien
aataactctgttctcaataactgat

SEQ ID NO: 387171 - DNA, 25 bp, Homo sapien
ataactctgttctcaataactgata

SEQ ID NO: 387172 - DNA, 25 bp, Homo sapien
taactctgttctcaataactgataa

SEQ ID NO: 387173 - DNA, 25 bp, Homo sapien
ggataacattatcaactggtttaat

SEQ ID NO: 387174 - DNA, 25 bp, Homo sapien
catttataaaacactctactcaaga

SEQ ID NO: 387175 - DNA, 25 bp, Homo sapien
taaaacactctactcaagagcaaca

SEQ ID NO: 387176 - DNA, 25 bp, Homo sapien
aagagacatggaaaaatccacagtc

SEQ ID NO: 387177 - DNA, 25 bp, Homo sapien
tagttaattggactgattcttaccc

SEQ ID NO: 387178 - DNA, 25 bp, Homo sapien
aattggactgattcttacccagccc

SEQ ID NO: 387179 - DNA, 25 bp, Homo sapien
tacccagccctggtcaagaatctgt

SEQ ID NO: 387180 - DNA, 25 bp, Homo sapien
aagaatctgtgaggcatgtgactga

SEQ ID NO: 387181 - DNA, 25 bp, Homo sapien
gaggcatgtgactgaagtactaaat

SEQ ID NO: 387182 - DNA, 25 bp, Homo sapien
gaatttttaagactgtaggtggact

SEQ ID NO: 387183 - DNA, 25 bp, Homo sapien
agactgtaggtggactatgttagta

SEQ ID NO: 387184 - DNA, 25 bp, Homo sapien
ctatgttagtagttttcaagcagga

SEQ ID NO: 387185 - DNA, 25 bp, Homo sapien
tttcaagcaggatgtctgtattcag

SEQ ID NO: 387186 - DNA, 25 bp, Homo sapien
tgtctgtattcagcattcaataatg

SEQ ID NO: 387187 - DNA, 25 bp, Homo sapien
gtttttatcctttgctgactaaaat

SEQ ID NO: 387188 - DNA, 25 bp, Homo sapien
ttttttaaatggcactatgtagtaa

SEQ ID NO: 387189 - DNA, 25 bp, Homo sapien
tttttaaatggcactatgtagtaat

SEQ ID NO: 387190 - DNA, 25 bp, Homo sapien
aaatggcactatgtagtaattaaga

SEQ ID NO: 387191 - DNA, 25 bp, Homo sapien
atggcactatgtagtaattaagagc

SEQ ID NO: 387192 - DNA, 25 bp, Homo sapien
ggcactatgtagtaattaagagcta

SEQ ID NO: 387193 - DNA, 25 bp, Homo sapien
gcactatgtagtaattaagagctaa

SEQ ID NO: 387194 - DNA, 25 bp, Homo sapien
tagtaattaagagctaaggagacag

SEQ ID NO: 387195 - DNA, 25 bp, Homo sapien
gcaattctttatttgataagagtga

SEQ ID NO: 387196 - DNA, 25 bp, Homo sapien
tctttatttgataagagtgaactga

SEQ ID NO: 387197 - DNA, 25 bp, Homo sapien
aatggtagacatgaaaggcaggtga

SEQ ID NO: 387198 - DNA, 25 bp, Homo sapien
gacatgaaaggcaggtgaggaaaca

SEQ ID NO: 387199 - DNA, 25 bp, Homo sapien
gtggctttagaccagtcagtacctt

SEQ ID NO: 387200 - DNA, 25 bp, Homo sapien
taccttgctctttgtgcatggtgca

SEQ ID NO: 387201 - DNA, 25 bp, Homo sapien
ggtgcatgtcaagtcaggaagccaa

SEQ ID NO: 387202 - DNA, 25 bp, Homo sapien
gaaaccgttggcattaaaatctaga

SEQ ID NO: 387203 - DNA, 25 bp, Homo sapien
tagagatccttgctatgagttgtgg

SEQ ID NO: 387204 - DNA, 25 bp, Homo sapien
gataggagtggctccatctatcctt

SEQ ID NO: 387205 - DNA, 25 bp, Homo sapien
ggctccatctatccttgtggtgaaa

SEQ ID NO: 387206 - DNA, 25 bp, Homo sapien
ggtgaaagagtccaggagctccttt

SEQ ID NO: 387207 - DNA, 25 bp, Homo sapien
gagctcctttagagattgtcaagtc

SEQ ID NO: 387208 - DNA, 25 bp, Homo sapien
attgtcaagtcctgagcgatgagct

SEQ ID NO: 387209 - DNA, 25 bp, Homo sapien
gatgagctgcccttaatcctcagaa

SEQ ID NO: 387210 - DNA, 25 bp, Homo sapien
tgtccagtagccataccctactagg

SEQ ID NO: 387211 - DNA, 25 bp, Homo sapien
tagccataccctactaggccctaat

SEQ ID NO: 387212 - DNA, 25 bp, Homo sapien
tactaggccctaattagccccagag

SEQ ID NO: 387213 - DNA, 25 bp, Homo sapien
taggccctaattagccccagaggcg

SEQ ID NO: 387214 - DNA, 25 bp, Homo sapien
accacgcccgctaatgctaaaaatt

SEQ ID NO: 387215 - DNA, 25 bp, Homo sapien
agaccgagtcttgctataatgccca

SEQ ID NO: 387216 - DNA, 25 bp, Homo sapien
gaccgagtcttgctataatgcccag

SEQ ID NO: 387217 - DNA, 25 bp, Homo sapien
cctcccgcctctacaggatgagcca

SEQ ID NO: 387218 - DNA, 25 bp, Homo sapien
tggcctcaattcctctttaaaggaa

SEQ ID NO: 387219 - DNA, 25 bp, Homo sapien
ggaattgcctaaatcttaaaccagc

SEQ ID NO: 387220 - DNA, 25 bp, Homo sapien
gcctaaatcttaaaccagcaatcaa

SEQ ID NO: 387221 - DNA, 25 bp, Homo sapien
gtcccctctaccactgtgatgagat

SEQ ID NO: 387222 - DNA, 25 bp, Homo sapien
agggcatcagtacatctccatttta

SEQ ID NO: 387223 - DNA, 25 bp, Homo sapien
aaagactacctgtggttttgtggca

SEQ ID NO: 387224 - DNA, 25 bp, Homo sapien
acctgtggttttgtggcacacccaa

SEQ ID NO: 387225 - DNA, 25 bp, Homo sapien
ttttgtggcacacccaacatctctg

SEQ ID NO: 387226 - DNA, 25 bp, Homo sapien
ctgtctccaggtaggtggaccagag

SEQ ID NO: 387227 - DNA, 25 bp, Homo sapien
gtggaccagagaacttgagcgaagc

SEQ ID NO: 387228 - DNA, 25 bp, Homo sapien
tgagcgaagctcaagccttctcaac

SEQ ID NO: 387229 - DNA, 25 bp, Homo sapien
aagctcaagccttctcaactcaagg

SEQ ID NO: 387230 - DNA, 25 bp, Homo sapien
tgtagagcctgagcgtgggcactgt

SEQ ID NO: 387231 - DNA, 25 bp, Homo sapien
ttgtgcaaaatctcagtaaaaatgg

SEQ ID NO: 387232 - DNA, 25 bp, Homo sapien
gtgaaattcacacatgatcagatta

SEQ ID NO: 387233 - DNA, 25 bp, Homo sapien
acatgatcagattatgcgacggtat

SEQ ID NO: 387234 - DNA, 25 bp, Homo sapien
gcgacggtatgggacaaggccaaca

SEQ ID NO: 387235 - DNA, 25 bp, Homo sapien
aaggccaacaagctatgtgtcatga

SEQ ID NO: 387236 - DNA, 25 bp, Homo sapien
gtgtcatgaagctttgtcacatatc

SEQ ID NO: 387237 - DNA, 25 bp, Homo sapien
tgtacactttttgcaactggtttga

SEQ ID NO: 387238 - DNA, 25 bp, Homo sapien
gcaactggtttgatgtcacatttca

SEQ ID NO: 387239 - DNA, 25 bp, Homo sapien
tgatgtcacatttcagctccaactt

SEQ ID NO: 387240 - DNA, 25 bp, Homo sapien
tcacatttcagctccaactttgcat

SEQ ID NO: 387241 - DNA, 25 bp, Homo sapien
tccaactttgcatcctgagaacact

SEQ ID NO: 387242 - DNA, 25 bp, Homo sapien
gcatcctgagaacacttaaacgttt

SEQ ID NO: 387243 - DNA, 25 bp, Homo sapien
agagggtaggacatgtgttcttcaa

SEQ ID NO: 387244 - DNA, 25 bp, Homo sapien
gtgttcttcaatggatatcaaagga

SEQ ID NO: 387245 - DNA, 25 bp, Homo sapien
aagccatttggcaagccctgtagcc

SEQ ID NO: 387246 - DNA, 25 bp, Homo sapien
gccctgtagcctgggccatttaaga

SEQ ID NO: 387247 - DNA, 25 bp, Homo sapien
gtagcctgggccatttaagacaggg

SEQ ID NO: 387248 - DNA, 25 bp, Homo sapien
ttgcacccatttaactatcccaaag

SEQ ID NO: 387249 - DNA, 25 bp, Homo sapien
atttaactatcccaaagagccacag

SEQ ID NO: 387250 - DNA, 25 bp, Homo sapien
aacccaggccctaagttgatgaaga

SEQ ID NO: 387251 - DNA, 25 bp, Homo sapien
ggaggtgatacaattggaaatattc

SEQ ID NO: 387252 - DNA, 25 bp, Homo sapien
ggaaatattcccatcaaatggttaa

SEQ ID NO: 387253 - DNA, 25 bp, Homo sapien
gaaaaagtccttccaagatgatttt

SEQ ID NO: 387254 - DNA, 25 bp, Homo sapien
ttgcacccatttaactatcccaaag

SEQ ID NO: 387255 - DNA, 25 bp, Homo sapien
tgcacccatttaactatcccaaaga

SEQ ID NO: 387256 - DNA, 25 bp, Homo sapien
gcacccatttaactatcccaaagag

SEQ ID NO: 387257 - DNA, 25 bp, Homo sapien
atttaactatcccaaagagccacag

SEQ ID NO: 387258 - DNA, 25 bp, Homo sapien
ggccctaagttgatgaagaaaaagt

SEQ ID NO: 387259 - DNA, 25 bp, Homo sapien
ggaaatattcccatcaaatggttaa

SEQ ID NO: 387260 - DNA, 25 bp, Homo sapien
tcccatcaaatggttaatcttattt

SEQ ID NO: 387261 - DNA, 25 bp, Homo sapien
gttaatcttatttagaaaatgggca

SEQ ID NO: 387262 - DNA, 25 bp, Homo sapien
tattagaaaaagtccttccaagatg

SEQ ID NO: 387263 - DNA, 25 bp, Homo sapien
gaaaaagtccttccaagatgatttt

SEQ ID NO: 387264 - DNA, 25 bp, Homo sapien
agtccttccaagatgattttggata

SEQ ID NO: 387265 - DNA, 25 bp, Homo sapien
atggaatcacccaccaaattagatg

SEQ ID NO: 387266 - DNA, 25 bp, Homo sapien
attagatgtgacactggccaaggac

SEQ ID NO: 387267 - DNA, 25 bp, Homo sapien
ggccaaggacatgcagccatccatg

SEQ ID NO: 387268 - DNA, 25 bp, Homo sapien
atggaatcagatatggccctagtca

SEQ ID NO: 387269 - DNA, 25 bp, Homo sapien
gtcaaggacatggaactacccacag

SEQ ID NO: 387270 - DNA, 25 bp, Homo sapien
gaagtggccctggttaaggatgtca

SEQ ID NO: 387271 - DNA, 25 bp, Homo sapien
taaggatgtcagatggcccacagaa

SEQ ID NO: 387272 - DNA, 25 bp, Homo sapien
gaaacagatgtatcttcagccaaga

SEQ ID NO: 387273 - DNA, 25 bp, Homo sapien
ggtactgcccacagaaacagaggta

SEQ ID NO: 387274 - DNA, 25 bp, Homo sapien
ggtagccccagccaaggatgtgaca

SEQ ID NO: 387275 - DNA, 25 bp, Homo sapien
gagagggcatctcctataaaaatgg

SEQ ID NO: 387276 - DNA, 25 bp, Homo sapien
atgatggtgtgacttcctcctcaga

SEQ ID NO: 387277 - DNA, 25 bp, Homo sapien
ttcctcctcagatatctggctcttc

SEQ ID NO: 387278 - DNA, 25 bp, Homo sapien
agatatctggctcttctctccaata

SEQ ID NO: 387279 - DNA, 25 bp, Homo sapien
atctggctcttctctccaatatgtt

SEQ ID NO: 387280 - DNA, 25 bp, Homo sapien
ggctcttctctccaatatgttgcat

SEQ ID NO: 387281 - DNA, 25 bp, Homo sapien
ttctctccaatatgttgcatcctgg

SEQ ID NO: 387282 - DNA, 25 bp, Homo sapien
tgtttggcatcccagctgcctaatt

SEQ ID NO: 387283 - DNA, 25 bp, Homo sapien
tggcatcccagctgcctaatttcta

SEQ ID NO: 387284 - DNA, 25 bp, Homo sapien
agctgcctaatttctactctgcatc

SEQ ID NO: 387285 - DNA, 25 bp, Homo sapien
cctaatttctactctgcatcttggg

SEQ ID NO: 387286 - DNA, 25 bp, Homo sapien
accttacctaatcatccctattaca

SEQ ID NO: 387287 - DNA, 25 bp, Homo sapien
aaagttgtataccaggctgagggct

SEQ ID NO: 387288 - DNA, 25 bp, Homo sapien
tctgtgtcacttcacaggaagtagg

SEQ ID NO: 387289 - DNA, 25 bp, Homo sapien
ttcacaggaagtaggtaaacaccga

SEQ ID NO: 387290 - DNA, 25 bp, Homo sapien
caccgaaatttagtcagtgtcatta

SEQ ID NO: 387291 - DNA, 25 bp, Homo sapien
gtcattattagagttgtgctttcat

SEQ ID NO: 387292 - DNA, 25 bp, Homo sapien
aatctctcaagtgtgacaaggctaa

SEQ ID NO: 387293 - DNA, 25 bp, Homo sapien
tagaggccagttaggagatccttgt

SEQ ID NO: 387294 - DNA, 25 bp, Homo sapien
ggagatccttgtaataatccacagt

SEQ ID NO: 387295 - DNA, 25 bp, Homo sapien
aatgaggatctagagtagccaggct

SEQ ID NO: 387296 - DNA, 25 bp, Homo sapien
tagccaggctggaggtaacaaagag

SEQ ID NO: 387297 - DNA, 25 bp, Homo sapien
ggcaggagtactctactttaaagta

SEQ ID NO: 387298 - DNA, 25 bp, Homo sapien
agccccactgttgatgcaggtttgc

SEQ ID NO: 387299 - DNA, 25 bp, Homo sapien
gaaattcaaacaccacaacagcagt

SEQ ID NO: 387300 - DNA, 25 bp, Homo sapien
gcagtcaatggattcaagcattcta

SEQ ID NO: 387301 - DNA, 25 bp, Homo sapien
gcattctaagctttgttgacatttt

SEQ ID NO: 387302 - DNA, 25 bp, Homo sapien
tgacattttctctgttcctaggact

SEQ ID NO: 387303 - DNA, 25 bp, Homo sapien
ttcctaggacttcttcatgggtctt

SEQ ID NO: 387304 - DNA, 25 bp, Homo sapien
catgggtcttacagttctatgttag

SEQ ID NO: 387305 - DNA, 25 bp, Homo sapien
gaaacatttgcatacacatcgtctt

SEQ ID NO: 387306 - DNA, 25 bp, Homo sapien
cacatcgtctttaatgtcactttta

SEQ ID NO: 387307 - DNA, 25 bp, Homo sapien
cttttttacggttcagatattcatc

SEQ ID NO: 387308 - DNA, 25 bp, Homo sapien
gatattcatctatacgtctgtacag

SEQ ID NO: 387309 - DNA, 25 bp, Homo sapien
aacactccaggcagtactgtttata

SEQ ID NO: 387310 - DNA, 25 bp, Homo sapien
actgtttatagtgctgagccaggta

SEQ ID NO: 387311 - DNA, 25 bp, Homo sapien
ggctcacataattcgcatgctcagg

SEQ ID NO: 387312 - DNA, 25 bp, Homo sapien
aattcgcatgctcaggccagggcag

SEQ ID NO: 387313 - DNA, 25 bp, Homo sapien
aaaatagccttctgcttctttcaac

SEQ ID NO: 387314 - DNA, 25 bp, Homo sapien
tgcttctttcaacccagtatcagga

SEQ ID NO: 387315 - DNA, 25 bp, Homo sapien
agtatcaggaagcactaccccagtg

SEQ ID NO: 387316 - DNA, 25 bp, Homo sapien
taccccagtgttattatttgttttg

SEQ ID NO: 387317 - DNA, 25 bp, Homo sapien
aaacttcttcggaaggcatggcgaa

SEQ ID NO: 387318 - DNA, 25 bp, Homo sapien
aaggcatggcgaagggagtatttta

SEQ ID NO: 387319 - DNA, 25 bp, Homo sapien
gaattagcatgcatctctttgtgtg

SEQ ID NO: 387320 - DNA, 25 bp, Homo sapien
agcaagaagcacagaactactccct

SEQ ID NO: 387321 - DNA, 25 bp, Homo sapien
ccctcttcatctccatattttcata

SEQ ID NO: 387322 - DNA, 25 bp, Homo sapien
ttttcataatttcttgtgtttcaaa

SEQ ID NO: 387323 - DNA, 25 bp, Homo sapien
ttcaaatagggaaacatcttcctca

SEQ ID NO: 387324 - DNA, 25 bp, Homo sapien
atcttcctcaaagtctgcctagtga

SEQ ID NO: 387325 - DNA, 25 bp, Homo sapien
tctgcctagtgagatatggcctact

SEQ ID NO: 387326 - DNA, 25 bp, Homo sapien
gatatggcctactggttgcctcata

SEQ ID NO: 387327 - DNA, 25 bp, Homo sapien
ggttgcctcatagctttgtacagat

SEQ ID NO: 387328 - DNA, 25 bp, Homo sapien
tagctttgtacagattatgaggact

SEQ ID NO: 387329 - DNA, 25 bp, Homo sapien
gggcatttacccatcttggtatctg

SEQ ID NO: 387330 - DNA, 25 bp, Homo sapien
cttggtatctgttgtatcctttatc

SEQ ID NO: 387331 - DNA, 25 bp, Homo sapien
tatgattatggcctacaatgttgta

SEQ ID NO: 387332 - DNA, 25 bp, Homo sapien
tatgccaaatgttaactgccaagct

SEQ ID NO: 387333 - DNA, 25 bp, Homo sapien
aactgccaagcttggagtgacctaa

SEQ ID NO: 387334 - DNA, 25 bp, Homo sapien
gcttggagtgacctaaagcattttt

SEQ ID NO: 387335 - DNA, 25 bp, Homo sapien
gcatggctagatttacttcagtata

SEQ ID NO: 387336 - DNA, 25 bp, Homo sapien
aagccacaggtgttgattgttataa

SEQ ID NO: 387337 - DNA, 25 bp, Homo sapien
taacatgctgccattcttgattgct

SEQ ID NO: 387338 - DNA, 25 bp, Homo sapien
gctgccattcttgattgctagagtt

SEQ ID NO: 387339 - DNA, 25 bp, Homo sapien
gattgctagagtttttgttagtact

SEQ ID NO: 387340 - DNA, 25 bp, Homo sapien
gtttttgttagtactttggatgcaa

SEQ ID NO: 387341 - DNA, 25 bp, Homo sapien
aaaactatgtgctatcacatgtgaa

SEQ ID NO: 387342 - DNA, 25 bp, Homo sapien
ttagctcctcaagcatatctgactg

SEQ ID NO: 387343 - DNA, 25 bp, Homo sapien
agcatatctgactggcatgatcctg

SEQ ID NO: 387344 - DNA, 25 bp, Homo sapien
tctgactggcatgatcctgcattgt

SEQ ID NO: 387345 - DNA, 25 bp, Homo sapien
gatcctgcattgtggttacctggaa

SEQ ID NO: 387346 - DNA, 25 bp, Homo sapien
ttatccaggaagttggaacaatcac

SEQ ID NO: 387347 - DNA, 25 bp, Homo sapien
aagcgcaaaggttggcggcgattca

SEQ ID NO: 387348 - DNA, 25 bp, Homo sapien
gttggcggcgattcaaaggcagaac

SEQ ID NO: 387349 - DNA, 25 bp, Homo sapien
aaggcagaacgagcaaatgatgcag

SEQ ID NO: 387350 - DNA, 25 bp, Homo sapien
gggagagactccatcaggaacaagt

SEQ ID NO: 387351 - DNA, 25 bp, Homo sapien
gactccatcaggaacaagtgagaca

SEQ ID NO: 387352 - DNA, 25 bp, Homo sapien
acaagtgagacaaatggagatagcc

SEQ ID NO: 387353 - DNA, 25 bp, Homo sapien
aagagcccctttgcttcttgctggg

SEQ ID NO: 387354 - DNA, 25 bp, Homo sapien
cagggctgtggtgctggcccacttt

SEQ ID NO: 387355 - DNA, 25 bp, Homo sapien
ctcggccaggaatccaggtccttgg

SEQ ID NO: 387356 - DNA, 25 bp, Homo sapien
gtttcatttttagcacttctcacca

SEQ ID NO: 387357 - DNA, 25 bp, Homo sapien
tttagcacttctcaccagagagatg

SEQ ID NO: 387358 - DNA, 25 bp, Homo sapien
gcacaagagttgcttctgggataga

SEQ ID NO: 387359 - DNA, 25 bp, Homo sapien
aacaaagctgggatacggtgattgc

SEQ ID NO: 387360 - DNA, 25 bp, Homo sapien
tacggtgattgctagttgtgactga

SEQ ID NO: 387361 - DNA, 25 bp, Homo sapien
gtttatacggcttttttgctggtca

SEQ ID NO: 387362 - DNA, 25 bp, Homo sapien
ttgctggtcagcagtttgtcccact

SEQ ID NO: 387363 - DNA, 25 bp, Homo sapien
tgctttctctagtctctatcccata

SEQ ID NO: 387364 - DNA, 25 bp, Homo sapien
gaccccaacgctaagacacgtcgcg

SEQ ID NO: 387365 - DNA, 25 bp, Homo sapien
ggaggtgatcgagttcaccagcaat

SEQ ID NO: 387366 - DNA, 25 bp, Homo sapien
gttcaccagcaatgaggagatgctg

SEQ ID NO: 387367 - DNA, 25 bp, Homo sapien
aggagatgctgtgccgggaccccaa

SEQ ID NO: 387368 - DNA, 25 bp, Homo sapien
tgctgtgccgggaccccaaaggcaa

SEQ ID NO: 387369 - DNA, 25 bp, Homo sapien
ggaccccaaaggcaaatatggctac

SEQ ID NO: 387370 - DNA, 25 bp, Homo sapien
aatatggctacgtgcccagaacagc

SEQ ID NO: 387371 - DNA, 25 bp, Homo sapien
tggctacgtgcccagaacagcgctc

SEQ ID NO: 387372 - DNA, 25 bp, Homo sapien
acggaggtgtacgatgatgtcgact

SEQ ID NO: 387373 - DNA, 25 bp, Homo sapien
gtgtacgatgatgtcgacttctgcg

SEQ ID NO: 387374 - DNA, 25 bp, Homo sapien
tacgatgatgtcgacttctgcgatc

SEQ ID NO: 387375 - DNA, 25 bp, Homo sapien
tatatatggctcctttgtgccccat

SEQ ID NO: 387376 - DNA, 25 bp, Homo sapien
cattttcagattatggtagcatgct

SEQ ID NO: 387377 - DNA, 25 bp, Homo sapien
ggtagcatgctgatacagcaccatg

SEQ ID NO: 387378 - DNA, 25 bp, Homo sapien
tgttctgaggtcacatgggtttgga

SEQ ID NO: 387379 - DNA, 25 bp, Homo sapien
gtcacatgggtttggactgtctcaa

SEQ ID NO: 387380 - DNA, 25 bp, Homo sapien
ggactgtctcaatcagaaagattaa

SEQ ID NO: 387381 - DNA, 25 bp, Homo sapien
tatcaagaacatgaacattggcttc

SEQ ID NO: 387382 - DNA, 25 bp, Homo sapien
gtatctgagttgcataccaggcagt

SEQ ID NO: 387383 - DNA, 25 bp, Homo sapien
ggcagtattaaaatctaacaggtct

SEQ ID NO: 387384 - DNA, 25 bp, Homo sapien
taacaggtctgtttggcccattgat

SEQ ID NO: 387385 - DNA, 25 bp, Homo sapien
ctgtttggcccattgatagatactc

SEQ ID NO: 387386 - DNA, 25 bp, Homo sapien
ttcagtttctgtataacaacaggta

SEQ ID NO: 387387 - DNA, 25 bp, Homo sapien
caacaggtagaggttctaatcatat

SEQ ID NO: 387388 - DNA, 25 bp, Homo sapien
aattgtgttataatggtctgagcca

SEQ ID NO: 387389 - DNA, 25 bp, Homo sapien
aatggtctgagccatgttgctagga

SEQ ID NO: 387390 - DNA, 25 bp, Homo sapien
ctgagccatgttgctaggaaacaat

SEQ ID NO: 387391 - DNA, 25 bp, Homo sapien
cctgctctcctgtgctgaaaagtga

SEQ ID NO: 387392 - DNA, 25 bp, Homo sapien
ctctcctgtgctgaaaagtgactgg

SEQ ID NO: 387393 - DNA, 25 bp, Homo sapien
aagtgactggatactgtacaggttc

SEQ ID NO: 387394 - DNA, 25 bp, Homo sapien
ctggatactgtacaggttcatgttc

SEQ ID NO: 387395 - DNA, 25 bp, Homo sapien
ctggctgcagttaaatggtcttttg

SEQ ID NO: 387396 - DNA, 25 bp, Homo sapien
taaatggtcttttgcattttgctct

SEQ ID NO: 387397 - DNA, 25 bp, Homo sapien
ggaaatgtgatctggctgtgtttgt

SEQ ID NO: 387398 - DNA, 25 bp, Homo sapien
tggctgtgtttgtcttctgtacaaa

SEQ ID NO: 387399 - DNA, 25 bp, Homo sapien
tctgtacaaagcctgaagtgcttat

SEQ ID NO: 387400 - DNA, 25 bp, Homo sapien
tggttttttggctaacagccacaga

SEQ ID NO: 387401 - DNA, 25 bp, Homo sapien
gccacagagggcaaagtttaagact

SEQ ID NO: 387402 - DNA, 25 bp, Homo sapien
aagactttcttgtaaggactaactg

SEQ ID NO: 387403 - DNA, 25 bp, Homo sapien
ggactaactgttcttttcaagctac

SEQ ID NO: 387404 - DNA, 25 bp, Homo sapien
gttcttttcaagctactgtttgttt

SEQ ID NO: 387405 - DNA, 25 bp, Homo sapien
gcaggatttgcttccgtaggaggca

SEQ ID NO: 387406 - DNA, 25 bp, Homo sapien
ttccgtaggaggcaagttccttgat

SEQ ID NO: 387407 - DNA, 25 bp, Homo sapien
gatgtggaatagtgcaacctgtata

SEQ ID NO: 387408 - DNA, 25 bp, Homo sapien
cccttggctttcgaagcaaattgat

SEQ ID NO: 387409 - DNA, 25 bp, Homo sapien
tggctttcgaagcaaattgatgttc

SEQ ID NO: 387410 - DNA, 25 bp, Homo sapien
gaagcaaattgatgttcacgtctga

SEQ ID NO: 387411 - DNA, 25 bp, Homo sapien
gcaaattgatgttcacgtctgacgt

SEQ ID NO: 387412 - DNA, 25 bp, Homo sapien
attgatgttcacgtctgacgtgggc

SEQ ID NO: 387413 - DNA, 25 bp, Homo sapien
tgtggctctgattatgtacacgtga

SEQ ID NO: 387414 - DNA, 25 bp, Homo sapien
gtacacgtgagatggcctggctggg

SEQ ID NO: 387415 - DNA, 25 bp, Homo sapien
ggccgggctcacatggtttgtacaa

SEQ ID NO: 387416 - DNA, 25 bp, Homo sapien
gccgggctcacatggtttgtacaat

SEQ ID NO: 387417 - DNA, 25 bp, Homo sapien
cgggctcacatggtttgtacaataa

SEQ ID NO: 387418 - DNA, 25 bp, Homo sapien
ggctcacatggtttgtacaataaat

SEQ ID NO: 387419 - DNA, 25 bp, Homo sapien
gtgcccaggttttcttggagttatc

SEQ ID NO: 387420 - DNA, 25 bp, Homo sapien
gcccaggttttcttggagttatcca

SEQ ID NO: 387421 - DNA, 25 bp, Homo sapien
ctgcgcccctagctgggatctggta

SEQ ID NO: 387422 - DNA, 25 bp, Homo sapien
ctgggatctggtacctggactaggc

SEQ ID NO: 387423 - DNA, 25 bp, Homo sapien
gatctggtacctggactaggctaat

SEQ ID NO: 387424 - DNA, 25 bp, Homo sapien
gtacctggactaggctaattacagc

SEQ ID NO: 387425 - DNA, 25 bp, Homo sapien
taattacagcttctccccaacagga

SEQ ID NO: 387426 - DNA, 25 bp, Homo sapien
gcttctccccaacaggaaactgtgg

SEQ ID NO: 387427 - DNA, 25 bp, Homo sapien
aacagagaacctagtggtctaccaa

SEQ ID NO: 387428 - DNA, 25 bp, Homo sapien
tggtctaccaagtggttggcaactt

SEQ ID NO: 387429 - DNA, 25 bp, Homo sapien
gtctgcttactctgaggcttggcac

SEQ ID NO: 387430 - DNA, 25 bp, Homo sapien
ggaaaaccctaacagatctgtccta

SEQ ID NO: 387431 - DNA, 25 bp, Homo sapien
gatctgtcctagtgattttaccttt

SEQ ID NO: 387432 - DNA, 25 bp, Homo sapien
gtcctagtgattttacctttgttct

SEQ ID NO: 387433 - DNA, 25 bp, Homo sapien
acctttgttctagaaggcgctcctt

SEQ ID NO: 387434 - DNA, 25 bp, Homo sapien
agaaggcgctcctttcagggttgtg

SEQ ID NO: 387435 - DNA, 25 bp, Homo sapien
ctttcagggttgtggtattcttagg

SEQ ID NO: 387436 - DNA, 25 bp, Homo sapien
ggtattcttaggttagcggagcttt

SEQ ID NO: 387437 - DNA, 25 bp, Homo sapien
taggttagcggagctttttcctctt

SEQ ID NO: 387438 - DNA, 25 bp, Homo sapien
atctccccaatattgcccattatta

SEQ ID NO: 387439 - DNA, 25 bp, Homo sapien
tctttctttggttggaaccctggca

SEQ ID NO: 387440 - DNA, 25 bp, Homo sapien
ggttggaaccctggcagttctgctc

SEQ ID NO: 387441 - DNA, 25 bp, Homo sapien
agctattcctacctacagacccatt

SEQ ID NO: 387442 - DNA, 25 bp, Homo sapien
agacccattccaatatgctgtgata

SEQ ID NO: 387443 - DNA, 25 bp, Homo sapien
tatgctgtgatacacgacacggtgc

SEQ ID NO: 387444 - DNA, 25 bp, Homo sapien
acgacacggtgcaccgcagaggaga

SEQ ID NO: 387445 - DNA, 25 bp, Homo sapien
gaggagacagacatcttcagcacaa

SEQ ID NO: 387446 - DNA, 25 bp, Homo sapien
tcttcagcacaaacacagatgcctg

SEQ ID NO: 387447 - DNA, 25 bp, Homo sapien
cctgcaggagcttggcaagtcacta

SEQ ID NO: 387448 - DNA, 25 bp, Homo sapien
tgaggtgcacaccaaatgcagggat

SEQ ID NO: 387449 - DNA, 25 bp, Homo sapien
gccgtgggaagctctgtattctcaa

SEQ ID NO: 387450 - DNA, 25 bp, Homo sapien
tgacagctaattccggtttttagaa

SEQ ID NO: 387451 - DNA, 25 bp, Homo sapien
gtagaggccctctagtcactcactg

SEQ ID NO: 387452 - DNA, 25 bp, Homo sapien
gaatatttattagccatatgcagaa

SEQ ID NO: 387453 - DNA, 25 bp, Homo sapien
agccatatgcagaatttctaatgat

SEQ ID NO: 387454 - DNA, 25 bp, Homo sapien
aatgatgatattgtacagcttctaa

SEQ ID NO: 387455 - DNA, 25 bp, Homo sapien
attgtacagcttctaattcactttt

SEQ ID NO: 387456 - DNA, 25 bp, Homo sapien
attcacttttcagatcagtgtttga

SEQ ID NO: 387457 - DNA, 25 bp, Homo sapien
gaaatggcaattatcagtgttggat

SEQ ID NO: 387458 - DNA, 25 bp, Homo sapien
gtgttggatttagttccaactactt

SEQ ID NO: 387459 - DNA, 25 bp, Homo sapien
ctcagttgtgggaataattatcaga

SEQ ID NO: 387460 - DNA, 25 bp, Homo sapien
gaataattatcagagacatgcaact

SEQ ID NO: 387461 - DNA, 25 bp, Homo sapien
tgcaactgaaaatgtctcacctttc

SEQ ID NO: 387462 - DNA, 25 bp, Homo sapien
tatcttgtagaatttgatgagaccc

SEQ ID NO: 387463 - DNA, 25 bp, Homo sapien
agctggcaaggttcatagaatataa

SEQ ID NO: 387464 - DNA, 25 bp, Homo sapien
agaatataatggctatccccctctg

SEQ ID NO: 387465 - DNA, 25 bp, Homo sapien
atccccctctgccaaataagactat

SEQ ID NO: 387466 - DNA, 25 bp, Homo sapien
aaataagactatccacaacccagct

SEQ ID NO: 387467 - DNA, 25 bp, Homo sapien
ataagactatccacaacccagctca

SEQ ID NO: 387468 - DNA, 25 bp, Homo sapien
aacccagctcagacacagtggttat

SEQ ID NO: 387469 - DNA, 25 bp, Homo sapien
acagtggttatatgattttgtgtcc

SEQ ID NO: 387470 - DNA, 25 bp, Homo sapien
ttttgtgtccatacaggagaggcct

SEQ ID NO: 387471 - DNA, 25 bp, Homo sapien
tgtgtccatacaggagaggccttgg

SEQ ID NO: 387472 - DNA, 25 bp, Homo sapien
cacatacattctctgagccaacatc

SEQ ID NO: 387473 - DNA, 25 bp, Homo sapien
tctgagccaacatctatccagcagc

SEQ ID NO: 387474 - DNA, 25 bp, Homo sapien
acacctctgaactcagggcctagcc

SEQ ID NO: 387475 - DNA, 25 bp, Homo sapien
caaacttccaaatcccacttttgtg

SEQ ID NO: 387476 - DNA, 25 bp, Homo sapien
atcccacttttgtgatatgtgaagc

SEQ ID NO: 387477 - DNA, 25 bp, Homo sapien
atgtgaagctactcatttcttaccc

SEQ ID NO: 387478 - DNA, 25 bp, Homo sapien
aagctactcatttcttacccttgga

SEQ ID NO: 387479 - DNA, 25 bp, Homo sapien
tactcatttcttacccttggaggct

SEQ ID NO: 387480 - DNA, 25 bp, Homo sapien
atttcttacccttggaggctgtgtg

SEQ ID NO: 387481 - DNA, 25 bp, Homo sapien
gaatttccagcccttttatgcctgt

SEQ ID NO: 387482 - DNA, 25 bp, Homo sapien
gcccttttatgcctgtgtgatccca

SEQ ID NO: 387483 - DNA, 25 bp, Homo sapien
tttatgcctgtgtgatcccacccca

SEQ ID NO: 387484 - DNA, 25 bp, Homo sapien
ccccatagttgtataaaggtcatag

SEQ ID NO: 387485 - DNA, 25 bp, Homo sapien
tgcaaggtgggttcttccattcctg

SEQ ID NO: 387486 - DNA, 25 bp, Homo sapien
tgcacctcagtgagatgctcaaacg

SEQ ID NO: 387487 - DNA, 25 bp, Homo sapien
gagatgctcaaacgtagtcttccgc

SEQ ID NO: 387488 - DNA, 25 bp, Homo sapien
tcttccgccccgaaagggagactgg

SEQ ID NO: 387489 - DNA, 25 bp, Homo sapien
agactggcgacatccgaggagttgt

SEQ ID NO: 387490 - DNA, 25 bp, Homo sapien
gttgtagaaggttcacttgatctcc

SEQ ID NO: 387491 - DNA, 25 bp, Homo sapien
acttgatctccttcgacgcttctat

SEQ ID NO: 387492 - DNA, 25 bp, Homo sapien
gacgcttctattccagaatctctta

SEQ ID NO: 387493 - DNA, 25 bp, Homo sapien
gaatctcttaaccttagcggtggaa

SEQ ID NO: 387494 - DNA, 25 bp, Homo sapien
cttcaacatctgtacttcatcggat

SEQ ID NO: 387495 - DNA, 25 bp, Homo sapien
ggattattacaagcctcctcttcat

SEQ ID NO: 387496 - DNA, 25 bp, Homo sapien
agtcttaaaataatgcgtccatctg

SEQ ID NO: 387497 - DNA, 25 bp, Homo sapien
aaaataatgcgtccatctgaagaat

SEQ ID NO: 387498 - DNA, 25 bp, Homo sapien
ataatgcgtccatctgaagaatttt

SEQ ID NO: 387499 - DNA, 25 bp, Homo sapien
aaatatcactgatacagcctgcccc

SEQ ID NO: 387500 - DNA, 25 bp, Homo sapien
gagatgtcttggactagagacactt

SEQ ID NO: 387501 - DNA, 25 bp, Homo sapien
tcttggactagagacacttgtttaa

SEQ ID NO: 387502 - DNA, 25 bp, Homo sapien
ttggactagagacacttgtttaata

SEQ ID NO: 387503 - DNA, 25 bp, Homo sapien
gtttaataatagcttgtctctgata

SEQ ID NO: 387504 - DNA, 25 bp, Homo sapien
gatggtgcccttgattagaagtgtc

SEQ ID NO: 387505 - DNA, 25 bp, Homo sapien
ggtgcccttgattagaagtgtctgg

SEQ ID NO: 387506 - DNA, 25 bp, Homo sapien
tgcccttgattagaagtgtctggag

SEQ ID NO: 387507 - DNA, 25 bp, Homo sapien
gaagtgatctttttaatccttgtga

SEQ ID NO: 387508 - DNA, 25 bp, Homo sapien
aatccttgtgatagtaaatgcattg

SEQ ID NO: 387509 - DNA, 25 bp, Homo sapien
ccttgtgatagtaaatgcattgata

SEQ ID NO: 387510 - DNA, 25 bp, Homo sapien
aatgcattgataattaacaggaaaa

SEQ ID NO: 387511 - DNA, 25 bp, Homo sapien
ataatctacaaatgagaacccaaat

SEQ ID NO: 387512 - DNA, 25 bp, Homo sapien
gtagtgttttgtttgacagaagtaa

SEQ ID NO: 387513 - DNA, 25 bp, Homo sapien
tataatgcaaaatttcaggacagtt

SEQ ID NO: 387514 - DNA, 25 bp, Homo sapien
aatgcaaaatttcaggacagttaat

SEQ ID NO: 387515 - DNA, 25 bp, Homo sapien
caaaatttcaggacagttaatttgg

SEQ ID NO: 387516 - DNA, 25 bp, Homo sapien
ataaggagaagaggtgtggttcaaa

SEQ ID NO: 387517 - DNA, 25 bp, Homo sapien
gaagaggtgtggttcaaagaaaatt

SEQ ID NO: 387518 - DNA, 25 bp, Homo sapien
cagtcagtgcaaatgtcagatacaa

SEQ ID NO: 387519 - DNA, 25 bp, Homo sapien
ttacttatcatccacattgttttaa

SEQ ID NO: 387520 - DNA, 25 bp, Homo sapien
caagatgctggatgtctgccaattt

SEQ ID NO: 387521 - DNA, 25 bp, Homo sapien
gatgtctgccaatttttgccttcat

SEQ ID NO: 387522 - DNA, 25 bp, Homo sapien
gccaatttttgccttcattaccttt

SEQ ID NO: 387523 - DNA, 25 bp, Homo sapien
ttgataaagtttctcagatccttgt

SEQ ID NO: 387524 - DNA, 25 bp, Homo sapien
ttctcagatccttgtttcaaacaca

SEQ ID NO: 387525 - DNA, 25 bp, Homo sapien
aaatgcagggattgctgccactttt

SEQ ID NO: 387526 - DNA, 25 bp, Homo sapien
aatattgaacttttttccactgaag

SEQ ID NO: 387527 - DNA, 25 bp, Homo sapien
tccactgaagtagtgtgcagttcta

SEQ ID NO: 387528 - DNA, 25 bp, Homo sapien
gcagttctagtttgcattcctgata

SEQ ID NO: 387529 - DNA, 25 bp, Homo sapien
ataacagcctgagcacttatgtctc

SEQ ID NO: 387530 - DNA, 25 bp, Homo sapien
tgagcacttatgtctctcgtttcat

SEQ ID NO: 387531 - DNA, 25 bp, Homo sapien
atgtctctcgtttcatcctgcagga

SEQ ID NO: 387532 - DNA, 25 bp, Homo sapien
atcctgcaggaggatgtagcgcctc

SEQ ID NO: 387533 - DNA, 25 bp, Homo sapien
gctaatatgtgttatcagatctgcg

SEQ ID NO: 387534 - DNA, 25 bp, Homo sapien
ggatgtagcgcctcagtttatttta

SEQ ID NO: 387535 - DNA, 25 bp, Homo sapien
gattggaactgcgatccttggtacc

SEQ ID NO: 387536 - DNA, 25 bp, Homo sapien
cgatccttggtaccacagtcacaga

SEQ ID NO: 387537 - DNA, 25 bp, Homo sapien
tcagatctgcgggaaaactatttct

SEQ ID NO: 387538 - DNA, 25 bp, Homo sapien
catgggaatcatactattctggtaa

SEQ ID NO: 387539 - DNA, 25 bp, Homo sapien
gttattagcataacagcctgagcac

SEQ ID NO: 387540 - DNA, 25 bp, Homo sapien
cttgggattgatgtgttgtggccat

SEQ ID NO: 387541 - DNA, 25 bp, Homo sapien
tccctgaggattgacttctgcacta

SEQ ID NO: 387542 - DNA, 25 bp, Homo sapien
gattgacttctgcactaatccagtg

SEQ ID NO: 387543 - DNA, 25 bp, Homo sapien
gaggctgtgtcaaaagaagggctca

SEQ ID NO: 387544 - DNA, 25 bp, Homo sapien
gaagggctcagaagccctcttttca

SEQ ID NO: 387545 - DNA, 25 bp, Homo sapien
gtcagtatgaggtcccttagttact

SEQ ID NO: 387546 - DNA, 25 bp, Homo sapien
aaagggacatgatttaactccagtt

SEQ ID NO: 387547 - DNA, 25 bp, Homo sapien
taactccagtttgatgaacctcctc

SEQ ID NO: 387548 - DNA, 25 bp, Homo sapien
tgaacctcctccgagtttactttat

SEQ ID NO: 387549 - DNA, 25 bp, Homo sapien
tcctccgagtttactttattgtctt

SEQ ID NO: 387550 - DNA, 25 bp, Homo sapien
gagatttgtgggttttgtgccttat

SEQ ID NO: 387551 - DNA, 25 bp, Homo sapien
ttacctactaaacagtggtagccat

SEQ ID NO: 387552 - DNA, 25 bp, Homo sapien
gacatggaaagtcaactgattctac

SEQ ID NO: 387553 - DNA, 25 bp, Homo sapien
gattctacaattggacattcatttg

SEQ ID NO: 387554 - DNA, 25 bp, Homo sapien
catttgtgtgccctggaatttccaa

SEQ ID NO: 387555 - DNA, 25 bp, Homo sapien
gtgtgccctggaatttccaactagt

SEQ ID NO: 387556 - DNA, 25 bp, Homo sapien
tactgttgatgtagttttaaaccac

SEQ ID NO: 387557 - DNA, 25 bp, Homo sapien
tttaaaccacttgaagggactcatg

SEQ ID NO: 387558 - DNA, 25 bp, Homo sapien
gggactcatgaagcatcctgcaaca

SEQ ID NO: 387559 - DNA, 25 bp, Homo sapien
taaccttctaacaactatctttcaa

SEQ ID NO: 387560 - DNA, 25 bp, Homo sapien
aaaatgtttatgatcccagcaatac

SEQ ID NO: 387561 - DNA, 25 bp, Homo sapien
atgatcccagcaatacactttttaa

SEQ ID NO: 387562 - DNA, 25 bp, Homo sapien
ttttccttggccgactctagggagc

SEQ ID NO: 387563 - DNA, 25 bp, Homo sapien
tccttggccgactctagggagcgat

SEQ ID NO: 387564 - DNA, 25 bp, Homo sapien
ttggccgactctagggagcgattgc

SEQ ID NO: 387565 - DNA, 25 bp, Homo sapien
gccgactctagggagcgattgcctc

SEQ ID NO: 387566 - DNA, 25 bp, Homo sapien
ctctgtgaccgggtggcccagccag

SEQ ID NO: 387567 - DNA, 25 bp, Homo sapien
cagaaccgtgctctgggccaaagcc

SEQ ID NO: 387568 - DNA, 25 bp, Homo sapien
gggccaaagcccgaagaaccaggca

SEQ ID NO: 387569 - DNA, 25 bp, Homo sapien
caaagcccgaagaaccaggcagcgg

SEQ ID NO: 387570 - DNA, 25 bp, Homo sapien
tccgcacacagcagctcgcacaggc

SEQ ID NO: 387571 - DNA, 25 bp, Homo sapien
gattgatgcagggagaagcccgtcc

SEQ ID NO: 387572 - DNA, 25 bp, Homo sapien
ttgatgcagggagaagcccgtcccc

SEQ ID NO: 387573 - DNA, 25 bp, Homo sapien
gacaagtgatcagagcacatggact

SEQ ID NO: 387574 - DNA, 25 bp, Homo sapien
gagcacatggactatggtcatttta

SEQ ID NO: 387575 - DNA, 25 bp, Homo sapien
tatggtcattttagtggcactttgc

SEQ ID NO: 387576 - DNA, 25 bp, Homo sapien
ttagtggcactttgctaaagtaaca

SEQ ID NO: 387577 - DNA, 25 bp, Homo sapien
aaagtaacatgcttccaatgaggag

SEQ ID NO: 387578 - DNA, 25 bp, Homo sapien
gcttccaatgaggagcagcattcta

SEQ ID NO: 387579 - DNA, 25 bp, Homo sapien
atgaggagcagcattctacttttgg

SEQ ID NO: 387580 - DNA, 25 bp, Homo sapien
aaacaatgtcacttaaacactgagc

SEQ ID NO: 387581 - DNA, 25 bp, Homo sapien
aaacactgagcacttgtgtgccagt

SEQ ID NO: 387582 - DNA, 25 bp, Homo sapien
aaacatctaggaatacatacttaaa

SEQ ID NO: 387583 - DNA, 25 bp, Homo sapien
aataacagctttggctgagcatggt

SEQ ID NO: 387584 - DNA, 25 bp, Homo sapien
tctaatcttaatggttctccactta

SEQ ID NO: 387585 - DNA, 25 bp, Homo sapien
taatcttaatggttctccacttaaa

SEQ ID NO: 387586 - DNA, 25 bp, Homo sapien
taatggttctccacttaaaaaatat

SEQ ID NO: 387587 - DNA, 25 bp, Homo sapien
aaaatattttctggctggacatgtg

SEQ ID NO: 387588 - DNA, 25 bp, Homo sapien
atattttctggctggacatgtggct

SEQ ID NO: 387589 - DNA, 25 bp, Homo sapien
atacaagaaattagctaagcacggt

SEQ ID NO: 387590 - DNA, 25 bp, Homo sapien
tacaagaaattagctaagcacggtg

SEQ ID NO: 387591 - DNA, 25 bp, Homo sapien
acaagaaattagctaagcacggtga

SEQ ID NO: 387592 - DNA, 25 bp, Homo sapien
gaaattagctaagcacggtgacatg

SEQ ID NO: 387593 - DNA, 25 bp, Homo sapien
aattagctaagcacggtgacatgtg

SEQ ID NO: 387594 - DNA, 25 bp, Homo sapien
agctaagcacggtgacatgtgcctg

SEQ ID NO: 387595 - DNA, 25 bp, Homo sapien
ggcttatgcacgactctaccccgtg

SEQ ID NO: 387596 - DNA, 25 bp, Homo sapien
tctaccccgtgctgctggtgaagca

SEQ ID NO: 387597 - DNA, 25 bp, Homo sapien
ggtgaagcaggatggctccaccatc

SEQ ID NO: 387598 - DNA, 25 bp, Homo sapien
ctacagggagccacggcgcatgctg

SEQ ID NO: 387599 - DNA, 25 bp, Homo sapien
gcgcatgctggcgatgcccatagat

SEQ ID NO: 387600 - DNA, 25 bp, Homo sapien
gatgcccatagatctggacaccctg

SEQ ID NO: 387601 - DNA, 25 bp, Homo sapien
tggacaccctgtctcctgaggagcg

SEQ ID NO: 387602 - DNA, 25 bp, Homo sapien
gtgaggctcagctccagtcgaggaa

SEQ ID NO: 387603 - DNA, 25 bp, Homo sapien
atgacttgcatgtggagcgctaccg

SEQ ID NO: 387604 - DNA, 25 bp, Homo sapien
gagcgctaccgacagttctggacca

SEQ ID NO: 387605 - DNA, 25 bp, Homo sapien
agttctggaccaggaccaagaagtg

SEQ ID NO: 387606 - DNA, 25 bp, Homo sapien
actgagaagacatttcacctggcaa

SEQ ID NO: 387607 - DNA, 25 bp, Homo sapien
agcgctgactgatagatacctctgt

SEQ ID NO: 387608 - DNA, 25 bp, Homo sapien
gataccagtataattcgaagtcaca

SEQ ID NO: 387609 - DNA, 25 bp, Homo sapien
tcacattggttcaacatgactctcc

SEQ ID NO: 387610 - DNA, 25 bp, Homo sapien
atgactctccccagaaagctgatgt

SEQ ID NO: 387611 - DNA, 25 bp, Homo sapien
gaaagctgatgtgctgaagcaacca

SEQ ID NO: 387612 - DNA, 25 bp, Homo sapien
gaagcaaccagaggcaaatgttcac

SEQ ID NO: 387613 - DNA, 25 bp, Homo sapien
gcaaatgttcacacacctagagaga

SEQ ID NO: 387614 - DNA, 25 bp, Homo sapien
ttcaaatgcaaggagtagctggctt

SEQ ID NO: 387615 - DNA, 25 bp, Homo sapien
tagctggcttagtggcttcaaaacc

SEQ ID NO: 387616 - DNA, 25 bp, Homo sapien
aaaaccacctcattcctgctgttat

SEQ ID NO: 387617 - DNA, 25 bp, Homo sapien
agagaatatcactccgatggtcggt

SEQ ID NO: 387618 - DNA, 25 bp, Homo sapien
gatggtcggtttctgactgtcacgc

SEQ ID NO: 387619 - DNA, 25 bp, Homo sapien
gactgtcacgctaagggcaactgta

SEQ ID NO: 387620 - DNA, 25 bp, Homo sapien
gctaagggcaactgtaaactggaat

SEQ ID NO: 387621 - DNA, 25 bp, Homo sapien
actggaataataatgcactcgcaac

SEQ ID NO: 387622 - DNA, 25 bp, Homo sapien
aatgcactcgcaaccaggtaaactt

SEQ ID NO: 387623 - DNA, 25 bp, Homo sapien
gcaaccaggtaaacttagatacact

SEQ ID NO: 387624 - DNA, 25 bp, Homo sapien
atagatttactgtacatgacttgta

SEQ ID NO: 387625 - DNA, 25 bp, Homo sapien
gaactgcagcaatatccatgggtcc

SEQ ID NO: 387626 - DNA, 25 bp, Homo sapien
gcagcaatatccatgggtcctaata

SEQ ID NO: 387627 - DNA, 25 bp, Homo sapien
gtcctaataattgtagttccccact

SEQ ID NO: 387628 - DNA, 25 bp, Homo sapien
tattcaaaagagactgcaactaaca

SEQ ID NO: 387629 - DNA, 25 bp, Homo sapien
aacaagactcttatttcatcaaaat

SEQ ID NO: 387630 - DNA, 25 bp, Homo sapien
atttctgagttgtatttttaatgcc

SEQ ID NO: 387631 - DNA, 25 bp, Homo sapien
gttgtatttttaatgcctctttctt

SEQ ID NO: 387632 - DNA, 25 bp, Homo sapien
tttcttttctgcctaaatgcttaga

SEQ ID NO: 387633 - DNA, 25 bp, Homo sapien
ttctgcctaaatgcttagaaattat

SEQ ID NO: 387634 - DNA, 25 bp, Homo sapien
acttttcagaacatcaaattcctaa

SEQ ID NO: 387635 - DNA, 25 bp, Homo sapien
gaacatcaaattcctaatgaagaag

SEQ ID NO: 387636 - DNA, 25 bp, Homo sapien
gtatgtttgttaatgcaactggaat

SEQ ID NO: 387637 - DNA, 25 bp, Homo sapien
gttaatgcaactggaatatttgact

SEQ ID NO: 387638 - DNA, 25 bp, Homo sapien
tatttgacttaggtgagtatcagtt

SEQ ID NO: 387639 - DNA, 25 bp, Homo sapien
gttaatctgtgtctaattatctgat

SEQ ID NO: 387640 - DNA, 25 bp, Homo sapien
tccttgaaggctaccccttgggaag

SEQ ID NO: 387641 - DNA, 25 bp, Homo sapien
ttacaggctcacacccagtctgatc

SEQ ID NO: 387642 - DNA, 25 bp, Homo sapien
acacccagtctgatcaggctgagtt

SEQ ID NO: 387643 - DNA, 25 bp, Homo sapien
atcaggctgagttttgtatgtatct

SEQ ID NO: 387644 - DNA, 25 bp, Homo sapien
gtatgtatctatctgttaatgcttg

SEQ ID NO: 387645 - DNA, 25 bp, Homo sapien
ctatctgttaatgcttgttactttt

SEQ ID NO: 387646 - DNA, 25 bp, Homo sapien
gttacttttaactaatcagatcttt

SEQ ID NO: 387647 - DNA, 25 bp, Homo sapien
ctttttacagtatccatttattatg

SEQ ID NO: 387648 - DNA, 25 bp, Homo sapien
attatgtaatgcttcttagaaaaga

SEQ ID NO: 387649 - DNA, 25 bp, Homo sapien
gaaaagaatcttatagtacatgtta

SEQ ID NO: 387650 - DNA, 25 bp, Homo sapien
gcaggtgcacaatgcttctttgagt

SEQ ID NO: 387651 - DNA, 25 bp, Homo sapien
ggtgcacaatgcttctttgagtatc

SEQ ID NO: 387652 - DNA, 25 bp, Homo sapien
acaatgcttctttgagtatctccgt

SEQ ID NO: 387653 - DNA, 25 bp, Homo sapien
atgcttctttgagtatctccgtgtc

SEQ ID NO: 387654 - DNA, 25 bp, Homo sapien
ttctttgagtatctccgtgtctgtg

SEQ ID NO: 387655 - DNA, 25 bp, Homo sapien
gagtatctccgtgtctgtggctgat

SEQ ID NO: 387656 - DNA, 25 bp, Homo sapien
tgcatagacatactggtcaaattac

SEQ ID NO: 387657 - DNA, 25 bp, Homo sapien
tggtcaaattacagcacagcctcta

SEQ ID NO: 387658 - DNA, 25 bp, Homo sapien
acagcctctacacctttactgaaga

SEQ ID NO: 387659 - DNA, 25 bp, Homo sapien
gcctctacacctttactgaagatgg

SEQ ID NO: 387660 - DNA, 25 bp, Homo sapien
acacctttactgaagatggaaaact

SEQ ID NO: 387661 - DNA, 25 bp, Homo sapien
ggccaccataaatcagcgcaggaat

SEQ ID NO: 387662 - DNA, 25 bp, Homo sapien
gccaccataaatcagcgcaggaatg

SEQ ID NO: 387663 - DNA, 25 bp, Homo sapien
cgcaggaatgcaggctggccagtct

SEQ ID NO: 387664 - DNA, 25 bp, Homo sapien
ggaatgcaggctggccagtctggcg

SEQ ID NO: 387665 - DNA, 25 bp, Homo sapien
gggcggagacaaagaccaggcagct

SEQ ID NO: 387666 - DNA, 25 bp, Homo sapien
aaagaccaggcagctggacctcggg

SEQ ID NO: 387667 - DNA, 25 bp, Homo sapien
agaccaggcagctggacctcgggca

SEQ ID NO: 387668 - DNA, 25 bp, Homo sapien
gcagcctcgaccacccagggcagag

SEQ ID NO: 387669 - DNA, 25 bp, Homo sapien
agggcagaggtcaggactcctggct

SEQ ID NO: 387670 - DNA, 25 bp, Homo sapien
ttcccggaaggcctcactgggcctc

SEQ ID NO: 387671 - DNA, 25 bp, Homo sapien
agcacctgggatgtccccgcagcag

SEQ ID NO: 387672 - DNA, 25 bp, Homo sapien
ctttacctaggagcttgtctaacaa

SEQ ID NO: 387673 - DNA, 25 bp, Homo sapien
tttacctaggagcttgtctaacaac

SEQ ID NO: 387674 - DNA, 25 bp, Homo sapien
ttacctaggagcttgtctaacaaca

SEQ ID NO: 387675 - DNA, 25 bp, Homo sapien
tacctaggagcttgtctaacaacaa

SEQ ID NO: 387676 - DNA, 25 bp, Homo sapien
cctaggagcttgtctaacaacaaat

SEQ ID NO: 387677 - DNA, 25 bp, Homo sapien
aggagcttgtctaacaacaaatttt

SEQ ID NO: 387678 - DNA, 25 bp, Homo sapien
cttcccttgacacccctagtagttg

SEQ ID NO: 387679 - DNA, 25 bp, Homo sapien
cttgacacccctagtagttgtccta

SEQ ID NO: 387680 - DNA, 25 bp, Homo sapien
ttgacacccctagtagttgtcctaa

SEQ ID NO: 387681 - DNA, 25 bp, Homo sapien
tgacacccctagtagttgtcctaag

SEQ ID NO: 387682 - DNA, 25 bp, Homo sapien
gacacccctagtagttgtcctaagt

SEQ ID NO: 387683 - DNA, 25 bp, Homo sapien
atagcttgtgttagtttcagggagg

SEQ ID NO: 387684 - DNA, 25 bp, Homo sapien
aaatacttgactttgtaattctgta

SEQ ID NO: 387685 - DNA, 25 bp, Homo sapien
tatacaatttatagcagagccgttt

SEQ ID NO: 387686 - DNA, 25 bp, Homo sapien
agcagagccgttttaagacagcctt

SEQ ID NO: 387687 - DNA, 25 bp, Homo sapien
gagccgttttaagacagccttgtca

SEQ ID NO: 387688 - DNA, 25 bp, Homo sapien
ttaagacagccttgtcacatttttt

SEQ ID NO: 387689 - DNA, 25 bp, Homo sapien
gtatgcattgagtacatgaccaact

SEQ ID NO: 387690 - DNA, 25 bp, Homo sapien
cattgagtacatgaccaactagaat

SEQ ID NO: 387691 - DNA, 25 bp, Homo sapien
gaacatactgtatgctgtacaagat

SEQ ID NO: 387692 - DNA, 25 bp, Homo sapien
gtaacttgctgttttagcatctgta

SEQ ID NO: 387693 - DNA, 25 bp, Homo sapien
acttgctgttttagcatctgtattt

SEQ ID NO: 387694 - DNA, 25 bp, Homo sapien
agtaccttaggaaccttgtaggctg

SEQ ID NO: 387695 - DNA, 25 bp, Homo sapien
gtaccttaggaaccttgtaggctgc

SEQ ID NO: 387696 - DNA, 25 bp, Homo sapien
accttaggaaccttgtaggctgcag

SEQ ID NO: 387697 - DNA, 25 bp, Homo sapien
accttccaacagacaggctctgctg

SEQ ID NO: 387698 - DNA, 25 bp, Homo sapien
ccaacagacaggctctgctgtatct

SEQ ID NO: 387699 - DNA, 25 bp, Homo sapien
gctctgctgtatctgttgtacatac

SEQ ID NO: 387700 - DNA, 25 bp, Homo sapien
ctctgctgtatctgttgtacatact

SEQ ID NO: 387701 - DNA, 25 bp, Homo sapien
ctgctgtatctgttgtacatactgg

SEQ ID NO: 387702 - DNA, 25 bp, Homo sapien
acatactgggattctgtaaaggaca

SEQ ID NO: 387703 - DNA, 25 bp, Homo sapien
gtatgtatttttgtgtgttctgctt

SEQ ID NO: 387704 - DNA, 25 bp, Homo sapien
gtatttttgtgtgttctgctttttt

SEQ ID NO: 387705 - DNA, 25 bp, Homo sapien
aaggcttttgttacactttgtcatg

SEQ ID NO: 387706 - DNA, 25 bp, Homo sapien
attaaaagcagacctttgggctgtt

SEQ ID NO: 387707 - DNA, 25 bp, Homo sapien
gctgtttaaccgtgtaacaaaaatg

SEQ ID NO: 387708 - DNA, 25 bp, Homo sapien
tgtaacaaaaatgccacgtgaaaaa

SEQ ID NO: 387709 - DNA, 25 bp, Homo sapien
agtagataatctaagtccttatttt

SEQ ID NO: 387710 - DNA, 25 bp, Homo sapien
ttattttctgatggctcttgttcca

SEQ ID NO: 387711 - DNA, 25 bp, Homo sapien
ttttaaaatcctatcagcagcctcc

SEQ ID NO: 387712 - DNA, 25 bp, Homo sapien
taattagcagtgttaggaatttgcc

SEQ ID NO: 387713 - DNA, 25 bp, Homo sapien
gaatttgccttatgttttccatctc

SEQ ID NO: 387714 - DNA, 25 bp, Homo sapien
tgccttatgttttccatctcatctc

SEQ ID NO: 387715 - DNA, 25 bp, Homo sapien
gaacctgttattctgagaactcata

SEQ ID NO: 387716 - DNA, 25 bp, Homo sapien
cagattaattagtcaccatgaggtc

SEQ ID NO: 387717 - DNA, 25 bp, Homo sapien
taattagtcaccatgaggtcactgg

SEQ ID NO: 387718 - DNA, 25 bp, Homo sapien
gagatggccacatgaacacagacac

SEQ ID NO: 387719 - DNA, 25 bp, Homo sapien
gatggccacatgaacacagacacgc

SEQ ID NO: 387720 - DNA, 25 bp, Homo sapien
gagaaggcagccgtgtgaaggagtc

SEQ ID NO: 387721 - DNA, 25 bp, Homo sapien
ggactgccagaaaaccaccagctgc

SEQ ID NO: 387722 - DNA, 25 bp, Homo sapien
gaaaaccaccagctgcccggagagg

SEQ ID NO: 387723 - DNA, 25 bp, Homo sapien
accagctgcccggagaggcaggaca

SEQ ID NO: 387724 - DNA, 25 bp, Homo sapien
gagaggcaggacaggatccttccct

SEQ ID NO: 387725 - DNA, 25 bp, Homo sapien
ggcaggacaggatccttccctaaag

SEQ ID NO: 387726 - DNA, 25 bp, Homo sapien
ggacaggatccttccctaaagcctt

SEQ ID NO: 387727 - DNA, 25 bp, Homo sapien
ggttctccctgtgtaaactgaggta

SEQ ID NO: 387728 - DNA, 25 bp, Homo sapien
taaactgaggtagtccggctattcc

SEQ ID NO: 387729 - DNA, 25 bp, Homo sapien
gaggtagtccggctattccccagcg

SEQ ID NO: 387730 - DNA, 25 bp, Homo sapien
agcgcccaggtgttgtgagtcctaa

SEQ ID NO: 387731 - DNA, 25 bp, Homo sapien
gcattttgcaaatgttctgtactat

SEQ ID NO: 387732 - DNA, 25 bp, Homo sapien
agtgcctaatatggagagtcttcaa

SEQ ID NO: 387733 - DNA, 25 bp, Homo sapien
gagtcttcaagcaaaaatgtgctct

SEQ ID NO: 387734 - DNA, 25 bp, Homo sapien
atgtgctctagctcaattcagaata

SEQ ID NO: 387735 - DNA, 25 bp, Homo sapien
gaatactaattcacccattgttttc

SEQ ID NO: 387736 - DNA, 25 bp, Homo sapien
ctaattcacccattgttttcaaaag

SEQ ID NO: 387737 - DNA, 25 bp, Homo sapien
ttctagtcatttgaactgtttttat

SEQ ID NO: 387738 - DNA, 25 bp, Homo sapien
tccatggtctctgagcctgtaaaga

SEQ ID NO: 387739 - DNA, 25 bp, Homo sapien
aaggtttagtggtctcagggccagt

SEQ ID NO: 387740 - DNA, 25 bp, Homo sapien
cagggccagtcaaggatcaagatgt

SEQ ID NO: 387741 - DNA, 25 bp, Homo sapien
atcaagatgttgtagtcccagagca

SEQ ID NO: 387742 - DNA, 25 bp, Homo sapien
gtagtcccagagcatgcaaaggttc

SEQ ID NO: 387743 - DNA, 25 bp, Homo sapien
gcaaaggttcacgattctgcagttg

SEQ ID NO: 387744 - DNA, 25 bp, Homo sapien
gattctgcagttgtggcacctgtaa

SEQ ID NO: 387745 - DNA, 25 bp, Homo sapien
tggtccccgagtccgtgaagaatca

SEQ ID NO: 387746 - DNA, 25 bp, Homo sapien
gaatcaaggtcgtatagtccctgaa

SEQ ID NO: 387747 - DNA, 25 bp, Homo sapien
gtatagtccctgaacctctgaagaa

SEQ ID NO: 387748 - DNA, 25 bp, Homo sapien
tcccagtgcctctgaaggatcaaga

SEQ ID NO: 387749 - DNA, 25 bp, Homo sapien
gtgtttccaaacaatacctatcata

SEQ ID NO: 387750 - DNA, 25 bp, Homo sapien
aactacgtattcattgtctacctgc

SEQ ID NO: 387751 - DNA, 25 bp, Homo sapien
ttgtctacctgctaagtcaagggtt

SEQ ID NO: 387752 - DNA, 25 bp, Homo sapien
agtcaagggttcactgcatttctcc

SEQ ID NO: 387753 - DNA, 25 bp, Homo sapien
atgtggccattttgatggaaatcca

SEQ ID NO: 387754 - DNA, 25 bp, Homo sapien
aactcaattcctcaattgggctggc

SEQ ID NO: 387755 - DNA, 25 bp, Homo sapien
aattgggctggccacatttcaaatg

SEQ ID NO: 387756 - DNA, 25 bp, Homo sapien
atttcaaatgctcactacccacctg

SEQ ID NO: 387757 - DNA, 25 bp, Homo sapien
actacccacctgtggctagggtcta

SEQ ID NO: 387758 - DNA, 25 bp, Homo sapien
tggctagggtctacttctactgtat

SEQ ID NO: 387759 - DNA, 25 bp, Homo sapien
acttctactgtattggcgagcatgg

SEQ ID NO: 387760 - DNA, 25 bp, Homo sapien
tgctactgatccaaactgcagaact

SEQ ID NO: 387761 - DNA, 25 bp, Homo sapien
tactgatccaaactgcagaacttct

SEQ ID NO: 387762 - DNA, 25 bp, Homo sapien
gatccaaactgcagaacttctcatt

SEQ ID NO: 387763 - DNA, 25 bp, Homo sapien
tccaaactgcagaacttctcattca

SEQ ID NO: 387764 - DNA, 25 bp, Homo sapien
tgagaccctaaaaggctgaccggtt

SEQ ID NO: 387765 - DNA, 25 bp, Homo sapien
ctaaaaggctgaccggttccctgat

SEQ ID NO: 387766 - DNA, 25 bp, Homo sapien
aaaggctgaccggttccctgatgtg

SEQ ID NO: 387767 - DNA, 25 bp, Homo sapien
ggctgaccggttccctgatgtgtta

SEQ ID NO: 387768 - DNA, 25 bp, Homo sapien
tgaccggttccctgatgtgttacct

SEQ ID NO: 387769 - DNA, 25 bp, Homo sapien
gaccggttccctgatgtgttacctg

SEQ ID NO: 387770 - DNA, 25 bp, Homo sapien
ccggttccctgatgtgttacctgct

SEQ ID NO: 387771 - DNA, 25 bp, Homo sapien
gtggaatcagtttttggactgtgac

SEQ ID NO: 387772 - DNA, 25 bp, Homo sapien
tcagtttttggactgtgacccatgc

SEQ ID NO: 387773 - DNA, 25 bp, Homo sapien
cagtttttggactgtgacccatgca

SEQ ID NO: 387774 - DNA, 25 bp, Homo sapien
tgttgggggacaaggagttgcttca

SEQ ID NO: 387775 - DNA, 25 bp, Homo sapien
gagttagtgcagtgcgcctccaagg

SEQ ID NO: 387776 - DNA, 25 bp, Homo sapien
agttagtgcagtgcgcctccaaggg

SEQ ID NO: 387777 - DNA, 25 bp, Homo sapien
agtgcagtgcgcctccaaggggcag

SEQ ID NO: 387778 - DNA, 25 bp, Homo sapien
tgcagtgcgcctccaaggggcagtg

SEQ ID NO: 387779 - DNA, 25 bp, Homo sapien
tataaagggtttgaaagccactact

SEQ ID NO: 387780 - DNA, 25 bp, Homo sapien
taaagggtttgaaagccactactat

SEQ ID NO: 387781 - DNA, 25 bp, Homo sapien
attgattttctactaatttttacat

SEQ ID NO: 387782 - DNA, 25 bp, Homo sapien
acctgagtcaaatgaggacatctct

SEQ ID NO: 387783 - DNA, 25 bp, Homo sapien
atgaggacatctctacaactgtagt

SEQ ID NO: 387784 - DNA, 25 bp, Homo sapien
ggacatctctacaactgtagtatat

SEQ ID NO: 387785 - DNA, 25 bp, Homo sapien
aatctttcaaacatctttagctttt

SEQ ID NO: 387786 - DNA, 25 bp, Homo sapien
attttttgttctcaatcttgggtgc

SEQ ID NO: 387787 - DNA, 25 bp, Homo sapien
tttgttctcaatcttgggtgctgga

SEQ ID NO: 387788 - DNA, 25 bp, Homo sapien
gttctcaatcttgggtgctggagcc

SEQ ID NO: 387789 - DNA, 25 bp, Homo sapien
atcttgggtgctggagccataaagc

SEQ ID NO: 387790 - DNA, 25 bp, Homo sapien
ggtgctggagccataaagctttttt

SEQ ID NO: 387791 - DNA, 25 bp, Homo sapien
cagtagattaagaagtgcatttgtt

SEQ ID NO: 387792 - DNA, 25 bp, Homo sapien
gaagtgcatttgttggtctttaaaa

SEQ ID NO: 387793 - DNA, 25 bp, Homo sapien
atgattctgtggaattggtgtccct

SEQ ID NO: 387794 - DNA, 25 bp, Homo sapien
gtggaattggtgtccctgttagcaa

SEQ ID NO: 387795 - DNA, 25 bp, Homo sapien
gcctggagcctagatctggtgcttc

SEQ ID NO: 387796 - DNA, 25 bp, Homo sapien
atctggtgcttcttctgtgctgtgg

SEQ ID NO: 387797 - DNA, 25 bp, Homo sapien
tgtgctgtggtttaccccaaacctt

SEQ ID NO: 387798 - DNA, 25 bp, Homo sapien
acctttaggttgtttattcattcag

SEQ ID NO: 387799 - DNA, 25 bp, Homo sapien
cagattagatagactggagccataa

SEQ ID NO: 387800 - DNA, 25 bp, Homo sapien
ggagccataaagttaatttgcacct

SEQ ID NO: 387801 - DNA, 25 bp, Homo sapien
tttgcacctagctttttggagaata

SEQ ID NO: 387802 - DNA, 25 bp, Homo sapien
catgattaactgctattcgtggtgg

SEQ ID NO: 387803 - DNA, 25 bp, Homo sapien
gggaaccctatgatttactatgcag

SEQ ID NO: 387804 - DNA, 25 bp, Homo sapien
taggctataagggaagattgtcaat

SEQ ID NO: 387805 - DNA, 25 bp, Homo sapien
agctacagtcattttttctttgcac

SEQ ID NO: 387806 - DNA, 25 bp, Homo sapien
tttctttgcactttggatgctgaaa

SEQ ID NO: 387807 - DNA, 25 bp, Homo sapien
ttttcccatggaacatagccacatc

SEQ ID NO: 387808 - DNA, 25 bp, Homo sapien
ggaacatagccacatctagatagat

SEQ ID NO: 387809 - DNA, 25 bp, Homo sapien
tctagatagatgtgagctttttctt

SEQ ID NO: 387810 - DNA, 25 bp, Homo sapien
gtctgtaaaaacgattttcttctgt

SEQ ID NO: 387811 - DNA, 25 bp, Homo sapien
gattttcttctgtagaatgtttgac

SEQ ID NO: 387812 - DNA, 25 bp, Homo sapien
gaatgtttgacttcgtattgaccct

SEQ ID NO: 387813 - DNA, 25 bp, Homo sapien
gacttcgtattgacccttatctgta

SEQ ID NO: 387814 - DNA, 25 bp, Homo sapien
atctgtaaaacacctatttgggata

SEQ ID NO: 387815 - DNA, 25 bp, Homo sapien
aagaaaagcctagacagactgtatt

SEQ ID NO: 387816 - DNA, 25 bp, Homo sapien
aagcctagacagactgtatttccag

SEQ ID NO: 387817 - DNA, 25 bp, Homo sapien
agcctagacagactgtatttccagt

SEQ ID NO: 387818 - DNA, 25 bp, Homo sapien
gacagactgtatttccagtcacaga

SEQ ID NO: 387819 - DNA, 25 bp, Homo sapien
gactgtatttccagtcacagaacat

SEQ ID NO: 387820 - DNA, 25 bp, Homo sapien
gtatttccagtcacagaacataaaa

SEQ ID NO: 387821 - DNA, 25 bp, Homo sapien
ttccagtcacagaacataaaactta

SEQ ID NO: 387822 - DNA, 25 bp, Homo sapien
aggagccctccacgaggcccagtta

SEQ ID NO: 387823 - DNA, 25 bp, Homo sapien
gagccctccacgaggcccagttaat

SEQ ID NO: 387824 - DNA, 25 bp, Homo sapien
tagtggagacgaggtttccccctat

SEQ ID NO: 387825 - DNA, 25 bp, Homo sapien
tggagacgaggtttccccctattgg

SEQ ID NO: 387826 - DNA, 25 bp, Homo sapien
ggaagaggctcccaacccagagtgt

SEQ ID NO: 387827 - DNA, 25 bp, Homo sapien
ccaacccagagtgtccctgtgggag

SEQ ID NO: 387828 - DNA, 25 bp, Homo sapien
aggcaggcagaaggtgacaattgac

SEQ ID NO: 387829 - DNA, 25 bp, Homo sapien
gacaattgacacgatttcctgcacg

SEQ ID NO: 387830 - DNA, 25 bp, Homo sapien
aattgacacgatttcctgcacgcgt

SEQ ID NO: 387831 - DNA, 25 bp, Homo sapien
cctctaccttggaagcagttagaat

SEQ ID NO: 387832 - DNA, 25 bp, Homo sapien
gcagttagaatctaccaggcacaga

SEQ ID NO: 387833 - DNA, 25 bp, Homo sapien
caggcacagatgaggccgcccttgc

SEQ ID NO: 387834 - DNA, 25 bp, Homo sapien
gccgcccttgcctgacggagcttga

SEQ ID NO: 387835 - DNA, 25 bp, Homo sapien
agcttgatgagcagcccttggtctc

SEQ ID NO: 387836 - DNA, 25 bp, Homo sapien
ccttggtctccggttccaggactga

SEQ ID NO: 387837 - DNA, 25 bp, Homo sapien
tatggttcaggcagccatgactctt

SEQ ID NO: 387838 - DNA, 25 bp, Homo sapien
tcaggcagccatgactcttctaagt

SEQ ID NO: 387839 - DNA, 25 bp, Homo sapien
aagtgatgcttctcatctgcctaag

SEQ ID NO: 387840 - DNA, 25 bp, Homo sapien
ttctcatctgcctaaggcgggcggg

SEQ ID NO: 387841 - DNA, 25 bp, Homo sapien
tgacagactcaacaaacacggtatt

SEQ ID NO: 387842 - DNA, 25 bp, Homo sapien
gtttagtgttattagcagctctgaa

SEQ ID NO: 387843 - DNA, 25 bp, Homo sapien
gcagctctgaagtctaaacactgga

SEQ ID NO: 387844 - DNA, 25 bp, Homo sapien
aactgaagtcataacgtgcgtgaat

SEQ ID NO: 387845 - DNA, 25 bp, Homo sapien
aacagcttctctatttgatatttga

SEQ ID NO: 387846 - DNA, 25 bp, Homo sapien
gaaattcttctgtaagcctgtctga

SEQ ID NO: 387847 - DNA, 25 bp, Homo sapien
agcctgtctgagtgtatgtggaaac

SEQ ID NO: 387848 - DNA, 25 bp, Homo sapien
tgttctgaggcagctcaagtgctct

SEQ ID NO: 387849 - DNA, 25 bp, Homo sapien
agtcaccgctgccagtgatgaacac

SEQ ID NO: 387850 - DNA, 25 bp, Homo sapien
gatgaacacacgcacgggctaggca

SEQ ID NO: 387851 - DNA, 25 bp, Homo sapien
gctaggcacatggagcccaagcaca

SEQ ID NO: 387852 - DNA, 25 bp, Homo sapien
gactgccttgtggtgtggccgtcct

SEQ ID NO: 387853 - DNA, 25 bp, Homo sapien
ctcatctgccacaggaagacagact

SEQ ID NO: 387854 - DNA, 25 bp, Homo sapien
aagacagacttcgagggacctcttg

SEQ ID NO: 387855 - DNA, 25 bp, Homo sapien
gagggacctcttgcctaaggcctcg

SEQ ID NO: 387856 - DNA, 25 bp, Homo sapien
taaggcctcgctgactcaagggtag

SEQ ID NO: 387857 - DNA, 25 bp, Homo sapien
cagggaccaacacggtgcctcggtc

SEQ ID NO: 387858 - DNA, 25 bp, Homo sapien
tgcttccatccatgcaagtgtcctc

SEQ ID NO: 387859 - DNA, 25 bp, Homo sapien
gctctccgcacagtggttagacggg

SEQ ID NO: 387860 - DNA, 25 bp, Homo sapien
tagacgggaagatccggagctgtcc

SEQ ID NO: 387861 - DNA, 25 bp, Homo sapien
ggagctgtccagtgtcttgggtaat

SEQ ID NO: 387862 - DNA, 25 bp, Homo sapien
ttgggtaatgcacggcatcgcctga

SEQ ID NO: 387863 - DNA, 25 bp, Homo sapien
atcgcctgatgtctgacgctagaac

SEQ ID NO: 387864 - DNA, 25 bp, Homo sapien
agggaagtgaatgcgccctaggccc

SEQ ID NO: 387865 - DNA, 25 bp, Homo sapien
gagttggtgcaatcctagagatgcc

SEQ ID NO: 387866 - DNA, 25 bp, Homo sapien
tagagatgccggcaggtgcaccaat

SEQ ID NO: 387867 - DNA, 25 bp, Homo sapien
ggtgcaccaatctgtggcacacgta

SEQ ID NO: 387868 - DNA, 25 bp, Homo sapien
acacgtacgctctccaatggaagac

SEQ ID NO: 387869 - DNA, 25 bp, Homo sapien
gaagacaactcaagaccacaccaag

SEQ ID NO: 387870 - DNA, 25 bp, Homo sapien
tttccctttaatactgatgatgcaa

SEQ ID NO: 387871 - DNA, 25 bp, Homo sapien
gcaattttgaaatgttgcttgttct

SEQ ID NO: 387872 - DNA, 25 bp, Homo sapien
tgttctggaatacttcggaagttaa

SEQ ID NO: 387873 - DNA, 25 bp, Homo sapien
gagatcatgatctttatactgtgaa

SEQ ID NO: 387874 - DNA, 25 bp, Homo sapien
tccactccaaaacatatcaccagag

SEQ ID NO: 387875 - DNA, 25 bp, Homo sapien
atcaccagagtgacaacttcagccc

SEQ ID NO: 387876 - DNA, 25 bp, Homo sapien
tcagcctctgcaatccatatatatc

SEQ ID NO: 387877 - DNA, 25 bp, Homo sapien
aatccatatatatcctggtcttggg

SEQ ID NO: 387878 - DNA, 25 bp, Homo sapien
cctggtcttgggagtccatagaata

SEQ ID NO: 387879 - DNA, 25 bp, Homo sapien
tgggagtccatagaatactgtttcc

SEQ ID NO: 387880 - DNA, 25 bp, Homo sapien
gaatactgtttccttctaataaagg

SEQ ID NO: 387881 - DNA, 25 bp, Homo sapien
tacctgcttctgctactgatccaaa

SEQ ID NO: 387882 - DNA, 25 bp, Homo sapien
tgctactgatccaaactgcagaact

SEQ ID NO: 387883 - DNA, 25 bp, Homo sapien
gatccaaactgcagaacttctcatt

SEQ ID NO: 387884 - DNA, 25 bp, Homo sapien
tccaaactgcagaacttctcattca

SEQ ID NO: 387885 - DNA, 25 bp, Homo sapien
tgagaccctaaaaggctgaccggtt

SEQ ID NO: 387886 - DNA, 25 bp, Homo sapien
ctaaaaggctgaccggttccctgat

SEQ ID NO: 387887 - DNA, 25 bp, Homo sapien
aaaggctgaccggttccctgatgtg

SEQ ID NO: 387888 - DNA, 25 bp, Homo sapien
ggctgaccggttccctgatgtgtta

SEQ ID NO: 387889 - DNA, 25 bp, Homo sapien
tgaccggttccctgatgtgttacct

SEQ ID NO: 387890 - DNA, 25 bp, Homo sapien
ccggttccctgatgtgttacctgct

SEQ ID NO: 387891 - DNA, 25 bp, Homo sapien
gtgttacctgcttctgctactgatc

SEQ ID NO: 387892 - DNA, 25 bp, Homo sapien
aagttttaactggaatagatttgct

SEQ ID NO: 387893 - DNA, 25 bp, Homo sapien
aaaaattatatctcgggctgcctca

SEQ ID NO: 387894 - DNA, 25 bp, Homo sapien
gatattgaggatttgccatttgata

SEQ ID NO: 387895 - DNA, 25 bp, Homo sapien
ggctgcctcacacatcttttaacag

SEQ ID NO: 387896 - DNA, 25 bp, Homo sapien
gcctcacacatcttttaacaggata

SEQ ID NO: 387897 - DNA, 25 bp, Homo sapien
taagacctatgagttatggcatcag

SEQ ID NO: 387898 - DNA, 25 bp, Homo sapien
gttatggcatcaggcttgaacttta

SEQ ID NO: 387899 - DNA, 25 bp, Homo sapien
caggcttgaactttaatttatgaat

SEQ ID NO: 387900 - DNA, 25 bp, Homo sapien
tgccatttgatattgaccagggtgt

SEQ ID NO: 387901 - DNA, 25 bp, Homo sapien
gaccagggtgtattgtgcacaaata

SEQ ID NO: 387902 - DNA, 25 bp, Homo sapien
taaatcactgtaagttttaactgga

SEQ ID NO: 387903 - DNA, 25 bp, Homo sapien
tttgcttaccccttagaccaagaat

SEQ ID NO: 387904 - DNA, 25 bp, Homo sapien
gcttaccccttagaccaagaatctt

SEQ ID NO: 387905 - DNA, 25 bp, Homo sapien
agaatcttaagatcttccccagcta

SEQ ID NO: 387906 - DNA, 25 bp, Homo sapien
tcttaagatcttccccagctatgaa

SEQ ID NO: 387907 - DNA, 25 bp, Homo sapien
ttccccagctatgaagcctatcttg

SEQ ID NO: 387908 - DNA, 25 bp, Homo sapien
gaagcctatcttggaatgggaaacc

SEQ ID NO: 387909 - DNA, 25 bp, Homo sapien
ggaagaaatagccttacagcccctg

SEQ ID NO: 387910 - DNA, 25 bp, Homo sapien
ggagtccttacatccacagtgtctg

SEQ ID NO: 387911 - DNA, 25 bp, Homo sapien
ctggtcgtggtcagaaggcagtaat

SEQ ID NO: 387912 - DNA, 25 bp, Homo sapien
gaaggcagtaatgcaagagtccttt

SEQ ID NO: 387913 - DNA, 25 bp, Homo sapien
agagtccttttgtgaagagtgtttc

SEQ ID NO: 387914 - DNA, 25 bp, Homo sapien
tttccaaaccagcattactttcacc

SEQ ID NO: 387915 - DNA, 25 bp, Homo sapien
tactttcaccgctcgtggatctgaa

SEQ ID NO: 387916 - DNA, 25 bp, Homo sapien
catttagtactattacactctcaga

SEQ ID NO: 387917 - DNA, 25 bp, Homo sapien
gcacatgtatgcaatctaggtcatc

SEQ ID NO: 387918 - DNA, 25 bp, Homo sapien
tgaatttatacagccctagatttga

SEQ ID NO: 387919 - DNA, 25 bp, Homo sapien
cctagatttgagattgtggccctga

SEQ ID NO: 387920 - DNA, 25 bp, Homo sapien
tgtggccctgagtatctggatagtt

SEQ ID NO: 387921 - DNA, 25 bp, Homo sapien
atatgatagaggtgctttgttcctg

SEQ ID NO: 387922 - DNA, 25 bp, Homo sapien
ttgttcctgcagcttagaaacagaa

SEQ ID NO: 387923 - DNA, 25 bp, Homo sapien
gcagccattcactgagaagcttaag

SEQ ID NO: 387924 - DNA, 25 bp, Homo sapien
gaagtatcaacctcattttccaaac

SEQ ID NO: 387925 - DNA, 25 bp, Homo sapien
gaagagccaaggacaaggtcaggtt

SEQ ID NO: 387926 - DNA, 25 bp, Homo sapien
gtaggaggtgttcacacatcctctt

SEQ ID NO: 387927 - DNA, 25 bp, Homo sapien
acatcctcttgtgtgctaggtagtg

SEQ ID NO: 387928 - DNA, 25 bp, Homo sapien
ctaggtagtggcgtgcatctgatct

SEQ ID NO: 387929 - DNA, 25 bp, Homo sapien
tagtggcgtgcatctgatctgagag

SEQ ID NO: 387930 - DNA, 25 bp, Homo sapien
gaacattgaagtcctgattgcagca

SEQ ID NO: 387931 - DNA, 25 bp, Homo sapien
aagtcctgattgcagcagtgactct

SEQ ID NO: 387932 - DNA, 25 bp, Homo sapien
cagtgactctgcaaccttggataaa

SEQ ID NO: 387933 - DNA, 25 bp, Homo sapien
aaacggagataacggcctataggat

SEQ ID NO: 387934 - DNA, 25 bp, Homo sapien
acggcctataggattgttaagactg

SEQ ID NO: 387935 - DNA, 25 bp, Homo sapien
gaatggtgcctgacaaatgagaaac

SEQ ID NO: 387936 - DNA, 25 bp, Homo sapien
aatttgtgttaaccgtagattgcgc

SEQ ID NO: 387937 - DNA, 25 bp, Homo sapien
ttgtgttaaccgtagattgcgccat

SEQ ID NO: 387938 - DNA, 25 bp, Homo sapien
gtgttaaccgtagattgcgccattg

SEQ ID NO: 387939 - DNA, 25 bp, Homo sapien
tgttaaccgtagattgcgccattgc

SEQ ID NO: 387940 - DNA, 25 bp, Homo sapien
aaaggaataagtcagttgggtgcaa

SEQ ID NO: 387941 - DNA, 25 bp, Homo sapien
cagttgggtgcaaaggttcatgcct

SEQ ID NO: 387942 - DNA, 25 bp, Homo sapien
cgtgcttggcccgaggcagaaatat

SEQ ID NO: 387943 - DNA, 25 bp, Homo sapien
ttggcccgaggcagaaatatttttt

SEQ ID NO: 387944 - DNA, 25 bp, Homo sapien
aagccaagaggcgtaatttgtgtta

SEQ ID NO: 387945 - DNA, 25 bp, Homo sapien
gaggcgtaatttgtgttaaccgtag

SEQ ID NO: 387946 - DNA, 25 bp, Homo sapien
ggcgtaatttgtgttaaccgtagat

SEQ ID NO: 387947 - DNA, 25 bp, Homo sapien
tgtctccgacacaaagcacttatct

SEQ ID NO: 387948 - DNA, 25 bp, Homo sapien
gcacttatctcttaggagattccca

SEQ ID NO: 387949 - DNA, 25 bp, Homo sapien
ggagattcccaagaaagtcaacaag

SEQ ID NO: 387950 - DNA, 25 bp, Homo sapien
agactggagaaattcctcccttcct

SEQ ID NO: 387951 - DNA, 25 bp, Homo sapien
ctctgagctgtgaatctctcttcat

SEQ ID NO: 387952 - DNA, 25 bp, Homo sapien
tctctcttcatgaaagccaaaggta

SEQ ID NO: 387953 - DNA, 25 bp, Homo sapien
cagggccaggttagggccttccaca

SEQ ID NO: 387954 - DNA, 25 bp, Homo sapien
caaacacttctagagttgcccattc

SEQ ID NO: 387955 - DNA, 25 bp, Homo sapien
acttctagagttgcccattcctgtt

SEQ ID NO: 387956 - DNA, 25 bp, Homo sapien
ttcctgttatgttcttggaccctaa

SEQ ID NO: 387957 - DNA, 25 bp, Homo sapien
tcttggaccctaagatacctcctgt

SEQ ID NO: 387958 - DNA, 25 bp, Homo sapien
aggttggaaatgcactgaactctgg

SEQ ID NO: 387959 - DNA, 25 bp, Homo sapien
ctgaactctgggtgccgagagatgt

SEQ ID NO: 387960 - DNA, 25 bp, Homo sapien
ggctttgagacatgctactgaattt

SEQ ID NO: 387961 - DNA, 25 bp, Homo sapien
actgaatttggagggcaggcacgaa

SEQ ID NO: 387962 - DNA, 25 bp, Homo sapien
ggcaggcacgaagaacagtgagatt

SEQ ID NO: 387963 - DNA, 25 bp, Homo sapien
gagacaaccacagatcctacaggac

SEQ ID NO: 387964 - DNA, 25 bp, Homo sapien
agatcctacaggactgtctgtctcc

SEQ ID NO: 387965 - DNA, 25 bp, Homo sapien
atgatgaccctcaggaattgcaaag

SEQ ID NO: 387966 - DNA, 25 bp, Homo sapien
gaattgcaaaggctctgctgtcaca

SEQ ID NO: 387967 - DNA, 25 bp, Homo sapien
caaaggctctgctgtcacaaggaga

SEQ ID NO: 387968 - DNA, 25 bp, Homo sapien
tttggagcagggtccatccggcagt

SEQ ID NO: 387969 - DNA, 25 bp, Homo sapien
ccctgctggaaggtgtcgagagcca

SEQ ID NO: 387970 - DNA, 25 bp, Homo sapien
cagccaagcctgacctgggagatgg

SEQ ID NO: 387971 - DNA, 25 bp, Homo sapien
ctgctgccagtctgattccacagag

SEQ ID NO: 387972 - DNA, 25 bp, Homo sapien
tgctgccagtctgattccacagagg

SEQ ID NO: 387973 - DNA, 25 bp, Homo sapien
ctgccagtctgattccacagagggt

SEQ ID NO: 387974 - DNA, 25 bp, Homo sapien
gccagtctgattccacagagggtgc

SEQ ID NO: 387975 - DNA, 25 bp, Homo sapien
cagtctgattccacagagggtgctc

SEQ ID NO: 387976 - DNA, 25 bp, Homo sapien
gtctgattccacagagggtgctctg

SEQ ID NO: 387977 - DNA, 25 bp, Homo sapien
gagggggcttgtctaagcttaccca

SEQ ID NO: 387978 - DNA, 25 bp, Homo sapien
gcttacccagcccggaagcatcggg

SEQ ID NO: 387979 - DNA, 25 bp, Homo sapien
ggtcaaagcttaaccccctgctgga

SEQ ID NO: 387980 - DNA, 25 bp, Homo sapien
aggcaagattctagcaaagagagat

SEQ ID NO: 387981 - DNA, 25 bp, Homo sapien
tgggagataaatggctgagagttca

SEQ ID NO: 387982 - DNA, 25 bp, Homo sapien
atggctgagagttcaggtgaatatt

SEQ ID NO: 387983 - DNA, 25 bp, Homo sapien
tatttttaatgccttttcctgggat

SEQ ID NO: 387984 - DNA, 25 bp, Homo sapien
ttttaatgccttttcctgggataag

SEQ ID NO: 387985 - DNA, 25 bp, Homo sapien
ttaatgccttttcctgggataagca

SEQ ID NO: 387986 - DNA, 25 bp, Homo sapien
gagatctatgtacaattttaataaa

SEQ ID NO: 387987 - DNA, 25 bp, Homo sapien
atgccttttcctgggataagcatta

SEQ ID NO: 387988 - DNA, 25 bp, Homo sapien
gccttttcctgggataagcattaaa

SEQ ID NO: 387989 - DNA, 25 bp, Homo sapien
gatagtgatggtaaggcaagattct

SEQ ID NO: 387990 - DNA, 25 bp, Homo sapien
gatggtaaggcaagattctagcaaa

SEQ ID NO: 387991 - DNA, 25 bp, Homo sapien
gtatcttcaattttaattactggat

SEQ ID NO: 387992 - DNA, 25 bp, Homo sapien
gatttggaagttgaaatgccatcct

SEQ ID NO: 387993 - DNA, 25 bp, Homo sapien
gaaatgccatccttcaatatcactg

SEQ ID NO: 387994 - DNA, 25 bp, Homo sapien
catccttcaatatcactggtctcaa

SEQ ID NO: 387995 - DNA, 25 bp, Homo sapien
atatcactggtctcaaattcattga

SEQ ID NO: 387996 - DNA, 25 bp, Homo sapien
taatctcctaaattggtacccactg

SEQ ID NO: 387997 - DNA, 25 bp, Homo sapien
taaattggtacccactggctgctcc

SEQ ID NO: 387998 - DNA, 25 bp, Homo sapien
tggctgctcctaaactggtttccag

SEQ ID NO: 387999 - DNA, 25 bp, Homo sapien
tggtttccagtcatgtcctccagta

SEQ ID NO: 388000 - DNA, 25 bp, Homo sapien
cagtcatgtcctccagtatgtgatt

SEQ ID NO: 388001 - DNA, 25 bp, Homo sapien
gtcctccagtatgtgatttttataa

SEQ ID NO: 388002 - DNA, 25 bp, Homo sapien
tcttttctacacactcagccacaaa

SEQ ID NO: 388003 - DNA, 25 bp, Homo sapien
cttttctacacactcagccacaaag

SEQ ID NO: 388004 - DNA, 25 bp, Homo sapien
tacagaggaagctgttggtgttcta

SEQ ID NO: 388005 - DNA, 25 bp, Homo sapien
cagaggaagctgttggtgttctaag

SEQ ID NO: 388006 - DNA, 25 bp, Homo sapien
aggaagctgttggtgttctaagact

SEQ ID NO: 388007 - DNA, 25 bp, Homo sapien
agctgttggtgttctaagactctgt

SEQ ID NO: 388008 - DNA, 25 bp, Homo sapien
ctgttggtgttctaagactctgtgt

SEQ ID NO: 388009 - DNA, 25 bp, Homo sapien
gttggtgttctaagactctgtgtgg

SEQ ID NO: 388010 - DNA, 25 bp, Homo sapien
ttggtgttctaagactctgtgtggc

SEQ ID NO: 388011 - DNA, 25 bp, Homo sapien
ggctgtgcaatttctgtacatttgc

SEQ ID NO: 388012 - DNA, 25 bp, Homo sapien
ctgtgcaatttctgtacatttgcaa

SEQ ID NO: 388013 - DNA, 25 bp, Homo sapien
agtaccttaggaaccttgtaggctg

SEQ ID NO: 388014 - DNA, 25 bp, Homo sapien
gtaccttaggaaccttgtaggctgc

SEQ ID NO: 388015 - DNA, 25 bp, Homo sapien
taccttaggaaccttgtaggctgca

SEQ ID NO: 388016 - DNA, 25 bp, Homo sapien
accttaggaaccttgtaggctgcag

SEQ ID NO: 388017 - DNA, 25 bp, Homo sapien
gctctgctgtatctgttgtacatac

SEQ ID NO: 388018 - DNA, 25 bp, Homo sapien
ctctgctgtatctgttgtacatact

SEQ ID NO: 388019 - DNA, 25 bp, Homo sapien
tctgctgtatctgttgtacatactg

SEQ ID NO: 388020 - DNA, 25 bp, Homo sapien
ctgctgtatctgttgtacatactgg

SEQ ID NO: 388021 - DNA, 25 bp, Homo sapien
tctgtaaaggacattatctggggtg

SEQ ID NO: 388022 - DNA, 25 bp, Homo sapien
tgtatgtatttttgtgtgttctgct

SEQ ID NO: 388023 - DNA, 25 bp, Homo sapien
gtatgtatttttgtgtgttctgctt

SEQ ID NO: 388024 - DNA, 25 bp, Homo sapien
ttttcctgagccctcactctgtttt

SEQ ID NO: 388025 - DNA, 25 bp, Homo sapien
actctgtttttgtgctgttactcgg

SEQ ID NO: 388026 - DNA, 25 bp, Homo sapien
ttttgtgctgttactcggtagagtc

SEQ ID NO: 388027 - DNA, 25 bp, Homo sapien
actcggtagagtcaagactgttact

SEQ ID NO: 388028 - DNA, 25 bp, Homo sapien
gactgttactttttagccatggctg

SEQ ID NO: 388029 - DNA, 25 bp, Homo sapien
tagccatggctgacattgtatcaat

SEQ ID NO: 388030 - DNA, 25 bp, Homo sapien
aaaccgagggcttcaagcgtgctca

SEQ ID NO: 388031 - DNA, 25 bp, Homo sapien
gtgctcagagccgtttcagacagtg

SEQ ID NO: 388032 - DNA, 25 bp, Homo sapien
gccgtttcagacagtggaaatccat

SEQ ID NO: 388033 - DNA, 25 bp, Homo sapien
tgtgatcattaattgtaaagcgctt

SEQ ID NO: 388034 - DNA, 25 bp, Homo sapien
aagcgctttgtaaaattcacattta

SEQ ID NO: 388035 - DNA, 25 bp, Homo sapien
agccctaaggtgctctcccagccgt

SEQ ID NO: 388036 - DNA, 25 bp, Homo sapien
agccgtccgacctggatctccaaga

SEQ ID NO: 388037 - DNA, 25 bp, Homo sapien
gtccgacctggatctccaagacgta

SEQ ID NO: 388038 - DNA, 25 bp, Homo sapien
acctggatctccaagacgtagagga

SEQ ID NO: 388039 - DNA, 25 bp, Homo sapien
gatctccaagacgtagaggaagtgg

SEQ ID NO: 388040 - DNA, 25 bp, Homo sapien
gtggagatcggcagagacaccttct

SEQ ID NO: 388041 - DNA, 25 bp, Homo sapien
gagatcggcagagacaccttctggc

SEQ ID NO: 388042 - DNA, 25 bp, Homo sapien
ggcagagacaccttctggcccgact

SEQ ID NO: 388043 - DNA, 25 bp, Homo sapien
gggcgctgcgcagcctcctgaggag

SEQ ID NO: 388044 - DNA, 25 bp, Homo sapien
tcctgaggagccttccccgcagggc

SEQ ID NO: 388045 - DNA, 25 bp, Homo sapien
agggcccggtgcagcgccggcttcg

SEQ ID NO: 388046 - DNA, 25 bp, Homo sapien
aaattgctccagatctggaatgcca

SEQ ID NO: 388047 - DNA, 25 bp, Homo sapien
gctccagatctggaatgccagtttg

SEQ ID NO: 388048 - DNA, 25 bp, Homo sapien
cagtttgacctttgtcttctataat

SEQ ID NO: 388049 - DNA, 25 bp, Homo sapien
gacctttgtcttctataatatttcc

SEQ ID NO: 388050 - DNA, 25 bp, Homo sapien
gattcttaactaaaattgttctctt

SEQ ID NO: 388051 - DNA, 25 bp, Homo sapien
caccctttagtgtacatttatgttc

SEQ ID NO: 388052 - DNA, 25 bp, Homo sapien
tgttcctttatttaggaaacaccat

SEQ ID NO: 388053 - DNA, 25 bp, Homo sapien
gggacattcactataatgatctaag

SEQ ID NO: 388054 - DNA, 25 bp, Homo sapien
gatctaagaagctacagattgtcat

SEQ ID NO: 388055 - DNA, 25 bp, Homo sapien
gattgtcatagttgttttcctgctt

SEQ ID NO: 388056 - DNA, 25 bp, Homo sapien
gtcatagttgttttcctgctttaca

SEQ ID NO: 388057 - DNA, 25 bp, Homo sapien
gttaatatttggattatcagagtcc

SEQ ID NO: 388058 - DNA, 25 bp, Homo sapien
tatcagagtccatgttataaacaga

SEQ ID NO: 388059 - DNA, 25 bp, Homo sapien
ataaacagaatttacctatgcaaga

SEQ ID NO: 388060 - DNA, 25 bp, Homo sapien
gcaagacaaattctaactgtgcaac

SEQ ID NO: 388061 - DNA, 25 bp, Homo sapien
actgtgcaacattttcatgagaatt

SEQ ID NO: 388062 - DNA, 25 bp, Homo sapien
tgaatgtttttatgtgtaagtgcct

SEQ ID NO: 388063 - DNA, 25 bp, Homo sapien
atgtgtaagtgcctaaagaaccgta

SEQ ID NO: 388064 - DNA, 25 bp, Homo sapien
gtgcctaaagaaccgtagaaacagt

SEQ ID NO: 388065 - DNA, 25 bp, Homo sapien
gaaacagtacatcaaaagctcttat

SEQ ID NO: 388066 - DNA, 25 bp, Homo sapien
gatattgggttatgacaggattcta

SEQ ID NO: 388067 - DNA, 25 bp, Homo sapien
atttttagctatgaatggtgcttat

SEQ ID NO: 388068 - DNA, 25 bp, Homo sapien
gggcttagtttttccggaagatcag

SEQ ID NO: 388069 - DNA, 25 bp, Homo sapien
ttttccggaagatcaggcatttgtt

SEQ ID NO: 388070 - DNA, 25 bp, Homo sapien
atcaggcatttgttgttggctggca

SEQ ID NO: 388071 - DNA, 25 bp, Homo sapien
atttgttgttggctggcatgtccac

SEQ ID NO: 388072 - DNA, 25 bp, Homo sapien
tgttggctggcatgtccaccatcct

SEQ ID NO: 388073 - DNA, 25 bp, Homo sapien
ccattctgggttccccgtaggtgat

SEQ ID NO: 388074 - DNA, 25 bp, Homo sapien
aggtgtcctgctgctctgaagagcc

SEQ ID NO: 388075 - DNA, 25 bp, Homo sapien
tgaagagcccctccgtgcagcgcag

SEQ ID NO: 388076 - DNA, 25 bp, Homo sapien
acatgggccatgttgatgcagagca

SEQ ID NO: 388077 - DNA, 25 bp, Homo sapien
atgcagagcaacaggtccagcgact

SEQ ID NO: 388078 - DNA, 25 bp, Homo sapien
gcaacaggtccagcgactgtggcag

SEQ ID NO: 388079 - DNA, 25 bp, Homo sapien
tggtcaaatgcttgtaaatgtagct

SEQ ID NO: 388080 - DNA, 25 bp, Homo sapien
gaagatagggagaaactgcggatcc

SEQ ID NO: 388081 - DNA, 25 bp, Homo sapien
gaaactgcggatcccaaactgttcc

SEQ ID NO: 388082 - DNA, 25 bp, Homo sapien
actgcggatcccaaactgttccctt

SEQ ID NO: 388083 - DNA, 25 bp, Homo sapien
aaatcatgtttaatcgtataaggaa

SEQ ID NO: 388084 - DNA, 25 bp, Homo sapien
gaaacatttcaatacacttatacag

SEQ ID NO: 388085 - DNA, 25 bp, Homo sapien
gaagtacatgtgtgtgattcagtct

SEQ ID NO: 388086 - DNA, 25 bp, Homo sapien
catgtgtgtgattcagtctgattca

SEQ ID NO: 388087 - DNA, 25 bp, Homo sapien
attcagtctgattcacagaattctg

SEQ ID NO: 388088 - DNA, 25 bp, Homo sapien
ggaataaaacaactccacttagatg

SEQ ID NO: 388089 - DNA, 25 bp, Homo sapien
acaactccacttagatgataactga

SEQ ID NO: 388090 - DNA, 25 bp, Homo sapien
gctcctgctgcaaaatacagtgcct

SEQ ID NO: 388091 - DNA, 25 bp, Homo sapien
agtgccttcaaaatgattctctgtg

SEQ ID NO: 388092 - DNA, 25 bp, Homo sapien
agaccgcacctgatttttggaccaa

SEQ ID NO: 388093 - DNA, 25 bp, Homo sapien
gattctctgtgtgaattgcatgcaa

SEQ ID NO: 388094 - DNA, 25 bp, Homo sapien
aaagtgtaacctgtatgtgcatgac

SEQ ID NO: 388095 - DNA, 25 bp, Homo sapien
gtggatcagtggacctgctgaagtc

SEQ ID NO: 388096 - DNA, 25 bp, Homo sapien
tgctgaagtcactggactcatgtga

SEQ ID NO: 388097 - DNA, 25 bp, Homo sapien
tttggaccaaagtttcatataggaa

SEQ ID NO: 388098 - DNA, 25 bp, Homo sapien
taaaaaggaggaccacttgtgagcc

SEQ ID NO: 388099 - DNA, 25 bp, Homo sapien
acttgtgagccaacctaggaaggac

SEQ ID NO: 388100 - DNA, 25 bp, Homo sapien
gaaggacttgccagaaagtagcagc

SEQ ID NO: 388101 - DNA, 25 bp, Homo sapien
gggcttagtttttccggaagatcag

SEQ ID NO: 388102 - DNA, 25 bp, Homo sapien
tagtttttccggaagatcaggcatt

SEQ ID NO: 388103 - DNA, 25 bp, Homo sapien
ttttccggaagatcaggcatttgtt

SEQ ID NO: 388104 - DNA, 25 bp, Homo sapien
tccggaagatcaggcatttgttgtt

SEQ ID NO: 388105 - DNA, 25 bp, Homo sapien
gaagatcaggcatttgttgttggct

SEQ ID NO: 388106 - DNA, 25 bp, Homo sapien
atcaggcatttgttgttggctggca

SEQ ID NO: 388107 - DNA, 25 bp, Homo sapien
aggcatttgttgttggctggcatgt

SEQ ID NO: 388108 - DNA, 25 bp, Homo sapien
atttgttgttggctggcatgtccac

SEQ ID NO: 388109 - DNA, 25 bp, Homo sapien
ttgttgttggctggcatgtccacca

SEQ ID NO: 388110 - DNA, 25 bp, Homo sapien
gttgttggctggcatgtccaccatc

SEQ ID NO: 388111 - DNA, 25 bp, Homo sapien
ttggctggcatgtccaccatcctct

SEQ ID NO: 388112 - DNA, 25 bp, Homo sapien
gtctccaaagttccctcagctagat

SEQ ID NO: 388113 - DNA, 25 bp, Homo sapien
agttccctcagctagattctgacga

SEQ ID NO: 388114 - DNA, 25 bp, Homo sapien
gattctgacgaacataccccagttg

SEQ ID NO: 388115 - DNA, 25 bp, Homo sapien
cgaacataccccagttgaggatgaa

SEQ ID NO: 388116 - DNA, 25 bp, Homo sapien
gaagaggtaacgcatcagaaaagca

SEQ ID NO: 388117 - DNA, 25 bp, Homo sapien
gaaaagcagcagttcagattccaac

SEQ ID NO: 388118 - DNA, 25 bp, Homo sapien
gcagttcagattccaactcggaaga

SEQ ID NO: 388119 - DNA, 25 bp, Homo sapien
agaagaccagtcgttcaagaaacaa

SEQ ID NO: 388120 - DNA, 25 bp, Homo sapien
atattctgatagtgacagtaactca

SEQ ID NO: 388121 - DNA, 25 bp, Homo sapien
gacagtaactcagagtctgacacaa

SEQ ID NO: 388122 - DNA, 25 bp, Homo sapien
tctgacacaaattctgactctgatg

SEQ ID NO: 388123 - DNA, 25 bp, Homo sapien
gaatgcagagtaaagggaccttctt

SEQ ID NO: 388124 - DNA, 25 bp, Homo sapien
gggaccttcttggttctgcaggaac

SEQ ID NO: 388125 - DNA, 25 bp, Homo sapien
gatgaggagacagaacccctacttc

SEQ ID NO: 388126 - DNA, 25 bp, Homo sapien
aagtgctctatttgtattacccaga

SEQ ID NO: 388127 - DNA, 25 bp, Homo sapien
gtattacccagatgactgaagctta

SEQ ID NO: 388128 - DNA, 25 bp, Homo sapien
gaagtatacaagcagagccagttct

SEQ ID NO: 388129 - DNA, 25 bp, Homo sapien
caagcagagccagttctggtacaaa

SEQ ID NO: 388130 - DNA, 25 bp, Homo sapien
aatggaagggtcttcttcaccactc

SEQ ID NO: 388131 - DNA, 25 bp, Homo sapien
tcaccactccttaccttctatgtga

SEQ ID NO: 388132 - DNA, 25 bp, Homo sapien
gagcttataaaagtacttccatttt

SEQ ID NO: 388133 - DNA, 25 bp, Homo sapien
tattctcctgaataccaaaggcaat

SEQ ID NO: 388134 - DNA, 25 bp, Homo sapien
gaaagcaaggggtgcctaaatctag

SEQ ID NO: 388135 - DNA, 25 bp, Homo sapien
aaagcaaggggtgcctaaatctaga

SEQ ID NO: 388136 - DNA, 25 bp, Homo sapien
tccacaccgggcagcggggttgcaa

SEQ ID NO: 388137 - DNA, 25 bp, Homo sapien
gggttgcaacccagcacctggtagg

SEQ ID NO: 388138 - DNA, 25 bp, Homo sapien
ggttgcaacccagcacctggtaggc

SEQ ID NO: 388139 - DNA, 25 bp, Homo sapien
gttgcaacccagcacctggtaggct

SEQ ID NO: 388140 - DNA, 25 bp, Homo sapien
ttgcaacccagcacctggtaggctc

SEQ ID NO: 388141 - DNA, 25 bp, Homo sapien
tgcaacccagcacctggtaggctcc

SEQ ID NO: 388142 - DNA, 25 bp, Homo sapien
gcaacccagcacctggtaggctcca

SEQ ID NO: 388143 - DNA, 25 bp, Homo sapien
aacccagcacctggtaggctccatt

SEQ ID NO: 388144 - DNA, 25 bp, Homo sapien
ccagcacctggtaggctccatttct

SEQ ID NO: 388145 - DNA, 25 bp, Homo sapien
gtttccaatatgaatcgtgttacaa

SEQ ID NO: 388146 - DNA, 25 bp, Homo sapien
ttccaatatgaatcgtgttacaaaa

SEQ ID NO: 388147 - DNA, 25 bp, Homo sapien
ccaatatgaatcgtgttacaaaatt

SEQ ID NO: 388148 - DNA, 25 bp, Homo sapien
tgaatcgtgttacaaaattcttaat

SEQ ID NO: 388149 - DNA, 25 bp, Homo sapien
taataactaaaacctcttgaaaatg

SEQ ID NO: 388150 - DNA, 25 bp, Homo sapien
taactaaaacctcttgaaaatgtca

SEQ ID NO: 388151 - DNA, 25 bp, Homo sapien
gaaatacttgatttctgatgcaact

SEQ ID NO: 388152 - DNA, 25 bp, Homo sapien
aaatacttgatttctgatgcaactt

SEQ ID NO: 388153 - DNA, 25 bp, Homo sapien
aatacttgatttctgatgcaacttt

SEQ ID NO: 388154 - DNA, 25 bp, Homo sapien
atacttgatttctgatgcaactttg

SEQ ID NO: 388155 - DNA, 25 bp, Homo sapien
ctgatgcaactttgactaaaatatt

SEQ ID NO: 388156 - DNA, 25 bp, Homo sapien
tgacttctttggtgacaagttcagt

SEQ ID NO: 388157 - DNA, 25 bp, Homo sapien
caagttcagtgatatttcaagcatg

SEQ ID NO: 388158 - DNA, 25 bp, Homo sapien
ttcaagcatgatgttttgagtttga

SEQ ID NO: 388159 - DNA, 25 bp, Homo sapien
tgtatttgtgaggacacatcacttt

SEQ ID NO: 388160 - DNA, 25 bp, Homo sapien
tgaggacacatcactttaattaaaa

SEQ ID NO: 388161 - DNA, 25 bp, Homo sapien
cagagtgagatttctgagaggagaa

SEQ ID NO: 388162 - DNA, 25 bp, Homo sapien
aagaaaagtatggttaacattgcca

SEQ ID NO: 388163 - DNA, 25 bp, Homo sapien
gggtcatacagccttgctttttgct

SEQ ID NO: 388164 - DNA, 25 bp, Homo sapien
agccttgctttttgctggagttagc

SEQ ID NO: 388165 - DNA, 25 bp, Homo sapien
cattctccatatgatagttttagat

SEQ ID NO: 388166 - DNA, 25 bp, Homo sapien
atatgatagttttagatgttcccca

SEQ ID NO: 388167 - DNA, 25 bp, Homo sapien
ggagaagcatcgggccagatcaacc

SEQ ID NO: 388168 - DNA, 25 bp, Homo sapien
accgttaataacatgcttctgagct

SEQ ID NO: 388169 - DNA, 25 bp, Homo sapien
gcttctgagctatgtggatgtataa

SEQ ID NO: 388170 - DNA, 25 bp, Homo sapien
ccccaactaggtattgtagaggctg

SEQ ID NO: 388171 - DNA, 25 bp, Homo sapien
gatgggattatacaggtgatgcata

SEQ ID NO: 388172 - DNA, 25 bp, Homo sapien
acaggtgatgcatatttttgttttg

SEQ ID NO: 388173 - DNA, 25 bp, Homo sapien
gttttgagactcaacaatgtgctac

SEQ ID NO: 388174 - DNA, 25 bp, Homo sapien
gagactcaacaatgtgctacaaatg

SEQ ID NO: 388175 - DNA, 25 bp, Homo sapien
gctacaaatgtgatacttaaccctg

SEQ ID NO: 388176 - DNA, 25 bp, Homo sapien
tgtgatacttaaccctgaactgcat

SEQ ID NO: 388177 - DNA, 25 bp, Homo sapien
acttaaccctgaactgcatgtattg

SEQ ID NO: 388178 - DNA, 25 bp, Homo sapien
ttattctcattaagatgtatcctgg

SEQ ID NO: 388179 - DNA, 25 bp, Homo sapien
attctcattaagatgtatcctggaa

SEQ ID NO: 388180 - DNA, 25 bp, Homo sapien
tctcattaagatgtatcctggaata

SEQ ID NO: 388181 - DNA, 25 bp, Homo sapien
tcattaagatgtatcctggaataaa

SEQ ID NO: 388182 - DNA, 25 bp, Homo sapien
taaatgctttgaaaagcagaagcca

SEQ ID NO: 388183 - DNA, 25 bp, Homo sapien
ccagctaaaaacagatgaactctcc

SEQ ID NO: 388184 - DNA, 25 bp, Homo sapien
cactgtgactgtgtgtctgtgctga

SEQ ID NO: 388185 - DNA, 25 bp, Homo sapien
actgtgactgtgtgtctgtgctgat

SEQ ID NO: 388186 - DNA, 25 bp, Homo sapien
ctgtgactgtgtgtctgtgctgatg

SEQ ID NO: 388187 - DNA, 25 bp, Homo sapien
gtatggtttgctggctcagttgtca

SEQ ID NO: 388188 - DNA, 25 bp, Homo sapien
tttagaaacttttgaccacataatt

SEQ ID NO: 388189 - DNA, 25 bp, Homo sapien
cagcaaaggagcaggactcccaggc

SEQ ID NO: 388190 - DNA, 25 bp, Homo sapien
ctccctggccggtgcaaagtacagg

SEQ ID NO: 388191 - DNA, 25 bp, Homo sapien
tccctggccggtgcaaagtacaggg

SEQ ID NO: 388192 - DNA, 25 bp, Homo sapien
ccctggccggtgcaaagtacaggga

SEQ ID NO: 388193 - DNA, 25 bp, Homo sapien
cctggccggtgcaaagtacagggag

SEQ ID NO: 388194 - DNA, 25 bp, Homo sapien
tggccggtgcaaagtacagggaggt

SEQ ID NO: 388195 - DNA, 25 bp, Homo sapien
ggccggtgcaaagtacagggaggta

SEQ ID NO: 388196 - DNA, 25 bp, Homo sapien
gccggtgcaaagtacagggaggtaa

SEQ ID NO: 388197 - DNA, 25 bp, Homo sapien
cggtgcaaagtacagggaggtaaag

SEQ ID NO: 388198 - DNA, 25 bp, Homo sapien
ggaggtaaagcaggacccttgcaga

SEQ ID NO: 388199 - DNA, 25 bp, Homo sapien
gaggtaaagcaggacccttgcagac

SEQ ID NO: 388200 - DNA, 25 bp, Homo sapien
tgcatcacctgttctataaaactgg

SEQ ID NO: 388201 - DNA, 25 bp, Homo sapien
gcatcacctgttctataaaactggt

SEQ ID NO: 388202 - DNA, 25 bp, Homo sapien
atcacctgttctataaaactggttg

SEQ ID NO: 388203 - DNA, 25 bp, Homo sapien
tcacctgttctataaaactggttgc

SEQ ID NO: 388204 - DNA, 25 bp, Homo sapien
acctgttctataaaactggttgctg

SEQ ID NO: 388205 - DNA, 25 bp, Homo sapien
ctgttctataaaactggttgctggc

SEQ ID NO: 388206 - DNA, 25 bp, Homo sapien
tgttctataaaactggttgctggct

SEQ ID NO: 388207 - DNA, 25 bp, Homo sapien
gttctataaaactggttgctggctg

SEQ ID NO: 388208 - DNA, 25 bp, Homo sapien
ttctataaaactggttgctggctgg

SEQ ID NO: 388209 - DNA, 25 bp, Homo sapien
ggctcaactcgtataatcccaacac

SEQ ID NO: 388210 - DNA, 25 bp, Homo sapien
gctcaactcgtataatcccaacact

SEQ ID NO: 388211 - DNA, 25 bp, Homo sapien
aggtacagcatgcaagcccgtaacg

SEQ ID NO: 388212 - DNA, 25 bp, Homo sapien
ggtacagcatgcaagcccgtaacgg

SEQ ID NO: 388213 - DNA, 25 bp, Homo sapien
gtacagcatgcaagcccgtaacggc

SEQ ID NO: 388214 - DNA, 25 bp, Homo sapien
tacagcatgcaagcccgtaacggca

SEQ ID NO: 388215 - DNA, 25 bp, Homo sapien
atgcaagcccgtaacggcatctccc

SEQ ID NO: 388216 - DNA, 25 bp, Homo sapien
caccaaccccaccaaattgcagatt

SEQ ID NO: 388217 - DNA, 25 bp, Homo sapien
gaacggcgagttcagaaacagcagc

SEQ ID NO: 388218 - DNA, 25 bp, Homo sapien
agaaacagcagcaattgttaacctg

SEQ ID NO: 388219 - DNA, 25 bp, Homo sapien
aattgttaacctgcctgaggaggga

SEQ ID NO: 388220 - DNA, 25 bp, Homo sapien
gtggccaagggcagggtctcggcct

SEQ ID NO: 388221 - DNA, 25 bp, Homo sapien
gaggcacccacggttgcagccccag

SEQ ID NO: 388222 - DNA, 25 bp, Homo sapien
tcttttctacacactcagccacaaa

SEQ ID NO: 388223 - DNA, 25 bp, Homo sapien
cttttctacacactcagccacaaag

SEQ ID NO: 388224 - DNA, 25 bp, Homo sapien
agctcccctcttttgtaagtatgtg

SEQ ID NO: 388225 - DNA, 25 bp, Homo sapien
ctccagctgcgacttttaactatgt

SEQ ID NO: 388226 - DNA, 25 bp, Homo sapien
cagaggaagctgttggtgttctaag

SEQ ID NO: 388227 - DNA, 25 bp, Homo sapien
aggaagctgttggtgttctaagact

SEQ ID NO: 388228 - DNA, 25 bp, Homo sapien
agctgttggtgttctaagactctgt

SEQ ID NO: 388229 - DNA, 25 bp, Homo sapien
ctgttggtgttctaagactctgtgt

SEQ ID NO: 388230 - DNA, 25 bp, Homo sapien
ttggtgttctaagactctgtgtggc

SEQ ID NO: 388231 - DNA, 25 bp, Homo sapien
ggctgtgcaatttctgtacatttgc

SEQ ID NO: 388232 - DNA, 25 bp, Homo sapien
ctgtgcaatttctgtacatttgcaa

SEQ ID NO: 388233 - DNA, 25 bp, Homo sapien
gggtggaggagcagaatttactaca

SEQ ID NO: 388234 - DNA, 25 bp, Homo sapien
ggagcagaatttactacagcatgtg

SEQ ID NO: 388235 - DNA, 25 bp, Homo sapien
tttcaggttaatgactccagagagt

SEQ ID NO: 388236 - DNA, 25 bp, Homo sapien
gcaccacccggctagttgaaataat

SEQ ID NO: 388237 - DNA, 25 bp, Homo sapien
tgaaataatcggaagtagacaagct

SEQ ID NO: 388238 - DNA, 25 bp, Homo sapien
gagtggggcccttaaactggattca

SEQ ID NO: 388239 - DNA, 25 bp, Homo sapien
acataggaatggttgaagaggtctt

SEQ ID NO: 388240 - DNA, 25 bp, Homo sapien
gaagaggtcttgcagtcttcagatg

SEQ ID NO: 388241 - DNA, 25 bp, Homo sapien
gacttcctttaataagtgttgcgct

SEQ ID NO: 388242 - DNA, 25 bp, Homo sapien
ataagtgttgcgctggttcaaggtt

SEQ ID NO: 388243 - DNA, 25 bp, Homo sapien
ttgcgctggttcaaggttgggcatt

SEQ ID NO: 388244 - DNA, 25 bp, Homo sapien
gaaagttgcattccttattagagta

SEQ ID NO: 388245 - DNA, 25 bp, Homo sapien
agagtaggaactctctagcccaact

SEQ ID NO: 388246 - DNA, 25 bp, Homo sapien
caactccattctatgttctcagctc

SEQ ID NO: 388247 - DNA, 25 bp, Homo sapien
ggaacgagagcatctacaccagcat

SEQ ID NO: 388248 - DNA, 25 bp, Homo sapien
tagcaaggcagtcctatgtttacaa

SEQ ID NO: 388249 - DNA, 25 bp, Homo sapien
gattgtcatttcattccataactct

SEQ ID NO: 388250 - DNA, 25 bp, Homo sapien
acgtattttaaatgctcggtctgta

SEQ ID NO: 388251 - DNA, 25 bp, Homo sapien
acaccagcatttcaggtatagctct

SEQ ID NO: 388252 - DNA, 25 bp, Homo sapien
gtatagctctttataactctggaga

SEQ ID NO: 388253 - DNA, 25 bp, Homo sapien
gtaaaacatgtttaacacccacgag

SEQ ID NO: 388254 - DNA, 25 bp, Homo sapien
acacccacgagttttgaaagttgca

SEQ ID NO: 388255 - DNA, 25 bp, Homo sapien
gggaggatgtattctcccctcagtt

SEQ ID NO: 388256 - DNA, 25 bp, Homo sapien
gtttcctgccagctgtcatagtcaa

SEQ ID NO: 388257 - DNA, 25 bp, Homo sapien
tctgctgcctgaatccaagccaaaa

SEQ ID NO: 388258 - DNA, 25 bp, Homo sapien
gccaaaatatagactgtgaccaact

SEQ ID NO: 388259 - DNA, 25 bp, Homo sapien
gactgtgaccaactctaagaaacta

SEQ ID NO: 388260 - DNA, 25 bp, Homo sapien
aagaagacttaatcccttgaattgg

SEQ ID NO: 388261 - DNA, 25 bp, Homo sapien
tgacagacacttggcactcttgcaa

SEQ ID NO: 388262 - DNA, 25 bp, Homo sapien
cactcttgcaagtgtttgacagaga

SEQ ID NO: 388263 - DNA, 25 bp, Homo sapien
aaatgtacaaagacagccttcaatt

SEQ ID NO: 388264 - DNA, 25 bp, Homo sapien
taaggattaatcactatggcaactg

SEQ ID NO: 388265 - DNA, 25 bp, Homo sapien
atggcaactgagatgtggtgactga

SEQ ID NO: 388266 - DNA, 25 bp, Homo sapien
ggtagctacacatgaaggtttactt

SEQ ID NO: 388267 - DNA, 25 bp, Homo sapien
aggtttacttgagcttttgtgattc

SEQ ID NO: 388268 - DNA, 25 bp, Homo sapien
gagcttttgtgattcaaagttcagg

SEQ ID NO: 388269 - DNA, 25 bp, Homo sapien
tggtaaggactctggtaccagggaa

SEQ ID NO: 388270 - DNA, 25 bp, Homo sapien
tttttgttttcctctgttgctagat

SEQ ID NO: 388271 - DNA, 25 bp, Homo sapien
gttttcctctgttgctagataaata

SEQ ID NO: 388272 - DNA, 25 bp, Homo sapien
atagctctatttctctgccaatata

SEQ ID NO: 388273 - DNA, 25 bp, Homo sapien
aaaatctacctttcatataatgcta

SEQ ID NO: 388274 - DNA, 25 bp, Homo sapien
taatgctacattgaaggcacagaat

SEQ ID NO: 388275 - DNA, 25 bp, Homo sapien
agaatttgctaccatctctctctcc

SEQ ID NO: 388276 - DNA, 25 bp, Homo sapien
ctacctaccaaactatccacaattt

SEQ ID NO: 388277 - DNA, 25 bp, Homo sapien
tgtgaccctaggcatttgacttagc

SEQ ID NO: 388278 - DNA, 25 bp, Homo sapien
ctaggcatttgacttagcctttctg

SEQ ID NO: 388279 - DNA, 25 bp, Homo sapien
ggattggactaggtaatctccaaga

SEQ ID NO: 388280 - DNA, 25 bp, Homo sapien
atctccaagatcctaggaacccagg

SEQ ID NO: 388281 - DNA, 25 bp, Homo sapien
gtacaagaatgaacactcaggtgga

SEQ ID NO: 388282 - DNA, 25 bp, Homo sapien
actcaggtggaaatgctgcaatcct

SEQ ID NO: 388283 - DNA, 25 bp, Homo sapien
atgctgcaatcctgagaagctccca

SEQ ID NO: 388284 - DNA, 25 bp, Homo sapien
ctgagaagctcccaggatgaatgaa

SEQ ID NO: 388285 - DNA, 25 bp, Homo sapien
atgaaaggcacaggacctcttaccc

SEQ ID NO: 388286 - DNA, 25 bp, Homo sapien
cctcaagagctggtttctcaaacct

SEQ ID NO: 388287 - DNA, 25 bp, Homo sapien
gagctggtttctcaaacctttctct

SEQ ID NO: 388288 - DNA, 25 bp, Homo sapien
tggtcaacgggctactgcagcacat

SEQ ID NO: 388289 - DNA, 25 bp, Homo sapien
acgggctactgcagcacatcctgtg

SEQ ID NO: 388290 - DNA, 25 bp, Homo sapien
cagctggagatgcaaggcccctgaa

SEQ ID NO: 388291 - DNA, 25 bp, Homo sapien
gggcaaaaccaatgtcatcctgctg

SEQ ID NO: 388292 - DNA, 25 bp, Homo sapien
aatgtcatcctgctgggagactcta

SEQ ID NO: 388293 - DNA, 25 bp, Homo sapien
catcctgctgggagactctatcggg

SEQ ID NO: 388294 - DNA, 25 bp, Homo sapien
ggttcctggtgtgcagaacattctc

SEQ ID NO: 388295 - DNA, 25 bp, Homo sapien
attctcaaaattggcttcctgaatg

SEQ ID NO: 388296 - DNA, 25 bp, Homo sapien
ttggcttcctgaatgacaaggtgga

SEQ ID NO: 388297 - DNA, 25 bp, Homo sapien
acatggactcctatgacatcgtgct

SEQ ID NO: 388298 - DNA, 25 bp, Homo sapien
gactcctatgacatcgtgctggaga

SEQ ID NO: 388299 - DNA, 25 bp, Homo sapien
acaagttgctgggtaaagtcacaat

SEQ ID NO: 388300 - DNA, 25 bp, Homo sapien
agttgctgggtaaagtcacaattgc

SEQ ID NO: 388301 - DNA, 25 bp, Homo sapien
tgctgggtaaagtcacaattgctca

SEQ ID NO: 388302 - DNA, 25 bp, Homo sapien
agaagttcgcaatggctcgtaccaa

SEQ ID NO: 388303 - DNA, 25 bp, Homo sapien
gaagttcgcaatggctcgtaccaag

SEQ ID NO: 388304 - DNA, 25 bp, Homo sapien
agttcgcaatggctcgtaccaagca

SEQ ID NO: 388305 - DNA, 25 bp, Homo sapien
gttcgcaatggctcgtaccaagcag

SEQ ID NO: 388306 - DNA, 25 bp, Homo sapien
ttcgcaatggctcgtaccaagcaga

SEQ ID NO: 388307 - DNA, 25 bp, Homo sapien
tcgcaatggctcgtaccaagcagac

SEQ ID NO: 388308 - DNA, 25 bp, Homo sapien
gcaatggctcgtaccaagcagactg

SEQ ID NO: 388309 - DNA, 25 bp, Homo sapien
gctgctcgaaagagcgctccagcca

SEQ ID NO: 388310 - DNA, 25 bp, Homo sapien
gccaagaaacaggttctgaaacttt

SEQ ID NO: 388311 - DNA, 25 bp, Homo sapien
aaacagaggtgggagtgtgaacaca

SEQ ID NO: 388312 - DNA, 25 bp, Homo sapien
acaggcaggagctccaattcctgac

SEQ ID NO: 388313 - DNA, 25 bp, Homo sapien
ctgtcctgacccagatggagtgctg

SEQ ID NO: 388314 - DNA, 25 bp, Homo sapien
tgacccagatggagtgctgctctca

SEQ ID NO: 388315 - DNA, 25 bp, Homo sapien
gatggagtgctgctctcacatctca

SEQ ID NO: 388316 - DNA, 25 bp, Homo sapien
gagtgctgctctcacatctcagaga

SEQ ID NO: 388317 - DNA, 25 bp, Homo sapien
tgctgctctcacatctcagagactt

SEQ ID NO: 388318 - DNA, 25 bp, Homo sapien
tcagagacttcgcactcagccctgc

SEQ ID NO: 388319 - DNA, 25 bp, Homo sapien
tttctttcggagacagtctagctcc

SEQ ID NO: 388320 - DNA, 25 bp, Homo sapien
tttcggagacagtctagctccgtca

SEQ ID NO: 388321 - DNA, 25 bp, Homo sapien
agcaaaggagcaggactcccaggcc

SEQ ID NO: 388322 - DNA, 25 bp, Homo sapien
agcttctgtttcaagctgggcagac

SEQ ID NO: 388323 - DNA, 25 bp, Homo sapien
tctgtttcaagctgggcagacccca

SEQ ID NO: 388324 - DNA, 25 bp, Homo sapien
ttccctccctaaggactcagctgag

SEQ ID NO: 388325 - DNA, 25 bp, Homo sapien
ccagcttgatgtttgggtctcccca

SEQ ID NO: 388326 - DNA, 25 bp, Homo sapien
cagcttgatgtttgggtctccccag

SEQ ID NO: 388327 - DNA, 25 bp, Homo sapien
agcttgatgtttgggtctccccagc

SEQ ID NO: 388328 - DNA, 25 bp, Homo sapien
cttgatgtttgggtctccccagcac

SEQ ID NO: 388329 - DNA, 25 bp, Homo sapien
ttgatgtttgggtctccccagcacc

SEQ ID NO: 388330 - DNA, 25 bp, Homo sapien
gatgtttgggtctccccagcaccct

SEQ ID NO: 388331 - DNA, 25 bp, Homo sapien
gaggtaaagcaggacccttgcagac

SEQ ID NO: 388332 - DNA, 25 bp, Homo sapien
ggtccacgaacacggcggccatgca

SEQ ID NO: 388333 - DNA, 25 bp, Homo sapien
atgaggctgcagtcgttgaccagga

SEQ ID NO: 388334 - DNA, 25 bp, Homo sapien
ggctgcagtcgttgaccaggaagct

SEQ ID NO: 388335 - DNA, 25 bp, Homo sapien
agctgagggctttcacgatctggtg

SEQ ID NO: 388336 - DNA, 25 bp, Homo sapien
gagggctttcacgatctggtgtagc

SEQ ID NO: 388337 - DNA, 25 bp, Homo sapien
ggtgtagcccccaggagatctccag

SEQ ID NO: 388338 - DNA, 25 bp, Homo sapien
ctccactctcgccttgaggtatatt

SEQ ID NO: 388339 - DNA, 25 bp, Homo sapien
tcgccttgaggtatattcccaacgg

SEQ ID NO: 388340 - DNA, 25 bp, Homo sapien
gtcacagcctctgtcacgacgtgga

SEQ ID NO: 388341 - DNA, 25 bp, Homo sapien
ttgccctgggccgaatacatgtagt

SEQ ID NO: 388342 - DNA, 25 bp, Homo sapien
gccgaatacatgtagtccaggcccc

SEQ ID NO: 388343 - DNA, 25 bp, Homo sapien
tgtgaaacacttcctctccagcagt

SEQ ID NO: 388344 - DNA, 25 bp, Homo sapien
gtgttgggaaagttctggacctcta

SEQ ID NO: 388345 - DNA, 25 bp, Homo sapien
gaaagttctggacctctactggatc

SEQ ID NO: 388346 - DNA, 25 bp, Homo sapien
ggacctctactggatctagccataa

SEQ ID NO: 388347 - DNA, 25 bp, Homo sapien
ggatctagccataaatggtggtctt

SEQ ID NO: 388348 - DNA, 25 bp, Homo sapien
ccataaatggtggtcttcagaaaaa

SEQ ID NO: 388349 - DNA, 25 bp, Homo sapien
agcctcatgccatgcaggcagcaag

SEQ ID NO: 388350 - DNA, 25 bp, Homo sapien
gcagcaagccatcctgaacagcgtt

SEQ ID NO: 388351 - DNA, 25 bp, Homo sapien
agggcagagaaggaaccctaagatt

SEQ ID NO: 388352 - DNA, 25 bp, Homo sapien
taagattagcatagagccactcatc

SEQ ID NO: 388353 - DNA, 25 bp, Homo sapien
tagcatagagccactcatctctcct

SEQ ID NO: 388354 - DNA, 25 bp, Homo sapien
cagggctggcagttccatctaggag

SEQ ID NO: 388355 - DNA, 25 bp, Homo sapien
atctaggagggtgcctctaggcccc

SEQ ID NO: 388356 - DNA, 25 bp, Homo sapien
gccccactctcaggctaggatggag

SEQ ID NO: 388357 - DNA, 25 bp, Homo sapien
ggacaggtgcccgaacacagggtct

SEQ ID NO: 388358 - DNA, 25 bp, Homo sapien
gtgcccgaacacagggtctccagga

SEQ ID NO: 388359 - DNA, 25 bp, Homo sapien
cccgcatacttgaatgtatgtgcgt

SEQ ID NO: 388360 - DNA, 25 bp, Homo sapien
gtatgtgcgtatttattgctcacgt

SEQ ID NO: 388361 - DNA, 25 bp, Homo sapien
tatttattgctcacgtctgtgccat

SEQ ID NO: 388362 - DNA, 25 bp, Homo sapien
tcacgtctgtgccatgttgtcaatg

SEQ ID NO: 388363 - DNA, 25 bp, Homo sapien
catgttgtcaatgggtcctttccaa

SEQ ID NO: 388364 - DNA, 25 bp, Homo sapien
tttccaacccaagaggtacatttgt

SEQ ID NO: 388365 - DNA, 25 bp, Homo sapien
tttacatactcaaacgtgactcctt

SEQ ID NO: 388366 - DNA, 25 bp, Homo sapien
actcaaacgtgactccttaagactg

SEQ ID NO: 388367 - DNA, 25 bp, Homo sapien
gactgactttaacatgttctttcaa

SEQ ID NO: 388368 - DNA, 25 bp, Homo sapien
gttctttcaactttattcaaatcag

SEQ ID NO: 388369 - DNA, 25 bp, Homo sapien
tttattcaaatcagatggccccctc

SEQ ID NO: 388370 - DNA, 25 bp, Homo sapien
ggtgatgttcactttaatcctgttt

SEQ ID NO: 388371 - DNA, 25 bp, Homo sapien
tgttcactttaatcctgtttgcctt

SEQ ID NO: 388372 - DNA, 25 bp, Homo sapien
tcactttaatcctgtttgccttcac

SEQ ID NO: 388373 - DNA, 25 bp, Homo sapien
gccactgtcgtgagccttcattcca

SEQ ID NO: 388374 - DNA, 25 bp, Homo sapien
ttcattccaggccacatacacaaag

SEQ ID NO: 388375 - DNA, 25 bp, Homo sapien
ttccaggccacatacacaaagaggg

SEQ ID NO: 388376 - DNA, 25 bp, Homo sapien
gaggcttaatacacccaacattata

SEQ ID NO: 388377 - DNA, 25 bp, Homo sapien
ggctatgggagttctgaagcagaaa

SEQ ID NO: 388378 - DNA, 25 bp, Homo sapien
ttaataccagataccctaatcccag

SEQ ID NO: 388379 - DNA, 25 bp, Homo sapien
agataccctaatcccagtcctaact

SEQ ID NO: 388380 - DNA, 25 bp, Homo sapien
tcctaacttcatttaaccttggtca

SEQ ID NO: 388381 - DNA, 25 bp, Homo sapien
aaccttggtcacattgagtcattcc

SEQ ID NO: 388382 - DNA, 25 bp, Homo sapien
ggtcacattgagtcattccaggatg

SEQ ID NO: 388383 - DNA, 25 bp, Homo sapien
ttgagtcattccaggatgagtggct

SEQ ID NO: 388384 - DNA, 25 bp, Homo sapien
gtggctcaagtatttcctcagggaa

SEQ ID NO: 388385 - DNA, 25 bp, Homo sapien
ctcagggaaaatacttctgtgcccc

SEQ ID NO: 388386 - DNA, 25 bp, Homo sapien
gtttcctgaggcttaatacacccaa

SEQ ID NO: 388387 - DNA, 25 bp, Homo sapien
accgctgaccctgtgtgaagagaga

SEQ ID NO: 388388 - DNA, 25 bp, Homo sapien
tggtgcgttactgccatctaatggg

SEQ ID NO: 388389 - DNA, 25 bp, Homo sapien
cagttgggaaaagcagctgtgcatt

SEQ ID NO: 388390 - DNA, 25 bp, Homo sapien
gcatttaagggtagggctttctgaa

SEQ ID NO: 388391 - DNA, 25 bp, Homo sapien
gaaggatttctgatacagtccagaa

SEQ ID NO: 388392 - DNA, 25 bp, Homo sapien
atgacacagcagttgccatcttgaa

SEQ ID NO: 388393 - DNA, 25 bp, Homo sapien
tgccatcttgaaaaatgccctttcc

SEQ ID NO: 388394 - DNA, 25 bp, Homo sapien
gggtgttttgaagtctaatacaact

SEQ ID NO: 388395 - DNA, 25 bp, Homo sapien
acaactatcatcacaaggtccctgg

SEQ ID NO: 388396 - DNA, 25 bp, Homo sapien
caaggtccctggactaaggctggat

SEQ ID NO: 388397 - DNA, 25 bp, Homo sapien
gactaaggctggatcgtgtaattta

SEQ ID NO: 388398 - DNA, 25 bp, Homo sapien
atggcaaacccaggccttggttctc

SEQ ID NO: 388399 - DNA, 25 bp, Homo sapien
aaacccaggccttggttctcacctg

SEQ ID NO: 388400 - DNA, 25 bp, Homo sapien
ttctcacctgggttctgtggccgaa

SEQ ID NO: 388401 - DNA, 25 bp, Homo sapien
tgcccctctgaaacgtcaaccagaa

SEQ ID NO: 388402 - DNA, 25 bp, Homo sapien
tgaaacgtcaaccagaaagctctga

SEQ ID NO: 388403 - DNA, 25 bp, Homo sapien
aggagccctaaacccaggctggaga

SEQ ID NO: 388404 - DNA, 25 bp, Homo sapien
taaacccaggctggagattgggcaa

SEQ ID NO: 388405 - DNA, 25 bp, Homo sapien
tgggcaaaatctccggaaactccct

SEQ ID NO: 388406 - DNA, 25 bp, Homo sapien
agggccgagataagcggcccgcact

SEQ ID NO: 388407 - DNA, 25 bp, Homo sapien
gtgtgaagttctgaaggtgcccctc

SEQ ID NO: 388408 - DNA, 25 bp, Homo sapien
tgaagttctgaaggtgcccctccgc

SEQ ID NO: 388409 - DNA, 25 bp, Homo sapien
aaaaaactagtccaggtcacacagc

SEQ ID NO: 388410 - DNA, 25 bp, Homo sapien
gcaagtagcagcagttcttaaatcc

SEQ ID NO: 388411 - DNA, 25 bp, Homo sapien
agtagcagcagttcttaaatccaag

SEQ ID NO: 388412 - DNA, 25 bp, Homo sapien
gcagcagttcttaaatccaagcgag

SEQ ID NO: 388413 - DNA, 25 bp, Homo sapien
gttcttaaatccaagcgagcagttt

SEQ ID NO: 388414 - DNA, 25 bp, Homo sapien
aaatccaagcgagcagtttctcacc

SEQ ID NO: 388415 - DNA, 25 bp, Homo sapien
agcagtttctcaccttttttcccag

SEQ ID NO: 388416 - DNA, 25 bp, Homo sapien
tttctcaccttttttcccagccatt

SEQ ID NO: 388417 - DNA, 25 bp, Homo sapien
ttttttcccagccatttgctttatt

SEQ ID NO: 388418 - DNA, 25 bp, Homo sapien
tttcccagccatttgctttattaaa

SEQ ID NO: 388419 - DNA, 25 bp, Homo sapien
ttacaagatgcttccatatatttga

SEQ ID NO: 388420 - DNA, 25 bp, Homo sapien
ttcccacttgtggtcagttcaagcc

SEQ ID NO: 388421 - DNA, 25 bp, Homo sapien
caccagccacacatgggctaatggt

SEQ ID NO: 388422 - DNA, 25 bp, Homo sapien
taatggtgctaagtggcatccccac

SEQ ID NO: 388423 - DNA, 25 bp, Homo sapien
aagctgcttgtttgggcaagaagag

SEQ ID NO: 388424 - DNA, 25 bp, Homo sapien
caagaagagagatgccccgtgatgc

SEQ ID NO: 388425 - DNA, 25 bp, Homo sapien
atgccccgtgatgccgaagagcaag

SEQ ID NO: 388426 - DNA, 25 bp, Homo sapien
caagttatggtggaggcctgagcat

SEQ ID NO: 388427 - DNA, 25 bp, Homo sapien
tgagagctctggtcacaccacgccg

SEQ ID NO: 388428 - DNA, 25 bp, Homo sapien
gaggaccggacggtgcccttgcttc

SEQ ID NO: 388429 - DNA, 25 bp, Homo sapien
acatgggcaggtgtttttctggcgc

SEQ ID NO: 388430 - DNA, 25 bp, Homo sapien
aggtgtttttctggcgcactctctg

SEQ ID NO: 388431 - DNA, 25 bp, Homo sapien
gcccctccaacatatctactggaaa

SEQ ID NO: 388432 - DNA, 25 bp, Homo sapien
tactggaaattctgctggttaactt

SEQ ID NO: 388433 - DNA, 25 bp, Homo sapien
tgctggttaactttatctctctctc

SEQ ID NO: 388434 - DNA, 25 bp, Homo sapien
cttaatttagactttcaacctatga

SEQ ID NO: 388435 - DNA, 25 bp, Homo sapien
aactaaactatcagtcatttacatc

SEQ ID NO: 388436 - DNA, 25 bp, Homo sapien
aggacacagcaaacaggacacattt

SEQ ID NO: 388437 - DNA, 25 bp, Homo sapien
aacaggacacatttgcctgcttctc

SEQ ID NO: 388438 - DNA, 25 bp, Homo sapien
cctgcttctctcttgcctaattctt

SEQ ID NO: 388439 - DNA, 25 bp, Homo sapien
cctaattcttcctgacctgtattta

SEQ ID NO: 388440 - DNA, 25 bp, Homo sapien
tcctgacctgtatttactgatgctt

SEQ ID NO: 388441 - DNA, 25 bp, Homo sapien
ggttcatttcccatttcagcggaaa

SEQ ID NO: 388442 - DNA, 25 bp, Homo sapien
actttgtgactctttggtgtggccc

SEQ ID NO: 388443 - DNA, 25 bp, Homo sapien
tgtgactctttggtgtggccctgga

SEQ ID NO: 388444 - DNA, 25 bp, Homo sapien
cacttgacaactcctttaaggcttc

SEQ ID NO: 388445 - DNA, 25 bp, Homo sapien
cttaacacgggatccctgtggtggt

SEQ ID NO: 388446 - DNA, 25 bp, Homo sapien
acacgggatccctgtggtggtgttt

SEQ ID NO: 388447 - DNA, 25 bp, Homo sapien
ccccagctgaagcatggcaatctgg

SEQ ID NO: 388448 - DNA, 25 bp, Homo sapien
tgaagcatggcaatctggctgctct

SEQ ID NO: 388449 - DNA, 25 bp, Homo sapien
agcatggcaatctggctgctctcta

SEQ ID NO: 388450 - DNA, 25 bp, Homo sapien
atggcaatctggctgctctctacag

SEQ ID NO: 388451 - DNA, 25 bp, Homo sapien
caatctggctgctctctacagggac

SEQ ID NO: 388452 - DNA, 25 bp, Homo sapien
atctggctgctctctacagggaccc

SEQ ID NO: 388453 - DNA, 25 bp, Homo sapien
ccgctacacctggacgtgacgtggg

SEQ ID NO: 388454 - DNA, 25 bp, Homo sapien
ggacctgttgctctgcatcaacatg

SEQ ID NO: 388455 - DNA, 25 bp, Homo sapien
ttgctctgcatcaacatggcccatg

SEQ ID NO: 388456 - DNA, 25 bp, Homo sapien
ggctcttcagagcagcaggacacct

SEQ ID NO: 388457 - DNA, 25 bp, Homo sapien
gcaggacacctgctcaaacccaggg

SEQ ID NO: 388458 - DNA, 25 bp, Homo sapien
tatgccatcaatgggaagatctccc

SEQ ID NO: 388459 - DNA, 25 bp, Homo sapien
atgggaagatctccccccagagcaa

SEQ ID NO: 388460 - DNA, 25 bp, Homo sapien
gagcaacgtggactttgacctgatg

SEQ ID NO: 388461 - DNA, 25 bp, Homo sapien
gtggactttgacctgatgctcagat

SEQ ID NO: 388462 - DNA, 25 bp, Homo sapien
gactttgacctgatgctcagatgca

SEQ ID NO: 388463 - DNA, 25 bp, Homo sapien
gacctgatgctcagatgcaggaacc

SEQ ID NO: 388464 - DNA, 25 bp, Homo sapien
gcacacagtggatcactttgatatt

SEQ ID NO: 388465 - DNA, 25 bp, Homo sapien
gatatttttaatagtccaagtctgg

SEQ ID NO: 388466 - DNA, 25 bp, Homo sapien
gattttatttattcctgagccaaca

SEQ ID NO: 388467 - DNA, 25 bp, Homo sapien
gcatattttccatgtttctgactgt

SEQ ID NO: 388468 - DNA, 25 bp, Homo sapien
ttttcctcattgttccattgtaaat

SEQ ID NO: 388469 - DNA, 25 bp, Homo sapien
atattcctcttgttggaactctttt

SEQ ID NO: 388470 - DNA, 25 bp, Homo sapien
ggaactctttttaatcctgagattt

SEQ ID NO: 388471 - DNA, 25 bp, Homo sapien
taaacctgtacctttcaattgtctg

SEQ ID NO: 388472 - DNA, 25 bp, Homo sapien
gtctgtgacctttcaatttcacttt

SEQ ID NO: 388473 - DNA, 25 bp, Homo sapien
tttgtaaatctctcagaagcttgaa

SEQ ID NO: 388474 - DNA, 25 bp, Homo sapien
gcttgaaaatatcttgtctctaccc

SEQ ID NO: 388475 - DNA, 25 bp, Homo sapien
tgatttcccaagactctctttgtgg

SEQ ID NO: 388476 - DNA, 25 bp, Homo sapien
ccaagactctctttgtggcttttga

SEQ ID NO: 388477 - DNA, 25 bp, Homo sapien
agactctctttgtggcttttgaggg

SEQ ID NO: 388478 - DNA, 25 bp, Homo sapien
cttttgagggtcagccaaggagcag

SEQ ID NO: 388479 - DNA, 25 bp, Homo sapien
gaaggaccattttagcttaacactt

SEQ ID NO: 388480 - DNA, 25 bp, Homo sapien
ggagataccatttgactcttgatga

SEQ ID NO: 388481 - DNA, 25 bp, Homo sapien
tgactcttgatgagagttgtacgaa

SEQ ID NO: 388482 - DNA, 25 bp, Homo sapien
atgagggatgattccaggcgtttta

SEQ ID NO: 388483 - DNA, 25 bp, Homo sapien
gggaaggctgcagataccattctaa

SEQ ID NO: 388484 - DNA, 25 bp, Homo sapien
aaggctgcagataccattctaaccc

SEQ ID NO: 388485 - DNA, 25 bp, Homo sapien
taacccccaagatactgtgttctca

SEQ ID NO: 388486 - DNA, 25 bp, Homo sapien
acctccgtttcctgcttaagtgcat

SEQ ID NO: 388487 - DNA, 25 bp, Homo sapien
tccgtttcctgcttaagtgcattcc

SEQ ID NO: 388488 - DNA, 25 bp, Homo sapien
acgttgatggcctccttggcactgg

SEQ ID NO: 388489 - DNA, 25 bp, Homo sapien
cttggcactggtctcaaagtaggga

SEQ ID NO: 388490 - DNA, 25 bp, Homo sapien
ttgtggccacttgtctgttttcgag

SEQ ID NO: 388491 - DNA, 25 bp, Homo sapien
acttgtctgttttcgaggtcaatct

SEQ ID NO: 388492 - DNA, 25 bp, Homo sapien
aggtcaatcttgtttcccaacacaa

SEQ ID NO: 388493 - DNA, 25 bp, Homo sapien
cttgtttcccaacacaacaaatggg

SEQ ID NO: 388494 - DNA, 25 bp, Homo sapien
ggatgagaaactcatctctccagct

SEQ ID NO: 388495 - DNA, 25 bp, Homo sapien
atctctccagctatctagggttttg

SEQ ID NO: 388496 - DNA, 25 bp, Homo sapien
ctccagctatctagggttttgaatg

SEQ ID NO: 388497 - DNA, 25 bp, Homo sapien
aattctattggctcttagtcacttg

SEQ ID NO: 388498 - DNA, 25 bp, Homo sapien
tggctcttagtcacttggaactgat

SEQ ID NO: 388499 - DNA, 25 bp, Homo sapien
ttggaactgattaattctgactttc

SEQ ID NO: 388500 - DNA, 25 bp, Homo sapien
ttctgagcaccaaacggttaacacg

SEQ ID NO: 388501 - DNA, 25 bp, Homo sapien
taacacgaatgtccactagaactct

SEQ ID NO: 388502 - DNA, 25 bp, Homo sapien
gaatgtccactagaactctgctgtg

SEQ ID NO: 388503 - DNA, 25 bp, Homo sapien
gaactctgctgtgtgtcacccttaa

SEQ ID NO: 388504 - DNA, 25 bp, Homo sapien
tgtgtgtcacccttaaatcagtcta

SEQ ID NO: 388505 - DNA, 25 bp, Homo sapien
gtcacccttaaatcagtctaaatct

SEQ ID NO: 388506 - DNA, 25 bp, Homo sapien
ataggaggtaggatttctgtgttaa

SEQ ID NO: 388507 - DNA, 25 bp, Homo sapien
aggatttctgtgttaagactcttat

SEQ ID NO: 388508 - DNA, 25 bp, Homo sapien
ccgctacacctggacgtgacgtggg

SEQ ID NO: 388509 - DNA, 25 bp, Homo sapien
actggggcgggatcctgccacagtc

SEQ ID NO: 388510 - DNA, 25 bp, Homo sapien
ggacctgttgctctgcatcaacatg

SEQ ID NO: 388511 - DNA, 25 bp, Homo sapien
gacctgttgctctgcatcaacatgg

SEQ ID NO: 388512 - DNA, 25 bp, Homo sapien
acctgttgctctgcatcaacatggc

SEQ ID NO: 388513 - DNA, 25 bp, Homo sapien
tgttgctctgcatcaacatggccca

SEQ ID NO: 388514 - DNA, 25 bp, Homo sapien
ttgctctgcatcaacatggcccatg

SEQ ID NO: 388515 - DNA, 25 bp, Homo sapien
gctctgcatcaacatggcccatgtc

SEQ ID NO: 388516 - DNA, 25 bp, Homo sapien
tctgcatcaacatggcccatgtcag

SEQ ID NO: 388517 - DNA, 25 bp, Homo sapien
ctgcgctgcacggaggggctcttca

SEQ ID NO: 388518 - DNA, 25 bp, Homo sapien
gcaggacacctgctcaaacccaggg

SEQ ID NO: 388519 - DNA, 25 bp, Homo sapien
ggtaatattcagagacagttgttgt

SEQ ID NO: 388520 - DNA, 25 bp, Homo sapien
attcagagacagttgttgtgatcag

SEQ ID NO: 388521 - DNA, 25 bp, Homo sapien
gacagttgttgtgatcagatggctt

SEQ ID NO: 388522 - DNA, 25 bp, Homo sapien
agttgttgtgatcagatggcttaga

SEQ ID NO: 388523 - DNA, 25 bp, Homo sapien
gtgatcagatggcttagagaaattt

SEQ ID NO: 388524 - DNA, 25 bp, Homo sapien
tttctggaatattcacattcgaaga

SEQ ID NO: 388525 - DNA, 25 bp, Homo sapien
tgtctttgacttaaatctaaccaaa

SEQ ID NO: 388526 - DNA, 25 bp, Homo sapien
tgacttaaatctaaccaaaaactgc

SEQ ID NO: 388527 - DNA, 25 bp, Homo sapien
aaactgcaacattattctttgtaca

SEQ ID NO: 388528 - DNA, 25 bp, Homo sapien
atagtgttaacaagcttagttgcaa

SEQ ID NO: 388529 - DNA, 25 bp, Homo sapien
gttaacaagcttagttgcaaacaaa

SEQ ID NO: 388530 - DNA, 25 bp, Homo sapien
tttaatgagtggttcagccatcacc

SEQ ID NO: 388531 - DNA, 25 bp, Homo sapien
accagtggccacctgttcaataaaa

SEQ ID NO: 388532 - DNA, 25 bp, Homo sapien
aaaattgcctagcaccacagtggag

SEQ ID NO: 388533 - DNA, 25 bp, Homo sapien
agtggagagtcatctacaccccaag

SEQ ID NO: 388534 - DNA, 25 bp, Homo sapien
caccccaaggtgagctgtaagactg

SEQ ID NO: 388535 - DNA, 25 bp, Homo sapien
agactggccaattctttgaagacct

SEQ ID NO: 388536 - DNA, 25 bp, Homo sapien
gaagccaggctctttaatgttccaa

SEQ ID NO: 388537 - DNA, 25 bp, Homo sapien
taatgttccaagtcagctgtgcctc

SEQ ID NO: 388538 - DNA, 25 bp, Homo sapien
ctcacacaaggctctctttttagct

SEQ ID NO: 388539 - DNA, 25 bp, Homo sapien
tcaagactttgtatctgtgcagcat

SEQ ID NO: 388540 - DNA, 25 bp, Homo sapien
ctgtgcagcattttatggaaatcac

SEQ ID NO: 388541 - DNA, 25 bp, Homo sapien
ttaatccttgtgatagtaaatgcat

SEQ ID NO: 388542 - DNA, 25 bp, Homo sapien
atccttgtgatagtaaatgcattga

SEQ ID NO: 388543 - DNA, 25 bp, Homo sapien
ccttgtgatagtaaatgcattgata

SEQ ID NO: 388544 - DNA, 25 bp, Homo sapien
aatgcattgataattaacaggaaaa

SEQ ID NO: 388545 - DNA, 25 bp, Homo sapien
ataatctacaaatgagaacccaaat

SEQ ID NO: 388546 - DNA, 25 bp, Homo sapien
gtagtgttttgtttgacagaagtaa

SEQ ID NO: 388547 - DNA, 25 bp, Homo sapien
tataatgcaaaatttcaggacagtt

SEQ ID NO: 388548 - DNA, 25 bp, Homo sapien
aatgcaaaatttcaggacagttaat

SEQ ID NO: 388549 - DNA, 25 bp, Homo sapien
caaaatttcaggacagttaatttgg

SEQ ID NO: 388550 - DNA, 25 bp, Homo sapien
ataaggagaagaggtgtggttcaaa

SEQ ID NO: 388551 - DNA, 25 bp, Homo sapien
gaagaggtgtggttcaaagaaaatt

SEQ ID NO: 388552 - DNA, 25 bp, Homo sapien
aatagctcattcactgccttgattc

SEQ ID NO: 388553 - DNA, 25 bp, Homo sapien
attcactgccttgattccttttgcc

SEQ ID NO: 388554 - DNA, 25 bp, Homo sapien
tgccaacaattttaccagcagttat

SEQ ID NO: 388555 - DNA, 25 bp, Homo sapien
ttaccagcagttatacctaacatat

SEQ ID NO: 388556 - DNA, 25 bp, Homo sapien
gcaattttctcttggtgctacctga

SEQ ID NO: 388557 - DNA, 25 bp, Homo sapien
gctacctgatggaattcctgcactt

SEQ ID NO: 388558 - DNA, 25 bp, Homo sapien
aaagttctggctgactaaacaagat

SEQ ID NO: 388559 - DNA, 25 bp, Homo sapien
aatgatgatctctttcttgcaaatg

SEQ ID NO: 388560 - DNA, 25 bp, Homo sapien
tacggtgtatgtccagtggcctcca

SEQ ID NO: 388561 - DNA, 25 bp, Homo sapien
gtccagtggcctccagcagatcatg

SEQ ID NO: 388562 - DNA, 25 bp, Homo sapien
tgacatcatggacccaatagctcat

SEQ ID NO: 388563 - DNA, 25 bp, Homo sapien
gaattccctatagatctttttgaaa

SEQ ID NO: 388564 - DNA, 25 bp, Homo sapien
ggtacctgggtatcacacatagaac

SEQ ID NO: 388565 - DNA, 25 bp, Homo sapien
gggtatcacacatagaacttttaat

SEQ ID NO: 388566 - DNA, 25 bp, Homo sapien
gaacttttaattctgctggtgtagg

SEQ ID NO: 388567 - DNA, 25 bp, Homo sapien
gctggtgtaggctgttgcccaaaca

SEQ ID NO: 388568 - DNA, 25 bp, Homo sapien
ggctgttgcccaaacatctataatt

SEQ ID NO: 388569 - DNA, 25 bp, Homo sapien
tactgagctcttcaagtgattctga

SEQ ID NO: 388570 - DNA, 25 bp, Homo sapien
taaaccaatagccaagtgttcttta

SEQ ID NO: 388571 - DNA, 25 bp, Homo sapien
tgttctttaaataggaggcaccctt

SEQ ID NO: 388572 - DNA, 25 bp, Homo sapien
ggcacccttcccattgtgccaaaat

SEQ ID NO: 388573 - DNA, 25 bp, Homo sapien
ttcccattgtgccaaaatcatcttt

SEQ ID NO: 388574 - DNA, 25 bp, Homo sapien
caagttcagtgatatttcaagcatg

SEQ ID NO: 388575 - DNA, 25 bp, Homo sapien
cagtgatatttcaagcatgatgttt

SEQ ID NO: 388576 - DNA, 25 bp, Homo sapien
ttcaagcatgatgttttgagtttga

SEQ ID NO: 388577 - DNA, 25 bp, Homo sapien
aaatgtatttgtgaggacacatcac

SEQ ID NO: 388578 - DNA, 25 bp, Homo sapien
tgtatttgtgaggacacatcacttt

SEQ ID NO: 388579 - DNA, 25 bp, Homo sapien
ttgtgaggacacatcactttaatta

SEQ ID NO: 388580 - DNA, 25 bp, Homo sapien
tgaggacacatcactttaattaaaa

SEQ ID NO: 388581 - DNA, 25 bp, Homo sapien
cagagtgagatttctgagaggagaa

SEQ ID NO: 388582 - DNA, 25 bp, Homo sapien
gtagatggcagttattgagagtggg

SEQ ID NO: 388583 - DNA, 25 bp, Homo sapien
aagaaaagtatggttaacattgcca

SEQ ID NO: 388584 - DNA, 25 bp, Homo sapien
cattctccatatgatagttttagat

SEQ ID NO: 388585 - DNA, 25 bp, Homo sapien
aatgtcttcatcttagtgtaatagg

SEQ ID NO: 388586 - DNA, 25 bp, Homo sapien
atgtcttcatcttagtgtaataggg

SEQ ID NO: 388587 - DNA, 25 bp, Homo sapien
gtcttcatcttagtgtaatagggat

SEQ ID NO: 388588 - DNA, 25 bp, Homo sapien
cccaagatgcagagtagaaattagg

SEQ ID NO: 388589 - DNA, 25 bp, Homo sapien
agagtagaaattaggcagctgggat

SEQ ID NO: 388590 - DNA, 25 bp, Homo sapien
gaaattaggcagctgggatgccaaa

SEQ ID NO: 388591 - DNA, 25 bp, Homo sapien
aattaggcagctgggatgccaaaca

SEQ ID NO: 388592 - DNA, 25 bp, Homo sapien
tgtttttttgctgggctttaccttg

SEQ ID NO: 388593 - DNA, 25 bp, Homo sapien
taattttctgaacttcattctgctc

SEQ ID NO: 388594 - DNA, 25 bp, Homo sapien
acttcattctgctcatctgaaaaat

SEQ ID NO: 388595 - DNA, 25 bp, Homo sapien
cttcattctgctcatctgaaaaatg

SEQ ID NO: 388596 - DNA, 25 bp, Homo sapien
ttttattctgaatgcatgatctcaa

SEQ ID NO: 388597 - DNA, 25 bp, Homo sapien
gaatgcatgatctcaagccttaact

SEQ ID NO: 388598 - DNA, 25 bp, Homo sapien
gcatgatctcaagccttaactacta

SEQ ID NO: 388599 - DNA, 25 bp, Homo sapien
gccttaactactataatctttttct

SEQ ID NO: 388600 - DNA, 25 bp, Homo sapien
ctgcccctcagaaattgaataacct

SEQ ID NO: 388601 - DNA, 25 bp, Homo sapien
gaataacctaaccaagatgccttta

SEQ ID NO: 388602 - DNA, 25 bp, Homo sapien
gggatgccctaagtaaatgtaattt

SEQ ID NO: 388603 - DNA, 25 bp, Homo sapien
ttcctctctaagtgttccttccctt

SEQ ID NO: 388604 - DNA, 25 bp, Homo sapien
ttctcctgctctccatcatgttatg

SEQ ID NO: 388605 - DNA, 25 bp, Homo sapien
catcatgttatggagaccagtgagg

SEQ ID NO: 388606 - DNA, 25 bp, Homo sapien
gaccagtgaggaaccagtgttaact

SEQ ID NO: 388607 - DNA, 25 bp, Homo sapien
agtcctttccctgttgagtcaatta

SEQ ID NO: 388608 - DNA, 25 bp, Homo sapien
tttacatagaggtgagactgtgaat

SEQ ID NO: 388609 - DNA, 25 bp, Homo sapien
gtagattagtgtgaatgaccagggt

SEQ ID NO: 388610 - DNA, 25 bp, Homo sapien
atgaccagggtggaatgtttttgaa

SEQ ID NO: 388611 - DNA, 25 bp, Homo sapien
agcaaaaactggttgacattcacaa

SEQ ID NO: 388612 - DNA, 25 bp, Homo sapien
ggttgacattcacaaactgttcttt

SEQ ID NO: 388613 - DNA, 25 bp, Homo sapien
ttggacccttaaatatgactaaaat

SEQ ID NO: 388614 - DNA, 25 bp, Homo sapien
acagcaatattgttacatacgggtt

SEQ ID NO: 388615 - DNA, 25 bp, Homo sapien
atacgggttatatgccaactctgtt

SEQ ID NO: 388616 - DNA, 25 bp, Homo sapien
ggttatatgccaactctgtttgaaa

SEQ ID NO: 388617 - DNA, 25 bp, Homo sapien
aacagctgaattgtcttggttatta

SEQ ID NO: 388618 - DNA, 25 bp, Homo sapien
aagtacattcactaggagaagtagt

SEQ ID NO: 388619 - DNA, 25 bp, Homo sapien
ataagagctctagaatcaaaatcag

SEQ ID NO: 388620 - DNA, 25 bp, Homo sapien
gggaagcagcatggatgacccttga

SEQ ID NO: 388621 - DNA, 25 bp, Homo sapien
ataagtcagccataagaagacaaat

SEQ ID NO: 388622 - DNA, 25 bp, Homo sapien
gggtgattccacttctatgaggtct

SEQ ID NO: 388623 - DNA, 25 bp, Homo sapien
gtgattccacttctatgaggtctct

SEQ ID NO: 388624 - DNA, 25 bp, Homo sapien
ttccacttctatgaggtctctaaag

SEQ ID NO: 388625 - DNA, 25 bp, Homo sapien
gaggtctctaaagtagtcacattta

SEQ ID NO: 388626 - DNA, 25 bp, Homo sapien
ttgcaaagaacagtgtgaatatact

SEQ ID NO: 388627 - DNA, 25 bp, Homo sapien
aatactactgaactatacgctgaaa

SEQ ID NO: 388628 - DNA, 25 bp, Homo sapien
gaactatacgctgaaaaatggtgaa

SEQ ID NO: 388629 - DNA, 25 bp, Homo sapien
gaacaagtatgccacatcgaagcat

SEQ ID NO: 388630 - DNA, 25 bp, Homo sapien
gtatgccacatcgaagcatgctaag

SEQ ID NO: 388631 - DNA, 25 bp, Homo sapien
gaagcatgctaagatcagcactcta

SEQ ID NO: 388632 - DNA, 25 bp, Homo sapien
taagatcagcactctaccacagctg

SEQ ID NO: 388633 - DNA, 25 bp, Homo sapien
taccacagctgaattctgcactagt

SEQ ID NO: 388634 - DNA, 25 bp, Homo sapien
agctgaattctgcactagttcaaga

SEQ ID NO: 388635 - DNA, 25 bp, Homo sapien
tctgcactagttcaagatttagcca

SEQ ID NO: 388636 - DNA, 25 bp, Homo sapien
ctagttcaagatttagccaaggctg

SEQ ID NO: 388637 - DNA, 25 bp, Homo sapien
ccaaggctgtggcaaaggtgtaact

SEQ ID NO: 388638 - DNA, 25 bp, Homo sapien
gctgtggcaaaggtgtaacttgtaa

SEQ ID NO: 388639 - DNA, 25 bp, Homo sapien
acttgagttggagtactatatttac

SEQ ID NO: 388640 - DNA, 25 bp, Homo sapien
gaaaattttacttccataggacata

SEQ ID NO: 388641 - DNA, 25 bp, Homo sapien
cttccataggacatactgcatgtaa

SEQ ID NO: 388642 - DNA, 25 bp, Homo sapien
tactgcatgtaagccaagtcatgga

SEQ ID NO: 388643 - DNA, 25 bp, Homo sapien
taagccaagtcatggagaatctgct

SEQ ID NO: 388644 - DNA, 25 bp, Homo sapien
tttcttcttgtgattgctgccataa

SEQ ID NO: 388645 - DNA, 25 bp, Homo sapien
cttcttgtgattgctgccataattc

SEQ ID NO: 388646 - DNA, 25 bp, Homo sapien
ttaccactatttaagttatcaactt

SEQ ID NO: 388647 - DNA, 25 bp, Homo sapien
gttatcaactttagctagtatcttc

SEQ ID NO: 388648 - DNA, 25 bp, Homo sapien
gctagtatcttcaaactttcacttt

SEQ ID NO: 388649 - DNA, 25 bp, Homo sapien
gaattttatattctaagccagtttt

SEQ ID NO: 388650 - DNA, 25 bp, Homo sapien
attctaagccagttttcattttggt

SEQ ID NO: 388651 - DNA, 25 bp, Homo sapien
ggaaatattcccatcaaatggttaa

SEQ ID NO: 388652 - DNA, 25 bp, Homo sapien
gaaaaagtccttccaagatgatttt

SEQ ID NO: 388653 - DNA, 25 bp, Homo sapien
gtggaaattggtattatctctgttt

SEQ ID NO: 388654 - DNA, 25 bp, Homo sapien
ttatctctgttttatgcacttacat

SEQ ID NO: 388655 - DNA, 25 bp, Homo sapien
tgttttatgcacttacatttatccc

SEQ ID NO: 388656 - DNA, 25 bp, Homo sapien
tgcacttacatttatcccttacatt

SEQ ID NO: 388657 - DNA, 25 bp, Homo sapien
ttgtttttagtgaccctacatgaca

SEQ ID NO: 388658 - DNA, 25 bp, Homo sapien
ttagtgaccctacatgacattaaat

SEQ ID NO: 388659 - DNA, 25 bp, Homo sapien
gtgaccctacatgacattaaattta

SEQ ID NO: 388660 - DNA, 25 bp, Homo sapien
gttaccttttggcttgagaatgtct

SEQ ID NO: 388661 - DNA, 25 bp, Homo sapien
ttgagaatgtctttcagctccagaa

SEQ ID NO: 388662 - DNA, 25 bp, Homo sapien
catgcttcttatagtgttagggtga

SEQ ID NO: 388663 - DNA, 25 bp, Homo sapien
ttagggtgagagctcactgtcttcc

SEQ ID NO: 388664 - DNA, 25 bp, Homo sapien
tctcactcaacttcacctttcataa

SEQ ID NO: 388665 - DNA, 25 bp, Homo sapien
caacttcacctttcataatcacaca

SEQ ID NO: 388666 - DNA, 25 bp, Homo sapien
tgtaatattcatagatcagttcccc

SEQ ID NO: 388667 - DNA, 25 bp, Homo sapien
catagatcagttccccctagggtaa

SEQ ID NO: 388668 - DNA, 25 bp, Homo sapien
ttctgtcaagactgcaggattgttc

SEQ ID NO: 388669 - DNA, 25 bp, Homo sapien
attgttctgaagactaagccctcct

SEQ ID NO: 388670 - DNA, 25 bp, Homo sapien
gttctgaagactaagccctcctcaa

SEQ ID NO: 388671 - DNA, 25 bp, Homo sapien
ggtgaattattggtctattgagatc

SEQ ID NO: 388672 - DNA, 25 bp, Homo sapien
ggtctattgagatcatgcttcttat

SEQ ID NO: 388673 - DNA, 25 bp, Homo sapien
ttttttaaatccctcttcgcttgct

SEQ ID NO: 388674 - DNA, 25 bp, Homo sapien
aatccctcttcgcttgctttatttt

SEQ ID NO: 388675 - DNA, 25 bp, Homo sapien
gctttattttcagtaccaacttgtt

SEQ ID NO: 388676 - DNA, 25 bp, Homo sapien
tcagtaccaacttgttatctttttc

SEQ ID NO: 388677 - DNA, 25 bp, Homo sapien
tttttccttatctgaggctacctgg

SEQ ID NO: 388678 - DNA, 25 bp, Homo sapien
ctggactcccagaaatgctgagggt

SEQ ID NO: 388679 - DNA, 25 bp, Homo sapien
aaatgctgagggtccctcttccagg

SEQ ID NO: 388680 - DNA, 25 bp, Homo sapien
tattcccgagggtcctgtggtcagg

SEQ ID NO: 388681 - DNA, 25 bp, Homo sapien
ggtcctgtggtcagggtcctgcttt

SEQ ID NO: 388682 - DNA, 25 bp, Homo sapien
tgctttgtccctggcaggctgtcag

SEQ ID NO: 388683 - DNA, 25 bp, Homo sapien
tggagtctctgggtgttccttcagc

SEQ ID NO: 388684 - DNA, 25 bp, Homo sapien
agtattttgagaattgccatattaa

SEQ ID NO: 388685 - DNA, 25 bp, Homo sapien
ggaaaacttaataaattgctactgt

SEQ ID NO: 388686 - DNA, 25 bp, Homo sapien
aaattgctactgttttatatcataa

SEQ ID NO: 388687 - DNA, 25 bp, Homo sapien
ataccatggtaatatttgcaaaagg

SEQ ID NO: 388688 - DNA, 25 bp, Homo sapien
atatttgcaaaaggtctggccatac

SEQ ID NO: 388689 - DNA, 25 bp, Homo sapien
tttgcaaaaggtctggccataccag

SEQ ID NO: 388690 - DNA, 25 bp, Homo sapien
tggccataccagaaaagtacagttg

SEQ ID NO: 388691 - DNA, 25 bp, Homo sapien
gatataaccacaagtcagagtacat

SEQ ID NO: 388692 - DNA, 25 bp, Homo sapien
acaagtcagagtacattggttgtat

SEQ ID NO: 388693 - DNA, 25 bp, Homo sapien
ggttgtattttgtaaactttcatga

SEQ ID NO: 388694 - DNA, 25 bp, Homo sapien
gtgacaaatgtggtagactaaaggt

SEQ ID NO: 388695 - DNA, 25 bp, Homo sapien
gctgggtcttgctgttttcctgacg

SEQ ID NO: 388696 - DNA, 25 bp, Homo sapien
gctgttttcctgacgctgaccacag

SEQ ID NO: 388697 - DNA, 25 bp, Homo sapien
gaccacagcggatctaggtggctat

SEQ ID NO: 388698 - DNA, 25 bp, Homo sapien
tctaggtggctatttcgttggtgca

SEQ ID NO: 388699 - DNA, 25 bp, Homo sapien
tatttcgttggtgcacaggcgttca

SEQ ID NO: 388700 - DNA, 25 bp, Homo sapien
gtgcacaggcgttcacagaggcaga

SEQ ID NO: 388701 - DNA, 25 bp, Homo sapien
gaaagttgtcaaacagattcacaga

SEQ ID NO: 388702 - DNA, 25 bp, Homo sapien
ttcacagactgtcaaagtgcggctt

SEQ ID NO: 388703 - DNA, 25 bp, Homo sapien
aagtgcggcttaaaccgagttcctg

SEQ ID NO: 388704 - DNA, 25 bp, Homo sapien
taaaccgagttcctgggctccctca

SEQ ID NO: 388705 - DNA, 25 bp, Homo sapien
tcactggcttcgtccacttaaactt

SEQ ID NO: 388706 - DNA, 25 bp, Homo sapien
tggggagacccaaacatcaagctgg

SEQ ID NO: 388707 - DNA, 25 bp, Homo sapien
ctcagctgagtccttagggagggaa

SEQ ID NO: 388708 - DNA, 25 bp, Homo sapien
atcctggggtctgcccagcttgaaa

SEQ ID NO: 388709 - DNA, 25 bp, Homo sapien
aaggccctgaatcaggccaggcagg

SEQ ID NO: 388710 - DNA, 25 bp, Homo sapien
gcctgggagtcctgctcctttgctg

SEQ ID NO: 388711 - DNA, 25 bp, Homo sapien
tcctgctttacctccctgtactttg

SEQ ID NO: 388712 - DNA, 25 bp, Homo sapien
tgctttacctccctgtactttgcac

SEQ ID NO: 388713 - DNA, 25 bp, Homo sapien
tttacctccctgtactttgcaccgg

SEQ ID NO: 388714 - DNA, 25 bp, Homo sapien
cctgtactttgcaccggccagggag

SEQ ID NO: 388715 - DNA, 25 bp, Homo sapien
ctgtactttgcaccggccagggagg

SEQ ID NO: 388716 - DNA, 25 bp, Homo sapien
ctttgcaccggccagggaggagggt

SEQ ID NO: 388717 - DNA, 25 bp, Homo sapien
aaaatccaaacgcattcgactctct

SEQ ID NO: 388718 - DNA, 25 bp, Homo sapien
aacgcattcgactctctaaatgtga

SEQ ID NO: 388719 - DNA, 25 bp, Homo sapien
ttcgactctctaaatgtgattaatt

SEQ ID NO: 388720 - DNA, 25 bp, Homo sapien
cttgcttttgagattggagaccact

SEQ ID NO: 388721 - DNA, 25 bp, Homo sapien
gagattggagaccacttttgcattt

SEQ ID NO: 388722 - DNA, 25 bp, Homo sapien
gagaccacttttgcatttggccagg

SEQ ID NO: 388723 - DNA, 25 bp, Homo sapien
ttggccaggctgtcttgcggagccc

SEQ ID NO: 388724 - DNA, 25 bp, Homo sapien
gagctatttgccgagatcgtgcggc

SEQ ID NO: 388725 - DNA, 25 bp, Homo sapien
gatcgtgcggcagatgaactacgcg

SEQ ID NO: 388726 - DNA, 25 bp, Homo sapien
tgcggcagatgaactacgcggcgca

SEQ ID NO: 388727 - DNA, 25 bp, Homo sapien
ccaacggcgatgagggctgctgctc

SEQ ID NO: 388728 - DNA, 25 bp, Homo sapien
ttgatttcttcttttcacccacagc

SEQ ID NO: 388729 - DNA, 25 bp, Homo sapien
aattgtatccattctgttttcaccg

SEQ ID NO: 388730 - DNA, 25 bp, Homo sapien
gttttcaccgtctcttgtactggtc

SEQ ID NO: 388731 - DNA, 25 bp, Homo sapien
ggtctcctttctattgtaactgtca

SEQ ID NO: 388732 - DNA, 25 bp, Homo sapien
gtaactgtcatcatcctaactcaag

SEQ ID NO: 388733 - DNA, 25 bp, Homo sapien
actcaagatccttctgtagctttcc

SEQ ID NO: 388734 - DNA, 25 bp, Homo sapien
tagctttccccggttattggaatat

SEQ ID NO: 388735 - DNA, 25 bp, Homo sapien
gaatatccttattacgactgccacc

SEQ ID NO: 388736 - DNA, 25 bp, Homo sapien
caccttttctaatccagtctgttta

SEQ ID NO: 388737 - DNA, 25 bp, Homo sapien
gtctgtttactactgccgggttaat

SEQ ID NO: 388738 - DNA, 25 bp, Homo sapien
ttaatttccccaaactgcatgtctg

SEQ ID NO: 388739 - DNA, 25 bp, Homo sapien
tattgggcacctactttgtgcccgc

SEQ ID NO: 388740 - DNA, 25 bp, Homo sapien
actttgtgcccgctcatttcaggtg

SEQ ID NO: 388741 - DNA, 25 bp, Homo sapien
ccgctcatttcaggtgcctaggaat

SEQ ID NO: 388742 - DNA, 25 bp, Homo sapien
tttcaggtgcctaggaatacaacac

SEQ ID NO: 388743 - DNA, 25 bp, Homo sapien
atagaccaaaaaacaccgccctcat

SEQ ID NO: 388744 - DNA, 25 bp, Homo sapien
gaccaaaaaacaccgccctcataga

SEQ ID NO: 388745 - DNA, 25 bp, Homo sapien
gccctcatagagcttgtattttagt

SEQ ID NO: 388746 - DNA, 25 bp, Homo sapien
catagagcttgtattttagtgaata

SEQ ID NO: 388747 - DNA, 25 bp, Homo sapien
caactaaaatttgatgggtttcatg

SEQ ID NO: 388748 - DNA, 25 bp, Homo sapien
taaatgctcagcctaactagaacat

SEQ ID NO: 388749 - DNA, 25 bp, Homo sapien
ctcagcctaactagaacatagcaat

SEQ ID NO: 388750 - DNA, 25 bp, Homo sapien
tgcggctgctcagggacagtccagc

SEQ ID NO: 388751 - DNA, 25 bp, Homo sapien
gctcagggacagtccagcggctcag

SEQ ID NO: 388752 - DNA, 25 bp, Homo sapien
agcggctcaggaggacaatgaccat

SEQ ID NO: 388753 - DNA, 25 bp, Homo sapien
ggaggacaatgaccatgccagagac

SEQ ID NO: 388754 - DNA, 25 bp, Homo sapien
gaccatgccagagacggtttccaaa

SEQ ID NO: 388755 - DNA, 25 bp, Homo sapien
ccagagacggtttccaaatgaagct

SEQ ID NO: 388756 - DNA, 25 bp, Homo sapien
ttcgccccggaggaactggtggtgc

SEQ ID NO: 388757 - DNA, 25 bp, Homo sapien
gcagttagttgctgactcggatgca

SEQ ID NO: 388758 - DNA, 25 bp, Homo sapien
ttagttgctgactcggatgcagaga

SEQ ID NO: 388759 - DNA, 25 bp, Homo sapien
ggatgcagagagtcggtaacacctt

SEQ ID NO: 388760 - DNA, 25 bp, Homo sapien
cagagagtcggtaacaccttctcca

SEQ ID NO: 388761 - DNA, 25 bp, Homo sapien
tctgaatcaagcacactgtatgttc

SEQ ID NO: 388762 - DNA, 25 bp, Homo sapien
gcacactgtatgttcagtaggttga

SEQ ID NO: 388763 - DNA, 25 bp, Homo sapien
gtaggttgaactatgaacactgtca

SEQ ID NO: 388764 - DNA, 25 bp, Homo sapien
aacactgtcatcaatgttcagttca

SEQ ID NO: 388765 - DNA, 25 bp, Homo sapien
tcatcaatgttcagttcaaaagcct

SEQ ID NO: 388766 - DNA, 25 bp, Homo sapien
gcctgaaagtttagatctagaagct

SEQ ID NO: 388767 - DNA, 25 bp, Homo sapien
gggaaccattgttgtcttcacttaa

SEQ ID NO: 388768 - DNA, 25 bp, Homo sapien
ccattgttgtcttcacttaatccat

SEQ ID NO: 388769 - DNA, 25 bp, Homo sapien
cacttaatccatttagcactattta

SEQ ID NO: 388770 - DNA, 25 bp, Homo sapien
aagcacaccaagttatatgactaat

SEQ ID NO: 388771 - DNA, 25 bp, Homo sapien
ataactcttgaggatgtaatgcatt

SEQ ID NO: 388772 - DNA, 25 bp, Homo sapien
aagcaaacctttcaaatgagagtga

SEQ ID NO: 388773 - DNA, 25 bp, Homo sapien
atgttctttatttcacgaaatcgtc

SEQ ID NO: 388774 - DNA, 25 bp, Homo sapien
tcacgaaatcgtcaatcttaagcat

SEQ ID NO: 388775 - DNA, 25 bp, Homo sapien
gtcaatcttaagcatgagcagggat

SEQ ID NO: 388776 - DNA, 25 bp, Homo sapien
gagcagggataaacaactcctagaa

SEQ ID NO: 388777 - DNA, 25 bp, Homo sapien
aaggaactcaattcattcttcctgg

SEQ ID NO: 388778 - DNA, 25 bp, Homo sapien
atgatagtccccaatcgtttcttta

SEQ ID NO: 388779 - DNA, 25 bp, Homo sapien
gtccccaatcgtttctttataggag

SEQ ID NO: 388780 - DNA, 25 bp, Homo sapien
ataggaggttattacatttcattac

SEQ ID NO: 388781 - DNA, 25 bp, Homo sapien
atttcattacagtcactgcattttg

SEQ ID NO: 388782 - DNA, 25 bp, Homo sapien
ttgactgttgtgtttagaatttgaa

SEQ ID NO: 388783 - DNA, 25 bp, Homo sapien
atggagatcgttaggtctccctcca

SEQ ID NO: 388784 - DNA, 25 bp, Homo sapien
atcgttaggtctccctccaaaccag

SEQ ID NO: 388785 - DNA, 25 bp, Homo sapien
caaaccagcctgcatgatactcatt

SEQ ID NO: 388786 - DNA, 25 bp, Homo sapien
tgcatgatactcattgcactccagc

SEQ ID NO: 388787 - DNA, 25 bp, Homo sapien
gggtggctaaggctgacattacaaa

SEQ ID NO: 388788 - DNA, 25 bp, Homo sapien
aggctgacattacaaataagttcca

SEQ ID NO: 388789 - DNA, 25 bp, Homo sapien
agttccagagagtgaagtccagcct

SEQ ID NO: 388790 - DNA, 25 bp, Homo sapien
cagagagtgaagtccagcctgtgag

SEQ ID NO: 388791 - DNA, 25 bp, Homo sapien
tgtgagaggcccatagcactgccct

SEQ ID NO: 388792 - DNA, 25 bp, Homo sapien
gcactgccctttagaggatcaacat

SEQ ID NO: 388793 - DNA, 25 bp, Homo sapien
gccctttagaggatcaacatggaga

SEQ ID NO: 388794 - DNA, 25 bp, Homo sapien
gtggaatcagtttttggactgtgac

SEQ ID NO: 388795 - DNA, 25 bp, Homo sapien
tcagtttttggactgtgacccatgc

SEQ ID NO: 388796 - DNA, 25 bp, Homo sapien
cagtttttggactgtgacccatgca

SEQ ID NO: 388797 - DNA, 25 bp, Homo sapien
tgttgggggacaaggagttgcttca

SEQ ID NO: 388798 - DNA, 25 bp, Homo sapien
gagttagtgcagtgcgcctccaagg

SEQ ID NO: 388799 - DNA, 25 bp, Homo sapien
agttagtgcagtgcgcctccaaggg

SEQ ID NO: 388800 - DNA, 25 bp, Homo sapien
gttagtgcagtgcgcctccaagggg

SEQ ID NO: 388801 - DNA, 25 bp, Homo sapien
ttagtgcagtgcgcctccaaggggc

SEQ ID NO: 388802 - DNA, 25 bp, Homo sapien
agtgcagtgcgcctccaaggggcag

SEQ ID NO: 388803 - DNA, 25 bp, Homo sapien
gtgcagtgcgcctccaaggggcagt

SEQ ID NO: 388804 - DNA, 25 bp, Homo sapien
tgcagtgcgcctccaaggggcagtg

SEQ ID NO: 388805 - DNA, 25 bp, Homo sapien
agctggcaaggttcatagaatataa

SEQ ID NO: 388806 - DNA, 25 bp, Homo sapien
agaatataatggctatccccctctg

SEQ ID NO: 388807 - DNA, 25 bp, Homo sapien
aaataagactatccacaacccagct

SEQ ID NO: 388808 - DNA, 25 bp, Homo sapien
aacccagctcagacacagtggttat

SEQ ID NO: 388809 - DNA, 25 bp, Homo sapien
acagtggttatatgattttgtgtcc

SEQ ID NO: 388810 - DNA, 25 bp, Homo sapien
tttgtgtccatacaggagaggcctt

SEQ ID NO: 388811 - DNA, 25 bp, Homo sapien
acaggagaggccttggtgtcttcac

SEQ ID NO: 388812 - DNA, 25 bp, Homo sapien
cacatacattctctgagccaacatc

SEQ ID NO: 388813 - DNA, 25 bp, Homo sapien
tctgagccaacatctatccagcagc

SEQ ID NO: 388814 - DNA, 25 bp, Homo sapien
ccctgacctcctgctataatttaag

SEQ ID NO: 388815 - DNA, 25 bp, Homo sapien
gtatattggcaactccacagcttat

SEQ ID NO: 388816 - DNA, 25 bp, Homo sapien
gaaaagcaagagatgggatgccata

SEQ ID NO: 388817 - DNA, 25 bp, Homo sapien
gatgccataatagtaaacagccctt

SEQ ID NO: 388818 - DNA, 25 bp, Homo sapien
acagcccttgtgttggatgtaaccc

SEQ ID NO: 388819 - DNA, 25 bp, Homo sapien
cttgtgttggatgtaacccaatccc

SEQ ID NO: 388820 - DNA, 25 bp, Homo sapien
tttgagtgtgtgttgattatttttt

SEQ ID NO: 388821 - DNA, 25 bp, Homo sapien
ttttgtcttccacttttctattatg

SEQ ID NO: 388822 - DNA, 25 bp, Homo sapien
ttctgcagacattttcctctcagat

SEQ ID NO: 388823 - DNA, 25 bp, Homo sapien
gcagacattttcctctcagatagga

SEQ ID NO: 388824 - DNA, 25 bp, Homo sapien
cctctcagataggatgacattttgt

SEQ ID NO: 388825 - DNA, 25 bp, Homo sapien
attattttgtctttcctcatgaatg

SEQ ID NO: 388826 - DNA, 25 bp, Homo sapien
tttgtctttcctcatgaatgcactg

SEQ ID NO: 388827 - DNA, 25 bp, Homo sapien
gtaaatacctaacacaccaagaatg

SEQ ID NO: 388828 - DNA, 25 bp, Homo sapien
accaagaatgtgcagtgaacctcag

SEQ ID NO: 388829 - DNA, 25 bp, Homo sapien
gtgaacctcaggcatttaagacacc

SEQ ID NO: 388830 - DNA, 25 bp, Homo sapien
gtgtggtcccaaaacaagccaacag

SEQ ID NO: 388831 - DNA, 25 bp, Homo sapien
aagccaacagctgtatatctcaaaa

SEQ ID NO: 388832 - DNA, 25 bp, Homo sapien
gctgtatatctcaaaagttaaccca

SEQ ID NO: 388833 - DNA, 25 bp, Homo sapien
agttaacccaagacaactctgatat

SEQ ID NO: 388834 - DNA, 25 bp, Homo sapien
gagactcattggtactgactggcaa

SEQ ID NO: 388835 - DNA, 25 bp, Homo sapien
gtactgactggcaagtattctgctt

SEQ ID NO: 388836 - DNA, 25 bp, Homo sapien
actggcaagtattctgctttaaagt

SEQ ID NO: 388837 - DNA, 25 bp, Homo sapien
aaatgtttagacagcatgtgtttta

SEQ ID NO: 388838 - DNA, 25 bp, Homo sapien
aatcagtgtataatcacaatggagt

SEQ ID NO: 388839 - DNA, 25 bp, Homo sapien
cagtgtataatcacaatggagtata

SEQ ID NO: 388840 - DNA, 25 bp, Homo sapien
aatcacaatggagtatattggcaac

SEQ ID NO: 388841 - DNA, 25 bp, Homo sapien
atcacaatggagtatattggcaact

SEQ ID NO: 388842 - DNA, 25 bp, Homo sapien
tcacaatggagtatattggcaactc

SEQ ID NO: 388843 - DNA, 25 bp, Homo sapien
gagtatattggcaactccacagctt

SEQ ID NO: 388844 - DNA, 25 bp, Homo sapien
agtatattggcaactccacagctta

SEQ ID NO: 388845 - DNA, 25 bp, Homo sapien
gtatattggcaactccacagcttat

SEQ ID NO: 388846 - DNA, 25 bp, Homo sapien
tatattggcaactccacagcttata

SEQ ID NO: 388847 - DNA, 25 bp, Homo sapien
atattggcaactccacagcttatag

SEQ ID NO: 388848 - DNA, 25 bp, Homo sapien
tattggcaactccacagcttatagt

SEQ ID NO: 388849 - DNA, 25 bp, Homo sapien
caggaaaggccccattgcagaaaaa

SEQ ID NO: 388850 - DNA, 25 bp, Homo sapien
gaaaggccccattgcagaaaaaaat

SEQ ID NO: 388851 - DNA, 25 bp, Homo sapien
aaatgagggagggaacaggtggata

SEQ ID NO: 388852 - DNA, 25 bp, Homo sapien
aatgagggagggaacaggtggataa

SEQ ID NO: 388853 - DNA, 25 bp, Homo sapien
atgagggagggaacaggtggataac

SEQ ID NO: 388854 - DNA, 25 bp, Homo sapien
tgagggagggaacaggtggataact

SEQ ID NO: 388855 - DNA, 25 bp, Homo sapien
gagggagggaacaggtggataactg

SEQ ID NO: 388856 - DNA, 25 bp, Homo sapien
ggctcttgggtcagaacaagaattt

SEQ ID NO: 388857 - DNA, 25 bp, Homo sapien
ttaagctgttcattcaaccaaaaaa

SEQ ID NO: 388858 - DNA, 25 bp, Homo sapien
taagctgttcattcaaccaaaaaat

SEQ ID NO: 388859 - DNA, 25 bp, Homo sapien
aaaatgagtgggtagctgggtgtgg

SEQ ID NO: 388860 - DNA, 25 bp, Homo sapien
cctggagtgcctgcctagcaaggag

SEQ ID NO: 388861 - DNA, 25 bp, Homo sapien
aggagcatgtggatgtcattgccaa

SEQ ID NO: 388862 - DNA, 25 bp, Homo sapien
gtttgcccagcttgagtttcagctg

SEQ ID NO: 388863 - DNA, 25 bp, Homo sapien
cagagcgggccaaagccatttttga

SEQ ID NO: 388864 - DNA, 25 bp, Homo sapien
atttttgagaacacgctgagcacct

SEQ ID NO: 388865 - DNA, 25 bp, Homo sapien
acagatgtctggtcggtctatatcg

SEQ ID NO: 388866 - DNA, 25 bp, Homo sapien
atgaccatcaagcacggcagccaga

SEQ ID NO: 388867 - DNA, 25 bp, Homo sapien
gcagccagaaggacgtccgggacat

SEQ ID NO: 388868 - DNA, 25 bp, Homo sapien
acgtccgggacatctttgagcgggt

SEQ ID NO: 388869 - DNA, 25 bp, Homo sapien
agcgggtcattcatctgagcttggc

SEQ ID NO: 388870 - DNA, 25 bp, Homo sapien
gaagttcttcttcaagcgctacctg

SEQ ID NO: 388871 - DNA, 25 bp, Homo sapien
ctggtgattggtttaaaactgattt

SEQ ID NO: 388872 - DNA, 25 bp, Homo sapien
aatgctagcataaattagattgact

SEQ ID NO: 388873 - DNA, 25 bp, Homo sapien
atgctagcataaattagattgacta

SEQ ID NO: 388874 - DNA, 25 bp, Homo sapien
tgctagcataaattagattgactat

SEQ ID NO: 388875 - DNA, 25 bp, Homo sapien
gtgactgtagtagttaatgtaacac

SEQ ID NO: 388876 - DNA, 25 bp, Homo sapien
tgactgtagtagttaatgtaacaca

SEQ ID NO: 388877 - DNA, 25 bp, Homo sapien
gactgtagtagttaatgtaacacat

SEQ ID NO: 388878 - DNA, 25 bp, Homo sapien
actgtagtagttaatgtaacacatt

SEQ ID NO: 388879 - DNA, 25 bp, Homo sapien
ctgtagtagttaatgtaacacattt

SEQ ID NO: 388880 - DNA, 25 bp, Homo sapien
gtagttaatgtaacacattttgtat

SEQ ID NO: 388881 - DNA, 25 bp, Homo sapien
acacattttgtataaagtacagttt

SEQ ID NO: 388882 - DNA, 25 bp, Homo sapien
gtggaaattggtattatctctgttt

SEQ ID NO: 388883 - DNA, 25 bp, Homo sapien
ttatctctgttttatgcacttacat

SEQ ID NO: 388884 - DNA, 25 bp, Homo sapien
atctctgttttatgcacttacattt

SEQ ID NO: 388885 - DNA, 25 bp, Homo sapien
tgttttatgcacttacatttatccc

SEQ ID NO: 388886 - DNA, 25 bp, Homo sapien
ttgtttttagtgaccctacatgaca

SEQ ID NO: 388887 - DNA, 25 bp, Homo sapien
ttagtgaccctacatgacattaaat

SEQ ID NO: 388888 - DNA, 25 bp, Homo sapien
gtgaccctacatgacattaaattta

SEQ ID NO: 388889 - DNA, 25 bp, Homo sapien
gttaccttttggcttgagaatgtct

SEQ ID NO: 388890 - DNA, 25 bp, Homo sapien
accttttggcttgagaatgtctttc

SEQ ID NO: 388891 - DNA, 25 bp, Homo sapien
ggcttgagaatgtctttcagctcca

SEQ ID NO: 388892 - DNA, 25 bp, Homo sapien
ttgagaatgtctttcagctccagaa

SEQ ID NO: 388893 - DNA, 25 bp, Homo sapien
gcacagctgacttggaacattaaag

SEQ ID NO: 388894 - DNA, 25 bp, Homo sapien
ctataggtcaccagtgatttccata

SEQ ID NO: 388895 - DNA, 25 bp, Homo sapien
aggtcttcaaagaattggccagtct

SEQ ID NO: 388896 - DNA, 25 bp, Homo sapien
ggtgtagatgactctccactgtggt

SEQ ID NO: 388897 - DNA, 25 bp, Homo sapien
tctccactgtggtgctaggcaattt

SEQ ID NO: 388898 - DNA, 25 bp, Homo sapien
cactgtggtgctaggcaattttatt

SEQ ID NO: 388899 - DNA, 25 bp, Homo sapien
caattttattgaacaggtggccact

SEQ ID NO: 388900 - DNA, 25 bp, Homo sapien
ggtgatggctgaaccactcattaaa

SEQ ID NO: 388901 - DNA, 25 bp, Homo sapien
gaaccactcattaaacaaattgctc

SEQ ID NO: 388902 - DNA, 25 bp, Homo sapien
atgctgcacagatacaaagtcttga

SEQ ID NO: 388903 - DNA, 25 bp, Homo sapien
aaagagagccttgtgtgaggcacag

SEQ ID NO: 388904 - DNA, 25 bp, Homo sapien
agcttctgctttagtctggccagtg

SEQ ID NO: 388905 - DNA, 25 bp, Homo sapien
agtgtcatggttttctcaggagggc

SEQ ID NO: 388906 - DNA, 25 bp, Homo sapien
gagggccattgaggcggacattccc

SEQ ID NO: 388907 - DNA, 25 bp, Homo sapien
gaggcggacattcccaaatatccaa

SEQ ID NO: 388908 - DNA, 25 bp, Homo sapien
aaatatccaactctgcttcatgctc

SEQ ID NO: 388909 - DNA, 25 bp, Homo sapien
tccaggtcacaactcccaaaggaga

SEQ ID NO: 388910 - DNA, 25 bp, Homo sapien
aggcatggctctctgcctctgatca

SEQ ID NO: 388911 - DNA, 25 bp, Homo sapien
gatcaccatcactgtatctcaaggt

SEQ ID NO: 388912 - DNA, 25 bp, Homo sapien
ctgtatctcaaggttcagcagcaga

SEQ ID NO: 388913 - DNA, 25 bp, Homo sapien
aagaagaccagtcgtccaagacggc

SEQ ID NO: 388914 - DNA, 25 bp, Homo sapien
aagacggcagctgttcacaagcact

SEQ ID NO: 388915 - DNA, 25 bp, Homo sapien
gcaaatgactccaagctggtctcta

SEQ ID NO: 388916 - DNA, 25 bp, Homo sapien
tggtctctaagccaatacccttata

SEQ ID NO: 388917 - DNA, 25 bp, Homo sapien
agagcccaggaaagacagctcgagt

SEQ ID NO: 388918 - DNA, 25 bp, Homo sapien
acagctcgagtgtataattctctgg

SEQ ID NO: 388919 - DNA, 25 bp, Homo sapien
attctctggagctcaattctatgca

SEQ ID NO: 388920 - DNA, 25 bp, Homo sapien
tggagctcaattctatgcagttgtg

SEQ ID NO: 388921 - DNA, 25 bp, Homo sapien
gcagttgtgctgatatttcattaag

SEQ ID NO: 388922 - DNA, 25 bp, Homo sapien
gtgttgatacattaaaagtcgcttt

SEQ ID NO: 388923 - DNA, 25 bp, Homo sapien
aaagtcgctttatggaagatgagta

SEQ ID NO: 388924 - DNA, 25 bp, Homo sapien
ttccttgttaacttctacagatcag

SEQ ID NO: 388925 - DNA, 25 bp, Homo sapien
acttctacagatcagggcatgcaac

SEQ ID NO: 388926 - DNA, 25 bp, Homo sapien
aaggggtgcctaaatctagacttgg

SEQ ID NO: 388927 - DNA, 25 bp, Homo sapien
aaatctagacttggggtccacaccg

SEQ ID NO: 388928 - DNA, 25 bp, Homo sapien
tccacaccgggcagcggggttgcaa

SEQ ID NO: 388929 - DNA, 25 bp, Homo sapien
gggttgcaacccagcacctggtagg

SEQ ID NO: 388930 - DNA, 25 bp, Homo sapien
gttgcaacccagcacctggtaggct

SEQ ID NO: 388931 - DNA, 25 bp, Homo sapien
ttgcaacccagcacctggtaggctc

SEQ ID NO: 388932 - DNA, 25 bp, Homo sapien
ccagcacctggtaggctccatttct

SEQ ID NO: 388933 - DNA, 25 bp, Homo sapien
cagcacctggtaggctccatttctt

SEQ ID NO: 388934 - DNA, 25 bp, Homo sapien
atttcttcccaagcccgagcagagg

SEQ ID NO: 388935 - DNA, 25 bp, Homo sapien
ttcttcccaagcccgagcagagggt

SEQ ID NO: 388936 - DNA, 25 bp, Homo sapien
tcccaagcccgagcagagggtcatg

SEQ ID NO: 388937 - DNA, 25 bp, Homo sapien
gaaagtggtatcagtactcatgatg

SEQ ID NO: 388938 - DNA, 25 bp, Homo sapien
ggttactactgaacaaattcacatt

SEQ ID NO: 388939 - DNA, 25 bp, Homo sapien
aaattcacatttcaggaacacctct

SEQ ID NO: 388940 - DNA, 25 bp, Homo sapien
ttcaggaacacctctatctttggtt

SEQ ID NO: 388941 - DNA, 25 bp, Homo sapien
gaacacctctatctttggtttaaat

SEQ ID NO: 388942 - DNA, 25 bp, Homo sapien
ttttccgtctaaaaatcatactggt

SEQ ID NO: 388943 - DNA, 25 bp, Homo sapien
aaatggtttcattctctgcaatatg

SEQ ID NO: 388944 - DNA, 25 bp, Homo sapien
actttctggtactgtaaagaacctg

SEQ ID NO: 388945 - DNA, 25 bp, Homo sapien
gggtgattaatccagtattctttac

SEQ ID NO: 388946 - DNA, 25 bp, Homo sapien
aatccagtattctttaccctgaatg

SEQ ID NO: 388947 - DNA, 25 bp, Homo sapien
tctttaccctgaatgtttggatatt

SEQ ID NO: 388948 - DNA, 25 bp, Homo sapien
gggtgataccccaggaccagtccat

SEQ ID NO: 388949 - DNA, 25 bp, Homo sapien
tgataccccaggaccagtccattgt

SEQ ID NO: 388950 - DNA, 25 bp, Homo sapien
aggaccagtccattgtccgaacctc

SEQ ID NO: 388951 - DNA, 25 bp, Homo sapien
ccattgtccgaacctctcttgctgt

SEQ ID NO: 388952 - DNA, 25 bp, Homo sapien
gggaactgtatcccacaatgatccg

SEQ ID NO: 388953 - DNA, 25 bp, Homo sapien
agccactgccagacacggtgcagga

SEQ ID NO: 388954 - DNA, 25 bp, Homo sapien
cactgccagacacggtgcaggacct

SEQ ID NO: 388955 - DNA, 25 bp, Homo sapien
aaagggaaacagacgcgacagcaac

SEQ ID NO: 388956 - DNA, 25 bp, Homo sapien
aaacagacgcgacagcaacaagagc

SEQ ID NO: 388957 - DNA, 25 bp, Homo sapien
gagcaccagaagtatatggtcccac

SEQ ID NO: 388958 - DNA, 25 bp, Homo sapien
ccagaagtatatggtcccactgcag

SEQ ID NO: 388959 - DNA, 25 bp, Homo sapien
gaaagcaaggggtgcctaaatctag

SEQ ID NO: 388960 - DNA, 25 bp, Homo sapien
aaagcaaggggtgcctaaatctaga

SEQ ID NO: 388961 - DNA, 25 bp, Homo sapien
tccacaccgggcagcggggttgcaa

SEQ ID NO: 388962 - DNA, 25 bp, Homo sapien
gggttgcaacccagcacctggtagg

SEQ ID NO: 388963 - DNA, 25 bp, Homo sapien
ggttgcaacccagcacctggtaggc

SEQ ID NO: 388964 - DNA, 25 bp, Homo sapien
gttgcaacccagcacctggtaggct

SEQ ID NO: 388965 - DNA, 25 bp, Homo sapien
ttgcaacccagcacctggtaggctc

SEQ ID NO: 388966 - DNA, 25 bp, Homo sapien
tgcaacccagcacctggtaggctcc

SEQ ID NO: 388967 - DNA, 25 bp, Homo sapien
gcaacccagcacctggtaggctcca

SEQ ID NO: 388968 - DNA, 25 bp, Homo sapien
aacccagcacctggtaggctccatt

SEQ ID NO: 388969 - DNA, 25 bp, Homo sapien
ccagcacctggtaggctccatttct

SEQ ID NO: 388970 - DNA, 25 bp, Homo sapien
cacccgcctcaggaggtagggacaa

SEQ ID NO: 388971 - DNA, 25 bp, Homo sapien
gggtggctttgcagaccctgagaat

SEQ ID NO: 388972 - DNA, 25 bp, Homo sapien
accctgagaatgaatattgtcctgc

SEQ ID NO: 388973 - DNA, 25 bp, Homo sapien
atattgtcctgcatacacagccagt

SEQ ID NO: 388974 - DNA, 25 bp, Homo sapien
tgtcctgcatacacagccagtggca

SEQ ID NO: 388975 - DNA, 25 bp, Homo sapien
atacacagccagtggcacgagaggc

SEQ ID NO: 388976 - DNA, 25 bp, Homo sapien
gcacgagaggcgacgaagatactga

SEQ ID NO: 388977 - DNA, 25 bp, Homo sapien
ggcgacgaagatactgaaggtcaca

SEQ ID NO: 388978 - DNA, 25 bp, Homo sapien
actgaaggtcacagagggccagagc

SEQ ID NO: 388979 - DNA, 25 bp, Homo sapien
agggcttgagcaccctctctccagg

SEQ ID NO: 388980 - DNA, 25 bp, Homo sapien
cttcagacctccgggcaggaaaaga

SEQ ID NO: 388981 - DNA, 25 bp, Homo sapien
caggaaaggccccattgcagaaaaa

SEQ ID NO: 388982 - DNA, 25 bp, Homo sapien
gaaaggccccattgcagaaaaaaat

SEQ ID NO: 388983 - DNA, 25 bp, Homo sapien
atgagggagggaacaggtggataac

SEQ ID NO: 388984 - DNA, 25 bp, Homo sapien
tgagggagggaacaggtggataact

SEQ ID NO: 388985 - DNA, 25 bp, Homo sapien
aaaggctcttgggtcagaacaagaa

SEQ ID NO: 388986 - DNA, 25 bp, Homo sapien
aaggctcttgggtcagaacaagaat

SEQ ID NO: 388987 - DNA, 25 bp, Homo sapien
ggctcttgggtcagaacaagaattt

SEQ ID NO: 388988 - DNA, 25 bp, Homo sapien
ttaagctgttcattcaaccaaaaaa

SEQ ID NO: 388989 - DNA, 25 bp, Homo sapien
taagctgttcattcaaccaaaaaat

SEQ ID NO: 388990 - DNA, 25 bp, Homo sapien
aagctgttcattcaaccaaaaaatg

SEQ ID NO: 388991 - DNA, 25 bp, Homo sapien
aaaatgagtgggtagctgggtgtgg

SEQ ID NO: 388992 - DNA, 25 bp, Homo sapien
ggctccatttcttcccaagcccgag

SEQ ID NO: 388993 - DNA, 25 bp, Homo sapien
gctccatttcttcccaagcccgagc

SEQ ID NO: 388994 - DNA, 25 bp, Homo sapien
ctccatttcttcccaagcccgagca

SEQ ID NO: 388995 - DNA, 25 bp, Homo sapien
tccatttcttcccaagcccgagcag

SEQ ID NO: 388996 - DNA, 25 bp, Homo sapien
ccatttcttcccaagcccgagcaga

SEQ ID NO: 388997 - DNA, 25 bp, Homo sapien
catttcttcccaagcccgagcagag

SEQ ID NO: 388998 - DNA, 25 bp, Homo sapien
atttcttcccaagcccgagcagagg

SEQ ID NO: 388999 - DNA, 25 bp, Homo sapien
tttcttcccaagcccgagcagaggg

SEQ ID NO: 389000 - DNA, 25 bp, Homo sapien
ttcttcccaagcccgagcagagggt

SEQ ID NO: 389001 - DNA, 25 bp, Homo sapien
cccagggaggagatggtccaactcc

SEQ ID NO: 389002 - DNA, 25 bp, Homo sapien
agatggtccaactcctgatcagttt

SEQ ID NO: 389003 - DNA, 25 bp, Homo sapien
actcctgatcagttttgtgtccgat

SEQ ID NO: 389004 - DNA, 25 bp, Homo sapien
atcagttttgtgtccgatggagcag

SEQ ID NO: 389005 - DNA, 25 bp, Homo sapien
gtgaagacactggaactagctgggt

SEQ ID NO: 389006 - DNA, 25 bp, Homo sapien
acactggaactagctgggtcctggg

SEQ ID NO: 389007 - DNA, 25 bp, Homo sapien
gctttgggcctaaaagggcagcctg

SEQ ID NO: 389008 - DNA, 25 bp, Homo sapien
cctaaaagggcagcctgaacctgga

SEQ ID NO: 389009 - DNA, 25 bp, Homo sapien
tgaacctggagtcttatctccccca

SEQ ID NO: 389010 - DNA, 25 bp, Homo sapien
ccccaggaaatcaagcgctgcttct

SEQ ID NO: 389011 - DNA, 25 bp, Homo sapien
aagcgctgcttctcagctcctgtgg

SEQ ID NO: 389012 - DNA, 25 bp, Homo sapien
agccctaaggtgctctcccagccgt

SEQ ID NO: 389013 - DNA, 25 bp, Homo sapien
agccgtccgacctggatctccaaga

SEQ ID NO: 389014 - DNA, 25 bp, Homo sapien
gtccgacctggatctccaagacgta

SEQ ID NO: 389015 - DNA, 25 bp, Homo sapien
acctggatctccaagacgtagagga

SEQ ID NO: 389016 - DNA, 25 bp, Homo sapien
gatctccaagacgtagaggaagtgg

SEQ ID NO: 389017 - DNA, 25 bp, Homo sapien
gtggagatcggcagagacaccttct

SEQ ID NO: 389018 - DNA, 25 bp, Homo sapien
gagatcggcagagacaccttctggc

SEQ ID NO: 389019 - DNA, 25 bp, Homo sapien
ggcagagacaccttctggcccgact

SEQ ID NO: 389020 - DNA, 25 bp, Homo sapien
gggcgctgcgcagcctcctgaggag

SEQ ID NO: 389021 - DNA, 25 bp, Homo sapien
tgcagcgccggcttcgggcctgaat

SEQ ID NO: 389022 - DNA, 25 bp, Homo sapien
ttcgggcctgaatccagcgcggagc

SEQ ID NO: 389023 - DNA, 25 bp, Homo sapien
taggagtccacccttaaaaccagca

SEQ ID NO: 389024 - DNA, 25 bp, Homo sapien
tctgggcccgagacagccgcaggcc

SEQ ID NO: 389025 - DNA, 25 bp, Homo sapien
aggccccagccactgaatgatactg

SEQ ID NO: 389026 - DNA, 25 bp, Homo sapien
ccactgaatgatactggcagcggct

SEQ ID NO: 389027 - DNA, 25 bp, Homo sapien
actgaatgatactggcagcggctgg

SEQ ID NO: 389028 - DNA, 25 bp, Homo sapien
gcggctggggttttatgaactcctt

SEQ ID NO: 389029 - DNA, 25 bp, Homo sapien
tggggttttatgaactcctttctgg

SEQ ID NO: 389030 - DNA, 25 bp, Homo sapien
atatgttacgtctcaatttttgtgc

SEQ ID NO: 389031 - DNA, 25 bp, Homo sapien
gttacgtctcaatttttgtgcttaa

SEQ ID NO: 389032 - DNA, 25 bp, Homo sapien
tacgtctcaatttttgtgcttaagt

SEQ ID NO: 389033 - DNA, 25 bp, Homo sapien
cgtctcaatttttgtgcttaagtaa

SEQ ID NO: 389034 - DNA, 25 bp, Homo sapien
gcaggcggcctcctggtatctcaac

SEQ ID NO: 389035 - DNA, 25 bp, Homo sapien
acgttcgcggcccagcagcaaactt

SEQ ID NO: 389036 - DNA, 25 bp, Homo sapien
agcagcaaactttccccaacgtgcg

SEQ ID NO: 389037 - DNA, 25 bp, Homo sapien
aactttccccaacgtgcgggagatg

SEQ ID NO: 389038 - DNA, 25 bp, Homo sapien
tttccccaacgtgcgggagatgttc

SEQ ID NO: 389039 - DNA, 25 bp, Homo sapien
gcgggagatgttcaactcccaccgg

SEQ ID NO: 389040 - DNA, 25 bp, Homo sapien
agatgttcaactcccaccggctggg

SEQ ID NO: 389041 - DNA, 25 bp, Homo sapien
gattgagaactcgaccctcggggag

SEQ ID NO: 389042 - DNA, 25 bp, Homo sapien
gagtcccaggtgagtggcaatgcca

SEQ ID NO: 389043 - DNA, 25 bp, Homo sapien
gtgagtggcaatgccagctgccagc

SEQ ID NO: 389044 - DNA, 25 bp, Homo sapien
agtggcaatgccagctgccagctgc

SEQ ID NO: 389045 - DNA, 25 bp, Homo sapien
gacactgtacaaagtgtgcgtgcaa

SEQ ID NO: 389046 - DNA, 25 bp, Homo sapien
gtgcaaaaggacacggttggtagta

SEQ ID NO: 389047 - DNA, 25 bp, Homo sapien
agcagtcctgccttttaaatcttgt

SEQ ID NO: 389048 - DNA, 25 bp, Homo sapien
tttaaatcttgtggcagctcagaag

SEQ ID NO: 389049 - DNA, 25 bp, Homo sapien
gaggtgcttaagaaccttaactact

SEQ ID NO: 389050 - DNA, 25 bp, Homo sapien
gaaccttaactactatgtcagataa

SEQ ID NO: 389051 - DNA, 25 bp, Homo sapien
ccattttggagattggttactgctc

SEQ ID NO: 389052 - DNA, 25 bp, Homo sapien
gattggttactgctcacacatgatg

SEQ ID NO: 389053 - DNA, 25 bp, Homo sapien
gctcacacatgatgtatagggctaa

SEQ ID NO: 389054 - DNA, 25 bp, Homo sapien
gggctaaatatatgcttgtttcctt

SEQ ID NO: 389055 - DNA, 25 bp, Homo sapien
tttccttcccctgtaggcaataaat

SEQ ID NO: 389056 - DNA, 25 bp, Homo sapien
gaagtaatacttttgggtatggcac

SEQ ID NO: 389057 - DNA, 25 bp, Homo sapien
tgggtatggcactagtttttcctct

SEQ ID NO: 389058 - DNA, 25 bp, Homo sapien
gggtatggcactagtttttcctctg

SEQ ID NO: 389059 - DNA, 25 bp, Homo sapien
gtttttcctctgactattttactgt

SEQ ID NO: 389060 - DNA, 25 bp, Homo sapien
ttcctctgactattttactgtttct

SEQ ID NO: 389061 - DNA, 25 bp, Homo sapien
ttactgtttctttcactctcaatat

SEQ ID NO: 389062 - DNA, 25 bp, Homo sapien
atttagacaaatcagctataatgta

SEQ ID NO: 389063 - DNA, 25 bp, Homo sapien
ataattacgttttatctgattaaag

SEQ ID NO: 389064 - DNA, 25 bp, Homo sapien
agttacaatgatcatagcactttaa

SEQ ID NO: 389065 - DNA, 25 bp, Homo sapien
tgaactgtcatttgtttatatatta

SEQ ID NO: 389066 - DNA, 25 bp, Homo sapien
ttgtttatatattaccgtctaataa

SEQ ID NO: 389067 - DNA, 25 bp, Homo sapien
cattttagagagtgggtcattggca

SEQ ID NO: 389068 - DNA, 25 bp, Homo sapien
gtcattggcagggagtgctccggag

SEQ ID NO: 389069 - DNA, 25 bp, Homo sapien
gaagacagaactcacacatgctccc

SEQ ID NO: 389070 - DNA, 25 bp, Homo sapien
taacagaaggcaaaggccagtttcc

SEQ ID NO: 389071 - DNA, 25 bp, Homo sapien
ccagtttccccgttatcatgaaggg

SEQ ID NO: 389072 - DNA, 25 bp, Homo sapien
ccactcaggacaggaacaaggacaa

SEQ ID NO: 389073 - DNA, 25 bp, Homo sapien
aggaacaaggacaactcctcctcct

SEQ ID NO: 389074 - DNA, 25 bp, Homo sapien
gctgctcctgggataccaggtcagt

SEQ ID NO: 389075 - DNA, 25 bp, Homo sapien
accaggtcagtgatgtagtcttgca

SEQ ID NO: 389076 - DNA, 25 bp, Homo sapien
gtagtcttgcagtttggcaacttcc

SEQ ID NO: 389077 - DNA, 25 bp, Homo sapien
gtttggcaacttcctagcctgagaa

SEQ ID NO: 389078 - DNA, 25 bp, Homo sapien
tggggagacccaaacatcaagctgg

SEQ ID NO: 389079 - DNA, 25 bp, Homo sapien
ctcagctgagtccttagggagggaa

SEQ ID NO: 389080 - DNA, 25 bp, Homo sapien
gggtctgcccagcttgaaacagaag

SEQ ID NO: 389081 - DNA, 25 bp, Homo sapien
aaggccctgaatcaggccaggcagg

SEQ ID NO: 389082 - DNA, 25 bp, Homo sapien
gcctgggagtcctgctcctttgctg

SEQ ID NO: 389083 - DNA, 25 bp, Homo sapien
agtcctgctcctttgctgtgagacc

SEQ ID NO: 389084 - DNA, 25 bp, Homo sapien
tcctgctttacctccctgtactttg

SEQ ID NO: 389085 - DNA, 25 bp, Homo sapien
tgctttacctccctgtactttgcac

SEQ ID NO: 389086 - DNA, 25 bp, Homo sapien
tttacctccctgtactttgcaccgg

SEQ ID NO: 389087 - DNA, 25 bp, Homo sapien
cctgtactttgcaccggccagggag

SEQ ID NO: 389088 - DNA, 25 bp, Homo sapien
ctttgcaccggccagggaggagggt

SEQ ID NO: 389089 - DNA, 25 bp, Homo sapien
aatgcccgcctcatgagtgccctga

SEQ ID NO: 389090 - DNA, 25 bp, Homo sapien
agtgccctgacccagctgaaagaga

SEQ ID NO: 389091 - DNA, 25 bp, Homo sapien
aggtacagcatgcaagcccgtaacg

SEQ ID NO: 389092 - DNA, 25 bp, Homo sapien
tacagcatgcaagcccgtaacggca

SEQ ID NO: 389093 - DNA, 25 bp, Homo sapien
caccaaccccaccaaattgcagatt

SEQ ID NO: 389094 - DNA, 25 bp, Homo sapien
gcagattactgagaacggcgagttc

SEQ ID NO: 389095 - DNA, 25 bp, Homo sapien
gaacggcgagttcagaaacagcagc

SEQ ID NO: 389096 - DNA, 25 bp, Homo sapien
agaaacagcagcaattgttaacctg

SEQ ID NO: 389097 - DNA, 25 bp, Homo sapien
aattgttaacctgcctgaggaggga

SEQ ID NO: 389098 - DNA, 25 bp, Homo sapien
gtggccaagggcagggtctcggcct

SEQ ID NO: 389099 - DNA, 25 bp, Homo sapien
gaggcacccacggttgcagccccag

SEQ ID NO: 389100 - DNA, 25 bp, Homo sapien
aaaaaccagcccaaaacatcagcct

SEQ ID NO: 389101 - DNA, 25 bp, Homo sapien
accagcccaaaacatcagcctaatg

SEQ ID NO: 389102 - DNA, 25 bp, Homo sapien
cagcctaatggctcatgtcagtatg

SEQ ID NO: 389103 - DNA, 25 bp, Homo sapien
ttcaaccatgagataaacccccatc

SEQ ID NO: 389104 - DNA, 25 bp, Homo sapien
atctgaccagaaacatgccaatcct

SEQ ID NO: 389105 - DNA, 25 bp, Homo sapien
gaccagaaacatgccaatcctgaga

SEQ ID NO: 389106 - DNA, 25 bp, Homo sapien
atattccaactctgcaataaaactc

SEQ ID NO: 389107 - DNA, 25 bp, Homo sapien
cttcacacagaaacattcgcagcct

SEQ ID NO: 389108 - DNA, 25 bp, Homo sapien
acacagaaacattcgcagcctgcgg

SEQ ID NO: 389109 - DNA, 25 bp, Homo sapien
aacattcgcagcctgcggtaggctc

SEQ ID NO: 389110 - DNA, 25 bp, Homo sapien
gagaatgtccctgaccgaaatcggc

SEQ ID NO: 389111 - DNA, 25 bp, Homo sapien
aaatgctagcataaattagattgac

SEQ ID NO: 389112 - DNA, 25 bp, Homo sapien
aatgctagcataaattagattgact

SEQ ID NO: 389113 - DNA, 25 bp, Homo sapien
atgctagcataaattagattgacta

SEQ ID NO: 389114 - DNA, 25 bp, Homo sapien
tgctagcataaattagattgactat

SEQ ID NO: 389115 - DNA, 25 bp, Homo sapien
gtgactgtagtagttaatgtaacac

SEQ ID NO: 389116 - DNA, 25 bp, Homo sapien
tgactgtagtagttaatgtaacaca

SEQ ID NO: 389117 - DNA, 25 bp, Homo sapien
gactgtagtagttaatgtaacacat

SEQ ID NO: 389118 - DNA, 25 bp, Homo sapien
actgtagtagttaatgtaacacatt

SEQ ID NO: 389119 - DNA, 25 bp, Homo sapien
ctgtagtagttaatgtaacacattt

SEQ ID NO: 389120 - DNA, 25 bp, Homo sapien
gtagtagttaatgtaacacattttg

SEQ ID NO: 389121 - DNA, 25 bp, Homo sapien
gtagttaatgtaacacattttgtat

SEQ ID NO: 389122 - DNA, 25 bp, Homo sapien
ggagttatttaacaatgagcccagt

SEQ ID NO: 389123 - DNA, 25 bp, Homo sapien
aacaatgagcccagtgactcaatag

SEQ ID NO: 389124 - DNA, 25 bp, Homo sapien
agtgactcaatagggcccaaacctt

SEQ ID NO: 389125 - DNA, 25 bp, Homo sapien
ttacaatatgagctccaagacactt

SEQ ID NO: 389126 - DNA, 25 bp, Homo sapien
taaaatgttattagccttatcaaat

SEQ ID NO: 389127 - DNA, 25 bp, Homo sapien
aaatgagcacagctctttgttcgct

SEQ ID NO: 389128 - DNA, 25 bp, Homo sapien
acagctctttgttcgctctattgaa

SEQ ID NO: 389129 - DNA, 25 bp, Homo sapien
gctctttgttcgctctattgaactg

SEQ ID NO: 389130 - DNA, 25 bp, Homo sapien
ttcgctctattgaactgggtgataa

SEQ ID NO: 389131 - DNA, 25 bp, Homo sapien
gtgaatgttaggtcagttctactgt

SEQ ID NO: 389132 - DNA, 25 bp, Homo sapien
atgttaggtcagttctactgtaata

SEQ ID NO: 389133 - DNA, 25 bp, Homo sapien
gatcattggatcattcattttggcc

SEQ ID NO: 389134 - DNA, 25 bp, Homo sapien
tagcttctccaaagtgactaacatc

SEQ ID NO: 389135 - DNA, 25 bp, Homo sapien
aagtgactaacatcagggcctacaa

SEQ ID NO: 389136 - DNA, 25 bp, Homo sapien
atcagggcctacaataaaatctgta

SEQ ID NO: 389137 - DNA, 25 bp, Homo sapien
aaatctgtaattctccaagtttagt

SEQ ID NO: 389138 - DNA, 25 bp, Homo sapien
ggcaggaagggctcattaagtacta

SEQ ID NO: 389139 - DNA, 25 bp, Homo sapien
ggaagggctcattaagtactaataa

SEQ ID NO: 389140 - DNA, 25 bp, Homo sapien
gtgtcatcaaaaaggtccacaattg

SEQ ID NO: 389141 - DNA, 25 bp, Homo sapien
gtaaatgctgttttataacatacat

SEQ ID NO: 389142 - DNA, 25 bp, Homo sapien
taacatacatttttctgctaattca

SEQ ID NO: 389143 - DNA, 25 bp, Homo sapien
ttctgttttgtgtgacctaataaag

SEQ ID NO: 389144 - DNA, 25 bp, Homo sapien
attgttgctttctcttatatggaac

SEQ ID NO: 389145 - DNA, 25 bp, Homo sapien
ggaacttattgtgtacctcttacct

SEQ ID NO: 389146 - DNA, 25 bp, Homo sapien
acctcttacctttatttctaatcat

SEQ ID NO: 389147 - DNA, 25 bp, Homo sapien
ttagtgatactaatcttttcatagt

SEQ ID NO: 389148 - DNA, 25 bp, Homo sapien
gtattcctagagtttacattcctaa

SEQ ID NO: 389149 - DNA, 25 bp, Homo sapien
taaacgacgactttggctatttttg

SEQ ID NO: 389150 - DNA, 25 bp, Homo sapien
gtgtgttccctaccttcttaaggct

SEQ ID NO: 389151 - DNA, 25 bp, Homo sapien
gttccctaccttcttaaggctatgg

SEQ ID NO: 389152 - DNA, 25 bp, Homo sapien
aaggctatggaaataaactggagtt

SEQ ID NO: 389153 - DNA, 25 bp, Homo sapien
atttgtgtaaatgttctccatatgt

SEQ ID NO: 389154 - DNA, 25 bp, Homo sapien
caagtgttgcctcttgttttattga

SEQ ID NO: 389155 - DNA, 25 bp, Homo sapien
gatagcactgaaacatgttgacttt

SEQ ID NO: 389156 - DNA, 25 bp, Homo sapien
gtattttcccctacgtaatgtacat

SEQ ID NO: 389157 - DNA, 25 bp, Homo sapien
gtacatgtctttaggccacagtatt

SEQ ID NO: 389158 - DNA, 25 bp, Homo sapien
tattaggagtttgatttttccctgc

SEQ ID NO: 389159 - DNA, 25 bp, Homo sapien
ccctcaggtaggtggcagtggtcat

SEQ ID NO: 389160 - DNA, 25 bp, Homo sapien
gtggcagtggtcattgtagcttaat

SEQ ID NO: 389161 - DNA, 25 bp, Homo sapien
attgtagcttaatcagacccctgtt

SEQ ID NO: 389162 - DNA, 25 bp, Homo sapien
taatcagacccctgttaagttcctg

SEQ ID NO: 389163 - DNA, 25 bp, Homo sapien
gttcctgggcatttcaaggtaaatt

SEQ ID NO: 389164 - DNA, 25 bp, Homo sapien
aggtaaattcacgtcttccttctca

SEQ ID NO: 389165 - DNA, 25 bp, Homo sapien
taggtacttaagacagacatccaaa

SEQ ID NO: 389166 - DNA, 25 bp, Homo sapien
tttaataactttgcggggccctgca

SEQ ID NO: 389167 - DNA, 25 bp, Homo sapien
gggccctgcaaattaataatctaca

SEQ ID NO: 389168 - DNA, 25 bp, Homo sapien
tagagggaaactaatcttactgcta

SEQ ID NO: 389169 - DNA, 25 bp, Homo sapien
actgctaagcagtgtgttgtactac

SEQ ID NO: 389170 - DNA, 25 bp, Homo sapien
gcagtgtgttgtactacatagtgaa

SEQ ID NO: 389171 - DNA, 25 bp, Homo sapien
catagtgaatgttcgtgttttggaa

SEQ ID NO: 389172 - DNA, 25 bp, Homo sapien
gacttgcttatttttaagtgatcac

SEQ ID NO: 389173 - DNA, 25 bp, Homo sapien
agtgatcaccattaagtcagaaaaa

SEQ ID NO: 389174 - DNA, 25 bp, Homo sapien
aatgtttcttgaagtgccttttgaa

SEQ ID NO: 389175 - DNA, 25 bp, Homo sapien
gtttcttgaagtgccttttgaacat

SEQ ID NO: 389176 - DNA, 25 bp, Homo sapien
aaacagcggatttaaataatgcata

SEQ ID NO: 389177 - DNA, 25 bp, Homo sapien
tttattctcattaagatgtatcctg

SEQ ID NO: 389178 - DNA, 25 bp, Homo sapien
ttattctcattaagatgtatcctgg

SEQ ID NO: 389179 - DNA, 25 bp, Homo sapien
tattctcattaagatgtatcctgga

SEQ ID NO: 389180 - DNA, 25 bp, Homo sapien
attctcattaagatgtatcctggaa

SEQ ID NO: 389181 - DNA, 25 bp, Homo sapien
ttctcattaagatgtatcctggaat

SEQ ID NO: 389182 - DNA, 25 bp, Homo sapien
tctcattaagatgtatcctggaata

SEQ ID NO: 389183 - DNA, 25 bp, Homo sapien
ctcattaagatgtatcctggaataa

SEQ ID NO: 389184 - DNA, 25 bp, Homo sapien
tcattaagatgtatcctggaataaa

SEQ ID NO: 389185 - DNA, 25 bp, Homo sapien
taaatgctttgaaaagcagaagcca

SEQ ID NO: 389186 - DNA, 25 bp, Homo sapien
cactgtgactgtgtgtctgtgctga

SEQ ID NO: 389187 - DNA, 25 bp, Homo sapien
gtatggtttgctggctcagttgtca

SEQ ID NO: 389188 - DNA, 25 bp, Homo sapien
ggacccaaaggactcagaactttct

SEQ ID NO: 389189 - DNA, 25 bp, Homo sapien
agaactttctctccatacctccttt

SEQ ID NO: 389190 - DNA, 25 bp, Homo sapien
tccatacctccttttactcttttct

SEQ ID NO: 389191 - DNA, 25 bp, Homo sapien
tctttctgtgtaatgtatcaacaac

SEQ ID NO: 389192 - DNA, 25 bp, Homo sapien
atcaacaactgtttaatctcccttc

SEQ ID NO: 389193 - DNA, 25 bp, Homo sapien
ttaatctcccttctaacaaaccttg

SEQ ID NO: 389194 - DNA, 25 bp, Homo sapien
tattgacagttaacccttactgatt

SEQ ID NO: 389195 - DNA, 25 bp, Homo sapien
tgattttaaacttgactatccagtc

SEQ ID NO: 389196 - DNA, 25 bp, Homo sapien
ctatccagtctgttaattacctaag

SEQ ID NO: 389197 - DNA, 25 bp, Homo sapien
ttgttttgatcattggcagagaaag

SEQ ID NO: 389198 - DNA, 25 bp, Homo sapien
aattcatatcagttttgctccttat

SEQ ID NO: 389199 - DNA, 25 bp, Homo sapien
gtgtatttttgctagttgcctacct

SEQ ID NO: 389200 - DNA, 25 bp, Homo sapien
ctagttgcctaccttctgagataaa

SEQ ID NO: 389201 - DNA, 25 bp, Homo sapien
aagcacaatcttgcaatggatccaa

SEQ ID NO: 389202 - DNA, 25 bp, Homo sapien
atggatccaataacccagttaggta

SEQ ID NO: 389203 - DNA, 25 bp, Homo sapien
gtgtgctaagtaaaagttccatgat

SEQ ID NO: 389204 - DNA, 25 bp, Homo sapien
gtattaacccatgttgcaaaagctg

SEQ ID NO: 389205 - DNA, 25 bp, Homo sapien
tgttgcaaaagctgttactggccaa

SEQ ID NO: 389206 - DNA, 25 bp, Homo sapien
gttactggccaacagattgtaatga

SEQ ID NO: 389207 - DNA, 25 bp, Homo sapien
gcattaactaggcattaacgtttgt

SEQ ID NO: 389208 - DNA, 25 bp, Homo sapien
atataccatgcagaagtcttcattt

SEQ ID NO: 389209 - DNA, 25 bp, Homo sapien
tcttcatttttatagcagactgcat

SEQ ID NO: 389210 - DNA, 25 bp, Homo sapien
tatagtgtaagaagtggatcctggc

SEQ ID NO: 389211 - DNA, 25 bp, Homo sapien
atagtgtaagaagtggatcctggct

SEQ ID NO: 389212 - DNA, 25 bp, Homo sapien
tagtgtaagaagtggatcctggcta

SEQ ID NO: 389213 - DNA, 25 bp, Homo sapien
agtgtaagaagtggatcctggctag

SEQ ID NO: 389214 - DNA, 25 bp, Homo sapien
tgtaagaagtggatcctggctaggt

SEQ ID NO: 389215 - DNA, 25 bp, Homo sapien
gaagtggatcctggctaggtgcagt

SEQ ID NO: 389216 - DNA, 25 bp, Homo sapien
tagccaggtgtcatgagacacacct

SEQ ID NO: 389217 - DNA, 25 bp, Homo sapien
gccaggtgtcatgagacacacctgt

SEQ ID NO: 389218 - DNA, 25 bp, Homo sapien
aggtgtcatgagacacacctgtagt

SEQ ID NO: 389219 - DNA, 25 bp, Homo sapien
ggtgtcatgagacacacctgtagtc

SEQ ID NO: 389220 - DNA, 25 bp, Homo sapien
gtgtcatgagacacacctgtagtcc

SEQ ID NO: 389221 - DNA, 25 bp, Homo sapien
agaatgttttatgtgattccacagc

SEQ ID NO: 389222 - DNA, 25 bp, Homo sapien
tgtgattccacagcattttctgtat

SEQ ID NO: 389223 - DNA, 25 bp, Homo sapien
agagtagctcacaacattttaaatg

SEQ ID NO: 389224 - DNA, 25 bp, Homo sapien
gtttccaatatgaatcgtgttacaa

SEQ ID NO: 389225 - DNA, 25 bp, Homo sapien
tccaatatgaatcgtgttacaaaat

SEQ ID NO: 389226 - DNA, 25 bp, Homo sapien
tgaatcgtgttacaaaattcttaat

SEQ ID NO: 389227 - DNA, 25 bp, Homo sapien
taataactaaaacctcttgaaaatg

SEQ ID NO: 389228 - DNA, 25 bp, Homo sapien
taactaaaacctcttgaaaatgtca

SEQ ID NO: 389229 - DNA, 25 bp, Homo sapien
aaatacttgatttctgatgcaactt

SEQ ID NO: 389230 - DNA, 25 bp, Homo sapien
atacttgatttctgatgcaactttg

SEQ ID NO: 389231 - DNA, 25 bp, Homo sapien
ctgatgcaactttgactaaaatatt

SEQ ID NO: 389232 - DNA, 25 bp, Homo sapien
ccctgctggaaggtgtcgagagcca

SEQ ID NO: 389233 - DNA, 25 bp, Homo sapien
gtgtcgagagccaggcagccaagcc

SEQ ID NO: 389234 - DNA, 25 bp, Homo sapien
cagccaagcctgacctgggagatgg

SEQ ID NO: 389235 - DNA, 25 bp, Homo sapien
tgctgccagtctgattccacagagg

SEQ ID NO: 389236 - DNA, 25 bp, Homo sapien
ctgccagtctgattccacagagggt

SEQ ID NO: 389237 - DNA, 25 bp, Homo sapien
gccagtctgattccacagagggtgc

SEQ ID NO: 389238 - DNA, 25 bp, Homo sapien
gtctgattccacagagggtgctctg

SEQ ID NO: 389239 - DNA, 25 bp, Homo sapien
ggtgctctgaccgagtgtttaccaa

SEQ ID NO: 389240 - DNA, 25 bp, Homo sapien
gagggggcttgtctaagcttaccca

SEQ ID NO: 389241 - DNA, 25 bp, Homo sapien
gcttacccagcccggaagcatcggg

SEQ ID NO: 389242 - DNA, 25 bp, Homo sapien
ggtcaaagcttaaccccctgctgga

SEQ ID NO: 389243 - DNA, 25 bp, Homo sapien
gtcctggtccagaactgtcggtagc

SEQ ID NO: 389244 - DNA, 25 bp, Homo sapien
tggtccagaactgtcggtagcgctc

SEQ ID NO: 389245 - DNA, 25 bp, Homo sapien
gtagcgctccacatgcaagtcatca

SEQ ID NO: 389246 - DNA, 25 bp, Homo sapien
gctcgtactccttcctcgactggag

SEQ ID NO: 389247 - DNA, 25 bp, Homo sapien
tcgactggagctgagcctcacgctt

SEQ ID NO: 389248 - DNA, 25 bp, Homo sapien
cgctcctcaggagacagggtgtcca

SEQ ID NO: 389249 - DNA, 25 bp, Homo sapien
gacagggtgtccagatctatgggca

SEQ ID NO: 389250 - DNA, 25 bp, Homo sapien
tgtccagatctatgggcatcgccag

SEQ ID NO: 389251 - DNA, 25 bp, Homo sapien
atgggcatcgccagcatgcgccgtg

SEQ ID NO: 389252 - DNA, 25 bp, Homo sapien
atgcgccgtggctccctgtagcgga

SEQ ID NO: 389253 - DNA, 25 bp, Homo sapien
gaacgagtgatttaagaacagccct

SEQ ID NO: 389254 - DNA, 25 bp, Homo sapien
atggactacggcatcactcatgttc

SEQ ID NO: 389255 - DNA, 25 bp, Homo sapien
tcatgttctgtggtcgggccctttg

SEQ ID NO: 389256 - DNA, 25 bp, Homo sapien
gctgtttggtggagaaactctgacc

SEQ ID NO: 389257 - DNA, 25 bp, Homo sapien
ctgaccagagctagagacaccatct

SEQ ID NO: 389258 - DNA, 25 bp, Homo sapien
caccatctgcaatgatctctacatc

SEQ ID NO: 389259 - DNA, 25 bp, Homo sapien
acatctatgatactcgcacatctcc

SEQ ID NO: 389260 - DNA, 25 bp, Homo sapien
acttcccctgtgcagatcgtgggat

SEQ ID NO: 389261 - DNA, 25 bp, Homo sapien
aattacggaggaaccacctgtgctc

SEQ ID NO: 389262 - DNA, 25 bp, Homo sapien
tcgtgggatgaaacgcatgggccat

SEQ ID NO: 389263 - DNA, 25 bp, Homo sapien
acctgtgctcctcatttgatggaac

SEQ ID NO: 389264 - DNA, 25 bp, Homo sapien
tgatggaacagcttgcaaggcttgt

SEQ ID NO: 389265 - DNA, 25 bp, Homo sapien
gatttgcccaatctttattgctcac

SEQ ID NO: 389266 - DNA, 25 bp, Homo sapien
agggaagtggcttagattatggcat

SEQ ID NO: 389267 - DNA, 25 bp, Homo sapien
ttgcccaatctttattgctcaccta

SEQ ID NO: 389268 - DNA, 25 bp, Homo sapien
aagtgatttgtgctataggacataa

SEQ ID NO: 389269 - DNA, 25 bp, Homo sapien
ctcagaaatagtaaggacagtggta

SEQ ID NO: 389270 - DNA, 25 bp, Homo sapien
attgctcacctattaaagtgctaaa

SEQ ID NO: 389271 - DNA, 25 bp, Homo sapien
gctaaacaagctgatggtgattcct

SEQ ID NO: 389272 - DNA, 25 bp, Homo sapien
aagctgatggtgattcctgttctca

SEQ ID NO: 389273 - DNA, 25 bp, Homo sapien
tggtgattcctgttctcagaagcct

SEQ ID NO: 389274 - DNA, 25 bp, Homo sapien
gattcctgttctcagaagcctgtgt

SEQ ID NO: 389275 - DNA, 25 bp, Homo sapien
gtgttctagcaggttataagaagat

SEQ ID NO: 389276 - DNA, 25 bp, Homo sapien
cttgtccagtttgataggttcagga

SEQ ID NO: 389277 - DNA, 25 bp, Homo sapien
ttgtccagtttgataggttcaggaa

SEQ ID NO: 389278 - DNA, 25 bp, Homo sapien
gtccagtttgataggttcaggaaat

SEQ ID NO: 389279 - DNA, 25 bp, Homo sapien
ccagtttgataggttcaggaaattc

SEQ ID NO: 389280 - DNA, 25 bp, Homo sapien
gataggttcaggaaattcgttgtac

SEQ ID NO: 389281 - DNA, 25 bp, Homo sapien
ataggttcaggaaattcgttgtaca

SEQ ID NO: 389282 - DNA, 25 bp, Homo sapien
aggttcaggaaattcgttgtacagc

SEQ ID NO: 389283 - DNA, 25 bp, Homo sapien
ggttcaggaaattcgttgtacagct

SEQ ID NO: 389284 - DNA, 25 bp, Homo sapien
gttcaggaaattcgttgtacagctc

SEQ ID NO: 389285 - DNA, 25 bp, Homo sapien
ttcaggaaattcgttgtacagctcc

SEQ ID NO: 389286 - DNA, 25 bp, Homo sapien
tcaggaaattcgttgtacagctcca

SEQ ID NO: 389287 - DNA, 25 bp, Homo sapien
acgctctaccagctgctgcgtgatg

SEQ ID NO: 389288 - DNA, 25 bp, Homo sapien
accagctgctgcgtgatgcccgtgt

SEQ ID NO: 389289 - DNA, 25 bp, Homo sapien
tgcgtgatgcccgtgtccaagatca

SEQ ID NO: 389290 - DNA, 25 bp, Homo sapien
gatgcccgtgtccaagatcaggttg

SEQ ID NO: 389291 - DNA, 25 bp, Homo sapien
cccgtgtccaagatcaggttgtgca

SEQ ID NO: 389292 - DNA, 25 bp, Homo sapien
gtccaagatcaggttgtgcagaagg

SEQ ID NO: 389293 - DNA, 25 bp, Homo sapien
ggtgggggcatcttcttgcagctcc

SEQ ID NO: 389294 - DNA, 25 bp, Homo sapien
ctgggtgatgcctacgtgttgagat

SEQ ID NO: 389295 - DNA, 25 bp, Homo sapien
ggtgatgcctacgtgttgagatcct

SEQ ID NO: 389296 - DNA, 25 bp, Homo sapien
atgcctacgtgttgagatcctggtc

SEQ ID NO: 389297 - DNA, 25 bp, Homo sapien
ctacgtgttgagatcctggtccctc

SEQ ID NO: 389298 - DNA, 25 bp, Homo sapien
aggaaagctgacttggaaacacggg

SEQ ID NO: 389299 - DNA, 25 bp, Homo sapien
aaggactctggcaagcagatccact

SEQ ID NO: 389300 - DNA, 25 bp, Homo sapien
gcaagcagatccacttgtctgggtc

SEQ ID NO: 389301 - DNA, 25 bp, Homo sapien
tgtctgggtccctgcagtgaagaac

SEQ ID NO: 389302 - DNA, 25 bp, Homo sapien
gtccctgcagtgaagaacccaagat

SEQ ID NO: 389303 - DNA, 25 bp, Homo sapien
agaacccaagatccaggtacctcag

SEQ ID NO: 389304 - DNA, 25 bp, Homo sapien
ggtacctcagcctggaagaaaccgt

SEQ ID NO: 389305 - DNA, 25 bp, Homo sapien
agcctggaagaaaccgtgcactgca

SEQ ID NO: 389306 - DNA, 25 bp, Homo sapien
aagaaaccgtgcactgcaggtcttc

SEQ ID NO: 389307 - DNA, 25 bp, Homo sapien
caggtcttcccttctatcaaaacta

SEQ ID NO: 389308 - DNA, 25 bp, Homo sapien
accttctggcagtctctggataatg

SEQ ID NO: 389309 - DNA, 25 bp, Homo sapien
aagaggctgagtaccagatggctga

SEQ ID NO: 389310 - DNA, 25 bp, Homo sapien
gagaagccactataccagccctagt

SEQ ID NO: 389311 - DNA, 25 bp, Homo sapien
tataccagccctagtttcgagttta

SEQ ID NO: 389312 - DNA, 25 bp, Homo sapien
gccctagtttcgagtttacactgct

SEQ ID NO: 389313 - DNA, 25 bp, Homo sapien
agtttcgagtttacactgcttctgt

SEQ ID NO: 389314 - DNA, 25 bp, Homo sapien
gagtttacactgcttctgtgaaaga

SEQ ID NO: 389315 - DNA, 25 bp, Homo sapien
tatatgcagcctactaatcctatcc

SEQ ID NO: 389316 - DNA, 25 bp, Homo sapien
cagcctactaatcctatccaaacaa

SEQ ID NO: 389317 - DNA, 25 bp, Homo sapien
ctaatcctatccaaacaaggcttga

SEQ ID NO: 389318 - DNA, 25 bp, Homo sapien
caaggcttgaataaggtttactaca

SEQ ID NO: 389319 - DNA, 25 bp, Homo sapien
gaataaggtttactacagctctttt

SEQ ID NO: 389320 - DNA, 25 bp, Homo sapien
atctgggactgcagctctgtcaact

SEQ ID NO: 389321 - DNA, 25 bp, Homo sapien
tctgtcaactccgtctcattgaggg

SEQ ID NO: 389322 - DNA, 25 bp, Homo sapien
tccgtctcattgagggtcctgagga

SEQ ID NO: 389323 - DNA, 25 bp, Homo sapien
gttgatctcatcattcagggcatcc

SEQ ID NO: 389324 - DNA, 25 bp, Homo sapien
atcattcagggcatccaccttggcc

SEQ ID NO: 389325 - DNA, 25 bp, Homo sapien
agctccaccttgctcatgtaggcag

SEQ ID NO: 389326 - DNA, 25 bp, Homo sapien
tgctcatgtaggcagcatccacatc

SEQ ID NO: 389327 - DNA, 25 bp, Homo sapien
agcaccacaaactcattctcagcag

SEQ ID NO: 389328 - DNA, 25 bp, Homo sapien
aatttcatcttcgtacttattcttg

SEQ ID NO: 389329 - DNA, 25 bp, Homo sapien
atccacctgcagtgcctcaagctga

SEQ ID NO: 389330 - DNA, 25 bp, Homo sapien
agtgcctcaagctgaccccgaaggc

SEQ ID NO: 389331 - DNA, 25 bp, Homo sapien
taagagacttggtacgggccaggaa

SEQ ID NO: 389332 - DNA, 25 bp, Homo sapien
gaatatgtggcagagctcctggaaa

SEQ ID NO: 389333 - DNA, 25 bp, Homo sapien
ggcagagctcctggaaatgatgcag

SEQ ID NO: 389334 - DNA, 25 bp, Homo sapien
taggtggcatttttgtcagctctgt

SEQ ID NO: 389335 - DNA, 25 bp, Homo sapien
cagctctgtggtttattgttgggac

SEQ ID NO: 389336 - DNA, 25 bp, Homo sapien
tattgttgggactattctttaaaat

SEQ ID NO: 389337 - DNA, 25 bp, Homo sapien
aaatatccattgttcactacagtga

SEQ ID NO: 389338 - DNA, 25 bp, Homo sapien
accgtgtactatccacatgcattac

SEQ ID NO: 389339 - DNA, 25 bp, Homo sapien
attacaaacatttcgcagagctgct

SEQ ID NO: 389340 - DNA, 25 bp, Homo sapien
ttcgcagagctgcttagtatataag

SEQ ID NO: 389341 - DNA, 25 bp, Homo sapien
acaatgtatgtaataaccatctcat

SEQ ID NO: 389342 - DNA, 25 bp, Homo sapien
ggattatcagagtccatgttataaa

SEQ ID NO: 389343 - DNA, 25 bp, Homo sapien
ggtctagaatatatccagatccttg

SEQ ID NO: 389344 - DNA, 25 bp, Homo sapien
ataaacagaatttacctatgcaaga

SEQ ID NO: 389345 - DNA, 25 bp, Homo sapien
gcaagacaaattctaactgtgcaac

SEQ ID NO: 389346 - DNA, 25 bp, Homo sapien
actgtgcaacattttcatgagaatt

SEQ ID NO: 389347 - DNA, 25 bp, Homo sapien
tgaatgtttttatgtgtaagtgcct

SEQ ID NO: 389348 - DNA, 25 bp, Homo sapien
atgtgtaagtgcctaaagaaccgta

SEQ ID NO: 389349 - DNA, 25 bp, Homo sapien
gtgcctaaagaaccgtagaaacagt

SEQ ID NO: 389350 - DNA, 25 bp, Homo sapien
gaaacagtacatcaaaagctcttat

SEQ ID NO: 389351 - DNA, 25 bp, Homo sapien
gatattgggttatgacaggattcta

SEQ ID NO: 389352 - DNA, 25 bp, Homo sapien
ggtgcttatttttccctatattagg

SEQ ID NO: 389353 - DNA, 25 bp, Homo sapien
agtggagtctggttcacaccctggg

SEQ ID NO: 389354 - DNA, 25 bp, Homo sapien
taggagtccacccttaaaaccagca

SEQ ID NO: 389355 - DNA, 25 bp, Homo sapien
tctgggcccgagacagccgcaggcc

SEQ ID NO: 389356 - DNA, 25 bp, Homo sapien
aggccccagccactgaatgatactg

SEQ ID NO: 389357 - DNA, 25 bp, Homo sapien
actgaatgatactggcagcggctgg

SEQ ID NO: 389358 - DNA, 25 bp, Homo sapien
gcggctggggttttatgaactcctt

SEQ ID NO: 389359 - DNA, 25 bp, Homo sapien
tggggttttatgaactcctttctgg

SEQ ID NO: 389360 - DNA, 25 bp, Homo sapien
tttttcccctctatgtacaaatgta

SEQ ID NO: 389361 - DNA, 25 bp, Homo sapien
atatgttacgtctcaatttttgtgc

SEQ ID NO: 389362 - DNA, 25 bp, Homo sapien
gttacgtctcaatttttgtgcttaa

SEQ ID NO: 389363 - DNA, 25 bp, Homo sapien
cgtctcaatttttgtgcttaagtaa

SEQ ID NO: 389364 - DNA, 25 bp, Homo sapien
tgaaagactttcctcctttacaaga

SEQ ID NO: 389365 - DNA, 25 bp, Homo sapien
ggtgctgcctttctgtttagtaaaa

SEQ ID NO: 389366 - DNA, 25 bp, Homo sapien
tgcagtggcatctaaagagatcttt

SEQ ID NO: 389367 - DNA, 25 bp, Homo sapien
atgtattgtggcataatcctttttt

SEQ ID NO: 389368 - DNA, 25 bp, Homo sapien
ataatcctttttttgagctctacag

SEQ ID NO: 389369 - DNA, 25 bp, Homo sapien
gagctctacagagaacagtcttttg

SEQ ID NO: 389370 - DNA, 25 bp, Homo sapien
aacagtcttttggtaatagtggcag

SEQ ID NO: 389371 - DNA, 25 bp, Homo sapien
gtggcaggtatttattccttctgaa

SEQ ID NO: 389372 - DNA, 25 bp, Homo sapien
ccttctgaatatataccccattata

SEQ ID NO: 389373 - DNA, 25 bp, Homo sapien
tataccccattataggaataactgt

SEQ ID NO: 389374 - DNA, 25 bp, Homo sapien
actgttacttatttaggattccatc

SEQ ID NO: 389375 - DNA, 25 bp, Homo sapien
cccttggctttcgaagcaaattgat

SEQ ID NO: 389376 - DNA, 25 bp, Homo sapien
tggctttcgaagcaaattgatgttc

SEQ ID NO: 389377 - DNA, 25 bp, Homo sapien
tcgaagcaaattgatgttcacgtct

SEQ ID NO: 389378 - DNA, 25 bp, Homo sapien
aagcaaattgatgttcacgtctgac

SEQ ID NO: 389379 - DNA, 25 bp, Homo sapien
gcaaattgatgttcacgtctgacgt

SEQ ID NO: 389380 - DNA, 25 bp, Homo sapien
aaattgatgttcacgtctgacgtgg

SEQ ID NO: 389381 - DNA, 25 bp, Homo sapien
attgatgttcacgtctgacgtgggc

SEQ ID NO: 389382 - DNA, 25 bp, Homo sapien
ggccgggctcacatggtttgtacaa

SEQ ID NO: 389383 - DNA, 25 bp, Homo sapien
gccgggctcacatggtttgtacaat

SEQ ID NO: 389384 - DNA, 25 bp, Homo sapien
cgggctcacatggtttgtacaataa

SEQ ID NO: 389385 - DNA, 25 bp, Homo sapien
ggctcacatggtttgtacaataaat

SEQ ID NO: 389386 - DNA, 25 bp, Homo sapien
aagcagccttacagggaagcccacc

SEQ ID NO: 389387 - DNA, 25 bp, Homo sapien
gccttacagggaagcccaccaagta

SEQ ID NO: 389388 - DNA, 25 bp, Homo sapien
gaagcccaccaagtaaggaaccaag

SEQ ID NO: 389389 - DNA, 25 bp, Homo sapien
agtaaggaaccaaggcctgccaatg

SEQ ID NO: 389390 - DNA, 25 bp, Homo sapien
aaggcctgccaatggctgtgtaagt

SEQ ID NO: 389391 - DNA, 25 bp, Homo sapien
atggctgtgtaagtgacccgtttca

SEQ ID NO: 389392 - DNA, 25 bp, Homo sapien
gctgtgtaagtgacccgtttcagaa

SEQ ID NO: 389393 - DNA, 25 bp, Homo sapien
aagtgacccgtttcagaaatatcct

SEQ ID NO: 389394 - DNA, 25 bp, Homo sapien
gcatgtacctgtagttcctctcacc

SEQ ID NO: 389395 - DNA, 25 bp, Homo sapien
tacctgtagttcctctcacctgagt

SEQ ID NO: 389396 - DNA, 25 bp, Homo sapien
gtagttcctctcacctgagtccagg

SEQ ID NO: 389397 - DNA, 25 bp, Homo sapien
tgaagagcccctccgtgcagcgcag

SEQ ID NO: 389398 - DNA, 25 bp, Homo sapien
acatgggccatgttgatgcagagca

SEQ ID NO: 389399 - DNA, 25 bp, Homo sapien
gccatgttgatgcagagcaacaggt

SEQ ID NO: 389400 - DNA, 25 bp, Homo sapien
agccccacgtcacgtccaggtgtag

SEQ ID NO: 389401 - DNA, 25 bp, Homo sapien
cccacgtcacgtccaggtgtagcgg

SEQ ID NO: 389402 - DNA, 25 bp, Homo sapien
tgggcttgcgtggtggccgcgatgc

SEQ ID NO: 389403 - DNA, 25 bp, Homo sapien
gccgcgatgctgtccaggcagcgct

SEQ ID NO: 389404 - DNA, 25 bp, Homo sapien
cgatgctgtccaggcagcgctggtc

SEQ ID NO: 389405 - DNA, 25 bp, Homo sapien
ggccctgggtttgagcaggtgtcct

SEQ ID NO: 389406 - DNA, 25 bp, Homo sapien
agcaggtgtcctgctgctctgaaga

SEQ ID NO: 389407 - DNA, 25 bp, Homo sapien
aggtgtcctgctgctctgaagagcc

SEQ ID NO: 389408 - DNA, 25 bp, Homo sapien
ttccctccctaaggactcagctgag

SEQ ID NO: 389409 - DNA, 25 bp, Homo sapien
tccctccctaaggactcagctgagg

SEQ ID NO: 389410 - DNA, 25 bp, Homo sapien
ccctccctaaggactcagctgaggg

SEQ ID NO: 389411 - DNA, 25 bp, Homo sapien
ccagcttgatgtttgggtctcccca

SEQ ID NO: 389412 - DNA, 25 bp, Homo sapien
cagcttgatgtttgggtctccccag

SEQ ID NO: 389413 - DNA, 25 bp, Homo sapien
agcttgatgtttgggtctccccagc

SEQ ID NO: 389414 - DNA, 25 bp, Homo sapien
cttgatgtttgggtctccccagcac

SEQ ID NO: 389415 - DNA, 25 bp, Homo sapien
ttgatgtttgggtctccccagcacc

SEQ ID NO: 389416 - DNA, 25 bp, Homo sapien
tgatgtttgggtctccccagcaccc

SEQ ID NO: 389417 - DNA, 25 bp, Homo sapien
gatgtttgggtctccccagcaccct

SEQ ID NO: 389418 - DNA, 25 bp, Homo sapien
atgtttgggtctccccagcaccctc

SEQ ID NO: 389419 - DNA, 25 bp, Homo sapien
gcaaattaaactccactttacgctg

SEQ ID NO: 389420 - DNA, 25 bp, Homo sapien
ctttacgctggaatgctttctttag

SEQ ID NO: 389421 - DNA, 25 bp, Homo sapien
ttagcatgaaaataccaggtccttg

SEQ ID NO: 389422 - DNA, 25 bp, Homo sapien
ggaaagttgcttaaattgtggacac

SEQ ID NO: 389423 - DNA, 25 bp, Homo sapien
attgtggacactggaattaatctga

SEQ ID NO: 389424 - DNA, 25 bp, Homo sapien
gaattaatctgaatgtcactgagga

SEQ ID NO: 389425 - DNA, 25 bp, Homo sapien
gtcactgaggaatttcacatgaagt

SEQ ID NO: 389426 - DNA, 25 bp, Homo sapien
gaagtgtaatccctagtcaataaga

SEQ ID NO: 389427 - DNA, 25 bp, Homo sapien
gctaaattacatccattcaggtaaa

SEQ ID NO: 389428 - DNA, 25 bp, Homo sapien
aaaggatcttagcttactgaaggat

SEQ ID NO: 389429 - DNA, 25 bp, Homo sapien
agagcaaagccaagatctcactact

SEQ ID NO: 389430 - DNA, 25 bp, Homo sapien
gttggcctggaaccggcccgaccag

SEQ ID NO: 389431 - DNA, 25 bp, Homo sapien
ttggcctggaaccggcccgaccagt

SEQ ID NO: 389432 - DNA, 25 bp, Homo sapien
tggcctggaaccggcccgaccagtt

SEQ ID NO: 389433 - DNA, 25 bp, Homo sapien
gaccagttccgcccgggcgcgagga

SEQ ID NO: 389434 - DNA, 25 bp, Homo sapien
cagttccgcccgggcgcgaggaccg

SEQ ID NO: 389435 - DNA, 25 bp, Homo sapien
gaccggccgcaggaagttgctgcaa

SEQ ID NO: 389436 - DNA, 25 bp, Homo sapien
accggccgcaggaagttgctgcaaa

SEQ ID NO: 389437 - DNA, 25 bp, Homo sapien
ccggccgcaggaagttgctgcaaaa

SEQ ID NO: 389438 - DNA, 25 bp, Homo sapien
cggccgcaggaagttgctgcaaaac

SEQ ID NO: 389439 - DNA, 25 bp, Homo sapien
ggccgcaggaagttgctgcaaaact

SEQ ID NO: 389440 - DNA, 25 bp, Homo sapien
gccgcaggaagttgctgcaaaactt

SEQ ID NO: 389441 - DNA, 25 bp, Homo sapien
cttgaatgaaggctgctccggtcct

SEQ ID NO: 389442 - DNA, 25 bp, Homo sapien
atgaaggctgctccggtccttatta

SEQ ID NO: 389443 - DNA, 25 bp, Homo sapien
gctccggtccttattatcggatttt

SEQ ID NO: 389444 - DNA, 25 bp, Homo sapien
ggtttttataagtgtcacagacatg

SEQ ID NO: 389445 - DNA, 25 bp, Homo sapien
agattttcttctccagcaagctctt

SEQ ID NO: 389446 - DNA, 25 bp, Homo sapien
ttcttctccagcaagctcttatgaa

SEQ ID NO: 389447 - DNA, 25 bp, Homo sapien
gctcttatgaaatagcttgtattaa

SEQ ID NO: 389448 - DNA, 25 bp, Homo sapien
tgaatctaaacatcgtgctctctat

SEQ ID NO: 389449 - DNA, 25 bp, Homo sapien
taaacatcgtgctctctatctctaa

SEQ ID NO: 389450 - DNA, 25 bp, Homo sapien
gtgctctctatctctaatgacgaaa

SEQ ID NO: 389451 - DNA, 25 bp, Homo sapien
atctctaatgacgaaaactgtttga

SEQ ID NO: 389452 - DNA, 25 bp, Homo sapien
ctggccccatgaatacactactaat

SEQ ID NO: 389453 - DNA, 25 bp, Homo sapien
ggaaaattttcagagtattctagtt

SEQ ID NO: 389454 - DNA, 25 bp, Homo sapien
tttctaattctgtaaattctattac

SEQ ID NO: 389455 - DNA, 25 bp, Homo sapien
aagtatgttgtttattacaactcat

SEQ ID NO: 389456 - DNA, 25 bp, Homo sapien
tattacaactcattacaactaccta

SEQ ID NO: 389457 - DNA, 25 bp, Homo sapien
tacaactcattacaactacctaaat

SEQ ID NO: 389458 - DNA, 25 bp, Homo sapien
tcattacaactacctaaattttagg

SEQ ID NO: 389459 - DNA, 25 bp, Homo sapien
tatttttgcatttcatagccagaaa

SEQ ID NO: 389460 - DNA, 25 bp, Homo sapien
aaaatactgatgttcacttaaagat

SEQ ID NO: 389461 - DNA, 25 bp, Homo sapien
gatgttcacttaaagatattcagca

SEQ ID NO: 389462 - DNA, 25 bp, Homo sapien
gttcacttaaagatattcagcaatt

SEQ ID NO: 389463 - DNA, 25 bp, Homo sapien
cagtatcctgttccgcctctggaag

SEQ ID NO: 389464 - DNA, 25 bp, Homo sapien
atcctgttccgcctctggaagtcct

SEQ ID NO: 389465 - DNA, 25 bp, Homo sapien
ctgttccgcctctggaagtcctgca

SEQ ID NO: 389466 - DNA, 25 bp, Homo sapien
gcctctggaagtcctgcaccaatgt

SEQ ID NO: 389467 - DNA, 25 bp, Homo sapien
ctctggaagtcctgcaccaatgttt

SEQ ID NO: 389468 - DNA, 25 bp, Homo sapien
ctggaagtcctgcaccaatgtttgt

SEQ ID NO: 389469 - DNA, 25 bp, Homo sapien
tggaagtcctgcaccaatgtttgtc

SEQ ID NO: 389470 - DNA, 25 bp, Homo sapien
ggaagtcctgcaccaatgtttgtcc

SEQ ID NO: 389471 - DNA, 25 bp, Homo sapien
aagtcctgcaccaatgtttgtccca

SEQ ID NO: 389472 - DNA, 25 bp, Homo sapien
gtcctgcaccaatgtttgtcccact

SEQ ID NO: 389473 - DNA, 25 bp, Homo sapien
tttgtcccactcactgtgacctcct

SEQ ID NO: 389474 - DNA, 25 bp, Homo sapien
acagttttgtcacccattagccata

SEQ ID NO: 389475 - DNA, 25 bp, Homo sapien
tagccataaattgctgtttgtatca

SEQ ID NO: 389476 - DNA, 25 bp, Homo sapien
gtttgtatcaaagcgcatgctgctt

SEQ ID NO: 389477 - DNA, 25 bp, Homo sapien
atcaaagcgcatgctgcttctcttg

SEQ ID NO: 389478 - DNA, 25 bp, Homo sapien
cttgcactgtttccctttcgcaggg

SEQ ID NO: 389479 - DNA, 25 bp, Homo sapien
cctttcgcagggacatgttggtgtt

SEQ ID NO: 389480 - DNA, 25 bp, Homo sapien
gttggtgtttgctattgaattggcc

SEQ ID NO: 389481 - DNA, 25 bp, Homo sapien
tttgcagtttgtatttacactacag

SEQ ID NO: 389482 - DNA, 25 bp, Homo sapien
gattggtgaatttgccaacgtcctc

SEQ ID NO: 389483 - DNA, 25 bp, Homo sapien
gccaacgtcctcactgtgattatgt

SEQ ID NO: 389484 - DNA, 25 bp, Homo sapien
gtgattatgtgtatattgctgttta

SEQ ID NO: 389485 - DNA, 25 bp, Homo sapien
atgggcccaattgcagcactgttac

SEQ ID NO: 389486 - DNA, 25 bp, Homo sapien
agcactgttacaagatctgatttca

SEQ ID NO: 389487 - DNA, 25 bp, Homo sapien
agatctgatttcaaattgcctttaa

SEQ ID NO: 389488 - DNA, 25 bp, Homo sapien
agttataattgccatctttgaatct

SEQ ID NO: 389489 - DNA, 25 bp, Homo sapien
ttgaatcttttatgactcagtcacc

SEQ ID NO: 389490 - DNA, 25 bp, Homo sapien
cagatgtgattcctgttgtcaacaa

SEQ ID NO: 389491 - DNA, 25 bp, Homo sapien
gttgtcaacaaagttacagcctaga

SEQ ID NO: 389492 - DNA, 25 bp, Homo sapien
gaagctgacattgtactttcctagg

SEQ ID NO: 389493 - DNA, 25 bp, Homo sapien
actttcctaggtacaatgacttaag

SEQ ID NO: 389494 - DNA, 25 bp, Homo sapien
atgacttaggcttgttcctgattta

SEQ ID NO: 389495 - DNA, 25 bp, Homo sapien
ggcttgttcctgatttagacatgta

SEQ ID NO: 389496 - DNA, 25 bp, Homo sapien
tttcagttaagctttcatggtatgt

SEQ ID NO: 389497 - DNA, 25 bp, Homo sapien
ttcatggtatgtaattttccagcct

SEQ ID NO: 389498 - DNA, 25 bp, Homo sapien
tccagccttttgagaaaacaagcat

SEQ ID NO: 389499 - DNA, 25 bp, Homo sapien
tttgtttcatgctaggcttttcctg

SEQ ID NO: 389500 - DNA, 25 bp, Homo sapien
ggcttttcctggcagcatgtccatt

SEQ ID NO: 389501 - DNA, 25 bp, Homo sapien
gcagcatgtccattgcaggcagtgg

SEQ ID NO: 389502 - DNA, 25 bp, Homo sapien
gacaagaaaccaccagcattgagct

SEQ ID NO: 389503 - DNA, 25 bp, Homo sapien
attgagctaacccagtacatgctag

SEQ ID NO: 389504 - DNA, 25 bp, Homo sapien
ccagtacatgctaggacctgtccta

SEQ ID NO: 389505 - DNA, 25 bp, Homo sapien
gggccacttttcattacctgagtta

SEQ ID NO: 389506 - DNA, 25 bp, Homo sapien
gggcaatagccattatttttgtgga

SEQ ID NO: 389507 - DNA, 25 bp, Homo sapien
atgtatagatttcattgaccaacta

SEQ ID NO: 389508 - DNA, 25 bp, Homo sapien
gttgggtgtctgtaaatgagaccaa

SEQ ID NO: 389509 - DNA, 25 bp, Homo sapien
tgagaccaaaacgtgggttgctttt

SEQ ID NO: 389510 - DNA, 25 bp, Homo sapien
agtatttgcattacattcataaaag

SEQ ID NO: 389511 - DNA, 25 bp, Homo sapien
ttcataaaagtgtgcaagtcctgtg

SEQ ID NO: 389512 - DNA, 25 bp, Homo sapien
aagtgtgcaagtcctgtgactccca

SEQ ID NO: 389513 - DNA, 25 bp, Homo sapien
gcaagtcctgtgactcccagcttaa

SEQ ID NO: 389514 - DNA, 25 bp, Homo sapien
ctgtgactcccagcttaactgaaat

SEQ ID NO: 389515 - DNA, 25 bp, Homo sapien
gtgactcccagcttaactgaaatac

SEQ ID NO: 389516 - DNA, 25 bp, Homo sapien
gaaatactgttatgccacctaactt

SEQ ID NO: 389517 - DNA, 25 bp, Homo sapien
tgatgtaaaatgatatcccatgaat

SEQ ID NO: 389518 - DNA, 25 bp, Homo sapien
tgtttttcacaaagctcttattatg

SEQ ID NO: 389519 - DNA, 25 bp, Homo sapien
cacaaagctcttattatgaagcaaa

SEQ ID NO: 389520 - DNA, 25 bp, Homo sapien
tcattcattcctgttaagctgccaa

SEQ ID NO: 389521 - DNA, 25 bp, Homo sapien
ttcattcctgttaagctgccaaaaa

SEQ ID NO: 389522 - DNA, 25 bp, Homo sapien
attcctgttaagctgccaaaaatta

SEQ ID NO: 389523 - DNA, 25 bp, Homo sapien
ttaagctgccaaaaattaaagtgca

SEQ ID NO: 389524 - DNA, 25 bp, Homo sapien
gatgtttctcagatcacaagaaata

SEQ ID NO: 389525 - DNA, 25 bp, Homo sapien
atttacatccaatacactgaatctt

SEQ ID NO: 389526 - DNA, 25 bp, Homo sapien
acatccaatacactgaatcttcctt

SEQ ID NO: 389527 - DNA, 25 bp, Homo sapien
atatttggtttatttggcactactg

SEQ ID NO: 389528 - DNA, 25 bp, Homo sapien
ggtttatttggcactactgtaagtt

SEQ ID NO: 389529 - DNA, 25 bp, Homo sapien
ggaaaattttcagagtattctagtt

SEQ ID NO: 389530 - DNA, 25 bp, Homo sapien
tttctaattctgtaaattctattac

SEQ ID NO: 389531 - DNA, 25 bp, Homo sapien
aagtatgttgtttattacaactcat

SEQ ID NO: 389532 - DNA, 25 bp, Homo sapien
tattacaactcattacaactaccta

SEQ ID NO: 389533 - DNA, 25 bp, Homo sapien
tacaactcattacaactacctaaat

SEQ ID NO: 389534 - DNA, 25 bp, Homo sapien
caactcattacaactacctaaattt

SEQ ID NO: 389535 - DNA, 25 bp, Homo sapien
tcattacaactacctaaattttagg

SEQ ID NO: 389536 - DNA, 25 bp, Homo sapien
ggtgttaactgtatttaagtaaatg

SEQ ID NO: 389537 - DNA, 25 bp, Homo sapien
aaaatactgatgttcacttaaagat

SEQ ID NO: 389538 - DNA, 25 bp, Homo sapien
gatgttcacttaaagatattcagca

SEQ ID NO: 389539 - DNA, 25 bp, Homo sapien
gttcacttaaagatattcagcaatt

SEQ ID NO: 389540 - DNA, 25 bp, Homo sapien
ataaaatacaggtacatcaaagtgt

SEQ ID NO: 389541 - DNA, 25 bp, Homo sapien
tacaggtacatcaaagtgtaaactt

SEQ ID NO: 389542 - DNA, 25 bp, Homo sapien
atgataaagatacatgaaacggttt

SEQ ID NO: 389543 - DNA, 25 bp, Homo sapien
catgaaacggtttagtatgaaactt

SEQ ID NO: 389544 - DNA, 25 bp, Homo sapien
aaacttagtgttttagtagatcttg

SEQ ID NO: 389545 - DNA, 25 bp, Homo sapien
cttagtgttttagtagatcttgtga

SEQ ID NO: 389546 - DNA, 25 bp, Homo sapien
gtgttttagtagatcttgtgatttc

SEQ ID NO: 389547 - DNA, 25 bp, Homo sapien
agtagatcttgtgatttctgaaaac

SEQ ID NO: 389548 - DNA, 25 bp, Homo sapien
tagatcttgtgatttctgaaaacga

SEQ ID NO: 389549 - DNA, 25 bp, Homo sapien
gatcttgtgatttctgaaaacgaat

SEQ ID NO: 389550 - DNA, 25 bp, Homo sapien
tgtgatttctgaaaacgaatttctt

SEQ ID NO: 389551 - DNA, 25 bp, Homo sapien
ttttctgccttgataacatttcata

SEQ ID NO: 389552 - DNA, 25 bp, Homo sapien
tgtggtattagttttaaagggtcat

SEQ ID NO: 389553 - DNA, 25 bp, Homo sapien
gaaaatgcacatattccatgaattt

SEQ ID NO: 389554 - DNA, 25 bp, Homo sapien
ttccatgaattttaagacccataga

SEQ ID NO: 389555 - DNA, 25 bp, Homo sapien
ttttcttatccagtaatgtaaacac

SEQ ID NO: 389556 - DNA, 25 bp, Homo sapien
gacagaacattgagatgtgcctagt

SEQ ID NO: 389557 - DNA, 25 bp, Homo sapien
gtatttacagtttggtctggctgtt

SEQ ID NO: 389558 - DNA, 25 bp, Homo sapien
acagtttggtctggctgtttgagtt

SEQ ID NO: 389559 - DNA, 25 bp, Homo sapien
ggctgtttgagttctagcgcattta

SEQ ID NO: 389560 - DNA, 25 bp, Homo sapien
tgagttctagcgcatttaatgttaa

SEQ ID NO: 389561 - DNA, 25 bp, Homo sapien
gaaattgtccagaacgagaatattg

SEQ ID NO: 389562 - DNA, 25 bp, Homo sapien
gaagaccaagaatcatccgctgcct

SEQ ID NO: 389563 - DNA, 25 bp, Homo sapien
gctgcctcatgactcacaacaaagg

SEQ ID NO: 389564 - DNA, 25 bp, Homo sapien
gggtcagctttagcctggcagcctc

SEQ ID NO: 389565 - DNA, 25 bp, Homo sapien
tttagcctggcagcctccatcgatg

SEQ ID NO: 389566 - DNA, 25 bp, Homo sapien
tctgtgccccttccacgggctggga

SEQ ID NO: 389567 - DNA, 25 bp, Homo sapien
acgggctgggacatgccttggattc

SEQ ID NO: 389568 - DNA, 25 bp, Homo sapien
atgccttggattctgatgctgctgc

SEQ ID NO: 389569 - DNA, 25 bp, Homo sapien
gctgctgctcacaatgggccaggga

SEQ ID NO: 389570 - DNA, 25 bp, Homo sapien
caatgggccagggagttgtcatcct

SEQ ID NO: 389571 - DNA, 25 bp, Homo sapien
agggagttgtcatcctggccctcag

SEQ ID NO: 389572 - DNA, 25 bp, Homo sapien
ctcagcatcgtgctctggaggcaga

SEQ ID NO: 389573 - DNA, 25 bp, Homo sapien
tctactgtactaatgtttagatgat

SEQ ID NO: 389574 - DNA, 25 bp, Homo sapien
gatgatagcagataaaacaccaaag

SEQ ID NO: 389575 - DNA, 25 bp, Homo sapien
caccaaagcaaaggatatgagctat

SEQ ID NO: 389576 - DNA, 25 bp, Homo sapien
atgagctatttaggaattgattata

SEQ ID NO: 389577 - DNA, 25 bp, Homo sapien
gtttaggattttaagtatctacatt

SEQ ID NO: 389578 - DNA, 25 bp, Homo sapien
gtagactacaagtggttgttaccca

SEQ ID NO: 389579 - DNA, 25 bp, Homo sapien
gactacaagtggttgttacccattc

SEQ ID NO: 389580 - DNA, 25 bp, Homo sapien
tacaagtggttgttacccattcaat

SEQ ID NO: 389581 - DNA, 25 bp, Homo sapien
aagtggttgttacccattcaatgac

SEQ ID NO: 389582 - DNA, 25 bp, Homo sapien
gtggttgttacccattcaatgacta

SEQ ID NO: 389583 - DNA, 25 bp, Homo sapien
ggttgttacccattcaatgactatt

SEQ ID NO: 389584 - DNA, 25 bp, Homo sapien
taaagtgtaataccagttttgttat

SEQ ID NO: 389585 - DNA, 25 bp, Homo sapien
tgtaataccagttttgttattttag

SEQ ID NO: 389586 - DNA, 25 bp, Homo sapien
tgggatgattgttaaagttccccaa

SEQ ID NO: 389587 - DNA, 25 bp, Homo sapien
ccccaaaaatgttggcatgaaatta

SEQ ID NO: 389588 - DNA, 25 bp, Homo sapien
acacattttgctatctgtgtcatca

SEQ ID NO: 389589 - DNA, 25 bp, Homo sapien
ttttgctatctgtgtcatcaggata

SEQ ID NO: 389590 - DNA, 25 bp, Homo sapien
tatctgtgtcatcaggatagtgtaa

SEQ ID NO: 389591 - DNA, 25 bp, Homo sapien
tgtcatcaggatagtgtaagtggta

SEQ ID NO: 389592 - DNA, 25 bp, Homo sapien
gtagagactaccctagacatctgca

SEQ ID NO: 389593 - DNA, 25 bp, Homo sapien
agactaccctagacatctgcatctt

SEQ ID NO: 389594 - DNA, 25 bp, Homo sapien
ctaccctagacatctgcatctttgt

SEQ ID NO: 389595 - DNA, 25 bp, Homo sapien
aggccacaggcgtcgggcgtgaaga

SEQ ID NO: 389596 - DNA, 25 bp, Homo sapien
tgaagagcgcgatggccttgaggca

SEQ ID NO: 389597 - DNA, 25 bp, Homo sapien
agcttgtccacctgctcctggaagg

SEQ ID NO: 389598 - DNA, 25 bp, Homo sapien
tgtccacctgctcctggaaggcgcg

SEQ ID NO: 389599 - DNA, 25 bp, Homo sapien
gaaggcgcgcacctggtccatgaaa

SEQ ID NO: 389600 - DNA, 25 bp, Homo sapien
gcgcacctggtccatgaaagccacg

SEQ ID NO: 389601 - DNA, 25 bp, Homo sapien
tggtccatgaaagccacggcgcgct

SEQ ID NO: 389602 - DNA, 25 bp, Homo sapien
tcggcggccataggcgcggcgtgga

SEQ ID NO: 389603 - DNA, 25 bp, Homo sapien
tgcgccgcgttcagcacgaagagct

SEQ ID NO: 389604 - DNA, 25 bp, Homo sapien
gttcagcacgaagagctcgctccag

SEQ ID NO: 389605 - DNA, 25 bp, Homo sapien
aagagctcgctccagctcaggcgca

SEQ ID NO: 389606 - DNA, 25 bp, Homo sapien
aggtcgctgtgcaacttggacccat

SEQ ID NO: 389607 - DNA, 25 bp, Homo sapien
agaaagaatctcaggctaataagga

SEQ ID NO: 389608 - DNA, 25 bp, Homo sapien
tcactgccttacttaaatcgagttg

SEQ ID NO: 389609 - DNA, 25 bp, Homo sapien
aatgcaactgtttctatgatcctag

SEQ ID NO: 389610 - DNA, 25 bp, Homo sapien
gaaaactttccgactgtagtaagct

SEQ ID NO: 389611 - DNA, 25 bp, Homo sapien
ccgactgtagtaagctttaggattt

SEQ ID NO: 389612 - DNA, 25 bp, Homo sapien
aggattttgactgcactactgtgtt

SEQ ID NO: 389613 - DNA, 25 bp, Homo sapien
actgcactactgtgtttggtgactg

SEQ ID NO: 389614 - DNA, 25 bp, Homo sapien
taaggaatccggtttgcatatgctg

SEQ ID NO: 389615 - DNA, 25 bp, Homo sapien
ggaatccggtttgcatatgctgtca

SEQ ID NO: 389616 - DNA, 25 bp, Homo sapien
gtgtaaatgaggtcgctgtgcaact

SEQ ID NO: 389617 - DNA, 25 bp, Homo sapien
ctgctatgggtccatgcttgcagga

SEQ ID NO: 389618 - DNA, 25 bp, Homo sapien
acagctgtgtagaatttcctattgc

SEQ ID NO: 389619 - DNA, 25 bp, Homo sapien
ttcctattgcatttcatttgtgggt

SEQ ID NO: 389620 - DNA, 25 bp, Homo sapien
ttgtgggtttagaactcggttgctt

SEQ ID NO: 389621 - DNA, 25 bp, Homo sapien
gaactcggttgcttatttcatattg

SEQ ID NO: 389622 - DNA, 25 bp, Homo sapien
aggtttgtatgtgcgcagagccctg

SEQ ID NO: 389623 - DNA, 25 bp, Homo sapien
caaggtacatttttccaacttctct

SEQ ID NO: 389624 - DNA, 25 bp, Homo sapien
gtcgcaatgccccagcaagcttctt

SEQ ID NO: 389625 - DNA, 25 bp, Homo sapien
caagcttcttgttggcatgtggcca

SEQ ID NO: 389626 - DNA, 25 bp, Homo sapien
atgtggccactctaaattgtgctcc

SEQ ID NO: 389627 - DNA, 25 bp, Homo sapien
gctccaggatctgctatgggtccat

SEQ ID NO: 389628 - DNA, 25 bp, Homo sapien
ttatttctttttctgttgaggcttc

SEQ ID NO: 389629 - DNA, 25 bp, Homo sapien
tatttctttttctgttgaggcttcc

SEQ ID NO: 389630 - DNA, 25 bp, Homo sapien
tctttttctgttgaggcttccccct

SEQ ID NO: 389631 - DNA, 25 bp, Homo sapien
tttttctgttgaggcttccccctct

SEQ ID NO: 389632 - DNA, 25 bp, Homo sapien
tttctgttgaggcttccccctctct

SEQ ID NO: 389633 - DNA, 25 bp, Homo sapien
tctgttgaggcttccccctctctga

SEQ ID NO: 389634 - DNA, 25 bp, Homo sapien
ggtggcattagccactccctgcctc

SEQ ID NO: 389635 - DNA, 25 bp, Homo sapien
tccctgcctctcactccagacctgt

SEQ ID NO: 389636 - DNA, 25 bp, Homo sapien
actccagacctgttcccacaactgg

SEQ ID NO: 389637 - DNA, 25 bp, Homo sapien
cagacctgttcccacaactggggag

SEQ ID NO: 389638 - DNA, 25 bp, Homo sapien
gacctgttcccacaactggggaggt

SEQ ID NO: 389639 - DNA, 25 bp, Homo sapien
ttcagttggataaagtggacgtcat

SEQ ID NO: 389640 - DNA, 25 bp, Homo sapien
gtggacgtcatacctgtgacagcta

SEQ ID NO: 389641 - DNA, 25 bp, Homo sapien
gtgacagctatcaacttatatccag

SEQ ID NO: 389642 - DNA, 25 bp, Homo sapien
acttatatccagatggtccagagaa

SEQ ID NO: 389643 - DNA, 25 bp, Homo sapien
taaaacgccatctcatatcatggac

SEQ ID NO: 389644 - DNA, 25 bp, Homo sapien
atcatggactccgaagtagcctgtt

SEQ ID NO: 389645 - DNA, 25 bp, Homo sapien
gaagtagcctgttgcctccaaattt

SEQ ID NO: 389646 - DNA, 25 bp, Homo sapien
gcctccaaatttgccacttgaatat

SEQ ID NO: 389647 - DNA, 25 bp, Homo sapien
cagtttttgaacatcatggtggttg

SEQ ID NO: 389648 - DNA, 25 bp, Homo sapien
gcagctgtggtaataaccatcttaa

SEQ ID NO: 389649 - DNA, 25 bp, Homo sapien
gtgtttttcccagtttctgaataca

SEQ ID NO: 389650 - DNA, 25 bp, Homo sapien
tcacatgctgagaattgttaacaag

SEQ ID NO: 389651 - DNA, 25 bp, Homo sapien
agtacagtactcaatacgcaatgtt

SEQ ID NO: 389652 - DNA, 25 bp, Homo sapien
tacgcaatgttagaacttactttgt

SEQ ID NO: 389653 - DNA, 25 bp, Homo sapien
aatatctatcccctaaccccaagat

SEQ ID NO: 389654 - DNA, 25 bp, Homo sapien
cctaaccccaagatgcttacaatct

SEQ ID NO: 389655 - DNA, 25 bp, Homo sapien
gatgcttacaatcttcctagagttc

SEQ ID NO: 389656 - DNA, 25 bp, Homo sapien
tcttcctagagttcaaggcttgctt

SEQ ID NO: 389657 - DNA, 25 bp, Homo sapien
gaggcaatgaatggcaatacagata

SEQ ID NO: 389658 - DNA, 25 bp, Homo sapien
gaagttcgctgtaagttggtgtagt

SEQ ID NO: 389659 - DNA, 25 bp, Homo sapien
aatgatgatctgtagttcgtctgag

SEQ ID NO: 389660 - DNA, 25 bp, Homo sapien
tctgtagttcgtctgagagagttgc

SEQ ID NO: 389661 - DNA, 25 bp, Homo sapien
aggccacgctgtgttgacgctgcac

SEQ ID NO: 389662 - DNA, 25 bp, Homo sapien
ttgacgctgcactcagcacgtgggt

SEQ ID NO: 389663 - DNA, 25 bp, Homo sapien
tcagcacgtgggtgttggctctgcc

SEQ ID NO: 389664 - DNA, 25 bp, Homo sapien
ggaccctacaggaggctgcggccct

SEQ ID NO: 389665 - DNA, 25 bp, Homo sapien
ctgcggccctgagagcctgggatca

SEQ ID NO: 389666 - DNA, 25 bp, Homo sapien
tgggatcagcgaggtgtccgacatc

SEQ ID NO: 389667 - DNA, 25 bp, Homo sapien
gaggtgtccgacatcccttcctcaa

SEQ ID NO: 389668 - DNA, 25 bp, Homo sapien
ttattttatagccacaaccctcttg

SEQ ID NO: 389669 - DNA, 25 bp, Homo sapien
tgtggatgtatcacttctctctaaa

SEQ ID NO: 389670 - DNA, 25 bp, Homo sapien
taaaatgtcattgttagcactaatt

SEQ ID NO: 389671 - DNA, 25 bp, Homo sapien
gttagcactaattacaggttcatgt

SEQ ID NO: 389672 - DNA, 25 bp, Homo sapien
tcacctaccccagggaacttccaag

SEQ ID NO: 389673 - DNA, 25 bp, Homo sapien
gactaagtgggcagaagaaaccctt

SEQ ID NO: 389674 - DNA, 25 bp, Homo sapien
agaagaaacccttggcagccctgtg

SEQ ID NO: 389675 - DNA, 25 bp, Homo sapien
cagccctgtgcctctcgaatgttag

SEQ ID NO: 389676 - DNA, 25 bp, Homo sapien
gtgcctctcgaatgttagccttgga

SEQ ID NO: 389677 - DNA, 25 bp, Homo sapien
gcctctcgaatgttagccttggatg

SEQ ID NO: 389678 - DNA, 25 bp, Homo sapien
ctctcgaatgttagccttggatggg

SEQ ID NO: 389679 - DNA, 25 bp, Homo sapien
gggctttcacagttagaagagctga

SEQ ID NO: 389680 - DNA, 25 bp, Homo sapien
tcacagttagaagagctgaaaccag

SEQ ID NO: 389681 - DNA, 25 bp, Homo sapien
gccggtgggagaggcccgggtcaga

SEQ ID NO: 389682 - DNA, 25 bp, Homo sapien
aagaaccttgcccaaactcaggcag

SEQ ID NO: 389683 - DNA, 25 bp, Homo sapien
gccccgtaaggcctgggcgccgtgg

SEQ ID NO: 389684 - DNA, 25 bp, Homo sapien
ggccctgtgccctcctagaggagca

SEQ ID NO: 389685 - DNA, 25 bp, Homo sapien
tgtgccctcctagaggagcaggcac

SEQ ID NO: 389686 - DNA, 25 bp, Homo sapien
tagaggagcaggcacctcccccaga

SEQ ID NO: 389687 - DNA, 25 bp, Homo sapien
tgccccaagtcttttaacctgggtg

SEQ ID NO: 389688 - DNA, 25 bp, Homo sapien
agtcttttaacctgggtgttagcat

SEQ ID NO: 389689 - DNA, 25 bp, Homo sapien
gtcttttaacctgggtgttagcatt

SEQ ID NO: 389690 - DNA, 25 bp, Homo sapien
actagtgatgtttgtacaaccaaag

SEQ ID NO: 389691 - DNA, 25 bp, Homo sapien
gatgtttgtacaaccaaagactcta

SEQ ID NO: 389692 - DNA, 25 bp, Homo sapien
gtttgtacaaccaaagactctattt

SEQ ID NO: 389693 - DNA, 25 bp, Homo sapien
acaaccaaagactctattttgtggt

SEQ ID NO: 389694 - DNA, 25 bp, Homo sapien
ctaactgtagaccaggcgagggcac

SEQ ID NO: 389695 - DNA, 25 bp, Homo sapien
ctgcttccccagtgtacatattgta

SEQ ID NO: 389696 - DNA, 25 bp, Homo sapien
gcttccccagtgtacatattgtatc

SEQ ID NO: 389697 - DNA, 25 bp, Homo sapien
gtacatattgtatctgtgtaacatt

SEQ ID NO: 389698 - DNA, 25 bp, Homo sapien
gtgtaacattttgtatattccaggg

SEQ ID NO: 389699 - DNA, 25 bp, Homo sapien
cccctgtatcatacctagcagaggt

SEQ ID NO: 389700 - DNA, 25 bp, Homo sapien
ctagcagaggttggagctggcacat

SEQ ID NO: 389701 - DNA, 25 bp, Homo sapien
aacttatttattgatagcataggac

SEQ ID NO: 389702 - DNA, 25 bp, Homo sapien
tcgtggcgccctggtgatgcgactc

SEQ ID NO: 389703 - DNA, 25 bp, Homo sapien
cctggtgatgcgactcctgtttatt

SEQ ID NO: 389704 - DNA, 25 bp, Homo sapien
ggtgatgcgactcctgtttattttg

SEQ ID NO: 389705 - DNA, 25 bp, Homo sapien
ggactttaggtgtcattaactcttc

SEQ ID NO: 389706 - DNA, 25 bp, Homo sapien
gtgtcattaactcttcacacctgtt

SEQ ID NO: 389707 - DNA, 25 bp, Homo sapien
gggctccacatcagtcaggcaactt

SEQ ID NO: 389708 - DNA, 25 bp, Homo sapien
agtcaggcaacttttcttcgtgggc

SEQ ID NO: 389709 - DNA, 25 bp, Homo sapien
tcgtgggcattctctaatgagagaa

SEQ ID NO: 389710 - DNA, 25 bp, Homo sapien
ctctaatgagagaagtctgacgatt

SEQ ID NO: 389711 - DNA, 25 bp, Homo sapien
gtctgacgattagaaatttgcggat

SEQ ID NO: 389712 - DNA, 25 bp, Homo sapien
gaaatttgcggattaatgtctcgaa

SEQ ID NO: 389713 - DNA, 25 bp, Homo sapien
gcggattaatgtctcgaagggctaa

SEQ ID NO: 389714 - DNA, 25 bp, Homo sapien
atacattgattgctggcttttcttc

SEQ ID NO: 389715 - DNA, 25 bp, Homo sapien
ttgattgctggcttttcttcttaga

SEQ ID NO: 389716 - DNA, 25 bp, Homo sapien
gacttttaaatctagctatagagtt

SEQ ID NO: 389717 - DNA, 25 bp, Homo sapien
aaatctagctatagagttgggaaaa

SEQ ID NO: 389718 - DNA, 25 bp, Homo sapien
tatttccacttagatattttacatg

SEQ ID NO: 389719 - DNA, 25 bp, Homo sapien
aacacatgaccacatatgtatatgt

SEQ ID NO: 389720 - DNA, 25 bp, Homo sapien
gtatatctacctaaacattgtatca

SEQ ID NO: 389721 - DNA, 25 bp, Homo sapien
aacattgtatcatggtttcagtatg

SEQ ID NO: 389722 - DNA, 25 bp, Homo sapien
atcatggtttcagtatgttattcat

SEQ ID NO: 389723 - DNA, 25 bp, Homo sapien
gtatgttattcatgtattactggga

SEQ ID NO: 389724 - DNA, 25 bp, Homo sapien
tcatgtattactgggagatgctacc

SEQ ID NO: 389725 - DNA, 25 bp, Homo sapien
gtattactgggagatgctaccaaga

SEQ ID NO: 389726 - DNA, 25 bp, Homo sapien
ggagatgctaccaagaaaccaaccc

SEQ ID NO: 389727 - DNA, 25 bp, Homo sapien
agggttaattcaatacatggctgaa

SEQ ID NO: 389728 - DNA, 25 bp, Homo sapien
acatggctgaaattaccaaatgtat

SEQ ID NO: 389729 - DNA, 25 bp, Homo sapien
aaatacctcattttcactaccatac

SEQ ID NO: 389730 - DNA, 25 bp, Homo sapien
atacctcattttcactaccatacaa

SEQ ID NO: 389731 - DNA, 25 bp, Homo sapien
acctcattttcactaccatacaaga

SEQ ID NO: 389732 - DNA, 25 bp, Homo sapien
aaacacctattttgattgatcagtt

SEQ ID NO: 389733 - DNA, 25 bp, Homo sapien
tcttttgtatgaatatccacctcct

SEQ ID NO: 389734 - DNA, 25 bp, Homo sapien
gtatgaatatccacctcctttaaat

SEQ ID NO: 389735 - DNA, 25 bp, Homo sapien
gaatatccacctcctttaaatactc

SEQ ID NO: 389736 - DNA, 25 bp, Homo sapien
atccacctcctttaaatactctatt

SEQ ID NO: 389737 - DNA, 25 bp, Homo sapien
aaacaatacaaatctgcatcttaca

SEQ ID NO: 389738 - DNA, 25 bp, Homo sapien
acaaaagatgttgtgtgcggtctcc

SEQ ID NO: 389739 - DNA, 25 bp, Homo sapien
gtatcggtgtggatccaacagctct

SEQ ID NO: 389740 - DNA, 25 bp, Homo sapien
ggtgtggatccaacagctctccagg

SEQ ID NO: 389741 - DNA, 25 bp, Homo sapien
gctctccagggagtcacattgcatg

SEQ ID NO: 389742 - DNA, 25 bp, Homo sapien
gttgagttgacggttcttgtgatat

SEQ ID NO: 389743 - DNA, 25 bp, Homo sapien
gtgatatgtaaacccccgagaccaa

SEQ ID NO: 389744 - DNA, 25 bp, Homo sapien
ctttgttttggtgccgtttctccat

SEQ ID NO: 389745 - DNA, 25 bp, Homo sapien
tttggtgccgtttctccatttacag

SEQ ID NO: 389746 - DNA, 25 bp, Homo sapien
tccatttacagccaaatcagtttca

SEQ ID NO: 389747 - DNA, 25 bp, Homo sapien
cagccaaatcagtttcatgatgttc

SEQ ID NO: 389748 - DNA, 25 bp, Homo sapien
gatgttcaaaacatttactgatgtc

SEQ ID NO: 389749 - DNA, 25 bp, Homo sapien
tctgtccaactattcaggtgtattg

SEQ ID NO: 389750 - DNA, 25 bp, Homo sapien
attcaggtgtattgatgtagacagc

SEQ ID NO: 389751 - DNA, 25 bp, Homo sapien
tgatgtagacagcagaatctcttct

SEQ ID NO: 389752 - DNA, 25 bp, Homo sapien
tgtagacagcagaatctcttctgaa

SEQ ID NO: 389753 - DNA, 25 bp, Homo sapien
cactggactctgcacgcacttctta

SEQ ID NO: 389754 - DNA, 25 bp, Homo sapien
gcacttcttacagcctaactttcta

SEQ ID NO: 389755 - DNA, 25 bp, Homo sapien
ttacagcctaactttctatttcact

SEQ ID NO: 389756 - DNA, 25 bp, Homo sapien
gcctaactttctatttcactgtgct

SEQ ID NO: 389757 - DNA, 25 bp, Homo sapien
atttcactgtgcttcatagttagaa

SEQ ID NO: 389758 - DNA, 25 bp, Homo sapien
aaagatttcaattttctgtccaact

SEQ ID NO: 389759 - DNA, 25 bp, Homo sapien
aattttctgtccaactattcaggtg

SEQ ID NO: 389760 - DNA, 25 bp, Homo sapien
tgctttttaaagcatcctttcaaga

SEQ ID NO: 389761 - DNA, 25 bp, Homo sapien
tattgaataattggagctgagaact

SEQ ID NO: 389762 - DNA, 25 bp, Homo sapien
gctgagaactcaggagcttcactgt

SEQ ID NO: 389763 - DNA, 25 bp, Homo sapien
aactcaggagcttcactgtagtaga

SEQ ID NO: 389764 - DNA, 25 bp, Homo sapien
tgccaattggacgtttttcagtaac

SEQ ID NO: 389765 - DNA, 25 bp, Homo sapien
aattggacgtttttcagtaacagtg

SEQ ID NO: 389766 - DNA, 25 bp, Homo sapien
gaaggagtggagtgaatgccaaata

SEQ ID NO: 389767 - DNA, 25 bp, Homo sapien
tgccaaatatttgccctgggtggtt

SEQ ID NO: 389768 - DNA, 25 bp, Homo sapien
caaatatttgccctgggtggttcct

SEQ ID NO: 389769 - DNA, 25 bp, Homo sapien
atctcttcagttaaacatggtgcag

SEQ ID NO: 389770 - DNA, 25 bp, Homo sapien
agttaaacatggtgcagtattctct

SEQ ID NO: 389771 - DNA, 25 bp, Homo sapien
ggtagtaactggtcctgggcattca

SEQ ID NO: 389772 - DNA, 25 bp, Homo sapien
ctggtcctgggcattcagattttta

SEQ ID NO: 389773 - DNA, 25 bp, Homo sapien
gttgtcttagctaatttctgggatt

SEQ ID NO: 389774 - DNA, 25 bp, Homo sapien
gttaatagctattattggcactcta

SEQ ID NO: 389775 - DNA, 25 bp, Homo sapien
gctattattggcactctatgttaca

SEQ ID NO: 389776 - DNA, 25 bp, Homo sapien
ggcactctatgttacaatattaagg

SEQ ID NO: 389777 - DNA, 25 bp, Homo sapien
taaatagattcccacttagccacga

SEQ ID NO: 389778 - DNA, 25 bp, Homo sapien
acttagccacgatgcttttcttaag

SEQ ID NO: 389779 - DNA, 25 bp, Homo sapien
ttttcttaagcataattcatctcta

SEQ ID NO: 389780 - DNA, 25 bp, Homo sapien
gatcttaactcacttttttctaatg

SEQ ID NO: 389781 - DNA, 25 bp, Homo sapien
ctttcaactggtagtaactggtcct

SEQ ID NO: 389782 - DNA, 25 bp, Homo sapien
ccaatttgatttgctagtattagac

SEQ ID NO: 389783 - DNA, 25 bp, Homo sapien
gacaataaactgtacaaggaaattt

SEQ ID NO: 389784 - DNA, 25 bp, Homo sapien
aggaaatttattatctcagtgtctt

SEQ ID NO: 389785 - DNA, 25 bp, Homo sapien
aatttattatctcagtgtctttatt

SEQ ID NO: 389786 - DNA, 25 bp, Homo sapien
tatttagcataaaagtggccttaga

SEQ ID NO: 389787 - DNA, 25 bp, Homo sapien
aaggttagatagatggaatctctgt

SEQ ID NO: 389788 - DNA, 25 bp, Homo sapien
ggacaaacagctgtagcatcccctt

SEQ ID NO: 389789 - DNA, 25 bp, Homo sapien
aaacagctgtagcatccccttagca

SEQ ID NO: 389790 - DNA, 25 bp, Homo sapien
tagcatccccttagcatctttctag

SEQ ID NO: 389791 - DNA, 25 bp, Homo sapien
cccttagcatctttctagccaatga

SEQ ID NO: 389792 - DNA, 25 bp, Homo sapien
tagcatctttctagccaatgagccc

SEQ ID NO: 389793 - DNA, 25 bp, Homo sapien
ttcttaatgcctgaaattttctcca

SEQ ID NO: 389794 - DNA, 25 bp, Homo sapien
ctccattggcccgaaagcagtaaaa

SEQ ID NO: 389795 - DNA, 25 bp, Homo sapien
cattggcccgaaagcagtaaaaatt

SEQ ID NO: 389796 - DNA, 25 bp, Homo sapien
aattgttcattaatcttccgttagg

SEQ ID NO: 389797 - DNA, 25 bp, Homo sapien
gttcattaatcttccgttaggccaa

SEQ ID NO: 389798 - DNA, 25 bp, Homo sapien
taatcttccgttaggccaataaaag

SEQ ID NO: 389799 - DNA, 25 bp, Homo sapien
agaagggcctcacaagacaaaacag

SEQ ID NO: 389800 - DNA, 25 bp, Homo sapien
actgaatatcccatcatcctatttc

SEQ ID NO: 389801 - DNA, 25 bp, Homo sapien
gaatatcccatcatcctatttcatg

SEQ ID NO: 389802 - DNA, 25 bp, Homo sapien
atcccatcatcctatttcatgtata

SEQ ID NO: 389803 - DNA, 25 bp, Homo sapien
agtttttatacatcctttcattgaa

SEQ ID NO: 389804 - DNA, 25 bp, Homo sapien
ggccctgtgccctcctagaggagca

SEQ ID NO: 389805 - DNA, 25 bp, Homo sapien
tgtgccctcctagaggagcaggcac

SEQ ID NO: 389806 - DNA, 25 bp, Homo sapien
tagaggagcaggcacctcccccaga

SEQ ID NO: 389807 - DNA, 25 bp, Homo sapien
tgccccaagtcttttaacctgggtg

SEQ ID NO: 389808 - DNA, 25 bp, Homo sapien
gtcttttaacctgggtgttagcatt

SEQ ID NO: 389809 - DNA, 25 bp, Homo sapien
tttaaagagaccccacaggagttct

SEQ ID NO: 389810 - DNA, 25 bp, Homo sapien
tctggcctgtgactaactaactgcc

SEQ ID NO: 389811 - DNA, 25 bp, Homo sapien
gacctcggcgagactgtaactagtg

SEQ ID NO: 389812 - DNA, 25 bp, Homo sapien
actagtgatgtttgtacaaccaaag

SEQ ID NO: 389813 - DNA, 25 bp, Homo sapien
gtttgtacaaccaaagactctattt

SEQ ID NO: 389814 - DNA, 25 bp, Homo sapien
acaaccaaagactctattttgtggt

SEQ ID NO: 389815 - DNA, 25 bp, Homo sapien
gcaattcctgttagcaaaacttcta

SEQ ID NO: 389816 - DNA, 25 bp, Homo sapien
aaatgcaggattcttccagtgagcc

SEQ ID NO: 389817 - DNA, 25 bp, Homo sapien
gcaggattcttccagtgagccagca

SEQ ID NO: 389818 - DNA, 25 bp, Homo sapien
gtgagccagcatttcccatagctaa

SEQ ID NO: 389819 - DNA, 25 bp, Homo sapien
agcatttcccatagctaaccctatt

SEQ ID NO: 389820 - DNA, 25 bp, Homo sapien
agctaaccctattctcttagtcttt

SEQ ID NO: 389821 - DNA, 25 bp, Homo sapien
gaatgggtccaataatggctataag

SEQ ID NO: 389822 - DNA, 25 bp, Homo sapien
gtaataaatcccatcttaatttgtt

SEQ ID NO: 389823 - DNA, 25 bp, Homo sapien
gtttcataaatcactgaacacttat

SEQ ID NO: 389824 - DNA, 25 bp, Homo sapien
aactgaaacttcataaaggatgcat

SEQ ID NO: 389825 - DNA, 25 bp, Homo sapien
attttaaggcttgtattgtttgatt

SEQ ID NO: 389826 - DNA, 25 bp, Homo sapien
cggcccgagtgagccattcttatct

SEQ ID NO: 389827 - DNA, 25 bp, Homo sapien
ttcttatctcttagggaatggtggg

SEQ ID NO: 389828 - DNA, 25 bp, Homo sapien
ccctcctggagtctatgttcttaga

SEQ ID NO: 389829 - DNA, 25 bp, Homo sapien
tatgttcttagacaccacccaaggg

SEQ ID NO: 389830 - DNA, 25 bp, Homo sapien
ttcttagacaccacccaagggccaa

SEQ ID NO: 389831 - DNA, 25 bp, Homo sapien
aaccttgaagcaggcctttccaagg

SEQ ID NO: 389832 - DNA, 25 bp, Homo sapien
aggcctttccaaggatcgcagttga

SEQ ID NO: 389833 - DNA, 25 bp, Homo sapien
aaggatcgcagttgaggcctgctct

SEQ ID NO: 389834 - DNA, 25 bp, Homo sapien
tgaggcctgctctgttactgttttt

SEQ ID NO: 389835 - DNA, 25 bp, Homo sapien
tactgtttttctgcacagtgtgcaa

SEQ ID NO: 389836 - DNA, 25 bp, Homo sapien
ttttctgcacagtgtgcaacaccac

SEQ ID NO: 389837 - DNA, 25 bp, Homo sapien
ttgagctacaatatggcagcagatt

SEQ ID NO: 389838 - DNA, 25 bp, Homo sapien
acagaacatagccttgttgccacga

SEQ ID NO: 389839 - DNA, 25 bp, Homo sapien
catagccttgttgccacgagacagg

SEQ ID NO: 389840 - DNA, 25 bp, Homo sapien
gacaggacacaggattccaagtact

SEQ ID NO: 389841 - DNA, 25 bp, Homo sapien
acaggattccaagtactcagtagcg

SEQ ID NO: 389842 - DNA, 25 bp, Homo sapien
gattccaagtactcagtagcggcga

SEQ ID NO: 389843 - DNA, 25 bp, Homo sapien
caagtactcagtagcggcgagtgaa

SEQ ID NO: 389844 - DNA, 25 bp, Homo sapien
cgccctgcatgccaccgtgtgggat

SEQ ID NO: 389845 - DNA, 25 bp, Homo sapien
tgacattcctcctcggttcatcatg

SEQ ID NO: 389846 - DNA, 25 bp, Homo sapien
tcctcctcggttcatcatgtggcca

SEQ ID NO: 389847 - DNA, 25 bp, Homo sapien
caaattcacattgtattgagctaca

SEQ ID NO: 389848 - DNA, 25 bp, Homo sapien
ctgtccagccccatctgaatgtgtt

SEQ ID NO: 389849 - DNA, 25 bp, Homo sapien
gtccagccccatctgaatgtgttgg

SEQ ID NO: 389850 - DNA, 25 bp, Homo sapien
tccagccccatctgaatgtgttggg

SEQ ID NO: 389851 - DNA, 25 bp, Homo sapien
tgcacttgaaggcaggaccctcaga

SEQ ID NO: 389852 - DNA, 25 bp, Homo sapien
acttgaaggcaggaccctcagacct

SEQ ID NO: 389853 - DNA, 25 bp, Homo sapien
ggaccctcagacctcgctggtaaag

SEQ ID NO: 389854 - DNA, 25 bp, Homo sapien
accctcagacctcgctggtaaaggt

SEQ ID NO: 389855 - DNA, 25 bp, Homo sapien
ctcagacctcgctggtaaaggtcaa

SEQ ID NO: 389856 - DNA, 25 bp, Homo sapien
acctcgctggtaaaggtcaaatggg

SEQ ID NO: 389857 - DNA, 25 bp, Homo sapien
tcaaatggggtcatctgctcctttt

SEQ ID NO: 389858 - DNA, 25 bp, Homo sapien
ttttccatcccctgacataccttaa

SEQ ID NO: 389859 - DNA, 25 bp, Homo sapien
ttagccaggtacagcggggcatgcc

SEQ ID NO: 389860 - DNA, 25 bp, Homo sapien
tagccaggtacagcggggcatgcct

SEQ ID NO: 389861 - DNA, 25 bp, Homo sapien
ccaggtacagcggggcatgcctgta

SEQ ID NO: 389862 - DNA, 25 bp, Homo sapien
gaggcagagatgaggtagtgagctg

SEQ ID NO: 389863 - DNA, 25 bp, Homo sapien
ggcagagatgaggtagtgagctgag

SEQ ID NO: 389864 - DNA, 25 bp, Homo sapien
actccggcctgagtggtagggcgag

SEQ ID NO: 389865 - DNA, 25 bp, Homo sapien
ctccggcctgagtggtagggcgaga

SEQ ID NO: 389866 - DNA, 25 bp, Homo sapien
tccggcctgagtggtagggcgagac

SEQ ID NO: 389867 - DNA, 25 bp, Homo sapien
ccggcctgagtggtagggcgagact

SEQ ID NO: 389868 - DNA, 25 bp, Homo sapien
cggcctgagtggtagggcgagactc

SEQ ID NO: 389869 - DNA, 25 bp, Homo sapien
ggcctgagtggtagggcgagactct

SEQ ID NO: 389870 - DNA, 25 bp, Homo sapien
cttcaccagacctgccatgatttta

SEQ ID NO: 389871 - DNA, 25 bp, Homo sapien
accagacctgccatgattttataag

SEQ ID NO: 389872 - DNA, 25 bp, Homo sapien
gattttataagatttaggcctcagt

SEQ ID NO: 389873 - DNA, 25 bp, Homo sapien
gatttaggcctcagtgacatgctcc

SEQ ID NO: 389874 - DNA, 25 bp, Homo sapien
gtcactcaccgataaaggtagcatc

SEQ ID NO: 389875 - DNA, 25 bp, Homo sapien
ggtagcatccttaagttcatttttg

SEQ ID NO: 389876 - DNA, 25 bp, Homo sapien
ttgaaaggtggaggaggatctcccc

SEQ ID NO: 389877 - DNA, 25 bp, Homo sapien
tttttatcagaataccttgaaaggg

SEQ ID NO: 389878 - DNA, 25 bp, Homo sapien
taatttcttggctgtgtttgataac

SEQ ID NO: 389879 - DNA, 25 bp, Homo sapien
gtttgataacagttcctatgcatgg

SEQ ID NO: 389880 - DNA, 25 bp, Homo sapien
aacagttcctatgcatggtttttaa

SEQ ID NO: 389881 - DNA, 25 bp, Homo sapien
atccgcacggcgacgacgggcgctt

SEQ ID NO: 389882 - DNA, 25 bp, Homo sapien
gacgacgggcgcttgaacattctgc

SEQ ID NO: 389883 - DNA, 25 bp, Homo sapien
acgggcgcttgaacattctgcctta

SEQ ID NO: 389884 - DNA, 25 bp, Homo sapien
ggcgcttgaacattctgccttatgt

SEQ ID NO: 389885 - DNA, 25 bp, Homo sapien
cttgaacattctgccttatgtctgc

SEQ ID NO: 389886 - DNA, 25 bp, Homo sapien
attctgccttatgtctgcttggact

SEQ ID NO: 389887 - DNA, 25 bp, Homo sapien
tgtcagccacaaagtgcattcccat

SEQ ID NO: 389888 - DNA, 25 bp, Homo sapien
aagtgcattcccatcttgcagaagc

SEQ ID NO: 389889 - DNA, 25 bp, Homo sapien
ttcccatcttgcagaagccgggtgg

SEQ ID NO: 389890 - DNA, 25 bp, Homo sapien
acaaacatgcgaacgaggaccgcgt

SEQ ID NO: 389891 - DNA, 25 bp, Homo sapien
acatgcgaacgaggaccgcgtggac

SEQ ID NO: 389892 - DNA, 25 bp, Homo sapien
gccaaattaaggtgacctgctcaca

SEQ ID NO: 389893 - DNA, 25 bp, Homo sapien
acctgctcacacattatatttataa

SEQ ID NO: 389894 - DNA, 25 bp, Homo sapien
taatccatgtctagcttttaagaac

SEQ ID NO: 389895 - DNA, 25 bp, Homo sapien
gaactactttcttacatttcatcaa

SEQ ID NO: 389896 - DNA, 25 bp, Homo sapien
tttcatcaaatgctgttcggtccca

SEQ ID NO: 389897 - DNA, 25 bp, Homo sapien
gttcggtcccaggacaagactttca

SEQ ID NO: 389898 - DNA, 25 bp, Homo sapien
ggacaagactttcattgcaatgtga

SEQ ID NO: 389899 - DNA, 25 bp, Homo sapien
attttatcaagctaagaggtctgga

SEQ ID NO: 389900 - DNA, 25 bp, Homo sapien
ggtctggattaatactgggcaacat

SEQ ID NO: 389901 - DNA, 25 bp, Homo sapien
tatgtattcacattgtctgacttgt

SEQ ID NO: 389902 - DNA, 25 bp, Homo sapien
cacattgtctgacttgtgcattcaa

SEQ ID NO: 389903 - DNA, 25 bp, Homo sapien
gtaatgcttatataccatagagttt

SEQ ID NO: 389904 - DNA, 25 bp, Homo sapien
gagaaatccatttcctccgagggtc

SEQ ID NO: 389905 - DNA, 25 bp, Homo sapien
ttcctccgagggtcactattaacaa

SEQ ID NO: 389906 - DNA, 25 bp, Homo sapien
taacaatgtacttccttaaatttag

SEQ ID NO: 389907 - DNA, 25 bp, Homo sapien
tttaatgattgtaatgggtgctgca

SEQ ID NO: 389908 - DNA, 25 bp, Homo sapien
atgggtgctgcatttgcacattgca

SEQ ID NO: 389909 - DNA, 25 bp, Homo sapien
gtgctgcatttgcacattgcattaa

SEQ ID NO: 389910 - DNA, 25 bp, Homo sapien
tcttatgtggacttatttccagaaa

SEQ ID NO: 389911 - DNA, 25 bp, Homo sapien
gtggacttatttccagaaaactttg

SEQ ID NO: 389912 - DNA, 25 bp, Homo sapien
aactttggtgataattcttgagaca

SEQ ID NO: 389913 - DNA, 25 bp, Homo sapien
gacaaaaggtggttaagtagcatta

SEQ ID NO: 389914 - DNA, 25 bp, Homo sapien
aaaaatgacgtgaggctgctttgcc

SEQ ID NO: 389915 - DNA, 25 bp, Homo sapien
atgacgtgaggctgctttgccttca

SEQ ID NO: 389916 - DNA, 25 bp, Homo sapien
ctttgccttcaataatacctagttt

SEQ ID NO: 389917 - DNA, 25 bp, Homo sapien
tacctagttttcagctgttccaact

SEQ ID NO: 389918 - DNA, 25 bp, Homo sapien
gctgttccaactcgtttccaaatag

SEQ ID NO: 389919 - DNA, 25 bp, Homo sapien
atagaaattagctggaacacactac

SEQ ID NO: 389920 - DNA, 25 bp, Homo sapien
ggaacacactacagtaatctcaagg

SEQ ID NO: 389921 - DNA, 25 bp, Homo sapien
gaagtcagcatggtacccaattgaa

SEQ ID NO: 389922 - DNA, 25 bp, Homo sapien
gcatggtacccaattgaaacctttt

SEQ ID NO: 389923 - DNA, 25 bp, Homo sapien
gggaattcattctatttgcactaaa

SEQ ID NO: 389924 - DNA, 25 bp, Homo sapien
ctatttgcactaaaagccttaactg

SEQ ID NO: 389925 - DNA, 25 bp, Homo sapien
aactctccctttgtcatatcttgtt

SEQ ID NO: 389926 - DNA, 25 bp, Homo sapien
ctccctttgtcatatcttgtttctg

SEQ ID NO: 389927 - DNA, 25 bp, Homo sapien
ctttgtcatatcttgtttctgatga

SEQ ID NO: 389928 - DNA, 25 bp, Homo sapien
ccactcgtgagtccaacggtctttt

SEQ ID NO: 389929 - DNA, 25 bp, Homo sapien
actcgtgagtccaacggtcttttct

SEQ ID NO: 389930 - DNA, 25 bp, Homo sapien
gtgagtccaacggtcttttctgcag

SEQ ID NO: 389931 - DNA, 25 bp, Homo sapien
agtccaacggtcttttctgcagaaa

SEQ ID NO: 389932 - DNA, 25 bp, Homo sapien
ccaacggtcttttctgcagaaagga

SEQ ID NO: 389933 - DNA, 25 bp, Homo sapien
gcagaaaggaggactttcctttcag

SEQ ID NO: 389934 - DNA, 25 bp, Homo sapien
gtctttctggggctcttactataaa

SEQ ID NO: 389935 - DNA, 25 bp, Homo sapien
gaccaactctccctttgtcatatct

SEQ ID NO: 389936 - DNA, 25 bp, Homo sapien
tttttgtcatgatacctcaaattga

SEQ ID NO: 389937 - DNA, 25 bp, Homo sapien
tgtcatgatacctcaaattgatata

SEQ ID NO: 389938 - DNA, 25 bp, Homo sapien
gatacctcaaattgatatatgttgt

SEQ ID NO: 389939 - DNA, 25 bp, Homo sapien
gctggagccttcagccatattaaca

SEQ ID NO: 389940 - DNA, 25 bp, Homo sapien
ggagccttcagccatattaacatac

SEQ ID NO: 389941 - DNA, 25 bp, Homo sapien
gccttcagccatattaacatacatt

SEQ ID NO: 389942 - DNA, 25 bp, Homo sapien
acatacattgacataaagacctttg

SEQ ID NO: 389943 - DNA, 25 bp, Homo sapien
tgattccagttaacaaatggagaaa

SEQ ID NO: 389944 - DNA, 25 bp, Homo sapien
aaattaatatttagcttctcaaaag

SEQ ID NO: 389945 - DNA, 25 bp, Homo sapien
atatttagcttctcaaaagagactc

SEQ ID NO: 389946 - DNA, 25 bp, Homo sapien
tatacttcctagttttataggtcag

SEQ ID NO: 389947 - DNA, 25 bp, Homo sapien
ttgattatccccataaattggcatt

SEQ ID NO: 389948 - DNA, 25 bp, Homo sapien
atccccataaattggcatttcggtt

SEQ ID NO: 389949 - DNA, 25 bp, Homo sapien
atgaccaatttgtatatcctgtaca

SEQ ID NO: 389950 - DNA, 25 bp, Homo sapien
gtatatcctgtacaattctaaccta

SEQ ID NO: 389951 - DNA, 25 bp, Homo sapien
ttctaacctaattcttttgcaaatg

SEQ ID NO: 389952 - DNA, 25 bp, Homo sapien
tgcaaatgaataaccatatcttcta

SEQ ID NO: 389953 - DNA, 25 bp, Homo sapien
aattttaaggctacatacctgaatt

SEQ ID NO: 389954 - DNA, 25 bp, Homo sapien
gcatgatctgcacaaatctactttt

SEQ ID NO: 389955 - DNA, 25 bp, Homo sapien
aatctacttttgattctatgaacaa

SEQ ID NO: 389956 - DNA, 25 bp, Homo sapien
gaatctcaattcatgcattatgcca

SEQ ID NO: 389957 - DNA, 25 bp, Homo sapien
atgccattataaacattcttagttg

SEQ ID NO: 389958 - DNA, 25 bp, Homo sapien
atggttccaccaaagtattcaaaat

SEQ ID NO: 389959 - DNA, 25 bp, Homo sapien
aaaattgcttttcatatttcagaat

SEQ ID NO: 389960 - DNA, 25 bp, Homo sapien
gaaagtaacccaaactgcagtggtg

SEQ ID NO: 389961 - DNA, 25 bp, Homo sapien
aacccaaactgcagtggtgctgtgg

SEQ ID NO: 389962 - DNA, 25 bp, Homo sapien
gggctagcataaaatgttaatcagg

SEQ ID NO: 389963 - DNA, 25 bp, Homo sapien
aatcaggtaaataggaactcaaagg

SEQ ID NO: 389964 - DNA, 25 bp, Homo sapien
ttacatgtgtaattacccatctgtg

SEQ ID NO: 389965 - DNA, 25 bp, Homo sapien
tgtgtaattacccatctgtgatcat

SEQ ID NO: 389966 - DNA, 25 bp, Homo sapien
catctgtgatcattctactgttcta

SEQ ID NO: 389967 - DNA, 25 bp, Homo sapien
ctgtgatcattctactgttctattt

SEQ ID NO: 389968 - DNA, 25 bp, Homo sapien
tctcctcccacactgggttaaaaat

SEQ ID NO: 389969 - DNA, 25 bp, Homo sapien
aggcagctcgtccagggccattcag

SEQ ID NO: 389970 - DNA, 25 bp, Homo sapien
ggccattcagatcccaagcatcagg

SEQ ID NO: 389971 - DNA, 25 bp, Homo sapien
tcaggaaatcattttgtacaaccac

SEQ ID NO: 389972 - DNA, 25 bp, Homo sapien
tttgtacaaccacccgaagcagaga

SEQ ID NO: 389973 - DNA, 25 bp, Homo sapien
accacccgaagcagagatatttttt

SEQ ID NO: 389974 - DNA, 25 bp, Homo sapien
tttcagttgttttctgatcctgcct

SEQ ID NO: 389975 - DNA, 25 bp, Homo sapien
gttgttttctgatcctgcctttttc

SEQ ID NO: 389976 - DNA, 25 bp, Homo sapien
acaacttcacgccagtgattcgttc

SEQ ID NO: 389977 - DNA, 25 bp, Homo sapien
gccagtgattcgttcacatcaggta

SEQ ID NO: 389978 - DNA, 25 bp, Homo sapien
attcgttcacatcaggtaaatcttg

SEQ ID NO: 389979 - DNA, 25 bp, Homo sapien
gaaacgagctcatggactgacccgg

SEQ ID NO: 389980 - DNA, 25 bp, Homo sapien
aatttttatgcagtttggctaagga

SEQ ID NO: 389981 - DNA, 25 bp, Homo sapien
ggaaaataacattcatcagcttcta

SEQ ID NO: 389982 - DNA, 25 bp, Homo sapien
tcatcagcttctacactgcactttt

SEQ ID NO: 389983 - DNA, 25 bp, Homo sapien
gtttaatgtccgtttaacagttgct

SEQ ID NO: 389984 - DNA, 25 bp, Homo sapien
gtccgtttaacagttgcttgtttat

SEQ ID NO: 389985 - DNA, 25 bp, Homo sapien
tatttgtgtaaacctagctagtaaa

SEQ ID NO: 389986 - DNA, 25 bp, Homo sapien
tgatgatgttcagggccactgactt

SEQ ID NO: 389987 - DNA, 25 bp, Homo sapien
atgttcagggccactgacttgcaca

SEQ ID NO: 389988 - DNA, 25 bp, Homo sapien
acttgcacagcccttggagcactat

SEQ ID NO: 389989 - DNA, 25 bp, Homo sapien
ggagcactattcacacagaacacaa

SEQ ID NO: 389990 - DNA, 25 bp, Homo sapien
gacattaacacactttgatatctat

SEQ ID NO: 389991 - DNA, 25 bp, Homo sapien
gtcttgagaagacacccaaatgttc

SEQ ID NO: 389992 - DNA, 25 bp, Homo sapien
gagaagacacccaaatgttcatgcc

SEQ ID NO: 389993 - DNA, 25 bp, Homo sapien
tgttcatgcctcagaaaggcagcag

SEQ ID NO: 389994 - DNA, 25 bp, Homo sapien
taagaagaagcagttgtttctctct

SEQ ID NO: 389995 - DNA, 25 bp, Homo sapien
ggctgtattttctttccaggaatgt

SEQ ID NO: 389996 - DNA, 25 bp, Homo sapien
tattttctttccaggaatgtaacct

SEQ ID NO: 389997 - DNA, 25 bp, Homo sapien
gacctgagccaagattggaaatcag

SEQ ID NO: 389998 - DNA, 25 bp, Homo sapien
ggaaatcagaaagtctcctgtacat

SEQ ID NO: 389999 - DNA, 25 bp, Homo sapien
agaaagtctcctgtacatggagctg

SEQ ID NO: 390000 - DNA, 25 bp, Homo sapien
gggctgctgttttccgaatgttttc

SEQ ID NO: 390001 - DNA, 25 bp, Homo sapien
ctgctgttttccgaatgttttccat

SEQ ID NO: 390002 - DNA, 25 bp, Homo sapien
catctttcaggtggtgttatgattt

SEQ ID NO: 390003 - DNA, 25 bp, Homo sapien
gttcctgaaaggattgagttagtca

SEQ ID NO: 390004 - DNA, 25 bp, Homo sapien
agttagtcatactcctcagttcatg

SEQ ID NO: 390005 - DNA, 25 bp, Homo sapien
tagtcatactcctcagttcatggca

SEQ ID NO: 390006 - DNA, 25 bp, Homo sapien
gttcatggcatactatcatcagacc

SEQ ID NO: 390007 - DNA, 25 bp, Homo sapien
atcagaccatgacagtgaggccctc

SEQ ID NO: 390008 - DNA, 25 bp, Homo sapien
gacagtgaggccctcttgttttatt

SEQ ID NO: 390009 - DNA, 25 bp, Homo sapien
agtcccattttctcactacaatagg

SEQ ID NO: 390010 - DNA, 25 bp, Homo sapien
tttctaatgtgcttaatgtggatat

SEQ ID NO: 390011 - DNA, 25 bp, Homo sapien
atagttattatttcgtgagcatgca

SEQ ID NO: 390012 - DNA, 25 bp, Homo sapien
tatttcgtgagcatgcattattaaa

SEQ ID NO: 390013 - DNA, 25 bp, Homo sapien
gaagatgccgtcagtgtgggtgggc

SEQ ID NO: 390014 - DNA, 25 bp, Homo sapien
aggaggacagccagtcgtcctgctg

SEQ ID NO: 390015 - DNA, 25 bp, Homo sapien
agcccaatagcttccagcggcaggt

SEQ ID NO: 390016 - DNA, 25 bp, Homo sapien
ccaatagcttccagcggcaggtgcc

SEQ ID NO: 390017 - DNA, 25 bp, Homo sapien
ggtgctaccggagcccctcataggg

SEQ ID NO: 390018 - DNA, 25 bp, Homo sapien
aggcactcatcgtaagcctcctggt

SEQ ID NO: 390019 - DNA, 25 bp, Homo sapien
taagcctcctggtactcctcatggg

SEQ ID NO: 390020 - DNA, 25 bp, Homo sapien
gggcttgaccattatcacacaggtg

SEQ ID NO: 390021 - DNA, 25 bp, Homo sapien
gctgcacccaggtccgtcttagagg

SEQ ID NO: 390022 - DNA, 25 bp, Homo sapien
gacatagggcaaatttcggtcctca

SEQ ID NO: 390023 - DNA, 25 bp, Homo sapien
tagggcaaatttcggtcctcacaca

SEQ ID NO: 390024 - DNA, 25 bp, Homo sapien
gcacagatattccaaatcaggacag

SEQ ID NO: 390025 - DNA, 25 bp, Homo sapien
ggacagaggtaatttctctatacat

SEQ ID NO: 390026 - DNA, 25 bp, Homo sapien
tgtaatattaattgggcctctgcat

SEQ ID NO: 390027 - DNA, 25 bp, Homo sapien
aaaaccaccaattgaatgccttcac

SEQ ID NO: 390028 - DNA, 25 bp, Homo sapien
tgaatgccttcaccaactcgcttga

SEQ ID NO: 390029 - DNA, 25 bp, Homo sapien
gccttcaccaactcgcttgagttaa

SEQ ID NO: 390030 - DNA, 25 bp, Homo sapien
taattgggcctctgcatagccaaat

SEQ ID NO: 390031 - DNA, 25 bp, Homo sapien
ggcctctgcatagccaaatggtgaa

SEQ ID NO: 390032 - DNA, 25 bp, Homo sapien
aatggtgaaattattgctacaatac

SEQ ID NO: 390033 - DNA, 25 bp, Homo sapien
gctacaatacaaacaggcccaaaag

SEQ ID NO: 390034 - DNA, 25 bp, Homo sapien
aaacagcccaaaatagcacagatat

SEQ ID NO: 390035 - DNA, 25 bp, Homo sapien
aggagaatcataaaagcaggagacc

SEQ ID NO: 390036 - DNA, 25 bp, Homo sapien
gcaggagaccagtagcagaaatgta

SEQ ID NO: 390037 - DNA, 25 bp, Homo sapien
gagaccagtagcagaaatgtagaca

SEQ ID NO: 390038 - DNA, 25 bp, Homo sapien
gaaatgtagacaggatgtatcatcc

SEQ ID NO: 390039 - DNA, 25 bp, Homo sapien
gatgtatcatccaaaggttttcttt

SEQ ID NO: 390040 - DNA, 25 bp, Homo sapien
gtatcatccaaaggttttctttctt

SEQ ID NO: 390041 - DNA, 25 bp, Homo sapien
ttcttacaatttttggccatcctga

SEQ ID NO: 390042 - DNA, 25 bp, Homo sapien
cttacaatttttggccatcctgagg

SEQ ID NO: 390043 - DNA, 25 bp, Homo sapien
acaatttttggccatcctgaggcat

SEQ ID NO: 390044 - DNA, 25 bp, Homo sapien
atttttggccatcctgaggcattta

SEQ ID NO: 390045 - DNA, 25 bp, Homo sapien
aagatttcaccattacagccctgcc

SEQ ID NO: 390046 - DNA, 25 bp, Homo sapien
gtcctggctcactttgcagttggca

SEQ ID NO: 390047 - DNA, 25 bp, Homo sapien
ctcactttgcagttggcactgggtt

SEQ ID NO: 390048 - DNA, 25 bp, Homo sapien
agagagctgatgagtgtggcttccc

SEQ ID NO: 390049 - DNA, 25 bp, Homo sapien
gtttccctgcttgtccagttgtgag

SEQ ID NO: 390050 - DNA, 25 bp, Homo sapien
cagttgtgagctgtcctcggtgtta

SEQ ID NO: 390051 - DNA, 25 bp, Homo sapien
tcggtgttaccgaggctgtgcctag

SEQ ID NO: 390052 - DNA, 25 bp, Homo sapien
gctgtgcctagagagtggagatttt

SEQ ID NO: 390053 - DNA, 25 bp, Homo sapien
ttgatgaaaggtgtgctcgctctct

SEQ ID NO: 390054 - DNA, 25 bp, Homo sapien
tccttgttcctgcaaaccacaagat

SEQ ID NO: 390055 - DNA, 25 bp, Homo sapien
aaggtagtggtgtgtctcgacccca

SEQ ID NO: 390056 - DNA, 25 bp, Homo sapien
acacaagtcctcaaaagtttcagct

SEQ ID NO: 390057 - DNA, 25 bp, Homo sapien
tcatttagccaaagtatgttactac

SEQ ID NO: 390058 - DNA, 25 bp, Homo sapien
atgttactactaaaagtgactgttc

SEQ ID NO: 390059 - DNA, 25 bp, Homo sapien
gtgactgttctaaggctgtttgtgt

SEQ ID NO: 390060 - DNA, 25 bp, Homo sapien
ctaaggctgtttgtgtgaagtatta

SEQ ID NO: 390061 - DNA, 25 bp, Homo sapien
ttggcctttttatgcttttgttatt

SEQ ID NO: 390062 - DNA, 25 bp, Homo sapien
atgcttttgttatttgattagctta

SEQ ID NO: 390063 - DNA, 25 bp, Homo sapien
ttttcttttctgagtgttcagtcaa

SEQ ID NO: 390064 - DNA, 25 bp, Homo sapien
ttatctgtactgaccagaagaggaa

SEQ ID NO: 390065 - DNA, 25 bp, Homo sapien
cttgaacattactttaaagtgactt

SEQ ID NO: 390066 - DNA, 25 bp, Homo sapien
aagtgacttataattggagactgac

SEQ ID NO: 390067 - DNA, 25 bp, Homo sapien
aattggagactgacaaatttgtgtt

SEQ ID NO: 390068 - DNA, 25 bp, Homo sapien
atggttccaccaaagtattcaaaat

SEQ ID NO: 390069 - DNA, 25 bp, Homo sapien
aaaattgcttttcatatttcagaat

SEQ ID NO: 390070 - DNA, 25 bp, Homo sapien
gaaagtaacccaaactgcagtggtg

SEQ ID NO: 390071 - DNA, 25 bp, Homo sapien
aacccaaactgcagtggtgctgtgg

SEQ ID NO: 390072 - DNA, 25 bp, Homo sapien
aatcaggtaaataggaactcaaagg

SEQ ID NO: 390073 - DNA, 25 bp, Homo sapien
ccaaattgagctcatttacatgtgt

SEQ ID NO: 390074 - DNA, 25 bp, Homo sapien
ttacatgtgtaattacccatctgtg

SEQ ID NO: 390075 - DNA, 25 bp, Homo sapien
gtgtaattacccatctgtgatcatt

SEQ ID NO: 390076 - DNA, 25 bp, Homo sapien
ctgtgatcattctactgttctattt

SEQ ID NO: 390077 - DNA, 25 bp, Homo sapien
gttctatttattctgtctttctcct

SEQ ID NO: 390078 - DNA, 25 bp, Homo sapien
tctcctcccacactgggttaaaaat

SEQ ID NO: 390079 - DNA, 25 bp, Homo sapien
tcatttgtgggagctgagctgagcc

SEQ ID NO: 390080 - DNA, 25 bp, Homo sapien
agcctggttatccaagctgagggca

SEQ ID NO: 390081 - DNA, 25 bp, Homo sapien
tatccaagctgagggcaggtagtct

SEQ ID NO: 390082 - DNA, 25 bp, Homo sapien
ctcagccaaggagccagagttgcag

SEQ ID NO: 390083 - DNA, 25 bp, Homo sapien
agagttgcagcatcagggccagact

SEQ ID NO: 390084 - DNA, 25 bp, Homo sapien
agggccagactgagcaggagacccc

SEQ ID NO: 390085 - DNA, 25 bp, Homo sapien
tgaagcatctcaccagcattcacat

SEQ ID NO: 390086 - DNA, 25 bp, Homo sapien
gcattcacatgcatggctgcagcat

SEQ ID NO: 390087 - DNA, 25 bp, Homo sapien
atggctgcagcatagaacctcgcca

SEQ ID NO: 390088 - DNA, 25 bp, Homo sapien
agaacctcgccacttcctcgttggg

SEQ ID NO: 390089 - DNA, 25 bp, Homo sapien
accatggagcagcaacagactgggt

SEQ ID NO: 390090 - DNA, 25 bp, Homo sapien
gctctggtgccaaggacgctgacgc

SEQ ID NO: 390091 - DNA, 25 bp, Homo sapien
tgccaaggacgctgacgccacggag

SEQ ID NO: 390092 - DNA, 25 bp, Homo sapien
cacggagccgcgtccagacaggatc

SEQ ID NO: 390093 - DNA, 25 bp, Homo sapien
gcgtccagacaggatccggcagcag

SEQ ID NO: 390094 - DNA, 25 bp, Homo sapien
cagccaacgggcttatgcagaccag

SEQ ID NO: 390095 - DNA, 25 bp, Homo sapien
gggcttatgcagaccagcaagctgt

SEQ ID NO: 390096 - DNA, 25 bp, Homo sapien
cagaccagcaagctgtgagagtgca

SEQ ID NO: 390097 - DNA, 25 bp, Homo sapien
ggaggttgcactgcggtgaccccca

SEQ ID NO: 390098 - DNA, 25 bp, Homo sapien
tctctgacaacttccgccagagctt

SEQ ID NO: 390099 - DNA, 25 bp, Homo sapien
agaaggttctgtgcctccgcaaggg

SEQ ID NO: 390100 - DNA, 25 bp, Homo sapien
tgtgcctccgcaagggctctggtgc

SEQ ID NO: 390101 - DNA, 25 bp, Homo sapien
cctgcagcggtctctgagaggccga

SEQ ID NO: 390102 - DNA, 25 bp, Homo sapien
cagcggtctctgagaggccgagctc

SEQ ID NO: 390103 - DNA, 25 bp, Homo sapien
acccctcgggtcttgtgcttcagca

SEQ ID NO: 390104 - DNA, 25 bp, Homo sapien
aggaccctggatgaatccgttctgt

SEQ ID NO: 390105 - DNA, 25 bp, Homo sapien
ggaccctggatgaatccgttctgtg

SEQ ID NO: 390106 - DNA, 25 bp, Homo sapien
accctggatgaatccgttctgtgct

SEQ ID NO: 390107 - DNA, 25 bp, Homo sapien
ctggatgaatccgttctgtgcttcc

SEQ ID NO: 390108 - DNA, 25 bp, Homo sapien
ggatgaatccgttctgtgcttcctt

SEQ ID NO: 390109 - DNA, 25 bp, Homo sapien
atgaatccgttctgtgcttcctttt

SEQ ID NO: 390110 - DNA, 25 bp, Homo sapien
gaatccgttctgtgcttccttttcc

SEQ ID NO: 390111 - DNA, 25 bp, Homo sapien
atccgttctgtgcttccttttccct

SEQ ID NO: 390112 - DNA, 25 bp, Homo sapien
gacagtgagctcatgcaaggggaat

SEQ ID NO: 390113 - DNA, 25 bp, Homo sapien
tcccaagttggagtgagtaagaggc

SEQ ID NO: 390114 - DNA, 25 bp, Homo sapien
ggagtgagtaagaggcgggccaggc

SEQ ID NO: 390115 - DNA, 25 bp, Homo sapien
tcgccctcgggtgctgtctagacag

SEQ ID NO: 390116 - DNA, 25 bp, Homo sapien
gccctcgggtgctgtctagacagag

SEQ ID NO: 390117 - DNA, 25 bp, Homo sapien
ccctcgggtgctgtctagacagagg

SEQ ID NO: 390118 - DNA, 25 bp, Homo sapien
ctgtctagacagagggcagaggcgg

SEQ ID NO: 390119 - DNA, 25 bp, Homo sapien
tccagggcctgctgaccctgacatg

SEQ ID NO: 390120 - DNA, 25 bp, Homo sapien
accctgacatgcccagtgcctggtg

SEQ ID NO: 390121 - DNA, 25 bp, Homo sapien
cagtgcctggtgtttggtggtgttt

SEQ ID NO: 390122 - DNA, 25 bp, Homo sapien
ccagccctgcgccaaagggagagca

SEQ ID NO: 390123 - DNA, 25 bp, Homo sapien
tgtccagccccatctgaatgtgttg

SEQ ID NO: 390124 - DNA, 25 bp, Homo sapien
tgcacttgaaggcaggaccctcaga

SEQ ID NO: 390125 - DNA, 25 bp, Homo sapien
gaccctcagacctcgctggtaaagg

SEQ ID NO: 390126 - DNA, 25 bp, Homo sapien
acataccttaacctctgaactctga

SEQ ID NO: 390127 - DNA, 25 bp, Homo sapien
tgaactctgacctcaggaggctctg

SEQ ID NO: 390128 - DNA, 25 bp, Homo sapien
tgaaagccccaagtgtacccagttg

SEQ ID NO: 390129 - DNA, 25 bp, Homo sapien
agcctcccgtcactctgactaaaaa

SEQ ID NO: 390130 - DNA, 25 bp, Homo sapien
gtcactctgactaaaaagaatcttc

SEQ ID NO: 390131 - DNA, 25 bp, Homo sapien
gaatcttcagagtgcatatttggag

SEQ ID NO: 390132 - DNA, 25 bp, Homo sapien
gaaagattgttcagttaccctaaag

SEQ ID NO: 390133 - DNA, 25 bp, Homo sapien
gattgttcagttaccctaaagactt

SEQ ID NO: 390134 - DNA, 25 bp, Homo sapien
gatgcagccagtttcttaatttttt

SEQ ID NO: 390135 - DNA, 25 bp, Homo sapien
tatttgtacacctaactacctggca

SEQ ID NO: 390136 - DNA, 25 bp, Homo sapien
aactacctggcacttggaaatcaca

SEQ ID NO: 390137 - DNA, 25 bp, Homo sapien
atcacagcactactcagaggcaatt

SEQ ID NO: 390138 - DNA, 25 bp, Homo sapien
cagacaccaggcaaaattgctctaa

SEQ ID NO: 390139 - DNA, 25 bp, Homo sapien
aagaagccagttactgtcatccctc

SEQ ID NO: 390140 - DNA, 25 bp, Homo sapien
ctgtcatccctctatggttctagaa

SEQ ID NO: 390141 - DNA, 25 bp, Homo sapien
gacaggtcatcctatgagcgtcatg

SEQ ID NO: 390142 - DNA, 25 bp, Homo sapien
gagcgtcatgccaatgaaaccccat

SEQ ID NO: 390143 - DNA, 25 bp, Homo sapien
ggagaagcccttgaatcagaattat

SEQ ID NO: 390144 - DNA, 25 bp, Homo sapien
ttcttgatgtcgtcagatgcagcca

SEQ ID NO: 390145 - DNA, 25 bp, Homo sapien
caagacgggccagaataaaatagag

SEQ ID NO: 390146 - DNA, 25 bp, Homo sapien
gaacaccctaagctgggagactcat

SEQ ID NO: 390147 - DNA, 25 bp, Homo sapien
ctaagctgggagactcatcttggac

SEQ ID NO: 390148 - DNA, 25 bp, Homo sapien
gagccaccacgtttggcctaaaggc

SEQ ID NO: 390149 - DNA, 25 bp, Homo sapien
ttcagccggcaacttaggctcagta

SEQ ID NO: 390150 - DNA, 25 bp, Homo sapien
ggcaacttaggctcagtactgcaag

SEQ ID NO: 390151 - DNA, 25 bp, Homo sapien
aggctcagtactgcaagcctcggct

SEQ ID NO: 390152 - DNA, 25 bp, Homo sapien
accacgtttggcctaaaggcacata

SEQ ID NO: 390153 - DNA, 25 bp, Homo sapien
gggttaaaatgtgacctatgaccac

SEQ ID NO: 390154 - DNA, 25 bp, Homo sapien
tgacctatgaccacaagacgggcca

SEQ ID NO: 390155 - DNA, 25 bp, Homo sapien
tatgaccacaagacgggccagaata

SEQ ID NO: 390156 - DNA, 25 bp, Homo sapien
acggccagcccacaatgatattaca

SEQ ID NO: 390157 - DNA, 25 bp, Homo sapien
ggccagcccacaatgatattacaaa

SEQ ID NO: 390158 - DNA, 25 bp, Homo sapien
gcccacaatgatattacaaacctat

SEQ ID NO: 390159 - DNA, 25 bp, Homo sapien
aaaatgatacttagacagaattgtc

SEQ ID NO: 390160 - DNA, 25 bp, Homo sapien
attcaagaacatttaggctatagga

SEQ ID NO: 390161 - DNA, 25 bp, Homo sapien
ttaggctataggatgttaaatgaca

SEQ ID NO: 390162 - DNA, 25 bp, Homo sapien
atatatatgtatgtgaccctaccca

SEQ ID NO: 390163 - DNA, 25 bp, Homo sapien
atatgtatgtgaccctacccataaa

SEQ ID NO: 390164 - DNA, 25 bp, Homo sapien
atgtatgtgaccctacccataaaaa

SEQ ID NO: 390165 - DNA, 25 bp, Homo sapien
gtatgtgaccctacccataaaaaat

SEQ ID NO: 390166 - DNA, 25 bp, Homo sapien
tgtgaccctacccataaaaaatgaa

SEQ ID NO: 390167 - DNA, 25 bp, Homo sapien
cacccacaaaggcttcagtggaaaa

SEQ ID NO: 390168 - DNA, 25 bp, Homo sapien
tgggtcacgttctccatatgtgtgg

SEQ ID NO: 390169 - DNA, 25 bp, Homo sapien
ctccatatgtgtgggtggttctgtt

SEQ ID NO: 390170 - DNA, 25 bp, Homo sapien
agaaggaagagaatcggctgctgta

SEQ ID NO: 390171 - DNA, 25 bp, Homo sapien
ctgctgtaggtcttgggcagcaaga

SEQ ID NO: 390172 - DNA, 25 bp, Homo sapien
ggcagcaagaagtttacatcgatca

SEQ ID NO: 390173 - DNA, 25 bp, Homo sapien
gttctgtttcagcaaatggtctttt

SEQ ID NO: 390174 - DNA, 25 bp, Homo sapien
aatggtcttttcactagcccacatc

SEQ ID NO: 390175 - DNA, 25 bp, Homo sapien
tttcactagcccacatcaagacaaa

SEQ ID NO: 390176 - DNA, 25 bp, Homo sapien
agacaaagacatgttctgaactgga

SEQ ID NO: 390177 - DNA, 25 bp, Homo sapien
gaactggagatgatgccaagcctgg

SEQ ID NO: 390178 - DNA, 25 bp, Homo sapien
acataccttaacctctgaactctga

SEQ ID NO: 390179 - DNA, 25 bp, Homo sapien
cataccttaacctctgaactctgac

SEQ ID NO: 390180 - DNA, 25 bp, Homo sapien
ataccttaacctctgaactctgacc

SEQ ID NO: 390181 - DNA, 25 bp, Homo sapien
ctgaactctgacctcaggaggctct

SEQ ID NO: 390182 - DNA, 25 bp, Homo sapien
tgaactctgacctcaggaggctctg

SEQ ID NO: 390183 - DNA, 25 bp, Homo sapien
ctctgggcactccagccctgaaagc

SEQ ID NO: 390184 - DNA, 25 bp, Homo sapien
tctgggcactccagccctgaaagcc

SEQ ID NO: 390185 - DNA, 25 bp, Homo sapien
ctgggcactccagccctgaaagccc

SEQ ID NO: 390186 - DNA, 25 bp, Homo sapien
tgggcactccagccctgaaagcccc

SEQ ID NO: 390187 - DNA, 25 bp, Homo sapien
gggcactccagccctgaaagcccca

SEQ ID NO: 390188 - DNA, 25 bp, Homo sapien
gatatcataaggacctacttcccag

SEQ ID NO: 390189 - DNA, 25 bp, Homo sapien
tcataaggacctacttcccagccta

SEQ ID NO: 390190 - DNA, 25 bp, Homo sapien
tacctttcttcctctacctgataat

SEQ ID NO: 390191 - DNA, 25 bp, Homo sapien
ctttcttcctctacctgataatgat

SEQ ID NO: 390192 - DNA, 25 bp, Homo sapien
ggaaacacaaagaaatcctgctttc

SEQ ID NO: 390193 - DNA, 25 bp, Homo sapien
tgctttcacatctcctatttcttgg

SEQ ID NO: 390194 - DNA, 25 bp, Homo sapien
atctcctatttcttgggctccttaa

SEQ ID NO: 390195 - DNA, 25 bp, Homo sapien
gggctccttaataactactgatggt

SEQ ID NO: 390196 - DNA, 25 bp, Homo sapien
aactactgatggtttgttcatgaaa

SEQ ID NO: 390197 - DNA, 25 bp, Homo sapien
aagattgtacttggccctgagttga

SEQ ID NO: 390198 - DNA, 25 bp, Homo sapien
aagtttgtacttggccctgagttga

SEQ ID NO: 390199 - DNA, 25 bp, Homo sapien
agaagaaaacgctgatgcctgccgc

SEQ ID NO: 390200 - DNA, 25 bp, Homo sapien
gaagaaaacgctgatgcctgccgcc

SEQ ID NO: 390201 - DNA, 25 bp, Homo sapien
agaaaacgctgatgcctgccgcctt

SEQ ID NO: 390202 - DNA, 25 bp, Homo sapien
tctctctgcttcagctacctaagag

SEQ ID NO: 390203 - DNA, 25 bp, Homo sapien
gaagggcccgctgtcctgtgatcag

SEQ ID NO: 390204 - DNA, 25 bp, Homo sapien
ggcccgctgtcctgtgatcaggtga

SEQ ID NO: 390205 - DNA, 25 bp, Homo sapien
gcccgctgtcctgtgatcaggtgac

SEQ ID NO: 390206 - DNA, 25 bp, Homo sapien
atcacttagaagactgaccctcctt

SEQ ID NO: 390207 - DNA, 25 bp, Homo sapien
cacttagaagactgaccctccttat

SEQ ID NO: 390208 - DNA, 25 bp, Homo sapien
ttagaagactgaccctccttatcct

SEQ ID NO: 390209 - DNA, 25 bp, Homo sapien
cgtgtctttgtggtagtggtccccg

SEQ ID NO: 390210 - DNA, 25 bp, Homo sapien
acggacactggcctcagctatctgt

SEQ ID NO: 390211 - DNA, 25 bp, Homo sapien
gacactggcctcagctatctgtcca

SEQ ID NO: 390212 - DNA, 25 bp, Homo sapien
tcagctatctgtccaccatgtcgtc

SEQ ID NO: 390213 - DNA, 25 bp, Homo sapien
tccgcagcctctacctgcgatggtg

SEQ ID NO: 390214 - DNA, 25 bp, Homo sapien
tgccaggtgcaagacttcgggctga

SEQ ID NO: 390215 - DNA, 25 bp, Homo sapien
aggtgcaagacttcgggctgaagca

SEQ ID NO: 390216 - DNA, 25 bp, Homo sapien
aagacttcgggctgaagcacctcct

SEQ ID NO: 390217 - DNA, 25 bp, Homo sapien
gacttcgggctgaagcacctcctgg

SEQ ID NO: 390218 - DNA, 25 bp, Homo sapien
ggctgaagcacctcctggccctggg

SEQ ID NO: 390219 - DNA, 25 bp, Homo sapien
cttcaagtatttctcgcagcacctg

SEQ ID NO: 390220 - DNA, 25 bp, Homo sapien
tcaagtatttctcgcagcacctgcc

SEQ ID NO: 390221 - DNA, 25 bp, Homo sapien
gttctatgctccctggaatattact

SEQ ID NO: 390222 - DNA, 25 bp, Homo sapien
ctccctggaatattactgctttgtg

SEQ ID NO: 390223 - DNA, 25 bp, Homo sapien
gaaagtccagactgaacgcagcacc

SEQ ID NO: 390224 - DNA, 25 bp, Homo sapien
cgcagcaccctctgtgtacctagta

SEQ ID NO: 390225 - DNA, 25 bp, Homo sapien
tgggtctctcactacttgatatttt

SEQ ID NO: 390226 - DNA, 25 bp, Homo sapien
gatatttttgcattagttaagacag

SEQ ID NO: 390227 - DNA, 25 bp, Homo sapien
tgctgctagaaatgtctgaactaag

SEQ ID NO: 390228 - DNA, 25 bp, Homo sapien
gtctgaactaagtgccatactcgtc

SEQ ID NO: 390229 - DNA, 25 bp, Homo sapien
gtgccatactcgtctgggtaagatt

SEQ ID NO: 390230 - DNA, 25 bp, Homo sapien
tactcgtctgggtaagatttgggaa

SEQ ID NO: 390231 - DNA, 25 bp, Homo sapien
gatttgggaaacataacctctgtac

SEQ ID NO: 390232 - DNA, 25 bp, Homo sapien
ggagtatcatccctcagccaaatca

SEQ ID NO: 390233 - DNA, 25 bp, Homo sapien
gccaaatcacttttccatctctaaa

SEQ ID NO: 390234 - DNA, 25 bp, Homo sapien
ggaagtcatctccaactaattgtgt

SEQ ID NO: 390235 - DNA, 25 bp, Homo sapien
aattgtgtctggatttagttgctaa

SEQ ID NO: 390236 - DNA, 25 bp, Homo sapien
aaaattgtcttatttatgaagcagc

SEQ ID NO: 390237 - DNA, 25 bp, Homo sapien
agcctgaaagcatttctgccatagt

SEQ ID NO: 390238 - DNA, 25 bp, Homo sapien
gcatttctgccatagttgttgtagt

SEQ ID NO: 390239 - DNA, 25 bp, Homo sapien
aattcgtgggatgtggtatattctg

SEQ ID NO: 390240 - DNA, 25 bp, Homo sapien
gtatattctgtgtcaacttcaagat

SEQ ID NO: 390241 - DNA, 25 bp, Homo sapien
ttcaagataatcactcattttctcg

SEQ ID NO: 390242 - DNA, 25 bp, Homo sapien
cattttctcgttatattcaggtctg

SEQ ID NO: 390243 - DNA, 25 bp, Homo sapien
acctccgacagcaaacagcaactga

SEQ ID NO: 390244 - DNA, 25 bp, Homo sapien
acagcaactgactgcaggtgctggc

SEQ ID NO: 390245 - DNA, 25 bp, Homo sapien
gtggtgcaccttggacacgtggaca

SEQ ID NO: 390246 - DNA, 25 bp, Homo sapien
ttggacacgtggacaaggcccaggc

SEQ ID NO: 390247 - DNA, 25 bp, Homo sapien
tgccctcgatgccacatggcggtga

SEQ ID NO: 390248 - DNA, 25 bp, Homo sapien
gccacatggcggtgaacacatctga

SEQ ID NO: 390249 - DNA, 25 bp, Homo sapien
acatctgaagccactatgtttcctg

SEQ ID NO: 390250 - DNA, 25 bp, Homo sapien
actatgtttcctggctctaaggctc

SEQ ID NO: 390251 - DNA, 25 bp, Homo sapien
tggctctaaggctcgtctgtgtaac

SEQ ID NO: 390252 - DNA, 25 bp, Homo sapien
aggctcgtctgtgtaacccataaaa

SEQ ID NO: 390253 - DNA, 25 bp, Homo sapien
tgtgtaacccataaaacctgctttg

SEQ ID NO: 390254 - DNA, 25 bp, Homo sapien
agctttatgcacaactgtcaaaact

SEQ ID NO: 390255 - DNA, 25 bp, Homo sapien
gctttatgcacaactgtcaaaactt

SEQ ID NO: 390256 - DNA, 25 bp, Homo sapien
atgcacaactgtcaaaactttaaag

SEQ ID NO: 390257 - DNA, 25 bp, Homo sapien
gccaaaaacaaaatgagctatcaag

SEQ ID NO: 390258 - DNA, 25 bp, Homo sapien
tatcaagccatgaaagaaccttaaa

SEQ ID NO: 390259 - DNA, 25 bp, Homo sapien
agccatgaaagaaccttaaatgcat

SEQ ID NO: 390260 - DNA, 25 bp, Homo sapien
gagggagagataaacaggcatagca

SEQ ID NO: 390261 - DNA, 25 bp, Homo sapien
ggagagataaacaggcatagcataa

SEQ ID NO: 390262 - DNA, 25 bp, Homo sapien
aacaggcatagcataagggattttt

SEQ ID NO: 390263 - DNA, 25 bp, Homo sapien
acaggcatagcataagggatttttg

SEQ ID NO: 390264 - DNA, 25 bp, Homo sapien
catagcataagggatttttgcagtg

SEQ ID NO: 390265 - DNA, 25 bp, Homo sapien
aatcctaggcaccactgagttgttt

SEQ ID NO: 390266 - DNA, 25 bp, Homo sapien
agtattttgtgtctggcgtcttgca

SEQ ID NO: 390267 - DNA, 25 bp, Homo sapien
gcgtcttgcacttagcatggtgttc

SEQ ID NO: 390268 - DNA, 25 bp, Homo sapien
agcatggtgttcttgaggttcatct

SEQ ID NO: 390269 - DNA, 25 bp, Homo sapien
gtgttcttgaggttcatctgttgta

SEQ ID NO: 390270 - DNA, 25 bp, Homo sapien
tgaggttcatctgttgtagtatgta

SEQ ID NO: 390271 - DNA, 25 bp, Homo sapien
ttattgccgaatactattccattgc

SEQ ID NO: 390272 - DNA, 25 bp, Homo sapien
ccattgcatggaaaagacctatttt

SEQ ID NO: 390273 - DNA, 25 bp, Homo sapien
tctaggttcaccagttgagggacat

SEQ ID NO: 390274 - DNA, 25 bp, Homo sapien
ctgttaggaataatgttgctctgaa

SEQ ID NO: 390275 - DNA, 25 bp, Homo sapien
gttgctctgaacatgtaaataaaga

SEQ ID NO: 390276 - DNA, 25 bp, Homo sapien
aaatggaatgtgtccgtacaatggt

SEQ ID NO: 390277 - DNA, 25 bp, Homo sapien
gaatgtgtccgtacaatggtgaagg

SEQ ID NO: 390278 - DNA, 25 bp, Homo sapien
ttggcagacgagcagccccatttag

SEQ ID NO: 390279 - DNA, 25 bp, Homo sapien
gcagccccatttagccctaaaaagg

SEQ ID NO: 390280 - DNA, 25 bp, Homo sapien
catttagccctaaaaaggcgtgaag

SEQ ID NO: 390281 - DNA, 25 bp, Homo sapien
cgtgaaggactgatgcgtgccgcaa

SEQ ID NO: 390282 - DNA, 25 bp, Homo sapien
aaggactgatgcgtgccgcaacaca

SEQ ID NO: 390283 - DNA, 25 bp, Homo sapien
gatgcgtgccgcaacacagatgtac

SEQ ID NO: 390284 - DNA, 25 bp, Homo sapien
gtgccgcaacacagatgtacttttc

SEQ ID NO: 390285 - DNA, 25 bp, Homo sapien
gcaacacagatgtacttttcataaa

SEQ ID NO: 390286 - DNA, 25 bp, Homo sapien
atccagataaaatgcttgacactat

SEQ ID NO: 390287 - DNA, 25 bp, Homo sapien
gaattgccactcagttcctctgggt

SEQ ID NO: 390288 - DNA, 25 bp, Homo sapien
tcctctgggtgtgcacatatgtttg

SEQ ID NO: 390289 - DNA, 25 bp, Homo sapien
agagggccacgtaactgagagctta

SEQ ID NO: 390290 - DNA, 25 bp, Homo sapien
agagcttacagtgccaatgccgttt

SEQ ID NO: 390291 - DNA, 25 bp, Homo sapien
aatgccgtttgtgttctggccagag

SEQ ID NO: 390292 - DNA, 25 bp, Homo sapien
ccagagtggagtgcgcagccctgac

SEQ ID NO: 390293 - DNA, 25 bp, Homo sapien
gactcccaggcgctgagattgttgc

SEQ ID NO: 390294 - DNA, 25 bp, Homo sapien
gctgagattgttgcctggttaccca

SEQ ID NO: 390295 - DNA, 25 bp, Homo sapien
tggttacccaggaagctgctgttcc

SEQ ID NO: 390296 - DNA, 25 bp, Homo sapien
tttctctgagccagcggatgcacag

SEQ ID NO: 390297 - DNA, 25 bp, Homo sapien
cttcttcaggcttattgatgatgct

SEQ ID NO: 390298 - DNA, 25 bp, Homo sapien
taaacttatcttgctggacacgccg

SEQ ID NO: 390299 - DNA, 25 bp, Homo sapien
cgctctttctcctggaatcagatga

SEQ ID NO: 390300 - DNA, 25 bp, Homo sapien
cagctgctgcagaggttactgaaga

SEQ ID NO: 390301 - DNA, 25 bp, Homo sapien
ggttactgaagagcaatagccactt

SEQ ID NO: 390302 - DNA, 25 bp, Homo sapien
tgaagagcaatagccacttgagtga

SEQ ID NO: 390303 - DNA, 25 bp, Homo sapien
gagcttctcctgcaaagaggaacca

SEQ ID NO: 390304 - DNA, 25 bp, Homo sapien
aagaggaaccacgaaggtggccaca

SEQ ID NO: 390305 - DNA, 25 bp, Homo sapien
acgaaggtggccacaggtctggttc

SEQ ID NO: 390306 - DNA, 25 bp, Homo sapien
gtggccacaggtctggttctgaaca

SEQ ID NO: 390307 - DNA, 25 bp, Homo sapien
gccacaggtctggttctgaacagag

SEQ ID NO: 390308 - DNA, 25 bp, Homo sapien
ttctgaacagagaccagaggctcgc

SEQ ID NO: 390309 - DNA, 25 bp, Homo sapien
aatctctgcagatggccgtacgtgt

SEQ ID NO: 390310 - DNA, 25 bp, Homo sapien
aacaacactgtttgtgacagtcacg

SEQ ID NO: 390311 - DNA, 25 bp, Homo sapien
gacagtcacgggttttgtgacaata

SEQ ID NO: 390312 - DNA, 25 bp, Homo sapien
ttgtgacaatacagctggctccttc

SEQ ID NO: 390313 - DNA, 25 bp, Homo sapien
ctgcctctgttatcagggctttcaa

SEQ ID NO: 390314 - DNA, 25 bp, Homo sapien
gtgtgtggtgaagccttctgtgaaa

SEQ ID NO: 390315 - DNA, 25 bp, Homo sapien
tctgtgaaaacgtggaagggtcctt

SEQ ID NO: 390316 - DNA, 25 bp, Homo sapien
aagggtccttcctgtgcgtgtgtgc

SEQ ID NO: 390317 - DNA, 25 bp, Homo sapien
gtgcgtgtgtgctgatgaaaaccaa

SEQ ID NO: 390318 - DNA, 25 bp, Homo sapien
aaaaccaagagtacagccccatgac

SEQ ID NO: 390319 - DNA, 25 bp, Homo sapien
atgactgggcagtgccgctcccgga

SEQ ID NO: 390320 - DNA, 25 bp, Homo sapien
cccactgtactgtatgcacggatcg

SEQ ID NO: 390321 - DNA, 25 bp, Homo sapien
gtactgtatgcacggatcgcttggc

SEQ ID NO: 390322 - DNA, 25 bp, Homo sapien
atgtcagtgaatctgagacttgtat

SEQ ID NO: 390323 - DNA, 25 bp, Homo sapien
gaagggaattcgtagacttttcact

SEQ ID NO: 390324 - DNA, 25 bp, Homo sapien
ttctccacacctccctgatgggtgt

SEQ ID NO: 390325 - DNA, 25 bp, Homo sapien
gggtgtctctctacctgggttgtaa

SEQ ID NO: 390326 - DNA, 25 bp, Homo sapien
ctacctgggttgtaattagaactgg

SEQ ID NO: 390327 - DNA, 25 bp, Homo sapien
gatctatttaatttctccagccatt

SEQ ID NO: 390328 - DNA, 25 bp, Homo sapien
cccttcccacagtactagaaatctt

SEQ ID NO: 390329 - DNA, 25 bp, Homo sapien
aaatcttagtcctataccagagtaa

SEQ ID NO: 390330 - DNA, 25 bp, Homo sapien
agagtaagaggtgtgtacaagcccc

SEQ ID NO: 390331 - DNA, 25 bp, Homo sapien
atggttatgccttctagaatcctaa

SEQ ID NO: 390332 - DNA, 25 bp, Homo sapien
ggttatgccttctagaatcctaaag

SEQ ID NO: 390333 - DNA, 25 bp, Homo sapien
gttatgccttctagaatcctaaagt

SEQ ID NO: 390334 - DNA, 25 bp, Homo sapien
tatgccttctagaatcctaaagttg

SEQ ID NO: 390335 - DNA, 25 bp, Homo sapien
tgccttctagaatcctaaagttgac

SEQ ID NO: 390336 - DNA, 25 bp, Homo sapien
tctagaatcctaaagttgacctgaa

SEQ ID NO: 390337 - DNA, 25 bp, Homo sapien
agaatcctaaagttgacctgaagcc

SEQ ID NO: 390338 - DNA, 25 bp, Homo sapien
gaatcctaaagttgacctgaagcca

SEQ ID NO: 390339 - DNA, 25 bp, Homo sapien
atcctaaagttgacctgaagccaag

SEQ ID NO: 390340 - DNA, 25 bp, Homo sapien
cctaaagttgacctgaagccaagaa

SEQ ID NO: 390341 - DNA, 25 bp, Homo sapien
taaagttgacctgaagccaagaaga

SEQ ID NO: 390342 - DNA, 25 bp, Homo sapien
aaagtccttcgtggatgcaacctca

SEQ ID NO: 390343 - DNA, 25 bp, Homo sapien
tgcaacctcaaccatatattctaca

SEQ ID NO: 390344 - DNA, 25 bp, Homo sapien
atatattctacagcaccctggtgcc

SEQ ID NO: 390345 - DNA, 25 bp, Homo sapien
gtgccgtgttaactccctcaatgga

SEQ ID NO: 390346 - DNA, 25 bp, Homo sapien
atggagcacaccatgtcactacagc

SEQ ID NO: 390347 - DNA, 25 bp, Homo sapien
actacagcccgcatcaatgatcagc

SEQ ID NO: 390348 - DNA, 25 bp, Homo sapien
agatgagtcatctgtcactaggcag

SEQ ID NO: 390349 - DNA, 25 bp, Homo sapien
tgtcactaggcagcaccggaacata

SEQ ID NO: 390350 - DNA, 25 bp, Homo sapien
gaacatacatgcctgcaacgtcagc

SEQ ID NO: 390351 - DNA, 25 bp, Homo sapien
aaggagcctacttgccacagtatgc

SEQ ID NO: 390352 - DNA, 25 bp, Homo sapien
acagcggttcctgttgaggaggcaa

SEQ ID NO: 390353 - DNA, 25 bp, Homo sapien
cctggtattgggagctgtatttggt

SEQ ID NO: 390354 - DNA, 25 bp, Homo sapien
agctgtatttggtttctcctcgtat

SEQ ID NO: 390355 - DNA, 25 bp, Homo sapien
tatttggtttctcctcgtatggccc

SEQ ID NO: 390356 - DNA, 25 bp, Homo sapien
gtatggccccattgccctgtttgga

SEQ ID NO: 390357 - DNA, 25 bp, Homo sapien
tgtggcacctcccacgccattgtgg

SEQ ID NO: 390358 - DNA, 25 bp, Homo sapien
acgccattgtgggactcatggccaa

SEQ ID NO: 390359 - DNA, 25 bp, Homo sapien
gactcatggccaatgtgggcggctt

SEQ ID NO: 390360 - DNA, 25 bp, Homo sapien
catggccaatgtgggcggctttctg

SEQ ID NO: 390361 - DNA, 25 bp, Homo sapien
gcaccattgccaagcactacagttg

SEQ ID NO: 390362 - DNA, 25 bp, Homo sapien
ctgaagtgatttgtgcggccagcac

SEQ ID NO: 390363 - DNA, 25 bp, Homo sapien
tctggatcctggtattgggagctgt

SEQ ID NO: 390364 - DNA, 25 bp, Homo sapien
aagaggaaccacgaaggtggccaca

SEQ ID NO: 390365 - DNA, 25 bp, Homo sapien
aggaaccacgaaggtggccacaggt

SEQ ID NO: 390366 - DNA, 25 bp, Homo sapien
gaaccacgaaggtggccacaggtct

SEQ ID NO: 390367 - DNA, 25 bp, Homo sapien
gtggccacaggtctggttctgaaca

SEQ ID NO: 390368 - DNA, 25 bp, Homo sapien
tggccacaggtctggttctgaacag

SEQ ID NO: 390369 - DNA, 25 bp, Homo sapien
ggccacaggtctggttctgaacaga

SEQ ID NO: 390370 - DNA, 25 bp, Homo sapien
gccacaggtctggttctgaacagag

SEQ ID NO: 390371 - DNA, 25 bp, Homo sapien
cacaggtctggttctgaacagagac

SEQ ID NO: 390372 - DNA, 25 bp, Homo sapien
aggtctggttctgaacagagaccag

SEQ ID NO: 390373 - DNA, 25 bp, Homo sapien
ggttctgaacagagaccagaggctc

SEQ ID NO: 390374 - DNA, 25 bp, Homo sapien
ttctgaacagagaccagaggctcgc

SEQ ID NO: 390375 - DNA, 25 bp, Homo sapien
caaagccctcactgctggagagaag

SEQ ID NO: 390376 - DNA, 25 bp, Homo sapien
cctcactgctggagagaaggccata

SEQ ID NO: 390377 - DNA, 25 bp, Homo sapien
ccatagcagcggagcgggccatgaa

SEQ ID NO: 390378 - DNA, 25 bp, Homo sapien
gcgggccatgaaggaagcagctgag

SEQ ID NO: 390379 - DNA, 25 bp, Homo sapien
cagcagcaaatgatggaggctcaag

SEQ ID NO: 390380 - DNA, 25 bp, Homo sapien
atggaggctcaagagagaagcttcc

SEQ ID NO: 390381 - DNA, 25 bp, Homo sapien
aagggaaaaccttctcagagagcat

SEQ ID NO: 390382 - DNA, 25 bp, Homo sapien
gggaaaaccttctcagagagcatga

SEQ ID NO: 390383 - DNA, 25 bp, Homo sapien
cagagagcatgaaaggctgctaaaa

SEQ ID NO: 390384 - DNA, 25 bp, Homo sapien
gaaaggctgctaaaacacaagctga

SEQ ID NO: 390385 - DNA, 25 bp, Homo sapien
aaacacaagctgaaggtacaagaag

SEQ ID NO: 390386 - DNA, 25 bp, Homo sapien
tagtatagagggttctcccacttac

SEQ ID NO: 390387 - DNA, 25 bp, Homo sapien
acaaatggagaagagcctgtacatt

SEQ ID NO: 390388 - DNA, 25 bp, Homo sapien
ttcatattcacagaaagttttcctg

SEQ ID NO: 390389 - DNA, 25 bp, Homo sapien
gggtcaacatgattatcactggact

SEQ ID NO: 390390 - DNA, 25 bp, Homo sapien
ttatcactggactctgctcgtaaat

SEQ ID NO: 390391 - DNA, 25 bp, Homo sapien
tcgtaaatcctcctctactcttgtc

SEQ ID NO: 390392 - DNA, 25 bp, Homo sapien
ggaattcaagcccacatttaaatct

SEQ ID NO: 390393 - DNA, 25 bp, Homo sapien
gcccacatttaaatcttgtcagctt

SEQ ID NO: 390394 - DNA, 25 bp, Homo sapien
atcttgtcagcttcatagttgttgg

SEQ ID NO: 390395 - DNA, 25 bp, Homo sapien
tagttgttggctttgctgtggccta

SEQ ID NO: 390396 - DNA, 25 bp, Homo sapien
tgtggcctacgctccctattttcat

SEQ ID NO: 390397 - DNA, 25 bp, Homo sapien
ccgccatacccgctgaaggaggtgg

SEQ ID NO: 390398 - DNA, 25 bp, Homo sapien
aaaccacctttgcaacgcggaatat

SEQ ID NO: 390399 - DNA, 25 bp, Homo sapien
accacctttgcaacgcggaatatca

SEQ ID NO: 390400 - DNA, 25 bp, Homo sapien
tttgcaacgcggaatatcacaccgg

SEQ ID NO: 390401 - DNA, 25 bp, Homo sapien
gcggaatatcacaccggcctccata

SEQ ID NO: 390402 - DNA, 25 bp, Homo sapien
tccatacgggccacagctttcaaat

SEQ ID NO: 390403 - DNA, 25 bp, Homo sapien
atacgggccacagctttcaaatcgt

SEQ ID NO: 390404 - DNA, 25 bp, Homo sapien
acagctttcaaatcgtccgcgatga

SEQ ID NO: 390405 - DNA, 25 bp, Homo sapien
gctttcaaatcgtccgcgatgacat

SEQ ID NO: 390406 - DNA, 25 bp, Homo sapien
aaatcgtccgcgatgacatgctgtg

SEQ ID NO: 390407 - DNA, 25 bp, Homo sapien
cgaaaatcacgactcctgccagggt

SEQ ID NO: 390408 - DNA, 25 bp, Homo sapien
ttttggccctgcagcatgtcatgct

SEQ ID NO: 390409 - DNA, 25 bp, Homo sapien
gcatgtcatgctcccagaatttcag

SEQ ID NO: 390410 - DNA, 25 bp, Homo sapien
gtcatgctcccagaatttcagcttc

SEQ ID NO: 390411 - DNA, 25 bp, Homo sapien
tcagcttcagcttaactgacagacg

SEQ ID NO: 390412 - DNA, 25 bp, Homo sapien
agcttcagcttaactgacagacgtt

SEQ ID NO: 390413 - DNA, 25 bp, Homo sapien
gcttcagcttaactgacagacgtta

SEQ ID NO: 390414 - DNA, 25 bp, Homo sapien
cttcagcttaactgacagacgttaa

SEQ ID NO: 390415 - DNA, 25 bp, Homo sapien
tcagcttaactgacagacgttaaag

SEQ ID NO: 390416 - DNA, 25 bp, Homo sapien
taactgacagacgttaaagctttct

SEQ ID NO: 390417 - DNA, 25 bp, Homo sapien
actgacagacgttaaagctttctgg

SEQ ID NO: 390418 - DNA, 25 bp, Homo sapien
acagacgttaaagctttctggttag

SEQ ID NO: 390419 - DNA, 25 bp, Homo sapien
tctgctcatctgctccaggtggaaa

SEQ ID NO: 390420 - DNA, 25 bp, Homo sapien
aggtggaaactctcacccctgagct

SEQ ID NO: 390421 - DNA, 25 bp, Homo sapien
tgagctgcccgacctgggttcaagc

SEQ ID NO: 390422 - DNA, 25 bp, Homo sapien
gggtacatccctagcccaggccagg

SEQ ID NO: 390423 - DNA, 25 bp, Homo sapien
gagttagcaaggagacacctgaaaa

SEQ ID NO: 390424 - DNA, 25 bp, Homo sapien
ggacagaatggaagtgcacactccc

SEQ ID NO: 390425 - DNA, 25 bp, Homo sapien
gggaccgccccatccagaaagggtg

SEQ ID NO: 390426 - DNA, 25 bp, Homo sapien
catccagaaagggtgccccgggtgt

SEQ ID NO: 390427 - DNA, 25 bp, Homo sapien
aggccagggctttgagttttcctag

SEQ ID NO: 390428 - DNA, 25 bp, Homo sapien
tgcaaagccccacaggccgaaatct

SEQ ID NO: 390429 - DNA, 25 bp, Homo sapien
aggccgaaatctcagcgtggccctc

SEQ ID NO: 390430 - DNA, 25 bp, Homo sapien
aagctggacagtatttcaataaaat

SEQ ID NO: 390431 - DNA, 25 bp, Homo sapien
agctggacagtatttcaataaaata

SEQ ID NO: 390432 - DNA, 25 bp, Homo sapien
gctggacagtatttcaataaaatac

SEQ ID NO: 390433 - DNA, 25 bp, Homo sapien
ctggacagtatttcaataaaataca

SEQ ID NO: 390434 - DNA, 25 bp, Homo sapien
caggagagactgcactggcgtttta

SEQ ID NO: 390435 - DNA, 25 bp, Homo sapien
aggagagactgcactggcgttttac

SEQ ID NO: 390436 - DNA, 25 bp, Homo sapien
ggagagactgcactggcgttttaca

SEQ ID NO: 390437 - DNA, 25 bp, Homo sapien
gagagactgcactggcgttttacag

SEQ ID NO: 390438 - DNA, 25 bp, Homo sapien
agagactgcactggcgttttacaga

SEQ ID NO: 390439 - DNA, 25 bp, Homo sapien
gagactgcactggcgttttacagag

SEQ ID NO: 390440 - DNA, 25 bp, Homo sapien
cagtatcctgttccgcctctggaag

SEQ ID NO: 390441 - DNA, 25 bp, Homo sapien
atcctgttccgcctctggaagtcct

SEQ ID NO: 390442 - DNA, 25 bp, Homo sapien
ctgttccgcctctggaagtcctgca

SEQ ID NO: 390443 - DNA, 25 bp, Homo sapien
gcctctggaagtcctgcaccaatgt

SEQ ID NO: 390444 - DNA, 25 bp, Homo sapien
tctggaagtcctgcaccaatgtttg

SEQ ID NO: 390445 - DNA, 25 bp, Homo sapien
tggaagtcctgcaccaatgtttgtc

SEQ ID NO: 390446 - DNA, 25 bp, Homo sapien
ggaagtcctgcaccaatgtttgtcc

SEQ ID NO: 390447 - DNA, 25 bp, Homo sapien
aagtcctgcaccaatgtttgtccca

SEQ ID NO: 390448 - DNA, 25 bp, Homo sapien
gtcctgcaccaatgtttgtcccact

SEQ ID NO: 390449 - DNA, 25 bp, Homo sapien
tgtttgtcccactcactgtgacctc

SEQ ID NO: 390450 - DNA, 25 bp, Homo sapien
agatgtgcgggagacccttacaggt

SEQ ID NO: 390451 - DNA, 25 bp, Homo sapien
ggccagggcactagccgagcaggag

SEQ ID NO: 390452 - DNA, 25 bp, Homo sapien
agcaggagcaggctttctgttccat

SEQ ID NO: 390453 - DNA, 25 bp, Homo sapien
tctgctgcaacctcgacatcaaatt

SEQ ID NO: 390454 - DNA, 25 bp, Homo sapien
gcaacctcgacatcaaatttctacc

SEQ ID NO: 390455 - DNA, 25 bp, Homo sapien
tcgacatcaaatttctacccagtcc

SEQ ID NO: 390456 - DNA, 25 bp, Homo sapien
agtccccacctgatgcaaagacatt

SEQ ID NO: 390457 - DNA, 25 bp, Homo sapien
caaagacattcgaggcagccagcgt

SEQ ID NO: 390458 - DNA, 25 bp, Homo sapien
gcagccagcgtgcttctacatccag

SEQ ID NO: 390459 - DNA, 25 bp, Homo sapien
tacatccagtttatacacagctcta

SEQ ID NO: 390460 - DNA, 25 bp, Homo sapien
tacacagctctatacaatatacaga

SEQ ID NO: 390461 - DNA, 25 bp, Homo sapien
tacagaaacctttatatacagatat

SEQ ID NO: 390462 - DNA, 25 bp, Homo sapien
agtcgggcccagtttgtgacctgcg

SEQ ID NO: 390463 - DNA, 25 bp, Homo sapien
cagtttgtgacctgcgggcaggata

SEQ ID NO: 390464 - DNA, 25 bp, Homo sapien
ggcaggataagctggtgcatctatg

SEQ ID NO: 390465 - DNA, 25 bp, Homo sapien
gcatctatggagctcagattcccac

SEQ ID NO: 390466 - DNA, 25 bp, Homo sapien
accagcccctgtggagcaggatcat

SEQ ID NO: 390467 - DNA, 25 bp, Homo sapien
tgtggagcaggatcatcgaggaccc

SEQ ID NO: 390468 - DNA, 25 bp, Homo sapien
cagtgactggcagatggctgctgct

SEQ ID NO: 390469 - DNA, 25 bp, Homo sapien
tggacacggagacccatgacctggt

SEQ ID NO: 390470 - DNA, 25 bp, Homo sapien
atgacctggtggctatccacacaga

SEQ ID NO: 390471 - DNA, 25 bp, Homo sapien
cacagacggcaatgaacagatctca

SEQ ID NO: 390472 - DNA, 25 bp, Homo sapien
aatgaacagatctcagtggtcagct

SEQ ID NO: 390473 - DNA, 25 bp, Homo sapien
aattgtagacttttgtgattttgcc

SEQ ID NO: 390474 - DNA, 25 bp, Homo sapien
tttcagatccacttaaaatatttag

SEQ ID NO: 390475 - DNA, 25 bp, Homo sapien
aacaagttttattccttatgtgtct

SEQ ID NO: 390476 - DNA, 25 bp, Homo sapien
agttttattccttatgtgtcttata

SEQ ID NO: 390477 - DNA, 25 bp, Homo sapien
aatggtcttcatttgacacttactt

SEQ ID NO: 390478 - DNA, 25 bp, Homo sapien
tcttcatttgacacttactttccca

SEQ ID NO: 390479 - DNA, 25 bp, Homo sapien
atttgacacttactttcccatgaac

SEQ ID NO: 390480 - DNA, 25 bp, Homo sapien
gacacttactttcccatgaacactt

SEQ ID NO: 390481 - DNA, 25 bp, Homo sapien
cttactttcccatgaacacttgcag

SEQ ID NO: 390482 - DNA, 25 bp, Homo sapien
tttcccatgaacacttgcagttgct

SEQ ID NO: 390483 - DNA, 25 bp, Homo sapien
catgaacacttgcagttgctaaggg

SEQ ID NO: 390484 - DNA, 25 bp, Homo sapien
ggtgcaggacgcagcagaaatagtc

SEQ ID NO: 390485 - DNA, 25 bp, Homo sapien
gacgcagcagaaatagtcccagaaa

SEQ ID NO: 390486 - DNA, 25 bp, Homo sapien
gagagacgggtcatgcagcgggctt

SEQ ID NO: 390487 - DNA, 25 bp, Homo sapien
gtgttttacaccatacatctccaaa

SEQ ID NO: 390488 - DNA, 25 bp, Homo sapien
tacaccatacatctccaaatgaagt

SEQ ID NO: 390489 - DNA, 25 bp, Homo sapien
caattgtagtgtaagcctgtgataa

SEQ ID NO: 390490 - DNA, 25 bp, Homo sapien
atagcacaaaggttctttaaagaag

SEQ ID NO: 390491 - DNA, 25 bp, Homo sapien
gaagttcacttttaaggcatcagaa

SEQ ID NO: 390492 - DNA, 25 bp, Homo sapien
tgaaaaccagcagtgatttgggtcc

SEQ ID NO: 390493 - DNA, 25 bp, Homo sapien
cccctgaaacctctgtgaatcggag

SEQ ID NO: 390494 - DNA, 25 bp, Homo sapien
aacctctgtgaatcggaggtgggcc

SEQ ID NO: 390495 - DNA, 25 bp, Homo sapien
agatggttccattttcttgtgctca

SEQ ID NO: 390496 - DNA, 25 bp, Homo sapien
gttccattttcttgtgctcataggc

SEQ ID NO: 390497 - DNA, 25 bp, Homo sapien
cattttcttgtgctcataggcattt

SEQ ID NO: 390498 - DNA, 25 bp, Homo sapien
cctctctctttcacatagcgtatat

SEQ ID NO: 390499 - DNA, 25 bp, Homo sapien
tagcgtatatgatgagctgtggata

SEQ ID NO: 390500 - DNA, 25 bp, Homo sapien
tatgatgagctgtggatacattttt

SEQ ID NO: 390501 - DNA, 25 bp, Homo sapien
atagtaatgtttcatattcaggaca

SEQ ID NO: 390502 - DNA, 25 bp, Homo sapien
gtttcatattcaggacatatctatc

SEQ ID NO: 390503 - DNA, 25 bp, Homo sapien
ggacatatctatctgtaagccctgt

SEQ ID NO: 390504 - DNA, 25 bp, Homo sapien
atctatctgtaagccctgtcctttt

SEQ ID NO: 390505 - DNA, 25 bp, Homo sapien
aaatacgcttcagaaatattgctgt

SEQ ID NO: 390506 - DNA, 25 bp, Homo sapien
atgtcagacccgaactggcctggag

SEQ ID NO: 390507 - DNA, 25 bp, Homo sapien
acccgaactggcctggagagagtcc

SEQ ID NO: 390508 - DNA, 25 bp, Homo sapien
gagagagtcctgtaccactcacgag

SEQ ID NO: 390509 - DNA, 25 bp, Homo sapien
taccactcacgagagctgatggcac

SEQ ID NO: 390510 - DNA, 25 bp, Homo sapien
agctgatggcactaacactgggttt

SEQ ID NO: 390511 - DNA, 25 bp, Homo sapien
ggcactaacactgggtttccaagat

SEQ ID NO: 390512 - DNA, 25 bp, Homo sapien
tgggtttccaagatatccaaatgat

SEQ ID NO: 390513 - DNA, 25 bp, Homo sapien
tatgctaactggatgctttcaccct

SEQ ID NO: 390514 - DNA, 25 bp, Homo sapien
ctttcaccctcagcggcaaaattaa

SEQ ID NO: 390515 - DNA, 25 bp, Homo sapien
cagcggcaaaattaatggacacgtt

SEQ ID NO: 390516 - DNA, 25 bp, Homo sapien
ggacacgtttgatagttaacatttc

SEQ ID NO: 390517 - DNA, 25 bp, Homo sapien
accatgccgggctggattgaaccgg

SEQ ID NO: 390518 - DNA, 25 bp, Homo sapien
ggctggattgaaccggctcccacag

SEQ ID NO: 390519 - DNA, 25 bp, Homo sapien
taatgcagaggttttagttttcggg

SEQ ID NO: 390520 - DNA, 25 bp, Homo sapien
ttaagtttcgtatgtgccgttcggc

SEQ ID NO: 390521 - DNA, 25 bp, Homo sapien
aagtttcgtatgtgccgttcggcaa

SEQ ID NO: 390522 - DNA, 25 bp, Homo sapien
tcgtatgtgccgttcggcaaggaga

SEQ ID NO: 390523 - DNA, 25 bp, Homo sapien
agaggaccgcgaggtaggcaccgaa

SEQ ID NO: 390524 - DNA, 25 bp, Homo sapien
aggcaccgaagctggacgccgcgat

SEQ ID NO: 390525 - DNA, 25 bp, Homo sapien
gccgatcttcatgcgcccgggcagg

SEQ ID NO: 390526 - DNA, 25 bp, Homo sapien
cccgggcaggcctggagaaccatgc

SEQ ID NO: 390527 - DNA, 25 bp, Homo sapien
ctggagaaccatgccgggctggatt

SEQ ID NO: 390528 - DNA, 25 bp, Homo sapien
catatcttagtggtaaacagctttt

SEQ ID NO: 390529 - DNA, 25 bp, Homo sapien
tcagattgcctcaggtttagaaaga

SEQ ID NO: 390530 - DNA, 25 bp, Homo sapien
ggctgagaaatcaaatcttgaacac

SEQ ID NO: 390531 - DNA, 25 bp, Homo sapien
aatcttgaacacaatcaacttacat

SEQ ID NO: 390532 - DNA, 25 bp, Homo sapien
attttaaaggaatctgcctcaaatg

SEQ ID NO: 390533 - DNA, 25 bp, Homo sapien
aatctggcagaaaaggtaaagccta

SEQ ID NO: 390534 - DNA, 25 bp, Homo sapien
gaaagctattctcatgttaccaaat

SEQ ID NO: 390535 - DNA, 25 bp, Homo sapien
gttaccaaattctatctgcgcatat

SEQ ID NO: 390536 - DNA, 25 bp, Homo sapien
accaaattctatctgcgcatatgtt

SEQ ID NO: 390537 - DNA, 25 bp, Homo sapien
ctatctgcgcatatgtttttgtata

SEQ ID NO: 390538 - DNA, 25 bp, Homo sapien
gtttttgtataacatttcggtgaca

SEQ ID NO: 390539 - DNA, 25 bp, Homo sapien
ttgttccatttgaagctggacagta

SEQ ID NO: 390540 - DNA, 25 bp, Homo sapien
tacaggtacatcaaagtgtaaactt

SEQ ID NO: 390541 - DNA, 25 bp, Homo sapien
atgataaagatacatgaaacggttt

SEQ ID NO: 390542 - DNA, 25 bp, Homo sapien
catgaaacggtttagtatgaaactt

SEQ ID NO: 390543 - DNA, 25 bp, Homo sapien
cttagtgttttagtagatcttgtga

SEQ ID NO: 390544 - DNA, 25 bp, Homo sapien
gtagatcttgtgatttctgaaaacg

SEQ ID NO: 390545 - DNA, 25 bp, Homo sapien
gatcttgtgatttctgaaaacgaat

SEQ ID NO: 390546 - DNA, 25 bp, Homo sapien
tgtgatttctgaaaacgaatttctt

SEQ ID NO: 390547 - DNA, 25 bp, Homo sapien
aggagagactgcactggcgttttac

SEQ ID NO: 390548 - DNA, 25 bp, Homo sapien
gactgcactggcgttttacagagct

SEQ ID NO: 390549 - DNA, 25 bp, Homo sapien
gcactggcgttttacagagctaaga

SEQ ID NO: 390550 - DNA, 25 bp, Homo sapien
agtgtggaacataggcaattgcttt

SEQ ID NO: 390551 - DNA, 25 bp, Homo sapien
taggcaattgctttgagattcttgg

SEQ ID NO: 390552 - DNA, 25 bp, Homo sapien
aagaggacaacattctgcacctgcc

SEQ ID NO: 390553 - DNA, 25 bp, Homo sapien
gaaagatgagtaactttccccacta

SEQ ID NO: 390554 - DNA, 25 bp, Homo sapien
ctgccttcctgttcagtaactctta

SEQ ID NO: 390555 - DNA, 25 bp, Homo sapien
cagtaactcttacttttgcctgaag

SEQ ID NO: 390556 - DNA, 25 bp, Homo sapien
tttgcctgaagtaacagcatcttct

SEQ ID NO: 390557 - DNA, 25 bp, Homo sapien
gtaacagcatcttctacttctccat

SEQ ID NO: 390558 - DNA, 25 bp, Homo sapien
ttgtgtgtgtgccatcaaggttagc

SEQ ID NO: 390559 - DNA, 25 bp, Homo sapien
ggttagcaaactttatacgtagcct

SEQ ID NO: 390560 - DNA, 25 bp, Homo sapien
aatgcactcattatcttaaacctaa

SEQ ID NO: 390561 - DNA, 25 bp, Homo sapien
ctgaccctcgcgatcttaatatttg

SEQ ID NO: 390562 - DNA, 25 bp, Homo sapien
cttaatatttgccagtgatgcctgc

SEQ ID NO: 390563 - DNA, 25 bp, Homo sapien
atgtgacattacatgttccctccaa

SEQ ID NO: 390564 - DNA, 25 bp, Homo sapien
gttccctccaaactagatgccgaga

SEQ ID NO: 390565 - DNA, 25 bp, Homo sapien
agatgccgagaaacttgttggtaga

SEQ ID NO: 390566 - DNA, 25 bp, Homo sapien
agagttaacctgaaagagtgcttta

SEQ ID NO: 390567 - DNA, 25 bp, Homo sapien
gagtgctttacagctgcaaatctaa

SEQ ID NO: 390568 - DNA, 25 bp, Homo sapien
agtgatcctgacttccaaattttgg

SEQ ID NO: 390569 - DNA, 25 bp, Homo sapien
ggaggatggttcagtctatacaaca

SEQ ID NO: 390570 - DNA, 25 bp, Homo sapien
aatactattctattgtcctcggaga

SEQ ID NO: 390571 - DNA, 25 bp, Homo sapien
taccatattactttccaacactgag

SEQ ID NO: 390572 - DNA, 25 bp, Homo sapien
gggacctttccattgaaagcagtgc

SEQ ID NO: 390573 - DNA, 25 bp, Homo sapien
ctttccattgaaagcagtgcagtca

SEQ ID NO: 390574 - DNA, 25 bp, Homo sapien
aaagcagtgcagtcagctgtttcgt

SEQ ID NO: 390575 - DNA, 25 bp, Homo sapien
gcagtgcagtcagctgtttcgtaga

SEQ ID NO: 390576 - DNA, 25 bp, Homo sapien
agtgcagtcagctgtttcgtagatg

SEQ ID NO: 390577 - DNA, 25 bp, Homo sapien
gactgggggatatttatgtttgtgc

SEQ ID NO: 390578 - DNA, 25 bp, Homo sapien
gcttgtaacattgttcttgtgtcca

SEQ ID NO: 390579 - DNA, 25 bp, Homo sapien
gtaacattgttcttgtgtccataat

SEQ ID NO: 390580 - DNA, 25 bp, Homo sapien
acattgttcttgtgtccataattga

SEQ ID NO: 390581 - DNA, 25 bp, Homo sapien
gttcttgtgtccataattgactgaa

SEQ ID NO: 390582 - DNA, 25 bp, Homo sapien
cataattgactgaaatgtcaagctc

SEQ ID NO: 390583 - DNA, 25 bp, Homo sapien
aagctgcaggcccatgtcctgttga

SEQ ID NO: 390584 - DNA, 25 bp, Homo sapien
ggcccatgtcctgttgatcaaagca

SEQ ID NO: 390585 - DNA, 25 bp, Homo sapien
ctgttgatcaaagcagtccacggat

SEQ ID NO: 390586 - DNA, 25 bp, Homo sapien
caaagcagtccacggatattttgat

SEQ ID NO: 390587 - DNA, 25 bp, Homo sapien
aaggagtccctgtcgttcatgatag

SEQ ID NO: 390588 - DNA, 25 bp, Homo sapien
agtccctgtcgttcatgatagacac

SEQ ID NO: 390589 - DNA, 25 bp, Homo sapien
tgtggaagtcccaggcaatcactgt

SEQ ID NO: 390590 - DNA, 25 bp, Homo sapien
tcccaggcaatcactgtgtccacat

SEQ ID NO: 390591 - DNA, 25 bp, Homo sapien
tgtgtccacatgagcgaaccccagc

SEQ ID NO: 390592 - DNA, 25 bp, Homo sapien
cagcacgtggccagtatcatcagct

SEQ ID NO: 390593 - DNA, 25 bp, Homo sapien
cagtatcatcagctccttcttacag

SEQ ID NO: 390594 - DNA, 25 bp, Homo sapien
gacagtgagctcatgcaaggggaat

SEQ ID NO: 390595 - DNA, 25 bp, Homo sapien
tcccaagttggagtgagtaagaggc

SEQ ID NO: 390596 - DNA, 25 bp, Homo sapien
tcgccctcgggtgctgtctagacag

SEQ ID NO: 390597 - DNA, 25 bp, Homo sapien
gccctcgggtgctgtctagacagag

SEQ ID NO: 390598 - DNA, 25 bp, Homo sapien
ctgtctagacagagggcagaggcgg

SEQ ID NO: 390599 - DNA, 25 bp, Homo sapien
agaagcggctccagggcctgctgac

SEQ ID NO: 390600 - DNA, 25 bp, Homo sapien
tccagggcctgctgaccctgacatg

SEQ ID NO: 390601 - DNA, 25 bp, Homo sapien
cctgacatgcccagtgcctggtgtt

SEQ ID NO: 390602 - DNA, 25 bp, Homo sapien
cagtgcctggtgtttggtggtgttt

SEQ ID NO: 390603 - DNA, 25 bp, Homo sapien
ccagccctgcgccaaagggagagca

SEQ ID NO: 390604 - DNA, 25 bp, Homo sapien
gtccctggggagacagtgagctcat

SEQ ID NO: 390605 - DNA, 25 bp, Homo sapien
gtttacaagtatttagaactcttca

SEQ ID NO: 390606 - DNA, 25 bp, Homo sapien
agaactcttcagttcagggcaaaat

SEQ ID NO: 390607 - DNA, 25 bp, Homo sapien
tcagttcagggcaaaatgttcatga

SEQ ID NO: 390608 - DNA, 25 bp, Homo sapien
aatgttcatgaagttattcctctta

SEQ ID NO: 390609 - DNA, 25 bp, Homo sapien
ttattcctcttaaacatggttagga

SEQ ID NO: 390610 - DNA, 25 bp, Homo sapien
catggttaggaagctgatgacgtta

SEQ ID NO: 390611 - DNA, 25 bp, Homo sapien
gaagctgatgacgttattgattttg

SEQ ID NO: 390612 - DNA, 25 bp, Homo sapien
gattttgtctggattatgtttctgg

SEQ ID NO: 390613 - DNA, 25 bp, Homo sapien
aaacaagctatttgagttttgactt

SEQ ID NO: 390614 - DNA, 25 bp, Homo sapien
gacttgacaaggcaaaacatgacag

SEQ ID NO: 390615 - DNA, 25 bp, Homo sapien
acatgacagtggattctctttacaa

SEQ ID NO: 390616 - DNA, 25 bp, Homo sapien
aatattgctagcctaccacatcagc

SEQ ID NO: 390617 - DNA, 25 bp, Homo sapien
acatcagcaggacggcactggtgca

SEQ ID NO: 390618 - DNA, 25 bp, Homo sapien
cccaggacagacgtcgatgggcagc

SEQ ID NO: 390619 - DNA, 25 bp, Homo sapien
acagacgtcgatgggcagcgggcac

SEQ ID NO: 390620 - DNA, 25 bp, Homo sapien
tgggcaccgcccaagcttttccttt

SEQ ID NO: 390621 - DNA, 25 bp, Homo sapien
gcttttccttttggagctgcttcgt

SEQ ID NO: 390622 - DNA, 25 bp, Homo sapien
ttcgtgatgccgtcttcatttggaa

SEQ ID NO: 390623 - DNA, 25 bp, Homo sapien
gtgatgccgtcttcatttggaacaa

SEQ ID NO: 390624 - DNA, 25 bp, Homo sapien
atgccgtcttcatttggaacaaggg

SEQ ID NO: 390625 - DNA, 25 bp, Homo sapien
atggttacagtcacaaacatgattt

SEQ ID NO: 390626 - DNA, 25 bp, Homo sapien
accaaaatattgctagcctaccaca

SEQ ID NO: 390627 - DNA, 25 bp, Homo sapien
cctttaacaacgtagaatttagatg

SEQ ID NO: 390628 - DNA, 25 bp, Homo sapien
ttaacaacgtagaatttagatgggt

SEQ ID NO: 390629 - DNA, 25 bp, Homo sapien
acaacgtagaatttagatgggttca

SEQ ID NO: 390630 - DNA, 25 bp, Homo sapien
caacgtagaatttagatgggttcat

SEQ ID NO: 390631 - DNA, 25 bp, Homo sapien
aacgtagaatttagatgggttcata

SEQ ID NO: 390632 - DNA, 25 bp, Homo sapien
cgtagaatttagatgggttcatata

SEQ ID NO: 390633 - DNA, 25 bp, Homo sapien
gaatttagatgggttcatatatgtg

SEQ ID NO: 390634 - DNA, 25 bp, Homo sapien
atgggttcatatatgtgagaaaaac

SEQ ID NO: 390635 - DNA, 25 bp, Homo sapien
tgagaaaaacctgaatataggacag

SEQ ID NO: 390636 - DNA, 25 bp, Homo sapien
caagtgatccaccagagaggagatc

SEQ ID NO: 390637 - DNA, 25 bp, Homo sapien
agagaggagatcctcggcctcccca

SEQ ID NO: 390638 - DNA, 25 bp, Homo sapien
gtaagagacttactgccgtcaggct

SEQ ID NO: 390639 - DNA, 25 bp, Homo sapien
ttactgccgtcaggctctagagatg

SEQ ID NO: 390640 - DNA, 25 bp, Homo sapien
gctctagagatgagcctccacctgc

SEQ ID NO: 390641 - DNA, 25 bp, Homo sapien
tctcagagcactagccaggactgtt

SEQ ID NO: 390642 - DNA, 25 bp, Homo sapien
caggctttaaaacagagcccataaa

SEQ ID NO: 390643 - DNA, 25 bp, Homo sapien
gagcccataaaactatgacctctga

SEQ ID NO: 390644 - DNA, 25 bp, Homo sapien
tgacctctgaggtttcattggaaag

SEQ ID NO: 390645 - DNA, 25 bp, Homo sapien
gaaagtgtactgtgcattatccatt

SEQ ID NO: 390646 - DNA, 25 bp, Homo sapien
gatttcattggcttcaaaatccaaa

SEQ ID NO: 390647 - DNA, 25 bp, Homo sapien
gttagaactaagctgccttggcagt

SEQ ID NO: 390648 - DNA, 25 bp, Homo sapien
gcagtgtgcatttttgagccaaaca

SEQ ID NO: 390649 - DNA, 25 bp, Homo sapien
gttggcctggaaccggcccgaccag

SEQ ID NO: 390650 - DNA, 25 bp, Homo sapien
gaccagttccgcccgggcgcgagga

SEQ ID NO: 390651 - DNA, 25 bp, Homo sapien
gaccggccgcaggaagttgctgcaa

SEQ ID NO: 390652 - DNA, 25 bp, Homo sapien
accggccgcaggaagttgctgcaaa

SEQ ID NO: 390653 - DNA, 25 bp, Homo sapien
ccggccgcaggaagttgctgcaaaa

SEQ ID NO: 390654 - DNA, 25 bp, Homo sapien
gccgcaggaagttgctgcaaaactt

SEQ ID NO: 390655 - DNA, 25 bp, Homo sapien
ggtgcccggagggaagagcgcggtg

SEQ ID NO: 390656 - DNA, 25 bp, Homo sapien
gggctatggccatggtgaccggcgg

SEQ ID NO: 390657 - DNA, 25 bp, Homo sapien
atggccatggtgaccggcggctggg

SEQ ID NO: 390658 - DNA, 25 bp, Homo sapien
ggcggcgacacgaacggcgtggaca

SEQ ID NO: 390659 - DNA, 25 bp, Homo sapien
acggcgtggacaaggcgggcggcta

SEQ ID NO: 390660 - DNA, 25 bp, Homo sapien
gatttagatcttagacaagtcattc

SEQ ID NO: 390661 - DNA, 25 bp, Homo sapien
acaagtcattctaggtgtctccact

SEQ ID NO: 390662 - DNA, 25 bp, Homo sapien
attctaggtgtctccactgtttcag

SEQ ID NO: 390663 - DNA, 25 bp, Homo sapien
cactgtttcagttctcgcgttcgtt

SEQ ID NO: 390664 - DNA, 25 bp, Homo sapien
agttctcgcgttcgttcattcttgt

SEQ ID NO: 390665 - DNA, 25 bp, Homo sapien
tcattcttgtgctttttcgttttac

SEQ ID NO: 390666 - DNA, 25 bp, Homo sapien
taaaatagccccttgatgtcatatg

SEQ ID NO: 390667 - DNA, 25 bp, Homo sapien
gatgtcatatgaatccacgctatgc

SEQ ID NO: 390668 - DNA, 25 bp, Homo sapien
gaatccacgctatgcttaatgagta

SEQ ID NO: 390669 - DNA, 25 bp, Homo sapien
aactagtaatcttcatctatgcaat

SEQ ID NO: 390670 - DNA, 25 bp, Homo sapien
gaaaagtacataatacctcgattag

SEQ ID NO: 390671 - DNA, 25 bp, Homo sapien
tgcagcacacgccacagttggtttt

SEQ ID NO: 390672 - DNA, 25 bp, Homo sapien
agcacacgccacagttggttttgca

SEQ ID NO: 390673 - DNA, 25 bp, Homo sapien
acacgccacagttggttttgcacaa

SEQ ID NO: 390674 - DNA, 25 bp, Homo sapien
cttttccagagctccgagtaactga

SEQ ID NO: 390675 - DNA, 25 bp, Homo sapien
ccagagctccgagtaactgagcagt

SEQ ID NO: 390676 - DNA, 25 bp, Homo sapien
ctccgagtaactgagcagtgtcttt

SEQ ID NO: 390677 - DNA, 25 bp, Homo sapien
tgagcagtgtctttgacggcacctc

SEQ ID NO: 390678 - DNA, 25 bp, Homo sapien
agcagtgtctttgacggcacctcgt

SEQ ID NO: 390679 - DNA, 25 bp, Homo sapien
cagtgtctttgacggcacctcgtag

SEQ ID NO: 390680 - DNA, 25 bp, Homo sapien
tttgacggcacctcgtagcctaggg

SEQ ID NO: 390681 - DNA, 25 bp, Homo sapien
gcgagcagaggttgagcagtttctt

SEQ ID NO: 390682 - DNA, 25 bp, Homo sapien
agtgaagagtcaaggccaccccgct

SEQ ID NO: 390683 - DNA, 25 bp, Homo sapien
ggatggagaggtgccctccttccag

SEQ ID NO: 390684 - DNA, 25 bp, Homo sapien
tccttccaggtgtatagagcgcctt

SEQ ID NO: 390685 - DNA, 25 bp, Homo sapien
tagagcgccttttggtaacttcacc

SEQ ID NO: 390686 - DNA, 25 bp, Homo sapien
aagctgaccgcttgtatgtctacag

SEQ ID NO: 390687 - DNA, 25 bp, Homo sapien
atgtctacagtagggctgctccagg

SEQ ID NO: 390688 - DNA, 25 bp, Homo sapien
agcccctcccgcaagtggatgctga

SEQ ID NO: 390689 - DNA, 25 bp, Homo sapien
aagtggatgctgacgaccttggcct

SEQ ID NO: 390690 - DNA, 25 bp, Homo sapien
gaccttggcctgtgatgccaagcgg

SEQ ID NO: 390691 - DNA, 25 bp, Homo sapien
gggctggaagtttgacttcagcttc

SEQ ID NO: 390692 - DNA, 25 bp, Homo sapien
tcagcttctacgtggccaccaagga

SEQ ID NO: 390693 - DNA, 25 bp, Homo sapien
gggccgaatgcgcgccgcgtagggt

SEQ ID NO: 390694 - DNA, 25 bp, Homo sapien
aatgcgcgccgcgtagggtcccccg

SEQ ID NO: 390695 - DNA, 25 bp, Homo sapien
ggtgcccggagggaagagcgcggtg

SEQ ID NO: 390696 - DNA, 25 bp, Homo sapien
ccctggggctatggccatggtgacc

SEQ ID NO: 390697 - DNA, 25 bp, Homo sapien
tggggctatggccatggtgaccggc

SEQ ID NO: 390698 - DNA, 25 bp, Homo sapien
ggcggcgacacgaacggcgtggaca

SEQ ID NO: 390699 - DNA, 25 bp, Homo sapien
gcggcgacacgaacggcgtggacaa

SEQ ID NO: 390700 - DNA, 25 bp, Homo sapien
cggcgacacgaacggcgtggacaag

SEQ ID NO: 390701 - DNA, 25 bp, Homo sapien
acgaacggcgtggacaaggcgggcg

SEQ ID NO: 390702 - DNA, 25 bp, Homo sapien
cggcgtggacaaggcgggcggctac

SEQ ID NO: 390703 - DNA, 25 bp, Homo sapien
aaggcgggcggctacccgcgcgcgg

SEQ ID NO: 390704 - DNA, 25 bp, Homo sapien
gacaacagcttttagacatatcttt

SEQ ID NO: 390705 - DNA, 25 bp, Homo sapien
cagcttttagacatatcttttccaa

SEQ ID NO: 390706 - DNA, 25 bp, Homo sapien
acatatcttttccaacagtcgtcac

SEQ ID NO: 390707 - DNA, 25 bp, Homo sapien
atatcttttccaacagtcgtcactg

SEQ ID NO: 390708 - DNA, 25 bp, Homo sapien
ttttccaacagtcgtcactgctgga

SEQ ID NO: 390709 - DNA, 25 bp, Homo sapien
aacagtcgtcactgctggacactgt

SEQ ID NO: 390710 - DNA, 25 bp, Homo sapien
aaccaatgaaaatgagtgatcctag

SEQ ID NO: 390711 - DNA, 25 bp, Homo sapien
aatgagtgatcctagaagaagataa

SEQ ID NO: 390712 - DNA, 25 bp, Homo sapien
aaatggaggtattttgaacaatcaa

SEQ ID NO: 390713 - DNA, 25 bp, Homo sapien
aaggacaaatgaacacctggctgag

SEQ ID NO: 390714 - DNA, 25 bp, Homo sapien
aaattagctcttttttctatgcata

SEQ ID NO: 390715 - DNA, 25 bp, Homo sapien
tacaagctcatcgtgcagatcaagg

SEQ ID NO: 390716 - DNA, 25 bp, Homo sapien
gcagcgtggaggacatccccgtgat

SEQ ID NO: 390717 - DNA, 25 bp, Homo sapien
tccccgtgatgctcgtgggcaacaa

SEQ ID NO: 390718 - DNA, 25 bp, Homo sapien
gcccaggagtggaagtgcgctttca

SEQ ID NO: 390719 - DNA, 25 bp, Homo sapien
aagtgcgctttcatggagacctcgg

SEQ ID NO: 390720 - DNA, 25 bp, Homo sapien
agacctcggccaagatgaactacaa

SEQ ID NO: 390721 - DNA, 25 bp, Homo sapien
agacgcgccggaacatgagcctcaa

SEQ ID NO: 390722 - DNA, 25 bp, Homo sapien
atgagcctcaacatcgacggcaagc

SEQ ID NO: 390723 - DNA, 25 bp, Homo sapien
acatcgacggcaagcgctccgggaa

SEQ ID NO: 390724 - DNA, 25 bp, Homo sapien
aggacagaccgcgtcaagggcaaat

SEQ ID NO: 390725 - DNA, 25 bp, Homo sapien
gcgtcaagggcaaatgcaccctcat

SEQ ID NO: 390726 - DNA, 25 bp, Homo sapien
gaattcacctaaagatcaaaatatc

SEQ ID NO: 390727 - DNA, 25 bp, Homo sapien
atggattgaacctcatcaattgata

SEQ ID NO: 390728 - DNA, 25 bp, Homo sapien
ggattgaacctcatcaattgatagc

SEQ ID NO: 390729 - DNA, 25 bp, Homo sapien
gaacctcatcaattgatagcagtga

SEQ ID NO: 390730 - DNA, 25 bp, Homo sapien
catcaattgatagcagtgagtgact

SEQ ID NO: 390731 - DNA, 25 bp, Homo sapien
agcagtgagtgactgaagcttccaa

SEQ ID NO: 390732 - DNA, 25 bp, Homo sapien
agtgagtgactgaagcttccaaatc

SEQ ID NO: 390733 - DNA, 25 bp, Homo sapien
gtgagtgactgaagcttccaaatca

SEQ ID NO: 390734 - DNA, 25 bp, Homo sapien
gagtgactgaagcttccaaatcaag

SEQ ID NO: 390735 - DNA, 25 bp, Homo sapien
agtgactgaagcttccaaatcaaga

SEQ ID NO: 390736 - DNA, 25 bp, Homo sapien
tcaagaaaagccggcaccaagaact

SEQ ID NO: 390737 - DNA, 25 bp, Homo sapien
gcttccaggaatatacagcaccgtt

SEQ ID NO: 390738 - DNA, 25 bp, Homo sapien
acagtggctcctttagtcctccact

SEQ ID NO: 390739 - DNA, 25 bp, Homo sapien
atacagcaccgttacagagaggatt

SEQ ID NO: 390740 - DNA, 25 bp, Homo sapien
agaggattgaattgcatggcttctt

SEQ ID NO: 390741 - DNA, 25 bp, Homo sapien
catggcttcttgagcaacctggaac

SEQ ID NO: 390742 - DNA, 25 bp, Homo sapien
aacctggaacacttgagccagccaa

SEQ ID NO: 390743 - DNA, 25 bp, Homo sapien
gagccagccaaatttctgctttatt

SEQ ID NO: 390744 - DNA, 25 bp, Homo sapien
agaccaccaggtataacagcagaat

SEQ ID NO: 390745 - DNA, 25 bp, Homo sapien
gaaaggtgttagtgtgcagtccata

SEQ ID NO: 390746 - DNA, 25 bp, Homo sapien
acccttcctctgagcctacaaataa

SEQ ID NO: 390747 - DNA, 25 bp, Homo sapien
ctacaaataatgcaggctggcctct

SEQ ID NO: 390748 - DNA, 25 bp, Homo sapien
atatggttatatctgagctgtagtc

SEQ ID NO: 390749 - DNA, 25 bp, Homo sapien
gctgtagtcatattatctcaagaaa

SEQ ID NO: 390750 - DNA, 25 bp, Homo sapien
ccaaatttggctttcctctactatc

SEQ ID NO: 390751 - DNA, 25 bp, Homo sapien
ccccatagagaaccactaacaagtg

SEQ ID NO: 390752 - DNA, 25 bp, Homo sapien
gtggatgtctaatattcctctggtg

SEQ ID NO: 390753 - DNA, 25 bp, Homo sapien
tattcctctggtgagttgaaggcag

SEQ ID NO: 390754 - DNA, 25 bp, Homo sapien
gtttcaatgagtatccaggtgacct

SEQ ID NO: 390755 - DNA, 25 bp, Homo sapien
aggtgacctatcctggccctctact

SEQ ID NO: 390756 - DNA, 25 bp, Homo sapien
cctctactcagaaaccggcaatttg

SEQ ID NO: 390757 - DNA, 25 bp, Homo sapien
cggcaatttgtcttcactctgagat

SEQ ID NO: 390758 - DNA, 25 bp, Homo sapien
ctctgagattcattaaattgctgtt

SEQ ID NO: 390759 - DNA, 25 bp, Homo sapien
tgcttctataatgaggcacatatta

SEQ ID NO: 390760 - DNA, 25 bp, Homo sapien
gaggcacatattaatacagttttta

SEQ ID NO: 390761 - DNA, 25 bp, Homo sapien
ggtatctatgaaagagttcacttca

SEQ ID NO: 390762 - DNA, 25 bp, Homo sapien
gaaagagttcacttcatagagaata

SEQ ID NO: 390763 - DNA, 25 bp, Homo sapien
tgagcaaatgtatccaagaaagcaa

SEQ ID NO: 390764 - DNA, 25 bp, Homo sapien
ttatggaataaactccagatctgaa

SEQ ID NO: 390765 - DNA, 25 bp, Homo sapien
aattgaaatggtttcacgccacacg

SEQ ID NO: 390766 - DNA, 25 bp, Homo sapien
gaaatggtttcacgccacacggaaa

SEQ ID NO: 390767 - DNA, 25 bp, Homo sapien
gtttcacgccacacggaaatcttta

SEQ ID NO: 390768 - DNA, 25 bp, Homo sapien
gccacacggaaatctttaagttatt

SEQ ID NO: 390769 - DNA, 25 bp, Homo sapien
aagttatttgttgaggtaccatata

SEQ ID NO: 390770 - DNA, 25 bp, Homo sapien
aagacttgacaaattacttagtatt

SEQ ID NO: 390771 - DNA, 25 bp, Homo sapien
acttagtatttattttccaactgct

SEQ ID NO: 390772 - DNA, 25 bp, Homo sapien
attttccaactgctttatctctgta

SEQ ID NO: 390773 - DNA, 25 bp, Homo sapien
tttccaactgctttatctctgtaaa

SEQ ID NO: 390774 - DNA, 25 bp, Homo sapien
tctctgtaaaatgatatgctgaatt

SEQ ID NO: 390775 - DNA, 25 bp, Homo sapien
tccccttaacttatgtaaacagtct

SEQ ID NO: 390776 - DNA, 25 bp, Homo sapien
aaatttgataattgtggcccagtaa

SEQ ID NO: 390777 - DNA, 25 bp, Homo sapien
tgtggcccagtaagctcaacacttt

SEQ ID NO: 390778 - DNA, 25 bp, Homo sapien
aacactttgccttccccaagactgg

SEQ ID NO: 390779 - DNA, 25 bp, Homo sapien
aaaagggtttatctgcccatttgct

SEQ ID NO: 390780 - DNA, 25 bp, Homo sapien
gatcccttcccttgtagaaactaca

SEQ ID NO: 390781 - DNA, 25 bp, Homo sapien
ttccaggccttcgtgaagagggaga

SEQ ID NO: 390782 - DNA, 25 bp, Homo sapien
gagccaggcttatgcgtaagcttca

SEQ ID NO: 390783 - DNA, 25 bp, Homo sapien
ggcttatgcgtaagcttcatagctt

SEQ ID NO: 390784 - DNA, 25 bp, Homo sapien
gtaagcttcatagcttctgctggcc

SEQ ID NO: 390785 - DNA, 25 bp, Homo sapien
aagcttcatagcttctgctggcctg

SEQ ID NO: 390786 - DNA, 25 bp, Homo sapien
cctgggtgccctgagtggtggtaaa

SEQ ID NO: 390787 - DNA, 25 bp, Homo sapien
ggtggtaaagtggagcaatcccttc

SEQ ID NO: 390788 - DNA, 25 bp, Homo sapien
taaagtggagcaatcccttcacgct

SEQ ID NO: 390789 - DNA, 25 bp, Homo sapien
ggagcaatcccttcacgctccttgg

SEQ ID NO: 390790 - DNA, 25 bp, Homo sapien
ttggccatgttctgagcggccagct

SEQ ID NO: 390791 - DNA, 25 bp, Homo sapien
gccatgttctgagcggccagcttgg

SEQ ID NO: 390792 - DNA, 25 bp, Homo sapien
tagccaggtacagcggggcatgcct

SEQ ID NO: 390793 - DNA, 25 bp, Homo sapien
ccaggtacagcggggcatgcctgta

SEQ ID NO: 390794 - DNA, 25 bp, Homo sapien
ggcagagatgaggtagtgagctgag

SEQ ID NO: 390795 - DNA, 25 bp, Homo sapien
actccggcctgagtggtagggcgag

SEQ ID NO: 390796 - DNA, 25 bp, Homo sapien
ctccggcctgagtggtagggcgaga

SEQ ID NO: 390797 - DNA, 25 bp, Homo sapien
tccggcctgagtggtagggcgagac

SEQ ID NO: 390798 - DNA, 25 bp, Homo sapien
ccggcctgagtggtagggcgagact

SEQ ID NO: 390799 - DNA, 25 bp, Homo sapien
cggcctgagtggtagggcgagactc

SEQ ID NO: 390800 - DNA, 25 bp, Homo sapien
ggcctgagtggtagggcgagactct

SEQ ID NO: 390801 - DNA, 25 bp, Homo sapien
gcctgagtggtagggcgagactctg

SEQ ID NO: 390802 - DNA, 25 bp, Homo sapien
catttatttgtttgttgagactcca

SEQ ID NO: 390803 - DNA, 25 bp, Homo sapien
agcctcaggctggaaagatcgtttc

SEQ ID NO: 390804 - DNA, 25 bp, Homo sapien
tggaaagatcgtttcccttcccagc

SEQ ID NO: 390805 - DNA, 25 bp, Homo sapien
ttcccttcccagctagaaagactca

SEQ ID NO: 390806 - DNA, 25 bp, Homo sapien
gaaagactcatccatcaggctgtgt

SEQ ID NO: 390807 - DNA, 25 bp, Homo sapien
aggaatgacagaagcagcagcgaga

SEQ ID NO: 390808 - DNA, 25 bp, Homo sapien
atcaggctgtgtcagacgcacctga

SEQ ID NO: 390809 - DNA, 25 bp, Homo sapien
ggtcaaagaatctgcatcacagaag

SEQ ID NO: 390810 - DNA, 25 bp, Homo sapien
agatatccagttgggcaagaccccg

SEQ ID NO: 390811 - DNA, 25 bp, Homo sapien
gagagcccttcagaggaccgcgaaa

SEQ ID NO: 390812 - DNA, 25 bp, Homo sapien
gaggaccgcgaaacgcgaactcccg

SEQ ID NO: 390813 - DNA, 25 bp, Homo sapien
ctcaaacccaggacattcagtgtaa

SEQ ID NO: 390814 - DNA, 25 bp, Homo sapien
gacaacagcttttagacatatcttt

SEQ ID NO: 390815 - DNA, 25 bp, Homo sapien
acatatcttttccaacagtcgtcac

SEQ ID NO: 390816 - DNA, 25 bp, Homo sapien
atatcttttccaacagtcgtcactg

SEQ ID NO: 390817 - DNA, 25 bp, Homo sapien
ttttccaacagtcgtcactgctgga

SEQ ID NO: 390818 - DNA, 25 bp, Homo sapien
aacagtcgtcactgctggacactgt

SEQ ID NO: 390819 - DNA, 25 bp, Homo sapien
gctggacactgtttcatcttgcaaa

SEQ ID NO: 390820 - DNA, 25 bp, Homo sapien
aaccaatgaaaatgagtgatcctag

SEQ ID NO: 390821 - DNA, 25 bp, Homo sapien
aaatggaggtattttgaacaatcaa

SEQ ID NO: 390822 - DNA, 25 bp, Homo sapien
aaggacaaatgaacacctggctgag

SEQ ID NO: 390823 - DNA, 25 bp, Homo sapien
atgaacacctggctgagaaaaatta

SEQ ID NO: 390824 - DNA, 25 bp, Homo sapien
aaattagctcttttttctatgcata

SEQ ID NO: 390825 - DNA, 25 bp, Homo sapien
cacacctggccttggaatgtgttat

SEQ ID NO: 390826 - DNA, 25 bp, Homo sapien
ggccttggaatgtgttattttggac

SEQ ID NO: 390827 - DNA, 25 bp, Homo sapien
attttggacatgtacgcacttacag

SEQ ID NO: 390828 - DNA, 25 bp, Homo sapien
gtacgcacttacagtacatttgtaa

SEQ ID NO: 390829 - DNA, 25 bp, Homo sapien
gtaacaataacactctggtatttct

SEQ ID NO: 390830 - DNA, 25 bp, Homo sapien
tggtatttctacaatgagccaggta

SEQ ID NO: 390831 - DNA, 25 bp, Homo sapien
atgagccaggtagtggtgagataac

SEQ ID NO: 390832 - DNA, 25 bp, Homo sapien
gtgagataacagtgaatacaacaga

SEQ ID NO: 390833 - DNA, 25 bp, Homo sapien
tcatcttgtctcactttagtggagg

SEQ ID NO: 390834 - DNA, 25 bp, Homo sapien
tagtggaggacatatttactgtaca

SEQ ID NO: 390835 - DNA, 25 bp, Homo sapien
aagtatgtatggtatcaggtggtga

SEQ ID NO: 390836 - DNA, 25 bp, Homo sapien
tgggctcttctggatttgttcctca

SEQ ID NO: 390837 - DNA, 25 bp, Homo sapien
ggatttgttcctcatttgtcacagg

SEQ ID NO: 390838 - DNA, 25 bp, Homo sapien
tcctcatttgtcacaggtgtcttgt

SEQ ID NO: 390839 - DNA, 25 bp, Homo sapien
gtatgtaaatcgtgccttagaaaca

SEQ ID NO: 390840 - DNA, 25 bp, Homo sapien
tctgttgtcttttctgtgtttggtc

SEQ ID NO: 390841 - DNA, 25 bp, Homo sapien
gtcttttctgtgtttggtcgatatt

SEQ ID NO: 390842 - DNA, 25 bp, Homo sapien
atttttgcctatctagtatcttcaa

SEQ ID NO: 390843 - DNA, 25 bp, Homo sapien
caaattgtagtctttgtaacaacca

SEQ ID NO: 390844 - DNA, 25 bp, Homo sapien
caaataaccttttgtggtcactgta

SEQ ID NO: 390845 - DNA, 25 bp, Homo sapien
ggtagacagaatccatgtacctttg

SEQ ID NO: 390846 - DNA, 25 bp, Homo sapien
ccatgtacctttgctaaggttagaa

SEQ ID NO: 390847 - DNA, 25 bp, Homo sapien
catagagaaaggagtgcccacagtt

SEQ ID NO: 390848 - DNA, 25 bp, Homo sapien
agtgcccacagttgaggcatgaccc

SEQ ID NO: 390849 - DNA, 25 bp, Homo sapien
cctccattcagacctctaactgttg

SEQ ID NO: 390850 - DNA, 25 bp, Homo sapien
cagacctctaactgttgcctgagta

SEQ ID NO: 390851 - DNA, 25 bp, Homo sapien
cctctaactgttgcctgagtacaca

SEQ ID NO: 390852 - DNA, 25 bp, Homo sapien
gttgcctgagtacacagatgtgccc

SEQ ID NO: 390853 - DNA, 25 bp, Homo sapien
gagtacacagatgtgccctgatttc

SEQ ID NO: 390854 - DNA, 25 bp, Homo sapien
cccattggccatagtactgtgccta

SEQ ID NO: 390855 - DNA, 25 bp, Homo sapien
ggccatagtactgtgcctaatcaat

SEQ ID NO: 390856 - DNA, 25 bp, Homo sapien
tcaatgtaataggtttattttccca

SEQ ID NO: 390857 - DNA, 25 bp, Homo sapien
gtagactagtaacatttgatgcttt

SEQ ID NO: 390858 - DNA, 25 bp, Homo sapien
gatgatctcttcagggaagcagata

SEQ ID NO: 390859 - DNA, 25 bp, Homo sapien
gaagcagatatcgaacccaatggca

SEQ ID NO: 390860 - DNA, 25 bp, Homo sapien
gatatcgaacccaatggcaaagtga

SEQ ID NO: 390861 - DNA, 25 bp, Homo sapien
gtatgatgaatttatccacaagatc

SEQ ID NO: 390862 - DNA, 25 bp, Homo sapien
aaagtgttcttttcacttgggagag

SEQ ID NO: 390863 - DNA, 25 bp, Homo sapien
tgttcttttcacttgggagagatgg

SEQ ID NO: 390864 - DNA, 25 bp, Homo sapien
ggagagatggcaaacacagtggcaa

SEQ ID NO: 390865 - DNA, 25 bp, Homo sapien
aataatagatgatttcagccatggt

SEQ ID NO: 390866 - DNA, 25 bp, Homo sapien
gatgatttcagccatggtatgagta

SEQ ID NO: 390867 - DNA, 25 bp, Homo sapien
ttcagccatggtatgagtagatctt

SEQ ID NO: 390868 - DNA, 25 bp, Homo sapien
gccatggtatgagtagatctttaat

SEQ ID NO: 390869 - DNA, 25 bp, Homo sapien
agcgcgaggagcgtgagcggctgga

SEQ ID NO: 390870 - DNA, 25 bp, Homo sapien
gcgtgagcggctggagattgcccga

SEQ ID NO: 390871 - DNA, 25 bp, Homo sapien
agattgcccgagagaggctggcctt

SEQ ID NO: 390872 - DNA, 25 bp, Homo sapien
ttgcccgagagaggctggccttcca

SEQ ID NO: 390873 - DNA, 25 bp, Homo sapien
agaggctggccttccagcgccagcg

SEQ ID NO: 390874 - DNA, 25 bp, Homo sapien
aacggctggagcgcgaacgcatgca

SEQ ID NO: 390875 - DNA, 25 bp, Homo sapien
gaggcgccagcaggaactgcgctat

SEQ ID NO: 390876 - DNA, 25 bp, Homo sapien
ggcgccagcaggaactgcgctatga

SEQ ID NO: 390877 - DNA, 25 bp, Homo sapien
gccagcaggaactgcgctatgagca

SEQ ID NO: 390878 - DNA, 25 bp, Homo sapien
caggaactgcgctatgagcaggagc

SEQ ID NO: 390879 - DNA, 25 bp, Homo sapien
ctattggccggaagccaagcgggcc

SEQ ID NO: 390880 - DNA, 25 bp, Homo sapien
gcacagcgtggcagactgttcagtc

SEQ ID NO: 390881 - DNA, 25 bp, Homo sapien
acagcgtggcagactgttcagtctc

SEQ ID NO: 390882 - DNA, 25 bp, Homo sapien
agactgttcagtctctgctgggtct

SEQ ID NO: 390883 - DNA, 25 bp, Homo sapien
ttcagtctctgctgggtctttccta

SEQ ID NO: 390884 - DNA, 25 bp, Homo sapien
gtctctgctgggtctttcctaggga

SEQ ID NO: 390885 - DNA, 25 bp, Homo sapien
tgggtctttcctagggacctggaag

SEQ ID NO: 390886 - DNA, 25 bp, Homo sapien
tctttcctagggacctggaaggcca

SEQ ID NO: 390887 - DNA, 25 bp, Homo sapien
ttccccaatgccttatgcctgggca

SEQ ID NO: 390888 - DNA, 25 bp, Homo sapien
aatgccttatgcctgggcacactgc

SEQ ID NO: 390889 - DNA, 25 bp, Homo sapien
ggcacactgccacagaatatgcaat

SEQ ID NO: 390890 - DNA, 25 bp, Homo sapien
aatatgcaatatgtgtgggtgacca

SEQ ID NO: 390891 - DNA, 25 bp, Homo sapien
gaatcagaggattctattgtctaaa

SEQ ID NO: 390892 - DNA, 25 bp, Homo sapien
tctaaataaactttggaggtgactt

SEQ ID NO: 390893 - DNA, 25 bp, Homo sapien
ggaggtgacttagtcttctcttccc

SEQ ID NO: 390894 - DNA, 25 bp, Homo sapien
agatcttctttatctctcagttcaa

SEQ ID NO: 390895 - DNA, 25 bp, Homo sapien
tatctctcagttcaacatatattgc

SEQ ID NO: 390896 - DNA, 25 bp, Homo sapien
acatatattgctcaaatggttccta

SEQ ID NO: 390897 - DNA, 25 bp, Homo sapien
aatggttcctaggtgcaagggatct

SEQ ID NO: 390898 - DNA, 25 bp, Homo sapien
gtgcaagggatctggaagttattaa

SEQ ID NO: 390899 - DNA, 25 bp, Homo sapien
gaaatagattttggaccatgacctt

SEQ ID NO: 390900 - DNA, 25 bp, Homo sapien
tgcataacacattgttaccacccac

SEQ ID NO: 390901 - DNA, 25 bp, Homo sapien
accacccacaccattttgttgagta

SEQ ID NO: 390902 - DNA, 25 bp, Homo sapien
gaagaacaactctcatcccacaatt

SEQ ID NO: 390903 - DNA, 25 bp, Homo sapien
acaattgctgcagaactcttctctc

SEQ ID NO: 390904 - DNA, 25 bp, Homo sapien
ggccacagtgggtctcttaatttga

SEQ ID NO: 390905 - DNA, 25 bp, Homo sapien
gggtggtataacttttcttcagaag

SEQ ID NO: 390906 - DNA, 25 bp, Homo sapien
tttcttcagaagacccatgtgggac

SEQ ID NO: 390907 - DNA, 25 bp, Homo sapien
agacccatgtgggacacctccaagg

SEQ ID NO: 390908 - DNA, 25 bp, Homo sapien
atgttccagtaaacctctccaccaa

SEQ ID NO: 390909 - DNA, 25 bp, Homo sapien
caaggaactgtgttcagctgccaca

SEQ ID NO: 390910 - DNA, 25 bp, Homo sapien
ggaggagtttcctggcctgtcacgt

SEQ ID NO: 390911 - DNA, 25 bp, Homo sapien
gcctgtcacgtgaggtttgatcagt

SEQ ID NO: 390912 - DNA, 25 bp, Homo sapien
tgatcagtaaaccagtgcacgcttg

SEQ ID NO: 390913 - DNA, 25 bp, Homo sapien
ctgagctgcgtctattgaattggta

SEQ ID NO: 390914 - DNA, 25 bp, Homo sapien
gctgcgtctattgaattggtaaagt

SEQ ID NO: 390915 - DNA, 25 bp, Homo sapien
agtaataccaatggctttttatcat

SEQ ID NO: 390916 - DNA, 25 bp, Homo sapien
catggttatttttatcgttgggatc

SEQ ID NO: 390917 - DNA, 25 bp, Homo sapien
ttatcgttgggatctttctgtcttc

SEQ ID NO: 390918 - DNA, 25 bp, Homo sapien
acatggtagttcagttcttaaccaa

SEQ ID NO: 390919 - DNA, 25 bp, Homo sapien
ggtagttcagttcttaaccaatgac

SEQ ID NO: 390920 - DNA, 25 bp, Homo sapien
gttcagttcttaaccaatgacttgg

SEQ ID NO: 390921 - DNA, 25 bp, Homo sapien
gatgatgcaaacaattactgtcgtt

SEQ ID NO: 390922 - DNA, 25 bp, Homo sapien
tactgtcgttgggatttagagtgta

SEQ ID NO: 390923 - DNA, 25 bp, Homo sapien
atttagagtgtattagtcacgcatg

SEQ ID NO: 390924 - DNA, 25 bp, Homo sapien
ttgtggagaaggtggcgtttccacc

SEQ ID NO: 390925 - DNA, 25 bp, Homo sapien
tggcgtttccaccttttccataata

SEQ ID NO: 390926 - DNA, 25 bp, Homo sapien
ggacaccagttaaacagaccagcaa

SEQ ID NO: 390927 - DNA, 25 bp, Homo sapien
gttaaacagaccagcaaatccgcgt

SEQ ID NO: 390928 - DNA, 25 bp, Homo sapien
cagaccagcaaatccgcgtgcggaa

SEQ ID NO: 390929 - DNA, 25 bp, Homo sapien
atccgcgtgcggaacaggacccagg

SEQ ID NO: 390930 - DNA, 25 bp, Homo sapien
cgtgcggaacaggacccaggcgtct

SEQ ID NO: 390931 - DNA, 25 bp, Homo sapien
cgtctcctcttgctccctggttggg

SEQ ID NO: 390932 - DNA, 25 bp, Homo sapien
gctgtgcggccaatgatggatttgt

SEQ ID NO: 390933 - DNA, 25 bp, Homo sapien
gcggccaatgatggatttgtttctt

SEQ ID NO: 390934 - DNA, 25 bp, Homo sapien
atgatggatttgtttcttttatgtt

SEQ ID NO: 390935 - DNA, 25 bp, Homo sapien
aatattaactactttatgcctacac

SEQ ID NO: 390936 - DNA, 25 bp, Homo sapien
taactactttatgcctacacactat

SEQ ID NO: 390937 - DNA, 25 bp, Homo sapien
actttatgcctacacactatgctgt

SEQ ID NO: 390938 - DNA, 25 bp, Homo sapien
tttatgcctacacactatgctgtag

SEQ ID NO: 390939 - DNA, 25 bp, Homo sapien
aagtgttggtattactactttcact

SEQ ID NO: 390940 - DNA, 25 bp, Homo sapien
tactactttcactacagagcctttg

SEQ ID NO: 390941 - DNA, 25 bp, Homo sapien
ctctaataatgctgaggtgggctga

SEQ ID NO: 390942 - DNA, 25 bp, Homo sapien
gtgggctgatccttcccatttctgt

SEQ ID NO: 390943 - DNA, 25 bp, Homo sapien
atccttcccatttctgtcttcgggt

SEQ ID NO: 390944 - DNA, 25 bp, Homo sapien
ccatttctgtcttcgggtcattctg

SEQ ID NO: 390945 - DNA, 25 bp, Homo sapien
tctgtcttcgggtcattctgggtag

SEQ ID NO: 390946 - DNA, 25 bp, Homo sapien
ctgctgtctacatcaatacacctga

SEQ ID NO: 390947 - DNA, 25 bp, Homo sapien
gctgtctacatcaatacacctgaat

SEQ ID NO: 390948 - DNA, 25 bp, Homo sapien
gtctacatcaatacacctgaatagt

SEQ ID NO: 390949 - DNA, 25 bp, Homo sapien
tacatcaatacacctgaatagttgg

SEQ ID NO: 390950 - DNA, 25 bp, Homo sapien
atcaatacacctgaatagttggaca

SEQ ID NO: 390951 - DNA, 25 bp, Homo sapien
aatacacctgaatagttggacagaa

SEQ ID NO: 390952 - DNA, 25 bp, Homo sapien
cacctgaatagttggacagaaaatt

SEQ ID NO: 390953 - DNA, 25 bp, Homo sapien
tgaaatcttttaactaattctaact

SEQ ID NO: 390954 - DNA, 25 bp, Homo sapien
ctaattctaactatgaagcacagtg

SEQ ID NO: 390955 - DNA, 25 bp, Homo sapien
ttctaactatgaagcacagtgaaat

SEQ ID NO: 390956 - DNA, 25 bp, Homo sapien
gcacagtgaaatagaaagttaggct

SEQ ID NO: 390957 - DNA, 25 bp, Homo sapien
aggactatggttcctgatccaagga

SEQ ID NO: 390958 - DNA, 25 bp, Homo sapien
gttcctgatccaaggagtgacgact

SEQ ID NO: 390959 - DNA, 25 bp, Homo sapien
caaggagtgacgactgagaatcagc

SEQ ID NO: 390960 - DNA, 25 bp, Homo sapien
gaatcagcacacagtctcttgaggg

SEQ ID NO: 390961 - DNA, 25 bp, Homo sapien
acagtctcttgagggtgtccaggcc

SEQ ID NO: 390962 - DNA, 25 bp, Homo sapien
gtgtccaggcctggctgttaagctc

SEQ ID NO: 390963 - DNA, 25 bp, Homo sapien
tgttaagctccctgctctgattagt

SEQ ID NO: 390964 - DNA, 25 bp, Homo sapien
ctccctgctctgattagtttgtcga

SEQ ID NO: 390965 - DNA, 25 bp, Homo sapien
agtttgtcgagttcacagtgttcca

SEQ ID NO: 390966 - DNA, 25 bp, Homo sapien
atctaacttccactaactgggagga

SEQ ID NO: 390967 - DNA, 25 bp, Homo sapien
aactgggaggaaatgtcttataaat

SEQ ID NO: 390968 - DNA, 25 bp, Homo sapien
agttggcagcctcccgtcactctga

SEQ ID NO: 390969 - DNA, 25 bp, Homo sapien
agcctcccgtcactctgactaaaaa

SEQ ID NO: 390970 - DNA, 25 bp, Homo sapien
cctcccgtcactctgactaaaaaga

SEQ ID NO: 390971 - DNA, 25 bp, Homo sapien
tcccgtcactctgactaaaaagaat

SEQ ID NO: 390972 - DNA, 25 bp, Homo sapien
gtcactctgactaaaaagaatcttc

SEQ ID NO: 390973 - DNA, 25 bp, Homo sapien
agaatcttcagagtgcatatttgga

SEQ ID NO: 390974 - DNA, 25 bp, Homo sapien
aatcttcagagtgcatatttggagg

SEQ ID NO: 390975 - DNA, 25 bp, Homo sapien
tcttcagagtgcatatttggaggtg

SEQ ID NO: 390976 - DNA, 25 bp, Homo sapien
ttcagagtgcatatttggaggtgga

SEQ ID NO: 390977 - DNA, 25 bp, Homo sapien
gaaagattgttcagttaccctaaag

SEQ ID NO: 390978 - DNA, 25 bp, Homo sapien
gattgttcagttaccctaaagactt

SEQ ID NO: 390979 - DNA, 25 bp, Homo sapien
accgagagcatgtgatcattggatt

SEQ ID NO: 390980 - DNA, 25 bp, Homo sapien
tcattggattcatccactgcacaca

SEQ ID NO: 390981 - DNA, 25 bp, Homo sapien
acacagcaggttgcctccattagat

SEQ ID NO: 390982 - DNA, 25 bp, Homo sapien
ccattagatttggagaagcccacac

SEQ ID NO: 390983 - DNA, 25 bp, Homo sapien
ggagaagcccacacagcacacggct

SEQ ID NO: 390984 - DNA, 25 bp, Homo sapien
ccaagcccagcacgtgtaaggtgga

SEQ ID NO: 390985 - DNA, 25 bp, Homo sapien
gaaactgagtcccagatgcgcacgt

SEQ ID NO: 390986 - DNA, 25 bp, Homo sapien
cagcggcttcccttccttagtggtt

SEQ ID NO: 390987 - DNA, 25 bp, Homo sapien
ttccttagtggttcccgccacctgt

SEQ ID NO: 390988 - DNA, 25 bp, Homo sapien
tgtcccgtggcgatggtgaccatat

SEQ ID NO: 390989 - DNA, 25 bp, Homo sapien
accatatctgggtggatggccaagc

SEQ ID NO: 390990 - DNA, 25 bp, Homo sapien
aacagatgatgcacttgcaaattgt

SEQ ID NO: 390991 - DNA, 25 bp, Homo sapien
gcaaattgtgcaaggcttgttctgt

SEQ ID NO: 390992 - DNA, 25 bp, Homo sapien
gcaaggcttgttctgtaatgcaaat

SEQ ID NO: 390993 - DNA, 25 bp, Homo sapien
gtaatgcaaataggatgtcttcttt

SEQ ID NO: 390994 - DNA, 25 bp, Homo sapien
aaataggatgtcttctttgaaatgt

SEQ ID NO: 390995 - DNA, 25 bp, Homo sapien
gaaatttcagttaatgaccaggtag

SEQ ID NO: 390996 - DNA, 25 bp, Homo sapien
ccaggtaggtataagatggtgtcct

SEQ ID NO: 390997 - DNA, 25 bp, Homo sapien
gatggtgtccttagataattctgat

SEQ ID NO: 390998 - DNA, 25 bp, Homo sapien
tatcagaactgatgttaattgtagt

SEQ ID NO: 390999 - DNA, 25 bp, Homo sapien
tgtagtttaagacaactctcctgag

SEQ ID NO: 391000 - DNA, 25 bp, Homo sapien
taagacaactctcctgagacaggag

SEQ ID NO: 391001 - DNA, 25 bp, Homo sapien
tgcactcaggttcacgccgtccttg

SEQ ID NO: 391002 - DNA, 25 bp, Homo sapien
ttcacgccgtccttgggcgcgtgtt

SEQ ID NO: 391003 - DNA, 25 bp, Homo sapien
ccctggtcggctcttgaatctttat

SEQ ID NO: 391004 - DNA, 25 bp, Homo sapien
gtcggctcttgaatctttatccttc

SEQ ID NO: 391005 - DNA, 25 bp, Homo sapien
tattgagctcccactggtgcccagt

SEQ ID NO: 391006 - DNA, 25 bp, Homo sapien
ggtgcccagtcagacgctgggacta

SEQ ID NO: 391007 - DNA, 25 bp, Homo sapien
gtcagacgctgggactacccttttt

SEQ ID NO: 391008 - DNA, 25 bp, Homo sapien
tttttctattccactcagcaacgcg

SEQ ID NO: 391009 - DNA, 25 bp, Homo sapien
agcagctccaagttgctctgcaacc

SEQ ID NO: 391010 - DNA, 25 bp, Homo sapien
ggttgccacccgcactgcggattcg

SEQ ID NO: 391011 - DNA, 25 bp, Homo sapien
cgcactgcggattcgcggacagcgc

SEQ ID NO: 391012 - DNA, 25 bp, Homo sapien
ggcaatctagaaagaccttggaata

SEQ ID NO: 391013 - DNA, 25 bp, Homo sapien
taataataccatttcctgaggacct

SEQ ID NO: 391014 - DNA, 25 bp, Homo sapien
gaggaccttctaaataagtgccatt

SEQ ID NO: 391015 - DNA, 25 bp, Homo sapien
aagtgccattaaagctttaaataca

SEQ ID NO: 391016 - DNA, 25 bp, Homo sapien
aaatctctgctaatagtaggtatta

SEQ ID NO: 391017 - DNA, 25 bp, Homo sapien
agtaggtattaattgagactcaaga

SEQ ID NO: 391018 - DNA, 25 bp, Homo sapien
ataacttatttatggctacacagct

SEQ ID NO: 391019 - DNA, 25 bp, Homo sapien
ggctacacagctagatactaatggc

SEQ ID NO: 391020 - DNA, 25 bp, Homo sapien
gaagtacttttactatcccaggttg

SEQ ID NO: 391021 - DNA, 25 bp, Homo sapien
ttactatcccaggttgcctcaaatg

SEQ ID NO: 391022 - DNA, 25 bp, Homo sapien
attttggacagcaatgtaaggtgaa

SEQ ID NO: 391023 - DNA, 25 bp, Homo sapien
tagtgctcccagactcaacactggg

SEQ ID NO: 391024 - DNA, 25 bp, Homo sapien
agactcaacactgggactctgagtt

SEQ ID NO: 391025 - DNA, 25 bp, Homo sapien
gggacaggcctcactagtcttgagg

SEQ ID NO: 391026 - DNA, 25 bp, Homo sapien
tcactagtcttgaggcccagcctag

SEQ ID NO: 391027 - DNA, 25 bp, Homo sapien
tcttgaggcccagcctaggatggta

SEQ ID NO: 391028 - DNA, 25 bp, Homo sapien
aggcccagcctaggatggtagtcag

SEQ ID NO: 391029 - DNA, 25 bp, Homo sapien
ggaaggagcgagattccaacttcaa

SEQ ID NO: 391030 - DNA, 25 bp, Homo sapien
gagattccaacttcaacatctgtga

SEQ ID NO: 391031 - DNA, 25 bp, Homo sapien
caacttcaacatctgtgacctcaag

SEQ ID NO: 391032 - DNA, 25 bp, Homo sapien
ttccctgctgcccaactggatggaa

SEQ ID NO: 391033 - DNA, 25 bp, Homo sapien
cctgctgcccaactggatggaaaat

SEQ ID NO: 391034 - DNA, 25 bp, Homo sapien
aaaacacctttcttgtatccatata

SEQ ID NO: 391035 - DNA, 25 bp, Homo sapien
gtatccatatacttcaggtgttgct

SEQ ID NO: 391036 - DNA, 25 bp, Homo sapien
atacttcaggtgttgctgttaacat

SEQ ID NO: 391037 - DNA, 25 bp, Homo sapien
tgctgttaacatttactatgatatt

SEQ ID NO: 391038 - DNA, 25 bp, Homo sapien
aacccacaaatgcatacttaccctg

SEQ ID NO: 391039 - DNA, 25 bp, Homo sapien
acaaatgcatacttaccctgtgcct

SEQ ID NO: 391040 - DNA, 25 bp, Homo sapien
taccctgtgcctcatatttcaatag

SEQ ID NO: 391041 - DNA, 25 bp, Homo sapien
gtgcctcatatttcaatagtactgt

SEQ ID NO: 391042 - DNA, 25 bp, Homo sapien
tcaatagtactgtaatatggacatc

SEQ ID NO: 391043 - DNA, 25 bp, Homo sapien
tatggacatcttttgtgaaatactt

SEQ ID NO: 391044 - DNA, 25 bp, Homo sapien
tctgttattagctttgaaaattgta

SEQ ID NO: 391045 - DNA, 25 bp, Homo sapien
caggcttctagggcagcgttgcacg

SEQ ID NO: 391046 - DNA, 25 bp, Homo sapien
ccccatggaatagcacggaagagca

SEQ ID NO: 391047 - DNA, 25 bp, Homo sapien
aatagcacggaagagcagccacaaa

SEQ ID NO: 391048 - DNA, 25 bp, Homo sapien
tatgcactaactttcttaaaacttt

SEQ ID NO: 391049 - DNA, 25 bp, Homo sapien
aatgctgtgcaaatggccttgtgag

SEQ ID NO: 391050 - DNA, 25 bp, Homo sapien
aatggccttgtgagtttgaactagc

SEQ ID NO: 391051 - DNA, 25 bp, Homo sapien
gtgtgtcaggtgactatcagccctt

SEQ ID NO: 391052 - DNA, 25 bp, Homo sapien
aggtgactatcagcccttctgcctt

SEQ ID NO: 391053 - DNA, 25 bp, Homo sapien
tgcctttttgtagccaggcttgcta

SEQ ID NO: 391054 - DNA, 25 bp, Homo sapien
gccaggcttgctatgaatgaaacgg

SEQ ID NO: 391055 - DNA, 25 bp, Homo sapien
gcttgctatgaatgaaacggttcta

SEQ ID NO: 391056 - DNA, 25 bp, Homo sapien
acaatttaagttgtgcctgcttata

SEQ ID NO: 391057 - DNA, 25 bp, Homo sapien
agttgtgcctgcttataacgatttc

SEQ ID NO: 391058 - DNA, 25 bp, Homo sapien
gtgcctgcttataacgatttcttac

SEQ ID NO: 391059 - DNA, 25 bp, Homo sapien
tataacgatttcttacatcagtttt

SEQ ID NO: 391060 - DNA, 25 bp, Homo sapien
tactggttatataggttcagctttc

SEQ ID NO: 391061 - DNA, 25 bp, Homo sapien
tatataggttcagctttcagcatgt

SEQ ID NO: 391062 - DNA, 25 bp, Homo sapien
atttgccactggttttatgaatttt

SEQ ID NO: 391063 - DNA, 25 bp, Homo sapien
gaattttcctagacttatcattgta

SEQ ID NO: 391064 - DNA, 25 bp, Homo sapien
tatcatttcatttccataggtcata

SEQ ID NO: 391065 - DNA, 25 bp, Homo sapien
tctattgtggctcaggtgagtatca

SEQ ID NO: 391066 - DNA, 25 bp, Homo sapien
tgtggctcaggtgagtatcatttta

SEQ ID NO: 391067 - DNA, 25 bp, Homo sapien
aaaatgtttgccctgctgtacctca

SEQ ID NO: 391068 - DNA, 25 bp, Homo sapien
gccctgctgtacctcatttttagga

SEQ ID NO: 391069 - DNA, 25 bp, Homo sapien
aaaatgggacattctggaactgctg

SEQ ID NO: 391070 - DNA, 25 bp, Homo sapien
gactttgtcgccctgtgcactaaaa

SEQ ID NO: 391071 - DNA, 25 bp, Homo sapien
aagggccagattttcagcagccaag

SEQ ID NO: 391072 - DNA, 25 bp, Homo sapien
ttttcagcagccaaggacatccata

SEQ ID NO: 391073 - DNA, 25 bp, Homo sapien
aaggacatccatacccaagtgaatg

SEQ ID NO: 391074 - DNA, 25 bp, Homo sapien
gagacaattcactctggctgtttga

SEQ ID NO: 391075 - DNA, 25 bp, Homo sapien
gaacagcagcgtttcataggaagag

SEQ ID NO: 391076 - DNA, 25 bp, Homo sapien
ttttctgaccacataaaggcttctt

SEQ ID NO: 391077 - DNA, 25 bp, Homo sapien
aaggcttcttctctttgtaataaag

SEQ ID NO: 391078 - DNA, 25 bp, Homo sapien
ataccctgaggaccagccgcatcaa

SEQ ID NO: 391079 - DNA, 25 bp, Homo sapien
gggcttgagcaaaagcaggcgtcct

SEQ ID NO: 391080 - DNA, 25 bp, Homo sapien
agcaggcgtcctgggaaaatgacaa

SEQ ID NO: 391081 - DNA, 25 bp, Homo sapien
gaaaatgacaagctcaaactggcct

SEQ ID NO: 391082 - DNA, 25 bp, Homo sapien
tgacaagctcaaactggcctcaaga

SEQ ID NO: 391083 - DNA, 25 bp, Homo sapien
tttcacttcagggttctttcagata

SEQ ID NO: 391084 - DNA, 25 bp, Homo sapien
attaacaaatctccatcttcccgga

SEQ ID NO: 391085 - DNA, 25 bp, Homo sapien
atcttcccggaaatctattctcaca

SEQ ID NO: 391086 - DNA, 25 bp, Homo sapien
ggaaatctattctcacaattggaag

SEQ ID NO: 391087 - DNA, 25 bp, Homo sapien
acaattggaagcgtgctccctacaa

SEQ ID NO: 391088 - DNA, 25 bp, Homo sapien
agcgtgctccctacaaaccggacag

SEQ ID NO: 391089 - DNA, 25 bp, Homo sapien
aggacctggccgatgagctgatcac

SEQ ID NO: 391090 - DNA, 25 bp, Homo sapien
ccccagggccatgagaagttgctga

SEQ ID NO: 391091 - DNA, 25 bp, Homo sapien
ggacactttttgaggatgctggcta

SEQ ID NO: 391092 - DNA, 25 bp, Homo sapien
aggatgctggctacttaaagacccc

SEQ ID NO: 391093 - DNA, 25 bp, Homo sapien
tggctacttaaagaccccagaagaa

SEQ ID NO: 391094 - DNA, 25 bp, Homo sapien
cacccagctggagggaggtcctgac

SEQ ID NO: 391095 - DNA, 25 bp, Homo sapien
gggtttgagaccctggaaaactgca

SEQ ID NO: 391096 - DNA, 25 bp, Homo sapien
gcaggaaggctcataaagaactctc

SEQ ID NO: 391097 - DNA, 25 bp, Homo sapien
aaggctgaaaggtttgctcacccag

SEQ ID NO: 391098 - DNA, 25 bp, Homo sapien
aaggtttgctcacccagcacggcat

SEQ ID NO: 391099 - DNA, 25 bp, Homo sapien
gaggcccacagaaacttccaacttg

SEQ ID NO: 391100 - DNA, 25 bp, Homo sapien
gtggcacagagtggaagcatctcct

SEQ ID NO: 391101 - DNA, 25 bp, Homo sapien
ccactgggccttgcttacagaagag

SEQ ID NO: 391102 - DNA, 25 bp, Homo sapien
agaagaggcaatggctcagaccagc

SEQ ID NO: 391103 - DNA, 25 bp, Homo sapien
ctgtagttgcctccctggcccatga

SEQ ID NO: 391104 - DNA, 25 bp, Homo sapien
tccctggcccatgagtgaggatgca

SEQ ID NO: 391105 - DNA, 25 bp, Homo sapien
agactgctagccacctcagaggctc

SEQ ID NO: 391106 - DNA, 25 bp, Homo sapien
tcagaggctccaagggcccagttcc

SEQ ID NO: 391107 - DNA, 25 bp, Homo sapien
caggaatcaaccctgtgctagctga

SEQ ID NO: 391108 - DNA, 25 bp, Homo sapien
tgctagctgagttcacctgcaccga

SEQ ID NO: 391109 - DNA, 25 bp, Homo sapien
tgagttcacctgcaccgagaccagc

SEQ ID NO: 391110 - DNA, 25 bp, Homo sapien
agaccagcccctagccaagattcta

SEQ ID NO: 391111 - DNA, 25 bp, Homo sapien
agaaccacaagctgacccacagcgg

SEQ ID NO: 391112 - DNA, 25 bp, Homo sapien
cagcggcgagaagcagtacaaatgt

SEQ ID NO: 391113 - DNA, 25 bp, Homo sapien
gtacaaatgtaccatctgcaacaag

SEQ ID NO: 391114 - DNA, 25 bp, Homo sapien
caaatgtaccatctgcaacaaggcc

SEQ ID NO: 391115 - DNA, 25 bp, Homo sapien
aggtctacaacctaaccttccatat

SEQ ID NO: 391116 - DNA, 25 bp, Homo sapien
tacaacctaaccttccatatgcaca

SEQ ID NO: 391117 - DNA, 25 bp, Homo sapien
tatgcacacccacaacgacaagaag

SEQ ID NO: 391118 - DNA, 25 bp, Homo sapien
acacccacaacgacaagaagccttt

SEQ ID NO: 391119 - DNA, 25 bp, Homo sapien
gacaagaagcctttcacgtgcgcca

SEQ ID NO: 391120 - DNA, 25 bp, Homo sapien
aagaagcctttcacgtgcgccactt

SEQ ID NO: 391121 - DNA, 25 bp, Homo sapien
aagcctttcacgtgcgccacttgcg

SEQ ID NO: 391122 - DNA, 25 bp, Homo sapien
aaagcaataactgtggatggccatt

SEQ ID NO: 391123 - DNA, 25 bp, Homo sapien
gatggccattttatggctgcagatc

SEQ ID NO: 391124 - DNA, 25 bp, Homo sapien
gatcacagcacatttataaaagatg

SEQ ID NO: 391125 - DNA, 25 bp, Homo sapien
gatgtgtgtttcatgaaaatgtgca

SEQ ID NO: 391126 - DNA, 25 bp, Homo sapien
gaaaatgtgcatttcatcgtggaaa

SEQ ID NO: 391127 - DNA, 25 bp, Homo sapien
actgtggttggaggagatttctcaa

SEQ ID NO: 391128 - DNA, 25 bp, Homo sapien
agtgtaggtgacttaacttgcaaaa

SEQ ID NO: 391129 - DNA, 25 bp, Homo sapien
tgatcatatgtgagaacggatgtct

SEQ ID NO: 391130 - DNA, 25 bp, Homo sapien
agaacggatgtctcaaattaggaaa

SEQ ID NO: 391131 - DNA, 25 bp, Homo sapien
taaaaaagcctcatgtattgatttg

SEQ ID NO: 391132 - DNA, 25 bp, Homo sapien
gaaaaagatattttggtgctcatca

SEQ ID NO: 391133 - DNA, 25 bp, Homo sapien
aaggcccctctagccatgcagggtg

SEQ ID NO: 391134 - DNA, 25 bp, Homo sapien
tttcccaccatcactccgggagaca

SEQ ID NO: 391135 - DNA, 25 bp, Homo sapien
atttgtgaagggtgcaggaggtgtt

SEQ ID NO: 391136 - DNA, 25 bp, Homo sapien
tttaagggaatggagagtgcacttc

SEQ ID NO: 391137 - DNA, 25 bp, Homo sapien
aatggagagtgcacttccctaccta

SEQ ID NO: 391138 - DNA, 25 bp, Homo sapien
atattgccaggaggtggagaattca

SEQ ID NO: 391139 - DNA, 25 bp, Homo sapien
ggagaattcagggtcacggcatcat

SEQ ID NO: 391140 - DNA, 25 bp, Homo sapien
gagaattcagggtcacggcatcatg

SEQ ID NO: 391141 - DNA, 25 bp, Homo sapien
agaattcagggtcacggcatcatgg

SEQ ID NO: 391142 - DNA, 25 bp, Homo sapien
gaattcagggtcacggcatcatggg

SEQ ID NO: 391143 - DNA, 25 bp, Homo sapien
atggggacccacctagcaggctctg

SEQ ID NO: 391144 - DNA, 25 bp, Homo sapien
ctggcagggaggtccatggcacttc

SEQ ID NO: 391145 - DNA, 25 bp, Homo sapien
catctgcaacttctgatcagactcc

SEQ ID NO: 391146 - DNA, 25 bp, Homo sapien
tgcaacttctgatcagactccagcc

SEQ ID NO: 391147 - DNA, 25 bp, Homo sapien
acctcacccctgcatgcagaaatag

SEQ ID NO: 391148 - DNA, 25 bp, Homo sapien
gggtaccgaaatgacctgggacaga

SEQ ID NO: 391149 - DNA, 25 bp, Homo sapien
accgaaatgacctgggacagacctg

SEQ ID NO: 391150 - DNA, 25 bp, Homo sapien
tgggttcccattcagactttgtgtc

SEQ ID NO: 391151 - DNA, 25 bp, Homo sapien
gtctgaatgggacacaaagctgtgt

SEQ ID NO: 391152 - DNA, 25 bp, Homo sapien
aaagctgtgtgtctccgggcaagtc

SEQ ID NO: 391153 - DNA, 25 bp, Homo sapien
gtgtctccgggcaagtcactgactc

SEQ ID NO: 391154 - DNA, 25 bp, Homo sapien
ccgggcaagtcactgactctctctg

SEQ ID NO: 391155 - DNA, 25 bp, Homo sapien
gttggatccgtggatgggaaaccca

SEQ ID NO: 391156 - DNA, 25 bp, Homo sapien
gaaacccacgggtacagaggactga

SEQ ID NO: 391157 - DNA, 25 bp, Homo sapien
acgggtacagaggactgaccatatt

SEQ ID NO: 391158 - DNA, 25 bp, Homo sapien
cagaggactgaccatattaaagagt

SEQ ID NO: 391159 - DNA, 25 bp, Homo sapien
ggctactaacctcaaaaagtttctg

SEQ ID NO: 391160 - DNA, 25 bp, Homo sapien
aagtttctgaatgaccggaagttct

SEQ ID NO: 391161 - DNA, 25 bp, Homo sapien
gaccggaagttcttctgatcttcac

SEQ ID NO: 391162 - DNA, 25 bp, Homo sapien
gatcttcacaaacatctcttgggtt

SEQ ID NO: 391163 - DNA, 25 bp, Homo sapien
aacatctcttgggttttctcacttg

SEQ ID NO: 391164 - DNA, 25 bp, Homo sapien
ttgggttttctcacttgctaaaatt

SEQ ID NO: 391165 - DNA, 25 bp, Homo sapien
ttttctccagtgtcaatattcaaga

SEQ ID NO: 391166 - DNA, 25 bp, Homo sapien
cccaactcagtcttcagtgatttta

SEQ ID NO: 391167 - DNA, 25 bp, Homo sapien
agtcttcagtgattttaaacagcat

SEQ ID NO: 391168 - DNA, 25 bp, Homo sapien
aaccatctatgacatgagttttgag

SEQ ID NO: 391169 - DNA, 25 bp, Homo sapien
aagctgaagcactaatcccactaag

SEQ ID NO: 391170 - DNA, 25 bp, Homo sapien
aagcactaatcccactaagttaaag

SEQ ID NO: 391171 - DNA, 25 bp, Homo sapien
cactaagttaaagacttctttccag

SEQ ID NO: 391172 - DNA, 25 bp, Homo sapien
ttctttccagtccaaggcaggcctg

SEQ ID NO: 391173 - DNA, 25 bp, Homo sapien
ggcaggcctgaatcaactgtcttta

SEQ ID NO: 391174 - DNA, 25 bp, Homo sapien
aggcctgaatcaactgtctttaaat

SEQ ID NO: 391175 - DNA, 25 bp, Homo sapien
gaaaaaatgcttaaaatcctgtcat

SEQ ID NO: 391176 - DNA, 25 bp, Homo sapien
gagattaaagtgactctttactgta

SEQ ID NO: 391177 - DNA, 25 bp, Homo sapien
agtccgaagcctgatcagaccttag

SEQ ID NO: 391178 - DNA, 25 bp, Homo sapien
ttcacccctcaagatcattactaga

SEQ ID NO: 391179 - DNA, 25 bp, Homo sapien
gagttttcactcacagttccaggtg

SEQ ID NO: 391180 - DNA, 25 bp, Homo sapien
tcccacccatgtatagcagagctct

SEQ ID NO: 391181 - DNA, 25 bp, Homo sapien
gagctctgtagctgagtcctgtagt

SEQ ID NO: 391182 - DNA, 25 bp, Homo sapien
agtcctgtagtgtcctctctcaaga

SEQ ID NO: 391183 - DNA, 25 bp, Homo sapien
gatgtagagattagctgtcctgatt

SEQ ID NO: 391184 - DNA, 25 bp, Homo sapien
gctgtcctgattaaactggtgattt

SEQ ID NO: 391185 - DNA, 25 bp, Homo sapien
actggtgatttcagagtctcttgac

SEQ ID NO: 391186 - DNA, 25 bp, Homo sapien
gagtctcttgacaacagcatttcag

SEQ ID NO: 391187 - DNA, 25 bp, Homo sapien
agcatttcaggttctcttgacccag

SEQ ID NO: 391188 - DNA, 25 bp, Homo sapien
ttctttctcctttgcactaagtgct

SEQ ID NO: 391189 - DNA, 25 bp, Homo sapien
agtgctttgcagacacggcacagca

SEQ ID NO: 391190 - DNA, 25 bp, Homo sapien
agaatgtccccaggagtcagcaggt

SEQ ID NO: 391191 - DNA, 25 bp, Homo sapien
tccccaggagtcagcaggtcacagt

SEQ ID NO: 391192 - DNA, 25 bp, Homo sapien
gagtcagcaggtcacagtctggctt

SEQ ID NO: 391193 - DNA, 25 bp, Homo sapien
gcaggtcacagtctggctttgtgat

SEQ ID NO: 391194 - DNA, 25 bp, Homo sapien
cagtctggctttgtgatggttgaca

SEQ ID NO: 391195 - DNA, 25 bp, Homo sapien
gatggttgacaaggtctagctacat

SEQ ID NO: 391196 - DNA, 25 bp, Homo sapien
ggtctagctacatgggaaagcctga

SEQ ID NO: 391197 - DNA, 25 bp, Homo sapien
ggaaagcctgagaagtcactttgga

SEQ ID NO: 391198 - DNA, 25 bp, Homo sapien
aagtcactttggaactaaattgcct

SEQ ID NO: 391199 - DNA, 25 bp, Homo sapien
gttcctatgattgctgtcatgcaca

SEQ ID NO: 391200 - DNA, 25 bp, Homo sapien
gctgtcatgcacatacagacactaa

SEQ ID NO: 391201 - DNA, 25 bp, Homo sapien
attttggctgtacatttagtgcaca

SEQ ID NO: 391202 - DNA, 25 bp, Homo sapien
ttagtgcacaaaatatccctttttt

SEQ ID NO: 391203 - DNA, 25 bp, Homo sapien
atatcccttttttgaatgccaaatg

SEQ ID NO: 391204 - DNA, 25 bp, Homo sapien
atgccaaatggccaagtgtgaaaac

SEQ ID NO: 391205 - DNA, 25 bp, Homo sapien
aagctggagcagaagtcggtatcat

SEQ ID NO: 391206 - DNA, 25 bp, Homo sapien
gaagtcggtatcatcatcatagagt

SEQ ID NO: 391207 - DNA, 25 bp, Homo sapien
agagtaaacttctggcatatgtgaa

SEQ ID NO: 391208 - DNA, 25 bp, Homo sapien
cagtgctgcctgttgctagattgtt

SEQ ID NO: 391209 - DNA, 25 bp, Homo sapien
gcctgttgctagattgttcctatga

SEQ ID NO: 391210 - DNA, 25 bp, Homo sapien
ccaactgactacatccttcatggtt

SEQ ID NO: 391211 - DNA, 25 bp, Homo sapien
cccctgccagcatgttgtatattaa

SEQ ID NO: 391212 - DNA, 25 bp, Homo sapien
tttgttattcgtatatgttctcctt

SEQ ID NO: 391213 - DNA, 25 bp, Homo sapien
acctggctgcaaggatccagaggga

SEQ ID NO: 391214 - DNA, 25 bp, Homo sapien
atagggacccctttcattgtgtttg

SEQ ID NO: 391215 - DNA, 25 bp, Homo sapien
tgttgctgtatttgtattgctcaga

SEQ ID NO: 391216 - DNA, 25 bp, Homo sapien
gtatttgtattgctcagaacgtagt

SEQ ID NO: 391217 - DNA, 25 bp, Homo sapien
gtaaggtcctagtcacaggttctgg

SEQ ID NO: 391218 - DNA, 25 bp, Homo sapien
tcctagtcacaggttctgggacatg

SEQ ID NO: 391219 - DNA, 25 bp, Homo sapien
tctgggacatggatgtcatcttttc

SEQ ID NO: 391220 - DNA, 25 bp, Homo sapien
gggctgtgacccaactgactacatc

SEQ ID NO: 391221 - DNA, 25 bp, Homo sapien
ggccctctggctggatgcgtttgcc

SEQ ID NO: 391222 - DNA, 25 bp, Homo sapien
gctggatgcgtttgcctatcaggac

SEQ ID NO: 391223 - DNA, 25 bp, Homo sapien
gcgtttgcctatcaggacccagaat

SEQ ID NO: 391224 - DNA, 25 bp, Homo sapien
tatcaggacccagaattacttacag

SEQ ID NO: 391225 - DNA, 25 bp, Homo sapien
ttacagacctgtttagggctaggct

SEQ ID NO: 391226 - DNA, 25 bp, Homo sapien
ctgtttagggctaggcttggcctct

SEQ ID NO: 391227 - DNA, 25 bp, Homo sapien
gggtgtggcaacactcattcttcat

SEQ ID NO: 391228 - DNA, 25 bp, Homo sapien
aacactcattcttcatccttattct

SEQ ID NO: 391229 - DNA, 25 bp, Homo sapien
tcatccttattctccctggctgtgg

SEQ ID NO: 391230 - DNA, 25 bp, Homo sapien
tggctgtgggcaacactggtcctca

SEQ ID NO: 391231 - DNA, 25 bp, Homo sapien
gggcaacactggtcctcagtgtcac

SEQ ID NO: 391232 - DNA, 25 bp, Homo sapien
gtaattggcagcatagcccttgggt

SEQ ID NO: 391233 - DNA, 25 bp, Homo sapien
tagcccttgggtgcaatgatccagt

SEQ ID NO: 391234 - DNA, 25 bp, Homo sapien
gatccagtccttaatttcatgcaaa

SEQ ID NO: 391235 - DNA, 25 bp, Homo sapien
agcatgcacttctcacactatttgt

SEQ ID NO: 391236 - DNA, 25 bp, Homo sapien
ggtatttttcacattgcacaggcaa

SEQ ID NO: 391237 - DNA, 25 bp, Homo sapien
gcaaggatacagacgcaggaaggct

SEQ ID NO: 391238 - DNA, 25 bp, Homo sapien
gtccaagttcacattcaagtggcaa

SEQ ID NO: 391239 - DNA, 25 bp, Homo sapien
caaggtctgcacaatcgcgtggttg

SEQ ID NO: 391240 - DNA, 25 bp, Homo sapien
acaatcgcgtggttggttgcattca

SEQ ID NO: 391241 - DNA, 25 bp, Homo sapien
ggttgcattcatgtgtgcgttgagt

SEQ ID NO: 391242 - DNA, 25 bp, Homo sapien
ggagcattctccatcacagtaattg

SEQ ID NO: 391243 - DNA, 25 bp, Homo sapien
gtggctctttgagtatcaccgatcc

SEQ ID NO: 391244 - DNA, 25 bp, Homo sapien
ctccatgacctacctctatgaggac

SEQ ID NO: 391245 - DNA, 25 bp, Homo sapien
tgtatggcacgacatctcagacttc

SEQ ID NO: 391246 - DNA, 25 bp, Homo sapien
agagccgtccctccaattaatgcag

SEQ ID NO: 391247 - DNA, 25 bp, Homo sapien
ttaatgcagccctgaggtgtctggc

SEQ ID NO: 391248 - DNA, 25 bp, Homo sapien
aggtgtctggctgtggctcaagatt

SEQ ID NO: 391249 - DNA, 25 bp, Homo sapien
catgcagaccctcccaaaggatact

SEQ ID NO: 391250 - DNA, 25 bp, Homo sapien
ggatactgccttctcaagatcatag

SEQ ID NO: 391251 - DNA, 25 bp, Homo sapien
aagatcataggcctcagactccaac

SEQ ID NO: 391252 - DNA, 25 bp, Homo sapien
agactccaactggtgttatcccagg

SEQ ID NO: 391253 - DNA, 25 bp, Homo sapien
ttatcccagggttccgtttgctgaa

SEQ ID NO: 391254 - DNA, 25 bp, Homo sapien
gggcctccctcacctgtcttggtgg

SEQ ID NO: 391255 - DNA, 25 bp, Homo sapien
cagggatggctcctaggtggctgag

SEQ ID NO: 391256 - DNA, 25 bp, Homo sapien
agcagtggctggaaggtgccccgtg

SEQ ID NO: 391257 - DNA, 25 bp, Homo sapien
ctggcggccggctctgcatgttctt

SEQ ID NO: 391258 - DNA, 25 bp, Homo sapien
ggctctgcatgttcttgttgcctgt

SEQ ID NO: 391259 - DNA, 25 bp, Homo sapien
tgttcttgttgcctgtcgtctgtaa

SEQ ID NO: 391260 - DNA, 25 bp, Homo sapien
ttgttgcctgtcgtctgtaactcta

SEQ ID NO: 391261 - DNA, 25 bp, Homo sapien
ttgcctgtcgtctgtaactctagtg

SEQ ID NO: 391262 - DNA, 25 bp, Homo sapien
ctgtcgtctgtaactctagtgttcg

SEQ ID NO: 391263 - DNA, 25 bp, Homo sapien
gtaactctagtgttcgacattcgcc

SEQ ID NO: 391264 - DNA, 25 bp, Homo sapien
ctagtgttcgacattcgccgtgata

SEQ ID NO: 391265 - DNA, 25 bp, Homo sapien
agttgattaccccatcagcaagcat

SEQ ID NO: 391266 - DNA, 25 bp, Homo sapien
catacctttggatgtcttgtacctt

SEQ ID NO: 391267 - DNA, 25 bp, Homo sapien
gatgtcttgtaccttaggccagtta

SEQ ID NO: 391268 - DNA, 25 bp, Homo sapien
ggccagttattatcctatttacatt

SEQ ID NO: 391269 - DNA, 25 bp, Homo sapien
ttttgacagtttcccaacaagcatg

SEQ ID NO: 391270 - DNA, 25 bp, Homo sapien
gtttcccaacaagcatgtttccttc

SEQ ID NO: 391271 - DNA, 25 bp, Homo sapien
tgtttccttctctaacactggccat

SEQ ID NO: 391272 - DNA, 25 bp, Homo sapien
ttctctaacactggccattatggga

SEQ ID NO: 391273 - DNA, 25 bp, Homo sapien
gtgttttcactaatcttttttcatg

SEQ ID NO: 391274 - DNA, 25 bp, Homo sapien
ggtcaaaagggcaccttggcatgat

SEQ ID NO: 391275 - DNA, 25 bp, Homo sapien
ggcatgatgtcaaccaaataaattt

SEQ ID NO: 391276 - DNA, 25 bp, Homo sapien
tattttggtacctgcttctgggcca

SEQ ID NO: 391277 - DNA, 25 bp, Homo sapien
agtccccagcctgtcatgagtgtgt

SEQ ID NO: 391278 - DNA, 25 bp, Homo sapien
cccagcctgtcatgagtgtgtgtgt

SEQ ID NO: 391279 - DNA, 25 bp, Homo sapien
catggatgtgactgggagctctgct

SEQ ID NO: 391280 - DNA, 25 bp, Homo sapien
ggtcaagatgagtttccctgtagat

SEQ ID NO: 391281 - DNA, 25 bp, Homo sapien
gatgagtttccctgtagattgtacc

SEQ ID NO: 391282 - DNA, 25 bp, Homo sapien
agtttccctgtagattgtaccttgg

SEQ ID NO: 391283 - DNA, 25 bp, Homo sapien
aagagtatttttctagcgcctgggc

SEQ ID NO: 391284 - DNA, 25 bp, Homo sapien
agtatttttctagcgcctgggctgg

SEQ ID NO: 391285 - DNA, 25 bp, Homo sapien
tagcgcctgggctggacagttgttt

SEQ ID NO: 391286 - DNA, 25 bp, Homo sapien
ctgggctggacagttgtttctaaaa

SEQ ID NO: 391287 - DNA, 25 bp, Homo sapien
gggagccaggttctccctgccaaaa

SEQ ID NO: 391288 - DNA, 25 bp, Homo sapien
acagctgagagtgggattcatccag

SEQ ID NO: 391289 - DNA, 25 bp, Homo sapien
atccagactcatgcaataacccttt

SEQ ID NO: 391290 - DNA, 25 bp, Homo sapien
gcaataaccctttgattgttttcta

SEQ ID NO: 391291 - DNA, 25 bp, Homo sapien
taaaaggagactccctcggcaagat

SEQ ID NO: 391292 - DNA, 25 bp, Homo sapien
ggtacggagtcttcaggcccagttt

SEQ ID NO: 391293 - DNA, 25 bp, Homo sapien
gcccagtttctcactttagccaatt

SEQ ID NO: 391294 - DNA, 25 bp, Homo sapien
ttagccaattcgagggctccttgtg

SEQ ID NO: 391295 - DNA, 25 bp, Homo sapien
ggctccttgtggtgggatcagaact

SEQ ID NO: 391296 - DNA, 25 bp, Homo sapien
gatcagaactaatccagagtgtggg

SEQ ID NO: 391297 - DNA, 25 bp, Homo sapien
aagtgacagtcaaaaccccacctgg

SEQ ID NO: 391298 - DNA, 25 bp, Homo sapien
tcatttagccaaagtatgttactac

SEQ ID NO: 391299 - DNA, 25 bp, Homo sapien
atgttactactaaaagtgactgttc

SEQ ID NO: 391300 - DNA, 25 bp, Homo sapien
gtgactgttctaaggctgtttgtgt

SEQ ID NO: 391301 - DNA, 25 bp, Homo sapien
ctaaggctgtttgtgtgaagtatta

SEQ ID NO: 391302 - DNA, 25 bp, Homo sapien
tgttcttttcctcaaggctttaatt

SEQ ID NO: 391303 - DNA, 25 bp, Homo sapien
ttggcctttttatgcttttgttatt

SEQ ID NO: 391304 - DNA, 25 bp, Homo sapien
ttttcttttctgagtgttcagtcaa

SEQ ID NO: 391305 - DNA, 25 bp, Homo sapien
ttatctgtactgaccagaagaggaa

SEQ ID NO: 391306 - DNA, 25 bp, Homo sapien
gaggaatttcatcttttgctttcta

SEQ ID NO: 391307 - DNA, 25 bp, Homo sapien
aagtgacttataattggagactgac

SEQ ID NO: 391308 - DNA, 25 bp, Homo sapien
aattggagactgacaaatttgtgtt

SEQ ID NO: 391309 - DNA, 25 bp, Homo sapien
atgcgtggcccaatatgatatcaat

SEQ ID NO: 391310 - DNA, 25 bp, Homo sapien
aaacatgttctctcttagaccgtac

SEQ ID NO: 391311 - DNA, 25 bp, Homo sapien
gttctctcttagaccgtacttatca

SEQ ID NO: 391312 - DNA, 25 bp, Homo sapien
agaccgtacttatcacttattggga

SEQ ID NO: 391313 - DNA, 25 bp, Homo sapien
cacttattgggatatagcttcaaca

SEQ ID NO: 391314 - DNA, 25 bp, Homo sapien
aaagcatcagtacatatattcaaag

SEQ ID NO: 391315 - DNA, 25 bp, Homo sapien
agatatttattgtagccttgcttat

SEQ ID NO: 391316 - DNA, 25 bp, Homo sapien
gtagccttgcttatgctggaaaaat

SEQ ID NO: 391317 - DNA, 25 bp, Homo sapien
actgcttatcagtagttcccatttg

SEQ ID NO: 391318 - DNA, 25 bp, Homo sapien
cagtagttcccatttgagtaaatta

SEQ ID NO: 391319 - DNA, 25 bp, Homo sapien
tacaatttgagaacagtggccaggt

SEQ ID NO: 391320 - DNA, 25 bp, Homo sapien
agtgctcacaaccttccagtgtgga

SEQ ID NO: 391321 - DNA, 25 bp, Homo sapien
acaaccttccagtgtggatgttaca

SEQ ID NO: 391322 - DNA, 25 bp, Homo sapien
cttccagtgtggatgttacagggtg

SEQ ID NO: 391323 - DNA, 25 bp, Homo sapien
atgttacagggtggcccccattcta

SEQ ID NO: 391324 - DNA, 25 bp, Homo sapien
ccccattctaccgatgtgaaaactg

SEQ ID NO: 391325 - DNA, 25 bp, Homo sapien
agtggctgccctgtcgctggatcag

SEQ ID NO: 391326 - DNA, 25 bp, Homo sapien
gccctgtcgctggatcagtagcaga

SEQ ID NO: 391327 - DNA, 25 bp, Homo sapien
tgtcgctggatcagtagcagagcca

SEQ ID NO: 391328 - DNA, 25 bp, Homo sapien
gccgccctcgggaatcatacaggaa

SEQ ID NO: 391329 - DNA, 25 bp, Homo sapien
gggaatcatacaggaagagcacagt

SEQ ID NO: 391330 - DNA, 25 bp, Homo sapien
aagagcacagtggatccagggtggg

SEQ ID NO: 391331 - DNA, 25 bp, Homo sapien
ttatgccttgtaaaacagcagcata

SEQ ID NO: 391332 - DNA, 25 bp, Homo sapien
tgtaaaacagcagcatagggctttt

SEQ ID NO: 391333 - DNA, 25 bp, Homo sapien
aacagcagcatagggcttttaaaag

SEQ ID NO: 391334 - DNA, 25 bp, Homo sapien
tatgtagtaggtgtttttaatgatt

SEQ ID NO: 391335 - DNA, 25 bp, Homo sapien
gtttgtaaggctgtacgccaacagt

SEQ ID NO: 391336 - DNA, 25 bp, Homo sapien
aaggctgtacgccaacagtttcctc

SEQ ID NO: 391337 - DNA, 25 bp, Homo sapien
tgtacgccaacagtttcctctgata

SEQ ID NO: 391338 - DNA, 25 bp, Homo sapien
acgccaacagtttcctctgatagtt

SEQ ID NO: 391339 - DNA, 25 bp, Homo sapien
ttcctctgatagtttgactgattta

SEQ ID NO: 391340 - DNA, 25 bp, Homo sapien
tgactgatttaggatatctgctgta

SEQ ID NO: 391341 - DNA, 25 bp, Homo sapien
gcaatgtaaagtcttttttgccttt

SEQ ID NO: 391342 - DNA, 25 bp, Homo sapien
gagaacaagcccaagaatcactaca

SEQ ID NO: 391343 - DNA, 25 bp, Homo sapien
aatcactacaagaacatccttccct

SEQ ID NO: 391344 - DNA, 25 bp, Homo sapien
atcactacaagaacatccttccctg

SEQ ID NO: 391345 - DNA, 25 bp, Homo sapien
taggtactcttccgcccacacggga

SEQ ID NO: 391346 - DNA, 25 bp, Homo sapien
gtgagctgaaggctccatcacctcc

SEQ ID NO: 391347 - DNA, 25 bp, Homo sapien
gagctgaaggctccatcacctccag

SEQ ID NO: 391348 - DNA, 25 bp, Homo sapien
tgcagcagcaggaatgccggttcct

SEQ ID NO: 391349 - DNA, 25 bp, Homo sapien
agcagcaggaatgccggttcctgta

SEQ ID NO: 391350 - DNA, 25 bp, Homo sapien
aggaatgccggttcctgtaccctcg

SEQ ID NO: 391351 - DNA, 25 bp, Homo sapien
gaatgccggttcctgtaccctcgga

SEQ ID NO: 391352 - DNA, 25 bp, Homo sapien
tgccggttcctgtaccctcggaagg

SEQ ID NO: 391353 - DNA, 25 bp, Homo sapien
tggcttcagcatgtggcatcagaat

SEQ ID NO: 391354 - DNA, 25 bp, Homo sapien
ttgttaaaacccagattgctcccct

SEQ ID NO: 391355 - DNA, 25 bp, Homo sapien
aagttcccaggtgatctatcgggag

SEQ ID NO: 391356 - DNA, 25 bp, Homo sapien
ccaggtgatctatcgggagaaccac

SEQ ID NO: 391357 - DNA, 25 bp, Homo sapien
gggagaaccacgattgagaaccact

SEQ ID NO: 391358 - DNA, 25 bp, Homo sapien
gaaccactgataaaggccgcctgta

SEQ ID NO: 391359 - DNA, 25 bp, Homo sapien
aaggccgcctgtaggcatgtctgtt

SEQ ID NO: 391360 - DNA, 25 bp, Homo sapien
aattaaggccagtgtcccccaggtg

SEQ ID NO: 391361 - DNA, 25 bp, Homo sapien
ccccaggtgggcattgatgctatgg

SEQ ID NO: 391362 - DNA, 25 bp, Homo sapien
gcattgatgctatggttgtggccaa

SEQ ID NO: 391363 - DNA, 25 bp, Homo sapien
tgctatggttgtggccaagtggctt

SEQ ID NO: 391364 - DNA, 25 bp, Homo sapien
gaagtcagtagttattctcccatga

SEQ ID NO: 391365 - DNA, 25 bp, Homo sapien
gttattctcccatgaacgttcttgt

SEQ ID NO: 391366 - DNA, 25 bp, Homo sapien
tgaacgttcttgtctgtgtacagtt

SEQ ID NO: 391367 - DNA, 25 bp, Homo sapien
aaaggatctgtttgcttagctgtca

SEQ ID NO: 391368 - DNA, 25 bp, Homo sapien
gatctgtttgcttagctgtcaacaa

SEQ ID NO: 391369 - DNA, 25 bp, Homo sapien
ttgtatgttggaacgtgccccagaa

SEQ ID NO: 391370 - DNA, 25 bp, Homo sapien
gaatgaggcagttggcaaacttctc

SEQ ID NO: 391371 - DNA, 25 bp, Homo sapien
gttggcaaacttctcaggacaatga

SEQ ID NO: 391372 - DNA, 25 bp, Homo sapien
ttatgccacacagtgcattgttttt

SEQ ID NO: 391373 - DNA, 25 bp, Homo sapien
tgttttttctacctgcttgtcttat

SEQ ID NO: 391374 - DNA, 25 bp, Homo sapien
ttctacctgcttgtcttatttttag

SEQ ID NO: 391375 - DNA, 25 bp, Homo sapien
taatcgagaatttccagtctttcag

SEQ ID NO: 391376 - DNA, 25 bp, Homo sapien
ttccagtctttcagtctgatctatt

SEQ ID NO: 391377 - DNA, 25 bp, Homo sapien
gtctgatctatttaattcactactt

SEQ ID NO: 391378 - DNA, 25 bp, Homo sapien
attcactacttgttacataatccag

SEQ ID NO: 391379 - DNA, 25 bp, Homo sapien
ctacttgttacataatccagtgaaa

SEQ ID NO: 391380 - DNA, 25 bp, Homo sapien
cagtgaaaactctacttgttgaaat

SEQ ID NO: 391381 - DNA, 25 bp, Homo sapien
atcttgcagctttatttgagtattt

SEQ ID NO: 391382 - DNA, 25 bp, Homo sapien
tttgttcttttgtgtagtttccatc

SEQ ID NO: 391383 - DNA, 25 bp, Homo sapien
tcttttgtgtagtttccatctttta

SEQ ID NO: 391384 - DNA, 25 bp, Homo sapien
taaagtattatcttctctgcaaaaa

SEQ ID NO: 391385 - DNA, 25 bp, Homo sapien
aattcctggagtaattttctctcat

SEQ ID NO: 391386 - DNA, 25 bp, Homo sapien
gggcacaattcgctatcacacacct

SEQ ID NO: 391387 - DNA, 25 bp, Homo sapien
attcgctatcacacacctccaagat

SEQ ID NO: 391388 - DNA, 25 bp, Homo sapien
gatcaagatcctgttctgagtcaga

SEQ ID NO: 391389 - DNA, 25 bp, Homo sapien
agcagtgaaactcctcctcactgga

SEQ ID NO: 391390 - DNA, 25 bp, Homo sapien
aagagcatatagaccacctagtgga

SEQ ID NO: 391391 - DNA, 25 bp, Homo sapien
gagataagttaagtgacccctgttc

SEQ ID NO: 391392 - DNA, 25 bp, Homo sapien
acccctgttcaagccgatgggatga

SEQ ID NO: 391393 - DNA, 25 bp, Homo sapien
gaagcttgtctcagagatccagatc

SEQ ID NO: 391394 - DNA, 25 bp, Homo sapien
gagatccagatcatggtcctataat

SEQ ID NO: 391395 - DNA, 25 bp, Homo sapien
tattattcagaccttagtacagcaa

SEQ ID NO: 391396 - DNA, 25 bp, Homo sapien
tagtacagcaagacactctggccac

SEQ ID NO: 391397 - DNA, 25 bp, Homo sapien
tcttcaaataggttcctggtgtctt

SEQ ID NO: 391398 - DNA, 25 bp, Homo sapien
ttcaaataggttcctggtgtcttat

SEQ ID NO: 391399 - DNA, 25 bp, Homo sapien
tcatttgttgagttcatgttttctt

SEQ ID NO: 391400 - DNA, 25 bp, Homo sapien
gttcatgttttcttggatggtctgg

SEQ ID NO: 391401 - DNA, 25 bp, Homo sapien
ttttcttggatggtctggatgctta

SEQ ID NO: 391402 - DNA, 25 bp, Homo sapien
tcttggatggtctggatgcttatgt

SEQ ID NO: 391403 - DNA, 25 bp, Homo sapien
tagtatgttaattgcgttttccaac

SEQ ID NO: 391404 - DNA, 25 bp, Homo sapien
gttaattgcgttttccaactctaga

SEQ ID NO: 391405 - DNA, 25 bp, Homo sapien
aattgcgttttccaactctagaatt

SEQ ID NO: 391406 - DNA, 25 bp, Homo sapien
tttaagtttcttcaacacagcactt

SEQ ID NO: 391407 - DNA, 25 bp, Homo sapien
tttcttcaacacagcacttttgaat

SEQ ID NO: 391408 - DNA, 25 bp, Homo sapien
gaagtcagtagttattctcccatga

SEQ ID NO: 391409 - DNA, 25 bp, Homo sapien
gtcagtagttattctcccatgaacg

SEQ ID NO: 391410 - DNA, 25 bp, Homo sapien
agtagttattctcccatgaacgttc

SEQ ID NO: 391411 - DNA, 25 bp, Homo sapien
gttattctcccatgaacgttcttgt

SEQ ID NO: 391412 - DNA, 25 bp, Homo sapien
attctcccatgaacgttcttgtctg

SEQ ID NO: 391413 - DNA, 25 bp, Homo sapien
ccatgaacgttcttgtctgtgtaca

SEQ ID NO: 391414 - DNA, 25 bp, Homo sapien
gaacgttcttgtctgtgtacagttt

SEQ ID NO: 391415 - DNA, 25 bp, Homo sapien
gttcttgtctgtgtacagtttttag

SEQ ID NO: 391416 - DNA, 25 bp, Homo sapien
aaaggatctgtttgcttagctgtca

SEQ ID NO: 391417 - DNA, 25 bp, Homo sapien
ggatctgtttgcttagctgtcaaca

SEQ ID NO: 391418 - DNA, 25 bp, Homo sapien
ctgtttgcttagctgtcaacaaaaa

SEQ ID NO: 391419 - DNA, 25 bp, Homo sapien
atgattatagccatttttgtaggta

SEQ ID NO: 391420 - DNA, 25 bp, Homo sapien
tttgtaggtacaaagtggcatctca

SEQ ID NO: 391421 - DNA, 25 bp, Homo sapien
atttgcatttccataatatctaatt

SEQ ID NO: 391422 - DNA, 25 bp, Homo sapien
ttattggccatttgtttgactttgt

SEQ ID NO: 391423 - DNA, 25 bp, Homo sapien
ggccatttgtttgactttgtttggt

SEQ ID NO: 391424 - DNA, 25 bp, Homo sapien
tgactttgtttggtgaaatgtatac

SEQ ID NO: 391425 - DNA, 25 bp, Homo sapien
taatttgggttgtctgtcttgtctt

SEQ ID NO: 391426 - DNA, 25 bp, Homo sapien
ttgtctgtcttgtcttctcatttta

SEQ ID NO: 391427 - DNA, 25 bp, Homo sapien
gagttcttaataatctctggcttac

SEQ ID NO: 391428 - DNA, 25 bp, Homo sapien
aatctctggcttacaagtccttaat

SEQ ID NO: 391429 - DNA, 25 bp, Homo sapien
ggcttacaagtccttaatttatcaa

SEQ ID NO: 391430 - DNA, 25 bp, Homo sapien
aatgtaacatatgctgcctacccac

SEQ ID NO: 391431 - DNA, 25 bp, Homo sapien
gccagagttgtagtcccaaagaaga

SEQ ID NO: 391432 - DNA, 25 bp, Homo sapien
tagggaattgaactggcctgtgcaa

SEQ ID NO: 391433 - DNA, 25 bp, Homo sapien
tgaactggcctgtgcaatgggcatg

SEQ ID NO: 391434 - DNA, 25 bp, Homo sapien
gccttaccgtggcagtacggagaca

SEQ ID NO: 391435 - DNA, 25 bp, Homo sapien
gcagtacggagacagtccagaacat

SEQ ID NO: 391436 - DNA, 25 bp, Homo sapien
ccagaacatggtcttcttgccacgg

SEQ ID NO: 391437 - DNA, 25 bp, Homo sapien
tgttgttgtctctggtggtgctgca

SEQ ID NO: 391438 - DNA, 25 bp, Homo sapien
gtctctggtggtgctgcatgtctgt

SEQ ID NO: 391439 - DNA, 25 bp, Homo sapien
tgtctgtggctcacctttattcttg

SEQ ID NO: 391440 - DNA, 25 bp, Homo sapien
atctggctactgaggctagagccca

SEQ ID NO: 391441 - DNA, 25 bp, Homo sapien
tactcaacataactggcgagaactg

SEQ ID NO: 391442 - DNA, 25 bp, Homo sapien
agaactggatgtgggctcaggcacc

SEQ ID NO: 391443 - DNA, 25 bp, Homo sapien
attccttgagggatctgggcaatgg

SEQ ID NO: 391444 - DNA, 25 bp, Homo sapien
gatctgggcaatgggtttacgcaaa

SEQ ID NO: 391445 - DNA, 25 bp, Homo sapien
gcaaaagggtcaccatttggaggtc

SEQ ID NO: 391446 - DNA, 25 bp, Homo sapien
atttggaggtcctggcgcttactaa

SEQ ID NO: 391447 - DNA, 25 bp, Homo sapien
ggtcctggcgcttactaattattgt

SEQ ID NO: 391448 - DNA, 25 bp, Homo sapien
tactaattattgtcgcgtggcccaa

SEQ ID NO: 391449 - DNA, 25 bp, Homo sapien
ttattgtcgcgtggcccaaacaaac

SEQ ID NO: 391450 - DNA, 25 bp, Homo sapien
gtgcacatttggtgtttctctctaa

SEQ ID NO: 391451 - DNA, 25 bp, Homo sapien
gtttctctctaagtttggaggcagg

SEQ ID NO: 391452 - DNA, 25 bp, Homo sapien
tctaagattgctctaacgtctagtg

SEQ ID NO: 391453 - DNA, 25 bp, Homo sapien
gattgctctaacgtctagtgaaaaa

SEQ ID NO: 391454 - DNA, 25 bp, Homo sapien
tttcagccaaataatgcattttatt

SEQ ID NO: 391455 - DNA, 25 bp, Homo sapien
gggagaaacctctagttttgccaat

SEQ ID NO: 391456 - DNA, 25 bp, Homo sapien
gaaacctctagttttgccaatagaa

SEQ ID NO: 391457 - DNA, 25 bp, Homo sapien
tgccaatagaaaatgcttcttccat

SEQ ID NO: 391458 - DNA, 25 bp, Homo sapien
gaaaatgcttcttccattgaataaa

SEQ ID NO: 391459 - DNA, 25 bp, Homo sapien
atatatcctatgctgattttcccaa

SEQ ID NO: 391460 - DNA, 25 bp, Homo sapien
atcctatgctgattttcccaaaaca

SEQ ID NO: 391461 - DNA, 25 bp, Homo sapien
gattttcccaaaacatgacccatag

SEQ ID NO: 391462 - DNA, 25 bp, Homo sapien
aacatgacccatagtattaaataca

SEQ ID NO: 391463 - DNA, 25 bp, Homo sapien
gacaaaaggaaaataggctggcatt

SEQ ID NO: 391464 - DNA, 25 bp, Homo sapien
ataggctggcatttttacagtgtca

SEQ ID NO: 391465 - DNA, 25 bp, Homo sapien
gctggcatttttacagtgtcagggt

SEQ ID NO: 391466 - DNA, 25 bp, Homo sapien
tacagtgtcagggtgggttagcaaa

SEQ ID NO: 391467 - DNA, 25 bp, Homo sapien
ggtgggttagcaaagacatgatatc

SEQ ID NO: 391468 - DNA, 25 bp, Homo sapien
gcaaagacatgatatcagaagcaga

SEQ ID NO: 391469 - DNA, 25 bp, Homo sapien
gaagcagaaaataaagtgatccgtt

SEQ ID NO: 391470 - DNA, 25 bp, Homo sapien
aaagtgatccgtttgactaaataga

SEQ ID NO: 391471 - DNA, 25 bp, Homo sapien
gaaacaaaacatatagcagagactt

SEQ ID NO: 391472 - DNA, 25 bp, Homo sapien
tgaaggcaatcagtaaactgggaaa

SEQ ID NO: 391473 - DNA, 25 bp, Homo sapien
tccttttttgtaatggcagtttgtc

SEQ ID NO: 391474 - DNA, 25 bp, Homo sapien
aaatactttggacgtgacccagccg

SEQ ID NO: 391475 - DNA, 25 bp, Homo sapien
tggacgtgacccagccgatggaaga

SEQ ID NO: 391476 - DNA, 25 bp, Homo sapien
gaatgaggctttctcgaaaagtgct

SEQ ID NO: 391477 - DNA, 25 bp, Homo sapien
gaaaagtgcttcagtcgccagctac

SEQ ID NO: 391478 - DNA, 25 bp, Homo sapien
tcgccagctacaaccgtggtcagaa

SEQ ID NO: 391479 - DNA, 25 bp, Homo sapien
caaccgtggtcagaactttgaatga

SEQ ID NO: 391480 - DNA, 25 bp, Homo sapien
ttgtaatgggagaacctatttcaca

SEQ ID NO: 391481 - DNA, 25 bp, Homo sapien
ttcacagtcatcatctaattctcag

SEQ ID NO: 391482 - DNA, 25 bp, Homo sapien
attttgtctagggtgatgtgctgta

SEQ ID NO: 391483 - DNA, 25 bp, Homo sapien
gtgctgtagagcaacattttagtag

SEQ ID NO: 391484 - DNA, 25 bp, Homo sapien
ttttagtagtatcttccattgtgta

SEQ ID NO: 391485 - DNA, 25 bp, Homo sapien
tctctagcgcggactgagctctttc

SEQ ID NO: 391486 - DNA, 25 bp, Homo sapien
agctctttctctccgaagagcggta

SEQ ID NO: 391487 - DNA, 25 bp, Homo sapien
aagagcggtagcttggccggcccac

SEQ ID NO: 391488 - DNA, 25 bp, Homo sapien
ccggctctctcctggaaggttattt

SEQ ID NO: 391489 - DNA, 25 bp, Homo sapien
tcctggaaggttatttgtagcctct

SEQ ID NO: 391490 - DNA, 25 bp, Homo sapien
tgtagcctctttggcgtgttgggac

SEQ ID NO: 391491 - DNA, 25 bp, Homo sapien
aggaatgtagctgttcttcccacca

SEQ ID NO: 391492 - DNA, 25 bp, Homo sapien
gtagctgttcttcccaccacatggg

SEQ ID NO: 391493 - DNA, 25 bp, Homo sapien
taaagggacagctttgctttttggg

SEQ ID NO: 391494 - DNA, 25 bp, Homo sapien
aaacagagttttcatgtctcttatt

SEQ ID NO: 391495 - DNA, 25 bp, Homo sapien
gtctcttatttaaactacctgtggg

SEQ ID NO: 391496 - DNA, 25 bp, Homo sapien
gatgttctgatcaatatggcggaca

SEQ ID NO: 391497 - DNA, 25 bp, Homo sapien
tctgatcaatatggcggacactgtc

SEQ ID NO: 391498 - DNA, 25 bp, Homo sapien
tatggcggacactgtcattcataca

SEQ ID NO: 391499 - DNA, 25 bp, Homo sapien
gcggacactgtcattcatacaacta

SEQ ID NO: 391500 - DNA, 25 bp, Homo sapien
gtcattcatacaactacaggcgctc

SEQ ID NO: 391501 - DNA, 25 bp, Homo sapien
gacccagaaccaacgtagggagtgg

SEQ ID NO: 391502 - DNA, 25 bp, Homo sapien
tgtgtgcacgaattaaaaaacaggc

SEQ ID NO: 391503 - DNA, 25 bp, Homo sapien
cctggagagcaatgtggagtaagca

SEQ ID NO: 391504 - DNA, 25 bp, Homo sapien
gcaatgtggagtaagcaatgtaata

SEQ ID NO: 391505 - DNA, 25 bp, Homo sapien
aaaagtacgaatcccaatgccacag

SEQ ID NO: 391506 - DNA, 25 bp, Homo sapien
caatgccacagggacttacttcaaa

SEQ ID NO: 391507 - DNA, 25 bp, Homo sapien
gatactttcataattgtgtgttttg

SEQ ID NO: 391508 - DNA, 25 bp, Homo sapien
ttgtgtgttttgagggcaagtgact

SEQ ID NO: 391509 - DNA, 25 bp, Homo sapien
gggcaagtgacttatctgaactttt

SEQ ID NO: 391510 - DNA, 25 bp, Homo sapien
taacactggatgataattaaccctc

SEQ ID NO: 391511 - DNA, 25 bp, Homo sapien
ctggatgataattaaccctcaggat

SEQ ID NO: 391512 - DNA, 25 bp, Homo sapien
ttaaccctcaggattgtgaggattt

SEQ ID NO: 391513 - DNA, 25 bp, Homo sapien
gatttaataactaagtcctgactca

SEQ ID NO: 391514 - DNA, 25 bp, Homo sapien
aactaagtcctgactcaaattatgt

SEQ ID NO: 391515 - DNA, 25 bp, Homo sapien
tttttcccctcagtcctgtttagtg

SEQ ID NO: 391516 - DNA, 25 bp, Homo sapien
cttcacccacagagacaggtgttgt

SEQ ID NO: 391517 - DNA, 25 bp, Homo sapien
gtaacttatgaatctagactcttaa

SEQ ID NO: 391518 - DNA, 25 bp, Homo sapien
acgataatcgtatatttctactccg

SEQ ID NO: 391519 - DNA, 25 bp, Homo sapien
gtatatttctactccgattcgcctt

SEQ ID NO: 391520 - DNA, 25 bp, Homo sapien
cgattcgccttttctgggttgagaa

SEQ ID NO: 391521 - DNA, 25 bp, Homo sapien
ttcgccttttctgggttgagaagtt

SEQ ID NO: 391522 - DNA, 25 bp, Homo sapien
ggttgagaagttcccccgtgacatt

SEQ ID NO: 391523 - DNA, 25 bp, Homo sapien
tgacattttcttccgcacccggaga

SEQ ID NO: 391524 - DNA, 25 bp, Homo sapien
ttccgcacccggagagcagacattc

SEQ ID NO: 391525 - DNA, 25 bp, Homo sapien
agacattcgggagaagcggcctggg

SEQ ID NO: 391526 - DNA, 25 bp, Homo sapien
ggtaagatgggcgagctttccgtct

SEQ ID NO: 391527 - DNA, 25 bp, Homo sapien
agatgggcgagctttccgtctcccg

SEQ ID NO: 391528 - DNA, 25 bp, Homo sapien
tcccgccccacgataatcgtatatt

SEQ ID NO: 391529 - DNA, 25 bp, Homo sapien
ttattttttcgctttgtatctacaa

SEQ ID NO: 391530 - DNA, 25 bp, Homo sapien
aaatctcttcatggcaagttgggct

SEQ ID NO: 391531 - DNA, 25 bp, Homo sapien
gttgggctaatggactttgcactca

SEQ ID NO: 391532 - DNA, 25 bp, Homo sapien
gactttgcactcaagaaaggtttgt

SEQ ID NO: 391533 - DNA, 25 bp, Homo sapien
taccagttttgtagccatgtttggc

SEQ ID NO: 391534 - DNA, 25 bp, Homo sapien
catgtttggcaaatcttagcaacta

SEQ ID NO: 391535 - DNA, 25 bp, Homo sapien
ttatatgttcttgcagttactcttg

SEQ ID NO: 391536 - DNA, 25 bp, Homo sapien
attttctgactttaagctttgagac

SEQ ID NO: 391537 - DNA, 25 bp, Homo sapien
ttaagctttgagactactgcatctt

SEQ ID NO: 391538 - DNA, 25 bp, Homo sapien
gaagaactaggctgactggcaaaaa

SEQ ID NO: 391539 - DNA, 25 bp, Homo sapien
gcaaaaagtcttgccagtggccctg

SEQ ID NO: 391540 - DNA, 25 bp, Homo sapien
gtgtagcttgagtcacaggaccacc

SEQ ID NO: 391541 - DNA, 25 bp, Homo sapien
tgagtcacaggaccacccaatgcct

SEQ ID NO: 391542 - DNA, 25 bp, Homo sapien
aatgcctcatgccacgtagcaagac

SEQ ID NO: 391543 - DNA, 25 bp, Homo sapien
gcagaagcagagctagaactcatac

SEQ ID NO: 391544 - DNA, 25 bp, Homo sapien
gcttctgttcttgctgcctactgaa

SEQ ID NO: 391545 - DNA, 25 bp, Homo sapien
tactgaagtaccttcctcggctttc

SEQ ID NO: 391546 - DNA, 25 bp, Homo sapien
taaaaccccaccgtcactaatgaag

SEQ ID NO: 391547 - DNA, 25 bp, Homo sapien
gaggaatgttgctccacacgtcact

SEQ ID NO: 391548 - DNA, 25 bp, Homo sapien
tttctccaagttccagggttggcat

SEQ ID NO: 391549 - DNA, 25 bp, Homo sapien
agttccagggttggcatgcttgttg

SEQ ID NO: 391550 - DNA, 25 bp, Homo sapien
tgcttgttggcttgccaggtgtgta

SEQ ID NO: 391551 - DNA, 25 bp, Homo sapien
attactctttctcttagtcaccttg

SEQ ID NO: 391552 - DNA, 25 bp, Homo sapien
tactctttctcttagtcaccttgct

SEQ ID NO: 391553 - DNA, 25 bp, Homo sapien
tctttctcttagtcaccttgctcta

SEQ ID NO: 391554 - DNA, 25 bp, Homo sapien
tttctcttagtcaccttgctctatc

SEQ ID NO: 391555 - DNA, 25 bp, Homo sapien
tcttagtcaccttgctctatccata

SEQ ID NO: 391556 - DNA, 25 bp, Homo sapien
ttagtcaccttgctctatccatact

SEQ ID NO: 391557 - DNA, 25 bp, Homo sapien
agtcaccttgctctatccatactga

SEQ ID NO: 391558 - DNA, 25 bp, Homo sapien
accttgctctatccatactgaccat

SEQ ID NO: 391559 - DNA, 25 bp, Homo sapien
ctctcccatgaatgccccttagatg

SEQ ID NO: 391560 - DNA, 25 bp, Homo sapien
gccatcattttaagataactgaagt

SEQ ID NO: 391561 - DNA, 25 bp, Homo sapien
tattactctttctcttagtcacctt

SEQ ID NO: 391562 - DNA, 25 bp, Homo sapien
gttttgcaaacgttctaggagatgt

SEQ ID NO: 391563 - DNA, 25 bp, Homo sapien
gtaaccacatcttagtggcccaaga

SEQ ID NO: 391564 - DNA, 25 bp, Homo sapien
gattgtgtctctatagagcttcaaa

SEQ ID NO: 391565 - DNA, 25 bp, Homo sapien
gagcttcaaagcatacaggtcaatt

SEQ ID NO: 391566 - DNA, 25 bp, Homo sapien
ggtcaattaagaaagcccctctctc

SEQ ID NO: 391567 - DNA, 25 bp, Homo sapien
agagccgtttccctagcttttggca

SEQ ID NO: 391568 - DNA, 25 bp, Homo sapien
tagcttttggcacctggatgccaca

SEQ ID NO: 391569 - DNA, 25 bp, Homo sapien
atgccacagtcctccattaggctga

SEQ ID NO: 391570 - DNA, 25 bp, Homo sapien
attaggctgatgactccaaagatgt

SEQ ID NO: 391571 - DNA, 25 bp, Homo sapien
aagatgtaactctagcctcttgcct

SEQ ID NO: 391572 - DNA, 25 bp, Homo sapien
tcttgcctgagcttcagactcgcgt

SEQ ID NO: 391573 - DNA, 25 bp, Homo sapien
atccgcacggcgacgacgggcgctt

SEQ ID NO: 391574 - DNA, 25 bp, Homo sapien
cgacgacgggcgcttgaacattctg

SEQ ID NO: 391575 - DNA, 25 bp, Homo sapien
gacgacgggcgcttgaacattctgc

SEQ ID NO: 391576 - DNA, 25 bp, Homo sapien
acgggcgcttgaacattctgcctta

SEQ ID NO: 391577 - DNA, 25 bp, Homo sapien
gggcgcttgaacattctgccttatg

SEQ ID NO: 391578 - DNA, 25 bp, Homo sapien
gcgcttgaacattctgccttatgtc

SEQ ID NO: 391579 - DNA, 25 bp, Homo sapien
cttgaacattctgccttatgtctgc

SEQ ID NO: 391580 - DNA, 25 bp, Homo sapien
tgtcagccacaaagtgcattcccat

SEQ ID NO: 391581 - DNA, 25 bp, Homo sapien
ccatcttgcagaagccgggtgggcg

SEQ ID NO: 391582 - DNA, 25 bp, Homo sapien
acaaacatgcgaacgaggaccgcgt

SEQ ID NO: 391583 - DNA, 25 bp, Homo sapien
acatgcgaacgaggaccgcgtggac

SEQ ID NO: 391584 - DNA, 25 bp, Homo sapien
aagtttttgcaacacattgtgtctt

SEQ ID NO: 391585 - DNA, 25 bp, Homo sapien
ttgtgtctttatttggtctgcctat

SEQ ID NO: 391586 - DNA, 25 bp, Homo sapien
gtgtctttatttggtctgcctatgt

SEQ ID NO: 391587 - DNA, 25 bp, Homo sapien
gtctttatttggtctgcctatgttt

SEQ ID NO: 391588 - DNA, 25 bp, Homo sapien
tttatttggtctgcctatgttttta

SEQ ID NO: 391589 - DNA, 25 bp, Homo sapien
cctatgtttttatcacattgcttat

SEQ ID NO: 391590 - DNA, 25 bp, Homo sapien
tgtgtgtattaattagtgtgccttc

SEQ ID NO: 391591 - DNA, 25 bp, Homo sapien
attagtgtgccttctggacaaatta

SEQ ID NO: 391592 - DNA, 25 bp, Homo sapien
gtgtgccttctggacaaattaagaa

SEQ ID NO: 391593 - DNA, 25 bp, Homo sapien
tttttctatatttcaatgcggttgt

SEQ ID NO: 391594 - DNA, 25 bp, Homo sapien
ttcaatgcggttgtatttaataact

SEQ ID NO: 391595 - DNA, 25 bp, Homo sapien
aaggcccctctagccatgcagggtg

SEQ ID NO: 391596 - DNA, 25 bp, Homo sapien
tttcccaccatcactccgggagaca

SEQ ID NO: 391597 - DNA, 25 bp, Homo sapien
atttgtgaagggtgcaggaggtgtt

SEQ ID NO: 391598 - DNA, 25 bp, Homo sapien
tttaagggaatggagagtgcacttc

SEQ ID NO: 391599 - DNA, 25 bp, Homo sapien
taagggaatggagagtgcacttccc

SEQ ID NO: 391600 - DNA, 25 bp, Homo sapien
ggagaattcagggtcacggcatcat

SEQ ID NO: 391601 - DNA, 25 bp, Homo sapien
gagaattcagggtcacggcatcatg

SEQ ID NO: 391602 - DNA, 25 bp, Homo sapien
agaattcagggtcacggcatcatgg

SEQ ID NO: 391603 - DNA, 25 bp, Homo sapien
gaattcagggtcacggcatcatggg

SEQ ID NO: 391604 - DNA, 25 bp, Homo sapien
gtcacggcatcatggggacccacct

SEQ ID NO: 391605 - DNA, 25 bp, Homo sapien
atggggacccacctagcaggctctg

SEQ ID NO: 391606 - DNA, 25 bp, Homo sapien
atgagtcattgctcccagccattag

SEQ ID NO: 391607 - DNA, 25 bp, Homo sapien
gtcattgctcccagccattagaaag

SEQ ID NO: 391608 - DNA, 25 bp, Homo sapien
attgctcccagccattagaaagatt

SEQ ID NO: 391609 - DNA, 25 bp, Homo sapien
gctcccagccattagaaagattgtt

SEQ ID NO: 391610 - DNA, 25 bp, Homo sapien
tcccagccattagaaagattgttaa

SEQ ID NO: 391611 - DNA, 25 bp, Homo sapien
gattgttaatcctatgaactccctt

SEQ ID NO: 391612 - DNA, 25 bp, Homo sapien
gttaatcctatgaactcccttttgt

SEQ ID NO: 391613 - DNA, 25 bp, Homo sapien
taatcctatgaactcccttttgtag

SEQ ID NO: 391614 - DNA, 25 bp, Homo sapien
cctatgaactcccttttgtaggaga

SEQ ID NO: 391615 - DNA, 25 bp, Homo sapien
tgaactcccttttgtaggagagaaa

SEQ ID NO: 391616 - DNA, 25 bp, Homo sapien
aatctgtaggggtagccctgtccag

SEQ ID NO: 391617 - DNA, 25 bp, Homo sapien
tgaacaaaaatggtcgtctctatgt

SEQ ID NO: 391618 - DNA, 25 bp, Homo sapien
atggtcgtctctatgtttaaaacac

SEQ ID NO: 391619 - DNA, 25 bp, Homo sapien
tataccaaaactgcatactcactta

SEQ ID NO: 391620 - DNA, 25 bp, Homo sapien
aactgcatactcacttattcatgtg

SEQ ID NO: 391621 - DNA, 25 bp, Homo sapien
gaaaatcactgcttctttgtaaaat

SEQ ID NO: 391622 - DNA, 25 bp, Homo sapien
aaatattacgtaacatctaccatga

SEQ ID NO: 391623 - DNA, 25 bp, Homo sapien
aacatctaccatgatattctacaga

SEQ ID NO: 391624 - DNA, 25 bp, Homo sapien
cagaaatgctgtacttgaggttatc

SEQ ID NO: 391625 - DNA, 25 bp, Homo sapien
acttgaggttatctggtttgctgga

SEQ ID NO: 391626 - DNA, 25 bp, Homo sapien
caggagtttatgtagctgctttctc

SEQ ID NO: 391627 - DNA, 25 bp, Homo sapien
gtagctgctttctctgtagtttaaa

SEQ ID NO: 391628 - DNA, 25 bp, Homo sapien
atgggataacattgccggtggactt

SEQ ID NO: 391629 - DNA, 25 bp, Homo sapien
tgggataacattgccggtggacttc

SEQ ID NO: 391630 - DNA, 25 bp, Homo sapien
gggataacattgccggtggacttcc

SEQ ID NO: 391631 - DNA, 25 bp, Homo sapien
ataacattgccggtggacttccagg

SEQ ID NO: 391632 - DNA, 25 bp, Homo sapien
taacattgccggtggacttccaggg

SEQ ID NO: 391633 - DNA, 25 bp, Homo sapien
acattgccggtggacttccagggga

SEQ ID NO: 391634 - DNA, 25 bp, Homo sapien
aaatagctgaaaaggctctaaagaa

SEQ ID NO: 391635 - DNA, 25 bp, Homo sapien
aatagctgaaaaggctctaaagaaa

SEQ ID NO: 391636 - DNA, 25 bp, Homo sapien
gctgaaaaggctctaaagaaacaca

SEQ ID NO: 391637 - DNA, 25 bp, Homo sapien
ctgaaaaggctctaaagaaacacaa

SEQ ID NO: 391638 - DNA, 25 bp, Homo sapien
gaaaaggctctaaagaaacacaagg

SEQ ID NO: 391639 - DNA, 25 bp, Homo sapien
tgccatgttatggttctgccttgaa

SEQ ID NO: 391640 - DNA, 25 bp, Homo sapien
ggttctgccttgaaacagcacaatg

SEQ ID NO: 391641 - DNA, 25 bp, Homo sapien
tgttttgtgtcttctgttgcctgtc

SEQ ID NO: 391642 - DNA, 25 bp, Homo sapien
tgttgcctgtcctttgggccagatg

SEQ ID NO: 391643 - DNA, 25 bp, Homo sapien
tcctttgggccagatgtgggccagt

SEQ ID NO: 391644 - DNA, 25 bp, Homo sapien
gtgggccagttaaatgcagttatca

SEQ ID NO: 391645 - DNA, 25 bp, Homo sapien
taaaatatctttagtgctgcaacat

SEQ ID NO: 391646 - DNA, 25 bp, Homo sapien
gtgctgcaacattttacctaacttt

SEQ ID NO: 391647 - DNA, 25 bp, Homo sapien
ttcatgactgtgtgttattttccaa

SEQ ID NO: 391648 - DNA, 25 bp, Homo sapien
tattttccaaagctgttcctacctc

SEQ ID NO: 391649 - DNA, 25 bp, Homo sapien
gttcctacctcaccatgaggcttta

SEQ ID NO: 391650 - DNA, 25 bp, Homo sapien
ttctaaacacttcactgattcccac

SEQ ID NO: 391651 - DNA, 25 bp, Homo sapien
cacttcactgattcccacgtgagaa

SEQ ID NO: 391652 - DNA, 25 bp, Homo sapien
aatcgttttgtggagtcggcacagt

SEQ ID NO: 391653 - DNA, 25 bp, Homo sapien
gagtcggcacagttcaggttatgga

SEQ ID NO: 391654 - DNA, 25 bp, Homo sapien
aggttatggaggcacgtaattcacc

SEQ ID NO: 391655 - DNA, 25 bp, Homo sapien
gcaaaggaaaacacgctgcattgta

SEQ ID NO: 391656 - DNA, 25 bp, Homo sapien
aacacgctgcattgtagaataaggc

SEQ ID NO: 391657 - DNA, 25 bp, Homo sapien
gaataaggcattcaaatgtgctgtt

SEQ ID NO: 391658 - DNA, 25 bp, Homo sapien
gcattcaaatgtgctgttaacgttt

SEQ ID NO: 391659 - DNA, 25 bp, Homo sapien
aatgtgctgttaacgtttaaggcag

SEQ ID NO: 391660 - DNA, 25 bp, Homo sapien
tgttaacgtttaaggcagctaatgg

SEQ ID NO: 391661 - DNA, 25 bp, Homo sapien
taggtgcggccgaagtccatggacc

SEQ ID NO: 391662 - DNA, 25 bp, Homo sapien
ggccgaagtccatggaccgctccag

SEQ ID NO: 391663 - DNA, 25 bp, Homo sapien
agcacccagaggtccggccgggaca

SEQ ID NO: 391664 - DNA, 25 bp, Homo sapien
acaggaagggaagcccgcgctggag

SEQ ID NO: 391665 - DNA, 25 bp, Homo sapien
ctggaggactcccatctgtctctga

SEQ ID NO: 391666 - DNA, 25 bp, Homo sapien
atctgtctctgacctggtcgcggct

SEQ ID NO: 391667 - DNA, 25 bp, Homo sapien
gccatgacccggagcgagcgcagac

SEQ ID NO: 391668 - DNA, 25 bp, Homo sapien
cacggcggcagagactcacaggcaa

SEQ ID NO: 391669 - DNA, 25 bp, Homo sapien
ggcagagactcacaggcaaagaact

SEQ ID NO: 391670 - DNA, 25 bp, Homo sapien
gagactcacaggcaaagaactgcca

SEQ ID NO: 391671 - DNA, 25 bp, Homo sapien
caaagaactgccagggctggtaggt

SEQ ID NO: 391672 - DNA, 25 bp, Homo sapien
aaattccagcctcactttcactaag

SEQ ID NO: 391673 - DNA, 25 bp, Homo sapien
ctttcactaagtgtatgacccttaa

SEQ ID NO: 391674 - DNA, 25 bp, Homo sapien
gaactacatcgccttgtaagcctta

SEQ ID NO: 391675 - DNA, 25 bp, Homo sapien
catcgccttgtaagccttagtttcc

SEQ ID NO: 391676 - DNA, 25 bp, Homo sapien
gcatctatacgccaaagagttgttg

SEQ ID NO: 391677 - DNA, 25 bp, Homo sapien
gaacttagcatatcacctaacacat

SEQ ID NO: 391678 - DNA, 25 bp, Homo sapien
gtgagatatgtctttccagtttaag

SEQ ID NO: 391679 - DNA, 25 bp, Homo sapien
gtactttaacgttctagcattccaa

SEQ ID NO: 391680 - DNA, 25 bp, Homo sapien
aacgttctagcattccaataccgac

SEQ ID NO: 391681 - DNA, 25 bp, Homo sapien
tagcattccaataccgacgcatata

SEQ ID NO: 391682 - DNA, 25 bp, Homo sapien
ataccgacgcatataaacagagaag

SEQ ID NO: 391683 - DNA, 25 bp, Homo sapien
aactcaaactctgttacactagtaa

SEQ ID NO: 391684 - DNA, 25 bp, Homo sapien
gaaccactttggaaagagattggca

SEQ ID NO: 391685 - DNA, 25 bp, Homo sapien
agagattggcagtttctggaaaaaa

SEQ ID NO: 391686 - DNA, 25 bp, Homo sapien
gaccaagcaattttactacgtaagt

SEQ ID NO: 391687 - DNA, 25 bp, Homo sapien
taagaatgaaaacgtgtgcacacaa

SEQ ID NO: 391688 - DNA, 25 bp, Homo sapien
gtgtgcacacaaagatctgtactaa

SEQ ID NO: 391689 - DNA, 25 bp, Homo sapien
ttattcataacagcctaacagtgca

SEQ ID NO: 391690 - DNA, 25 bp, Homo sapien
agcctaacagtgcaaatgtctgtca

SEQ ID NO: 391691 - DNA, 25 bp, Homo sapien
aaatgtctgtcaactactgtgaatg

SEQ ID NO: 391692 - DNA, 25 bp, Homo sapien
gtctgtcaactactgtgaatggaga

SEQ ID NO: 391693 - DNA, 25 bp, Homo sapien
tacaataaaactacccagcaataaa

SEQ ID NO: 391694 - DNA, 25 bp, Homo sapien
aatcagagtaacctctttctccatc

SEQ ID NO: 391695 - DNA, 25 bp, Homo sapien
cttttccacactattcttgccaaat

SEQ ID NO: 391696 - DNA, 25 bp, Homo sapien
tattcttgccaaatatttctactga

SEQ ID NO: 391697 - DNA, 25 bp, Homo sapien
gccaaatatttctactgaaacccag

SEQ ID NO: 391698 - DNA, 25 bp, Homo sapien
gaaacccagtttcagcaaggcaaaa

SEQ ID NO: 391699 - DNA, 25 bp, Homo sapien
agcaaggcaaaatgatgggactctc

SEQ ID NO: 391700 - DNA, 25 bp, Homo sapien
aatgatgggactctcaaacctccct

SEQ ID NO: 391701 - DNA, 25 bp, Homo sapien
tctgtcttatgcctggcctggcctt

SEQ ID NO: 391702 - DNA, 25 bp, Homo sapien
gtatttcaagactgcagaatttcaa

SEQ ID NO: 391703 - DNA, 25 bp, Homo sapien
gactgcagaatttcaagtgtatatc

SEQ ID NO: 391704 - DNA, 25 bp, Homo sapien
tttttaaaatcttcggctacacagt

SEQ ID NO: 391705 - DNA, 25 bp, Homo sapien
gttgagtttctcactgtgcagttgg

SEQ ID NO: 391706 - DNA, 25 bp, Homo sapien
ctgtgcagttggaagagccctttgt

SEQ ID NO: 391707 - DNA, 25 bp, Homo sapien
agccctttgtgtttaaatgactcca

SEQ ID NO: 391708 - DNA, 25 bp, Homo sapien
atgactccaaagactgaactcactt

SEQ ID NO: 391709 - DNA, 25 bp, Homo sapien
actcactttagttgactttctcagg

SEQ ID NO: 391710 - DNA, 25 bp, Homo sapien
gactttctcaggaagctcatgggta

SEQ ID NO: 391711 - DNA, 25 bp, Homo sapien
gggaacagttcagcttattacttca

SEQ ID NO: 391712 - DNA, 25 bp, Homo sapien
cagcttattacttcataacccctga

SEQ ID NO: 391713 - DNA, 25 bp, Homo sapien
acactccagttaatgtgccctgaga

SEQ ID NO: 391714 - DNA, 25 bp, Homo sapien
tcataacccctgatactcttgctaa

SEQ ID NO: 391715 - DNA, 25 bp, Homo sapien
agctgagctctgtggacacttgaag

SEQ ID NO: 391716 - DNA, 25 bp, Homo sapien
ttcagaaccaggtgaaggctcggga

SEQ ID NO: 391717 - DNA, 25 bp, Homo sapien
tcagtgtgactactctggctggagc

SEQ ID NO: 391718 - DNA, 25 bp, Homo sapien
gacaaagtctctgaaactggaacat

SEQ ID NO: 391719 - DNA, 25 bp, Homo sapien
aactggaacattcctgatctctccc

SEQ ID NO: 391720 - DNA, 25 bp, Homo sapien
acagaggccagcagacctcttcctg

SEQ ID NO: 391721 - DNA, 25 bp, Homo sapien
ggacttctgtttaaaggaggacgag

SEQ ID NO: 391722 - DNA, 25 bp, Homo sapien
ggagcccacaaactggagcacagag

SEQ ID NO: 391723 - DNA, 25 bp, Homo sapien
gaacatgaagctatggaccatccac

SEQ ID NO: 391724 - DNA, 25 bp, Homo sapien
gaccatccacgagctgctgcaagat

SEQ ID NO: 391725 - DNA, 25 bp, Homo sapien
gctgcaagatagcaagccggacaag

SEQ ID NO: 391726 - DNA, 25 bp, Homo sapien
atagcaagccggacaaggatatgga

SEQ ID NO: 391727 - DNA, 25 bp, Homo sapien
aggactgcagccaaggtctggcgca

SEQ ID NO: 391728 - DNA, 25 bp, Homo sapien
ggactgcagccaaggtctggcgcac

SEQ ID NO: 391729 - DNA, 25 bp, Homo sapien
gactgcagccaaggtctggcgcacc

SEQ ID NO: 391730 - DNA, 25 bp, Homo sapien
ggcgaccaaggtatgggctctgttc

SEQ ID NO: 391731 - DNA, 25 bp, Homo sapien
gcgaccaaggtatgggctctgttcc

SEQ ID NO: 391732 - DNA, 25 bp, Homo sapien
cgaccaaggtatgggctctgttcct

SEQ ID NO: 391733 - DNA, 25 bp, Homo sapien
gaccaaggtatgggctctgttcctt

SEQ ID NO: 391734 - DNA, 25 bp, Homo sapien
accaaggtatgggctctgttccttt

SEQ ID NO: 391735 - DNA, 25 bp, Homo sapien
caaggtatgggctctgttccttttc

SEQ ID NO: 391736 - DNA, 25 bp, Homo sapien
aggtatgggctctgttccttttcca

SEQ ID NO: 391737 - DNA, 25 bp, Homo sapien
ggtatgggctctgttccttttccac

SEQ ID NO: 391738 - DNA, 25 bp, Homo sapien
tgatggtgaatttatcagattaacc

SEQ ID NO: 391739 - DNA, 25 bp, Homo sapien
ctttttgtggtgcagatggttctaa

SEQ ID NO: 391740 - DNA, 25 bp, Homo sapien
cagatggttctaagtatcaggtgac

SEQ ID NO: 391741 - DNA, 25 bp, Homo sapien
tatcaggtgacagggtattctactc

SEQ ID NO: 391742 - DNA, 25 bp, Homo sapien
gtgacagggtattctactctttcta

SEQ ID NO: 391743 - DNA, 25 bp, Homo sapien
agggtattctactctttctagtcaa

SEQ ID NO: 391744 - DNA, 25 bp, Homo sapien
gtattctactctttctagtcaatta

SEQ ID NO: 391745 - DNA, 25 bp, Homo sapien
gcatgattcataaactaaccagctg

SEQ ID NO: 391746 - DNA, 25 bp, Homo sapien
gcctccttttattttgaggaccctg

SEQ ID NO: 391747 - DNA, 25 bp, Homo sapien
attttgaggaccctgtagtcactat

SEQ ID NO: 391748 - DNA, 25 bp, Homo sapien
gaggaccctgtagtcactataataa

SEQ ID NO: 391749 - DNA, 25 bp, Homo sapien
agttgattgccgaatgaccacctac

SEQ ID NO: 391750 - DNA, 25 bp, Homo sapien
gacttaaaagatcaacctcagggag

SEQ ID NO: 391751 - DNA, 25 bp, Homo sapien
acctcagggaggattggagctttct

SEQ ID NO: 391752 - DNA, 25 bp, Homo sapien
acaggccgggttggactgaatcttt

SEQ ID NO: 391753 - DNA, 25 bp, Homo sapien
aatctttaagtggacatgagggaca

SEQ ID NO: 391754 - DNA, 25 bp, Homo sapien
gtacctcctgttggtaaacatctca

SEQ ID NO: 391755 - DNA, 25 bp, Homo sapien
gtggtggctaaaatcccacctttag

SEQ ID NO: 391756 - DNA, 25 bp, Homo sapien
gcaacatatgagcatgtcaccagga

SEQ ID NO: 391757 - DNA, 25 bp, Homo sapien
aggcctgtctgccacctgagtgtag

SEQ ID NO: 391758 - DNA, 25 bp, Homo sapien
tctgccacctgagtgtagacatctt

SEQ ID NO: 391759 - DNA, 25 bp, Homo sapien
tgtagacatcttttggccctggagc

SEQ ID NO: 391760 - DNA, 25 bp, Homo sapien
gaaaccaacatactttctttcattt

SEQ ID NO: 391761 - DNA, 25 bp, Homo sapien
gaaagtctcattcacacaatcaaca

SEQ ID NO: 391762 - DNA, 25 bp, Homo sapien
attcacacaatcaacaatgaggcta

SEQ ID NO: 391763 - DNA, 25 bp, Homo sapien
aatgaggctaagaggtagctaccat

SEQ ID NO: 391764 - DNA, 25 bp, Homo sapien
gaggtagctaccatgtggctaatga

SEQ ID NO: 391765 - DNA, 25 bp, Homo sapien
accatgtggctaatgaatgtgccta

SEQ ID NO: 391766 - DNA, 25 bp, Homo sapien
catgtatgagaaccatattttctgt

SEQ ID NO: 391767 - DNA, 25 bp, Homo sapien
gtttctattcaaaactgctgcttta

SEQ ID NO: 391768 - DNA, 25 bp, Homo sapien
ttcaaaactgctgctttatttgtac

SEQ ID NO: 391769 - DNA, 25 bp, Homo sapien
ataaggattatcctgggcataattc

SEQ ID NO: 391770 - DNA, 25 bp, Homo sapien
ttatcctgggcataattcatttgaa

SEQ ID NO: 391771 - DNA, 25 bp, Homo sapien
agtcaacaactaaaacagaggcatg

SEQ ID NO: 391772 - DNA, 25 bp, Homo sapien
gggtcaggctgagtatactctgcag

SEQ ID NO: 391773 - DNA, 25 bp, Homo sapien
gctgagtatactctgcagagctctg

SEQ ID NO: 391774 - DNA, 25 bp, Homo sapien
agagctctgcttcccacaaatgtca

SEQ ID NO: 391775 - DNA, 25 bp, Homo sapien
aaatgtcaggagaacaaaggccatg

SEQ ID NO: 391776 - DNA, 25 bp, Homo sapien
agccaagacaatattttgggttctt

SEQ ID NO: 391777 - DNA, 25 bp, Homo sapien
acagcattggttggtgacaaacctg

SEQ ID NO: 391778 - DNA, 25 bp, Homo sapien
ttggtgacaaacctgtggctggtct

SEQ ID NO: 391779 - DNA, 25 bp, Homo sapien
gttcttatcccaaaatacttagtca

SEQ ID NO: 391780 - DNA, 25 bp, Homo sapien
gtcatctaaaatcataaccctattg

SEQ ID NO: 391781 - DNA, 25 bp, Homo sapien
atcataaccctattgaaagctgcct

SEQ ID NO: 391782 - DNA, 25 bp, Homo sapien
gactttataacaacacacattacct

SEQ ID NO: 391783 - DNA, 25 bp, Homo sapien
aacacacattacctataggtgtcta

SEQ ID NO: 391784 - DNA, 25 bp, Homo sapien
gtgtgtacagacaagcttcatacgt

SEQ ID NO: 391785 - DNA, 25 bp, Homo sapien
agacaagcttcatacgtatatactg

SEQ ID NO: 391786 - DNA, 25 bp, Homo sapien
gtatatactgtaatccgttacaaca

SEQ ID NO: 391787 - DNA, 25 bp, Homo sapien
tcgtttaacatgtatgtggtacttc

SEQ ID NO: 391788 - DNA, 25 bp, Homo sapien
gtatgtggtacttctacagtgtaca

SEQ ID NO: 391789 - DNA, 25 bp, Homo sapien
ggtacttctacagtgtacattgttt

SEQ ID NO: 391790 - DNA, 25 bp, Homo sapien
aaacaaaagtatcccagcatcttca

SEQ ID NO: 391791 - DNA, 25 bp, Homo sapien
cttcatcctgtacacttggaattaa

SEQ ID NO: 391792 - DNA, 25 bp, Homo sapien
aattaatttcatttgggcatatcca

SEQ ID NO: 391793 - DNA, 25 bp, Homo sapien
gcctgattagcattccattatttat

SEQ ID NO: 391794 - DNA, 25 bp, Homo sapien
gaaatgctcagtgtttgctcaaatt

SEQ ID NO: 391795 - DNA, 25 bp, Homo sapien
ttgaagacatattctctgagcctta

SEQ ID NO: 391796 - DNA, 25 bp, Homo sapien
tctctgagccttaaaaatggctgct

SEQ ID NO: 391797 - DNA, 25 bp, Homo sapien
aatggctgctatcgacagtactgta

SEQ ID NO: 391798 - DNA, 25 bp, Homo sapien
cagtactgtaagatgcactgccagt

SEQ ID NO: 391799 - DNA, 25 bp, Homo sapien
cttttcatttcagtgtaggcagtaa

SEQ ID NO: 391800 - DNA, 25 bp, Homo sapien
cagtgtaggcagtaatgttttctaa

SEQ ID NO: 391801 - DNA, 25 bp, Homo sapien
aaaactgaagtgtcccattcagaac

SEQ ID NO: 391802 - DNA, 25 bp, Homo sapien
gtgtcccattcagaacactttggaa

SEQ ID NO: 391803 - DNA, 25 bp, Homo sapien
actttggaaaggttgtctgcattag

SEQ ID NO: 391804 - DNA, 25 bp, Homo sapien
aagaaccgggatgcaaggagctgcc

SEQ ID NO: 391805 - DNA, 25 bp, Homo sapien
aaccgggatgcaaggagctgcctgt

SEQ ID NO: 391806 - DNA, 25 bp, Homo sapien
aggagagggctcacttatcacttgt

SEQ ID NO: 391807 - DNA, 25 bp, Homo sapien
gagagggctcacttatcacttgtgc

SEQ ID NO: 391808 - DNA, 25 bp, Homo sapien
ggctcacttatcacttgtgccatag

SEQ ID NO: 391809 - DNA, 25 bp, Homo sapien
tatcacttgtgccatagcacctggt

SEQ ID NO: 391810 - DNA, 25 bp, Homo sapien
gtgccatagcacctggtctcaaaat

SEQ ID NO: 391811 - DNA, 25 bp, Homo sapien
tgccttgctccacaaggtccacttt

SEQ ID NO: 391812 - DNA, 25 bp, Homo sapien
aaggtccactttcctgggtcttgtg

SEQ ID NO: 391813 - DNA, 25 bp, Homo sapien
ccactttcctgggtcttgtgctgtg

SEQ ID NO: 391814 - DNA, 25 bp, Homo sapien
tgggtcttgtgctgtgcctttcctt

SEQ ID NO: 391815 - DNA, 25 bp, Homo sapien
aaggcctcaggctagtccggcaaag

SEQ ID NO: 391816 - DNA, 25 bp, Homo sapien
gtgagcctcagcctgatcgtggcac

SEQ ID NO: 391817 - DNA, 25 bp, Homo sapien
ccagggtgcagatcacactggagtg

SEQ ID NO: 391818 - DNA, 25 bp, Homo sapien
tcacactggagtgggctggaaaacc

SEQ ID NO: 391819 - DNA, 25 bp, Homo sapien
tcagcctgatcgtggcactgtaggg

SEQ ID NO: 391820 - DNA, 25 bp, Homo sapien
gaggtgcctgcaggcatcaggctcc

SEQ ID NO: 391821 - DNA, 25 bp, Homo sapien
atcaggctccagggctcacagatgg

SEQ ID NO: 391822 - DNA, 25 bp, Homo sapien
gcctcaatttccaacgacaaacagc

SEQ ID NO: 391823 - DNA, 25 bp, Homo sapien
atttccaacgacaaacagctcagcc

SEQ ID NO: 391824 - DNA, 25 bp, Homo sapien
aacagctcagccctgtctagacaag

SEQ ID NO: 391825 - DNA, 25 bp, Homo sapien
agccctgtctagacaaggcctcagg

SEQ ID NO: 391826 - DNA, 25 bp, Homo sapien
atgggccaagagtactgaggatgca

SEQ ID NO: 391827 - DNA, 25 bp, Homo sapien
gtgctcaaattactgtattgacctt

SEQ ID NO: 391828 - DNA, 25 bp, Homo sapien
gtattgaccttgtaatcccaagctg

SEQ ID NO: 391829 - DNA, 25 bp, Homo sapien
gatgtgctatagaaatgtgctgttg

SEQ ID NO: 391830 - DNA, 25 bp, Homo sapien
gaaaatggtagactaagcccctctc

SEQ ID NO: 391831 - DNA, 25 bp, Homo sapien
aagcccctctccaattatactgtgg

SEQ ID NO: 391832 - DNA, 25 bp, Homo sapien
ccaattatactgtggaatgagccgt

SEQ ID NO: 391833 - DNA, 25 bp, Homo sapien
gaatgagccgtataacatgttgtga

SEQ ID NO: 391834 - DNA, 25 bp, Homo sapien
ttgtgattattggtttctcccttct

SEQ ID NO: 391835 - DNA, 25 bp, Homo sapien
tggtttctcccttctggacctggag

SEQ ID NO: 391836 - DNA, 25 bp, Homo sapien
ggacctggagtgtcagttcttctaa

SEQ ID NO: 391837 - DNA, 25 bp, Homo sapien
tgactgtgctctccgagtccgagtc

SEQ ID NO: 391838 - DNA, 25 bp, Homo sapien
gagtccgagtcaacactttggcctt

SEQ ID NO: 391839 - DNA, 25 bp, Homo sapien
acactttggccttcaggttcgtaag

SEQ ID NO: 391840 - DNA, 25 bp, Homo sapien
tataactggatacctttatgctggg

SEQ ID NO: 391841 - DNA, 25 bp, Homo sapien
tttatgctgggaccggacactttcc

SEQ ID NO: 391842 - DNA, 25 bp, Homo sapien
tttcctgcctctgaaattctgtcat

SEQ ID NO: 391843 - DNA, 25 bp, Homo sapien
atgatcctctgtgcctcatagggct

SEQ ID NO: 391844 - DNA, 25 bp, Homo sapien
atagggctccatgtagccagcactc

SEQ ID NO: 391845 - DNA, 25 bp, Homo sapien
gctcttgagatcattcttggcatca

SEQ ID NO: 391846 - DNA, 25 bp, Homo sapien
agggatctgagtagtcatcggctat

SEQ ID NO: 391847 - DNA, 25 bp, Homo sapien
atcggctatggtcaccttgtccttc

SEQ ID NO: 391848 - DNA, 25 bp, Homo sapien
agacagctaggacatattttcttac

SEQ ID NO: 391849 - DNA, 25 bp, Homo sapien
tttcttacaagcttcttcacctatc

SEQ ID NO: 391850 - DNA, 25 bp, Homo sapien
agttttttagtgttcatctccctct

SEQ ID NO: 391851 - DNA, 25 bp, Homo sapien
gaaagcttattttatcccttacatt

SEQ ID NO: 391852 - DNA, 25 bp, Homo sapien
gaattagttttgtttagtcatccat

SEQ ID NO: 391853 - DNA, 25 bp, Homo sapien
agtcatccattttatctcaagcaga

SEQ ID NO: 391854 - DNA, 25 bp, Homo sapien
ttttatctcaagcagaggcatccct

SEQ ID NO: 391855 - DNA, 25 bp, Homo sapien
aggcatcccttccatgttcttcttg

SEQ ID NO: 391856 - DNA, 25 bp, Homo sapien
gctgattctagctgagagtccttat

SEQ ID NO: 391857 - DNA, 25 bp, Homo sapien
gtccttattggtaaactctccttgc

SEQ ID NO: 391858 - DNA, 25 bp, Homo sapien
gtaaactctccttgctgagatggaa

SEQ ID NO: 391859 - DNA, 25 bp, Homo sapien
cagaaagggcgctcaggcccaaatg

SEQ ID NO: 391860 - DNA, 25 bp, Homo sapien
gctgtgttcagggagccacaagtca

SEQ ID NO: 391861 - DNA, 25 bp, Homo sapien
gccacaagtcacctggtcttaggga

SEQ ID NO: 391862 - DNA, 25 bp, Homo sapien
agagttctgaggaccttgaggtaga

SEQ ID NO: 391863 - DNA, 25 bp, Homo sapien
ccttgaggtagattggcactgccag

SEQ ID NO: 391864 - DNA, 25 bp, Homo sapien
ttggcactgccaggcatgtaggctg

SEQ ID NO: 391865 - DNA, 25 bp, Homo sapien
atgtaggctggctttagctcactga

SEQ ID NO: 391866 - DNA, 25 bp, Homo sapien
ttagctcactgatacgccttgttca

SEQ ID NO: 391867 - DNA, 25 bp, Homo sapien
tgatacgccttgttcagcccagaga

SEQ ID NO: 391868 - DNA, 25 bp, Homo sapien
cttgttcagcccagagaggttttct

SEQ ID NO: 391869 - DNA, 25 bp, Homo sapien
gagctgttttggatgtttatcctca

SEQ ID NO: 391870 - DNA, 25 bp, Homo sapien
aacagcccctccatggttgggtggg

SEQ ID NO: 391871 - DNA, 25 bp, Homo sapien
tccggcaagaggtagcagccgctca

SEQ ID NO: 391872 - DNA, 25 bp, Homo sapien
tcaggtggctctgctggcatcggag

SEQ ID NO: 391873 - DNA, 25 bp, Homo sapien
gctggcatcggagcccacagaagtg

SEQ ID NO: 391874 - DNA, 25 bp, Homo sapien
cccacagaagtgaggagtggccgat

SEQ ID NO: 391875 - DNA, 25 bp, Homo sapien
aaatgtgcctgactctgggtcttgc

SEQ ID NO: 391876 - DNA, 25 bp, Homo sapien
actctgggtcttgctgtcactggat

SEQ ID NO: 391877 - DNA, 25 bp, Homo sapien
ctgggtcttgctgtcactggatttc

SEQ ID NO: 391878 - DNA, 25 bp, Homo sapien
ggatttcctggcatggcagacagaa

SEQ ID NO: 391879 - DNA, 25 bp, Homo sapien
agaaagatagtttgaccaagtcgta

SEQ ID NO: 391880 - DNA, 25 bp, Homo sapien
accaagtcgtagaagctgatccagc

SEQ ID NO: 391881 - DNA, 25 bp, Homo sapien
cggagccccttgtggatgccaccat

SEQ ID NO: 391882 - DNA, 25 bp, Homo sapien
gccaccatcatggtgtatgcaacca

SEQ ID NO: 391883 - DNA, 25 bp, Homo sapien
tggtgtatgcaaccatcacctccca

SEQ ID NO: 391884 - DNA, 25 bp, Homo sapien
tctccaaggtcttccaaggcatgct

SEQ ID NO: 391885 - DNA, 25 bp, Homo sapien
aaggtcttccaaggcatgctcatgg

SEQ ID NO: 391886 - DNA, 25 bp, Homo sapien
tcttccaaggcatgctcatggctga

SEQ ID NO: 391887 - DNA, 25 bp, Homo sapien
aaggcatgctcatggctgacccggc

SEQ ID NO: 391888 - DNA, 25 bp, Homo sapien
atgctcatggctgacccggccaagg

SEQ ID NO: 391889 - DNA, 25 bp, Homo sapien
gacccggccaaggtcgaggaccaag

SEQ ID NO: 391890 - DNA, 25 bp, Homo sapien
aggtcgaggaccaagtgcagctgct

SEQ ID NO: 391891 - DNA, 25 bp, Homo sapien
tgttccgggaccgactggtgaatga

SEQ ID NO: 391892 - DNA, 25 bp, Homo sapien
atatgtggacacatttagtcacaaa

SEQ ID NO: 391893 - DNA, 25 bp, Homo sapien
ggacacatttagtcacaaacaaatc

SEQ ID NO: 391894 - DNA, 25 bp, Homo sapien
aaactgtttattaattcctcgctgc

SEQ ID NO: 391895 - DNA, 25 bp, Homo sapien
ctgtttattaattcctcgctgcatg

SEQ ID NO: 391896 - DNA, 25 bp, Homo sapien
ttattaattcctcgctgcatgacag

SEQ ID NO: 391897 - DNA, 25 bp, Homo sapien
aattcctcgctgcatgacagaagtg

SEQ ID NO: 391898 - DNA, 25 bp, Homo sapien
ctcgctgcatgacagaagtggctta

SEQ ID NO: 391899 - DNA, 25 bp, Homo sapien
aagtggcttaatatactctttccag

SEQ ID NO: 391900 - DNA, 25 bp, Homo sapien
gcttaatatactctttccagaccaa

SEQ ID NO: 391901 - DNA, 25 bp, Homo sapien
taggttatctctaagttcatttaaa

SEQ ID NO: 391902 - DNA, 25 bp, Homo sapien
aaaggaatttgatgtgtgctgggca

SEQ ID NO: 391903 - DNA, 25 bp, Homo sapien
gtatatttgtaggtaactccagctg

SEQ ID NO: 391904 - DNA, 25 bp, Homo sapien
ggtaactccagctgttgcatttata

SEQ ID NO: 391905 - DNA, 25 bp, Homo sapien
gttgcatttatactgggaatcttca

SEQ ID NO: 391906 - DNA, 25 bp, Homo sapien
caaagtactgttttagctgtgcatg

SEQ ID NO: 391907 - DNA, 25 bp, Homo sapien
gttttagctgtgcatgtcatatcca

SEQ ID NO: 391908 - DNA, 25 bp, Homo sapien
gtgcatgtcatatccacaaagactt

SEQ ID NO: 391909 - DNA, 25 bp, Homo sapien
caaagacttttagcaggtgaactgt

SEQ ID NO: 391910 - DNA, 25 bp, Homo sapien
ggtgaactgttccaagactgacaca

SEQ ID NO: 391911 - DNA, 25 bp, Homo sapien
gactgacacaaggatgtttcaaact

SEQ ID NO: 391912 - DNA, 25 bp, Homo sapien
ggatgtttcaaacttgcctctgtct

SEQ ID NO: 391913 - DNA, 25 bp, Homo sapien
caaacttgcctctgtctgtagaaaa

SEQ ID NO: 391914 - DNA, 25 bp, Homo sapien
gaaaagagattttacacatttataa

SEQ ID NO: 391915 - DNA, 25 bp, Homo sapien
agaattctcaaactagtataaccct

SEQ ID NO: 391916 - DNA, 25 bp, Homo sapien
attctcaaactagtataaccctatt

SEQ ID NO: 391917 - DNA, 25 bp, Homo sapien
caaactagtataaccctatttctct

SEQ ID NO: 391918 - DNA, 25 bp, Homo sapien
actagtataaccctatttctctata

SEQ ID NO: 391919 - DNA, 25 bp, Homo sapien
acaaagacatcttgtaggcatgttc

SEQ ID NO: 391920 - DNA, 25 bp, Homo sapien
aaagacatcttgtaggcatgttcct

SEQ ID NO: 391921 - DNA, 25 bp, Homo sapien
tcttgtaggcatgttcctctgaagg

SEQ ID NO: 391922 - DNA, 25 bp, Homo sapien
ggcatgttcctctgaaggacttgag

SEQ ID NO: 391923 - DNA, 25 bp, Homo sapien
gcatgttcctctgaaggacttgaga

SEQ ID NO: 391924 - DNA, 25 bp, Homo sapien
atgttcctctgaaggacttgagaat

SEQ ID NO: 391925 - DNA, 25 bp, Homo sapien
ggatgacacctacccagattatcaa

SEQ ID NO: 391926 - DNA, 25 bp, Homo sapien
agattatcaaagatacctcctttaa

SEQ ID NO: 391927 - DNA, 25 bp, Homo sapien
tacctcctttaattagacttatctg

SEQ ID NO: 391928 - DNA, 25 bp, Homo sapien
gactatagatgcttacccaactaca

SEQ ID NO: 391929 - DNA, 25 bp, Homo sapien
tacagaatactttcacagcaacatt

SEQ ID NO: 391930 - DNA, 25 bp, Homo sapien
ttcacagcaacatttagattcatgt

SEQ ID NO: 391931 - DNA, 25 bp, Homo sapien
ggaaactgggtacgatagcctagcc

SEQ ID NO: 391932 - DNA, 25 bp, Homo sapien
gatagcctagccaaatttacacata

SEQ ID NO: 391933 - DNA, 25 bp, Homo sapien
taaaaccagtcatcacagtgctcca

SEQ ID NO: 391934 - DNA, 25 bp, Homo sapien
gtcatcacagtgctccagagagaga

SEQ ID NO: 391935 - DNA, 25 bp, Homo sapien
gaagctgaagctacagtccaaaggc

SEQ ID NO: 391936 - DNA, 25 bp, Homo sapien
aatacagaagtcgtttcctcaagtt

SEQ ID NO: 391937 - DNA, 25 bp, Homo sapien
gtcgtttcctcaagtttgactgttt

SEQ ID NO: 391938 - DNA, 25 bp, Homo sapien
aaattgtttaatgcttctgctgtaa

SEQ ID NO: 391939 - DNA, 25 bp, Homo sapien
gaggatgctactttactggagttga

SEQ ID NO: 391940 - DNA, 25 bp, Homo sapien
aggaagatgttaacacctgtaatcc

SEQ ID NO: 391941 - DNA, 25 bp, Homo sapien
tactttactggagttgagacacccc

SEQ ID NO: 391942 - DNA, 25 bp, Homo sapien
atggcaatttgctcaatattcagta

SEQ ID NO: 391943 - DNA, 25 bp, Homo sapien
ttctcaccctcagctattttgtggg

SEQ ID NO: 391944 - DNA, 25 bp, Homo sapien
tcagctattttgtgggcagtattca

SEQ ID NO: 391945 - DNA, 25 bp, Homo sapien
ggcagtattcaggaagagctacttc

SEQ ID NO: 391946 - DNA, 25 bp, Homo sapien
gctacttcaaacctttctttaaatg

SEQ ID NO: 391947 - DNA, 25 bp, Homo sapien
ttacacactaaaatggttgcagttt

SEQ ID NO: 391948 - DNA, 25 bp, Homo sapien
gttttatggcatatgtctccgattt

SEQ ID NO: 391949 - DNA, 25 bp, Homo sapien
atgtctccgatttagatggttattc

SEQ ID NO: 391950 - DNA, 25 bp, Homo sapien
aatgccctttttcttgataccactc

SEQ ID NO: 391951 - DNA, 25 bp, Homo sapien
tcttgataccactcatccacgtgtt

SEQ ID NO: 391952 - DNA, 25 bp, Homo sapien
tgttcctgattgtccacatttcatg

SEQ ID NO: 391953 - DNA, 25 bp, Homo sapien
ctgattgtccacatttcatgataaa

SEQ ID NO: 391954 - DNA, 25 bp, Homo sapien
gataaaatgagagctctgcagagaa

SEQ ID NO: 391955 - DNA, 25 bp, Homo sapien
gagaatgttagcctttctgttgtaa

SEQ ID NO: 391956 - DNA, 25 bp, Homo sapien
ctttctgttgtaaatgtaatcttca

SEQ ID NO: 391957 - DNA, 25 bp, Homo sapien
gtaatcttcaagtagtcactttttg

SEQ ID NO: 391958 - DNA, 25 bp, Homo sapien
aattgctcatgattgtaaaacatac

SEQ ID NO: 391959 - DNA, 25 bp, Homo sapien
ttgtaaaacatacttccggatggta

SEQ ID NO: 391960 - DNA, 25 bp, Homo sapien
catacttccggatggtaagggagat

SEQ ID NO: 391961 - DNA, 25 bp, Homo sapien
aagggagatgttaagatgatttgtc

SEQ ID NO: 391962 - DNA, 25 bp, Homo sapien
ttattgcctgtcataaaaagaggga

SEQ ID NO: 391963 - DNA, 25 bp, Homo sapien
ggttcataatcttaaatcagtccaa

SEQ ID NO: 391964 - DNA, 25 bp, Homo sapien
tatttctgtttaattcaatgcgtta

SEQ ID NO: 391965 - DNA, 25 bp, Homo sapien
aattcaatgcgttaatctttagcat

SEQ ID NO: 391966 - DNA, 25 bp, Homo sapien
tctttagcattggtcaatacagcca

SEQ ID NO: 391967 - DNA, 25 bp, Homo sapien
ggtcaatacagccaaaagatgagga

SEQ ID NO: 391968 - DNA, 25 bp, Homo sapien
gaaataactgcaaccataaatgtat

SEQ ID NO: 391969 - DNA, 25 bp, Homo sapien
ggaaaaccctgtcacagaaggaaag

SEQ ID NO: 391970 - DNA, 25 bp, Homo sapien
gaagtccttggtgactggcttgata

SEQ ID NO: 391971 - DNA, 25 bp, Homo sapien
tggcttgataccagagcctcttcta

SEQ ID NO: 391972 - DNA, 25 bp, Homo sapien
agcctcttctatgggccacaatcaa

SEQ ID NO: 391973 - DNA, 25 bp, Homo sapien
tcaagaggaatctcctttccttctg

SEQ ID NO: 391974 - DNA, 25 bp, Homo sapien
gaatctcctttccttctgtaacagg

SEQ ID NO: 391975 - DNA, 25 bp, Homo sapien
caggcaggcatttgggtggctccaa

SEQ ID NO: 391976 - DNA, 25 bp, Homo sapien
ttccctgggaactccagagaccttt

SEQ ID NO: 391977 - DNA, 25 bp, Homo sapien
agagacctttgctctgggccccgct

SEQ ID NO: 391978 - DNA, 25 bp, Homo sapien
aagttctcttgggactgagcccaaa

SEQ ID NO: 391979 - DNA, 25 bp, Homo sapien
ctgagcccaaataatctgaggtgag

SEQ ID NO: 391980 - DNA, 25 bp, Homo sapien
atatgtatttgtgttgcgtcttccc

SEQ ID NO: 391981 - DNA, 25 bp, Homo sapien
gcgtcttcccaataagtggtcttta

SEQ ID NO: 391982 - DNA, 25 bp, Homo sapien
agtggtctttattcaaacgttggag

SEQ ID NO: 391983 - DNA, 25 bp, Homo sapien
gttggagcttcagtaaacccctatt

SEQ ID NO: 391984 - DNA, 25 bp, Homo sapien
aaacccctatttggctgtgaacaga

SEQ ID NO: 391985 - DNA, 25 bp, Homo sapien
gtgaacagattagtctcaatcctag

SEQ ID NO: 391986 - DNA, 25 bp, Homo sapien
gagtgaaagtaacacctttctctta

SEQ ID NO: 391987 - DNA, 25 bp, Homo sapien
atctttctgatgttctccccatgga

SEQ ID NO: 391988 - DNA, 25 bp, Homo sapien
ccttttctagggtatatgctccatg

SEQ ID NO: 391989 - DNA, 25 bp, Homo sapien
gcagggactttgttgtacctccagg

SEQ ID NO: 391990 - DNA, 25 bp, Homo sapien
cagaactggcacactagagatggat

SEQ ID NO: 391991 - DNA, 25 bp, Homo sapien
tttgggctttgcttacagtatttcc

SEQ ID NO: 391992 - DNA, 25 bp, Homo sapien
agtatttccatgtgtagcctggcgt

SEQ ID NO: 391993 - DNA, 25 bp, Homo sapien
gtagcctggcgtgtgagaaagtatt

SEQ ID NO: 391994 - DNA, 25 bp, Homo sapien
atgccagtttcatggttcaggtgaa

SEQ ID NO: 391995 - DNA, 25 bp, Homo sapien
gtgaaagtctgtgatcattcccctc

SEQ ID NO: 391996 - DNA, 25 bp, Homo sapien
acttttgcccttcaaggagttgccg

SEQ ID NO: 391997 - DNA, 25 bp, Homo sapien
cagagctcccctgtgcttttctgga

SEQ ID NO: 391998 - DNA, 25 bp, Homo sapien
gtgtaactgcagaacatagacccag

SEQ ID NO: 391999 - DNA, 25 bp, Homo sapien
atagacccagttctaccaggcaagg

SEQ ID NO: 392000 - DNA, 25 bp, Homo sapien
caggcaaggccagtgttgggaacac

SEQ ID NO: 392001 - DNA, 25 bp, Homo sapien
tgggaacaccagacagggctgcttt

SEQ ID NO: 392002 - DNA, 25 bp, Homo sapien
agctcactggcacagcctcagattc

SEQ ID NO: 392003 - DNA, 25 bp, Homo sapien
cggctgcattttttaccattgggat

SEQ ID NO: 392004 - DNA, 25 bp, Homo sapien
gggataagttattagtaccattgaa

SEQ ID NO: 392005 - DNA, 25 bp, Homo sapien
agtaccattgaaaattaatacctgg

SEQ ID NO: 392006 - DNA, 25 bp, Homo sapien
tgttcttctcagcagttttaccatg

SEQ ID NO: 392007 - DNA, 25 bp, Homo sapien
gttttaccatgaggaatctgtctta

SEQ ID NO: 392008 - DNA, 25 bp, Homo sapien
accatgaggaatctgtcttaaacaa

SEQ ID NO: 392009 - DNA, 25 bp, Homo sapien
caatgtcagttgtcaatagcgttat

SEQ ID NO: 392010 - DNA, 25 bp, Homo sapien
aaaaggtggtcagacctggcagctt

SEQ ID NO: 392011 - DNA, 25 bp, Homo sapien
aaagggccctggctggttcaagtca

SEQ ID NO: 392012 - DNA, 25 bp, Homo sapien
ctggttcaagtcacagctctgtcct

SEQ ID NO: 392013 - DNA, 25 bp, Homo sapien
aatcaaggcctcagaatttcataca

SEQ ID NO: 392014 - DNA, 25 bp, Homo sapien
gaatttcatacaaacaccaagacca

SEQ ID NO: 392015 - DNA, 25 bp, Homo sapien
caccaagaccaaaatcctaagtatt

SEQ ID NO: 392016 - DNA, 25 bp, Homo sapien
tcctaagtattggtattgcgtctca

SEQ ID NO: 392017 - DNA, 25 bp, Homo sapien
ttgcgtctcaaatttttcccattaa

SEQ ID NO: 392018 - DNA, 25 bp, Homo sapien
aagcttaaacttacgtgccttacag

SEQ ID NO: 392019 - DNA, 25 bp, Homo sapien
cgtgccttacaggttattaaatgaa

SEQ ID NO: 392020 - DNA, 25 bp, Homo sapien
acttttaatagtagacacagctcct

SEQ ID NO: 392021 - DNA, 25 bp, Homo sapien
gtagacacagctcctatattgtttt

SEQ ID NO: 392022 - DNA, 25 bp, Homo sapien
gtctttcaacatgcatccaaaacag

SEQ ID NO: 392023 - DNA, 25 bp, Homo sapien
caaaacagtgttcaatttaacgtgg

SEQ ID NO: 392024 - DNA, 25 bp, Homo sapien
cagttcagcctttattaggtcaaag

SEQ ID NO: 392025 - DNA, 25 bp, Homo sapien
gtttagtaatgaatgccatcagcct

SEQ ID NO: 392026 - DNA, 25 bp, Homo sapien
atgccatcagcctttatgtcatcag

SEQ ID NO: 392027 - DNA, 25 bp, Homo sapien
caggattcaggatgtttaggtgtgt

SEQ ID NO: 392028 - DNA, 25 bp, Homo sapien
ttaggtgtgtgtttgctcagggctc

SEQ ID NO: 392029 - DNA, 25 bp, Homo sapien
ttgctcagggctcagaaatagtctt

SEQ ID NO: 392030 - DNA, 25 bp, Homo sapien
atagtcttggtggtgggtttacagc

SEQ ID NO: 392031 - DNA, 25 bp, Homo sapien
tggtggtgggtttacagctgcccat

SEQ ID NO: 392032 - DNA, 25 bp, Homo sapien
agctgcccatcttgttaggtgtgga

SEQ ID NO: 392033 - DNA, 25 bp, Homo sapien
atcttgttaggtgtggaacctgcct

SEQ ID NO: 392034 - DNA, 25 bp, Homo sapien
gtctatgatatactcttggctttcc

SEQ ID NO: 392035 - DNA, 25 bp, Homo sapien
ataaatccattcaggtgacaaccca

SEQ ID NO: 392036 - DNA, 25 bp, Homo sapien
aggtgacaacccatcatcaaaatta

SEQ ID NO: 392037 - DNA, 25 bp, Homo sapien
ttttctgattgaactcatctgaatc

SEQ ID NO: 392038 - DNA, 25 bp, Homo sapien
gaatcatcagttccttgatggagag

SEQ ID NO: 392039 - DNA, 25 bp, Homo sapien
aatgtgtctggtaaccccaaatgga

SEQ ID NO: 392040 - DNA, 25 bp, Homo sapien
tggagtacaagtagcctttgttttc

SEQ ID NO: 392041 - DNA, 25 bp, Homo sapien
aatggacttgttgaatgcgaacgaa

SEQ ID NO: 392042 - DNA, 25 bp, Homo sapien
tatgcaattcatatacttttggaga

SEQ ID NO: 392043 - DNA, 25 bp, Homo sapien
gaacgtagatatgtgtgtcagcttt

SEQ ID NO: 392044 - DNA, 25 bp, Homo sapien
agctttgagatggtgtgtcctggat

SEQ ID NO: 392045 - DNA, 25 bp, Homo sapien
gtgtgtcctggattaatactttgtc

SEQ ID NO: 392046 - DNA, 25 bp, Homo sapien
agcgcaaagaggacgccccagagga

SEQ ID NO: 392047 - DNA, 25 bp, Homo sapien
gacagagcagatggtctcgtcctcc

SEQ ID NO: 392048 - DNA, 25 bp, Homo sapien
agagcagatggtctcgtcctcctgg

SEQ ID NO: 392049 - DNA, 25 bp, Homo sapien
agatggtctcgtcctcctggatgat

SEQ ID NO: 392050 - DNA, 25 bp, Homo sapien
atggtctcgtcctcctggatgatga

SEQ ID NO: 392051 - DNA, 25 bp, Homo sapien
atgaaggcaaacgtcagcccaaaga

SEQ ID NO: 392052 - DNA, 25 bp, Homo sapien
aggcaaacgtcagcccaaagaggcc

SEQ ID NO: 392053 - DNA, 25 bp, Homo sapien
tctccttgatgaagggcagccgcac

SEQ ID NO: 392054 - DNA, 25 bp, Homo sapien
gcagccgcaccaggaggatgagcat

SEQ ID NO: 392055 - DNA, 25 bp, Homo sapien
catgcctggctcagcaggcaggaga

SEQ ID NO: 392056 - DNA, 25 bp, Homo sapien
gcaggcaggagaagcagagcgcaaa

SEQ ID NO: 392057 - DNA, 25 bp, Homo sapien
ttagataagacctggtttggctctc

SEQ ID NO: 392058 - DNA, 25 bp, Homo sapien
gtagctctgtacagggatatatcta

SEQ ID NO: 392059 - DNA, 25 bp, Homo sapien
gctctgtacagggatatatctatat

SEQ ID NO: 392060 - DNA, 25 bp, Homo sapien
atatatctatattagtcttcatctg

SEQ ID NO: 392061 - DNA, 25 bp, Homo sapien
tctcatattatgttcaagaaagtat

SEQ ID NO: 392062 - DNA, 25 bp, Homo sapien
agccccaggtgtatttctgagtgtc

SEQ ID NO: 392063 - DNA, 25 bp, Homo sapien
gccccaggtgtatttctgagtgtca

SEQ ID NO: 392064 - DNA, 25 bp, Homo sapien
ccaggtgtatttctgagtgtcaaca

SEQ ID NO: 392065 - DNA, 25 bp, Homo sapien
gtatttctgagtgtcaacagtgtta

SEQ ID NO: 392066 - DNA, 25 bp, Homo sapien
aacagtgttaatttcaagcatgcta

SEQ ID NO: 392067 - DNA, 25 bp, Homo sapien
agtgttaatttcaagcatgctaata

SEQ ID NO: 392068 - DNA, 25 bp, Homo sapien
caccgtgggacgtcttgtgcactgt

SEQ ID NO: 392069 - DNA, 25 bp, Homo sapien
aattcggaacgaggtctgcctccct

SEQ ID NO: 392070 - DNA, 25 bp, Homo sapien
tgttgagccgcatccgtggtctcca

SEQ ID NO: 392071 - DNA, 25 bp, Homo sapien
gaaatgactccacacattgccaaat

SEQ ID NO: 392072 - DNA, 25 bp, Homo sapien
aaagtcacccacttgggcgttatgt

SEQ ID NO: 392073 - DNA, 25 bp, Homo sapien
ggcgttatgttacccactgatgatc

SEQ ID NO: 392074 - DNA, 25 bp, Homo sapien
cactgatgatctgaatttttgtcca

SEQ ID NO: 392075 - DNA, 25 bp, Homo sapien
gtctcggcatctttgtctggcactg

SEQ ID NO: 392076 - DNA, 25 bp, Homo sapien
tgtctggcactgctgatggttttgc

SEQ ID NO: 392077 - DNA, 25 bp, Homo sapien
atggttttgcctaaacggctctttg

SEQ ID NO: 392078 - DNA, 25 bp, Homo sapien
ttgcctaaacggctctttgctgtgg

SEQ ID NO: 392079 - DNA, 25 bp, Homo sapien
cctccctgtggtaaaaagtattcat

SEQ ID NO: 392080 - DNA, 25 bp, Homo sapien
ggtaaaaagtattcattggcactac

SEQ ID NO: 392081 - DNA, 25 bp, Homo sapien
gtattcattggcactactaattaat

SEQ ID NO: 392082 - DNA, 25 bp, Homo sapien
cattggcactactaattaatctgtt

SEQ ID NO: 392083 - DNA, 25 bp, Homo sapien
ggcactactaattaatctgttagct

SEQ ID NO: 392084 - DNA, 25 bp, Homo sapien
gtgaaatacaattgtcagttccttt

SEQ ID NO: 392085 - DNA, 25 bp, Homo sapien
atacaattgtcagttccttttcatt

SEQ ID NO: 392086 - DNA, 25 bp, Homo sapien
tattagtagtatatacccctgagaa

SEQ ID NO: 392087 - DNA, 25 bp, Homo sapien
gtatatacccctgagaaagcactaa

SEQ ID NO: 392088 - DNA, 25 bp, Homo sapien
tacccctgagaaagcactaatttat

SEQ ID NO: 392089 - DNA, 25 bp, Homo sapien
gctgttactaccctttaacatgatt

SEQ ID NO: 392090 - DNA, 25 bp, Homo sapien
aataataacctcctctgtttgctgt

SEQ ID NO: 392091 - DNA, 25 bp, Homo sapien
aacctcctctgtttgctgtgggaat

SEQ ID NO: 392092 - DNA, 25 bp, Homo sapien
gaccaaaaacagcttttgattcctg

SEQ ID NO: 392093 - DNA, 25 bp, Homo sapien
aagtttcatatttggattagctctg

SEQ ID NO: 392094 - DNA, 25 bp, Homo sapien
attagctctgacatttatttatctg

SEQ ID NO: 392095 - DNA, 25 bp, Homo sapien
tgaacactggtaattgcctcagtaa

SEQ ID NO: 392096 - DNA, 25 bp, Homo sapien
tggtaattgcctcagtaaagacact

SEQ ID NO: 392097 - DNA, 25 bp, Homo sapien
tttgattcctgttctccaacctgtt

SEQ ID NO: 392098 - DNA, 25 bp, Homo sapien
caacctgttcctctcctagttttct

SEQ ID NO: 392099 - DNA, 25 bp, Homo sapien
ctcctagttttctccatctcagaaa

SEQ ID NO: 392100 - DNA, 25 bp, Homo sapien
tctgcaaagtctttccctgacttat

SEQ ID NO: 392101 - DNA, 25 bp, Homo sapien
cagcgcacccggcaacaataacatt

SEQ ID NO: 392102 - DNA, 25 bp, Homo sapien
catttaataggcatgtctcattcta

SEQ ID NO: 392103 - DNA, 25 bp, Homo sapien
aataggcatgtctcattctaatgat

SEQ ID NO: 392104 - DNA, 25 bp, Homo sapien
ggcatgtctcattctaatgatatat

SEQ ID NO: 392105 - DNA, 25 bp, Homo sapien
aatgatatataccttctacctagtg

SEQ ID NO: 392106 - DNA, 25 bp, Homo sapien
gatatataccttctacctagtgggc

SEQ ID NO: 392107 - DNA, 25 bp, Homo sapien
atataccttctacctagtgggcact

SEQ ID NO: 392108 - DNA, 25 bp, Homo sapien
ataccttctacctagtgggcacttg

SEQ ID NO: 392109 - DNA, 25 bp, Homo sapien
accttctacctagtgggcacttgta

SEQ ID NO: 392110 - DNA, 25 bp, Homo sapien
cttctacctagtgggcacttgtaca

SEQ ID NO: 392111 - DNA, 25 bp, Homo sapien
cctagtgggcacttgtacatattta

SEQ ID NO: 392112 - DNA, 25 bp, Homo sapien
atatgtaacatgcttgtcaatttaa

SEQ ID NO: 392113 - DNA, 25 bp, Homo sapien
gtaacatgcttgtcaatttaaaaac

SEQ ID NO: 392114 - DNA, 25 bp, Homo sapien
catgataagatgaacaccagtgaac

SEQ ID NO: 392115 - DNA, 25 bp, Homo sapien
accagtgaacacatcacctagagaa

SEQ ID NO: 392116 - DNA, 25 bp, Homo sapien
acacatcacctagagaatgaagcaa

SEQ ID NO: 392117 - DNA, 25 bp, Homo sapien
aaaaattctattgcagcttcccgtg

SEQ ID NO: 392118 - DNA, 25 bp, Homo sapien
aaaattctattgcagcttcccgtgt

SEQ ID NO: 392119 - DNA, 25 bp, Homo sapien
aattctattgcagcttcccgtgtgg

SEQ ID NO: 392120 - DNA, 25 bp, Homo sapien
ttctattgcagcttcccgtgtggcc

SEQ ID NO: 392121 - DNA, 25 bp, Homo sapien
agctctctattccatgccagggata

SEQ ID NO: 392122 - DNA, 25 bp, Homo sapien
ctctctattccatgccagggatatc

SEQ ID NO: 392123 - DNA, 25 bp, Homo sapien
agcaatgccagccaggctcaaatga

SEQ ID NO: 392124 - DNA, 25 bp, Homo sapien
ggctcaaatgactgcctgacccact

SEQ ID NO: 392125 - DNA, 25 bp, Homo sapien
actgggaccctggatcaagtgatgt

SEQ ID NO: 392126 - DNA, 25 bp, Homo sapien
ggaccctggatcaagtgatgtgcca

SEQ ID NO: 392127 - DNA, 25 bp, Homo sapien
gcctattgattctctagattacctc

SEQ ID NO: 392128 - DNA, 25 bp, Homo sapien
gattctctagattacctccttgaga

SEQ ID NO: 392129 - DNA, 25 bp, Homo sapien
gtgatttctcttgaaacatacacac

SEQ ID NO: 392130 - DNA, 25 bp, Homo sapien
atacacacaaccaaaggcctgactg

SEQ ID NO: 392131 - DNA, 25 bp, Homo sapien
aaaggcctgactgagactgtctgtc

SEQ ID NO: 392132 - DNA, 25 bp, Homo sapien
gactgtctgtcaggacaatctggaa

SEQ ID NO: 392133 - DNA, 25 bp, Homo sapien
ggacaatctggaatttagcaatgcc

SEQ ID NO: 392134 - DNA, 25 bp, Homo sapien
agttctgccaactttctaggaaata

SEQ ID NO: 392135 - DNA, 25 bp, Homo sapien
taggaaataaggtaatcccagtgct

SEQ ID NO: 392136 - DNA, 25 bp, Homo sapien
cagtgctttgggagtacaaatagag

SEQ ID NO: 392137 - DNA, 25 bp, Homo sapien
acaaatagagtcacttgagtccaag

SEQ ID NO: 392138 - DNA, 25 bp, Homo sapien
tgagtccaagagtaccagaccaggc

SEQ ID NO: 392139 - DNA, 25 bp, Homo sapien
agagtaccagaccaggcgggacaaa

SEQ ID NO: 392140 - DNA, 25 bp, Homo sapien
gcgggacaaaaaagcgagacctcat

SEQ ID NO: 392141 - DNA, 25 bp, Homo sapien
acaaaaaagcgagacctcatttcta

SEQ ID NO: 392142 - DNA, 25 bp, Homo sapien
acatgtggtggccatacgtgtattg

SEQ ID NO: 392143 - DNA, 25 bp, Homo sapien
ccatacgtgtattgtagtcccagct

SEQ ID NO: 392144 - DNA, 25 bp, Homo sapien
gttctaggaggcagtgggctattat

SEQ ID NO: 392145 - DNA, 25 bp, Homo sapien
gaacatatgttttgtgactccagtt

SEQ ID NO: 392146 - DNA, 25 bp, Homo sapien
gactccagttttcctttcagatttt

SEQ ID NO: 392147 - DNA, 25 bp, Homo sapien
ttttgttgaggtactgggacaggtt

SEQ ID NO: 392148 - DNA, 25 bp, Homo sapien
aatacagttgtagccctcaggatat

SEQ ID NO: 392149 - DNA, 25 bp, Homo sapien
tgtagccctcaggatatttaatatc

SEQ ID NO: 392150 - DNA, 25 bp, Homo sapien
gtgacagtcagtaaaccaacaatct

SEQ ID NO: 392151 - DNA, 25 bp, Homo sapien
agtcagtaaaccaacaatctcaata

SEQ ID NO: 392152 - DNA, 25 bp, Homo sapien
gaggttgtgataaccgattcttgtt

SEQ ID NO: 392153 - DNA, 25 bp, Homo sapien
gtgataaccgattcttgtttagttt

SEQ ID NO: 392154 - DNA, 25 bp, Homo sapien
gtttagtttaattctatatctccct

SEQ ID NO: 392155 - DNA, 25 bp, Homo sapien
aattctatatctcccttagaccagt

SEQ ID NO: 392156 - DNA, 25 bp, Homo sapien
gaaatttaggtactgcaggacgcaa

SEQ ID NO: 392157 - DNA, 25 bp, Homo sapien
aatgttgatgaggacaagaccttca

SEQ ID NO: 392158 - DNA, 25 bp, Homo sapien
tgcaggacgcaagggatcatgtctg

SEQ ID NO: 392159 - DNA, 25 bp, Homo sapien
aagctggtccagagatgggtactga

SEQ ID NO: 392160 - DNA, 25 bp, Homo sapien
ggcatccacatgaacccgcacaaag

SEQ ID NO: 392161 - DNA, 25 bp, Homo sapien
aacccgcacaaagttctgaatgatt

SEQ ID NO: 392162 - DNA, 25 bp, Homo sapien
tgaatgatttcctgcatgtcctcga

SEQ ID NO: 392163 - DNA, 25 bp, Homo sapien
acaagaccttcaacagtgtccgggt

SEQ ID NO: 392164 - DNA, 25 bp, Homo sapien
gcatgtcctcgaactgaaacagtgg

SEQ ID NO: 392165 - DNA, 25 bp, Homo sapien
aacagtggctggaagcaagatttat

SEQ ID NO: 392166 - DNA, 25 bp, Homo sapien
acaccaactccaattattgtagaga

SEQ ID NO: 392167 - DNA, 25 bp, Homo sapien
gaatgattagattatccccaagcaa

SEQ ID NO: 392168 - DNA, 25 bp, Homo sapien
gattatccccaagcaaatatcagat

SEQ ID NO: 392169 - DNA, 25 bp, Homo sapien
gaatgtactaagatttctgggtata

SEQ ID NO: 392170 - DNA, 25 bp, Homo sapien
tatagtatactttgtcctccttcac

SEQ ID NO: 392171 - DNA, 25 bp, Homo sapien
gcatcctcagaggtttggaaagttt

SEQ ID NO: 392172 - DNA, 25 bp, Homo sapien
gaatgtacactagtgagagcctgct

SEQ ID NO: 392173 - DNA, 25 bp, Homo sapien
taggatgcttgattagtcctttctg

SEQ ID NO: 392174 - DNA, 25 bp, Homo sapien
aacatttcccaataaagctgcatat

SEQ ID NO: 392175 - DNA, 25 bp, Homo sapien
gctgcatattcatctgtcctttaat

SEQ ID NO: 392176 - DNA, 25 bp, Homo sapien
agcctgctgcccacaagttgctcag

SEQ ID NO: 392177 - DNA, 25 bp, Homo sapien
tcctgagaacatgccctgacagaat

SEQ ID NO: 392178 - DNA, 25 bp, Homo sapien
agctatagacatgcctgagcctcta

SEQ ID NO: 392179 - DNA, 25 bp, Homo sapien
gagcctctatatgcccaggctagaa

SEQ ID NO: 392180 - DNA, 25 bp, Homo sapien
gaacaggaaggtcacattttctaaa

SEQ ID NO: 392181 - DNA, 25 bp, Homo sapien
aacttttgccactattaggatgcct

SEQ ID NO: 392182 - DNA, 25 bp, Homo sapien
gcctagtgatgcattcggaatgttg

SEQ ID NO: 392183 - DNA, 25 bp, Homo sapien
atagcataggaccatttactgtggc

SEQ ID NO: 392184 - DNA, 25 bp, Homo sapien
ttactgtggcccattcatctcagcc

SEQ ID NO: 392185 - DNA, 25 bp, Homo sapien
cagccattcttatccctgaatacag

SEQ ID NO: 392186 - DNA, 25 bp, Homo sapien
cataagtgggttacctcctaggcca

SEQ ID NO: 392187 - DNA, 25 bp, Homo sapien
cctcctaggccagtcatcagaataa

SEQ ID NO: 392188 - DNA, 25 bp, Homo sapien
agaataactgaccaggcttctgcct

SEQ ID NO: 392189 - DNA, 25 bp, Homo sapien
gtctgcgtagattagtggacttgga

SEQ ID NO: 392190 - DNA, 25 bp, Homo sapien
gtggacttggagaatatatttgtaa

SEQ ID NO: 392191 - DNA, 25 bp, Homo sapien
aaggccttaaactggacagagagtc

SEQ ID NO: 392192 - DNA, 25 bp, Homo sapien
atttgtaaaattggcatcacctcca

SEQ ID NO: 392193 - DNA, 25 bp, Homo sapien
gttcctaggaggagataagaatcta

SEQ ID NO: 392194 - DNA, 25 bp, Homo sapien
gataagaatctaaatggcccatggc

SEQ ID NO: 392195 - DNA, 25 bp, Homo sapien
ggcccatggcataaataataagttt

SEQ ID NO: 392196 - DNA, 25 bp, Homo sapien
aactggacagagagtctagtgcttc

SEQ ID NO: 392197 - DNA, 25 bp, Homo sapien
tattatatcatcaaactctgcatgt

SEQ ID NO: 392198 - DNA, 25 bp, Homo sapien
gagtctagtgcttccattattctgg

SEQ ID NO: 392199 - DNA, 25 bp, Homo sapien
tagtgcttccattattctggtaatt

SEQ ID NO: 392200 - DNA, 25 bp, Homo sapien
ttcccctccgggaaatgcataggtg

SEQ ID NO: 392201 - DNA, 25 bp, Homo sapien
aaatgcataggtggacacgcgagcg

SEQ ID NO: 392202 - DNA, 25 bp, Homo sapien
ggttgaaatctttagaaaacgcttg

SEQ ID NO: 392203 - DNA, 25 bp, Homo sapien
ttcatgttgaacttgcgcgcgcctc

SEQ ID NO: 392204 - DNA, 25 bp, Homo sapien
ggcccatccaccttgcggaaggagt

SEQ ID NO: 392205 - DNA, 25 bp, Homo sapien
tccaccttgcggaaggagtactcca

SEQ ID NO: 392206 - DNA, 25 bp, Homo sapien
gaaaacgcttgagaaactgcaaaaa

SEQ ID NO: 392207 - DNA, 25 bp, Homo sapien
actgcaaaaaagacgcatgctgatg

SEQ ID NO: 392208 - DNA, 25 bp, Homo sapien
aaaaagacgcatgctgatgaaaaac

SEQ ID NO: 392209 - DNA, 25 bp, Homo sapien
gaaaaacagtcctgcggttgggcgt

SEQ ID NO: 392210 - DNA, 25 bp, Homo sapien
agtcctgcggttgggcgtctacaaa

SEQ ID NO: 392211 - DNA, 25 bp, Homo sapien
acagttggctcgcaatatgggtcga

SEQ ID NO: 392212 - DNA, 25 bp, Homo sapien
cgcaatatgggtcgacgttttgtct

SEQ ID NO: 392213 - DNA, 25 bp, Homo sapien
acgttttgtctaaagtcttgctctt

SEQ ID NO: 392214 - DNA, 25 bp, Homo sapien
agtcttgctcttttatctacaggga

SEQ ID NO: 392215 - DNA, 25 bp, Homo sapien
cagcccttcctgttgattacaaagc

SEQ ID NO: 392216 - DNA, 25 bp, Homo sapien
tcctcagttccgtctaaatgtgttt

SEQ ID NO: 392217 - DNA, 25 bp, Homo sapien
ttctgcttcaattacaccagttctg

SEQ ID NO: 392218 - DNA, 25 bp, Homo sapien
gatgaaacaacacccatacctgaaa

SEQ ID NO: 392219 - DNA, 25 bp, Homo sapien
atgtgtgactttcaaatcccctttc

SEQ ID NO: 392220 - DNA, 25 bp, Homo sapien
tttcaaatcccctttcgcagtgaaa

SEQ ID NO: 392221 - DNA, 25 bp, Homo sapien
acagcaaacacttaagattcagcat

SEQ ID NO: 392222 - DNA, 25 bp, Homo sapien
gccagtgcccactgacaggtacagt

SEQ ID NO: 392223 - DNA, 25 bp, Homo sapien
gctgtggctgcattagagaagttca

SEQ ID NO: 392224 - DNA, 25 bp, Homo sapien
aatactgtgatgtccattctggttc

SEQ ID NO: 392225 - DNA, 25 bp, Homo sapien
tagagaagttcactctcaccagagt

SEQ ID NO: 392226 - DNA, 25 bp, Homo sapien
ctcaccagagtgtctccagcaagag

SEQ ID NO: 392227 - DNA, 25 bp, Homo sapien
gcatgaaaccccatgtgacccaggg

SEQ ID NO: 392228 - DNA, 25 bp, Homo sapien
gtgatgtccattctggttcttccag

SEQ ID NO: 392229 - DNA, 25 bp, Homo sapien
gggagaaggacctccacagaggccc

SEQ ID NO: 392230 - DNA, 25 bp, Homo sapien
gttcttccaggctaggcacatatct

SEQ ID NO: 392231 - DNA, 25 bp, Homo sapien
ctgtaatctcagacggtgccagtca

SEQ ID NO: 392232 - DNA, 25 bp, Homo sapien
gtgccagtcaggaacaccaagcttc

SEQ ID NO: 392233 - DNA, 25 bp, Homo sapien
gcttggaccccgattggctgcaatg

SEQ ID NO: 392234 - DNA, 25 bp, Homo sapien
gaccccgattggctgcaatgctgaa

SEQ ID NO: 392235 - DNA, 25 bp, Homo sapien
gctgcaatgctgaactttaatcttc

SEQ ID NO: 392236 - DNA, 25 bp, Homo sapien
actttaatcttcagcaactttgtgg

SEQ ID NO: 392237 - DNA, 25 bp, Homo sapien
ccccaagtgccgtgacctgaaagtt

SEQ ID NO: 392238 - DNA, 25 bp, Homo sapien
gtgccgtgacctgaaagttgaaaac

SEQ ID NO: 392239 - DNA, 25 bp, Homo sapien
cggttcgcgaaagccattgctgacg

SEQ ID NO: 392240 - DNA, 25 bp, Homo sapien
gaaagccattgctgacgaccagaga

SEQ ID NO: 392241 - DNA, 25 bp, Homo sapien
tgacgaccagagatcctacagtaag

SEQ ID NO: 392242 - DNA, 25 bp, Homo sapien
gatgcggaaggcagggatcaaatcc

SEQ ID NO: 392243 - DNA, 25 bp, Homo sapien
gggatcaaatccacaatagcaatag

SEQ ID NO: 392244 - DNA, 25 bp, Homo sapien
gaatgacctatgcaggaagcagtgt

SEQ ID NO: 392245 - DNA, 25 bp, Homo sapien
ggaagcagtgtaggttatgattaaa

SEQ ID NO: 392246 - DNA, 25 bp, Homo sapien
tatgattaaaagcttgaaccttggg

SEQ ID NO: 392247 - DNA, 25 bp, Homo sapien
gacagacacaggtttgaatcctagc

SEQ ID NO: 392248 - DNA, 25 bp, Homo sapien
gtttgaatcctagctctgtcacttt

SEQ ID NO: 392249 - DNA, 25 bp, Homo sapien
gtccaggccaggtgctgactcagtt

SEQ ID NO: 392250 - DNA, 25 bp, Homo sapien
aatcctagctctgtcacttttttgt

SEQ ID NO: 392251 - DNA, 25 bp, Homo sapien
gctctgtcacttttttgttgtggcc

SEQ ID NO: 392252 - DNA, 25 bp, Homo sapien
tcacttttttgttgtggccttccag

SEQ ID NO: 392253 - DNA, 25 bp, Homo sapien
ggccttccaggcaggatacttaacc

SEQ ID NO: 392254 - DNA, 25 bp, Homo sapien
tccaggcaggatacttaacctccct

SEQ ID NO: 392255 - DNA, 25 bp, Homo sapien
ctataataaaatccacagaaagctg

SEQ ID NO: 392256 - DNA, 25 bp, Homo sapien
gaaagctgttaaaatctttcctatt

SEQ ID NO: 392257 - DNA, 25 bp, Homo sapien
gactcaactttccattccctgaaat

SEQ ID NO: 392258 - DNA, 25 bp, Homo sapien
caactttccattccctgaaatcact

SEQ ID NO: 392259 - DNA, 25 bp, Homo sapien
gaaatcactcacaagctgagtttgt

SEQ ID NO: 392260 - DNA, 25 bp, Homo sapien
aagctgagtttgttaataggctctc

SEQ ID NO: 392261 - DNA, 25 bp, Homo sapien
gagtttgttaataggctctcaatat

SEQ ID NO: 392262 - DNA, 25 bp, Homo sapien
gtatatgttttactgtactagactt

SEQ ID NO: 392263 - DNA, 25 bp, Homo sapien
tatgttttactgtactagacttagt

SEQ ID NO: 392264 - DNA, 25 bp, Homo sapien
agacgtataacatagttgaacaact

SEQ ID NO: 392265 - DNA, 25 bp, Homo sapien
acaactttaagttgctctaagaagt

SEQ ID NO: 392266 - DNA, 25 bp, Homo sapien
gtagctctaggtcagtgtaatgaac

SEQ ID NO: 392267 - DNA, 25 bp, Homo sapien
aatgaactactagaggccaatccta

SEQ ID NO: 392268 - DNA, 25 bp, Homo sapien
gaggccaatcctaaggccgaaggat

SEQ ID NO: 392269 - DNA, 25 bp, Homo sapien
aaggccgaaggattgcttcaaggta

SEQ ID NO: 392270 - DNA, 25 bp, Homo sapien
tgggcaagatggctcccagttctgc

SEQ ID NO: 392271 - DNA, 25 bp, Homo sapien
ggagtacagtgccattaggaccagc

SEQ ID NO: 392272 - DNA, 25 bp, Homo sapien
gtgacacaggaattctgaatccaga

SEQ ID NO: 392273 - DNA, 25 bp, Homo sapien
gatggttataccctcaactacaatg

SEQ ID NO: 392274 - DNA, 25 bp, Homo sapien
tgtatataaccccaaccaggtccgt

SEQ ID NO: 392275 - DNA, 25 bp, Homo sapien
caaccaggtccgtatgcggtacctt

SEQ ID NO: 392276 - DNA, 25 bp, Homo sapien
gtttaatttccttcagctgtggtga

SEQ ID NO: 392277 - DNA, 25 bp, Homo sapien
agcaagcagggattcccaaggagga

SEQ ID NO: 392278 - DNA, 25 bp, Homo sapien
tggccttccaaactagccgttacaa

SEQ ID NO: 392279 - DNA, 25 bp, Homo sapien
actagccgttacaaactccattact

SEQ ID NO: 392280 - DNA, 25 bp, Homo sapien
acaaactccattactacgagacgcc

SEQ ID NO: 392281 - DNA, 25 bp, Homo sapien
atgaatactgacttgggcgtgggac

SEQ ID NO: 392282 - DNA, 25 bp, Homo sapien
tgggacccatccgagatgtgctgca

SEQ ID NO: 392283 - DNA, 25 bp, Homo sapien
atgtgctgcaccacatctacagtgc

SEQ ID NO: 392284 - DNA, 25 bp, Homo sapien
tctacagtgcgctgtatgtggagct

SEQ ID NO: 392285 - DNA, 25 bp, Homo sapien
tggtggtgaagaatcccctgtgccc

SEQ ID NO: 392286 - DNA, 25 bp, Homo sapien
aactgtgcaaagtgagctctttcgc

SEQ ID NO: 392287 - DNA, 25 bp, Homo sapien
gcaaagtgagctctttcgctcccga

SEQ ID NO: 392288 - DNA, 25 bp, Homo sapien
tagtggccaagaacgcacgcgcaga

SEQ ID NO: 392289 - DNA, 25 bp, Homo sapien
agaacgcacgcgcagaaatcgacta

SEQ ID NO: 392290 - DNA, 25 bp, Homo sapien
acgcacgcgcagaaatcgactacag

SEQ ID NO: 392291 - DNA, 25 bp, Homo sapien
agaaatcgactacagcgacgctcct

SEQ ID NO: 392292 - DNA, 25 bp, Homo sapien
tacagcgacgctcctgatgagttca

SEQ ID NO: 392293 - DNA, 25 bp, Homo sapien
gcgacgctcctgatgagttcagaga

SEQ ID NO: 392294 - DNA, 25 bp, Homo sapien
tcctgatgagttcagagaccctctg

SEQ ID NO: 392295 - DNA, 25 bp, Homo sapien
tgagttcagagaccctctgatggac

SEQ ID NO: 392296 - DNA, 25 bp, Homo sapien
tggaccgctccatcatcctgcggca

SEQ ID NO: 392297 - DNA, 25 bp, Homo sapien
acagaacagcgatcactaaaccgtt

SEQ ID NO: 392298 - DNA, 25 bp, Homo sapien
aacagcgatcactaaaccgttccgc

SEQ ID NO: 392299 - DNA, 25 bp, Homo sapien
gaatttctcagttgaaggatgctta

SEQ ID NO: 392300 - DNA, 25 bp, Homo sapien
gttgaaggatgcttacactcttgtc

SEQ ID NO: 392301 - DNA, 25 bp, Homo sapien
ttgtccatctagacctcaattactg

SEQ ID NO: 392302 - DNA, 25 bp, Homo sapien
gtttttcaggaatgtctgatcacag

SEQ ID NO: 392303 - DNA, 25 bp, Homo sapien
tactttccagagcacaacaggacac

SEQ ID NO: 392304 - DNA, 25 bp, Homo sapien
aacaggacactgtgtacacatgcgg

SEQ ID NO: 392305 - DNA, 25 bp, Homo sapien
gggattaccttacagagctactgag

SEQ ID NO: 392306 - DNA, 25 bp, Homo sapien
gagatgaactcacaagtcaatattt

SEQ ID NO: 392307 - DNA, 25 bp, Homo sapien
cagtatggcagtaagtcagccttat

SEQ ID NO: 392308 - DNA, 25 bp, Homo sapien
ggcagtaagtcagccttattctata

SEQ ID NO: 392309 - DNA, 25 bp, Homo sapien
gccttattctataaatgtgagcact

SEQ ID NO: 392310 - DNA, 25 bp, Homo sapien
actttggttgttagacagttcatgc

SEQ ID NO: 392311 - DNA, 25 bp, Homo sapien
gacagttcatgcacaaagccaaaat

SEQ ID NO: 392312 - DNA, 25 bp, Homo sapien
gcacaaagccaaaatttgtccttta

SEQ ID NO: 392313 - DNA, 25 bp, Homo sapien
ttgtcctttatgtatcttctttcca

SEQ ID NO: 392314 - DNA, 25 bp, Homo sapien
cttctttccatagtgcttactggag

SEQ ID NO: 392315 - DNA, 25 bp, Homo sapien
gccttccaaaataatgtctcctcaa

SEQ ID NO: 392316 - DNA, 25 bp, Homo sapien
gtgacagcccctcaggaatttgaag

SEQ ID NO: 392317 - DNA, 25 bp, Homo sapien
agcccctcaggaatttgaaggcaat

SEQ ID NO: 392318 - DNA, 25 bp, Homo sapien
ggtttattaacgtcagtctttacag

SEQ ID NO: 392319 - DNA, 25 bp, Homo sapien
gtcagtctttacagtcagtgctcat

SEQ ID NO: 392320 - DNA, 25 bp, Homo sapien
agtctttacagtcagtgctcattga

SEQ ID NO: 392321 - DNA, 25 bp, Homo sapien
ttgttgtcgttgcttgtttgaagaa

SEQ ID NO: 392322 - DNA, 25 bp, Homo sapien
gaaaatcatgacattccaagttgac

SEQ ID NO: 392323 - DNA, 25 bp, Homo sapien
atgacattccaagttgacatttttt

SEQ ID NO: 392324 - DNA, 25 bp, Homo sapien
gaaattctgaacaccgtcagcaccc

SEQ ID NO: 392325 - DNA, 25 bp, Homo sapien
ctcttccctatcatgggtcatctga

SEQ ID NO: 392326 - DNA, 25 bp, Homo sapien
atgggtcatctgacccctgtccgtc

SEQ ID NO: 392327 - DNA, 25 bp, Homo sapien
tccttgtccctgcttcatgtttggg

SEQ ID NO: 392328 - DNA, 25 bp, Homo sapien
gcctttctttaactgccttcctggc

SEQ ID NO: 392329 - DNA, 25 bp, Homo sapien
tgccttcctggcttagctcagatgg

SEQ ID NO: 392330 - DNA, 25 bp, Homo sapien
ctggcttagctcagatggcagatga

SEQ ID NO: 392331 - DNA, 25 bp, Homo sapien
cagatgagagtgtagtcaagggcct

SEQ ID NO: 392332 - DNA, 25 bp, Homo sapien
caagagcagattaagcagaggacta

SEQ ID NO: 392333 - DNA, 25 bp, Homo sapien
gcagaggactaagttggagcttaaa

SEQ ID NO: 392334 - DNA, 25 bp, Homo sapien
ggagcttaaagccaaggatttacaa

SEQ ID NO: 392335 - DNA, 25 bp, Homo sapien
aaagccaaggatttacaagatgaac

SEQ ID NO: 392336 - DNA, 25 bp, Homo sapien
ttacaagatgaactagcaggcaata

SEQ ID NO: 392337 - DNA, 25 bp, Homo sapien
tagcaggcaatagtgaacaaaggaa

SEQ ID NO: 392338 - DNA, 25 bp, Homo sapien
ttattaaaagagaggcagaagctgc

SEQ ID NO: 392339 - DNA, 25 bp, Homo sapien
acagaacccaaattcaacagtgtga

SEQ ID NO: 392340 - DNA, 25 bp, Homo sapien
aaatggaggatatcgaacgccaagt

SEQ ID NO: 392341 - DNA, 25 bp, Homo sapien
ggaggatatcgaacgccaagttaga

SEQ ID NO: 392342 - DNA, 25 bp, Homo sapien
tatcgaacgccaagttagagaattg

SEQ ID NO: 392343 - DNA, 25 bp, Homo sapien
gggaagaatcttagtatctctaaga

SEQ ID NO: 392344 - DNA, 25 bp, Homo sapien
gaggagatactttctggtagttagt

SEQ ID NO: 392345 - DNA, 25 bp, Homo sapien
actttctggtagttagtgactccct

SEQ ID NO: 392346 - DNA, 25 bp, Homo sapien
ggtagttagtgactccctgatgact

SEQ ID NO: 392347 - DNA, 25 bp, Homo sapien
ttagtgactccctgatgactggtat

SEQ ID NO: 392348 - DNA, 25 bp, Homo sapien
gactccctgatgactggtatagacc

SEQ ID NO: 392349 - DNA, 25 bp, Homo sapien
gatgactggtatagacccataactg

SEQ ID NO: 392350 - DNA, 25 bp, Homo sapien
tagacccataactgagcacctgata

SEQ ID NO: 392351 - DNA, 25 bp, Homo sapien
aactgagcacctgataatatatccc

SEQ ID NO: 392352 - DNA, 25 bp, Homo sapien
ctgataatatatcccataccactga

SEQ ID NO: 392353 - DNA, 25 bp, Homo sapien
gccccttacgctacttttgagaaga

SEQ ID NO: 392354 - DNA, 25 bp, Homo sapien
taccggctggtgcagtagctaccgc

SEQ ID NO: 392355 - DNA, 25 bp, Homo sapien
ggctggtgcagtagctaccgcctga

SEQ ID NO: 392356 - DNA, 25 bp, Homo sapien
tggtgcagtagctaccgcctgacag

SEQ ID NO: 392357 - DNA, 25 bp, Homo sapien
ggtgcagtagctaccgcctgacagc

SEQ ID NO: 392358 - DNA, 25 bp, Homo sapien
gtgcagtagctaccgcctgacagcc

SEQ ID NO: 392359 - DNA, 25 bp, Homo sapien
gcctgacagcccctagaggcggaca

SEQ ID NO: 392360 - DNA, 25 bp, Homo sapien
ctgacagcccctagaggcggacaca

SEQ ID NO: 392361 - DNA, 25 bp, Homo sapien
gacagcccctagaggcggacacaca

SEQ ID NO: 392362 - DNA, 25 bp, Homo sapien
ctagaggcggacacacagcgacccc

SEQ ID NO: 392363 - DNA, 25 bp, Homo sapien
ctgcaggacaaacgcccctgccctg

SEQ ID NO: 392364 - DNA, 25 bp, Homo sapien
tctcacggctgctgctcctctggac

SEQ ID NO: 392365 - DNA, 25 bp, Homo sapien
ctctactttccagagcacaacagga

SEQ ID NO: 392366 - DNA, 25 bp, Homo sapien
tctactttccagagcacaacaggac

SEQ ID NO: 392367 - DNA, 25 bp, Homo sapien
ctactttccagagcacaacaggaca

SEQ ID NO: 392368 - DNA, 25 bp, Homo sapien
tactttccagagcacaacaggacac

SEQ ID NO: 392369 - DNA, 25 bp, Homo sapien
actttccagagcacaacaggacact

SEQ ID NO: 392370 - DNA, 25 bp, Homo sapien
ctttccagagcacaacaggacactg

SEQ ID NO: 392371 - DNA, 25 bp, Homo sapien
acaacaggacactgtgtacacatgc

SEQ ID NO: 392372 - DNA, 25 bp, Homo sapien
aacaggacactgtgtacacatgcgg

SEQ ID NO: 392373 - DNA, 25 bp, Homo sapien
gacactgtgtacacatgcggggatt

SEQ ID NO: 392374 - DNA, 25 bp, Homo sapien
atgcggggattaccttacagagcta

SEQ ID NO: 392375 - DNA, 25 bp, Homo sapien
cggggattaccttacagagctactg

SEQ ID NO: 392376 - DNA, 25 bp, Homo sapien
atgagcggccggttgatgccgttca

SEQ ID NO: 392377 - DNA, 25 bp, Homo sapien
gttgatgccgttcatcttgtggtag

SEQ ID NO: 392378 - DNA, 25 bp, Homo sapien
atcttgtggtagaggccgcaggcgt

SEQ ID NO: 392379 - DNA, 25 bp, Homo sapien
attgcggcgccacagcgtggtggtg

SEQ ID NO: 392380 - DNA, 25 bp, Homo sapien
gcacagatagtgacccgtcccatct

SEQ ID NO: 392381 - DNA, 25 bp, Homo sapien
tggacatagccccacagttgacaca

SEQ ID NO: 392382 - DNA, 25 bp, Homo sapien
actctctgccttctgagaagtcgtc

SEQ ID NO: 392383 - DNA, 25 bp, Homo sapien
gccttctgagaagtcgtcaaacata

SEQ ID NO: 392384 - DNA, 25 bp, Homo sapien
gcagttggcacaggagaggcccact

SEQ ID NO: 392385 - DNA, 25 bp, Homo sapien
ttggcacaggagaggcccactcggc

SEQ ID NO: 392386 - DNA, 25 bp, Homo sapien
acagccggcgctgaggcttgatgag

SEQ ID NO: 392387 - DNA, 25 bp, Homo sapien
aatctagaaacttcagggaatccag

SEQ ID NO: 392388 - DNA, 25 bp, Homo sapien
gagcagatggtctgaatagtcacca

SEQ ID NO: 392389 - DNA, 25 bp, Homo sapien
tagtcaccattcacattttgctttg

SEQ ID NO: 392390 - DNA, 25 bp, Homo sapien
ttgctttgttttggtaactattact

SEQ ID NO: 392391 - DNA, 25 bp, Homo sapien
ggtaactattactatcacttaatta

SEQ ID NO: 392392 - DNA, 25 bp, Homo sapien
ttcttattttcagtgctaaccctaa

SEQ ID NO: 392393 - DNA, 25 bp, Homo sapien
aactctacctcctggttggaactca

SEQ ID NO: 392394 - DNA, 25 bp, Homo sapien
ttttcagtgctaaccctaaaatggt

SEQ ID NO: 392395 - DNA, 25 bp, Homo sapien
aatggtaaaactcttgcaggttgaa

SEQ ID NO: 392396 - DNA, 25 bp, Homo sapien
tacctcctggttggaactcatattg

SEQ ID NO: 392397 - DNA, 25 bp, Homo sapien
ggaactcatattgtagattgcaaaa

SEQ ID NO: 392398 - DNA, 25 bp, Homo sapien
tgagcttgggcctcgctccttggga

SEQ ID NO: 392399 - DNA, 25 bp, Homo sapien
cttctggcagatgagcccggcggca

SEQ ID NO: 392400 - DNA, 25 bp, Homo sapien
tgcagtgagcaatgtggctccataa

SEQ ID NO: 392401 - DNA, 25 bp, Homo sapien
gcaatgtggctccataagcacagta

SEQ ID NO: 392402 - DNA, 25 bp, Homo sapien
gtacaatgcatatcctttcagccac

SEQ ID NO: 392403 - DNA, 25 bp, Homo sapien
atcctttcagccacgtctttgttta

SEQ ID NO: 392404 - DNA, 25 bp, Homo sapien
cagccacgtctttgtttatttcatt

SEQ ID NO: 392405 - DNA, 25 bp, Homo sapien
gaaatatttcaagaactggcattgt

SEQ ID NO: 392406 - DNA, 25 bp, Homo sapien
gccactttccaggtggtcgttcttt

SEQ ID NO: 392407 - DNA, 25 bp, Homo sapien
aggtggtcgttctttgtcctcctga

SEQ ID NO: 392408 - DNA, 25 bp, Homo sapien
gttctttgtcctcctgagcttgggc

SEQ ID NO: 392409 - DNA, 25 bp, Homo sapien
cccagcgctgtgggagcctgaggcg

SEQ ID NO: 392410 - DNA, 25 bp, Homo sapien
ccagcgctgtgggagcctgaggcgg

SEQ ID NO: 392411 - DNA, 25 bp, Homo sapien
cctgaggcgggtgggtctcttgagg

SEQ ID NO: 392412 - DNA, 25 bp, Homo sapien
gaggattacttgaaccggggaggca

SEQ ID NO: 392413 - DNA, 25 bp, Homo sapien
aggattacttgaaccggggaggcat

SEQ ID NO: 392414 - DNA, 25 bp, Homo sapien
ggattacttgaaccggggaggcata

SEQ ID NO: 392415 - DNA, 25 bp, Homo sapien
gattacttgaaccggggaggcatag

SEQ ID NO: 392416 - DNA, 25 bp, Homo sapien
attacttgaaccggggaggcatagg

SEQ ID NO: 392417 - DNA, 25 bp, Homo sapien
aaccggggaggcataggttgtagtg

SEQ ID NO: 392418 - DNA, 25 bp, Homo sapien
accggggaggcataggttgtagtga

SEQ ID NO: 392419 - DNA, 25 bp, Homo sapien
cggggaggcataggttgtagtgagc

SEQ ID NO: 392420 - DNA, 25 bp, Homo sapien
tacttttaccatggccaactttaag

SEQ ID NO: 392421 - DNA, 25 bp, Homo sapien
agaggcacatcatcagctcctggga

SEQ ID NO: 392422 - DNA, 25 bp, Homo sapien
atcatcagctcctgggaacctgcag

SEQ ID NO: 392423 - DNA, 25 bp, Homo sapien
gaacctgcagcgcacagtgtcagag

SEQ ID NO: 392424 - DNA, 25 bp, Homo sapien
acagtgtcagagatgacccagtcta

SEQ ID NO: 392425 - DNA, 25 bp, Homo sapien
gatgacccagtctaagtgaatcaga

SEQ ID NO: 392426 - DNA, 25 bp, Homo sapien
gaatcagaccatttatccctctggg

SEQ ID NO: 392427 - DNA, 25 bp, Homo sapien
ctctgggcctaggactcaagccaga

SEQ ID NO: 392428 - DNA, 25 bp, Homo sapien
agctccttaggtccaattcctttga

SEQ ID NO: 392429 - DNA, 25 bp, Homo sapien
actgttgtggaagaggcaccatctt

SEQ ID NO: 392430 - DNA, 25 bp, Homo sapien
accatctttcactgcgttcgttgaa

SEQ ID NO: 392431 - DNA, 25 bp, Homo sapien
acgtaccatctaaggctgttctttc

SEQ ID NO: 392432 - DNA, 25 bp, Homo sapien
atctaaggctgttctttcctgtgac

SEQ ID NO: 392433 - DNA, 25 bp, Homo sapien
cctgtgacttgacatgttttgttgg

SEQ ID NO: 392434 - DNA, 25 bp, Homo sapien
gacatgttttgttggatctgaagac

SEQ ID NO: 392435 - DNA, 25 bp, Homo sapien
tgctaaaatttaccagcttccaggg

SEQ ID NO: 392436 - DNA, 25 bp, Homo sapien
cacttttatcttctggatcctgcga

SEQ ID NO: 392437 - DNA, 25 bp, Homo sapien
tatcttctggatcctgcgaacgaga

SEQ ID NO: 392438 - DNA, 25 bp, Homo sapien
gtatcatcgatatccaatttttaga

SEQ ID NO: 392439 - DNA, 25 bp, Homo sapien
atcataagggcagatctgaacattg

SEQ ID NO: 392440 - DNA, 25 bp, Homo sapien
gaacattgttagaagttgcacctct

SEQ ID NO: 392441 - DNA, 25 bp, Homo sapien
agaagttgcacctctaacgtaccat

SEQ ID NO: 392442 - DNA, 25 bp, Homo sapien
agggagagatctttgctatggagca

SEQ ID NO: 392443 - DNA, 25 bp, Homo sapien
atctttgctatggagcagtcctgga

SEQ ID NO: 392444 - DNA, 25 bp, Homo sapien
accccataagtagtgctgagctcca

SEQ ID NO: 392445 - DNA, 25 bp, Homo sapien
tgagctccagcttagctgagccaag

SEQ ID NO: 392446 - DNA, 25 bp, Homo sapien
aagctcagtccttatctggtgttca

SEQ ID NO: 392447 - DNA, 25 bp, Homo sapien
tggtgttcagccagtgcacaggtat

SEQ ID NO: 392448 - DNA, 25 bp, Homo sapien
gcacaggtataagcagaactacaga

SEQ ID NO: 392449 - DNA, 25 bp, Homo sapien
gagctgaatgtagcttccctgggat

SEQ ID NO: 392450 - DNA, 25 bp, Homo sapien
aatgtagcttccctgggatctcttc

SEQ ID NO: 392451 - DNA, 25 bp, Homo sapien
agcatttttcacacagttctgtacc

SEQ ID NO: 392452 - DNA, 25 bp, Homo sapien
ttctgtacctcctacccaagttggg

SEQ ID NO: 392453 - DNA, 25 bp, Homo sapien
gagggatgagtgaccaccatccagg

SEQ ID NO: 392454 - DNA, 25 bp, Homo sapien
ccaccatccaggctgagactgaaag

SEQ ID NO: 392455 - DNA, 25 bp, Homo sapien
gcagaggctggaactacagtattct

SEQ ID NO: 392456 - DNA, 25 bp, Homo sapien
ggaactacagtattctttcccctgc

SEQ ID NO: 392457 - DNA, 25 bp, Homo sapien
tttcccctgctagcaaccatgtgcc

SEQ ID NO: 392458 - DNA, 25 bp, Homo sapien
atgtgcctcccatcctgactgtgga

SEQ ID NO: 392459 - DNA, 25 bp, Homo sapien
tgcctcccatcctgactgtggagtt

SEQ ID NO: 392460 - DNA, 25 bp, Homo sapien
agtggggctggaacaaagcttctgc

SEQ ID NO: 392461 - DNA, 25 bp, Homo sapien
cttctgcctagggaggagctaagca

SEQ ID NO: 392462 - DNA, 25 bp, Homo sapien
aagcaggcccggcagttggaggaag

SEQ ID NO: 392463 - DNA, 25 bp, Homo sapien
tgtgctccggctttccctcagggaa

SEQ ID NO: 392464 - DNA, 25 bp, Homo sapien
agctggcatctcaagaaggcacatt

SEQ ID NO: 392465 - DNA, 25 bp, Homo sapien
gaaggcacattgagattggttctat

SEQ ID NO: 392466 - DNA, 25 bp, Homo sapien
ccccaaattgcaatcagctgctact

SEQ ID NO: 392467 - DNA, 25 bp, Homo sapien
agctgctactactagcaggcactat

SEQ ID NO: 392468 - DNA, 25 bp, Homo sapien
gcaggcactattgctttcggagtga

SEQ ID NO: 392469 - DNA, 25 bp, Homo sapien
tttgagaacaggtcactgcttgcct

SEQ ID NO: 392470 - DNA, 25 bp, Homo sapien
gaattgttgctagagtgagacttaa

SEQ ID NO: 392471 - DNA, 25 bp, Homo sapien
gaaacccatccgaaggaaacagcaa

SEQ ID NO: 392472 - DNA, 25 bp, Homo sapien
gcctgtaactgatttctctgagttc

SEQ ID NO: 392473 - DNA, 25 bp, Homo sapien
gggagcctatagacctgggaaccag

SEQ ID NO: 392474 - DNA, 25 bp, Homo sapien
cctgggaaccaggtatctgaggaag

SEQ ID NO: 392475 - DNA, 25 bp, Homo sapien
gtggacccgatctgtgcccccggga

SEQ ID NO: 392476 - DNA, 25 bp, Homo sapien
gggattggcccgtcaggcccatctg

SEQ ID NO: 392477 - DNA, 25 bp, Homo sapien
gattggcccgtcaggcccatctgtg

SEQ ID NO: 392478 - DNA, 25 bp, Homo sapien
tctgtgagcctggaggctgatgcct

SEQ ID NO: 392479 - DNA, 25 bp, Homo sapien
tgcctgcaggcaactcccatatggg

SEQ ID NO: 392480 - DNA, 25 bp, Homo sapien
ctgcaggcaactcccatatgggttt

SEQ ID NO: 392481 - DNA, 25 bp, Homo sapien
aggcaactcccatatgggtttccag

SEQ ID NO: 392482 - DNA, 25 bp, Homo sapien
gcaactcccatatgggtttccaggc

SEQ ID NO: 392483 - DNA, 25 bp, Homo sapien
ctcccatatgggtttccaggccact

SEQ ID NO: 392484 - DNA, 25 bp, Homo sapien
atatgggtttccaggccactccact

SEQ ID NO: 392485 - DNA, 25 bp, Homo sapien
tccaggccactccactgtgatctga

SEQ ID NO: 392486 - DNA, 25 bp, Homo sapien
ctgcagctatgagacagatctggct

SEQ ID NO: 392487 - DNA, 25 bp, Homo sapien
agctatgagacagatctggcttcaa

SEQ ID NO: 392488 - DNA, 25 bp, Homo sapien
tgagacagatctggcttcaaatcca

SEQ ID NO: 392489 - DNA, 25 bp, Homo sapien
gacagatctggcttcaaatccaaga

SEQ ID NO: 392490 - DNA, 25 bp, Homo sapien
atctggcttcaaatccaagagttgc

SEQ ID NO: 392491 - DNA, 25 bp, Homo sapien
aatccaagagttgccatgcacttgc

SEQ ID NO: 392492 - DNA, 25 bp, Homo sapien
aagagttgccatgcacttgctgtgt

SEQ ID NO: 392493 - DNA, 25 bp, Homo sapien
gggcttacgatactactacctcata

SEQ ID NO: 392494 - DNA, 25 bp, Homo sapien
gcttacgatactactacctcatagg

SEQ ID NO: 392495 - DNA, 25 bp, Homo sapien
tacgatactactacctcatagggtt

SEQ ID NO: 392496 - DNA, 25 bp, Homo sapien
cctcatagggttgtcctggggatcc

SEQ ID NO: 392497 - DNA, 25 bp, Homo sapien
gcctcctggagattcacaaaataat

SEQ ID NO: 392498 - DNA, 25 bp, Homo sapien
aataatgcggacgtaccgactgcca

SEQ ID NO: 392499 - DNA, 25 bp, Homo sapien
gtaccgactgccagatctttacact

SEQ ID NO: 392500 - DNA, 25 bp, Homo sapien
tgccccgaggagtccggtcacaagg

SEQ ID NO: 392501 - DNA, 25 bp, Homo sapien
gaaggcccagaatccattttaggtt

SEQ ID NO: 392502 - DNA, 25 bp, Homo sapien
acagacctttcgtcccttcaaggtg

SEQ ID NO: 392503 - DNA, 25 bp, Homo sapien
tcaaggtgtaaccaccgttttccat

SEQ ID NO: 392504 - DNA, 25 bp, Homo sapien
caccgttttccattccagccatttt

SEQ ID NO: 392505 - DNA, 25 bp, Homo sapien
ggccacaccgttaccttacttatag

SEQ ID NO: 392506 - DNA, 25 bp, Homo sapien
ttacttataggtatttccccagaag

SEQ ID NO: 392507 - DNA, 25 bp, Homo sapien
atttccccagaagaagactccagag

SEQ ID NO: 392508 - DNA, 25 bp, Homo sapien
aacagggtcagactcatagggtcat

SEQ ID NO: 392509 - DNA, 25 bp, Homo sapien
ggtcatggagtacatacagcagttg

SEQ ID NO: 392510 - DNA, 25 bp, Homo sapien
gcagttgaaggactttactaccgat

SEQ ID NO: 392511 - DNA, 25 bp, Homo sapien
tactaccgatgacctgttgcagcta

SEQ ID NO: 392512 - DNA, 25 bp, Homo sapien
gcagctattaatgtcatgtccccaa

SEQ ID NO: 392513 - DNA, 25 bp, Homo sapien
atgtcatgtccccaagttgaattaa

SEQ ID NO: 392514 - DNA, 25 bp, Homo sapien
gttgaattaattcagtgtctcacta

SEQ ID NO: 392515 - DNA, 25 bp, Homo sapien
catctttatcttttggtcttgctat

SEQ ID NO: 392516 - DNA, 25 bp, Homo sapien
tggtcttgctatacttcatctgttc

SEQ ID NO: 392517 - DNA, 25 bp, Homo sapien
atctgttctctgcagacatgaaaaa

SEQ ID NO: 392518 - DNA, 25 bp, Homo sapien
agttggcattaagctacttcaagaa

SEQ ID NO: 392519 - DNA, 25 bp, Homo sapien
ttacttacgatatcttcccctccca

SEQ ID NO: 392520 - DNA, 25 bp, Homo sapien
gtaagtcaagaagcacctgtagagg

SEQ ID NO: 392521 - DNA, 25 bp, Homo sapien
gaagcacctgtagaggtctgccttt

SEQ ID NO: 392522 - DNA, 25 bp, Homo sapien
acctgtagaggtctgcctttaccaa

SEQ ID NO: 392523 - DNA, 25 bp, Homo sapien
gtagaggtctgcctttaccaatttc

SEQ ID NO: 392524 - DNA, 25 bp, Homo sapien
aggtctgcctttaccaatttcagct

SEQ ID NO: 392525 - DNA, 25 bp, Homo sapien
taaattggagagcagaagcaggtct

SEQ ID NO: 392526 - DNA, 25 bp, Homo sapien
caggtctgaaacaaatactgcagtt

SEQ ID NO: 392527 - DNA, 25 bp, Homo sapien
aacaaatactgcagttagctttgtg

SEQ ID NO: 392528 - DNA, 25 bp, Homo sapien
ggtaggctagtctaagctctgatgc

SEQ ID NO: 392529 - DNA, 25 bp, Homo sapien
aggctagtctaagctctgatgctca

SEQ ID NO: 392530 - DNA, 25 bp, Homo sapien
ggagtattcatcaggttccttattg

SEQ ID NO: 392531 - DNA, 25 bp, Homo sapien
ggttccttattgtgctgccactaga

SEQ ID NO: 392532 - DNA, 25 bp, Homo sapien
tgctgccactagatgccaggcatgt

SEQ ID NO: 392533 - DNA, 25 bp, Homo sapien
gagaggaagacagcggccctgccct

SEQ ID NO: 392534 - DNA, 25 bp, Homo sapien
gccctctgctagcaggcagaaccga

SEQ ID NO: 392535 - DNA, 25 bp, Homo sapien
aggcagaaccgagttctggccacac

SEQ ID NO: 392536 - DNA, 25 bp, Homo sapien
agttctggccacactgtgaagaaag

SEQ ID NO: 392537 - DNA, 25 bp, Homo sapien
cctgcggtggcagctggttaagctc

SEQ ID NO: 392538 - DNA, 25 bp, Homo sapien
ggagaatggatttcacggagcagaa

SEQ ID NO: 392539 - DNA, 25 bp, Homo sapien
gcagaaggatgtgctcaaggtgacc

SEQ ID NO: 392540 - DNA, 25 bp, Homo sapien
gacagagaagcagtcgactgtggaa

SEQ ID NO: 392541 - DNA, 25 bp, Homo sapien
ttaagaaagtcatatttttgcattt

SEQ ID NO: 392542 - DNA, 25 bp, Homo sapien
tatttttgcatttcagccaaaataa

SEQ ID NO: 392543 - DNA, 25 bp, Homo sapien
gccaaaataaagaccgcctgtaata

SEQ ID NO: 392544 - DNA, 25 bp, Homo sapien
aaagaccgcctgtaataatctgtta

SEQ ID NO: 392545 - DNA, 25 bp, Homo sapien
gaccgcctgtaataatctgttagaa

SEQ ID NO: 392546 - DNA, 25 bp, Homo sapien
gaaatccatatgtttcatatgatct

SEQ ID NO: 392547 - DNA, 25 bp, Homo sapien
tcatatgatctaaactgtattttcc

SEQ ID NO: 392548 - DNA, 25 bp, Homo sapien
agattcagaaaggttcatatttttc

SEQ ID NO: 392549 - DNA, 25 bp, Homo sapien
attttgttaggttgcataaagaagc

SEQ ID NO: 392550 - DNA, 25 bp, Homo sapien
gaaagctattaggtatatttgtaca

SEQ ID NO: 392551 - DNA, 25 bp, Homo sapien
gtatatttgtacatgactgcaaatg

SEQ ID NO: 392552 - DNA, 25 bp, Homo sapien
gccacagggagtcctaagcaggaat

SEQ ID NO: 392553 - DNA, 25 bp, Homo sapien
caggctggataggatacttggaact

SEQ ID NO: 392554 - DNA, 25 bp, Homo sapien
gatatacttacttagctaaagcagt

SEQ ID NO: 392555 - DNA, 25 bp, Homo sapien
agcagtgttacgtagaatagtatca

SEQ ID NO: 392556 - DNA, 25 bp, Homo sapien
ttttcgaaatcgtcaatgctgggaa

SEQ ID NO: 392557 - DNA, 25 bp, Homo sapien
ggagaaaagcttaattcttgacatt

SEQ ID NO: 392558 - DNA, 25 bp, Homo sapien
gacatttaaataccagttttccaag

SEQ ID NO: 392559 - DNA, 25 bp, Homo sapien
taccagttttccaagtaaggagttg

SEQ ID NO: 392560 - DNA, 25 bp, Homo sapien
gtaaggagttgatgtaagagccacc

SEQ ID NO: 392561 - DNA, 25 bp, Homo sapien
aagagccaccttaaacgatgtcaaa

SEQ ID NO: 392562 - DNA, 25 bp, Homo sapien
ttttctttttctgtagactggtaga

SEQ ID NO: 392563 - DNA, 25 bp, Homo sapien
gagggatgagtgaccaccatccagg

SEQ ID NO: 392564 - DNA, 25 bp, Homo sapien
ccaccatccaggctgagactgaaag

SEQ ID NO: 392565 - DNA, 25 bp, Homo sapien
gcagaggctggaactacagtattct

SEQ ID NO: 392566 - DNA, 25 bp, Homo sapien
ggaactacagtattctttcccctgc

SEQ ID NO: 392567 - DNA, 25 bp, Homo sapien
atgtgcctcccatcctgactgtgga

SEQ ID NO: 392568 - DNA, 25 bp, Homo sapien
cccatcctgactgtggagttgggat

SEQ ID NO: 392569 - DNA, 25 bp, Homo sapien
gctggaacaaagcttctgcctaggg

SEQ ID NO: 392570 - DNA, 25 bp, Homo sapien
cttctgcctagggaggagctaagca

SEQ ID NO: 392571 - DNA, 25 bp, Homo sapien
aagcaggcccggcagttggaggaag

SEQ ID NO: 392572 - DNA, 25 bp, Homo sapien
aaggccagaggaacagctttgtgct

SEQ ID NO: 392573 - DNA, 25 bp, Homo sapien
tgtgctccggctttccctcagggaa

SEQ ID NO: 392574 - DNA, 25 bp, Homo sapien
gtaaaccctgcctcttaccacaatg

SEQ ID NO: 392575 - DNA, 25 bp, Homo sapien
taaaccctgcctcttaccacaatgt

SEQ ID NO: 392576 - DNA, 25 bp, Homo sapien
ctgcctcttaccacaatgtccagga

SEQ ID NO: 392577 - DNA, 25 bp, Homo sapien
tgcctcttaccacaatgtccaggag

SEQ ID NO: 392578 - DNA, 25 bp, Homo sapien
gcctcttaccacaatgtccaggagg

SEQ ID NO: 392579 - DNA, 25 bp, Homo sapien
ctcttaccacaatgtccaggaggaa

SEQ ID NO: 392580 - DNA, 25 bp, Homo sapien
tcttaccacaatgtccaggaggaat

SEQ ID NO: 392581 - DNA, 25 bp, Homo sapien
cttaccacaatgtccaggaggaatg

SEQ ID NO: 392582 - DNA, 25 bp, Homo sapien
ttaccacaatgtccaggaggaatgg

SEQ ID NO: 392583 - DNA, 25 bp, Homo sapien
taccacaatgtccaggaggaatggg

SEQ ID NO: 392584 - DNA, 25 bp, Homo sapien
ccacaatgtccaggaggaatgggtc

SEQ ID NO: 392585 - DNA, 25 bp, Homo sapien
gggtctgggcatttcctcgaagctg

SEQ ID NO: 392586 - DNA, 25 bp, Homo sapien
gctgcttccaggacaggatcaggaa

SEQ ID NO: 392587 - DNA, 25 bp, Homo sapien
aggatcaggaacgtgttacttgggt

SEQ ID NO: 392588 - DNA, 25 bp, Homo sapien
aaggagctctggttctgcccatgtc

SEQ ID NO: 392589 - DNA, 25 bp, Homo sapien
atgtcctccagcctcgagtgtgcaa

SEQ ID NO: 392590 - DNA, 25 bp, Homo sapien
gagtgtgcaactgctcttctgggaa

SEQ ID NO: 392591 - DNA, 25 bp, Homo sapien
gctcttctgggaacttgggtctcct

SEQ ID NO: 392592 - DNA, 25 bp, Homo sapien
agagcagatgcccttacacccatag

SEQ ID NO: 392593 - DNA, 25 bp, Homo sapien
gtgagttcttgcatatcagcttgtg

SEQ ID NO: 392594 - DNA, 25 bp, Homo sapien
tcagcttgtgacagcgttgtgacct

SEQ ID NO: 392595 - DNA, 25 bp, Homo sapien
agcgttgtgacctgcccctttgtca

SEQ ID NO: 392596 - DNA, 25 bp, Homo sapien
gtaccttatatgacttattttcagg

SEQ ID NO: 392597 - DNA, 25 bp, Homo sapien
catattgtcccattattctgagaag

SEQ ID NO: 392598 - DNA, 25 bp, Homo sapien
tcaggttagaaaaatgtggtcctac

SEQ ID NO: 392599 - DNA, 25 bp, Homo sapien
tagaaaaatgtggtcctacagtttt

SEQ ID NO: 392600 - DNA, 25 bp, Homo sapien
gtttgcctgggccatgtgaagccac

SEQ ID NO: 392601 - DNA, 25 bp, Homo sapien
gggccatgtgaagccaccattatca

SEQ ID NO: 392602 - DNA, 25 bp, Homo sapien
gaagccaccattatcatttacgtca

SEQ ID NO: 392603 - DNA, 25 bp, Homo sapien
gccaccattatcatttacgtcaaaa

SEQ ID NO: 392604 - DNA, 25 bp, Homo sapien
atctgttgcccaagagaaaaataca

SEQ ID NO: 392605 - DNA, 25 bp, Homo sapien
gaataaatctgattactgactagat

SEQ ID NO: 392606 - DNA, 25 bp, Homo sapien
ctgactagatacaagataaccacat

SEQ ID NO: 392607 - DNA, 25 bp, Homo sapien
tctcaacagaatcgcaccaaactat

SEQ ID NO: 392608 - DNA, 25 bp, Homo sapien
acagaatcgcaccaaactatacttt

SEQ ID NO: 392609 - DNA, 25 bp, Homo sapien
gaatcgcaccaaactatactttcag

SEQ ID NO: 392610 - DNA, 25 bp, Homo sapien
atcgcaccaaactatactttcagga

SEQ ID NO: 392611 - DNA, 25 bp, Homo sapien
tcgcaccaaactatactttcaggat

SEQ ID NO: 392612 - DNA, 25 bp, Homo sapien
gcaccaaactatactttcaggatga

SEQ ID NO: 392613 - DNA, 25 bp, Homo sapien
caccaaactatactttcaggatgaa

SEQ ID NO: 392614 - DNA, 25 bp, Homo sapien
gaagagccatctcaacagaatcgca

SEQ ID NO: 392615 - DNA, 25 bp, Homo sapien
agagccatctcaacagaatcgcacc

SEQ ID NO: 392616 - DNA, 25 bp, Homo sapien
agccatctcaacagaatcgcaccaa

SEQ ID NO: 392617 - DNA, 25 bp, Homo sapien
catctcaacagaatcgcaccaaact

SEQ ID NO: 392618 - DNA, 25 bp, Homo sapien
accttgtgatcgtgttgttgtggtg

SEQ ID NO: 392619 - DNA, 25 bp, Homo sapien
gatcgtgttgttgtggtggtattac

SEQ ID NO: 392620 - DNA, 25 bp, Homo sapien
gttgtggtggtattactactactca

SEQ ID NO: 392621 - DNA, 25 bp, Homo sapien
ttactactactcagcaagattctgg

SEQ ID NO: 392622 - DNA, 25 bp, Homo sapien
gcaagattctggttttacttctcat

SEQ ID NO: 392623 - DNA, 25 bp, Homo sapien
tgggagttaccatcaagacgttagg

SEQ ID NO: 392624 - DNA, 25 bp, Homo sapien
tcaagacgttaggtatggctgtgtg

SEQ ID NO: 392625 - DNA, 25 bp, Homo sapien
tgtgtgacccactttggccaatgaa

SEQ ID NO: 392626 - DNA, 25 bp, Homo sapien
gtgtgacccactttggccaatgaaa

SEQ ID NO: 392627 - DNA, 25 bp, Homo sapien
cagaaatggcatatgtcacttgtgg

SEQ ID NO: 392628 - DNA, 25 bp, Homo sapien
atttaagcaagaatttcccttgctg

SEQ ID NO: 392629 - DNA, 25 bp, Homo sapien
gtgaccaccagaatgctttactgta

SEQ ID NO: 392630 - DNA, 25 bp, Homo sapien
cctttgttatctgtagggtgatact

SEQ ID NO: 392631 - DNA, 25 bp, Homo sapien
ctgtagggtgatactttgagaccat

SEQ ID NO: 392632 - DNA, 25 bp, Homo sapien
gagaccatgtaaatagccggttcct

SEQ ID NO: 392633 - DNA, 25 bp, Homo sapien
tgtaaatagccggttcctccacaac

SEQ ID NO: 392634 - DNA, 25 bp, Homo sapien
ctttcaactgagtcaacaattgtat

SEQ ID NO: 392635 - DNA, 25 bp, Homo sapien
attccttattagctgcattcttctg

SEQ ID NO: 392636 - DNA, 25 bp, Homo sapien
gtcaagaatactacacctcaggagg

SEQ ID NO: 392637 - DNA, 25 bp, Homo sapien
aggcagagattgtacctgtatgggt

SEQ ID NO: 392638 - DNA, 25 bp, Homo sapien
gtacctgtatgggtgatactaagtt

SEQ ID NO: 392639 - DNA, 25 bp, Homo sapien
gtttggataagatggtgaccaccag

SEQ ID NO: 392640 - DNA, 25 bp, Homo sapien
gattacataaacttttctctgcatt

SEQ ID NO: 392641 - DNA, 25 bp, Homo sapien
gcattggtcttttcactatcttatt

SEQ ID NO: 392642 - DNA, 25 bp, Homo sapien
ggtcttttcactatcttatttgcta

SEQ ID NO: 392643 - DNA, 25 bp, Homo sapien
cactatcttatttgctaacttttct

SEQ ID NO: 392644 - DNA, 25 bp, Homo sapien
attaaacagggaaagcttgctacat

SEQ ID NO: 392645 - DNA, 25 bp, Homo sapien
aacagggaaagcttgctacattata

SEQ ID NO: 392646 - DNA, 25 bp, Homo sapien
ggaaagcttgctacattataaagat

SEQ ID NO: 392647 - DNA, 25 bp, Homo sapien
attataaagattgttggcaccattt

SEQ ID NO: 392648 - DNA, 25 bp, Homo sapien
aacttttggaaatgatgagctactt

SEQ ID NO: 392649 - DNA, 25 bp, Homo sapien
atgtgtttactcatgctttgtgata

SEQ ID NO: 392650 - DNA, 25 bp, Homo sapien
gtgtttactcatgctttgtgatatt

SEQ ID NO: 392651 - DNA, 25 bp, Homo sapien
gccagctacaggtgctcacctgaaa

SEQ ID NO: 392652 - DNA, 25 bp, Homo sapien
cagctacaggtgctcacctgaaaag

SEQ ID NO: 392653 - DNA, 25 bp, Homo sapien
aggtgctcacctgaaaagcaagcca

SEQ ID NO: 392654 - DNA, 25 bp, Homo sapien
gtgctcacctgaaaagcaagccaga

SEQ ID NO: 392655 - DNA, 25 bp, Homo sapien
gctcacctgaaaagcaagccagacc

SEQ ID NO: 392656 - DNA, 25 bp, Homo sapien
tcacctgaaaagcaagccagaccat

SEQ ID NO: 392657 - DNA, 25 bp, Homo sapien
acctgaaaagcaagccagaccatat

SEQ ID NO: 392658 - DNA, 25 bp, Homo sapien
gaaaagcaagccagaccatattaac

SEQ ID NO: 392659 - DNA, 25 bp, Homo sapien
aaagcaagccagaccatattaaccc

SEQ ID NO: 392660 - DNA, 25 bp, Homo sapien
aagcaagccagaccatattaaccct

SEQ ID NO: 392661 - DNA, 25 bp, Homo sapien
tctgattcaatgctttccacctcct

SEQ ID NO: 392662 - DNA, 25 bp, Homo sapien
tcaccccgtgtatcttctgaaagag

SEQ ID NO: 392663 - DNA, 25 bp, Homo sapien
gaaagagaagtaggtctttcctcct

SEQ ID NO: 392664 - DNA, 25 bp, Homo sapien
agttgctgcccttcgatttctctat

SEQ ID NO: 392665 - DNA, 25 bp, Homo sapien
aagccctcctggttcagggtcagaa

SEQ ID NO: 392666 - DNA, 25 bp, Homo sapien
ttcagggtcagaagctcagcacctt

SEQ ID NO: 392667 - DNA, 25 bp, Homo sapien
ggtcagaagctcagcaccttgcctt

SEQ ID NO: 392668 - DNA, 25 bp, Homo sapien
cttctccatgatcccaaagcacaat

SEQ ID NO: 392669 - DNA, 25 bp, Homo sapien
gatcccaaagcacaattggtgagtg

SEQ ID NO: 392670 - DNA, 25 bp, Homo sapien
ttcgatttctctatgctctctccca

SEQ ID NO: 392671 - DNA, 25 bp, Homo sapien
ccaccctctagatcaggcagaatgg

SEQ ID NO: 392672 - DNA, 25 bp, Homo sapien
ggcctgtgctgcgtctgcacacagg

SEQ ID NO: 392673 - DNA, 25 bp, Homo sapien
ggtggcgcatgcctcattcacgtac

SEQ ID NO: 392674 - DNA, 25 bp, Homo sapien
atgcctcattcacgtacatgggaga

SEQ ID NO: 392675 - DNA, 25 bp, Homo sapien
cattcacgtacatgggagagtctac

SEQ ID NO: 392676 - DNA, 25 bp, Homo sapien
tgggagagtctacaaagtcacacgt

SEQ ID NO: 392677 - DNA, 25 bp, Homo sapien
gagtctacaaagtcacacgtattca

SEQ ID NO: 392678 - DNA, 25 bp, Homo sapien
caaagtcacacgtattcataggtta

SEQ ID NO: 392679 - DNA, 25 bp, Homo sapien
acacgtattcataggttaagccaca

SEQ ID NO: 392680 - DNA, 25 bp, Homo sapien
cataggttaagccacatgctgacaa

SEQ ID NO: 392681 - DNA, 25 bp, Homo sapien
taagccacatgctgacaaatgtcat

SEQ ID NO: 392682 - DNA, 25 bp, Homo sapien
tgtcataagaagaccctacactttt

SEQ ID NO: 392683 - DNA, 25 bp, Homo sapien
tacacttttaccttggccgatccct

SEQ ID NO: 392684 - DNA, 25 bp, Homo sapien
aagccactttcctgccagctacagg

SEQ ID NO: 392685 - DNA, 25 bp, Homo sapien
gccagctacaggtgctcacctgaaa

SEQ ID NO: 392686 - DNA, 25 bp, Homo sapien
aggtgctcacctgaaaagcaagcca

SEQ ID NO: 392687 - DNA, 25 bp, Homo sapien
gtgctcacctgaaaagcaagccaga

SEQ ID NO: 392688 - DNA, 25 bp, Homo sapien
tcacctgaaaagcaagccagaccat

SEQ ID NO: 392689 - DNA, 25 bp, Homo sapien
gaaaagcaagccagaccatattaac

SEQ ID NO: 392690 - DNA, 25 bp, Homo sapien
aaagcaagccagaccatattaaccc

SEQ ID NO: 392691 - DNA, 25 bp, Homo sapien
aagcaagccagaccatattaaccct

SEQ ID NO: 392692 - DNA, 25 bp, Homo sapien
gaagactttctgattcaatgctttc

SEQ ID NO: 392693 - DNA, 25 bp, Homo sapien
actttctgattcaatgctttccacc

SEQ ID NO: 392694 - DNA, 25 bp, Homo sapien
tctgattcaatgctttccacctcct

SEQ ID NO: 392695 - DNA, 25 bp, Homo sapien
ggctaccctcgaaaaagcgaccaag

SEQ ID NO: 392696 - DNA, 25 bp, Homo sapien
ctacacacatccttcgagatcatca

SEQ ID NO: 392697 - DNA, 25 bp, Homo sapien
gcaaatccaagctaccacgggttag

SEQ ID NO: 392698 - DNA, 25 bp, Homo sapien
aaatgctgacattggcaacttgccg

SEQ ID NO: 392699 - DNA, 25 bp, Homo sapien
tgtctctgtgctacttttctctttt

SEQ ID NO: 392700 - DNA, 25 bp, Homo sapien
tttctcttttcctccatatcagatg

SEQ ID NO: 392701 - DNA, 25 bp, Homo sapien
ttcctccatatcagatgcctacaat

SEQ ID NO: 392702 - DNA, 25 bp, Homo sapien
ttcgagatcatcaccaatgtccctg

SEQ ID NO: 392703 - DNA, 25 bp, Homo sapien
accaatgtccctgggctatcatggg

SEQ ID NO: 392704 - DNA, 25 bp, Homo sapien
tgacaatctcacaggaaaagtcctc

SEQ ID NO: 392705 - DNA, 25 bp, Homo sapien
gtcctcagtactgtaaggctaccct

SEQ ID NO: 392706 - DNA, 25 bp, Homo sapien
gctagtacactgtaagtactcaaat

SEQ ID NO: 392707 - DNA, 25 bp, Homo sapien
atggatcgtatttgtatcaatcacc

SEQ ID NO: 392708 - DNA, 25 bp, Homo sapien
acatttaaatgttcagtttgcctaa

SEQ ID NO: 392709 - DNA, 25 bp, Homo sapien
aaatgttcagtttgcctaatagcct

SEQ ID NO: 392710 - DNA, 25 bp, Homo sapien
gttcagtttgcctaatagccttcaa

SEQ ID NO: 392711 - DNA, 25 bp, Homo sapien
cagtttgcctaatagccttcaatga

SEQ ID NO: 392712 - DNA, 25 bp, Homo sapien
gtttgcctaatagccttcaatgaaa

SEQ ID NO: 392713 - DNA, 25 bp, Homo sapien
gccttcaatgaaacacggattcttc

SEQ ID NO: 392714 - DNA, 25 bp, Homo sapien
ataaaactgattactatgcaagaaa

SEQ ID NO: 392715 - DNA, 25 bp, Homo sapien
aagggaagaatacttagcacagtgc

SEQ ID NO: 392716 - DNA, 25 bp, Homo sapien
acttagcacagtgctagtacactgt

SEQ ID NO: 392717 - DNA, 25 bp, Homo sapien
gttctttacaaagttcgctggaaag

SEQ ID NO: 392718 - DNA, 25 bp, Homo sapien
tcgctggaaaggctatacatcggat

SEQ ID NO: 392719 - DNA, 25 bp, Homo sapien
gatgatgatacctgggagcccgaga

SEQ ID NO: 392720 - DNA, 25 bp, Homo sapien
ggagcccgagattcacctggaggac

SEQ ID NO: 392721 - DNA, 25 bp, Homo sapien
ttcacctggaggactgtaaagaagt

SEQ ID NO: 392722 - DNA, 25 bp, Homo sapien
aagaagtgcttcttgaatttaggaa

SEQ ID NO: 392723 - DNA, 25 bp, Homo sapien
gtcaggaaggatattcagagactat

SEQ ID NO: 392724 - DNA, 25 bp, Homo sapien
gagactatccttaaataacgacata

SEQ ID NO: 392725 - DNA, 25 bp, Homo sapien
aacgacatatttgaggcgaactctg

SEQ ID NO: 392726 - DNA, 25 bp, Homo sapien
ttgaggcgaactctgatagcgatca

SEQ ID NO: 392727 - DNA, 25 bp, Homo sapien
gatagcgatcagcaaagtgagacaa

SEQ ID NO: 392728 - DNA, 25 bp, Homo sapien
gtttcccaaagagcttgagtgttgt

SEQ ID NO: 392729 - DNA, 25 bp, Homo sapien
gagcttgagtgttgttcttggcttt

SEQ ID NO: 392730 - DNA, 25 bp, Homo sapien
ggctttgttccagctctggttgaat

SEQ ID NO: 392731 - DNA, 25 bp, Homo sapien
ccagctctggttgaattacttttac

SEQ ID NO: 392732 - DNA, 25 bp, Homo sapien
caagtttaattgtctgtgggcttct

SEQ ID NO: 392733 - DNA, 25 bp, Homo sapien
gtctttctgtcctaaactattgctg

SEQ ID NO: 392734 - DNA, 25 bp, Homo sapien
tgctgtgtatctccaaatgacttaa

SEQ ID NO: 392735 - DNA, 25 bp, Homo sapien
cttgagttcaagacagactgcgctg

SEQ ID NO: 392736 - DNA, 25 bp, Homo sapien
gactgcgctgatgctcaactgctga

SEQ ID NO: 392737 - DNA, 25 bp, Homo sapien
tcaactgctgaccactaaagtcata

SEQ ID NO: 392738 - DNA, 25 bp, Homo sapien
taaagtcataaaattcctaccagtt

SEQ ID NO: 392739 - DNA, 25 bp, Homo sapien
acaagttttaagtctaagcctcctg

SEQ ID NO: 392740 - DNA, 25 bp, Homo sapien
ttttaagtctaagcctcctgggtgg

SEQ ID NO: 392741 - DNA, 25 bp, Homo sapien
tgtttcaacatatgctccagtcatg

SEQ ID NO: 392742 - DNA, 25 bp, Homo sapien
tgctccagtcatggcagactttggc

SEQ ID NO: 392743 - DNA, 25 bp, Homo sapien
gtcatggcagactttggccagacag

SEQ ID NO: 392744 - DNA, 25 bp, Homo sapien
cagacagcgccctttttcagagtga

SEQ ID NO: 392745 - DNA, 25 bp, Homo sapien
acagcgccctttttcagagtgaact

SEQ ID NO: 392746 - DNA, 25 bp, Homo sapien
gcgccctttttcagagtgaactgag

SEQ ID NO: 392747 - DNA, 25 bp, Homo sapien
gaactgagtgtagcacaaattatct

SEQ ID NO: 392748 - DNA, 25 bp, Homo sapien
tatctgccagtgctagttagcaaac

SEQ ID NO: 392749 - DNA, 25 bp, Homo sapien
gctagttagcaaacagaatggagcc

SEQ ID NO: 392750 - DNA, 25 bp, Homo sapien
tcacaccttgttcatgtcattgctt

SEQ ID NO: 392751 - DNA, 25 bp, Homo sapien
gtcattgctttttggcagcacttac

SEQ ID NO: 392752 - DNA, 25 bp, Homo sapien
gatgagcaccttgagaactcactga

SEQ ID NO: 392753 - DNA, 25 bp, Homo sapien
gaactcactgagaattgcaactact

SEQ ID NO: 392754 - DNA, 25 bp, Homo sapien
tgcaactacttccatcaagccagat

SEQ ID NO: 392755 - DNA, 25 bp, Homo sapien
gatactgatggattagtttctcaaa

SEQ ID NO: 392756 - DNA, 25 bp, Homo sapien
caatgtcaagtaccccactagtttt

SEQ ID NO: 392757 - DNA, 25 bp, Homo sapien
gattttgcctctttactggactttt

SEQ ID NO: 392758 - DNA, 25 bp, Homo sapien
tggacttttgtaagacctgtcttcc

SEQ ID NO: 392759 - DNA, 25 bp, Homo sapien
tgtaagacctgtcttcccaatgaca

SEQ ID NO: 392760 - DNA, 25 bp, Homo sapien
ttgcttcacaatcacaccttgttca

SEQ ID NO: 392761 - DNA, 25 bp, Homo sapien
gattcccattcttctcaatcaagac

SEQ ID NO: 392762 - DNA, 25 bp, Homo sapien
agacctaccctgaatggatttggag

SEQ ID NO: 392763 - DNA, 25 bp, Homo sapien
gggccaggcagatccaggtttcaaa

SEQ ID NO: 392764 - DNA, 25 bp, Homo sapien
gatccaggtttcaaacccatctctg

SEQ ID NO: 392765 - DNA, 25 bp, Homo sapien
ttcttacctctgagacctttggcaa

SEQ ID NO: 392766 - DNA, 25 bp, Homo sapien
acctctgagacctttggcaaacatt

SEQ ID NO: 392767 - DNA, 25 bp, Homo sapien
ttgacttaattgagccttagtttcc

SEQ ID NO: 392768 - DNA, 25 bp, Homo sapien
tggatatgtcctgttattcgcgtca

SEQ ID NO: 392769 - DNA, 25 bp, Homo sapien
tgttattcgcgtcagcagtcactca

SEQ ID NO: 392770 - DNA, 25 bp, Homo sapien
gcgtcagcagtcactcatccaaaga

SEQ ID NO: 392771 - DNA, 25 bp, Homo sapien
aagcttctagtgttctaaaggctca

SEQ ID NO: 392772 - DNA, 25 bp, Homo sapien
tttccagttcactcaggccttacta

SEQ ID NO: 392773 - DNA, 25 bp, Homo sapien
caggccttactaatccataccaaat

SEQ ID NO: 392774 - DNA, 25 bp, Homo sapien
aatccataccaaattagcctaaaga

SEQ ID NO: 392775 - DNA, 25 bp, Homo sapien
catttctattttcagcatgtttcta

SEQ ID NO: 392776 - DNA, 25 bp, Homo sapien
tagaaccaacacgtacctctgaatg

SEQ ID NO: 392777 - DNA, 25 bp, Homo sapien
tttggaaatttacagagccatgatt

SEQ ID NO: 392778 - DNA, 25 bp, Homo sapien
cagagccatgatttttgaacctaat

SEQ ID NO: 392779 - DNA, 25 bp, Homo sapien
ccatctgaattgttgcaggtccaca

SEQ ID NO: 392780 - DNA, 25 bp, Homo sapien
tttttgccaaagatacactctatag

SEQ ID NO: 392781 - DNA, 25 bp, Homo sapien
gatacactctatagatgcttagtag

SEQ ID NO: 392782 - DNA, 25 bp, Homo sapien
atgcttagtagtggcctgatttttt

SEQ ID NO: 392783 - DNA, 25 bp, Homo sapien
ctgtctcgtcgtggcaggtcaccga

SEQ ID NO: 392784 - DNA, 25 bp, Homo sapien
ggtcaccgagccgtcaagcaagaat

SEQ ID NO: 392785 - DNA, 25 bp, Homo sapien
gagccgtcaagcaagaatctgtggg

SEQ ID NO: 392786 - DNA, 25 bp, Homo sapien
ttgcgccagtagaggaaatgctttt

SEQ ID NO: 392787 - DNA, 25 bp, Homo sapien
aaatgctttttcatggcttcagtgc

SEQ ID NO: 392788 - DNA, 25 bp, Homo sapien
tttttcatggcttcagtgcagagca

SEQ ID NO: 392789 - DNA, 25 bp, Homo sapien
tttccggtttcccatttcaccatga

SEQ ID NO: 392790 - DNA, 25 bp, Homo sapien
ggtttcccatttcaccatgatctca

SEQ ID NO: 392791 - DNA, 25 bp, Homo sapien
atttcaccatgatctcacgtacacc

SEQ ID NO: 392792 - DNA, 25 bp, Homo sapien
agctgctctacagactcgtcgttca

SEQ ID NO: 392793 - DNA, 25 bp, Homo sapien
tctacagactcgtcgttcacccgga

SEQ ID NO: 392794 - DNA, 25 bp, Homo sapien
agaagaaaacgctgatgcctgccgc

SEQ ID NO: 392795 - DNA, 25 bp, Homo sapien
agaaaacgctgatgcctgccgcctt

SEQ ID NO: 392796 - DNA, 25 bp, Homo sapien
tctctctgcttcagctacctaagag

SEQ ID NO: 392797 - DNA, 25 bp, Homo sapien
gaagggcccgctgtcctgtgatcag

SEQ ID NO: 392798 - DNA, 25 bp, Homo sapien
ggcccgctgtcctgtgatcaggtga

SEQ ID NO: 392799 - DNA, 25 bp, Homo sapien
tcctgtgatcaggtgacttgcttca

SEQ ID NO: 392800 - DNA, 25 bp, Homo sapien
acttgcttcaccttgtcaatcactt

SEQ ID NO: 392801 - DNA, 25 bp, Homo sapien
atcacttagaagactgaccctcctt

SEQ ID NO: 392802 - DNA, 25 bp, Homo sapien
cacttagaagactgaccctccttat

SEQ ID NO: 392803 - DNA, 25 bp, Homo sapien
ttagaagactgaccctccttatcct

SEQ ID NO: 392804 - DNA, 25 bp, Homo sapien
cgtgtctttgtggtagtggtccccg

SEQ ID NO: 392805 - DNA, 25 bp, Homo sapien
tgaggatatggaaccccaacctctt

SEQ ID NO: 392806 - DNA, 25 bp, Homo sapien
ttcctggacacctgatgatctgctt

SEQ ID NO: 392807 - DNA, 25 bp, Homo sapien
tgatgatctgcttgtgatgggctca

SEQ ID NO: 392808 - DNA, 25 bp, Homo sapien
tgtgatgggctcagagtcttgaaac

SEQ ID NO: 392809 - DNA, 25 bp, Homo sapien
gaaacacagaactatgagctcatct

SEQ ID NO: 392810 - DNA, 25 bp, Homo sapien
tgagctcatctcatatcccaatcca

SEQ ID NO: 392811 - DNA, 25 bp, Homo sapien
tcatatcccaatccagcagcatgga

SEQ ID NO: 392812 - DNA, 25 bp, Homo sapien
gaaacctcagactgcaaggcccaag

SEQ ID NO: 392813 - DNA, 25 bp, Homo sapien
cagcagggtttagagcagcacgaaa

SEQ ID NO: 392814 - DNA, 25 bp, Homo sapien
gcacgaaaagtgaactgaccctgga

SEQ ID NO: 392815 - DNA, 25 bp, Homo sapien
aaatggtaatcttctcatctgtgag

SEQ ID NO: 392816 - DNA, 25 bp, Homo sapien
agagatgatgtttccttgactgagc

SEQ ID NO: 392817 - DNA, 25 bp, Homo sapien
gtttccttgactgagcatcttgaga

SEQ ID NO: 392818 - DNA, 25 bp, Homo sapien
ccttgactgagcatcttgagaaatc

SEQ ID NO: 392819 - DNA, 25 bp, Homo sapien
tagttgacaattagacatgaggaga

SEQ ID NO: 392820 - DNA, 25 bp, Homo sapien
gagaatagagagctagaagaccttg

SEQ ID NO: 392821 - DNA, 25 bp, Homo sapien
gaagaccttgcataaactgattgac

SEQ ID NO: 392822 - DNA, 25 bp, Homo sapien
gaccttgcataaactgattgaccaa

SEQ ID NO: 392823 - DNA, 25 bp, Homo sapien
gatacactaatcatgtctacaggaa

SEQ ID NO: 392824 - DNA, 25 bp, Homo sapien
actaatcatgtctacaggaacagaa

SEQ ID NO: 392825 - DNA, 25 bp, Homo sapien
aaaggcaggaagattacgaatggct

SEQ ID NO: 392826 - DNA, 25 bp, Homo sapien
attacgaatggcttctactctctgg

SEQ ID NO: 392827 - DNA, 25 bp, Homo sapien
agagcacaatgttcaaaccaatgga

SEQ ID NO: 392828 - DNA, 25 bp, Homo sapien
gccagaatttttcagtagctctcac

SEQ ID NO: 392829 - DNA, 25 bp, Homo sapien
agtagctctcactctttcttgtatg

SEQ ID NO: 392830 - DNA, 25 bp, Homo sapien
gtatgacacttttcaaagggatgct

SEQ ID NO: 392831 - DNA, 25 bp, Homo sapien
ggatgctatttaaactgacctgttc

SEQ ID NO: 392832 - DNA, 25 bp, Homo sapien
tgacctgttctatgttgaataccta

SEQ ID NO: 392833 - DNA, 25 bp, Homo sapien
tgaatacctattttccagcttctgg

SEQ ID NO: 392834 - DNA, 25 bp, Homo sapien
tccagcttctggaaggccatgttca

SEQ ID NO: 392835 - DNA, 25 bp, Homo sapien
ggaaggccatgttcagatccatcat

SEQ ID NO: 392836 - DNA, 25 bp, Homo sapien
cagatccatcatagtattacacatt

SEQ ID NO: 392837 - DNA, 25 bp, Homo sapien
attattttgtttgcctgatgtttag

SEQ ID NO: 392838 - DNA, 25 bp, Homo sapien
gaacattccaacttctatgcctttg

SEQ ID NO: 392839 - DNA, 25 bp, Homo sapien
caacttctatgcctttgctcttgtg

SEQ ID NO: 392840 - DNA, 25 bp, Homo sapien
aatcaagtccaaaatctttgtctga

SEQ ID NO: 392841 - DNA, 25 bp, Homo sapien
gtgggctccctcatgtaattaggat

SEQ ID NO: 392842 - DNA, 25 bp, Homo sapien
ggataatttccagccaggtattccc

SEQ ID NO: 392843 - DNA, 25 bp, Homo sapien
ttccctcacccttgttttacaactg

SEQ ID NO: 392844 - DNA, 25 bp, Homo sapien
tttacaactgaatcccactttctct

SEQ ID NO: 392845 - DNA, 25 bp, Homo sapien
gggactccactgcttggtcactctg

SEQ ID NO: 392846 - DNA, 25 bp, Homo sapien
actctgccctgtgctttgagaggag

SEQ ID NO: 392847 - DNA, 25 bp, Homo sapien
ggcttttgcaaataggatcccatac

SEQ ID NO: 392848 - DNA, 25 bp, Homo sapien
aataggatcccatacatcttccagc

SEQ ID NO: 392849 - DNA, 25 bp, Homo sapien
ctttcctcttgtgttaggaccatga

SEQ ID NO: 392850 - DNA, 25 bp, Homo sapien
aggaccatgacctcattaagctcat

SEQ ID NO: 392851 - DNA, 25 bp, Homo sapien
gacctcattaagctcatgttgttca

SEQ ID NO: 392852 - DNA, 25 bp, Homo sapien
atgttgttcacagcactggtccttc

SEQ ID NO: 392853 - DNA, 25 bp, Homo sapien
tatcgcccaacacaaacacctaggt

SEQ ID NO: 392854 - DNA, 25 bp, Homo sapien
ctagctctcagattttccatgattt

SEQ ID NO: 392855 - DNA, 25 bp, Homo sapien
gattttctcatatcagtatgtttcc

SEQ ID NO: 392856 - DNA, 25 bp, Homo sapien
gtatgtttccatctagacaatgatc

SEQ ID NO: 392857 - DNA, 25 bp, Homo sapien
ctaggtttcctaatttatttcatga

SEQ ID NO: 392858 - DNA, 25 bp, Homo sapien
ggagcaaggctctagggtattaaaa

SEQ ID NO: 392859 - DNA, 25 bp, Homo sapien
agggtattaaaaccagcacttcaga

SEQ ID NO: 392860 - DNA, 25 bp, Homo sapien
ttctgtctccgacatgcccctggga

SEQ ID NO: 392861 - DNA, 25 bp, Homo sapien
ctccgacatgcccctgggaacggaa

SEQ ID NO: 392862 - DNA, 25 bp, Homo sapien
acccgatcgtacattagttctattc

SEQ ID NO: 392863 - DNA, 25 bp, Homo sapien
cccgatcgtacattagttctattct

SEQ ID NO: 392864 - DNA, 25 bp, Homo sapien
ccgatcgtacattagttctattctg

SEQ ID NO: 392865 - DNA, 25 bp, Homo sapien
gcggcaatgctgctctgttactctg

SEQ ID NO: 392866 - DNA, 25 bp, Homo sapien
cggcaatgctgctctgttactctgc

SEQ ID NO: 392867 - DNA, 25 bp, Homo sapien
ggcaatgctgctctgttactctgct

SEQ ID NO: 392868 - DNA, 25 bp, Homo sapien
gcaatgctgctctgttactctgcta

SEQ ID NO: 392869 - DNA, 25 bp, Homo sapien
caatgctgctctgttactctgctac

SEQ ID NO: 392870 - DNA, 25 bp, Homo sapien
aatgctgctctgttactctgctaca

SEQ ID NO: 392871 - DNA, 25 bp, Homo sapien
agcgcaaagaggacgccccagagga

SEQ ID NO: 392872 - DNA, 25 bp, Homo sapien
cggacagagcagatggtctcgtcct

SEQ ID NO: 392873 - DNA, 25 bp, Homo sapien
gacagagcagatggtctcgtcctcc

SEQ ID NO: 392874 - DNA, 25 bp, Homo sapien
agagcagatggtctcgtcctcctgg

SEQ ID NO: 392875 - DNA, 25 bp, Homo sapien
agcagatggtctcgtcctcctggat

SEQ ID NO: 392876 - DNA, 25 bp, Homo sapien
agatggtctcgtcctcctggatgat

SEQ ID NO: 392877 - DNA, 25 bp, Homo sapien
atggtctcgtcctcctggatgatga

SEQ ID NO: 392878 - DNA, 25 bp, Homo sapien
atgaaggcaaacgtcagcccaaaga

SEQ ID NO: 392879 - DNA, 25 bp, Homo sapien
aggcaaacgtcagcccaaagaggcc

SEQ ID NO: 392880 - DNA, 25 bp, Homo sapien
tctccttgatgaagggcagccgcac

SEQ ID NO: 392881 - DNA, 25 bp, Homo sapien
agcaggcaggagaagcagagcgcaa

SEQ ID NO: 392882 - DNA, 25 bp, Homo sapien
atgaatgcatctcttaaacctgtac

SEQ ID NO: 392883 - DNA, 25 bp, Homo sapien
gaatgcatctcttaaacctgtacca

SEQ ID NO: 392884 - DNA, 25 bp, Homo sapien
aatgcatctcttaaacctgtaccat

SEQ ID NO: 392885 - DNA, 25 bp, Homo sapien
tgcatctcttaaacctgtaccatta

SEQ ID NO: 392886 - DNA, 25 bp, Homo sapien
gcatctcttaaacctgtaccattaa

SEQ ID NO: 392887 - DNA, 25 bp, Homo sapien
tctcttaaacctgtaccattaattt

SEQ ID NO: 392888 - DNA, 25 bp, Homo sapien
gataaaatatgcctcatttcactag

SEQ ID NO: 392889 - DNA, 25 bp, Homo sapien
cctcatttcactagaattttaagaa

SEQ ID NO: 392890 - DNA, 25 bp, Homo sapien
aaatatccacaatatcttctttgat

SEQ ID NO: 392891 - DNA, 25 bp, Homo sapien
atatcttctttgattttcatgtaac

SEQ ID NO: 392892 - DNA, 25 bp, Homo sapien
atcttctttgattttcatgtaacac

SEQ ID NO: 392893 - DNA, 25 bp, Homo sapien
tctcctctgcacattgctgtttctg

SEQ ID NO: 392894 - DNA, 25 bp, Homo sapien
tctgcacattgctgtttctgcccct

SEQ ID NO: 392895 - DNA, 25 bp, Homo sapien
cctctttctcagcagagctgtagct

SEQ ID NO: 392896 - DNA, 25 bp, Homo sapien
agagctgtagctgactgtggcatta

SEQ ID NO: 392897 - DNA, 25 bp, Homo sapien
agctgtagctgactgtggcattact

SEQ ID NO: 392898 - DNA, 25 bp, Homo sapien
agctgactgtggcattactacgcct

SEQ ID NO: 392899 - DNA, 25 bp, Homo sapien
tgactgtggcattactacgcctccc

SEQ ID NO: 392900 - DNA, 25 bp, Homo sapien
tagcagagaatacctttgaaccaag

SEQ ID NO: 392901 - DNA, 25 bp, Homo sapien
atacctttgaaccaagattctgttt

SEQ ID NO: 392902 - DNA, 25 bp, Homo sapien
ctttgaaccaagattctgttttaat

SEQ ID NO: 392903 - DNA, 25 bp, Homo sapien
gttttaatcatcatttacattgttt

SEQ ID NO: 392904 - DNA, 25 bp, Homo sapien
atgccttccaggatgaacaaaggca

SEQ ID NO: 392905 - DNA, 25 bp, Homo sapien
aacaaaggcagaccagctccgaggg

SEQ ID NO: 392906 - DNA, 25 bp, Homo sapien
gagctccctggctgacatctctttg

SEQ ID NO: 392907 - DNA, 25 bp, Homo sapien
tggctgacatctctttgttctccag

SEQ ID NO: 392908 - DNA, 25 bp, Homo sapien
ttgttctccagctgtctcaaattca

SEQ ID NO: 392909 - DNA, 25 bp, Homo sapien
ttctccagctgtctcaaattcacac

SEQ ID NO: 392910 - DNA, 25 bp, Homo sapien
aaattcacacctctgtacagggcaa

SEQ ID NO: 392911 - DNA, 25 bp, Homo sapien
ttcacacctctgtacagggcaaagt

SEQ ID NO: 392912 - DNA, 25 bp, Homo sapien
acacctctgtacagggcaaagtttt

SEQ ID NO: 392913 - DNA, 25 bp, Homo sapien
cagggcaaagttttcccacaggagc

SEQ ID NO: 392914 - DNA, 25 bp, Homo sapien
gagcccccctactgatgctgggagc

SEQ ID NO: 392915 - DNA, 25 bp, Homo sapien
gctgagatggcaagaagccgtcttt

SEQ ID NO: 392916 - DNA, 25 bp, Homo sapien
ctgagatggcaagaagccgtctttt

SEQ ID NO: 392917 - DNA, 25 bp, Homo sapien
gagatggcaagaagccgtcttttat

SEQ ID NO: 392918 - DNA, 25 bp, Homo sapien
agatggcaagaagccgtcttttata

SEQ ID NO: 392919 - DNA, 25 bp, Homo sapien
tggcaagaagccgtcttttatagaa

SEQ ID NO: 392920 - DNA, 25 bp, Homo sapien
ggcaagaagccgtcttttatagaaa

SEQ ID NO: 392921 - DNA, 25 bp, Homo sapien
aagaagccgtcttttatagaaactg

SEQ ID NO: 392922 - DNA, 25 bp, Homo sapien
gaagccgtcttttatagaaactgtc

SEQ ID NO: 392923 - DNA, 25 bp, Homo sapien
agccgtcttttatagaaactgtctc

SEQ ID NO: 392924 - DNA, 25 bp, Homo sapien
ccgtcttttatagaaactgtctctg

SEQ ID NO: 392925 - DNA, 25 bp, Homo sapien
gccgaaggccgtgggtcatgcctgt

SEQ ID NO: 392926 - DNA, 25 bp, Homo sapien
agaagttttataacagctggcctgt

SEQ ID NO: 392927 - DNA, 25 bp, Homo sapien
acagctggcctgtagctacattata

SEQ ID NO: 392928 - DNA, 25 bp, Homo sapien
gtagctacattataacttcggtaat

SEQ ID NO: 392929 - DNA, 25 bp, Homo sapien
attaagtgacaaaactggtctcatt

SEQ ID NO: 392930 - DNA, 25 bp, Homo sapien
gtgctttccagaattaatacttatc

SEQ ID NO: 392931 - DNA, 25 bp, Homo sapien
aaatcaacctacctgaattctggac

SEQ ID NO: 392932 - DNA, 25 bp, Homo sapien
gaattctggactcttcaatcatgag

SEQ ID NO: 392933 - DNA, 25 bp, Homo sapien
caatcatgagtagccattttacaaa

SEQ ID NO: 392934 - DNA, 25 bp, Homo sapien
ggtctcatttcccaaacagtacttt

SEQ ID NO: 392935 - DNA, 25 bp, Homo sapien
aaacagtactttaaatatcatccta

SEQ ID NO: 392936 - DNA, 25 bp, Homo sapien
aatcctattaatactcacttcaatg

SEQ ID NO: 392937 - DNA, 25 bp, Homo sapien
gtacctgacatgtagtagatactta

SEQ ID NO: 392938 - DNA, 25 bp, Homo sapien
aattatgatctttcccaaagttctg

SEQ ID NO: 392939 - DNA, 25 bp, Homo sapien
ttcccaaagttctgacttcattcta

SEQ ID NO: 392940 - DNA, 25 bp, Homo sapien
ttctgacttcattctaagacagggt

SEQ ID NO: 392941 - DNA, 25 bp, Homo sapien
aagacagggttagtatctccataca

SEQ ID NO: 392942 - DNA, 25 bp, Homo sapien
gggttagtatctccatacataattt

SEQ ID NO: 392943 - DNA, 25 bp, Homo sapien
cacagtctttgtctgttgcattcat

SEQ ID NO: 392944 - DNA, 25 bp, Homo sapien
gttgcattcattgctgtatctctag

SEQ ID NO: 392945 - DNA, 25 bp, Homo sapien
attgctgtatctctagcacccagta

SEQ ID NO: 392946 - DNA, 25 bp, Homo sapien
gtatctctagcacccagtacagtac

SEQ ID NO: 392947 - DNA, 25 bp, Homo sapien
gcacccagtacagtacctgacatgt

SEQ ID NO: 392948 - DNA, 25 bp, Homo sapien
tggattcgtgacgtgagggtcaact

SEQ ID NO: 392949 - DNA, 25 bp, Homo sapien
attcgtgacgtgagggtcaactcct

SEQ ID NO: 392950 - DNA, 25 bp, Homo sapien
gtgacgtgagggtcaactcctcgca

SEQ ID NO: 392951 - DNA, 25 bp, Homo sapien
acgtgagggtcaactcctcgcaggt

SEQ ID NO: 392952 - DNA, 25 bp, Homo sapien
tgagggtcaactcctcgcaggtcct

SEQ ID NO: 392953 - DNA, 25 bp, Homo sapien
agggtcaactcctcgcaggtcctgc

SEQ ID NO: 392954 - DNA, 25 bp, Homo sapien
tgcccgtggacagcggcgaggtgaa

SEQ ID NO: 392955 - DNA, 25 bp, Homo sapien
gtgaagctggacgatgagccgccca

SEQ ID NO: 392956 - DNA, 25 bp, Homo sapien
tgaagctggacgatgagccgcccaa

SEQ ID NO: 392957 - DNA, 25 bp, Homo sapien
gaagctggacgatgagccgcccaac

SEQ ID NO: 392958 - DNA, 25 bp, Homo sapien
agctggacgatgagccgcccaacag

SEQ ID NO: 392959 - DNA, 25 bp, Homo sapien
ttctgtctccgacatgcccctggga

SEQ ID NO: 392960 - DNA, 25 bp, Homo sapien
cgacatgcccctgggaacggaatgt

SEQ ID NO: 392961 - DNA, 25 bp, Homo sapien
gaatgtctccgtgtaaaacccgatc

SEQ ID NO: 392962 - DNA, 25 bp, Homo sapien
tgtctccgtgtaaaacccgatcgta

SEQ ID NO: 392963 - DNA, 25 bp, Homo sapien
acccgatcgtacattagttctattc

SEQ ID NO: 392964 - DNA, 25 bp, Homo sapien
ccgatcgtacattagttctattctg

SEQ ID NO: 392965 - DNA, 25 bp, Homo sapien
acattagttctattctgagacagga

SEQ ID NO: 392966 - DNA, 25 bp, Homo sapien
gcggcaatgctgctctgttactctg

SEQ ID NO: 392967 - DNA, 25 bp, Homo sapien
gcaatgctgctctgttactctgcta

SEQ ID NO: 392968 - DNA, 25 bp, Homo sapien
aatgctgctctgttactctgctaca

SEQ ID NO: 392969 - DNA, 25 bp, Homo sapien
tctgttactctgctacactgagatg

SEQ ID NO: 392970 - DNA, 25 bp, Homo sapien
gggcctcctcccaaggagaacatga

SEQ ID NO: 392971 - DNA, 25 bp, Homo sapien
gaccacttcatatctggaactctag

SEQ ID NO: 392972 - DNA, 25 bp, Homo sapien
ggaactctagaaacactggctgcag

SEQ ID NO: 392973 - DNA, 25 bp, Homo sapien
tgcagcaatcaacctcctgtgccaa

SEQ ID NO: 392974 - DNA, 25 bp, Homo sapien
tggccccactcttgtagcatggaca

SEQ ID NO: 392975 - DNA, 25 bp, Homo sapien
agcatggacactgctagctgggttc

SEQ ID NO: 392976 - DNA, 25 bp, Homo sapien
agttgccagcgctgggtgacctcga

SEQ ID NO: 392977 - DNA, 25 bp, Homo sapien
gggtgacctcgagcaagtgactact

SEQ ID NO: 392978 - DNA, 25 bp, Homo sapien
gtgactactcctcactggattgtag

SEQ ID NO: 392979 - DNA, 25 bp, Homo sapien
gtcattatttacagttcaccacacg

SEQ ID NO: 392980 - DNA, 25 bp, Homo sapien
ccctggatcctcaaaataacctcat

SEQ ID NO: 392981 - DNA, 25 bp, Homo sapien
agcatgtattatggccaaataacat

SEQ ID NO: 392982 - DNA, 25 bp, Homo sapien
tccattttatggatataccaccttc

SEQ ID NO: 392983 - DNA, 25 bp, Homo sapien
atggatataccaccttcatcaactg

SEQ ID NO: 392984 - DNA, 25 bp, Homo sapien
gatataccaccttcatcaactgatg

SEQ ID NO: 392985 - DNA, 25 bp, Homo sapien
taccaccttcatcaactgatggaca

SEQ ID NO: 392986 - DNA, 25 bp, Homo sapien
accttcatcaactgatggacatagg

SEQ ID NO: 392987 - DNA, 25 bp, Homo sapien
catacattcatacatgagctttaga

SEQ ID NO: 392988 - DNA, 25 bp, Homo sapien
attcatacatgagctttagagtgga

SEQ ID NO: 392989 - DNA, 25 bp, Homo sapien
catacatgagctttagagtggatat

SEQ ID NO: 392990 - DNA, 25 bp, Homo sapien
agtggatatgtgttttcagctctct

SEQ ID NO: 392991 - DNA, 25 bp, Homo sapien
tcagctctctgggatataaaagagt

SEQ ID NO: 392992 - DNA, 25 bp, Homo sapien
tcccgaggatttgctcctggctctt

SEQ ID NO: 392993 - DNA, 25 bp, Homo sapien
ggacctcctgaacctgttggttgca

SEQ ID NO: 392994 - DNA, 25 bp, Homo sapien
tagagggaggtaaggccccatgatt

SEQ ID NO: 392995 - DNA, 25 bp, Homo sapien
gaggtaaggccccatgattcctagg

SEQ ID NO: 392996 - DNA, 25 bp, Homo sapien
aaggccccatgattcctagggagga

SEQ ID NO: 392997 - DNA, 25 bp, Homo sapien
tgattcctagggaggagccctgagc

SEQ ID NO: 392998 - DNA, 25 bp, Homo sapien
gaggaatgtggcctcatccttcctt

SEQ ID NO: 392999 - DNA, 25 bp, Homo sapien
ggacctgttgagaattcccacctgt

SEQ ID NO: 393000 - DNA, 25 bp, Homo sapien
gttgagaattcccacctgtttagag

SEQ ID NO: 393001 - DNA, 25 bp, Homo sapien
gaattcccacctgtttagaggcaga

SEQ ID NO: 393002 - DNA, 25 bp, Homo sapien
ccacctgtttagaggcagatggttt

SEQ ID NO: 393003 - DNA, 25 bp, Homo sapien
aatacgatcccaggattaacacttg

SEQ ID NO: 393004 - DNA, 25 bp, Homo sapien
gattaacacttggtagcaggcacag

SEQ ID NO: 393005 - DNA, 25 bp, Homo sapien
ggtagcaggcacagttatctcacag

SEQ ID NO: 393006 - DNA, 25 bp, Homo sapien
gcaggcacagttatctcacagaata

SEQ ID NO: 393007 - DNA, 25 bp, Homo sapien
cagaatatatgtttggagggccagg

SEQ ID NO: 393008 - DNA, 25 bp, Homo sapien
aaatccacagcagtgcaagtagggt

SEQ ID NO: 393009 - DNA, 25 bp, Homo sapien
acagcagtgcaagtagggtcaggaa

SEQ ID NO: 393010 - DNA, 25 bp, Homo sapien
aatgtccaaggttctctaatcacaa

SEQ ID NO: 393011 - DNA, 25 bp, Homo sapien
ggttctctaatcacaatcaaatcaa

SEQ ID NO: 393012 - DNA, 25 bp, Homo sapien
attctgaaaatatcttgcctttttt

SEQ ID NO: 393013 - DNA, 25 bp, Homo sapien
ttattaatcatgtcatctaacacca

SEQ ID NO: 393014 - DNA, 25 bp, Homo sapien
catgaagatgttgacttgatacaat

SEQ ID NO: 393015 - DNA, 25 bp, Homo sapien
gacttgatacaatataatacctata

SEQ ID NO: 393016 - DNA, 25 bp, Homo sapien
tgcttgagtagtcattgcactgctt

SEQ ID NO: 393017 - DNA, 25 bp, Homo sapien
gtagtcattgcactgcttgatcctc

SEQ ID NO: 393018 - DNA, 25 bp, Homo sapien
tcacagcaatcctctggtctcagtt

SEQ ID NO: 393019 - DNA, 25 bp, Homo sapien
gcaatcctctggtctcagttttctt

SEQ ID NO: 393020 - DNA, 25 bp, Homo sapien
gttttcttttctgatatggtgatgc

SEQ ID NO: 393021 - DNA, 25 bp, Homo sapien
gtgatgctaattcctaccttactgg

SEQ ID NO: 393022 - DNA, 25 bp, Homo sapien
gctaattcctaccttactgggttat

SEQ ID NO: 393023 - DNA, 25 bp, Homo sapien
actgggttattatatacaatatcag

SEQ ID NO: 393024 - DNA, 25 bp, Homo sapien
atatcaggacatgtaacttgttcat

SEQ ID NO: 393025 - DNA, 25 bp, Homo sapien
tcatcctgaaagtatagtttggtgc

SEQ ID NO: 393026 - DNA, 25 bp, Homo sapien
tcctgaaagtatagtttggtgcgat

SEQ ID NO: 393027 - DNA, 25 bp, Homo sapien
aagtatagtttggtgcgattctgtt

SEQ ID NO: 393028 - DNA, 25 bp, Homo sapien
gtatagtttggtgcgattctgttga

SEQ ID NO: 393029 - DNA, 25 bp, Homo sapien
atagtttggtgcgattctgttgaga

SEQ ID NO: 393030 - DNA, 25 bp, Homo sapien
agtttggtgcgattctgttgagatg

SEQ ID NO: 393031 - DNA, 25 bp, Homo sapien
ttggtgcgattctgttgagatggct

SEQ ID NO: 393032 - DNA, 25 bp, Homo sapien
ggtgcgattctgttgagatggctct

SEQ ID NO: 393033 - DNA, 25 bp, Homo sapien
gtgcgattctgttgagatggctctt

SEQ ID NO: 393034 - DNA, 25 bp, Homo sapien
gcgattctgttgagatggctcttcc

SEQ ID NO: 393035 - DNA, 25 bp, Homo sapien
cgattctgttgagatggctcttccc

SEQ ID NO: 393036 - DNA, 25 bp, Homo sapien
acctgctcctatctatggacttcat

SEQ ID NO: 393037 - DNA, 25 bp, Homo sapien
ggacttcattttagtcaccatggag

SEQ ID NO: 393038 - DNA, 25 bp, Homo sapien
catatattcgatgatctgctcacat

SEQ ID NO: 393039 - DNA, 25 bp, Homo sapien
tgctctctacctacttcttggtatt

SEQ ID NO: 393040 - DNA, 25 bp, Homo sapien
tggtattccgaattgttcagttaat

SEQ ID NO: 393041 - DNA, 25 bp, Homo sapien
gaaggccttttctgaagggatatct

SEQ ID NO: 393042 - DNA, 25 bp, Homo sapien
ataggaaatccttggttcagaggga

SEQ ID NO: 393043 - DNA, 25 bp, Homo sapien
aagtgggtctgcttcatggttgtta

SEQ ID NO: 393044 - DNA, 25 bp, Homo sapien
gcagcagactgctctgggtcagtga

SEQ ID NO: 393045 - DNA, 25 bp, Homo sapien
tgctctgggtcagtgacaactgtac

SEQ ID NO: 393046 - DNA, 25 bp, Homo sapien
acatcaggagattgtgttgttttct

SEQ ID NO: 393047 - DNA, 25 bp, Homo sapien
gtctggtcacttttggcagttaagt

SEQ ID NO: 393048 - DNA, 25 bp, Homo sapien
ggctgcaagaggcaccttgtgactt

SEQ ID NO: 393049 - DNA, 25 bp, Homo sapien
gtgacttaaaaatctctccctgaat

SEQ ID NO: 393050 - DNA, 25 bp, Homo sapien
tccctgaatatctctgtcaccttga

SEQ ID NO: 393051 - DNA, 25 bp, Homo sapien
tgtcaccttgatatgaatgtcctgt

SEQ ID NO: 393052 - DNA, 25 bp, Homo sapien
gtcctgtttcatttgtgaatctctg

SEQ ID NO: 393053 - DNA, 25 bp, Homo sapien
tttgtgaatctctgtcctacactgc

SEQ ID NO: 393054 - DNA, 25 bp, Homo sapien
agagatgaattgtcctttcctccat

SEQ ID NO: 393055 - DNA, 25 bp, Homo sapien
tccattcttgaggtcattgctatta

SEQ ID NO: 393056 - DNA, 25 bp, Homo sapien
gtgtgtaccatctcctgcattgtag

SEQ ID NO: 393057 - DNA, 25 bp, Homo sapien
gcattgtaggatgttcagcattttt

SEQ ID NO: 393058 - DNA, 25 bp, Homo sapien
tcccaggaattcgtctggttgatag

SEQ ID NO: 393059 - DNA, 25 bp, Homo sapien
gaattcgtctggttgatagcaccca

SEQ ID NO: 393060 - DNA, 25 bp, Homo sapien
attcgtctggttgatagcacccaaa

SEQ ID NO: 393061 - DNA, 25 bp, Homo sapien
gtctggttgatagcacccaaagccc

SEQ ID NO: 393062 - DNA, 25 bp, Homo sapien
ttcctgttaccatttatctttttca

SEQ ID NO: 393063 - DNA, 25 bp, Homo sapien
atctttttcactttcttgcctgttt

SEQ ID NO: 393064 - DNA, 25 bp, Homo sapien
tgtaaaattgcttcagctcggctcc

SEQ ID NO: 393065 - DNA, 25 bp, Homo sapien
taaaattgcttcagctcggctccct

SEQ ID NO: 393066 - DNA, 25 bp, Homo sapien
aattgcttcagctcggctccctctt

SEQ ID NO: 393067 - DNA, 25 bp, Homo sapien
aattttgagcgctagccgtctctca

SEQ ID NO: 393068 - DNA, 25 bp, Homo sapien
ttttgagcgctagccgtctctcagt

SEQ ID NO: 393069 - DNA, 25 bp, Homo sapien
tggagacaaaagttactaccacttg

SEQ ID NO: 393070 - DNA, 25 bp, Homo sapien
gttactaccacttgagaccattgct

SEQ ID NO: 393071 - DNA, 25 bp, Homo sapien
gagaccattgctctagaagttgtat

SEQ ID NO: 393072 - DNA, 25 bp, Homo sapien
ttaggttcatgacttatttgtgtat

SEQ ID NO: 393073 - DNA, 25 bp, Homo sapien
ggatatccaagtgtttcatcaccat

SEQ ID NO: 393074 - DNA, 25 bp, Homo sapien
aagtgtttcatcaccatttgttgaa

SEQ ID NO: 393075 - DNA, 25 bp, Homo sapien
gaaaagactactttctcaaatgaat

SEQ ID NO: 393076 - DNA, 25 bp, Homo sapien
aaatgaattacctttgcactattgt

SEQ ID NO: 393077 - DNA, 25 bp, Homo sapien
atatttatggatgctctgctctgct

SEQ ID NO: 393078 - DNA, 25 bp, Homo sapien
tgctctgttctgatgatctatgtat

SEQ ID NO: 393079 - DNA, 25 bp, Homo sapien
atctatgtatcctttctccaatacc

SEQ ID NO: 393080 - DNA, 25 bp, Homo sapien
aaacacaggatagtcttcttggccc

SEQ ID NO: 393081 - DNA, 25 bp, Homo sapien
aggatagtcttcttggccctacctg

SEQ ID NO: 393082 - DNA, 25 bp, Homo sapien
gccctacctgttggtgccaatggaa

SEQ ID NO: 393083 - DNA, 25 bp, Homo sapien
aggataattcttagggccagggcac

SEQ ID NO: 393084 - DNA, 25 bp, Homo sapien
tagggccagggcacaagtgtcctga

SEQ ID NO: 393085 - DNA, 25 bp, Homo sapien
agggcacaagtgtcctgagttcccc

SEQ ID NO: 393086 - DNA, 25 bp, Homo sapien
gcaatgaaccgagatcacatcattg

SEQ ID NO: 393087 - DNA, 25 bp, Homo sapien
tgagttccccctgccagtgtggaaa

SEQ ID NO: 393088 - DNA, 25 bp, Homo sapien
aaaaccacagatgcactggacggtg

SEQ ID NO: 393089 - DNA, 25 bp, Homo sapien
tgctggctccccaattcctggtttt

SEQ ID NO: 393090 - DNA, 25 bp, Homo sapien
gggacctctaagatggccccaatgt

SEQ ID NO: 393091 - DNA, 25 bp, Homo sapien
aagctgagcagcctccctttccaga

SEQ ID NO: 393092 - DNA, 25 bp, Homo sapien
gctgagcagcctccctttccagaag

SEQ ID NO: 393093 - DNA, 25 bp, Homo sapien
ccctttccagaaggatataaagtca

SEQ ID NO: 393094 - DNA, 25 bp, Homo sapien
aacaggagcctgtgattacggttgc

SEQ ID NO: 393095 - DNA, 25 bp, Homo sapien
caggagcctgtgattacggttgcgc

SEQ ID NO: 393096 - DNA, 25 bp, Homo sapien
aggagcctgtgattacggttgcgcc

SEQ ID NO: 393097 - DNA, 25 bp, Homo sapien
ggagcctgtgattacggttgcgcca

SEQ ID NO: 393098 - DNA, 25 bp, Homo sapien
gagcctgtgattacggttgcgccag

SEQ ID NO: 393099 - DNA, 25 bp, Homo sapien
agcctgtgattacggttgcgccagt

SEQ ID NO: 393100 - DNA, 25 bp, Homo sapien
cctgtgattacggttgcgccagtag

SEQ ID NO: 393101 - DNA, 25 bp, Homo sapien
ctgtgattacggttgcgccagtaga

SEQ ID NO: 393102 - DNA, 25 bp, Homo sapien
agatgtatacatcaaatgcaacttg

SEQ ID NO: 393103 - DNA, 25 bp, Homo sapien
atgcaacttgattttactggctctt

SEQ ID NO: 393104 - DNA, 25 bp, Homo sapien
gattttactggctctttatctagag

SEQ ID NO: 393105 - DNA, 25 bp, Homo sapien
gataactgatgcactgtcttctttc

SEQ ID NO: 393106 - DNA, 25 bp, Homo sapien
gatacccttctgtaattcagcttgg

SEQ ID NO: 393107 - DNA, 25 bp, Homo sapien
gtaattcagcttggcatagtatgat

SEQ ID NO: 393108 - DNA, 25 bp, Homo sapien
tgttttgagttcttattgagggttt

SEQ ID NO: 393109 - DNA, 25 bp, Homo sapien
acatttgtcatcaattttatgtcta

SEQ ID NO: 393110 - DNA, 25 bp, Homo sapien
ttatgtctactctattgaaaaagca

SEQ ID NO: 393111 - DNA, 25 bp, Homo sapien
caatgtattccatatttcttagctc

SEQ ID NO: 393112 - DNA, 25 bp, Homo sapien
gctacaattttgagtattcaccaga

SEQ ID NO: 393113 - DNA, 25 bp, Homo sapien
atgcacgcttgagaatggagattta

SEQ ID NO: 393114 - DNA, 25 bp, Homo sapien
tcactatattcaggtacatggtagg

SEQ ID NO: 393115 - DNA, 25 bp, Homo sapien
tcaggtacatggtaggatcaacttc

SEQ ID NO: 393116 - DNA, 25 bp, Homo sapien
tggtaggatcaacttcctgaccttg

SEQ ID NO: 393117 - DNA, 25 bp, Homo sapien
atcaacttcctgaccttgtgacaga

SEQ ID NO: 393118 - DNA, 25 bp, Homo sapien
aaatgagaacgaggctttggagcac

SEQ ID NO: 393119 - DNA, 25 bp, Homo sapien
gaacgaggctttggagcacagcatt

SEQ ID NO: 393120 - DNA, 25 bp, Homo sapien
agcacagcattggattgctcatgca

SEQ ID NO: 393121 - DNA, 25 bp, Homo sapien
gattgctcatgcagaacaccaccca

SEQ ID NO: 393122 - DNA, 25 bp, Homo sapien
tgggactggcaatactggctctgtg

SEQ ID NO: 393123 - DNA, 25 bp, Homo sapien
tgtgggctgtgacatctcatccatc

SEQ ID NO: 393124 - DNA, 25 bp, Homo sapien
tgcctgggatgcagctccgtggcta

SEQ ID NO: 393125 - DNA, 25 bp, Homo sapien
atgcagctccgtggctaagtaggga

SEQ ID NO: 393126 - DNA, 25 bp, Homo sapien
tccgtggctaagtagggatccccag

SEQ ID NO: 393127 - DNA, 25 bp, Homo sapien
ggctaagtagggatccccagtgact

SEQ ID NO: 393128 - DNA, 25 bp, Homo sapien
agtgactggccccaaatatccccta

SEQ ID NO: 393129 - DNA, 25 bp, Homo sapien
aaatatcccctaagactgaccctcg

SEQ ID NO: 393130 - DNA, 25 bp, Homo sapien
taagactgaccctcgttctgcagcc

SEQ ID NO: 393131 - DNA, 25 bp, Homo sapien
aggctcaccgcgcaggcaggaagca

SEQ ID NO: 393132 - DNA, 25 bp, Homo sapien
agcagcggtagggttgaggcgccct

SEQ ID NO: 393133 - DNA, 25 bp, Homo sapien
caccacgagtggtttctgacctctt

SEQ ID NO: 393134 - DNA, 25 bp, Homo sapien
acgagtggtttctgacctcttcctg

SEQ ID NO: 393135 - DNA, 25 bp, Homo sapien
aaatggttaaacttctgcactttct

SEQ ID NO: 393136 - DNA, 25 bp, Homo sapien
acttctgcactttcttagttaccac

SEQ ID NO: 393137 - DNA, 25 bp, Homo sapien
tagttaccacagtcttcataccaag

SEQ ID NO: 393138 - DNA, 25 bp, Homo sapien
acagtcttcataccaagtattgggt

SEQ ID NO: 393139 - DNA, 25 bp, Homo sapien
gtacaggttacaattttgaagccat

SEQ ID NO: 393140 - DNA, 25 bp, Homo sapien
tttagggcagccaatattttattat

SEQ ID NO: 393141 - DNA, 25 bp, Homo sapien
gagaccagtagattttcaatgggaa

SEQ ID NO: 393142 - DNA, 25 bp, Homo sapien
aaatgtacctagcaagctggttctt

SEQ ID NO: 393143 - DNA, 25 bp, Homo sapien
agctggttcttgcttatatatagtg

SEQ ID NO: 393144 - DNA, 25 bp, Homo sapien
ggaattcagacactgttcttaccgt

SEQ ID NO: 393145 - DNA, 25 bp, Homo sapien
cagacactgttcttaccgtgtttgt

SEQ ID NO: 393146 - DNA, 25 bp, Homo sapien
gaatttctcagttgaaggatgctta

SEQ ID NO: 393147 - DNA, 25 bp, Homo sapien
tcagttgaaggatgcttacactctt

SEQ ID NO: 393148 - DNA, 25 bp, Homo sapien
ttgaaggatgcttacactcttgtcc

SEQ ID NO: 393149 - DNA, 25 bp, Homo sapien
ttgtccatctagacctcaattactg

SEQ ID NO: 393150 - DNA, 25 bp, Homo sapien
ataatgtaagtgtgagatgaactca

SEQ ID NO: 393151 - DNA, 25 bp, Homo sapien
gagatgaactcacaagtcaatattt

SEQ ID NO: 393152 - DNA, 25 bp, Homo sapien
cagtatggcagtaagtcagccttat

SEQ ID NO: 393153 - DNA, 25 bp, Homo sapien
ggcagtaagtcagccttattctata

SEQ ID NO: 393154 - DNA, 25 bp, Homo sapien
aagtcagccttattctataaatgtg

SEQ ID NO: 393155 - DNA, 25 bp, Homo sapien
gccttattctataaatgtgagcact

SEQ ID NO: 393156 - DNA, 25 bp, Homo sapien
taaatgtgagcactatgttagaaat

SEQ ID NO: 393157 - DNA, 25 bp, Homo sapien
ctgtaatccaggctgcagtacactg

SEQ ID NO: 393158 - DNA, 25 bp, Homo sapien
atcggccctgtcatgtttttgaggt

SEQ ID NO: 393159 - DNA, 25 bp, Homo sapien
ctgcagtacactggcatgaccatgg

SEQ ID NO: 393160 - DNA, 25 bp, Homo sapien
tgaccatggctcactatagacttgg

SEQ ID NO: 393161 - DNA, 25 bp, Homo sapien
ctcactatagacttgggctcagcca

SEQ ID NO: 393162 - DNA, 25 bp, Homo sapien
gacttgggctcagccaatcttcctg

SEQ ID NO: 393163 - DNA, 25 bp, Homo sapien
tccccagggccatatgtcagcttat

SEQ ID NO: 393164 - DNA, 25 bp, Homo sapien
gggccatatgtcagcttatttaccc

SEQ ID NO: 393165 - DNA, 25 bp, Homo sapien
tatttaccctcctcacttggtgtct

SEQ ID NO: 393166 - DNA, 25 bp, Homo sapien
gtttttgaggttatccaggctgtat

SEQ ID NO: 393167 - DNA, 25 bp, Homo sapien
aggttatccaggctgtatatctctg

SEQ ID NO: 393168 - DNA, 25 bp, Homo sapien
atgcagatcctgagttcctgctgta

SEQ ID NO: 393169 - DNA, 25 bp, Homo sapien
gatcctgagttcctgctgtatgagc

SEQ ID NO: 393170 - DNA, 25 bp, Homo sapien
tgctgtatgagcagggatatccatg

SEQ ID NO: 393171 - DNA, 25 bp, Homo sapien
gatatccatgcttatgtatccaaac

SEQ ID NO: 393172 - DNA, 25 bp, Homo sapien
gtatccaaacacagagacccatggg

SEQ ID NO: 393173 - DNA, 25 bp, Homo sapien
gacccatgggaacaaatgagacaca

SEQ ID NO: 393174 - DNA, 25 bp, Homo sapien
agacacatatagatactgagacctg

SEQ ID NO: 393175 - DNA, 25 bp, Homo sapien
atagatactgagacctgtgtgtaca

SEQ ID NO: 393176 - DNA, 25 bp, Homo sapien
agacctgtgtgtacagtaggaccat

SEQ ID NO: 393177 - DNA, 25 bp, Homo sapien
gtacagtaggaccatgcactcacac

SEQ ID NO: 393178 - DNA, 25 bp, Homo sapien
cacacatatcacagttttcacacag

SEQ ID NO: 393179 - DNA, 25 bp, Homo sapien
taccaaagggcaaatcgagcttcag

SEQ ID NO: 393180 - DNA, 25 bp, Homo sapien
gagtcttgcctgaaagccagcacct

SEQ ID NO: 393181 - DNA, 25 bp, Homo sapien
gtgggctgaggtttggatctggttc

SEQ ID NO: 393182 - DNA, 25 bp, Homo sapien
gatctggttctgaagcacgttgttc

SEQ ID NO: 393183 - DNA, 25 bp, Homo sapien
ggttctgaagcacgttgttcttccc

SEQ ID NO: 393184 - DNA, 25 bp, Homo sapien
gcacgttgttcttccccgtggctgt

SEQ ID NO: 393185 - DNA, 25 bp, Homo sapien
tggctgtggctttgttcacattaga

SEQ ID NO: 393186 - DNA, 25 bp, Homo sapien
gctttgttcacattagaccacctga

SEQ ID NO: 393187 - DNA, 25 bp, Homo sapien
ttagaccacctgacaagtctgccca

SEQ ID NO: 393188 - DNA, 25 bp, Homo sapien
tcccgtctttactggataaaggtca

SEQ ID NO: 393189 - DNA, 25 bp, Homo sapien
aggcaccgggccgtgtgctttacac

SEQ ID NO: 393190 - DNA, 25 bp, Homo sapien
agaagctcgctgactggtggacaga

SEQ ID NO: 393191 - DNA, 25 bp, Homo sapien
gctcgctgactggtggacagactgt

SEQ ID NO: 393192 - DNA, 25 bp, Homo sapien
cgctgactggtggacagactgttcg

SEQ ID NO: 393193 - DNA, 25 bp, Homo sapien
gactgttcggcggagggcggctatg

SEQ ID NO: 393194 - DNA, 25 bp, Homo sapien
agggcggctatgataccctcccgta

SEQ ID NO: 393195 - DNA, 25 bp, Homo sapien
gtacactccttgagcagcaacacag

SEQ ID NO: 393196 - DNA, 25 bp, Homo sapien
tgagcagcaacacagcctgcagcgg

SEQ ID NO: 393197 - DNA, 25 bp, Homo sapien
accggtcggccagtgcctcttttct

SEQ ID NO: 393198 - DNA, 25 bp, Homo sapien
tctcctgccccacaagggagagcct

SEQ ID NO: 393199 - DNA, 25 bp, Homo sapien
agctgctggcaaaagcccctgagcc

SEQ ID NO: 393200 - DNA, 25 bp, Homo sapien
cctgcgtgggacaagctgggccact

SEQ ID NO: 393201 - DNA, 25 bp, Homo sapien
ttgcgaaaaacatgactctgagtcc

SEQ ID NO: 393202 - DNA, 25 bp, Homo sapien
cagagtattgtatagaccccttgaa

SEQ ID NO: 393203 - DNA, 25 bp, Homo sapien
gaaaagagattttacacatttataa

SEQ ID NO: 393204 - DNA, 25 bp, Homo sapien
agaattctcaaactagtataaccct

SEQ ID NO: 393205 - DNA, 25 bp, Homo sapien
caaactagtataaccctatttctct

SEQ ID NO: 393206 - DNA, 25 bp, Homo sapien
actagtataaccctatttctctata

SEQ ID NO: 393207 - DNA, 25 bp, Homo sapien
aaagacatcttgtaggcatgttcct

SEQ ID NO: 393208 - DNA, 25 bp, Homo sapien
tcttgtaggcatgttcctctgaagg

SEQ ID NO: 393209 - DNA, 25 bp, Homo sapien
ggcatgttcctctgaaggacttgag

SEQ ID NO: 393210 - DNA, 25 bp, Homo sapien
gcatgttcctctgaaggacttgaga

SEQ ID NO: 393211 - DNA, 25 bp, Homo sapien
atgttcctctgaaggacttgagaat

SEQ ID NO: 393212 - DNA, 25 bp, Homo sapien
gagtgaggaggccttcgccgcggat

SEQ ID NO: 393213 - DNA, 25 bp, Homo sapien
gccttcgccgcggatagggtaacag

SEQ ID NO: 393214 - DNA, 25 bp, Homo sapien
ttcgccgcggatagggtaacagccc

SEQ ID NO: 393215 - DNA, 25 bp, Homo sapien
ggatagggtaacagcccgccgccgc

SEQ ID NO: 393216 - DNA, 25 bp, Homo sapien
gttattatcgtcgtcactgatttcc

SEQ ID NO: 393217 - DNA, 25 bp, Homo sapien
ttatcgtcgtcactgatttccccat

SEQ ID NO: 393218 - DNA, 25 bp, Homo sapien
cgtcactgatttccccatcttcaag

SEQ ID NO: 393219 - DNA, 25 bp, Homo sapien
ttccttcggcgagaggccactggag

SEQ ID NO: 393220 - DNA, 25 bp, Homo sapien
ggccggagtatctgcggtcgccatc

SEQ ID NO: 393221 - DNA, 25 bp, Homo sapien
agcagcgccttccacacaaccttag

SEQ ID NO: 393222 - DNA, 25 bp, Homo sapien
ggatccgcccgacaattgcctcgtt

SEQ ID NO: 393223 - DNA, 25 bp, Homo sapien
atgttagtcatcgttattatattca

SEQ ID NO: 393224 - DNA, 25 bp, Homo sapien
gttattatattcatcatcatcagta

SEQ ID NO: 393225 - DNA, 25 bp, Homo sapien
gaaaggctttttaacttctgcagaa

SEQ ID NO: 393226 - DNA, 25 bp, Homo sapien
aacttctgcagaacttagtcaccat

SEQ ID NO: 393227 - DNA, 25 bp, Homo sapien
gcagaacttagtcaccattaggcag

SEQ ID NO: 393228 - DNA, 25 bp, Homo sapien
ccattaggcagggtgtttgactgaa

SEQ ID NO: 393229 - DNA, 25 bp, Homo sapien
gactgaagaaagaccctttgaaggt

SEQ ID NO: 393230 - DNA, 25 bp, Homo sapien
gtgtgaaggactttattccgactaa

SEQ ID NO: 393231 - DNA, 25 bp, Homo sapien
ggactttattccgactaatactctt

SEQ ID NO: 393232 - DNA, 25 bp, Homo sapien
gactaatactctttttgtcgcattt

SEQ ID NO: 393233 - DNA, 25 bp, Homo sapien
ttttgtcgcattttatacccagtaa

SEQ ID NO: 393234 - DNA, 25 bp, Homo sapien
tctgtagatacttatgcatgaacat

SEQ ID NO: 393235 - DNA, 25 bp, Homo sapien
gggttcattatttgtattgtgttta

SEQ ID NO: 393236 - DNA, 25 bp, Homo sapien
attgtgtttactacttgtgatcatg

SEQ ID NO: 393237 - DNA, 25 bp, Homo sapien
cttgtgatcatgtagttgtgcctta

SEQ ID NO: 393238 - DNA, 25 bp, Homo sapien
tcatgtagttgtgccttactttgtg

SEQ ID NO: 393239 - DNA, 25 bp, Homo sapien
gaaaggttagctcagtaaatactgc

SEQ ID NO: 393240 - DNA, 25 bp, Homo sapien
taaatactgcaatttctaaactcag

SEQ ID NO: 393241 - DNA, 25 bp, Homo sapien
ctaaactcagtgattggaaggttat

SEQ ID NO: 393242 - DNA, 25 bp, Homo sapien
actgataaagtacgtgacagcattt

SEQ ID NO: 393243 - DNA, 25 bp, Homo sapien
taaagtacgtgacagcatttaaatc

SEQ ID NO: 393244 - DNA, 25 bp, Homo sapien
gaaggatccttattgaattgttgct

SEQ ID NO: 393245 - DNA, 25 bp, Homo sapien
gtaaacttaaacacagccgagaagt

SEQ ID NO: 393246 - DNA, 25 bp, Homo sapien
aaacacagccgagaagttgcttctt

SEQ ID NO: 393247 - DNA, 25 bp, Homo sapien
gataatgcctctgcttctatttctc

SEQ ID NO: 393248 - DNA, 25 bp, Homo sapien
atgcctctgcttctatttctctggg

SEQ ID NO: 393249 - DNA, 25 bp, Homo sapien
gtcgcagacccgtttcatgcagcgt

SEQ ID NO: 393250 - DNA, 25 bp, Homo sapien
gcagacccgtttcatgcagcgtctc

SEQ ID NO: 393251 - DNA, 25 bp, Homo sapien
ctttctgaccaagcaacgctaactt

SEQ ID NO: 393252 - DNA, 25 bp, Homo sapien
tctgaccaagcaacgctaacttttg

SEQ ID NO: 393253 - DNA, 25 bp, Homo sapien
caagcaacgctaacttttgtacaga

SEQ ID NO: 393254 - DNA, 25 bp, Homo sapien
aacgctaacttttgtacagatcgat

SEQ ID NO: 393255 - DNA, 25 bp, Homo sapien
aacttttgtacagatcgatttgata

SEQ ID NO: 393256 - DNA, 25 bp, Homo sapien
aaggcattactattgttctggtcta

SEQ ID NO: 393257 - DNA, 25 bp, Homo sapien
tattgttctggtctaagtactctaa

SEQ ID NO: 393258 - DNA, 25 bp, Homo sapien
ctaagtactctaacaggacgatgat

SEQ ID NO: 393259 - DNA, 25 bp, Homo sapien
ggacgatgatttctaaccctagcat

SEQ ID NO: 393260 - DNA, 25 bp, Homo sapien
ctaaccctagcatcatgacatgtat

SEQ ID NO: 393261 - DNA, 25 bp, Homo sapien
tagtgtgttgtaagacatttgccag

SEQ ID NO: 393262 - DNA, 25 bp, Homo sapien
gacatttgccagctaatagttacag

SEQ ID NO: 393263 - DNA, 25 bp, Homo sapien
cagtactgaagcttgtgaatacgtt

SEQ ID NO: 393264 - DNA, 25 bp, Homo sapien
agcaggttcaaagttatcccatgat

SEQ ID NO: 393265 - DNA, 25 bp, Homo sapien
atcccatgatagtggcattcttatt

SEQ ID NO: 393266 - DNA, 25 bp, Homo sapien
atatgtaacatgtacctaagtttta

SEQ ID NO: 393267 - DNA, 25 bp, Homo sapien
cactctgctcgttactttagggatg

SEQ ID NO: 393268 - DNA, 25 bp, Homo sapien
ttactgaatggccatcatgccgaaa

SEQ ID NO: 393269 - DNA, 25 bp, Homo sapien
tgccgaaacatactcatgcttacgt

SEQ ID NO: 393270 - DNA, 25 bp, Homo sapien
tgagatatgctggagcctttctatg

SEQ ID NO: 393271 - DNA, 25 bp, Homo sapien
cctttctatgcttctcgaggcagaa

SEQ ID NO: 393272 - DNA, 25 bp, Homo sapien
gaggcagaactttgggcttctctcc

SEQ ID NO: 393273 - DNA, 25 bp, Homo sapien
gtggcgcgttccttacaatagttaa

SEQ ID NO: 393274 - DNA, 25 bp, Homo sapien
agttaacgcactgggtcgtgctcat

SEQ ID NO: 393275 - DNA, 25 bp, Homo sapien
gtcgtgctcattggtctgatttgaa

SEQ ID NO: 393276 - DNA, 25 bp, Homo sapien
gaacatttaacttcgtacacccaag

SEQ ID NO: 393277 - DNA, 25 bp, Homo sapien
tgaagtacttactgtggtcacacac

SEQ ID NO: 393278 - DNA, 25 bp, Homo sapien
actgtgttcatgattgttgattctc

SEQ ID NO: 393279 - DNA, 25 bp, Homo sapien
tgattgttgattctccttctacttc

SEQ ID NO: 393280 - DNA, 25 bp, Homo sapien
ctccttctacttcagtgttatactg

SEQ ID NO: 393281 - DNA, 25 bp, Homo sapien
actgtgtgaatcaagcactgtgtca

SEQ ID NO: 393282 - DNA, 25 bp, Homo sapien
gtgtcaaaacagagcatttccctct

SEQ ID NO: 393283 - DNA, 25 bp, Homo sapien
cagagcatttccctcttaaaaatta

SEQ ID NO: 393284 - DNA, 25 bp, Homo sapien
caaaccgaagtgatagaagcatgtc

SEQ ID NO: 393285 - DNA, 25 bp, Homo sapien
gtcagaattgagaagacattttgaa

SEQ ID NO: 393286 - DNA, 25 bp, Homo sapien
agcaagaacaatgtgatgtacctat

SEQ ID NO: 393287 - DNA, 25 bp, Homo sapien
aacatttgacaaactctaacactac

SEQ ID NO: 393288 - DNA, 25 bp, Homo sapien
gacaaactctaacactacaatcatt

SEQ ID NO: 393289 - DNA, 25 bp, Homo sapien
tggttcttgtcctatatccacctag

SEQ ID NO: 393290 - DNA, 25 bp, Homo sapien
tatatccacctagtcttcacctggg

SEQ ID NO: 393291 - DNA, 25 bp, Homo sapien
ctggggctataattctgtcctggaa

SEQ ID NO: 393292 - DNA, 25 bp, Homo sapien
aagaactctgaaaacctgggtcagg

SEQ ID NO: 393293 - DNA, 25 bp, Homo sapien
gattcctaaggaaaacggtctgcat

SEQ ID NO: 393294 - DNA, 25 bp, Homo sapien
aaacggtctgcatttgagctctggt

SEQ ID NO: 393295 - DNA, 25 bp, Homo sapien
gacactccagatgtggttggaagca

SEQ ID NO: 393296 - DNA, 25 bp, Homo sapien
ggctggctggttgagttttgttatt

SEQ ID NO: 393297 - DNA, 25 bp, Homo sapien
gagatatatcaacacttggaattgt

SEQ ID NO: 393298 - DNA, 25 bp, Homo sapien
cttggaattgttacccatctgcaga

SEQ ID NO: 393299 - DNA, 25 bp, Homo sapien
acccatctgcagaattgacttctca

SEQ ID NO: 393300 - DNA, 25 bp, Homo sapien
ttcacctttgtgtcacagatcaaat

SEQ ID NO: 393301 - DNA, 25 bp, Homo sapien
gtgtcacagatcaaatggtaaccca

SEQ ID NO: 393302 - DNA, 25 bp, Homo sapien
gatatgcaggttgtgcttagcagcc

SEQ ID NO: 393303 - DNA, 25 bp, Homo sapien
taccttgtgctagaacggaactgcc

SEQ ID NO: 393304 - DNA, 25 bp, Homo sapien
gaacggaactgcctctgccatctct

SEQ ID NO: 393305 - DNA, 25 bp, Homo sapien
agaagcacatcctgagaacctgaga

SEQ ID NO: 393306 - DNA, 25 bp, Homo sapien
gagagctcaaggtaagtggctgaac

SEQ ID NO: 393307 - DNA, 25 bp, Homo sapien
gtggctgaacactgtcaacacatac

SEQ ID NO: 393308 - DNA, 25 bp, Homo sapien
gtcaacacatacagacatctaactg

SEQ ID NO: 393309 - DNA, 25 bp, Homo sapien
gacatctaactgtctccttactgta

SEQ ID NO: 393310 - DNA, 25 bp, Homo sapien
tctaactgtctccttactgtacagc

SEQ ID NO: 393311 - DNA, 25 bp, Homo sapien
gaagaatcatttctgggcttgtgat

SEQ ID NO: 393312 - DNA, 25 bp, Homo sapien
gcttgtgatgttaatattgcccccc

SEQ ID NO: 393313 - DNA, 25 bp, Homo sapien
ttgtgatgttaatattgccccccta

SEQ ID NO: 393314 - DNA, 25 bp, Homo sapien
gatgttaatattgcccccctactgg

SEQ ID NO: 393315 - DNA, 25 bp, Homo sapien
atggatggttggttggatatgtcac

SEQ ID NO: 393316 - DNA, 25 bp, Homo sapien
gatggttggttggatatgtcacttt

SEQ ID NO: 393317 - DNA, 25 bp, Homo sapien
ggttggttggatatgtcacttttct

SEQ ID NO: 393318 - DNA, 25 bp, Homo sapien
tggttggatatgtcacttttcttat

SEQ ID NO: 393319 - DNA, 25 bp, Homo sapien
gttggatatgtcacttttcttatgg

SEQ ID NO: 393320 - DNA, 25 bp, Homo sapien
tggatatgtcacttttcttatggta

SEQ ID NO: 393321 - DNA, 25 bp, Homo sapien
aacaattaaatccatattctctctg

SEQ ID NO: 393322 - DNA, 25 bp, Homo sapien
agtagcttgaacactatcacttgtc

SEQ ID NO: 393323 - DNA, 25 bp, Homo sapien
gaacactatcacttgtccaatggga

SEQ ID NO: 393324 - DNA, 25 bp, Homo sapien
agttgatgcttatctttatggcaaa

SEQ ID NO: 393325 - DNA, 25 bp, Homo sapien
ctttatggcaaatgcttggttgaat

SEQ ID NO: 393326 - DNA, 25 bp, Homo sapien
gatacctgtaaaacagtttctccag

SEQ ID NO: 393327 - DNA, 25 bp, Homo sapien
aacagtttctccagatgactttaaa

SEQ ID NO: 393328 - DNA, 25 bp, Homo sapien
ggtgttaagttgtgaaatacctaat

SEQ ID NO: 393329 - DNA, 25 bp, Homo sapien
tacctaatgatgtgggcctaaattt

SEQ ID NO: 393330 - DNA, 25 bp, Homo sapien
gtgggcctaaatttgcctcattcag

SEQ ID NO: 393331 - DNA, 25 bp, Homo sapien
tttgcctcattcagactgagacagg

SEQ ID NO: 393332 - DNA, 25 bp, Homo sapien
gagacagggctgttaaaattcattt

SEQ ID NO: 393333 - DNA, 25 bp, Homo sapien
ataccagcttacaggagttctcagc

SEQ ID NO: 393334 - DNA, 25 bp, Homo sapien
aggagttctcagcaggtgcttttta

SEQ ID NO: 393335 - DNA, 25 bp, Homo sapien
cagcaggtgctttttattaactgat

SEQ ID NO: 393336 - DNA, 25 bp, Homo sapien
attaactgatgaagagctaaggctc

SEQ ID NO: 393337 - DNA, 25 bp, Homo sapien
gctaaggctcacttttgatagataa

SEQ ID NO: 393338 - DNA, 25 bp, Homo sapien
cccggctgactgttgcatacttata

SEQ ID NO: 393339 - DNA, 25 bp, Homo sapien
ctgactgttgcatacttataaaaaa

SEQ ID NO: 393340 - DNA, 25 bp, Homo sapien
tttcaagacaatcaatatgtaccat

SEQ ID NO: 393341 - DNA, 25 bp, Homo sapien
tatgtaccataaacgactatataaa

SEQ ID NO: 393342 - DNA, 25 bp, Homo sapien
agcatgggcagataggttttatttt

SEQ ID NO: 393343 - DNA, 25 bp, Homo sapien
attttcaaaatgctgttcttaacac

SEQ ID NO: 393344 - DNA, 25 bp, Homo sapien
ggtaatcaccattcagcagatactg

SEQ ID NO: 393345 - DNA, 25 bp, Homo sapien
gagacaccaagtgaggagggtaaat

SEQ ID NO: 393346 - DNA, 25 bp, Homo sapien
aaataagctgacatatggccctggg

SEQ ID NO: 393347 - DNA, 25 bp, Homo sapien
ggcgccctctagtgggccactgcaa

SEQ ID NO: 393348 - DNA, 25 bp, Homo sapien
tggctgagcccaagtctatagtgag

SEQ ID NO: 393349 - DNA, 25 bp, Homo sapien
gagcccaagtctatagtgagccatg

SEQ ID NO: 393350 - DNA, 25 bp, Homo sapien
ccagtgtactgcagcctggattaca

SEQ ID NO: 393351 - DNA, 25 bp, Homo sapien
tgggccactgcaaggaaataatcac

SEQ ID NO: 393352 - DNA, 25 bp, Homo sapien
tcaccaataattgcttttagataag

SEQ ID NO: 393353 - DNA, 25 bp, Homo sapien
agcaattttgtgttagttccactta

SEQ ID NO: 393354 - DNA, 25 bp, Homo sapien
gttccacttaataggtaatcaccat

SEQ ID NO: 393355 - DNA, 25 bp, Homo sapien
gttaaatgctatgaaactcttatgg

SEQ ID NO: 393356 - DNA, 25 bp, Homo sapien
atgctatgaaactcttatggtattg

SEQ ID NO: 393357 - DNA, 25 bp, Homo sapien
tatgaaactcttatggtattggaga

SEQ ID NO: 393358 - DNA, 25 bp, Homo sapien
gttttgagagccaattcagttataa

SEQ ID NO: 393359 - DNA, 25 bp, Homo sapien
tagcaagactgccttgacaaaaatt

SEQ ID NO: 393360 - DNA, 25 bp, Homo sapien
actttatattaaagggtgctgataa

SEQ ID NO: 393361 - DNA, 25 bp, Homo sapien
ggtgctgataaataatgttcaatta

SEQ ID NO: 393362 - DNA, 25 bp, Homo sapien
gttcaattagcattctttgggttct

SEQ ID NO: 393363 - DNA, 25 bp, Homo sapien
aattagcattctttgggttctgagt

SEQ ID NO: 393364 - DNA, 25 bp, Homo sapien
agcattctttgggttctgagttaaa

SEQ ID NO: 393365 - DNA, 25 bp, Homo sapien
ctttgggttctgagttaaatgctat

SEQ ID NO: 393366 - DNA, 25 bp, Homo sapien
cattacatgtcacaatccgattgag

SEQ ID NO: 393367 - DNA, 25 bp, Homo sapien
atggtttgttgttgcgtagcataaa

SEQ ID NO: 393368 - DNA, 25 bp, Homo sapien
gaagactacacttcaaaacgatagt

SEQ ID NO: 393369 - DNA, 25 bp, Homo sapien
aaacgatagttttgatttccgctca

SEQ ID NO: 393370 - DNA, 25 bp, Homo sapien
atagttttgatttccgctcagctca

SEQ ID NO: 393371 - DNA, 25 bp, Homo sapien
aatggtttcaccaggattcagaaaa

SEQ ID NO: 393372 - DNA, 25 bp, Homo sapien
cagatgggcagcagaccaccgaaca

SEQ ID NO: 393373 - DNA, 25 bp, Homo sapien
atgggcagcagaccaccgaacagtg

SEQ ID NO: 393374 - DNA, 25 bp, Homo sapien
ttggagctgcctcttggtccaacca

SEQ ID NO: 393375 - DNA, 25 bp, Homo sapien
cactgagctggttgttgtataaaat

SEQ ID NO: 393376 - DNA, 25 bp, Homo sapien
gctggttgttgtataaaattcactt

SEQ ID NO: 393377 - DNA, 25 bp, Homo sapien
aggatacacacatcagatcaccttt

SEQ ID NO: 393378 - DNA, 25 bp, Homo sapien
acatcagatcacctttacatgctct

SEQ ID NO: 393379 - DNA, 25 bp, Homo sapien
agatcacctttacatgctctaacat

SEQ ID NO: 393380 - DNA, 25 bp, Homo sapien
ttaggaaagtcatcaagctcattct

SEQ ID NO: 393381 - DNA, 25 bp, Homo sapien
aaacatctgcacaatttgaacatca

SEQ ID NO: 393382 - DNA, 25 bp, Homo sapien
cagtccagggctagggacacctgta

SEQ ID NO: 393383 - DNA, 25 bp, Homo sapien
gggctagggacacctgtaagaccat

SEQ ID NO: 393384 - DNA, 25 bp, Homo sapien
gggacacctgtaagaccatgatatc

SEQ ID NO: 393385 - DNA, 25 bp, Homo sapien
gtaagaccatgatatcatctgatac

SEQ ID NO: 393386 - DNA, 25 bp, Homo sapien
atcatctgatacataacctttacat

SEQ ID NO: 393387 - DNA, 25 bp, Homo sapien
aacctttacatcataagctttacat

SEQ ID NO: 393388 - DNA, 25 bp, Homo sapien
aatattttctggcattgggtctact

SEQ ID NO: 393389 - DNA, 25 bp, Homo sapien
attgggtctactgctgagccagttt

SEQ ID NO: 393390 - DNA, 25 bp, Homo sapien
gctgagccagtttctcagtctacca

SEQ ID NO: 393391 - DNA, 25 bp, Homo sapien
cagtctaccacttctgattatcagt

SEQ ID NO: 393392 - DNA, 25 bp, Homo sapien
atcagtgggatgttagccgtaatca

SEQ ID NO: 393393 - DNA, 25 bp, Homo sapien
agccgtaatcaaccctatatcgatg

SEQ ID NO: 393394 - DNA, 25 bp, Homo sapien
tgggttaaatggtctgtcttctgct

SEQ ID NO: 393395 - DNA, 25 bp, Homo sapien
gatcccaactctgattggaatgcac

SEQ ID NO: 393396 - DNA, 25 bp, Homo sapien
gacgaagaaagagcttcacttctaa

SEQ ID NO: 393397 - DNA, 25 bp, Homo sapien
tcacttctaaagtcccaggaaccaa

SEQ ID NO: 393398 - DNA, 25 bp, Homo sapien
gagagggagctcttccaactgggaa

SEQ ID NO: 393399 - DNA, 25 bp, Homo sapien
gtgtatccccgaagccaacagtact

SEQ ID NO: 393400 - DNA, 25 bp, Homo sapien
caacagtactcctacctacatagtt

SEQ ID NO: 393401 - DNA, 25 bp, Homo sapien
tacctacatagttgcggctctagca

SEQ ID NO: 393402 - DNA, 25 bp, Homo sapien
ttgcggctctagcaacagaagtcag

SEQ ID NO: 393403 - DNA, 25 bp, Homo sapien
ggtgtcaggactgcaaaatgcacat

SEQ ID NO: 393404 - DNA, 25 bp, Homo sapien
gtgactatgactgccaaaggaatct

SEQ ID NO: 393405 - DNA, 25 bp, Homo sapien
gaatctggattgtttccttcaccac

SEQ ID NO: 393406 - DNA, 25 bp, Homo sapien
ttcaccacagtgttcttccatagtg

SEQ ID NO: 393407 - DNA, 25 bp, Homo sapien
agtgttcttccatagtgagaccctg

SEQ ID NO: 393408 - DNA, 25 bp, Homo sapien
aagactgtcctatagggtcaccagt

SEQ ID NO: 393409 - DNA, 25 bp, Homo sapien
ggtcaccagtgtgtgtatccccgaa

SEQ ID NO: 393410 - DNA, 25 bp, Homo sapien
ataagattccttttgatctaccgga

SEQ ID NO: 393411 - DNA, 25 bp, Homo sapien
gatctaccggaatatacatgtacag

SEQ ID NO: 393412 - DNA, 25 bp, Homo sapien
cagagtacattggatcatgttggaa

SEQ ID NO: 393413 - DNA, 25 bp, Homo sapien
gtcagagatgaagtagcgaagttat

SEQ ID NO: 393414 - DNA, 25 bp, Homo sapien
gcgaagttatggaatatcgtggaaa

SEQ ID NO: 393415 - DNA, 25 bp, Homo sapien
tcgtggaaaggatactagttgtgaa

SEQ ID NO: 393416 - DNA, 25 bp, Homo sapien
gaaagagacaagttatagtacccca

SEQ ID NO: 393417 - DNA, 25 bp, Homo sapien
gacaagttatagtaccccaaaagca

SEQ ID NO: 393418 - DNA, 25 bp, Homo sapien
gttgccacctttataccggaagact

SEQ ID NO: 393419 - DNA, 25 bp, Homo sapien
gccacctttataccggaagactctg

SEQ ID NO: 393420 - DNA, 25 bp, Homo sapien
tataccggaagactctgttgtagaa

SEQ ID NO: 393421 - DNA, 25 bp, Homo sapien
ttgttttgaacaccgactgggaaga

SEQ ID NO: 393422 - DNA, 25 bp, Homo sapien
ggcttaggtaacagccaaacctggc

SEQ ID NO: 393423 - DNA, 25 bp, Homo sapien
aagagttcctgcttctgtatggcaa

SEQ ID NO: 393424 - DNA, 25 bp, Homo sapien
gttcctgcttctgtatggcaagcat

SEQ ID NO: 393425 - DNA, 25 bp, Homo sapien
gcataaatcaagctcagtctgggtt

SEQ ID NO: 393426 - DNA, 25 bp, Homo sapien
gctcagtctgggttatggagaagtt

SEQ ID NO: 393427 - DNA, 25 bp, Homo sapien
ttgttttgttcctcattagtttata

SEQ ID NO: 393428 - DNA, 25 bp, Homo sapien
acttttcagaattcacgtttgtgta

SEQ ID NO: 393429 - DNA, 25 bp, Homo sapien
cacgtttgtgtagatatttcagaga

SEQ ID NO: 393430 - DNA, 25 bp, Homo sapien
tactttacatcctaaaactgccttt

SEQ ID NO: 393431 - DNA, 25 bp, Homo sapien
gccttttcctatggttttgtcaata

SEQ ID NO: 393432 - DNA, 25 bp, Homo sapien
gggaaaacctgcctgctgatgagct

SEQ ID NO: 393433 - DNA, 25 bp, Homo sapien
tgctgatgagctacgccaacgacgc

SEQ ID NO: 393434 - DNA, 25 bp, Homo sapien
ttcccagaggaatacgtgcccactg

SEQ ID NO: 393435 - DNA, 25 bp, Homo sapien
agaggaatacgtgcccactgtgttt

SEQ ID NO: 393436 - DNA, 25 bp, Homo sapien
cactatgcagttactgtgactgtgg

SEQ ID NO: 393437 - DNA, 25 bp, Homo sapien
ccgcgggacaggaggactacaacca

SEQ ID NO: 393438 - DNA, 25 bp, Homo sapien
aggactacaaccagctgaggccact

SEQ ID NO: 393439 - DNA, 25 bp, Homo sapien
tcctaccccaacacggatgtgtttt

SEQ ID NO: 393440 - DNA, 25 bp, Homo sapien
gatgtgtttttgatctgcttctctg

SEQ ID NO: 393441 - DNA, 25 bp, Homo sapien
tttgatctgcttctctgtcgtaaac

SEQ ID NO: 393442 - DNA, 25 bp, Homo sapien
atctgcttctctgtcgtaaaccctg

SEQ ID NO: 393443 - DNA, 25 bp, Homo sapien
ccacacaggtggatttcttgcgcta

SEQ ID NO: 393444 - DNA, 25 bp, Homo sapien
ccgggtgccccgagacatatgctgc

SEQ ID NO: 393445 - DNA, 25 bp, Homo sapien
cgagacatatgctgcccgcaggccg

SEQ ID NO: 393446 - DNA, 25 bp, Homo sapien
acaggtggatttcttgcgctacgcc

SEQ ID NO: 393447 - DNA, 25 bp, Homo sapien
ggcccgacggagtgctcactgccga

SEQ ID NO: 393448 - DNA, 25 bp, Homo sapien
gtgctcactgccgaggcggttctca

SEQ ID NO: 393449 - DNA, 25 bp, Homo sapien
gaggcggttctcagcccatcaaaag

SEQ ID NO: 393450 - DNA, 25 bp, Homo sapien
aggctttcttcagccgtatgggccg

SEQ ID NO: 393451 - DNA, 25 bp, Homo sapien
ttcttcagccgtatgggccgcgagg

SEQ ID NO: 393452 - DNA, 25 bp, Homo sapien
atttcttgcgctacgccaggtgggc

SEQ ID NO: 393453 - DNA, 25 bp, Homo sapien
tggccggaggcctgaagcccaaagg

SEQ ID NO: 393454 - DNA, 25 bp, Homo sapien
gaacctgtttaacagctgtaaccaa

SEQ ID NO: 393455 - DNA, 25 bp, Homo sapien
gtaaccaatggtactgatctatcca

SEQ ID NO: 393456 - DNA, 25 bp, Homo sapien
tcattatatttgactgtggttcaac

SEQ ID NO: 393457 - DNA, 25 bp, Homo sapien
gtggttcaacagtattgcgttgtca

SEQ ID NO: 393458 - DNA, 25 bp, Homo sapien
acagtattgcgttgtcagactagga

SEQ ID NO: 393459 - DNA, 25 bp, Homo sapien
agttttgctgaagactggccttatt

SEQ ID NO: 393460 - DNA, 25 bp, Homo sapien
tggccttattaatggacagctttcc

SEQ ID NO: 393461 - DNA, 25 bp, Homo sapien
tggacagctttcctaacaagagatt

SEQ ID NO: 393462 - DNA, 25 bp, Homo sapien
tatcaggtgttaacatctgtttcag

SEQ ID NO: 393463 - DNA, 25 bp, Homo sapien
catctgtttcaggaacatggcagta

SEQ ID NO: 393464 - DNA, 25 bp, Homo sapien
atggcagtatgtttacatgtcagaa

SEQ ID NO: 393465 - DNA, 25 bp, Homo sapien
tgccatcattggctgaagcaccacc

SEQ ID NO: 393466 - DNA, 25 bp, Homo sapien
tgaagcaccaccaggattcacggca

SEQ ID NO: 393467 - DNA, 25 bp, Homo sapien
ggattcacggcacccaactgcttca

SEQ ID NO: 393468 - DNA, 25 bp, Homo sapien
aactgcttcagggtacttcgtagac

SEQ ID NO: 393469 - DNA, 25 bp, Homo sapien
agggtacttcgtagactctgcctca

SEQ ID NO: 393470 - DNA, 25 bp, Homo sapien
ctctgcctcactacatgtcgaaaga

SEQ ID NO: 393471 - DNA, 25 bp, Homo sapien
gagttatttgagttctcttctgttt

SEQ ID NO: 393472 - DNA, 25 bp, Homo sapien
ttgggtgtaccccatggctgcctct

SEQ ID NO: 393473 - DNA, 25 bp, Homo sapien
cagtgtctattttgagaggatggct

SEQ ID NO: 393474 - DNA, 25 bp, Homo sapien
gatggcttacctcttctttgtgaaa

SEQ ID NO: 393475 - DNA, 25 bp, Homo sapien
aatactatctcatttcctggaaata

SEQ ID NO: 393476 - DNA, 25 bp, Homo sapien
gtcaaaacctaattgcaattctgtt

SEQ ID NO: 393477 - DNA, 25 bp, Homo sapien
gacagtgtttcaccgtattatttag

SEQ ID NO: 393478 - DNA, 25 bp, Homo sapien
ccatttctttcactgattacaccat

SEQ ID NO: 393479 - DNA, 25 bp, Homo sapien
gattacaccatatacaggaaacagg

SEQ ID NO: 393480 - DNA, 25 bp, Homo sapien
aactttattgtgctggttgatgcca

SEQ ID NO: 393481 - DNA, 25 bp, Homo sapien
gctggttgatgccaacttggttgaa

SEQ ID NO: 393482 - DNA, 25 bp, Homo sapien
acttggttgaaaagctctctgcaga

SEQ ID NO: 393483 - DNA, 25 bp, Homo sapien
gaagaagtgatctagactgacagaa

SEQ ID NO: 393484 - DNA, 25 bp, Homo sapien
acagaagtgttgctaattacaagtt

SEQ ID NO: 393485 - DNA, 25 bp, Homo sapien
acaagttgtgttctcatgacgtaat

SEQ ID NO: 393486 - DNA, 25 bp, Homo sapien
gaaagtaacttctcaaagtacaact

SEQ ID NO: 393487 - DNA, 25 bp, Homo sapien
ctttcttacccaggaagccattata

SEQ ID NO: 393488 - DNA, 25 bp, Homo sapien
tacccaggaagccattataaggatt

SEQ ID NO: 393489 - DNA, 25 bp, Homo sapien
taattatcaaagcagttgctggcat

SEQ ID NO: 393490 - DNA, 25 bp, Homo sapien
ggcaggcattcaacagaaaccgtgt

SEQ ID NO: 393491 - DNA, 25 bp, Homo sapien
gaaaccgtgttgctatgttattttt

SEQ ID NO: 393492 - DNA, 25 bp, Homo sapien
tattcctattgggattgaaaccctt

SEQ ID NO: 393493 - DNA, 25 bp, Homo sapien
gggattgaaacccttatgtcatatc

SEQ ID NO: 393494 - DNA, 25 bp, Homo sapien
cttatgtcatatcaaaacttttcca

SEQ ID NO: 393495 - DNA, 25 bp, Homo sapien
aacttttccatctttgacaaatgag

SEQ ID NO: 393496 - DNA, 25 bp, Homo sapien
aagagtttagtgcttgagctattca

SEQ ID NO: 393497 - DNA, 25 bp, Homo sapien
agtgcttgagctattcaattattaa

SEQ ID NO: 393498 - DNA, 25 bp, Homo sapien
gaggcactcaggtgtcacggctaga

SEQ ID NO: 393499 - DNA, 25 bp, Homo sapien
tgcagctatgagacagatctggctt

SEQ ID NO: 393500 - DNA, 25 bp, Homo sapien
gacagatctggcttcaaatccaaga

SEQ ID NO: 393501 - DNA, 25 bp, Homo sapien
atctggcttcaaatccaagagttgc

SEQ ID NO: 393502 - DNA, 25 bp, Homo sapien
aatccaagagttgccatgcacttgc

SEQ ID NO: 393503 - DNA, 25 bp, Homo sapien
aagagttgccatgcacttgctgtgt

SEQ ID NO: 393504 - DNA, 25 bp, Homo sapien
gagccccgtgttcctcatctgtaca

SEQ ID NO: 393505 - DNA, 25 bp, Homo sapien
gggcttacgatactactacctcata

SEQ ID NO: 393506 - DNA, 25 bp, Homo sapien
tacgatactactacctcatagggtt

SEQ ID NO: 393507 - DNA, 25 bp, Homo sapien
aggcctgccataaactcttcggagt

SEQ ID NO: 393508 - DNA, 25 bp, Homo sapien
gagtttacgtgttgcaccttttcac

SEQ ID NO: 393509 - DNA, 25 bp, Homo sapien
ggcaggctcaccagatagttacaaa

SEQ ID NO: 393510 - DNA, 25 bp, Homo sapien
gatagttacaaagtccagaaccaaa

SEQ ID NO: 393511 - DNA, 25 bp, Homo sapien
aaccaaatattctatagggccatct

SEQ ID NO: 393512 - DNA, 25 bp, Homo sapien
agggccatctacagggattttcggt

SEQ ID NO: 393513 - DNA, 25 bp, Homo sapien
gattttcggtggtttgaatgggtca

SEQ ID NO: 393514 - DNA, 25 bp, Homo sapien
gaatgggtcaatttcaacaccagta

SEQ ID NO: 393515 - DNA, 25 bp, Homo sapien
gttttccaaatctaatatttctcca

SEQ ID NO: 393516 - DNA, 25 bp, Homo sapien
atatttctccattatggtttggaac

SEQ ID NO: 393517 - DNA, 25 bp, Homo sapien
ggaactttaaggtcacaatcaagca

SEQ ID NO: 393518 - DNA, 25 bp, Homo sapien
aatgttctacctgacagatccaaag

SEQ ID NO: 393519 - DNA, 25 bp, Homo sapien
gcaagtctactaattaaatctcatg

SEQ ID NO: 393520 - DNA, 25 bp, Homo sapien
tatactctctttgacagcagtttgg

SEQ ID NO: 393521 - DNA, 25 bp, Homo sapien
agcagtttggaattcttctagcaca

SEQ ID NO: 393522 - DNA, 25 bp, Homo sapien
ggaattcttctagcacatctatgta

SEQ ID NO: 393523 - DNA, 25 bp, Homo sapien
agttttgtctgtaaacctcttgcag

SEQ ID NO: 393524 - DNA, 25 bp, Homo sapien
agctgtgtctgtgccagtatgccgg

SEQ ID NO: 393525 - DNA, 25 bp, Homo sapien
tctgtgccagtatgccggaatctca

SEQ ID NO: 393526 - DNA, 25 bp, Homo sapien
gtatgccggaatctcagtgcagtgt

SEQ ID NO: 393527 - DNA, 25 bp, Homo sapien
ggaatctcagtgcagtgtccagact

SEQ ID NO: 393528 - DNA, 25 bp, Homo sapien
cagtgtccagactgcgtatttcagt

SEQ ID NO: 393529 - DNA, 25 bp, Homo sapien
cagactgcgtatttcagtttttcca

SEQ ID NO: 393530 - DNA, 25 bp, Homo sapien
tccacaatgtggatagtacatatga

SEQ ID NO: 393531 - DNA, 25 bp, Homo sapien
gagacaatccagtagtccactttgt

SEQ ID NO: 393532 - DNA, 25 bp, Homo sapien
tccagtagtccactttgtcaggagt

SEQ ID NO: 393533 - DNA, 25 bp, Homo sapien
ctttgtcaggagtgtttcaaacaac

SEQ ID NO: 393534 - DNA, 25 bp, Homo sapien
aaacaacatctgtgaacccactgga

SEQ ID NO: 393535 - DNA, 25 bp, Homo sapien
atctgtgaacccactggacttcaag

SEQ ID NO: 393536 - DNA, 25 bp, Homo sapien
agctcctacaggctagagatttggt

SEQ ID NO: 393537 - DNA, 25 bp, Homo sapien
gagatttggtctatttcatctgcat

SEQ ID NO: 393538 - DNA, 25 bp, Homo sapien
catctgcattgtgaaaggtcctgga

SEQ ID NO: 393539 - DNA, 25 bp, Homo sapien
gagaatcaggaattactagactata

SEQ ID NO: 393540 - DNA, 25 bp, Homo sapien
tttcttatctccaacatttctggga

SEQ ID NO: 393541 - DNA, 25 bp, Homo sapien
gtgtctgtggattttatgttactgg

SEQ ID NO: 393542 - DNA, 25 bp, Homo sapien
agcccctgatccagcatgggaggat

SEQ ID NO: 393543 - DNA, 25 bp, Homo sapien
ggagacactttctggttgtcattat

SEQ ID NO: 393544 - DNA, 25 bp, Homo sapien
tggttgtcattatacaggctccctg

SEQ ID NO: 393545 - DNA, 25 bp, Homo sapien
ttgtcattatacaggctccctggag

SEQ ID NO: 393546 - DNA, 25 bp, Homo sapien
ccttcaggatttagctcctctactt

SEQ ID NO: 393547 - DNA, 25 bp, Homo sapien
aggatttagctcctctacttcccct

SEQ ID NO: 393548 - DNA, 25 bp, Homo sapien
ccctgggctggtgtgggcacattgt

SEQ ID NO: 393549 - DNA, 25 bp, Homo sapien
aagaaagatgaagccagcagtcccc

SEQ ID NO: 393550 - DNA, 25 bp, Homo sapien
agtccccactcactgagctagaaga

SEQ ID NO: 393551 - DNA, 25 bp, Homo sapien
cactcactgagctagaagacctgga

SEQ ID NO: 393552 - DNA, 25 bp, Homo sapien
gaagacctggaacactagacagagg

SEQ ID NO: 393553 - DNA, 25 bp, Homo sapien
aagcactgttgtactcttgtgggcc

SEQ ID NO: 393554 - DNA, 25 bp, Homo sapien
ttgtactcttgtgggccctggaatt

SEQ ID NO: 393555 - DNA, 25 bp, Homo sapien
ggcagaatttgcctcctcatggatt

SEQ ID NO: 393556 - DNA, 25 bp, Homo sapien
gacagttgaatatgtacatcagata

SEQ ID NO: 393557 - DNA, 25 bp, Homo sapien
taactttcacaagggttggaaatct

SEQ ID NO: 393558 - DNA, 25 bp, Homo sapien
atcttaagtccgttttctatctcct

SEQ ID NO: 393559 - DNA, 25 bp, Homo sapien
cgttttctatctccttagtgcttgg

SEQ ID NO: 393560 - DNA, 25 bp, Homo sapien
ttctagaaaccattgaaaccctatt

SEQ ID NO: 393561 - DNA, 25 bp, Homo sapien
gaaaccctattcattcttaaagact

SEQ ID NO: 393562 - DNA, 25 bp, Homo sapien
tttagtgttctactgtatgccaagc

SEQ ID NO: 393563 - DNA, 25 bp, Homo sapien
gtatgccaagcactgttgtactctt

SEQ ID NO: 393564 - DNA, 25 bp, Homo sapien
gaagactgtcagaaaacttggtcaa

SEQ ID NO: 393565 - DNA, 25 bp, Homo sapien
aacttggtcaaacttgtctcaacga

SEQ ID NO: 393566 - DNA, 25 bp, Homo sapien
ttgtctcaacgacagcatcattact

SEQ ID NO: 393567 - DNA, 25 bp, Homo sapien
cattactagaatactgagccaggtc

SEQ ID NO: 393568 - DNA, 25 bp, Homo sapien
ccaggtctcgaatcccattcatgaa

SEQ ID NO: 393569 - DNA, 25 bp, Homo sapien
aggcttttccagtatcaatcattgc

SEQ ID NO: 393570 - DNA, 25 bp, Homo sapien
aagcttatcaagttttagttccaat

SEQ ID NO: 393571 - DNA, 25 bp, Homo sapien
tttagttccaattctgccacatcac

SEQ ID NO: 393572 - DNA, 25 bp, Homo sapien
acatcaccttctacttcttccaaag

SEQ ID NO: 393573 - DNA, 25 bp, Homo sapien
gagtccttcagacactcctcgaaat

SEQ ID NO: 393574 - DNA, 25 bp, Homo sapien
tcctcgaaatccacagtcatcttca

SEQ ID NO: 393575 - DNA, 25 bp, Homo sapien
ttcctgcttttatgggtaaacttat

SEQ ID NO: 393576 - DNA, 25 bp, Homo sapien
tgttctgtggtttgctgttaaccaa

SEQ ID NO: 393577 - DNA, 25 bp, Homo sapien
gctgttaaccaagattctcccattt

SEQ ID NO: 393578 - DNA, 25 bp, Homo sapien
ttaaaatgccacagaccgaccctca

SEQ ID NO: 393579 - DNA, 25 bp, Homo sapien
agaccgaccctcaaggcagatccga

SEQ ID NO: 393580 - DNA, 25 bp, Homo sapien
gcagatccgaaagcctagtagttag

SEQ ID NO: 393581 - DNA, 25 bp, Homo sapien
gcctagtagttagttgcactgggtt

SEQ ID NO: 393582 - DNA, 25 bp, Homo sapien
gcactgggttgttttgacaagctac

SEQ ID NO: 393583 - DNA, 25 bp, Homo sapien
tgacaagctaccacacgtcttaagt

SEQ ID NO: 393584 - DNA, 25 bp, Homo sapien
gatgagacacttaaacccagacaga

SEQ ID NO: 393585 - DNA, 25 bp, Homo sapien
gatttttgttgtctaagtcccaaag

SEQ ID NO: 393586 - DNA, 25 bp, Homo sapien
agccagcgggcttaggacaggtcct

SEQ ID NO: 393587 - DNA, 25 bp, Homo sapien
ggcttaggacaggtcctgtggcaca

SEQ ID NO: 393588 - DNA, 25 bp, Homo sapien
ttaggacaggtcctgtggcacagtc

SEQ ID NO: 393589 - DNA, 25 bp, Homo sapien
gacaggtcctgtggcacagtccgtg

SEQ ID NO: 393590 - DNA, 25 bp, Homo sapien
cctgtggcacagtccgtggctttga

SEQ ID NO: 393591 - DNA, 25 bp, Homo sapien
gcacagtccgtggctttgagggaaa

SEQ ID NO: 393592 - DNA, 25 bp, Homo sapien
cccaggtcgtgatgcaggcgccatg

SEQ ID NO: 393593 - DNA, 25 bp, Homo sapien
atgcaggcgccatgggccggtaatc

SEQ ID NO: 393594 - DNA, 25 bp, Homo sapien
gccggtaatcgtggctgggctggaa

SEQ ID NO: 393595 - DNA, 25 bp, Homo sapien
cagttggacctgtgattgtccagca

SEQ ID NO: 393596 - DNA, 25 bp, Homo sapien
ggacctgtgattgtccagcagccca

SEQ ID NO: 393597 - DNA, 25 bp, Homo sapien
atgtacaacagggtggtactgcttc

SEQ ID NO: 393598 - DNA, 25 bp, Homo sapien
cagggtggtactgcttcagaatttc

SEQ ID NO: 393599 - DNA, 25 bp, Homo sapien
tttgcttttatggttttgatgacac

SEQ ID NO: 393600 - DNA, 25 bp, Homo sapien
ggatctttctgggatactgcttacg

SEQ ID NO: 393601 - DNA, 25 bp, Homo sapien
ctttctgggatactgcttacgtttt

SEQ ID NO: 393602 - DNA, 25 bp, Homo sapien
gatactgcttacgttttgtggctat

SEQ ID NO: 393603 - DNA, 25 bp, Homo sapien
acgttttgtggctatatctactatg

SEQ ID NO: 393604 - DNA, 25 bp, Homo sapien
gtggctatatctactatgatttcat

SEQ ID NO: 393605 - DNA, 25 bp, Homo sapien
ctatgatttcatcaaactgatcttc

SEQ ID NO: 393606 - DNA, 25 bp, Homo sapien
actgatcttcaagtactttgatgtc

SEQ ID NO: 393607 - DNA, 25 bp, Homo sapien
agtactttgatgtcagaatccataa

SEQ ID NO: 393608 - DNA, 25 bp, Homo sapien
gtctgccagctgcacttatcagaaa

SEQ ID NO: 393609 - DNA, 25 bp, Homo sapien
tcctccttctcaagatgggtgcagt

SEQ ID NO: 393610 - DNA, 25 bp, Homo sapien
gtgcagttccgaggtttggagctta

SEQ ID NO: 393611 - DNA, 25 bp, Homo sapien
ttggagcttattactcaggcaagac

SEQ ID NO: 393612 - DNA, 25 bp, Homo sapien
agaacttattactgcctagcatgga

SEQ ID NO: 393613 - DNA, 25 bp, Homo sapien
gaaagtacctaatccttcaggtgtg

SEQ ID NO: 393614 - DNA, 25 bp, Homo sapien
aggtgtgacatagcgtctccgggta

SEQ ID NO: 393615 - DNA, 25 bp, Homo sapien
gtctccgggtagtctctcatcagta

SEQ ID NO: 393616 - DNA, 25 bp, Homo sapien
aatatctgccttcacaacaaagttg

SEQ ID NO: 393617 - DNA, 25 bp, Homo sapien
atttgcccgtgattaagcgtataga

SEQ ID NO: 393618 - DNA, 25 bp, Homo sapien
gcgtatagagtgtctgccagctgca

SEQ ID NO: 393619 - DNA, 25 bp, Homo sapien
cactatttgggtaaagccagcccag

SEQ ID NO: 393620 - DNA, 25 bp, Homo sapien
tatttgggtaaagccagcccagaag

SEQ ID NO: 393621 - DNA, 25 bp, Homo sapien
cccagaagtgcatgctagggctccc

SEQ ID NO: 393622 - DNA, 25 bp, Homo sapien
agtcagccccccaggaaggtgttgg

SEQ ID NO: 393623 - DNA, 25 bp, Homo sapien
cccaggaaggtgttggcggtcacct

SEQ ID NO: 393624 - DNA, 25 bp, Homo sapien
gtgttggcggtcaccttgggcatcc

SEQ ID NO: 393625 - DNA, 25 bp, Homo sapien
gtcaccttgggcatccctctgttgc

SEQ ID NO: 393626 - DNA, 25 bp, Homo sapien
ttaaaaagcctaaacccgctgcact

SEQ ID NO: 393627 - DNA, 25 bp, Homo sapien
ccctgacccagtggtgtttggagtg

SEQ ID NO: 393628 - DNA, 25 bp, Homo sapien
gggtgcctcactatttgggtaaagc

SEQ ID NO: 393629 - DNA, 25 bp, Homo sapien
gtgcctcactatttgggtaaagcca

SEQ ID NO: 393630 - DNA, 25 bp, Homo sapien
tgcctggtggcttgtccgatttgca

SEQ ID NO: 393631 - DNA, 25 bp, Homo sapien
ggcttgtccgatttgcacggtgact

SEQ ID NO: 393632 - DNA, 25 bp, Homo sapien
gattacactctctcattcatggtca

SEQ ID NO: 393633 - DNA, 25 bp, Homo sapien
ttacactctctcattcatggtcact

SEQ ID NO: 393634 - DNA, 25 bp, Homo sapien
ggtcacttccgaagcgctttagtgc

SEQ ID NO: 393635 - DNA, 25 bp, Homo sapien
tccgaagcgctttagtgccttccgt

SEQ ID NO: 393636 - DNA, 25 bp, Homo sapien
gcgctttagtgccttccgtccctaa

SEQ ID NO: 393637 - DNA, 25 bp, Homo sapien
ttctccccgcggtttgtcactgatc

SEQ ID NO: 393638 - DNA, 25 bp, Homo sapien
tttgtcactgatccgcagggcccgg

SEQ ID NO: 393639 - DNA, 25 bp, Homo sapien
cttcggagtgactcggcagagacag

SEQ ID NO: 393640 - DNA, 25 bp, Homo sapien
gtgactcggcagagacagaggcaca

SEQ ID NO: 393641 - DNA, 25 bp, Homo sapien
tttggacaaccaagcaagctctaac

SEQ ID NO: 393642 - DNA, 25 bp, Homo sapien
aagcaagctctaaccgcaatgccag

SEQ ID NO: 393643 - DNA, 25 bp, Homo sapien
taaccgcaatgccagatggccttgt

SEQ ID NO: 393644 - DNA, 25 bp, Homo sapien
ttgtccgagggcctagtgtttgcac

SEQ ID NO: 393645 - DNA, 25 bp, Homo sapien
cctagtgtttgcacggcagtgggaa

SEQ ID NO: 393646 - DNA, 25 bp, Homo sapien
tgggaactgggcctttcctacagga

SEQ ID NO: 393647 - DNA, 25 bp, Homo sapien
tttcctacaggacaactggcaagtt

SEQ ID NO: 393648 - DNA, 25 bp, Homo sapien
ctggcaagtttgctgggaagtcaaa

SEQ ID NO: 393649 - DNA, 25 bp, Homo sapien
aataatacattccacctggcagctg

SEQ ID NO: 393650 - DNA, 25 bp, Homo sapien
atgcctctggctggtgaagttctca

SEQ ID NO: 393651 - DNA, 25 bp, Homo sapien
gaagttctcacataggctgatttaa

SEQ ID NO: 393652 - DNA, 25 bp, Homo sapien
agttccagatagtttcatttcacct

SEQ ID NO: 393653 - DNA, 25 bp, Homo sapien
ttcacctgtaaactgtatcactttg

SEQ ID NO: 393654 - DNA, 25 bp, Homo sapien
atatgtttacagatgtgccctgcat

SEQ ID NO: 393655 - DNA, 25 bp, Homo sapien
atgtgccctgcatttagtctgcctt

SEQ ID NO: 393656 - DNA, 25 bp, Homo sapien
gtctgccttgttcctattttgattt

SEQ ID NO: 393657 - DNA, 25 bp, Homo sapien
atttttgttgagtctcctgcctgct

SEQ ID NO: 393658 - DNA, 25 bp, Homo sapien
tctcctgcctgcttgccaaaagcta

SEQ ID NO: 393659 - DNA, 25 bp, Homo sapien
agctaggatgcttcaggcccatgta

SEQ ID NO: 393660 - DNA, 25 bp, Homo sapien
aggcccatgtacaattgaaagcaga

SEQ ID NO: 393661 - DNA, 25 bp, Homo sapien
agaggcatccttgagctttaaagca

SEQ ID NO: 393662 - DNA, 25 bp, Homo sapien
aatgcaacataccacataactgaag

SEQ ID NO: 393663 - DNA, 25 bp, Homo sapien
gagagtctcacttctaaatgaaaca

SEQ ID NO: 393664 - DNA, 25 bp, Homo sapien
catttcactttgatttctccactga

SEQ ID NO: 393665 - DNA, 25 bp, Homo sapien
taggaatgtctgttaactttctgag

SEQ ID NO: 393666 - DNA, 25 bp, Homo sapien
taactttctgagaaccctagtgccc

SEQ ID NO: 393667 - DNA, 25 bp, Homo sapien
ctagtgccccatcatattaactgtc

SEQ ID NO: 393668 - DNA, 25 bp, Homo sapien
atagacttaattgcctaggtacaag

SEQ ID NO: 393669 - DNA, 25 bp, Homo sapien
aggtacaagcaggactttgggacaa

SEQ ID NO: 393670 - DNA, 25 bp, Homo sapien
aatctctttgtgctgtttggtaaca

SEQ ID NO: 393671 - DNA, 25 bp, Homo sapien
gtttggtaacacttaactctatttg

SEQ ID NO: 393672 - DNA, 25 bp, Homo sapien
aatctttctccttaggtcctcacac

SEQ ID NO: 393673 - DNA, 25 bp, Homo sapien
ggtcctcacacaattccttacagag

SEQ ID NO: 393674 - DNA, 25 bp, Homo sapien
aactatttaccatacaattacttgt

SEQ ID NO: 393675 - DNA, 25 bp, Homo sapien
ttaagaacattgtatctttcatttt

SEQ ID NO: 393676 - DNA, 25 bp, Homo sapien
atattaataactatccttctatttg

SEQ ID NO: 393677 - DNA, 25 bp, Homo sapien
aataactatccttctatttgttacg

SEQ ID NO: 393678 - DNA, 25 bp, Homo sapien
ataactatccttctatttgttacgt

SEQ ID NO: 393679 - DNA, 25 bp, Homo sapien
actatccttctatttgttacgttct

SEQ ID NO: 393680 - DNA, 25 bp, Homo sapien
ctatccttctatttgttacgttctt

SEQ ID NO: 393681 - DNA, 25 bp, Homo sapien
tatccttctatttgttacgttcttt

SEQ ID NO: 393682 - DNA, 25 bp, Homo sapien
tcaggtaattaatacacaaaacttt

SEQ ID NO: 393683 - DNA, 25 bp, Homo sapien
attaatacacaaaactttattctgt

SEQ ID NO: 393684 - DNA, 25 bp, Homo sapien
ttctgtcccttgcttgtagcactac

SEQ ID NO: 393685 - DNA, 25 bp, Homo sapien
tagttgatcggtagaggaagcttgt

SEQ ID NO: 393686 - DNA, 25 bp, Homo sapien
gtaggacaggttatgatgtcttcac

SEQ ID NO: 393687 - DNA, 25 bp, Homo sapien
tatgatgtcttcactgtatggacgt

SEQ ID NO: 393688 - DNA, 25 bp, Homo sapien
ctgtatggacgtgaacccagggttc

SEQ ID NO: 393689 - DNA, 25 bp, Homo sapien
tgaacccagggttctaataggttgg

SEQ ID NO: 393690 - DNA, 25 bp, Homo sapien
ttgcccaaggtcacctgctagcttg

SEQ ID NO: 393691 - DNA, 25 bp, Homo sapien
aaggtcacctgctagcttgtaaggt

SEQ ID NO: 393692 - DNA, 25 bp, Homo sapien
gcttgtaaggtaggaatagggctca

SEQ ID NO: 393693 - DNA, 25 bp, Homo sapien
ttttggttcagaagcttgactcata

SEQ ID NO: 393694 - DNA, 25 bp, Homo sapien
gcttgactcataaactatactatat

SEQ ID NO: 393695 - DNA, 25 bp, Homo sapien
tattcccaaaaatgtcagtattgac

SEQ ID NO: 393696 - DNA, 25 bp, Homo sapien
aatggccactcctgtagtttctttt

SEQ ID NO: 393697 - DNA, 25 bp, Homo sapien
aaatgggatctggacgaatgatacc

SEQ ID NO: 393698 - DNA, 25 bp, Homo sapien
gataccaaacgtttctttctaacat

SEQ ID NO: 393699 - DNA, 25 bp, Homo sapien
gtattttataactctggcctatgat

SEQ ID NO: 393700 - DNA, 25 bp, Homo sapien
gcctatgattgtgttgtgtcttgca

SEQ ID NO: 393701 - DNA, 25 bp, Homo sapien
tacttctgttatctgaaatacctga

SEQ ID NO: 393702 - DNA, 25 bp, Homo sapien
atacctgagatgcactttaaactgt

SEQ ID NO: 393703 - DNA, 25 bp, Homo sapien
ctgttgaaatgtaagctctgagggc

SEQ ID NO: 393704 - DNA, 25 bp, Homo sapien
gggcagggaccgtatcttatttact

SEQ ID NO: 393705 - DNA, 25 bp, Homo sapien
tactgttagtatccgttgcatctag

SEQ ID NO: 393706 - DNA, 25 bp, Homo sapien
gcatctagtgtggtgcacctggcac

SEQ ID NO: 393707 - DNA, 25 bp, Homo sapien
gatttagaggagtctgcatagcaga

SEQ ID NO: 393708 - DNA, 25 bp, Homo sapien
gaggtgttagcaaagagtatctgtg

SEQ ID NO: 393709 - DNA, 25 bp, Homo sapien
tatctgtgaggatgatactcttgga

SEQ ID NO: 393710 - DNA, 25 bp, Homo sapien
gatactcttggaattgcaggtcata

SEQ ID NO: 393711 - DNA, 25 bp, Homo sapien
aagtaggtaaatgctccctgaatgg

SEQ ID NO: 393712 - DNA, 25 bp, Homo sapien
gggcttatactttatcctataggca

SEQ ID NO: 393713 - DNA, 25 bp, Homo sapien
tatcctataggcagtgggaagcctt

SEQ ID NO: 393714 - DNA, 25 bp, Homo sapien
gggaagccttaggtaagaatacagt

SEQ ID NO: 393715 - DNA, 25 bp, Homo sapien
tacagtgatacgaaagttttgcatt

SEQ ID NO: 393716 - DNA, 25 bp, Homo sapien
agttttgcattcactttagtaatgg

SEQ ID NO: 393717 - DNA, 25 bp, Homo sapien
caggagagaagccaggatatttcac

SEQ ID NO: 393718 - DNA, 25 bp, Homo sapien
agtggcagctcgtcggtcacgtcgt

SEQ ID NO: 393719 - DNA, 25 bp, Homo sapien
agctcgtcggtcacgtcgtaggact

SEQ ID NO: 393720 - DNA, 25 bp, Homo sapien
tcggtcacgtcgtaggactgctggc

SEQ ID NO: 393721 - DNA, 25 bp, Homo sapien
tagggtcttgccatgtggtgatttt

SEQ ID NO: 393722 - DNA, 25 bp, Homo sapien
tcttgccatgtggtgattttttcta

SEQ ID NO: 393723 - DNA, 25 bp, Homo sapien
tgcgagcggacatgctgggcacccc

SEQ ID NO: 393724 - DNA, 25 bp, Homo sapien
actggcgcgagtgcgagcccgaatc

SEQ ID NO: 393725 - DNA, 25 bp, Homo sapien
ttctatgtgattgaggaagtacctc

SEQ ID NO: 393726 - DNA, 25 bp, Homo sapien
aggaagtacctctggccagtggccg

SEQ ID NO: 393727 - DNA, 25 bp, Homo sapien
tggccagtggccgtgaaggtcatct

SEQ ID NO: 393728 - DNA, 25 bp, Homo sapien
agtggccgtgaaggtcatctcccag

SEQ ID NO: 393729 - DNA, 25 bp, Homo sapien
aatttctgtgaagagtgcccctggt

SEQ ID NO: 393730 - DNA, 25 bp, Homo sapien
gaagagtgcccctggtgtttcatct

SEQ ID NO: 393731 - DNA, 25 bp, Homo sapien
gtgtttcatcttggcctgttttgat

SEQ ID NO: 393732 - DNA, 25 bp, Homo sapien
ttgtgtctggataacgcgtcagctt

SEQ ID NO: 393733 - DNA, 25 bp, Homo sapien
gataacgcgtcagcttcttaaagta

SEQ ID NO: 393734 - DNA, 25 bp, Homo sapien
agaattttccagctctaactgcctt

SEQ ID NO: 393735 - DNA, 25 bp, Homo sapien
gctctaactgccttcttagtacatg

SEQ ID NO: 393736 - DNA, 25 bp, Homo sapien
cttagtacatgtctttctgcctttg

SEQ ID NO: 393737 - DNA, 25 bp, Homo sapien
ctttctgcctttgaagcatatgagt

SEQ ID NO: 393738 - DNA, 25 bp, Homo sapien
tgagtttgccaaagtcattctcccc

SEQ ID NO: 393739 - DNA, 25 bp, Homo sapien
cccctaatgacatattgtggactta

SEQ ID NO: 393740 - DNA, 25 bp, Homo sapien
tttaaccttacctgctttccaagag

SEQ ID NO: 393741 - DNA, 25 bp, Homo sapien
ttaaccttacctgctttccaagaga

SEQ ID NO: 393742 - DNA, 25 bp, Homo sapien
taaccttacctgctttccaagagag

SEQ ID NO: 393743 - DNA, 25 bp, Homo sapien
aaccttacctgctttccaagagaga

SEQ ID NO: 393744 - DNA, 25 bp, Homo sapien
accttacctgctttccaagagagat

SEQ ID NO: 393745 - DNA, 25 bp, Homo sapien
ccttacctgctttccaagagagatt

SEQ ID NO: 393746 - DNA, 25 bp, Homo sapien
ctttccaagagagattttatgtttt

SEQ ID NO: 393747 - DNA, 25 bp, Homo sapien
tttagggtagggtcttgtagaatgc

SEQ ID NO: 393748 - DNA, 25 bp, Homo sapien
agggtagggtcttgtagaatgcaat

SEQ ID NO: 393749 - DNA, 25 bp, Homo sapien
gtagggtcttgtagaatgcaatggt

SEQ ID NO: 393750 - DNA, 25 bp, Homo sapien
gggtcttgtagaatgcaatggtgca

SEQ ID NO: 393751 - DNA, 25 bp, Homo sapien
atgcacgcttgagaatggagattta

SEQ ID NO: 393752 - DNA, 25 bp, Homo sapien
tcactatattcaggtacatggtagg

SEQ ID NO: 393753 - DNA, 25 bp, Homo sapien
tcaggtacatggtaggatcaacttc

SEQ ID NO: 393754 - DNA, 25 bp, Homo sapien
tggtaggatcaacttcctgaccttg

SEQ ID NO: 393755 - DNA, 25 bp, Homo sapien
aaatgagaacgaggctttggagcac

SEQ ID NO: 393756 - DNA, 25 bp, Homo sapien
gaacgaggctttggagcacagcatt

SEQ ID NO: 393757 - DNA, 25 bp, Homo sapien
cgaggctttggagcacagcattgga

SEQ ID NO: 393758 - DNA, 25 bp, Homo sapien
gctttggagcacagcattggattgc

SEQ ID NO: 393759 - DNA, 25 bp, Homo sapien
agcacagcattggattgctcatgca

SEQ ID NO: 393760 - DNA, 25 bp, Homo sapien
attggattgctcatgcagaacacca

SEQ ID NO: 393761 - DNA, 25 bp, Homo sapien
gattgctcatgcagaacaccaccca

SEQ ID NO: 393762 - DNA, 25 bp, Homo sapien
aggctgctgcagcacttccaggacg

SEQ ID NO: 393763 - DNA, 25 bp, Homo sapien
tgctgcagcacttccaggacggtgg

SEQ ID NO: 393764 - DNA, 25 bp, Homo sapien
gctgccctggaggagcacgtggctg

SEQ ID NO: 393765 - DNA, 25 bp, Homo sapien
ggctgatgagaacctcaaggccttc

SEQ ID NO: 393766 - DNA, 25 bp, Homo sapien
gatgagaacctcaaggccttcctca

SEQ ID NO: 393767 - DNA, 25 bp, Homo sapien
ggatggagatccggctgcacaccag

SEQ ID NO: 393768 - DNA, 25 bp, Homo sapien
tgcacaccaggtgcggaggctgagc

SEQ ID NO: 393769 - DNA, 25 bp, Homo sapien
gctggactccctaccgcaggacgga

SEQ ID NO: 393770 - DNA, 25 bp, Homo sapien
ccctaccgcaggacggagtccagga

SEQ ID NO: 393771 - DNA, 25 bp, Homo sapien
acagactccttgtgtccaacgggaa

SEQ ID NO: 393772 - DNA, 25 bp, Homo sapien
actccttgtgtccaacgggaatagg

SEQ ID NO: 393773 - DNA, 25 bp, Homo sapien
gaagaatcatttctgggcttgtgat

SEQ ID NO: 393774 - DNA, 25 bp, Homo sapien
gcttgtgatgttaatattgcccccc

SEQ ID NO: 393775 - DNA, 25 bp, Homo sapien
gatgttaatattgcccccctactgg

SEQ ID NO: 393776 - DNA, 25 bp, Homo sapien
atgggataacattgccggtggactt

SEQ ID NO: 393777 - DNA, 25 bp, Homo sapien
taacattgccggtggacttccaggg

SEQ ID NO: 393778 - DNA, 25 bp, Homo sapien
gcagtttgcttcacaggaaatagct

SEQ ID NO: 393779 - DNA, 25 bp, Homo sapien
gctgaaaaggctctaaagaaacaca

SEQ ID NO: 393780 - DNA, 25 bp, Homo sapien
atggatggttggttggatatgtcac

SEQ ID NO: 393781 - DNA, 25 bp, Homo sapien
gttggttggatatgtcacttttctt

SEQ ID NO: 393782 - DNA, 25 bp, Homo sapien
tggatatgtcacttttcttatggta

SEQ ID NO: 393783 - DNA, 25 bp, Homo sapien
aacaattaaatccatattctctctg

SEQ ID NO: 393784 - DNA, 25 bp, Homo sapien
tgacccgtcttaaatcaatccagat

SEQ ID NO: 393785 - DNA, 25 bp, Homo sapien
aaagccattcgaagagcggcggtaa

SEQ ID NO: 393786 - DNA, 25 bp, Homo sapien
gctaatccggaaatgcaatggctat

SEQ ID NO: 393787 - DNA, 25 bp, Homo sapien
atggctatgaacactttcctgcgtc

SEQ ID NO: 393788 - DNA, 25 bp, Homo sapien
tcctgcgtccctcgaggagaactaa

SEQ ID NO: 393789 - DNA, 25 bp, Homo sapien
ctaagggtgtcgttttgtggaagat

SEQ ID NO: 393790 - DNA, 25 bp, Homo sapien
ggagcatcactttggtggtgaccaa

SEQ ID NO: 393791 - DNA, 25 bp, Homo sapien
aagttcactgctgaatcacggcctt

SEQ ID NO: 393792 - DNA, 25 bp, Homo sapien
agatattcttgaaccacactgttcc

SEQ ID NO: 393793 - DNA, 25 bp, Homo sapien
ttcaagccacgctagtgctatctga

SEQ ID NO: 393794 - DNA, 25 bp, Homo sapien
tagtgctatctgacccgtcttaaat

SEQ ID NO: 393795 - DNA, 25 bp, Homo sapien
gagtcggagatgatgcagcacacac

SEQ ID NO: 393796 - DNA, 25 bp, Homo sapien
aattccccagcccagtgatgcttgt

SEQ ID NO: 393797 - DNA, 25 bp, Homo sapien
ccagtgatgcttgtgttgaccagat

SEQ ID NO: 393798 - DNA, 25 bp, Homo sapien
ttgaccagatgttcctgagtctgga

SEQ ID NO: 393799 - DNA, 25 bp, Homo sapien
ctgagtctggagcaagcacccaggc

SEQ ID NO: 393800 - DNA, 25 bp, Homo sapien
gcacccaggccagaataacagagct

SEQ ID NO: 393801 - DNA, 25 bp, Homo sapien
aacagagctttcttagttggtgaag

SEQ ID NO: 393802 - DNA, 25 bp, Homo sapien
gaagacttaaacatctgcctgaggt

SEQ ID NO: 393803 - DNA, 25 bp, Homo sapien
aggtcaggaggcaatttgcctgcct

SEQ ID NO: 393804 - DNA, 25 bp, Homo sapien
ctgccttgtacaaaagctcaggtga

SEQ ID NO: 393805 - DNA, 25 bp, Homo sapien
gagatgaatgtctttcctctccctg

SEQ ID NO: 393806 - DNA, 25 bp, Homo sapien
tcaaacaattgtagatcccttcagt

SEQ ID NO: 393807 - DNA, 25 bp, Homo sapien
gtagatcccttcagttcaaaacata

SEQ ID NO: 393808 - DNA, 25 bp, Homo sapien
atgcaattcagtttgttctcagtga

SEQ ID NO: 393809 - DNA, 25 bp, Homo sapien
gagtttagtcatcttcgtccagaac

SEQ ID NO: 393810 - DNA, 25 bp, Homo sapien
ttcgtccagaacagcggttggcttt

SEQ ID NO: 393811 - DNA, 25 bp, Homo sapien
attgcatgaaggtactggtcctcgt

SEQ ID NO: 393812 - DNA, 25 bp, Homo sapien
actggtcctcgtgttatttctgctt

SEQ ID NO: 393813 - DNA, 25 bp, Homo sapien
ttgataattcagacaaccggttacc

SEQ ID NO: 393814 - DNA, 25 bp, Homo sapien
caaccggttaccaatcgataaagag

SEQ ID NO: 393815 - DNA, 25 bp, Homo sapien
acttcgaagagttattggtgccaaa

SEQ ID NO: 393816 - DNA, 25 bp, Homo sapien
tggtgccaaaaaggatcagtatttc

SEQ ID NO: 393817 - DNA, 25 bp, Homo sapien
gatccttacctaccacgatgtggga

SEQ ID NO: 393818 - DNA, 25 bp, Homo sapien
accacgatgtgggactcaactataa

SEQ ID NO: 393819 - DNA, 25 bp, Homo sapien
actataaatcttgcttccagccact

SEQ ID NO: 393820 - DNA, 25 bp, Homo sapien
tccagccactgtttcagttcgagga

SEQ ID NO: 393821 - DNA, 25 bp, Homo sapien
actgtttcagttcgaggacatgcag

SEQ ID NO: 393822 - DNA, 25 bp, Homo sapien
aaatcattcagaactttgtgcgggt

SEQ ID NO: 393823 - DNA, 25 bp, Homo sapien
ttgtgcgggttcatgtggatgcccc

SEQ ID NO: 393824 - DNA, 25 bp, Homo sapien
atatcagtacccatctctggaccag

SEQ ID NO: 393825 - DNA, 25 bp, Homo sapien
agcttgcagacatgatcccttgcgt

SEQ ID NO: 393826 - DNA, 25 bp, Homo sapien
ttgcgtcctgcagtacctaaatttc

SEQ ID NO: 393827 - DNA, 25 bp, Homo sapien
gcagtacctaaatttctctacaata

SEQ ID NO: 393828 - DNA, 25 bp, Homo sapien
gcaataatggttaagagcatggact

SEQ ID NO: 393829 - DNA, 25 bp, Homo sapien
ctctcagaagtcaaactgccggagt

SEQ ID NO: 393830 - DNA, 25 bp, Homo sapien
ttgaatactggttcctcctctccct

SEQ ID NO: 393831 - DNA, 25 bp, Homo sapien
tccctttccgcctggttttcagaat

SEQ ID NO: 393832 - DNA, 25 bp, Homo sapien
ctggttttcagaatgttgcttaaac

SEQ ID NO: 393833 - DNA, 25 bp, Homo sapien
tgttgcttaaacattctacctttgt

SEQ ID NO: 393834 - DNA, 25 bp, Homo sapien
acattctacctttgtttccttgtct

SEQ ID NO: 393835 - DNA, 25 bp, Homo sapien
catagggttgttgtcagggttgaat

SEQ ID NO: 393836 - DNA, 25 bp, Homo sapien
gtcagggttgaatgagctaatatat

SEQ ID NO: 393837 - DNA, 25 bp, Homo sapien
aaccttacatgttaaactggtcata

SEQ ID NO: 393838 - DNA, 25 bp, Homo sapien
gtcaaaaccaaagcttgtacttgtt

SEQ ID NO: 393839 - DNA, 25 bp, Homo sapien
aggattaaagttcagtctcgctctg

SEQ ID NO: 393840 - DNA, 25 bp, Homo sapien
ggattaaagttcagtctcgctctgt

SEQ ID NO: 393841 - DNA, 25 bp, Homo sapien
accaccacacacggctggtttttgt

SEQ ID NO: 393842 - DNA, 25 bp, Homo sapien
cactgcatccagctcttagcatgtg

SEQ ID NO: 393843 - DNA, 25 bp, Homo sapien
gtgctgcgatcttggatcactgcga

SEQ ID NO: 393844 - DNA, 25 bp, Homo sapien
ctgcctgctgggtttaggcgattca

SEQ ID NO: 393845 - DNA, 25 bp, Homo sapien
tgcctgctgggtttaggcgattcag

SEQ ID NO: 393846 - DNA, 25 bp, Homo sapien
cctgctgggtttaggcgattcaggt

SEQ ID NO: 393847 - DNA, 25 bp, Homo sapien
tgggtttaggcgattcaggtgcctc

SEQ ID NO: 393848 - DNA, 25 bp, Homo sapien
tttaggcgattcaggtgcctcggcc

SEQ ID NO: 393849 - DNA, 25 bp, Homo sapien
ttaggcgattcaggtgcctcggcct

SEQ ID NO: 393850 - DNA, 25 bp, Homo sapien
gttaagaatgtgctgcagtggcttt

SEQ ID NO: 393851 - DNA, 25 bp, Homo sapien
gagagaccagcaggactttgcccag

SEQ ID NO: 393852 - DNA, 25 bp, Homo sapien
ccagcaggactttgcccagttttgt

SEQ ID NO: 393853 - DNA, 25 bp, Homo sapien
gagtcaagcatggagcatatttctt

SEQ ID NO: 393854 - DNA, 25 bp, Homo sapien
ggagcatatttcttgcttggataac

SEQ ID NO: 393855 - DNA, 25 bp, Homo sapien
gataactgagtgctggcatcccatt

SEQ ID NO: 393856 - DNA, 25 bp, Homo sapien
ggcatcccatttgatcattcgtaga

SEQ ID NO: 393857 - DNA, 25 bp, Homo sapien
gatcattcgtagatatgctgagttt

SEQ ID NO: 393858 - DNA, 25 bp, Homo sapien
tatgctgagtttcaggtggcttcag

SEQ ID NO: 393859 - DNA, 25 bp, Homo sapien
gtggcttcaggacatccaagtggac

SEQ ID NO: 393860 - DNA, 25 bp, Homo sapien
ggacatccagtaggattctgcagat

SEQ ID NO: 393861 - DNA, 25 bp, Homo sapien
aaatatttttcctcaacacaggaga

SEQ ID NO: 393862 - DNA, 25 bp, Homo sapien
cagatgcaagtcacatgcatgatat

SEQ ID NO: 393863 - DNA, 25 bp, Homo sapien
catgcatgatattgatgtggatctc

SEQ ID NO: 393864 - DNA, 25 bp, Homo sapien
gatattgatgtggatctcaatgttg

SEQ ID NO: 393865 - DNA, 25 bp, Homo sapien
gttaagttcctctggaacaaccatg

SEQ ID NO: 393866 - DNA, 25 bp, Homo sapien
gttcctctggaacaaccatgtgata

SEQ ID NO: 393867 - DNA, 25 bp, Homo sapien
tcctctggaacaaccatgtgataaa

SEQ ID NO: 393868 - DNA, 25 bp, Homo sapien
atgtgataaatctattctggcccaa

SEQ ID NO: 393869 - DNA, 25 bp, Homo sapien
gtgataaatctattctggcccaaac

SEQ ID NO: 393870 - DNA, 25 bp, Homo sapien
gataaatctattctggcccaaactg

SEQ ID NO: 393871 - DNA, 25 bp, Homo sapien
ataaatctattctggcccaaactgg

SEQ ID NO: 393872 - DNA, 25 bp, Homo sapien
attaggcagggcatactcctaccca

SEQ ID NO: 393873 - DNA, 25 bp, Homo sapien
gcaaactaagctgcctctcaacaat

SEQ ID NO: 393874 - DNA, 25 bp, Homo sapien
taagctgcctctcaacaatgaggga

SEQ ID NO: 393875 - DNA, 25 bp, Homo sapien
tgcctctcaacaatgagggagaact

SEQ ID NO: 393876 - DNA, 25 bp, Homo sapien
ctattatgttttgaaagtcgggaag

SEQ ID NO: 393877 - DNA, 25 bp, Homo sapien
aaatgtatccgtaaacaaggtgatg

SEQ ID NO: 393878 - DNA, 25 bp, Homo sapien
caaggtgatgtgatctttcatgtgt

SEQ ID NO: 393879 - DNA, 25 bp, Homo sapien
atctttcatgtgttagtatattcga

SEQ ID NO: 393880 - DNA, 25 bp, Homo sapien
tacatatgagaggtatgcctgtcca

SEQ ID NO: 393881 - DNA, 25 bp, Homo sapien
gagaggtatgcctgtccagtaaaga

SEQ ID NO: 393882 - DNA, 25 bp, Homo sapien
gcctgtccagtaaagagattgattt

SEQ ID NO: 393883 - DNA, 25 bp, Homo sapien
gattataaatactctgaatcaggca

SEQ ID NO: 393884 - DNA, 25 bp, Homo sapien
gaatcaggcatctattttgcaccca

SEQ ID NO: 393885 - DNA, 25 bp, Homo sapien
tggctgacagcctacaagagtttaa

SEQ ID NO: 393886 - DNA, 25 bp, Homo sapien
gacagcctacaagagtttaaggact

SEQ ID NO: 393887 - DNA, 25 bp, Homo sapien
ttaaggactacattgaaaatctgcc

SEQ ID NO: 393888 - DNA, 25 bp, Homo sapien
gaaaatctgcctttgatcgatgacc

SEQ ID NO: 393889 - DNA, 25 bp, Homo sapien
ctgcctttgatcgatgacccagaaa

SEQ ID NO: 393890 - DNA, 25 bp, Homo sapien
gcctttgatcgatgacccagaaatt

SEQ ID NO: 393891 - DNA, 25 bp, Homo sapien
tttgatcgatgacccagaaattttt

SEQ ID NO: 393892 - DNA, 25 bp, Homo sapien
ccagaaatttttggaatgcatgaaa

SEQ ID NO: 393893 - DNA, 25 bp, Homo sapien
tgaaaatgctaatctagtcttccag

SEQ ID NO: 393894 - DNA, 25 bp, Homo sapien
ttgaaacctttgacactgacagatg

SEQ ID NO: 393895 - DNA, 25 bp, Homo sapien
gatgtgtttgcaaggatacggctgc

SEQ ID NO: 393896 - DNA, 25 bp, Homo sapien
aaggatacggctgcagtattactaa

SEQ ID NO: 393897 - DNA, 25 bp, Homo sapien
ggcataccaaaatccagaagtttaa

SEQ ID NO: 393898 - DNA, 25 bp, Homo sapien
gaactctgaatatgccttctttttt

SEQ ID NO: 393899 - DNA, 25 bp, Homo sapien
gaaatatcttcgagacttgggtgtt

SEQ ID NO: 393900 - DNA, 25 bp, Homo sapien
tttcctgagggatttctaaccatgt

SEQ ID NO: 393901 - DNA, 25 bp, Homo sapien
taaccatgtatctaatcctcccatt

SEQ ID NO: 393902 - DNA, 25 bp, Homo sapien
gtatctaatcctcccatttgggcag

SEQ ID NO: 393903 - DNA, 25 bp, Homo sapien
tcccatttgggcagtataggtgttt

SEQ ID NO: 393904 - DNA, 25 bp, Homo sapien
gcagtataggtgtttgcttttttgt

SEQ ID NO: 393905 - DNA, 25 bp, Homo sapien
cagcctacctaagcttatgttcaag

SEQ ID NO: 393906 - DNA, 25 bp, Homo sapien
tacctaagcttatgttcaagagtct

SEQ ID NO: 393907 - DNA, 25 bp, Homo sapien
caagagtctctcttgaaatccagga

SEQ ID NO: 393908 - DNA, 25 bp, Homo sapien
gatattccaagagtgatttaattgt

SEQ ID NO: 393909 - DNA, 25 bp, Homo sapien
tgatttaattgtgggatcctcctga

SEQ ID NO: 393910 - DNA, 25 bp, Homo sapien
gtaattttattatgacctccttcac

SEQ ID NO: 393911 - DNA, 25 bp, Homo sapien
gacctccttcacagtggttttcagg

SEQ ID NO: 393912 - DNA, 25 bp, Homo sapien
tttcaggtaaccctgctttcttagt

SEQ ID NO: 393913 - DNA, 25 bp, Homo sapien
caccgcacccagctaccagaagaaa

SEQ ID NO: 393914 - DNA, 25 bp, Homo sapien
gaaaactttcacacagcctacctaa

SEQ ID NO: 393915 - DNA, 25 bp, Homo sapien
ttcacacagcctacctaagcttatg

SEQ ID NO: 393916 - DNA, 25 bp, Homo sapien
tgcgtccctggagttacctcaattt

SEQ ID NO: 393917 - DNA, 25 bp, Homo sapien
gtccctggagttacctcaatttggg

SEQ ID NO: 393918 - DNA, 25 bp, Homo sapien
aaaatccctcgaggtgtaactcagg

SEQ ID NO: 393919 - DNA, 25 bp, Homo sapien
gtaactcaggaaggcctagcgaatc

SEQ ID NO: 393920 - DNA, 25 bp, Homo sapien
aaggcctagcgaatcccgactcgga

SEQ ID NO: 393921 - DNA, 25 bp, Homo sapien
aatcccgactcggatggtgtcgcga

SEQ ID NO: 393922 - DNA, 25 bp, Homo sapien
gatggtgtcgcgagacccttttgca

SEQ ID NO: 393923 - DNA, 25 bp, Homo sapien
cgcgagacccttttgcaggcggcga

SEQ ID NO: 393924 - DNA, 25 bp, Homo sapien
gtgagttgaggaagtgcccctcacc

SEQ ID NO: 393925 - DNA, 25 bp, Homo sapien
gggacccctcatctcacgggtcatt

SEQ ID NO: 393926 - DNA, 25 bp, Homo sapien
ctcacgggtcatttccaccactaaa

SEQ ID NO: 393927 - DNA, 25 bp, Homo sapien
acacttgggtttacgttgcagggca

SEQ ID NO: 393928 - DNA, 25 bp, Homo sapien
gtttacgttgcagggcaacacctgt

SEQ ID NO: 393929 - DNA, 25 bp, Homo sapien
agggcaacacctgtgatgaacaaaa

SEQ ID NO: 393930 - DNA, 25 bp, Homo sapien
aaacacatggtagcgatagcccatt

SEQ ID NO: 393931 - DNA, 25 bp, Homo sapien
gtagcgatagcccattcatgaaaaa

SEQ ID NO: 393932 - DNA, 25 bp, Homo sapien
gtatttccagttggagccaaaacag

SEQ ID NO: 393933 - DNA, 25 bp, Homo sapien
gattagagataacaggaaccgggca

SEQ ID NO: 393934 - DNA, 25 bp, Homo sapien
gaggaatttttacatacgttcaagc

SEQ ID NO: 393935 - DNA, 25 bp, Homo sapien
tacgttcaagcttttcactttgcag

SEQ ID NO: 393936 - DNA, 25 bp, Homo sapien
tcaagcttttcactttgcagccaca

SEQ ID NO: 393937 - DNA, 25 bp, Homo sapien
tttcactttgcagccacactctgat

SEQ ID NO: 393938 - DNA, 25 bp, Homo sapien
ctgggatccagcgagcgacatggta

SEQ ID NO: 393939 - DNA, 25 bp, Homo sapien
tggtaaatgagctccagaacctatt

SEQ ID NO: 393940 - DNA, 25 bp, Homo sapien
cagaacctattgagcttgcagggaa

SEQ ID NO: 393941 - DNA, 25 bp, Homo sapien
gaagccaagcttgcagttccagcaa

SEQ ID NO: 393942 - DNA, 25 bp, Homo sapien
tagaccaaaccctaatctctacagg

SEQ ID NO: 393943 - DNA, 25 bp, Homo sapien
ccagtacagttgtttggcctacctg

SEQ ID NO: 393944 - DNA, 25 bp, Homo sapien
tggcctacctgatgctatctctaaa

SEQ ID NO: 393945 - DNA, 25 bp, Homo sapien
ctgatgctatctctaaactactttt

SEQ ID NO: 393946 - DNA, 25 bp, Homo sapien
acatttgggtgtttcatgtcagtga

SEQ ID NO: 393947 - DNA, 25 bp, Homo sapien
ggacttaacaaacatactgttccca

SEQ ID NO: 393948 - DNA, 25 bp, Homo sapien
tactgttcccatacatagtacaaag

SEQ ID NO: 393949 - DNA, 25 bp, Homo sapien
ggagaaacatctgctagtggaataa

SEQ ID NO: 393950 - DNA, 25 bp, Homo sapien
ttgttcaggcttattatggctcata

SEQ ID NO: 393951 - DNA, 25 bp, Homo sapien
ggcttattatggctcatagattaca

SEQ ID NO: 393952 - DNA, 25 bp, Homo sapien
gagaatgatgctagttacatgccaa

SEQ ID NO: 393953 - DNA, 25 bp, Homo sapien
gatgctagttacatgccaatgaact

SEQ ID NO: 393954 - DNA, 25 bp, Homo sapien
gccaatgaactatttttactctttt

SEQ ID NO: 393955 - DNA, 25 bp, Homo sapien
gaactatttttactctttttatatg

SEQ ID NO: 393956 - DNA, 25 bp, Homo sapien
gttctggtgatggtggtacctctta

SEQ ID NO: 393957 - DNA, 25 bp, Homo sapien
gatggtggtacctcttattacctta

SEQ ID NO: 393958 - DNA, 25 bp, Homo sapien
gtggtacctcttattaccttatgta

SEQ ID NO: 393959 - DNA, 25 bp, Homo sapien
accttatgtaaaacacttgaacagc

SEQ ID NO: 393960 - DNA, 25 bp, Homo sapien
aaaaatggttggtgtattttgtcag

SEQ ID NO: 393961 - DNA, 25 bp, Homo sapien
gtaattgtacataacttttggcaca

SEQ ID NO: 393962 - DNA, 25 bp, Homo sapien
ataacttttggcacatgacatagaa

SEQ ID NO: 393963 - DNA, 25 bp, Homo sapien
attattttgctaagagactgtatgc

SEQ ID NO: 393964 - DNA, 25 bp, Homo sapien
agagactgtatgcaagccttgggcc

SEQ ID NO: 393965 - DNA, 25 bp, Homo sapien
aagccttgggccgactttacagacg

SEQ ID NO: 393966 - DNA, 25 bp, Homo sapien
tgggccgactttacagacgtccaga

SEQ ID NO: 393967 - DNA, 25 bp, Homo sapien
tttacagacgtccagagcaaagccc

SEQ ID NO: 393968 - DNA, 25 bp, Homo sapien
agcaaagccccttctttgtacctat

SEQ ID NO: 393969 - DNA, 25 bp, Homo sapien
tacaaatatactaattggttctttc

SEQ ID NO: 393970 - DNA, 25 bp, Homo sapien
gttctttctattttcagaggttatt

SEQ ID NO: 393971 - DNA, 25 bp, Homo sapien
tgataagatgttagaaatttggacc

SEQ ID NO: 393972 - DNA, 25 bp, Homo sapien
taatcagggtagcattaaaatggag

SEQ ID NO: 393973 - DNA, 25 bp, Homo sapien
atgcagtaaatataagccacatttc

SEQ ID NO: 393974 - DNA, 25 bp, Homo sapien
aaatataagccacatttctaaagtt

SEQ ID NO: 393975 - DNA, 25 bp, Homo sapien
agcttcttttaagattttgaaatct

SEQ ID NO: 393976 - DNA, 25 bp, Homo sapien
ttgaaatctattctgcattcccaag

SEQ ID NO: 393977 - DNA, 25 bp, Homo sapien
gaaatctattctgcattcccaagag

SEQ ID NO: 393978 - DNA, 25 bp, Homo sapien
aaatctattctgcattcccaagagt

SEQ ID NO: 393979 - DNA, 25 bp, Homo sapien
atctattctgcattcccaagagttt

SEQ ID NO: 393980 - DNA, 25 bp, Homo sapien
ctattctgcattcccaagagtttat

SEQ ID NO: 393981 - DNA, 25 bp, Homo sapien
tgtatttttctttggttgtccctat

SEQ ID NO: 393982 - DNA, 25 bp, Homo sapien
cccagcatgcttttggcattgtttt

SEQ ID NO: 393983 - DNA, 25 bp, Homo sapien
agccgaggtagcttcctgaaatgcg

SEQ ID NO: 393984 - DNA, 25 bp, Homo sapien
gccgaggtagcttcctgaaatgcgt

SEQ ID NO: 393985 - DNA, 25 bp, Homo sapien
ccgaggtagcttcctgaaatgcgtg

SEQ ID NO: 393986 - DNA, 25 bp, Homo sapien
cgaggtagcttcctgaaatgcgtga

SEQ ID NO: 393987 - DNA, 25 bp, Homo sapien
gaggtagcttcctgaaatgcgtgaa

SEQ ID NO: 393988 - DNA, 25 bp, Homo sapien
ggtagcttcctgaaatgcgtgaagg

SEQ ID NO: 393989 - DNA, 25 bp, Homo sapien
actgtgtgagaaccaacgggaaaga

SEQ ID NO: 393990 - DNA, 25 bp, Homo sapien
gtgtgagaaccaacgggaaagagct

SEQ ID NO: 393991 - DNA, 25 bp, Homo sapien
agaaccaacgggaaagagcttgagc

SEQ ID NO: 393992 - DNA, 25 bp, Homo sapien
ccaacgggaaagagcttgagctgct

SEQ ID NO: 393993 - DNA, 25 bp, Homo sapien
gttttaggagccctcgatcgccatg

SEQ ID NO: 393994 - DNA, 25 bp, Homo sapien
ttttaggagccctcgatcgccatgg

SEQ ID NO: 393995 - DNA, 25 bp, Homo sapien
tgaaaccagttttgcacctattgtt

SEQ ID NO: 393996 - DNA, 25 bp, Homo sapien
gaaaccagttttgcacctattgttt

SEQ ID NO: 393997 - DNA, 25 bp, Homo sapien
accagttttgcacctattgttttga

SEQ ID NO: 393998 - DNA, 25 bp, Homo sapien
cagttttgcacctattgttttgatt

SEQ ID NO: 393999 - DNA, 25 bp, Homo sapien
gttttgcacctattgttttgatttt

SEQ ID NO: 394000 - DNA, 25 bp, Homo sapien
gcttggtctcggcctcaggatgccc

SEQ ID NO: 394001 - DNA, 25 bp, Homo sapien
tgccccctgttaacccctgtaggat

SEQ ID NO: 394002 - DNA, 25 bp, Homo sapien
agaggtgcagcgagttgcaccttcc

SEQ ID NO: 394003 - DNA, 25 bp, Homo sapien
tgcagcgagttgcaccttccctaaa

SEQ ID NO: 394004 - DNA, 25 bp, Homo sapien
tgtgcataccgtgtcagccgtgggc

SEQ ID NO: 394005 - DNA, 25 bp, Homo sapien
gtgctcaactgtttcatcttttcta

SEQ ID NO: 394006 - DNA, 25 bp, Homo sapien
atattgtacacaacccaggaagtaa

SEQ ID NO: 394007 - DNA, 25 bp, Homo sapien
caggaagtaactattttggacatgt

SEQ ID NO: 394008 - DNA, 25 bp, Homo sapien
aggtaatttactattatcctggaat

SEQ ID NO: 394009 - DNA, 25 bp, Homo sapien
tttagactaggtttgtttcatttgt

SEQ ID NO: 394010 - DNA, 25 bp, Homo sapien
ttgttgacttagtttccagccaaga

SEQ ID NO: 394011 - DNA, 25 bp, Homo sapien
gccaagaaggaaacgactgtctccc

SEQ ID NO: 394012 - DNA, 25 bp, Homo sapien
tccaggtctcagtttcaagggcaga

SEQ ID NO: 394013 - DNA, 25 bp, Homo sapien
gagagcagtctggaaaccctggctg

SEQ ID NO: 394014 - DNA, 25 bp, Homo sapien
tggaaaccctggctgtgcataccgt

SEQ ID NO: 394015 - DNA, 25 bp, Homo sapien
ctgacagactccctgcagtgggcag

SEQ ID NO: 394016 - DNA, 25 bp, Homo sapien
gccttggccgacattaatgaagtgc

SEQ ID NO: 394017 - DNA, 25 bp, Homo sapien
gccgacattaatgaagtgccaggat

SEQ ID NO: 394018 - DNA, 25 bp, Homo sapien
ggcctgctgatttgttctgttttac

SEQ ID NO: 394019 - DNA, 25 bp, Homo sapien
taagggtaactagagcgttactgga

SEQ ID NO: 394020 - DNA, 25 bp, Homo sapien
gtgtgtcacacatttcactggcaac

SEQ ID NO: 394021 - DNA, 25 bp, Homo sapien
tttaaaatgctgataccgccccaag

SEQ ID NO: 394022 - DNA, 25 bp, Homo sapien
taccgccccaagagagctgagtcaa

SEQ ID NO: 394023 - DNA, 25 bp, Homo sapien
gctgagtcaagtgaggcaaacgttc

SEQ ID NO: 394024 - DNA, 25 bp, Homo sapien
gtgaggcaaacgttcgcctgttgtt

SEQ ID NO: 394025 - DNA, 25 bp, Homo sapien
gttcgcctgttgttctcctgacaga

SEQ ID NO: 394026 - DNA, 25 bp, Homo sapien
ttcccatggcgatgtccatctgcca

SEQ ID NO: 394027 - DNA, 25 bp, Homo sapien
tgccaccgtggcactggtattgctt

SEQ ID NO: 394028 - DNA, 25 bp, Homo sapien
accgtggcactggtattgctttgag

SEQ ID NO: 394029 - DNA, 25 bp, Homo sapien
cactggtattgctttgagtgcaggg

SEQ ID NO: 394030 - DNA, 25 bp, Homo sapien
gcaggggtctctctttttggcatgt

SEQ ID NO: 394031 - DNA, 25 bp, Homo sapien
gttactccctgggaactttgagtct

SEQ ID NO: 394032 - DNA, 25 bp, Homo sapien
ccctgggaactttgagtcttatttg

SEQ ID NO: 394033 - DNA, 25 bp, Homo sapien
gggccagcactgatccacacagcta

SEQ ID NO: 394034 - DNA, 25 bp, Homo sapien
tgatccacacagctaagtttgcact

SEQ ID NO: 394035 - DNA, 25 bp, Homo sapien
gacacttgatgtgggacctaggaaa

SEQ ID NO: 394036 - DNA, 25 bp, Homo sapien
tgtgggacctaggaaaaggcctgaa

SEQ ID NO: 394037 - DNA, 25 bp, Homo sapien
tccttaatttgccatatgtgaaaac

SEQ ID NO: 394038 - DNA, 25 bp, Homo sapien
taatctatacattacttgggtgcta

SEQ ID NO: 394039 - DNA, 25 bp, Homo sapien
tatatataactagctttggagtcag

SEQ ID NO: 394040 - DNA, 25 bp, Homo sapien
ggagtcagaattagcgtctcatcct

SEQ ID NO: 394041 - DNA, 25 bp, Homo sapien
cagaattagcgtctcatcctggctc

SEQ ID NO: 394042 - DNA, 25 bp, Homo sapien
ttccatggatcagtgggtcagccgt

SEQ ID NO: 394043 - DNA, 25 bp, Homo sapien
taccactttccaactgtgcgactgt

SEQ ID NO: 394044 - DNA, 25 bp, Homo sapien
actgtgcgactgtggccaagtgact

SEQ ID NO: 394045 - DNA, 25 bp, Homo sapien
gggtcagccgtcacttgtgccctgg

SEQ ID NO: 394046 - DNA, 25 bp, Homo sapien
gcttgggcagcatgcatcattcatt

SEQ ID NO: 394047 - DNA, 25 bp, Homo sapien
gggcagcatgcatcattcattctga

SEQ ID NO: 394048 - DNA, 25 bp, Homo sapien
tccatgattgcggtcgcccggtgct

SEQ ID NO: 394049 - DNA, 25 bp, Homo sapien
gcttcgcccagccaaactttaaggt

SEQ ID NO: 394050 - DNA, 25 bp, Homo sapien
aactttaaggtggatggcattctga

SEQ ID NO: 394051 - DNA, 25 bp, Homo sapien
ggcattctgaaaacggttctccggg

SEQ ID NO: 394052 - DNA, 25 bp, Homo sapien
tgaaaacggttctccgggacgagat

SEQ ID NO: 394053 - DNA, 25 bp, Homo sapien
gggacgagatcattgcttggcacaa

SEQ ID NO: 394054 - DNA, 25 bp, Homo sapien
acatggacagccagcaactggtgtc

SEQ ID NO: 394055 - DNA, 25 bp, Homo sapien
aactggtgtccctggttcagaaagc

SEQ ID NO: 394056 - DNA, 25 bp, Homo sapien
ttcagaaagccgtcaccgccatcat

SEQ ID NO: 394057 - DNA, 25 bp, Homo sapien
acaacctcgcccagttcgaaggcgg

SEQ ID NO: 394058 - DNA, 25 bp, Homo sapien
ggccgcggcaaacagcctggacaat

SEQ ID NO: 394059 - DNA, 25 bp, Homo sapien
tcatggattctatggttcgtgacat

SEQ ID NO: 394060 - DNA, 25 bp, Homo sapien
atggttcgtgacatactggaccgca

SEQ ID NO: 394061 - DNA, 25 bp, Homo sapien
ttcgtgacatactggaccgcatcgc

SEQ ID NO: 394062 - DNA, 25 bp, Homo sapien
ctggcccactactccaagtgcgtga

SEQ ID NO: 394063 - DNA, 25 bp, Homo sapien
cactactccaagtgcgtgaccatca

SEQ ID NO: 394064 - DNA, 25 bp, Homo sapien
gacattcggatggccgtgtgcctgc

SEQ ID NO: 394065 - DNA, 25 bp, Homo sapien
ggcaagctcgctgagtctcagggca

SEQ ID NO: 394066 - DNA, 25 bp, Homo sapien
agctcgctgagtctcagggcacgaa

SEQ ID NO: 394067 - DNA, 25 bp, Homo sapien
gccatgccaacagcggcggagatat

SEQ ID NO: 394068 - DNA, 25 bp, Homo sapien
caacagcggcggagatatcttcggg

SEQ ID NO: 394069 - DNA, 25 bp, Homo sapien
gggacagctttgccgcctatttccc

SEQ ID NO: 394070 - DNA, 25 bp, Homo sapien
cctgaaaacaagaagtggcccttag

SEQ ID NO: 394071 - DNA, 25 bp, Homo sapien
gaagtggcccttagaaatctctctc

SEQ ID NO: 394072 - DNA, 25 bp, Homo sapien
agtcccactatcagaggccaactgc

SEQ ID NO: 394073 - DNA, 25 bp, Homo sapien
tccctccctgactgacaggcagaag

SEQ ID NO: 394074 - DNA, 25 bp, Homo sapien
gtgcctctggatatccccacagtgc

SEQ ID NO: 394075 - DNA, 25 bp, Homo sapien
acagtgccctgagctgcatctcttg

SEQ ID NO: 394076 - DNA, 25 bp, Homo sapien
tgccaccagactattgctccttgat

SEQ ID NO: 394077 - DNA, 25 bp, Homo sapien
accagactattgctccttgatgctc

SEQ ID NO: 394078 - DNA, 25 bp, Homo sapien
tccttgatgctctgggtcacctgca

SEQ ID NO: 394079 - DNA, 25 bp, Homo sapien
gtcacctgcatctagcatggcatat

SEQ ID NO: 394080 - DNA, 25 bp, Homo sapien
gcatggcatatatctagtgctcaat

SEQ ID NO: 394081 - DNA, 25 bp, Homo sapien
tattcccactctttattactgtcct

SEQ ID NO: 394082 - DNA, 25 bp, Homo sapien
attactgtcctgtcctacggatgca

SEQ ID NO: 394083 - DNA, 25 bp, Homo sapien
tacggatgcattctggccaccatat

SEQ ID NO: 394084 - DNA, 25 bp, Homo sapien
caccatattatgcatgcccacagga

SEQ ID NO: 394085 - DNA, 25 bp, Homo sapien
aagcagaaagcgttctccacttgtg

SEQ ID NO: 394086 - DNA, 25 bp, Homo sapien
tgtgcctcccatcttgtggtggtca

SEQ ID NO: 394087 - DNA, 25 bp, Homo sapien
caccattttctattcagccattatt

SEQ ID NO: 394088 - DNA, 25 bp, Homo sapien
attttcatgtatgctcgacctcgag

SEQ ID NO: 394089 - DNA, 25 bp, Homo sapien
gacctcgagttatccatgccttcaa

SEQ ID NO: 394090 - DNA, 25 bp, Homo sapien
attatttccatcttctatgccattg

SEQ ID NO: 394091 - DNA, 25 bp, Homo sapien
caaccctttcatttattgcctaaga

SEQ ID NO: 394092 - DNA, 25 bp, Homo sapien
gtcaaaatgacagcggaatgagccg

SEQ ID NO: 394093 - DNA, 25 bp, Homo sapien
aaatgacagcggaatgagccgggaa

SEQ ID NO: 394094 - DNA, 25 bp, Homo sapien
aatgacagcggaatgagccgggaaa

SEQ ID NO: 394095 - DNA, 25 bp, Homo sapien
aaggaaagaggccccgtgggatgct

SEQ ID NO: 394096 - DNA, 25 bp, Homo sapien
gggcctcggcccgacttctcacacg

SEQ ID NO: 394097 - DNA, 25 bp, Homo sapien
atgctgggggtcgagtcctaggccc

SEQ ID NO: 394098 - DNA, 25 bp, Homo sapien
gcttcaacctcgaacgggggcgacg

SEQ ID NO: 394099 - DNA, 25 bp, Homo sapien
gcgacggcaggtcccagccccgaca

SEQ ID NO: 394100 - DNA, 25 bp, Homo sapien
cacctcggccctgggatgctgggaa

SEQ ID NO: 394101 - DNA, 25 bp, Homo sapien
ggatgctgggaagggaacgaggcga

SEQ ID NO: 394102 - DNA, 25 bp, Homo sapien
gggaaccccaggtcaaaatgacagc

SEQ ID NO: 394103 - DNA, 25 bp, Homo sapien
ctgtgctagggatcacttccttgtt

SEQ ID NO: 394104 - DNA, 25 bp, Homo sapien
tgtgctagggatcacttccttgttg

SEQ ID NO: 394105 - DNA, 25 bp, Homo sapien
ggccggagttttaagaggatcttct

SEQ ID NO: 394106 - DNA, 25 bp, Homo sapien
ggagttttaagaggatcttctgctc

SEQ ID NO: 394107 - DNA, 25 bp, Homo sapien
tttaagaggatcttctgctcctcct

SEQ ID NO: 394108 - DNA, 25 bp, Homo sapien
ttaagaggatcttctgctcctcctc

SEQ ID NO: 394109 - DNA, 25 bp, Homo sapien
ggagtcccctaagacacatcttcag

SEQ ID NO: 394110 - DNA, 25 bp, Homo sapien
gtcccctaagacacatcttcagtca

SEQ ID NO: 394111 - DNA, 25 bp, Homo sapien
ccctaagacacatcttcagtcactt

SEQ ID NO: 394112 - DNA, 25 bp, Homo sapien
atcttcagtcacttctctctgcctg

SEQ ID NO: 394113 - DNA, 25 bp, Homo sapien
cttcagtcacttctctctgcctgtg

SEQ ID NO: 394114 - DNA, 25 bp, Homo sapien
gcaggttaaatgcagttttgaaaac

SEQ ID NO: 394115 - DNA, 25 bp, Homo sapien
aaacatcaaatggaggcgggaaata

SEQ ID NO: 394116 - DNA, 25 bp, Homo sapien
ggctgaacacagcagtgaccgtggg

SEQ ID NO: 394117 - DNA, 25 bp, Homo sapien
ccaggacctggctcgtgagtgcgtc

SEQ ID NO: 394118 - DNA, 25 bp, Homo sapien
tctgggtcaggaagagacctctctg

SEQ ID NO: 394119 - DNA, 25 bp, Homo sapien
ggaagagacctctctgtgcgtctca

SEQ ID NO: 394120 - DNA, 25 bp, Homo sapien
ctctctgtgcgtctcaggctgagat

SEQ ID NO: 394121 - DNA, 25 bp, Homo sapien
tcaggctgagatgcagatttctgtt

SEQ ID NO: 394122 - DNA, 25 bp, Homo sapien
ttttctaaaactggaagcgaccttg

SEQ ID NO: 394123 - DNA, 25 bp, Homo sapien
aaactggaagcgaccttgacgtgta

SEQ ID NO: 394124 - DNA, 25 bp, Homo sapien
ggaagcgaccttgacgtgtattgaa

SEQ ID NO: 394125 - DNA, 25 bp, Homo sapien
aagtacaagatcagattgccagcat

SEQ ID NO: 394126 - DNA, 25 bp, Homo sapien
atcaaagtaatgtcaagtgcttctg

SEQ ID NO: 394127 - DNA, 25 bp, Homo sapien
taatgtcaagtgcttctgacccact

SEQ ID NO: 394128 - DNA, 25 bp, Homo sapien
tgcattaaacgtgtgctgagcagtt

SEQ ID NO: 394129 - DNA, 25 bp, Homo sapien
ctgagcagttggtggtagaagacat

SEQ ID NO: 394130 - DNA, 25 bp, Homo sapien
gaagacattattgtgaaggctgctc

SEQ ID NO: 394131 - DNA, 25 bp, Homo sapien
cattattgtgaaggctgctcaccac

SEQ ID NO: 394132 - DNA, 25 bp, Homo sapien
tgctcaccaccaatttcatcactgt

SEQ ID NO: 394133 - DNA, 25 bp, Homo sapien
ttcatcactgttgctaactccagct

SEQ ID NO: 394134 - DNA, 25 bp, Homo sapien
tgttgctaactccagctcatctaat

SEQ ID NO: 394135 - DNA, 25 bp, Homo sapien
tgctaactccagctcatctaatctc

SEQ ID NO: 394136 - DNA, 25 bp, Homo sapien
ttattactgtataacatatgctagt

SEQ ID NO: 394137 - DNA, 25 bp, Homo sapien
tattactgtataacatatgctagtg

SEQ ID NO: 394138 - DNA, 25 bp, Homo sapien
attactgtataacatatgctagtgt

SEQ ID NO: 394139 - DNA, 25 bp, Homo sapien
ttactgtataacatatgctagtgtt

SEQ ID NO: 394140 - DNA, 25 bp, Homo sapien
tactgtataacatatgctagtgttt

SEQ ID NO: 394141 - DNA, 25 bp, Homo sapien
actgtataacatatgctagtgttta

SEQ ID NO: 394142 - DNA, 25 bp, Homo sapien
ctgtataacatatgctagtgtttag

SEQ ID NO: 394143 - DNA, 25 bp, Homo sapien
tgagttataaaagtatcttattgct

SEQ ID NO: 394144 - DNA, 25 bp, Homo sapien
gcctgtgttctcatggttattaacc

SEQ ID NO: 394145 - DNA, 25 bp, Homo sapien
gttattaaccagagaaaacctcagg

SEQ ID NO: 394146 - DNA, 25 bp, Homo sapien
agaagtaccagcccgtggacctgca

SEQ ID NO: 394147 - DNA, 25 bp, Homo sapien
cagcccgtggacctgcagcctaaga

SEQ ID NO: 394148 - DNA, 25 bp, Homo sapien
tgcagcctaagaagacatgcgccat

SEQ ID NO: 394149 - DNA, 25 bp, Homo sapien
agcctaagaagacatgcgccatgag

SEQ ID NO: 394150 - DNA, 25 bp, Homo sapien
tgcgccatgagccactgtctcaaca

SEQ ID NO: 394151 - DNA, 25 bp, Homo sapien
gagccactgtctcaacaagcacgag

SEQ ID NO: 394152 - DNA, 25 bp, Homo sapien
gctgtcccagctgcgtgtcactaaa

SEQ ID NO: 394153 - DNA, 25 bp, Homo sapien
gtcccagctgcgtgtcactaaagtg

SEQ ID NO: 394154 - DNA, 25 bp, Homo sapien
cccagctgcgtgtcactaaagtgac

SEQ ID NO: 394155 - DNA, 25 bp, Homo sapien
gagatgttactggagtcaccagcat

SEQ ID NO: 394156 - DNA, 25 bp, Homo sapien
tcaccagcatttaccagggaccatt

SEQ ID NO: 394157 - DNA, 25 bp, Homo sapien
agatacccagctccggtcctgcttt

SEQ ID NO: 394158 - DNA, 25 bp, Homo sapien
tccggtcctgctttccatggtgaac

SEQ ID NO: 394159 - DNA, 25 bp, Homo sapien
cagcagtcccagtacaaatggctgt

SEQ ID NO: 394160 - DNA, 25 bp, Homo sapien
tttatcacccgctctaagtgcaatg

SEQ ID NO: 394161 - DNA, 25 bp, Homo sapien
ccgctctaagtgcaatggcctggat

SEQ ID NO: 394162 - DNA, 25 bp, Homo sapien
aaaatcactgatggacttctactga

SEQ ID NO: 394163 - DNA, 25 bp, Homo sapien
cactgatggacttctactgataaga

SEQ ID NO: 394164 - DNA, 25 bp, Homo sapien
aaatgttcccacaggcaccaataat

SEQ ID NO: 394165 - DNA, 25 bp, Homo sapien
ggcaccaataataaggccaaggtac

SEQ ID NO: 394166 - DNA, 25 bp, Homo sapien
ctgaagctggtaattttaagtaaag

SEQ ID NO: 394167 - DNA, 25 bp, Homo sapien
atattggtacgttggaaaatgtgaa

SEQ ID NO: 394168 - DNA, 25 bp, Homo sapien
agagctttactttcaaaatgtatgt

SEQ ID NO: 394169 - DNA, 25 bp, Homo sapien
ttcccataatttgggcctatgctat

SEQ ID NO: 394170 - DNA, 25 bp, Homo sapien
taatttgggcctatgctatcctgtt

SEQ ID NO: 394171 - DNA, 25 bp, Homo sapien
gggcctatgctatcctgttgatttt

SEQ ID NO: 394172 - DNA, 25 bp, Homo sapien
ttatgtctagcttaaaaggtatttg

SEQ ID NO: 394173 - DNA, 25 bp, Homo sapien
gaaaatgttccatttgtgttttatt

SEQ ID NO: 394174 - DNA, 25 bp, Homo sapien
tattttctgtcctatgacagttcta

SEQ ID NO: 394175 - DNA, 25 bp, Homo sapien
gtcctatgacagttctatgctaaat

SEQ ID NO: 394176 - DNA, 25 bp, Homo sapien
gacagttctatgctaaatgtatttt

SEQ ID NO: 394177 - DNA, 25 bp, Homo sapien
ctgcctcctggtaaatacggcgaca

SEQ ID NO: 394178 - DNA, 25 bp, Homo sapien
aatacggcgacattttgctgctctt

SEQ ID NO: 394179 - DNA, 25 bp, Homo sapien
ttgctgctcttctacttacagtcag

SEQ ID NO: 394180 - DNA, 25 bp, Homo sapien
ttctacttacagtcagtgtgaggga

SEQ ID NO: 394181 - DNA, 25 bp, Homo sapien
atgcacagcagccaccaaagactgt

SEQ ID NO: 394182 - DNA, 25 bp, Homo sapien
agccaccaaagactgtgctgaaagc

SEQ ID NO: 394183 - DNA, 25 bp, Homo sapien
tgctgaaagcacatcctagaaggcg

SEQ ID NO: 394184 - DNA, 25 bp, Homo sapien
aagcacatcctagaaggcggagagg

SEQ ID NO: 394185 - DNA, 25 bp, Homo sapien
gaagtcaaaatcaggtagaaactct

SEQ ID NO: 394186 - DNA, 25 bp, Homo sapien
gaaactctgatttggtagggaagga

SEQ ID NO: 394187 - DNA, 25 bp, Homo sapien
gatgaatgtttactcagtgtcctta

SEQ ID NO: 394188 - DNA, 25 bp, Homo sapien
actctaagatagtttcctccatacg

SEQ ID NO: 394189 - DNA, 25 bp, Homo sapien
tctaagatagtttcctccatacgtg

SEQ ID NO: 394190 - DNA, 25 bp, Homo sapien
ctaagatagtttcctccatacgtgc

SEQ ID NO: 394191 - DNA, 25 bp, Homo sapien
taagatagtttcctccatacgtgca

SEQ ID NO: 394192 - DNA, 25 bp, Homo sapien
aagatagtttcctccatacgtgcaa

SEQ ID NO: 394193 - DNA, 25 bp, Homo sapien
agatagtttcctccatacgtgcaat

SEQ ID NO: 394194 - DNA, 25 bp, Homo sapien
gatagtttcctccatacgtgcaatc

SEQ ID NO: 394195 - DNA, 25 bp, Homo sapien
atagtttcctccatacgtgcaatct

SEQ ID NO: 394196 - DNA, 25 bp, Homo sapien
tagtttcctccatacgtgcaatctc

SEQ ID NO: 394197 - DNA, 25 bp, Homo sapien
agtttcctccatacgtgcaatctca

SEQ ID NO: 394198 - DNA, 25 bp, Homo sapien
gtttcctccatacgtgcaatctcat

SEQ ID NO: 394199 - DNA, 25 bp, Homo sapien
accactggtggcgtttgagtcatgg

SEQ ID NO: 394200 - DNA, 25 bp, Homo sapien
ggcgtttgagtcatggacgatgaat

SEQ ID NO: 394201 - DNA, 25 bp, Homo sapien
ggacgatgaatactacgtgtctgaa

SEQ ID NO: 394202 - DNA, 25 bp, Homo sapien
gaatactacgtgtctgaaactctga

SEQ ID NO: 394203 - DNA, 25 bp, Homo sapien
tactacgtgtctgaaactctgaggt

SEQ ID NO: 394204 - DNA, 25 bp, Homo sapien
aaagatcatattcttactttggatt

SEQ ID NO: 394205 - DNA, 25 bp, Homo sapien
gattaatagattgaggttcatcatc

SEQ ID NO: 394206 - DNA, 25 bp, Homo sapien
gaggttcatcatcaatagataaatg

SEQ ID NO: 394207 - DNA, 25 bp, Homo sapien
aggtgaatcattgttcaattatgaa

SEQ ID NO: 394208 - DNA, 25 bp, Homo sapien
gaaatggatcatgagtcccgccact

SEQ ID NO: 394209 - DNA, 25 bp, Homo sapien
atggatcatgagtcccgccactgca

SEQ ID NO: 394210 - DNA, 25 bp, Homo sapien
atgcagaaaattcagcatgggctgt

SEQ ID NO: 394211 - DNA, 25 bp, Homo sapien
gggctgtgagacactttaccctcag

SEQ ID NO: 394212 - DNA, 25 bp, Homo sapien
tcagtcactctggtcctctgagatc

SEQ ID NO: 394213 - DNA, 25 bp, Homo sapien
gagatcagctagaagctctcactgg

SEQ ID NO: 394214 - DNA, 25 bp, Homo sapien
agctagaagctctcactgggcatcc

SEQ ID NO: 394215 - DNA, 25 bp, Homo sapien
actgggcatcctcgtgatttagtca

SEQ ID NO: 394216 - DNA, 25 bp, Homo sapien
ggcatcctcgtgatttagtcaaaat

SEQ ID NO: 394217 - DNA, 25 bp, Homo sapien
ttcaaaagcagctccattataagag

SEQ ID NO: 394218 - DNA, 25 bp, Homo sapien
tccattataagagtcccccaaaggt

SEQ ID NO: 394219 - DNA, 25 bp, Homo sapien
ccccaaaggtctagtaaagatatct

SEQ ID NO: 394220 - DNA, 25 bp, Homo sapien
tagaccaaagcaaggtggaaactgc

SEQ ID NO: 394221 - DNA, 25 bp, Homo sapien
agaatataagctccacgagggtgga

SEQ ID NO: 394222 - DNA, 25 bp, Homo sapien
gtggaaacttttgctcttatttgct

SEQ ID NO: 394223 - DNA, 25 bp, Homo sapien
gaatatgttcaggatgctcagagga

SEQ ID NO: 394224 - DNA, 25 bp, Homo sapien
gatgctcagaggaagatcccaccaa

SEQ ID NO: 394225 - DNA, 25 bp, Homo sapien
gatcccaccaatcatcaaaccagga

SEQ ID NO: 394226 - DNA, 25 bp, Homo sapien
aggaagggatctggtctccacttgt

SEQ ID NO: 394227 - DNA, 25 bp, Homo sapien
ctgagatgtgttctgagatggccca

SEQ ID NO: 394228 - DNA, 25 bp, Homo sapien
agatggcccagtgtccgagttttat

SEQ ID NO: 394229 - DNA, 25 bp, Homo sapien
cagtgtccgagttttattccctcac

SEQ ID NO: 394230 - DNA, 25 bp, Homo sapien
tattccctcacctactgagaacagg

SEQ ID NO: 394231 - DNA, 25 bp, Homo sapien
tgagaacagggacctgccctttgac

SEQ ID NO: 394232 - DNA, 25 bp, Homo sapien
acaggcggtgcagcctccaggctgt

SEQ ID NO: 394233 - DNA, 25 bp, Homo sapien
agcctccaggctgtctaagatccga

SEQ ID NO: 394234 - DNA, 25 bp, Homo sapien
gcctgtgttctcatggttattaacc

SEQ ID NO: 394235 - DNA, 25 bp, Homo sapien
gttattaaccagagaaaacctcagg

SEQ ID NO: 394236 - DNA, 25 bp, Homo sapien
cagcccgtggacctgcagcctaaga

SEQ ID NO: 394237 - DNA, 25 bp, Homo sapien
tgcagcctaagaagacatgcgccat

SEQ ID NO: 394238 - DNA, 25 bp, Homo sapien
agcctaagaagacatgcgccatgag

SEQ ID NO: 394239 - DNA, 25 bp, Homo sapien
tgcgccatgagccactgtctcaaca

SEQ ID NO: 394240 - DNA, 25 bp, Homo sapien
gagccactgtctcaacaagcacgag

SEQ ID NO: 394241 - DNA, 25 bp, Homo sapien
tgtcccagctgcgtgtcactaaagt

SEQ ID NO: 394242 - DNA, 25 bp, Homo sapien
cccagctgcgtgtcactaaagtgac

SEQ ID NO: 394243 - DNA, 25 bp, Homo sapien
aaaatcaccatgtaccaacctatcc

SEQ ID NO: 394244 - DNA, 25 bp, Homo sapien
atgtaccaacctatccaaacttatc

SEQ ID NO: 394245 - DNA, 25 bp, Homo sapien
ggatgaatctatccagaagacggga

SEQ ID NO: 394246 - DNA, 25 bp, Homo sapien
aagacgggagttccgatgcttgtct

SEQ ID NO: 394247 - DNA, 25 bp, Homo sapien
cgatgcttgtcttgctctgaatgtc

SEQ ID NO: 394248 - DNA, 25 bp, Homo sapien
tgctctgaatgtctgcttgtcacct

SEQ ID NO: 394249 - DNA, 25 bp, Homo sapien
aatgtctgcttgtcacctgcttagg

SEQ ID NO: 394250 - DNA, 25 bp, Homo sapien
cctgcttagggttatcgactgtgat

SEQ ID NO: 394251 - DNA, 25 bp, Homo sapien
tatcgactgtgattctgggactcat

SEQ ID NO: 394252 - DNA, 25 bp, Homo sapien
gattctgggactcattgttgttcta

SEQ ID NO: 394253 - DNA, 25 bp, Homo sapien
ggactcattgttgttctacaggacc

SEQ ID NO: 394254 - DNA, 25 bp, Homo sapien
gagctctattttggacatgttaaat

SEQ ID NO: 394255 - DNA, 25 bp, Homo sapien
aaatgagaaataccaattagttgtc

SEQ ID NO: 394256 - DNA, 25 bp, Homo sapien
aattagttgtcttggtagagattga

SEQ ID NO: 394257 - DNA, 25 bp, Homo sapien
aatatagttcaagttcctgacataa

SEQ ID NO: 394258 - DNA, 25 bp, Homo sapien
agttcaagttcctgacataataggt

SEQ ID NO: 394259 - DNA, 25 bp, Homo sapien
gcagatggattgaatgtgatacacg

SEQ ID NO: 394260 - DNA, 25 bp, Homo sapien
cttagcttcccttttgtggtatttg

SEQ ID NO: 394261 - DNA, 25 bp, Homo sapien
gcttcccttttgtggtatttgacgt

SEQ ID NO: 394262 - DNA, 25 bp, Homo sapien
agagtagcagagtcatggcagagaa

SEQ ID NO: 394263 - DNA, 25 bp, Homo sapien
aagccctgctatttactgagaaggc

SEQ ID NO: 394264 - DNA, 25 bp, Homo sapien
tactgagaaggctaactctgcagga

SEQ ID NO: 394265 - DNA, 25 bp, Homo sapien
gggaccccagtgtgaccagcaaagt

SEQ ID NO: 394266 - DNA, 25 bp, Homo sapien
tgaaggagaactaccggcagaagaa

SEQ ID NO: 394267 - DNA, 25 bp, Homo sapien
aggtggcccaggttaaggcactatc

SEQ ID NO: 394268 - DNA, 25 bp, Homo sapien
tggcccaggttaaggcactatctga

SEQ ID NO: 394269 - DNA, 25 bp, Homo sapien
gttaaggcactatctgaggagctga

SEQ ID NO: 394270 - DNA, 25 bp, Homo sapien
ggcactatctgaggagctgaatctg

SEQ ID NO: 394271 - DNA, 25 bp, Homo sapien
atctgaggagctgaatctgctggcc

SEQ ID NO: 394272 - DNA, 25 bp, Homo sapien
aggagctgaatctgctggccgtgtt

SEQ ID NO: 394273 - DNA, 25 bp, Homo sapien
agctgaatctgctggccgtgttctt

SEQ ID NO: 394274 - DNA, 25 bp, Homo sapien
aatctgctggccgtgttcttgcaat

SEQ ID NO: 394275 - DNA, 25 bp, Homo sapien
tctgctggccgtgttcttgcaatat

SEQ ID NO: 394276 - DNA, 25 bp, Homo sapien
ctctgttatgatcctgcaacaagta

SEQ ID NO: 394277 - DNA, 25 bp, Homo sapien
gatcctgcaacaagtatcatcacag

SEQ ID NO: 394278 - DNA, 25 bp, Homo sapien
tcctgcaacaagtatcatcacaggg

SEQ ID NO: 394279 - DNA, 25 bp, Homo sapien
atcacaggggtagctgcaatgccca

SEQ ID NO: 394280 - DNA, 25 bp, Homo sapien
aatgcccaggccagtgtcctatcat

SEQ ID NO: 394281 - DNA, 25 bp, Homo sapien
tgcccaggccagtgtcctatcatgg

SEQ ID NO: 394282 - DNA, 25 bp, Homo sapien
aggccagtgtcctatcatggctgtg

SEQ ID NO: 394283 - DNA, 25 bp, Homo sapien
ccagtgtcctatcatggctgtgtga

SEQ ID NO: 394284 - DNA, 25 bp, Homo sapien
gtgtcctatcatggctgtgtgacta

SEQ ID NO: 394285 - DNA, 25 bp, Homo sapien
ttcaaactataataaagcctttcct

SEQ ID NO: 394286 - DNA, 25 bp, Homo sapien
tataataaagcctttcctataattg

SEQ ID NO: 394287 - DNA, 25 bp, Homo sapien
tggaccatcttttgcacctggcaga

SEQ ID NO: 394288 - DNA, 25 bp, Homo sapien
accccagcgtgttctgtgaacttga

SEQ ID NO: 394289 - DNA, 25 bp, Homo sapien
acttgagtgacaacgcgtgcttgca

SEQ ID NO: 394290 - DNA, 25 bp, Homo sapien
cttgcagggtgctttttggatgact

SEQ ID NO: 394291 - DNA, 25 bp, Homo sapien
atgttttacaacctgaacctcagaa

SEQ ID NO: 394292 - DNA, 25 bp, Homo sapien
gaacctcagaactgtgatcctccaa

SEQ ID NO: 394293 - DNA, 25 bp, Homo sapien
gaactgtgatcctccaaggagcgcg

SEQ ID NO: 394294 - DNA, 25 bp, Homo sapien
aaggagcgcgctacttgaagaaaag

SEQ ID NO: 394295 - DNA, 25 bp, Homo sapien
agtcgaatggcttctcagggatttt

SEQ ID NO: 394296 - DNA, 25 bp, Homo sapien
cagggattttgttttccgtgcacat

SEQ ID NO: 394297 - DNA, 25 bp, Homo sapien
gttttccgtgcacatataagccata

SEQ ID NO: 394298 - DNA, 25 bp, Homo sapien
gattttgctcctagggttatctcaa

SEQ ID NO: 394299 - DNA, 25 bp, Homo sapien
tttgctcctagggttatctcaagtt

SEQ ID NO: 394300 - DNA, 25 bp, Homo sapien
gctcctagggttatctcaagttggg

SEQ ID NO: 394301 - DNA, 25 bp, Homo sapien
aaggcagcacagactaccaaatgct

SEQ ID NO: 394302 - DNA, 25 bp, Homo sapien
gcacagactaccaaatgctgttttt

SEQ ID NO: 394303 - DNA, 25 bp, Homo sapien
ttgggagatatttttcggcaacact

SEQ ID NO: 394304 - DNA, 25 bp, Homo sapien
ggagatatttttcggcaacactgga

SEQ ID NO: 394305 - DNA, 25 bp, Homo sapien
ttcggcaacactggaaagattagtt

SEQ ID NO: 394306 - DNA, 25 bp, Homo sapien
aaaagtactcatgcatatgtatata

SEQ ID NO: 394307 - DNA, 25 bp, Homo sapien
gttagccaggttagagttggcccta

SEQ ID NO: 394308 - DNA, 25 bp, Homo sapien
ccaggttagagttggccctacgtgg

SEQ ID NO: 394309 - DNA, 25 bp, Homo sapien
gagcatgtgattggggccctacata

SEQ ID NO: 394310 - DNA, 25 bp, Homo sapien
gcttcagacaggcatgcaagttgcc

SEQ ID NO: 394311 - DNA, 25 bp, Homo sapien
gccctacatagggtcacgtttaagt

SEQ ID NO: 394312 - DNA, 25 bp, Homo sapien
catagggtcacgtttaagttccctg

SEQ ID NO: 394313 - DNA, 25 bp, Homo sapien
tcacgtttaagttccctggccacca

SEQ ID NO: 394314 - DNA, 25 bp, Homo sapien
cacgtttaagttccctggccaccag

SEQ ID NO: 394315 - DNA, 25 bp, Homo sapien
tcagacaggcatgcaagttgccttt

SEQ ID NO: 394316 - DNA, 25 bp, Homo sapien
gacaggcatgcaagttgcctttgga

SEQ ID NO: 394317 - DNA, 25 bp, Homo sapien
atgaatttgaatatgtggtggctga

SEQ ID NO: 394318 - DNA, 25 bp, Homo sapien
atttgaatatgtggtggctgagaaa

SEQ ID NO: 394319 - DNA, 25 bp, Homo sapien
ggtcaaatccatccctagtcatggc

SEQ ID NO: 394320 - DNA, 25 bp, Homo sapien
gtgaccatgttggatcattgacaat

SEQ ID NO: 394321 - DNA, 25 bp, Homo sapien
gacaatttttaggtatgtactgacc

SEQ ID NO: 394322 - DNA, 25 bp, Homo sapien
acatttatgatgaagatcctgagcg

SEQ ID NO: 394323 - DNA, 25 bp, Homo sapien
gatcctgagcggaggttaagatatt

SEQ ID NO: 394324 - DNA, 25 bp, Homo sapien
taagttattttccatatgaatcaga

SEQ ID NO: 394325 - DNA, 25 bp, Homo sapien
gaatgctgagattggttaagtttgc

SEQ ID NO: 394326 - DNA, 25 bp, Homo sapien
aagtttgcaatgaccatcttgaacc

SEQ ID NO: 394327 - DNA, 25 bp, Homo sapien
gaccatcttgaaccacagatttctg

SEQ ID NO: 394328 - DNA, 25 bp, Homo sapien
acagatttctgctatgtgtcatcaa

SEQ ID NO: 394329 - DNA, 25 bp, Homo sapien
catcaaaacatctagttctgagtaa

SEQ ID NO: 394330 - DNA, 25 bp, Homo sapien
ttctgagtaacattttcacgattgt

SEQ ID NO: 394331 - DNA, 25 bp, Homo sapien
cagtagcagtaatgatggaccggtt

SEQ ID NO: 394332 - DNA, 25 bp, Homo sapien
tggaccggttaataagagactctga

SEQ ID NO: 394333 - DNA, 25 bp, Homo sapien
acaatagagcccattggaatttttt

SEQ ID NO: 394334 - DNA, 25 bp, Homo sapien
tttttcttccacgtattgttagatg

SEQ ID NO: 394335 - DNA, 25 bp, Homo sapien
gtaaaacctgatacactaccataca

SEQ ID NO: 394336 - DNA, 25 bp, Homo sapien
ctaccatacagacaggtgattgact

SEQ ID NO: 394337 - DNA, 25 bp, Homo sapien
gtgattgactagaccttgtttatgt

SEQ ID NO: 394338 - DNA, 25 bp, Homo sapien
gaccttgtttatgtagttctaatgt

SEQ ID NO: 394339 - DNA, 25 bp, Homo sapien
gagttgttatgaattacgattatcc

SEQ ID NO: 394340 - DNA, 25 bp, Homo sapien
gaattacgattatccataacttttg

SEQ ID NO: 394341 - DNA, 25 bp, Homo sapien
tttgaatctaaaaagctggctacac

SEQ ID NO: 394342 - DNA, 25 bp, Homo sapien
taatgatttttcactctctttaaaa

SEQ ID NO: 394343 - DNA, 25 bp, Homo sapien
ctaaatcatttatgtccatttctca

SEQ ID NO: 394344 - DNA, 25 bp, Homo sapien
ttatgtccatttctcaattttttca

SEQ ID NO: 394345 - DNA, 25 bp, Homo sapien
gatctatgctttgagtttgctttct

SEQ ID NO: 394346 - DNA, 25 bp, Homo sapien
ttgagtttgctttctcaacattatt

SEQ ID NO: 394347 - DNA, 25 bp, Homo sapien
caacattattgtattttccacttat

SEQ ID NO: 394348 - DNA, 25 bp, Homo sapien
atgctagtgtttagttggattaatc

SEQ ID NO: 394349 - DNA, 25 bp, Homo sapien
ggattaatcttacctaaaagtactg

SEQ ID NO: 394350 - DNA, 25 bp, Homo sapien
tactgaaaaatgctttttagtactt

SEQ ID NO: 394351 - DNA, 25 bp, Homo sapien
aatgctttttagtactttttcatat

SEQ ID NO: 394352 - DNA, 25 bp, Homo sapien
atttattttccgaatgtatcattga

SEQ ID NO: 394353 - DNA, 25 bp, Homo sapien
gtcaaaatgacagcggaatgagccg

SEQ ID NO: 394354 - DNA, 25 bp, Homo sapien
aaatgacagcggaatgagccgggaa

SEQ ID NO: 394355 - DNA, 25 bp, Homo sapien
aaggaaagaggccccgtgggatgct

SEQ ID NO: 394356 - DNA, 25 bp, Homo sapien
gggcctcggcccgacttctcacacg

SEQ ID NO: 394357 - DNA, 25 bp, Homo sapien
atgctgggggtcgagtcctaggccc

SEQ ID NO: 394358 - DNA, 25 bp, Homo sapien
gcttcaacctcgaacgggggcgacg

SEQ ID NO: 394359 - DNA, 25 bp, Homo sapien
agccccgacaggccgcgagcgggag

SEQ ID NO: 394360 - DNA, 25 bp, Homo sapien
aggccacgctccctcacgactgtcc

SEQ ID NO: 394361 - DNA, 25 bp, Homo sapien
tgtccccacccaccgcggagggccg

SEQ ID NO: 394362 - DNA, 25 bp, Homo sapien
cctcacctcggccctgggatgctgg

SEQ ID NO: 394363 - DNA, 25 bp, Homo sapien
ggatgctgggaagggaacgaggcga

SEQ ID NO: 394364 - DNA, 25 bp, Homo sapien
gttggatctttcaacatccttactc

SEQ ID NO: 394365 - DNA, 25 bp, Homo sapien
gatctttcaacatccttactcaaaa

SEQ ID NO: 394366 - DNA, 25 bp, Homo sapien
agtggaagacagtccccagtatagc

SEQ ID NO: 394367 - DNA, 25 bp, Homo sapien
gtggaagacagtccccagtatagct

SEQ ID NO: 394368 - DNA, 25 bp, Homo sapien
gaagacagtccccagtatagctgtg

SEQ ID NO: 394369 - DNA, 25 bp, Homo sapien
agacagtccccagtatagctgtgaa

SEQ ID NO: 394370 - DNA, 25 bp, Homo sapien
gacagtccccagtatagctgtgaag

SEQ ID NO: 394371 - DNA, 25 bp, Homo sapien
cagtccccagtatagctgtgaagag

SEQ ID NO: 394372 - DNA, 25 bp, Homo sapien
gtccccagtatagctgtgaagagac

SEQ ID NO: 394373 - DNA, 25 bp, Homo sapien
gctgtgaagagactacaagtagcca

SEQ ID NO: 394374 - DNA, 25 bp, Homo sapien
agactacaagtagccataattcaaa

SEQ ID NO: 394375 - DNA, 25 bp, Homo sapien
ctctgtgctggtcctaatgactgga

SEQ ID NO: 394376 - DNA, 25 bp, Homo sapien
aatgactggattctttgtgcacatc

SEQ ID NO: 394377 - DNA, 25 bp, Homo sapien
gattctttgtgcacatcaggatgta

SEQ ID NO: 394378 - DNA, 25 bp, Homo sapien
gagtaaatcccagtgttagtggcct

SEQ ID NO: 394379 - DNA, 25 bp, Homo sapien
tagtggcctttccatacctgggata

SEQ ID NO: 394380 - DNA, 25 bp, Homo sapien
ccatacctgggatattagatgttat

SEQ ID NO: 394381 - DNA, 25 bp, Homo sapien
gacaactggagaaccacagtgtgaa

SEQ ID NO: 394382 - DNA, 25 bp, Homo sapien
aagttgcccgaaggaagcttcagga

SEQ ID NO: 394383 - DNA, 25 bp, Homo sapien
gcttcaggagattgaggacaggata

SEQ ID NO: 394384 - DNA, 25 bp, Homo sapien
acagaaatgttaaccatctccccag

SEQ ID NO: 394385 - DNA, 25 bp, Homo sapien
agtcttgtcctttctgataccatga

SEQ ID NO: 394386 - DNA, 25 bp, Homo sapien
aggtggcccaggttaaggcactatc

SEQ ID NO: 394387 - DNA, 25 bp, Homo sapien
tggcccaggttaaggcactatctga

SEQ ID NO: 394388 - DNA, 25 bp, Homo sapien
gttaaggcactatctgaggagctga

SEQ ID NO: 394389 - DNA, 25 bp, Homo sapien
aaggcactatctgaggagctgaatc

SEQ ID NO: 394390 - DNA, 25 bp, Homo sapien
ggcactatctgaggagctgaatctg

SEQ ID NO: 394391 - DNA, 25 bp, Homo sapien
atctgaggagctgaatctgctggcc

SEQ ID NO: 394392 - DNA, 25 bp, Homo sapien
ctgaggagctgaatctgctggccgt

SEQ ID NO: 394393 - DNA, 25 bp, Homo sapien
ggagctgaatctgctggccgtgttc

SEQ ID NO: 394394 - DNA, 25 bp, Homo sapien
agctgaatctgctggccgtgttctt

SEQ ID NO: 394395 - DNA, 25 bp, Homo sapien
aatctgctggccgtgttcttgcaat

SEQ ID NO: 394396 - DNA, 25 bp, Homo sapien
tctgctggccgtgttcttgcaatat

SEQ ID NO: 394397 - DNA, 25 bp, Homo sapien
ctagttgtgattttccgaatttaag

SEQ ID NO: 394398 - DNA, 25 bp, Homo sapien
tgtgattttccgaatttaagacgtt

SEQ ID NO: 394399 - DNA, 25 bp, Homo sapien
gacgttttcttactacatgtgttaa

SEQ ID NO: 394400 - DNA, 25 bp, Homo sapien
aaattgttacctataatatcttcct

SEQ ID NO: 394401 - DNA, 25 bp, Homo sapien
attggaatctgggatgactcttagt

SEQ ID NO: 394402 - DNA, 25 bp, Homo sapien
gggatgactcttagtaatctactat

SEQ ID NO: 394403 - DNA, 25 bp, Homo sapien
tcttaattcaacgatggccaccagc

SEQ ID NO: 394404 - DNA, 25 bp, Homo sapien
taattcaacgatggccaccagctac

SEQ ID NO: 394405 - DNA, 25 bp, Homo sapien
accagctacctgacacattttgtaa

SEQ ID NO: 394406 - DNA, 25 bp, Homo sapien
gcgtgcatgtgcacattactgcatt

SEQ ID NO: 394407 - DNA, 25 bp, Homo sapien
tgcatgtgcacattactgcatttat

SEQ ID NO: 394408 - DNA, 25 bp, Homo sapien
tttgcagtagcgctgctgggcggtg

SEQ ID NO: 394409 - DNA, 25 bp, Homo sapien
gcagtagcgctgctgggcggtggtc

SEQ ID NO: 394410 - DNA, 25 bp, Homo sapien
ggtggtcccctcactgggatcctgt

SEQ ID NO: 394411 - DNA, 25 bp, Homo sapien
tggtcccctcactgggatcctgtac

SEQ ID NO: 394412 - DNA, 25 bp, Homo sapien
actgggatcctgtactcttactcta

SEQ ID NO: 394413 - DNA, 25 bp, Homo sapien
ctctcagttgtctccttattttatg

SEQ ID NO: 394414 - DNA, 25 bp, Homo sapien
tccttattttatggtacatgcttag

SEQ ID NO: 394415 - DNA, 25 bp, Homo sapien
cttattttatggtacatgcttaggg

SEQ ID NO: 394416 - DNA, 25 bp, Homo sapien
gggtgtaccttagttctgctgccac

SEQ ID NO: 394417 - DNA, 25 bp, Homo sapien
acaattcacacacaggtgctgcagc

SEQ ID NO: 394418 - DNA, 25 bp, Homo sapien
caattcacacacaggtgctgcagcc

SEQ ID NO: 394419 - DNA, 25 bp, Homo sapien
cctccaagcggtccaaagactactg

SEQ ID NO: 394420 - DNA, 25 bp, Homo sapien
aagactactggattgccaagggatc

SEQ ID NO: 394421 - DNA, 25 bp, Homo sapien
attgccaagggatcagctttgctct

SEQ ID NO: 394422 - DNA, 25 bp, Homo sapien
gccaagggatcagctttgctctgcc

SEQ ID NO: 394423 - DNA, 25 bp, Homo sapien
gctctgccagctgagcgaatgaaaa

SEQ ID NO: 394424 - DNA, 25 bp, Homo sapien
atgaaaaggtgccacctcagccctg

SEQ ID NO: 394425 - DNA, 25 bp, Homo sapien
aggccagagatctttcctaatggga

SEQ ID NO: 394426 - DNA, 25 bp, Homo sapien
gagatctttcctaatgggagcaaaa

SEQ ID NO: 394427 - DNA, 25 bp, Homo sapien
tttatatgtgagcaaaacggtgtta

SEQ ID NO: 394428 - DNA, 25 bp, Homo sapien
aacggtgttaattctgatttgactt

SEQ ID NO: 394429 - DNA, 25 bp, Homo sapien
gatttgacttaaacgtattgtgact

SEQ ID NO: 394430 - DNA, 25 bp, Homo sapien
atagccaaaatatacccctaagaag

SEQ ID NO: 394431 - DNA, 25 bp, Homo sapien
ttcataactgatttcctattgtttt

SEQ ID NO: 394432 - DNA, 25 bp, Homo sapien
gatttcctattgttttagacctcct

SEQ ID NO: 394433 - DNA, 25 bp, Homo sapien
tcctattgttttagacctccttgga

SEQ ID NO: 394434 - DNA, 25 bp, Homo sapien
ctccttggaaggtaccttgaagtat

SEQ ID NO: 394435 - DNA, 25 bp, Homo sapien
cttggaaggtaccttgaagtattct

SEQ ID NO: 394436 - DNA, 25 bp, Homo sapien
gtattctgtgaatcaccaaagtggt

SEQ ID NO: 394437 - DNA, 25 bp, Homo sapien
caccaaagtggtaatgatttatcag

SEQ ID NO: 394438 - DNA, 25 bp, Homo sapien
gatttatcaggatacctaactcgga

SEQ ID NO: 394439 - DNA, 25 bp, Homo sapien
tcaggatacctaactcggataaaac

SEQ ID NO: 394440 - DNA, 25 bp, Homo sapien
gtggtggtaaaaactaatagtgcct

SEQ ID NO: 394441 - DNA, 25 bp, Homo sapien
cctctctcactttctatagctttgt

SEQ ID NO: 394442 - DNA, 25 bp, Homo sapien
actttctatagctttgttggaccag

SEQ ID NO: 394443 - DNA, 25 bp, Homo sapien
tatagctttgttggaccagatggtg

SEQ ID NO: 394444 - DNA, 25 bp, Homo sapien
acagccccaaagtcaggaagcctgg

SEQ ID NO: 394445 - DNA, 25 bp, Homo sapien
gaaaccagagctgagacctcttcaa

SEQ ID NO: 394446 - DNA, 25 bp, Homo sapien
gagctgagacctcttcaacagggtt

SEQ ID NO: 394447 - DNA, 25 bp, Homo sapien
gacctcttcaacagggtttctttga

SEQ ID NO: 394448 - DNA, 25 bp, Homo sapien
ttctttgagatcctacacctccatt

SEQ ID NO: 394449 - DNA, 25 bp, Homo sapien
ttgagatcctacacctccattgggc

SEQ ID NO: 394450 - DNA, 25 bp, Homo sapien
tgggccctttttcagtcttcaatgg

SEQ ID NO: 394451 - DNA, 25 bp, Homo sapien
aatgggggcccagttggctctagaa

SEQ ID NO: 394452 - DNA, 25 bp, Homo sapien
ataattggaatctgggatgactctt

SEQ ID NO: 394453 - DNA, 25 bp, Homo sapien
ggaatctgggatgactcttagtaat

SEQ ID NO: 394454 - DNA, 25 bp, Homo sapien
atctgggatgactcttagtaatcta

SEQ ID NO: 394455 - DNA, 25 bp, Homo sapien
gggatgactcttagtaatctactat

SEQ ID NO: 394456 - DNA, 25 bp, Homo sapien
tgactcttagtaatctactattctt

SEQ ID NO: 394457 - DNA, 25 bp, Homo sapien
tactattcttaattcaacgatggcc

SEQ ID NO: 394458 - DNA, 25 bp, Homo sapien
tcttaattcaacgatggccaccagc

SEQ ID NO: 394459 - DNA, 25 bp, Homo sapien
taattcaacgatggccaccagctac

SEQ ID NO: 394460 - DNA, 25 bp, Homo sapien
tcaacgatggccaccagctacctga

SEQ ID NO: 394461 - DNA, 25 bp, Homo sapien
gatggccaccagctacctgacacat

SEQ ID NO: 394462 - DNA, 25 bp, Homo sapien
accagctacctgacacattttgtaa

SEQ ID NO: 394463 - DNA, 25 bp, Homo sapien
acatcacctgcgttgtcctgagggt

SEQ ID NO: 394464 - DNA, 25 bp, Homo sapien
tgcgttgtcctgagggtcccatcca

SEQ ID NO: 394465 - DNA, 25 bp, Homo sapien
atggcaccatcatgtctccatattt

SEQ ID NO: 394466 - DNA, 25 bp, Homo sapien
tccatatttcagaacttcatcctcc

SEQ ID NO: 394467 - DNA, 25 bp, Homo sapien
cctcccactcagctcagagagatat

SEQ ID NO: 394468 - DNA, 25 bp, Homo sapien
ctcagagagatatagcagctgctgt

SEQ ID NO: 394469 - DNA, 25 bp, Homo sapien
cagctgctgtgaggttcacagtggt

SEQ ID NO: 394470 - DNA, 25 bp, Homo sapien
ctgtgaggttcacagtggtgactcc

SEQ ID NO: 394471 - DNA, 25 bp, Homo sapien
gtggtgactcccgtgatgaatcctt

SEQ ID NO: 394472 - DNA, 25 bp, Homo sapien
gtgactcccgtgatgaatcctttga

SEQ ID NO: 394473 - DNA, 25 bp, Homo sapien
atgaatcctttgatctacagcctga

SEQ ID NO: 394474 - DNA, 25 bp, Homo sapien
gcagcttggcagtctcatgtcccct

SEQ ID NO: 394475 - DNA, 25 bp, Homo sapien
cagcttggcagtctcatgtcccctt

SEQ ID NO: 394476 - DNA, 25 bp, Homo sapien
agcttggcagtctcatgtcccctta

SEQ ID NO: 394477 - DNA, 25 bp, Homo sapien
gcttggcagtctcatgtccccttac

SEQ ID NO: 394478 - DNA, 25 bp, Homo sapien
ttggcagtctcatgtccccttacct

SEQ ID NO: 394479 - DNA, 25 bp, Homo sapien
tggcagtctcatgtccccttacctc

SEQ ID NO: 394480 - DNA, 25 bp, Homo sapien
ggcagtctcatgtccccttacctca

SEQ ID NO: 394481 - DNA, 25 bp, Homo sapien
tctcatgtccccttacctcacttgt

SEQ ID NO: 394482 - DNA, 25 bp, Homo sapien
ctcatgtccccttacctcacttgtc

SEQ ID NO: 394483 - DNA, 25 bp, Homo sapien
cttctctgaagcaacagctcttctc

SEQ ID NO: 394484 - DNA, 25 bp, Homo sapien
ttctctgaagcaacagctcttctcc

SEQ ID NO: 394485 - DNA, 25 bp, Homo sapien
gatgaagactagtacgcagctggat

SEQ ID NO: 394486 - DNA, 25 bp, Homo sapien
acgcagctggatagcagagtccgaa

SEQ ID NO: 394487 - DNA, 25 bp, Homo sapien
agtccgaaactcaggtggaggtgaa

SEQ ID NO: 394488 - DNA, 25 bp, Homo sapien
gagggaattatcacaatctagtttg

SEQ ID NO: 394489 - DNA, 25 bp, Homo sapien
gtatgacaacttaccaactggaatg

SEQ ID NO: 394490 - DNA, 25 bp, Homo sapien
ggaatgttctagctaatatctcaac

SEQ ID NO: 394491 - DNA, 25 bp, Homo sapien
cttagaatccatctcactaccaatg

SEQ ID NO: 394492 - DNA, 25 bp, Homo sapien
accaatgggcaaacacttgtgttct

SEQ ID NO: 394493 - DNA, 25 bp, Homo sapien
tgcaagtagtttatactgccaactt

SEQ ID NO: 394494 - DNA, 25 bp, Homo sapien
actgccaacttgatatatatacatg

SEQ ID NO: 394495 - DNA, 25 bp, Homo sapien
gtttgaacattttgtgtacttccaa

SEQ ID NO: 394496 - DNA, 25 bp, Homo sapien
tttgcattcctgatgaatcaccctc

SEQ ID NO: 394497 - DNA, 25 bp, Homo sapien
gtggttgtacatggccccttgaagt

SEQ ID NO: 394498 - DNA, 25 bp, Homo sapien
acatggccccttgaagtacattaag

SEQ ID NO: 394499 - DNA, 25 bp, Homo sapien
gaagtacattaagctggaccagcct

SEQ ID NO: 394500 - DNA, 25 bp, Homo sapien
agcctagatttgaatgtgctcttgc

SEQ ID NO: 394501 - DNA, 25 bp, Homo sapien
gatttgaatgtgctcttgcccaggc

SEQ ID NO: 394502 - DNA, 25 bp, Homo sapien
gggaaccagtcaagtttgaagattg

SEQ ID NO: 394503 - DNA, 25 bp, Homo sapien
gggatgagttccttattattctaga

SEQ ID NO: 394504 - DNA, 25 bp, Homo sapien
gggccagctgctatgctgcaacgtt

SEQ ID NO: 394505 - DNA, 25 bp, Homo sapien
agctgctatgctgcaacgttgataa

SEQ ID NO: 394506 - DNA, 25 bp, Homo sapien
gattattttggtgaatttgcattcc

SEQ ID NO: 394507 - DNA, 25 bp, Homo sapien
ttaatgccatccttcattgtctttc

SEQ ID NO: 394508 - DNA, 25 bp, Homo sapien
tcttcttctggcacagtaccatttt

SEQ ID NO: 394509 - DNA, 25 bp, Homo sapien
tctggcacagtaccattttgggtct

SEQ ID NO: 394510 - DNA, 25 bp, Homo sapien
gtaccattttgggtctgtgccccag

SEQ ID NO: 394511 - DNA, 25 bp, Homo sapien
gtctgtgccccagtgtggagcaaaa

SEQ ID NO: 394512 - DNA, 25 bp, Homo sapien
tggagcaaaacattgcctgtcccat

SEQ ID NO: 394513 - DNA, 25 bp, Homo sapien
gcctgtcccattctgatatacttca

SEQ ID NO: 394514 - DNA, 25 bp, Homo sapien
tctctcaagccccaaggactggagc

SEQ ID NO: 394515 - DNA, 25 bp, Homo sapien
tggagccacctctggaataatgtgt

SEQ ID NO: 394516 - DNA, 25 bp, Homo sapien
gccacctctggaataatgtgttaaa

SEQ ID NO: 394517 - DNA, 25 bp, Homo sapien
atttccttcccattaagaatcttgt

SEQ ID NO: 394518 - DNA, 25 bp, Homo sapien
agccgaggtagcttcctgaaatgcg

SEQ ID NO: 394519 - DNA, 25 bp, Homo sapien
gccgaggtagcttcctgaaatgcgt

SEQ ID NO: 394520 - DNA, 25 bp, Homo sapien
ccgaggtagcttcctgaaatgcgtg

SEQ ID NO: 394521 - DNA, 25 bp, Homo sapien
cgaggtagcttcctgaaatgcgtga

SEQ ID NO: 394522 - DNA, 25 bp, Homo sapien
gaggtagcttcctgaaatgcgtgaa

SEQ ID NO: 394523 - DNA, 25 bp, Homo sapien
aggtagcttcctgaaatgcgtgaag

SEQ ID NO: 394524 - DNA, 25 bp, Homo sapien
ggtagcttcctgaaatgcgtgaagg

SEQ ID NO: 394525 - DNA, 25 bp, Homo sapien
actgtgtgagaaccaacgggaaaga

SEQ ID NO: 394526 - DNA, 25 bp, Homo sapien
gtgtgagaaccaacgggaaagagct

SEQ ID NO: 394527 - DNA, 25 bp, Homo sapien
gagaaccaacgggaaagagcttgag

SEQ ID NO: 394528 - DNA, 25 bp, Homo sapien
agaaccaacgggaaagagcttgagc

SEQ ID NO: 394529 - DNA, 25 bp, Homo sapien
acctggccccagaagtgtttcaaca

SEQ ID NO: 394530 - DNA, 25 bp, Homo sapien
tggaaattttccttagcccttctgt

SEQ ID NO: 394531 - DNA, 25 bp, Homo sapien
gaaattttccttagcccttctgtgg

SEQ ID NO: 394532 - DNA, 25 bp, Homo sapien
ccttctgtggttgtcatggcttaat

SEQ ID NO: 394533 - DNA, 25 bp, Homo sapien
gtcatggcttaatgtgtgtctttcc

SEQ ID NO: 394534 - DNA, 25 bp, Homo sapien
atggcttaatgtgtgtctttccaga

SEQ ID NO: 394535 - DNA, 25 bp, Homo sapien
tctttccagaactttgaatgtttgc

SEQ ID NO: 394536 - DNA, 25 bp, Homo sapien
gaactttgaatgtttgcatacttgt

SEQ ID NO: 394537 - DNA, 25 bp, Homo sapien
gcatacttgtggatgtacctttcaa

SEQ ID NO: 394538 - DNA, 25 bp, Homo sapien
gtggatgtacctttcaaatatgttt

SEQ ID NO: 394539 - DNA, 25 bp, Homo sapien
acctttcaaatatgtttgtcttgtg

SEQ ID NO: 394540 - DNA, 25 bp, Homo sapien
gctgctttgagctcaacaccttcag

SEQ ID NO: 394541 - DNA, 25 bp, Homo sapien
aacctgctgagccacacaatcatac

SEQ ID NO: 394542 - DNA, 25 bp, Homo sapien
aaaaacttatgcctggagctgtatc

SEQ ID NO: 394543 - DNA, 25 bp, Homo sapien
cctgccccgcaggaaagttatggtg

SEQ ID NO: 394544 - DNA, 25 bp, Homo sapien
tatggtgctgatggtactctctgct

SEQ ID NO: 394545 - DNA, 25 bp, Homo sapien
gatggtactctctgctggagcagat

SEQ ID NO: 394546 - DNA, 25 bp, Homo sapien
aagtgaggcacttaaggcaccccaa

SEQ ID NO: 394547 - DNA, 25 bp, Homo sapien
cttaaggcaccccaagaggatcttg

SEQ ID NO: 394548 - DNA, 25 bp, Homo sapien
aagaggatcttgttctgtactgaca

SEQ ID NO: 394549 - DNA, 25 bp, Homo sapien
tgttctgtactgacaactgccctga

SEQ ID NO: 394550 - DNA, 25 bp, Homo sapien
aactgccctgaccatggcgacaggt

SEQ ID NO: 394551 - DNA, 25 bp, Homo sapien
acaaggaccagactcgcacctactt

SEQ ID NO: 394552 - DNA, 25 bp, Homo sapien
gcacctacttccagatcatcacagt

SEQ ID NO: 394553 - DNA, 25 bp, Homo sapien
ttccagatcatcacagtcactacag

SEQ ID NO: 394554 - DNA, 25 bp, Homo sapien
tatactatcaccatcagccgcagtt

SEQ ID NO: 394555 - DNA, 25 bp, Homo sapien
catcagccgcagttctatatctttg

SEQ ID NO: 394556 - DNA, 25 bp, Homo sapien
tatatctttgcgaggcgagggtacc

SEQ ID NO: 394557 - DNA, 25 bp, Homo sapien
cgagggtaccttgcgcctgtcctgg

SEQ ID NO: 394558 - DNA, 25 bp, Homo sapien
tgggaccaacctgccctgctgaaga

SEQ ID NO: 394559 - DNA, 25 bp, Homo sapien
ctggagctctatgtggctgctgcag

SEQ ID NO: 394560 - DNA, 25 bp, Homo sapien
taccttgagttcctagtcctccgac

SEQ ID NO: 394561 - DNA, 25 bp, Homo sapien
gggttctacgtggccaatggctcag

SEQ ID NO: 394562 - DNA, 25 bp, Homo sapien
caggcgacccggaggtagcatttcc

SEQ ID NO: 394563 - DNA, 25 bp, Homo sapien
atgggcacagccacgccagatggac

SEQ ID NO: 394564 - DNA, 25 bp, Homo sapien
gcacagccacgccagatggacgaga

SEQ ID NO: 394565 - DNA, 25 bp, Homo sapien
cacgccagatggacgagaagaccaa

SEQ ID NO: 394566 - DNA, 25 bp, Homo sapien
aatgaagtgtgccatctggctggca

SEQ ID NO: 394567 - DNA, 25 bp, Homo sapien
aacgggtgcccctgagtgtgcaact

SEQ ID NO: 394568 - DNA, 25 bp, Homo sapien
ggtgcccctgagtgtgcaactgaag

SEQ ID NO: 394569 - DNA, 25 bp, Homo sapien
gtgtgcaactgaagcctgaggtctc

SEQ ID NO: 394570 - DNA, 25 bp, Homo sapien
tgaggtctccccaacgcaggacatc

SEQ ID NO: 394571 - DNA, 25 bp, Homo sapien
cgcaggacatcagattcctcatggt

SEQ ID NO: 394572 - DNA, 25 bp, Homo sapien
catggtgcaaaatggccattccagc

SEQ ID NO: 394573 - DNA, 25 bp, Homo sapien
acaggtggcaatgaagtgtgccatc

SEQ ID NO: 394574 - DNA, 25 bp, Homo sapien
gcaatgaagtgtgccatctggctgg

SEQ ID NO: 394575 - DNA, 25 bp, Homo sapien
aatgaagtgtgccatctggctggca

SEQ ID NO: 394576 - DNA, 25 bp, Homo sapien
ggctggcagagcaacgggtgcccct

SEQ ID NO: 394577 - DNA, 25 bp, Homo sapien
aacgggtgcccctgagtgtgcaact

SEQ ID NO: 394578 - DNA, 25 bp, Homo sapien
gggtgcccctgagtgtgcaactgaa

SEQ ID NO: 394579 - DNA, 25 bp, Homo sapien
ggtgcccctgagtgtgcaactgaag

SEQ ID NO: 394580 - DNA, 25 bp, Homo sapien
gagtgtgcaactgaagcctgaggtc

SEQ ID NO: 394581 - DNA, 25 bp, Homo sapien
gtgtgcaactgaagcctgaggtctc

SEQ ID NO: 394582 - DNA, 25 bp, Homo sapien
tgaggtctccccaacgcaggacatc

SEQ ID NO: 394583 - DNA, 25 bp, Homo sapien
aggtctccccaacgcaggacatcag

SEQ ID NO: 394584 - DNA, 25 bp, Homo sapien
gagaaggtgttccaagttgatgttt

SEQ ID NO: 394585 - DNA, 25 bp, Homo sapien
gttccaagttgatgtttaaatccac

SEQ ID NO: 394586 - DNA, 25 bp, Homo sapien
cattttgcttccttacctacaagaa

SEQ ID NO: 394587 - DNA, 25 bp, Homo sapien
caggcagcaggcagtctctggctgt

SEQ ID NO: 394588 - DNA, 25 bp, Homo sapien
atggcatttccatgagtacttctca

SEQ ID NO: 394589 - DNA, 25 bp, Homo sapien
tgagtacttctcatgcatctttgca

SEQ ID NO: 394590 - DNA, 25 bp, Homo sapien
tgcatctttgcatatttcacctggg

SEQ ID NO: 394591 - DNA, 25 bp, Homo sapien
gagggcgcgtcacctcgcctacttg

SEQ ID NO: 394592 - DNA, 25 bp, Homo sapien
ggtgggaaccagtcatatatgcata

SEQ ID NO: 394593 - DNA, 25 bp, Homo sapien
atgcatatgaccaaacagcttttct

SEQ ID NO: 394594 - DNA, 25 bp, Homo sapien
tctactggagaagtttagcattggt

SEQ ID NO: 394595 - DNA, 25 bp, Homo sapien
tatccaggacttaaggtagccatct

SEQ ID NO: 394596 - DNA, 25 bp, Homo sapien
gtagccatctggatcataagaaggt

SEQ ID NO: 394597 - DNA, 25 bp, Homo sapien
gaaggtcctgcagttgagacaaaat

SEQ ID NO: 394598 - DNA, 25 bp, Homo sapien
aaatgacccaagtgtattttccaca

SEQ ID NO: 394599 - DNA, 25 bp, Homo sapien
gtattttccacaagttttgatcctg

SEQ ID NO: 394600 - DNA, 25 bp, Homo sapien
gttttgatcctgtgtaatatttctt

SEQ ID NO: 394601 - DNA, 25 bp, Homo sapien
tccttccctagtgtatgtagataca

SEQ ID NO: 394602 - DNA, 25 bp, Homo sapien
atggaatgcagttccactttctccc

SEQ ID NO: 394603 - DNA, 25 bp, Homo sapien
tctccccagagttgatctttttgtg

SEQ ID NO: 394604 - DNA, 25 bp, Homo sapien
attgctttcccgtctctagtagtat

SEQ ID NO: 394605 - DNA, 25 bp, Homo sapien
actgattttttcctacatacgcaaa

SEQ ID NO: 394606 - DNA, 25 bp, Homo sapien
gacaatgagagtgtccgcctcctga

SEQ ID NO: 394607 - DNA, 25 bp, Homo sapien
caatgagagtgtccgcctcctgagc

SEQ ID NO: 394608 - DNA, 25 bp, Homo sapien
agagtgtccgcctcctgagccaata

SEQ ID NO: 394609 - DNA, 25 bp, Homo sapien
gtgtccgcctcctgagccaataaag

SEQ ID NO: 394610 - DNA, 25 bp, Homo sapien
gtccgcctcctgagccaataaagct

SEQ ID NO: 394611 - DNA, 25 bp, Homo sapien
gccaataaagctgtactggttttga

SEQ ID NO: 394612 - DNA, 25 bp, Homo sapien
aaagctgtactggttttgaatcgcg

SEQ ID NO: 394613 - DNA, 25 bp, Homo sapien
ctgtactggttttgaatcgcggcgc

SEQ ID NO: 394614 - DNA, 25 bp, Homo sapien
gtactggttttgaatcgcggcgcgt

SEQ ID NO: 394615 - DNA, 25 bp, Homo sapien
actggttttgaatcgcggcgcgttt

SEQ ID NO: 394616 - DNA, 25 bp, Homo sapien
ctggttttgaatcgcggcgcgtttc

SEQ ID NO: 394617 - DNA, 25 bp, Homo sapien
atgatcacaagctccatatttgttc

SEQ ID NO: 394618 - DNA, 25 bp, Homo sapien
gatcacaagctccatatttgttctc

SEQ ID NO: 394619 - DNA, 25 bp, Homo sapien
tcacaagctccatatttgttctcat

SEQ ID NO: 394620 - DNA, 25 bp, Homo sapien
tctcacttcttatggtgccatcgtc

SEQ ID NO: 394621 - DNA, 25 bp, Homo sapien
gaaagtgtttggaacatgtggagct

SEQ ID NO: 394622 - DNA, 25 bp, Homo sapien
aacatgtggagctcatcttatggct

SEQ ID NO: 394623 - DNA, 25 bp, Homo sapien
tttcattccggccatgtgcatatat

SEQ ID NO: 394624 - DNA, 25 bp, Homo sapien
ttcattccggccatgtgcatatatc

SEQ ID NO: 394625 - DNA, 25 bp, Homo sapien
tccggccatgtgcatatatctccag

SEQ ID NO: 394626 - DNA, 25 bp, Homo sapien
gccaccatcaggaaattctcaagat

SEQ ID NO: 394627 - DNA, 25 bp, Homo sapien
acaccctcagaaacaaagttgtaag

SEQ ID NO: 394628 - DNA, 25 bp, Homo sapien
gcattgtatgagctgtatctgggtc

SEQ ID NO: 394629 - DNA, 25 bp, Homo sapien
tgagctgtatctgggtcagggtttc

SEQ ID NO: 394630 - DNA, 25 bp, Homo sapien
tcagggtttcccattaaaggatgtt

SEQ ID NO: 394631 - DNA, 25 bp, Homo sapien
gattactttgtttaagaccatctcc

SEQ ID NO: 394632 - DNA, 25 bp, Homo sapien
tttaagaccatctcccttcaagtaa

SEQ ID NO: 394633 - DNA, 25 bp, Homo sapien
tctcccttcaagtaactcacagttt

SEQ ID NO: 394634 - DNA, 25 bp, Homo sapien
gtaactcacagtttatgtaatacta

SEQ ID NO: 394635 - DNA, 25 bp, Homo sapien
gttagggaagaaacctcatttcatc

SEQ ID NO: 394636 - DNA, 25 bp, Homo sapien
gaaacctcatttcatccattctaac

SEQ ID NO: 394637 - DNA, 25 bp, Homo sapien
atttcatccattctaacactcctga

SEQ ID NO: 394638 - DNA, 25 bp, Homo sapien
cattctaacactcctgatgaagtcc

SEQ ID NO: 394639 - DNA, 25 bp, Homo sapien
ggccagtcctttacttttataggtg

SEQ ID NO: 394640 - DNA, 25 bp, Homo sapien
ctgagacctaagaactgaagtgact

SEQ ID NO: 394641 - DNA, 25 bp, Homo sapien
gaagtgacttacgtccatggcaaat

SEQ ID NO: 394642 - DNA, 25 bp, Homo sapien
gcaaattgattgcagagccaaaagt

SEQ ID NO: 394643 - DNA, 25 bp, Homo sapien
cagatctcctaacttccatactaga

SEQ ID NO: 394644 - DNA, 25 bp, Homo sapien
gttgatggtacctgcctgaagtttc

SEQ ID NO: 394645 - DNA, 25 bp, Homo sapien
cctgaagtttccatggttgctgggt

SEQ ID NO: 394646 - DNA, 25 bp, Homo sapien
ctgggtggaaacagcactcttcctt

SEQ ID NO: 394647 - DNA, 25 bp, Homo sapien
gaaacagcactcttccttctgtctt

SEQ ID NO: 394648 - DNA, 25 bp, Homo sapien
gcactcaagcatcccgatggacatt

SEQ ID NO: 394649 - DNA, 25 bp, Homo sapien
aagcatcccgatggacattgaattt

SEQ ID NO: 394650 - DNA, 25 bp, Homo sapien
ggaactaagtgagtacatctccagt

SEQ ID NO: 394651 - DNA, 25 bp, Homo sapien
aagtgagtacatctccagttgccca

SEQ ID NO: 394652 - DNA, 25 bp, Homo sapien
gtgagtacatctccagttgcccatg

SEQ ID NO: 394653 - DNA, 25 bp, Homo sapien
gagtacatctccagttgcccatgaa

SEQ ID NO: 394654 - DNA, 25 bp, Homo sapien
gtacatctccagttgcccatgaaag

SEQ ID NO: 394655 - DNA, 25 bp, Homo sapien
acatctccagttgcccatgaaagca

SEQ ID NO: 394656 - DNA, 25 bp, Homo sapien
tctccagttgcccatgaaagcataa

SEQ ID NO: 394657 - DNA, 25 bp, Homo sapien
tttgttttcctcagctgaggcaagt

SEQ ID NO: 394658 - DNA, 25 bp, Homo sapien
gttttcctcagctgaggcaagtggt

SEQ ID NO: 394659 - DNA, 25 bp, Homo sapien
tcagctgaggcaagtggtagagtat

SEQ ID NO: 394660 - DNA, 25 bp, Homo sapien
gctgaggcaagtggtagagtataca

SEQ ID NO: 394661 - DNA, 25 bp, Homo sapien
ccggagacaatggcagatgagagtc

SEQ ID NO: 394662 - DNA, 25 bp, Homo sapien
aatggcagatgagagtctcagcagc

SEQ ID NO: 394663 - DNA, 25 bp, Homo sapien
gctgcagcttccaaactagtgccat

SEQ ID NO: 394664 - DNA, 25 bp, Homo sapien
ctgcagcttccaaactagtgccatt

SEQ ID NO: 394665 - DNA, 25 bp, Homo sapien
tgcagcttccaaactagtgccattt

SEQ ID NO: 394666 - DNA, 25 bp, Homo sapien
catttcaagggacatagacatggca

SEQ ID NO: 394667 - DNA, 25 bp, Homo sapien
tttcaagggacatagacatggcagc

SEQ ID NO: 394668 - DNA, 25 bp, Homo sapien
tcaagggacatagacatggcagcca

SEQ ID NO: 394669 - DNA, 25 bp, Homo sapien
caagggacatagacatggcagccaa

SEQ ID NO: 394670 - DNA, 25 bp, Homo sapien
acatggcagccaaattcattggggc

SEQ ID NO: 394671 - DNA, 25 bp, Homo sapien
aattcattggggctggggctaccac

SEQ ID NO: 394672 - DNA, 25 bp, Homo sapien
gcatcaaagtgatcagaaaagctga

SEQ ID NO: 394673 - DNA, 25 bp, Homo sapien
gaaaagctgagaaacttggtaaggg

SEQ ID NO: 394674 - DNA, 25 bp, Homo sapien
gaaatatcaccgtgacatcccaggt

SEQ ID NO: 394675 - DNA, 25 bp, Homo sapien
taatctatgtgattggttgcacgta

SEQ ID NO: 394676 - DNA, 25 bp, Homo sapien
atgtgattggttgcacgtagttgct

SEQ ID NO: 394677 - DNA, 25 bp, Homo sapien
gattggttgcacgtagttgctaaga

SEQ ID NO: 394678 - DNA, 25 bp, Homo sapien
tgcacgtagttgctaagagagttat

SEQ ID NO: 394679 - DNA, 25 bp, Homo sapien
gagttatgaattccgttacttccaa

SEQ ID NO: 394680 - DNA, 25 bp, Homo sapien
tatgaattccgttacttccaaatta

SEQ ID NO: 394681 - DNA, 25 bp, Homo sapien
gattctgaaattcactcttgattgc

SEQ ID NO: 394682 - DNA, 25 bp, Homo sapien
tgattgcacccaccccataaaagat

SEQ ID NO: 394683 - DNA, 25 bp, Homo sapien
atggctgtgtgactattcatagata

SEQ ID NO: 394684 - DNA, 25 bp, Homo sapien
gtgtgactattcatagatacaatga

SEQ ID NO: 394685 - DNA, 25 bp, Homo sapien
tctgaagacaggatacctcaccgaa

SEQ ID NO: 394686 - DNA, 25 bp, Homo sapien
gacaggatacctcaccgaagaagcc

SEQ ID NO: 394687 - DNA, 25 bp, Homo sapien
atacctcaccgaagaagccacactg

SEQ ID NO: 394688 - DNA, 25 bp, Homo sapien
gaagaagccacactgatccaagatg

SEQ ID NO: 394689 - DNA, 25 bp, Homo sapien
gccacactgatccaagatgggaggt

SEQ ID NO: 394690 - DNA, 25 bp, Homo sapien
cactgatccaagatgggaggtttta

SEQ ID NO: 394691 - DNA, 25 bp, Homo sapien
aaaactctacagtgggaacttcaca

SEQ ID NO: 394692 - DNA, 25 bp, Homo sapien
cagtgggaacttcacatatctcctt

SEQ ID NO: 394693 - DNA, 25 bp, Homo sapien
acatatctcctttgtgccatatgca

SEQ ID NO: 394694 - DNA, 25 bp, Homo sapien
agtggacaacagcaatcaaattatg

SEQ ID NO: 394695 - DNA, 25 bp, Homo sapien
gtggacaacagcaatcaaattatgg

SEQ ID NO: 394696 - DNA, 25 bp, Homo sapien
tggacaacagcaatcaaattatgga

SEQ ID NO: 394697 - DNA, 25 bp, Homo sapien
ggacaacagcaatcaaattatggac

SEQ ID NO: 394698 - DNA, 25 bp, Homo sapien
ggtggaagaagctcgggcagtccct

SEQ ID NO: 394699 - DNA, 25 bp, Homo sapien
tggaagaagctcgggcagtccctat

SEQ ID NO: 394700 - DNA, 25 bp, Homo sapien
ggaagaagctcgggcagtccctatg

SEQ ID NO: 394701 - DNA, 25 bp, Homo sapien
gaagaagctcgggcagtccctatgg

SEQ ID NO: 394702 - DNA, 25 bp, Homo sapien
aagaagctcgggcagtccctatggt

SEQ ID NO: 394703 - DNA, 25 bp, Homo sapien
aagctcgggcagtccctatggtggt

SEQ ID NO: 394704 - DNA, 25 bp, Homo sapien
agctcgggcagtccctatggtggtg

SEQ ID NO: 394705 - DNA, 25 bp, Homo sapien
taggactatagtcagcatgctagac

SEQ ID NO: 394706 - DNA, 25 bp, Homo sapien
catgctagactgagaggtaaacact

SEQ ID NO: 394707 - DNA, 25 bp, Homo sapien
ggtaaacactgatgcaattagaaca

SEQ ID NO: 394708 - DNA, 25 bp, Homo sapien
gtgtttaacactatgtttagctgtg

SEQ ID NO: 394709 - DNA, 25 bp, Homo sapien
tagacactagctagtactgctgcct

SEQ ID NO: 394710 - DNA, 25 bp, Homo sapien
tagctagtactgctgcctcatgtaa

SEQ ID NO: 394711 - DNA, 25 bp, Homo sapien
gctgcctcatgtaactccaaagaaa

SEQ ID NO: 394712 - DNA, 25 bp, Homo sapien
aaacaggatttcattaagtgcattg

SEQ ID NO: 394713 - DNA, 25 bp, Homo sapien
agttactcatattgtcctttgcttg

SEQ ID NO: 394714 - DNA, 25 bp, Homo sapien
ctttgcttgaatgcaatgccgtgca

SEQ ID NO: 394715 - DNA, 25 bp, Homo sapien
gaatgcaatgccgtgcagatttatg

SEQ ID NO: 394716 - DNA, 25 bp, Homo sapien
acatcacctgcgttgtcctgagggt

SEQ ID NO: 394717 - DNA, 25 bp, Homo sapien
acctgcgttgtcctgagggtcccat

SEQ ID NO: 394718 - DNA, 25 bp, Homo sapien
tgcgttgtcctgagggtcccatcca

SEQ ID NO: 394719 - DNA, 25 bp, Homo sapien
gtctccatatttcagaacttcatcc

SEQ ID NO: 394720 - DNA, 25 bp, Homo sapien
tccatatttcagaacttcatcctcc

SEQ ID NO: 394721 - DNA, 25 bp, Homo sapien
cctcccactcagctcagagagatat

SEQ ID NO: 394722 - DNA, 25 bp, Homo sapien
actcagctcagagagatatagcagc

SEQ ID NO: 394723 - DNA, 25 bp, Homo sapien
cagctgctgtgaggttcacagtggt

SEQ ID NO: 394724 - DNA, 25 bp, Homo sapien
ctgtgaggttcacagtggtgactcc

SEQ ID NO: 394725 - DNA, 25 bp, Homo sapien
gtggtgactcccgtgatgaatcctt

SEQ ID NO: 394726 - DNA, 25 bp, Homo sapien
gtgactcccgtgatgaatcctttga

SEQ ID NO: 394727 - DNA, 25 bp, Homo sapien
cctctctcactttctatagctttgt

SEQ ID NO: 394728 - DNA, 25 bp, Homo sapien
ctcactttctatagctttgttggac

SEQ ID NO: 394729 - DNA, 25 bp, Homo sapien
actttctatagctttgttggaccag

SEQ ID NO: 394730 - DNA, 25 bp, Homo sapien
tatagctttgttggaccagatggtg

SEQ ID NO: 394731 - DNA, 25 bp, Homo sapien
gaaaccagagctgagacctcttcaa

SEQ ID NO: 394732 - DNA, 25 bp, Homo sapien
agctgagacctcttcaacagggttt

SEQ ID NO: 394733 - DNA, 25 bp, Homo sapien
ttctttgagatcctacacctccatt

SEQ ID NO: 394734 - DNA, 25 bp, Homo sapien
ttgagatcctacacctccattgggc

SEQ ID NO: 394735 - DNA, 25 bp, Homo sapien
tgggccctttttcagtcttcaatgg

SEQ ID NO: 394736 - DNA, 25 bp, Homo sapien
gggccctttttcagtcttcaatggg

SEQ ID NO: 394737 - DNA, 25 bp, Homo sapien
aatgggggcccagttggctctagaa

SEQ ID NO: 394738 - DNA, 25 bp, Homo sapien
gcaactaattagtggctgcacctgc

SEQ ID NO: 394739 - DNA, 25 bp, Homo sapien
ttggtcctttggctcgggccattaa

SEQ ID NO: 394740 - DNA, 25 bp, Homo sapien
ttggctcgggccattaataatgctt

SEQ ID NO: 394741 - DNA, 25 bp, Homo sapien
taataatgctttcgcatctccgcgt

SEQ ID NO: 394742 - DNA, 25 bp, Homo sapien
gcgttggccacgtcatcggatatcg

SEQ ID NO: 394743 - DNA, 25 bp, Homo sapien
gactgccccttttgcgaaggagact

SEQ ID NO: 394744 - DNA, 25 bp, Homo sapien
gaaggagactccgtgtcatctggtc

SEQ ID NO: 394745 - DNA, 25 bp, Homo sapien
tctggtcgccgtctcattttttaaa

SEQ ID NO: 394746 - DNA, 25 bp, Homo sapien
tcggtctgcgaaaaccccaagccaa

SEQ ID NO: 394747 - DNA, 25 bp, Homo sapien
aaaccccaagccaaacaagctgata

SEQ ID NO: 394748 - DNA, 25 bp, Homo sapien
tgctgccttttctaccgattacaaa

SEQ ID NO: 394749 - DNA, 25 bp, Homo sapien
atttctgctgtaaccaaaccttaag

SEQ ID NO: 394750 - DNA, 25 bp, Homo sapien
aaccttaagatcctgtgggaatggc

SEQ ID NO: 394751 - DNA, 25 bp, Homo sapien
tcctgtgggaatggcttgtttgtca

SEQ ID NO: 394752 - DNA, 25 bp, Homo sapien
gaatggcttgtttgtcaatgggcaa

SEQ ID NO: 394753 - DNA, 25 bp, Homo sapien
ggcttgtttgtcaatgggcaaaatt

SEQ ID NO: 394754 - DNA, 25 bp, Homo sapien
tgtatgttgctgattggtgtgtaaa

SEQ ID NO: 394755 - DNA, 25 bp, Homo sapien
gtttcagaaaggcagcttggcaata

SEQ ID NO: 394756 - DNA, 25 bp, Homo sapien
gaaaggcagcttggcaatatatata

SEQ ID NO: 394757 - DNA, 25 bp, Homo sapien
gtttatgtatccaagacagattttc

SEQ ID NO: 394758 - DNA, 25 bp, Homo sapien
tgtatccaagacagattttcagagg

SEQ ID NO: 394759 - DNA, 25 bp, Homo sapien
gataacatttctgctgtaaccaaac

SEQ ID NO: 394760 - DNA, 25 bp, Homo sapien
agcgaacatttccaaatcatcaaag

SEQ ID NO: 394761 - DNA, 25 bp, Homo sapien
atcatcaaagactgcctgcttcact

SEQ ID NO: 394762 - DNA, 25 bp, Homo sapien
tgcctgcttcactttatacttatta

SEQ ID NO: 394763 - DNA, 25 bp, Homo sapien
gggatattttaacaaatgactcttc

SEQ ID NO: 394764 - DNA, 25 bp, Homo sapien
gtcctgtttaatcaggagtgtccta

SEQ ID NO: 394765 - DNA, 25 bp, Homo sapien
aacatcaatcacatgtgaggcaggt

SEQ ID NO: 394766 - DNA, 25 bp, Homo sapien
gtccccgttgctgccaaaaagtgta

SEQ ID NO: 394767 - DNA, 25 bp, Homo sapien
aatcaacctttcctatccattcatc

SEQ ID NO: 394768 - DNA, 25 bp, Homo sapien
ttcctatccattcatccaaatgctg

SEQ ID NO: 394769 - DNA, 25 bp, Homo sapien
caggagtgtcctaatagttttaaat

SEQ ID NO: 394770 - DNA, 25 bp, Homo sapien
ctgcctttcagcgaacatttccaaa

SEQ ID NO: 394771 - DNA, 25 bp, Homo sapien
agcagtactctattctctaggcact

SEQ ID NO: 394772 - DNA, 25 bp, Homo sapien
aagctcttttttcctgacttctcag

SEQ ID NO: 394773 - DNA, 25 bp, Homo sapien
acaatcccttggtgagtggccctct

SEQ ID NO: 394774 - DNA, 25 bp, Homo sapien
gtggccctcttttggacaagtgcag

SEQ ID NO: 394775 - DNA, 25 bp, Homo sapien
ggaatggctcttaagtttgcactgg

SEQ ID NO: 394776 - DNA, 25 bp, Homo sapien
gaggttgagtgtcatgtccacagac

SEQ ID NO: 394777 - DNA, 25 bp, Homo sapien
ggctcttaagtttgcactgggtgct

SEQ ID NO: 394778 - DNA, 25 bp, Homo sapien
tgcactgggtgcttgaggtaagatt

SEQ ID NO: 394779 - DNA, 25 bp, Homo sapien
taagattaggcagacccagagggta

SEQ ID NO: 394780 - DNA, 25 bp, Homo sapien
gtagtggagactttgaccttatcat

SEQ ID NO: 394781 - DNA, 25 bp, Homo sapien
gactttgaccttatcatgaaactct

SEQ ID NO: 394782 - DNA, 25 bp, Homo sapien
tgaagcttgaaggtagtggaagcta

SEQ ID NO: 394783 - DNA, 25 bp, Homo sapien
ggagcggagttcctgatcgcttctc

SEQ ID NO: 394784 - DNA, 25 bp, Homo sapien
gagcggagttcctgatcgcttctca

SEQ ID NO: 394785 - DNA, 25 bp, Homo sapien
tgatcgcttctcaggctccagctct

SEQ ID NO: 394786 - DNA, 25 bp, Homo sapien
tcgcttctcaggctccagctctggg

SEQ ID NO: 394787 - DNA, 25 bp, Homo sapien
ctgattattactgtgagacctggga

SEQ ID NO: 394788 - DNA, 25 bp, Homo sapien
tgattattactgtgagacctgggac

SEQ ID NO: 394789 - DNA, 25 bp, Homo sapien
gattattactgtgagacctgggaca

SEQ ID NO: 394790 - DNA, 25 bp, Homo sapien
attattactgtgagacctgggacag

SEQ ID NO: 394791 - DNA, 25 bp, Homo sapien
tattactgtgagacctgggacagta

SEQ ID NO: 394792 - DNA, 25 bp, Homo sapien
tactgtgagacctgggacagtaaca

SEQ ID NO: 394793 - DNA, 25 bp, Homo sapien
agatgcagaatctcggcagggagtt

SEQ ID NO: 394794 - DNA, 25 bp, Homo sapien
aatctcggcagggagttcattgtcc

SEQ ID NO: 394795 - DNA, 25 bp, Homo sapien
ggagttcattgtccctggaatggac

SEQ ID NO: 394796 - DNA, 25 bp, Homo sapien
tccctggaatggacagcgctacgtc

SEQ ID NO: 394797 - DNA, 25 bp, Homo sapien
gaatggacagcgctacgtccctgat

SEQ ID NO: 394798 - DNA, 25 bp, Homo sapien
agcgctacgtccctgatctgggcaa

SEQ ID NO: 394799 - DNA, 25 bp, Homo sapien
acgtccctgatctgggcaaccaagg

SEQ ID NO: 394800 - DNA, 25 bp, Homo sapien
ctgatctgggcaaccaaggacttat

SEQ ID NO: 394801 - DNA, 25 bp, Homo sapien
caaccaaggacttatgaatgctgtg

SEQ ID NO: 394802 - DNA, 25 bp, Homo sapien
gaaacaggatgagtcacagagcgag

SEQ ID NO: 394803 - DNA, 25 bp, Homo sapien
tcacagagcgagattaaatgggcat

SEQ ID NO: 394804 - DNA, 25 bp, Homo sapien
gtaattgtccaaatgtaatgctgct

SEQ ID NO: 394805 - DNA, 25 bp, Homo sapien
tgtccaaatgtaatgctgctatgta

SEQ ID NO: 394806 - DNA, 25 bp, Homo sapien
gctatgtatattatttgggttccag

SEQ ID NO: 394807 - DNA, 25 bp, Homo sapien
ttctcaaaacactcagtgtccttac

SEQ ID NO: 394808 - DNA, 25 bp, Homo sapien
gtgtccttacaactgcagctaaaat

SEQ ID NO: 394809 - DNA, 25 bp, Homo sapien
aaatggttaatcattctggcaagaa

SEQ ID NO: 394810 - DNA, 25 bp, Homo sapien
cagtgtgtatattggaaaggcagac

SEQ ID NO: 394811 - DNA, 25 bp, Homo sapien
gaaaggcagacattcacatttgaaa

SEQ ID NO: 394812 - DNA, 25 bp, Homo sapien
gttagctaaaatcaacctctccttg

SEQ ID NO: 394813 - DNA, 25 bp, Homo sapien
caacctctccttgaatgtagataca

SEQ ID NO: 394814 - DNA, 25 bp, Homo sapien
ggttttgcagtcaattctgaatgga

SEQ ID NO: 394815 - DNA, 25 bp, Homo sapien
ggcctgggtcagtcgaatgaaatga

SEQ ID NO: 394816 - DNA, 25 bp, Homo sapien
tgtgcctgcggttgctgggccacgg

SEQ ID NO: 394817 - DNA, 25 bp, Homo sapien
cagcagagccacagacccacaagtg

SEQ ID NO: 394818 - DNA, 25 bp, Homo sapien
gccacagacccacaagtgcttgtaa

SEQ ID NO: 394819 - DNA, 25 bp, Homo sapien
aagtgcttgtaatccatgtccacgg

SEQ ID NO: 394820 - DNA, 25 bp, Homo sapien
gtgcttgtaatccatgtccacggac

SEQ ID NO: 394821 - DNA, 25 bp, Homo sapien
tgtaatccatgtccacggactgcag

SEQ ID NO: 394822 - DNA, 25 bp, Homo sapien
atgtccacggactgcagctcatgca

SEQ ID NO: 394823 - DNA, 25 bp, Homo sapien
agctcatgcggcctttgcctttcaa

SEQ ID NO: 394824 - DNA, 25 bp, Homo sapien
gcggcctttgcctttcaagtaaatt

SEQ ID NO: 394825 - DNA, 25 bp, Homo sapien
tcaagtaaattcacggtttttcctg

SEQ ID NO: 394826 - DNA, 25 bp, Homo sapien
gtgcttccagagcaggtccaaataa

SEQ ID NO: 394827 - DNA, 25 bp, Homo sapien
agaagtgggtcgaattcagactgaa

SEQ ID NO: 394828 - DNA, 25 bp, Homo sapien
tactgaagtacacgtagagaagctt

SEQ ID NO: 394829 - DNA, 25 bp, Homo sapien
gtacacgtagagaagcttcactttg

SEQ ID NO: 394830 - DNA, 25 bp, Homo sapien
acgtagagaagcttcactttgaatg

SEQ ID NO: 394831 - DNA, 25 bp, Homo sapien
tgaatggataaatcaggtgccagtg

SEQ ID NO: 394832 - DNA, 25 bp, Homo sapien
gaagcagacttggaccacgtgaccc

SEQ ID NO: 394833 - DNA, 25 bp, Homo sapien
accccagaaatctatgaaccgagag

SEQ ID NO: 394834 - DNA, 25 bp, Homo sapien
gaaatctatgaaccgagagaagaga

SEQ ID NO: 394835 - DNA, 25 bp, Homo sapien
gaagagagaacctagccaagcagat

SEQ ID NO: 394836 - DNA, 25 bp, Homo sapien
ctgaggattagagagcaagccaaca

SEQ ID NO: 394837 - DNA, 25 bp, Homo sapien
ctgtcagcatctccgtggtcagcag

SEQ ID NO: 394838 - DNA, 25 bp, Homo sapien
ttccgcctccgcaggtggctatgga

SEQ ID NO: 394839 - DNA, 25 bp, Homo sapien
tacggcggaggcatgggcggtggtt

SEQ ID NO: 394840 - DNA, 25 bp, Homo sapien
ggcggtggtttaggaggtggcttca

SEQ ID NO: 394841 - DNA, 25 bp, Homo sapien
cggcggctcaggcattggctttggc

SEQ ID NO: 394842 - DNA, 25 bp, Homo sapien
atcggcggtggatttggcggcggca

SEQ ID NO: 394843 - DNA, 25 bp, Homo sapien
acgagcggtttcagcggtggcagcg

SEQ ID NO: 394844 - DNA, 25 bp, Homo sapien
ggtggcagcggctttggctccatct

SEQ ID NO: 394845 - DNA, 25 bp, Homo sapien
agcggctttggctccatctctggcg

SEQ ID NO: 394846 - DNA, 25 bp, Homo sapien
tctggcgcccgctatggagtgagtg

SEQ ID NO: 394847 - DNA, 25 bp, Homo sapien
aaccggggcggcagcatcaagttct

SEQ ID NO: 394848 - DNA, 25 bp, Homo sapien
gcaagtaaacgtttccaggtggtca

SEQ ID NO: 394849 - DNA, 25 bp, Homo sapien
ttccaggtggtcagctacaacacag

SEQ ID NO: 394850 - DNA, 25 bp, Homo sapien
agtgatgacctggaacttctctacc

SEQ ID NO: 394851 - DNA, 25 bp, Homo sapien
cacatcccagaattcatccctgaag

SEQ ID NO: 394852 - DNA, 25 bp, Homo sapien
gaagctcgaggattggagttcctga

SEQ ID NO: 394853 - DNA, 25 bp, Homo sapien
gagttcctgatgatcctagggacag

SEQ ID NO: 394854 - DNA, 25 bp, Homo sapien
agggacagagtcctacaccagcact

SEQ ID NO: 394855 - DNA, 25 bp, Homo sapien
aagggcatcttctgtaacccgtaca

SEQ ID NO: 394856 - DNA, 25 bp, Homo sapien
gtaacccgtacaacaatctgatctt

SEQ ID NO: 394857 - DNA, 25 bp, Homo sapien
gcagagatctggtacctcctggagg

SEQ ID NO: 394858 - DNA, 25 bp, Homo sapien
tggagggcagctaccgggtctacca

SEQ ID NO: 394859 - DNA, 25 bp, Homo sapien
gtggtggtcttggttatagtaaaat

SEQ ID NO: 394860 - DNA, 25 bp, Homo sapien
tggtggtcttggttatagtaaaata

SEQ ID NO: 394861 - DNA, 25 bp, Homo sapien
ggtggtggaccaggacatgaaaacc

SEQ ID NO: 394862 - DNA, 25 bp, Homo sapien
ggcaatggtggaggatgtgatggtt

SEQ ID NO: 394863 - DNA, 25 bp, Homo sapien
aattttgacagtggtaactatgatg

SEQ ID NO: 394864 - DNA, 25 bp, Homo sapien
ttttgacagtggtaactatgatggt

SEQ ID NO: 394865 - DNA, 25 bp, Homo sapien
ttgacagtggtaactatgatggtgg

SEQ ID NO: 394866 - DNA, 25 bp, Homo sapien
atggtggtgggaagtatagtgattt

SEQ ID NO: 394867 - DNA, 25 bp, Homo sapien
tggacccatgaaaggaggctttctg

SEQ ID NO: 394868 - DNA, 25 bp, Homo sapien
gaaaggaggctttctgggtggaaga

SEQ ID NO: 394869 - DNA, 25 bp, Homo sapien
cgggcagtccctatggtggtgatta

SEQ ID NO: 394870 - DNA, 25 bp, Homo sapien
ctggtggtgactgcacgtgacaatg

SEQ ID NO: 394871 - DNA, 25 bp, Homo sapien
gactgcacgtgacaatggatctcat

SEQ ID NO: 394872 - DNA, 25 bp, Homo sapien
tggatctcatagagctagctgtctt

SEQ ID NO: 394873 - DNA, 25 bp, Homo sapien
cctgccctgcatcataaaatacaaa

SEQ ID NO: 394874 - DNA, 25 bp, Homo sapien
gagaagactgggatgtctagtccac

SEQ ID NO: 394875 - DNA, 25 bp, Homo sapien
cacacagattaacttggcagacaaa

SEQ ID NO: 394876 - DNA, 25 bp, Homo sapien
ggaagccatcagaaccaatgacaat

SEQ ID NO: 394877 - DNA, 25 bp, Homo sapien
tgacaatgacagacaggatgagatc

SEQ ID NO: 394878 - DNA, 25 bp, Homo sapien
agggaggcaatatcctgggtccaaa

SEQ ID NO: 394879 - DNA, 25 bp, Homo sapien
tgggtccaaaatctctggctctcat

SEQ ID NO: 394880 - DNA, 25 bp, Homo sapien
ctggctctcattgccaagctggaaa

SEQ ID NO: 394881 - DNA, 25 bp, Homo sapien
gagtcttatttggaatgcgtgaagt

SEQ ID NO: 394882 - DNA, 25 bp, Homo sapien
cttatttggaatgcgtgaagtccct

SEQ ID NO: 394883 - DNA, 25 bp, Homo sapien
tttggaatgcgtgaagtccctgtgt

SEQ ID NO: 394884 - DNA, 25 bp, Homo sapien
atgtatcatatctggaatggggtca

SEQ ID NO: 394885 - DNA, 25 bp, Homo sapien
gtatcatatctggaatggggtcaga

SEQ ID NO: 394886 - DNA, 25 bp, Homo sapien
tatcatatctggaatggggtcagac

SEQ ID NO: 394887 - DNA, 25 bp, Homo sapien
atcatatctggaatggggtcagaca

SEQ ID NO: 394888 - DNA, 25 bp, Homo sapien
tcatatctggaatggggtcagacac

SEQ ID NO: 394889 - DNA, 25 bp, Homo sapien
catatctggaatggggtcagacact

SEQ ID NO: 394890 - DNA, 25 bp, Homo sapien
atctggaatggggtcagacacttga

SEQ ID NO: 394891 - DNA, 25 bp, Homo sapien
tctggaatggggtcagacacttgat

SEQ ID NO: 394892 - DNA, 25 bp, Homo sapien
cagaagtttcttaattaggatcgac

SEQ ID NO: 394893 - DNA, 25 bp, Homo sapien
aagtttcttaattaggatcgacagc

SEQ ID NO: 394894 - DNA, 25 bp, Homo sapien
aggatcgacagcctgggaccggccc

SEQ ID NO: 394895 - DNA, 25 bp, Homo sapien
atctgcccctactgtggaatgatgt

SEQ ID NO: 394896 - DNA, 25 bp, Homo sapien
tttttctcgcacttttttgggtatg

SEQ ID NO: 394897 - DNA, 25 bp, Homo sapien
ttctcgcacttttttgggtatggct

SEQ ID NO: 394898 - DNA, 25 bp, Homo sapien
ctcgcacttttttgggtatggcttc

SEQ ID NO: 394899 - DNA, 25 bp, Homo sapien
gcacttttttgggtatggcttctat

SEQ ID NO: 394900 - DNA, 25 bp, Homo sapien
cttttttgggtatggcttctatcgc

SEQ ID NO: 394901 - DNA, 25 bp, Homo sapien
ttttttgggtatggcttctatcgca

SEQ ID NO: 394902 - DNA, 25 bp, Homo sapien
cagacatagaataacacttacagtg

SEQ ID NO: 394903 - DNA, 25 bp, Homo sapien
gtgtatttttactccttaaagagct

SEQ ID NO: 394904 - DNA, 25 bp, Homo sapien
gctagaatacatagttttcacctta

SEQ ID NO: 394905 - DNA, 25 bp, Homo sapien
atgaatcaactgaccattacgtagt

SEQ ID NO: 394906 - DNA, 25 bp, Homo sapien
aactgaccattacgtagtagacaat

SEQ ID NO: 394907 - DNA, 25 bp, Homo sapien
cattacgtagtagacaatttctgta

SEQ ID NO: 394908 - DNA, 25 bp, Homo sapien
cttctttctaggctctgttgctgtg

SEQ ID NO: 394909 - DNA, 25 bp, Homo sapien
gaatccattagatttacagtatcgt

SEQ ID NO: 394910 - DNA, 25 bp, Homo sapien
tctttaaagccctctcctttagaat

SEQ ID NO: 394911 - DNA, 25 bp, Homo sapien
aatattgtaccattgaagagtttgg

SEQ ID NO: 394912 - DNA, 25 bp, Homo sapien
gtgtaacttgtgatgccttagaaaa

SEQ ID NO: 394913 - DNA, 25 bp, Homo sapien
gtgatgccttagaaaaatatcctaa

SEQ ID NO: 394914 - DNA, 25 bp, Homo sapien
gagccactttctgtactgctgtatg

SEQ ID NO: 394915 - DNA, 25 bp, Homo sapien
gtttctcttggtcaaaaacacactc

SEQ ID NO: 394916 - DNA, 25 bp, Homo sapien
cactttctgtactgctgtatggaca

SEQ ID NO: 394917 - DNA, 25 bp, Homo sapien
gctgtatggacaagtgtagcaacac

SEQ ID NO: 394918 - DNA, 25 bp, Homo sapien
tatggacaagtgtagcaacacaagt

SEQ ID NO: 394919 - DNA, 25 bp, Homo sapien
gaatggaacccatcccctgttagct

SEQ ID NO: 394920 - DNA, 25 bp, Homo sapien
aatggaacccatcccctgttagctg

SEQ ID NO: 394921 - DNA, 25 bp, Homo sapien
tggtcaaaaacacactcaagtcgtc

SEQ ID NO: 394922 - DNA, 25 bp, Homo sapien
aaaaacacactcaagtcgtctccaa

SEQ ID NO: 394923 - DNA, 25 bp, Homo sapien
aacacactcaagtcgtctccaagtt

SEQ ID NO: 394924 - DNA, 25 bp, Homo sapien
acacactcaagtcgtctccaagttc

SEQ ID NO: 394925 - DNA, 25 bp, Homo sapien
aggcgccggcgccagacgcggaggg

SEQ ID NO: 394926 - DNA, 25 bp, Homo sapien
gcgccggcgccagacgcggagggaa

SEQ ID NO: 394927 - DNA, 25 bp, Homo sapien
gccggcgccagacgcggagggaagg

SEQ ID NO: 394928 - DNA, 25 bp, Homo sapien
gcgccagacgcggagggaaggagct

SEQ ID NO: 394929 - DNA, 25 bp, Homo sapien
gccagacgcggagggaaggagctac

SEQ ID NO: 394930 - DNA, 25 bp, Homo sapien
aaggagctacgagtagccgccgaga

SEQ ID NO: 394931 - DNA, 25 bp, Homo sapien
aggagctacgagtagccgccgagag

SEQ ID NO: 394932 - DNA, 25 bp, Homo sapien
gagctacgagtagccgccgagaggc

SEQ ID NO: 394933 - DNA, 25 bp, Homo sapien
tacgagtagccgccgagaggccgcg

SEQ ID NO: 394934 - DNA, 25 bp, Homo sapien
gcggagccagcgacgaccgacccag

SEQ ID NO: 394935 - DNA, 25 bp, Homo sapien
agcgacgaccgacccagccgagccg

SEQ ID NO: 394936 - DNA, 25 bp, Homo sapien
aggattaaagttcagtctcgctctg

SEQ ID NO: 394937 - DNA, 25 bp, Homo sapien
ggattaaagttcagtctcgctctgt

SEQ ID NO: 394938 - DNA, 25 bp, Homo sapien
accaccacacacggctggtttttgt

SEQ ID NO: 394939 - DNA, 25 bp, Homo sapien
ccaccacacacggctggtttttgtg

SEQ ID NO: 394940 - DNA, 25 bp, Homo sapien
ctgcctgctgggtttaggcgattca

SEQ ID NO: 394941 - DNA, 25 bp, Homo sapien
tgcctgctgggtttaggcgattcag

SEQ ID NO: 394942 - DNA, 25 bp, Homo sapien
cctgctgggtttaggcgattcaggt

SEQ ID NO: 394943 - DNA, 25 bp, Homo sapien
ctgggtttaggcgattcaggtgcct

SEQ ID NO: 394944 - DNA, 25 bp, Homo sapien
tgggtttaggcgattcaggtgcctc

SEQ ID NO: 394945 - DNA, 25 bp, Homo sapien
tttaggcgattcaggtgcctcggcc

SEQ ID NO: 394946 - DNA, 25 bp, Homo sapien
ttaggcgattcaggtgcctcggcct

SEQ ID NO: 394947 - DNA, 25 bp, Homo sapien
ctgtcccaggtctcacagtaataat

SEQ ID NO: 394948 - DNA, 25 bp, Homo sapien
gtcccaggtctcacagtaataatca

SEQ ID NO: 394949 - DNA, 25 bp, Homo sapien
tcccaggtctcacagtaataatcag

SEQ ID NO: 394950 - DNA, 25 bp, Homo sapien
ctggagcctgagaagcgatcaggaa

SEQ ID NO: 394951 - DNA, 25 bp, Homo sapien
gagaagcgatcaggaactccgctcc

SEQ ID NO: 394952 - DNA, 25 bp, Homo sapien
aggaactccgctccccttgttgtag

SEQ ID NO: 394953 - DNA, 25 bp, Homo sapien
aactccgctccccttgttgtagctt

SEQ ID NO: 394954 - DNA, 25 bp, Homo sapien
ttgttgtagcttccactaccttcaa

SEQ ID NO: 394955 - DNA, 25 bp, Homo sapien
tgttgtagcttccactaccttcaag

SEQ ID NO: 394956 - DNA, 25 bp, Homo sapien
ttgtagcttccactaccttcaagct

SEQ ID NO: 394957 - DNA, 25 bp, Homo sapien
gtagcttccactaccttcaagcttc

SEQ ID NO: 394958 - DNA, 25 bp, Homo sapien
aatgagctccgggtttgaagcagcc

SEQ ID NO: 394959 - DNA, 25 bp, Homo sapien
tgagctccgggtttgaagcagccac

SEQ ID NO: 394960 - DNA, 25 bp, Homo sapien
tccgggtttgaagcagccacctctt

SEQ ID NO: 394961 - DNA, 25 bp, Homo sapien
attgcaggaccggtccatcagaatt

SEQ ID NO: 394962 - DNA, 25 bp, Homo sapien
ggaccggtccatcagaattgccagg

SEQ ID NO: 394963 - DNA, 25 bp, Homo sapien
gtccatcagaattgccaggtaggtt

SEQ ID NO: 394964 - DNA, 25 bp, Homo sapien
ggtaggtttctctggaaatatccaa

SEQ ID NO: 394965 - DNA, 25 bp, Homo sapien
ggaaatatccaaggcttcagcaacc

SEQ ID NO: 394966 - DNA, 25 bp, Homo sapien
aaggcttcagcaaccatcaccttgt

SEQ ID NO: 394967 - DNA, 25 bp, Homo sapien
gcaaccatcaccttgttaactttca

SEQ ID NO: 394968 - DNA, 25 bp, Homo sapien
catcaccttgttaactttcacacct

SEQ ID NO: 394969 - DNA, 25 bp, Homo sapien
tttgtgtgtgaagttgctttgtaaa

SEQ ID NO: 394970 - DNA, 25 bp, Homo sapien
gctttgtaaagtgcatgtggaatta

SEQ ID NO: 394971 - DNA, 25 bp, Homo sapien
ggaattaatgggacagtgtgccctt

SEQ ID NO: 394972 - DNA, 25 bp, Homo sapien
atgggacagtgtgccctttgtgtta

SEQ ID NO: 394973 - DNA, 25 bp, Homo sapien
cagtgtgccctttgtgttagatgtt

SEQ ID NO: 394974 - DNA, 25 bp, Homo sapien
gccctttgtgttagatgttagagca

SEQ ID NO: 394975 - DNA, 25 bp, Homo sapien
aagggcttatagtgttagtattgga

SEQ ID NO: 394976 - DNA, 25 bp, Homo sapien
ttagtattggagcactttgaagata

SEQ ID NO: 394977 - DNA, 25 bp, Homo sapien
tgatggcaattggaaatagtcacaa

SEQ ID NO: 394978 - DNA, 25 bp, Homo sapien
atgaagttcttcatccagtaggtgt

SEQ ID NO: 394979 - DNA, 25 bp, Homo sapien
gtgttattttgccactggtaatgtg

SEQ ID NO: 394980 - DNA, 25 bp, Homo sapien
aattgtcaaagcactgccaaaataa

SEQ ID NO: 394981 - DNA, 25 bp, Homo sapien
aaatgacagtgctcatatttgacac

SEQ ID NO: 394982 - DNA, 25 bp, Homo sapien
gtgctcatatttgacacttgtgtat

SEQ ID NO: 394983 - DNA, 25 bp, Homo sapien
gacacttgtgtattggactctcttt

SEQ ID NO: 394984 - DNA, 25 bp, Homo sapien
gtattggactctcttttgaatgaat

SEQ ID NO: 394985 - DNA, 25 bp, Homo sapien
gggtgcgtgttgtttttcatgccat

SEQ ID NO: 394986 - DNA, 25 bp, Homo sapien
gcgtgttgtttttcatgccatggtt

SEQ ID NO: 394987 - DNA, 25 bp, Homo sapien
gtttttcatgccatggtttgtgaat

SEQ ID NO: 394988 - DNA, 25 bp, Homo sapien
gtgaattttaattgtggtttcccat

SEQ ID NO: 394989 - DNA, 25 bp, Homo sapien
tgtggtttcccatttcgttgttgta

SEQ ID NO: 394990 - DNA, 25 bp, Homo sapien
catttcgttgttgtaactgggcaga

SEQ ID NO: 394991 - DNA, 25 bp, Homo sapien
gattctatgatccatgacatattgg

SEQ ID NO: 394992 - DNA, 25 bp, Homo sapien
tgatccatgacatattggaccgcat

SEQ ID NO: 394993 - DNA, 25 bp, Homo sapien
tccatgacatattggaccgcatcgc

SEQ ID NO: 394994 - DNA, 25 bp, Homo sapien
gaggctggtcagctggcccattaca

SEQ ID NO: 394995 - DNA, 25 bp, Homo sapien
aggctggtcagctggcccattacac

SEQ ID NO: 394996 - DNA, 25 bp, Homo sapien
ggtcagctggcccattacaccaagc

SEQ ID NO: 394997 - DNA, 25 bp, Homo sapien
agctggcccattacaccaagcgcgt

SEQ ID NO: 394998 - DNA, 25 bp, Homo sapien
tggcccattacaccaagcgcgtgac

SEQ ID NO: 394999 - DNA, 25 bp, Homo sapien
cattacaccaagcgcgtgaccatca

SEQ ID NO: 395000 - DNA, 25 bp, Homo sapien
gacatccagatggccgtgcgactgc

SEQ ID NO: 395001 - DNA, 25 bp, Homo sapien
gatgggcaagctcgccgaggcccag

SEQ ID NO: 395002 - DNA, 25 bp, Homo sapien
ttctctatttatcagttttgtaaaa

SEQ ID NO: 395003 - DNA, 25 bp, Homo sapien
aaattcataaaagccaactgactat

SEQ ID NO: 395004 - DNA, 25 bp, Homo sapien
agccaactgactattggctttaaac

SEQ ID NO: 395005 - DNA, 25 bp, Homo sapien
tggctttaaactaccaataatttag

SEQ ID NO: 395006 - DNA, 25 bp, Homo sapien
accaataatttagttgatctctata

SEQ ID NO: 395007 - DNA, 25 bp, Homo sapien
gaaacaactattggccagttaactt

SEQ ID NO: 395008 - DNA, 25 bp, Homo sapien
cagttaactttcatgccgctatttt

SEQ ID NO: 395009 - DNA, 25 bp, Homo sapien
ctttcatgccgctattttcatttcc

SEQ ID NO: 395010 - DNA, 25 bp, Homo sapien
tttcatttcctggtatgcttattgc

SEQ ID NO: 395011 - DNA, 25 bp, Homo sapien
ttcctggtatgcttattgctacttt

SEQ ID NO: 395012 - DNA, 25 bp, Homo sapien
tatgcttattgctactttgtttttg

SEQ ID NO: 395013 - DNA, 25 bp, Homo sapien
ggtactgtcatgtgaagccttgcct

SEQ ID NO: 395014 - DNA, 25 bp, Homo sapien
gtgaagccttgcctagtagttctct

SEQ ID NO: 395015 - DNA, 25 bp, Homo sapien
agtagttctctccagggcaaatgaa

SEQ ID NO: 395016 - DNA, 25 bp, Homo sapien
aatgaagctcacagttttgcaaggt

SEQ ID NO: 395017 - DNA, 25 bp, Homo sapien
aaacctcttattcacatttgctttg

SEQ ID NO: 395018 - DNA, 25 bp, Homo sapien
tttgctttgattccccgatggagta

SEQ ID NO: 395019 - DNA, 25 bp, Homo sapien
attccccgatggagtagactgcctt

SEQ ID NO: 395020 - DNA, 25 bp, Homo sapien
gtagactgcctttgttccatacagg

SEQ ID NO: 395021 - DNA, 25 bp, Homo sapien
atatcatcctacttcttattagcat

SEQ ID NO: 395022 - DNA, 25 bp, Homo sapien
tgtatgtctcctgaaacatccaaat

SEQ ID NO: 395023 - DNA, 25 bp, Homo sapien
gaacactttatgtacaatctggaaa

SEQ ID NO: 395024 - DNA, 25 bp, Homo sapien
gcatcaaagtgatcagaaaagctga

SEQ ID NO: 395025 - DNA, 25 bp, Homo sapien
gaaaagctgagaaacttggtaaggg

SEQ ID NO: 395026 - DNA, 25 bp, Homo sapien
gaaatatcaccgtgacatcccaggt

SEQ ID NO: 395027 - DNA, 25 bp, Homo sapien
aaatatcaccgtgacatcccaggtg

SEQ ID NO: 395028 - DNA, 25 bp, Homo sapien
taatctatgtgattggttgcacgta

SEQ ID NO: 395029 - DNA, 25 bp, Homo sapien
atgtgattggttgcacgtagttgct

SEQ ID NO: 395030 - DNA, 25 bp, Homo sapien
gattggttgcacgtagttgctaaga

SEQ ID NO: 395031 - DNA, 25 bp, Homo sapien
tgcacgtagttgctaagagagttat

SEQ ID NO: 395032 - DNA, 25 bp, Homo sapien
gagttatgaattccgttacttccaa

SEQ ID NO: 395033 - DNA, 25 bp, Homo sapien
tatgaattccgttacttccaaatta

SEQ ID NO: 395034 - DNA, 25 bp, Homo sapien
ccaccccataaaagatggaatcatg

SEQ ID NO: 395035 - DNA, 25 bp, Homo sapien
gggccagcttccaacacaagcacgg

SEQ ID NO: 395036 - DNA, 25 bp, Homo sapien
ttccaacacaagcacgggtaggtcc

SEQ ID NO: 395037 - DNA, 25 bp, Homo sapien
aagcacgggtaggtccctctgcaga

SEQ ID NO: 395038 - DNA, 25 bp, Homo sapien
cctctgcagaccatgggctgcaaga

SEQ ID NO: 395039 - DNA, 25 bp, Homo sapien
catgggctgcaagaggcccggcctt

SEQ ID NO: 395040 - DNA, 25 bp, Homo sapien
gcacgaagcaggtgggtgtccacca

SEQ ID NO: 395041 - DNA, 25 bp, Homo sapien
ggtgtccaccaatctagtatccaaa

SEQ ID NO: 395042 - DNA, 25 bp, Homo sapien
tctagtatccaaaaccctgcttggt

SEQ ID NO: 395043 - DNA, 25 bp, Homo sapien
tggttctcactcctctgaacacttc

SEQ ID NO: 395044 - DNA, 25 bp, Homo sapien
aacacttccagcctggctaatagcc

SEQ ID NO: 395045 - DNA, 25 bp, Homo sapien
agcctggctaatagcccactgcatc

SEQ ID NO: 395046 - DNA, 25 bp, Homo sapien
tcttcccactgcaaactggaagccc

SEQ ID NO: 395047 - DNA, 25 bp, Homo sapien
cttcccactgcaaactggaagcccc

SEQ ID NO: 395048 - DNA, 25 bp, Homo sapien
ctgcccacctatacccactacctgc

SEQ ID NO: 395049 - DNA, 25 bp, Homo sapien
tgcccacctatacccactacctgcc

SEQ ID NO: 395050 - DNA, 25 bp, Homo sapien
gcccacctatacccactacctgccc

SEQ ID NO: 395051 - DNA, 25 bp, Homo sapien
cacctatacccactacctgccccct

SEQ ID NO: 395052 - DNA, 25 bp, Homo sapien
acctatacccactacctgccccctg

SEQ ID NO: 395053 - DNA, 25 bp, Homo sapien
cctatacccactacctgccccctgg

SEQ ID NO: 395054 - DNA, 25 bp, Homo sapien
agtcagcaaatctatatccaaggtc

SEQ ID NO: 395055 - DNA, 25 bp, Homo sapien
atccaaggtcaatccgcttcaaggg

SEQ ID NO: 395056 - DNA, 25 bp, Homo sapien
gccaaagtccttcctgcacatgctg

SEQ ID NO: 395057 - DNA, 25 bp, Homo sapien
gggatagcatctccagaaccccata

SEQ ID NO: 395058 - DNA, 25 bp, Homo sapien
ctccagaaccccataactaacaatt

SEQ ID NO: 395059 - DNA, 25 bp, Homo sapien
catttttaactgaaacgggcactgc

SEQ ID NO: 395060 - DNA, 25 bp, Homo sapien
aagcttgctgaaaatcacggacatg

SEQ ID NO: 395061 - DNA, 25 bp, Homo sapien
aatcacggacatgaggccggttgat

SEQ ID NO: 395062 - DNA, 25 bp, Homo sapien
gaggccggttgatttagcacataga

SEQ ID NO: 395063 - DNA, 25 bp, Homo sapien
tagcacatagacacgggagacttca

SEQ ID NO: 395064 - DNA, 25 bp, Homo sapien
gacttcaaaatgaggacccacccac

SEQ ID NO: 395065 - DNA, 25 bp, Homo sapien
tcctttagtcaaaaagctaccctca

SEQ ID NO: 395066 - DNA, 25 bp, Homo sapien
ctttagtcaaaaagctaccctcatt

SEQ ID NO: 395067 - DNA, 25 bp, Homo sapien
gccttataagtgtggtgactgtggg

SEQ ID NO: 395068 - DNA, 25 bp, Homo sapien
aagctccatccttattcaacaccgg

SEQ ID NO: 395069 - DNA, 25 bp, Homo sapien
agctccatccttattcaacaccgga

SEQ ID NO: 395070 - DNA, 25 bp, Homo sapien
ctccatccttattcaacaccggaga

SEQ ID NO: 395071 - DNA, 25 bp, Homo sapien
catccttattcaacaccggagaatt

SEQ ID NO: 395072 - DNA, 25 bp, Homo sapien
gtgtggccagtgtggaaagtccttt

SEQ ID NO: 395073 - DNA, 25 bp, Homo sapien
aagtctggtctcattcaacaccaag

SEQ ID NO: 395074 - DNA, 25 bp, Homo sapien
caacaaatgtgggaattcctttagc

SEQ ID NO: 395075 - DNA, 25 bp, Homo sapien
aaatgtgggaattcctttagccaat

SEQ ID NO: 395076 - DNA, 25 bp, Homo sapien
atcgttctcttttgctgacctaaaa

SEQ ID NO: 395077 - DNA, 25 bp, Homo sapien
aacttcactgatgaggttgtcctca

SEQ ID NO: 395078 - DNA, 25 bp, Homo sapien
gttataatctatttcctaagctggc

SEQ ID NO: 395079 - DNA, 25 bp, Homo sapien
atttcctaagctggcaatgtgttca

SEQ ID NO: 395080 - DNA, 25 bp, Homo sapien
gctggcaatgtgttcattctatttt

SEQ ID NO: 395081 - DNA, 25 bp, Homo sapien
aaatatcttagtttgtacatgtaaa

SEQ ID NO: 395082 - DNA, 25 bp, Homo sapien
gttgtcctcactgggaattacccga

SEQ ID NO: 395083 - DNA, 25 bp, Homo sapien
aaatgagtattttctgatggtgtaa

SEQ ID NO: 395084 - DNA, 25 bp, Homo sapien
gatggtgtaattgtagctgtcctag

SEQ ID NO: 395085 - DNA, 25 bp, Homo sapien
gtagctgtcctaggatgatggtcag

SEQ ID NO: 395086 - DNA, 25 bp, Homo sapien
tgatggtcagatcgttctcttttgc

SEQ ID NO: 395087 - DNA, 25 bp, Homo sapien
cagggcattagcaatgggttatcct

SEQ ID NO: 395088 - DNA, 25 bp, Homo sapien
ggcattagcaatgggttatcctggt

SEQ ID NO: 395089 - DNA, 25 bp, Homo sapien
attagcaatgggttatcctggtatc

SEQ ID NO: 395090 - DNA, 25 bp, Homo sapien
tagcaatgggttatcctggtatcag

SEQ ID NO: 395091 - DNA, 25 bp, Homo sapien
agcaatgggttatcctggtatcagc

SEQ ID NO: 395092 - DNA, 25 bp, Homo sapien
gcaatgggttatcctggtatcagca

SEQ ID NO: 395093 - DNA, 25 bp, Homo sapien
aatgggttatcctggtatcagcaga

SEQ ID NO: 395094 - DNA, 25 bp, Homo sapien
agaaaccagggcaagcccctacgct

SEQ ID NO: 395095 - DNA, 25 bp, Homo sapien
agggcaagcccctacgctcctgatc

SEQ ID NO: 395096 - DNA, 25 bp, Homo sapien
ccagtttgcagtcgggggtcccatc

SEQ ID NO: 395097 - DNA, 25 bp, Homo sapien
tgcagtcgggggtcccatctcggtt

SEQ ID NO: 395098 - DNA, 25 bp, Homo sapien
caccccacaaggctaagaagcatat

SEQ ID NO: 395099 - DNA, 25 bp, Homo sapien
aagaagcatatctgcatgtggcctt

SEQ ID NO: 395100 - DNA, 25 bp, Homo sapien
catatctgcatgtggccttcccagt

SEQ ID NO: 395101 - DNA, 25 bp, Homo sapien
catacacgcagatgtgttcacttat

SEQ ID NO: 395102 - DNA, 25 bp, Homo sapien
aagaactgcatgtttagatttgccc

SEQ ID NO: 395103 - DNA, 25 bp, Homo sapien
atcgctgagctctgtactcagacaa

SEQ ID NO: 395104 - DNA, 25 bp, Homo sapien
agtgaactgagtcgagaccgtttgt

SEQ ID NO: 395105 - DNA, 25 bp, Homo sapien
gttcacttatgtatttggctttcaa

SEQ ID NO: 395106 - DNA, 25 bp, Homo sapien
aagatgcatatgatgtcctaagggc

SEQ ID NO: 395107 - DNA, 25 bp, Homo sapien
cctaagggcagtttcagcagaagta

SEQ ID NO: 395108 - DNA, 25 bp, Homo sapien
cagcagaagtagctacagccatagt

SEQ ID NO: 395109 - DNA, 25 bp, Homo sapien
tgattgatgaccagggcatgcccaa

SEQ ID NO: 395110 - DNA, 25 bp, Homo sapien
agggcatgcccaagaactgtctcct

SEQ ID NO: 395111 - DNA, 25 bp, Homo sapien
atgcccaagaactgtctcctgattc

SEQ ID NO: 395112 - DNA, 25 bp, Homo sapien
caagaactgtctcctgattcttatt

SEQ ID NO: 395113 - DNA, 25 bp, Homo sapien
catctgggaagtgttgagtgcaata

SEQ ID NO: 395114 - DNA, 25 bp, Homo sapien
gggatcccagaaagctgctcactat

SEQ ID NO: 395115 - DNA, 25 bp, Homo sapien
gaaagctgctcactatacattgggt

SEQ ID NO: 395116 - DNA, 25 bp, Homo sapien
aagctgctcactatacattgggtgc

SEQ ID NO: 395117 - DNA, 25 bp, Homo sapien
gtgctcctccacgttatgaattttt

SEQ ID NO: 395118 - DNA, 25 bp, Homo sapien
aagagcccattcagaggccagcaag

SEQ ID NO: 395119 - DNA, 25 bp, Homo sapien
ggccagcaagagaagtcttagagtt

SEQ ID NO: 395120 - DNA, 25 bp, Homo sapien
gggaagtatttaattgcccatgata

SEQ ID NO: 395121 - DNA, 25 bp, Homo sapien
tatttaattgcccatgatatgtatt

SEQ ID NO: 395122 - DNA, 25 bp, Homo sapien
attttacttatactatgccagagag

SEQ ID NO: 395123 - DNA, 25 bp, Homo sapien
ttacttatactatgccagagaggaa

SEQ ID NO: 395124 - DNA, 25 bp, Homo sapien
tactatgccagagaggaaactataa

SEQ ID NO: 395125 - DNA, 25 bp, Homo sapien
ttacacatgtaatcttgggtttttc

SEQ ID NO: 395126 - DNA, 25 bp, Homo sapien
cacatgtaatcttgggtttttcaca

SEQ ID NO: 395127 - DNA, 25 bp, Homo sapien
tgtaatcttgggtttttcacatatg

SEQ ID NO: 395128 - DNA, 25 bp, Homo sapien
gtttttcacatatgtaggtattcat

SEQ ID NO: 395129 - DNA, 25 bp, Homo sapien
aattcctgatgggatagtatcaata

SEQ ID NO: 395130 - DNA, 25 bp, Homo sapien
taagtatttaaaagccagtattcta

SEQ ID NO: 395131 - DNA, 25 bp, Homo sapien
tttagacaaagctataccctcgttg

SEQ ID NO: 395132 - DNA, 25 bp, Homo sapien
caaagctataccctcgttgaacacc

SEQ ID NO: 395133 - DNA, 25 bp, Homo sapien
gattaaggccttacgactgtggaca

SEQ ID NO: 395134 - DNA, 25 bp, Homo sapien
gactgtggacagtgcgggaaatcct

SEQ ID NO: 395135 - DNA, 25 bp, Homo sapien
ggaaatcctttatccaaaagtctag

SEQ ID NO: 395136 - DNA, 25 bp, Homo sapien
tatccaaaagtctagcctcattcaa

SEQ ID NO: 395137 - DNA, 25 bp, Homo sapien
gggaagtcctttacacaacactctg

SEQ ID NO: 395138 - DNA, 25 bp, Homo sapien
tttacacaacactctggcctcattc

SEQ ID NO: 395139 - DNA, 25 bp, Homo sapien
tggcctcattctccaccgaaaatct

SEQ ID NO: 395140 - DNA, 25 bp, Homo sapien
tctccaccgaaaatctcacactgtg

SEQ ID NO: 395141 - DNA, 25 bp, Homo sapien
agaggcctcgtgacagcagcaaatg

SEQ ID NO: 395142 - DNA, 25 bp, Homo sapien
ttttctctcttacgtctaactgact

SEQ ID NO: 395143 - DNA, 25 bp, Homo sapien
ctctcttacgtctaactgactaggg

SEQ ID NO: 395144 - DNA, 25 bp, Homo sapien
tacgtctaactgactagggaacaat

SEQ ID NO: 395145 - DNA, 25 bp, Homo sapien
gaacaattgttgatatgcatagcat

SEQ ID NO: 395146 - DNA, 25 bp, Homo sapien
gcatagcattggaatacttgtcatt

SEQ ID NO: 395147 - DNA, 25 bp, Homo sapien
aatacttgtcattatatactcttac

SEQ ID NO: 395148 - DNA, 25 bp, Homo sapien
tatactcttacaaataacacatgaa

SEQ ID NO: 395149 - DNA, 25 bp, Homo sapien
gaagcaagaatgaccaatattctga

SEQ ID NO: 395150 - DNA, 25 bp, Homo sapien
ctgataattggcactggatcacaaa

SEQ ID NO: 395151 - DNA, 25 bp, Homo sapien
attggcactggatcacaaaatgtga

SEQ ID NO: 395152 - DNA, 25 bp, Homo sapien
atgtatttctttagaggcattactt

SEQ ID NO: 395153 - DNA, 25 bp, Homo sapien
attgcataggagtacccaaatctga

SEQ ID NO: 395154 - DNA, 25 bp, Homo sapien
ttgcataggagtacccaaatctgaa

SEQ ID NO: 395155 - DNA, 25 bp, Homo sapien
taagaagtgagttgctctgacagac

SEQ ID NO: 395156 - DNA, 25 bp, Homo sapien
agaagtgagttgctctgacagacaa

SEQ ID NO: 395157 - DNA, 25 bp, Homo sapien
agtgagttgctctgacagacaacac

SEQ ID NO: 395158 - DNA, 25 bp, Homo sapien
tggcatcacctgcatggaggatctg

SEQ ID NO: 395159 - DNA, 25 bp, Homo sapien
catcacctgcatggaggatctgatc

SEQ ID NO: 395160 - DNA, 25 bp, Homo sapien
tcacctgcatggaggatctgatcat

SEQ ID NO: 395161 - DNA, 25 bp, Homo sapien
acctgcatggaggatctgatcatga

SEQ ID NO: 395162 - DNA, 25 bp, Homo sapien
aaattatcttctgcattaagtggaa

SEQ ID NO: 395163 - DNA, 25 bp, Homo sapien
tatcttctgcattaagtggaatgaa

SEQ ID NO: 395164 - DNA, 25 bp, Homo sapien
taccaggcagaacacgggcccgact

SEQ ID NO: 395165 - DNA, 25 bp, Homo sapien
tgagtgcagatggacggcggcagct

SEQ ID NO: 395166 - DNA, 25 bp, Homo sapien
ggctcggaagcatctgcacaacttt

SEQ ID NO: 395167 - DNA, 25 bp, Homo sapien
tgcacaactttgaggccactcactg

SEQ ID NO: 395168 - DNA, 25 bp, Homo sapien
cagatgccctggcacctctagggac

SEQ ID NO: 395169 - DNA, 25 bp, Homo sapien
ctggcacctctagggaccaactggg

SEQ ID NO: 395170 - DNA, 25 bp, Homo sapien
ggaccaactgggactcattatggaa

SEQ ID NO: 395171 - DNA, 25 bp, Homo sapien
ggagacatgaggaaagaccctctta

SEQ ID NO: 395172 - DNA, 25 bp, Homo sapien
gaccctcttatttgtgattctctgt

SEQ ID NO: 395173 - DNA, 25 bp, Homo sapien
tgattctctgtgttcatgttgctgt

SEQ ID NO: 395174 - DNA, 25 bp, Homo sapien
ctctgtgttcatgttgctgtttata

SEQ ID NO: 395175 - DNA, 25 bp, Homo sapien
gggagtcttcagtggtctgactatc

SEQ ID NO: 395176 - DNA, 25 bp, Homo sapien
gtctgactatcctgatttcctacat

SEQ ID NO: 395177 - DNA, 25 bp, Homo sapien
ttcctacatttacatcctcatggcc

SEQ ID NO: 395178 - DNA, 25 bp, Homo sapien
atccgctctgctgatgggaggtgca

SEQ ID NO: 395179 - DNA, 25 bp, Homo sapien
caaaaccttttctacttgctcttct

SEQ ID NO: 395180 - DNA, 25 bp, Homo sapien
tcacctgacagctgttttcatcttg

SEQ ID NO: 395181 - DNA, 25 bp, Homo sapien
tatggtacccttttctttatttatg

SEQ ID NO: 395182 - DNA, 25 bp, Homo sapien
atttatgtacatcccagtgcaacct

SEQ ID NO: 395183 - DNA, 25 bp, Homo sapien
ttctccctggatctcaataaagtag

SEQ ID NO: 395184 - DNA, 25 bp, Homo sapien
gtgttttacacagcagtgattccta

SEQ ID NO: 395185 - DNA, 25 bp, Homo sapien
gtgattcctatgttgaacccactta

SEQ ID NO: 395186 - DNA, 25 bp, Homo sapien
tagaggccacggtgcagcgtgaggc

SEQ ID NO: 395187 - DNA, 25 bp, Homo sapien
gcgtgaggccctgttcatgaagagt

SEQ ID NO: 395188 - DNA, 25 bp, Homo sapien
gaggccctgttcatgaagagtgagc

SEQ ID NO: 395189 - DNA, 25 bp, Homo sapien
gttcatgaagagtgagcgacacgca

SEQ ID NO: 395190 - DNA, 25 bp, Homo sapien
aagctgccagggaccactccagcgt

SEQ ID NO: 395191 - DNA, 25 bp, Homo sapien
cagcgtggtggctttgtacagaagc

SEQ ID NO: 395192 - DNA, 25 bp, Homo sapien
ttgtacagaagccacctcctatatg

SEQ ID NO: 395193 - DNA, 25 bp, Homo sapien
ctcctatatgccattcagggccaga

SEQ ID NO: 395194 - DNA, 25 bp, Homo sapien
atatgccattcagggccagatggat

SEQ ID NO: 395195 - DNA, 25 bp, Homo sapien
gatgaagatgtgcagcggattctca

SEQ ID NO: 395196 - DNA, 25 bp, Homo sapien
atgtgcagcggattctcagccagat

SEQ ID NO: 395197 - DNA, 25 bp, Homo sapien
atgtgcccatattttcagaacatgc

SEQ ID NO: 395198 - DNA, 25 bp, Homo sapien
gaatgtctacctgtaagcataaatc

SEQ ID NO: 395199 - DNA, 25 bp, Homo sapien
aagcataaatctttgaggcagttta

SEQ ID NO: 395200 - DNA, 25 bp, Homo sapien
gcaatttatacaagaagctgtccat

SEQ ID NO: 395201 - DNA, 25 bp, Homo sapien
caagaagctgtccataactgattat

SEQ ID NO: 395202 - DNA, 25 bp, Homo sapien
aactgattatgcttatgtacttact

SEQ ID NO: 395203 - DNA, 25 bp, Homo sapien
gcttatgtacttacttacacatttt

SEQ ID NO: 395204 - DNA, 25 bp, Homo sapien
ttttaactttatgaccagcctaaat

SEQ ID NO: 395205 - DNA, 25 bp, Homo sapien
gtaccattacatgtttcagtgcagc

SEQ ID NO: 395206 - DNA, 25 bp, Homo sapien
ttcagtgcagcatggttactaacgc

SEQ ID NO: 395207 - DNA, 25 bp, Homo sapien
ggttactaacgctatgtcagactaa

SEQ ID NO: 395208 - DNA, 25 bp, Homo sapien
aaaggcaggacgcaccataaagtgt

SEQ ID NO: 395209 - DNA, 25 bp, Homo sapien
aggcaggacgcaccataaagtgtac

SEQ ID NO: 395210 - DNA, 25 bp, Homo sapien
gcaggacgcaccataaagtgtacaa

SEQ ID NO: 395211 - DNA, 25 bp, Homo sapien
acgcaccataaagtgtacaatgcct

SEQ ID NO: 395212 - DNA, 25 bp, Homo sapien
gtgtacaatgcctatggttcacctt

SEQ ID NO: 395213 - DNA, 25 bp, Homo sapien
gtacaatgcctatggttcaccttga

SEQ ID NO: 395214 - DNA, 25 bp, Homo sapien
acaatgcctatggttcaccttgaga

SEQ ID NO: 395215 - DNA, 25 bp, Homo sapien
caatgcctatggttcaccttgagaa

SEQ ID NO: 395216 - DNA, 25 bp, Homo sapien
atgcctatggttcaccttgagaaac

SEQ ID NO: 395217 - DNA, 25 bp, Homo sapien
tgcctatggttcaccttgagaaacc

SEQ ID NO: 395218 - DNA, 25 bp, Homo sapien
cctatggttcaccttgagaaaccac

SEQ ID NO: 395219 - DNA, 25 bp, Homo sapien
tagaaagtccagcatgtagaagaat

SEQ ID NO: 395220 - DNA, 25 bp, Homo sapien
gaaaatttgactagtttattgaaca

SEQ ID NO: 395221 - DNA, 25 bp, Homo sapien
gattgaatcactattatattccagg

SEQ ID NO: 395222 - DNA, 25 bp, Homo sapien
tattccaggtattttactaggacct

SEQ ID NO: 395223 - DNA, 25 bp, Homo sapien
tactaggacctttaatatacactgt

SEQ ID NO: 395224 - DNA, 25 bp, Homo sapien
tatacactgtcccatgtaaggtaat

SEQ ID NO: 395225 - DNA, 25 bp, Homo sapien
gtcccatgtaaggtaataagtactg

SEQ ID NO: 395226 - DNA, 25 bp, Homo sapien
agaatttattagatatagcctcata

SEQ ID NO: 395227 - DNA, 25 bp, Homo sapien
gatatagcctcataaattccttaga

SEQ ID NO: 395228 - DNA, 25 bp, Homo sapien
ttccttagatatataacatttccaa

SEQ ID NO: 395229 - DNA, 25 bp, Homo sapien
acatttccaaattctttgtccttga

SEQ ID NO: 395230 - DNA, 25 bp, Homo sapien
tactaaatcatttatgtccatttct

SEQ ID NO: 395231 - DNA, 25 bp, Homo sapien
actaaatcatttatgtccatttctc

SEQ ID NO: 395232 - DNA, 25 bp, Homo sapien
ctaaatcatttatgtccatttctca

SEQ ID NO: 395233 - DNA, 25 bp, Homo sapien
tatgctagtgtttagttggattaat

SEQ ID NO: 395234 - DNA, 25 bp, Homo sapien
atgctagtgtttagttggattaatc

SEQ ID NO: 395235 - DNA, 25 bp, Homo sapien
tgctagtgtttagttggattaatct

SEQ ID NO: 395236 - DNA, 25 bp, Homo sapien
tactgaaaaatgctttttagtactt

SEQ ID NO: 395237 - DNA, 25 bp, Homo sapien
tacatttattttccgaatgtatcat

SEQ ID NO: 395238 - DNA, 25 bp, Homo sapien
catttattttccgaatgtatcattg

SEQ ID NO: 395239 - DNA, 25 bp, Homo sapien
atttattttccgaatgtatcattga

SEQ ID NO: 395240 - DNA, 25 bp, Homo sapien
tttattttccgaatgtatcattgaa

SEQ ID NO: 395241 - DNA, 25 bp, Homo sapien
tttgcagtagcgctgctgggcggtg

SEQ ID NO: 395242 - DNA, 25 bp, Homo sapien
gcagtagcgctgctgggcggtggtc

SEQ ID NO: 395243 - DNA, 25 bp, Homo sapien
gcggtggtcccctcactgggatcct

SEQ ID NO: 395244 - DNA, 25 bp, Homo sapien
cggtggtcccctcactgggatcctg

SEQ ID NO: 395245 - DNA, 25 bp, Homo sapien
ggtggtcccctcactgggatcctgt

SEQ ID NO: 395246 - DNA, 25 bp, Homo sapien
gtggtcccctcactgggatcctgta

SEQ ID NO: 395247 - DNA, 25 bp, Homo sapien
tggtcccctcactgggatcctgtac

SEQ ID NO: 395248 - DNA, 25 bp, Homo sapien
tccttattttatggtacatgcttag

SEQ ID NO: 395249 - DNA, 25 bp, Homo sapien
ccttattttatggtacatgcttagg

SEQ ID NO: 395250 - DNA, 25 bp, Homo sapien
cttattttatggtacatgcttaggg

SEQ ID NO: 395251 - DNA, 25 bp, Homo sapien
attttatggtacatgcttaggggtg

SEQ ID NO: 395252 - DNA, 25 bp, Homo sapien
aacaacctgtcctgttttgtcagtt

SEQ ID NO: 395253 - DNA, 25 bp, Homo sapien
tgtcctgttttgtcagttcccagct

SEQ ID NO: 395254 - DNA, 25 bp, Homo sapien
tcagttcccagcttcttcgtttaga

SEQ ID NO: 395255 - DNA, 25 bp, Homo sapien
gaaacgtgcttgtctctgtataccc

SEQ ID NO: 395256 - DNA, 25 bp, Homo sapien
ttgtctctgtatacccgcagaatga

SEQ ID NO: 395257 - DNA, 25 bp, Homo sapien
tttcattttactaggttccgaagag

SEQ ID NO: 395258 - DNA, 25 bp, Homo sapien
ctaggttccgaagagtccagatgct

SEQ ID NO: 395259 - DNA, 25 bp, Homo sapien
agtccagatgcttggtagatgttca

SEQ ID NO: 395260 - DNA, 25 bp, Homo sapien
gcttggtagatgttcaatacgtgat

SEQ ID NO: 395261 - DNA, 25 bp, Homo sapien
atgtgttcatttaaaatcctcctta

SEQ ID NO: 395262 - DNA, 25 bp, Homo sapien
aatcctccttaacatttctagaaag

SEQ ID NO: 395263 - DNA, 25 bp, Homo sapien
ccggagacaatggcagatgagagtc

SEQ ID NO: 395264 - DNA, 25 bp, Homo sapien
gctgcagcttccaaactagtgccat

SEQ ID NO: 395265 - DNA, 25 bp, Homo sapien
ctgcagcttccaaactagtgccatt

SEQ ID NO: 395266 - DNA, 25 bp, Homo sapien
tgcagcttccaaactagtgccattt

SEQ ID NO: 395267 - DNA, 25 bp, Homo sapien
catttcaagggacatagacatggca

SEQ ID NO: 395268 - DNA, 25 bp, Homo sapien
atttcaagggacatagacatggcag

SEQ ID NO: 395269 - DNA, 25 bp, Homo sapien
tttcaagggacatagacatggcagc

SEQ ID NO: 395270 - DNA, 25 bp, Homo sapien
ttcaagggacatagacatggcagcc

SEQ ID NO: 395271 - DNA, 25 bp, Homo sapien
tcaagggacatagacatggcagcca

SEQ ID NO: 395272 - DNA, 25 bp, Homo sapien
caagggacatagacatggcagccaa

SEQ ID NO: 395273 - DNA, 25 bp, Homo sapien
acatggcagccaaattcattggggc

SEQ ID NO: 395274 - DNA, 25 bp, Homo sapien
attcttgtcaaatttcactcaaaag

SEQ ID NO: 395275 - DNA, 25 bp, Homo sapien
ggaacatgaggtatatatctttgcc

SEQ ID NO: 395276 - DNA, 25 bp, Homo sapien
gaggtatatatctttgcctttataa

SEQ ID NO: 395277 - DNA, 25 bp, Homo sapien
ctgaaaacctatctttattagagga

SEQ ID NO: 395278 - DNA, 25 bp, Homo sapien
agaggaaaatctcaatcttcagttt

SEQ ID NO: 395279 - DNA, 25 bp, Homo sapien
atctcaatcttcagttttggccttc

SEQ ID NO: 395280 - DNA, 25 bp, Homo sapien
aatcttcagttttggccttctgtca

SEQ ID NO: 395281 - DNA, 25 bp, Homo sapien
agttttggccttctgtcaccagaat

SEQ ID NO: 395282 - DNA, 25 bp, Homo sapien
tggccttctgtcaccagaatgataa

SEQ ID NO: 395283 - DNA, 25 bp, Homo sapien
cagaatgataagtgcaatagttgta

SEQ ID NO: 395284 - DNA, 25 bp, Homo sapien
agttgtaaatctacttgacactgta

SEQ ID NO: 395285 - DNA, 25 bp, Homo sapien
ggctcttccacttcatacaaccctc

SEQ ID NO: 395286 - DNA, 25 bp, Homo sapien
cacttcatacaaccctccccttgct

SEQ ID NO: 395287 - DNA, 25 bp, Homo sapien
tcttcccactgcaaactggaagccc

SEQ ID NO: 395288 - DNA, 25 bp, Homo sapien
tcaccgtgcttccttcctcagagtg

SEQ ID NO: 395289 - DNA, 25 bp, Homo sapien
caccgtgcttccttcctcagagtga

SEQ ID NO: 395290 - DNA, 25 bp, Homo sapien
accgtgcttccttcctcagagtgac

SEQ ID NO: 395291 - DNA, 25 bp, Homo sapien
ctcagagtgaccctaggcttcaggg

SEQ ID NO: 395292 - DNA, 25 bp, Homo sapien
aggcttcagggggaacttctgccca

SEQ ID NO: 395293 - DNA, 25 bp, Homo sapien
ttcagggggaacttctgcccaccta

SEQ ID NO: 395294 - DNA, 25 bp, Homo sapien
cagggggaacttctgcccacctata

SEQ ID NO: 395295 - DNA, 25 bp, Homo sapien
aacttctgcccacctatacccacta

SEQ ID NO: 395296 - DNA, 25 bp, Homo sapien
attgcataggagtacccaaatctga

SEQ ID NO: 395297 - DNA, 25 bp, Homo sapien
ttgcataggagtacccaaatctgaa

SEQ ID NO: 395298 - DNA, 25 bp, Homo sapien
aagaagtgagttgctctgacagaca

SEQ ID NO: 395299 - DNA, 25 bp, Homo sapien
agtgagttgctctgacagacaacac

SEQ ID NO: 395300 - DNA, 25 bp, Homo sapien
gacaacactttgattgctcgacctc

SEQ ID NO: 395301 - DNA, 25 bp, Homo sapien
tggcatcacctgcatggaggatctg

SEQ ID NO: 395302 - DNA, 25 bp, Homo sapien
atcacctgcatggaggatctgatca

SEQ ID NO: 395303 - DNA, 25 bp, Homo sapien
acctgcatggaggatctgatcatga

SEQ ID NO: 395304 - DNA, 25 bp, Homo sapien
ggcccttcaaattatcttctgcatt

SEQ ID NO: 395305 - DNA, 25 bp, Homo sapien
aaattatcttctgcattaagtggaa

SEQ ID NO: 395306 - DNA, 25 bp, Homo sapien
tatcttctgcattaagtggaatgaa

SEQ ID NO: 395307 - DNA, 25 bp, Homo sapien
atagacatccacttgggaggtgctc

SEQ ID NO: 395308 - DNA, 25 bp, Homo sapien
gcttcaagacagaatccctgtgact

SEQ ID NO: 395309 - DNA, 25 bp, Homo sapien
gacagaatccctgtgactaaccctg

SEQ ID NO: 395310 - DNA, 25 bp, Homo sapien
agaatccctgtgactaaccctgggc

SEQ ID NO: 395311 - DNA, 25 bp, Homo sapien
tgggccccgagaagcagccttgcca

SEQ ID NO: 395312 - DNA, 25 bp, Homo sapien
atccacttgggaggtgctcagcctg

SEQ ID NO: 395313 - DNA, 25 bp, Homo sapien
ttgggaggtgctcagcctgcccttt

SEQ ID NO: 395314 - DNA, 25 bp, Homo sapien
agccttcccgggaggactgagccct

SEQ ID NO: 395315 - DNA, 25 bp, Homo sapien
aggactgagccctgtgagctagaac

SEQ ID NO: 395316 - DNA, 25 bp, Homo sapien
actgagccctgtgagctagaaccca

SEQ ID NO: 395317 - DNA, 25 bp, Homo sapien
agccctgtgagctagaacccaggac

SEQ ID NO: 395318 - DNA, 25 bp, Homo sapien
cagggaatgtccctaactgcgtctt

SEQ ID NO: 395319 - DNA, 25 bp, Homo sapien
agcacgctgtattctgcaggaccgc

SEQ ID NO: 395320 - DNA, 25 bp, Homo sapien
gctgtattctgcaggaccgcctcct

SEQ ID NO: 395321 - DNA, 25 bp, Homo sapien
taacaacaaccacagtgttgctgaa

SEQ ID NO: 395322 - DNA, 25 bp, Homo sapien
acagtgttgctgaaattggagaaaa

SEQ ID NO: 395323 - DNA, 25 bp, Homo sapien
gggaagcatgtggtaccgcctcagc

SEQ ID NO: 395324 - DNA, 25 bp, Homo sapien
aagcatgtggtaccgcctcagccag

SEQ ID NO: 395325 - DNA, 25 bp, Homo sapien
atgtggtaccgcctcagccagtgcc

SEQ ID NO: 395326 - DNA, 25 bp, Homo sapien
ggacccctcagcagaaagggacagc

SEQ ID NO: 395327 - DNA, 25 bp, Homo sapien
agggacagcctgtccttagaggact

SEQ ID NO: 395328 - DNA, 25 bp, Homo sapien
cagcctgtccttagaggactggaaa

SEQ ID NO: 395329 - DNA, 25 bp, Homo sapien
gtttctcttggtcaaaaacacactc

SEQ ID NO: 395330 - DNA, 25 bp, Homo sapien
gctgtatggacaagtgtagcaacac

SEQ ID NO: 395331 - DNA, 25 bp, Homo sapien
tatggacaagtgtagcaacacaagt

SEQ ID NO: 395332 - DNA, 25 bp, Homo sapien
gaatggaacccatcccctgttagct

SEQ ID NO: 395333 - DNA, 25 bp, Homo sapien
aatggaacccatcccctgttagctg

SEQ ID NO: 395334 - DNA, 25 bp, Homo sapien
ttggtcaaaaacacactcaagtcgt

SEQ ID NO: 395335 - DNA, 25 bp, Homo sapien
ggtcaaaaacacactcaagtcgtct

SEQ ID NO: 395336 - DNA, 25 bp, Homo sapien
aaaaacacactcaagtcgtctccaa

SEQ ID NO: 395337 - DNA, 25 bp, Homo sapien
aaaacacactcaagtcgtctccaag

SEQ ID NO: 395338 - DNA, 25 bp, Homo sapien
aacacactcaagtcgtctccaagtt

SEQ ID NO: 395339 - DNA, 25 bp, Homo sapien
acacactcaagtcgtctccaagttc

SEQ ID NO: 395340 - DNA, 25 bp, Homo sapien
atccggaacaagcagtcggcgcaag

SEQ ID NO: 395341 - DNA, 25 bp, Homo sapien
agcagtcggcgcaagaaagcaggaa

SEQ ID NO: 395342 - DNA, 25 bp, Homo sapien
agaaggaatatatcgatggcctgga

SEQ ID NO: 395343 - DNA, 25 bp, Homo sapien
gatggcctggagactcggtcctgtt

SEQ ID NO: 395344 - DNA, 25 bp, Homo sapien
agactcggtcctgttgctgtccttt

SEQ ID NO: 395345 - DNA, 25 bp, Homo sapien
ggactttgcgcctgtacgagtgttc

SEQ ID NO: 395346 - DNA, 25 bp, Homo sapien
gcctgtacgagtgttctccagaact

SEQ ID NO: 395347 - DNA, 25 bp, Homo sapien
agaactttgcacaacgatgctgcct

SEQ ID NO: 395348 - DNA, 25 bp, Homo sapien
tcccgcgtggctgctgatgctgtgc

SEQ ID NO: 395349 - DNA, 25 bp, Homo sapien
gaggctgacacaacccgagaagagt

SEQ ID NO: 395350 - DNA, 25 bp, Homo sapien
acaacccgagaagagtctccaggaa

SEQ ID NO: 395351 - DNA, 25 bp, Homo sapien
aaacgtttagatcacctttgaggat

SEQ ID NO: 395352 - DNA, 25 bp, Homo sapien
gctgtctaggcaaacttctggatca

SEQ ID NO: 395353 - DNA, 25 bp, Homo sapien
ggatcaagaatcctgtccagactag

SEQ ID NO: 395354 - DNA, 25 bp, Homo sapien
tccagactagtcttcctgatcttta

SEQ ID NO: 395355 - DNA, 25 bp, Homo sapien
ctgatctttagatgcttatgtgtca

SEQ ID NO: 395356 - DNA, 25 bp, Homo sapien
ttatgtgtcagcacctccaataggc

SEQ ID NO: 395357 - DNA, 25 bp, Homo sapien
agcacctccaataggcaatagtatt

SEQ ID NO: 395358 - DNA, 25 bp, Homo sapien
gctatacactatttcgaattttaat

SEQ ID NO: 395359 - DNA, 25 bp, Homo sapien
agttcaaacctcagctagaattttt

SEQ ID NO: 395360 - DNA, 25 bp, Homo sapien
gtttctcttattcaaattcttaact

SEQ ID NO: 395361 - DNA, 25 bp, Homo sapien
ttaatacggactcactaaagggaat

SEQ ID NO: 395362 - DNA, 25 bp, Homo sapien
aagtcagaccactttgcttgccttg

SEQ ID NO: 395363 - DNA, 25 bp, Homo sapien
tttgcttgccttgttgacagcccaa

SEQ ID NO: 395364 - DNA, 25 bp, Homo sapien
caagacctgattcctaacctccttt

SEQ ID NO: 395365 - DNA, 25 bp, Homo sapien
cctccttttcaatggataaccgctc

SEQ ID NO: 395366 - DNA, 25 bp, Homo sapien
atggataaccgctcctaagacccat

SEQ ID NO: 395367 - DNA, 25 bp, Homo sapien
gacgccccagacattccgtaaaggt

SEQ ID NO: 395368 - DNA, 25 bp, Homo sapien
ggcacagagattagcgagttttcct

SEQ ID NO: 395369 - DNA, 25 bp, Homo sapien
gcgagttttcctgaggttactgata

SEQ ID NO: 395370 - DNA, 25 bp, Homo sapien
aataatacccatcagcctccttcaa

SEQ ID NO: 395371 - DNA, 25 bp, Homo sapien
agcctccttcaaagccacaacaaat

SEQ ID NO: 395372 - DNA, 25 bp, Homo sapien
aaatcaacctgtactccaagtcaga

SEQ ID NO: 395373 - DNA, 25 bp, Homo sapien
ggtggagccttcagctgctccctcg

SEQ ID NO: 395374 - DNA, 25 bp, Homo sapien
gctccctcgttgactgtcagggtga

SEQ ID NO: 395375 - DNA, 25 bp, Homo sapien
gactgtcagggtgagatagtgcccc

SEQ ID NO: 395376 - DNA, 25 bp, Homo sapien
ggagatgaacgccacaaagacccag

SEQ ID NO: 395377 - DNA, 25 bp, Homo sapien
agagtaactgcagttcagctcgagc

SEQ ID NO: 395378 - DNA, 25 bp, Homo sapien
tcagctcgagcctcgggctgcgtgt

SEQ ID NO: 395379 - DNA, 25 bp, Homo sapien
gctgcgtgtgccagcccgggcactt

SEQ ID NO: 395380 - DNA, 25 bp, Homo sapien
gcgtccccgaagaccactgcgagtg

SEQ ID NO: 395381 - DNA, 25 bp, Homo sapien
ccgaagaccactgcgagtgctggca

SEQ ID NO: 395382 - DNA, 25 bp, Homo sapien
agtgctggcaccttgggcgtcccca

SEQ ID NO: 395383 - DNA, 25 bp, Homo sapien
ttgggcgtccccacctggtgagaca

SEQ ID NO: 395384 - DNA, 25 bp, Homo sapien
gcaaaagcagtttcaggctgggtga

SEQ ID NO: 395385 - DNA, 25 bp, Homo sapien
aaagcagtttcaggctgggtgagat

SEQ ID NO: 395386 - DNA, 25 bp, Homo sapien
agatggaccccaccaaggccaagtt

SEQ ID NO: 395387 - DNA, 25 bp, Homo sapien
caaggccaagttccccatgcagcag

SEQ ID NO: 395388 - DNA, 25 bp, Homo sapien
aagttccccatgcagcagtgtatcg

SEQ ID NO: 395389 - DNA, 25 bp, Homo sapien
ttccccatgcagcagtgtatcgacg

SEQ ID NO: 395390 - DNA, 25 bp, Homo sapien
atgcagcagtgtatcgacgccggcc

SEQ ID NO: 395391 - DNA, 25 bp, Homo sapien
agcagtgtatcgacgccggcctccg

SEQ ID NO: 395392 - DNA, 25 bp, Homo sapien
cgggtccccaactctgaggtcagcg

SEQ ID NO: 395393 - DNA, 25 bp, Homo sapien
gaggaggagtgttcagggaccggct

SEQ ID NO: 395394 - DNA, 25 bp, Homo sapien
gatgtcagtgcgtgacccaccccag

SEQ ID NO: 395395 - DNA, 25 bp, Homo sapien
gctttcatttggtcagcactagaac

SEQ ID NO: 395396 - DNA, 25 bp, Homo sapien
gcactagaacagtatcttctgaaga

SEQ ID NO: 395397 - DNA, 25 bp, Homo sapien
agacaaaactgaatgctatagcttt

SEQ ID NO: 395398 - DNA, 25 bp, Homo sapien
ggataaaaagccctgaagtgctcat

SEQ ID NO: 395399 - DNA, 25 bp, Homo sapien
agccctgaagtgctcatcacgaatg

SEQ ID NO: 395400 - DNA, 25 bp, Homo sapien
gtgctcatcacgaatgaaacaccaa

SEQ ID NO: 395401 - DNA, 25 bp, Homo sapien
gaaacaccaaaaccagagactatca

SEQ ID NO: 395402 - DNA, 25 bp, Homo sapien
gagactatcatcataccagagcaat

SEQ ID NO: 395403 - DNA, 25 bp, Homo sapien
attggccaacggaacaaatgtcctc

SEQ ID NO: 395404 - DNA, 25 bp, Homo sapien
aacaaatgtcctcggcttactgatt

SEQ ID NO: 395405 - DNA, 25 bp, Homo sapien
ggcttactgattgacactttattaa

SEQ ID NO: 395406 - DNA, 25 bp, Homo sapien
ggaagggagaacatatctatcctct

SEQ ID NO: 395407 - DNA, 25 bp, Homo sapien
gggagaacatatctatcctctcaga

SEQ ID NO: 395408 - DNA, 25 bp, Homo sapien
gaacatatctatcctctcagaccct

SEQ ID NO: 395409 - DNA, 25 bp, Homo sapien
agcaactcatacttggctaatgata

SEQ ID NO: 395410 - DNA, 25 bp, Homo sapien
catacttggctaatgatatggagca

SEQ ID NO: 395411 - DNA, 25 bp, Homo sapien
taaaatggaaatcccagatccctgg

SEQ ID NO: 395412 - DNA, 25 bp, Homo sapien
tggaaatcccagatccctggtcctg

SEQ ID NO: 395413 - DNA, 25 bp, Homo sapien
tgccgacacgcagctactgagaaga

SEQ ID NO: 395414 - DNA, 25 bp, Homo sapien
gtttcagcactttgtaaatagcaag

SEQ ID NO: 395415 - DNA, 25 bp, Homo sapien
aatagcaagaagctgtacagattct

SEQ ID NO: 395416 - DNA, 25 bp, Homo sapien
gaagctgtacagattctagttaatg

SEQ ID NO: 395417 - DNA, 25 bp, Homo sapien
aagaaaagaacggtgactcatcatt

SEQ ID NO: 395418 - DNA, 25 bp, Homo sapien
cggtgactcatcatttcaagctttt

SEQ ID NO: 395419 - DNA, 25 bp, Homo sapien
gtgactcatcatttcaagcttttca

SEQ ID NO: 395420 - DNA, 25 bp, Homo sapien
gactcatcatttcaagcttttcatt

SEQ ID NO: 395421 - DNA, 25 bp, Homo sapien
atcatttcaagcttttcattctgga

SEQ ID NO: 395422 - DNA, 25 bp, Homo sapien
atttcaagcttttcattctggaagt

SEQ ID NO: 395423 - DNA, 25 bp, Homo sapien
caagcttttcattctggaagttgga

SEQ ID NO: 395424 - DNA, 25 bp, Homo sapien
tgccagcatcatcagatttgatatc

SEQ ID NO: 395425 - DNA, 25 bp, Homo sapien
gccagcatcatcagatttgatatca

SEQ ID NO: 395426 - DNA, 25 bp, Homo sapien
gttgctctgaagactaaagccctgg

SEQ ID NO: 395427 - DNA, 25 bp, Homo sapien
ctctgaagactaaagccctgggatc

SEQ ID NO: 395428 - DNA, 25 bp, Homo sapien
tgaacttcaagttggctcaggacat

SEQ ID NO: 395429 - DNA, 25 bp, Homo sapien
acttcaagttggctcaggacatcgt

SEQ ID NO: 395430 - DNA, 25 bp, Homo sapien
tcaagttggctcaggacatcgtgat

SEQ ID NO: 395431 - DNA, 25 bp, Homo sapien
aagttggctcaggacatcgtgatca

SEQ ID NO: 395432 - DNA, 25 bp, Homo sapien
gttggctcaggacatcgtgatcacc

SEQ ID NO: 395433 - DNA, 25 bp, Homo sapien
tggctcaggacatcgtgatcaccac

SEQ ID NO: 395434 - DNA, 25 bp, Homo sapien
aggacatcgtgatcaccacctacag

SEQ ID NO: 395435 - DNA, 25 bp, Homo sapien
atgcagagcatgagtatccatatga

SEQ ID NO: 395436 - DNA, 25 bp, Homo sapien
atccatatgaagaccaccagtggct

SEQ ID NO: 395437 - DNA, 25 bp, Homo sapien
accagtggctatgcaggtagtctga

SEQ ID NO: 395438 - DNA, 25 bp, Homo sapien
ttgaggcccagaatgggaagctcgt

SEQ ID NO: 395439 - DNA, 25 bp, Homo sapien
aagagcgctggctttggtgtcagac

SEQ ID NO: 395440 - DNA, 25 bp, Homo sapien
tggctttggtgtcagacccagattc

SEQ ID NO: 395441 - DNA, 25 bp, Homo sapien
gattcaaattcttgctctgacgctt

SEQ ID NO: 395442 - DNA, 25 bp, Homo sapien
ggctgtgtgatttttgacaagtcac

SEQ ID NO: 395443 - DNA, 25 bp, Homo sapien
tgagcctcgatttcctctttctgtc

SEQ ID NO: 395444 - DNA, 25 bp, Homo sapien
ggaatgatcatagtactttcatctt

SEQ ID NO: 395445 - DNA, 25 bp, Homo sapien
actacgagtgaatgcagtgtttccc

SEQ ID NO: 395446 - DNA, 25 bp, Homo sapien
aaagtgtgtacattcagcgtcagtg

SEQ ID NO: 395447 - DNA, 25 bp, Homo sapien
attcagcgtcagtgatatatgggat

SEQ ID NO: 395448 - DNA, 25 bp, Homo sapien
ggatgatttcaggtcttacgtgagt

SEQ ID NO: 395449 - DNA, 25 bp, Homo sapien
atagtcctgagttagcttttgtgaa

SEQ ID NO: 395450 - DNA, 25 bp, Homo sapien
gtggtggtcttggttatagtaaaat

SEQ ID NO: 395451 - DNA, 25 bp, Homo sapien
tggtggtcttggttatagtaaaata

SEQ ID NO: 395452 - DNA, 25 bp, Homo sapien
gtggtcttggttatagtaaaataag

SEQ ID NO: 395453 - DNA, 25 bp, Homo sapien
aattttgacagtggtaactatgatg

SEQ ID NO: 395454 - DNA, 25 bp, Homo sapien
attttgacagtggtaactatgatgg

SEQ ID NO: 395455 - DNA, 25 bp, Homo sapien
ttttgacagtggtaactatgatggt

SEQ ID NO: 395456 - DNA, 25 bp, Homo sapien
tttgacagtggtaactatgatggtg

SEQ ID NO: 395457 - DNA, 25 bp, Homo sapien
ttgacagtggtaactatgatggtgg

SEQ ID NO: 395458 - DNA, 25 bp, Homo sapien
atggtggtgggaagtatagtgattt

SEQ ID NO: 395459 - DNA, 25 bp, Homo sapien
atgaaaggaggctttctgggtggaa

SEQ ID NO: 395460 - DNA, 25 bp, Homo sapien
gaaaggaggctttctgggtggaaga

SEQ ID NO: 395461 - DNA, 25 bp, Homo sapien
gaaaaggatcatagtcacattgaat

SEQ ID NO: 395462 - DNA, 25 bp, Homo sapien
gtcacattgaatttgtgaaggccaa

SEQ ID NO: 395463 - DNA, 25 bp, Homo sapien
tgtgtacaagaataccaggcagagt

SEQ ID NO: 395464 - DNA, 25 bp, Homo sapien
caggcagagtgttttacccatggaa

SEQ ID NO: 395465 - DNA, 25 bp, Homo sapien
ttttacccatggaaacaggtttcag

SEQ ID NO: 395466 - DNA, 25 bp, Homo sapien
tttactgttagagtctcaagtttag

SEQ ID NO: 395467 - DNA, 25 bp, Homo sapien
ttagaaatgctaacacttaaatcag

SEQ ID NO: 395468 - DNA, 25 bp, Homo sapien
tttttctcactatacttgaagattg

SEQ ID NO: 395469 - DNA, 25 bp, Homo sapien
attttgatatcttcctagcttgatg

SEQ ID NO: 395470 - DNA, 25 bp, Homo sapien
gatatcttcctagcttgatgaattt

SEQ ID NO: 395471 - DNA, 25 bp, Homo sapien
ttaaacatatcttcagatctgtgac

SEQ ID NO: 395472 - DNA, 25 bp, Homo sapien
ttcccctgtgtactactggcataaa

SEQ ID NO: 395473 - DNA, 25 bp, Homo sapien
gtactactggcataaacttgaggga

SEQ ID NO: 395474 - DNA, 25 bp, Homo sapien
agggaagagacatcgtgccagtgaa

SEQ ID NO: 395475 - DNA, 25 bp, Homo sapien
caaccaccgggattttggtcattgg

SEQ ID NO: 395476 - DNA, 25 bp, Homo sapien
caaggttattaccagtgtactgcca

SEQ ID NO: 395477 - DNA, 25 bp, Homo sapien
agtgtactgccatcaacagacttgg

SEQ ID NO: 395478 - DNA, 25 bp, Homo sapien
cagacttggcaatagttcctgcgaa

SEQ ID NO: 395479 - DNA, 25 bp, Homo sapien
tgcgaaatcgatctcacttcttcac

SEQ ID NO: 395480 - DNA, 25 bp, Homo sapien
attggtagcctggtaggtgccgcca

SEQ ID NO: 395481 - DNA, 25 bp, Homo sapien
aggtgccgccatcatcatctctgtt

SEQ ID NO: 395482 - DNA, 25 bp, Homo sapien
gtgtgcttcgcaaggaataaggcaa

SEQ ID NO: 395483 - DNA, 25 bp, Homo sapien
atttctgctgtaaccaaaccttaag

SEQ ID NO: 395484 - DNA, 25 bp, Homo sapien
aaccttaagatcctgtgggaatggc

SEQ ID NO: 395485 - DNA, 25 bp, Homo sapien
tcctgtgggaatggcttgtttgtca

SEQ ID NO: 395486 - DNA, 25 bp, Homo sapien
gaatggcttgtttgtcaatgggcaa

SEQ ID NO: 395487 - DNA, 25 bp, Homo sapien
tgtatgttgctgattggtgtgtaaa

SEQ ID NO: 395488 - DNA, 25 bp, Homo sapien
gtttcagaaaggcagcttggcaata

SEQ ID NO: 395489 - DNA, 25 bp, Homo sapien
gaaaggcagcttggcaatatatata

SEQ ID NO: 395490 - DNA, 25 bp, Homo sapien
tgtatccaagacagattttcagagg

SEQ ID NO: 395491 - DNA, 25 bp, Homo sapien
gaagggtttaacctcatggataata

SEQ ID NO: 395492 - DNA, 25 bp, Homo sapien
tccttccaccttgataacatttctg

SEQ ID NO: 395493 - DNA, 25 bp, Homo sapien
ataacatttctgctgtaaccaaacc

SEQ ID NO: 395494 - DNA, 25 bp, Homo sapien
atgatcacaagctccatatttgttc

SEQ ID NO: 395495 - DNA, 25 bp, Homo sapien
tgatcacaagctccatatttgttct

SEQ ID NO: 395496 - DNA, 25 bp, Homo sapien
gatcacaagctccatatttgttctc

SEQ ID NO: 395497 - DNA, 25 bp, Homo sapien
atcacaagctccatatttgttctca

SEQ ID NO: 395498 - DNA, 25 bp, Homo sapien
tcacaagctccatatttgttctcat

SEQ ID NO: 395499 - DNA, 25 bp, Homo sapien
tctcacttcttatggtgccatcgtc

SEQ ID NO: 395500 - DNA, 25 bp, Homo sapien
gaaagtgtttggaacatgtggagct

SEQ ID NO: 395501 - DNA, 25 bp, Homo sapien
aacatgtggagctcatcttatggct

SEQ ID NO: 395502 - DNA, 25 bp, Homo sapien
tttcattccggccatgtgcatatat

SEQ ID NO: 395503 - DNA, 25 bp, Homo sapien
ttcattccggccatgtgcatatatc

SEQ ID NO: 395504 - DNA, 25 bp, Homo sapien
acaccctcagaaacaaagttgtaag

SEQ ID NO: 395505 - DNA, 25 bp, Homo sapien
gaagatgacttcaggctggattgtc

SEQ ID NO: 395506 - DNA, 25 bp, Homo sapien
gacttcaggctggattgtctactgt

SEQ ID NO: 395507 - DNA, 25 bp, Homo sapien
caggctggattgtctactgtggaca

SEQ ID NO: 395508 - DNA, 25 bp, Homo sapien
tggattgtctactgtggacaggtgt

SEQ ID NO: 395509 - DNA, 25 bp, Homo sapien
tggacaggtgtttgagaaggtcccc

SEQ ID NO: 395510 - DNA, 25 bp, Homo sapien
gggtaaagaacttcagcgtctggct

SEQ ID NO: 395511 - DNA, 25 bp, Homo sapien
gtaaagaacttcagcgtctggctgc

SEQ ID NO: 395512 - DNA, 25 bp, Homo sapien
acacatacagggaatactgggacct

SEQ ID NO: 395513 - DNA, 25 bp, Homo sapien
catacagggaatactgggacctgac

SEQ ID NO: 395514 - DNA, 25 bp, Homo sapien
ccaggcccactgcatccagatcatg

SEQ ID NO: 395515 - DNA, 25 bp, Homo sapien
gcagccaacaagtgccgccgggcca

SEQ ID NO: 395516 - DNA, 25 bp, Homo sapien
aaaggcacaagattacactgaacat

SEQ ID NO: 395517 - DNA, 25 bp, Homo sapien
aaaaggcactgctaagacattcaag

SEQ ID NO: 395518 - DNA, 25 bp, Homo sapien
agctattacacactactgcagattt

SEQ ID NO: 395519 - DNA, 25 bp, Homo sapien
ctgcagattttacaggtttctaatt

SEQ ID NO: 395520 - DNA, 25 bp, Homo sapien
tgaaaaatccgtgagtattccaaaa

SEQ ID NO: 395521 - DNA, 25 bp, Homo sapien
tctgcattaatataccatccatgtg

SEQ ID NO: 395522 - DNA, 25 bp, Homo sapien
ataccatccatgtgtttttaccatt

SEQ ID NO: 395523 - DNA, 25 bp, Homo sapien
gtttttaccatttgccttaatattg

SEQ ID NO: 395524 - DNA, 25 bp, Homo sapien
gaatatactgtttacctcacactaa

SEQ ID NO: 395525 - DNA, 25 bp, Homo sapien
accagaagccttatttgtgattttg

SEQ ID NO: 395526 - DNA, 25 bp, Homo sapien
tgattttgggagtggaagcttccat

SEQ ID NO: 395527 - DNA, 25 bp, Homo sapien
ccgcaccccacgtgaagcagaatat

SEQ ID NO: 395528 - DNA, 25 bp, Homo sapien
accccacgtgaagcagaatataaag

SEQ ID NO: 395529 - DNA, 25 bp, Homo sapien
atggcgaaggactgaagggatcccc

SEQ ID NO: 395530 - DNA, 25 bp, Homo sapien
gctgaggcggtttcggagttggccg

SEQ ID NO: 395531 - DNA, 25 bp, Homo sapien
tcctttccgaagctcgctctcgaag

SEQ ID NO: 395532 - DNA, 25 bp, Homo sapien
cgaagctcgctctcgaaggcaggag

SEQ ID NO: 395533 - DNA, 25 bp, Homo sapien
aaggcaggagcgaccggcgcctttg

SEQ ID NO: 395534 - DNA, 25 bp, Homo sapien
gaccggcgcctttggctgaggagga

SEQ ID NO: 395535 - DNA, 25 bp, Homo sapien
gagaaggaggaatcgcgccaggcgg

SEQ ID NO: 395536 - DNA, 25 bp, Homo sapien
agaaggtgggcatttctcgcttttc

SEQ ID NO: 395537 - DNA, 25 bp, Homo sapien
aggtgggcatttctcgcttttcctc

SEQ ID NO: 395538 - DNA, 25 bp, Homo sapien
gccagcaagaagttacagtactaga

SEQ ID NO: 395539 - DNA, 25 bp, Homo sapien
acagtactagaattgccttacccct

SEQ ID NO: 395540 - DNA, 25 bp, Homo sapien
tactagaattgccttacccctgaga

SEQ ID NO: 395541 - DNA, 25 bp, Homo sapien
ccttacccctgagagtatcaatgat

SEQ ID NO: 395542 - DNA, 25 bp, Homo sapien
acccctgagagtatcaatgatcaga

SEQ ID NO: 395543 - DNA, 25 bp, Homo sapien
gatcagatcatagtatcaggtgact

SEQ ID NO: 395544 - DNA, 25 bp, Homo sapien
catagtatcaggtgactgggctata

SEQ ID NO: 395545 - DNA, 25 bp, Homo sapien
gactgggctatagaagatgactttt

SEQ ID NO: 395546 - DNA, 25 bp, Homo sapien
gacttttattacttaacattatgaa

SEQ ID NO: 395547 - DNA, 25 bp, Homo sapien
gttactagggctgatttagaaatcg

SEQ ID NO: 395548 - DNA, 25 bp, Homo sapien
agaaatcgaggaacactggtgaaac

SEQ ID NO: 395549 - DNA, 25 bp, Homo sapien
atgaacttcaagttggctcaggaca

SEQ ID NO: 395550 - DNA, 25 bp, Homo sapien
gaacttcaagttggctcaggacatc

SEQ ID NO: 395551 - DNA, 25 bp, Homo sapien
acttcaagttggctcaggacatcgt

SEQ ID NO: 395552 - DNA, 25 bp, Homo sapien
cttcaagttggctcaggacatcgtg

SEQ ID NO: 395553 - DNA, 25 bp, Homo sapien
tcaagttggctcaggacatcgtgat

SEQ ID NO: 395554 - DNA, 25 bp, Homo sapien
aagttggctcaggacatcgtgatca

SEQ ID NO: 395555 - DNA, 25 bp, Homo sapien
gttggctcaggacatcgtgatcacc

SEQ ID NO: 395556 - DNA, 25 bp, Homo sapien
ttggctcaggacatcgtgatcacca

SEQ ID NO: 395557 - DNA, 25 bp, Homo sapien
tggctcaggacatcgtgatcaccac

SEQ ID NO: 395558 - DNA, 25 bp, Homo sapien
ctcaggacatcgtgatcaccaccta

SEQ ID NO: 395559 - DNA, 25 bp, Homo sapien
aggacatcgtgatcaccacctacag

SEQ ID NO: 395560 - DNA, 25 bp, Homo sapien
aaaggcacaagattacactgaacat

SEQ ID NO: 395561 - DNA, 25 bp, Homo sapien
tctgcattaatataccatccatgtg

SEQ ID NO: 395562 - DNA, 25 bp, Homo sapien
gcattaatataccatccatgtgttt

SEQ ID NO: 395563 - DNA, 25 bp, Homo sapien
atataccatccatgtgtttttacca

SEQ ID NO: 395564 - DNA, 25 bp, Homo sapien
ataccatccatgtgtttttaccatt

SEQ ID NO: 395565 - DNA, 25 bp, Homo sapien
taccatccatgtgtttttaccattt

SEQ ID NO: 395566 - DNA, 25 bp, Homo sapien
atattgaatatactgtttacctcac

SEQ ID NO: 395567 - DNA, 25 bp, Homo sapien
ttgaatatactgtttacctcacact

SEQ ID NO: 395568 - DNA, 25 bp, Homo sapien
gaatatactgtttacctcacactaa

SEQ ID NO: 395569 - DNA, 25 bp, Homo sapien
aatatactgtttacctcacactaaa

SEQ ID NO: 395570 - DNA, 25 bp, Homo sapien
tatactgtttacctcacactaaaaa

SEQ ID NO: 395571 - DNA, 25 bp, Homo sapien
tactgaagtacacgtagagaagctt

SEQ ID NO: 395572 - DNA, 25 bp, Homo sapien
gtacacgtagagaagcttcactttg

SEQ ID NO: 395573 - DNA, 25 bp, Homo sapien
cacgtagagaagcttcactttgaat

SEQ ID NO: 395574 - DNA, 25 bp, Homo sapien
cgtagagaagcttcactttgaatgg

SEQ ID NO: 395575 - DNA, 25 bp, Homo sapien
tgaatggataaatcaggtgccagtg

SEQ ID NO: 395576 - DNA, 25 bp, Homo sapien
accccagaaatctatgaaccgagag

SEQ ID NO: 395577 - DNA, 25 bp, Homo sapien
cccagaaatctatgaaccgagagaa

SEQ ID NO: 395578 - DNA, 25 bp, Homo sapien
gaaatctatgaaccgagagaagaga

SEQ ID NO: 395579 - DNA, 25 bp, Homo sapien
gaagagagaacctagccaagcagat

SEQ ID NO: 395580 - DNA, 25 bp, Homo sapien
aagagagaacctagccaagcagatg

SEQ ID NO: 395581 - DNA, 25 bp, Homo sapien
ctgaggattagagagcaagccaaca

SEQ ID NO: 395582 - DNA, 25 bp, Homo sapien
gaatttactaccacacttaagatct

SEQ ID NO: 395583 - DNA, 25 bp, Homo sapien
aacacagtcctatggcatggacctt

SEQ ID NO: 395584 - DNA, 25 bp, Homo sapien
tggaccttgaggatactgcaacagt

SEQ ID NO: 395585 - DNA, 25 bp, Homo sapien
gtgggtctcaagaacaactgtattt

SEQ ID NO: 395586 - DNA, 25 bp, Homo sapien
atggcaatggtcaatggtggctcga

SEQ ID NO: 395587 - DNA, 25 bp, Homo sapien
ctttggtggtggtttgtcattggta

SEQ ID NO: 395588 - DNA, 25 bp, Homo sapien
gtggctcgaggattttttgctttct

SEQ ID NO: 395589 - DNA, 25 bp, Homo sapien
gtcattggtaaatcagtgcctactg

SEQ ID NO: 395590 - DNA, 25 bp, Homo sapien
gtgcctactgaggacctgacatatt

SEQ ID NO: 395591 - DNA, 25 bp, Homo sapien
catattgaaggtactgagcagactc

SEQ ID NO: 395592 - DNA, 25 bp, Homo sapien
gagcagactcatactgaacttctct

SEQ ID NO: 395593 - DNA, 25 bp, Homo sapien
tctggaacagccttttcatgggccc

SEQ ID NO: 395594 - DNA, 25 bp, Homo sapien
ctggaacagccttttcatgggccct

SEQ ID NO: 395595 - DNA, 25 bp, Homo sapien
tgtgacccccgcactacagggacat

SEQ ID NO: 395596 - DNA, 25 bp, Homo sapien
gtgacccccgcactacagggacata

SEQ ID NO: 395597 - DNA, 25 bp, Homo sapien
tgacccccgcactacagggacatac

SEQ ID NO: 395598 - DNA, 25 bp, Homo sapien
ccgcactacagggacatacagatgt

SEQ ID NO: 395599 - DNA, 25 bp, Homo sapien
cgcactacagggacatacagatgtc

SEQ ID NO: 395600 - DNA, 25 bp, Homo sapien
gcactacagggacatacagatgtcg

SEQ ID NO: 395601 - DNA, 25 bp, Homo sapien
cactacagggacatacagatgtcgg

SEQ ID NO: 395602 - DNA, 25 bp, Homo sapien
actacagggacatacagatgtcggg

SEQ ID NO: 395603 - DNA, 25 bp, Homo sapien
ggacatgtcattcttcggtgtcact

SEQ ID NO: 395604 - DNA, 25 bp, Homo sapien
aagtctccatcctctgcagttagct

SEQ ID NO: 395605 - DNA, 25 bp, Homo sapien
ctgcagttagctcttctagttataa

SEQ ID NO: 395606 - DNA, 25 bp, Homo sapien
agagcaatgtctgttggcaggcatt

SEQ ID NO: 395607 - DNA, 25 bp, Homo sapien
caggcattgtgccatgaacttttat

SEQ ID NO: 395608 - DNA, 25 bp, Homo sapien
tatacactatttcatcttaatcctc

SEQ ID NO: 395609 - DNA, 25 bp, Homo sapien
aggtagtatcttcatcgttagttta

SEQ ID NO: 395610 - DNA, 25 bp, Homo sapien
gaaactgtgtggttaggcacctgat

SEQ ID NO: 395611 - DNA, 25 bp, Homo sapien
gttaggcacctgatagaaggacaca

SEQ ID NO: 395612 - DNA, 25 bp, Homo sapien
ggaattcaagctaggtccacctgag

SEQ ID NO: 395613 - DNA, 25 bp, Homo sapien
aggtccacctgagtccagagcttga

SEQ ID NO: 395614 - DNA, 25 bp, Homo sapien
gctataagctgtcatgctctactga

SEQ ID NO: 395615 - DNA, 25 bp, Homo sapien
tggaaccctggcccaattcctcaga

SEQ ID NO: 395616 - DNA, 25 bp, Homo sapien
agagtggcctgggacccaagctgcc

SEQ ID NO: 395617 - DNA, 25 bp, Homo sapien
agcggacacctcctcaggcttaaat

SEQ ID NO: 395618 - DNA, 25 bp, Homo sapien
ctcaggcttaaatctcaggcttcac

SEQ ID NO: 395619 - DNA, 25 bp, Homo sapien
aaatctcaggcttcacattgcaatg

SEQ ID NO: 395620 - DNA, 25 bp, Homo sapien
cacattgcaatgacgattgcagttt

SEQ ID NO: 395621 - DNA, 25 bp, Homo sapien
tttggagatgacacacctactgctt

SEQ ID NO: 395622 - DNA, 25 bp, Homo sapien
agatgacacacctactgcttctttt

SEQ ID NO: 395623 - DNA, 25 bp, Homo sapien
ctgcttcttttctaggataaatcta

SEQ ID NO: 395624 - DNA, 25 bp, Homo sapien
aattactgtttactggtggagtaca

SEQ ID NO: 395625 - DNA, 25 bp, Homo sapien
tactggtggagtacatatgcataga

SEQ ID NO: 395626 - DNA, 25 bp, Homo sapien
gattaaaagccaccatgaaagatga

SEQ ID NO: 395627 - DNA, 25 bp, Homo sapien
ttaaaagccaccatgaaagatgatc

SEQ ID NO: 395628 - DNA, 25 bp, Homo sapien
cagattatggtggttatgatggagg

SEQ ID NO: 395629 - DNA, 25 bp, Homo sapien
gaaaagtcactatattatgccagtt

SEQ ID NO: 395630 - DNA, 25 bp, Homo sapien
aagtcactatattatgccagttttt

SEQ ID NO: 395631 - DNA, 25 bp, Homo sapien
gtcactatattatgccagttttttg

SEQ ID NO: 395632 - DNA, 25 bp, Homo sapien
actatattatgccagttttttggaa

SEQ ID NO: 395633 - DNA, 25 bp, Homo sapien
atattatgccagttttttggaagtc

SEQ ID NO: 395634 - DNA, 25 bp, Homo sapien
attatgccagttttttggaagtctt

SEQ ID NO: 395635 - DNA, 25 bp, Homo sapien
tatgccagttttttggaagtcttag

SEQ ID NO: 395636 - DNA, 25 bp, Homo sapien
tgccagttttttggaagtcttagtt

SEQ ID NO: 395637 - DNA, 25 bp, Homo sapien
aatgggggacataaagcctgtcctg

SEQ ID NO: 395638 - DNA, 25 bp, Homo sapien
atgggggacataaagcctgtcctgt

SEQ ID NO: 395639 - DNA, 25 bp, Homo sapien
tgggggacataaagcctgtcctgtc

SEQ ID NO: 395640 - DNA, 25 bp, Homo sapien
gggggacataaagcctgtcctgtct

SEQ ID NO: 395641 - DNA, 25 bp, Homo sapien
agcctgtcctgtctctattctaggc

SEQ ID NO: 395642 - DNA, 25 bp, Homo sapien
gcctgtcctgtctctattctaggca

SEQ ID NO: 395643 - DNA, 25 bp, Homo sapien
tttttctaaagagtcccagagaatg

SEQ ID NO: 395644 - DNA, 25 bp, Homo sapien
ttttctaaagagtcccagagaatgg

SEQ ID NO: 395645 - DNA, 25 bp, Homo sapien
tttctaaagagtcccagagaatggg

SEQ ID NO: 395646 - DNA, 25 bp, Homo sapien
gtctctgaggctgtggttgctacag

SEQ ID NO: 395647 - DNA, 25 bp, Homo sapien
gttgctacagggtcaccacgagctt

SEQ ID NO: 395648 - DNA, 25 bp, Homo sapien
acgagcttggcttacttgtctcatc

SEQ ID NO: 395649 - DNA, 25 bp, Homo sapien
tcccttgcctggtatcattttctca

SEQ ID NO: 395650 - DNA, 25 bp, Homo sapien
ttttctcagttctcccaaaagccat

SEQ ID NO: 395651 - DNA, 25 bp, Homo sapien
tgaccccagcgacctctggaaggat

SEQ ID NO: 395652 - DNA, 25 bp, Homo sapien
ccgagaagccagagtccaccctgga

SEQ ID NO: 395653 - DNA, 25 bp, Homo sapien
ggctgcagcccgagctttctatgag

SEQ ID NO: 395654 - DNA, 25 bp, Homo sapien
cgagctttctatgaggccctgattg

SEQ ID NO: 395655 - DNA, 25 bp, Homo sapien
gggatgagagcagcgctcctgactc

SEQ ID NO: 395656 - DNA, 25 bp, Homo sapien
tgactcccagagatctcagactgaa

SEQ ID NO: 395657 - DNA, 25 bp, Homo sapien
gaccgcactgtcaagggaaggcctg

SEQ ID NO: 395658 - DNA, 25 bp, Homo sapien
aaggcctgacgagggcgtcaagccc

SEQ ID NO: 395659 - DNA, 25 bp, Homo sapien
aggaccaacgagtctgctccactgt

SEQ ID NO: 395660 - DNA, 25 bp, Homo sapien
acaagggagctctaagctggtggaa

SEQ ID NO: 395661 - DNA, 25 bp, Homo sapien
ggaagctatcaagacccacgacaac

SEQ ID NO: 395662 - DNA, 25 bp, Homo sapien
tatgacaagatctgccatcgctggg

SEQ ID NO: 395663 - DNA, 25 bp, Homo sapien
tgccatcgctgggaaagctagctct

SEQ ID NO: 395664 - DNA, 25 bp, Homo sapien
ggaaagctagctctgggaccaaaat

SEQ ID NO: 395665 - DNA, 25 bp, Homo sapien
accaaaatctgtggctcacgttgcc

SEQ ID NO: 395666 - DNA, 25 bp, Homo sapien
gcaaaggccacagaacctgccaata

SEQ ID NO: 395667 - DNA, 25 bp, Homo sapien
gaacctgccaataaactgggtgaaa

SEQ ID NO: 395668 - DNA, 25 bp, Homo sapien
aagctgggagcacgccgcgctggag

SEQ ID NO: 395669 - DNA, 25 bp, Homo sapien
cgctgacccagctgacaacaagatt

SEQ ID NO: 395670 - DNA, 25 bp, Homo sapien
tgacaacaagattcaccttgtggac

SEQ ID NO: 395671 - DNA, 25 bp, Homo sapien
ttcagagcctgaaggacttgacgct

SEQ ID NO: 395672 - DNA, 25 bp, Homo sapien
agcctgaaggacttgacgctggcaa

SEQ ID NO: 395673 - DNA, 25 bp, Homo sapien
ggacttgacgctggcaagcccctga

SEQ ID NO: 395674 - DNA, 25 bp, Homo sapien
tgaagtacatcgtcaagcaccccag

SEQ ID NO: 395675 - DNA, 25 bp, Homo sapien
tacatcgtcaagcaccccaggaaat

SEQ ID NO: 395676 - DNA, 25 bp, Homo sapien
gtcaagcaccccaggaaatcaacct

SEQ ID NO: 395677 - DNA, 25 bp, Homo sapien
aggaaatcaacctcctgaaccacac

SEQ ID NO: 395678 - DNA, 25 bp, Homo sapien
gatcgagtggttcagggccggcagt

SEQ ID NO: 395679 - DNA, 25 bp, Homo sapien
gaagatgacttcaggctggattgtc

SEQ ID NO: 395680 - DNA, 25 bp, Homo sapien
gacttcaggctggattgtctactgt

SEQ ID NO: 395681 - DNA, 25 bp, Homo sapien
caggctggattgtctactgtggaca

SEQ ID NO: 395682 - DNA, 25 bp, Homo sapien
tggattgtctactgtggacaggtgt

SEQ ID NO: 395683 - DNA, 25 bp, Homo sapien
tggacaggtgtttgagaaggtcccc

SEQ ID NO: 395684 - DNA, 25 bp, Homo sapien
gggtaaagaacttcagcgtctggct

SEQ ID NO: 395685 - DNA, 25 bp, Homo sapien
agaacttcagcgtctggctgctcta

SEQ ID NO: 395686 - DNA, 25 bp, Homo sapien
agcgtctggctgctctatgactccc

SEQ ID NO: 395687 - DNA, 25 bp, Homo sapien
acacatacagggaatactgggacct

SEQ ID NO: 395688 - DNA, 25 bp, Homo sapien
gaatactgggacctgaccaccatgg

SEQ ID NO: 395689 - DNA, 25 bp, Homo sapien
aggcccactgcatccagatcatgaa

SEQ ID NO: 395690 - DNA, 25 bp, Homo sapien
tttcaatatttgtgggtctctttaa

SEQ ID NO: 395691 - DNA, 25 bp, Homo sapien
tttgtgggtctctttaacatagaag

SEQ ID NO: 395692 - DNA, 25 bp, Homo sapien
aattgatgatgatttcagtcttgag

SEQ ID NO: 395693 - DNA, 25 bp, Homo sapien
tctgcatttcgtgaatttgaggagt

SEQ ID NO: 395694 - DNA, 25 bp, Homo sapien
gttagctaagcaactacaagcccaa

SEQ ID NO: 395695 - DNA, 25 bp, Homo sapien
tacaagcccaaatagacaaccaaaa

SEQ ID NO: 395696 - DNA, 25 bp, Homo sapien
aaccaaaatgatcctgaggtgggac

SEQ ID NO: 395697 - DNA, 25 bp, Homo sapien
cctgaggtgggacaacaaagttaat

SEQ ID NO: 395698 - DNA, 25 bp, Homo sapien
taatatgattaaccacctgccgctg

SEQ ID NO: 395699 - DNA, 25 bp, Homo sapien
ctgatcagccttatgttcccaaaga

SEQ ID NO: 395700 - DNA, 25 bp, Homo sapien
cccaaagagccctgagtagtgcttt

SEQ ID NO: 395701 - DNA, 25 bp, Homo sapien
ttgggagcgggatctaaggacttac

SEQ ID NO: 395702 - DNA, 25 bp, Homo sapien
aaggacttacatgaacctcgagttc

SEQ ID NO: 395703 - DNA, 25 bp, Homo sapien
gaacctcgagttctgactttggtaa

SEQ ID NO: 395704 - DNA, 25 bp, Homo sapien
tggtaaagtctgaccctagtctgct

SEQ ID NO: 395705 - DNA, 25 bp, Homo sapien
ccctagtctgctgctgaagtctgaa

SEQ ID NO: 395706 - DNA, 25 bp, Homo sapien
gcagatcctgaagtttttggtcaat

SEQ ID NO: 395707 - DNA, 25 bp, Homo sapien
gtttttggtcaataggctctgtctt

SEQ ID NO: 395708 - DNA, 25 bp, Homo sapien
tggtcaataggctctgtcttcgtga

SEQ ID NO: 395709 - DNA, 25 bp, Homo sapien
ataggctctgtcttcgtgagagacg

SEQ ID NO: 395710 - DNA, 25 bp, Homo sapien
agagacgggctgagagtcagaaata

SEQ ID NO: 395711 - DNA, 25 bp, Homo sapien
cagaaataaatcaaccatttgtggt

SEQ ID NO: 395712 - DNA, 25 bp, Homo sapien
ccttttaacttccgttcatagacat

SEQ ID NO: 395713 - DNA, 25 bp, Homo sapien
agacatatatgtgacttccaattcg

SEQ ID NO: 395714 - DNA, 25 bp, Homo sapien
tatatgtgacttccaattcgaccct

SEQ ID NO: 395715 - DNA, 25 bp, Homo sapien
atgtgacttccaattcgaccctctg

SEQ ID NO: 395716 - DNA, 25 bp, Homo sapien
caattcgaccctctggcaagtgagt

SEQ ID NO: 395717 - DNA, 25 bp, Homo sapien
attcgaccctctggcaagtgagtgt

SEQ ID NO: 395718 - DNA, 25 bp, Homo sapien
gaccctctggcaagtgagtgtggaa

SEQ ID NO: 395719 - DNA, 25 bp, Homo sapien
gcagttcttttataattgcttgaaa

SEQ ID NO: 395720 - DNA, 25 bp, Homo sapien
attgcttgaaattaggaaagcgctt

SEQ ID NO: 395721 - DNA, 25 bp, Homo sapien
gaaagcgcttatttcctagaagcaa

SEQ ID NO: 395722 - DNA, 25 bp, Homo sapien
agcgcttatttcctagaagcaaata

SEQ ID NO: 395723 - DNA, 25 bp, Homo sapien
caacagtatctgtaatcacaagtat

SEQ ID NO: 395724 - DNA, 25 bp, Homo sapien
atttttcaacaacctccattgtcct

SEQ ID NO: 395725 - DNA, 25 bp, Homo sapien
ggtaaccaaggtgcatcttagtatc

SEQ ID NO: 395726 - DNA, 25 bp, Homo sapien
ggtgcatcttagtatctgctttcca

SEQ ID NO: 395727 - DNA, 25 bp, Homo sapien
atacactgggccaaatacatttgaa

SEQ ID NO: 395728 - DNA, 25 bp, Homo sapien
acatttgaagatgcaggaaactaca

SEQ ID NO: 395729 - DNA, 25 bp, Homo sapien
aagaaccagtttctagacctgaatt

SEQ ID NO: 395730 - DNA, 25 bp, Homo sapien
gaaatttattcccacatgacctgtg

SEQ ID NO: 395731 - DNA, 25 bp, Homo sapien
tgacctgtgctactgacacccaaaa

SEQ ID NO: 395732 - DNA, 25 bp, Homo sapien
acacccaaaatgtcaagtttgtgtt

SEQ ID NO: 395733 - DNA, 25 bp, Homo sapien
gtttgacgcagttacagatataata

SEQ ID NO: 395734 - DNA, 25 bp, Homo sapien
agaggctttccccaggcattggaac

SEQ ID NO: 395735 - DNA, 25 bp, Homo sapien
tttccccaggcattggaactcacta

SEQ ID NO: 395736 - DNA, 25 bp, Homo sapien
ccaggcattggaactcactaggcat

SEQ ID NO: 395737 - DNA, 25 bp, Homo sapien
gcattggaactcactaggcatcaga

SEQ ID NO: 395738 - DNA, 25 bp, Homo sapien
tggaactcactaggcatcagaatat

SEQ ID NO: 395739 - DNA, 25 bp, Homo sapien
atacatctttgagaggaaccacaga

SEQ ID NO: 395740 - DNA, 25 bp, Homo sapien
gcatgctaaggtttttacccgaaca

SEQ ID NO: 395741 - DNA, 25 bp, Homo sapien
tgctaaggtttttacccgaacatca

SEQ ID NO: 395742 - DNA, 25 bp, Homo sapien
tttacccgaacatcaaaatggaaag

SEQ ID NO: 395743 - DNA, 25 bp, Homo sapien
gtattcatactagagacaaccttcc

SEQ ID NO: 395744 - DNA, 25 bp, Homo sapien
actagagacaaccttccaaataaat

SEQ ID NO: 395745 - DNA, 25 bp, Homo sapien
tttggtaaagcagttcatacagctt

SEQ ID NO: 395746 - DNA, 25 bp, Homo sapien
ttcatacagcttttttctaagttcc

SEQ ID NO: 395747 - DNA, 25 bp, Homo sapien
aagttccatgaatcttacccagtgt

SEQ ID NO: 395748 - DNA, 25 bp, Homo sapien
ccatgaatcttacccagtgtttacc

SEQ ID NO: 395749 - DNA, 25 bp, Homo sapien
gaatcttacccagtgtttaccgaag

SEQ ID NO: 395750 - DNA, 25 bp, Homo sapien
tcttacccagtgtttaccgaagtat

SEQ ID NO: 395751 - DNA, 25 bp, Homo sapien
gtgtttaccgaagtatttaagcagc

SEQ ID NO: 395752 - DNA, 25 bp, Homo sapien
agcatctgaatatttccacccagca

SEQ ID NO: 395753 - DNA, 25 bp, Homo sapien
ctgaatatttccacccagcaatgtt

SEQ ID NO: 395754 - DNA, 25 bp, Homo sapien
tatttccacccagcaatgttaattt

SEQ ID NO: 395755 - DNA, 25 bp, Homo sapien
acccagcaatgttaatttatctagg

SEQ ID NO: 395756 - DNA, 25 bp, Homo sapien
tgaagcttgaaggtagtggaagcta

SEQ ID NO: 395757 - DNA, 25 bp, Homo sapien
ggagcggagttcctgatcgcttctc

SEQ ID NO: 395758 - DNA, 25 bp, Homo sapien
gagcggagttcctgatcgcttctca

SEQ ID NO: 395759 - DNA, 25 bp, Homo sapien
ctgattattactgtgagacctggga

SEQ ID NO: 395760 - DNA, 25 bp, Homo sapien
tgattattactgtgagacctgggac

SEQ ID NO: 395761 - DNA, 25 bp, Homo sapien
gattattactgtgagacctgggaca

SEQ ID NO: 395762 - DNA, 25 bp, Homo sapien
attattactgtgagacctgggacag

SEQ ID NO: 395763 - DNA, 25 bp, Homo sapien
ttattactgtgagacctgggacagt

SEQ ID NO: 395764 - DNA, 25 bp, Homo sapien
tattactgtgagacctgggacagta

SEQ ID NO: 395765 - DNA, 25 bp, Homo sapien
attactgtgagacctgggacagtaa

SEQ ID NO: 395766 - DNA, 25 bp, Homo sapien
tactgtgagacctgggacagtaaca

SEQ ID NO: 395767 - DNA, 25 bp, Homo sapien
cagagaacctcgtccactcggaaac

SEQ ID NO: 395768 - DNA, 25 bp, Homo sapien
cgtccactcggaaaccaaagcagaa

SEQ ID NO: 395769 - DNA, 25 bp, Homo sapien
agcgcccagggaagcggctcaacca

SEQ ID NO: 395770 - DNA, 25 bp, Homo sapien
agaaccacttttctctcggtctcgt

SEQ ID NO: 395771 - DNA, 25 bp, Homo sapien
ctcggtctcgttaagtcatgtctga

SEQ ID NO: 395772 - DNA, 25 bp, Homo sapien
cgttaagtcatgtctgagtcacaga

SEQ ID NO: 395773 - DNA, 25 bp, Homo sapien
gagtcacagagatgggcaagatcga

SEQ ID NO: 395774 - DNA, 25 bp, Homo sapien
aacgagagggtgatcctcaatgtcg

SEQ ID NO: 395775 - DNA, 25 bp, Homo sapien
tcaaccacctgaatccggaaaacgc

SEQ ID NO: 395776 - DNA, 25 bp, Homo sapien
cgccaacaagtagtttctcgtcgga

SEQ ID NO: 395777 - DNA, 25 bp, Homo sapien
ttctcgtcggagaagggcggctcac

SEQ ID NO: 395778 - DNA, 25 bp, Homo sapien
caatttcctacaggtaggtacaaag

SEQ ID NO: 395779 - DNA, 25 bp, Homo sapien
ttcctacaggtaggtacaaaggaca

SEQ ID NO: 395780 - DNA, 25 bp, Homo sapien
tcctacaggtaggtacaaaggacac

SEQ ID NO: 395781 - DNA, 25 bp, Homo sapien
caggtaggtacaaaggacactttca

SEQ ID NO: 395782 - DNA, 25 bp, Homo sapien
gacactttcaatgtccctggaggtg

SEQ ID NO: 395783 - DNA, 25 bp, Homo sapien
ctgtcctgtctctattctaggcagg

SEQ ID NO: 395784 - DNA, 25 bp, Homo sapien
ctaggcaggaagagtgggttcaaaa

SEQ ID NO: 395785 - DNA, 25 bp, Homo sapien
gtgggttcaaaagactcctgggctt

SEQ ID NO: 395786 - DNA, 25 bp, Homo sapien
gggacggtgctacactcgtctccac

SEQ ID NO: 395787 - DNA, 25 bp, Homo sapien
tacactcgtctccactgttttgctt

SEQ ID NO: 395788 - DNA, 25 bp, Homo sapien
ttttctaaagagtcccagagaatgg

SEQ ID NO: 395789 - DNA, 25 bp, Homo sapien
agagcaacaggcgagatgcctcatt

SEQ ID NO: 395790 - DNA, 25 bp, Homo sapien
gagatgcctcattctactggaacat

SEQ ID NO: 395791 - DNA, 25 bp, Homo sapien
tctactggaacatcactgtgggtga

SEQ ID NO: 395792 - DNA, 25 bp, Homo sapien
gaacagagatttccaggttttccct

SEQ ID NO: 395793 - DNA, 25 bp, Homo sapien
aatatttgtcccacaccgacaagag

SEQ ID NO: 395794 - DNA, 25 bp, Homo sapien
cgacaagagtccagtcaccaggcct

SEQ ID NO: 395795 - DNA, 25 bp, Homo sapien
ggaacttctgcttgtagcagccgcc

SEQ ID NO: 395796 - DNA, 25 bp, Homo sapien
gggccaagtggcttgttcattccag

SEQ ID NO: 395797 - DNA, 25 bp, Homo sapien
tggcttgttcattccagcatctaac

SEQ ID NO: 395798 - DNA, 25 bp, Homo sapien
gttcattccagcatctaacatcata

SEQ ID NO: 395799 - DNA, 25 bp, Homo sapien
tctaacatcataaaggtgggcccag

SEQ ID NO: 395800 - DNA, 25 bp, Homo sapien
aagtcagcgtgggtgttccagaccc

SEQ ID NO: 395801 - DNA, 25 bp, Homo sapien
gtcgctacctgcgttgggcttcagc

SEQ ID NO: 395802 - DNA, 25 bp, Homo sapien
tcagctccatcatcggcgtgatgta

SEQ ID NO: 395803 - DNA, 25 bp, Homo sapien
agggtcttgtccctccgcatgagga

SEQ ID NO: 395804 - DNA, 25 bp, Homo sapien
atgaggaggcggatggcccctttct

SEQ ID NO: 395805 - DNA, 25 bp, Homo sapien
tgtgcttcaggagcttgacgtcacc

SEQ ID NO: 395806 - DNA, 25 bp, Homo sapien
aggagcttgacgtcaccagtgcctc

SEQ ID NO: 395807 - DNA, 25 bp, Homo sapien
tccattctgggagatcgttctcaga

SEQ ID NO: 395808 - DNA, 25 bp, Homo sapien
gatcgttctcagaggcaaatcggaa

SEQ ID NO: 395809 - DNA, 25 bp, Homo sapien
atcggaacagttttgcccgcatttt

SEQ ID NO: 395810 - DNA, 25 bp, Homo sapien
ctcttcatcttcttccagtgtttta

SEQ ID NO: 395811 - DNA, 25 bp, Homo sapien
tgattgatgaccagggcatgcccaa

SEQ ID NO: 395812 - DNA, 25 bp, Homo sapien
agggcatgcccaagaactgtctcct

SEQ ID NO: 395813 - DNA, 25 bp, Homo sapien
gcatgcccaagaactgtctcctgat

SEQ ID NO: 395814 - DNA, 25 bp, Homo sapien
atgcccaagaactgtctcctgattc

SEQ ID NO: 395815 - DNA, 25 bp, Homo sapien
caagaactgtctcctgattcttatt

SEQ ID NO: 395816 - DNA, 25 bp, Homo sapien
catctgggaagtgttgagtgcaata

SEQ ID NO: 395817 - DNA, 25 bp, Homo sapien
gggatcccagaaagctgctcactat

SEQ ID NO: 395818 - DNA, 25 bp, Homo sapien
gatcccagaaagctgctcactatac

SEQ ID NO: 395819 - DNA, 25 bp, Homo sapien
gaaagctgctcactatacattgggt

SEQ ID NO: 395820 - DNA, 25 bp, Homo sapien
aagctgctcactatacattgggtgc

SEQ ID NO: 395821 - DNA, 25 bp, Homo sapien
ggccagcaagagaagtcttagagtt

SEQ ID NO: 395822 - DNA, 25 bp, Homo sapien
cagggcattagcaatgggttatcct

SEQ ID NO: 395823 - DNA, 25 bp, Homo sapien
ggcattagcaatgggttatcctggt

SEQ ID NO: 395824 - DNA, 25 bp, Homo sapien
cattagcaatgggttatcctggtat

SEQ ID NO: 395825 - DNA, 25 bp, Homo sapien
ttagcaatgggttatcctggtatca

SEQ ID NO: 395826 - DNA, 25 bp, Homo sapien
tagcaatgggttatcctggtatcag

SEQ ID NO: 395827 - DNA, 25 bp, Homo sapien
agcaatgggttatcctggtatcagc

SEQ ID NO: 395828 - DNA, 25 bp, Homo sapien
gcaatgggttatcctggtatcagca

SEQ ID NO: 395829 - DNA, 25 bp, Homo sapien
aatgggttatcctggtatcagcaga

SEQ ID NO: 395830 - DNA, 25 bp, Homo sapien
agggcaagcccctacgctcctgatc

SEQ ID NO: 395831 - DNA, 25 bp, Homo sapien
ccagtttgcagtcgggggtcccatc

SEQ ID NO: 395832 - DNA, 25 bp, Homo sapien
tgcagtcgggggtcccatctcggtt

SEQ ID NO: 395833 - DNA, 25 bp, Homo sapien
gggtctctggcctcaccctggggaa

SEQ ID NO: 395834 - DNA, 25 bp, Homo sapien
cctgctgagcctggcgtgggaacaa

SEQ ID NO: 395835 - DNA, 25 bp, Homo sapien
tgggctcccggctacaacagcgcca

SEQ ID NO: 395836 - DNA, 25 bp, Homo sapien
gcgtgggaacaatgtggcctctatc

SEQ ID NO: 395837 - DNA, 25 bp, Homo sapien
tgggaacaatgtggcctctatccct

SEQ ID NO: 395838 - DNA, 25 bp, Homo sapien
aacaatgtggcctctatccctggag

SEQ ID NO: 395839 - DNA, 25 bp, Homo sapien
atgtggcctctatccctggagcgag

SEQ ID NO: 395840 - DNA, 25 bp, Homo sapien
ggcctctatccctggagcgagccag

SEQ ID NO: 395841 - DNA, 25 bp, Homo sapien
agcgccagcctccacaggcattaga

SEQ ID NO: 395842 - DNA, 25 bp, Homo sapien
gccagcctccacaggcattagaagg

SEQ ID NO: 395843 - DNA, 25 bp, Homo sapien
ggactcactgcgagggccccagcca

SEQ ID NO: 395844 - DNA, 25 bp, Homo sapien
gatcaaatgggatgccagcactcag

SEQ ID NO: 395845 - DNA, 25 bp, Homo sapien
gccagcactcagttatccaagcaag

SEQ ID NO: 395846 - DNA, 25 bp, Homo sapien
aatatgctccatgcttgactcttta

SEQ ID NO: 395847 - DNA, 25 bp, Homo sapien
tgactctttaccctcactaacaaaa

SEQ ID NO: 395848 - DNA, 25 bp, Homo sapien
tggtctctctctttaatacttctca

SEQ ID NO: 395849 - DNA, 25 bp, Homo sapien
atacttctcaaatctgtccctttag

SEQ ID NO: 395850 - DNA, 25 bp, Homo sapien
ttagtttcatccctctgttactgtt

SEQ ID NO: 395851 - DNA, 25 bp, Homo sapien
gttactgttctcattcagattctta

SEQ ID NO: 395852 - DNA, 25 bp, Homo sapien
ttattacatctcaccaaagccactg

SEQ ID NO: 395853 - DNA, 25 bp, Homo sapien
aaagccactgcagcacattcttaac

SEQ ID NO: 395854 - DNA, 25 bp, Homo sapien
cattcttaactgtgtccaagtggta

SEQ ID NO: 395855 - DNA, 25 bp, Homo sapien
gtacttaacttctaggactgcaaca

SEQ ID NO: 395856 - DNA, 25 bp, Homo sapien
aacttctaggactgcaacacctact

SEQ ID NO: 395857 - DNA, 25 bp, Homo sapien
ctgtgttttgctcttctctaactta

SEQ ID NO: 395858 - DNA, 25 bp, Homo sapien
gttttgctcttctctaacttaccaa

SEQ ID NO: 395859 - DNA, 25 bp, Homo sapien
tcttctctaacttaccaacatcttg

SEQ ID NO: 395860 - DNA, 25 bp, Homo sapien
tctctaacttaccaacatcttgtgt

SEQ ID NO: 395861 - DNA, 25 bp, Homo sapien
gggtgtgttttgtcacttggagaac

SEQ ID NO: 395862 - DNA, 25 bp, Homo sapien
ttggagaactagtgtgaccccaccc

SEQ ID NO: 395863 - DNA, 25 bp, Homo sapien
tgtgaccccacccaagagcatgaca

SEQ ID NO: 395864 - DNA, 25 bp, Homo sapien
taatggagcgccgtgaattttcagt

SEQ ID NO: 395865 - DNA, 25 bp, Homo sapien
ccgtgaattttcagtgtgggatcct

SEQ ID NO: 395866 - DNA, 25 bp, Homo sapien
ttctaggagacactgcagggctttc

SEQ ID NO: 395867 - DNA, 25 bp, Homo sapien
agggctttctggctctgatttttgc

SEQ ID NO: 395868 - DNA, 25 bp, Homo sapien
atttttgcctgcatgtgggctcaga

SEQ ID NO: 395869 - DNA, 25 bp, Homo sapien
gttgtggcaacttccattgtttctg

SEQ ID NO: 395870 - DNA, 25 bp, Homo sapien
ggatatcacataatgccctgcaatg

SEQ ID NO: 395871 - DNA, 25 bp, Homo sapien
gccctgcaatgtttagaatccctta

SEQ ID NO: 395872 - DNA, 25 bp, Homo sapien
gaatcccttaatgaggtcctgtgaa

SEQ ID NO: 395873 - DNA, 25 bp, Homo sapien
gtcccttgaaacacagaattcagtg

SEQ ID NO: 395874 - DNA, 25 bp, Homo sapien
gaattcagtgagctagtgtccctag

SEQ ID NO: 395875 - DNA, 25 bp, Homo sapien
agtgtccctagctataaaaccatgg

SEQ ID NO: 395876 - DNA, 25 bp, Homo sapien
gggctggagcgaaacataattggta

SEQ ID NO: 395877 - DNA, 25 bp, Homo sapien
cagatggagtcctttgaacagtgag

SEQ ID NO: 395878 - DNA, 25 bp, Homo sapien
gaggcataatatttgtcacccaatt

SEQ ID NO: 395879 - DNA, 25 bp, Homo sapien
atttgtcacccaattcctgttggaa

SEQ ID NO: 395880 - DNA, 25 bp, Homo sapien
gagcctctgacctagatattttaac

SEQ ID NO: 395881 - DNA, 25 bp, Homo sapien
gtaatgtggctgtgaacgacacgga

SEQ ID NO: 395882 - DNA, 25 bp, Homo sapien
aacgacacggaaactggtggacagt

SEQ ID NO: 395883 - DNA, 25 bp, Homo sapien
ggtggacagtcatgtcaaggtctaa

SEQ ID NO: 395884 - DNA, 25 bp, Homo sapien
agacagacagttacacatttgggtg

SEQ ID NO: 395885 - DNA, 25 bp, Homo sapien
catttgggtgcaggagttgacactt

SEQ ID NO: 395886 - DNA, 25 bp, Homo sapien
gttgacactttacaattgctcaggc

SEQ ID NO: 395887 - DNA, 25 bp, Homo sapien
tttatcatttgtggccagatggagt

SEQ ID NO: 395888 - DNA, 25 bp, Homo sapien
actgcctatgcagaagctggaggtg

SEQ ID NO: 395889 - DNA, 25 bp, Homo sapien
tggtgaacgcgcacctgcaggatat

SEQ ID NO: 395890 - DNA, 25 bp, Homo sapien
gaacgcgcacctgcaggatatgatc

SEQ ID NO: 395891 - DNA, 25 bp, Homo sapien
aggatatgatcatcctgcccgagat

SEQ ID NO: 395892 - DNA, 25 bp, Homo sapien
atcatcctgcccgagatgggagaca

SEQ ID NO: 395893 - DNA, 25 bp, Homo sapien
tcaaccaagtggagggcaagcccga

SEQ ID NO: 395894 - DNA, 25 bp, Homo sapien
gcaagcccgagaggattggccatta

SEQ ID NO: 395895 - DNA, 25 bp, Homo sapien
gaggattggccattacctcgatcac

SEQ ID NO: 395896 - DNA, 25 bp, Homo sapien
attacctcgatcacctacaagctcg

SEQ ID NO: 395897 - DNA, 25 bp, Homo sapien
tacaagctcgtgaagcactgcccgg

SEQ ID NO: 395898 - DNA, 25 bp, Homo sapien
agctcgtgaagcactgcccggccag

SEQ ID NO: 395899 - DNA, 25 bp, Homo sapien
tccaaatgacattatctgcacgttt

SEQ ID NO: 395900 - DNA, 25 bp, Homo sapien
gacattatctgcacgtttttaaaat

SEQ ID NO: 395901 - DNA, 25 bp, Homo sapien
aacgtgaaactactttctgttacat

SEQ ID NO: 395902 - DNA, 25 bp, Homo sapien
ttctgttacattaggtgttccctag

SEQ ID NO: 395903 - DNA, 25 bp, Homo sapien
taggtgttccctagtgtttcttaat

SEQ ID NO: 395904 - DNA, 25 bp, Homo sapien
tgttccctagtgtttcttaatttct

SEQ ID NO: 395905 - DNA, 25 bp, Homo sapien
ttattagtatttttccggtgaacag

SEQ ID NO: 395906 - DNA, 25 bp, Homo sapien
tttttccggtgaacagaagatttgt

SEQ ID NO: 395907 - DNA, 25 bp, Homo sapien
tactaagacagtacctattaggaaa

SEQ ID NO: 395908 - DNA, 25 bp, Homo sapien
ggtcaattcgattttaatttctcaa

SEQ ID NO: 395909 - DNA, 25 bp, Homo sapien
aaagatactctgttatccagaagat

SEQ ID NO: 395910 - DNA, 25 bp, Homo sapien
catgcagatgaagcaactcagtggg

SEQ ID NO: 395911 - DNA, 25 bp, Homo sapien
aactcagtggggtcctgctgcacct

SEQ ID NO: 395912 - DNA, 25 bp, Homo sapien
cctggagtctgagctagcacagaca

SEQ ID NO: 395913 - DNA, 25 bp, Homo sapien
tctgagctagcacagacacgggcag

SEQ ID NO: 395914 - DNA, 25 bp, Homo sapien
tgagctagcacagacacgggcagag

SEQ ID NO: 395915 - DNA, 25 bp, Homo sapien
aggctgagatcaccacctaccacta

SEQ ID NO: 395916 - DNA, 25 bp, Homo sapien
cacccgcaggatagtggaccacaaa

SEQ ID NO: 395917 - DNA, 25 bp, Homo sapien
agtggaccacaaagtggtgtccgaa

SEQ ID NO: 395918 - DNA, 25 bp, Homo sapien
agaggcccactacaccatgcagatg

SEQ ID NO: 395919 - DNA, 25 bp, Homo sapien
aggcccactacaccatgcagatgaa

SEQ ID NO: 395920 - DNA, 25 bp, Homo sapien
accatgcagatgaagcaactcagtg

SEQ ID NO: 395921 - DNA, 25 bp, Homo sapien
gctttatcacgctttgtagttgctt

SEQ ID NO: 395922 - DNA, 25 bp, Homo sapien
cacgctttgtagttgcttaattatc

SEQ ID NO: 395923 - DNA, 25 bp, Homo sapien
tgcttaattatctatgtcaaaccta

SEQ ID NO: 395924 - DNA, 25 bp, Homo sapien
ggcgggctgaacatctagaaagtga

SEQ ID NO: 395925 - DNA, 25 bp, Homo sapien
aacctagagagcaactgatgacact

SEQ ID NO: 395926 - DNA, 25 bp, Homo sapien
tgacactcagagacatcgcccaaag

SEQ ID NO: 395927 - DNA, 25 bp, Homo sapien
gacatcgcccaaagttctgaaaacc

SEQ ID NO: 395928 - DNA, 25 bp, Homo sapien
ataaactgccagttttaccacatcc

SEQ ID NO: 395929 - DNA, 25 bp, Homo sapien
gaagtacttgccgttagtcacacac

SEQ ID NO: 395930 - DNA, 25 bp, Homo sapien
gttagtcacacaccaagtctggact

SEQ ID NO: 395931 - DNA, 25 bp, Homo sapien
aacacacaggctcgcctctttgcgt

SEQ ID NO: 395932 - DNA, 25 bp, Homo sapien
ggaatttgcctgtaggagatactga

SEQ ID NO: 395933 - DNA, 25 bp, Homo sapien
gagatactgaaaattattttacctc

SEQ ID NO: 395934 - DNA, 25 bp, Homo sapien
ttacctctgatcttgattagaacca

SEQ ID NO: 395935 - DNA, 25 bp, Homo sapien
tgattagaaccatattgtcccattt

SEQ ID NO: 395936 - DNA, 25 bp, Homo sapien
tgaaacttttggtgtatatctacta

SEQ ID NO: 395937 - DNA, 25 bp, Homo sapien
gtatatctactaaacactgtggcat

SEQ ID NO: 395938 - DNA, 25 bp, Homo sapien
ggctcatcaatcacagtggcttact

SEQ ID NO: 395939 - DNA, 25 bp, Homo sapien
tcacagtggcttactattatagcag

SEQ ID NO: 395940 - DNA, 25 bp, Homo sapien
gtggcttactattatagcagagttg

SEQ ID NO: 395941 - DNA, 25 bp, Homo sapien
gcagagttgttagctaggagaagac

SEQ ID NO: 395942 - DNA, 25 bp, Homo sapien
gacagtagaaaggagggaagcattt

SEQ ID NO: 395943 - DNA, 25 bp, Homo sapien
aacagagcatggtctacatcccact

SEQ ID NO: 395944 - DNA, 25 bp, Homo sapien
tacatcccactgtgtcaaccagaag

SEQ ID NO: 395945 - DNA, 25 bp, Homo sapien
agtgttatctcaattggcccagtgt

SEQ ID NO: 395946 - DNA, 25 bp, Homo sapien
actgttaagggctctaagggaatgt

SEQ ID NO: 395947 - DNA, 25 bp, Homo sapien
acagagtctccctgttattctgact

SEQ ID NO: 395948 - DNA, 25 bp, Homo sapien
tattctgacttcctgcttgatgagc

SEQ ID NO: 395949 - DNA, 25 bp, Homo sapien
gcttgatgagctttcagttcctgtt

SEQ ID NO: 395950 - DNA, 25 bp, Homo sapien
tcagttcctgtttttgctattgttt

SEQ ID NO: 395951 - DNA, 25 bp, Homo sapien
ggtgtagtgtgttgaggcttttcaa

SEQ ID NO: 395952 - DNA, 25 bp, Homo sapien
gggtctagtgagctaagtttcatct

SEQ ID NO: 395953 - DNA, 25 bp, Homo sapien
agtttcatcttctggtactcattga

SEQ ID NO: 395954 - DNA, 25 bp, Homo sapien
gagaacatacacgagcatcaggaat

SEQ ID NO: 395955 - DNA, 25 bp, Homo sapien
aaggaaagccgtgctgagtggccca

SEQ ID NO: 395956 - DNA, 25 bp, Homo sapien
cagtctgctgagaatgaaaccgacc

SEQ ID NO: 395957 - DNA, 25 bp, Homo sapien
gatccctccacgatgctatccaaag

SEQ ID NO: 395958 - DNA, 25 bp, Homo sapien
ttacttacaaggttcactactctaa

SEQ ID NO: 395959 - DNA, 25 bp, Homo sapien
actactctaacagctccactgagat

SEQ ID NO: 395960 - DNA, 25 bp, Homo sapien
agattcctgaattcctcactgcatt

SEQ ID NO: 395961 - DNA, 25 bp, Homo sapien
tgcattggaagtgctgatggcttca

SEQ ID NO: 395962 - DNA, 25 bp, Homo sapien
gatggcttcagacttcctagatata

SEQ ID NO: 395963 - DNA, 25 bp, Homo sapien
aggccctgatgccatggatggtaaa

SEQ ID NO: 395964 - DNA, 25 bp, Homo sapien
aactggtatcttctgacgatgatga

SEQ ID NO: 395965 - DNA, 25 bp, Homo sapien
cagaagtttcttaattaggatcgac

SEQ ID NO: 395966 - DNA, 25 bp, Homo sapien
aagtttcttaattaggatcgacagc

SEQ ID NO: 395967 - DNA, 25 bp, Homo sapien
tttttctcgcacttttttgggtatg

SEQ ID NO: 395968 - DNA, 25 bp, Homo sapien
tttctcgcacttttttgggtatggc

SEQ ID NO: 395969 - DNA, 25 bp, Homo sapien
tctcgcacttttttgggtatggctt

SEQ ID NO: 395970 - DNA, 25 bp, Homo sapien
tcgcacttttttgggtatggcttct

SEQ ID NO: 395971 - DNA, 25 bp, Homo sapien
gcacttttttgggtatggcttctat

SEQ ID NO: 395972 - DNA, 25 bp, Homo sapien
cacttttttgggtatggcttctatc

SEQ ID NO: 395973 - DNA, 25 bp, Homo sapien
cttttttgggtatggcttctatcgc

SEQ ID NO: 395974 - DNA, 25 bp, Homo sapien
ttttttgggtatggcttctatcgca

SEQ ID NO: 395975 - DNA, 25 bp, Homo sapien
cagacatagaataacacttacagtg

SEQ ID NO: 395976 - DNA, 25 bp, Homo sapien
tcttctaattccagtgacattgatc

SEQ ID NO: 395977 - DNA, 25 bp, Homo sapien
agtgacattgatcctcatctcctat

SEQ ID NO: 395978 - DNA, 25 bp, Homo sapien
atcctcatctcctatggcttcatag

SEQ ID NO: 395979 - DNA, 25 bp, Homo sapien
atggcttcatagctcaagcagtatt

SEQ ID NO: 395980 - DNA, 25 bp, Homo sapien
caggtcagcagaaggacggcaaaaa

SEQ ID NO: 395981 - DNA, 25 bp, Homo sapien
ggtcccacatgattgtggtgtccct

SEQ ID NO: 395982 - DNA, 25 bp, Homo sapien
ggtgtccctcttttatggaacagcc

SEQ ID NO: 395983 - DNA, 25 bp, Homo sapien
ggaacagccatttatatgtatcttc

SEQ ID NO: 395984 - DNA, 25 bp, Homo sapien
atatgtatcttcaaccaccttcatc

SEQ ID NO: 395985 - DNA, 25 bp, Homo sapien
ggaatcatcacatccatgttgaact

SEQ ID NO: 395986 - DNA, 25 bp, Homo sapien
tccatgttgaactccctcatctaca

SEQ ID NO: 395987 - DNA, 25 bp, Homo sapien
tgaatcctgattcttatggaaatct

SEQ ID NO: 395988 - DNA, 25 bp, Homo sapien
atttcaagatgagacaacactgaag

SEQ ID NO: 395989 - DNA, 25 bp, Homo sapien
gatgagacaacactgaagatcaaat

SEQ ID NO: 395990 - DNA, 25 bp, Homo sapien
gagacaacactgaagatcaaattgt

SEQ ID NO: 395991 - DNA, 25 bp, Homo sapien
tggtagaaagatgggaaccttattt

SEQ ID NO: 395992 - DNA, 25 bp, Homo sapien
gaaagatgggaaccttatttgaatg

SEQ ID NO: 395993 - DNA, 25 bp, Homo sapien
ttttttccatgatgtccaattttgt

SEQ ID NO: 395994 - DNA, 25 bp, Homo sapien
tttccatgatgtccaattttgttgt

SEQ ID NO: 395995 - DNA, 25 bp, Homo sapien
catgatgtccaattttgttgtggga

SEQ ID NO: 395996 - DNA, 25 bp, Homo sapien
gatgtccaattttgttgtgggaaag

SEQ ID NO: 395997 - DNA, 25 bp, Homo sapien
gtccaattttgttgtgggaaaggat

SEQ ID NO: 395998 - DNA, 25 bp, Homo sapien
gagcatgtgattggggccctacata

SEQ ID NO: 395999 - DNA, 25 bp, Homo sapien
gcttcagacaggcatgcaagttgcc

SEQ ID NO: 396000 - DNA, 25 bp, Homo sapien
gccctacatagggtcacgtttaagt

SEQ ID NO: 396001 - DNA, 25 bp, Homo sapien
catagggtcacgtttaagttccctg

SEQ ID NO: 396002 - DNA, 25 bp, Homo sapien
cacgtttaagttccctggccaccag

SEQ ID NO: 396003 - DNA, 25 bp, Homo sapien
gacaggcatgcaagttgcctttgga

SEQ ID NO: 396004 - DNA, 25 bp, Homo sapien
atgaatttgaatatgtggtggctga

SEQ ID NO: 396005 - DNA, 25 bp, Homo sapien
atttgaatatgtggtggctgagaaa

SEQ ID NO: 396006 - DNA, 25 bp, Homo sapien
ggtcaaatccatccctagtcatggc

SEQ ID NO: 396007 - DNA, 25 bp, Homo sapien
tggccaagtcatcatgttcatccac

SEQ ID NO: 396008 - DNA, 25 bp, Homo sapien
catcatgttcatccacaccaagctg

SEQ ID NO: 396009 - DNA, 25 bp, Homo sapien
gaaaacctagctaaggtggccagta

SEQ ID NO: 396010 - DNA, 25 bp, Homo sapien
ggccagtagccaaggttaatttcca

SEQ ID NO: 396011 - DNA, 25 bp, Homo sapien
gccaaggttaatttccaaactgata

SEQ ID NO: 396012 - DNA, 25 bp, Homo sapien
ttttgcctataaatctctaataacc

SEQ ID NO: 396013 - DNA, 25 bp, Homo sapien
ggagttaaattttcagtctattttg

SEQ ID NO: 396014 - DNA, 25 bp, Homo sapien
ttgagacccaagtgattctgctcct

SEQ ID NO: 396015 - DNA, 25 bp, Homo sapien
aagtgattctgctcctctgtaacac

SEQ ID NO: 396016 - DNA, 25 bp, Homo sapien
tctgctcctctgtaacactgcagca

SEQ ID NO: 396017 - DNA, 25 bp, Homo sapien
catgttaactgtcaggttttttcca

SEQ ID NO: 396018 - DNA, 25 bp, Homo sapien
aatgcatgttttccccatgactgct

SEQ ID NO: 396019 - DNA, 25 bp, Homo sapien
gttttccccatgactgctaattaag

SEQ ID NO: 396020 - DNA, 25 bp, Homo sapien
ccccatgttccgtaatgtgcccaca

SEQ ID NO: 396021 - DNA, 25 bp, Homo sapien
cccatgttccgtaatgtgcccacag

SEQ ID NO: 396022 - DNA, 25 bp, Homo sapien
ccatgttccgtaatgtgcccacagc

SEQ ID NO: 396023 - DNA, 25 bp, Homo sapien
catgttccgtaatgtgcccacagca

SEQ ID NO: 396024 - DNA, 25 bp, Homo sapien
atgttccgtaatgtgcccacagcaa

SEQ ID NO: 396025 - DNA, 25 bp, Homo sapien
tgttccgtaatgtgcccacagcaaa

SEQ ID NO: 396026 - DNA, 25 bp, Homo sapien
gttccgtaatgtgcccacagcaaac

SEQ ID NO: 396027 - DNA, 25 bp, Homo sapien
ttccgtaatgtgcccacagcaaacc

SEQ ID NO: 396028 - DNA, 25 bp, Homo sapien
tccgtaatgtgcccacagcaaaccc

SEQ ID NO: 396029 - DNA, 25 bp, Homo sapien
ccgtaatgtgcccacagcaaacccc

SEQ ID NO: 396030 - DNA, 25 bp, Homo sapien
cgtaatgtgcccacagcaaacccca

SEQ ID NO: 396031 - DNA, 25 bp, Homo sapien
ttcactattatgaagttggcatcgt

SEQ ID NO: 396032 - DNA, 25 bp, Homo sapien
cactattatgaagttggcatcgttc

SEQ ID NO: 396033 - DNA, 25 bp, Homo sapien
actattatgaagttggcatcgttca

SEQ ID NO: 396034 - DNA, 25 bp, Homo sapien
tattatgaagttggcatcgttcagt

SEQ ID NO: 396035 - DNA, 25 bp, Homo sapien
ttatgaagttggcatcgttcagttg

SEQ ID NO: 396036 - DNA, 25 bp, Homo sapien
tatgaagttggcatcgttcagttgg

SEQ ID NO: 396037 - DNA, 25 bp, Homo sapien
atgaagttggcatcgttcagttggt

SEQ ID NO: 396038 - DNA, 25 bp, Homo sapien
tgaagttggcatcgttcagttggtt

SEQ ID NO: 396039 - DNA, 25 bp, Homo sapien
gaagttggcatcgttcagttggtta

SEQ ID NO: 396040 - DNA, 25 bp, Homo sapien
aagttggcatcgttcagttggttag

SEQ ID NO: 396041 - DNA, 25 bp, Homo sapien
agttggcatcgttcagttggttagt

SEQ ID NO: 396042 - DNA, 25 bp, Homo sapien
gagtagttccaggaccagaggttgt

SEQ ID NO: 396043 - DNA, 25 bp, Homo sapien
gttccaggaccagaggttgtgctag

SEQ ID NO: 396044 - DNA, 25 bp, Homo sapien
aggaccagaggttgtgctagttgta

SEQ ID NO: 396045 - DNA, 25 bp, Homo sapien
accagaggttgtgctagttgtagaa

SEQ ID NO: 396046 - DNA, 25 bp, Homo sapien
ggagtagtttcaggaccagagattc

SEQ ID NO: 396047 - DNA, 25 bp, Homo sapien
agagattctgctggttgtagtggca

SEQ ID NO: 396048 - DNA, 25 bp, Homo sapien
agtggcagaggttgtgctgcttata

SEQ ID NO: 396049 - DNA, 25 bp, Homo sapien
cagagtttgtgctggttgtaggtgc

SEQ ID NO: 396050 - DNA, 25 bp, Homo sapien
cagaggttatgctggtggtgggaac

SEQ ID NO: 396051 - DNA, 25 bp, Homo sapien
gggaacagcactgggagtagttcca

SEQ ID NO: 396052 - DNA, 25 bp, Homo sapien
agcactgggagtagttccaggacaa

SEQ ID NO: 396053 - DNA, 25 bp, Homo sapien
accacggagagcactagggacacga

SEQ ID NO: 396054 - DNA, 25 bp, Homo sapien
agagcactagggacacgagttcatc

SEQ ID NO: 396055 - DNA, 25 bp, Homo sapien
actagggacacgagttcatccccta

SEQ ID NO: 396056 - DNA, 25 bp, Homo sapien
tagggacacgagttcatcccctacc

SEQ ID NO: 396057 - DNA, 25 bp, Homo sapien
taaccctactctattccgtaactct

SEQ ID NO: 396058 - DNA, 25 bp, Homo sapien
tactctattccgtaactctcaacgt

SEQ ID NO: 396059 - DNA, 25 bp, Homo sapien
ctctattccgtaactctcaacgtga

SEQ ID NO: 396060 - DNA, 25 bp, Homo sapien
ctattccgtaactctcaacgtgaat

SEQ ID NO: 396061 - DNA, 25 bp, Homo sapien
tcgtgctccccggagtagcatacag

SEQ ID NO: 396062 - DNA, 25 bp, Homo sapien
gctccccggagtagcatacagcatg

SEQ ID NO: 396063 - DNA, 25 bp, Homo sapien
gagtagcatacagcatgctgaatgt

SEQ ID NO: 396064 - DNA, 25 bp, Homo sapien
tccttcagctgcacctgctcctcca

SEQ ID NO: 396065 - DNA, 25 bp, Homo sapien
ctgctcctccagggccatggttgtg

SEQ ID NO: 396066 - DNA, 25 bp, Homo sapien
tgtgaagaagattgaaacccgtgat

SEQ ID NO: 396067 - DNA, 25 bp, Homo sapien
gtgaagaagattgaaacccgtgatg

SEQ ID NO: 396068 - DNA, 25 bp, Homo sapien
tgaagaagattgaaacccgtgatgg

SEQ ID NO: 396069 - DNA, 25 bp, Homo sapien
gaagaagattgaaacccgtgatggg

SEQ ID NO: 396070 - DNA, 25 bp, Homo sapien
aagaagattgaaacccgtgatggga

SEQ ID NO: 396071 - DNA, 25 bp, Homo sapien
agaagattgaaacccgtgatgggaa

SEQ ID NO: 396072 - DNA, 25 bp, Homo sapien
agattgaaacccgtgatgggaagct

SEQ ID NO: 396073 - DNA, 25 bp, Homo sapien
gattgaaacccgtgatgggaagctg

SEQ ID NO: 396074 - DNA, 25 bp, Homo sapien
ttgaaacccgtgatgggaagctggt

SEQ ID NO: 396075 - DNA, 25 bp, Homo sapien
aatataatgatcaccccctcacttt

SEQ ID NO: 396076 - DNA, 25 bp, Homo sapien
atataatgatcaccccctcactttc

SEQ ID NO: 396077 - DNA, 25 bp, Homo sapien
ataatgatcaccccctcactttcgg

SEQ ID NO: 396078 - DNA, 25 bp, Homo sapien
aatgatcaccccctcactttcggcc

SEQ ID NO: 396079 - DNA, 25 bp, Homo sapien
taattttttaacttggtatcagaag

SEQ ID NO: 396080 - DNA, 25 bp, Homo sapien
ttttttaacttggtatcagaagaag

SEQ ID NO: 396081 - DNA, 25 bp, Homo sapien
tttttaacttggtatcagaagaagc

SEQ ID NO: 396082 - DNA, 25 bp, Homo sapien
ttttaacttggtatcagaagaagcc

SEQ ID NO: 396083 - DNA, 25 bp, Homo sapien
tttaacttggtatcagaagaagcca

SEQ ID NO: 396084 - DNA, 25 bp, Homo sapien
ttaacttggtatcagaagaagccag

SEQ ID NO: 396085 - DNA, 25 bp, Homo sapien
taacttggtatcagaagaagccagg

SEQ ID NO: 396086 - DNA, 25 bp, Homo sapien
cctgtctttgaagaagcccctgtgg

SEQ ID NO: 396087 - DNA, 25 bp, Homo sapien
aagcccctgtggagctgaggtgcaa

SEQ ID NO: 396088 - DNA, 25 bp, Homo sapien
atcgtctgtttcagtgtatctcttc

SEQ ID NO: 396089 - DNA, 25 bp, Homo sapien
gtatttatcaggatccaccctggtt

SEQ ID NO: 396090 - DNA, 25 bp, Homo sapien
aacaagagtcaaacttccttccact

SEQ ID NO: 396091 - DNA, 25 bp, Homo sapien
gtcaaacttccttccacttgaggaa

SEQ ID NO: 396092 - DNA, 25 bp, Homo sapien
ttccacttgaggaaaccctcagtcc

SEQ ID NO: 396093 - DNA, 25 bp, Homo sapien
gtctgtgacccagcttgacagccaa

SEQ ID NO: 396094 - DNA, 25 bp, Homo sapien
tgtgacccagcttgacagccaagtc

SEQ ID NO: 396095 - DNA, 25 bp, Homo sapien
cagccaagtccctgtctttgaagaa

SEQ ID NO: 396096 - DNA, 25 bp, Homo sapien
agtccctgtctttgaagaagcccct

SEQ ID NO: 396097 - DNA, 25 bp, Homo sapien
gacatgactggcgattcgcagcatc

SEQ ID NO: 396098 - DNA, 25 bp, Homo sapien
atgactggcgattcgcagcatcctc

SEQ ID NO: 396099 - DNA, 25 bp, Homo sapien
caggcatgcagctagaagatggctg

SEQ ID NO: 396100 - DNA, 25 bp, Homo sapien
tgcagctagaagatggctgtactct

SEQ ID NO: 396101 - DNA, 25 bp, Homo sapien
actggcgattcgcagcatcctcgta

SEQ ID NO: 396102 - DNA, 25 bp, Homo sapien
tggcgattcgcagcatcctcgtatc

SEQ ID NO: 396103 - DNA, 25 bp, Homo sapien
gcgattcgcagcatcctcgtatctg

SEQ ID NO: 396104 - DNA, 25 bp, Homo sapien
ttcgcagcatcctcgtatctgctaa

SEQ ID NO: 396105 - DNA, 25 bp, Homo sapien
gcagcatcctcgtatctgctaacag

SEQ ID NO: 396106 - DNA, 25 bp, Homo sapien
agcatcctcgtatctgctaacaggt

SEQ ID NO: 396107 - DNA, 25 bp, Homo sapien
catcctcgtatctgctaacaggtca

SEQ ID NO: 396108 - DNA, 25 bp, Homo sapien
gtaagttgcgaaatcttcaggctgc

SEQ ID NO: 396109 - DNA, 25 bp, Homo sapien
gaaatcttcaggctgcaggctgctg

SEQ ID NO: 396110 - DNA, 25 bp, Homo sapien
gagagagtgaaatctgtcccagatc

SEQ ID NO: 396111 - DNA, 25 bp, Homo sapien
tgatgggaccccactttgcaaactg

SEQ ID NO: 396112 - DNA, 25 bp, Homo sapien
atggtgggcccacagttcgtttgat

SEQ ID NO: 396113 - DNA, 25 bp, Homo sapien
cactttgcaaactgcttgcagcata

SEQ ID NO: 396114 - DNA, 25 bp, Homo sapien
gcttgcagcatagatcaggagttta

SEQ ID NO: 396115 - DNA, 25 bp, Homo sapien
gtttctgttgataccaggctaacca

SEQ ID NO: 396116 - DNA, 25 bp, Homo sapien
tgataccaggctaaccacctgctaa

SEQ ID NO: 396117 - DNA, 25 bp, Homo sapien
tccctccgccgaaagtgagcgggaa

SEQ ID NO: 396118 - DNA, 25 bp, Homo sapien
gcgggaaactgttagtctgttgaca

SEQ ID NO: 396119 - DNA, 25 bp, Homo sapien
aaatcgaaagagaacatcccagcct

SEQ ID NO: 396120 - DNA, 25 bp, Homo sapien
atcgaaagagaacatcccagcctat

SEQ ID NO: 396121 - DNA, 25 bp, Homo sapien
cccagcctatccattgttgcaaaga

SEQ ID NO: 396122 - DNA, 25 bp, Homo sapien
ccagcctatccattgttgcaaagaa

SEQ ID NO: 396123 - DNA, 25 bp, Homo sapien
gaaactgggagagacatggaatgac

SEQ ID NO: 396124 - DNA, 25 bp, Homo sapien
agacatggaatgacactgctgcaga

SEQ ID NO: 396125 - DNA, 25 bp, Homo sapien
acatggaatgacactgctgcagatg

SEQ ID NO: 396126 - DNA, 25 bp, Homo sapien
atacccaaagaatattgctgcacag

SEQ ID NO: 396127 - DNA, 25 bp, Homo sapien
gaatattgctgcacagtaagctaaa

SEQ ID NO: 396128 - DNA, 25 bp, Homo sapien
attgctgcacagtaagctaaaggaa

SEQ ID NO: 396129 - DNA, 25 bp, Homo sapien
tgcacagtaagctaaaggaaagact

SEQ ID NO: 396130 - DNA, 25 bp, Homo sapien
gggaaactctatggctcaaaagaat

SEQ ID NO: 396131 - DNA, 25 bp, Homo sapien
aacaatgactgtaagctgaaggaga

SEQ ID NO: 396132 - DNA, 25 bp, Homo sapien
atggatacaatacctatgcatcatt

SEQ ID NO: 396133 - DNA, 25 bp, Homo sapien
acctatgcatcatttaactggcagc

SEQ ID NO: 396134 - DNA, 25 bp, Homo sapien
aactggcagcataatgggaggcaaa

SEQ ID NO: 396135 - DNA, 25 bp, Homo sapien
aaggaaaaacacctctgctcacttt

SEQ ID NO: 396136 - DNA, 25 bp, Homo sapien
tgctcactttcttccaatggtggta

SEQ ID NO: 396137 - DNA, 25 bp, Homo sapien
ttcttccaatggtggtacactcata

SEQ ID NO: 396138 - DNA, 25 bp, Homo sapien
gtggtacactcatagaggaaggcaa

SEQ ID NO: 396139 - DNA, 25 bp, Homo sapien
gatgcagtagaaccaatggctcttt

SEQ ID NO: 396140 - DNA, 25 bp, Homo sapien
atggctctttgccaagaatagtgga

SEQ ID NO: 396141 - DNA, 25 bp, Homo sapien
tgtttccggtggctccatcggcaga

SEQ ID NO: 396142 - DNA, 25 bp, Homo sapien
tccatcggcagaggcagttactact

SEQ ID NO: 396143 - DNA, 25 bp, Homo sapien
gcagttactactgggcctgggtccg

SEQ ID NO: 396144 - DNA, 25 bp, Homo sapien
gtgtctattatactgggagcaccaa

SEQ ID NO: 396145 - DNA, 25 bp, Homo sapien
agcagtcgaggcaccatttcagtgg

SEQ ID NO: 396146 - DNA, 25 bp, Homo sapien
gcaccatttcagtggacacggccaa

SEQ ID NO: 396147 - DNA, 25 bp, Homo sapien
gtggacacggccaaggaccagttct

SEQ ID NO: 396148 - DNA, 25 bp, Homo sapien
agttctccctgaatttcaactctgt

SEQ ID NO: 396149 - DNA, 25 bp, Homo sapien
cctgaatttcaactctgtgaccgcc

SEQ ID NO: 396150 - DNA, 25 bp, Homo sapien
tgtgcgagggccgtcggtggtaaaa

SEQ ID NO: 396151 - DNA, 25 bp, Homo sapien
gtaaaaacccaatctttgagtactg

SEQ ID NO: 396152 - DNA, 25 bp, Homo sapien
ggacttcatcaccatcaaggttctg

SEQ ID NO: 396153 - DNA, 25 bp, Homo sapien
atcaccatcaaggttctgggcccag

SEQ ID NO: 396154 - DNA, 25 bp, Homo sapien
agtggcagttacagtggaagtgaca

SEQ ID NO: 396155 - DNA, 25 bp, Homo sapien
agtggaagtgacagtagtcaacccc

SEQ ID NO: 396156 - DNA, 25 bp, Homo sapien
gaacagctcagcatcgacgtgccta

SEQ ID NO: 396157 - DNA, 25 bp, Homo sapien
tcaggagagggcctcagtccagttt

SEQ ID NO: 396158 - DNA, 25 bp, Homo sapien
agggcctcagtccagtttgacatca

SEQ ID NO: 396159 - DNA, 25 bp, Homo sapien
aaagtggcccaaggcagctgcaggt

SEQ ID NO: 396160 - DNA, 25 bp, Homo sapien
agctgcaggtggaccttgtaagccc

SEQ ID NO: 396161 - DNA, 25 bp, Homo sapien
aggtggaccttgtaagccctcactt

SEQ ID NO: 396162 - DNA, 25 bp, Homo sapien
tcacttcccggacatcaagggcttt

SEQ ID NO: 396163 - DNA, 25 bp, Homo sapien
ttccaggtaatgagccagtggtttc

SEQ ID NO: 396164 - DNA, 25 bp, Homo sapien
agccagtggtttctttcattttaat

SEQ ID NO: 396165 - DNA, 25 bp, Homo sapien
acttgctgatcacttagcagttgct

SEQ ID NO: 396166 - DNA, 25 bp, Homo sapien
agcagttgctgcttccaagaggtct

SEQ ID NO: 396167 - DNA, 25 bp, Homo sapien
aagaggtcttggtccatgaagtggc

SEQ ID NO: 396168 - DNA, 25 bp, Homo sapien
gtggcaaggtctgaatgttggctaa

SEQ ID NO: 396169 - DNA, 25 bp, Homo sapien
aagtttaactagagcagtagccata

SEQ ID NO: 396170 - DNA, 25 bp, Homo sapien
gccataaagtattgtgggagctcag

SEQ ID NO: 396171 - DNA, 25 bp, Homo sapien
gctcagagtgggtatgctttcataa

SEQ ID NO: 396172 - DNA, 25 bp, Homo sapien
atgctttcataatctgggtgacagg

SEQ ID NO: 396173 - DNA, 25 bp, Homo sapien
gtggtcagcttaccttctacaagag

SEQ ID NO: 396174 - DNA, 25 bp, Homo sapien
tccatggtctcttcggatggaagac

SEQ ID NO: 396175 - DNA, 25 bp, Homo sapien
gtctcttcggatggaagacaggtca

SEQ ID NO: 396176 - DNA, 25 bp, Homo sapien
cttcggatggaagacaggtcaagcc

SEQ ID NO: 396177 - DNA, 25 bp, Homo sapien
acaggtcaagccgttggattatttt

SEQ ID NO: 396178 - DNA, 25 bp, Homo sapien
ggtcaagccgttggattattttaca

SEQ ID NO: 396179 - DNA, 25 bp, Homo sapien
aagccgttggattattttacacaga

SEQ ID NO: 396180 - DNA, 25 bp, Homo sapien
aagcacatctctggaacaaagtgat

SEQ ID NO: 396181 - DNA, 25 bp, Homo sapien
acatctctggaacaaagtgatcttt

SEQ ID NO: 396182 - DNA, 25 bp, Homo sapien
ggaacaaagtgatctttgccagcat

SEQ ID NO: 396183 - DNA, 25 bp, Homo sapien
gccacactgtggaaaaggcaggcaa

SEQ ID NO: 396184 - DNA, 25 bp, Homo sapien
ggcaggcaagcacaggactgggcct

SEQ ID NO: 396185 - DNA, 25 bp, Homo sapien
ttagtgtggctctggctgtcatctc

SEQ ID NO: 396186 - DNA, 25 bp, Homo sapien
gcagcacttgcccagaaatcactgc

SEQ ID NO: 396187 - DNA, 25 bp, Homo sapien
tgcccagaaatcactgcctgtggac

SEQ ID NO: 396188 - DNA, 25 bp, Homo sapien
tgcatgttccagagttgacctgatg

SEQ ID NO: 396189 - DNA, 25 bp, Homo sapien
tgacctgatgataactcgtgaagca

SEQ ID NO: 396190 - DNA, 25 bp, Homo sapien
agcatgaattctagcttcctgggag

SEQ ID NO: 396191 - DNA, 25 bp, Homo sapien
ttctagcttcctgggaggtggctca

SEQ ID NO: 396192 - DNA, 25 bp, Homo sapien
agaagccatgaggaatgtcacttgt

SEQ ID NO: 396193 - DNA, 25 bp, Homo sapien
aggaatgtcacttgtgggccgccac

SEQ ID NO: 396194 - DNA, 25 bp, Homo sapien
ggatgtcaggtagagcggcctacct

SEQ ID NO: 396195 - DNA, 25 bp, Homo sapien
agcggcctacctctgcctattttaa

SEQ ID NO: 396196 - DNA, 25 bp, Homo sapien
atttactgtattctgaacaagagaa

SEQ ID NO: 396197 - DNA, 25 bp, Homo sapien
gagaaagacagcttaactcctgatc

SEQ ID NO: 396198 - DNA, 25 bp, Homo sapien
gaaagacagcttaactcctgatctc

SEQ ID NO: 396199 - DNA, 25 bp, Homo sapien
aaagacagcttaactcctgatctcc

SEQ ID NO: 396200 - DNA, 25 bp, Homo sapien
aagacagcttaactcctgatctccc

SEQ ID NO: 396201 - DNA, 25 bp, Homo sapien
agacagcttaactcctgatctccct

SEQ ID NO: 396202 - DNA, 25 bp, Homo sapien
ttaactcctgatctccctcctaata

SEQ ID NO: 396203 - DNA, 25 bp, Homo sapien
taactcctgatctccctcctaatat

SEQ ID NO: 396204 - DNA, 25 bp, Homo sapien
tcctaatatcacactgtcctggcag

SEQ ID NO: 396205 - DNA, 25 bp, Homo sapien
ctaatatcacactgtcctggcagca

SEQ ID NO: 396206 - DNA, 25 bp, Homo sapien
taatatcacactgtcctggcagcag

SEQ ID NO: 396207 - DNA, 25 bp, Homo sapien
caccatgtcagaggcagttgtggac

SEQ ID NO: 396208 - DNA, 25 bp, Homo sapien
gtcagaggcagttgtggacacaagc

SEQ ID NO: 396209 - DNA, 25 bp, Homo sapien
gtggacacaagctccgtgatcacca

SEQ ID NO: 396210 - DNA, 25 bp, Homo sapien
aagctccgtgatcaccaccaaggac

SEQ ID NO: 396211 - DNA, 25 bp, Homo sapien
tgcctcagagtctggcagcttaatc

SEQ ID NO: 396212 - DNA, 25 bp, Homo sapien
cagagtctggcagcttaatcgacat

SEQ ID NO: 396213 - DNA, 25 bp, Homo sapien
tggcagcttaatcgacatagtcccc

SEQ ID NO: 396214 - DNA, 25 bp, Homo sapien
taatcgacatagtccccaaactctc

SEQ ID NO: 396215 - DNA, 25 bp, Homo sapien
ccaaactctcactttcttcttaatc

SEQ ID NO: 396216 - DNA, 25 bp, Homo sapien
tcactttcttcttaatcccttgcat

SEQ ID NO: 396217 - DNA, 25 bp, Homo sapien
taatcccttgcatcggatcaccgct

SEQ ID NO: 396218 - DNA, 25 bp, Homo sapien
agaggccttctggagcctttatctt

SEQ ID NO: 396219 - DNA, 25 bp, Homo sapien
gagcctttatcttgttcggttctga

SEQ ID NO: 396220 - DNA, 25 bp, Homo sapien
tgttcggttctgagtaccgcccaaa

SEQ ID NO: 396221 - DNA, 25 bp, Homo sapien
tgagtaccgcccaaaaatcaaaaat

SEQ ID NO: 396222 - DNA, 25 bp, Homo sapien
aatcaaaaataacatcccagcctat

SEQ ID NO: 396223 - DNA, 25 bp, Homo sapien
cccagcctatccattagtaacgttg

SEQ ID NO: 396224 - DNA, 25 bp, Homo sapien
ctatccattagtaacgttgcaaaga

SEQ ID NO: 396225 - DNA, 25 bp, Homo sapien
tgcagacaataagcagccatgtgaa

SEQ ID NO: 396226 - DNA, 25 bp, Homo sapien
catgtgaaaggaaggctgcaaagct

SEQ ID NO: 396227 - DNA, 25 bp, Homo sapien
aaggatatcgttgtacacggagcta

SEQ ID NO: 396228 - DNA, 25 bp, Homo sapien
tcgttgtacacggagctaaaggaaa

SEQ ID NO: 396229 - DNA, 25 bp, Homo sapien
aattatatgaacacacattcttttt

SEQ ID NO: 396230 - DNA, 25 bp, Homo sapien
tttggcaaagaaaattgagcctcta

SEQ ID NO: 396231 - DNA, 25 bp, Homo sapien
attgagcctctaaaaacttgaccct

SEQ ID NO: 396232 - DNA, 25 bp, Homo sapien
tgacaaaaaaggctttggataacct

SEQ ID NO: 396233 - DNA, 25 bp, Homo sapien
gaacatggaatagtctctcaagtac

SEQ ID NO: 396234 - DNA, 25 bp, Homo sapien
gtctctcaagtacatgaagtaggcc

SEQ ID NO: 396235 - DNA, 25 bp, Homo sapien
gtaggcctccttcagatgtacctga

SEQ ID NO: 396236 - DNA, 25 bp, Homo sapien
ggcctccttcagatgtacctgaaga

SEQ ID NO: 396237 - DNA, 25 bp, Homo sapien
gcctggcaggacaaaagaggacctc

SEQ ID NO: 396238 - DNA, 25 bp, Homo sapien
gaggacctcaggaaacaatataagg

SEQ ID NO: 396239 - DNA, 25 bp, Homo sapien
gtaaaggcaatgaaatgcccaggag

SEQ ID NO: 396240 - DNA, 25 bp, Homo sapien
atataagctgccttctgtggtcata

SEQ ID NO: 396241 - DNA, 25 bp, Homo sapien
ctgtggtcatatgccaacattcttc

SEQ ID NO: 396242 - DNA, 25 bp, Homo sapien
tagaacttctatttgcagtgatctg

SEQ ID NO: 396243 - DNA, 25 bp, Homo sapien
gaacttctatttgcagtgatctgtg

SEQ ID NO: 396244 - DNA, 25 bp, Homo sapien
cttctatttgcagtgatctgtggaa

SEQ ID NO: 396245 - DNA, 25 bp, Homo sapien
tgcagtgatctgtggaacttaaagc

SEQ ID NO: 396246 - DNA, 25 bp, Homo sapien
gtgatctgtggaacttaaagcaacc

SEQ ID NO: 396247 - DNA, 25 bp, Homo sapien
gatctgtggaacttaaagcaacctc

SEQ ID NO: 396248 - DNA, 25 bp, Homo sapien
ctgtggaacttaaagcaacctcaaa

SEQ ID NO: 396249 - DNA, 25 bp, Homo sapien
tggaacttaaagcaacctcaaacaa

SEQ ID NO: 396250 - DNA, 25 bp, Homo sapien
ttaaagcaacctcaaacaaaattag

SEQ ID NO: 396251 - DNA, 25 bp, Homo sapien
tcgcaaagagaggacaggatgtagc

SEQ ID NO: 396252 - DNA, 25 bp, Homo sapien
aagagaggacaggatgtagctctca

SEQ ID NO: 396253 - DNA, 25 bp, Homo sapien
gtgtgatccaatttcgggtcatgta

SEQ ID NO: 396254 - DNA, 25 bp, Homo sapien
tgtgatccaatttcgggtcatgtat

SEQ ID NO: 396255 - DNA, 25 bp, Homo sapien
atccaatttcgggtcatgtatccct

SEQ ID NO: 396256 - DNA, 25 bp, Homo sapien
tccaatttcgggtcatgtatccctt

SEQ ID NO: 396257 - DNA, 25 bp, Homo sapien
caatttcgggtcatgtatccctttt

SEQ ID NO: 396258 - DNA, 25 bp, Homo sapien
gtcccctaggtacaaagtcgcaaag

SEQ ID NO: 396259 - DNA, 25 bp, Homo sapien
tcccctaggtacaaagtcgcaaaga

SEQ ID NO: 396260 - DNA, 25 bp, Homo sapien
ccctaggtacaaagtcgcaaagaga

SEQ ID NO: 396261 - DNA, 25 bp, Homo sapien
taggtacaaagtcgcaaagagagga

SEQ ID NO: 396262 - DNA, 25 bp, Homo sapien
aaggaatcgcactaatatcagtata

SEQ ID NO: 396263 - DNA, 25 bp, Homo sapien
gacagatactagcaccaatttctat

SEQ ID NO: 396264 - DNA, 25 bp, Homo sapien
agcaccaatttctatcatattccaa

SEQ ID NO: 396265 - DNA, 25 bp, Homo sapien
tatcatattccaaatctttccctca

SEQ ID NO: 396266 - DNA, 25 bp, Homo sapien
tttccctcagtggacctaaatacac

SEQ ID NO: 396267 - DNA, 25 bp, Homo sapien
acactattaacaattgcagcactat

SEQ ID NO: 396268 - DNA, 25 bp, Homo sapien
agcactatctatcttagtaggagat

SEQ ID NO: 396269 - DNA, 25 bp, Homo sapien
gggctcaatcaaacacagctctgaa

SEQ ID NO: 396270 - DNA, 25 bp, Homo sapien
ttagcatatacgtcaattgccgata

SEQ ID NO: 396271 - DNA, 25 bp, Homo sapien
gtcattacaatcttaagtctactaa

SEQ ID NO: 396272 - DNA, 25 bp, Homo sapien
aacagcaactgtatctattctcaat

SEQ ID NO: 396273 - DNA, 25 bp, Homo sapien
cagtctggagtctggtgatgcccag

SEQ ID NO: 396274 - DNA, 25 bp, Homo sapien
cccagggtggctgacgtgccagact

SEQ ID NO: 396275 - DNA, 25 bp, Homo sapien
cctgagggtcgcttattatttttat

SEQ ID NO: 396276 - DNA, 25 bp, Homo sapien
gctggtaccaggatacataattctt

SEQ ID NO: 396277 - DNA, 25 bp, Homo sapien
ggatacataattcttcccaatgttg

SEQ ID NO: 396278 - DNA, 25 bp, Homo sapien
actcaggctgctatcccatgttccg

SEQ ID NO: 396279 - DNA, 25 bp, Homo sapien
tgctatcccatgttccgcagtaata

SEQ ID NO: 396280 - DNA, 25 bp, Homo sapien
ctatcccatgttccgcagtaataat

SEQ ID NO: 396281 - DNA, 25 bp, Homo sapien
gttccgcagtaataatcggcctcgt

SEQ ID NO: 396282 - DNA, 25 bp, Homo sapien
gtaataatcggcctcgtccccagtc

SEQ ID NO: 396283 - DNA, 25 bp, Homo sapien
aatcggcctcgtccccagtctggag

SEQ ID NO: 396284 - DNA, 25 bp, Homo sapien
ttgctcctaacttgctcttggacag

SEQ ID NO: 396285 - DNA, 25 bp, Homo sapien
gctcctaacttgctcttggacagga

SEQ ID NO: 396286 - DNA, 25 bp, Homo sapien
taacttgctcttggacaggaaccag

SEQ ID NO: 396287 - DNA, 25 bp, Homo sapien
ttgctcttggacaggaaccagggaa

SEQ ID NO: 396288 - DNA, 25 bp, Homo sapien
agatcctgatgattggtctcgtctg

SEQ ID NO: 396289 - DNA, 25 bp, Homo sapien
gatcctgatgattggtctcgtctgg

SEQ ID NO: 396290 - DNA, 25 bp, Homo sapien
atcctgatgattggtctcgtctggc

SEQ ID NO: 396291 - DNA, 25 bp, Homo sapien
cctgatgattggtctcgtctggcgc

SEQ ID NO: 396292 - DNA, 25 bp, Homo sapien
tgatgattggtctcgtctggcgctc

SEQ ID NO: 396293 - DNA, 25 bp, Homo sapien
atgattggtctcgtctggcgctcca

SEQ ID NO: 396294 - DNA, 25 bp, Homo sapien
ttggtctcgtctggcgctccatgga

SEQ ID NO: 396295 - DNA, 25 bp, Homo sapien
attactggcagtcctatgacaggag

SEQ ID NO: 396296 - DNA, 25 bp, Homo sapien
ttactggcagtcctatgacaggagt

SEQ ID NO: 396297 - DNA, 25 bp, Homo sapien
tactggcagtcctatgacaggagtc

SEQ ID NO: 396298 - DNA, 25 bp, Homo sapien
actggcagtcctatgacaggagtct

SEQ ID NO: 396299 - DNA, 25 bp, Homo sapien
ctggcagtcctatgacaggagtctg

SEQ ID NO: 396300 - DNA, 25 bp, Homo sapien
tggcagtcctatgacaggagtctga

SEQ ID NO: 396301 - DNA, 25 bp, Homo sapien
cagtcctatgacaggagtctgagtg

SEQ ID NO: 396302 - DNA, 25 bp, Homo sapien
gacaggagtctgagtggtgtggtat

SEQ ID NO: 396303 - DNA, 25 bp, Homo sapien
gaaattactgtaaactggtaccagc

SEQ ID NO: 396304 - DNA, 25 bp, Homo sapien
aattactgtaaactggtaccagcag

SEQ ID NO: 396305 - DNA, 25 bp, Homo sapien
attactgtaaactggtaccagcagc

SEQ ID NO: 396306 - DNA, 25 bp, Homo sapien
gagagcccaggccataatttccacc

SEQ ID NO: 396307 - DNA, 25 bp, Homo sapien
aatttccaccacagatgatgccact

SEQ ID NO: 396308 - DNA, 25 bp, Homo sapien
tttccaccacagatgatgccactgc

SEQ ID NO: 396309 - DNA, 25 bp, Homo sapien
ccatgcccagtgcaagcttcagttt

SEQ ID NO: 396310 - DNA, 25 bp, Homo sapien
caacagttctcctccacgttatgaa

SEQ ID NO: 396311 - DNA, 25 bp, Homo sapien
agagtttttggccaagctatacaat

SEQ ID NO: 396312 - DNA, 25 bp, Homo sapien
gagtttttggccaagctatacaata

SEQ ID NO: 396313 - DNA, 25 bp, Homo sapien
gtttttggccaagctatacaatagt

SEQ ID NO: 396314 - DNA, 25 bp, Homo sapien
tttggccaagctatacaatagtatc

SEQ ID NO: 396315 - DNA, 25 bp, Homo sapien
ggccaagctatacaatagtatccct

SEQ ID NO: 396316 - DNA, 25 bp, Homo sapien
atagtatccctatttcctttccatc

SEQ ID NO: 396317 - DNA, 25 bp, Homo sapien
tgagaacctcatccgaaagcataca

SEQ ID NO: 396318 - DNA, 25 bp, Homo sapien
ctcatccgaaagcatacaggttctg

SEQ ID NO: 396319 - DNA, 25 bp, Homo sapien
tggcctttggcaaggtgaaagaacg

SEQ ID NO: 396320 - DNA, 25 bp, Homo sapien
tttggcaaggtgaaagaacgtgtga

SEQ ID NO: 396321 - DNA, 25 bp, Homo sapien
gaacgtgtgaatattgtggaagcca

SEQ ID NO: 396322 - DNA, 25 bp, Homo sapien
acgtgtgaatattgtggaagccatg

SEQ ID NO: 396323 - DNA, 25 bp, Homo sapien
ggaagccatggagcactttgggtac

SEQ ID NO: 396324 - DNA, 25 bp, Homo sapien
aagccatggagcactttgggtacag

SEQ ID NO: 396325 - DNA, 25 bp, Homo sapien
atggagcactttgggtacaggaata

SEQ ID NO: 396326 - DNA, 25 bp, Homo sapien
gagcactttgggtacaggaatagca

SEQ ID NO: 396327 - DNA, 25 bp, Homo sapien
actttgggtacaggaatagcaagac

SEQ ID NO: 396328 - DNA, 25 bp, Homo sapien
tactgtgcgagagggccggagtggt

SEQ ID NO: 396329 - DNA, 25 bp, Homo sapien
ctgtgcgagagggccggagtggtta

SEQ ID NO: 396330 - DNA, 25 bp, Homo sapien
gtgcgagagggccggagtggttact

SEQ ID NO: 396331 - DNA, 25 bp, Homo sapien
gcgagagggccggagtggttactcg

SEQ ID NO: 396332 - DNA, 25 bp, Homo sapien
gagagggccggagtggttactcggt

SEQ ID NO: 396333 - DNA, 25 bp, Homo sapien
gagggccggagtggttactcggtat

SEQ ID NO: 396334 - DNA, 25 bp, Homo sapien
agggccggagtggttactcggtatg

SEQ ID NO: 396335 - DNA, 25 bp, Homo sapien
gggccggagtggttactcggtatgg

SEQ ID NO: 396336 - DNA, 25 bp, Homo sapien
ggccggagtggttactcggtatgga

SEQ ID NO: 396337 - DNA, 25 bp, Homo sapien
gccggagtggttactcggtatggac

SEQ ID NO: 396338 - DNA, 25 bp, Homo sapien
agtggttactcggtatggacgtctg

SEQ ID NO: 396339 - DNA, 25 bp, Homo sapien
atatgttgcaacgtcgtcaggctgg

SEQ ID NO: 396340 - DNA, 25 bp, Homo sapien
gcaacgtcgtcaggctggaagctgc

SEQ ID NO: 396341 - DNA, 25 bp, Homo sapien
tcaggctggaagctgccgatggtga

SEQ ID NO: 396342 - DNA, 25 bp, Homo sapien
acggtgcaggcccagtacgtctgat

SEQ ID NO: 396343 - DNA, 25 bp, Homo sapien
gtgcaggcccagtacgtctgatatc

SEQ ID NO: 396344 - DNA, 25 bp, Homo sapien
aggcccagtacgtctgatatccact

SEQ ID NO: 396345 - DNA, 25 bp, Homo sapien
aaagagttggtaatgtcctgactcg

SEQ ID NO: 396346 - DNA, 25 bp, Homo sapien
gtacgtctgatatccactttggtcc

SEQ ID NO: 396347 - DNA, 25 bp, Homo sapien
cagggccgaaagtaattgggagatc

SEQ ID NO: 396348 - DNA, 25 bp, Homo sapien
attgggagatcatcatagtgttgac

SEQ ID NO: 396349 - DNA, 25 bp, Homo sapien
gagatcatcatagtgttgacagtaa

SEQ ID NO: 396350 - DNA, 25 bp, Homo sapien
ggacattatcaccttaaaaacacag

SEQ ID NO: 396351 - DNA, 25 bp, Homo sapien
aaacacagagcatgttcaagaacac

SEQ ID NO: 396352 - DNA, 25 bp, Homo sapien
gtgacactggatggaagcaaacttt

SEQ ID NO: 396353 - DNA, 25 bp, Homo sapien
agcaaactttttcacctgcagaagt

SEQ ID NO: 396354 - DNA, 25 bp, Homo sapien
ttcacctgcagaagtgtaacgggca

SEQ ID NO: 396355 - DNA, 25 bp, Homo sapien
gtgtaacgggcaagagaggacactt

SEQ ID NO: 396356 - DNA, 25 bp, Homo sapien
agagaggacacttgtgccagagcta

SEQ ID NO: 396357 - DNA, 25 bp, Homo sapien
gccagagctaagtgatgggaaactc

SEQ ID NO: 396358 - DNA, 25 bp, Homo sapien
tcacccagggcactgcggtttacac

SEQ ID NO: 396359 - DNA, 25 bp, Homo sapien
agggcactgcggtttacactcgcac

SEQ ID NO: 396360 - DNA, 25 bp, Homo sapien
gaaagaggtatcgtctgcctgcgct

SEQ ID NO: 396361 - DNA, 25 bp, Homo sapien
gactgtatagcatatgctgcatgcc

SEQ ID NO: 396362 - DNA, 25 bp, Homo sapien
gctgcatgccataaatgtatagact

SEQ ID NO: 396363 - DNA, 25 bp, Homo sapien
tgttaataaggtgcctgcggtgcca

SEQ ID NO: 396364 - DNA, 25 bp, Homo sapien
ggtgcctgcggtgccagaaaccatt

SEQ ID NO: 396365 - DNA, 25 bp, Homo sapien
agaaaccattgaacccagcagaaaa

SEQ ID NO: 396366 - DNA, 25 bp, Homo sapien
cagcagaaaaacgtagacaccttaa

SEQ ID NO: 396367 - DNA, 25 bp, Homo sapien
agacaccttaaggacaaacgaagat

SEQ ID NO: 396368 - DNA, 25 bp, Homo sapien
aaacgaagattccacagcatagctg

SEQ ID NO: 396369 - DNA, 25 bp, Homo sapien
gcatagctggacagtaccgagggca

SEQ ID NO: 396370 - DNA, 25 bp, Homo sapien
taccgagggcagtgtaatacatgtt

SEQ ID NO: 396371 - DNA, 25 bp, Homo sapien
atacatgttgtgaccaggcacggca

SEQ ID NO: 396372 - DNA, 25 bp, Homo sapien
cctgagggccgcttaatgacatcat

SEQ ID NO: 396373 - DNA, 25 bp, Homo sapien
ctgagggccgcttaatgacatcata

SEQ ID NO: 396374 - DNA, 25 bp, Homo sapien
gagggccgcttaatgacatcataaa

SEQ ID NO: 396375 - DNA, 25 bp, Homo sapien
gggccgcttaatgacatcataaatc

SEQ ID NO: 396376 - DNA, 25 bp, Homo sapien
atgacatcataaatcatgagtgtgg

SEQ ID NO: 396377 - DNA, 25 bp, Homo sapien
atggtgactgactgtccaggagatc

SEQ ID NO: 396378 - DNA, 25 bp, Homo sapien
ggtgactgactgtccaggagatccg

SEQ ID NO: 396379 - DNA, 25 bp, Homo sapien
aagacataaaaactgcctgcatttg

SEQ ID NO: 396380 - DNA, 25 bp, Homo sapien
taaaaactgcctgcatttgagctgc

SEQ ID NO: 396381 - DNA, 25 bp, Homo sapien
gcatttgagctgcaataataatcag

SEQ ID NO: 396382 - DNA, 25 bp, Homo sapien
tgagctgcaataataatcagcctca

SEQ ID NO: 396383 - DNA, 25 bp, Homo sapien
tcaagtccttctccatggctaaggg

SEQ ID NO: 396384 - DNA, 25 bp, Homo sapien
caagtccttctccatggctaagggc

SEQ ID NO: 396385 - DNA, 25 bp, Homo sapien
aagtccttctccatggctaagggcc

SEQ ID NO: 396386 - DNA, 25 bp, Homo sapien
agtccttctccatggctaagggcct

SEQ ID NO: 396387 - DNA, 25 bp, Homo sapien
gtccttctccatggctaagggcctg

SEQ ID NO: 396388 - DNA, 25 bp, Homo sapien
cttctccatggctaagggcctgaat

SEQ ID NO: 396389 - DNA, 25 bp, Homo sapien
ttctccatggctaagggcctgaatg

SEQ ID NO: 396390 - DNA, 25 bp, Homo sapien
ctccatggctaagggcctgaatgcc

SEQ ID NO: 396391 - DNA, 25 bp, Homo sapien
atgccaggatgatgcgaggcctctc

SEQ ID NO: 396392 - DNA, 25 bp, Homo sapien
ccaggatgatgcgaggcctctccta

SEQ ID NO: 396393 - DNA, 25 bp, Homo sapien
aggatgatgcgaggcctctcctact

SEQ ID NO: 396394 - DNA, 25 bp, Homo sapien
gagctggacgtgtgcgtggaggagg

SEQ ID NO: 396395 - DNA, 25 bp, Homo sapien
agctggacgtgtgcgtggaggaggc

SEQ ID NO: 396396 - DNA, 25 bp, Homo sapien
gccgagggcgaggcgccgtggacgt

SEQ ID NO: 396397 - DNA, 25 bp, Homo sapien
ccgagggcgaggcgccgtggacgtg

SEQ ID NO: 396398 - DNA, 25 bp, Homo sapien
cgtggaccggcctctgcatcttcgc

SEQ ID NO: 396399 - DNA, 25 bp, Homo sapien
gtggaccggcctctgcatcttcgcc

SEQ ID NO: 396400 - DNA, 25 bp, Homo sapien
tggaccggcctctgcatcttcgccg

SEQ ID NO: 396401 - DNA, 25 bp, Homo sapien
gcatcttcgccgcactcttcctgct

SEQ ID NO: 396402 - DNA, 25 bp, Homo sapien
catcttcgccgcactcttcctgctc

SEQ ID NO: 396403 - DNA, 25 bp, Homo sapien
atcttcgccgcactcttcctgctca

SEQ ID NO: 396404 - DNA, 25 bp, Homo sapien
gatatatagtacgatagaagtcaga

SEQ ID NO: 396405 - DNA, 25 bp, Homo sapien
tagaagtcagatatgttatgcacaa

SEQ ID NO: 396406 - DNA, 25 bp, Homo sapien
agatatgttatgcacaatctgtgaa

SEQ ID NO: 396407 - DNA, 25 bp, Homo sapien
ttatgcacaatctgtgaagagcaga

SEQ ID NO: 396408 - DNA, 25 bp, Homo sapien
aagagcagattcaccatctccaaag

SEQ ID NO: 396409 - DNA, 25 bp, Homo sapien
ctggattaaccttcagtagctactg

SEQ ID NO: 396410 - DNA, 25 bp, Homo sapien
ggattaaccttcagtagctactgaa

SEQ ID NO: 396411 - DNA, 25 bp, Homo sapien
cagtagctactgaatgagctcagat

SEQ ID NO: 396412 - DNA, 25 bp, Homo sapien
tactgaatgagctcagattcccagg

SEQ ID NO: 396413 - DNA, 25 bp, Homo sapien
agctcagattcccaggctccaggga

SEQ ID NO: 396414 - DNA, 25 bp, Homo sapien
ggctggagtgagtagtagatatata

SEQ ID NO: 396415 - DNA, 25 bp, Homo sapien
accagcaggtcaccttctgtgatcc

SEQ ID NO: 396416 - DNA, 25 bp, Homo sapien
gcaggtcaccttctgtgatccccat

SEQ ID NO: 396417 - DNA, 25 bp, Homo sapien
atcccaaggcactggtggtgactct

SEQ ID NO: 396418 - DNA, 25 bp, Homo sapien
aaggcactggtggtgactctgcttc

SEQ ID NO: 396419 - DNA, 25 bp, Homo sapien
ggcactggtggtgactctgcttcct

SEQ ID NO: 396420 - DNA, 25 bp, Homo sapien
tctgcctgtgcactgcaagctgtgt

SEQ ID NO: 396421 - DNA, 25 bp, Homo sapien
gtgcactgcaagctgtgtctactca

SEQ ID NO: 396422 - DNA, 25 bp, Homo sapien
actgcaagctgtgtctactcaggcc

SEQ ID NO: 396423 - DNA, 25 bp, Homo sapien
gcaagctgtgtctactcaggcccca

SEQ ID NO: 396424 - DNA, 25 bp, Homo sapien
aaggggactctctgtttccattctc

SEQ ID NO: 396425 - DNA, 25 bp, Homo sapien
cccacagacctgtcaagagaagcat

SEQ ID NO: 396426 - DNA, 25 bp, Homo sapien
gatacagccaccagggcggtcccag

SEQ ID NO: 396427 - DNA, 25 bp, Homo sapien
agagaccctcctatacatgttctgg

SEQ ID NO: 396428 - DNA, 25 bp, Homo sapien
agaccctcctatacatgttctggtt

SEQ ID NO: 396429 - DNA, 25 bp, Homo sapien
tcctatacatgttctggttccactt

SEQ ID NO: 396430 - DNA, 25 bp, Homo sapien
tatacatgttctggttccacttctg

SEQ ID NO: 396431 - DNA, 25 bp, Homo sapien
tggttccacttctggtgatcatggt

SEQ ID NO: 396432 - DNA, 25 bp, Homo sapien
ccacttctggtgatcatggtatgaa

SEQ ID NO: 396433 - DNA, 25 bp, Homo sapien
ttagctgggttttccttgttggtat

SEQ ID NO: 396434 - DNA, 25 bp, Homo sapien
aaaggtatgcaatgtgaggtgcaac

SEQ ID NO: 396435 - DNA, 25 bp, Homo sapien
atgtgaggtgcaactggtggaatct

SEQ ID NO: 396436 - DNA, 25 bp, Homo sapien
gaggctcgatacagccaccagggcg

SEQ ID NO: 396437 - DNA, 25 bp, Homo sapien
gttcacgtgcacatctctaagtcta

SEQ ID NO: 396438 - DNA, 25 bp, Homo sapien
tggttggctgatccaactgttccac

SEQ ID NO: 396439 - DNA, 25 bp, Homo sapien
gaagatcgaatctgctctgcgtaac

SEQ ID NO: 396440 - DNA, 25 bp, Homo sapien
tgaaaaggttaccaactctgtttct

SEQ ID NO: 396441 - DNA, 25 bp, Homo sapien
ctctgtttcttctaagcttcaacca

SEQ ID NO: 396442 - DNA, 25 bp, Homo sapien
gcttcaaccatacttccaaactctg

SEQ ID NO: 396443 - DNA, 25 bp, Homo sapien
ccaaactctgccagtcatgactaag

SEQ ID NO: 396444 - DNA, 25 bp, Homo sapien
gatcgattctgtggctggtatcaac

SEQ ID NO: 396445 - DNA, 25 bp, Homo sapien
tatcaactacggtctggttgctcca

SEQ ID NO: 396446 - DNA, 25 bp, Homo sapien
tactgctgagactctggacgttcaa

SEQ ID NO: 396447 - DNA, 25 bp, Homo sapien
gaagggtgaattctactctgaaaac

SEQ ID NO: 396448 - DNA, 25 bp, Homo sapien
gacattggagccgtcttcgggctca

SEQ ID NO: 396449 - DNA, 25 bp, Homo sapien
acattggagccgtcttcgggctcag

SEQ ID NO: 396450 - DNA, 25 bp, Homo sapien
cattggagccgtcttcgggctcagc

SEQ ID NO: 396451 - DNA, 25 bp, Homo sapien
attggagccgtcttcgggctcagct

SEQ ID NO: 396452 - DNA, 25 bp, Homo sapien
ttggagccgtcttcgggctcagctt

SEQ ID NO: 396453 - DNA, 25 bp, Homo sapien
tggagccgtcttcgggctcagcttc

SEQ ID NO: 396454 - DNA, 25 bp, Homo sapien
gggctcagcttcccaccttgtcttg

SEQ ID NO: 396455 - DNA, 25 bp, Homo sapien
acgggctcaagaagtatgaggctgc

SEQ ID NO: 396456 - DNA, 25 bp, Homo sapien
gggctcaagaagtatgaggctgcct

SEQ ID NO: 396457 - DNA, 25 bp, Homo sapien
aagtatgaggctgcctatggaaaag

SEQ ID NO: 396458 - DNA, 25 bp, Homo sapien
gtatgaggctgcctatggaaaagag

SEQ ID NO: 396459 - DNA, 25 bp, Homo sapien
tctgccactacaaccagcagaatct

SEQ ID NO: 396460 - DNA, 25 bp, Homo sapien
aaccagcagaatctctggtcctgaa

SEQ ID NO: 396461 - DNA, 25 bp, Homo sapien
gcagaatctctggtcctgaaactac

SEQ ID NO: 396462 - DNA, 25 bp, Homo sapien
aacctctgcttctacaactagcaca

SEQ ID NO: 396463 - DNA, 25 bp, Homo sapien
tctgcttctacaactagcacaacct

SEQ ID NO: 396464 - DNA, 25 bp, Homo sapien
acaacctctggtcctggaactactc

SEQ ID NO: 396465 - DNA, 25 bp, Homo sapien
ggaactactcccagtgctgttccca

SEQ ID NO: 396466 - DNA, 25 bp, Homo sapien
accagcacaatctctgttcctacca

SEQ ID NO: 396467 - DNA, 25 bp, Homo sapien
tgcacctacaaccagcacaaactct

SEQ ID NO: 396468 - DNA, 25 bp, Homo sapien
aaactctgcccctataagcagcaca

SEQ ID NO: 396469 - DNA, 25 bp, Homo sapien
ataagcagcacaacctctgccacta

SEQ ID NO: 396470 - DNA, 25 bp, Homo sapien
aattgcttggtaatagagagccatc

SEQ ID NO: 396471 - DNA, 25 bp, Homo sapien
gagagccatcagaggtttgcaggtc

SEQ ID NO: 396472 - DNA, 25 bp, Homo sapien
agccatcagaggtttgcaggtcggt

SEQ ID NO: 396473 - DNA, 25 bp, Homo sapien
ccatcagaggtttgcaggtcggtca

SEQ ID NO: 396474 - DNA, 25 bp, Homo sapien
atcagaggtttgcaggtcggtcaaa

SEQ ID NO: 396475 - DNA, 25 bp, Homo sapien
tttgcaggtcggtcaaagaaaaact

SEQ ID NO: 396476 - DNA, 25 bp, Homo sapien
aaactgacgtatggaaaagaagcaa

SEQ ID NO: 396477 - DNA, 25 bp, Homo sapien
cgaaaaaatgagagccgaagatggt

SEQ ID NO: 396478 - DNA, 25 bp, Homo sapien
gagatcctacaagaatcccagatga

SEQ ID NO: 396479 - DNA, 25 bp, Homo sapien
agatgatgatcccagattgccagcg

SEQ ID NO: 396480 - DNA, 25 bp, Homo sapien
atttggatcttcaacagatgttaga

SEQ ID NO: 396481 - DNA, 25 bp, Homo sapien
gtcaaccgtgttaccatactctgtg

SEQ ID NO: 396482 - DNA, 25 bp, Homo sapien
gtgttaccatactctgtgacaaatt

SEQ ID NO: 396483 - DNA, 25 bp, Homo sapien
gtgacaaatttagtggccattccaa

SEQ ID NO: 396484 - DNA, 25 bp, Homo sapien
gtggccattccaaagggtttgcata

SEQ ID NO: 396485 - DNA, 25 bp, Homo sapien
gggtttgcatatatagagttctcag

SEQ ID NO: 396486 - DNA, 25 bp, Homo sapien
tggccttagatgactccctatttag

SEQ ID NO: 396487 - DNA, 25 bp, Homo sapien
ttttccaggagcccgctaccatgcc

SEQ ID NO: 396488 - DNA, 25 bp, Homo sapien
aactacagcagttccctctctcgat

SEQ ID NO: 396489 - DNA, 25 bp, Homo sapien
ttccctctctcgattccacagtggt

SEQ ID NO: 396490 - DNA, 25 bp, Homo sapien
cacagtggttttaacagcaggcccc

SEQ ID NO: 396491 - DNA, 25 bp, Homo sapien
gggtcacgtctacagaggccaggct

SEQ ID NO: 396492 - DNA, 25 bp, Homo sapien
agttttcccttccagaagtgacatg

SEQ ID NO: 396493 - DNA, 25 bp, Homo sapien
ccttccagaagtgacatgctcattg

SEQ ID NO: 396494 - DNA, 25 bp, Homo sapien
gatttactcaatccagttacccagt

SEQ ID NO: 396495 - DNA, 25 bp, Homo sapien
ctcaatccagttacccagttaatca

SEQ ID NO: 396496 - DNA, 25 bp, Homo sapien
cagttacccagttaatcaagaagac

SEQ ID NO: 396497 - DNA, 25 bp, Homo sapien
gactgagcccccagaggttaagtca

SEQ ID NO: 396498 - DNA, 25 bp, Homo sapien
agaggttaagtcacatcattatgaa

SEQ ID NO: 396499 - DNA, 25 bp, Homo sapien
agaagaagatctgaaccccggtctc

SEQ ID NO: 396500 - DNA, 25 bp, Homo sapien
gagagtatcttctctataaacctgg

SEQ ID NO: 396501 - DNA, 25 bp, Homo sapien
ttctcatctgttgttttcaaaggcg

SEQ ID NO: 396502 - DNA, 25 bp, Homo sapien
caaaggcgagtcatttccagttttc

SEQ ID NO: 396503 - DNA, 25 bp, Homo sapien
tccccagatggcacgctgctcattt

SEQ ID NO: 396504 - DNA, 25 bp, Homo sapien
cagatggcacgctgctcatttacaa

SEQ ID NO: 396505 - DNA, 25 bp, Homo sapien
agatggcacgctgctcatttacaac

SEQ ID NO: 396506 - DNA, 25 bp, Homo sapien
atggcacgctgctcatttacaactt

SEQ ID NO: 396507 - DNA, 25 bp, Homo sapien
tggcacgctgctcatttacaacttg

SEQ ID NO: 396508 - DNA, 25 bp, Homo sapien
gcacgctgctcatttacaacttgcg

SEQ ID NO: 396509 - DNA, 25 bp, Homo sapien
gctgctcatttacaacttgcgggcc

SEQ ID NO: 396510 - DNA, 25 bp, Homo sapien
tgctcatttacaacttgcgggccag

SEQ ID NO: 396511 - DNA, 25 bp, Homo sapien
ctcatttacaacttgcgggccaggg

SEQ ID NO: 396512 - DNA, 25 bp, Homo sapien
catttacaacttgcgggccagggat

SEQ ID NO: 396513 - DNA, 25 bp, Homo sapien
aacttgcgggccagggatgagggct

SEQ ID NO: 396514 - DNA, 25 bp, Homo sapien
tagaacttctatttgcagtgatctg

SEQ ID NO: 396515 - DNA, 25 bp, Homo sapien
gaacttctatttgcagtgatctgtg

SEQ ID NO: 396516 - DNA, 25 bp, Homo sapien
aacttctatttgcagtgatctgtgg

SEQ ID NO: 396517 - DNA, 25 bp, Homo sapien
cttctatttgcagtgatctgtggaa

SEQ ID NO: 396518 - DNA, 25 bp, Homo sapien
tgcagtgatctgtggaacttaaagc

SEQ ID NO: 396519 - DNA, 25 bp, Homo sapien
gtgatctgtggaacttaaagcaacc

SEQ ID NO: 396520 - DNA, 25 bp, Homo sapien
gatctgtggaacttaaagcaacctc

SEQ ID NO: 396521 - DNA, 25 bp, Homo sapien
tctgtggaacttaaagcaacctcaa

SEQ ID NO: 396522 - DNA, 25 bp, Homo sapien
tgtggaacttaaagcaacctcaaac

SEQ ID NO: 396523 - DNA, 25 bp, Homo sapien
tggaacttaaagcaacctcaaacaa

SEQ ID NO: 396524 - DNA, 25 bp, Homo sapien
ttaaagcaacctcaaacaaaattag

SEQ ID NO: 396525 - DNA, 25 bp, Homo sapien
cacctaccactacgatgagattctc

SEQ ID NO: 396526 - DNA, 25 bp, Homo sapien
cccccggttggcttggagtgacagt

SEQ ID NO: 396527 - DNA, 25 bp, Homo sapien
gacagtgatagattaaatgcaccaa

SEQ ID NO: 396528 - DNA, 25 bp, Homo sapien
aatgcaccaattaaattagatccta

SEQ ID NO: 396529 - DNA, 25 bp, Homo sapien
atccaagtttcagttggcacccgta

SEQ ID NO: 396530 - DNA, 25 bp, Homo sapien
agtttcagttggcacccgtatggtt

SEQ ID NO: 396531 - DNA, 25 bp, Homo sapien
agttggcacccgtatggttcccaga

SEQ ID NO: 396532 - DNA, 25 bp, Homo sapien
gtatggttcccagacttgctgctgc

SEQ ID NO: 396533 - DNA, 25 bp, Homo sapien
ccagacttgctgctgccttacgttc

SEQ ID NO: 396534 - DNA, 25 bp, Homo sapien
gccttacgttcccagtagttcacaa

SEQ ID NO: 396535 - DNA, 25 bp, Homo sapien
acgttcccagtagttcacaagacct

SEQ ID NO: 396536 - DNA, 25 bp, Homo sapien
actggtggctatgtccctgtactgg

SEQ ID NO: 396537 - DNA, 25 bp, Homo sapien
gtccctgtactggattgccacacag

SEQ ID NO: 396538 - DNA, 25 bp, Homo sapien
tcacattgtttgcacgtctgctgag

SEQ ID NO: 396539 - DNA, 25 bp, Homo sapien
tttgcacgtctgctgagctgaagga

SEQ ID NO: 396540 - DNA, 25 bp, Homo sapien
atactattctggtaataagctggaa

SEQ ID NO: 396541 - DNA, 25 bp, Homo sapien
ccatgtgtgttgacagcctctctga

SEQ ID NO: 396542 - DNA, 25 bp, Homo sapien
tgttgacagcctctctgactattct

SEQ ID NO: 396543 - DNA, 25 bp, Homo sapien
actattctcttctgggtcgttttgc

SEQ ID NO: 396544 - DNA, 25 bp, Homo sapien
ttctgggtcgttttgctgttcatga

SEQ ID NO: 396545 - DNA, 25 bp, Homo sapien
gatatgagatagacagttactactg

SEQ ID NO: 396546 - DNA, 25 bp, Homo sapien
agcagtggacaagaaagcttctgaa

SEQ ID NO: 396547 - DNA, 25 bp, Homo sapien
aaagcccccaaactcatgatttatg

SEQ ID NO: 396548 - DNA, 25 bp, Homo sapien
ctcaggggtttctaatcgcttctct

SEQ ID NO: 396549 - DNA, 25 bp, Homo sapien
ggggtttctaatcgcttctctggct

SEQ ID NO: 396550 - DNA, 25 bp, Homo sapien
ctgcctccgtgtctgggtctcctgg

SEQ ID NO: 396551 - DNA, 25 bp, Homo sapien
tccgtgtctgggtctcctggacagt

SEQ ID NO: 396552 - DNA, 25 bp, Homo sapien
tgtctgggtctcctggacagtcgat

SEQ ID NO: 396553 - DNA, 25 bp, Homo sapien
tctgggtctcctggacagtcgatca

SEQ ID NO: 396554 - DNA, 25 bp, Homo sapien
tgggtctcctggacagtcgatcacc

SEQ ID NO: 396555 - DNA, 25 bp, Homo sapien
ggtctcctggacagtcgatcaccat

SEQ ID NO: 396556 - DNA, 25 bp, Homo sapien
ctgcactggaaccagcagtgacgtt

SEQ ID NO: 396557 - DNA, 25 bp, Homo sapien
tgcactggaaccagcagtgacgttg

SEQ ID NO: 396558 - DNA, 25 bp, Homo sapien
aagcattgtgtccagttgccactga

SEQ ID NO: 396559 - DNA, 25 bp, Homo sapien
tcatcctgaactacaagtggcactg

SEQ ID NO: 396560 - DNA, 25 bp, Homo sapien
gaattctaagcagcttcctgtgtaa

SEQ ID NO: 396561 - DNA, 25 bp, Homo sapien
gcttcctgtgtaaaggccagatctt

SEQ ID NO: 396562 - DNA, 25 bp, Homo sapien
ggaagttaggactgagccaccaatc

SEQ ID NO: 396563 - DNA, 25 bp, Homo sapien
gactgagccaccaatcatgaacgga

SEQ ID NO: 396564 - DNA, 25 bp, Homo sapien
gaacggaatgaccactgggactgca

SEQ ID NO: 396565 - DNA, 25 bp, Homo sapien
tatgtcagccaaacccaagattcag

SEQ ID NO: 396566 - DNA, 25 bp, Homo sapien
aatttatttgctctacatggtcatt

SEQ ID NO: 396567 - DNA, 25 bp, Homo sapien
tacatggtcatttgagcattacccc

SEQ ID NO: 396568 - DNA, 25 bp, Homo sapien
ttctgccatgatgactgtccagcat

SEQ ID NO: 396569 - DNA, 25 bp, Homo sapien
tgctgcggcacaggttgaactggct

SEQ ID NO: 396570 - DNA, 25 bp, Homo sapien
gctgcggcacaggttgaactggctc

SEQ ID NO: 396571 - DNA, 25 bp, Homo sapien
ctgcggcacaggttgaactggctcg

SEQ ID NO: 396572 - DNA, 25 bp, Homo sapien
ggtactgagcttgcaagacctctgc

SEQ ID NO: 396573 - DNA, 25 bp, Homo sapien
gtgtcctgcacacctgtgcatctgg

SEQ ID NO: 396574 - DNA, 25 bp, Homo sapien
gcatctggtggacaagctcccgctc

SEQ ID NO: 396575 - DNA, 25 bp, Homo sapien
tcaagtccttctccatggctaaggg

SEQ ID NO: 396576 - DNA, 25 bp, Homo sapien
cttctccatggctaagggcctgaat

SEQ ID NO: 396577 - DNA, 25 bp, Homo sapien
atgccaggatgatgcgaggcctctc

SEQ ID NO: 396578 - DNA, 25 bp, Homo sapien
tccactcacaaaaggagcagcctct

SEQ ID NO: 396579 - DNA, 25 bp, Homo sapien
gcaaagtgaagatcgtctgcccacc

SEQ ID NO: 396580 - DNA, 25 bp, Homo sapien
ctgctcagcgtgagctacagcgccg

SEQ ID NO: 396581 - DNA, 25 bp, Homo sapien
ctcacgctcctcatggtgcagcggt

SEQ ID NO: 396582 - DNA, 25 bp, Homo sapien
tcacgctcctcatggtgcagcggtt

SEQ ID NO: 396583 - DNA, 25 bp, Homo sapien
cgctcctcatggtgcagcggttcct

SEQ ID NO: 396584 - DNA, 25 bp, Homo sapien
ctcctcatggtgcagcggttcctct

SEQ ID NO: 396585 - DNA, 25 bp, Homo sapien
tcctcatggtgcagcggttcctctc

SEQ ID NO: 396586 - DNA, 25 bp, Homo sapien
taaatcccgagctggacgtgtgcgt

SEQ ID NO: 396587 - DNA, 25 bp, Homo sapien
tcatggtgcagcggttcctctcagc

SEQ ID NO: 396588 - DNA, 25 bp, Homo sapien
atggtgcagcggttcctctcagcca

SEQ ID NO: 396589 - DNA, 25 bp, Homo sapien
ggtgcagcggttcctctcagccacg

SEQ ID NO: 396590 - DNA, 25 bp, Homo sapien
agcggttcctctcagccacgcggca

SEQ ID NO: 396591 - DNA, 25 bp, Homo sapien
attgcatgaggtacccaaatctgaa

SEQ ID NO: 396592 - DNA, 25 bp, Homo sapien
ctttgacagataatgctttgacagc

SEQ ID NO: 396593 - DNA, 25 bp, Homo sapien
gacagataatgctttgacagctcga

SEQ ID NO: 396594 - DNA, 25 bp, Homo sapien
gataatgctttgacagctcgatctc

SEQ ID NO: 396595 - DNA, 25 bp, Homo sapien
aatgctttgacagctcgatctcttg

SEQ ID NO: 396596 - DNA, 25 bp, Homo sapien
tgctttgacagctcgatctcttggt

SEQ ID NO: 396597 - DNA, 25 bp, Homo sapien
gtaaatatgggatcatctgcaggga

SEQ ID NO: 396598 - DNA, 25 bp, Homo sapien
aatatgggatcatctgcagggagga

SEQ ID NO: 396599 - DNA, 25 bp, Homo sapien
atgggatcatctgcagggaggatct

SEQ ID NO: 396600 - DNA, 25 bp, Homo sapien
gtggcccttcagtatcttctccacg

SEQ ID NO: 396601 - DNA, 25 bp, Homo sapien
cccttcagtatcttctccacgaggt

SEQ ID NO: 396602 - DNA, 25 bp, Homo sapien
gacacccaatggatcatcaaaccac

SEQ ID NO: 396603 - DNA, 25 bp, Homo sapien
acacccaatggatcatcaaaccact

SEQ ID NO: 396604 - DNA, 25 bp, Homo sapien
cacccaatggatcatcaaaccactc

SEQ ID NO: 396605 - DNA, 25 bp, Homo sapien
acccaatggatcatcaaaccactcc

SEQ ID NO: 396606 - DNA, 25 bp, Homo sapien
cccaatggatcatcaaaccactcca

SEQ ID NO: 396607 - DNA, 25 bp, Homo sapien
ccaatggatcatcaaaccactccac

SEQ ID NO: 396608 - DNA, 25 bp, Homo sapien
caatggatcatcaaaccactccaca

SEQ ID NO: 396609 - DNA, 25 bp, Homo sapien
aatggatcatcaaaccactccacaa

SEQ ID NO: 396610 - DNA, 25 bp, Homo sapien
atggatcatcaaaccactccacaag

SEQ ID NO: 396611 - DNA, 25 bp, Homo sapien
gccctgggcttggaaagggccataa

SEQ ID NO: 396612 - DNA, 25 bp, Homo sapien
ccacactcatgatttatgatgtcat

SEQ ID NO: 396613 - DNA, 25 bp, Homo sapien
cactcatgatttatgatgtcattaa

SEQ ID NO: 396614 - DNA, 25 bp, Homo sapien
atgatgtcattaagcggccctcagg

SEQ ID NO: 396615 - DNA, 25 bp, Homo sapien
gactcagcctcgctcagtgtccgga

SEQ ID NO: 396616 - DNA, 25 bp, Homo sapien
ctgattattattgcagctcaaatgc

SEQ ID NO: 396617 - DNA, 25 bp, Homo sapien
tcagcctcgctcagtgtccggatct

SEQ ID NO: 396618 - DNA, 25 bp, Homo sapien
tcaaatgcaggcagtttttatgtct

SEQ ID NO: 396619 - DNA, 25 bp, Homo sapien
ctcgctcagtgtccggatctcctgg

SEQ ID NO: 396620 - DNA, 25 bp, Homo sapien
gctcagtgtccggatctcctggaca

SEQ ID NO: 396621 - DNA, 25 bp, Homo sapien
gatctcctggacagtcagtcaccat

SEQ ID NO: 396622 - DNA, 25 bp, Homo sapien
gcaccggaaccagcagtgatgttgg

SEQ ID NO: 396623 - DNA, 25 bp, Homo sapien
ccccaaactcgtcatccatggtaat

SEQ ID NO: 396624 - DNA, 25 bp, Homo sapien
caaactcgtcatccatggtaatagc

SEQ ID NO: 396625 - DNA, 25 bp, Homo sapien
aactcgtcatccatggtaatagcaa

SEQ ID NO: 396626 - DNA, 25 bp, Homo sapien
ctcgtcatccatggtaatagcaatc

SEQ ID NO: 396627 - DNA, 25 bp, Homo sapien
gtcatccatggtaatagcaatcggc

SEQ ID NO: 396628 - DNA, 25 bp, Homo sapien
atccatggtaatagcaatcggccct

SEQ ID NO: 396629 - DNA, 25 bp, Homo sapien
ccatggtaatagcaatcggccctca

SEQ ID NO: 396630 - DNA, 25 bp, Homo sapien
catggtaatagcaatcggccctcag

SEQ ID NO: 396631 - DNA, 25 bp, Homo sapien
ttactgccagacctatgacagcagg

SEQ ID NO: 396632 - DNA, 25 bp, Homo sapien
ctgccagacctatgacagcaggctg

SEQ ID NO: 396633 - DNA, 25 bp, Homo sapien
gacagcaggctgaatatttgcgtgt

SEQ ID NO: 396634 - DNA, 25 bp, Homo sapien
caggtggaagatgaccgcactcatt

SEQ ID NO: 396635 - DNA, 25 bp, Homo sapien
aggtggaagatgaccgcactcattc

SEQ ID NO: 396636 - DNA, 25 bp, Homo sapien
ggtggaagatgaccgcactcattct

SEQ ID NO: 396637 - DNA, 25 bp, Homo sapien
agatgaccgcactcattctgactat

SEQ ID NO: 396638 - DNA, 25 bp, Homo sapien
gatgaccgcactcattctgactata

SEQ ID NO: 396639 - DNA, 25 bp, Homo sapien
atgaccgcactcattctgactataa

SEQ ID NO: 396640 - DNA, 25 bp, Homo sapien
tgaccgcactcattctgactataac

SEQ ID NO: 396641 - DNA, 25 bp, Homo sapien
gaccgcactcattctgactataaca

SEQ ID NO: 396642 - DNA, 25 bp, Homo sapien
accgcactcattctgactataacat

SEQ ID NO: 396643 - DNA, 25 bp, Homo sapien
aagagtagaccctgcacctggtcct

SEQ ID NO: 396644 - DNA, 25 bp, Homo sapien
tgcacctggtcctgagtctgagagg

SEQ ID NO: 396645 - DNA, 25 bp, Homo sapien
gtagtgttttaattacagtgatgta

SEQ ID NO: 396646 - DNA, 25 bp, Homo sapien
cagtgatgtattttagactcacatt

SEQ ID NO: 396647 - DNA, 25 bp, Homo sapien
ttttagactcacattttgtgattca

SEQ ID NO: 396648 - DNA, 25 bp, Homo sapien
gttataaaggcattcttgcaccatg

SEQ ID NO: 396649 - DNA, 25 bp, Homo sapien
aaggcattcttgcaccatggtaaag

SEQ ID NO: 396650 - DNA, 25 bp, Homo sapien
aatgtgtgtggtaaatctccgttta

SEQ ID NO: 396651 - DNA, 25 bp, Homo sapien
gtgtgtggtaaatctccgtttatat

SEQ ID NO: 396652 - DNA, 25 bp, Homo sapien
gtaaactatatatgtgctatcagga

SEQ ID NO: 396653 - DNA, 25 bp, Homo sapien
atgtgctatcaggaaaccccttcat

SEQ ID NO: 396654 - DNA, 25 bp, Homo sapien
tcaggaaaccccttcatactgtgta

SEQ ID NO: 396655 - DNA, 25 bp, Homo sapien
tactgtgtataaaattgcaatctag

SEQ ID NO: 396656 - DNA, 25 bp, Homo sapien
aattgcttggtaatagagagccatc

SEQ ID NO: 396657 - DNA, 25 bp, Homo sapien
aatagagagccatcagaggtttgca

SEQ ID NO: 396658 - DNA, 25 bp, Homo sapien
gagagccatcagaggtttgcaggtc

SEQ ID NO: 396659 - DNA, 25 bp, Homo sapien
agagccatcagaggtttgcaggtcg

SEQ ID NO: 396660 - DNA, 25 bp, Homo sapien
agccatcagaggtttgcaggtcggt

SEQ ID NO: 396661 - DNA, 25 bp, Homo sapien
ccatcagaggtttgcaggtcggtca

SEQ ID NO: 396662 - DNA, 25 bp, Homo sapien
catcagaggtttgcaggtcggtcaa

SEQ ID NO: 396663 - DNA, 25 bp, Homo sapien
atcagaggtttgcaggtcggtcaaa

SEQ ID NO: 396664 - DNA, 25 bp, Homo sapien
tttgcaggtcggtcaaagaaaaact

SEQ ID NO: 396665 - DNA, 25 bp, Homo sapien
aaactgacgtatggaaaagaagcaa

SEQ ID NO: 396666 - DNA, 25 bp, Homo sapien
cgaaaaaatgagagccgaagatggt

SEQ ID NO: 396667 - DNA, 25 bp, Homo sapien
caggactctggcacttccattggtt

SEQ ID NO: 396668 - DNA, 25 bp, Homo sapien
ctggcacttccattggttcttcctt

SEQ ID NO: 396669 - DNA, 25 bp, Homo sapien
cctttccctggagctgaggtttaga

SEQ ID NO: 396670 - DNA, 25 bp, Homo sapien
gtttagatgtgcaacctgtggctca

SEQ ID NO: 396671 - DNA, 25 bp, Homo sapien
ttagatgtgcaacctgtggctcagg

SEQ ID NO: 396672 - DNA, 25 bp, Homo sapien
gggagcaagcttacacaagaagtga

SEQ ID NO: 396673 - DNA, 25 bp, Homo sapien
gtgcccatgaagaggagattggcca

SEQ ID NO: 396674 - DNA, 25 bp, Homo sapien
ccagtgagaagctgaggcctatgca

SEQ ID NO: 396675 - DNA, 25 bp, Homo sapien
agctgaggcctatgcagacatctct

SEQ ID NO: 396676 - DNA, 25 bp, Homo sapien
gaggcctatgcagacatctctggag

SEQ ID NO: 396677 - DNA, 25 bp, Homo sapien
tatgcagacatctctggagccagag

SEQ ID NO: 396678 - DNA, 25 bp, Homo sapien
ggcacctttctactgcgcttcagtg

SEQ ID NO: 396679 - DNA, 25 bp, Homo sapien
cacctttctactgcgcttcagtgaa

SEQ ID NO: 396680 - DNA, 25 bp, Homo sapien
ctttctactgcgcttcagtgaatcg

SEQ ID NO: 396681 - DNA, 25 bp, Homo sapien
ttctactgcgcttcagtgaatcgtc

SEQ ID NO: 396682 - DNA, 25 bp, Homo sapien
ctactgcgcttcagtgaatcgtcag

SEQ ID NO: 396683 - DNA, 25 bp, Homo sapien
actgcgcttcagtgaatcgtcagaa

SEQ ID NO: 396684 - DNA, 25 bp, Homo sapien
gcgcttcagtgaatcgtcagaaggg

SEQ ID NO: 396685 - DNA, 25 bp, Homo sapien
tgaatcgtcagaagggggcattacc

SEQ ID NO: 396686 - DNA, 25 bp, Homo sapien
ggcattacctgctcctgggtggagc

SEQ ID NO: 396687 - DNA, 25 bp, Homo sapien
attacctgctcctgggtggagcacc

SEQ ID NO: 396688 - DNA, 25 bp, Homo sapien
ctgctcctgggtggagcaccaggat

SEQ ID NO: 396689 - DNA, 25 bp, Homo sapien
agctcctgcggaactggctgtggca

SEQ ID NO: 396690 - DNA, 25 bp, Homo sapien
gctcctgcggaactggctgtggcat

SEQ ID NO: 396691 - DNA, 25 bp, Homo sapien
gcagtggagctgtgagcacccgtat

SEQ ID NO: 396692 - DNA, 25 bp, Homo sapien
cagtggagctgtgagcacccgtatc

SEQ ID NO: 396693 - DNA, 25 bp, Homo sapien
agtggagctgtgagcacccgtatca

SEQ ID NO: 396694 - DNA, 25 bp, Homo sapien
gtggagctgtgagcacccgtatcag

SEQ ID NO: 396695 - DNA, 25 bp, Homo sapien
ggagctgtgagcacccgtatcaggt

SEQ ID NO: 396696 - DNA, 25 bp, Homo sapien
ctgtgagcacccgtatcaggtggtg

SEQ ID NO: 396697 - DNA, 25 bp, Homo sapien
gtgagcacccgtatcaggtggtgcc

SEQ ID NO: 396698 - DNA, 25 bp, Homo sapien
tgagcacccgtatcaggtggtgccg

SEQ ID NO: 396699 - DNA, 25 bp, Homo sapien
acccgtatcaggtggtgccgcccag

SEQ ID NO: 396700 - DNA, 25 bp, Homo sapien
tatggcggtgggtacatgagctcca

SEQ ID NO: 396701 - DNA, 25 bp, Homo sapien
atgagctccaccttgcagatgtaga

SEQ ID NO: 396702 - DNA, 25 bp, Homo sapien
cagatgtagagtcccgtgtccatgg

SEQ ID NO: 396703 - DNA, 25 bp, Homo sapien
atggccctcagtccttggatagtga

SEQ ID NO: 396704 - DNA, 25 bp, Homo sapien
ggtgcccgtgcagatggaatcatct

SEQ ID NO: 396705 - DNA, 25 bp, Homo sapien
taggaaggtcaactcattccccatc

SEQ ID NO: 396706 - DNA, 25 bp, Homo sapien
tgtaggttgccgcacagacttcagt

SEQ ID NO: 396707 - DNA, 25 bp, Homo sapien
agacttcagtcacctggctgtcagc

SEQ ID NO: 396708 - DNA, 25 bp, Homo sapien
cattttcacatagacccctgttgta

SEQ ID NO: 396709 - DNA, 25 bp, Homo sapien
aagagggcttcttttctttagcaat

SEQ ID NO: 396710 - DNA, 25 bp, Homo sapien
ataaatctgggttccgttgcctatg

SEQ ID NO: 396711 - DNA, 25 bp, Homo sapien
gatcccctttggaaaaggctggagc

SEQ ID NO: 396712 - DNA, 25 bp, Homo sapien
ggagccagaacactgaaggcctgcc

SEQ ID NO: 396713 - DNA, 25 bp, Homo sapien
tttctgcaagaaagactatggcccc

SEQ ID NO: 396714 - DNA, 25 bp, Homo sapien
ccagtccctggacaagctaaggcag

SEQ ID NO: 396715 - DNA, 25 bp, Homo sapien
caggcagcagtgttggctttgggat

SEQ ID NO: 396716 - DNA, 25 bp, Homo sapien
tgggatgccttttccacctgcccag

SEQ ID NO: 396717 - DNA, 25 bp, Homo sapien
ggctctgttgggagaggacctttta

SEQ ID NO: 396718 - DNA, 25 bp, Homo sapien
ggaccttttagatcatcagcctctt

SEQ ID NO: 396719 - DNA, 25 bp, Homo sapien
atcagcctcttcattttccattggc

SEQ ID NO: 396720 - DNA, 25 bp, Homo sapien
ctcttcattttccattggcgcaaaa

SEQ ID NO: 396721 - DNA, 25 bp, Homo sapien
ttccattggcgcaaaatcaaaaacc

SEQ ID NO: 396722 - DNA, 25 bp, Homo sapien
ttatcccccaaattatctccagagc

SEQ ID NO: 396723 - DNA, 25 bp, Homo sapien
agcaggggatggtggctgtctgtcc

SEQ ID NO: 396724 - DNA, 25 bp, Homo sapien
ctccgccgaataccgcagtgttggt

SEQ ID NO: 396725 - DNA, 25 bp, Homo sapien
cgccgaataccgcagtgttggtgtc

SEQ ID NO: 396726 - DNA, 25 bp, Homo sapien
gccgaataccgcagtgttggtgtcc

SEQ ID NO: 396727 - DNA, 25 bp, Homo sapien
cgaataccgcagtgttggtgtccca

SEQ ID NO: 396728 - DNA, 25 bp, Homo sapien
gaataccgcagtgttggtgtcccac

SEQ ID NO: 396729 - DNA, 25 bp, Homo sapien
aataccgcagtgttggtgtcccacg

SEQ ID NO: 396730 - DNA, 25 bp, Homo sapien
ataccgcagtgttggtgtcccacgc

SEQ ID NO: 396731 - DNA, 25 bp, Homo sapien
cgcagtgttggtgtcccacgcctga

SEQ ID NO: 396732 - DNA, 25 bp, Homo sapien
gcagtgttggtgtcccacgcctgac

SEQ ID NO: 396733 - DNA, 25 bp, Homo sapien
attcaagtcaaacacagaataaagc

SEQ ID NO: 396734 - DNA, 25 bp, Homo sapien
gtgctgatgagttagacgtcaacaa

SEQ ID NO: 396735 - DNA, 25 bp, Homo sapien
tgctgatgagttagacgtcaacaaa

SEQ ID NO: 396736 - DNA, 25 bp, Homo sapien
gctgatgagttagacgtcaacaaag

SEQ ID NO: 396737 - DNA, 25 bp, Homo sapien
ctgatgagttagacgtcaacaaaga

SEQ ID NO: 396738 - DNA, 25 bp, Homo sapien
tgatgagttagacgtcaacaaagac

SEQ ID NO: 396739 - DNA, 25 bp, Homo sapien
gatgagttagacgtcaacaaagacg

SEQ ID NO: 396740 - DNA, 25 bp, Homo sapien
gagttagacgtcaacaaagacgata

SEQ ID NO: 396741 - DNA, 25 bp, Homo sapien
gttagacgtcaacaaagacgatatt

SEQ ID NO: 396742 - DNA, 25 bp, Homo sapien
gacgtcaacaaagacgatatttggc

SEQ ID NO: 396743 - DNA, 25 bp, Homo sapien
cgtcaacaaagacgatatttggcca

SEQ ID NO: 396744 - DNA, 25 bp, Homo sapien
gacactgagggcacctagactgaca

SEQ ID NO: 396745 - DNA, 25 bp, Homo sapien
agaaatttcccttcactggtaacat

SEQ ID NO: 396746 - DNA, 25 bp, Homo sapien
tcactggtaacatctccatttgaga

SEQ ID NO: 396747 - DNA, 25 bp, Homo sapien
gaggattctgtttggcatggtgaac

SEQ ID NO: 396748 - DNA, 25 bp, Homo sapien
agagaaccattgtcatctgcccaga

SEQ ID NO: 396749 - DNA, 25 bp, Homo sapien
gactgtgtgcactacatgtccaagt

SEQ ID NO: 396750 - DNA, 25 bp, Homo sapien
aatatgcctgtgtacctattctccc

SEQ ID NO: 396751 - DNA, 25 bp, Homo sapien
tcccactcagggacatccagatcgg

SEQ ID NO: 396752 - DNA, 25 bp, Homo sapien
tgtcacagtgggtgagtaccagccc

SEQ ID NO: 396753 - DNA, 25 bp, Homo sapien
agtaccagcccctgagcaagactgt

SEQ ID NO: 396754 - DNA, 25 bp, Homo sapien
gactgtacacttcaacatgctcaag

SEQ ID NO: 396755 - DNA, 25 bp, Homo sapien
tctattataatttcgaccggccctc

SEQ ID NO: 396756 - DNA, 25 bp, Homo sapien
ttataatttcgaccggccctcaggt

SEQ ID NO: 396757 - DNA, 25 bp, Homo sapien
aactctgggaacacggccaccctga

SEQ ID NO: 396758 - DNA, 25 bp, Homo sapien
gggatgaggccgactatttctgtca

SEQ ID NO: 396759 - DNA, 25 bp, Homo sapien
atgaggccgactatttctgtcagct

SEQ ID NO: 396760 - DNA, 25 bp, Homo sapien
gaggccgactatttctgtcagctgt

SEQ ID NO: 396761 - DNA, 25 bp, Homo sapien
ggccgactatttctgtcagctgtgg

SEQ ID NO: 396762 - DNA, 25 bp, Homo sapien
tctgtcagctgtgggatataagtag

SEQ ID NO: 396763 - DNA, 25 bp, Homo sapien
aaagtaaaactgtgcactggtacca

SEQ ID NO: 396764 - DNA, 25 bp, Homo sapien
ggcccctattctggtcatctattat

SEQ ID NO: 396765 - DNA, 25 bp, Homo sapien
cccctattctggtcatctattataa

SEQ ID NO: 396766 - DNA, 25 bp, Homo sapien
ttcaagaaggcaatgactgctaaag

SEQ ID NO: 396767 - DNA, 25 bp, Homo sapien
gactgctaaaggaggtgatgtctct

SEQ ID NO: 396768 - DNA, 25 bp, Homo sapien
ggaggtgatgtctctgtttgtgaat

SEQ ID NO: 396769 - DNA, 25 bp, Homo sapien
atgtctctgtttgtgaatggtacca

SEQ ID NO: 396770 - DNA, 25 bp, Homo sapien
gtttgtgaatggtaccagcatgtgt

SEQ ID NO: 396771 - DNA, 25 bp, Homo sapien
taccagcatgtgtacaagtctctct

SEQ ID NO: 396772 - DNA, 25 bp, Homo sapien
tgtgtacaagtctctctgccctata

SEQ ID NO: 396773 - DNA, 25 bp, Homo sapien
acaggactgccccttttgacaggcg

SEQ ID NO: 396774 - DNA, 25 bp, Homo sapien
ggactgccccttttgacaggcgctt

SEQ ID NO: 396775 - DNA, 25 bp, Homo sapien
aaccagaaccagaccaggaatggct

SEQ ID NO: 396776 - DNA, 25 bp, Homo sapien
ggaatggctggcagaaatacctgga

SEQ ID NO: 396777 - DNA, 25 bp, Homo sapien
ggaggtccccccagtatataatgaa

SEQ ID NO: 396778 - DNA, 25 bp, Homo sapien
aaggttaagagtgatggcagccaca

SEQ ID NO: 396779 - DNA, 25 bp, Homo sapien
acgggatccccgatcgcttcatggg

SEQ ID NO: 396780 - DNA, 25 bp, Homo sapien
cgatcgcttcatgggctccagttct

SEQ ID NO: 396781 - DNA, 25 bp, Homo sapien
agtctgacgatgaggctgagtatca

SEQ ID NO: 396782 - DNA, 25 bp, Homo sapien
atgaggctgagtatcactgtggaga

SEQ ID NO: 396783 - DNA, 25 bp, Homo sapien
ccgtctgcatctgccttgctgggag

SEQ ID NO: 396784 - DNA, 25 bp, Homo sapien
ttgctgggagcctcgatcaagctca

SEQ ID NO: 396785 - DNA, 25 bp, Homo sapien
agctcacctgcaccctaagcagtga

SEQ ID NO: 396786 - DNA, 25 bp, Homo sapien
taagcagtgagcacagcacctacac

SEQ ID NO: 396787 - DNA, 25 bp, Homo sapien
acagcacctacaccatcgaatggta

SEQ ID NO: 396788 - DNA, 25 bp, Homo sapien
ttttccaggagcccgctaccatgcc

SEQ ID NO: 396789 - DNA, 25 bp, Homo sapien
acagcagttccctctctcgattcca

SEQ ID NO: 396790 - DNA, 25 bp, Homo sapien
cagcagttccctctctcgattccac

SEQ ID NO: 396791 - DNA, 25 bp, Homo sapien
agcagttccctctctcgattccaca

SEQ ID NO: 396792 - DNA, 25 bp, Homo sapien
gcagttccctctctcgattccacag

SEQ ID NO: 396793 - DNA, 25 bp, Homo sapien
cagttccctctctcgattccacagt

SEQ ID NO: 396794 - DNA, 25 bp, Homo sapien
ttccctctctcgattccacagtggt

SEQ ID NO: 396795 - DNA, 25 bp, Homo sapien
cccggggtcacgtctacagaggcca

SEQ ID NO: 396796 - DNA, 25 bp, Homo sapien
ccggggtcacgtctacagaggccag

SEQ ID NO: 396797 - DNA, 25 bp, Homo sapien
cggggtcacgtctacagaggccagg

SEQ ID NO: 396798 - DNA, 25 bp, Homo sapien
gggtcacgtctacagaggccaggct

SEQ ID NO: 396799 - DNA, 25 bp, Homo sapien
tgactggatcccctacaatgggaaa

SEQ ID NO: 396800 - DNA, 25 bp, Homo sapien
ctacaatgggaaaacagctttctgg

SEQ ID NO: 396801 - DNA, 25 bp, Homo sapien
gggacatcccatccgcaggactaaa

SEQ ID NO: 396802 - DNA, 25 bp, Homo sapien
gactaaaaacgtccaccactttcat

SEQ ID NO: 396803 - DNA, 25 bp, Homo sapien
aaaacgtccaccactttcatcagta

SEQ ID NO: 396804 - DNA, 25 bp, Homo sapien
tttcatcagtaacaacacggccatc

SEQ ID NO: 396805 - DNA, 25 bp, Homo sapien
gagacgtctcagagcagttcacagc

SEQ ID NO: 396806 - DNA, 25 bp, Homo sapien
gagcagttcacagccatgttcaggt

SEQ ID NO: 396807 - DNA, 25 bp, Homo sapien
cacagccatgttcaggtgcaaggcc

SEQ ID NO: 396808 - DNA, 25 bp, Homo sapien
cctggtatcagagtaccaacagtat

SEQ ID NO: 396809 - DNA, 25 bp, Homo sapien
taccaacagtatcaggatgccactg

SEQ ID NO: 396810 - DNA, 25 bp, Homo sapien
cgtccactacacctagcactataaa

SEQ ID NO: 396811 - DNA, 25 bp, Homo sapien
aagtattcattgaccatgccttcca

SEQ ID NO: 396812 - DNA, 25 bp, Homo sapien
ctgctgcatcctcttacagtaatgt

SEQ ID NO: 396813 - DNA, 25 bp, Homo sapien
gttacagtaccattaacatctgcat

SEQ ID NO: 396814 - DNA, 25 bp, Homo sapien
atctgcatgggatgtacctatatat

SEQ ID NO: 396815 - DNA, 25 bp, Homo sapien
tacctatatatactggcccggacat

SEQ ID NO: 396816 - DNA, 25 bp, Homo sapien
ggacattatattgccatcccatact

SEQ ID NO: 396817 - DNA, 25 bp, Homo sapien
atcccatactcctatgtggcctagt

SEQ ID NO: 396818 - DNA, 25 bp, Homo sapien
tgtggcctagtacatctcctaccaa

SEQ ID NO: 396819 - DNA, 25 bp, Homo sapien
tgccacctccacctatataggtatt

SEQ ID NO: 396820 - DNA, 25 bp, Homo sapien
tatataggtattcatggcacacaat

SEQ ID NO: 396821 - DNA, 25 bp, Homo sapien
ccagtagtgggaacacggtggtgct

SEQ ID NO: 396822 - DNA, 25 bp, Homo sapien
acaagcaggctcctgttgagctgga

SEQ ID NO: 396823 - DNA, 25 bp, Homo sapien
tgttgagctggagcacctctgggca

SEQ ID NO: 396824 - DNA, 25 bp, Homo sapien
gcacctctgggcacagaagttttat

SEQ ID NO: 396825 - DNA, 25 bp, Homo sapien
ttattttcctggcattcccaacaag

SEQ ID NO: 396826 - DNA, 25 bp, Homo sapien
tttcctggcattcccaacaagtgtt

SEQ ID NO: 396827 - DNA, 25 bp, Homo sapien
gcattcccaacaagtgttccctggg

SEQ ID NO: 396828 - DNA, 25 bp, Homo sapien
gggattcagctcatggtcactgttg

SEQ ID NO: 396829 - DNA, 25 bp, Homo sapien
tcagctcatggtcactgttgaaagc

SEQ ID NO: 396830 - DNA, 25 bp, Homo sapien
catggtcactgttgaaagccttcat

SEQ ID NO: 396831 - DNA, 25 bp, Homo sapien
gtcactgttgaaagccttcattcag

SEQ ID NO: 396832 - DNA, 25 bp, Homo sapien
ggactatttcagcaatcatggcata

SEQ ID NO: 396833 - DNA, 25 bp, Homo sapien
ctctcagccgtagtcgtagtgatgt

SEQ ID NO: 396834 - DNA, 25 bp, Homo sapien
agtcaggtaccatcattgctactgt

SEQ ID NO: 396835 - DNA, 25 bp, Homo sapien
gagagccttcaggttatctggcagt

SEQ ID NO: 396836 - DNA, 25 bp, Homo sapien
tggcagttctgatcgcccagcatac

SEQ ID NO: 396837 - DNA, 25 bp, Homo sapien
catacccagggttcattgttataaa

SEQ ID NO: 396838 - DNA, 25 bp, Homo sapien
gtcaagttttagttcagttccctca

SEQ ID NO: 396839 - DNA, 25 bp, Homo sapien
gttcagttccctcaaacatcagtat

SEQ ID NO: 396840 - DNA, 25 bp, Homo sapien
gacagctgctctgaacacaagcgat

SEQ ID NO: 396841 - DNA, 25 bp, Homo sapien
caagcgatacgtagccacaattttt

SEQ ID NO: 396842 - DNA, 25 bp, Homo sapien
ggtcgagcagtgacaaacccacagg

SEQ ID NO: 396843 - DNA, 25 bp, Homo sapien
atggagttagagtctgggactggct

SEQ ID NO: 396844 - DNA, 25 bp, Homo sapien
accgctgcggcatctgggactcacg

SEQ ID NO: 396845 - DNA, 25 bp, Homo sapien
atcagtgccagacgcttcacctctg

SEQ ID NO: 396846 - DNA, 25 bp, Homo sapien
gtgccagacgcttcacctctgctga

SEQ ID NO: 396847 - DNA, 25 bp, Homo sapien
ctgctgacagcagacttgggtgtct

SEQ ID NO: 396848 - DNA, 25 bp, Homo sapien
gacagcagacttgggtgtctcttgc

SEQ ID NO: 396849 - DNA, 25 bp, Homo sapien
cagacttgggtgtctcttgcagtat

SEQ ID NO: 396850 - DNA, 25 bp, Homo sapien
acttgggtgtctcttgcagtatctg

SEQ ID NO: 396851 - DNA, 25 bp, Homo sapien
tgggtgtctcttgcagtatctggga

SEQ ID NO: 396852 - DNA, 25 bp, Homo sapien
ccggctgcacagactgaaagtggac

SEQ ID NO: 396853 - DNA, 25 bp, Homo sapien
aaagtggaccaagtctgtcacctgc

SEQ ID NO: 396854 - DNA, 25 bp, Homo sapien
tctgactcttggtggttccttgaga

SEQ ID NO: 396855 - DNA, 25 bp, Homo sapien
ggttccttgagagctttgatgatca

SEQ ID NO: 396856 - DNA, 25 bp, Homo sapien
agaaggcaccacctcaatctgggct

SEQ ID NO: 396857 - DNA, 25 bp, Homo sapien
tgggcttgtctgttctgaatggtca

SEQ ID NO: 396858 - DNA, 25 bp, Homo sapien
gtttcactgtaatactcaggccctt

SEQ ID NO: 396859 - DNA, 25 bp, Homo sapien
ttccagtcacctgttgccttggcaa

SEQ ID NO: 396860 - DNA, 25 bp, Homo sapien
gttgccttggcaatgtcatcaccaa

SEQ ID NO: 396861 - DNA, 25 bp, Homo sapien
atgtcatcaccaaccttttttggag

SEQ ID NO: 396862 - DNA, 25 bp, Homo sapien
tgcagaaagtggcaccgacttcacc

SEQ ID NO: 396863 - DNA, 25 bp, Homo sapien
cggtgcacctcaggtatacgacttt

SEQ ID NO: 396864 - DNA, 25 bp, Homo sapien
ggtatacgactttgatctcattggg

SEQ ID NO: 396865 - DNA, 25 bp, Homo sapien
cctctatcattctgctgtcaaaagc

SEQ ID NO: 396866 - DNA, 25 bp, Homo sapien
attctgctgtcaaaagctccttgcc

SEQ ID NO: 396867 - DNA, 25 bp, Homo sapien
ataaactcaatacccttaaagacag

SEQ ID NO: 396868 - DNA, 25 bp, Homo sapien
ccaaagtctgtaccaatcaatgtaa

SEQ ID NO: 396869 - DNA, 25 bp, Homo sapien
aatcaatgtaatctccaccccttct

SEQ ID NO: 396870 - DNA, 25 bp, Homo sapien
ccaccccttctgcagaagaatttag

SEQ ID NO: 396871 - DNA, 25 bp, Homo sapien
tggaaatgctcaggacagtcccgta

SEQ ID NO: 396872 - DNA, 25 bp, Homo sapien
caggacagtcccgtagagctaaaac

SEQ ID NO: 396873 - DNA, 25 bp, Homo sapien
gtcccgtagagctaaaacagcccag

SEQ ID NO: 396874 - DNA, 25 bp, Homo sapien
gctaaaacagcccagactcagtgaa

SEQ ID NO: 396875 - DNA, 25 bp, Homo sapien
aaaacagcccagactcagtgaaaac

SEQ ID NO: 396876 - DNA, 25 bp, Homo sapien
ccatcttctgtttctgcatctatag

SEQ ID NO: 396877 - DNA, 25 bp, Homo sapien
tcttctgtttctgcatctataggag

SEQ ID NO: 396878 - DNA, 25 bp, Homo sapien
tctgtttctgcatctataggagaca

SEQ ID NO: 396879 - DNA, 25 bp, Homo sapien
gaagatttcgcaacttacttttgtc

SEQ ID NO: 396880 - DNA, 25 bp, Homo sapien
gatttcgcaacttacttttgtcaac

SEQ ID NO: 396881 - DNA, 25 bp, Homo sapien
gcaacttacttttgtcaacagacta

SEQ ID NO: 396882 - DNA, 25 bp, Homo sapien
gtcaacagactaacagtttcccgct

SEQ ID NO: 396883 - DNA, 25 bp, Homo sapien
agactaacagtttcccgctcacttt

SEQ ID NO: 396884 - DNA, 25 bp, Homo sapien
gttagcaggtggttagcctggtatc

SEQ ID NO: 396885 - DNA, 25 bp, Homo sapien
aggtggttagcctggtatcaacaga

SEQ ID NO: 396886 - DNA, 25 bp, Homo sapien
tggttagcctggtatcaacagaaac

SEQ ID NO: 396887 - DNA, 25 bp, Homo sapien
agggtatgaactgcatgaacaaaga

SEQ ID NO: 396888 - DNA, 25 bp, Homo sapien
gggtatgaactgcatgaacaaagac

SEQ ID NO: 396889 - DNA, 25 bp, Homo sapien
gtatgaactgcatgaacaaagacca

SEQ ID NO: 396890 - DNA, 25 bp, Homo sapien
tatgaactgcatgaacaaagaccat

SEQ ID NO: 396891 - DNA, 25 bp, Homo sapien
atgaactgcatgaacaaagaccatg

SEQ ID NO: 396892 - DNA, 25 bp, Homo sapien
catgaacaaagaccatggctgtgcc

SEQ ID NO: 396893 - DNA, 25 bp, Homo sapien
acatctgccgggagacgcccaaagg

SEQ ID NO: 396894 - DNA, 25 bp, Homo sapien
catctgccgggagacgcccaaaggt

SEQ ID NO: 396895 - DNA, 25 bp, Homo sapien
atctgccgggagacgcccaaaggtg

SEQ ID NO: 396896 - DNA, 25 bp, Homo sapien
tctgccgggagacgcccaaaggtgg

SEQ ID NO: 396897 - DNA, 25 bp, Homo sapien
caaaggtggggtggcctgcgactgc

SEQ ID NO: 396898 - DNA, 25 bp, Homo sapien
agccagagaagcgattagaaacccc

SEQ ID NO: 396899 - DNA, 25 bp, Homo sapien
gccagagaagcgattagaaacccct

SEQ ID NO: 396900 - DNA, 25 bp, Homo sapien
ccagagaagcgattagaaacccctg

SEQ ID NO: 396901 - DNA, 25 bp, Homo sapien
agagaagcgattagaaacccctgag

SEQ ID NO: 396902 - DNA, 25 bp, Homo sapien
gagaagcgattagaaacccctgagg

SEQ ID NO: 396903 - DNA, 25 bp, Homo sapien
agaagcgattagaaacccctgaggg

SEQ ID NO: 396904 - DNA, 25 bp, Homo sapien
agcgattagaaacccctgagggccg

SEQ ID NO: 396905 - DNA, 25 bp, Homo sapien
gcgattagaaacccctgagggccga

SEQ ID NO: 396906 - DNA, 25 bp, Homo sapien
caggtggaagatgaccgcactcatt

SEQ ID NO: 396907 - DNA, 25 bp, Homo sapien
aggtggaagatgaccgcactcattc

SEQ ID NO: 396908 - DNA, 25 bp, Homo sapien
ggtggaagatgaccgcactcattct

SEQ ID NO: 396909 - DNA, 25 bp, Homo sapien
gtggaagatgaccgcactcattctg

SEQ ID NO: 396910 - DNA, 25 bp, Homo sapien
agatgaccgcactcattctgactat

SEQ ID NO: 396911 - DNA, 25 bp, Homo sapien
gatgaccgcactcattctgactata

SEQ ID NO: 396912 - DNA, 25 bp, Homo sapien
atgaccgcactcattctgactataa

SEQ ID NO: 396913 - DNA, 25 bp, Homo sapien
tgaccgcactcattctgactataac

SEQ ID NO: 396914 - DNA, 25 bp, Homo sapien
gaccgcactcattctgactataaca

SEQ ID NO: 396915 - DNA, 25 bp, Homo sapien
accgcactcattctgactataacat

SEQ ID NO: 396916 - DNA, 25 bp, Homo sapien
agggtatgaactgcatgaacaaaga

SEQ ID NO: 396917 - DNA, 25 bp, Homo sapien
gggtatgaactgcatgaacaaagac

SEQ ID NO: 396918 - DNA, 25 bp, Homo sapien
ggtatgaactgcatgaacaaagacc

SEQ ID NO: 396919 - DNA, 25 bp, Homo sapien
gtatgaactgcatgaacaaagacca

SEQ ID NO: 396920 - DNA, 25 bp, Homo sapien
tatgaactgcatgaacaaagaccat

SEQ ID NO: 396921 - DNA, 25 bp, Homo sapien
atgaactgcatgaacaaagaccatg

SEQ ID NO: 396922 - DNA, 25 bp, Homo sapien
acatctgccgggagacgcccaaagg

SEQ ID NO: 396923 - DNA, 25 bp, Homo sapien
catctgccgggagacgcccaaaggt

SEQ ID NO: 396924 - DNA, 25 bp, Homo sapien
atctgccgggagacgcccaaaggtg

SEQ ID NO: 396925 - DNA, 25 bp, Homo sapien
tctgccgggagacgcccaaaggtgg

SEQ ID NO: 396926 - DNA, 25 bp, Homo sapien
caaaggtggggtggcctgcgactgc

SEQ ID NO: 396927 - DNA, 25 bp, Homo sapien
gacccatcagggttcctataatact

SEQ ID NO: 396928 - DNA, 25 bp, Homo sapien
atacttttagattacacagcccctg

SEQ ID NO: 396929 - DNA, 25 bp, Homo sapien
acagcccctgtgcactatatggata

SEQ ID NO: 396930 - DNA, 25 bp, Homo sapien
atggatataacttctccacatcccc

SEQ ID NO: 396931 - DNA, 25 bp, Homo sapien
gtcctcaccgagtgggaccatgacg

SEQ ID NO: 396932 - DNA, 25 bp, Homo sapien
ggaccatgacggatcggcagatgtt

SEQ ID NO: 396933 - DNA, 25 bp, Homo sapien
atgacggatcggcagatgttgcccc

SEQ ID NO: 396934 - DNA, 25 bp, Homo sapien
cccctgtggaaggagtgcacctgct

SEQ ID NO: 396935 - DNA, 25 bp, Homo sapien
gggtcagcagagtttctttgactct

SEQ ID NO: 396936 - DNA, 25 bp, Homo sapien
agtttctttgactctaggaccctag

SEQ ID NO: 396937 - DNA, 25 bp, Homo sapien
aggaccctaggaagcttaactctgt

SEQ ID NO: 396938 - DNA, 25 bp, Homo sapien
aaacatagcagaggccacagcagtg

SEQ ID NO: 396939 - DNA, 25 bp, Homo sapien
ggacatttctgaagtgagccctcaa

SEQ ID NO: 396940 - DNA, 25 bp, Homo sapien
tgagccctcaatgctcacagtgttt

SEQ ID NO: 396941 - DNA, 25 bp, Homo sapien
aatgctcacagtgtttcccaagctg

SEQ ID NO: 396942 - DNA, 25 bp, Homo sapien
gctatattgctgtgcgaattgtacc

SEQ ID NO: 396943 - DNA, 25 bp, Homo sapien
gtgcgaattgtaccattcacagcaa

SEQ ID NO: 396944 - DNA, 25 bp, Homo sapien
acccctaccactatttagacctgtg

SEQ ID NO: 396945 - DNA, 25 bp, Homo sapien
aatggtcatgccattcacttgcagc

SEQ ID NO: 396946 - DNA, 25 bp, Homo sapien
ctgttcactgcaagaactgtgctca

SEQ ID NO: 396947 - DNA, 25 bp, Homo sapien
aactgtgctcaatgcatgcccagga

SEQ ID NO: 396948 - DNA, 25 bp, Homo sapien
gcatgcccaggaataaggctattaa

SEQ ID NO: 396949 - DNA, 25 bp, Homo sapien
cctaggtatatgaggagggcctgct

SEQ ID NO: 396950 - DNA, 25 bp, Homo sapien
atcaaggtcaaagtgtcggctaagc

SEQ ID NO: 396951 - DNA, 25 bp, Homo sapien
aaagtgtcggctaagctggccacct

SEQ ID NO: 396952 - DNA, 25 bp, Homo sapien
taagctggccaccttactgctgcct

SEQ ID NO: 396953 - DNA, 25 bp, Homo sapien
gagggacttcaatcccggtgatgcc

SEQ ID NO: 396954 - DNA, 25 bp, Homo sapien
tgatgccctggatagcagcaatccc

SEQ ID NO: 396955 - DNA, 25 bp, Homo sapien
gatagcagcaatcccatgcaagcca

SEQ ID NO: 396956 - DNA, 25 bp, Homo sapien
aatcccatgcaagccatctgaaaga

SEQ ID NO: 396957 - DNA, 25 bp, Homo sapien
atctgaaagaccaccacttgcagga

SEQ ID NO: 396958 - DNA, 25 bp, Homo sapien
agtggacggcaaagtagcatctccc

SEQ ID NO: 396959 - DNA, 25 bp, Homo sapien
gaggcccacaatgccatgcagatgg

SEQ ID NO: 396960 - DNA, 25 bp, Homo sapien
gtgcttaagattcaggttcactatt

SEQ ID NO: 396961 - DNA, 25 bp, Homo sapien
gcttaagattcaggttcactattat

SEQ ID NO: 396962 - DNA, 25 bp, Homo sapien
taagattcaggttcactattatgaa

SEQ ID NO: 396963 - DNA, 25 bp, Homo sapien
gttcagttggttagtcataaagatg

SEQ ID NO: 396964 - DNA, 25 bp, Homo sapien
ttagtcataaagatgtacaggattc

SEQ ID NO: 396965 - DNA, 25 bp, Homo sapien
gtttcgaatgaagcccaaactgcca

SEQ ID NO: 396966 - DNA, 25 bp, Homo sapien
tcgaatgaagcccaaactgccaagg

SEQ ID NO: 396967 - DNA, 25 bp, Homo sapien
aatgaagcccaaactgccaaggagt

SEQ ID NO: 396968 - DNA, 25 bp, Homo sapien
aatgagtatcagacagcaattagtg

SEQ ID NO: 396969 - DNA, 25 bp, Homo sapien
gacagcaattagtgaaaactatcaa

SEQ ID NO: 396970 - DNA, 25 bp, Homo sapien
gcaccaaaatcgactggaacaagat

SEQ ID NO: 396971 - DNA, 25 bp, Homo sapien
gaatgtcctctatggaccgggcatt

SEQ ID NO: 396972 - DNA, 25 bp, Homo sapien
gtcctctatggaccgggcattccca

SEQ ID NO: 396973 - DNA, 25 bp, Homo sapien
tatggaccgggcattcccaccattt

SEQ ID NO: 396974 - DNA, 25 bp, Homo sapien
cccagactcctattaccatccaggg

SEQ ID NO: 396975 - DNA, 25 bp, Homo sapien
acagtactcctggtttgtcagtgga

SEQ ID NO: 396976 - DNA, 25 bp, Homo sapien
gtactcctggtttgtcagtggaatg

SEQ ID NO: 396977 - DNA, 25 bp, Homo sapien
aatgctccagcaacacacacaaaag

SEQ ID NO: 396978 - DNA, 25 bp, Homo sapien
tttatccccaacatcgcagtggata

SEQ ID NO: 396979 - DNA, 25 bp, Homo sapien
cccaacatcgcagtggataagagtg

SEQ ID NO: 396980 - DNA, 25 bp, Homo sapien
gataagagtggatcctatgcttgcc

SEQ ID NO: 396981 - DNA, 25 bp, Homo sapien
aagagtggatcctatgcttgcctcg

SEQ ID NO: 396982 - DNA, 25 bp, Homo sapien
tcagagtggctgtgtttccagaggt

SEQ ID NO: 396983 - DNA, 25 bp, Homo sapien
aggggactggcctggtctctgttga

SEQ ID NO: 396984 - DNA, 25 bp, Homo sapien
tctctgttgataccaggaagcatat

SEQ ID NO: 396985 - DNA, 25 bp, Homo sapien
ctctgttgataccaggaagcatatt

SEQ ID NO: 396986 - DNA, 25 bp, Homo sapien
atttcccaatttatctccagagcag

SEQ ID NO: 396987 - DNA, 25 bp, Homo sapien
ctccgccgaatatcacatgggtgtt

SEQ ID NO: 396988 - DNA, 25 bp, Homo sapien
ccgccgaatatcacatgggtgttgt

SEQ ID NO: 396989 - DNA, 25 bp, Homo sapien
ccgaatatcacatgggtgttgtccc

SEQ ID NO: 396990 - DNA, 25 bp, Homo sapien
atatcacatgggtgttgtcccacgc

SEQ ID NO: 396991 - DNA, 25 bp, Homo sapien
atcacatgggtgttgtcccacgcct

SEQ ID NO: 396992 - DNA, 25 bp, Homo sapien
acatgggtgttgtcccacgcctgac

SEQ ID NO: 396993 - DNA, 25 bp, Homo sapien
tctagaacgtgctgcgcgtcctggg

SEQ ID NO: 396994 - DNA, 25 bp, Homo sapien
ggctgcggcctggaagaagcactcc

SEQ ID NO: 396995 - DNA, 25 bp, Homo sapien
caccttccacattcgggaacgtgcg

SEQ ID NO: 396996 - DNA, 25 bp, Homo sapien
gaacgtgcggaagctcatcaccgag

SEQ ID NO: 396997 - DNA, 25 bp, Homo sapien
atcaccgaggagttcgtccagcaga

SEQ ID NO: 396998 - DNA, 25 bp, Homo sapien
cgaggagttcgtccagcagaattac

SEQ ID NO: 396999 - DNA, 25 bp, Homo sapien
cagaattacctgaagtaccggcccg

SEQ ID NO: 397000 - DNA, 25 bp, Homo sapien
ggccagccgcgaaattacgaacatg

SEQ ID NO: 397001 - DNA, 25 bp, Homo sapien
gcgaaattacgaacatgcaaatcat

SEQ ID NO: 397002 - DNA, 25 bp, Homo sapien
gccaggcaggccttccggatactgg

SEQ ID NO: 397003 - DNA, 25 bp, Homo sapien
ggccttccggatactgggaagctat

SEQ ID NO: 397004 - DNA, 25 bp, Homo sapien
taacaacatgggagaagcgggagca

SEQ ID NO: 397005 - DNA, 25 bp, Homo sapien
aggaccctgcgcactgcgacccagc

SEQ ID NO: 397006 - DNA, 25 bp, Homo sapien
gacagcctcaggtctcccaggaagg

SEQ ID NO: 397007 - DNA, 25 bp, Homo sapien
cagcctcaggtctcccaggaaggac

SEQ ID NO: 397008 - DNA, 25 bp, Homo sapien
gatggtcagagaacaggacagccag

SEQ ID NO: 397009 - DNA, 25 bp, Homo sapien
ggacagccagcagggtgcagcccga

SEQ ID NO: 397010 - DNA, 25 bp, Homo sapien
agcccgaggacagggatggacgctg

SEQ ID NO: 397011 - DNA, 25 bp, Homo sapien
atggacgctgggaggtcaacaggac

SEQ ID NO: 397012 - DNA, 25 bp, Homo sapien
gggccgtggagtgggcgaaggtcct

SEQ ID NO: 397013 - DNA, 25 bp, Homo sapien
ctggagaacctgtgggtccgtgttt

SEQ ID NO: 397014 - DNA, 25 bp, Homo sapien
cctgtgggtccgtgtttgtgggaag

SEQ ID NO: 397015 - DNA, 25 bp, Homo sapien
tctgccactacaaccagcagaatct

SEQ ID NO: 397016 - DNA, 25 bp, Homo sapien
aaccagcagaatctctggtcctgaa

SEQ ID NO: 397017 - DNA, 25 bp, Homo sapien
cagcagaatctctggtcctgaaact

SEQ ID NO: 397018 - DNA, 25 bp, Homo sapien
gcagaatctctggtcctgaaactac

SEQ ID NO: 397019 - DNA, 25 bp, Homo sapien
ctctgcttctacaactagcacaacc

SEQ ID NO: 397020 - DNA, 25 bp, Homo sapien
ggaactactcccagtgctgttccca

SEQ ID NO: 397021 - DNA, 25 bp, Homo sapien
accagcacaatctctgttcctacca

SEQ ID NO: 397022 - DNA, 25 bp, Homo sapien
tgcacctacaaccagcacaaactct

SEQ ID NO: 397023 - DNA, 25 bp, Homo sapien
aaactctgcccctataagcagcaca

SEQ ID NO: 397024 - DNA, 25 bp, Homo sapien
aactctgcccctataagcagcacaa

SEQ ID NO: 397025 - DNA, 25 bp, Homo sapien
ataagcagcacaacctctgccacta

SEQ ID NO: 397026 - DNA, 25 bp, Homo sapien
gcaactacgccaagcgggtccgggc

SEQ ID NO: 397027 - DNA, 25 bp, Homo sapien
tcgccatccacgacgagaagctcaa

SEQ ID NO: 397028 - DNA, 25 bp, Homo sapien
catccacgacgagaagctcaacaag

SEQ ID NO: 397029 - DNA, 25 bp, Homo sapien
caacaagctgttgggcaaagttact

SEQ ID NO: 397030 - DNA, 25 bp, Homo sapien
gttgggcaaagttactatcgcgcag

SEQ ID NO: 397031 - DNA, 25 bp, Homo sapien
caaagttactatcgcgcagggcggt

SEQ ID NO: 397032 - DNA, 25 bp, Homo sapien
cgcgccaaggctaaaacgcactctt

SEQ ID NO: 397033 - DNA, 25 bp, Homo sapien
aaggctaaaacgcactcttccaggg

SEQ ID NO: 397034 - DNA, 25 bp, Homo sapien
taaaacgcactcttccagggctggt

SEQ ID NO: 397035 - DNA, 25 bp, Homo sapien
cagggctggtctccagttttctgtg

SEQ ID NO: 397036 - DNA, 25 bp, Homo sapien
gtctccagttttctgtgggccgagt

SEQ ID NO: 397037 - DNA, 25 bp, Homo sapien
acaggacagagaagaggaagcggct

SEQ ID NO: 397038 - DNA, 25 bp, Homo sapien
agctccagtgccaaccagcaggggg

SEQ ID NO: 397039 - DNA, 25 bp, Homo sapien
agcagggggcacaggacagagaaga

SEQ ID NO: 397040 - DNA, 25 bp, Homo sapien
cagagaagaggaagcggcagcagcc

SEQ ID NO: 397041 - DNA, 25 bp, Homo sapien
agagaagaggaagcggcagcagccc

SEQ ID NO: 397042 - DNA, 25 bp, Homo sapien
agaagaggaagcggcagcagcccca

SEQ ID NO: 397043 - DNA, 25 bp, Homo sapien
aagaggaagcggcagcagccccagc

SEQ ID NO: 397044 - DNA, 25 bp, Homo sapien
agaggaagcggcagcagccccagcg

SEQ ID NO: 397045 - DNA, 25 bp, Homo sapien
agccccagcgccgaccagcagcggg

SEQ ID NO: 397046 - DNA, 25 bp, Homo sapien
agcgccgaccagcagcgggcacagg

SEQ ID NO: 397047 - DNA, 25 bp, Homo sapien
gcgccgaccagcagggggcacagga

SEQ ID NO: 397048 - DNA, 25 bp, Homo sapien
gatacagccaccagggcggtcccag

SEQ ID NO: 397049 - DNA, 25 bp, Homo sapien
agagaccctcctatacatgttctgg

SEQ ID NO: 397050 - DNA, 25 bp, Homo sapien
agaccctcctatacatgttctggtt

SEQ ID NO: 397051 - DNA, 25 bp, Homo sapien
tcctatacatgttctggttccactt

SEQ ID NO: 397052 - DNA, 25 bp, Homo sapien
tatacatgttctggttccacttctg

SEQ ID NO: 397053 - DNA, 25 bp, Homo sapien
tggttccacttctggtgatcatggt

SEQ ID NO: 397054 - DNA, 25 bp, Homo sapien
gttccacttctggtgatcatggtat

SEQ ID NO: 397055 - DNA, 25 bp, Homo sapien
cacttctggtgatcatggtatgaat

SEQ ID NO: 397056 - DNA, 25 bp, Homo sapien
ttgttggtattttaaaaggtatgca

SEQ ID NO: 397057 - DNA, 25 bp, Homo sapien
aaaggtatgcaatgtgaggtgcaac

SEQ ID NO: 397058 - DNA, 25 bp, Homo sapien
gaggctcgatacagccaccagggcg

SEQ ID NO: 397059 - DNA, 25 bp, Homo sapien
gtagatatatagtacgatagaagtc

SEQ ID NO: 397060 - DNA, 25 bp, Homo sapien
gatagaagtcagatatgttatgcac

SEQ ID NO: 397061 - DNA, 25 bp, Homo sapien
gaagtcagatatgttatgcacaatc

SEQ ID NO: 397062 - DNA, 25 bp, Homo sapien
agatatgttatgcacaatctgtgaa

SEQ ID NO: 397063 - DNA, 25 bp, Homo sapien
ttatgcacaatctgtgaagagcaga

SEQ ID NO: 397064 - DNA, 25 bp, Homo sapien
ctggattaaccttcagtagctactg

SEQ ID NO: 397065 - DNA, 25 bp, Homo sapien
ggattaaccttcagtagctactgaa

SEQ ID NO: 397066 - DNA, 25 bp, Homo sapien
cagtagctactgaatgagctcagat

SEQ ID NO: 397067 - DNA, 25 bp, Homo sapien
gctactgaatgagctcagattccca

SEQ ID NO: 397068 - DNA, 25 bp, Homo sapien
tactgaatgagctcagattcccagg

SEQ ID NO: 397069 - DNA, 25 bp, Homo sapien
ggctggagtgagtagtagatatata

SEQ ID NO: 397070 - DNA, 25 bp, Homo sapien
gagctaagacgtctaatgatgtcca

SEQ ID NO: 397071 - DNA, 25 bp, Homo sapien
ctaagacgtctaatgatgtccaaag

SEQ ID NO: 397072 - DNA, 25 bp, Homo sapien
ttacaaggtggacaggcatgattat

SEQ ID NO: 397073 - DNA, 25 bp, Homo sapien
tacaaggtggacaggcatgattatt

SEQ ID NO: 397074 - DNA, 25 bp, Homo sapien
ggacaggcatgattattgggccacc

SEQ ID NO: 397075 - DNA, 25 bp, Homo sapien
gacaggcatgattattgggccacca

SEQ ID NO: 397076 - DNA, 25 bp, Homo sapien
acaggcatgattattgggccaccaa

SEQ ID NO: 397077 - DNA, 25 bp, Homo sapien
caggcatgattattgggccaccaag

SEQ ID NO: 397078 - DNA, 25 bp, Homo sapien
ggcatgattattgggccaccaagga

SEQ ID NO: 397079 - DNA, 25 bp, Homo sapien
tgattattgggccaccaaggacaaa

SEQ ID NO: 397080 - DNA, 25 bp, Homo sapien
gattattgggccaccaaggacaaat

SEQ ID NO: 397081 - DNA, 25 bp, Homo sapien
aagaggattatgctggaatgttctc

SEQ ID NO: 397082 - DNA, 25 bp, Homo sapien
gaatgttctcagactaagggtcatg

SEQ ID NO: 397083 - DNA, 25 bp, Homo sapien
gggtcatgatagaatgtactggtat

SEQ ID NO: 397084 - DNA, 25 bp, Homo sapien
aggactgggcctacggttgatctat

SEQ ID NO: 397085 - DNA, 25 bp, Homo sapien
tgggcctacggttgatctattactc

SEQ ID NO: 397086 - DNA, 25 bp, Homo sapien
tacggttgatctattactcctttga

SEQ ID NO: 397087 - DNA, 25 bp, Homo sapien
ttgatctattactcctttgatgtca

SEQ ID NO: 397088 - DNA, 25 bp, Homo sapien
aggagagatctctgatggatacagt

SEQ ID NO: 397089 - DNA, 25 bp, Homo sapien
tgatggatacagtgtctctcgacag

SEQ ID NO: 397090 - DNA, 25 bp, Homo sapien
tgtgccaccagtgacccaggacaga

SEQ ID NO: 397091 - DNA, 25 bp, Homo sapien
gaccccaaggaataggatcacaaag

SEQ ID NO: 397092 - DNA, 25 bp, Homo sapien
gctcattcgccttaagccataagta

SEQ ID NO: 397093 - DNA, 25 bp, Homo sapien
acaagttgtctggaatgcatgccgt

SEQ ID NO: 397094 - DNA, 25 bp, Homo sapien
aatgcatgccgttgctaggtttgtc

SEQ ID NO: 397095 - DNA, 25 bp, Homo sapien
ggcagtactctgaggatgacgtttt

SEQ ID NO: 397096 - DNA, 25 bp, Homo sapien
gatgacgttttcaaggatgctccct

SEQ ID NO: 397097 - DNA, 25 bp, Homo sapien
tgaactggatgctgtgtaaacacct

SEQ ID NO: 397098 - DNA, 25 bp, Homo sapien
acacctatgggtgcaagcttatacg

SEQ ID NO: 397099 - DNA, 25 bp, Homo sapien
acatggatgttgacctccttgccac

SEQ ID NO: 397100 - DNA, 25 bp, Homo sapien
tccttgccacctagtgtttggatga

SEQ ID NO: 397101 - DNA, 25 bp, Homo sapien
tatctctaggccatcatccgaagga

SEQ ID NO: 397102 - DNA, 25 bp, Homo sapien
gaaggatcgctgaagtccctggctc

SEQ ID NO: 397103 - DNA, 25 bp, Homo sapien
gccaatactgcaataaggaatgcct

SEQ ID NO: 397104 - DNA, 25 bp, Homo sapien
caatactgcaataaggaatgcctca

SEQ ID NO: 397105 - DNA, 25 bp, Homo sapien
gcaataaggaatgcctcagcctggg

SEQ ID NO: 397106 - DNA, 25 bp, Homo sapien
gcctgggtgccctcaagaaacacat

SEQ ID NO: 397107 - DNA, 25 bp, Homo sapien
tgccctcaagaaacacatccgaagc

SEQ ID NO: 397108 - DNA, 25 bp, Homo sapien
gaaacacatccgaagccacacgctg

SEQ ID NO: 397109 - DNA, 25 bp, Homo sapien
ttctccagaccctggctgctgcggg

SEQ ID NO: 397110 - DNA, 25 bp, Homo sapien
catgtccggacccacactggtgaga

SEQ ID NO: 397111 - DNA, 25 bp, Homo sapien
cccacttggacgtcaagaagtacca

SEQ ID NO: 397112 - DNA, 25 bp, Homo sapien
caagaagtaccagtgccaggcgtgc

SEQ ID NO: 397113 - DNA, 25 bp, Homo sapien
tgcgctcgaaccttctcccgaatgg

SEQ ID NO: 397114 - DNA, 25 bp, Homo sapien
aggaatcagcatgggagatcatctc

SEQ ID NO: 397115 - DNA, 25 bp, Homo sapien
gaatcagcatgggagatcatctctg

SEQ ID NO: 397116 - DNA, 25 bp, Homo sapien
cagcatgggagatcatctctgggtg

SEQ ID NO: 397117 - DNA, 25 bp, Homo sapien
agtgatagcaacctttgatcctaag

SEQ ID NO: 397118 - DNA, 25 bp, Homo sapien
gatagcaacctttgatcctaagccc

SEQ ID NO: 397119 - DNA, 25 bp, Homo sapien
agcaacctttgatcctaagcccatt

SEQ ID NO: 397120 - DNA, 25 bp, Homo sapien
aacctttgatcctaagcccattcct

SEQ ID NO: 397121 - DNA, 25 bp, Homo sapien
atcctaagcccattcctgggaactg

SEQ ID NO: 397122 - DNA, 25 bp, Homo sapien
tcctaagcccattcctgggaactgg

SEQ ID NO: 397123 - DNA, 25 bp, Homo sapien
gaactggaatggtgcaggctgccat

SEQ ID NO: 397124 - DNA, 25 bp, Homo sapien
tggaatggtgcaggctgccatacca

SEQ ID NO: 397125 - DNA, 25 bp, Homo sapien
tactttcaccatcggcagcttccag

SEQ ID NO: 397126 - DNA, 25 bp, Homo sapien
agcttccagcctgacgacgttgcaa

SEQ ID NO: 397127 - DNA, 25 bp, Homo sapien
ccagcctgacgacgttgcaacatat

SEQ ID NO: 397128 - DNA, 25 bp, Homo sapien
tactgtcaacactatgatgatctcc

SEQ ID NO: 397129 - DNA, 25 bp, Homo sapien
gtcaacactatgatgatctcccaat

SEQ ID NO: 397130 - DNA, 25 bp, Homo sapien
actatgatgatctcccaattacttt

SEQ ID NO: 397131 - DNA, 25 bp, Homo sapien
tgatgatctcccaattactttcggc

SEQ ID NO: 397132 - DNA, 25 bp, Homo sapien
atgatctcccaattactttcggccc

SEQ ID NO: 397133 - DNA, 25 bp, Homo sapien
cgagtcaggacattaccaactcttt

SEQ ID NO: 397134 - DNA, 25 bp, Homo sapien
gtcaggacattaccaactctttaaa

SEQ ID NO: 397135 - DNA, 25 bp, Homo sapien
aggacattaccaactctttaaattg

SEQ ID NO: 397136 - DNA, 25 bp, Homo sapien
aacttggtatcagaagaagccaggg

SEQ ID NO: 397137 - DNA, 25 bp, Homo sapien
agcccctaaagtcctgatctacgat

SEQ ID NO: 397138 - DNA, 25 bp, Homo sapien
agtggttctgggacagattttactt

SEQ ID NO: 397139 - DNA, 25 bp, Homo sapien
atcgccagcctgcagcctgacgatt

SEQ ID NO: 397140 - DNA, 25 bp, Homo sapien
aatataatgatcaccccctcacttt

SEQ ID NO: 397141 - DNA, 25 bp, Homo sapien
atataatgatcaccccctcactttc

SEQ ID NO: 397142 - DNA, 25 bp, Homo sapien
cgagtcaggacattagtaatttttt

SEQ ID NO: 397143 - DNA, 25 bp, Homo sapien
taattttttaacttggtatcagaag

SEQ ID NO: 397144 - DNA, 25 bp, Homo sapien
ttttaacttggtatcagaagaagcc

SEQ ID NO: 397145 - DNA, 25 bp, Homo sapien
ttaacttggtatcagaagaagccag

SEQ ID NO: 397146 - DNA, 25 bp, Homo sapien
taacttggtatcagaagaagccagg

SEQ ID NO: 397147 - DNA, 25 bp, Homo sapien
cagctgagatggcttgtttcatgtt

SEQ ID NO: 397148 - DNA, 25 bp, Homo sapien
tgagatggcttgtttcatgttccct

SEQ ID NO: 397149 - DNA, 25 bp, Homo sapien
agatggcttgtttcatgttccctca

SEQ ID NO: 397150 - DNA, 25 bp, Homo sapien
tggcttgtttcatgttccctcagga

SEQ ID NO: 397151 - DNA, 25 bp, Homo sapien
gcttgtttcatgttccctcaggagg

SEQ ID NO: 397152 - DNA, 25 bp, Homo sapien
tttcatgttccctcaggaggatatc

SEQ ID NO: 397153 - DNA, 25 bp, Homo sapien
ccctcaggaggatatcatagcagct

SEQ ID NO: 397154 - DNA, 25 bp, Homo sapien
tcatagcagctgtcaggtcacatag

SEQ ID NO: 397155 - DNA, 25 bp, Homo sapien
tagcagctgtcaggtcacatagtgc

SEQ ID NO: 397156 - DNA, 25 bp, Homo sapien
agctgtcaggtcacatagtgctgat

SEQ ID NO: 397157 - DNA, 25 bp, Homo sapien
tgtcaggtcacatagtgctgatggg

SEQ ID NO: 397158 - DNA, 25 bp, Homo sapien
gtggcagtgtgagaaaggctcaact

SEQ ID NO: 397159 - DNA, 25 bp, Homo sapien
gtgtgagaaaggctcaactggccat

SEQ ID NO: 397160 - DNA, 25 bp, Homo sapien
gtgagaaaggctcaactggccattg

SEQ ID NO: 397161 - DNA, 25 bp, Homo sapien
gagaaaggctcaactggccattgct

SEQ ID NO: 397162 - DNA, 25 bp, Homo sapien
gaaaggctcaactggccattgctgg

SEQ ID NO: 397163 - DNA, 25 bp, Homo sapien
aaaggctcaactggccattgctggc

SEQ ID NO: 397164 - DNA, 25 bp, Homo sapien
ggctcaactggccattgctggcttc

SEQ ID NO: 397165 - DNA, 25 bp, Homo sapien
tcaactggccattgctggcttcgag

SEQ ID NO: 397166 - DNA, 25 bp, Homo sapien
aactggccattgctggcttcgaggc

SEQ ID NO: 397167 - DNA, 25 bp, Homo sapien
ccattgctggcttcgaggctgtagg

SEQ ID NO: 397168 - DNA, 25 bp, Homo sapien
attgctggcttcgaggctgtaggaa

SEQ ID NO: 397169 - DNA, 25 bp, Homo sapien
agcaccaggatgatggtcagctgct

SEQ ID NO: 397170 - DNA, 25 bp, Homo sapien
gcaccaggatgatggtcagctgctc

SEQ ID NO: 397171 - DNA, 25 bp, Homo sapien
caccaggatgatggtcagctgctct

SEQ ID NO: 397172 - DNA, 25 bp, Homo sapien
accaggatgatggtcagctgctctg

SEQ ID NO: 397173 - DNA, 25 bp, Homo sapien
ccaggatgatggtcagctgctctgc

SEQ ID NO: 397174 - DNA, 25 bp, Homo sapien
caggatgatggtcagctgctctgcc

SEQ ID NO: 397175 - DNA, 25 bp, Homo sapien
aggatgatggtcagctgctctgccc

SEQ ID NO: 397176 - DNA, 25 bp, Homo sapien
ggatgatggtcagctgctctgccct

SEQ ID NO: 397177 - DNA, 25 bp, Homo sapien
gatgatggtcagctgctctgccctg

SEQ ID NO: 397178 - DNA, 25 bp, Homo sapien
atgatggtcagctgctctgccctgc

SEQ ID NO: 397179 - DNA, 25 bp, Homo sapien
tgatggtcagctgctctgccctgcc

SEQ ID NO: 397180 - DNA, 25 bp, Homo sapien
gccaatactgcaataaggaatgcct

SEQ ID NO: 397181 - DNA, 25 bp, Homo sapien
ccaatactgcaataaggaatgcctc

SEQ ID NO: 397182 - DNA, 25 bp, Homo sapien
caatactgcaataaggaatgcctca

SEQ ID NO: 397183 - DNA, 25 bp, Homo sapien
ggctgctgcggggccatgtccggac

SEQ ID NO: 397184 - DNA, 25 bp, Homo sapien
gctgctgcggggccatgtccggacc

SEQ ID NO: 397185 - DNA, 25 bp, Homo sapien
cccacttggacgtcaagaagtacca

SEQ ID NO: 397186 - DNA, 25 bp, Homo sapien
ccacttggacgtcaagaagtaccag

SEQ ID NO: 397187 - DNA, 25 bp, Homo sapien
tgcgctcgaaccttctcccgaatgg

SEQ ID NO: 397188 - DNA, 25 bp, Homo sapien
gcgctcgaaccttctcccgaatggc

SEQ ID NO: 397189 - DNA, 25 bp, Homo sapien
cgctcgaaccttctcccgaatggcc

SEQ ID NO: 397190 - DNA, 25 bp, Homo sapien
atctgcactgcagcgtgtcagtctg

SEQ ID NO: 397191 - DNA, 25 bp, Homo sapien
catcctgtgtggtgacctgtcctga

SEQ ID NO: 397192 - DNA, 25 bp, Homo sapien
gacctgtcctgatctcagtcgaaga

SEQ ID NO: 397193 - DNA, 25 bp, Homo sapien
tagtgtttctagcaaaggccccatg

SEQ ID NO: 397194 - DNA, 25 bp, Homo sapien
catgattctactccaagccactaag

SEQ ID NO: 397195 - DNA, 25 bp, Homo sapien
taaggaccctccagaaaagctccgt

SEQ ID NO: 397196 - DNA, 25 bp, Homo sapien
aaaagctccgtgttcctgtagactc

SEQ ID NO: 397197 - DNA, 25 bp, Homo sapien
aagttctgtgggtggcaggcctttc

SEQ ID NO: 397198 - DNA, 25 bp, Homo sapien
tttctgggaccttaatccttggagc

SEQ ID NO: 397199 - DNA, 25 bp, Homo sapien
atccttggagccttgttagtatcct

SEQ ID NO: 397200 - DNA, 25 bp, Homo sapien
gttagtatcctacttggctgtcaag

SEQ ID NO: 397201 - DNA, 25 bp, Homo sapien
gatggcgttagtcatgcacaactac

SEQ ID NO: 397202 - DNA, 25 bp, Homo sapien
gagccgaaccacagcgtcacaaaat

SEQ ID NO: 397203 - DNA, 25 bp, Homo sapien
tggaccccgagcaacactgcaagaa

SEQ ID NO: 397204 - DNA, 25 bp, Homo sapien
gtgacggcagaattgagcttacagt

SEQ ID NO: 397205 - DNA, 25 bp, Homo sapien
gcttacagtagagagctcggcagat

SEQ ID NO: 397206 - DNA, 25 bp, Homo sapien
gctcggcagatgaccttagaacact

SEQ ID NO: 397207 - DNA, 25 bp, Homo sapien
gaccttagaacactacagcagctgt

SEQ ID NO: 397208 - DNA, 25 bp, Homo sapien
tgtattgcatttggaacctcagaat

SEQ ID NO: 397209 - DNA, 25 bp, Homo sapien
gaattagatcctgttgacctgttgt

SEQ ID NO: 397210 - DNA, 25 bp, Homo sapien
gttgacctgttgtgttacgagcaat

SEQ ID NO: 397211 - DNA, 25 bp, Homo sapien
gttacgagcaattaagcgagtcaga

SEQ ID NO: 397212 - DNA, 25 bp, Homo sapien
aggccattgaggaagacggcaccga

SEQ ID NO: 397213 - DNA, 25 bp, Homo sapien
ctttggagcacctggtagtgtggca

SEQ ID NO: 397214 - DNA, 25 bp, Homo sapien
tgtccgcagccacacgcaaaaaaga

SEQ ID NO: 397215 - DNA, 25 bp, Homo sapien
gatccgcatgtcactcaccttcagg

SEQ ID NO: 397216 - DNA, 25 bp, Homo sapien
gcacctggtagtgtggcatgtccac

SEQ ID NO: 397217 - DNA, 25 bp, Homo sapien
ggtagtgtggcatgtccacagtgaa

SEQ ID NO: 397218 - DNA, 25 bp, Homo sapien
ccacagtgaagaccagagtttcgtt

SEQ ID NO: 397219 - DNA, 25 bp, Homo sapien
gaagaccagagtttcgttgtcctta

SEQ ID NO: 397220 - DNA, 25 bp, Homo sapien
ccagagtttcgttgtccttaagact

SEQ ID NO: 397221 - DNA, 25 bp, Homo sapien
tcgttgtccttaagactgacctggg

SEQ ID NO: 397222 - DNA, 25 bp, Homo sapien
gggagacgtggctgcaggccattga

SEQ ID NO: 397223 - DNA, 25 bp, Homo sapien
tgtccgcggcggtcacagagttgaa

SEQ ID NO: 397224 - DNA, 25 bp, Homo sapien
gcggcggtcacagagttgaaattca

SEQ ID NO: 397225 - DNA, 25 bp, Homo sapien
gagaactggtccttggccgtgtcca

SEQ ID NO: 397226 - DNA, 25 bp, Homo sapien
ttggccgtgtccactgaaatggtgc

SEQ ID NO: 397227 - DNA, 25 bp, Homo sapien
ctgaaatggtgcctcgactgctgag

SEQ ID NO: 397228 - DNA, 25 bp, Homo sapien
aatggtgcctcgactgctgagggac

SEQ ID NO: 397229 - DNA, 25 bp, Homo sapien
agttggtgctcccagtataatagac

SEQ ID NO: 397230 - DNA, 25 bp, Homo sapien
gctcccagtataatagacactccca

SEQ ID NO: 397231 - DNA, 25 bp, Homo sapien
gtataatagacactcccaatccact

SEQ ID NO: 397232 - DNA, 25 bp, Homo sapien
ctggcggacccaggcccagtagtaa

SEQ ID NO: 397233 - DNA, 25 bp, Homo sapien
cctggccccagtactcaaagattgg

SEQ ID NO: 397234 - DNA, 25 bp, Homo sapien
agagtttttggccaagctatacaat

SEQ ID NO: 397235 - DNA, 25 bp, Homo sapien
gagtttttggccaagctatacaata

SEQ ID NO: 397236 - DNA, 25 bp, Homo sapien
agtttttggccaagctatacaatag

SEQ ID NO: 397237 - DNA, 25 bp, Homo sapien
gtttttggccaagctatacaatagt

SEQ ID NO: 397238 - DNA, 25 bp, Homo sapien
tttttggccaagctatacaatagta

SEQ ID NO: 397239 - DNA, 25 bp, Homo sapien
tttggccaagctatacaatagtatc

SEQ ID NO: 397240 - DNA, 25 bp, Homo sapien
ggccaagctatacaatagtatccct

SEQ ID NO: 397241 - DNA, 25 bp, Homo sapien
gccaagctatacaatagtatcccta

SEQ ID NO: 397242 - DNA, 25 bp, Homo sapien
gctatacaatagtatccctatttcc

SEQ ID NO: 397243 - DNA, 25 bp, Homo sapien
tatacaatagtatccctatttcctt

SEQ ID NO: 397244 - DNA, 25 bp, Homo sapien
atagtatccctatttcctttccatc

SEQ ID NO: 397245 - DNA, 25 bp, Homo sapien
atatgcttcctggtttcagcagaag

SEQ ID NO: 397246 - DNA, 25 bp, Homo sapien
cagtctcagctgactcagccggcct

SEQ ID NO: 397247 - DNA, 25 bp, Homo sapien
cctgtcctggtcatctatcaagata

SEQ ID NO: 397248 - DNA, 25 bp, Homo sapien
tatcaagataacaagcggccctcag

SEQ ID NO: 397249 - DNA, 25 bp, Homo sapien
gattctccggctccaactctgggag

SEQ ID NO: 397250 - DNA, 25 bp, Homo sapien
aactctgggagcacagccactctga

SEQ ID NO: 397251 - DNA, 25 bp, Homo sapien
actctgggagcacagccactctgac

SEQ ID NO: 397252 - DNA, 25 bp, Homo sapien
actcagccggcctcggtgtccgtgt

SEQ ID NO: 397253 - DNA, 25 bp, Homo sapien
gtcaggcgtgggacaccaacactgc

SEQ ID NO: 397254 - DNA, 25 bp, Homo sapien
gcgtgggacaccaacactgcggtat

SEQ ID NO: 397255 - DNA, 25 bp, Homo sapien
gccaccatcccctgctctggagata

SEQ ID NO: 397256 - DNA, 25 bp, Homo sapien
gcctgaaaatagaaagtggacccaa

SEQ ID NO: 397257 - DNA, 25 bp, Homo sapien
agtggacccaaatacccagaagctc

SEQ ID NO: 397258 - DNA, 25 bp, Homo sapien
agctcccccatcagttagatttgta

SEQ ID NO: 397259 - DNA, 25 bp, Homo sapien
ggatggtggatgaccgcagcacacc

SEQ ID NO: 397260 - DNA, 25 bp, Homo sapien
gtggatgaccgcagcacaccagtgt

SEQ ID NO: 397261 - DNA, 25 bp, Homo sapien
gatgaccgcagcacaccagtgttag

SEQ ID NO: 397262 - DNA, 25 bp, Homo sapien
tgaccgcagcacaccagtgttagca

SEQ ID NO: 397263 - DNA, 25 bp, Homo sapien
accgcagcacaccagtgttagcaaa

SEQ ID NO: 397264 - DNA, 25 bp, Homo sapien
tgtacttcaggagctaagacgtcta

SEQ ID NO: 397265 - DNA, 25 bp, Homo sapien
tttacaaggtggacaggcatgatta

SEQ ID NO: 397266 - DNA, 25 bp, Homo sapien
ggcatgattattgggccaccaagga

SEQ ID NO: 397267 - DNA, 25 bp, Homo sapien
aacaacaacaactactgtgccttgg

SEQ ID NO: 397268 - DNA, 25 bp, Homo sapien
acaacaactactgtgccttgggctg

SEQ ID NO: 397269 - DNA, 25 bp, Homo sapien
caactactgtgccttgggctgctat

SEQ ID NO: 397270 - DNA, 25 bp, Homo sapien
gctatgggggatggcacctctcagc

SEQ ID NO: 397271 - DNA, 25 bp, Homo sapien
tttcttgtgaccatcagggcctgga

SEQ ID NO: 397272 - DNA, 25 bp, Homo sapien
ttgtgaccatcagggcctggagacc

SEQ ID NO: 397273 - DNA, 25 bp, Homo sapien
cccagcaaggagttgcctgggtgct

SEQ ID NO: 397274 - DNA, 25 bp, Homo sapien
tgggtgctggctggtcactgccaga

SEQ ID NO: 397275 - DNA, 25 bp, Homo sapien
ctgcatgaggacctccagggcatgt

SEQ ID NO: 397276 - DNA, 25 bp, Homo sapien
tgaggacctccagggcatgttgctc

SEQ ID NO: 397277 - DNA, 25 bp, Homo sapien
tccagggcatgttgctcccttctgt

SEQ ID NO: 397278 - DNA, 25 bp, Homo sapien
tctggcagtgctattatgaggagtg

SEQ ID NO: 397279 - DNA, 25 bp, Homo sapien
ctggcagtgctattatgaggagtga

SEQ ID NO: 397280 - DNA, 25 bp, Homo sapien
tggcagtgctattatgaggagtgaa

SEQ ID NO: 397281 - DNA, 25 bp, Homo sapien
cagtgctattatgaggagtgaagac

SEQ ID NO: 397282 - DNA, 25 bp, Homo sapien
tgctattatgaggagtgaagacccc

SEQ ID NO: 397283 - DNA, 25 bp, Homo sapien
gctattatgaggagtgaagacccca

SEQ ID NO: 397284 - DNA, 25 bp, Homo sapien
tattatgaggagtgaagaccccaga

SEQ ID NO: 397285 - DNA, 25 bp, Homo sapien
tgaggagtgaagaccccagatctgt

SEQ ID NO: 397286 - DNA, 25 bp, Homo sapien
gagtgaagaccccagatctgtgatc

SEQ ID NO: 397287 - DNA, 25 bp, Homo sapien
agtgaagaccccagatctgtgatca

SEQ ID NO: 397288 - DNA, 25 bp, Homo sapien
gtgaagaccccagatctgtgatcaa

SEQ ID NO: 397289 - DNA, 25 bp, Homo sapien
cttctccttcttcaagacacatcaa

SEQ ID NO: 397290 - DNA, 25 bp, Homo sapien
tctccttcttcaagacacatcaaca

SEQ ID NO: 397291 - DNA, 25 bp, Homo sapien
cttcttcaagacacatcaacaggaa

SEQ ID NO: 397292 - DNA, 25 bp, Homo sapien
acatcaacaggaagttagcagaaac

SEQ ID NO: 397293 - DNA, 25 bp, Homo sapien
ggaagttagcagaaactacacattt

SEQ ID NO: 397294 - DNA, 25 bp, Homo sapien
tagcagaaactacacatttgaaatg

SEQ ID NO: 397295 - DNA, 25 bp, Homo sapien
gtaatgactacaaccctttcaatgg

SEQ ID NO: 397296 - DNA, 25 bp, Homo sapien
tgactacaaccctttcaatggcttc

SEQ ID NO: 397297 - DNA, 25 bp, Homo sapien
actacaaccctttcaatggcttccg

SEQ ID NO: 397298 - DNA, 25 bp, Homo sapien
tacaaccctttcaatggcttccgtc

SEQ ID NO: 397299 - DNA, 25 bp, Homo sapien
caaccctttcaatggcttccgtctt

SEQ ID NO: 397300 - DNA, 25 bp, Homo sapien
ccacactcatgatttatgatgtcat

SEQ ID NO: 397301 - DNA, 25 bp, Homo sapien
acactcatgatttatgatgtcatta

SEQ ID NO: 397302 - DNA, 25 bp, Homo sapien
ctcatgatttatgatgtcattaagc

SEQ ID NO: 397303 - DNA, 25 bp, Homo sapien
gactcagcctcgctcagtgtccgga

SEQ ID NO: 397304 - DNA, 25 bp, Homo sapien
actcagcctcgctcagtgtccggat

SEQ ID NO: 397305 - DNA, 25 bp, Homo sapien
ctgattattattgcagctcaaatgc

SEQ ID NO: 397306 - DNA, 25 bp, Homo sapien
tcagcctcgctcagtgtccggatct

SEQ ID NO: 397307 - DNA, 25 bp, Homo sapien
ctcaaatgcaggcagtttttatgtc

SEQ ID NO: 397308 - DNA, 25 bp, Homo sapien
tcaaatgcaggcagtttttatgtct

SEQ ID NO: 397309 - DNA, 25 bp, Homo sapien
ctcgctcagtgtccggatctcctgg

SEQ ID NO: 397310 - DNA, 25 bp, Homo sapien
gctcagtgtccggatctcctggaca

SEQ ID NO: 397311 - DNA, 25 bp, Homo sapien
tgtagcttttccagctgagaatggg

SEQ ID NO: 397312 - DNA, 25 bp, Homo sapien
atggggttcaggataccgaatcaac

SEQ ID NO: 397313 - DNA, 25 bp, Homo sapien
ctgtcactgaatctggttataaaac

SEQ ID NO: 397314 - DNA, 25 bp, Homo sapien
ggttataaaaccttatcttgcacta

SEQ ID NO: 397315 - DNA, 25 bp, Homo sapien
gttataaaaccttatcttgcactag

SEQ ID NO: 397316 - DNA, 25 bp, Homo sapien
ataaaaccttatcttgcactagaag

SEQ ID NO: 397317 - DNA, 25 bp, Homo sapien
aaaccttatcttgcactagaaggat

SEQ ID NO: 397318 - DNA, 25 bp, Homo sapien
cttatcttgcactagaaggatctgt

SEQ ID NO: 397319 - DNA, 25 bp, Homo sapien
atcttgcactagaaggatctgtagc

SEQ ID NO: 397320 - DNA, 25 bp, Homo sapien
cttgcactagaaggatctgtagctt

SEQ ID NO: 397321 - DNA, 25 bp, Homo sapien
gcactagaaggatctgtagcttttc

SEQ ID NO: 397322 - DNA, 25 bp, Homo sapien
aaatcgtcaggctgcaggctggcga

SEQ ID NO: 397323 - DNA, 25 bp, Homo sapien
aatcgtcaggctgcaggctggcgat

SEQ ID NO: 397324 - DNA, 25 bp, Homo sapien
tagatggtgcggcacagttcgtctc

SEQ ID NO: 397325 - DNA, 25 bp, Homo sapien
atggtgcggcacagttcgtctcaca

SEQ ID NO: 397326 - DNA, 25 bp, Homo sapien
ggtgcggcacagttcgtctcacatc

SEQ ID NO: 397327 - DNA, 25 bp, Homo sapien
ttccctggcttcttctgataccaag

SEQ ID NO: 397328 - DNA, 25 bp, Homo sapien
cctggcttcttctgataccaagtta

SEQ ID NO: 397329 - DNA, 25 bp, Homo sapien
aaaaaattactaatgtcctgactcg

SEQ ID NO: 397330 - DNA, 25 bp, Homo sapien
acagttcgtctcacatccactttgg

SEQ ID NO: 397331 - DNA, 25 bp, Homo sapien
gttcgtctcacatccactttggtcc

SEQ ID NO: 397332 - DNA, 25 bp, Homo sapien
atatgttgcaaaatcgtcaggctgc

SEQ ID NO: 397333 - DNA, 25 bp, Homo sapien
catgtccccactgccaaggtgttgg

SEQ ID NO: 397334 - DNA, 25 bp, Homo sapien
actgccaaggtgttggtcgtggacc

SEQ ID NO: 397335 - DNA, 25 bp, Homo sapien
tggacccgacctgccatctggaaaa

SEQ ID NO: 397336 - DNA, 25 bp, Homo sapien
ctgccatctggaaaacctgccaaat

SEQ ID NO: 397337 - DNA, 25 bp, Homo sapien
tgaagcaggcttcagaggatcctat

SEQ ID NO: 397338 - DNA, 25 bp, Homo sapien
gaggatcctatcaagggcatcctgg

SEQ ID NO: 397339 - DNA, 25 bp, Homo sapien
tgagcaccagattgtctcctccgac

SEQ ID NO: 397340 - DNA, 25 bp, Homo sapien
ttgtctcctccgacttcaacagtga

SEQ ID NO: 397341 - DNA, 25 bp, Homo sapien
tccgacttcaacagtgacacacagt

SEQ ID NO: 397342 - DNA, 25 bp, Homo sapien
tgacacacagtcttccacctttgat

SEQ ID NO: 397343 - DNA, 25 bp, Homo sapien
cacagtcttccacctttgatgctgg

SEQ ID NO: 397344 - DNA, 25 bp, Homo sapien
tatagtaataatcagcggccctcag

SEQ ID NO: 397345 - DNA, 25 bp, Homo sapien
attactggcagtcctatgacaggag

SEQ ID NO: 397346 - DNA, 25 bp, Homo sapien
ttactggcagtcctatgacaggagt

SEQ ID NO: 397347 - DNA, 25 bp, Homo sapien
tactggcagtcctatgacaggagtc

SEQ ID NO: 397348 - DNA, 25 bp, Homo sapien
actggcagtcctatgacaggagtct

SEQ ID NO: 397349 - DNA, 25 bp, Homo sapien
tggcagtcctatgacaggagtctga

SEQ ID NO: 397350 - DNA, 25 bp, Homo sapien
cagtcctatgacaggagtctgagtg

SEQ ID NO: 397351 - DNA, 25 bp, Homo sapien
gacaggagtctgagtggtgtggtat

SEQ ID NO: 397352 - DNA, 25 bp, Homo sapien
gaaattactgtaaactggtaccagc

SEQ ID NO: 397353 - DNA, 25 bp, Homo sapien
aattactgtaaactggtaccagcag

SEQ ID NO: 397354 - DNA, 25 bp, Homo sapien
attactgtaaactggtaccagcagc

SEQ ID NO: 397355 - DNA, 25 bp, Homo sapien
tcccacggccgtacccaggatgaaa

SEQ ID NO: 397356 - DNA, 25 bp, Homo sapien
gatgaaaacccggtggtgcacttct

SEQ ID NO: 397357 - DNA, 25 bp, Homo sapien
ccggtggtgcacttcttcaaaaaca

SEQ ID NO: 397358 - DNA, 25 bp, Homo sapien
cgtctcagggcaaaggccgtggcct

SEQ ID NO: 397359 - DNA, 25 bp, Homo sapien
cggcggccgtgcgtccgactataaa

SEQ ID NO: 397360 - DNA, 25 bp, Homo sapien
cttcaaaggcgtggatgcccagggc

SEQ ID NO: 397361 - DNA, 25 bp, Homo sapien
caccctgtccaaaattttcaaactg

SEQ ID NO: 397362 - DNA, 25 bp, Homo sapien
aattttcaaactgggcggccgtgat

SEQ ID NO: 397363 - DNA, 25 bp, Homo sapien
aactgggcggccgtgatagccgttc

SEQ ID NO: 397364 - DNA, 25 bp, Homo sapien
gtgatagccgttctggctctccgat

SEQ ID NO: 397365 - DNA, 25 bp, Homo sapien
cgttctggctctccgatggctagac

SEQ ID NO: 397366 - DNA, 25 bp, Homo sapien
tcccaggctctttctgcagtcatac

SEQ ID NO: 397367 - DNA, 25 bp, Homo sapien
aggctctttctgcagtcataccgcg

SEQ ID NO: 397368 - DNA, 25 bp, Homo sapien
gctctttctgcagtcataccgcgga

SEQ ID NO: 397369 - DNA, 25 bp, Homo sapien
ttctgcagtcataccgcggacccaa

SEQ ID NO: 397370 - DNA, 25 bp, Homo sapien
agtcataccgcggacccaatgggcg

SEQ ID NO: 397371 - DNA, 25 bp, Homo sapien
gtttctggggccgtcagacttggat

SEQ ID NO: 397372 - DNA, 25 bp, Homo sapien
agacttggatacatcgtaaactccg

SEQ ID NO: 397373 - DNA, 25 bp, Homo sapien
ttggatacatcgtaaactccgcctc

SEQ ID NO: 397374 - DNA, 25 bp, Homo sapien
ggatacatcgtaaactccgcctcca

SEQ ID NO: 397375 - DNA, 25 bp, Homo sapien
gccttgcgagcaagctcggaatcca

SEQ ID NO: 397376 - DNA, 25 bp, Homo sapien
tgcgagcaagctcggaatccagttc

SEQ ID NO: 397377 - DNA, 25 bp, Homo sapien
ggagcccaatctgctggacagcctg

SEQ ID NO: 397378 - DNA, 25 bp, Homo sapien
ggacagcctgggaccgtccattttc

SEQ ID NO: 397379 - DNA, 25 bp, Homo sapien
aggagaccaccttctacacagttat

SEQ ID NO: 397380 - DNA, 25 bp, Homo sapien
agttatgcggctggttgccaccgac

SEQ ID NO: 397381 - DNA, 25 bp, Homo sapien
accgacctgttgttcactttgctgg

SEQ ID NO: 397382 - DNA, 25 bp, Homo sapien
ttgctggtgagccaggtgaccatca

SEQ ID NO: 397383 - DNA, 25 bp, Homo sapien
aggtgaccatcaccatgtacatgaa

SEQ ID NO: 397384 - DNA, 25 bp, Homo sapien
gccagctgctgtgtgagtacagcat

SEQ ID NO: 397385 - DNA, 25 bp, Homo sapien
gtacagcatcttcagcttgttcttc

SEQ ID NO: 397386 - DNA, 25 bp, Homo sapien
agcttgttcttcttcagtcagtccg

SEQ ID NO: 397387 - DNA, 25 bp, Homo sapien
ctcagcatcgtctgtgccatgatat

SEQ ID NO: 397388 - DNA, 25 bp, Homo sapien
gaatgtgttcctgaagtcgcaccac

SEQ ID NO: 397389 - DNA, 25 bp, Homo sapien
accacggagagcactagggacacga

SEQ ID NO: 397390 - DNA, 25 bp, Homo sapien
agagcactagggacacgagttcatc

SEQ ID NO: 397391 - DNA, 25 bp, Homo sapien
tagggacacgagttcatcccctacc

SEQ ID NO: 397392 - DNA, 25 bp, Homo sapien
taaccctactctattccgtaactct

SEQ ID NO: 397393 - DNA, 25 bp, Homo sapien
tactctattccgtaactctcaacgt

SEQ ID NO: 397394 - DNA, 25 bp, Homo sapien
ctattccgtaactctcaacgtgaat

SEQ ID NO: 397395 - DNA, 25 bp, Homo sapien
ctcgcatgtggaaggccctcaccta

SEQ ID NO: 397396 - DNA, 25 bp, Homo sapien
tcgtgctccccggagtagcatacag

SEQ ID NO: 397397 - DNA, 25 bp, Homo sapien
gctccccggagtagcatacagcatg

SEQ ID NO: 397398 - DNA, 25 bp, Homo sapien
gagtagcatacagcatgctgaatgt

SEQ ID NO: 397399 - DNA, 25 bp, Homo sapien
caggagtccttcgataatgtcaaat

SEQ ID NO: 397400 - DNA, 25 bp, Homo sapien
aatagtggttgcaggaaattgatca

SEQ ID NO: 397401 - DNA, 25 bp, Homo sapien
ggaaattgatcactaggccagtgaa

SEQ ID NO: 397402 - DNA, 25 bp, Homo sapien
gtaggaaacaaatgtgattgcccac

SEQ ID NO: 397403 - DNA, 25 bp, Homo sapien
gtgattgcccacaaagaaagtagac

SEQ ID NO: 397404 - DNA, 25 bp, Homo sapien
tggaaactggtgctaagaacacagc

SEQ ID NO: 397405 - DNA, 25 bp, Homo sapien
cagcaaatgtagaacagactttcat

SEQ ID NO: 397406 - DNA, 25 bp, Homo sapien
gactttcatgaaaatggcatctgag

SEQ ID NO: 397407 - DNA, 25 bp, Homo sapien
gcaaatgggactagagcaacagctg

SEQ ID NO: 397408 - DNA, 25 bp, Homo sapien
gactagagcaacagctggtgatgca

SEQ ID NO: 397409 - DNA, 25 bp, Homo sapien
ctggtgatgcagagaagtctaattt

SEQ ID NO: 397410 - DNA, 25 bp, Homo sapien
ctggcagagcgagtcctcatcctgg

SEQ ID NO: 397411 - DNA, 25 bp, Homo sapien
aggttctggccaggatgctgccctg

SEQ ID NO: 397412 - DNA, 25 bp, Homo sapien
ggttctggccaggatgctgccctga

SEQ ID NO: 397413 - DNA, 25 bp, Homo sapien
ggccttaccctggacaaaagagcgt

SEQ ID NO: 397414 - DNA, 25 bp, Homo sapien
aagaaggagagaaagccgccactgc

SEQ ID NO: 397415 - DNA, 25 bp, Homo sapien
agaaggagagaaagccgccactgca

SEQ ID NO: 397416 - DNA, 25 bp, Homo sapien
gaaggagagaaagccgccactgcag

SEQ ID NO: 397417 - DNA, 25 bp, Homo sapien
agagaaagccgccactgcagagggc

SEQ ID NO: 397418 - DNA, 25 bp, Homo sapien
aaagccgccactgcagagggcgagg

SEQ ID NO: 397419 - DNA, 25 bp, Homo sapien
agatcctggcagagcgagtcctcat

SEQ ID NO: 397420 - DNA, 25 bp, Homo sapien
gatcctggcagagcgagtcctcatc

SEQ ID NO: 397421 - DNA, 25 bp, Homo sapien
actccatgtggattggcagctccat

SEQ ID NO: 397422 - DNA, 25 bp, Homo sapien
acatctgcaaagaccggtacgtcaa

SEQ ID NO: 397423 - DNA, 25 bp, Homo sapien
gcaaagaccggtacgtcaacagagt

SEQ ID NO: 397424 - DNA, 25 bp, Homo sapien
gaccggtacgtcaacagagtgctgt

SEQ ID NO: 397425 - DNA, 25 bp, Homo sapien
ggtacgtcaacagagtgctgtctgg

SEQ ID NO: 397426 - DNA, 25 bp, Homo sapien
atggcatcgccgacaggatgcagga

SEQ ID NO: 397427 - DNA, 25 bp, Homo sapien
atgcaggagatcaccggcttggctc

SEQ ID NO: 397428 - DNA, 25 bp, Homo sapien
ttggctccaagcacgatgaagatca

SEQ ID NO: 397429 - DNA, 25 bp, Homo sapien
tccaagcacgatgaagatcaagatc

SEQ ID NO: 397430 - DNA, 25 bp, Homo sapien
tccttctgagcgcaaatactccatg

SEQ ID NO: 397431 - DNA, 25 bp, Homo sapien
ttctgagcgcaaatactccatgtgg

SEQ ID NO: 397432 - DNA, 25 bp, Homo sapien
gtgtccacggcggtcatagagctca

SEQ ID NO: 397433 - DNA, 25 bp, Homo sapien
atagagctcagcttcagggagaact

SEQ ID NO: 397434 - DNA, 25 bp, Homo sapien
gagaactggttcttggacgtgtcta

SEQ ID NO: 397435 - DNA, 25 bp, Homo sapien
ggttcttggacgtgtctactgacat

SEQ ID NO: 397436 - DNA, 25 bp, Homo sapien
tctactgacatggtgactcgactct

SEQ ID NO: 397437 - DNA, 25 bp, Homo sapien
acatggtgactcgactctggaggga

SEQ ID NO: 397438 - DNA, 25 bp, Homo sapien
agttggtgctcccactggtatagat

SEQ ID NO: 397439 - DNA, 25 bp, Homo sapien
ctggtatagatacgcccaatccact

SEQ ID NO: 397440 - DNA, 25 bp, Homo sapien
ttaccggcgggctgccggatccagc

SEQ ID NO: 397441 - DNA, 25 bp, Homo sapien
ggatccagctccagtagtaactact

SEQ ID NO: 397442 - DNA, 25 bp, Homo sapien
cagacgtccataccgagtaaccact

SEQ ID NO: 397443 - DNA, 25 bp, Homo sapien
gaaactgactcgtatgctgaccttc

SEQ ID NO: 397444 - DNA, 25 bp, Homo sapien
tgaccttcaagttctacatgccgaa

SEQ ID NO: 397445 - DNA, 25 bp, Homo sapien
gaaagctaccgaactgaaacacctg

SEQ ID NO: 397446 - DNA, 25 bp, Homo sapien
gaaacacctgcaatgcctcgaggag

SEQ ID NO: 397447 - DNA, 25 bp, Homo sapien
tgaacctggctcagtccaagaactt

SEQ ID NO: 397448 - DNA, 25 bp, Homo sapien
gacctgatctccaacatcaacgtta

SEQ ID NO: 397449 - DNA, 25 bp, Homo sapien
atcaacgttatcgttctggaactga

SEQ ID NO: 397450 - DNA, 25 bp, Homo sapien
gtgagactaccttcatgtgcgaata

SEQ ID NO: 397451 - DNA, 25 bp, Homo sapien
aatacgctgacgaaaccgctactat

SEQ ID NO: 397452 - DNA, 25 bp, Homo sapien
accgctactatcgttgaattcctga

SEQ ID NO: 397453 - DNA, 25 bp, Homo sapien
aattcctgaaccgttggatcacctt

SEQ ID NO: 397454 - DNA, 25 bp, Homo sapien
tcaacagagaccaggccagtcccct

SEQ ID NO: 397455 - DNA, 25 bp, Homo sapien
tcccctgtactggtcatctatcaag

SEQ ID NO: 397456 - DNA, 25 bp, Homo sapien
atctatcaagatgccaagcggccct

SEQ ID NO: 397457 - DNA, 25 bp, Homo sapien
acctctggaaacacagccactctga

SEQ ID NO: 397458 - DNA, 25 bp, Homo sapien
gtcaggcgtgggacaacacccatgt

SEQ ID NO: 397459 - DNA, 25 bp, Homo sapien
aggcgtgggacaacacccatgtgat

SEQ ID NO: 397460 - DNA, 25 bp, Homo sapien
gcgtgggacaacacccatgtgatat

SEQ ID NO: 397461 - DNA, 25 bp, Homo sapien
gacagccagcttcacctgctctgga

SEQ ID NO: 397462 - DNA, 25 bp, Homo sapien
ctgctctggagataaattgggaaat

SEQ ID NO: 397463 - DNA, 25 bp, Homo sapien
aatatgcttcctggtatcaacagag

SEQ ID NO: 397464 - DNA, 25 bp, Homo sapien
atatgcttcctggtatcaacagaga

SEQ ID NO: 397465 - DNA, 25 bp, Homo sapien
gtgagctacagcgccgccctcacgc

SEQ ID NO: 397466 - DNA, 25 bp, Homo sapien
ctcacgctcctcatggtgcagcggt

SEQ ID NO: 397467 - DNA, 25 bp, Homo sapien
tcacgctcctcatggtgcagcggtt

SEQ ID NO: 397468 - DNA, 25 bp, Homo sapien
cacgctcctcatggtgcagcggttc

SEQ ID NO: 397469 - DNA, 25 bp, Homo sapien
cgctcctcatggtgcagcggttcct

SEQ ID NO: 397470 - DNA, 25 bp, Homo sapien
ctcctcatggtgcagcggttcctct

SEQ ID NO: 397471 - DNA, 25 bp, Homo sapien
tcctcatggtgcagcggttcctctc

SEQ ID NO: 397472 - DNA, 25 bp, Homo sapien
cctcatggtgcagcggttcctctca

SEQ ID NO: 397473 - DNA, 25 bp, Homo sapien
tcatggtgcagcggttcctctcagc

SEQ ID NO: 397474 - DNA, 25 bp, Homo sapien
catggtgcagcggttcctctcagcc

SEQ ID NO: 397475 - DNA, 25 bp, Homo sapien
agcggttcctctcagccacgcggca

SEQ ID NO: 397476 - DNA, 25 bp, Homo sapien
actgatttcatcaagcttgatgctg

SEQ ID NO: 397477 - DNA, 25 bp, Homo sapien
tcatcaagcttgatgctggtaacca

SEQ ID NO: 397478 - DNA, 25 bp, Homo sapien
ggtaaccagcatatggtgactggag

SEQ ID NO: 397479 - DNA, 25 bp, Homo sapien
ctggaggtgctaacttgggaataat

SEQ ID NO: 397480 - DNA, 25 bp, Homo sapien
gctaacttgggaataatttgtgtga

SEQ ID NO: 397481 - DNA, 25 bp, Homo sapien
atattttgccatggttcacgtgaaa

SEQ ID NO: 397482 - DNA, 25 bp, Homo sapien
atggcacaaaccatggcaacaagcc

SEQ ID NO: 397483 - DNA, 25 bp, Homo sapien
atggcaacaagccaagggcaacaaa

SEQ ID NO: 397484 - DNA, 25 bp, Homo sapien
gaggaaagggtgtccacctcacctt

SEQ ID NO: 397485 - DNA, 25 bp, Homo sapien
gtgtccacctcacctttgctaaaga

SEQ ID NO: 397486 - DNA, 25 bp, Homo sapien
tcacctttgctaaagacggagacaa

SEQ ID NO: 397487 - DNA, 25 bp, Homo sapien
caccttccacattcgggaacgtgcg

SEQ ID NO: 397488 - DNA, 25 bp, Homo sapien
tcatcaccgaggagttcgtccagca

SEQ ID NO: 397489 - DNA, 25 bp, Homo sapien
tcaccgaggagttcgtccagcagaa

SEQ ID NO: 397490 - DNA, 25 bp, Homo sapien
cgaggagttcgtccagcagaattac

SEQ ID NO: 397491 - DNA, 25 bp, Homo sapien
cccggcccctacgtggagcagctgg

SEQ ID NO: 397492 - DNA, 25 bp, Homo sapien
ggccagccgcgaaattacgaacatg

SEQ ID NO: 397493 - DNA, 25 bp, Homo sapien
gccgcgaaattacgaacatgcaaat

SEQ ID NO: 397494 - DNA, 25 bp, Homo sapien
gcgaaattacgaacatgcaaatcat

SEQ ID NO: 397495 - DNA, 25 bp, Homo sapien
gccaggcaggccttccggatactgg

SEQ ID NO: 397496 - DNA, 25 bp, Homo sapien
gcaggccttccggatactgggaagc

SEQ ID NO: 397497 - DNA, 25 bp, Homo sapien
ggccttccggatactgggaagctat

SEQ ID NO: 397498 - DNA, 25 bp, Homo sapien
ggatggtggatgaccgcagcacacc

SEQ ID NO: 397499 - DNA, 25 bp, Homo sapien
gatggtggatgaccgcagcacacca

SEQ ID NO: 397500 - DNA, 25 bp, Homo sapien
atggtggatgaccgcagcacaccag

SEQ ID NO: 397501 - DNA, 25 bp, Homo sapien
gtggatgaccgcagcacaccagtgt

SEQ ID NO: 397502 - DNA, 25 bp, Homo sapien
tggatgaccgcagcacaccagtgtt

SEQ ID NO: 397503 - DNA, 25 bp, Homo sapien
ggatgaccgcagcacaccagtgtta

SEQ ID NO: 397504 - DNA, 25 bp, Homo sapien
gatgaccgcagcacaccagtgttag

SEQ ID NO: 397505 - DNA, 25 bp, Homo sapien
atgaccgcagcacaccagtgttagc

SEQ ID NO: 397506 - DNA, 25 bp, Homo sapien
tgaccgcagcacaccagtgttagca

SEQ ID NO: 397507 - DNA, 25 bp, Homo sapien
gaccgcagcacaccagtgttagcaa

SEQ ID NO: 397508 - DNA, 25 bp, Homo sapien
accgcagcacaccagtgttagcaaa

SEQ ID NO: 397509 - DNA, 25 bp, Homo sapien
ttgtaatttccggtgtaaaagatgg

SEQ ID NO: 397510 - DNA, 25 bp, Homo sapien
aaaagatggaattatattttctgca

SEQ ID NO: 397511 - DNA, 25 bp, Homo sapien
ctgaggtacctgaacttccttacaa

SEQ ID NO: 397512 - DNA, 25 bp, Homo sapien
actctcttcaatggtgacactcaat

SEQ ID NO: 397513 - DNA, 25 bp, Homo sapien
atgtctgcagacatacaccttgttg

SEQ ID NO: 397514 - DNA, 25 bp, Homo sapien
gtctgcagacatacaccttgttgta

SEQ ID NO: 397515 - DNA, 25 bp, Homo sapien
gcagacatacaccttgttgtagact

SEQ ID NO: 397516 - DNA, 25 bp, Homo sapien
gacatacaccttgttgtagactata

SEQ ID NO: 397517 - DNA, 25 bp, Homo sapien
gactataaaattgctgatgtgggac

SEQ ID NO: 397518 - DNA, 25 bp, Homo sapien
aattgctgatgtgggacacttaaag

SEQ ID NO: 397519 - DNA, 25 bp, Homo sapien
tgatgtgggacacttaaagtactac

SEQ ID NO: 397520 - DNA, 25 bp, Homo sapien
cagtctcagctgactcagccggcct

SEQ ID NO: 397521 - DNA, 25 bp, Homo sapien
aactctgggagcacagccactctga

SEQ ID NO: 397522 - DNA, 25 bp, Homo sapien
actctgggagcacagccactctgac

SEQ ID NO: 397523 - DNA, 25 bp, Homo sapien
actcagccggcctcggtgtccgtgt

SEQ ID NO: 397524 - DNA, 25 bp, Homo sapien
gtcaggcgtgggacaccaacactgc

SEQ ID NO: 397525 - DNA, 25 bp, Homo sapien
tcaggcgtgggacaccaacactgcg

SEQ ID NO: 397526 - DNA, 25 bp, Homo sapien
caggcgtgggacaccaacactgcgg

SEQ ID NO: 397527 - DNA, 25 bp, Homo sapien
gcgtgggacaccaacactgcggtat

SEQ ID NO: 397528 - DNA, 25 bp, Homo sapien
aggacagacagccaccatcccctgc

SEQ ID NO: 397529 - DNA, 25 bp, Homo sapien
gccaccatcccctgctctggagata

SEQ ID NO: 397530 - DNA, 25 bp, Homo sapien
aatttgggggataaatatgcttcct

SEQ ID NO: 397531 - DNA, 25 bp, Homo sapien
gtgtgggtactttcttcatacttct

SEQ ID NO: 397532 - DNA, 25 bp, Homo sapien
atacttctaatctcctacgtcttca

SEQ ID NO: 397533 - DNA, 25 bp, Homo sapien
acgtcttcatcctgtttactgtttg

SEQ ID NO: 397534 - DNA, 25 bp, Homo sapien
aacattcctcaggtggttcatccaa

SEQ ID NO: 397535 - DNA, 25 bp, Homo sapien
actctttcagctcacagcacagtgg

SEQ ID NO: 397536 - DNA, 25 bp, Homo sapien
cacagtggtccttttgttctttggt

SEQ ID NO: 397537 - DNA, 25 bp, Homo sapien
tccacccatgtttgtgtatacacgg

SEQ ID NO: 397538 - DNA, 25 bp, Homo sapien
ggccacaccctaattcacagatgga

SEQ ID NO: 397539 - DNA, 25 bp, Homo sapien
gatggacaagtttctggctattttt

SEQ ID NO: 397540 - DNA, 25 bp, Homo sapien
atttttgatgcagttctcactcctt

SEQ ID NO: 397541 - DNA, 25 bp, Homo sapien
tctcactccttttctgaatccagtt

SEQ ID NO: 397542 - DNA, 25 bp, Homo sapien
gcactaaaaagtcctcagccatgaa

SEQ ID NO: 397543 - DNA, 25 bp, Homo sapien
caaagatgtggccttgggctctctt

SEQ ID NO: 397544 - DNA, 25 bp, Homo sapien
accacaaggagctatctacctctgg

SEQ ID NO: 397545 - DNA, 25 bp, Homo sapien
gaacccagagccagcactcaaggac

SEQ ID NO: 397546 - DNA, 25 bp, Homo sapien
tcaaggacaaacctggccacacaga

SEQ ID NO: 397547 - DNA, 25 bp, Homo sapien
cacagaggcgggttaccggctaact

SEQ ID NO: 397548 - DNA, 25 bp, Homo sapien
gttaccggctaactcttctgtgcca

SEQ ID NO: 397549 - DNA, 25 bp, Homo sapien
attcacccagtcctgcagacattgt

SEQ ID NO: 397550 - DNA, 25 bp, Homo sapien
tgcagacattgtgcgtgctacccag

SEQ ID NO: 397551 - DNA, 25 bp, Homo sapien
gagaagtccttcacacaaggaatct

SEQ ID NO: 397552 - DNA, 25 bp, Homo sapien
aaggaatctcctctgcacaggagca

SEQ ID NO: 397553 - DNA, 25 bp, Homo sapien
cacggagccgggaatcagacgggtt

SEQ ID NO: 397554 - DNA, 25 bp, Homo sapien
atccgggagtcgagcagcacaacag

SEQ ID NO: 397555 - DNA, 25 bp, Homo sapien
gtcgagcagcacaacagggatggtc

SEQ ID NO: 397556 - DNA, 25 bp, Homo sapien
gcacaacagggatggtcgtcggcat

SEQ ID NO: 397557 - DNA, 25 bp, Homo sapien
ctctgcatcttgatcctcctgtacg

SEQ ID NO: 397558 - DNA, 25 bp, Homo sapien
tgatcctcctgtacgccatgtacaa

SEQ ID NO: 397559 - DNA, 25 bp, Homo sapien
gtacaagtacaggaacagggacgag

SEQ ID NO: 397560 - DNA, 25 bp, Homo sapien
tatcaagtggacgagacgcggaact

SEQ ID NO: 397561 - DNA, 25 bp, Homo sapien
agacgcggaactacatcagcaactc

SEQ ID NO: 397562 - DNA, 25 bp, Homo sapien
agcaacggcacgctcatgaaggaga

SEQ ID NO: 397563 - DNA, 25 bp, Homo sapien
agcagagctcgaagagcggccacaa

SEQ ID NO: 397564 - DNA, 25 bp, Homo sapien
gccagaagcctgaggtgcccaatgg

SEQ ID NO: 397565 - DNA, 25 bp, Homo sapien
gaagcctgaggtgcccaatggagtc

SEQ ID NO: 397566 - DNA, 25 bp, Homo sapien
gaggtgcccaatggagtctcaccag

SEQ ID NO: 397567 - DNA, 25 bp, Homo sapien
aatggagtctcaccaggtcaccgcc

SEQ ID NO: 397568 - DNA, 25 bp, Homo sapien
cttccccatggctatcatagtgaca

SEQ ID NO: 397569 - DNA, 25 bp, Homo sapien
gctatcatagtgacaagcgacgtct

SEQ ID NO: 397570 - DNA, 25 bp, Homo sapien
gacaagcgacgtcttagtaaggcca

SEQ ID NO: 397571 - DNA, 25 bp, Homo sapien
gcgacgtcttagtaaggccagcagc

SEQ ID NO: 397572 - DNA, 25 bp, Homo sapien
gtcatcactgcttgggctctttgag

SEQ ID NO: 397573 - DNA, 25 bp, Homo sapien
ttgggctctttgagccccggtctca

SEQ ID NO: 397574 - DNA, 25 bp, Homo sapien
attctgaaactataccagggttttg

SEQ ID NO: 397575 - DNA, 25 bp, Homo sapien
gaagctcattgatatggttttctgt

SEQ ID NO: 397576 - DNA, 25 bp, Homo sapien
ggttttctgtatctccaacatgtct

SEQ ID NO: 397577 - DNA, 25 bp, Homo sapien
tcatggacctgacctgcattctgga

SEQ ID NO: 397578 - DNA, 25 bp, Homo sapien
gagtcaggcattggaaggcccctta

SEQ ID NO: 397579 - DNA, 25 bp, Homo sapien
gaaggccccttagaggacaccctgg

SEQ ID NO: 397580 - DNA, 25 bp, Homo sapien
cctggcctacgctaaagaccaagtt

SEQ ID NO: 397581 - DNA, 25 bp, Homo sapien
ttaacagtgacacccattcctccat

SEQ ID NO: 397582 - DNA, 25 bp, Homo sapien
tccatctttgatgcttgggctagca

SEQ ID NO: 397583 - DNA, 25 bp, Homo sapien
gggctagcattgatctccatgacca

SEQ ID NO: 397584 - DNA, 25 bp, Homo sapien
tgatctccatgaccatattgttaag

SEQ ID NO: 397585 - DNA, 25 bp, Homo sapien
gacaatgagtttggctgtaggaacc

SEQ ID NO: 397586 - DNA, 25 bp, Homo sapien
atcgaatacactacaggcccatttc

SEQ ID NO: 397587 - DNA, 25 bp, Homo sapien
acaccctaaccactatcatttttct

SEQ ID NO: 397588 - DNA, 25 bp, Homo sapien
tatcatttttctaggagcattacat

SEQ ID NO: 397589 - DNA, 25 bp, Homo sapien
gcattacatgatatcttcataccag

SEQ ID NO: 397590 - DNA, 25 bp, Homo sapien
tgttctattaacaaccctcttccta

SEQ ID NO: 397591 - DNA, 25 bp, Homo sapien
accctcttcctatgaattcaagcat

SEQ ID NO: 397592 - DNA, 25 bp, Homo sapien
atacctatgattccaatatgaccaa

SEQ ID NO: 397593 - DNA, 25 bp, Homo sapien
tgaccaacttatacaactcttaatg

SEQ ID NO: 397594 - DNA, 25 bp, Homo sapien
gatttctatctcttacactagcgtt

SEQ ID NO: 397595 - DNA, 25 bp, Homo sapien
cactagcgttatgcgtatgacacct

SEQ ID NO: 397596 - DNA, 25 bp, Homo sapien
gcgtatgacacctttcagtgcccat

SEQ ID NO: 397597 - DNA, 25 bp, Homo sapien
tgtacaactgactcctatggctacc

SEQ ID NO: 397598 - DNA, 25 bp, Homo sapien
tatcccttgagtaacagcctcatgc

SEQ ID NO: 397599 - DNA, 25 bp, Homo sapien
tgcaaccatgttatgagccagtcat

SEQ ID NO: 397600 - DNA, 25 bp, Homo sapien
agccagtcatggtacggagcgtgcc

SEQ ID NO: 397601 - DNA, 25 bp, Homo sapien
gaatccttgggttggaatgtgcaat

SEQ ID NO: 397602 - DNA, 25 bp, Homo sapien
aatgtgcaatgattccagggagcat

SEQ ID NO: 397603 - DNA, 25 bp, Homo sapien
gcatatgatcccagaacaccagtat

SEQ ID NO: 397604 - DNA, 25 bp, Homo sapien
gaacaccagtatcagacctacaaga

SEQ ID NO: 397605 - DNA, 25 bp, Homo sapien
caagaacctctgcaatattttccct

SEQ ID NO: 397606 - DNA, 25 bp, Homo sapien
cttctaacatcgtccttgcagtgat

SEQ ID NO: 397607 - DNA, 25 bp, Homo sapien
gagaagaatccccacacagcagatg

SEQ ID NO: 397608 - DNA, 25 bp, Homo sapien
agcacaaacacaagggaggtctctt

SEQ ID NO: 397609 - DNA, 25 bp, Homo sapien
tgctgtgggttttaagccggttctt

SEQ ID NO: 397610 - DNA, 25 bp, Homo sapien
agaacattctgtagctcccagatct

SEQ ID NO: 397611 - DNA, 25 bp, Homo sapien
agatctcatcttggcgtggaggtga

SEQ ID NO: 397612 - DNA, 25 bp, Homo sapien
gattgttagcattctgcatcgacag

SEQ ID NO: 397613 - DNA, 25 bp, Homo sapien
atcgacagtgtgtaccgtgacgacc

SEQ ID NO: 397614 - DNA, 25 bp, Homo sapien
gacgaccgcctgtaagtggtggcta

SEQ ID NO: 397615 - DNA, 25 bp, Homo sapien
accggtagtggtggaacttgtgact

SEQ ID NO: 397616 - DNA, 25 bp, Homo sapien
gaacttgtgacttagtagggcagca

SEQ ID NO: 397617 - DNA, 25 bp, Homo sapien
tccaggtctaagtcctcatcatggt

SEQ ID NO: 397618 - DNA, 25 bp, Homo sapien
aagtcctcatcatggtttcccacat

SEQ ID NO: 397619 - DNA, 25 bp, Homo sapien
ctgctggtaccagtttacagtaatt

SEQ ID NO: 397620 - DNA, 25 bp, Homo sapien
gctggtaccagtttacagtaatttc

SEQ ID NO: 397621 - DNA, 25 bp, Homo sapien
gtttacagtaatttcttccccgatg

SEQ ID NO: 397622 - DNA, 25 bp, Homo sapien
tacagtaatttcttccccgatgttg

SEQ ID NO: 397623 - DNA, 25 bp, Homo sapien
cagtaatttcttccccgatgttgga

SEQ ID NO: 397624 - DNA, 25 bp, Homo sapien
gtaatttcttccccgatgttggagc

SEQ ID NO: 397625 - DNA, 25 bp, Homo sapien
cactcagactcctgtcataggactg

SEQ ID NO: 397626 - DNA, 25 bp, Homo sapien
tcagactcctgtcataggactgcca

SEQ ID NO: 397627 - DNA, 25 bp, Homo sapien
agactcctgtcataggactgccagt

SEQ ID NO: 397628 - DNA, 25 bp, Homo sapien
gactcctgtcataggactgccagta

SEQ ID NO: 397629 - DNA, 25 bp, Homo sapien
ctcctgtcataggactgccagtaat

SEQ ID NO: 397630 - DNA, 25 bp, Homo sapien
ttgtggggactaatgccaatcatgc

SEQ ID NO: 397631 - DNA, 25 bp, Homo sapien
tgccaatcatgcctccccagtgaga

SEQ ID NO: 397632 - DNA, 25 bp, Homo sapien
gccaatcatgcctccccagtgagaa

SEQ ID NO: 397633 - DNA, 25 bp, Homo sapien
ccaatcatgcctccccagtgagaat

SEQ ID NO: 397634 - DNA, 25 bp, Homo sapien
atcatgcctccccagtgagaatttc

SEQ ID NO: 397635 - DNA, 25 bp, Homo sapien
catgcctccccagtgagaatttcaa

SEQ ID NO: 397636 - DNA, 25 bp, Homo sapien
ggagaatggtctgaaatacactggg

SEQ ID NO: 397637 - DNA, 25 bp, Homo sapien
gtctgaaatacactggggaggccat

SEQ ID NO: 397638 - DNA, 25 bp, Homo sapien
gaggccatcaagaaattaagcaagc

SEQ ID NO: 397639 - DNA, 25 bp, Homo sapien
ggccatcaagaaattaagcaagcga

SEQ ID NO: 397640 - DNA, 25 bp, Homo sapien
aagaaattaagcaagcgacaccagt

SEQ ID NO: 397641 - DNA, 25 bp, Homo sapien
tggaattttggtgtacctccaccac

SEQ ID NO: 397642 - DNA, 25 bp, Homo sapien
ggatacatatcgttttgtgcaatca

SEQ ID NO: 397643 - DNA, 25 bp, Homo sapien
aatcagttgctgttacctgtcaaaa

SEQ ID NO: 397644 - DNA, 25 bp, Homo sapien
gatactacacctccagaaaagcagg

SEQ ID NO: 397645 - DNA, 25 bp, Homo sapien
cctccgatttggatcaatatcccct

SEQ ID NO: 397646 - DNA, 25 bp, Homo sapien
gatcaatatccccttggtcgaaagt

SEQ ID NO: 397647 - DNA, 25 bp, Homo sapien
tttagttcaggctgggttacgtcgt

SEQ ID NO: 397648 - DNA, 25 bp, Homo sapien
tgggttacgtcgtaggcctaccata

SEQ ID NO: 397649 - DNA, 25 bp, Homo sapien
gtaggcctaccataggacctcgtaa

SEQ ID NO: 397650 - DNA, 25 bp, Homo sapien
ataggacctcgtaagcgtcctgctg

SEQ ID NO: 397651 - DNA, 25 bp, Homo sapien
tgcttccacgtctactgcatctagg

SEQ ID NO: 397652 - DNA, 25 bp, Homo sapien
gaatgtcctctatggaccgggcatt

SEQ ID NO: 397653 - DNA, 25 bp, Homo sapien
gtcctctatggaccgggcattccca

SEQ ID NO: 397654 - DNA, 25 bp, Homo sapien
cccagactcctattaccatccaggg

SEQ ID NO: 397655 - DNA, 25 bp, Homo sapien
acagtactcctggtttgtcagtgga

SEQ ID NO: 397656 - DNA, 25 bp, Homo sapien
gtactcctggtttgtcagtggaatg

SEQ ID NO: 397657 - DNA, 25 bp, Homo sapien
tttatccccaacatcgcagtggata

SEQ ID NO: 397658 - DNA, 25 bp, Homo sapien
tccccaacatcgcagtggataagag

SEQ ID NO: 397659 - DNA, 25 bp, Homo sapien
acatcgcagtggataagagtggatc

SEQ ID NO: 397660 - DNA, 25 bp, Homo sapien
ataagagtggatcctatgcttgcct

SEQ ID NO: 397661 - DNA, 25 bp, Homo sapien
aagagtggatcctatgcttgcctcg

SEQ ID NO: 397662 - DNA, 25 bp, Homo sapien
ctatgcttgcctcgcccataactca

SEQ ID NO: 397663 - DNA, 25 bp, Homo sapien
tggttactcctggagctcgatccgg

SEQ ID NO: 397664 - DNA, 25 bp, Homo sapien
ggttactcctggagctcgatccggc

SEQ ID NO: 397665 - DNA, 25 bp, Homo sapien
cataaattatagtgggagcacctac

SEQ ID NO: 397666 - DNA, 25 bp, Homo sapien
gtgcaggagtccggctcaggactgg

SEQ ID NO: 397667 - DNA, 25 bp, Homo sapien
cacttctccctgaaggtgaggtctg

SEQ ID NO: 397668 - DNA, 25 bp, Homo sapien
acttctccctgaaggtgaggtctgt

SEQ ID NO: 397669 - DNA, 25 bp, Homo sapien
cttctccctgaaggtgaggtctgtg

SEQ ID NO: 397670 - DNA, 25 bp, Homo sapien
cagacccggtccctcacctgcgatg

SEQ ID NO: 397671 - DNA, 25 bp, Homo sapien
acctgcgatgtctctggtggcccca

SEQ ID NO: 397672 - DNA, 25 bp, Homo sapien
tgcgatgtctctggtggccccatca

SEQ ID NO: 397673 - DNA, 25 bp, Homo sapien
gcgatgtctctggtggccccatcag

SEQ ID NO: 397674 - DNA, 25 bp, Homo sapien
ggtttctccatcagtagttactact

SEQ ID NO: 397675 - DNA, 25 bp, Homo sapien
gcagcccgccggtaagggactggag

SEQ ID NO: 397676 - DNA, 25 bp, Homo sapien
agtggattgggcgtatctataccag

SEQ ID NO: 397677 - DNA, 25 bp, Homo sapien
ggattgggcgtatctataccagtgg

SEQ ID NO: 397678 - DNA, 25 bp, Homo sapien
acaacctctccctccagagtcgagt

SEQ ID NO: 397679 - DNA, 25 bp, Homo sapien
atgaccgccgtggacacggccgtat

SEQ ID NO: 397680 - DNA, 25 bp, Homo sapien
tactgtgcgagagggccggagtggt

SEQ ID NO: 397681 - DNA, 25 bp, Homo sapien
gagagggccggagtggttactcggt

SEQ ID NO: 397682 - DNA, 25 bp, Homo sapien
gagggccggagtggttactcggtat

SEQ ID NO: 397683 - DNA, 25 bp, Homo sapien
agggccggagtggttactcggtatg

SEQ ID NO: 397684 - DNA, 25 bp, Homo sapien
agtggttactcggtatggacgtctg

SEQ ID NO: 397685 - DNA, 25 bp, Homo sapien
tatgatgctgtacaaaggggccctg

SEQ ID NO: 397686 - DNA, 25 bp, Homo sapien
tcacaggagaccatgcagaggattc

SEQ ID NO: 397687 - DNA, 25 bp, Homo sapien
agaccatgcagaggattcgctggct

SEQ ID NO: 397688 - DNA, 25 bp, Homo sapien
catgcagaggattcgctggctggcc

SEQ ID NO: 397689 - DNA, 25 bp, Homo sapien
gctggctggccaggctaccaacaaa

SEQ ID NO: 397690 - DNA, 25 bp, Homo sapien
gctggccaggctaccaacaaatggg

SEQ ID NO: 397691 - DNA, 25 bp, Homo sapien
cagcagccaaggatggttaacattc

SEQ ID NO: 397692 - DNA, 25 bp, Homo sapien
gatggttaacattcctcaaggcagc

SEQ ID NO: 397693 - DNA, 25 bp, Homo sapien
ggttaacattcctcaaggcagctgg

SEQ ID NO: 397694 - DNA, 25 bp, Homo sapien
taacattcctcaaggcagctggcca

SEQ ID NO: 397695 - DNA, 25 bp, Homo sapien
attcctcaaggcagctggccaaggg

SEQ ID NO: 397696 - DNA, 25 bp, Homo sapien
ggcggttgggaagcacggagacaaa

SEQ ID NO: 397697 - DNA, 25 bp, Homo sapien
gagagaacgggaaccaaaagcctat

SEQ ID NO: 397698 - DNA, 25 bp, Homo sapien
agagaacgggaaccaaaagcctatg

SEQ ID NO: 397699 - DNA, 25 bp, Homo sapien
gagaacgggaaccaaaagcctatgg

SEQ ID NO: 397700 - DNA, 25 bp, Homo sapien
gaaccaaaagcctatggtacccgct

SEQ ID NO: 397701 - DNA, 25 bp, Homo sapien
ctggcggtgctgcagtggcggatct

SEQ ID NO: 397702 - DNA, 25 bp, Homo sapien
gcggtgctgcagtggcggatcttca

SEQ ID NO: 397703 - DNA, 25 bp, Homo sapien
tgcagtggcggatcttcaggaggag

SEQ ID NO: 397704 - DNA, 25 bp, Homo sapien
agtggcggatcttcaggaggaggtc

SEQ ID NO: 397705 - DNA, 25 bp, Homo sapien
ggaggaggtcctgggcttcggctgg

SEQ ID NO: 397706 - DNA, 25 bp, Homo sapien
gctggggcgcggtggctgtcaaggg

SEQ ID NO: 397707 - DNA, 25 bp, Homo sapien
caggtattccctgatggccatagaa

SEQ ID NO: 397708 - DNA, 25 bp, Homo sapien
ggtattccctgatggccatagaaag

SEQ ID NO: 397709 - DNA, 25 bp, Homo sapien
gatggccatagaaaggatacacaga

SEQ ID NO: 397710 - DNA, 25 bp, Homo sapien
agaaaggatacacagagacaggcaa

SEQ ID NO: 397711 - DNA, 25 bp, Homo sapien
agacaggcaaacagatactgggccc

SEQ ID NO: 397712 - DNA, 25 bp, Homo sapien
ggcaaacagatactgggcccagtga

SEQ ID NO: 397713 - DNA, 25 bp, Homo sapien
cagtgaaggaaccacttctcggagc

SEQ ID NO: 397714 - DNA, 25 bp, Homo sapien
tgaaggaaccacttctcggagctca

SEQ ID NO: 397715 - DNA, 25 bp, Homo sapien
aagagagaacaatgacccctttgac

SEQ ID NO: 397716 - DNA, 25 bp, Homo sapien
gggacgatgaactgacagactttga

SEQ ID NO: 397717 - DNA, 25 bp, Homo sapien
gtgtttttacaagcaggtattccct

SEQ ID NO: 397718 - DNA, 25 bp, Homo sapien
gatggtcagagtggctgtgctccca

SEQ ID NO: 397719 - DNA, 25 bp, Homo sapien
gagggccgcttgttatcttgataga

SEQ ID NO: 397720 - DNA, 25 bp, Homo sapien
ggcttctgctgaaaccaggaagcat

SEQ ID NO: 397721 - DNA, 25 bp, Homo sapien
aggaagcatatttatcccccaaatt

SEQ ID NO: 397722 - DNA, 25 bp, Homo sapien
tatcccccaaattatctccagagca

SEQ ID NO: 397723 - DNA, 25 bp, Homo sapien
ctccgccgaataccgcagtgttggt

SEQ ID NO: 397724 - DNA, 25 bp, Homo sapien
cgccgaataccgcagtgttggtgtc

SEQ ID NO: 397725 - DNA, 25 bp, Homo sapien
cgaataccgcagtgttggtgtccca

SEQ ID NO: 397726 - DNA, 25 bp, Homo sapien
aataccgcagtgttggtgtcccacg

SEQ ID NO: 397727 - DNA, 25 bp, Homo sapien
ataccgcagtgttggtgtcccacgc

SEQ ID NO: 397728 - DNA, 25 bp, Homo sapien
gcagtgttggtgtcccacgcctgac

SEQ ID NO: 397729 - DNA, 25 bp, Homo sapien
aagatgaaggcatctcgcagaggaa

SEQ ID NO: 397730 - DNA, 25 bp, Homo sapien
ggcatctcgcagaggaagtttctga

SEQ ID NO: 397731 - DNA, 25 bp, Homo sapien
gaagtttctgaatggcaatgagctc

SEQ ID NO: 397732 - DNA, 25 bp, Homo sapien
ctgaatggcaatgagctcaccctgg

SEQ ID NO: 397733 - DNA, 25 bp, Homo sapien
atttaacatccctgaggccttcccg

SEQ ID NO: 397734 - DNA, 25 bp, Homo sapien
tcccgggaacgcgtcagcacttgag

SEQ ID NO: 397735 - DNA, 25 bp, Homo sapien
ggaacgcgtcagcacttgagcaatg

SEQ ID NO: 397736 - DNA, 25 bp, Homo sapien
gcgtcagcacttgagcaatgcttat

SEQ ID NO: 397737 - DNA, 25 bp, Homo sapien
aatgcttatgcatgggaagaacccg

SEQ ID NO: 397738 - DNA, 25 bp, Homo sapien
atgcatgggaagaacccgtctccac

SEQ ID NO: 397739 - DNA, 25 bp, Homo sapien
tctccacctgcccagatgatgaaga

SEQ ID NO: 397740 - DNA, 25 bp, Homo sapien
agatgtagagctcaggtgtgatcca

SEQ ID NO: 397741 - DNA, 25 bp, Homo sapien
tactgccctttactggtaccgacaa

SEQ ID NO: 397742 - DNA, 25 bp, Homo sapien
ccagagtttctaatttacttccaag

SEQ ID NO: 397743 - DNA, 25 bp, Homo sapien
ttacttccaaggcacgggtgcggca

SEQ ID NO: 397744 - DNA, 25 bp, Homo sapien
tacttccaaggcacgggtgcggcag

SEQ ID NO: 397745 - DNA, 25 bp, Homo sapien
tccaaggcacgggtgcggcagatga

SEQ ID NO: 397746 - DNA, 25 bp, Homo sapien
gcagatgactcagggctgcccaaag

SEQ ID NO: 397747 - DNA, 25 bp, Homo sapien
tcagggctgcccaaagatcggttct

SEQ ID NO: 397748 - DNA, 25 bp, Homo sapien
aagatcggttctttgcagtcaggcc

SEQ ID NO: 397749 - DNA, 25 bp, Homo sapien
cggttctttgcagtcaggcctgagg

SEQ ID NO: 397750 - DNA, 25 bp, Homo sapien
agacccccagtaacaaggtcacaga

SEQ ID NO: 397751 - DNA, 25 bp, Homo sapien
ttcatccagcgctgtgcagtagccc

SEQ ID NO: 397752 - DNA, 25 bp, Homo sapien
gtgcagtagcccagctgcgtgtctg

SEQ ID NO: 397753 - DNA, 25 bp, Homo sapien
aagtgccctgcctactggctgcttc

SEQ ID NO: 397754 - DNA, 25 bp, Homo sapien
ctctctgcctagttcacacactgag

SEQ ID NO: 397755 - DNA, 25 bp, Homo sapien
tagttcacacactgagccactcgca

SEQ ID NO: 397756 - DNA, 25 bp, Homo sapien
acactgagccactcgcacatgcgag

SEQ ID NO: 397757 - DNA, 25 bp, Homo sapien
gcacatgcgagcacattccttcctt

SEQ ID NO: 397758 - DNA, 25 bp, Homo sapien
tctctcggcccttgacttctacaag

SEQ ID NO: 397759 - DNA, 25 bp, Homo sapien
aaagacgttcttgatccagcagggt

SEQ ID NO: 397760 - DNA, 25 bp, Homo sapien
acgttcttgatccagcagggtaggc

SEQ ID NO: 397761 - DNA, 25 bp, Homo sapien
gatccagcagggtaggcttgttttg

SEQ ID NO: 397762 - DNA, 25 bp, Homo sapien
aggccattgaggaagacggcaccga

SEQ ID NO: 397763 - DNA, 25 bp, Homo sapien
ccattgaggaagacggcaccgaaag

SEQ ID NO: 397764 - DNA, 25 bp, Homo sapien
ctttggagcacctggtagtgtggca

SEQ ID NO: 397765 - DNA, 25 bp, Homo sapien
gcacctggtagtgtggcatgtccac

SEQ ID NO: 397766 - DNA, 25 bp, Homo sapien
ggtagtgtggcatgtccacagtgaa

SEQ ID NO: 397767 - DNA, 25 bp, Homo sapien
ccacagtgaagaccagagtttcgtt

SEQ ID NO: 397768 - DNA, 25 bp, Homo sapien
gaagaccagagtttcgttgtcctta

SEQ ID NO: 397769 - DNA, 25 bp, Homo sapien
ccagagtttcgttgtccttaagact

SEQ ID NO: 397770 - DNA, 25 bp, Homo sapien
gtttcgttgtccttaagactgacct

SEQ ID NO: 397771 - DNA, 25 bp, Homo sapien
tcgttgtccttaagactgacctggg

SEQ ID NO: 397772 - DNA, 25 bp, Homo sapien
gggagacgtggctgcaggccattga

SEQ ID NO: 397773 - DNA, 25 bp, Homo sapien
cccagtgtttaccaggtccactaat

SEQ ID NO: 397774 - DNA, 25 bp, Homo sapien
aggtccactaatttactccatctat

SEQ ID NO: 397775 - DNA, 25 bp, Homo sapien
attattcgcctgctgtgatcgtggt

SEQ ID NO: 397776 - DNA, 25 bp, Homo sapien
tactccatctattatcgatattaag

SEQ ID NO: 397777 - DNA, 25 bp, Homo sapien
cgatattaagatataagctgccttc

SEQ ID NO: 397778 - DNA, 25 bp, Homo sapien
cgcctgctgtgatcgtggtgatgat

SEQ ID NO: 397779 - DNA, 25 bp, Homo sapien
gtggtgatgattgtcactaccccta

SEQ ID NO: 397780 - DNA, 25 bp, Homo sapien
gatgattgtcactacccctaagtgt

SEQ ID NO: 397781 - DNA, 25 bp, Homo sapien
gtcactacccctaagtgtgagaggt

SEQ ID NO: 397782 - DNA, 25 bp, Homo sapien
acccctaagtgtgagaggtacaata

SEQ ID NO: 397783 - DNA, 25 bp, Homo sapien
ttataactgttgattctgcccactc

SEQ ID NO: 397784 - DNA, 25 bp, Homo sapien
aattttttctgtgagatgccagcat

SEQ ID NO: 397785 - DNA, 25 bp, Homo sapien
tcaagatggcttgtgtctattcaaa

SEQ ID NO: 397786 - DNA, 25 bp, Homo sapien
agattgttgtctttgctttcggagt

SEQ ID NO: 397787 - DNA, 25 bp, Homo sapien
gctttcggagtggtatttcttttcg

SEQ ID NO: 397788 - DNA, 25 bp, Homo sapien
tttcttttcgtacctctatcactaa

SEQ ID NO: 397789 - DNA, 25 bp, Homo sapien
tcactaattcttatctcatatggag

SEQ ID NO: 397790 - DNA, 25 bp, Homo sapien
ggagttatcactcaagctgtaatga

SEQ ID NO: 397791 - DNA, 25 bp, Homo sapien
tgaggatcaagtcagcaacaaggtt

SEQ ID NO: 397792 - DNA, 25 bp, Homo sapien
gatccttaatacatgtggctcccac

SEQ ID NO: 397793 - DNA, 25 bp, Homo sapien
ctcccacctcacagtagtaattctg

SEQ ID NO: 397794 - DNA, 25 bp, Homo sapien
aagccacagaataccatatcccaag

SEQ ID NO: 397795 - DNA, 25 bp, Homo sapien
gaactaaaacttgaccccacatgtg

SEQ ID NO: 397796 - DNA, 25 bp, Homo sapien
gtctttataacaatgaaccctgggt

SEQ ID NO: 397797 - DNA, 25 bp, Homo sapien
aaccctgggtatgctgggcgatcag

SEQ ID NO: 397798 - DNA, 25 bp, Homo sapien
aactgccagataacctgaaggctct

SEQ ID NO: 397799 - DNA, 25 bp, Homo sapien
gaaggctctctttcggacagtagca

SEQ ID NO: 397800 - DNA, 25 bp, Homo sapien
ggtacctgactatgccatgattgct

SEQ ID NO: 397801 - DNA, 25 bp, Homo sapien
gaaatagtcctatactcctgtgggt

SEQ ID NO: 397802 - DNA, 25 bp, Homo sapien
tcctgtgggtttgtcactgctcgac

SEQ ID NO: 397803 - DNA, 25 bp, Homo sapien
actgctcgaccactgtctgtaaaaa

SEQ ID NO: 397804 - DNA, 25 bp, Homo sapien
aattgtggctacgtatcgcttgtgt

SEQ ID NO: 397805 - DNA, 25 bp, Homo sapien
tcgcttgtgttcagagcagctgtca

SEQ ID NO: 397806 - DNA, 25 bp, Homo sapien
tggttactcctggagctcgatccgg

SEQ ID NO: 397807 - DNA, 25 bp, Homo sapien
ggttactcctggagctcgatccggc

SEQ ID NO: 397808 - DNA, 25 bp, Homo sapien
cataaattatagtgggagcacctac

SEQ ID NO: 397809 - DNA, 25 bp, Homo sapien
gcaggtgcaggagtccggctcagga

SEQ ID NO: 397810 - DNA, 25 bp, Homo sapien
aaccacttctccctgaaggtgaggt

SEQ ID NO: 397811 - DNA, 25 bp, Homo sapien
cacttctccctgaaggtgaggtctg

SEQ ID NO: 397812 - DNA, 25 bp, Homo sapien
cttctccctgaaggtgaggtctgtg

SEQ ID NO: 397813 - DNA, 25 bp, Homo sapien
tggtgaagccttcacagacccggtc

SEQ ID NO: 397814 - DNA, 25 bp, Homo sapien
acctgcgatgtctctggtggcccca

SEQ ID NO: 397815 - DNA, 25 bp, Homo sapien
gcgatgtctctggtggccccatcag

SEQ ID NO: 397816 - DNA, 25 bp, Homo sapien
cccatcagcagtggtggttactcct

SEQ ID NO: 397817 - DNA, 25 bp, Homo sapien
aaagtacgcaggagggaaggcgccg

SEQ ID NO: 397818 - DNA, 25 bp, Homo sapien
gggaagtgaaatctcggcattagaa

SEQ ID NO: 397819 - DNA, 25 bp, Homo sapien
gaagtgaaatctcggcattagaacc

SEQ ID NO: 397820 - DNA, 25 bp, Homo sapien
aatctcggcattagaacccccgctg

SEQ ID NO: 397821 - DNA, 25 bp, Homo sapien
gggctggctgcacccggctggacac

SEQ ID NO: 397822 - DNA, 25 bp, Homo sapien
tccggctggcgtcacctcacaggaa

SEQ ID NO: 397823 - DNA, 25 bp, Homo sapien
ggctggcgtcacctcacaggaatcc

SEQ ID NO: 397824 - DNA, 25 bp, Homo sapien
gcctctgccattgcccaaagaaagt

SEQ ID NO: 397825 - DNA, 25 bp, Homo sapien
tctgccattgcccaaagaaagtacg

SEQ ID NO: 397826 - DNA, 25 bp, Homo sapien
gccattgcccaaagaaagtacgcag

SEQ ID NO: 397827 - DNA, 25 bp, Homo sapien
attgcccaaagaaagtacgcaggag

SEQ ID NO: 397828 - DNA, 25 bp, Homo sapien
tggctcacagccaccacctggatgg

SEQ ID NO: 397829 - DNA, 25 bp, Homo sapien
accacctggatggatctgctccatg

SEQ ID NO: 397830 - DNA, 25 bp, Homo sapien
atctgctccatgcagatctagccag

SEQ ID NO: 397831 - DNA, 25 bp, Homo sapien
gctccatgcagatctagccaggcct

SEQ ID NO: 397832 - DNA, 25 bp, Homo sapien
cagccagcaggttctctcctgtgag

SEQ ID NO: 397833 - DNA, 25 bp, Homo sapien
agcaggttctctcctgtgagctccc

SEQ ID NO: 397834 - DNA, 25 bp, Homo sapien
ggttctctcctgtgagctccccaat

SEQ ID NO: 397835 - DNA, 25 bp, Homo sapien
aatccaacccatgcatggcctccca

SEQ ID NO: 397836 - DNA, 25 bp, Homo sapien
agcctggccccaaatgttctttcct

SEQ ID NO: 397837 - DNA, 25 bp, Homo sapien
atcctcagcaagtgctgagtctgtg

SEQ ID NO: 397838 - DNA, 25 bp, Homo sapien
ctgagtctgtgaataaagccacata

SEQ ID NO: 397839 - DNA, 25 bp, Homo sapien
tgcttgggggtacccaaatctaaag

SEQ ID NO: 397840 - DNA, 25 bp, Homo sapien
aaagtcactaaatgaacttatctac

SEQ ID NO: 397841 - DNA, 25 bp, Homo sapien
caagcgtggttatggagaattcagt

SEQ ID NO: 397842 - DNA, 25 bp, Homo sapien
agcgtggttatggagaattcagtaa

SEQ ID NO: 397843 - DNA, 25 bp, Homo sapien
cgtggttatggagaattcagtaaga

SEQ ID NO: 397844 - DNA, 25 bp, Homo sapien
gagaattcagtaagaagcgaattgc

SEQ ID NO: 397845 - DNA, 25 bp, Homo sapien
gtaaatatggcatcatctgctggag

SEQ ID NO: 397846 - DNA, 25 bp, Homo sapien
taaatatggcatcatctgctggagg

SEQ ID NO: 397847 - DNA, 25 bp, Homo sapien
attatcttctccatgaggcagaatg

SEQ ID NO: 397848 - DNA, 25 bp, Homo sapien
ttatcttctccatgaggcagaatga

SEQ ID NO: 397849 - DNA, 25 bp, Homo sapien
tatcttctccatgaggcagaatgaa

SEQ ID NO: 397850 - DNA, 25 bp, Homo sapien
tgaacatccacaaggcacctgcaag

SEQ ID NO: 397851 - DNA, 25 bp, Homo sapien
tgagacccagctctgtgtctcctcg

SEQ ID NO: 397852 - DNA, 25 bp, Homo sapien
gtctcctcgtcgtacagcttgtgga

SEQ ID NO: 397853 - DNA, 25 bp, Homo sapien
acagcttgtggagctccgactgcaa

SEQ ID NO: 397854 - DNA, 25 bp, Homo sapien
ggagctccgactgcaaggccatcag

SEQ ID NO: 397855 - DNA, 25 bp, Homo sapien
aaggccatcagcatgcccaggcagg

SEQ ID NO: 397856 - DNA, 25 bp, Homo sapien
ggacaggccagcaggatgccgcttc

SEQ ID NO: 397857 - DNA, 25 bp, Homo sapien
aagaacctgatgtttcctgactgct

SEQ ID NO: 397858 - DNA, 25 bp, Homo sapien
gatgccgcttctgctccagggcatg

SEQ ID NO: 397859 - DNA, 25 bp, Homo sapien
gctccagggcatgcaccatgcgtga

SEQ ID NO: 397860 - DNA, 25 bp, Homo sapien
ccctgcttggatagaggcctccgaa

SEQ ID NO: 397861 - DNA, 25 bp, Homo sapien
gaattccaagacctcttgagccaag

SEQ ID NO: 397862 - DNA, 25 bp, Homo sapien
agatagatcaccactgggatcctcc

SEQ ID NO: 397863 - DNA, 25 bp, Homo sapien
ccactccaattctagaccttgacat

SEQ ID NO: 397864 - DNA, 25 bp, Homo sapien
gaccttgacatccagagacatttaa

SEQ ID NO: 397865 - DNA, 25 bp, Homo sapien
gatcactcatggctttgggactccg

SEQ ID NO: 397866 - DNA, 25 bp, Homo sapien
gactccggcaatatgtgcagctcta

SEQ ID NO: 397867 - DNA, 25 bp, Homo sapien
gcagctctaagcactttccaaacag

SEQ ID NO: 397868 - DNA, 25 bp, Homo sapien
aacacactactcacaagaacggcgg

SEQ ID NO: 397869 - DNA, 25 bp, Homo sapien
agcggcggattctggccaaggacat

SEQ ID NO: 397870 - DNA, 25 bp, Homo sapien
ccaaggacatgccaactcggagaaa

SEQ ID NO: 397871 - DNA, 25 bp, Homo sapien
gagaaagctcccctgcggaaaactt

SEQ ID NO: 397872 - DNA, 25 bp, Homo sapien
tcagagtggctgtgtttccagaggt

SEQ ID NO: 397873 - DNA, 25 bp, Homo sapien
agggccgcttggcatcttgatagat

SEQ ID NO: 397874 - DNA, 25 bp, Homo sapien
gggactggcctggtctctgttgata

SEQ ID NO: 397875 - DNA, 25 bp, Homo sapien
tctctgttgataccaggaagcatat

SEQ ID NO: 397876 - DNA, 25 bp, Homo sapien
atttcccaatttatctccagagcag

SEQ ID NO: 397877 - DNA, 25 bp, Homo sapien
gcaggtgaagctggctgtctgtcct

SEQ ID NO: 397878 - DNA, 25 bp, Homo sapien
ctccgccgaatatcacatgggtgtt

SEQ ID NO: 397879 - DNA, 25 bp, Homo sapien
gccgaatatcacatgggtgttgtcc

SEQ ID NO: 397880 - DNA, 25 bp, Homo sapien
atatcacatgggtgttgtcccacgc

SEQ ID NO: 397881 - DNA, 25 bp, Homo sapien
atcacatgggtgttgtcccacgcct

SEQ ID NO: 397882 - DNA, 25 bp, Homo sapien
acatgggtgttgtcccacgcctgac

SEQ ID NO: 397883 - DNA, 25 bp, Homo sapien
agctctgtgtctcctcgtcgtacag

SEQ ID NO: 397884 - DNA, 25 bp, Homo sapien
gtctcctcgtcgtacagcttgtgga

SEQ ID NO: 397885 - DNA, 25 bp, Homo sapien
tcctcgtcgtacagcttgtggagct

SEQ ID NO: 397886 - DNA, 25 bp, Homo sapien
cgtcgtacagcttgtggagctccga

SEQ ID NO: 397887 - DNA, 25 bp, Homo sapien
tacagcttgtggagctccgactgca

SEQ ID NO: 397888 - DNA, 25 bp, Homo sapien
agcttgtggagctccgactgcaagg

SEQ ID NO: 397889 - DNA, 25 bp, Homo sapien
tgtggagctccgactgcaaggccat

SEQ ID NO: 397890 - DNA, 25 bp, Homo sapien
gagctccgactgcaaggccatcagc

SEQ ID NO: 397891 - DNA, 25 bp, Homo sapien
ggacaggccagcaggatgccgcttc

SEQ ID NO: 397892 - DNA, 25 bp, Homo sapien
gatgccgcttctgctccagggcatg

SEQ ID NO: 397893 - DNA, 25 bp, Homo sapien
gctccagggcatgcaccatgcgtga

SEQ ID NO: 397894 - DNA, 25 bp, Homo sapien
taaaaattttctgaggttgtcctca

SEQ ID NO: 397895 - DNA, 25 bp, Homo sapien
gacacccaatggatcatcaaaccac

SEQ ID NO: 397896 - DNA, 25 bp, Homo sapien
acacccaatggatcatcaaaccact

SEQ ID NO: 397897 - DNA, 25 bp, Homo sapien
caatggatcatcaaaccactccaca

SEQ ID NO: 397898 - DNA, 25 bp, Homo sapien
aatggatcatcaaaccactccacaa

SEQ ID NO: 397899 - DNA, 25 bp, Homo sapien
atggatcatcaaaccactccacaag

SEQ ID NO: 397900 - DNA, 25 bp, Homo sapien
gacatctgaaggctgaaagagccct

SEQ ID NO: 397901 - DNA, 25 bp, Homo sapien
tctgaaggctgaaagagccctgggc

SEQ ID NO: 397902 - DNA, 25 bp, Homo sapien
gccctgggcttggaaagggccataa

SEQ ID NO: 397903 - DNA, 25 bp, Homo sapien
cctgggcttggaaagggccataagt

SEQ ID NO: 397904 - DNA, 25 bp, Homo sapien
ctgggcttggaaagggccataagtt

SEQ ID NO: 397905 - DNA, 25 bp, Homo sapien
gacattggagccgtcttcgggctca

SEQ ID NO: 397906 - DNA, 25 bp, Homo sapien
acattggagccgtcttcgggctcag

SEQ ID NO: 397907 - DNA, 25 bp, Homo sapien
attggagccgtcttcgggctcagct

SEQ ID NO: 397908 - DNA, 25 bp, Homo sapien
ttggagccgtcttcgggctcagctt

SEQ ID NO: 397909 - DNA, 25 bp, Homo sapien
gggctcagcttcccaccttgtcttg

SEQ ID NO: 397910 - DNA, 25 bp, Homo sapien
agcttcccaccttgtcttggagggc

SEQ ID NO: 397911 - DNA, 25 bp, Homo sapien
acgggctcaagaagtatgaggctgc

SEQ ID NO: 397912 - DNA, 25 bp, Homo sapien
gggctcaagaagtatgaggctgcct

SEQ ID NO: 397913 - DNA, 25 bp, Homo sapien
aagtatgaggctgcctatggaaaag

SEQ ID NO: 397914 - DNA, 25 bp, Homo sapien
agatgcctcctaagtctgaagtctc

SEQ ID NO: 397915 - DNA, 25 bp, Homo sapien
agttccgcctgctgacaagatttgt

SEQ ID NO: 397916 - DNA, 25 bp, Homo sapien
attggcactgtaatggtcgttttta

SEQ ID NO: 397917 - DNA, 25 bp, Homo sapien
acatttatgttctgttccgcattca

SEQ ID NO: 397918 - DNA, 25 bp, Homo sapien
tgttctgttccgcattcacttaaca

SEQ ID NO: 397919 - DNA, 25 bp, Homo sapien
gcattcacttaacatgtgcgttaaa

SEQ ID NO: 397920 - DNA, 25 bp, Homo sapien
gaacaaagctagctggaggtagcaa

SEQ ID NO: 397921 - DNA, 25 bp, Homo sapien
atcagggattgctaagaaaacttac

SEQ ID NO: 397922 - DNA, 25 bp, Homo sapien
gaaaacttacaactaatgaccacag

SEQ ID NO: 397923 - DNA, 25 bp, Homo sapien
tagatgtgattgtagccgtggtgcc

SEQ ID NO: 397924 - DNA, 25 bp, Homo sapien
aaacatgctgtcctcttatgacaat

SEQ ID NO: 397925 - DNA, 25 bp, Homo sapien
gctgtcctcttatgacaatatgtgc

SEQ ID NO: 397926 - DNA, 25 bp, Homo sapien
atgtgcagagaaggccccaaacgct

SEQ ID NO: 397927 - DNA, 25 bp, Homo sapien
gatgaggatgaaaccgcaacagata

SEQ ID NO: 397928 - DNA, 25 bp, Homo sapien
cgcaacagatacagggtcggatatg

SEQ ID NO: 397929 - DNA, 25 bp, Homo sapien
cagggtcggatatggtagattttat

SEQ ID NO: 397930 - DNA, 25 bp, Homo sapien
ttattgacacacaattatccatttg

SEQ ID NO: 397931 - DNA, 25 bp, Homo sapien
tatccatttgtgaacaggcagagca

SEQ ID NO: 397932 - DNA, 25 bp, Homo sapien
agacagcacaggcattgttcgatgc

SEQ ID NO: 397933 - DNA, 25 bp, Homo sapien
acaggcattgttcgatgcgcaggaa

SEQ ID NO: 397934 - DNA, 25 bp, Homo sapien
gttcgatgcgcaggaagttcagaat

SEQ ID NO: 397935 - DNA, 25 bp, Homo sapien
agttcagaatgatgcacaggtgttg

SEQ ID NO: 397936 - DNA, 25 bp, Homo sapien
atgcacaggtgttggatcttttaaa

SEQ ID NO: 397937 - DNA, 25 bp, Homo sapien
aaacgaaactttgcaggaggcagca

SEQ ID NO: 397938 - DNA, 25 bp, Homo sapien
ataaggtgatacaggcctgccattc

SEQ ID NO: 397939 - DNA, 25 bp, Homo sapien
cctgccattcttgtcctaaagcaat

SEQ ID NO: 397940 - DNA, 25 bp, Homo sapien
gtcaatgcctatgaacacatcagat

SEQ ID NO: 397941 - DNA, 25 bp, Homo sapien
gagctatccccgatgatgacttgga

SEQ ID NO: 397942 - DNA, 25 bp, Homo sapien
ggtaaataatcgattcccttctaat

SEQ ID NO: 397943 - DNA, 25 bp, Homo sapien
tcgattcccttctaatagttttcac

SEQ ID NO: 397944 - DNA, 25 bp, Homo sapien
agttttcactatcaagtacttccag

SEQ ID NO: 397945 - DNA, 25 bp, Homo sapien
atcaagtacttccagactgctctag

SEQ ID NO: 397946 - DNA, 25 bp, Homo sapien
ttccagactgctctagaagtacaga

SEQ ID NO: 397947 - DNA, 25 bp, Homo sapien
gttggttttgagaatgcctttaaag

SEQ ID NO: 397948 - DNA, 25 bp, Homo sapien
gcctttaaagcgtactcaaatgcaa

SEQ ID NO: 397949 - DNA, 25 bp, Homo sapien
ctgagggccgattgctattaccatg

SEQ ID NO: 397950 - DNA, 25 bp, Homo sapien
agggccgattgctattaccatggat

SEQ ID NO: 397951 - DNA, 25 bp, Homo sapien
ggccgattgctattaccatggatga

SEQ ID NO: 397952 - DNA, 25 bp, Homo sapien
gattgctattaccatggatgacgag

SEQ ID NO: 397953 - DNA, 25 bp, Homo sapien
gctattaccatggatgacgagtttg

SEQ ID NO: 397954 - DNA, 25 bp, Homo sapien
gccgaacacgcaaatattcagcctg

SEQ ID NO: 397955 - DNA, 25 bp, Homo sapien
gaacacgcaaatattcagcctgctg

SEQ ID NO: 397956 - DNA, 25 bp, Homo sapien
cacgcaaatattcagcctgctgtca

SEQ ID NO: 397957 - DNA, 25 bp, Homo sapien
attcagcctgctgtcataggtctgg

SEQ ID NO: 397958 - DNA, 25 bp, Homo sapien
tcagcctgctgtcataggtctggca

SEQ ID NO: 397959 - DNA, 25 bp, Homo sapien
cctgctgtcataggtctggcagtaa

SEQ ID NO: 397960 - DNA, 25 bp, Homo sapien
ttgtaatttccggtgtaaaagatgg

SEQ ID NO: 397961 - DNA, 25 bp, Homo sapien
aaaagatggaattatattttctgca

SEQ ID NO: 397962 - DNA, 25 bp, Homo sapien
atgtctgcagacatacaccttgttg

SEQ ID NO: 397963 - DNA, 25 bp, Homo sapien
gtctgcagacatacaccttgttgta

SEQ ID NO: 397964 - DNA, 25 bp, Homo sapien
ctgcagacatacaccttgttgtaga

SEQ ID NO: 397965 - DNA, 25 bp, Homo sapien
gcagacatacaccttgttgtagact

SEQ ID NO: 397966 - DNA, 25 bp, Homo sapien
gacatacaccttgttgtagactata

SEQ ID NO: 397967 - DNA, 25 bp, Homo sapien
gtagactataaaattgctgatgtgg

SEQ ID NO: 397968 - DNA, 25 bp, Homo sapien
ctataaaattgctgatgtgggacac

SEQ ID NO: 397969 - DNA, 25 bp, Homo sapien
aattgctgatgtgggacacttaaag

SEQ ID NO: 397970 - DNA, 25 bp, Homo sapien
tgatgtgggacacttaaagtactac

SEQ ID NO: 397971 - DNA, 25 bp, Homo sapien
tcgcaaagagaggacaggatgtagc

SEQ ID NO: 397972 - DNA, 25 bp, Homo sapien
aagagaggacaggatgtagctctca

SEQ ID NO: 397973 - DNA, 25 bp, Homo sapien
gtgtgatccaatttcgggtcatgta

SEQ ID NO: 397974 - DNA, 25 bp, Homo sapien
tgtgatccaatttcgggtcatgtat

SEQ ID NO: 397975 - DNA, 25 bp, Homo sapien
atccaatttcgggtcatgtatccct

SEQ ID NO: 397976 - DNA, 25 bp, Homo sapien
caatttcgggtcatgtatccctttt

SEQ ID NO: 397977 - DNA, 25 bp, Homo sapien
tgtatcccttttttggtaccaacag

SEQ ID NO: 397978 - DNA, 25 bp, Homo sapien
gatcgcttctttgcagaaaggcctg

SEQ ID NO: 397979 - DNA, 25 bp, Homo sapien
gtcccctaggtacaaagtcgcaaag

SEQ ID NO: 397980 - DNA, 25 bp, Homo sapien
cccctaggtacaaagtcgcaaagag

SEQ ID NO: 397981 - DNA, 25 bp, Homo sapien
ctaggtacaaagtcgcaaagagagg

SEQ ID NO: 397982 - DNA, 25 bp, Homo sapien
gagtggttttttccctgcccaccag

SEQ ID NO: 397983 - DNA, 25 bp, Homo sapien
tgcccaccagaggagaaagcccttg

SEQ ID NO: 397984 - DNA, 25 bp, Homo sapien
ccaccagaggagaaagcccttgtag

SEQ ID NO: 397985 - DNA, 25 bp, Homo sapien
tagaattctgcagtgttacaagtgt

SEQ ID NO: 397986 - DNA, 25 bp, Homo sapien
tacaagtgttccctacaaaaactga

SEQ ID NO: 397987 - DNA, 25 bp, Homo sapien
aatggtattctgtaaagtggtgctc

SEQ ID NO: 397988 - DNA, 25 bp, Homo sapien
ttctgtaaagtggtgctctaggcat

SEQ ID NO: 397989 - DNA, 25 bp, Homo sapien
gtgctctaggcataatttaaattct

SEQ ID NO: 397990 - DNA, 25 bp, Homo sapien
tttttgctgcatcctttgtaagaag

SEQ ID NO: 397991 - DNA, 25 bp, Homo sapien
gcatcctttgtaagaagactgccaa

SEQ ID NO: 397992 - DNA, 25 bp, Homo sapien
taagaagactgccaacagaggaaaa

SEQ ID NO: 397993 - DNA, 25 bp, Homo sapien
gttccataaggtgatacaggcctgc

SEQ ID NO: 397994 - DNA, 25 bp, Homo sapien
taaggtgatacaggcctgccattct

SEQ ID NO: 397995 - DNA, 25 bp, Homo sapien
gtgatacaggcctgccattcttgtc

SEQ ID NO: 397996 - DNA, 25 bp, Homo sapien
gcctgccattcttgtcctaaagcaa

SEQ ID NO: 397997 - DNA, 25 bp, Homo sapien
gccattcttgtcctaaagcaattga

SEQ ID NO: 397998 - DNA, 25 bp, Homo sapien
cttgtcctaaagcaattgaagttgt

SEQ ID NO: 397999 - DNA, 25 bp, Homo sapien
gaagttgtagtcaatgcctatgaac

SEQ ID NO: 398000 - DNA, 25 bp, Homo sapien
gtcaatgcctatgaacacatcagat

SEQ ID NO: 398001 - DNA, 25 bp, Homo sapien
aaagtggagaagagctatccccgat

SEQ ID NO: 398002 - DNA, 25 bp, Homo sapien
gagaagagctatccccgatgatgac

SEQ ID NO: 398003 - DNA, 25 bp, Homo sapien
agctatccccgatgatgacttggag

SEQ ID NO: 398004 - DNA, 25 bp, Homo sapien
aaaagtatgttcaagagctacaagg

SEQ ID NO: 398005 - DNA, 25 bp, Homo sapien
acaaggtatttgtattgctggcaaa

SEQ ID NO: 398006 - DNA, 25 bp, Homo sapien
ggatcctacagggtatggcagtttt

SEQ ID NO: 398007 - DNA, 25 bp, Homo sapien
tcctacagggtatggcagttttaaa

SEQ ID NO: 398008 - DNA, 25 bp, Homo sapien
ggaaaggcagatatacaaggccaaa

SEQ ID NO: 398009 - DNA, 25 bp, Homo sapien
ggccaaaggaatgggttgtacaaag

SEQ ID NO: 398010 - DNA, 25 bp, Homo sapien
acaaagacattgtaccgttgcctgg

SEQ ID NO: 398011 - DNA, 25 bp, Homo sapien
aaagacattgtaccgttgcctggaa

SEQ ID NO: 398012 - DNA, 25 bp, Homo sapien
agacattgtaccgttgcctggaaaa

SEQ ID NO: 398013 - DNA, 25 bp, Homo sapien
cattgtaccgttgcctggaaaagta

SEQ ID NO: 398014 - DNA, 25 bp, Homo sapien
accgttgcctggaaaagtatgttca

SEQ ID NO: 398015 - DNA, 25 bp, Homo sapien
ggagccaggcagtcagccgcagcac

SEQ ID NO: 398016 - DNA, 25 bp, Homo sapien
gcagtcagccgcagcaccgaggtga

SEQ ID NO: 398017 - DNA, 25 bp, Homo sapien
agcaccgaggtgaaggtggtctcac

SEQ ID NO: 398018 - DNA, 25 bp, Homo sapien
gtgaaggtggtctcaccagcaccca

SEQ ID NO: 398019 - DNA, 25 bp, Homo sapien
accctggcagggactgcgtcgacca

SEQ ID NO: 398020 - DNA, 25 bp, Homo sapien
gggactgcgtcgaccagccagagct

SEQ ID NO: 398021 - DNA, 25 bp, Homo sapien
tgcaggcccagctttgtggcaatga

SEQ ID NO: 398022 - DNA, 25 bp, Homo sapien
ggcccagctttgtggcaatgagtat

SEQ ID NO: 398023 - DNA, 25 bp, Homo sapien
gctttgtggcaatgagtattactcc

SEQ ID NO: 398024 - DNA, 25 bp, Homo sapien
atgagtattactccagcttctgctg

SEQ ID NO: 398025 - DNA, 25 bp, Homo sapien
gtattactccagcttctgctgtgcc

SEQ ID NO: 398026 - DNA, 25 bp, Homo sapien
cctggagtcagagctaacacagacc

SEQ ID NO: 398027 - DNA, 25 bp, Homo sapien
tggagtcagagctaacacagacccg

SEQ ID NO: 398028 - DNA, 25 bp, Homo sapien
ggagtcagagctaacacagacccgg

SEQ ID NO: 398029 - DNA, 25 bp, Homo sapien
agagctaacacagacccgggcagag

SEQ ID NO: 398030 - DNA, 25 bp, Homo sapien
gctctccaagcccagaagtacaagg

SEQ ID NO: 398031 - DNA, 25 bp, Homo sapien
aagcccagaagtacaaggccctgct

SEQ ID NO: 398032 - DNA, 25 bp, Homo sapien
agcccagaagtacaaggccctgctg

SEQ ID NO: 398033 - DNA, 25 bp, Homo sapien
aggtggaggcctgttatgccctgca

SEQ ID NO: 398034 - DNA, 25 bp, Homo sapien
ttatgccctgcagatggagcagctc

SEQ ID NO: 398035 - DNA, 25 bp, Homo sapien
agcagctcaacctggatcctggatc

SEQ ID NO: 398036 - DNA, 25 bp, Homo sapien
cagctcaacctggatcctggatcct

SEQ ID NO: 398037 - DNA, 25 bp, Homo sapien
aaagcaccaaaatctccacgtggca

SEQ ID NO: 398038 - DNA, 25 bp, Homo sapien
accaaaatctccacgtggcatgcct

SEQ ID NO: 398039 - DNA, 25 bp, Homo sapien
ggcatgcctccaagtagatttcaag

SEQ ID NO: 398040 - DNA, 25 bp, Homo sapien
agtttgtgctgtgagacctaaagtt

SEQ ID NO: 398041 - DNA, 25 bp, Homo sapien
taaagttcttatgaggttatcttga

SEQ ID NO: 398042 - DNA, 25 bp, Homo sapien
gaaaaaatgtgtcagcagagcctat

SEQ ID NO: 398043 - DNA, 25 bp, Homo sapien
gttccatgtatgctaattgtgtcca

SEQ ID NO: 398044 - DNA, 25 bp, Homo sapien
atgtatgctaattgtgtccatgaca

SEQ ID NO: 398045 - DNA, 25 bp, Homo sapien
gtccatgacaggatcaaacatgctt

SEQ ID NO: 398046 - DNA, 25 bp, Homo sapien
caaacatgctttcttcatcaaggag

SEQ ID NO: 398047 - DNA, 25 bp, Homo sapien
atgctttcttcatcaaggagcagaa

SEQ ID NO: 398048 - DNA, 25 bp, Homo sapien
gcagctcagcagatttcttggattt

SEQ ID NO: 398049 - DNA, 25 bp, Homo sapien
gttctgaaagcctagaagccatctc

SEQ ID NO: 398050 - DNA, 25 bp, Homo sapien
gccatctcaagctcaggacaacaat

SEQ ID NO: 398051 - DNA, 25 bp, Homo sapien
aacaatcagatagcctttcagaaca

SEQ ID NO: 398052 - DNA, 25 bp, Homo sapien
agcctttcagaacagagagcagata

SEQ ID NO: 398053 - DNA, 25 bp, Homo sapien
gcagatacagaatgcatgcaggact

SEQ ID NO: 398054 - DNA, 25 bp, Homo sapien
aatgcatgcaggactggcaaaacct

SEQ ID NO: 398055 - DNA, 25 bp, Homo sapien
ctctggaagtcatttggcatatgtg

SEQ ID NO: 398056 - DNA, 25 bp, Homo sapien
ggaaggataggccatcttgtcattt

SEQ ID NO: 398057 - DNA, 25 bp, Homo sapien
aaagaagtctggttttcatgcctcc

SEQ ID NO: 398058 - DNA, 25 bp, Homo sapien
aagtctggttttcatgcctcctttg

SEQ ID NO: 398059 - DNA, 25 bp, Homo sapien
gtacctggagacactgtcaggactg

SEQ ID NO: 398060 - DNA, 25 bp, Homo sapien
gagacactgtcaggactggtggaca

SEQ ID NO: 398061 - DNA, 25 bp, Homo sapien
ggactggtggacagtaacctcaact

SEQ ID NO: 398062 - DNA, 25 bp, Homo sapien
agtaacctcaactgcgggcctgtgc

SEQ ID NO: 398063 - DNA, 25 bp, Homo sapien
actgcgggcctgtgctcacctggat

SEQ ID NO: 398064 - DNA, 25 bp, Homo sapien
acctggatggaggtgggcctgggca

SEQ ID NO: 398065 - DNA, 25 bp, Homo sapien
ccacgcccagcacagagagatttta

SEQ ID NO: 398066 - DNA, 25 bp, Homo sapien
cgcccagcacagagagattttagat

SEQ ID NO: 398067 - DNA, 25 bp, Homo sapien
gattttagatggcaaccgtgtggca

SEQ ID NO: 398068 - DNA, 25 bp, Homo sapien
atggcaaccgtgtggcatctgctgt

SEQ ID NO: 398069 - DNA, 25 bp, Homo sapien
caaccgtgtggcatctgctgtggag

SEQ ID NO: 398070 - DNA, 25 bp, Homo sapien
cgaggaggccaggtgttttacaaca

SEQ ID NO: 398071 - DNA, 25 bp, Homo sapien
ggccaggtgttttacaacagcgagt

SEQ ID NO: 398072 - DNA, 25 bp, Homo sapien
aggtgttttacaacagcgagtatgg

SEQ ID NO: 398073 - DNA, 25 bp, Homo sapien
tcggagccaagcgaggaggaccact

SEQ ID NO: 398074 - DNA, 25 bp, Homo sapien
agccaagcgaggaggaccactgctc

SEQ ID NO: 398075 - DNA, 25 bp, Homo sapien
aagcggcttcagctgtaaaggacct

SEQ ID NO: 398076 - DNA, 25 bp, Homo sapien
gcttcagctgtaaaggacctggcca

SEQ ID NO: 398077 - DNA, 25 bp, Homo sapien
cagctgtaaaggacctggccagaat

SEQ ID NO: 398078 - DNA, 25 bp, Homo sapien
aaggacctggccagaatgtggctgt

SEQ ID NO: 398079 - DNA, 25 bp, Homo sapien
ctggccagaatgtggctgtgaccag

SEQ ID NO: 398080 - DNA, 25 bp, Homo sapien
gggcacaccctgactcccaagggag

SEQ ID NO: 398081 - DNA, 25 bp, Homo sapien
tcaacagagaccaggccagtcccct

SEQ ID NO: 398082 - DNA, 25 bp, Homo sapien
gtcaggcgtgggacaacacccatgt

SEQ ID NO: 398083 - DNA, 25 bp, Homo sapien
tcaggcgtgggacaacacccatgtg

SEQ ID NO: 398084 - DNA, 25 bp, Homo sapien
caggcgtgggacaacacccatgtga

SEQ ID NO: 398085 - DNA, 25 bp, Homo sapien
aggcgtgggacaacacccatgtgat

SEQ ID NO: 398086 - DNA, 25 bp, Homo sapien
ggcgtgggacaacacccatgtgata

SEQ ID NO: 398087 - DNA, 25 bp, Homo sapien
gcgtgggacaacacccatgtgatat

SEQ ID NO: 398088 - DNA, 25 bp, Homo sapien
ctgctctggagataaattgggaaat

SEQ ID NO: 398089 - DNA, 25 bp, Homo sapien
gctctggagataaattgggaaataa

SEQ ID NO: 398090 - DNA, 25 bp, Homo sapien
aatatgcttcctggtatcaacagag

SEQ ID NO: 398091 - DNA, 25 bp, Homo sapien
atatgcttcctggtatcaacagaga

SEQ ID NO: 398092 - DNA, 25 bp, Homo sapien
ttataaagtggactggtaccagcag

SEQ ID NO: 398093 - DNA, 25 bp, Homo sapien
tgatcgcttctcagtcttgggctca

SEQ ID NO: 398094 - DNA, 25 bp, Homo sapien
gcttctcagtcttgggctcaggcct

SEQ ID NO: 398095 - DNA, 25 bp, Homo sapien
tgggctcaggcctgaatcggtacct

SEQ ID NO: 398096 - DNA, 25 bp, Homo sapien
aggcctgaatcggtacctgaccatc

SEQ ID NO: 398097 - DNA, 25 bp, Homo sapien
gaatcggtacctgaccatcaagaac

SEQ ID NO: 398098 - DNA, 25 bp, Homo sapien
ggtacctgaccatcaagaacatcca

SEQ ID NO: 398099 - DNA, 25 bp, Homo sapien
gaccatcaagaacatccaggaagaa

SEQ ID NO: 398100 - DNA, 25 bp, Homo sapien
tgggagcctcggtcacactcacctg

SEQ ID NO: 398101 - DNA, 25 bp, Homo sapien
tgcaccctgagcagcggctacagta

SEQ ID NO: 398102 - DNA, 25 bp, Homo sapien
gagcagcggctacagtaattataaa

SEQ ID NO: 398103 - DNA, 25 bp, Homo sapien
tggcatgtagccatgggtgtcccca

SEQ ID NO: 398104 - DNA, 25 bp, Homo sapien
agtgctcaccttcagcccgaggttg

SEQ ID NO: 398105 - DNA, 25 bp, Homo sapien
accttcagcccgaggttgatggcgg

SEQ ID NO: 398106 - DNA, 25 bp, Homo sapien
ggttgatggcggtgaatagaccttt

SEQ ID NO: 398107 - DNA, 25 bp, Homo sapien
aatagacctttgcagattgggcagg

SEQ ID NO: 398108 - DNA, 25 bp, Homo sapien
tgtagccatgggtgtccccaaaggg

SEQ ID NO: 398109 - DNA, 25 bp, Homo sapien
cacccaaagacatctcggagccggg

SEQ ID NO: 398110 - DNA, 25 bp, Homo sapien
gggagcaaactcagtgatggattgt

SEQ ID NO: 398111 - DNA, 25 bp, Homo sapien
gatggattgtagatgccaccctctc

SEQ ID NO: 398112 - DNA, 25 bp, Homo sapien
accctctccatcagggatgcattct

SEQ ID NO: 398113 - DNA, 25 bp, Homo sapien
agggatgcattctgagcccagcgca

SEQ ID NO: 398114 - DNA, 25 bp, Homo sapien
aaaccctcgatagagacagaaactg

SEQ ID NO: 398115 - DNA, 25 bp, Homo sapien
tgaactgtcagtccttagagctcgc

SEQ ID NO: 398116 - DNA, 25 bp, Homo sapien
tgtcagtccttagagctcgcccagt

SEQ ID NO: 398117 - DNA, 25 bp, Homo sapien
agtccatgccacaactgggccacag

SEQ ID NO: 398118 - DNA, 25 bp, Homo sapien
caactgggccacagctaaagcttta

SEQ ID NO: 398119 - DNA, 25 bp, Homo sapien
cttgcccagacaagatcacctgtta

SEQ ID NO: 398120 - DNA, 25 bp, Homo sapien
agatcacctgttaagacttcttggc

SEQ ID NO: 398121 - DNA, 25 bp, Homo sapien
gacttcttggcgttaagttatgaca

SEQ ID NO: 398122 - DNA, 25 bp, Homo sapien
gttatgacatgtatacgcgtttgtt

SEQ ID NO: 398123 - DNA, 25 bp, Homo sapien
taaaaggctgaccagggcacctagc

SEQ ID NO: 398124 - DNA, 25 bp, Homo sapien
tagccctggagctgtcttggcgagc

SEQ ID NO: 398125 - DNA, 25 bp, Homo sapien
accgctgcggcatctgggactcacg

SEQ ID NO: 398126 - DNA, 25 bp, Homo sapien
gggactcacgcgcatgaacatcagt

SEQ ID NO: 398127 - DNA, 25 bp, Homo sapien
atcagtgccagacgcttcacctctg

SEQ ID NO: 398128 - DNA, 25 bp, Homo sapien
gtgccagacgcttcacctctgctga

SEQ ID NO: 398129 - DNA, 25 bp, Homo sapien
ctgctgacagcagacttgggtgtct

SEQ ID NO: 398130 - DNA, 25 bp, Homo sapien
gacagcagacttgggtgtctcttgc

SEQ ID NO: 398131 - DNA, 25 bp, Homo sapien
cagacttgggtgtctcttgcagtat

SEQ ID NO: 398132 - DNA, 25 bp, Homo sapien
tgggtgtctcttgcagtatctggga

SEQ ID NO: 398133 - DNA, 25 bp, Homo sapien
tgtctcttgcagtatctgggagaaa

SEQ ID NO: 398134 - DNA, 25 bp, Homo sapien
ccggctgcacagactgaaagtggac

SEQ ID NO: 398135 - DNA, 25 bp, Homo sapien
aaagtggaccaagtctgtcacctgc

SEQ ID NO: 398136 - DNA, 25 bp, Homo sapien
ccaaaaagtccaacagctgtataat

SEQ ID NO: 398137 - DNA, 25 bp, Homo sapien
acagctgtataattggtggcccaga

SEQ ID NO: 398138 - DNA, 25 bp, Homo sapien
ctgtataattggtggcccagaagga

SEQ ID NO: 398139 - DNA, 25 bp, Homo sapien
gaactaatgactgataatgtttcaa

SEQ ID NO: 398140 - DNA, 25 bp, Homo sapien
tatagattcaaaagcccagctgaat

SEQ ID NO: 398141 - DNA, 25 bp, Homo sapien
aagcccagctgaattcaaataggat

SEQ ID NO: 398142 - DNA, 25 bp, Homo sapien
aaattggttttgtcacaagccagca

SEQ ID NO: 398143 - DNA, 25 bp, Homo sapien
ggttttgtcacaagccagcattgtc

SEQ ID NO: 398144 - DNA, 25 bp, Homo sapien
tgtcacaagccagcattgtcactgt

SEQ ID NO: 398145 - DNA, 25 bp, Homo sapien
gcattgtcactgtgggagaaaagag

SEQ ID NO: 398146 - DNA, 25 bp, Homo sapien
gagatcaaaagtacacaaggaagga

SEQ ID NO: 398147 - DNA, 25 bp, Homo sapien
atactccatgtggattggcagctcc

SEQ ID NO: 398148 - DNA, 25 bp, Homo sapien
ctccatgtggattggcagctccatc

SEQ ID NO: 398149 - DNA, 25 bp, Homo sapien
acatctgcaaagaccggtacgtcaa

SEQ ID NO: 398150 - DNA, 25 bp, Homo sapien
aaagaccggtacgtcaacagagtgc

SEQ ID NO: 398151 - DNA, 25 bp, Homo sapien
atggcatcgccgacaggatgcagga

SEQ ID NO: 398152 - DNA, 25 bp, Homo sapien
gcatcgccgacaggatgcaggagat

SEQ ID NO: 398153 - DNA, 25 bp, Homo sapien
tcaccggcttggctccaagcacgat

SEQ ID NO: 398154 - DNA, 25 bp, Homo sapien
ttggctccaagcacgatgaagatca

SEQ ID NO: 398155 - DNA, 25 bp, Homo sapien
tccaagcacgatgaagatcaagatc

SEQ ID NO: 398156 - DNA, 25 bp, Homo sapien
tccttctgagcgcaaatactccatg

SEQ ID NO: 398157 - DNA, 25 bp, Homo sapien
ttctgagcgcaaatactccatgtgg

SEQ ID NO: 398158 - DNA, 25 bp, Homo sapien
cctggagtcagagctaacacagacc

SEQ ID NO: 398159 - DNA, 25 bp, Homo sapien
ctggagtcagagctaacacagaccc

SEQ ID NO: 398160 - DNA, 25 bp, Homo sapien
tggagtcagagctaacacagacccg

SEQ ID NO: 398161 - DNA, 25 bp, Homo sapien
ggagtcagagctaacacagacccgg

SEQ ID NO: 398162 - DNA, 25 bp, Homo sapien
tccaagcccagaagtacaaggccct

SEQ ID NO: 398163 - DNA, 25 bp, Homo sapien
caagcccagaagtacaaggccctgc

SEQ ID NO: 398164 - DNA, 25 bp, Homo sapien
aagcccagaagtacaaggccctgct

SEQ ID NO: 398165 - DNA, 25 bp, Homo sapien
agcccagaagtacaaggccctgctg

SEQ ID NO: 398166 - DNA, 25 bp, Homo sapien
agcagctcaacctggatcctggatc

SEQ ID NO: 398167 - DNA, 25 bp, Homo sapien
gcagctcaacctggatcctggatcc

SEQ ID NO: 398168 - DNA, 25 bp, Homo sapien
cagctcaacctggatcctggatcct

SEQ ID NO: 398169 - DNA, 25 bp, Homo sapien
aagaggcagcatgaggaaccagaga

SEQ ID NO: 398170 - DNA, 25 bp, Homo sapien
agagagcttctttacctggtttact

SEQ ID NO: 398171 - DNA, 25 bp, Homo sapien
gagagcttctttacctggtttactg

SEQ ID NO: 398172 - DNA, 25 bp, Homo sapien
gagcttctttacctggtttactgac

SEQ ID NO: 398173 - DNA, 25 bp, Homo sapien
gcttctttacctggtttactgacca

SEQ ID NO: 398174 - DNA, 25 bp, Homo sapien
cttctttacctggtttactgaccat

SEQ ID NO: 398175 - DNA, 25 bp, Homo sapien
gatatttggccaaacccattacagt

SEQ ID NO: 398176 - DNA, 25 bp, Homo sapien
tatttggccaaacccattacagtac

SEQ ID NO: 398177 - DNA, 25 bp, Homo sapien
tggccaaacccattacagtactact

SEQ ID NO: 398178 - DNA, 25 bp, Homo sapien
ggccaaacccattacagtactactt

SEQ ID NO: 398179 - DNA, 25 bp, Homo sapien
caaacccattacagtactacttggt

SEQ ID NO: 398180 - DNA, 25 bp, Homo sapien
actgaggtccgggtgacagtgcttc

SEQ ID NO: 398181 - DNA, 25 bp, Homo sapien
agtgcttcggcaggctgacagccag

SEQ ID NO: 398182 - DNA, 25 bp, Homo sapien
tgactgaagtctgtgcggcaaccta

SEQ ID NO: 398183 - DNA, 25 bp, Homo sapien
tgagttgaccttcctagatgattcc

SEQ ID NO: 398184 - DNA, 25 bp, Homo sapien
agatgattccatctgcacgggcacc

SEQ ID NO: 398185 - DNA, 25 bp, Homo sapien
gtgaacctcactatccaaggactga

SEQ ID NO: 398186 - DNA, 25 bp, Homo sapien
tgagggccatggacacgggactcta

SEQ ID NO: 398187 - DNA, 25 bp, Homo sapien
acgggactctacatctgcaaggtgg

SEQ ID NO: 398188 - DNA, 25 bp, Homo sapien
aaggtggagctcatgtacccaccgc

SEQ ID NO: 398189 - DNA, 25 bp, Homo sapien
tactacctgggcataggcaacggaa

SEQ ID NO: 398190 - DNA, 25 bp, Homo sapien
agaaaagaagccctcttacaacagg

SEQ ID NO: 398191 - DNA, 25 bp, Homo sapien
cctggcagagcgagtcctcatcctg

SEQ ID NO: 398192 - DNA, 25 bp, Homo sapien
ctggcagagcgagtcctcatcctgg

SEQ ID NO: 398193 - DNA, 25 bp, Homo sapien
aagaaggagagaaagccgccactgc

SEQ ID NO: 398194 - DNA, 25 bp, Homo sapien
agaaggagagaaagccgccactgca

SEQ ID NO: 398195 - DNA, 25 bp, Homo sapien
gaaggagagaaagccgccactgcag

SEQ ID NO: 398196 - DNA, 25 bp, Homo sapien
aaggagagaaagccgccactgcaga

SEQ ID NO: 398197 - DNA, 25 bp, Homo sapien
agagaaagccgccactgcagagggc

SEQ ID NO: 398198 - DNA, 25 bp, Homo sapien
agaaagccgccactgcagagggcga

SEQ ID NO: 398199 - DNA, 25 bp, Homo sapien
aagccgccactgcagagggcgaggg

SEQ ID NO: 398200 - DNA, 25 bp, Homo sapien
agatcctggcagagcgagtcctcat

SEQ ID NO: 398201 - DNA, 25 bp, Homo sapien
gatcctggcagagcgagtcctcatc

SEQ ID NO: 398202 - DNA, 25 bp, Homo sapien
gtgctaaaacaggttcaccccgata

SEQ ID NO: 398203 - DNA, 25 bp, Homo sapien
taaaacaggttcaccccgatactgg

SEQ ID NO: 398204 - DNA, 25 bp, Homo sapien
gttcaccccgatactggcatctcat

SEQ ID NO: 398205 - DNA, 25 bp, Homo sapien
aagcacgcagtgtccgaaggtacca

SEQ ID NO: 398206 - DNA, 25 bp, Homo sapien
agcacgcagtgtccgaaggtaccaa

SEQ ID NO: 398207 - DNA, 25 bp, Homo sapien
cacgcagtgtccgaaggtaccaagg

SEQ ID NO: 398208 - DNA, 25 bp, Homo sapien
cgcagtgtccgaaggtaccaaggct

SEQ ID NO: 398209 - DNA, 25 bp, Homo sapien
agtgtccgaaggtaccaaggctgtc

SEQ ID NO: 398210 - DNA, 25 bp, Homo sapien
tgtccgaaggtaccaaggctgtcac

SEQ ID NO: 398211 - DNA, 25 bp, Homo sapien
caagtatacaagctccaagtaaatg

SEQ ID NO: 398212 - DNA, 25 bp, Homo sapien
acaagctccaagtaaatgtgtgctt

SEQ ID NO: 398213 - DNA, 25 bp, Homo sapien
aaacaacctacatttcaagtactat

SEQ ID NO: 398214 - DNA, 25 bp, Homo sapien
acatttcaagtactatttcccttct

SEQ ID NO: 398215 - DNA, 25 bp, Homo sapien
cttctctcccatctaattgctaaag

SEQ ID NO: 398216 - DNA, 25 bp, Homo sapien
tctcccatctaattgctaaagattt

SEQ ID NO: 398217 - DNA, 25 bp, Homo sapien
agattttctttcatacgcacacact

SEQ ID NO: 398218 - DNA, 25 bp, Homo sapien
ttttctttcatacgcacacactcca

SEQ ID NO: 398219 - DNA, 25 bp, Homo sapien
tttcatacgcacacactccagtgac

SEQ ID NO: 398220 - DNA, 25 bp, Homo sapien
tacgcacacactccagtgactggaa

SEQ ID NO: 398221 - DNA, 25 bp, Homo sapien
tccagtgactggaaaaacgggagtt

SEQ ID NO: 398222 - DNA, 25 bp, Homo sapien
aacgggagttttcagtcaaagcttg

SEQ ID NO: 398223 - DNA, 25 bp, Homo sapien
acgggagttttcagtcaaagcttga

SEQ ID NO: 398224 - DNA, 25 bp, Homo sapien
gccctggccactagtgttaatgatg

SEQ ID NO: 398225 - DNA, 25 bp, Homo sapien
atgatgtttaacgtcagtgccaccg

SEQ ID NO: 398226 - DNA, 25 bp, Homo sapien
atgtttaacgtcagtgccaccgttc

SEQ ID NO: 398227 - DNA, 25 bp, Homo sapien
taacgtcagtgccaccgttctttac

SEQ ID NO: 398228 - DNA, 25 bp, Homo sapien
agtgccaccgttctttacgtcaccg

SEQ ID NO: 398229 - DNA, 25 bp, Homo sapien
gacctgacgtccctgaagggcacgc

SEQ ID NO: 398230 - DNA, 25 bp, Homo sapien
gaagggcacgcagccgtataaccag

SEQ ID NO: 398231 - DNA, 25 bp, Homo sapien
gtataaccagcgtgcggctacctcg

SEQ ID NO: 398232 - DNA, 25 bp, Homo sapien
tgatcgcctacggagtgagcgactt

SEQ ID NO: 398233 - DNA, 25 bp, Homo sapien
gtgagcgacttcttcagctaccatg

SEQ ID NO: 398234 - DNA, 25 bp, Homo sapien
agcgacttcttcagctaccatgcct

SEQ ID NO: 398235 - DNA, 25 bp, Homo sapien
aagatggcttctgggttccactcct

SEQ ID NO: 398236 - DNA, 25 bp, Homo sapien
ttttttggaggctgactgatacctg

SEQ ID NO: 398237 - DNA, 25 bp, Homo sapien
ggctgactgatacctggacttctgg

SEQ ID NO: 398238 - DNA, 25 bp, Homo sapien
tgaggcttccttatgtctgctccga

SEQ ID NO: 398239 - DNA, 25 bp, Homo sapien
ggcttccttatgtctgctccgaggt

SEQ ID NO: 398240 - DNA, 25 bp, Homo sapien
agggagctcccctccgtccggatag

SEQ ID NO: 398241 - DNA, 25 bp, Homo sapien
ccgtccggatagtggtaggtgcttc

SEQ ID NO: 398242 - DNA, 25 bp, Homo sapien
gtaggtgcttcctgcggtggcattt

SEQ ID NO: 398243 - DNA, 25 bp, Homo sapien
ttcctgcggtggcatttctggcgac

SEQ ID NO: 398244 - DNA, 25 bp, Homo sapien
ctggcgaccccgagcatcgtagagg

SEQ ID NO: 398245 - DNA, 25 bp, Homo sapien
catcgtagagggtctcgggatcgaa

SEQ ID NO: 398246 - DNA, 25 bp, Homo sapien
gcctggacaggtgctgacgtacctg

SEQ ID NO: 398247 - DNA, 25 bp, Homo sapien
aggtgctgacgtacctgctgctacc

SEQ ID NO: 398248 - DNA, 25 bp, Homo sapien
tgcacactgcccttcgagtacatct

SEQ ID NO: 398249 - DNA, 25 bp, Homo sapien
gagtacatctacttccgcagcagaa

SEQ ID NO: 398250 - DNA, 25 bp, Homo sapien
acttccgcagcagaaggttggtggt

SEQ ID NO: 398251 - DNA, 25 bp, Homo sapien
gacttgtggtggatgcagggcctgc

SEQ ID NO: 398252 - DNA, 25 bp, Homo sapien
gcctgctgaggaacatggccctcga

SEQ ID NO: 398253 - DNA, 25 bp, Homo sapien
aggaacatggccctcgaggttttct

SEQ ID NO: 398254 - DNA, 25 bp, Homo sapien
atggccctcgaggttttctccagga

SEQ ID NO: 398255 - DNA, 25 bp, Homo sapien
ggccactcgcgtcctggaaacaagc

SEQ ID NO: 398256 - DNA, 25 bp, Homo sapien
gcatgtacgagggatcccagccggt

SEQ ID NO: 398257 - DNA, 25 bp, Homo sapien
gtacttacatatactacgcagactc

SEQ ID NO: 398258 - DNA, 25 bp, Homo sapien
acatatactacgcagactcagtgaa

SEQ ID NO: 398259 - DNA, 25 bp, Homo sapien
ctggattcaccttcaatcactatag

SEQ ID NO: 398260 - DNA, 25 bp, Homo sapien
attcaccttcaatcactatagcatg

SEQ ID NO: 398261 - DNA, 25 bp, Homo sapien
ttactgtgcgagatattcctaccac

SEQ ID NO: 398262 - DNA, 25 bp, Homo sapien
actgtgcgagatattcctaccacca

SEQ ID NO: 398263 - DNA, 25 bp, Homo sapien
tgtgcgagatattcctaccaccagg

SEQ ID NO: 398264 - DNA, 25 bp, Homo sapien
tgcgagatattcctaccaccaggtg

SEQ ID NO: 398265 - DNA, 25 bp, Homo sapien
actatagcatgaactgggtccgcca

SEQ ID NO: 398266 - DNA, 25 bp, Homo sapien
gtgggtctcatccattagtagtaat

SEQ ID NO: 398267 - DNA, 25 bp, Homo sapien
ggtctcatccattagtagtaatagt

SEQ ID NO: 398268 - DNA, 25 bp, Homo sapien
atcggcgtcttctacttgtgcatgc

SEQ ID NO: 398269 - DNA, 25 bp, Homo sapien
ttctacttgtgcatgcagctcatcc

SEQ ID NO: 398270 - DNA, 25 bp, Homo sapien
tgggctacgtcctctatgacatgac

SEQ ID NO: 398271 - DNA, 25 bp, Homo sapien
atgacatgacccattactacctgca

SEQ ID NO: 398272 - DNA, 25 bp, Homo sapien
tgcactttggctcgccgcacaaggg

SEQ ID NO: 398273 - DNA, 25 bp, Homo sapien
aagggctcctacctgtacagcctga

SEQ ID NO: 398274 - DNA, 25 bp, Homo sapien
gtcaagcaccactttgcacatcaga

SEQ ID NO: 398275 - DNA, 25 bp, Homo sapien
agcaccactttgcacatcagaagtc

SEQ ID NO: 398276 - DNA, 25 bp, Homo sapien
tggagcgtccctgcctagagctcag

SEQ ID NO: 398277 - DNA, 25 bp, Homo sapien
tagagctcagcccacaggactgctt

SEQ ID NO: 398278 - DNA, 25 bp, Homo sapien
agcccacaggactgcttcaggccgt

SEQ ID NO: 398279 - DNA, 25 bp, Homo sapien
catactaggaaaacaccttcaaagg

SEQ ID NO: 398280 - DNA, 25 bp, Homo sapien
gaacattaaaagttaccagggccag

SEQ ID NO: 398281 - DNA, 25 bp, Homo sapien
tgaggcagatggatcccaagtccag

SEQ ID NO: 398282 - DNA, 25 bp, Homo sapien
gcagatggatcccaagtccaggaat

SEQ ID NO: 398283 - DNA, 25 bp, Homo sapien
catagtgagagcctgtcaacaaaaa

SEQ ID NO: 398284 - DNA, 25 bp, Homo sapien
tgggcttggtgatacacatctgtag

SEQ ID NO: 398285 - DNA, 25 bp, Homo sapien
gcttggtgatacacatctgtagtcc

SEQ ID NO: 398286 - DNA, 25 bp, Homo sapien
ctatttgggaggctgccttgatatc

SEQ ID NO: 398287 - DNA, 25 bp, Homo sapien
tgggaggctgccttgatatcaggca

SEQ ID NO: 398288 - DNA, 25 bp, Homo sapien
gatatcaggcagtcgaggctgcagt

SEQ ID NO: 398289 - DNA, 25 bp, Homo sapien
agctgactgccccactgtattccag

SEQ ID NO: 398290 - DNA, 25 bp, Homo sapien
tacttggtgcagtgtgctgtccaga

SEQ ID NO: 398291 - DNA, 25 bp, Homo sapien
agtgtgctgtccagagagacctgct

SEQ ID NO: 398292 - DNA, 25 bp, Homo sapien
gacccagtctgggacaggcacagtg

SEQ ID NO: 398293 - DNA, 25 bp, Homo sapien
gcctctggaccgtcagtgtggcgta

SEQ ID NO: 398294 - DNA, 25 bp, Homo sapien
tcagtgtggcgtaggcagtgggtct

SEQ ID NO: 398295 - DNA, 25 bp, Homo sapien
gaggcagcctcttgactttgtcaca

SEQ ID NO: 398296 - DNA, 25 bp, Homo sapien
gactttgtcacaacggttgcactga

SEQ ID NO: 398297 - DNA, 25 bp, Homo sapien
caacggttgcactgaagatggcccc

SEQ ID NO: 398298 - DNA, 25 bp, Homo sapien
ccccacaagcccagttgtgaatatc

SEQ ID NO: 398299 - DNA, 25 bp, Homo sapien
ttgtgaatatcaaggtgaccctgcc

SEQ ID NO: 398300 - DNA, 25 bp, Homo sapien
aacctgaagccctgagaaggagagc

SEQ ID NO: 398301 - DNA, 25 bp, Homo sapien
ttctgcctttgacaaacccttagcc

SEQ ID NO: 398302 - DNA, 25 bp, Homo sapien
aaacccttagcccactgatctggtc

SEQ ID NO: 398303 - DNA, 25 bp, Homo sapien
ctgatctggtctgggcttctggcta

SEQ ID NO: 398304 - DNA, 25 bp, Homo sapien
ctggccttgggatctactttcagga

SEQ ID NO: 398305 - DNA, 25 bp, Homo sapien
gggatctactttcaggattatttct

SEQ ID NO: 398306 - DNA, 25 bp, Homo sapien
ttcttgtctttgaacgtgacagtgt

SEQ ID NO: 398307 - DNA, 25 bp, Homo sapien
aagtgagtgtagatgctgcgaccct

SEQ ID NO: 398308 - DNA, 25 bp, Homo sapien
tgcgaccctgcgagaagcaatagct

SEQ ID NO: 398309 - DNA, 25 bp, Homo sapien
aaccgtgatgacaacgaagatgggc

SEQ ID NO: 398310 - DNA, 25 bp, Homo sapien
agatgggcgatggattcgcttccaa

SEQ ID NO: 398311 - DNA, 25 bp, Homo sapien
gattcgcttccaatgacaaagcccc

SEQ ID NO: 398312 - DNA, 25 bp, Homo sapien
ggccagctgggtcatctgctgtaat

SEQ ID NO: 398313 - DNA, 25 bp, Homo sapien
agctgggtcatctgctgtaatcact

SEQ ID NO: 398314 - DNA, 25 bp, Homo sapien
ggaaggccccacagcatcttccata

SEQ ID NO: 398315 - DNA, 25 bp, Homo sapien
agcatcttccatactatgaccccta

SEQ ID NO: 398316 - DNA, 25 bp, Homo sapien
atcttccatactatgacccctacta

SEQ ID NO: 398317 - DNA, 25 bp, Homo sapien
atactatgacccctactactccagg

SEQ ID NO: 398318 - DNA, 25 bp, Homo sapien
atgacccctactactccagggttgt

SEQ ID NO: 398319 - DNA, 25 bp, Homo sapien
ccctactactccagggttgtgttgg

SEQ ID NO: 398320 - DNA, 25 bp, Homo sapien
atcaagaatcagtagaggaaagtat

SEQ ID NO: 398321 - DNA, 25 bp, Homo sapien
tgaggaggagctggaaattgatact

SEQ ID NO: 398322 - DNA, 25 bp, Homo sapien
aggcacagtgattcacacctgccct

SEQ ID NO: 398323 - DNA, 25 bp, Homo sapien
aacacctgcttgttcttcatccctg

SEQ ID NO: 398324 - DNA, 25 bp, Homo sapien
tcatccctgggctgttgggaggaac

SEQ ID NO: 398325 - DNA, 25 bp, Homo sapien
gaggaacagatgagacagtggctat

SEQ ID NO: 398326 - DNA, 25 bp, Homo sapien
gacagtggctatagaagcacttgga

SEQ ID NO: 398327 - DNA, 25 bp, Homo sapien
cttggaaaatgcacttgtcctgttt

SEQ ID NO: 398328 - DNA, 25 bp, Homo sapien
aaatgtgtatttctgccatgtacct

SEQ ID NO: 398329 - DNA, 25 bp, Homo sapien
gtatttctgccatgtacctaatgat

SEQ ID NO: 398330 - DNA, 25 bp, Homo sapien
gtacctaatgattattcagtgcgta

SEQ ID NO: 398331 - DNA, 25 bp, Homo sapien
gaaaagtcatgttgcaaatctttct

SEQ ID NO: 398332 - DNA, 25 bp, Homo sapien
aaatctttctgtgaaacagatgcta

SEQ ID NO: 398333 - DNA, 25 bp, Homo sapien
gatgctattttaaattcactgggag

SEQ ID NO: 398334 - DNA, 25 bp, Homo sapien
atctgaatttctgattacgcccaat

SEQ ID NO: 398335 - DNA, 25 bp, Homo sapien
gaatttctgattacgcccaattttt

SEQ ID NO: 398336 - DNA, 25 bp, Homo sapien
ggaattagttgaccttttacagcgt

SEQ ID NO: 398337 - DNA, 25 bp, Homo sapien
tgaccttttacagcgttaacctcta

SEQ ID NO: 398338 - DNA, 25 bp, Homo sapien
acagcgttaacctctatttcttaat

SEQ ID NO: 398339 - DNA, 25 bp, Homo sapien
ttgtgagaaaaacaagcctgtgtcc

SEQ ID NO: 398340 - DNA, 25 bp, Homo sapien
ggagagaccagacagaaacctttct

SEQ ID NO: 398341 - DNA, 25 bp, Homo sapien
gaaacctttctttcttagcaggcct

SEQ ID NO: 398342 - DNA, 25 bp, Homo sapien
ttagcaggccttccggcactcagaa

SEQ ID NO: 398343 - DNA, 25 bp, Homo sapien
cttccggcactcagaacccatggaa

SEQ ID NO: 398344 - DNA, 25 bp, Homo sapien
taggaagagttgttccgacaagaaa

SEQ ID NO: 398345 - DNA, 25 bp, Homo sapien
agccctgggagacagaaagccttgt

SEQ ID NO: 398346 - DNA, 25 bp, Homo sapien
gactgttccgtcagaatgagcagct

SEQ ID NO: 398347 - DNA, 25 bp, Homo sapien
aaaatgtcgcctgtgaggtctcagc

SEQ ID NO: 398348 - DNA, 25 bp, Homo sapien
tgaggtctcagctcgtacaacaaga

SEQ ID NO: 398349 - DNA, 25 bp, Homo sapien
agaagatagcaatctgcaaaccaga

SEQ ID NO: 398350 - DNA, 25 bp, Homo sapien
aaaccagaaagtgggccctcacaag

SEQ ID NO: 398351 - DNA, 25 bp, Homo sapien
gtgggccctcacaagaactagatga

SEQ ID NO: 398352 - DNA, 25 bp, Homo sapien
gatgatgatggtgtcctggcttcaa

SEQ ID NO: 398353 - DNA, 25 bp, Homo sapien
atggtgtcctggcttcaaactccca

SEQ ID NO: 398354 - DNA, 25 bp, Homo sapien
ggcagagtctgaaaccaagtcgcac

SEQ ID NO: 398355 - DNA, 25 bp, Homo sapien
aaaccaagtcgcacaagccctggga

SEQ ID NO: 398356 - DNA, 25 bp, Homo sapien
cccatttccaaaccatgatatgaat

SEQ ID NO: 398357 - DNA, 25 bp, Homo sapien
ccatgatatgaatgggcgctgacat

SEQ ID NO: 398358 - DNA, 25 bp, Homo sapien
gaatagataatttgtgtgtttgcaa

SEQ ID NO: 398359 - DNA, 25 bp, Homo sapien
tttgcaatgtgtgttttagataaat

SEQ ID NO: 398360 - DNA, 25 bp, Homo sapien
ggattgggtatttaaattagcattt

SEQ ID NO: 398361 - DNA, 25 bp, Homo sapien
ttagcatttgtgaatttaatagcat

SEQ ID NO: 398362 - DNA, 25 bp, Homo sapien
aatttctatttggtttttgtgcatt

SEQ ID NO: 398363 - DNA, 25 bp, Homo sapien
gattttagtgtgttagacttgctga

SEQ ID NO: 398364 - DNA, 25 bp, Homo sapien
gttagacttgctgagtcctagctgt

SEQ ID NO: 398365 - DNA, 25 bp, Homo sapien
acttgctgagtcctagctgtgttta

SEQ ID NO: 398366 - DNA, 25 bp, Homo sapien
ctgagtcctagctgtgtttagaaca

SEQ ID NO: 398367 - DNA, 25 bp, Homo sapien
gacgcacaggcggaagctgcgggcc

SEQ ID NO: 398368 - DNA, 25 bp, Homo sapien
ctcacgctgctgctctgcgtaggac

SEQ ID NO: 398369 - DNA, 25 bp, Homo sapien
tgctgctctgcgtaggaccctacaa

SEQ ID NO: 398370 - DNA, 25 bp, Homo sapien
tacaacgcctccaacgtggccagct

SEQ ID NO: 398371 - DNA, 25 bp, Homo sapien
ggctcatcacgggtgcctggagtgt

SEQ ID NO: 398372 - DNA, 25 bp, Homo sapien
cctggagtgtggtgcttaatccgct

SEQ ID NO: 398373 - DNA, 25 bp, Homo sapien
gtgtggtgcttaatccgctggtgac

SEQ ID NO: 398374 - DNA, 25 bp, Homo sapien
tgcttaatccgctggtgaccggtta

SEQ ID NO: 398375 - DNA, 25 bp, Homo sapien
aatccgctggtgaccggttacttgg

SEQ ID NO: 398376 - DNA, 25 bp, Homo sapien
cctgaagacagtgtgtgcggcaaga

SEQ ID NO: 398377 - DNA, 25 bp, Homo sapien
aagacagtgtgtgcggcaagaacgc

SEQ ID NO: 398378 - DNA, 25 bp, Homo sapien
gtccttattagagcaagccagccaa

SEQ ID NO: 398379 - DNA, 25 bp, Homo sapien
atggcagaagcagagctggttcaag

SEQ ID NO: 398380 - DNA, 25 bp, Homo sapien
tgaaatccaaagcaccctccggaaa

SEQ ID NO: 398381 - DNA, 25 bp, Homo sapien
ctccggaaacggctgtatctgcagt

SEQ ID NO: 398382 - DNA, 25 bp, Homo sapien
aacggctgtatctgcagtagaagta

SEQ ID NO: 398383 - DNA, 25 bp, Homo sapien
ttccagcattctttctgtctcacag

SEQ ID NO: 398384 - DNA, 25 bp, Homo sapien
tctgtctcacagaaatttagaggca

SEQ ID NO: 398385 - DNA, 25 bp, Homo sapien
atttagaggcagctcttacctctcc

SEQ ID NO: 398386 - DNA, 25 bp, Homo sapien
ttacctctccccaagatcttctgtt

SEQ ID NO: 398387 - DNA, 25 bp, Homo sapien
ttcatgcaggtcctcctgtccttat

SEQ ID NO: 398388 - DNA, 25 bp, Homo sapien
ggtcctcctgtccttattagagcaa

SEQ ID NO: 398389 - DNA, 25 bp, Homo sapien
aaacctctcactttgatctgccagg

SEQ ID NO: 398390 - DNA, 25 bp, Homo sapien
gatctgccaggctgtcaaatgcttt

SEQ ID NO: 398391 - DNA, 25 bp, Homo sapien
tctgccaggctgtcaaatgctttga

SEQ ID NO: 398392 - DNA, 25 bp, Homo sapien
gtcaaatgctttgattgccctctct

SEQ ID NO: 398393 - DNA, 25 bp, Homo sapien
aaatgctttgattgccctctctgtt

SEQ ID NO: 398394 - DNA, 25 bp, Homo sapien
tttgattgccctctctgttttgttc

SEQ ID NO: 398395 - DNA, 25 bp, Homo sapien
tctgcctcaggaaagactgtccagg

SEQ ID NO: 398396 - DNA, 25 bp, Homo sapien
ctcaggaaagactgtccagggcata

SEQ ID NO: 398397 - DNA, 25 bp, Homo sapien
gtccagggcataggaagcccacaca

SEQ ID NO: 398398 - DNA, 25 bp, Homo sapien
atgacaagtttgcatctggcacggc

SEQ ID NO: 398399 - DNA, 25 bp, Homo sapien
caagtttgcatctggcacggctggg

SEQ ID NO: 398400 - DNA, 25 bp, Homo sapien
tacatctgagaccacctaccctatt

SEQ ID NO: 398401 - DNA, 25 bp, Homo sapien
agcactgtcacagagtccacgactg

SEQ ID NO: 398402 - DNA, 25 bp, Homo sapien
gagtccacgactgaaatcacctatt

SEQ ID NO: 398403 - DNA, 25 bp, Homo sapien
gactgaaatcacctattccactact

SEQ ID NO: 398404 - DNA, 25 bp, Homo sapien
gaaatcacctattccactactatga

SEQ ID NO: 398405 - DNA, 25 bp, Homo sapien
tgacagagacatcatccagtgccac

SEQ ID NO: 398406 - DNA, 25 bp, Homo sapien
agagacatcatccagtgccacctct

SEQ ID NO: 398407 - DNA, 25 bp, Homo sapien
tctcccttggtctcaaccacagaaa

SEQ ID NO: 398408 - DNA, 25 bp, Homo sapien
ccaaaactcctaccacaatcttggt

SEQ ID NO: 398409 - DNA, 25 bp, Homo sapien
atcacttcagttcccactaccttgg

SEQ ID NO: 398410 - DNA, 25 bp, Homo sapien
cagttcccactaccttgggtaccat

SEQ ID NO: 398411 - DNA, 25 bp, Homo sapien
ctttgtatgagtttggtgtgggtga

SEQ ID NO: 398412 - DNA, 25 bp, Homo sapien
aaattatgagattttgagcagatga

SEQ ID NO: 398413 - DNA, 25 bp, Homo sapien
gaagtgttgccaaaacctcagatgt

SEQ ID NO: 398414 - DNA, 25 bp, Homo sapien
gtgttgccaaaacctcagatgtgtg

SEQ ID NO: 398415 - DNA, 25 bp, Homo sapien
agatgtgtggccttctggccaagcg

SEQ ID NO: 398416 - DNA, 25 bp, Homo sapien
ttctggccaagcgtctgcgatttca

SEQ ID NO: 398417 - DNA, 25 bp, Homo sapien
tggccaagcgtctgcgatttcaatg

SEQ ID NO: 398418 - DNA, 25 bp, Homo sapien
ccaagcgtctgcgatttcaatgttt

SEQ ID NO: 398419 - DNA, 25 bp, Homo sapien
agcgtctgcgatttcaatgtttgga

SEQ ID NO: 398420 - DNA, 25 bp, Homo sapien
gcgatttcaatgtttggagcattca

SEQ ID NO: 398421 - DNA, 25 bp, Homo sapien
atttcaatgtttggagcattcatgg

SEQ ID NO: 398422 - DNA, 25 bp, Homo sapien
cacatacacacatacgtccagacat

SEQ ID NO: 398423 - DNA, 25 bp, Homo sapien
catacacacatacgtccagacatct

SEQ ID NO: 398424 - DNA, 25 bp, Homo sapien
gtccagacatctccctcataaaata

SEQ ID NO: 398425 - DNA, 25 bp, Homo sapien
gacatctccctcataaaataaccat

SEQ ID NO: 398426 - DNA, 25 bp, Homo sapien
aataaccatcagtttctatgaaaac

SEQ ID NO: 398427 - DNA, 25 bp, Homo sapien
ctatgaaaaccttaagtggaagcca

SEQ ID NO: 398428 - DNA, 25 bp, Homo sapien
gtggaagccaatttcccatagtaaa

SEQ ID NO: 398429 - DNA, 25 bp, Homo sapien
aagccaatttcccatagtaaataat

SEQ ID NO: 398430 - DNA, 25 bp, Homo sapien
gcttaaaatgttgctcaaacccctg

SEQ ID NO: 398431 - DNA, 25 bp, Homo sapien
taaaatgttgctcaaacccctgacc

SEQ ID NO: 398432 - DNA, 25 bp, Homo sapien
ccctgacctattactaaactataat

SEQ ID NO: 398433 - DNA, 25 bp, Homo sapien
atatttttgaagctgatacccaaag

SEQ ID NO: 398434 - DNA, 25 bp, Homo sapien
gaagctgatacccaaagtacaaatt

SEQ ID NO: 398435 - DNA, 25 bp, Homo sapien
atgggtgaatcgatacttgcagtgt

SEQ ID NO: 398436 - DNA, 25 bp, Homo sapien
gaatcgatacttgcagtgtatgaga

SEQ ID NO: 398437 - DNA, 25 bp, Homo sapien
gtgtatgagaggatccttttcagca

SEQ ID NO: 398438 - DNA, 25 bp, Homo sapien
gagaggatccttttcagcacattgg

SEQ ID NO: 398439 - DNA, 25 bp, Homo sapien
gatccttttcagcacattggttgta

SEQ ID NO: 398440 - DNA, 25 bp, Homo sapien
gcacattggttgtacattcctttac

SEQ ID NO: 398441 - DNA, 25 bp, Homo sapien
gtacattcctttacaaatatctaat

SEQ ID NO: 398442 - DNA, 25 bp, Homo sapien
tttctaatgagtgtgaactttttca

SEQ ID NO: 398443 - DNA, 25 bp, Homo sapien
tttcatatctgtatttgctgctttt

SEQ ID NO: 398444 - DNA, 25 bp, Homo sapien
ttacattcctttgctgaatatttaa

SEQ ID NO: 398445 - DNA, 25 bp, Homo sapien
aaattctgcatatgaatcctttctg

SEQ ID NO: 398446 - DNA, 25 bp, Homo sapien
tttagcaaatatctttgcccagtgg

SEQ ID NO: 398447 - DNA, 25 bp, Homo sapien
tttgcccagtggatgacttaccttt

SEQ ID NO: 398448 - DNA, 25 bp, Homo sapien
gtggatgacttaccttttaactttg

SEQ ID NO: 398449 - DNA, 25 bp, Homo sapien
actttgttcctgatgtcttttgttg

SEQ ID NO: 398450 - DNA, 25 bp, Homo sapien
gttcctgatgtcttttgttgagcaa

SEQ ID NO: 398451 - DNA, 25 bp, Homo sapien
gttgagcaaaagtctttcattttaa

SEQ ID NO: 398452 - DNA, 25 bp, Homo sapien
atcagattatcggtattttattcaa

SEQ ID NO: 398453 - DNA, 25 bp, Homo sapien
tattcaatggtttgtgctttttgaa

SEQ ID NO: 398454 - DNA, 25 bp, Homo sapien
ggagatccttccctacaaatcaata

SEQ ID NO: 398455 - DNA, 25 bp, Homo sapien
gaatcaagtgttcccatgtgccaag

SEQ ID NO: 398456 - DNA, 25 bp, Homo sapien
ctgaggcattggaagaccggtcact

SEQ ID NO: 398457 - DNA, 25 bp, Homo sapien
gaccggtcactacactttaattcat

SEQ ID NO: 398458 - DNA, 25 bp, Homo sapien
gcaaggctgaatttgccctagactt

SEQ ID NO: 398459 - DNA, 25 bp, Homo sapien
ttgccctagacttaattctgtactg

SEQ ID NO: 398460 - DNA, 25 bp, Homo sapien
aattctgtactgtggctgtgaaggc

SEQ ID NO: 398461 - DNA, 25 bp, Homo sapien
atggcggttttacttcttacattgc

SEQ ID NO: 398462 - DNA, 25 bp, Homo sapien
gaagagctgctaacagtgaatccag

SEQ ID NO: 398463 - DNA, 25 bp, Homo sapien
gaatccagaaagcaattctttggca

SEQ ID NO: 398464 - DNA, 25 bp, Homo sapien
gagagactctgaaatttgtcaagca

SEQ ID NO: 398465 - DNA, 25 bp, Homo sapien
agcatattaaccaccgaagcctgga

SEQ ID NO: 398466 - DNA, 25 bp, Homo sapien
cagtatatactgactagttatctta

SEQ ID NO: 398467 - DNA, 25 bp, Homo sapien
gactagttatcttaaaaatactgag

SEQ ID NO: 398468 - DNA, 25 bp, Homo sapien
aaatactgagccaatgaattcgttc

SEQ ID NO: 398469 - DNA, 25 bp, Homo sapien
gagccaatgaattcgttcagctatg

SEQ ID NO: 398470 - DNA, 25 bp, Homo sapien
gccaatgaattcgttcagctatgta

SEQ ID NO: 398471 - DNA, 25 bp, Homo sapien
gaattcgttcagctatgtaagatta

SEQ ID NO: 398472 - DNA, 25 bp, Homo sapien
ttcgttcagctatgtaagattaaag

SEQ ID NO: 398473 - DNA, 25 bp, Homo sapien
gaagagcattaaaagttgagatata

SEQ ID NO: 398474 - DNA, 25 bp, Homo sapien
atgggagagggcctgttaattttca

SEQ ID NO: 398475 - DNA, 25 bp, Homo sapien
tgggagagggcctgttaattttcag

SEQ ID NO: 398476 - DNA, 25 bp, Homo sapien
tcttttaagttacagaacagtatat

SEQ ID NO: 398477 - DNA, 25 bp, Homo sapien
tgtgtcatcatctcccaggaatgga

SEQ ID NO: 398478 - DNA, 25 bp, Homo sapien
gtgtcatcatctcccaggaatggag

SEQ ID NO: 398479 - DNA, 25 bp, Homo sapien
gtcatcatctcccaggaatggagtg

SEQ ID NO: 398480 - DNA, 25 bp, Homo sapien
tcatcatctcccaggaatggagtgg

SEQ ID NO: 398481 - DNA, 25 bp, Homo sapien
catcatctcccaggaatggagtggt

SEQ ID NO: 398482 - DNA, 25 bp, Homo sapien
atcatctcccaggaatggagtggtg

SEQ ID NO: 398483 - DNA, 25 bp, Homo sapien
tcatctcccaggaatggagtggtgg

SEQ ID NO: 398484 - DNA, 25 bp, Homo sapien
catctcccaggaatggagtggtggc

SEQ ID NO: 398485 - DNA, 25 bp, Homo sapien
atctcccaggaatggagtggtggca

SEQ ID NO: 398486 - DNA, 25 bp, Homo sapien
tctcccaggaatggagtggtggcat

SEQ ID NO: 398487 - DNA, 25 bp, Homo sapien
atggagtggtggcatcagtgatgta

SEQ ID NO: 398488 - DNA, 25 bp, Homo sapien
aagttctagtcttgtttctccttct

SEQ ID NO: 398489 - DNA, 25 bp, Homo sapien
ataagtattctggtccgagggttca

SEQ ID NO: 398490 - DNA, 25 bp, Homo sapien
tccgagggttcagttcctttagtca

SEQ ID NO: 398491 - DNA, 25 bp, Homo sapien
gttcctttagtcaagatgtcacaag

SEQ ID NO: 398492 - DNA, 25 bp, Homo sapien
aactaccaaaggctcaggagttgtc

SEQ ID NO: 398493 - DNA, 25 bp, Homo sapien
aaggctcaggagttgtccactttgt

SEQ ID NO: 398494 - DNA, 25 bp, Homo sapien
ggagttgtccactttgttgaaatcc

SEQ ID NO: 398495 - DNA, 25 bp, Homo sapien
gagaagtctcactaacagatgtatt

SEQ ID NO: 398496 - DNA, 25 bp, Homo sapien
ccttccccaaattacagtcagcatt

SEQ ID NO: 398497 - DNA, 25 bp, Homo sapien
taaagctgtttatggcttgccatca

SEQ ID NO: 398498 - DNA, 25 bp, Homo sapien
tgtttatggcttgccatcagcatta

SEQ ID NO: 398499 - DNA, 25 bp, Homo sapien
gggaagcatgcttttatttaaacag

SEQ ID NO: 398500 - DNA, 25 bp, Homo sapien
atactagcaaagatactgacccctt

SEQ ID NO: 398501 - DNA, 25 bp, Homo sapien
tagcaaagatactgacccctttagg

SEQ ID NO: 398502 - DNA, 25 bp, Homo sapien
ttttccccatcttccagagattttt

SEQ ID NO: 398503 - DNA, 25 bp, Homo sapien
tttttcctgctttggctacatatcc

SEQ ID NO: 398504 - DNA, 25 bp, Homo sapien
tcctgctttggctacatatccatca

SEQ ID NO: 398505 - DNA, 25 bp, Homo sapien
gctttggctacatatccatcattgt

SEQ ID NO: 398506 - DNA, 25 bp, Homo sapien
ggctacatatccatcattgtttatt

SEQ ID NO: 398507 - DNA, 25 bp, Homo sapien
gaaactataatccagatacttcttt

SEQ ID NO: 398508 - DNA, 25 bp, Homo sapien
atacttctttttcatggattcccga

SEQ ID NO: 398509 - DNA, 25 bp, Homo sapien
tttttcatggattcccgagatcacc

SEQ ID NO: 398510 - DNA, 25 bp, Homo sapien
atctcttgagctaaggaggttaaga

SEQ ID NO: 398511 - DNA, 25 bp, Homo sapien
tctcttgagctaaggaggttaagac

SEQ ID NO: 398512 - DNA, 25 bp, Homo sapien
ctcttgagctaaggaggttaagacc

SEQ ID NO: 398513 - DNA, 25 bp, Homo sapien
ttagctgggcgtagtagttcctgcc

SEQ ID NO: 398514 - DNA, 25 bp, Homo sapien
tagctgggcgtagtagttcctgcct

SEQ ID NO: 398515 - DNA, 25 bp, Homo sapien
agctgggcgtagtagttcctgcctg

SEQ ID NO: 398516 - DNA, 25 bp, Homo sapien
ctgggcgtagtagttcctgcctgta

SEQ ID NO: 398517 - DNA, 25 bp, Homo sapien
tgggcgtagtagttcctgcctgtag

SEQ ID NO: 398518 - DNA, 25 bp, Homo sapien
gcgtagtagttcctgcctgtagtcc

SEQ ID NO: 398519 - DNA, 25 bp, Homo sapien
cgtagtagttcctgcctgtagtcct

SEQ ID NO: 398520 - DNA, 25 bp, Homo sapien
tagtagttcctgcctgtagtcctag

SEQ ID NO: 398521 - DNA, 25 bp, Homo sapien
aagaagtccttgtatcttcatatga

SEQ ID NO: 398522 - DNA, 25 bp, Homo sapien
agtccttgtatcttcatatgaacag

SEQ ID NO: 398523 - DNA, 25 bp, Homo sapien
tttggagtgggtatcagctattggt

SEQ ID NO: 398524 - DNA, 25 bp, Homo sapien
ggagtgggtatcagctattggtact

SEQ ID NO: 398525 - DNA, 25 bp, Homo sapien
gtgggtatcagctattggtactggt

SEQ ID NO: 398526 - DNA, 25 bp, Homo sapien
ggtatcagctattggtactggtggt

SEQ ID NO: 398527 - DNA, 25 bp, Homo sapien
tcagctattggtactggtggtgata

SEQ ID NO: 398528 - DNA, 25 bp, Homo sapien
gctattggtactggtggtgatacat

SEQ ID NO: 398529 - DNA, 25 bp, Homo sapien
attggtactggtggtgatacatact

SEQ ID NO: 398530 - DNA, 25 bp, Homo sapien
tactggtggtgatacatactatgca

SEQ ID NO: 398531 - DNA, 25 bp, Homo sapien
gtggtgatacatactatgcagactc

SEQ ID NO: 398532 - DNA, 25 bp, Homo sapien
acgtacaccagtgtggtagtgattg

SEQ ID NO: 398533 - DNA, 25 bp, Homo sapien
accagtgtggtagtgattgtcaatt

SEQ ID NO: 398534 - DNA, 25 bp, Homo sapien
attattgtggagctttactaatcca

SEQ ID NO: 398535 - DNA, 25 bp, Homo sapien
ggagctttactaatccatttaattt

SEQ ID NO: 398536 - DNA, 25 bp, Homo sapien
gagtatatacatgagaatgctttgt

SEQ ID NO: 398537 - DNA, 25 bp, Homo sapien
aatgctttgtatgtgaatgaccctc

SEQ ID NO: 398538 - DNA, 25 bp, Homo sapien
gtgaatgaccctcacatgtgtcata

SEQ ID NO: 398539 - DNA, 25 bp, Homo sapien
gaccctcacatgtgtcatagtgaaa

SEQ ID NO: 398540 - DNA, 25 bp, Homo sapien
aaattccttggtagaaaatgaccat

SEQ ID NO: 398541 - DNA, 25 bp, Homo sapien
agaaaatgaccattgcacctatctc

SEQ ID NO: 398542 - DNA, 25 bp, Homo sapien
atctcagttctcctcattttaactc

SEQ ID NO: 398543 - DNA, 25 bp, Homo sapien
gtttaagcctatttgtaacaatcca

SEQ ID NO: 398544 - DNA, 25 bp, Homo sapien
aaaattctatctgtgggcattctaa

SEQ ID NO: 398545 - DNA, 25 bp, Homo sapien
gtgggcattctaaataagctgtttt

SEQ ID NO: 398546 - DNA, 25 bp, Homo sapien
taaatcacttaatcctaacacccaa

SEQ ID NO: 398547 - DNA, 25 bp, Homo sapien
tcctaacacccaaagacagccaatg

SEQ ID NO: 398548 - DNA, 25 bp, Homo sapien
agacagccaatgttaatcttctcgc

SEQ ID NO: 398549 - DNA, 25 bp, Homo sapien
ccaatgttaatcttctcgcttctga

SEQ ID NO: 398550 - DNA, 25 bp, Homo sapien
taatcttctcgcttctgaatttata

SEQ ID NO: 398551 - DNA, 25 bp, Homo sapien
ctcgcttctgaatttatatatgtat

SEQ ID NO: 398552 - DNA, 25 bp, Homo sapien
tataatttgtgtactgatcctacaa

SEQ ID NO: 398553 - DNA, 25 bp, Homo sapien
gtgtactgatcctacaaagtatagt

SEQ ID NO: 398554 - DNA, 25 bp, Homo sapien
ttctccagctcaggttcggcctaag

SEQ ID NO: 398555 - DNA, 25 bp, Homo sapien
caggttcggcctaagcctcagggtt

SEQ ID NO: 398556 - DNA, 25 bp, Homo sapien
tgttcagaggcagagacaggctcaa

SEQ ID NO: 398557 - DNA, 25 bp, Homo sapien
acaggctcaaggtctttggctttta

SEQ ID NO: 398558 - DNA, 25 bp, Homo sapien
tggcttttaggttctgttgatgggt

SEQ ID NO: 398559 - DNA, 25 bp, Homo sapien
gatgggtgagttccagatatagctt

SEQ ID NO: 398560 - DNA, 25 bp, Homo sapien
aggtgttacaaaatccaggccagac

SEQ ID NO: 398561 - DNA, 25 bp, Homo sapien
atccaggccagaccaatctaaactt

SEQ ID NO: 398562 - DNA, 25 bp, Homo sapien
atctaaactttaatctcatacccgg

SEQ ID NO: 398563 - DNA, 25 bp, Homo sapien
tttaatctcatacccggttcctaga

SEQ ID NO: 398564 - DNA, 25 bp, Homo sapien
atacccggttcctagatgagtccct

SEQ ID NO: 398565 - DNA, 25 bp, Homo sapien
gctccctttcctgtgcgcagggtgg

SEQ ID NO: 398566 - DNA, 25 bp, Homo sapien
ctccctttcctgtgcgcagggtggg

SEQ ID NO: 398567 - DNA, 25 bp, Homo sapien
tccctttcctgtgcgcagggtggga

SEQ ID NO: 398568 - DNA, 25 bp, Homo sapien
gtttgtggagtttccatggtgatgt

SEQ ID NO: 398569 - DNA, 25 bp, Homo sapien
tttgtggagtttccatggtgatgtt

SEQ ID NO: 398570 - DNA, 25 bp, Homo sapien
ttgtggagtttccatggtgatgttt

SEQ ID NO: 398571 - DNA, 25 bp, Homo sapien
tgtggagtttccatggtgatgttta

SEQ ID NO: 398572 - DNA, 25 bp, Homo sapien
gtggagtttccatggtgatgtttac

SEQ ID NO: 398573 - DNA, 25 bp, Homo sapien
tggagtttccatggtgatgtttaca

SEQ ID NO: 398574 - DNA, 25 bp, Homo sapien
ccggccggggtgtgctcagggaatg

SEQ ID NO: 398575 - DNA, 25 bp, Homo sapien
ccggggtgtgctcagggaatgtgga

SEQ ID NO: 398576 - DNA, 25 bp, Homo sapien
ccctggaggcaggttttgtgatccc

SEQ ID NO: 398577 - DNA, 25 bp, Homo sapien
gaggcaggttttgtgatcccttttt

SEQ ID NO: 398578 - DNA, 25 bp, Homo sapien
agttgtcactcacccagatcacact

SEQ ID NO: 398579 - DNA, 25 bp, Homo sapien
agatcacactctcatctgctgatgg

SEQ ID NO: 398580 - DNA, 25 bp, Homo sapien
cacactctcatctgctgatgggagg

SEQ ID NO: 398581 - DNA, 25 bp, Homo sapien
agtatttgatgggatgtgtgagccc

SEQ ID NO: 398582 - DNA, 25 bp, Homo sapien
ggccgtctcccttgggacacatcag

SEQ ID NO: 398583 - DNA, 25 bp, Homo sapien
ccttgggacacatcagctcattaaa

SEQ ID NO: 398584 - DNA, 25 bp, Homo sapien
agctcattaaatttgccagcccctg

SEQ ID NO: 398585 - DNA, 25 bp, Homo sapien
tttgccttttacaatgcacccattg

SEQ ID NO: 398586 - DNA, 25 bp, Homo sapien
gcacccattgcaagttaattaactg

SEQ ID NO: 398587 - DNA, 25 bp, Homo sapien
gagcccacaggagtaaaagcccagt

SEQ ID NO: 398588 - DNA, 25 bp, Homo sapien
aaaagcccagtttgctaggaggtct

SEQ ID NO: 398589 - DNA, 25 bp, Homo sapien
gtttgctaggaggtctgcttactga

SEQ ID NO: 398590 - DNA, 25 bp, Homo sapien
taggaggtctgcttactgaaaacaa

SEQ ID NO: 398591 - DNA, 25 bp, Homo sapien
gggcacatttgctcagtcactaatc

SEQ ID NO: 398592 - DNA, 25 bp, Homo sapien
ttgctcagtcactaatccagcttga

SEQ ID NO: 398593 - DNA, 25 bp, Homo sapien
taatccagcttgagtgtccgtgtgt

SEQ ID NO: 398594 - DNA, 25 bp, Homo sapien
gtgtccgtgtgttctgcatgtgcag

SEQ ID NO: 398595 - DNA, 25 bp, Homo sapien
ggtcattctagtgcccggtgtgttg

SEQ ID NO: 398596 - DNA, 25 bp, Homo sapien
gtgtgttggcatcatctttttgctc

SEQ ID NO: 398597 - DNA, 25 bp, Homo sapien
gcatcatctttttgctctagccctt

SEQ ID NO: 398598 - DNA, 25 bp, Homo sapien
gcagagaaagatccttcaagccttt

SEQ ID NO: 398599 - DNA, 25 bp, Homo sapien
cctttcctggcatgcgtgactccaa

SEQ ID NO: 398600 - DNA, 25 bp, Homo sapien
ttcctggcatgcgtgactccaacat

SEQ ID NO: 398601 - DNA, 25 bp, Homo sapien
tcctggcatgcgtgactccaacatc

SEQ ID NO: 398602 - DNA, 25 bp, Homo sapien
ctggcatgcgtgactccaacatcag

SEQ ID NO: 398603 - DNA, 25 bp, Homo sapien
tggcatgcgtgactccaacatcagc

SEQ ID NO: 398604 - DNA, 25 bp, Homo sapien
ggcatgcgtgactccaacatcagca

SEQ ID NO: 398605 - DNA, 25 bp, Homo sapien
atgcgtgactccaacatcagcaaga

SEQ ID NO: 398606 - DNA, 25 bp, Homo sapien
gcgtgactccaacatcagcaagata

SEQ ID NO: 398607 - DNA, 25 bp, Homo sapien
gtgactccaacatcagcaagatatt

SEQ ID NO: 398608 - DNA, 25 bp, Homo sapien
cagcaagatattgggatctcactgg

SEQ ID NO: 398609 - DNA, 25 bp, Homo sapien
agcttttggcagttttgattcatta

SEQ ID NO: 398610 - DNA, 25 bp, Homo sapien
ggcagttttgattcattaccaatta

SEQ ID NO: 398611 - DNA, 25 bp, Homo sapien
aaatatgaatattgtcccttcccat

SEQ ID NO: 398612 - DNA, 25 bp, Homo sapien
atattgtcccttcccattatgaaaa

SEQ ID NO: 398613 - DNA, 25 bp, Homo sapien
tataaaggttgatgactatatgctt

SEQ ID NO: 398614 - DNA, 25 bp, Homo sapien
aaattaatctgatgaatgctgttaa

SEQ ID NO: 398615 - DNA, 25 bp, Homo sapien
gattatttgggctgggtcccagaag

SEQ ID NO: 398616 - DNA, 25 bp, Homo sapien
gggctgggtcccagaaggctcccaa

SEQ ID NO: 398617 - DNA, 25 bp, Homo sapien
agaaggctcccaatttccctaagca

SEQ ID NO: 398618 - DNA, 25 bp, Homo sapien
atttccctaagcaaccttgatcatc

SEQ ID NO: 398619 - DNA, 25 bp, Homo sapien
agcaaccttgatcatcaatgttgtc

SEQ ID NO: 398620 - DNA, 25 bp, Homo sapien
agtccgaggaggtgtcggtgtgcca

SEQ ID NO: 398621 - DNA, 25 bp, Homo sapien
aggaggtgtcggtgtgccaggagat

SEQ ID NO: 398622 - DNA, 25 bp, Homo sapien
aggtgtcggtgtgccaggagatgct

SEQ ID NO: 398623 - DNA, 25 bp, Homo sapien
tgtcggtgtgccaggagatgctgca

SEQ ID NO: 398624 - DNA, 25 bp, Homo sapien
aggagctgcgccacgccgtttcttg

SEQ ID NO: 398625 - DNA, 25 bp, Homo sapien
ggagctgcgccacgccgtttcttgc

SEQ ID NO: 398626 - DNA, 25 bp, Homo sapien
cacgccgtttcttgccgcaagacgt

SEQ ID NO: 398627 - DNA, 25 bp, Homo sapien
gtttcttgccgcaagacgtcgcgtt

SEQ ID NO: 398628 - DNA, 25 bp, Homo sapien
tttcttgccgcaagacgtcgcgttc

SEQ ID NO: 398629 - DNA, 25 bp, Homo sapien
gcaagacgtcgcgttcccgccggcg

SEQ ID NO: 398630 - DNA, 25 bp, Homo sapien
gggccctgctgtcactgcgcgcggt

SEQ ID NO: 398631 - DNA, 25 bp, Homo sapien
ctgatggaacatgtctgcaacttgg

SEQ ID NO: 398632 - DNA, 25 bp, Homo sapien
gataatggtggtacacacatgcacg

SEQ ID NO: 398633 - DNA, 25 bp, Homo sapien
acatgcacgcatgcatgctgcagaa

SEQ ID NO: 398634 - DNA, 25 bp, Homo sapien
gcagaaatgtgaagtgttaccaatt

SEQ ID NO: 398635 - DNA, 25 bp, Homo sapien
gtgttaccaattgaacaatctggat

SEQ ID NO: 398636 - DNA, 25 bp, Homo sapien
tgaacaatctggatgaagtgaacat

SEQ ID NO: 398637 - DNA, 25 bp, Homo sapien
agtgaacatgggagttctttgtact

SEQ ID NO: 398638 - DNA, 25 bp, Homo sapien
ttggcctttttttgacaatgtggta

SEQ ID NO: 398639 - DNA, 25 bp, Homo sapien
gacaatgtggtagttatgtacaaga

SEQ ID NO: 398640 - DNA, 25 bp, Homo sapien
tatgtacaagagtgtctttgttttt

SEQ ID NO: 398641 - DNA, 25 bp, Homo sapien
ctggagtgtttaggactgatggaac

SEQ ID NO: 398642 - DNA, 25 bp, Homo sapien
gaaccaatgtaactctggcctcaat

SEQ ID NO: 398643 - DNA, 25 bp, Homo sapien
tgtaactctggcctcaatcatattc

SEQ ID NO: 398644 - DNA, 25 bp, Homo sapien
tggcctcaatcatattcctctggga

SEQ ID NO: 398645 - DNA, 25 bp, Homo sapien
tcatattcctctgggatttctaaac

SEQ ID NO: 398646 - DNA, 25 bp, Homo sapien
attgatggagtctgcattccaccac

SEQ ID NO: 398647 - DNA, 25 bp, Homo sapien
accacatatccacccttgagaagta

SEQ ID NO: 398648 - DNA, 25 bp, Homo sapien
atatccacccttgagaagtatgtca

SEQ ID NO: 398649 - DNA, 25 bp, Homo sapien
gtatgtcaaaagactgcagactata

SEQ ID NO: 398650 - DNA, 25 bp, Homo sapien
taaatcagctagtgaaagacctcag

SEQ ID NO: 398651 - DNA, 25 bp, Homo sapien
tcccatcatccggatttctggttgt

SEQ ID NO: 398652 - DNA, 25 bp, Homo sapien
caactgttcgaattttatgaaccaa

SEQ ID NO: 398653 - DNA, 25 bp, Homo sapien
accagtagctgtaccagtgggcaat

SEQ ID NO: 398654 - DNA, 25 bp, Homo sapien
cagtagctgtaccagtgggcaataa

SEQ ID NO: 398655 - DNA, 25 bp, Homo sapien
gtagctgtaccagtgggcaataacc

SEQ ID NO: 398656 - DNA, 25 bp, Homo sapien
agctgtaccagtgggcaataacctt

SEQ ID NO: 398657 - DNA, 25 bp, Homo sapien
tgtaccagtgggcaataacctttaa

SEQ ID NO: 398658 - DNA, 25 bp, Homo sapien
actttgcaatttgttgctgcaaaat

SEQ ID NO: 398659 - DNA, 25 bp, Homo sapien
aaacttgatggaatcacaactgtca

SEQ ID NO: 398660 - DNA, 25 bp, Homo sapien
gatggaatcacaactgtcaatataa

SEQ ID NO: 398661 - DNA, 25 bp, Homo sapien
ggaatcacaactgtcaatataattt

SEQ ID NO: 398662 - DNA, 25 bp, Homo sapien
aactctgcagagtctagctatccgc

SEQ ID NO: 398663 - DNA, 25 bp, Homo sapien
agagtctagctatccgccaacaggg

SEQ ID NO: 398664 - DNA, 25 bp, Homo sapien
aatacctatatttgctcaacagtgg

SEQ ID NO: 398665 - DNA, 25 bp, Homo sapien
tgctcaacagtggtaaacacacaat

SEQ ID NO: 398666 - DNA, 25 bp, Homo sapien
cacaattaaaacttgtcctcattaa

SEQ ID NO: 398667 - DNA, 25 bp, Homo sapien
ggacttttgtacactataatttgaa

SEQ ID NO: 398668 - DNA, 25 bp, Homo sapien
gtataacgttccatttttggctata

SEQ ID NO: 398669 - DNA, 25 bp, Homo sapien
acgttccatttttggctatattttg

SEQ ID NO: 398670 - DNA, 25 bp, Homo sapien
aaaacatttttggtgtaatcagtat

SEQ ID NO: 398671 - DNA, 25 bp, Homo sapien
ggtgtaatcagtatgactatcacat

SEQ ID NO: 398672 - DNA, 25 bp, Homo sapien
aatcagtatgactatcacatatgtc

SEQ ID NO: 398673 - DNA, 25 bp, Homo sapien
gtaacatacagggatgcatcttaat

SEQ ID NO: 398674 - DNA, 25 bp, Homo sapien
gggatgcatcttaatacctatattt

SEQ ID NO: 398675 - DNA, 25 bp, Homo sapien
ttagacttaactactcatgtgtatg

SEQ ID NO: 398676 - DNA, 25 bp, Homo sapien
taactactcatgtgtatggcgccga

SEQ ID NO: 398677 - DNA, 25 bp, Homo sapien
actactcatgtgtatggcgccgata

SEQ ID NO: 398678 - DNA, 25 bp, Homo sapien
ctactcatgtgtatggcgccgataa

SEQ ID NO: 398679 - DNA, 25 bp, Homo sapien
actcatgtgtatggcgccgataaat

SEQ ID NO: 398680 - DNA, 25 bp, Homo sapien
gtgtatggcgccgataaatctcgag

SEQ ID NO: 398681 - DNA, 25 bp, Homo sapien
gtatggcgccgataaatctcgagga

SEQ ID NO: 398682 - DNA, 25 bp, Homo sapien
atggcgccgataaatctcgaggact

SEQ ID NO: 398683 - DNA, 25 bp, Homo sapien
ggcgccgataaatctcgaggactgt

SEQ ID NO: 398684 - DNA, 25 bp, Homo sapien
cgccgataaatctcgaggactgtat

SEQ ID NO: 398685 - DNA, 25 bp, Homo sapien
aatctcgaggactgtatattgtgac

SEQ ID NO: 398686 - DNA, 25 bp, Homo sapien
ggtccttcctacttcctctattcta

SEQ ID NO: 398687 - DNA, 25 bp, Homo sapien
tatttttactctggctcaatccctc

SEQ ID NO: 398688 - DNA, 25 bp, Homo sapien
ttttactctggctcaatccctccat

SEQ ID NO: 398689 - DNA, 25 bp, Homo sapien
atctaacactgacccagacctctgc

SEQ ID NO: 398690 - DNA, 25 bp, Homo sapien
agacctctgcagtggccaggatcct

SEQ ID NO: 398691 - DNA, 25 bp, Homo sapien
tgcttctctcggctctaccatggac

SEQ ID NO: 398692 - DNA, 25 bp, Homo sapien
ttctctcggctctaccatggacagc

SEQ ID NO: 398693 - DNA, 25 bp, Homo sapien
accactggggtgcttttcaaatgca

SEQ ID NO: 398694 - DNA, 25 bp, Homo sapien
cttttcaaatgcaaacctgggctcc

SEQ ID NO: 398695 - DNA, 25 bp, Homo sapien
tttcaaatgcaaacctgggctccag

SEQ ID NO: 398696 - DNA, 25 bp, Homo sapien
tccctccttacctggaggagccacg

SEQ ID NO: 398697 - DNA, 25 bp, Homo sapien
gtacagaggttagtaagatttcttt

SEQ ID NO: 398698 - DNA, 25 bp, Homo sapien
gttacgtcaagtagcttattaagaa

SEQ ID NO: 398699 - DNA, 25 bp, Homo sapien
atgacttaaattcttaattctcagt

SEQ ID NO: 398700 - DNA, 25 bp, Homo sapien
attctcagttgatacaaaggcttat

SEQ ID NO: 398701 - DNA, 25 bp, Homo sapien
aaggcttataatcatgtgttttaaa

SEQ ID NO: 398702 - DNA, 25 bp, Homo sapien
attttgatttcattttcgttccttg

SEQ ID NO: 398703 - DNA, 25 bp, Homo sapien
gatttcattttcgttccttgaaggt

SEQ ID NO: 398704 - DNA, 25 bp, Homo sapien
aaaattaatacactgcagctttgcc

SEQ ID NO: 398705 - DNA, 25 bp, Homo sapien
ctgcagctttgccaaggtctgtgat

SEQ ID NO: 398706 - DNA, 25 bp, Homo sapien
gctttgccaaggtctgtgatatggt

SEQ ID NO: 398707 - DNA, 25 bp, Homo sapien
ggtctgtgatatggttgtaaccttt

SEQ ID NO: 398708 - DNA, 25 bp, Homo sapien
tgaggagactctgtaatttaaagca

SEQ ID NO: 398709 - DNA, 25 bp, Homo sapien
aaacttccatgttaacatggcctac

SEQ ID NO: 398710 - DNA, 25 bp, Homo sapien
tgttaacatggcctactctcactcc

SEQ ID NO: 398711 - DNA, 25 bp, Homo sapien
tactctcactcctttctaaacgagc

SEQ ID NO: 398712 - DNA, 25 bp, Homo sapien
tcctttctaaacgagccacttttgg

SEQ ID NO: 398713 - DNA, 25 bp, Homo sapien
aaacgagccacttttggcgtcagaa

SEQ ID NO: 398714 - DNA, 25 bp, Homo sapien
gccacttttggcgtcagaagttgac

SEQ ID NO: 398715 - DNA, 25 bp, Homo sapien
tttggcgtcagaagttgactggaga

SEQ ID NO: 398716 - DNA, 25 bp, Homo sapien
gagagagataaacaaactcccagtc

SEQ ID NO: 398717 - DNA, 25 bp, Homo sapien
gataaacaaactcccagtcaaagcc

SEQ ID NO: 398718 - DNA, 25 bp, Homo sapien
gtcaaagcccctaaagcgacagtgc

SEQ ID NO: 398719 - DNA, 25 bp, Homo sapien
ggacagcaaacgaccctccgggatc

SEQ ID NO: 398720 - DNA, 25 bp, Homo sapien
gaccctccgggatccctgagagatt

SEQ ID NO: 398721 - DNA, 25 bp, Homo sapien
agctcagggacaatggccaccttga

SEQ ID NO: 398722 - DNA, 25 bp, Homo sapien
ctcagggacaatggccaccttgact

SEQ ID NO: 398723 - DNA, 25 bp, Homo sapien
agggacaatggccaccttgactatc

SEQ ID NO: 398724 - DNA, 25 bp, Homo sapien
ggacaatggccaccttgactatcag

SEQ ID NO: 398725 - DNA, 25 bp, Homo sapien
acaatggccaccttgactatcagtg

SEQ ID NO: 398726 - DNA, 25 bp, Homo sapien
aatggccaccttgactatcagtggg

SEQ ID NO: 398727 - DNA, 25 bp, Homo sapien
caccttgactatcagtggggcccag

SEQ ID NO: 398728 - DNA, 25 bp, Homo sapien
aggacaaacggccaggatcacctgc

SEQ ID NO: 398729 - DNA, 25 bp, Homo sapien
tgctctggagatgcattgccaaaaa

SEQ ID NO: 398730 - DNA, 25 bp, Homo sapien
ttgttcttcggaatctgctttgcct

SEQ ID NO: 398731 - DNA, 25 bp, Homo sapien
tcggaatctgctttgcctccgtcag

SEQ ID NO: 398732 - DNA, 25 bp, Homo sapien
ggcagtaccctttcaactcatccta

SEQ ID NO: 398733 - DNA, 25 bp, Homo sapien
ttcaactcatcctaagcttcgtgta

SEQ ID NO: 398734 - DNA, 25 bp, Homo sapien
aagcttcgtgtagattactttagta

SEQ ID NO: 398735 - DNA, 25 bp, Homo sapien
aaacataaagcctttcctctcgatg

SEQ ID NO: 398736 - DNA, 25 bp, Homo sapien
aagcctttcctctcgatggaaatca

SEQ ID NO: 398737 - DNA, 25 bp, Homo sapien
ctctcgatggaaatcaaagcttacc

SEQ ID NO: 398738 - DNA, 25 bp, Homo sapien
aaagcttaccatgtgagcactcgaa

SEQ ID NO: 398739 - DNA, 25 bp, Homo sapien
tgtgagcactcgaacttctaagttg

SEQ ID NO: 398740 - DNA, 25 bp, Homo sapien
gaacttctaagttgtgacaggaata

SEQ ID NO: 398741 - DNA, 25 bp, Homo sapien
ggaaggccccacagcatcttccata

SEQ ID NO: 398742 - DNA, 25 bp, Homo sapien
gaaggccccacagcatcttccatac

SEQ ID NO: 398743 - DNA, 25 bp, Homo sapien
aaggccccacagcatcttccatact

SEQ ID NO: 398744 - DNA, 25 bp, Homo sapien
aggccccacagcatcttccatacta

SEQ ID NO: 398745 - DNA, 25 bp, Homo sapien
agcatcttccatactatgaccccta

SEQ ID NO: 398746 - DNA, 25 bp, Homo sapien
atcttccatactatgacccctacta

SEQ ID NO: 398747 - DNA, 25 bp, Homo sapien
tcttccatactatgacccctactac

SEQ ID NO: 398748 - DNA, 25 bp, Homo sapien
cttccatactatgacccctactact

SEQ ID NO: 398749 - DNA, 25 bp, Homo sapien
ttccatactatgacccctactactc

SEQ ID NO: 398750 - DNA, 25 bp, Homo sapien
atactatgacccctactactccagg

SEQ ID NO: 398751 - DNA, 25 bp, Homo sapien
atcaagaatcagtagaggaaagtat

SEQ ID NO: 398752 - DNA, 25 bp, Homo sapien
agttagaatatacccattgccctat

SEQ ID NO: 398753 - DNA, 25 bp, Homo sapien
atacccattgccctatattctcgat

SEQ ID NO: 398754 - DNA, 25 bp, Homo sapien
tattctcgatgatagttacccctgc

SEQ ID NO: 398755 - DNA, 25 bp, Homo sapien
gtagaccaaaatataacagttccca

SEQ ID NO: 398756 - DNA, 25 bp, Homo sapien
acaccctcttagtaagcccatgcag

SEQ ID NO: 398757 - DNA, 25 bp, Homo sapien
agcccatgcagacatcattaatcaa

SEQ ID NO: 398758 - DNA, 25 bp, Homo sapien
aagtaggtaggtcattctccgctaa

SEQ ID NO: 398759 - DNA, 25 bp, Homo sapien
cattctccgctaatcctagctgaaa

SEQ ID NO: 398760 - DNA, 25 bp, Homo sapien
aagtcttaaaattagccacaacatc

SEQ ID NO: 398761 - DNA, 25 bp, Homo sapien
taacagttcccattcttgaagtaac

SEQ ID NO: 398762 - DNA, 25 bp, Homo sapien
agttgttcaactttgcttattgtga

SEQ ID NO: 398763 - DNA, 25 bp, Homo sapien
gtttgtggagtttccatggtgatgt

SEQ ID NO: 398764 - DNA, 25 bp, Homo sapien
tttgtggagtttccatggtgatgtt

SEQ ID NO: 398765 - DNA, 25 bp, Homo sapien
ttgtggagtttccatggtgatgttt

SEQ ID NO: 398766 - DNA, 25 bp, Homo sapien
tgtggagtttccatggtgatgttta

SEQ ID NO: 398767 - DNA, 25 bp, Homo sapien
gtggagtttccatggtgatgtttac

SEQ ID NO: 398768 - DNA, 25 bp, Homo sapien
tggagtttccatggtgatgtttaca

SEQ ID NO: 398769 - DNA, 25 bp, Homo sapien
ccggccggggtgtgctcagggaatg

SEQ ID NO: 398770 - DNA, 25 bp, Homo sapien
cggccggggtgtgctcagggaatgt

SEQ ID NO: 398771 - DNA, 25 bp, Homo sapien
ggccggggtgtgctcagggaatgtg

SEQ ID NO: 398772 - DNA, 25 bp, Homo sapien
gccggggtgtgctcagggaatgtgg

SEQ ID NO: 398773 - DNA, 25 bp, Homo sapien
ccggggtgtgctcagggaatgtgga

SEQ ID NO: 398774 - DNA, 25 bp, Homo sapien
cccaggatgtggaccccaggcctga

SEQ ID NO: 398775 - DNA, 25 bp, Homo sapien
tggtgctgcatctgcaatgaggatg

SEQ ID NO: 398776 - DNA, 25 bp, Homo sapien
tgcatctgcaatgaggatgccaccc

SEQ ID NO: 398777 - DNA, 25 bp, Homo sapien
ttctgtgcccgctgcttccgagagg

SEQ ID NO: 398778 - DNA, 25 bp, Homo sapien
ttccgagagggccatgatgcctttg

SEQ ID NO: 398779 - DNA, 25 bp, Homo sapien
gatgcctttgagcttaaagagcacc

SEQ ID NO: 398780 - DNA, 25 bp, Homo sapien
aaagagcaccagacatctgcctact

SEQ ID NO: 398781 - DNA, 25 bp, Homo sapien
agagcaccagacatctgcctactct

SEQ ID NO: 398782 - DNA, 25 bp, Homo sapien
ccacgtgcaggccaagagcactgaa

SEQ ID NO: 398783 - DNA, 25 bp, Homo sapien
caagagcactgaagacaccctggtc

SEQ ID NO: 398784 - DNA, 25 bp, Homo sapien
tggtcctcccggaagggcagtccca

SEQ ID NO: 398785 - DNA, 25 bp, Homo sapien
caacatgaagatgatatgaggccgg

SEQ ID NO: 398786 - DNA, 25 bp, Homo sapien
aacatgaagatgatatgaggccggg

SEQ ID NO: 398787 - DNA, 25 bp, Homo sapien
atgaagatgatatgaggccggggcg

SEQ ID NO: 398788 - DNA, 25 bp, Homo sapien
gaagatgatatgaggccggggcggg

SEQ ID NO: 398789 - DNA, 25 bp, Homo sapien
ctacccttctacacacgttctcttt

SEQ ID NO: 398790 - DNA, 25 bp, Homo sapien
tacccttctacacacgttctctttc

SEQ ID NO: 398791 - DNA, 25 bp, Homo sapien
acccttctacacacgttctctttct

SEQ ID NO: 398792 - DNA, 25 bp, Homo sapien
cccttctacacacgttctctttctc

SEQ ID NO: 398793 - DNA, 25 bp, Homo sapien
ttctacacacgttctctttctccct

SEQ ID NO: 398794 - DNA, 25 bp, Homo sapien
tctacacacgttctctttctccctc

SEQ ID NO: 398795 - DNA, 25 bp, Homo sapien
cgacgcgccccgcaagttcaacatg

SEQ ID NO: 398796 - DNA, 25 bp, Homo sapien
ggcccgccagcttgatgaggaccac

SEQ ID NO: 398797 - DNA, 25 bp, Homo sapien
atgaggaccacagcctactggaagc

SEQ ID NO: 398798 - DNA, 25 bp, Homo sapien
acagcctactggaagctctgaccct

SEQ ID NO: 398799 - DNA, 25 bp, Homo sapien
gcaagcgcagcgtgcccatggccaa

SEQ ID NO: 398800 - DNA, 25 bp, Homo sapien
aagcccaagttcagcatctctccag

SEQ ID NO: 398801 - DNA, 25 bp, Homo sapien
atctctccagattccctgtcctgag

SEQ ID NO: 398802 - DNA, 25 bp, Homo sapien
acacgcgtgtgtacacacggaccat

SEQ ID NO: 398803 - DNA, 25 bp, Homo sapien
tgtgtacacacggaccatgtggtat

SEQ ID NO: 398804 - DNA, 25 bp, Homo sapien
ggaccatgtggtatgtagcccggcc

SEQ ID NO: 398805 - DNA, 25 bp, Homo sapien
ccatgtggtatgtagcccggccagg

SEQ ID NO: 398806 - DNA, 25 bp, Homo sapien
ctgctcatccagggtgttacaggca

SEQ ID NO: 398807 - DNA, 25 bp, Homo sapien
cccaaggaggaggaccatcgagcta

SEQ ID NO: 398808 - DNA, 25 bp, Homo sapien
ggaccatcgagctaaaggtttgggc

SEQ ID NO: 398809 - DNA, 25 bp, Homo sapien
aaaggtttgggcatggagaacattg

SEQ ID NO: 398810 - DNA, 25 bp, Homo sapien
gaacattggtggcatttttatcgtg

SEQ ID NO: 398811 - DNA, 25 bp, Homo sapien
gtggcatttttatcgtgctcatctg

SEQ ID NO: 398812 - DNA, 25 bp, Homo sapien
tcatctgtggcctcatcattgctgt

SEQ ID NO: 398813 - DNA, 25 bp, Homo sapien
gtcttcgtggcggtcatggaattca

SEQ ID NO: 398814 - DNA, 25 bp, Homo sapien
tcgtggcggtcatggaattcatatg

SEQ ID NO: 398815 - DNA, 25 bp, Homo sapien
atatggtccacacggaggtcagctg

SEQ ID NO: 398816 - DNA, 25 bp, Homo sapien
ggtccacacggaggtcagctgagtc

SEQ ID NO: 398817 - DNA, 25 bp, Homo sapien
cacacggaggtcagctgagtccgag

SEQ ID NO: 398818 - DNA, 25 bp, Homo sapien
ttctccctcttgcatgctttacctg

SEQ ID NO: 398819 - DNA, 25 bp, Homo sapien
atgccaatgtgccaagtctcccttg

SEQ ID NO: 398820 - DNA, 25 bp, Homo sapien
gccaatgtgccaagtctcccttggg

SEQ ID NO: 398821 - DNA, 25 bp, Homo sapien
ctgagtctgggtgttcccattgggt

SEQ ID NO: 398822 - DNA, 25 bp, Homo sapien
gttcccattgggttgggccaggcaa

SEQ ID NO: 398823 - DNA, 25 bp, Homo sapien
ttcccattgggttgggccaggcaag

SEQ ID NO: 398824 - DNA, 25 bp, Homo sapien
aggcaaggcctctggtgcccgctgc

SEQ ID NO: 398825 - DNA, 25 bp, Homo sapien
tgggctctgctaggcctgtgctgag

SEQ ID NO: 398826 - DNA, 25 bp, Homo sapien
gctgagcaacagctgttattgtcat

SEQ ID NO: 398827 - DNA, 25 bp, Homo sapien
gaccctgtcatcctgctttatttat

SEQ ID NO: 398828 - DNA, 25 bp, Homo sapien
cctgtcatcctgctttatttatttg

SEQ ID NO: 398829 - DNA, 25 bp, Homo sapien
tgcagatacagtgagttcttggcgt

SEQ ID NO: 398830 - DNA, 25 bp, Homo sapien
atacagtgagttcttggcgttgtct

SEQ ID NO: 398831 - DNA, 25 bp, Homo sapien
ggcccttcacagagtctacatagta

SEQ ID NO: 398832 - DNA, 25 bp, Homo sapien
gagtctacatagtatttctcacttt

SEQ ID NO: 398833 - DNA, 25 bp, Homo sapien
atagtatttctcactttcatcttgc

SEQ ID NO: 398834 - DNA, 25 bp, Homo sapien
tcttgctttatgttggccacccact

SEQ ID NO: 398835 - DNA, 25 bp, Homo sapien
ggcggacccagctcatccaattgct

SEQ ID NO: 398836 - DNA, 25 bp, Homo sapien
acccagctcatccaattgctactaa

SEQ ID NO: 398837 - DNA, 25 bp, Homo sapien
caattgctactaaaggtgaatccag

SEQ ID NO: 398838 - DNA, 25 bp, Homo sapien
caggcactgctatacccggggtcgg

SEQ ID NO: 398839 - DNA, 25 bp, Homo sapien
ccggggtcggctctcgcacagtaat

SEQ ID NO: 398840 - DNA, 25 bp, Homo sapien
agagccaggattctcacctgaaccc

SEQ ID NO: 398841 - DNA, 25 bp, Homo sapien
ctgtggacccatggctgagggctta

SEQ ID NO: 398842 - DNA, 25 bp, Homo sapien
tggacccatggctgagggcttagct

SEQ ID NO: 398843 - DNA, 25 bp, Homo sapien
acccatggctgagggcttagctgct

SEQ ID NO: 398844 - DNA, 25 bp, Homo sapien
gggacacgaagtggccctgtctcca

SEQ ID NO: 398845 - DNA, 25 bp, Homo sapien
cacgaagtggccctgtctccaaggg

SEQ ID NO: 398846 - DNA, 25 bp, Homo sapien
aagggctctgacaagacacatgact

SEQ ID NO: 398847 - DNA, 25 bp, Homo sapien
gctctgacaagacacatgacttcat

SEQ ID NO: 398848 - DNA, 25 bp, Homo sapien
tgaaccccataatctccatgctgct

SEQ ID NO: 398849 - DNA, 25 bp, Homo sapien
cataatctccatgctgctgatgtgc

SEQ ID NO: 398850 - DNA, 25 bp, Homo sapien
gctgctgatgtgcaaagtctcagac

SEQ ID NO: 398851 - DNA, 25 bp, Homo sapien
gtgttcttttgacaatagcgtcatt

SEQ ID NO: 398852 - DNA, 25 bp, Homo sapien
tagcgtcattgccaagtgcacatca

SEQ ID NO: 398853 - DNA, 25 bp, Homo sapien
agtgcacatcagtgagcctcttgaa

SEQ ID NO: 398854 - DNA, 25 bp, Homo sapien
agcctcttgaatctgtttagtctcc

SEQ ID NO: 398855 - DNA, 25 bp, Homo sapien
agagaggctgagatcattcaggagt

SEQ ID NO: 398856 - DNA, 25 bp, Homo sapien
caagcatggagcttcttgcacaaat

SEQ ID NO: 398857 - DNA, 25 bp, Homo sapien
ggagcttcttgcacaaattctgggt

SEQ ID NO: 398858 - DNA, 25 bp, Homo sapien
tgctgatccagtagccctggaggtt

SEQ ID NO: 398859 - DNA, 25 bp, Homo sapien
ggagagccagaggtgccagccttcc

SEQ ID NO: 398860 - DNA, 25 bp, Homo sapien
agccttcctgaagggccagaaaatt

SEQ ID NO: 398861 - DNA, 25 bp, Homo sapien
aagggccagaaaatttagcctggat

SEQ ID NO: 398862 - DNA, 25 bp, Homo sapien
gcctttttcagaataagtgccaatc

SEQ ID NO: 398863 - DNA, 25 bp, Homo sapien
agtgccaatcactgatgttgtaaat

SEQ ID NO: 398864 - DNA, 25 bp, Homo sapien
ggtgccttaactttatatgcttccc

SEQ ID NO: 398865 - DNA, 25 bp, Homo sapien
aactttatatgcttccctggcactt

SEQ ID NO: 398866 - DNA, 25 bp, Homo sapien
cctggcacttcgtttctgatttttt

SEQ ID NO: 398867 - DNA, 25 bp, Homo sapien
gtacatagttttcactcacttgcag

SEQ ID NO: 398868 - DNA, 25 bp, Homo sapien
tttcactcacttgcagcttactaaa

SEQ ID NO: 398869 - DNA, 25 bp, Homo sapien
gtacatgtactaatgtttttcccac

SEQ ID NO: 398870 - DNA, 25 bp, Homo sapien
aaaaaatcctttacttctgatgtat

SEQ ID NO: 398871 - DNA, 25 bp, Homo sapien
aatagttaagcctaatacctgaata

SEQ ID NO: 398872 - DNA, 25 bp, Homo sapien
tacctgaataagactcaccaatgtg

SEQ ID NO: 398873 - DNA, 25 bp, Homo sapien
agatggagtccaccttttgtataac

SEQ ID NO: 398874 - DNA, 25 bp, Homo sapien
gagtccaccttttgtataacccatg

SEQ ID NO: 398875 - DNA, 25 bp, Homo sapien
ccaccttttgtataacccatgctga

SEQ ID NO: 398876 - DNA, 25 bp, Homo sapien
aacccatgctgaagttttcaggtaa

SEQ ID NO: 398877 - DNA, 25 bp, Homo sapien
tcaggtaagtgattcagtgtccctt

SEQ ID NO: 398878 - DNA, 25 bp, Homo sapien
aagtgattcagtgtcccttgtctaa

SEQ ID NO: 398879 - DNA, 25 bp, Homo sapien
tgtcccttgtctaatcatccatgaa

SEQ ID NO: 398880 - DNA, 25 bp, Homo sapien
atcatccatgaaaaaaggccttctg

SEQ ID NO: 398881 - DNA, 25 bp, Homo sapien
tggaatttggtaccaggtgctagaa

SEQ ID NO: 398882 - DNA, 25 bp, Homo sapien
tgctagaaagaatcctacttcccct

SEQ ID NO: 398883 - DNA, 25 bp, Homo sapien
cttcccctcttatctacagggaaat

SEQ ID NO: 398884 - DNA, 25 bp, Homo sapien
tggcctggcggtgtcaaacgcattc

SEQ ID NO: 398885 - DNA, 25 bp, Homo sapien
aaacgcattctggtctcatcttttt

SEQ ID NO: 398886 - DNA, 25 bp, Homo sapien
ggtctcatctttttagaaacccgtg

SEQ ID NO: 398887 - DNA, 25 bp, Homo sapien
aaacccgtggatgctcaaggaattt

SEQ ID NO: 398888 - DNA, 25 bp, Homo sapien
ggaatttccggataacgtgatcccg

SEQ ID NO: 398889 - DNA, 25 bp, Homo sapien
aacgtgatcccggatgcgcttgact

SEQ ID NO: 398890 - DNA, 25 bp, Homo sapien
tgcgcttgactgacttacacggaac

SEQ ID NO: 398891 - DNA, 25 bp, Homo sapien
gagcaaagcgcaaagcagtccctgc

SEQ ID NO: 398892 - DNA, 25 bp, Homo sapien
aagcagtccctgctaaggacttagt

SEQ ID NO: 398893 - DNA, 25 bp, Homo sapien
aggacttagtttatgccctcaagcg

SEQ ID NO: 398894 - DNA, 25 bp, Homo sapien
ggcgccaccgcaagttgctgtgcaa

SEQ ID NO: 398895 - DNA, 25 bp, Homo sapien
agccctgtgaatacagtgaatgtaa

SEQ ID NO: 398896 - DNA, 25 bp, Homo sapien
tgaatgtaaggatcccttcagtcac

SEQ ID NO: 398897 - DNA, 25 bp, Homo sapien
actcattgcagaaggattcatacca

SEQ ID NO: 398898 - DNA, 25 bp, Homo sapien
ggaaggcattccatcaacatcagag

SEQ ID NO: 398899 - DNA, 25 bp, Homo sapien
gaaggcattccatcaacatcagaga

SEQ ID NO: 398900 - DNA, 25 bp, Homo sapien
ggccagagcagaaatcttactatct

SEQ ID NO: 398901 - DNA, 25 bp, Homo sapien
gaaatcttactatctgagaatcata

SEQ ID NO: 398902 - DNA, 25 bp, Homo sapien
gtgaccaggttgtcacttgcttgtc

SEQ ID NO: 398903 - DNA, 25 bp, Homo sapien
ggttgtcacttgcttgtcctataaa

SEQ ID NO: 398904 - DNA, 25 bp, Homo sapien
tgtcacttgcttgtcctataaagag

SEQ ID NO: 398905 - DNA, 25 bp, Homo sapien
acttgcttgtcctataaagagccat

SEQ ID NO: 398906 - DNA, 25 bp, Homo sapien
caacccagacgccatgagagccatg

SEQ ID NO: 398907 - DNA, 25 bp, Homo sapien
acagagagtccctggatggtcacca

SEQ ID NO: 398908 - DNA, 25 bp, Homo sapien
agtccctggatggtcaccagatccg

SEQ ID NO: 398909 - DNA, 25 bp, Homo sapien
ggatggtcaccagatccgcgtggat

SEQ ID NO: 398910 - DNA, 25 bp, Homo sapien
tggtcaccagatccgcgtggatcat

SEQ ID NO: 398911 - DNA, 25 bp, Homo sapien
tagatatggatatggacagtccaga

SEQ ID NO: 398912 - DNA, 25 bp, Homo sapien
gactataatgtcagaagccagggta

SEQ ID NO: 398913 - DNA, 25 bp, Homo sapien
ataatgtcagaagccagggtagtta

SEQ ID NO: 398914 - DNA, 25 bp, Homo sapien
gaagccagggtagttatgactgcta

SEQ ID NO: 398915 - DNA, 25 bp, Homo sapien
agggtagttatgactgctactcaga

SEQ ID NO: 398916 - DNA, 25 bp, Homo sapien
agttatgactgctactcagaaggaa

SEQ ID NO: 398917 - DNA, 25 bp, Homo sapien
ctattaaaatttgtagtttgggctg

SEQ ID NO: 398918 - DNA, 25 bp, Homo sapien
tattaaaatttgtagtttgggctgg

SEQ ID NO: 398919 - DNA, 25 bp, Homo sapien
taaaatttgtagtttgggctgggtg

SEQ ID NO: 398920 - DNA, 25 bp, Homo sapien
aaatttgtagtttgggctgggtgct

SEQ ID NO: 398921 - DNA, 25 bp, Homo sapien
aatttgtagtttgggctgggtgctg

SEQ ID NO: 398922 - DNA, 25 bp, Homo sapien
ccatgcctgtagtacctgctattgg

SEQ ID NO: 398923 - DNA, 25 bp, Homo sapien
gcctgtagtacctgctattggtaag

SEQ ID NO: 398924 - DNA, 25 bp, Homo sapien
gtagtacctgctattggtaaggctg

SEQ ID NO: 398925 - DNA, 25 bp, Homo sapien
tagtacctgctattggtaaggctga

SEQ ID NO: 398926 - DNA, 25 bp, Homo sapien
agtacctgctattggtaaggctgag

SEQ ID NO: 398927 - DNA, 25 bp, Homo sapien
tacctgctattggtaaggctgaggt

SEQ ID NO: 398928 - DNA, 25 bp, Homo sapien
gggcccgtgttctggcttggaggga

SEQ ID NO: 398929 - DNA, 25 bp, Homo sapien
gactttggccaaaggtagcgtgacc

SEQ ID NO: 398930 - DNA, 25 bp, Homo sapien
aaaggtagcgtgacctttcccagat

SEQ ID NO: 398931 - DNA, 25 bp, Homo sapien
gtgacctttcccagatgccggatac

SEQ ID NO: 398932 - DNA, 25 bp, Homo sapien
tgggtgcctgcacactggcatcctg

SEQ ID NO: 398933 - DNA, 25 bp, Homo sapien
acactggcatcctgtggtccgagat

SEQ ID NO: 398934 - DNA, 25 bp, Homo sapien
atcctgtggtccgagatgcgctccg

SEQ ID NO: 398935 - DNA, 25 bp, Homo sapien
tccgagatgcgctccgcctgatggg

SEQ ID NO: 398936 - DNA, 25 bp, Homo sapien
agttatgccgggagcatccatcttt

SEQ ID NO: 398937 - DNA, 25 bp, Homo sapien
ggagcatccatctttgccatgggtg

SEQ ID NO: 398938 - DNA, 25 bp, Homo sapien
ccatctttgccatgggtgcttgtgc

SEQ ID NO: 398939 - DNA, 25 bp, Homo sapien
ggcgctctgggagggcttttcccca

SEQ ID NO: 398940 - DNA, 25 bp, Homo sapien
ttttccccagcgtggttctgcatgg

SEQ ID NO: 398941 - DNA, 25 bp, Homo sapien
agcgtggttctgcatggtgacattt

SEQ ID NO: 398942 - DNA, 25 bp, Homo sapien
gcatggtgacatttgctccatattc

SEQ ID NO: 398943 - DNA, 25 bp, Homo sapien
aggacatgtgtatcaggacatctct

SEQ ID NO: 398944 - DNA, 25 bp, Homo sapien
gaagagagcctctagggacctttca

SEQ ID NO: 398945 - DNA, 25 bp, Homo sapien
agagagcctctagggacctttcagc

SEQ ID NO: 398946 - DNA, 25 bp, Homo sapien
aatatcacacacctcccttcagagt

SEQ ID NO: 398947 - DNA, 25 bp, Homo sapien
acctcccttcagagtctatgatgat

SEQ ID NO: 398948 - DNA, 25 bp, Homo sapien
tgatgatgtagcagagccagtccta

SEQ ID NO: 398949 - DNA, 25 bp, Homo sapien
tgatgtagcagagccagtcctacta

SEQ ID NO: 398950 - DNA, 25 bp, Homo sapien
agaagagcctgaacctcaacatctt

SEQ ID NO: 398951 - DNA, 25 bp, Homo sapien
gaacctcaacatcttcctgaagcaa

SEQ ID NO: 398952 - DNA, 25 bp, Homo sapien
gcaatttaagtgctccaacgaggag

SEQ ID NO: 398953 - DNA, 25 bp, Homo sapien
ccaacgaggaggtcgctgctatgat

SEQ ID NO: 398954 - DNA, 25 bp, Homo sapien
tcgctgctatgatccgggctggaga

SEQ ID NO: 398955 - DNA, 25 bp, Homo sapien
ctggagataccaccaagtttgatgt

SEQ ID NO: 398956 - DNA, 25 bp, Homo sapien
gtggaggttctcaaacaactcctta

SEQ ID NO: 398957 - DNA, 25 bp, Homo sapien
aagctccttcccgagaagcacgaga

SEQ ID NO: 398958 - DNA, 25 bp, Homo sapien
aaacctgcgggcattcacagaggag

SEQ ID NO: 398959 - DNA, 25 bp, Homo sapien
agcgagccaagctggccagcgccga

SEQ ID NO: 398960 - DNA, 25 bp, Homo sapien
gctaccagctgcgaatcgagtgcat

SEQ ID NO: 398961 - DNA, 25 bp, Homo sapien
atcagggtagtatcctgccttccct

SEQ ID NO: 398962 - DNA, 25 bp, Homo sapien
tgaccccacatggtctcagggcccc

SEQ ID NO: 398963 - DNA, 25 bp, Homo sapien
cactgatagcttcctccttctctgg

SEQ ID NO: 398964 - DNA, 25 bp, Homo sapien
cttctctggcacaaggggagcccca

SEQ ID NO: 398965 - DNA, 25 bp, Homo sapien
gggaaatgccactgcttttagcaaa

SEQ ID NO: 398966 - DNA, 25 bp, Homo sapien
ggaaatgccactgcttttagcaaaa

SEQ ID NO: 398967 - DNA, 25 bp, Homo sapien
cctcccagaattagccagcttgcct

SEQ ID NO: 398968 - DNA, 25 bp, Homo sapien
taagctgactaacaactgtcccctc

SEQ ID NO: 398969 - DNA, 25 bp, Homo sapien
aagctgactaacaactgtcccctca

SEQ ID NO: 398970 - DNA, 25 bp, Homo sapien
tatttccccagggtagagtgggcaa

SEQ ID NO: 398971 - DNA, 25 bp, Homo sapien
ggtagagtgggcaattctcaccttc

SEQ ID NO: 398972 - DNA, 25 bp, Homo sapien
ggcaaggttgaccagaacttctctc

SEQ ID NO: 398973 - DNA, 25 bp, Homo sapien
gggtactggctggagccccacattt

SEQ ID NO: 398974 - DNA, 25 bp, Homo sapien
gaggcctgagagtttagcacgatgt

SEQ ID NO: 398975 - DNA, 25 bp, Homo sapien
gtttagcacgatgtacttgtacttt

SEQ ID NO: 398976 - DNA, 25 bp, Homo sapien
gtacttgtactttttccagttgcag

SEQ ID NO: 398977 - DNA, 25 bp, Homo sapien
ttgtactttttccagttgcaggcct

SEQ ID NO: 398978 - DNA, 25 bp, Homo sapien
actttttccagttgcaggccttggg

SEQ ID NO: 398979 - DNA, 25 bp, Homo sapien
tggctggagccccacatttgaactg

SEQ ID NO: 398980 - DNA, 25 bp, Homo sapien
ggagccccacatttgaactgcacag

SEQ ID NO: 398981 - DNA, 25 bp, Homo sapien
gcagcagttggagagagcctgctct

SEQ ID NO: 398982 - DNA, 25 bp, Homo sapien
gggaccaggaatgggtccttcttca

SEQ ID NO: 398983 - DNA, 25 bp, Homo sapien
tttctagaggtaacaactgatgttg

SEQ ID NO: 398984 - DNA, 25 bp, Homo sapien
ccaaatttgaaagctccatctccga

SEQ ID NO: 398985 - DNA, 25 bp, Homo sapien
atttgaaagctccatctccgagaag

SEQ ID NO: 398986 - DNA, 25 bp, Homo sapien
ttgaaagctccatctccgagaagca

SEQ ID NO: 398987 - DNA, 25 bp, Homo sapien
gaaagctccatctccgagaagcaaa

SEQ ID NO: 398988 - DNA, 25 bp, Homo sapien
agctccatctccgagaagcaaattt

SEQ ID NO: 398989 - DNA, 25 bp, Homo sapien
catctccgagaagcaaattttacag

SEQ ID NO: 398990 - DNA, 25 bp, Homo sapien
cagccactccagatttgtattccaa

SEQ ID NO: 398991 - DNA, 25 bp, Homo sapien
agaggtaacaactgatgttggaact

SEQ ID NO: 398992 - DNA, 25 bp, Homo sapien
cagttccccagttgacgagaacaac

SEQ ID NO: 398993 - DNA, 25 bp, Homo sapien
gttccccagttgacgagaacaacta

SEQ ID NO: 398994 - DNA, 25 bp, Homo sapien
gagaccaatgacaacatcacgatat

SEQ ID NO: 398995 - DNA, 25 bp, Homo sapien
atcacgatatttaccaggatcttgg

SEQ ID NO: 398996 - DNA, 25 bp, Homo sapien
taccaggatcttggatgggctcttg

SEQ ID NO: 398997 - DNA, 25 bp, Homo sapien
gatgggctcttggatggctacgaca

SEQ ID NO: 398998 - DNA, 25 bp, Homo sapien
ttggatggctacgacaacagacttc

SEQ ID NO: 398999 - DNA, 25 bp, Homo sapien
acgacaacagacttcggcccgggct

SEQ ID NO: 399000 - DNA, 25 bp, Homo sapien
ccgggctgggagagcgcatcactca

SEQ ID NO: 399001 - DNA, 25 bp, Homo sapien
agcgcatcactcaggtgaggaccga

SEQ ID NO: 399002 - DNA, 25 bp, Homo sapien
tgaggaccgacatctacgtcaccag

SEQ ID NO: 399003 - DNA, 25 bp, Homo sapien
gcttcggcccggtgtccgacacgga

SEQ ID NO: 399004 - DNA, 25 bp, Homo sapien
caccatagacgtgtttttccgacaa

SEQ ID NO: 399005 - DNA, 25 bp, Homo sapien
attgttttcctgtcttattcaggcc

SEQ ID NO: 399006 - DNA, 25 bp, Homo sapien
ttcctgtcttattcaggccctgaat

SEQ ID NO: 399007 - DNA, 25 bp, Homo sapien
ccctgaatattttcctcctctttat

SEQ ID NO: 399008 - DNA, 25 bp, Homo sapien
ttcctcctctttatattagcaatta

SEQ ID NO: 399009 - DNA, 25 bp, Homo sapien
gcaattaccaacttgtattccttct

SEQ ID NO: 399010 - DNA, 25 bp, Homo sapien
accaacttgtattccttctaatcag

SEQ ID NO: 399011 - DNA, 25 bp, Homo sapien
cttgtattccttctaatcagtgttt

SEQ ID NO: 399012 - DNA, 25 bp, Homo sapien
attccttctaatcagtgttttttct

SEQ ID NO: 399013 - DNA, 25 bp, Homo sapien
ggtttggagactggcagaagaataa

SEQ ID NO: 399014 - DNA, 25 bp, Homo sapien
ttgagtcacaaggtattaatctgat

SEQ ID NO: 399015 - DNA, 25 bp, Homo sapien
ggtattaatctgatattagcaaatc

SEQ ID NO: 399016 - DNA, 25 bp, Homo sapien
gttgcagtaccacctgtatgggttc

SEQ ID NO: 399017 - DNA, 25 bp, Homo sapien
tgtatgggttccagatgcccagctc

SEQ ID NO: 399018 - DNA, 25 bp, Homo sapien
cagctcctttgcatgtggccaagag

SEQ ID NO: 399019 - DNA, 25 bp, Homo sapien
agagccttgcccgtatagattaact

SEQ ID NO: 399020 - DNA, 25 bp, Homo sapien
atagattaacttgcaccttttccca

SEQ ID NO: 399021 - DNA, 25 bp, Homo sapien
cacccctcggagaagatcatctttc

SEQ ID NO: 399022 - DNA, 25 bp, Homo sapien
gggtcagtgggttccgtctcttgtt

SEQ ID NO: 399023 - DNA, 25 bp, Homo sapien
gttccgtctcttgttcactcttttg

SEQ ID NO: 399024 - DNA, 25 bp, Homo sapien
ttgtgcttctgggtctgggaagact

SEQ ID NO: 399025 - DNA, 25 bp, Homo sapien
ggaagactgtgtaagcccctgcgga

SEQ ID NO: 399026 - DNA, 25 bp, Homo sapien
aagcccctgcggaacttcctgggtg

SEQ ID NO: 399027 - DNA, 25 bp, Homo sapien
tgagtttgagtcctggtattaccac

SEQ ID NO: 399028 - DNA, 25 bp, Homo sapien
tttgagtcctggtattaccactcgt

SEQ ID NO: 399029 - DNA, 25 bp, Homo sapien
ttcagtggttaggaagttaacttct

SEQ ID NO: 399030 - DNA, 25 bp, Homo sapien
acagctgactgtatacagggttact

SEQ ID NO: 399031 - DNA, 25 bp, Homo sapien
ctgaagacagacaaacctaagtttg

SEQ ID NO: 399032 - DNA, 25 bp, Homo sapien
aagtttgaatcatggttcacccctt

SEQ ID NO: 399033 - DNA, 25 bp, Homo sapien
tgaatcatggttcaccccttagtgg

SEQ ID NO: 399034 - DNA, 25 bp, Homo sapien
ggttcaccccttagtggctttgtgg

SEQ ID NO: 399035 - DNA, 25 bp, Homo sapien
aggtgatgaagatctcactgactta

SEQ ID NO: 399036 - DNA, 25 bp, Homo sapien
ctcactgacttagtgttgatggctt

SEQ ID NO: 399037 - DNA, 25 bp, Homo sapien
gtgttgatggcttgagtttgagtcc

SEQ ID NO: 399038 - DNA, 25 bp, Homo sapien
gcattaaactgagaagaaccactga

SEQ ID NO: 399039 - DNA, 25 bp, Homo sapien
aagattctgtggcaggtgccgcatt

SEQ ID NO: 399040 - DNA, 25 bp, Homo sapien
tggcaggtgccgcatttcatccagc

SEQ ID NO: 399041 - DNA, 25 bp, Homo sapien
atttcatccagctcactccgtgcta

SEQ ID NO: 399042 - DNA, 25 bp, Homo sapien
gaagaaccactgaggaaagcatgcc

SEQ ID NO: 399043 - DNA, 25 bp, Homo sapien
tcactccgtgctagttcctaagaca

SEQ ID NO: 399044 - DNA, 25 bp, Homo sapien
tccgtgctagttcctaagacatctt

SEQ ID NO: 399045 - DNA, 25 bp, Homo sapien
gtgctagttcctaagacatcttaat

SEQ ID NO: 399046 - DNA, 25 bp, Homo sapien
gaaagcatgccacagtctttcccaa

SEQ ID NO: 399047 - DNA, 25 bp, Homo sapien
gcatgccacagtctttcccaaaatc

SEQ ID NO: 399048 - DNA, 25 bp, Homo sapien
gaagttaactggtcagggaaaagat

SEQ ID NO: 399049 - DNA, 25 bp, Homo sapien
aagaatgacaagctgtaccttaaac

SEQ ID NO: 399050 - DNA, 25 bp, Homo sapien
tgacaagctgtaccttaaaccaaaa

SEQ ID NO: 399051 - DNA, 25 bp, Homo sapien
cacttcgtaatctcatccaattgca

SEQ ID NO: 399052 - DNA, 25 bp, Homo sapien
cgtaatctcatccaattgcaaaaag

SEQ ID NO: 399053 - DNA, 25 bp, Homo sapien
gagttattagccaaccaggtattcc

SEQ ID NO: 399054 - DNA, 25 bp, Homo sapien
agccaaccaggtattcccagtagtg

SEQ ID NO: 399055 - DNA, 25 bp, Homo sapien
attcccagtagtgacagtggatata

SEQ ID NO: 399056 - DNA, 25 bp, Homo sapien
ataactgtgtagtcattcacctctg

SEQ ID NO: 399057 - DNA, 25 bp, Homo sapien
tgtagtcattcacctctgcttatat

SEQ ID NO: 399058 - DNA, 25 bp, Homo sapien
agtcattcacctctgcttatatgaa

SEQ ID NO: 399059 - DNA, 25 bp, Homo sapien
tcacctctgcttatatgaatacttt

SEQ ID NO: 399060 - DNA, 25 bp, Homo sapien
taaatcatgttgttaccaatttgtt

SEQ ID NO: 399061 - DNA, 25 bp, Homo sapien
caatttgtttggaaggccctggttg

SEQ ID NO: 399062 - DNA, 25 bp, Homo sapien
gaaggccctggttgagaagagtttt

SEQ ID NO: 399063 - DNA, 25 bp, Homo sapien
accaatgtctactgttttgctccag

SEQ ID NO: 399064 - DNA, 25 bp, Homo sapien
tttgctccagctagtgcttacagtt

SEQ ID NO: 399065 - DNA, 25 bp, Homo sapien
cttacagtttcattcgagccctgag

SEQ ID NO: 399066 - DNA, 25 bp, Homo sapien
agtttcattcgagccctgagtatgt

SEQ ID NO: 399067 - DNA, 25 bp, Homo sapien
agtatgtgccctgctgttactctct

SEQ ID NO: 399068 - DNA, 25 bp, Homo sapien
tctctttggtagttgaacgttgaat

SEQ ID NO: 399069 - DNA, 25 bp, Homo sapien
gctagtgtttgaatatgctctcttg

SEQ ID NO: 399070 - DNA, 25 bp, Homo sapien
gaatatgctctcttgttgctctaat

SEQ ID NO: 399071 - DNA, 25 bp, Homo sapien
ttatttattgcatgcgtcgcttcca

SEQ ID NO: 399072 - DNA, 25 bp, Homo sapien
tattgcatgcgtcgcttccacaggg

SEQ ID NO: 399073 - DNA, 25 bp, Homo sapien
gggcccctcaagagctgtgactcgg

SEQ ID NO: 399074 - DNA, 25 bp, Homo sapien
gctgtgactcgggagagctacctta

SEQ ID NO: 399075 - DNA, 25 bp, Homo sapien
actcgggagagctaccttactttga

SEQ ID NO: 399076 - DNA, 25 bp, Homo sapien
gggagagctaccttactttgaccaa

SEQ ID NO: 399077 - DNA, 25 bp, Homo sapien
agagctaccttactttgaccaacag

SEQ ID NO: 399078 - DNA, 25 bp, Homo sapien
ttactttgaccaacagcctgcccag

SEQ ID NO: 399079 - DNA, 25 bp, Homo sapien
gcctgcccagtgtggatgtctctta

SEQ ID NO: 399080 - DNA, 25 bp, Homo sapien
gcccagtgtggatgtctcttacaga

SEQ ID NO: 399081 - DNA, 25 bp, Homo sapien
cttgtccactttgggctccagagtc

SEQ ID NO: 399082 - DNA, 25 bp, Homo sapien
ctgcggctggctgcttgtcttttat

SEQ ID NO: 399083 - DNA, 25 bp, Homo sapien
ctggctgcttgtcttttatctttat

SEQ ID NO: 399084 - DNA, 25 bp, Homo sapien
ggaccaattcttttgctttatagcc

SEQ ID NO: 399085 - DNA, 25 bp, Homo sapien
aaatctaagaggaggaactggtcaa

SEQ ID NO: 399086 - DNA, 25 bp, Homo sapien
ggaactggtcaaaaccatactccca

SEQ ID NO: 399087 - DNA, 25 bp, Homo sapien
tcccacttgtcttcttgtatgacat

SEQ ID NO: 399088 - DNA, 25 bp, Homo sapien
cttgtatgacatcacagcctttctt

SEQ ID NO: 399089 - DNA, 25 bp, Homo sapien
atcacagcctttcttacattgcatg

SEQ ID NO: 399090 - DNA, 25 bp, Homo sapien
acattgcatgtaatcacctgtccac

SEQ ID NO: 399091 - DNA, 25 bp, Homo sapien
ctcctggactatgagcgctttgagg

SEQ ID NO: 399092 - DNA, 25 bp, Homo sapien
tgagcgctttgagggcagagaccac

SEQ ID NO: 399093 - DNA, 25 bp, Homo sapien
taaatcatgttgttaccaatttgtt

SEQ ID NO: 399094 - DNA, 25 bp, Homo sapien
gaaggccctggttgagaagagtttt

SEQ ID NO: 399095 - DNA, 25 bp, Homo sapien
aggccctggttgagaagagttttag

SEQ ID NO: 399096 - DNA, 25 bp, Homo sapien
ttaagaagtactaagcaaacaagca

SEQ ID NO: 399097 - DNA, 25 bp, Homo sapien
gaagtactaagcaaacaagcaataa

SEQ ID NO: 399098 - DNA, 25 bp, Homo sapien
tgctagtgtttgaatatgctctctt

SEQ ID NO: 399099 - DNA, 25 bp, Homo sapien
tagtgtttgaatatgctctcttgtt

SEQ ID NO: 399100 - DNA, 25 bp, Homo sapien
gtgtttgaatatgctctcttgttgc

SEQ ID NO: 399101 - DNA, 25 bp, Homo sapien
gtttgaatatgctctcttgttgctc

SEQ ID NO: 399102 - DNA, 25 bp, Homo sapien
ttgaatatgctctcttgttgctcta

SEQ ID NO: 399103 - DNA, 25 bp, Homo sapien
gaatatgctctcttgttgctctaat

SEQ ID NO: 399104 - DNA, 25 bp, Homo sapien
tggtgaatgttcctaaaacccgccg

SEQ ID NO: 399105 - DNA, 25 bp, Homo sapien
ggtgggcagactaagccgattttct

SEQ ID NO: 399106 - DNA, 25 bp, Homo sapien
tgagtgtgttgagcccaactgcaga

SEQ ID NO: 399107 - DNA, 25 bp, Homo sapien
aactgcagatctaagcgaacactgg

SEQ ID NO: 399108 - DNA, 25 bp, Homo sapien
gcagatctaagcgaacactggctat

SEQ ID NO: 399109 - DNA, 25 bp, Homo sapien
gatctaagcgaacactggctattaa

SEQ ID NO: 399110 - DNA, 25 bp, Homo sapien
taagcgaacactggctattaaaaga

SEQ ID NO: 399111 - DNA, 25 bp, Homo sapien
agaagtgtggcaagcgccaacccca

SEQ ID NO: 399112 - DNA, 25 bp, Homo sapien
gacacagtacaagaaagtggctatg

SEQ ID NO: 399113 - DNA, 25 bp, Homo sapien
agaaagtggctatggtgcctgccca

SEQ ID NO: 399114 - DNA, 25 bp, Homo sapien
aaagtggctatggtgcctgcccagg

SEQ ID NO: 399115 - DNA, 25 bp, Homo sapien
aaacataagtgattgcagaattttg

SEQ ID NO: 399116 - DNA, 25 bp, Homo sapien
acataagtgattgcagaattttgtt

SEQ ID NO: 399117 - DNA, 25 bp, Homo sapien
gtgattgcagaattttgttcttctc

SEQ ID NO: 399118 - DNA, 25 bp, Homo sapien
gattgcagaattttgttcttctcat

SEQ ID NO: 399119 - DNA, 25 bp, Homo sapien
tgcagaattttgttcttctcataat

SEQ ID NO: 399120 - DNA, 25 bp, Homo sapien
gcagaattttgttcttctcataatt

SEQ ID NO: 399121 - DNA, 25 bp, Homo sapien
cagaattttgttcttctcataattt

SEQ ID NO: 399122 - DNA, 25 bp, Homo sapien
agaattttgttcttctcataatttc

SEQ ID NO: 399123 - DNA, 25 bp, Homo sapien
aattttgttcttctcataatttctg

SEQ ID NO: 399124 - DNA, 25 bp, Homo sapien
attttgttcttctcataatttctgg

SEQ ID NO: 399125 - DNA, 25 bp, Homo sapien
ttttgttcttctcataatttctggt

SEQ ID NO: 399126 - DNA, 25 bp, Homo sapien
tcagttggtcgctcctccgaatagg

SEQ ID NO: 399127 - DNA, 25 bp, Homo sapien
agttggtcgctcctccgaataggac

SEQ ID NO: 399128 - DNA, 25 bp, Homo sapien
gttggtcgctcctccgaataggaca

SEQ ID NO: 399129 - DNA, 25 bp, Homo sapien
ctgagggccgatcggtgttaccata

SEQ ID NO: 399130 - DNA, 25 bp, Homo sapien
gagggccgatcggtgttaccataga

SEQ ID NO: 399131 - DNA, 25 bp, Homo sapien
agggccgatcggtgttaccatagat

SEQ ID NO: 399132 - DNA, 25 bp, Homo sapien
gggccgatcggtgttaccatagatg

SEQ ID NO: 399133 - DNA, 25 bp, Homo sapien
ggccgatcggtgttaccatagatga

SEQ ID NO: 399134 - DNA, 25 bp, Homo sapien
ttggtcgctcctccgaataggacac

SEQ ID NO: 399135 - DNA, 25 bp, Homo sapien
gtgccgggaagttgccggtaccagt

SEQ ID NO: 399136 - DNA, 25 bp, Homo sapien
tcctccgaataggacaccactcagg

SEQ ID NO: 399137 - DNA, 25 bp, Homo sapien
gggctggaatgggtgacttttatag

SEQ ID NO: 399138 - DNA, 25 bp, Homo sapien
gtgacttttataggattcatagaag

SEQ ID NO: 399139 - DNA, 25 bp, Homo sapien
cttttataggattcatagaagtcat

SEQ ID NO: 399140 - DNA, 25 bp, Homo sapien
gtcatgaattctatagagacttcgt

SEQ ID NO: 399141 - DNA, 25 bp, Homo sapien
catgaattctatagagacttcgtga

SEQ ID NO: 399142 - DNA, 25 bp, Homo sapien
atgaattctatagagacttcgtgaa

SEQ ID NO: 399143 - DNA, 25 bp, Homo sapien
tgaattctatagagacttcgtgaag

SEQ ID NO: 399144 - DNA, 25 bp, Homo sapien
gaattctatagagacttcgtgaagg

SEQ ID NO: 399145 - DNA, 25 bp, Homo sapien
aattctatagagacttcgtgaaggg

SEQ ID NO: 399146 - DNA, 25 bp, Homo sapien
gagacttcgtgaagggccgatttat

SEQ ID NO: 399147 - DNA, 25 bp, Homo sapien
tcgtgaagggccgatttatcatctc

SEQ ID NO: 399148 - DNA, 25 bp, Homo sapien
tggcctctgggcacttgtgctgaga

SEQ ID NO: 399149 - DNA, 25 bp, Homo sapien
ggcacttgtgctgagactctgggac

SEQ ID NO: 399150 - DNA, 25 bp, Homo sapien
acttgtgctgagactctgggaccca

SEQ ID NO: 399151 - DNA, 25 bp, Homo sapien
gtgctgagactctgggacccaggca

SEQ ID NO: 399152 - DNA, 25 bp, Homo sapien
agctgccaccttgtcaccatgagag

SEQ ID NO: 399153 - DNA, 25 bp, Homo sapien
tgccaccttgtcaccatgagagaat

SEQ ID NO: 399154 - DNA, 25 bp, Homo sapien
caccttgtcaccatgagagaatttg

SEQ ID NO: 399155 - DNA, 25 bp, Homo sapien
gggagtgcttgcatgctagccagca

SEQ ID NO: 399156 - DNA, 25 bp, Homo sapien
gtgcttgcatgctagccagcaggct

SEQ ID NO: 399157 - DNA, 25 bp, Homo sapien
atgctagccagcaggctcctgtctg

SEQ ID NO: 399158 - DNA, 25 bp, Homo sapien
agcaggctcctgtctgggtgccacg

SEQ ID NO: 399159 - DNA, 25 bp, Homo sapien
gaagcaaggaaacagtggcgttaaa

SEQ ID NO: 399160 - DNA, 25 bp, Homo sapien
gcaaggaaacagtggcgttaaaaca

SEQ ID NO: 399161 - DNA, 25 bp, Homo sapien
tttaaggcaggtgtacacagggcag

SEQ ID NO: 399162 - DNA, 25 bp, Homo sapien
taaggcaggtgtacacagggcagct

SEQ ID NO: 399163 - DNA, 25 bp, Homo sapien
ttttataaacatagggcaagtgacc

SEQ ID NO: 399164 - DNA, 25 bp, Homo sapien
ggcaggtgtacacagggcagctgtc

SEQ ID NO: 399165 - DNA, 25 bp, Homo sapien
catagggcaagtgaccttgaagtct

SEQ ID NO: 399166 - DNA, 25 bp, Homo sapien
agggcaagtgaccttgaagtctttt

SEQ ID NO: 399167 - DNA, 25 bp, Homo sapien
ggcaagtgaccttgaagtctttttt

SEQ ID NO: 399168 - DNA, 25 bp, Homo sapien
tgcaggacaagccaaaaggagtaaa

SEQ ID NO: 399169 - DNA, 25 bp, Homo sapien
gccaaaaggagtaaacttatctgaa

SEQ ID NO: 399170 - DNA, 25 bp, Homo sapien
gagattcatctgatattggcctaga

SEQ ID NO: 399171 - DNA, 25 bp, Homo sapien
gatattggcctagaagtggccgtaa

SEQ ID NO: 399172 - DNA, 25 bp, Homo sapien
gtggccgtaagactacaaaccctca

SEQ ID NO: 399173 - DNA, 25 bp, Homo sapien
gtaagactacaaaccctcacttttg

SEQ ID NO: 399174 - DNA, 25 bp, Homo sapien
ctcacttttggatgtttctctcctt

SEQ ID NO: 399175 - DNA, 25 bp, Homo sapien
cttcacctcagcagggtatatttaa

SEQ ID NO: 399176 - DNA, 25 bp, Homo sapien
tttaaacatagcatgtggtctttcc

SEQ ID NO: 399177 - DNA, 25 bp, Homo sapien
gtgtatgttcccattggtggtataa

SEQ ID NO: 399178 - DNA, 25 bp, Homo sapien
tcccattggtggtataactttataa

SEQ ID NO: 399179 - DNA, 25 bp, Homo sapien
aactttataacttgcatgtctttaa

SEQ ID NO: 399180 - DNA, 25 bp, Homo sapien
gtgaagagatccttctgtaaaggtt

SEQ ID NO: 399181 - DNA, 25 bp, Homo sapien
ttctccctcttgcatgctttacctg

SEQ ID NO: 399182 - DNA, 25 bp, Homo sapien
tctccctcttgcatgctttacctgt

SEQ ID NO: 399183 - DNA, 25 bp, Homo sapien
atgccaatgtgccaagtctcccttg

SEQ ID NO: 399184 - DNA, 25 bp, Homo sapien
gccaatgtgccaagtctcccttggg

SEQ ID NO: 399185 - DNA, 25 bp, Homo sapien
gttcccattgggttgggccaggcaa

SEQ ID NO: 399186 - DNA, 25 bp, Homo sapien
ttcccattgggttgggccaggcaag

SEQ ID NO: 399187 - DNA, 25 bp, Homo sapien
aggcaaggcctctggtgcccgctgc

SEQ ID NO: 399188 - DNA, 25 bp, Homo sapien
tgggctctgctaggcctgtgctgag

SEQ ID NO: 399189 - DNA, 25 bp, Homo sapien
gaccctgtcatcctgctttatttat

SEQ ID NO: 399190 - DNA, 25 bp, Homo sapien
accctgtcatcctgctttatttatt

SEQ ID NO: 399191 - DNA, 25 bp, Homo sapien
cctgtcatcctgctttatttatttg

SEQ ID NO: 399192 - DNA, 25 bp, Homo sapien
acatataggtagatgtgatcttatc

SEQ ID NO: 399193 - DNA, 25 bp, Homo sapien
gatgtgatcttatctacatatggat

SEQ ID NO: 399194 - DNA, 25 bp, Homo sapien
gaataacttggctagtgatgttgtc

SEQ ID NO: 399195 - DNA, 25 bp, Homo sapien
cttggctagtgatgttgtcaccatt

SEQ ID NO: 399196 - DNA, 25 bp, Homo sapien
gctagtgatgttgtcaccattatca

SEQ ID NO: 399197 - DNA, 25 bp, Homo sapien
gatgttgtcaccattatcatcaaaa

SEQ ID NO: 399198 - DNA, 25 bp, Homo sapien
atcatcaaaattgccttcgttaagg

SEQ ID NO: 399199 - DNA, 25 bp, Homo sapien
ccttcgttaaggcatttgcttctct

SEQ ID NO: 399200 - DNA, 25 bp, Homo sapien
taaggcatttgcttctcttgactca

SEQ ID NO: 399201 - DNA, 25 bp, Homo sapien
aaggcatttgcttctcttgactcat

SEQ ID NO: 399202 - DNA, 25 bp, Homo sapien
ttctcttgactcatgtctagaaatg

SEQ ID NO: 399203 - DNA, 25 bp, Homo sapien
gaacttgccttgtcaatggaaagat

SEQ ID NO: 399204 - DNA, 25 bp, Homo sapien
tctcccgttgaagggtgaaaacaga

SEQ ID NO: 399205 - DNA, 25 bp, Homo sapien
ataaatctatatatacacgtatgta

SEQ ID NO: 399206 - DNA, 25 bp, Homo sapien
gtataataggtaaacagcctttgtt

SEQ ID NO: 399207 - DNA, 25 bp, Homo sapien
gcctttgttaagcaagattaatgtc

SEQ ID NO: 399208 - DNA, 25 bp, Homo sapien
caagattaatgtctatggaaagttc

SEQ ID NO: 399209 - DNA, 25 bp, Homo sapien
aaagttctggattattctgtaagcc

SEQ ID NO: 399210 - DNA, 25 bp, Homo sapien
tggattattctgtaagccagaggag

SEQ ID NO: 399211 - DNA, 25 bp, Homo sapien
cagacccttatgtgtatatctgtac

SEQ ID NO: 399212 - DNA, 25 bp, Homo sapien
atatgggatgtggtggcactttgct

SEQ ID NO: 399213 - DNA, 25 bp, Homo sapien
atgtgaacttgccttgtcaatggaa

SEQ ID NO: 399214 - DNA, 25 bp, Homo sapien
accagtagctgtaccagtgggcaat

SEQ ID NO: 399215 - DNA, 25 bp, Homo sapien
cagtagctgtaccagtgggcaataa

SEQ ID NO: 399216 - DNA, 25 bp, Homo sapien
gtagctgtaccagtgggcaataacc

SEQ ID NO: 399217 - DNA, 25 bp, Homo sapien
agctgtaccagtgggcaataacctt

SEQ ID NO: 399218 - DNA, 25 bp, Homo sapien
tgtaccagtgggcaataacctttaa

SEQ ID NO: 399219 - DNA, 25 bp, Homo sapien
actttgcaatttgttgctgcaaaat

SEQ ID NO: 399220 - DNA, 25 bp, Homo sapien
ttgcaatttgttgctgcaaaatggg

SEQ ID NO: 399221 - DNA, 25 bp, Homo sapien
aaacttgatggaatcacaactgtca

SEQ ID NO: 399222 - DNA, 25 bp, Homo sapien
cttgatggaatcacaactgtcaata

SEQ ID NO: 399223 - DNA, 25 bp, Homo sapien
gatggaatcacaactgtcaatataa

SEQ ID NO: 399224 - DNA, 25 bp, Homo sapien
ggaatcacaactgtcaatataattt

SEQ ID NO: 399225 - DNA, 25 bp, Homo sapien
aatgttaacctgctatttatattcc

SEQ ID NO: 399226 - DNA, 25 bp, Homo sapien
atttatattccagtgcccttcgcat

SEQ ID NO: 399227 - DNA, 25 bp, Homo sapien
tttatattccagtgcccttcgcatg

SEQ ID NO: 399228 - DNA, 25 bp, Homo sapien
ttatattccagtgcccttcgcatgg

SEQ ID NO: 399229 - DNA, 25 bp, Homo sapien
tatattccagtgcccttcgcatggc

SEQ ID NO: 399230 - DNA, 25 bp, Homo sapien
ttaaaagctattttccattcttcgg

SEQ ID NO: 399231 - DNA, 25 bp, Homo sapien
taaaagctattttccattcttcgga

SEQ ID NO: 399232 - DNA, 25 bp, Homo sapien
ttccattcttcggaaagtgttttgg

SEQ ID NO: 399233 - DNA, 25 bp, Homo sapien
tccattcttcggaaagtgttttggt

SEQ ID NO: 399234 - DNA, 25 bp, Homo sapien
agctatagagttcaatgttatttta

SEQ ID NO: 399235 - DNA, 25 bp, Homo sapien
aatggaatgatctatatcattgtaa

SEQ ID NO: 399236 - DNA, 25 bp, Homo sapien
atactagcaaagatactgacccctt

SEQ ID NO: 399237 - DNA, 25 bp, Homo sapien
tagcaaagatactgacccctttagg

SEQ ID NO: 399238 - DNA, 25 bp, Homo sapien
tttttcctgctttggctacatatcc

SEQ ID NO: 399239 - DNA, 25 bp, Homo sapien
ttcctgctttggctacatatccatc

SEQ ID NO: 399240 - DNA, 25 bp, Homo sapien
cctgctttggctacatatccatcat

SEQ ID NO: 399241 - DNA, 25 bp, Homo sapien
gctttggctacatatccatcattgt

SEQ ID NO: 399242 - DNA, 25 bp, Homo sapien
ggctacatatccatcattgtttatt

SEQ ID NO: 399243 - DNA, 25 bp, Homo sapien
tacatatccatcattgtttattttt

SEQ ID NO: 399244 - DNA, 25 bp, Homo sapien
gaaactataatccagatacttcttt

SEQ ID NO: 399245 - DNA, 25 bp, Homo sapien
ctttttcatggattcccgagatcac

SEQ ID NO: 399246 - DNA, 25 bp, Homo sapien
tttttcatggattcccgagatcacc

SEQ ID NO: 399247 - DNA, 25 bp, Homo sapien
aaatgctgcccctactggaatattg

SEQ ID NO: 399248 - DNA, 25 bp, Homo sapien
ctgcagtggcagttgtatgtaatga

SEQ ID NO: 399249 - DNA, 25 bp, Homo sapien
gaacatttaaagtctcatctaaaga

SEQ ID NO: 399250 - DNA, 25 bp, Homo sapien
atctaaagacatccacacactattt

SEQ ID NO: 399251 - DNA, 25 bp, Homo sapien
ccacacactatttatttatcttcct

SEQ ID NO: 399252 - DNA, 25 bp, Homo sapien
aaaaatgccatctgtcccatgagag

SEQ ID NO: 399253 - DNA, 25 bp, Homo sapien
gccatctgtcccatgagagtaagaa

SEQ ID NO: 399254 - DNA, 25 bp, Homo sapien
agagctggagattcacttgaggagc

SEQ ID NO: 399255 - DNA, 25 bp, Homo sapien
aggagctttgtgcatttttcctctc

SEQ ID NO: 399256 - DNA, 25 bp, Homo sapien
atttttcctctctctgaagtggaga

SEQ ID NO: 399257 - DNA, 25 bp, Homo sapien
gaagtggagatgttccacagaccag

SEQ ID NO: 399258 - DNA, 25 bp, Homo sapien
ctaccagggcctgtccaatgagcag

SEQ ID NO: 399259 - DNA, 25 bp, Homo sapien
atgagcaggtgctgaagttcgtcat

SEQ ID NO: 399260 - DNA, 25 bp, Homo sapien
caggtgctgaagttcgtcatggatg

SEQ ID NO: 399261 - DNA, 25 bp, Homo sapien
agctggagggctgtccccttcagct

SEQ ID NO: 399262 - DNA, 25 bp, Homo sapien
ctgcaggagctgatgagccgctgct

SEQ ID NO: 399263 - DNA, 25 bp, Homo sapien
tgatgagccgctgctggcagccgaa

SEQ ID NO: 399264 - DNA, 25 bp, Homo sapien
catctttcacacacattctggacag

SEQ ID NO: 399265 - DNA, 25 bp, Homo sapien
ctttcacacacattctggacagcat

SEQ ID NO: 399266 - DNA, 25 bp, Homo sapien
cacacacattctggacagcatacag

SEQ ID NO: 399267 - DNA, 25 bp, Homo sapien
tctccttctactacagcccggaatg

SEQ ID NO: 399268 - DNA, 25 bp, Homo sapien
tgcctaccaccgatgcagagcctga

SEQ ID NO: 399269 - DNA, 25 bp, Homo sapien
gcttggtaaagattttcagtttgcc

SEQ ID NO: 399270 - DNA, 25 bp, Homo sapien
aaaggacccagctgagagtaccatg

SEQ ID NO: 399271 - DNA, 25 bp, Homo sapien
gagtaccatgatattgcttagtcca

SEQ ID NO: 399272 - DNA, 25 bp, Homo sapien
attgcttagtccatttgaacccttg

SEQ ID NO: 399273 - DNA, 25 bp, Homo sapien
agtccatttgaacccttgcattcct

SEQ ID NO: 399274 - DNA, 25 bp, Homo sapien
gtattaaaactctacatctaggatt

SEQ ID NO: 399275 - DNA, 25 bp, Homo sapien
ctacatctaggatttcagcatttcc

SEQ ID NO: 399276 - DNA, 25 bp, Homo sapien
cagcatttcctgagtaagaccttta

SEQ ID NO: 399277 - DNA, 25 bp, Homo sapien
gagtaagacctttatatgccaaaag

SEQ ID NO: 399278 - DNA, 25 bp, Homo sapien
cacccacaagctccctttagaaagg

SEQ ID NO: 399279 - DNA, 25 bp, Homo sapien
ccctttagaaaggtcttgctattgt

SEQ ID NO: 399280 - DNA, 25 bp, Homo sapien
actatagtaactagatgcagtgtga

SEQ ID NO: 399281 - DNA, 25 bp, Homo sapien
caaacaaacaagtcagtggcttaaa

SEQ ID NO: 399282 - DNA, 25 bp, Homo sapien
ggcttaaatgtgattatggtcctgc

SEQ ID NO: 399283 - DNA, 25 bp, Homo sapien
gattatggtcctgcaaggtgattct

SEQ ID NO: 399284 - DNA, 25 bp, Homo sapien
atggtcctgcaaggtgattcttgct

SEQ ID NO: 399285 - DNA, 25 bp, Homo sapien
aggtgattcttgctaaaatatctaa

SEQ ID NO: 399286 - DNA, 25 bp, Homo sapien
tgtcaacagtggtgtgtcattttat

SEQ ID NO: 399287 - DNA, 25 bp, Homo sapien
cagtggtgtgtcattttatgtatgt

SEQ ID NO: 399288 - DNA, 25 bp, Homo sapien
ttatgtatgttcctaatgcttatgg

SEQ ID NO: 399289 - DNA, 25 bp, Homo sapien
tcctaatgcttatggaactcctcca

SEQ ID NO: 399290 - DNA, 25 bp, Homo sapien
tatggaactcctccaaaataaagtt

SEQ ID NO: 399291 - DNA, 25 bp, Homo sapien
gggctggaatgggtgacttttatag

SEQ ID NO: 399292 - DNA, 25 bp, Homo sapien
gtgacttttataggattcatagaag

SEQ ID NO: 399293 - DNA, 25 bp, Homo sapien
cttttataggattcatagaagtcat

SEQ ID NO: 399294 - DNA, 25 bp, Homo sapien
taggattcatagaagtcatgaattc

SEQ ID NO: 399295 - DNA, 25 bp, Homo sapien
gtcatgaattctatagagacttcgt

SEQ ID NO: 399296 - DNA, 25 bp, Homo sapien
tcatgaattctatagagacttcgtg

SEQ ID NO: 399297 - DNA, 25 bp, Homo sapien
catgaattctatagagacttcgtga

SEQ ID NO: 399298 - DNA, 25 bp, Homo sapien
atgaattctatagagacttcgtgaa

SEQ ID NO: 399299 - DNA, 25 bp, Homo sapien
tgaattctatagagacttcgtgaag

SEQ ID NO: 399300 - DNA, 25 bp, Homo sapien
gaattctatagagacttcgtgaagg

SEQ ID NO: 399301 - DNA, 25 bp, Homo sapien
aattctatagagacttcgtgaaggg

SEQ ID NO: 399302 - DNA, 25 bp, Homo sapien
tgctgctatttctttgactggtgga

SEQ ID NO: 399303 - DNA, 25 bp, Homo sapien
ctgctatttctttgactggtggaga

SEQ ID NO: 399304 - DNA, 25 bp, Homo sapien
tgactggtggagaaatcctgttggt

SEQ ID NO: 399305 - DNA, 25 bp, Homo sapien
tattgttttctttggcataagagcc

SEQ ID NO: 399306 - DNA, 25 bp, Homo sapien
gttttctttggcataagagccttca

SEQ ID NO: 399307 - DNA, 25 bp, Homo sapien
tggcataagagccttcaagccctat

SEQ ID NO: 399308 - DNA, 25 bp, Homo sapien
ataagagccttcaagccctatgaaa

SEQ ID NO: 399309 - DNA, 25 bp, Homo sapien
aagccctatgaaaaagattcaggtt

SEQ ID NO: 399310 - DNA, 25 bp, Homo sapien
gattcaggttaggaaactgtctctg

SEQ ID NO: 399311 - DNA, 25 bp, Homo sapien
ggttaggaaactgtctctgaaggct

SEQ ID NO: 399312 - DNA, 25 bp, Homo sapien
taggaaactgtctctgaaggctggg

SEQ ID NO: 399313 - DNA, 25 bp, Homo sapien
tcagcctcaggcttgatgtccatca

SEQ ID NO: 399314 - DNA, 25 bp, Homo sapien
tcaggcttgatgtccatcacacaat

SEQ ID NO: 399315 - DNA, 25 bp, Homo sapien
aacacaggagtctcgggcaccgggt

SEQ ID NO: 399316 - DNA, 25 bp, Homo sapien
caccgggtcgaggtccaggaagtca

SEQ ID NO: 399317 - DNA, 25 bp, Homo sapien
aggtccaggaagtcatcctcgatct

SEQ ID NO: 399318 - DNA, 25 bp, Homo sapien
aggaagtcatcctcgatcttctcct

SEQ ID NO: 399319 - DNA, 25 bp, Homo sapien
tcctccatccactctgagtaggtga

SEQ ID NO: 399320 - DNA, 25 bp, Homo sapien
aggtgccacaccagggtggtaacga

SEQ ID NO: 399321 - DNA, 25 bp, Homo sapien
aggaccaggcccacggacagaaaga

SEQ ID NO: 399322 - DNA, 25 bp, Homo sapien
acggacagaaagaccagcagcagac

SEQ ID NO: 399323 - DNA, 25 bp, Homo sapien
gtcccagagtcaagccaggacgtgg

SEQ ID NO: 399324 - DNA, 25 bp, Homo sapien
ttcaaatacgtctcaggagataatg

SEQ ID NO: 399325 - DNA, 25 bp, Homo sapien
ataatgagtttgatgggctccacta

SEQ ID NO: 399326 - DNA, 25 bp, Homo sapien
gatgggctccactaaatgctagaac

SEQ ID NO: 399327 - DNA, 25 bp, Homo sapien
tccactaaatgctagaacctccagg

SEQ ID NO: 399328 - DNA, 25 bp, Homo sapien
gaacctccaggaaaacttcgtggtg

SEQ ID NO: 399329 - DNA, 25 bp, Homo sapien
caggaaaacttcgtggtggctggtt

SEQ ID NO: 399330 - DNA, 25 bp, Homo sapien
gggacagaccatgcttttactactg

SEQ ID NO: 399331 - DNA, 25 bp, Homo sapien
gaccatgcttttactactgtagaac

SEQ ID NO: 399332 - DNA, 25 bp, Homo sapien
gtttgccttttaaatactgggatat

SEQ ID NO: 399333 - DNA, 25 bp, Homo sapien
atacaaaatgcgctggtgacacacc

SEQ ID NO: 399334 - DNA, 25 bp, Homo sapien
atgcgctggtgacacaccacttatt

SEQ ID NO: 399335 - DNA, 25 bp, Homo sapien
gtaacaaaactcacagctctggaca

SEQ ID NO: 399336 - DNA, 25 bp, Homo sapien
acagctctggacagttctggcacaa

SEQ ID NO: 399337 - DNA, 25 bp, Homo sapien
acagttctggcacaaaggtcaagtc

SEQ ID NO: 399338 - DNA, 25 bp, Homo sapien
gcaactcaagattctcattccacat

SEQ ID NO: 399339 - DNA, 25 bp, Homo sapien
gaaaaaatgggtctccagccacagt

SEQ ID NO: 399340 - DNA, 25 bp, Homo sapien
cagccacagtgtgagaatgtgtcaa

SEQ ID NO: 399341 - DNA, 25 bp, Homo sapien
atgtgtcaagaagtggactgtgcat

SEQ ID NO: 399342 - DNA, 25 bp, Homo sapien
gactgtgcatggagtccatccccga

SEQ ID NO: 399343 - DNA, 25 bp, Homo sapien
aagactgagcgagacagcactgcct

SEQ ID NO: 399344 - DNA, 25 bp, Homo sapien
cagcccaggatgcatcgatgaccct

SEQ ID NO: 399345 - DNA, 25 bp, Homo sapien
gatgcatcgatgaccctggaagagt

SEQ ID NO: 399346 - DNA, 25 bp, Homo sapien
aatgggagcccacggaactaagtag

SEQ ID NO: 399347 - DNA, 25 bp, Homo sapien
aaaaaacgggagctatttcacagag

SEQ ID NO: 399348 - DNA, 25 bp, Homo sapien
ttatgggatttgagttgcaggtgtc

SEQ ID NO: 399349 - DNA, 25 bp, Homo sapien
gttgcaggtgtccacttaactgact

SEQ ID NO: 399350 - DNA, 25 bp, Homo sapien
gcaggtgtccacttaactgactagc

SEQ ID NO: 399351 - DNA, 25 bp, Homo sapien
ggtgtccacttaactgactagcttt

SEQ ID NO: 399352 - DNA, 25 bp, Homo sapien
tccacttaactgactagctttgata

SEQ ID NO: 399353 - DNA, 25 bp, Homo sapien
gactagctttgataaacaatgtcag

SEQ ID NO: 399354 - DNA, 25 bp, Homo sapien
aacaatgtcagattttaactatgaa

SEQ ID NO: 399355 - DNA, 25 bp, Homo sapien
gaaaacgacattaccttgtgcattt

SEQ ID NO: 399356 - DNA, 25 bp, Homo sapien
cgacattaccttgtgcatttttata

SEQ ID NO: 399357 - DNA, 25 bp, Homo sapien
gggcatgggccacgcgggaaccgac

SEQ ID NO: 399358 - DNA, 25 bp, Homo sapien
aaccgactttccattgattcagggc

SEQ ID NO: 399359 - DNA, 25 bp, Homo sapien
ctttccattgattcagggcgtctga

SEQ ID NO: 399360 - DNA, 25 bp, Homo sapien
tcagggcgtctgatgacacaggctg

SEQ ID NO: 399361 - DNA, 25 bp, Homo sapien
acacaggctgactcatggccgggct

SEQ ID NO: 399362 - DNA, 25 bp, Homo sapien
aggctgactcatggccgggctgact

SEQ ID NO: 399363 - DNA, 25 bp, Homo sapien
tgcgggtccttcctctcatgacttg

SEQ ID NO: 399364 - DNA, 25 bp, Homo sapien
cctcttgctactagccactgagaag

SEQ ID NO: 399365 - DNA, 25 bp, Homo sapien
tactagccactgagaagtgcacttt

SEQ ID NO: 399366 - DNA, 25 bp, Homo sapien
aagtgcactttaagaggtgggagct

SEQ ID NO: 399367 - DNA, 25 bp, Homo sapien
agacagagtcaggctgttgcggctc

SEQ ID NO: 399368 - DNA, 25 bp, Homo sapien
gcagctgaagacaccatatttaaca

SEQ ID NO: 399369 - DNA, 25 bp, Homo sapien
taacactatatctcagtgataggga

SEQ ID NO: 399370 - DNA, 25 bp, Homo sapien
gggaaatagctgcattgatcttaca

SEQ ID NO: 399371 - DNA, 25 bp, Homo sapien
aatagctgcattgatcttacatgag

SEQ ID NO: 399372 - DNA, 25 bp, Homo sapien
gctgcattgatcttacatgagcata

SEQ ID NO: 399373 - DNA, 25 bp, Homo sapien
gatcttacatgagcataatcatcct

SEQ ID NO: 399374 - DNA, 25 bp, Homo sapien
gagcataatcatccttatacttcat

SEQ ID NO: 399375 - DNA, 25 bp, Homo sapien
taatcatccttatacttcatgaggg

SEQ ID NO: 399376 - DNA, 25 bp, Homo sapien
gcagaagttctggttaaatcacaac

SEQ ID NO: 399377 - DNA, 25 bp, Homo sapien
gtgacaaatcatataaaaccattca

SEQ ID NO: 399378 - DNA, 25 bp, Homo sapien
gttttagtgactaattcaggatgaa

SEQ ID NO: 399379 - DNA, 25 bp, Homo sapien
tcaagccggaacagggcttcgtgtg

SEQ ID NO: 399380 - DNA, 25 bp, Homo sapien
aggccagtgagttcgaggctgacac

SEQ ID NO: 399381 - DNA, 25 bp, Homo sapien
agttcgaggctgacacggcgggttc

SEQ ID NO: 399382 - DNA, 25 bp, Homo sapien
gcgggttcgaccgtggaacgccaca

SEQ ID NO: 399383 - DNA, 25 bp, Homo sapien
gaacgccacaagaaggcccagctgg

SEQ ID NO: 399384 - DNA, 25 bp, Homo sapien
gacatcaacgtgcagattgacgact

SEQ ID NO: 399385 - DNA, 25 bp, Homo sapien
agattgacgactcctatctggtgga

SEQ ID NO: 399386 - DNA, 25 bp, Homo sapien
tgacgactcctatctggtggaggcg

SEQ ID NO: 399387 - DNA, 25 bp, Homo sapien
agtgccgcatgtgcgagaagtccta

SEQ ID NO: 399388 - DNA, 25 bp, Homo sapien
cagagtgtgggttcgagccacccca

SEQ ID NO: 399389 - DNA, 25 bp, Homo sapien
agtccccggagcctgtcaagccgga

SEQ ID NO: 399390 - DNA, 25 bp, Homo sapien
ctgctggtgagcctatggaagagga

SEQ ID NO: 399391 - DNA, 25 bp, Homo sapien
ctggtgagcctatggaagaggagcc

SEQ ID NO: 399392 - DNA, 25 bp, Homo sapien
gtgagcctatggaagaggagccagc

SEQ ID NO: 399393 - DNA, 25 bp, Homo sapien
attcaaaaactgctggtgagcctat

SEQ ID NO: 399394 - DNA, 25 bp, Homo sapien
ttcaaaaactgctggtgagcctatg

SEQ ID NO: 399395 - DNA, 25 bp, Homo sapien
tcaaaaactgctggtgagcctatgg

SEQ ID NO: 399396 - DNA, 25 bp, Homo sapien
caaaaactgctggtgagcctatgga

SEQ ID NO: 399397 - DNA, 25 bp, Homo sapien
aaaaactgctggtgagcctatggaa

SEQ ID NO: 399398 - DNA, 25 bp, Homo sapien
aaaactgctggtgagcctatggaag

SEQ ID NO: 399399 - DNA, 25 bp, Homo sapien
aaactgctggtgagcctatggaaga

SEQ ID NO: 399400 - DNA, 25 bp, Homo sapien
aactgctggtgagcctatggaagag

SEQ ID NO: 399401 - DNA, 25 bp, Homo sapien
tttgctgttattaaaactaacctga

SEQ ID NO: 399402 - DNA, 25 bp, Homo sapien
ccaagaactctgcttgataaaataa

SEQ ID NO: 399403 - DNA, 25 bp, Homo sapien
taagcatagttttaggaacagccat

SEQ ID NO: 399404 - DNA, 25 bp, Homo sapien
agttttaggaacagccatgcagata

SEQ ID NO: 399405 - DNA, 25 bp, Homo sapien
atcaagcataataactcatcaccta

SEQ ID NO: 399406 - DNA, 25 bp, Homo sapien
agcataataactcatcacctaactt

SEQ ID NO: 399407 - DNA, 25 bp, Homo sapien
ataactcatcacctaacttaagaat

SEQ ID NO: 399408 - DNA, 25 bp, Homo sapien
cattatgagtgcttgtattttatct

SEQ ID NO: 399409 - DNA, 25 bp, Homo sapien
gagtgcttgtattttatctatttga

SEQ ID NO: 399410 - DNA, 25 bp, Homo sapien
attttatctatttgagctcttctcc

SEQ ID NO: 399411 - DNA, 25 bp, Homo sapien
ttatctatttgagctcttctcctat

SEQ ID NO: 399412 - DNA, 25 bp, Homo sapien
tcaactgctatactgaattatgttt

SEQ ID NO: 399413 - DNA, 25 bp, Homo sapien
actgctatactgaattatgtttaga

SEQ ID NO: 399414 - DNA, 25 bp, Homo sapien
gaagattctgaaagcaagattatcc

SEQ ID NO: 399415 - DNA, 25 bp, Homo sapien
gattctgaaagcaagattatccagt

SEQ ID NO: 399416 - DNA, 25 bp, Homo sapien
gaaagcaagattatccagtgggtaa

SEQ ID NO: 399417 - DNA, 25 bp, Homo sapien
ggtaaatgagagtcgactggattct

SEQ ID NO: 399418 - DNA, 25 bp, Homo sapien
taaatgagagtcgactggattctgt

SEQ ID NO: 399419 - DNA, 25 bp, Homo sapien
aatgagagtcgactggattctgtca

SEQ ID NO: 399420 - DNA, 25 bp, Homo sapien
atgagagtcgactggattctgtcag

SEQ ID NO: 399421 - DNA, 25 bp, Homo sapien
tgagagtcgactggattctgtcagt

SEQ ID NO: 399422 - DNA, 25 bp, Homo sapien
gagagtcgactggattctgtcagtt

SEQ ID NO: 399423 - DNA, 25 bp, Homo sapien
aactgcagatctaagcgaacactgg

SEQ ID NO: 399424 - DNA, 25 bp, Homo sapien
ctgcagatctaagcgaacactggct

SEQ ID NO: 399425 - DNA, 25 bp, Homo sapien
gcagatctaagcgaacactggctat

SEQ ID NO: 399426 - DNA, 25 bp, Homo sapien
agatctaagcgaacactggctatta

SEQ ID NO: 399427 - DNA, 25 bp, Homo sapien
atctaagcgaacactggctattaaa

SEQ ID NO: 399428 - DNA, 25 bp, Homo sapien
taagcgaacactggctattaaaaga

SEQ ID NO: 399429 - DNA, 25 bp, Homo sapien
gacacagtacaagaaagtggctatg

SEQ ID NO: 399430 - DNA, 25 bp, Homo sapien
aagaaagtggctatggtgcctgccc

SEQ ID NO: 399431 - DNA, 25 bp, Homo sapien
agaaagtggctatggtgcctgccca

SEQ ID NO: 399432 - DNA, 25 bp, Homo sapien
gaaagtggctatggtgcctgcccag

SEQ ID NO: 399433 - DNA, 25 bp, Homo sapien
aaagtggctatggtgcctgcccagg

SEQ ID NO: 399434 - DNA, 25 bp, Homo sapien
caatatggttcttgctcagcacctg

SEQ ID NO: 399435 - DNA, 25 bp, Homo sapien
atggcccagcatgctgaggaccttc

SEQ ID NO: 399436 - DNA, 25 bp, Homo sapien
ccctgtggcaaagaagagctcatta

SEQ ID NO: 399437 - DNA, 25 bp, Homo sapien
gagctcattaaaggcctcacttacg

SEQ ID NO: 399438 - DNA, 25 bp, Homo sapien
gagtgcttgccctcgagagcctggt

SEQ ID NO: 399439 - DNA, 25 bp, Homo sapien
gatcacccgtgagtagaacagagtt

SEQ ID NO: 399440 - DNA, 25 bp, Homo sapien
agaacagagttcacgccacaggcct

SEQ ID NO: 399441 - DNA, 25 bp, Homo sapien
ctgaagctgctctccttaggaattc

SEQ ID NO: 399442 - DNA, 25 bp, Homo sapien
aggaattctgctggcatctgggaac

SEQ ID NO: 399443 - DNA, 25 bp, Homo sapien
caccatcccctaactgatgagagta

SEQ ID NO: 399444 - DNA, 25 bp, Homo sapien
gagagtagttcactgggccgaaatt

SEQ ID NO: 399445 - DNA, 25 bp, Homo sapien
tctgcagcacggcttcttccgccgc

SEQ ID NO: 399446 - DNA, 25 bp, Homo sapien
ttcttccgccgcacggccgacgagg

SEQ ID NO: 399447 - DNA, 25 bp, Homo sapien
agtggctcctccagtgacaaccgga

SEQ ID NO: 399448 - DNA, 25 bp, Homo sapien
gtgacaaccggacctaccgctacag

SEQ ID NO: 399449 - DNA, 25 bp, Homo sapien
ggacctaccgctacagcaaccgata

SEQ ID NO: 399450 - DNA, 25 bp, Homo sapien
taccgctacagcaaccgatattgtg

SEQ ID NO: 399451 - DNA, 25 bp, Homo sapien
ccgctacagcaaccgatattgtggg

SEQ ID NO: 399452 - DNA, 25 bp, Homo sapien
agcaaccgatattgtgggggccctg

SEQ ID NO: 399453 - DNA, 25 bp, Homo sapien
tgggccccctatcacagactgtgag

SEQ ID NO: 399454 - DNA, 25 bp, Homo sapien
cacagactgtgagatgaacagcccc

SEQ ID NO: 399455 - DNA, 25 bp, Homo sapien
actgtgagatgaacagcccccaggt

SEQ ID NO: 399456 - DNA, 25 bp, Homo sapien
ccctggttcaccagagggagcggat

SEQ ID NO: 399457 - DNA, 25 bp, Homo sapien
ctggttcaccagagggagcggatga

SEQ ID NO: 399458 - DNA, 25 bp, Homo sapien
tcaccagagggagcggatgaaggat

SEQ ID NO: 399459 - DNA, 25 bp, Homo sapien
aaggatggcagcatctcacatgccc

SEQ ID NO: 399460 - DNA, 25 bp, Homo sapien
aggatggcagcatctcacatgcccc

SEQ ID NO: 399461 - DNA, 25 bp, Homo sapien
ggatggcagcatctcacatgcccca

SEQ ID NO: 399462 - DNA, 25 bp, Homo sapien
gatggcagcatctcacatgccccat

SEQ ID NO: 399463 - DNA, 25 bp, Homo sapien
tggcagcatctcacatgccccatca

SEQ ID NO: 399464 - DNA, 25 bp, Homo sapien
catcaccaactctgaggcacctggg

SEQ ID NO: 399465 - DNA, 25 bp, Homo sapien
cctgtgggagccattggaatgtatc

SEQ ID NO: 399466 - DNA, 25 bp, Homo sapien
ctgtgggagccattggaatgtatcc

SEQ ID NO: 399467 - DNA, 25 bp, Homo sapien
tcatctatggtaacaccgatcggcc

SEQ ID NO: 399468 - DNA, 25 bp, Homo sapien
catctatggtaacaccgatcggccc

SEQ ID NO: 399469 - DNA, 25 bp, Homo sapien
atctatggtaacaccgatcggccct

SEQ ID NO: 399470 - DNA, 25 bp, Homo sapien
tctatggtaacaccgatcggccctc

SEQ ID NO: 399471 - DNA, 25 bp, Homo sapien
tatggtaacaccgatcggccctcag

SEQ ID NO: 399472 - DNA, 25 bp, Homo sapien
atggtaacaccgatcggccctcagg

SEQ ID NO: 399473 - DNA, 25 bp, Homo sapien
tggtaacaccgatcggccctcaggg

SEQ ID NO: 399474 - DNA, 25 bp, Homo sapien
gggagagtgtcaccttctcctgcac

SEQ ID NO: 399475 - DNA, 25 bp, Homo sapien
gcaagtcctatgacagcagcctgag

SEQ ID NO: 399476 - DNA, 25 bp, Homo sapien
gtacactggtaccggcaacttcccg

SEQ ID NO: 399477 - DNA, 25 bp, Homo sapien
tggtaccggcaacttcccggcacag

SEQ ID NO: 399478 - DNA, 25 bp, Homo sapien
ccaaggtgggcagttcgcttgctgc

SEQ ID NO: 399479 - DNA, 25 bp, Homo sapien
caaggtgggcagttcgcttgctgcc

SEQ ID NO: 399480 - DNA, 25 bp, Homo sapien
aaggtgggcagttcgcttgctgcca

SEQ ID NO: 399481 - DNA, 25 bp, Homo sapien
ggcagttcgcttgctgccaggagtt

SEQ ID NO: 399482 - DNA, 25 bp, Homo sapien
gcagttcgcttgctgccaggagttt

SEQ ID NO: 399483 - DNA, 25 bp, Homo sapien
cagttcgcttgctgccaggagtttg

SEQ ID NO: 399484 - DNA, 25 bp, Homo sapien
agttcgcttgctgccaggagtttga

SEQ ID NO: 399485 - DNA, 25 bp, Homo sapien
gttcgcttgctgccaggagtttgag

SEQ ID NO: 399486 - DNA, 25 bp, Homo sapien
aattagccgagtgtgctggcgcaca

SEQ ID NO: 399487 - DNA, 25 bp, Homo sapien
gccgagtgtgctggcgcacacctgt

SEQ ID NO: 399488 - DNA, 25 bp, Homo sapien
gaggcagaggttgcctgcactccag

SEQ ID NO: 399489 - DNA, 25 bp, Homo sapien
tggtggttgacaactttttccctgg

SEQ ID NO: 399490 - DNA, 25 bp, Homo sapien
ttttccctggttaaacaatactcat

SEQ ID NO: 399491 - DNA, 25 bp, Homo sapien
ttctctaagtcagtagttaaggaac

SEQ ID NO: 399492 - DNA, 25 bp, Homo sapien
gtcagtagttaaggaactttgtatt

SEQ ID NO: 399493 - DNA, 25 bp, Homo sapien
tcttccccaaaaccagtttagccat

SEQ ID NO: 399494 - DNA, 25 bp, Homo sapien
tccccaaaaccagtttagccattgt

SEQ ID NO: 399495 - DNA, 25 bp, Homo sapien
gactataattatagaatgcctatgg

SEQ ID NO: 399496 - DNA, 25 bp, Homo sapien
gaatgcctatggaacaattttatga

SEQ ID NO: 399497 - DNA, 25 bp, Homo sapien
gaacaattttatgaacatgccaagg

SEQ ID NO: 399498 - DNA, 25 bp, Homo sapien
gaacatgccaaggatatgcctaaat

SEQ ID NO: 399499 - DNA, 25 bp, Homo sapien
aggatatgcctaaataattgagatt

SEQ ID NO: 399500 - DNA, 25 bp, Homo sapien
ggacagcaaacgaccctccgggatc

SEQ ID NO: 399501 - DNA, 25 bp, Homo sapien
cagctcagggacaatggccaccttg

SEQ ID NO: 399502 - DNA, 25 bp, Homo sapien
agctcagggacaatggccaccttga

SEQ ID NO: 399503 - DNA, 25 bp, Homo sapien
ctcagggacaatggccaccttgact

SEQ ID NO: 399504 - DNA, 25 bp, Homo sapien
agggacaatggccaccttgactatc

SEQ ID NO: 399505 - DNA, 25 bp, Homo sapien
ggacaatggccaccttgactatcag

SEQ ID NO: 399506 - DNA, 25 bp, Homo sapien
gacaatggccaccttgactatcagt

SEQ ID NO: 399507 - DNA, 25 bp, Homo sapien
acaatggccaccttgactatcagtg

SEQ ID NO: 399508 - DNA, 25 bp, Homo sapien
aatggccaccttgactatcagtggg

SEQ ID NO: 399509 - DNA, 25 bp, Homo sapien
caccttgactatcagtggggcccag

SEQ ID NO: 399510 - DNA, 25 bp, Homo sapien
tctggagatgcattgccaaaaaaat

SEQ ID NO: 399511 - DNA, 25 bp, Homo sapien
caattattttgagccggtcggagcc

SEQ ID NO: 399512 - DNA, 25 bp, Homo sapien
cggtgcgccagtgtacttacagtac

SEQ ID NO: 399513 - DNA, 25 bp, Homo sapien
tggccgccgagatcttagaactggt

SEQ ID NO: 399514 - DNA, 25 bp, Homo sapien
tgggcagcgccatacgtgacaagac

SEQ ID NO: 399515 - DNA, 25 bp, Homo sapien
ctggccatccgaaacgacgacgagg

SEQ ID NO: 399516 - DNA, 25 bp, Homo sapien
aagcagctgggcaacgtcactattg

SEQ ID NO: 399517 - DNA, 25 bp, Homo sapien
gtcactattgctcagggaggcgtcc

SEQ ID NO: 399518 - DNA, 25 bp, Homo sapien
ggaggcgtcctgtccaatattcagg

SEQ ID NO: 399519 - DNA, 25 bp, Homo sapien
tcaggccgtcctgttgccaaaataa

SEQ ID NO: 399520 - DNA, 25 bp, Homo sapien
cgggcttgcagttcccaatagggca

SEQ ID NO: 399521 - DNA, 25 bp, Homo sapien
gcagagtccgtcatctttttcgaaa

SEQ ID NO: 399522 - DNA, 25 bp, Homo sapien
tagtggtgagggatgacaacgtatt

SEQ ID NO: 399523 - DNA, 25 bp, Homo sapien
acaacgtattagtggctgtgggcca

SEQ ID NO: 399524 - DNA, 25 bp, Homo sapien
aagtcatggctgttgtgagagtttc

SEQ ID NO: 399525 - DNA, 25 bp, Homo sapien
ggctgttgtgagagtttcttcagaa

SEQ ID NO: 399526 - DNA, 25 bp, Homo sapien
tttcttcagaaaagtcagtcgtagg

SEQ ID NO: 399527 - DNA, 25 bp, Homo sapien
aaaagtcagtcgtaggagtcaatgt

SEQ ID NO: 399528 - DNA, 25 bp, Homo sapien
gagtcaatgtggtggtctcagtgaa

SEQ ID NO: 399529 - DNA, 25 bp, Homo sapien
gaaggtggtctgacctgtgcttgta

SEQ ID NO: 399530 - DNA, 25 bp, Homo sapien
tggtctgacctgtgcttgtagttgc

SEQ ID NO: 399531 - DNA, 25 bp, Homo sapien
tgtagttgctacactggatgaaggt

SEQ ID NO: 399532 - DNA, 25 bp, Homo sapien
gatgaaggtgattccatagttgtgg

SEQ ID NO: 399533 - DNA, 25 bp, Homo sapien
gtggcaaaagctttggaaggacttc

SEQ ID NO: 399534 - DNA, 25 bp, Homo sapien
gcaaaagctttggaaggacttccca

SEQ ID NO: 399535 - DNA, 25 bp, Homo sapien
aaagctttggaaggacttcccatct

SEQ ID NO: 399536 - DNA, 25 bp, Homo sapien
agctttggaaggacttcccatctaa

SEQ ID NO: 399537 - DNA, 25 bp, Homo sapien
ttggaaggacttcccatctaagcca

SEQ ID NO: 399538 - DNA, 25 bp, Homo sapien
ggaaggacttcccatctaagccaac

SEQ ID NO: 399539 - DNA, 25 bp, Homo sapien
gaaggacttcccatctaagccaaca

SEQ ID NO: 399540 - DNA, 25 bp, Homo sapien
atctaagccaacatcagcgtattca

SEQ ID NO: 399541 - DNA, 25 bp, Homo sapien
ctaagccaacatcagcgtattcaca

SEQ ID NO: 399542 - DNA, 25 bp, Homo sapien
aagccaacatcagcgtattcacaca

SEQ ID NO: 399543 - DNA, 25 bp, Homo sapien
gccaacatcagcgtattcacacagg

SEQ ID NO: 399544 - DNA, 25 bp, Homo sapien
aaatatcaagtccagcttcattttc

SEQ ID NO: 399545 - DNA, 25 bp, Homo sapien
tctggtttagttaaaatgctgtggg

SEQ ID NO: 399546 - DNA, 25 bp, Homo sapien
ctctggactagaggacattgacctt

SEQ ID NO: 399547 - DNA, 25 bp, Homo sapien
gactagaggacattgacctttggaa

SEQ ID NO: 399548 - DNA, 25 bp, Homo sapien
tgacctttggaaggcgttggctgct

SEQ ID NO: 399549 - DNA, 25 bp, Homo sapien
aaggcgttggctgctcctgaagaaa

SEQ ID NO: 399550 - DNA, 25 bp, Homo sapien
ggctgctcctgaagaaagctcctgg

SEQ ID NO: 399551 - DNA, 25 bp, Homo sapien
gaaagctcctggctgtttaaaggaa

SEQ ID NO: 399552 - DNA, 25 bp, Homo sapien
ggccacgcccaaaagcaagtcagtt

SEQ ID NO: 399553 - DNA, 25 bp, Homo sapien
cacgcccaaaagcaagtcagttcat

SEQ ID NO: 399554 - DNA, 25 bp, Homo sapien
gatatatcctattgcaatgcttttg

SEQ ID NO: 399555 - DNA, 25 bp, Homo sapien
atgcctagccaaaatgtttcttaag

SEQ ID NO: 399556 - DNA, 25 bp, Homo sapien
aggtatacattttgggtcttagaag

SEQ ID NO: 399557 - DNA, 25 bp, Homo sapien
gtcttagaagacttatacatttgta

SEQ ID NO: 399558 - DNA, 25 bp, Homo sapien
aatgttaccatgtgagctactttga

SEQ ID NO: 399559 - DNA, 25 bp, Homo sapien
gctactttgaatcaggcttcttgca

SEQ ID NO: 399560 - DNA, 25 bp, Homo sapien
ttgaatcaggcttcttgcacaccaa

SEQ ID NO: 399561 - DNA, 25 bp, Homo sapien
tcaggcttcttgcacaccaatttaa

SEQ ID NO: 399562 - DNA, 25 bp, Homo sapien
ggcttcttgcacaccaatttaaaaa

SEQ ID NO: 399563 - DNA, 25 bp, Homo sapien
gttaactcttgatatatacactagt

SEQ ID NO: 399564 - DNA, 25 bp, Homo sapien
tgatatatacactagttataccact

SEQ ID NO: 399565 - DNA, 25 bp, Homo sapien
ggtcctgaactgctgaattcaagtg

SEQ ID NO: 399566 - DNA, 25 bp, Homo sapien
aggttggcactcagatccgcaccat

SEQ ID NO: 399567 - DNA, 25 bp, Homo sapien
gcaccatcaccgaggagatcagaga

SEQ ID NO: 399568 - DNA, 25 bp, Homo sapien
gatgggaaagtcatctcctccaggg

SEQ ID NO: 399569 - DNA, 25 bp, Homo sapien
atctcctccagggagcacgtgcagt

SEQ ID NO: 399570 - DNA, 25 bp, Homo sapien
tgtgacagcccacttggtccaccag

SEQ ID NO: 399571 - DNA, 25 bp, Homo sapien
ctggaggcttaacgaccctgccctt

SEQ ID NO: 399572 - DNA, 25 bp, Homo sapien
taccaaaacactccccgtattgtgt

SEQ ID NO: 399573 - DNA, 25 bp, Homo sapien
cgtattgtgtttccggacttaactg

SEQ ID NO: 399574 - DNA, 25 bp, Homo sapien
tgtttccggacttaactgtgctttt

SEQ ID NO: 399575 - DNA, 25 bp, Homo sapien
aactgtgcttttacgccatgcaaaa

SEQ ID NO: 399576 - DNA, 25 bp, Homo sapien
gcttttacgccatgcaaaaccaggt

SEQ ID NO: 399577 - DNA, 25 bp, Homo sapien
agtggacaacagcaatcaaattatg

SEQ ID NO: 399578 - DNA, 25 bp, Homo sapien
gtggacaacagcaatcaaattatgg

SEQ ID NO: 399579 - DNA, 25 bp, Homo sapien
tggacaacagcaatcaaattatgga

SEQ ID NO: 399580 - DNA, 25 bp, Homo sapien
ggacaacagcaatcaaattatggac

SEQ ID NO: 399581 - DNA, 25 bp, Homo sapien
ggtggaagaagctcgggcagtccct

SEQ ID NO: 399582 - DNA, 25 bp, Homo sapien
tggaagaagctcgggcagtccctat

SEQ ID NO: 399583 - DNA, 25 bp, Homo sapien
ggaagaagctcgggcagtccctatg

SEQ ID NO: 399584 - DNA, 25 bp, Homo sapien
gaagaagctcgggcagtccctatgg

SEQ ID NO: 399585 - DNA, 25 bp, Homo sapien
aagaagctcgggcagtccctatggt

SEQ ID NO: 399586 - DNA, 25 bp, Homo sapien
aagctcgggcagtccctatggtggt

SEQ ID NO: 399587 - DNA, 25 bp, Homo sapien
agctcgggcagtccctatggtggtg

SEQ ID NO: 399588 - DNA, 25 bp, Homo sapien
atgatgctactgtacatagaactgt

SEQ ID NO: 399589 - DNA, 25 bp, Homo sapien
tcctttggagattgttcaacaatgg

SEQ ID NO: 399590 - DNA, 25 bp, Homo sapien
tgttcaacaatggtgggttgttttt

SEQ ID NO: 399591 - DNA, 25 bp, Homo sapien
tattagtcattcaaaatctggccac

SEQ ID NO: 399592 - DNA, 25 bp, Homo sapien
gtcattcaaaatctggccacaatct

SEQ ID NO: 399593 - DNA, 25 bp, Homo sapien
aaatctggccacaatcttaggaata

SEQ ID NO: 399594 - DNA, 25 bp, Homo sapien
tggccacaatcttaggaatacaaaa

SEQ ID NO: 399595 - DNA, 25 bp, Homo sapien
aatgtcacaatgtaatagatctaac

SEQ ID NO: 399596 - DNA, 25 bp, Homo sapien
gatctaacattgcatatatttctga

SEQ ID NO: 399597 - DNA, 25 bp, Homo sapien
cattgcatatatttctgatgtgatg

SEQ ID NO: 399598 - DNA, 25 bp, Homo sapien
ttttctatcgtgcaaactacagctc

SEQ ID NO: 399599 - DNA, 25 bp, Homo sapien
gcaccatccttcaacaggctgattt

SEQ ID NO: 399600 - DNA, 25 bp, Homo sapien
gacatcgaggacttcactatggatc

SEQ ID NO: 399601 - DNA, 25 bp, Homo sapien
ctatggatcgggaagtgcacaaaat

SEQ ID NO: 399602 - DNA, 25 bp, Homo sapien
aatcaaccctgagtgtaaatctgtc

SEQ ID NO: 399603 - DNA, 25 bp, Homo sapien
agtgtaaatctgtccaccattgcat

SEQ ID NO: 399604 - DNA, 25 bp, Homo sapien
accattgcatcaccaagtcccagga

SEQ ID NO: 399605 - DNA, 25 bp, Homo sapien
agtgcaggtgcccatcttcaagggc

SEQ ID NO: 399606 - DNA, 25 bp, Homo sapien
acatcctcagccaggagtctctact

SEQ ID NO: 399607 - DNA, 25 bp, Homo sapien
tctactctctctctacaaggaggag

SEQ ID NO: 399608 - DNA, 25 bp, Homo sapien
ttatgagccaatcgatgccaccggt

SEQ ID NO: 399609 - DNA, 25 bp, Homo sapien
tcgatgccaccggtttcatcaacat

SEQ ID NO: 399610 - DNA, 25 bp, Homo sapien
gaaagcaagattatccagtgggtaa

SEQ ID NO: 399611 - DNA, 25 bp, Homo sapien
gagagtcgactggattctgtcagtt

SEQ ID NO: 399612 - DNA, 25 bp, Homo sapien
ttattatatgtacagtattcccact

SEQ ID NO: 399613 - DNA, 25 bp, Homo sapien
acagtattcccactcctggcatttt

SEQ ID NO: 399614 - DNA, 25 bp, Homo sapien
tcctggcattttctggcaggtttaa

SEQ ID NO: 399615 - DNA, 25 bp, Homo sapien
ctggcattttctggcaggtttaaaa

SEQ ID NO: 399616 - DNA, 25 bp, Homo sapien
aatattcagcataaatccagcagag

SEQ ID NO: 399617 - DNA, 25 bp, Homo sapien
aatccagcagaggtggctgagctta

SEQ ID NO: 399618 - DNA, 25 bp, Homo sapien
gcagaggtggctgagcttaattgct

SEQ ID NO: 399619 - DNA, 25 bp, Homo sapien
aggtggctgagcttaattgcttaaa

SEQ ID NO: 399620 - DNA, 25 bp, Homo sapien
ggctgagcttaattgcttaaataag

SEQ ID NO: 399621 - DNA, 25 bp, Homo sapien
cctttcctggcatgcgtgactccaa

SEQ ID NO: 399622 - DNA, 25 bp, Homo sapien
ctttcctggcatgcgtgactccaac

SEQ ID NO: 399623 - DNA, 25 bp, Homo sapien
tttcctggcatgcgtgactccaaca

SEQ ID NO: 399624 - DNA, 25 bp, Homo sapien
ttcctggcatgcgtgactccaacat

SEQ ID NO: 399625 - DNA, 25 bp, Homo sapien
tcctggcatgcgtgactccaacatc

SEQ ID NO: 399626 - DNA, 25 bp, Homo sapien
cctggcatgcgtgactccaacatca

SEQ ID NO: 399627 - DNA, 25 bp, Homo sapien
ctggcatgcgtgactccaacatcag

SEQ ID NO: 399628 - DNA, 25 bp, Homo sapien
tggcatgcgtgactccaacatcagc

SEQ ID NO: 399629 - DNA, 25 bp, Homo sapien
ggcatgcgtgactccaacatcagca

SEQ ID NO: 399630 - DNA, 25 bp, Homo sapien
tggttgggttgacactaacttttct

SEQ ID NO: 399631 - DNA, 25 bp, Homo sapien
tgggttgacactaacttttcttaag

SEQ ID NO: 399632 - DNA, 25 bp, Homo sapien
gttgacactaacttttcttaagatg

SEQ ID NO: 399633 - DNA, 25 bp, Homo sapien
cttaagatgctgtgagaatcatttc

SEQ ID NO: 399634 - DNA, 25 bp, Homo sapien
tgctgtgagaatcatttcatccaaa

SEQ ID NO: 399635 - DNA, 25 bp, Homo sapien
ctctaggaccagcttgccacggttt

SEQ ID NO: 399636 - DNA, 25 bp, Homo sapien
gaccagcttgccacggtttctcaga

SEQ ID NO: 399637 - DNA, 25 bp, Homo sapien
tctgacctgccatgcggaggtggga

SEQ ID NO: 399638 - DNA, 25 bp, Homo sapien
cggaggtgggatttgatactgtaca

SEQ ID NO: 399639 - DNA, 25 bp, Homo sapien
gatactgtacattgtcttgatgcct

SEQ ID NO: 399640 - DNA, 25 bp, Homo sapien
gtacattgtcttgatgcctgttttt

SEQ ID NO: 399641 - DNA, 25 bp, Homo sapien
attgcgcatgatgtggatcccatca

SEQ ID NO: 399642 - DNA, 25 bp, Homo sapien
tgcgcatgatgtggatcccatcaag

SEQ ID NO: 399643 - DNA, 25 bp, Homo sapien
gcatgatgtggatcccatcaagctg

SEQ ID NO: 399644 - DNA, 25 bp, Homo sapien
ataaaaggggagtcccttactgcat

SEQ ID NO: 399645 - DNA, 25 bp, Homo sapien
atgacaggatgagatccgccatcac

SEQ ID NO: 399646 - DNA, 25 bp, Homo sapien
acaggatgagatccgccatcactgg

SEQ ID NO: 399647 - DNA, 25 bp, Homo sapien
agatccgccatcactggggagggaa

SEQ ID NO: 399648 - DNA, 25 bp, Homo sapien
gaaggccctgggtctcaagtctgtg

SEQ ID NO: 399649 - DNA, 25 bp, Homo sapien
ggtctcaagtctgtggctcagatcg

SEQ ID NO: 399650 - DNA, 25 bp, Homo sapien
ggctcagatcgccaagctcaaaaag

SEQ ID NO: 399651 - DNA, 25 bp, Homo sapien
ctcagatcgccaagctcaaaaaggc

SEQ ID NO: 399652 - DNA, 25 bp, Homo sapien
gctgtccttgaggctgagccctcag

SEQ ID NO: 399653 - DNA, 25 bp, Homo sapien
gggacagcaaggtcccttgttataa

SEQ ID NO: 399654 - DNA, 25 bp, Homo sapien
agcaaggtcccttgttataagaggg

SEQ ID NO: 399655 - DNA, 25 bp, Homo sapien
ggcagagaggacaactccgctttgg

SEQ ID NO: 399656 - DNA, 25 bp, Homo sapien
gagaggacaactccgctttggccaa

SEQ ID NO: 399657 - DNA, 25 bp, Homo sapien
gacaactccgctttggccaacctag

SEQ ID NO: 399658 - DNA, 25 bp, Homo sapien
gctgcagcatatagaccaggaaatc

SEQ ID NO: 399659 - DNA, 25 bp, Homo sapien
gaccaggaaatcaggtagcccagac

SEQ ID NO: 399660 - DNA, 25 bp, Homo sapien
aggaaatcaggtagcccagactggt

SEQ ID NO: 399661 - DNA, 25 bp, Homo sapien
ggaatctatgattctgcttccccag

SEQ ID NO: 399662 - DNA, 25 bp, Homo sapien
gggtagcacagcctcacagcaaccg

SEQ ID NO: 399663 - DNA, 25 bp, Homo sapien
gccactcctggccagcgagggagga

SEQ ID NO: 399664 - DNA, 25 bp, Homo sapien
agtgcgggaccagacaggccgccta

SEQ ID NO: 399665 - DNA, 25 bp, Homo sapien
agacaggccgcctaggcctcctggg

SEQ ID NO: 399666 - DNA, 25 bp, Homo sapien
atacccgacctagcagatcggaagc

SEQ ID NO: 399667 - DNA, 25 bp, Homo sapien
agcagatcggaagcgctgcgactgt

SEQ ID NO: 399668 - DNA, 25 bp, Homo sapien
aagcgctgcgactgtgcccgcaggt

SEQ ID NO: 399669 - DNA, 25 bp, Homo sapien
tgtgcccgcaggttgaccttgccaa

SEQ ID NO: 399670 - DNA, 25 bp, Homo sapien
gttgaccttgccaagccctccaggt

SEQ ID NO: 399671 - DNA, 25 bp, Homo sapien
tggacgccagcttccgcaggaacct

SEQ ID NO: 399672 - DNA, 25 bp, Homo sapien
ggaacctccgccagctgataacttg

SEQ ID NO: 399673 - DNA, 25 bp, Homo sapien
cagctgataacttgccgcgcggcag

SEQ ID NO: 399674 - DNA, 25 bp, Homo sapien
attaaattcaaatatgagccaggta

SEQ ID NO: 399675 - DNA, 25 bp, Homo sapien
ttaaattcaaatatgagccaggtat

SEQ ID NO: 399676 - DNA, 25 bp, Homo sapien
taaattcaaatatgagccaggtatg

SEQ ID NO: 399677 - DNA, 25 bp, Homo sapien
ttgagactacggtgtgctgtgatcg

SEQ ID NO: 399678 - DNA, 25 bp, Homo sapien
tgagactacggtgtgctgtgatcgt

SEQ ID NO: 399679 - DNA, 25 bp, Homo sapien
agactacggtgtgctgtgatcgtgc

SEQ ID NO: 399680 - DNA, 25 bp, Homo sapien
actacggtgtgctgtgatcgtgcac

SEQ ID NO: 399681 - DNA, 25 bp, Homo sapien
ctacggtgtgctgtgatcgtgcact

SEQ ID NO: 399682 - DNA, 25 bp, Homo sapien
tacggtgtgctgtgatcgtgcactc

SEQ ID NO: 399683 - DNA, 25 bp, Homo sapien
acggtgtgctgtgatcgtgcactcc

SEQ ID NO: 399684 - DNA, 25 bp, Homo sapien
ggtgtgctgtgatcgtgcactccat

SEQ ID NO: 399685 - DNA, 25 bp, Homo sapien
ggaataactcctgcctaagaggtag

SEQ ID NO: 399686 - DNA, 25 bp, Homo sapien
ggatcaagtacatctggtggacatt

SEQ ID NO: 399687 - DNA, 25 bp, Homo sapien
ggtggacattgaccggtatcagcaa

SEQ ID NO: 399688 - DNA, 25 bp, Homo sapien
atgggcaattacaatggagaagctt

SEQ ID NO: 399689 - DNA, 25 bp, Homo sapien
ttaagtgtgcgctaaatgaaggcat

SEQ ID NO: 399690 - DNA, 25 bp, Homo sapien
ggcatgccagtttattgtagatcct

SEQ ID NO: 399691 - DNA, 25 bp, Homo sapien
gaaaaggatcacctaatcatcaaat

SEQ ID NO: 399692 - DNA, 25 bp, Homo sapien
caaatttaaggcctacttccgtgag

SEQ ID NO: 399693 - DNA, 25 bp, Homo sapien
tacttccgtgagaatgcctttctgt

SEQ ID NO: 399694 - DNA, 25 bp, Homo sapien
gcctttctgtctcctgataaactct

SEQ ID NO: 399695 - DNA, 25 bp, Homo sapien
actctctttgctggaataactcctg

SEQ ID NO: 399696 - DNA, 25 bp, Homo sapien
agcctccggatgaggtggctgccac

SEQ ID NO: 399697 - DNA, 25 bp, Homo sapien
accaggcccgaatgatccccaggag

SEQ ID NO: 399698 - DNA, 25 bp, Homo sapien
caaaccccaacatcgaatcaaacat

SEQ ID NO: 399699 - DNA, 25 bp, Homo sapien
atctccatccccaagtgcagtaaca

SEQ ID NO: 399700 - DNA, 25 bp, Homo sapien
ccaagctggtctggcaagggcgctc

SEQ ID NO: 399701 - DNA, 25 bp, Homo sapien
gaaaggcctggtgcgattctcagta

SEQ ID NO: 399702 - DNA, 25 bp, Homo sapien
tgcgattctcagtaggactcacacc

SEQ ID NO: 399703 - DNA, 25 bp, Homo sapien
tacctagaagtactgggctggcctg

SEQ ID NO: 399704 - DNA, 25 bp, Homo sapien
gggagcaatggccagtcaccttcac

SEQ ID NO: 399705 - DNA, 25 bp, Homo sapien
tcaccttcaccttctaactaactag

SEQ ID NO: 399706 - DNA, 25 bp, Homo sapien
ttctaactaactagcctccggatga

SEQ ID NO: 399707 - DNA, 25 bp, Homo sapien
aggaaaatctggttctcccctgagc

SEQ ID NO: 399708 - DNA, 25 bp, Homo sapien
aaaatctggttctcccctgagctgg

SEQ ID NO: 399709 - DNA, 25 bp, Homo sapien
ccgtgtgtttccttatcatggtggt

SEQ ID NO: 399710 - DNA, 25 bp, Homo sapien
gtttccttatcatggtggtcaattg

SEQ ID NO: 399711 - DNA, 25 bp, Homo sapien
catggtggtcaattggaggtgttaa

SEQ ID NO: 399712 - DNA, 25 bp, Homo sapien
atttgaatggattaaggaacaccta

SEQ ID NO: 399713 - DNA, 25 bp, Homo sapien
ggaacacctagaacactggtaaggc

SEQ ID NO: 399714 - DNA, 25 bp, Homo sapien
gtaaggcattatttctgggacatta

SEQ ID NO: 399715 - DNA, 25 bp, Homo sapien
tttctgggacattatttctgggcat

SEQ ID NO: 399716 - DNA, 25 bp, Homo sapien
ttatttctgggcatgtcttcgaggg

SEQ ID NO: 399717 - DNA, 25 bp, Homo sapien
gcatgtcttcgagggtgtttccaga

SEQ ID NO: 399718 - DNA, 25 bp, Homo sapien
ctgtggtcggaggtcgagcgcctga

SEQ ID NO: 399719 - DNA, 25 bp, Homo sapien
aggtcgagcgcctgagggacgagca

SEQ ID NO: 399720 - DNA, 25 bp, Homo sapien
gacgagcagctgaactcgccctaca

SEQ ID NO: 399721 - DNA, 25 bp, Homo sapien
tcgccctacagctgccaggcggagg

SEQ ID NO: 399722 - DNA, 25 bp, Homo sapien
gggccgtgcctcacgcgggaggtgg

SEQ ID NO: 399723 - DNA, 25 bp, Homo sapien
gaggtggcgcagctccgggccgaga

SEQ ID NO: 399724 - DNA, 25 bp, Homo sapien
agctccgggccgagaactgcgacct

SEQ ID NO: 399725 - DNA, 25 bp, Homo sapien
tccgggccgagaactgcgacctgcg

SEQ ID NO: 399726 - DNA, 25 bp, Homo sapien
gcctgtgcagcctgcggctgtgcct

SEQ ID NO: 399727 - DNA, 25 bp, Homo sapien
gtcggtgcctgagggaggccgcgat

SEQ ID NO: 399728 - DNA, 25 bp, Homo sapien
ggaggccgtggcgtcgcgcctggag

SEQ ID NO: 399729 - DNA, 25 bp, Homo sapien
aattttggcggtggtaactatggtg

SEQ ID NO: 399730 - DNA, 25 bp, Homo sapien
actatggtggtggtgggaactataa

SEQ ID NO: 399731 - DNA, 25 bp, Homo sapien
gtggtggtgggaactataatgattt

SEQ ID NO: 399732 - DNA, 25 bp, Homo sapien
gggcagttttggtggaagaagctcg

SEQ ID NO: 399733 - DNA, 25 bp, Homo sapien
ccctatggtggtggttatggatctg

SEQ ID NO: 399734 - DNA, 25 bp, Homo sapien
tggatatggtagcagaaggttctaa

SEQ ID NO: 399735 - DNA, 25 bp, Homo sapien
gtagcagaaggttctaaaaacagca

SEQ ID NO: 399736 - DNA, 25 bp, Homo sapien
tacagttcttagcaggagagagagc

SEQ ID NO: 399737 - DNA, 25 bp, Homo sapien
agttgtcaggaaagctgcaggttac

SEQ ID NO: 399738 - DNA, 25 bp, Homo sapien
gaaagctgcaggttactttgagaca

SEQ ID NO: 399739 - DNA, 25 bp, Homo sapien
caggttactttgagacagtcgtccc

SEQ ID NO: 399740 - DNA, 25 bp, Homo sapien
agaaacttcattatttactgtgctt

SEQ ID NO: 399741 - DNA, 25 bp, Homo sapien
tactgtgctttgtatggcataactg

SEQ ID NO: 399742 - DNA, 25 bp, Homo sapien
gtatggcataactggtaacaaggca

SEQ ID NO: 399743 - DNA, 25 bp, Homo sapien
acatatttgaactggaccatagtaa

SEQ ID NO: 399744 - DNA, 25 bp, Homo sapien
tcatttgcaagataattgtcaggtt

SEQ ID NO: 399745 - DNA, 25 bp, Homo sapien
gttaatagtaagtggcagcttccca

SEQ ID NO: 399746 - DNA, 25 bp, Homo sapien
gtggcagcttcccagaaatttgggt

SEQ ID NO: 399747 - DNA, 25 bp, Homo sapien
aatttgggttatttggcctaggctg

SEQ ID NO: 399748 - DNA, 25 bp, Homo sapien
ggcctaggctgtgccctgggattac

SEQ ID NO: 399749 - DNA, 25 bp, Homo sapien
tgggattacctcttcatcttccttg

SEQ ID NO: 399750 - DNA, 25 bp, Homo sapien
tcatcttccttgacttttaagttca

SEQ ID NO: 399751 - DNA, 25 bp, Homo sapien
acacaattcgttttttcatttgaat

SEQ ID NO: 399752 - DNA, 25 bp, Homo sapien
ttttcatttgaattggcatttccca

SEQ ID NO: 399753 - DNA, 25 bp, Homo sapien
tggcatttcccaatatttgctaaac

SEQ ID NO: 399754 - DNA, 25 bp, Homo sapien
atttgctaaacatttgctggagaaa

SEQ ID NO: 399755 - DNA, 25 bp, Homo sapien
ccctgaaatatttaggtgtctatat

SEQ ID NO: 399756 - DNA, 25 bp, Homo sapien
gattagtatttttccatgtttattg

SEQ ID NO: 399757 - DNA, 25 bp, Homo sapien
gtttattgtgttatcagagtgcatt

SEQ ID NO: 399758 - DNA, 25 bp, Homo sapien
tagtgattcatcttcacagcacatt

SEQ ID NO: 399759 - DNA, 25 bp, Homo sapien
acagcacatttttaatcaagcagtt

SEQ ID NO: 399760 - DNA, 25 bp, Homo sapien
caaccagcacattcgttttgttcat

SEQ ID NO: 399761 - DNA, 25 bp, Homo sapien
gcacattcgttttgttcatattcac

SEQ ID NO: 399762 - DNA, 25 bp, Homo sapien
actatggtggtggtgggaactataa

SEQ ID NO: 399763 - DNA, 25 bp, Homo sapien
ctatggtggtggtgggaactataat

SEQ ID NO: 399764 - DNA, 25 bp, Homo sapien
gtggtggtgggaactataatgattt

SEQ ID NO: 399765 - DNA, 25 bp, Homo sapien
gggcagttttggtggaagaagctcg

SEQ ID NO: 399766 - DNA, 25 bp, Homo sapien
tggatatggtagcagaaggttctaa

SEQ ID NO: 399767 - DNA, 25 bp, Homo sapien
ggatatggtagcagaaggttctaaa

SEQ ID NO: 399768 - DNA, 25 bp, Homo sapien
ggtagcagaaggttctaaaaacagc

SEQ ID NO: 399769 - DNA, 25 bp, Homo sapien
tagcagaaggttctaaaaacagcag

SEQ ID NO: 399770 - DNA, 25 bp, Homo sapien
gagttgtcaggaaagctgcaggtta

SEQ ID NO: 399771 - DNA, 25 bp, Homo sapien
agttgtcaggaaagctgcaggttac

SEQ ID NO: 399772 - DNA, 25 bp, Homo sapien
gttgtcaggaaagctgcaggttact

SEQ ID NO: 399773 - DNA, 25 bp, Homo sapien
gggtcagagaaggatcttccagaga

SEQ ID NO: 399774 - DNA, 25 bp, Homo sapien
gatcttccagagattgctgagtggg

SEQ ID NO: 399775 - DNA, 25 bp, Homo sapien
gatatggttctacagtttttggtca

SEQ ID NO: 399776 - DNA, 25 bp, Homo sapien
gttctacagtttttggtcataacca

SEQ ID NO: 399777 - DNA, 25 bp, Homo sapien
atctctgctgcctggtcgatgaagc

SEQ ID NO: 399778 - DNA, 25 bp, Homo sapien
tgcctggtcgatgaagcatcccaaa

SEQ ID NO: 399779 - DNA, 25 bp, Homo sapien
gaagcatcccaaatagtccatcagc

SEQ ID NO: 399780 - DNA, 25 bp, Homo sapien
tagtccatcagcgagggcaaagtga

SEQ ID NO: 399781 - DNA, 25 bp, Homo sapien
tggaaacatttggagtcactgatta

SEQ ID NO: 399782 - DNA, 25 bp, Homo sapien
tcactgattaacatgcttgagggct

SEQ ID NO: 399783 - DNA, 25 bp, Homo sapien
tggctgacctgggacctggtgaaat

SEQ ID NO: 399784 - DNA, 25 bp, Homo sapien
tttctagaggtaacaactgatgttg

SEQ ID NO: 399785 - DNA, 25 bp, Homo sapien
ccaaatttgaaagctccatctccga

SEQ ID NO: 399786 - DNA, 25 bp, Homo sapien
aaatttgaaagctccatctccgaga

SEQ ID NO: 399787 - DNA, 25 bp, Homo sapien
atttgaaagctccatctccgagaag

SEQ ID NO: 399788 - DNA, 25 bp, Homo sapien
ttgaaagctccatctccgagaagca

SEQ ID NO: 399789 - DNA, 25 bp, Homo sapien
gaaagctccatctccgagaagcaaa

SEQ ID NO: 399790 - DNA, 25 bp, Homo sapien
agctccatctccgagaagcaaattt

SEQ ID NO: 399791 - DNA, 25 bp, Homo sapien
catctccgagaagcaaattttacag

SEQ ID NO: 399792 - DNA, 25 bp, Homo sapien
agaggtaacaactgatgttggaact

SEQ ID NO: 399793 - DNA, 25 bp, Homo sapien
cagttccccagttgacgagaacaac

SEQ ID NO: 399794 - DNA, 25 bp, Homo sapien
gttccccagttgacgagaacaacta

SEQ ID NO: 399795 - DNA, 25 bp, Homo sapien
ggtgccagggcgacccaggctgcgg

SEQ ID NO: 399796 - DNA, 25 bp, Homo sapien
gcgccggccctgtgccttgcagaga

SEQ ID NO: 399797 - DNA, 25 bp, Homo sapien
ggagtagcttgctggctttgaacgc

SEQ ID NO: 399798 - DNA, 25 bp, Homo sapien
cttgctggctttgaacgcgtggcgt

SEQ ID NO: 399799 - DNA, 25 bp, Homo sapien
aacgcgtggcgtggcagatatttca

SEQ ID NO: 399800 - DNA, 25 bp, Homo sapien
gatatttcagaaagcttcaagaaca

SEQ ID NO: 399801 - DNA, 25 bp, Homo sapien
gaagagttattcctccatattcacc

SEQ ID NO: 399802 - DNA, 25 bp, Homo sapien
gcttcaactactattcttattggga

SEQ ID NO: 399803 - DNA, 25 bp, Homo sapien
atggacaatggaatgttctctggtt

SEQ ID NO: 399804 - DNA, 25 bp, Homo sapien
tgttctctggttttatcatgatcaa

SEQ ID NO: 399805 - DNA, 25 bp, Homo sapien
atcatgatcaaaaacctccttctct

SEQ ID NO: 399806 - DNA, 25 bp, Homo sapien
gtgagaaatactatgtagactctgt

SEQ ID NO: 399807 - DNA, 25 bp, Homo sapien
gaaatactatgtagactctgtgaag

SEQ ID NO: 399808 - DNA, 25 bp, Homo sapien
tgtgcgagagccgaccccgggtata

SEQ ID NO: 399809 - DNA, 25 bp, Homo sapien
gccgaccccgggtatagcagtgcct

SEQ ID NO: 399810 - DNA, 25 bp, Homo sapien
cgaccccgggtatagcagtgcctgg

SEQ ID NO: 399811 - DNA, 25 bp, Homo sapien
tggattcacctttagtagcaattgg

SEQ ID NO: 399812 - DNA, 25 bp, Homo sapien
ggattcacctttagtagcaattgga

SEQ ID NO: 399813 - DNA, 25 bp, Homo sapien
gattcacctttagtagcaattggat

SEQ ID NO: 399814 - DNA, 25 bp, Homo sapien
attcacctttagtagcaattggatg

SEQ ID NO: 399815 - DNA, 25 bp, Homo sapien
cacctttagtagcaattggatgagc

SEQ ID NO: 399816 - DNA, 25 bp, Homo sapien
tagcaattggatgagctgggtccgc

SEQ ID NO: 399817 - DNA, 25 bp, Homo sapien
cttgctggctttgaacgcgtggcgt

SEQ ID NO: 399818 - DNA, 25 bp, Homo sapien
ttgctggctttgaacgcgtggcgtg

SEQ ID NO: 399819 - DNA, 25 bp, Homo sapien
tgctggctttgaacgcgtggcgtgg

SEQ ID NO: 399820 - DNA, 25 bp, Homo sapien
gctggctttgaacgcgtggcgtggc

SEQ ID NO: 399821 - DNA, 25 bp, Homo sapien
gatatttcagaaagcttcaagaaca

SEQ ID NO: 399822 - DNA, 25 bp, Homo sapien
tatttcagaaagcttcaagaacaag

SEQ ID NO: 399823 - DNA, 25 bp, Homo sapien
aagggaagagttattcctccatatt

SEQ ID NO: 399824 - DNA, 25 bp, Homo sapien
agggaagagttattcctccatattc

SEQ ID NO: 399825 - DNA, 25 bp, Homo sapien
gggaagagttattcctccatattca

SEQ ID NO: 399826 - DNA, 25 bp, Homo sapien
ggaagagttattcctccatattcac

SEQ ID NO: 399827 - DNA, 25 bp, Homo sapien
gaagagttattcctccatattcacc

SEQ ID NO: 399828 - DNA, 25 bp, Homo sapien
aataggatctcaaatttatactcag

SEQ ID NO: 399829 - DNA, 25 bp, Homo sapien
acagtccagcaagggaaacagactt

SEQ ID NO: 399830 - DNA, 25 bp, Homo sapien
gggaaacagacttgggtatgactat

SEQ ID NO: 399831 - DNA, 25 bp, Homo sapien
cagacttgggtatgactatgtatag

SEQ ID NO: 399832 - DNA, 25 bp, Homo sapien
tatgtatagtacaactcagtcgaaa

SEQ ID NO: 399833 - DNA, 25 bp, Homo sapien
gtacaactcagtcgaaatgctaaga

SEQ ID NO: 399834 - DNA, 25 bp, Homo sapien
ctaagatgtaagcactaaccaccca

SEQ ID NO: 399835 - DNA, 25 bp, Homo sapien
atctgattggtgattggtggagtaa

SEQ ID NO: 399836 - DNA, 25 bp, Homo sapien
gcttcttgcttaattgttcccctaa

SEQ ID NO: 399837 - DNA, 25 bp, Homo sapien
tgcttaattgttcccctaatattgg

SEQ ID NO: 399838 - DNA, 25 bp, Homo sapien
gttcccctaatattgggcatgactt

SEQ ID NO: 399839 - DNA, 25 bp, Homo sapien
catctggtggccaaagagaatcgta

SEQ ID NO: 399840 - DNA, 25 bp, Homo sapien
caaagagaatcgtagccccagagct

SEQ ID NO: 399841 - DNA, 25 bp, Homo sapien
aaagagaatcgtagccccagagctg

SEQ ID NO: 399842 - DNA, 25 bp, Homo sapien
gaatcgtagccccagagctgcccaa

SEQ ID NO: 399843 - DNA, 25 bp, Homo sapien
gaggacctgacatctgtaggtggcc

SEQ ID NO: 399844 - DNA, 25 bp, Homo sapien
tgatgccccatctacagcaggaggt

SEQ ID NO: 399845 - DNA, 25 bp, Homo sapien
atgccccatctacagcaggaggtca

SEQ ID NO: 399846 - DNA, 25 bp, Homo sapien
aggaggtcaggaccacgcccctggc

SEQ ID NO: 399847 - DNA, 25 bp, Homo sapien
gggtctgtgtcacctccatctcagt

SEQ ID NO: 399848 - DNA, 25 bp, Homo sapien
ctgtgtcacctccatctcagtcttg

SEQ ID NO: 399849 - DNA, 25 bp, Homo sapien
catctcagtcttggcctggctatga

SEQ ID NO: 399850 - DNA, 25 bp, Homo sapien
ctaccagggcctgtccaatgagcag

SEQ ID NO: 399851 - DNA, 25 bp, Homo sapien
atgagcaggtgctgaagttcgtcat

SEQ ID NO: 399852 - DNA, 25 bp, Homo sapien
gcaggtgctgaagttcgtcatggat

SEQ ID NO: 399853 - DNA, 25 bp, Homo sapien
gctgaagttcgtcatggatggcggg

SEQ ID NO: 399854 - DNA, 25 bp, Homo sapien
agctggagggctgtccccttcagct

SEQ ID NO: 399855 - DNA, 25 bp, Homo sapien
tgatgagccgctgctggcagccgaa

SEQ ID NO: 399856 - DNA, 25 bp, Homo sapien
atgagccgctgctggcagccgaacc

SEQ ID NO: 399857 - DNA, 25 bp, Homo sapien
catctttcacacacattctggacag

SEQ ID NO: 399858 - DNA, 25 bp, Homo sapien
ctttcacacacattctggacagcat

SEQ ID NO: 399859 - DNA, 25 bp, Homo sapien
cttctactacagcccggaatgccgg

SEQ ID NO: 399860 - DNA, 25 bp, Homo sapien
ctgcctaccaccgatgcagagcctg

SEQ ID NO: 399861 - DNA, 25 bp, Homo sapien
taacactatatctcagtgataggga

SEQ ID NO: 399862 - DNA, 25 bp, Homo sapien
cactatatctcagtgatagggaaat

SEQ ID NO: 399863 - DNA, 25 bp, Homo sapien
gggaaatagctgcattgatcttaca

SEQ ID NO: 399864 - DNA, 25 bp, Homo sapien
aatagctgcattgatcttacatgag

SEQ ID NO: 399865 - DNA, 25 bp, Homo sapien
gctgcattgatcttacatgagcata

SEQ ID NO: 399866 - DNA, 25 bp, Homo sapien
tgcattgatcttacatgagcataat

SEQ ID NO: 399867 - DNA, 25 bp, Homo sapien
gatcttacatgagcataatcatcct

SEQ ID NO: 399868 - DNA, 25 bp, Homo sapien
gagcataatcatccttatacttcat

SEQ ID NO: 399869 - DNA, 25 bp, Homo sapien
catatgtatatgtttagtgacaaat

SEQ ID NO: 399870 - DNA, 25 bp, Homo sapien
gtgacaaatcatataaaaccattca

SEQ ID NO: 399871 - DNA, 25 bp, Homo sapien
gttttagtgactaattcaggatgaa

SEQ ID NO: 399872 - DNA, 25 bp, Homo sapien
tcaattcttcctgccctgttattaa

SEQ ID NO: 399873 - DNA, 25 bp, Homo sapien
ttcctgccctgttattaattaagat

SEQ ID NO: 399874 - DNA, 25 bp, Homo sapien
acagaaaaatcctgcctaaggcaaa

SEQ ID NO: 399875 - DNA, 25 bp, Homo sapien
gggttaagtaatagatttccagcta

SEQ ID NO: 399876 - DNA, 25 bp, Homo sapien
agatttccagctaaattggtctaaa

SEQ ID NO: 399877 - DNA, 25 bp, Homo sapien
aagtgtggacagacctatttcaaag

SEQ ID NO: 399878 - DNA, 25 bp, Homo sapien
gcttaattgatctcacttgttttag

SEQ ID NO: 399879 - DNA, 25 bp, Homo sapien
acttgttttagttctgatccaggga

SEQ ID NO: 399880 - DNA, 25 bp, Homo sapien
agttctgatccagggagatcacccc

SEQ ID NO: 399881 - DNA, 25 bp, Homo sapien
gagatcacccctctaattatttctg

SEQ ID NO: 399882 - DNA, 25 bp, Homo sapien
acccctctaattatttctgaacttg

SEQ ID NO: 399883 - DNA, 25 bp, Homo sapien
gctacaagtcctccggcttcatcga

SEQ ID NO: 399884 - DNA, 25 bp, Homo sapien
gacctgctccacgacaagtggtaca

SEQ ID NO: 399885 - DNA, 25 bp, Homo sapien
ggtacaagatggtgccttgcggcaa

SEQ ID NO: 399886 - DNA, 25 bp, Homo sapien
tgccttgcggcaagcgggtctttgc

SEQ ID NO: 399887 - DNA, 25 bp, Homo sapien
aagcgggtctttgcggttacagaga

SEQ ID NO: 399888 - DNA, 25 bp, Homo sapien
ttgcggttacagagaccctgcagat

SEQ ID NO: 399889 - DNA, 25 bp, Homo sapien
agagaccctgcagatgagcatctac

SEQ ID NO: 399890 - DNA, 25 bp, Homo sapien
gatgagcatctaccacttcgcgggc

SEQ ID NO: 399891 - DNA, 25 bp, Homo sapien
gggcctcttcgtgttgctgtgcctg

SEQ ID NO: 399892 - DNA, 25 bp, Homo sapien
tgggcagcgctctgctcagctcgct

SEQ ID NO: 399893 - DNA, 25 bp, Homo sapien
agcaggctgcagtactggctgcaca

SEQ ID NO: 399894 - DNA, 25 bp, Homo sapien
gaccgcgggtgccagggcgacccag

SEQ ID NO: 399895 - DNA, 25 bp, Homo sapien
accgcgggtgccagggcgacccagg

SEQ ID NO: 399896 - DNA, 25 bp, Homo sapien
gggtgccagggcgacccaggctgcg

SEQ ID NO: 399897 - DNA, 25 bp, Homo sapien
ggtgccagggcgacccaggctgcgg

SEQ ID NO: 399898 - DNA, 25 bp, Homo sapien
gtgccagggcgacccaggctgcggc

SEQ ID NO: 399899 - DNA, 25 bp, Homo sapien
gccagggcgacccaggctgcggctc

SEQ ID NO: 399900 - DNA, 25 bp, Homo sapien
cgcgccggccctgtgccttgcagag

SEQ ID NO: 399901 - DNA, 25 bp, Homo sapien
tgccgctgcggaccgcgcgggtggc

SEQ ID NO: 399902 - DNA, 25 bp, Homo sapien
cgctgcggaccgcgcgggtggcgac

SEQ ID NO: 399903 - DNA, 25 bp, Homo sapien
tggcgaccgcgggtgccagggcgac

SEQ ID NO: 399904 - DNA, 25 bp, Homo sapien
ggcgaccgcgggtgccagggcgacc

SEQ ID NO: 399905 - DNA, 25 bp, Homo sapien
tttcccagagaccttctgatctcca

SEQ ID NO: 399906 - DNA, 25 bp, Homo sapien
gaccttctgatctccaaaaagagga

SEQ ID NO: 399907 - DNA, 25 bp, Homo sapien
agaggagatgactacatttagcccc

SEQ ID NO: 399908 - DNA, 25 bp, Homo sapien
taattccaggtagataactgcattt

SEQ ID NO: 399909 - DNA, 25 bp, Homo sapien
agctgtttcctcacgtccatcactg

SEQ ID NO: 399910 - DNA, 25 bp, Homo sapien
tcacgtccatcactggctctctaat

SEQ ID NO: 399911 - DNA, 25 bp, Homo sapien
ggctctctaattccacttgttcatt

SEQ ID NO: 399912 - DNA, 25 bp, Homo sapien
aattccacttgttcattctgtgacc

SEQ ID NO: 399913 - DNA, 25 bp, Homo sapien
acttgttcattctgtgaccctagtt

SEQ ID NO: 399914 - DNA, 25 bp, Homo sapien
gttcattctgtgaccctagttattt

SEQ ID NO: 399915 - DNA, 25 bp, Homo sapien
ctgtgaccctagttattttctgaaa

SEQ ID NO: 399916 - DNA, 25 bp, Homo sapien
atctctttgctgcattgtcttactc

SEQ ID NO: 399917 - DNA, 25 bp, Homo sapien
tttgctgcattgtcttactctgtcc

SEQ ID NO: 399918 - DNA, 25 bp, Homo sapien
tactctgtcccagcagtaattgaca

SEQ ID NO: 399919 - DNA, 25 bp, Homo sapien
gtaattgacagttaccactctccgg

SEQ ID NO: 399920 - DNA, 25 bp, Homo sapien
ttgacagttaccactctccggaagt

SEQ ID NO: 399921 - DNA, 25 bp, Homo sapien
ccactctccggaagtggtctgtcat

SEQ ID NO: 399922 - DNA, 25 bp, Homo sapien
gtcatcttgcttcccgggcactgtg

SEQ ID NO: 399923 - DNA, 25 bp, Homo sapien
tgttttctatcagcttctctagcca

SEQ ID NO: 399924 - DNA, 25 bp, Homo sapien
tcaggttatctcttccattctcttg

SEQ ID NO: 399925 - DNA, 25 bp, Homo sapien
atctcttccattctcttggtattac

SEQ ID NO: 399926 - DNA, 25 bp, Homo sapien
tggtattacatagcatccatgtgtt

SEQ ID NO: 399927 - DNA, 25 bp, Homo sapien
catctggtggccaaagagaatcgta

SEQ ID NO: 399928 - DNA, 25 bp, Homo sapien
tctggtggccaaagagaatcgtagc

SEQ ID NO: 399929 - DNA, 25 bp, Homo sapien
gtggccaaagagaatcgtagcccca

SEQ ID NO: 399930 - DNA, 25 bp, Homo sapien
caaagagaatcgtagccccagagct

SEQ ID NO: 399931 - DNA, 25 bp, Homo sapien
aaagagaatcgtagccccagagctg

SEQ ID NO: 399932 - DNA, 25 bp, Homo sapien
agagaatcgtagccccagagctgcc

SEQ ID NO: 399933 - DNA, 25 bp, Homo sapien
tgatgccccatctacagcaggaggt

SEQ ID NO: 399934 - DNA, 25 bp, Homo sapien
atgccccatctacagcaggaggtca

SEQ ID NO: 399935 - DNA, 25 bp, Homo sapien
aggaggtcaggaccacgcccctggc

SEQ ID NO: 399936 - DNA, 25 bp, Homo sapien
gggtctgtgtcacctccatctcagt

SEQ ID NO: 399937 - DNA, 25 bp, Homo sapien
ctgtgtcacctccatctcagtcttg

SEQ ID NO: 399938 - DNA, 25 bp, Homo sapien
tcatctatggtaacaccgatcggcc

SEQ ID NO: 399939 - DNA, 25 bp, Homo sapien
catctatggtaacaccgatcggccc

SEQ ID NO: 399940 - DNA, 25 bp, Homo sapien
atctatggtaacaccgatcggccct

SEQ ID NO: 399941 - DNA, 25 bp, Homo sapien
tctatggtaacaccgatcggccctc

SEQ ID NO: 399942 - DNA, 25 bp, Homo sapien
tatggtaacaccgatcggccctcag

SEQ ID NO: 399943 - DNA, 25 bp, Homo sapien
atggtaacaccgatcggccctcagg

SEQ ID NO: 399944 - DNA, 25 bp, Homo sapien
tggtaacaccgatcggccctcaggg

SEQ ID NO: 399945 - DNA, 25 bp, Homo sapien
gtacactggtaccggcaacttcccg

SEQ ID NO: 399946 - DNA, 25 bp, Homo sapien
tggtaccggcaacttcccggcacag

SEQ ID NO: 399947 - DNA, 25 bp, Homo sapien
ggtaccggcaacttcccggcacagc

SEQ ID NO: 399948 - DNA, 25 bp, Homo sapien
gtaccggcaacttcccggcacagcc

SEQ ID NO: 399949 - DNA, 25 bp, Homo sapien
acttcccaagtttttgcatgtaaca

SEQ ID NO: 399950 - DNA, 25 bp, Homo sapien
gaaacaatgcccagttcccctaaag

SEQ ID NO: 399951 - DNA, 25 bp, Homo sapien
ccaatggtggcagatagatcagatt

SEQ ID NO: 399952 - DNA, 25 bp, Homo sapien
ttagatgtcttttggcagagacaac

SEQ ID NO: 399953 - DNA, 25 bp, Homo sapien
gcccagttcccctaaagacaagaga

SEQ ID NO: 399954 - DNA, 25 bp, Homo sapien
gagacaactggttatgccacacttc

SEQ ID NO: 399955 - DNA, 25 bp, Homo sapien
atgccacacttcagcatacctattg

SEQ ID NO: 399956 - DNA, 25 bp, Homo sapien
ttcagcatacctattgcctacaacc

SEQ ID NO: 399957 - DNA, 25 bp, Homo sapien
tattgcctacaaccttgttctgcat

SEQ ID NO: 399958 - DNA, 25 bp, Homo sapien
aaccttgttctgcatttcccatgag

SEQ ID NO: 399959 - DNA, 25 bp, Homo sapien
gacaagagatgtgaaggagcccaga

SEQ ID NO: 399960 - DNA, 25 bp, Homo sapien
tatggcacaaacttcagactctagg

SEQ ID NO: 399961 - DNA, 25 bp, Homo sapien
aacttcagactctaggctgaccata

SEQ ID NO: 399962 - DNA, 25 bp, Homo sapien
taggctgaccatatacaacgtgaga

SEQ ID NO: 399963 - DNA, 25 bp, Homo sapien
cctgtgcgtcagtgtgaaaatgcct

SEQ ID NO: 399964 - DNA, 25 bp, Homo sapien
gtgaaaatgcctttgctgataattt

SEQ ID NO: 399965 - DNA, 25 bp, Homo sapien
caaatgagtaaaatccacggcaagc

SEQ ID NO: 399966 - DNA, 25 bp, Homo sapien
ccacggcaagcaaccatatgtctgt

SEQ ID NO: 399967 - DNA, 25 bp, Homo sapien
atgtctgtaattgctgtgcactctc

SEQ ID NO: 399968 - DNA, 25 bp, Homo sapien
gtaattgctgtgcactctcattcag

SEQ ID NO: 399969 - DNA, 25 bp, Homo sapien
tctcattcagctagcaccatttggt

SEQ ID NO: 399970 - DNA, 25 bp, Homo sapien
gcaccatttggtgtgtgcagaaatc

SEQ ID NO: 399971 - DNA, 25 bp, Homo sapien
gggcacctggaaattcacctacaat

SEQ ID NO: 399972 - DNA, 25 bp, Homo sapien
gaaattcacctacaatcccatggac

SEQ ID NO: 399973 - DNA, 25 bp, Homo sapien
atggaccctctggactacaaggatc

SEQ ID NO: 399974 - DNA, 25 bp, Homo sapien
gtgcctggaagtttcagatcttgta

SEQ ID NO: 399975 - DNA, 25 bp, Homo sapien
ttgtagaggacgcagtctccatctc

SEQ ID NO: 399976 - DNA, 25 bp, Homo sapien
ggacctttctcttctgaatctgctt

SEQ ID NO: 399977 - DNA, 25 bp, Homo sapien
gaatctgcttccctgcagtttagat

SEQ ID NO: 399978 - DNA, 25 bp, Homo sapien
cctgcagtttagatcccgggatggc

SEQ ID NO: 399979 - DNA, 25 bp, Homo sapien
ctgagaaagcaacccgaaccagctg

SEQ ID NO: 399980 - DNA, 25 bp, Homo sapien
gacagctcggtgttcagcttacaga

SEQ ID NO: 399981 - DNA, 25 bp, Homo sapien
gggacagctcacaggtctagtgatt

SEQ ID NO: 399982 - DNA, 25 bp, Homo sapien
gggtgggatagctgatgccctcctt

SEQ ID NO: 399983 - DNA, 25 bp, Homo sapien
tgtggaatctgctggctcttcatca

SEQ ID NO: 399984 - DNA, 25 bp, Homo sapien
ggcttcatttcccaataaaggagtg

SEQ ID NO: 399985 - DNA, 25 bp, Homo sapien
tcatttcccaataaaggagtgactt

SEQ ID NO: 399986 - DNA, 25 bp, Homo sapien
gagtgacttcaatcatcccagcaat

SEQ ID NO: 399987 - DNA, 25 bp, Homo sapien
tcccagcaatcacttggttcacatt

SEQ ID NO: 399988 - DNA, 25 bp, Homo sapien
ccagcaatcacttggttcacattca

SEQ ID NO: 399989 - DNA, 25 bp, Homo sapien
agcaatcacttggttcacattcatt

SEQ ID NO: 399990 - DNA, 25 bp, Homo sapien
aatcacttggttcacattcattcag

SEQ ID NO: 399991 - DNA, 25 bp, Homo sapien
ctggctcttcatcagattgggcaga

SEQ ID NO: 399992 - DNA, 25 bp, Homo sapien
agaggaccataagcactgcttccca

SEQ ID NO: 399993 - DNA, 25 bp, Homo sapien
aatctgtatagtcgtcttcaccctt

SEQ ID NO: 399994 - DNA, 25 bp, Homo sapien
acccttctactaatctcctatggag

SEQ ID NO: 399995 - DNA, 25 bp, Homo sapien
atggagtcatcctaaactcccttaa

SEQ ID NO: 399996 - DNA, 25 bp, Homo sapien
ataaagtcctgtttacctgcagctc

SEQ ID NO: 399997 - DNA, 25 bp, Homo sapien
tgcagctcccacattatcgtctttg

SEQ ID NO: 399998 - DNA, 25 bp, Homo sapien
attatcgtctttgccctcttttttg

SEQ ID NO: 399999 - DNA, 25 bp, Homo sapien
ttcatgtatgttagacctgtttcaa

SEQ ID NO: 400000 - DNA, 25 bp, Homo sapien
gacctgtttcaaacatccttttgat

SEQ ID NO: 400001 - DNA, 25 bp, Homo sapien
tccttttgataaattcctgacagtg

SEQ ID NO: 400002 - DNA, 25 bp, Homo sapien
gttttatacagttatcacacccatg

SEQ ID NO: 400003 - DNA, 25 bp, Homo sapien
cacacccatgttgaatcctttaata

SEQ ID NO: 400004 - DNA, 25 bp, Homo sapien
acatctgatctaaagactggctcca

SEQ ID NO: 400005 - DNA, 25 bp, Homo sapien
ggctgccaggattatgcagtccact

SEQ ID NO: 400006 - DNA, 25 bp, Homo sapien
gcagtccacttggtctaccttaatt

SEQ ID NO: 400007 - DNA, 25 bp, Homo sapien
ttaacctgtggccaaactcagagat

SEQ ID NO: 400008 - DNA, 25 bp, Homo sapien
aagcatgaccagagccagggaccct

SEQ ID NO: 400009 - DNA, 25 bp, Homo sapien
agccagggaccctgtggctctgatc

SEQ ID NO: 400010 - DNA, 25 bp, Homo sapien
accccatgtgcctcaggactagagt

SEQ ID NO: 400011 - DNA, 25 bp, Homo sapien
gagtgagcaatcataccttataaat

SEQ ID NO: 400012 - DNA, 25 bp, Homo sapien
aaatgacttttgtgcctttctgctc

SEQ ID NO: 400013 - DNA, 25 bp, Homo sapien
tctgctccagtctcaaaatttccta

SEQ ID NO: 400014 - DNA, 25 bp, Homo sapien
aaaatttcctacacctgccagttct

SEQ ID NO: 400015 - DNA, 25 bp, Homo sapien
ttacaacgacagatacagatacgat

SEQ ID NO: 400016 - DNA, 25 bp, Homo sapien
tacaacgacagatacagatacgatg

SEQ ID NO: 400017 - DNA, 25 bp, Homo sapien
acaacgacagatacagatacgatga

SEQ ID NO: 400018 - DNA, 25 bp, Homo sapien
caacgacagatacagatacgatgag

SEQ ID NO: 400019 - DNA, 25 bp, Homo sapien
aacgacagatacagatacgatgaga

SEQ ID NO: 400020 - DNA, 25 bp, Homo sapien
tgtcactggggcagcaacgtcctgg

SEQ ID NO: 400021 - DNA, 25 bp, Homo sapien
cactggggcagcaacgtcctgggtc

SEQ ID NO: 400022 - DNA, 25 bp, Homo sapien
actggggcagcaacgtcctgggtcc

SEQ ID NO: 400023 - DNA, 25 bp, Homo sapien
tggggcagcaacgtcctgggtccta

SEQ ID NO: 400024 - DNA, 25 bp, Homo sapien
gggcagcaacgtcctgggtcctaag

SEQ ID NO: 400025 - DNA, 25 bp, Homo sapien
tgggtcctaagtccgtggctcgtat

SEQ ID NO: 400026 - DNA, 25 bp, Homo sapien
gtttgtgctgtagacttgctgctgc

SEQ ID NO: 400027 - DNA, 25 bp, Homo sapien
ttgctgctgctgaatcctttctggg

SEQ ID NO: 400028 - DNA, 25 bp, Homo sapien
gagcagagggcttctcgttcatgca

SEQ ID NO: 400029 - DNA, 25 bp, Homo sapien
cgttcatgcaccctttgcctgaaca

SEQ ID NO: 400030 - DNA, 25 bp, Homo sapien
tttgcctgaacacccatgtagctgc

SEQ ID NO: 400031 - DNA, 25 bp, Homo sapien
atgtagctgctgtgttgtgtatata

SEQ ID NO: 400032 - DNA, 25 bp, Homo sapien
cttacagtgatttcaattgcaccat

SEQ ID NO: 400033 - DNA, 25 bp, Homo sapien
aattgcaccatgacttcttcactaa

SEQ ID NO: 400034 - DNA, 25 bp, Homo sapien
atgacttcttcactaaaaccacaaa

SEQ ID NO: 400035 - DNA, 25 bp, Homo sapien
cacaaagtcctgcttaaaactatgg

SEQ ID NO: 400036 - DNA, 25 bp, Homo sapien
ctaacctgattagagccttgactat

SEQ ID NO: 400037 - DNA, 25 bp, Homo sapien
aagtgggtggctttttgcgatatcc

SEQ ID NO: 400038 - DNA, 25 bp, Homo sapien
gtgggtggctttttgcgatatccag

SEQ ID NO: 400039 - DNA, 25 bp, Homo sapien
aaatcacagtggtttgtgtgaggct

SEQ ID NO: 400040 - DNA, 25 bp, Homo sapien
cacagtggtttgtgtgaggcttgtc

SEQ ID NO: 400041 - DNA, 25 bp, Homo sapien
gggtggctttttgcgatatccagaa

SEQ ID NO: 400042 - DNA, 25 bp, Homo sapien
gaggcttgtcatgttttgtttgggt

SEQ ID NO: 400043 - DNA, 25 bp, Homo sapien
ggcttgtcatgttttgtttgggtga

SEQ ID NO: 400044 - DNA, 25 bp, Homo sapien
ggctttttgcgatatccagaataat

SEQ ID NO: 400045 - DNA, 25 bp, Homo sapien
aaatatggacatgtttactggatct

SEQ ID NO: 400046 - DNA, 25 bp, Homo sapien
atatggacatgtttactggatcttt

SEQ ID NO: 400047 - DNA, 25 bp, Homo sapien
ttgcgatatccagaataatttaaga

SEQ ID NO: 400048 - DNA, 25 bp, Homo sapien
ctttggcaaagtgtcgcaacaaggt

SEQ ID NO: 400049 - DNA, 25 bp, Homo sapien
aaagtgtcgcaacaaggttccctca

SEQ ID NO: 400050 - DNA, 25 bp, Homo sapien
gtcgcaacaaggttccctcaaggat

SEQ ID NO: 400051 - DNA, 25 bp, Homo sapien
aacaaggttccctcaaggatgccat

SEQ ID NO: 400052 - DNA, 25 bp, Homo sapien
aaggttccctcaaggatgccatacc

SEQ ID NO: 400053 - DNA, 25 bp, Homo sapien
caaggatgccataccctgtgaggaa

SEQ ID NO: 400054 - DNA, 25 bp, Homo sapien
tcatcttggtgctccctctccgggt

SEQ ID NO: 400055 - DNA, 25 bp, Homo sapien
tccctctccgggtggagggtgctcc

SEQ ID NO: 400056 - DNA, 25 bp, Homo sapien
ggtgctcccggagagattgccagcc

SEQ ID NO: 400057 - DNA, 25 bp, Homo sapien
tcccggagagattgccagcctgcag

SEQ ID NO: 400058 - DNA, 25 bp, Homo sapien
gagattgccagcctgcaggagtcat

SEQ ID NO: 400059 - DNA, 25 bp, Homo sapien
tcagttggtcgctcctccgaatagg

SEQ ID NO: 400060 - DNA, 25 bp, Homo sapien
agttggtcgctcctccgaataggac

SEQ ID NO: 400061 - DNA, 25 bp, Homo sapien
ctgagggccgatcggtgttaccata

SEQ ID NO: 400062 - DNA, 25 bp, Homo sapien
agggccgatcggtgttaccatagat

SEQ ID NO: 400063 - DNA, 25 bp, Homo sapien
ggccgatcggtgttaccatagatga

SEQ ID NO: 400064 - DNA, 25 bp, Homo sapien
ttggtcgctcctccgaataggacac

SEQ ID NO: 400065 - DNA, 25 bp, Homo sapien
gtgccgggaagttgccggtaccagt

SEQ ID NO: 400066 - DNA, 25 bp, Homo sapien
cagtgcaggagaaggtgacactctc

SEQ ID NO: 400067 - DNA, 25 bp, Homo sapien
tgcaggagaaggtgacactctcccc

SEQ ID NO: 400068 - DNA, 25 bp, Homo sapien
tccgaataggacaccactcaggctg

SEQ ID NO: 400069 - DNA, 25 bp, Homo sapien
tcaggctgctgtcataggacttgca

SEQ ID NO: 400070 - DNA, 25 bp, Homo sapien
gcctaattgatactatagaaaagat

SEQ ID NO: 400071 - DNA, 25 bp, Homo sapien
tagaaaagatgcgttctaaccaggt

SEQ ID NO: 400072 - DNA, 25 bp, Homo sapien
agaaaagatgcgttctaaccaggtg

SEQ ID NO: 400073 - DNA, 25 bp, Homo sapien
gaaaagatgcgttctaaccaggtgc

SEQ ID NO: 400074 - DNA, 25 bp, Homo sapien
aaaagatgcgttctaaccaggtgct

SEQ ID NO: 400075 - DNA, 25 bp, Homo sapien
aaagatgcgttctaaccaggtgctg

SEQ ID NO: 400076 - DNA, 25 bp, Homo sapien
aagatgcgttctaaccaggtgctgt

SEQ ID NO: 400077 - DNA, 25 bp, Homo sapien
agatgcgttctaaccaggtgctgtg

SEQ ID NO: 400078 - DNA, 25 bp, Homo sapien
atgcgttctaaccaggtgctgtggc

SEQ ID NO: 400079 - DNA, 25 bp, Homo sapien
ggccaggctttgagacaagcccggc

SEQ ID NO: 400080 - DNA, 25 bp, Homo sapien
caggctttgagacaagcccggccaa

SEQ ID NO: 400081 - DNA, 25 bp, Homo sapien
attgacctggttctttgtagaacca

SEQ ID NO: 400082 - DNA, 25 bp, Homo sapien
ataaagatcctctatcccataccat

SEQ ID NO: 400083 - DNA, 25 bp, Homo sapien
ggctgcaatattttctgtgcaccag

SEQ ID NO: 400084 - DNA, 25 bp, Homo sapien
ttctgtgcaccagaaagtcttcctt

SEQ ID NO: 400085 - DNA, 25 bp, Homo sapien
agtcttccttgatatttcgtcttca

SEQ ID NO: 400086 - DNA, 25 bp, Homo sapien
atttcgtcttcagttgttacagtta

SEQ ID NO: 400087 - DNA, 25 bp, Homo sapien
gttacagttagctttactctgcgta

SEQ ID NO: 400088 - DNA, 25 bp, Homo sapien
tactctgcgtaaatgcactttagtt

SEQ ID NO: 400089 - DNA, 25 bp, Homo sapien
tggtgtgaaccatttttgtggtctt

SEQ ID NO: 400090 - DNA, 25 bp, Homo sapien
tggtcttatttctctaacacattat

SEQ ID NO: 400091 - DNA, 25 bp, Homo sapien
atgcccatataacaaattttcccag

SEQ ID NO: 400092 - DNA, 25 bp, Homo sapien
tccagattgtgagccgccaatatca

SEQ ID NO: 400093 - DNA, 25 bp, Homo sapien
attgtgagccgccaatatcatcacc

SEQ ID NO: 400094 - DNA, 25 bp, Homo sapien
ttgtgagccgccaatatcatcacca

SEQ ID NO: 400095 - DNA, 25 bp, Homo sapien
caatatcatcaccaggaggagtgtt

SEQ ID NO: 400096 - DNA, 25 bp, Homo sapien
tatcatcaccaggaggagtgtttaa

SEQ ID NO: 400097 - DNA, 25 bp, Homo sapien
catcaccaggaggagtgtttaatga

SEQ ID NO: 400098 - DNA, 25 bp, Homo sapien
caggaggagtgtttaatgatggatt

SEQ ID NO: 400099 - DNA, 25 bp, Homo sapien
taatgatggatttaggcttacggta

SEQ ID NO: 400100 - DNA, 25 bp, Homo sapien
gattttggagcaaaggcggaacaat

SEQ ID NO: 400101 - DNA, 25 bp, Homo sapien
aaggcggaacaataagcagcatatc

SEQ ID NO: 400102 - DNA, 25 bp, Homo sapien
ggcggaacaataagcagcatatcta

SEQ ID NO: 400103 - DNA, 25 bp, Homo sapien
ggcagaaattaatcagctcccaatg

SEQ ID NO: 400104 - DNA, 25 bp, Homo sapien
gcagaaattaatcagctcccaatgg

SEQ ID NO: 400105 - DNA, 25 bp, Homo sapien
gaaattaatcagctcccaatgggag

SEQ ID NO: 400106 - DNA, 25 bp, Homo sapien
aaattaatcagctcccaatgggagc

SEQ ID NO: 400107 - DNA, 25 bp, Homo sapien
gcttctgccaaatttcattcctcaa

SEQ ID NO: 400108 - DNA, 25 bp, Homo sapien
atttcattcctcaaacctttcagga

SEQ ID NO: 400109 - DNA, 25 bp, Homo sapien
tttcattcctcaaacctttcaggag

SEQ ID NO: 400110 - DNA, 25 bp, Homo sapien
ttcattcctcaaacctttcaggagg

SEQ ID NO: 400111 - DNA, 25 bp, Homo sapien
tcattcctcaaacctttcaggaggg

SEQ ID NO: 400112 - DNA, 25 bp, Homo sapien
ttcctcaaacctttcaggaggggtg

SEQ ID NO: 400113 - DNA, 25 bp, Homo sapien
tcaggaggggtggttggcgtttcta

SEQ ID NO: 400114 - DNA, 25 bp, Homo sapien
aggagccagccttgtgaagtgccaa

SEQ ID NO: 400115 - DNA, 25 bp, Homo sapien
gagccagccttgtgaagtgccaagt

SEQ ID NO: 400116 - DNA, 25 bp, Homo sapien
gccagccttgtgaagtgccaagtcc

SEQ ID NO: 400117 - DNA, 25 bp, Homo sapien
ccagccttgtgaagtgccaagtccc

SEQ ID NO: 400118 - DNA, 25 bp, Homo sapien
cttgtgaagtgccaagtccccctct

SEQ ID NO: 400119 - DNA, 25 bp, Homo sapien
cccctctgatatttcctgtgtgtga

SEQ ID NO: 400120 - DNA, 25 bp, Homo sapien
cctctgatatttcctgtgtgtgaca

SEQ ID NO: 400121 - DNA, 25 bp, Homo sapien
tctgatatttcctgtgtgtgacatc

SEQ ID NO: 400122 - DNA, 25 bp, Homo sapien
gatatttcctgtgtgtgacatcatt

SEQ ID NO: 400123 - DNA, 25 bp, Homo sapien
atatttcctgtgtgtgacatcattg

SEQ ID NO: 400124 - DNA, 25 bp, Homo sapien
accctcagacatgtcttgtctgctg

SEQ ID NO: 400125 - DNA, 25 bp, Homo sapien
cagtttccaactgttttggctcagt

SEQ ID NO: 400126 - DNA, 25 bp, Homo sapien
ttggctcagttttcatccatgacac

SEQ ID NO: 400127 - DNA, 25 bp, Homo sapien
cagccattctcctgtgggagcaaga

SEQ ID NO: 400128 - DNA, 25 bp, Homo sapien
gagggcatctccatgcttgtgggac

SEQ ID NO: 400129 - DNA, 25 bp, Homo sapien
tctctggccctacaaaagttttcct

SEQ ID NO: 400130 - DNA, 25 bp, Homo sapien
agttttcctaattgtctgatcttta

SEQ ID NO: 400131 - DNA, 25 bp, Homo sapien
gtgcattcaggttatggcacctgga

SEQ ID NO: 400132 - DNA, 25 bp, Homo sapien
gaggaatgccctttatcttttgaag

SEQ ID NO: 400133 - DNA, 25 bp, Homo sapien
ggatttcccatctcaaccctggatt

SEQ ID NO: 400134 - DNA, 25 bp, Homo sapien
tggattcctcaccttcagaacgagc

SEQ ID NO: 400135 - DNA, 25 bp, Homo sapien
cctgccactgtctccaataaaatgt

SEQ ID NO: 400136 - DNA, 25 bp, Homo sapien
gaggacaatatcctgtactcacaca

SEQ ID NO: 400137 - DNA, 25 bp, Homo sapien
ggacaatatcctgtactcacacatg

SEQ ID NO: 400138 - DNA, 25 bp, Homo sapien
gacaatatcctgtactcacacatgg

SEQ ID NO: 400139 - DNA, 25 bp, Homo sapien
acaatatcctgtactcacacatggt

SEQ ID NO: 400140 - DNA, 25 bp, Homo sapien
aatatcctgtactcacacatggtgg

SEQ ID NO: 400141 - DNA, 25 bp, Homo sapien
atatcctgtactcacacatggtgga

SEQ ID NO: 400142 - DNA, 25 bp, Homo sapien
tatcctgtactcacacatggtggac

SEQ ID NO: 400143 - DNA, 25 bp, Homo sapien
aattcgatgggccccagcaggacgc

SEQ ID NO: 400144 - DNA, 25 bp, Homo sapien
gatgggccccagcaggacgcccagg

SEQ ID NO: 400145 - DNA, 25 bp, Homo sapien
agatcatcgactcccacttcacgta

SEQ ID NO: 400146 - DNA, 25 bp, Homo sapien
cgtacgccaccgacacgaagaacat

SEQ ID NO: 400147 - DNA, 25 bp, Homo sapien
cccaggatgtggaccccaggcctga

SEQ ID NO: 400148 - DNA, 25 bp, Homo sapien
tggtgctgcatctgcaatgaggatg

SEQ ID NO: 400149 - DNA, 25 bp, Homo sapien
tgcatctgcaatgaggatgccaccc

SEQ ID NO: 400150 - DNA, 25 bp, Homo sapien
gtgcccgctgcttccgagagggcca

SEQ ID NO: 400151 - DNA, 25 bp, Homo sapien
ttccgagagggccatgatgcctttg

SEQ ID NO: 400152 - DNA, 25 bp, Homo sapien
gatgcctttgagcttaaagagcacc

SEQ ID NO: 400153 - DNA, 25 bp, Homo sapien
aaagagcaccagacatctgcctact

SEQ ID NO: 400154 - DNA, 25 bp, Homo sapien
agagcaccagacatctgcctactct

SEQ ID NO: 400155 - DNA, 25 bp, Homo sapien
tctcctccacgtgcaggccaagagc

SEQ ID NO: 400156 - DNA, 25 bp, Homo sapien
agcactgaagacaccctggtcctcc

SEQ ID NO: 400157 - DNA, 25 bp, Homo sapien
tggtcctcccggaagggcagtccca

SEQ ID NO: 400158 - DNA, 25 bp, Homo sapien
cgtgtaccgctttgtgtgtgacctg

SEQ ID NO: 400159 - DNA, 25 bp, Homo sapien
taccgctttgtgtgtgacctgcaga

SEQ ID NO: 400160 - DNA, 25 bp, Homo sapien
ccgctttgtgtgtgacctgcagagc

SEQ ID NO: 400161 - DNA, 25 bp, Homo sapien
ctgaggagctgcacgccatgctgga

SEQ ID NO: 400162 - DNA, 25 bp, Homo sapien
agctgcacgccatgctggacgtcaa

SEQ ID NO: 400163 - DNA, 25 bp, Homo sapien
acgccatgctggacgtcaagccaga

SEQ ID NO: 400164 - DNA, 25 bp, Homo sapien
gtcaagccagatgccgacgagtgat

SEQ ID NO: 400165 - DNA, 25 bp, Homo sapien
gatgccgacgagtgatggcactgaa

SEQ ID NO: 400166 - DNA, 25 bp, Homo sapien
ggttggactctgaattttgaattgt

SEQ ID NO: 400167 - DNA, 25 bp, Homo sapien
gggagctaagtcagttgcagctgta

SEQ ID NO: 400168 - DNA, 25 bp, Homo sapien
agctaagtcagttgcagctgtaatc

SEQ ID NO: 400169 - DNA, 25 bp, Homo sapien
agaaggctttctccacctgtggccc

SEQ ID NO: 400170 - DNA, 25 bp, Homo sapien
gtggtgtctctcttctatgggacaa

SEQ ID NO: 400171 - DNA, 25 bp, Homo sapien
gtgtctctcttctatgggacaatta

SEQ ID NO: 400172 - DNA, 25 bp, Homo sapien
cttctatgggacaattattggtctc

SEQ ID NO: 400173 - DNA, 25 bp, Homo sapien
tacttgtgcccattgacgaatcata

SEQ ID NO: 400174 - DNA, 25 bp, Homo sapien
gcccattgacgaatcataacactgt

SEQ ID NO: 400175 - DNA, 25 bp, Homo sapien
taacactgtgaaggacactgtcatg

SEQ ID NO: 400176 - DNA, 25 bp, Homo sapien
aaccctgggcagagtcttcagcaca

SEQ ID NO: 400177 - DNA, 25 bp, Homo sapien
ctgggcagagtcttcagcacaaaga

SEQ ID NO: 400178 - DNA, 25 bp, Homo sapien
atagttggcattttaccgttattga

SEQ ID NO: 400179 - DNA, 25 bp, Homo sapien
ggcattttaccgttattgaatttag

SEQ ID NO: 400180 - DNA, 25 bp, Homo sapien
ggcttcatttcccaataaaggagtg

SEQ ID NO: 400181 - DNA, 25 bp, Homo sapien
tcatttcccaataaaggagtgactt

SEQ ID NO: 400182 - DNA, 25 bp, Homo sapien
tcccagcaatcacttggttcacatt

SEQ ID NO: 400183 - DNA, 25 bp, Homo sapien
cccagcaatcacttggttcacattc

SEQ ID NO: 400184 - DNA, 25 bp, Homo sapien
ccagcaatcacttggttcacattca

SEQ ID NO: 400185 - DNA, 25 bp, Homo sapien
cagcaatcacttggttcacattcat

SEQ ID NO: 400186 - DNA, 25 bp, Homo sapien
agcaatcacttggttcacattcatt

SEQ ID NO: 400187 - DNA, 25 bp, Homo sapien
gcaatcacttggttcacattcattc

SEQ ID NO: 400188 - DNA, 25 bp, Homo sapien
caatcacttggttcacattcattca

SEQ ID NO: 400189 - DNA, 25 bp, Homo sapien
aatcacttggttcacattcattcag

SEQ ID NO: 400190 - DNA, 25 bp, Homo sapien
gagatcttttggttattataagagg

SEQ ID NO: 400191 - DNA, 25 bp, Homo sapien
agatcttttggttattataagaggg

SEQ ID NO: 400192 - DNA, 25 bp, Homo sapien
gatcttttggttattataagaggga

SEQ ID NO: 400193 - DNA, 25 bp, Homo sapien
tattataagagggagttttcctgca

SEQ ID NO: 400194 - DNA, 25 bp, Homo sapien
aagagggagttttcctgcacaagcc

SEQ ID NO: 400195 - DNA, 25 bp, Homo sapien
ggagttttcctgcacaagccctcat

SEQ ID NO: 400196 - DNA, 25 bp, Homo sapien
gagttttcctgcacaagccctcatt

SEQ ID NO: 400197 - DNA, 25 bp, Homo sapien
agttttcctgcacaagccctcattt

SEQ ID NO: 400198 - DNA, 25 bp, Homo sapien
ttttcctgcacaagccctcattttg

SEQ ID NO: 400199 - DNA, 25 bp, Homo sapien
tatataagatgtgatttgctgctcc

SEQ ID NO: 400200 - DNA, 25 bp, Homo sapien
gtgatttgctgctccttgccttccg

SEQ ID NO: 400201 - DNA, 25 bp, Homo sapien
aattgtctcctccattccaagaatt

SEQ ID NO: 400202 - DNA, 25 bp, Homo sapien
ccattccaagaattccatcgtcaga

SEQ ID NO: 400203 - DNA, 25 bp, Homo sapien
tgtgtcatcatctcccaggaatgga

SEQ ID NO: 400204 - DNA, 25 bp, Homo sapien
gtgtcatcatctcccaggaatggag

SEQ ID NO: 400205 - DNA, 25 bp, Homo sapien
gtcatcatctcccaggaatggagtg

SEQ ID NO: 400206 - DNA, 25 bp, Homo sapien
catcatctcccaggaatggagtggt

SEQ ID NO: 400207 - DNA, 25 bp, Homo sapien
tcatctcccaggaatggagtggtgg

SEQ ID NO: 400208 - DNA, 25 bp, Homo sapien
tctcccaggaatggagtggtggcat

SEQ ID NO: 400209 - DNA, 25 bp, Homo sapien
atggagtggtggcatcagtgatgta

SEQ ID NO: 400210 - DNA, 25 bp, Homo sapien
gggacattcatagtgccctgtggag

SEQ ID NO: 400211 - DNA, 25 bp, Homo sapien
catagtgccctgtggaggctgcgca

SEQ ID NO: 400212 - DNA, 25 bp, Homo sapien
agcagttcctgactttacggccaga

SEQ ID NO: 400213 - DNA, 25 bp, Homo sapien
tgactttacggccagatcagcagct

SEQ ID NO: 400214 - DNA, 25 bp, Homo sapien
ggccagatcagcagctccacatctt

SEQ ID NO: 400215 - DNA, 25 bp, Homo sapien
acatcttcaacacgctgcggtctca

SEQ ID NO: 400216 - DNA, 25 bp, Homo sapien
gctgcggtctcatctgatcgacaaa

SEQ ID NO: 400217 - DNA, 25 bp, Homo sapien
atctgatcgacaaagggatgctgac

SEQ ID NO: 400218 - DNA, 25 bp, Homo sapien
agggatgctgacatccaccacagag

SEQ ID NO: 400219 - DNA, 25 bp, Homo sapien
catccaccacagaggacgagtaggg

SEQ ID NO: 400220 - DNA, 25 bp, Homo sapien
ccagctggtgtgacttagacaatga

SEQ ID NO: 400221 - DNA, 25 bp, Homo sapien
gacttagacaatgacgaggcttcaa

SEQ ID NO: 400222 - DNA, 25 bp, Homo sapien
gaggcttcaactcactgtctttttt

SEQ ID NO: 400223 - DNA, 25 bp, Homo sapien
cctgaccgattcagtggcagcgggt

SEQ ID NO: 400224 - DNA, 25 bp, Homo sapien
ctgaccgattcagtggcagcgggtc

SEQ ID NO: 400225 - DNA, 25 bp, Homo sapien
tgaccgattcagtggcagcgggtct

SEQ ID NO: 400226 - DNA, 25 bp, Homo sapien
gaccgattcagtggcagcgggtctg

SEQ ID NO: 400227 - DNA, 25 bp, Homo sapien
accgattcagtggcagcgggtctgg

SEQ ID NO: 400228 - DNA, 25 bp, Homo sapien
ccgattcagtggcagcgggtctggg

SEQ ID NO: 400229 - DNA, 25 bp, Homo sapien
cgattcagtggcagcgggtctggga

SEQ ID NO: 400230 - DNA, 25 bp, Homo sapien
cctgcaggctgaagatgtggcagtt

SEQ ID NO: 400231 - DNA, 25 bp, Homo sapien
tgcaggctgaagatgtggcagttta

SEQ ID NO: 400232 - DNA, 25 bp, Homo sapien
gcaggctgaagatgtggcagtttat

SEQ ID NO: 400233 - DNA, 25 bp, Homo sapien
aggctgaagatgtggcagtttatta

SEQ ID NO: 400234 - DNA, 25 bp, Homo sapien
ttacaacgacagatacagatacgat

SEQ ID NO: 400235 - DNA, 25 bp, Homo sapien
tacaacgacagatacagatacgatg

SEQ ID NO: 400236 - DNA, 25 bp, Homo sapien
acaacgacagatacagatacgatga

SEQ ID NO: 400237 - DNA, 25 bp, Homo sapien
caacgacagatacagatacgatgag

SEQ ID NO: 400238 - DNA, 25 bp, Homo sapien
aacgacagatacagatacgatgaga

SEQ ID NO: 400239 - DNA, 25 bp, Homo sapien
ctgtcactggggcagcaacgtcctg

SEQ ID NO: 400240 - DNA, 25 bp, Homo sapien
tgtcactggggcagcaacgtcctgg

SEQ ID NO: 400241 - DNA, 25 bp, Homo sapien
cactggggcagcaacgtcctgggtc

SEQ ID NO: 400242 - DNA, 25 bp, Homo sapien
actggggcagcaacgtcctgggtcc

SEQ ID NO: 400243 - DNA, 25 bp, Homo sapien
tggggcagcaacgtcctgggtccta

SEQ ID NO: 400244 - DNA, 25 bp, Homo sapien
gggcagcaacgtcctgggtcctaag

SEQ ID NO: 400245 - DNA, 25 bp, Homo sapien
gttcacgccggagcgaagccttaca

SEQ ID NO: 400246 - DNA, 25 bp, Homo sapien
acgccggagcgaagccttacaagtg

SEQ ID NO: 400247 - DNA, 25 bp, Homo sapien
agccttacaagtgttgggagtgtga

SEQ ID NO: 400248 - DNA, 25 bp, Homo sapien
caagtgttgggagtgtgagaaaacc

SEQ ID NO: 400249 - DNA, 25 bp, Homo sapien
gtgagaaaacctcccacaagtcgcg

SEQ ID NO: 400250 - DNA, 25 bp, Homo sapien
acaagtcgcgcctcatcgagcacct

SEQ ID NO: 400251 - DNA, 25 bp, Homo sapien
cctgcggctgcagggaatgcggaaa

SEQ ID NO: 400252 - DNA, 25 bp, Homo sapien
aagtcacacctcatcctgcgtcaga

SEQ ID NO: 400253 - DNA, 25 bp, Homo sapien
tcacacctcatcctgcgtcagagga

SEQ ID NO: 400254 - DNA, 25 bp, Homo sapien
tcatcctgcgtcagaggactcacac

SEQ ID NO: 400255 - DNA, 25 bp, Homo sapien
gagaagccctgcgactgcgcggagt

SEQ ID NO: 400256 - DNA, 25 bp, Homo sapien
tctttaatcttacatagctgaacga

SEQ ID NO: 400257 - DNA, 25 bp, Homo sapien
atagctgaacgaattcattggctca

SEQ ID NO: 400258 - DNA, 25 bp, Homo sapien
gaacgaattcattggctcagtattt

SEQ ID NO: 400259 - DNA, 25 bp, Homo sapien
gaattcattggctcagtatttttaa

SEQ ID NO: 400260 - DNA, 25 bp, Homo sapien
attggctcagtatttttaagataac

SEQ ID NO: 400261 - DNA, 25 bp, Homo sapien
actagtcagtatatactgttctgta

SEQ ID NO: 400262 - DNA, 25 bp, Homo sapien
ctgttctgtaacttaaaagatgacc

SEQ ID NO: 400263 - DNA, 25 bp, Homo sapien
gacctgaaaattaacaggccctctc

SEQ ID NO: 400264 - DNA, 25 bp, Homo sapien
tatcccccaccgaagagggctcaga

SEQ ID NO: 400265 - DNA, 25 bp, Homo sapien
gcttaaatgtactggaacgtttgtc

SEQ ID NO: 400266 - DNA, 25 bp, Homo sapien
tactggaacgtttgtcagtgagttt

SEQ ID NO: 400267 - DNA, 25 bp, Homo sapien
ctggccagctcagcatattcttaag

SEQ ID NO: 400268 - DNA, 25 bp, Homo sapien
ggccagctcagcatattcttaagta

SEQ ID NO: 400269 - DNA, 25 bp, Homo sapien
gccagctcagcatattcttaagtag

SEQ ID NO: 400270 - DNA, 25 bp, Homo sapien
cagctcagcatattcttaagtagga

SEQ ID NO: 400271 - DNA, 25 bp, Homo sapien
gctcagcatattcttaagtaggatt

SEQ ID NO: 400272 - DNA, 25 bp, Homo sapien
tcagcatattcttaagtaggattca

SEQ ID NO: 400273 - DNA, 25 bp, Homo sapien
cacatttaattcttggtattataag

SEQ ID NO: 400274 - DNA, 25 bp, Homo sapien
ttaattcttggtattataagttgca

SEQ ID NO: 400275 - DNA, 25 bp, Homo sapien
ataagttgcaaccatttgatttaga

SEQ ID NO: 400276 - DNA, 25 bp, Homo sapien
gttgcaaccatttgatttagaatgt

SEQ ID NO: 400277 - DNA, 25 bp, Homo sapien
ttgatttagaatgtatgcagctctc

SEQ ID NO: 400278 - DNA, 25 bp, Homo sapien
tttaagggcattgttctttctagtt

SEQ ID NO: 400279 - DNA, 25 bp, Homo sapien
agggcattgttctttctagtttatt

SEQ ID NO: 400280 - DNA, 25 bp, Homo sapien
gcattgttctttctagtttatttct

SEQ ID NO: 400281 - DNA, 25 bp, Homo sapien
aacagttccattgtcgtttctgaaa

SEQ ID NO: 400282 - DNA, 25 bp, Homo sapien
cagttccattgtcgtttctgaaaac

SEQ ID NO: 400283 - DNA, 25 bp, Homo sapien
tccattgtcgtttctgaaaactaca

SEQ ID NO: 400284 - DNA, 25 bp, Homo sapien
gaaaactacagtattctcagaagtt

SEQ ID NO: 400285 - DNA, 25 bp, Homo sapien
tattctcagaagttgtagcagcagt

SEQ ID NO: 400286 - DNA, 25 bp, Homo sapien
tgttaaaccaatttgtaagttactg

SEQ ID NO: 400287 - DNA, 25 bp, Homo sapien
attacacttctaaaaagctgaattt

SEQ ID NO: 400288 - DNA, 25 bp, Homo sapien
atttatactcatgtcctaaaggaga

SEQ ID NO: 400289 - DNA, 25 bp, Homo sapien
agcttagggaagacccggcactgca

SEQ ID NO: 400290 - DNA, 25 bp, Homo sapien
cctcatctctcttggttattcacaa

SEQ ID NO: 400291 - DNA, 25 bp, Homo sapien
aatttgagtctaagggcaaggcacc

SEQ ID NO: 400292 - DNA, 25 bp, Homo sapien
agggcaaggcacctttgtcagttgc

SEQ ID NO: 400293 - DNA, 25 bp, Homo sapien
tgtcagttgcccattccattactaa

SEQ ID NO: 400294 - DNA, 25 bp, Homo sapien
ggactttctttttcattcaagcctg

SEQ ID NO: 400295 - DNA, 25 bp, Homo sapien
aaatgctgcaacctgacatcccagc

SEQ ID NO: 400296 - DNA, 25 bp, Homo sapien
atcccagcaggcagttttcactatt

SEQ ID NO: 400297 - DNA, 25 bp, Homo sapien
actattgtactaactactccatctg

SEQ ID NO: 400298 - DNA, 25 bp, Homo sapien
actccatctgttatgaaggtcacaa

SEQ ID NO: 400299 - DNA, 25 bp, Homo sapien
tggagtgatttattgtcttggctat

SEQ ID NO: 400300 - DNA, 25 bp, Homo sapien
gtttagcttgagatgggacttggtc

SEQ ID NO: 400301 - DNA, 25 bp, Homo sapien
gggacttggtcttagagctagttct

SEQ ID NO: 400302 - DNA, 25 bp, Homo sapien
gagctagttctaaaggttgtttact

SEQ ID NO: 400303 - DNA, 25 bp, Homo sapien
tttacttttctagggaggagtctgc

SEQ ID NO: 400304 - DNA, 25 bp, Homo sapien
gtctgctactagtcttatcagctct

SEQ ID NO: 400305 - DNA, 25 bp, Homo sapien
tagtcttatcagctcttaaaaacag

SEQ ID NO: 400306 - DNA, 25 bp, Homo sapien
aactcatctgtccaagttcgtggca

SEQ ID NO: 400307 - DNA, 25 bp, Homo sapien
cgtggcagaaaggaacgtccttgtg

SEQ ID NO: 400308 - DNA, 25 bp, Homo sapien
gaagacctttatctgagccactgta

SEQ ID NO: 400309 - DNA, 25 bp, Homo sapien
tgtacttcgttatcactgccatgca

SEQ ID NO: 400310 - DNA, 25 bp, Homo sapien
tgttctgcagctcaaattccatttt

SEQ ID NO: 400311 - DNA, 25 bp, Homo sapien
caacatgaagatgatatgaggccgg

SEQ ID NO: 400312 - DNA, 25 bp, Homo sapien
aacatgaagatgatatgaggccggg

SEQ ID NO: 400313 - DNA, 25 bp, Homo sapien
tgaagatgatatgaggccggggcgg

SEQ ID NO: 400314 - DNA, 25 bp, Homo sapien
ggggaaggggcctggccgccacctg

SEQ ID NO: 400315 - DNA, 25 bp, Homo sapien
ctacccttctacacacgttctcttt

SEQ ID NO: 400316 - DNA, 25 bp, Homo sapien
tacccttctacacacgttctctttc

SEQ ID NO: 400317 - DNA, 25 bp, Homo sapien
acccttctacacacgttctctttct

SEQ ID NO: 400318 - DNA, 25 bp, Homo sapien
ttctacacacgttctctttctccct

SEQ ID NO: 400319 - DNA, 25 bp, Homo sapien
tctacacacgttctctttctccctc

SEQ ID NO: 400320 - DNA, 25 bp, Homo sapien
cgacgcgccccgcaagttcaacatg

SEQ ID NO: 400321 - DNA, 25 bp, Homo sapien
gcgccccgcaagttcaacatgaaga

SEQ ID NO: 400322 - DNA, 25 bp, Homo sapien
ttatactccatacctgcttttccca

SEQ ID NO: 400323 - DNA, 25 bp, Homo sapien
atggccgccctacggaaaatcccat

SEQ ID NO: 400324 - DNA, 25 bp, Homo sapien
cggaaaatcccatccacagaggcca

SEQ ID NO: 400325 - DNA, 25 bp, Homo sapien
tgagctgggcctttcctttatgaac

SEQ ID NO: 400326 - DNA, 25 bp, Homo sapien
atcctcccagccagctacagtaggg

SEQ ID NO: 400327 - DNA, 25 bp, Homo sapien
agccagctacagtagggcctcctca

SEQ ID NO: 400328 - DNA, 25 bp, Homo sapien
tagacagtgtcagcactcatctcct

SEQ ID NO: 400329 - DNA, 25 bp, Homo sapien
ttccccattgacctttgtggtcttc

SEQ ID NO: 400330 - DNA, 25 bp, Homo sapien
acctttgtggtcttctgtgattatt

SEQ ID NO: 400331 - DNA, 25 bp, Homo sapien
ctgtgattatttatgctgcctccca

SEQ ID NO: 400332 - DNA, 25 bp, Homo sapien
tgctgcctcccaaggatagaattga

SEQ ID NO: 400333 - DNA, 25 bp, Homo sapien
tcccggtccatgagcacctggtgaa

SEQ ID NO: 400334 - DNA, 25 bp, Homo sapien
acctggtgaatctcctgcaccatct

SEQ ID NO: 400335 - DNA, 25 bp, Homo sapien
acctgcagggagaagggctcgatcc

SEQ ID NO: 400336 - DNA, 25 bp, Homo sapien
atcttcacagaaaagcccgtgtcct

SEQ ID NO: 400337 - DNA, 25 bp, Homo sapien
gaaaagcccgtgtcctgaatgacaa

SEQ ID NO: 400338 - DNA, 25 bp, Homo sapien
gtgtcctgaatgacaatgacttcct

SEQ ID NO: 400339 - DNA, 25 bp, Homo sapien
tcgacgtgcgcagctccgagaagtg

SEQ ID NO: 400340 - DNA, 25 bp, Homo sapien
tggccggtggtctcatctcccgggc

SEQ ID NO: 400341 - DNA, 25 bp, Homo sapien
gggccggcctcgtcaagcccatttt

SEQ ID NO: 400342 - DNA, 25 bp, Homo sapien
agctccgagaagtggtccagcacgt

SEQ ID NO: 400343 - DNA, 25 bp, Homo sapien
agcacgttgccatccaggtgcagtg

SEQ ID NO: 400344 - DNA, 25 bp, Homo sapien
aaaggaatgattgatagcggagtgc

SEQ ID NO: 400345 - DNA, 25 bp, Homo sapien
agcggagtgcatatagagctagagc

SEQ ID NO: 400346 - DNA, 25 bp, Homo sapien
atccttgaactctgcaaatcctttc

SEQ ID NO: 400347 - DNA, 25 bp, Homo sapien
tattgtgtgaatatctaggcaaaac

SEQ ID NO: 400348 - DNA, 25 bp, Homo sapien
tgaactctgcaaatcctttcttcca

SEQ ID NO: 400349 - DNA, 25 bp, Homo sapien
tctgcaaatcctttcttccatttta

SEQ ID NO: 400350 - DNA, 25 bp, Homo sapien
gcaaatcctttcttccattttaata

SEQ ID NO: 400351 - DNA, 25 bp, Homo sapien
aacataacaatttggctcaattttc

SEQ ID NO: 400352 - DNA, 25 bp, Homo sapien
gctcaattttcttctttagaggatt

SEQ ID NO: 400353 - DNA, 25 bp, Homo sapien
ttcttctttagaggattcgtgctgt

SEQ ID NO: 400354 - DNA, 25 bp, Homo sapien
gaggattcgtgctgtttttgttcat

SEQ ID NO: 400355 - DNA, 25 bp, Homo sapien
agtctgctactagtcttatcagctc

SEQ ID NO: 400356 - DNA, 25 bp, Homo sapien
gtctgctactagtcttatcagctct

SEQ ID NO: 400357 - DNA, 25 bp, Homo sapien
gctactagtcttatcagctcttaaa

SEQ ID NO: 400358 - DNA, 25 bp, Homo sapien
tactagtcttatcagctcttaaaaa

SEQ ID NO: 400359 - DNA, 25 bp, Homo sapien
tgtacttcgttatcactgccatgca

SEQ ID NO: 400360 - DNA, 25 bp, Homo sapien
tacttcgttatcactgccatgcagt

SEQ ID NO: 400361 - DNA, 25 bp, Homo sapien
acttcgttatcactgccatgcagtt

SEQ ID NO: 400362 - DNA, 25 bp, Homo sapien
ttcgttatcactgccatgcagttta

SEQ ID NO: 400363 - DNA, 25 bp, Homo sapien
cgttatcactgccatgcagtttaca

SEQ ID NO: 400364 - DNA, 25 bp, Homo sapien
gctgttctgcagctcaaattccatt

SEQ ID NO: 400365 - DNA, 25 bp, Homo sapien
tgttctgcagctcaaattccatttt

SEQ ID NO: 400366 - DNA, 25 bp, Homo sapien
aaaaaacataagtgattgcagaatt

SEQ ID NO: 400367 - DNA, 25 bp, Homo sapien
aaaaacataagtgattgcagaattt

SEQ ID NO: 400368 - DNA, 25 bp, Homo sapien
aaacataagtgattgcagaattttg

SEQ ID NO: 400369 - DNA, 25 bp, Homo sapien
aacataagtgattgcagaattttgt

SEQ ID NO: 400370 - DNA, 25 bp, Homo sapien
acataagtgattgcagaattttgtt

SEQ ID NO: 400371 - DNA, 25 bp, Homo sapien
tgcagaattttgttcttctcataat

SEQ ID NO: 400372 - DNA, 25 bp, Homo sapien
gcagaattttgttcttctcataatt

SEQ ID NO: 400373 - DNA, 25 bp, Homo sapien
cagaattttgttcttctcataattt

SEQ ID NO: 400374 - DNA, 25 bp, Homo sapien
aattttgttcttctcataatttctg

SEQ ID NO: 400375 - DNA, 25 bp, Homo sapien
attttgttcttctcataatttctgg

SEQ ID NO: 400376 - DNA, 25 bp, Homo sapien
ttttgttcttctcataatttctggt

SEQ ID NO: 400377 - DNA, 25 bp, Homo sapien
gaatcatgtacagcattcagaatgc

SEQ ID NO: 400378 - DNA, 25 bp, Homo sapien
gtgaagaggcacaccggacttagac

SEQ ID NO: 400379 - DNA, 25 bp, Homo sapien
ggcacaccggacttagacatgctaa

SEQ ID NO: 400380 - DNA, 25 bp, Homo sapien
aaagtctcagattcaagtcctctca

SEQ ID NO: 400381 - DNA, 25 bp, Homo sapien
agtcctctcatctcatgctcatgtt

SEQ ID NO: 400382 - DNA, 25 bp, Homo sapien
gttcatcctggtaaataacttcact

SEQ ID NO: 400383 - DNA, 25 bp, Homo sapien
tggtaaataacttcactttggtgta

SEQ ID NO: 400384 - DNA, 25 bp, Homo sapien
cactttggtgtaaaacctcattgag

SEQ ID NO: 400385 - DNA, 25 bp, Homo sapien
cattgagtggaattgtgagcaaact

SEQ ID NO: 400386 - DNA, 25 bp, Homo sapien
gtgagcaaacttttgtactgtttat

SEQ ID NO: 400387 - DNA, 25 bp, Homo sapien
cttcctggtcaagtttgcatagtta

SEQ ID NO: 400388 - DNA, 25 bp, Homo sapien
gcttcattgccaccagcatctgctg

SEQ ID NO: 400389 - DNA, 25 bp, Homo sapien
gacatcctgaagaccacgtgccagc

SEQ ID NO: 400390 - DNA, 25 bp, Homo sapien
cacgtgccagctccgtcaggacagg

SEQ ID NO: 400391 - DNA, 25 bp, Homo sapien
gcggcatgatccagcactgcgagca

SEQ ID NO: 400392 - DNA, 25 bp, Homo sapien
gcgagcagtaccagtttgtgcacca

SEQ ID NO: 400393 - DNA, 25 bp, Homo sapien
taccagtttgtgcaccacgtcatga

SEQ ID NO: 400394 - DNA, 25 bp, Homo sapien
accacgtcatgagcctctacgaaaa

SEQ ID NO: 400395 - DNA, 25 bp, Homo sapien
gagcctctacgaaaagcagctgtcc

SEQ ID NO: 400396 - DNA, 25 bp, Homo sapien
accagtccccagaatgactgcgctt

SEQ ID NO: 400397 - DNA, 25 bp, Homo sapien
tgcgcttctcctacaaggttctctg

SEQ ID NO: 400398 - DNA, 25 bp, Homo sapien
tacaaggttctctgggcactgccag

SEQ ID NO: 400399 - DNA, 25 bp, Homo sapien
aagggtgtcagtggcataacttcag

SEQ ID NO: 400400 - DNA, 25 bp, Homo sapien
gcataacttcaggaagacccaggga

SEQ ID NO: 400401 - DNA, 25 bp, Homo sapien
gtgcttgggtaggtgaaactgtcat

SEQ ID NO: 400402 - DNA, 25 bp, Homo sapien
agtttgagactcatggctgtaggca

SEQ ID NO: 400403 - DNA, 25 bp, Homo sapien
ggctgtaggcaccatccaaggccaa

SEQ ID NO: 400404 - DNA, 25 bp, Homo sapien
ccaaggccaattttccaattctgga

SEQ ID NO: 400405 - DNA, 25 bp, Homo sapien
gaatcttagaatacctcacaagtgt

SEQ ID NO: 400406 - DNA, 25 bp, Homo sapien
aaatgtgctttttagtgtctccttt

SEQ ID NO: 400407 - DNA, 25 bp, Homo sapien
tagtgtctcctttatctcagtgtgt

SEQ ID NO: 400408 - DNA, 25 bp, Homo sapien
atctcagtgtgtttatgatctgtca

SEQ ID NO: 400409 - DNA, 25 bp, Homo sapien
acaaaaagggactcgggtgtctgag

SEQ ID NO: 400410 - DNA, 25 bp, Homo sapien
aaaatcagtctgataagtctttgat

SEQ ID NO: 400411 - DNA, 25 bp, Homo sapien
gataagtccattgaatttgcttctg

SEQ ID NO: 400412 - DNA, 25 bp, Homo sapien
ccattgaatttgcttctgattactt

SEQ ID NO: 400413 - DNA, 25 bp, Homo sapien
gtagctaaacatgtatgtactccta

SEQ ID NO: 400414 - DNA, 25 bp, Homo sapien
gtatgtactcctatgattacaatga

SEQ ID NO: 400415 - DNA, 25 bp, Homo sapien
tgattacaatgaacactcctctcca

SEQ ID NO: 400416 - DNA, 25 bp, Homo sapien
gaacactcctctccatttaaattaa

SEQ ID NO: 400417 - DNA, 25 bp, Homo sapien
atgactaaatactgtcttggttttt

SEQ ID NO: 400418 - DNA, 25 bp, Homo sapien
tactgtcttggttttttcgttccag

SEQ ID NO: 400419 - DNA, 25 bp, Homo sapien
gttttttcgttccaggtcagtcaat

SEQ ID NO: 400420 - DNA, 25 bp, Homo sapien
ttcgttccaggtcagtcaatattaa

SEQ ID NO: 400421 - DNA, 25 bp, Homo sapien
atgtggaatctgtatgtctttgctc

SEQ ID NO: 400422 - DNA, 25 bp, Homo sapien
gtggaatctgtatgtctttgctctg

SEQ ID NO: 400423 - DNA, 25 bp, Homo sapien
ggaatctgtatgtctttgctctgat

SEQ ID NO: 400424 - DNA, 25 bp, Homo sapien
gaatctgtatgtctttgctctgatg

SEQ ID NO: 400425 - DNA, 25 bp, Homo sapien
tctgtatgtctttgctctgatgttc

SEQ ID NO: 400426 - DNA, 25 bp, Homo sapien
gctctgatgttcttgtatgcaccat

SEQ ID NO: 400427 - DNA, 25 bp, Homo sapien
tgatgttcttgtatgcaccatccca

SEQ ID NO: 400428 - DNA, 25 bp, Homo sapien
atgttcttgtatgcaccatcccata

SEQ ID NO: 400429 - DNA, 25 bp, Homo sapien
gttcttgtatgcaccatcccataaa

SEQ ID NO: 400430 - DNA, 25 bp, Homo sapien
tcttgtatgcaccatcccataaaaa

SEQ ID NO: 400431 - DNA, 25 bp, Homo sapien
aactatggagaagaccagtccaatg

SEQ ID NO: 400432 - DNA, 25 bp, Homo sapien
tccgcttcctgattatcgacgaggc

SEQ ID NO: 400433 - DNA, 25 bp, Homo sapien
tatcgacgaggctgaccggatgatt

SEQ ID NO: 400434 - DNA, 25 bp, Homo sapien
tgaccggatgattgacagcatgcat

SEQ ID NO: 400435 - DNA, 25 bp, Homo sapien
gacagcatgcatcagtcctggctgc

SEQ ID NO: 400436 - DNA, 25 bp, Homo sapien
tggcggccgccttccagagcgagga

SEQ ID NO: 400437 - DNA, 25 bp, Homo sapien
ctgtgccctgctccagcgaaggcag

SEQ ID NO: 400438 - DNA, 25 bp, Homo sapien
tgtgacagccgccagcacctgctgt

SEQ ID NO: 400439 - DNA, 25 bp, Homo sapien
tgcagaagctgctcttctcagctac

SEQ ID NO: 400440 - DNA, 25 bp, Homo sapien
tcttctcagctactctgacccagaa

SEQ ID NO: 400441 - DNA, 25 bp, Homo sapien
gggaagtatgcctttcctgttgggc

SEQ ID NO: 400442 - DNA, 25 bp, Homo sapien
atgcctttcctgttgggctcacgca

SEQ ID NO: 400443 - DNA, 25 bp, Homo sapien
tgctcagcagcccttgatgatggca

SEQ ID NO: 400444 - DNA, 25 bp, Homo sapien
agcagcccttgatgatggcacactg

SEQ ID NO: 400445 - DNA, 25 bp, Homo sapien
gatgatggcacactggccggtcttt

SEQ ID NO: 400446 - DNA, 25 bp, Homo sapien
actggccggtcttttgtgcttcctg

SEQ ID NO: 400447 - DNA, 25 bp, Homo sapien
gccggtcttttgtgcttcctgctgg

SEQ ID NO: 400448 - DNA, 25 bp, Homo sapien
tgggtcacccattgctcccaaagca

SEQ ID NO: 400449 - DNA, 25 bp, Homo sapien
ttgctggccaagtgctccaggtggt

SEQ ID NO: 400450 - DNA, 25 bp, Homo sapien
ctccaggtggtcagcacctagacat

SEQ ID NO: 400451 - DNA, 25 bp, Homo sapien
gtggtcagcacctagacatgctcct

SEQ ID NO: 400452 - DNA, 25 bp, Homo sapien
gggctcccttgggataacgtgcacc

SEQ ID NO: 400453 - DNA, 25 bp, Homo sapien
ggataacgtgcaccctttcctaggg

SEQ ID NO: 400454 - DNA, 25 bp, Homo sapien
gaacgcgcttgacccaaagccgtgg

SEQ ID NO: 400455 - DNA, 25 bp, Homo sapien
aacgcgcttgacccaaagccgtggc

SEQ ID NO: 400456 - DNA, 25 bp, Homo sapien
acgcgcttgacccaaagccgtggcg

SEQ ID NO: 400457 - DNA, 25 bp, Homo sapien
gcgcttgacccaaagccgtggcgca

SEQ ID NO: 400458 - DNA, 25 bp, Homo sapien
cgcttgacccaaagccgtggcgcac

SEQ ID NO: 400459 - DNA, 25 bp, Homo sapien
gcttgacccaaagccgtggcgcacg

SEQ ID NO: 400460 - DNA, 25 bp, Homo sapien
cttgacccaaagccgtggcgcacgt

SEQ ID NO: 400461 - DNA, 25 bp, Homo sapien
ttgacccaaagccgtggcgcacgtg

SEQ ID NO: 400462 - DNA, 25 bp, Homo sapien
gacccaaagccgtggcgcacgtgga

SEQ ID NO: 400463 - DNA, 25 bp, Homo sapien
ttaagctggagcctcggtagccgtt

SEQ ID NO: 400464 - DNA, 25 bp, Homo sapien
tgcccaaacgcgctgtccgccctga

SEQ ID NO: 400465 - DNA, 25 bp, Homo sapien
aaggagaggacttcaccacgtactg

SEQ ID NO: 400466 - DNA, 25 bp, Homo sapien
gaggacttcaccacgtactgcaatt

SEQ ID NO: 400467 - DNA, 25 bp, Homo sapien
cgtactgcaattcctcaactacttt

SEQ ID NO: 400468 - DNA, 25 bp, Homo sapien
atgctactcatcacatcaatgttgg

SEQ ID NO: 400469 - DNA, 25 bp, Homo sapien
acagtggtataagcaaaggcctggt

SEQ ID NO: 400470 - DNA, 25 bp, Homo sapien
caaaggcctggtggacatcccgttt

SEQ ID NO: 400471 - DNA, 25 bp, Homo sapien
ctgacatttcagtttggagaagcaa

SEQ ID NO: 400472 - DNA, 25 bp, Homo sapien
atcaatgttggtcttatggatgcaa

SEQ ID NO: 400473 - DNA, 25 bp, Homo sapien
atggatgcaattgtcacaggtgaat

SEQ ID NO: 400474 - DNA, 25 bp, Homo sapien
cacaggtgaatggacaacaggtaat

SEQ ID NO: 400475 - DNA, 25 bp, Homo sapien
gcaaattcctcagtaccagcatgta

SEQ ID NO: 400476 - DNA, 25 bp, Homo sapien
tcagccatttctaaattcagtccat

SEQ ID NO: 400477 - DNA, 25 bp, Homo sapien
gccatttctaaattcagtccatata

SEQ ID NO: 400478 - DNA, 25 bp, Homo sapien
cagtccatataaattcactttgggt

SEQ ID NO: 400479 - DNA, 25 bp, Homo sapien
aagagcaggtatgatctcaatgaat

SEQ ID NO: 400480 - DNA, 25 bp, Homo sapien
gatctcaatgaatatagtgtggtaa

SEQ ID NO: 400481 - DNA, 25 bp, Homo sapien
agtgtggtaatttctgcctaatacc

SEQ ID NO: 400482 - DNA, 25 bp, Homo sapien
taatttctgcctaatacctaccctt

SEQ ID NO: 400483 - DNA, 25 bp, Homo sapien
tgcctaatacctacccttttggagg

SEQ ID NO: 400484 - DNA, 25 bp, Homo sapien
gaggaaggaaaggtaatcctgtttg

SEQ ID NO: 400485 - DNA, 25 bp, Homo sapien
tggttgattttaaagccatctgctt

SEQ ID NO: 400486 - DNA, 25 bp, Homo sapien
atctgcttctggtggactttaccat

SEQ ID NO: 400487 - DNA, 25 bp, Homo sapien
gaacgcgcttgacccaaagccgtgg

SEQ ID NO: 400488 - DNA, 25 bp, Homo sapien
aacgcgcttgacccaaagccgtggc

SEQ ID NO: 400489 - DNA, 25 bp, Homo sapien
acgcgcttgacccaaagccgtggcg

SEQ ID NO: 400490 - DNA, 25 bp, Homo sapien
cgcgcttgacccaaagccgtggcgc

SEQ ID NO: 400491 - DNA, 25 bp, Homo sapien
gcgcttgacccaaagccgtggcgca

SEQ ID NO: 400492 - DNA, 25 bp, Homo sapien
cgcttgacccaaagccgtggcgcac

SEQ ID NO: 400493 - DNA, 25 bp, Homo sapien
gcttgacccaaagccgtggcgcacg

SEQ ID NO: 400494 - DNA, 25 bp, Homo sapien
cttgacccaaagccgtggcgcacgt

SEQ ID NO: 400495 - DNA, 25 bp, Homo sapien
ttgacccaaagccgtggcgcacgtg

SEQ ID NO: 400496 - DNA, 25 bp, Homo sapien
cagtcaccaaaagcaccagctaaaa

SEQ ID NO: 400497 - DNA, 25 bp, Homo sapien
gacttccaacctaagattgtcctgg

SEQ ID NO: 400498 - DNA, 25 bp, Homo sapien
gattgtcctggaaacttaattctta

SEQ ID NO: 400499 - DNA, 25 bp, Homo sapien
gaaacttaattcttatcttggctca

SEQ ID NO: 400500 - DNA, 25 bp, Homo sapien
atcttggctcatctcttcaaaacag

SEQ ID NO: 400501 - DNA, 25 bp, Homo sapien
aacagatgcctctttcgttggtgac

SEQ ID NO: 400502 - DNA, 25 bp, Homo sapien
gttggtgacctcagatacactgttc

SEQ ID NO: 400503 - DNA, 25 bp, Homo sapien
tacactgttcagaagtactcaaagt

SEQ ID NO: 400504 - DNA, 25 bp, Homo sapien
ttctcacatttgagagtcactctag

SEQ ID NO: 400505 - DNA, 25 bp, Homo sapien
taatgagttaagcaagccagccctg

SEQ ID NO: 400506 - DNA, 25 bp, Homo sapien
gtctaaccttactttgatctgatga

SEQ ID NO: 400507 - DNA, 25 bp, Homo sapien
cattttgcaggaggctaagtgtaag

SEQ ID NO: 400508 - DNA, 25 bp, Homo sapien
cataaagtctttaattttgagcacc

SEQ ID NO: 400509 - DNA, 25 bp, Homo sapien
tgagcaccttaccaaacataacaat

SEQ ID NO: 400510 - DNA, 25 bp, Homo sapien
aatccattatccttttggcaacacc

SEQ ID NO: 400511 - DNA, 25 bp, Homo sapien
aacaccacaaagatcgcatctgtta

SEQ ID NO: 400512 - DNA, 25 bp, Homo sapien
gtacaagttgacatgaggttagttt

SEQ ID NO: 400513 - DNA, 25 bp, Homo sapien
gttagtttaattgtacaccatgata

SEQ ID NO: 400514 - DNA, 25 bp, Homo sapien
ccatgatattggtggtatttatgct

SEQ ID NO: 400515 - DNA, 25 bp, Homo sapien
gtatttatgctgttaagtccaaacc

SEQ ID NO: 400516 - DNA, 25 bp, Homo sapien
agtccaaacctttatctgtctgtta

SEQ ID NO: 400517 - DNA, 25 bp, Homo sapien
acctttatctgtctgttattcttaa

SEQ ID NO: 400518 - DNA, 25 bp, Homo sapien
tccaacagttggcatttgccacagt

SEQ ID NO: 400519 - DNA, 25 bp, Homo sapien
gccacagtagagaccactaaccatt

SEQ ID NO: 400520 - DNA, 25 bp, Homo sapien
actaaccattccctaattgtgatga

SEQ ID NO: 400521 - DNA, 25 bp, Homo sapien
attgtgatgattttattacccagca

SEQ ID NO: 400522 - DNA, 25 bp, Homo sapien
tatctgtaaggtgctcagtctcagc

SEQ ID NO: 400523 - DNA, 25 bp, Homo sapien
agaacacttcactgcaagctctagt

SEQ ID NO: 400524 - DNA, 25 bp, Homo sapien
gcaagctctagttcagtcagttcag

SEQ ID NO: 400525 - DNA, 25 bp, Homo sapien
gaaaggctgtgaattgcccaccctg

SEQ ID NO: 400526 - DNA, 25 bp, Homo sapien
gcccaccctgatttacagcactaat

SEQ ID NO: 400527 - DNA, 25 bp, Homo sapien
taatctgaagacaaattcgcttggg

SEQ ID NO: 400528 - DNA, 25 bp, Homo sapien
gggcttatccaagggactagtctta

SEQ ID NO: 400529 - DNA, 25 bp, Homo sapien
ctgttcccacagaatgatgctcatt

SEQ ID NO: 400530 - DNA, 25 bp, Homo sapien
gaatgatgctcatttccctgttcca

SEQ ID NO: 400531 - DNA, 25 bp, Homo sapien
gatgatggatgcgttggtctttctc

SEQ ID NO: 400532 - DNA, 25 bp, Homo sapien
tacaagggcgtgtgctcccagaata

SEQ ID NO: 400533 - DNA, 25 bp, Homo sapien
gtgtgctcccagaatatgctgtaat

SEQ ID NO: 400534 - DNA, 25 bp, Homo sapien
ttggtgaagagacccagcgtttcct

SEQ ID NO: 400535 - DNA, 25 bp, Homo sapien
tctcatgcagtcgtgtggcttcttg

SEQ ID NO: 400536 - DNA, 25 bp, Homo sapien
cttcttgcccaggtttcaaagctga

SEQ ID NO: 400537 - DNA, 25 bp, Homo sapien
gaagtacattgtccttagcggctgt

SEQ ID NO: 400538 - DNA, 25 bp, Homo sapien
cttagcggctgtaacatgtctcttg

SEQ ID NO: 400539 - DNA, 25 bp, Homo sapien
atgtctcttgacagtagtgcacttg

SEQ ID NO: 400540 - DNA, 25 bp, Homo sapien
aaagaatcaggctcaaatgcactaa

SEQ ID NO: 400541 - DNA, 25 bp, Homo sapien
ggctcaaatgcactaaaagacagac

SEQ ID NO: 400542 - DNA, 25 bp, Homo sapien
gaaaattgtgtttagactactctga

SEQ ID NO: 400543 - DNA, 25 bp, Homo sapien
gactactctgaaaattcttatccct

SEQ ID NO: 400544 - DNA, 25 bp, Homo sapien
tgaaaattcttatccctataataga

SEQ ID NO: 400545 - DNA, 25 bp, Homo sapien
atctagaaaccctctgatggcatgt

SEQ ID NO: 400546 - DNA, 25 bp, Homo sapien
accctctgatggcatgtagaacttg

SEQ ID NO: 400547 - DNA, 25 bp, Homo sapien
gtagaacttgttctcagtggaaaac

SEQ ID NO: 400548 - DNA, 25 bp, Homo sapien
gtggaaaactcagtcaactaattct

SEQ ID NO: 400549 - DNA, 25 bp, Homo sapien
gtcaactaattctcaaatgtttgca

SEQ ID NO: 400550 - DNA, 25 bp, Homo sapien
gtttgcatacttaaattatacccca

SEQ ID NO: 400551 - DNA, 25 bp, Homo sapien
aatgcctaaatacatacatctctgc

SEQ ID NO: 400552 - DNA, 25 bp, Homo sapien
catctctgcatggtacaatttctca

SEQ ID NO: 400553 - DNA, 25 bp, Homo sapien
cagtgttttttctctgtttaagcag

SEQ ID NO: 400554 - DNA, 25 bp, Homo sapien
gagtcagtgatatgtgatcttcgtt

SEQ ID NO: 400555 - DNA, 25 bp, Homo sapien
gatcttcgttggtttcattttgtga

SEQ ID NO: 400556 - DNA, 25 bp, Homo sapien
attttgtgaagctcagtctgtctct

SEQ ID NO: 400557 - DNA, 25 bp, Homo sapien
ctgtctctgtaacatactttaggat

SEQ ID NO: 400558 - DNA, 25 bp, Homo sapien
taggatttgcaccttgtgctcccca

SEQ ID NO: 400559 - DNA, 25 bp, Homo sapien
tgtgctccccaggaattatgttagt

SEQ ID NO: 400560 - DNA, 25 bp, Homo sapien
agtgtccttttctatgctgtcttca

SEQ ID NO: 400561 - DNA, 25 bp, Homo sapien
aggatggacagaggcctaaaccaca

SEQ ID NO: 400562 - DNA, 25 bp, Homo sapien
cccaggtattaaagaagcccctgtg

SEQ ID NO: 400563 - DNA, 25 bp, Homo sapien
ccaggtattaaagaagcccctgtgg

SEQ ID NO: 400564 - DNA, 25 bp, Homo sapien
tgggcagtgcctccctttatcctga

SEQ ID NO: 400565 - DNA, 25 bp, Homo sapien
cagtgcctccctttatcctgacaat

SEQ ID NO: 400566 - DNA, 25 bp, Homo sapien
gtgcctccctttatcctgacaatct

SEQ ID NO: 400567 - DNA, 25 bp, Homo sapien
tccctttatcctgacaatctctagt

SEQ ID NO: 400568 - DNA, 25 bp, Homo sapien
ttgctgccaagtgcgaataaacggt

SEQ ID NO: 400569 - DNA, 25 bp, Homo sapien
gctgccaagtgcgaataaacggtgt

SEQ ID NO: 400570 - DNA, 25 bp, Homo sapien
tgccaagtgcgaataaacggtgtga

SEQ ID NO: 400571 - DNA, 25 bp, Homo sapien
ccaagtgcgaataaacggtgtgatt

SEQ ID NO: 400572 - DNA, 25 bp, Homo sapien
aagtgcgaataaacggtgtgattgc

SEQ ID NO: 400573 - DNA, 25 bp, Homo sapien
caagacacctttgaggtcctcttct

SEQ ID NO: 400574 - DNA, 25 bp, Homo sapien
agacacctttgaggtcctcttctgg

SEQ ID NO: 400575 - DNA, 25 bp, Homo sapien
acacctttgaggtcctcttctggtc

SEQ ID NO: 400576 - DNA, 25 bp, Homo sapien
tttgaggtcctcttctggtcctctg

SEQ ID NO: 400577 - DNA, 25 bp, Homo sapien
tgaggtcctcttctggtcctctgca

SEQ ID NO: 400578 - DNA, 25 bp, Homo sapien
tggtcctctgcaccagaaagcttgg

SEQ ID NO: 400579 - DNA, 25 bp, Homo sapien
tcctctgcaccagaaagcttgggag

SEQ ID NO: 400580 - DNA, 25 bp, Homo sapien
cccattgctgcattcctagtaacta

SEQ ID NO: 400581 - DNA, 25 bp, Homo sapien
ccattgctgcattcctagtaactag

SEQ ID NO: 400582 - DNA, 25 bp, Homo sapien
cctagtaactagatgtgtgctgcaa

SEQ ID NO: 400583 - DNA, 25 bp, Homo sapien
gtaactagatgtgtgctgcaaaaaa

SEQ ID NO: 400584 - DNA, 25 bp, Homo sapien
gaccgcccacgccacatggacacag

SEQ ID NO: 400585 - DNA, 25 bp, Homo sapien
ttttctctgcctttctaccgaccat

SEQ ID NO: 400586 - DNA, 25 bp, Homo sapien
tctgcctttctaccgaccatgtgac

SEQ ID NO: 400587 - DNA, 25 bp, Homo sapien
tttctaccgaccatgtgaccccgca

SEQ ID NO: 400588 - DNA, 25 bp, Homo sapien
gcctgggccctcagtggactgcctg

SEQ ID NO: 400589 - DNA, 25 bp, Homo sapien
ctgggccctcagtggactgcctgct

SEQ ID NO: 400590 - DNA, 25 bp, Homo sapien
acagcctgggctgacgtcagaggcc

SEQ ID NO: 400591 - DNA, 25 bp, Homo sapien
acgtcagaggccgaggccaggaact

SEQ ID NO: 400592 - DNA, 25 bp, Homo sapien
caggaactgagtgaggcccctggtc

SEQ ID NO: 400593 - DNA, 25 bp, Homo sapien
agtgaggcccctggtcctgggtctc

SEQ ID NO: 400594 - DNA, 25 bp, Homo sapien
tggtcctgggtctcaggatgggtcc

SEQ ID NO: 400595 - DNA, 25 bp, Homo sapien
aatttatctcagagctggttccaca

SEQ ID NO: 400596 - DNA, 25 bp, Homo sapien
gagctggttccacattagtacataa

SEQ ID NO: 400597 - DNA, 25 bp, Homo sapien
gcagctttgctctttttaacggtgg

SEQ ID NO: 400598 - DNA, 25 bp, Homo sapien
gtggcaggccattcctctgaaagat

SEQ ID NO: 400599 - DNA, 25 bp, Homo sapien
tcctctgaaagatggcctgatttat

SEQ ID NO: 400600 - DNA, 25 bp, Homo sapien
ctgatttatttcaccagttcctggt

SEQ ID NO: 400601 - DNA, 25 bp, Homo sapien
agttcctggttttgcggctcaggat

SEQ ID NO: 400602 - DNA, 25 bp, Homo sapien
tcttcatttatgtgggtcttcttgt

SEQ ID NO: 400603 - DNA, 25 bp, Homo sapien
gtgaatcgcgttgaggttactagga

SEQ ID NO: 400604 - DNA, 25 bp, Homo sapien
ttactaggaattgccatgctgccca

SEQ ID NO: 400605 - DNA, 25 bp, Homo sapien
aggcatatctatacacattttcctg

SEQ ID NO: 400606 - DNA, 25 bp, Homo sapien
tcagccatttctaaattcagtccat

SEQ ID NO: 400607 - DNA, 25 bp, Homo sapien
gccatttctaaattcagtccatata

SEQ ID NO: 400608 - DNA, 25 bp, Homo sapien
attcagtccatataaattcactttg

SEQ ID NO: 400609 - DNA, 25 bp, Homo sapien
gtccatataaattcactttgggtaa

SEQ ID NO: 400610 - DNA, 25 bp, Homo sapien
aagagcaggtatgatctcaatgaat

SEQ ID NO: 400611 - DNA, 25 bp, Homo sapien
gatctcaatgaatatagtgtggtaa

SEQ ID NO: 400612 - DNA, 25 bp, Homo sapien
agtgtggtaatttctgcctaatacc

SEQ ID NO: 400613 - DNA, 25 bp, Homo sapien
gtaatttctgcctaatacctaccct

SEQ ID NO: 400614 - DNA, 25 bp, Homo sapien
tttctgcctaatacctacccttttg

SEQ ID NO: 400615 - DNA, 25 bp, Homo sapien
tgcctaatacctacccttttggagg

SEQ ID NO: 400616 - DNA, 25 bp, Homo sapien
gaggaaggaaaggtaatcctgtttg

SEQ ID NO: 400617 - DNA, 25 bp, Homo sapien
gaatctagtgccttccgcagtgaaa

SEQ ID NO: 400618 - DNA, 25 bp, Homo sapien
tgccttccgcagtgaaaccgccaaa

SEQ ID NO: 400619 - DNA, 25 bp, Homo sapien
agtgaaaccgccaaagcccagaaga

SEQ ID NO: 400620 - DNA, 25 bp, Homo sapien
tgggaacttactacaactccagctc

SEQ ID NO: 400621 - DNA, 25 bp, Homo sapien
tcacctgcttcttctggttcattct

SEQ ID NO: 400622 - DNA, 25 bp, Homo sapien
gcttcttctggttcattctccaaat

SEQ ID NO: 400623 - DNA, 25 bp, Homo sapien
ggttcattctccaaatccccgagca

SEQ ID NO: 400624 - DNA, 25 bp, Homo sapien
gagccccgaggtggtgcaggcactg

SEQ ID NO: 400625 - DNA, 25 bp, Homo sapien
agctgctgtccacagtcaacagctc

SEQ ID NO: 400626 - DNA, 25 bp, Homo sapien
tgtccacagtcaacagctcggctgc

SEQ ID NO: 400627 - DNA, 25 bp, Homo sapien
tacagggccgagtacgaagtggacc

SEQ ID NO: 400628 - DNA, 25 bp, Homo sapien
gatgccacagccgaggaggagggcg

SEQ ID NO: 400629 - DNA, 25 bp, Homo sapien
aggaggtggcctagagccttcagtc

SEQ ID NO: 400630 - DNA, 25 bp, Homo sapien
ggaggtggcctagagccttcagtca

SEQ ID NO: 400631 - DNA, 25 bp, Homo sapien
gaggtggcctagagccttcagtcac

SEQ ID NO: 400632 - DNA, 25 bp, Homo sapien
aggtggcctagagccttcagtcact

SEQ ID NO: 400633 - DNA, 25 bp, Homo sapien
gtggcctagagccttcagtcactgg

SEQ ID NO: 400634 - DNA, 25 bp, Homo sapien
tggcctagagccttcagtcactggg

SEQ ID NO: 400635 - DNA, 25 bp, Homo sapien
ctagagccttcagtcactggggaaa

SEQ ID NO: 400636 - DNA, 25 bp, Homo sapien
aaaaatgtccgccaccttcattggc

SEQ ID NO: 400637 - DNA, 25 bp, Homo sapien
aaatgtccgccaccttcattggcaa

SEQ ID NO: 400638 - DNA, 25 bp, Homo sapien
aatgtccgccaccttcattggcaac

SEQ ID NO: 400639 - DNA, 25 bp, Homo sapien
gattttccaaaaccacagcttcagc

SEQ ID NO: 400640 - DNA, 25 bp, Homo sapien
tcagaatgtccaaatgctgtccttt

SEQ ID NO: 400641 - DNA, 25 bp, Homo sapien
gctgtcctttcccttacagagaaga

SEQ ID NO: 400642 - DNA, 25 bp, Homo sapien
gaacaatggtaactaaaagctgcat

SEQ ID NO: 400643 - DNA, 25 bp, Homo sapien
aactacattgaacggtgtgcattgt

SEQ ID NO: 400644 - DNA, 25 bp, Homo sapien
aactgctttttccaaactctgtata

SEQ ID NO: 400645 - DNA, 25 bp, Homo sapien
cttttaaatggctggaactactcgt

SEQ ID NO: 400646 - DNA, 25 bp, Homo sapien
ggctggaactactcgtataaggact

SEQ ID NO: 400647 - DNA, 25 bp, Homo sapien
actcgtataaggactagactgtatt

SEQ ID NO: 400648 - DNA, 25 bp, Homo sapien
gactgtatttttgacatgctcctat

SEQ ID NO: 400649 - DNA, 25 bp, Homo sapien
gacatgctcctatttttgtaacttg

SEQ ID NO: 400650 - DNA, 25 bp, Homo sapien
ccagcccagtcctggacagtgggtg

SEQ ID NO: 400651 - DNA, 25 bp, Homo sapien
gggacatactcaacgccaggttcat

SEQ ID NO: 400652 - DNA, 25 bp, Homo sapien
actcaacgccaggttcattcgaaac

SEQ ID NO: 400653 - DNA, 25 bp, Homo sapien
attcgaaacctgcaggaacgtcgca

SEQ ID NO: 400654 - DNA, 25 bp, Homo sapien
aggaacgtcgcagcaccaggccttg

SEQ ID NO: 400655 - DNA, 25 bp, Homo sapien
agcaccaggccttggtgaccgcagc

SEQ ID NO: 400656 - DNA, 25 bp, Homo sapien
agccccgtcaaacatcttcaaagta

SEQ ID NO: 400657 - DNA, 25 bp, Homo sapien
cttcaaagtattatttctccctcac

SEQ ID NO: 400658 - DNA, 25 bp, Homo sapien
caaagcccaaccctcataatagatg

SEQ ID NO: 400659 - DNA, 25 bp, Homo sapien
attcattcagcaggcttatcagatt

SEQ ID NO: 400660 - DNA, 25 bp, Homo sapien
ggcttatcagattcaagtcatttgt

SEQ ID NO: 400661 - DNA, 25 bp, Homo sapien
gaagctgagtcagctacgggcaagc

SEQ ID NO: 400662 - DNA, 25 bp, Homo sapien
aagctgagtcagctacgggcaagcg

SEQ ID NO: 400663 - DNA, 25 bp, Homo sapien
gctgagtcagctacgggcaagcggg

SEQ ID NO: 400664 - DNA, 25 bp, Homo sapien
tcagctacgggcaagcgggcagctg

SEQ ID NO: 400665 - DNA, 25 bp, Homo sapien
agctacgggcaagcgggcagctgaa

SEQ ID NO: 400666 - DNA, 25 bp, Homo sapien
atgaggatgacgatgtcgataccaa

SEQ ID NO: 400667 - DNA, 25 bp, Homo sapien
cagaagaccgacgaggatgactaga

SEQ ID NO: 400668 - DNA, 25 bp, Homo sapien
agaagaccgacgaggatgactagac

SEQ ID NO: 400669 - DNA, 25 bp, Homo sapien
gaagaccgacgaggatgactagaca

SEQ ID NO: 400670 - DNA, 25 bp, Homo sapien
aagaccgacgaggatgactagacag

SEQ ID NO: 400671 - DNA, 25 bp, Homo sapien
agaccgacgaggatgactagacagc

SEQ ID NO: 400672 - DNA, 25 bp, Homo sapien
gaaaattctctattgtgtcatccta

SEQ ID NO: 400673 - DNA, 25 bp, Homo sapien
aaattctctattgtgtcatcctaac

SEQ ID NO: 400674 - DNA, 25 bp, Homo sapien
ttctctattgtgtcatcctaacagc

SEQ ID NO: 400675 - DNA, 25 bp, Homo sapien
tattgtgtcatcctaacagctaaca

SEQ ID NO: 400676 - DNA, 25 bp, Homo sapien
gtcatcctaacagctaacacagagt

SEQ ID NO: 400677 - DNA, 25 bp, Homo sapien
aacagctaacacagagttcctcttc

SEQ ID NO: 400678 - DNA, 25 bp, Homo sapien
gctaacacagagttcctcttcgaag

SEQ ID NO: 400679 - DNA, 25 bp, Homo sapien
aacacagagttcctcttcgaagaaa

SEQ ID NO: 400680 - DNA, 25 bp, Homo sapien
cagagttcctcttcgaagaaacttt

SEQ ID NO: 400681 - DNA, 25 bp, Homo sapien
tctgcgcgactgctgtgcaaccatc

SEQ ID NO: 400682 - DNA, 25 bp, Homo sapien
actgctgtgcaaccatccaagtatg

SEQ ID NO: 400683 - DNA, 25 bp, Homo sapien
gcggatgataatctcaagacacctc

SEQ ID NO: 400684 - DNA, 25 bp, Homo sapien
ggatgataatctcaagacacctccc

SEQ ID NO: 400685 - DNA, 25 bp, Homo sapien
tgataatctcaagacacctcccgag

SEQ ID NO: 400686 - DNA, 25 bp, Homo sapien
taatctcaagacacctcccgagtgt

SEQ ID NO: 400687 - DNA, 25 bp, Homo sapien
atctcaagacacctcccgagtgtct

SEQ ID NO: 400688 - DNA, 25 bp, Homo sapien
agctccaccctcagcggatgataat

SEQ ID NO: 400689 - DNA, 25 bp, Homo sapien
gctccaccctcagcggatgataatc

SEQ ID NO: 400690 - DNA, 25 bp, Homo sapien
tcagcggatgataatctcaagacac

SEQ ID NO: 400691 - DNA, 25 bp, Homo sapien
ccttccaccctcagcggatgataat

SEQ ID NO: 400692 - DNA, 25 bp, Homo sapien
accctcagcggatgataatctcaag

SEQ ID NO: 400693 - DNA, 25 bp, Homo sapien
ttccgagcgttagctcactcccctt

SEQ ID NO: 400694 - DNA, 25 bp, Homo sapien
aaacatctttaactatagcctagag

SEQ ID NO: 400695 - DNA, 25 bp, Homo sapien
gttctgaacaacacactgtgataaa

SEQ ID NO: 400696 - DNA, 25 bp, Homo sapien
ggactagagtggaagattccctatt

SEQ ID NO: 400697 - DNA, 25 bp, Homo sapien
ggaagattccctatttaaacacatg

SEQ ID NO: 400698 - DNA, 25 bp, Homo sapien
aaacacatgaagctctgggtcctag

SEQ ID NO: 400699 - DNA, 25 bp, Homo sapien
atgaagctctgggtcctagcctttt

SEQ ID NO: 400700 - DNA, 25 bp, Homo sapien
gctctgggtcctagccttttttggt

SEQ ID NO: 400701 - DNA, 25 bp, Homo sapien
ttttggttataagccctttgagaat

SEQ ID NO: 400702 - DNA, 25 bp, Homo sapien
ggttataagccctttgagaatctga

SEQ ID NO: 400703 - DNA, 25 bp, Homo sapien
aaagctgtggatcatctcctaggaa

SEQ ID NO: 400704 - DNA, 25 bp, Homo sapien
gctgtggatcatctcctaggaaaat

SEQ ID NO: 400705 - DNA, 25 bp, Homo sapien
tgttcccaggatgaggatgttaccc

SEQ ID NO: 400706 - DNA, 25 bp, Homo sapien
gagtagccaaagaatcaacatgaaa

SEQ ID NO: 400707 - DNA, 25 bp, Homo sapien
atattaactacttcctctgaccata

SEQ ID NO: 400708 - DNA, 25 bp, Homo sapien
ctacttcctctgaccatactaaaga

SEQ ID NO: 400709 - DNA, 25 bp, Homo sapien
tacacagtgaccaatgtgcctcaat

SEQ ID NO: 400710 - DNA, 25 bp, Homo sapien
gaccaatgtgcctcaatatcttatt

SEQ ID NO: 400711 - DNA, 25 bp, Homo sapien
gttcaacttgacattttctaggact

SEQ ID NO: 400712 - DNA, 25 bp, Homo sapien
aggactgtacttgatgaaaatgcca

SEQ ID NO: 400713 - DNA, 25 bp, Homo sapien
gaaaatgccaacacactagaccact

SEQ ID NO: 400714 - DNA, 25 bp, Homo sapien
actagaccactctttggattcaaga

SEQ ID NO: 400715 - DNA, 25 bp, Homo sapien
gagcactgtgtatgactgaaatttc

SEQ ID NO: 400716 - DNA, 25 bp, Homo sapien
cgttaccgcagtcgatgacgttctg

SEQ ID NO: 400717 - DNA, 25 bp, Homo sapien
tcgatgacgttctgcacggacagga

SEQ ID NO: 400718 - DNA, 25 bp, Homo sapien
tagatttctgccatcatcttctccc

SEQ ID NO: 400719 - DNA, 25 bp, Homo sapien
ccctccagagggtgtagttccggat

SEQ ID NO: 400720 - DNA, 25 bp, Homo sapien
tgtagttccggatggcgtggcactc

SEQ ID NO: 400721 - DNA, 25 bp, Homo sapien
ggatggcgtggcactctttgaattc

SEQ ID NO: 400722 - DNA, 25 bp, Homo sapien
gaattcattgcatgtcccacattgg

SEQ ID NO: 400723 - DNA, 25 bp, Homo sapien
tggttaaacttgtcacactcctggt

SEQ ID NO: 400724 - DNA, 25 bp, Homo sapien
ggtccttggcctggtagttgttgca

SEQ ID NO: 400725 - DNA, 25 bp, Homo sapien
ctggtagttgttgcaggtctcgtca

SEQ ID NO: 400726 - DNA, 25 bp, Homo sapien
tagtcccacacggacaggtcattac

SEQ ID NO: 400727 - DNA, 25 bp, Homo sapien
gaaacatgatagaccagatgccaaa

SEQ ID NO: 400728 - DNA, 25 bp, Homo sapien
tgatagaccagatgccaaaggctaa

SEQ ID NO: 400729 - DNA, 25 bp, Homo sapien
gatgccaaaggctaaaatgtacata

SEQ ID NO: 400730 - DNA, 25 bp, Homo sapien
agtcactgtttaattccatgcctag

SEQ ID NO: 400731 - DNA, 25 bp, Homo sapien
ttccatgcctagtattcttatgaat

SEQ ID NO: 400732 - DNA, 25 bp, Homo sapien
gaatgtttgtggtttcatagattta

SEQ ID NO: 400733 - DNA, 25 bp, Homo sapien
catagatttatgcactttgaatatc

SEQ ID NO: 400734 - DNA, 25 bp, Homo sapien
actttgaatatctgtcacgtgcagt

SEQ ID NO: 400735 - DNA, 25 bp, Homo sapien
gaatatctgtcacgtgcagtgttaa

SEQ ID NO: 400736 - DNA, 25 bp, Homo sapien
gtcacgtgcagtgttaatgttacct

SEQ ID NO: 400737 - DNA, 25 bp, Homo sapien
gtgttaatgttacctgttcttgtct

SEQ ID NO: 400738 - DNA, 25 bp, Homo sapien
ttggcaccacctgcagtgttagaga

SEQ ID NO: 400739 - DNA, 25 bp, Homo sapien
tggcaccacctgcagtgttagagag

SEQ ID NO: 400740 - DNA, 25 bp, Homo sapien
ggcaccacctgcagtgttagagaga

SEQ ID NO: 400741 - DNA, 25 bp, Homo sapien
gcaccacctgcagtgttagagagac

SEQ ID NO: 400742 - DNA, 25 bp, Homo sapien
caccacctgcagtgttagagagact

SEQ ID NO: 400743 - DNA, 25 bp, Homo sapien
accacctgcagtgttagagagactg

SEQ ID NO: 400744 - DNA, 25 bp, Homo sapien
ccacctgcagtgttagagagactgc

SEQ ID NO: 400745 - DNA, 25 bp, Homo sapien
cagtgttagagagactgcggctgat

SEQ ID NO: 400746 - DNA, 25 bp, Homo sapien
ccaggaatccattcctgtgtccact

SEQ ID NO: 400747 - DNA, 25 bp, Homo sapien
tcgctccggatagggatgagtgatt

SEQ ID NO: 400748 - DNA, 25 bp, Homo sapien
ccggatagggatgagtgattggact

SEQ ID NO: 400749 - DNA, 25 bp, Homo sapien
acaaatacagtatccaaacattgga

SEQ ID NO: 400750 - DNA, 25 bp, Homo sapien
aacattggagattagtgactcacct

SEQ ID NO: 400751 - DNA, 25 bp, Homo sapien
gtgactcacctgcagttgggagcca

SEQ ID NO: 400752 - DNA, 25 bp, Homo sapien
acctgcagttgggagccagctacaa

SEQ ID NO: 400753 - DNA, 25 bp, Homo sapien
agccagctacaacccaaatcatttt

SEQ ID NO: 400754 - DNA, 25 bp, Homo sapien
aattctttgatctcatgcaatgcac

SEQ ID NO: 400755 - DNA, 25 bp, Homo sapien
gcaatgcacactttcttctgaatta

SEQ ID NO: 400756 - DNA, 25 bp, Homo sapien
gcacactttcttctgaattagcaaa

SEQ ID NO: 400757 - DNA, 25 bp, Homo sapien
ctttcttctgaattagcaaactgaa

SEQ ID NO: 400758 - DNA, 25 bp, Homo sapien
aggctgagacacacgaatcccttgg

SEQ ID NO: 400759 - DNA, 25 bp, Homo sapien
tgagacacacgaatcccttgggccc

SEQ ID NO: 400760 - DNA, 25 bp, Homo sapien
gttctgtcatctagttaatagtaat

SEQ ID NO: 400761 - DNA, 25 bp, Homo sapien
acagttagttatatgaggtgtcaca

SEQ ID NO: 400762 - DNA, 25 bp, Homo sapien
tgaggtgtcacatttggaggaagct

SEQ ID NO: 400763 - DNA, 25 bp, Homo sapien
ggaagctgtgtgaaggctacattga

SEQ ID NO: 400764 - DNA, 25 bp, Homo sapien
gaaggctacattgaattctgtacta

SEQ ID NO: 400765 - DNA, 25 bp, Homo sapien
ttttgtaacttcctgcaggtttcta

SEQ ID NO: 400766 - DNA, 25 bp, Homo sapien
acttcctgcaggtttctattccaaa

SEQ ID NO: 400767 - DNA, 25 bp, Homo sapien
ctgcaggtttctattccaaattaaa

SEQ ID NO: 400768 - DNA, 25 bp, Homo sapien
gttaatgggcataaagcttcacact

SEQ ID NO: 400769 - DNA, 25 bp, Homo sapien
gggcataaagcttcacactagtaac

SEQ ID NO: 400770 - DNA, 25 bp, Homo sapien
cataactgttttaactctaatttct

SEQ ID NO: 400771 - DNA, 25 bp, Homo sapien
ttgtatttcgtgttgcactcgttct

SEQ ID NO: 400772 - DNA, 25 bp, Homo sapien
gcactcgttctgtttcatattggac

SEQ ID NO: 400773 - DNA, 25 bp, Homo sapien
gacacatttgaattctctttagcat

SEQ ID NO: 400774 - DNA, 25 bp, Homo sapien
tctttagcataaagctgtgcattgg

SEQ ID NO: 400775 - DNA, 25 bp, Homo sapien
gctgtgcattggaaactatgtgact

SEQ ID NO: 400776 - DNA, 25 bp, Homo sapien
ctatgtgactgtatccatacggtta

SEQ ID NO: 400777 - DNA, 25 bp, Homo sapien
ccatacggttagcaaaatactcttt

SEQ ID NO: 400778 - DNA, 25 bp, Homo sapien
atactctttgccaccaaaggtaaat

SEQ ID NO: 400779 - DNA, 25 bp, Homo sapien
gaaactgtaaaatacctctggatat

SEQ ID NO: 400780 - DNA, 25 bp, Homo sapien
tgaacttttcttagcatattaggat

SEQ ID NO: 400781 - DNA, 25 bp, Homo sapien
gtatgtttcatctaggacttacaat

SEQ ID NO: 400782 - DNA, 25 bp, Homo sapien
gttgatagtttcactcccaagcaat

SEQ ID NO: 400783 - DNA, 25 bp, Homo sapien
gtttcactcccaagcaatgaattgc

SEQ ID NO: 400784 - DNA, 25 bp, Homo sapien
attgcttctgtgtgtttccctgtag

SEQ ID NO: 400785 - DNA, 25 bp, Homo sapien
tgcttctgtgtgtttccctgtagga

SEQ ID NO: 400786 - DNA, 25 bp, Homo sapien
gtttccctgtaggactcaatagtaa

SEQ ID NO: 400787 - DNA, 25 bp, Homo sapien
actcaatagtaaatgctgtctgtct

SEQ ID NO: 400788 - DNA, 25 bp, Homo sapien
tataaggaccctgcaagacgacgac

SEQ ID NO: 400789 - DNA, 25 bp, Homo sapien
gcctttggcctgtgctactaaacaa

SEQ ID NO: 400790 - DNA, 25 bp, Homo sapien
gcctgtgctactaaacaagaagcct

SEQ ID NO: 400791 - DNA, 25 bp, Homo sapien
gaagcctatgaaaaatttcttcttt

SEQ ID NO: 400792 - DNA, 25 bp, Homo sapien
ctttccagtaagttcacatttggat

SEQ ID NO: 400793 - DNA, 25 bp, Homo sapien
aaatagtttctcttcagctgtaaat

SEQ ID NO: 400794 - DNA, 25 bp, Homo sapien
aacaggatacagaattaacaagaga

SEQ ID NO: 400795 - DNA, 25 bp, Homo sapien
aacaggatattgacataatagcaca

SEQ ID NO: 400796 - DNA, 25 bp, Homo sapien
aatagcacaaaatgacactcttcta

SEQ ID NO: 400797 - DNA, 25 bp, Homo sapien
gcacaaaatgacactcttctaaaac

SEQ ID NO: 400798 - DNA, 25 bp, Homo sapien
actcttctaaaactaaatgggcaca

SEQ ID NO: 400799 - DNA, 25 bp, Homo sapien
tcctgggaaagttcacatcaaaaag

SEQ ID NO: 400800 - DNA, 25 bp, Homo sapien
tgggaaagttcacatcaaaaagagt

SEQ ID NO: 400801 - DNA, 25 bp, Homo sapien
agagtgaatgtggtatatttctaaa

SEQ ID NO: 400802 - DNA, 25 bp, Homo sapien
atagagacagatttgtcctttacag

SEQ ID NO: 400803 - DNA, 25 bp, Homo sapien
agagacagatttgtcctttacagaa

SEQ ID NO: 400804 - DNA, 25 bp, Homo sapien
gaggtgctgacggactcacctttgg

SEQ ID NO: 400805 - DNA, 25 bp, Homo sapien
tgctgacggactcacctttggcaaa

SEQ ID NO: 400806 - DNA, 25 bp, Homo sapien
ctgacggactcacctttggcaaagg

SEQ ID NO: 400807 - DNA, 25 bp, Homo sapien
gacggactcacctttggcaaaggga

SEQ ID NO: 400808 - DNA, 25 bp, Homo sapien
acctttggcaaagggactcatctaa

SEQ ID NO: 400809 - DNA, 25 bp, Homo sapien
tttggcaaagggactcatctaatca

SEQ ID NO: 400810 - DNA, 25 bp, Homo sapien
tggcaaagggactcatctaatcatc

SEQ ID NO: 400811 - DNA, 25 bp, Homo sapien
aagggactcatctaatcatccagcc

SEQ ID NO: 400812 - DNA, 25 bp, Homo sapien
ggactcatctaatcatccagcccta

SEQ ID NO: 400813 - DNA, 25 bp, Homo sapien
tcatctaatcatccagccctatatc

SEQ ID NO: 400814 - DNA, 25 bp, Homo sapien
atctaatcatccagccctatatcca

SEQ ID NO: 400815 - DNA, 25 bp, Homo sapien
aagagcctgtgggagttctctcggg

SEQ ID NO: 400816 - DNA, 25 bp, Homo sapien
ttctctcgggagttagtgaagcaga

SEQ ID NO: 400817 - DNA, 25 bp, Homo sapien
gtgaagcagagaaccctcgagaagc

SEQ ID NO: 400818 - DNA, 25 bp, Homo sapien
agagaaccctcgagaagcccatctc

SEQ ID NO: 400819 - DNA, 25 bp, Homo sapien
atctccaggaccaggtgcaggacga

SEQ ID NO: 400820 - DNA, 25 bp, Homo sapien
tgcaggacgaccagcggcttagagc

SEQ ID NO: 400821 - DNA, 25 bp, Homo sapien
ccagcggcttagagctgaggctgca

SEQ ID NO: 400822 - DNA, 25 bp, Homo sapien
gcacgtagtggtgcgtgagcccaac

SEQ ID NO: 400823 - DNA, 25 bp, Homo sapien
agtggtgcgtgagcccaacaggaaa

SEQ ID NO: 400824 - DNA, 25 bp, Homo sapien
caggaaaggcatacttccccgaatc

SEQ ID NO: 400825 - DNA, 25 bp, Homo sapien
aagcttgcaccagcaggaagagcct

SEQ ID NO: 400826 - DNA, 25 bp, Homo sapien
ggacaaagatacctcaacaggagaa

SEQ ID NO: 400827 - DNA, 25 bp, Homo sapien
gggacagggcattctctccagcagg

SEQ ID NO: 400828 - DNA, 25 bp, Homo sapien
agggcattctctccagcaggtgact

SEQ ID NO: 400829 - DNA, 25 bp, Homo sapien
acgcccgcagctacttctagagtca

SEQ ID NO: 400830 - DNA, 25 bp, Homo sapien
ccgatcgatgggttcaatggaaggt

SEQ ID NO: 400831 - DNA, 25 bp, Homo sapien
gcagctacttctagagtcacgtggt

SEQ ID NO: 400832 - DNA, 25 bp, Homo sapien
tacttctagagtcacgtggttccgc

SEQ ID NO: 400833 - DNA, 25 bp, Homo sapien
tagagtcacgtggttccgccccttt

SEQ ID NO: 400834 - DNA, 25 bp, Homo sapien
gccccttttgcggaaaactgatcag

SEQ ID NO: 400835 - DNA, 25 bp, Homo sapien
cttttgcggaaaactgatcaggatc

SEQ ID NO: 400836 - DNA, 25 bp, Homo sapien
gatcaggatcatggcggtacaggaa

SEQ ID NO: 400837 - DNA, 25 bp, Homo sapien
atggctgcactgtgggacatacacc

SEQ ID NO: 400838 - DNA, 25 bp, Homo sapien
tgcactgtgggacatacaccagcta

SEQ ID NO: 400839 - DNA, 25 bp, Homo sapien
gggacatacaccagctacaaggaag

SEQ ID NO: 400840 - DNA, 25 bp, Homo sapien
ccagctacaaggaaggtgaaaggat

SEQ ID NO: 400841 - DNA, 25 bp, Homo sapien
tgttgccagtgcctggtagccataa

SEQ ID NO: 400842 - DNA, 25 bp, Homo sapien
ctggtagccataaggcctgctgatc

SEQ ID NO: 400843 - DNA, 25 bp, Homo sapien
acctgtgtgtggcatgttgagtttc

SEQ ID NO: 400844 - DNA, 25 bp, Homo sapien
gcatgttgagtttcagtggaagtca

SEQ ID NO: 400845 - DNA, 25 bp, Homo sapien
gagtttcagtggaagtcatatactt

SEQ ID NO: 400846 - DNA, 25 bp, Homo sapien
aagtcatatacttctgggcttcata

SEQ ID NO: 400847 - DNA, 25 bp, Homo sapien
gggcttcatagtttatggctgcact

SEQ ID NO: 400848 - DNA, 25 bp, Homo sapien
agagaaaccccgagacactgtacac

SEQ ID NO: 400849 - DNA, 25 bp, Homo sapien
accccgatccctaggtgaggagaag

SEQ ID NO: 400850 - DNA, 25 bp, Homo sapien
gaagcagggctccattcattcaaca

SEQ ID NO: 400851 - DNA, 25 bp, Homo sapien
attcaacacacatgaccacccgtgt

SEQ ID NO: 400852 - DNA, 25 bp, Homo sapien
atgaccacccgtgtgatcttgaaca

SEQ ID NO: 400853 - DNA, 25 bp, Homo sapien
aacaagaggcccaatctcacttcgc

SEQ ID NO: 400854 - DNA, 25 bp, Homo sapien
atctcacttcgccttggtttcctta

SEQ ID NO: 400855 - DNA, 25 bp, Homo sapien
gtaaaatgagaccatcttattgctg

SEQ ID NO: 400856 - DNA, 25 bp, Homo sapien
attgctgacttcaaagggctgttgt

SEQ ID NO: 400857 - DNA, 25 bp, Homo sapien
aaagcgctgatccaagttgctctgt

SEQ ID NO: 400858 - DNA, 25 bp, Homo sapien
caagttgctctgtaggaatttctgt

SEQ ID NO: 400859 - DNA, 25 bp, Homo sapien
gcagagataagctatagggttaata

SEQ ID NO: 400860 - DNA, 25 bp, Homo sapien
gagtgaatgatctaatcacattttc

SEQ ID NO: 400861 - DNA, 25 bp, Homo sapien
ttttcattttaatactgtcattctg

SEQ ID NO: 400862 - DNA, 25 bp, Homo sapien
ttctgaaaacatcctatgcgatgga

SEQ ID NO: 400863 - DNA, 25 bp, Homo sapien
aacatcctatgcgatggaatggaga

SEQ ID NO: 400864 - DNA, 25 bp, Homo sapien
aaggaagtgatgactcagagtgtga

SEQ ID NO: 400865 - DNA, 25 bp, Homo sapien
gtgaagagttcttagtatttgttat

SEQ ID NO: 400866 - DNA, 25 bp, Homo sapien
ctgactctgagaagggattgcagac

SEQ ID NO: 400867 - DNA, 25 bp, Homo sapien
aagggattgcagacacagagaatgg

SEQ ID NO: 400868 - DNA, 25 bp, Homo sapien
gaatgggtaaatgttcagaattgtt

SEQ ID NO: 400869 - DNA, 25 bp, Homo sapien
cagaattgttggcttacagtgtgta

SEQ ID NO: 400870 - DNA, 25 bp, Homo sapien
atgggtagggcagttgaattttttg

SEQ ID NO: 400871 - DNA, 25 bp, Homo sapien
tggtggtttcgtaccatttgggtga

SEQ ID NO: 400872 - DNA, 25 bp, Homo sapien
gtaccatttgggtgattgaagcatg

SEQ ID NO: 400873 - DNA, 25 bp, Homo sapien
gggtgtgacagagcatcatgtttgt

SEQ ID NO: 400874 - DNA, 25 bp, Homo sapien
catcatgtttgttattctgccttaa

SEQ ID NO: 400875 - DNA, 25 bp, Homo sapien
ttctgccttaaatttctacttactg

SEQ ID NO: 400876 - DNA, 25 bp, Homo sapien
gccttaaatttctacttactgtctt

SEQ ID NO: 400877 - DNA, 25 bp, Homo sapien
caaactatatttgtacttgggctta

SEQ ID NO: 400878 - DNA, 25 bp, Homo sapien
atatttgtacttgggcttagataga

SEQ ID NO: 400879 - DNA, 25 bp, Homo sapien
gggcttagatagaaagtcttacaca

SEQ ID NO: 400880 - DNA, 25 bp, Homo sapien
gtcttacacaagcatagtatcttct

SEQ ID NO: 400881 - DNA, 25 bp, Homo sapien
gtctttacttaacctgccctaatat

SEQ ID NO: 400882 - DNA, 25 bp, Homo sapien
tatttttcggcctgatgggaattag

SEQ ID NO: 400883 - DNA, 25 bp, Homo sapien
tttcggcctgatgggaattagtgca

SEQ ID NO: 400884 - DNA, 25 bp, Homo sapien
tgatgggaattagtgcagagaagcc

SEQ ID NO: 400885 - DNA, 25 bp, Homo sapien
gtcaccatagaaggcaactcctact

SEQ ID NO: 400886 - DNA, 25 bp, Homo sapien
gaaggcaactcctacttgtgtgtgg

SEQ ID NO: 400887 - DNA, 25 bp, Homo sapien
gcaactcctacttgtgtgtggactg

SEQ ID NO: 400888 - DNA, 25 bp, Homo sapien
tcctacttgtgtgtggactgagcaa

SEQ ID NO: 400889 - DNA, 25 bp, Homo sapien
acttgtgtgtggactgagcaatcag

SEQ ID NO: 400890 - DNA, 25 bp, Homo sapien
tgtgtggactgagcaatcagagtct

SEQ ID NO: 400891 - DNA, 25 bp, Homo sapien
gataatattgctgaaaatgcactgc

SEQ ID NO: 400892 - DNA, 25 bp, Homo sapien
aggagggagccaattccacgctgcg

SEQ ID NO: 400893 - DNA, 25 bp, Homo sapien
caattccacgctgcggtgcaatttt

SEQ ID NO: 400894 - DNA, 25 bp, Homo sapien
cggtgcaatttttctgactctgtga

SEQ ID NO: 400895 - DNA, 25 bp, Homo sapien
gactctgtgaacaatttgcagtggt

SEQ ID NO: 400896 - DNA, 25 bp, Homo sapien
gcagtggtttcatcaaaacccttgg

SEQ ID NO: 400897 - DNA, 25 bp, Homo sapien
ggacagctcatcaacctgttttaca

SEQ ID NO: 400898 - DNA, 25 bp, Homo sapien
catcaacctgttttacattccctca

SEQ ID NO: 400899 - DNA, 25 bp, Homo sapien
aagattaagcgccacgactgtcgct

SEQ ID NO: 400900 - DNA, 25 bp, Homo sapien
tgtcgctacggaacgctacagctta

SEQ ID NO: 400901 - DNA, 25 bp, Homo sapien
gggctcttgagtgcccaggtttgct

SEQ ID NO: 400902 - DNA, 25 bp, Homo sapien
agcagagtcctccagacctgattct

SEQ ID NO: 400903 - DNA, 25 bp, Homo sapien
tagatctatctatatgcacatacat

SEQ ID NO: 400904 - DNA, 25 bp, Homo sapien
atatatacacacacccagccgatct

SEQ ID NO: 400905 - DNA, 25 bp, Homo sapien
gctcccagactgctctcgtatgtgg

SEQ ID NO: 400906 - DNA, 25 bp, Homo sapien
gggaatgggatgaatccccatctgt
